United States Patent 7,901,882 (ANALYSIS OF METHYLATION USING NUCLEIC ACID ARRAYS) - sequence listing, part 12

SEQ ID NO: 434131 - DNA, 25 bp, Mus musculus
ggtctactgcggaaaactctctctc

SEQ ID NO: 434132 - DNA, 25 bp, Mus musculus
cgaaagcacgctctgtccctgcagg

SEQ ID NO: 434133 - DNA, 25 bp, Mus musculus
tccctgcaggggaagtgacttcagc

SEQ ID NO: 434134 - DNA, 25 bp, Mus musculus
ggtacagctgatccgcgcacaaaga

SEQ ID NO: 434135 - DNA, 25 bp, Mus musculus
ggattagatgccagagcccacggta

SEQ ID NO: 434136 - DNA, 25 bp, Mus musculus
gtattaaatgtcacataaaggcgtg

SEQ ID NO: 434137 - DNA, 25 bp, Mus musculus
actgtattaaatgtcacataaaggc

SEQ ID NO: 434138 - DNA, 25 bp, Mus musculus
actgcccagcgtgaagaactgtatt

SEQ ID NO: 434139 - DNA, 25 bp, Mus musculus
ccactgcccagcgtgaagaactgta

SEQ ID NO: 434140 - DNA, 25 bp, Mus musculus
gaactgtattaaatgtcacataaag

SEQ ID NO: 434141 - DNA, 25 bp, Mus musculus
ctgcccagcgtgaagaactgtatta

SEQ ID NO: 434142 - DNA, 25 bp, Mus musculus
ctgtattaaatgtcacataaaggcg

SEQ ID NO: 434143 - DNA, 25 bp, Mus musculus
accgcccagcgtgaagaactgtatt

SEQ ID NO: 434144 - DNA, 25 bp, Mus musculus
caccaccgcccagcgtgaagaactg

SEQ ID NO: 434145 - DNA, 25 bp, Mus musculus
ttaaagggtgacataaaggcgtgca

SEQ ID NO: 434146 - DNA, 25 bp, Mus musculus
ccgcccagcgtgaagaactgtatta

SEQ ID NO: 434147 - DNA, 25 bp, Mus musculus
ccaccgcccagcgtgaagaactgta

SEQ ID NO: 434148 - DNA, 25 bp, Mus musculus
caccgcccagcgtgaagaactgtat

SEQ ID NO: 434149 - DNA, 25 bp, Mus musculus
ctgtattaaagggtgacataaaggc

SEQ ID NO: 434150 - DNA, 25 bp, Mus musculus
tcctcgctaaaagggacttctgtga

SEQ ID NO: 434151 - DNA, 25 bp, Mus musculus
gccgcactgcggttttgcaccgaga

SEQ ID NO: 434152 - DNA, 25 bp, Mus musculus
gtgccacgaaagctaatcaaacctc

SEQ ID NO: 434153 - DNA, 25 bp, Mus musculus
ccgctgcaggtaacaatgctgccta

SEQ ID NO: 434154 - DNA, 25 bp, Mus musculus
tggggcttcttctgtgcctatccga

SEQ ID NO: 434155 - DNA, 25 bp, Mus musculus
gttcacggaacagtggccgccagcc

SEQ ID NO: 434156 - DNA, 25 bp, Mus musculus
cagtctcggaccatctcagaggcca

SEQ ID NO: 434157 - DNA, 25 bp, Mus musculus
acgccacttcggaggtgaacttcca

SEQ ID NO: 434158 - DNA, 25 bp, Mus musculus
acttccagggaggtgtgcagtcatt

SEQ ID NO: 434159 - DNA, 25 bp, Mus musculus
cacatcactatagcaggagcgagtc

SEQ ID NO: 434160 - DNA, 25 bp, Mus musculus
tgcgcgacccgcataagtgccacga

SEQ ID NO: 434161 - DNA, 25 bp, Mus musculus
tacaccgagctcagggtccgatgcc

SEQ ID NO: 434162 - DNA, 25 bp, Mus musculus
gaatccggaacagagctcgcgcttc

SEQ ID NO: 434163 - DNA, 25 bp, Mus musculus
ctctctatggagctcgtggttcacg

SEQ ID NO: 434164 - DNA, 25 bp, Mus musculus
ttaggtttctcgctagctctccgcg

SEQ ID NO: 434165 - DNA, 25 bp, Mus musculus
ttgcagcgtagaggaacagtccata

SEQ ID NO: 434166 - DNA, 25 bp, Mus musculus
atcaccgcactcttaccagtctgtg

SEQ ID NO: 434167 - DNA, 25 bp, Mus musculus
agtttgtcaaccaccggagagaaga

SEQ ID NO: 434168 - DNA, 25 bp, Mus musculus
tcaccaccgcggagccgaaagtttg

SEQ ID NO: 434169 - DNA, 25 bp, Mus musculus
cacacgcgtactccgtgtctggagg

SEQ ID NO: 434170 - DNA, 25 bp, Mus musculus
ccatagtttgcgaagtgcagccctc

SEQ ID NO: 434171 - DNA, 25 bp, Mus musculus
gcggccctgtgaactacatccggga

SEQ ID NO: 434172 - DNA, 25 bp, Mus musculus
ggacagcctctctctagaagccaag

SEQ ID NO: 434173 - DNA, 25 bp, Mus musculus
acagctgtcacaggctccgggcaac

SEQ ID NO: 434174 - DNA, 25 bp, Mus musculus
agccctcgggaatcacgtcggccag

SEQ ID NO: 434175 - DNA, 25 bp, Mus musculus
acatccatctgtcgggaagcacgcc

SEQ ID NO: 434176 - DNA, 25 bp, Mus musculus
tgtgcaccaagaccggcaaccgtga

SEQ ID NO: 434177 - DNA, 25 bp, Mus musculus
ctcacctgtctgtcagcggggaagc

SEQ ID NO: 434178 - DNA, 25 bp, Mus musculus
gactcgtagctgctcagccgggaga

SEQ ID NO: 434179 - DNA, 25 bp, Mus musculus
cctcggcgggactccaggagttctc

SEQ ID NO: 434180 - DNA, 25 bp, Mus musculus
gggcttctctttgggcctgccgccg

SEQ ID NO: 434181 - DNA, 25 bp, Mus musculus
atcccatagcggagtgtatgaaccc

SEQ ID NO: 434182 - DNA, 25 bp, Mus musculus
ctttctgcctcgtcccggactgtgg

SEQ ID NO: 434183 - DNA, 25 bp, Mus musculus
ggctgctgcacacgccgaagccgga

SEQ ID NO: 434184 - DNA, 25 bp, Mus musculus
agagacccggcatccgtgcactggc

SEQ ID NO: 434185 - DNA, 25 bp, Mus musculus
gcatccgagagacccggcatccgtg

SEQ ID NO: 434186 - DNA, 25 bp, Mus musculus
cagaagctgagcttcgggcgctgcc

SEQ ID NO: 434187 - DNA, 25 bp, Mus musculus
ttacgtcatcgctgggcgccactct

SEQ ID NO: 434188 - DNA, 25 bp, Mus musculus
cggttgctaggcgacttacgtcatc

SEQ ID NO: 434189 - DNA, 25 bp, Mus musculus
gtgcgtcatcagaacgcgccgcagc

SEQ ID NO: 434190 - DNA, 25 bp, Mus musculus
cctcttcccttggtgcgtcatcaga

SEQ ID NO: 434191 - DNA, 25 bp, Mus musculus
gggccgtagcatcccatagcggagt

SEQ ID NO: 434192 - DNA, 25 bp, Mus musculus
aagtgacgtcacagcacggcaccgc

SEQ ID NO: 434193 - DNA, 25 bp, Mus musculus
gcaggattctcgtagctccggcgct

SEQ ID NO: 434194 - DNA, 25 bp, Mus musculus
tagctccggcgctggcctctgacat

SEQ ID NO: 434195 - DNA, 25 bp, Mus musculus
tggcctctgacatctgccacctgag

SEQ ID NO: 434196 - DNA, 25 bp, Mus musculus
tgtcgccttcttcgggggcgcctga

SEQ ID NO: 434197 - DNA, 25 bp, Mus musculus
gcgcctgacctcgtacccaggagga

SEQ ID NO: 434198 - DNA, 25 bp, Mus musculus
gacctcgtacccaggaggatgctcc

SEQ ID NO: 434199 - DNA, 25 bp, Mus musculus
atgctcccgcgctacctggggagga

SEQ ID NO: 434200 - DNA, 25 bp, Mus musculus
gaaggaaggcggctcctgttggact

SEQ ID NO: 434201 - DNA, 25 bp, Mus musculus
tgcccgggcactcggactcctcacg

SEQ ID NO: 434202 - DNA, 25 bp, Mus musculus
ggactcctcacgtgaccctccgccc

SEQ ID NO: 434203 - DNA, 25 bp, Mus musculus
agcagccgctcggtgcctgggcaca

SEQ ID NO: 434204 - DNA, 25 bp, Mus musculus
cagccaggttcccgcgaaccgaggg

SEQ ID NO: 434205 - DNA, 25 bp, Mus musculus
tgggcacagccacccagccaggttc

SEQ ID NO: 434206 - DNA, 25 bp, Mus musculus
gatttcccacttccagaaggtttga

SEQ ID NO: 434207 - DNA, 25 bp, Mus musculus
tcgggagactcgaattgcgcgacta

SEQ ID NO: 434208 - DNA, 25 bp, Mus musculus
gggcacaacttttctccagcacgtc

SEQ ID NO: 434209 - DNA, 25 bp, Mus musculus
ccagctagagaaggtcggggcacaa

SEQ ID NO: 434210 - DNA, 25 bp, Mus musculus
ccctggcttcaactcagtctgagga

SEQ ID NO: 434211 - DNA, 25 bp, Mus musculus
agcgcacagggcacaacagaggact

SEQ ID NO: 434212 - DNA, 25 bp, Mus musculus
tcagaaagtttgtgcgacggtcccg

SEQ ID NO: 434213 - DNA, 25 bp, Mus musculus
ggggcctctgcgagaaagtttccac

SEQ ID NO: 434214 - DNA, 25 bp, Mus musculus
caccgaaacttgaactggagcgttg

SEQ ID NO: 434215 - DNA, 25 bp, Mus musculus
gggctcgcctctctggcgaacttca

SEQ ID NO: 434216 - DNA, 25 bp, Mus musculus
acgcgcggacgtcttagatttccca

SEQ ID NO: 434217 - DNA, 25 bp, Mus musculus
agcgcgcaccggtttcctaggtgaa

SEQ ID NO: 434218 - DNA, 25 bp, Mus musculus
gcggatcctcctgctacgcagtgtc

SEQ ID NO: 434219 - DNA, 25 bp, Mus musculus
cggctggtttctagggttttctgag

SEQ ID NO: 434220 - DNA, 25 bp, Mus musculus
cgccgagcgcgctggcgagggccat

SEQ ID NO: 434221 - DNA, 25 bp, Mus musculus
cgctgcaggtggagccctccttccc

SEQ ID NO: 434222 - DNA, 25 bp, Mus musculus
tgcgtgcccagaaggcggggagctc

SEQ ID NO: 434223 - DNA, 25 bp, Mus musculus
gccgccggtgcgtgcccagaaggcg

SEQ ID NO: 434224 - DNA, 25 bp, Mus musculus
aaccggacgggaagcgagctgccga

SEQ ID NO: 434225 - DNA, 25 bp, Mus musculus
cgatcccaggctggacctctgtggg

SEQ ID NO: 434226 - DNA, 25 bp, Mus musculus
ggagcccgcccgatcccaggctgga

SEQ ID NO: 434227 - DNA, 25 bp, Mus musculus
ccactcggctgcaggtgagacgcgg

SEQ ID NO: 434228 - DNA, 25 bp, Mus musculus
tggcgagggccatccgctgcccgca

SEQ ID NO: 434229 - DNA, 25 bp, Mus musculus
agctcgcccgccgtccctgggctgc

SEQ ID NO: 434230 - DNA, 25 bp, Mus musculus
aagagctgcgagagcgccgcgagct

SEQ ID NO: 434231 - DNA, 25 bp, Mus musculus
gcgctcccgggccactcggctgcag

SEQ ID NO: 434232 - DNA, 25 bp, Mus musculus
gagcatctaggaccgggttctccgc

SEQ ID NO: 434233 - DNA, 25 bp, Mus musculus
ccgatcccaggctggacctctgtgg

SEQ ID NO: 434234 - DNA, 25 bp, Mus musculus
gccgtctacgtgacccttgctcttt

SEQ ID NO: 434235 - DNA, 25 bp, Mus musculus
cggctttaagaatctcgcgacacta

SEQ ID NO: 434236 - DNA, 25 bp, Mus musculus
cggaagtacaactcgcgcgagaact

SEQ ID NO: 434237 - DNA, 25 bp, Mus musculus
cgtgctgcgacagcgccctcgtgtg

SEQ ID NO: 434238 - DNA, 25 bp, Mus musculus
cacgcgagcgactgctagagacgca

SEQ ID NO: 434239 - DNA, 25 bp, Mus musculus
atctcgcgacactagctggcggctc

SEQ ID NO: 434240 - DNA, 25 bp, Mus musculus
tgctctttcgcccttccggctttaa

SEQ ID NO: 434241 - DNA, 25 bp, Mus musculus
cgcgagaacttaacgcgagccgggc

SEQ ID NO: 434242 - DNA, 25 bp, Mus musculus
ccatggtgccgaccggagagccaaa

SEQ ID NO: 434243 - DNA, 25 bp, Mus musculus
ttgttcttgccgaccgccatggtgc

SEQ ID NO: 434244 - DNA, 25 bp, Mus musculus
ttcgtcaggcgcttgttcttgccga

SEQ ID NO: 434245 - DNA, 25 bp, Mus musculus
cttgccacctttcgtcaggcgcttg

SEQ ID NO: 434246 - DNA, 25 bp, Mus musculus
cactttcttcttagctcccttcttg

SEQ ID NO: 434247 - DNA, 25 bp, Mus musculus
tggcggctcgtttcccgccgtgctg

SEQ ID NO: 434248 - DNA, 25 bp, Mus musculus
ccgagcgctgaggagaatcaccgcc

SEQ ID NO: 434249 - DNA, 25 bp, Mus musculus
gcgctcagagacctgctgttgcaca

SEQ ID NO: 434250 - DNA, 25 bp, Mus musculus
ctgcgaccaggtgccttgacctttc

SEQ ID NO: 434251 - DNA, 25 bp, Mus musculus
caaagcacagtctgggcgaagagtg

SEQ ID NO: 434252 - DNA, 25 bp, Mus musculus
tctacctgagcagcgcgctctcgag

SEQ ID NO: 434253 - DNA, 25 bp, Mus musculus
gcgaggagcagcttcagtaggcata

SEQ ID NO: 434254 - DNA, 25 bp, Mus musculus
cttcagtaggcataggggtagtccc

SEQ ID NO: 434255 - DNA, 25 bp, Mus musculus
ttctgtggcagtagcatcctcggcc

SEQ ID NO: 434256 - DNA, 25 bp, Mus musculus
cccgcctgcagtagctgcgtttgca

SEQ ID NO: 434257 - DNA, 25 bp, Mus musculus
caggtgtccttctccaagtccaaca

SEQ ID NO: 434258 - DNA, 25 bp, Mus musculus
cggactagggaaacttgaaggctgc

SEQ ID NO: 434259 - DNA, 25 bp, Mus musculus
cgaggacaccttgacaacgtggggc

SEQ ID NO: 434260 - DNA, 25 bp, Mus musculus
aagcacggagttctaggcagccgcc

SEQ ID NO: 434261 - DNA, 25 bp, Mus musculus
ccgttcgtcgccaaagcacagtctg

SEQ ID NO: 434262 - DNA, 25 bp, Mus musculus
gatgcgcaacttgacctcactagtg

SEQ ID NO: 434263 - DNA, 25 bp, Mus musculus
tagcgggcgtcaatctcactcagag

SEQ ID NO: 434264 - DNA, 25 bp, Mus musculus
agatcccggtgcacttgaacgctgg

SEQ ID NO: 434265 - DNA, 25 bp, Mus musculus
gggtgtttctcgcactcgtacagca

SEQ ID NO: 434266 - DNA, 25 bp, Mus musculus
gacactaccttgcagacttctcgga

SEQ ID NO: 434267 - DNA, 25 bp, Mus musculus
tcccatctggttgaggtagagtacc

SEQ ID NO: 434268 - DNA, 25 bp, Mus musculus
cgcttccgcccatcgcttagtttga

SEQ ID NO: 434269 - DNA, 25 bp, Mus musculus
cgctgtgatgaactcgacccaaaga

SEQ ID NO: 434270 - DNA, 25 bp, Mus musculus
cgcctgggctactagtgtctggaaa

SEQ ID NO: 434271 - DNA, 25 bp, Mus musculus
cgatcatcttgaccacgtcccggta

SEQ ID NO: 434272 - DNA, 25 bp, Mus musculus
atttgcaccacgtagcgctccctga

SEQ ID NO: 434273 - DNA, 25 bp, Mus musculus
gcttgccagtcagcgagtagcactc

SEQ ID NO: 434274 - DNA, 25 bp, Mus musculus
gcaccgagaggcacttgtttctaca

SEQ ID NO: 434275 - DNA, 25 bp, Mus musculus
tacaccggcgtctcgcaatacgttg

SEQ ID NO: 434276 - DNA, 25 bp, Mus musculus
tggagatggcaaagaccaggccttt

SEQ ID NO: 434277 - DNA, 25 bp, Mus musculus
agccgccaagttgaacgaccctagg

SEQ ID NO: 434278 - DNA, 25 bp, Mus musculus
tggagccgctcagccagctaaaggc

SEQ ID NO: 434279 - DNA, 25 bp, Mus musculus
ccgtcttaaagcagcgggacacctg

SEQ ID NO: 434280 - DNA, 25 bp, Mus musculus
tctaggcgctccgtcccgtcttaaa

SEQ ID NO: 434281 - DNA, 25 bp, Mus musculus
gcgcatcgaaggaacggaaacggtc

SEQ ID NO: 434282 - DNA, 25 bp, Mus musculus
gggagagctctccacaaattaatta

SEQ ID NO: 434283 - DNA, 25 bp, Mus musculus
ctcaatgctccttgtgctggccatc

SEQ ID NO: 434284 - DNA, 25 bp, Mus musculus
gtcccgttcttcaaaatgttccagc

SEQ ID NO: 434285 - DNA, 25 bp, Mus musculus
tgcggtagaagctgcagtgagcact

SEQ ID NO: 434286 - DNA, 25 bp, Mus musculus
acgcctcacaagtagcgcgcgggca

SEQ ID NO: 434287 - DNA, 25 bp, Mus musculus
attccggtagaaccgcgccttcttg

SEQ ID NO: 434288 - DNA, 25 bp, Mus musculus
cctggggcaggttcacattgtcaga

SEQ ID NO: 434289 - DNA, 25 bp, Mus musculus
tggccttcttctccgagctgagggc

SEQ ID NO: 434290 - DNA, 25 bp, Mus musculus
atcccttttctactcggatctcggc

SEQ ID NO: 434291 - DNA, 25 bp, Mus musculus
tgccctccggctttatctctcgggg

SEQ ID NO: 434292 - DNA, 25 bp, Mus musculus
cctaataatttctgccctccggctt

SEQ ID NO: 434293 - DNA, 25 bp, Mus musculus
aggaggctcagcatgctgtccgccc

SEQ ID NO: 434294 - DNA, 25 bp, Mus musculus
aggatccagatgaggaggctcagca

SEQ ID NO: 434295 - DNA, 25 bp, Mus musculus
accttgtgagaaagtgttgtagaga

SEQ ID NO: 434296 - DNA, 25 bp, Mus musculus
ctggggcttaccttgtgagaaagtg

SEQ ID NO: 434297 - DNA, 25 bp, Mus musculus
tcaccaagaactcctcggtgttctc

SEQ ID NO: 434298 - DNA, 25 bp, Mus musculus
agttgggccgcttcaccaagaactc

SEQ ID NO: 434299 - DNA, 25 bp, Mus musculus
ccgcgcagccagaggaagcaagttg

SEQ ID NO: 434300 - DNA, 25 bp, Mus musculus
tgttctcccgcgcagccagaggaag

SEQ ID NO: 434301 - DNA, 25 bp, Mus musculus
ttgcgacctaagttctctgttctcc

SEQ ID NO: 434302 - DNA, 25 bp, Mus musculus
tcggatctcggcttttgcgacctaa

SEQ ID NO: 434303 - DNA, 25 bp, Mus musculus
ggctttatctctcggggcctctctc

SEQ ID NO: 434304 - DNA, 25 bp, Mus musculus
aaagccgccgcggagtcacttcctt

SEQ ID NO: 434305 - DNA, 25 bp, Mus musculus
tcacttccttctgggtggatgagga

SEQ ID NO: 434306 - DNA, 25 bp, Mus musculus
gagtcacttccttctgggtggatga

SEQ ID NO: 434307 - DNA, 25 bp, Mus musculus
aacacctgcagacgcgcctgcgggc

SEQ ID NO: 434308 - DNA, 25 bp, Mus musculus
ccgtggaagccgctgcggaccagcg

SEQ ID NO: 434309 - DNA, 25 bp, Mus musculus
gcggagtcacttccttctgggtgga

SEQ ID NO: 434310 - DNA, 25 bp, Mus musculus
cagagtggaagtgacgaaagccgcc

SEQ ID NO: 434311 - DNA, 25 bp, Mus musculus
gcccagagtggaagtgacgaaagcc

SEQ ID NO: 434312 - DNA, 25 bp, Mus musculus
cctggcccagagtggaagtgacgaa

SEQ ID NO: 434313 - DNA, 25 bp, Mus musculus
ggcggaagccgtgccgctcacgaca

SEQ ID NO: 434314 - DNA, 25 bp, Mus musculus
accttctgggcggaagccgtgccgc

SEQ ID NO: 434315 - DNA, 25 bp, Mus musculus
gcaccggtaccttctgggcggaagc

SEQ ID NO: 434316 - DNA, 25 bp, Mus musculus
cacggaggggcaccggtaccttctg

SEQ ID NO: 434317 - DNA, 25 bp, Mus musculus
cgccctgggggagtcgcgaacacct

SEQ ID NO: 434318 - DNA, 25 bp, Mus musculus
ctggtaacttggaaaggagcgcgac

SEQ ID NO: 434319 - DNA, 25 bp, Mus musculus
cagctaagagggttcctggtaactt

SEQ ID NO: 434320 - DNA, 25 bp, Mus musculus
cgcgacaaatgagtgaaaacgggca

SEQ ID NO: 434321 - DNA, 25 bp, Mus musculus
cggccagcggacactgcggaaacaa

SEQ ID NO: 434322 - DNA, 25 bp, Mus musculus
tgcggaaacaaaggtcgagtctctg

SEQ ID NO: 434323 - DNA, 25 bp, Mus musculus
acaaaggtcgagtctctgggacagc

SEQ ID NO: 434324 - DNA, 25 bp, Mus musculus
ctctgggacagcagcaccgggagca

SEQ ID NO: 434325 - DNA, 25 bp, Mus musculus
cagcaccgggagcagctaggccgca

SEQ ID NO: 434326 - DNA, 25 bp, Mus musculus
tggccctaaccgagccgcaacaata

SEQ ID NO: 434327 - DNA, 25 bp, Mus musculus
caacaatactaggagcgggtcgccg

SEQ ID NO: 434328 - DNA, 25 bp, Mus musculus
ggaagcgggactaccgctccagagc

SEQ ID NO: 434329 - DNA, 25 bp, Mus musculus
taccgctccagagcgctgcggcgag

SEQ ID NO: 434330 - DNA, 25 bp, Mus musculus
cgagagagactttcggagcctggac

SEQ ID NO: 434331 - DNA, 25 bp, Mus musculus
cgagggcacagctaagagggttcct

SEQ ID NO: 434332 - DNA, 25 bp, Mus musculus
taccgacgggtcctgctggccgaca

SEQ ID NO: 434333 - DNA, 25 bp, Mus musculus
cggccttcaggggaggggcaccctg

SEQ ID NO: 434334 - DNA, 25 bp, Mus musculus
ggagagccgcccaacctgacagccc

SEQ ID NO: 434335 - DNA, 25 bp, Mus musculus
gaagtggacggggagagccgcccaa

SEQ ID NO: 434336 - DNA, 25 bp, Mus musculus
tccgcacgcctgtctgcgaagtgga

SEQ ID NO: 434337 - DNA, 25 bp, Mus musculus
tggggtcagccctccgcacgcctgt

SEQ ID NO: 434338 - DNA, 25 bp, Mus musculus
cccaggcaggaagtccgcgcgggga

SEQ ID NO: 434339 - DNA, 25 bp, Mus musculus
cggggctcggagctcggagctcaga

SEQ ID NO: 434340 - DNA, 25 bp, Mus musculus
cctgctggccgacagagctggctgc

SEQ ID NO: 434341 - DNA, 25 bp, Mus musculus
ttgtaccgacgggtcctgctggccg

SEQ ID NO: 434342 - DNA, 25 bp, Mus musculus
gcgtgttgtaccgacgggtcctgct

SEQ ID NO: 434343 - DNA, 25 bp, Mus musculus
ctcagagcggcgtgttgtaccgacg

SEQ ID NO: 434344 - DNA, 25 bp, Mus musculus
gctcagagcggcgtgttgtaccgac

SEQ ID NO: 434345 - DNA, 25 bp, Mus musculus
cgcccgcgcccaggcaggaagtccg

SEQ ID NO: 434346 - DNA, 25 bp, Mus musculus
aagtccgcctggctccgagtcacgt

SEQ ID NO: 434347 - DNA, 25 bp, Mus musculus
gccctgcccgtctgcgtgtgcgtgt

SEQ ID NO: 434348 - DNA, 25 bp, Mus musculus
tgcgctcagcccagcgtgagcggca

SEQ ID NO: 434349 - DNA, 25 bp, Mus musculus
cagcgtgagcggcacctgctagtcc

SEQ ID NO: 434350 - DNA, 25 bp, Mus musculus
cctgctagtccgggctcgccgagga

SEQ ID NO: 434351 - DNA, 25 bp, Mus musculus
aggaggccgcctcgccgggctctca

SEQ ID NO: 434352 - DNA, 25 bp, Mus musculus
ccgcccgagcggctcagagggcttc

SEQ ID NO: 434353 - DNA, 25 bp, Mus musculus
gcttcgagggctccgaggtcgccca

SEQ ID NO: 434354 - DNA, 25 bp, Mus musculus
tcgagggctccgaggtcgcccagca

SEQ ID NO: 434355 - DNA, 25 bp, Mus musculus
gtgcccgaggcagagactgagaaaa

SEQ ID NO: 434356 - DNA, 25 bp, Mus musculus
tgcaagtccgcctggctccgagtca

SEQ ID NO: 434357 - DNA, 25 bp, Mus musculus
ctccgagtcacgtgtcagtgcccga

SEQ ID NO: 434358 - DNA, 25 bp, Mus musculus
tcacgtgtcagtgcccgaggcagag

SEQ ID NO: 434359 - DNA, 25 bp, Mus musculus
tgtcagtgcccgaggcagagactga

SEQ ID NO: 434360 - DNA, 25 bp, Mus musculus
tccaagaactgagtgaagatgaaac

SEQ ID NO: 434361 - DNA, 25 bp, Mus musculus
gtagttcccgttgttgacatgcgtg

SEQ ID NO: 434362 - DNA, 25 bp, Mus musculus
gtctcgttgagcacagagccgttga

SEQ ID NO: 434363 - DNA, 25 bp, Mus musculus
agagacggtgctggctgcccgtcca

SEQ ID NO: 434364 - DNA, 25 bp, Mus musculus
gttgaacaaccagcgcagagacggt

SEQ ID NO: 434365 - DNA, 25 bp, Mus musculus
gagcacagagccgttgaacaaccag

SEQ ID NO: 434366 - DNA, 25 bp, Mus musculus
aagatgaaactggtctcgttgagca

SEQ ID NO: 434367 - DNA, 25 bp, Mus musculus
agcgcagactccaagaactgagtga

SEQ ID NO: 434368 - DNA, 25 bp, Mus musculus
tggtctcattagtcagcgcagactc

SEQ ID NO: 434369 - DNA, 25 bp, Mus musculus
ccgtgccgcatggtctcattagtca

SEQ ID NO: 434370 - DNA, 25 bp, Mus musculus
ttgttgacatgcgtgggctgattga

SEQ ID NO: 434371 - DNA, 25 bp, Mus musculus
cagggtgtagttcccgttgttgaca

SEQ ID NO: 434372 - DNA, 25 bp, Mus musculus
ccgccagcagggtgtagttcccgtt

SEQ ID NO: 434373 - DNA, 25 bp, Mus musculus
cgcaggcagccgtgccgcatggtct

SEQ ID NO: 434374 - DNA, 25 bp, Mus musculus
cggcggaggcacaggccagcatcaa

SEQ ID NO: 434375 - DNA, 25 bp, Mus musculus
ttaaagactagccaccaggagaggg

SEQ ID NO: 434376 - DNA, 25 bp, Mus musculus
gggcggtgttaaagactagccacca

SEQ ID NO: 434377 - DNA, 25 bp, Mus musculus
ccgtccgtgcgctcctagctgccgc

SEQ ID NO: 434378 - DNA, 25 bp, Mus musculus
cgagccgctggcctcgcagcatcgc

SEQ ID NO: 434379 - DNA, 25 bp, Mus musculus
acgaagtcatcagactgcctagccc

SEQ ID NO: 434380 - DNA, 25 bp, Mus musculus
ggcacaggccagcatcaacgaagtc

SEQ ID NO: 434381 - DNA, 25 bp, Mus musculus
agcagacctcgcgacaggatgcggc

SEQ ID NO: 434382 - DNA, 25 bp, Mus musculus
ggacagcagacctcgcgacaggatg

SEQ ID NO: 434383 - DNA, 25 bp, Mus musculus
cacgggacagcagacctcgcgacag

SEQ ID NO: 434384 - DNA, 25 bp, Mus musculus
gcggagggtatccagggaccctgcc

SEQ ID NO: 434385 - DNA, 25 bp, Mus musculus
actcacagctccgtcaggttcccgg

SEQ ID NO: 434386 - DNA, 25 bp, Mus musculus
gggaagggctgtgccctcctgaccc

SEQ ID NO: 434387 - DNA, 25 bp, Mus musculus
ggccagcatcaacgaagtcatcaga

SEQ ID NO: 434388 - DNA, 25 bp, Mus musculus
cctccctcagttgacaggctaaata

SEQ ID NO: 434389 - DNA, 25 bp, Mus musculus
ctcaggactgcctggactgtctgga

SEQ ID NO: 434390 - DNA, 25 bp, Mus musculus
ggttccagagctcagttcttggccc

SEQ ID NO: 434391 - DNA, 25 bp, Mus musculus
cagttgacaggctaaatattttccc

SEQ ID NO: 434392 - DNA, 25 bp, Mus musculus
atattttcccttgacttggtgggag

SEQ ID NO: 434393 - DNA, 25 bp, Mus musculus
tcgaccgagagtggaagtctgcatg

SEQ ID NO: 434394 - DNA, 25 bp, Mus musculus
agagtggaagtctgcatgtccagga

SEQ ID NO: 434395 - DNA, 25 bp, Mus musculus
ctggatctttgtgttctgaatcatc

SEQ ID NO: 434396 - DNA, 25 bp, Mus musculus
ttctgaatcatcctccctctggatg

SEQ ID NO: 434397 - DNA, 25 bp, Mus musculus
tctggatgcctctctgaggctcctc

SEQ ID NO: 434398 - DNA, 25 bp, Mus musculus
gcatctctgtcccagtatctgtctc

SEQ ID NO: 434399 - DNA, 25 bp, Mus musculus
atctgtctctggaccacactgaggc

SEQ ID NO: 434400 - DNA, 25 bp, Mus musculus
gagaggggttccagagctcagttct

SEQ ID NO: 434401 - DNA, 25 bp, Mus musculus
cctggactgtctggatctttgtgtt

SEQ ID NO: 434402 - DNA, 25 bp, Mus musculus
gtgacctctacatcaatgactactg

SEQ ID NO: 434403 - DNA, 25 bp, Mus musculus
ttcgaccgtgaagacccggcgctgg

SEQ ID NO: 434404 - DNA, 25 bp, Mus musculus
acgcttcgaccgtgaagacccggcg

SEQ ID NO: 434405 - DNA, 25 bp, Mus musculus
acgacacacgcttcgaccgtgaaga

SEQ ID NO: 434406 - DNA, 25 bp, Mus musculus
tgcccaccagcagccacgacacacg

SEQ ID NO: 434407 - DNA, 25 bp, Mus musculus
cctggcggaggacggtgacctctac

SEQ ID NO: 434408 - DNA, 25 bp, Mus musculus
ggacggtgacctctacatcaatgac

SEQ ID NO: 434409 - DNA, 25 bp, Mus musculus
tacatcaatgactactgccaccgcg

SEQ ID NO: 434410 - DNA, 25 bp, Mus musculus
tgcctcaggcctggggtgctcggta

SEQ ID NO: 434411 - DNA, 25 bp, Mus musculus
tggcgggtggaccactgccttgact

SEQ ID NO: 434412 - DNA, 25 bp, Mus musculus
gggtggaccactgccttgacttccc

SEQ ID NO: 434413 - DNA, 25 bp, Mus musculus
gcctctgcaccgtggccataggtct

SEQ ID NO: 434414 - DNA, 25 bp, Mus musculus
gcaccgtggccataggtctgcggct

SEQ ID NO: 434415 - DNA, 25 bp, Mus musculus
gcggaggacggtgacctctacatca

SEQ ID NO: 434416 - DNA, 25 bp, Mus musculus
tgtgtcgcttctttcgccgcgaatc

SEQ ID NO: 434417 - DNA, 25 bp, Mus musculus
accaccgcttacataacggaggcga

SEQ ID NO: 434418 - DNA, 25 bp, Mus musculus
ccctactgcgggttgcataacgctc

SEQ ID NO: 434419 - DNA, 25 bp, Mus musculus
tcggcactcggctcttcaagcctgt

SEQ ID NO: 434420 - DNA, 25 bp, Mus musculus
gcctgttaaaaatggcgggagccca

SEQ ID NO: 434421 - DNA, 25 bp, Mus musculus
ggctcttcaagcctgtgcctctgag

SEQ ID NO: 434422 - DNA, 25 bp, Mus musculus
cgccgaggagggagcaattgaattt

SEQ ID NO: 434423 - DNA, 25 bp, Mus musculus
acacaaacaaccacacgagctagcg

SEQ ID NO: 434424 - DNA, 25 bp, Mus musculus
acgcgcaaacttgggctcgcgcttc

SEQ ID NO: 434425 - DNA, 25 bp, Mus musculus
tgtcgcgatccaaccggcagaaaga

SEQ ID NO: 434426 - DNA, 25 bp, Mus musculus
acaagtgcggagacctggtgtttgc

SEQ ID NO: 434427 - DNA, 25 bp, Mus musculus
tgtttgcgaagataaagggataccc

SEQ ID NO: 434428 - DNA, 25 bp, Mus musculus
taaagggatacccacactggccggc

SEQ ID NO: 434429 - DNA, 25 bp, Mus musculus
ggcgccagctccttttgggctggca

SEQ ID NO: 434430 - DNA, 25 bp, Mus musculus
gccgcccgacgagcctgggacagag

SEQ ID NO: 434431 - DNA, 25 bp, Mus musculus
cgccatcttgtttcttccctctcgc

SEQ ID NO: 434432 - DNA, 25 bp, Mus musculus
ccctgggcgagctcaaccgggtctt

SEQ ID NO: 434433 - DNA, 25 bp, Mus musculus
agcgcggtcacgtgagctgcgccgc

SEQ ID NO: 434434 - DNA, 25 bp, Mus musculus
tcttccctctcgctcggtgactggg

SEQ ID NO: 434435 - DNA, 25 bp, Mus musculus
gctccggatcgcctgcagccgccat

SEQ ID NO: 434436 - DNA, 25 bp, Mus musculus
ggctcagtccgaattgccggggccc

SEQ ID NO: 434437 - DNA, 25 bp, Mus musculus
agaaggctcagtccgaattgccggg

SEQ ID NO: 434438 - DNA, 25 bp, Mus musculus
agggagaaggctcagtccgaattgc

SEQ ID NO: 434439 - DNA, 25 bp, Mus musculus
cctcatgtcggagccgcggcttgcg

SEQ ID NO: 434440 - DNA, 25 bp, Mus musculus
agcgctccgcagcaggagccgcggg

SEQ ID NO: 434441 - DNA, 25 bp, Mus musculus
tgctgccgcggtgccgcgagcgcag

SEQ ID NO: 434442 - DNA, 25 bp, Mus musculus
agctcaaccgggtcttgggcgccac

SEQ ID NO: 434443 - DNA, 25 bp, Mus musculus
ggggaaccgacagcggccgcaggcc

SEQ ID NO: 434444 - DNA, 25 bp, Mus musculus
cgcgaacgaacttacgcagcaaatt

SEQ ID NO: 434445 - DNA, 25 bp, Mus musculus
cgcagcaaattagcatgtctttcgc

SEQ ID NO: 434446 - DNA, 25 bp, Mus musculus
ttccgcaatttgactacatctccca

SEQ ID NO: 434447 - DNA, 25 bp, Mus musculus
cgaagagcgcgaacgaacttacgca

SEQ ID NO: 434448 - DNA, 25 bp, Mus musculus
agaacgcacgtggaaagaaagttgc

SEQ ID NO: 434449 - DNA, 25 bp, Mus musculus
tagcatgtctttcgccttcaattcc

SEQ ID NO: 434450 - DNA, 25 bp, Mus musculus
tctttcgccttcaattcccgacatg

SEQ ID NO: 434451 - DNA, 25 bp, Mus musculus
tctggatttcctacggttggctaaa

SEQ ID NO: 434452 - DNA, 25 bp, Mus musculus
tcctgtttcctgtccattttgtagc

SEQ ID NO: 434453 - DNA, 25 bp, Mus musculus
tccattttgtagcaacggactagag

SEQ ID NO: 434454 - DNA, 25 bp, Mus musculus
acggactagagttcccagacgctgg

SEQ ID NO: 434455 - DNA, 25 bp, Mus musculus
ttgagccttcctttccgcaatttga

SEQ ID NO: 434456 - DNA, 25 bp, Mus musculus
acatctcccaaaaatccggtgggtg

SEQ ID NO: 434457 - DNA, 25 bp, Mus musculus
actgcggacgtagagaacgcacgtg

SEQ ID NO: 434458 - DNA, 25 bp, Mus musculus
caccttcgagttgtacctccacggg

SEQ ID NO: 434459 - DNA, 25 bp, Mus musculus
gggcgatcccgtcctattacaaatc

SEQ ID NO: 434460 - DNA, 25 bp, Mus musculus
gggccaagccatttgcgcagccgca

SEQ ID NO: 434461 - DNA, 25 bp, Mus musculus
gcccgacgcaaagcaagaactccga

SEQ ID NO: 434462 - DNA, 25 bp, Mus musculus
ggtcggtaccacgaaaccatgcaac

SEQ ID NO: 434463 - DNA, 25 bp, Mus musculus
cccgcatcctgtggcgtgaaatgtc

SEQ ID NO: 434464 - DNA, 25 bp, Mus musculus
catgcgagaggccatgggctgaaac

SEQ ID NO: 434465 - DNA, 25 bp, Mus musculus
agttgccttctctcctcatgcgaga

SEQ ID NO: 434466 - DNA, 25 bp, Mus musculus
gtgaggtccacagccagttgccttc

SEQ ID NO: 434467 - DNA, 25 bp, Mus musculus
tccaggatggaacggtagtgagcta

SEQ ID NO: 434468 - DNA, 25 bp, Mus musculus
tccttagaacaaggcgcacttgccc

SEQ ID NO: 434469 - DNA, 25 bp, Mus musculus
aacgtcacgacttccactgggccaa

SEQ ID NO: 434470 - DNA, 25 bp, Mus musculus
ctcacgatgatgtaggcgtccagga

SEQ ID NO: 434471 - DNA, 25 bp, Mus musculus
actcggagacgtcacagaagcgcgc

SEQ ID NO: 434472 - DNA, 25 bp, Mus musculus
gttgcgtcggggaagaatcttttca

SEQ ID NO: 434473 - DNA, 25 bp, Mus musculus
agagtcgcttagaggtgcagcagct

SEQ ID NO: 434474 - DNA, 25 bp, Mus musculus
ctggaacagagattggaaggccgct

SEQ ID NO: 434475 - DNA, 25 bp, Mus musculus
ctgatcgcgacagcctccaggagcg

SEQ ID NO: 434476 - DNA, 25 bp, Mus musculus
agcgcgtggctcacatggagagctc

SEQ ID NO: 434477 - DNA, 25 bp, Mus musculus
gcgcgacaaccttgccgaagagctg

SEQ ID NO: 434478 - DNA, 25 bp, Mus musculus
gaggcctacctgacccgggtcaaga

SEQ ID NO: 434479 - DNA, 25 bp, Mus musculus
tcttttcagatgtgggagctcaatc

SEQ ID NO: 434480 - DNA, 25 bp, Mus musculus
ccagaccagcgacatggagggttgc

SEQ ID NO: 434481 - DNA, 25 bp, Mus musculus
ttctctagtgctccacgtccgcttg

SEQ ID NO: 434482 - DNA, 25 bp, Mus musculus
ggaatcctccgcttccgctgggtca

SEQ ID NO: 434483 - DNA, 25 bp, Mus musculus
tgaataccctcgcttcagctcgctg

SEQ ID NO: 434484 - DNA, 25 bp, Mus musculus
cggccggcgggagtatgaataccct

SEQ ID NO: 434485 - DNA, 25 bp, Mus musculus
ggagctcaatcgacgcctggaggcc

SEQ ID NO: 434486 - DNA, 25 bp, Mus musculus
aaggctcgatcctctgtggacaggg

SEQ ID NO: 434487 - DNA, 25 bp, Mus musculus
cgtcgataccgtgctggacctcgca

SEQ ID NO: 434488 - DNA, 25 bp, Mus musculus
catgggatggccagggcaccgccca

SEQ ID NO: 434489 - DNA, 25 bp, Mus musculus
gctgcagccagacgcaggacgtagt

SEQ ID NO: 434490 - DNA, 25 bp, Mus musculus
tcaaagccggctgcagccagacgca

SEQ ID NO: 434491 - DNA, 25 bp, Mus musculus
atgcgcacgcggaaggctcgatcct

SEQ ID NO: 434492 - DNA, 25 bp, Mus musculus
ttcgtttaccttgacgcgcagccca

SEQ ID NO: 434493 - DNA, 25 bp, Mus musculus
gtaggcttcgtttaccttgacgcgc

SEQ ID NO: 434494 - DNA, 25 bp, Mus musculus
ctagagacacatccgtgagcgatgc

SEQ ID NO: 434495 - DNA, 25 bp, Mus musculus
gctcaatactagagacacatccgtg

SEQ ID NO: 434496 - DNA, 25 bp, Mus musculus
tgggccgcagttcgctcaatactag

SEQ ID NO: 434497 - DNA, 25 bp, Mus musculus
cccggaatcattgggccgcagttcg

SEQ ID NO: 434498 - DNA, 25 bp, Mus musculus
tgctggacctcgcagcgatagaccc

SEQ ID NO: 434499 - DNA, 25 bp, Mus musculus
agcgccacgcggaaccggtaggctt

SEQ ID NO: 434500 - DNA, 25 bp, Mus musculus
atccttagtcgctccgcagcccaga

SEQ ID NO: 434501 - DNA, 25 bp, Mus musculus
gacaagcgaagtaggacaaggttcc

SEQ ID NO: 434502 - DNA, 25 bp, Mus musculus
cccaggaagctacggtgggtcactg

SEQ ID NO: 434503 - DNA, 25 bp, Mus musculus
acagcagccagtatcgcggcccgct

SEQ ID NO: 434504 - DNA, 25 bp, Mus musculus
tcgcccggatcctttggctcagaga

SEQ ID NO: 434505 - DNA, 25 bp, Mus musculus
cctttggctcagagaggtcaagaaa

SEQ ID NO: 434506 - DNA, 25 bp, Mus musculus
tcagagaggtcaagaaacttaccca

SEQ ID NO: 434507 - DNA, 25 bp, Mus musculus
tgggtcactgtctcggtcgcccaca

SEQ ID NO: 434508 - DNA, 25 bp, Mus musculus
aggcctccgcactcaccttgcgagg

SEQ ID NO: 434509 - DNA, 25 bp, Mus musculus
ggacccgctgccttctctgtgcggg

SEQ ID NO: 434510 - DNA, 25 bp, Mus musculus
ttctctgtgcgggttccgggcgaca

SEQ ID NO: 434511 - DNA, 25 bp, Mus musculus
cggacgggagcccaagacttgcagc

SEQ ID NO: 434512 - DNA, 25 bp, Mus musculus
tgccgaagccggcacagagcgctgc

SEQ ID NO: 434513 - DNA, 25 bp, Mus musculus
caagcgaccgatagggccaggcctc

SEQ ID NO: 434514 - DNA, 25 bp, Mus musculus
gagcagcgcagtgggttcttcccag

SEQ ID NO: 434515 - DNA, 25 bp, Mus musculus
gtccgagcccgcaatggggaaagcc

SEQ ID NO: 434516 - DNA, 25 bp, Mus musculus
ctaggatggcagcagtcactgagcg

SEQ ID NO: 434517 - DNA, 25 bp, Mus musculus
acgtcttccgtgttgtctccctcat

SEQ ID NO: 434518 - DNA, 25 bp, Mus musculus
tgtctccctcatgctttcctggcgg

SEQ ID NO: 434519 - DNA, 25 bp, Mus musculus
cagccagagctcgaggtgtctagga

SEQ ID NO: 434520 - DNA, 25 bp, Mus musculus
ctgactgtgcggtgatccggtcctc

SEQ ID NO: 434521 - DNA, 25 bp, Mus musculus
aagttggccttagccacccgcagcg

SEQ ID NO: 434522 - DNA, 25 bp, Mus musculus
cggcggtccagcaagttggccttag

SEQ ID NO: 434523 - DNA, 25 bp, Mus musculus
cgatggttttgaagatgcgaacacc

SEQ ID NO: 434524 - DNA, 25 bp, Mus musculus
gcgccggaagccagaacaaaagtgc

SEQ ID NO: 434525 - DNA, 25 bp, Mus musculus
agcagtcactgagcgctgctctctc

SEQ ID NO: 434526 - DNA, 25 bp, Mus musculus
aacaaaagtgctctctgggccgcga

SEQ ID NO: 434527 - DNA, 25 bp, Mus musculus
gctagctccggcagcttcacgtctt

SEQ ID NO: 434528 - DNA, 25 bp, Mus musculus
aaacaccacacctggggagcggaga

SEQ ID NO: 434529 - DNA, 25 bp, Mus musculus
cgaagaacacctggcctggaaatgc

SEQ ID NO: 434530 - DNA, 25 bp, Mus musculus
tccgagaagccctcacaggaccgtg

SEQ ID NO: 434531 - DNA, 25 bp, Mus musculus
ggaccgtgcggaggaaaattgtcta

SEQ ID NO: 434532 - DNA, 25 bp, Mus musculus
aattgtctaggatgcgctcgccctg

SEQ ID NO: 434533 - DNA, 25 bp, Mus musculus
gcccacgacacagggagctgaccag

SEQ ID NO: 434534 - DNA, 25 bp, Mus musculus
ccgaggtgaagcagaaggcgtcata

SEQ ID NO: 434535 - DNA, 25 bp, Mus musculus
acgggagtcaccagcacaagccaga

SEQ ID NO: 434536 - DNA, 25 bp, Mus musculus
gctcaccctggtagagttggccgta

SEQ ID NO: 434537 - DNA, 25 bp, Mus musculus
cgcccgcttcgcttcgaagtaattg

SEQ ID NO: 434538 - DNA, 25 bp, Mus musculus
gctgggttggtacggaaacaccaca

SEQ ID NO: 434539 - DNA, 25 bp, Mus musculus
aattagggaacctcagtgccggcgc

SEQ ID NO: 434540 - DNA, 25 bp, Mus musculus
agggtcagtgccacgctctcgtcct

SEQ ID NO: 434541 - DNA, 25 bp, Mus musculus
taattgaactggtagcggcctcggc

SEQ ID NO: 434542 - DNA, 25 bp, Mus musculus
cggcgctgtgttccccaccagatgg

SEQ ID NO: 434543 - DNA, 25 bp, Mus musculus
cattcgactagcagagcgccgctcg

SEQ ID NO: 434544 - DNA, 25 bp, Mus musculus
tctgctggctgatgacccgtggcag

SEQ ID NO: 434545 - DNA, 25 bp, Mus musculus
gcagcccggacattcgactagcaga

SEQ ID NO: 434546 - DNA, 25 bp, Mus musculus
caccagatgggccttgcacgacaca

SEQ ID NO: 434547 - DNA, 25 bp, Mus musculus
taccttaagtacttcaccgcagcgc

SEQ ID NO: 434548 - DNA, 25 bp, Mus musculus
gccgtaccttaagtacttcaccgca

SEQ ID NO: 434549 - DNA, 25 bp, Mus musculus
gcacgacacacactctgctggctga

SEQ ID NO: 434550 - DNA, 25 bp, Mus musculus
tgcatctaaccgtccgttcctagtc

SEQ ID NO: 434551 - DNA, 25 bp, Mus musculus
gtccgttcctagtcccagactatca

SEQ ID NO: 434552 - DNA, 25 bp, Mus musculus
atgggccttgcacgacacacactct

SEQ ID NO: 434553 - DNA, 25 bp, Mus musculus
gagcctctgcatctaaccgtccgtt

SEQ ID NO: 434554 - DNA, 25 bp, Mus musculus
agtcccagactatcaggcgttccgc

SEQ ID NO: 434555 - DNA, 25 bp, Mus musculus
cgcccaccttcgttccgccctgcgt

SEQ ID NO: 434556 - DNA, 25 bp, Mus musculus
ccgcagtgaggggtggtgtcccagc

SEQ ID NO: 434557 - DNA, 25 bp, Mus musculus
cggcacgaacgggaagcgtcccatc

SEQ ID NO: 434558 - DNA, 25 bp, Mus musculus
ccatcccggcgtgaccgcagtgagg

SEQ ID NO: 434559 - DNA, 25 bp, Mus musculus
tcccagcggcgggagattcaaaact

SEQ ID NO: 434560 - DNA, 25 bp, Mus musculus
agcggcgggagattcaaaactggca

SEQ ID NO: 434561 - DNA, 25 bp, Mus musculus
cgggagattcaaaactggcaggaga

SEQ ID NO: 434562 - DNA, 25 bp, Mus musculus
aaactggcaggagaaggaacatgga

SEQ ID NO: 434563 - DNA, 25 bp, Mus musculus
attggctgcccggagcactgctccc

SEQ ID NO: 434564 - DNA, 25 bp, Mus musculus
cttggttttcgcgggattggctgcc

SEQ ID NO: 434565 - DNA, 25 bp, Mus musculus
ctgtgagtgcgggaaggatctgagg

SEQ ID NO: 434566 - DNA, 25 bp, Mus musculus
ccgagctcggacagcctgtgagtgc

SEQ ID NO: 434567 - DNA, 25 bp, Mus musculus
aaggaacatggagccgtgcgcggca

SEQ ID NO: 434568 - DNA, 25 bp, Mus musculus
caaaactggcaggagaaggaacatg

SEQ ID NO: 434569 - DNA, 25 bp, Mus musculus
gggaagcgtcccatcccggcgtgac

SEQ ID NO: 434570 - DNA, 25 bp, Mus musculus
ggaggaaggaagcaaaatatcaaca

SEQ ID NO: 434571 - DNA, 25 bp, Mus musculus
cttggtcgggcgtgtcagcaacgcc

SEQ ID NO: 434572 - DNA, 25 bp, Mus musculus
tcgcgtaaccgaggattcggcggac

SEQ ID NO: 434573 - DNA, 25 bp, Mus musculus
ctgcggcttcgcgtaaccgaggatt

SEQ ID NO: 434574 - DNA, 25 bp, Mus musculus
ccttcgctgtttcccgtcggagctg

SEQ ID NO: 434575 - DNA, 25 bp, Mus musculus
ccatctcgcaagctaggctgcgcgg

SEQ ID NO: 434576 - DNA, 25 bp, Mus musculus
tatcaacaaccgtcgaggcggcttg

SEQ ID NO: 434577 - DNA, 25 bp, Mus musculus
ggaagcaaaatatcaacaaccgtcg

SEQ ID NO: 434578 - DNA, 25 bp, Mus musculus
gcaagctaggctgcgcggtgcctac

SEQ ID NO: 434579 - DNA, 25 bp, Mus musculus
aggagttgcctttggagcccgaaag

SEQ ID NO: 434580 - DNA, 25 bp, Mus musculus
ctacgtcggcctcgagtctggggct

SEQ ID NO: 434581 - DNA, 25 bp, Mus musculus
cggtgcctacgtcggcctcgagtct

SEQ ID NO: 434582 - DNA, 25 bp, Mus musculus
tgtgacagccgcgcctggtacccga

SEQ ID NO: 434583 - DNA, 25 bp, Mus musculus
gcttgtccatcactctcgtcttttc

SEQ ID NO: 434584 - DNA, 25 bp, Mus musculus
catttcctagccgcggcgcacagtg

SEQ ID NO: 434585 - DNA, 25 bp, Mus musculus
ccctccgcaggttccgcctgcgcgc

SEQ ID NO: 434586 - DNA, 25 bp, Mus musculus
tactcccatttcctagccgcggcgc

SEQ ID NO: 434587 - DNA, 25 bp, Mus musculus
cccacgcctactcccatttcctagc

SEQ ID NO: 434588 - DNA, 25 bp, Mus musculus
gaacgcgttcgaagctttcacgccc

SEQ ID NO: 434589 - DNA, 25 bp, Mus musculus
ggaacgcgttcgaagctttcacgcc

SEQ ID NO: 434590 - DNA, 25 bp, Mus musculus
agggaacgcgttcgaagctttcacg

SEQ ID NO: 434591 - DNA, 25 bp, Mus musculus
ccagggaacgcgttcgaagctttca

SEQ ID NO: 434592 - DNA, 25 bp, Mus musculus
ccgaccagggaacgcgttcgaagct

SEQ ID NO: 434593 - DNA, 25 bp, Mus musculus
cgctaggtgagtgctcgggcctcca

SEQ ID NO: 434594 - DNA, 25 bp, Mus musculus
tgtccccgccggtgcgggaactatc

SEQ ID NO: 434595 - DNA, 25 bp, Mus musculus
cacgcccgtagagcacgcacttccg

SEQ ID NO: 434596 - DNA, 25 bp, Mus musculus
cgcgcacgcccgtagagcacgcact

SEQ ID NO: 434597 - DNA, 25 bp, Mus musculus
agtgcgcagaagcaccccgagctcg

SEQ ID NO: 434598 - DNA, 25 bp, Mus musculus
gaaatacgccggtcctcactactga

SEQ ID NO: 434599 - DNA, 25 bp, Mus musculus
tgcgaacgctcaagaccctcgaggc

SEQ ID NO: 434600 - DNA, 25 bp, Mus musculus
tggagtctagaccacgtgcgaacgc

SEQ ID NO: 434601 - DNA, 25 bp, Mus musculus
gcgaccgacaccaaggaggaaaatc

SEQ ID NO: 434602 - DNA, 25 bp, Mus musculus
agcctttgtgcttcctctcgcgaga

SEQ ID NO: 434603 - DNA, 25 bp, Mus musculus
tgccattttgggttggcctacagcc

SEQ ID NO: 434604 - DNA, 25 bp, Mus musculus
acgtgaattcttcttccagggttgc

SEQ ID NO: 434605 - DNA, 25 bp, Mus musculus
ccggcgcctaagactccagtagaca

SEQ ID NO: 434606 - DNA, 25 bp, Mus musculus
gctctacacctaggaatccctcagg

SEQ ID NO: 434607 - DNA, 25 bp, Mus musculus
gtcggctttgtcagtctgctctaca

SEQ ID NO: 434608 - DNA, 25 bp, Mus musculus
cgtcactaggaactggtcggctttg

SEQ ID NO: 434609 - DNA, 25 bp, Mus musculus
ccttcccaagtgtgagaaactcaag

SEQ ID NO: 434610 - DNA, 25 bp, Mus musculus
caacttctgaacctcatgcggcgtc

SEQ ID NO: 434611 - DNA, 25 bp, Mus musculus
ctcccggctagtagagacagaaatc

SEQ ID NO: 434612 - DNA, 25 bp, Mus musculus
cccaaggtgtcgctgagacccttga

SEQ ID NO: 434613 - DNA, 25 bp, Mus musculus
ctctcgtaaagttccgccgcgcgtg

SEQ ID NO: 434614 - DNA, 25 bp, Mus musculus
tagagtcgcctaacatccatttccg

SEQ ID NO: 434615 - DNA, 25 bp, Mus musculus
aggacgccggatcacgcgcccgtta

SEQ ID NO: 434616 - DNA, 25 bp, Mus musculus
ccgcgcgtggaacaaaggccttcaa

SEQ ID NO: 434617 - DNA, 25 bp, Mus musculus
cgctccggagcctctcgtaaagttc

SEQ ID NO: 434618 - DNA, 25 bp, Mus musculus
tggcagagcacgctccggagcctct

SEQ ID NO: 434619 - DNA, 25 bp, Mus musculus
agacccttgactgcgtctccggggc

SEQ ID NO: 434620 - DNA, 25 bp, Mus musculus
taacatccatttccgtacgttctgc

SEQ ID NO: 434621 - DNA, 25 bp, Mus musculus
atagaaggtaggctgtagagtcgcc

SEQ ID NO: 434622 - DNA, 25 bp, Mus musculus
caaagtaaccctccactctaaggcg

SEQ ID NO: 434623 - DNA, 25 bp, Mus musculus
ggagatgaattgcttccgggtttca

SEQ ID NO: 434624 - DNA, 25 bp, Mus musculus
acccgcggtgtgttccggagatgaa

SEQ ID NO: 434625 - DNA, 25 bp, Mus musculus
tggaacaaaggccttcaagccacgc

SEQ ID NO: 434626 - DNA, 25 bp, Mus musculus
atccgccgttttgacgaggtccaga

SEQ ID NO: 434627 - DNA, 25 bp, Mus musculus
caggtgtgtcgcctgtcctctctac

SEQ ID NO: 434628 - DNA, 25 bp, Mus musculus
cgattggcgctcttcgtctgagcga

SEQ ID NO: 434629 - DNA, 25 bp, Mus musculus
gcgtctttttcctggggccaagcca

SEQ ID NO: 434630 - DNA, 25 bp, Mus musculus
cagccctagtcttggggtgcagacg

SEQ ID NO: 434631 - DNA, 25 bp, Mus musculus
actacagtcctggttgctcgcctgc

SEQ ID NO: 434632 - DNA, 25 bp, Mus musculus
agcaaagaccctgagggcccgaaga

SEQ ID NO: 434633 - DNA, 25 bp, Mus musculus
attcattgctttcttccgggcaggg

SEQ ID NO: 434634 - DNA, 25 bp, Mus musculus
gcccgcgagccgcatttattcattg

SEQ ID NO: 434635 - DNA, 25 bp, Mus musculus
gtcttccgtgaactagcccgcgagc

SEQ ID NO: 434636 - DNA, 25 bp, Mus musculus
cagcttaggcttggtcttccgtgaa

SEQ ID NO: 434637 - DNA, 25 bp, Mus musculus
ggtccactgacccatcagcttaggc

SEQ ID NO: 434638 - DNA, 25 bp, Mus musculus
gaactttctgggaacaggtccactg

SEQ ID NO: 434639 - DNA, 25 bp, Mus musculus
cgggcttcctgcgtggagttctaac

SEQ ID NO: 434640 - DNA, 25 bp, Mus musculus
tggggagtctctagatcaccctcca

SEQ ID NO: 434641 - DNA, 25 bp, Mus musculus
gaggtcctggatcccatcttttcgc

SEQ ID NO: 434642 - DNA, 25 bp, Mus musculus
agaccgcgcaggacactaccactgg

SEQ ID NO: 434643 - DNA, 25 bp, Mus musculus
tttgatgtaagtggcctgacccgcg

SEQ ID NO: 434644 - DNA, 25 bp, Mus musculus
tccagtgggttcagtccagatagcc

SEQ ID NO: 434645 - DNA, 25 bp, Mus musculus
ctctgaatgatttcggctgcgtttt

SEQ ID NO: 434646 - DNA, 25 bp, Mus musculus
gactgctcgcccgattctctctggg

SEQ ID NO: 434647 - DNA, 25 bp, Mus musculus
gagctcacactcgaccttccagaga

SEQ ID NO: 434648 - DNA, 25 bp, Mus musculus
gggccgcttggtttcagcctagatt

SEQ ID NO: 434649 - DNA, 25 bp, Mus musculus
ttcagcctagattcccgacctcaga

SEQ ID NO: 434650 - DNA, 25 bp, Mus musculus
gaaccgtcggcggtagcatcttttc

SEQ ID NO: 434651 - DNA, 25 bp, Mus musculus
aggccctggagcctttccactagca

SEQ ID NO: 434652 - DNA, 25 bp, Mus musculus
tctcgtcgtgatagtgcgtgaggtc

SEQ ID NO: 434653 - DNA, 25 bp, Mus musculus
tcgcctttctgaggtctcgtcgtga

SEQ ID NO: 434654 - DNA, 25 bp, Mus musculus
attcctccaaggagcggcctgagcc

SEQ ID NO: 434655 - DNA, 25 bp, Mus musculus
ctcccgaagccggtgcaggtcttct

SEQ ID NO: 434656 - DNA, 25 bp, Mus musculus
cgccacggacggcacagacaatggt

SEQ ID NO: 434657 - DNA, 25 bp, Mus musculus
cagacaatggtgctctatcccggga

SEQ ID NO: 434658 - DNA, 25 bp, Mus musculus
ctggccgcctggagcatttgcatat

SEQ ID NO: 434659 - DNA, 25 bp, Mus musculus
tgctcacggcccgtcgaaggttcct

SEQ ID NO: 434660 - DNA, 25 bp, Mus musculus
agcatttgcatatggcccggggaca

SEQ ID NO: 434661 - DNA, 25 bp, Mus musculus
tagcctgctttgttggctgcgcacg

SEQ ID NO: 434662 - DNA, 25 bp, Mus musculus
agctcgccagacaaagccgccgggg

SEQ ID NO: 434663 - DNA, 25 bp, Mus musculus
aggtcttctcgccacggacggcaca

SEQ ID NO: 434664 - DNA, 25 bp, Mus musculus
tcagtgcgtgcctactcggtctgac

SEQ ID NO: 434665 - DNA, 25 bp, Mus musculus
gcgccgtgtctaattcctccaagga

SEQ ID NO: 434666 - DNA, 25 bp, Mus musculus
gccgtgacgcgaatcccaatgctca

SEQ ID NO: 434667 - DNA, 25 bp, Mus musculus
ggatgccgcgccgtgtctaattcct

SEQ ID NO: 434668 - DNA, 25 bp, Mus musculus
ccggacaaagatagcaaagaggagg

SEQ ID NO: 434669 - DNA, 25 bp, Mus musculus
gcagtgccggccaagctgactcctg

SEQ ID NO: 434670 - DNA, 25 bp, Mus musculus
tctccggcagggcagtgccggccaa

SEQ ID NO: 434671 - DNA, 25 bp, Mus musculus
tgttctcccggtctccggcagggca

SEQ ID NO: 434672 - DNA, 25 bp, Mus musculus
gcgccttggaagagcaggcacagca

SEQ ID NO: 434673 - DNA, 25 bp, Mus musculus
ttcgtggttgtaccggacaaagata

SEQ ID NO: 434674 - DNA, 25 bp, Mus musculus
cagcgtcggtttcgtggttgtaccg

SEQ ID NO: 434675 - DNA, 25 bp, Mus musculus
cccagtgccacagggcagcgtcggt

SEQ ID NO: 434676 - DNA, 25 bp, Mus musculus
gttgtccacgttactgtggttgccc

SEQ ID NO: 434677 - DNA, 25 bp, Mus musculus
aaaactcgttgtccacgttactgtg

SEQ ID NO: 434678 - DNA, 25 bp, Mus musculus
tagcgaaagtaaaactcgttgtcca

SEQ ID NO: 434679 - DNA, 25 bp, Mus musculus
cactcacttgggtagcgaaagtaaa

SEQ ID NO: 434680 - DNA, 25 bp, Mus musculus
cgcccgcactcacttgggtagcgaa

SEQ ID NO: 434681 - DNA, 25 bp, Mus musculus
ccatgaacgcggctgtgttctcccg

SEQ ID NO: 434682 - DNA, 25 bp, Mus musculus
gagccagctaactgcccgtgctttg

SEQ ID NO: 434683 - DNA, 25 bp, Mus musculus
ttccgctctcggagtcgctagtctt

SEQ ID NO: 434684 - DNA, 25 bp, Mus musculus
catccctccgtagaggcgtgactta

SEQ ID NO: 434685 - DNA, 25 bp, Mus musculus
ggccttgcttcctatgctcggtcca

SEQ ID NO: 434686 - DNA, 25 bp, Mus musculus
cccgtgtcctttacagcatgatttc

SEQ ID NO: 434687 - DNA, 25 bp, Mus musculus
catcctattcgcgttcggttcttta

SEQ ID NO: 434688 - DNA, 25 bp, Mus musculus
cgctagtctttacgtgtgcttcatc

SEQ ID NO: 434689 - DNA, 25 bp, Mus musculus
gttcagggaagggatgtctctctcc

SEQ ID NO: 434690 - DNA, 25 bp, Mus musculus
tccagtgctcgtgctcagtgagttc

SEQ ID NO: 434691 - DNA, 25 bp, Mus musculus
tcattcctgaggaggcagcgttttc

SEQ ID NO: 434692 - DNA, 25 bp, Mus musculus
ggcacttcagaggttagcaggtttc

SEQ ID NO: 434693 - DNA, 25 bp, Mus musculus
ggggctaatactgtcgattggccta

SEQ ID NO: 434694 - DNA, 25 bp, Mus musculus
tgccctctctatctaacttgccttg

SEQ ID NO: 434695 - DNA, 25 bp, Mus musculus
gccttgcctttcttgcgtagagggc

SEQ ID NO: 434696 - DNA, 25 bp, Mus musculus
gccgttgtcctgctttgcggccgcg

SEQ ID NO: 434697 - DNA, 25 bp, Mus musculus
cggcgccgttgtcctgctttgcggc

SEQ ID NO: 434698 - DNA, 25 bp, Mus musculus
ggtagctgccgccacccggttggac

SEQ ID NO: 434699 - DNA, 25 bp, Mus musculus
aaaggcctgcacaggtagctgccgc

SEQ ID NO: 434700 - DNA, 25 bp, Mus musculus
gtttcatggacaaaggcctgcacag

SEQ ID NO: 434701 - DNA, 25 bp, Mus musculus
tgtgtttcatggacaaaggcctgca

SEQ ID NO: 434702 - DNA, 25 bp, Mus musculus
cggggatgtgtgtttcatggacaaa

SEQ ID NO: 434703 - DNA, 25 bp, Mus musculus
cggcggtgtgtagcgaaatcgaacg

SEQ ID NO: 434704 - DNA, 25 bp, Mus musculus
tccccgtcgcgggtaccatggaggc

SEQ ID NO: 434705 - DNA, 25 bp, Mus musculus
gctgggcgccggttaacacccactc

SEQ ID NO: 434706 - DNA, 25 bp, Mus musculus
cccgcttttggaggcgtgagcaagc

SEQ ID NO: 434707 - DNA, 25 bp, Mus musculus
cccgctcccgcttttggaggcgtga

SEQ ID NO: 434708 - DNA, 25 bp, Mus musculus
cggcaggcggttagagtcctcgccc

SEQ ID NO: 434709 - DNA, 25 bp, Mus musculus
aatcgaacgggaggatggcgacagc

SEQ ID NO: 434710 - DNA, 25 bp, Mus musculus
ggcgacagctctcagtgcctcacga

SEQ ID NO: 434711 - DNA, 25 bp, Mus musculus
gaaggcgtatgctccgtacagcaga

SEQ ID NO: 434712 - DNA, 25 bp, Mus musculus
catcgaaaggcaggaaggcgtatgc

SEQ ID NO: 434713 - DNA, 25 bp, Mus musculus
ccgtacagcagacaggggaagaaga

SEQ ID NO: 434714 - DNA, 25 bp, Mus musculus
accaccgaggcgacagctctcagtg

SEQ ID NO: 434715 - DNA, 25 bp, Mus musculus
cgtcgcgatgcaggatgcgctcctc

SEQ ID NO: 434716 - DNA, 25 bp, Mus musculus
tgcctcacgacctccacagcttcca

SEQ ID NO: 434717 - DNA, 25 bp, Mus musculus
ggggtctcaccacggcctcagccca

SEQ ID NO: 434718 - DNA, 25 bp, Mus musculus
agcccacttgcgctctgggggctca

SEQ ID NO: 434719 - DNA, 25 bp, Mus musculus
ggcaggaaattcctgagctcgcctg

SEQ ID NO: 434720 - DNA, 25 bp, Mus musculus
aattcctgagctcgcctggtccagc

SEQ ID NO: 434721 - DNA, 25 bp, Mus musculus
tcgcctggtccagcgtcgcgatgca

SEQ ID NO: 434722 - DNA, 25 bp, Mus musculus
aggatgcgctcctcctgtggcttcc

SEQ ID NO: 434723 - DNA, 25 bp, Mus musculus
ggaagaagatgagggccgccaccac

SEQ ID NO: 434724 - DNA, 25 bp, Mus musculus
ccgaggacttaagcccagcagaagc

SEQ ID NO: 434725 - DNA, 25 bp, Mus musculus
atttttcgcgagacttggtgggttg

SEQ ID NO: 434726 - DNA, 25 bp, Mus musculus
ctaggcggatgagcctgcgctagaa

SEQ ID NO: 434727 - DNA, 25 bp, Mus musculus
agcctgcgctagaacgctcagtttc

SEQ ID NO: 434728 - DNA, 25 bp, Mus musculus
tgcgctagaacgctcagtttctcta

SEQ ID NO: 434729 - DNA, 25 bp, Mus musculus
aacgctcagtttctctacatctgtg

SEQ ID NO: 434730 - DNA, 25 bp, Mus musculus
tctctacatctgtggcaataaagtg

SEQ ID NO: 434731 - DNA, 25 bp, Mus musculus
tacatctgtggcaataaagtgtccc

SEQ ID NO: 434732 - DNA, 25 bp, Mus musculus
gccatgccacccacaaccagctcgg

SEQ ID NO: 434733 - DNA, 25 bp, Mus musculus
accagctcggttgacttcccggaga

SEQ ID NO: 434734 - DNA, 25 bp, Mus musculus
ctcggttgacttcccggagagagaa

SEQ ID NO: 434735 - DNA, 25 bp, Mus musculus
tcccggagagagaaggcaatttttc

SEQ ID NO: 434736 - DNA, 25 bp, Mus musculus
agaaggcaatttttcgcgagacttg

SEQ ID NO: 434737 - DNA, 25 bp, Mus musculus
ttaagcccagcagaagccatgccac

SEQ ID NO: 434738 - DNA, 25 bp, Mus musculus
tgctcgtcacatctgctacttcctg

SEQ ID NO: 434739 - DNA, 25 bp, Mus musculus
taccgctgctggtcttcctactgcc

SEQ ID NO: 434740 - DNA, 25 bp, Mus musculus
aggtgcctggcgcaggtacttcctg

SEQ ID NO: 434741 - DNA, 25 bp, Mus musculus
caggtacttcctgtggcgcctcctg

SEQ ID NO: 434742 - DNA, 25 bp, Mus musculus
ctgtggcgcctcctggcgttaggca

SEQ ID NO: 434743 - DNA, 25 bp, Mus musculus
ctggcgttaggcagcccgggctttc

SEQ ID NO: 434744 - DNA, 25 bp, Mus musculus
ggacccataccacctaccgctgctg

SEQ ID NO: 434745 - DNA, 25 bp, Mus musculus
gcctctatcccttcgcatcctgctg

SEQ ID NO: 434746 - DNA, 25 bp, Mus musculus
gcatcctgctgtgcgcacaccttta

SEQ ID NO: 434747 - DNA, 25 bp, Mus musculus
gtgcgcacacctttagctccatgtc

SEQ ID NO: 434748 - DNA, 25 bp, Mus musculus
acctttagctccatgtcgcctcgtg

SEQ ID NO: 434749 - DNA, 25 bp, Mus musculus
tctgctacttcctggactacggggc

SEQ ID NO: 434750 - DNA, 25 bp, Mus musculus
atgtcgcctcgtgctcgtcacatct

SEQ ID NO: 434751 - DNA, 25 bp, Mus musculus
ttagctccatgtcgcctcgtgctcg

SEQ ID NO: 434752 - DNA, 25 bp, Mus musculus
acccgcgcggaatttgtccctgcaa

SEQ ID NO: 434753 - DNA, 25 bp, Mus musculus
accaggaacacattgccgcgggagc

SEQ ID NO: 434754 - DNA, 25 bp, Mus musculus
ctgcaagcccaccttgtaaagagga

SEQ ID NO: 434755 - DNA, 25 bp, Mus musculus
gggctcttatactctgtgcatttgc

SEQ ID NO: 434756 - DNA, 25 bp, Mus musculus
cagctccctgtgacgcattgtggtc

SEQ ID NO: 434757 - DNA, 25 bp, Mus musculus
gcggcatgcagattcggtactcctt

SEQ ID NO: 434758 - DNA, 25 bp, Mus musculus
ggcgtcccaacagatgagcaaggct

SEQ ID NO: 434759 - DNA, 25 bp, Mus musculus
tggtgcgctcagctcctaactgcct

SEQ ID NO: 434760 - DNA, 25 bp, Mus musculus
agcatgtcaagcttcgggtcccggt

SEQ ID NO: 434761 - DNA, 25 bp, Mus musculus
tcagccctctcggtattgcaaagtc

SEQ ID NO: 434762 - DNA, 25 bp, Mus musculus
aacgcacaaaagtctcctctggatc

SEQ ID NO: 434763 - DNA, 25 bp, Mus musculus
ctccgaaagcagagctgaacctggc

SEQ ID NO: 434764 - DNA, 25 bp, Mus musculus
cagtggctaccaccacggccggtta

SEQ ID NO: 434765 - DNA, 25 bp, Mus musculus
cgtctaccgtgggttaatgtcacca

SEQ ID NO: 434766 - DNA, 25 bp, Mus musculus
actatggcgtccaggagtttcaccc

SEQ ID NO: 434767 - DNA, 25 bp, Mus musculus
cagcagagctctgcgctcatctggc

SEQ ID NO: 434768 - DNA, 25 bp, Mus musculus
gctcacctcagccatgttgaaattg

SEQ ID NO: 434769 - DNA, 25 bp, Mus musculus
acctccgattggaggccgcggaatg

SEQ ID NO: 434770 - DNA, 25 bp, Mus musculus
ccaaaataaactggccctgcagctc

SEQ ID NO: 434771 - DNA, 25 bp, Mus musculus
cacagcttccggagaggagccctca

SEQ ID NO: 434772 - DNA, 25 bp, Mus musculus
cttctggaggaaagtgtctactatg

SEQ ID NO: 434773 - DNA, 25 bp, Mus musculus
tcctgtcggcgactagcttctggag

SEQ ID NO: 434774 - DNA, 25 bp, Mus musculus
gcgggacttacgatcctgcgacaga

SEQ ID NO: 434775 - DNA, 25 bp, Mus musculus
cgccaagcgtatctcgcgggactta

SEQ ID NO: 434776 - DNA, 25 bp, Mus musculus
gcccacgtgactgcgccaagcgtat

SEQ ID NO: 434777 - DNA, 25 bp, Mus musculus
agacagcaactgcaatccgaccttc

SEQ ID NO: 434778 - DNA, 25 bp, Mus musculus
cagatgacctctggggaaggacgtc

SEQ ID NO: 434779 - DNA, 25 bp, Mus musculus
ccctggcgcgttaggtctacgtaag

SEQ ID NO: 434780 - DNA, 25 bp, Mus musculus
acttgttgcgcagccgcacgaactt

SEQ ID NO: 434781 - DNA, 25 bp, Mus musculus
cctggtactcgtccagctgctgctg

SEQ ID NO: 434782 - DNA, 25 bp, Mus musculus
ggatctccatgtccagggccagctt

SEQ ID NO: 434783 - DNA, 25 bp, Mus musculus
gctttcgataggcatggatctccat

SEQ ID NO: 434784 - DNA, 25 bp, Mus musculus
tcgccctccagcagctttcgatagg

SEQ ID NO: 434785 - DNA, 25 bp, Mus musculus
gttagtcatggtagttgcggccaga

SEQ ID NO: 434786 - DNA, 25 bp, Mus musculus
tgcctccaccctgagactgggatga

SEQ ID NO: 434787 - DNA, 25 bp, Mus musculus
gcgctttttggtgacgctgcctcca

SEQ ID NO: 434788 - DNA, 25 bp, Mus musculus
agactccagcttgcgctttttggtg

SEQ ID NO: 434789 - DNA, 25 bp, Mus musculus
tccggctctcggaagactccagctt

SEQ ID NO: 434790 - DNA, 25 bp, Mus musculus
tgcgagcatgctgcgagaagctgct

SEQ ID NO: 434791 - DNA, 25 bp, Mus musculus
acacgcccgctagtgcgagcatgct

SEQ ID NO: 434792 - DNA, 25 bp, Mus musculus
acgaactttccctcttcatcgactt

SEQ ID NO: 434793 - DNA, 25 bp, Mus musculus
tggtatcgcgctcacgggccagcga

SEQ ID NO: 434794 - DNA, 25 bp, Mus musculus
gaccacctcttcagactcagtgatg

SEQ ID NO: 434795 - DNA, 25 bp, Mus musculus
gactagatggccagttacaggcgac

SEQ ID NO: 434796 - DNA, 25 bp, Mus musculus
gccaggcggtcattgagctcctgca

SEQ ID NO: 434797 - DNA, 25 bp, Mus musculus
acgcgatcgatgtacacggccaggc

SEQ ID NO: 434798 - DNA, 25 bp, Mus musculus
ccagggaacgcacgcgatcgatgta

SEQ ID NO: 434799 - DNA, 25 bp, Mus musculus
actcagtgatgcgaaggcgcagccc

SEQ ID NO: 434800 - DNA, 25 bp, Mus musculus
ccgcgttctcggtctccagggaacg

SEQ ID NO: 434801 - DNA, 25 bp, Mus musculus
ttgatgccggacacctctcggctga

SEQ ID NO: 434802 - DNA, 25 bp, Mus musculus
agctcggcctcgtaggccgccttga

SEQ ID NO: 434803 - DNA, 25 bp, Mus musculus
gaatcaagggtcttgcgggcatccc

SEQ ID NO: 434804 - DNA, 25 bp, Mus musculus
gcgctccttggccacagaatcaagg

SEQ ID NO: 434805 - DNA, 25 bp, Mus musculus
tcacgcactttgctcagctctagct

SEQ ID NO: 434806 - DNA, 25 bp, Mus musculus
tcgctcctggcaggcgtggagatct

SEQ ID NO: 434807 - DNA, 25 bp, Mus musculus
tacaggcgactgctgcctccctggt

SEQ ID NO: 434808 - DNA, 25 bp, Mus musculus
ttttcccgtgaccagtgggcagagc

SEQ ID NO: 434809 - DNA, 25 bp, Mus musculus
cccggccctcattaccataagaaag

SEQ ID NO: 434810 - DNA, 25 bp, Mus musculus
gctgctccatccagttcatttaaaa

SEQ ID NO: 434811 - DNA, 25 bp, Mus musculus
tgctccaccagctctctcccagagg

SEQ ID NO: 434812 - DNA, 25 bp, Mus musculus
cccgtgaccagtgggcagagcccga

SEQ ID NO: 434813 - DNA, 25 bp, Mus musculus
acaaaagagtttgagcgctggaagg

SEQ ID NO: 434814 - DNA, 25 bp, Mus musculus
cccgaggcttttcccgtgaccagtg

SEQ ID NO: 434815 - DNA, 25 bp, Mus musculus
gctcctaaaatttctcggaccacaa

SEQ ID NO: 434816 - DNA, 25 bp, Mus musculus
tgccagctcctaaaatttctcggac

SEQ ID NO: 434817 - DNA, 25 bp, Mus musculus
acacccgctcccttcccgcatactg

SEQ ID NO: 434818 - DNA, 25 bp, Mus musculus
ggcagaggagaaacgcctttccaca

SEQ ID NO: 434819 - DNA, 25 bp, Mus musculus
acccgcgggcagaggagaaacgcct

SEQ ID NO: 434820 - DNA, 25 bp, Mus musculus
cattaccataagaaagaggcccggg

SEQ ID NO: 434821 - DNA, 25 bp, Mus musculus
gtcagttccatgctgctccatccag

SEQ ID NO: 434822 - DNA, 25 bp, Mus musculus
agttcatcgcttccttctttgcgcg

SEQ ID NO: 434823 - DNA, 25 bp, Mus musculus
cgactgaagggcagcagcaacacca

SEQ ID NO: 434824 - DNA, 25 bp, Mus musculus
agcagcaacaccacggagtgcgttc

SEQ ID NO: 434825 - DNA, 25 bp, Mus musculus
gcaacaccacggagtgcgttcccgt

SEQ ID NO: 434826 - DNA, 25 bp, Mus musculus
agtgcgttcccgtgcccacctccga

SEQ ID NO: 434827 - DNA, 25 bp, Mus musculus
acctccgagcacgtggccgagatcg

SEQ ID NO: 434828 - DNA, 25 bp, Mus musculus
ctccgagcacgtggccgagatcgtg

SEQ ID NO: 434829 - DNA, 25 bp, Mus musculus
caaggtaagcgggcgtctggacact

SEQ ID NO: 434830 - DNA, 25 bp, Mus musculus
tctggacactgcgagggttggagtg

SEQ ID NO: 434831 - DNA, 25 bp, Mus musculus
tgcgcgctctacaaagaggccgagc

SEQ ID NO: 434832 - DNA, 25 bp, Mus musculus
gcacggaaagttcatcgcttccttc

SEQ ID NO: 434833 - DNA, 25 bp, Mus musculus
aagctctgcgcgctctacaaagagg

SEQ ID NO: 434834 - DNA, 25 bp, Mus musculus
cccggcacggaaagttcatcgcttc

SEQ ID NO: 434835 - DNA, 25 bp, Mus musculus
acaaagaggccgagctgcgactgaa

SEQ ID NO: 434836 - DNA, 25 bp, Mus musculus
tgtgcgcaccggcaagattcttgaa

SEQ ID NO: 434837 - DNA, 25 bp, Mus musculus
gcgacttcctggctggcagccctga

SEQ ID NO: 434838 - DNA, 25 bp, Mus musculus
ggagagccactgcagggtttctcta

SEQ ID NO: 434839 - DNA, 25 bp, Mus musculus
actatggcgtggcagagacaagccc

SEQ ID NO: 434840 - DNA, 25 bp, Mus musculus
tgtgggcaagcaggacgtgtactat

SEQ ID NO: 434841 - DNA, 25 bp, Mus musculus
ggatatctgtttccgggctacggtg

SEQ ID NO: 434842 - DNA, 25 bp, Mus musculus
ggggactttggctacagcggatatc

SEQ ID NO: 434843 - DNA, 25 bp, Mus musculus
atccagcagcagaccaacacgtaca

SEQ ID NO: 434844 - DNA, 25 bp, Mus musculus
ctgccttggacagccgctactcaga

SEQ ID NO: 434845 - DNA, 25 bp, Mus musculus
cgcaacaagtctggcgccgcctttg

SEQ ID NO: 434846 - DNA, 25 bp, Mus musculus
ccgtgtttgagataaccggcgcacc

SEQ ID NO: 434847 - DNA, 25 bp, Mus musculus
aggccaagtgaccatccgtgtacga

SEQ ID NO: 434848 - DNA, 25 bp, Mus musculus
tgtacgagtaccctaccgcgtggtg

SEQ ID NO: 434849 - DNA, 25 bp, Mus musculus
atgctccaggctgtaagccgctctc

SEQ ID NO: 434850 - DNA, 25 bp, Mus musculus
cccagctacgaggcgcctgggagtt

SEQ ID NO: 434851 - DNA, 25 bp, Mus musculus
gagttgtagtcaccgggcccatcta

SEQ ID NO: 434852 - DNA, 25 bp, Mus musculus
accgggcccatctactgaggctctg

SEQ ID NO: 434853 - DNA, 25 bp, Mus musculus
tactgaggctctggcccaattcccg

SEQ ID NO: 434854 - DNA, 25 bp, Mus musculus
gggaatcgtagtttcatgtgatcgc

SEQ ID NO: 434855 - DNA, 25 bp, Mus musculus
tgatcgctcaaggaattctgggaac

SEQ ID NO: 434856 - DNA, 25 bp, Mus musculus
cagtggcaacggtggaaatactttt

SEQ ID NO: 434857 - DNA, 25 bp, Mus musculus
ttctgggaaccatagttcagcgttc

SEQ ID NO: 434858 - DNA, 25 bp, Mus musculus
catagttcagcgttccagtgggacc

SEQ ID NO: 434859 - DNA, 25 bp, Mus musculus
cgttccagtgggaccatgtggttgt

SEQ ID NO: 434860 - DNA, 25 bp, Mus musculus
acgccttcgtgcctactggtcaatc

SEQ ID NO: 434861 - DNA, 25 bp, Mus musculus
atcttccacgcgaaggacgccttcg

SEQ ID NO: 434862 - DNA, 25 bp, Mus musculus
aatacttttaacatcttccacgcga

SEQ ID NO: 434863 - DNA, 25 bp, Mus musculus
gtagtttcatgtgatcgctcaagga

SEQ ID NO: 434864 - DNA, 25 bp, Mus musculus
cgcggagagtgcgttactaggcaac

SEQ ID NO: 434865 - DNA, 25 bp, Mus musculus
tctggactcgcttaaggaccgaccg

SEQ ID NO: 434866 - DNA, 25 bp, Mus musculus
aggaattcgcgctctgctctggact

SEQ ID NO: 434867 - DNA, 25 bp, Mus musculus
ctggccacaaaggagcacccggagc

SEQ ID NO: 434868 - DNA, 25 bp, Mus musculus
cgtcctggatctcaaagcggtgagc

SEQ ID NO: 434869 - DNA, 25 bp, Mus musculus
ccaaattcgtgtcgttgctgcagga

SEQ ID NO: 434870 - DNA, 25 bp, Mus musculus
gtcacttcctgccatttaaactcgg

SEQ ID NO: 434871 - DNA, 25 bp, Mus musculus
ccaaaagcacgctccgcctgaggga

SEQ ID NO: 434872 - DNA, 25 bp, Mus musculus
atgagcgctccaggccgaccaaaag

SEQ ID NO: 434873 - DNA, 25 bp, Mus musculus
cacctgatcagggatgagcgctcca

SEQ ID NO: 434874 - DNA, 25 bp, Mus musculus
tgagccttacaatacttgcacctga

SEQ ID NO: 434875 - DNA, 25 bp, Mus musculus
cctatttacgcgaagatgagcctta

SEQ ID NO: 434876 - DNA, 25 bp, Mus musculus
ggacgcggcgttctcctatttacgc

SEQ ID NO: 434877 - DNA, 25 bp, Mus musculus
gcctgggcttgcttaccaccaaatt

SEQ ID NO: 434878 - DNA, 25 bp, Mus musculus
ggccacgactgctcgaatccgcaga

SEQ ID NO: 434879 - DNA, 25 bp, Mus musculus
cggaggccacgactgctcgaatccg

SEQ ID NO: 434880 - DNA, 25 bp, Mus musculus
tttgtccgaacaggagggagccgca

SEQ ID NO: 434881 - DNA, 25 bp, Mus musculus
tcctttgtccgaacaggagggagcc

SEQ ID NO: 434882 - DNA, 25 bp, Mus musculus
caacgaaagtcctttgtccgaacag

SEQ ID NO: 434883 - DNA, 25 bp, Mus musculus
agacggcgacaacgaaagtcctttg

SEQ ID NO: 434884 - DNA, 25 bp, Mus musculus
ggaacggagataagacggcgacaac

SEQ ID NO: 434885 - DNA, 25 bp, Mus musculus
atccgcagaggtcttaaggacgtcc

SEQ ID NO: 434886 - DNA, 25 bp, Mus musculus
gcctctcaagaaaaccaagtgaccc

SEQ ID NO: 434887 - DNA, 25 bp, Mus musculus
caggcctctcaagaaaaccaagtga

SEQ ID NO: 434888 - DNA, 25 bp, Mus musculus
tgaaccaggaacgaacccaggcctc

SEQ ID NO: 434889 - DNA, 25 bp, Mus musculus
gtcttaaggacgtcctgaaccagga

SEQ ID NO: 434890 - DNA, 25 bp, Mus musculus
cgcagaggtcttaaggacgtcctga

SEQ ID NO: 434891 - DNA, 25 bp, Mus musculus
tgctcgaatccgcagaggtcttaag

SEQ ID NO: 434892 - DNA, 25 bp, Mus musculus
catttggagcctaggcttgaggaga

SEQ ID NO: 434893 - DNA, 25 bp, Mus musculus
cactggtagaggttccaggcgctaa

SEQ ID NO: 434894 - DNA, 25 bp, Mus musculus
gttccaggcgctaaggcaccgtgcg

SEQ ID NO: 434895 - DNA, 25 bp, Mus musculus
tccaggcgctaaggcaccgtgcggc

SEQ ID NO: 434896 - DNA, 25 bp, Mus musculus
agcgagctgcggctatgctctcccg

SEQ ID NO: 434897 - DNA, 25 bp, Mus musculus
ccagggtcactggtagaggttccag

SEQ ID NO: 434898 - DNA, 25 bp, Mus musculus
cttgaggagagtgtgctccagggtc

SEQ ID NO: 434899 - DNA, 25 bp, Mus musculus
tccatttggagcctaggcttgagga

SEQ ID NO: 434900 - DNA, 25 bp, Mus musculus
ggctccatttggagcctaggcttga

SEQ ID NO: 434901 - DNA, 25 bp, Mus musculus
gcttgcgggctccatttggagccta

SEQ ID NO: 434902 - DNA, 25 bp, Mus musculus
cggctatgctctcccgggagtgtcg

SEQ ID NO: 434903 - DNA, 25 bp, Mus musculus
ttgcttgcgggctccatttggagcc

SEQ ID NO: 434904 - DNA, 25 bp, Mus musculus
tgcggctatgctctcccgggagtgt

SEQ ID NO: 434905 - DNA, 25 bp, Mus musculus
ctccagggtcactggtagaggttcc

SEQ ID NO: 434906 - DNA, 25 bp, Mus musculus
tcctagccggggttggacctgcttg

SEQ ID NO: 434907 - DNA, 25 bp, Mus musculus
cactgcctgactggcgagggcctca

SEQ ID NO: 434908 - DNA, 25 bp, Mus musculus
ttggacctgcttgagtgggagaccc

SEQ ID NO: 434909 - DNA, 25 bp, Mus musculus
cgtgcatccttggtgtcttcctagc

SEQ ID NO: 434910 - DNA, 25 bp, Mus musculus
actgcgggctggagcgtgcatcctt

SEQ ID NO: 434911 - DNA, 25 bp, Mus musculus
tgagtcacggcgtggagcctgtcta

SEQ ID NO: 434912 - DNA, 25 bp, Mus musculus
ctgcctgagtgcgagaagctggcca

SEQ ID NO: 434913 - DNA, 25 bp, Mus musculus
actacagcgccacggtggaccagcg

SEQ ID NO: 434914 - DNA, 25 bp, Mus musculus
tggaagtggactacagcgccacggt

SEQ ID NO: 434915 - DNA, 25 bp, Mus musculus
cgcattgtgaagatggaagtggact

SEQ ID NO: 434916 - DNA, 25 bp, Mus musculus
caggggactcttaggcagggaccat

SEQ ID NO: 434917 - DNA, 25 bp, Mus musculus
aacctggggtacagcaggggactct

SEQ ID NO: 434918 - DNA, 25 bp, Mus musculus
ttccgacgcactgcctgagtggatg

SEQ ID NO: 434919 - DNA, 25 bp, Mus musculus
accagcgcctgcctgagtgcgagaa

SEQ ID NO: 434920 - DNA, 25 bp, Mus musculus
tcagatccgtttccggtctttcgga

SEQ ID NO: 434921 - DNA, 25 bp, Mus musculus
agcgcggtacacactgctgtggctt

SEQ ID NO: 434922 - DNA, 25 bp, Mus musculus
gcagcgcggtacacactgctgtggc

SEQ ID NO: 434923 - DNA, 25 bp, Mus musculus
ccggcagcgcggtacacactgctgt

SEQ ID NO: 434924 - DNA, 25 bp, Mus musculus
gggagacgcaagagcgctggggtcc

SEQ ID NO: 434925 - DNA, 25 bp, Mus musculus
tgagtctgggagacgcaagagcgct

SEQ ID NO: 434926 - DNA, 25 bp, Mus musculus
ctcacggtgagtctgggagacgcaa

SEQ ID NO: 434927 - DNA, 25 bp, Mus musculus
cccagggaggcgtttggggtgctca

SEQ ID NO: 434928 - DNA, 25 bp, Mus musculus
tttccggttgtctgtggcccaggga

SEQ ID NO: 434929 - DNA, 25 bp, Mus musculus
ttgttttccggttgtctgtggccca

SEQ ID NO: 434930 - DNA, 25 bp, Mus musculus
tctttcggaggctgacgttgttttc

SEQ ID NO: 434931 - DNA, 25 bp, Mus musculus
cggtctttcggaggctgacgttgtt

SEQ ID NO: 434932 - DNA, 25 bp, Mus musculus
tccggtctttcggaggctgacgttg

SEQ ID NO: 434933 - DNA, 25 bp, Mus musculus
cgcggtacacactgctgtggcttgg

SEQ ID NO: 434934 - DNA, 25 bp, Mus musculus
tgtcgggttcctagggacgacgctc

SEQ ID NO: 434935 - DNA, 25 bp, Mus musculus
tcccgcggctcacgctggattatgt

SEQ ID NO: 434936 - DNA, 25 bp, Mus musculus
aagttgctccggtaagggatcgagc

SEQ ID NO: 434937 - DNA, 25 bp, Mus musculus
gggccgctcggaagaaagttgctcc

SEQ ID NO: 434938 - DNA, 25 bp, Mus musculus
agctgagctgggttaccagtggttc

SEQ ID NO: 434939 - DNA, 25 bp, Mus musculus
cacccgcgcagcttctgtgcgggga

SEQ ID NO: 434940 - DNA, 25 bp, Mus musculus
ttgcttgcggccgtgcccgctagcg

SEQ ID NO: 434941 - DNA, 25 bp, Mus musculus
gacccgcgtctccagcacccgcgca

SEQ ID NO: 434942 - DNA, 25 bp, Mus musculus
gaggaccgcaacgtgacccgcgtct

SEQ ID NO: 434943 - DNA, 25 bp, Mus musculus
caggcaaccaaggtgggctggctct

SEQ ID NO: 434944 - DNA, 25 bp, Mus musculus
tgtctcggatcgaatccctcactcg

SEQ ID NO: 434945 - DNA, 25 bp, Mus musculus
cgctggattatgtctcggatcgaat

SEQ ID NO: 434946 - DNA, 25 bp, Mus musculus
ctagggacgacgctcttgggcaccc

SEQ ID NO: 434947 - DNA, 25 bp, Mus musculus
ggctcacgctggattatgtctcgga

SEQ ID NO: 434948 - DNA, 25 bp, Mus musculus
agatccgccggcagcttgcagcctt

SEQ ID NO: 434949 - DNA, 25 bp, Mus musculus
ggctgaagagatccgccggcagctt

SEQ ID NO: 434950 - DNA, 25 bp, Mus musculus
atccgccggcagcttgcagccttgg

SEQ ID NO: 434951 - DNA, 25 bp, Mus musculus
cggcagcttgcagccttgggccaaa

SEQ ID NO: 434952 - DNA, 25 bp, Mus musculus
gcagcttgcagccttgggccaaaac

SEQ ID NO: 434953 - DNA, 25 bp, Mus musculus
agcttgcagccttgggccaaaacga

SEQ ID NO: 434954 - DNA, 25 bp, Mus musculus
agccttgggccaaaacgagccactc

SEQ ID NO: 434955 - DNA, 25 bp, Mus musculus
aaacgagccactcccggcagaagcg

SEQ ID NO: 434956 - DNA, 25 bp, Mus musculus
ggctcgcaggcctctggacccacgg

SEQ ID NO: 434957 - DNA, 25 bp, Mus musculus
cctctggacccacggcgccgcagcc

SEQ ID NO: 434958 - DNA, 25 bp, Mus musculus
agcggctcggggaagagcgggcaac

SEQ ID NO: 434959 - DNA, 25 bp, Mus musculus
ccacggcgccgcagccttccagcgg

SEQ ID NO: 434960 - DNA, 25 bp, Mus musculus
caaaacgagccactcccggcagaag

SEQ ID NO: 434961 - DNA, 25 bp, Mus musculus
agcgggcaactgaagctggcagcct

SEQ ID NO: 434962 - DNA, 25 bp, Mus musculus
tacacaaaggaaggccgtgggcctc

SEQ ID NO: 434963 - DNA, 25 bp, Mus musculus
acttgtcttccaggcaactcgcttg

SEQ ID NO: 434964 - DNA, 25 bp, Mus musculus
actcgcttgcccacaataaaaatgg

SEQ ID NO: 434965 - DNA, 25 bp, Mus musculus
atggattctcctagcccgcaactcg

SEQ ID NO: 434966 - DNA, 25 bp, Mus musculus
gcactcctgtcactgagacgccaga

SEQ ID NO: 434967 - DNA, 25 bp, Mus musculus
gccagacgctttaaatcaccgaggg

SEQ ID NO: 434968 - DNA, 25 bp, Mus musculus
ggtccaatcggaatcaagagtcctc

SEQ ID NO: 434969 - DNA, 25 bp, Mus musculus
ccgtctagtaggacgcgtccggatg

SEQ ID NO: 434970 - DNA, 25 bp, Mus musculus
tcggagccttttagaaggacgagcc

SEQ ID NO: 434971 - DNA, 25 bp, Mus musculus
tagataggaatctcgggcacgtctc

SEQ ID NO: 434972 - DNA, 25 bp, Mus musculus
ttttcctacctgtaggcgccgcagc

SEQ ID NO: 434973 - DNA, 25 bp, Mus musculus
gcgccgcagcaaatgggatcagcca

SEQ ID NO: 434974 - DNA, 25 bp, Mus musculus
gccgtggctgccaagatcaatgcta

SEQ ID NO: 434975 - DNA, 25 bp, Mus musculus
ccgagccgagtctccggatggaagt

SEQ ID NO: 434976 - DNA, 25 bp, Mus musculus
caccgtgaaagaacgtgacagtgtc

SEQ ID NO: 434977 - DNA, 25 bp, Mus musculus
cgccatcttccaggacccgggcggg

SEQ ID NO: 434978 - DNA, 25 bp, Mus musculus
acccggcctcaaagctggtttcaga

SEQ ID NO: 434979 - DNA, 25 bp, Mus musculus
ggcctcaaagctggtttcagaggta

SEQ ID NO: 434980 - DNA, 25 bp, Mus musculus
caaagctggtttcagaggtacaggc

SEQ ID NO: 434981 - DNA, 25 bp, Mus musculus
agctggtttcagaggtacaggctca

SEQ ID NO: 434982 - DNA, 25 bp, Mus musculus
gtttcagaggtacaggctcaggtga

SEQ ID NO: 434983 - DNA, 25 bp, Mus musculus
cagaggtacaggctcaggtgaacag

SEQ ID NO: 434984 - DNA, 25 bp, Mus musculus
acggccaccgtgaaagaacgtgaca

SEQ ID NO: 434985 - DNA, 25 bp, Mus musculus
cggagcagagtatctgtcagctgtg

SEQ ID NO: 434986 - DNA, 25 bp, Mus musculus
acgtgacagtgtcaggcagcgctct

SEQ ID NO: 434987 - DNA, 25 bp, Mus musculus
gacagtgtcaggcagcgctctgcac

SEQ ID NO: 434988 - DNA, 25 bp, Mus musculus
tgtcaggcagcgctctgcactcatc

SEQ ID NO: 434989 - DNA, 25 bp, Mus musculus
ggagccacggccaccgtgaaagaac

SEQ ID NO: 434990 - DNA, 25 bp, Mus musculus
catctggcgcatgctccttgacgcg

SEQ ID NO: 434991 - DNA, 25 bp, Mus musculus
cacgtcagccggtgccgttgcgtta

SEQ ID NO: 434992 - DNA, 25 bp, Mus musculus
cttgacgcggaggtcccgcgcatcg

SEQ ID NO: 434993 - DNA, 25 bp, Mus musculus
gacctgggctaacgttgagcgctga

SEQ ID NO: 434994 - DNA, 25 bp, Mus musculus
tgcccaggatgaggggcgtctgctc

SEQ ID NO: 434995 - DNA, 25 bp, Mus musculus
cagcacgttagacgtggggctcccg

SEQ ID NO: 434996 - DNA, 25 bp, Mus musculus
aagcagcacgttagacgtggggctc

SEQ ID NO: 434997 - DNA, 25 bp, Mus musculus
cctctgagggtatttggtagtgtgt

SEQ ID NO: 434998 - DNA, 25 bp, Mus musculus
ttccgcgggatcagagcgggcctct

SEQ ID NO: 434999 - DNA, 25 bp, Mus musculus
gttgcgttacttccgctggtgcagg

SEQ ID NO: 435000 - DNA, 25 bp, Mus musculus
tcagccggtgccgttgcgttacttc

SEQ ID NO: 435001 - DNA, 25 bp, Mus musculus
cgcatgctccttgacgcggaggtcc

SEQ ID NO: 435002 - DNA, 25 bp, Mus musculus
gatcatctggcgcatgctccttgac

SEQ ID NO: 435003 - DNA, 25 bp, Mus musculus
ccgttgcgttacttccgctggtgca

SEQ ID NO: 435004 - DNA, 25 bp, Mus musculus
cgaaacccgcgaaatgtcccaactg

SEQ ID NO: 435005 - DNA, 25 bp, Mus musculus
gcgatcggctgttgtctctccgttc

SEQ ID NO: 435006 - DNA, 25 bp, Mus musculus
tgcccgatccggtatctgaagtgaa

SEQ ID NO: 435007 - DNA, 25 bp, Mus musculus
ttccttctgcgcctcagactgtggc

SEQ ID NO: 435008 - DNA, 25 bp, Mus musculus
ggcctcccgattcgttggtctccga

SEQ ID NO: 435009 - DNA, 25 bp, Mus musculus
gtgcctgacctgctggttccaccag

SEQ ID NO: 435010 - DNA, 25 bp, Mus musculus
agcgcagcatcctgtaggggtcaca

SEQ ID NO: 435011 - DNA, 25 bp, Mus musculus
agtgtccggcctgttctgtacaaga

SEQ ID NO: 435012 - DNA, 25 bp, Mus musculus
aggtttcctggccatgcagtgtccg

SEQ ID NO: 435013 - DNA, 25 bp, Mus musculus
ccattaggatgagtcgaggcgtata

SEQ ID NO: 435014 - DNA, 25 bp, Mus musculus
gcctcacctttcagatccattagga

SEQ ID NO: 435015 - DNA, 25 bp, Mus musculus
ctcgcacgccacacgggaaaacttg

SEQ ID NO: 435016 - DNA, 25 bp, Mus musculus
ctgaagtgaactgatgctagggccc

SEQ ID NO: 435017 - DNA, 25 bp, Mus musculus
ttcttggaatgtaggaagctgccgc

SEQ ID NO: 435018 - DNA, 25 bp, Mus musculus
actatccagcgaaaccacagccaag

SEQ ID NO: 435019 - DNA, 25 bp, Mus musculus
agacatgagaggtgtagaataagtg

SEQ ID NO: 435020 - DNA, 25 bp, Mus musculus
aaattcaatgaagcgcgggtaaacg

SEQ ID NO: 435021 - DNA, 25 bp, Mus musculus
gactctcttaaggtagccaaatgcc

SEQ ID NO: 435022 - DNA, 25 bp, Mus musculus
aggtagccaaatgcctcgtcatcta

SEQ ID NO: 435023 - DNA, 25 bp, Mus musculus
gccaaatgcctcgtcatctaattag

SEQ ID NO: 435024 - DNA, 25 bp, Mus musculus
atctaattagtgacgcgcatgaatg

SEQ ID NO: 435025 - DNA, 25 bp, Mus musculus
gcgcatgaatggatgaacgagattc

SEQ ID NO: 435026 - DNA, 25 bp, Mus musculus
atgaacgagattcccactgtcccta

SEQ ID NO: 435027 - DNA, 25 bp, Mus musculus
tgtccctacctactatccagcgaaa

SEQ ID NO: 435028 - DNA, 25 bp, Mus musculus
ccacagccaagggaacgggcttggc

SEQ ID NO: 435029 - DNA, 25 bp, Mus musculus
gcttgactctagtctggcacggtga

SEQ ID NO: 435030 - DNA, 25 bp, Mus musculus
gaagaccctgttgagcttgactcta

SEQ ID NO: 435031 - DNA, 25 bp, Mus musculus
tctggcacggtgaagagacatgaga

SEQ ID NO: 435032 - DNA, 25 bp, Mus musculus
ttctcaccaaagttcacgcggctgc

SEQ ID NO: 435033 - DNA, 25 bp, Mus musculus
ttggtgtcaccaatcgaagccgcgg

SEQ ID NO: 435034 - DNA, 25 bp, Mus musculus
cccacgaggaatcgatagaggacta

SEQ ID NO: 435035 - DNA, 25 bp, Mus musculus
agtgacgccatccacaagctcagga

SEQ ID NO: 435036 - DNA, 25 bp, Mus musculus
ccagtcaattgagagctttccagcc

SEQ ID NO: 435037 - DNA, 25 bp, Mus musculus
cgactcagtggagcttcgcctacta

SEQ ID NO: 435038 - DNA, 25 bp, Mus musculus
ttcgcctactagcatgccatggacg

SEQ ID NO: 435039 - DNA, 25 bp, Mus musculus
gccatggacgtttttcataggttta

SEQ ID NO: 435040 - DNA, 25 bp, Mus musculus
ttgagaagaagcctcccaccggtga

SEQ ID NO: 435041 - DNA, 25 bp, Mus musculus
aggttccacgcatcgcctcgctagg

SEQ ID NO: 435042 - DNA, 25 bp, Mus musculus
tggtcgtcacccacgaaaggcgaaa

SEQ ID NO: 435043 - DNA, 25 bp, Mus musculus
agaagtctgtccttccggtctcaga

SEQ ID NO: 435044 - DNA, 25 bp, Mus musculus
ttccgggaagacgagccagtcaatt

SEQ ID NO: 435045 - DNA, 25 bp, Mus musculus
tccggtctcagatgcttggtgtcac

SEQ ID NO: 435046 - DNA, 25 bp, Mus musculus
cagacagcagctcgcgtaaggaatg

SEQ ID NO: 435047 - DNA, 25 bp, Mus musculus
tggggaagtcacagtccacaatttg

SEQ ID NO: 435048 - DNA, 25 bp, Mus musculus
tttggactctaacccggctgaattc

SEQ ID NO: 435049 - DNA, 25 bp, Mus musculus
cctagagggtcgcagatcacattac

SEQ ID NO: 435050 - DNA, 25 bp, Mus musculus
gcttaaccttcccagatcccaattg

SEQ ID NO: 435051 - DNA, 25 bp, Mus musculus
ccaattgcagctttgcgggcggatt

SEQ ID NO: 435052 - DNA, 25 bp, Mus musculus
ttcaccgagttcctgggatcctagg

SEQ ID NO: 435053 - DNA, 25 bp, Mus musculus
ggcttcttaggataccgacactgtc

SEQ ID NO: 435054 - DNA, 25 bp, Mus musculus
tacatctatgcatccgctagccggc

SEQ ID NO: 435055 - DNA, 25 bp, Mus musculus
ccataatgctttgtggggacgttga

SEQ ID NO: 435056 - DNA, 25 bp, Mus musculus
tatctggctactagggcaggatcgc

SEQ ID NO: 435057 - DNA, 25 bp, Mus musculus
ccttgagaagtctcgcaggcgctga

SEQ ID NO: 435058 - DNA, 25 bp, Mus musculus
tgcagccgggttctcttgagttacc

SEQ ID NO: 435059 - DNA, 25 bp, Mus musculus
ggacacgccgtgttgattgaatgca

SEQ ID NO: 435060 - DNA, 25 bp, Mus musculus
gccagggaagccgaggcgccaggct

SEQ ID NO: 435061 - DNA, 25 bp, Mus musculus
gcacgcggcgcccttcgctggctcg

SEQ ID NO: 435062 - DNA, 25 bp, Mus musculus
ccattttgggttcgctttgcggagg

SEQ ID NO: 435063 - DNA, 25 bp, Mus musculus
gagacgatcccggtctcggttgccg

SEQ ID NO: 435064 - DNA, 25 bp, Mus musculus
gacgatcccggtctcggttgccgga

SEQ ID NO: 435065 - DNA, 25 bp, Mus musculus
tcggttgccggacccgccttctctc

SEQ ID NO: 435066 - DNA, 25 bp, Mus musculus
ccgacctacgcctttggcttctcct

SEQ ID NO: 435067 - DNA, 25 bp, Mus musculus
tttggcttctcctctctcgcgtttc

SEQ ID NO: 435068 - DNA, 25 bp, Mus musculus
gcttctcctctctcgcgtttccgcc

SEQ ID NO: 435069 - DNA, 25 bp, Mus musculus
tccgccggtccgcttacccgctggc

SEQ ID NO: 435070 - DNA, 25 bp, Mus musculus
ctggccgcctcctgacaagcgggaa

SEQ ID NO: 435071 - DNA, 25 bp, Mus musculus
gcctcctgacaagcgggaagggtta

SEQ ID NO: 435072 - DNA, 25 bp, Mus musculus
gttacagtgtggagccagggaagcc

SEQ ID NO: 435073 - DNA, 25 bp, Mus musculus
cctgacaagcgggaagggttacagt

SEQ ID NO: 435074 - DNA, 25 bp, Mus musculus
tctcgaccggagttccttgaaggtg

SEQ ID NO: 435075 - DNA, 25 bp, Mus musculus
ctgcgatctttcttggcctgcggca

SEQ ID NO: 435076 - DNA, 25 bp, Mus musculus
gaaggtgctacttctgggaaagagc

SEQ ID NO: 435077 - DNA, 25 bp, Mus musculus
cccgagtgggaggagaataagctcc

SEQ ID NO: 435078 - DNA, 25 bp, Mus musculus
taagctcccactggggataggcgca

SEQ ID NO: 435079 - DNA, 25 bp, Mus musculus
gaccacccggtcagaggcgtaaaga

SEQ ID NO: 435080 - DNA, 25 bp, Mus musculus
ggagcaaagagttagtcccttcact

SEQ ID NO: 435081 - DNA, 25 bp, Mus musculus
tgcgaggcggatgcctcctcaccag

SEQ ID NO: 435082 - DNA, 25 bp, Mus musculus
aggctgcagcccaagtcgatttttc

SEQ ID NO: 435083 - DNA, 25 bp, Mus musculus
agtcgatttttcttcctccgcggag

SEQ ID NO: 435084 - DNA, 25 bp, Mus musculus
agttccttgaaggtggtgacttctc

SEQ ID NO: 435085 - DNA, 25 bp, Mus musculus
tctcggggaggtgccaaagaacctc

SEQ ID NO: 435086 - DNA, 25 bp, Mus musculus
actatgagccagtcgctgcgatctt

SEQ ID NO: 435087 - DNA, 25 bp, Mus musculus
tcagtgtcgggcgagaagactatga

SEQ ID NO: 435088 - DNA, 25 bp, Mus musculus
ggagcttcacccgatccgagacacg

SEQ ID NO: 435089 - DNA, 25 bp, Mus musculus
aaattacctcgtgtgagcatgggcc

SEQ ID NO: 435090 - DNA, 25 bp, Mus musculus
tggcctagttcgctgattggctaaa

SEQ ID NO: 435091 - DNA, 25 bp, Mus musculus
tgccacggactaggcggcaagaaac

SEQ ID NO: 435092 - DNA, 25 bp, Mus musculus
aggctcaggaggcagaacataaata

SEQ ID NO: 435093 - DNA, 25 bp, Mus musculus
tgcggcttacacctaaaagctgagc

SEQ ID NO: 435094 - DNA, 25 bp, Mus musculus
gctctcacctgttcttcaacgcgga

SEQ ID NO: 435095 - DNA, 25 bp, Mus musculus
gcttgtcatctgtcccggcactggt

SEQ ID NO: 435096 - DNA, 25 bp, Mus musculus
tggtcctttagtgcctcggagcttc

SEQ ID NO: 435097 - DNA, 25 bp, Mus musculus
tcggcggtgtcggtacacccatacc

SEQ ID NO: 435098 - DNA, 25 bp, Mus musculus
cgtaactccaacacggactggtcct

SEQ ID NO: 435099 - DNA, 25 bp, Mus musculus
gacgccagcgtttagaaattcacga

SEQ ID NO: 435100 - DNA, 25 bp, Mus musculus
gccttgtgacggctggccaatgaaa

SEQ ID NO: 435101 - DNA, 25 bp, Mus musculus
attctcccggggtccaagatgtttg

SEQ ID NO: 435102 - DNA, 25 bp, Mus musculus
ctcgatttctactgctttgtggctg

SEQ ID NO: 435103 - DNA, 25 bp, Mus musculus
ctcctgctcgatttctactgctttg

SEQ ID NO: 435104 - DNA, 25 bp, Mus musculus
cggtagcactggtgtccctcgctct

SEQ ID NO: 435105 - DNA, 25 bp, Mus musculus
tctactgctttgtggctgccgaaga

SEQ ID NO: 435106 - DNA, 25 bp, Mus musculus
actgctttgtggctgccgaagaccc

SEQ ID NO: 435107 - DNA, 25 bp, Mus musculus
gccgaagacccggagagagaacttg

SEQ ID NO: 435108 - DNA, 25 bp, Mus musculus
gacccggagagagaacttgttgacc

SEQ ID NO: 435109 - DNA, 25 bp, Mus musculus
agagaacttgttgaccgtcggctgc

SEQ ID NO: 435110 - DNA, 25 bp, Mus musculus
ttgaccgtcggctgcagcagcgtcc

SEQ ID NO: 435111 - DNA, 25 bp, Mus musculus
cgcctcttcggctcgggcgcagact

SEQ ID NO: 435112 - DNA, 25 bp, Mus musculus
tccatgattgccctcactcgtaggg

SEQ ID NO: 435113 - DNA, 25 bp, Mus musculus
cccaaccggtccagggccatggcgg

SEQ ID NO: 435114 - DNA, 25 bp, Mus musculus
cgacagacgtgcgagagctgcgccc

SEQ ID NO: 435115 - DNA, 25 bp, Mus musculus
aacttgttgaccgtcggctgcagca

SEQ ID NO: 435116 - DNA, 25 bp, Mus musculus
tcgagacccgaaccaagaggcgcac

SEQ ID NO: 435117 - DNA, 25 bp, Mus musculus
agaaattaggagtgtcgggctctcg

SEQ ID NO: 435118 - DNA, 25 bp, Mus musculus
acggcaacgggatatggagaaatta

SEQ ID NO: 435119 - DNA, 25 bp, Mus musculus
tggctaccgccagacggacggcaac

SEQ ID NO: 435120 - DNA, 25 bp, Mus musculus
ggccgcggaaagatggctaccgcca

SEQ ID NO: 435121 - DNA, 25 bp, Mus musculus
gccatcacggacttcctgtgggaca

SEQ ID NO: 435122 - DNA, 25 bp, Mus musculus
gtggaaccgcacttcgtcgccgcgg

SEQ ID NO: 435123 - DNA, 25 bp, Mus musculus
ccatcagaggctgggaagtgacgca

SEQ ID NO: 435124 - DNA, 25 bp, Mus musculus
aagcggctcactggcccgaagggcc

SEQ ID NO: 435125 - DNA, 25 bp, Mus musculus
gtgacaagctccgagcgcctcgaga

SEQ ID NO: 435126 - DNA, 25 bp, Mus musculus
ccaccgcttctctaactctggaagg

SEQ ID NO: 435127 - DNA, 25 bp, Mus musculus
gagcgcctcgagacccgaaccaaga

SEQ ID NO: 435128 - DNA, 25 bp, Mus musculus
cgggctctcgaagcagcagagtagc

SEQ ID NO: 435129 - DNA, 25 bp, Mus musculus
ttctctaactctggaaggcgcaggg

SEQ ID NO: 435130 - DNA, 25 bp, Mus musculus
tttcggcagtcctatgaataccatc

SEQ ID NO: 435131 - DNA, 25 bp, Mus musculus
cagcagccgaaggaaacacagaagg

SEQ ID NO: 435132 - DNA, 25 bp, Mus musculus
agcagttaccgaagccagcgcagca

SEQ ID NO: 435133 - DNA, 25 bp, Mus musculus
taccatcgagagaacagcagttacc

SEQ ID NO: 435134 - DNA, 25 bp, Mus musculus
ggcagtcctatgaataccatcgaga

SEQ ID NO: 435135 - DNA, 25 bp, Mus musculus
acgacacagactttcggcagtccta

SEQ ID NO: 435136 - DNA, 25 bp, Mus musculus
ggaggcttactacgacacagacttt

SEQ ID NO: 435137 - DNA, 25 bp, Mus musculus
acagaggggaggcttactacgacac

SEQ ID NO: 435138 - DNA, 25 bp, Mus musculus
gcgcaatgactacagccgggacaga

SEQ ID NO: 435139 - DNA, 25 bp, Mus musculus
atcggcggtactgtggcagctacag

SEQ ID NO: 435140 - DNA, 25 bp, Mus musculus
aggagacggagccggacattcagcc

SEQ ID NO: 435141 - DNA, 25 bp, Mus musculus
tccgatcggcggctgtacgatcggc

SEQ ID NO: 435142 - DNA, 25 bp, Mus musculus
tgtggcagctacaggcgcaatgact

SEQ ID NO: 435143 - DNA, 25 bp, Mus musculus
ttaccgaagccagcgcagcagccga

SEQ ID NO: 435144 - DNA, 25 bp, Mus musculus
gagggccacctcatctaccacgtcg

SEQ ID NO: 435145 - DNA, 25 bp, Mus musculus
ggacgacgctgagggccacctcatc

SEQ ID NO: 435146 - DNA, 25 bp, Mus musculus
ccaagagtgtagaggacgacgctga

SEQ ID NO: 435147 - DNA, 25 bp, Mus musculus
agcagccggagagccaagagtgtag

SEQ ID NO: 435148 - DNA, 25 bp, Mus musculus
cgatccgacacctggcttgctccga

SEQ ID NO: 435149 - DNA, 25 bp, Mus musculus
gggcgcctgtgaccggtgaccccta

SEQ ID NO: 435150 - DNA, 25 bp, Mus musculus
atctgacgtgttcccttccactgtc

SEQ ID NO: 435151 - DNA, 25 bp, Mus musculus
agcacatctgacgtgttcccttcca

SEQ ID NO: 435152 - DNA, 25 bp, Mus musculus
ttagcacatctgacgtgttcccttc

SEQ ID NO: 435153 - DNA, 25 bp, Mus musculus
cgccttagcacatctgacgtgttcc

SEQ ID NO: 435154 - DNA, 25 bp, Mus musculus
tccgccttagcacatctgacgtgtt

SEQ ID NO: 435155 - DNA, 25 bp, Mus musculus
gatccgccttagcacatctgacgtg

SEQ ID NO: 435156 - DNA, 25 bp, Mus musculus
gccgctctctcttctcacaccgatc

SEQ ID NO: 435157 - DNA, 25 bp, Mus musculus
tctcttctcacaccgatccgcctta

SEQ ID NO: 435158 - DNA, 25 bp, Mus musculus
tcagagcagagacaccgggaatcca

SEQ ID NO: 435159 - DNA, 25 bp, Mus musculus
ggttgtttcaaccaattggagcaca

SEQ ID NO: 435160 - DNA, 25 bp, Mus musculus
ggcgagcttgacaatccctttcagg

SEQ ID NO: 435161 - DNA, 25 bp, Mus musculus
gcagtccactgctgctgcgggaatc

SEQ ID NO: 435162 - DNA, 25 bp, Mus musculus
gcgactcttccggttgtttcaacca

SEQ ID NO: 435163 - DNA, 25 bp, Mus musculus
tcaaccaattggagcacagggaagc

SEQ ID NO: 435164 - DNA, 25 bp, Mus musculus
cagggaagcgagtggaccaagcaca

SEQ ID NO: 435165 - DNA, 25 bp, Mus musculus
ccaagcacaccggagggagttcttt

SEQ ID NO: 435166 - DNA, 25 bp, Mus musculus
cggccgggttcacttgcaaacatgg

SEQ ID NO: 435167 - DNA, 25 bp, Mus musculus
ggttcacttgcaaacatggctcaga

SEQ ID NO: 435168 - DNA, 25 bp, Mus musculus
acttgcaaacatggctcagagcaga

SEQ ID NO: 435169 - DNA, 25 bp, Mus musculus
gactccggcgagcttgacaatccct

SEQ ID NO: 435170 - DNA, 25 bp, Mus musculus
aatccctttcaggtgatttgcgccg

SEQ ID NO: 435171 - DNA, 25 bp, Mus musculus
tccactgctgctgcgggaatcttcg

SEQ ID NO: 435172 - DNA, 25 bp, Mus musculus
cgctccgtcgattatgtgctcttcc

SEQ ID NO: 435173 - DNA, 25 bp, Mus musculus
acagctgctcgcagttgccaccggt

SEQ ID NO: 435174 - DNA, 25 bp, Mus musculus
ctcctgcccgagcaccagctcgacg

SEQ ID NO: 435175 - DNA, 25 bp, Mus musculus
tgggaccttgtttccccgagctgag

SEQ ID NO: 435176 - DNA, 25 bp, Mus musculus
tgccaccggttagaaggctggccgc

SEQ ID NO: 435177 - DNA, 25 bp, Mus musculus
cagttgccaccggttagaaggctgg

SEQ ID NO: 435178 - DNA, 25 bp, Mus musculus
gctcgcagttgccaccggttagaag

SEQ ID NO: 435179 - DNA, 25 bp, Mus musculus
aagacagtcccttgccaaggcgacc

SEQ ID NO: 435180 - DNA, 25 bp, Mus musculus
tgaagacagtcccttgccaaggcga

SEQ ID NO: 435181 - DNA, 25 bp, Mus musculus
ggtccctttgaagacagtcccttgc

SEQ ID NO: 435182 - DNA, 25 bp, Mus musculus
gctactgccttagcctggactgcgg

SEQ ID NO: 435183 - DNA, 25 bp, Mus musculus
cgcgcaggctactgccttagcctgg

SEQ ID NO: 435184 - DNA, 25 bp, Mus musculus
gtcgattatgtgctcttccgctcca

SEQ ID NO: 435185 - DNA, 25 bp, Mus musculus
ttatgtgctcttccgctccatccag

SEQ ID NO: 435186 - DNA, 25 bp, Mus musculus
cagtttctctcaagacgcatgcgtc

SEQ ID NO: 435187 - DNA, 25 bp, Mus musculus
ctaggaaatccggacgtaaggcgcg

SEQ ID NO: 435188 - DNA, 25 bp, Mus musculus
gccgcatgttttccactgcgcgtta

SEQ ID NO: 435189 - DNA, 25 bp, Mus musculus
ggggcacttgccaaactgcacatgg

SEQ ID NO: 435190 - DNA, 25 bp, Mus musculus
gtccagacgcgcttgggactttcgc

SEQ ID NO: 435191 - DNA, 25 bp, Mus musculus
accttctcgtatgcgtcggccttct

SEQ ID NO: 435192 - DNA, 25 bp, Mus musculus
ttgtacgctctctgacccggaagca

SEQ ID NO: 435193 - DNA, 25 bp, Mus musculus
agactatccaggtccaccgacggca

SEQ ID NO: 435194 - DNA, 25 bp, Mus musculus
tcagaggacaggtgcatgagccctc

SEQ ID NO: 435195 - DNA, 25 bp, Mus musculus
tccggctctccagagatcagaggac

SEQ ID NO: 435196 - DNA, 25 bp, Mus musculus
catcggccttcgactgcctcagttt

SEQ ID NO: 435197 - DNA, 25 bp, Mus musculus
catgcgtctcggttctcggcaaagc

SEQ ID NO: 435198 - DNA, 25 bp, Mus musculus
gctgcctgtcgccatggaaacaaaa

SEQ ID NO: 435199 - DNA, 25 bp, Mus musculus
gcagttgccttcgtaacgggaactc

SEQ ID NO: 435200 - DNA, 25 bp, Mus musculus
aggctccggccgtggtcagcagcat

SEQ ID NO: 435201 - DNA, 25 bp, Mus musculus
tgtgtttcattgtgtctgtgcgcga

SEQ ID NO: 435202 - DNA, 25 bp, Mus musculus
ggatcgctccgctctcgggttgcgc

SEQ ID NO: 435203 - DNA, 25 bp, Mus musculus
cgtgcgtgagtttctgtgtgtttca

SEQ ID NO: 435204 - DNA, 25 bp, Mus musculus
tgctgcgcccgtgtccactcgggaa

SEQ ID NO: 435205 - DNA, 25 bp, Mus musculus
ccctcccagctttaggttctttgtg

SEQ ID NO: 435206 - DNA, 25 bp, Mus musculus
gttctttgtgtctcgcgtggagcca

SEQ ID NO: 435207 - DNA, 25 bp, Mus musculus
ggggtcctaccttcgatgcaacaca

SEQ ID NO: 435208 - DNA, 25 bp, Mus musculus
acccgccacagtcccgaatgggtga

SEQ ID NO: 435209 - DNA, 25 bp, Mus musculus
tcgtccatggtcaggttggtgccgt

SEQ ID NO: 435210 - DNA, 25 bp, Mus musculus
agatgtgcgcgctggagtacagcca

SEQ ID NO: 435211 - DNA, 25 bp, Mus musculus
tacagccagtagtcggtgccgatgg

SEQ ID NO: 435212 - DNA, 25 bp, Mus musculus
ctgcgcggggctcaaactccgaggc

SEQ ID NO: 435213 - DNA, 25 bp, Mus musculus
tcgcatcgcaccatggtgggcgcct

SEQ ID NO: 435214 - DNA, 25 bp, Mus musculus
aggtccacagtgtccctgccacagg

SEQ ID NO: 435215 - DNA, 25 bp, Mus musculus
cacagtgtccctgccacaggctctc

SEQ ID NO: 435216 - DNA, 25 bp, Mus musculus
acaggctctccatcgaggaccatgg

SEQ ID NO: 435217 - DNA, 25 bp, Mus musculus
caggctctccatcgaggaccatggc

SEQ ID NO: 435218 - DNA, 25 bp, Mus musculus
aggctctccatcgaggaccatggcg

SEQ ID NO: 435219 - DNA, 25 bp, Mus musculus
ggctctccatcgaggaccatggcga

SEQ ID NO: 435220 - DNA, 25 bp, Mus musculus
tctccatcgaggaccatggcgaggc

SEQ ID NO: 435221 - DNA, 25 bp, Mus musculus
tccatcgaggaccatggcgaggctg

SEQ ID NO: 435222 - DNA, 25 bp, Mus musculus
ccaggcccgcccagctccttggcgc

SEQ ID NO: 435223 - DNA, 25 bp, Mus musculus
ccatcgaggaccatggcgaggctga

SEQ ID NO: 435224 - DNA, 25 bp, Mus musculus
gtacggcgagcacaacggtgagcgc

SEQ ID NO: 435225 - DNA, 25 bp, Mus musculus
ccctgcgggtgacgaccgtgccctc

SEQ ID NO: 435226 - DNA, 25 bp, Mus musculus
cgggcgccctgccacaggtccacag

SEQ ID NO: 435227 - DNA, 25 bp, Mus musculus
cacaggctctccatcgaggaccatg

SEQ ID NO: 435228 - DNA, 25 bp, Mus musculus
acgctaaagcagtgcgcgcgcttgc

SEQ ID NO: 435229 - DNA, 25 bp, Mus musculus
gaaggccactttccaacgctaaagc

SEQ ID NO: 435230 - DNA, 25 bp, Mus musculus
ttgaatggctgttgcctggcaatcc

SEQ ID NO: 435231 - DNA, 25 bp, Mus musculus
gcgcgcttgctctttaaatactcag

SEQ ID NO: 435232 - DNA, 25 bp, Mus musculus
actcagactgagaggcgcagagcca

SEQ ID NO: 435233 - DNA, 25 bp, Mus musculus
agccatcgccatggtgacgggtgtc

SEQ ID NO: 435234 - DNA, 25 bp, Mus musculus
ggtgtcccagcaaccgaattgaatg

SEQ ID NO: 435235 - DNA, 25 bp, Mus musculus
tggtttactccgcaacctccgcttg

SEQ ID NO: 435236 - DNA, 25 bp, Mus musculus
agttgtaactgctcctgctggttta

SEQ ID NO: 435237 - DNA, 25 bp, Mus musculus
gggactaagaactgtttgcctacta

SEQ ID NO: 435238 - DNA, 25 bp, Mus musculus
ccgtcttgtattcgttgggactaag

SEQ ID NO: 435239 - DNA, 25 bp, Mus musculus
tccgttcctgcacctccgaaatgtt

SEQ ID NO: 435240 - DNA, 25 bp, Mus musculus
cctaaatacttgtgggcgaactgac

SEQ ID NO: 435241 - DNA, 25 bp, Mus musculus
ggtgccgcccacctaaatacttgtg

SEQ ID NO: 435242 - DNA, 25 bp, Mus musculus
caaggcgcgtagaggaagaagtaaa

SEQ ID NO: 435243 - DNA, 25 bp, Mus musculus
gaagtaaagcaagtccacgttggcc

SEQ ID NO: 435244 - DNA, 25 bp, Mus musculus
gcctgcgtacagacaaccgcgccgg

SEQ ID NO: 435245 - DNA, 25 bp, Mus musculus
tctttctccagggacacggattgga

SEQ ID NO: 435246 - DNA, 25 bp, Mus musculus
ccagggacacggattggaccacgga

SEQ ID NO: 435247 - DNA, 25 bp, Mus musculus
atgggtaaccgcaccggcgggatgc

SEQ ID NO: 435248 - DNA, 25 bp, Mus musculus
aactagcatttcctccggacaggcg

SEQ ID NO: 435249 - DNA, 25 bp, Mus musculus
gtggtcctcttttctccgtagcctc

SEQ ID NO: 435250 - DNA, 25 bp, Mus musculus
ttctccgtagcctcggtaaagctga

SEQ ID NO: 435251 - DNA, 25 bp, Mus musculus
tagcctcggtaaagctgacgtgtcc

SEQ ID NO: 435252 - DNA, 25 bp, Mus musculus
taaagctgacgtgtcctgggaacta

SEQ ID NO: 435253 - DNA, 25 bp, Mus musculus
gacgtgtcctgggaactagcatttc

SEQ ID NO: 435254 - DNA, 25 bp, Mus musculus
tgggaactagcatttcctccggaca

SEQ ID NO: 435255 - DNA, 25 bp, Mus musculus
cgctgcacccaaggcgcgtagagga

SEQ ID NO: 435256 - DNA, 25 bp, Mus musculus
tctgaactcagattttcgaagagca

SEQ ID NO: 435257 - DNA, 25 bp, Mus musculus
cagcgtttcggggtatcctccgatt

SEQ ID NO: 435258 - DNA, 25 bp, Mus musculus
ggtatcctccgattgtccacaagtt

SEQ ID NO: 435259 - DNA, 25 bp, Mus musculus
gtccacaagttccagccggtatcga

SEQ ID NO: 435260 - DNA, 25 bp, Mus musculus
tgtgggtctccagaacaaaacggca

SEQ ID NO: 435261 - DNA, 25 bp, Mus musculus
tcgaagagcagtgtataaccaacct

SEQ ID NO: 435262 - DNA, 25 bp, Mus musculus
taaccaacctggatctgagcgcggc

SEQ ID NO: 435263 - DNA, 25 bp, Mus musculus
ggccgaaattgtcctaagaactaca

SEQ ID NO: 435264 - DNA, 25 bp, Mus musculus
cagttcccagaaggcagcccggaaa

SEQ ID NO: 435265 - DNA, 25 bp, Mus musculus
gtagtagaaagggacttccggatgc

SEQ ID NO: 435266 - DNA, 25 bp, Mus musculus
acttccggatgctgatgcgggcctt

SEQ ID NO: 435267 - DNA, 25 bp, Mus musculus
cagcgcggcacacggaggtacgctt

SEQ ID NO: 435268 - DNA, 25 bp, Mus musculus
gagcgcggccgaaattgtcctaaga

SEQ ID NO: 435269 - DNA, 25 bp, Mus musculus
ccggtatcgatgtgggtctccagaa

SEQ ID NO: 435270 - DNA, 25 bp, Mus musculus
ctgtaattacatcgggccaggacgc

SEQ ID NO: 435271 - DNA, 25 bp, Mus musculus
cttccctcctaggaggtgggccctg

SEQ ID NO: 435272 - DNA, 25 bp, Mus musculus
ggttcgaagtttatccgctgcccta

SEQ ID NO: 435273 - DNA, 25 bp, Mus musculus
tttactcaagcatacgccaccggtg

SEQ ID NO: 435274 - DNA, 25 bp, Mus musculus
ggtcagggtccgtctttactcaagc

SEQ ID NO: 435275 - DNA, 25 bp, Mus musculus
ttactgagctccaactaggtgccgc

SEQ ID NO: 435276 - DNA, 25 bp, Mus musculus
ttttttacggccaggcttggcggca

SEQ ID NO: 435277 - DNA, 25 bp, Mus musculus
agcttccgaggcttccaggccgttt

SEQ ID NO: 435278 - DNA, 25 bp, Mus musculus
ccctggtctctcttctttgcggctg

SEQ ID NO: 435279 - DNA, 25 bp, Mus musculus
ccgtaaagtcaaaagctgagtgctt

SEQ ID NO: 435280 - DNA, 25 bp, Mus musculus
tcgagtgcattcttggagccgtaaa

SEQ ID NO: 435281 - DNA, 25 bp, Mus musculus
caggtgtttgattaggctcgagtgc

SEQ ID NO: 435282 - DNA, 25 bp, Mus musculus
cttggcggcagaccctgtaattaca

SEQ ID NO: 435283 - DNA, 25 bp, Mus musculus
ctgcttgtcgctctcaccataaata

SEQ ID NO: 435284 - DNA, 25 bp, Mus musculus
ttgtagtgcggacagtaaatatcca

SEQ ID NO: 435285 - DNA, 25 bp, Mus musculus
gtcgttcacgttcacctgcacggtg

SEQ ID NO: 435286 - DNA, 25 bp, Mus musculus
cgagaaggcgctgtaacgctggaac

SEQ ID NO: 435287 - DNA, 25 bp, Mus musculus
cgctgtaacgctggaacttctcgga

SEQ ID NO: 435288 - DNA, 25 bp, Mus musculus
cgctggaacttctcggagaacttga

SEQ ID NO: 435289 - DNA, 25 bp, Mus musculus
acgttcacctgcacggtgtagccct

SEQ ID NO: 435290 - DNA, 25 bp, Mus musculus
ttctcggagaacttgatggggctgt

SEQ ID NO: 435291 - DNA, 25 bp, Mus musculus
tgcggtagccgctcaggttcaccat

SEQ ID NO: 435292 - DNA, 25 bp, Mus musculus
ggtagccgctcaggttcaccatgta

SEQ ID NO: 435293 - DNA, 25 bp, Mus musculus
tcaggttcaccatgtacagcacgta

SEQ ID NO: 435294 - DNA, 25 bp, Mus musculus
ccctgagctgttgtagtgcggacag

SEQ ID NO: 435295 - DNA, 25 bp, Mus musculus
gcggacagtaaatatccagatagtc

SEQ ID NO: 435296 - DNA, 25 bp, Mus musculus
aatatccagatagtcgttcacgttc

SEQ ID NO: 435297 - DNA, 25 bp, Mus musculus
accatgtacagcacgtactgctccg

SEQ ID NO: 435298 - DNA, 25 bp, Mus musculus
ccagggactataactcaaggggctg

SEQ ID NO: 435299 - DNA, 25 bp, Mus musculus
gaggctattgcacgtgtcccaccag

SEQ ID NO: 435300 - DNA, 25 bp, Mus musculus
aggtctcgattattcccagggacta

SEQ ID NO: 435301 - DNA, 25 bp, Mus musculus
gcgtcctagtttctgggccaggtta

SEQ ID NO: 435302 - DNA, 25 bp, Mus musculus
aataaggttgctcccaccgcgtcct

SEQ ID NO: 435303 - DNA, 25 bp, Mus musculus
gaaagacatgtttggccttcaactc

SEQ ID NO: 435304 - DNA, 25 bp, Mus musculus
gcaacaccttcgttttagttcacag

SEQ ID NO: 435305 - DNA, 25 bp, Mus musculus
gccaggaacctagatcacgtgactg

SEQ ID NO: 435306 - DNA, 25 bp, Mus musculus
gagcacgtcgctctcacgatttatg

SEQ ID NO: 435307 - DNA, 25 bp, Mus musculus
gtccctgcccacaccggagtggaga

SEQ ID NO: 435308 - DNA, 25 bp, Mus musculus
gaaccatcccgttccggagctttca

SEQ ID NO: 435309 - DNA, 25 bp, Mus musculus
agctctctgctcgtgccagactgta

SEQ ID NO: 435310 - DNA, 25 bp, Mus musculus
tggcaagctaccagcagtggggttc

SEQ ID NO: 435311 - DNA, 25 bp, Mus musculus
gagtaggctactgcaggtctgtcaa

SEQ ID NO: 435312 - DNA, 25 bp, Mus musculus
ctttaggaacaacgcgcctctcctc

SEQ ID NO: 435313 - DNA, 25 bp, Mus musculus
ggtccacacctttctccatagagtg

SEQ ID NO: 435314 - DNA, 25 bp, Mus musculus
agctgttccagtataccgcatgccg

SEQ ID NO: 435315 - DNA, 25 bp, Mus musculus
taccgcatgccggtttcccagtgcg

SEQ ID NO: 435316 - DNA, 25 bp, Mus musculus
gcgcgtgggcgacccatactgtgta

SEQ ID NO: 435317 - DNA, 25 bp, Mus musculus
gcctctcctctctcctaggtgattt

SEQ ID NO: 435318 - DNA, 25 bp, Mus musculus
tctctcctaggtgatttgctgcaga

SEQ ID NO: 435319 - DNA, 25 bp, Mus musculus
tttgctgcagaggtttgcgtcttta

SEQ ID NO: 435320 - DNA, 25 bp, Mus musculus
cccaagcttggagttcacagaagga

SEQ ID NO: 435321 - DNA, 25 bp, Mus musculus
tcacagaaggatttggaagccaaga

SEQ ID NO: 435322 - DNA, 25 bp, Mus musculus
ttggaagccaagacctggacataca

SEQ ID NO: 435323 - DNA, 25 bp, Mus musculus
catacatctggtgtaggtccacacc

SEQ ID NO: 435324 - DNA, 25 bp, Mus musculus
acacctttctccatagagtgtgggg

SEQ ID NO: 435325 - DNA, 25 bp, Mus musculus
aagacctggacatacatctggtgta

SEQ ID NO: 435326 - DNA, 25 bp, Mus musculus
ctcagacagcgccttgcaaaaaggc

SEQ ID NO: 435327 - DNA, 25 bp, Mus musculus
ttagaggagttccagtagattgggt

SEQ ID NO: 435328 - DNA, 25 bp, Mus musculus
ttccagtagattgggtggcggaggc

SEQ ID NO: 435329 - DNA, 25 bp, Mus musculus
ggcccagagcacagtccgcagcagg

SEQ ID NO: 435330 - DNA, 25 bp, Mus musculus
agcacagtccgcagcaggggcagca

SEQ ID NO: 435331 - DNA, 25 bp, Mus musculus
ccctggggtccagtctggtctggcc

SEQ ID NO: 435332 - DNA, 25 bp, Mus musculus
tccagtctggtctggcccggctggt

SEQ ID NO: 435333 - DNA, 25 bp, Mus musculus
tggtcccggcccacttctctgtccc

SEQ ID NO: 435334 - DNA, 25 bp, Mus musculus
tgctacctggggttagaggagttcc

SEQ ID NO: 435335 - DNA, 25 bp, Mus musculus
ctacctggggttagaggagttccag

SEQ ID NO: 435336 - DNA, 25 bp, Mus musculus
ggcccagctcggctctcgcctcgct

SEQ ID NO: 435337 - DNA, 25 bp, Mus musculus
cagggctcagacagcgccttgcaaa

SEQ ID NO: 435338 - DNA, 25 bp, Mus musculus
tcaaacaaaggagccccatcgcgcg

SEQ ID NO: 435339 - DNA, 25 bp, Mus musculus
ctcgctcggccgtgctacctggggt

SEQ ID NO: 435340 - DNA, 25 bp, Mus musculus
tctgtagcccggcttcgtggagatt

SEQ ID NO: 435341 - DNA, 25 bp, Mus musculus
cagcgctgacgcatgaagcggtgca

SEQ ID NO: 435342 - DNA, 25 bp, Mus musculus
aatccggcgtctccattgcctggca

SEQ ID NO: 435343 - DNA, 25 bp, Mus musculus
ggcacacgtaggaatccggcgtctc

SEQ ID NO: 435344 - DNA, 25 bp, Mus musculus
gcagtacagggccttgcagtctggt

SEQ ID NO: 435345 - DNA, 25 bp, Mus musculus
gtcccagcacgaccggcagtacagg

SEQ ID NO: 435346 - DNA, 25 bp, Mus musculus
acaccagctcggtgcagcgcagcaa

SEQ ID NO: 435347 - DNA, 25 bp, Mus musculus
ccgcaggagcgtgcatcacacttta

SEQ ID NO: 435348 - DNA, 25 bp, Mus musculus
agagccgttgcatgtcgtcccagca

SEQ ID NO: 435349 - DNA, 25 bp, Mus musculus
cctctttccggcagctaccgggatg

SEQ ID NO: 435350 - DNA, 25 bp, Mus musculus
gggcagcatcccttcaatcgccata

SEQ ID NO: 435351 - DNA, 25 bp, Mus musculus
aatcccggatgcctgcgaagcacca

SEQ ID NO: 435352 - DNA, 25 bp, Mus musculus
ttggacaccacaagactcgcgcctt

SEQ ID NO: 435353 - DNA, 25 bp, Mus musculus
tttattaagcaagaaggcgggcagc

SEQ ID NO: 435354 - DNA, 25 bp, Mus musculus
ctttccatccggtctaagcctctga

SEQ ID NO: 435355 - DNA, 25 bp, Mus musculus
cctacggccattggaccacggctga

SEQ ID NO: 435356 - DNA, 25 bp, Mus musculus
ggcttgctaagcgtgccctgcccta

SEQ ID NO: 435357 - DNA, 25 bp, Mus musculus
agccgcggcttgctaagcgtgccct

SEQ ID NO: 435358 - DNA, 25 bp, Mus musculus
ttggcctggggtggcatttaaaggc

SEQ ID NO: 435359 - DNA, 25 bp, Mus musculus
tgcactcaccaccacggcgtcgctg

SEQ ID NO: 435360 - DNA, 25 bp, Mus musculus
ggcggctgacaggtaccgcgcttcc

SEQ ID NO: 435361 - DNA, 25 bp, Mus musculus
tccaagcacaaacgctcccggagtc

SEQ ID NO: 435362 - DNA, 25 bp, Mus musculus
cacccgggaagcaaagcccgtgtag

SEQ ID NO: 435363 - DNA, 25 bp, Mus musculus
atcaaattcaaggtcgcggcccacc

SEQ ID NO: 435364 - DNA, 25 bp, Mus musculus
ttgagaccggatcaaattcaaggtc

SEQ ID NO: 435365 - DNA, 25 bp, Mus musculus
cccaggctcttgagaccggatcaaa

SEQ ID NO: 435366 - DNA, 25 bp, Mus musculus
tccggtctaagcctctgatgatccc

SEQ ID NO: 435367 - DNA, 25 bp, Mus musculus
gccattggaccacggctgaaggccg

SEQ ID NO: 435368 - DNA, 25 bp, Mus musculus
tctctccaaacactagcagggccgg

SEQ ID NO: 435369 - DNA, 25 bp, Mus musculus
aggacacgtcgctctcttacttggg

SEQ ID NO: 435370 - DNA, 25 bp, Mus musculus
aagctggaaatggaaagcagcgccc

SEQ ID NO: 435371 - DNA, 25 bp, Mus musculus
aatggccaacctcggccagcggtgc

SEQ ID NO: 435372 - DNA, 25 bp, Mus musculus
cagcggtgcgcactaggtttctacc

SEQ ID NO: 435373 - DNA, 25 bp, Mus musculus
actaggtttctaccacacagcgacc

SEQ ID NO: 435374 - DNA, 25 bp, Mus musculus
gtctcagccgccctttgatacatgg

SEQ ID NO: 435375 - DNA, 25 bp, Mus musculus
gcgcaagaaaccgaatagtccagcc

SEQ ID NO: 435376 - DNA, 25 bp, Mus musculus
acccaccctcgcactggagttgtga

SEQ ID NO: 435377 - DNA, 25 bp, Mus musculus
ctggagttgtgagagcaaaagctga

SEQ ID NO: 435378 - DNA, 25 bp, Mus musculus
aggcttgagagaccggaatgtgatt

SEQ ID NO: 435379 - DNA, 25 bp, Mus musculus
tgagccgcactaccgctggagagac

SEQ ID NO: 435380 - DNA, 25 bp, Mus musculus
acgcggctctggaagcgcaagaaac

SEQ ID NO: 435381 - DNA, 25 bp, Mus musculus
accgctggtaggtcgagttcttatc

SEQ ID NO: 435382 - DNA, 25 bp, Mus musculus
tgaccatgtcccaccactggggata

SEQ ID NO: 435383 - DNA, 25 bp, Mus musculus
gacaatacctatcgggaccacagcc

SEQ ID NO: 435384 - DNA, 25 bp, Mus musculus
tctcaaacttgcttggccgcgcaca

SEQ ID NO: 435385 - DNA, 25 bp, Mus musculus
agcgctctctaggatctgatctcaa

SEQ ID NO: 435386 - DNA, 25 bp, Mus musculus
gcccgactcagagcgctctctagga

SEQ ID NO: 435387 - DNA, 25 bp, Mus musculus
tggggatacagcaagcacaacggtg

SEQ ID NO: 435388 - DNA, 25 bp, Mus musculus
accgctagacggacgacaacttctg

SEQ ID NO: 435389 - DNA, 25 bp, Mus musculus
cgacacacactgcaggaccgctaga

SEQ ID NO: 435390 - DNA, 25 bp, Mus musculus
ggagcctataaaagccggacggtgc

SEQ ID NO: 435391 - DNA, 25 bp, Mus musculus
agagcaccaagttggcgggagccta

SEQ ID NO: 435392 - DNA, 25 bp, Mus musculus
gtgaccaggtcggtgctcacaatgg

SEQ ID NO: 435393 - DNA, 25 bp, Mus musculus
ggcaaagccgggtcgtcttcccgca

SEQ ID NO: 435394 - DNA, 25 bp, Mus musculus
gcagatcccggagcgcagcttggat

SEQ ID NO: 435395 - DNA, 25 bp, Mus musculus
caaggtcaaactccgcagccgcgtg

SEQ ID NO: 435396 - DNA, 25 bp, Mus musculus
cctgtcctgctgtctcacctgtcct

SEQ ID NO: 435397 - DNA, 25 bp, Mus musculus
acattcacctggcttccactcgccc

SEQ ID NO: 435398 - DNA, 25 bp, Mus musculus
cgtacattcacctggcttccactcg

SEQ ID NO: 435399 - DNA, 25 bp, Mus musculus
gagccgtacattcacctggcttcca

SEQ ID NO: 435400 - DNA, 25 bp, Mus musculus
agagccgtacattcacctggcttcc

SEQ ID NO: 435401 - DNA, 25 bp, Mus musculus
gagagccgtacattcacctggcttc

SEQ ID NO: 435402 - DNA, 25 bp, Mus musculus
ctcgctgctcgttgctggggggctc

SEQ ID NO: 435403 - DNA, 25 bp, Mus musculus
ggagagccgtacattcacctggctt

SEQ ID NO: 435404 - DNA, 25 bp, Mus musculus
cggagagccgtacattcacctggct

SEQ ID NO: 435405 - DNA, 25 bp, Mus musculus
gcggagagccgtacattcacctggc

SEQ ID NO: 435406 - DNA, 25 bp, Mus musculus
cgcggagagccgtacattcacctgg

SEQ ID NO: 435407 - DNA, 25 bp, Mus musculus
ccgcggagagccgtacattcacctg

SEQ ID NO: 435408 - DNA, 25 bp, Mus musculus
tgcctcctcctgttgcccgcccccc

SEQ ID NO: 435409 - DNA, 25 bp, Mus musculus
tcctgctgtctcacctgtcctctct

SEQ ID NO: 435410 - DNA, 25 bp, Mus musculus
cagtaggctcgagtttagtgtatcc

SEQ ID NO: 435411 - DNA, 25 bp, Mus musculus
acagggaatgcgactggttgaaatc

SEQ ID NO: 435412 - DNA, 25 bp, Mus musculus
atgcgactggttgaaatctggtgtg

SEQ ID NO: 435413 - DNA, 25 bp, Mus musculus
tacgtgtgtgtacaggggtctcaca

SEQ ID NO: 435414 - DNA, 25 bp, Mus musculus
tgtacaggggtctcacaggacgcac

SEQ ID NO: 435415 - DNA, 25 bp, Mus musculus
tctcacaggacgcacgaaggacact

SEQ ID NO: 435416 - DNA, 25 bp, Mus musculus
gacactgcagtaggctcgagtttag

SEQ ID NO: 435417 - DNA, 25 bp, Mus musculus
gagtttagtgtatcccgagccaagg

SEQ ID NO: 435418 - DNA, 25 bp, Mus musculus
tcacttacctttcagccgttgggtc

SEQ ID NO: 435419 - DNA, 25 bp, Mus musculus
ctttcagccgttgggtccgttcgct

SEQ ID NO: 435420 - DNA, 25 bp, Mus musculus
acagggtgtaggaagaagcgcgtcc

SEQ ID NO: 435421 - DNA, 25 bp, Mus musculus
ggctctgctccggtcctggtcagaa

SEQ ID NO: 435422 - DNA, 25 bp, Mus musculus
tcctggtcagaaggccgcggtcagt

SEQ ID NO: 435423 - DNA, 25 bp, Mus musculus
aggacgcacgaaggacactgcagta

SEQ ID NO: 435424 - DNA, 25 bp, Mus musculus
gctaatcgccgctgggatctctgcg

SEQ ID NO: 435425 - DNA, 25 bp, Mus musculus
ggctgcctccgcttccctcgaaaaa

SEQ ID NO: 435426 - DNA, 25 bp, Mus musculus
attctgggcctctcggctggagccc

SEQ ID NO: 435427 - DNA, 25 bp, Mus musculus
ggagcccgctgcagcgcagtgctaa

SEQ ID NO: 435428 - DNA, 25 bp, Mus musculus
gcgcagtgctaatcgccgctgggat

SEQ ID NO: 435429 - DNA, 25 bp, Mus musculus
cccaggaaaccgctgggggcgctca

SEQ ID NO: 435430 - DNA, 25 bp, Mus musculus
gcccaacccacctgaagaggcggtg

SEQ ID NO: 435431 - DNA, 25 bp, Mus musculus
cctattctgggcctctcggctggag

SEQ ID NO: 435432 - DNA, 25 bp, Mus musculus
ccacacctgcgggtagcactattta

SEQ ID NO: 435433 - DNA, 25 bp, Mus musculus
cctgcgggtagcactatttataact

SEQ ID NO: 435434 - DNA, 25 bp, Mus musculus
actatttataactgcgcgcctattc

SEQ ID NO: 435435 - DNA, 25 bp, Mus musculus
taactgcgcgcctattctgggcctc

SEQ ID NO: 435436 - DNA, 25 bp, Mus musculus
agaggcggtggctgccaagggtacc

SEQ ID NO: 435437 - DNA, 25 bp, Mus musculus
cgctgcagcgcagtgctaatcgccg

SEQ ID NO: 435438 - DNA, 25 bp, Mus musculus
cgcgccggcactaaccggtattcga

SEQ ID NO: 435439 - DNA, 25 bp, Mus musculus
acttcctattggtctctgcggccga

SEQ ID NO: 435440 - DNA, 25 bp, Mus musculus
ggtaactaactcctcgcgtgctctc

SEQ ID NO: 435441 - DNA, 25 bp, Mus musculus
tttggcctcgctttcaaacacaccg

SEQ ID NO: 435442 - DNA, 25 bp, Mus musculus
cgcaggcctccagacaactcccagc

SEQ ID NO: 435443 - DNA, 25 bp, Mus musculus
attgctctgtccgagggcgctcagc

SEQ ID NO: 435444 - DNA, 25 bp, Mus musculus
acatgattgctctgtccgagggcgc

SEQ ID NO: 435445 - DNA, 25 bp, Mus musculus
atttgtttgtgggacatgattgctc

SEQ ID NO: 435446 - DNA, 25 bp, Mus musculus
cctcgtcgtcgtatttgtccgaata

SEQ ID NO: 435447 - DNA, 25 bp, Mus musculus
ggtattcgaactcctcgtcgtcgta

SEQ ID NO: 435448 - DNA, 25 bp, Mus musculus
cgcgtgctctcttttgtctgtagtc

SEQ ID NO: 435449 - DNA, 25 bp, Mus musculus
cgcacgcgcccgttctacactgtcc

SEQ ID NO: 435450 - DNA, 25 bp, Mus musculus
cggcctaggtaactaactcctcgcg

SEQ ID NO: 435451 - DNA, 25 bp, Mus musculus
tgtccgaatagtagatttgtttgtg

SEQ ID NO: 435452 - DNA, 25 bp, Mus musculus
cgcgcagttggtgcaacggctctgt

SEQ ID NO: 435453 - DNA, 25 bp, Mus musculus
acgtatctgcaaggcgactggctcg

SEQ ID NO: 435454 - DNA, 25 bp, Mus musculus
atctgcaaggcgactggctcgcggc

SEQ ID NO: 435455 - DNA, 25 bp, Mus musculus
ccctgtcgagtggtgcgttccactc

SEQ ID NO: 435456 - DNA, 25 bp, Mus musculus
gcgttccactctgctaccgggctag

SEQ ID NO: 435457 - DNA, 25 bp, Mus musculus
tccactctgctaccgggctagctgg

SEQ ID NO: 435458 - DNA, 25 bp, Mus musculus
cccagccttcctgggtgcggcgtct

SEQ ID NO: 435459 - DNA, 25 bp, Mus musculus
caccgcgttccgtggtggtgaccca

SEQ ID NO: 435460 - DNA, 25 bp, Mus musculus
gctgactcgggtccccaatccatgg

SEQ ID NO: 435461 - DNA, 25 bp, Mus musculus
ttccggttccggttgctgtggctgc

SEQ ID NO: 435462 - DNA, 25 bp, Mus musculus
tggtgcaacggctctgtgctttccc

SEQ ID NO: 435463 - DNA, 25 bp, Mus musculus
tagggacgtatctgcaaggcgactg

SEQ ID NO: 435464 - DNA, 25 bp, Mus musculus
ctgtgcggtagggacgtatctgcaa

SEQ ID NO: 435465 - DNA, 25 bp, Mus musculus
tggtgacccattggagttccggttc

SEQ ID NO: 435466 - DNA, 25 bp, Mus musculus
aatcgcgcgcgggtaagaggaccct

SEQ ID NO: 435467 - DNA, 25 bp, Mus musculus
actggcacactgaggcctccgacga

SEQ ID NO: 435468 - DNA, 25 bp, Mus musculus
gaggacaccggcacactggcacact

SEQ ID NO: 435469 - DNA, 25 bp, Mus musculus
cgttctgcgtcggtatccgagtccc

SEQ ID NO: 435470 - DNA, 25 bp, Mus musculus
ccctgccagagggtaaggcgttctg

SEQ ID NO: 435471 - DNA, 25 bp, Mus musculus
acctgccttcccttggtctgtttgg

SEQ ID NO: 435472 - DNA, 25 bp, Mus musculus
aggccttgttgcgtcacctgccttc

SEQ ID NO: 435473 - DNA, 25 bp, Mus musculus
ctccgcagcctgcagcgctggaaaa

SEQ ID NO: 435474 - DNA, 25 bp, Mus musculus
aagactacgcgttgggactagccgg

SEQ ID NO: 435475 - DNA, 25 bp, Mus musculus
ttcctgactgaaggtggaagactac

SEQ ID NO: 435476 - DNA, 25 bp, Mus musculus
gccctaaccattgattcctgactga

SEQ ID NO: 435477 - DNA, 25 bp, Mus musculus
gtgatgtcaccaatctgcgccctaa

SEQ ID NO: 435478 - DNA, 25 bp, Mus musculus
ccggcgcgccagtgatgtcaccaat

SEQ ID NO: 435479 - DNA, 25 bp, Mus musculus
gccctgaatcaggaggccttgttgc

SEQ ID NO: 435480 - DNA, 25 bp, Mus musculus
ctcgctgacacaagggctgcggacg

SEQ ID NO: 435481 - DNA, 25 bp, Mus musculus
ctcttctagggaacacaagtggaac

SEQ ID NO: 435482 - DNA, 25 bp, Mus musculus
ggccatgccgcctgcatagcgcgga

SEQ ID NO: 435483 - DNA, 25 bp, Mus musculus
atgccgcctgcatagcgcggagcct

SEQ ID NO: 435484 - DNA, 25 bp, Mus musculus
ctagggaacacaagtggaactacta

SEQ ID NO: 435485 - DNA, 25 bp, Mus musculus
cggtcccggctgctcttctagggaa

SEQ ID NO: 435486 - DNA, 25 bp, Mus musculus
actgcgcggcagttcctggaacgag

SEQ ID NO: 435487 - DNA, 25 bp, Mus musculus
ccactgcgcggcagttcctggaacg

SEQ ID NO: 435488 - DNA, 25 bp, Mus musculus
ctgaagtgcccactgcgcggcagtt

SEQ ID NO: 435489 - DNA, 25 bp, Mus musculus
tcgcggcctccagggctgaagtgcc

SEQ ID NO: 435490 - DNA, 25 bp, Mus musculus
cgcgcagccgccttcacccgggtgg

SEQ ID NO: 435491 - DNA, 25 bp, Mus musculus
tggtgctgaagccgcgcagccgcct

SEQ ID NO: 435492 - DNA, 25 bp, Mus musculus
agcgcggagcctcgctgacacaagg

SEQ ID NO: 435493 - DNA, 25 bp, Mus musculus
gaactactaggggaggagtctccgc

SEQ ID NO: 435494 - DNA, 25 bp, Mus musculus
cgggagctgaagctgctcgagtcca

SEQ ID NO: 435495 - DNA, 25 bp, Mus musculus
aacatcacggtgaggacctcgcttg

SEQ ID NO: 435496 - DNA, 25 bp, Mus musculus
agctgagctgcgagttcctgctggc

SEQ ID NO: 435497 - DNA, 25 bp, Mus musculus
tgaagctgctcgagtccatcttcca

SEQ ID NO: 435498 - DNA, 25 bp, Mus musculus
cgcacggaagcgcttcgagcagcga

SEQ ID NO: 435499 - DNA, 25 bp, Mus musculus
cacgtacacgcacggaagcgcttcg

SEQ ID NO: 435500 - DNA, 25 bp, Mus musculus
tgcacggtcacgcacgacgcacgta

SEQ ID NO: 435501 - DNA, 25 bp, Mus musculus
ccatgtgacagggaagcgctggcaa

SEQ ID NO: 435502 - DNA, 25 bp, Mus musculus
acgtgacaagagacgccggccatgt

SEQ ID NO: 435503 - DNA, 25 bp, Mus musculus
gcaccggccacgtgacaagagacgc

SEQ ID NO: 435504 - DNA, 25 bp, Mus musculus
tgggaacacaggcaccggccacgtg

SEQ ID NO: 435505 - DNA, 25 bp, Mus musculus
tacaggacagacacggccatgcgcc

SEQ ID NO: 435506 - DNA, 25 bp, Mus musculus
cccatgggaatacaggacagacacg

SEQ ID NO: 435507 - DNA, 25 bp, Mus musculus
attgccagcgcctgcctggacgagc

SEQ ID NO: 435508 - DNA, 25 bp, Mus musculus
ggcaagccgcgcaagaactcggaga

SEQ ID NO: 435509 - DNA, 25 bp, Mus musculus
cgcacacgtcccgtctgcagagatg

SEQ ID NO: 435510 - DNA, 25 bp, Mus musculus
ggacagcctgcagggtctgatccag

SEQ ID NO: 435511 - DNA, 25 bp, Mus musculus
ctggcaaaggccgtaagaactcccg

SEQ ID NO: 435512 - DNA, 25 bp, Mus musculus
cgcttactctgaagaccgcgtcgga

SEQ ID NO: 435513 - DNA, 25 bp, Mus musculus
tcccgatccttgttctcgagcgcga

SEQ ID NO: 435514 - DNA, 25 bp, Mus musculus
gccatcgtcccagttagggtgggca

SEQ ID NO: 435515 - DNA, 25 bp, Mus musculus
ccaagcggtggagcgcagagaacac

SEQ ID NO: 435516 - DNA, 25 bp, Mus musculus
gagaacacggcggtccgatcactgc

SEQ ID NO: 435517 - DNA, 25 bp, Mus musculus
atcactgcgcccgtctagcttcggg

SEQ ID NO: 435518 - DNA, 25 bp, Mus musculus
tgatccaggccgctgctggcaaagg

SEQ ID NO: 435519 - DNA, 25 bp, Mus musculus
gcggcgaaatggttcaaggagttcc

SEQ ID NO: 435520 - DNA, 25 bp, Mus musculus
aaggagttcccgcttactctgaaga

SEQ ID NO: 435521 - DNA, 25 bp, Mus musculus
cagagccgcccggtcgaacttcgag

SEQ ID NO: 435522 - DNA, 25 bp, Mus musculus
cgcgcgcacctaccagatgaagtcg

SEQ ID NO: 435523 - DNA, 25 bp, Mus musculus
ccattgaccgctccgcttggtgaca

SEQ ID NO: 435524 - DNA, 25 bp, Mus musculus
cgtgcagagccaagcgtcccttcag

SEQ ID NO: 435525 - DNA, 25 bp, Mus musculus
gtcccttcagggcaccagggcatgc

SEQ ID NO: 435526 - DNA, 25 bp, Mus musculus
tccggccaggcactctaagttctcg

SEQ ID NO: 435527 - DNA, 25 bp, Mus musculus
ctaagttctcggaggagtcctggcc

SEQ ID NO: 435528 - DNA, 25 bp, Mus musculus
tcctggccctgagagtaaggacgcg

SEQ ID NO: 435529 - DNA, 25 bp, Mus musculus
tggggccactttgactccagcaatc

SEQ ID NO: 435530 - DNA, 25 bp, Mus musculus
atgcccggagagctagcgtgtgtat

SEQ ID NO: 435531 - DNA, 25 bp, Mus musculus
gcgggcgatgaatttgtggtctttc

SEQ ID NO: 435532 - DNA, 25 bp, Mus musculus
gtggtctttcacctcatgcacgttc

SEQ ID NO: 435533 - DNA, 25 bp, Mus musculus
ccacgtcctgagacgccgtggagtc

SEQ ID NO: 435534 - DNA, 25 bp, Mus musculus
gccgggtaaacgtcagccatggttc

SEQ ID NO: 435535 - DNA, 25 bp, Mus musculus
taagtcccggggacaagcagacctg

SEQ ID NO: 435536 - DNA, 25 bp, Mus musculus
gcccagtaggatggcgcaatcggcc

SEQ ID NO: 435537 - DNA, 25 bp, Mus musculus
agttataggcgctagacgcaacagg

SEQ ID NO: 435538 - DNA, 25 bp, Mus musculus
tccaccgcgtcagcacaggtgagtc

SEQ ID NO: 435539 - DNA, 25 bp, Mus musculus
agtcagcccaggctagcagccggta

SEQ ID NO: 435540 - DNA, 25 bp, Mus musculus
ggctcactctgcgaacggaaccaga

SEQ ID NO: 435541 - DNA, 25 bp, Mus musculus
cggaaccagacagtgtcacattccc

SEQ ID NO: 435542 - DNA, 25 bp, Mus musculus
accaacagcgtgcagccgacggtca

SEQ ID NO: 435543 - DNA, 25 bp, Mus musculus
agccgacggtcagcatgcttccttc

SEQ ID NO: 435544 - DNA, 25 bp, Mus musculus
catgcttccttctacgcgggacggc

SEQ ID NO: 435545 - DNA, 25 bp, Mus musculus
ggcgcgacttcccacatgcacgtga

SEQ ID NO: 435546 - DNA, 25 bp, Mus musculus
atgcacgtgacacacagcagccggc

SEQ ID NO: 435547 - DNA, 25 bp, Mus musculus
cggccgtcctggcaacagtgaaaca

SEQ ID NO: 435548 - DNA, 25 bp, Mus musculus
ggctcgcggttacgaaagcccagta

SEQ ID NO: 435549 - DNA, 25 bp, Mus musculus
tgaaacatttgaggaaccggtgctg

SEQ ID NO: 435550 - DNA, 25 bp, Mus musculus
ccgtttttaaaaggcgcattgactg

SEQ ID NO: 435551 - DNA, 25 bp, Mus musculus
ggaccgcccgcgttgtccaggacaa

SEQ ID NO: 435552 - DNA, 25 bp, Mus musculus
tatctccttggggaccgtcatgatc

SEQ ID NO: 435553 - DNA, 25 bp, Mus musculus
cacttctcgggtatctccttgggga

SEQ ID NO: 435554 - DNA, 25 bp, Mus musculus
ttgtccaggacaacggctttcaacc

SEQ ID NO: 435555 - DNA, 25 bp, Mus musculus
ctcccagccaatgcgggagagcgga

SEQ ID NO: 435556 - DNA, 25 bp, Mus musculus
gtaggcgaaagccagcgcatggccc

SEQ ID NO: 435557 - DNA, 25 bp, Mus musculus
tgccagtgccgcgtaggcgaaagcc

SEQ ID NO: 435558 - DNA, 25 bp, Mus musculus
tgcagagccgaagcctgccagtgcc

SEQ ID NO: 435559 - DNA, 25 bp, Mus musculus
gcctgggaccaccagctctgcagga

SEQ ID NO: 435560 - DNA, 25 bp, Mus musculus
tgtccttgggcctcagcgtcgccta

SEQ ID NO: 435561 - DNA, 25 bp, Mus musculus
gcgcattgactgtccttgggcctca

SEQ ID NO: 435562 - DNA, 25 bp, Mus musculus
cttggggaccgtcatgatcccgttt

SEQ ID NO: 435563 - DNA, 25 bp, Mus musculus
gacaacggctttcaacccacagaca

SEQ ID NO: 435564 - DNA, 25 bp, Mus musculus
tcagccactagcgtggatcaggtga

SEQ ID NO: 435565 - DNA, 25 bp, Mus musculus
cgtcagactggatagcggaaggtca

SEQ ID NO: 435566 - DNA, 25 bp, Mus musculus
gaccgcttctgtagcctccaggcta

SEQ ID NO: 435567 - DNA, 25 bp, Mus musculus
aacgctcacggtaccgcgcatgcgt

SEQ ID NO: 435568 - DNA, 25 bp, Mus musculus
cgcgcatgcgtctaaagtacagctg

SEQ ID NO: 435569 - DNA, 25 bp, Mus musculus
gtctaaagtacagctgcgcctccgg

SEQ ID NO: 435570 - DNA, 25 bp, Mus musculus
ggctgaggcgcctgtccgccattgt

SEQ ID NO: 435571 - DNA, 25 bp, Mus musculus
tgtccgccattgtgggcccgaggat

SEQ ID NO: 435572 - DNA, 25 bp, Mus musculus
gtagtcgactgctgtgagtgctctc

SEQ ID NO: 435573 - DNA, 25 bp, Mus musculus
ctgtgagtgctctcggcgaggccca

SEQ ID NO: 435574 - DNA, 25 bp, Mus musculus
acggtgaagaatgtcagccactagc

SEQ ID NO: 435575 - DNA, 25 bp, Mus musculus
ggacaggcgctgctggaccgcttct

SEQ ID NO: 435576 - DNA, 25 bp, Mus musculus
ggatctggtggggttcacacctacg

SEQ ID NO: 435577 - DNA, 25 bp, Mus musculus
tcctctcgggttacggtgaagaatg

SEQ ID NO: 435578 - DNA, 25 bp, Mus musculus
ggcccgctactttgtgtcagtttcg

SEQ ID NO: 435579 - DNA, 25 bp, Mus musculus
gacacgcacacaatcggcgaggctg

SEQ ID NO: 435580 - DNA, 25 bp, Mus musculus
agccgggacacgcacacaatcggcg

SEQ ID NO: 435581 - DNA, 25 bp, Mus musculus
cacgcacacaatcggcgaggctgga

SEQ ID NO: 435582 - DNA, 25 bp, Mus musculus
tactttgtgtcagtttcggccgcgg

SEQ ID NO: 435583 - DNA, 25 bp, Mus musculus
cccgctactttgtgtcagtttcggc

SEQ ID NO: 435584 - DNA, 25 bp, Mus musculus
gtgcgccatcttggtgcgtagggaa

SEQ ID NO: 435585 - DNA, 25 bp, Mus musculus
ccggcccgctactttgtgtcagttt

SEQ ID NO: 435586 - DNA, 25 bp, Mus musculus
cgccttaccttagcgctccgcgcgc

SEQ ID NO: 435587 - DNA, 25 bp, Mus musculus
gtggcagcgccttaccttagcgctc

SEQ ID NO: 435588 - DNA, 25 bp, Mus musculus
cggtggcagcgccttaccttagcgc

SEQ ID NO: 435589 - DNA, 25 bp, Mus musculus
ccagagccgaccctcccggtccaca

SEQ ID NO: 435590 - DNA, 25 bp, Mus musculus
ccgcgcctcccagagccgaccctcc

SEQ ID NO: 435591 - DNA, 25 bp, Mus musculus
gctactttgtgtcagtttcggccgc

SEQ ID NO: 435592 - DNA, 25 bp, Mus musculus
tcggagagctccagggaacctaggt

SEQ ID NO: 435593 - DNA, 25 bp, Mus musculus
gtgactccagtaaggtctcggcttc

SEQ ID NO: 435594 - DNA, 25 bp, Mus musculus
ccagtaggccgcgaacccaactata

SEQ ID NO: 435595 - DNA, 25 bp, Mus musculus
gcctaccgcgggacaggaatacgga

SEQ ID NO: 435596 - DNA, 25 bp, Mus musculus
tgcgctcccaactttacctcagtat

SEQ ID NO: 435597 - DNA, 25 bp, Mus musculus
ccctgtcacgtgatataagattccc

SEQ ID NO: 435598 - DNA, 25 bp, Mus musculus
aaacactgctcttgagttccgcgcg

SEQ ID NO: 435599 - DNA, 25 bp, Mus musculus
cggcttcctcttactggcgtagttc

SEQ ID NO: 435600 - DNA, 25 bp, Mus musculus
tcccaggtacctttgcggacataag

SEQ ID NO: 435601 - DNA, 25 bp, Mus musculus
cgggaaggtccgatgcttaactagc

SEQ ID NO: 435602 - DNA, 25 bp, Mus musculus
ccaccatgttttctgacggactcta

SEQ ID NO: 435603 - DNA, 25 bp, Mus musculus
ctgacggactctagcctggtttttt

SEQ ID NO: 435604 - DNA, 25 bp, Mus musculus
tggcgtctagtagtaactggctttc

SEQ ID NO: 435605 - DNA, 25 bp, Mus musculus
ccatatggaaatgttcggagagctc

SEQ ID NO: 435606 - DNA, 25 bp, Mus musculus
ctcaggaaatgagccagcagttggc

SEQ ID NO: 435607 - DNA, 25 bp, Mus musculus
acatcccggcgtatgagtgagttcc

SEQ ID NO: 435608 - DNA, 25 bp, Mus musculus
ctccctcactggtcgagcttaaggc

SEQ ID NO: 435609 - DNA, 25 bp, Mus musculus
ggccgagcgtaacctgtgaaaaatg

SEQ ID NO: 435610 - DNA, 25 bp, Mus musculus
tggggaccttttactctcgcctgag

SEQ ID NO: 435611 - DNA, 25 bp, Mus musculus
cagctcattcattcggtccctcgga

SEQ ID NO: 435612 - DNA, 25 bp, Mus musculus
ctagaccctggaaagaatcgagccc

SEQ ID NO: 435613 - DNA, 25 bp, Mus musculus
tgctcacgcgagcaggctagaccct

SEQ ID NO: 435614 - DNA, 25 bp, Mus musculus
actcgattacgatggcccggtaagc

SEQ ID NO: 435615 - DNA, 25 bp, Mus musculus
catggagccttggaaacccggacta

SEQ ID NO: 435616 - DNA, 25 bp, Mus musculus
tgctgtgctcagctccatggagcct

SEQ ID NO: 435617 - DNA, 25 bp, Mus musculus
caagatccaggttctgcagcagcaa

SEQ ID NO: 435618 - DNA, 25 bp, Mus musculus
gggaccaccaccatcgaggcggtaa

SEQ ID NO: 435619 - DNA, 25 bp, Mus musculus
ccagaagcagcttgtaggcaccatg

SEQ ID NO: 435620 - DNA, 25 bp, Mus musculus
ggaccaaggaactcacaggcatgtt

SEQ ID NO: 435621 - DNA, 25 bp, Mus musculus
tcctaagagacgcagagcgcacatg

SEQ ID NO: 435622 - DNA, 25 bp, Mus musculus
gtggaccctgtaggacccgcaatta

SEQ ID NO: 435623 - DNA, 25 bp, Mus musculus
ccgcaattagcgcaagaggaccgtg

SEQ ID NO: 435624 - DNA, 25 bp, Mus musculus
gtgcggacccaagagcgagttctct

SEQ ID NO: 435625 - DNA, 25 bp, Mus musculus
ttctctgtcgaaacctggaccaagg

SEQ ID NO: 435626 - DNA, 25 bp, Mus musculus
catgttctcgtagggaggtcgtcac

SEQ ID NO: 435627 - DNA, 25 bp, Mus musculus
gcggaaatcctgttccttatatctg

SEQ ID NO: 435628 - DNA, 25 bp, Mus musculus
acgagccgtgttgcttcgccatctt

SEQ ID NO: 435629 - DNA, 25 bp, Mus musculus
cggaaggtcttctactctgttcgaa

SEQ ID NO: 435630 - DNA, 25 bp, Mus musculus
tctgttcgaatgcaacggaatgccc

SEQ ID NO: 435631 - DNA, 25 bp, Mus musculus
tagaaggtccgtaaaggctcctcgc

SEQ ID NO: 435632 - DNA, 25 bp, Mus musculus
cgcggctctggttactgtcctaaga

SEQ ID NO: 435633 - DNA, 25 bp, Mus musculus
tgcccgttgactgccatttgtagaa

SEQ ID NO: 435634 - DNA, 25 bp, Mus musculus
ggatcccgcctaccagtgttggctc

SEQ ID NO: 435635 - DNA, 25 bp, Mus musculus
cttcaagttgctgctcatcggggac

SEQ ID NO: 435636 - DNA, 25 bp, Mus musculus
ctcttcaagttgctgctcatcgggg

SEQ ID NO: 435637 - DNA, 25 bp, Mus musculus
gactccggcggtttctgcctgccaa

SEQ ID NO: 435638 - DNA, 25 bp, Mus musculus
tcggatcccgcctaccagtgttggc

SEQ ID NO: 435639 - DNA, 25 bp, Mus musculus
atcccgcctaccagtgttggctctt

SEQ ID NO: 435640 - DNA, 25 bp, Mus musculus
gcctaccagtgttggctcttcccga

SEQ ID NO: 435641 - DNA, 25 bp, Mus musculus
taccagtgttggctcttcccgaccc

SEQ ID NO: 435642 - DNA, 25 bp, Mus musculus
cagtgtccgccatggccaaagccta

SEQ ID NO: 435643 - DNA, 25 bp, Mus musculus
agtgtccgccatggccaaagcctac

SEQ ID NO: 435644 - DNA, 25 bp, Mus musculus
tggccaaagcctacgaccacctctt

SEQ ID NO: 435645 - DNA, 25 bp, Mus musculus
acctcttcaagttgctgctcatcgg

SEQ ID NO: 435646 - DNA, 25 bp, Mus musculus
cctggctgggactccggcggtttct

SEQ ID NO: 435647 - DNA, 25 bp, Mus musculus
tgcctgccaaccctcggatcccgcc

SEQ ID NO: 435648 - DNA, 25 bp, Mus musculus
caaagacctcgtgcttctagcaaga

SEQ ID NO: 435649 - DNA, 25 bp, Mus musculus
cgccggctctgcaaacactacaagg

SEQ ID NO: 435650 - DNA, 25 bp, Mus musculus
cgcccagctgaagagtcgcgtgatc

SEQ ID NO: 435651 - DNA, 25 bp, Mus musculus
tcgcgtgatcctgcgcaaacgcagt

SEQ ID NO: 435652 - DNA, 25 bp, Mus musculus
aacgcagtgagatgcagttgccacc

SEQ ID NO: 435653 - DNA, 25 bp, Mus musculus
agttgccaccgagtccggaacgaca

SEQ ID NO: 435654 - DNA, 25 bp, Mus musculus
agcaaacagacgagagcacccggga

SEQ ID NO: 435655 - DNA, 25 bp, Mus musculus
gaccaggagcctccgcgagcaagat

SEQ ID NO: 435656 - DNA, 25 bp, Mus musculus
tcacgaggccgttcctatagcgctc

SEQ ID NO: 435657 - DNA, 25 bp, Mus musculus
aacctcagggaggtctgctgcaaca

SEQ ID NO: 435658 - DNA, 25 bp, Mus musculus
atagcgctctagttggcccagactg

SEQ ID NO: 435659 - DNA, 25 bp, Mus musculus
catggattattctcgctgtggtcac

SEQ ID NO: 435660 - DNA, 25 bp, Mus musculus
tctagcaagacacccgcatggatta

SEQ ID NO: 435661 - DNA, 25 bp, Mus musculus
gcatctggctgctcggagctggaac

SEQ ID NO: 435662 - DNA, 25 bp, Mus musculus
gcgacagcaatggagtgagaccctc

SEQ ID NO: 435663 - DNA, 25 bp, Mus musculus
tcccggttctggcttcgtctcagct

SEQ ID NO: 435664 - DNA, 25 bp, Mus musculus
agacgccgcccagtgcgggcaaagc

SEQ ID NO: 435665 - DNA, 25 bp, Mus musculus
tgttaacatttcctctgcttcctgc

SEQ ID NO: 435666 - DNA, 25 bp, Mus musculus
tcgcagggtcaaaggcagcttctga

SEQ ID NO: 435667 - DNA, 25 bp, Mus musculus
gagctggggtctccgtgttaacatt

SEQ ID NO: 435668 - DNA, 25 bp, Mus musculus
tggtctccgagacttccagacgccg

SEQ ID NO: 435669 - DNA, 25 bp, Mus musculus
gcttctgaggcctcccaggctagga

SEQ ID NO: 435670 - DNA, 25 bp, Mus musculus
aggccggaaccgagcgacagcaatg

SEQ ID NO: 435671 - DNA, 25 bp, Mus musculus
tcagtcattggcagcctcgtgcggg

SEQ ID NO: 435672 - DNA, 25 bp, Mus musculus
tctaggctaggctcctcccactgag

SEQ ID NO: 435673 - DNA, 25 bp, Mus musculus
tcgcagcgcacgtcactctaggcta

SEQ ID NO: 435674 - DNA, 25 bp, Mus musculus
ttcagactctaattgctcgcagcgc

SEQ ID NO: 435675 - DNA, 25 bp, Mus musculus
gccgccagcctagctttctctagtt

SEQ ID NO: 435676 - DNA, 25 bp, Mus musculus
agttctcaggaaagtttgggcaggc

SEQ ID NO: 435677 - DNA, 25 bp, Mus musculus
gttaccatagcaacggagctgcttg

SEQ ID NO: 435678 - DNA, 25 bp, Mus musculus
gagctgcttgctggcgccatttctc

SEQ ID NO: 435679 - DNA, 25 bp, Mus musculus
ctgcgcagtagactagacagttacc

SEQ ID NO: 435680 - DNA, 25 bp, Mus musculus
aggagggaagtctccgcccttagca

SEQ ID NO: 435681 - DNA, 25 bp, Mus musculus
ttagcatgcgaactgcccgaagggc

SEQ ID NO: 435682 - DNA, 25 bp, Mus musculus
ccctcggacttgaggagcagtgaca

SEQ ID NO: 435683 - DNA, 25 bp, Mus musculus
agcagtgacagacctaacccggagc

SEQ ID NO: 435684 - DNA, 25 bp, Mus musculus
caacagagttgaatgccagccgcag

SEQ ID NO: 435685 - DNA, 25 bp, Mus musculus
gacaggcgagtttgctagtcccgcc

SEQ ID NO: 435686 - DNA, 25 bp, Mus musculus
cgcaaggatttgaaaccgtttggct

SEQ ID NO: 435687 - DNA, 25 bp, Mus musculus
tctcttgtttctcccatcgacaatc

SEQ ID NO: 435688 - DNA, 25 bp, Mus musculus
caggttctgagtggaattttgcgcg

SEQ ID NO: 435689 - DNA, 25 bp, Mus musculus
gcgacggccagggaaaagttctcag

SEQ ID NO: 435690 - DNA, 25 bp, Mus musculus
cctgggagcccgatcactgaggagc

SEQ ID NO: 435691 - DNA, 25 bp, Mus musculus
ctgggaagtgatgtccgcttcctgc

SEQ ID NO: 435692 - DNA, 25 bp, Mus musculus
ctccctgcgtgtctgagggcgtaga

SEQ ID NO: 435693 - DNA, 25 bp, Mus musculus
tcagcgtccaatccacgcaagttta

SEQ ID NO: 435694 - DNA, 25 bp, Mus musculus
ccacgcaagtttagtgagaagattg

SEQ ID NO: 435695 - DNA, 25 bp, Mus musculus
tttagtgagaagattgcgctgcaga

SEQ ID NO: 435696 - DNA, 25 bp, Mus musculus
cgctgcagaagcagcgtcaggccga

SEQ ID NO: 435697 - DNA, 25 bp, Mus musculus
ggtgatgatggacatcggctccaca

SEQ ID NO: 435698 - DNA, 25 bp, Mus musculus
tccacacgggtaaggggtcatgcct

SEQ ID NO: 435699 - DNA, 25 bp, Mus musculus
cccgatcactgaggagcgggtcccg

SEQ ID NO: 435700 - DNA, 25 bp, Mus musculus
cccggggtcacacgactgctgggaa

SEQ ID NO: 435701 - DNA, 25 bp, Mus musculus
gatggacatcggctccacacgggta

SEQ ID NO: 435702 - DNA, 25 bp, Mus musculus
tagaactacctttcccggcttgctg

SEQ ID NO: 435703 - DNA, 25 bp, Mus musculus
ggctcgggactgttgtagaactacc

SEQ ID NO: 435704 - DNA, 25 bp, Mus musculus
agatcttcttccaccgtgcccggcg

SEQ ID NO: 435705 - DNA, 25 bp, Mus musculus
acttcccgtcattcggcatgtgggc

SEQ ID NO: 435706 - DNA, 25 bp, Mus musculus
cgcgagcggctcctaagtcgagtgc

SEQ ID NO: 435707 - DNA, 25 bp, Mus musculus
ctcctaagtcgagtgcgccatgtcc

SEQ ID NO: 435708 - DNA, 25 bp, Mus musculus
ccatgtccggggctggatagcagcc

SEQ ID NO: 435709 - DNA, 25 bp, Mus musculus
ccagctgttctacgctgcgcatctg

SEQ ID NO: 435710 - DNA, 25 bp, Mus musculus
cccgcgggcgctcaagccagagcac

SEQ ID NO: 435711 - DNA, 25 bp, Mus musculus
tacgctgcgcatctggttccgcttc

SEQ ID NO: 435712 - DNA, 25 bp, Mus musculus
gggcgcaacccagagctagctagct

SEQ ID NO: 435713 - DNA, 25 bp, Mus musculus
ctagctagctgtgctcgacatccta

SEQ ID NO: 435714 - DNA, 25 bp, Mus musculus
gggacgctgggaccgcccagatctt

SEQ ID NO: 435715 - DNA, 25 bp, Mus musculus
tgtgctcgacatcctacaacctgga

SEQ ID NO: 435716 - DNA, 25 bp, Mus musculus
tcctacaacctggagctcccgcggg

SEQ ID NO: 435717 - DNA, 25 bp, Mus musculus
ctgctgcttcttccttcagcccggg

SEQ ID NO: 435718 - DNA, 25 bp, Mus musculus
gcagcctgaagcgattttttgaccc

SEQ ID NO: 435719 - DNA, 25 bp, Mus musculus
ctggccgaggtacccattaacgcgc

SEQ ID NO: 435720 - DNA, 25 bp, Mus musculus
cccggtctccatctttagacgagaa

SEQ ID NO: 435721 - DNA, 25 bp, Mus musculus
ttagacgagaaagaatgagagcctg

SEQ ID NO: 435722 - DNA, 25 bp, Mus musculus
tgagagcctgtcaaaggagaatccc

SEQ ID NO: 435723 - DNA, 25 bp, Mus musculus
agcctgtcaaaggagaatcccggtt

SEQ ID NO: 435724 - DNA, 25 bp, Mus musculus
ttaagagactaggtggtacggcggc

SEQ ID NO: 435725 - DNA, 25 bp, Mus musculus
ctgccaggggaccaaaacgtctaca

SEQ ID NO: 435726 - DNA, 25 bp, Mus musculus
acgtctacaaggtaaagctgcagcc

SEQ ID NO: 435727 - DNA, 25 bp, Mus musculus
agctgcagcctgaagcgattttttg

SEQ ID NO: 435728 - DNA, 25 bp, Mus musculus
cccgacacttaatgggctgtcgaag

SEQ ID NO: 435729 - DNA, 25 bp, Mus musculus
tcgaagacccggatgtgtctgggac

SEQ ID NO: 435730 - DNA, 25 bp, Mus musculus
tgggactggccgaggtacccattaa

SEQ ID NO: 435731 - DNA, 25 bp, Mus musculus
cttaatgggctgtcgaagacccgga

SEQ ID NO: 435732 - DNA, 25 bp, Mus musculus
cccgaggcctgacactaaagtctgg

SEQ ID NO: 435733 - DNA, 25 bp, Mus musculus
agtggctgccaggtttctttggctc

SEQ ID NO: 435734 - DNA, 25 bp, Mus musculus
ccctgagcattgctaaagccgagta

SEQ ID NO: 435735 - DNA, 25 bp, Mus musculus
gcgcaccctcgcgtttacacatttt

SEQ ID NO: 435736 - DNA, 25 bp, Mus musculus
acgatgcctgtgaccgctcttactc

SEQ ID NO: 435737 - DNA, 25 bp, Mus musculus
ccaggaggggtgtcctatagaaccg

SEQ ID NO: 435738 - DNA, 25 bp, Mus musculus
ggcccacactgtggacggtcgtctg

SEQ ID NO: 435739 - DNA, 25 bp, Mus musculus
cggacccagggtctacgagaacgtg

SEQ ID NO: 435740 - DNA, 25 bp, Mus musculus
gtattgcggagaccgaaccaggcct

SEQ ID NO: 435741 - DNA, 25 bp, Mus musculus
catctgggctaagtgaggtattgcg

SEQ ID NO: 435742 - DNA, 25 bp, Mus musculus
gctgttgactttctgtcgtgggaca

SEQ ID NO: 435743 - DNA, 25 bp, Mus musculus
tgccgtgctctttcgcagctgttga

SEQ ID NO: 435744 - DNA, 25 bp, Mus musculus
tgagacttccttctgccgtgctctt

SEQ ID NO: 435745 - DNA, 25 bp, Mus musculus
gggacggctcctcctgagacttcct

SEQ ID NO: 435746 - DNA, 25 bp, Mus musculus
tgtcttcgctttttactctttctcc

SEQ ID NO: 435747 - DNA, 25 bp, Mus musculus
tgcactgagtcctatgtttgacggc

SEQ ID NO: 435748 - DNA, 25 bp, Mus musculus
cgacccggctggtgtcccttcgtgt

SEQ ID NO: 435749 - DNA, 25 bp, Mus musculus
tgtcccttcgtgtcttcgcttttta

SEQ ID NO: 435750 - DNA, 25 bp, Mus musculus
tgagtcctatgtttgacggcggata

SEQ ID NO: 435751 - DNA, 25 bp, Mus musculus
tccctgcactgagtcctatgtttga

SEQ ID NO: 435752 - DNA, 25 bp, Mus musculus
cgctccctgcactgagtcctatgtt

SEQ ID NO: 435753 - DNA, 25 bp, Mus musculus
cccagtagtgccctcggggtgcggg

SEQ ID NO: 435754 - DNA, 25 bp, Mus musculus
gagcgtcctcctctccgtgttttta

SEQ ID NO: 435755 - DNA, 25 bp, Mus musculus
tcagtacctcatgcccgccatgctc

SEQ ID NO: 435756 - DNA, 25 bp, Mus musculus
ttttcactcagtacctcatgcccgc

SEQ ID NO: 435757 - DNA, 25 bp, Mus musculus
tcgtgtcttcgctttttactctttc

SEQ ID NO: 435758 - DNA, 25 bp, Mus musculus
tggtgtcccttcgtgtcttcgcttt

SEQ ID NO: 435759 - DNA, 25 bp, Mus musculus
tcctatgtttgacggcggataggac

SEQ ID NO: 435760 - DNA, 25 bp, Mus musculus
ggtggtccttcctgaaacactaagc

SEQ ID NO: 435761 - DNA, 25 bp, Mus musculus
agcaatccggttgctctcgcgctca

SEQ ID NO: 435762 - DNA, 25 bp, Mus musculus
gcagccttacctgtggccagcacga

SEQ ID NO: 435763 - DNA, 25 bp, Mus musculus
gccagctttggccagtccgaaccaa

SEQ ID NO: 435764 - DNA, 25 bp, Mus musculus
atccaaaggaaatccgggcccgctg

SEQ ID NO: 435765 - DNA, 25 bp, Mus musculus
taggcgcacacgctccggaatttga

SEQ ID NO: 435766 - DNA, 25 bp, Mus musculus
tagcagccgcatctccagccggagg

SEQ ID NO: 435767 - DNA, 25 bp, Mus musculus
agcctccgcgtagctaaagcgctgc

SEQ ID NO: 435768 - DNA, 25 bp, Mus musculus
acgcgagacgccaggccagactgca

SEQ ID NO: 435769 - DNA, 25 bp, Mus musculus
agactgcacccgctctcagagcttt

SEQ ID NO: 435770 - DNA, 25 bp, Mus musculus
ggccagacgtctagcttcagcagca

SEQ ID NO: 435771 - DNA, 25 bp, Mus musculus
agcagctcacacacactccaggtgg

SEQ ID NO: 435772 - DNA, 25 bp, Mus musculus
taagccagctttggtccggctcgga

SEQ ID NO: 435773 - DNA, 25 bp, Mus musculus
gccatggtgcccttttcctctagtc

SEQ ID NO: 435774 - DNA, 25 bp, Mus musculus
tcgcatccttcctctgcatctggag

SEQ ID NO: 435775 - DNA, 25 bp, Mus musculus
gatccggaaaaagccgggctgcgcc

SEQ ID NO: 435776 - DNA, 25 bp, Mus musculus
tactgctgggcgatccggaaaaagc

SEQ ID NO: 435777 - DNA, 25 bp, Mus musculus
acaagtgtgcccaatcgcatccttc

SEQ ID NO: 435778 - DNA, 25 bp, Mus musculus
tggtctgacgggcaacaagtgtgcc

SEQ ID NO: 435779 - DNA, 25 bp, Mus musculus
attgagtctggtctgacgggcaaca

SEQ ID NO: 435780 - DNA, 25 bp, Mus musculus
attgtagggagaagaattgagtctg

SEQ ID NO: 435781 - DNA, 25 bp, Mus musculus
cccgggctgccaattgtagggagaa

SEQ ID NO: 435782 - DNA, 25 bp, Mus musculus
gcggactggccttttcccgggctgc

SEQ ID NO: 435783 - DNA, 25 bp, Mus musculus
ctctaaggagtaagccgacgacggc

SEQ ID NO: 435784 - DNA, 25 bp, Mus musculus
gtggcgccaggtctctaaggagtaa

SEQ ID NO: 435785 - DNA, 25 bp, Mus musculus
cgccaatagcggcttccgcggtggc

SEQ ID NO: 435786 - DNA, 25 bp, Mus musculus
gcgctatgggaggaccagcttctcc

SEQ ID NO: 435787 - DNA, 25 bp, Mus musculus
gggcgtccgccaatagcggcttccg

SEQ ID NO: 435788 - DNA, 25 bp, Mus musculus
gtcccaccggggcagcagagtatac

SEQ ID NO: 435789 - DNA, 25 bp, Mus musculus
tcaagagcgcccgagccgtagcgag

SEQ ID NO: 435790 - DNA, 25 bp, Mus musculus
acgaagtcgcccagcttgacatggc

SEQ ID NO: 435791 - DNA, 25 bp, Mus musculus
cgatgcagcgccgtcacgaagtcgc

SEQ ID NO: 435792 - DNA, 25 bp, Mus musculus
agcgcagcacccgaagggagtccgt

SEQ ID NO: 435793 - DNA, 25 bp, Mus musculus
tctgatcgccgtcctcgggctcaga

SEQ ID NO: 435794 - DNA, 25 bp, Mus musculus
ctgtcaccatggtctgatcgccgtc

SEQ ID NO: 435795 - DNA, 25 bp, Mus musculus
ggaacccggcatggcctcagcgagc

SEQ ID NO: 435796 - DNA, 25 bp, Mus musculus
aggtgttggtcagcggcagcaccac

SEQ ID NO: 435797 - DNA, 25 bp, Mus musculus
ccaagaccacgggtacgaggtgttg

SEQ ID NO: 435798 - DNA, 25 bp, Mus musculus
gggctgtgctcccacttgagatcca

SEQ ID NO: 435799 - DNA, 25 bp, Mus musculus
cagagtatacgcagccggggcccag

SEQ ID NO: 435800 - DNA, 25 bp, Mus musculus
ggtggttaacgcgtactcatccttc

SEQ ID NO: 435801 - DNA, 25 bp, Mus musculus
aacgagagggcgatctaagaagagc

SEQ ID NO: 435802 - DNA, 25 bp, Mus musculus
ttaacggcccaggaagatctccctc

SEQ ID NO: 435803 - DNA, 25 bp, Mus musculus
gacacgccggccagacgtttctcag

SEQ ID NO: 435804 - DNA, 25 bp, Mus musculus
cgtttctcagccagcctagttcttc

SEQ ID NO: 435805 - DNA, 25 bp, Mus musculus
ttcttcccagcgaagagcggttgtg

SEQ ID NO: 435806 - DNA, 25 bp, Mus musculus
gtgtggcctccattgttcaggatta

SEQ ID NO: 435807 - DNA, 25 bp, Mus musculus
tcaggattaagcgagccatgaggta

SEQ ID NO: 435808 - DNA, 25 bp, Mus musculus
agtggacagaggtgcttgaaagttc

SEQ ID NO: 435809 - DNA, 25 bp, Mus musculus
ttgaaagttccagccgaagtctcgg

SEQ ID NO: 435810 - DNA, 25 bp, Mus musculus
tcggaggaacaagggcctgcatctg

SEQ ID NO: 435811 - DNA, 25 bp, Mus musculus
atggaggagaggtcttaacggccca

SEQ ID NO: 435812 - DNA, 25 bp, Mus musculus
gatctccctccgtgcgcaataagta

SEQ ID NO: 435813 - DNA, 25 bp, Mus musculus
ccgtgcgcaataagtaggctggagc

SEQ ID NO: 435814 - DNA, 25 bp, Mus musculus
tatcgcgcaggcgtttgttgggaca

SEQ ID NO: 435815 - DNA, 25 bp, Mus musculus
ggagttgtgttgatacctgggtctc

SEQ ID NO: 435816 - DNA, 25 bp, Mus musculus
cgtgagagtcgagctgctgcaccgc

SEQ ID NO: 435817 - DNA, 25 bp, Mus musculus
agaccgccgctgtgcaccgcgagag

SEQ ID NO: 435818 - DNA, 25 bp, Mus musculus
ccagcaacccggtcctgcacctgac

SEQ ID NO: 435819 - DNA, 25 bp, Mus musculus
gcacctgaccgcgtgcacgtgagag

SEQ ID NO: 435820 - DNA, 25 bp, Mus musculus
gcacgtgagagtcgagctgctgcac

SEQ ID NO: 435821 - DNA, 25 bp, Mus musculus
cctgacgccctcagcctgccgcgag

SEQ ID NO: 435822 - DNA, 25 bp, Mus musculus
gctgcaccgcgggtcgcaggaactc

SEQ ID NO: 435823 - DNA, 25 bp, Mus musculus
cgggtcgcaggaactccaggagccc

SEQ ID NO: 435824 - DNA, 25 bp, Mus musculus
ggaactccaggagcccctcggcaaa

SEQ ID NO: 435825 - DNA, 25 bp, Mus musculus
cctcggcaaagaggtcgcggcctgt

SEQ ID NO: 435826 - DNA, 25 bp, Mus musculus
cgcggccatcgcgaactgccctgac

SEQ ID NO: 435827 - DNA, 25 bp, Mus musculus
gtcgccgggaactccagaccgccgc

SEQ ID NO: 435828 - DNA, 25 bp, Mus musculus
tcgcgaactgccctgacgccctcag

SEQ ID NO: 435829 - DNA, 25 bp, Mus musculus
accgcgtgcacgtgagagtcgagct

SEQ ID NO: 435830 - DNA, 25 bp, Mus musculus
acttctccaagtggcgttggggacg

SEQ ID NO: 435831 - DNA, 25 bp, Mus musculus
cgccagcggatcaatggtgagtgcc

SEQ ID NO: 435832 - DNA, 25 bp, Mus musculus
gcgtgttcatgcgagtgcttttgga

SEQ ID NO: 435833 - DNA, 25 bp, Mus musculus
ttgaagttggcaggccggctatttc

SEQ ID NO: 435834 - DNA, 25 bp, Mus musculus
gcacagttaaatccacagcgcagtt

SEQ ID NO: 435835 - DNA, 25 bp, Mus musculus
gcagtttttgttggaagcgcccgga

SEQ ID NO: 435836 - DNA, 25 bp, Mus musculus
ccggaggacatttggtgcgcctagt

SEQ ID NO: 435837 - DNA, 25 bp, Mus musculus
gggccggtcagggagacttctccaa

SEQ ID NO: 435838 - DNA, 25 bp, Mus musculus
gtgcgcctagtgactgctggaaaca

SEQ ID NO: 435839 - DNA, 25 bp, Mus musculus
ctcgcgcctttgaagtgcacagtta

SEQ ID NO: 435840 - DNA, 25 bp, Mus musculus
gaggcccactcggatcttttgcata

SEQ ID NO: 435841 - DNA, 25 bp, Mus musculus
tcttttgcataaaaggggcagcggg

SEQ ID NO: 435842 - DNA, 25 bp, Mus musculus
cgcagacctcgggatcgttgttttc

SEQ ID NO: 435843 - DNA, 25 bp, Mus musculus
aggtctccgcaaggagtgcgccagc

SEQ ID NO: 435844 - DNA, 25 bp, Mus musculus
cgtggcaacatggtcctttggccta

SEQ ID NO: 435845 - DNA, 25 bp, Mus musculus
agttacgtgtagtgctccgccttcg

SEQ ID NO: 435846 - DNA, 25 bp, Mus musculus
gcaaagatcccttaagttacgtgta

SEQ ID NO: 435847 - DNA, 25 bp, Mus musculus
tgactttggcaaagatcccttaagt

SEQ ID NO: 435848 - DNA, 25 bp, Mus musculus
ggtcctttggcctagcgcaagaatc

SEQ ID NO: 435849 - DNA, 25 bp, Mus musculus
cgcgcaactaggggcgtggcaacat

SEQ ID NO: 435850 - DNA, 25 bp, Mus musculus
aaatggcgccgacgggcttgcgtca

SEQ ID NO: 435851 - DNA, 25 bp, Mus musculus
tgaccggctaaaatggcgccgacgg

SEQ ID NO: 435852 - DNA, 25 bp, Mus musculus
cagtgcagcgtgaccggctaaaatg

SEQ ID NO: 435853 - DNA, 25 bp, Mus musculus
cttggtgtccaaaacaaaatggccg

SEQ ID NO: 435854 - DNA, 25 bp, Mus musculus
cccgcttggtgtccaaaacaaaatg

SEQ ID NO: 435855 - DNA, 25 bp, Mus musculus
aacctgagctgacggcgggccgctc

SEQ ID NO: 435856 - DNA, 25 bp, Mus musculus
ggaggccggcctaacctgagctgac

SEQ ID NO: 435857 - DNA, 25 bp, Mus musculus
cctagcgcaagaatcgcagcgaatc

SEQ ID NO: 435858 - DNA, 25 bp, Mus musculus
tggccgatcggctgcacatcagccg

SEQ ID NO: 435859 - DNA, 25 bp, Mus musculus
cttttgtaagaacctatgtgagacg

SEQ ID NO: 435860 - DNA, 25 bp, Mus musculus
agaacctatgtgaatctgtggagtc

SEQ ID NO: 435861 - DNA, 25 bp, Mus musculus
gaatactcaagtgcttggtcttata

SEQ ID NO: 435862 - DNA, 25 bp, Mus musculus
agaatatagacatggttttaaatcg

SEQ ID NO: 435863 - DNA, 25 bp, Mus musculus
gaacaacagaatggacagaaatatt

SEQ ID NO: 435864 - DNA, 25 bp, Mus musculus
taagaacctatgtgagacgtagctc

SEQ ID NO: 435865 - DNA, 25 bp, Mus musculus
cctatgtgagacgtagctcaggtcc

SEQ ID NO: 435866 - DNA, 25 bp, Mus musculus
ctattacatgaactctgccaacgtg

SEQ ID NO: 435867 - DNA, 25 bp, Mus musculus
cctatgtgaatctgtggagtcagta

SEQ ID NO: 435868 - DNA, 25 bp, Mus musculus
ctgtggagtcagtataaagaaactc

SEQ ID NO: 435869 - DNA, 25 bp, Mus musculus
ctcttgagttgatgttagttgttta

SEQ ID NO: 435870 - DNA, 25 bp, Mus musculus
agttgtttagagaatactcaagtgc

SEQ ID NO: 435871 - DNA, 25 bp, Mus musculus
gtggaataaaagaatatagacatgg

SEQ ID NO: 435872 - DNA, 25 bp, Mus musculus
gccgggaacaagaacgccgcctgga

SEQ ID NO: 435873 - DNA, 25 bp, Mus musculus
aacgccaccaggaacgtgaggaaga

SEQ ID NO: 435874 - DNA, 25 bp, Mus musculus
ccgccgggaacaagaacgccaccag

SEQ ID NO: 435875 - DNA, 25 bp, Mus musculus
acgccaccaggaacgtgaggaagag

SEQ ID NO: 435876 - DNA, 25 bp, Mus musculus
cgccgggaacaagaacgccaccagg

SEQ ID NO: 435877 - DNA, 25 bp, Mus musculus
cgccaccaggaacgtgaggaagagc

SEQ ID NO: 435878 - DNA, 25 bp, Mus musculus
aagagcagctgcgggacagaccatc

SEQ ID NO: 435879 - DNA, 25 bp, Mus musculus
gagcagctgcgggacagaccatccc

SEQ ID NO: 435880 - DNA, 25 bp, Mus musculus
gcgggacagaccatcccgccgggaa

SEQ ID NO: 435881 - DNA, 25 bp, Mus musculus
aacaagaacgccaccaggaacgtga

SEQ ID NO: 435882 - DNA, 25 bp, Mus musculus
gaacgccaccaggaacgtgaggaag

SEQ ID NO: 435883 - DNA, 25 bp, Mus musculus
gggacagaccatcccgccgggaaca

SEQ ID NO: 435884 - DNA, 25 bp, Mus musculus
cgccgggaacaagaacgccgcctgg

SEQ ID NO: 435885 - DNA, 25 bp, Mus musculus
gaacaagaacgccaccaggaacgtg

SEQ ID NO: 435886 - DNA, 25 bp, Mus musculus
accagagattccgtcgggaacaaga

SEQ ID NO: 435887 - DNA, 25 bp, Mus musculus
agcgcgaccgtcagatcctagagga

SEQ ID NO: 435888 - DNA, 25 bp, Mus musculus
tgacagaaaattacaccgggaacta

SEQ ID NO: 435889 - DNA, 25 bp, Mus musculus
ccgccgccaggaatgtgacagaaaa

SEQ ID NO: 435890 - DNA, 25 bp, Mus musculus
tcattccgccgggagcaagagctca

SEQ ID NO: 435891 - DNA, 25 bp, Mus musculus
tctcgtgaacaagagcgccgccagc

SEQ ID NO: 435892 - DNA, 25 bp, Mus musculus
cggcaggaatgcgacagaaaatctc

SEQ ID NO: 435893 - DNA, 25 bp, Mus musculus
gaggagcacctccaagaacgcgaga

SEQ ID NO: 435894 - DNA, 25 bp, Mus musculus
ggcgtcaagaacaagagagagaatt

SEQ ID NO: 435895 - DNA, 25 bp, Mus musculus
tccagggagaatcgagaagacggca

SEQ ID NO: 435896 - DNA, 25 bp, Mus musculus
cgttccaggaggaagaacagctcca

SEQ ID NO: 435897 - DNA, 25 bp, Mus musculus
gcaccaacgggaagccagaagacga

SEQ ID NO: 435898 - DNA, 25 bp, Mus musculus
agagcagtttcagcgagagcaccaa

SEQ ID NO: 435899 - DNA, 25 bp, Mus musculus
gcaagagctcagacgggacagaaaa

SEQ ID NO: 435900 - DNA, 25 bp, Mus musculus
cgctaggcgttcatgaagactagaa

SEQ ID NO: 435901 - DNA, 25 bp, Mus musculus
gtgagcccctgaacccaaccagtgg

SEQ ID NO: 435902 - DNA, 25 bp, Mus musculus
aaataagttctaggctgggtgcggc

SEQ ID NO: 435903 - DNA, 25 bp, Mus musculus
cccgggcaaaataagttctaggctg

SEQ ID NO: 435904 - DNA, 25 bp, Mus musculus
ctgggtgcggctgcctaactggcct

SEQ ID NO: 435905 - DNA, 25 bp, Mus musculus
tgcggctgcctaactggcctgagcc

SEQ ID NO: 435906 - DNA, 25 bp, Mus musculus
ccgctagactccctggggccgtgag

SEQ ID NO: 435907 - DNA, 25 bp, Mus musculus
aacccaaccagtggcggccgccaga

SEQ ID NO: 435908 - DNA, 25 bp, Mus musculus
ccagagagctgcagactcagtgaga

SEQ ID NO: 435909 - DNA, 25 bp, Mus musculus
agctgcagactcagtgagaacttgg

SEQ ID NO: 435910 - DNA, 25 bp, Mus musculus
cgtcgctaggcgttcatgaagacta

SEQ ID NO: 435911 - DNA, 25 bp, Mus musculus
tcatgaagactagaaagaaagcggt

SEQ ID NO: 435912 - DNA, 25 bp, Mus musculus
actagaaagaaagcggttcagaacg

SEQ ID NO: 435913 - DNA, 25 bp, Mus musculus
ggcagcgtcgctaggcgttcatgaa

SEQ ID NO: 435914 - DNA, 25 bp, Mus musculus
agcccagactcggatctcctcctga

SEQ ID NO: 435915 - DNA, 25 bp, Mus musculus
atgctgtgaaaagagccgctgcttg

SEQ ID NO: 435916 - DNA, 25 bp, Mus musculus
agccgcaagggatgctgtgaaaaga

SEQ ID NO: 435917 - DNA, 25 bp, Mus musculus
gaaaagagccgctgcttgccgcctc

SEQ ID NO: 435918 - DNA, 25 bp, Mus musculus
ctcattcttcttctttccatcttgc

SEQ ID NO: 435919 - DNA, 25 bp, Mus musculus
agcgggctcagacccgatctctgct

SEQ ID NO: 435920 - DNA, 25 bp, Mus musculus
tgactcccgccgcagtcagagagag

SEQ ID NO: 435921 - DNA, 25 bp, Mus musculus
gccgcagtcagagagagcgcatctg

SEQ ID NO: 435922 - DNA, 25 bp, Mus musculus
gagcgcatctgctgcgctgccctta

SEQ ID NO: 435923 - DNA, 25 bp, Mus musculus
atctgctgcgctgcccttaaatcta

SEQ ID NO: 435924 - DNA, 25 bp, Mus musculus
gctgcccttaaatctacgcccagag

SEQ ID NO: 435925 - DNA, 25 bp, Mus musculus
cccttaaatctacgcccagagcggg

SEQ ID NO: 435926 - DNA, 25 bp, Mus musculus
tctgctctccagagccggaggaagc

SEQ ID NO: 435927 - DNA, 25 bp, Mus musculus
tccggcctgccgtccagagggctcc

SEQ ID NO: 435928 - DNA, 25 bp, Mus musculus
ggtgtgcccagctcttccaaggact

SEQ ID NO: 435929 - DNA, 25 bp, Mus musculus
ttcggatgcccccagactcgctggg

SEQ ID NO: 435930 - DNA, 25 bp, Mus musculus
tctgtacccgcctcgcgtacaaaga

SEQ ID NO: 435931 - DNA, 25 bp, Mus musculus
tcgcgtacaaagacgcgcggtcttc

SEQ ID NO: 435932 - DNA, 25 bp, Mus musculus
caaagacgcgcggtcttcggcacta

SEQ ID NO: 435933 - DNA, 25 bp, Mus musculus
gcggtcttcggcactagcctcatcg

SEQ ID NO: 435934 - DNA, 25 bp, Mus musculus
tcggcactagcctcatcgtggtgtg

SEQ ID NO: 435935 - DNA, 25 bp, Mus musculus
ctagcctcatcgtggtgtgcccagc

SEQ ID NO: 435936 - DNA, 25 bp, Mus musculus
gcccaggtgagtcccgcacctaata

SEQ ID NO: 435937 - DNA, 25 bp, Mus musculus
gtgagtcccgcacctaatatctgcc

SEQ ID NO: 435938 - DNA, 25 bp, Mus musculus
acacccgcttgcttcggcctccagc

SEQ ID NO: 435939 - DNA, 25 bp, Mus musculus
ccagccaggcttcgcgaggagccgc

SEQ ID NO: 435940 - DNA, 25 bp, Mus musculus
tccagctcgcacactgcttcggatg

SEQ ID NO: 435941 - DNA, 25 bp, Mus musculus
cttccaaggactgctgcgcttcggg

SEQ ID NO: 435942 - DNA, 25 bp, Mus musculus
ggcagctgcgcctgtccaccgagta

SEQ ID NO: 435943 - DNA, 25 bp, Mus musculus
ttatagggtacggaccgcagaggcc

SEQ ID NO: 435944 - DNA, 25 bp, Mus musculus
gtcgccgcgagtccttgttccacgg

SEQ ID NO: 435945 - DNA, 25 bp, Mus musculus
ccagctcggcggacactagtccgta

SEQ ID NO: 435946 - DNA, 25 bp, Mus musculus
accaaggacagcgtgctgcgcctgg

SEQ ID NO: 435947 - DNA, 25 bp, Mus musculus
tgtccaccgagtaccaggcggggcc

SEQ ID NO: 435948 - DNA, 25 bp, Mus musculus
tgctgcgtgattctgcggctgcagc

SEQ ID NO: 435949 - DNA, 25 bp, Mus musculus
gtggtccagagcagctgcaacccta

SEQ ID NO: 435950 - DNA, 25 bp, Mus musculus
gctgcaaccctatcttcaacgaaga

SEQ ID NO: 435951 - DNA, 25 bp, Mus musculus
agacttcttcttcgaggggctgcgc

SEQ ID NO: 435952 - DNA, 25 bp, Mus musculus
ccggatctggccgtccgcagtctga

SEQ ID NO: 435953 - DNA, 25 bp, Mus musculus
tccgcagtctgagggccaaagtgct

SEQ ID NO: 435954 - DNA, 25 bp, Mus musculus
agtctgagggccaaagtgctggaca

SEQ ID NO: 435955 - DNA, 25 bp, Mus musculus
caactgcggccgaccaaggacagcg

SEQ ID NO: 435956 - DNA, 25 bp, Mus musculus
ggagcgcgattggtcagacttcaaa

SEQ ID NO: 435957 - DNA, 25 bp, Mus musculus
gctcacggcagtccgcagaaggatt

SEQ ID NO: 435958 - DNA, 25 bp, Mus musculus
taattggacttgagcgcgcaccagc

SEQ ID NO: 435959 - DNA, 25 bp, Mus musculus
gcgggcttggattttcatccgggta

SEQ ID NO: 435960 - DNA, 25 bp, Mus musculus
ttctcagcaggtgcgagctccatta

SEQ ID NO: 435961 - DNA, 25 bp, Mus musculus
cctcctagaggaggaccgaggactc

SEQ ID NO: 435962 - DNA, 25 bp, Mus musculus
gcgccaaagtccctcgcggcttaaa

SEQ ID NO: 435963 - DNA, 25 bp, Mus musculus
cgccgcaatcaggaggtggcttccc

SEQ ID NO: 435964 - DNA, 25 bp, Mus musculus
ttcttaacagataaagtggcgccgc

SEQ ID NO: 435965 - DNA, 25 bp, Mus musculus
ggggtccatccaggcagaaattctt

SEQ ID NO: 435966 - DNA, 25 bp, Mus musculus
agtttttcaagcaaaccgctgcctg

SEQ ID NO: 435967 - DNA, 25 bp, Mus musculus
acggcggctggaattcagtttttca

SEQ ID NO: 435968 - DNA, 25 bp, Mus musculus
ccctcgcctcaaagtgaaggtggta

SEQ ID NO: 435969 - DNA, 25 bp, Mus musculus
tagggaccctggcaattggaagacc

SEQ ID NO: 435970 - DNA, 25 bp, Mus musculus
ccgggagctattccggccgcgaatt

SEQ ID NO: 435971 - DNA, 25 bp, Mus musculus
gcggggttgcggcaactctcccact

SEQ ID NO: 435972 - DNA, 25 bp, Mus musculus
ggtctcagcgcagcctatatctata

SEQ ID NO: 435973 - DNA, 25 bp, Mus musculus
atatctataccactcaggcgcgccg

SEQ ID NO: 435974 - DNA, 25 bp, Mus musculus
tgtcgttcgtgccagactcagactg

SEQ ID NO: 435975 - DNA, 25 bp, Mus musculus
cgtcaaggaggcatccgggagctat

SEQ ID NO: 435976 - DNA, 25 bp, Mus musculus
tccggccgcgaattgaagggagtac

SEQ ID NO: 435977 - DNA, 25 bp, Mus musculus
cttcagtctctctcattatcaggtg

SEQ ID NO: 435978 - DNA, 25 bp, Mus musculus
ctcattatcaggtgagggccggctg

SEQ ID NO: 435979 - DNA, 25 bp, Mus musculus
cggcgtcaccgcgtgtataagttgg

SEQ ID NO: 435980 - DNA, 25 bp, Mus musculus
cgctgtcctatcgtcggcgtgcaag

SEQ ID NO: 435981 - DNA, 25 bp, Mus musculus
tgaccaccagagcacggtcatcgtg

SEQ ID NO: 435982 - DNA, 25 bp, Mus musculus
ttgttctctgcggacactcgctcac

SEQ ID NO: 435983 - DNA, 25 bp, Mus musculus
agttggtggaggacacgaaacaccg

SEQ ID NO: 435984 - DNA, 25 bp, Mus musculus
tctcgagctaagagaggtgcggcct

SEQ ID NO: 435985 - DNA, 25 bp, Mus musculus
cccgcacgttgaagccgtagccgga

SEQ ID NO: 435986 - DNA, 25 bp, Mus musculus
gccgtagccggattcggacttgaca

SEQ ID NO: 435987 - DNA, 25 bp, Mus musculus
accgctggagctagtgggccaccgc

SEQ ID NO: 435988 - DNA, 25 bp, Mus musculus
ctccgccgaccgctggagctagtgg

SEQ ID NO: 435989 - DNA, 25 bp, Mus musculus
caggctctcgagctaagagaggtgc

SEQ ID NO: 435990 - DNA, 25 bp, Mus musculus
cgtggcggcagcgatactcacacct

SEQ ID NO: 435991 - DNA, 25 bp, Mus musculus
cttgacaatgcgcacgacccgcggg

SEQ ID NO: 435992 - DNA, 25 bp, Mus musculus
gcgatactcacacctccaggatgcg

SEQ ID NO: 435993 - DNA, 25 bp, Mus musculus
agcacggcgctcacatgctgcagcg

SEQ ID NO: 435994 - DNA, 25 bp, Mus musculus
gctccccgttgatgctccgcagttg

SEQ ID NO: 435995 - DNA, 25 bp, Mus musculus
agttgcccgccctcgctcacttggc

SEQ ID NO: 435996 - DNA, 25 bp, Mus musculus
ccggattcggacttgacaatgcgca

SEQ ID NO: 435997 - DNA, 25 bp, Mus musculus
gtccgccatcttgcgagcaagcgag

SEQ ID NO: 435998 - DNA, 25 bp, Mus musculus
gcctttgaaaaagctgcgtcggata

SEQ ID NO: 435999 - DNA, 25 bp, Mus musculus
gggcactttgagaactcgagttatc

SEQ ID NO: 436000 - DNA, 25 bp, Mus musculus
tggagctcagatttcgcctttgaaa

SEQ ID NO: 436001 - DNA, 25 bp, Mus musculus
aaagtgtgtgtggagctcagatttc

SEQ ID NO: 436002 - DNA, 25 bp, Mus musculus
gtgtcactgtttctgcctcaccttc

SEQ ID NO: 436003 - DNA, 25 bp, Mus musculus
gtgtcttacacctcccgtgtcactg

SEQ ID NO: 436004 - DNA, 25 bp, Mus musculus
atgcggggaaggttgtgtcttacac

SEQ ID NO: 436005 - DNA, 25 bp, Mus musculus
ggctagactacctacccggcgtgtc

SEQ ID NO: 436006 - DNA, 25 bp, Mus musculus
gagtgggtacggctagactacctac

SEQ ID NO: 436007 - DNA, 25 bp, Mus musculus
ctggcttgcgtgttctggttgtcgt

SEQ ID NO: 436008 - DNA, 25 bp, Mus musculus
aattggtttcacctgcacgcagccg

SEQ ID NO: 436009 - DNA, 25 bp, Mus musculus
cagagtggggaagtttactgaaatt

SEQ ID NO: 436010 - DNA, 25 bp, Mus musculus
tgagaactcgagttatctgtgcaga

SEQ ID NO: 436011 - DNA, 25 bp, Mus musculus
gtcggatacttgagacgagcacctc

SEQ ID NO: 436012 - DNA, 25 bp, Mus musculus
tactcggatgcgatatggaacgttc

SEQ ID NO: 436013 - DNA, 25 bp, Mus musculus
cgaatttctttgagcgcccgaggag

SEQ ID NO: 436014 - DNA, 25 bp, Mus musculus
cttccgaatttctttgagcgcccga

SEQ ID NO: 436015 - DNA, 25 bp, Mus musculus
ccttcatggcaaacttccgaatttc

SEQ ID NO: 436016 - DNA, 25 bp, Mus musculus
catttccttcatggcaaacttccga

SEQ ID NO: 436017 - DNA, 25 bp, Mus musculus
ctttttgagcctggtgtcaatgcgc

SEQ ID NO: 436018 - DNA, 25 bp, Mus musculus
cagacggctttttgagcctggtgtc

SEQ ID NO: 436019 - DNA, 25 bp, Mus musculus
tggcccagacggctttttgagcctg

SEQ ID NO: 436020 - DNA, 25 bp, Mus musculus
tcccttggcccagacggctttttga

SEQ ID NO: 436021 - DNA, 25 bp, Mus musculus
cggatgcgatatggaacgttcctta

SEQ ID NO: 436022 - DNA, 25 bp, Mus musculus
tggacaagcgtactcggatgcgata

SEQ ID NO: 436023 - DNA, 25 bp, Mus musculus
ttctggacaagcgtactcggatgcg

SEQ ID NO: 436024 - DNA, 25 bp, Mus musculus
cgttttctggacaagcgtactcgga

SEQ ID NO: 436025 - DNA, 25 bp, Mus musculus
atatggaacgttccttattcccttg

SEQ ID NO: 436026 - DNA, 25 bp, Mus musculus
tcccgttcatcttcacgcggaggtc

SEQ ID NO: 436027 - DNA, 25 bp, Mus musculus
gccaagaggcttcaggactcgccta

SEQ ID NO: 436028 - DNA, 25 bp, Mus musculus
caacgtccgaaacagcgcagggatc

SEQ ID NO: 436029 - DNA, 25 bp, Mus musculus
tgaaggtgacgacctaccgcggtct

SEQ ID NO: 436030 - DNA, 25 bp, Mus musculus
gcctacccgtgctatggacgattta

SEQ ID NO: 436031 - DNA, 25 bp, Mus musculus
cgcccagggcggtatttatcaatga

SEQ ID NO: 436032 - DNA, 25 bp, Mus musculus
cgcggaggtcgtatgagcttcctca

SEQ ID NO: 436033 - DNA, 25 bp, Mus musculus
ccgggtgcacgtccaccaaggtaca

SEQ ID NO: 436034 - DNA, 25 bp, Mus musculus
atgggctacctgagcctgaggcacg

SEQ ID NO: 436035 - DNA, 25 bp, Mus musculus
ccacagtccgccacagggcaaagga

SEQ ID NO: 436036 - DNA, 25 bp, Mus musculus
ctgccagtgtttcgtcctgtgcttc

SEQ ID NO: 436037 - DNA, 25 bp, Mus musculus
agctgcccacgagacgcctgagtaa

SEQ ID NO: 436038 - DNA, 25 bp, Mus musculus
gagcgtcttccacgacccaatctag

SEQ ID NO: 436039 - DNA, 25 bp, Mus musculus
gctggaaagccactgtgcctgagtg

SEQ ID NO: 436040 - DNA, 25 bp, Mus musculus
tgtccagactctggctccgcttgcg

SEQ ID NO: 436041 - DNA, 25 bp, Mus musculus
ctctggctccgcttgcgctgttcgt

SEQ ID NO: 436042 - DNA, 25 bp, Mus musculus
ggagcctgctgtccagactctggct

SEQ ID NO: 436043 - DNA, 25 bp, Mus musculus
cacgtgtatcccgtgggagcctgct

SEQ ID NO: 436044 - DNA, 25 bp, Mus musculus
tggtgctcccgttcctcacgtgtat

SEQ ID NO: 436045 - DNA, 25 bp, Mus musculus
cagtggttagcggactggtgctccc

SEQ ID NO: 436046 - DNA, 25 bp, Mus musculus
tgtcatactttgtgccgcgggtcca

SEQ ID NO: 436047 - DNA, 25 bp, Mus musculus
ctgtccacatggttgtcatactttg

SEQ ID NO: 436048 - DNA, 25 bp, Mus musculus
gggttctttgaactgtccacatggt

SEQ ID NO: 436049 - DNA, 25 bp, Mus musculus
ctgcttctgcgatgggttctttgaa

SEQ ID NO: 436050 - DNA, 25 bp, Mus musculus
gctgaacgggctctgcttctgcgat

SEQ ID NO: 436051 - DNA, 25 bp, Mus musculus
ctgaagctgctgaacgggctctgct

SEQ ID NO: 436052 - DNA, 25 bp, Mus musculus
cgcgaacggctgaagctgctgaacg

SEQ ID NO: 436053 - DNA, 25 bp, Mus musculus
aagtgtccttgtgcggcgcccagtg

SEQ ID NO: 436054 - DNA, 25 bp, Mus musculus
tcttcgtagtctcccgatgtcagcg

SEQ ID NO: 436055 - DNA, 25 bp, Mus musculus
tcgcctgccttatcggcaatccgaa

SEQ ID NO: 436056 - DNA, 25 bp, Mus musculus
cggccctcgagcatactcctgagga

SEQ ID NO: 436057 - DNA, 25 bp, Mus musculus
ctgaggacccactcgcatcgcaggt

SEQ ID NO: 436058 - DNA, 25 bp, Mus musculus
atcgcaggtgtcctcgctccagaca

SEQ ID NO: 436059 - DNA, 25 bp, Mus musculus
gtccagatcagtgctcccggattca

SEQ ID NO: 436060 - DNA, 25 bp, Mus musculus
tattggtcagtttcccgcaaggggc

SEQ ID NO: 436061 - DNA, 25 bp, Mus musculus
ccgcgtagcttagcgccagagcatc

SEQ ID NO: 436062 - DNA, 25 bp, Mus musculus
tgggaagtgccttcctcgtgctctt

SEQ ID NO: 436063 - DNA, 25 bp, Mus musculus
aaatctcggttcacagccctttctg

SEQ ID NO: 436064 - DNA, 25 bp, Mus musculus
atgtcagcgcgttctgcatctctgc

SEQ ID NO: 436065 - DNA, 25 bp, Mus musculus
atacagttctgtcgctttccgcaga

SEQ ID NO: 436066 - DNA, 25 bp, Mus musculus
ggcaatccgaaccaaaatctcagtc

SEQ ID NO: 436067 - DNA, 25 bp, Mus musculus
ctccgcataagccagaatacagttc

SEQ ID NO: 436068 - DNA, 25 bp, Mus musculus
tcagtgcggaagctctccaaaatcg

SEQ ID NO: 436069 - DNA, 25 bp, Mus musculus
gcttagtcgcctacctcaaccaagg

SEQ ID NO: 436070 - DNA, 25 bp, Mus musculus
ctcttcctgcacaagagcctgggca

SEQ ID NO: 436071 - DNA, 25 bp, Mus musculus
tggaggcggcttttcgctccacacc

SEQ ID NO: 436072 - DNA, 25 bp, Mus musculus
gtttcgagcccgctgatcccgaagg

SEQ ID NO: 436073 - DNA, 25 bp, Mus musculus
cctggaggaaatgcggcgcttagtc

SEQ ID NO: 436074 - DNA, 25 bp, Mus musculus
ggccgcgagcgaagacgacctcttc

SEQ ID NO: 436075 - DNA, 25 bp, Mus musculus
acgcgcacagcccttcagtgcggaa

SEQ ID NO: 436076 - DNA, 25 bp, Mus musculus
agctgcgcgcggtcattccttacgc

SEQ ID NO: 436077 - DNA, 25 bp, Mus musculus
cgacctgaacgacgctctggatgag

SEQ ID NO: 436078 - DNA, 25 bp, Mus musculus
aacatcaacgctcgcgagcgccgga

SEQ ID NO: 436079 - DNA, 25 bp, Mus musculus
aaggcgttgcgcctcaacatcaacg

SEQ ID NO: 436080 - DNA, 25 bp, Mus musculus
cccacttgcatggtggctcgggcct

SEQ ID NO: 436081 - DNA, 25 bp, Mus musculus
gccctgtgcctcaagtacggcgaga

SEQ ID NO: 436082 - DNA, 25 bp, Mus musculus
ttccgaaacgagacaatgagagggg

SEQ ID NO: 436083 - DNA, 25 bp, Mus musculus
ccgaggcgttccgaaacgagacaat

SEQ ID NO: 436084 - DNA, 25 bp, Mus musculus
ttccgttatcttttcgctgggccga

SEQ ID NO: 436085 - DNA, 25 bp, Mus musculus
acggcaccttcctcgggtcagacta

SEQ ID NO: 436086 - DNA, 25 bp, Mus musculus
tcactcgaacccgagggaggcttcc

SEQ ID NO: 436087 - DNA, 25 bp, Mus musculus
gagaggagctttcaacggttccctc

SEQ ID NO: 436088 - DNA, 25 bp, Mus musculus
gtgttatgtaatcccgctccgtctg

SEQ ID NO: 436089 - DNA, 25 bp, Mus musculus
tcaccctcggggagaggagctttca

SEQ ID NO: 436090 - DNA, 25 bp, Mus musculus
cgagggaggcttcctttcaccctcg

SEQ ID NO: 436091 - DNA, 25 bp, Mus musculus
gacgtagcgtactagccagccaatt

SEQ ID NO: 436092 - DNA, 25 bp, Mus musculus
gccagccaattgaaagagcacgaga

SEQ ID NO: 436093 - DNA, 25 bp, Mus musculus
gcggaagtgacgagaggtatccctc

SEQ ID NO: 436094 - DNA, 25 bp, Mus musculus
atacacggagccacattccttggcc

SEQ ID NO: 436095 - DNA, 25 bp, Mus musculus
ctcgggtcagactaccggcggcgac

SEQ ID NO: 436096 - DNA, 25 bp, Mus musculus
cgcataatacgagagatattgcgga

SEQ ID NO: 436097 - DNA, 25 bp, Mus musculus
ttagtcacctcagccgacagaaatg

SEQ ID NO: 436098 - DNA, 25 bp, Mus musculus
tcccaaaacgcttccatcttagtca

SEQ ID NO: 436099 - DNA, 25 bp, Mus musculus
agtggccagcccgtgactcccaaaa

SEQ ID NO: 436100 - DNA, 25 bp, Mus musculus
gatgcggtaaaactgccctggagcc

SEQ ID NO: 436101 - DNA, 25 bp, Mus musculus
agcgcgactcactgggtccgagtga

SEQ ID NO: 436102 - DNA, 25 bp, Mus musculus
cctgaatcgtgaaaagggtccctga

SEQ ID NO: 436103 - DNA, 25 bp, Mus musculus
ggtcaccatggggttcctgaatcgt

SEQ ID NO: 436104 - DNA, 25 bp, Mus musculus
gagtaccgatgtcccggtcaccatg

SEQ ID NO: 436105 - DNA, 25 bp, Mus musculus
atattgcggaaacgagccagggagc

SEQ ID NO: 436106 - DNA, 25 bp, Mus musculus
agtgctgtcgttgactcgcataata

SEQ ID NO: 436107 - DNA, 25 bp, Mus musculus
cccgaggcacccagcatagtgctgt

SEQ ID NO: 436108 - DNA, 25 bp, Mus musculus
gaaagcgctagcgtcaccggaaacg

SEQ ID NO: 436109 - DNA, 25 bp, Mus musculus
ggagcccagcatgtctgcagcaatc

SEQ ID NO: 436110 - DNA, 25 bp, Mus musculus
gggcaacagcactccggagctagca

SEQ ID NO: 436111 - DNA, 25 bp, Mus musculus
ctaatgtccgtgctggaaggcgacg

SEQ ID NO: 436112 - DNA, 25 bp, Mus musculus
ggagctagcaggaccagctccttgc

SEQ ID NO: 436113 - DNA, 25 bp, Mus musculus
gtagccacagggtagtttctctttc

SEQ ID NO: 436114 - DNA, 25 bp, Mus musculus
taaaagcaacgcacgagcccgccgg

SEQ ID NO: 436115 - DNA, 25 bp, Mus musculus
ctggcataaccattcagaaaaagga

SEQ ID NO: 436116 - DNA, 25 bp, Mus musculus
cgcggctggcataaccattcagaaa

SEQ ID NO: 436117 - DNA, 25 bp, Mus musculus
ttctctctcacctatctaatgtccg

SEQ ID NO: 436118 - DNA, 25 bp, Mus musculus
cgtgcccgaatctgggaccctgttc

SEQ ID NO: 436119 - DNA, 25 bp, Mus musculus
ctgagttcggagacctagcccagca

SEQ ID NO: 436120 - DNA, 25 bp, Mus musculus
acctagcccagcacctggggttggg

SEQ ID NO: 436121 - DNA, 25 bp, Mus musculus
gctgaggtagccacagggtagtttc

SEQ ID NO: 436122 - DNA, 25 bp, Mus musculus
cgtgcgtgtatccaggcagatcgcg

SEQ ID NO: 436123 - DNA, 25 bp, Mus musculus
gcagatcgcggctggcataaccatt

SEQ ID NO: 436124 - DNA, 25 bp, Mus musculus
gaacctcgtcggctccgtgtggaac

SEQ ID NO: 436125 - DNA, 25 bp, Mus musculus
tggacctgtcattcaactgtgagcc

SEQ ID NO: 436126 - DNA, 25 bp, Mus musculus
ctcagtctaagagcgccaggactta

SEQ ID NO: 436127 - DNA, 25 bp, Mus musculus
ccgtgcttccagcaaactggagttc

SEQ ID NO: 436128 - DNA, 25 bp, Mus musculus
ccaccggtggtcctcgaagaagaag

SEQ ID NO: 436129 - DNA, 25 bp, Mus musculus
gcgagcgtgcttacttgttccgatc

SEQ ID NO: 436130 - DNA, 25 bp, Mus musculus
tgcccgctttcatactcgccattgg

SEQ ID NO: 436131 - DNA, 25 bp, Mus musculus
ccagtcccgtatgggattggccctc

SEQ ID NO: 436132 - DNA, 25 bp, Mus musculus
tctgagcagcccgaaagccattggc

SEQ ID NO: 436133 - DNA, 25 bp, Mus musculus
gtcgcttagcaagaagccagcctta

SEQ ID NO: 436134 - DNA, 25 bp, Mus musculus
aagcgtagccatcctctctccattg

SEQ ID NO: 436135 - DNA, 25 bp, Mus musculus
tcgaagctggacactgtgcctcaca

SEQ ID NO: 436136 - DNA, 25 bp, Mus musculus
tgttcgtgccgtttcctcaggctaa

SEQ ID NO: 436137 - DNA, 25 bp, Mus musculus
ctctccattggtcgctcgaagctgg

SEQ ID NO: 436138 - DNA, 25 bp, Mus musculus
gaggaagcaaacctccaggaggccg

SEQ ID NO: 436139 - DNA, 25 bp, Mus musculus
ctgaaacttgctagcgtgtacgcca

SEQ ID NO: 436140 - DNA, 25 bp, Mus musculus
gagggaaccaagagtcggaccacta

SEQ ID NO: 436141 - DNA, 25 bp, Mus musculus
gagtcggaccactaaaactgagctg

SEQ ID NO: 436142 - DNA, 25 bp, Mus musculus
tcggaccactaaaactgagctgaaa

SEQ ID NO: 436143 - DNA, 25 bp, Mus musculus
ttgctagcgtgtacgccacccgacg

SEQ ID NO: 436144 - DNA, 25 bp, Mus musculus
gtcagtgccagctgggcagccctcg

SEQ ID NO: 436145 - DNA, 25 bp, Mus musculus
agccctcgcgcgctaaggcgtgaca

SEQ ID NO: 436146 - DNA, 25 bp, Mus musculus
ctcgcgcgctaaggcgtgacagcga

SEQ ID NO: 436147 - DNA, 25 bp, Mus musculus
ccggagtgagaagaggaagcaaacc

SEQ ID NO: 436148 - DNA, 25 bp, Mus musculus
ctggtctcagagtccggaagagcgc

SEQ ID NO: 436149 - DNA, 25 bp, Mus musculus
ggtggaccgagctgtcatccctcgg

SEQ ID NO: 436150 - DNA, 25 bp, Mus musculus
agctgtcatccctcggctgggcgtc

SEQ ID NO: 436151 - DNA, 25 bp, Mus musculus
gctaaggcgtgacagcgagcgaccc

SEQ ID NO: 436152 - DNA, 25 bp, Mus musculus
ctcgcggcgcccatctccgccactc

SEQ ID NO: 436153 - DNA, 25 bp, Mus musculus
gcttctccgggatcggtcgcgttac

SEQ ID NO: 436154 - DNA, 25 bp, Mus musculus
ccgagggcaacggaggccatcgccc

SEQ ID NO: 436155 - DNA, 25 bp, Mus musculus
atcggccgagggcaacggaggccat

SEQ ID NO: 436156 - DNA, 25 bp, Mus musculus
ttaccgcactggacgcctcgcggcg

SEQ ID NO: 436157 - DNA, 25 bp, Mus musculus
tcgcgttaccgcactggacgcctcg

SEQ ID NO: 436158 - DNA, 25 bp, Mus musculus
tcggtcgcgttaccgcactggacgc

SEQ ID NO: 436159 - DNA, 25 bp, Mus musculus
atcggtcgcgttaccgcactggacg

SEQ ID NO: 436160 - DNA, 25 bp, Mus musculus
ggatcggtcgcgttaccgcactgga

SEQ ID NO: 436161 - DNA, 25 bp, Mus musculus
tccgggatcggtcgcgttaccgcac

SEQ ID NO: 436162 - DNA, 25 bp, Mus musculus
tctccgggatcggtcgcgttaccgc

SEQ ID NO: 436163 - DNA, 25 bp, Mus musculus
ggcttctccgggatcggtcgcgtta

SEQ ID NO: 436164 - DNA, 25 bp, Mus musculus
gcccttcacaaagaaaagagaactc

SEQ ID NO: 436165 - DNA, 25 bp, Mus musculus
ctccgggatcggtcgcgttaccgca

SEQ ID NO: 436166 - DNA, 25 bp, Mus musculus
cgggactgacaaacaacagcacctc

SEQ ID NO: 436167 - DNA, 25 bp, Mus musculus
ggatgactcagggagtcgtctgcca

SEQ ID NO: 436168 - DNA, 25 bp, Mus musculus
ccgattggcctggtgctcatcacca

SEQ ID NO: 436169 - DNA, 25 bp, Mus musculus
aaagaactcagtcttcatgctgccc

SEQ ID NO: 436170 - DNA, 25 bp, Mus musculus
gtgctcatcaccaatcaaagaactc

SEQ ID NO: 436171 - DNA, 25 bp, Mus musculus
ggcctggtgctcatcaccaatcaaa

SEQ ID NO: 436172 - DNA, 25 bp, Mus musculus
aacagcacctccgattggcctggtg

SEQ ID NO: 436173 - DNA, 25 bp, Mus musculus
gaccggctccgggactgacaaacaa

SEQ ID NO: 436174 - DNA, 25 bp, Mus musculus
ctccttccctctgcggaccggctcc

SEQ ID NO: 436175 - DNA, 25 bp, Mus musculus
atagtgctctccaacaccatcttgc

SEQ ID NO: 436176 - DNA, 25 bp, Mus musculus
cgaagctcctcaccaaaccatagtg

SEQ ID NO: 436177 - DNA, 25 bp, Mus musculus
gccacgcgcaccaacaacccagacg

SEQ ID NO: 436178 - DNA, 25 bp, Mus musculus
cgaagccacatctcgcccggcgacc

SEQ ID NO: 436179 - DNA, 25 bp, Mus musculus
tcagggagtcgtctgccagagtccc

SEQ ID NO: 436180 - DNA, 25 bp, Mus musculus
tccaccgaccgtagaccgtgagtct

SEQ ID NO: 436181 - DNA, 25 bp, Mus musculus
ccaatcagaggggacttcggatcac

SEQ ID NO: 436182 - DNA, 25 bp, Mus musculus
tagccggagaaaagagaagccaatc

SEQ ID NO: 436183 - DNA, 25 bp, Mus musculus
cgttcgtctatctagccggagaaaa

SEQ ID NO: 436184 - DNA, 25 bp, Mus musculus
gccacagcttctcggcgttcgtcta

SEQ ID NO: 436185 - DNA, 25 bp, Mus musculus
ccgcgtctcggatagaacaaaccta

SEQ ID NO: 436186 - DNA, 25 bp, Mus musculus
tcttaccagacaggaacacttgagc

SEQ ID NO: 436187 - DNA, 25 bp, Mus musculus
tccttttctcggaatcgaatcttcc

SEQ ID NO: 436188 - DNA, 25 bp, Mus musculus
gccaaagctaccttctcttaccaga

SEQ ID NO: 436189 - DNA, 25 bp, Mus musculus
gtctcgcaccttcctagcaacttga

SEQ ID NO: 436190 - DNA, 25 bp, Mus musculus
ttcaggctccaggacaagctcagga

SEQ ID NO: 436191 - DNA, 25 bp, Mus musculus
tctcacaggcgttgttcaggctcca

SEQ ID NO: 436192 - DNA, 25 bp, Mus musculus
gtctcttcacagaacccgcgttcgg

SEQ ID NO: 436193 - DNA, 25 bp, Mus musculus
cttcggatcacgtgacagatgatgc

SEQ ID NO: 436194 - DNA, 25 bp, Mus musculus
cctcgctgctggtctcgtcgataaa

SEQ ID NO: 436195 - DNA, 25 bp, Mus musculus
cggcactcgacgagcagacctgcta

SEQ ID NO: 436196 - DNA, 25 bp, Mus musculus
taaagctcgtctagcacctcgctgc

SEQ ID NO: 436197 - DNA, 25 bp, Mus musculus
ttggacacgcggtaaagctcgtcta

SEQ ID NO: 436198 - DNA, 25 bp, Mus musculus
cggctgtgcgtgtattctttggaca

SEQ ID NO: 436199 - DNA, 25 bp, Mus musculus
tgaggtctttgatcacccgctgtgc

SEQ ID NO: 436200 - DNA, 25 bp, Mus musculus
ctttaaccgctaccttgatgaggtc

SEQ ID NO: 436201 - DNA, 25 bp, Mus musculus
tgcggtgcagcacagccactttaac

SEQ ID NO: 436202 - DNA, 25 bp, Mus musculus
aaatcgtgtagccagagccagctcc

SEQ ID NO: 436203 - DNA, 25 bp, Mus musculus
cgccctgccgtagcttctgacgaaa

SEQ ID NO: 436204 - DNA, 25 bp, Mus musculus
aagctaagtgcggtcatggcgccct

SEQ ID NO: 436205 - DNA, 25 bp, Mus musculus
gaagtccacctcaccgaagctaagt

SEQ ID NO: 436206 - DNA, 25 bp, Mus musculus
tcgataaagagatgcgccacggacc

SEQ ID NO: 436207 - DNA, 25 bp, Mus musculus
tgctagcacggcagcctcaaaggtg

SEQ ID NO: 436208 - DNA, 25 bp, Mus musculus
ggcctggcgacagcatcctagttca

SEQ ID NO: 436209 - DNA, 25 bp, Mus musculus
ctagtcctgtttccctagtctggga

SEQ ID NO: 436210 - DNA, 25 bp, Mus musculus
cgcattgttttcctccgccgatctg

SEQ ID NO: 436211 - DNA, 25 bp, Mus musculus
ccgaggctcttgtaacccgacagtg

SEQ ID NO: 436212 - DNA, 25 bp, Mus musculus
ccgacagtgccctggagtctaaatc

SEQ ID NO: 436213 - DNA, 25 bp, Mus musculus
ctaaatctaagcacggacgttcgtc

SEQ ID NO: 436214 - DNA, 25 bp, Mus musculus
caaccacggattgcgaactctgcga

SEQ ID NO: 436215 - DNA, 25 bp, Mus musculus
cccggatctcggagcaagtaccttg

SEQ ID NO: 436216 - DNA, 25 bp, Mus musculus
gagggtcaagctcctaagtgtcaca

SEQ ID NO: 436217 - DNA, 25 bp, Mus musculus
gtgtaggcttcttttccgactggtc

SEQ ID NO: 436218 - DNA, 25 bp, Mus musculus
gggttgcttccctgtccttgtgcag

SEQ ID NO: 436219 - DNA, 25 bp, Mus musculus
ttccgccctgggctttgttagactg

SEQ ID NO: 436220 - DNA, 25 bp, Mus musculus
tgttagactggtctcccacggagga

SEQ ID NO: 436221 - DNA, 25 bp, Mus musculus
attcccacttgatctgcgcctgcag

SEQ ID NO: 436222 - DNA, 25 bp, Mus musculus
tggacgtgaagtctccgctgtcgcc

SEQ ID NO: 436223 - DNA, 25 bp, Mus musculus
ctgtcctttggcgaggaactcgccc

SEQ ID NO: 436224 - DNA, 25 bp, Mus musculus
gagctgcccgtgaagcacctccgtg

SEQ ID NO: 436225 - DNA, 25 bp, Mus musculus
ccctgggaatggaaccagaatggga

SEQ ID NO: 436226 - DNA, 25 bp, Mus musculus
cagaatgggaacaacgcctcggagg

SEQ ID NO: 436227 - DNA, 25 bp, Mus musculus
tagaggtgaccacgctggaggaact

SEQ ID NO: 436228 - DNA, 25 bp, Mus musculus
cgcccaggaagggtagcgaacctct

SEQ ID NO: 436229 - DNA, 25 bp, Mus musculus
tcgctgttcgtggactccagcccga

SEQ ID NO: 436230 - DNA, 25 bp, Mus musculus
ggctcgacgtgccacccgaaggcaa

SEQ ID NO: 436231 - DNA, 25 bp, Mus musculus
gaggcacctcctgtacctgggccgg

SEQ ID NO: 436232 - DNA, 25 bp, Mus musculus
cccgcacggtggtcatttcaacttc

SEQ ID NO: 436233 - DNA, 25 bp, Mus musculus
aacttctgacggaagctgctcgcgc

SEQ ID NO: 436234 - DNA, 25 bp, Mus musculus
cctctcgcctcggtttatttattga

SEQ ID NO: 436235 - DNA, 25 bp, Mus musculus
catttcaggggacctggccgactcc

SEQ ID NO: 436236 - DNA, 25 bp, Mus musculus
cggccttttcacatatgcatatttg

SEQ ID NO: 436237 - DNA, 25 bp, Mus musculus
gcagcgctcggaggaactggttact

SEQ ID NO: 436238 - DNA, 25 bp, Mus musculus
acgtggcttacgtgagggatagttc

SEQ ID NO: 436239 - DNA, 25 bp, Mus musculus
gcaggatcaccgattacgtggctta

SEQ ID NO: 436240 - DNA, 25 bp, Mus musculus
catcctgagcgggactacttagcga

SEQ ID NO: 436241 - DNA, 25 bp, Mus musculus
ctcgtgagctggaaaaacgtatacc

SEQ ID NO: 436242 - DNA, 25 bp, Mus musculus
ccttgcatcgcagttcggaagctcc

SEQ ID NO: 436243 - DNA, 25 bp, Mus musculus
tgagtccgactccttcctactgagg

SEQ ID NO: 436244 - DNA, 25 bp, Mus musculus
gttagcggagccactttgcccttct

SEQ ID NO: 436245 - DNA, 25 bp, Mus musculus
gaagctccggaaccctgcgtgtcct

SEQ ID NO: 436246 - DNA, 25 bp, Mus musculus
gcactctaccttcctgctggttcaa

SEQ ID NO: 436247 - DNA, 25 bp, Mus musculus
tagttaagactccttgccagcggcc

SEQ ID NO: 436248 - DNA, 25 bp, Mus musculus
gcagatggtagttttggcgccaacc

SEQ ID NO: 436249 - DNA, 25 bp, Mus musculus
gtgaaggcgctgtgactatacgtcc

SEQ ID NO: 436250 - DNA, 25 bp, Mus musculus
ccgagagcagtaaggtggcggcaaa

SEQ ID NO: 436251 - DNA, 25 bp, Mus musculus
ggctccctgcatcccgacgagctgg

SEQ ID NO: 436252 - DNA, 25 bp, Mus musculus
agggtcgtggctccctgcatcccga

SEQ ID NO: 436253 - DNA, 25 bp, Mus musculus
atctagggtcgtggctccctgcatc

SEQ ID NO: 436254 - DNA, 25 bp, Mus musculus
gcggcatctagggtcgtggctccct

SEQ ID NO: 436255 - DNA, 25 bp, Mus musculus
gtggcggcaaagagaaggcctagga

SEQ ID NO: 436256 - DNA, 25 bp, Mus musculus
gtaaggaggaacagggccgagagca

SEQ ID NO: 436257 - DNA, 25 bp, Mus musculus
agccaggcgcttacctggtgcgccg

SEQ ID NO: 436258 - DNA, 25 bp, Mus musculus
cgtggccagccaggcgcttacctgg

SEQ ID NO: 436259 - DNA, 25 bp, Mus musculus
catgcgtggccagccaggcgcttac

SEQ ID NO: 436260 - DNA, 25 bp, Mus musculus
gccgcgatcccacgcatgcgtggcc

SEQ ID NO: 436261 - DNA, 25 bp, Mus musculus
acgaggtcgcgtggccgcgatccca

SEQ ID NO: 436262 - DNA, 25 bp, Mus musculus
ccctgccggactcgggtgtccacga

SEQ ID NO: 436263 - DNA, 25 bp, Mus musculus
agaggccctggcgaggcggcatcta

SEQ ID NO: 436264 - DNA, 25 bp, Mus musculus
ggtcgcgatcacagtacacgcgcgg

SEQ ID NO: 436265 - DNA, 25 bp, Mus musculus
cgagcgcggtgcttgccgctgtccc

SEQ ID NO: 436266 - DNA, 25 bp, Mus musculus
cgctctcagcccctgggtttcgtaa

SEQ ID NO: 436267 - DNA, 25 bp, Mus musculus
cctgggtttcgtaatcgcgtcgccg

SEQ ID NO: 436268 - DNA, 25 bp, Mus musculus
tgggtttcgtaatcgcgtcgccggc

SEQ ID NO: 436269 - DNA, 25 bp, Mus musculus
tcgtaatcgcgtcgccggcgtttcc

SEQ ID NO: 436270 - DNA, 25 bp, Mus musculus
cccgccgtgccgagaagcagccagg

SEQ ID NO: 436271 - DNA, 25 bp, Mus musculus
aagcagccaggggacccggagtggc

SEQ ID NO: 436272 - DNA, 25 bp, Mus musculus
agccgcaggtaagagcgccgggcga

SEQ ID NO: 436273 - DNA, 25 bp, Mus musculus
tgcgaagcgacaggggctcctcgcc

SEQ ID NO: 436274 - DNA, 25 bp, Mus musculus
gggaggtcgcgatcacagtacacgc

SEQ ID NO: 436275 - DNA, 25 bp, Mus musculus
gcgcaagccacggagaggcagggaa

SEQ ID NO: 436276 - DNA, 25 bp, Mus musculus
agaggcagggaagcggcgactgcag

SEQ ID NO: 436277 - DNA, 25 bp, Mus musculus
cggggaggtcgcgatcacagtacac

SEQ ID NO: 436278 - DNA, 25 bp, Mus musculus
ccaggagaggtaacccggcagaatg

SEQ ID NO: 436279 - DNA, 25 bp, Mus musculus
gccgaaggacccgactcaagcaaac

SEQ ID NO: 436280 - DNA, 25 bp, Mus musculus
tgcgtaatccggcactccgggagtc

SEQ ID NO: 436281 - DNA, 25 bp, Mus musculus
cccaggaggaagtgcgtaatccggc

SEQ ID NO: 436282 - DNA, 25 bp, Mus musculus
ctccatggtaaagcccgaggtgtgc

SEQ ID NO: 436283 - DNA, 25 bp, Mus musculus
acagtcctgcaggtagtcctccatg

SEQ ID NO: 436284 - DNA, 25 bp, Mus musculus
ctgcaaagcggctcgacagtcctgc

SEQ ID NO: 436285 - DNA, 25 bp, Mus musculus
actgggacccgttacctgcaaagcg

SEQ ID NO: 436286 - DNA, 25 bp, Mus musculus
acgctgcattcctttcggtcacgga

SEQ ID NO: 436287 - DNA, 25 bp, Mus musculus
cgaagggcttggtcctctagctccc

SEQ ID NO: 436288 - DNA, 25 bp, Mus musculus
tcaagcaaaccaagagactcctttc

SEQ ID NO: 436289 - DNA, 25 bp, Mus musculus
cgccgcacaggttctgccgaaggac

SEQ ID NO: 436290 - DNA, 25 bp, Mus musculus
agaagggagagacacacctcgccgg

SEQ ID NO: 436291 - DNA, 25 bp, Mus musculus
tctcccgcctatggccgaagggctt

SEQ ID NO: 436292 - DNA, 25 bp, Mus musculus
cgccgcgagagtaaacccgtgtcaa

SEQ ID NO: 436293 - DNA, 25 bp, Mus musculus
tcggtgactcgggaatcctgaagac

SEQ ID NO: 436294 - DNA, 25 bp, Mus musculus
aggctcggtgactcgggaatcctga

SEQ ID NO: 436295 - DNA, 25 bp, Mus musculus
ctcgggaatcctgaagactctggga

SEQ ID NO: 436296 - DNA, 25 bp, Mus musculus
tcctgaagactctgggaagccaggc

SEQ ID NO: 436297 - DNA, 25 bp, Mus musculus
accgcctgcgctgtgccttgcttgt

SEQ ID NO: 436298 - DNA, 25 bp, Mus musculus
gcgctgtgccttgcttgtcctcggc

SEQ ID NO: 436299 - DNA, 25 bp, Mus musculus
acccaggctggacgccgcgagagta

SEQ ID NO: 436300 - DNA, 25 bp, Mus musculus
cgtgtaagctctggggctgacagct

SEQ ID NO: 436301 - DNA, 25 bp, Mus musculus
cgcgagagtaaacccgtgtcaagcc

SEQ ID NO: 436302 - DNA, 25 bp, Mus musculus
gagtaaacccgtgtcaagccgtgta

SEQ ID NO: 436303 - DNA, 25 bp, Mus musculus
aacccgtgtcaagccgtgtaagctc

SEQ ID NO: 436304 - DNA, 25 bp, Mus musculus
tgtcaagccgtgtaagctctggggc

SEQ ID NO: 436305 - DNA, 25 bp, Mus musculus
cccgtattgggcgtgtgtccggaag

SEQ ID NO: 436306 - DNA, 25 bp, Mus musculus
acaaatgcctgtcgcgggagaagac

SEQ ID NO: 436307 - DNA, 25 bp, Mus musculus
ttgccctggtcccttcgatccggga

SEQ ID NO: 436308 - DNA, 25 bp, Mus musculus
tgggcaccgttctgtgcgccctgtt

SEQ ID NO: 436309 - DNA, 25 bp, Mus musculus
tctacagcaacgtgatcaaaggtgc

SEQ ID NO: 436310 - DNA, 25 bp, Mus musculus
tgcggatcatccacggccaggactt

SEQ ID NO: 436311 - DNA, 25 bp, Mus musculus
tacgtgaagcggctggtgaagatcc

SEQ ID NO: 436312 - DNA, 25 bp, Mus musculus
gtccaaggagatcgacaaatgcctg

SEQ ID NO: 436313 - DNA, 25 bp, Mus musculus
gcagcagcgcaagtccaaggagatc

SEQ ID NO: 436314 - DNA, 25 bp, Mus musculus
gcaagatggcggacttcctgccgtc

SEQ ID NO: 436315 - DNA, 25 bp, Mus musculus
tggcgagtcagtcctcgggttccct

SEQ ID NO: 436316 - DNA, 25 bp, Mus musculus
ggctgcacaggagcgcgtgactccc

SEQ ID NO: 436317 - DNA, 25 bp, Mus musculus
agaaactctggatccgcaggcgcgc

SEQ ID NO: 436318 - DNA, 25 bp, Mus musculus
tggcactaaagggaaacagaaactc

SEQ ID NO: 436319 - DNA, 25 bp, Mus musculus
ctgcgtgcgcgtacccgaaaggcag

SEQ ID NO: 436320 - DNA, 25 bp, Mus musculus
cgcaaccgcgccactcagagaccca

SEQ ID NO: 436321 - DNA, 25 bp, Mus musculus
agcggaccttcggtgctagaagccc

SEQ ID NO: 436322 - DNA, 25 bp, Mus musculus
gagcagtagcggaccttcggtgcta

SEQ ID NO: 436323 - DNA, 25 bp, Mus musculus
cctttgttaggagtggagcagtagc

SEQ ID NO: 436324 - DNA, 25 bp, Mus musculus
ctcaggatccatggtacagacgccc

SEQ ID NO: 436325 - DNA, 25 bp, Mus musculus
gcgctcgctcaggatccatggtaca

SEQ ID NO: 436326 - DNA, 25 bp, Mus musculus
gcctcggaccagagaaggcctgcgg

SEQ ID NO: 436327 - DNA, 25 bp, Mus musculus
tccaccggctcatggcggccggcct

SEQ ID NO: 436328 - DNA, 25 bp, Mus musculus
accggacgccgagtaagtctgtgcg

SEQ ID NO: 436329 - DNA, 25 bp, Mus musculus
agcagctctgcaccggacgccgagt

SEQ ID NO: 436330 - DNA, 25 bp, Mus musculus
cgctagaagtgggaaacggagtagc

SEQ ID NO: 436331 - DNA, 25 bp, Mus musculus
gaggacccggcccagtcagtgcgca

SEQ ID NO: 436332 - DNA, 25 bp, Mus musculus
gccgcggcccacacccaactcagct

SEQ ID NO: 436333 - DNA, 25 bp, Mus musculus
ctccataggcgcagcgcagggttcc

SEQ ID NO: 436334 - DNA, 25 bp, Mus musculus
ggaccaaatttattgcatagcgctg

SEQ ID NO: 436335 - DNA, 25 bp, Mus musculus
agggaccaaatttattgcatagcgc

SEQ ID NO: 436336 - DNA, 25 bp, Mus musculus
ccgaagggaccaaatttattgcata

SEQ ID NO: 436337 - DNA, 25 bp, Mus musculus
gcccgaagggaccaaatttattgca

SEQ ID NO: 436338 - DNA, 25 bp, Mus musculus
cggcctctccgacggtagcccgaag

SEQ ID NO: 436339 - DNA, 25 bp, Mus musculus
atagggagcgtccttccggcctctc

SEQ ID NO: 436340 - DNA, 25 bp, Mus musculus
aggggaaacagcgtgaggaggcagg

SEQ ID NO: 436341 - DNA, 25 bp, Mus musculus
caatagggagcgtccttccggcctc

SEQ ID NO: 436342 - DNA, 25 bp, Mus musculus
aagcaatagggagcgtccttccggc

SEQ ID NO: 436343 - DNA, 25 bp, Mus musculus
ccggaagcaatagggagcgtccttc

SEQ ID NO: 436344 - DNA, 25 bp, Mus musculus
tccggaagcaatagggagcgtcctt

SEQ ID NO: 436345 - DNA, 25 bp, Mus musculus
gcaaaccgacggtccggaagcaata

SEQ ID NO: 436346 - DNA, 25 bp, Mus musculus
ggagcaaaccgacggtccggaagca

SEQ ID NO: 436347 - DNA, 25 bp, Mus musculus
accaaatttattgcatagcgctgcg

SEQ ID NO: 436348 - DNA, 25 bp, Mus musculus
ctccttcagtttgcctgggtttggc

SEQ ID NO: 436349 - DNA, 25 bp, Mus musculus
ccttcagtttgcctgggtttggcaa

SEQ ID NO: 436350 - DNA, 25 bp, Mus musculus
ttcagtttgcctgggtttggcaagg

SEQ ID NO: 436351 - DNA, 25 bp, Mus musculus
aggcggagccctggagtaaaacctg

SEQ ID NO: 436352 - DNA, 25 bp, Mus musculus
cggggttgtgagacgcggcccttgc

SEQ ID NO: 436353 - DNA, 25 bp, Mus musculus
ggcccttgcggtcgggcgccagagt

SEQ ID NO: 436354 - DNA, 25 bp, Mus musculus
acggactgaggtgcgctgaggccga

SEQ ID NO: 436355 - DNA, 25 bp, Mus musculus
aggccgaggtggacctgggaggctt

SEQ ID NO: 436356 - DNA, 25 bp, Mus musculus
aggctgctgcggttctgcgtggccc

SEQ ID NO: 436357 - DNA, 25 bp, Mus musculus
cctgtgcgcgttattccgagtgtgg

SEQ ID NO: 436358 - DNA, 25 bp, Mus musculus
gcgcgttattccgagtgtggctgct

SEQ ID NO: 436359 - DNA, 25 bp, Mus musculus
cgcgttattccgagtgtggctgctg

SEQ ID NO: 436360 - DNA, 25 bp, Mus musculus
agtgtggctgctgggtggtcgccat

SEQ ID NO: 436361 - DNA, 25 bp, Mus musculus
tctctccttcagtttgcctgggttt

SEQ ID NO: 436362 - DNA, 25 bp, Mus musculus
cgccatcttggattccgcggtagcg

SEQ ID NO: 436363 - DNA, 25 bp, Mus musculus
atagtttggggcgtgtcttctgccc

SEQ ID NO: 436364 - DNA, 25 bp, Mus musculus
tgtcttctgcccaggatggggaggg

SEQ ID NO: 436365 - DNA, 25 bp, Mus musculus
ccatcttggattccgcggtagcggt

SEQ ID NO: 436366 - DNA, 25 bp, Mus musculus
cggtaaggtgcctaatctgcggagt

SEQ ID NO: 436367 - DNA, 25 bp, Mus musculus
aggtgcctaatctgcggagtggctc

SEQ ID NO: 436368 - DNA, 25 bp, Mus musculus
cgcagggacggtgccatctcgacca

SEQ ID NO: 436369 - DNA, 25 bp, Mus musculus
gaccatggcggcgactacagctaac

SEQ ID NO: 436370 - DNA, 25 bp, Mus musculus
tggcggcgactacagctaacccagg

SEQ ID NO: 436371 - DNA, 25 bp, Mus musculus
cagaaaggactgacaagtgcggaga

SEQ ID NO: 436372 - DNA, 25 bp, Mus musculus
aaggactgacaagtgcggagagcca

SEQ ID NO: 436373 - DNA, 25 bp, Mus musculus
ctgacaagtgcggagagccagagca

SEQ ID NO: 436374 - DNA, 25 bp, Mus musculus
gcgccctgcccggaggacctgggga

SEQ ID NO: 436375 - DNA, 25 bp, Mus musculus
agggacggtgccatctcgaccatgg

SEQ ID NO: 436376 - DNA, 25 bp, Mus musculus
aagactcttgcctgtcgctgccgga

SEQ ID NO: 436377 - DNA, 25 bp, Mus musculus
tcttgcctgtcgctgccggacgctt

SEQ ID NO: 436378 - DNA, 25 bp, Mus musculus
tggagccttgctgcgagcctggctc

SEQ ID NO: 436379 - DNA, 25 bp, Mus musculus
tcccggcaggccttgcgcagctttt

SEQ ID NO: 436380 - DNA, 25 bp, Mus musculus
ccttgcgcagcttttggcgggaata

SEQ ID NO: 436381 - DNA, 25 bp, Mus musculus
ttgcgcagcttttggcgggaatagt

SEQ ID NO: 436382 - DNA, 25 bp, Mus musculus
gaatagtggtctggcctgaggtcaa

SEQ ID NO: 436383 - DNA, 25 bp, Mus musculus
cctgaggtcaaagggtgcgccacgt

SEQ ID NO: 436384 - DNA, 25 bp, Mus musculus
tgcgccacgtgccagtgacagttaa

SEQ ID NO: 436385 - DNA, 25 bp, Mus musculus
cacgtgccagtgacagttaaggcgc

SEQ ID NO: 436386 - DNA, 25 bp, Mus musculus
cagtgacagttaaggcgcatgcgca

SEQ ID NO: 436387 - DNA, 25 bp, Mus musculus
ggagcgccgcacttcaagactcttg

SEQ ID NO: 436388 - DNA, 25 bp, Mus musculus
tgccggacgcttccctcaggcggtg

SEQ ID NO: 436389 - DNA, 25 bp, Mus musculus
gccgcacttcaagactcttgcctgt

SEQ ID NO: 436390 - DNA, 25 bp, Mus musculus
gacacagatcagcaggcgttcccga

SEQ ID NO: 436391 - DNA, 25 bp, Mus musculus
tcatctcgcgctacttgcgggagca

SEQ ID NO: 436392 - DNA, 25 bp, Mus musculus
accgccagtcgctggagatcatctc

SEQ ID NO: 436393 - DNA, 25 bp, Mus musculus
aagaggacgacctataccgccagtc

SEQ ID NO: 436394 - DNA, 25 bp, Mus musculus
ccgaaaggcggctgcataagtcgcc

SEQ ID NO: 436395 - DNA, 25 bp, Mus musculus
atcggcttgaacctgtactgcggcg

SEQ ID NO: 436396 - DNA, 25 bp, Mus musculus
ggagaaacgcggtcatcggcttgaa

SEQ ID NO: 436397 - DNA, 25 bp, Mus musculus
ccgaccatgtttggcctgcggagaa

SEQ ID NO: 436398 - DNA, 25 bp, Mus musculus
agggaacggccttcctcactcctga

SEQ ID NO: 436399 - DNA, 25 bp, Mus musculus
cttttacgggaagtcctcgcctgcg

SEQ ID NO: 436400 - DNA, 25 bp, Mus musculus
agcacaatccgtccgcgagccaagg

SEQ ID NO: 436401 - DNA, 25 bp, Mus musculus
cgggctgagagttgtaccggacaaa

SEQ ID NO: 436402 - DNA, 25 bp, Mus musculus
aagcacttggccagccgggctgaga

SEQ ID NO: 436403 - DNA, 25 bp, Mus musculus
gcgaccggctccaaggactcgaagc

SEQ ID NO: 436404 - DNA, 25 bp, Mus musculus
gggaggttctaccttctctgcgccc

SEQ ID NO: 436405 - DNA, 25 bp, Mus musculus
tgcagccacgctgtggacacggttc

SEQ ID NO: 436406 - DNA, 25 bp, Mus musculus
tccagctgcctctggtagtggccac

SEQ ID NO: 436407 - DNA, 25 bp, Mus musculus
agctgcctctggtagtggccaccgc

SEQ ID NO: 436408 - DNA, 25 bp, Mus musculus
tgcctctggtagtggccaccgcggc

SEQ ID NO: 436409 - DNA, 25 bp, Mus musculus
gccacgcgccggactcaaccaccca

SEQ ID NO: 436410 - DNA, 25 bp, Mus musculus
agccacgctgtggacacggttcccg

SEQ ID NO: 436411 - DNA, 25 bp, Mus musculus
cccgtacagctaaagagcttgcagc

SEQ ID NO: 436412 - DNA, 25 bp, Mus musculus
tacagctaaagagcttgcagccacg

SEQ ID NO: 436413 - DNA, 25 bp, Mus musculus
agctaaagagcttgcagccacgctg

SEQ ID NO: 436414 - DNA, 25 bp, Mus musculus
ctaaagagcttgcagccacgctgtg

SEQ ID NO: 436415 - DNA, 25 bp, Mus musculus
agagcttgcagccacgctgtggaca

SEQ ID NO: 436416 - DNA, 25 bp, Mus musculus
agcttgcagccacgctgtggacacg

SEQ ID NO: 436417 - DNA, 25 bp, Mus musculus
tcggggaggttctaccttctctgcg

SEQ ID NO: 436418 - DNA, 25 bp, Mus musculus
agagaagagcacgtccggagccgtc

SEQ ID NO: 436419 - DNA, 25 bp, Mus musculus
cgcagaggctcgcagatttacagaa

SEQ ID NO: 436420 - DNA, 25 bp, Mus musculus
gaggctcgcagatttacagaaagaa

SEQ ID NO: 436421 - DNA, 25 bp, Mus musculus
tttacagaaagaacgccgcgacatg

SEQ ID NO: 436422 - DNA, 25 bp, Mus musculus
aagaacgccgcgacatggacacccg

SEQ ID NO: 436423 - DNA, 25 bp, Mus musculus
gcgacatggacacccgctactcgta

SEQ ID NO: 436424 - DNA, 25 bp, Mus musculus
cacccgctactcgtagggcgggctg

SEQ ID NO: 436425 - DNA, 25 bp, Mus musculus
ggctacgtaccctccagagctccgg

SEQ ID NO: 436426 - DNA, 25 bp, Mus musculus
ggagcctgccgcagcatcagagccg

SEQ ID NO: 436427 - DNA, 25 bp, Mus musculus
agagccgcacccaccacggcggaca

SEQ ID NO: 436428 - DNA, 25 bp, Mus musculus
acggcccgactcaaagaaccacagg

SEQ ID NO: 436429 - DNA, 25 bp, Mus musculus
ccgactcaaagaaccacagggctga

SEQ ID NO: 436430 - DNA, 25 bp, Mus musculus
agaaccacagggctgagtcgctggc

SEQ ID NO: 436431 - DNA, 25 bp, Mus musculus
atggacacccgctactcgtagggcg

SEQ ID NO: 436432 - DNA, 25 bp, Mus musculus
ggcccaaagctacctaggcagaaaa

SEQ ID NO: 436433 - DNA, 25 bp, Mus musculus
cgggagcgggcaaaacaatcagtgc

SEQ ID NO: 436434 - DNA, 25 bp, Mus musculus
cgacggcgccgacaactaaggcttt

SEQ ID NO: 436435 - DNA, 25 bp, Mus musculus
ggcttttagcctctacgctcctcaa

SEQ ID NO: 436436 - DNA, 25 bp, Mus musculus
cgttggccaaattccggtgagccca

SEQ ID NO: 436437 - DNA, 25 bp, Mus musculus
tggtaccgaagacgaaacgctactc

SEQ ID NO: 436438 - DNA, 25 bp, Mus musculus
ttctaccacaggaaaggcccaaagc

SEQ ID NO: 436439 - DNA, 25 bp, Mus musculus
tggcgctgcgattcgaccaatcagg

SEQ ID NO: 436440 - DNA, 25 bp, Mus musculus
ctccggagcctaggacgttactaga

SEQ ID NO: 436441 - DNA, 25 bp, Mus musculus
ctcggccctgcttttggcttcatgg

SEQ ID NO: 436442 - DNA, 25 bp, Mus musculus
ccctgggagcctttaattcacacta

SEQ ID NO: 436443 - DNA, 25 bp, Mus musculus
ttcacactaggatgggaaatgccca

SEQ ID NO: 436444 - DNA, 25 bp, Mus musculus
cggctgcagagagctttgcctttag

SEQ ID NO: 436445 - DNA, 25 bp, Mus musculus
tcggggacctacacgcgacaaaatg

SEQ ID NO: 436446 - DNA, 25 bp, Mus musculus
ctcagctgcgcagccgcggtatcaa

SEQ ID NO: 436447 - DNA, 25 bp, Mus musculus
gctcgcaccgaaggctacagccttt

SEQ ID NO: 436448 - DNA, 25 bp, Mus musculus
ccgaaggctacagcctttcgggcgc

SEQ ID NO: 436449 - DNA, 25 bp, Mus musculus
gcggggccactactcacctcacaaa

SEQ ID NO: 436450 - DNA, 25 bp, Mus musculus
cctgagacggagcccgaacgttaca

SEQ ID NO: 436451 - DNA, 25 bp, Mus musculus
ggcccgccgtcgctaccgccacaca

SEQ ID NO: 436452 - DNA, 25 bp, Mus musculus
cgggcattatttcccggagcagaaa

SEQ ID NO: 436453 - DNA, 25 bp, Mus musculus
ctacggcacgtgactacggaaggcg

SEQ ID NO: 436454 - DNA, 25 bp, Mus musculus
cagccgcggtatcaaggtgccggcc

SEQ ID NO: 436455 - DNA, 25 bp, Mus musculus
atcctaaagcctagtccgcgggttg

SEQ ID NO: 436456 - DNA, 25 bp, Mus musculus
cgggttgtcccggagcgatgccaac

SEQ ID NO: 436457 - DNA, 25 bp, Mus musculus
ccggagcgatgccaacgttagttcg

SEQ ID NO: 436458 - DNA, 25 bp, Mus musculus
tgccaacgttagttcgggcattatt

SEQ ID NO: 436459 - DNA, 25 bp, Mus musculus
acgctgcggtccctacggcacgtga

SEQ ID NO: 436460 - DNA, 25 bp, Mus musculus
tccctgggtagaagacgcgaactct

SEQ ID NO: 436461 - DNA, 25 bp, Mus musculus
tccaagcgggtgatgtgtcaagccg

SEQ ID NO: 436462 - DNA, 25 bp, Mus musculus
cggacacggctgacttatttggacc

SEQ ID NO: 436463 - DNA, 25 bp, Mus musculus
tatgggcaaccagctagcacgtctg

SEQ ID NO: 436464 - DNA, 25 bp, Mus musculus
ttttgactcaagcagagactgggtg

SEQ ID NO: 436465 - DNA, 25 bp, Mus musculus
atgtctcttgggaacaacgcgggcc

SEQ ID NO: 436466 - DNA, 25 bp, Mus musculus
ctcagtgtttggaggaggagcctta

SEQ ID NO: 436467 - DNA, 25 bp, Mus musculus
tgaaatggacagaggtcacgccttc

SEQ ID NO: 436468 - DNA, 25 bp, Mus musculus
tttagtcaaccacacacagcgtgag

SEQ ID NO: 436469 - DNA, 25 bp, Mus musculus
tggggactgtccgacactacatcgc

SEQ ID NO: 436470 - DNA, 25 bp, Mus musculus
ggccgacgcgaaacagcgacgactg

SEQ ID NO: 436471 - DNA, 25 bp, Mus musculus
ttactcaggctcagcccacggcagg

SEQ ID NO: 436472 - DNA, 25 bp, Mus musculus
ttggacccagtggttaaattactca

SEQ ID NO: 436473 - DNA, 25 bp, Mus musculus
tgcaccggccgtgcaagttgctatg

SEQ ID NO: 436474 - DNA, 25 bp, Mus musculus
aagcggaagctacggagtcccgcga

SEQ ID NO: 436475 - DNA, 25 bp, Mus musculus
tactcgctttgcagctcagtgaacc

SEQ ID NO: 436476 - DNA, 25 bp, Mus musculus
cctctaggcaccacgcgaaatcttg

SEQ ID NO: 436477 - DNA, 25 bp, Mus musculus
tacctggggcctctgaattcggact

SEQ ID NO: 436478 - DNA, 25 bp, Mus musculus
gactccgggtctctgcggaccggaa

SEQ ID NO: 436479 - DNA, 25 bp, Mus musculus
accttcctatggaggagtcgcggtc

SEQ ID NO: 436480 - DNA, 25 bp, Mus musculus
tcccgcgacgggaggaagctacgct

SEQ ID NO: 436481 - DNA, 25 bp, Mus musculus
ggaagctacgctgcagggctcagcc

SEQ ID NO: 436482 - DNA, 25 bp, Mus musculus
tccgcttaccgtctgaccttgcgaa

SEQ ID NO: 436483 - DNA, 25 bp, Mus musculus
accttgcgaaggttcggtgctgagc

SEQ ID NO: 436484 - DNA, 25 bp, Mus musculus
gcgctggactttccgcctgacagtc

SEQ ID NO: 436485 - DNA, 25 bp, Mus musculus
cctgacagtcaaaggaacagcgtcc

SEQ ID NO: 436486 - DNA, 25 bp, Mus musculus
gtctgcgagaaggtcagcccgatcc

SEQ ID NO: 436487 - DNA, 25 bp, Mus musculus
cctctgaattcggactccgggtctc

SEQ ID NO: 436488 - DNA, 25 bp, Mus musculus
ttggatagcttaccggcaacacgtg

SEQ ID NO: 436489 - DNA, 25 bp, Mus musculus
gcagcttctccagccggttcttaca

SEQ ID NO: 436490 - DNA, 25 bp, Mus musculus
accatcaggtgcactgcgctggtca

SEQ ID NO: 436491 - DNA, 25 bp, Mus musculus
gtcgcgcctgccaggtgatgcaata

SEQ ID NO: 436492 - DNA, 25 bp, Mus musculus
agagcgcttggctctcgtccgctta

SEQ ID NO: 436493 - DNA, 25 bp, Mus musculus
ccggtcggtatgcagcttcttcact

SEQ ID NO: 436494 - DNA, 25 bp, Mus musculus
tcactgtctgtgctggtctagccga

SEQ ID NO: 436495 - DNA, 25 bp, Mus musculus
acagaccttgtgctctcattggata

SEQ ID NO: 436496 - DNA, 25 bp, Mus musculus
ggaagcagtccatgctccgcccgta

SEQ ID NO: 436497 - DNA, 25 bp, Mus musculus
catgcggctcctcgggtgataaaaa

SEQ ID NO: 436498 - DNA, 25 bp, Mus musculus
agggtggagctcatagccttaaata

SEQ ID NO: 436499 - DNA, 25 bp, Mus musculus
gccttaaataggacagcactgcgcg

SEQ ID NO: 436500 - DNA, 25 bp, Mus musculus
ctcagcaactcgtgtccgcaacgtg

SEQ ID NO: 436501 - DNA, 25 bp, Mus musculus
gatgcagacgctcacagcccatttg

SEQ ID NO: 436502 - DNA, 25 bp, Mus musculus
gtgagtgtcgagtggtggagacggg

SEQ ID NO: 436503 - DNA, 25 bp, Mus musculus
cctggtggcggggtgagtgtcgagt

SEQ ID NO: 436504 - DNA, 25 bp, Mus musculus
ttgttccctcttcggcttccgtaga

SEQ ID NO: 436505 - DNA, 25 bp, Mus musculus
tgttccctcttcggcttccgtagac

SEQ ID NO: 436506 - DNA, 25 bp, Mus musculus
ttccctcttcggcttccgtagacga

SEQ ID NO: 436507 - DNA, 25 bp, Mus musculus
catcctggtggcggggtgagtgtcg

SEQ ID NO: 436508 - DNA, 25 bp, Mus musculus
atcctggtggcggggtgagtgtcga

SEQ ID NO: 436509 - DNA, 25 bp, Mus musculus
ctggtggcggggtgagtgtcgagtg

SEQ ID NO: 436510 - DNA, 25 bp, Mus musculus
tggtggcggggtgagtgtcgagtgg

SEQ ID NO: 436511 - DNA, 25 bp, Mus musculus
tggcggggtgagtgtcgagtggtgg

SEQ ID NO: 436512 - DNA, 25 bp, Mus musculus
cggggtgagtgtcgagtggtggaga

SEQ ID NO: 436513 - DNA, 25 bp, Mus musculus
ggggtgagtgtcgagtggtggagac

SEQ ID NO: 436514 - DNA, 25 bp, Mus musculus
ggtgagtgtcgagtggtggagacgg

SEQ ID NO: 436515 - DNA, 25 bp, Mus musculus
gggtgagtgtcgagtggtggagacg

SEQ ID NO: 436516 - DNA, 25 bp, Mus musculus
tccgggggtgacattgcaccgcgcc

SEQ ID NO: 436517 - DNA, 25 bp, Mus musculus
gcgcagctccctttcgccttccttg

SEQ ID NO: 436518 - DNA, 25 bp, Mus musculus
cccagctgcccagtcatgggggctg

SEQ ID NO: 436519 - DNA, 25 bp, Mus musculus
ggctgctgtgtttttcggatgcacc

SEQ ID NO: 436520 - DNA, 25 bp, Mus musculus
tgtgtttttcggatgcaccttcgtc

SEQ ID NO: 436521 - DNA, 25 bp, Mus musculus
ttttcggatgcaccttcgtcgcgtt

SEQ ID NO: 436522 - DNA, 25 bp, Mus musculus
ggatgcaccttcgtcgcgttcggcc

SEQ ID NO: 436523 - DNA, 25 bp, Mus musculus
cttctcccttttcctgatcactgta

SEQ ID NO: 436524 - DNA, 25 bp, Mus musculus
tcccttttcctgatcactgtagctg

SEQ ID NO: 436525 - DNA, 25 bp, Mus musculus
cctgatcactgtagctggagaccca

SEQ ID NO: 436526 - DNA, 25 bp, Mus musculus
tcactgtagctggagacccacttcg

SEQ ID NO: 436527 - DNA, 25 bp, Mus musculus
agctggagacccacttcgggttatc

SEQ ID NO: 436528 - DNA, 25 bp, Mus musculus
acttcgggttatcatcctggtggcg

SEQ ID NO: 436529 - DNA, 25 bp, Mus musculus
gacccacttcgggttatcatcctgg

SEQ ID NO: 436530 - DNA, 25 bp, Mus musculus
tcaccaggctcttgtgcttaaaatg

SEQ ID NO: 436531 - DNA, 25 bp, Mus musculus
gcagccgagttagtcccaagtcgtc

SEQ ID NO: 436532 - DNA, 25 bp, Mus musculus
ccctcactctctctgtgtgaaagtg

SEQ ID NO: 436533 - DNA, 25 bp, Mus musculus
cgtcggactccatttgctattcttt

SEQ ID NO: 436534 - DNA, 25 bp, Mus musculus
gcgtctcttttcattcatctccaga

SEQ ID NO: 436535 - DNA, 25 bp, Mus musculus
cgtagggaagagtcccgagtcttga

SEQ ID NO: 436536 - DNA, 25 bp, Mus musculus
atggcgaagggcttaagtttctagg

SEQ ID NO: 436537 - DNA, 25 bp, Mus musculus
tctaggggcattttcgtgagcgcgc

SEQ ID NO: 436538 - DNA, 25 bp, Mus musculus
tcctcgcagactggtggcccggcat

SEQ ID NO: 436539 - DNA, 25 bp, Mus musculus
cacctgcgaagttggtgtaactttc

SEQ ID NO: 436540 - DNA, 25 bp, Mus musculus
cgcgcggacttttacgcaagctgga

SEQ ID NO: 436541 - DNA, 25 bp, Mus musculus
caagctggaggcttgtgcgagcctc

SEQ ID NO: 436542 - DNA, 25 bp, Mus musculus
tcggattccctagcggtttacgcca

SEQ ID NO: 436543 - DNA, 25 bp, Mus musculus
ccacacccgtgtggtagtgggcgtt

SEQ ID NO: 436544 - DNA, 25 bp, Mus musculus
tggggtccgccaagaacaggactta

SEQ ID NO: 436545 - DNA, 25 bp, Mus musculus
cgctgttcattgtccttcgggtctc

SEQ ID NO: 436546 - DNA, 25 bp, Mus musculus
gtgctgcgctagacgccaactttta

SEQ ID NO: 436547 - DNA, 25 bp, Mus musculus
gactcttctaaggtcgcgtttccca

SEQ ID NO: 436548 - DNA, 25 bp, Mus musculus
tgctgccacgtatcgggtcttgata

SEQ ID NO: 436549 - DNA, 25 bp, Mus musculus
gcttgaacaggtcatgccatttatc

SEQ ID NO: 436550 - DNA, 25 bp, Mus musculus
atgcttttggaagtcagtcctctgc

SEQ ID NO: 436551 - DNA, 25 bp, Mus musculus
gggcatatcccgagcttccaatctt

SEQ ID NO: 436552 - DNA, 25 bp, Mus musculus
tcgactacgtcggatgcacctgcca

SEQ ID NO: 436553 - DNA, 25 bp, Mus musculus
gggacagactcgacctgaccgaatc

SEQ ID NO: 436554 - DNA, 25 bp, Mus musculus
tttctaaactccactgggccgcagc

SEQ ID NO: 436555 - DNA, 25 bp, Mus musculus
ggctctggagtttccgcatcacgga

SEQ ID NO: 436556 - DNA, 25 bp, Mus musculus
cctcagggatcctctacgctgttca

SEQ ID NO: 436557 - DNA, 25 bp, Mus musculus
atcgagcactcgttccggagctagc

SEQ ID NO: 436558 - DNA, 25 bp, Mus musculus
gaggcctgcggtaaacacgcgtgca

SEQ ID NO: 436559 - DNA, 25 bp, Mus musculus
tagcggtttttccaaatctccctga

SEQ ID NO: 436560 - DNA, 25 bp, Mus musculus
acagggtcccgacggctcgcgcaag

SEQ ID NO: 436561 - DNA, 25 bp, Mus musculus
cctacctccttctcggagacgtaga

SEQ ID NO: 436562 - DNA, 25 bp, Mus musculus
gagacgtagagctggtcgcctttca

SEQ ID NO: 436563 - DNA, 25 bp, Mus musculus
gctggtcgcctttcagcaccacata

SEQ ID NO: 436564 - DNA, 25 bp, Mus musculus
tttcagcaccacatagcggtttttc

SEQ ID NO: 436565 - DNA, 25 bp, Mus musculus
gcgccgcagactgatggtttccatc

SEQ ID NO: 436566 - DNA, 25 bp, Mus musculus
actgatggtttccatccggaggccc

SEQ ID NO: 436567 - DNA, 25 bp, Mus musculus
ggcggctcagactggtctctgcgcc

SEQ ID NO: 436568 - DNA, 25 bp, Mus musculus
ttgccggagccgctcttcttcatgg

SEQ ID NO: 436569 - DNA, 25 bp, Mus musculus
cgctcttcttcatggcgggatcggg

SEQ ID NO: 436570 - DNA, 25 bp, Mus musculus
gggagtctccactctcgacctactg

SEQ ID NO: 436571 - DNA, 25 bp, Mus musculus
tctcgacctactgccgggcggacgt

SEQ ID NO: 436572 - DNA, 25 bp, Mus musculus
gtgccattcccgacgcttctcggta

SEQ ID NO: 436573 - DNA, 25 bp, Mus musculus
caaagcctcggcttccgggagtccg

SEQ ID NO: 436574 - DNA, 25 bp, Mus musculus
agtccgggtagctccgatactggga

SEQ ID NO: 436575 - DNA, 25 bp, Mus musculus
ggtagctccgatactgggaattgta

SEQ ID NO: 436576 - DNA, 25 bp, Mus musculus
ggaattgtagttcctccgtggagtc

SEQ ID NO: 436577 - DNA, 25 bp, Mus musculus
cagcagctaagcgacggtgccattc

SEQ ID NO: 436578 - DNA, 25 bp, Mus musculus
tcccgacgcttctcggtagggagtg

SEQ ID NO: 436579 - DNA, 25 bp, Mus musculus
aacccgcgctgtgctggcttctggt

SEQ ID NO: 436580 - DNA, 25 bp, Mus musculus
aagcgcttggcgcaccgcgggatac

SEQ ID NO: 436581 - DNA, 25 bp, Mus musculus
gcgggatacagctctctcggacact

SEQ ID NO: 436582 - DNA, 25 bp, Mus musculus
tctcggacactgtttgctgagcatc

SEQ ID NO: 436583 - DNA, 25 bp, Mus musculus
gctgagcatcttttctgaagccctc

SEQ ID NO: 436584 - DNA, 25 bp, Mus musculus
tttctgaagccctcgcacgtcatcg

SEQ ID NO: 436585 - DNA, 25 bp, Mus musculus
tcctccgtggagtccgggactcaga

SEQ ID NO: 436586 - DNA, 25 bp, Mus musculus
agctcccgctcaaaagtgcctccgc

SEQ ID NO: 436587 - DNA, 25 bp, Mus musculus
tcactgccgaggaatgaggcgaggc

SEQ ID NO: 436588 - DNA, 25 bp, Mus musculus
gcaacagccgcggtcgcagtgtccg

SEQ ID NO: 436589 - DNA, 25 bp, Mus musculus
tctcctgtggagagcaacagccgcg

SEQ ID NO: 436590 - DNA, 25 bp, Mus musculus
agctccggtcagtcccggcttggct

SEQ ID NO: 436591 - DNA, 25 bp, Mus musculus
aagccattgggaagaggccagctcc

SEQ ID NO: 436592 - DNA, 25 bp, Mus musculus
ctgaaccagccgctggagtcggagt

SEQ ID NO: 436593 - DNA, 25 bp, Mus musculus
accgatcctgaaccagccgctggag

SEQ ID NO: 436594 - DNA, 25 bp, Mus musculus
ggacggccgaaagccaccgatcctg

SEQ ID NO: 436595 - DNA, 25 bp, Mus musculus
ggcggctagggtgtcaccgccaacc

SEQ ID NO: 436596 - DNA, 25 bp, Mus musculus
gggcaagcgccaaaccggccacagc

SEQ ID NO: 436597 - DNA, 25 bp, Mus musculus
cgcgagccaaaaacgcgcggggtca

SEQ ID NO: 436598 - DNA, 25 bp, Mus musculus
gctcggggacgcgagccaaaaacgc

SEQ ID NO: 436599 - DNA, 25 bp, Mus musculus
cggcctagagccttgccccgagagt

SEQ ID NO: 436600 - DNA, 25 bp, Mus musculus
cgcacagagcccgggacaggtagcc

SEQ ID NO: 436601 - DNA, 25 bp, Mus musculus
tgccctcgctggatccgggctgaac

SEQ ID NO: 436602 - DNA, 25 bp, Mus musculus
cgcggcacactagcaagcacacgcc

SEQ ID NO: 436603 - DNA, 25 bp, Mus musculus
gtggccggcgagcagacacgccttc

SEQ ID NO: 436604 - DNA, 25 bp, Mus musculus
cgagccgttcactggtcagcctagg

SEQ ID NO: 436605 - DNA, 25 bp, Mus musculus
cactggtcagcctaggccgggccag

SEQ ID NO: 436606 - DNA, 25 bp, Mus musculus
ggattggctgattggcataaggtcc

SEQ ID NO: 436607 - DNA, 25 bp, Mus musculus
ctgattggcataaggtcctgggaca

SEQ ID NO: 436608 - DNA, 25 bp, Mus musculus
tcctgggacagccaatctggaaggc

SEQ ID NO: 436609 - DNA, 25 bp, Mus musculus
atctggaaggctgagcagctgcgaa

SEQ ID NO: 436610 - DNA, 25 bp, Mus musculus
ggaatggctaccacccggagctgaa

SEQ ID NO: 436611 - DNA, 25 bp, Mus musculus
taccacccggagctgaacggtggcg

SEQ ID NO: 436612 - DNA, 25 bp, Mus musculus
cctcagcgagccgttcactggtcag

SEQ ID NO: 436613 - DNA, 25 bp, Mus musculus
aagcccggagcagagagcagccctc

SEQ ID NO: 436614 - DNA, 25 bp, Mus musculus
ttaactgtgtcgagacgggctgagc

SEQ ID NO: 436615 - DNA, 25 bp, Mus musculus
acagcagcagccctagagcgccttt

SEQ ID NO: 436616 - DNA, 25 bp, Mus musculus
cgagcgtcgtggacctcactaaata

SEQ ID NO: 436617 - DNA, 25 bp, Mus musculus
atggctgccggaccgatctccgaac

SEQ ID NO: 436618 - DNA, 25 bp, Mus musculus
cgtgtgagcctctaacagtctggaa

SEQ ID NO: 436619 - DNA, 25 bp, Mus musculus
tcccttccgaaagacaagactccga

SEQ ID NO: 436620 - DNA, 25 bp, Mus musculus
tctccgaacggaatcagggtaattg

SEQ ID NO: 436621 - DNA, 25 bp, Mus musculus
cagtctggaagcatccggggcttta

SEQ ID NO: 436622 - DNA, 25 bp, Mus musculus
aagcctggttttgcacttgaatgtg

SEQ ID NO: 436623 - DNA, 25 bp, Mus musculus
tgcgtcacagaacgtacaaagcctg

SEQ ID NO: 436624 - DNA, 25 bp, Mus musculus
tgcacttaggacacaactctgcgtc

SEQ ID NO: 436625 - DNA, 25 bp, Mus musculus
gaaggcagtcctggccctgcactta

SEQ ID NO: 436626 - DNA, 25 bp, Mus musculus
taataggtcgctccagaaggcagtc

SEQ ID NO: 436627 - DNA, 25 bp, Mus musculus
gcccggaagtggaagttgtaactga

SEQ ID NO: 436628 - DNA, 25 bp, Mus musculus
ggggaaggaaggtacctctctgaca

SEQ ID NO: 436629 - DNA, 25 bp, Mus musculus
agccgttcagctgcacgacactttg

SEQ ID NO: 436630 - DNA, 25 bp, Mus musculus
actttgctgccgctggtagcccggc

SEQ ID NO: 436631 - DNA, 25 bp, Mus musculus
cttggaagttgtgcgggaccgacca

SEQ ID NO: 436632 - DNA, 25 bp, Mus musculus
accagcaggcagcaagcgggtgaca

SEQ ID NO: 436633 - DNA, 25 bp, Mus musculus
cagcccggcaaggtgtgggacccac

SEQ ID NO: 436634 - DNA, 25 bp, Mus musculus
gacccacgctccgaagggaaatctg

SEQ ID NO: 436635 - DNA, 25 bp, Mus musculus
gggaaatctgtctctctccgggacc

SEQ ID NO: 436636 - DNA, 25 bp, Mus musculus
aatccagagagggtctgagacggtc

SEQ ID NO: 436637 - DNA, 25 bp, Mus musculus
acttttccctcgtgctgcctcagtg

SEQ ID NO: 436638 - DNA, 25 bp, Mus musculus
ggtacctctctgacatttcgctctg

SEQ ID NO: 436639 - DNA, 25 bp, Mus musculus
acatttcgctctgctgacgcgccgg

SEQ ID NO: 436640 - DNA, 25 bp, Mus musculus
cgccggcaacttcatgaggaaaatc

SEQ ID NO: 436641 - DNA, 25 bp, Mus musculus
taacagggatggagacccgaagttc

SEQ ID NO: 436642 - DNA, 25 bp, Mus musculus
ttgctccaatttggcgcgaatagcg

SEQ ID NO: 436643 - DNA, 25 bp, Mus musculus
gcctgctgtaccaccgcttgatcta

SEQ ID NO: 436644 - DNA, 25 bp, Mus musculus
atggagaccatgcactgggccgatc

SEQ ID NO: 436645 - DNA, 25 bp, Mus musculus
gcgcacttagcattcgctgcggaga

SEQ ID NO: 436646 - DNA, 25 bp, Mus musculus
tggaaccgcctctactctgcgtggc

SEQ ID NO: 436647 - DNA, 25 bp, Mus musculus
ttaacgcggcttctacgccggtagc

SEQ ID NO: 436648 - DNA, 25 bp, Mus musculus
actaagggcactgggaaagcatggc

SEQ ID NO: 436649 - DNA, 25 bp, Mus musculus
acttggtccttttggctgagtcaga

SEQ ID NO: 436650 - DNA, 25 bp, Mus musculus
agctcctccgacagtgcctcgtgga

SEQ ID NO: 436651 - DNA, 25 bp, Mus musculus
gtacctttgtacttgctgcgcagcc

SEQ ID NO: 436652 - DNA, 25 bp, Mus musculus
acgcgaaaatgcgtctcgctgcctg

SEQ ID NO: 436653 - DNA, 25 bp, Mus musculus
ctcgctaggaaacgcagtccggttg

SEQ ID NO: 436654 - DNA, 25 bp, Mus musculus
tatcgtctctccgaaccctagggtg

SEQ ID NO: 436655 - DNA, 25 bp, Mus musculus
gaatagcggcttccactggtcctgc

SEQ ID NO: 436656 - DNA, 25 bp, Mus musculus
tggtcacaaactggcgcgttagcta

SEQ ID NO: 436657 - DNA, 25 bp, Mus musculus
gctcttagccttgtggctctcggtc

SEQ ID NO: 436658 - DNA, 25 bp, Mus musculus
ccgcgccatctgcaactagctgtga

SEQ ID NO: 436659 - DNA, 25 bp, Mus musculus
tgcaactagctgtgaggaacgatga

SEQ ID NO: 436660 - DNA, 25 bp, Mus musculus
cgatgaggagctcaacaagttacta

SEQ ID NO: 436661 - DNA, 25 bp, Mus musculus
tcaggctgtcttacttccgaagaaa

SEQ ID NO: 436662 - DNA, 25 bp, Mus musculus
acggaaagtcataagcctggaaaga

SEQ ID NO: 436663 - DNA, 25 bp, Mus musculus
gcctggaaagaacaaataactatta

SEQ ID NO: 436664 - DNA, 25 bp, Mus musculus
tttaagagccaccaaagtgtcatcc

SEQ ID NO: 436665 - DNA, 25 bp, Mus musculus
agtgtcatccaaagggctggtcaca

SEQ ID NO: 436666 - DNA, 25 bp, Mus musculus
ggcgcgttagctagctcctttgtaa

SEQ ID NO: 436667 - DNA, 25 bp, Mus musculus
ctttttggattcgtgttgagtttca

SEQ ID NO: 436668 - DNA, 25 bp, Mus musculus
tcctttgtaaaagatttggtggctc

SEQ ID NO: 436669 - DNA, 25 bp, Mus musculus
tgagtttcacttgctcttagccttg

SEQ ID NO: 436670 - DNA, 25 bp, Mus musculus
gcgccaagtagaggcctccctggat

SEQ ID NO: 436671 - DNA, 25 bp, Mus musculus
aatgacatctttgagcgcatagcaa

SEQ ID NO: 436672 - DNA, 25 bp, Mus musculus
ttgagcgcatagcaaacgaggcttc

SEQ ID NO: 436673 - DNA, 25 bp, Mus musculus
gcgcatagcaaacgaggcttctcgc

SEQ ID NO: 436674 - DNA, 25 bp, Mus musculus
caaacgaggcttctcgcctggcgca

SEQ ID NO: 436675 - DNA, 25 bp, Mus musculus
gcattacaacaagcggtctacaatc

SEQ ID NO: 436676 - DNA, 25 bp, Mus musculus
cggtctacaatcacatcgcgggaga

SEQ ID NO: 436677 - DNA, 25 bp, Mus musculus
tctacaatcacatcgcgggagatcc

SEQ ID NO: 436678 - DNA, 25 bp, Mus musculus
cacatcgcgggagatccagacgtcg

SEQ ID NO: 436679 - DNA, 25 bp, Mus musculus
agatccagacgtcggtgcgccttct

SEQ ID NO: 436680 - DNA, 25 bp, Mus musculus
tgcgccttctactgcccggagaact

SEQ ID NO: 436681 - DNA, 25 bp, Mus musculus
tactgcccggagaactggccaagca

SEQ ID NO: 436682 - DNA, 25 bp, Mus musculus
accaagtacaccagcgccaagtaga

SEQ ID NO: 436683 - DNA, 25 bp, Mus musculus
agaggcctccctggatgaggcgctc

SEQ ID NO: 436684 - DNA, 25 bp, Mus musculus
aaggccaccaagaccggctaccgtg

SEQ ID NO: 436685 - DNA, 25 bp, Mus musculus
cactcttacttttggggcagggcca

SEQ ID NO: 436686 - DNA, 25 bp, Mus musculus
cagggcatgaaccaaagagcgacaa

SEQ ID NO: 436687 - DNA, 25 bp, Mus musculus
aaagagcctttttaggagctcgcgg

SEQ ID NO: 436688 - DNA, 25 bp, Mus musculus
cggtccacttgccaacgttctgcga

SEQ ID NO: 436689 - DNA, 25 bp, Mus musculus
ggctaccgtgacacaactctttatc

SEQ ID NO: 436690 - DNA, 25 bp, Mus musculus
ggacggtcagcgagaaccgcgtatc

SEQ ID NO: 436691 - DNA, 25 bp, Mus musculus
cgtcctagttgagtcttagtcctgg

SEQ ID NO: 436692 - DNA, 25 bp, Mus musculus
tagattggcctagacgtcctagttg

SEQ ID NO: 436693 - DNA, 25 bp, Mus musculus
cggctgactgcgacttatgtctaga

SEQ ID NO: 436694 - DNA, 25 bp, Mus musculus
aatctagtgtttgtgcagcaccgcc

SEQ ID NO: 436695 - DNA, 25 bp, Mus musculus
gtcccagggcagaactaatctagtg

SEQ ID NO: 436696 - DNA, 25 bp, Mus musculus
agccacgtctggcagctgcccgtag

SEQ ID NO: 436697 - DNA, 25 bp, Mus musculus
ttatctgattcagtgggtggctctg

SEQ ID NO: 436698 - DNA, 25 bp, Mus musculus
ctagattagttctgccctgggactt

SEQ ID NO: 436699 - DNA, 25 bp, Mus musculus
aagagttgtgtcacggtagccggtc

SEQ ID NO: 436700 - DNA, 25 bp, Mus musculus
tggctccaccctcgcagaacgttgg

SEQ ID NO: 436701 - DNA, 25 bp, Mus musculus
ttgtcgctctttggttcatgccctg

SEQ ID NO: 436702 - DNA, 25 bp, Mus musculus
agcggatacgcggttctcgctgacc

SEQ ID NO: 436703 - DNA, 25 bp, Mus musculus
tctcgctgaccgtcccaagcattta

SEQ ID NO: 436704 - DNA, 25 bp, Mus musculus
ttcccaggactaagactcaactagg

SEQ ID NO: 436705 - DNA, 25 bp, Mus musculus
ctcaactaggacgtctaggccaatc

SEQ ID NO: 436706 - DNA, 25 bp, Mus musculus
ataagtcgcagtcagccgcgctctc

SEQ ID NO: 436707 - DNA, 25 bp, Mus musculus
cgcgagctcctaaaaaggctctttt

SEQ ID NO: 436708 - DNA, 25 bp, Mus musculus
gcggtgctgcacaaacactagatta

SEQ ID NO: 436709 - DNA, 25 bp, Mus musculus
tcagagccacccactgaatcagata

SEQ ID NO: 436710 - DNA, 25 bp, Mus musculus
tcgtccggtccttggggaatgtcta

SEQ ID NO: 436711 - DNA, 25 bp, Mus musculus
cccaaaagtaagagtgtcgtgtcct

SEQ ID NO: 436712 - DNA, 25 bp, Mus musculus
acaccacatccatagcggtgacggt

SEQ ID NO: 436713 - DNA, 25 bp, Mus musculus
agagcgtacaccacatccatagcgg

SEQ ID NO: 436714 - DNA, 25 bp, Mus musculus
gagcgtacaccacatccatagcggt

SEQ ID NO: 436715 - DNA, 25 bp, Mus musculus
agcgtacaccacatccatagcggtg

SEQ ID NO: 436716 - DNA, 25 bp, Mus musculus
gcgtacaccacatccatagcggtga

SEQ ID NO: 436717 - DNA, 25 bp, Mus musculus
tacaccacatccatagcggtgacgg

SEQ ID NO: 436718 - DNA, 25 bp, Mus musculus
gagagcgtacaccacatccatagcg

SEQ ID NO: 436719 - DNA, 25 bp, Mus musculus
caccacatccatagcggtgacggtc

SEQ ID NO: 436720 - DNA, 25 bp, Mus musculus
ccggagatgcgcttgaccccaccgc

SEQ ID NO: 436721 - DNA, 25 bp, Mus musculus
gttgtcacgcaagactttgcgatgg

SEQ ID NO: 436722 - DNA, 25 bp, Mus musculus
ttgtcacgcaagactttgcgatggc

SEQ ID NO: 436723 - DNA, 25 bp, Mus musculus
tgtcacgcaagactttgcgatggcg

SEQ ID NO: 436724 - DNA, 25 bp, Mus musculus
gtcacgcaagactttgcgatggcgc

SEQ ID NO: 436725 - DNA, 25 bp, Mus musculus
gtacaccacatccatagcggtgacg

SEQ ID NO: 436726 - DNA, 25 bp, Mus musculus
gctgatccgcaagctgccgttccag

SEQ ID NO: 436727 - DNA, 25 bp, Mus musculus
ctggtgcgcgagatcgcgcaggact

SEQ ID NO: 436728 - DNA, 25 bp, Mus musculus
cgcctggtgcgcgagatcgcgcagg

SEQ ID NO: 436729 - DNA, 25 bp, Mus musculus
aagctgccgttccagcgcctggtgc

SEQ ID NO: 436730 - DNA, 25 bp, Mus musculus
caagctgccgttccagcgcctggtg

SEQ ID NO: 436731 - DNA, 25 bp, Mus musculus
gcaagctgccgttccagcgcctggt

SEQ ID NO: 436732 - DNA, 25 bp, Mus musculus
tgatccgcaagctgccgttccagcg

SEQ ID NO: 436733 - DNA, 25 bp, Mus musculus
tgctgatccgcaagctgccgttcca

SEQ ID NO: 436734 - DNA, 25 bp, Mus musculus
gctgctgatccgcaagctgccgttc

SEQ ID NO: 436735 - DNA, 25 bp, Mus musculus
cgagctgctgatccgcaagctgccg

SEQ ID NO: 436736 - DNA, 25 bp, Mus musculus
gaccgagctgctgatccgcaagctg

SEQ ID NO: 436737 - DNA, 25 bp, Mus musculus
cgaccgagctgctgatccgcaagct

SEQ ID NO: 436738 - DNA, 25 bp, Mus musculus
tcgaccgagctgctgatccgcaagc

SEQ ID NO: 436739 - DNA, 25 bp, Mus musculus
gatccgcaagctgccgttccagcgc

SEQ ID NO: 436740 - DNA, 25 bp, Mus musculus
agggctctaagaaagctgtcacgaa

SEQ ID NO: 436741 - DNA, 25 bp, Mus musculus
cccgacacgggcatctcatctaagg

SEQ ID NO: 436742 - DNA, 25 bp, Mus musculus
gcaagccgcgctgaaacagttcgta

SEQ ID NO: 436743 - DNA, 25 bp, Mus musculus
agagttggctaaacacgctgtgtcg

SEQ ID NO: 436744 - DNA, 25 bp, Mus musculus
cgcggaggaaaatgccggatccagc

SEQ ID NO: 436745 - DNA, 25 bp, Mus musculus
ctaaggctatgggaatcatgaattc

SEQ ID NO: 436746 - DNA, 25 bp, Mus musculus
aacacgctgtgtcggaaggcaccaa

SEQ ID NO: 436747 - DNA, 25 bp, Mus musculus
ctgtttacgtgtacaaggtcctgaa

SEQ ID NO: 436748 - DNA, 25 bp, Mus musculus
gtcacgaaagtgcagaagaaagatg

SEQ ID NO: 436749 - DNA, 25 bp, Mus musculus
cggatccagcgaagtctgctcctgc

SEQ ID NO: 436750 - DNA, 25 bp, Mus musculus
cgttgcatctttagacgcggaggaa

SEQ ID NO: 436751 - DNA, 25 bp, Mus musculus
gcccggtctaccttacgttgcatct

SEQ ID NO: 436752 - DNA, 25 bp, Mus musculus
tgaaacagttcgtagttgcccggtc

SEQ ID NO: 436753 - DNA, 25 bp, Mus musculus
catgaattccttcgtgaacgatatc

SEQ ID NO: 436754 - DNA, 25 bp, Mus musculus
gttaggcgggactttgaatcttctc

SEQ ID NO: 436755 - DNA, 25 bp, Mus musculus
accaggagtcgctatgtgggtcctc

SEQ ID NO: 436756 - DNA, 25 bp, Mus musculus
ctcgaccgcgctgatcagactggcg

SEQ ID NO: 436757 - DNA, 25 bp, Mus musculus
agtagttctgcagctgcgcattcgc

SEQ ID NO: 436758 - DNA, 25 bp, Mus musculus
agactgccagcctctcgtgatgctg

SEQ ID NO: 436759 - DNA, 25 bp, Mus musculus
ccatcattaccaagagctgagtctg

SEQ ID NO: 436760 - DNA, 25 bp, Mus musculus
tataccggagggaatcggacacgca

SEQ ID NO: 436761 - DNA, 25 bp, Mus musculus
cactcttgtctgctaggtgaaagca

SEQ ID NO: 436762 - DNA, 25 bp, Mus musculus
tgctctttggcgtctacccaccaga

SEQ ID NO: 436763 - DNA, 25 bp, Mus musculus
gcacactgcctgcattgtatacaga

SEQ ID NO: 436764 - DNA, 25 bp, Mus musculus
tgcgctcgcgcagatgcaaagtgaa

SEQ ID NO: 436765 - DNA, 25 bp, Mus musculus
atacagatgaccacgagatggcgcc

SEQ ID NO: 436766 - DNA, 25 bp, Mus musculus
ggtctccgagctttggcaacgatga

SEQ ID NO: 436767 - DNA, 25 bp, Mus musculus
gtctgctttggaatggggcccttcc

SEQ ID NO: 436768 - DNA, 25 bp, Mus musculus
tccactccggggagcagcgtctttc

SEQ ID NO: 436769 - DNA, 25 bp, Mus musculus
caatgctgcgggtgtaaaatcggtc

SEQ ID NO: 436770 - DNA, 25 bp, Mus musculus
ctccatcctgaaggtaagccgctga

SEQ ID NO: 436771 - DNA, 25 bp, Mus musculus
cgctttccgatccaagacggctttc

SEQ ID NO: 436772 - DNA, 25 bp, Mus musculus
agaaaatcagcctccactccgggga

SEQ ID NO: 436773 - DNA, 25 bp, Mus musculus
aatcggtcagagaaaatcagcctcc

SEQ ID NO: 436774 - DNA, 25 bp, Mus musculus
cgtctttcgggtgcagctggcagac

SEQ ID NO: 436775 - DNA, 25 bp, Mus musculus
gctggcagacgcaattcctggaaca

SEQ ID NO: 436776 - DNA, 25 bp, Mus musculus
cgcaattcctggaacacagagcggc

SEQ ID NO: 436777 - DNA, 25 bp, Mus musculus
ctccggcgggcgatgacttcatgca

SEQ ID NO: 436778 - DNA, 25 bp, Mus musculus
gatgacttcatgcagccagcctgga

SEQ ID NO: 436779 - DNA, 25 bp, Mus musculus
cagcctggagtagccagcggccgct

SEQ ID NO: 436780 - DNA, 25 bp, Mus musculus
gacgcgtctctccatcctgaaggta

SEQ ID NO: 436781 - DNA, 25 bp, Mus musculus
aaggtaagccgctgacccgcgcttt

SEQ ID NO: 436782 - DNA, 25 bp, Mus musculus
gagttcctcctctagagaccacttc

SEQ ID NO: 436783 - DNA, 25 bp, Mus musculus
gagtcagcatctccgcttctccgtg

SEQ ID NO: 436784 - DNA, 25 bp, Mus musculus
tcttatcctataccggctgcagccg

SEQ ID NO: 436785 - DNA, 25 bp, Mus musculus
cacggaaggtaaccgcgctgtcatc

SEQ ID NO: 436786 - DNA, 25 bp, Mus musculus
ttgctgccggtgcactgtcgtgttc

SEQ ID NO: 436787 - DNA, 25 bp, Mus musculus
gacgcctctggggtccttggcccga

SEQ ID NO: 436788 - DNA, 25 bp, Mus musculus
cccggcacttagctgcagtgcgagc

SEQ ID NO: 436789 - DNA, 25 bp, Mus musculus
ctggtcccggactgaacaggttcct

SEQ ID NO: 436790 - DNA, 25 bp, Mus musculus
caggttccttccagtttgggtgtga

SEQ ID NO: 436791 - DNA, 25 bp, Mus musculus
cgggatcccgagttcctcctctaga

SEQ ID NO: 436792 - DNA, 25 bp, Mus musculus
gaagtgccgcaatgggccctaagga

SEQ ID NO: 436793 - DNA, 25 bp, Mus musculus
ccgtgctgccttgtttgcagccgca

SEQ ID NO: 436794 - DNA, 25 bp, Mus musculus
ttctctctgcctatctcttatccta

SEQ ID NO: 436795 - DNA, 25 bp, Mus musculus
cagcatccgcgctgcgcgaaagaga

SEQ ID NO: 436796 - DNA, 25 bp, Mus musculus
tcggcgctgtttcgtccgacagatc

SEQ ID NO: 436797 - DNA, 25 bp, Mus musculus
gcaccggcagctggtagcatacttc

SEQ ID NO: 436798 - DNA, 25 bp, Mus musculus
gctggtagcatacttccattgaaca

SEQ ID NO: 436799 - DNA, 25 bp, Mus musculus
gtccgacagatccaaaatgcccaga

SEQ ID NO: 436800 - DNA, 25 bp, Mus musculus
tttgttcggcctaccggatcggcgc

SEQ ID NO: 436801 - DNA, 25 bp, Mus musculus
ctcgggcgcaccgacccggagtttg

SEQ ID NO: 436802 - DNA, 25 bp, Mus musculus
caggagagttacgtggggcatcctc

SEQ ID NO: 436803 - DNA, 25 bp, Mus musculus
tcacactttgcagcagcggaccctg

SEQ ID NO: 436804 - DNA, 25 bp, Mus musculus
tccagaagacaaaagcaccgagctg

SEQ ID NO: 436805 - DNA, 25 bp, Mus musculus
ccattgaacacgtccgccttggatc

SEQ ID NO: 436806 - DNA, 25 bp, Mus musculus
ctggagctgaagctgatggctcctc

SEQ ID NO: 436807 - DNA, 25 bp, Mus musculus
cgagcccggcgtaattcacactttg

SEQ ID NO: 436808 - DNA, 25 bp, Mus musculus
ccagcctaccgaggcgggaacaatg

SEQ ID NO: 436809 - DNA, 25 bp, Mus musculus
caatggcccgagtccctccagaaga

SEQ ID NO: 436810 - DNA, 25 bp, Mus musculus
tgagaaagtccaacaggccccggga

SEQ ID NO: 436811 - DNA, 25 bp, Mus musculus
tgatgtcactcctgggtggctgacg

SEQ ID NO: 436812 - DNA, 25 bp, Mus musculus
gtgacttgtccctggtccttcaccg

SEQ ID NO: 436813 - DNA, 25 bp, Mus musculus
ccggggaaacgcgagagatttctcg

SEQ ID NO: 436814 - DNA, 25 bp, Mus musculus
cgactcctgtgctccgacttggaga

SEQ ID NO: 436815 - DNA, 25 bp, Mus musculus
ggtccttcaccgctccagcactgcg

SEQ ID NO: 436816 - DNA, 25 bp, Mus musculus
caaggtgacttgtccctggtccttc

SEQ ID NO: 436817 - DNA, 25 bp, Mus musculus
aagagacggtgcaaggtgacttgtc

SEQ ID NO: 436818 - DNA, 25 bp, Mus musculus
tcggccacaaggatgttggcacctg

SEQ ID NO: 436819 - DNA, 25 bp, Mus musculus
tacccaaaagagtcggccacaagga

SEQ ID NO: 436820 - DNA, 25 bp, Mus musculus
cgttcgtccatacccaaaagagtcg

SEQ ID NO: 436821 - DNA, 25 bp, Mus musculus
gaagacgggcgtccgttcgtccata

SEQ ID NO: 436822 - DNA, 25 bp, Mus musculus
ctccgacttggagaagacgggcgtc

SEQ ID NO: 436823 - DNA, 25 bp, Mus musculus
acgcgagagatttctcgcgcggcgt

SEQ ID NO: 436824 - DNA, 25 bp, Mus musculus
gacattcttgcgctctgctgacacc

SEQ ID NO: 436825 - DNA, 25 bp, Mus musculus
cccggcagaccctgcgcgcttatct

SEQ ID NO: 436826 - DNA, 25 bp, Mus musculus
atttctgcacggagcgcggacccgg

SEQ ID NO: 436827 - DNA, 25 bp, Mus musculus
tcacatttctgcacggagcgcggac

SEQ ID NO: 436828 - DNA, 25 bp, Mus musculus
cctcacatttctgcacggagcgcgg

SEQ ID NO: 436829 - DNA, 25 bp, Mus musculus
tgacacccgcgtatccgcgctccct

SEQ ID NO: 436830 - DNA, 25 bp, Mus musculus
ttgcgctctgctgacacccgcgtat

SEQ ID NO: 436831 - DNA, 25 bp, Mus musculus
acacgacattcttgcgctctgctga

SEQ ID NO: 436832 - DNA, 25 bp, Mus musculus
tcgtcgcacacgacattcttgcgct

SEQ ID NO: 436833 - DNA, 25 bp, Mus musculus
gtcgcctctacactcttaacacacg

SEQ ID NO: 436834 - DNA, 25 bp, Mus musculus
cgcttatctgcatacaccacgccca

SEQ ID NO: 436835 - DNA, 25 bp, Mus musculus
ggctcacacccgtcgcctctacact

SEQ ID NO: 436836 - DNA, 25 bp, Mus musculus
acgcccatacccgtgacatcaggga

SEQ ID NO: 436837 - DNA, 25 bp, Mus musculus
catacccgtgacatcagggatgacg

SEQ ID NO: 436838 - DNA, 25 bp, Mus musculus
tccctgatgtcacgggtatgggcgt

SEQ ID NO: 436839 - DNA, 25 bp, Mus musculus
agcgcaagaatgtcgtgtgcgacga

SEQ ID NO: 436840 - DNA, 25 bp, Mus musculus
cagagcgcaagaatgtcgtgtgcga

SEQ ID NO: 436841 - DNA, 25 bp, Mus musculus
tcagcagagcgcaagaatgtcgtgt

SEQ ID NO: 436842 - DNA, 25 bp, Mus musculus
atacgcgggtgtcagcagagcgcaa

SEQ ID NO: 436843 - DNA, 25 bp, Mus musculus
tccgtgcagaaatgtgaggggtttc

SEQ ID NO: 436844 - DNA, 25 bp, Mus musculus
tccgcgctccgtgcagaaatgtgag

SEQ ID NO: 436845 - DNA, 25 bp, Mus musculus
ccgggtccgcgctccgtgcagaaat

SEQ ID NO: 436846 - DNA, 25 bp, Mus musculus
tatgggcgtggtgtatgcagataag

SEQ ID NO: 436847 - DNA, 25 bp, Mus musculus
cgtcatccctgatgtcacgggtatg

SEQ ID NO: 436848 - DNA, 25 bp, Mus musculus
ggtgtcagcagagcgcaagaatgtc

SEQ ID NO: 436849 - DNA, 25 bp, Mus musculus
cgtgtgttaagagtgtagaggcgac

SEQ ID NO: 436850 - DNA, 25 bp, Mus musculus
tgcagataagcgcgcagggtctgcc

SEQ ID NO: 436851 - DNA, 25 bp, Mus musculus
gcagaaatgtgaggggtttctcccg

SEQ ID NO: 436852 - DNA, 25 bp, Mus musculus
cacgcgcgcggttcattacggtcac

SEQ ID NO: 436853 - DNA, 25 bp, Mus musculus
tgccctcagtaagcgccgtgaccaa

SEQ ID NO: 436854 - DNA, 25 bp, Mus musculus
tcggtacctgcttagggtctgcgaa

SEQ ID NO: 436855 - DNA, 25 bp, Mus musculus
ctgcgaaggaccgtaccctaaagcg

SEQ ID NO: 436856 - DNA, 25 bp, Mus musculus
ctaaagcgtaataggttccttatcg

SEQ ID NO: 436857 - DNA, 25 bp, Mus musculus
aggttccttatcgtagtccttctgg

SEQ ID NO: 436858 - DNA, 25 bp, Mus musculus
tcgtagtccttctgggcgtccaggc

SEQ ID NO: 436859 - DNA, 25 bp, Mus musculus
aagtgacagcgggatctcagcatcg

SEQ ID NO: 436860 - DNA, 25 bp, Mus musculus
atctcagcatcggaaggcgccagca

SEQ ID NO: 436861 - DNA, 25 bp, Mus musculus
tcattacggtcacgcgagcccggga

SEQ ID NO: 436862 - DNA, 25 bp, Mus musculus
ggtgacgccagttcaacttccaacg

SEQ ID NO: 436863 - DNA, 25 bp, Mus musculus
aacccggcgcaggacctgcggtctg

SEQ ID NO: 436864 - DNA, 25 bp, Mus musculus
acttccaacggctgccctcagtaag

SEQ ID NO: 436865 - DNA, 25 bp, Mus musculus
gccgtgaccaacctccaggactgaa

SEQ ID NO: 436866 - DNA, 25 bp, Mus musculus
cggcaaaactactcgctgttgttcg

SEQ ID NO: 436867 - DNA, 25 bp, Mus musculus
gcgatcataggtggcctcagtgact

SEQ ID NO: 436868 - DNA, 25 bp, Mus musculus
cagtgactctgggttcggacgtccg

SEQ ID NO: 436869 - DNA, 25 bp, Mus musculus
cttcgttcgcggcaaaactactcgc

SEQ ID NO: 436870 - DNA, 25 bp, Mus musculus
tcgttcgcggcaaaactactcgctg

SEQ ID NO: 436871 - DNA, 25 bp, Mus musculus
gccggtgtacgcagttcccaccgtg

SEQ ID NO: 436872 - DNA, 25 bp, Mus musculus
cgcggcaaaactactcgctgttgtt

SEQ ID NO: 436873 - DNA, 25 bp, Mus musculus
ggtgtacgcagttcccaccgtgtcc

SEQ ID NO: 436874 - DNA, 25 bp, Mus musculus
tccgcgatcataggtggcctcagtg

SEQ ID NO: 436875 - DNA, 25 bp, Mus musculus
aggtccgcgatcataggtggcctca

SEQ ID NO: 436876 - DNA, 25 bp, Mus musculus
gccgccagaggtccgcgatcatagg

SEQ ID NO: 436877 - DNA, 25 bp, Mus musculus
gcggccgccagaggtccgcgatcat

SEQ ID NO: 436878 - DNA, 25 bp, Mus musculus
gcctcagtgactctgggttcggacg

SEQ ID NO: 436879 - DNA, 25 bp, Mus musculus
ttcgcggcaaaactactcgctgttg

SEQ ID NO: 436880 - DNA, 25 bp, Mus musculus
gcggagaacaaaagaccagaaccca

SEQ ID NO: 436881 - DNA, 25 bp, Mus musculus
ctgattggtcgagcccagcacttgc

SEQ ID NO: 436882 - DNA, 25 bp, Mus musculus
cgcgctgattggtcgagcccagcac

SEQ ID NO: 436883 - DNA, 25 bp, Mus musculus
cttaaataccccatggcgcgcgctg

SEQ ID NO: 436884 - DNA, 25 bp, Mus musculus
gttaggtgccgaggcctagccgccc

SEQ ID NO: 436885 - DNA, 25 bp, Mus musculus
aaatcagggttaggtgccgaggcct

SEQ ID NO: 436886 - DNA, 25 bp, Mus musculus
agaccagaacccacagctaatgaaa

SEQ ID NO: 436887 - DNA, 25 bp, Mus musculus
acagcgggcggagaacaaaagacca

SEQ ID NO: 436888 - DNA, 25 bp, Mus musculus
tgacgtttgtttttgaggctcggga

SEQ ID NO: 436889 - DNA, 25 bp, Mus musculus
gcgctgacgtttgtttttgaggctc

SEQ ID NO: 436890 - DNA, 25 bp, Mus musculus
ctcctgcgctgacgtttgtttttga

SEQ ID NO: 436891 - DNA, 25 bp, Mus musculus
gagctcctgcgctgacgtttgtttt

SEQ ID NO: 436892 - DNA, 25 bp, Mus musculus
ggagctcccggcgaacctggagctc

SEQ ID NO: 436893 - DNA, 25 bp, Mus musculus
ccacagctaatgaaaatcagggtta

SEQ ID NO: 436894 - DNA, 25 bp, Mus musculus
tgggtagactgggaatactttctta

SEQ ID NO: 436895 - DNA, 25 bp, Mus musculus
ggacgacagacagttaggcctcacc

SEQ ID NO: 436896 - DNA, 25 bp, Mus musculus
aggcctcacctaggcttttaacagc

SEQ ID NO: 436897 - DNA, 25 bp, Mus musculus
taaccttgcctgtcggtcggtcaca

SEQ ID NO: 436898 - DNA, 25 bp, Mus musculus
ggattatttgtcacatgcctcggcc

SEQ ID NO: 436899 - DNA, 25 bp, Mus musculus
tgcctcggccaggaagaacttttca

SEQ ID NO: 436900 - DNA, 25 bp, Mus musculus
cccgcctgatatccctggtgtattt

SEQ ID NO: 436901 - DNA, 25 bp, Mus musculus
caccagtcacgtctgcgggacgaca

SEQ ID NO: 436902 - DNA, 25 bp, Mus musculus
gtgacgcctgcctgaacaaggaacc

SEQ ID NO: 436903 - DNA, 25 bp, Mus musculus
ccctgagctgcgttcttttgatgta

SEQ ID NO: 436904 - DNA, 25 bp, Mus musculus
ttgcttctaggaacgcccgtggacc

SEQ ID NO: 436905 - DNA, 25 bp, Mus musculus
cgcggccttggggaaaatagctaag

SEQ ID NO: 436906 - DNA, 25 bp, Mus musculus
acctcaccgtgggtgctccagctga

SEQ ID NO: 436907 - DNA, 25 bp, Mus musculus
cttggcgacaacacccatctgcgga

SEQ ID NO: 436908 - DNA, 25 bp, Mus musculus
agcacccacggtgaggttgaggtcc

SEQ ID NO: 436909 - DNA, 25 bp, Mus musculus
gccacgccggttccttgttcaggca

SEQ ID NO: 436910 - DNA, 25 bp, Mus musculus
gtctctgctcgcctcagaggcttca

SEQ ID NO: 436911 - DNA, 25 bp, Mus musculus
tcgtcccgcagacgtgactggtgcc

SEQ ID NO: 436912 - DNA, 25 bp, Mus musculus
gtccacgggcgttcctagaagcaag

SEQ ID NO: 436913 - DNA, 25 bp, Mus musculus
gcaagccaggggtgtaaagttccta

SEQ ID NO: 436914 - DNA, 25 bp, Mus musculus
cctatgatagcgtttacctgtgtta

SEQ ID NO: 436915 - DNA, 25 bp, Mus musculus
ctggagacttgtacgatgatttttg

SEQ ID NO: 436916 - DNA, 25 bp, Mus musculus
gatgggtgttgtcgccaagttcttc

SEQ ID NO: 436917 - DNA, 25 bp, Mus musculus
tgaaaagttcttcctggccgaggca

SEQ ID NO: 436918 - DNA, 25 bp, Mus musculus
tggccgaggcatgtgacaaataatc

SEQ ID NO: 436919 - DNA, 25 bp, Mus musculus
tgtgaccgaccgacaggcaaggtta

SEQ ID NO: 436920 - DNA, 25 bp, Mus musculus
agcccttgcttgttttgagtttgcc

SEQ ID NO: 436921 - DNA, 25 bp, Mus musculus
cctaggtgaggcctaactgtctgtc

SEQ ID NO: 436922 - DNA, 25 bp, Mus musculus
acaccctttggtggcgacattctgt

SEQ ID NO: 436923 - DNA, 25 bp, Mus musculus
ggagaaaccgtttgccattggccga

SEQ ID NO: 436924 - DNA, 25 bp, Mus musculus
ccggctagccaccagttgcgttaca

SEQ ID NO: 436925 - DNA, 25 bp, Mus musculus
ttgcgttacaggacaacaccctttg

SEQ ID NO: 436926 - DNA, 25 bp, Mus musculus
tgttttcattgccagagcgtccaga

SEQ ID NO: 436927 - DNA, 25 bp, Mus musculus
gccaggattggccaccaactctttt

SEQ ID NO: 436928 - DNA, 25 bp, Mus musculus
agccttccgcagacagccaggattg

SEQ ID NO: 436929 - DNA, 25 bp, Mus musculus
actgctgaccgaacagagccttccg

SEQ ID NO: 436930 - DNA, 25 bp, Mus musculus
ccgcctctttatcactgggaacaga

SEQ ID NO: 436931 - DNA, 25 bp, Mus musculus
gagcctccttctacctagcttggta

SEQ ID NO: 436932 - DNA, 25 bp, Mus musculus
tgggtcctaaaacagccaggccacg

SEQ ID NO: 436933 - DNA, 25 bp, Mus musculus
ccttcagagaatcggctgggtccta

SEQ ID NO: 436934 - DNA, 25 bp, Mus musculus
ggcttacgtgcagtcttggttgaaa

SEQ ID NO: 436935 - DNA, 25 bp, Mus musculus
caagcctgccttagcgtcggagaca

SEQ ID NO: 436936 - DNA, 25 bp, Mus musculus
cgtcagccacccaggagtgacatca

SEQ ID NO: 436937 - DNA, 25 bp, Mus musculus
caacatccttgtggccgactctttt

SEQ ID NO: 436938 - DNA, 25 bp, Mus musculus
ccggggcctgttggactttctcact

SEQ ID NO: 436939 - DNA, 25 bp, Mus musculus
tgaaggaccagggacaagtcacctt

SEQ ID NO: 436940 - DNA, 25 bp, Mus musculus
acaagtcaccttgcaccgtctctta

SEQ ID NO: 436941 - DNA, 25 bp, Mus musculus
cctaactggccgctcgtggcccacc

SEQ ID NO: 436942 - DNA, 25 bp, Mus musculus
caggtgccaacatccttgtggccga

SEQ ID NO: 436943 - DNA, 25 bp, Mus musculus
caggagtcgggcagcacaggagcca

SEQ ID NO: 436944 - DNA, 25 bp, Mus musculus
ttctccaagtcggagcacaggagtc

SEQ ID NO: 436945 - DNA, 25 bp, Mus musculus
ggacgcccgtcttctccaagtcgga

SEQ ID NO: 436946 - DNA, 25 bp, Mus musculus
tatggacgaacggacgcccgtcttc

SEQ ID NO: 436947 - DNA, 25 bp, Mus musculus
cgactcttttgggtatggacgaacg

SEQ ID NO: 436948 - DNA, 25 bp, Mus musculus
cttgtggccgactcttttgggtatg

SEQ ID NO: 436949 - DNA, 25 bp, Mus musculus
gccgcgcgagaaatctctcgcgttt

SEQ ID NO: 436950 - DNA, 25 bp, Mus musculus
ccctgctgagcagggccctgcaagg

SEQ ID NO: 436951 - DNA, 25 bp, Mus musculus
gaagtattcttcacccatgcggatc

SEQ ID NO: 436952 - DNA, 25 bp, Mus musculus
acccatgcggatcagaaccggctga

SEQ ID NO: 436953 - DNA, 25 bp, Mus musculus
ctgcaagaaattcaagggctgcggg

SEQ ID NO: 436954 - DNA, 25 bp, Mus musculus
ggcaggcaggacgacagagccacca

SEQ ID NO: 436955 - DNA, 25 bp, Mus musculus
cagccgcatgttaggggcgctctct

SEQ ID NO: 436956 - DNA, 25 bp, Mus musculus
gcgctctctgaagcaccgaggttga

SEQ ID NO: 436957 - DNA, 25 bp, Mus musculus
cccaggcggaggaagtattcttcac

SEQ ID NO: 436958 - DNA, 25 bp, Mus musculus
agcagcgggacttctgttgagattc

SEQ ID NO: 436959 - DNA, 25 bp, Mus musculus
aaagttagccgcagcctggtcgtgc

SEQ ID NO: 436960 - DNA, 25 bp, Mus musculus
tgctgcagcaacacgcggaaaaagt

SEQ ID NO: 436961 - DNA, 25 bp, Mus musculus
agcgagcgctgaggcatctgcagct

SEQ ID NO: 436962 - DNA, 25 bp, Mus musculus
ctggtggccaccgagggcatcctcg

SEQ ID NO: 436963 - DNA, 25 bp, Mus musculus
ggctgctccggctgcaagaaattca

SEQ ID NO: 436964 - DNA, 25 bp, Mus musculus
gccaccgggagatcccagggatcca

SEQ ID NO: 436965 - DNA, 25 bp, Mus musculus
caagctcgtgggaatggaatgaacc

SEQ ID NO: 436966 - DNA, 25 bp, Mus musculus
cgagtccacttctcaagctcgtggg

SEQ ID NO: 436967 - DNA, 25 bp, Mus musculus
gcaagcctcgagtccacttctcaag

SEQ ID NO: 436968 - DNA, 25 bp, Mus musculus
cacccgcggtcagcgcaggaagctt

SEQ ID NO: 436969 - DNA, 25 bp, Mus musculus
gcaccgcgggtagctactctaaagg

SEQ ID NO: 436970 - DNA, 25 bp, Mus musculus
gtaactgattttgccacccgcggtc

SEQ ID NO: 436971 - DNA, 25 bp, Mus musculus
cagggatccaacagggctctgcgaa

SEQ ID NO: 436972 - DNA, 25 bp, Mus musculus
caccacccggtaactgattttgcca

SEQ ID NO: 436973 - DNA, 25 bp, Mus musculus
caagtgcgctttagggtcgggtact

SEQ ID NO: 436974 - DNA, 25 bp, Mus musculus
tcgggtactttgcagaccacgagta

SEQ ID NO: 436975 - DNA, 25 bp, Mus musculus
ttgcagaccacgagtacggacgcgc

SEQ ID NO: 436976 - DNA, 25 bp, Mus musculus
ctctgcgaagaagcccaagtgcgct

SEQ ID NO: 436977 - DNA, 25 bp, Mus musculus
agctactctaaaggaacgtgaattt

SEQ ID NO: 436978 - DNA, 25 bp, Mus musculus
aatatctcgctttccgcggcgggtg

SEQ ID NO: 436979 - DNA, 25 bp, Mus musculus
agcgaagttaccctgccatgccctt

SEQ ID NO: 436980 - DNA, 25 bp, Mus musculus
taccaggctacccttctacgcgtcc

SEQ ID NO: 436981 - DNA, 25 bp, Mus musculus
ggtgacgtcccagtctaccaggcta

SEQ ID NO: 436982 - DNA, 25 bp, Mus musculus
acatccagggtgacgtcccagtcta

SEQ ID NO: 436983 - DNA, 25 bp, Mus musculus
tgtacacaccgcgacccaggggaca

SEQ ID NO: 436984 - DNA, 25 bp, Mus musculus
ccctcatctgcataagccacgccca

SEQ ID NO: 436985 - DNA, 25 bp, Mus musculus
cttctctgcgcctcgcctgtacaca

SEQ ID NO: 436986 - DNA, 25 bp, Mus musculus
cgccgcctgagaaatatctcgcttt

SEQ ID NO: 436987 - DNA, 25 bp, Mus musculus
tctctcgccgcctgagaaatatctc

SEQ ID NO: 436988 - DNA, 25 bp, Mus musculus
gctccgctgacacccagggtcccgc

SEQ ID NO: 436989 - DNA, 25 bp, Mus musculus
acggtcacttcgtcccgcctgatag

SEQ ID NO: 436990 - DNA, 25 bp, Mus musculus
cgcccacaactgacatccagggtga

SEQ ID NO: 436991 - DNA, 25 bp, Mus musculus
ggaacagcgaagttaccctgccatg

SEQ ID NO: 436992 - DNA, 25 bp, Mus musculus
aagggcatggcagggtaacttcgct

SEQ ID NO: 436993 - DNA, 25 bp, Mus musculus
agactgggacgtcaccctggatgtc

SEQ ID NO: 436994 - DNA, 25 bp, Mus musculus
ctatcaggcgggacgaagtgaccgt

SEQ ID NO: 436995 - DNA, 25 bp, Mus musculus
gtgtgtacaggcgaggcgcagagaa

SEQ ID NO: 436996 - DNA, 25 bp, Mus musculus
tggcagggtaacttcgctgttccct

SEQ ID NO: 436997 - DNA, 25 bp, Mus musculus
acgcgtagaagggtagcctggtaga

SEQ ID NO: 436998 - DNA, 25 bp, Mus musculus
agatatttctcaggcggcgagagag

SEQ ID NO: 436999 - DNA, 25 bp, Mus musculus
gcgagatatttctcaggcggcgaga

SEQ ID NO: 437000 - DNA, 25 bp, Mus musculus
gccgcggaaagcgagatatttctca

SEQ ID NO: 437001 - DNA, 25 bp, Mus musculus
cacccgccgcggaaagcgagatatt

SEQ ID NO: 437002 - DNA, 25 bp, Mus musculus
tagcctggtagactgggacgtcacc

SEQ ID NO: 437003 - DNA, 25 bp, Mus musculus
gacgtcaccctggatgtcagttgtg

SEQ ID NO: 437004 - DNA, 25 bp, Mus musculus
tgtcccctgggtcgcggtgtgtaca

SEQ ID NO: 437005 - DNA, 25 bp, Mus musculus
caccctggatgtcagttgtgggcgt

SEQ ID NO: 437006 - DNA, 25 bp, Mus musculus
tgcgcacccgaacaacaaccatttt

SEQ ID NO: 437007 - DNA, 25 bp, Mus musculus
ctgctggcaaggctgcgcacccgaa

SEQ ID NO: 437008 - DNA, 25 bp, Mus musculus
gcaaggctgcgcacccgaacaacaa

SEQ ID NO: 437009 - DNA, 25 bp, Mus musculus
gctaggagcacaccgtgtccacgcg

SEQ ID NO: 437010 - DNA, 25 bp, Mus musculus
ctgattggttggaggcctggtaaac

SEQ ID NO: 437011 - DNA, 25 bp, Mus musculus
gcctggtaaacaagggccaagtagc

SEQ ID NO: 437012 - DNA, 25 bp, Mus musculus
caagggccaagtagccaatgggaga

SEQ ID NO: 437013 - DNA, 25 bp, Mus musculus
tagccaatgggagaactgtgcacga

SEQ ID NO: 437014 - DNA, 25 bp, Mus musculus
agaactgtgcacgagggctgcacga

SEQ ID NO: 437015 - DNA, 25 bp, Mus musculus
acgagggctgcacgagcctccaggc

SEQ ID NO: 437016 - DNA, 25 bp, Mus musculus
tccaggccagcactcgcgtggagcg

SEQ ID NO: 437017 - DNA, 25 bp, Mus musculus
gagcgccaagccaggcggctatata

SEQ ID NO: 437018 - DNA, 25 bp, Mus musculus
gccaggcggctatataagccgtttc

SEQ ID NO: 437019 - DNA, 25 bp, Mus musculus
ctatataagccgtttccggcagccg

SEQ ID NO: 437020 - DNA, 25 bp, Mus musculus
ccacgcagccgccaacttgaaattt

SEQ ID NO: 437021 - DNA, 25 bp, Mus musculus
gcttaaccggaactgaggcttggga

SEQ ID NO: 437022 - DNA, 25 bp, Mus musculus
agggagcgagcttaaccggaactga

SEQ ID NO: 437023 - DNA, 25 bp, Mus musculus
tcctggccaatcgacgagagcggag

SEQ ID NO: 437024 - DNA, 25 bp, Mus musculus
ttttcctggccaatcgacgagagcg

SEQ ID NO: 437025 - DNA, 25 bp, Mus musculus
gtgggttttcctggccaatcgacga

SEQ ID NO: 437026 - DNA, 25 bp, Mus musculus
ccgagctctccattggtgggttttc

SEQ ID NO: 437027 - DNA, 25 bp, Mus musculus
ttatctacgtcgctgtcggcgccga

SEQ ID NO: 437028 - DNA, 25 bp, Mus musculus
gcagccgccaacttgaaatttgctt

SEQ ID NO: 437029 - DNA, 25 bp, Mus musculus
gtcgaagccttacctgccgtccctc

SEQ ID NO: 437030 - DNA, 25 bp, Mus musculus
agagccaccaggtcgaagccttacc

SEQ ID NO: 437031 - DNA, 25 bp, Mus musculus
gaaccaaaccgggtcagagccacca

SEQ ID NO: 437032 - DNA, 25 bp, Mus musculus
tcggcgccgagggactaattcggga

SEQ ID NO: 437033 - DNA, 25 bp, Mus musculus
ttccagccctcgttctaggcccgcc

SEQ ID NO: 437034 - DNA, 25 bp, Mus musculus
ttcaatggcttgaccctgaccggga

SEQ ID NO: 437035 - DNA, 25 bp, Mus musculus
tgccacactgctggacgcctgcaag

SEQ ID NO: 437036 - DNA, 25 bp, Mus musculus
ggatcccaacatcgcagaccgttta

SEQ ID NO: 437037 - DNA, 25 bp, Mus musculus
cgaccctcagaacaaggcgcgcatg

SEQ ID NO: 437038 - DNA, 25 bp, Mus musculus
gaccgtttaggacgtaccgcgctga

SEQ ID NO: 437039 - DNA, 25 bp, Mus musculus
ggcgcagacccttcagttcgagatc

SEQ ID NO: 437040 - DNA, 25 bp, Mus musculus
ggctcaggagtctggtcttccttca

SEQ ID NO: 437041 - DNA, 25 bp, Mus musculus
ggcacggaggtcatcatcataacga

SEQ ID NO: 437042 - DNA, 25 bp, Mus musculus
ataacgacggatacctcgccctcgg

SEQ ID NO: 437043 - DNA, 25 bp, Mus musculus
tcgccttcagaagtccaactgcaga

SEQ ID NO: 437044 - DNA, 25 bp, Mus musculus
ggcgcgcatggtacgctatctcttg

SEQ ID NO: 437045 - DNA, 25 bp, Mus musculus
gagcgtctggctgctgaattcaatg

SEQ ID NO: 437046 - DNA, 25 bp, Mus musculus
agaccgcgtctttctcggcgtcaca

SEQ ID NO: 437047 - DNA, 25 bp, Mus musculus
gctcaattccgagccctggggcctt

SEQ ID NO: 437048 - DNA, 25 bp, Mus musculus
tagctcgccaggctggcaggctccg

SEQ ID NO: 437049 - DNA, 25 bp, Mus musculus
gaggcactttgcgagcgctgcggcc

SEQ ID NO: 437050 - DNA, 25 bp, Mus musculus
agcacagcggctgcagcccggtgta

SEQ ID NO: 437051 - DNA, 25 bp, Mus musculus
gatgcgagcacagcggctgcagccc

SEQ ID NO: 437052 - DNA, 25 bp, Mus musculus
agctccgccggccaccgggatggag

SEQ ID NO: 437053 - DNA, 25 bp, Mus musculus
ggaccgttagctcgccaggctggca

SEQ ID NO: 437054 - DNA, 25 bp, Mus musculus
gtagctgggaccgttagctcgccag

SEQ ID NO: 437055 - DNA, 25 bp, Mus musculus
ctggctcttgctcactggggtagct

SEQ ID NO: 437056 - DNA, 25 bp, Mus musculus
tggatcccggcaccgccctcaatcc

SEQ ID NO: 437057 - DNA, 25 bp, Mus musculus
gactgacagctggatcccggcaccg

SEQ ID NO: 437058 - DNA, 25 bp, Mus musculus
cttgactgacagctggatcccggca

SEQ ID NO: 437059 - DNA, 25 bp, Mus musculus
gctcttgactgacagctggatcccg

SEQ ID NO: 437060 - DNA, 25 bp, Mus musculus
gtcccgcccgctcttgactgacagc

SEQ ID NO: 437061 - DNA, 25 bp, Mus musculus
agacgatgcgagcacagcggctgca

SEQ ID NO: 437062 - DNA, 25 bp, Mus musculus
cgtgacgtttttcttctgcgacagc

SEQ ID NO: 437063 - DNA, 25 bp, Mus musculus
cgtttctagcgcttcatagtggggc

SEQ ID NO: 437064 - DNA, 25 bp, Mus musculus
tagcgcttcatagtggggccgccta

SEQ ID NO: 437065 - DNA, 25 bp, Mus musculus
gggccgcctacattggcgaattttc

SEQ ID NO: 437066 - DNA, 25 bp, Mus musculus
ggcgaattttcaccgcgccgagggc

SEQ ID NO: 437067 - DNA, 25 bp, Mus musculus
ttggtcagcctaactcgtgacgttt

SEQ ID NO: 437068 - DNA, 25 bp, Mus musculus
cttcccgaggtgcttagcttctaga

SEQ ID NO: 437069 - DNA, 25 bp, Mus musculus
ggtgcttagcttctagagactcaga

SEQ ID NO: 437070 - DNA, 25 bp, Mus musculus
tctagagactcagaaagcgccgaga

SEQ ID NO: 437071 - DNA, 25 bp, Mus musculus
aaagcgccgagagaagcaagatggc

SEQ ID NO: 437072 - DNA, 25 bp, Mus musculus
cggacgtgctggatcttcacgaggc

SEQ ID NO: 437073 - DNA, 25 bp, Mus musculus
cgaagatttcgccatggatgaggat

SEQ ID NO: 437074 - DNA, 25 bp, Mus musculus
tcttctgcgacagcttcccgaggtg

SEQ ID NO: 437075 - DNA, 25 bp, Mus musculus
ggaggcaacctttaattggtcagcc

SEQ ID NO: 437076 - DNA, 25 bp, Mus musculus
ttgtgaggagctgcccggaacgccc

SEQ ID NO: 437077 - DNA, 25 bp, Mus musculus
tctagtccgcgctcggctctgcgtt

SEQ ID NO: 437078 - DNA, 25 bp, Mus musculus
cttcccagtgtgtgtcagtgaccca

SEQ ID NO: 437079 - DNA, 25 bp, Mus musculus
cagtgacccaaaggcggttcgaggc

SEQ ID NO: 437080 - DNA, 25 bp, Mus musculus
cgccaccggatctgcctgcagcccg

SEQ ID NO: 437081 - DNA, 25 bp, Mus musculus
gagctcaccacaaagcgggcccgag

SEQ ID NO: 437082 - DNA, 25 bp, Mus musculus
gcccgagcctccctctctagtccgc

SEQ ID NO: 437083 - DNA, 25 bp, Mus musculus
ggctccgctggtgcctgcgttcaac

SEQ ID NO: 437084 - DNA, 25 bp, Mus musculus
tgcctgcgttcaaccggtgctcgcg

SEQ ID NO: 437085 - DNA, 25 bp, Mus musculus
gccaccagcagtcgtccggtgagtg

SEQ ID NO: 437086 - DNA, 25 bp, Mus musculus
gcgcggaacttcctccgagcctttg

SEQ ID NO: 437087 - DNA, 25 bp, Mus musculus
aacttcctccgagcctttgccggtg

SEQ ID NO: 437088 - DNA, 25 bp, Mus musculus
gaagcgcctttgtgaggagctgccc

SEQ ID NO: 437089 - DNA, 25 bp, Mus musculus
agcagagtttgcggcgccgcatccc

SEQ ID NO: 437090 - DNA, 25 bp, Mus musculus
aattccacttcaaggccggctccgg

SEQ ID NO: 437091 - DNA, 25 bp, Mus musculus
ggtccgcttcagtgctcagagccaa

SEQ ID NO: 437092 - DNA, 25 bp, Mus musculus
cgtgtgcgccttggcggcaacctac

SEQ ID NO: 437093 - DNA, 25 bp, Mus musculus
cccttgctgctgagaatttaaagca

SEQ ID NO: 437094 - DNA, 25 bp, Mus musculus
taaagcagaatgtgctcctaggggc

SEQ ID NO: 437095 - DNA, 25 bp, Mus musculus
ctcctaggggcgtgcttaaaagccg

SEQ ID NO: 437096 - DNA, 25 bp, Mus musculus
gcgtgcttaaaagccggagaccatc

SEQ ID NO: 437097 - DNA, 25 bp, Mus musculus
cggagaccatcccagagaagggtga

SEQ ID NO: 437098 - DNA, 25 bp, Mus musculus
tgagctgccggaaatgcacccacga

SEQ ID NO: 437099 - DNA, 25 bp, Mus musculus
tctcgcttcgcgtcctgaaattcca

SEQ ID NO: 437100 - DNA, 25 bp, Mus musculus
cggctccggctgcttggctttcctg

SEQ ID NO: 437101 - DNA, 25 bp, Mus musculus
cttggctttcctgccgccgtttgtc

SEQ ID NO: 437102 - DNA, 25 bp, Mus musculus
gccgctgtcatggacgcctgggtcc

SEQ ID NO: 437103 - DNA, 25 bp, Mus musculus
ggaaatgcacccacgatctcgcttc

SEQ ID NO: 437104 - DNA, 25 bp, Mus musculus
ttcggcacagccgtagccgagttgg

SEQ ID NO: 437105 - DNA, 25 bp, Mus musculus
agactgcgggctttttgcctctgca

SEQ ID NO: 437106 - DNA, 25 bp, Mus musculus
aggctgcgagcatccctcttggatt

SEQ ID NO: 437107 - DNA, 25 bp, Mus musculus
ctcttggattcggtaggtaactaca

SEQ ID NO: 437108 - DNA, 25 bp, Mus musculus
aagggcggaacttgagagccagcca

SEQ ID NO: 437109 - DNA, 25 bp, Mus musculus
gccagccagggtggccgcaaaagac

SEQ ID NO: 437110 - DNA, 25 bp, Mus musculus
gccgcaaaagactgcgggctttttg

SEQ ID NO: 437111 - DNA, 25 bp, Mus musculus
ttttgcctctgcagggacggggtta

SEQ ID NO: 437112 - DNA, 25 bp, Mus musculus
ggttttaagcccagccttcagttga

SEQ ID NO: 437113 - DNA, 25 bp, Mus musculus
agcccagccttcagttgaacgtcta

SEQ ID NO: 437114 - DNA, 25 bp, Mus musculus
ttcagttgaacgtctacgattgagc

SEQ ID NO: 437115 - DNA, 25 bp, Mus musculus
ggcgggacccagtctgctttttgac

SEQ ID NO: 437116 - DNA, 25 bp, Mus musculus
ttgacagctgtctttcggcacagcc

SEQ ID NO: 437117 - DNA, 25 bp, Mus musculus
gtctgctttttgacagctgtctttc

SEQ ID NO: 437118 - DNA, 25 bp, Mus musculus
cctgtaaggccacattcggttgcga

SEQ ID NO: 437119 - DNA, 25 bp, Mus musculus
acggtgctgattggactgcaagctc

SEQ ID NO: 437120 - DNA, 25 bp, Mus musculus
tgagccttttagtcttcatacagtg

SEQ ID NO: 437121 - DNA, 25 bp, Mus musculus
aacgtagtcctagccagtctctgag

SEQ ID NO: 437122 - DNA, 25 bp, Mus musculus
agctcgcccggaaccacagtatgga

SEQ ID NO: 437123 - DNA, 25 bp, Mus musculus
agttcgcgcgtcatcagagcatcca

SEQ ID NO: 437124 - DNA, 25 bp, Mus musculus
agaattcgaccttggcaccctaccg

SEQ ID NO: 437125 - DNA, 25 bp, Mus musculus
tgcagcgcctcccagtgcacaaaga

SEQ ID NO: 437126 - DNA, 25 bp, Mus musculus
gtacgttctgaagtatgctgcaccg

SEQ ID NO: 437127 - DNA, 25 bp, Mus musculus
ttccggattaagagtccagaggtcc

SEQ ID NO: 437128 - DNA, 25 bp, Mus musculus
acacattgctaaccggctccacgta

SEQ ID NO: 437129 - DNA, 25 bp, Mus musculus
gggccggcctctaagcacatcagct

SEQ ID NO: 437130 - DNA, 25 bp, Mus musculus
agtgaaccctcagcgcctgtaaggc

SEQ ID NO: 437131 - DNA, 25 bp, Mus musculus
cgcgtggccaagaacgagctaaaac

SEQ ID NO: 437132 - DNA, 25 bp, Mus musculus
gccaggagctcaaagtcgtgctgga

SEQ ID NO: 437133 - DNA, 25 bp, Mus musculus
gaagaagtggccgagctgagagctc

SEQ ID NO: 437134 - DNA, 25 bp, Mus musculus
gccagcacgagaagacgcgaggctc

SEQ ID NO: 437135 - DNA, 25 bp, Mus musculus
tcgctggtggcccaggcacaggctt

SEQ ID NO: 437136 - DNA, 25 bp, Mus musculus
cttggggccaggagctcaaagtcgt

SEQ ID NO: 437137 - DNA, 25 bp, Mus musculus
agtcgtgctggagaagtacaacaca

SEQ ID NO: 437138 - DNA, 25 bp, Mus musculus
ggagaagtacaacacagcctgtcgg

SEQ ID NO: 437139 - DNA, 25 bp, Mus musculus
aacacagcctgtcgggaaatgactc

SEQ ID NO: 437140 - DNA, 25 bp, Mus musculus
agcctgtcgggaaatgactcgattg

SEQ ID NO: 437141 - DNA, 25 bp, Mus musculus
cgggaaatgactcgattgcgggaca

SEQ ID NO: 437142 - DNA, 25 bp, Mus musculus
acactgtggcggaggaacgtcgccg

SEQ ID NO: 437143 - DNA, 25 bp, Mus musculus
aacgtcgccgcagcgaggacctggc

SEQ ID NO: 437144 - DNA, 25 bp, Mus musculus
aatgactcgattgcgggacactgtg

SEQ ID NO: 437145 - DNA, 25 bp, Mus musculus
cagcctgcgccagcacgagaagacg

SEQ ID NO: 437146 - DNA, 25 bp, Mus musculus
gctaactaaacttgcggcggagatc

SEQ ID NO: 437147 - DNA, 25 bp, Mus musculus
gactgaactccagccgtgcagcaga

SEQ ID NO: 437148 - DNA, 25 bp, Mus musculus
ttggctgcctaaaagcccatccctt

SEQ ID NO: 437149 - DNA, 25 bp, Mus musculus
ggcagttccggatactttccctcca

SEQ ID NO: 437150 - DNA, 25 bp, Mus musculus
ggcgcctgcgatgtctcaagatggc

SEQ ID NO: 437151 - DNA, 25 bp, Mus musculus
tctgggatttcgctaactaaacttg

SEQ ID NO: 437152 - DNA, 25 bp, Mus musculus
caggagagcatcactttcagagttg

SEQ ID NO: 437153 - DNA, 25 bp, Mus musculus
agccgtctccaacagttcgcaagtc

SEQ ID NO: 437154 - DNA, 25 bp, Mus musculus
gtgaagaattcggaacagccgtctc

SEQ ID NO: 437155 - DNA, 25 bp, Mus musculus
ggcgctagcaggacctaagcttgta

SEQ ID NO: 437156 - DNA, 25 bp, Mus musculus
agccttgagtcgtatggcgctagca

SEQ ID NO: 437157 - DNA, 25 bp, Mus musculus
aactttgttgcctgtcaagccttga

SEQ ID NO: 437158 - DNA, 25 bp, Mus musculus
ctgctttccgcacccaactttgttg

SEQ ID NO: 437159 - DNA, 25 bp, Mus musculus
aactctgcgggtaagtcctgctttc

SEQ ID NO: 437160 - DNA, 25 bp, Mus musculus
gtgaagctcactgactccaggcgcc

SEQ ID NO: 437161 - DNA, 25 bp, Mus musculus
gattgctagagaggacaagctgtcc

SEQ ID NO: 437162 - DNA, 25 bp, Mus musculus
gacaagctgtcctcgctccaagctg

SEQ ID NO: 437163 - DNA, 25 bp, Mus musculus
gctgtcctcgctccaagctgcaatg

SEQ ID NO: 437164 - DNA, 25 bp, Mus musculus
ctcgctccaagctgcaatgcgtgtg

SEQ ID NO: 437165 - DNA, 25 bp, Mus musculus
agctgcaatgcgtgtgccacggccc

SEQ ID NO: 437166 - DNA, 25 bp, Mus musculus
aatgcgtgtgccacggcccgggtct

SEQ ID NO: 437167 - DNA, 25 bp, Mus musculus
acacgctctgtgtgaagctcactga

SEQ ID NO: 437168 - DNA, 25 bp, Mus musculus
ccagctcgcggaggcgtgcagcttc

SEQ ID NO: 437169 - DNA, 25 bp, Mus musculus
ccggcgaggcgcaacagcaaccgtg

SEQ ID NO: 437170 - DNA, 25 bp, Mus musculus
aacagcaaccgtgcggcagccatcg

SEQ ID NO: 437171 - DNA, 25 bp, Mus musculus
tgcggcagccatcgcgcagctctgg

SEQ ID NO: 437172 - DNA, 25 bp, Mus musculus
gcagctctggtcaccgcgcagctct

SEQ ID NO: 437173 - DNA, 25 bp, Mus musculus
cacccaggagtccacacacgctctg

SEQ ID NO: 437174 - DNA, 25 bp, Mus musculus
ggacgctctttctctcctctcgttg

SEQ ID NO: 437175 - DNA, 25 bp, Mus musculus
acaccggtgttctcggtacctgctg

SEQ ID NO: 437176 - DNA, 25 bp, Mus musculus
acccgtgattcccttgacaccggtg

SEQ ID NO: 437177 - DNA, 25 bp, Mus musculus
gcactggtcgcaaaccctgggcatc

SEQ ID NO: 437178 - DNA, 25 bp, Mus musculus
ttaggctgcccgcacacccgtgatt

SEQ ID NO: 437179 - DNA, 25 bp, Mus musculus
gctggaaaccgggtcttaggctgcc

SEQ ID NO: 437180 - DNA, 25 bp, Mus musculus
tccttggctcctagggctggaaacc

SEQ ID NO: 437181 - DNA, 25 bp, Mus musculus
tcaatcccaaactaccggtaagagc

SEQ ID NO: 437182 - DNA, 25 bp, Mus musculus
gccacttttgtaagggcgaggtcaa

SEQ ID NO: 437183 - DNA, 25 bp, Mus musculus
ttcggacatcctcggcggaggcgaa

SEQ ID NO: 437184 - DNA, 25 bp, Mus musculus
ggactcacgtgacccttgcgggcct

SEQ ID NO: 437185 - DNA, 25 bp, Mus musculus
ctctcctctgcctttggtgccggga

SEQ ID NO: 437186 - DNA, 25 bp, Mus musculus
tctctcctctcgttgggaggctgga

SEQ ID NO: 437187 - DNA, 25 bp, Mus musculus
acgggccgctctagccgacagtgtc

SEQ ID NO: 437188 - DNA, 25 bp, Mus musculus
ccgcgacccgcaaagagtgaacagc

SEQ ID NO: 437189 - DNA, 25 bp, Mus musculus
cgcacgctaggtgagtgacagcacc

SEQ ID NO: 437190 - DNA, 25 bp, Mus musculus
ccagagaacgaaagatgaggtgtca

SEQ ID NO: 437191 - DNA, 25 bp, Mus musculus
aaagctcagacttggacctcgcgga

SEQ ID NO: 437192 - DNA, 25 bp, Mus musculus
ggacctcgcggaggcaaacgtgtca

SEQ ID NO: 437193 - DNA, 25 bp, Mus musculus
tgtcagcacccggatcctgcaaagc

SEQ ID NO: 437194 - DNA, 25 bp, Mus musculus
gtcctcagccctggtaggcacgctg

SEQ ID NO: 437195 - DNA, 25 bp, Mus musculus
gcgggctgagcaaatccaggttctc

SEQ ID NO: 437196 - DNA, 25 bp, Mus musculus
cacctgggaggtgatcatgatgctg

SEQ ID NO: 437197 - DNA, 25 bp, Mus musculus
atgctggagtcgatcaggaagctca

SEQ ID NO: 437198 - DNA, 25 bp, Mus musculus
atcaggaagctcatggcgaagcctc

SEQ ID NO: 437199 - DNA, 25 bp, Mus musculus
gaagccgcggcttaagacctgtcca

SEQ ID NO: 437200 - DNA, 25 bp, Mus musculus
ctggcgcgtgcttacgtcatcaaga

SEQ ID NO: 437201 - DNA, 25 bp, Mus musculus
taagacctgtccacctgctgtggta

SEQ ID NO: 437202 - DNA, 25 bp, Mus musculus
tcggacgaagtctcaggactcactt

SEQ ID NO: 437203 - DNA, 25 bp, Mus musculus
cgcgcatagcattgtggaagttgta

SEQ ID NO: 437204 - DNA, 25 bp, Mus musculus
gttcttggggacacactttagcgtc

SEQ ID NO: 437205 - DNA, 25 bp, Mus musculus
ccgcaacctactggagctgaaaatg

SEQ ID NO: 437206 - DNA, 25 bp, Mus musculus
tcctgacctcgctggcttactgctt

SEQ ID NO: 437207 - DNA, 25 bp, Mus musculus
agcctccatcatgcgcgtgtgggtc

SEQ ID NO: 437208 - DNA, 25 bp, Mus musculus
ttcccgcgaacttctgagtagctgc

SEQ ID NO: 437209 - DNA, 25 bp, Mus musculus
ccgctagagtcgcttgttctgagag

SEQ ID NO: 437210 - DNA, 25 bp, Mus musculus
gccggcagacgctaggcttaaacta

SEQ ID NO: 437211 - DNA, 25 bp, Mus musculus
taactgccctgactgagcctgcatg

SEQ ID NO: 437212 - DNA, 25 bp, Mus musculus
tcacacggtttgaagtgcaagtttc

SEQ ID NO: 437213 - DNA, 25 bp, Mus musculus
ggtgtccgaggaacttctgcttttg

SEQ ID NO: 437214 - DNA, 25 bp, Mus musculus
tgctcctgtgcgcagacttaattgg

SEQ ID NO: 437215 - DNA, 25 bp, Mus musculus
tctgagagcttggatgcacttgccc

SEQ ID NO: 437216 - DNA, 25 bp, Mus musculus
aaggcgatcgatggtaccagcccgc

SEQ ID NO: 437217 - DNA, 25 bp, Mus musculus
cccgaaggcgatcgatggtaccagc

SEQ ID NO: 437218 - DNA, 25 bp, Mus musculus
ccgaaggcgatcgatggtaccagcc

SEQ ID NO: 437219 - DNA, 25 bp, Mus musculus
gaaggcgatcgatggtaccagcccg

SEQ ID NO: 437220 - DNA, 25 bp, Mus musculus
ggcgatcgatggtaccagcccgccg

SEQ ID NO: 437221 - DNA, 25 bp, Mus musculus
aggcgatcgatggtaccagcccgcc

SEQ ID NO: 437222 - DNA, 25 bp, Mus musculus
caccgccttctgctttgcatgaccc

SEQ ID NO: 437223 - DNA, 25 bp, Mus musculus
ggcaccgccttctgctttgcatgac

SEQ ID NO: 437224 - DNA, 25 bp, Mus musculus
cggcaccgccttctgctttgcatga

SEQ ID NO: 437225 - DNA, 25 bp, Mus musculus
acggcaccgccttctgctttgcatg

SEQ ID NO: 437226 - DNA, 25 bp, Mus musculus
gacggcaccgccttctgctttgcat

SEQ ID NO: 437227 - DNA, 25 bp, Mus musculus
cctggctcaagagaagccgcccgcg

SEQ ID NO: 437228 - DNA, 25 bp, Mus musculus
gatcgatggtaccagcccgccgcgg

SEQ ID NO: 437229 - DNA, 25 bp, Mus musculus
cgaaggcgatcgatggtaccagccc

SEQ ID NO: 437230 - DNA, 25 bp, Mus musculus
gtctacacaggatgcgcgctctgtc

SEQ ID NO: 437231 - DNA, 25 bp, Mus musculus
gcgcattgacgtcagcagccgaacg

SEQ ID NO: 437232 - DNA, 25 bp, Mus musculus
ggcgtctgcgcctttaaggttgcca

SEQ ID NO: 437233 - DNA, 25 bp, Mus musculus
gttctagctagatgacgacgggcta

SEQ ID NO: 437234 - DNA, 25 bp, Mus musculus
ggtgccctgcaagagaacggttcta

SEQ ID NO: 437235 - DNA, 25 bp, Mus musculus
ggggctacgtatacgcgacaagata

SEQ ID NO: 437236 - DNA, 25 bp, Mus musculus
agaggctgagatctccgaacagcta

SEQ ID NO: 437237 - DNA, 25 bp, Mus musculus
gacgcaagagccaccgaggaaccga

SEQ ID NO: 437238 - DNA, 25 bp, Mus musculus
ctgtcaccgaatcgtcccacgtggg

SEQ ID NO: 437239 - DNA, 25 bp, Mus musculus
tcccatagcacccagggcggagtcg

SEQ ID NO: 437240 - DNA, 25 bp, Mus musculus
tcttccaacagcagggatctccttg

SEQ ID NO: 437241 - DNA, 25 bp, Mus musculus
gcgctcagctgtggtagatccgcta

SEQ ID NO: 437242 - DNA, 25 bp, Mus musculus
tgtccatcaggagcatctcagcatc

SEQ ID NO: 437243 - DNA, 25 bp, Mus musculus
agccgctatcgcagagtggtagtga

SEQ ID NO: 437244 - DNA, 25 bp, Mus musculus
aggaagcgcggcaagccgctcgcca

SEQ ID NO: 437245 - DNA, 25 bp, Mus musculus
ttccttagcacgcaggtgcggaaga

SEQ ID NO: 437246 - DNA, 25 bp, Mus musculus
cacgcttccttagcacgcaggtgcg

SEQ ID NO: 437247 - DNA, 25 bp, Mus musculus
ggagtacaacgcaccgccgccagag

SEQ ID NO: 437248 - DNA, 25 bp, Mus musculus
tcgctcccgcgcgtgcggagtacaa

SEQ ID NO: 437249 - DNA, 25 bp, Mus musculus
agccgctcgccatcccgagaggccc

SEQ ID NO: 437250 - DNA, 25 bp, Mus musculus
tcctgcacccgcgtccgaagcggct

SEQ ID NO: 437251 - DNA, 25 bp, Mus musculus
actgctgtaagtccggttcctgcac

SEQ ID NO: 437252 - DNA, 25 bp, Mus musculus
cccactgctgtaagtccggttcctg

SEQ ID NO: 437253 - DNA, 25 bp, Mus musculus
ccagtcggcagggaaacgcagactg

SEQ ID NO: 437254 - DNA, 25 bp, Mus musculus
tgcgcatgcccagtcggcagggaaa

SEQ ID NO: 437255 - DNA, 25 bp, Mus musculus
gcaggtgcggaagactctggtctaa

SEQ ID NO: 437256 - DNA, 25 bp, Mus musculus
cgcaacaagtgagtgcgcatgccca

SEQ ID NO: 437257 - DNA, 25 bp, Mus musculus
actctggtctaagtgtgcgtctgcg

SEQ ID NO: 437258 - DNA, 25 bp, Mus musculus
cacccaccacagaggcggtgctggt

SEQ ID NO: 437259 - DNA, 25 bp, Mus musculus
cccgggaaaggagcacaagatcatg

SEQ ID NO: 437260 - DNA, 25 bp, Mus musculus
agccaaagctgctcgagctgagggc

SEQ ID NO: 437261 - DNA, 25 bp, Mus musculus
gagcgccacggagccaaagctgctc

SEQ ID NO: 437262 - DNA, 25 bp, Mus musculus
atgggaaacactaccagcgagcggg

SEQ ID NO: 437263 - DNA, 25 bp, Mus musculus
gtcgcgggccttgtagccattttag

SEQ ID NO: 437264 - DNA, 25 bp, Mus musculus
ttcagcctgcccgactccaaggtga

SEQ ID NO: 437265 - DNA, 25 bp, Mus musculus
tgcccgactccaaggtgaggtagcg

SEQ ID NO: 437266 - DNA, 25 bp, Mus musculus
ttctccgagccgaggcgtccgtgaa

SEQ ID NO: 437267 - DNA, 25 bp, Mus musculus
gaacagccggcgtgcgtgtagccac

SEQ ID NO: 437268 - DNA, 25 bp, Mus musculus
agcacaagatcatggtggggagcac

SEQ ID NO: 437269 - DNA, 25 bp, Mus musculus
ttggtctccttgtacgccgaacagc

SEQ ID NO: 437270 - DNA, 25 bp, Mus musculus
tggggcgcggcttcaatttcaataa

SEQ ID NO: 437271 - DNA, 25 bp, Mus musculus
actcgagctgcagccatgggaaaca

SEQ ID NO: 437272 - DNA, 25 bp, Mus musculus
tccctggtgcccatcgactggagca

SEQ ID NO: 437273 - DNA, 25 bp, Mus musculus
acgctctggacaccgagcttcactt

SEQ ID NO: 437274 - DNA, 25 bp, Mus musculus
gcgtccaggacaaacgctctggaca

SEQ ID NO: 437275 - DNA, 25 bp, Mus musculus
gcatccgttcctttcgctgcaagcg

SEQ ID NO: 437276 - DNA, 25 bp, Mus musculus
gaaggtcctgcagcatccgttcctt

SEQ ID NO: 437277 - DNA, 25 bp, Mus musculus
tgttccgatcgctcagaaggtcctg

SEQ ID NO: 437278 - DNA, 25 bp, Mus musculus
ggcttgtttgttccgatcgctcaga

SEQ ID NO: 437279 - DNA, 25 bp, Mus musculus
tggtgcccatcgactggagcagccc

SEQ ID NO: 437280 - DNA, 25 bp, Mus musculus
cttacctgtctttcctgctccctgg

SEQ ID NO: 437281 - DNA, 25 bp, Mus musculus
ggttctgccctaccgcttacctgtc

SEQ ID NO: 437282 - DNA, 25 bp, Mus musculus
gtcgcaggctcctcatccggttctg

SEQ ID NO: 437283 - DNA, 25 bp, Mus musculus
acgagtgcgtcgcaggctcctcatc

SEQ ID NO: 437284 - DNA, 25 bp, Mus musculus
gtctgccggcctagagcgtcacttc

SEQ ID NO: 437285 - DNA, 25 bp, Mus musculus
gtgctccacggcttgtttgttccga

SEQ ID NO: 437286 - DNA, 25 bp, Mus musculus
cggatcacgtgagcgctgcgaccac

SEQ ID NO: 437287 - DNA, 25 bp, Mus musculus
tgcaggttgtacagacgcaccatcc

SEQ ID NO: 437288 - DNA, 25 bp, Mus musculus
caagcttagagagctgctccggatc

SEQ ID NO: 437289 - DNA, 25 bp, Mus musculus
gcaccgctccttaaagaggccgcgc

SEQ ID NO: 437290 - DNA, 25 bp, Mus musculus
ttcgctgtaggccatgcgcagcacc

SEQ ID NO: 437291 - DNA, 25 bp, Mus musculus
ggcggcttccgcaagcttagagagc

SEQ ID NO: 437292 - DNA, 25 bp, Mus musculus
cccaaacgggtgcaggttgtacaga

SEQ ID NO: 437293 - DNA, 25 bp, Mus musculus
ggactacctgctgcgacccaaacgg

SEQ ID NO: 437294 - DNA, 25 bp, Mus musculus
gctcccactggcaggggactacctg

SEQ ID NO: 437295 - DNA, 25 bp, Mus musculus
ttgcagccggcagccacgaacagcg

SEQ ID NO: 437296 - DNA, 25 bp, Mus musculus
agcgaacgcctccaccttgcagccg

SEQ ID NO: 437297 - DNA, 25 bp, Mus musculus
agctcttcgccctgaacagcgaacg

SEQ ID NO: 437298 - DNA, 25 bp, Mus musculus
aaggcgcagcgctgccggcacagct

SEQ ID NO: 437299 - DNA, 25 bp, Mus musculus
ctgctccggatcacgtgagcgctgc

SEQ ID NO: 437300 - DNA, 25 bp, Mus musculus
tagcccggtaaagcggactttgctc

SEQ ID NO: 437301 - DNA, 25 bp, Mus musculus
ggacagtaaagtcggctcagagctg

SEQ ID NO: 437302 - DNA, 25 bp, Mus musculus
ctgctagcccggtaaagcggacttt

SEQ ID NO: 437303 - DNA, 25 bp, Mus musculus
cgcaaagcccgggagatgaagcatc

SEQ ID NO: 437304 - DNA, 25 bp, Mus musculus
gcccgggagatgaagcatcagattt

SEQ ID NO: 437305 - DNA, 25 bp, Mus musculus
gaagcatcagatttcaagatggcgc

SEQ ID NO: 437306 - DNA, 25 bp, Mus musculus
cgggataggcggtctccccaagcct

SEQ ID NO: 437307 - DNA, 25 bp, Mus musculus
cccaagcctcctctgggagatgtag

SEQ ID NO: 437308 - DNA, 25 bp, Mus musculus
atgcgggctggcgagtacctcccct

SEQ ID NO: 437309 - DNA, 25 bp, Mus musculus
ggcagtctaggctctgggacagtaa

SEQ ID NO: 437310 - DNA, 25 bp, Mus musculus
attctcgcctgctagcccggtaaag

SEQ ID NO: 437311 - DNA, 25 bp, Mus musculus
gctctgggacagtaaagtcggctca

SEQ ID NO: 437312 - DNA, 25 bp, Mus musculus
ctcgcctccaatccattctcgcctg

SEQ ID NO: 437313 - DNA, 25 bp, Mus musculus
tcggctcagagctgacgcaaagccc

SEQ ID NO: 437314 - DNA, 25 bp, Mus musculus
tacaaggcagggactgttctcggga

SEQ ID NO: 437315 - DNA, 25 bp, Mus musculus
ctgagctgtcaaccgcgagggagca

SEQ ID NO: 437316 - DNA, 25 bp, Mus musculus
gctgatccgcaccagctgagctgtc

SEQ ID NO: 437317 - DNA, 25 bp, Mus musculus
tggcacgagctgatccgcaccagct

SEQ ID NO: 437318 - DNA, 25 bp, Mus musculus
acgctcccaggctgagacgcgactg

SEQ ID NO: 437319 - DNA, 25 bp, Mus musculus
ctaacggtgctctgggtacaaggca

SEQ ID NO: 437320 - DNA, 25 bp, Mus musculus
cgcaccctaagctaacggtgctctg

SEQ ID NO: 437321 - DNA, 25 bp, Mus musculus
gagcgagtcgatcggcctcagccgc

SEQ ID NO: 437322 - DNA, 25 bp, Mus musculus
tttttgaagagagcgagtcgatcgg

SEQ ID NO: 437323 - DNA, 25 bp, Mus musculus
cgggtgaaggaacaaggtccgctct

SEQ ID NO: 437324 - DNA, 25 bp, Mus musculus
agtctccagcgcaaaaagcccgagt

SEQ ID NO: 437325 - DNA, 25 bp, Mus musculus
ccaggagtctccagcgcaaaaagcc

SEQ ID NO: 437326 - DNA, 25 bp, Mus musculus
tctcctcagtctcggggtgccggtc

SEQ ID NO: 437327 - DNA, 25 bp, Mus musculus
acgcgactggctggcacgagctgat

SEQ ID NO: 437328 - DNA, 25 bp, Mus musculus
gcgaggctgtctgccaactgctccg

SEQ ID NO: 437329 - DNA, 25 bp, Mus musculus
cagatgctggccacgtcttacctca

SEQ ID NO: 437330 - DNA, 25 bp, Mus musculus
tggccacgtcttacctcatccaggg

SEQ ID NO: 437331 - DNA, 25 bp, Mus musculus
ttacctcatccagggtgccgccgag

SEQ ID NO: 437332 - DNA, 25 bp, Mus musculus
acccgctgtccgtgcgcttcatggt

SEQ ID NO: 437333 - DNA, 25 bp, Mus musculus
cgtgcgcttcatggttccgaggcct

SEQ ID NO: 437334 - DNA, 25 bp, Mus musculus
gggcactgtgcccttgctatgatct

SEQ ID NO: 437335 - DNA, 25 bp, Mus musculus
cttgctatgatctctgcgtggtttc

SEQ ID NO: 437336 - DNA, 25 bp, Mus musculus
ctctgcgtggtttcttttggtttca

SEQ ID NO: 437337 - DNA, 25 bp, Mus musculus
ttcttttggtttcaccggctgccca

SEQ ID NO: 437338 - DNA, 25 bp, Mus musculus
cgcatcctcccagcgtggaagagca

SEQ ID NO: 437339 - DNA, 25 bp, Mus musculus
cgtggaagagcatccaacccagatg

SEQ ID NO: 437340 - DNA, 25 bp, Mus musculus
caggttctgcctcccgcgaggctgt

SEQ ID NO: 437341 - DNA, 25 bp, Mus musculus
caacccagatgctgcggctgtggct

SEQ ID NO: 437342 - DNA, 25 bp, Mus musculus
tcggaggaatgactgcggaactaaa

SEQ ID NO: 437343 - DNA, 25 bp, Mus musculus
actgaggcggcctggtctccgtagc

SEQ ID NO: 437344 - DNA, 25 bp, Mus musculus
tctcgagagctcttttaccgtttgc

SEQ ID NO: 437345 - DNA, 25 bp, Mus musculus
tgagaccctagcgacctcacagact

SEQ ID NO: 437346 - DNA, 25 bp, Mus musculus
ctgctcccggctagtgagaccctag

SEQ ID NO: 437347 - DNA, 25 bp, Mus musculus
tgctgctgacgatgatcgcccgtgt

SEQ ID NO: 437348 - DNA, 25 bp, Mus musculus
tctccgtagccagggaagatggtgc

SEQ ID NO: 437349 - DNA, 25 bp, Mus musculus
acctcagccggaggtgtaactggcc

SEQ ID NO: 437350 - DNA, 25 bp, Mus musculus
cagcggctagctgttggggacctca

SEQ ID NO: 437351 - DNA, 25 bp, Mus musculus
ccacctcagcgggaagcggagacgc

SEQ ID NO: 437352 - DNA, 25 bp, Mus musculus
tctgaagtcgtttccggccacctca

SEQ ID NO: 437353 - DNA, 25 bp, Mus musculus
accggtagtggaaagctctgaagtc

SEQ ID NO: 437354 - DNA, 25 bp, Mus musculus
ggttctcggtgggaagccaattgaa

SEQ ID NO: 437355 - DNA, 25 bp, Mus musculus
aagccaattgaaaggaccggtagtg

SEQ ID NO: 437356 - DNA, 25 bp, Mus musculus
ctctctgtctctgcgctacggggac

SEQ ID NO: 437357 - DNA, 25 bp, Mus musculus
gcttgcggcgttcccagcttttgac

SEQ ID NO: 437358 - DNA, 25 bp, Mus musculus
tagagcacgcgagagccgggctcct

SEQ ID NO: 437359 - DNA, 25 bp, Mus musculus
ggggtgctgctcactcagatccctc

SEQ ID NO: 437360 - DNA, 25 bp, Mus musculus
cccagcttttgacacccggatcggt

SEQ ID NO: 437361 - DNA, 25 bp, Mus musculus
ctcgagtcttggcaacgcgtagcgt

SEQ ID NO: 437362 - DNA, 25 bp, Mus musculus
aaactgcctcgtccgggcctcgagt

SEQ ID NO: 437363 - DNA, 25 bp, Mus musculus
tacggggactgcgtcttccaaactg

SEQ ID NO: 437364 - DNA, 25 bp, Mus musculus
cccatgcggatctgctctggctgcg

SEQ ID NO: 437365 - DNA, 25 bp, Mus musculus
cgggagctccaggactcagcgagcc

SEQ ID NO: 437366 - DNA, 25 bp, Mus musculus
tttcagccaaacttcgggcggcggc

SEQ ID NO: 437367 - DNA, 25 bp, Mus musculus
gcgcggcgcagccagaaactttcag

SEQ ID NO: 437368 - DNA, 25 bp, Mus musculus
agaggaccggcgcttctttctgcgg

SEQ ID NO: 437369 - DNA, 25 bp, Mus musculus
tgacacccggatcggtcggtttgtc

SEQ ID NO: 437370 - DNA, 25 bp, Mus musculus
tcctggctggccaggagccagtctt

SEQ ID NO: 437371 - DNA, 25 bp, Mus musculus
ttgtgcgaggctgtgccaaggtctc

SEQ ID NO: 437372 - DNA, 25 bp, Mus musculus
tcctccggtaataccgcagcgcctc

SEQ ID NO: 437373 - DNA, 25 bp, Mus musculus
ctggctggccaggagccagtcttcg

SEQ ID NO: 437374 - DNA, 25 bp, Mus musculus
agaggcggatcctccaggacttggt

SEQ ID NO: 437375 - DNA, 25 bp, Mus musculus
ggcggatcctccaggacttggtaga

SEQ ID NO: 437376 - DNA, 25 bp, Mus musculus
cctccaggacttggtagagcgagtg

SEQ ID NO: 437377 - DNA, 25 bp, Mus musculus
gcgaagagggcctgcagcttagagc

SEQ ID NO: 437378 - DNA, 25 bp, Mus musculus
gctgggatgctcaacccggggcaaa

SEQ ID NO: 437379 - DNA, 25 bp, Mus musculus
tgggatgctcaacccggggcaaagc

SEQ ID NO: 437380 - DNA, 25 bp, Mus musculus
ggggcaaagctcctgaaaagttgtg

SEQ ID NO: 437381 - DNA, 25 bp, Mus musculus
gcaaagctcctgaaaagttgtgcga

SEQ ID NO: 437382 - DNA, 25 bp, Mus musculus
ccagtcttcgggtcccaggagaggc

SEQ ID NO: 437383 - DNA, 25 bp, Mus musculus
ctgaaaagttgtgcgaggctgtgcc

SEQ ID NO: 437384 - DNA, 25 bp, Mus musculus
tggcaggaagtctcggtgaactaca

SEQ ID NO: 437385 - DNA, 25 bp, Mus musculus
ctgcccggcgcatcacaggtaggag

SEQ ID NO: 437386 - DNA, 25 bp, Mus musculus
ctgcaggatcgcgactctaccaagc

SEQ ID NO: 437387 - DNA, 25 bp, Mus musculus
cgactctaccaagcggcggcgggtc

SEQ ID NO: 437388 - DNA, 25 bp, Mus musculus
gtcggccatcggctccgagctacta

SEQ ID NO: 437389 - DNA, 25 bp, Mus musculus
tactacagcccgacagggtcctctc

SEQ ID NO: 437390 - DNA, 25 bp, Mus musculus
tccagtcctggggtctgagtagagc

SEQ ID NO: 437391 - DNA, 25 bp, Mus musculus
tgaactacaaatcgaggcatgctgg

SEQ ID NO: 437392 - DNA, 25 bp, Mus musculus
ggcatgctgggaacattccctgctc

SEQ ID NO: 437393 - DNA, 25 bp, Mus musculus
tgctcctcccaggaaatgtcctttg

SEQ ID NO: 437394 - DNA, 25 bp, Mus musculus
ccaggaaatgtcctttgtccagccc

SEQ ID NO: 437395 - DNA, 25 bp, Mus musculus
gttgcatagcctcagcaccgggcgc

SEQ ID NO: 437396 - DNA, 25 bp, Mus musculus
ggaagtctcggtgaactacaaatcg

SEQ ID NO: 437397 - DNA, 25 bp, Mus musculus
agcccgcggttgcatagcctcagca

SEQ ID NO: 437398 - DNA, 25 bp, Mus musculus
gcgagaagccctacatgtgctccga

SEQ ID NO: 437399 - DNA, 25 bp, Mus musculus
gagtgcggcgaagccttcagcctca

SEQ ID NO: 437400 - DNA, 25 bp, Mus musculus
ttcagcgtgagctcgcacctcttca

SEQ ID NO: 437401 - DNA, 25 bp, Mus musculus
agaagccctacacatgtctcgagtg

SEQ ID NO: 437402 - DNA, 25 bp, Mus musculus
agcttggagcccttcggtttggccg

SEQ ID NO: 437403 - DNA, 25 bp, Mus musculus
caagagcttcagctggcgcgccgac

SEQ ID NO: 437404 - DNA, 25 bp, Mus musculus
accatctgcccagactgcggggaga

SEQ ID NO: 437405 - DNA, 25 bp, Mus musculus
aagcgcttcagctggcgctcggacc

SEQ ID NO: 437406 - DNA, 25 bp, Mus musculus
cgctcggacctggtgaagcaccagc

SEQ ID NO: 437407 - DNA, 25 bp, Mus musculus
tggtgaagcaccagcgcgtgcacac

SEQ ID NO: 437408 - DNA, 25 bp, Mus musculus
cctacatgtgctccgagtgcggcga

SEQ ID NO: 437409 - DNA, 25 bp, Mus musculus
acaagcgcacgcactcgggcgagcg

SEQ ID NO: 437410 - DNA, 25 bp, Mus musculus
gcgagaagcgcttcagcgacttctc

SEQ ID NO: 437411 - DNA, 25 bp, Mus musculus
gcaaaggcttcagccgcaacaccta

SEQ ID NO: 437412 - DNA, 25 bp, Mus musculus
aacttagttgctctgcgatcgatcg

SEQ ID NO: 437413 - DNA, 25 bp, Mus musculus
ggtcttctgctttaggtctccgatc

SEQ ID NO: 437414 - DNA, 25 bp, Mus musculus
cgttctcttgcgcaccgttctgtta

SEQ ID NO: 437415 - DNA, 25 bp, Mus musculus
catctcctgaaagagtgtgacgtta

SEQ ID NO: 437416 - DNA, 25 bp, Mus musculus
agaccacagcgacgttgcacacatg

SEQ ID NO: 437417 - DNA, 25 bp, Mus musculus
tccgaggtccactagcctatgactg

SEQ ID NO: 437418 - DNA, 25 bp, Mus musculus
tgcttcctgtaaagagccctccaca

SEQ ID NO: 437419 - DNA, 25 bp, Mus musculus
ccaggtaacccgagccggtcttctg

SEQ ID NO: 437420 - DNA, 25 bp, Mus musculus
gcttcatccgggcacttcacaaagg

SEQ ID NO: 437421 - DNA, 25 bp, Mus musculus
ctcaagatggcgctgttctctgtgc

SEQ ID NO: 437422 - DNA, 25 bp, Mus musculus
ggcgcatgcgtagtaagcacaactc

SEQ ID NO: 437423 - DNA, 25 bp, Mus musculus
ctgcgctgcaaacttaggaaacatc

SEQ ID NO: 437424 - DNA, 25 bp, Mus musculus
aagaatcggtgctcggtgatcctta

SEQ ID NO: 437425 - DNA, 25 bp, Mus musculus
tactgagctactttggccagcggca

SEQ ID NO: 437426 - DNA, 25 bp, Mus musculus
agagtccagttaatctccgcacgga

SEQ ID NO: 437427 - DNA, 25 bp, Mus musculus
ctgaaacaaggtctagctctgccgc

SEQ ID NO: 437428 - DNA, 25 bp, Mus musculus
gccgcttggtccctaaagttgctag

SEQ ID NO: 437429 - DNA, 25 bp, Mus musculus
tttcccgtagcaaaatcgagaggtg

SEQ ID NO: 437430 - DNA, 25 bp, Mus musculus
tcccgggttctcagatcaatttgca

SEQ ID NO: 437431 - DNA, 25 bp, Mus musculus
cagccagcttattcggtcgtccaaa

SEQ ID NO: 437432 - DNA, 25 bp, Mus musculus
tagctcagcactatccgcgacgggg

SEQ ID NO: 437433 - DNA, 25 bp, Mus musculus
ggaagtctggcctcatccatcagtc

SEQ ID NO: 437434 - DNA, 25 bp, Mus musculus
gtagctcacactgcgggttcacaaa

SEQ ID NO: 437435 - DNA, 25 bp, Mus musculus
cccggagatgcagcgctctagctga

SEQ ID NO: 437436 - DNA, 25 bp, Mus musculus
ggtggtccgaatagcgagaatccta

SEQ ID NO: 437437 - DNA, 25 bp, Mus musculus
gcctcggaaagctaacgggaatctc

SEQ ID NO: 437438 - DNA, 25 bp, Mus musculus
tgacagctaaatctgcccggacgcg

SEQ ID NO: 437439 - DNA, 25 bp, Mus musculus
tccatcagtccgtgtagtcagtagc

SEQ ID NO: 437440 - DNA, 25 bp, Mus musculus
atgttttaccgtgcaaggcgtctcg

SEQ ID NO: 437441 - DNA, 25 bp, Mus musculus
accaatgcattgtcgcggctgacca

SEQ ID NO: 437442 - DNA, 25 bp, Mus musculus
ctattctagtgaaggtgcgcgcccg

SEQ ID NO: 437443 - DNA, 25 bp, Mus musculus
aggccaattgctctgcgctctattc

SEQ ID NO: 437444 - DNA, 25 bp, Mus musculus
gcgccatgtcctatacgttcacgag

SEQ ID NO: 437445 - DNA, 25 bp, Mus musculus
ctttatcaggctgtctgggaagatc

SEQ ID NO: 437446 - DNA, 25 bp, Mus musculus
gccgcactgcctttgaatcgcagca

SEQ ID NO: 437447 - DNA, 25 bp, Mus musculus
ccacgacgccttgaggagctttatc

SEQ ID NO: 437448 - DNA, 25 bp, Mus musculus
gcctggcggttctgatttggattcc

SEQ ID NO: 437449 - DNA, 25 bp, Mus musculus
caccggtttctcagactgttgcagg

SEQ ID NO: 437450 - DNA, 25 bp, Mus musculus
gccgatcgcagaacgtcaccggttt

SEQ ID NO: 437451 - DNA, 25 bp, Mus musculus
ctcttcctttggattgggccctggc

SEQ ID NO: 437452 - DNA, 25 bp, Mus musculus
gggcgctttataggtgcagtttgca

SEQ ID NO: 437453 - DNA, 25 bp, Mus musculus
tctcggactgcggaagaaccaggta

SEQ ID NO: 437454 - DNA, 25 bp, Mus musculus
taaaaagcggaaactgcgagactgg

SEQ ID NO: 437455 - DNA, 25 bp, Mus musculus
tgccagctcagtagcgcgggctaga

SEQ ID NO: 437456 - DNA, 25 bp, Mus musculus
cccgcgctagttcctagaggctggg

SEQ ID NO: 437457 - DNA, 25 bp, Mus musculus
gagacacagacgacccggcgacaca

SEQ ID NO: 437458 - DNA, 25 bp, Mus musculus
actcggagacacagacgacccggcg

SEQ ID NO: 437459 - DNA, 25 bp, Mus musculus
gacttgtccatggaggcgctgagtc

SEQ ID NO: 437460 - DNA, 25 bp, Mus musculus
gagaaggaacaccagccggtatccc

SEQ ID NO: 437461 - DNA, 25 bp, Mus musculus
cttgatcggctcaaataaaaagcgg

SEQ ID NO: 437462 - DNA, 25 bp, Mus musculus
gttgaagccttgatcggctcaaata

SEQ ID NO: 437463 - DNA, 25 bp, Mus musculus
gccttctccgttgaagccttgatcg

SEQ ID NO: 437464 - DNA, 25 bp, Mus musculus
ccgagcacatgccttctccgttgaa

SEQ ID NO: 437465 - DNA, 25 bp, Mus musculus
tgaacggagaagatctgcagtcgcc

SEQ ID NO: 437466 - DNA, 25 bp, Mus musculus
gcggctaaaatgagtgaacggagaa

SEQ ID NO: 437467 - DNA, 25 bp, Mus musculus
aagatctgcagtcgccctgagctcc

SEQ ID NO: 437468 - DNA, 25 bp, Mus musculus
tgaacaccactgtgcggggaaccgc

SEQ ID NO: 437469 - DNA, 25 bp, Mus musculus
agagtccagcccgtcctataaatcg

SEQ ID NO: 437470 - DNA, 25 bp, Mus musculus
cgcctgaattctgccacggatctga

SEQ ID NO: 437471 - DNA, 25 bp, Mus musculus
caagcaaagtgtacggatgtcatcc

SEQ ID NO: 437472 - DNA, 25 bp, Mus musculus
gcctccgcctctggcaagcaaagtg

SEQ ID NO: 437473 - DNA, 25 bp, Mus musculus
tggagaccggttcgcttcagcctcc

SEQ ID NO: 437474 - DNA, 25 bp, Mus musculus
gctgtcagatcgctgtcgccagtca

SEQ ID NO: 437475 - DNA, 25 bp, Mus musculus
tcccttaccttctaggcggaagtga

SEQ ID NO: 437476 - DNA, 25 bp, Mus musculus
ccgccacttccggtccgattggaag

SEQ ID NO: 437477 - DNA, 25 bp, Mus musculus
cgcgatccctaaagagccagcaaca

SEQ ID NO: 437478 - DNA, 25 bp, Mus musculus
tcggctcaccgtgaacaccactgtg

SEQ ID NO: 437479 - DNA, 25 bp, Mus musculus
tccctagtgcccttagcgcggagtc

SEQ ID NO: 437480 - DNA, 25 bp, Mus musculus
gcctctgggttctgcgatgcagacg

SEQ ID NO: 437481 - DNA, 25 bp, Mus musculus
agcagacagcgctgcctacgagacc

SEQ ID NO: 437482 - DNA, 25 bp, Mus musculus
aggctctgccgggactgaccctaag

SEQ ID NO: 437483 - DNA, 25 bp, Mus musculus
agacgcgcagcttcgatcatttggc

SEQ ID NO: 437484 - DNA, 25 bp, Mus musculus
cgcgctgggtgtccacagtcccaaa

SEQ ID NO: 437485 - DNA, 25 bp, Mus musculus
agggagaaggatctcagccgccatc

SEQ ID NO: 437486 - DNA, 25 bp, Mus musculus
tgcgccgccaaaaccgcggggttca

SEQ ID NO: 437487 - DNA, 25 bp, Mus musculus
accgactaggtgcagggaaagagcc

SEQ ID NO: 437488 - DNA, 25 bp, Mus musculus
gcagcaggaactcgcccaagtttgc

SEQ ID NO: 437489 - DNA, 25 bp, Mus musculus
caagtttgccaaagcccggccacgg

SEQ ID NO: 437490 - DNA, 25 bp, Mus musculus
tccttcacagaggaaagtttgcgtg

SEQ ID NO: 437491 - DNA, 25 bp, Mus musculus
tggggttgagggcacaattttcctc

SEQ ID NO: 437492 - DNA, 25 bp, Mus musculus
gggtcctgacacctgctggcatctc

SEQ ID NO: 437493 - DNA, 25 bp, Mus musculus
ggctcctcgggtcaatggttgccga

SEQ ID NO: 437494 - DNA, 25 bp, Mus musculus
ggttgccgagagacgagtaaacctc

SEQ ID NO: 437495 - DNA, 25 bp, Mus musculus
cgcaggcgcaatagagaggtgcttt

SEQ ID NO: 437496 - DNA, 25 bp, Mus musculus
gggcgacggcgtcccgaacactaca

SEQ ID NO: 437497 - DNA, 25 bp, Mus musculus
gtggctcgcacgctcgcgctgactg

SEQ ID NO: 437498 - DNA, 25 bp, Mus musculus
atcgggcgagccacaccgcagagaa

SEQ ID NO: 437499 - DNA, 25 bp, Mus musculus
gtcaggagcggaacttcctcctcag

SEQ ID NO: 437500 - DNA, 25 bp, Mus musculus
cacaccgcagagaagctgcaaggtg

SEQ ID NO: 437501 - DNA, 25 bp, Mus musculus
aagctgcaaggtgggttctgccatg

SEQ ID NO: 437502 - DNA, 25 bp, Mus musculus
cccggcgaagacgacgagttgcagt

SEQ ID NO: 437503 - DNA, 25 bp, Mus musculus
accaggcgcttggatcgcgaaagtg

SEQ ID NO: 437504 - DNA, 25 bp, Mus musculus
acgagttgcagtaggtcggttccac

SEQ ID NO: 437505 - DNA, 25 bp, Mus musculus
gcagtaggtcggttccactcggtcc

SEQ ID NO: 437506 - DNA, 25 bp, Mus musculus
gggcgtagcagcgacgaccctcagc

SEQ ID NO: 437507 - DNA, 25 bp, Mus musculus
tagcagcgacgaccctcagccgagg

SEQ ID NO: 437508 - DNA, 25 bp, Mus musculus
cgcgctctgtcaggagcggaacttc

SEQ ID NO: 437509 - DNA, 25 bp, Mus musculus
tcattcctcgcaccgcctgggagag

SEQ ID NO: 437510 - DNA, 25 bp, Mus musculus
gtcactctggaggacgacatggctc

SEQ ID NO: 437511 - DNA, 25 bp, Mus musculus
ctttcggacggtgattggattcttc

SEQ ID NO: 437512 - DNA, 25 bp, Mus musculus
gcaggagctcacattcgtgacgcca

SEQ ID NO: 437513 - DNA, 25 bp, Mus musculus
gtggccgctgattcgctatagcctc

SEQ ID NO: 437514 - DNA, 25 bp, Mus musculus
ccctcactctgggagagcccgagga

SEQ ID NO: 437515 - DNA, 25 bp, Mus musculus
attcttcggagaatcctggtctggg

SEQ ID NO: 437516 - DNA, 25 bp, Mus musculus
tgtggaccttgctgaacttattgga

SEQ ID NO: 437517 - DNA, 25 bp, Mus musculus
agcgcaggcttttcaacgatccaga

SEQ ID NO: 437518 - DNA, 25 bp, Mus musculus
cgcaccaatgggagaaccctatctg

SEQ ID NO: 437519 - DNA, 25 bp, Mus musculus
cgactgacagtaccacgcaccaatg

SEQ ID NO: 437520 - DNA, 25 bp, Mus musculus
tccagaatgcttcgggctacacctc

SEQ ID NO: 437521 - DNA, 25 bp, Mus musculus
cgagagcctgcctacaacttccaga

SEQ ID NO: 437522 - DNA, 25 bp, Mus musculus
tatagcctctgcaaccgagagcctg

SEQ ID NO: 437523 - DNA, 25 bp, Mus musculus
tagggcctcctaggcaaaccagaga

SEQ ID NO: 437524 - DNA, 25 bp, Mus musculus
aggcagaggtaacgcggagcctccc

SEQ ID NO: 437525 - DNA, 25 bp, Mus musculus
cgactcagggcgagcttgtctttgc

SEQ ID NO: 437526 - DNA, 25 bp, Mus musculus
actcagggcgagcttgtctttgcgc

SEQ ID NO: 437527 - DNA, 25 bp, Mus musculus
ctcagggcgagcttgtctttgcgcc

SEQ ID NO: 437528 - DNA, 25 bp, Mus musculus
cagggcgagcttgtctttgcgccta

SEQ ID NO: 437529 - DNA, 25 bp, Mus musculus
gggcgagcttgtctttgcgcctaga

SEQ ID NO: 437530 - DNA, 25 bp, Mus musculus
ggcgagcttgtctttgcgcctagac

SEQ ID NO: 437531 - DNA, 25 bp, Mus musculus
gcgagcttgtctttgcgcctagact

SEQ ID NO: 437532 - DNA, 25 bp, Mus musculus
cgagcttgtctttgcgcctagactc

SEQ ID NO: 437533 - DNA, 25 bp, Mus musculus
ttgcgcctagactcctagaggcaga

SEQ ID NO: 437534 - DNA, 25 bp, Mus musculus
tgcgcctagactcctagaggcagag

SEQ ID NO: 437535 - DNA, 25 bp, Mus musculus
gcgcctagactcctagaggcagagg

SEQ ID NO: 437536 - DNA, 25 bp, Mus musculus
ggagcctccccgctgcctggattgg

SEQ ID NO: 437537 - DNA, 25 bp, Mus musculus
gcgactcagggcgagcttgtctttg

SEQ ID NO: 437538 - DNA, 25 bp, Mus musculus
cttccaaggatgctgtctctccgca

SEQ ID NO: 437539 - DNA, 25 bp, Mus musculus
aacgcagagttgacaaagcaggggc

SEQ ID NO: 437540 - DNA, 25 bp, Mus musculus
agggcgatcactggagggagcgcaa

SEQ ID NO: 437541 - DNA, 25 bp, Mus musculus
agggagcgcaaaggagctctcgccc

SEQ ID NO: 437542 - DNA, 25 bp, Mus musculus
gcaaaggagctctcgccccctagga

SEQ ID NO: 437543 - DNA, 25 bp, Mus musculus
tctcgccccctaggaggaggctgga

SEQ ID NO: 437544 - DNA, 25 bp, Mus musculus
aggctggagagactgcgtagcccgg

SEQ ID NO: 437545 - DNA, 25 bp, Mus musculus
agactgcgtagcccggggcgtctct

SEQ ID NO: 437546 - DNA, 25 bp, Mus musculus
gggcgtctcttccaaggatgctgtc

SEQ ID NO: 437547 - DNA, 25 bp, Mus musculus
gtctcttccaaggatgctgtctctc

SEQ ID NO: 437548 - DNA, 25 bp, Mus musculus
caaggatgctgtctctccgcagctg

SEQ ID NO: 437549 - DNA, 25 bp, Mus musculus
ctgcaggcggcagggactcctgtgc

SEQ ID NO: 437550 - DNA, 25 bp, Mus musculus
gagggaacgcagagttgacaaagca

SEQ ID NO: 437551 - DNA, 25 bp, Mus musculus
aggatgctgtctctccgcagctgct

SEQ ID NO: 437552 - DNA, 25 bp, Mus musculus
cgtgctccggacacttaaccaggtc

SEQ ID NO: 437553 - DNA, 25 bp, Mus musculus
cgcggacgccggtctttaagaagca

SEQ ID NO: 437554 - DNA, 25 bp, Mus musculus
taaccaggtccataccgcagccagg

SEQ ID NO: 437555 - DNA, 25 bp, Mus musculus
gtccggcacacgtagaagctctttc

SEQ ID NO: 437556 - DNA, 25 bp, Mus musculus
agctctttcccttattcgggccatc

SEQ ID NO: 437557 - DNA, 25 bp, Mus musculus
cttattcgggccatcgcggacgccg

SEQ ID NO: 437558 - DNA, 25 bp, Mus musculus
gccggtctttaagaagcaggcgtcc

SEQ ID NO: 437559 - DNA, 25 bp, Mus musculus
ccctgaggaaacaagaaggtcagca

SEQ ID NO: 437560 - DNA, 25 bp, Mus musculus
gaaggtcagcatcggccactccaag

SEQ ID NO: 437561 - DNA, 25 bp, Mus musculus
tggcctgcacgaagccgcatgtgtt

SEQ ID NO: 437562 - DNA, 25 bp, Mus musculus
tgaggccttaccgtgctccggacac

SEQ ID NO: 437563 - DNA, 25 bp, Mus musculus
agactcactcggtggcctgcacgaa

SEQ ID NO: 437564 - DNA, 25 bp, Mus musculus
gggaaatcccgagactgaggcctta

SEQ ID NO: 437565 - DNA, 25 bp, Mus musculus
aagccgcatgtgttcgtccggcaca

SEQ ID NO: 437566 - DNA, 25 bp, Mus musculus
tacttggtctcgttgggactggaga

SEQ ID NO: 437567 - DNA, 25 bp, Mus musculus
gtacaggcccgcatcggagacctga

SEQ ID NO: 437568 - DNA, 25 bp, Mus musculus
tcggagacctgagtctggtacattc

SEQ ID NO: 437569 - DNA, 25 bp, Mus musculus
ctggtacattcggtatcggaactca

SEQ ID NO: 437570 - DNA, 25 bp, Mus musculus
tcggaactcatcctcctgaactttc

SEQ ID NO: 437571 - DNA, 25 bp, Mus musculus
acccgagacgcgtcggtccagttct

SEQ ID NO: 437572 - DNA, 25 bp, Mus musculus
gcgtcggtccagttctccagcttca

SEQ ID NO: 437573 - DNA, 25 bp, Mus musculus
tccagcttcaccacggagtcctggt

SEQ ID NO: 437574 - DNA, 25 bp, Mus musculus
ttcaccacggagtcctggtccaggg

SEQ ID NO: 437575 - DNA, 25 bp, Mus musculus
ccagggagataatgtacttggtctc

SEQ ID NO: 437576 - DNA, 25 bp, Mus musculus
cgacgggcttctcagccgtgatgag

SEQ ID NO: 437577 - DNA, 25 bp, Mus musculus
tcagccgtgatgagaactgagtatc

SEQ ID NO: 437578 - DNA, 25 bp, Mus musculus
cgtgatgagaactgagtatcgtggc

SEQ ID NO: 437579 - DNA, 25 bp, Mus musculus
cctggtccagggagataatgtactt

SEQ ID NO: 437580 - DNA, 25 bp, Mus musculus
gtagcgctgctcatagccagggcct

SEQ ID NO: 437581 - DNA, 25 bp, Mus musculus
gggccacggtgcagttcccaccgaa

SEQ ID NO: 437582 - DNA, 25 bp, Mus musculus
tgcctactgtgtccaggcgtacgtc

SEQ ID NO: 437583 - DNA, 25 bp, Mus musculus
aggcggtaggcatcgctgcctactg

SEQ ID NO: 437584 - DNA, 25 bp, Mus musculus
ggtgacgtggtagacgcgatacatc

SEQ ID NO: 437585 - DNA, 25 bp, Mus musculus
gtgcagttcccaccgaagtgccagg

SEQ ID NO: 437586 - DNA, 25 bp, Mus musculus
atgcttcggtgcaccgggccacggt

SEQ ID NO: 437587 - DNA, 25 bp, Mus musculus
ttagggctaggatgcttcggtgcac

SEQ ID NO: 437588 - DNA, 25 bp, Mus musculus
ctgccctcgtggcttagggctagga

SEQ ID NO: 437589 - DNA, 25 bp, Mus musculus
gtgaaacctgccctcgtggcttagg

SEQ ID NO: 437590 - DNA, 25 bp, Mus musculus
cagggcctgggtgaaacctgccctc

SEQ ID NO: 437591 - DNA, 25 bp, Mus musculus
cccactgtggtagcgctgctcatag

SEQ ID NO: 437592 - DNA, 25 bp, Mus musculus
ggcatcgctgcctactgtgtccagg

SEQ ID NO: 437593 - DNA, 25 bp, Mus musculus
ccgaagtgccaggtgtgtgtgcaac

SEQ ID NO: 437594 - DNA, 25 bp, Mus musculus
ggtgctagcaagctccacgaaactg

SEQ ID NO: 437595 - DNA, 25 bp, Mus musculus
gcaggggatcaccagctcagtgccc

SEQ ID NO: 437596 - DNA, 25 bp, Mus musculus
gacattgcaggggatcaccagctca

SEQ ID NO: 437597 - DNA, 25 bp, Mus musculus
tggggccgtcatagtcgctgacatt

SEQ ID NO: 437598 - DNA, 25 bp, Mus musculus
cgctcccggtacagctgtgccggga

SEQ ID NO: 437599 - DNA, 25 bp, Mus musculus
gagaagctccagtcgaagttctgct

SEQ ID NO: 437600 - DNA, 25 bp, Mus musculus
agacgagaagctccagtcgaagttc

SEQ ID NO: 437601 - DNA, 25 bp, Mus musculus
tcccaggtgctagcaagctccacga

SEQ ID NO: 437602 - DNA, 25 bp, Mus musculus
gctccacgaaactgctcccggaaga

SEQ ID NO: 437603 - DNA, 25 bp, Mus musculus
tcagtgcccaccacgcgaaccaggg

SEQ ID NO: 437604 - DNA, 25 bp, Mus musculus
tcgctgacattgcaggggatcacca

SEQ ID NO: 437605 - DNA, 25 bp, Mus musculus
cggtacagctgtgccgggaagccca

SEQ ID NO: 437606 - DNA, 25 bp, Mus musculus
ctgctcccggaagacgagaagctcc

SEQ ID NO: 437607 - DNA, 25 bp, Mus musculus
aagttctgctcgctggggccgtcat

SEQ ID NO: 437608 - DNA, 25 bp, Mus musculus
atgtgcaccgggctcagatcggccc

SEQ ID NO: 437609 - DNA, 25 bp, Mus musculus
gaaacctcatcttttgggccctatc

SEQ ID NO: 437610 - DNA, 25 bp, Mus musculus
ggaagacttgtctggaaacctcatc

SEQ ID NO: 437611 - DNA, 25 bp, Mus musculus
taaaagttggcctggaagacttgtc

SEQ ID NO: 437612 - DNA, 25 bp, Mus musculus
aggcgctggggccacccgcttaaag

SEQ ID NO: 437613 - DNA, 25 bp, Mus musculus
ttgccagcaacaaacacaaactttc

SEQ ID NO: 437614 - DNA, 25 bp, Mus musculus
cggcgctttgccagcaacaaacaca

SEQ ID NO: 437615 - DNA, 25 bp, Mus musculus
tccggctgctccagagtcggctgct

SEQ ID NO: 437616 - DNA, 25 bp, Mus musculus
cccaggaggatgtgcaccgggctca

SEQ ID NO: 437617 - DNA, 25 bp, Mus musculus
cacacgtgaggacccggctcggtca

SEQ ID NO: 437618 - DNA, 25 bp, Mus musculus
cgggacacagcaaaggctcacattt

SEQ ID NO: 437619 - DNA, 25 bp, Mus musculus
agcaaaggctcacatttccgcccag

SEQ ID NO: 437620 - DNA, 25 bp, Mus musculus
tcacggtggccaacaggtagagagc

SEQ ID NO: 437621 - DNA, 25 bp, Mus musculus
ccgaaagcaaaagggaagagccgtg

SEQ ID NO: 437622 - DNA, 25 bp, Mus musculus
gctcggttagcagccggagccgctc

SEQ ID NO: 437623 - DNA, 25 bp, Mus musculus
ccggtgtttccgtagggcgcctgct

SEQ ID NO: 437624 - DNA, 25 bp, Mus musculus
gccgctcttatagcggccgtcacgt

SEQ ID NO: 437625 - DNA, 25 bp, Mus musculus
ggttcgcgagctacccggagcttcc

SEQ ID NO: 437626 - DNA, 25 bp, Mus musculus
acccggctgctgaggcctaaaaata

SEQ ID NO: 437627 - DNA, 25 bp, Mus musculus
agagcagggccgcaacccggtgttt

SEQ ID NO: 437628 - DNA, 25 bp, Mus musculus
atggcaggagcacctccgggctccg

SEQ ID NO: 437629 - DNA, 25 bp, Mus musculus
agacggaagccaccgctctgcagcg

SEQ ID NO: 437630 - DNA, 25 bp, Mus musculus
tctgcagcgcggctcggttagcagc

SEQ ID NO: 437631 - DNA, 25 bp, Mus musculus
gcgctagccggctcccatgtagcag

SEQ ID NO: 437632 - DNA, 25 bp, Mus musculus
ggagccgctctccacggttcgcgag

SEQ ID NO: 437633 - DNA, 25 bp, Mus musculus
gttacgcggggcgtacctgtcatag

SEQ ID NO: 437634 - DNA, 25 bp, Mus musculus
cgtacctgtcatagtgtggccgggt

SEQ ID NO: 437635 - DNA, 25 bp, Mus musculus
ctaaaaataggatcagtgcagcggc

SEQ ID NO: 437636 - DNA, 25 bp, Mus musculus
catcccaggtggtccgcagctgcgt

SEQ ID NO: 437637 - DNA, 25 bp, Mus musculus
aggccaccgccttcgcccttgctcg

SEQ ID NO: 437638 - DNA, 25 bp, Mus musculus
cgaagcgttttgctattgtttaccg

SEQ ID NO: 437639 - DNA, 25 bp, Mus musculus
tgctattgtttaccgggcgaaagac

SEQ ID NO: 437640 - DNA, 25 bp, Mus musculus
cgaaagacgcgtccccgggagcctg

SEQ ID NO: 437641 - DNA, 25 bp, Mus musculus
ttccatcagctcatcccaggtggtc

SEQ ID NO: 437642 - DNA, 25 bp, Mus musculus
gcgggctcagcttgccgcaagcgga

SEQ ID NO: 437643 - DNA, 25 bp, Mus musculus
tttctttgccagtgtctcagactca

SEQ ID NO: 437644 - DNA, 25 bp, Mus musculus
agtgtctcagactcaaccgccgggg

SEQ ID NO: 437645 - DNA, 25 bp, Mus musculus
tctcagactcaaccgccggggaggt

SEQ ID NO: 437646 - DNA, 25 bp, Mus musculus
aggtaaaacaatagcgggccacctg

SEQ ID NO: 437647 - DNA, 25 bp, Mus musculus
acaatagcgggccacctgggacgcg

SEQ ID NO: 437648 - DNA, 25 bp, Mus musculus
acaggaccggcgagcgttcggttgc

SEQ ID NO: 437649 - DNA, 25 bp, Mus musculus
cccaggttaactttccatcagctca

SEQ ID NO: 437650 - DNA, 25 bp, Mus musculus
gctgcagttcgagaggcatgtgtcg

SEQ ID NO: 437651 - DNA, 25 bp, Mus musculus
cgaactcgcacttcgccgtgctgtg

SEQ ID NO: 437652 - DNA, 25 bp, Mus musculus
acttcgccgtgctgtggtatgttca

SEQ ID NO: 437653 - DNA, 25 bp, Mus musculus
cgccgtgctgtggtatgttcacaaa

SEQ ID NO: 437654 - DNA, 25 bp, Mus musculus
tatgttcacaaaccctcggacgcgg

SEQ ID NO: 437655 - DNA, 25 bp, Mus musculus
caaaccctcggacgcggacggcaag

SEQ ID NO: 437656 - DNA, 25 bp, Mus musculus
gcggacggcaagctcatcctcaaaa

SEQ ID NO: 437657 - DNA, 25 bp, Mus musculus
atcctcaaaaccacgcacagctcgg

SEQ ID NO: 437658 - DNA, 25 bp, Mus musculus
cacagctcggccttcgagtacggga

SEQ ID NO: 437659 - DNA, 25 bp, Mus musculus
tcgagtacgggacctacgccgagga

SEQ ID NO: 437660 - DNA, 25 bp, Mus musculus
ggcctgttcagcctcactgtgcagc

SEQ ID NO: 437661 - DNA, 25 bp, Mus musculus
tcagcctcactgtgcagcgagccga

SEQ ID NO: 437662 - DNA, 25 bp, Mus musculus
cactgtgcagcgagccgaggtcagc

SEQ ID NO: 437663 - DNA, 25 bp, Mus musculus
gctcggccttcgagtacgggaccta

SEQ ID NO: 437664 - DNA, 25 bp, Mus musculus
acgcgtgcacgtcaccgttaccgga

SEQ ID NO: 437665 - DNA, 25 bp, Mus musculus
ctcagcgtagcttttctggggtctc

SEQ ID NO: 437666 - DNA, 25 bp, Mus musculus
ctcacttcctaaaatatgcaacctg

SEQ ID NO: 437667 - DNA, 25 bp, Mus musculus
ccattgccgagagcccggtctctaa

SEQ ID NO: 437668 - DNA, 25 bp, Mus musculus
ctgcagaatccaggccggcatcctt

SEQ ID NO: 437669 - DNA, 25 bp, Mus musculus
cagcagctgcacgactccgagggat

SEQ ID NO: 437670 - DNA, 25 bp, Mus musculus
agtcggggctagtctacttgctcag

SEQ ID NO: 437671 - DNA, 25 bp, Mus musculus
ctgcagaacactggggacttgagtg

SEQ ID NO: 437672 - DNA, 25 bp, Mus musculus
tctgggtctctcaagggctacggag

SEQ ID NO: 437673 - DNA, 25 bp, Mus musculus
cgttaccggagcaacctgacaccgg

SEQ ID NO: 437674 - DNA, 25 bp, Mus musculus
atgcaacctgcgtgatggctccgcc

SEQ ID NO: 437675 - DNA, 25 bp, Mus musculus
cgggtcctgttgctggagactagaa

SEQ ID NO: 437676 - DNA, 25 bp, Mus musculus
gagagcccggtctctaagccgcttc

SEQ ID NO: 437677 - DNA, 25 bp, Mus musculus
ccgagggattcctctctgcagaatc

SEQ ID NO: 437678 - DNA, 25 bp, Mus musculus
ctggcgcgcggaagggaaagaggaa

SEQ ID NO: 437679 - DNA, 25 bp, Mus musculus
ccgccaccgcgacggaggacctggc

SEQ ID NO: 437680 - DNA, 25 bp, Mus musculus
ctccacctccatggcgggctcgcgc

SEQ ID NO: 437681 - DNA, 25 bp, Mus musculus
gtggctgaagatcgggcgacggagc

SEQ ID NO: 437682 - DNA, 25 bp, Mus musculus
gcgacggagcgaccgaggactgagc

SEQ ID NO: 437683 - DNA, 25 bp, Mus musculus
gcgggaccctgcagacgaccgggtc

SEQ ID NO: 437684 - DNA, 25 bp, Mus musculus
ggcggagatgcgatgctggtcgccc

SEQ ID NO: 437685 - DNA, 25 bp, Mus musculus
tgacaggaatttttggcgagcggtt

SEQ ID NO: 437686 - DNA, 25 bp, Mus musculus
ctctagagccttccgagaagagggc

SEQ ID NO: 437687 - DNA, 25 bp, Mus musculus
ccggcagctccacgccgtgtcccgc

SEQ ID NO: 437688 - DNA, 25 bp, Mus musculus
cccttcgcacaaagcggtggaatgc

SEQ ID NO: 437689 - DNA, 25 bp, Mus musculus
ccttcgcacaaagcggtggaatgcg

SEQ ID NO: 437690 - DNA, 25 bp, Mus musculus
agctctagagccttccgagaagagg

SEQ ID NO: 437691 - DNA, 25 bp, Mus musculus
gaagtgacaggaatttttggcgagc

SEQ ID NO: 437692 - DNA, 25 bp, Mus musculus
ctggccactgtctgggatgctattc

SEQ ID NO: 437693 - DNA, 25 bp, Mus musculus
tccgcaagcgcgcaggcttgaaagc

SEQ ID NO: 437694 - DNA, 25 bp, Mus musculus
cgagctctccgcagacgcgcattta

SEQ ID NO: 437695 - DNA, 25 bp, Mus musculus
aggaattctgcacggctggatagcc

SEQ ID NO: 437696 - DNA, 25 bp, Mus musculus
gggtttgatgcataagcagcacttc

SEQ ID NO: 437697 - DNA, 25 bp, Mus musculus
tcgcgcgtgccacctgttaactctg

SEQ ID NO: 437698 - DNA, 25 bp, Mus musculus
caagagctccaggtgatgcctacga

SEQ ID NO: 437699 - DNA, 25 bp, Mus musculus
ccaacactacggaggactcggactc

SEQ ID NO: 437700 - DNA, 25 bp, Mus musculus
tcccaattaggaacagtaccggctc

SEQ ID NO: 437701 - DNA, 25 bp, Mus musculus
cctgggagcgaagttgaagctaaac

SEQ ID NO: 437702 - DNA, 25 bp, Mus musculus
gccgcgtcttggttgcctatgacca

SEQ ID NO: 437703 - DNA, 25 bp, Mus musculus
agctgccaggctcactgtaggaccc

SEQ ID NO: 437704 - DNA, 25 bp, Mus musculus
gatgctattcgcacgcgttcctgga

SEQ ID NO: 437705 - DNA, 25 bp, Mus musculus
ctgtgcgcagacacccgagtctagg

SEQ ID NO: 437706 - DNA, 25 bp, Mus musculus
tgctcagaacctcctggggagctcg

SEQ ID NO: 437707 - DNA, 25 bp, Mus musculus
ctctctccgcagacacgaatggcga

SEQ ID NO: 437708 - DNA, 25 bp, Mus musculus
gccgactctagctcaggtgctcaga

SEQ ID NO: 437709 - DNA, 25 bp, Mus musculus
tacttggttggacctgccgactcta

SEQ ID NO: 437710 - DNA, 25 bp, Mus musculus
acgagtcgcagagtacttggttgga

SEQ ID NO: 437711 - DNA, 25 bp, Mus musculus
cgcggcgaacgagtcgcagagtact

SEQ ID NO: 437712 - DNA, 25 bp, Mus musculus
taatgcgcgtgctcctggagctcga

SEQ ID NO: 437713 - DNA, 25 bp, Mus musculus
aaattctgcgcggagacgcggtccg

SEQ ID NO: 437714 - DNA, 25 bp, Mus musculus
acggagctcggaaattctgcgcgga

SEQ ID NO: 437715 - DNA, 25 bp, Mus musculus
cggtaagtgacggagctcggaaatt

SEQ ID NO: 437716 - DNA, 25 bp, Mus musculus
gcgagcttacctgcggcgaccgcga

SEQ ID NO: 437717 - DNA, 25 bp, Mus musculus
tgtcaggcccaagccgcgagcttac

SEQ ID NO: 437718 - DNA, 25 bp, Mus musculus
aatggcgagcgacctcgagcgccgc

SEQ ID NO: 437719 - DNA, 25 bp, Mus musculus
gcagacacgaatggcgagcgacctc

SEQ ID NO: 437720 - DNA, 25 bp, Mus musculus
agactgccgggcattgtgtgatcca

SEQ ID NO: 437721 - DNA, 25 bp, Mus musculus
aatgatgctgagtccggaccaagcc

SEQ ID NO: 437722 - DNA, 25 bp, Mus musculus
agaagtccaggtttgctaggccctc

SEQ ID NO: 437723 - DNA, 25 bp, Mus musculus
atgcgctttgatacccgctccttgc

SEQ ID NO: 437724 - DNA, 25 bp, Mus musculus
ctgtgtgggttcagaatgcgctttg

SEQ ID NO: 437725 - DNA, 25 bp, Mus musculus
agagagcagctgatgtctggccaga

SEQ ID NO: 437726 - DNA, 25 bp, Mus musculus
ttcgggatctttcctgtgtctggga

SEQ ID NO: 437727 - DNA, 25 bp, Mus musculus
ttcgggcatccatcccttcgggatc

SEQ ID NO: 437728 - DNA, 25 bp, Mus musculus
gggtgggaagcacactctgcatctc

SEQ ID NO: 437729 - DNA, 25 bp, Mus musculus
cttttgaaaggaccgaacacatgtg

SEQ ID NO: 437730 - DNA, 25 bp, Mus musculus
tatgagggccgaggagtcaattttc

SEQ ID NO: 437731 - DNA, 25 bp, Mus musculus
cagtctgcgtgacagatggtgctcc

SEQ ID NO: 437732 - DNA, 25 bp, Mus musculus
tgtgtgatccacgtccctaggtccc

SEQ ID NO: 437733 - DNA, 25 bp, Mus musculus
acaccaaggttctgggcagcgtgtc

SEQ ID NO: 437734 - DNA, 25 bp, Mus musculus
atggctgcaggatgaaataaggttc

SEQ ID NO: 437735 - DNA, 25 bp, Mus musculus
ttcgactggtgtctaaggctgcccg

SEQ ID NO: 437736 - DNA, 25 bp, Mus musculus
cgaggttgcccaggacagggactcc

SEQ ID NO: 437737 - DNA, 25 bp, Mus musculus
acagggactcctcctttggctggga

SEQ ID NO: 437738 - DNA, 25 bp, Mus musculus
gcgcttttgaaagtaaactacctgc

SEQ ID NO: 437739 - DNA, 25 bp, Mus musculus
taaactacctgcctgttgcgctccg

SEQ ID NO: 437740 - DNA, 25 bp, Mus musculus
ccaggactccgagcactggaatgga

SEQ ID NO: 437741 - DNA, 25 bp, Mus musculus
ctgcggttttgtaagcgaagtgaga

SEQ ID NO: 437742 - DNA, 25 bp, Mus musculus
tgagaaacacgagccagctccgttc

SEQ ID NO: 437743 - DNA, 25 bp, Mus musculus
cgttcctgtgctggaaaaccggcca

SEQ ID NO: 437744 - DNA, 25 bp, Mus musculus
tcgcgttctgccctgcaaggcgcgt

SEQ ID NO: 437745 - DNA, 25 bp, Mus musculus
tggttgcctccgacacgccgtcatt

SEQ ID NO: 437746 - DNA, 25 bp, Mus musculus
acaaggcaaagaagtccgaggtagc

SEQ ID NO: 437747 - DNA, 25 bp, Mus musculus
ggtctatgctgctttccgcttcctg

SEQ ID NO: 437748 - DNA, 25 bp, Mus musculus
tgagggtctccctggtcgtgaaatt

SEQ ID NO: 437749 - DNA, 25 bp, Mus musculus
acagcgctcaagagagcctggagtg

SEQ ID NO: 437750 - DNA, 25 bp, Mus musculus
gtgcttggatccctgtctagctaga

SEQ ID NO: 437751 - DNA, 25 bp, Mus musculus
ctagatctttgtgggctgaagcgca

SEQ ID NO: 437752 - DNA, 25 bp, Mus musculus
ctgaagcgcacccttgaaagaactg

SEQ ID NO: 437753 - DNA, 25 bp, Mus musculus
ccttgaaagaactgtcccgagtaga

SEQ ID NO: 437754 - DNA, 25 bp, Mus musculus
gcgcatcggtgagtcaggcttctct

SEQ ID NO: 437755 - DNA, 25 bp, Mus musculus
aacacgagatcgtgggcacgcaagg

SEQ ID NO: 437756 - DNA, 25 bp, Mus musculus
cgtgaaattccctgttcctggatga

SEQ ID NO: 437757 - DNA, 25 bp, Mus musculus
ctggatgaccagaagtaccaaagtc

SEQ ID NO: 437758 - DNA, 25 bp, Mus musculus
gtaccaaagtcaacactggcgcctg

SEQ ID NO: 437759 - DNA, 25 bp, Mus musculus
actggcgcctgcagaagctgcattg

SEQ ID NO: 437760 - DNA, 25 bp, Mus musculus
ctctcaggctagaaggggacagcgc

SEQ ID NO: 437761 - DNA, 25 bp, Mus musculus
cccgagtagatgtaggaacacgaga

SEQ ID NO: 437762 - DNA, 25 bp, Mus musculus
agaagccatcatcttcggcggcatc

SEQ ID NO: 437763 - DNA, 25 bp, Mus musculus
gggcgcacatatgctcggatagcta

SEQ ID NO: 437764 - DNA, 25 bp, Mus musculus
gtatctgctgctcggcttcaacctg

SEQ ID NO: 437765 - DNA, 25 bp, Mus musculus
acctgctgttctgggtgagacccga

SEQ ID NO: 437766 - DNA, 25 bp, Mus musculus
aggtgaccgcaatagagttgggcca

SEQ ID NO: 437767 - DNA, 25 bp, Mus musculus
gacgaaggtggtgctacctccaagg

SEQ ID NO: 437768 - DNA, 25 bp, Mus musculus
tcggatagctacaggagcccaagcc

SEQ ID NO: 437769 - DNA, 25 bp, Mus musculus
aagcttgagctaccagaggtgatga

SEQ ID NO: 437770 - DNA, 25 bp, Mus musculus
tgctccctgcatcctgctgtgtaca

SEQ ID NO: 437771 - DNA, 25 bp, Mus musculus
ttctcgcgctgccttctctggggaa

SEQ ID NO: 437772 - DNA, 25 bp, Mus musculus
caaggctctgggagggaaatcccta

SEQ ID NO: 437773 - DNA, 25 bp, Mus musculus
cccaaccaagagtgtgcggacacgc

SEQ ID NO: 437774 - DNA, 25 bp, Mus musculus
ggcctgcggtgcatcaagtatctgc

SEQ ID NO: 437775 - DNA, 25 bp, Mus musculus
ttcagaggcgctaagcagacaaaga

SEQ ID NO: 437776 - DNA, 25 bp, Mus musculus
aagccaagcacctggacacgcgtga

SEQ ID NO: 437777 - DNA, 25 bp, Mus musculus
tggaactttctaggggtggacctca

SEQ ID NO: 437778 - DNA, 25 bp, Mus musculus
catggaacggaaccgtgagcttccc

SEQ ID NO: 437779 - DNA, 25 bp, Mus musculus
tctaccaagtctgcgctcaaaattg

SEQ ID NO: 437780 - DNA, 25 bp, Mus musculus
ccgcgtgcgttctagggatggaact

SEQ ID NO: 437781 - DNA, 25 bp, Mus musculus
gcccacgcaagctgaccttgaagta

SEQ ID NO: 437782 - DNA, 25 bp, Mus musculus
ccttgaagtagttggagtctcctcc

SEQ ID NO: 437783 - DNA, 25 bp, Mus musculus
tttcacggcggacacttgactgctg

SEQ ID NO: 437784 - DNA, 25 bp, Mus musculus
aagggcttttgcttctccatgctgc

SEQ ID NO: 437785 - DNA, 25 bp, Mus musculus
cgcgtgcgctcctttatgaagacga

SEQ ID NO: 437786 - DNA, 25 bp, Mus musculus
gaacctcctggaagcccgagaactc

SEQ ID NO: 437787 - DNA, 25 bp, Mus musculus
ctcaatttaacggttggtccagctg

SEQ ID NO: 437788 - DNA, 25 bp, Mus musculus
ccacgtgccgggttctctaccaagt

SEQ ID NO: 437789 - DNA, 25 bp, Mus musculus
gtggaagccacccttctcgccttga

SEQ ID NO: 437790 - DNA, 25 bp, Mus musculus
gaccgagatgccaccacgcctttaa

SEQ ID NO: 437791 - DNA, 25 bp, Mus musculus
cgagtcgctggtggaccagtcggct

SEQ ID NO: 437792 - DNA, 25 bp, Mus musculus
agatcttgacggacgccaagacgct

SEQ ID NO: 437793 - DNA, 25 bp, Mus musculus
tcgagaagatcttgacggacgccaa

SEQ ID NO: 437794 - DNA, 25 bp, Mus musculus
agctgcacgatcgagaagatcttga

SEQ ID NO: 437795 - DNA, 25 bp, Mus musculus
tatgagctgcacgatcgagaagatc

SEQ ID NO: 437796 - DNA, 25 bp, Mus musculus
cggccactatgagctgcacgatcga

SEQ ID NO: 437797 - DNA, 25 bp, Mus musculus
tcctcggccactatgagctgcacga

SEQ ID NO: 437798 - DNA, 25 bp, Mus musculus
gggtaaggtctgagcgaagcgccta

SEQ ID NO: 437799 - DNA, 25 bp, Mus musculus
acgcgattcgcgctgagccagggcc

SEQ ID NO: 437800 - DNA, 25 bp, Mus musculus
aagtgacgcgattcgcgctgagcca

SEQ ID NO: 437801 - DNA, 25 bp, Mus musculus
gccgtgttacccgagcaggtcggcc

SEQ ID NO: 437802 - DNA, 25 bp, Mus musculus
gagatgccaccacgcctttaaagtg

SEQ ID NO: 437803 - DNA, 25 bp, Mus musculus
cgcctttaaagtgcacccggaagtg

SEQ ID NO: 437804 - DNA, 25 bp, Mus musculus
agcgggcgtgtttacgcgcatccaa

SEQ ID NO: 437805 - DNA, 25 bp, Mus musculus
ctctggaacgaatgcgcggcgagcc

SEQ ID NO: 437806 - DNA, 25 bp, Mus musculus
aagcgccacccaggcagcgggacag

SEQ ID NO: 437807 - DNA, 25 bp, Mus musculus
cgggcgaagggactcaagcgccacc

SEQ ID NO: 437808 - DNA, 25 bp, Mus musculus
tgaacgcggagtccatgtggagccc

SEQ ID NO: 437809 - DNA, 25 bp, Mus musculus
gcgcatccaagtgtgcggcactttg

SEQ ID NO: 437810 - DNA, 25 bp, Mus musculus
acctttccaggtacgctccggagcg

SEQ ID NO: 437811 - DNA, 25 bp, Mus musculus
caggcgaagcacctttccaggtacg

SEQ ID NO: 437812 - DNA, 25 bp, Mus musculus
ctagaactcgctcacggcaggcgaa

SEQ ID NO: 437813 - DNA, 25 bp, Mus musculus
tgctccgggtcccatcctagaactc

SEQ ID NO: 437814 - DNA, 25 bp, Mus musculus
caatttcagctttgcgttttcacca

SEQ ID NO: 437815 - DNA, 25 bp, Mus musculus
cacatttgggcgcacaacttcaatt

SEQ ID NO: 437816 - DNA, 25 bp, Mus musculus
cagacaagtcgcacatttgggcgca

SEQ ID NO: 437817 - DNA, 25 bp, Mus musculus
cggcactttgaacgcggagtccatg

SEQ ID NO: 437818 - DNA, 25 bp, Mus musculus
caccggcttgcgtgtggctaaacgc

SEQ ID NO: 437819 - DNA, 25 bp, Mus musculus
cccagcgtcgcagcagagtcactaa

SEQ ID NO: 437820 - DNA, 25 bp, Mus musculus
aaagctttcgggctcgcgaacaccg

SEQ ID NO: 437821 - DNA, 25 bp, Mus musculus
cgcagagattgcttctggcactacc

SEQ ID NO: 437822 - DNA, 25 bp, Mus musculus
gcgaacgtagagaagaagagtcacc

SEQ ID NO: 437823 - DNA, 25 bp, Mus musculus
tggcttcaaccgtctcggcctcagg

SEQ ID NO: 437824 - DNA, 25 bp, Mus musculus
gccctcgcgcgcaagcgtactaaga

SEQ ID NO: 437825 - DNA, 25 bp, Mus musculus
cggagcctgcaactctcgcgagaga

SEQ ID NO: 437826 - DNA, 25 bp, Mus musculus
tattcctacgtaccgggccgtgctg

SEQ ID NO: 437827 - DNA, 25 bp, Mus musculus
tggggtgagtacgacctcagtgtta

SEQ ID NO: 437828 - DNA, 25 bp, Mus musculus
gagtgggcactcctagaattccgga

SEQ ID NO: 437829 - DNA, 25 bp, Mus musculus
tgagttcctactccaggcgtccctt

SEQ ID NO: 437830 - DNA, 25 bp, Mus musculus
atggaaactccgaccgcagccaaga

SEQ ID NO: 437831 - DNA, 25 bp, Mus musculus
ctggcactacccaggggcgaacgta

SEQ ID NO: 437832 - DNA, 25 bp, Mus musculus
tccaacagcttctcaggttgaagtc

SEQ ID NO: 437833 - DNA, 25 bp, Mus musculus
ttctcagcgtgtgaacgcctggcgg

SEQ ID NO: 437834 - DNA, 25 bp, Mus musculus
ggccggctgcaagactctagtcgtc

SEQ ID NO: 437835 - DNA, 25 bp, Mus musculus
cggctgcaagactctagtcgtcggc

SEQ ID NO: 437836 - DNA, 25 bp, Mus musculus
gactctagtcgtcggcccacgtggc

SEQ ID NO: 437837 - DNA, 25 bp, Mus musculus
cttgggcgcctagtgattacgtagc

SEQ ID NO: 437838 - DNA, 25 bp, Mus musculus
ctgttcatggcggtttcggggtctc

SEQ ID NO: 437839 - DNA, 25 bp, Mus musculus
tcatggcggtttcggggtctccaac

SEQ ID NO: 437840 - DNA, 25 bp, Mus musculus
ttgaagtccaaaagcctcccgaggc

SEQ ID NO: 437841 - DNA, 25 bp, Mus musculus
gggtctgcggagtttgaggtaaagc

SEQ ID NO: 437842 - DNA, 25 bp, Mus musculus
tgaggtaaagctccggcctgcctgg

SEQ ID NO: 437843 - DNA, 25 bp, Mus musculus
gcgtcggacttctcagcgtgtgaac

SEQ ID NO: 437844 - DNA, 25 bp, Mus musculus
tcggacttctcagcgtgtgaacgcc

SEQ ID NO: 437845 - DNA, 25 bp, Mus musculus
tctcaggttgaagtccaaaagcctc

SEQ ID NO: 437846 - DNA, 25 bp, Mus musculus
cccaggcaaaagagggcgtgtctta

SEQ ID NO: 437847 - DNA, 25 bp, Mus musculus
ccgtagatccggagatagagctttg

SEQ ID NO: 437848 - DNA, 25 bp, Mus musculus
cgtgtagtcgcacagaccgtagatc

SEQ ID NO: 437849 - DNA, 25 bp, Mus musculus
ttcgcgcgctttgcttcggaactac

SEQ ID NO: 437850 - DNA, 25 bp, Mus musculus
atagagctttggctccaggcctggg

SEQ ID NO: 437851 - DNA, 25 bp, Mus musculus
gccctggaaggacagagccttactg

SEQ ID NO: 437852 - DNA, 25 bp, Mus musculus
cagacaagcggtaaagcgtgtgttc

SEQ ID NO: 437853 - DNA, 25 bp, Mus musculus
gatcccagaggccaccgacgcgagt

SEQ ID NO: 437854 - DNA, 25 bp, Mus musculus
tggtcagccgagagctgggtacctc

SEQ ID NO: 437855 - DNA, 25 bp, Mus musculus
cgccgcgaggaaacgcgcctatcag

SEQ ID NO: 437856 - DNA, 25 bp, Mus musculus
cctatcaggcggtcttgaacttgga

SEQ ID NO: 437857 - DNA, 25 bp, Mus musculus
ggtcttgaacttggacgtgcccgga

SEQ ID NO: 437858 - DNA, 25 bp, Mus musculus
tgcccggacggagcacttcagacaa

SEQ ID NO: 437859 - DNA, 25 bp, Mus musculus
ggttccgagccttgaggagagccct

SEQ ID NO: 437860 - DNA, 25 bp, Mus musculus
accctgagctggaagtcggagagcc

SEQ ID NO: 437861 - DNA, 25 bp, Mus musculus
gtcctagtctagacacgctcgcgtg

SEQ ID NO: 437862 - DNA, 25 bp, Mus musculus
ggctcgcgtatgaatctcctggacc

SEQ ID NO: 437863 - DNA, 25 bp, Mus musculus
tgggagcgacaactttaccagtttc

SEQ ID NO: 437864 - DNA, 25 bp, Mus musculus
cgctgctcggaactgcctggaaact

SEQ ID NO: 437865 - DNA, 25 bp, Mus musculus
cccttcatgaagatgaccgacgagc

SEQ ID NO: 437866 - DNA, 25 bp, Mus musculus
ggagtatttattagagaccctgagc

SEQ ID NO: 437867 - DNA, 25 bp, Mus musculus
gattggcccgaggtatctaacgtga

SEQ ID NO: 437868 - DNA, 25 bp, Mus musculus
tgactcaagagctagccgtgattgg

SEQ ID NO: 437869 - DNA, 25 bp, Mus musculus
gcgacttgccaacactgatgactca

SEQ ID NO: 437870 - DNA, 25 bp, Mus musculus
aatccggtccaatcagcgacttgcc

SEQ ID NO: 437871 - DNA, 25 bp, Mus musculus
ttccgagagtagagagcaaacttac

SEQ ID NO: 437872 - DNA, 25 bp, Mus musculus
agaccgttccaaaactgtgacattc

SEQ ID NO: 437873 - DNA, 25 bp, Mus musculus
cctggaaacttctgtgggagcgaca

SEQ ID NO: 437874 - DNA, 25 bp, Mus musculus
cgaccctggcctgttctcgttctta

SEQ ID NO: 437875 - DNA, 25 bp, Mus musculus
aggtggtggtagatgcgctaccata

SEQ ID NO: 437876 - DNA, 25 bp, Mus musculus
accaaggctatgaggcacccggcgt

SEQ ID NO: 437877 - DNA, 25 bp, Mus musculus
ttttgaccaaggctatgaggcaccc

SEQ ID NO: 437878 - DNA, 25 bp, Mus musculus
ttctcgttcttaggcggcggccctg

SEQ ID NO: 437879 - DNA, 25 bp, Mus musculus
tgcgctaccatattttgaccaaggc

SEQ ID NO: 437880 - DNA, 25 bp, Mus musculus
ctcttgaagcctagtgccgcgcgat

SEQ ID NO: 437881 - DNA, 25 bp, Mus musculus
gaaggcgctcttgaagcctagtgcc

SEQ ID NO: 437882 - DNA, 25 bp, Mus musculus
agaaccgaggctgcgcagactcaga

SEQ ID NO: 437883 - DNA, 25 bp, Mus musculus
gtggaattagaaccgaggctgcgca

SEQ ID NO: 437884 - DNA, 25 bp, Mus musculus
gtgtgtgacgtcattccaggcgcag

SEQ ID NO: 437885 - DNA, 25 bp, Mus musculus
cagcggcgtgtgtgacgtcattcca

SEQ ID NO: 437886 - DNA, 25 bp, Mus musculus
tgcgcccgaatcgaagccccaaagg

SEQ ID NO: 437887 - DNA, 25 bp, Mus musculus
cgcaggcgcagtggaattagaaccg

SEQ ID NO: 437888 - DNA, 25 bp, Mus musculus
agctgcatcgcggtctgtcccgcga

SEQ ID NO: 437889 - DNA, 25 bp, Mus musculus
tgtcagcagagcttgcagagccggc

SEQ ID NO: 437890 - DNA, 25 bp, Mus musculus
gacacctgcgcggtgtgtcagcaga

SEQ ID NO: 437891 - DNA, 25 bp, Mus musculus
ggctcctggttcctcgtcggggcca

SEQ ID NO: 437892 - DNA, 25 bp, Mus musculus
aacatggcggaaaacaaaggcggcg

SEQ ID NO: 437893 - DNA, 25 bp, Mus musculus
ctcggcggccgctcttgctgtggct

SEQ ID NO: 437894 - DNA, 25 bp, Mus musculus
tccctccggaggacgtcggtgcgta

SEQ ID NO: 437895 - DNA, 25 bp, Mus musculus
gcaacagaccacaccgaggcgcgga

SEQ ID NO: 437896 - DNA, 25 bp, Mus musculus
actccagccgggtggcaacagacca

SEQ ID NO: 437897 - DNA, 25 bp, Mus musculus
cgagctacacaactccagccgggtg

SEQ ID NO: 437898 - DNA, 25 bp, Mus musculus
gccacatcatagagacccagttcca

SEQ ID NO: 437899 - DNA, 25 bp, Mus musculus
cttcggcgctagcagccacatcata

SEQ ID NO: 437900 - DNA, 25 bp, Mus musculus
ggggcgaacgcaagccggcctccta

SEQ ID NO: 437901 - DNA, 25 bp, Mus musculus
tcggtgcgtacgtgcgcgtgcccac

SEQ ID NO: 437902 - DNA, 25 bp, Mus musculus
tccagggttcaggatctaggatcca

SEQ ID NO: 437903 - DNA, 25 bp, Mus musculus
caccgactttgccaggcgggaacct

SEQ ID NO: 437904 - DNA, 25 bp, Mus musculus
agacttgtcggagcttcgagctgca

SEQ ID NO: 437905 - DNA, 25 bp, Mus musculus
gcagactcaggtactgggagaccca

SEQ ID NO: 437906 - DNA, 25 bp, Mus musculus
ctggatttctcttctcagtggcctc

SEQ ID NO: 437907 - DNA, 25 bp, Mus musculus
ctcagaagtctagctcggagtccca

SEQ ID NO: 437908 - DNA, 25 bp, Mus musculus
agtctgggtcagttccctggctcac

SEQ ID NO: 437909 - DNA, 25 bp, Mus musculus
cactaattatgagagcccggagatg

SEQ ID NO: 437910 - DNA, 25 bp, Mus musculus
tcccttgtgtcttgggctcatccca

SEQ ID NO: 437911 - DNA, 25 bp, Mus musculus
tgccactgggcttgggaaaaacttg

SEQ ID NO: 437912 - DNA, 25 bp, Mus musculus
tgtccaggtttctcagcagcgagtg

SEQ ID NO: 437913 - DNA, 25 bp, Mus musculus
tcggtctctctctgactcactcgga

SEQ ID NO: 437914 - DNA, 25 bp, Mus musculus
cacgcggtctttgtgtccaggtttc

SEQ ID NO: 437915 - DNA, 25 bp, Mus musculus
gtgttcaactgagccggtgcctctc

SEQ ID NO: 437916 - DNA, 25 bp, Mus musculus
caccgccggtgtgtgtagttctcag

SEQ ID NO: 437917 - DNA, 25 bp, Mus musculus
ccgcacagcagtctccgaggtcgtt

SEQ ID NO: 437918 - DNA, 25 bp, Mus musculus
gaccggtttcccagtcctctccgca

SEQ ID NO: 437919 - DNA, 25 bp, Mus musculus
tgagatcactgcatcttgccccggg

SEQ ID NO: 437920 - DNA, 25 bp, Mus musculus
tgacacctactgaggcggaagtgcg

SEQ ID NO: 437921 - DNA, 25 bp, Mus musculus
cctagcgccatgacacctactgagg

SEQ ID NO: 437922 - DNA, 25 bp, Mus musculus
gccggaaccattcagccacctagcg

SEQ ID NO: 437923 - DNA, 25 bp, Mus musculus
gccgccgttgtcaccagacccgaca

SEQ ID NO: 437924 - DNA, 25 bp, Mus musculus
caagcaagccggctacccaagggag

SEQ ID NO: 437925 - DNA, 25 bp, Mus musculus
tgtgtgtagttctcagcctcgagtc

SEQ ID NO: 437926 - DNA, 25 bp, Mus musculus
cgagcctgactcaccgccggtgtgt

SEQ ID NO: 437927 - DNA, 25 bp, Mus musculus
agcagtctccgaggtcgtttaaccg

SEQ ID NO: 437928 - DNA, 25 bp, Mus musculus
tagttctcagcctcgagtcggggcc

SEQ ID NO: 437929 - DNA, 25 bp, Mus musculus
tacccaagggagtctgcggctcgct

SEQ ID NO: 437930 - DNA, 25 bp, Mus musculus
cccagaaacggaattagtagacaga

SEQ ID NO: 437931 - DNA, 25 bp, Mus musculus
agctgctccttgtgtctcagggcga

SEQ ID NO: 437932 - DNA, 25 bp, Mus musculus
cgcgacccggaaagctgctccttgt

SEQ ID NO: 437933 - DNA, 25 bp, Mus musculus
gctcacacagtgagctgcgcgcctg

SEQ ID NO: 437934 - DNA, 25 bp, Mus musculus
agaccctagtagttgatttccgatc

SEQ ID NO: 437935 - DNA, 25 bp, Mus musculus
cacattgtcaaagctcgcgcggcgg

SEQ ID NO: 437936 - DNA, 25 bp, Mus musculus
cgatcaggatgaaagcgcccaacgc

SEQ ID NO: 437937 - DNA, 25 bp, Mus musculus
tggaacaagtccagaagccctaaag

SEQ ID NO: 437938 - DNA, 25 bp, Mus musculus
cccaatgacaagtggactctggaac

SEQ ID NO: 437939 - DNA, 25 bp, Mus musculus
ggtttccacgacagcgtcccaatga

SEQ ID NO: 437940 - DNA, 25 bp, Mus musculus
gcactcctgagtgaggtttccacga

SEQ ID NO: 437941 - DNA, 25 bp, Mus musculus
gtcttcgcgggaaccgcactcctga

SEQ ID NO: 437942 - DNA, 25 bp, Mus musculus
acggcgcaggctccaaaagtccaca

SEQ ID NO: 437943 - DNA, 25 bp, Mus musculus
agtcgggagagcatcactcacaacc

SEQ ID NO: 437944 - DNA, 25 bp, Mus musculus
tcaccttctcgcctctgacggtgag

SEQ ID NO: 437945 - DNA, 25 bp, Mus musculus
gcgcgtccagggtgctttacaatag

SEQ ID NO: 437946 - DNA, 25 bp, Mus musculus
cacaaggagcggcacaagcaccatc

SEQ ID NO: 437947 - DNA, 25 bp, Mus musculus
ccgggcgatctcaagcacaaggaca

SEQ ID NO: 437948 - DNA, 25 bp, Mus musculus
cggccgggcccaagcataagggcca

SEQ ID NO: 437949 - DNA, 25 bp, Mus musculus
gggccctgttgaacctctgctcctg

SEQ ID NO: 437950 - DNA, 25 bp, Mus musculus
cggtcgggccatttaaatgtgtgtt

SEQ ID NO: 437951 - DNA, 25 bp, Mus musculus
gagagactccaatgcccagcgggcc

SEQ ID NO: 437952 - DNA, 25 bp, Mus musculus
tctacgagaacgaccgatcagtgga

SEQ ID NO: 437953 - DNA, 25 bp, Mus musculus
ttccggcatgttcaggtctacgaga

SEQ ID NO: 437954 - DNA, 25 bp, Mus musculus
tttacaatagaagctcggttggcga

SEQ ID NO: 437955 - DNA, 25 bp, Mus musculus
gctcctccactcagagagcaaagtg

SEQ ID NO: 437956 - DNA, 25 bp, Mus musculus
cacggcgagactctgaaagctatta

SEQ ID NO: 437957 - DNA, 25 bp, Mus musculus
agaggtgtcggaactgccgtttccg

SEQ ID NO: 437958 - DNA, 25 bp, Mus musculus
aggaacctctggaacatcgggacca

SEQ ID NO: 437959 - DNA, 25 bp, Mus musculus
tttgtccatccaacaagaacggaga

SEQ ID NO: 437960 - DNA, 25 bp, Mus musculus
gaacggagaactcgagcgaaggctc

SEQ ID NO: 437961 - DNA, 25 bp, Mus musculus
aaggctcgtgccctgcactagtctc

SEQ ID NO: 437962 - DNA, 25 bp, Mus musculus
gctaaatgctacagacccgcacagg

SEQ ID NO: 437963 - DNA, 25 bp, Mus musculus
tctccatggtaacggccaggcggac

SEQ ID NO: 437964 - DNA, 25 bp, Mus musculus
ctgaggtgactttccgttaagcgtc

SEQ ID NO: 437965 - DNA, 25 bp, Mus musculus
gttaagcgtcgagggttacacgcga

SEQ ID NO: 437966 - DNA, 25 bp, Mus musculus
gctgtcggcttcttcctccgggcag

SEQ ID NO: 437967 - DNA, 25 bp, Mus musculus
cgatcgcatcgagagcttgtggagc

SEQ ID NO: 437968 - DNA, 25 bp, Mus musculus
ctggcttctcccatggcctgttctg

SEQ ID NO: 437969 - DNA, 25 bp, Mus musculus
catggcctgttctgtggccgcctag

SEQ ID NO: 437970 - DNA, 25 bp, Mus musculus
aggccagctcgggtacttgctgtcc

SEQ ID NO: 437971 - DNA, 25 bp, Mus musculus
tgaagtaaacaccacgctaaatgct

SEQ ID NO: 437972 - DNA, 25 bp, Mus musculus
gtgggcaccttgtgcctgtggcctc

SEQ ID NO: 437973 - DNA, 25 bp, Mus musculus
tgtgggcaccttgtgcctgtggcct

SEQ ID NO: 437974 - DNA, 25 bp, Mus musculus
ctcaggacgcgagtgtgggcacctt

SEQ ID NO: 437975 - DNA, 25 bp, Mus musculus
cactcaggacgcgagtgtgggcacc

SEQ ID NO: 437976 - DNA, 25 bp, Mus musculus
ctcgctcactcaggacgcgagtgtg

SEQ ID NO: 437977 - DNA, 25 bp, Mus musculus
gggcctcgctcactcaggacgcgag

SEQ ID NO: 437978 - DNA, 25 bp, Mus musculus
ccagggctcaggatgggtgctggtc

SEQ ID NO: 437979 - DNA, 25 bp, Mus musculus
ccctgtgctcacatagcgggggagc

SEQ ID NO: 437980 - DNA, 25 bp, Mus musculus
agccgccctgtgctcacatagcggg

SEQ ID NO: 437981 - DNA, 25 bp, Mus musculus
tgcgggaggcactgggcccaggcga

SEQ ID NO: 437982 - DNA, 25 bp, Mus musculus
acagcgtcgccaagcaggtgagcgc

SEQ ID NO: 437983 - DNA, 25 bp, Mus musculus
cgccggacccgctgcccggctgtca

SEQ ID NO: 437984 - DNA, 25 bp, Mus musculus
ccgcgcgtcctggaggggacagcgt

SEQ ID NO: 437985 - DNA, 25 bp, Mus musculus
tgtgcctgtggcctccccacgagga

SEQ ID NO: 437986 - DNA, 25 bp, Mus musculus
acgctcagcagccagccaatcggag

SEQ ID NO: 437987 - DNA, 25 bp, Mus musculus
gagatgcccggaggctaaaccgcca

SEQ ID NO: 437988 - DNA, 25 bp, Mus musculus
aggcgagcattacagcggccctttc

SEQ ID NO: 437989 - DNA, 25 bp, Mus musculus
cgcactagggccttgaaatagaatg

SEQ ID NO: 437990 - DNA, 25 bp, Mus musculus
tgcagctattcctccgcttgtgggc

SEQ ID NO: 437991 - DNA, 25 bp, Mus musculus
ttctccttttccgagctgcttctgc

SEQ ID NO: 437992 - DNA, 25 bp, Mus musculus
tctgagagaggcgaggcctacgatt

SEQ ID NO: 437993 - DNA, 25 bp, Mus musculus
cgagaggaggaaacgacgctaccgc

SEQ ID NO: 437994 - DNA, 25 bp, Mus musculus
acagcagctagctcagagagtcggc

SEQ ID NO: 437995 - DNA, 25 bp, Mus musculus
ggacccgctcgagaacagcagctag

SEQ ID NO: 437996 - DNA, 25 bp, Mus musculus
tgcagtccagcagaggaagacggca

SEQ ID NO: 437997 - DNA, 25 bp, Mus musculus
gcagcttcctgcgactgcagtccag

SEQ ID NO: 437998 - DNA, 25 bp, Mus musculus
tgggaccctctactcacaggctgga

SEQ ID NO: 437999 - DNA, 25 bp, Mus musculus
gacgcaacgtactcacgctcagcag

SEQ ID NO: 438000 - DNA, 25 bp, Mus musculus
acaaagtggcgagctgcgacgtgac

SEQ ID NO: 438001 - DNA, 25 bp, Mus musculus
gcggcacggaatccgcggtgccctt

SEQ ID NO: 438002 - DNA, 25 bp, Mus musculus
tacttaggactcgtggcatacccgc

SEQ ID NO: 438003 - DNA, 25 bp, Mus musculus
aggccgcttcacgtggtgcactcct

SEQ ID NO: 438004 - DNA, 25 bp, Mus musculus
aagagggacgacctgaggccgcttc

SEQ ID NO: 438005 - DNA, 25 bp, Mus musculus
gctgcctactctaggcgcctggaga

SEQ ID NO: 438006 - DNA, 25 bp, Mus musculus
ggagacgcttccagcgctgcctact

SEQ ID NO: 438007 - DNA, 25 bp, Mus musculus
ccctcagagcgctgataaggatgtg

SEQ ID NO: 438008 - DNA, 25 bp, Mus musculus
accttgaggcgctgggcacagcgtc

SEQ ID NO: 438009 - DNA, 25 bp, Mus musculus
acataacggttagtccgggctgagc

SEQ ID NO: 438010 - DNA, 25 bp, Mus musculus
cgccgcgagacacacataacggtta

SEQ ID NO: 438011 - DNA, 25 bp, Mus musculus
tcggtcgtgtaggtgcagcagccaa

SEQ ID NO: 438012 - DNA, 25 bp, Mus musculus
cgggttataaggcagccgcgcctgc

SEQ ID NO: 438013 - DNA, 25 bp, Mus musculus
cagggtccgccctcagggcagtttt

SEQ ID NO: 438014 - DNA, 25 bp, Mus musculus
ggccacggaacagactcacatctct

SEQ ID NO: 438015 - DNA, 25 bp, Mus musculus
tcttcaaggcgctgcaagccgactc

SEQ ID NO: 438016 - DNA, 25 bp, Mus musculus
atgctatcttcaaggcgctgcaagc

SEQ ID NO: 438017 - DNA, 25 bp, Mus musculus
tcctaatgctatcttcaaggcgctg

SEQ ID NO: 438018 - DNA, 25 bp, Mus musculus
cagactcacatctctcctaatgcta

SEQ ID NO: 438019 - DNA, 25 bp, Mus musculus
gaacagactcacatctctcctaatg

SEQ ID NO: 438020 - DNA, 25 bp, Mus musculus
tgaagaacggacaagcggaggccga

SEQ ID NO: 438021 - DNA, 25 bp, Mus musculus
ggaagtcggtgaagaacggacaagc

SEQ ID NO: 438022 - DNA, 25 bp, Mus musculus
cgattacaagtaccagccccggcgg

SEQ ID NO: 438023 - DNA, 25 bp, Mus musculus
gcgtgcagcacaagaaagaccaccc

SEQ ID NO: 438024 - DNA, 25 bp, Mus musculus
ctgcgcgtgcagcacaagaaagacc

SEQ ID NO: 438025 - DNA, 25 bp, Mus musculus
agagcgagaagagacccttcgtgga

SEQ ID NO: 438026 - DNA, 25 bp, Mus musculus
cgagagcgagaagagacccttcgtg

SEQ ID NO: 438027 - DNA, 25 bp, Mus musculus
agaggccacggaacagactcacatc

SEQ ID NO: 438028 - DNA, 25 bp, Mus musculus
accggtggacttcctagcggtctgc

SEQ ID NO: 438029 - DNA, 25 bp, Mus musculus
ccaccggtggacttcctagcggtct

SEQ ID NO: 438030 - DNA, 25 bp, Mus musculus
caacgaacgaccaaaccgctctgcg

SEQ ID NO: 438031 - DNA, 25 bp, Mus musculus
acttcctagcggtctgcttggttcg

SEQ ID NO: 438032 - DNA, 25 bp, Mus musculus
cggtctgcttggttcgggccatttt

SEQ ID NO: 438033 - DNA, 25 bp, Mus musculus
aggcgacgctggaagcgctcgaaca

SEQ ID NO: 438034 - DNA, 25 bp, Mus musculus
cgctggaagcgctcgaacaagagcc

SEQ ID NO: 438035 - DNA, 25 bp, Mus musculus
tggaagcgctcgaacaagagccgca

SEQ ID NO: 438036 - DNA, 25 bp, Mus musculus
tttccgagccgccttggtggccagc

SEQ ID NO: 438037 - DNA, 25 bp, Mus musculus
gcgctcgaacaagagccgcaatcgg

SEQ ID NO: 438038 - DNA, 25 bp, Mus musculus
agcagaacgggcagatactccacca

SEQ ID NO: 438039 - DNA, 25 bp, Mus musculus
gaacgggcagatactccaccaacga

SEQ ID NO: 438040 - DNA, 25 bp, Mus musculus
cgggcagatactccaccaacgaacg

SEQ ID NO: 438041 - DNA, 25 bp, Mus musculus
ggcagatactccaccaacgaacgac

SEQ ID NO: 438042 - DNA, 25 bp, Mus musculus
tgcaccgagctgagtatgtatcgcc

SEQ ID NO: 438043 - DNA, 25 bp, Mus musculus
cattgagaggagtccgaggttaacc

SEQ ID NO: 438044 - DNA, 25 bp, Mus musculus
gagaggttctggacccagagctgcc

SEQ ID NO: 438045 - DNA, 25 bp, Mus musculus
ccagagctgcctcagaggttgtgcg

SEQ ID NO: 438046 - DNA, 25 bp, Mus musculus
ccgcagttttgcgattgcgacacta

SEQ ID NO: 438047 - DNA, 25 bp, Mus musculus
ttgcgattgcgacactaggtcagtc

SEQ ID NO: 438048 - DNA, 25 bp, Mus musculus
acactaggtcagtcccaccgcgagg

SEQ ID NO: 438049 - DNA, 25 bp, Mus musculus
ggcgctgctcatgcagacgcccgga

SEQ ID NO: 438050 - DNA, 25 bp, Mus musculus
tgctcatgcagacgcccggagtcta

SEQ ID NO: 438051 - DNA, 25 bp, Mus musculus
cgctcagctgcgacccttgcatcca

SEQ ID NO: 438052 - DNA, 25 bp, Mus musculus
cggagtctagagctctgcaccgagc

SEQ ID NO: 438053 - DNA, 25 bp, Mus musculus
ctgagtatgtatcgcctgctgtgga

SEQ ID NO: 438054 - DNA, 25 bp, Mus musculus
tatgtatcgcctgctgtggaggcct

SEQ ID NO: 438055 - DNA, 25 bp, Mus musculus
acgcccggagtctagagctctgcac

SEQ ID NO: 438056 - DNA, 25 bp, Mus musculus
acgaccttcttcaggaccttgttca

SEQ ID NO: 438057 - DNA, 25 bp, Mus musculus
ccctttgacactcaggcgggacaaa

SEQ ID NO: 438058 - DNA, 25 bp, Mus musculus
ggtggaaagactcgctcatccgctt

SEQ ID NO: 438059 - DNA, 25 bp, Mus musculus
ggactagttccttttgccagggaga

SEQ ID NO: 438060 - DNA, 25 bp, Mus musculus
gggtgcaaattccacgaccttcttc

SEQ ID NO: 438061 - DNA, 25 bp, Mus musculus
gacgcatcccggcttcaggaaccat

SEQ ID NO: 438062 - DNA, 25 bp, Mus musculus
cccagacgaggatgggactcccatt

SEQ ID NO: 438063 - DNA, 25 bp, Mus musculus
tgccctggagcacaggctatgccga

SEQ ID NO: 438064 - DNA, 25 bp, Mus musculus
tgtgagcttctctcgacccaccttt

SEQ ID NO: 438065 - DNA, 25 bp, Mus musculus
agaccgcggagactactgtgagctt

SEQ ID NO: 438066 - DNA, 25 bp, Mus musculus
cagcatgctaaaccgggtgcgctca

SEQ ID NO: 438067 - DNA, 25 bp, Mus musculus
tcgttccgcttctttcccacaatag

SEQ ID NO: 438068 - DNA, 25 bp, Mus musculus
tagcggatgtctaacctacagcatg

SEQ ID NO: 438069 - DNA, 25 bp, Mus musculus
cgccgcccaagaaacacctaagagt

SEQ ID NO: 438070 - DNA, 25 bp, Mus musculus
agcaatccagacatctccgggcaca

SEQ ID NO: 438071 - DNA, 25 bp, Mus musculus
cgattcccggatcgctccgggagcg

SEQ ID NO: 438072 - DNA, 25 bp, Mus musculus
ggagagcactttcccgattcccgga

SEQ ID NO: 438073 - DNA, 25 bp, Mus musculus
tgacctcggaggagagcactttccc

SEQ ID NO: 438074 - DNA, 25 bp, Mus musculus
atccagacatctccgggcacagttc

SEQ ID NO: 438075 - DNA, 25 bp, Mus musculus
gcccgctcaccacccagcaatccag

SEQ ID NO: 438076 - DNA, 25 bp, Mus musculus
gcagaggccgagttatccggggtcc

SEQ ID NO: 438077 - DNA, 25 bp, Mus musculus
gccgctcaactttcccgaagctggt

SEQ ID NO: 438078 - DNA, 25 bp, Mus musculus
ctggaagccgctcaactttcccgaa

SEQ ID NO: 438079 - DNA, 25 bp, Mus musculus
agggcagcagtggccctcgctgacc

SEQ ID NO: 438080 - DNA, 25 bp, Mus musculus
cttcgaggtctggatggccacgcga

SEQ ID NO: 438081 - DNA, 25 bp, Mus musculus
aaatactggagcttcgaggtctgga

SEQ ID NO: 438082 - DNA, 25 bp, Mus musculus
agggtgtaggaaatactggagcttc

SEQ ID NO: 438083 - DNA, 25 bp, Mus musculus
gggtcagtctcagcctccggcactg

SEQ ID NO: 438084 - DNA, 25 bp, Mus musculus
aatgaaactgaaagtcgccgccgcg

SEQ ID NO: 438085 - DNA, 25 bp, Mus musculus
acgacggagtaggtctgccaggacc

SEQ ID NO: 438086 - DNA, 25 bp, Mus musculus
cggcccgtacctgggcttgaagtcg

SEQ ID NO: 438087 - DNA, 25 bp, Mus musculus
cctgggcttgaagtcgtggttgtaa

SEQ ID NO: 438088 - DNA, 25 bp, Mus musculus
tcgtggttgtaaatcgtccgcagcc

SEQ ID NO: 438089 - DNA, 25 bp, Mus musculus
gtaaatcgtccgcagccgctcacga

SEQ ID NO: 438090 - DNA, 25 bp, Mus musculus
tgtctccaggtccagtccacgttcg

SEQ ID NO: 438091 - DNA, 25 bp, Mus musculus
gtccagtccacgttcggccagaaaa

SEQ ID NO: 438092 - DNA, 25 bp, Mus musculus
tccacgttcggccagaaaactctcg

SEQ ID NO: 438093 - DNA, 25 bp, Mus musculus
agaaaactctcgaacctctggccgg

SEQ ID NO: 438094 - DNA, 25 bp, Mus musculus
tcccggagctttcggcagctgaact

SEQ ID NO: 438095 - DNA, 25 bp, Mus musculus
tcggcagctgaacttgctaggcatc

SEQ ID NO: 438096 - DNA, 25 bp, Mus musculus
gagggtccgcggaaatgaaactgaa

SEQ ID NO: 438097 - DNA, 25 bp, Mus musculus
ctgaacttgctaggcatcgcggcgg

SEQ ID NO: 438098 - DNA, 25 bp, Mus musculus
gcgccacactgagtccgtttccaga

SEQ ID NO: 438099 - DNA, 25 bp, Mus musculus
gacaggttaccctcaaccacgtatg

SEQ ID NO: 438100 - DNA, 25 bp, Mus musculus
tcggggctttgcagccttaacatct

SEQ ID NO: 438101 - DNA, 25 bp, Mus musculus
ttctccctgagttccggtcactttc

SEQ ID NO: 438102 - DNA, 25 bp, Mus musculus
cggtcactttcccattcgtcctgga

SEQ ID NO: 438103 - DNA, 25 bp, Mus musculus
ccctctggtcatggagcagttgcta

SEQ ID NO: 438104 - DNA, 25 bp, Mus musculus
gcagttgctacacctctaagttttt

SEQ ID NO: 438105 - DNA, 25 bp, Mus musculus
ttttctgatccggttggtctcctgg

SEQ ID NO: 438106 - DNA, 25 bp, Mus musculus
gaggccagcttcaagtccgccacta

SEQ ID NO: 438107 - DNA, 25 bp, Mus musculus
agctgctcggctctttgagacatca

SEQ ID NO: 438108 - DNA, 25 bp, Mus musculus
ctgctttacgctctgagggtcccgc

SEQ ID NO: 438109 - DNA, 25 bp, Mus musculus
ttccagaagaataagcgccaccatc

SEQ ID NO: 438110 - DNA, 25 bp, Mus musculus
ccatgcacctgttcctggcttgggc

SEQ ID NO: 438111 - DNA, 25 bp, Mus musculus
ccgagtccagggcactaagagctgc

SEQ ID NO: 438112 - DNA, 25 bp, Mus musculus
gccagacgcagggttcccaagagcg

SEQ ID NO: 438113 - DNA, 25 bp, Mus musculus
ccatccttgcgcttctaggaaactg

SEQ ID NO: 438114 - DNA, 25 bp, Mus musculus
cgaggacctcaaggcacgtggagcc

SEQ ID NO: 438115 - DNA, 25 bp, Mus musculus
ggttgcggacacttccagttcttta

SEQ ID NO: 438116 - DNA, 25 bp, Mus musculus
tttgatggcaaggagcacacggtgt

SEQ ID NO: 438117 - DNA, 25 bp, Mus musculus
acgcggaccactgcgtttgatggca

SEQ ID NO: 438118 - DNA, 25 bp, Mus musculus
gatgcactttctcttggtcctccca

SEQ ID NO: 438119 - DNA, 25 bp, Mus musculus
tagacacccggccagcaagagttgc

SEQ ID NO: 438120 - DNA, 25 bp, Mus musculus
ggatagtgggactcctttggccaca

SEQ ID NO: 438121 - DNA, 25 bp, Mus musculus
gggcagcgcagccacccaagaaaca

SEQ ID NO: 438122 - DNA, 25 bp, Mus musculus
ttgagagtcttgtccaccttggtgc

SEQ ID NO: 438123 - DNA, 25 bp, Mus musculus
gcttcctcaggcgtctcctagatcg

SEQ ID NO: 438124 - DNA, 25 bp, Mus musculus
ctttggccacactgccctcaggggt

SEQ ID NO: 438125 - DNA, 25 bp, Mus musculus
ggcggaccctctcaagaaggactca

SEQ ID NO: 438126 - DNA, 25 bp, Mus musculus
gggacccgactgagcgagcccagac

SEQ ID NO: 438127 - DNA, 25 bp, Mus musculus
agtcctttgcaacgctcgcggccgg

SEQ ID NO: 438128 - DNA, 25 bp, Mus musculus
acgcacggacgtggcccagagagac

SEQ ID NO: 438129 - DNA, 25 bp, Mus musculus
ctttgcaacgctcgcggccggctgg

SEQ ID NO: 438130 - DNA, 25 bp, Mus musculus
aggcccggttgctctctgtgggaat

SEQ ID NO: 438131 - DNA, 25 bp, Mus musculus
agcgagcccagacgcccagtccttt

SEQ ID NO: 438132 - DNA, 25 bp, Mus musculus
gtggcccagagagacgccgcagacc

SEQ ID NO: 438133 - DNA, 25 bp, Mus musculus
tcacaacgcacggacgtggcccaga

SEQ ID NO: 438134 - DNA, 25 bp, Mus musculus
ctaggcgtcacaacgcacggacgtg

SEQ ID NO: 438135 - DNA, 25 bp, Mus musculus
tgttctaggcgtcacaacgcacgga

SEQ ID NO: 438136 - DNA, 25 bp, Mus musculus
catccctctgttctaggcgtcacaa

SEQ ID NO: 438137 - DNA, 25 bp, Mus musculus
agcccgcggaccactctcgccgcca

SEQ ID NO: 438138 - DNA, 25 bp, Mus musculus
cccggttgctctctgtgggaatggt

SEQ ID NO: 438139 - DNA, 25 bp, Mus musculus
cggctggaatgcaccccgtgcgcag

SEQ ID NO: 438140 - DNA, 25 bp, Mus musculus
cggctggactaacgtctacccatta

SEQ ID NO: 438141 - DNA, 25 bp, Mus musculus
gattgacgccctccgtgcgatttca

SEQ ID NO: 438142 - DNA, 25 bp, Mus musculus
gcctgttttcggcagccgtaaagcg

SEQ ID NO: 438143 - DNA, 25 bp, Mus musculus
ggactcgcgttacctgagcggcgcc

SEQ ID NO: 438144 - DNA, 25 bp, Mus musculus
ccactcggggaagacagcgcgacat

SEQ ID NO: 438145 - DNA, 25 bp, Mus musculus
gtgatggggatgctcgacacccgac

SEQ ID NO: 438146 - DNA, 25 bp, Mus musculus
cgtctacccattaacttagttcagg

SEQ ID NO: 438147 - DNA, 25 bp, Mus musculus
gtttcttcgcagctcggctggacta

SEQ ID NO: 438148 - DNA, 25 bp, Mus musculus
gcggagtttcctaagtttcttcgca

SEQ ID NO: 438149 - DNA, 25 bp, Mus musculus
actgcgagtgcctcgctgcgagaga

SEQ ID NO: 438150 - DNA, 25 bp, Mus musculus
agcgtcgcctcctcgcgggtgtcaa

SEQ ID NO: 438151 - DNA, 25 bp, Mus musculus
cgctcgtggctgactgaagtaaaca

SEQ ID NO: 438152 - DNA, 25 bp, Mus musculus
ccctgtttatcgtttgcgccctacg

SEQ ID NO: 438153 - DNA, 25 bp, Mus musculus
ctgaagtaaacactgcgagtgcctc

SEQ ID NO: 438154 - DNA, 25 bp, Mus musculus
cggaggctagcgagagacaatgaac

SEQ ID NO: 438155 - DNA, 25 bp, Mus musculus
tacccttgcggctctgaaaccaatc

SEQ ID NO: 438156 - DNA, 25 bp, Mus musculus
tagctttacccttgcggctctgaaa

SEQ ID NO: 438157 - DNA, 25 bp, Mus musculus
ctcgccaatcatagctttacccttg

SEQ ID NO: 438158 - DNA, 25 bp, Mus musculus
caggcagataccctcgccaatcata

SEQ ID NO: 438159 - DNA, 25 bp, Mus musculus
gcggcagtgacaggcagataccctc

SEQ ID NO: 438160 - DNA, 25 bp, Mus musculus
agcccacgctccgtacctggcctcg

SEQ ID NO: 438161 - DNA, 25 bp, Mus musculus
ggccaggaggctctctcggagaccc

SEQ ID NO: 438162 - DNA, 25 bp, Mus musculus
tctgctgaaagccactcacgctccg

SEQ ID NO: 438163 - DNA, 25 bp, Mus musculus
cccgacagggacttctgctgaaagc

SEQ ID NO: 438164 - DNA, 25 bp, Mus musculus
cctccttggggaatcccgggatctg

SEQ ID NO: 438165 - DNA, 25 bp, Mus musculus
atgccgcgacgcctccttggggaat

SEQ ID NO: 438166 - DNA, 25 bp, Mus musculus
agacaatgaacaatcgtaaagaccc

SEQ ID NO: 438167 - DNA, 25 bp, Mus musculus
tgaaaccaatcctcgccgcctgaag

SEQ ID NO: 438168 - DNA, 25 bp, Mus musculus
catcggtgaactgagcagcgacgtc

SEQ ID NO: 438169 - DNA, 25 bp, Mus musculus
agaactccggctcctactacagtca

SEQ ID NO: 438170 - DNA, 25 bp, Mus musculus
acaccttggcaaccagggagagtcc

SEQ ID NO: 438171 - DNA, 25 bp, Mus musculus
ctcctaagagtaggggctttgcaaa

SEQ ID NO: 438172 - DNA, 25 bp, Mus musculus
gcaaagcgcttgttgattttttacc

SEQ ID NO: 438173 - DNA, 25 bp, Mus musculus
ctcttttatggcctgcagggcaatc

SEQ ID NO: 438174 - DNA, 25 bp, Mus musculus
ccgacgtgcaagctggcaaagttga

SEQ ID NO: 438175 - DNA, 25 bp, Mus musculus
acttccgcgacgtggacatcggtga

SEQ ID NO: 438176 - DNA, 25 bp, Mus musculus
gcagcgacgtcatctccaacattga

SEQ ID NO: 438177 - DNA, 25 bp, Mus musculus
ttgaccaatacttgccacccaacgg

SEQ ID NO: 438178 - DNA, 25 bp, Mus musculus
tacactggcagttacggcatcagca

SEQ ID NO: 438179 - DNA, 25 bp, Mus musculus
aacgcacatcaagacggagcagctg

SEQ ID NO: 438180 - DNA, 25 bp, Mus musculus
gagaccttcgacgtcaatgagtttg

SEQ ID NO: 438181 - DNA, 25 bp, Mus musculus
tcgcaatacgactacgctgaccatc

SEQ ID NO: 438182 - DNA, 25 bp, Mus musculus
ccctccgcagcctggccgctctgct

SEQ ID NO: 438183 - DNA, 25 bp, Mus musculus
cctctgccctcttgccattggcctg

SEQ ID NO: 438184 - DNA, 25 bp, Mus musculus
cacaccctcgcgcagagtcactccc

SEQ ID NO: 438185 - DNA, 25 bp, Mus musculus
cgcctcctcgggagaggcagcccgt

SEQ ID NO: 438186 - DNA, 25 bp, Mus musculus
gaccgacgcacgaaccgaccgagtg

SEQ ID NO: 438187 - DNA, 25 bp, Mus musculus
cgcacgaaccgaccgagtgaaggag

SEQ ID NO: 438188 - DNA, 25 bp, Mus musculus
acgagcgagacttcgccggcgagga

SEQ ID NO: 438189 - DNA, 25 bp, Mus musculus
cctggcctcagcttcctcgcgcgcg

SEQ ID NO: 438190 - DNA, 25 bp, Mus musculus
agagggaaacgaccgagcctcccag

SEQ ID NO: 438191 - DNA, 25 bp, Mus musculus
agcctcccagagacagcaagtgcga

SEQ ID NO: 438192 - DNA, 25 bp, Mus musculus
acagcaagtgcgaggagcgctgctc

SEQ ID NO: 438193 - DNA, 25 bp, Mus musculus
caagtgcgaggagcgctgctcccac

SEQ ID NO: 438194 - DNA, 25 bp, Mus musculus
aggggacacgctgccaagcccgggc

SEQ ID NO: 438195 - DNA, 25 bp, Mus musculus
tgctcccacgcctgttgctcccgct

SEQ ID NO: 438196 - DNA, 25 bp, Mus musculus
atgaatgcatctctgcctacgacga

SEQ ID NO: 438197 - DNA, 25 bp, Mus musculus
gggaagctgcactacccacgctatg

SEQ ID NO: 438198 - DNA, 25 bp, Mus musculus
cgttgtgtgcttaacttctaccgca

SEQ ID NO: 438199 - DNA, 25 bp, Mus musculus
cggaagtgttccgttgtgtgcttaa

SEQ ID NO: 438200 - DNA, 25 bp, Mus musculus
caatgaggacacgaaggagtacttc

SEQ ID NO: 438201 - DNA, 25 bp, Mus musculus
aaggagttcttcttcaatgaggaca

SEQ ID NO: 438202 - DNA, 25 bp, Mus musculus
tatcccgacaccttgctgggtagca

SEQ ID NO: 438203 - DNA, 25 bp, Mus musculus
ggaccactctggagcgctatcccga

SEQ ID NO: 438204 - DNA, 25 bp, Mus musculus
gttccagacctggaggaccactctg

SEQ ID NO: 438205 - DNA, 25 bp, Mus musculus
gctgatcgtcctcaacgtaagtgga

SEQ ID NO: 438206 - DNA, 25 bp, Mus musculus
caagcggcaagacgagctgatcgtc

SEQ ID NO: 438207 - DNA, 25 bp, Mus musculus
tgctgctacgaggagtacaaagacc

SEQ ID NO: 438208 - DNA, 25 bp, Mus musculus
cgagatcatcggagactgctgctac

SEQ ID NO: 438209 - DNA, 25 bp, Mus musculus
cctacgacgatgaactggccttcta

SEQ ID NO: 438210 - DNA, 25 bp, Mus musculus
cgctttgtgacgcagctcgcgaatc

SEQ ID NO: 438211 - DNA, 25 bp, Mus musculus
ctctctcggaaaccctaggctaata

SEQ ID NO: 438212 - DNA, 25 bp, Mus musculus
acgctccgcagccatagtggactcg

SEQ ID NO: 438213 - DNA, 25 bp, Mus musculus
gcgcctccagatctcgcgatattta

SEQ ID NO: 438214 - DNA, 25 bp, Mus musculus
gaagtcggaggctgtcactctagga

SEQ ID NO: 438215 - DNA, 25 bp, Mus musculus
ttgggtcaagctcggctgtagccac

SEQ ID NO: 438216 - DNA, 25 bp, Mus musculus
tgtagccacgccgaagtcttcgcga

SEQ ID NO: 438217 - DNA, 25 bp, Mus musculus
agtcttcgcgatccgtaccctgtcg

SEQ ID NO: 438218 - DNA, 25 bp, Mus musculus
cgcgtgacggaagtctcctgatatt

SEQ ID NO: 438219 - DNA, 25 bp, Mus musculus
taagtggaaacctggactgcacgcc

SEQ ID NO: 438220 - DNA, 25 bp, Mus musculus
acgccaactcctaggctctgcttga

SEQ ID NO: 438221 - DNA, 25 bp, Mus musculus
gctctgcttgatcgctctctcggaa

SEQ ID NO: 438222 - DNA, 25 bp, Mus musculus
ctaggctaatagacgtctcgggtcc

SEQ ID NO: 438223 - DNA, 25 bp, Mus musculus
aactttattggcagcctcccggaga

SEQ ID NO: 438224 - DNA, 25 bp, Mus musculus
atcccgggcattgagcggcagcagc

SEQ ID NO: 438225 - DNA, 25 bp, Mus musculus
ctatcccgggcattgagcggcagca

SEQ ID NO: 438226 - DNA, 25 bp, Mus musculus
cggtgacagactttctcgggtcgcc

SEQ ID NO: 438227 - DNA, 25 bp, Mus musculus
ccctatcccgggcattgagcggcag

SEQ ID NO: 438228 - DNA, 25 bp, Mus musculus
ctgaggctcggctcagcgcggataa

SEQ ID NO: 438229 - DNA, 25 bp, Mus musculus
cagcggggaacgccgctctaagtcc

SEQ ID NO: 438230 - DNA, 25 bp, Mus musculus
tctcattggctgctgcacttttcct

SEQ ID NO: 438231 - DNA, 25 bp, Mus musculus
ttctcattggctgctgcacttttcc

SEQ ID NO: 438232 - DNA, 25 bp, Mus musculus
tctgagttctcattggctgctgcac

SEQ ID NO: 438233 - DNA, 25 bp, Mus musculus
ccttctgagttctcattggctgctg

SEQ ID NO: 438234 - DNA, 25 bp, Mus musculus
cattggccgaagataccccttctga

SEQ ID NO: 438235 - DNA, 25 bp, Mus musculus
ctcgggtcgccaggcccgagcaccc

SEQ ID NO: 438236 - DNA, 25 bp, Mus musculus
tgacagactttctcgggtcgccagg

SEQ ID NO: 438237 - DNA, 25 bp, Mus musculus
ctctaagtccccacgctggagctga

SEQ ID NO: 438238 - DNA, 25 bp, Mus musculus
cccgggcttgtctgccagcagggag

SEQ ID NO: 438239 - DNA, 25 bp, Mus musculus
ttctcttgcctctctctcctcttgt

SEQ ID NO: 438240 - DNA, 25 bp, Mus musculus
gtgaattctgatttctttctcttgc

SEQ ID NO: 438241 - DNA, 25 bp, Mus musculus
agccaggtgaattctgatttctttc

SEQ ID NO: 438242 - DNA, 25 bp, Mus musculus
gggaagccaggtgaattctgatttc

SEQ ID NO: 438243 - DNA, 25 bp, Mus musculus
tgtgttagggaagccaggtgaattc

SEQ ID NO: 438244 - DNA, 25 bp, Mus musculus
ctgttaaggctgtgttagggaagcc

SEQ ID NO: 438245 - DNA, 25 bp, Mus musculus
ataagtgactgttaaggctgtgtta

SEQ ID NO: 438246 - DNA, 25 bp, Mus musculus
cactgaagagggataagtgactgtt

SEQ ID NO: 438247 - DNA, 25 bp, Mus musculus
ctgagggtgagtatgctaccctgga

SEQ ID NO: 438248 - DNA, 25 bp, Mus musculus
tcggccagatgtcaggtctgggctt

SEQ ID NO: 438249 - DNA, 25 bp, Mus musculus
tcgctcgctcgtggggagctggcac

SEQ ID NO: 438250 - DNA, 25 bp, Mus musculus
caggaggtcaggctggactgctcgc

SEQ ID NO: 438251 - DNA, 25 bp, Mus musculus
gtgctgagggtgagtatgctaccct

SEQ ID NO: 438252 - DNA, 25 bp, Mus musculus
cgcaggaatgacaggcacaggcatc

SEQ ID NO: 438253 - DNA, 25 bp, Mus musculus
gacacacccagaggggacaggcaca

SEQ ID NO: 438254 - DNA, 25 bp, Mus musculus
tggacaagtaacagggagtcagagc

SEQ ID NO: 438255 - DNA, 25 bp, Mus musculus
ggagtcagagcacccagataagttg

SEQ ID NO: 438256 - DNA, 25 bp, Mus musculus
cccagataagttgaatgtgacagaa

SEQ ID NO: 438257 - DNA, 25 bp, Mus musculus
aggtccctgccctgtgcaggaggtc

SEQ ID NO: 438258 - DNA, 25 bp, Mus musculus
agagaaaggaggacacacccagagg

SEQ ID NO: 438259 - DNA, 25 bp, Mus musculus
cctgccctgtgcaggaggtcaggct

SEQ ID NO: 438260 - DNA, 25 bp, Mus musculus
acccagaggggacaggcacacggac

SEQ ID NO: 438261 - DNA, 25 bp, Mus musculus
cacacggacggagtaaggctcaagt

SEQ ID NO: 438262 - DNA, 25 bp, Mus musculus
gtaaggctcaagtgtccagagtcgc

SEQ ID NO: 438263 - DNA, 25 bp, Mus musculus
tcaagtgtccagagtcgcaggaatg

SEQ ID NO: 438264 - DNA, 25 bp, Mus musculus
acaggcacaggcatcgggcgccagt

SEQ ID NO: 438265 - DNA, 25 bp, Mus musculus
tgtgacagaacaactgaagagaaag

SEQ ID NO: 438266 - DNA, 25 bp, Mus musculus
tcgcggacggttaagaataggccac

SEQ ID NO: 438267 - DNA, 25 bp, Mus musculus
caccgtggcctctttcctgacaaaa

SEQ ID NO: 438268 - DNA, 25 bp, Mus musculus
gtggcctctttcctgacaaaattca

SEQ ID NO: 438269 - DNA, 25 bp, Mus musculus
gtgggcggaagaccggaatcacacc

SEQ ID NO: 438270 - DNA, 25 bp, Mus musculus
ctgacaaaattcaggggtagcagca

SEQ ID NO: 438271 - DNA, 25 bp, Mus musculus
gggtagcagcagatatcagagagtc

SEQ ID NO: 438272 - DNA, 25 bp, Mus musculus
atcagagagtcgagagcgacgctgc

SEQ ID NO: 438273 - DNA, 25 bp, Mus musculus
gcgacgctgcaaaggcgaacacatg

SEQ ID NO: 438274 - DNA, 25 bp, Mus musculus
cgaacacatggcaagcggcagaata

SEQ ID NO: 438275 - DNA, 25 bp, Mus musculus
accggaatcacaccgtggcctcttt

SEQ ID NO: 438276 - DNA, 25 bp, Mus musculus
cggactcgcggacggttaagaatag

SEQ ID NO: 438277 - DNA, 25 bp, Mus musculus
ttaagaataggccaccgaggtgcgg

SEQ ID NO: 438278 - DNA, 25 bp, Mus musculus
taggccaccgaggtgcggccagtcc

SEQ ID NO: 438279 - DNA, 25 bp, Mus musculus
catggcaagcggcagaatacagagg

SEQ ID NO: 438280 - DNA, 25 bp, Mus musculus
tcagacacggggctggaaatacaca

SEQ ID NO: 438281 - DNA, 25 bp, Mus musculus
aatcgtggagatgcggaaggacacc

SEQ ID NO: 438282 - DNA, 25 bp, Mus musculus
gggtctctcgtcgagtctgggtcta

SEQ ID NO: 438283 - DNA, 25 bp, Mus musculus
ttgcgcagaggtacaccacgtgtgc

SEQ ID NO: 438284 - DNA, 25 bp, Mus musculus
cgcgagaagtagagcgaattccctc

SEQ ID NO: 438285 - DNA, 25 bp, Mus musculus
ggctggaagggtagacacaattctc

SEQ ID NO: 438286 - DNA, 25 bp, Mus musculus
tcagctcgctttttctcggaagttc

SEQ ID NO: 438287 - DNA, 25 bp, Mus musculus
tggccgctcgcacatctcgcgagaa

SEQ ID NO: 438288 - DNA, 25 bp, Mus musculus
cccgggacagcattgtctgcgaaga

SEQ ID NO: 438289 - DNA, 25 bp, Mus musculus
gcagcagaaagcaccacccgggaca

SEQ ID NO: 438290 - DNA, 25 bp, Mus musculus
gctaacctaggctctacgtctctca

SEQ ID NO: 438291 - DNA, 25 bp, Mus musculus
tggcttcttcctagtcaccctgcta

SEQ ID NO: 438292 - DNA, 25 bp, Mus musculus
agctctccagatcgctcccgtgggt

SEQ ID NO: 438293 - DNA, 25 bp, Mus musculus
gcccgcatgcatggaacgtcaattg

SEQ ID NO: 438294 - DNA, 25 bp, Mus musculus
cgccgcctccgagccagcctgagac

SEQ ID NO: 438295 - DNA, 25 bp, Mus musculus
ccctcccggatggacgcgctggcgc

SEQ ID NO: 438296 - DNA, 25 bp, Mus musculus
tgcgcctcccgcgtgaaagtgaaag

SEQ ID NO: 438297 - DNA, 25 bp, Mus musculus
gcctcccgcgtgaaagtgaaagttc

SEQ ID NO: 438298 - DNA, 25 bp, Mus musculus
tcccgcgtgaaagtgaaagttccag

SEQ ID NO: 438299 - DNA, 25 bp, Mus musculus
gcgtgaaagtgaaagttccagggcc

SEQ ID NO: 438300 - DNA, 25 bp, Mus musculus
cagggccccaagaaggtcaaggatt

SEQ ID NO: 438301 - DNA, 25 bp, Mus musculus
aggacccgagaagagcggccagccc

SEQ ID NO: 438302 - DNA, 25 bp, Mus musculus
agcctgagactgaaacgcggccagc

SEQ ID NO: 438303 - DNA, 25 bp, Mus musculus
ccagcggggttagtgcgggccacaa

SEQ ID NO: 438304 - DNA, 25 bp, Mus musculus
cgaactataggctcggtgcggcact

SEQ ID NO: 438305 - DNA, 25 bp, Mus musculus
tcaggaacgtggatcagtttgggcg

SEQ ID NO: 438306 - DNA, 25 bp, Mus musculus
cctgagactgaaacgcggccagcgg

SEQ ID NO: 438307 - DNA, 25 bp, Mus musculus
gacccgagaagagcggccagcccag

SEQ ID NO: 438308 - DNA, 25 bp, Mus musculus
agacaaggtcggttccgcgaagcca

SEQ ID NO: 438309 - DNA, 25 bp, Mus musculus
tagcaactccgactccaggcgactg

SEQ ID NO: 438310 - DNA, 25 bp, Mus musculus
actgagtgactgataggcggcagca

SEQ ID NO: 438311 - DNA, 25 bp, Mus musculus
ggcggcagcacgttcacgacacttt

SEQ ID NO: 438312 - DNA, 25 bp, Mus musculus
acgacactttcacgattgccgtaaa

SEQ ID NO: 438313 - DNA, 25 bp, Mus musculus
ctcagaaaaggttgaggcgcgcctc

SEQ ID NO: 438314 - DNA, 25 bp, Mus musculus
acagtgggcctgttctgcactttga

SEQ ID NO: 438315 - DNA, 25 bp, Mus musculus
cgctcggcaggttttctacttgggt

SEQ ID NO: 438316 - DNA, 25 bp, Mus musculus
atgacaactaggctgaggtctccgc

SEQ ID NO: 438317 - DNA, 25 bp, Mus musculus
tcgaagtgtggttcgcaagccaaga

SEQ ID NO: 438318 - DNA, 25 bp, Mus musculus
agccacgcgaacctcggtagcttca

SEQ ID NO: 438319 - DNA, 25 bp, Mus musculus
acctggttccgtgaacttcgtgaca

SEQ ID NO: 438320 - DNA, 25 bp, Mus musculus
cacgaatcacgggagatgacaacta

SEQ ID NO: 438321 - DNA, 25 bp, Mus musculus
tccgcagctacccagttctgtctag

SEQ ID NO: 438322 - DNA, 25 bp, Mus musculus
aaggcgcacccaagcaggctcactg

SEQ ID NO: 438323 - DNA, 25 bp, Mus musculus
agcgcgcagcgcacactcagtgtct

SEQ ID NO: 438324 - DNA, 25 bp, Mus musculus
ccaagcaggctcactgcagaggctg

SEQ ID NO: 438325 - DNA, 25 bp, Mus musculus
cgccgctcggaagactaggagcctc

SEQ ID NO: 438326 - DNA, 25 bp, Mus musculus
gactaggagcctccgcacgagtccg

SEQ ID NO: 438327 - DNA, 25 bp, Mus musculus
tcagtgtctcactcctctcggcttc

SEQ ID NO: 438328 - DNA, 25 bp, Mus musculus
cgggttcgcctttcctgccttggct

SEQ ID NO: 438329 - DNA, 25 bp, Mus musculus
tccgaaccctagcaggccgggatga

SEQ ID NO: 438330 - DNA, 25 bp, Mus musculus
gaaagatgcatgtactcggccaccc

SEQ ID NO: 438331 - DNA, 25 bp, Mus musculus
caggatgcaacgtggagaacgccca

SEQ ID NO: 438332 - DNA, 25 bp, Mus musculus
aacgcccaccgcgagggtgcgcaaa

SEQ ID NO: 438333 - DNA, 25 bp, Mus musculus
caccgcgagggtgcgcaaaaccggc

SEQ ID NO: 438334 - DNA, 25 bp, Mus musculus
cctccgcggactctcagaatcactg

SEQ ID NO: 438335 - DNA, 25 bp, Mus musculus
tggctcccacggactcggttggcct

SEQ ID NO: 438336 - DNA, 25 bp, Mus musculus
cgcgctatctccaggagcggaccgg

SEQ ID NO: 438337 - DNA, 25 bp, Mus musculus
gcgcggagattacgcgcttcgcctc

SEQ ID NO: 438338 - DNA, 25 bp, Mus musculus
caccactgagctctgcgagccgttg

SEQ ID NO: 438339 - DNA, 25 bp, Mus musculus
tgaacactttctgcgccaccactga

SEQ ID NO: 438340 - DNA, 25 bp, Mus musculus
gcgtacagcccgaaacagaagaagt

SEQ ID NO: 438341 - DNA, 25 bp, Mus musculus
tggaggcgcagaaccacagcgtaca

SEQ ID NO: 438342 - DNA, 25 bp, Mus musculus
gaggacgctcgccaggcagcaaagc

SEQ ID NO: 438343 - DNA, 25 bp, Mus musculus
agtcgggcaaggatcctgtggtaca

SEQ ID NO: 438344 - DNA, 25 bp, Mus musculus
tatcctaatagaagcctcgggtttg

SEQ ID NO: 438345 - DNA, 25 bp, Mus musculus
tggcgaatccagactatcctaatag

SEQ ID NO: 438346 - DNA, 25 bp, Mus musculus
acacaatccgcgctaggagaaaccc

SEQ ID NO: 438347 - DNA, 25 bp, Mus musculus
tgagcatcgccaacgcaaacacaca

SEQ ID NO: 438348 - DNA, 25 bp, Mus musculus
acagctctgcgcctttcttctatga

SEQ ID NO: 438349 - DNA, 25 bp, Mus musculus
agccgttgggccattccagcctttt

SEQ ID NO: 438350 - DNA, 25 bp, Mus musculus
cgctgtcgattggaccacgtcataa

SEQ ID NO: 438351 - DNA, 25 bp, Mus musculus
ccctggctctaggagctcggtttta

SEQ ID NO: 438352 - DNA, 25 bp, Mus musculus
agcttgcctgaggtaggagtcttcc

SEQ ID NO: 438353 - DNA, 25 bp, Mus musculus
cgcccacaccctgtgacttaggttg

SEQ ID NO: 438354 - DNA, 25 bp, Mus musculus
tcatggccgcgtcagctgacgttca

SEQ ID NO: 438355 - DNA, 25 bp, Mus musculus
gctcccagtcctctccaaaatgtaa

SEQ ID NO: 438356 - DNA, 25 bp, Mus musculus
tggcgatgctccaagaatctcaaac

SEQ ID NO: 438357 - DNA, 25 bp, Mus musculus
cgccggaaaactgtgagcttgcctg

SEQ ID NO: 438358 - DNA, 25 bp, Mus musculus
cccatcgtggattagcaagtgcagc

SEQ ID NO: 438359 - DNA, 25 bp, Mus musculus
tgatgcgtcacgtagccagaagaga

SEQ ID NO: 438360 - DNA, 25 bp, Mus musculus
cgatccattcgccttggtaaccata

SEQ ID NO: 438361 - DNA, 25 bp, Mus musculus
ctctctgactggctgtgatgcgtca

SEQ ID NO: 438362 - DNA, 25 bp, Mus musculus
gcagactccgatcaggccctgtcgt

SEQ ID NO: 438363 - DNA, 25 bp, Mus musculus
acgccacccgctcgaatttcatagg

SEQ ID NO: 438364 - DNA, 25 bp, Mus musculus
caagcggcgcatgcggtactttgac

SEQ ID NO: 438365 - DNA, 25 bp, Mus musculus
cagggaaggaaagcaccgccgcctc

SEQ ID NO: 438366 - DNA, 25 bp, Mus musculus
cggcgatccagtgacaaagaaggtc

SEQ ID NO: 438367 - DNA, 25 bp, Mus musculus
agctgccgccagacatgaccgtggt

SEQ ID NO: 438368 - DNA, 25 bp, Mus musculus
cccgccgcgggcgagcaagattgct

SEQ ID NO: 438369 - DNA, 25 bp, Mus musculus
ggcgagcgtgtggtcatcaacatct

SEQ ID NO: 438370 - DNA, 25 bp, Mus musculus
tcgagacgcagctcaagaccctctg

SEQ ID NO: 438371 - DNA, 25 bp, Mus musculus
ggtactttgacccactccgcaatga

SEQ ID NO: 438372 - DNA, 25 bp, Mus musculus
cactccgcaatgagtacttcttcga

SEQ ID NO: 438373 - DNA, 25 bp, Mus musculus
gtgcccatcgacatcttctccgagg

SEQ ID NO: 438374 - DNA, 25 bp, Mus musculus
agatccgcttttaccagctgggtga

SEQ ID NO: 438375 - DNA, 25 bp, Mus musculus
agttccgtgaggatgagggcttcct

SEQ ID NO: 438376 - DNA, 25 bp, Mus musculus
ctcttcgaatatccggagagctccg

SEQ ID NO: 438377 - DNA, 25 bp, Mus musculus
gtggtcatcaacatctctgggctgc

SEQ ID NO: 438378 - DNA, 25 bp, Mus musculus
tcagagttcgggctcctgtgtttca

SEQ ID NO: 438379 - DNA, 25 bp, Mus musculus
gctgactgcatagccaccgctggta

SEQ ID NO: 438380 - DNA, 25 bp, Mus musculus
tttaattcgagttcgctgcggggcc

SEQ ID NO: 438381 - DNA, 25 bp, Mus musculus
ctgccacccaggaacatggaggctc

SEQ ID NO: 438382 - DNA, 25 bp, Mus musculus
gaggctctggtacccatctgcaagg

SEQ ID NO: 438383 - DNA, 25 bp, Mus musculus
ttaaggtggcacactctagcggtcc

SEQ ID NO: 438384 - DNA, 25 bp, Mus musculus
cggcattctgctgcgcatgctgcca

SEQ ID NO: 438385 - DNA, 25 bp, Mus musculus
cacttgggtcctcctggttgcattt

SEQ ID NO: 438386 - DNA, 25 bp, Mus musculus
tgcctctcggcaacggagtaaaatg

SEQ ID NO: 438387 - DNA, 25 bp, Mus musculus
aaatgggcttctctgcagtctcttg

SEQ ID NO: 438388 - DNA, 25 bp, Mus musculus
ggctgccgtgaagctctccagccta

SEQ ID NO: 438389 - DNA, 25 bp, Mus musculus
ctccagcctaaaaggaagctagatc

SEQ ID NO: 438390 - DNA, 25 bp, Mus musculus
accgcactgcgcaggaaggggttaa

SEQ ID NO: 438391 - DNA, 25 bp, Mus musculus
aagggtaaatcagtgtccggcattc

SEQ ID NO: 438392 - DNA, 25 bp, Mus musculus
cgtttgtggcccgtcagttgctcag

SEQ ID NO: 438393 - DNA, 25 bp, Mus musculus
gcgctgaatttcgtccctctggaga

SEQ ID NO: 438394 - DNA, 25 bp, Mus musculus
gtgccaaagcactttcacgcacatc

SEQ ID NO: 438395 - DNA, 25 bp, Mus musculus
tagctcttgagaagtttgggaaacg

SEQ ID NO: 438396 - DNA, 25 bp, Mus musculus
tgttcgcagaatcgagtagctcttg

SEQ ID NO: 438397 - DNA, 25 bp, Mus musculus
agcgggtgacttctgcctacggccg

SEQ ID NO: 438398 - DNA, 25 bp, Mus musculus
taaagtttcgttaggcgtgttcgca

SEQ ID NO: 438399 - DNA, 25 bp, Mus musculus
gcagcatttggaggacacgtgagta

SEQ ID NO: 438400 - DNA, 25 bp, Mus musculus
actttggagcagcatttggaggaca

SEQ ID NO: 438401 - DNA, 25 bp, Mus musculus
tcacgtgatcgaggtttgcggtgaa

SEQ ID NO: 438402 - DNA, 25 bp, Mus musculus
cacgcacatcttcccgcgtttgtgg

SEQ ID NO: 438403 - DNA, 25 bp, Mus musculus
atttcgtccctctggagacgccgtc

SEQ ID NO: 438404 - DNA, 25 bp, Mus musculus
cgcctcggtcaagtcacgtgatcga

SEQ ID NO: 438405 - DNA, 25 bp, Mus musculus
accgcgagtgtctgcggaagcgttt

SEQ ID NO: 438406 - DNA, 25 bp, Mus musculus
actctgccctgtaacggtacttcta

SEQ ID NO: 438407 - DNA, 25 bp, Mus musculus
gctgtaactgtgcaagcggctactg

SEQ ID NO: 438408 - DNA, 25 bp, Mus musculus
cctttcattgttgagggtcgccgga

SEQ ID NO: 438409 - DNA, 25 bp, Mus musculus
gctcgtttcacacagcggactcgca

SEQ ID NO: 438410 - DNA, 25 bp, Mus musculus
cgacgctgttattgggttcccaacg

SEQ ID NO: 438411 - DNA, 25 bp, Mus musculus
cccgcctgaggaatttttggtgctc

SEQ ID NO: 438412 - DNA, 25 bp, Mus musculus
cctttcattggtttgtggccacgtc

SEQ ID NO: 438413 - DNA, 25 bp, Mus musculus
ggtcacctgacccaaagcctagaag

SEQ ID NO: 438414 - DNA, 25 bp, Mus musculus
ggccacgtcttttaaatcactatcg

SEQ ID NO: 438415 - DNA, 25 bp, Mus musculus
cggtacttctagcacggcgaacgca

SEQ ID NO: 438416 - DNA, 25 bp, Mus musculus
aatttggctctctccgatctcgcga

SEQ ID NO: 438417 - DNA, 25 bp, Mus musculus
tggacatcagttcaggcgttttttc

SEQ ID NO: 438418 - DNA, 25 bp, Mus musculus
tcactatcgggaagtctggacatca

SEQ ID NO: 438419 - DNA, 25 bp, Mus musculus
tatcttaacggttcctcgcgccagg

SEQ ID NO: 438420 - DNA, 25 bp, Mus musculus
cgaggagcggaacctgctctccgtg

SEQ ID NO: 438421 - DNA, 25 bp, Mus musculus
acaagaatgtgtatgggcggccaga

SEQ ID NO: 438422 - DNA, 25 bp, Mus musculus
ctacaagaatgtgtatgggcggcca

SEQ ID NO: 438423 - DNA, 25 bp, Mus musculus
gtggcctacaagaatgtgtatgggc

SEQ ID NO: 438424 - DNA, 25 bp, Mus musculus
ccgtggcctacaagaatgtgtatgg

SEQ ID NO: 438425 - DNA, 25 bp, Mus musculus
tccgtggcctacaagaatgtgtatg

SEQ ID NO: 438426 - DNA, 25 bp, Mus musculus
tctccgtggcctacaagaatgtgta

SEQ ID NO: 438427 - DNA, 25 bp, Mus musculus
gctctccgtggcctacaagaatgtg

SEQ ID NO: 438428 - DNA, 25 bp, Mus musculus
cctgctctccgtggcctacaagaat

SEQ ID NO: 438429 - DNA, 25 bp, Mus musculus
acctgctctccgtggcctacaagaa

SEQ ID NO: 438430 - DNA, 25 bp, Mus musculus
aacctgctctccgtggcctacaaga

SEQ ID NO: 438431 - DNA, 25 bp, Mus musculus
ggaacctgctctccgtggcctacaa

SEQ ID NO: 438432 - DNA, 25 bp, Mus musculus
aggagcggaacctgctctccgtggc

SEQ ID NO: 438433 - DNA, 25 bp, Mus musculus
agcggaacctgctctccgtggccta

SEQ ID NO: 438434 - DNA, 25 bp, Mus musculus
agacctgggtcgaggactcaaacca

SEQ ID NO: 438435 - DNA, 25 bp, Mus musculus
agcgtaacagcaacaagtcctcgga

SEQ ID NO: 438436 - DNA, 25 bp, Mus musculus
atctcctccttcagacatgttttgg

SEQ ID NO: 438437 - DNA, 25 bp, Mus musculus
aagagttggctttctgtggtgcaca

SEQ ID NO: 438438 - DNA, 25 bp, Mus musculus
tgctcctacggtagccagagctctg

SEQ ID NO: 438439 - DNA, 25 bp, Mus musculus
accctttggctcctagaacgcggcg

SEQ ID NO: 438440 - DNA, 25 bp, Mus musculus
cagagaagcgcacagtcccagagca

SEQ ID NO: 438441 - DNA, 25 bp, Mus musculus
taggggcaagcacaaggatgctctg

SEQ ID NO: 438442 - DNA, 25 bp, Mus musculus
ttgggatttaggcaggcagaaccta

SEQ ID NO: 438443 - DNA, 25 bp, Mus musculus
cccttcccaaggaggcagcgtcaga

SEQ ID NO: 438444 - DNA, 25 bp, Mus musculus
ctgatcataagaagcgctgcggggc

SEQ ID NO: 438445 - DNA, 25 bp, Mus musculus
gacacacaccgagctgatcataaga

SEQ ID NO: 438446 - DNA, 25 bp, Mus musculus
acatgttttggacggaggcttgttc

SEQ ID NO: 438447 - DNA, 25 bp, Mus musculus
ccattcataaatccagcgcggagca

SEQ ID NO: 438448 - DNA, 25 bp, Mus musculus
ccattcggggagcaaacagcgactc

SEQ ID NO: 438449 - DNA, 25 bp, Mus musculus
cagctgtcctgttacctccggagtt

SEQ ID NO: 438450 - DNA, 25 bp, Mus musculus
gggcgcgaacgttctgcttctctag

SEQ ID NO: 438451 - DNA, 25 bp, Mus musculus
tctagccaatgttaccgtcaaggtc

SEQ ID NO: 438452 - DNA, 25 bp, Mus musculus
gctggcctcgctggctcttcattag

SEQ ID NO: 438453 - DNA, 25 bp, Mus musculus
gcgctgttccctcgctttccgaaag

SEQ ID NO: 438454 - DNA, 25 bp, Mus musculus
attagtgctcgcctcttcagctgtc

SEQ ID NO: 438455 - DNA, 25 bp, Mus musculus
tggggcatcctgagctccagaagct

SEQ ID NO: 438456 - DNA, 25 bp, Mus musculus
gctgaagctcaagtccaacctgtgc

SEQ ID NO: 438457 - DNA, 25 bp, Mus musculus
caacctgtgcaggagctgccgtgca

SEQ ID NO: 438458 - DNA, 25 bp, Mus musculus
gtgcacccttgacgcgccagaacgt

SEQ ID NO: 438459 - DNA, 25 bp, Mus musculus
ttgcacgctttcaggcctttcaggc

SEQ ID NO: 438460 - DNA, 25 bp, Mus musculus
tgcaccgtccttcccgagggcaagg

SEQ ID NO: 438461 - DNA, 25 bp, Mus musculus
cgcaggtcgtgtggacccagagaaa

SEQ ID NO: 438462 - DNA, 25 bp, Mus musculus
tcgaccgatcgatcatagttagtgg

SEQ ID NO: 438463 - DNA, 25 bp, Mus musculus
catagttagtggaggactctcgctc

SEQ ID NO: 438464 - DNA, 25 bp, Mus musculus
ctgcagagaccctgtgcggacaacc

SEQ ID NO: 438465 - DNA, 25 bp, Mus musculus
cacggaatgtttatcgaagagtgca

SEQ ID NO: 438466 - DNA, 25 bp, Mus musculus
gctccctgtgacaatcgcgtgcgtc

SEQ ID NO: 438467 - DNA, 25 bp, Mus musculus
cgagggtccttccaatcgaccgatc

SEQ ID NO: 438468 - DNA, 25 bp, Mus musculus
ccagaatgagtgactgcagagaccc

SEQ ID NO: 438469 - DNA, 25 bp, Mus musculus
ctgccgcctgtgaccagaatgagtg

SEQ ID NO: 438470 - DNA, 25 bp, Mus musculus
gctatttggaacctcgctgccgcct

SEQ ID NO: 438471 - DNA, 25 bp, Mus musculus
cttcgctgcgggctatttggaacct

SEQ ID NO: 438472 - DNA, 25 bp, Mus musculus
aacagacgggactgagcgcttcgct

SEQ ID NO: 438473 - DNA, 25 bp, Mus musculus
tcgccagcacgaacaacagacggga

SEQ ID NO: 438474 - DNA, 25 bp, Mus musculus
aaaagcgcacgtacagcagcctggg

SEQ ID NO: 438475 - DNA, 25 bp, Mus musculus
aatcgcgtgcgtcctagccggactc

SEQ ID NO: 438476 - DNA, 25 bp, Mus musculus
tagatcccgggagatccgccaatgc

SEQ ID NO: 438477 - DNA, 25 bp, Mus musculus
ctcagaactgggactgtcttcaaga

SEQ ID NO: 438478 - DNA, 25 bp, Mus musculus
agtagggacgatcttgggcccattc

SEQ ID NO: 438479 - DNA, 25 bp, Mus musculus
agttctgcttttgtgcatggcgccc

SEQ ID NO: 438480 - DNA, 25 bp, Mus musculus
gcctcgacttagtggccaaactgga

SEQ ID NO: 438481 - DNA, 25 bp, Mus musculus
ccagcctctgcaggaaaaggttttc

SEQ ID NO: 438482 - DNA, 25 bp, Mus musculus
tgatgccgttaagtcgctccgcaga

SEQ ID NO: 438483 - DNA, 25 bp, Mus musculus
atggctacccttcttgcagttggca

SEQ ID NO: 438484 - DNA, 25 bp, Mus musculus
gcagttggcatctcggcaccgaatc

SEQ ID NO: 438485 - DNA, 25 bp, Mus musculus
cgggtcggaccgtaccattatctga

SEQ ID NO: 438486 - DNA, 25 bp, Mus musculus
ttatctgagaatgcgcctgagtggc

SEQ ID NO: 438487 - DNA, 25 bp, Mus musculus
ccctcgtatgcagccacatttcgta

SEQ ID NO: 438488 - DNA, 25 bp, Mus musculus
gagcttcgtgtctaatgccgtttga

SEQ ID NO: 438489 - DNA, 25 bp, Mus musculus
caagactcttttgccgcccactgta

SEQ ID NO: 438490 - DNA, 25 bp, Mus musculus
tctctcagacgccagaagggccagc

SEQ ID NO: 438491 - DNA, 25 bp, Mus musculus
gccagtgtgcatacgcgtgtgtcac

SEQ ID NO: 438492 - DNA, 25 bp, Mus musculus
ttagcctgactctgcaacctgtgcc

SEQ ID NO: 438493 - DNA, 25 bp, Mus musculus
ggttttctccactctgctcaccggg

SEQ ID NO: 438494 - DNA, 25 bp, Mus musculus
gggacaagcacactttgggcacctg

SEQ ID NO: 438495 - DNA, 25 bp, Mus musculus
cagcttctgggtgctagagaacaca

SEQ ID NO: 438496 - DNA, 25 bp, Mus musculus
ctcctggacgcccagctgggtaaaa

SEQ ID NO: 438497 - DNA, 25 bp, Mus musculus
cgtcaatgatctacaggccaagcta

SEQ ID NO: 438498 - DNA, 25 bp, Mus musculus
ggtctgctgtcttatcctgggccac

SEQ ID NO: 438499 - DNA, 25 bp, Mus musculus
gtcgtggagacactgacatcgcttc

SEQ ID NO: 438500 - DNA, 25 bp, Mus musculus
cgccgcaccagctgcctggaatttg

SEQ ID NO: 438501 - DNA, 25 bp, Mus musculus
ggagctagtctaggtcacccaagtc

SEQ ID NO: 438502 - DNA, 25 bp, Mus musculus
cacgtcttaaaggtcccggagctag

SEQ ID NO: 438503 - DNA, 25 bp, Mus musculus
tgggcacctgcatgcatctgttctg

SEQ ID NO: 438504 - DNA, 25 bp, Mus musculus
cggtgctcgacttcaccgcggggtt

SEQ ID NO: 438505 - DNA, 25 bp, Mus musculus
gcacggtgctcgacttcaccgcggg

SEQ ID NO: 438506 - DNA, 25 bp, Mus musculus
acccgcgcggaccaataggaggccg

SEQ ID NO: 438507 - DNA, 25 bp, Mus musculus
gggcacggtgctcgacttcaccgcg

SEQ ID NO: 438508 - DNA, 25 bp, Mus musculus
tgctcgacttcaccgcggggttgga

SEQ ID NO: 438509 - DNA, 25 bp, Mus musculus
cccgcgctcgccgacacccggggcg

SEQ ID NO: 438510 - DNA, 25 bp, Mus musculus
tcatggacggactggaaggtgagac

SEQ ID NO: 438511 - DNA, 25 bp, Mus musculus
ctgaggcggcgcgtcatggacggac

SEQ ID NO: 438512 - DNA, 25 bp, Mus musculus
tgctgcctgcggagcctgaggcggc

SEQ ID NO: 438513 - DNA, 25 bp, Mus musculus
cggccgtgttgctacagcaggaact

SEQ ID NO: 438514 - DNA, 25 bp, Mus musculus
tgcggccgtgttgctacagcaggaa

SEQ ID NO: 438515 - DNA, 25 bp, Mus musculus
ccgggatgttagagtgtgggaggtg

SEQ ID NO: 438516 - DNA, 25 bp, Mus musculus
accaataggaggccgggatgttaga

SEQ ID NO: 438517 - DNA, 25 bp, Mus musculus
tcgacttcaccgcggggttggagcc

SEQ ID NO: 438518 - DNA, 25 bp, Mus musculus
ctcagactgagctcggggcatccct

SEQ ID NO: 438519 - DNA, 25 bp, Mus musculus
tcggggcatccctactccgactggg

SEQ ID NO: 438520 - DNA, 25 bp, Mus musculus
ggggcatccctactcggactgggct

SEQ ID NO: 438521 - DNA, 25 bp, Mus musculus
ggggcatccctactcggactgagct

SEQ ID NO: 438522 - DNA, 25 bp, Mus musculus
catccctactcggtgtgggctcggg

SEQ ID NO: 438523 - DNA, 25 bp, Mus musculus
gggcatccctactcggactgggctc

SEQ ID NO: 438524 - DNA, 25 bp, Mus musculus
ctcggggcatccctactcagactga

SEQ ID NO: 438525 - DNA, 25 bp, Mus musculus
cctactccgactgggctcggggcat

SEQ ID NO: 438526 - DNA, 25 bp, Mus musculus
ggggcatccctactccgactgggct

SEQ ID NO: 438527 - DNA, 25 bp, Mus musculus
catccctactcggactgggctcggg

SEQ ID NO: 438528 - DNA, 25 bp, Mus musculus
actcggactgagctcggggcatccc

SEQ ID NO: 438529 - DNA, 25 bp, Mus musculus
gggcatccctactcggtgtgggctc

SEQ ID NO: 438530 - DNA, 25 bp, Mus musculus
ggcatccctactcggtgtgggctcg

SEQ ID NO: 438531 - DNA, 25 bp, Mus musculus
ctcggggcatccctactcggactgg

SEQ ID NO: 438532 - DNA, 25 bp, Mus musculus
ttcagtgtggctgcgtgtgtcgaaa

SEQ ID NO: 438533 - DNA, 25 bp, Mus musculus
ctgcggctgcttgttgttcacaatc

SEQ ID NO: 438534 - DNA, 25 bp, Mus musculus
tgttcacaatcagagggccgggacc

SEQ ID NO: 438535 - DNA, 25 bp, Mus musculus
cccgtcaggcaactctcgcgtgatt

SEQ ID NO: 438536 - DNA, 25 bp, Mus musculus
ccaatcgccatattcagtgtggctg

SEQ ID NO: 438537 - DNA, 25 bp, Mus musculus
cccggccgcagcagagttggtgaca

SEQ ID NO: 438538 - DNA, 25 bp, Mus musculus
ggtccctgtcaagccgtcgggaagc

SEQ ID NO: 438539 - DNA, 25 bp, Mus musculus
ctctcgcgtgatttcctccaggaaa

SEQ ID NO: 438540 - DNA, 25 bp, Mus musculus
tggtgacagggctccgggctttcct

SEQ ID NO: 438541 - DNA, 25 bp, Mus musculus
tgccagcctagctaactgcacggtt

SEQ ID NO: 438542 - DNA, 25 bp, Mus musculus
gttcccggtaaagtgacagctccca

SEQ ID NO: 438543 - DNA, 25 bp, Mus musculus
tctttgcgctggttgcggttgaact

SEQ ID NO: 438544 - DNA, 25 bp, Mus musculus
ctgcagctctgacctccgagtcttt

SEQ ID NO: 438545 - DNA, 25 bp, Mus musculus
acctccgagtctttgcgctggttgc

SEQ ID NO: 438546 - DNA, 25 bp, Mus musculus
ttctcggcgtcctcgatctccttgg

SEQ ID NO: 438547 - DNA, 25 bp, Mus musculus
gccctgtcgggcttcagtaagatcc

SEQ ID NO: 438548 - DNA, 25 bp, Mus musculus
cgagggacaaagaaaagcgaggtca

SEQ ID NO: 438549 - DNA, 25 bp, Mus musculus
agagcggcctctttggctccagcta

SEQ ID NO: 438550 - DNA, 25 bp, Mus musculus
ggccacccactacatcgtgtcaatg

SEQ ID NO: 438551 - DNA, 25 bp, Mus musculus
cccgcaccttcttgggagccttggt

SEQ ID NO: 438552 - DNA, 25 bp, Mus musculus
cgtggccatgaaggagtacttctcg

SEQ ID NO: 438553 - DNA, 25 bp, Mus musculus
ggcatcgcgtcaggcatcgacatcc

SEQ ID NO: 438554 - DNA, 25 bp, Mus musculus
acggcggccacagaaccagaagcaa

SEQ ID NO: 438555 - DNA, 25 bp, Mus musculus
caagcacgcacgcaaagtaagggta

SEQ ID NO: 438556 - DNA, 25 bp, Mus musculus
gggcggagacgccacgtcaagtact

SEQ ID NO: 438557 - DNA, 25 bp, Mus musculus
gagccttggtgaccgtggccatgaa

SEQ ID NO: 438558 - DNA, 25 bp, Mus musculus
cgcgctctggtgacgtcaacatgct

SEQ ID NO: 438559 - DNA, 25 bp, Mus musculus
cgaatttaaggcctggccctgtcgg

SEQ ID NO: 438560 - DNA, 25 bp, Mus musculus
agccctcggcacagccttttaagcg

SEQ ID NO: 438561 - DNA, 25 bp, Mus musculus
tcccttgctcgctagtggctgaaga

SEQ ID NO: 438562 - DNA, 25 bp, Mus musculus
ttgctcgctagtggctgaagagccc

SEQ ID NO: 438563 - DNA, 25 bp, Mus musculus
gctagtggctgaagagcccgcgccc

SEQ ID NO: 438564 - DNA, 25 bp, Mus musculus
ccacgccgctgtcctgggatgcaga

SEQ ID NO: 438565 - DNA, 25 bp, Mus musculus
ccgctgtcctgggatgcagagagcc

SEQ ID NO: 438566 - DNA, 25 bp, Mus musculus
cagagagccgcagcgacaccgagag

SEQ ID NO: 438567 - DNA, 25 bp, Mus musculus
gcgacaccgagagcaccgaggcaaa

SEQ ID NO: 438568 - DNA, 25 bp, Mus musculus
tgttggccgccctggttcgctcgct

SEQ ID NO: 438569 - DNA, 25 bp, Mus musculus
gcaccgaggcaaactttcactttcc

SEQ ID NO: 438570 - DNA, 25 bp, Mus musculus
ctggccgagcttcgctggccagccc

SEQ ID NO: 438571 - DNA, 25 bp, Mus musculus
cacagccttttaagcgggcgggctg

SEQ ID NO: 438572 - DNA, 25 bp, Mus musculus
ccgagagcaccgaggcaaactttca

SEQ ID NO: 438573 - DNA, 25 bp, Mus musculus
ctcggcacagccttttaagcgggcg

SEQ ID NO: 438574 - DNA, 25 bp, Mus musculus
tgggccgatctccagcctacctatg

SEQ ID NO: 438575 - DNA, 25 bp, Mus musculus
cggcccacagcgtccagtataaagt

SEQ ID NO: 438576 - DNA, 25 bp, Mus musculus
agtataaagttagccgcccacagtc

SEQ ID NO: 438577 - DNA, 25 bp, Mus musculus
tagaggaataaggtactggaagttc

SEQ ID NO: 438578 - DNA, 25 bp, Mus musculus
gatctccagcctacctatggggtcc

SEQ ID NO: 438579 - DNA, 25 bp, Mus musculus
ggctgcctaaggacaatttccctgg

SEQ ID NO: 438580 - DNA, 25 bp, Mus musculus
ggtgagtggtccctcgccagcccag

SEQ ID NO: 438581 - DNA, 25 bp, Mus musculus
atatccgcggggtgagtggtccctc

SEQ ID NO: 438582 - DNA, 25 bp, Mus musculus
ttctgggttactgggatatccgcgg

SEQ ID NO: 438583 - DNA, 25 bp, Mus musculus
catccaagtctatggttctgggtta

SEQ ID NO: 438584 - DNA, 25 bp, Mus musculus
aggggctaagatcgcccaaaatgtc

SEQ ID NO: 438585 - DNA, 25 bp, Mus musculus
ggagacagttcggtcgcgtcagccc

SEQ ID NO: 438586 - DNA, 25 bp, Mus musculus
ttccctggacaggacgcaggagctt

SEQ ID NO: 438587 - DNA, 25 bp, Mus musculus
actgtgggtagaggaataaggtact

SEQ ID NO: 438588 - DNA, 25 bp, Mus musculus
ctagggttctttcaccactttctgg

SEQ ID NO: 438589 - DNA, 25 bp, Mus musculus
gacttcagcggccagactgacctca

SEQ ID NO: 438590 - DNA, 25 bp, Mus musculus
attcgcctagggttctttcaccact

SEQ ID NO: 438591 - DNA, 25 bp, Mus musculus
atcaattagggatccggctcctgtg

SEQ ID NO: 438592 - DNA, 25 bp, Mus musculus
cccaagcctgcactcaagaggaaac

SEQ ID NO: 438593 - DNA, 25 bp, Mus musculus
aggttttcaaaatggccagctggcc

SEQ ID NO: 438594 - DNA, 25 bp, Mus musculus
gaaggcaaggttttcaaaatggcca

SEQ ID NO: 438595 - DNA, 25 bp, Mus musculus
ctgcacccgcactgagaagcgggaa

SEQ ID NO: 438596 - DNA, 25 bp, Mus musculus
cgaaagtctgcacagcgagggagcc

SEQ ID NO: 438597 - DNA, 25 bp, Mus musculus
ggaaggcagcctacgaaagtctgca

SEQ ID NO: 438598 - DNA, 25 bp, Mus musculus
ccactttctgggaatcaattaggga

SEQ ID NO: 438599 - DNA, 25 bp, Mus musculus
ctcaagaggaaacaggccacgtgct

SEQ ID NO: 438600 - DNA, 25 bp, Mus musculus
cgcgtggaccaggaaggcagcctac

SEQ ID NO: 438601 - DNA, 25 bp, Mus musculus
gcggccagactgacctcaggagacc

SEQ ID NO: 438602 - DNA, 25 bp, Mus musculus
tgctgtttacgacacttccggcgac

SEQ ID NO: 438603 - DNA, 25 bp, Mus musculus
tacggagagcggaagttccctggta

SEQ ID NO: 438604 - DNA, 25 bp, Mus musculus
cctagctcccggaagaaccggatgt

SEQ ID NO: 438605 - DNA, 25 bp, Mus musculus
gcttcacttctttggccgctttctc

SEQ ID NO: 438606 - DNA, 25 bp, Mus musculus
ggaagttccctggtacctgactgtc

SEQ ID NO: 438607 - DNA, 25 bp, Mus musculus
tacttagagcgctgtgccagtggga

SEQ ID NO: 438608 - DNA, 25 bp, Mus musculus
cgttactacttagagcgctgtgcca

SEQ ID NO: 438609 - DNA, 25 bp, Mus musculus
gcccagcggccgttactacttagag

SEQ ID NO: 438610 - DNA, 25 bp, Mus musculus
aaccggatgtgtgctgtttacgaca

SEQ ID NO: 438611 - DNA, 25 bp, Mus musculus
gggcggtggccttctccgtcagctc

SEQ ID NO: 438612 - DNA, 25 bp, Mus musculus
aatcgccacacaccggcggagacgg

SEQ ID NO: 438613 - DNA, 25 bp, Mus musculus
gcgggaatcgccacacaccggcgga

SEQ ID NO: 438614 - DNA, 25 bp, Mus musculus
gggcccgggctcactcacacacacc

SEQ ID NO: 438615 - DNA, 25 bp, Mus musculus
tggagtgatggcgagccttcgctcc

SEQ ID NO: 438616 - DNA, 25 bp, Mus musculus
acgctcgctagctctgggcccagcc

SEQ ID NO: 438617 - DNA, 25 bp, Mus musculus
ccagcaagttcctcgcaggcgatgt

SEQ ID NO: 438618 - DNA, 25 bp, Mus musculus
gcaggtgcagtgacccgagggtcta

SEQ ID NO: 438619 - DNA, 25 bp, Mus musculus
gagacgcatcctcgccgagcaggtg

SEQ ID NO: 438620 - DNA, 25 bp, Mus musculus
actggccatgggctgagacgcatcc

SEQ ID NO: 438621 - DNA, 25 bp, Mus musculus
agctcctggactggccatgggctga

SEQ ID NO: 438622 - DNA, 25 bp, Mus musculus
ttcctcgcaggcgatgtcgccgggc

SEQ ID NO: 438623 - DNA, 25 bp, Mus musculus
cggaacccagcaagttcctcgcagg

SEQ ID NO: 438624 - DNA, 25 bp, Mus musculus
ctcgccgcactgcttctcgcctggc

SEQ ID NO: 438625 - DNA, 25 bp, Mus musculus
tccctcggctgggatcgcggcgtct

SEQ ID NO: 438626 - DNA, 25 bp, Mus musculus
cggagacaaacacacgcacgtgcgc

SEQ ID NO: 438627 - DNA, 25 bp, Mus musculus
cgccgggagccggagacaaacacac

SEQ ID NO: 438628 - DNA, 25 bp, Mus musculus
cccagcccgggatggcagaggaaat

SEQ ID NO: 438629 - DNA, 25 bp, Mus musculus
ctttgaggggccacgctcgctagct

SEQ ID NO: 438630 - DNA, 25 bp, Mus musculus
ccacagcgccctctgtagagtgggg

SEQ ID NO: 438631 - DNA, 25 bp, Mus musculus
ctcctcagctgagggtccaggtttc

SEQ ID NO: 438632 - DNA, 25 bp, Mus musculus
tccaggtttccagtctcccagtgcg

SEQ ID NO: 438633 - DNA, 25 bp, Mus musculus
cactcactggttccgggccgggaca

SEQ ID NO: 438634 - DNA, 25 bp, Mus musculus
ggccgggacagcacagtcagaaaga

SEQ ID NO: 438635 - DNA, 25 bp, Mus musculus
tcagaaagatggtgaagcccaaagc

SEQ ID NO: 438636 - DNA, 25 bp, Mus musculus
agcccaaagctatcaggtgcgccaa

SEQ ID NO: 438637 - DNA, 25 bp, Mus musculus
atcaggtgcgccaagatcccactgc

SEQ ID NO: 438638 - DNA, 25 bp, Mus musculus
ctccctcgctggagcgggaaccaga

SEQ ID NO: 438639 - DNA, 25 bp, Mus musculus
gggaaccagacctacctccatggaa

SEQ ID NO: 438640 - DNA, 25 bp, Mus musculus
ctccatggaatgcatagcagtgcca

SEQ ID NO: 438641 - DNA, 25 bp, Mus musculus
gccggcacaatccagctaccagagg

SEQ ID NO: 438642 - DNA, 25 bp, Mus musculus
ggcggctacaggagaggctcctccc

SEQ ID NO: 438643 - DNA, 25 bp, Mus musculus
taccagaggcttcttccgggtttgc

SEQ ID NO: 438644 - DNA, 25 bp, Mus musculus
cccgcaggtcagtccgggatccgaa

SEQ ID NO: 438645 - DNA, 25 bp, Mus musculus
caacgcgctcttcgagactcatgga

SEQ ID NO: 438646 - DNA, 25 bp, Mus musculus
ggctcccgacctggcggaagcactt

SEQ ID NO: 438647 - DNA, 25 bp, Mus musculus
cggccggcggatccctggcttagca

SEQ ID NO: 438648 - DNA, 25 bp, Mus musculus
ctccgcgctcaagcggctggatctg

SEQ ID NO: 438649 - DNA, 25 bp, Mus musculus
tgccgaaaagccagccggccttttg

SEQ ID NO: 438650 - DNA, 25 bp, Mus musculus
tggatctgcgcgatcccaacgcgct

SEQ ID NO: 438651 - DNA, 25 bp, Mus musculus
tcttcgagactcatggagcggagga

SEQ ID NO: 438652 - DNA, 25 bp, Mus musculus
caggtccgagccgagatcgaacaca

SEQ ID NO: 438653 - DNA, 25 bp, Mus musculus
aacacaagaaggaggagctgcggca

SEQ ID NO: 438654 - DNA, 25 bp, Mus musculus
agcggtaccgcgacctgatcgaggc

SEQ ID NO: 438655 - DNA, 25 bp, Mus musculus
gccgtgcaggccaccgatcaatact

SEQ ID NO: 438656 - DNA, 25 bp, Mus musculus
acgctggtccgctgccgaaaagcca

SEQ ID NO: 438657 - DNA, 25 bp, Mus musculus
ggcggacaccatcggccagatgcgc

SEQ ID NO: 438658 - DNA, 25 bp, Mus musculus
tgcccaagatactcttctaaagccg

SEQ ID NO: 438659 - DNA, 25 bp, Mus musculus
agcctcgggatatcctctttcaacc

SEQ ID NO: 438660 - DNA, 25 bp, Mus musculus
tccgtacacgtcctttgtgccacta

SEQ ID NO: 438661 - DNA, 25 bp, Mus musculus
cccggattctaatgtgtctgtactc

SEQ ID NO: 438662 - DNA, 25 bp, Mus musculus
tctaaagccgtgcatccgccagctg

SEQ ID NO: 438663 - DNA, 25 bp, Mus musculus
tgtgccactagttcactctcccaaa

SEQ ID NO: 438664 - DNA, 25 bp, Mus musculus
tccgaaatgcacaatcgcacgcggg

SEQ ID NO: 438665 - DNA, 25 bp, Mus musculus
agctagccgagggatcccttccgaa

SEQ ID NO: 438666 - DNA, 25 bp, Mus musculus
tggcgatgcttacggagctagccga

SEQ ID NO: 438667 - DNA, 25 bp, Mus musculus
tctcaacacagctttctgggaagtg

SEQ ID NO: 438668 - DNA, 25 bp, Mus musculus
tgccagttcactctctgcgcaagcg

SEQ ID NO: 438669 - DNA, 25 bp, Mus musculus
agtcatcgagactcggcactcgccg

SEQ ID NO: 438670 - DNA, 25 bp, Mus musculus
gctctgtcccgcgaagtcatcgaga

SEQ ID NO: 438671 - DNA, 25 bp, Mus musculus
tgtactcaccgtctgccgcaggcag

SEQ ID NO: 438672 - DNA, 25 bp, Mus musculus
ttaaagggacctgtggagcctgcta

SEQ ID NO: 438673 - DNA, 25 bp, Mus musculus
ggccgactcacccactggagaactt

SEQ ID NO: 438674 - DNA, 25 bp, Mus musculus
cgtccgagtgaaatgtgagcgccct

SEQ ID NO: 438675 - DNA, 25 bp, Mus musculus
ttgcacatagaaggtccgaatccgg

SEQ ID NO: 438676 - DNA, 25 bp, Mus musculus
cgctggagcagcaaccctggttctc

SEQ ID NO: 438677 - DNA, 25 bp, Mus musculus
attgcttcgggtccgcgtcacaatc

SEQ ID NO: 438678 - DNA, 25 bp, Mus musculus
cgtcacaatccaggctcccgaaata

SEQ ID NO: 438679 - DNA, 25 bp, Mus musculus
gaactttgatgaagcccagcggctc

SEQ ID NO: 438680 - DNA, 25 bp, Mus musculus
gtccacctgcggagacaaagccagc

SEQ ID NO: 438681 - DNA, 25 bp, Mus musculus
agcgtggggctttctattcacattg

SEQ ID NO: 438682 - DNA, 25 bp, Mus musculus
cgggagagacggaatcagacacatt

SEQ ID NO: 438683 - DNA, 25 bp, Mus musculus
cacattcgggacatctaggtagaca

SEQ ID NO: 438684 - DNA, 25 bp, Mus musculus
tctgtcaaacaatctggcggacttg

SEQ ID NO: 438685 - DNA, 25 bp, Mus musculus
cccgagtccgattcaaacttctgtc

SEQ ID NO: 438686 - DNA, 25 bp, Mus musculus
ggcggactgccgattggtcaatccc

SEQ ID NO: 438687 - DNA, 25 bp, Mus musculus
ggtcaatcccaacgtctgccttcgg

SEQ ID NO: 438688 - DNA, 25 bp, Mus musculus
agccatgctgattggcgcgctctgt

SEQ ID NO: 438689 - DNA, 25 bp, Mus musculus
gcgccggacagaagcagaatagata

SEQ ID NO: 438690 - DNA, 25 bp, Mus musculus
gctgattggttgtgagtgtgtttca

SEQ ID NO: 438691 - DNA, 25 bp, Mus musculus
cctccttttgataggctggaacctc

SEQ ID NO: 438692 - DNA, 25 bp, Mus musculus
gtcgctctctctaagagccatgctg

SEQ ID NO: 438693 - DNA, 25 bp, Mus musculus
aggctgccgcctccgattcaaaaaa

SEQ ID NO: 438694 - DNA, 25 bp, Mus musculus
gcagtcctcgcttatccttctcaaa

SEQ ID NO: 438695 - DNA, 25 bp, Mus musculus
aaggaaccacgacggcgcagtcctc

SEQ ID NO: 438696 - DNA, 25 bp, Mus musculus
cctcaccacgctcagagattttaaa

SEQ ID NO: 438697 - DNA, 25 bp, Mus musculus
cacggcccgtgctcagttccgggtt

SEQ ID NO: 438698 - DNA, 25 bp, Mus musculus
aatagatagagagcccagcctcccg

SEQ ID NO: 438699 - DNA, 25 bp, Mus musculus
ttcaaatccggtaaacggctggagc

SEQ ID NO: 438700 - DNA, 25 bp, Mus musculus
cccttggaaaaggagctgcttggtt

SEQ ID NO: 438701 - DNA, 25 bp, Mus musculus
agcgcgcagcgcgtagagcacacgt

SEQ ID NO: 438702 - DNA, 25 bp, Mus musculus
ttcgaagacctcgtgtgagtagcgc

SEQ ID NO: 438703 - DNA, 25 bp, Mus musculus
ttggttctttcgaagacctcgtgtg

SEQ ID NO: 438704 - DNA, 25 bp, Mus musculus
gctgcttggttctttcgaagacctc

SEQ ID NO: 438705 - DNA, 25 bp, Mus musculus
aggagctgcttggttctttcgaaga

SEQ ID NO: 438706 - DNA, 25 bp, Mus musculus
gcagcgcgtagagcacacgtcacgg

SEQ ID NO: 438707 - DNA, 25 bp, Mus musculus
atgtgatctctataggcccgaaccc

SEQ ID NO: 438708 - DNA, 25 bp, Mus musculus
cgatatgtgatctctataggcccga

SEQ ID NO: 438709 - DNA, 25 bp, Mus musculus
cgctcgatatgtgatctctataggc

SEQ ID NO: 438710 - DNA, 25 bp, Mus musculus
atcttcgctcgatatgtgatctcta

SEQ ID NO: 438711 - DNA, 25 bp, Mus musculus
acggaacaaatcttcgctcgatatg

SEQ ID NO: 438712 - DNA, 25 bp, Mus musculus
cgcaggtggttcacggaacaaatct

SEQ ID NO: 438713 - DNA, 25 bp, Mus musculus
tggttcacggaacaaatcttcgctc

SEQ ID NO: 438714 - DNA, 25 bp, Mus musculus
cagcgcccgtagcaaccaagggtga

SEQ ID NO: 438715 - DNA, 25 bp, Mus musculus
ccatgttcctcactcggtccgagta

SEQ ID NO: 438716 - DNA, 25 bp, Mus musculus
ttgcagccatccaaagcgcggcgtg

SEQ ID NO: 438717 - DNA, 25 bp, Mus musculus
catttacgcgagctggcgagactta

SEQ ID NO: 438718 - DNA, 25 bp, Mus musculus
ggacccgttgcacttgtcccgctga

SEQ ID NO: 438719 - DNA, 25 bp, Mus musculus
ggcgcccggagaacctaagtctggc

SEQ ID NO: 438720 - DNA, 25 bp, Mus musculus
agggtgctgctttcaatcgtgtggc

SEQ ID NO: 438721 - DNA, 25 bp, Mus musculus
catcgcggcgagaatatcaatcagc

SEQ ID NO: 438722 - DNA, 25 bp, Mus musculus
agcttgtcaagtccaatcatcgcgg

SEQ ID NO: 438723 - DNA, 25 bp, Mus musculus
ccaggtccggtgaagaagcttgtca

SEQ ID NO: 438724 - DNA, 25 bp, Mus musculus
cgacgaggttcactctcaccggttg

SEQ ID NO: 438725 - DNA, 25 bp, Mus musculus
aacccagtcatcaggccaagtcttg

SEQ ID NO: 438726 - DNA, 25 bp, Mus musculus
ggcgagacttacgtcacgattccga

SEQ ID NO: 438727 - DNA, 25 bp, Mus musculus
aagctacactgcagcggacccgttg

SEQ ID NO: 438728 - DNA, 25 bp, Mus musculus
gagggtctccggaagcgccgccaac

SEQ ID NO: 438729 - DNA, 25 bp, Mus musculus
agcggcgtctgcattcggcagcgat

SEQ ID NO: 438730 - DNA, 25 bp, Mus musculus
cctaggccaactccgggagcccagc

SEQ ID NO: 438731 - DNA, 25 bp, Mus musculus
ccgagcgacggtggagaatgacctc

SEQ ID NO: 438732 - DNA, 25 bp, Mus musculus
tggagaatgacctcagccgtccctg

SEQ ID NO: 438733 - DNA, 25 bp, Mus musculus
gtccctgccacgttccagccaatca

SEQ ID NO: 438734 - DNA, 25 bp, Mus musculus
tgctccttcaactgctgcctcctgc

SEQ ID NO: 438735 - DNA, 25 bp, Mus musculus
aatcagtcccgcatcttggcatccg

SEQ ID NO: 438736 - DNA, 25 bp, Mus musculus
agtcccgcatcttggcatccgaatc

SEQ ID NO: 438737 - DNA, 25 bp, Mus musculus
cgcatcttggcatccgaatccagga

SEQ ID NO: 438738 - DNA, 25 bp, Mus musculus
cgacgcgagccaatgaggagtgggc

SEQ ID NO: 438739 - DNA, 25 bp, Mus musculus
agaaggacaggcggccagcctattg

SEQ ID NO: 438740 - DNA, 25 bp, Mus musculus
cggctgcgcgtatccaagcagcgcg

SEQ ID NO: 438741 - DNA, 25 bp, Mus musculus
gagaaggcggcaacgtgacccaacc

SEQ ID NO: 438742 - DNA, 25 bp, Mus musculus
tcctgcgtagactgtgaagcgaggt

SEQ ID NO: 438743 - DNA, 25 bp, Mus musculus
taagaaattcgaacgaagctccgcc

SEQ ID NO: 438744 - DNA, 25 bp, Mus musculus
tagaaggaggcgctccggtacacgc

SEQ ID NO: 438745 - DNA, 25 bp, Mus musculus
agaaaagcttcctgcgtagactgtg

SEQ ID NO: 438746 - DNA, 25 bp, Mus musculus
ttcccgggaactgggagattgtaga

SEQ ID NO: 438747 - DNA, 25 bp, Mus musculus
ggactgggtggagcctaagaaattc

SEQ ID NO: 438748 - DNA, 25 bp, Mus musculus
accaatcgctgtgcgtttgtggcgg

SEQ ID NO: 438749 - DNA, 25 bp, Mus musculus
ccttggactcaccaatcgctgtgcg

SEQ ID NO: 438750 - DNA, 25 bp, Mus musculus
ggctgacatcccgactgctcccgac

SEQ ID NO: 438751 - DNA, 25 bp, Mus musculus
gggacaatcttctccggctgacatc

SEQ ID NO: 438752 - DNA, 25 bp, Mus musculus
tggtccaagggacaatcttctccgg

SEQ ID NO: 438753 - DNA, 25 bp, Mus musculus
gaagtgccctttggtccaagggaca

SEQ ID NO: 438754 - DNA, 25 bp, Mus musculus
tccggtacacgccaccgcgcactca

SEQ ID NO: 438755 - DNA, 25 bp, Mus musculus
tgggagattgtagaagaaaagcttc

SEQ ID NO: 438756 - DNA, 25 bp, Mus musculus
ctgtgaagcctggtgggcagcgaca

SEQ ID NO: 438757 - DNA, 25 bp, Mus musculus
ggctcccgcaggcaaatgttgtcgt

SEQ ID NO: 438758 - DNA, 25 bp, Mus musculus
tcgcatgtaattctcgcagggctcc

SEQ ID NO: 438759 - DNA, 25 bp, Mus musculus
acatcgcatgtaattctcgcagggc

SEQ ID NO: 438760 - DNA, 25 bp, Mus musculus
gcagcacagacacacatcgcatgta

SEQ ID NO: 438761 - DNA, 25 bp, Mus musculus
ggagtcgaaccgcagcacagacaca

SEQ ID NO: 438762 - DNA, 25 bp, Mus musculus
cggtctcgcagtagtcgcctgtgaa

SEQ ID NO: 438763 - DNA, 25 bp, Mus musculus
cgcagaggagtcgaaccgcagcaca

SEQ ID NO: 438764 - DNA, 25 bp, Mus musculus
caaatgttgtcgtcgaaggggagca

SEQ ID NO: 438765 - DNA, 25 bp, Mus musculus
tctcgcagtagtcgcctgtgaagcc

SEQ ID NO: 438766 - DNA, 25 bp, Mus musculus
cgcaggcaaatgttgtcgtcgaagg

SEQ ID NO: 438767 - DNA, 25 bp, Mus musculus
cgcagtagtcgcctgtgaagcctgg

SEQ ID NO: 438768 - DNA, 25 bp, Mus musculus
tcccgcaggcaaatgttgtcgtcga

SEQ ID NO: 438769 - DNA, 25 bp, Mus musculus
aagagcaccgaagaggaagcgatga

SEQ ID NO: 438770 - DNA, 25 bp, Mus musculus
ttggaaggtgtagaaaaccctgcca

SEQ ID NO: 438771 - DNA, 25 bp, Mus musculus
tagacgctgccctggtaggaatctc

SEQ ID NO: 438772 - DNA, 25 bp, Mus musculus
ggcggcacgtcctcgtagacgctgc

SEQ ID NO: 438773 - DNA, 25 bp, Mus musculus
ctgagatctgcaggacgctggtgaa

SEQ ID NO: 438774 - DNA, 25 bp, Mus musculus
gagtctcgatccgtggctgagatct

SEQ ID NO: 438775 - DNA, 25 bp, Mus musculus
agaaaaccctgccattcagaccgga

SEQ ID NO: 438776 - DNA, 25 bp, Mus musculus
tcgactctacaataaagtcaccgtc

SEQ ID NO: 438777 - DNA, 25 bp, Mus musculus
gcccgatgtcgactctacaataaag

SEQ ID NO: 438778 - DNA, 25 bp, Mus musculus
cgcacaatgcccgatgtcgactcta

SEQ ID NO: 438779 - DNA, 25 bp, Mus musculus
cgcagtgtgcgcacaatgcccgatg

SEQ ID NO: 438780 - DNA, 25 bp, Mus musculus
tgggccacgttctcacgatccagcc

SEQ ID NO: 438781 - DNA, 25 bp, Mus musculus
cgcaggacgtactgggccacgttct

SEQ ID NO: 438782 - DNA, 25 bp, Mus musculus
cgcataggcccgcaggacgtactgg

SEQ ID NO: 438783 - DNA, 25 bp, Mus musculus
ttcagaccggagtctcgatccgtgg

SEQ ID NO: 438784 - DNA, 25 bp, Mus musculus
cacttcctcccggtctacagggccg

SEQ ID NO: 438785 - DNA, 25 bp, Mus musculus
gtcattatcatcctccaccgacagg

SEQ ID NO: 438786 - DNA, 25 bp, Mus musculus
cctccactgttaacttgtaggattc

SEQ ID NO: 438787 - DNA, 25 bp, Mus musculus
ggccctggtcactcgcctccactgt

SEQ ID NO: 438788 - DNA, 25 bp, Mus musculus
ctggaccacataacgcttctcgcta

SEQ ID NO: 438789 - DNA, 25 bp, Mus musculus
cttctcgctaaactggggggcgttg

SEQ ID NO: 438790 - DNA, 25 bp, Mus musculus
taacttgtaggattccacttcctcc

SEQ ID NO: 438791 - DNA, 25 bp, Mus musculus
cccgagcgaggatcgatctcaaagg

SEQ ID NO: 438792 - DNA, 25 bp, Mus musculus
gaggatcgatctcaaaggcgtctga

SEQ ID NO: 438793 - DNA, 25 bp, Mus musculus
ctcaaaggcgtctgaggggctgcct

SEQ ID NO: 438794 - DNA, 25 bp, Mus musculus
ctccagcaggcggtacagaatgttg

SEQ ID NO: 438795 - DNA, 25 bp, Mus musculus
caggcggtacagaatgttggcattg

SEQ ID NO: 438796 - DNA, 25 bp, Mus musculus
ggggcgttgtcattatcatcctcca

SEQ ID NO: 438797 - DNA, 25 bp, Mus musculus
tcctccaccgacaggaaaacaatgg

SEQ ID NO: 438798 - DNA, 25 bp, Mus musculus
agctggagcgcagatccgagacgac

SEQ ID NO: 438799 - DNA, 25 bp, Mus musculus
cggaaggcaacgctcggcttctttg

SEQ ID NO: 438800 - DNA, 25 bp, Mus musculus
tcggcttctttggacaacctgggcg

SEQ ID NO: 438801 - DNA, 25 bp, Mus musculus
agatccgagacgactcctgccttta

SEQ ID NO: 438802 - DNA, 25 bp, Mus musculus
cgagacgactcctgcctttacgagg

SEQ ID NO: 438803 - DNA, 25 bp, Mus musculus
tcctgcctttacgaggacgacaggg

SEQ ID NO: 438804 - DNA, 25 bp, Mus musculus
gagactgctggctgacaggacaccc

SEQ ID NO: 438805 - DNA, 25 bp, Mus musculus
tgcactaggcctcgtctggggctgc

SEQ ID NO: 438806 - DNA, 25 bp, Mus musculus
gtctcctcggggcttggagctgaca

SEQ ID NO: 438807 - DNA, 25 bp, Mus musculus
cttggagctgacagagtttcggagc

SEQ ID NO: 438808 - DNA, 25 bp, Mus musculus
acagagtttcggagccggtgaccga

SEQ ID NO: 438809 - DNA, 25 bp, Mus musculus
gtgaccgagccgaagcttcatcctc

SEQ ID NO: 438810 - DNA, 25 bp, Mus musculus
ccgctctggggtcgctagctctgcg

SEQ ID NO: 438811 - DNA, 25 bp, Mus musculus
acgctcggcttctttggacaacctg

SEQ ID NO: 438812 - DNA, 25 bp, Mus musculus
gctcattaccatagacctgctcgcg

SEQ ID NO: 438813 - DNA, 25 bp, Mus musculus
cgccgccgcggtcttaaagcggcga

SEQ ID NO: 438814 - DNA, 25 bp, Mus musculus
tggcggcggctcattaccatagacc

SEQ ID NO: 438815 - DNA, 25 bp, Mus musculus
ggctgccaacgatggccctgcgcca

SEQ ID NO: 438816 - DNA, 25 bp, Mus musculus
tgcgctctgagcgttctctacctgc

SEQ ID NO: 438817 - DNA, 25 bp, Mus musculus
gccgcgaggatctctggctctgccg

SEQ ID NO: 438818 - DNA, 25 bp, Mus musculus
agtcgccgcgaccactgcgggttca

SEQ ID NO: 438819 - DNA, 25 bp, Mus musculus
gccgggctcccaccactctcgaagc

SEQ ID NO: 438820 - DNA, 25 bp, Mus musculus
ggggccgcgctcttagcccacgatg

SEQ ID NO: 438821 - DNA, 25 bp, Mus musculus
ccacctgtacgtcccactgggcctg

SEQ ID NO: 438822 - DNA, 25 bp, Mus musculus
gcatctctccctgttcccggccagc

SEQ ID NO: 438823 - DNA, 25 bp, Mus musculus
cccacctgcgtctgcggagcctcac

SEQ ID NO: 438824 - DNA, 25 bp, Mus musculus
cgctgcgcttccacctgcgctctga

SEQ ID NO: 438825 - DNA, 25 bp, Mus musculus
tcttaaagcggcgacgcccaacgcg

SEQ ID NO: 438826 - DNA, 25 bp, Mus musculus
ccttcctaaagcactggcggcagtc

SEQ ID NO: 438827 - DNA, 25 bp, Mus musculus
tggcggcagtcagcatagagcacgc

SEQ ID NO: 438828 - DNA, 25 bp, Mus musculus
agcccggttcccagcttgttctacg

SEQ ID NO: 438829 - DNA, 25 bp, Mus musculus
cttgttctacggacaagccggtaga

SEQ ID NO: 438830 - DNA, 25 bp, Mus musculus
ccagtcgcgggagcatctgacaaaa

SEQ ID NO: 438831 - DNA, 25 bp, Mus musculus
ctgtgacctctgaagccatgaggga

SEQ ID NO: 438832 - DNA, 25 bp, Mus musculus
ccatgagggattcaagggatactgc

SEQ ID NO: 438833 - DNA, 25 bp, Mus musculus
ggatactgcgagctcctggtactta

SEQ ID NO: 438834 - DNA, 25 bp, Mus musculus
gtacttacatcgtcgccactcactg

SEQ ID NO: 438835 - DNA, 25 bp, Mus musculus
cactgtctgctttcaccagctggtc

SEQ ID NO: 438836 - DNA, 25 bp, Mus musculus
cgggtccttgaagcgcttctcctgc

SEQ ID NO: 438837 - DNA, 25 bp, Mus musculus
cgcttctcctgcgtctctcgaatga

SEQ ID NO: 438838 - DNA, 25 bp, Mus musculus
cgaaacaaatccaggtccagcacca

SEQ ID NO: 438839 - DNA, 25 bp, Mus musculus
tgcgtgcgtgcagctccttcctaaa

SEQ ID NO: 438840 - DNA, 25 bp, Mus musculus
tcgctcggtaatcagcggctgggac

SEQ ID NO: 438841 - DNA, 25 bp, Mus musculus
cacgcacgcacacggtggggaaaaa

SEQ ID NO: 438842 - DNA, 25 bp, Mus musculus
gctgcgggaacaaagcctccaaaag

SEQ ID NO: 438843 - DNA, 25 bp, Mus musculus
caaagcctccaaaaggggcggcgtg

SEQ ID NO: 438844 - DNA, 25 bp, Mus musculus
gtgacgtctgccctgggctctttca

SEQ ID NO: 438845 - DNA, 25 bp, Mus musculus
tctgccctgggctctttcaccttga

SEQ ID NO: 438846 - DNA, 25 bp, Mus musculus
ttgagcctcttgagcttcaccagca

SEQ ID NO: 438847 - DNA, 25 bp, Mus musculus
tcaccagcacacgaagctatagacg

SEQ ID NO: 438848 - DNA, 25 bp, Mus musculus
cacgaagctatagacgtgagccggg

SEQ ID NO: 438849 - DNA, 25 bp, Mus musculus
ctcagatcagaatcgctcggtaatc

SEQ ID NO: 438850 - DNA, 25 bp, Mus musculus
ggacccggcctcgtctatctgatca

SEQ ID NO: 438851 - DNA, 25 bp, Mus musculus
cggcctcgtctatctgatcaattca

SEQ ID NO: 438852 - DNA, 25 bp, Mus musculus
attcatcacttctgagcgccgggcc

SEQ ID NO: 438853 - DNA, 25 bp, Mus musculus
gccgggctcagatcagaatcgctcg

SEQ ID NO: 438854 - DNA, 25 bp, Mus musculus
gtctcgtccttgctcctctaaacga

SEQ ID NO: 438855 - DNA, 25 bp, Mus musculus
ctattcgcaaggacaccgcggaggg

SEQ ID NO: 438856 - DNA, 25 bp, Mus musculus
tcccgacgcagcctgtgattggctc

SEQ ID NO: 438857 - DNA, 25 bp, Mus musculus
tggctcgcagcctgaggaggaacac

SEQ ID NO: 438858 - DNA, 25 bp, Mus musculus
gaggaacacgtgaaacagcagctgc

SEQ ID NO: 438859 - DNA, 25 bp, Mus musculus
agctgcggctggcagaaacttgctg

SEQ ID NO: 438860 - DNA, 25 bp, Mus musculus
gaaacttgctggtcttctccgggta

SEQ ID NO: 438861 - DNA, 25 bp, Mus musculus
ttctccgggtagcatcgcaccgtac

SEQ ID NO: 438862 - DNA, 25 bp, Mus musculus
cctggggacaatgaggtcgtcatgc

SEQ ID NO: 438863 - DNA, 25 bp, Mus musculus
aggtcgtcatgcgtcctactggccg

SEQ ID NO: 438864 - DNA, 25 bp, Mus musculus
gctctggctgcctactacgtgtaca

SEQ ID NO: 438865 - DNA, 25 bp, Mus musculus
tgcctactacgtgtacatcccactg

SEQ ID NO: 438866 - DNA, 25 bp, Mus musculus
cctggaaactgatgctgctggacgc

SEQ ID NO: 438867 - DNA, 25 bp, Mus musculus
gagcccgcagctattcgcaaggaca

SEQ ID NO: 438868 - DNA, 25 bp, Mus musculus
cgaggcttcctttgtggtcatggca

SEQ ID NO: 438869 - DNA, 25 bp, Mus musculus
gccacgtttggtcccagtcctctac

SEQ ID NO: 438870 - DNA, 25 bp, Mus musculus
gctctcaccgttcgtcatggcggta

SEQ ID NO: 438871 - DNA, 25 bp, Mus musculus
accgttcgtcatggcggtagtgccc

SEQ ID NO: 438872 - DNA, 25 bp, Mus musculus
ttgacacttcccgatccgggccgtg

SEQ ID NO: 438873 - DNA, 25 bp, Mus musculus
cgagccgtagtacgcaagcgcgaga

SEQ ID NO: 438874 - DNA, 25 bp, Mus musculus
gccgagcgagagaaacgccgaactc

SEQ ID NO: 438875 - DNA, 25 bp, Mus musculus
ttgtggtcatggcaaccggaagtcc

SEQ ID NO: 438876 - DNA, 25 bp, Mus musculus
cgccgaactcaatcaggcataatta

SEQ ID NO: 438877 - DNA, 25 bp, Mus musculus
aggcataattagctgatcgtcgagc

SEQ ID NO: 438878 - DNA, 25 bp, Mus musculus
gctgatcgtcgagccaaagcctcgc

SEQ ID NO: 438879 - DNA, 25 bp, Mus musculus
tgcgtagcgtctgcgtccctacgta

SEQ ID NO: 438880 - DNA, 25 bp, Mus musculus
tctgcgtccctacgtagtgggagga

SEQ ID NO: 438881 - DNA, 25 bp, Mus musculus
gggaacggccacgtcagtctagccc

SEQ ID NO: 438882 - DNA, 25 bp, Mus musculus
aggcagagtctgacccgcttgtgcc

SEQ ID NO: 438883 - DNA, 25 bp, Mus musculus
atcactagcggaggcagagtctgac

SEQ ID NO: 438884 - DNA, 25 bp, Mus musculus
ctgcgcaacgctggccaggccggaa

SEQ ID NO: 438885 - DNA, 25 bp, Mus musculus
ctttcggatcactagcggaggcaga

SEQ ID NO: 438886 - DNA, 25 bp, Mus musculus
tgacccgcttgtgccttagggattc

SEQ ID NO: 438887 - DNA, 25 bp, Mus musculus
tggttcctcactcctttcggatcac

SEQ ID NO: 438888 - DNA, 25 bp, Mus musculus
gagcgcctgtctcagcctggttcct

SEQ ID NO: 438889 - DNA, 25 bp, Mus musculus
ccaccgtgagtgagcgcctgtctca

SEQ ID NO: 438890 - DNA, 25 bp, Mus musculus
catggcagatgaggaggaagacccc

SEQ ID NO: 438891 - DNA, 25 bp, Mus musculus
ctggcgagcagctagcatggcagat

SEQ ID NO: 438892 - DNA, 25 bp, Mus musculus
tcttataaaactcgccagccgccgg

SEQ ID NO: 438893 - DNA, 25 bp, Mus musculus
gtgacgtacgtatcttataaaactc

SEQ ID NO: 438894 - DNA, 25 bp, Mus musculus
caggccggaagtgacgtacgtatct

SEQ ID NO: 438895 - DNA, 25 bp, Mus musculus
gccttagggattcccgccgagagtc

SEQ ID NO: 438896 - DNA, 25 bp, Mus musculus
gtttgccctttctgacgccaggcca

SEQ ID NO: 438897 - DNA, 25 bp, Mus musculus
cgctcgcgccttagactggaattgg

SEQ ID NO: 438898 - DNA, 25 bp, Mus musculus
ctccagggacgagcagtgattggct

SEQ ID NO: 438899 - DNA, 25 bp, Mus musculus
tccagcggcgcttgacaaccgcagt

SEQ ID NO: 438900 - DNA, 25 bp, Mus musculus
ctgacgagctgatggattgacgtgc

SEQ ID NO: 438901 - DNA, 25 bp, Mus musculus
gggacaggggcatcgactgaatttc

SEQ ID NO: 438902 - DNA, 25 bp, Mus musculus
acgtgcgggctgcttagcccagacc

SEQ ID NO: 438903 - DNA, 25 bp, Mus musculus
gtcgccacctgtcactagcctgatg

SEQ ID NO: 438904 - DNA, 25 bp, Mus musculus
tcactagcctgatgcggcgcagacc

SEQ ID NO: 438905 - DNA, 25 bp, Mus musculus
ggacccgccaggcaatctatccagg

SEQ ID NO: 438906 - DNA, 25 bp, Mus musculus
tacttgccagtctgattcgggcggc

SEQ ID NO: 438907 - DNA, 25 bp, Mus musculus
gagtatccacctcgccgctgctgag

SEQ ID NO: 438908 - DNA, 25 bp, Mus musculus
gccagtggctgttaggagcagtcct

SEQ ID NO: 438909 - DNA, 25 bp, Mus musculus
ccctcgccctggtatggagtatcca

SEQ ID NO: 438910 - DNA, 25 bp, Mus musculus
gctaaccctgcgaatataccgagcg

SEQ ID NO: 438911 - DNA, 25 bp, Mus musculus
tccgagtgcaccgtgtttgaggtag

SEQ ID NO: 438912 - DNA, 25 bp, Mus musculus
caatcagcaacgcgcgcgggaaggc

SEQ ID NO: 438913 - DNA, 25 bp, Mus musculus
gccgagcgagtcgatgagtccgctc

SEQ ID NO: 438914 - DNA, 25 bp, Mus musculus
cgagtcgatgagtccgctcgggact

SEQ ID NO: 438915 - DNA, 25 bp, Mus musculus
tccgctcgggactccagtccgagtg

SEQ ID NO: 438916 - DNA, 25 bp, Mus musculus
gactccagtccgagtgcaccgtgtt

SEQ ID NO: 438917 - DNA, 25 bp, Mus musculus
cctctgaaagagcaggcaggaccct

SEQ ID NO: 438918 - DNA, 25 bp, Mus musculus
accctcgacgtgagtgggcgctctt

SEQ ID NO: 438919 - DNA, 25 bp, Mus musculus
gcctgggcccgtggcgattccctgt

SEQ ID NO: 438920 - DNA, 25 bp, Mus musculus
gtggcgattccctgttccgtcttac

SEQ ID NO: 438921 - DNA, 25 bp, Mus musculus
ctgttccgtcttacgcgggtagaca

SEQ ID NO: 438922 - DNA, 25 bp, Mus musculus
cttgtctcggctaaccctgcgaata

SEQ ID NO: 438923 - DNA, 25 bp, Mus musculus
ttacgcgggtagacagcgcccgcca

SEQ ID NO: 438924 - DNA, 25 bp, Mus musculus
ggctcctgagaacaaggaaccgctg

SEQ ID NO: 438925 - DNA, 25 bp, Mus musculus
tctcagagggtctcaccgccagcaa

SEQ ID NO: 438926 - DNA, 25 bp, Mus musculus
gcaagtattttcaaggtctgcagaa

SEQ ID NO: 438927 - DNA, 25 bp, Mus musculus
cgacgtgcctgggattcgaatccac

SEQ ID NO: 438928 - DNA, 25 bp, Mus musculus
ggctcgcccattcaaactgacaacg

SEQ ID NO: 438929 - DNA, 25 bp, Mus musculus
ccgtagactaggaaccgcggcgctt

SEQ ID NO: 438930 - DNA, 25 bp, Mus musculus
atgagcgcctctggccgtagactag

SEQ ID NO: 438931 - DNA, 25 bp, Mus musculus
aaccgctgcagggatgagcgcctct

SEQ ID NO: 438932 - DNA, 25 bp, Mus musculus
acagcctaaatggtgcgggtgcgaa

SEQ ID NO: 438933 - DNA, 25 bp, Mus musculus
tgaagtcgctgcatcccagcaagta

SEQ ID NO: 438934 - DNA, 25 bp, Mus musculus
ttacgctcggaaaacgcgtgaagtc

SEQ ID NO: 438935 - DNA, 25 bp, Mus musculus
ttgtatccaccgtctgttacgctcg

SEQ ID NO: 438936 - DNA, 25 bp, Mus musculus
atccactgggattcggctttgtatc

SEQ ID NO: 438937 - DNA, 25 bp, Mus musculus
gcgttttttggaccggccaatggca

SEQ ID NO: 438938 - DNA, 25 bp, Mus musculus
tactttggccctgaaagctgcgctc

SEQ ID NO: 438939 - DNA, 25 bp, Mus musculus
gcgggacagagtagtaacacagagc

SEQ ID NO: 438940 - DNA, 25 bp, Mus musculus
ctcagactgtgtcggatggagagac

SEQ ID NO: 438941 - DNA, 25 bp, Mus musculus
tggggctttgcggaagaacctcacc

SEQ ID NO: 438942 - DNA, 25 bp, Mus musculus
cctcaccggggtgagagttggccaa

SEQ ID NO: 438943 - DNA, 25 bp, Mus musculus
tggtgctggcacgaaacccgactct

SEQ ID NO: 438944 - DNA, 25 bp, Mus musculus
gaaacccgactctgggcaagccgga

SEQ ID NO: 438945 - DNA, 25 bp, Mus musculus
ccggaaggagtcaagccagggactt

SEQ ID NO: 438946 - DNA, 25 bp, Mus musculus
ggacttggtcccaaagcaacaagtg

SEQ ID NO: 438947 - DNA, 25 bp, Mus musculus
ctcccagagaggctgcagagctgca

SEQ ID NO: 438948 - DNA, 25 bp, Mus musculus
cctcaggtgacgtcacgcgcatcaa

SEQ ID NO: 438949 - DNA, 25 bp, Mus musculus
cgcgcatcaactagggcgtgtcccg

SEQ ID NO: 438950 - DNA, 25 bp, Mus musculus
cggcttctgaaaacacggggacgag

SEQ ID NO: 438951 - DNA, 25 bp, Mus musculus
caagtgcccatgcagctcccagaga

SEQ ID NO: 438952 - DNA, 25 bp, Mus musculus
tggaacttcgcgtctccgaacggtg

SEQ ID NO: 438953 - DNA, 25 bp, Mus musculus
ttccgaagcggaaagggcagaagac

SEQ ID NO: 438954 - DNA, 25 bp, Mus musculus
ctgcccacggggtccaagtgtcaga

SEQ ID NO: 438955 - DNA, 25 bp, Mus musculus
gcgctcgctcatggcagctggtgaa

SEQ ID NO: 438956 - DNA, 25 bp, Mus musculus
catcaccgcgcacgcaggaagaggc

SEQ ID NO: 438957 - DNA, 25 bp, Mus musculus
ccagagggaagactgaccgggaact

SEQ ID NO: 438958 - DNA, 25 bp, Mus musculus
ggggcagccgcctgttcaaaaacaa

SEQ ID NO: 438959 - DNA, 25 bp, Mus musculus
cgacgtaaaagtcaagccagatttt

SEQ ID NO: 438960 - DNA, 25 bp, Mus musculus
acgatcattgatacttgtctctgcg

SEQ ID NO: 438961 - DNA, 25 bp, Mus musculus
ccagacgagctccatcaggcacaga

SEQ ID NO: 438962 - DNA, 25 bp, Mus musculus
cggagcccgttccatggagtagcta

SEQ ID NO: 438963 - DNA, 25 bp, Mus musculus
ctgggctatttttccgcgacctttg

SEQ ID NO: 438964 - DNA, 25 bp, Mus musculus
ccgcgacctttgttgcaggtcaaga

SEQ ID NO: 438965 - DNA, 25 bp, Mus musculus
gtctctgcgttaagcctctctaagg

SEQ ID NO: 438966 - DNA, 25 bp, Mus musculus
agctcgatcgcgctcttcgggacaa

SEQ ID NO: 438967 - DNA, 25 bp, Mus musculus
gcggcctagaggatgcgtaccttaa

SEQ ID NO: 438968 - DNA, 25 bp, Mus musculus
cgtaccttaaagtagatctcgtcca

SEQ ID NO: 438969 - DNA, 25 bp, Mus musculus
ccacctcgtggtaggtcttgagctc

SEQ ID NO: 438970 - DNA, 25 bp, Mus musculus
tgcactttgaagtaaggcgacgaca

SEQ ID NO: 438971 - DNA, 25 bp, Mus musculus
agcggcagcacattgccctgcttgc

SEQ ID NO: 438972 - DNA, 25 bp, Mus musculus
gtcccggacctactccatggaaggc

SEQ ID NO: 438973 - DNA, 25 bp, Mus musculus
ggaaactgcaactgggacgccgaca

SEQ ID NO: 438974 - DNA, 25 bp, Mus musculus
cggacgcaaagcagaacgggcagca

SEQ ID NO: 438975 - DNA, 25 bp, Mus musculus
ggagctcgatctcttccgccaactg

SEQ ID NO: 438976 - DNA, 25 bp, Mus musculus
cgttcgagctaaggccgtggccaat

SEQ ID NO: 438977 - DNA, 25 bp, Mus musculus
tggccaatcagagccgcccgtgtgt

SEQ ID NO: 438978 - DNA, 25 bp, Mus musculus
gctattcctcttcctggttgcgcga

SEQ ID NO: 438979 - DNA, 25 bp, Mus musculus
tgaggttcatggtcttctcgttgcc

SEQ ID NO: 438980 - DNA, 25 bp, Mus musculus
ttcggaagataggtgggaaaatgtc

SEQ ID NO: 438981 - DNA, 25 bp, Mus musculus
ttcgcacgcccagcgaggaccctga

SEQ ID NO: 438982 - DNA, 25 bp, Mus musculus
ggacgatgttcacgtctcttccgcg

SEQ ID NO: 438983 - DNA, 25 bp, Mus musculus
ttcacgtctcttccgcgcacgagga

SEQ ID NO: 438984 - DNA, 25 bp, Mus musculus
cacgaggagcctcgcacacgggacg

SEQ ID NO: 438985 - DNA, 25 bp, Mus musculus
acacgggacgccacggacctaacag

SEQ ID NO: 438986 - DNA, 25 bp, Mus musculus
gagcacgcagtctggccgccagtct

SEQ ID NO: 438987 - DNA, 25 bp, Mus musculus
tctgggtcgcatccaacagtcgccg

SEQ ID NO: 438988 - DNA, 25 bp, Mus musculus
gtcgcatccaacagtcgccgcaggg

SEQ ID NO: 438989 - DNA, 25 bp, Mus musculus
acagtcgccgcaggggcaggtcaac

SEQ ID NO: 438990 - DNA, 25 bp, Mus musculus
ggaaaatgtcttcagggcatgcgcc

SEQ ID NO: 438991 - DNA, 25 bp, Mus musculus
gccacagcggccgttaaatgaccca

SEQ ID NO: 438992 - DNA, 25 bp, Mus musculus
aaaccgacaccttggaggcggcagc

SEQ ID NO: 438993 - DNA, 25 bp, Mus musculus
atgtcttcagggcatgcgccacagc

SEQ ID NO: 438994 - DNA, 25 bp, Mus musculus
ctgggcaagctaacacgcgacagca

SEQ ID NO: 438995 - DNA, 25 bp, Mus musculus
cagcccactgcgaagcacttggtgc

SEQ ID NO: 438996 - DNA, 25 bp, Mus musculus
ctaggagaacggtcgctgccgcctc

SEQ ID NO: 438997 - DNA, 25 bp, Mus musculus
ttcttcatcatcgtgagggccaggc

SEQ ID NO: 438998 - DNA, 25 bp, Mus musculus
gagctcgaagtccaccttaaactta

SEQ ID NO: 438999 - DNA, 25 bp, Mus musculus
aggagagctcctcgagctcgaagtc

SEQ ID NO: 439000 - DNA, 25 bp, Mus musculus
tccagcagccgcatcttgcagaaga

SEQ ID NO: 439001 - DNA, 25 bp, Mus musculus
catagaaagggatgctggccgtgca

SEQ ID NO: 439002 - DNA, 25 bp, Mus musculus
cgacagagcaaaggggccaagcata

SEQ ID NO: 439003 - DNA, 25 bp, Mus musculus
cgagctggcagctcgacagagcaaa

SEQ ID NO: 439004 - DNA, 25 bp, Mus musculus
cgtctctggaggacgatgagctcac

SEQ ID NO: 439005 - DNA, 25 bp, Mus musculus
ggctgatttcagactcgtctctgga

SEQ ID NO: 439006 - DNA, 25 bp, Mus musculus
ttgttcgatgctctggctgatttca

SEQ ID NO: 439007 - DNA, 25 bp, Mus musculus
acttggtgccgtttgttcgatgctc

SEQ ID NO: 439008 - DNA, 25 bp, Mus musculus
ctgcagcaggggctgcaaagcctgg

SEQ ID NO: 439009 - DNA, 25 bp, Mus musculus
acatcggagagctgcagcaggggct

SEQ ID NO: 439010 - DNA, 25 bp, Mus musculus
acggcgtggtggacatcggagagct

SEQ ID NO: 439011 - DNA, 25 bp, Mus musculus
cgctggaccgcaatggggacggcgt

SEQ ID NO: 439012 - DNA, 25 bp, Mus musculus
ctcttccgggcgctggaccgcaatg

SEQ ID NO: 439013 - DNA, 25 bp, Mus musculus
acacgctacgaaacgctcttccggg

SEQ ID NO: 439014 - DNA, 25 bp, Mus musculus
gacgatccagacaacccgcggccgc

SEQ ID NO: 439015 - DNA, 25 bp, Mus musculus
cgcctgccacgacgcggagccgccc

SEQ ID NO: 439016 - DNA, 25 bp, Mus musculus
ccaccgccgcctgccacgacgcgga

SEQ ID NO: 439017 - DNA, 25 bp, Mus musculus
tggctgcgggcctttgtgctgccca

SEQ ID NO: 439018 - DNA, 25 bp, Mus musculus
cccgggaccatgctgcgctggctgc

SEQ ID NO: 439019 - DNA, 25 bp, Mus musculus
tcacggtgacttccccgggaccatg

SEQ ID NO: 439020 - DNA, 25 bp, Mus musculus
acaggcctccgcactcggatcgcgc

SEQ ID NO: 439021 - DNA, 25 bp, Mus musculus
tgggcatcccgctgggccaggacgc

SEQ ID NO: 439022 - DNA, 25 bp, Mus musculus
atccagcatggccttctccgatctg

SEQ ID NO: 439023 - DNA, 25 bp, Mus musculus
tgtgctctacagtctcatcgggagg

SEQ ID NO: 439024 - DNA, 25 bp, Mus musculus
gagcgtcttcttcttcctgccggtc

SEQ ID NO: 439025 - DNA, 25 bp, Mus musculus
catccttgtcatttgggccgtggcc

SEQ ID NO: 439026 - DNA, 25 bp, Mus musculus
ccgtgtgaagctggtcatccttgtc

SEQ ID NO: 439027 - DNA, 25 bp, Mus musculus
cttccagtttgtcagcgagagctgc

SEQ ID NO: 439028 - DNA, 25 bp, Mus musculus
tcggcgacctgctctgcaaactctt

SEQ ID NO: 439029 - DNA, 25 bp, Mus musculus
tcatcttcctgtgcatgccgctgga

SEQ ID NO: 439030 - DNA, 25 bp, Mus musculus
gggcaacctgctcaccatgctggtg

SEQ ID NO: 439031 - DNA, 25 bp, Mus musculus
actctctgacgaactgctgccactg

SEQ ID NO: 439032 - DNA, 25 bp, Mus musculus
tgggacgcttctcccggcaacgact

SEQ ID NO: 439033 - DNA, 25 bp, Mus musculus
agcctaacgtcacgctggacctgga

SEQ ID NO: 439034 - DNA, 25 bp, Mus musculus
cctggcaacatgtggaacgcgacgc

SEQ ID NO: 439035 - DNA, 25 bp, Mus musculus
cctctggcagtatcggccctggaac

SEQ ID NO: 439036 - DNA, 25 bp, Mus musculus
cggcgcccgctccagaaaggcaaag

SEQ ID NO: 439037 - DNA, 25 bp, Mus musculus
actcggcgcaggtgttcgacctggc

SEQ ID NO: 439038 - DNA, 25 bp, Mus musculus
ccaaccatcgggtgacctgggactc

SEQ ID NO: 439039 - DNA, 25 bp, Mus musculus
gtggctcatccacagcaaggtgctg

SEQ ID NO: 439040 - DNA, 25 bp, Mus musculus
aagcagtgcgctcagtggctcatcc

SEQ ID NO: 439041 - DNA, 25 bp, Mus musculus
gccgatgggctaatccctggacgcc

SEQ ID NO: 439042 - DNA, 25 bp, Mus musculus
ctccagaaaggcaaagcgaaccagg

SEQ ID NO: 439043 - DNA, 25 bp, Mus musculus
agagcgcgcggcactcgctgctgca

SEQ ID NO: 439044 - DNA, 25 bp, Mus musculus
tcggaagccagtgctcagcggagcc

SEQ ID NO: 439045 - DNA, 25 bp, Mus musculus
aggctcgccagtcggaagccagtgc

SEQ ID NO: 439046 - DNA, 25 bp, Mus musculus
aggtgttcgacctggcgcagaccct

SEQ ID NO: 439047 - DNA, 25 bp, Mus musculus
tccactcatccgagggttcacgggc

SEQ ID NO: 439048 - DNA, 25 bp, Mus musculus
aaccaggggccatcagcgcgactgg

SEQ ID NO: 439049 - DNA, 25 bp, Mus musculus
ccggggttgtgcaagctccactcat

SEQ ID NO: 439050 - DNA, 25 bp, Mus musculus
gatggaggctcaggatgcaacagcc

SEQ ID NO: 439051 - DNA, 25 bp, Mus musculus
tcaggatgcaacagcctgcgacccg

SEQ ID NO: 439052 - DNA, 25 bp, Mus musculus
tgtgggagacagagcgctgcgcgtt

SEQ ID NO: 439053 - DNA, 25 bp, Mus musculus
tggaggctcaggatgcaacagcctg

SEQ ID NO: 439054 - DNA, 25 bp, Mus musculus
aggctcaggatgcaacagcctgcga

SEQ ID NO: 439055 - DNA, 25 bp, Mus musculus
gctcaggatgcaacagcctgcgacc

SEQ ID NO: 439056 - DNA, 25 bp, Mus musculus
aacagcctgcgacccggtgctgggc

SEQ ID NO: 439057 - DNA, 25 bp, Mus musculus
caagcctgggatgtagtgtgggtgt

SEQ ID NO: 439058 - DNA, 25 bp, Mus musculus
gagttctggagtgcgcacaggctcc

SEQ ID NO: 439059 - DNA, 25 bp, Mus musculus
gcacaggctccgctctacctcctta

SEQ ID NO: 439060 - DNA, 25 bp, Mus musculus
tctacctccttaaggcgctttccaa

SEQ ID NO: 439061 - DNA, 25 bp, Mus musculus
atgcaacagcctgcgacccggtgct

SEQ ID NO: 439062 - DNA, 25 bp, Mus musculus
taaggcgctttccaaagttcctcgc

SEQ ID NO: 439063 - DNA, 25 bp, Mus musculus
tgctgggcgcaagcctgggatgtag

SEQ ID NO: 439064 - DNA, 25 bp, Mus musculus
gcagccagctctcggcaaacttagg

SEQ ID NO: 439065 - DNA, 25 bp, Mus musculus
cctctccctccaaaaatacagtggg

SEQ ID NO: 439066 - DNA, 25 bp, Mus musculus
cccaagatgcttcgggattgcggtt

SEQ ID NO: 439067 - DNA, 25 bp, Mus musculus
cgcgacgcacccaaagtccgtttga

SEQ ID NO: 439068 - DNA, 25 bp, Mus musculus
tgtcactgaacatagcgttgatggc

SEQ ID NO: 439069 - DNA, 25 bp, Mus musculus
ttcctccactcaagtcagaaatgtc

SEQ ID NO: 439070 - DNA, 25 bp, Mus musculus
ccttggcgccaagaagatcctctcg

SEQ ID NO: 439071 - DNA, 25 bp, Mus musculus
aatcaggacaattagccttggcgcc

SEQ ID NO: 439072 - DNA, 25 bp, Mus musculus
tcccgcttggcaccgctttcatttt

SEQ ID NO: 439073 - DNA, 25 bp, Mus musculus
atcccaggggatcagaaccagcagc

SEQ ID NO: 439074 - DNA, 25 bp, Mus musculus
ttttaagctgcagaacgattttccc

SEQ ID NO: 439075 - DNA, 25 bp, Mus musculus
aaatcgccgccttccgaggtctcgg

SEQ ID NO: 439076 - DNA, 25 bp, Mus musculus
cagtgggattaggaaccaaatcgcc

SEQ ID NO: 439077 - DNA, 25 bp, Mus musculus
gcccgcaaagcgacgagcgacgaaa

SEQ ID NO: 439078 - DNA, 25 bp, Mus musculus
gtgctgcttcacctggctccagaaa

SEQ ID NO: 439079 - DNA, 25 bp, Mus musculus
ggcgaagctctccatgcagctcata

SEQ ID NO: 439080 - DNA, 25 bp, Mus musculus
atcctgcaccacgatctccgaatgg

SEQ ID NO: 439081 - DNA, 25 bp, Mus musculus
cgaaaccatgtagaggcgcggaacc

SEQ ID NO: 439082 - DNA, 25 bp, Mus musculus
tgcagctcatatccacgccatagtg

SEQ ID NO: 439083 - DNA, 25 bp, Mus musculus
ttcaagtagaggagcgcctgcttcc

SEQ ID NO: 439084 - DNA, 25 bp, Mus musculus
cgccactcgagcatctggtcgctaa

SEQ ID NO: 439085 - DNA, 25 bp, Mus musculus
ccttcagccatttggtccgcgcgtg

SEQ ID NO: 439086 - DNA, 25 bp, Mus musculus
acggagctcagcatggactcgtgca

SEQ ID NO: 439087 - DNA, 25 bp, Mus musculus
gtagcccatccactcgctgacgatg

SEQ ID NO: 439088 - DNA, 25 bp, Mus musculus
gcggcccagttcttcaggatgccta

SEQ ID NO: 439089 - DNA, 25 bp, Mus musculus
actcgtagtacagctggtcccgctc

SEQ ID NO: 439090 - DNA, 25 bp, Mus musculus
ttcttgctcagcgacatcttggccc

SEQ ID NO: 439091 - DNA, 25 bp, Mus musculus
acagcaccagaggtttctccgagtc

SEQ ID NO: 439092 - DNA, 25 bp, Mus musculus
ggcgaccagctcactcgcaaagttc

SEQ ID NO: 439093 - DNA, 25 bp, Mus musculus
gttcttgacacctggacgccccata

SEQ ID NO: 439094 - DNA, 25 bp, Mus musculus
catagccggagcctgcgaggctcac

SEQ ID NO: 439095 - DNA, 25 bp, Mus musculus
cgctcaagccggacgaagctgcgtc

SEQ ID NO: 439096 - DNA, 25 bp, Mus musculus
ggactctgggtctacaccgcgcgat

SEQ ID NO: 439097 - DNA, 25 bp, Mus musculus
cgcgcgatccgcatcttgctgctgt

SEQ ID NO: 439098 - DNA, 25 bp, Mus musculus
tgtcggcgactgacggcgaccagct

SEQ ID NO: 439099 - DNA, 25 bp, Mus musculus
tacctcgctcaagccggacgaagct

SEQ ID NO: 439100 - DNA, 25 bp, Mus musculus
ctcgcaaagttccctgagctggggt

SEQ ID NO: 439101 - DNA, 25 bp, Mus musculus
ctcagcggtgcactccaatggccag

SEQ ID NO: 439102 - DNA, 25 bp, Mus musculus
tgcccgcaccacttttgcaagacga

SEQ ID NO: 439103 - DNA, 25 bp, Mus musculus
cacttttgcaagacgaagtctctga

SEQ ID NO: 439104 - DNA, 25 bp, Mus musculus
catcttgctgctgtcggcgactgac

SEQ ID NO: 439105 - DNA, 25 bp, Mus musculus
acgaagctgcgtccgcaggactctg

SEQ ID NO: 439106 - DNA, 25 bp, Mus musculus
ccacggaactcaactcggctgcttg

SEQ ID NO: 439107 - DNA, 25 bp, Mus musculus
ccaggtttctaagggaccgccagct

SEQ ID NO: 439108 - DNA, 25 bp, Mus musculus
tccaagtcttccaagggaggcgggc

SEQ ID NO: 439109 - DNA, 25 bp, Mus musculus
gctattgccttccagccggctcttg

SEQ ID NO: 439110 - DNA, 25 bp, Mus musculus
tggcgcctaaagcagtgtgtgtaca

SEQ ID NO: 439111 - DNA, 25 bp, Mus musculus
tacacgggagagcacgcgtacaccc

SEQ ID NO: 439112 - DNA, 25 bp, Mus musculus
ccgacgaactcagcggttattcatg

SEQ ID NO: 439113 - DNA, 25 bp, Mus musculus
ttcatggagaagtctgtgcgcacac

SEQ ID NO: 439114 - DNA, 25 bp, Mus musculus
gcaaatgattttctgggacacggta

SEQ ID NO: 439115 - DNA, 25 bp, Mus musculus
tgcctacccacgctgggcacagagg

SEQ ID NO: 439116 - DNA, 25 bp, Mus musculus
ttctccacgtcaccaggggtctcga

SEQ ID NO: 439117 - DNA, 25 bp, Mus musculus
gcgctgatgtcactccgtcgcagca

SEQ ID NO: 439118 - DNA, 25 bp, Mus musculus
gcttggcctcccaggttcaaatcta

SEQ ID NO: 439119 - DNA, 25 bp, Mus musculus
ccactgggccacaaacggatgctcg

SEQ ID NO: 439120 - DNA, 25 bp, Mus musculus
atgtttgagtcctggcttgccggga

SEQ ID NO: 439121 - DNA, 25 bp, Mus musculus
tggagcggtctgtcatctccgcctc

SEQ ID NO: 439122 - DNA, 25 bp, Mus musculus
gaagtccctccggttgttcctgcca

SEQ ID NO: 439123 - DNA, 25 bp, Mus musculus
gtcatcagcccggacgccctttggg

SEQ ID NO: 439124 - DNA, 25 bp, Mus musculus
ctctgcgctttacggcgccgttagg

SEQ ID NO: 439125 - DNA, 25 bp, Mus musculus
gcctcctgccagtcgtaaagtgctg

SEQ ID NO: 439126 - DNA, 25 bp, Mus musculus
tctatagctcgttcctggagcggtc

SEQ ID NO: 439127 - DNA, 25 bp, Mus musculus
ggggtatgcgatcgctctatagctc

SEQ ID NO: 439128 - DNA, 25 bp, Mus musculus
agctggacccattcctgacccttga

SEQ ID NO: 439129 - DNA, 25 bp, Mus musculus
acgctgggtcctttccaggcgcaca

SEQ ID NO: 439130 - DNA, 25 bp, Mus musculus
cgccctttggggatgtttgagtcct

SEQ ID NO: 439131 - DNA, 25 bp, Mus musculus
cgattgggagctatcgtcatcagcc

SEQ ID NO: 439132 - DNA, 25 bp, Mus musculus
ttgttcctgccagtgtgcgtctgga

SEQ ID NO: 439133 - DNA, 25 bp, Mus musculus
cgtaaagtgctgtgaagggctctgc

SEQ ID NO: 439134 - DNA, 25 bp, Mus musculus
cggaaaccgtcacgcgggacgcgat

SEQ ID NO: 439135 - DNA, 25 bp, Mus musculus
ctctagctgagctaggggtcctatc

SEQ ID NO: 439136 - DNA, 25 bp, Mus musculus
agcggtgacgcttcaaacgcggacc

SEQ ID NO: 439137 - DNA, 25 bp, Mus musculus
cacacacccgggaattcgaggactt

SEQ ID NO: 439138 - DNA, 25 bp, Mus musculus
tgcggaaagtccgagctgaaagctt

SEQ ID NO: 439139 - DNA, 25 bp, Mus musculus
agctgaaagcttggggatctatctc

SEQ ID NO: 439140 - DNA, 25 bp, Mus musculus
ggggtcctatctcctgaactcacga

SEQ ID NO: 439141 - DNA, 25 bp, Mus musculus
ctgctggctctctgcagacgtggct

SEQ ID NO: 439142 - DNA, 25 bp, Mus musculus
catcactgaaaagcccaggcggcca

SEQ ID NO: 439143 - DNA, 25 bp, Mus musculus
ccgtccctctagaagtgactcggta

SEQ ID NO: 439144 - DNA, 25 bp, Mus musculus
ccgaggtcaacgctaagggagtcca

SEQ ID NO: 439145 - DNA, 25 bp, Mus musculus
tgtgccttaggcagcatcactgaaa

SEQ ID NO: 439146 - DNA, 25 bp, Mus musculus
tgcgagaatggcttcccgaggtcaa

SEQ ID NO: 439147 - DNA, 25 bp, Mus musculus
ccactgcacgggatgtgcgagaatg

SEQ ID NO: 439148 - DNA, 25 bp, Mus musculus
cagcagcaccgacaagccgctgaga

SEQ ID NO: 439149 - DNA, 25 bp, Mus musculus
cgggtacccagttgcgcctgggaca

SEQ ID NO: 439150 - DNA, 25 bp, Mus musculus
cccggcaggacagatcgcacggatc

SEQ ID NO: 439151 - DNA, 25 bp, Mus musculus
atcgcacggatctgcggaactcctc

SEQ ID NO: 439152 - DNA, 25 bp, Mus musculus
ggaactcctcgttcctccacgtgta

SEQ ID NO: 439153 - DNA, 25 bp, Mus musculus
tcctccacgtgtagagcagcgggtt

SEQ ID NO: 439154 - DNA, 25 bp, Mus musculus
ttgagcgccgacagggcgcagcaca

SEQ ID NO: 439155 - DNA, 25 bp, Mus musculus
agcacaggagccagctggccgcctg

SEQ ID NO: 439156 - DNA, 25 bp, Mus musculus
ggagaagccactggccaggctcacc

SEQ ID NO: 439157 - DNA, 25 bp, Mus musculus
gccagcaggaagacgcagcagagca

SEQ ID NO: 439158 - DNA, 25 bp, Mus musculus
gacaagccgctgagacgccgctgcg

SEQ ID NO: 439159 - DNA, 25 bp, Mus musculus
aggtggaagttgagcacgctgaccc

SEQ ID NO: 439160 - DNA, 25 bp, Mus musculus
tgagcacgctgacccgcttgacgct

SEQ ID NO: 439161 - DNA, 25 bp, Mus musculus
acaccagcggctgcgtggccagcag

SEQ ID NO: 439162 - DNA, 25 bp, Mus musculus
tgaccataccgttggccagcgtgcc

SEQ ID NO: 439163 - DNA, 25 bp, Mus musculus
cgccctagcgttggcttcgtgtagc

SEQ ID NO: 439164 - DNA, 25 bp, Mus musculus
cacgattcttcttcctcgcagagca

SEQ ID NO: 439165 - DNA, 25 bp, Mus musculus
agcatgcccaccgtgtggcgccgtt

SEQ ID NO: 439166 - DNA, 25 bp, Mus musculus
ttcagcgccacgaggcaatgggaca

SEQ ID NO: 439167 - DNA, 25 bp, Mus musculus
gggacacagtgagcccgaggcccaa

SEQ ID NO: 439168 - DNA, 25 bp, Mus musculus
accgcctcctgtggcatccagaggg

SEQ ID NO: 439169 - DNA, 25 bp, Mus musculus
cagacgctgagatccgcggcgcagc

SEQ ID NO: 439170 - DNA, 25 bp, Mus musculus
ggtcattctggccaactcttcacac

SEQ ID NO: 439171 - DNA, 25 bp, Mus musculus
cggcgcagccattcacgatgaaggc

SEQ ID NO: 439172 - DNA, 25 bp, Mus musculus
tgcagctttcggaaggacgacacga

SEQ ID NO: 439173 - DNA, 25 bp, Mus musculus
acgacacgagatagatgaccatacc

SEQ ID NO: 439174 - DNA, 25 bp, Mus musculus
tacaggagagacaccgggatccgcc

SEQ ID NO: 439175 - DNA, 25 bp, Mus musculus
ccaggcccgagtacaggagagacac

SEQ ID NO: 439176 - DNA, 25 bp, Mus musculus
tcagaactgagtgcgtgcagctgta

SEQ ID NO: 439177 - DNA, 25 bp, Mus musculus
aactgagtgcgtgcagctgtacgtc

SEQ ID NO: 439178 - DNA, 25 bp, Mus musculus
tcagaactgagtgcgtgcaactgta

SEQ ID NO: 439179 - DNA, 25 bp, Mus musculus
tgcaactgtacgtcagcgtcagaac

SEQ ID NO: 439180 - DNA, 25 bp, Mus musculus
tgagtgcgtgcaactgtacgtcagc

SEQ ID NO: 439181 - DNA, 25 bp, Mus musculus
actgtacgtcatcgtcagaactgag

SEQ ID NO: 439182 - DNA, 25 bp, Mus musculus
tgcaactgtacgtcatcgtcagaac

SEQ ID NO: 439183 - DNA, 25 bp, Mus musculus
cgtcagaactgagtgcgtgcaactg

SEQ ID NO: 439184 - DNA, 25 bp, Mus musculus
gcaactgtacgtcagcgtcagaact

SEQ ID NO: 439185 - DNA, 25 bp, Mus musculus
gtgcagctgtacgtcagcgtcagaa

SEQ ID NO: 439186 - DNA, 25 bp, Mus musculus
tgcagctgtacgtcagcgtcagaac

SEQ ID NO: 439187 - DNA, 25 bp, Mus musculus
cgtcagaactgagtgcgtgcagctg

SEQ ID NO: 439188 - DNA, 25 bp, Mus musculus
cgtgcaactgtacgtcagcgtcaga

SEQ ID NO: 439189 - DNA, 25 bp, Mus musculus
gcgtcagaactgagtgcgtgcaact

SEQ ID NO: 439190 - DNA, 25 bp, Mus musculus
cccgctttccgcgaggactgacagg

SEQ ID NO: 439191 - DNA, 25 bp, Mus musculus
ctcgtgcagactcggagtccggccg

SEQ ID NO: 439192 - DNA, 25 bp, Mus musculus
agcgcactcgtgcagactcggagtc

SEQ ID NO: 439193 - DNA, 25 bp, Mus musculus
ggcagccaagttttcctcgggcatc

SEQ ID NO: 439194 - DNA, 25 bp, Mus musculus
cgggactcggcagccaagttttcct

SEQ ID NO: 439195 - DNA, 25 bp, Mus musculus
aggtctcccgggacgctcgcagagt

SEQ ID NO: 439196 - DNA, 25 bp, Mus musculus
acgtcgaagattcctcggcctggcc

SEQ ID NO: 439197 - DNA, 25 bp, Mus musculus
tcccaaagtgacacgtcgaagattc

SEQ ID NO: 439198 - DNA, 25 bp, Mus musculus
tacagcctcccaaagtgacacgtcg

SEQ ID NO: 439199 - DNA, 25 bp, Mus musculus
tggaaatctacagcctcccaaagtg

SEQ ID NO: 439200 - DNA, 25 bp, Mus musculus
tccctccaccatatggaaatctaca

SEQ ID NO: 439201 - DNA, 25 bp, Mus musculus
ggcgcggattccacccgctgggtct

SEQ ID NO: 439202 - DNA, 25 bp, Mus musculus
tgcctgccatccgaaccagacggtc

SEQ ID NO: 439203 - DNA, 25 bp, Mus musculus
ttccgcgaggactgacaggcccttc

SEQ ID NO: 439204 - DNA, 25 bp, Mus musculus
ggagctcgcggtcccaatcaccgag

SEQ ID NO: 439205 - DNA, 25 bp, Mus musculus
ccactgcccaagagctgggagctcg

SEQ ID NO: 439206 - DNA, 25 bp, Mus musculus
tcatggaggacaagacgtttggccc

SEQ ID NO: 439207 - DNA, 25 bp, Mus musculus
cccggctcccaaagtgatcatggag

SEQ ID NO: 439208 - DNA, 25 bp, Mus musculus
accagctcccaaggccgggcaaagt

SEQ ID NO: 439209 - DNA, 25 bp, Mus musculus
tgtaaccgctgtgatccggactctg

SEQ ID NO: 439210 - DNA, 25 bp, Mus musculus
catcttaagcgagatccgcacgggg

SEQ ID NO: 439211 - DNA, 25 bp, Mus musculus
gactccgctgccatcttaagcgaga

SEQ ID NO: 439212 - DNA, 25 bp, Mus musculus
ggctgctcctcacctttcatgaact

SEQ ID NO: 439213 - DNA, 25 bp, Mus musculus
ccagcatagaggcttgggacaaagg

SEQ ID NO: 439214 - DNA, 25 bp, Mus musculus
ggcccgaaaagaaacccagcataga

SEQ ID NO: 439215 - DNA, 25 bp, Mus musculus
tcgtggccagatgaggtcacccgcc

SEQ ID NO: 439216 - DNA, 25 bp, Mus musculus
ccgagccgcagtactgagggacaca

SEQ ID NO: 439217 - DNA, 25 bp, Mus musculus
tgctgctgcttctcgagctgcagct

SEQ ID NO: 439218 - DNA, 25 bp, Mus musculus
gagaccctgaggatctggccgccct

SEQ ID NO: 439219 - DNA, 25 bp, Mus musculus
actgttgctgtggaaacgaattccc

SEQ ID NO: 439220 - DNA, 25 bp, Mus musculus
ccgggaaactgttgctgtggaaacg

SEQ ID NO: 439221 - DNA, 25 bp, Mus musculus
ccgagctcgccggaaggagaaagaa

SEQ ID NO: 439222 - DNA, 25 bp, Mus musculus
tgatagtgcgcttccgggccgagct

SEQ ID NO: 439223 - DNA, 25 bp, Mus musculus
ccgcaggcctgatagtgcgcttccg

SEQ ID NO: 439224 - DNA, 25 bp, Mus musculus
ccgcaagcccgcaggcctgatagtg

SEQ ID NO: 439225 - DNA, 25 bp, Mus musculus
ccggcaaaagacgaggcgcccgcaa

SEQ ID NO: 439226 - DNA, 25 bp, Mus musculus
cgtccctgctgcaaccggcaaaaga

SEQ ID NO: 439227 - DNA, 25 bp, Mus musculus
atctggccgccctgtagagagcacc

SEQ ID NO: 439228 - DNA, 25 bp, Mus musculus
ttctgcacgcgcaagggtaggccca

SEQ ID NO: 439229 - DNA, 25 bp, Mus musculus
cggatcttctgcacgcgcaagggta

SEQ ID NO: 439230 - DNA, 25 bp, Mus musculus
gaccctgccggcagctgtacgcatg

SEQ ID NO: 439231 - DNA, 25 bp, Mus musculus
aatgacagaggttgaatggaggccc

SEQ ID NO: 439232 - DNA, 25 bp, Mus musculus
ggctgacgaggtccaaagctccttc

SEQ ID NO: 439233 - DNA, 25 bp, Mus musculus
ccctgcggacttaatggataccttt

SEQ ID NO: 439234 - DNA, 25 bp, Mus musculus
gcagcttgttcccttgctagtgaaa

SEQ ID NO: 439235 - DNA, 25 bp, Mus musculus
cagcggtccgacatgagtcaagttc

SEQ ID NO: 439236 - DNA, 25 bp, Mus musculus
agctccttcgttccctctgtttatc

SEQ ID NO: 439237 - DNA, 25 bp, Mus musculus
agcgtgttcgccacagaaccttttc

SEQ ID NO: 439238 - DNA, 25 bp, Mus musculus
aactcaaactcatcgggaccggctc

SEQ ID NO: 439239 - DNA, 25 bp, Mus musculus
cggtgggcagaactgcatttactta

SEQ ID NO: 439240 - DNA, 25 bp, Mus musculus
ggaaatgacgcatcagcccggctcg

SEQ ID NO: 439241 - DNA, 25 bp, Mus musculus
ctacgaagtagttgcatctgccgtc

SEQ ID NO: 439242 - DNA, 25 bp, Mus musculus
tctgccgtcgatgggaaatccgatc

SEQ ID NO: 439243 - DNA, 25 bp, Mus musculus
gcctccataacgctgggtccttttg

SEQ ID NO: 439244 - DNA, 25 bp, Mus musculus
ctggctcagcccaaagttgtcagtc

SEQ ID NO: 439245 - DNA, 25 bp, Mus musculus
tcccttaacaaacgtggccgcctga

SEQ ID NO: 439246 - DNA, 25 bp, Mus musculus
cgctctcggcccagcgaaggcggaa

SEQ ID NO: 439247 - DNA, 25 bp, Mus musculus
ccctgggtcattttaccatcctcga

SEQ ID NO: 439248 - DNA, 25 bp, Mus musculus
tggccagcatgatactgcggttcgc

SEQ ID NO: 439249 - DNA, 25 bp, Mus musculus
cttaatgatgatctttttggccagc

SEQ ID NO: 439250 - DNA, 25 bp, Mus musculus
ccggcgaccgcgatgggacaacgca

SEQ ID NO: 439251 - DNA, 25 bp, Mus musculus
tgcggcgcggaaccagcagcactca

SEQ ID NO: 439252 - DNA, 25 bp, Mus musculus
cgcgtcacatcgtgcgatcggctga

SEQ ID NO: 439253 - DNA, 25 bp, Mus musculus
ccaaccctgcaatagcggaggactg

SEQ ID NO: 439254 - DNA, 25 bp, Mus musculus
cgccggaggtaccagcagcgtccag

SEQ ID NO: 439255 - DNA, 25 bp, Mus musculus
tacggagcgcaaggctgcccagcct

SEQ ID NO: 439256 - DNA, 25 bp, Mus musculus
ggtagccgaacagctccaagccgct

SEQ ID NO: 439257 - DNA, 25 bp, Mus musculus
ccgccacagcatacggagcgcaagg

SEQ ID NO: 439258 - DNA, 25 bp, Mus musculus
atgggacaacgcacgtaccctggcc

SEQ ID NO: 439259 - DNA, 25 bp, Mus musculus
accgtgcctccgtccttaatgatga

SEQ ID NO: 439260 - DNA, 25 bp, Mus musculus
accggaagcgcaaacactgggttgg

SEQ ID NO: 439261 - DNA, 25 bp, Mus musculus
ctcagcctccatgcaggacacttgt

SEQ ID NO: 439262 - DNA, 25 bp, Mus musculus
agcccgcatattcccgaacactaaa

SEQ ID NO: 439263 - DNA, 25 bp, Mus musculus
ggggcattatccagcccgcatattc

SEQ ID NO: 439264 - DNA, 25 bp, Mus musculus
ttgcttggaggcgagggtcttctac

SEQ ID NO: 439265 - DNA, 25 bp, Mus musculus
cagcgcaggccttgccgaggtagat

SEQ ID NO: 439266 - DNA, 25 bp, Mus musculus
acaaagcctggttggcggctacttc

SEQ ID NO: 439267 - DNA, 25 bp, Mus musculus
tgcaggacacttgttcccggtttta

SEQ ID NO: 439268 - DNA, 25 bp, Mus musculus
ccggagaaactagtgacccgcctca

SEQ ID NO: 439269 - DNA, 25 bp, Mus musculus
gcctcagcttcgaacaacacaaaca

SEQ ID NO: 439270 - DNA, 25 bp, Mus musculus
aagattcctggcacagtcgtcgctg

SEQ ID NO: 439271 - DNA, 25 bp, Mus musculus
ggcaggcaagagtaggacacacacc

SEQ ID NO: 439272 - DNA, 25 bp, Mus musculus
ggacacacaccggtacagcgcaggc

SEQ ID NO: 439273 - DNA, 25 bp, Mus musculus
cttgtagtgttggataacgcgcagc

SEQ ID NO: 439274 - DNA, 25 bp, Mus musculus
ttcctcaccaggctgtctgctctgg

SEQ ID NO: 439275 - DNA, 25 bp, Mus musculus
tcaaagcagcagtggccaggcatcc

SEQ ID NO: 439276 - DNA, 25 bp, Mus musculus
gcacctcctttcaacacacccactg

SEQ ID NO: 439277 - DNA, 25 bp, Mus musculus
tgggctccgggaccatgccgccaaa

SEQ ID NO: 439278 - DNA, 25 bp, Mus musculus
ccaaacgcaagaaagctcgggtgca

SEQ ID NO: 439279 - DNA, 25 bp, Mus musculus
ggcatccagctagtcctggaagctg

SEQ ID NO: 439280 - DNA, 25 bp, Mus musculus
ctacagatcaaagcagcagtggcca

SEQ ID NO: 439281 - DNA, 25 bp, Mus musculus
ctgggccgctacagatcaaagcagc

SEQ ID NO: 439282 - DNA, 25 bp, Mus musculus
accaggctgtctgctctgggccgct

SEQ ID NO: 439283 - DNA, 25 bp, Mus musculus
acccactgaacacccactagccctt

SEQ ID NO: 439284 - DNA, 25 bp, Mus musculus
cagagacgcgcgggcatccgctgca

SEQ ID NO: 439285 - DNA, 25 bp, Mus musculus
gtagcctaccatgaccctccagggg

SEQ ID NO: 439286 - DNA, 25 bp, Mus musculus
aagaaagctcgggtgcagccgccgc

SEQ ID NO: 439287 - DNA, 25 bp, Mus musculus
cagctagtcctggaagctggaggct

SEQ ID NO: 439288 - DNA, 25 bp, Mus musculus
agctcccgtgacagtctcacggtcg

SEQ ID NO: 439289 - DNA, 25 bp, Mus musculus
tgcagccgtccgctgtggtcccggt

SEQ ID NO: 439290 - DNA, 25 bp, Mus musculus
caggctgagccggagctcccgaaat

SEQ ID NO: 439291 - DNA, 25 bp, Mus musculus
ccagcttcgcgcttgcgggacgcgt

SEQ ID NO: 439292 - DNA, 25 bp, Mus musculus
gctgtggtcccggtggcctcaaccg

SEQ ID NO: 439293 - DNA, 25 bp, Mus musculus
tctactcctcataaactagggctgc

SEQ ID NO: 439294 - DNA, 25 bp, Mus musculus
ccggaggtacaaggcgcccattcat

SEQ ID NO: 439295 - DNA, 25 bp, Mus musculus
tcggcacgtccaggccggaggtaca

SEQ ID NO: 439296 - DNA, 25 bp, Mus musculus
acccagaacgtttcggcacgtccag

SEQ ID NO: 439297 - DNA, 25 bp, Mus musculus
tctggagcttgcaggcacactgcct

SEQ ID NO: 439298 - DNA, 25 bp, Mus musculus
cacttggcccgccagtctggagctt

SEQ ID NO: 439299 - DNA, 25 bp, Mus musculus
atgaccgcggaaggacaggccgcca

SEQ ID NO: 439300 - DNA, 25 bp, Mus musculus
ctcccgaaatgaccgcggaaggaca

SEQ ID NO: 439301 - DNA, 25 bp, Mus musculus
tctgtggcccggaccgcttcggtga

SEQ ID NO: 439302 - DNA, 25 bp, Mus musculus
ggacgcattccaggcacttacgagc

SEQ ID NO: 439303 - DNA, 25 bp, Mus musculus
acagaccactgatctcgcgagaggt

SEQ ID NO: 439304 - DNA, 25 bp, Mus musculus
agcacagaccactgatctcgcgaga

SEQ ID NO: 439305 - DNA, 25 bp, Mus musculus
aggacgtgccgactccgctgggccc

SEQ ID NO: 439306 - DNA, 25 bp, Mus musculus
tgacaggccagggccgccgagactc

SEQ ID NO: 439307 - DNA, 25 bp, Mus musculus
cgggccaggggacagtgacaggcca

SEQ ID NO: 439308 - DNA, 25 bp, Mus musculus
caggcacttacgagcgggatagacg

SEQ ID NO: 439309 - DNA, 25 bp, Mus musculus
gagacggacgcattccaggcactta

SEQ ID NO: 439310 - DNA, 25 bp, Mus musculus
cgcgtccggagacggacgcattcca

SEQ ID NO: 439311 - DNA, 25 bp, Mus musculus
tagatagaaggaatgcgcgtccgga

SEQ ID NO: 439312 - DNA, 25 bp, Mus musculus
gctatagatagaaggaatgcgcgtc

SEQ ID NO: 439313 - DNA, 25 bp, Mus musculus
gcgatgtacagagcggctatagata

SEQ ID NO: 439314 - DNA, 25 bp, Mus musculus
gcatgcgatgtacagagcggctata

SEQ ID NO: 439315 - DNA, 25 bp, Mus musculus
gtacagcgggaacgccggacgcagc

SEQ ID NO: 439316 - DNA, 25 bp, Mus musculus
gagctgtccggaaagatctgcatta

SEQ ID NO: 439317 - DNA, 25 bp, Mus musculus
ccaagctgttgctgagatggcttcc

SEQ ID NO: 439318 - DNA, 25 bp, Mus musculus
tagcagctccctctccaagctgttg

SEQ ID NO: 439319 - DNA, 25 bp, Mus musculus
tgcgggcaagggatagcagctccct

SEQ ID NO: 439320 - DNA, 25 bp, Mus musculus
gtcttcttcagcctggctttagtcc

SEQ ID NO: 439321 - DNA, 25 bp, Mus musculus
gctttagtccgtgttttgcgggcaa

SEQ ID NO: 439322 - DNA, 25 bp, Mus musculus
tccttgatcactttgccctttggcc

SEQ ID NO: 439323 - DNA, 25 bp, Mus musculus
ggagggtgacgctgtccttgatcac

SEQ ID NO: 439324 - DNA, 25 bp, Mus musculus
ctcaacgaaataaaaacagggcagg

SEQ ID NO: 439325 - DNA, 25 bp, Mus musculus
aagccgtgaggctcctctgctggct

SEQ ID NO: 439326 - DNA, 25 bp, Mus musculus
tctgcattatgccagggcgctgggc

SEQ ID NO: 439327 - DNA, 25 bp, Mus musculus
gcccaggacccgaattagctccgga

SEQ ID NO: 439328 - DNA, 25 bp, Mus musculus
tgggccaactcacctcaacgaaata

SEQ ID NO: 439329 - DNA, 25 bp, Mus musculus
accgctggaaccagcgcgctgcatg

SEQ ID NO: 439330 - DNA, 25 bp, Mus musculus
ggacgaggtgccaccgacgccgctt

SEQ ID NO: 439331 - DNA, 25 bp, Mus musculus
ggacggtgatgctggcttactactt

SEQ ID NO: 439332 - DNA, 25 bp, Mus musculus
gattcttctgccacgacagcgccta

SEQ ID NO: 439333 - DNA, 25 bp, Mus musculus
cactgtgaacgtgcagggattcttc

SEQ ID NO: 439334 - DNA, 25 bp, Mus musculus
tacacagacacgttcactgtgaacg

SEQ ID NO: 439335 - DNA, 25 bp, Mus musculus
ttcgaatacacagacacgttcactg

SEQ ID NO: 439336 - DNA, 25 bp, Mus musculus
gctggcttactacttcgaatacaca

SEQ ID NO: 439337 - DNA, 25 bp, Mus musculus
tccagatggtgatcatggcagggac

SEQ ID NO: 439338 - DNA, 25 bp, Mus musculus
gctctatttccagatggtgatcatg

SEQ ID NO: 439339 - DNA, 25 bp, Mus musculus
cagcagcatgctctatttccagatg

SEQ ID NO: 439340 - DNA, 25 bp, Mus musculus
tgcccgtggcgctcatcagcagcat

SEQ ID NO: 439341 - DNA, 25 bp, Mus musculus
gcgcatcccgaagcccagtcgcatc

SEQ ID NO: 439342 - DNA, 25 bp, Mus musculus
ccggtccgagggcttgaccacagtg

SEQ ID NO: 439343 - DNA, 25 bp, Mus musculus
cttgaccacagtgccgcggtgtcgc

SEQ ID NO: 439344 - DNA, 25 bp, Mus musculus
cgccagctccgaggagcccgacgcc

SEQ ID NO: 439345 - DNA, 25 bp, Mus musculus
tcctcgtcctcgtccagatccagca

SEQ ID NO: 439346 - DNA, 25 bp, Mus musculus
agatccagcacatcggcctgcagca

SEQ ID NO: 439347 - DNA, 25 bp, Mus musculus
catcccggcagtgcgcgcccagccg

SEQ ID NO: 439348 - DNA, 25 bp, Mus musculus
caggcgctcgccgtccatcccggca

SEQ ID NO: 439349 - DNA, 25 bp, Mus musculus
tgcaggaaccgctgccactcgggat

SEQ ID NO: 439350 - DNA, 25 bp, Mus musculus
aggctgcaggaaccgctgccactcg

SEQ ID NO: 439351 - DNA, 25 bp, Mus musculus
gcaggctgcaggaaccgctgccact

SEQ ID NO: 439352 - DNA, 25 bp, Mus musculus
cagcaggctgcaggaaccgctgcca

SEQ ID NO: 439353 - DNA, 25 bp, Mus musculus
ctgcagcaggctgcaggaaccgctg

SEQ ID NO: 439354 - DNA, 25 bp, Mus musculus
gcacatcggcctgcagcaggctgca

SEQ ID NO: 439355 - DNA, 25 bp, Mus musculus
cagcacatcggcctgcagcaggctg

SEQ ID NO: 439356 - DNA, 25 bp, Mus musculus
gatccagcacatcggcctgcagcag

SEQ ID NO: 439357 - DNA, 25 bp, Mus musculus
ctcgccgtccatcccggcagtgcgc

SEQ ID NO: 439358 - DNA, 25 bp, Mus musculus
aaattgccgaaggtgccggagcgca

SEQ ID NO: 439359 - DNA, 25 bp, Mus musculus
tggtggtaaaggcattccgatggcc

SEQ ID NO: 439360 - DNA, 25 bp, Mus musculus
taaaggcattccgatggcctcccgc

SEQ ID NO: 439361 - DNA, 25 bp, Mus musculus
ccgctcccagactcggatgaaaaca

SEQ ID NO: 439362 - DNA, 25 bp, Mus musculus
cccagactcggatgaaaacaaagga

SEQ ID NO: 439363 - DNA, 25 bp, Mus musculus
acaaaggagtgtgacatgtgccctc

SEQ ID NO: 439364 - DNA, 25 bp, Mus musculus
gagtgtgacatgtgccctcctccct

SEQ ID NO: 439365 - DNA, 25 bp, Mus musculus
tacccgtccattgccgaaccggaca

SEQ ID NO: 439366 - DNA, 25 bp, Mus musculus
gaaccggacaaagcttcgctcccaa

SEQ ID NO: 439367 - DNA, 25 bp, Mus musculus
caaagcttcgctcccaagaaccgag

SEQ ID NO: 439368 - DNA, 25 bp, Mus musculus
aagaaccgagccacgcagccagcga

SEQ ID NO: 439369 - DNA, 25 bp, Mus musculus
agccagcgagccacacaagcggcga

SEQ ID NO: 439370 - DNA, 25 bp, Mus musculus
cacacaagcggcgagaaaatggcgg

SEQ ID NO: 439371 - DNA, 25 bp, Mus musculus
gccagggcccgacggaaattgccga

SEQ ID NO: 439372 - DNA, 25 bp, Mus musculus
agccgggtcagctgctgatgtccta

SEQ ID NO: 439373 - DNA, 25 bp, Mus musculus
ggggcgtcctctgtaggatgcaccc

SEQ ID NO: 439374 - DNA, 25 bp, Mus musculus
cgcgcacactgaccgcaggcgagga

SEQ ID NO: 439375 - DNA, 25 bp, Mus musculus
cccgcggataactgtggctgagtta

SEQ ID NO: 439376 - DNA, 25 bp, Mus musculus
tcccgggctcagtagatttgttcgc

SEQ ID NO: 439377 - DNA, 25 bp, Mus musculus
tctcaagtccctgcagatccggggc

SEQ ID NO: 439378 - DNA, 25 bp, Mus musculus
gcgaggaccgctaccctgagagcag

SEQ ID NO: 439379 - DNA, 25 bp, Mus musculus
tgcgctggcaagagccgcgcgcaca

SEQ ID NO: 439380 - DNA, 25 bp, Mus musculus
ggagtccctcccatagtcttaattc

SEQ ID NO: 439381 - DNA, 25 bp, Mus musculus
agccctgtccctgaagttcccttgg

SEQ ID NO: 439382 - DNA, 25 bp, Mus musculus
gacgttcgcggtcctcgtgcttcat

SEQ ID NO: 439383 - DNA, 25 bp, Mus musculus
ccaggcttgcgggacttctgagccc

SEQ ID NO: 439384 - DNA, 25 bp, Mus musculus
ggctgagttaggacacttggacaga

SEQ ID NO: 439385 - DNA, 25 bp, Mus musculus
agatttgttcgctcccgctagatcg

SEQ ID NO: 439386 - DNA, 25 bp, Mus musculus
tgcgcgggctttcccagcaagtcac

SEQ ID NO: 439387 - DNA, 25 bp, Mus musculus
gccgccgcacacctgcgagagcctc

SEQ ID NO: 439388 - DNA, 25 bp, Mus musculus
caaacggcgtcacctgtgccgggtc

SEQ ID NO: 439389 - DNA, 25 bp, Mus musculus
acaggcgcctggtcatccagcctgg

SEQ ID NO: 439390 - DNA, 25 bp, Mus musculus
gccacgcgcgagatgctcgcggaaa

SEQ ID NO: 439391 - DNA, 25 bp, Mus musculus
ctcgggttaccgcagagcggctcct

SEQ ID NO: 439392 - DNA, 25 bp, Mus musculus
ggttaccgcagagcggctccttaaa

SEQ ID NO: 439393 - DNA, 25 bp, Mus musculus
cacctcccggcgctgggacttggat

SEQ ID NO: 439394 - DNA, 25 bp, Mus musculus
gctgcgaaggaaccctgagagctca

SEQ ID NO: 439395 - DNA, 25 bp, Mus musculus
ggagaagaagtatgtgagtccgccc

SEQ ID NO: 439396 - DNA, 25 bp, Mus musculus
gagagctcacacctctgcccgggtg

SEQ ID NO: 439397 - DNA, 25 bp, Mus musculus
agcaagtcacagacctcacgagtgg

SEQ ID NO: 439398 - DNA, 25 bp, Mus musculus
acagacctcacgagtggggagaaga

SEQ ID NO: 439399 - DNA, 25 bp, Mus musculus
ggaaccctgagagctcacacctctg

SEQ ID NO: 439400 - DNA, 25 bp, Mus musculus
tcgtggctggatccggtaagtatcc

SEQ ID NO: 439401 - DNA, 25 bp, Mus musculus
gcgttttccaatcagagccacactt

SEQ ID NO: 439402 - DNA, 25 bp, Mus musculus
ttcgcccttcttagcgcctttagga

SEQ ID NO: 439403 - DNA, 25 bp, Mus musculus
cgacggtcttgagttaggcactaca

SEQ ID NO: 439404 - DNA, 25 bp, Mus musculus
agtctctcagactcttgatcgtggc

SEQ ID NO: 439405 - DNA, 25 bp, Mus musculus
ttccagcgactatggaccgtgcttg

SEQ ID NO: 439406 - DNA, 25 bp, Mus musculus
ccgcagggctagtgatcttgctatt

SEQ ID NO: 439407 - DNA, 25 bp, Mus musculus
cgccatcctttgaatgctgagcatt

SEQ ID NO: 439408 - DNA, 25 bp, Mus musculus
ggtctacacgcatgcgccatccttt

SEQ ID NO: 439409 - DNA, 25 bp, Mus musculus
agcgcggtgcttgcaaactttaacc

SEQ ID NO: 439410 - DNA, 25 bp, Mus musculus
tctgaactttgaccgcccaacttgg

SEQ ID NO: 439411 - DNA, 25 bp, Mus musculus
gagacgcgtcgttctgcgttttcca

SEQ ID NO: 439412 - DNA, 25 bp, Mus musculus
acccggctcactgagacgcaagaga

SEQ ID NO: 439413 - DNA, 25 bp, Mus musculus
agaggcgctttgctccctgtttgct

SEQ ID NO: 439414 - DNA, 25 bp, Mus musculus
agcctggctcgcacgcgttggtgct

SEQ ID NO: 439415 - DNA, 25 bp, Mus musculus
ccattggccgggaagccttggagca

SEQ ID NO: 439416 - DNA, 25 bp, Mus musculus
tcattggtcgggctcgccggccaat

SEQ ID NO: 439417 - DNA, 25 bp, Mus musculus
atccgcgtccgtctgcggcgttcgg

SEQ ID NO: 439418 - DNA, 25 bp, Mus musculus
ctgaccgctagaactcttccagtcg

SEQ ID NO: 439419 - DNA, 25 bp, Mus musculus
cgctagaactcttccagtcgtccaa

SEQ ID NO: 439420 - DNA, 25 bp, Mus musculus
agagatgctcctcggctcgcggagc

SEQ ID NO: 439421 - DNA, 25 bp, Mus musculus
ttggtgctggctttgttcccgcgcc

SEQ ID NO: 439422 - DNA, 25 bp, Mus musculus
cccgctccaaggctgtagggtgcgc

SEQ ID NO: 439423 - DNA, 25 bp, Mus musculus
gcgctcctgagtggcctgtggccct

SEQ ID NO: 439424 - DNA, 25 bp, Mus musculus
gggccctgccttacggctgggtctc

SEQ ID NO: 439425 - DNA, 25 bp, Mus musculus
ctcctcccacaagcgaagttgggcg

SEQ ID NO: 439426 - DNA, 25 bp, Mus musculus
ccacaagcgaagttgggcggttacg

SEQ ID NO: 439427 - DNA, 25 bp, Mus musculus
aagttaagaacaaggtacgcgcgcg

SEQ ID NO: 439428 - DNA, 25 bp, Mus musculus
tcgctggatgagctcccgaatcaga

SEQ ID NO: 439429 - DNA, 25 bp, Mus musculus
accgggaaagccctgccggcagctt

SEQ ID NO: 439430 - DNA, 25 bp, Mus musculus
tcagaggacaacttcaggaaacttc

SEQ ID NO: 439431 - DNA, 25 bp, Mus musculus
gagcacctccggctagcaaactttg

SEQ ID NO: 439432 - DNA, 25 bp, Mus musculus
ggggctcgccctaggctctgagcac

SEQ ID NO: 439433 - DNA, 25 bp, Mus musculus
ggtcctcgtgcccaattcagtgatt

SEQ ID NO: 439434 - DNA, 25 bp, Mus musculus
tttgcagaaggcatctaagcggggc

SEQ ID NO: 439435 - DNA, 25 bp, Mus musculus
gctctgctgccgagcctgagagtct

SEQ ID NO: 439436 - DNA, 25 bp, Mus musculus
cgcggttagcataacggtccgaatc

SEQ ID NO: 439437 - DNA, 25 bp, Mus musculus
gctcagcgtcctcagagctgctctg

SEQ ID NO: 439438 - DNA, 25 bp, Mus musculus
gccgacgtagtcaccgcggttccag

SEQ ID NO: 439439 - DNA, 25 bp, Mus musculus
cagcagctgcctcgcagagcctgga

SEQ ID NO: 439440 - DNA, 25 bp, Mus musculus
cctgggacttgatgtaagcggagca

SEQ ID NO: 439441 - DNA, 25 bp, Mus musculus
ctagcaaactttgcgggtcccacgg

SEQ ID NO: 439442 - DNA, 25 bp, Mus musculus
agtgctcctgaccactgtgcgacgc

SEQ ID NO: 439443 - DNA, 25 bp, Mus musculus
tcctagaggtccagggcgctggtcc

SEQ ID NO: 439444 - DNA, 25 bp, Mus musculus
cggaagcgtcctgtctgtgcaggta

SEQ ID NO: 439445 - DNA, 25 bp, Mus musculus
accggttcccaggaagtgctcctga

SEQ ID NO: 439446 - DNA, 25 bp, Mus musculus
cacgccctttccgtggtggctttag

SEQ ID NO: 439447 - DNA, 25 bp, Mus musculus
gggctcagcgcctcctagaggtcca

SEQ ID NO: 439448 - DNA, 25 bp, Mus musculus
gtcgccttgcacacgggacagaggt

SEQ ID NO: 439449 - DNA, 25 bp, Mus musculus
gcactgcatggtacccggcatctgg

SEQ ID NO: 439450 - DNA, 25 bp, Mus musculus
tcggcgcccaagcactgcatggtac

SEQ ID NO: 439451 - DNA, 25 bp, Mus musculus
tcttaccaggtactcggcgcccaag

SEQ ID NO: 439452 - DNA, 25 bp, Mus musculus
gactcaagttgtcgctcttaccagg

SEQ ID NO: 439453 - DNA, 25 bp, Mus musculus
ggccgcttctctcaggactcaagtt

SEQ ID NO: 439454 - DNA, 25 bp, Mus musculus
gtcctgtctgtgcaggtaggtgccc

SEQ ID NO: 439455 - DNA, 25 bp, Mus musculus
tgcgcagcaccggttcccaggaagt

SEQ ID NO: 439456 - DNA, 25 bp, Mus musculus
ctgggtctccgcagtacctggatcc

SEQ ID NO: 439457 - DNA, 25 bp, Mus musculus
tggacatggcgatcctcgtgcgccc

SEQ ID NO: 439458 - DNA, 25 bp, Mus musculus
gcctccagcccttggacatggcgat

SEQ ID NO: 439459 - DNA, 25 bp, Mus musculus
atcgctcctgtagcgtagccaacgc

SEQ ID NO: 439460 - DNA, 25 bp, Mus musculus
tccgatcgctcctgtagcgtagcca

SEQ ID NO: 439461 - DNA, 25 bp, Mus musculus
gggtacagccggtacccatcactcg

SEQ ID NO: 439462 - DNA, 25 bp, Mus musculus
ccggcagcctgggtacagccggtac

SEQ ID NO: 439463 - DNA, 25 bp, Mus musculus
tgtccgcgcggccctttataacgca

SEQ ID NO: 439464 - DNA, 25 bp, Mus musculus
tggactgatcgggagccgcccaccg

SEQ ID NO: 439465 - DNA, 25 bp, Mus musculus
tctcggagtttcctacaggagggga

SEQ ID NO: 439466 - DNA, 25 bp, Mus musculus
gctgttgaatcacggttgagtcacc

SEQ ID NO: 439467 - DNA, 25 bp, Mus musculus
ctccgcggcgctgttgaatcacggt

SEQ ID NO: 439468 - DNA, 25 bp, Mus musculus
acctggatccgcctgcgccgaaggg

SEQ ID NO: 439469 - DNA, 25 bp, Mus musculus
tgagtggcattggtcctgagaagcc

SEQ ID NO: 439470 - DNA, 25 bp, Mus musculus
gaccgtggtaatacagtctcggggc

SEQ ID NO: 439471 - DNA, 25 bp, Mus musculus
aataatacagtctcggggctcggac

SEQ ID NO: 439472 - DNA, 25 bp, Mus musculus
tcggaccgtggtaataatacagtct

SEQ ID NO: 439473 - DNA, 25 bp, Mus musculus
tggtaataatacagtctcggggttc

SEQ ID NO: 439474 - DNA, 25 bp, Mus musculus
taataatacagtctcggggttcgga

SEQ ID NO: 439475 - DNA, 25 bp, Mus musculus
gttcggaccgtggtaatacagtctc

SEQ ID NO: 439476 - DNA, 25 bp, Mus musculus
tggtaatacagtctcggggttcgga

SEQ ID NO: 439477 - DNA, 25 bp, Mus musculus
cgtggtaatacagtctcggggttcg

SEQ ID NO: 439478 - DNA, 25 bp, Mus musculus
ttcggaccgtggtaatacagtctcg

SEQ ID NO: 439479 - DNA, 25 bp, Mus musculus
tctcggggctcggaccgtggtaata

SEQ ID NO: 439480 - DNA, 25 bp, Mus musculus
tggtaatacagtctcggggctcaga

SEQ ID NO: 439481 - DNA, 25 bp, Mus musculus
cggggctcagactgtggtaataata

SEQ ID NO: 439482 - DNA, 25 bp, Mus musculus
ccgtggtaatacagtctcggggctc

SEQ ID NO: 439483 - DNA, 25 bp, Mus musculus
tggtaataatacagtctcggggctc

SEQ ID NO: 439484 - DNA, 25 bp, Mus musculus
aagtacttgctgaaggccgccatgg

SEQ ID NO: 439485 - DNA, 25 bp, Mus musculus
cactactccggagtcgagctggcga

SEQ ID NO: 439486 - DNA, 25 bp, Mus musculus
ggcgggcagacaacgctagtcctcc

SEQ ID NO: 439487 - DNA, 25 bp, Mus musculus
gccggcgacaacctcagtgcaggaa

SEQ ID NO: 439488 - DNA, 25 bp, Mus musculus
ttcacaagaactggaagagcgggcc

SEQ ID NO: 439489 - DNA, 25 bp, Mus musculus
gtgttccgtgccgtcaagtacttgc

SEQ ID NO: 439490 - DNA, 25 bp, Mus musculus
cgcgacgccgcttatggagtaggca

SEQ ID NO: 439491 - DNA, 25 bp, Mus musculus
ctccctcccgtggtgttgagattgc

SEQ ID NO: 439492 - DNA, 25 bp, Mus musculus
cccataaagttgacatgcacgggga

SEQ ID NO: 439493 - DNA, 25 bp, Mus musculus
tcagtggcgatgagatggcaaaacc

SEQ ID NO: 439494 - DNA, 25 bp, Mus musculus
caaaccttagcgttcagtggcgatg

SEQ ID NO: 439495 - DNA, 25 bp, Mus musculus
catcccgaacgaacgcaaaccttag

SEQ ID NO: 439496 - DNA, 25 bp, Mus musculus
ctggcgagtaaaatgcccatcccga

SEQ ID NO: 439497 - DNA, 25 bp, Mus musculus
cgagcccaccgtggactttggcttc

SEQ ID NO: 439498 - DNA, 25 bp, Mus musculus
tcacgtctgggtttcctgccgggat

SEQ ID NO: 439499 - DNA, 25 bp, Mus musculus
ggactgaccgtcctcctccaaggtc

SEQ ID NO: 439500 - DNA, 25 bp, Mus musculus
ggtcttcacgtctgggtttcctgcc

SEQ ID NO: 439501 - DNA, 25 bp, Mus musculus
gagagcttccccatcgctttttctt

SEQ ID NO: 439502 - DNA, 25 bp, Mus musculus
ggcacttgggctccgagagcttccc

SEQ ID NO: 439503 - DNA, 25 bp, Mus musculus
tctcccgcctgcctgaggcacttgg

SEQ ID NO: 439504 - DNA, 25 bp, Mus musculus
ccaaggtctcggcagcgggcgacct

SEQ ID NO: 439505 - DNA, 25 bp, Mus musculus
tccacccgtgagagtcaggaggcga

SEQ ID NO: 439506 - DNA, 25 bp, Mus musculus
ttccctccacccgtgagagtcagga

SEQ ID NO: 439507 - DNA, 25 bp, Mus musculus
ttgaaattccctccacccgtgagag

SEQ ID NO: 439508 - DNA, 25 bp, Mus musculus
tactccggacttgaaattccctcca

SEQ ID NO: 439509 - DNA, 25 bp, Mus musculus
gcagggcccggtactccggacttga

SEQ ID NO: 439510 - DNA, 25 bp, Mus musculus
accggcgtcctcaggccagtcgtgg

SEQ ID NO: 439511 - DNA, 25 bp, Mus musculus
cgtgagcgttaagcgtccgggacgc

SEQ ID NO: 439512 - DNA, 25 bp, Mus musculus
tctcctcgaagtggggacaagcagg

SEQ ID NO: 439513 - DNA, 25 bp, Mus musculus
ccgtccacgcacagcgaggaggtga

SEQ ID NO: 439514 - DNA, 25 bp, Mus musculus
cgggcaatgagacactcgcgccatc

SEQ ID NO: 439515 - DNA, 25 bp, Mus musculus
atcgcatcagctccttagacacaga

SEQ ID NO: 439516 - DNA, 25 bp, Mus musculus
tagacacagaagcaggcacgctctc

SEQ ID NO: 439517 - DNA, 25 bp, Mus musculus
ggacctccggcggtcctctcgaaga

SEQ ID NO: 439518 - DNA, 25 bp, Mus musculus
cggttacgaagcactttctcgggtg

SEQ ID NO: 439519 - DNA, 25 bp, Mus musculus
cgcctgcgaaaaaagtgcccgtcca

SEQ ID NO: 439520 - DNA, 25 bp, Mus musculus
tgcagaccgggaacctgctcaactg

SEQ ID NO: 439521 - DNA, 25 bp, Mus musculus
aacagctccctcgtttcagcggcgg

SEQ ID NO: 439522 - DNA, 25 bp, Mus musculus
gcttagtcattgtcttccaggaaac

SEQ ID NO: 439523 - DNA, 25 bp, Mus musculus
ctttctcgggtgaggtttctgctta

SEQ ID NO: 439524 - DNA, 25 bp, Mus musculus
tactatcccggcttggcaggtgcca

SEQ ID NO: 439525 - DNA, 25 bp, Mus musculus
gggcgcaccgtcaactctcacgagg

SEQ ID NO: 439526 - DNA, 25 bp, Mus musculus
tcttacgggagtttcggtagcgtgc

SEQ ID NO: 439527 - DNA, 25 bp, Mus musculus
ccgcacagcggacgagctgggaact

SEQ ID NO: 439528 - DNA, 25 bp, Mus musculus
gctgacccgcactagtccgatggcg

SEQ ID NO: 439529 - DNA, 25 bp, Mus musculus
accgctggccagaactgcagtggag

SEQ ID NO: 439530 - DNA, 25 bp, Mus musculus
aaggaacgattctcccgagccgcgg

SEQ ID NO: 439531 - DNA, 25 bp, Mus musculus
tccgcagggaaacctaagcgagttc

SEQ ID NO: 439532 - DNA, 25 bp, Mus musculus
gcgagttcctgtttcgacgcacttc

SEQ ID NO: 439533 - DNA, 25 bp, Mus musculus
aggctccaagaaagctcccagcaga

SEQ ID NO: 439534 - DNA, 25 bp, Mus musculus
gccacctcgaccaagcctggtttgg

SEQ ID NO: 439535 - DNA, 25 bp, Mus musculus
gggataggaggagcaccgttttcac

SEQ ID NO: 439536 - DNA, 25 bp, Mus musculus
ccgttttcacgtggagagactggca

SEQ ID NO: 439537 - DNA, 25 bp, Mus musculus
agagactggcatggccgagcactaa

SEQ ID NO: 439538 - DNA, 25 bp, Mus musculus
ctgcgcaggcgaggccttttaagtt

SEQ ID NO: 439539 - DNA, 25 bp, Mus musculus
ccgaagcgtcggaacagaggaagcc

SEQ ID NO: 439540 - DNA, 25 bp, Mus musculus
gcttctagcaaacctactcagccta

SEQ ID NO: 439541 - DNA, 25 bp, Mus musculus
atttccgtggggaattgcggcacgc

SEQ ID NO: 439542 - DNA, 25 bp, Mus musculus
ttccctgcgcacaagtccttatatg

SEQ ID NO: 439543 - DNA, 25 bp, Mus musculus
gacagagctcacatctctcggattt

SEQ ID NO: 439544 - DNA, 25 bp, Mus musculus
caggtcttgggtgtggcgatatcca

SEQ ID NO: 439545 - DNA, 25 bp, Mus musculus
tcacatctctcggatttccagcttc

SEQ ID NO: 439546 - DNA, 25 bp, Mus musculus
tgtggcgatatccagacagagctca

SEQ ID NO: 439547 - DNA, 25 bp, Mus musculus
tcagcctagagaaccacagacgatt

SEQ ID NO: 439548 - DNA, 25 bp, Mus musculus
accacagacgattcgggcctgcctt

SEQ ID NO: 439549 - DNA, 25 bp, Mus musculus
ctgcaacccagtggccgcgaatgac

SEQ ID NO: 439550 - DNA, 25 bp, Mus musculus
gaatgaccgtgaccctgtggccact

SEQ ID NO: 439551 - DNA, 25 bp, Mus musculus
actgctcagcaccaaagccaggctg

SEQ ID NO: 439552 - DNA, 25 bp, Mus musculus
ggctcggcgcgtgtgagcttctccc

SEQ ID NO: 439553 - DNA, 25 bp, Mus musculus
tccttatatgcaccggttgcaccgg

SEQ ID NO: 439554 - DNA, 25 bp, Mus musculus
cgaatttctgaggtatccgggctct

SEQ ID NO: 439555 - DNA, 25 bp, Mus musculus
cctcccgggagctttatccactatg

SEQ ID NO: 439556 - DNA, 25 bp, Mus musculus
ggagctttatccactatgccgccgc

SEQ ID NO: 439557 - DNA, 25 bp, Mus musculus
gcatttctttgctcagaagggcggg

SEQ ID NO: 439558 - DNA, 25 bp, Mus musculus
accgaggcatcctcccgggagcttt

SEQ ID NO: 439559 - DNA, 25 bp, Mus musculus
ataaaagcccagttgctaggcaacg

SEQ ID NO: 439560 - DNA, 25 bp, Mus musculus
ggccgctgccagacaaaagcccagg

SEQ ID NO: 439561 - DNA, 25 bp, Mus musculus
tgcgtgtttatctgcgcggggcttc

SEQ ID NO: 439562 - DNA, 25 bp, Mus musculus
gcgtgcttgtgcgtgtttatctgcg

SEQ ID NO: 439563 - DNA, 25 bp, Mus musculus
gcgcctaggtcacctccaacggtaa

SEQ ID NO: 439564 - DNA, 25 bp, Mus musculus
ccacagacccagagccgaatttctg

SEQ ID NO: 439565 - DNA, 25 bp, Mus musculus
gcccgagggaagagaactagctaaa

SEQ ID NO: 439566 - DNA, 25 bp, Mus musculus
tcacctccaacggtaacggcgaggc

SEQ ID NO: 439567 - DNA, 25 bp, Mus musculus
aggcaacggccgctgccagacaaaa

SEQ ID NO: 439568 - DNA, 25 bp, Mus musculus
atcaccagttgagggccagagagcg

SEQ ID NO: 439569 - DNA, 25 bp, Mus musculus
gagagccagacgaggtcaccgaatg

SEQ ID NO: 439570 - DNA, 25 bp, Mus musculus
tggggccgcgaagccgcaaatcacc

SEQ ID NO: 439571 - DNA, 25 bp, Mus musculus
cgcgaagccgcaaatcaccagttga

SEQ ID NO: 439572 - DNA, 25 bp, Mus musculus
cgcaaatcaccagttgagggccaga

SEQ ID NO: 439573 - DNA, 25 bp, Mus musculus
aggtcaccgaatgtaaaagtcgccg

SEQ ID NO: 439574 - DNA, 25 bp, Mus musculus
gcgctgccggctcagagctgagcct

SEQ ID NO: 439575 - DNA, 25 bp, Mus musculus
cgggacagccgtgcacacccgccag

SEQ ID NO: 439576 - DNA, 25 bp, Mus musculus
cgcaccagcctcttggcggacgccc

SEQ ID NO: 439577 - DNA, 25 bp, Mus musculus
cgcggaccatgagccgcccgagctc

SEQ ID NO: 439578 - DNA, 25 bp, Mus musculus
ggcgctgaaccgcaatcccggactc

SEQ ID NO: 439579 - DNA, 25 bp, Mus musculus
aggtgagtgtgtcccgtgcgttcct

SEQ ID NO: 439580 - DNA, 25 bp, Mus musculus
tgtcccgtgcgttcctgttcagcct

SEQ ID NO: 439581 - DNA, 25 bp, Mus musculus
gttcagcctcctgagctccctcggt

SEQ ID NO: 439582 - DNA, 25 bp, Mus musculus
cccggcggaaggatgccaagtgtaa

SEQ ID NO: 439583 - DNA, 25 bp, Mus musculus
gttggcattgccacgtgtgcacacc

SEQ ID NO: 439584 - DNA, 25 bp, Mus musculus
gcgtgtcacactgaggttggcattg

SEQ ID NO: 439585 - DNA, 25 bp, Mus musculus
agcttggcgacccagcgtgtcacac

SEQ ID NO: 439586 - DNA, 25 bp, Mus musculus
tgccaagtgtaagtgcgggctcccg

SEQ ID NO: 439587 - DNA, 25 bp, Mus musculus
agatcaaggactttctgctgacagc

SEQ ID NO: 439588 - DNA, 25 bp, Mus musculus
cagcctcggaaaattgaggagatca

SEQ ID NO: 439589 - DNA, 25 bp, Mus musculus
gtccctcctatgttacagcctcgga

SEQ ID NO: 439590 - DNA, 25 bp, Mus musculus
ggctcatcttctgtccctcctatgt

SEQ ID NO: 439591 - DNA, 25 bp, Mus musculus
atcgcggccggttaactcgggattg

SEQ ID NO: 439592 - DNA, 25 bp, Mus musculus
ctcatcgctgtgagtgtgctgggca

SEQ ID NO: 439593 - DNA, 25 bp, Mus musculus
gttctcttcggttctcatcgctgtg

SEQ ID NO: 439594 - DNA, 25 bp, Mus musculus
cgtccggaagcggaagcctcgttct

SEQ ID NO: 439595 - DNA, 25 bp, Mus musculus
aacagcaggttatggcgagcttggc

SEQ ID NO: 439596 - DNA, 25 bp, Mus musculus
aagcagacccgccagcccagagagg

SEQ ID NO: 439597 - DNA, 25 bp, Mus musculus
tcaagcgatcggcaagccgcgcgct

SEQ ID NO: 439598 - DNA, 25 bp, Mus musculus
cgcgcgctcctttcgccaaaatgag

SEQ ID NO: 439599 - DNA, 25 bp, Mus musculus
gccaaaatgagcgtcccttcctcga

SEQ ID NO: 439600 - DNA, 25 bp, Mus musculus
ctcgatcccactacctaattcgggt

SEQ ID NO: 439601 - DNA, 25 bp, Mus musculus
ctaattcgggtcacaaaagcagacc

SEQ ID NO: 439602 - DNA, 25 bp, Mus musculus
tgagtgagagagacacgactgaagc

SEQ ID NO: 439603 - DNA, 25 bp, Mus musculus
ggctgggaacaaagccgcccggctc

SEQ ID NO: 439604 - DNA, 25 bp, Mus musculus
gcacccgtccgcaaagtcaggcaga

SEQ ID NO: 439605 - DNA, 25 bp, Mus musculus
cgagcgggctctcgcggcacaaaga

SEQ ID NO: 439606 - DNA, 25 bp, Mus musculus
gctcatggcggaacctgaggcgact

SEQ ID NO: 439607 - DNA, 25 bp, Mus musculus
tcagcgtctgcctcgaaagctgccg

SEQ ID NO: 439608 - DNA, 25 bp, Mus musculus
agaacgagagggaaatcaagcgatc

SEQ ID NO: 439609 - DNA, 25 bp, Mus musculus
taggtcccgagcaaggaggcagcaa

SEQ ID NO: 439610 - DNA, 25 bp, Mus musculus
cggactggagtcctctacttaaagg

SEQ ID NO: 439611 - DNA, 25 bp, Mus musculus
acagccagggacatgaagcgtgacc

SEQ ID NO: 439612 - DNA, 25 bp, Mus musculus
ccaccaggtaagaagaggagccaca

SEQ ID NO: 439613 - DNA, 25 bp, Mus musculus
aagcgtgacctgaggctgatctctc

SEQ ID NO: 439614 - DNA, 25 bp, Mus musculus
cggaagtagcttctcggtcccagta

SEQ ID NO: 439615 - DNA, 25 bp, Mus musculus
gcgcgccgatctgggctgaactaac

SEQ ID NO: 439616 - DNA, 25 bp, Mus musculus
cgtcggattagaaaggacttgccca

SEQ ID NO: 439617 - DNA, 25 bp, Mus musculus
cccggccctggagcaagattactct

SEQ ID NO: 439618 - DNA, 25 bp, Mus musculus
agtcctctggtcatccctcttctgg

SEQ ID NO: 439619 - DNA, 25 bp, Mus musculus
cgcaaggaggattttcgcggagctt

SEQ ID NO: 439620 - DNA, 25 bp, Mus musculus
cagttcttcctggtctcgagccaaa

SEQ ID NO: 439621 - DNA, 25 bp, Mus musculus
gagcctgtcctttaggatccgactg

SEQ ID NO: 439622 - DNA, 25 bp, Mus musculus
ctgaactaaccagctctgctttgga

SEQ ID NO: 439623 - DNA, 25 bp, Mus musculus
ccaggccctttgcttcggaagtagc

SEQ ID NO: 439624 - DNA, 25 bp, Mus musculus
gtctgggcagtgacacctgcgatca

SEQ ID NO: 439625 - DNA, 25 bp, Mus musculus
ttcagccattgctgggtcggcaccc

SEQ ID NO: 439626 - DNA, 25 bp, Mus musculus
aatccagtctgctccgccaaggagg

SEQ ID NO: 439627 - DNA, 25 bp, Mus musculus
ccgccaaggaggaacgccaatcacg

SEQ ID NO: 439628 - DNA, 25 bp, Mus musculus
gccaatcacgctggagccctggtga

SEQ ID NO: 439629 - DNA, 25 bp, Mus musculus
gtgaaggctcagtgctccggcagct

SEQ ID NO: 439630 - DNA, 25 bp, Mus musculus
cccacaacgtcgtgacaggcaaagc

SEQ ID NO: 439631 - DNA, 25 bp, Mus musculus
aggcaaagcgacacgcacagggaca

SEQ ID NO: 439632 - DNA, 25 bp, Mus musculus
ctttcccgcgggtgatgctcccttt

SEQ ID NO: 439633 - DNA, 25 bp, Mus musculus
gctccctttccgagggcttgtgtga

SEQ ID NO: 439634 - DNA, 25 bp, Mus musculus
actgcggcggatttccacggcagac

SEQ ID NO: 439635 - DNA, 25 bp, Mus musculus
gtccgccttggttggcggctttgca

SEQ ID NO: 439636 - DNA, 25 bp, Mus musculus
gggttctgtgggtttcagccattgc

SEQ ID NO: 439637 - DNA, 25 bp, Mus musculus
ctgcgatcaacaggtctctggaccc

SEQ ID NO: 439638 - DNA, 25 bp, Mus musculus
ccgggacatcattagagggaaacgc

SEQ ID NO: 439639 - DNA, 25 bp, Mus musculus
ttctgcaacttggtgtactgggtga

SEQ ID NO: 439640 - DNA, 25 bp, Mus musculus
tccgagggaaaatggcaactacagt

SEQ ID NO: 439641 - DNA, 25 bp, Mus musculus
gaagcgaattcctcccaggaccagg

SEQ ID NO: 439642 - DNA, 25 bp, Mus musculus
cgacacgcgtcgcttccagtaaggc

SEQ ID NO: 439643 - DNA, 25 bp, Mus musculus
gccgcttgcagctgagtcaggtttc

SEQ ID NO: 439644 - DNA, 25 bp, Mus musculus
tgccaagtggctctctgccatgtcg

SEQ ID NO: 439645 - DNA, 25 bp, Mus musculus
tgtctttgtagaatccgagcgctcg

SEQ ID NO: 439646 - DNA, 25 bp, Mus musculus
ctacagtgttcagctccgggacatc

SEQ ID NO: 439647 - DNA, 25 bp, Mus musculus
tgacgtggcactagcaacccagagc

SEQ ID NO: 439648 - DNA, 25 bp, Mus musculus
gggcctcgcgaaggaaaagcttaga

SEQ ID NO: 439649 - DNA, 25 bp, Mus musculus
ccggctccggaggatctttgacaaa

SEQ ID NO: 439650 - DNA, 25 bp, Mus musculus
cgcagcgattcagtgccacctgttg

SEQ ID NO: 439651 - DNA, 25 bp, Mus musculus
gtcttctgaaggctctgggctgcac

SEQ ID NO: 439652 - DNA, 25 bp, Mus musculus
tcaggaggaagtttccggcgcgcct

SEQ ID NO: 439653 - DNA, 25 bp, Mus musculus
gccgcacacctgctgagctaggagc

SEQ ID NO: 439654 - DNA, 25 bp, Mus musculus
ggagctgccgccgtaacttctgccg

SEQ ID NO: 439655 - DNA, 25 bp, Mus musculus
ccgcctccaggacgccgaagatatg

SEQ ID NO: 439656 - DNA, 25 bp, Mus musculus
gctatgcctgaacaggaagtcccgc

SEQ ID NO: 439657 - DNA, 25 bp, Mus musculus
gccgaagatatgatgtcacacgacg

SEQ ID NO: 439658 - DNA, 25 bp, Mus musculus
cgcgcctgaaacaggctatgcctga

SEQ ID NO: 439659 - DNA, 25 bp, Mus musculus
tcacgtccctcaggaggaagtttcc

SEQ ID NO: 439660 - DNA, 25 bp, Mus musculus
gagactttcacgtccctcaggagga

SEQ ID NO: 439661 - DNA, 25 bp, Mus musculus
attctgacccggagactttcacgtc

SEQ ID NO: 439662 - DNA, 25 bp, Mus musculus
cgcagagattctgacccggagactt

SEQ ID NO: 439663 - DNA, 25 bp, Mus musculus
tccgcgcccgccaaaatgcaaatcc

SEQ ID NO: 439664 - DNA, 25 bp, Mus musculus
cggatctcctgcaggcggctatcca

SEQ ID NO: 439665 - DNA, 25 bp, Mus musculus
tgcaaatccacctgccaaaccagga

SEQ ID NO: 439666 - DNA, 25 bp, Mus musculus
ggggcaatgccaccaacctcggcgt

SEQ ID NO: 439667 - DNA, 25 bp, Mus musculus
tcggcgtcccgtgtctacactggga

SEQ ID NO: 439668 - DNA, 25 bp, Mus musculus
tgttggcaccggcagcctagacctt

SEQ ID NO: 439669 - DNA, 25 bp, Mus musculus
tagtggcccgcgctgatccggtctc

SEQ ID NO: 439670 - DNA, 25 bp, Mus musculus
caacttctgccggagcccggatggc

SEQ ID NO: 439671 - DNA, 25 bp, Mus musculus
ctacactgggacgaggtgccgccct

SEQ ID NO: 439672 - DNA, 25 bp, Mus musculus
agagtcgtggggcaatgccaccaac

SEQ ID NO: 439673 - DNA, 25 bp, Mus musculus
tttaggggcactgtctgtagtggcc

SEQ ID NO: 439674 - DNA, 25 bp, Mus musculus
tgctggctgtgattttaggggcact

SEQ ID NO: 439675 - DNA, 25 bp, Mus musculus
ggagcccagcatggaccacactcgg

SEQ ID NO: 439676 - DNA, 25 bp, Mus musculus
tgaccctttgggtcccggtgtgatc

SEQ ID NO: 439677 - DNA, 25 bp, Mus musculus
tccagcctttgcttcgcggggctga

SEQ ID NO: 439678 - DNA, 25 bp, Mus musculus
ggctacagagctcctggcgctcatc

SEQ ID NO: 439679 - DNA, 25 bp, Mus musculus
agctgcgagggcagccgcacaactt

SEQ ID NO: 439680 - DNA, 25 bp, Mus musculus
ccgcttgcccttttgatctgatctc

SEQ ID NO: 439681 - DNA, 25 bp, Mus musculus
tacatactcgtaggcggatcgcagc

SEQ ID NO: 439682 - DNA, 25 bp, Mus musculus
cttcacggcgctcttgcagagttga

SEQ ID NO: 439683 - DNA, 25 bp, Mus musculus
atcggctttacatggtggtcgtcgc

SEQ ID NO: 439684 - DNA, 25 bp, Mus musculus
gcatctcggccactcacaaataagg

SEQ ID NO: 439685 - DNA, 25 bp, Mus musculus
gatctcacttttgcccgacacagcg

SEQ ID NO: 439686 - DNA, 25 bp, Mus musculus
gcggatcgcagccaaagagacttct

SEQ ID NO: 439687 - DNA, 25 bp, Mus musculus
gcgcacgcttttatagcccgggtga

SEQ ID NO: 439688 - DNA, 25 bp, Mus musculus
cccgcgcctcgtcactttgattggt

SEQ ID NO: 439689 - DNA, 25 bp, Mus musculus
aaaccacagttctcgcggtgtcaga

SEQ ID NO: 439690 - DNA, 25 bp, Mus musculus
ggccagcaccatagccaccttgtgt

SEQ ID NO: 439691 - DNA, 25 bp, Mus musculus
gctgcgttcttctctgggacccaaa

SEQ ID NO: 439692 - DNA, 25 bp, Mus musculus
cttttccgggaggaaggcatatctc

SEQ ID NO: 439693 - DNA, 25 bp, Mus musculus
gcgcgcgttttctcttcttggctgc

SEQ ID NO: 439694 - DNA, 25 bp, Mus musculus
ttggtcctctgcttctctgcgctct

SEQ ID NO: 439695 - DNA, 25 bp, Mus musculus
gtggagcgccggcattctgcctctt

SEQ ID NO: 439696 - DNA, 25 bp, Mus musculus
agcgccggcattctgcctcttggtc

SEQ ID NO: 439697 - DNA, 25 bp, Mus musculus
tcttggtcctctgcttctctgcgct

SEQ ID NO: 439698 - DNA, 25 bp, Mus musculus
tctcgctgcagagccacggctgcag

SEQ ID NO: 439699 - DNA, 25 bp, Mus musculus
ccagcatcggctcctgagccggagt

SEQ ID NO: 439700 - DNA, 25 bp, Mus musculus
ttggaccggcgctcgtcccacgccg

SEQ ID NO: 439701 - DNA, 25 bp, Mus musculus
cacgccggcgcgcagtctcctgggt

SEQ ID NO: 439702 - DNA, 25 bp, Mus musculus
cgcgagctgggacctggttcccaac

SEQ ID NO: 439703 - DNA, 25 bp, Mus musculus
aggagccgagctgcaccacaggtga

SEQ ID NO: 439704 - DNA, 25 bp, Mus musculus
ccgagctgcaccacaggtgatggtg

SEQ ID NO: 439705 - DNA, 25 bp, Mus musculus
tgcaccacaggtgatggtgcccggc

SEQ ID NO: 439706 - DNA, 25 bp, Mus musculus
tggcaggacgagtggtccaggagct

SEQ ID NO: 439707 - DNA, 25 bp, Mus musculus
cggcattctgcctcttggtcctctg

SEQ ID NO: 439708 - DNA, 25 bp, Mus musculus
cccgcgaagagtcgacatggcgagc

SEQ ID NO: 439709 - DNA, 25 bp, Mus musculus
gcccttagccgatcagggcgcgcag

SEQ ID NO: 439710 - DNA, 25 bp, Mus musculus
atcccgcggatcgacgctctcggaa

SEQ ID NO: 439711 - DNA, 25 bp, Mus musculus
gatcgacgctctcggaagatcggga

SEQ ID NO: 439712 - DNA, 25 bp, Mus musculus
gaagatcgggatcggactcttgctg

SEQ ID NO: 439713 - DNA, 25 bp, Mus musculus
gcctctctggcggacagccgcatga

SEQ ID NO: 439714 - DNA, 25 bp, Mus musculus
cagccgcatgaggacgcgagcgaaa

SEQ ID NO: 439715 - DNA, 25 bp, Mus musculus
catgaggacgcgagcgaaatagacc

SEQ ID NO: 439716 - DNA, 25 bp, Mus musculus
aatagaccggggtggaattgccaag

SEQ ID NO: 439717 - DNA, 25 bp, Mus musculus
tggaattgccaaggaagacgcttcg

SEQ ID NO: 439718 - DNA, 25 bp, Mus musculus
tttctcccgcgaagagtcgacatgg

SEQ ID NO: 439719 - DNA, 25 bp, Mus musculus
cagctcgcagcctggatgaaatcga

SEQ ID NO: 439720 - DNA, 25 bp, Mus musculus
agcctggatgaaatcgatctctccg

SEQ ID NO: 439721 - DNA, 25 bp, Mus musculus
tggttttggtccatttctcccgcga

SEQ ID NO: 439722 - DNA, 25 bp, Mus musculus
atcggtgcagcaaatccgcgctcgc

SEQ ID NO: 439723 - DNA, 25 bp, Mus musculus
gtcgatcgcgttcctcactctgcag

SEQ ID NO: 439724 - DNA, 25 bp, Mus musculus
gcacctccgagatgtcgatcgcgtt

SEQ ID NO: 439725 - DNA, 25 bp, Mus musculus
ggcttatgttcgagggcacctccga

SEQ ID NO: 439726 - DNA, 25 bp, Mus musculus
catgttcttcgtgctggggcttatg

SEQ ID NO: 439727 - DNA, 25 bp, Mus musculus
atatggtctcctgcgtgggcatgtt

SEQ ID NO: 439728 - DNA, 25 bp, Mus musculus
ggtgcagaaccacgcggatatggtc

SEQ ID NO: 439729 - DNA, 25 bp, Mus musculus
gccacgaattcatggtgcagaacca

SEQ ID NO: 439730 - DNA, 25 bp, Mus musculus
ccggtgttgagccacgaattcatgg

SEQ ID NO: 439731 - DNA, 25 bp, Mus musculus
catggggctccgcaagaagaacgcc

SEQ ID NO: 439732 - DNA, 25 bp, Mus musculus
gactactggtgagtaccgcggcatg

SEQ ID NO: 439733 - DNA, 25 bp, Mus musculus
ccagcctttgattgatcggtcggca

SEQ ID NO: 439734 - DNA, 25 bp, Mus musculus
gcgcggcgctcgatttcctttcctg

SEQ ID NO: 439735 - DNA, 25 bp, Mus musculus
ttgtcccagcggaagggctgccctc

SEQ ID NO: 439736 - DNA, 25 bp, Mus musculus
atctgaatcggcgtgactggcggcc

SEQ ID NO: 439737 - DNA, 25 bp, Mus musculus
gacctgagcagagcctcgtgcatgg

SEQ ID NO: 439738 - DNA, 25 bp, Mus musculus
cgtgtcctcgcctagggctggatat

SEQ ID NO: 439739 - DNA, 25 bp, Mus musculus
gacccgctgcagcttgtgcaagcca

SEQ ID NO: 439740 - DNA, 25 bp, Mus musculus
cgcgagtggagtacatcgcgccctg

SEQ ID NO: 439741 - DNA, 25 bp, Mus musculus
tgtggctgcacagcgttccgcacct

SEQ ID NO: 439742 - DNA, 25 bp, Mus musculus
cctgcagcgagtagacagcaccttc

SEQ ID NO: 439743 - DNA, 25 bp, Mus musculus
taccaggaggtaagcccatgagccg

SEQ ID NO: 439744 - DNA, 25 bp, Mus musculus
cgagccacggagagggacccttaga

SEQ ID NO: 439745 - DNA, 25 bp, Mus musculus
gacccttagagtgagagccagagcc

SEQ ID NO: 439746 - DNA, 25 bp, Mus musculus
cgggacgctcgacctagctggaaat

SEQ ID NO: 439747 - DNA, 25 bp, Mus musculus
gacctagctggaaatctcggagttg

SEQ ID NO: 439748 - DNA, 25 bp, Mus musculus
gggctgagccttccaaagacttaca

SEQ ID NO: 439749 - DNA, 25 bp, Mus musculus
ctcggagttggtaaagctggaaaca

SEQ ID NO: 439750 - DNA, 25 bp, Mus musculus
tgtgcatcccggagcagctccattc

SEQ ID NO: 439751 - DNA, 25 bp, Mus musculus
gggccacgagcgacagtgctgtctt

SEQ ID NO: 439752 - DNA, 25 bp, Mus musculus
tgcgaggctgcacctgccatcaaag

SEQ ID NO: 439753 - DNA, 25 bp, Mus musculus
tcagcgcgccactactgagcgggag

SEQ ID NO: 439754 - DNA, 25 bp, Mus musculus
tgccgggcttaagacgggcgctcta

SEQ ID NO: 439755 - DNA, 25 bp, Mus musculus
agagaacaactgtgcatcccggagc

SEQ ID NO: 439756 - DNA, 25 bp, Mus musculus
cgctctagggcaggcgatgctccgc

SEQ ID NO: 439757 - DNA, 25 bp, Mus musculus
tcacctcggacagagaacaactgtg

SEQ ID NO: 439758 - DNA, 25 bp, Mus musculus
cgcagggtgacaagaccgaactctc

SEQ ID NO: 439759 - DNA, 25 bp, Mus musculus
ctcagtcaagtgcaaggtcccgcgt

SEQ ID NO: 439760 - DNA, 25 bp, Mus musculus
agccctcaggcactttcagacagaa

SEQ ID NO: 439761 - DNA, 25 bp, Mus musculus
ccacgactgcggtcaccgaaaggtc

SEQ ID NO: 439762 - DNA, 25 bp, Mus musculus
cctctgcttcgtccgctgctttttt

SEQ ID NO: 439763 - DNA, 25 bp, Mus musculus
agtgctgtcttctgtccacgactgc

SEQ ID NO: 439764 - DNA, 25 bp, Mus musculus
tagaactaagtcagccacccaaggg

SEQ ID NO: 439765 - DNA, 25 bp, Mus musculus
ggacacgtgcgctctgcgatcgccg

SEQ ID NO: 439766 - DNA, 25 bp, Mus musculus
gctgcagcacccacaggggacacgt

SEQ ID NO: 439767 - DNA, 25 bp, Mus musculus
agcagctgcagcacccacaggggac

SEQ ID NO: 439768 - DNA, 25 bp, Mus musculus
gtcagccacccaagggcacgctgga

SEQ ID NO: 439769 - DNA, 25 bp, Mus musculus
cacagatggctagaactaagtcagc

SEQ ID NO: 439770 - DNA, 25 bp, Mus musculus
aacagaggaggaaagcacagatggc

SEQ ID NO: 439771 - DNA, 25 bp, Mus musculus
actgcctggcgaacagaggaggaaa

SEQ ID NO: 439772 - DNA, 25 bp, Mus musculus
atggatctccggctgcgactgcctg

SEQ ID NO: 439773 - DNA, 25 bp, Mus musculus
caagcatggatctccggctgcgact

SEQ ID NO: 439774 - DNA, 25 bp, Mus musculus
tcgccgcccaggactctgtgaatgt

SEQ ID NO: 439775 - DNA, 25 bp, Mus musculus
tcgggtccatccttttcctcgcaga

SEQ ID NO: 439776 - DNA, 25 bp, Mus musculus
gccctcaaccagcaagcatggatct

SEQ ID NO: 439777 - DNA, 25 bp, Mus musculus
agcaaagccgcccttctcgggtcca

SEQ ID NO: 439778 - DNA, 25 bp, Mus musculus
agctcggaaagtaagcgtccctgcc

SEQ ID NO: 439779 - DNA, 25 bp, Mus musculus
ccctcgtctccctcgtggggataga

SEQ ID NO: 439780 - DNA, 25 bp, Mus musculus
atcagctctttgaggagctcggaaa

SEQ ID NO: 439781 - DNA, 25 bp, Mus musculus
ccggttcaccgacgagtatcagctc

SEQ ID NO: 439782 - DNA, 25 bp, Mus musculus
aagccaggtctgttcgcgtgtcgcc

SEQ ID NO: 439783 - DNA, 25 bp, Mus musculus
ggcgagctactttcggacacggaaa

SEQ ID NO: 439784 - DNA, 25 bp, Mus musculus
tggaacgaccggctgggtgttcact

SEQ ID NO: 439785 - DNA, 25 bp, Mus musculus
gtgggtcactgcgacatctcagtcc

SEQ ID NO: 439786 - DNA, 25 bp, Mus musculus
tctttccgcccttcgtgggtcactg

SEQ ID NO: 439787 - DNA, 25 bp, Mus musculus
agcttcgagtggtctctcatctttc

SEQ ID NO: 439788 - DNA, 25 bp, Mus musculus
caagggttgcttccctctctcggct

SEQ ID NO: 439789 - DNA, 25 bp, Mus musculus
ccgcgcccagatgcaagggttgctt

SEQ ID NO: 439790 - DNA, 25 bp, Mus musculus
tctgggagcagtaaacgcgaaccgc

SEQ ID NO: 439791 - DNA, 25 bp, Mus musculus
ctccctagacggctgcgggagagca

SEQ ID NO: 439792 - DNA, 25 bp, Mus musculus
aagaggagggcttcttccttcgccg

SEQ ID NO: 439793 - DNA, 25 bp, Mus musculus
aagcgctaagcgactgctgctggtg

SEQ ID NO: 439794 - DNA, 25 bp, Mus musculus
acgccagatctcctgtccgcgtggg

SEQ ID NO: 439795 - DNA, 25 bp, Mus musculus
gggataagaagctcggctgcgctcc

SEQ ID NO: 439796 - DNA, 25 bp, Mus musculus
tatatgcaccactgcctgccggagc

SEQ ID NO: 439797 - DNA, 25 bp, Mus musculus
gatgagctcatggacagctcccaga

SEQ ID NO: 439798 - DNA, 25 bp, Mus musculus
agaagccatgtccacgctctcggaa

SEQ ID NO: 439799 - DNA, 25 bp, Mus musculus
ccctgaagtcgatgtcccggtcctt

SEQ ID NO: 439800 - DNA, 25 bp, Mus musculus
caagctcgcatgaatgggttccctg

SEQ ID NO: 439801 - DNA, 25 bp, Mus musculus
gccaggcgaagtgcacaagctcgca

SEQ ID NO: 439802 - DNA, 25 bp, Mus musculus
tttcaggaatactcctgggccaggc

SEQ ID NO: 439803 - DNA, 25 bp, Mus musculus
ttacacgcctggtttaggaaggcgc

SEQ ID NO: 439804 - DNA, 25 bp, Mus musculus
cgcgtgcttctaggcgaccgcagaa

SEQ ID NO: 439805 - DNA, 25 bp, Mus musculus
cagctcccagaaatatgtctatatg

SEQ ID NO: 439806 - DNA, 25 bp, Mus musculus
ccggtgaagtggagacttttctctc

SEQ ID NO: 439807 - DNA, 25 bp, Mus musculus
cctctgtactgagctccgaatagca

SEQ ID NO: 439808 - DNA, 25 bp, Mus musculus
cggcgccaaaccaacggcacagtgg

SEQ ID NO: 439809 - DNA, 25 bp, Mus musculus
gagacccgactgagaggagttccca

SEQ ID NO: 439810 - DNA, 25 bp, Mus musculus
ggagttcccacctctacgggtctga

SEQ ID NO: 439811 - DNA, 25 bp, Mus musculus
ggctctgcaggccagtagtgactta

SEQ ID NO: 439812 - DNA, 25 bp, Mus musculus
cacggtcagcgcttgtgttctccca

SEQ ID NO: 439813 - DNA, 25 bp, Mus musculus
cggtcggcggaaatttgcgtcattc

SEQ ID NO: 439814 - DNA, 25 bp, Mus musculus
cgtcattcgagtagcgacgcgcttc

SEQ ID NO: 439815 - DNA, 25 bp, Mus musculus
gcccagggttcgttgctgacgtcat

SEQ ID NO: 439816 - DNA, 25 bp, Mus musculus
cgtcacttaagttggcgggagaaat

SEQ ID NO: 439817 - DNA, 25 bp, Mus musculus
ctctcccgtgttctaggcaagaagg

SEQ ID NO: 439818 - DNA, 25 bp, Mus musculus
tggacactgactcgcctccacggaa

SEQ ID NO: 439819 - DNA, 25 bp, Mus musculus
gctgacgtcataggcggagcatctc

SEQ ID NO: 439820 - DNA, 25 bp, Mus musculus
gaaggccgcgccagtcccatcgccc

SEQ ID NO: 439821 - DNA, 25 bp, Mus musculus
ggcgtcgctgtactgccaagtcccg

SEQ ID NO: 439822 - DNA, 25 bp, Mus musculus
ccctgggcgtcgctgtactgccaag

SEQ ID NO: 439823 - DNA, 25 bp, Mus musculus
cgctcctgctgctgtcgcgagctgt

SEQ ID NO: 439824 - DNA, 25 bp, Mus musculus
agctgtcgaggctcaggtgtggccc

SEQ ID NO: 439825 - DNA, 25 bp, Mus musculus
gcgctggaggaaagccgggtgttgt

SEQ ID NO: 439826 - DNA, 25 bp, Mus musculus
ggtgttgtgttgtaaaagccttctc

SEQ ID NO: 439827 - DNA, 25 bp, Mus musculus
tgtgttgtaaaagccttctccaccc

SEQ ID NO: 439828 - DNA, 25 bp, Mus musculus
taaaagccttctccacccggctctg

SEQ ID NO: 439829 - DNA, 25 bp, Mus musculus
cccggctctgcttctaggcgtgaat

SEQ ID NO: 439830 - DNA, 25 bp, Mus musculus
cggctctgcttctaggcgtgaatga

SEQ ID NO: 439831 - DNA, 25 bp, Mus musculus
ctgcttctaggcgtgaatgagtgag

SEQ ID NO: 439832 - DNA, 25 bp, Mus musculus
cgagctggagaaaagaggcgctggc

SEQ ID NO: 439833 - DNA, 25 bp, Mus musculus
tgctgtcgcgagctgtcgaggctca

SEQ ID NO: 439834 - DNA, 25 bp, Mus musculus
ccatcgctctagacgcagtgacttc

SEQ ID NO: 439835 - DNA, 25 bp, Mus musculus
cctgtccattctgggaataaatttc

SEQ ID NO: 439836 - DNA, 25 bp, Mus musculus
cccggggcagatctgattgttttct

SEQ ID NO: 439837 - DNA, 25 bp, Mus musculus
ctcttctttctcaggatgttcgtca

SEQ ID NO: 439838 - DNA, 25 bp, Mus musculus
cgcagtgacttctgtgaccggcaga

SEQ ID NO: 439839 - DNA, 25 bp, Mus musculus
ggctctccacttcgcaggcagtgtc

SEQ ID NO: 439840 - DNA, 25 bp, Mus musculus
agccgcgtaggtaagtgtgcatgcc

SEQ ID NO: 439841 - DNA, 25 bp, Mus musculus
ctgcggggacattcccggacacaca

SEQ ID NO: 439842 - DNA, 25 bp, Mus musculus
gctcttggcaaagtcgcccagccga

SEQ ID NO: 439843 - DNA, 25 bp, Mus musculus
agccacacggccagggactgactga

SEQ ID NO: 439844 - DNA, 25 bp, Mus musculus
tttaactggagtgccttggagtcgc

SEQ ID NO: 439845 - DNA, 25 bp, Mus musculus
ctgaaccacaagcagctcggcttta

SEQ ID NO: 439846 - DNA, 25 bp, Mus musculus
gtgtgccagacacgcagccactgaa

SEQ ID NO: 439847 - DNA, 25 bp, Mus musculus
cgccatcttcgcgaatgcacattga

SEQ ID NO: 439848 - DNA, 25 bp, Mus musculus
ggattcctcgagctcccacggcgct

SEQ ID NO: 439849 - DNA, 25 bp, Mus musculus
agcgacctgcggattcctcgagctc

SEQ ID NO: 439850 - DNA, 25 bp, Mus musculus
aggaccagcgacctgcggattcctc

SEQ ID NO: 439851 - DNA, 25 bp, Mus musculus
gtcactcgcgcgaggccgctcttgg

SEQ ID NO: 439852 - DNA, 25 bp, Mus musculus
tttgccgaggtcactcgcgcgaggc

SEQ ID NO: 439853 - DNA, 25 bp, Mus musculus
aagggctttgccgaggtcactcgcg

SEQ ID NO: 439854 - DNA, 25 bp, Mus musculus
ggcaagggctttgccgaggtcactc

SEQ ID NO: 439855 - DNA, 25 bp, Mus musculus
ttcctcccggcaagggctttgccga

SEQ ID NO: 439856 - DNA, 25 bp, Mus musculus
tctgcggggctttcctcccggcaag

SEQ ID NO: 439857 - DNA, 25 bp, Mus musculus
gcttcctgtggaaaagggctggacg

SEQ ID NO: 439858 - DNA, 25 bp, Mus musculus
tcaggagacctcagagaggcgacag

SEQ ID NO: 439859 - DNA, 25 bp, Mus musculus
gtcagtcaggagacctcagagaggc

SEQ ID NO: 439860 - DNA, 25 bp, Mus musculus
gactcaaacccggtcagtcaggaga

SEQ ID NO: 439861 - DNA, 25 bp, Mus musculus
cggcgactcaaacccggtcagtcag

SEQ ID NO: 439862 - DNA, 25 bp, Mus musculus
cagaggattcgcatccggttgctgg

SEQ ID NO: 439863 - DNA, 25 bp, Mus musculus
tgtgatccgggattttccaattttc

SEQ ID NO: 439864 - DNA, 25 bp, Mus musculus
ccaacgctggaaagcgctgagcttg

SEQ ID NO: 439865 - DNA, 25 bp, Mus musculus
agcgctgagcttgcctgacgctctc

SEQ ID NO: 439866 - DNA, 25 bp, Mus musculus
cgtagccgggtcacaggaaagccca

SEQ ID NO: 439867 - DNA, 25 bp, Mus musculus
ggtcacaggaaagcccagcgtcgtt

SEQ ID NO: 439868 - DNA, 25 bp, Mus musculus
acaggaaagcccagcgtcgttgtga

SEQ ID NO: 439869 - DNA, 25 bp, Mus musculus
aaagcccagcgtcgttgtgatccgg

SEQ ID NO: 439870 - DNA, 25 bp, Mus musculus
cagcgtcgttgtgatccgggatttt

SEQ ID NO: 439871 - DNA, 25 bp, Mus musculus
cgtcgttgtgatccgggattttcca

SEQ ID NO: 439872 - DNA, 25 bp, Mus musculus
ttccaattttcccagaggattcgca

SEQ ID NO: 439873 - DNA, 25 bp, Mus musculus
tgagcttgcctgacgctctcctctc

SEQ ID NO: 439874 - DNA, 25 bp, Mus musculus
ttcccagaggattcgcatccggttg

SEQ ID NO: 439875 - DNA, 25 bp, Mus musculus
aattttcccagaggattcgcatccg

SEQ ID NO: 439876 - DNA, 25 bp, Mus musculus
cccgggaacactgcgaagcttcaaa

SEQ ID NO: 439877 - DNA, 25 bp, Mus musculus
ttcaaacagtcgactgcaggcagct

SEQ ID NO: 439878 - DNA, 25 bp, Mus musculus
tgcaggcagctctgcacgccggaag

SEQ ID NO: 439879 - DNA, 25 bp, Mus musculus
cacgccggaagtgcactaatccgca

SEQ ID NO: 439880 - DNA, 25 bp, Mus musculus
taatccgcagcacgtggggttgcca

SEQ ID NO: 439881 - DNA, 25 bp, Mus musculus
gttgccagggcgagcttcacgtgac

SEQ ID NO: 439882 - DNA, 25 bp, Mus musculus
gacctcgggaagcttcgagccaatg

SEQ ID NO: 439883 - DNA, 25 bp, Mus musculus
cttcgagccaatgggcgacctggag

SEQ ID NO: 439884 - DNA, 25 bp, Mus musculus
cctatcccggaagtgtggtcgcggc

SEQ ID NO: 439885 - DNA, 25 bp, Mus musculus
gagctagggccctttaccgctgggc

SEQ ID NO: 439886 - DNA, 25 bp, Mus musculus
cggcctggctgataccttggcagcg

SEQ ID NO: 439887 - DNA, 25 bp, Mus musculus
cgcaggaaggtcgtgggcacttctt

SEQ ID NO: 439888 - DNA, 25 bp, Mus musculus
tggtgtcgccttcactctccggcga

SEQ ID NO: 439889 - DNA, 25 bp, Mus musculus
agatgaggatgcatctcgcccggga

SEQ ID NO: 439890 - DNA, 25 bp, Mus musculus
accggtgaccactcgtactgacaga

SEQ ID NO: 439891 - DNA, 25 bp, Mus musculus
caatagctgcaacagaagcgcaagg

SEQ ID NO: 439892 - DNA, 25 bp, Mus musculus
tggagacgcccagtaacagtcaagc

SEQ ID NO: 439893 - DNA, 25 bp, Mus musculus
cgcagaagacacagccaggagcctc

SEQ ID NO: 439894 - DNA, 25 bp, Mus musculus
accatagtggaggtgcgtctcagcc

SEQ ID NO: 439895 - DNA, 25 bp, Mus musculus
gcgtggaggcgtcctgctcaccaaa

SEQ ID NO: 439896 - DNA, 25 bp, Mus musculus
tgcgtctcagccatgccagctgtcg

SEQ ID NO: 439897 - DNA, 25 bp, Mus musculus
acctcgggacaagcagcaatagctg

SEQ ID NO: 439898 - DNA, 25 bp, Mus musculus
tcgtactgacagaaaacctcgggac

SEQ ID NO: 439899 - DNA, 25 bp, Mus musculus
tcgagacgctcagaccggtgaccac

SEQ ID NO: 439900 - DNA, 25 bp, Mus musculus
caaggttgcttctgcccagctagtc

SEQ ID NO: 439901 - DNA, 25 bp, Mus musculus
agatcgtagccacaggcaaggttgc

SEQ ID NO: 439902 - DNA, 25 bp, Mus musculus
gtcaagcgagcagcagaagatcgta

SEQ ID NO: 439903 - DNA, 25 bp, Mus musculus
agagcgatccgaggaggtgaccata

SEQ ID NO: 439904 - DNA, 25 bp, Mus musculus
tggggatcatgcagcgcatgctcga

SEQ ID NO: 439905 - DNA, 25 bp, Mus musculus
ttcccggcggagcagcccgaagcat

SEQ ID NO: 439906 - DNA, 25 bp, Mus musculus
ccgaagcattgcgtccagcagcagt

SEQ ID NO: 439907 - DNA, 25 bp, Mus musculus
gcgggcgtcatttccgctggattcc

SEQ ID NO: 439908 - DNA, 25 bp, Mus musculus
catttccgctggattccggcttggc

SEQ ID NO: 439909 - DNA, 25 bp, Mus musculus
ctgttctcggttgtaggtgctgtgt

SEQ ID NO: 439910 - DNA, 25 bp, Mus musculus
gctgtgtgctgaacctgatcctaga

SEQ ID NO: 439911 - DNA, 25 bp, Mus musculus
ccgctgtcaagcagtggggatcatg

SEQ ID NO: 439912 - DNA, 25 bp, Mus musculus
atgctcgagcgcaagcttagccttc

SEQ ID NO: 439913 - DNA, 25 bp, Mus musculus
gcttagccttcgaactttgtaccta

SEQ ID NO: 439914 - DNA, 25 bp, Mus musculus
tttgtacctagagcgcacgagcctc

SEQ ID NO: 439915 - DNA, 25 bp, Mus musculus
cccttctgcagcagcgggtcggaag

SEQ ID NO: 439916 - DNA, 25 bp, Mus musculus
ggtcggaagtcacccaacgagtgcg

SEQ ID NO: 439917 - DNA, 25 bp, Mus musculus
atcctagacggggatctgctctctc

SEQ ID NO: 439918 - DNA, 25 bp, Mus musculus
ctctggagaacctccgccgtgtatg

SEQ ID NO: 439919 - DNA, 25 bp, Mus musculus
ctagaacagtcctacccggcgttga

SEQ ID NO: 439920 - DNA, 25 bp, Mus musculus
ttcgccctcaatcgcagacactaga

SEQ ID NO: 439921 - DNA, 25 bp, Mus musculus
cagcgcagttggcaaacagatctta

SEQ ID NO: 439922 - DNA, 25 bp, Mus musculus
cgccgtgtatgatttgtggctcgcc

SEQ ID NO: 439923 - DNA, 25 bp, Mus musculus
ctggaaatttgttccactctggaga

SEQ ID NO: 439924 - DNA, 25 bp, Mus musculus
acagagctgtgagataatgcgagtc

SEQ ID NO: 439925 - DNA, 25 bp, Mus musculus
agtggaggccctctctcccacagag

SEQ ID NO: 439926 - DNA, 25 bp, Mus musculus
ctctctccggtagccggtaagtgga

SEQ ID NO: 439927 - DNA, 25 bp, Mus musculus
ctcggaacttggcaccctcaagatc

SEQ ID NO: 439928 - DNA, 25 bp, Mus musculus
tttggtggaatctctgctgacgtca

SEQ ID NO: 439929 - DNA, 25 bp, Mus musculus
gcgccactgtgcactggagtttggt

SEQ ID NO: 439930 - DNA, 25 bp, Mus musculus
tgatcgcccagcgtacagcaggctc

SEQ ID NO: 439931 - DNA, 25 bp, Mus musculus
cgccgggcttgtttctccagattca

SEQ ID NO: 439932 - DNA, 25 bp, Mus musculus
gcagcaagctgttcccgcggcagca

SEQ ID NO: 439933 - DNA, 25 bp, Mus musculus
cttccctccgccctttggcatccgc

SEQ ID NO: 439934 - DNA, 25 bp, Mus musculus
ttggcatccgctgccaccgcacgtg

SEQ ID NO: 439935 - DNA, 25 bp, Mus musculus
actaacggcccaggcgtgcagccgg

SEQ ID NO: 439936 - DNA, 25 bp, Mus musculus
gtgcagccggcagccgttgaatgtc

SEQ ID NO: 439937 - DNA, 25 bp, Mus musculus
cggcagccgttgaatgtctcttctc

SEQ ID NO: 439938 - DNA, 25 bp, Mus musculus
gcagccgttgaatgtctcttctcca

SEQ ID NO: 439939 - DNA, 25 bp, Mus musculus
ccgttgaatgtctcttctccaaaga

SEQ ID NO: 439940 - DNA, 25 bp, Mus musculus
cttctccaaagactccgaaatcaaa

SEQ ID NO: 439941 - DNA, 25 bp, Mus musculus
tccgaaatcaaaaaggtcgagttca

SEQ ID NO: 439942 - DNA, 25 bp, Mus musculus
tcaaaaaggtcgagttcacggactc

SEQ ID NO: 439943 - DNA, 25 bp, Mus musculus
cggactctcccaagagccggaaaga

SEQ ID NO: 439944 - DNA, 25 bp, Mus musculus
gccggaaagagtcggccagcagcaa

SEQ ID NO: 439945 - DNA, 25 bp, Mus musculus
tcccaagagccggaaagagtcggcc

SEQ ID NO: 439946 - DNA, 25 bp, Mus musculus
gattcggcagtttgcgttccctggc

SEQ ID NO: 439947 - DNA, 25 bp, Mus musculus
ctggaggtgcatacaatctccgata

SEQ ID NO: 439948 - DNA, 25 bp, Mus musculus
ttggactcctccaaacatagactgg

SEQ ID NO: 439949 - DNA, 25 bp, Mus musculus
atgaactgcatgaaaggcccgctgc

SEQ ID NO: 439950 - DNA, 25 bp, Mus musculus
ccctggctctttcaagtctcggcta

SEQ ID NO: 439951 - DNA, 25 bp, Mus musculus
tttcggctgccgaactctttttggc

SEQ ID NO: 439952 - DNA, 25 bp, Mus musculus
tccctaaagaggctcgcagcggttc

SEQ ID NO: 439953 - DNA, 25 bp, Mus musculus
ggatcgtggaagtcggctccctaaa

SEQ ID NO: 439954 - DNA, 25 bp, Mus musculus
agcgctctcgtagctgtccttattg

SEQ ID NO: 439955 - DNA, 25 bp, Mus musculus
agctacctgtccctgtcactcttga

SEQ ID NO: 439956 - DNA, 25 bp, Mus musculus
agccgcctcggggaatctaatatca

SEQ ID NO: 439957 - DNA, 25 bp, Mus musculus
gcccgcctctggttttaagatgtta

SEQ ID NO: 439958 - DNA, 25 bp, Mus musculus
gagtgacgtcttgccaccaggaagc

SEQ ID NO: 439959 - DNA, 25 bp, Mus musculus
gtctcggctaacacggggacacttg

SEQ ID NO: 439960 - DNA, 25 bp, Mus musculus
ggccgaggccttgccaagaatcaga

SEQ ID NO: 439961 - DNA, 25 bp, Mus musculus
cccgtccaagaagaagcggcaacgc

SEQ ID NO: 439962 - DNA, 25 bp, Mus musculus
gcaacgccggcagaggactcatttc

SEQ ID NO: 439963 - DNA, 25 bp, Mus musculus
gactcatttcactagccagcagctg

SEQ ID NO: 439964 - DNA, 25 bp, Mus musculus
tggaagccactttccagagaaaccg

SEQ ID NO: 439965 - DNA, 25 bp, Mus musculus
agagaaaccgctacccagacatgtc

SEQ ID NO: 439966 - DNA, 25 bp, Mus musculus
agacatgtccactcgcgaagaaatc

SEQ ID NO: 439967 - DNA, 25 bp, Mus musculus
gaaatcgccgtgtggaccaacctta

SEQ ID NO: 439968 - DNA, 25 bp, Mus musculus
agggcattgtgttcccggcttaccg

SEQ ID NO: 439969 - DNA, 25 bp, Mus musculus
cgggcattcctcagcaaagggcatt

SEQ ID NO: 439970 - DNA, 25 bp, Mus musculus
ggttcccaggcagagctgccgcctg

SEQ ID NO: 439971 - DNA, 25 bp, Mus musculus
tcagagcctgcagatcatgggtggc

SEQ ID NO: 439972 - DNA, 25 bp, Mus musculus
ccgggtaggagccagcacccaatct

SEQ ID NO: 439973 - DNA, 25 bp, Mus musculus
cgaggttactgctcccggttcccag

SEQ ID NO: 439974 - DNA, 25 bp, Mus musculus
taacttgaacaacctgagcagcccg

SEQ ID NO: 439975 - DNA, 25 bp, Mus musculus
cagtatgcagtcgaccggccggtgt

SEQ ID NO: 439976 - DNA, 25 bp, Mus musculus
cgggctccagcctcaatagcctgaa

SEQ ID NO: 439977 - DNA, 25 bp, Mus musculus
tagcctgaataacttgaacaacctg

SEQ ID NO: 439978 - DNA, 25 bp, Mus musculus
tgagcagcccgtcgctgaattccgc

SEQ ID NO: 439979 - DNA, 25 bp, Mus musculus
tcctccgtacgtttatagggacaca

SEQ ID NO: 439980 - DNA, 25 bp, Mus musculus
tagggacacatgtaactcgagcctg

SEQ ID NO: 439981 - DNA, 25 bp, Mus musculus
taactcgagcctggccagcctgaga

SEQ ID NO: 439982 - DNA, 25 bp, Mus musculus
agcctgagactgaaagcaaagcagc

SEQ ID NO: 439983 - DNA, 25 bp, Mus musculus
aagcagcactccagcttcggctacg

SEQ ID NO: 439984 - DNA, 25 bp, Mus musculus
ttcggctacgccagcgtgcagaacc

SEQ ID NO: 439985 - DNA, 25 bp, Mus musculus
ggcctccaacctgagtgcttgccag

SEQ ID NO: 439986 - DNA, 25 bp, Mus musculus
agcccgtcgctgaattccgcggtgc

SEQ ID NO: 439987 - DNA, 25 bp, Mus musculus
tgcttgccagtatgcagtcgaccgg

SEQ ID NO: 439988 - DNA, 25 bp, Mus musculus
gagatgtttccctccggtttagtgc

SEQ ID NO: 439989 - DNA, 25 bp, Mus musculus
tgtttccctccggtttagtgcgagc

SEQ ID NO: 439990 - DNA, 25 bp, Mus musculus
agggcgctcgcgacctgccttccct

SEQ ID NO: 439991 - DNA, 25 bp, Mus musculus
tcatcaatgggaaaccggagacgcc

SEQ ID NO: 439992 - DNA, 25 bp, Mus musculus
cccgatcccgggcttgctgctcccg

SEQ ID NO: 439993 - DNA, 25 bp, Mus musculus
acccttggccttcagcttgcgagct

SEQ ID NO: 439994 - DNA, 25 bp, Mus musculus
cttcagcttgcgagctgggcccttg

SEQ ID NO: 439995 - DNA, 25 bp, Mus musculus
cccagagccagcctggtgcggtcgc

SEQ ID NO: 439996 - DNA, 25 bp, Mus musculus
tgctcctggacaccgaggacgcggg

SEQ ID NO: 439997 - DNA, 25 bp, Mus musculus
gcctgggtcccgagcgcgattacac

SEQ ID NO: 439998 - DNA, 25 bp, Mus musculus
tacacccccggggagtctggatcgc

SEQ ID NO: 439999 - DNA, 25 bp, Mus musculus
cccgagcgctgcaggaagcccagcc

SEQ ID NO: 440000 - DNA, 25 bp, Mus musculus
ggggtcctagcggtgcacttcctcc

SEQ ID NO: 440001 - DNA, 25 bp, Mus musculus
accgtgctgtggttggagatgtttc

SEQ ID NO: 440002 - DNA, 25 bp, Mus musculus
cgacctgactctgctccacggagtg

SEQ ID NO: 440003 - DNA, 25 bp, Mus musculus
ggctctgtcacttcttgggttgcga

SEQ ID NO: 440004 - DNA, 25 bp, Mus musculus
cgcgttgcccttggaaacggagttg

SEQ ID NO: 440005 - DNA, 25 bp, Mus musculus
gtagagcacacagcaccggaagaga

SEQ ID NO: 440006 - DNA, 25 bp, Mus musculus
tcccaacgccttaccgagtagagca

SEQ ID NO: 440007 - DNA, 25 bp, Mus musculus
accgtagccgtccaatgttaccaga

SEQ ID NO: 440008 - DNA, 25 bp, Mus musculus
tcaccgcgggtcgatcatttatcta

SEQ ID NO: 440009 - DNA, 25 bp, Mus musculus
cctggcgaaatagacgggccgctcc

SEQ ID NO: 440010 - DNA, 25 bp, Mus musculus
gaaagacatgctctctccggcctgg

SEQ ID NO: 440011 - DNA, 25 bp, Mus musculus
gcgacctccgcctcggaaagacatg

SEQ ID NO: 440012 - DNA, 25 bp, Mus musculus
ccctcggaagtggttgttgctgccg

SEQ ID NO: 440013 - DNA, 25 bp, Mus musculus
tcagcccaggacgtcggaacctgtc

SEQ ID NO: 440014 - DNA, 25 bp, Mus musculus
ttggccactcaagcggtgctcagcc

SEQ ID NO: 440015 - DNA, 25 bp, Mus musculus
ttgagtccttccgtgctaacagctg

SEQ ID NO: 440016 - DNA, 25 bp, Mus musculus
gaggacgggctctgccagtacaagt

SEQ ID NO: 440017 - DNA, 25 bp, Mus musculus
ggcatccacaagatagacacgtacc

SEQ ID NO: 440018 - DNA, 25 bp, Mus musculus
taagctacgggagcgttccggagac

SEQ ID NO: 440019 - DNA, 25 bp, Mus musculus
gaaatgcgagaatccgagccaggca

SEQ ID NO: 440020 - DNA, 25 bp, Mus musculus
tacaagtgcagcgacggtgagccgc

SEQ ID NO: 440021 - DNA, 25 bp, Mus musculus
tgccagtacaagtgcagcgacggtg

SEQ ID NO: 440022 - DNA, 25 bp, Mus musculus
gatagacacgtacctcaacgccgcg

SEQ ID NO: 440023 - DNA, 25 bp, Mus musculus
catccgcaacggcatccacaagata

SEQ ID NO: 440024 - DNA, 25 bp, Mus musculus
gaacaggaccagaccaccgactgga

SEQ ID NO: 440025 - DNA, 25 bp, Mus musculus
tgggcaggaacaggaccagaccacc

SEQ ID NO: 440026 - DNA, 25 bp, Mus musculus
caccgttcggcgcagctcagtgacg

SEQ ID NO: 440027 - DNA, 25 bp, Mus musculus
aatgaggctcccacgctcgggcgca

SEQ ID NO: 440028 - DNA, 25 bp, Mus musculus
ttccggagaccacgtgggcaatgag

SEQ ID NO: 440029 - DNA, 25 bp, Mus musculus
actggagggccaccctcaagaccat

SEQ ID NO: 440030 - DNA, 25 bp, Mus musculus
gcttttgtcctcacgtccgctgctt

SEQ ID NO: 440031 - DNA, 25 bp, Mus musculus
taagtgcggacacccgtgcgtgcgt

SEQ ID NO: 440032 - DNA, 25 bp, Mus musculus
ccggggactgctaggactgacagaa

SEQ ID NO: 440033 - DNA, 25 bp, Mus musculus
ctgctaggactgacagaagtgggct

SEQ ID NO: 440034 - DNA, 25 bp, Mus musculus
ctaggactgacagaagtgggcttgc

SEQ ID NO: 440035 - DNA, 25 bp, Mus musculus
cttgcggcgctgtgcagtgaaggac

SEQ ID NO: 440036 - DNA, 25 bp, Mus musculus
cagtgaaggacgtagcagcggtatt

SEQ ID NO: 440037 - DNA, 25 bp, Mus musculus
cgtagcagcggtattttgctcaggc

SEQ ID NO: 440038 - DNA, 25 bp, Mus musculus
cgtccgctgcttcccggctgtttaa

SEQ ID NO: 440039 - DNA, 25 bp, Mus musculus
gagcgcttttgtcctcacgtccgct

SEQ ID NO: 440040 - DNA, 25 bp, Mus musculus
gaggcctcagggctaggacaccggt

SEQ ID NO: 440041 - DNA, 25 bp, Mus musculus
caggtaagtgcggacacccgtgcgt

SEQ ID NO: 440042 - DNA, 25 bp, Mus musculus
agcggtattttgctcaggctaaccc

SEQ ID NO: 440043 - DNA, 25 bp, Mus musculus
cctccggggactgctaggactgaca

SEQ ID NO: 440044 - DNA, 25 bp, Mus musculus
tcagcctgctgtgccgcgtgcacga

SEQ ID NO: 440045 - DNA, 25 bp, Mus musculus
ctctgctccgcgacagcgctctgcg

SEQ ID NO: 440046 - DNA, 25 bp, Mus musculus
ctggaggtggaaaacaccgagatgc

SEQ ID NO: 440047 - DNA, 25 bp, Mus musculus
aacaccgagatgcagtcgcacgctc

SEQ ID NO: 440048 - DNA, 25 bp, Mus musculus
agatgcagtcgcacgctctgctccg

SEQ ID NO: 440049 - DNA, 25 bp, Mus musculus
agcagcaccgcagcctctgcgatga

SEQ ID NO: 440050 - DNA, 25 bp, Mus musculus
accgcacgggcctgggactttgtcg

SEQ ID NO: 440051 - DNA, 25 bp, Mus musculus
tcatcgacggtagggcccaaccgca

SEQ ID NO: 440052 - DNA, 25 bp, Mus musculus
gcagatcatcgacggtagggcccaa

SEQ ID NO: 440053 - DNA, 25 bp, Mus musculus
tcatccagggccagcggcagatcat

SEQ ID NO: 440054 - DNA, 25 bp, Mus musculus
tggaagagacgctgccgcgccgcat

SEQ ID NO: 440055 - DNA, 25 bp, Mus musculus
atgagatcatccagggccagcggca

SEQ ID NO: 440056 - DNA, 25 bp, Mus musculus
gccagcggcagatcatcgacggtag

SEQ ID NO: 440057 - DNA, 25 bp, Mus musculus
cgcagcctctgcgatgagatcatcc

SEQ ID NO: 440058 - DNA, 25 bp, Mus musculus
gcactccgtgcatatccggttccga

SEQ ID NO: 440059 - DNA, 25 bp, Mus musculus
gggcccgcgactagcttagtatcgg

SEQ ID NO: 440060 - DNA, 25 bp, Mus musculus
aggtgactgccaagcactccgtgca

SEQ ID NO: 440061 - DNA, 25 bp, Mus musculus
acgcctccgtttcctaggtgactgc

SEQ ID NO: 440062 - DNA, 25 bp, Mus musculus
ggcggaaaccaaacgccagggcatc

SEQ ID NO: 440063 - DNA, 25 bp, Mus musculus
ccggttccgagttgcgtatttcgca

SEQ ID NO: 440064 - DNA, 25 bp, Mus musculus
tttcgcacgctctgcgtatgacgca

SEQ ID NO: 440065 - DNA, 25 bp, Mus musculus
gacgcagcacgtttttatataaaag

SEQ ID NO: 440066 - DNA, 25 bp, Mus musculus
ttatataaaagcgtgcgtgcggcgc

SEQ ID NO: 440067 - DNA, 25 bp, Mus musculus
ctcgggtattacaggtagctattgc

SEQ ID NO: 440068 - DNA, 25 bp, Mus musculus
caggtagctattgcgtctagcgagc

SEQ ID NO: 440069 - DNA, 25 bp, Mus musculus
cggctcgactgggacgatagaatcc

SEQ ID NO: 440070 - DNA, 25 bp, Mus musculus
atagaatccgggttgcggagccgtc

SEQ ID NO: 440071 - DNA, 25 bp, Mus musculus
tcccactcgaagacgcaggcggaaa

SEQ ID NO: 440072 - DNA, 25 bp, Mus musculus
ctgccggacagagctcctggcatta

SEQ ID NO: 440073 - DNA, 25 bp, Mus musculus
actgctttcactcctgccgaacttg

SEQ ID NO: 440074 - DNA, 25 bp, Mus musculus
ctacagaccgcaggacacagcggtg

SEQ ID NO: 440075 - DNA, 25 bp, Mus musculus
gcagcacgcagggaactgctttcac

SEQ ID NO: 440076 - DNA, 25 bp, Mus musculus
gaacttgcccaacgcaaactttcca

SEQ ID NO: 440077 - DNA, 25 bp, Mus musculus
ctgcgccgcgccttacctggggtgt

SEQ ID NO: 440078 - DNA, 25 bp, Mus musculus
tgtggatggcagctccctgggatcc

SEQ ID NO: 440079 - DNA, 25 bp, Mus musculus
gacccagacatagcccgctcgggag

SEQ ID NO: 440080 - DNA, 25 bp, Mus musculus
gctcctggcattaacgacgcatcct

SEQ ID NO: 440081 - DNA, 25 bp, Mus musculus
gacgcatcctcatccggctgctata

SEQ ID NO: 440082 - DNA, 25 bp, Mus musculus
gctgctatagcccagcccgctgtgg

SEQ ID NO: 440083 - DNA, 25 bp, Mus musculus
ccgctttgacttcgcttggtgcaca

SEQ ID NO: 440084 - DNA, 25 bp, Mus musculus
tttgacttcgcttggtgcacacccg

SEQ ID NO: 440085 - DNA, 25 bp, Mus musculus
ggctcggatcgtccgcagcagctgc

SEQ ID NO: 440086 - DNA, 25 bp, Mus musculus
ctgcgccctgcagtgctgcagagcg

SEQ ID NO: 440087 - DNA, 25 bp, Mus musculus
ccagcccacccacgtacccatcctc

SEQ ID NO: 440088 - DNA, 25 bp, Mus musculus
gagtcctgggtcacgccagtcccag

SEQ ID NO: 440089 - DNA, 25 bp, Mus musculus
gtcccgagtcctgggtcacgccagt

SEQ ID NO: 440090 - DNA, 25 bp, Mus musculus
tgctgcagagcggtgcaaagctgcg

SEQ ID NO: 440091 - DNA, 25 bp, Mus musculus
agcctgcgccctgcagtgctgcaga

SEQ ID NO: 440092 - DNA, 25 bp, Mus musculus
ccgctacccggatggagcctgcgcc

SEQ ID NO: 440093 - DNA, 25 bp, Mus musculus
tggccgccgctacccggatggagcc

SEQ ID NO: 440094 - DNA, 25 bp, Mus musculus
ccgcatcgcggcctccaggctccac

SEQ ID NO: 440095 - DNA, 25 bp, Mus musculus
gccctgccggcccttcggtcgctcc

SEQ ID NO: 440096 - DNA, 25 bp, Mus musculus
ctccactccggcctcggtccgcgcg

SEQ ID NO: 440097 - DNA, 25 bp, Mus musculus
gcagacggtcgtgcgggccgccgac

SEQ ID NO: 440098 - DNA, 25 bp, Mus musculus
cccaggtcggagcagacggtcgtgc

SEQ ID NO: 440099 - DNA, 25 bp, Mus musculus
gctgaggtcccgagtcctgggtcac

SEQ ID NO: 440100 - DNA, 25 bp, Mus musculus
aggaggcaacggtgcaactttcttc

SEQ ID NO: 440101 - DNA, 25 bp, Mus musculus
gaggtcggcgccacatccgccttgg

SEQ ID NO: 440102 - DNA, 25 bp, Mus musculus
ctcggaggaggcaacggtgcaactt

SEQ ID NO: 440103 - DNA, 25 bp, Mus musculus
gaggcaacggtgcaactttcttcgg

SEQ ID NO: 440104 - DNA, 25 bp, Mus musculus
ggcaacggtgcaactttcttcggtc

SEQ ID NO: 440105 - DNA, 25 bp, Mus musculus
caacggtgcaactttcttcggtcgt

SEQ ID NO: 440106 - DNA, 25 bp, Mus musculus
gtgcaactttcttcggtcgtcccga

SEQ ID NO: 440107 - DNA, 25 bp, Mus musculus
tgccgcccaagttcgaccccaacga

SEQ ID NO: 440108 - DNA, 25 bp, Mus musculus
cgaatccgggttcatccgacaccag

SEQ ID NO: 440109 - DNA, 25 bp, Mus musculus
tgtacctgaggtgcaccggaggcga

SEQ ID NO: 440110 - DNA, 25 bp, Mus musculus
gaatccgggttcatccgacaccagc

SEQ ID NO: 440111 - DNA, 25 bp, Mus musculus
gttcatccgacaccagccgcctcca

SEQ ID NO: 440112 - DNA, 25 bp, Mus musculus
gccgcctccaccatgccgcccaagt

SEQ ID NO: 440113 - DNA, 25 bp, Mus musculus
tgcaactttcttcggtcgtcccgaa

SEQ ID NO: 440114 - DNA, 25 bp, Mus musculus
gccctagtgggtttcatttcagctg

SEQ ID NO: 440115 - DNA, 25 bp, Mus musculus
caggcagactcaacaggtcggagca

SEQ ID NO: 440116 - DNA, 25 bp, Mus musculus
ttttggccttgaactgatccaggtg

SEQ ID NO: 440117 - DNA, 25 bp, Mus musculus
ctgggcgaaggtgaatatattatgc

SEQ ID NO: 440118 - DNA, 25 bp, Mus musculus
cttacgatcgctgcttgggtcactc

SEQ ID NO: 440119 - DNA, 25 bp, Mus musculus
gcgcgcactgtctcacacaagagca

SEQ ID NO: 440120 - DNA, 25 bp, Mus musculus
acacgcgggtctgcggagatacttt

SEQ ID NO: 440121 - DNA, 25 bp, Mus musculus
catcccggggtatttaaggctcgca

SEQ ID NO: 440122 - DNA, 25 bp, Mus musculus
agggtgcttttcactcctagctgga

SEQ ID NO: 440123 - DNA, 25 bp, Mus musculus
agccacgcgcaggtccatctctaag

SEQ ID NO: 440124 - DNA, 25 bp, Mus musculus
gggctccgactctaccaactagttg

SEQ ID NO: 440125 - DNA, 25 bp, Mus musculus
taccaactagttgtgcagccgcagg

SEQ ID NO: 440126 - DNA, 25 bp, Mus musculus
gcagggactgaactttggaggaacc

SEQ ID NO: 440127 - DNA, 25 bp, Mus musculus
ggagatacttttggggcctcgcagc

SEQ ID NO: 440128 - DNA, 25 bp, Mus musculus
gtacaccgtcatagccgacggcatg

SEQ ID NO: 440129 - DNA, 25 bp, Mus musculus
ctaccagggcgtacaccgtcatagc

SEQ ID NO: 440130 - DNA, 25 bp, Mus musculus
actcggtacagagtctccatgtccc

SEQ ID NO: 440131 - DNA, 25 bp, Mus musculus
agcactaagaatgggactcggtaca

SEQ ID NO: 440132 - DNA, 25 bp, Mus musculus
ggttggggcattcgagcactaagaa

SEQ ID NO: 440133 - DNA, 25 bp, Mus musculus
cttcagcttcaggttggggcattcg

SEQ ID NO: 440134 - DNA, 25 bp, Mus musculus
gcacccagggcggtttcttcagctt

SEQ ID NO: 440135 - DNA, 25 bp, Mus musculus
agtaagataccactaccagggcgta

SEQ ID NO: 440136 - DNA, 25 bp, Mus musculus
ctccggtaatgaggaagtaagatac

SEQ ID NO: 440137 - DNA, 25 bp, Mus musculus
catcacggccgagttacctccggta

SEQ ID NO: 440138 - DNA, 25 bp, Mus musculus
ctttccagtgaaaggcgtgagccta

SEQ ID NO: 440139 - DNA, 25 bp, Mus musculus
ggagaccatctctttccagtgaaag

SEQ ID NO: 440140 - DNA, 25 bp, Mus musculus
ggcagagaggagaccatctctttcc

SEQ ID NO: 440141 - DNA, 25 bp, Mus musculus
atagccgacggcatgtgcacccagg

SEQ ID NO: 440142 - DNA, 25 bp, Mus musculus
aaaggagcccaaacgccaagcgcga

SEQ ID NO: 440143 - DNA, 25 bp, Mus musculus
acggcgccggacaggaagtacgtca

SEQ ID NO: 440144 - DNA, 25 bp, Mus musculus
aagaaggccaccatacctctgagca

SEQ ID NO: 440145 - DNA, 25 bp, Mus musculus
cagagcagaagaaggccaccatacc

SEQ ID NO: 440146 - DNA, 25 bp, Mus musculus
gcctcggatggctacggatcgtaaa

SEQ ID NO: 440147 - DNA, 25 bp, Mus musculus
gcttcccgagtctacgagccgaggc

SEQ ID NO: 440148 - DNA, 25 bp, Mus musculus
cgggtttgatctcgggcttcccgag

SEQ ID NO: 440149 - DNA, 25 bp, Mus musculus
ctcaccgcttcggaagccgggtttg

SEQ ID NO: 440150 - DNA, 25 bp, Mus musculus
caccatggcagacagcaccagggga

SEQ ID NO: 440151 - DNA, 25 bp, Mus musculus
gctcgctgactagccaccatggcag

SEQ ID NO: 440152 - DNA, 25 bp, Mus musculus
gccgccactgcttgattcgtatctt

SEQ ID NO: 440153 - DNA, 25 bp, Mus musculus
tgctaaggaccctgagccgccactg

SEQ ID NO: 440154 - DNA, 25 bp, Mus musculus
cgccatgttgtacggaagcggacgc

SEQ ID NO: 440155 - DNA, 25 bp, Mus musculus
cgcgacccggaccagtgctaaggac

SEQ ID NO: 440156 - DNA, 25 bp, Mus musculus
gcccacgccacattgaggcacagga

SEQ ID NO: 440157 - DNA, 25 bp, Mus musculus
cggatcctctgctggcacgtgtata

SEQ ID NO: 440158 - DNA, 25 bp, Mus musculus
gtccaagtgtggcatccctctgtcc

SEQ ID NO: 440159 - DNA, 25 bp, Mus musculus
ctctgtcctgatgctacgcaggatc

SEQ ID NO: 440160 - DNA, 25 bp, Mus musculus
tacgcaggatcttcggtgcgggatc

SEQ ID NO: 440161 - DNA, 25 bp, Mus musculus
tcggcttcccggtgcagagccaaac

SEQ ID NO: 440162 - DNA, 25 bp, Mus musculus
gcgttaggggcaggcactcatgcct

SEQ ID NO: 440163 - DNA, 25 bp, Mus musculus
tcatgcctggggttgacgtcccaca

SEQ ID NO: 440164 - DNA, 25 bp, Mus musculus
cccacagggcagagtggacagtgtt

SEQ ID NO: 440165 - DNA, 25 bp, Mus musculus
gtggacagtgttccctccaccctga

SEQ ID NO: 440166 - DNA, 25 bp, Mus musculus
tccaccctgagaggagggccgtcca

SEQ ID NO: 440167 - DNA, 25 bp, Mus musculus
gtgcgcaaattaccgcgccgagctg

SEQ ID NO: 440168 - DNA, 25 bp, Mus musculus
cgccctccgccgataaaaggcgaga

SEQ ID NO: 440169 - DNA, 25 bp, Mus musculus
cacgtgtataccagagccgaagtcc

SEQ ID NO: 440170 - DNA, 25 bp, Mus musculus
agaggttttgcacggtgacgcacca

SEQ ID NO: 440171 - DNA, 25 bp, Mus musculus
cctagtccatggtgcgcacgtgtgt

SEQ ID NO: 440172 - DNA, 25 bp, Mus musculus
tgattcttctcgtacctccgctggg

SEQ ID NO: 440173 - DNA, 25 bp, Mus musculus
caccgaaatcagcatccgaggaatc

SEQ ID NO: 440174 - DNA, 25 bp, Mus musculus
gcagcgggcagggaaatttatccca

SEQ ID NO: 440175 - DNA, 25 bp, Mus musculus
gagtccgaaatcatcccagccagca

SEQ ID NO: 440176 - DNA, 25 bp, Mus musculus
agtcatctttggttaacgagtccga

SEQ ID NO: 440177 - DNA, 25 bp, Mus musculus
gagggcgacttagccgacatcaagt

SEQ ID NO: 440178 - DNA, 25 bp, Mus musculus
cggagattacacagccgccgggatg

SEQ ID NO: 440179 - DNA, 25 bp, Mus musculus
ccttcttgctgtctcggagtgctcc

SEQ ID NO: 440180 - DNA, 25 bp, Mus musculus
ttctaagtgggaaagcgcggcaatc

SEQ ID NO: 440181 - DNA, 25 bp, Mus musculus
agccctggcagcctagcctagtgca

SEQ ID NO: 440182 - DNA, 25 bp, Mus musculus
gggaccctcgtttgcactttggcaa

SEQ ID NO: 440183 - DNA, 25 bp, Mus musculus
tcccaagtgtttctatggctaaacg

SEQ ID NO: 440184 - DNA, 25 bp, Mus musculus
catagctcagtgcagcagccgagga

SEQ ID NO: 440185 - DNA, 25 bp, Mus musculus
gcatgctgcaccttctcggacttca

SEQ ID NO: 440186 - DNA, 25 bp, Mus musculus
gcccggcagttagttgagaagcatg

SEQ ID NO: 440187 - DNA, 25 bp, Mus musculus
ttgagaagcatgcacgtaaggatcg

SEQ ID NO: 440188 - DNA, 25 bp, Mus musculus
catgcacgtaaggatcgggccgaag

SEQ ID NO: 440189 - DNA, 25 bp, Mus musculus
ccgaaggctgtagttctgggacact

SEQ ID NO: 440190 - DNA, 25 bp, Mus musculus
ttctgggacactgaagcatgctgca

SEQ ID NO: 440191 - DNA, 25 bp, Mus musculus
ttctcggacttcatcaaactatttc

SEQ ID NO: 440192 - DNA, 25 bp, Mus musculus
cgccgccgatgacggtcacatgctt

SEQ ID NO: 440193 - DNA, 25 bp, Mus musculus
gacggtcacatgcttgatcaggatc

SEQ ID NO: 440194 - DNA, 25 bp, Mus musculus
acatgcttgatcaggatcttcttgg

SEQ ID NO: 440195 - DNA, 25 bp, Mus musculus
ggacatggagcgcaagaattgcctg

SEQ ID NO: 440196 - DNA, 25 bp, Mus musculus
gtcacgaacgccatagctcagtgca

SEQ ID NO: 440197 - DNA, 25 bp, Mus musculus
gaattgcctggtcacgaacgccata

SEQ ID NO: 440198 - DNA, 25 bp, Mus musculus
actggtaagcctgcagcaagagatc

SEQ ID NO: 440199 - DNA, 25 bp, Mus musculus
accagcactgtcttctggaagctca

SEQ ID NO: 440200 - DNA, 25 bp, Mus musculus
gcgcgtggaacagctccagctcatc

SEQ ID NO: 440201 - DNA, 25 bp, Mus musculus
cccggtgctaacagcgtagtggtac

SEQ ID NO: 440202 - DNA, 25 bp, Mus musculus
agttgcgcctctgcagatctgcgtg

SEQ ID NO: 440203 - DNA, 25 bp, Mus musculus
cttcgctgctttgatggaagctgta

SEQ ID NO: 440204 - DNA, 25 bp, Mus musculus
ctgctagctggcgtgaccactagtc

SEQ ID NO: 440205 - DNA, 25 bp, Mus musculus
gagcacgttccaggtaatccggcga

SEQ ID NO: 440206 - DNA, 25 bp, Mus musculus
actgggtcccaactgcgtctggaaa

SEQ ID NO: 440207 - DNA, 25 bp, Mus musculus
gcgagccgggttgttgatgacccac

SEQ ID NO: 440208 - DNA, 25 bp, Mus musculus
ggcgctgccgttcacgtgaaaaaac

SEQ ID NO: 440209 - DNA, 25 bp, Mus musculus
cgcctgcagctggaaaagctgtgca

SEQ ID NO: 440210 - DNA, 25 bp, Mus musculus
ccgccacggcagaaaggttccaagc

SEQ ID NO: 440211 - DNA, 25 bp, Mus musculus
ccaagccaggaactgcaggcagctc

SEQ ID NO: 440212 - DNA, 25 bp, Mus musculus
gggatcctccagtcagctgctcctg

SEQ ID NO: 440213 - DNA, 25 bp, Mus musculus
cccagccagaactgcggtcgtagaa

SEQ ID NO: 440214 - DNA, 25 bp, Mus musculus
gcgggcggtcactgaacacttcagc

SEQ ID NO: 440215 - DNA, 25 bp, Mus musculus
tggaagtcgctgaggaccaccacca

SEQ ID NO: 440216 - DNA, 25 bp, Mus musculus
gctgaagatgttgccatagacacgg

SEQ ID NO: 440217 - DNA, 25 bp, Mus musculus
caggtacacatgctggcccaccgtg

SEQ ID NO: 440218 - DNA, 25 bp, Mus musculus
ccctatgctggtcatgacgcaggtc

SEQ ID NO: 440219 - DNA, 25 bp, Mus musculus
aagtgcccgaagttacccacgagtg

SEQ ID NO: 440220 - DNA, 25 bp, Mus musculus
ggcaaagtagcagcgcgcctcctgt

SEQ ID NO: 440221 - DNA, 25 bp, Mus musculus
acgtgcagtctagctcccggctgct

SEQ ID NO: 440222 - DNA, 25 bp, Mus musculus
cccgagcgaggacatgtcccaggta

SEQ ID NO: 440223 - DNA, 25 bp, Mus musculus
gtagccggctacatgactcaaggtc

SEQ ID NO: 440224 - DNA, 25 bp, Mus musculus
caaggcacgcccttccgattggctg

SEQ ID NO: 440225 - DNA, 25 bp, Mus musculus
actcaaggtcaaccgcgaggcaggg

SEQ ID NO: 440226 - DNA, 25 bp, Mus musculus
gcgcgctaggcgcacctacttgtgc

SEQ ID NO: 440227 - DNA, 25 bp, Mus musculus
atggttctgggcaaccgagctcagc

SEQ ID NO: 440228 - DNA, 25 bp, Mus musculus
tccaaagtgcaaggccgggctattc

SEQ ID NO: 440229 - DNA, 25 bp, Mus musculus
ctacttgtgcgcaccagagagcagc

SEQ ID NO: 440230 - DNA, 25 bp, Mus musculus
caaggccgggctattcccggacgtg

SEQ ID NO: 440231 - DNA, 25 bp, Mus musculus
tggggatctgaaaaccgcctcggga

SEQ ID NO: 440232 - DNA, 25 bp, Mus musculus
gctctcagcctgtccaaagtgcaag

SEQ ID NO: 440233 - DNA, 25 bp, Mus musculus
agaggccaagctctcagcctgtcca

SEQ ID NO: 440234 - DNA, 25 bp, Mus musculus
ctgaccatgggagaggccaagctct

SEQ ID NO: 440235 - DNA, 25 bp, Mus musculus
ctcagcgcgggtagtggctgaccat

SEQ ID NO: 440236 - DNA, 25 bp, Mus musculus
ttctgggcaaccgagctcagcgcgg

SEQ ID NO: 440237 - DNA, 25 bp, Mus musculus
ccaggtgccaatggttctgggcaac

SEQ ID NO: 440238 - DNA, 25 bp, Mus musculus
ttgtacgcccaggtgccaatggttc

SEQ ID NO: 440239 - DNA, 25 bp, Mus musculus
cccgccagggttgtacgcccaggtg

SEQ ID NO: 440240 - DNA, 25 bp, Mus musculus
tccagcccggcatgtaagtggcgct

SEQ ID NO: 440241 - DNA, 25 bp, Mus musculus
tccgcagcaagacgcacgtcgcggt

SEQ ID NO: 440242 - DNA, 25 bp, Mus musculus
cctgacagcccaaggagcgcgtggt

SEQ ID NO: 440243 - DNA, 25 bp, Mus musculus
gggctgtctctttaagcgctccgga

SEQ ID NO: 440244 - DNA, 25 bp, Mus musculus
ggaccgctggtctcactggtctcca

SEQ ID NO: 440245 - DNA, 25 bp, Mus musculus
tgtgcagctcttgggctacagtgcc

SEQ ID NO: 440246 - DNA, 25 bp, Mus musculus
ccactgctagcacgggcgctgttgc

SEQ ID NO: 440247 - DNA, 25 bp, Mus musculus
gagcgagcccggcactagcaacttc

SEQ ID NO: 440248 - DNA, 25 bp, Mus musculus
agcaacttctgcttggcgagcctaa

SEQ ID NO: 440249 - DNA, 25 bp, Mus musculus
cgagcctaacttctgagcgggcttc

SEQ ID NO: 440250 - DNA, 25 bp, Mus musculus
cgggcttcggacttgaggatcccaa

SEQ ID NO: 440251 - DNA, 25 bp, Mus musculus
ttgaggatcccaagctgcgcaccgc

SEQ ID NO: 440252 - DNA, 25 bp, Mus musculus
gtttctgcgtctgggccgctgccaa

SEQ ID NO: 440253 - DNA, 25 bp, Mus musculus
cccactgtgcttctggtgtttctgc

SEQ ID NO: 440254 - DNA, 25 bp, Mus musculus
tccggacgcctagccgagctcgaaa

SEQ ID NO: 440255 - DNA, 25 bp, Mus musculus
ctgcttcctaataacgacgtgtgcg

SEQ ID NO: 440256 - DNA, 25 bp, Mus musculus
ggtctcgcccgcataggtagccgct

SEQ ID NO: 440257 - DNA, 25 bp, Mus musculus
accgggcccgagagctgcaaacttt

SEQ ID NO: 440258 - DNA, 25 bp, Mus musculus
gggtaggtttccaaacatcacaaga

SEQ ID NO: 440259 - DNA, 25 bp, Mus musculus
agggaagggataagccacctccgca

SEQ ID NO: 440260 - DNA, 25 bp, Mus musculus
ggtgccgctcccagcaactttcagg

SEQ ID NO: 440261 - DNA, 25 bp, Mus musculus
gaaagttctctaggtgccgctccca

SEQ ID NO: 440262 - DNA, 25 bp, Mus musculus
cggggatcaatctgggaaagttctc

SEQ ID NO: 440263 - DNA, 25 bp, Mus musculus
tctgcggccctacaagatgcggcga

SEQ ID NO: 440264 - DNA, 25 bp, Mus musculus
gacttcttcggggaggcgatcccag

SEQ ID NO: 440265 - DNA, 25 bp, Mus musculus
gagctcgaaaaaccggtgcgacttc

SEQ ID NO: 440266 - DNA, 25 bp, Mus musculus
gacatcattcattctcgcactctcg

SEQ ID NO: 440267 - DNA, 25 bp, Mus musculus
gaccgcttggcgaggttagtcacca

SEQ ID NO: 440268 - DNA, 25 bp, Mus musculus
gcgcatgctcagcatctgaaggctc

SEQ ID NO: 440269 - DNA, 25 bp, Mus musculus
gctgagcaataacgcgcagaactgg

SEQ ID NO: 440270 - DNA, 25 bp, Mus musculus
ctagctggagcgcacgtcagcgcgc

SEQ ID NO: 440271 - DNA, 25 bp, Mus musculus
tctgtgcaagaaagtcaagctgagc

SEQ ID NO: 440272 - DNA, 25 bp, Mus musculus
tcctgggagtctgtgcaagaaagtc

SEQ ID NO: 440273 - DNA, 25 bp, Mus musculus
cggccatggagattcctgggagtct

SEQ ID NO: 440274 - DNA, 25 bp, Mus musculus
ggctctcagcagcagtgcatccgcg

SEQ ID NO: 440275 - DNA, 25 bp, Mus musculus
agccgaggcgatcactagctggagc

SEQ ID NO: 440276 - DNA, 25 bp, Mus musculus
ctagctccagccgaggcgatcacta

SEQ ID NO: 440277 - DNA, 25 bp, Mus musculus
acgctgctcggatgcctagctccag

SEQ ID NO: 440278 - DNA, 25 bp, Mus musculus
cctggtgattggatgttgaggtctc

SEQ ID NO: 440279 - DNA, 25 bp, Mus musculus
gtcctgggtcaaggcggagcttcaa

SEQ ID NO: 440280 - DNA, 25 bp, Mus musculus
aggctctcttcaacaaaccctcaga

SEQ ID NO: 440281 - DNA, 25 bp, Mus musculus
gcctctgcacgttccgggtgtgctt

SEQ ID NO: 440282 - DNA, 25 bp, Mus musculus
ttgggtcacgcctccttggcgagaa

SEQ ID NO: 440283 - DNA, 25 bp, Mus musculus
ccgagtgtctgatccaggaagggtt

SEQ ID NO: 440284 - DNA, 25 bp, Mus musculus
cgcggttaagggaggattccatcac

SEQ ID NO: 440285 - DNA, 25 bp, Mus musculus
cgctgatgcgggtcaaggattcatc

SEQ ID NO: 440286 - DNA, 25 bp, Mus musculus
aactgtgtctgtgaggagcccacgc

SEQ ID NO: 440287 - DNA, 25 bp, Mus musculus
tgaacaccaaacgaagccggcaggg

SEQ ID NO: 440288 - DNA, 25 bp, Mus musculus
taagttcttaagagtcccgagtgtc

SEQ ID NO: 440289 - DNA, 25 bp, Mus musculus
cttgaggcttgagactaagttctta

SEQ ID NO: 440290 - DNA, 25 bp, Mus musculus
tgcagaacttcctgcccgtcagagg

SEQ ID NO: 440291 - DNA, 25 bp, Mus musculus
ggcctttgattgcttccagggactg

SEQ ID NO: 440292 - DNA, 25 bp, Mus musculus
ctgggtctaacagcaccttgggtca

SEQ ID NO: 440293 - DNA, 25 bp, Mus musculus
caaaagcgcaaaggtgctgaacacc

SEQ ID NO: 440294 - DNA, 25 bp, Mus musculus
tcaccgcggaaaatcgtgcaaaagc

SEQ ID NO: 440295 - DNA, 25 bp, Mus musculus
tggcattcccatcttttcagggctc

SEQ ID NO: 440296 - DNA, 25 bp, Mus musculus
ggcccactaagcactgccaggcata

SEQ ID NO: 440297 - DNA, 25 bp, Mus musculus
tcaccctcgggttctgagccgggga

SEQ ID NO: 440298 - DNA, 25 bp, Mus musculus
gcgtctcggcgatgtgacgtcatga

SEQ ID NO: 440299 - DNA, 25 bp, Mus musculus
tctcggcgatgtgacgtcatgagca

SEQ ID NO: 440300 - DNA, 25 bp, Mus musculus
cgatgtgacgtcatgagcagtggcc

SEQ ID NO: 440301 - DNA, 25 bp, Mus musculus
acgtcatgagcagtggccgacccga

SEQ ID NO: 440302 - DNA, 25 bp, Mus musculus
aggtgcgcgctcaccctcgggttct

SEQ ID NO: 440303 - DNA, 25 bp, Mus musculus
aggcgtgtcgctccggctgtcacct

SEQ ID NO: 440304 - DNA, 25 bp, Mus musculus
tccctaggcggcctcttgtagacgc

SEQ ID NO: 440305 - DNA, 25 bp, Mus musculus
gcctcttgtagacgcgcctgaaatg

SEQ ID NO: 440306 - DNA, 25 bp, Mus musculus
gtagacgcgcctgaaatgcaggaca

SEQ ID NO: 440307 - DNA, 25 bp, Mus musculus
ctgaaatgcaggacacggcccacta

SEQ ID NO: 440308 - DNA, 25 bp, Mus musculus
agcactgccaggcatagcttccgcg

SEQ ID NO: 440309 - DNA, 25 bp, Mus musculus
aaatgcaggacacggcccactaagc

SEQ ID NO: 440310 - DNA, 25 bp, Mus musculus
ttgttccaagtacggtcctcgccgc

SEQ ID NO: 440311 - DNA, 25 bp, Mus musculus
cctctcagtactcatgttaagcttg

SEQ ID NO: 440312 - DNA, 25 bp, Mus musculus
gggacacagtccatcctgatcactg

SEQ ID NO: 440313 - DNA, 25 bp, Mus musculus
ccgctaggagcacagccatgccgga

SEQ ID NO: 440314 - DNA, 25 bp, Mus musculus
aagtcggcagccacctgcaggtaga

SEQ ID NO: 440315 - DNA, 25 bp, Mus musculus
ctccactcgaggtccctgagggaaa

SEQ ID NO: 440316 - DNA, 25 bp, Mus musculus
tctttctcctgagcccggagccagg

SEQ ID NO: 440317 - DNA, 25 bp, Mus musculus
acacggggcacgagcctctctttct

SEQ ID NO: 440318 - DNA, 25 bp, Mus musculus
atcactggctgtagggacgctccac

SEQ ID NO: 440319 - DNA, 25 bp, Mus musculus
cctttgtcgaatcgccgggtcacct

SEQ ID NO: 440320 - DNA, 25 bp, Mus musculus
atgttaagcttgtgtacaccgtccc

SEQ ID NO: 440321 - DNA, 25 bp, Mus musculus
agcggtgccgcgtgctacacacaca

SEQ ID NO: 440322 - DNA, 25 bp, Mus musculus
gcaagcaacagtcaggcccgccagg

SEQ ID NO: 440323 - DNA, 25 bp, Mus musculus
cctcgggtgccatttgttccaagta

SEQ ID NO: 440324 - DNA, 25 bp, Mus musculus
ccgtggaattgtccaagacctttga

SEQ ID NO: 440325 - DNA, 25 bp, Mus musculus
acctcataatttgcggggtggttgc

SEQ ID NO: 440326 - DNA, 25 bp, Mus musculus
cctgctggaggggagacctcataat

SEQ ID NO: 440327 - DNA, 25 bp, Mus musculus
ttcgaagagagctaccgggaaccga

SEQ ID NO: 440328 - DNA, 25 bp, Mus musculus
ctctcttcttaaagctggtgagggc

SEQ ID NO: 440329 - DNA, 25 bp, Mus musculus
tgttgcgggaacctttgtttctctc

SEQ ID NO: 440330 - DNA, 25 bp, Mus musculus
cctgctgtctcactcggaaacgttc

SEQ ID NO: 440331 - DNA, 25 bp, Mus musculus
gaccggaaggagtgccctacgtcac

SEQ ID NO: 440332 - DNA, 25 bp, Mus musculus
gccattcataatccggcggaccgga

SEQ ID NO: 440333 - DNA, 25 bp, Mus musculus
aagagacaacgtgtctgcgcgtccc

SEQ ID NO: 440334 - DNA, 25 bp, Mus musculus
agcgccctctttacctggtcgcagg

SEQ ID NO: 440335 - DNA, 25 bp, Mus musculus
ctgagcgctcctcctagtctggaag

SEQ ID NO: 440336 - DNA, 25 bp, Mus musculus
tgcacccacagcaaaagcctgcggt

SEQ ID NO: 440337 - DNA, 25 bp, Mus musculus
ctggcaagactctcaagggctgcga

SEQ ID NO: 440338 - DNA, 25 bp, Mus musculus
ccaaccgccctctgcagcgaccgca

SEQ ID NO: 440339 - DNA, 25 bp, Mus musculus
aagcgagtttgcctgcgaccgcgac

SEQ ID NO: 440340 - DNA, 25 bp, Mus musculus
tccgaaagcgagtttgcctgcgacc

SEQ ID NO: 440341 - DNA, 25 bp, Mus musculus
ccggggtcttcactccgaaagcgag

SEQ ID NO: 440342 - DNA, 25 bp, Mus musculus
gcctccgtacggccgcagaactttg

SEQ ID NO: 440343 - DNA, 25 bp, Mus musculus
gcgctgagctcctcccgctgacctc

SEQ ID NO: 440344 - DNA, 25 bp, Mus musculus
tcagtaagtcgttcgcccagctccg

SEQ ID NO: 440345 - DNA, 25 bp, Mus musculus
ccgcctgttcttcagtaagtcgttc

SEQ ID NO: 440346 - DNA, 25 bp, Mus musculus
ggactaccgcctgttcttcagtaag

SEQ ID NO: 440347 - DNA, 25 bp, Mus musculus
gctcgcaggactaccgcctgttctt

SEQ ID NO: 440348 - DNA, 25 bp, Mus musculus
tcatgtccctgtaccgcacggagga

SEQ ID NO: 440349 - DNA, 25 bp, Mus musculus
gcgtcatgtccctgtaccgcacgga

SEQ ID NO: 440350 - DNA, 25 bp, Mus musculus
tgcggttctcgcagaccgtccgcca

SEQ ID NO: 440351 - DNA, 25 bp, Mus musculus
gctgctaagcccatccgcctccgta

SEQ ID NO: 440352 - DNA, 25 bp, Mus musculus
cacgcacgaaagaggaggacgctcc

SEQ ID NO: 440353 - DNA, 25 bp, Mus musculus
caacccactagtcagtttggccaga

SEQ ID NO: 440354 - DNA, 25 bp, Mus musculus
agcgcgcttagctcagtgctcagtc

SEQ ID NO: 440355 - DNA, 25 bp, Mus musculus
ttaggattgctcgtacctggagcgc

SEQ ID NO: 440356 - DNA, 25 bp, Mus musculus
cgcgctttgttactggggattagga

SEQ ID NO: 440357 - DNA, 25 bp, Mus musculus
tggccagaaactccgatcgcctttc

SEQ ID NO: 440358 - DNA, 25 bp, Mus musculus
tgacgatgcacccactctacaagtt

SEQ ID NO: 440359 - DNA, 25 bp, Mus musculus
ggggcgtggcagtaaacagcaacaa

SEQ ID NO: 440360 - DNA, 25 bp, Mus musculus
tccagaaagtgagtacgcgcaagtg

SEQ ID NO: 440361 - DNA, 25 bp, Mus musculus
ctctttcgggagagaaaggcgaatc

SEQ ID NO: 440362 - DNA, 25 bp, Mus musculus
tgtctgtcacgggtagacgcgccaa

SEQ ID NO: 440363 - DNA, 25 bp, Mus musculus
ccaggcatgtgtctcatgggaaagc

SEQ ID NO: 440364 - DNA, 25 bp, Mus musculus
tgtgtccacgtgtgcaagctcgcta

SEQ ID NO: 440365 - DNA, 25 bp, Mus musculus
tgtcctagtgtgttcctcgctccag

SEQ ID NO: 440366 - DNA, 25 bp, Mus musculus
gcagccgggtctcctttctaacaaa

SEQ ID NO: 440367 - DNA, 25 bp, Mus musculus
tcgcctccgcatcaatattcataag

SEQ ID NO: 440368 - DNA, 25 bp, Mus musculus
tcagcgctctgacctggttctggtc

SEQ ID NO: 440369 - DNA, 25 bp, Mus musculus
gcttccttctgctcctctacgaaag

SEQ ID NO: 440370 - DNA, 25 bp, Mus musculus
ggttctggtccctcagcctcgcagt

SEQ ID NO: 440371 - DNA, 25 bp, Mus musculus
tcataaggcagtttgacgtctgttc

SEQ ID NO: 440372 - DNA, 25 bp, Mus musculus
taacaaatcctacagggcagccatc

SEQ ID NO: 440373 - DNA, 25 bp, Mus musculus
cccaaaggccgtgccgggagagcta

SEQ ID NO: 440374 - DNA, 25 bp, Mus musculus
ttctgtttactttggccacgtgggc

SEQ ID NO: 440375 - DNA, 25 bp, Mus musculus
ccaggcccaccttctgtttactttg

SEQ ID NO: 440376 - DNA, 25 bp, Mus musculus
aagtctccactctgcagcaatccgg

SEQ ID NO: 440377 - DNA, 25 bp, Mus musculus
ggcctgggcgctaaagtctccactc

SEQ ID NO: 440378 - DNA, 25 bp, Mus musculus
ccgcgtaggcacttggaaactctgc

SEQ ID NO: 440379 - DNA, 25 bp, Mus musculus
tttgacgtctgttctctaggctcgg

SEQ ID NO: 440380 - DNA, 25 bp, Mus musculus
aatcatcgggaggtgtccgcgccct

SEQ ID NO: 440381 - DNA, 25 bp, Mus musculus
gcgagccgggaaacgtggccgcgcc

SEQ ID NO: 440382 - DNA, 25 bp, Mus musculus
tgcacaaacacacccgcagagagcg

SEQ ID NO: 440383 - DNA, 25 bp, Mus musculus
tccaaacaattatctgccagaagaa

SEQ ID NO: 440384 - DNA, 25 bp, Mus musculus
aaaaagcaaatccttcgccgcgccg

SEQ ID NO: 440385 - DNA, 25 bp, Mus musculus
tccatcccttccaaacaattatctg

SEQ ID NO: 440386 - DNA, 25 bp, Mus musculus
aacgccctctcttccatcccttcca

SEQ ID NO: 440387 - DNA, 25 bp, Mus musculus
cgtgcacaaacacacccgcagagag

SEQ ID NO: 440388 - DNA, 25 bp, Mus musculus
cgccggcgagctggggatttgtgaa

SEQ ID NO: 440389 - DNA, 25 bp, Mus musculus
atttgtgaaaaggagcgctggcccg

SEQ ID NO: 440390 - DNA, 25 bp, Mus musculus
gtgcgcctcttgttccccgtgtaat

SEQ ID NO: 440391 - DNA, 25 bp, Mus musculus
cccgtgtaatttgcagccaatcatc

SEQ ID NO: 440392 - DNA, 25 bp, Mus musculus
taatttgcagccaatcatcgggagg

SEQ ID NO: 440393 - DNA, 25 bp, Mus musculus
tgcagccaatcatcgggaggtgtcc

SEQ ID NO: 440394 - DNA, 25 bp, Mus musculus
aatcgcgctctggtcgctggcctat

SEQ ID NO: 440395 - DNA, 25 bp, Mus musculus
ggtggcagtcttcggaaacctcatc

SEQ ID NO: 440396 - DNA, 25 bp, Mus musculus
gcgtggggtcccatacagggaatct

SEQ ID NO: 440397 - DNA, 25 bp, Mus musculus
atacagggaatctgagcgctgcgct

SEQ ID NO: 440398 - DNA, 25 bp, Mus musculus
cgctgggcttgccagtgacatccca

SEQ ID NO: 440399 - DNA, 25 bp, Mus musculus
ttgccagtgacatcccaggcacctt

SEQ ID NO: 440400 - DNA, 25 bp, Mus musculus
agtccgggccaacctgacgaaccag

SEQ ID NO: 440401 - DNA, 25 bp, Mus musculus
gaaccagttcgtgcagccctcctgg

SEQ ID NO: 440402 - DNA, 25 bp, Mus musculus
cggaaacctcatcgttatttggatc

SEQ ID NO: 440403 - DNA, 25 bp, Mus musculus
gttatttggatcatcttggcccaca

SEQ ID NO: 440404 - DNA, 25 bp, Mus musculus
cttggcccacaagcgcatgaggacc

SEQ ID NO: 440405 - DNA, 25 bp, Mus musculus
cgcatgaggaccgtcaccaactatt

SEQ ID NO: 440406 - DNA, 25 bp, Mus musculus
caccaactatttcctggtaaacctg

SEQ ID NO: 440407 - DNA, 25 bp, Mus musculus
tggtaaacctggctttctccgacgc

SEQ ID NO: 440408 - DNA, 25 bp, Mus musculus
tcgccgggcgttacgttgcattccc

SEQ ID NO: 440409 - DNA, 25 bp, Mus musculus
cacctgccgagtgactctgcggagc

SEQ ID NO: 440410 - DNA, 25 bp, Mus musculus
ggggacttcactggggcaaacatac

SEQ ID NO: 440411 - DNA, 25 bp, Mus musculus
tcgagattcctcaagtccaagtgtg

SEQ ID NO: 440412 - DNA, 25 bp, Mus musculus
gcctccagccctaaattccaatgtg

SEQ ID NO: 440413 - DNA, 25 bp, Mus musculus
gtcctttcccgaagcagctctgatg

SEQ ID NO: 440414 - DNA, 25 bp, Mus musculus
tggctggagcactggaaagacgccc

SEQ ID NO: 440415 - DNA, 25 bp, Mus musculus
agcagctctgatgtccgagggagta

SEQ ID NO: 440416 - DNA, 25 bp, Mus musculus
cccttcaacgctgggcagaagcatt

SEQ ID NO: 440417 - DNA, 25 bp, Mus musculus
cagactcctactagtccctgctaag

SEQ ID NO: 440418 - DNA, 25 bp, Mus musculus
ggagtgtcacccaagccttccctga

SEQ ID NO: 440419 - DNA, 25 bp, Mus musculus
cggctgcacccagaaagagaacggc

SEQ ID NO: 440420 - DNA, 25 bp, Mus musculus
ctcctggccttacggagcagcgttc

SEQ ID NO: 440421 - DNA, 25 bp, Mus musculus
cctatctttagtctctctggtccga

SEQ ID NO: 440422 - DNA, 25 bp, Mus musculus
tagttctgctcaggggacactgccg

SEQ ID NO: 440423 - DNA, 25 bp, Mus musculus
aggcttcagtggctgtctgtgttcg

SEQ ID NO: 440424 - DNA, 25 bp, Mus musculus
tccgactgcgcgtagttctgctcag

SEQ ID NO: 440425 - DNA, 25 bp, Mus musculus
cgaaaacacggtccgactgcgcgta

SEQ ID NO: 440426 - DNA, 25 bp, Mus musculus
cgacacccgggtgcaggactccgtt

SEQ ID NO: 440427 - DNA, 25 bp, Mus musculus
cccttagtctgcagcggacaggatg

SEQ ID NO: 440428 - DNA, 25 bp, Mus musculus
tcggcgccgttgctctccttcgttt

SEQ ID NO: 440429 - DNA, 25 bp, Mus musculus
ccgctgcaaccttgaggacatttta

SEQ ID NO: 440430 - DNA, 25 bp, Mus musculus
acccaatccgctgcaaccttgagga

SEQ ID NO: 440431 - DNA, 25 bp, Mus musculus
cgtcatgacgctgcgccacccaatc

SEQ ID NO: 440432 - DNA, 25 bp, Mus musculus
ccgcagcacttggactgtcccgtga

SEQ ID NO: 440433 - DNA, 25 bp, Mus musculus
gcacttggactgtcccgtgacgtca

SEQ ID NO: 440434 - DNA, 25 bp, Mus musculus
gacactgccgtcctcgcctgatgga

SEQ ID NO: 440435 - DNA, 25 bp, Mus musculus
gctctccttcgtttcccttagtctg

SEQ ID NO: 440436 - DNA, 25 bp, Mus musculus
tgcgggccacgctgtccaggaccat

SEQ ID NO: 440437 - DNA, 25 bp, Mus musculus
acccttgacgtctgcggaagcgggt

SEQ ID NO: 440438 - DNA, 25 bp, Mus musculus
gctttcgacccttgacgtctgcgga

SEQ ID NO: 440439 - DNA, 25 bp, Mus musculus
gtccgctttcgacccttgacgtctg

SEQ ID NO: 440440 - DNA, 25 bp, Mus musculus
gagcccggcctgtcctcggctcggc

SEQ ID NO: 440441 - DNA, 25 bp, Mus musculus
cccagcgtacggagcccggcctgtc

SEQ ID NO: 440442 - DNA, 25 bp, Mus musculus
gtccaggaccatcctgccgccggcg

SEQ ID NO: 440443 - DNA, 25 bp, Mus musculus
agctgcaccttcacgatgcgggcca

SEQ ID NO: 440444 - DNA, 25 bp, Mus musculus
gcgggcagctgcaccttcacgatgc

SEQ ID NO: 440445 - DNA, 25 bp, Mus musculus
gagctgcttgaggtaggcgggcagc

SEQ ID NO: 440446 - DNA, 25 bp, Mus musculus
gaacccggtgatgctgtcggggacc

SEQ ID NO: 440447 - DNA, 25 bp, Mus musculus
gagggttacctgtgaggcgggcgaa

SEQ ID NO: 440448 - DNA, 25 bp, Mus musculus
ttcgacccttgacgtctgcggaagc

SEQ ID NO: 440449 - DNA, 25 bp, Mus musculus
ctgcgcttgcgtgagagcggaagcg

SEQ ID NO: 440450 - DNA, 25 bp, Mus musculus
tgctgttccgacagggagacggcaa

SEQ ID NO: 440451 - DNA, 25 bp, Mus musculus
tgtcaggggcgacccagaacagccc

SEQ ID NO: 440452 - DNA, 25 bp, Mus musculus
ccctctgtacgcgtgggtgtggaca

SEQ ID NO: 440453 - DNA, 25 bp, Mus musculus
agagcggacatcttgtggctgtgcc

SEQ ID NO: 440454 - DNA, 25 bp, Mus musculus
gcccgagcgagggaagcaaaccgct

SEQ ID NO: 440455 - DNA, 25 bp, Mus musculus
cgctttagcgagaaggtgctgttcc

SEQ ID NO: 440456 - DNA, 25 bp, Mus musculus
ccgacctccgatcgctttagcgaga

SEQ ID NO: 440457 - DNA, 25 bp, Mus musculus
tctctgaatttaagggtttccgcca

SEQ ID NO: 440458 - DNA, 25 bp, Mus musculus
ccggttctcgatgcttctctgaatt

SEQ ID NO: 440459 - DNA, 25 bp, Mus musculus
taaggtctccttccggttctcgatg

SEQ ID NO: 440460 - DNA, 25 bp, Mus musculus
ctccatcccaagtgaggaaacgggg

SEQ ID NO: 440461 - DNA, 25 bp, Mus musculus
tgccacgaggttctcgcgagatccg

SEQ ID NO: 440462 - DNA, 25 bp, Mus musculus
tgctgcgagcctgccacgaggttct

SEQ ID NO: 440463 - DNA, 25 bp, Mus musculus
cagctggcagtagttccgtcagagc

SEQ ID NO: 440464 - DNA, 25 bp, Mus musculus
caacgggaatggctccctggagcta

SEQ ID NO: 440465 - DNA, 25 bp, Mus musculus
cgcgtattgagggagcgttcagcct

SEQ ID NO: 440466 - DNA, 25 bp, Mus musculus
gcgttcagcctgacaaatcctgggg

SEQ ID NO: 440467 - DNA, 25 bp, Mus musculus
atgtacaatctgctggtcaggcgtg

SEQ ID NO: 440468 - DNA, 25 bp, Mus musculus
ccgggcagagcctgcgtactattgt

SEQ ID NO: 440469 - DNA, 25 bp, Mus musculus
tactattgtggacgcgcacctgtcg

SEQ ID NO: 440470 - DNA, 25 bp, Mus musculus
gcacctgtcgtctcccaaatggtca

SEQ ID NO: 440471 - DNA, 25 bp, Mus musculus
tctgtcgcttttcatcattcggatg

SEQ ID NO: 440472 - DNA, 25 bp, Mus musculus
cccacttacaggatcgagctggagc

SEQ ID NO: 440473 - DNA, 25 bp, Mus musculus
agaagcccagctcacaggtcgcaga

SEQ ID NO: 440474 - DNA, 25 bp, Mus musculus
cagcgtccaggccttggcaaggctt

SEQ ID NO: 440475 - DNA, 25 bp, Mus musculus
tgcgagcggtcagcatgcatcttca

SEQ ID NO: 440476 - DNA, 25 bp, Mus musculus
gtggcaggtcctagctacagcctga

SEQ ID NO: 440477 - DNA, 25 bp, Mus musculus
ctgctcttgatattggcgctatttc

SEQ ID NO: 440478 - DNA, 25 bp, Mus musculus
tgcgctgctagaaccggcccgcgag

SEQ ID NO: 440479 - DNA, 25 bp, Mus musculus
gagcttcgagccagtgggacccgct

SEQ ID NO: 440480 - DNA, 25 bp, Mus musculus
gccgcccagtgcggatgtgcccttt

SEQ ID NO: 440481 - DNA, 25 bp, Mus musculus
gcccagtgcggatgtgccctttccc

SEQ ID NO: 440482 - DNA, 25 bp, Mus musculus
cagccggggccgctcgatccgcgac

SEQ ID NO: 440483 - DNA, 25 bp, Mus musculus
gctcgatccgcgactcctgcttggg

SEQ ID NO: 440484 - DNA, 25 bp, Mus musculus
atccgcgactcctgcttggggctct

SEQ ID NO: 440485 - DNA, 25 bp, Mus musculus
cttcgagccagtgggacccgctgca

SEQ ID NO: 440486 - DNA, 25 bp, Mus musculus
gagccagtgggacccgctgcaccgt

SEQ ID NO: 440487 - DNA, 25 bp, Mus musculus
ccgctgcaccgtggtgcggagagct

SEQ ID NO: 440488 - DNA, 25 bp, Mus musculus
agagctggcggctccgttcctctac

SEQ ID NO: 440489 - DNA, 25 bp, Mus musculus
ggcggctccgttcctctacctgccc

SEQ ID NO: 440490 - DNA, 25 bp, Mus musculus
gggcttaccctggagatgcggcgcg

SEQ ID NO: 440491 - DNA, 25 bp, Mus musculus
tgccccggggcttaccctggagatg

SEQ ID NO: 440492 - DNA, 25 bp, Mus musculus
tcggagggaccggagctcgccttca

SEQ ID NO: 440493 - DNA, 25 bp, Mus musculus
gtctcgctaactgggccaggcagtg

SEQ ID NO: 440494 - DNA, 25 bp, Mus musculus
cagtgacgcgggaccggcgcaccct

SEQ ID NO: 440495 - DNA, 25 bp, Mus musculus
taacggcactgacaccggggcaccg

SEQ ID NO: 440496 - DNA, 25 bp, Mus musculus
gcgcgggtccctgcatcagctagct

SEQ ID NO: 440497 - DNA, 25 bp, Mus musculus
ggtccctgcatcagctagctccgga

SEQ ID NO: 440498 - DNA, 25 bp, Mus musculus
ggagctgcgcgctccacgatggctc

SEQ ID NO: 440499 - DNA, 25 bp, Mus musculus
accggagctcgccttcagtgaggat

SEQ ID NO: 440500 - DNA, 25 bp, Mus musculus
agctcgccttcagtgaggatgtgct

SEQ ID NO: 440501 - DNA, 25 bp, Mus musculus
cgccttcagtgaggatgtgctgagc

SEQ ID NO: 440502 - DNA, 25 bp, Mus musculus
atgtgctgagcgtgttcggcgccaa

SEQ ID NO: 440503 - DNA, 25 bp, Mus musculus
tgctgagcgtgttcggcgccaaccg

SEQ ID NO: 440504 - DNA, 25 bp, Mus musculus
caaccggagcctgtcggccgcgcag

SEQ ID NO: 440505 - DNA, 25 bp, Mus musculus
tgcatcagctagctccggagctgcg

SEQ ID NO: 440506 - DNA, 25 bp, Mus musculus
acggtgccaagcacgtctgtctctg

SEQ ID NO: 440507 - DNA, 25 bp, Mus musculus
cgcagaagcgaaggcgggaatccca

SEQ ID NO: 440508 - DNA, 25 bp, Mus musculus
actgctcagagcgacaggcacagcc

SEQ ID NO: 440509 - DNA, 25 bp, Mus musculus
tcccaatgcggaaatgtccctactg

SEQ ID NO: 440510 - DNA, 25 bp, Mus musculus
taaggacctggccaatgagacacgc

SEQ ID NO: 440511 - DNA, 25 bp, Mus musculus
gtcacacgcaaacacctggagcctg

SEQ ID NO: 440512 - DNA, 25 bp, Mus musculus
ggggcaacgcaaccttttctccagc

SEQ ID NO: 440513 - DNA, 25 bp, Mus musculus
tccagcccataaatagccgggactc

SEQ ID NO: 440514 - DNA, 25 bp, Mus musculus
gggactcggagatgctgcgaattcc

SEQ ID NO: 440515 - DNA, 25 bp, Mus musculus
tgcgaattccgcactcgggcagaca

SEQ ID NO: 440516 - DNA, 25 bp, Mus musculus
cttcctattccctcgagggctgaga

SEQ ID NO: 440517 - DNA, 25 bp, Mus musculus
ctggaatcaggtctcgcacgctgca

SEQ ID NO: 440518 - DNA, 25 bp, Mus musculus
tttcatcaatggagaggcggaccta

SEQ ID NO: 440519 - DNA, 25 bp, Mus musculus
agtccggagccgaagtttgcctaag

SEQ ID NO: 440520 - DNA, 25 bp, Mus musculus
tggagatgtccgagcccaaggcgat

SEQ ID NO: 440521 - DNA, 25 bp, Mus musculus
cggggaccttctaggatctcctgca

SEQ ID NO: 440522 - DNA, 25 bp, Mus musculus
actgtgtccaccgagctcagcggct

SEQ ID NO: 440523 - DNA, 25 bp, Mus musculus
atctcctgcaagaggcgatcccttc

SEQ ID NO: 440524 - DNA, 25 bp, Mus musculus
ccaaggcgattgatcccaagttgtc

SEQ ID NO: 440525 - DNA, 25 bp, Mus musculus
cccagagctccagccgagcggtttg

SEQ ID NO: 440526 - DNA, 25 bp, Mus musculus
gcagtaactttcgagccagcccaga

SEQ ID NO: 440527 - DNA, 25 bp, Mus musculus
taaataaccagcacacacgcgcagc

SEQ ID NO: 440528 - DNA, 25 bp, Mus musculus
ccgggaggcgtgctcagaaaataaa

SEQ ID NO: 440529 - DNA, 25 bp, Mus musculus
gggtgctcgcgtgtgcttctcctcc

SEQ ID NO: 440530 - DNA, 25 bp, Mus musculus
atcggtcttaatcccgaccgtgtgc

SEQ ID NO: 440531 - DNA, 25 bp, Mus musculus
cccatgtgatcggtcttaatcccga

SEQ ID NO: 440532 - DNA, 25 bp, Mus musculus
agctcagcggctgttgcctgtgcgt

SEQ ID NO: 440533 - DNA, 25 bp, Mus musculus
tcccaagttgtcgacgaccgacagg

SEQ ID NO: 440534 - DNA, 25 bp, Mus musculus
tgaaatccggcaggtgagcgacccg

SEQ ID NO: 440535 - DNA, 25 bp, Mus musculus
tgcaggggaccactgtccaagcttc

SEQ ID NO: 440536 - DNA, 25 bp, Mus musculus
aggcgggacctataaagcgctctcc

SEQ ID NO: 440537 - DNA, 25 bp, Mus musculus
cgggacctataaagcgctctccatt

SEQ ID NO: 440538 - DNA, 25 bp, Mus musculus
aagcgctctccattcgggaggcgga

SEQ ID NO: 440539 - DNA, 25 bp, Mus musculus
agccttcggcttgctgcaggactgt

SEQ ID NO: 440540 - DNA, 25 bp, Mus musculus
gactgtgcaggggaccactgtccaa

SEQ ID NO: 440541 - DNA, 25 bp, Mus musculus
ggaccactgtccaagcttcggacta

SEQ ID NO: 440542 - DNA, 25 bp, Mus musculus
tccaagcttcggactactgaggggc

SEQ ID NO: 440543 - DNA, 25 bp, Mus musculus
cttcggactactgaggggcgcctgc

SEQ ID NO: 440544 - DNA, 25 bp, Mus musculus
tgcctcggtttacccttcagcgtct

SEQ ID NO: 440545 - DNA, 25 bp, Mus musculus
cggtttacccttcagcgtctggtga

SEQ ID NO: 440546 - DNA, 25 bp, Mus musculus
ttacccttcagcgtctggtgaaatc

SEQ ID NO: 440547 - DNA, 25 bp, Mus musculus
cttcagcgtctggtgaaatccggca

SEQ ID NO: 440548 - DNA, 25 bp, Mus musculus
ccgagatggtaacgtgaagagtgac

SEQ ID NO: 440549 - DNA, 25 bp, Mus musculus
tgggtgttccatcttagcatgagtg

SEQ ID NO: 440550 - DNA, 25 bp, Mus musculus
actccgctgtgcgttctcccattgg

SEQ ID NO: 440551 - DNA, 25 bp, Mus musculus
ccggatgagggaacattctgcagta

SEQ ID NO: 440552 - DNA, 25 bp, Mus musculus
tcacatgtgtgttaactggcggggc

SEQ ID NO: 440553 - DNA, 25 bp, Mus musculus
atgagtgatgtgtcgcgacttggcc

SEQ ID NO: 440554 - DNA, 25 bp, Mus musculus
tgcttgtttgtctgcaccctccatg

SEQ ID NO: 440555 - DNA, 25 bp, Mus musculus
gtgaccgggcctttatgtttgcacc

SEQ ID NO: 440556 - DNA, 25 bp, Mus musculus
tagcaactgccgcagtcgggtgacc

SEQ ID NO: 440557 - DNA, 25 bp, Mus musculus
ggtaattctatcttctccgtccctc

SEQ ID NO: 440558 - DNA, 25 bp, Mus musculus
gcgcgccgccttggtaattctatct

SEQ ID NO: 440559 - DNA, 25 bp, Mus musculus
ttctgcagtataaagggcgcgagga

SEQ ID NO: 440560 - DNA, 25 bp, Mus musculus
ctcccattggctggagcctcaagga

SEQ ID NO: 440561 - DNA, 25 bp, Mus musculus
ccctgcggagacagtgaatactggg

SEQ ID NO: 440562 - DNA, 25 bp, Mus musculus
ctccagaaggccgagaagctgtacc

SEQ ID NO: 440563 - DNA, 25 bp, Mus musculus
agatcgctcgcgaggccctgagcgc

SEQ ID NO: 440564 - DNA, 25 bp, Mus musculus
ctccgggccacaccggagcctaggg

SEQ ID NO: 440565 - DNA, 25 bp, Mus musculus
gccggcaaccgcgacaaggcccagc

SEQ ID NO: 440566 - DNA, 25 bp, Mus musculus
ccagaaggccgagaagctgtacccg

SEQ ID NO: 440567 - DNA, 25 bp, Mus musculus
ctgagcgccggcaaccgcgacaagg

SEQ ID NO: 440568 - DNA, 25 bp, Mus musculus
atgcgtgcagatcgctcgcgaggcc

SEQ ID NO: 440569 - DNA, 25 bp, Mus musculus
agaaatgcgtgcagatcgctcgcga

SEQ ID NO: 440570 - DNA, 25 bp, Mus musculus
gcggagaaatgcgtgcagatcgctc

SEQ ID NO: 440571 - DNA, 25 bp, Mus musculus
caaccgcgacgaggcggagaaatgc

SEQ ID NO: 440572 - DNA, 25 bp, Mus musculus
cgcgagccatggagggcaaccgcga

SEQ ID NO: 440573 - DNA, 25 bp, Mus musculus
cgcgtcggctttacggtccgccagg

SEQ ID NO: 440574 - DNA, 25 bp, Mus musculus
cgcgctccgccaacccacggcctcc

SEQ ID NO: 440575 - DNA, 25 bp, Mus musculus
aaggcccagcgcttcctccagaagg

SEQ ID NO: 440576 - DNA, 25 bp, Mus musculus
aagctcctgtacgaagggccacgga

SEQ ID NO: 440577 - DNA, 25 bp, Mus musculus
ctaggctttcgcgtaccgtgcatct

SEQ ID NO: 440578 - DNA, 25 bp, Mus musculus
tcgagacagaacacacggaagcttt

SEQ ID NO: 440579 - DNA, 25 bp, Mus musculus
tgcctcagcccgttatacgaaaagg

SEQ ID NO: 440580 - DNA, 25 bp, Mus musculus
cgccagtccggcttggccttgaata

SEQ ID NO: 440581 - DNA, 25 bp, Mus musculus
tacgaagctactggcggggaaatcc

SEQ ID NO: 440582 - DNA, 25 bp, Mus musculus
tgcagcgcagccgtaatcgcgtaaa

SEQ ID NO: 440583 - DNA, 25 bp, Mus musculus
caggccggtcaaaagcaagcacata

SEQ ID NO: 440584 - DNA, 25 bp, Mus musculus
cataaggttcgatcagcggctggcc

SEQ ID NO: 440585 - DNA, 25 bp, Mus musculus
gctggttttaaatcgtcactgcatc

SEQ ID NO: 440586 - DNA, 25 bp, Mus musculus
tagtccgctgacaactggccctcga

SEQ ID NO: 440587 - DNA, 25 bp, Mus musculus
ggagacacgcgtacattcacacact

SEQ ID NO: 440588 - DNA, 25 bp, Mus musculus
gccagctcggaatgataacgggttc

SEQ ID NO: 440589 - DNA, 25 bp, Mus musculus
acgcacactttcgtgggtttcggca

SEQ ID NO: 440590 - DNA, 25 bp, Mus musculus
tgcttcctggatcccgcggaggtca

SEQ ID NO: 440591 - DNA, 25 bp, Mus musculus
tgcgtctgcagaggtcgccgctcct

SEQ ID NO: 440592 - DNA, 25 bp, Mus musculus
acaccggggcaggtcttcccaggct

SEQ ID NO: 440593 - DNA, 25 bp, Mus musculus
actgaactgcgggaacaccggggca

SEQ ID NO: 440594 - DNA, 25 bp, Mus musculus
agaggcgactgaactgcgggaacac

SEQ ID NO: 440595 - DNA, 25 bp, Mus musculus
gcggcttcagagaggcgactgaact

SEQ ID NO: 440596 - DNA, 25 bp, Mus musculus
cagcgacttgacaggcggcttcaga

SEQ ID NO: 440597 - DNA, 25 bp, Mus musculus
atgtgacagcgacttgacaggcggc

SEQ ID NO: 440598 - DNA, 25 bp, Mus musculus
tgcagcaagtgcttcctggatcccg

SEQ ID NO: 440599 - DNA, 25 bp, Mus musculus
cccgcggaggtcacgagtaatgtga

SEQ ID NO: 440600 - DNA, 25 bp, Mus musculus
agaggtcgccgctcctctcagctcg

SEQ ID NO: 440601 - DNA, 25 bp, Mus musculus
caagtgcttcctggatcccgcggag

SEQ ID NO: 440602 - DNA, 25 bp, Mus musculus
cacgagtaatgtgacagcgacttga

SEQ ID NO: 440603 - DNA, 25 bp, Mus musculus
gtcccggtactggagggtgcagcaa

SEQ ID NO: 440604 - DNA, 25 bp, Mus musculus
tgccaaaggagcgtgagctacccta

SEQ ID NO: 440605 - DNA, 25 bp, Mus musculus
tctccggtttggagttagcgcagtc

SEQ ID NO: 440606 - DNA, 25 bp, Mus musculus
tgcaacgcttgaccgggaaaaacgc

SEQ ID NO: 440607 - DNA, 25 bp, Mus musculus
cctgtgggtagaaatgcaacgcttg

SEQ ID NO: 440608 - DNA, 25 bp, Mus musculus
agacccgagcttacacaggcctgtg

SEQ ID NO: 440609 - DNA, 25 bp, Mus musculus
gcgtggagccgagaacacttcagaa

SEQ ID NO: 440610 - DNA, 25 bp, Mus musculus
ttcaatttctttcagtggggcgatc

SEQ ID NO: 440611 - DNA, 25 bp, Mus musculus
gtccctaccggaagtgtggcagaaa

SEQ ID NO: 440612 - DNA, 25 bp, Mus musculus
gcgcagtccgatgacgtaagccgta

SEQ ID NO: 440613 - DNA, 25 bp, Mus musculus
cgctgcaaccaaggcttccggagta

SEQ ID NO: 440614 - DNA, 25 bp, Mus musculus
gtctcagggtagcttgtcgcaacgc

SEQ ID NO: 440615 - DNA, 25 bp, Mus musculus
cccgcggcacggtaaatatggcact

SEQ ID NO: 440616 - DNA, 25 bp, Mus musculus
ctgcccgttggtatcctttcggatg

SEQ ID NO: 440617 - DNA, 25 bp, Mus musculus
cgtgccgtcttccagagtcgtgatt

SEQ ID NO: 440618 - DNA, 25 bp, Mus musculus
ccacagagatgctttgcaggggctc

SEQ ID NO: 440619 - DNA, 25 bp, Mus musculus
tcacgcgggacggaagaacttgccc

SEQ ID NO: 440620 - DNA, 25 bp, Mus musculus
actagcggccatggcgaaccaggta

SEQ ID NO: 440621 - DNA, 25 bp, Mus musculus
tgaaccttagcgctcgatcccgaac

SEQ ID NO: 440622 - DNA, 25 bp, Mus musculus
gttccgctacactcgtgaaccttag

SEQ ID NO: 440623 - DNA, 25 bp, Mus musculus
cgaaactcaggctccgaaacgcggg

SEQ ID NO: 440624 - DNA, 25 bp, Mus musculus
agccagcctggaataaagcgcttca

SEQ ID NO: 440625 - DNA, 25 bp, Mus musculus
cccgggttgcaggatcagatttgga

SEQ ID NO: 440626 - DNA, 25 bp, Mus musculus
cgctatatttctctcacgtctaacg

SEQ ID NO: 440627 - DNA, 25 bp, Mus musculus
gtgctttcccacacgtgttaccaca

SEQ ID NO: 440628 - DNA, 25 bp, Mus musculus
ggcttgttctacacgtgctttccca

SEQ ID NO: 440629 - DNA, 25 bp, Mus musculus
cccgcaaatcagtagctcgctagct

SEQ ID NO: 440630 - DNA, 25 bp, Mus musculus
gctagcgcatgcaacccgcaaatca

SEQ ID NO: 440631 - DNA, 25 bp, Mus musculus
caacggagcgcagtagccgaaactc

SEQ ID NO: 440632 - DNA, 25 bp, Mus musculus
tcgcttccgtctccgtccgggattg

SEQ ID NO: 440633 - DNA, 25 bp, Mus musculus
tccgtccgggattgcagagacaccg

SEQ ID NO: 440634 - DNA, 25 bp, Mus musculus
cgtggattcctcagtttggttcgcc

SEQ ID NO: 440635 - DNA, 25 bp, Mus musculus
tcattcactcgcaggtggttgggaa

SEQ ID NO: 440636 - DNA, 25 bp, Mus musculus
cggtgtttcattcactcgcaggtgg

SEQ ID NO: 440637 - DNA, 25 bp, Mus musculus
ttcttgagccttcggtgtttcattc

SEQ ID NO: 440638 - DNA, 25 bp, Mus musculus
cccgagcgtgaaattcttgagcctt

SEQ ID NO: 440639 - DNA, 25 bp, Mus musculus
tggggtcagcggagatcctacaccc

SEQ ID NO: 440640 - DNA, 25 bp, Mus musculus
agctccgatggcaggcctaggcgcc

SEQ ID NO: 440641 - DNA, 25 bp, Mus musculus
gacactggagcttggcctcgctgct

SEQ ID NO: 440642 - DNA, 25 bp, Mus musculus
ctggatgcccagcttgatgcaggtg

SEQ ID NO: 440643 - DNA, 25 bp, Mus musculus
gcagaagtacgagccctggatgccc

SEQ ID NO: 440644 - DNA, 25 bp, Mus musculus
gaggtcttgggctaccggctcccgc

SEQ ID NO: 440645 - DNA, 25 bp, Mus musculus
tacctgcgagcagaagtacgagccc

SEQ ID NO: 440646 - DNA, 25 bp, Mus musculus
aggagcgaggcctacagatcgccgc

SEQ ID NO: 440647 - DNA, 25 bp, Mus musculus
cagggactcccgcaggacggcgtta

SEQ ID NO: 440648 - DNA, 25 bp, Mus musculus
aggtggggatcacattgtcctggcc

SEQ ID NO: 440649 - DNA, 25 bp, Mus musculus
ctggccggagacctgcatttcacac

SEQ ID NO: 440650 - DNA, 25 bp, Mus musculus
gaaccggtgagtattgccttcggcc

SEQ ID NO: 440651 - DNA, 25 bp, Mus musculus
ctaagatggcgactgtggaaccggt

SEQ ID NO: 440652 - DNA, 25 bp, Mus musculus
ttcaggagcggttgtgcgatcagat

SEQ ID NO: 440653 - DNA, 25 bp, Mus musculus
ggccaatccggtttgaatctcattt

SEQ ID NO: 440654 - DNA, 25 bp, Mus musculus
ggagccggccaatccggtttgaatc

SEQ ID NO: 440655 - DNA, 25 bp, Mus musculus
acacgtccgtcacgtgggcaggagc

SEQ ID NO: 440656 - DNA, 25 bp, Mus musculus
gccgctagggccaaacggacacgtc

SEQ ID NO: 440657 - DNA, 25 bp, Mus musculus
tgcgatcagatcgatctaagatggc

SEQ ID NO: 440658 - DNA, 25 bp, Mus musculus
catgctcaggggtcgtgtcgcgcac

SEQ ID NO: 440659 - DNA, 25 bp, Mus musculus
agcagctgcagtcttgcgcaggcgc

SEQ ID NO: 440660 - DNA, 25 bp, Mus musculus
gcgccaccttaggagctgtccagtg

SEQ ID NO: 440661 - DNA, 25 bp, Mus musculus
agtatctcagaactctggtcccggg

SEQ ID NO: 440662 - DNA, 25 bp, Mus musculus
gatcccgggctacgagtatctcaga

SEQ ID NO: 440663 - DNA, 25 bp, Mus musculus
tcacaagacaggtgatcccgggcta

SEQ ID NO: 440664 - DNA, 25 bp, Mus musculus
tcccagcatcttttgagtcacaaga

SEQ ID NO: 440665 - DNA, 25 bp, Mus musculus
tcaaaatcttgtgtggctcccagca

SEQ ID NO: 440666 - DNA, 25 bp, Mus musculus
cctctactagcctcaaaatcttgtg

SEQ ID NO: 440667 - DNA, 25 bp, Mus musculus
cgcgatgcgcacgtatttccctcta

SEQ ID NO: 440668 - DNA, 25 bp, Mus musculus
gcagctgatcctccggaacgcgatg

SEQ ID NO: 440669 - DNA, 25 bp, Mus musculus
gtaccgcagcgcgacgcagctgatc

SEQ ID NO: 440670 - DNA, 25 bp, Mus musculus
ggaatctttcgcagtgaagggtctg

SEQ ID NO: 440671 - DNA, 25 bp, Mus musculus
ctgtccagtgctgaccacggatgcc

SEQ ID NO: 440672 - DNA, 25 bp, Mus musculus
ccgggtgcacaacagaggcgattcc

SEQ ID NO: 440673 - DNA, 25 bp, Mus musculus
ccctgctgaactctggaatctttcg

SEQ ID NO: 440674 - DNA, 25 bp, Mus musculus
ggagctcccgctttgtgctccgtgc

SEQ ID NO: 440675 - DNA, 25 bp, Mus musculus
ggggagagaaacacttcatcctttc

SEQ ID NO: 440676 - DNA, 25 bp, Mus musculus
cgtggtcgctgctttacttttcgcc

SEQ ID NO: 440677 - DNA, 25 bp, Mus musculus
tattttgggtaagttggagcgctcc

SEQ ID NO: 440678 - DNA, 25 bp, Mus musculus
gtcctgaagtcagttgttgcatcaa

SEQ ID NO: 440679 - DNA, 25 bp, Mus musculus
ccgggaagcactacaagggtcctga

SEQ ID NO: 440680 - DNA, 25 bp, Mus musculus
caagtgtcttcatgaacccagagga

SEQ ID NO: 440681 - DNA, 25 bp, Mus musculus
tttgagaaacgagggagcacacgga

SEQ ID NO: 440682 - DNA, 25 bp, Mus musculus
aggacggctcggcagtttgagaaac

SEQ ID NO: 440683 - DNA, 25 bp, Mus musculus
cccagaggatgtccgggaagcacta

SEQ ID NO: 440684 - DNA, 25 bp, Mus musculus
tgcttcccgtgggatctggatgttg

SEQ ID NO: 440685 - DNA, 25 bp, Mus musculus
tcataatggggcaggctaatcgggc

SEQ ID NO: 440686 - DNA, 25 bp, Mus musculus
gcgagaggcgtctaccttccgcctt

SEQ ID NO: 440687 - DNA, 25 bp, Mus musculus
gcacacggattagatttgcttcccg

SEQ ID NO: 440688 - DNA, 25 bp, Mus musculus
ccagggcgcatcaggctgtcctgcg

SEQ ID NO: 440689 - DNA, 25 bp, Mus musculus
tttgcaggagagatgcactgccacc

SEQ ID NO: 440690 - DNA, 25 bp, Mus musculus
gagagatgcactgccaccctgcagc

SEQ ID NO: 440691 - DNA, 25 bp, Mus musculus
ggagaaaagaaaatgtcaggcgatg

SEQ ID NO: 440692 - DNA, 25 bp, Mus musculus
aaatgtcaggcgatgacggccggca

SEQ ID NO: 440693 - DNA, 25 bp, Mus musculus
acggccggcaggactcacccatgtt

SEQ ID NO: 440694 - DNA, 25 bp, Mus musculus
acccatgttcctcccacagagtgag

SEQ ID NO: 440695 - DNA, 25 bp, Mus musculus
ctcccacagagtgaggaccggcagg

SEQ ID NO: 440696 - DNA, 25 bp, Mus musculus
tcagtgcggccagtgctgcctcctg

SEQ ID NO: 440697 - DNA, 25 bp, Mus musculus
ctgtgcgtctacagaccggagcggt

SEQ ID NO: 440698 - DNA, 25 bp, Mus musculus
tctacagaccggagcggtacagctc

SEQ ID NO: 440699 - DNA, 25 bp, Mus musculus
cggtacagctcggtggctgttgctc

SEQ ID NO: 440700 - DNA, 25 bp, Mus musculus
cccggcaagtttgcaggagagatgc

SEQ ID NO: 440701 - DNA, 25 bp, Mus musculus
gctcagatctccgggctgctgggac

SEQ ID NO: 440702 - DNA, 25 bp, Mus musculus
gacccgagggaaagctgacgccgct

SEQ ID NO: 440703 - DNA, 25 bp, Mus musculus
caagacatctccgagctctgagcgc

SEQ ID NO: 440704 - DNA, 25 bp, Mus musculus
tctgagcgctcgaccggaaatgctc

SEQ ID NO: 440705 - DNA, 25 bp, Mus musculus
ggaagtgcacctacaggcccgagtc

SEQ ID NO: 440706 - DNA, 25 bp, Mus musculus
gacccgtgagcgctgaattgaacgc

SEQ ID NO: 440707 - DNA, 25 bp, Mus musculus
tctggctgctgtcctcgccacttta

SEQ ID NO: 440708 - DNA, 25 bp, Mus musculus
cgccactttacctctgtgccgagga

SEQ ID NO: 440709 - DNA, 25 bp, Mus musculus
tgacgccgctgagccagtcagcacg

SEQ ID NO: 440710 - DNA, 25 bp, Mus musculus
ctcgcactctagtcccgcgtgtagg

SEQ ID NO: 440711 - DNA, 25 bp, Mus musculus
caggccgcctgtctagtttccggtc

SEQ ID NO: 440712 - DNA, 25 bp, Mus musculus
tcactatgtatgaccgtgctccgcg

SEQ ID NO: 440713 - DNA, 25 bp, Mus musculus
tggctcgactgtgccaaccgcggca

SEQ ID NO: 440714 - DNA, 25 bp, Mus musculus
gcagggagcttcgtcagactctaca

SEQ ID NO: 440715 - DNA, 25 bp, Mus musculus
gtcagcacgcagctcgcactctagt

SEQ ID NO: 440716 - DNA, 25 bp, Mus musculus
cccggtaggacgtgatgacgtgatc

SEQ ID NO: 440717 - DNA, 25 bp, Mus musculus
tcggctcccaacgatcactcagtgg

SEQ ID NO: 440718 - DNA, 25 bp, Mus musculus
gcgttgcctacgtcagcaagctgga

SEQ ID NO: 440719 - DNA, 25 bp, Mus musculus
gccgagctcctctgatgcaacaata

SEQ ID NO: 440720 - DNA, 25 bp, Mus musculus
ctccagccggtacaggtcacatttc

SEQ ID NO: 440721 - DNA, 25 bp, Mus musculus
tcctcgcgtgtagcagaagccatga

SEQ ID NO: 440722 - DNA, 25 bp, Mus musculus
gctggcttttggaccattcccgaaa

SEQ ID NO: 440723 - DNA, 25 bp, Mus musculus
ggcttcctgcccatcacacaggtga

SEQ ID NO: 440724 - DNA, 25 bp, Mus musculus
tgcttatacagctggtcggccttca

SEQ ID NO: 440725 - DNA, 25 bp, Mus musculus
ggccttcaactccatgcgccgaatt

SEQ ID NO: 440726 - DNA, 25 bp, Mus musculus
ccacggatgaatttctgcttataca

SEQ ID NO: 440727 - DNA, 25 bp, Mus musculus
gccgaattacctgcatggtccggta

SEQ ID NO: 440728 - DNA, 25 bp, Mus musculus
cagctcggcgagaatggacttcacg

SEQ ID NO: 440729 - DNA, 25 bp, Mus musculus
gcggtcagcattttcctcatggaga

SEQ ID NO: 440730 - DNA, 25 bp, Mus musculus
gcgcgctgacgtttcttgaggcacg

SEQ ID NO: 440731 - DNA, 25 bp, Mus musculus
gctccgggcaaacctggagcgcctg

SEQ ID NO: 440732 - DNA, 25 bp, Mus musculus
aagctcttcccggtggcagcggagt

SEQ ID NO: 440733 - DNA, 25 bp, Mus musculus
cagagccaagctcttcccggtggca

SEQ ID NO: 440734 - DNA, 25 bp, Mus musculus
atgcggggaccagttctgttcctgt

SEQ ID NO: 440735 - DNA, 25 bp, Mus musculus
gagccaccgaatgcggggaccagtt

SEQ ID NO: 440736 - DNA, 25 bp, Mus musculus
cgcagctcaggagagccaccgaatg

SEQ ID NO: 440737 - DNA, 25 bp, Mus musculus
gtgcacttcccgcagctcaggagag

SEQ ID NO: 440738 - DNA, 25 bp, Mus musculus
gtcgcaggttcttgcggtccgccgt

SEQ ID NO: 440739 - DNA, 25 bp, Mus musculus
ccattcctcagggtcgcaggttctt

SEQ ID NO: 440740 - DNA, 25 bp, Mus musculus
gtgggcacacgcaccgtgcttagcc

SEQ ID NO: 440741 - DNA, 25 bp, Mus musculus
tcttttgggagcaccgtgggcacac

SEQ ID NO: 440742 - DNA, 25 bp, Mus musculus
ctcgacgcccgttcttttgggagca

SEQ ID NO: 440743 - DNA, 25 bp, Mus musculus
aacgccctttggctggcgaccctga

SEQ ID NO: 440744 - DNA, 25 bp, Mus musculus
cagagcattagcagccgggagacgt

SEQ ID NO: 440745 - DNA, 25 bp, Mus musculus
ctctgccgacgatgaggaaaggtct

SEQ ID NO: 440746 - DNA, 25 bp, Mus musculus
gctttcggctgtttgcgcgtctcct

SEQ ID NO: 440747 - DNA, 25 bp, Mus musculus
tatttctcaggactgcctggcggtg

SEQ ID NO: 440748 - DNA, 25 bp, Mus musculus
gcgctcaggctgctgttatttctca

SEQ ID NO: 440749 - DNA, 25 bp, Mus musculus
cgcagtggacgagggaccttcaaac

SEQ ID NO: 440750 - DNA, 25 bp, Mus musculus
tctccggcacagaagcgcaaggatc

SEQ ID NO: 440751 - DNA, 25 bp, Mus musculus
tccatcctcgcttacataaggcggg

SEQ ID NO: 440752 - DNA, 25 bp, Mus musculus
aggcgtggatttcgctccatcctcg

SEQ ID NO: 440753 - DNA, 25 bp, Mus musculus
agtggactccaccttccgcgcgagg

SEQ ID NO: 440754 - DNA, 25 bp, Mus musculus
ccaggtgtcccttgtcagcgccgga

SEQ ID NO: 440755 - DNA, 25 bp, Mus musculus
tgagctccgctggacaccgccaagt

SEQ ID NO: 440756 - DNA, 25 bp, Mus musculus
tgagcaagtgaacccagtggactcc

SEQ ID NO: 440757 - DNA, 25 bp, Mus musculus
ccctgcccttggagaaagtggagtg

SEQ ID NO: 440758 - DNA, 25 bp, Mus musculus
gagctgggaccgactccaaatggca

SEQ ID NO: 440759 - DNA, 25 bp, Mus musculus
gtgaacttcaacttctccggggcca

SEQ ID NO: 440760 - DNA, 25 bp, Mus musculus
ctgcagactgcgagccaagcactta

SEQ ID NO: 440761 - DNA, 25 bp, Mus musculus
cccactagtgactgcagactgcgag

SEQ ID NO: 440762 - DNA, 25 bp, Mus musculus
tggaatttttctcactcgccctctc

SEQ ID NO: 440763 - DNA, 25 bp, Mus musculus
cgccgccgctggaatttttctcact

SEQ ID NO: 440764 - DNA, 25 bp, Mus musculus
cgatcgccgcacaaagcgcgggcta

SEQ ID NO: 440765 - DNA, 25 bp, Mus musculus
ggttgtcccatgagcgccttggctc

SEQ ID NO: 440766 - DNA, 25 bp, Mus musculus
ccaaatggcagagcgcggtgaactt

SEQ ID NO: 440767 - DNA, 25 bp, Mus musculus
ccagaaacaaaagcgcgaggaggca

SEQ ID NO: 440768 - DNA, 25 bp, Mus musculus
gtccctggctggtccaaaagccttg

SEQ ID NO: 440769 - DNA, 25 bp, Mus musculus
gctgcagccggacaaacgtccctgg

SEQ ID NO: 440770 - DNA, 25 bp, Mus musculus
acttagcgcagggattacgcggccc

SEQ ID NO: 440771 - DNA, 25 bp, Mus musculus
accgaagagtgtggttgtcccatga

SEQ ID NO: 440772 - DNA, 25 bp, Mus musculus
gcctgggagccagcaaacaaaactg

SEQ ID NO: 440773 - DNA, 25 bp, Mus musculus
tctcaagccggtggggaacttccgc

SEQ ID NO: 440774 - DNA, 25 bp, Mus musculus
ccgcgactgatctaagtgggctttc

SEQ ID NO: 440775 - DNA, 25 bp, Mus musculus
tgggctttccttctggacgcaccga

SEQ ID NO: 440776 - DNA, 25 bp, Mus musculus
cttctggacgcaccgacgtgtaacc

SEQ ID NO: 440777 - DNA, 25 bp, Mus musculus
caccgacgtgtaaccctcacaggtt

SEQ ID NO: 440778 - DNA, 25 bp, Mus musculus
ctcacaggttacacaactgcacata

SEQ ID NO: 440779 - DNA, 25 bp, Mus musculus
caactgcacatatttcagggagggg

SEQ ID NO: 440780 - DNA, 25 bp, Mus musculus
gggaaatacacgcttctccgtagcc

SEQ ID NO: 440781 - DNA, 25 bp, Mus musculus
acacgcttctccgtagcctgggagc

SEQ ID NO: 440782 - DNA, 25 bp, Mus musculus
ccagcaaacaaaactgcgccgcttt

SEQ ID NO: 440783 - DNA, 25 bp, Mus musculus
gttccctcgcggaccaggacgtgct

SEQ ID NO: 440784 - DNA, 25 bp, Mus musculus
aaactgcgccgctttcccgtgcagg

SEQ ID NO: 440785 - DNA, 25 bp, Mus musculus
gccgtccctctcaagccggtgggga

SEQ ID NO: 440786 - DNA, 25 bp, Mus musculus
gtactaggcacatggtcggaccaca

SEQ ID NO: 440787 - DNA, 25 bp, Mus musculus
ttggaaccaggagaacgatgtaagc

SEQ ID NO: 440788 - DNA, 25 bp, Mus musculus
gacacctagcgacctccggactaag

SEQ ID NO: 440789 - DNA, 25 bp, Mus musculus
tagcgacctccggactaaggccagg

SEQ ID NO: 440790 - DNA, 25 bp, Mus musculus
ctaaggccagggacgcattggaacc

SEQ ID NO: 440791 - DNA, 25 bp, Mus musculus
ccagggacgcattggaaccaggaga

SEQ ID NO: 440792 - DNA, 25 bp, Mus musculus
gcattggaaccaggagaacgatgta

SEQ ID NO: 440793 - DNA, 25 bp, Mus musculus
aaccaggagaacgatgtaagcgggc

SEQ ID NO: 440794 - DNA, 25 bp, Mus musculus
acgtagtgagcggtgactcggcccg

SEQ ID NO: 440795 - DNA, 25 bp, Mus musculus
ctcggcccggggcatacagagtttg

SEQ ID NO: 440796 - DNA, 25 bp, Mus musculus
gcatacagagtttgcggagccggga

SEQ ID NO: 440797 - DNA, 25 bp, Mus musculus
ctaggcacatggtcggaccacagcg

SEQ ID NO: 440798 - DNA, 25 bp, Mus musculus
agcgcccgtactaggcacatggtcg

SEQ ID NO: 440799 - DNA, 25 bp, Mus musculus
gagaagcgcccgtactaggcacatg

SEQ ID NO: 440800 - DNA, 25 bp, Mus musculus
cctgctggctgaaacagccgcgggc

SEQ ID NO: 440801 - DNA, 25 bp, Mus musculus
tgcttacctgctggctgaaacagcc

SEQ ID NO: 440802 - DNA, 25 bp, Mus musculus
ggacagtgcttacctgctggctgaa

SEQ ID NO: 440803 - DNA, 25 bp, Mus musculus
taccctgaggacagtgcttacctgc

SEQ ID NO: 440804 - DNA, 25 bp, Mus musculus
cttggcaagggcttgctggtctacc

SEQ ID NO: 440805 - DNA, 25 bp, Mus musculus
tggtctaccctgaggacagtgctta

SEQ ID NO: 440806 - DNA, 25 bp, Mus musculus
tccctccgagatcgcggaggagtgc

SEQ ID NO: 440807 - DNA, 25 bp, Mus musculus
cttgctggtctaccctgaggacagt

SEQ ID NO: 440808 - DNA, 25 bp, Mus musculus
aacttccctccgagatcgcggagga

SEQ ID NO: 440809 - DNA, 25 bp, Mus musculus
aagctttcgtgcaggagcagccttc

SEQ ID NO: 440810 - DNA, 25 bp, Mus musculus
gcaagggcttgctggtctaccctga

SEQ ID NO: 440811 - DNA, 25 bp, Mus musculus
aaggatggctaaggtccgggaactg

SEQ ID NO: 440812 - DNA, 25 bp, Mus musculus
agcagcggtgagaaaggcggagatc

SEQ ID NO: 440813 - DNA, 25 bp, Mus musculus
agtgctgcgcgcagctgcttggcaa

SEQ ID NO: 440814 - DNA, 25 bp, Mus musculus
ttcagcccgaactacgatctcaccg

SEQ ID NO: 440815 - DNA, 25 bp, Mus musculus
gctcacctctgactgtccggggaca

SEQ ID NO: 440816 - DNA, 25 bp, Mus musculus
ttcgagccgggctcacctctgactg

SEQ ID NO: 440817 - DNA, 25 bp, Mus musculus
tctccctcgcttgcttcgagccggg

SEQ ID NO: 440818 - DNA, 25 bp, Mus musculus
agggcagggcggttcctcgctctcc

SEQ ID NO: 440819 - DNA, 25 bp, Mus musculus
gagtctatcagggtccgagccggtt

SEQ ID NO: 440820 - DNA, 25 bp, Mus musculus
tctcagacgtcctggctggcgtcgt

SEQ ID NO: 440821 - DNA, 25 bp, Mus musculus
gagtctcagacgtcctggctggcgt

SEQ ID NO: 440822 - DNA, 25 bp, Mus musculus
actgtccggggacatgactggcaca

SEQ ID NO: 440823 - DNA, 25 bp, Mus musculus
tccggggacatgactggcacaccag

SEQ ID NO: 440824 - DNA, 25 bp, Mus musculus
ggacatgactggcacaccaggagct

SEQ ID NO: 440825 - DNA, 25 bp, Mus musculus
accaggagctgctaccgctggggat

SEQ ID NO: 440826 - DNA, 25 bp, Mus musculus
cacctctgactgtccggggacatga

SEQ ID NO: 440827 - DNA, 25 bp, Mus musculus
gcacaccaggagctgctaccgctgg

SEQ ID NO: 440828 - DNA, 25 bp, Mus musculus
cgggtttgaccctgcggatccgcac

SEQ ID NO: 440829 - DNA, 25 bp, Mus musculus
cagcagcggagacaaccaggaagta

SEQ ID NO: 440830 - DNA, 25 bp, Mus musculus
tgtgtattttctcccttacggccca

SEQ ID NO: 440831 - DNA, 25 bp, Mus musculus
ctatcgatctgacaaccgcaaagtt

SEQ ID NO: 440832 - DNA, 25 bp, Mus musculus
aagcgacgttccaggtccctatcga

SEQ ID NO: 440833 - DNA, 25 bp, Mus musculus
tccgaagagctggaaaagcgacgtt

SEQ ID NO: 440834 - DNA, 25 bp, Mus musculus
acccttcaaccgtctttgtgtcatg

SEQ ID NO: 440835 - DNA, 25 bp, Mus musculus
gggtgtcccttacccacctgagtca

SEQ ID NO: 440836 - DNA, 25 bp, Mus musculus
accagccggtgagtgcaacggcctc

SEQ ID NO: 440837 - DNA, 25 bp, Mus musculus
agccgcgaagatggcgtcgaccagc

SEQ ID NO: 440838 - DNA, 25 bp, Mus musculus
aggagccagtgctgcttcctgcttc

SEQ ID NO: 440839 - DNA, 25 bp, Mus musculus
actcgcgcataaaagcccggctcgg

SEQ ID NO: 440840 - DNA, 25 bp, Mus musculus
cgtcaaggaccgagcgctttttagc

SEQ ID NO: 440841 - DNA, 25 bp, Mus musculus
aggaagtacacagcccgcgtcgtca

SEQ ID NO: 440842 - DNA, 25 bp, Mus musculus
cgcgtcgcaaaagcggccgcgcttg

SEQ ID NO: 440843 - DNA, 25 bp, Mus musculus
gcagattgagcctcgcttcggccct

SEQ ID NO: 440844 - DNA, 25 bp, Mus musculus
gcgagtttccacacctagcgggcca

SEQ ID NO: 440845 - DNA, 25 bp, Mus musculus
agtttccacacctagcgggccaggg

SEQ ID NO: 440846 - DNA, 25 bp, Mus musculus
gcccttacctgcagctcggtgagga

SEQ ID NO: 440847 - DNA, 25 bp, Mus musculus
tgcagctcggtgaggaggatctccc

SEQ ID NO: 440848 - DNA, 25 bp, Mus musculus
tcctcctgtcgcaccatttggctgt

SEQ ID NO: 440849 - DNA, 25 bp, Mus musculus
atttggctgtcaccgcgtcgcaaaa

SEQ ID NO: 440850 - DNA, 25 bp, Mus musculus
aagtcgagcgagcagaccacaccca

SEQ ID NO: 440851 - DNA, 25 bp, Mus musculus
cttaacggctctgcgcgaacgctag

SEQ ID NO: 440852 - DNA, 25 bp, Mus musculus
tctgcgcgaacgctaggtctggcct

SEQ ID NO: 440853 - DNA, 25 bp, Mus musculus
aacgctaggtctggcctccggccgg

SEQ ID NO: 440854 - DNA, 25 bp, Mus musculus
accgcggctgcgcttaacggctctg

SEQ ID NO: 440855 - DNA, 25 bp, Mus musculus
gccggccgcagattgagcctcgctt

SEQ ID NO: 440856 - DNA, 25 bp, Mus musculus
gctcggagtctgcaggtgcatttga

SEQ ID NO: 440857 - DNA, 25 bp, Mus musculus
gctgatttgcgagagcagattaatc

SEQ ID NO: 440858 - DNA, 25 bp, Mus musculus
ctcgctgctgatttgcgagagcaga

SEQ ID NO: 440859 - DNA, 25 bp, Mus musculus
gcctcggcgcggttaatcacgcgct

SEQ ID NO: 440860 - DNA, 25 bp, Mus musculus
acccgcagagaaagggcagcgccgc

SEQ ID NO: 440861 - DNA, 25 bp, Mus musculus
cgcgcccagagacccgcagagaaag

SEQ ID NO: 440862 - DNA, 25 bp, Mus musculus
cagtgaagcggttaagcggcagccg

SEQ ID NO: 440863 - DNA, 25 bp, Mus musculus
ctgcagggcagcagtgaagcggtta

SEQ ID NO: 440864 - DNA, 25 bp, Mus musculus
agacgcgcggatatcgtgggctgca

SEQ ID NO: 440865 - DNA, 25 bp, Mus musculus
tgcagccgccctgccagcgtgggat

SEQ ID NO: 440866 - DNA, 25 bp, Mus musculus
ttgaatcacgcagcaccctgtgcag

SEQ ID NO: 440867 - DNA, 25 bp, Mus musculus
tgcatttgaatcacgcagcaccctg

SEQ ID NO: 440868 - DNA, 25 bp, Mus musculus
gtctgcaggtgcatttgaatcacgc

SEQ ID NO: 440869 - DNA, 25 bp, Mus musculus
cgagagcagattaatcagagagcgc

SEQ ID NO: 440870 - DNA, 25 bp, Mus musculus
ctcgatggctcttgggtggagccga

SEQ ID NO: 440871 - DNA, 25 bp, Mus musculus
acggcgtccgaacttcctcctctgg

SEQ ID NO: 440872 - DNA, 25 bp, Mus musculus
cgagctcagctcactgcggctgcgg

SEQ ID NO: 440873 - DNA, 25 bp, Mus musculus
gccacgtgaaccgccggagcagagt

SEQ ID NO: 440874 - DNA, 25 bp, Mus musculus
gcagagtcggggacaccagcgccac

SEQ ID NO: 440875 - DNA, 25 bp, Mus musculus
agagtcggggacaccagcgccaccg

SEQ ID NO: 440876 - DNA, 25 bp, Mus musculus
cccgcaccgtggacctggcccgcca

SEQ ID NO: 440877 - DNA, 25 bp, Mus musculus
tcctctggccgcactttccgcgcca

SEQ ID NO: 440878 - DNA, 25 bp, Mus musculus
ttccgcgccagtcacccggcccgaa

SEQ ID NO: 440879 - DNA, 25 bp, Mus musculus
agtaggggtacagaaaagcgtgttg

SEQ ID NO: 440880 - DNA, 25 bp, Mus musculus
agaacccgagtttgcgtagctcctc

SEQ ID NO: 440881 - DNA, 25 bp, Mus musculus
cccgagtttgcgtagctcctcgatg

SEQ ID NO: 440882 - DNA, 25 bp, Mus musculus
agtttgcgtagctcctcgatggctc

SEQ ID NO: 440883 - DNA, 25 bp, Mus musculus
ttgcgtagctcctcgatggctcttg

SEQ ID NO: 440884 - DNA, 25 bp, Mus musculus
tgctctcaactttccaaagcgcttg

SEQ ID NO: 440885 - DNA, 25 bp, Mus musculus
cggggactgtcaaaactccgagagc

SEQ ID NO: 440886 - DNA, 25 bp, Mus musculus
agctgctgcccggattcaccatggt

SEQ ID NO: 440887 - DNA, 25 bp, Mus musculus
ttttctcaagctttgttctggggcc

SEQ ID NO: 440888 - DNA, 25 bp, Mus musculus
tgtcaaaactccgagagctaggctc

SEQ ID NO: 440889 - DNA, 25 bp, Mus musculus
ctgacaatttcagctcggggactgt

SEQ ID NO: 440890 - DNA, 25 bp, Mus musculus
ccaaagcgcttgctgctgacaattt

SEQ ID NO: 440891 - DNA, 25 bp, Mus musculus
tggggccacgagctgctctcaactt

SEQ ID NO: 440892 - DNA, 25 bp, Mus musculus
agcagccgcctgtttacttttctca

SEQ ID NO: 440893 - DNA, 25 bp, Mus musculus
agttagaagtcgatcgcagggcgcc

SEQ ID NO: 440894 - DNA, 25 bp, Mus musculus
acgggcgatgcaaaagttagaagtc

SEQ ID NO: 440895 - DNA, 25 bp, Mus musculus
gagagaaagacaaaacgggcgatgc

SEQ ID NO: 440896 - DNA, 25 bp, Mus musculus
ctgcccggattcaccatggtctgga

SEQ ID NO: 440897 - DNA, 25 bp, Mus musculus
agctaggctctgtggcgcgctccac

SEQ ID NO: 440898 - DNA, 25 bp, Mus musculus
acaaagggtgactgaaacgagactc

SEQ ID NO: 440899 - DNA, 25 bp, Mus musculus
aatcgcggctgcaagtttggcaatg

SEQ ID NO: 440900 - DNA, 25 bp, Mus musculus
ctatattgcaacactgcgagaggcg

SEQ ID NO: 440901 - DNA, 25 bp, Mus musculus
agggagttctcgcagaagcaggaaa

SEQ ID NO: 440902 - DNA, 25 bp, Mus musculus
gcccggcgaagaagtgtcaagtctc

SEQ ID NO: 440903 - DNA, 25 bp, Mus musculus
cgaagaagtgtcaagtctcagcccg

SEQ ID NO: 440904 - DNA, 25 bp, Mus musculus
agccactgctgcaatcgcggctgca

SEQ ID NO: 440905 - DNA, 25 bp, Mus musculus
ctgcaagtttggcaatgtggcttca

SEQ ID NO: 440906 - DNA, 25 bp, Mus musculus
atgtggcttcactttgtacgcgccc

SEQ ID NO: 440907 - DNA, 25 bp, Mus musculus
tcggcggcgcttacacatgtgttac

SEQ ID NO: 440908 - DNA, 25 bp, Mus musculus
acacatgtgttactgacagagcaga

SEQ ID NO: 440909 - DNA, 25 bp, Mus musculus
ctgacagagcagaatcccaactact

SEQ ID NO: 440910 - DNA, 25 bp, Mus musculus
gccggattgttcaggcggaataata

SEQ ID NO: 440911 - DNA, 25 bp, Mus musculus
acgtcagcgaccctcagccactggg

SEQ ID NO: 440912 - DNA, 25 bp, Mus musculus
ccggcccagaatattcgggtagaca

SEQ ID NO: 440913 - DNA, 25 bp, Mus musculus
tattcgggtagacaaactggggctc

SEQ ID NO: 440914 - DNA, 25 bp, Mus musculus
cgccttgatcattcccgagccgttg

SEQ ID NO: 440915 - DNA, 25 bp, Mus musculus
ccgagccgttgtcgatcaccactgg

SEQ ID NO: 440916 - DNA, 25 bp, Mus musculus
atcaccactggtggctggtagccgc

SEQ ID NO: 440917 - DNA, 25 bp, Mus musculus
gctggtagccgctcatgccgctggt

SEQ ID NO: 440918 - DNA, 25 bp, Mus musculus
gtgctgctgcatctgcgcctccaga

SEQ ID NO: 440919 - DNA, 25 bp, Mus musculus
tccagaccgctcttcccaggctgtg

SEQ ID NO: 440920 - DNA, 25 bp, Mus musculus
caggtgttggtaatgtcgcgtcaca

SEQ ID NO: 440921 - DNA, 25 bp, Mus musculus
gtcgcgtcacagaggacccggccat

SEQ ID NO: 440922 - DNA, 25 bp, Mus musculus
ctgctggcccgcatgacatgagtga

SEQ ID NO: 440923 - DNA, 25 bp, Mus musculus
ccgcatgacatgagtgaggtgcctc

SEQ ID NO: 440924 - DNA, 25 bp, Mus musculus
catgagtgaggtgcctcctgcgacc

SEQ ID NO: 440925 - DNA, 25 bp, Mus musculus
atggcccttggaccggcccagaata

SEQ ID NO: 440926 - DNA, 25 bp, Mus musculus
cgcttctcgccctttcggttcgatt

SEQ ID NO: 440927 - DNA, 25 bp, Mus musculus
aacttgggcggcatcataatcctga

SEQ ID NO: 440928 - DNA, 25 bp, Mus musculus
ttctggatctggttctccaagaaga

SEQ ID NO: 440929 - DNA, 25 bp, Mus musculus
tgaaacccgccgctcgcgatcaaga

SEQ ID NO: 440930 - DNA, 25 bp, Mus musculus
tcattggtccgaagagaggccgctt

SEQ ID NO: 440931 - DNA, 25 bp, Mus musculus
taggcttgtagcagtggcctttcgc

SEQ ID NO: 440932 - DNA, 25 bp, Mus musculus
tgtcacgggactcaagcaaggcgtt

SEQ ID NO: 440933 - DNA, 25 bp, Mus musculus
gcaaggcgttgtccgattgggtaaa

SEQ ID NO: 440934 - DNA, 25 bp, Mus musculus
gaacctgaggactgtttaacaatcg

SEQ ID NO: 440935 - DNA, 25 bp, Mus musculus
atcgatcacttacaggctcccatgg

SEQ ID NO: 440936 - DNA, 25 bp, Mus musculus
ggctcccatggtcgcctaactaaca

SEQ ID NO: 440937 - DNA, 25 bp, Mus musculus
cactcgtctttgtgggataataggc

SEQ ID NO: 440938 - DNA, 25 bp, Mus musculus
ccctgaagattgacggcagaccgca

SEQ ID NO: 440939 - DNA, 25 bp, Mus musculus
ccatcctccggtacagtggtgttca

SEQ ID NO: 440940 - DNA, 25 bp, Mus musculus
cttcacgttgaaatccatgatgttc

SEQ ID NO: 440941 - DNA, 25 bp, Mus musculus
gcaaccgcggcggaaaacagccggc

SEQ ID NO: 440942 - DNA, 25 bp, Mus musculus
aaggtgctcggcgtgccctgcctcg

SEQ ID NO: 440943 - DNA, 25 bp, Mus musculus
cgcccatcggcaggcctgggtacca

SEQ ID NO: 440944 - DNA, 25 bp, Mus musculus
cgccgtacctgcacggcccggctga

SEQ ID NO: 440945 - DNA, 25 bp, Mus musculus
cggccgccagcttcttcacgttgaa

SEQ ID NO: 440946 - DNA, 25 bp, Mus musculus
gccgccagcttcttcacgttgaaat

SEQ ID NO: 440947 - DNA, 25 bp, Mus musculus
agcttcttcacgttgaaatccatga

SEQ ID NO: 440948 - DNA, 25 bp, Mus musculus
catgatgttcatgccgggcggcagc

SEQ ID NO: 440949 - DNA, 25 bp, Mus musculus
ccgcgcagctgtcgtttcctggcgg

SEQ ID NO: 440950 - DNA, 25 bp, Mus musculus
ctctccgctcacacgctgggcctgt

SEQ ID NO: 440951 - DNA, 25 bp, Mus musculus
gcgtcgccgagcagctgcgagccac

SEQ ID NO: 440952 - DNA, 25 bp, Mus musculus
gcgactgtgcaaccgcggcggaaaa

SEQ ID NO: 440953 - DNA, 25 bp, Mus musculus
atccatgatgttcatgccgggcggc

SEQ ID NO: 440954 - DNA, 25 bp, Mus musculus
tcaggtcctcactgtcacccagagg

SEQ ID NO: 440955 - DNA, 25 bp, Mus musculus
caacgttgagctccaaggtggacgc

SEQ ID NO: 440956 - DNA, 25 bp, Mus musculus
tccaatcacagcaggaacggcgctc

SEQ ID NO: 440957 - DNA, 25 bp, Mus musculus
gcgctctagagctcccgaccaatta

SEQ ID NO: 440958 - DNA, 25 bp, Mus musculus
cgaccaattagctgcgtcggagcgg

SEQ ID NO: 440959 - DNA, 25 bp, Mus musculus
cgtttccacagaaaccgcaggccgg

SEQ ID NO: 440960 - DNA, 25 bp, Mus musculus
gcaggccggttactagcaacgttga

SEQ ID NO: 440961 - DNA, 25 bp, Mus musculus
tcaggccgccgctgcctgttctggt

SEQ ID NO: 440962 - DNA, 25 bp, Mus musculus
cctgttctggtgactcgtcagcttc

SEQ ID NO: 440963 - DNA, 25 bp, Mus musculus
aggcctccggccattgtaggtagtg

SEQ ID NO: 440964 - DNA, 25 bp, Mus musculus
tgaccctaggcacccggaagtgaaa

SEQ ID NO: 440965 - DNA, 25 bp, Mus musculus
tcacccagaggaaagcggacattgt

SEQ ID NO: 440966 - DNA, 25 bp, Mus musculus
tgtttggtgctcaggtcctcactgt

SEQ ID NO: 440967 - DNA, 25 bp, Mus musculus
ccctcctgaacagtatgtgtttggt

SEQ ID NO: 440968 - DNA, 25 bp, Mus musculus
cgcgctgagccttcgcagaacaaga

SEQ ID NO: 440969 - DNA, 25 bp, Mus musculus
tcccggagccttcgcagtttctaag

SEQ ID NO: 440970 - DNA, 25 bp, Mus musculus
tagatttgttcaccctggcgcaaga

SEQ ID NO: 440971 - DNA, 25 bp, Mus musculus
ttcctgtgcgttcgcaaccgcggtt

SEQ ID NO: 440972 - DNA, 25 bp, Mus musculus
ctccgcacttggtaacaaacacttc

SEQ ID NO: 440973 - DNA, 25 bp, Mus musculus
cctggagaagggtccaaatggctac

SEQ ID NO: 440974 - DNA, 25 bp, Mus musculus
aatggctacggcttccacctgcacg

SEQ ID NO: 440975 - DNA, 25 bp, Mus musculus
atccgtctggtagaacctggctcgc

SEQ ID NO: 440976 - DNA, 25 bp, Mus musculus
tctcaagaagctgggcgtctcgatc

SEQ ID NO: 440977 - DNA, 25 bp, Mus musculus
gaagtccgaacaagccgagcctcca

SEQ ID NO: 440978 - DNA, 25 bp, Mus musculus
ccgacactcatgaggctggggacca

SEQ ID NO: 440979 - DNA, 25 bp, Mus musculus
cccggacttccaagcactttctgaa

SEQ ID NO: 440980 - DNA, 25 bp, Mus musculus
aggaaacggcttctgccctctgtcc

SEQ ID NO: 440981 - DNA, 25 bp, Mus musculus
gagcccggttcgtgatttctgattg

SEQ ID NO: 440982 - DNA, 25 bp, Mus musculus
tacacgtcgtgaagagtcgtggccg

SEQ ID NO: 440983 - DNA, 25 bp, Mus musculus
cttggtggtgccaccgtgaagaacg

SEQ ID NO: 440984 - DNA, 25 bp, Mus musculus
ttcccgcaggcgtgcagagcttgcc

SEQ ID NO: 440985 - DNA, 25 bp, Mus musculus
atctctcttattggcttggtggtgc

SEQ ID NO: 440986 - DNA, 25 bp, Mus musculus
gcggttcgtttggtaatctctctta

SEQ ID NO: 440987 - DNA, 25 bp, Mus musculus
cttcggcctaggctcgtgagctcat

SEQ ID NO: 440988 - DNA, 25 bp, Mus musculus
agccgccgtgccgtaaagaacgcta

SEQ ID NO: 440989 - DNA, 25 bp, Mus musculus
tgccgtaaagaacgctacacgtcgt

SEQ ID NO: 440990 - DNA, 25 bp, Mus musculus
agcttgccgcggctgctttgctgca

SEQ ID NO: 440991 - DNA, 25 bp, Mus musculus
cgtggccggaacagctgctttacgg

SEQ ID NO: 440992 - DNA, 25 bp, Mus musculus
tgctttacggctagctcggcttccc

SEQ ID NO: 440993 - DNA, 25 bp, Mus musculus
agaacggagtggcagcttcggccta

SEQ ID NO: 440994 - DNA, 25 bp, Mus musculus
atctgcagctgagaaggaagggact

SEQ ID NO: 440995 - DNA, 25 bp, Mus musculus
ctcgtgagctcatggaatctgcagc

SEQ ID NO: 440996 - DNA, 25 bp, Mus musculus
tttagcgcagaccttacagcagccg

SEQ ID NO: 440997 - DNA, 25 bp, Mus musculus
gggagcccgccctttataatgcctg

SEQ ID NO: 440998 - DNA, 25 bp, Mus musculus
gcgcggcgacacagaaccaacaagc

SEQ ID NO: 440999 - DNA, 25 bp, Mus musculus
cgtcctgaaggtgctggagctcatt

SEQ ID NO: 441000 - DNA, 25 bp, Mus musculus
caccagtctggtcaagtggagaagg

SEQ ID NO: 441001 - DNA, 25 bp, Mus musculus
ccctgcggtgaaagatcatggcccg

SEQ ID NO: 441002 - DNA, 25 bp, Mus musculus
tttcagtctaactttccctgcggtg

SEQ ID NO: 441003 - DNA, 25 bp, Mus musculus
ccctgggcataaagcaacagctacc

SEQ ID NO: 441004 - DNA, 25 bp, Mus musculus
accagaagtgtctcgatcgcgtccc

SEQ ID NO: 441005 - DNA, 25 bp, Mus musculus
gggctccgtccaccagaagtgtctc

SEQ ID NO: 441006 - DNA, 25 bp, Mus musculus
gtaaactgccctgagcctaggtctg

SEQ ID NO: 441007 - DNA, 25 bp, Mus musculus
cattgctcggggaggcacgtaaact

SEQ ID NO: 441008 - DNA, 25 bp, Mus musculus
cgcgtgagattgctttgcattgctc

SEQ ID NO: 441009 - DNA, 25 bp, Mus musculus
ccgcgtgttgcagtgacgtagctct

SEQ ID NO: 441010 - DNA, 25 bp, Mus musculus
agtttacagcgcctcaatcccgggc

SEQ ID NO: 441011 - DNA, 25 bp, Mus musculus
ctctgtgccagacttcgagggtacg

SEQ ID NO: 441012 - DNA, 25 bp, Mus musculus
gaggtttccggcgactcacagcaca

SEQ ID NO: 441013 - DNA, 25 bp, Mus musculus
aggacgtttccagcctcggcccata

SEQ ID NO: 441014 - DNA, 25 bp, Mus musculus
ggcccatatttggtgaaagtctttc

SEQ ID NO: 441015 - DNA, 25 bp, Mus musculus
ttcgagacttcgtcatccggctcca

SEQ ID NO: 441016 - DNA, 25 bp, Mus musculus
cccggcgttcctgaaaagtgcatcc

SEQ ID NO: 441017 - DNA, 25 bp, Mus musculus
gaaaagtgcatcctggccgcccacg

SEQ ID NO: 441018 - DNA, 25 bp, Mus musculus
caggactggccgagtcccgagttta

SEQ ID NO: 441019 - DNA, 25 bp, Mus musculus
ccgtagcgcaggagagcagaatcca

SEQ ID NO: 441020 - DNA, 25 bp, Mus musculus
gattatgtcacttttccagtccacc

SEQ ID NO: 441021 - DNA, 25 bp, Mus musculus
actcgttctcccagcggggctgcaa

SEQ ID NO: 441022 - DNA, 25 bp, Mus musculus
acagggcgctgcaaagattatgtca

SEQ ID NO: 441023 - DNA, 25 bp, Mus musculus
ggctgcaagcgacctctctgtgcca

SEQ ID NO: 441024 - DNA, 25 bp, Mus musculus
ctcaaacccagccaccgtcgcctcc

SEQ ID NO: 441025 - DNA, 25 bp, Mus musculus
cgacgagagcctgcccgactgcgtg

SEQ ID NO: 441026 - DNA, 25 bp, Mus musculus
cacattcatcggctgccaagaggag

SEQ ID NO: 441027 - DNA, 25 bp, Mus musculus
cgcgggctcagttcccaacttccca

SEQ ID NO: 441028 - DNA, 25 bp, Mus musculus
ggacgctcgtggaactgaccccgcg

SEQ ID NO: 441029 - DNA, 25 bp, Mus musculus
cccagccgcaggaaggaggtaacgg

SEQ ID NO: 441030 - DNA, 25 bp, Mus musculus
gcctgcccgactgcgtgttcgtgga

SEQ ID NO: 441031 - DNA, 25 bp, Mus musculus
ccagcacgagctctacgtgggcgtg

SEQ ID NO: 441032 - DNA, 25 bp, Mus musculus
agcgccagcacgagctctacgtggg

SEQ ID NO: 441033 - DNA, 25 bp, Mus musculus
gtggatttcgctcgcgccgagcgcc

SEQ ID NO: 441034 - DNA, 25 bp, Mus musculus
tcctctccgcgcgaaccatggccgg

SEQ ID NO: 441035 - DNA, 25 bp, Mus musculus
gcagcagcacattcatcggctgcca

SEQ ID NO: 441036 - DNA, 25 bp, Mus musculus
ggaggaccgagccaccgactcaaac

SEQ ID NO: 441037 - DNA, 25 bp, Mus musculus
tcgtgtgcgaggagacggccctcat

SEQ ID NO: 441038 - DNA, 25 bp, Mus musculus
ccgagtaatcagacgcccacgtatt

SEQ ID NO: 441039 - DNA, 25 bp, Mus musculus
cgcccacggaaacaaatccttcagg

SEQ ID NO: 441040 - DNA, 25 bp, Mus musculus
cagatgggtgaaactggtctctatc

SEQ ID NO: 441041 - DNA, 25 bp, Mus musculus
atgtttccttgccatccgctcgtcg

SEQ ID NO: 441042 - DNA, 25 bp, Mus musculus
ggctgcggaaagctcgccagctgaa

SEQ ID NO: 441043 - DNA, 25 bp, Mus musculus
gagacgatccaccagcgacccggga

SEQ ID NO: 441044 - DNA, 25 bp, Mus musculus
cagctgaacgcacgccctggaattc

SEQ ID NO: 441045 - DNA, 25 bp, Mus musculus
ccctcacggaggaggatttgactga

SEQ ID NO: 441046 - DNA, 25 bp, Mus musculus
gaagtcacagcctgattcccggagg

SEQ ID NO: 441047 - DNA, 25 bp, Mus musculus
gtgcctgagttaggaagaacgctga

SEQ ID NO: 441048 - DNA, 25 bp, Mus musculus
ggtagtactgattggctggcacgta

SEQ ID NO: 441049 - DNA, 25 bp, Mus musculus
ccactgcggaagcagagacgtaacc

SEQ ID NO: 441050 - DNA, 25 bp, Mus musculus
gcgtccaatccgcaagcctatgtaa

SEQ ID NO: 441051 - DNA, 25 bp, Mus musculus
ctggtggctttccatcctgccgatc

SEQ ID NO: 441052 - DNA, 25 bp, Mus musculus
acccgttgagctacttcgcggctta

SEQ ID NO: 441053 - DNA, 25 bp, Mus musculus
gctacttcgcggcttacgggagcag

SEQ ID NO: 441054 - DNA, 25 bp, Mus musculus
cttacgggagcagcagctccgactc

SEQ ID NO: 441055 - DNA, 25 bp, Mus musculus
gcagcagctccgactcgtcggatga

SEQ ID NO: 441056 - DNA, 25 bp, Mus musculus
ccgactcgtcggatgagaacagcga

SEQ ID NO: 441057 - DNA, 25 bp, Mus musculus
atgagaacagcgagccggaagacgc

SEQ ID NO: 441058 - DNA, 25 bp, Mus musculus
tacaacccgctcaacaagcagatcg

SEQ ID NO: 441059 - DNA, 25 bp, Mus musculus
cccagccgggcgacgactaacggtg

SEQ ID NO: 441060 - DNA, 25 bp, Mus musculus
ttccctttgacgccgaagtgcctgc

SEQ ID NO: 441061 - DNA, 25 bp, Mus musculus
gcaaatggataactcgccagcctgg

SEQ ID NO: 441062 - DNA, 25 bp, Mus musculus
cggccgtcatggcagccgaagagaa

SEQ ID NO: 441063 - DNA, 25 bp, Mus musculus
tcatggcagccgaagagaaggaccc

SEQ ID NO: 441064 - DNA, 25 bp, Mus musculus
ccgaagagaaggacccgttgagcta

SEQ ID NO: 441065 - DNA, 25 bp, Mus musculus
ggcgacgactaacggtggtgactcc

SEQ ID NO: 441066 - DNA, 25 bp, Mus musculus
agaagtctcgagagcctccgcgtga

SEQ ID NO: 441067 - DNA, 25 bp, Mus musculus
ctgtccagttgcagaagtctcgaga

SEQ ID NO: 441068 - DNA, 25 bp, Mus musculus
gtcctcggatacaactgtccagttg

SEQ ID NO: 441069 - DNA, 25 bp, Mus musculus
gggacggcctcccagtcctcggata

SEQ ID NO: 441070 - DNA, 25 bp, Mus musculus
ccggtcgcctccgacggagtcgaga

SEQ ID NO: 441071 - DNA, 25 bp, Mus musculus
gctgatccaggccatgcacgaccta

SEQ ID NO: 441072 - DNA, 25 bp, Mus musculus
agaggcctattatctgctgatccag

SEQ ID NO: 441073 - DNA, 25 bp, Mus musculus
agacccagttgcgagaggcctatta

SEQ ID NO: 441074 - DNA, 25 bp, Mus musculus
agacgggcaggctgcagacccagtt

SEQ ID NO: 441075 - DNA, 25 bp, Mus musculus
gggcgccgactactacgagaacctg

SEQ ID NO: 441076 - DNA, 25 bp, Mus musculus
ttatgccaagtatgtgaggagctgg

SEQ ID NO: 441077 - DNA, 25 bp, Mus musculus
ccgctgccgagttatgccaagtatg

SEQ ID NO: 441078 - DNA, 25 bp, Mus musculus
cgtcgcggctctagttccggggcat

SEQ ID NO: 441079 - DNA, 25 bp, Mus musculus
agctgcatcaggtgcggtgcgcacc

SEQ ID NO: 441080 - DNA, 25 bp, Mus musculus
ctcctccggagagtgatggaacctt

SEQ ID NO: 441081 - DNA, 25 bp, Mus musculus
aagcccggtctccatccagaatctg

SEQ ID NO: 441082 - DNA, 25 bp, Mus musculus
gctgacaaggtgagcagctcgcacc

SEQ ID NO: 441083 - DNA, 25 bp, Mus musculus
tcgccggccctagtagacttttagc

SEQ ID NO: 441084 - DNA, 25 bp, Mus musculus
atggaccacacacccggacgtgacg

SEQ ID NO: 441085 - DNA, 25 bp, Mus musculus
acgtgacgctatcgcagaggaggaa

SEQ ID NO: 441086 - DNA, 25 bp, Mus musculus
gcgtcgcagtgacgtcctcccaaga

SEQ ID NO: 441087 - DNA, 25 bp, Mus musculus
tgagagagtgaagaaactgtttccc

SEQ ID NO: 441088 - DNA, 25 bp, Mus musculus
tgtcgtccctgcgttctgggatccc

SEQ ID NO: 441089 - DNA, 25 bp, Mus musculus
cgcctcggagatcgagcgcgattcg

SEQ ID NO: 441090 - DNA, 25 bp, Mus musculus
gcagcgtccgcggtatatgtagtca

SEQ ID NO: 441091 - DNA, 25 bp, Mus musculus
atatgtagtcatggccggtgccgtg

SEQ ID NO: 441092 - DNA, 25 bp, Mus musculus
atggaacctttgacacagcgggtcg

SEQ ID NO: 441093 - DNA, 25 bp, Mus musculus
tttagcgtcctatctccggtgtccc

SEQ ID NO: 441094 - DNA, 25 bp, Mus musculus
ccgagaaggtgtccctgagctcaca

SEQ ID NO: 441095 - DNA, 25 bp, Mus musculus
tcctggaatatctcccgccgagaag

SEQ ID NO: 441096 - DNA, 25 bp, Mus musculus
agggtgcacacagccgcttttccgc

SEQ ID NO: 441097 - DNA, 25 bp, Mus musculus
ccacgcgtagcgaccagggtgcaca

SEQ ID NO: 441098 - DNA, 25 bp, Mus musculus
ccgggctctccgctacgtagcaaaa

SEQ ID NO: 441099 - DNA, 25 bp, Mus musculus
atagcaggctttccggacgacttcc

SEQ ID NO: 441100 - DNA, 25 bp, Mus musculus
aaagtccttcgtgacagcgccctgg

SEQ ID NO: 441101 - DNA, 25 bp, Mus musculus
accatgtctggtggtcgtctggatt

SEQ ID NO: 441102 - DNA, 25 bp, Mus musculus
acgggcggcctcatagcaggctttc

SEQ ID NO: 441103 - DNA, 25 bp, Mus musculus
tttataagggcgtccactccacctg

SEQ ID NO: 441104 - DNA, 25 bp, Mus musculus
tgcatctcgcagacacccgtaggcg

SEQ ID NO: 441105 - DNA, 25 bp, Mus musculus
agggaatttggggtcacgtcatgcc

SEQ ID NO: 441106 - DNA, 25 bp, Mus musculus
tcatgcccggagacgaggagacgct

SEQ ID NO: 441107 - DNA, 25 bp, Mus musculus
agacgctggacctgcctgcgtggaa

SEQ ID NO: 441108 - DNA, 25 bp, Mus musculus
ctttggtttctaatccatttctcca

SEQ ID NO: 441109 - DNA, 25 bp, Mus musculus
aaagccgggctgcttcggcttcggc

SEQ ID NO: 441110 - DNA, 25 bp, Mus musculus
tgcagatgcaaaagccgggctgctt

SEQ ID NO: 441111 - DNA, 25 bp, Mus musculus
ctagagcaaaaagcaatgcagatgc

SEQ ID NO: 441112 - DNA, 25 bp, Mus musculus
cacttcgtgttttccctagagcaaa

SEQ ID NO: 441113 - DNA, 25 bp, Mus musculus
ctgcgctttcccacttcgtgttttc

SEQ ID NO: 441114 - DNA, 25 bp, Mus musculus
gtgtggcgtaccctgcgctttccca

SEQ ID NO: 441115 - DNA, 25 bp, Mus musculus
aggctccatcgcgacgcgctttgca

SEQ ID NO: 441116 - DNA, 25 bp, Mus musculus
catttctccaaactcctggggcgga

SEQ ID NO: 441117 - DNA, 25 bp, Mus musculus
cgtcttccgctgctggctggccgga

SEQ ID NO: 441118 - DNA, 25 bp, Mus musculus
tggccttctgccgtgccgatccgag

SEQ ID NO: 441119 - DNA, 25 bp, Mus musculus
gagcaggcgcttggctctgcctgct

SEQ ID NO: 441120 - DNA, 25 bp, Mus musculus
ctcgtcctagcaaagttgcccggga

SEQ ID NO: 441121 - DNA, 25 bp, Mus musculus
cggaactttcctcgcggtgtgtggc

SEQ ID NO: 441122 - DNA, 25 bp, Mus musculus
gaaacaggctttccgcatgcgcgta

SEQ ID NO: 441123 - DNA, 25 bp, Mus musculus
ccgtctaagcgctgtagtttgcaaa

SEQ ID NO: 441124 - DNA, 25 bp, Mus musculus
aaggcgtccccaacgacaggcgtca

SEQ ID NO: 441125 - DNA, 25 bp, Mus musculus
cgtcagcgtctgtcccggagaaaca

SEQ ID NO: 441126 - DNA, 25 bp, Mus musculus
tctgtcccggagaaacaggctttcc

SEQ ID NO: 441127 - DNA, 25 bp, Mus musculus
caggctttccgcatgcgcgtagagg

SEQ ID NO: 441128 - DNA, 25 bp, Mus musculus
cgtagaggggcttgctgtccgcttc

SEQ ID NO: 441129 - DNA, 25 bp, Mus musculus
ttgctgtccgcttccgccaggcaga

SEQ ID NO: 441130 - DNA, 25 bp, Mus musculus
cggcagccgcaaagcccaatcccgg

SEQ ID NO: 441131 - DNA, 25 bp, Mus musculus
gttcctcggccgtctaagcgctgta

SEQ ID NO: 441132 - DNA, 25 bp, Mus musculus
gaggcatccaatcaacgcactgcgc

SEQ ID NO: 441133 - DNA, 25 bp, Mus musculus
ctcggccgtctaagcgctgtagttt

SEQ ID NO: 441134 - DNA, 25 bp, Mus musculus
cgcgaggcatccaatcaacgcactg

SEQ ID NO: 441135 - DNA, 25 bp, Mus musculus
aagcgctgtagtttgcaaactgcaa

SEQ ID NO: 441136 - DNA, 25 bp, Mus musculus
cccatcatctactcgtacaaggacg

SEQ ID NO: 441137 - DNA, 25 bp, Mus musculus
cgtgcaacacgtgaagcgctggttc

SEQ ID NO: 441138 - DNA, 25 bp, Mus musculus
acacgtgaagcgctggttcctgctg

SEQ ID NO: 441139 - DNA, 25 bp, Mus musculus
tcgcactgctcaactccgtcatgaa

SEQ ID NO: 441140 - DNA, 25 bp, Mus musculus
caaggacgaggacatgtacaacacc

SEQ ID NO: 441141 - DNA, 25 bp, Mus musculus
gtacaacaccatgcggaagatgatc

SEQ ID NO: 441142 - DNA, 25 bp, Mus musculus
ggaagatgatctgctgtgccctgca

SEQ ID NO: 441143 - DNA, 25 bp, Mus musculus
ccctgcaggacagcaataccgagag

SEQ ID NO: 441144 - DNA, 25 bp, Mus musculus
tccaccatccacagcaggagcgaga

SEQ ID NO: 441145 - DNA, 25 bp, Mus musculus
agccagtacctggaggacagcatca

SEQ ID NO: 441146 - DNA, 25 bp, Mus musculus
ctggaggacagcatcagccagggcc

SEQ ID NO: 441147 - DNA, 25 bp, Mus musculus
cagggcccggtgtgcaataaaaacg

SEQ ID NO: 441148 - DNA, 25 bp, Mus musculus
cggtgtgcaataaaaacggctccta

SEQ ID NO: 441149 - DNA, 25 bp, Mus musculus
ggttcctgctgctcgcactgctcaa

SEQ ID NO: 441150 - DNA, 25 bp, Mus musculus
gcttggcgagtcctccgaggctgcc

SEQ ID NO: 441151 - DNA, 25 bp, Mus musculus
gctctaaagcggctaggaccctcct

SEQ ID NO: 441152 - DNA, 25 bp, Mus musculus
aagcggctaggaccctcctcttgtc

SEQ ID NO: 441153 - DNA, 25 bp, Mus musculus
cctcttgtccccgtggagagctggg

SEQ ID NO: 441154 - DNA, 25 bp, Mus musculus
ttgtcggaggctagtcctcgctgga

SEQ ID NO: 441155 - DNA, 25 bp, Mus musculus
gaggctagtcctcgctggaccaatg

SEQ ID NO: 441156 - DNA, 25 bp, Mus musculus
agtcctcgctggaccaatgcgggcc

SEQ ID NO: 441157 - DNA, 25 bp, Mus musculus
ccgcggttgttcgtcgcctggcaac

SEQ ID NO: 441158 - DNA, 25 bp, Mus musculus
tgttcgtcgcctggcaaccggcgga

SEQ ID NO: 441159 - DNA, 25 bp, Mus musculus
caggacttagcgagtgaggtctgcc

SEQ ID NO: 441160 - DNA, 25 bp, Mus musculus
cccgcgccctttcgggatgcggcgc

SEQ ID NO: 441161 - DNA, 25 bp, Mus musculus
tcctccgaggctgccgcaggactta

SEQ ID NO: 441162 - DNA, 25 bp, Mus musculus
ccgcaggacttagcgagtgaggtct

SEQ ID NO: 441163 - DNA, 25 bp, Mus musculus
gcgcccgccgaggaaagcggcgaga

SEQ ID NO: 441164 - DNA, 25 bp, Mus musculus
cgacttcgaggtcagcactcatttg

SEQ ID NO: 441165 - DNA, 25 bp, Mus musculus
cccgcctgcccataggacatcaggg

SEQ ID NO: 441166 - DNA, 25 bp, Mus musculus
ttcaagaggcgtcattcccgcagcc

SEQ ID NO: 441167 - DNA, 25 bp, Mus musculus
tccaccccaggcatggcgctgtgtg

SEQ ID NO: 441168 - DNA, 25 bp, Mus musculus
cgctgtgtggcctcccggaattcac

SEQ ID NO: 441169 - DNA, 25 bp, Mus musculus
tggcctcccggaattcactctgctg

SEQ ID NO: 441170 - DNA, 25 bp, Mus musculus
tgccgctgttggcacggctctcggc

SEQ ID NO: 441171 - DNA, 25 bp, Mus musculus
ggactgcccgtgctccgaggctgct

SEQ ID NO: 441172 - DNA, 25 bp, Mus musculus
gtgctccgaggctgctctctgccaa

SEQ ID NO: 441173 - DNA, 25 bp, Mus musculus
ctctgccaaccgatccgccaccgtc

SEQ ID NO: 441174 - DNA, 25 bp, Mus musculus
gtcccgacttcgaggtcagcactca

SEQ ID NO: 441175 - DNA, 25 bp, Mus musculus
tcagggcccgcccttcaagaggcgt

SEQ ID NO: 441176 - DNA, 25 bp, Mus musculus
gaggtcagcactcatttgcccgtcg

SEQ ID NO: 441177 - DNA, 25 bp, Mus musculus
ggcccgcccttcaagaggcgtcatt

SEQ ID NO: 441178 - DNA, 25 bp, Mus musculus
gatcgtcccgggagtctccggactc

SEQ ID NO: 441179 - DNA, 25 bp, Mus musculus
ggcgggtctcgccagcgacttccgt

SEQ ID NO: 441180 - DNA, 25 bp, Mus musculus
agggcgcctcacacagggctgagct

SEQ ID NO: 441181 - DNA, 25 bp, Mus musculus
gacttgggacgtgtcacggacgccc

SEQ ID NO: 441182 - DNA, 25 bp, Mus musculus
ccgagcgccatgtcgggttcttcta

SEQ ID NO: 441183 - DNA, 25 bp, Mus musculus
gggtccagcctcgaacaaagaggtg

SEQ ID NO: 441184 - DNA, 25 bp, Mus musculus
ccgccatgaagaaggtggtccagca

SEQ ID NO: 441185 - DNA, 25 bp, Mus musculus
gtcctttgaacacacacgagtccgc

SEQ ID NO: 441186 - DNA, 25 bp, Mus musculus
acacacacgagtccgcctgggtagc

SEQ ID NO: 441187 - DNA, 25 bp, Mus musculus
ggcggcctgatgagcaacttttgtt

SEQ ID NO: 441188 - DNA, 25 bp, Mus musculus
caacttttgtttgcggatcgtcccg

SEQ ID NO: 441189 - DNA, 25 bp, Mus musculus
agtctccggactccacctttgtggg

SEQ ID NO: 441190 - DNA, 25 bp, Mus musculus
acaaagaggtgtttgcagcagacgc

SEQ ID NO: 441191 - DNA, 25 bp, Mus musculus
ggttcttctagcgtcgccgccatga

SEQ ID NO: 441192 - DNA, 25 bp, Mus musculus
ccctacgccaagctcatccggcaaa

SEQ ID NO: 441193 - DNA, 25 bp, Mus musculus
cagaggctggatcgtcggttccaaa

SEQ ID NO: 441194 - DNA, 25 bp, Mus musculus
ctcatccggcaaaaggctgacgctg

SEQ ID NO: 441195 - DNA, 25 bp, Mus musculus
catccggcaaaaggctgacgctggg

SEQ ID NO: 441196 - DNA, 25 bp, Mus musculus
atctccggccagaggctggatcgtc

SEQ ID NO: 441197 - DNA, 25 bp, Mus musculus
ctggatcgtcggttccaaatccctc

SEQ ID NO: 441198 - DNA, 25 bp, Mus musculus
atcgtcggttccaaatccctcggct

SEQ ID NO: 441199 - DNA, 25 bp, Mus musculus
gcttcccagagagtgcaacccacgg

SEQ ID NO: 441200 - DNA, 25 bp, Mus musculus
cggagcaggcaagggccggattccc

SEQ ID NO: 441201 - DNA, 25 bp, Mus musculus
tcccagagagtgcaacccacggagc

SEQ ID NO: 441202 - DNA, 25 bp, Mus musculus
agagtgcaacccacggagcaggcaa

SEQ ID NO: 441203 - DNA, 25 bp, Mus musculus
ggaccctctgccatctccggccaga

SEQ ID NO: 441204 - DNA, 25 bp, Mus musculus
gccatctccggccagaggctggatc

SEQ ID NO: 441205 - DNA, 25 bp, Mus musculus
taggcaggcgggatgcgcaaaggca

SEQ ID NO: 441206 - DNA, 25 bp, Mus musculus
agctttcctcttcaagcctcgcttg

SEQ ID NO: 441207 - DNA, 25 bp, Mus musculus
ctctctgtctttgacccgggtcata

SEQ ID NO: 441208 - DNA, 25 bp, Mus musculus
acggaagtgctctctgtctttgacc

SEQ ID NO: 441209 - DNA, 25 bp, Mus musculus
tacggctgtacggaaacggaagtgc

SEQ ID NO: 441210 - DNA, 25 bp, Mus musculus
gccggccttcgccatgttgtttacg

SEQ ID NO: 441211 - DNA, 25 bp, Mus musculus
agcggcagctttcctcttcaagcct

SEQ ID NO: 441212 - DNA, 25 bp, Mus musculus
tcttgaggctcttcagcggcagctt

SEQ ID NO: 441213 - DNA, 25 bp, Mus musculus
gcggccgcagcctcttgaggctctt

SEQ ID NO: 441214 - DNA, 25 bp, Mus musculus
tgcttgttcttaatctccgagatac

SEQ ID NO: 441215 - DNA, 25 bp, Mus musculus
gtcgccgctgcttgttcttaatctc

SEQ ID NO: 441216 - DNA, 25 bp, Mus musculus
cgtgaacatcaagtgtcgccgctgc

SEQ ID NO: 441217 - DNA, 25 bp, Mus musculus
ttccaccgcgtgaacatcaagtgtc

SEQ ID NO: 441218 - DNA, 25 bp, Mus musculus
tgctgctgtttccaccgcgtgaaca

SEQ ID NO: 441219 - DNA, 25 bp, Mus musculus
ccatgttgtttacggctgtacggaa

SEQ ID NO: 441220 - DNA, 25 bp, Mus musculus
agttgtagtccaccgtggcgccgga

SEQ ID NO: 441221 - DNA, 25 bp, Mus musculus
agggcagagctgcacgcgtcccgaa

SEQ ID NO: 441222 - DNA, 25 bp, Mus musculus
acgcgtcccgaagggcgtctcctgg

SEQ ID NO: 441223 - DNA, 25 bp, Mus musculus
ctcctgggcaaagcacgggcgtctt

SEQ ID NO: 441224 - DNA, 25 bp, Mus musculus
cgccagcgtcgtctaagcaactgga

SEQ ID NO: 441225 - DNA, 25 bp, Mus musculus
tcgtctaagcaactggaggtggtgc

SEQ ID NO: 441226 - DNA, 25 bp, Mus musculus
gggaaaagtttcttctgagattctg

SEQ ID NO: 441227 - DNA, 25 bp, Mus musculus
gtggcgcagaccctagcacctacga

SEQ ID NO: 441228 - DNA, 25 bp, Mus musculus
gctccactccaggtgacaaagtgtt

SEQ ID NO: 441229 - DNA, 25 bp, Mus musculus
tgtttttgttcttatcctggtgttc

SEQ ID NO: 441230 - DNA, 25 bp, Mus musculus
ggacagcctgcgagcccatcactta

SEQ ID NO: 441231 - DNA, 25 bp, Mus musculus
tgacaaagtgttcgcccgcggggta

SEQ ID NO: 441232 - DNA, 25 bp, Mus musculus
ctggttcctttcatcctggagagga

SEQ ID NO: 441233 - DNA, 25 bp, Mus musculus
tatcctggtgttctctggttccttt

SEQ ID NO: 441234 - DNA, 25 bp, Mus musculus
tgcagggttgtagcggtaacttatt

SEQ ID NO: 441235 - DNA, 25 bp, Mus musculus
cgcttgatcttcctgcgtggctgca

SEQ ID NO: 441236 - DNA, 25 bp, Mus musculus
tggttgctctcgcttgatcttcctg

SEQ ID NO: 441237 - DNA, 25 bp, Mus musculus
gttccgcacgccgtggttgctctcg

SEQ ID NO: 441238 - DNA, 25 bp, Mus musculus
aacttattgcttgttgcgtggatgc

SEQ ID NO: 441239 - DNA, 25 bp, Mus musculus
atgctgagagctctccggcagagac

SEQ ID NO: 441240 - DNA, 25 bp, Mus musculus
ctttggctaggctttggctaggctc

SEQ ID NO: 441241 - DNA, 25 bp, Mus musculus
ccgcagtcggcagcaactttggcta

SEQ ID NO: 441242 - DNA, 25 bp, Mus musculus
ccatgacccgggagtccgcaagcag

SEQ ID NO: 441243 - DNA, 25 bp, Mus musculus
cctttcttggcgatcgcagtgttcc

SEQ ID NO: 441244 - DNA, 25 bp, Mus musculus
cacttcgctgcctttcttggcgatc

SEQ ID NO: 441245 - DNA, 25 bp, Mus musculus
taagaaaggggatcacagggacctc

SEQ ID NO: 441246 - DNA, 25 bp, Mus musculus
agccctcctcgctctagtaagaaag

SEQ ID NO: 441247 - DNA, 25 bp, Mus musculus
ctaagctcgaagtagcgagggacgt

SEQ ID NO: 441248 - DNA, 25 bp, Mus musculus
aagaagcggatccaggtagctcggc

SEQ ID NO: 441249 - DNA, 25 bp, Mus musculus
caggaagcgccacaggtgacgctgt

SEQ ID NO: 441250 - DNA, 25 bp, Mus musculus
cccggggatctgtgtttacacgcca

SEQ ID NO: 441251 - DNA, 25 bp, Mus musculus
tctgtgtttacacgccagccaggtg

SEQ ID NO: 441252 - DNA, 25 bp, Mus musculus
ttacacgccagccaggtgactcggg

SEQ ID NO: 441253 - DNA, 25 bp, Mus musculus
agccaggtgactcgggcgttcagtc

SEQ ID NO: 441254 - DNA, 25 bp, Mus musculus
ttcagtcagggctgagagccgacgc

SEQ ID NO: 441255 - DNA, 25 bp, Mus musculus
gagagccgacgcgacttgccagcct

SEQ ID NO: 441256 - DNA, 25 bp, Mus musculus
ccagagcccgcggcgggttacataa

SEQ ID NO: 441257 - DNA, 25 bp, Mus musculus
ggttacataacgggccgcgagccgc

SEQ ID NO: 441258 - DNA, 25 bp, Mus musculus
ccgactcgctccacgtcagaaggaa

SEQ ID NO: 441259 - DNA, 25 bp, Mus musculus
tccacgtcagaaggaaccgggcgga

SEQ ID NO: 441260 - DNA, 25 bp, Mus musculus
gcaggcgacacaagaagcggatcca

SEQ ID NO: 441261 - DNA, 25 bp, Mus musculus
ccaacatggcggaacgcaggcgaca

SEQ ID NO: 441262 - DNA, 25 bp, Mus musculus
gacttagtccacagtccacgacctg

SEQ ID NO: 441263 - DNA, 25 bp, Mus musculus
cgcggtgtcgttcagacttagtcca

SEQ ID NO: 441264 - DNA, 25 bp, Mus musculus
tgatcattttctcaaacgcggtgtc

SEQ ID NO: 441265 - DNA, 25 bp, Mus musculus
cccggaggttgttgtgcactaactc

SEQ ID NO: 441266 - DNA, 25 bp, Mus musculus
cttgagctccaagttgtgggttttg

SEQ ID NO: 441267 - DNA, 25 bp, Mus musculus
tgctgccgccaatcaccggtttaac

SEQ ID NO: 441268 - DNA, 25 bp, Mus musculus
ccgtcagctgggagacgtagctgtc

SEQ ID NO: 441269 - DNA, 25 bp, Mus musculus
atcgcgtcatcttcactgctgctgc

SEQ ID NO: 441270 - DNA, 25 bp, Mus musculus
aggcgtcagccacaatcgcgtcatc

SEQ ID NO: 441271 - DNA, 25 bp, Mus musculus
tgcatcaaagatgaggcgtcagcca

SEQ ID NO: 441272 - DNA, 25 bp, Mus musculus
gccctgggttgtcaccatgcatcaa

SEQ ID NO: 441273 - DNA, 25 bp, Mus musculus
tccagctctttgtggcggaactcca

SEQ ID NO: 441274 - DNA, 25 bp, Mus musculus
tagctgtctgttgcctccggcttca

SEQ ID NO: 441275 - DNA, 25 bp, Mus musculus
gacctgcacgccgtcgtggtagtcc

SEQ ID NO: 441276 - DNA, 25 bp, Mus musculus
ctgagcctgctgtaaggtccgggct

SEQ ID NO: 441277 - DNA, 25 bp, Mus musculus
aggtgcgatccctgatgcccgactc

SEQ ID NO: 441278 - DNA, 25 bp, Mus musculus
gatggcagccgcaacgactgtgttt

SEQ ID NO: 441279 - DNA, 25 bp, Mus musculus
gcagcatcttcagcacattggcctg

SEQ ID NO: 441280 - DNA, 25 bp, Mus musculus
cccagttctcgatggtacgagtggc

SEQ ID NO: 441281 - DNA, 25 bp, Mus musculus
aagagccgctcacgtccgctgtgct

SEQ ID NO: 441282 - DNA, 25 bp, Mus musculus
aactgtagtggcagtgcgcgtgcaa

SEQ ID NO: 441283 - DNA, 25 bp, Mus musculus
cctctctgctcgagggaaggaactg

SEQ ID NO: 441284 - DNA, 25 bp, Mus musculus
aaatgggcgccctgacctctctgct

SEQ ID NO: 441285 - DNA, 25 bp, Mus musculus
aaggcttctgccacggagctgggca

SEQ ID NO: 441286 - DNA, 25 bp, Mus musculus
gttggatcgagtgaaggcttctgcc

SEQ ID NO: 441287 - DNA, 25 bp, Mus musculus
tgaccggtacacctggcaggcagag

SEQ ID NO: 441288 - DNA, 25 bp, Mus musculus
aacgactgtgtttgagccacgtgcc

SEQ ID NO: 441289 - DNA, 25 bp, Mus musculus
tggcgcggtccaaagagccgctcac

SEQ ID NO: 441290 - DNA, 25 bp, Mus musculus
ccacacggctaagatttcggcattc

SEQ ID NO: 441291 - DNA, 25 bp, Mus musculus
cgcccttcaaaaaaccacgtctgtg

SEQ ID NO: 441292 - DNA, 25 bp, Mus musculus
accacgtctgtggatggtccgggct

SEQ ID NO: 441293 - DNA, 25 bp, Mus musculus
gtccgggcttcacgaccaatactga

SEQ ID NO: 441294 - DNA, 25 bp, Mus musculus
ccaatactgatcgacggccgagcca

SEQ ID NO: 441295 - DNA, 25 bp, Mus musculus
ggctcgcctgtcactcactgtttta

SEQ ID NO: 441296 - DNA, 25 bp, Mus musculus
cacggttacgctgcggaatgacgct

SEQ ID NO: 441297 - DNA, 25 bp, Mus musculus
tgagcactctctggttgccacacgg

SEQ ID NO: 441298 - DNA, 25 bp, Mus musculus
tacggttagaacactctgagcactc

SEQ ID NO: 441299 - DNA, 25 bp, Mus musculus
atgcacgctcccgtttaaggctacg

SEQ ID NO: 441300 - DNA, 25 bp, Mus musculus
ggtccctcaagcaagtgcgcatgca

SEQ ID NO: 441301 - DNA, 25 bp, Mus musculus
tatctactcgggttgggtccctcaa

SEQ ID NO: 441302 - DNA, 25 bp, Mus musculus
atgacgctgcggttgttatctactc

SEQ ID NO: 441303 - DNA, 25 bp, Mus musculus
ttccgtttacagcacggttacgctg

SEQ ID NO: 441304 - DNA, 25 bp, Mus musculus
aagtcaacatcttcccgcagtttcc

SEQ ID NO: 441305 - DNA, 25 bp, Mus musculus
gggctgaactggagtcacctcctgc

SEQ ID NO: 441306 - DNA, 25 bp, Mus musculus
ctgacacggactcagctagggctga

SEQ ID NO: 441307 - DNA, 25 bp, Mus musculus
gggagcccgaagtcctgacacggac

SEQ ID NO: 441308 - DNA, 25 bp, Mus musculus
taagctcccgatggcgctcgggcac

SEQ ID NO: 441309 - DNA, 25 bp, Mus musculus
agaatcctccggtaagctcccgatg

SEQ ID NO: 441310 - DNA, 25 bp, Mus musculus
tcaacaatcgctaagaatcctccgg

SEQ ID NO: 441311 - DNA, 25 bp, Mus musculus
ttcctcacatgtcgggtctcccggg

SEQ ID NO: 441312 - DNA, 25 bp, Mus musculus
tccgtcagtcagtccggaggagccc

SEQ ID NO: 441313 - DNA, 25 bp, Mus musculus
tcggcgtgtcctccgactcgagtct

SEQ ID NO: 441314 - DNA, 25 bp, Mus musculus
gcagtttcccacacgccgttccgcg

SEQ ID NO: 441315 - DNA, 25 bp, Mus musculus
ggggctaagtcaacatcttcccgca

SEQ ID NO: 441316 - DNA, 25 bp, Mus musculus
cggactcagctagggctgaactgga

SEQ ID NO: 441317 - DNA, 25 bp, Mus musculus
agcgaggccaagtccgtcagtcagt

SEQ ID NO: 441318 - DNA, 25 bp, Mus musculus
aagctccctggcctcggacagcgga

SEQ ID NO: 441319 - DNA, 25 bp, Mus musculus
ctcgctgatgctggagaagtcctcc

SEQ ID NO: 441320 - DNA, 25 bp, Mus musculus
ctccgcgcaggtgacagcggctgct

SEQ ID NO: 441321 - DNA, 25 bp, Mus musculus
cctcggacagcggactttgcgcttg

SEQ ID NO: 441322 - DNA, 25 bp, Mus musculus
atcttggcgtagagctcgctgatgc

SEQ ID NO: 441323 - DNA, 25 bp, Mus musculus
cggatggcgcgatctcgaacacgcc

SEQ ID NO: 441324 - DNA, 25 bp, Mus musculus
cgccagctgtgcgtggaacaccagc

SEQ ID NO: 441325 - DNA, 25 bp, Mus musculus
gaacaccagcttgcgtgccggagct

SEQ ID NO: 441326 - DNA, 25 bp, Mus musculus
ggacaccctggctgccactggatct

SEQ ID NO: 441327 - DNA, 25 bp, Mus musculus
agcctcgcggcctccttggacttgg

SEQ ID NO: 441328 - DNA, 25 bp, Mus musculus
cgcgcagtccaagcggcatcttgca

SEQ ID NO: 441329 - DNA, 25 bp, Mus musculus
ttgcaggtcccagggcgtggaccac

SEQ ID NO: 441330 - DNA, 25 bp, Mus musculus
tgctgggccaatggtagcagcgctt

SEQ ID NO: 441331 - DNA, 25 bp, Mus musculus
cgaacacgccggcaatcttggcgta

SEQ ID NO: 441332 - DNA, 25 bp, Mus musculus
gcggagtcgttaacgacgctttcaa

SEQ ID NO: 441333 - DNA, 25 bp, Mus musculus
gggtatggccgactactccacagtg

SEQ ID NO: 441334 - DNA, 25 bp, Mus musculus
cggaaacacggaaggacactagcta

SEQ ID NO: 441335 - DNA, 25 bp, Mus musculus
ttcttagcagttaaccgagagcggc

SEQ ID NO: 441336 - DNA, 25 bp, Mus musculus
cgctttcaaagatgccctgcagaga

SEQ ID NO: 441337 - DNA, 25 bp, Mus musculus
tcgtgcaagaatgtgatagagcctc

SEQ ID NO: 441338 - DNA, 25 bp, Mus musculus
ccctttacggcacgatggtcgtgca

SEQ ID NO: 441339 - DNA, 25 bp, Mus musculus
gggatttccgtctgccagtctccgc

SEQ ID NO: 441340 - DNA, 25 bp, Mus musculus
cagcgctgaaacatcgcgggatttc

SEQ ID NO: 441341 - DNA, 25 bp, Mus musculus
cgccaatcgcgcgtcagcgctgaaa

SEQ ID NO: 441342 - DNA, 25 bp, Mus musculus
agaccctactctcgtgggagcccgg

SEQ ID NO: 441343 - DNA, 25 bp, Mus musculus
aggaggcgcccagagagaccctact

SEQ ID NO: 441344 - DNA, 25 bp, Mus musculus
tagctagctccctgatccgcgacgg

SEQ ID NO: 441345 - DNA, 25 bp, Mus musculus
gcccgaggagatggcgtcttctcac

SEQ ID NO: 441346 - DNA, 25 bp, Mus musculus
cataaaagtcctggtgcagcggctc

SEQ ID NO: 441347 - DNA, 25 bp, Mus musculus
gggtgccacagtgaactcgcccgct

SEQ ID NO: 441348 - DNA, 25 bp, Mus musculus
cccatccgcaatttctttaaaatct

SEQ ID NO: 441349 - DNA, 25 bp, Mus musculus
tctttaaaatctcagccacagctgg

SEQ ID NO: 441350 - DNA, 25 bp, Mus musculus
tcagccacagctggcggagtccgca

SEQ ID NO: 441351 - DNA, 25 bp, Mus musculus
agctgttcccggaccaggccagtcc

SEQ ID NO: 441352 - DNA, 25 bp, Mus musculus
cacgtgttgggtgccacagtgaact

SEQ ID NO: 441353 - DNA, 25 bp, Mus musculus
ccggcggagagcgtacacacattcg

SEQ ID NO: 441354 - DNA, 25 bp, Mus musculus
agcgtacacacattcggctcatgga

SEQ ID NO: 441355 - DNA, 25 bp, Mus musculus
attcggctcatggaaacactctccc

SEQ ID NO: 441356 - DNA, 25 bp, Mus musculus
ccgcccagatgcaggtggagcagaa

SEQ ID NO: 441357 - DNA, 25 bp, Mus musculus
ccagcagcaagtttccataaaagtc

SEQ ID NO: 441358 - DNA, 25 bp, Mus musculus
ggtgcagcggctcccgcattccaga

SEQ ID NO: 441359 - DNA, 25 bp, Mus musculus
tctggccgagcgcaggccaccagga

SEQ ID NO: 441360 - DNA, 25 bp, Mus musculus
gaggggctacgtgcgaggccgctcc

SEQ ID NO: 441361 - DNA, 25 bp, Mus musculus
agcacccaggcagctgctaaggtcc

SEQ ID NO: 441362 - DNA, 25 bp, Mus musculus
gtgacgggcgtcatcagcacccagg

SEQ ID NO: 441363 - DNA, 25 bp, Mus musculus
acgggcgtcatcagcacccaggcag

SEQ ID NO: 441364 - DNA, 25 bp, Mus musculus
ggcgtcatcagcacccaggcagctg

SEQ ID NO: 441365 - DNA, 25 bp, Mus musculus
gtcatcagcacccaggcagctgcta

SEQ ID NO: 441366 - DNA, 25 bp, Mus musculus
tcagcacccaggcagctgctaaggt

SEQ ID NO: 441367 - DNA, 25 bp, Mus musculus
cccgcgctccgagcggtgtggtccc

SEQ ID NO: 441368 - DNA, 25 bp, Mus musculus
gcgcccgccagcacctgagcctcct

SEQ ID NO: 441369 - DNA, 25 bp, Mus musculus
tgagcctcctcggtctcccagccgc

SEQ ID NO: 441370 - DNA, 25 bp, Mus musculus
gccgcagcccgcacctagcagcctc

SEQ ID NO: 441371 - DNA, 25 bp, Mus musculus
acctagcagcctctggctgcgggag

SEQ ID NO: 441372 - DNA, 25 bp, Mus musculus
ctgcgggaggcggagttcttccggg

SEQ ID NO: 441373 - DNA, 25 bp, Mus musculus
tcacgacgcaaaggtaaggaaagtg

SEQ ID NO: 441374 - DNA, 25 bp, Mus musculus
tcccagtggcgtgtcttcggccgac

SEQ ID NO: 441375 - DNA, 25 bp, Mus musculus
gccgaagtggtgtacacgtcagctc

SEQ ID NO: 441376 - DNA, 25 bp, Mus musculus
cacgtcagctcaggttgcctgtcta

SEQ ID NO: 441377 - DNA, 25 bp, Mus musculus
tagcacaggcctagcggagaaccga

SEQ ID NO: 441378 - DNA, 25 bp, Mus musculus
ccgcgctgcggaaccgttttgcggc

SEQ ID NO: 441379 - DNA, 25 bp, Mus musculus
aaaccgaggtgtcaccgtcccagtg

SEQ ID NO: 441380 - DNA, 25 bp, Mus musculus
cgacgcagcgtttgggtcgagtcca

SEQ ID NO: 441381 - DNA, 25 bp, Mus musculus
tcgagtccagtcgtagcgtctgtcg

SEQ ID NO: 441382 - DNA, 25 bp, Mus musculus
ggtcgcagcttttgttcgggtcaca

SEQ ID NO: 441383 - DNA, 25 bp, Mus musculus
ttcgggtcacatttccacggtgtga

SEQ ID NO: 441384 - DNA, 25 bp, Mus musculus
gtgtgagtgctttcccaagcgctca

SEQ ID NO: 441385 - DNA, 25 bp, Mus musculus
caagcgctcaagcatttttcaaata

SEQ ID NO: 441386 - DNA, 25 bp, Mus musculus
caaaatgctcctcgtcggaaaattc

SEQ ID NO: 441387 - DNA, 25 bp, Mus musculus
tcattgctacgaacgggaaaaccga

SEQ ID NO: 441388 - DNA, 25 bp, Mus musculus
actctcgcgggacctggttggcaga

SEQ ID NO: 441389 - DNA, 25 bp, Mus musculus
ggaccagtaactcttttcctgcagg

SEQ ID NO: 441390 - DNA, 25 bp, Mus musculus
tcccagcgtctcagagccgaggaag

SEQ ID NO: 441391 - DNA, 25 bp, Mus musculus
agatctccggactctcgcgggacct

SEQ ID NO: 441392 - DNA, 25 bp, Mus musculus
tcggtatcgcgagatctccggactc

SEQ ID NO: 441393 - DNA, 25 bp, Mus musculus
ccagcgggtcggtatcgcgagatct

SEQ ID NO: 441394 - DNA, 25 bp, Mus musculus
gtcccgaagtagtgattagcttccc

SEQ ID NO: 441395 - DNA, 25 bp, Mus musculus
tcaaagtcccgaagtagtgattagc

SEQ ID NO: 441396 - DNA, 25 bp, Mus musculus
cgcggcctcccagtgcgaggacgaa

SEQ ID NO: 441397 - DNA, 25 bp, Mus musculus
gaaggcttgcctctcctcccgtttg

SEQ ID NO: 441398 - DNA, 25 bp, Mus musculus
ctcagacgactcagaggaggaatcc

SEQ ID NO: 441399 - DNA, 25 bp, Mus musculus
ctgagtttggcgtcccgcctttcct

SEQ ID NO: 441400 - DNA, 25 bp, Mus musculus
cccacgcgagaggtaagcgggatcc

SEQ ID NO: 441401 - DNA, 25 bp, Mus musculus
actcttttcctgcaggcaagttgga

SEQ ID NO: 441402 - DNA, 25 bp, Mus musculus
acttgcagggcggttgaaccctgcc

SEQ ID NO: 441403 - DNA, 25 bp, Mus musculus
ccttcctaggactcggggtgacgct

SEQ ID NO: 441404 - DNA, 25 bp, Mus musculus
ggattactcccgcagtaaccaaaga

SEQ ID NO: 441405 - DNA, 25 bp, Mus musculus
caccgccgacgtctgtggcggacga

SEQ ID NO: 441406 - DNA, 25 bp, Mus musculus
gagcgggaagccaccgccgacgtct

SEQ ID NO: 441407 - DNA, 25 bp, Mus musculus
gacgaggcttcccttcctaggactc

SEQ ID NO: 441408 - DNA, 25 bp, Mus musculus
gtcgcgtcgcgacgaggcttccctt

SEQ ID NO: 441409 - DNA, 25 bp, Mus musculus
agcgcacgactcgtggaggccactg

SEQ ID NO: 441410 - DNA, 25 bp, Mus musculus
ctacgccagggactgaggagtgcca

SEQ ID NO: 441411 - DNA, 25 bp, Mus musculus
gctactcacgctacgccagggactg

SEQ ID NO: 441412 - DNA, 25 bp, Mus musculus
tggcttttggctactcacgctacgc

SEQ ID NO: 441413 - DNA, 25 bp, Mus musculus
gaggttggtggcttttggctactca

SEQ ID NO: 441414 - DNA, 25 bp, Mus musculus
cccgcagtaaccaaagacaggaggc

SEQ ID NO: 441415 - DNA, 25 bp, Mus musculus
ggacttcccggcacttgcgggcact

SEQ ID NO: 441416 - DNA, 25 bp, Mus musculus
tccgcctcttcacgggagcagtagg

SEQ ID NO: 441417 - DNA, 25 bp, Mus musculus
agtcgtattcctccagcaccttgaa

SEQ ID NO: 441418 - DNA, 25 bp, Mus musculus
cagcgaacgcgctccagtcgtattc

SEQ ID NO: 441419 - DNA, 25 bp, Mus musculus
cgcacgccctcgaggaagagcgcgt

SEQ ID NO: 441420 - DNA, 25 bp, Mus musculus
tcgcggactttctggcgtaggctaa

SEQ ID NO: 441421 - DNA, 25 bp, Mus musculus
gggcccagctccagcgtgagcacgt

SEQ ID NO: 441422 - DNA, 25 bp, Mus musculus
agcctgtgcagcctccgcgaagagc

SEQ ID NO: 441423 - DNA, 25 bp, Mus musculus
attaggtactaaccacacgtgaccg

SEQ ID NO: 441424 - DNA, 25 bp, Mus musculus
cttcccagcgccagattaggtacta

SEQ ID NO: 441425 - DNA, 25 bp, Mus musculus
tgaccacactgatgaggcccactgg

SEQ ID NO: 441426 - DNA, 25 bp, Mus musculus
cccagctgtagaaaggcggagcctg

SEQ ID NO: 441427 - DNA, 25 bp, Mus musculus
taccgtactggcgtcggtagctgtg

SEQ ID NO: 441428 - DNA, 25 bp, Mus musculus
cagaatggctacaccgtcgcggact

SEQ ID NO: 441429 - DNA, 25 bp, Mus musculus
aggctaaggcgccaactctcggtga

SEQ ID NO: 441430 - DNA, 25 bp, Mus musculus
tcatggctttggtgttttgctcctc

SEQ ID NO: 441431 - DNA, 25 bp, Mus musculus
ccgctggacacatcgaggtaggcat

SEQ ID NO: 441432 - DNA, 25 bp, Mus musculus
agcggcagcgctgctttacggcact

SEQ ID NO: 441433 - DNA, 25 bp, Mus musculus
ccctttgctcttcggggcgtgagaa

SEQ ID NO: 441434 - DNA, 25 bp, Mus musculus
gcttcctcactctgcgggtggctac

SEQ ID NO: 441435 - DNA, 25 bp, Mus musculus
tacgatgctgttaccagcgatttcc

SEQ ID NO: 441436 - DNA, 25 bp, Mus musculus
ttggcgctcttgtctctcggcagct

SEQ ID NO: 441437 - DNA, 25 bp, Mus musculus
taggcatcggtgtctgttgaggacc

SEQ ID NO: 441438 - DNA, 25 bp, Mus musculus
tgtgggattcaggaccgtccgtcct

SEQ ID NO: 441439 - DNA, 25 bp, Mus musculus
gtcctgaggacagggaccggacaca

SEQ ID NO: 441440 - DNA, 25 bp, Mus musculus
ggacacagccttttagaacgccctg

SEQ ID NO: 441441 - DNA, 25 bp, Mus musculus
cggtcctctgctcctgtgacaggca

SEQ ID NO: 441442 - DNA, 25 bp, Mus musculus
ggctgcaggacgtctggtttcttta

SEQ ID NO: 441443 - DNA, 25 bp, Mus musculus
acgccctgttaagagtgcgaagcca

SEQ ID NO: 441444 - DNA, 25 bp, Mus musculus
caccgccgagctgttaccttgagga

SEQ ID NO: 441445 - DNA, 25 bp, Mus musculus
ggatcgaccctgtggctcgctgcac

SEQ ID NO: 441446 - DNA, 25 bp, Mus musculus
gtctcccacccagatgccttggcca

SEQ ID NO: 441447 - DNA, 25 bp, Mus musculus
gggctgccctgacccaagtctcgga

SEQ ID NO: 441448 - DNA, 25 bp, Mus musculus
cccacattcccgcagagcgagccgg

SEQ ID NO: 441449 - DNA, 25 bp, Mus musculus
aggccatggcgctatggatcgaccc

SEQ ID NO: 441450 - DNA, 25 bp, Mus musculus
ttaccttgaggatgcaggccatggc

SEQ ID NO: 441451 - DNA, 25 bp, Mus musculus
aaaggaagccgacgccaggaagaga

SEQ ID NO: 441452 - DNA, 25 bp, Mus musculus
tgcccaacgcacattacatagtctc

SEQ ID NO: 441453 - DNA, 25 bp, Mus musculus
gcaaggagtctgtgcccaacgcaca

SEQ ID NO: 441454 - DNA, 25 bp, Mus musculus
cagtgcaggcaaggagtctgtgccc

SEQ ID NO: 441455 - DNA, 25 bp, Mus musculus
tatacccatcattcggcacgccgcc

SEQ ID NO: 441456 - DNA, 25 bp, Mus musculus
agcaccctctgctccgcctgctata

SEQ ID NO: 441457 - DNA, 25 bp, Mus musculus
tagtcacgtgccctccgtgcagccc

SEQ ID NO: 441458 - DNA, 25 bp, Mus musculus
agggttgtgccggtttattctcatc

SEQ ID NO: 441459 - DNA, 25 bp, Mus musculus
gcgtggcttcgagcactccaaggct

SEQ ID NO: 441460 - DNA, 25 bp, Mus musculus
tggcgccttccgtactcggcctgga

SEQ ID NO: 441461 - DNA, 25 bp, Mus musculus
atggggcatccctccgcgacggcgt

SEQ ID NO: 441462 - DNA, 25 bp, Mus musculus
actggaaagcgatgcagcctcctgc

SEQ ID NO: 441463 - DNA, 25 bp, Mus musculus
ggcctttctgactcccaaggttctg

SEQ ID NO: 441464 - DNA, 25 bp, Mus musculus
tcccaaggttctgcgcgcgtggctt

SEQ ID NO: 441465 - DNA, 25 bp, Mus musculus
caccgctgacaaggcgggaggctaa

SEQ ID NO: 441466 - DNA, 25 bp, Mus musculus
gcatgcgcagtgctgtaatcgcgca

SEQ ID NO: 441467 - DNA, 25 bp, Mus musculus
cgcaggcgcaggaacaagcagcaca

SEQ ID NO: 441468 - DNA, 25 bp, Mus musculus
caagcagcacatgatgcacacagcg

SEQ ID NO: 441469 - DNA, 25 bp, Mus musculus
tcaggggtgagcagcgagtttctca

SEQ ID NO: 441470 - DNA, 25 bp, Mus musculus
tcacctttgcgtccagggttgtgcc

SEQ ID NO: 441471 - DNA, 25 bp, Mus musculus
agcgagtttctcacctttgcgtcca

SEQ ID NO: 441472 - DNA, 25 bp, Mus musculus
cccacaagaatgatcgccttgcagg

SEQ ID NO: 441473 - DNA, 25 bp, Mus musculus
cggtcgcacacctgcctgaaggact

SEQ ID NO: 441474 - DNA, 25 bp, Mus musculus
caagcggcagtccaagtatggccta

SEQ ID NO: 441475 - DNA, 25 bp, Mus musculus
tccgcggataagatcccaggcctcg

SEQ ID NO: 441476 - DNA, 25 bp, Mus musculus
gcctgaaggactccgcggtcacgat

SEQ ID NO: 441477 - DNA, 25 bp, Mus musculus
ggccgcgatttagccggtcgcacac

SEQ ID NO: 441478 - DNA, 25 bp, Mus musculus
tgtccgaccgccgaaagactgaagc

SEQ ID NO: 441479 - DNA, 25 bp, Mus musculus
gcagcgacggtgctctcaccatgtc

SEQ ID NO: 441480 - DNA, 25 bp, Mus musculus
aatgatcgccttgcaggcccgcctg

SEQ ID NO: 441481 - DNA, 25 bp, Mus musculus
tccaagtatggcctaaggaggccga

SEQ ID NO: 441482 - DNA, 25 bp, Mus musculus
gccatacacagctcaagcggcagtc

SEQ ID NO: 441483 - DNA, 25 bp, Mus musculus
tgcagaaaacgctgagccatacaca

SEQ ID NO: 441484 - DNA, 25 bp, Mus musculus
cccaggcctcgagaagtgcagaaaa

SEQ ID NO: 441485 - DNA, 25 bp, Mus musculus
cgcggtcacgatgcagccggctacg

SEQ ID NO: 441486 - DNA, 25 bp, Mus musculus
cgggtcaaagtctgcagacctcggg

SEQ ID NO: 441487 - DNA, 25 bp, Mus musculus
gccgctgccatgatggctcctcgat

SEQ ID NO: 441488 - DNA, 25 bp, Mus musculus
gccacgcctgcaggggtcagagccc

SEQ ID NO: 441489 - DNA, 25 bp, Mus musculus
tcagagcccggagatcagtgaggga

SEQ ID NO: 441490 - DNA, 25 bp, Mus musculus
accacccggtcacccgctcaccctg

SEQ ID NO: 441491 - DNA, 25 bp, Mus musculus
tcaccctgcagcctctgcggaacgc

SEQ ID NO: 441492 - DNA, 25 bp, Mus musculus
tgcggaacgccgctgccatgatggc

SEQ ID NO: 441493 - DNA, 25 bp, Mus musculus
gccatgatggctcctcgatctgctg

SEQ ID NO: 441494 - DNA, 25 bp, Mus musculus
tgatggctcctcgatctgctgcctc

SEQ ID NO: 441495 - DNA, 25 bp, Mus musculus
tcgatctgctgcctccgaccacctc

SEQ ID NO: 441496 - DNA, 25 bp, Mus musculus
gaccacctccgtgcagcaagcaaaa

SEQ ID NO: 441497 - DNA, 25 bp, Mus musculus
cacctccgtgcagcaagcaaaacgg

SEQ ID NO: 441498 - DNA, 25 bp, Mus musculus
ccttagactctaggggtgcggaggc

SEQ ID NO: 441499 - DNA, 25 bp, Mus musculus
ccgtgcagcaagcaaaacggacggg

SEQ ID NO: 441500 - DNA, 25 bp, Mus musculus
ctgcgcggcacaggaggctctgcgc

SEQ ID NO: 441501 - DNA, 25 bp, Mus musculus
cgctaccaactgtcgctggacgagg

SEQ ID NO: 441502 - DNA, 25 bp, Mus musculus
accaactgtcgctggacgagggtgc

SEQ ID NO: 441503 - DNA, 25 bp, Mus musculus
ccggcgctgcgcctccagtagaggc

SEQ ID NO: 441504 - DNA, 25 bp, Mus musculus
tccagtagaggcgccgcacagcaga

SEQ ID NO: 441505 - DNA, 25 bp, Mus musculus
cccgcgcagcagagccgagtggagt

SEQ ID NO: 441506 - DNA, 25 bp, Mus musculus
agtggagcgcgcaacctgaccgccg

SEQ ID NO: 441507 - DNA, 25 bp, Mus musculus
gccgccgcctggcatatgccatcac

SEQ ID NO: 441508 - DNA, 25 bp, Mus musculus
gcatatgccatcaccgccacaaaga

SEQ ID NO: 441509 - DNA, 25 bp, Mus musculus
tcaccgccacaaagagctcgctgag

SEQ ID NO: 441510 - DNA, 25 bp, Mus musculus
caaagagctcgctgagctcaggcga

SEQ ID NO: 441511 - DNA, 25 bp, Mus musculus
tcgctgagctcaggcgacggagctc

SEQ ID NO: 441512 - DNA, 25 bp, Mus musculus
ctgagctcaggcgacggagctcccg

SEQ ID NO: 441513 - DNA, 25 bp, Mus musculus
tcagccgctaccaactgtcgctgga

SEQ ID NO: 441514 - DNA, 25 bp, Mus musculus
tcctccgacatgagcccggggcact

SEQ ID NO: 441515 - DNA, 25 bp, Mus musculus
acagccgagcactggcctttcacgt

SEQ ID NO: 441516 - DNA, 25 bp, Mus musculus
gctccctcgggattcacctgcagga

SEQ ID NO: 441517 - DNA, 25 bp, Mus musculus
gggcagcccaaggactgtcctccgt

SEQ ID NO: 441518 - DNA, 25 bp, Mus musculus
tggggttcccagaccagcaggaccc

SEQ ID NO: 441519 - DNA, 25 bp, Mus musculus
cacggggcagcccaaggactgtcct

SEQ ID NO: 441520 - DNA, 25 bp, Mus musculus
ccgcgctcttgaagggcgcgcacga

SEQ ID NO: 441521 - DNA, 25 bp, Mus musculus
acccagctaataaccggcctcggtg

SEQ ID NO: 441522 - DNA, 25 bp, Mus musculus
ctcggtgcacaaagcgattgctttc

SEQ ID NO: 441523 - DNA, 25 bp, Mus musculus
agcgattgctttctagacgtcaatc

SEQ ID NO: 441524 - DNA, 25 bp, Mus musculus
tctagacgtcaatcacccgggagcg

SEQ ID NO: 441525 - DNA, 25 bp, Mus musculus
tcaatcacccgggagcggggaacac

SEQ ID NO: 441526 - DNA, 25 bp, Mus musculus
cacctgcaggaacagccgagcactg

SEQ ID NO: 441527 - DNA, 25 bp, Mus musculus
ccatccgcactgtggggttcccaga

SEQ ID NO: 441528 - DNA, 25 bp, Mus musculus
cataaaatgcgagcacccacgggtc

SEQ ID NO: 441529 - DNA, 25 bp, Mus musculus
tcagcagagcgcagccattggtatc

SEQ ID NO: 441530 - DNA, 25 bp, Mus musculus
ttcaccttatccgtggcaagagcca

SEQ ID NO: 441531 - DNA, 25 bp, Mus musculus
tgtccctttctaagagcgggcgggc

SEQ ID NO: 441532 - DNA, 25 bp, Mus musculus
ggctcgcctcgtactgcgaaatttg

SEQ ID NO: 441533 - DNA, 25 bp, Mus musculus
ttgcctccggagtaggtgacagctt

SEQ ID NO: 441534 - DNA, 25 bp, Mus musculus
ggaaccgagttccaccataaaatgc

SEQ ID NO: 441535 - DNA, 25 bp, Mus musculus
ggccctgctctccaacagtttagga

SEQ ID NO: 441536 - DNA, 25 bp, Mus musculus
gaagccagcactactctgcccatgt

SEQ ID NO: 441537 - DNA, 25 bp, Mus musculus
cgcgtcttcgtggacagaaagcatc

SEQ ID NO: 441538 - DNA, 25 bp, Mus musculus
cattggtatctggtgccctgagaca

SEQ ID NO: 441539 - DNA, 25 bp, Mus musculus
tcgcttttgcgtccctttgtctcct

SEQ ID NO: 441540 - DNA, 25 bp, Mus musculus
cgcgaacagcccgtcacgtagaata

SEQ ID NO: 441541 - DNA, 25 bp, Mus musculus
tctgtcttccgaaagctccaggtga

SEQ ID NO: 441542 - DNA, 25 bp, Mus musculus
tcttcccgcgagttcaggagctcca

SEQ ID NO: 441543 - DNA, 25 bp, Mus musculus
agggacttggagactcgagctcctc

SEQ ID NO: 441544 - DNA, 25 bp, Mus musculus
tcacccggaggacgcattagcattg

SEQ ID NO: 441545 - DNA, 25 bp, Mus musculus
cccgtccagaaggaggatgcgccct

SEQ ID NO: 441546 - DNA, 25 bp, Mus musculus
catagcgacagtgattgggttagcg

SEQ ID NO: 441547 - DNA, 25 bp, Mus musculus
gccagaccgtacaggcgtaaaccga

SEQ ID NO: 441548 - DNA, 25 bp, Mus musculus
ttcgggcgcccatctcatagcgaca

SEQ ID NO: 441549 - DNA, 25 bp, Mus musculus
gtccacactgcccttgcggctaagg

SEQ ID NO: 441550 - DNA, 25 bp, Mus musculus
taaggtccgccttgctcagactctg

SEQ ID NO: 441551 - DNA, 25 bp, Mus musculus
cgaactccgcgctacggtccatgag

SEQ ID NO: 441552 - DNA, 25 bp, Mus musculus
ttctgctctggaatgcgccttcttc

SEQ ID NO: 441553 - DNA, 25 bp, Mus musculus
gcgcagccatattgccgccacggtg

SEQ ID NO: 441554 - DNA, 25 bp, Mus musculus
cccattggcgcaaccaggagcaaga

SEQ ID NO: 441555 - DNA, 25 bp, Mus musculus
cgcaggagctggtggtgaaaaactc

SEQ ID NO: 441556 - DNA, 25 bp, Mus musculus
gagaactcagttccgccttggtacc

SEQ ID NO: 441557 - DNA, 25 bp, Mus musculus
tctgcgcagtttccgcagggtggct

SEQ ID NO: 441558 - DNA, 25 bp, Mus musculus
cggagagacgccatggccgacttcc

SEQ ID NO: 441559 - DNA, 25 bp, Mus musculus
acttccgggagcacacttagcacgc

SEQ ID NO: 441560 - DNA, 25 bp, Mus musculus
ggagcacacttagcacgcacgcgca

SEQ ID NO: 441561 - DNA, 25 bp, Mus musculus
cctggaagcgccctgagacttgaaa

SEQ ID NO: 441562 - DNA, 25 bp, Mus musculus
cttgaaaagctaggatggcgtgagc

SEQ ID NO: 441563 - DNA, 25 bp, Mus musculus
tgagcgtgcgcaagcggcgtttcct

SEQ ID NO: 441564 - DNA, 25 bp, Mus musculus
gcgtttcctgggcaacgatctgtgg

SEQ ID NO: 441565 - DNA, 25 bp, Mus musculus
gagctctgggttcctgccttaccgt

SEQ ID NO: 441566 - DNA, 25 bp, Mus musculus
gttcctgccttaccgtgtctgacaa

SEQ ID NO: 441567 - DNA, 25 bp, Mus musculus
cgtgtctgacaacccgcggtgcgac

SEQ ID NO: 441568 - DNA, 25 bp, Mus musculus
cagctcagaaaatctgcgcagtttc

SEQ ID NO: 441569 - DNA, 25 bp, Mus musculus
ggtacctctcagctcagaaaatctg

SEQ ID NO: 441570 - DNA, 25 bp, Mus musculus
attcatagggaacgtggcatctggc

SEQ ID NO: 441571 - DNA, 25 bp, Mus musculus
ttttaggccggcgataaataattca

SEQ ID NO: 441572 - DNA, 25 bp, Mus musculus
ttaggccggcgataaataattcata

SEQ ID NO: 441573 - DNA, 25 bp, Mus musculus
ggccaaatcgagcaccacgcactct

SEQ ID NO: 441574 - DNA, 25 bp, Mus musculus
tggcggccaaatcgagcaccacgca

SEQ ID NO: 441575 - DNA, 25 bp, Mus musculus
cggcgataaataattcatagggaac

SEQ ID NO: 441576 - DNA, 25 bp, Mus musculus
cgcgccacgcctcctggcggccaaa

SEQ ID NO: 441577 - DNA, 25 bp, Mus musculus
tagggaacgtggcatctggctgccc

SEQ ID NO: 441578 - DNA, 25 bp, Mus musculus
cgcgagcaccgaagagccaccatca

SEQ ID NO: 441579 - DNA, 25 bp, Mus musculus
gccaccatcactcgccgctcaagga

SEQ ID NO: 441580 - DNA, 25 bp, Mus musculus
tcgccgctcaaggacactcgcgatg

SEQ ID NO: 441581 - DNA, 25 bp, Mus musculus
cgctcaaggacactcgcgatgcggc

SEQ ID NO: 441582 - DNA, 25 bp, Mus musculus
ctcaaggacactcgcgatgcggcgg

SEQ ID NO: 441583 - DNA, 25 bp, Mus musculus
ggccggcgataaataattcataggg

SEQ ID NO: 441584 - DNA, 25 bp, Mus musculus
tcagctctggcactccagaggccta

SEQ ID NO: 441585 - DNA, 25 bp, Mus musculus
ccggttacgacatcagtcaccagca

SEQ ID NO: 441586 - DNA, 25 bp, Mus musculus
acgggcttggcacggaaatacttgc

SEQ ID NO: 441587 - DNA, 25 bp, Mus musculus
ccctgcaagagccaagagccgaggg

SEQ ID NO: 441588 - DNA, 25 bp, Mus musculus
gacatcagtcaccagcaagtcactc

SEQ ID NO: 441589 - DNA, 25 bp, Mus musculus
cacggaaatacttgccgcgttcagc

SEQ ID NO: 441590 - DNA, 25 bp, Mus musculus
gtagctgtgcgcttaggaccacaca

SEQ ID NO: 441591 - DNA, 25 bp, Mus musculus
agcgctacccaagaatgcggccctc

SEQ ID NO: 441592 - DNA, 25 bp, Mus musculus
tgagcatagcatcacagcgctaccc

SEQ ID NO: 441593 - DNA, 25 bp, Mus musculus
gtcgccaactgagcatagcatcaca

SEQ ID NO: 441594 - DNA, 25 bp, Mus musculus
acctgaagtttcaagtcgccaactg

SEQ ID NO: 441595 - DNA, 25 bp, Mus musculus
tccagaggcctacccgggaacctga

SEQ ID NO: 441596 - DNA, 25 bp, Mus musculus
atacttgccgcgttcagctctggca

SEQ ID NO: 441597 - DNA, 25 bp, Mus musculus
tcactaacacgaagtgcgcatgcgc

SEQ ID NO: 441598 - DNA, 25 bp, Mus musculus
acgcgccctgcacactccatctccc

SEQ ID NO: 441599 - DNA, 25 bp, Mus musculus
tccctctcacaagtggacactctgt

SEQ ID NO: 441600 - DNA, 25 bp, Mus musculus
gcacactccatctccctctcacaag

SEQ ID NO: 441601 - DNA, 25 bp, Mus musculus
gccctgcacactccatctccctctc

SEQ ID NO: 441602 - DNA, 25 bp, Mus musculus
gcgccctgcacactccatctccctc

SEQ ID NO: 441603 - DNA, 25 bp, Mus musculus
cgcgccctgcacactccatctccct

SEQ ID NO: 441604 - DNA, 25 bp, Mus musculus
cacgcgccctgcacactccatctcc

SEQ ID NO: 441605 - DNA, 25 bp, Mus musculus
gcacgcgccctgcacactccatctc

SEQ ID NO: 441606 - DNA, 25 bp, Mus musculus
cagcacgcgccctgcacactccatc

SEQ ID NO: 441607 - DNA, 25 bp, Mus musculus
ccctctcacaagtggacactctgtg

SEQ ID NO: 441608 - DNA, 25 bp, Mus musculus
cactccatctccctctcacaagtgg

SEQ ID NO: 441609 - DNA, 25 bp, Mus musculus
atccctcccgttgcgcctgcgtgtc

SEQ ID NO: 441610 - DNA, 25 bp, Mus musculus
catccctcccgttgcgcctgcgtgt

SEQ ID NO: 441611 - DNA, 25 bp, Mus musculus
ccagcacgcgccctgcacactccat

SEQ ID NO: 441612 - DNA, 25 bp, Mus musculus
ggcggactcacacacgcactagctt

SEQ ID NO: 441613 - DNA, 25 bp, Mus musculus
ttcggtcggcatgcccgaatcacta

SEQ ID NO: 441614 - DNA, 25 bp, Mus musculus
ttctccagtacgcacaggcggactc

SEQ ID NO: 441615 - DNA, 25 bp, Mus musculus
cgcacacacactcatgcgcaagtta

SEQ ID NO: 441616 - DNA, 25 bp, Mus musculus
ggcatgcccgaatcactatactgtc

SEQ ID NO: 441617 - DNA, 25 bp, Mus musculus
actagctttcggtcggcatgcccga

SEQ ID NO: 441618 - DNA, 25 bp, Mus musculus
cacgcactagctttcggtcggcatg

SEQ ID NO: 441619 - DNA, 25 bp, Mus musculus
tccagtacgcacaggcggactcaca

SEQ ID NO: 441620 - DNA, 25 bp, Mus musculus
gggcaggcgttctccagtacgcaca

SEQ ID NO: 441621 - DNA, 25 bp, Mus musculus
cacagagaagggcaggcgttctcca

SEQ ID NO: 441622 - DNA, 25 bp, Mus musculus
tcaagacgcacagagaagggcaggc

SEQ ID NO: 441623 - DNA, 25 bp, Mus musculus
gcaagttagtatcaagacgcacaga

SEQ ID NO: 441624 - DNA, 25 bp, Mus musculus
ctcatgcgcaagttagtatcaagac

SEQ ID NO: 441625 - DNA, 25 bp, Mus musculus
tactgtccccgtaaagcagcagcgc

SEQ ID NO: 441626 - DNA, 25 bp, Mus musculus
ccgtggacaacatgctggtgaggaa

SEQ ID NO: 441627 - DNA, 25 bp, Mus musculus
tctgctcgcagcctcgcaggacggt

SEQ ID NO: 441628 - DNA, 25 bp, Mus musculus
ctagacctcggcgtatcctcagtcg

SEQ ID NO: 441629 - DNA, 25 bp, Mus musculus
ggcgtatcctcagtcgccctagctt

SEQ ID NO: 441630 - DNA, 25 bp, Mus musculus
ctctttttgatctatctctttcgct

SEQ ID NO: 441631 - DNA, 25 bp, Mus musculus
tcctccatccctgggcggggttgct

SEQ ID NO: 441632 - DNA, 25 bp, Mus musculus
ttgctacggaaacggccgcttggca

SEQ ID NO: 441633 - DNA, 25 bp, Mus musculus
tgtgcggccgccagggattagccac

SEQ ID NO: 441634 - DNA, 25 bp, Mus musculus
ggattagccacgctccggacgcggc

SEQ ID NO: 441635 - DNA, 25 bp, Mus musculus
tggttatcgggcagcctcgccagca

SEQ ID NO: 441636 - DNA, 25 bp, Mus musculus
tggcaggcacggacatggtgctcct

SEQ ID NO: 441637 - DNA, 25 bp, Mus musculus
cgcttgttgctcgaaccagtggctg

SEQ ID NO: 441638 - DNA, 25 bp, Mus musculus
gccgggcagagcgtggacttccctt

SEQ ID NO: 441639 - DNA, 25 bp, Mus musculus
gcttctgagcctgtgctcttgcctc

SEQ ID NO: 441640 - DNA, 25 bp, Mus musculus
ccgaagcgaagcagagcctcaggac

SEQ ID NO: 441641 - DNA, 25 bp, Mus musculus
ctcaggagctcggtaaggccgaagc

SEQ ID NO: 441642 - DNA, 25 bp, Mus musculus
cagtgacttggcttttctcatcctc

SEQ ID NO: 441643 - DNA, 25 bp, Mus musculus
cttcggcctgcggagaactcggctg

SEQ ID NO: 441644 - DNA, 25 bp, Mus musculus
cctttctctagggtccttcggcctg

SEQ ID NO: 441645 - DNA, 25 bp, Mus musculus
ttctcatcctcctgccgagaggcag

SEQ ID NO: 441646 - DNA, 25 bp, Mus musculus
ctgctggcgtccaagatgtcgacca

SEQ ID NO: 441647 - DNA, 25 bp, Mus musculus
gatgtcgaccaagaatttccgagtc

SEQ ID NO: 441648 - DNA, 25 bp, Mus musculus
atttccgagtcagtgacggggactg

SEQ ID NO: 441649 - DNA, 25 bp, Mus musculus
ggggactggatctgccctgacaaga

SEQ ID NO: 441650 - DNA, 25 bp, Mus musculus
tctgccctgacaagaagtgagcgtg

SEQ ID NO: 441651 - DNA, 25 bp, Mus musculus
ctgagctcacggttcagtggccctg

SEQ ID NO: 441652 - DNA, 25 bp, Mus musculus
gtgctttcgggcctgcgatccgtcc

SEQ ID NO: 441653 - DNA, 25 bp, Mus musculus
cgcgcaagcccgtgggctatcgagc

SEQ ID NO: 441654 - DNA, 25 bp, Mus musculus
gcgcacagcaacctgtcaagtacta

SEQ ID NO: 441655 - DNA, 25 bp, Mus musculus
gtgcaccttcttcgggctaaccatg

SEQ ID NO: 441656 - DNA, 25 bp, Mus musculus
ccggagcactctgctgaagcgcaca

SEQ ID NO: 441657 - DNA, 25 bp, Mus musculus
tactaccgacgactgcggctccgtg

SEQ ID NO: 441658 - DNA, 25 bp, Mus musculus
aagaagtctttcctgctgtgcattg

SEQ ID NO: 441659 - DNA, 25 bp, Mus musculus
tcaccgacttagtggggcagctcct

SEQ ID NO: 441660 - DNA, 25 bp, Mus musculus
ggtggtcatcctcgtgtacctgtca

SEQ ID NO: 441661 - DNA, 25 bp, Mus musculus
ggctatcctcgctcctggtggccag

SEQ ID NO: 441662 - DNA, 25 bp, Mus musculus
tggtatgccagccacatgaagactc

SEQ ID NO: 441663 - DNA, 25 bp, Mus musculus
ctctggtggtgacctttgcctgcaa

SEQ ID NO: 441664 - DNA, 25 bp, Mus musculus
tttgcctgcaacctggcgaccatca

SEQ ID NO: 441665 - DNA, 25 bp, Mus musculus
atcaaagccctggtgtcccgctgtc

SEQ ID NO: 441666 - DNA, 25 bp, Mus musculus
cgcccagtggggcagaatcaccacg

SEQ ID NO: 441667 - DNA, 25 bp, Mus musculus
ccatgacagtgttcgggctatcctc

SEQ ID NO: 441668 - DNA, 25 bp, Mus musculus
agctagagttcgtaactgccgttga

SEQ ID NO: 441669 - DNA, 25 bp, Mus musculus
tttacgaaggcccagagcaccaggt

SEQ ID NO: 441670 - DNA, 25 bp, Mus musculus
agctctgagtctgggtctgaattca

SEQ ID NO: 441671 - DNA, 25 bp, Mus musculus
ggtgagctttgcctaatttccgtcc

SEQ ID NO: 441672 - DNA, 25 bp, Mus musculus
ggaccctgacccaagcgcagaagcg

SEQ ID NO: 441673 - DNA, 25 bp, Mus musculus
cgtttcctccgaagctctcgcgaga

SEQ ID NO: 441674 - DNA, 25 bp, Mus musculus
ctgcggctttcctcgtccgagacga

SEQ ID NO: 441675 - DNA, 25 bp, Mus musculus
ggagttcatgctgcgtgctaggctc

SEQ ID NO: 441676 - DNA, 25 bp, Mus musculus
ctatgaccggggagaagatccgctc

SEQ ID NO: 441677 - DNA, 25 bp, Mus musculus
ggagggaccacaagcccagcaaaga

SEQ ID NO: 441678 - DNA, 25 bp, Mus musculus
ggcaaggcctgccataagatcttca

SEQ ID NO: 441679 - DNA, 25 bp, Mus musculus
cccggtccacgagtgcgtctttaag

SEQ ID NO: 441680 - DNA, 25 bp, Mus musculus
aggagactgtcctcgctcatccgca

SEQ ID NO: 441681 - DNA, 25 bp, Mus musculus
tgccgttgacctcctcctttacgaa

SEQ ID NO: 441682 - DNA, 25 bp, Mus musculus
ccggtactcactccggcgggaagag

SEQ ID NO: 441683 - DNA, 25 bp, Mus musculus
ttttccacgctaggctccggcggac

SEQ ID NO: 441684 - DNA, 25 bp, Mus musculus
tcttgcccaggaagccgaagagcgt

SEQ ID NO: 441685 - DNA, 25 bp, Mus musculus
agccgaagagcgtacgcatctgctc

SEQ ID NO: 441686 - DNA, 25 bp, Mus musculus
catctgctctgagctggcgctcgga

SEQ ID NO: 441687 - DNA, 25 bp, Mus musculus
gcgctcggagacacgttggtcacct

SEQ ID NO: 441688 - DNA, 25 bp, Mus musculus
ttggtcacctggatcacctcggtgc

SEQ ID NO: 441689 - DNA, 25 bp, Mus musculus
gaccactgccgtgctgctcatggcg

SEQ ID NO: 441690 - DNA, 25 bp, Mus musculus
tcctgctcaacacatcaaacacaag

SEQ ID NO: 441691 - DNA, 25 bp, Mus musculus
aacacaagacagagtgagagcgcgc

SEQ ID NO: 441692 - DNA, 25 bp, Mus musculus
gcgcatgcgcccatatcccggaagt

SEQ ID NO: 441693 - DNA, 25 bp, Mus musculus
atcccggaagtacgcgtccagttcg

SEQ ID NO: 441694 - DNA, 25 bp, Mus musculus
aggcccgcggattttccacgctagg

SEQ ID NO: 441695 - DNA, 25 bp, Mus musculus
aggcgcagctcgtcgatcttgccca

SEQ ID NO: 441696 - DNA, 25 bp, Mus musculus
ccttgaaacgtcacagccgtggtcg

SEQ ID NO: 441697 - DNA, 25 bp, Mus musculus
gaggcagcgcgcgaacatcctcttg

SEQ ID NO: 441698 - DNA, 25 bp, Mus musculus
agaagcagcggccaactcaacttgg

SEQ ID NO: 441699 - DNA, 25 bp, Mus musculus
taggtttgaccctcgtgcgggattc

SEQ ID NO: 441700 - DNA, 25 bp, Mus musculus
ggcttccggtgtgagcttttgaata

SEQ ID NO: 441701 - DNA, 25 bp, Mus musculus
tccagccatggcaccttgaaacgtc

SEQ ID NO: 441702 - DNA, 25 bp, Mus musculus
gcagctagggcaaggcccggattac

SEQ ID NO: 441703 - DNA, 25 bp, Mus musculus
gaggacctctcagcccgttagacgc

SEQ ID NO: 441704 - DNA, 25 bp, Mus musculus
cgctgtctagggagcccatgttccc

SEQ ID NO: 441705 - DNA, 25 bp, Mus musculus
ttctgatgcgacgttgggtagcgca

SEQ ID NO: 441706 - DNA, 25 bp, Mus musculus
tcgacgccgccacgttctgatgcga

SEQ ID NO: 441707 - DNA, 25 bp, Mus musculus
ttcgatcaccgcactgaactcagcg

SEQ ID NO: 441708 - DNA, 25 bp, Mus musculus
cctgttctccgggatcaattcgatc

SEQ ID NO: 441709 - DNA, 25 bp, Mus musculus
cttttgaatatgtcgcgccagctga

SEQ ID NO: 441710 - DNA, 25 bp, Mus musculus
atcgtgtacccaactcggctgctgc

SEQ ID NO: 441711 - DNA, 25 bp, Mus musculus
tgagctctctaggtccctcagttgc

SEQ ID NO: 441712 - DNA, 25 bp, Mus musculus
gctgcagctgcttcaaagtgtgaaa

SEQ ID NO: 441713 - DNA, 25 bp, Mus musculus
tcaaggagattttccagggctcaga

SEQ ID NO: 441714 - DNA, 25 bp, Mus musculus
gtgctcccgcaccagttcagtgacg

SEQ ID NO: 441715 - DNA, 25 bp, Mus musculus
agaggatgaccaccaccttgccaga

SEQ ID NO: 441716 - DNA, 25 bp, Mus musculus
agccattcttggactaccttgcttg

SEQ ID NO: 441717 - DNA, 25 bp, Mus musculus
atgacctctacttggactccctgca

SEQ ID NO: 441718 - DNA, 25 bp, Mus musculus
ccctgcaatttggaggagcaagatc

SEQ ID NO: 441719 - DNA, 25 bp, Mus musculus
agtcccgcggagaaatgagatgttc

SEQ ID NO: 441720 - DNA, 25 bp, Mus musculus
gttctagctttctctggttccgtta

SEQ ID NO: 441721 - DNA, 25 bp, Mus musculus
cttttagacagccagttgagctctc

SEQ ID NO: 441722 - DNA, 25 bp, Mus musculus
ctcagttgcctggagtacacaaagc

SEQ ID NO: 441723 - DNA, 25 bp, Mus musculus
cgttaccacccgcagcttttagaca

SEQ ID NO: 441724 - DNA, 25 bp, Mus musculus
cccagagggacagcagcaccatgtc

SEQ ID NO: 441725 - DNA, 25 bp, Mus musculus
cctggacgtatgagtgtaggtcgcc

SEQ ID NO: 441726 - DNA, 25 bp, Mus musculus
ccggggctccgcgactcctgagccc

SEQ ID NO: 441727 - DNA, 25 bp, Mus musculus
cgccctgccgcggaatgcggccttg

SEQ ID NO: 441728 - DNA, 25 bp, Mus musculus
cacggcttcccgacaggctcgggag

SEQ ID NO: 441729 - DNA, 25 bp, Mus musculus
acaggctcgggaggccgagaccctc

SEQ ID NO: 441730 - DNA, 25 bp, Mus musculus
gagatgccgacccagagggacagca

SEQ ID NO: 441731 - DNA, 25 bp, Mus musculus
atgtcccacacggtcgcgtgcggcg

SEQ ID NO: 441732 - DNA, 25 bp, Mus musculus
gaccattcccaccaggtccgggtga

SEQ ID NO: 441733 - DNA, 25 bp, Mus musculus
caccaggtccgggtgaaagcctact

SEQ ID NO: 441734 - DNA, 25 bp, Mus musculus
ggtgaaagcctactaccgcgggtga

SEQ ID NO: 441735 - DNA, 25 bp, Mus musculus
gtggcaccctggacgtatgagtgta

SEQ ID NO: 441736 - DNA, 25 bp, Mus musculus
agggacagcagcaccatgtcccaca

SEQ ID NO: 441737 - DNA, 25 bp, Mus musculus
gaaagcctactaccgcgggtgagtg

SEQ ID NO: 441738 - DNA, 25 bp, Mus musculus
tcaccagccgactgagatggagctc

SEQ ID NO: 441739 - DNA, 25 bp, Mus musculus
ctggccatcgcttcaggcgaaggga

SEQ ID NO: 441740 - DNA, 25 bp, Mus musculus
accaccctagggacaatcgccttgg

SEQ ID NO: 441741 - DNA, 25 bp, Mus musculus
gcccaggtccacaccaacagtccgg

SEQ ID NO: 441742 - DNA, 25 bp, Mus musculus
aacagtccggctcccaagggtcgcg

SEQ ID NO: 441743 - DNA, 25 bp, Mus musculus
gcccgagctggccatactgtctcgg

SEQ ID NO: 441744 - DNA, 25 bp, Mus musculus
atactgtctcgggtgtcccgcgtct

SEQ ID NO: 441745 - DNA, 25 bp, Mus musculus
ttaagttgcctacgaagttggcgcc

SEQ ID NO: 441746 - DNA, 25 bp, Mus musculus
ccgcgcggtgctcttcccagagcca

SEQ ID NO: 441747 - DNA, 25 bp, Mus musculus
tcggggctcaccagccgactgagat

SEQ ID NO: 441748 - DNA, 25 bp, Mus musculus
actgagatggagctcgccaccgccg

SEQ ID NO: 441749 - DNA, 25 bp, Mus musculus
agactcccgcgtccggggactgtgc

SEQ ID NO: 441750 - DNA, 25 bp, Mus musculus
tgtgcccagcttggcctggccatcg

SEQ ID NO: 441751 - DNA, 25 bp, Mus musculus
accagtacgggtagcgcggcctgaa

SEQ ID NO: 441752 - DNA, 25 bp, Mus musculus
gaatagtattcttcaggtgttatac

SEQ ID NO: 441753 - DNA, 25 bp, Mus musculus
cctcccaagtaagctgcgagaagac

SEQ ID NO: 441754 - DNA, 25 bp, Mus musculus
tgcaggagaacactactaaacagtt

SEQ ID NO: 441755 - DNA, 25 bp, Mus musculus
tttgtgagattgaataaccttggca

SEQ ID NO: 441756 - DNA, 25 bp, Mus musculus
aaccttggcaatacttgttatctga

SEQ ID NO: 441757 - DNA, 25 bp, Mus musculus
ctgcgagaagacagagaacttgtta

SEQ ID NO: 441758 - DNA, 25 bp, Mus musculus
agttgttcctgctgcacagtcctcc

SEQ ID NO: 441759 - DNA, 25 bp, Mus musculus
ctggtaaccaagttgttcctgctgc

SEQ ID NO: 441760 - DNA, 25 bp, Mus musculus
ctcgaagggccatgactggtaacca

SEQ ID NO: 441761 - DNA, 25 bp, Mus musculus
gcggcacggactctcgaagggccat

SEQ ID NO: 441762 - DNA, 25 bp, Mus musculus
gctccctctccatggacgaatggtc

SEQ ID NO: 441763 - DNA, 25 bp, Mus musculus
gacctgaaaagggaagtagacacaa

SEQ ID NO: 441764 - DNA, 25 bp, Mus musculus
caagacaatactagacctgaaaagg

SEQ ID NO: 441765 - DNA, 25 bp, Mus musculus
gaacttgttaccatttgtgagattg

SEQ ID NO: 441766 - DNA, 25 bp, Mus musculus
cctggatacgttggctaggaagtcc

SEQ ID NO: 441767 - DNA, 25 bp, Mus musculus
cgctgcgctatttcagttcctgatc

SEQ ID NO: 441768 - DNA, 25 bp, Mus musculus
cgtcgccgaagctcgagttccctaa

SEQ ID NO: 441769 - DNA, 25 bp, Mus musculus
agctcgagttccctaagtctgcgca

SEQ ID NO: 441770 - DNA, 25 bp, Mus musculus
agttccctaagtctgcgcagtgcta

SEQ ID NO: 441771 - DNA, 25 bp, Mus musculus
taagtctgcgcagtgctactcgctg

SEQ ID NO: 441772 - DNA, 25 bp, Mus musculus
cagtgctactcgctgcgctatttca

SEQ ID NO: 441773 - DNA, 25 bp, Mus musculus
tttcagttcctgatcctgcggtggg

SEQ ID NO: 441774 - DNA, 25 bp, Mus musculus
cttggtgtttcgaaatatgacgggc

SEQ ID NO: 441775 - DNA, 25 bp, Mus musculus
tttcgaaatatgacgggctagcttc

SEQ ID NO: 441776 - DNA, 25 bp, Mus musculus
aatatgacgggctagcttcacagag

SEQ ID NO: 441777 - DNA, 25 bp, Mus musculus
tagcttcacagagttgaatattcga

SEQ ID NO: 441778 - DNA, 25 bp, Mus musculus
gaatattcgagctatcctggatacg

SEQ ID NO: 441779 - DNA, 25 bp, Mus musculus
cacagagttgaatattcgagctatc

SEQ ID NO: 441780 - DNA, 25 bp, Mus musculus
cggctgagcgactcgaggaaggaag

SEQ ID NO: 441781 - DNA, 25 bp, Mus musculus
caggtctggcccgtcgccacacggc

SEQ ID NO: 441782 - DNA, 25 bp, Mus musculus
ggccgagggaacatcctgtctgagc

SEQ ID NO: 441783 - DNA, 25 bp, Mus musculus
ccgagggaacatcctgtctgagccg

SEQ ID NO: 441784 - DNA, 25 bp, Mus musculus
gcaccgcagacagcgccgtgcgcca

SEQ ID NO: 441785 - DNA, 25 bp, Mus musculus
cgcagcctgcagtgtgcagcccgcc

SEQ ID NO: 441786 - DNA, 25 bp, Mus musculus
ccgccgggagccacaataggccaga

SEQ ID NO: 441787 - DNA, 25 bp, Mus musculus
cacaataggccagacggcgcgcgcg

SEQ ID NO: 441788 - DNA, 25 bp, Mus musculus
cgtctgcgggaagccgtgtctccgc

SEQ ID NO: 441789 - DNA, 25 bp, Mus musculus
gaagccgtgtctccgcagtgacgtg

SEQ ID NO: 441790 - DNA, 25 bp, Mus musculus
ggtcccacgggtgtacaggcctcgc

SEQ ID NO: 441791 - DNA, 25 bp, Mus musculus
cacgggtgtacaggcctcgcggatt

SEQ ID NO: 441792 - DNA, 25 bp, Mus musculus
cctcgcggattctgggacgggtcag

SEQ ID NO: 441793 - DNA, 25 bp, Mus musculus
ccgagcctgacctcgggcgcggcca

SEQ ID NO: 441794 - DNA, 25 bp, Mus musculus
tggcttgcgattggccggctcgtct

SEQ ID NO: 441795 - DNA, 25 bp, Mus musculus
gtttcgtcacgagcttcgtgggttg

SEQ ID NO: 441796 - DNA, 25 bp, Mus musculus
ctgcggccaccatggtagccacttg

SEQ ID NO: 441797 - DNA, 25 bp, Mus musculus
aaggctctgtccaggacgacacagg

SEQ ID NO: 441798 - DNA, 25 bp, Mus musculus
tgtcgcagcagtgcttgcagccgct

SEQ ID NO: 441799 - DNA, 25 bp, Mus musculus
ctgtcgcggattggcgcttgccagc

SEQ ID NO: 441800 - DNA, 25 bp, Mus musculus
ccgcaccgaagcctggcttgcgatt

SEQ ID NO: 441801 - DNA, 25 bp, Mus musculus
gtcaccagccgtggggcagcctgct

SEQ ID NO: 441802 - DNA, 25 bp, Mus musculus
agcgctgaccgtgtgtcaccagccg

SEQ ID NO: 441803 - DNA, 25 bp, Mus musculus
gtgggttggattggcatcatcgtca

SEQ ID NO: 441804 - DNA, 25 bp, Mus musculus
cacttgccttcaggtggtgggtttc

SEQ ID NO: 441805 - DNA, 25 bp, Mus musculus
tccctatcgggatgggattaattta

SEQ ID NO: 441806 - DNA, 25 bp, Mus musculus
ttcactctgcgggtccctatcggga

SEQ ID NO: 441807 - DNA, 25 bp, Mus musculus
attaatttaattcccagcgctgacc

SEQ ID NO: 441808 - DNA, 25 bp, Mus musculus
atagaagcctttgtcctcggcgggc

SEQ ID NO: 441809 - DNA, 25 bp, Mus musculus
tacgtgctctgatgcagggcttgct

SEQ ID NO: 441810 - DNA, 25 bp, Mus musculus
atcgtagcgctggtacgtgctctga

SEQ ID NO: 441811 - DNA, 25 bp, Mus musculus
agggatcatccacatcgtagcgctg

SEQ ID NO: 441812 - DNA, 25 bp, Mus musculus
ctcgccctcggtggcgtaggagaac

SEQ ID NO: 441813 - DNA, 25 bp, Mus musculus
ctgacatctgttggtaatagaagcc

SEQ ID NO: 441814 - DNA, 25 bp, Mus musculus
ttgccttcgcatctgacatctgttg

SEQ ID NO: 441815 - DNA, 25 bp, Mus musculus
tactcgtccggctgtttgccttcgc

SEQ ID NO: 441816 - DNA, 25 bp, Mus musculus
tttcgctttgctactcgtccggctg

SEQ ID NO: 441817 - DNA, 25 bp, Mus musculus
ggcctccgagttctgtttgtgtttg

SEQ ID NO: 441818 - DNA, 25 bp, Mus musculus
cgtcatttgcaatcagggcctccga

SEQ ID NO: 441819 - DNA, 25 bp, Mus musculus
ggagagcaatctaactcgtcatttg

SEQ ID NO: 441820 - DNA, 25 bp, Mus musculus
gcggttagtcttactccggagagca

SEQ ID NO: 441821 - DNA, 25 bp, Mus musculus
cctcctccacagaaaagggatcatc

SEQ ID NO: 441822 - DNA, 25 bp, Mus musculus
ggctccattggagtccctttgaaga

SEQ ID NO: 441823 - DNA, 25 bp, Mus musculus
tgcgagagtcctctcgagagccgcg

SEQ ID NO: 441824 - DNA, 25 bp, Mus musculus
ctccgggcaggaacctacccagata

SEQ ID NO: 441825 - DNA, 25 bp, Mus musculus
acagatggtcctcgtggcgcaccag

SEQ ID NO: 441826 - DNA, 25 bp, Mus musculus
ggagacctgggaggcccacactgtc

SEQ ID NO: 441827 - DNA, 25 bp, Mus musculus
gtccctttgaagagttttgctctgg

SEQ ID NO: 441828 - DNA, 25 bp, Mus musculus
tttgctctggttaaaggacagattc

SEQ ID NO: 441829 - DNA, 25 bp, Mus musculus
tcctctgggactgcggcccggaaaa

SEQ ID NO: 441830 - DNA, 25 bp, Mus musculus
cgaagcagtgcgtgcgagagtcctc

SEQ ID NO: 441831 - DNA, 25 bp, Mus musculus
ctctcctttttccaagggctcaatc

SEQ ID NO: 441832 - DNA, 25 bp, Mus musculus
caagggctcaatcccaggccaagag

SEQ ID NO: 441833 - DNA, 25 bp, Mus musculus
aatcccaggccaagagcccagttgc

SEQ ID NO: 441834 - DNA, 25 bp, Mus musculus
gacctcgctccttggtctttccaga

SEQ ID NO: 441835 - DNA, 25 bp, Mus musculus
ggcaggaacctacccagatagctct

SEQ ID NO: 441836 - DNA, 25 bp, Mus musculus
tgcgcatgtgcacggacaagcggct

SEQ ID NO: 441837 - DNA, 25 bp, Mus musculus
ccgggctgggcaagctcacacgcat

SEQ ID NO: 441838 - DNA, 25 bp, Mus musculus
gggcaagctcacacgcattcgggtc

SEQ ID NO: 441839 - DNA, 25 bp, Mus musculus
cacgcattcgggtcctgcgaggatg

SEQ ID NO: 441840 - DNA, 25 bp, Mus musculus
gcacacggacgcaaccgagcggact

SEQ ID NO: 441841 - DNA, 25 bp, Mus musculus
cgagcggactcgaggaccgcactca

SEQ ID NO: 441842 - DNA, 25 bp, Mus musculus
ctgcccgctccaagaccactttctg

SEQ ID NO: 441843 - DNA, 25 bp, Mus musculus
acggacaagcggctgctcccgcaga

SEQ ID NO: 441844 - DNA, 25 bp, Mus musculus
tcaaaagtcggtcggagcggagcca

SEQ ID NO: 441845 - DNA, 25 bp, Mus musculus
ctgattgtcaaaagtcggtcggagc

SEQ ID NO: 441846 - DNA, 25 bp, Mus musculus
tcccggcagcgctactgcgcatgtg

SEQ ID NO: 441847 - DNA, 25 bp, Mus musculus
gagccaccgggaaacagctgcagga

SEQ ID NO: 441848 - DNA, 25 bp, Mus musculus
cagctgcaggaagtgactgcggaac

SEQ ID NO: 441849 - DNA, 25 bp, Mus musculus
ctccgctgctggaggctgattgtca

SEQ ID NO: 441850 - DNA, 25 bp, Mus musculus
tagactgcagcccaaagctcgtgcc

SEQ ID NO: 441851 - DNA, 25 bp, Mus musculus
acgactgcagcgctgactcgcactg

SEQ ID NO: 441852 - DNA, 25 bp, Mus musculus
actcgcactgccactcggggcggaa

SEQ ID NO: 441853 - DNA, 25 bp, Mus musculus
cagtgagtcactgttcccgaacttg

SEQ ID NO: 441854 - DNA, 25 bp, Mus musculus
tcactgttcccgaacttgcccattg

SEQ ID NO: 441855 - DNA, 25 bp, Mus musculus
gtctttgcagccctgtttccggggc

SEQ ID NO: 441856 - DNA, 25 bp, Mus musculus
cgttgtttgtttacacgatgtgagc

SEQ ID NO: 441857 - DNA, 25 bp, Mus musculus
gagagaccaataaagtttattctgg

SEQ ID NO: 441858 - DNA, 25 bp, Mus musculus
ctgcgatccagggaccgtgcggcct

SEQ ID NO: 441859 - DNA, 25 bp, Mus musculus
ctcttctgccgctcgcggacggtgt

SEQ ID NO: 441860 - DNA, 25 bp, Mus musculus
gacggtgtcagcctccgctctacgt

SEQ ID NO: 441861 - DNA, 25 bp, Mus musculus
agcctccgctctacgtgggtagatg

SEQ ID NO: 441862 - DNA, 25 bp, Mus musculus
ggggacagagtagactgcagcccaa

SEQ ID NO: 441863 - DNA, 25 bp, Mus musculus
ctacgtgggtagatggaagaccagc

SEQ ID NO: 441864 - DNA, 25 bp, Mus musculus
cccgcccttagcatgaagccacgcc

SEQ ID NO: 441865 - DNA, 25 bp, Mus musculus
gatcactgcggccttccaggaaacc

SEQ ID NO: 441866 - DNA, 25 bp, Mus musculus
cggccttccaggaaaccgatgagtg

SEQ ID NO: 441867 - DNA, 25 bp, Mus musculus
catcatccgggcgtgtctcgccgga

SEQ ID NO: 441868 - DNA, 25 bp, Mus musculus
aggccacgccctcatccttagggtt

SEQ ID NO: 441869 - DNA, 25 bp, Mus musculus
gctagtctctccttgtcctgctgtt

SEQ ID NO: 441870 - DNA, 25 bp, Mus musculus
gcactgctagtctctccttgtcctg

SEQ ID NO: 441871 - DNA, 25 bp, Mus musculus
cgctagacagcactgctagtctctc

SEQ ID NO: 441872 - DNA, 25 bp, Mus musculus
taggggacgctagacagcactgcta

SEQ ID NO: 441873 - DNA, 25 bp, Mus musculus
tgcccgtaggggacgctagacagca

SEQ ID NO: 441874 - DNA, 25 bp, Mus musculus
tggcacggcccggatgtgcccgtag

SEQ ID NO: 441875 - DNA, 25 bp, Mus musculus
cgatgagtgggacagcgctgacctc

SEQ ID NO: 441876 - DNA, 25 bp, Mus musculus
ccaggaaaccgatgagtgggacagc

SEQ ID NO: 441877 - DNA, 25 bp, Mus musculus
atctttactctcgcggcccgctgtg

SEQ ID NO: 441878 - DNA, 25 bp, Mus musculus
cttttcacgcacaccagcgttagcg

SEQ ID NO: 441879 - DNA, 25 bp, Mus musculus
caggattccggagggagccaccctc

SEQ ID NO: 441880 - DNA, 25 bp, Mus musculus
cgcgccgtcagttcaggattccgga

SEQ ID NO: 441881 - DNA, 25 bp, Mus musculus
tcctccgcgccgtcagttcaggatt

SEQ ID NO: 441882 - DNA, 25 bp, Mus musculus
aggtaggaatccacccggctgggca

SEQ ID NO: 441883 - DNA, 25 bp, Mus musculus
tggccacggcgcttcttttcacgca

SEQ ID NO: 441884 - DNA, 25 bp, Mus musculus
cgacgtccggggtgaccttcgagct

SEQ ID NO: 441885 - DNA, 25 bp, Mus musculus
ctctttcgggaggatgagacagcca

SEQ ID NO: 441886 - DNA, 25 bp, Mus musculus
taggagatccgaagcgccggaagta

SEQ ID NO: 441887 - DNA, 25 bp, Mus musculus
cgaagcgtcagccaataggagatcc

SEQ ID NO: 441888 - DNA, 25 bp, Mus musculus
agttctggtctcgaagcgtcagcca

SEQ ID NO: 441889 - DNA, 25 bp, Mus musculus
cgcccgcaatatatgcagttctggt

SEQ ID NO: 441890 - DNA, 25 bp, Mus musculus
ggaaggccctgtccaggtaggaatc

SEQ ID NO: 441891 - DNA, 25 bp, Mus musculus
ggtgaccttcgagctccggaccggc

SEQ ID NO: 441892 - DNA, 25 bp, Mus musculus
gactcaccgagctggggacaagcga

SEQ ID NO: 441893 - DNA, 25 bp, Mus musculus
catccgcagcccgtgtctctgtgtt

SEQ ID NO: 441894 - DNA, 25 bp, Mus musculus
tgtctctgtgtttccgtcgtacctg

SEQ ID NO: 441895 - DNA, 25 bp, Mus musculus
tccgtcgtacctgccggcaaggcga

SEQ ID NO: 441896 - DNA, 25 bp, Mus musculus
atggcgcagtccacaccgtggcgct

SEQ ID NO: 441897 - DNA, 25 bp, Mus musculus
gagctcgcccgcaccacatcctgca

SEQ ID NO: 441898 - DNA, 25 bp, Mus musculus
tgacgctccagctctttcagcagcg

SEQ ID NO: 441899 - DNA, 25 bp, Mus musculus
aggcgcactacgaacggtctccatg

SEQ ID NO: 441900 - DNA, 25 bp, Mus musculus
atgggttccctggactcaccgagct

SEQ ID NO: 441901 - DNA, 25 bp, Mus musculus
agtcacgcatctggctgggacacca

SEQ ID NO: 441902 - DNA, 25 bp, Mus musculus
gctgggacaccactagcctgaggtc

SEQ ID NO: 441903 - DNA, 25 bp, Mus musculus
cactagcctgaggtcaccgtgggag

SEQ ID NO: 441904 - DNA, 25 bp, Mus musculus
gcggggtaccttctgccacgcacag

SEQ ID NO: 441905 - DNA, 25 bp, Mus musculus
acgaacggtctccatgggttccctg

SEQ ID NO: 441906 - DNA, 25 bp, Mus musculus
caaggcgtgcagcttctgcggcttt

SEQ ID NO: 441907 - DNA, 25 bp, Mus musculus
cgtgcagcttctgcggctttgggaa

SEQ ID NO: 441908 - DNA, 25 bp, Mus musculus
cttctgcggctttgggaagcggaaa

SEQ ID NO: 441909 - DNA, 25 bp, Mus musculus
ctttgggaagcggaaagcgcatccc

SEQ ID NO: 441910 - DNA, 25 bp, Mus musculus
ccctgcagtttcgatttatcagtgt

SEQ ID NO: 441911 - DNA, 25 bp, Mus musculus
tcctctagactcccgggtggacgca

SEQ ID NO: 441912 - DNA, 25 bp, Mus musculus
acccagaacgcgcttggcctgggtg

SEQ ID NO: 441913 - DNA, 25 bp, Mus musculus
gctcggggaacccagaacgcgcttg

SEQ ID NO: 441914 - DNA, 25 bp, Mus musculus
gacggcgaccacacccagagccctg

SEQ ID NO: 441915 - DNA, 25 bp, Mus musculus
ctggctccaccacacaagacggcga

SEQ ID NO: 441916 - DNA, 25 bp, Mus musculus
ggtcgcgaaccgctagctggctcca

SEQ ID NO: 441917 - DNA, 25 bp, Mus musculus
accaccgcgctactgctgggcgccc

SEQ ID NO: 441918 - DNA, 25 bp, Mus musculus
acacggagccctgacgcccgccgcc

SEQ ID NO: 441919 - DNA, 25 bp, Mus musculus
gcagtttcgatttatcagtgtgccc

SEQ ID NO: 441920 - DNA, 25 bp, Mus musculus
ctgaaacagaggatcactgaacacc

SEQ ID NO: 441921 - DNA, 25 bp, Mus musculus
tgcaacgacacccaggatcacgagg

SEQ ID NO: 441922 - DNA, 25 bp, Mus musculus
acgacacccaggatcacgaggggtg

SEQ ID NO: 441923 - DNA, 25 bp, Mus musculus
atcacgaggggtgtgtgctcccagc

SEQ ID NO: 441924 - DNA, 25 bp, Mus musculus
ggaccaagtcgcgatgagactgaaa

SEQ ID NO: 441925 - DNA, 25 bp, Mus musculus
cgcgatgagactgaaacagaggatc

SEQ ID NO: 441926 - DNA, 25 bp, Mus musculus
ggatcactgaacaccactcctggaa

SEQ ID NO: 441927 - DNA, 25 bp, Mus musculus
tgaacaccactcctggaagcgcttg

SEQ ID NO: 441928 - DNA, 25 bp, Mus musculus
accactcctggaagcgcttgcctgg

SEQ ID NO: 441929 - DNA, 25 bp, Mus musculus
ccagcgtgtcctcggcgcctgccat

SEQ ID NO: 441930 - DNA, 25 bp, Mus musculus
gaagcgcttgcctggcgagtaaagc

SEQ ID NO: 441931 - DNA, 25 bp, Mus musculus
tccggctgccgtcccagcgtgtcct

SEQ ID NO: 441932 - DNA, 25 bp, Mus musculus
gaccctccgccttcttgtcctcgtc

SEQ ID NO: 441933 - DNA, 25 bp, Mus musculus
gacaggaagtcagcgacgagagccc

SEQ ID NO: 441934 - DNA, 25 bp, Mus musculus
cgcgcaataggtttccggcttgtcc

SEQ ID NO: 441935 - DNA, 25 bp, Mus musculus
tattcgcgcgcgaagcacagctcca

SEQ ID NO: 441936 - DNA, 25 bp, Mus musculus
ccctacggatgccttccattggcta

SEQ ID NO: 441937 - DNA, 25 bp, Mus musculus
ccattggctaagacggctaaaccgc

SEQ ID NO: 441938 - DNA, 25 bp, Mus musculus
tgcagcagcgccacactctgattgg

SEQ ID NO: 441939 - DNA, 25 bp, Mus musculus
gctaatgactaagccggaccctttg

SEQ ID NO: 441940 - DNA, 25 bp, Mus musculus
ccggaccctttgtcattggttgata

SEQ ID NO: 441941 - DNA, 25 bp, Mus musculus
cgttctcagggagaggagtcacgcc

SEQ ID NO: 441942 - DNA, 25 bp, Mus musculus
tctttcgtccggtagtcttcggcca

SEQ ID NO: 441943 - DNA, 25 bp, Mus musculus
gctgctccgagatggcctcaaggaa

SEQ ID NO: 441944 - DNA, 25 bp, Mus musculus
tctgggtccttcagcagccactaca

SEQ ID NO: 441945 - DNA, 25 bp, Mus musculus
cccagatgagcggatccctgaggta

SEQ ID NO: 441946 - DNA, 25 bp, Mus musculus
ccctgaggtacaggctgcagttctc

SEQ ID NO: 441947 - DNA, 25 bp, Mus musculus
agtcacgccgctgttatctttcgtc

SEQ ID NO: 441948 - DNA, 25 bp, Mus musculus
caaaggcggaggcagtcatttcttc

SEQ ID NO: 441949 - DNA, 25 bp, Mus musculus
tgcatcctgcaagaagcgcccaaag

SEQ ID NO: 441950 - DNA, 25 bp, Mus musculus
tgagcagcgtccttgggatttacta

SEQ ID NO: 441951 - DNA, 25 bp, Mus musculus
gaacgctgaggctcttctacaaata

SEQ ID NO: 441952 - DNA, 25 bp, Mus musculus
actggtcgcagccatgtttctaatg

SEQ ID NO: 441953 - DNA, 25 bp, Mus musculus
tctcccaagtctgccatagagttta

SEQ ID NO: 441954 - DNA, 25 bp, Mus musculus
atgtcgtcacttttgtccgccagcg

SEQ ID NO: 441955 - DNA, 25 bp, Mus musculus
tcaatatggcctcctctagcgttcg

SEQ ID NO: 441956 - DNA, 25 bp, Mus musculus
ggcctgtctagagctctgttgcatc

SEQ ID NO: 441957 - DNA, 25 bp, Mus musculus
cgttcgccctcactggtggattgtc

SEQ ID NO: 441958 - DNA, 25 bp, Mus musculus
tcggaagttttctcacgcggagctt

SEQ ID NO: 441959 - DNA, 25 bp, Mus musculus
gctgcagatcggatggccttgttta

SEQ ID NO: 441960 - DNA, 25 bp, Mus musculus
agctcagcgtttgcgaagcgccttg

SEQ ID NO: 441961 - DNA, 25 bp, Mus musculus
taggcgactgcaaggtcacgctctc

SEQ ID NO: 441962 - DNA, 25 bp, Mus musculus
cgtctacaagaacgagtgcgccttc

SEQ ID NO: 441963 - DNA, 25 bp, Mus musculus
tgcaccgcttttttgtgcgggcttc

SEQ ID NO: 441964 - DNA, 25 bp, Mus musculus
tgcgggcttcccaggacctgatcct

SEQ ID NO: 441965 - DNA, 25 bp, Mus musculus
atcctgggcagttggggattacatc

SEQ ID NO: 441966 - DNA, 25 bp, Mus musculus
ccggcgactcgccattggattaaaa

SEQ ID NO: 441967 - DNA, 25 bp, Mus musculus
gccattggattaaaaatagcagctc

SEQ ID NO: 441968 - DNA, 25 bp, Mus musculus
tcccgagcctaaactgatcctcagc

SEQ ID NO: 441969 - DNA, 25 bp, Mus musculus
agttgcgcagccagcctgggaaacg

SEQ ID NO: 441970 - DNA, 25 bp, Mus musculus
gggaccgcgtctacaagaacgagtg

SEQ ID NO: 441971 - DNA, 25 bp, Mus musculus
gtcgcgctgtgcaccgcttttttgt

SEQ ID NO: 441972 - DNA, 25 bp, Mus musculus
aacgagtgcgccttctcctacgact

SEQ ID NO: 441973 - DNA, 25 bp, Mus musculus
cccggtaaggaagatccacggcgca

SEQ ID NO: 441974 - DNA, 25 bp, Mus musculus
gatccacggcgcagttgcgcagcca

SEQ ID NO: 441975 - DNA, 25 bp, Mus musculus
agctgctggtgcctcatatgcccac

SEQ ID NO: 441976 - DNA, 25 bp, Mus musculus
gctctcccgagctagctcgtagaga

SEQ ID NO: 441977 - DNA, 25 bp, Mus musculus
tctccgcgggcgcagtgccgctcgc

SEQ ID NO: 441978 - DNA, 25 bp, Mus musculus
tgatggctgctctcccgagctagct

SEQ ID NO: 441979 - DNA, 25 bp, Mus musculus
cgccgctcacgaggctgcagcgtcc

SEQ ID NO: 441980 - DNA, 25 bp, Mus musculus
ctcagggcacccgaggctgatggct

SEQ ID NO: 441981 - DNA, 25 bp, Mus musculus
tcgccgcgcctctccaactcgccgg

SEQ ID NO: 441982 - DNA, 25 bp, Mus musculus
ctgtcctccacgcgggtgctgagcg

SEQ ID NO: 441983 - DNA, 25 bp, Mus musculus
tacgggctacaggacgccggcgggc

SEQ ID NO: 441984 - DNA, 25 bp, Mus musculus
gcgcccgggctacgggctacaggac

SEQ ID NO: 441985 - DNA, 25 bp, Mus musculus
ctagctcgtagagagttgcgggtcg

SEQ ID NO: 441986 - DNA, 25 bp, Mus musculus
cccgagctagctcgtagagagttgc

SEQ ID NO: 441987 - DNA, 25 bp, Mus musculus
ggctgctctcccgagctagctcgta

SEQ ID NO: 441988 - DNA, 25 bp, Mus musculus
gctgatggctgctctcccgagctag

SEQ ID NO: 441989 - DNA, 25 bp, Mus musculus
tctcctcgccgctcacgaggctgca

SEQ ID NO: 441990 - DNA, 25 bp, Mus musculus
tgaacagcaggacaacccgcacttc

SEQ ID NO: 441991 - DNA, 25 bp, Mus musculus
ggtgacagccacatccctctaaaag

SEQ ID NO: 441992 - DNA, 25 bp, Mus musculus
tccctgctcccgtttccagagagaa

SEQ ID NO: 441993 - DNA, 25 bp, Mus musculus
actgtaggtccttgtctgtctgccc

SEQ ID NO: 441994 - DNA, 25 bp, Mus musculus
cgtcggtctagcaggcagctttcct

SEQ ID NO: 441995 - DNA, 25 bp, Mus musculus
gaccgccaccttgaggcaatcctga

SEQ ID NO: 441996 - DNA, 25 bp, Mus musculus
cgggcagacaggactgaggaaactt

SEQ ID NO: 441997 - DNA, 25 bp, Mus musculus
tgaactcggcagcacccggtgaaaa

SEQ ID NO: 441998 - DNA, 25 bp, Mus musculus
agctctggccttggcgacctaggaa

SEQ ID NO: 441999 - DNA, 25 bp, Mus musculus
cgccagaacagagcatgcgcgctgc

SEQ ID NO: 442000 - DNA, 25 bp, Mus musculus
acgtacgtgctaagctcaggcgtcc

SEQ ID NO: 442001 - DNA, 25 bp, Mus musculus
tgcgctttaaagctctccgggctgg

SEQ ID NO: 442002 - DNA, 25 bp, Mus musculus
taggaaccacacagcccgacgtacg

SEQ ID NO: 442003 - DNA, 25 bp, Mus musculus
gccgccgccaagtcaactgtaggtc

SEQ ID NO: 442004 - DNA, 25 bp, Mus musculus
gcccgcggcatgaatggctgactcc

SEQ ID NO: 442005 - DNA, 25 bp, Mus musculus
actgaggcgggcagctcactgcgac

SEQ ID NO: 442006 - DNA, 25 bp, Mus musculus
cgaggctccagagggaaggctccat

SEQ ID NO: 442007 - DNA, 25 bp, Mus musculus
tggcttgcctcctgtcccggagcgt

SEQ ID NO: 442008 - DNA, 25 bp, Mus musculus
ccaggctccgttatgtttggaaaca

SEQ ID NO: 442009 - DNA, 25 bp, Mus musculus
ggcctctgccctcggcgcggtttaa

SEQ ID NO: 442010 - DNA, 25 bp, Mus musculus
tcgcggctccaacggggctttctac

SEQ ID NO: 442011 - DNA, 25 bp, Mus musculus
gcggttccaacatggcggagctgac

SEQ ID NO: 442012 - DNA, 25 bp, Mus musculus
ctcgcgttggaaagtttctagaatc

SEQ ID NO: 442013 - DNA, 25 bp, Mus musculus
ggtccgcctcactcattgtgcgcga

SEQ ID NO: 442014 - DNA, 25 bp, Mus musculus
gcttcctgacgggaagagcccgtag

SEQ ID NO: 442015 - DNA, 25 bp, Mus musculus
caaacctgagagtgtcggccggcca

SEQ ID NO: 442016 - DNA, 25 bp, Mus musculus
gaaggctccatgagggcaaacctga

SEQ ID NO: 442017 - DNA, 25 bp, Mus musculus
ccagcagcctttgcggttccaacat

SEQ ID NO: 442018 - DNA, 25 bp, Mus musculus
aaaggtcagtctccgtatccgccca

SEQ ID NO: 442019 - DNA, 25 bp, Mus musculus
ccaactccggttgacggagaggtcg

SEQ ID NO: 442020 - DNA, 25 bp, Mus musculus
cggcgccgtaaagtgcgtcggaact

SEQ ID NO: 442021 - DNA, 25 bp, Mus musculus
cgcaacacggcagcggcgccgtaaa

SEQ ID NO: 442022 - DNA, 25 bp, Mus musculus
agcgatgccgccacttccactagcg

SEQ ID NO: 442023 - DNA, 25 bp, Mus musculus
aacgacagggccgagccagcgatgc

SEQ ID NO: 442024 - DNA, 25 bp, Mus musculus
tacagctgtggagaacgacagggcc

SEQ ID NO: 442025 - DNA, 25 bp, Mus musculus
caccgccacggtacagctgtggaga

SEQ ID NO: 442026 - DNA, 25 bp, Mus musculus
agtgccgcacaaagggcctcaccaa

SEQ ID NO: 442027 - DNA, 25 bp, Mus musculus
cagcgccgaccactcaccatgactc

SEQ ID NO: 442028 - DNA, 25 bp, Mus musculus
gaggccggagtaaaggtcagtctcc

SEQ ID NO: 442029 - DNA, 25 bp, Mus musculus
cgtcggaactgtcgcacaaagtgcc

SEQ ID NO: 442030 - DNA, 25 bp, Mus musculus
tgtcgcacaaagtgccgcacaaagg

SEQ ID NO: 442031 - DNA, 25 bp, Mus musculus
catgactccactccgcggctcggca

SEQ ID NO: 442032 - DNA, 25 bp, Mus musculus
acggtgcacgtcaaacctcagccag

SEQ ID NO: 442033 - DNA, 25 bp, Mus musculus
ggtgcacgtcaaacctcagccagta

SEQ ID NO: 442034 - DNA, 25 bp, Mus musculus
gtgcacgtcaaacctcagccagtaa

SEQ ID NO: 442035 - DNA, 25 bp, Mus musculus
tgcacgtcaaacctcagccagtaac

SEQ ID NO: 442036 - DNA, 25 bp, Mus musculus
aacgtcctcacggtgcacgtcaaac

SEQ ID NO: 442037 - DNA, 25 bp, Mus musculus
ctcagccagtaacgtcctcacggtg

SEQ ID NO: 442038 - DNA, 25 bp, Mus musculus
gtaacgtcctcacggtgcacgtcaa

SEQ ID NO: 442039 - DNA, 25 bp, Mus musculus
cagccagtaacgtcctcacggtgca

SEQ ID NO: 442040 - DNA, 25 bp, Mus musculus
gcacgtcaaacctcagccagtaacg

SEQ ID NO: 442041 - DNA, 25 bp, Mus musculus
cggtgcacgtcaaacctcagccagt

SEQ ID NO: 442042 - DNA, 25 bp, Mus musculus
ccagtaacgtcctcacggtgcacgt

SEQ ID NO: 442043 - DNA, 25 bp, Mus musculus
acgtcaaacctcagccagtaacgtc

SEQ ID NO: 442044 - DNA, 25 bp, Mus musculus
tcagccagtaacgtcctcacggtgc

SEQ ID NO: 442045 - DNA, 25 bp, Mus musculus
gccagtaacgtcctcacggtgcacg

SEQ ID NO: 442046 - DNA, 25 bp, Mus musculus
tgcgcccgtcctcagagaccttgaa

SEQ ID NO: 442047 - DNA, 25 bp, Mus musculus
ttgcgctgcatcttggcgcactcgc

SEQ ID NO: 442048 - DNA, 25 bp, Mus musculus
tccatgcgctcgtggtgcttgcgct

SEQ ID NO: 442049 - DNA, 25 bp, Mus musculus
tcttctggatcttggccttgccctt

SEQ ID NO: 442050 - DNA, 25 bp, Mus musculus
agagcgatcggacgcttttgcgccc

SEQ ID NO: 442051 - DNA, 25 bp, Mus musculus
tcactacccaactgcaggccggaga

SEQ ID NO: 442052 - DNA, 25 bp, Mus musculus
ggtgccctggcgcacaaacatcaca

SEQ ID NO: 442053 - DNA, 25 bp, Mus musculus
aacatgtccctgagtggggcacggc

SEQ ID NO: 442054 - DNA, 25 bp, Mus musculus
ctcgtccgagaggaacatgtccctg

SEQ ID NO: 442055 - DNA, 25 bp, Mus musculus
tgctgacctccgagtgagcaggctc

SEQ ID NO: 442056 - DNA, 25 bp, Mus musculus
taaacaaagagtcgtggcctgagtc

SEQ ID NO: 442057 - DNA, 25 bp, Mus musculus
cttcgaaacaccatggtacccaggc

SEQ ID NO: 442058 - DNA, 25 bp, Mus musculus
cgctgctcacatagttccttcgaaa

SEQ ID NO: 442059 - DNA, 25 bp, Mus musculus
tgcccagcgtcatgtgctgcagccg

SEQ ID NO: 442060 - DNA, 25 bp, Mus musculus
tgacgtgccctctcatctgattccg

SEQ ID NO: 442061 - DNA, 25 bp, Mus musculus
tggacattcaggagccgttgcctcg

SEQ ID NO: 442062 - DNA, 25 bp, Mus musculus
caagaacaggtcctgcctcggaagc

SEQ ID NO: 442063 - DNA, 25 bp, Mus musculus
ctgcggtcatctgtctcgcgaagca

SEQ ID NO: 442064 - DNA, 25 bp, Mus musculus
gggaaatcccaacctgagactagcc

SEQ ID NO: 442065 - DNA, 25 bp, Mus musculus
tttttccacgaagaggctaggcctg

SEQ ID NO: 442066 - DNA, 25 bp, Mus musculus
cagtcggtcgaaatgatggacattc

SEQ ID NO: 442067 - DNA, 25 bp, Mus musculus
agggttagacaaccgccattgcgga

SEQ ID NO: 442068 - DNA, 25 bp, Mus musculus
cgccattgcggagtgtggaagaatt

SEQ ID NO: 442069 - DNA, 25 bp, Mus musculus
tttgagaaatctacccgacagtcgg

SEQ ID NO: 442070 - DNA, 25 bp, Mus musculus
tctgattccgggatcggatctcgga

SEQ ID NO: 442071 - DNA, 25 bp, Mus musculus
tcggaagcggactgcaaaagggtta

SEQ ID NO: 442072 - DNA, 25 bp, Mus musculus
atctcggacgagaggggatttttga

SEQ ID NO: 442073 - DNA, 25 bp, Mus musculus
cgcgaagcagaagagtagagaaacc

SEQ ID NO: 442074 - DNA, 25 bp, Mus musculus
tgctgcctctttaagactagggctg

SEQ ID NO: 442075 - DNA, 25 bp, Mus musculus
gaaacccatttattccctgacagcc

SEQ ID NO: 442076 - DNA, 25 bp, Mus musculus
gaccggcggcaaccagaagaacagc

SEQ ID NO: 442077 - DNA, 25 bp, Mus musculus
gcccagcgcccgcatgtataacatg

SEQ ID NO: 442078 - DNA, 25 bp, Mus musculus
gagagcgcctgttttttcatcccaa

SEQ ID NO: 442079 - DNA, 25 bp, Mus musculus
agagaagtttggagcccgaggctta

SEQ ID NO: 442080 - DNA, 25 bp, Mus musculus
tgcgccgtgacctgttgctgaaaac

SEQ ID NO: 442081 - DNA, 25 bp, Mus musculus
cccttatgtatccaagagagagcca

SEQ ID NO: 442082 - DNA, 25 bp, Mus musculus
cttccttcgaacaggcgtgcgccgt

SEQ ID NO: 442083 - DNA, 25 bp, Mus musculus
gtgctgtttacccacttccttcgaa

SEQ ID NO: 442084 - DNA, 25 bp, Mus musculus
agctgtcgtcttggtgctgtttacc

SEQ ID NO: 442085 - DNA, 25 bp, Mus musculus
gagagagccaatattccgtagcatg

SEQ ID NO: 442086 - DNA, 25 bp, Mus musculus
tttcatgcaaaaccctctggcgagg

SEQ ID NO: 442087 - DNA, 25 bp, Mus musculus
taatcacaacaatcgcggcggcccg

SEQ ID NO: 442088 - DNA, 25 bp, Mus musculus
tgggtgatgtccgaaggcacttccc

SEQ ID NO: 442089 - DNA, 25 bp, Mus musculus
atagtccatagccagggcgtgcgcg

SEQ ID NO: 442090 - DNA, 25 bp, Mus musculus
taacgggcaacttcggccaggcatt

SEQ ID NO: 442091 - DNA, 25 bp, Mus musculus
tgatgctcagataacgggcaacttc

SEQ ID NO: 442092 - DNA, 25 bp, Mus musculus
cgagtccttcaatgatgctcagata

SEQ ID NO: 442093 - DNA, 25 bp, Mus musculus
cctccggatgggcagaagccagcct

SEQ ID NO: 442094 - DNA, 25 bp, Mus musculus
gtcggaggcatcgagtccttcaatg

SEQ ID NO: 442095 - DNA, 25 bp, Mus musculus
cttcccgctgggatgcgtagttgtt

SEQ ID NO: 442096 - DNA, 25 bp, Mus musculus
cccagggaatgtgtccgaggccacc

SEQ ID NO: 442097 - DNA, 25 bp, Mus musculus
ccgtggccattctggggcagcagca

SEQ ID NO: 442098 - DNA, 25 bp, Mus musculus
cggtgccagcgttcccgtggccatt

SEQ ID NO: 442099 - DNA, 25 bp, Mus musculus
agcctgccctggtgatgcggctccg

SEQ ID NO: 442100 - DNA, 25 bp, Mus musculus
caaactccgatagtccatagccagg

SEQ ID NO: 442101 - DNA, 25 bp, Mus musculus
gaatgtgtccgaggccaccgtgagc

SEQ ID NO: 442102 - DNA, 25 bp, Mus musculus
gtcagcgtagtcagcttctgcttta

SEQ ID NO: 442103 - DNA, 25 bp, Mus musculus
tcggcgctgagtgcagagaattatc

SEQ ID NO: 442104 - DNA, 25 bp, Mus musculus
cacgtgctgcgccttcgaaaggtga

SEQ ID NO: 442105 - DNA, 25 bp, Mus musculus
ccagggcctttgcagaagaacctcg

SEQ ID NO: 442106 - DNA, 25 bp, Mus musculus
aagctcgattgttttctccctcaga

SEQ ID NO: 442107 - DNA, 25 bp, Mus musculus
tcagagactcgggaacattcttttc

SEQ ID NO: 442108 - DNA, 25 bp, Mus musculus
acactgcaatctcgcgctgggagta

SEQ ID NO: 442109 - DNA, 25 bp, Mus musculus
tgccaatttttgtctcacccgagcc

SEQ ID NO: 442110 - DNA, 25 bp, Mus musculus
tcaacctcgggctctgacgctaagc

SEQ ID NO: 442111 - DNA, 25 bp, Mus musculus
ctaggcacctcgtcttttgttaata

SEQ ID NO: 442112 - DNA, 25 bp, Mus musculus
ccgcacgcacgattttatttagaca

SEQ ID NO: 442113 - DNA, 25 bp, Mus musculus
tcatatttagcaagccaggacggtg

SEQ ID NO: 442114 - DNA, 25 bp, Mus musculus
cgcctcgctttgaggacttagatac

SEQ ID NO: 442115 - DNA, 25 bp, Mus musculus
cggaaggacagccattagaagtatc

SEQ ID NO: 442116 - DNA, 25 bp, Mus musculus
aaagagccgcgcaggcatccgccat

SEQ ID NO: 442117 - DNA, 25 bp, Mus musculus
ggcatccgccatcaatacggaaggc

SEQ ID NO: 442118 - DNA, 25 bp, Mus musculus
catcaatacggaaggcagagggaaa

SEQ ID NO: 442119 - DNA, 25 bp, Mus musculus
gaaagagccgcgcaggcatccgcca

SEQ ID NO: 442120 - DNA, 25 bp, Mus musculus
caggcatccgccatcaatacggaag

SEQ ID NO: 442121 - DNA, 25 bp, Mus musculus
tccgccatcaatacggaaggcagag

SEQ ID NO: 442122 - DNA, 25 bp, Mus musculus
gcagagggaaagagccgcgcaggca

SEQ ID NO: 442123 - DNA, 25 bp, Mus musculus
gcaggcatccgccatcaatacggaa

SEQ ID NO: 442124 - DNA, 25 bp, Mus musculus
gcatccgccatcaatacggaaggca

SEQ ID NO: 442125 - DNA, 25 bp, Mus musculus
ccatcaatacggaaggcagagggaa

SEQ ID NO: 442126 - DNA, 25 bp, Mus musculus
ggaaagagccgcgcaggcatccgcc

SEQ ID NO: 442127 - DNA, 25 bp, Mus musculus
aggcatccgccatcaatacggaagg

SEQ ID NO: 442128 - DNA, 25 bp, Mus musculus
catccgccatcaatacggaaggcag

SEQ ID NO: 442129 - DNA, 25 bp, Mus musculus
ccgccatcaatacggaaggcagagg

SEQ ID NO: 442130 - DNA, 25 bp, Mus musculus
cgcggacacagggtattatgtctgt

SEQ ID NO: 442131 - DNA, 25 bp, Mus musculus
cttttgtttacagcgacggtgggag

SEQ ID NO: 442132 - DNA, 25 bp, Mus musculus
ttatgtctgtcgacagctccaatta

SEQ ID NO: 442133 - DNA, 25 bp, Mus musculus
gtctgactagtgacagcgccatcca

SEQ ID NO: 442134 - DNA, 25 bp, Mus musculus
ttagctggcgtgtctgactagtgac

SEQ ID NO: 442135 - DNA, 25 bp, Mus musculus
agcgccatccacttttgtttacagc

SEQ ID NO: 442136 - DNA, 25 bp, Mus musculus
agctccaattagctggcgtgtctga

SEQ ID NO: 442137 - DNA, 25 bp, Mus musculus
acggtgggagctgtatctcgtctcc

SEQ ID NO: 442138 - DNA, 25 bp, Mus musculus
acagatggatggagctgtgtaatca

SEQ ID NO: 442139 - DNA, 25 bp, Mus musculus
ctgtgtaatcatcgagggaagcatg

SEQ ID NO: 442140 - DNA, 25 bp, Mus musculus
tcatcgagggaagcatgcgatcttc

SEQ ID NO: 442141 - DNA, 25 bp, Mus musculus
gcatgcgatcttctcccttcacaaa

SEQ ID NO: 442142 - DNA, 25 bp, Mus musculus
ttcacaaaccgccacgaggagcaga

SEQ ID NO: 442143 - DNA, 25 bp, Mus musculus
accgccacgaggagcagaaccaacg

SEQ ID NO: 442144 - DNA, 25 bp, Mus musculus
ccggactccgaactaggctcgtgcg

SEQ ID NO: 442145 - DNA, 25 bp, Mus musculus
ccggaaaggtcttcaccgcagaccg

SEQ ID NO: 442146 - DNA, 25 bp, Mus musculus
tccgaactaggctcgtgcgggctcc

SEQ ID NO: 442147 - DNA, 25 bp, Mus musculus
atgcactgcagcttgcggccgctga

SEQ ID NO: 442148 - DNA, 25 bp, Mus musculus
ctcttccacctgctgccgctcggtc

SEQ ID NO: 442149 - DNA, 25 bp, Mus musculus
ctccggaggaggtctgggtcctcct

SEQ ID NO: 442150 - DNA, 25 bp, Mus musculus
acttaagcccgaggggctcgcctgc

SEQ ID NO: 442151 - DNA, 25 bp, Mus musculus
agagcagaacttaagcccgaggggc

SEQ ID NO: 442152 - DNA, 25 bp, Mus musculus
ggacagcagagagcagaacttaagc

SEQ ID NO: 442153 - DNA, 25 bp, Mus musculus
ctcgggtagaaaagcggggacagca

SEQ ID NO: 442154 - DNA, 25 bp, Mus musculus
tgcttcgggtgacaacggtcagaga

SEQ ID NO: 442155 - DNA, 25 bp, Mus musculus
tccggtcacactcggagtcctcttc

SEQ ID NO: 442156 - DNA, 25 bp, Mus musculus
gcgagcctgacagcgctgaggtttt

SEQ ID NO: 442157 - DNA, 25 bp, Mus musculus
cagcgctgaggttttcgcgacaaac

SEQ ID NO: 442158 - DNA, 25 bp, Mus musculus
ctccggctccgcagcgaatggacgg

SEQ ID NO: 442159 - DNA, 25 bp, Mus musculus
ggctgcggacacacgctgagacccg

SEQ ID NO: 442160 - DNA, 25 bp, Mus musculus
tcaccatgttggtgtcctccggacc

SEQ ID NO: 442161 - DNA, 25 bp, Mus musculus
gaaggcagcaggtctcgggtccccc

SEQ ID NO: 442162 - DNA, 25 bp, Mus musculus
gtcctccgtgcgctcctaatagctc

SEQ ID NO: 442163 - DNA, 25 bp, Mus musculus
gcgggcacagtgaggacgaagcgcc

SEQ ID NO: 442164 - DNA, 25 bp, Mus musculus
tggcctgccggcatccgtggcacga

SEQ ID NO: 442165 - DNA, 25 bp, Mus musculus
ccgggctcccgctcatgcgcagtgc

SEQ ID NO: 442166 - DNA, 25 bp, Mus musculus
atgttggtgtcctccggacctctcc

SEQ ID NO: 442167 - DNA, 25 bp, Mus musculus
cgcggttcctcaccatgttggtgtc

SEQ ID NO: 442168 - DNA, 25 bp, Mus musculus
cgccgcggttcctcaccatgttggt

SEQ ID NO: 442169 - DNA, 25 bp, Mus musculus
gccagcgcggaccagcaaggccgac

SEQ ID NO: 442170 - DNA, 25 bp, Mus musculus
tcgcagggaccgagcctcagccgag

SEQ ID NO: 442171 - DNA, 25 bp, Mus musculus
actcagggcgccctcgtcacggccg

SEQ ID NO: 442172 - DNA, 25 bp, Mus musculus
ctccgaagagcaagtaggcgtctcc

SEQ ID NO: 442173 - DNA, 25 bp, Mus musculus
atctccgcgctgttctgctggattc

SEQ ID NO: 442174 - DNA, 25 bp, Mus musculus
gcacggaccggcagtacccctgagt

SEQ ID NO: 442175 - DNA, 25 bp, Mus musculus
ccctgagtcacctcggctgcagcag

SEQ ID NO: 442176 - DNA, 25 bp, Mus musculus
ggacccgtcgcaactggttcctgtc

SEQ ID NO: 442177 - DNA, 25 bp, Mus musculus
cgcgctgttctgctggattccaaaa

SEQ ID NO: 442178 - DNA, 25 bp, Mus musculus
tgctggattccaaaagctgcttggc

SEQ ID NO: 442179 - DNA, 25 bp, Mus musculus
agctgcttggcttattcttgaaagc

SEQ ID NO: 442180 - DNA, 25 bp, Mus musculus
ttattcttgaaagcgtccctccctg

SEQ ID NO: 442181 - DNA, 25 bp, Mus musculus
tgacccagcgcctcgcatccgggcc

SEQ ID NO: 442182 - DNA, 25 bp, Mus musculus
gatccgccaccgtagctccgaagag

SEQ ID NO: 442183 - DNA, 25 bp, Mus musculus
cagcagcaggatcgggacccgtcgc

SEQ ID NO: 442184 - DNA, 25 bp, Mus musculus
ttgaaagcgtccctccctgcgcaag

SEQ ID NO: 442185 - DNA, 25 bp, Mus musculus
ggttcctgtccaccgcagccaacaa

SEQ ID NO: 442186 - DNA, 25 bp, Mus musculus
cttcctgggcaacatcgagcaggta

SEQ ID NO: 442187 - DNA, 25 bp, Mus musculus
ggcgcagcccttgcgtcatcaggaa

SEQ ID NO: 442188 - DNA, 25 bp, Mus musculus
aagtgcgagctagcttccggttgca

SEQ ID NO: 442189 - DNA, 25 bp, Mus musculus
gggcttccagcgacttgaagtctga

SEQ ID NO: 442190 - DNA, 25 bp, Mus musculus
tctgaagtcaggagcagcatgtctg

SEQ ID NO: 442191 - DNA, 25 bp, Mus musculus
gtctggctgtgtgctgctctcgcgt

SEQ ID NO: 442192 - DNA, 25 bp, Mus musculus
ttgcgtcatcaggaagtgcgagcta

SEQ ID NO: 442193 - DNA, 25 bp, Mus musculus
cagagctgctcgttcgccaaggagc

SEQ ID NO: 442194 - DNA, 25 bp, Mus musculus
tcccacctttcattctggccagagt

SEQ ID NO: 442195 - DNA, 25 bp, Mus musculus
ctggccagagttgcatggaacgtta

SEQ ID NO: 442196 - DNA, 25 bp, Mus musculus
atggaacgttatccgagcccgtaga

SEQ ID NO: 442197 - DNA, 25 bp, Mus musculus
gccaaacatccgagaggctgggctc

SEQ ID NO: 442198 - DNA, 25 bp, Mus musculus
ccgtagaagccaaacatccgagagg

SEQ ID NO: 442199 - DNA, 25 bp, Mus musculus
ttcccgggtgctgagggaattcacg

SEQ ID NO: 442200 - DNA, 25 bp, Mus musculus
gagacacggccctttctgggaagtg

SEQ ID NO: 442201 - DNA, 25 bp, Mus musculus
gcactgatgcgcgtatcctgaatcc

SEQ ID NO: 442202 - DNA, 25 bp, Mus musculus
ctgtgttctcacgtcccaggctggt

SEQ ID NO: 442203 - DNA, 25 bp, Mus musculus
gcgctctccagaccaagagcttgtg

SEQ ID NO: 442204 - DNA, 25 bp, Mus musculus
cagcttcaccgttgctaggcgacga

SEQ ID NO: 442205 - DNA, 25 bp, Mus musculus
gcttgcggaagaacgggcagcttca

SEQ ID NO: 442206 - DNA, 25 bp, Mus musculus
aactctctcagaggcgggaggaatt

SEQ ID NO: 442207 - DNA, 25 bp, Mus musculus
cggctaagagaccttccgttgctta

SEQ ID NO: 442208 - DNA, 25 bp, Mus musculus
tgcctgatggcgctcagcaattggc

SEQ ID NO: 442209 - DNA, 25 bp, Mus musculus
tacgcgcctcgctgcaaagtagtcc

SEQ ID NO: 442210 - DNA, 25 bp, Mus musculus
atcctgaatccgaagccggtggttg

SEQ ID NO: 442211 - DNA, 25 bp, Mus musculus
aagtgtagttcttccggcgacctct

SEQ ID NO: 442212 - DNA, 25 bp, Mus musculus
cccgcaaaggttcggctggagacac

SEQ ID NO: 442213 - DNA, 25 bp, Mus musculus
ccttcgtgcattcctgacagtgcta

SEQ ID NO: 442214 - DNA, 25 bp, Mus musculus
ccttggtgggccatgcgtcaccgcg

SEQ ID NO: 442215 - DNA, 25 bp, Mus musculus
gcgtcaccgcgcagcctgagctgga

SEQ ID NO: 442216 - DNA, 25 bp, Mus musculus
actgctgaagcctgctggtgagtgt

SEQ ID NO: 442217 - DNA, 25 bp, Mus musculus
tgagcactgctgaagcctgctggtg

SEQ ID NO: 442218 - DNA, 25 bp, Mus musculus
aggacggtgagcactgctgaagcct

SEQ ID NO: 442219 - DNA, 25 bp, Mus musculus
tgtgcatggtgtcctgagactggag

SEQ ID NO: 442220 - DNA, 25 bp, Mus musculus
agtcaagccacaatggtgagtgtgc

SEQ ID NO: 442221 - DNA, 25 bp, Mus musculus
tccgcgtagtcaagccacaatggtg

SEQ ID NO: 442222 - DNA, 25 bp, Mus musculus
gcggactccgcgtagtcaagccaca

SEQ ID NO: 442223 - DNA, 25 bp, Mus musculus
cgtctgtagggtgccgggccatcca

SEQ ID NO: 442224 - DNA, 25 bp, Mus musculus
cggcatccgtttgccctgcgtctgt

SEQ ID NO: 442225 - DNA, 25 bp, Mus musculus
tccgtttgccctgcgtctgtagggt

SEQ ID NO: 442226 - DNA, 25 bp, Mus musculus
ctgagctggagatccccggtacccg

SEQ ID NO: 442227 - DNA, 25 bp, Mus musculus
gccatccaccgggaggacgcggact

SEQ ID NO: 442228 - DNA, 25 bp, Mus musculus
aggcagtactcttcacaactccgtg

SEQ ID NO: 442229 - DNA, 25 bp, Mus musculus
ttaccaggcagtagagcgcaggctg

SEQ ID NO: 442230 - DNA, 25 bp, Mus musculus
caggaccgatgcacacgccaaagga

SEQ ID NO: 442231 - DNA, 25 bp, Mus musculus
gctcactcttcgctacgctggaggc

SEQ ID NO: 442232 - DNA, 25 bp, Mus musculus
cgccaaaggacaaggcagtactctt

SEQ ID NO: 442233 - DNA, 25 bp, Mus musculus
tcacaactccgtgcaacggaaacgc

SEQ ID NO: 442234 - DNA, 25 bp, Mus musculus
gtgcaacggaaacgccctgggcagc

SEQ ID NO: 442235 - DNA, 25 bp, Mus musculus
cgggactacggccacttaccaggca

SEQ ID NO: 442236 - DNA, 25 bp, Mus musculus
cccagagacgctgcactataagccc

SEQ ID NO: 442237 - DNA, 25 bp, Mus musculus
tgccacatccctggatacggtactt

SEQ ID NO: 442238 - DNA, 25 bp, Mus musculus
gatacggtactttcctcagacaagg

SEQ ID NO: 442239 - DNA, 25 bp, Mus musculus
taccatggccacctccctaattagg

SEQ ID NO: 442240 - DNA, 25 bp, Mus musculus
gccctgccacgtcctagcctctatg

SEQ ID NO: 442241 - DNA, 25 bp, Mus musculus
ggggcttttcgctcactcttcgcta

SEQ ID NO: 442242 - DNA, 25 bp, Mus musculus
gcccgccactatgaaggagacgccg

SEQ ID NO: 442243 - DNA, 25 bp, Mus musculus
cgggttgtccgtggatacattgtca

SEQ ID NO: 442244 - DNA, 25 bp, Mus musculus
caccgtggctttgggtgtagactcg

SEQ ID NO: 442245 - DNA, 25 bp, Mus musculus
cctgcggtgtgaacaccgtggcttt

SEQ ID NO: 442246 - DNA, 25 bp, Mus musculus
tcctgctccgcgcaattgaggagaa

SEQ ID NO: 442247 - DNA, 25 bp, Mus musculus
aggagacgccgctttccaactgtga

SEQ ID NO: 442248 - DNA, 25 bp, Mus musculus
tacattgtcagttcggcctgttgtg

SEQ ID NO: 442249 - DNA, 25 bp, Mus musculus
ggacttgtctcggtgccgttcatcc

SEQ ID NO: 442250 - DNA, 25 bp, Mus musculus
agaagccggtgtgcggacttgtctc

SEQ ID NO: 442251 - DNA, 25 bp, Mus musculus
cctggatgacgtcggttttccgcgc

SEQ ID NO: 442252 - DNA, 25 bp, Mus musculus
tgatttgctacactgcctgtaccgg

SEQ ID NO: 442253 - DNA, 25 bp, Mus musculus
ccgggaaatcttcgttgatttgcta

SEQ ID NO: 442254 - DNA, 25 bp, Mus musculus
tgccgttcatcctttgcgtggcccg

SEQ ID NO: 442255 - DNA, 25 bp, Mus musculus
gctttccaactgtgagcgccgcttc

SEQ ID NO: 442256 - DNA, 25 bp, Mus musculus
cagccccttgccctccggccttggc

SEQ ID NO: 442257 - DNA, 25 bp, Mus musculus
ctggaggtcgaccagatgtccgaaa

SEQ ID NO: 442258 - DNA, 25 bp, Mus musculus
tgctggaggtcgaccagatgtccga

SEQ ID NO: 442259 - DNA, 25 bp, Mus musculus
gatgctggaggtcgaccagatgtcc

SEQ ID NO: 442260 - DNA, 25 bp, Mus musculus
ccgatgctggaggtcgaccagatgt

SEQ ID NO: 442261 - DNA, 25 bp, Mus musculus
caacttcggaggtcgaccagtactc

SEQ ID NO: 442262 - DNA, 25 bp, Mus musculus
ccaacttcggaggtcgaccagtact

SEQ ID NO: 442263 - DNA, 25 bp, Mus musculus
ccgcggcggcgacgtgcgtacgagg

SEQ ID NO: 442264 - DNA, 25 bp, Mus musculus
gcgttcggcgccaggcctctggcgg

SEQ ID NO: 442265 - DNA, 25 bp, Mus musculus
gggatcgtcttctcctccgtctccc

SEQ ID NO: 442266 - DNA, 25 bp, Mus musculus
ccttccgtcgctctccttgggtgtg

SEQ ID NO: 442267 - DNA, 25 bp, Mus musculus
tccgtcgctctccttgggtgtggga

SEQ ID NO: 442268 - DNA, 25 bp, Mus musculus
agcctcgtgccgtcgcgaccgcggc

SEQ ID NO: 442269 - DNA, 25 bp, Mus musculus
ggggcgctctctccgcccgagcatc

SEQ ID NO: 442270 - DNA, 25 bp, Mus musculus
ctgccctcggcttgagcaatgctga

SEQ ID NO: 442271 - DNA, 25 bp, Mus musculus
cgcctccacagttaatagcccagag

SEQ ID NO: 442272 - DNA, 25 bp, Mus musculus
atgctgagaaactgcgctatgcgcc

SEQ ID NO: 442273 - DNA, 25 bp, Mus musculus
ctctttctggaacagagcagagagc

SEQ ID NO: 442274 - DNA, 25 bp, Mus musculus
actcttggggccacgcctgcgaggc

SEQ ID NO: 442275 - DNA, 25 bp, Mus musculus
cgctgcgccagtgcagtaaccgtgg

SEQ ID NO: 442276 - DNA, 25 bp, Mus musculus
agtgcagtaaccgtggctgagagcc

SEQ ID NO: 442277 - DNA, 25 bp, Mus musculus
ggctgagagccggacgcaaaatctc

SEQ ID NO: 442278 - DNA, 25 bp, Mus musculus
accaaaagcgggtgtagaggattcg

SEQ ID NO: 442279 - DNA, 25 bp, Mus musculus
tagaggattcggtccgcccggattc

SEQ ID NO: 442280 - DNA, 25 bp, Mus musculus
ccggattcggagaggcgccagcact

SEQ ID NO: 442281 - DNA, 25 bp, Mus musculus
atagcccagagtcggcgtgtggata

SEQ ID NO: 442282 - DNA, 25 bp, Mus musculus
gcagagagcagcgtcctgccctcgg

SEQ ID NO: 442283 - DNA, 25 bp, Mus musculus
tggatagtgtggctctttctggaac

SEQ ID NO: 442284 - DNA, 25 bp, Mus musculus
cagttgtgaagcaagctcgggtcgt

SEQ ID NO: 442285 - DNA, 25 bp, Mus musculus
ggtgacccgcacacaccgccagcgg

SEQ ID NO: 442286 - DNA, 25 bp, Mus musculus
aaacattccggtcaccgtggccagc

SEQ ID NO: 442287 - DNA, 25 bp, Mus musculus
ccaggcacccgtcctgcagttgtga

SEQ ID NO: 442288 - DNA, 25 bp, Mus musculus
tcctgcagttgtgaagcaagctcgg

SEQ ID NO: 442289 - DNA, 25 bp, Mus musculus
gtcgtgtggcaggaagctacccaac

SEQ ID NO: 442290 - DNA, 25 bp, Mus musculus
aggaagctacccaacgcgcagtcgc

SEQ ID NO: 442291 - DNA, 25 bp, Mus musculus
ggctgcaaccacagcccagcggagg

SEQ ID NO: 442292 - DNA, 25 bp, Mus musculus
cgtcccaggaggtccgcgcctaggt

SEQ ID NO: 442293 - DNA, 25 bp, Mus musculus
aggtccgcgcctaggtaccttcgct

SEQ ID NO: 442294 - DNA, 25 bp, Mus musculus
tcttcaaaacattccggtcaccgtg

SEQ ID NO: 442295 - DNA, 25 bp, Mus musculus
aggtaccttcgctcgctcttcaaaa

SEQ ID NO: 442296 - DNA, 25 bp, Mus musculus
ctcgcgccaaggaaggtacgcgtga

SEQ ID NO: 442297 - DNA, 25 bp, Mus musculus
agtccggacccactcggaagcgtgc

SEQ ID NO: 442298 - DNA, 25 bp, Mus musculus
tgaagtccgagaaggtgcagcatgc

SEQ ID NO: 442299 - DNA, 25 bp, Mus musculus
ctgcactgagctatggcgttcgtga

SEQ ID NO: 442300 - DNA, 25 bp, Mus musculus
tcctcggctgctgcactgagctatg

SEQ ID NO: 442301 - DNA, 25 bp, Mus musculus
ggcgttcgtgaccaggcaattcttg

SEQ ID NO: 442302 - DNA, 25 bp, Mus musculus
ccaggcaattcttgcgctccatgtc

SEQ ID NO: 442303 - DNA, 25 bp, Mus musculus
ccaagaagatcctgatcaagcatgt

SEQ ID NO: 442304 - DNA, 25 bp, Mus musculus
cctgatcaagcatgtgaccgtcatc

SEQ ID NO: 442305 - DNA, 25 bp, Mus musculus
tggtggaaatagtttgatgaagtcc

SEQ ID NO: 442306 - DNA, 25 bp, Mus musculus
cttctcaactaactgccgggccggg

SEQ ID NO: 442307 - DNA, 25 bp, Mus musculus
gtgcagcatgcttcagtgtcccaga

SEQ ID NO: 442308 - DNA, 25 bp, Mus musculus
agtgtcccagaactacagccttcgg

SEQ ID NO: 442309 - DNA, 25 bp, Mus musculus
tcggcccgatccttacgtgcatgct

SEQ ID NO: 442310 - DNA, 25 bp, Mus musculus
tacgtgcatgcttctcaactaactg

SEQ ID NO: 442311 - DNA, 25 bp, Mus musculus
aagcatgtgaccgtcatcggcggcg

SEQ ID NO: 442312 - DNA, 25 bp, Mus musculus
gccttcgcagctgcagcatccttga

SEQ ID NO: 442313 - DNA, 25 bp, Mus musculus
gggaaaactctttgaccgcgtcgca

SEQ ID NO: 442314 - DNA, 25 bp, Mus musculus
tgaccgcgtcgcagtcctttggtcc

SEQ ID NO: 442315 - DNA, 25 bp, Mus musculus
ttaaatgcgctctagcgggagccca

SEQ ID NO: 442316 - DNA, 25 bp, Mus musculus
aaagacaccgtgatgccgggaccgc

SEQ ID NO: 442317 - DNA, 25 bp, Mus musculus
agcatccttgagcttcgcgaaaaca

SEQ ID NO: 442318 - DNA, 25 bp, Mus musculus
aaacagcgttgatgagaaaccactc

SEQ ID NO: 442319 - DNA, 25 bp, Mus musculus
ccatgagctgtctggatgttatgta

SEQ ID NO: 442320 - DNA, 25 bp, Mus musculus
tgttatgtaccaggtctacggtccc

SEQ ID NO: 442321 - DNA, 25 bp, Mus musculus
taccaccaggtacgggtcgtccaga

SEQ ID NO: 442322 - DNA, 25 bp, Mus musculus
cggctacaaaagtaccactacctga

SEQ ID NO: 442323 - DNA, 25 bp, Mus musculus
agcttccacgctccagggcgacaga

SEQ ID NO: 442324 - DNA, 25 bp, Mus musculus
gacagacaggcacccaaagacaccg

SEQ ID NO: 442325 - DNA, 25 bp, Mus musculus
gcgccacgggctgcagggtttaaat

SEQ ID NO: 442326 - DNA, 25 bp, Mus musculus
ccctgctgccgcagatggtggatgc

SEQ ID NO: 442327 - DNA, 25 bp, Mus musculus
gactacagacgactacagactaccg

SEQ ID NO: 442328 - DNA, 25 bp, Mus musculus
cgcgactacagacgactacagacta

SEQ ID NO: 442329 - DNA, 25 bp, Mus musculus
agccgcgactacagacgactacaga

SEQ ID NO: 442330 - DNA, 25 bp, Mus musculus
cagatggtggatgcggagcgccaga

SEQ ID NO: 442331 - DNA, 25 bp, Mus musculus
gactgccgggttagggctgaggcat

SEQ ID NO: 442332 - DNA, 25 bp, Mus musculus
ggcaaggggcaccgagaattgtccc

SEQ ID NO: 442333 - DNA, 25 bp, Mus musculus
gcgcccaagttggacgggacgggca

SEQ ID NO: 442334 - DNA, 25 bp, Mus musculus
ctggtcattcatggcgcccaagttg

SEQ ID NO: 442335 - DNA, 25 bp, Mus musculus
atactggtcattcatggcgcccaag

SEQ ID NO: 442336 - DNA, 25 bp, Mus musculus
gtgatactggtcattcatggcgccc

SEQ ID NO: 442337 - DNA, 25 bp, Mus musculus
cccggtgatactggtcattcatggc

SEQ ID NO: 442338 - DNA, 25 bp, Mus musculus
cggcccggtgatactggtcattcat

SEQ ID NO: 442339 - DNA, 25 bp, Mus musculus
gccagagccgcgactacagacgact

SEQ ID NO: 442340 - DNA, 25 bp, Mus musculus
gggtttcgaagcctgcatttgaaaa

SEQ ID NO: 442341 - DNA, 25 bp, Mus musculus
cctcacttggatgcgctcaggccgg

SEQ ID NO: 442342 - DNA, 25 bp, Mus musculus
tcgttggtgttcatggctgtacggc

SEQ ID NO: 442343 - DNA, 25 bp, Mus musculus
tactccttggcgtcgttggtgttca

SEQ ID NO: 442344 - DNA, 25 bp, Mus musculus
gaggaatgtccctccgggccaggta

SEQ ID NO: 442345 - DNA, 25 bp, Mus musculus
ctcgaaaagctgaggaatgtccctc

SEQ ID NO: 442346 - DNA, 25 bp, Mus musculus
ccagcctcttacctcgaaaagctga

SEQ ID NO: 442347 - DNA, 25 bp, Mus musculus
acattcgctggggatcctttggcca

SEQ ID NO: 442348 - DNA, 25 bp, Mus musculus
acaccggaaggtgcagccgggcact

SEQ ID NO: 442349 - DNA, 25 bp, Mus musculus
tagggaccctacaccggaaggtgca

SEQ ID NO: 442350 - DNA, 25 bp, Mus musculus
gtgagcgccttcattagggacccta

SEQ ID NO: 442351 - DNA, 25 bp, Mus musculus
gacccgagcgcacaaggcgacttgt

SEQ ID NO: 442352 - DNA, 25 bp, Mus musculus
ctgcatttgaaaaggacccgagcga

SEQ ID NO: 442353 - DNA, 25 bp, Mus musculus
gactcccgggcagctgtgcagtccg

SEQ ID NO: 442354 - DNA, 25 bp, Mus musculus
gacctcccgagccagcgacccctgt

SEQ ID NO: 442355 - DNA, 25 bp, Mus musculus
cgagccagcgacccctgtaagtccg

SEQ ID NO: 442356 - DNA, 25 bp, Mus musculus
agcagcccgggcagccacgctcagc

SEQ ID NO: 442357 - DNA, 25 bp, Mus musculus
gcagcccgggcagccacgctcagcc

SEQ ID NO: 442358 - DNA, 25 bp, Mus musculus
accagacctcccgagccagcgaccc

SEQ ID NO: 442359 - DNA, 25 bp, Mus musculus
ccagacctcccgagccagcgacccc

SEQ ID NO: 442360 - DNA, 25 bp, Mus musculus
cagacctcccgagccagcgacccct

SEQ ID NO: 442361 - DNA, 25 bp, Mus musculus
agacctcccgagccagcgacccctg

SEQ ID NO: 442362 - DNA, 25 bp, Mus musculus
acctcccgagccagcgacccctgta

SEQ ID NO: 442363 - DNA, 25 bp, Mus musculus
ctcccgagccagcgacccctgtaag

SEQ ID NO: 442364 - DNA, 25 bp, Mus musculus
tcccgagccagcgacccctgtaagt

SEQ ID NO: 442365 - DNA, 25 bp, Mus musculus
cccgagccagcgacccctgtaagtc

SEQ ID NO: 442366 - DNA, 25 bp, Mus musculus
cctcccgagccagcgacccctgtaa

SEQ ID NO: 442367 - DNA, 25 bp, Mus musculus
ccgagccagcgacccctgtaagtcc

SEQ ID NO: 442368 - DNA, 25 bp, Mus musculus
ctcccttccgcctgcctaggcccca

SEQ ID NO: 442369 - DNA, 25 bp, Mus musculus
aggaaggaacgcgcccgcgtcacag

SEQ ID NO: 442370 - DNA, 25 bp, Mus musculus
aagaggaaggaacgcgcccgcgtca

SEQ ID NO: 442371 - DNA, 25 bp, Mus musculus
gggccgacatgacggcgcggctggc

SEQ ID NO: 442372 - DNA, 25 bp, Mus musculus
tccgccgagcttgggcggcatccgg

SEQ ID NO: 442373 - DNA, 25 bp, Mus musculus
agctccgccgagcttgggcggcatc

SEQ ID NO: 442374 - DNA, 25 bp, Mus musculus
acagctccgccgagcttgggcggca

SEQ ID NO: 442375 - DNA, 25 bp, Mus musculus
ggtgccaggccggagacagctccgc

SEQ ID NO: 442376 - DNA, 25 bp, Mus musculus
caccgttctgctgcggcggtgccag

SEQ ID NO: 442377 - DNA, 25 bp, Mus musculus
tcaccgttctgctgcggcggtgcca

SEQ ID NO: 442378 - DNA, 25 bp, Mus musculus
gcctcaccgttctgctgcggcggtg

SEQ ID NO: 442379 - DNA, 25 bp, Mus musculus
cctcccgcctcaccgttctgctgcg

SEQ ID NO: 442380 - DNA, 25 bp, Mus musculus
ttccgcctgcctaggccccacgccg

SEQ ID NO: 442381 - DNA, 25 bp, Mus musculus
cgccaccaccgcacgcgtgcggacc

SEQ ID NO: 442382 - DNA, 25 bp, Mus musculus
cgagcatggaattgaaccttgagcc

SEQ ID NO: 442383 - DNA, 25 bp, Mus musculus
actatcttccgctcagcctcggtga

SEQ ID NO: 442384 - DNA, 25 bp, Mus musculus
ggaggccattctcgcgaggagttct

SEQ ID NO: 442385 - DNA, 25 bp, Mus musculus
aggagttctcctctcgcgggatttc

SEQ ID NO: 442386 - DNA, 25 bp, Mus musculus
gcgggatttccctgcgtccagaatc

SEQ ID NO: 442387 - DNA, 25 bp, Mus musculus
tagaggtttctaccggcgagcgcac

SEQ ID NO: 442388 - DNA, 25 bp, Mus musculus
tccttagcgcgaagcggaaactatc

SEQ ID NO: 442389 - DNA, 25 bp, Mus musculus
aagcttgcgcggaggttccgtctct

SEQ ID NO: 442390 - DNA, 25 bp, Mus musculus
tctctggccgcttctgcagggaagc

SEQ ID NO: 442391 - DNA, 25 bp, Mus musculus
tactgaagtacttcggggcgcagtc

SEQ ID NO: 442392 - DNA, 25 bp, Mus musculus
cgtcctgtcagataaggggcgcctg

SEQ ID NO: 442393 - DNA, 25 bp, Mus musculus
gcctgcgcagcttgcctaccagaga

SEQ ID NO: 442394 - DNA, 25 bp, Mus musculus
cacgcagggactgtgtagaggtttc

SEQ ID NO: 442395 - DNA, 25 bp, Mus musculus
cgctaggaccgggagaaacaggact

SEQ ID NO: 442396 - DNA, 25 bp, Mus musculus
tctggcattcgagagaggttctggc

SEQ ID NO: 442397 - DNA, 25 bp, Mus musculus
ttgcagcgccggcaagaaacacgcg

SEQ ID NO: 442398 - DNA, 25 bp, Mus musculus
ctgcactttgcagcgccggcaagaa

SEQ ID NO: 442399 - DNA, 25 bp, Mus musculus
agatggagcagctgcactttgcagc

SEQ ID NO: 442400 - DNA, 25 bp, Mus musculus
aggttctggcatcccgcaggaccag

SEQ ID NO: 442401 - DNA, 25 bp, Mus musculus
cagagaggttctggcattcgagaga

SEQ ID NO: 442402 - DNA, 25 bp, Mus musculus
gcacgaaagctccagagaggttctg

SEQ ID NO: 442403 - DNA, 25 bp, Mus musculus
agcctgggtcgccaggcacgaaagc

SEQ ID NO: 442404 - DNA, 25 bp, Mus musculus
ccaggagtctgcactgagcagggat

SEQ ID NO: 442405 - DNA, 25 bp, Mus musculus
gtccgctgccacaaatgccacggga

SEQ ID NO: 442406 - DNA, 25 bp, Mus musculus
acaaaaggcggtgcgagtccgctgc

SEQ ID NO: 442407 - DNA, 25 bp, Mus musculus
tcttgcatcagacaaaaggcggtgc

SEQ ID NO: 442408 - DNA, 25 bp, Mus musculus
gagcgccaaggtcttgcatcagaca

SEQ ID NO: 442409 - DNA, 25 bp, Mus musculus
tcccgcaggaccagatggagcagct

SEQ ID NO: 442410 - DNA, 25 bp, Mus musculus
tcatcttcggaagccgcggggagaa

SEQ ID NO: 442411 - DNA, 25 bp, Mus musculus
cgccagggcagcgagaatgcccaag

SEQ ID NO: 442412 - DNA, 25 bp, Mus musculus
ggctttttccctccggtgctgccag

SEQ ID NO: 442413 - DNA, 25 bp, Mus musculus
ttccctccggtgctgccagagtgag

SEQ ID NO: 442414 - DNA, 25 bp, Mus musculus
ctccggtgctgccagagtgaggaca

SEQ ID NO: 442415 - DNA, 25 bp, Mus musculus
gcaggagctggccagcgcgcatggt

SEQ ID NO: 442416 - DNA, 25 bp, Mus musculus
ccagggcagcgagaatgcccaagtc

SEQ ID NO: 442417 - DNA, 25 bp, Mus musculus
agcgagaatgcccaagtcggcgatg

SEQ ID NO: 442418 - DNA, 25 bp, Mus musculus
cgagaatgcccaagtcggcgatggc

SEQ ID NO: 442419 - DNA, 25 bp, Mus musculus
gcgcgctcgcttccagccacccgat

SEQ ID NO: 442420 - DNA, 25 bp, Mus musculus
ctctcatcttcggaagccgcgggga

SEQ ID NO: 442421 - DNA, 25 bp, Mus musculus
gaggctttttccctccggtgctgcc

SEQ ID NO: 442422 - DNA, 25 bp, Mus musculus
ctcgcttccagccacccgatgatgg

SEQ ID NO: 442423 - DNA, 25 bp, Mus musculus
tttttccctccggtgctgccagagt

SEQ ID NO: 442424 - DNA, 25 bp, Mus musculus
caggaaatcggcgacctcggcagct

SEQ ID NO: 442425 - DNA, 25 bp, Mus musculus
tcttcattgaagaccgcgaggagga

SEQ ID NO: 442426 - DNA, 25 bp, Mus musculus
ctgctaccggctagaacagcatgga

SEQ ID NO: 442427 - DNA, 25 bp, Mus musculus
ggagctcgacgcacctgacaagaaa

SEQ ID NO: 442428 - DNA, 25 bp, Mus musculus
ggagtacaagatcctttgcctctgc

SEQ ID NO: 442429 - DNA, 25 bp, Mus musculus
ccatgtggccgaaatgctgctcttc

SEQ ID NO: 442430 - DNA, 25 bp, Mus musculus
ttgcgagaagtggaaccatgtggcc

SEQ ID NO: 442431 - DNA, 25 bp, Mus musculus
gcgagcccggataacgaaatgtgtt

SEQ ID NO: 442432 - DNA, 25 bp, Mus musculus
ggcccagtcgcggacaacaccagag

SEQ ID NO: 442433 - DNA, 25 bp, Mus musculus
cgcgagttacgcctttctgtcttca

SEQ ID NO: 442434 - DNA, 25 bp, Mus musculus
agccacattgggtgtaggaccgtcg

SEQ ID NO: 442435 - DNA, 25 bp, Mus musculus
cctgagaggaagaaggccgagccac

SEQ ID NO: 442436 - DNA, 25 bp, Mus musculus
gccggtttcctttaactgcctgaga

SEQ ID NO: 442437 - DNA, 25 bp, Mus musculus
ctcccgggcatttgtggagtaagtc

SEQ ID NO: 442438 - DNA, 25 bp, Mus musculus
tcctcagcggcttccggacggctgg

SEQ ID NO: 442439 - DNA, 25 bp, Mus musculus
ccagggaaccgaggctggagccggg

SEQ ID NO: 442440 - DNA, 25 bp, Mus musculus
ctggagccgggagttgggaggattt

SEQ ID NO: 442441 - DNA, 25 bp, Mus musculus
agttgggaggatttcgtagagggag

SEQ ID NO: 442442 - DNA, 25 bp, Mus musculus
cgctcgggctgtgccgcgttgtcat

SEQ ID NO: 442443 - DNA, 25 bp, Mus musculus
cccgaggttcggttgtgtggagctg

SEQ ID NO: 442444 - DNA, 25 bp, Mus musculus
tctcggagctggtccggcgctctgc

SEQ ID NO: 442445 - DNA, 25 bp, Mus musculus
tggtccggcgctctgcttcgggccc

SEQ ID NO: 442446 - DNA, 25 bp, Mus musculus
ctggccgggtcctcgcccgcactcg

SEQ ID NO: 442447 - DNA, 25 bp, Mus musculus
gtgacaacggttagctgcggagccg

SEQ ID NO: 442448 - DNA, 25 bp, Mus musculus
gtggcgtcctcagcggcttccggac

SEQ ID NO: 442449 - DNA, 25 bp, Mus musculus
cagggcgcgacggaccggaggtgac

SEQ ID NO: 442450 - DNA, 25 bp, Mus musculus
accggaggtgacaacggttagctgc

SEQ ID NO: 442451 - DNA, 25 bp, Mus musculus
cactcggtggcgtcctcagcggctt

SEQ ID NO: 442452 - DNA, 25 bp, Mus musculus
tctcgccggagccatggtgccgaga

SEQ ID NO: 442453 - DNA, 25 bp, Mus musculus
ctcggaaaaccgcagcttccggtcg

SEQ ID NO: 442454 - DNA, 25 bp, Mus musculus
caagtctgggagactcggtcctgcg

SEQ ID NO: 442455 - DNA, 25 bp, Mus musculus
gccgcaccacacgcgcgaggaggaa

SEQ ID NO: 442456 - DNA, 25 bp, Mus musculus
ccggcctagagagcccgccgcacca

SEQ ID NO: 442457 - DNA, 25 bp, Mus musculus
catagagacgcaccggcctagagag

SEQ ID NO: 442458 - DNA, 25 bp, Mus musculus
tgcggccatagagacgcaccggcct

SEQ ID NO: 442459 - DNA, 25 bp, Mus musculus
ccgagagagtctgcggaactgacgc

SEQ ID NO: 442460 - DNA, 25 bp, Mus musculus
tgccgagagagtctgcggaactgac

SEQ ID NO: 442461 - DNA, 25 bp, Mus musculus
cgccgttccctagcgaccgcccgca

SEQ ID NO: 442462 - DNA, 25 bp, Mus musculus
ctcactgcaccggtgtgcgggtgca

SEQ ID NO: 442463 - DNA, 25 bp, Mus musculus
ctccgaaccacagcctcgctccagg

SEQ ID NO: 442464 - DNA, 25 bp, Mus musculus
caagcccagggctccgaaccacagc

SEQ ID NO: 442465 - DNA, 25 bp, Mus musculus
aaaccgcagcttccggtcgaccgag

SEQ ID NO: 442466 - DNA, 25 bp, Mus musculus
gcgcggtcagcctgcaacaactttt

SEQ ID NO: 442467 - DNA, 25 bp, Mus musculus
gccgcgcaagtctactgccgggctt

SEQ ID NO: 442468 - DNA, 25 bp, Mus musculus
tctcggccaatcctggccaagtgga

SEQ ID NO: 442469 - DNA, 25 bp, Mus musculus
cccgagtaccttacataacgcgcgg

SEQ ID NO: 442470 - DNA, 25 bp, Mus musculus
cggcaacacgagctcccattggtca

SEQ ID NO: 442471 - DNA, 25 bp, Mus musculus
attggtcgctgttaccggcaacacg

SEQ ID NO: 442472 - DNA, 25 bp, Mus musculus
gccggcgagcatcgagaaacacctc

SEQ ID NO: 442473 - DNA, 25 bp, Mus musculus
ttccaccgtccttgctgggaagccg

SEQ ID NO: 442474 - DNA, 25 bp, Mus musculus
cacgctcatctgaggggcacttttc

SEQ ID NO: 442475 - DNA, 25 bp, Mus musculus
ctacagcgacagctcgatggcggaa

SEQ ID NO: 442476 - DNA, 25 bp, Mus musculus
ggcacttttctcctcagcatttcca

SEQ ID NO: 442477 - DNA, 25 bp, Mus musculus
atttccacagactctgctggggtga

SEQ ID NO: 442478 - DNA, 25 bp, Mus musculus
cgccttcgggaaagactggtcgccg

SEQ ID NO: 442479 - DNA, 25 bp, Mus musculus
tccgcgcagccaacaggtaagtgga

SEQ ID NO: 442480 - DNA, 25 bp, Mus musculus
cgcgtcactcacattttggcggcgg

SEQ ID NO: 442481 - DNA, 25 bp, Mus musculus
tcagcgcagcgcgtcactcacattt

SEQ ID NO: 442482 - DNA, 25 bp, Mus musculus
acggactcgcgctgcaggcaaccga

SEQ ID NO: 442483 - DNA, 25 bp, Mus musculus
agtccgagtgtcaagcagcggccac

SEQ ID NO: 442484 - DNA, 25 bp, Mus musculus
gcgaggcctccactcgagtccgagt

SEQ ID NO: 442485 - DNA, 25 bp, Mus musculus
ggtcgcaggagtgggccaccatccc

SEQ ID NO: 442486 - DNA, 25 bp, Mus musculus
cgacgcgctcttagtcgccaggggc

SEQ ID NO: 442487 - DNA, 25 bp, Mus musculus
cagcgcgggctgtcacctcggagca

SEQ ID NO: 442488 - DNA, 25 bp, Mus musculus
gcctgcgcctttgggctgggctctt

SEQ ID NO: 442489 - DNA, 25 bp, Mus musculus
gagtgagcgttcacgctcgctcccg

SEQ ID NO: 442490 - DNA, 25 bp, Mus musculus
cccgcgcacagagtgagcgttcacg

SEQ ID NO: 442491 - DNA, 25 bp, Mus musculus
agcgccaaacgctggcctacgacgg

SEQ ID NO: 442492 - DNA, 25 bp, Mus musculus
gtaggcctgcgaggcctccactcga

SEQ ID NO: 442493 - DNA, 25 bp, Mus musculus
gccgcttcctcggtcaggcggtgtc

SEQ ID NO: 442494 - DNA, 25 bp, Mus musculus
tcgctgtccagacgcggtgccttac

SEQ ID NO: 442495 - DNA, 25 bp, Mus musculus
ttcggacctcgcagtgatcccttca

SEQ ID NO: 442496 - DNA, 25 bp, Mus musculus
accatgtcggaggaactggtcccgc

SEQ ID NO: 442497 - DNA, 25 bp, Mus musculus
gaactggtcccgcatcccaatgaga

SEQ ID NO: 442498 - DNA, 25 bp, Mus musculus
atcccaatgagagcctgccggggcc

SEQ ID NO: 442499 - DNA, 25 bp, Mus musculus
tgctgtcggtgctgttggctgtcaa

SEQ ID NO: 442500 - DNA, 25 bp, Mus musculus
ctgttggctgtcaacgtgctgctgc

SEQ ID NO: 442501 - DNA, 25 bp, Mus musculus
gcctgcacgctcatcagcggcggtg

SEQ ID NO: 442502 - DNA, 25 bp, Mus musculus
tcatcagcggcggtgccttcaacaa

SEQ ID NO: 442503 - DNA, 25 bp, Mus musculus
ccttcaacaaggtggcggtgtatga

SEQ ID NO: 442504 - DNA, 25 bp, Mus musculus
acacggacgtgttcgctctgctcac

SEQ ID NO: 442505 - DNA, 25 bp, Mus musculus
tctgctcaccaccatgatgctgctg

SEQ ID NO: 442506 - DNA, 25 bp, Mus musculus
tggccgcgctatggatagtcttcta

SEQ ID NO: 442507 - DNA, 25 bp, Mus musculus
tggatagtcttctacctcctccgca

SEQ ID NO: 442508 - DNA, 25 bp, Mus musculus
tggcgcacgtaaacacactccgtct

SEQ ID NO: 442509 - DNA, 25 bp, Mus musculus
tccaacaccgcgagggccaatcgaa

SEQ ID NO: 442510 - DNA, 25 bp, Mus musculus
ctcactaggacgtgggagcacagtc

SEQ ID NO: 442511 - DNA, 25 bp, Mus musculus
ttcgccaggcgcacactcactagga

SEQ ID NO: 442512 - DNA, 25 bp, Mus musculus
gcaccctcgcgagcacgcgtgttgt

SEQ ID NO: 442513 - DNA, 25 bp, Mus musculus
agaatcacgcgtgcctgcacctagc

SEQ ID NO: 442514 - DNA, 25 bp, Mus musculus
cgcgcctgtaaagacaacccgaatg

SEQ ID NO: 442515 - DNA, 25 bp, Mus musculus
ccagggttcactcgcgccataaaca

SEQ ID NO: 442516 - DNA, 25 bp, Mus musculus
ctcaaacctacttgcagctgcgatc

SEQ ID NO: 442517 - DNA, 25 bp, Mus musculus
gcgcgtctcacacgcagtactcaaa

SEQ ID NO: 442518 - DNA, 25 bp, Mus musculus
ttgctccagaaacacagctcggctc

SEQ ID NO: 442519 - DNA, 25 bp, Mus musculus
cgcaccagcgattgctccagaaaca

SEQ ID NO: 442520 - DNA, 25 bp, Mus musculus
gtaaacacgggcctcgcaccagcga

SEQ ID NO: 442521 - DNA, 25 bp, Mus musculus
gggccaatcgaagtgagctacgtca

SEQ ID NO: 442522 - DNA, 25 bp, Mus musculus
cgcgtcaccagctactgcgtgaaaa

SEQ ID NO: 442523 - DNA, 25 bp, Mus musculus
ctgggcacgttcatttagagatcta

SEQ ID NO: 442524 - DNA, 25 bp, Mus musculus
gcctagtgcgcgctaaagctctatg

SEQ ID NO: 442525 - DNA, 25 bp, Mus musculus
agctctatgtttcgggaccaggcgc

SEQ ID NO: 442526 - DNA, 25 bp, Mus musculus
cctggccctgaatccggtaaacaag

SEQ ID NO: 442527 - DNA, 25 bp, Mus musculus
caggggaaggacaaatagcgctctc

SEQ ID NO: 442528 - DNA, 25 bp, Mus musculus
ccagccctcaatcacagtgcttttg

SEQ ID NO: 442529 - DNA, 25 bp, Mus musculus
agtgcttttgcgctttccctgccag

SEQ ID NO: 442530 - DNA, 25 bp, Mus musculus
ggctgcgcgctcttcctatgaacac

SEQ ID NO: 442531 - DNA, 25 bp, Mus musculus
cacacgtccctgcagtttggtgagc

SEQ ID NO: 442532 - DNA, 25 bp, Mus musculus
gctgtagcttctgcctccacacaaa

SEQ ID NO: 442533 - DNA, 25 bp, Mus musculus
agctcgctgccaagccaaccggttg

SEQ ID NO: 442534 - DNA, 25 bp, Mus musculus
aagggagatgcttacccgcctggcc

SEQ ID NO: 442535 - DNA, 25 bp, Mus musculus
cacggcccatcagacgagtgaaatg

SEQ ID NO: 442536 - DNA, 25 bp, Mus musculus
cattgccgttgctgtcgctcacacg

SEQ ID NO: 442537 - DNA, 25 bp, Mus musculus
ttttctccaattacggtgagagccc

SEQ ID NO: 442538 - DNA, 25 bp, Mus musculus
tcttctaccgcaaacgtcttttctc

SEQ ID NO: 442539 - DNA, 25 bp, Mus musculus
tggtgtcacgcagaggcgtcttcta

SEQ ID NO: 442540 - DNA, 25 bp, Mus musculus
ctggacagccctggtgtcacgcaga

SEQ ID NO: 442541 - DNA, 25 bp, Mus musculus
cccagacgtttgctggacagccctg

SEQ ID NO: 442542 - DNA, 25 bp, Mus musculus
aaactcattgccgttgctgtcgctc

SEQ ID NO: 442543 - DNA, 25 bp, Mus musculus
gttcactttacacagaaactcattg

SEQ ID NO: 442544 - DNA, 25 bp, Mus musculus
cgccggtctcttcgttcactttaca

SEQ ID NO: 442545 - DNA, 25 bp, Mus musculus
aaagagtgagcagcacgccggtctc

SEQ ID NO: 442546 - DNA, 25 bp, Mus musculus
cttcgatagctaggaaagagtgagc

SEQ ID NO: 442547 - DNA, 25 bp, Mus musculus
tcctcgcaaagcttcgatagctagg

SEQ ID NO: 442548 - DNA, 25 bp, Mus musculus
ggagcttttagacagtgcgcgcatt

SEQ ID NO: 442549 - DNA, 25 bp, Mus musculus
gtgcgcgcatttgcttcctcgcaaa

SEQ ID NO: 442550 - DNA, 25 bp, Mus musculus
tacagtgtttcccaagccgtccaga

SEQ ID NO: 442551 - DNA, 25 bp, Mus musculus
ccctgccggagggatacgtaaggca

SEQ ID NO: 442552 - DNA, 25 bp, Mus musculus
ggctctcaccttccggcttgttttc

SEQ ID NO: 442553 - DNA, 25 bp, Mus musculus
gtgccggttcacagcgttcccgaac

SEQ ID NO: 442554 - DNA, 25 bp, Mus musculus
gaccgtcatgaggaaggcgctcgct

SEQ ID NO: 442555 - DNA, 25 bp, Mus musculus
ccgagacgtggtgttttgattggac

SEQ ID NO: 442556 - DNA, 25 bp, Mus musculus
acggaatatttcctcgaggccgaga

SEQ ID NO: 442557 - DNA, 25 bp, Mus musculus
ggatgaggctgacacggaatatttc

SEQ ID NO: 442558 - DNA, 25 bp, Mus musculus
caccgcaccgactaaagtgattggc

SEQ ID NO: 442559 - DNA, 25 bp, Mus musculus
tgtccattggctgatcaccaccgca

SEQ ID NO: 442560 - DNA, 25 bp, Mus musculus
ggaggagcgtcctatccaccctgtc

SEQ ID NO: 442561 - DNA, 25 bp, Mus musculus
tcggaccgcaccaggggtctcacta

SEQ ID NO: 442562 - DNA, 25 bp, Mus musculus
ccggcttgttttcggcagccatttc

SEQ ID NO: 442563 - DNA, 25 bp, Mus musculus
cttcggaggacacgctgggatctcc

SEQ ID NO: 442564 - DNA, 25 bp, Mus musculus
tcggaccctcaatcgctggtgcttc

SEQ ID NO: 442565 - DNA, 25 bp, Mus musculus
cctggacagcaaggtcaaggccaca

SEQ ID NO: 442566 - DNA, 25 bp, Mus musculus
ccctaggctagagggtagggtcatc

SEQ ID NO: 442567 - DNA, 25 bp, Mus musculus
tattactcactgctgaacgtgcgca

SEQ ID NO: 442568 - DNA, 25 bp, Mus musculus
tgcttccgaagcagaggctaccctc

SEQ ID NO: 442569 - DNA, 25 bp, Mus musculus
tcccttgagcctttgcccagaaatc

SEQ ID NO: 442570 - DNA, 25 bp, Mus musculus
cccagaaatcagagagcaagacctc

SEQ ID NO: 442571 - DNA, 25 bp, Mus musculus
caagaagtgctaggccagagacgca

SEQ ID NO: 442572 - DNA, 25 bp, Mus musculus
tctgaccgcacttcagcatccagtg

SEQ ID NO: 442573 - DNA, 25 bp, Mus musculus
tccagtgcttgccagtggattcacg

SEQ ID NO: 442574 - DNA, 25 bp, Mus musculus
tggattcacgcggtctcctcgagaa

SEQ ID NO: 442575 - DNA, 25 bp, Mus musculus
cctcgagaataaaaagtcacccttg

SEQ ID NO: 442576 - DNA, 25 bp, Mus musculus
gtccgcactgtctggcacgtgtata

SEQ ID NO: 442577 - DNA, 25 bp, Mus musculus
agtcacccttgaggtccgcactgtc

SEQ ID NO: 442578 - DNA, 25 bp, Mus musculus
actcacgcccatctagtttgcactg

SEQ ID NO: 442579 - DNA, 25 bp, Mus musculus
gcatctcggagatgggcccactgcc

SEQ ID NO: 442580 - DNA, 25 bp, Mus musculus
ccgcgcaagacttcggcatctcgga

SEQ ID NO: 442581 - DNA, 25 bp, Mus musculus
tgccgggccgcgcaagacttcggca

SEQ ID NO: 442582 - DNA, 25 bp, Mus musculus
tcaccggtggaaggtgagctgcttc

SEQ ID NO: 442583 - DNA, 25 bp, Mus musculus
accgagacccgcgagcgttccgtag

SEQ ID NO: 442584 - DNA, 25 bp, Mus musculus
gagctcccgcccagtgcaccgagac

SEQ ID NO: 442585 - DNA, 25 bp, Mus musculus
ggtccacctcgcctgcaaaccctgg

SEQ ID NO: 442586 - DNA, 25 bp, Mus musculus
ccctctacgcagtcccggtccacct

SEQ ID NO: 442587 - DNA, 25 bp, Mus musculus
acctactgcttccaggcgaggaggg

SEQ ID NO: 442588 - DNA, 25 bp, Mus musculus
agcacctactgcttccaggcgagga

SEQ ID NO: 442589 - DNA, 25 bp, Mus musculus
gtttgcactgagcacctactgcttc

SEQ ID NO: 442590 - DNA, 25 bp, Mus musculus
ccatctagtttgcactgagcaccta

SEQ ID NO: 442591 - DNA, 25 bp, Mus musculus
ccctaaaaaagatggcggctcggcg

SEQ ID NO: 442592 - DNA, 25 bp, Mus musculus
atgtcgcgtcgcaggctcgctgatc

SEQ ID NO: 442593 - DNA, 25 bp, Mus musculus
acagcgagcgggaacccgaccggct

SEQ ID NO: 442594 - DNA, 25 bp, Mus musculus
agctcggactcacctcggggtggaa

SEQ ID NO: 442595 - DNA, 25 bp, Mus musculus
cccagttcggctcgtgtctcgggag

SEQ ID NO: 442596 - DNA, 25 bp, Mus musculus
cgggttgactggacttcgtcatgtg

SEQ ID NO: 442597 - DNA, 25 bp, Mus musculus
acctgacgcccagttcggctcgtgt

SEQ ID NO: 442598 - DNA, 25 bp, Mus musculus
gcgaagcgaagctcggactcacctc

SEQ ID NO: 442599 - DNA, 25 bp, Mus musculus
tggaggatgcagctcccacgacccg

SEQ ID NO: 442600 - DNA, 25 bp, Mus musculus
cacagcgaactgagtggaggatgca

SEQ ID NO: 442601 - DNA, 25 bp, Mus musculus
tggagtgtccacagcgaactgagtg

SEQ ID NO: 442602 - DNA, 25 bp, Mus musculus
ctcgctgatcccgaactggagtgtc

SEQ ID NO: 442603 - DNA, 25 bp, Mus musculus
cgcaggagtcggagtccatgttccg

SEQ ID NO: 442604 - DNA, 25 bp, Mus musculus
atgtagtccgggttgactggacttc

SEQ ID NO: 442605 - DNA, 25 bp, Mus musculus
cccgaactggagtgtccacagcgaa

SEQ ID NO: 442606 - DNA, 25 bp, Mus musculus
cgtatttatagaggcggtgccggac

SEQ ID NO: 442607 - DNA, 25 bp, Mus musculus
acctgctggcacacgtggaggccga

SEQ ID NO: 442608 - DNA, 25 bp, Mus musculus
ccgagcaactggagaggctgccgct

SEQ ID NO: 442609 - DNA, 25 bp, Mus musculus
tcatcctgcgccacgtgggcgaact

SEQ ID NO: 442610 - DNA, 25 bp, Mus musculus
gagcgctgcgcaacgcttcatcctg

SEQ ID NO: 442611 - DNA, 25 bp, Mus musculus
acatgcaggacttcgccgaggcctt

SEQ ID NO: 442612 - DNA, 25 bp, Mus musculus
acctggccaactgcctggacatgca

SEQ ID NO: 442613 - DNA, 25 bp, Mus musculus
tgcagcagcagctcgacctggccaa

SEQ ID NO: 442614 - DNA, 25 bp, Mus musculus
cctggacttcagctacaccggcaga

SEQ ID NO: 442615 - DNA, 25 bp, Mus musculus
ccgagcgcaagttcctggatgtgac

SEQ ID NO: 442616 - DNA, 25 bp, Mus musculus
tttggctgtgctgcccttctccgat

SEQ ID NO: 442617 - DNA, 25 bp, Mus musculus
tgcggctggtctgcgtatttataga

SEQ ID NO: 442618 - DNA, 25 bp, Mus musculus
aaatgggcaaggttagaggcgctcc

SEQ ID NO: 442619 - DNA, 25 bp, Mus musculus
ttgcgcggcctcagtcaactgcgcg

SEQ ID NO: 442620 - DNA, 25 bp, Mus musculus
ggaagctcatccacagactcgccag

SEQ ID NO: 442621 - DNA, 25 bp, Mus musculus
gtcaaatcgcttttcacgacgacgc

SEQ ID NO: 442622 - DNA, 25 bp, Mus musculus
acgacgccatcgagaagccctagca

SEQ ID NO: 442623 - DNA, 25 bp, Mus musculus
gaagccctagcatcactttctcggg

SEQ ID NO: 442624 - DNA, 25 bp, Mus musculus
ctttctcgggaaagaggagctcgtg

SEQ ID NO: 442625 - DNA, 25 bp, Mus musculus
agctccaggttggtggtcaagttac

SEQ ID NO: 442626 - DNA, 25 bp, Mus musculus
ggtcaagttactgagaacgctgatc

SEQ ID NO: 442627 - DNA, 25 bp, Mus musculus
aaagtgaccgtgtgacagagcctcc

SEQ ID NO: 442628 - DNA, 25 bp, Mus musculus
gtctcgtcctggaagctcatccaca

SEQ ID NO: 442629 - DNA, 25 bp, Mus musculus
tcgccagcgcaacgaagatgggcta

SEQ ID NO: 442630 - DNA, 25 bp, Mus musculus
ggctaacgggagaggacaccgataa

SEQ ID NO: 442631 - DNA, 25 bp, Mus musculus
ccgataaagtgaccgtgtgaggaca

SEQ ID NO: 442632 - DNA, 25 bp, Mus musculus
tgtgaggacacggataaagtgaccg

SEQ ID NO: 442633 - DNA, 25 bp, Mus musculus
gaacgctgatcagaaccgtctcgtc

SEQ ID NO: 442634 - DNA, 25 bp, Mus musculus
cctcagaaagagaccaatgggcagc

SEQ ID NO: 442635 - DNA, 25 bp, Mus musculus
aatccaaccgcgctgggtcccgagt

SEQ ID NO: 442636 - DNA, 25 bp, Mus musculus
ggacgcctccgtggcgcaatgtcct

SEQ ID NO: 442637 - DNA, 25 bp, Mus musculus
gacgacagctgatctgtagagcacc

SEQ ID NO: 442638 - DNA, 25 bp, Mus musculus
gtcccgagtcgcctagtaacgccaa

SEQ ID NO: 442639 - DNA, 25 bp, Mus musculus
accaagggtaaatccaaccgcgctg

SEQ ID NO: 442640 - DNA, 25 bp, Mus musculus
cctcaaaggcggagcctcagaaaga

SEQ ID NO: 442641 - DNA, 25 bp, Mus musculus
gcgcgcaggcaagaaccggacgcct

SEQ ID NO: 442642 - DNA, 25 bp, Mus musculus
atgtgacatacaggcgcgcaggcaa

SEQ ID NO: 442643 - DNA, 25 bp, Mus musculus
gccgccgcgccggatgtgacataca

SEQ ID NO: 442644 - DNA, 25 bp, Mus musculus
acacgctcctgagagcccgaggcgg

SEQ ID NO: 442645 - DNA, 25 bp, Mus musculus
gcggctgcgcacaggtgacccaagc

SEQ ID NO: 442646 - DNA, 25 bp, Mus musculus
tagagcacccaacggacagccagta

SEQ ID NO: 442647 - DNA, 25 bp, Mus musculus
agtcgcctagtaacgccaagctggg

SEQ ID NO: 442648 - DNA, 25 bp, Mus musculus
tgggaccttaccaagacggaggatc

SEQ ID NO: 442649 - DNA, 25 bp, Mus musculus
atgagattcccaatgtcaacagaaa

SEQ ID NO: 442650 - DNA, 25 bp, Mus musculus
gtcaacagaaaaatcgatgggcctt

SEQ ID NO: 442651 - DNA, 25 bp, Mus musculus
aatcgatgggccttggagcccgagc

SEQ ID NO: 442652 - DNA, 25 bp, Mus musculus
aaagggcgtcgaggcatctgtctca

SEQ ID NO: 442653 - DNA, 25 bp, Mus musculus
gaggcatctgtctcaaggcacctgg

SEQ ID NO: 442654 - DNA, 25 bp, Mus musculus
tctctgcctcgtcattggcttcacg

SEQ ID NO: 442655 - DNA, 25 bp, Mus musculus
aggcacctgggaccttaccaagacg

SEQ ID NO: 442656 - DNA, 25 bp, Mus musculus
taccaagacggaggatccgcgctgc

SEQ ID NO: 442657 - DNA, 25 bp, Mus musculus
atccgcgctgcaacccaagaggtgg

SEQ ID NO: 442658 - DNA, 25 bp, Mus musculus
ctgcaacccaagaggtggggagccc

SEQ ID NO: 442659 - DNA, 25 bp, Mus musculus
cggagtaattaacgagggattaatg

SEQ ID NO: 442660 - DNA, 25 bp, Mus musculus
ttggcttcacgacttgtgcccgagc

SEQ ID NO: 442661 - DNA, 25 bp, Mus musculus
agggattaatgagattcccaatgtc

SEQ ID NO: 442662 - DNA, 25 bp, Mus musculus
acgaccacggtggtcctggctcgag

SEQ ID NO: 442663 - DNA, 25 bp, Mus musculus
tatgacttccacctggtacttatcg

SEQ ID NO: 442664 - DNA, 25 bp, Mus musculus
gaacttgcgcttcccactgaggatc

SEQ ID NO: 442665 - DNA, 25 bp, Mus musculus
ttcccactgaggatcacgctgctcg

SEQ ID NO: 442666 - DNA, 25 bp, Mus musculus
cacctggtacttatcgctggggatg

SEQ ID NO: 442667 - DNA, 25 bp, Mus musculus
tgcagcagccgcactatgacttcca

SEQ ID NO: 442668 - DNA, 25 bp, Mus musculus
gcgagatccagacccagccgaagct

SEQ ID NO: 442669 - DNA, 25 bp, Mus musculus
tagctgccaacgagcgagatccaga

SEQ ID NO: 442670 - DNA, 25 bp, Mus musculus
tgcccgtagtcaccatagctgccaa

SEQ ID NO: 442671 - DNA, 25 bp, Mus musculus
agaggcaccacgtccttgaaggcga

SEQ ID NO: 442672 - DNA, 25 bp, Mus musculus
tgcatccttgggtcacccgcctggg

SEQ ID NO: 442673 - DNA, 25 bp, Mus musculus
catcatgcgctgcatccttgggtca

SEQ ID NO: 442674 - DNA, 25 bp, Mus musculus
tggctcgagccagacgcagcatcat

SEQ ID NO: 442675 - DNA, 25 bp, Mus musculus
caagaaggacgggaacttgcgcttc

SEQ ID NO: 442676 - DNA, 25 bp, Mus musculus
gtggcacttaaaccgccagcgatcc

SEQ ID NO: 442677 - DNA, 25 bp, Mus musculus
cggagcctctactcctagcaagcta

SEQ ID NO: 442678 - DNA, 25 bp, Mus musculus
ctcttcctggctgcgggtacgcaaa

SEQ ID NO: 442679 - DNA, 25 bp, Mus musculus
ttggggtcctgacccgagtcgagct

SEQ ID NO: 442680 - DNA, 25 bp, Mus musculus
cacgtggcggtaaagtgcaaactcc

SEQ ID NO: 442681 - DNA, 25 bp, Mus musculus
aaagtgcaaactccgggcccgcagc

SEQ ID NO: 442682 - DNA, 25 bp, Mus musculus
agcctccggatgcaggtcggatgca

SEQ ID NO: 442683 - DNA, 25 bp, Mus musculus
aggtcggatgcaagcccgtcctcgt

SEQ ID NO: 442684 - DNA, 25 bp, Mus musculus
ccagcgatccaggtgttcgaaacca

SEQ ID NO: 442685 - DNA, 25 bp, Mus musculus
ctctcacgggagtgaccgctgccat

SEQ ID NO: 442686 - DNA, 25 bp, Mus musculus
ctgccatgtctttcccgtgtcgatg

SEQ ID NO: 442687 - DNA, 25 bp, Mus musculus
gtgacgcggtctcgcgagatcgtcc

SEQ ID NO: 442688 - DNA, 25 bp, Mus musculus
tggggtcggacttagtggcacttaa

SEQ ID NO: 442689 - DNA, 25 bp, Mus musculus
cctagcaagctaatggggtcggact

SEQ ID NO: 442690 - DNA, 25 bp, Mus musculus
gcagtgcaggagaccgcctggaacc

SEQ ID NO: 442691 - DNA, 25 bp, Mus musculus
ggcggcccagccacagtgcagtgca

SEQ ID NO: 442692 - DNA, 25 bp, Mus musculus
gtcctcaaccctggatccgcgggtg

SEQ ID NO: 442693 - DNA, 25 bp, Mus musculus
atccgcgggtggcagccattccgaa

SEQ ID NO: 442694 - DNA, 25 bp, Mus musculus
gtggcagccattccgaacgagttgg

SEQ ID NO: 442695 - DNA, 25 bp, Mus musculus
ccattccgaacgagttggggcgctg

SEQ ID NO: 442696 - DNA, 25 bp, Mus musculus
gtgtgccaccgacccgcgtgtctgg

SEQ ID NO: 442697 - DNA, 25 bp, Mus musculus
ggccgactgactgcctcggtagttc

SEQ ID NO: 442698 - DNA, 25 bp, Mus musculus
actccttggaggcacttccggccgg

SEQ ID NO: 442699 - DNA, 25 bp, Mus musculus
ccacagtgcagtgcaggagaccgcc

SEQ ID NO: 442700 - DNA, 25 bp, Mus musculus
tgacggtctgctctcgcctcgcagg

SEQ ID NO: 442701 - DNA, 25 bp, Mus musculus
tgcctcggtagttcgcccgggtcgc

SEQ ID NO: 442702 - DNA, 25 bp, Mus musculus
ctgcacccgggactagctgcagctg

SEQ ID NO: 442703 - DNA, 25 bp, Mus musculus
ggaggcgcctactccttggaggcac

SEQ ID NO: 442704 - DNA, 25 bp, Mus musculus
tcaccggcgacctagttagaggctc

SEQ ID NO: 442705 - DNA, 25 bp, Mus musculus
tcacaagggcccaggcggtacagac

SEQ ID NO: 442706 - DNA, 25 bp, Mus musculus
ctgggtagtcttcaccggcgaccta

SEQ ID NO: 442707 - DNA, 25 bp, Mus musculus
tgtagccctggaacaaagcctccgg

SEQ ID NO: 442708 - DNA, 25 bp, Mus musculus
gtccagaacctgacctgtagccctg

SEQ ID NO: 442709 - DNA, 25 bp, Mus musculus
ggaggccaggaaactgtccagaacc

SEQ ID NO: 442710 - DNA, 25 bp, Mus musculus
cccgtcacgtagagggacatagccc

SEQ ID NO: 442711 - DNA, 25 bp, Mus musculus
ccctcagcttcggaagagcggcaga

SEQ ID NO: 442712 - DNA, 25 bp, Mus musculus
gaagagcggcagaccctaccctagc

SEQ ID NO: 442713 - DNA, 25 bp, Mus musculus
gggcaggcaggctagctctagtcta

SEQ ID NO: 442714 - DNA, 25 bp, Mus musculus
ctctagtctaggaacataggggctg

SEQ ID NO: 442715 - DNA, 25 bp, Mus musculus
agagccgcactcacaagggcccagg

SEQ ID NO: 442716 - DNA, 25 bp, Mus musculus
cggtacagaccgcaatggaggcacg

SEQ ID NO: 442717 - DNA, 25 bp, Mus musculus
ggttacgcgaccgaccagagccgca

SEQ ID NO: 442718 - DNA, 25 bp, Mus musculus
tgccgcttccgagaccagcagtatg

SEQ ID NO: 442719 - DNA, 25 bp, Mus musculus
ctggcccgcagctctacgatgtgat

SEQ ID NO: 442720 - DNA, 25 bp, Mus musculus
ccgcagctctacgatgtgatggatg

SEQ ID NO: 442721 - DNA, 25 bp, Mus musculus
tctacgatgtgatggatgcggtccc

SEQ ID NO: 442722 - DNA, 25 bp, Mus musculus
atgcggtcccagcacgaaggtggaa

SEQ ID NO: 442723 - DNA, 25 bp, Mus musculus
cccagcacgaaggtggaaggagttc

SEQ ID NO: 442724 - DNA, 25 bp, Mus musculus
ggaggtggaaatctgccgcttccga

SEQ ID NO: 442725 - DNA, 25 bp, Mus musculus
cttccgagaccagcagtatgagatg

SEQ ID NO: 442726 - DNA, 25 bp, Mus musculus
tatgagatgctcaagcgctggcgtc

SEQ ID NO: 442727 - DNA, 25 bp, Mus musculus
atgctcaagcgctggcgtcagcagc

SEQ ID NO: 442728 - DNA, 25 bp, Mus musculus
ctggcgtcagcagcagcctgcaggc

SEQ ID NO: 442729 - DNA, 25 bp, Mus musculus
gcctgcaggcctcggtgccatctat

SEQ ID NO: 442730 - DNA, 25 bp, Mus musculus
aaattgaagccgtggaggtggaaat

SEQ ID NO: 442731 - DNA, 25 bp, Mus musculus
ggtgccatctatgcggctctggagc

SEQ ID NO: 442732 - DNA, 25 bp, Mus musculus
ctcgggccagtacagaccatgggta

SEQ ID NO: 442733 - DNA, 25 bp, Mus musculus
ttcccggcaccaactgagcgaatga

SEQ ID NO: 442734 - DNA, 25 bp, Mus musculus
aggtcctgcaccgagacgccacatt

SEQ ID NO: 442735 - DNA, 25 bp, Mus musculus
attgccacgtagttctcctcgagga

SEQ ID NO: 442736 - DNA, 25 bp, Mus musculus
ggctcttggctcactggaactgatt

SEQ ID NO: 442737 - DNA, 25 bp, Mus musculus
gccacggctccgatgagtccagaga

SEQ ID NO: 442738 - DNA, 25 bp, Mus musculus
gaagagcttcctcctggtgccacgg

SEQ ID NO: 442739 - DNA, 25 bp, Mus musculus
gctagctaactgctcaggctccgga

SEQ ID NO: 442740 - DNA, 25 bp, Mus musculus
gcgctccttgcgcatgtcgatataa

SEQ ID NO: 442741 - DNA, 25 bp, Mus musculus
tgcgccagtgctccagaaagagata

SEQ ID NO: 442742 - DNA, 25 bp, Mus musculus
acaacccggggcagcaatctacgca

SEQ ID NO: 442743 - DNA, 25 bp, Mus musculus
ggtccgagtcctcaactgctggttg

SEQ ID NO: 442744 - DNA, 25 bp, Mus musculus
ttagcaactgtagcagccgctcttc

SEQ ID NO: 442745 - DNA, 25 bp, Mus musculus
cgtggagatcttgctgcaccaggca

SEQ ID NO: 442746 - DNA, 25 bp, Mus musculus
tgcctgtgcagcagctccgaatcct

SEQ ID NO: 442747 - DNA, 25 bp, Mus musculus
agtcggcctgacatcacccagggtc

SEQ ID NO: 442748 - DNA, 25 bp, Mus musculus
tggtggacacgcacctcctcgctgt

SEQ ID NO: 442749 - DNA, 25 bp, Mus musculus
ccgtgctgggctgtttactgaacga

SEQ ID NO: 442750 - DNA, 25 bp, Mus musculus
cagggtccgccaatcccaggcttaa

SEQ ID NO: 442751 - DNA, 25 bp, Mus musculus
gctgcccgcctatgagctcagtcgg

SEQ ID NO: 442752 - DNA, 25 bp, Mus musculus
ggacccgacacctgcgttacctgat

SEQ ID NO: 442753 - DNA, 25 bp, Mus musculus
gctcctacctgcgactgttccggtg

SEQ ID NO: 442754 - DNA, 25 bp, Mus musculus
tagtacccagggacgcttctgcttg

SEQ ID NO: 442755 - DNA, 25 bp, Mus musculus
agggctcggctgcaccctactagct

SEQ ID NO: 442756 - DNA, 25 bp, Mus musculus
tgcgctggaacagctcccacttagc

SEQ ID NO: 442757 - DNA, 25 bp, Mus musculus
cggacgatgcttttggctcgaatgc

SEQ ID NO: 442758 - DNA, 25 bp, Mus musculus
aatcctgcctgagcagcccggagtc

SEQ ID NO: 442759 - DNA, 25 bp, Mus musculus
cccaagcaggcacggatgtcacgga

SEQ ID NO: 442760 - DNA, 25 bp, Mus musculus
cagcaaagtgcatggccgtggcgcc

SEQ ID NO: 442761 - DNA, 25 bp, Mus musculus
agcactgtaagagggcgaagcacga

SEQ ID NO: 442762 - DNA, 25 bp, Mus musculus
tgggtgtggccattgaactctgcca

SEQ ID NO: 442763 - DNA, 25 bp, Mus musculus
actctgccaggtcggcagcggtgta

SEQ ID NO: 442764 - DNA, 25 bp, Mus musculus
tacccatcgtggtcgcggacgtcca

SEQ ID NO: 442765 - DNA, 25 bp, Mus musculus
cagcgccgttcaccgcgaggatctg

SEQ ID NO: 442766 - DNA, 25 bp, Mus musculus
gcgaggatctggcagcactgtaaga

SEQ ID NO: 442767 - DNA, 25 bp, Mus musculus
gtgggtccctccatgtccagcactt

SEQ ID NO: 442768 - DNA, 25 bp, Mus musculus
tccatgtccagcacttcagagaagc

SEQ ID NO: 442769 - DNA, 25 bp, Mus musculus
ttcagagaagctgcgaggacatcgc

SEQ ID NO: 442770 - DNA, 25 bp, Mus musculus
ccagagggcgacagcgtcccagtct

SEQ ID NO: 442771 - DNA, 25 bp, Mus musculus
ccgttctcagcagcgtcatgcagcg

SEQ ID NO: 442772 - DNA, 25 bp, Mus musculus
ggccgcgactggcagcaaagtgcat

SEQ ID NO: 442773 - DNA, 25 bp, Mus musculus
cagctgagcactttggtgtggccgc

SEQ ID NO: 442774 - DNA, 25 bp, Mus musculus
ccgaagagtgcccacttaagcctgg

SEQ ID NO: 442775 - DNA, 25 bp, Mus musculus
atgcagagagcctgccagccggctc

SEQ ID NO: 442776 - DNA, 25 bp, Mus musculus
aggctccaggagcaacctcgccgtg

SEQ ID NO: 442777 - DNA, 25 bp, Mus musculus
gtcatgcgggtggtcccaggctcca

SEQ ID NO: 442778 - DNA, 25 bp, Mus musculus
atggtgtcgccctcggcgccgcgat

SEQ ID NO: 442779 - DNA, 25 bp, Mus musculus
tgctccagggccatggtgtcgccct

SEQ ID NO: 442780 - DNA, 25 bp, Mus musculus
gcagggacctcagcacgtccaggtc

SEQ ID NO: 442781 - DNA, 25 bp, Mus musculus
tctagcgagtcgcgcagagaaggcc

SEQ ID NO: 442782 - DNA, 25 bp, Mus musculus
tgcagcttgcctgagcgggccgcat

SEQ ID NO: 442783 - DNA, 25 bp, Mus musculus
cgcagacagtgcagcttgcctgagc

SEQ ID NO: 442784 - DNA, 25 bp, Mus musculus
caccaagtagcgcagacagtgcagc

SEQ ID NO: 442785 - DNA, 25 bp, Mus musculus
aagagtgcccacttaagcctgggtc

SEQ ID NO: 442786 - DNA, 25 bp, Mus musculus
tcctccaccaagtagcgcagacagt

SEQ ID NO: 442787 - DNA, 25 bp, Mus musculus
acacggctgggagggcaacctcctc

SEQ ID NO: 442788 - DNA, 25 bp, Mus musculus
tacacccgcgacttaacggcctgga

SEQ ID NO: 442789 - DNA, 25 bp, Mus musculus
acccgcgacttaacggcctggagct

SEQ ID NO: 442790 - DNA, 25 bp, Mus musculus
gcgacttaacggcctggagctccct

SEQ ID NO: 442791 - DNA, 25 bp, Mus musculus
ctggagctccctgggcgctgggctt

SEQ ID NO: 442792 - DNA, 25 bp, Mus musculus
ctgggcttggccggaacgccaaccg

SEQ ID NO: 442793 - DNA, 25 bp, Mus musculus
gatcctaagcggcagtcgcgtaacc

SEQ ID NO: 442794 - DNA, 25 bp, Mus musculus
tcctaagcggcagtcgcgtaaccgt

SEQ ID NO: 442795 - DNA, 25 bp, Mus musculus
agcggcagtcgcgtaaccgtggaaa

SEQ ID NO: 442796 - DNA, 25 bp, Mus musculus
gcagtcgcgtaaccgtggaaacgga

SEQ ID NO: 442797 - DNA, 25 bp, Mus musculus
ccgtggaaacggaacgcgacgccag

SEQ ID NO: 442798 - DNA, 25 bp, Mus musculus
aacggaacgcgacgccagaggcttg

SEQ ID NO: 442799 - DNA, 25 bp, Mus musculus
gggtctggctatggggtgtggccag

SEQ ID NO: 442800 - DNA, 25 bp, Mus musculus
tccgacgtccgtcttctcgccggta

SEQ ID NO: 442801 - DNA, 25 bp, Mus musculus
ttctcgccggtacacccgcgactta

SEQ ID NO: 442802 - DNA, 25 bp, Mus musculus
ctccaagaagaagtccggagttctc

SEQ ID NO: 442803 - DNA, 25 bp, Mus musculus
gggatggagccctagttacaaagga

SEQ ID NO: 442804 - DNA, 25 bp, Mus musculus
gctgccatcgcgcaccagctgtttt

SEQ ID NO: 442805 - DNA, 25 bp, Mus musculus
cggcccggctttgtttgcattgagt

SEQ ID NO: 442806 - DNA, 25 bp, Mus musculus
ttgcattgagtcagccggggctgta

SEQ ID NO: 442807 - DNA, 25 bp, Mus musculus
tgtatgtccgggaccatgggcactg

SEQ ID NO: 442808 - DNA, 25 bp, Mus musculus
ccaggagtaggcacacgtcagccta

SEQ ID NO: 442809 - DNA, 25 bp, Mus musculus
tcccgttccggtgcttgtttcagca

SEQ ID NO: 442810 - DNA, 25 bp, Mus musculus
cgcacctgcgtcttggtggtcagct

SEQ ID NO: 442811 - DNA, 25 bp, Mus musculus
tggtggtcagctggatcaccgcctt

SEQ ID NO: 442812 - DNA, 25 bp, Mus musculus
caccgccttccggaagttcagcttg

SEQ ID NO: 442813 - DNA, 25 bp, Mus musculus
ttcagcttggagtctgcggatccca

SEQ ID NO: 442814 - DNA, 25 bp, Mus musculus
ctctggggagcgaagctgcgaaccc

SEQ ID NO: 442815 - DNA, 25 bp, Mus musculus
tctgcggatcccatgtcgatggacc

SEQ ID NO: 442816 - DNA, 25 bp, Mus musculus
taaacggaagctgtttgcagaacgc

SEQ ID NO: 442817 - DNA, 25 bp, Mus musculus
cgcagcaagcatatcgggcaatctt

SEQ ID NO: 442818 - DNA, 25 bp, Mus musculus
aactgctcgcgttcttcctcttcgt

SEQ ID NO: 442819 - DNA, 25 bp, Mus musculus
tctcccacgcacagcggaggtcagt

SEQ ID NO: 442820 - DNA, 25 bp, Mus musculus
cgggcgttgtttccatcactgccta

SEQ ID NO: 442821 - DNA, 25 bp, Mus musculus
atcgggcaatcttgaaactgctcgc

SEQ ID NO: 442822 - DNA, 25 bp, Mus musculus
ttgcagaacgcaaagagtgggtctc

SEQ ID NO: 442823 - DNA, 25 bp, Mus musculus
ctcggggcagtctcagataccattc

SEQ ID NO: 442824 - DNA, 25 bp, Mus musculus
cattcccgttttcaccacatggtgg

SEQ ID NO: 442825 - DNA, 25 bp, Mus musculus
tcaccacatggtggcgccatgcacg

SEQ ID NO: 442826 - DNA, 25 bp, Mus musculus
gccatgcacggtgtccgcctgagct

SEQ ID NO: 442827 - DNA, 25 bp, Mus musculus
tcccgggtgagctcaaacttcgtcg

SEQ ID NO: 442828 - DNA, 25 bp, Mus musculus
agctcaaacttcgtcgctgttcgcg

SEQ ID NO: 442829 - DNA, 25 bp, Mus musculus
gcggaggtcagtcagaacccagccc

SEQ ID NO: 442830 - DNA, 25 bp, Mus musculus
ccaagactgtcccaaaattgcaaca

SEQ ID NO: 442831 - DNA, 25 bp, Mus musculus
agcagcaacggccacgcgttgtgga

SEQ ID NO: 442832 - DNA, 25 bp, Mus musculus
cttcggagcccaagactgtcccaaa

SEQ ID NO: 442833 - DNA, 25 bp, Mus musculus
agcagccggggcacacgcccaggac

SEQ ID NO: 442834 - DNA, 25 bp, Mus musculus
ggagcccaagactgtcccaaaattg

SEQ ID NO: 442835 - DNA, 25 bp, Mus musculus
tcccaaaattgcaacagggtccgtg

SEQ ID NO: 442836 - DNA, 25 bp, Mus musculus
aattgcaacagggtccgtggaggta

SEQ ID NO: 442837 - DNA, 25 bp, Mus musculus
tccgtggaggtagccgttgccctgt

SEQ ID NO: 442838 - DNA, 25 bp, Mus musculus
gaggtagccgttgccctgtcagccg

SEQ ID NO: 442839 - DNA, 25 bp, Mus musculus
gtctcgccttcggagcccaagactg

SEQ ID NO: 442840 - DNA, 25 bp, Mus musculus
tttgcagcagcaacggccacgcgtt

SEQ ID NO: 442841 - DNA, 25 bp, Mus musculus
ctgccagtttgcagcagcaacggcc

SEQ ID NO: 442842 - DNA, 25 bp, Mus musculus
tcagccgacccagggaggggagccc

SEQ ID NO: 442843 - DNA, 25 bp, Mus musculus
gttgccctgtcagccgacccaggga

SEQ ID NO: 442844 - DNA, 25 bp, Mus musculus
tgtactcctctgcagcacctggtga

SEQ ID NO: 442845 - DNA, 25 bp, Mus musculus
cgcctactagagcacctgcgacaga

SEQ ID NO: 442846 - DNA, 25 bp, Mus musculus
tacctcgagggttaccgagcctgtc

SEQ ID NO: 442847 - DNA, 25 bp, Mus musculus
tgcgcagggcctttgaatagctacc

SEQ ID NO: 442848 - DNA, 25 bp, Mus musculus
cctggtgagtgaccatgctacatgc

SEQ ID NO: 442849 - DNA, 25 bp, Mus musculus
catcctggaaatgactgtgcgcttc

SEQ ID NO: 442850 - DNA, 25 bp, Mus musculus
ttcgaagttggagaaggcagacatc

SEQ ID NO: 442851 - DNA, 25 bp, Mus musculus
tggcgcagacttcccgctcttcgaa

SEQ ID NO: 442852 - DNA, 25 bp, Mus musculus
aggtactcagctgcccggtttattg

SEQ ID NO: 442853 - DNA, 25 bp, Mus musculus
tccgtggggatccaaagacctgcgt

SEQ ID NO: 442854 - DNA, 25 bp, Mus musculus
gccagctgaagggtctcgtattgcc

SEQ ID NO: 442855 - DNA, 25 bp, Mus musculus
cgcggatcaacgagagcctaagcca

SEQ ID NO: 442856 - DNA, 25 bp, Mus musculus
ggcggtctttctaactgtggtctca

SEQ ID NO: 442857 - DNA, 25 bp, Mus musculus
agtttgcaccgtactcaggacctga

SEQ ID NO: 442858 - DNA, 25 bp, Mus musculus
acactcgatgtaggaaatccgggca

SEQ ID NO: 442859 - DNA, 25 bp, Mus musculus
aaccttctggaagcggagtcccaca

SEQ ID NO: 442860 - DNA, 25 bp, Mus musculus
cccaggctcattcattcggggacgg

SEQ ID NO: 442861 - DNA, 25 bp, Mus musculus
ggcctgctggacacctgttctcaga

SEQ ID NO: 442862 - DNA, 25 bp, Mus musculus
gtcgtccgccgtcgcagccaagatg

SEQ ID NO: 442863 - DNA, 25 bp, Mus musculus
ggccgccatccagatctgccggtaa

SEQ ID NO: 442864 - DNA, 25 bp, Mus musculus
tctgccggtaagacagaggcctgcg

SEQ ID NO: 442865 - DNA, 25 bp, Mus musculus
aggcctgcgggctaagccgaccctt

SEQ ID NO: 442866 - DNA, 25 bp, Mus musculus
cgcgccggaactcgctgaggctgaa

SEQ ID NO: 442867 - DNA, 25 bp, Mus musculus
gctgaaggatgctgccttcatcctg

SEQ ID NO: 442868 - DNA, 25 bp, Mus musculus
ttgatcccttcactggactcaggcc

SEQ ID NO: 442869 - DNA, 25 bp, Mus musculus
tcaggcccaggattctgtacccgga

SEQ ID NO: 442870 - DNA, 25 bp, Mus musculus
cggccgcagttttgaggacactcga

SEQ ID NO: 442871 - DNA, 25 bp, Mus musculus
cctttggctgcatcccaagggcggc

SEQ ID NO: 442872 - DNA, 25 bp, Mus musculus
gagccggagccacgggcgcctcaat

SEQ ID NO: 442873 - DNA, 25 bp, Mus musculus
ccacgggcgcctcaatgccgggtga

SEQ ID NO: 442874 - DNA, 25 bp, Mus musculus
ccctcaactccaggcggtttagagg

SEQ ID NO: 442875 - DNA, 25 bp, Mus musculus
cgtgggcagcgtttagggccagaac

SEQ ID NO: 442876 - DNA, 25 bp, Mus musculus
gccgccctggcccaggggcaccgaa

SEQ ID NO: 442877 - DNA, 25 bp, Mus musculus
tcgcccgagagcagccagctgagcg

SEQ ID NO: 442878 - DNA, 25 bp, Mus musculus
cgctctgggcatcggcagcctccac

SEQ ID NO: 442879 - DNA, 25 bp, Mus musculus
atcactgcggctgctgggtctacgt

SEQ ID NO: 442880 - DNA, 25 bp, Mus musculus
tccaaggggcatcactgcggctgct

SEQ ID NO: 442881 - DNA, 25 bp, Mus musculus
gtcgcacgctccaaggggcatcact

SEQ ID NO: 442882 - DNA, 25 bp, Mus musculus
ggcgggtcctgtcgcacgctccaag

SEQ ID NO: 442883 - DNA, 25 bp, Mus musculus
gtggcctgagtgacccagacccgag

SEQ ID NO: 442884 - DNA, 25 bp, Mus musculus
caactccaggcggtttagaggcggt

SEQ ID NO: 442885 - DNA, 25 bp, Mus musculus
cgctttgagcacctggtgggatacc

SEQ ID NO: 442886 - DNA, 25 bp, Mus musculus
attggcctgggcttcggcgtctgct

SEQ ID NO: 442887 - DNA, 25 bp, Mus musculus
ttcaccgtgcccaccatcgtggtgg

SEQ ID NO: 442888 - DNA, 25 bp, Mus musculus
cttccagacactggccacgcaggtg

SEQ ID NO: 442889 - DNA, 25 bp, Mus musculus
gccatgggcatggtctgcacagcca

SEQ ID NO: 442890 - DNA, 25 bp, Mus musculus
cgtggccatgggcatggtctgcaca

SEQ ID NO: 442891 - DNA, 25 bp, Mus musculus
gcttcggcgtctgcttcttgctgct

SEQ ID NO: 442892 - DNA, 25 bp, Mus musculus
ttcatcgtggccgagattggcctgg

SEQ ID NO: 442893 - DNA, 25 bp, Mus musculus
tgccgcttcatcgtggccgagattg

SEQ ID NO: 442894 - DNA, 25 bp, Mus musculus
gcgagcgtttctacacccacggctg

SEQ ID NO: 442895 - DNA, 25 bp, Mus musculus
caccatcgtggtggaagacgcacag

SEQ ID NO: 442896 - DNA, 25 bp, Mus musculus
gctgaccgccgcaccttcaccgtgc

SEQ ID NO: 442897 - DNA, 25 bp, Mus musculus
ggcacgacacgagcgagcgtttcta

SEQ ID NO: 442898 - DNA, 25 bp, Mus musculus
cttcctgccgttggctggcacgaca

SEQ ID NO: 442899 - DNA, 25 bp, Mus musculus
acacgagcgagcgtttctacaccca

SEQ ID NO: 442900 - DNA, 25 bp, Mus musculus
gagcctgctggccttcgccgaggat

SEQ ID NO: 442901 - DNA, 25 bp, Mus musculus
ctgcagagcagcctgagcgcatctt

SEQ ID NO: 442902 - DNA, 25 bp, Mus musculus
ggcggttctcccacgatgatgccga

SEQ ID NO: 442903 - DNA, 25 bp, Mus musculus
tcccagagacgccatgcagagcgtg

SEQ ID NO: 442904 - DNA, 25 bp, Mus musculus
ctctgcgtcctagggctcccagaga

SEQ ID NO: 442905 - DNA, 25 bp, Mus musculus
cactcggactcgctgggctctgcgt

SEQ ID NO: 442906 - DNA, 25 bp, Mus musculus
ggctacgtcacgctgcactcggact

SEQ ID NO: 442907 - DNA, 25 bp, Mus musculus
agccctgtttcagcccggccgggtg

SEQ ID NO: 442908 - DNA, 25 bp, Mus musculus
tgcggcagcattagcagctttctga

SEQ ID NO: 442909 - DNA, 25 bp, Mus musculus
ctggtggccgtacgcaacgcagcca

SEQ ID NO: 442910 - DNA, 25 bp, Mus musculus
gcggagcctgctgaggtcccaacgc

SEQ ID NO: 442911 - DNA, 25 bp, Mus musculus
gctctgccgagagcctgttgtccct

SEQ ID NO: 442912 - DNA, 25 bp, Mus musculus
ggacttggcagctctggcacactta

SEQ ID NO: 442913 - DNA, 25 bp, Mus musculus
ttagcagctttctgagctcgccctc

SEQ ID NO: 442914 - DNA, 25 bp, Mus musculus
cccagcagtgtggaatcggtgtaga

SEQ ID NO: 442915 - DNA, 25 bp, Mus musculus
ggatccaatgttctacgccagcacg

SEQ ID NO: 442916 - DNA, 25 bp, Mus musculus
cagcacgccgcagccataagtattt

SEQ ID NO: 442917 - DNA, 25 bp, Mus musculus
tactctcggcctggcagtttgatgc

SEQ ID NO: 442918 - DNA, 25 bp, Mus musculus
tgtgctgcaagcaaccgcgaccttc

SEQ ID NO: 442919 - DNA, 25 bp, Mus musculus
gtccctgggaaaggggtacagctca

SEQ ID NO: 442920 - DNA, 25 bp, Mus musculus
ggatgagttcacctagcagtgcaga

SEQ ID NO: 442921 - DNA, 25 bp, Mus musculus
tcggtggaagactcaaggagacctc

SEQ ID NO: 442922 - DNA, 25 bp, Mus musculus
ccaatggttccgtggatttcctgca

SEQ ID NO: 442923 - DNA, 25 bp, Mus musculus
cccaggccaccgattgatagagttc

SEQ ID NO: 442924 - DNA, 25 bp, Mus musculus
agagttcctgcagtcaccatgggtg

SEQ ID NO: 442925 - DNA, 25 bp, Mus musculus
cgcaagtaccttaggggcggatcca

SEQ ID NO: 442926 - DNA, 25 bp, Mus musculus
gagcttgagtctaaatccttgccta

SEQ ID NO: 442927 - DNA, 25 bp, Mus musculus
tgcagacccgaatcgccaatggttc

SEQ ID NO: 442928 - DNA, 25 bp, Mus musculus
cccttgcaagtagctacggctctgg

SEQ ID NO: 442929 - DNA, 25 bp, Mus musculus
ctgccgcacatctgtaggaaggccg

SEQ ID NO: 442930 - DNA, 25 bp, Mus musculus
ttgtgcctggcgcacaaagcggcgc

SEQ ID NO: 442931 - DNA, 25 bp, Mus musculus
agccgagtgttaagggcattgtgcc

SEQ ID NO: 442932 - DNA, 25 bp, Mus musculus
cgggaggcaccgcacaaaaggagca

SEQ ID NO: 442933 - DNA, 25 bp, Mus musculus
agctttaaagcgctcgggccagtcg

SEQ ID NO: 442934 - DNA, 25 bp, Mus musculus
ccacgcgccgggtagctttaaagcg

SEQ ID NO: 442935 - DNA, 25 bp, Mus musculus
tgatgtgactgaagcccagaggcga

SEQ ID NO: 442936 - DNA, 25 bp, Mus musculus
aactctggaacgttctcctgccgct

SEQ ID NO: 442937 - DNA, 25 bp, Mus musculus
ggcgaccacaactctggaacgttct

SEQ ID NO: 442938 - DNA, 25 bp, Mus musculus
tttcaggcccagagaaaggcgacca

SEQ ID NO: 442939 - DNA, 25 bp, Mus musculus
cctagcagcgtggagaatcgagccc

SEQ ID NO: 442940 - DNA, 25 bp, Mus musculus
tatggctctcaaacgcctagcagcg

SEQ ID NO: 442941 - DNA, 25 bp, Mus musculus
cgcacaaaaggagcagccgagtgtt

SEQ ID NO: 442942 - DNA, 25 bp, Mus musculus
tggccggactcaacgcgctgctgct

SEQ ID NO: 442943 - DNA, 25 bp, Mus musculus
gaatgcgagccctgaagcgtgtctc

SEQ ID NO: 442944 - DNA, 25 bp, Mus musculus
tgaagcgtgtctcccggtccacgga

SEQ ID NO: 442945 - DNA, 25 bp, Mus musculus
gcacctgcgcagtgtcccggtgcga

SEQ ID NO: 442946 - DNA, 25 bp, Mus musculus
ccagcggccggttacgcccagttgt

SEQ ID NO: 442947 - DNA, 25 bp, Mus musculus
ccggttacgcccagttgtctcttgg

SEQ ID NO: 442948 - DNA, 25 bp, Mus musculus
ttgtctcttgggctctaaacttggg

SEQ ID NO: 442949 - DNA, 25 bp, Mus musculus
ctctaaacttgggacgaacttctgc

SEQ ID NO: 442950 - DNA, 25 bp, Mus musculus
acgaacttctgcagagcgccgaggc

SEQ ID NO: 442951 - DNA, 25 bp, Mus musculus
cgacgtcacgctgtcccgagctgag

SEQ ID NO: 442952 - DNA, 25 bp, Mus musculus
gggcctgcgagacaagccgctcgct

SEQ ID NO: 442953 - DNA, 25 bp, Mus musculus
agcagcgcacagctccgggcacttg

SEQ ID NO: 442954 - DNA, 25 bp, Mus musculus
tggcgctctacgtggccggactcaa

SEQ ID NO: 442955 - DNA, 25 bp, Mus musculus
tcagcctcgctacattcctcctggg

SEQ ID NO: 442956 - DNA, 25 bp, Mus musculus
cttcaagttgtcagatgggcgtcca

SEQ ID NO: 442957 - DNA, 25 bp, Mus musculus
gagttgcattctcgcgggactccga

SEQ ID NO: 442958 - DNA, 25 bp, Mus musculus
aggcgagtgacacgccctcatcctt

SEQ ID NO: 442959 - DNA, 25 bp, Mus musculus
attctcgcgggactccgagtcggtc

SEQ ID NO: 442960 - DNA, 25 bp, Mus musculus
cagatgggcgtccagggccttaccc

SEQ ID NO: 442961 - DNA, 25 bp, Mus musculus
tggcgaattgcgacttcaagttgtc

SEQ ID NO: 442962 - DNA, 25 bp, Mus musculus
gggcagtggcgaattgcgacttcaa

SEQ ID NO: 442963 - DNA, 25 bp, Mus musculus
ttccggccagctgtgctggtctgga

SEQ ID NO: 442964 - DNA, 25 bp, Mus musculus
gcaccgtcatttccggccagctgtg

SEQ ID NO: 442965 - DNA, 25 bp, Mus musculus
ccagcgtgtgcaccgtcatttccgg

SEQ ID NO: 442966 - DNA, 25 bp, Mus musculus
aacgtcagtgctgccagcgtgtgca

SEQ ID NO: 442967 - DNA, 25 bp, Mus musculus
aggactgccaacgtcagtgctgcca

SEQ ID NO: 442968 - DNA, 25 bp, Mus musculus
attctgagcggcaggactgccaacg

SEQ ID NO: 442969 - DNA, 25 bp, Mus musculus
ctggcagccagggagttgcattctc

SEQ ID NO: 442970 - DNA, 25 bp, Mus musculus
cacaatgccacgttcggcggggtca

SEQ ID NO: 442971 - DNA, 25 bp, Mus musculus
agcctggccgcggaacacaaagacg

SEQ ID NO: 442972 - DNA, 25 bp, Mus musculus
cgtaaaggcgaaacaggcactggta

SEQ ID NO: 442973 - DNA, 25 bp, Mus musculus
tgcagcgagctgaagctgaggcctc

SEQ ID NO: 442974 - DNA, 25 bp, Mus musculus
cgcacctgggtcacgtgataacaca

SEQ ID NO: 442975 - DNA, 25 bp, Mus musculus
ctcacctggcacagctggcggcagt

SEQ ID NO: 442976 - DNA, 25 bp, Mus musculus
aacaaaggccgagcgactgcgcgcg

SEQ ID NO: 442977 - DNA, 25 bp, Mus musculus
gtcgcagcctaacccaacaacaaag

SEQ ID NO: 442978 - DNA, 25 bp, Mus musculus
gaacatcaacaaagaccctccggtc

SEQ ID NO: 442979 - DNA, 25 bp, Mus musculus
cgggattggctcgagaacatcaaca

SEQ ID NO: 442980 - DNA, 25 bp, Mus musculus
tgacagctcctatgcaccgcggaga

SEQ ID NO: 442981 - DNA, 25 bp, Mus musculus
ctgactatggaacggtgacagctcc

SEQ ID NO: 442982 - DNA, 25 bp, Mus musculus
cccaagggacgactgactatggaac

SEQ ID NO: 442983 - DNA, 25 bp, Mus musculus
cacgcctgggcgcacgtacaaaggc

SEQ ID NO: 442984 - DNA, 25 bp, Mus musculus
ctcccacggtggacacctcccggcg

SEQ ID NO: 442985 - DNA, 25 bp, Mus musculus
gcgcctgcgcaccttgctgctctga

SEQ ID NO: 442986 - DNA, 25 bp, Mus musculus
tcatgagcggctcttctaacccggt

SEQ ID NO: 442987 - DNA, 25 bp, Mus musculus
gggattgagtcatgagcggctcttc

SEQ ID NO: 442988 - DNA, 25 bp, Mus musculus
atctggaccggggattgagtcatga

SEQ ID NO: 442989 - DNA, 25 bp, Mus musculus
agcgcgcgaattctgcgcggtggtc

SEQ ID NO: 442990 - DNA, 25 bp, Mus musculus
ttgtctcacgtgttggcgcctccca

SEQ ID NO: 442991 - DNA, 25 bp, Mus musculus
tcgccctcctggttgtctcacgtgt

SEQ ID NO: 442992 - DNA, 25 bp, Mus musculus
agcctttctcagtgattccgctcgc

SEQ ID NO: 442993 - DNA, 25 bp, Mus musculus
ttgctgctctgagccggtcttaggc

SEQ ID NO: 442994 - DNA, 25 bp, Mus musculus
agcggctcttctaacccggtgtctc

SEQ ID NO: 442995 - DNA, 25 bp, Mus musculus
ctttcagactgtcgcctggcccaga

SEQ ID NO: 442996 - DNA, 25 bp, Mus musculus
agcgtccctcgctttcagactgtcg

SEQ ID NO: 442997 - DNA, 25 bp, Mus musculus
gcccagaccccaagtgcagagcaga

SEQ ID NO: 442998 - DNA, 25 bp, Mus musculus
gagcaagctcagaccgcactctctt

SEQ ID NO: 442999 - DNA, 25 bp, Mus musculus
cgaacatgcgcgcacggtgcgtctc

SEQ ID NO: 443000 - DNA, 25 bp, Mus musculus
agcggatgcacagcagcgacttctt

SEQ ID NO: 443001 - DNA, 25 bp, Mus musculus
gtcctggggaccgagagcaagctca

SEQ ID NO: 443002 - DNA, 25 bp, Mus musculus
tgcccgcaggtattgcagaagtatg

SEQ ID NO: 443003 - DNA, 25 bp, Mus musculus
gctacaatgtcatggcgcgcgaaca

SEQ ID NO: 443004 - DNA, 25 bp, Mus musculus
tgcgctggcccagggctacaatgtc

SEQ ID NO: 443005 - DNA, 25 bp, Mus musculus
acacttctggatcacgtcgcggctg

SEQ ID NO: 443006 - DNA, 25 bp, Mus musculus
tatgcctcactcactacacttctgg

SEQ ID NO: 443007 - DNA, 25 bp, Mus musculus
ccaaccctgatcaaggtatgcctca

SEQ ID NO: 443008 - DNA, 25 bp, Mus musculus
agcccggcgacaggactgtctcgtc

SEQ ID NO: 443009 - DNA, 25 bp, Mus musculus
catgatgtacggctccgaatgcagc

SEQ ID NO: 443010 - DNA, 25 bp, Mus musculus
agcgacttcttgtcggtggaaaaca

SEQ ID NO: 443011 - DNA, 25 bp, Mus musculus
cagaagtatgtggtctctgcgtcct

SEQ ID NO: 443012 - DNA, 25 bp, Mus musculus
ggaagacggatgtgacctgccaccc

SEQ ID NO: 443013 - DNA, 25 bp, Mus musculus
gagaagcaagggctgatcgattgaa

SEQ ID NO: 443014 - DNA, 25 bp, Mus musculus
gacagccgacttcgccctgggaaaa

SEQ ID NO: 443015 - DNA, 25 bp, Mus musculus
tcgccctgggaaaagcaatagctgg

SEQ ID NO: 443016 - DNA, 25 bp, Mus musculus
aaagcaatagctggccgatcgttac

SEQ ID NO: 443017 - DNA, 25 bp, Mus musculus
atagcatcggagtccgagtccaacc

SEQ ID NO: 443018 - DNA, 25 bp, Mus musculus
ccgatcgttacttaggtggcaggga

SEQ ID NO: 443019 - DNA, 25 bp, Mus musculus
atcgattgaagttgcctggctcctt

SEQ ID NO: 443020 - DNA, 25 bp, Mus musculus
tggctccttgcgtgccctgtgcgct

SEQ ID NO: 443021 - DNA, 25 bp, Mus musculus
tgcgggctcttagcgcctgcgtagt

SEQ ID NO: 443022 - DNA, 25 bp, Mus musculus
atggcgcctgtggttagtatggctc

SEQ ID NO: 443023 - DNA, 25 bp, Mus musculus
cgcagtgggacagcccgtctgactc

SEQ ID NO: 443024 - DNA, 25 bp, Mus musculus
atcagccctgagtggcctggcaagc

SEQ ID NO: 443025 - DNA, 25 bp, Mus musculus
ctctgcagcatcagccctgagtggc

SEQ ID NO: 443026 - DNA, 25 bp, Mus musculus
tgcgcgctcactgagctgcccaaga

SEQ ID NO: 443027 - DNA, 25 bp, Mus musculus
gtccgtccggcagcgcacgggttaa

SEQ ID NO: 443028 - DNA, 25 bp, Mus musculus
ccaacttgttctcggctgttaacta

SEQ ID NO: 443029 - DNA, 25 bp, Mus musculus
cacgggttaaggctggcaccgcgcc

SEQ ID NO: 443030 - DNA, 25 bp, Mus musculus
gccgccatcttcttgccgagaccgc

SEQ ID NO: 443031 - DNA, 25 bp, Mus musculus
tcacaatccgggcatgtgtgccgcc

SEQ ID NO: 443032 - DNA, 25 bp, Mus musculus
gactggacgtcacaatccgggcatg

SEQ ID NO: 443033 - DNA, 25 bp, Mus musculus
ttgccacagcaaccagactggacgt

SEQ ID NO: 443034 - DNA, 25 bp, Mus musculus
gctgttaactagtcgcgctggcgta

SEQ ID NO: 443035 - DNA, 25 bp, Mus musculus
gctcactgagctgcccaagactagt

SEQ ID NO: 443036 - DNA, 25 bp, Mus musculus
ggcacctcgacagctcctggcaccc

SEQ ID NO: 443037 - DNA, 25 bp, Mus musculus
ttctccctgcgcctgggctatcgag

SEQ ID NO: 443038 - DNA, 25 bp, Mus musculus
tggattctccctgcgcctgggctat

SEQ ID NO: 443039 - DNA, 25 bp, Mus musculus
actagtcgcgctggcgtaacgatgg

SEQ ID NO: 443040 - DNA, 25 bp, Mus musculus
tggtaagagcgagaaacggaagaac

SEQ ID NO: 443041 - DNA, 25 bp, Mus musculus
acgcttctaccgctacggcatcaag

SEQ ID NO: 443042 - DNA, 25 bp, Mus musculus
gaggaacgcttctaccgctacggca

SEQ ID NO: 443043 - DNA, 25 bp, Mus musculus
ctacgccaagatggaggaacgcttc

SEQ ID NO: 443044 - DNA, 25 bp, Mus musculus
cggaagaacaaggaccctctctacg

SEQ ID NO: 443045 - DNA, 25 bp, Mus musculus
ttgattacggctctggcgatgagga

SEQ ID NO: 443046 - DNA, 25 bp, Mus musculus
caccctttgattacggctctggcga

SEQ ID NO: 443047 - DNA, 25 bp, Mus musculus
tggacgaaccgccaccctttgatta

SEQ ID NO: 443048 - DNA, 25 bp, Mus musculus
gaaagaatgacatggacgaaccgcc

SEQ ID NO: 443049 - DNA, 25 bp, Mus musculus
tatcgcaactaccaaagaaagaatg

SEQ ID NO: 443050 - DNA, 25 bp, Mus musculus
accacaccgtgatgtatcgcaacta

SEQ ID NO: 443051 - DNA, 25 bp, Mus musculus
ctctgtgactagttggagctgtacc

SEQ ID NO: 443052 - DNA, 25 bp, Mus musculus
cggtctcccgtgctctgtgactagt

SEQ ID NO: 443053 - DNA, 25 bp, Mus musculus
aaggaccctctctacgccaagatgg

SEQ ID NO: 443054 - DNA, 25 bp, Mus musculus
tccggggtcgaaatggatactgtac

SEQ ID NO: 443055 - DNA, 25 bp, Mus musculus
atctttacctcgtgggactccctcg

SEQ ID NO: 443056 - DNA, 25 bp, Mus musculus
gcttcacgccagtcacagtctcatt

SEQ ID NO: 443057 - DNA, 25 bp, Mus musculus
gccaaggcagtccatgcaaatcatg

SEQ ID NO: 443058 - DNA, 25 bp, Mus musculus
gagccttgaagatgcccaccgtctg

SEQ ID NO: 443059 - DNA, 25 bp, Mus musculus
aatccttggactcgggttctcattg

SEQ ID NO: 443060 - DNA, 25 bp, Mus musculus
cgcgcggccttgacgcaaaagtgac

SEQ ID NO: 443061 - DNA, 25 bp, Mus musculus
gatccggtgcccgtctcctaggtaa

SEQ ID NO: 443062 - DNA, 25 bp, Mus musculus
gcgccagcaaggactgaaccaagtg

SEQ ID NO: 443063 - DNA, 25 bp, Mus musculus
ggctgcatattgattcttacggaca

SEQ ID NO: 443064 - DNA, 25 bp, Mus musculus
acaacctggggtttgcaaggcaccg

SEQ ID NO: 443065 - DNA, 25 bp, Mus musculus
ctgctgggtcttcttcagttagttc

SEQ ID NO: 443066 - DNA, 25 bp, Mus musculus
ttaggccatgcaactcgctcagatc

SEQ ID NO: 443067 - DNA, 25 bp, Mus musculus
tgcatcccggttgccagctgatgtt

SEQ ID NO: 443068 - DNA, 25 bp, Mus musculus
tagtggtattattggcacaggttca

SEQ ID NO: 443069 - DNA, 25 bp, Mus musculus
catggcacatagtggtattattggc

SEQ ID NO: 443070 - DNA, 25 bp, Mus musculus
caggttcagaatcgtggtgcgagtc

SEQ ID NO: 443071 - DNA, 25 bp, Mus musculus
ttcagaatcgtggtgcgagtcccag

SEQ ID NO: 443072 - DNA, 25 bp, Mus musculus
agtcccaggcgtcgggagctgtctc

SEQ ID NO: 443073 - DNA, 25 bp, Mus musculus
gagctgtctcctgtccttctctgca

SEQ ID NO: 443074 - DNA, 25 bp, Mus musculus
gtccttctctgcatggcattctctg

SEQ ID NO: 443075 - DNA, 25 bp, Mus musculus
atggcattctctgccgtctccagtc

SEQ ID NO: 443076 - DNA, 25 bp, Mus musculus
gtctccagtccgcttcttgcgtgtc

SEQ ID NO: 443077 - DNA, 25 bp, Mus musculus
ccgcttcttgcgtgtcttctttctg

SEQ ID NO: 443078 - DNA, 25 bp, Mus musculus
gcgtgtcttctttctgctctccgga

SEQ ID NO: 443079 - DNA, 25 bp, Mus musculus
ctgctctccggagaaaactctggga

SEQ ID NO: 443080 - DNA, 25 bp, Mus musculus
tcctgccgagcttccgggtcattac

SEQ ID NO: 443081 - DNA, 25 bp, Mus musculus
tccgggtcattacatggcacatagt

SEQ ID NO: 443082 - DNA, 25 bp, Mus musculus
tcgttgggggtccacttcgcagact

SEQ ID NO: 443083 - DNA, 25 bp, Mus musculus
tccaggcatggcttccgagagagcg

SEQ ID NO: 443084 - DNA, 25 bp, Mus musculus
gctgcagcatggctatcagtatcca

SEQ ID NO: 443085 - DNA, 25 bp, Mus musculus
tcgaccgcaagctgcagcatggcta

SEQ ID NO: 443086 - DNA, 25 bp, Mus musculus
tcacaggatgggaagtcgaccgcaa

SEQ ID NO: 443087 - DNA, 25 bp, Mus musculus
ctagtgagtcacaggatgggaagtc

SEQ ID NO: 443088 - DNA, 25 bp, Mus musculus
cccagggcctagtgagtcacaggat

SEQ ID NO: 443089 - DNA, 25 bp, Mus musculus
ttcgcagactccacagccgctgggg

SEQ ID NO: 443090 - DNA, 25 bp, Mus musculus
tgggcacgttctgcccgggcagcac

SEQ ID NO: 443091 - DNA, 25 bp, Mus musculus
atctgtatgggtccgtgggcacgtt

SEQ ID NO: 443092 - DNA, 25 bp, Mus musculus
gagtctgcatctgtatgggtccgtg

SEQ ID NO: 443093 - DNA, 25 bp, Mus musculus
gagcacggggagtctgcatctgtat

SEQ ID NO: 443094 - DNA, 25 bp, Mus musculus
gcatggctatcagtatccaggcatg

SEQ ID NO: 443095 - DNA, 25 bp, Mus musculus
tgacaggagccggaactcgggccca

SEQ ID NO: 443096 - DNA, 25 bp, Mus musculus
ccgtgcgaggatctagcctgcagcc

SEQ ID NO: 443097 - DNA, 25 bp, Mus musculus
gcgcgtctgcctccagaagcgcttg

SEQ ID NO: 443098 - DNA, 25 bp, Mus musculus
tctaagcgctcgctctgcagacagc

SEQ ID NO: 443099 - DNA, 25 bp, Mus musculus
tgctggagagctccgtctaagcgct

SEQ ID NO: 443100 - DNA, 25 bp, Mus musculus
tctgtcccaggttctgacaccgatc

SEQ ID NO: 443101 - DNA, 25 bp, Mus musculus
gctccgcaagccgtgcgaggatcta

SEQ ID NO: 443102 - DNA, 25 bp, Mus musculus
ggaacccagcctcagaccttgcttg

SEQ ID NO: 443103 - DNA, 25 bp, Mus musculus
tggtcacgtttcagggaacccagcc

SEQ ID NO: 443104 - DNA, 25 bp, Mus musculus
tgttggatccacatggtcacgtttc

SEQ ID NO: 443105 - DNA, 25 bp, Mus musculus
cctgagtcctaaaagctgttggatc

SEQ ID NO: 443106 - DNA, 25 bp, Mus musculus
ccgggtcgctcacctgagtcctaaa

SEQ ID NO: 443107 - DNA, 25 bp, Mus musculus
ttgcaacagtgagcagcagcccagc

SEQ ID NO: 443108 - DNA, 25 bp, Mus musculus
agaagccgtgcctcggtttgcaaca

SEQ ID NO: 443109 - DNA, 25 bp, Mus musculus
ctgacaccgatcaagttgctggaga

SEQ ID NO: 443110 - DNA, 25 bp, Mus musculus
ccgctgcatccgcactctgctgacg

SEQ ID NO: 443111 - DNA, 25 bp, Mus musculus
tggtcccagctgtcgtcccactttg

SEQ ID NO: 443112 - DNA, 25 bp, Mus musculus
aagctggcggcctgggaagctgaaa

SEQ ID NO: 443113 - DNA, 25 bp, Mus musculus
cccttatttgcatacgtcttttgat

SEQ ID NO: 443114 - DNA, 25 bp, Mus musculus
cgagctcccgacgttggaagcccgg

SEQ ID NO: 443115 - DNA, 25 bp, Mus musculus
gtcccgggtggtcccagctgtcgtc

SEQ ID NO: 443116 - DNA, 25 bp, Mus musculus
cctagccctgcaggtggtcccgggt

SEQ ID NO: 443117 - DNA, 25 bp, Mus musculus
tgctgacgccctagccctgcaggtg

SEQ ID NO: 443118 - DNA, 25 bp, Mus musculus
ggcaaggggtacccgccgctgcatc

SEQ ID NO: 443119 - DNA, 25 bp, Mus musculus
tttgattggtctccggcggcaggtc

SEQ ID NO: 443120 - DNA, 25 bp, Mus musculus
gtcttttgattggtctccggcggca

SEQ ID NO: 443121 - DNA, 25 bp, Mus musculus
atacgtcttttgattggtctccggc

SEQ ID NO: 443122 - DNA, 25 bp, Mus musculus
tgcatacgtcttttgattggtctcc

SEQ ID NO: 443123 - DNA, 25 bp, Mus musculus
tccgccgcattgtcccgggctgcga

SEQ ID NO: 443124 - DNA, 25 bp, Mus musculus
cctgagacccgagagcacaggcctg

SEQ ID NO: 443125 - DNA, 25 bp, Mus musculus
gcgatgacatcagacgccgcgcgcg

SEQ ID NO: 443126 - DNA, 25 bp, Mus musculus
ctgattggtgacgtggcgatgacat

SEQ ID NO: 443127 - DNA, 25 bp, Mus musculus
tctgcacgcggagagcacgtgacct

SEQ ID NO: 443128 - DNA, 25 bp, Mus musculus
gtggcgggaaccttgcccagcttcc

SEQ ID NO: 443129 - DNA, 25 bp, Mus musculus
ctttcccagcgtggcgggaaccttg

SEQ ID NO: 443130 - DNA, 25 bp, Mus musculus
aaggagacgtccctttcccagcgtg

SEQ ID NO: 443131 - DNA, 25 bp, Mus musculus
ctccgcgcgaaggagacgtcccttt

SEQ ID NO: 443132 - DNA, 25 bp, Mus musculus
atgtgcccttcccaaacatggcggc

SEQ ID NO: 443133 - DNA, 25 bp, Mus musculus
ggtcccagggatgtgcccttcccaa

SEQ ID NO: 443134 - DNA, 25 bp, Mus musculus
cagagccgcgcgattgagacttggc

SEQ ID NO: 443135 - DNA, 25 bp, Mus musculus
agcacaggcctgcagcaaggcagcc

SEQ ID NO: 443136 - DNA, 25 bp, Mus musculus
aacccgagctgaaggtggcctgaga

SEQ ID NO: 443137 - DNA, 25 bp, Mus musculus
aggcagccgcccttctcaaacatgg

SEQ ID NO: 443138 - DNA, 25 bp, Mus musculus
acgcctgaacccgcagccttgggga

SEQ ID NO: 443139 - DNA, 25 bp, Mus musculus
ctgctgcacgctggcagcgccggcc

SEQ ID NO: 443140 - DNA, 25 bp, Mus musculus
tggcgccagcttcccgggtcctgcg

SEQ ID NO: 443141 - DNA, 25 bp, Mus musculus
ttggccggccttctccaaagagctg

SEQ ID NO: 443142 - DNA, 25 bp, Mus musculus
gagctgcctcagctggccacacagc

SEQ ID NO: 443143 - DNA, 25 bp, Mus musculus
acctgaagactggaaccggggatgc

SEQ ID NO: 443144 - DNA, 25 bp, Mus musculus
actgcgggacctgaagactggaacc

SEQ ID NO: 443145 - DNA, 25 bp, Mus musculus
cctagactgcgggacctgaagactg

SEQ ID NO: 443146 - DNA, 25 bp, Mus musculus
ctcttgaggaattcctagactgcgg

SEQ ID NO: 443147 - DNA, 25 bp, Mus musculus
agccggctcttgaggaattcctaga

SEQ ID NO: 443148 - DNA, 25 bp, Mus musculus
ccagccggctcttgaggaattccta

SEQ ID NO: 443149 - DNA, 25 bp, Mus musculus
cgcaccagccggctcttgaggaatt

SEQ ID NO: 443150 - DNA, 25 bp, Mus musculus
gggtcctgcgggcttcctgcaagcc

SEQ ID NO: 443151 - DNA, 25 bp, Mus musculus
ggcttggccggccttctccaaagag

SEQ ID NO: 443152 - DNA, 25 bp, Mus musculus
aagactgtagctctggctccgggta

SEQ ID NO: 443153 - DNA, 25 bp, Mus musculus
gcccggaatgcaagacccacctgga

SEQ ID NO: 443154 - DNA, 25 bp, Mus musculus
tcagcttgtcccacaacagtcttgg

SEQ ID NO: 443155 - DNA, 25 bp, Mus musculus
agccagctctgcgtactgtagaagc

SEQ ID NO: 443156 - DNA, 25 bp, Mus musculus
tgtagaagcctagcgcctgtccaag

SEQ ID NO: 443157 - DNA, 25 bp, Mus musculus
ggagcagttgccacgagactaaaga

SEQ ID NO: 443158 - DNA, 25 bp, Mus musculus
ctgtccaagcccacccaagaggatg

SEQ ID NO: 443159 - DNA, 25 bp, Mus musculus
acgccgaacttgcaggcgctatgta

SEQ ID NO: 443160 - DNA, 25 bp, Mus musculus
agggctcgcaacttgacgcatttgg

SEQ ID NO: 443161 - DNA, 25 bp, Mus musculus
tagcgacactggacttgtaacgttc

SEQ ID NO: 443162 - DNA, 25 bp, Mus musculus
ctctacgtaggtaggtgcaaccgga

SEQ ID NO: 443163 - DNA, 25 bp, Mus musculus
ccatcttcgtacaggcacagccggg

SEQ ID NO: 443164 - DNA, 25 bp, Mus musculus
cctcgtctgcatgcgttactgaaca

SEQ ID NO: 443165 - DNA, 25 bp, Mus musculus
atctcagccttcgtgtccggaatcg

SEQ ID NO: 443166 - DNA, 25 bp, Mus musculus
tctctatggtcatttccggctcccg

SEQ ID NO: 443167 - DNA, 25 bp, Mus musculus
ggagctcagcccagacatcgcgcat

SEQ ID NO: 443168 - DNA, 25 bp, Mus musculus
ccgacaactgcctgcgggagctcag

SEQ ID NO: 443169 - DNA, 25 bp, Mus musculus
ccctgctcagtgagctggcagctgc

SEQ ID NO: 443170 - DNA, 25 bp, Mus musculus
cctcgcctgcagagcctcaatctca

SEQ ID NO: 443171 - DNA, 25 bp, Mus musculus
gcaacgcgttggagacgctgccgcc

SEQ ID NO: 443172 - DNA, 25 bp, Mus musculus
ttgcgtccagactctctggcgagcg

SEQ ID NO: 443173 - DNA, 25 bp, Mus musculus
agactctctggcgagcgcgtgttct

SEQ ID NO: 443174 - DNA, 25 bp, Mus musculus
gcgcatcttgcctcgctcaaggtca

SEQ ID NO: 443175 - DNA, 25 bp, Mus musculus
acctgtccggcaacgcgttggagac

SEQ ID NO: 443176 - DNA, 25 bp, Mus musculus
ctcgctcaaggtcagtgggacccga

SEQ ID NO: 443177 - DNA, 25 bp, Mus musculus
gccctgctgtccctccttggaggat

SEQ ID NO: 443178 - DNA, 25 bp, Mus musculus
ccgctgctgcactacctggaggtga

SEQ ID NO: 443179 - DNA, 25 bp, Mus musculus
cgagcgcgtgttctctctatggtca

SEQ ID NO: 443180 - DNA, 25 bp, Mus musculus
tccaggtggccgacttggcagtgct

SEQ ID NO: 443181 - DNA, 25 bp, Mus musculus
ccgctgccctcccttcacgcatcca

SEQ ID NO: 443182 - DNA, 25 bp, Mus musculus
cttcacgcatccactggcaacacgg

SEQ ID NO: 443183 - DNA, 25 bp, Mus musculus
tggcaacacggctactcactgtcca

SEQ ID NO: 443184 - DNA, 25 bp, Mus musculus
ccggagacatggtgtcgaaggtgga

SEQ ID NO: 443185 - DNA, 25 bp, Mus musculus
cactgtccaggtggccgacttggca

SEQ ID NO: 443186 - DNA, 25 bp, Mus musculus
ggccgacttggcagtgctcgactgc

SEQ ID NO: 443187 - DNA, 25 bp, Mus musculus
gacttggcagtgctcgactgctgga

SEQ ID NO: 443188 - DNA, 25 bp, Mus musculus
cagtgctcgactgctggaaggtgac

SEQ ID NO: 443189 - DNA, 25 bp, Mus musculus
gtgctcgactgctggaaggtgacct

SEQ ID NO: 443190 - DNA, 25 bp, Mus musculus
gtagtcggtattggaagggatgaca

SEQ ID NO: 443191 - DNA, 25 bp, Mus musculus
gctcgactgctggaaggtgacctcg

SEQ ID NO: 443192 - DNA, 25 bp, Mus musculus
ctcactgtccaggtggccgacttgg

SEQ ID NO: 443193 - DNA, 25 bp, Mus musculus
gaagggatgacaggcgccggagaca

SEQ ID NO: 443194 - DNA, 25 bp, Mus musculus
tccgtctctgagaacggctcgaagc

SEQ ID NO: 443195 - DNA, 25 bp, Mus musculus
gttcactcggctagcacccgggcag

SEQ ID NO: 443196 - DNA, 25 bp, Mus musculus
agcctcggagcctcgtgcgaaatac

SEQ ID NO: 443197 - DNA, 25 bp, Mus musculus
tgcgaaatacctggccctagctcgg

SEQ ID NO: 443198 - DNA, 25 bp, Mus musculus
ctgccgcaggcttagcgcctttctt

SEQ ID NO: 443199 - DNA, 25 bp, Mus musculus
ttagcgcctttcttggcggaccggc

SEQ ID NO: 443200 - DNA, 25 bp, Mus musculus
cccgcaagctggtagccggagtctt

SEQ ID NO: 443201 - DNA, 25 bp, Mus musculus
tgcccttactgtcctaagcctgcaa

SEQ ID NO: 443202 - DNA, 25 bp, Mus musculus
aagcctgcaacccaggggctcagga

SEQ ID NO: 443203 - DNA, 25 bp, Mus musculus
cctgagaaaaccgagaggaccgact

SEQ ID NO: 443204 - DNA, 25 bp, Mus musculus
gaggaccgactgaaactgaacattg

SEQ ID NO: 443205 - DNA, 25 bp, Mus musculus
agcaccagcggggttccgtctctga

SEQ ID NO: 443206 - DNA, 25 bp, Mus musculus
accacagcccgcctggaaagagggt

SEQ ID NO: 443207 - DNA, 25 bp, Mus musculus
aaccgttgtcgttcggccagcacca

SEQ ID NO: 443208 - DNA, 25 bp, Mus musculus
gatccacatgccttcgaattcgttc

SEQ ID NO: 443209 - DNA, 25 bp, Mus musculus
gggagcgatcctggtctgaagtcca

SEQ ID NO: 443210 - DNA, 25 bp, Mus musculus
agcacttgaacgtcacgaggtcacg

SEQ ID NO: 443211 - DNA, 25 bp, Mus musculus
agacctgagaagcacttgaacgtca

SEQ ID NO: 443212 - DNA, 25 bp, Mus musculus
gccttcgaattcgttccgccacaga

SEQ ID NO: 443213 - DNA, 25 bp, Mus musculus
gaggcgacccacgagatccacatgc

SEQ ID NO: 443214 - DNA, 25 bp, Mus musculus
ctccaaaaaggtgaggcgacccacg

SEQ ID NO: 443215 - DNA, 25 bp, Mus musculus
cactctaactagaacctccaaaaag

SEQ ID NO: 443216 - DNA, 25 bp, Mus musculus
acctctgaatcaagtccacactcta

SEQ ID NO: 443217 - DNA, 25 bp, Mus musculus
gggtaccgagccacacctctgaatc

SEQ ID NO: 443218 - DNA, 25 bp, Mus musculus
tgctgtattctacgtgcccaccgag

SEQ ID NO: 443219 - DNA, 25 bp, Mus musculus
aacgtcacgaggtcacgctgcaggt

SEQ ID NO: 443220 - DNA, 25 bp, Mus musculus
ctgaagtccagttggtgctgtattc

SEQ ID NO: 443221 - DNA, 25 bp, Mus musculus
tcgttccgccacagacctgagaagc

SEQ ID NO: 443222 - DNA, 25 bp, Mus musculus
tttgcagggagatccgctatagcgc

SEQ ID NO: 443223 - DNA, 25 bp, Mus musculus
ggccatgaacttctcggagtcattc

SEQ ID NO: 443224 - DNA, 25 bp, Mus musculus
tctgcaggttctccccggacggcaa

SEQ ID NO: 443225 - DNA, 25 bp, Mus musculus
agctctcgggcctgctctgcaggtt

SEQ ID NO: 443226 - DNA, 25 bp, Mus musculus
cattcaagctctcgggcctgctctg

SEQ ID NO: 443227 - DNA, 25 bp, Mus musculus
ccggacggcaagtacctggtgagct

SEQ ID NO: 443228 - DNA, 25 bp, Mus musculus
ggagtcattcaagctctcgggcctg

SEQ ID NO: 443229 - DNA, 25 bp, Mus musculus
acttctcggagtcattcaagctctc

SEQ ID NO: 443230 - DNA, 25 bp, Mus musculus
tggccgtggccatgaacttctcgga

SEQ ID NO: 443231 - DNA, 25 bp, Mus musculus
ccattggctgctgctcgcttccgcc

SEQ ID NO: 443232 - DNA, 25 bp, Mus musculus
cacaatgccgcgcggccgcttgagg

SEQ ID NO: 443233 - DNA, 25 bp, Mus musculus
gggagatccgctatagcgcaaaggc

SEQ ID NO: 443234 - DNA, 25 bp, Mus musculus
cgtttcgggatttgcagggagatcc

SEQ ID NO: 443235 - DNA, 25 bp, Mus musculus
cgctatagcgcaaaggcgctcagcc

SEQ ID NO: 443236 - DNA, 25 bp, Mus musculus
attgggtctaaagtgctgccgttca

SEQ ID NO: 443237 - DNA, 25 bp, Mus musculus
caccttcgggcttacggtgcacttc

SEQ ID NO: 443238 - DNA, 25 bp, Mus musculus
cccgacagtgtgtcctcgcttggct

SEQ ID NO: 443239 - DNA, 25 bp, Mus musculus
tcctgtttacaggaagggcgagtta

SEQ ID NO: 443240 - DNA, 25 bp, Mus musculus
ctgccgttcatgattacggcggccc

SEQ ID NO: 443241 - DNA, 25 bp, Mus musculus
ctaagctgtcttctgcaattgggtc

SEQ ID NO: 443242 - DNA, 25 bp, Mus musculus
tcgactgcgtctcgcgattggcttt

SEQ ID NO: 443243 - DNA, 25 bp, Mus musculus
tgattggttgagtcctgcagagccc

SEQ ID NO: 443244 - DNA, 25 bp, Mus musculus
cctcgttcgccttgtgattggttga

SEQ ID NO: 443245 - DNA, 25 bp, Mus musculus
gccacaacgtctggcgcagcggtgt

SEQ ID NO: 443246 - DNA, 25 bp, Mus musculus
tcgtggacgttcagcggccacaacg

SEQ ID NO: 443247 - DNA, 25 bp, Mus musculus
acgaagtactccttgacgcgggcgc

SEQ ID NO: 443248 - DNA, 25 bp, Mus musculus
ggccggaacacgaagtactccttga

SEQ ID NO: 443249 - DNA, 25 bp, Mus musculus
acgcgcggagccacttcctgtttac

SEQ ID NO: 443250 - DNA, 25 bp, Mus musculus
cggcgaagctgacccggacagaact

SEQ ID NO: 443251 - DNA, 25 bp, Mus musculus
tctactggccgtaagggccgcctgt

SEQ ID NO: 443252 - DNA, 25 bp, Mus musculus
ctgcagccgagcatgtgagtagcgc

SEQ ID NO: 443253 - DNA, 25 bp, Mus musculus
gaccgcgcgcactatgcctgtcggg

SEQ ID NO: 443254 - DNA, 25 bp, Mus musculus
cccgctccgagtttgctctccatca

SEQ ID NO: 443255 - DNA, 25 bp, Mus musculus
gccgcctgtgagtcgaagatcccag

SEQ ID NO: 443256 - DNA, 25 bp, Mus musculus
aagacagcgtctactggccgtaagg

SEQ ID NO: 443257 - DNA, 25 bp, Mus musculus
tatggcgcccgtgaagacagcgtct

SEQ ID NO: 443258 - DNA, 25 bp, Mus musculus
actgggttgtggtgctccgctgtcc

SEQ ID NO: 443259 - DNA, 25 bp, Mus musculus
actgtcccatctgcacctgcgggaa

SEQ ID NO: 443260 - DNA, 25 bp, Mus musculus
ggtccgggcaactgtcccatctgca

SEQ ID NO: 443261 - DNA, 25 bp, Mus musculus
gcgccgaaccgagcgcgaaggtctc

SEQ ID NO: 443262 - DNA, 25 bp, Mus musculus
tggcaagtgtctggccgcgccgaac

SEQ ID NO: 443263 - DNA, 25 bp, Mus musculus
tcgaagatcccaggaccgagtggga

SEQ ID NO: 443264 - DNA, 25 bp, Mus musculus
tgctccgttcccaggtgagccagga

SEQ ID NO: 443265 - DNA, 25 bp, Mus musculus
tgccatagtggccaaagacccagcc

SEQ ID NO: 443266 - DNA, 25 bp, Mus musculus
ctggagaaatacgaggagctactga

SEQ ID NO: 443267 - DNA, 25 bp, Mus musculus
agtaccacgcgctgctggagaaata

SEQ ID NO: 443268 - DNA, 25 bp, Mus musculus
cgcaggcgcggtatgtctatcctgc

SEQ ID NO: 443269 - DNA, 25 bp, Mus musculus
acgttgcatgccaacagtgtgcgca

SEQ ID NO: 443270 - DNA, 25 bp, Mus musculus
gccatgctggcaacctcacgttgca

SEQ ID NO: 443271 - DNA, 25 bp, Mus musculus
tgacacggcgctcaatgccatagtg

SEQ ID NO: 443272 - DNA, 25 bp, Mus musculus
tgcgcaagagctgcagtgacacggc

SEQ ID NO: 443273 - DNA, 25 bp, Mus musculus
ctctaatgcccaggatggtgtctcc

SEQ ID NO: 443274 - DNA, 25 bp, Mus musculus
cagccaggcagtggagatgactcta

SEQ ID NO: 443275 - DNA, 25 bp, Mus musculus
tgcagcagatgaagcaggccaagac

SEQ ID NO: 443276 - DNA, 25 bp, Mus musculus
acacggtggtgctccaggagtacac

SEQ ID NO: 443277 - DNA, 25 bp, Mus musculus
cgctggaacaggaaaacgaacggct

SEQ ID NO: 443278 - DNA, 25 bp, Mus musculus
ggagtccgccctcgggtactgtcta

SEQ ID NO: 443279 - DNA, 25 bp, Mus musculus
tcactcccaggtccgccgcctcctc

SEQ ID NO: 443280 - DNA, 25 bp, Mus musculus
ttctgtgcctcactcccaggtccgc

SEQ ID NO: 443281 - DNA, 25 bp, Mus musculus
acgcccgcttccttctgtgcctcac

SEQ ID NO: 443282 - DNA, 25 bp, Mus musculus
gtactgtctaccctccctcccgctc

SEQ ID NO: 443283 - DNA, 25 bp, Mus musculus
ttcacgtgacccgtctggtggttcg

SEQ ID NO: 443284 - DNA, 25 bp, Mus musculus
cctgcgttcacgtgacccgtctggt

SEQ ID NO: 443285 - DNA, 25 bp, Mus musculus
acctgggtccgcctgcgttcacgtg

SEQ ID NO: 443286 - DNA, 25 bp, Mus musculus
gctgcgtcaccgctctacctgggtc

SEQ ID NO: 443287 - DNA, 25 bp, Mus musculus
tgtagcctgcagtgccgctgggtcc

SEQ ID NO: 443288 - DNA, 25 bp, Mus musculus
cacctgtgcgcgcaaccgagggtcg

SEQ ID NO: 443289 - DNA, 25 bp, Mus musculus
agaggggaatggagcagaggtgctc

SEQ ID NO: 443290 - DNA, 25 bp, Mus musculus
ggcgcgatgaagtcgccgaggtaca

SEQ ID NO: 443291 - DNA, 25 bp, Mus musculus
ctcccgctcctacgcccgcttcctt

SEQ ID NO: 443292 - DNA, 25 bp, Mus musculus
gtagcagaggtggtcgtgggtacag

SEQ ID NO: 443293 - DNA, 25 bp, Mus musculus
atatgcgtcttccaagcggccatca

SEQ ID NO: 443294 - DNA, 25 bp, Mus musculus
tgcgtcttccaagcggccatcaaat

SEQ ID NO: 443295 - DNA, 25 bp, Mus musculus
cttccaagcggccatcaaatttctc

SEQ ID NO: 443296 - DNA, 25 bp, Mus musculus
agcggccatcaaatttctcctctga

SEQ ID NO: 443297 - DNA, 25 bp, Mus musculus
tcaaatttctcctctgacccggtgg

SEQ ID NO: 443298 - DNA, 25 bp, Mus musculus
aatttctcctctgacccggtggccg

SEQ ID NO: 443299 - DNA, 25 bp, Mus musculus
tggcaccctggctgctattgctgac

SEQ ID NO: 443300 - DNA, 25 bp, Mus musculus
gcaccctggctgctattgctgaccg

SEQ ID NO: 443301 - DNA, 25 bp, Mus musculus
ctgctattgctgaccgcggagacaa

SEQ ID NO: 443302 - DNA, 25 bp, Mus musculus
cgcatatgcgtcttccaagcggcca

SEQ ID NO: 443303 - DNA, 25 bp, Mus musculus
tttcccagcgggctgggtagcttgg

SEQ ID NO: 443304 - DNA, 25 bp, Mus musculus
atggaggaaagatgcccgggaagcc

SEQ ID NO: 443305 - DNA, 25 bp, Mus musculus
tgctattgctgaccgcggagacaag

SEQ ID NO: 443306 - DNA, 25 bp, Mus musculus
tgactccagatgcagcgaccacggc

SEQ ID NO: 443307 - DNA, 25 bp, Mus musculus
gctggtttccttcacgccggcagca

SEQ ID NO: 443308 - DNA, 25 bp, Mus musculus
tttctgaccagcacgcgtgactcca

SEQ ID NO: 443309 - DNA, 25 bp, Mus musculus
ccagagcagcgatgcttgcagattc

SEQ ID NO: 443310 - DNA, 25 bp, Mus musculus
agattcacgcgaggggtttctgacc

SEQ ID NO: 443311 - DNA, 25 bp, Mus musculus
cagcagtttctggagccggagaaaa

SEQ ID NO: 443312 - DNA, 25 bp, Mus musculus
gcagaggaaagccaagaagcccgta

SEQ ID NO: 443313 - DNA, 25 bp, Mus musculus
tagggccctgctggtttccttcacg

SEQ ID NO: 443314 - DNA, 25 bp, Mus musculus
cttggaaggatctcttaccgtgggg

SEQ ID NO: 443315 - DNA, 25 bp, Mus musculus
tccacaccactcttggaaggatctc

SEQ ID NO: 443316 - DNA, 25 bp, Mus musculus
acgactgatcctccctaggtgtgcc

SEQ ID NO: 443317 - DNA, 25 bp, Mus musculus
gactggggtccgcacgactgatcct

SEQ ID NO: 443318 - DNA, 25 bp, Mus musculus
agaagcccgtactgcctaaaccaga

SEQ ID NO: 443319 - DNA, 25 bp, Mus musculus
gaaaaagagtgagctcctccagcca

SEQ ID NO: 443320 - DNA, 25 bp, Mus musculus
cgcgggagacttacttttggctagc

SEQ ID NO: 443321 - DNA, 25 bp, Mus musculus
gcacatgcgcacagagcactcaatc

SEQ ID NO: 443322 - DNA, 25 bp, Mus musculus
tgtcggctcgcggaatctctctcct

SEQ ID NO: 443323 - DNA, 25 bp, Mus musculus
agcccagaagcagctacacactatc

SEQ ID NO: 443324 - DNA, 25 bp, Mus musculus
catctccctagcattgtcagtttgg

SEQ ID NO: 443325 - DNA, 25 bp, Mus musculus
cgccttggatcgcatggtgtcggct

SEQ ID NO: 443326 - DNA, 25 bp, Mus musculus
cggaatatgatttgaccaggactga

SEQ ID NO: 443327 - DNA, 25 bp, Mus musculus
gcgcccactatttcaaaagcccgga

SEQ ID NO: 443328 - DNA, 25 bp, Mus musculus
aaaggcggtgctctagcgcccacta

SEQ ID NO: 443329 - DNA, 25 bp, Mus musculus
tcgagcgcaggaaaaagtctccatg

SEQ ID NO: 443330 - DNA, 25 bp, Mus musculus
cttcaagagcacagtttcgagcgca

SEQ ID NO: 443331 - DNA, 25 bp, Mus musculus
ggcaccacttgggaataaacttcaa

SEQ ID NO: 443332 - DNA, 25 bp, Mus musculus
cgaatcgcgaggatcacagaggagc

SEQ ID NO: 443333 - DNA, 25 bp, Mus musculus
agtttggacaccttcgcacatgcgc

SEQ ID NO: 443334 - DNA, 25 bp, Mus musculus
tgatagcgcagaaccggtgagctcc

SEQ ID NO: 443335 - DNA, 25 bp, Mus musculus
cgaatcaattaatgggcgttcttcc

SEQ ID NO: 443336 - DNA, 25 bp, Mus musculus
ccggtgcacgctttgccttcaatta

SEQ ID NO: 443337 - DNA, 25 bp, Mus musculus
ttcaattagcggatctcgccggccc

SEQ ID NO: 443338 - DNA, 25 bp, Mus musculus
cgccgcggaaactttctccttcttg

SEQ ID NO: 443339 - DNA, 25 bp, Mus musculus
tcgcctccagcccatctaattgaaa

SEQ ID NO: 443340 - DNA, 25 bp, Mus musculus
gggcaaggcctgtctctcctcctaa

SEQ ID NO: 443341 - DNA, 25 bp, Mus musculus
ctcctccgaggaagttcacatggtc

SEQ ID NO: 443342 - DNA, 25 bp, Mus musculus
ctgccagcctcattttttgaaagtc

SEQ ID NO: 443343 - DNA, 25 bp, Mus musculus
catgctttcgagttcctgcccgtca

SEQ ID NO: 443344 - DNA, 25 bp, Mus musculus
tcacgggccgcaagatgctatcgct

SEQ ID NO: 443345 - DNA, 25 bp, Mus musculus
ctggctgccgatggataaggttacc

SEQ ID NO: 443346 - DNA, 25 bp, Mus musculus
tgggttacgtttcacacaaaggcga

SEQ ID NO: 443347 - DNA, 25 bp, Mus musculus
aaggttaccacgaaagcattttgtg

SEQ ID NO: 443348 - DNA, 25 bp, Mus musculus
agggccgcaagatgctgctgcgctc

SEQ ID NO: 443349 - DNA, 25 bp, Mus musculus
tggactatgtcaccgcctgccggct

SEQ ID NO: 443350 - DNA, 25 bp, Mus musculus
gctgctgatcgccaaggcctacgtg

SEQ ID NO: 443351 - DNA, 25 bp, Mus musculus
gccaccttcttccaggatggaccag

SEQ ID NO: 443352 - DNA, 25 bp, Mus musculus
ggcctacgtgccctggaaccagcga

SEQ ID NO: 443353 - DNA, 25 bp, Mus musculus
ttcctgggcgcgctggactatgtca

SEQ ID NO: 443354 - DNA, 25 bp, Mus musculus
cgcgagctcttggttcccgtgacgc

SEQ ID NO: 443355 - DNA, 25 bp, Mus musculus
gctttgcccgcttcctggaggctgt

SEQ ID NO: 443356 - DNA, 25 bp, Mus musculus
gaccgcgaacgcctgcaggcacagg

SEQ ID NO: 443357 - DNA, 25 bp, Mus musculus
ggaagcagttccaggccctgctgtc

SEQ ID NO: 443358 - DNA, 25 bp, Mus musculus
cgccggcgcacggaagcagttccag

SEQ ID NO: 443359 - DNA, 25 bp, Mus musculus
ctacaggaggccttctgcgagagcc

SEQ ID NO: 443360 - DNA, 25 bp, Mus musculus
ctggggacatgctgcgggacctaca

SEQ ID NO: 443361 - DNA, 25 bp, Mus musculus
atgctgctgcgctcgccgagctacg

SEQ ID NO: 443362 - DNA, 25 bp, Mus musculus
gccgacatcctggagatggccgtca

SEQ ID NO: 443363 - DNA, 25 bp, Mus musculus
accaggactacagcgagggctactc

SEQ ID NO: 443364 - DNA, 25 bp, Mus musculus
tcgggaccgcatcaacagcagcata

SEQ ID NO: 443365 - DNA, 25 bp, Mus musculus
gaagctgctttaccacttccagcgg

SEQ ID NO: 443366 - DNA, 25 bp, Mus musculus
agcgaccattgtgcccgcgccaatt

SEQ ID NO: 443367 - DNA, 25 bp, Mus musculus
aggaggcggtacagttcctgaccct

SEQ ID NO: 443368 - DNA, 25 bp, Mus musculus
aacacagcaaaggtgagcccggcgc

SEQ ID NO: 443369 - DNA, 25 bp, Mus musculus
tggccgtcagctacctgaaacacag

SEQ ID NO: 443370 - DNA, 25 bp, Mus musculus
cagcccaactccaagctggagaagg

SEQ ID NO: 443371 - DNA, 25 bp, Mus musculus
tgctcagtcccaaggagaaaaaccg

SEQ ID NO: 443372 - DNA, 25 bp, Mus musculus
atcgcctccagagctccaggcatgg

SEQ ID NO: 443373 - DNA, 25 bp, Mus musculus
cgctgcccgcgcctatatagggctg

SEQ ID NO: 443374 - DNA, 25 bp, Mus musculus
cccgcgccaattcacaggcaattta

SEQ ID NO: 443375 - DNA, 25 bp, Mus musculus
acgccgccagcgacacgcagatgaa

SEQ ID NO: 443376 - DNA, 25 bp, Mus musculus
tcctgcgcgcctaggagttcacctt

SEQ ID NO: 443377 - DNA, 25 bp, Mus musculus
gcataatttatgcacgcggtcgttt

SEQ ID NO: 443378 - DNA, 25 bp, Mus musculus
cgcggtcgtttagcagtcaattata

SEQ ID NO: 443379 - DNA, 25 bp, Mus musculus
gcgcatatatttccatggctgatga

SEQ ID NO: 443380 - DNA, 25 bp, Mus musculus
gctggccgggcactttcaaaatggc

SEQ ID NO: 443381 - DNA, 25 bp, Mus musculus
gtctggacaagagcatcacgctgcc

SEQ ID NO: 443382 - DNA, 25 bp, Mus musculus
cgagatcttccgcaacctggagaac

SEQ ID NO: 443383 - DNA, 25 bp, Mus musculus
cgccattgatataggtagacacgga

SEQ ID NO: 443384 - DNA, 25 bp, Mus musculus
ggactcatagtgtgcgcggcgtcaa

SEQ ID NO: 443385 - DNA, 25 bp, Mus musculus
ggggcggagactcattagcataatt

SEQ ID NO: 443386 - DNA, 25 bp, Mus musculus
gcctggacacttgtcgagcgctgca

SEQ ID NO: 443387 - DNA, 25 bp, Mus musculus
cgccaagcgcttcgccattgatata

SEQ ID NO: 443388 - DNA, 25 bp, Mus musculus
gagttccggcttcccagtgagctgt

SEQ ID NO: 443389 - DNA, 25 bp, Mus musculus
cacggaccgggtactcaagaaagtg

SEQ ID NO: 443390 - DNA, 25 bp, Mus musculus
gtgagagcatctcgccgtattcccg

SEQ ID NO: 443391 - DNA, 25 bp, Mus musculus
tgggcgacgtgatgtccccagcctg

SEQ ID NO: 443392 - DNA, 25 bp, Mus musculus
gctcggctggcaatagcgcgcacgc

SEQ ID NO: 443393 - DNA, 25 bp, Mus musculus
ctggcaatagcgcgcacgcggctct

SEQ ID NO: 443394 - DNA, 25 bp, Mus musculus
tctggctccgagaggaggaacgcct

SEQ ID NO: 443395 - DNA, 25 bp, Mus musculus
ctccgagaggaggaacgcctcagga

SEQ ID NO: 443396 - DNA, 25 bp, Mus musculus
aggaacgcctcaggaagctggggcc

SEQ ID NO: 443397 - DNA, 25 bp, Mus musculus
cccagcctgctggaagccggtgagc

SEQ ID NO: 443398 - DNA, 25 bp, Mus musculus
gccggtgagccagcgtagctgctcc

SEQ ID NO: 443399 - DNA, 25 bp, Mus musculus
gagccagcgtagctgctccgtgaga

SEQ ID NO: 443400 - DNA, 25 bp, Mus musculus
agcgtagctgctccgtgagagcatc

SEQ ID NO: 443401 - DNA, 25 bp, Mus musculus
tagctgctccgtgagagcatctcgc

SEQ ID NO: 443402 - DNA, 25 bp, Mus musculus
tgctccgtgagagcatctcgccgta

SEQ ID NO: 443403 - DNA, 25 bp, Mus musculus
tccgtgagagcatctcgccgtattc

SEQ ID NO: 443404 - DNA, 25 bp, Mus musculus
gagcacttcccacatctcgaggctg

SEQ ID NO: 443405 - DNA, 25 bp, Mus musculus
cgggcaagcgcaacgcgcagagact

SEQ ID NO: 443406 - DNA, 25 bp, Mus musculus
ggggccgagagcacttcccacatct

SEQ ID NO: 443407 - DNA, 25 bp, Mus musculus
cacccgtgcccaaacggctaagaga

SEQ ID NO: 443408 - DNA, 25 bp, Mus musculus
cgccgcaaccaaagtactctttctg

SEQ ID NO: 443409 - DNA, 25 bp, Mus musculus
cgttcggcgctgtgacactgagccc

SEQ ID NO: 443410 - DNA, 25 bp, Mus musculus
ccgaggacatcgcttcgccagggct

SEQ ID NO: 443411 - DNA, 25 bp, Mus musculus
ctgaggctaaggttccgaggacatc

SEQ ID NO: 443412 - DNA, 25 bp, Mus musculus
ctggctctgactgaggctaaggttc

SEQ ID NO: 443413 - DNA, 25 bp, Mus musculus
ggcacctactgtgcttctgcggggc

SEQ ID NO: 443414 - DNA, 25 bp, Mus musculus
tgcagcaacaggagcggcacctact

SEQ ID NO: 443415 - DNA, 25 bp, Mus musculus
cagccctgcgtctgcagcaacagga

SEQ ID NO: 443416 - DNA, 25 bp, Mus musculus
acggctaagagaagcagctgggccc

SEQ ID NO: 443417 - DNA, 25 bp, Mus musculus
tttctgcaaagatgcacccgcagcc

SEQ ID NO: 443418 - DNA, 25 bp, Mus musculus
ttcctcccgctgctaggtgacgcga

SEQ ID NO: 443419 - DNA, 25 bp, Mus musculus
tcgttagtttgtccacgtttgcttc

SEQ ID NO: 443420 - DNA, 25 bp, Mus musculus
cgcgtctttctagatcgttagtttg

SEQ ID NO: 443421 - DNA, 25 bp, Mus musculus
gagagccgccacatacgcgtctttc

SEQ ID NO: 443422 - DNA, 25 bp, Mus musculus
gattgcaaccctcgtggctcgggta

SEQ ID NO: 443423 - DNA, 25 bp, Mus musculus
ggactgtagagtgtgattgcaaccc

SEQ ID NO: 443424 - DNA, 25 bp, Mus musculus
ccaggaggaactgatcgccctagta

SEQ ID NO: 443425 - DNA, 25 bp, Mus musculus
gataccgcctggaaggtcccggtga

SEQ ID NO: 443426 - DNA, 25 bp, Mus musculus
cagagcatctacagcctggacaagc

SEQ ID NO: 443427 - DNA, 25 bp, Mus musculus
acggcaccacgttccagagcatcta

SEQ ID NO: 443428 - DNA, 25 bp, Mus musculus
tctgcacagacaggtagacggcacc

SEQ ID NO: 443429 - DNA, 25 bp, Mus musculus
gcctgagccgaactggaacgttgtt

SEQ ID NO: 443430 - DNA, 25 bp, Mus musculus
ccggcggaacttaagagccagctca

SEQ ID NO: 443431 - DNA, 25 bp, Mus musculus
tgatcgccctagtaacccggccgga

SEQ ID NO: 443432 - DNA, 25 bp, Mus musculus
ccctgaagtgatccgggcagcgcag

SEQ ID NO: 443433 - DNA, 25 bp, Mus musculus
aagcgctgcacagcctagcgggtga

SEQ ID NO: 443434 - DNA, 25 bp, Mus musculus
tgcgagctctgcgattcgggccatg

SEQ ID NO: 443435 - DNA, 25 bp, Mus musculus
gtggacacgcccactactccgcctc

SEQ ID NO: 443436 - DNA, 25 bp, Mus musculus
ctgcacagcctagcgggtgagcgtt

SEQ ID NO: 443437 - DNA, 25 bp, Mus musculus
cgggtgaagcgctgcacagcctagc

SEQ ID NO: 443438 - DNA, 25 bp, Mus musculus
gacgagtactacctgggaggcctgc

SEQ ID NO: 443439 - DNA, 25 bp, Mus musculus
gcagcgcagaaggacgagtactacc

SEQ ID NO: 443440 - DNA, 25 bp, Mus musculus
agctctgcgattcgggccatggcgc

SEQ ID NO: 443441 - DNA, 25 bp, Mus musculus
ggacgcacgtcgagcgtcacaggcc

SEQ ID NO: 443442 - DNA, 25 bp, Mus musculus
cacgacggacgcacgtcgagcgtca

SEQ ID NO: 443443 - DNA, 25 bp, Mus musculus
ttcgcccgcgtggtgttcgcagcct

SEQ ID NO: 443444 - DNA, 25 bp, Mus musculus
ctccacagatgtcacgcctaggctc

SEQ ID NO: 443445 - DNA, 25 bp, Mus musculus
gagcgttccgggcacccagacaggc

SEQ ID NO: 443446 - DNA, 25 bp, Mus musculus
ccgcgaaacggtacgggctgcgtct

SEQ ID NO: 443447 - DNA, 25 bp, Mus musculus
attgacgtcctcaggctccggatcc

SEQ ID NO: 443448 - DNA, 25 bp, Mus musculus
cccgtggccttgacagcccagagga

SEQ ID NO: 443449 - DNA, 25 bp, Mus musculus
agctcggctccggatccgggaagct

SEQ ID NO: 443450 - DNA, 25 bp, Mus musculus
aagctgcacaggcacttccgttccg

SEQ ID NO: 443451 - DNA, 25 bp, Mus musculus
tttccgcttccggtatggacgcaga

SEQ ID NO: 443452 - DNA, 25 bp, Mus musculus
gtgcacaggcgcattgacgtcctca

SEQ ID NO: 443453 - DNA, 25 bp, Mus musculus
ccgctgcttcggatgttatggtctc

SEQ ID NO: 443454 - DNA, 25 bp, Mus musculus
atgttatggtctcctggccacgccc

SEQ ID NO: 443455 - DNA, 25 bp, Mus musculus
cggaggccaatggaaggcagcttta

SEQ ID NO: 443456 - DNA, 25 bp, Mus musculus
ggcagctttatggttgctagggaaa

SEQ ID NO: 443457 - DNA, 25 bp, Mus musculus
ctagggaaactttggcggcaagatg

SEQ ID NO: 443458 - DNA, 25 bp, Mus musculus
agctggcgatccctaccaggcttcg

SEQ ID NO: 443459 - DNA, 25 bp, Mus musculus
ctccacaggcgtggtccaggctgca

SEQ ID NO: 443460 - DNA, 25 bp, Mus musculus
cggttccagggcgtctctgtgccgc

SEQ ID NO: 443461 - DNA, 25 bp, Mus musculus
actgcggtcgaaccgctggaagccc

SEQ ID NO: 443462 - DNA, 25 bp, Mus musculus
ctagcaggagcctagcagagctgca

SEQ ID NO: 443463 - DNA, 25 bp, Mus musculus
tcctcctggagaagtgttgcggacg

SEQ ID NO: 443464 - DNA, 25 bp, Mus musculus
aaagggcgcgatccttctatgcaga

SEQ ID NO: 443465 - DNA, 25 bp, Mus musculus
tcgaaccgctggaagcccgcgcggt

SEQ ID NO: 443466 - DNA, 25 bp, Mus musculus
tccaggaatgatcccgcaggctggg

SEQ ID NO: 443467 - DNA, 25 bp, Mus musculus
acttggggtccaggaatgatcccgc

SEQ ID NO: 443468 - DNA, 25 bp, Mus musculus
atcctacgccgcaggaagtcgggtt

SEQ ID NO: 443469 - DNA, 25 bp, Mus musculus
tctctgggatcctacgccgcaggaa

SEQ ID NO: 443470 - DNA, 25 bp, Mus musculus
acacatgctctgaggcggatcccga

SEQ ID NO: 443471 - DNA, 25 bp, Mus musculus
ccacgaacacatgctctgaggcgga

SEQ ID NO: 443472 - DNA, 25 bp, Mus musculus
cttctatgcagaccacgaacacatg

SEQ ID NO: 443473 - DNA, 25 bp, Mus musculus
gagcctagcagagctgcagaccagg

SEQ ID NO: 443474 - DNA, 25 bp, Mus musculus
gtctcactcacccactcgccgctgc

SEQ ID NO: 443475 - DNA, 25 bp, Mus musculus
ttgttctgtccgtccttactccatc

SEQ ID NO: 443476 - DNA, 25 bp, Mus musculus
cgcgagccgaccgtggcagcagccc

SEQ ID NO: 443477 - DNA, 25 bp, Mus musculus
gaccctcgggagacctgactgggtc

SEQ ID NO: 443478 - DNA, 25 bp, Mus musculus
agacctgactgggtcgcaggaccca

SEQ ID NO: 443479 - DNA, 25 bp, Mus musculus
gactgggtcgcaggacccaccagct

SEQ ID NO: 443480 - DNA, 25 bp, Mus musculus
cgcgctcgccgtactcccggagggt

SEQ ID NO: 443481 - DNA, 25 bp, Mus musculus
gcggacagcaaagatgaggcccatc

SEQ ID NO: 443482 - DNA, 25 bp, Mus musculus
ggacagcaaagatgaggcccatccc

SEQ ID NO: 443483 - DNA, 25 bp, Mus musculus
cgaaatcctgcctgcgtgttgttct

SEQ ID NO: 443484 - DNA, 25 bp, Mus musculus
gaggagttcacctcgaaggagaaaa

SEQ ID NO: 443485 - DNA, 25 bp, Mus musculus
aatcctgcctgcgtgttgttctgtc

SEQ ID NO: 443486 - DNA, 25 bp, Mus musculus
acagggaggagttcacctcgaagga

SEQ ID NO: 443487 - DNA, 25 bp, Mus musculus
ttactccatcccaccggcgctttct

SEQ ID NO: 443488 - DNA, 25 bp, Mus musculus
ctcatggagctcaggtggaactgct

SEQ ID NO: 443489 - DNA, 25 bp, Mus musculus
gcagcttccatggtgcgatcgggct

SEQ ID NO: 443490 - DNA, 25 bp, Mus musculus
tggaactgctccagcgtcttctgca

SEQ ID NO: 443491 - DNA, 25 bp, Mus musculus
ctcggcgtccgtcttagtgatgagc

SEQ ID NO: 443492 - DNA, 25 bp, Mus musculus
tccttggcgctctccttcttgtagg

SEQ ID NO: 443493 - DNA, 25 bp, Mus musculus
tcccaccacgaaacaagagatggtc

SEQ ID NO: 443494 - DNA, 25 bp, Mus musculus
tgcggcaggcacagacgcttctcac

SEQ ID NO: 443495 - DNA, 25 bp, Mus musculus
ctgcagtgagaagtcgcgcagcacc

SEQ ID NO: 443496 - DNA, 25 bp, Mus musculus
cagctcatcgcacacggagttgatc

SEQ ID NO: 443497 - DNA, 25 bp, Mus musculus
gcgagcagtagatgtgcagctcatc

SEQ ID NO: 443498 - DNA, 25 bp, Mus musculus
ctttgaggatctccagctggtcggc

SEQ ID NO: 443499 - DNA, 25 bp, Mus musculus
ggcaggatgcccatgactttgagga

SEQ ID NO: 443500 - DNA, 25 bp, Mus musculus
tcgcgcagcaccgagttgaggatct

SEQ ID NO: 443501 - DNA, 25 bp, Mus musculus
tggccgccaactccttcttgcaagg

SEQ ID NO: 443502 - DNA, 25 bp, Mus musculus
ttccgccggacgctgtttggagaag

SEQ ID NO: 443503 - DNA, 25 bp, Mus musculus
caaggcggcagcctcgtgttcccaa

SEQ ID NO: 443504 - DNA, 25 bp, Mus musculus
cccaacggttgggatctcggcgcct

SEQ ID NO: 443505 - DNA, 25 bp, Mus musculus
atctcggcgccttagatttccagcg

SEQ ID NO: 443506 - DNA, 25 bp, Mus musculus
cttagatttccagcgccacaaaggg

SEQ ID NO: 443507 - DNA, 25 bp, Mus musculus
cgccacaaaggggagctggcacttg

SEQ ID NO: 443508 - DNA, 25 bp, Mus musculus
ggccgggctgtaagtctcacttccg

SEQ ID NO: 443509 - DNA, 25 bp, Mus musculus
tgttcccgcctagctgcggggttcc

SEQ ID NO: 443510 - DNA, 25 bp, Mus musculus
tcacttccgccggacgctgtttgga

SEQ ID NO: 443511 - DNA, 25 bp, Mus musculus
gggacgcctcgatgttcccgcctag

SEQ ID NO: 443512 - DNA, 25 bp, Mus musculus
gggttcctcgcacgcgtgcatctcg

SEQ ID NO: 443513 - DNA, 25 bp, Mus musculus
tgtaagtctcacttccgccggacgc

SEQ ID NO: 443514 - DNA, 25 bp, Mus musculus
tctcggggcgcggtcgcttcttccg

SEQ ID NO: 443515 - DNA, 25 bp, Mus musculus
gtgcatctcgctaccagccgcgctc

SEQ ID NO: 443516 - DNA, 25 bp, Mus musculus
cggcgacccgaatagtccagggaca

SEQ ID NO: 443517 - DNA, 25 bp, Mus musculus
acacgcgtgcctggttcttcttggt

SEQ ID NO: 443518 - DNA, 25 bp, Mus musculus
atcgagacggccaatccacgaggcg

SEQ ID NO: 443519 - DNA, 25 bp, Mus musculus
gcacgtagtggctttgcccggcaac

SEQ ID NO: 443520 - DNA, 25 bp, Mus musculus
ccgtagtgcgccttcagacggacgc

SEQ ID NO: 443521 - DNA, 25 bp, Mus musculus
agtccagggacagtcaggccactcc

SEQ ID NO: 443522 - DNA, 25 bp, Mus musculus
tctgttgtgctgaaagccgggcaaa

SEQ ID NO: 443523 - DNA, 25 bp, Mus musculus
gatgttttcagaccttcggagtacg

SEQ ID NO: 443524 - DNA, 25 bp, Mus musculus
gagtacgaactccagctgtccgcag

SEQ ID NO: 443525 - DNA, 25 bp, Mus musculus
actcctcaaagtgcgagctggtctg

SEQ ID NO: 443526 - DNA, 25 bp, Mus musculus
ccagttagcttctccgccgaacaga

SEQ ID NO: 443527 - DNA, 25 bp, Mus musculus
cgccgaacagatctggagaatcgta

SEQ ID NO: 443528 - DNA, 25 bp, Mus musculus
ttcgctttacattccacacgcgtgc

SEQ ID NO: 443529 - DNA, 25 bp, Mus musculus
gccgcggcccaataaccagagtgca

SEQ ID NO: 443530 - DNA, 25 bp, Mus musculus
gagggtgcccgccaaagaacgagtc

SEQ ID NO: 443531 - DNA, 25 bp, Mus musculus
gtcagccgggtccttagatctggaa

SEQ ID NO: 443532 - DNA, 25 bp, Mus musculus
acagcgcagcgttcagcaccgagga

SEQ ID NO: 443533 - DNA, 25 bp, Mus musculus
tccttagatctggaagagcggcagg

SEQ ID NO: 443534 - DNA, 25 bp, Mus musculus
cgcaaagcacaacagggtggaccta

SEQ ID NO: 443535 - DNA, 25 bp, Mus musculus
ctagaggtgaagactctgggtcctg

SEQ ID NO: 443536 - DNA, 25 bp, Mus musculus
tgggtcctgacaactcggaactctg

SEQ ID NO: 443537 - DNA, 25 bp, Mus musculus
agctgctcacctggcgccatggtgc

SEQ ID NO: 443538 - DNA, 25 bp, Mus musculus
agcccagaacgtccatggccttgcg

SEQ ID NO: 443539 - DNA, 25 bp, Mus musculus
tgcgcgggacaggtccagctagccc

SEQ ID NO: 443540 - DNA, 25 bp, Mus musculus
aagcaaagttgctttgcctgcggcc

SEQ ID NO: 443541 - DNA, 25 bp, Mus musculus
gaggcttctgcgcaccgcatagcac

SEQ ID NO: 443542 - DNA, 25 bp, Mus musculus
ctgcgctccggagagctccgagagc

SEQ ID NO: 443543 - DNA, 25 bp, Mus musculus
atagcacccggtggtcgctccgctg

SEQ ID NO: 443544 - DNA, 25 bp, Mus musculus
agcagccttccgttgccatggagct

SEQ ID NO: 443545 - DNA, 25 bp, Mus musculus
cgcctgcgcacaagctctccctccg

SEQ ID NO: 443546 - DNA, 25 bp, Mus musculus
caaagcagccttccgttgccatgga

SEQ ID NO: 443547 - DNA, 25 bp, Mus musculus
cccgctgttgcactacgcctgcgca

SEQ ID NO: 443548 - DNA, 25 bp, Mus musculus
tgccatggagctgcgcgcccaaact

SEQ ID NO: 443549 - DNA, 25 bp, Mus musculus
cgcgcccaaactacgcagcctcaga

SEQ ID NO: 443550 - DNA, 25 bp, Mus musculus
cagcctcagacccacggtggctggg

SEQ ID NO: 443551 - DNA, 25 bp, Mus musculus
ggccagtgctgaggaaccgtcgccg

SEQ ID NO: 443552 - DNA, 25 bp, Mus musculus
taagaggccatggtctagcggctta

SEQ ID NO: 443553 - DNA, 25 bp, Mus musculus
aggccatggtctagcggcttaagga

SEQ ID NO: 443554 - DNA, 25 bp, Mus musculus
gtctagcggcttaaggaactgattc

SEQ ID NO: 443555 - DNA, 25 bp, Mus musculus
tagcggcttaaggaactgattctgc

SEQ ID NO: 443556 - DNA, 25 bp, Mus musculus
cggcttaaggaactgattctgcggg

SEQ ID NO: 443557 - DNA, 25 bp, Mus musculus
cgggccgttaagaggccatggtcta

SEQ ID NO: 443558 - DNA, 25 bp, Mus musculus
ctcttctcgctcgtgggtcatcggc

SEQ ID NO: 443559 - DNA, 25 bp, Mus musculus
aggcgcttcttctcgcggccgagtc

SEQ ID NO: 443560 - DNA, 25 bp, Mus musculus
ggtcttaggctcaaggccgcgtccg

SEQ ID NO: 443561 - DNA, 25 bp, Mus musculus
tcaaggccagatctgggatgggttc

SEQ ID NO: 443562 - DNA, 25 bp, Mus musculus
ctgggttcaaggctggatcccggat

SEQ ID NO: 443563 - DNA, 25 bp, Mus musculus
tcccggatgcgggacctgatctgtg

SEQ ID NO: 443564 - DNA, 25 bp, Mus musculus
cctgatctgtggtcttgggttcaaa

SEQ ID NO: 443565 - DNA, 25 bp, Mus musculus
tcgtaggttcgagcctggatggctt

SEQ ID NO: 443566 - DNA, 25 bp, Mus musculus
cggaattcggtttccagactcattc

SEQ ID NO: 443567 - DNA, 25 bp, Mus musculus
gactcattcatgttcctggggtcga

SEQ ID NO: 443568 - DNA, 25 bp, Mus musculus
cccgcgggaacaaaagccgagctct

SEQ ID NO: 443569 - DNA, 25 bp, Mus musculus
gcccatcctgatggctggaggcgtc

SEQ ID NO: 443570 - DNA, 25 bp, Mus musculus
tcttgggttcaaagcccgtgtcgga

SEQ ID NO: 443571 - DNA, 25 bp, Mus musculus
gccgtcttcatcctgctcttcaggg

SEQ ID NO: 443572 - DNA, 25 bp, Mus musculus
gtacagatcccagcttctccctggg

SEQ ID NO: 443573 - DNA, 25 bp, Mus musculus
cgcggtcgttttagtacagatccca

SEQ ID NO: 443574 - DNA, 25 bp, Mus musculus
tagcgcggtcgttttagtacagatc

SEQ ID NO: 443575 - DNA, 25 bp, Mus musculus
tgcagctggatagcgcggtcgtttt

SEQ ID NO: 443576 - DNA, 25 bp, Mus musculus
cctgtgccggttgtgcagctggata

SEQ ID NO: 443577 - DNA, 25 bp, Mus musculus
gctctaccctgtgccggttgtgcag

SEQ ID NO: 443578 - DNA, 25 bp, Mus musculus
ctaggctctaccctgtgccggttgt

SEQ ID NO: 443579 - DNA, 25 bp, Mus musculus
aggcgacctcaaggcgcctcctagg

SEQ ID NO: 443580 - DNA, 25 bp, Mus musculus
cgactggatgagcaggcgacctcaa

SEQ ID NO: 443581 - DNA, 25 bp, Mus musculus
cacgcattctgcgactggatgagca

SEQ ID NO: 443582 - DNA, 25 bp, Mus musculus
cggaaactcacgcattctgcgactg

SEQ ID NO: 443583 - DNA, 25 bp, Mus musculus
gcttctccctgggtcaacaaccaaa

SEQ ID NO: 443584 - DNA, 25 bp, Mus musculus
cgaagaaacaaaatagcgctagggg

SEQ ID NO: 443585 - DNA, 25 bp, Mus musculus
tcgttttagtacagatcccagcttc

SEQ ID NO: 443586 - DNA, 25 bp, Mus musculus
gtctgaagatctggtccggccttgg

SEQ ID NO: 443587 - DNA, 25 bp, Mus musculus
ccagcatgtagacgtccacgcgggc

SEQ ID NO: 443588 - DNA, 25 bp, Mus musculus
tcactggccgggacccgtgaagaca

SEQ ID NO: 443589 - DNA, 25 bp, Mus musculus
aagacagggtcacggcgccggccct

SEQ ID NO: 443590 - DNA, 25 bp, Mus musculus
ccctgcgtccgaacgtgggttgcag

SEQ ID NO: 443591 - DNA, 25 bp, Mus musculus
taagccagttcagcgcgcagcaccg

SEQ ID NO: 443592 - DNA, 25 bp, Mus musculus
agcctaagggacaggtctgaagatc

SEQ ID NO: 443593 - DNA, 25 bp, Mus musculus
agaagccatgtaggccgccgttctg

SEQ ID NO: 443594 - DNA, 25 bp, Mus musculus
cgccgttctgttctaagccagttca

SEQ ID NO: 443595 - DNA, 25 bp, Mus musculus
ctgctcggcccagcatgtagacgtc

SEQ ID NO: 443596 - DNA, 25 bp, Mus musculus
ccggtctctggaccgagcggccatg

SEQ ID NO: 443597 - DNA, 25 bp, Mus musculus
tgcgcttgcgcactgacagccgcgg

SEQ ID NO: 443598 - DNA, 25 bp, Mus musculus
acgtgccctgcagcgcatgcgtgcg

SEQ ID NO: 443599 - DNA, 25 bp, Mus musculus
ttgcagccaggatgacgcgtggtct

SEQ ID NO: 443600 - DNA, 25 bp, Mus musculus
ggcctctgaggctcgaccaatgagc

SEQ ID NO: 443601 - DNA, 25 bp, Mus musculus
atcccggcagcgtccaagactcgga

SEQ ID NO: 443602 - DNA, 25 bp, Mus musculus
ctcgtcttgtgactttctggtcaga

SEQ ID NO: 443603 - DNA, 25 bp, Mus musculus
gccactgagcgcttctcgtcttgtg

SEQ ID NO: 443604 - DNA, 25 bp, Mus musculus
tcaccttggtctcggtggaacgttc

SEQ ID NO: 443605 - DNA, 25 bp, Mus musculus
acgttccggaatgtaccacaggcca

SEQ ID NO: 443606 - DNA, 25 bp, Mus musculus
taccacaggccagaggagcgacacc

SEQ ID NO: 443607 - DNA, 25 bp, Mus musculus
gaacgttctggaaggtgccattgtg

SEQ ID NO: 443608 - DNA, 25 bp, Mus musculus
taacagcttccggtgcgtcacgtcc

SEQ ID NO: 443609 - DNA, 25 bp, Mus musculus
cccgtgtgtgtgtcccaaatctaaa

SEQ ID NO: 443610 - DNA, 25 bp, Mus musculus
cttgactctggaccgctctgcctaa

SEQ ID NO: 443611 - DNA, 25 bp, Mus musculus
tgggctgaggctctgcataaactcc

SEQ ID NO: 443612 - DNA, 25 bp, Mus musculus
ggttcctcgcacgttcgccactgag

SEQ ID NO: 443613 - DNA, 25 bp, Mus musculus
cggcctcagaggattggctccttca

SEQ ID NO: 443614 - DNA, 25 bp, Mus musculus
aaaagtcgagcgcacacgcggttcg

SEQ ID NO: 443615 - DNA, 25 bp, Mus musculus
ccttgcctcaggtttgcgtgactga

SEQ ID NO: 443616 - DNA, 25 bp, Mus musculus
tgtaaggacacttccggtgcgcgca

SEQ ID NO: 443617 - DNA, 25 bp, Mus musculus
tacgtcatcatcacgcttccgcgga

SEQ ID NO: 443618 - DNA, 25 bp, Mus musculus
ggagccaactcacgatgtaaggaca

SEQ ID NO: 443619 - DNA, 25 bp, Mus musculus
gaagtgacgacaatcctggcgcgcg

SEQ ID NO: 443620 - DNA, 25 bp, Mus musculus
tcgcgtcgttggcaggagccaactc

SEQ ID NO: 443621 - DNA, 25 bp, Mus musculus
tgcgtgactgaaccctcagaagtgg

SEQ ID NO: 443622 - DNA, 25 bp, Mus musculus
ccaggacgttaccagacgctacttc

SEQ ID NO: 443623 - DNA, 25 bp, Mus musculus
ctcgaaacgtcatctctcggagaca

SEQ ID NO: 443624 - DNA, 25 bp, Mus musculus
gacggccgagcgcatcgtctcgaaa

SEQ ID NO: 443625 - DNA, 25 bp, Mus musculus
ggcctgcagactacgctaccgagtg

SEQ ID NO: 443626 - DNA, 25 bp, Mus musculus
gtgcaaatgctgctcggcctgcaga

SEQ ID NO: 443627 - DNA, 25 bp, Mus musculus
gcagtctcgctccacacggagctga

SEQ ID NO: 443628 - DNA, 25 bp, Mus musculus
gagaaggcacaacccgctcagggca

SEQ ID NO: 443629 - DNA, 25 bp, Mus musculus
cagaacacaccctacagtgtcgggg

SEQ ID NO: 443630 - DNA, 25 bp, Mus musculus
tgatacaccctcagatgctgacccg

SEQ ID NO: 443631 - DNA, 25 bp, Mus musculus
gactccagtcgggttagggccacaa

SEQ ID NO: 443632 - DNA, 25 bp, Mus musculus
aacgccaacgcggagagaaggcaca

SEQ ID NO: 443633 - DNA, 25 bp, Mus musculus
cggctgcgctggctcaaataaggaa

SEQ ID NO: 443634 - DNA, 25 bp, Mus musculus
ggcagcccatggcagactccagtcg

SEQ ID NO: 443635 - DNA, 25 bp, Mus musculus
gcggcagaggccagaacacacccta

SEQ ID NO: 443636 - DNA, 25 bp, Mus musculus
cccggtgcgattccaggaaccaggc

SEQ ID NO: 443637 - DNA, 25 bp, Mus musculus
cgttaagtctggaaccgtccgcatc

SEQ ID NO: 443638 - DNA, 25 bp, Mus musculus
ataaggaaccgactcgttaagtctg

SEQ ID NO: 443639 - DNA, 25 bp, Mus musculus
acgtagggacctggatcgcagagct

SEQ ID NO: 443640 - DNA, 25 bp, Mus musculus
gcggacggctcgagttacagcccta

SEQ ID NO: 443641 - DNA, 25 bp, Mus musculus
cagccctatggtgaagagaggaccc

SEQ ID NO: 443642 - DNA, 25 bp, Mus musculus
acgccggctgctgcaagggcagacc

SEQ ID NO: 443643 - DNA, 25 bp, Mus musculus
agcttgtgctccgacgccggctgct

SEQ ID NO: 443644 - DNA, 25 bp, Mus musculus
agtttacccgcggagcttgtgctcc

SEQ ID NO: 443645 - DNA, 25 bp, Mus musculus
aaccgcagtttacccgcggagcttg

SEQ ID NO: 443646 - DNA, 25 bp, Mus musculus
cggaggccaagcgaaccgcagttta

SEQ ID NO: 443647 - DNA, 25 bp, Mus musculus
gctgggagcctctagcggaggccaa

SEQ ID NO: 443648 - DNA, 25 bp, Mus musculus
cgtcgagcaaccactccaccgcccg

SEQ ID NO: 443649 - DNA, 25 bp, Mus musculus
accaggctcgctcgtcgagcaacca

SEQ ID NO: 443650 - DNA, 25 bp, Mus musculus
aggctgggttggaccccctatgccg

SEQ ID NO: 443651 - DNA, 25 bp, Mus musculus
cgtctcccgcccaggctgggttgga

SEQ ID NO: 443652 - DNA, 25 bp, Mus musculus
cgggactcgggctcacgtctcccgc

SEQ ID NO: 443653 - DNA, 25 bp, Mus musculus
gcaccgctttccagagcacagcctg

SEQ ID NO: 443654 - DNA, 25 bp, Mus musculus
gcctcccgaagacggggcgcccagc

SEQ ID NO: 443655 - DNA, 25 bp, Mus musculus
tgggttccgactcgcctcccgaaga

SEQ ID NO: 443656 - DNA, 25 bp, Mus musculus
gtgcgctcacacgaagatctgaatg

SEQ ID NO: 443657 - DNA, 25 bp, Mus musculus
ctcacacgaagatctgaatgcggtc

SEQ ID NO: 443658 - DNA, 25 bp, Mus musculus
cgaagatctgaatgcggtcgcggat

SEQ ID NO: 443659 - DNA, 25 bp, Mus musculus
taagcgcggcgccacagggcgcgca

SEQ ID NO: 443660 - DNA, 25 bp, Mus musculus
acagggcgcgcacgctccatggccg

SEQ ID NO: 443661 - DNA, 25 bp, Mus musculus
tccatggccgcactggaacaccagg

SEQ ID NO: 443662 - DNA, 25 bp, Mus musculus
acaccaggcggatgtggctgtcgat

SEQ ID NO: 443663 - DNA, 25 bp, Mus musculus
atggggcaggtgatgcgctcctcca

SEQ ID NO: 443664 - DNA, 25 bp, Mus musculus
aggtgatgcgctcctccatctgcct

SEQ ID NO: 443665 - DNA, 25 bp, Mus musculus
tccatctgcctgtagcggctctgta

SEQ ID NO: 443666 - DNA, 25 bp, Mus musculus
tgcctgtagcggctctgtagctcct

SEQ ID NO: 443667 - DNA, 25 bp, Mus musculus
tgtagctcctccaccagttgccgag

SEQ ID NO: 443668 - DNA, 25 bp, Mus musculus
cacggcgtgtggagtgcgctcacac

SEQ ID NO: 443669 - DNA, 25 bp, Mus musculus
tggagtgcgctcacacgaagatctg

SEQ ID NO: 443670 - DNA, 25 bp, Mus musculus
cctgcgtctcggcattcttggaaca

SEQ ID NO: 443671 - DNA, 25 bp, Mus musculus
agcgggagctctgtttctctaaaga

SEQ ID NO: 443672 - DNA, 25 bp, Mus musculus
ccgacggacgcgttatgcatggtca

SEQ ID NO: 443673 - DNA, 25 bp, Mus musculus
cgtacacgtctggtctggtagcaaa

SEQ ID NO: 443674 - DNA, 25 bp, Mus musculus
cggggcttatagctaccaaggcacc

SEQ ID NO: 443675 - DNA, 25 bp, Mus musculus
cgcgtgacgcactatgcttagggtc

SEQ ID NO: 443676 - DNA, 25 bp, Mus musculus
cgggacagacgactcccaggaggct

SEQ ID NO: 443677 - DNA, 25 bp, Mus musculus
cgccgcacagattgccgggagctgt

SEQ ID NO: 443678 - DNA, 25 bp, Mus musculus
tctcttgcgctagcccaccagggag

SEQ ID NO: 443679 - DNA, 25 bp, Mus musculus
acagtgtttagcaaggccgcctctc

SEQ ID NO: 443680 - DNA, 25 bp, Mus musculus
ttgccaagagtttccgcgctcgttc

SEQ ID NO: 443681 - DNA, 25 bp, Mus musculus
gccgaggtcagccaacaaaaccgca

SEQ ID NO: 443682 - DNA, 25 bp, Mus musculus
gaagcaccaaaagcccgtcgcgctg

SEQ ID NO: 443683 - DNA, 25 bp, Mus musculus
ggcgcaaagtcgcacccggaagtgc

SEQ ID NO: 443684 - DNA, 25 bp, Mus musculus
ccagcaccggatagagggaccgtcc

SEQ ID NO: 443685 - DNA, 25 bp, Mus musculus
gaccgtccggagttctcatcaattg

SEQ ID NO: 443686 - DNA, 25 bp, Mus musculus
cacccgcctgtgctaggtagacttt

SEQ ID NO: 443687 - DNA, 25 bp, Mus musculus
ggtagactttctcatgcccgtggga

SEQ ID NO: 443688 - DNA, 25 bp, Mus musculus
gcgtcttcgcgctaaactgctcgtg

SEQ ID NO: 443689 - DNA, 25 bp, Mus musculus
tggcgtggcacctatacgcgcttcc

SEQ ID NO: 443690 - DNA, 25 bp, Mus musculus
cttcccttgcgatcgcgtgcttttg

SEQ ID NO: 443691 - DNA, 25 bp, Mus musculus
gactacctgctaccggacgtgcacg

SEQ ID NO: 443692 - DNA, 25 bp, Mus musculus
tgcacgacagcgtgcgctaccgctt

SEQ ID NO: 443693 - DNA, 25 bp, Mus musculus
gagttcaccgccgaaccggcagcta

SEQ ID NO: 443694 - DNA, 25 bp, Mus musculus
accggcagctatgcaggagatcgtg

SEQ ID NO: 443695 - DNA, 25 bp, Mus musculus
catctgtgtcatgctggtggtcatc

SEQ ID NO: 443696 - DNA, 25 bp, Mus musculus
gtggcctacatcaccgagaacctca

SEQ ID NO: 443697 - DNA, 25 bp, Mus musculus
gtcatctgcctgctggtggcctaca

SEQ ID NO: 443698 - DNA, 25 bp, Mus musculus
agttttcagtattgcgcaagcgccg

SEQ ID NO: 443699 - DNA, 25 bp, Mus musculus
cgaagggtgcctggtgtttatcttt

SEQ ID NO: 443700 - DNA, 25 bp, Mus musculus
ggccaaggtctttccgtgctgcgaa

SEQ ID NO: 443701 - DNA, 25 bp, Mus musculus
gtaaaccctagaggtggccacacga

SEQ ID NO: 443702 - DNA, 25 bp, Mus musculus
acaccctcggtagtgtaggcatccc

SEQ ID NO: 443703 - DNA, 25 bp, Mus musculus
atcctcaggtagtgcaagctccacc

SEQ ID NO: 443704 - DNA, 25 bp, Mus musculus
tggaagcacacaacatcctcaggta

SEQ ID NO: 443705 - DNA, 25 bp, Mus musculus
gtggtgtgctcgagtaaccagaatc

SEQ ID NO: 443706 - DNA, 25 bp, Mus musculus
tgtcgcagatttccggttaccgcca

SEQ ID NO: 443707 - DNA, 25 bp, Mus musculus
gcgttcacttccgtgtcgcagattt

SEQ ID NO: 443708 - DNA, 25 bp, Mus musculus
gctgcagtacgagcccaggagagca

SEQ ID NO: 443709 - DNA, 25 bp, Mus musculus
acattaggacgcaggcgcggctcac

SEQ ID NO: 443710 - DNA, 25 bp, Mus musculus
atctttcccgtatatgtgtcgtccg

SEQ ID NO: 443711 - DNA, 25 bp, Mus musculus
tcatccgaggcgacggtacattagg

SEQ ID NO: 443712 - DNA, 25 bp, Mus musculus
caccatgatcttcatgattctgggg

SEQ ID NO: 443713 - DNA, 25 bp, Mus musculus
gagtgcgaacaccatgatcttcatg

SEQ ID NO: 443714 - DNA, 25 bp, Mus musculus
tcgccctgaccggtcatgggctctt

SEQ ID NO: 443715 - DNA, 25 bp, Mus musculus
atcgcgtgcttgatggacatgaacg

SEQ ID NO: 443716 - DNA, 25 bp, Mus musculus
cttgatggacatgaacgcgctgctg

SEQ ID NO: 443717 - DNA, 25 bp, Mus musculus
cgcgctgctggaccgattccataac

SEQ ID NO: 443718 - DNA, 25 bp, Mus musculus
ggaccgattccataactacatcctc

SEQ ID NO: 443719 - DNA, 25 bp, Mus musculus
gaggaccgcgtctgccactgcaact

SEQ ID NO: 443720 - DNA, 25 bp, Mus musculus
ccactgcaactgtggccggtgagtg

SEQ ID NO: 443721 - DNA, 25 bp, Mus musculus
ccggctctaggcactacacgcgtga

SEQ ID NO: 443722 - DNA, 25 bp, Mus musculus
ggcactacacgcgtgatcacacttg

SEQ ID NO: 443723 - DNA, 25 bp, Mus musculus
gtgatcacacttgtgcagcgggccc

SEQ ID NO: 443724 - DNA, 25 bp, Mus musculus
cgcccgatgtccatgagtgcgaaca

SEQ ID NO: 443725 - DNA, 25 bp, Mus musculus
tcttccaggccatcgcgtgcttgat

SEQ ID NO: 443726 - DNA, 25 bp, Mus musculus
aagacgacgccctccatcgaggggc

SEQ ID NO: 443727 - DNA, 25 bp, Mus musculus
tgccacagacatcacccgttgtgtg

SEQ ID NO: 443728 - DNA, 25 bp, Mus musculus
tcggaagttacagatgccacagaca

SEQ ID NO: 443729 - DNA, 25 bp, Mus musculus
gacacagatatctggccgacccgga

SEQ ID NO: 443730 - DNA, 25 bp, Mus musculus
tggcgctctagtctggacacagata

SEQ ID NO: 443731 - DNA, 25 bp, Mus musculus
aaagccggaagacgacgccctccat

SEQ ID NO: 443732 - DNA, 25 bp, Mus musculus
tcatcaagccacgtagctgcgctac

SEQ ID NO: 443733 - DNA, 25 bp, Mus musculus
gacagaaaagggtcgcaatccaacc

SEQ ID NO: 443734 - DNA, 25 bp, Mus musculus
agggtcgcaatccaacccgcgggca

SEQ ID NO: 443735 - DNA, 25 bp, Mus musculus
agagaggactcaaactagccgaagt

SEQ ID NO: 443736 - DNA, 25 bp, Mus musculus
ccaagcgccgctgctcggaagttac

SEQ ID NO: 443737 - DNA, 25 bp, Mus musculus
tagccgaagtcggatgagctcctca

SEQ ID NO: 443738 - DNA, 25 bp, Mus musculus
tgagctcctcatcaagccacgtagc

SEQ ID NO: 443739 - DNA, 25 bp, Mus musculus
atatctggccgacccggagaaaagc

SEQ ID NO: 443740 - DNA, 25 bp, Mus musculus
ctcggggctgccgtgcacatataaa

SEQ ID NO: 443741 - DNA, 25 bp, Mus musculus
cggcgttctgcactgcgctgtacgc

SEQ ID NO: 443742 - DNA, 25 bp, Mus musculus
acgcccggctgccaagacgggactg

SEQ ID NO: 443743 - DNA, 25 bp, Mus musculus
catataaagggacctcgtggacgcc

SEQ ID NO: 443744 - DNA, 25 bp, Mus musculus
tgccgtgcacatataaagggacctc

SEQ ID NO: 443745 - DNA, 25 bp, Mus musculus
gcacctctgagtgcccaggactcgg

SEQ ID NO: 443746 - DNA, 25 bp, Mus musculus
agcagaagctctaccacaacggcca

SEQ ID NO: 443747 - DNA, 25 bp, Mus musculus
atggctcgtggacctggctgcccaa

SEQ ID NO: 443748 - DNA, 25 bp, Mus musculus
ctgcactgcgctgtacgcgcctgga

SEQ ID NO: 443749 - DNA, 25 bp, Mus musculus
ccctgcagatggctcgtggacctgg

SEQ ID NO: 443750 - DNA, 25 bp, Mus musculus
catggtgcacgtgaagcagaagctc

SEQ ID NO: 443751 - DNA, 25 bp, Mus musculus
acacaggcccttcgaggagcctacg

SEQ ID NO: 443752 - DNA, 25 bp, Mus musculus
ccttcgaggagcctacggggaacat

SEQ ID NO: 443753 - DNA, 25 bp, Mus musculus
agcctacggggaacatggtgcacgt

SEQ ID NO: 443754 - DNA, 25 bp, Mus musculus
tggccgctgacatagggacgccagt

SEQ ID NO: 443755 - DNA, 25 bp, Mus musculus
agggtcaagacgttctcagccgccg

SEQ ID NO: 443756 - DNA, 25 bp, Mus musculus
ctgacatagggacgccagtggcgtc

SEQ ID NO: 443757 - DNA, 25 bp, Mus musculus
ccggattggccgctgacatagggac

SEQ ID NO: 443758 - DNA, 25 bp, Mus musculus
taccggagcgtgactcgcgaggctc

SEQ ID NO: 443759 - DNA, 25 bp, Mus musculus
ccgccaagcccagcccgcgcactca

SEQ ID NO: 443760 - DNA, 25 bp, Mus musculus
taggagggtcaagacgttctcagcc

SEQ ID NO: 443761 - DNA, 25 bp, Mus musculus
acctaggagggtcaagacgttctca

SEQ ID NO: 443762 - DNA, 25 bp, Mus musculus
tgactcgcgaggctcctcgcagtca

SEQ ID NO: 443763 - DNA, 25 bp, Mus musculus
agcgtgactcgcgaggctcctcgca

SEQ ID NO: 443764 - DNA, 25 bp, Mus musculus
tcaagacgttctcagccgccggatt

SEQ ID NO: 443765 - DNA, 25 bp, Mus musculus
cccgcgcactcacgcgagtgctcca

SEQ ID NO: 443766 - DNA, 25 bp, Mus musculus
cggaccgtaccggagcgtgactcgc

SEQ ID NO: 443767 - DNA, 25 bp, Mus musculus
aagacgttctcagccgccggattgg

SEQ ID NO: 443768 - DNA, 25 bp, Mus musculus
gaaaacccacgagcagcagtgtctc

SEQ ID NO: 443769 - DNA, 25 bp, Mus musculus
gtactcgcacgtgctgcggcctcag

SEQ ID NO: 443770 - DNA, 25 bp, Mus musculus
tcaccttgcagtgtgcgtactcgca

SEQ ID NO: 443771 - DNA, 25 bp, Mus musculus
ggaggagtggtcttcccatgccacc

SEQ ID NO: 443772 - DNA, 25 bp, Mus musculus
tgcgagatgacgatgcgttctggcc

SEQ ID NO: 443773 - DNA, 25 bp, Mus musculus
tacatggtagccgagagcggagtcc

SEQ ID NO: 443774 - DNA, 25 bp, Mus musculus
ccctgcagaggtccgagctgtacat

SEQ ID NO: 443775 - DNA, 25 bp, Mus musculus
tagtgctgttctggcctgctggcac

SEQ ID NO: 443776 - DNA, 25 bp, Mus musculus
cggcagtcacagtcaccaggtaagt

SEQ ID NO: 443777 - DNA, 25 bp, Mus musculus
agcagtgtctctctctccgggctag

SEQ ID NO: 443778 - DNA, 25 bp, Mus musculus
gtcaaaggcaggaccggcatcccat

SEQ ID NO: 443779 - DNA, 25 bp, Mus musculus
cgacgaaaggaattaacgctggtca

SEQ ID NO: 443780 - DNA, 25 bp, Mus musculus
atgaccagtggggaaacgacgaaag

SEQ ID NO: 443781 - DNA, 25 bp, Mus musculus
ggccgtacaggccttagccgacagc

SEQ ID NO: 443782 - DNA, 25 bp, Mus musculus
agcggatcggctatgaagaattgga

SEQ ID NO: 443783 - DNA, 25 bp, Mus musculus
aaagccatgctgaacgcagtccaga

SEQ ID NO: 443784 - DNA, 25 bp, Mus musculus
gcagtccagaacagcatcgcgcctg

SEQ ID NO: 443785 - DNA, 25 bp, Mus musculus
agtggcgggctcttgatcgaccaca

SEQ ID NO: 443786 - DNA, 25 bp, Mus musculus
tcgaccacagctggctgctaacttg

SEQ ID NO: 443787 - DNA, 25 bp, Mus musculus
tgctaacttgccctcctaccgtgag

SEQ ID NO: 443788 - DNA, 25 bp, Mus musculus
actcgcggccactcctgcttgggag

SEQ ID NO: 443789 - DNA, 25 bp, Mus musculus
tcgctcgcgcagaggccaatctgca

SEQ ID NO: 443790 - DNA, 25 bp, Mus musculus
tctgcacagactgcacggtgatgca

SEQ ID NO: 443791 - DNA, 25 bp, Mus musculus
atgcatgccatagcggtcccggact

SEQ ID NO: 443792 - DNA, 25 bp, Mus musculus
tgccaaccgcagactcaaagccatg

SEQ ID NO: 443793 - DNA, 25 bp, Mus musculus
ttcccacctactggttcggcggctg

SEQ ID NO: 443794 - DNA, 25 bp, Mus musculus
tggaatccgggtttcaccacactta

SEQ ID NO: 443795 - DNA, 25 bp, Mus musculus
gcggctgcacctggacagttcatga

SEQ ID NO: 443796 - DNA, 25 bp, Mus musculus
cgcccgagtcatccactttacgggg

SEQ ID NO: 443797 - DNA, 25 bp, Mus musculus
cgaacacaatgagcgccgcggagcc

SEQ ID NO: 443798 - DNA, 25 bp, Mus musculus
gagcaatccgaacacaatgagcgcc

SEQ ID NO: 443799 - DNA, 25 bp, Mus musculus
cggcagggagagcaatccgaacaca

SEQ ID NO: 443800 - DNA, 25 bp, Mus musculus
gtggccgtcggccagatctccgctg

SEQ ID NO: 443801 - DNA, 25 bp, Mus musculus
tccgggtggccgtcggccagatctc

SEQ ID NO: 443802 - DNA, 25 bp, Mus musculus
agagttgtttgtcctcgtccgggtg

SEQ ID NO: 443803 - DNA, 25 bp, Mus musculus
agcacagagttgtttgtcctcgtcc

SEQ ID NO: 443804 - DNA, 25 bp, Mus musculus
tcagacccaagcacagagttgtttg

SEQ ID NO: 443805 - DNA, 25 bp, Mus musculus
aggcgtcagacccaagcacagagtt

SEQ ID NO: 443806 - DNA, 25 bp, Mus musculus
cgcagagaccttgaggcgtcagacc

SEQ ID NO: 443807 - DNA, 25 bp, Mus musculus
ggaggctcttgacgcgcagagacct

SEQ ID NO: 443808 - DNA, 25 bp, Mus musculus
acctgggaggctcttgacgcgcaga

SEQ ID NO: 443809 - DNA, 25 bp, Mus musculus
agagcagcgctcggcaccgtggacc

SEQ ID NO: 443810 - DNA, 25 bp, Mus musculus
gcagcagagccacgccgaggatcgc

SEQ ID NO: 443811 - DNA, 25 bp, Mus musculus
gatagccaagctgggtacgccgtca

SEQ ID NO: 443812 - DNA, 25 bp, Mus musculus
cgtctgcgccaaggaaactttgagc

SEQ ID NO: 443813 - DNA, 25 bp, Mus musculus
aagcgtctgcgccaaggaaactttg

SEQ ID NO: 443814 - DNA, 25 bp, Mus musculus
ggctacagcccttgcgcccaagcgt

SEQ ID NO: 443815 - DNA, 25 bp, Mus musculus
aggcgtcttggctacagcccttgcg

SEQ ID NO: 443816 - DNA, 25 bp, Mus musculus
accaccaaggcgtcttggctacagc

SEQ ID NO: 443817 - DNA, 25 bp, Mus musculus
agccggggctcctctctgattctcg

SEQ ID NO: 443818 - DNA, 25 bp, Mus musculus
ccaaggaaactttgagcggaggccg

SEQ ID NO: 443819 - DNA, 25 bp, Mus musculus
tacgccgtcaggagccggggctcct

SEQ ID NO: 443820 - DNA, 25 bp, Mus musculus
caggtgctggcagcagagccacgcc

SEQ ID NO: 443821 - DNA, 25 bp, Mus musculus
cccacagatgcgtcggatagccaag

SEQ ID NO: 443822 - DNA, 25 bp, Mus musculus
gatccagttttcttccgtgacccca

SEQ ID NO: 443823 - DNA, 25 bp, Mus musculus
aggagccggggctcctctctgattc

SEQ ID NO: 443824 - DNA, 25 bp, Mus musculus
acagtgctcgcacacatccggcagg

SEQ ID NO: 443825 - DNA, 25 bp, Mus musculus
ttccttggcggtttctgtagatctg

SEQ ID NO: 443826 - DNA, 25 bp, Mus musculus
tgtagatctgatttccgtccgggac

SEQ ID NO: 443827 - DNA, 25 bp, Mus musculus
ggggcttcctccagtttatgctcta

SEQ ID NO: 443828 - DNA, 25 bp, Mus musculus
tatgctctaaccattctcccgcgtg

SEQ ID NO: 443829 - DNA, 25 bp, Mus musculus
cgttaagtgtacgaaggcccgcaga

SEQ ID NO: 443830 - DNA, 25 bp, Mus musculus
tctggcacaacggaactgagggagc

SEQ ID NO: 443831 - DNA, 25 bp, Mus musculus
cggggaaggaagaatcgctgctacc

SEQ ID NO: 443832 - DNA, 25 bp, Mus musculus
ttcatccagcattttcggggaagga

SEQ ID NO: 443833 - DNA, 25 bp, Mus musculus
gcggtgaccagagccttcgttaagt

SEQ ID NO: 443834 - DNA, 25 bp, Mus musculus
ggaaccgcctcaccgatcgctattg

SEQ ID NO: 443835 - DNA, 25 bp, Mus musculus
atcatggtcttcctcacgacgcggc

SEQ ID NO: 443836 - DNA, 25 bp, Mus musculus
gcttcgggagcccatcatggtcttc

SEQ ID NO: 443837 - DNA, 25 bp, Mus musculus
tctgaccgttgacccggaagcgctt

SEQ ID NO: 443838 - DNA, 25 bp, Mus musculus
acactgacggactggtcgtacggcc

SEQ ID NO: 443839 - DNA, 25 bp, Mus musculus
gtgcctgacgcgacactgacggact

SEQ ID NO: 443840 - DNA, 25 bp, Mus musculus
gagccaagtgggtaacgagcagccc

SEQ ID NO: 443841 - DNA, 25 bp, Mus musculus
actaagtcgcggtgtaacgtcgtgc

SEQ ID NO: 443842 - DNA, 25 bp, Mus musculus
gggctgagaactaaagactccgaac

SEQ ID NO: 443843 - DNA, 25 bp, Mus musculus
cttttgccaggcaggagttccggtt

SEQ ID NO: 443844 - DNA, 25 bp, Mus musculus
tcgtacggccaacggcgtcgagaca

SEQ ID NO: 443845 - DNA, 25 bp, Mus musculus
gcggcctcgacgtcgatacggagac

SEQ ID NO: 443846 - DNA, 25 bp, Mus musculus
gcttcacgccgtccatgtcgagcgg

SEQ ID NO: 443847 - DNA, 25 bp, Mus musculus
ttggaaaactgcctgctgcccgacg

SEQ ID NO: 443848 - DNA, 25 bp, Mus musculus
cgggcgtgctcatcaccttggaaaa

SEQ ID NO: 443849 - DNA, 25 bp, Mus musculus
tgctgatcggcgacaggctctactc

SEQ ID NO: 443850 - DNA, 25 bp, Mus musculus
agacagcggtgacgttcagccaatg

SEQ ID NO: 443851 - DNA, 25 bp, Mus musculus
cccgagaagagtcggcggcacaaaa

SEQ ID NO: 443852 - DNA, 25 bp, Mus musculus
gctaaccggcttgggagagacgaaa

SEQ ID NO: 443853 - DNA, 25 bp, Mus musculus
cagtcctacggtccatggcggtacc

SEQ ID NO: 443854 - DNA, 25 bp, Mus musculus
ggacgcggaatccacacctgacttg

SEQ ID NO: 443855 - DNA, 25 bp, Mus musculus
aggactgttgttccctgggcaggta

SEQ ID NO: 443856 - DNA, 25 bp, Mus musculus
ggaccaactgctcaccatgttcctg

SEQ ID NO: 443857 - DNA, 25 bp, Mus musculus
tgttctagctttgagcgctgccgcc

SEQ ID NO: 443858 - DNA, 25 bp, Mus musculus
gacctcagctggttcctgtgttcta

SEQ ID NO: 443859 - DNA, 25 bp, Mus musculus
gaagatgtctccttatcgcgggtca

SEQ ID NO: 443860 - DNA, 25 bp, Mus musculus
gcgctcagagcgacttttgaagatg

SEQ ID NO: 443861 - DNA, 25 bp, Mus musculus
tgatcggtcctaacttccgggattc

SEQ ID NO: 443862 - DNA, 25 bp, Mus musculus
cttcgggcacgcaaggatcgagtta

SEQ ID NO: 443863 - DNA, 25 bp, Mus musculus
tttacccggaacgttgttgctgctg

SEQ ID NO: 443864 - DNA, 25 bp, Mus musculus
tatactgtaaagtccgcgtgcacgc

SEQ ID NO: 443865 - DNA, 25 bp, Mus musculus
gccctaacaggaggagcgccacttg

SEQ ID NO: 443866 - DNA, 25 bp, Mus musculus
tactgccacctcgatgagagcctgg

SEQ ID NO: 443867 - DNA, 25 bp, Mus musculus
cgaccgcctgcttgacctgtatgca

SEQ ID NO: 443868 - DNA, 25 bp, Mus musculus
accgacagctacctggggtgtcaca

SEQ ID NO: 443869 - DNA, 25 bp, Mus musculus
ccgcagccctattaagtcgcgcata

SEQ ID NO: 443870 - DNA, 25 bp, Mus musculus
ttctgctttccacgacggcaacttc

SEQ ID NO: 443871 - DNA, 25 bp, Mus musculus
cagaggatcgtgagtgtgtcccttc

SEQ ID NO: 443872 - DNA, 25 bp, Mus musculus
ctgcgtgatcgcgtgtcagtgaaca

SEQ ID NO: 443873 - DNA, 25 bp, Mus musculus
ggtgacttctccctacgcatcgatg

SEQ ID NO: 443874 - DNA, 25 bp, Mus musculus
ctaagggtatcttctgccaagcagc

SEQ ID NO: 443875 - DNA, 25 bp, Mus musculus
tggcagaaactgaaaccttggcggc

SEQ ID NO: 443876 - DNA, 25 bp, Mus musculus
cggcgccgacttgtggatatgtatt

SEQ ID NO: 443877 - DNA, 25 bp, Mus musculus
accgtagtgggctgaaactttggca

SEQ ID NO: 443878 - DNA, 25 bp, Mus musculus
ctcgctgctcattcgcggtacactg

SEQ ID NO: 443879 - DNA, 25 bp, Mus musculus
ctgcgaggtgatctgactgcctttc

SEQ ID NO: 443880 - DNA, 25 bp, Mus musculus
ctcagcgtggactcaggtaagcgga

SEQ ID NO: 443881 - DNA, 25 bp, Mus musculus
tgggctaagctctgggcgcgcccac

SEQ ID NO: 443882 - DNA, 25 bp, Mus musculus
tggaacagcgcgtaccaggcgcctg

SEQ ID NO: 443883 - DNA, 25 bp, Mus musculus
ggcactgtacccgactctgggctaa

SEQ ID NO: 443884 - DNA, 25 bp, Mus musculus
tgggtctcagcgtggactcaggtaa

SEQ ID NO: 443885 - DNA, 25 bp, Mus musculus
ctccctgcgagcttgcggccaaggg

SEQ ID NO: 443886 - DNA, 25 bp, Mus musculus
agcagtgcacgaggtctacgcgccc

SEQ ID NO: 443887 - DNA, 25 bp, Mus musculus
cctgggagcacaagcctctgcctac

SEQ ID NO: 443888 - DNA, 25 bp, Mus musculus
gcaccatccctatgcgctgggcggc

SEQ ID NO: 443889 - DNA, 25 bp, Mus musculus
ccgccactctgcacggccacctgca

SEQ ID NO: 443890 - DNA, 25 bp, Mus musculus
tcggagctgccctttgccaccgacc

SEQ ID NO: 443891 - DNA, 25 bp, Mus musculus
tgcccgcgccactaggcagtcctct

SEQ ID NO: 443892 - DNA, 25 bp, Mus musculus
tacccgcggccagcagtgcacgagg

SEQ ID NO: 443893 - DNA, 25 bp, Mus musculus
gtacccgactctgggctaagctctg

SEQ ID NO: 443894 - DNA, 25 bp, Mus musculus
ggccggctctaccaggaaagttcgc

SEQ ID NO: 443895 - DNA, 25 bp, Mus musculus
agatttcgttgagctcccaggccct

SEQ ID NO: 443896 - DNA, 25 bp, Mus musculus
tgctccgtgctccagagttcgggct

SEQ ID NO: 443897 - DNA, 25 bp, Mus musculus
cgggctccagagaccgcgtagttct

SEQ ID NO: 443898 - DNA, 25 bp, Mus musculus
cgcgtagttctacctggcgtctgcg

SEQ ID NO: 443899 - DNA, 25 bp, Mus musculus
aggtgtgacccaaggacgctcccag

SEQ ID NO: 443900 - DNA, 25 bp, Mus musculus
gggccagtcgggcaaactgacaacc

SEQ ID NO: 443901 - DNA, 25 bp, Mus musculus
actgacaaccgcgacgaacccgagg

SEQ ID NO: 443902 - DNA, 25 bp, Mus musculus
cccggggactcagttaggaagcttg

SEQ ID NO: 443903 - DNA, 25 bp, Mus musculus
ccgcgccaatctcacggactagaag

SEQ ID NO: 443904 - DNA, 25 bp, Mus musculus
tcacggactagaagcaggggctacc

SEQ ID NO: 443905 - DNA, 25 bp, Mus musculus
ctccgcgggcaagttttcgttgtct

SEQ ID NO: 443906 - DNA, 25 bp, Mus musculus
tcgttgtctcctgatttcctccggc

SEQ ID NO: 443907 - DNA, 25 bp, Mus musculus
acgcgctttcggctttgagagaggt

SEQ ID NO: 443908 - DNA, 25 bp, Mus musculus
tgtgcacgagctggcacctgtccgc

SEQ ID NO: 443909 - DNA, 25 bp, Mus musculus
gccggtgcacgcctacaaattcttc

SEQ ID NO: 443910 - DNA, 25 bp, Mus musculus
ctgcgggcgactagtgacgtcaccg

SEQ ID NO: 443911 - DNA, 25 bp, Mus musculus
gtccatggaccaggacttcgggtca

SEQ ID NO: 443912 - DNA, 25 bp, Mus musculus
gcacgcctacaaattcttcttcaag

SEQ ID NO: 443913 - DNA, 25 bp, Mus musculus
acgtgctcagcaaccggccggtgca

SEQ ID NO: 443914 - DNA, 25 bp, Mus musculus
ggccgacttcaagaacgtgctcagc

SEQ ID NO: 443915 - DNA, 25 bp, Mus musculus
agcgcgtcacgctggccgacttcaa

SEQ ID NO: 443916 - DNA, 25 bp, Mus musculus
tacctggtcaagctgcccgtagctc

SEQ ID NO: 443917 - DNA, 25 bp, Mus musculus
atcatctaccacatggacgaggagg

SEQ ID NO: 443918 - DNA, 25 bp, Mus musculus
tggcggagaccaaaatcatctacca

SEQ ID NO: 443919 - DNA, 25 bp, Mus musculus
cgcgccatggcggagaccaaaatca

SEQ ID NO: 443920 - DNA, 25 bp, Mus musculus
cccagcaggcggttcgtgaacagcc

SEQ ID NO: 443921 - DNA, 25 bp, Mus musculus
ttcttcttcaagtccatggaccagg

SEQ ID NO: 443922 - DNA, 25 bp, Mus musculus
ggatgggtcccttcatctccgtagc

SEQ ID NO: 443923 - DNA, 25 bp, Mus musculus
gcgactttccgctcctgcatttgga

SEQ ID NO: 443924 - DNA, 25 bp, Mus musculus
ctgccgcctggttcacgtcaggtaa

SEQ ID NO: 443925 - DNA, 25 bp, Mus musculus
tcggagcctgcggttgagcagaaac

SEQ ID NO: 443926 - DNA, 25 bp, Mus musculus
ccatcccaattggttgctgatcatc

SEQ ID NO: 443927 - DNA, 25 bp, Mus musculus
gaactcgacatatccgcctgcgttt

SEQ ID NO: 443928 - DNA, 25 bp, Mus musculus
accatgcccgagattagggtcactc

SEQ ID NO: 443929 - DNA, 25 bp, Mus musculus
gtgagtccgagtcctaagcatcttc

SEQ ID NO: 443930 - DNA, 25 bp, Mus musculus
tctccgtagccgtttgatcatctgc

SEQ ID NO: 443931 - DNA, 25 bp, Mus musculus
ttcctggtcctagagctcgatatga

SEQ ID NO: 443932 - DNA, 25 bp, Mus musculus
tgtacctgggctgcttacgatggtc

SEQ ID NO: 443933 - DNA, 25 bp, Mus musculus
tgaggtgaaatgagcctcgcctgtc

SEQ ID NO: 443934 - DNA, 25 bp, Mus musculus
tggtgttgaatccagcacagaaatc

SEQ ID NO: 443935 - DNA, 25 bp, Mus musculus
tcgacgagatgtgggtttgattcct

SEQ ID NO: 443936 - DNA, 25 bp, Mus musculus
tgcagcggcgcttttagcgacgctc

SEQ ID NO: 443937 - DNA, 25 bp, Mus musculus
gaaggaattatctgcggtgtctgtg

SEQ ID NO: 443938 - DNA, 25 bp, Mus musculus
agccgagttcaccaccgccgtgatg

SEQ ID NO: 443939 - DNA, 25 bp, Mus musculus
tgtccgtcggcagcattccagccga

SEQ ID NO: 443940 - DNA, 25 bp, Mus musculus
gcgaccttaattcgttcactcccga

SEQ ID NO: 443941 - DNA, 25 bp, Mus musculus
gatgatgggtcgcttccgcacaagc

SEQ ID NO: 443942 - DNA, 25 bp, Mus musculus
gctatgtttcctgtcctcggcctca

SEQ ID NO: 443943 - DNA, 25 bp, Mus musculus
cggtcctctagagccggctatgttt

SEQ ID NO: 443944 - DNA, 25 bp, Mus musculus
ccaagcttagggatcgggtgcaaag

SEQ ID NO: 443945 - DNA, 25 bp, Mus musculus
cccgcaggagcccatatttgagcgg

SEQ ID NO: 443946 - DNA, 25 bp, Mus musculus
caagaacacaaggtagcgcgcacgc

SEQ ID NO: 443947 - DNA, 25 bp, Mus musculus
cttgaagtcagtgcccaagtactgc

SEQ ID NO: 443948 - DNA, 25 bp, Mus musculus
cagcgggaaaacgtacttgaagtca

SEQ ID NO: 443949 - DNA, 25 bp, Mus musculus
ccactgtgttcctcggctcctaaaa

SEQ ID NO: 443950 - DNA, 25 bp, Mus musculus
gggtaatgcaacaaaaccttgggca

SEQ ID NO: 443951 - DNA, 25 bp, Mus musculus
cccactcttccgcaccctgctctgg

SEQ ID NO: 443952 - DNA, 25 bp, Mus musculus
tggcctcgaccacggcgaacctgaa

SEQ ID NO: 443953 - DNA, 25 bp, Mus musculus
tcgaccacggcgaacctgaacgcgg

SEQ ID NO: 443954 - DNA, 25 bp, Mus musculus
cccgttggttacgtcgccggctgtg

SEQ ID NO: 443955 - DNA, 25 bp, Mus musculus
cggattctctcacggacgctcggaa

SEQ ID NO: 443956 - DNA, 25 bp, Mus musculus
ctcacggacgctcggaagactccga

SEQ ID NO: 443957 - DNA, 25 bp, Mus musculus
aagactccgaggaggagccaggttt

SEQ ID NO: 443958 - DNA, 25 bp, Mus musculus
gaggagccaggtttgatctttaaaa

SEQ ID NO: 443959 - DNA, 25 bp, Mus musculus
aacgtatcccgtgagtttgttgtgg

SEQ ID NO: 443960 - DNA, 25 bp, Mus musculus
cctttcatcgcgatcagttagaacc

SEQ ID NO: 443961 - DNA, 25 bp, Mus musculus
ccaggctgcttaatagaccccaaca

SEQ ID NO: 443962 - DNA, 25 bp, Mus musculus
acgcccttgagggtaatgcaacaaa

SEQ ID NO: 443963 - DNA, 25 bp, Mus musculus
agcgtgtccgcggttacgcccttga

SEQ ID NO: 443964 - DNA, 25 bp, Mus musculus
gctcctctggctacagactgcagga

SEQ ID NO: 443965 - DNA, 25 bp, Mus musculus
ctcaagaagtctcggcagctgtttg

SEQ ID NO: 443966 - DNA, 25 bp, Mus musculus
cgcggagactgagccatgtgggcct

SEQ ID NO: 443967 - DNA, 25 bp, Mus musculus
caccgagcaggaggataggtcgaca

SEQ ID NO: 443968 - DNA, 25 bp, Mus musculus
agtctcggcagctgtttgcgcgtgt

SEQ ID NO: 443969 - DNA, 25 bp, Mus musculus
cccggcaggagctcaagaagtctcg

SEQ ID NO: 443970 - DNA, 25 bp, Mus musculus
tctggctacagactgcaggagccgg

SEQ ID NO: 443971 - DNA, 25 bp, Mus musculus
gctgcagcgctcctctggctacaga

SEQ ID NO: 443972 - DNA, 25 bp, Mus musculus
tgcagacatgcaccagcggctgctg

SEQ ID NO: 443973 - DNA, 25 bp, Mus musculus
ttctggctcctcctgcagacatgca

SEQ ID NO: 443974 - DNA, 25 bp, Mus musculus
ggagttctggctcctcctgcagaca

SEQ ID NO: 443975 - DNA, 25 bp, Mus musculus
cgacagagacgaggagttctggctc

SEQ ID NO: 443976 - DNA, 25 bp, Mus musculus
ataggtcgacagagacgaggagttc

SEQ ID NO: 443977 - DNA, 25 bp, Mus musculus
gcgcgtgtggattcccccaatatta

SEQ ID NO: 443978 - DNA, 25 bp, Mus musculus
tccagccaggtcagcatggccagga

SEQ ID NO: 443979 - DNA, 25 bp, Mus musculus
ttcgcagaggctgcttccgcccata

SEQ ID NO: 443980 - DNA, 25 bp, Mus musculus
ccgcgcgccattcctattggttgct

SEQ ID NO: 443981 - DNA, 25 bp, Mus musculus
ctgggcccagaatgattgacacgtg

SEQ ID NO: 443982 - DNA, 25 bp, Mus musculus
gagctgatatccagggcggctttga

SEQ ID NO: 443983 - DNA, 25 bp, Mus musculus
ccaagcgcgccggaataccttcatg

SEQ ID NO: 443984 - DNA, 25 bp, Mus musculus
tacaacagagtggtgccgcagaacg

SEQ ID NO: 443985 - DNA, 25 bp, Mus musculus
cgcagcgcgccaggtacaacagagt

SEQ ID NO: 443986 - DNA, 25 bp, Mus musculus
cagccacgtgctgcgcactgcggtg

SEQ ID NO: 443987 - DNA, 25 bp, Mus musculus
taagccgccagtgcccacggcgaag

SEQ ID NO: 443988 - DNA, 25 bp, Mus musculus
ttcctattggttgcttcgcagaggc

SEQ ID NO: 443989 - DNA, 25 bp, Mus musculus
gaccttggccgtgaggttctcgtag

SEQ ID NO: 443990 - DNA, 25 bp, Mus musculus
acgaactcgaagtccacgcgctcat

SEQ ID NO: 443991 - DNA, 25 bp, Mus musculus
tgctcgagctcaagagcgcgccgct

SEQ ID NO: 443992 - DNA, 25 bp, Mus musculus
cccatctgccaagatcggaaggttc

SEQ ID NO: 443993 - DNA, 25 bp, Mus musculus
ggcgcacccggactagactgcaagc

SEQ ID NO: 443994 - DNA, 25 bp, Mus musculus
gactgcaagcttcagccatcgcttg

SEQ ID NO: 443995 - DNA, 25 bp, Mus musculus
ccatcgcttgcagcttctagaggga

SEQ ID NO: 443996 - DNA, 25 bp, Mus musculus
tcggcctgggacattgctagcaccc

SEQ ID NO: 443997 - DNA, 25 bp, Mus musculus
agcacccgcctgtgtgctccgggaa

SEQ ID NO: 443998 - DNA, 25 bp, Mus musculus
aaggaacgattgtgcccggcagatt

SEQ ID NO: 443999 - DNA, 25 bp, Mus musculus
actgcactgtgagcggtgagtacca

SEQ ID NO: 444000 - DNA, 25 bp, Mus musculus
tccgtgcaggcctttcccacgggtg

SEQ ID NO: 444001 - DNA, 25 bp, Mus musculus
tcccacgggtgcagacccgaggaca

SEQ ID NO: 444002 - DNA, 25 bp, Mus musculus
ctctggactgggagtggctctactc

SEQ ID NO: 444003 - DNA, 25 bp, Mus musculus
gtgtcattgtgccaggcccagccca

SEQ ID NO: 444004 - DNA, 25 bp, Mus musculus
cccacgggatagaaaggaacgattg

SEQ ID NO: 444005 - DNA, 25 bp, Mus musculus
gtgtgctccgggaactgcactgtga

SEQ ID NO: 444006 - DNA, 25 bp, Mus musculus
cggctgctaggagcctcgatggctc

SEQ ID NO: 444007 - DNA, 25 bp, Mus musculus
aaagcgcagaggatgcggcttcaca

SEQ ID NO: 444008 - DNA, 25 bp, Mus musculus
gtgcaccaggccgttctgagatagc

SEQ ID NO: 444009 - DNA, 25 bp, Mus musculus
gagggcatcgacttgcgtgcaccag

SEQ ID NO: 444010 - DNA, 25 bp, Mus musculus
gctcgagtcagacagccgcgatttg

SEQ ID NO: 444011 - DNA, 25 bp, Mus musculus
cgctatggagctaccgctcgagtca

SEQ ID NO: 444012 - DNA, 25 bp, Mus musculus
agagggctcagactccgctatggag

SEQ ID NO: 444013 - DNA, 25 bp, Mus musculus
ggacccagaacagagagagggctca

SEQ ID NO: 444014 - DNA, 25 bp, Mus musculus
ctcgatggctcgtacttctctgttc

SEQ ID NO: 444015 - DNA, 25 bp, Mus musculus
agtagcttttataggtcccggagag

SEQ ID NO: 444016 - DNA, 25 bp, Mus musculus
tgcgtttgtcacaaagtagctttta

SEQ ID NO: 444017 - DNA, 25 bp, Mus musculus
gcttctagaggttgcgtttgtcaca

SEQ ID NO: 444018 - DNA, 25 bp, Mus musculus
cgcccagacgggacgggcttctaga

SEQ ID NO: 444019 - DNA, 25 bp, Mus musculus
tgctgccttccagggacccagaaca

SEQ ID NO: 444020 - DNA, 25 bp, Mus musculus
ggtctcctggcccaagcaggctctt

SEQ ID NO: 444021 - DNA, 25 bp, Mus musculus
actgtgcgtttctagtcggtctcct

SEQ ID NO: 444022 - DNA, 25 bp, Mus musculus
gtcccggcctgggactgtgcgtttc

SEQ ID NO: 444023 - DNA, 25 bp, Mus musculus
ctcttaactgatgcgcacagggcgg

SEQ ID NO: 444024 - DNA, 25 bp, Mus musculus
ctgcgcccagctcttaactgatgcg

SEQ ID NO: 444025 - DNA, 25 bp, Mus musculus
cccgccgctgaattggggacacgag

SEQ ID NO: 444026 - DNA, 25 bp, Mus musculus
actgtccgctgccaaccaggagctg

SEQ ID NO: 444027 - DNA, 25 bp, Mus musculus
ctcgaactcagaagggacggaagga

SEQ ID NO: 444028 - DNA, 25 bp, Mus musculus
tgtgacgatggctcccagccaactc

SEQ ID NO: 444029 - DNA, 25 bp, Mus musculus
tctggtttcctcctgtgacgatggc

SEQ ID NO: 444030 - DNA, 25 bp, Mus musculus
cgcacctggcgtttctggtttcctc

SEQ ID NO: 444031 - DNA, 25 bp, Mus musculus
aagacctgtgcacccgggaggacgc

SEQ ID NO: 444032 - DNA, 25 bp, Mus musculus
cggcgcgctctgaagacctgtgcac

SEQ ID NO: 444033 - DNA, 25 bp, Mus musculus
caccggccaggagaccgcaggagac

SEQ ID NO: 444034 - DNA, 25 bp, Mus musculus
catcttgtcagtgaggaggcggtac

SEQ ID NO: 444035 - DNA, 25 bp, Mus musculus
cgctgcctgccatcttgtcagtgag

SEQ ID NO: 444036 - DNA, 25 bp, Mus musculus
acggaatcctgggtaaacgcacttg

SEQ ID NO: 444037 - DNA, 25 bp, Mus musculus
cgggtagcgcagactctgggactct

SEQ ID NO: 444038 - DNA, 25 bp, Mus musculus
gggcgggccagagactacaaatccc

SEQ ID NO: 444039 - DNA, 25 bp, Mus musculus
tgggaacgcaaacccgctgccagga

SEQ ID NO: 444040 - DNA, 25 bp, Mus musculus
gctcttcttgaggactttgccgtga

SEQ ID NO: 444041 - DNA, 25 bp, Mus musculus
ggactttgccgtgagagccactata

SEQ ID NO: 444042 - DNA, 25 bp, Mus musculus
agagccactatatcagcgagttaca

SEQ ID NO: 444043 - DNA, 25 bp, Mus musculus
gcgagttacacatcctcccgcgttt

SEQ ID NO: 444044 - DNA, 25 bp, Mus musculus
ctctgagactaatgcagggcctagc

SEQ ID NO: 444045 - DNA, 25 bp, Mus musculus
tacaaatcccagagacgctcgcggg

SEQ ID NO: 444046 - DNA, 25 bp, Mus musculus
cggctgcagcgacgccgtaaaggcc

SEQ ID NO: 444047 - DNA, 25 bp, Mus musculus
tcctcccgcgggatgtgctcttctt

SEQ ID NO: 444048 - DNA, 25 bp, Mus musculus
tctccagcaagcaaggaacggaaga

SEQ ID NO: 444049 - DNA, 25 bp, Mus musculus
gggcagctcgaaggcccgatgtcct

SEQ ID NO: 444050 - DNA, 25 bp, Mus musculus
tcctccgtggagctggaacaagtgt

SEQ ID NO: 444051 - DNA, 25 bp, Mus musculus
tggaagcgaggtctggaatacaata

SEQ ID NO: 444052 - DNA, 25 bp, Mus musculus
gaatacaatacaaaagagtccgtgg

SEQ ID NO: 444053 - DNA, 25 bp, Mus musculus
cggcggagtgctctctctccagcaa

SEQ ID NO: 444054 - DNA, 25 bp, Mus musculus
acggaagagagttgccggaagttct

SEQ ID NO: 444055 - DNA, 25 bp, Mus musculus
ccggaagttctctccttggccaatc

SEQ ID NO: 444056 - DNA, 25 bp, Mus musculus
ttggccaatccgaacgagcaatagg

SEQ ID NO: 444057 - DNA, 25 bp, Mus musculus
agcaataggcgggtctcatgtcaca

SEQ ID NO: 444058 - DNA, 25 bp, Mus musculus
gtctcatgtcacacttcagccaatg

SEQ ID NO: 444059 - DNA, 25 bp, Mus musculus
cagccaatgagcatggagtcccgtc

SEQ ID NO: 444060 - DNA, 25 bp, Mus musculus
gcaaagcagtgacctcgggcgctct

SEQ ID NO: 444061 - DNA, 25 bp, Mus musculus
gagtccgtggagattcgacccaaca

SEQ ID NO: 444062 - DNA, 25 bp, Mus musculus
aatgtagcccgcgttcccgctggaa

SEQ ID NO: 444063 - DNA, 25 bp, Mus musculus
ggatacctcccacgtgagcctgaga

SEQ ID NO: 444064 - DNA, 25 bp, Mus musculus
gctgctgcggcgaggatacctccca

SEQ ID NO: 444065 - DNA, 25 bp, Mus musculus
tcaccgcagcatcctcgcgtgggga

SEQ ID NO: 444066 - DNA, 25 bp, Mus musculus
tgaacgccatggaggcccagggctc

SEQ ID NO: 444067 - DNA, 25 bp, Mus musculus
gcctcttccgggtgaacgccatgga

SEQ ID NO: 444068 - DNA, 25 bp, Mus musculus
ctccttggagtagagctgcagctgc

SEQ ID NO: 444069 - DNA, 25 bp, Mus musculus
cgcgcacctctccttggagtagagc

SEQ ID NO: 444070 - DNA, 25 bp, Mus musculus
aacagcctcccatgcagggcgcgga

SEQ ID NO: 444071 - DNA, 25 bp, Mus musculus
agggaggccggagctctacccacgt

SEQ ID NO: 444072 - DNA, 25 bp, Mus musculus
ccacggggcggaagtgcgctttcct

SEQ ID NO: 444073 - DNA, 25 bp, Mus musculus
acagctgggtcacaaaaccaaccgc

SEQ ID NO: 444074 - DNA, 25 bp, Mus musculus
ttcccgctggaaccacagctgggtc

SEQ ID NO: 444075 - DNA, 25 bp, Mus musculus
tgagcctgagacctgcccgggagcc

SEQ ID NO: 444076 - DNA, 25 bp, Mus musculus
ccctatgacgtagaacgttcatcac

SEQ ID NO: 444077 - DNA, 25 bp, Mus musculus
aaaccgctgccgcacgcaggaggcg

SEQ ID NO: 444078 - DNA, 25 bp, Mus musculus
ctcacctccgaggacgcggtggcag

SEQ ID NO: 444079 - DNA, 25 bp, Mus musculus
aaccgctgggccgttggaagccagc

SEQ ID NO: 444080 - DNA, 25 bp, Mus musculus
tgggccgttggaagccagctcccgc

SEQ ID NO: 444081 - DNA, 25 bp, Mus musculus
cgccggctcagtaagctcggccggt

SEQ ID NO: 444082 - DNA, 25 bp, Mus musculus
caggatccgcgaaggcgtacccggc

SEQ ID NO: 444083 - DNA, 25 bp, Mus musculus
atccgcgaaggcgtacccggcggct

SEQ ID NO: 444084 - DNA, 25 bp, Mus musculus
ggcgcttcaccctcctcgcgagaca

SEQ ID NO: 444085 - DNA, 25 bp, Mus musculus
gtagaacgttcatcacccacaggca

SEQ ID NO: 444086 - DNA, 25 bp, Mus musculus
cacccacaggcagtttggaggcgga

SEQ ID NO: 444087 - DNA, 25 bp, Mus musculus
cccgagcccgcgcagcaaaacaccg

SEQ ID NO: 444088 - DNA, 25 bp, Mus musculus
acgttcatcacccacaggcagtttg

SEQ ID NO: 444089 - DNA, 25 bp, Mus musculus
tctgggcgcatgcgccaaaccgctg

SEQ ID NO: 444090 - DNA, 25 bp, Mus musculus
aggacacgcttttccgcctctgacg

SEQ ID NO: 444091 - DNA, 25 bp, Mus musculus
cctggactggacttactccctggta

SEQ ID NO: 444092 - DNA, 25 bp, Mus musculus
gcccggatcacgtgatgtgttccaa

SEQ ID NO: 444093 - DNA, 25 bp, Mus musculus
gtcccgctgaaaaatggctgctgca

SEQ ID NO: 444094 - DNA, 25 bp, Mus musculus
aaatggctgctgcatcggggtgcaa

SEQ ID NO: 444095 - DNA, 25 bp, Mus musculus
tcccttaccatgaggccgatgagtc

SEQ ID NO: 444096 - DNA, 25 bp, Mus musculus
atgagtcgccgaagcctggactgga

SEQ ID NO: 444097 - DNA, 25 bp, Mus musculus
ctccctggtaggtaccgagcagagc

SEQ ID NO: 444098 - DNA, 25 bp, Mus musculus
cggagctccagagcgcaccatggca

SEQ ID NO: 444099 - DNA, 25 bp, Mus musculus
gccgaaggtagactgttggctcgca

SEQ ID NO: 444100 - DNA, 25 bp, Mus musculus
ttggctcgcagcttggaactccaga

SEQ ID NO: 444101 - DNA, 25 bp, Mus musculus
tccagaacccattcctaaattgagc

SEQ ID NO: 444102 - DNA, 25 bp, Mus musculus
taaattgagcgttcacgccctgccc

SEQ ID NO: 444103 - DNA, 25 bp, Mus musculus
cctcttcctggaggacacgcttttc

SEQ ID NO: 444104 - DNA, 25 bp, Mus musculus
catccggcgtgtaccctgacatgtt

SEQ ID NO: 444105 - DNA, 25 bp, Mus musculus
ggaacccggacacccgtgtggctca

SEQ ID NO: 444106 - DNA, 25 bp, Mus musculus
ggacacccgtgtggctcatcactca

SEQ ID NO: 444107 - DNA, 25 bp, Mus musculus
tcccgcaaaaagttatcccagaatc

SEQ ID NO: 444108 - DNA, 25 bp, Mus musculus
agaatcgctccaggggccacatcct

SEQ ID NO: 444109 - DNA, 25 bp, Mus musculus
gcaacacgggctcccggggactcag

SEQ ID NO: 444110 - DNA, 25 bp, Mus musculus
gccgcagcttctcatccggcgtgta

SEQ ID NO: 444111 - DNA, 25 bp, Mus musculus
ccctgacatgttgccgacgagccta

SEQ ID NO: 444112 - DNA, 25 bp, Mus musculus
ttgccgacgagcctacacaggaccg

SEQ ID NO: 444113 - DNA, 25 bp, Mus musculus
tacacaggaccggtcactgacctgc

SEQ ID NO: 444114 - DNA, 25 bp, Mus musculus
tccgcaaagcgaccttgaggcgcct

SEQ ID NO: 444115 - DNA, 25 bp, Mus musculus
aagcgaccttgaggcgcctggaagc

SEQ ID NO: 444116 - DNA, 25 bp, Mus musculus
cggcgcggagtgatgacgccacacc

SEQ ID NO: 444117 - DNA, 25 bp, Mus musculus
ggtccttcagccatcgtctccttag

SEQ ID NO: 444118 - DNA, 25 bp, Mus musculus
ccgcttctagagctctggctaccta

SEQ ID NO: 444119 - DNA, 25 bp, Mus musculus
cggtttatggcagccgcacggacac

SEQ ID NO: 444120 - DNA, 25 bp, Mus musculus
gacaccggtccaagccacccgcctg

SEQ ID NO: 444121 - DNA, 25 bp, Mus musculus
cccgcgcgtccatctctgttcccag

SEQ ID NO: 444122 - DNA, 25 bp, Mus musculus
atctctgttcccagcgcggtgcaag

SEQ ID NO: 444123 - DNA, 25 bp, Mus musculus
tcccagcgcggtgcaagtgatgtaa

SEQ ID NO: 444124 - DNA, 25 bp, Mus musculus
caagtgatgtaaggcggccaggctc

SEQ ID NO: 444125 - DNA, 25 bp, Mus musculus
ggcggccaggctcgcgcgctttcct

SEQ ID NO: 444126 - DNA, 25 bp, Mus musculus
cgctttcctcctgcccggacggagt

SEQ ID NO: 444127 - DNA, 25 bp, Mus musculus
gccgcgcgcccactccgatccgctg

SEQ ID NO: 444128 - DNA, 25 bp, Mus musculus
actccgatccgctgcgcccaggctc

SEQ ID NO: 444129 - DNA, 25 bp, Mus musculus
ccaggctccgcttctagagctctgg

SEQ ID NO: 444130 - DNA, 25 bp, Mus musculus
cttctagagctctggctacctactc

SEQ ID NO: 444131 - DNA, 25 bp, Mus musculus
ggctccgcttctagagctctggcta

SEQ ID NO: 444132 - DNA, 25 bp, Mus musculus
ctccgagttagcagcccgggccaaa

SEQ ID NO: 444133 - DNA, 25 bp, Mus musculus
agaacagtggcgctagccgctagtt

SEQ ID NO: 444134 - DNA, 25 bp, Mus musculus
cgcccgatacccaggtagaacagtg

SEQ ID NO: 444135 - DNA, 25 bp, Mus musculus
gctggaacgttttctcgcccgatac

SEQ ID NO: 444136 - DNA, 25 bp, Mus musculus
atcttttcgagaattggctggaacg

SEQ ID NO: 444137 - DNA, 25 bp, Mus musculus
ccggtgatgattccagtatcttttc

SEQ ID NO: 444138 - DNA, 25 bp, Mus musculus
gctgcctagcaaccggtgatgattc

SEQ ID NO: 444139 - DNA, 25 bp, Mus musculus
atgacgtcacaaacggctgcctagc

SEQ ID NO: 444140 - DNA, 25 bp, Mus musculus
tccggtgctgagagatgacgtcaca

SEQ ID NO: 444141 - DNA, 25 bp, Mus musculus
gtggacacccacaaacttcacgctg

SEQ ID NO: 444142 - DNA, 25 bp, Mus musculus
ttaacttacctcgactgtggacacc

SEQ ID NO: 444143 - DNA, 25 bp, Mus musculus
cgaaggcaggcggaccattaactta

SEQ ID NO: 444144 - DNA, 25 bp, Mus musculus
aacccagcaaactacgaaggcaggc

SEQ ID NO: 444145 - DNA, 25 bp, Mus musculus
gaggatagctcctttgctcgcagcc

SEQ ID NO: 444146 - DNA, 25 bp, Mus musculus
cttcggaaggctgccgggaatgccc

SEQ ID NO: 444147 - DNA, 25 bp, Mus musculus
aggtccaaggcccaagccaattggc

SEQ ID NO: 444148 - DNA, 25 bp, Mus musculus
gcttacgggctctgggacatgacct

SEQ ID NO: 444149 - DNA, 25 bp, Mus musculus
gcggaactttccagaacgctcggtg

SEQ ID NO: 444150 - DNA, 25 bp, Mus musculus
aacccagagggcgagccagcttcca

SEQ ID NO: 444151 - DNA, 25 bp, Mus musculus
cctctctttgttgaggttcgacctc

SEQ ID NO: 444152 - DNA, 25 bp, Mus musculus
actgcgggttccttgagccggcctc

SEQ ID NO: 444153 - DNA, 25 bp, Mus musculus
ctcggctacaaaagaggtcggctgc

SEQ ID NO: 444154 - DNA, 25 bp, Mus musculus
gacgcgccggggctcggctacaaaa

SEQ ID NO: 444155 - DNA, 25 bp, Mus musculus
ctagaaaattctacgaggctcggga

SEQ ID NO: 444156 - DNA, 25 bp, Mus musculus
cgcactctggttcctcgcaataaga

SEQ ID NO: 444157 - DNA, 25 bp, Mus musculus
acctcaagacttccgcactctggtt

SEQ ID NO: 444158 - DNA, 25 bp, Mus musculus
gggacatgacctctccacctcaaga

SEQ ID NO: 444159 - DNA, 25 bp, Mus musculus
ctccgccttttcgatcagggtggga

SEQ ID NO: 444160 - DNA, 25 bp, Mus musculus
acgaatgcccatcggtttcgcgaac

SEQ ID NO: 444161 - DNA, 25 bp, Mus musculus
tcactcggaagactcgatttcgatc

SEQ ID NO: 444162 - DNA, 25 bp, Mus musculus
gaggaaaccacagtagtcaggtcta

SEQ ID NO: 444163 - DNA, 25 bp, Mus musculus
agagggagccaacccggaaagtgct

SEQ ID NO: 444164 - DNA, 25 bp, Mus musculus
ccggaaagtgcttcgaggccgcaac

SEQ ID NO: 444165 - DNA, 25 bp, Mus musculus
acgccacggcaggactcactcggaa

SEQ ID NO: 444166 - DNA, 25 bp, Mus musculus
atttcgatcgacatagcggtaacgc

SEQ ID NO: 444167 - DNA, 25 bp, Mus musculus
atagcggtaacgctccgggtccagg

SEQ ID NO: 444168 - DNA, 25 bp, Mus musculus
gacacttccgctccgttagggtcta

SEQ ID NO: 444169 - DNA, 25 bp, Mus musculus
tctaaagggcgaaggaagaacacgc

SEQ ID NO: 444170 - DNA, 25 bp, Mus musculus
tggcaggactacgaatgcccatcgg

SEQ ID NO: 444171 - DNA, 25 bp, Mus musculus
cggtgtggctagcagaggaaaccac

SEQ ID NO: 444172 - DNA, 25 bp, Mus musculus
cctcgcgaaagcgtggcaggactac

SEQ ID NO: 444173 - DNA, 25 bp, Mus musculus
tctcgcgggcccatctaaagaggga

SEQ ID NO: 444174 - DNA, 25 bp, Mus musculus
cctgacgtacccagtgactcgggta

SEQ ID NO: 444175 - DNA, 25 bp, Mus musculus
gccgcaaagcgggtctttttcgaga

SEQ ID NO: 444176 - DNA, 25 bp, Mus musculus
ccgccctgcagtgtagaggagactc

SEQ ID NO: 444177 - DNA, 25 bp, Mus musculus
tcgcggccagagaggtaatagacga

SEQ ID NO: 444178 - DNA, 25 bp, Mus musculus
tgccgcccaggaactgctcacgaaa

SEQ ID NO: 444179 - DNA, 25 bp, Mus musculus
gctacccgaccacagcgatcgaagg

SEQ ID NO: 444180 - DNA, 25 bp, Mus musculus
ctttggagagatcagcgggaaccac

SEQ ID NO: 444181 - DNA, 25 bp, Mus musculus
tcagccgggtttttctggcagctaa

SEQ ID NO: 444182 - DNA, 25 bp, Mus musculus
cacttggggactaaacgtggcgctc

SEQ ID NO: 444183 - DNA, 25 bp, Mus musculus
gcggcgctcagcttttcttcctagc

SEQ ID NO: 444184 - DNA, 25 bp, Mus musculus
ttcctagcgttcaccgtggagctta

SEQ ID NO: 444185 - DNA, 25 bp, Mus musculus
cgtggagcttaagtctctctaaacc

SEQ ID NO: 444186 - DNA, 25 bp, Mus musculus
gagctgctcaccacttcctgacgta

SEQ ID NO: 444187 - DNA, 25 bp, Mus musculus
agcttcttgttcaacgagctgctca

SEQ ID NO: 444188 - DNA, 25 bp, Mus musculus
aggctccgccacctagcttgacgga

SEQ ID NO: 444189 - DNA, 25 bp, Mus musculus
ctagcttgacggactgcattgggac

SEQ ID NO: 444190 - DNA, 25 bp, Mus musculus
tgaaccgattcttcggaaaagcgaa

SEQ ID NO: 444191 - DNA, 25 bp, Mus musculus
cgcagccggccaagatgaaccgatt

SEQ ID NO: 444192 - DNA, 25 bp, Mus musculus
cctccagtgtttgggtttcctcgca

SEQ ID NO: 444193 - DNA, 25 bp, Mus musculus
agcgactacgcttccgtttctggtt

SEQ ID NO: 444194 - DNA, 25 bp, Mus musculus
ccggaaattgacaccagagcgacta

SEQ ID NO: 444195 - DNA, 25 bp, Mus musculus
agactcgggcgagcactctgcgcct

SEQ ID NO: 444196 - DNA, 25 bp, Mus musculus
ccgcgctccttctccggaaggagga

SEQ ID NO: 444197 - DNA, 25 bp, Mus musculus
ttgttcacagcgcagcggtggctac

SEQ ID NO: 444198 - DNA, 25 bp, Mus musculus
ccaggccgcgtttgttcacagcgca

SEQ ID NO: 444199 - DNA, 25 bp, Mus musculus
ctgcactgcgcacagaggaacgctg

SEQ ID NO: 444200 - DNA, 25 bp, Mus musculus
gactttcttcttcacccgcggcttg

SEQ ID NO: 444201 - DNA, 25 bp, Mus musculus
ggcatttgactttgcatacctctga

SEQ ID NO: 444202 - DNA, 25 bp, Mus musculus
gagcctcgctcacactcaagcagta

SEQ ID NO: 444203 - DNA, 25 bp, Mus musculus
ccctactcatggtgtctggagtggg

SEQ ID NO: 444204 - DNA, 25 bp, Mus musculus
tctggagtgggattcgctcaagttc

SEQ ID NO: 444205 - DNA, 25 bp, Mus musculus
cgctcaagttctctgtgtggcacaa

SEQ ID NO: 444206 - DNA, 25 bp, Mus musculus
gtggcacaacaacacacagacggtg

SEQ ID NO: 444207 - DNA, 25 bp, Mus musculus
cactcaagcagtatcctgaggcata

SEQ ID NO: 444208 - DNA, 25 bp, Mus musculus
agacggtgctacacggatcctacca

SEQ ID NO: 444209 - DNA, 25 bp, Mus musculus
cgctggacttcaggactggctgcct

SEQ ID NO: 444210 - DNA, 25 bp, Mus musculus
aacatcgtctacctgctgggccgca

SEQ ID NO: 444211 - DNA, 25 bp, Mus musculus
aggactggctgcctgtccttctaca

SEQ ID NO: 444212 - DNA, 25 bp, Mus musculus
tccttctacagcgtggcgggcgacg

SEQ ID NO: 444213 - DNA, 25 bp, Mus musculus
ggcgggcgacgtgaacctcctctac

SEQ ID NO: 444214 - DNA, 25 bp, Mus musculus
tcatggtcagcagtggagcctcgct

SEQ ID NO: 444215 - DNA, 25 bp, Mus musculus
atcctgaggcataggtagcgcccgc

SEQ ID NO: 444216 - DNA, 25 bp, Mus musculus
tctagcagtctagtccgaagggtgc

SEQ ID NO: 444217 - DNA, 25 bp, Mus musculus
ggcggatggcaggacttgacaaaaa

SEQ ID NO: 444218 - DNA, 25 bp, Mus musculus
aaaggcgtagcagctggagaaccca

SEQ ID NO: 444219 - DNA, 25 bp, Mus musculus
cccagcagctctcgaaaagcaatta

SEQ ID NO: 444220 - DNA, 25 bp, Mus musculus
ccggcgcatttgtctgacgtcccaa

SEQ ID NO: 444221 - DNA, 25 bp, Mus musculus
gtctgacgtcccaaatgcgccattt

SEQ ID NO: 444222 - DNA, 25 bp, Mus musculus
cgccatttcactgtgtgctcaggta

SEQ ID NO: 444223 - DNA, 25 bp, Mus musculus
gcgtaggagcgactagtctctcggc

SEQ ID NO: 444224 - DNA, 25 bp, Mus musculus
ctctcggcgccggaaatccgggaca

SEQ ID NO: 444225 - DNA, 25 bp, Mus musculus
ctccggtctcaggtactgtcccgtt

SEQ ID NO: 444226 - DNA, 25 bp, Mus musculus
tcctccatcttccacgggatgggga

SEQ ID NO: 444227 - DNA, 25 bp, Mus musculus
gccgcctcttagctgaaggtcattt

SEQ ID NO: 444228 - DNA, 25 bp, Mus musculus
gccagcgagtttgcgcgctgtgcta

SEQ ID NO: 444229 - DNA, 25 bp, Mus musculus
cacgtgaccaggtgacagccttcgc

SEQ ID NO: 444230 - DNA, 25 bp, Mus musculus
ttttctccacgttagaggcctggga

SEQ ID NO: 444231 - DNA, 25 bp, Mus musculus
gcagagtgttcaccttgttgcaata

SEQ ID NO: 444232 - DNA, 25 bp, Mus musculus
tcaagatcggaggacactagtgccc

SEQ ID NO: 444233 - DNA, 25 bp, Mus musculus
cagaagaagggaatgcggctcgatc

SEQ ID NO: 444234 - DNA, 25 bp, Mus musculus
caggtaacttcacgcgctcattgtc

SEQ ID NO: 444235 - DNA, 25 bp, Mus musculus
cagagggtggaaaagcgctcaactc

SEQ ID NO: 444236 - DNA, 25 bp, Mus musculus
tgggctcaggagtaaaagaaacacc

SEQ ID NO: 444237 - DNA, 25 bp, Mus musculus
ttgttgcaatagtaggggtccaggc

SEQ ID NO: 444238 - DNA, 25 bp, Mus musculus
tgggctggaggaggataaaatctta

SEQ ID NO: 444239 - DNA, 25 bp, Mus musculus
cgccagaatcggtgcagacaaaagc

SEQ ID NO: 444240 - DNA, 25 bp, Mus musculus
caatatttactacccgagcgcacgc

SEQ ID NO: 444241 - DNA, 25 bp, Mus musculus
cggagctgctccacaatatttacta

SEQ ID NO: 444242 - DNA, 25 bp, Mus musculus
ccgcacaatcgcgttgtttggcaaa

SEQ ID NO: 444243 - DNA, 25 bp, Mus musculus
ctgggcgttttattggagactctgc

SEQ ID NO: 444244 - DNA, 25 bp, Mus musculus
aagtagctagcgcaaggcaccgaga

SEQ ID NO: 444245 - DNA, 25 bp, Mus musculus
tttatacgctcagcctgctgagccc

SEQ ID NO: 444246 - DNA, 25 bp, Mus musculus
gccctttatacgctcagcctgctga

SEQ ID NO: 444247 - DNA, 25 bp, Mus musculus
tggcgccctttatacgctcagcctg

SEQ ID NO: 444248 - DNA, 25 bp, Mus musculus
tagctagcgcaaggcaccgagagcg

SEQ ID NO: 444249 - DNA, 25 bp, Mus musculus
tgcaaagtagctagcgcaaggcacc

SEQ ID NO: 444250 - DNA, 25 bp, Mus musculus
tccggcggcgtacgagtgcaaagta

SEQ ID NO: 444251 - DNA, 25 bp, Mus musculus
tctgtcgacccatggcgcgaggcag

SEQ ID NO: 444252 - DNA, 25 bp, Mus musculus
tccttctgtcgacccatggcgcgag

SEQ ID NO: 444253 - DNA, 25 bp, Mus musculus
atcaactccttctgtcgacccatgg

SEQ ID NO: 444254 - DNA, 25 bp, Mus musculus
caacgattcatcaactccttctgtc

SEQ ID NO: 444255 - DNA, 25 bp, Mus musculus
cggtagcggatgtgaagcatctccc

SEQ ID NO: 444256 - DNA, 25 bp, Mus musculus
cagccggtagcggatgtgaagcatc

SEQ ID NO: 444257 - DNA, 25 bp, Mus musculus
gcaggtggcgccctttatacgctca

SEQ ID NO: 444258 - DNA, 25 bp, Mus musculus
ttgagctgaaatccctgcaggagga

SEQ ID NO: 444259 - DNA, 25 bp, Mus musculus
ggacacgcgcaagcgtcacaaagcg

SEQ ID NO: 444260 - DNA, 25 bp, Mus musculus
gggcttccggatcaccctggtggat

SEQ ID NO: 444261 - DNA, 25 bp, Mus musculus
ctgggaggtggccatcttcggaccc

SEQ ID NO: 444262 - DNA, 25 bp, Mus musculus
ctacaactgggaggtggccatcttc

SEQ ID NO: 444263 - DNA, 25 bp, Mus musculus
gatgagtccgacctctacaactggg

SEQ ID NO: 444264 - DNA, 25 bp, Mus musculus
tcaccctggtggatgagtccgacct

SEQ ID NO: 444265 - DNA, 25 bp, Mus musculus
cggtggagggcttccggatcaccct

SEQ ID NO: 444266 - DNA, 25 bp, Mus musculus
agccctgatgcttgagctgaaatcc

SEQ ID NO: 444267 - DNA, 25 bp, Mus musculus
gaccagctcgcagaaagccctgatg

SEQ ID NO: 444268 - DNA, 25 bp, Mus musculus
ccagcagcagatgaccagctcgcag

SEQ ID NO: 444269 - DNA, 25 bp, Mus musculus
cccgccaggcgtgtgaggacagaca

SEQ ID NO: 444270 - DNA, 25 bp, Mus musculus
tcacaaagcgcagccaccgtggggc

SEQ ID NO: 444271 - DNA, 25 bp, Mus musculus
caggagcagagtagagcagagcaca

SEQ ID NO: 444272 - DNA, 25 bp, Mus musculus
ggaaaacgccaaccgccagctgctg

SEQ ID NO: 444273 - DNA, 25 bp, Mus musculus
aatgggtgccacctgccaagcgaac

SEQ ID NO: 444274 - DNA, 25 bp, Mus musculus
ttccgagttagtaccaatgggtgcc

SEQ ID NO: 444275 - DNA, 25 bp, Mus musculus
gcgtgctcctaagtacaactcctga

SEQ ID NO: 444276 - DNA, 25 bp, Mus musculus
gtgcagccactcaaagcaagcctgg

SEQ ID NO: 444277 - DNA, 25 bp, Mus musculus
caagcctggcttctagacgttttga

SEQ ID NO: 444278 - DNA, 25 bp, Mus musculus
tgcggctctttcgtcacgtgacatg

SEQ ID NO: 444279 - DNA, 25 bp, Mus musculus
tcgcgctatgatgacctcagaaaca

SEQ ID NO: 444280 - DNA, 25 bp, Mus musculus
gccgcctatagagaacccactatta

SEQ ID NO: 444281 - DNA, 25 bp, Mus musculus
agggtcgtactatccgccgcctata

SEQ ID NO: 444282 - DNA, 25 bp, Mus musculus
tgccaatgtgcctcttacaaagcgg

SEQ ID NO: 444283 - DNA, 25 bp, Mus musculus
tgctgagccagacacccagaacgtc

SEQ ID NO: 444284 - DNA, 25 bp, Mus musculus
aattaccgctgctgctctcgttgga

SEQ ID NO: 444285 - DNA, 25 bp, Mus musculus
catcttatggctagcttccgagtta

SEQ ID NO: 444286 - DNA, 25 bp, Mus musculus
cctgctaactgctttccgggccata

SEQ ID NO: 444287 - DNA, 25 bp, Mus musculus
ggcgagcggcgagaaccaaaacacc

SEQ ID NO: 444288 - DNA, 25 bp, Mus musculus
tgctcgccagtacactgcagaagga

SEQ ID NO: 444289 - DNA, 25 bp, Mus musculus
tgctaggtgatgacccagacctgtg

SEQ ID NO: 444290 - DNA, 25 bp, Mus musculus
cgcagcaaggagaattgatgtcctc

SEQ ID NO: 444291 - DNA, 25 bp, Mus musculus
acatagcagcacgtcgccacggaga

SEQ ID NO: 444292 - DNA, 25 bp, Mus musculus
cctaccgccgtgtctggaaaggacg

SEQ ID NO: 444293 - DNA, 25 bp, Mus musculus
aacaagcagctttcctaccgccgtg

SEQ ID NO: 444294 - DNA, 25 bp, Mus musculus
ccgggcagcagtcgatcaaaatgag

SEQ ID NO: 444295 - DNA, 25 bp, Mus musculus
cggaaaatggctcggatcccgggca

SEQ ID NO: 444296 - DNA, 25 bp, Mus musculus
cgaggcagacgctttccgcttcctg

SEQ ID NO: 444297 - DNA, 25 bp, Mus musculus
tgaacccagctggaacgccctaagc

SEQ ID NO: 444298 - DNA, 25 bp, Mus musculus
gaaggaccggtcactgctctacagt

SEQ ID NO: 444299 - DNA, 25 bp, Mus musculus
cccagaccagcagggcgggacttaa

SEQ ID NO: 444300 - DNA, 25 bp, Mus musculus
gtcactgtcggctcctcccattggt

SEQ ID NO: 444301 - DNA, 25 bp, Mus musculus
atgaaaggatctggagtaaaggagc

SEQ ID NO: 444302 - DNA, 25 bp, Mus musculus
aagaggtggtgtttgctctccctag

SEQ ID NO: 444303 - DNA, 25 bp, Mus musculus
ggcgccagcacctttcagctttcgg

SEQ ID NO: 444304 - DNA, 25 bp, Mus musculus
gcacctttcagctttcgggacagca

SEQ ID NO: 444305 - DNA, 25 bp, Mus musculus
ttcagctttcgggacagcagcggca

SEQ ID NO: 444306 - DNA, 25 bp, Mus musculus
agccggacgacgaccgacgactcgg

SEQ ID NO: 444307 - DNA, 25 bp, Mus musculus
cgaccgacgactcggggcggattct

SEQ ID NO: 444308 - DNA, 25 bp, Mus musculus
aggagggaagtaggccttcaacatg

SEQ ID NO: 444309 - DNA, 25 bp, Mus musculus
catgatgtcagacgcctaaaggggc

SEQ ID NO: 444310 - DNA, 25 bp, Mus musculus
tcggctcctcccattggtcggggcg

SEQ ID NO: 444311 - DNA, 25 bp, Mus musculus
tttgctctccctaggggcagcggga

SEQ ID NO: 444312 - DNA, 25 bp, Mus musculus
gcggcgccatgatgtcagacgccta

SEQ ID NO: 444313 - DNA, 25 bp, Mus musculus
ggccttcaacatggcggctgtggta

SEQ ID NO: 444314 - DNA, 25 bp, Mus musculus
tgcagccgggctcttctgattggct

SEQ ID NO: 444315 - DNA, 25 bp, Mus musculus
aattctgtggctcgtctgaagtgca

SEQ ID NO: 444316 - DNA, 25 bp, Mus musculus
gaagcgcctgatgcccaattctgtg

SEQ ID NO: 444317 - DNA, 25 bp, Mus musculus
cagccaaaaaaccacgcctcagggg

SEQ ID NO: 444318 - DNA, 25 bp, Mus musculus
gatctcgcgacggtcccagccaaaa

SEQ ID NO: 444319 - DNA, 25 bp, Mus musculus
ccaatggttcagcttgaggcagatc

SEQ ID NO: 444320 - DNA, 25 bp, Mus musculus
ggtcattcacagagcctgtcacctc

SEQ ID NO: 444321 - DNA, 25 bp, Mus musculus
ggcaacgccacaagcgccagttcga

SEQ ID NO: 444322 - DNA, 25 bp, Mus musculus
agagcgtccggtcaacccgccttag

SEQ ID NO: 444323 - DNA, 25 bp, Mus musculus
tagtgcggtgaggagaaagccctaa

SEQ ID NO: 444324 - DNA, 25 bp, Mus musculus
tcagtcagttttcagggaggaccga

SEQ ID NO: 444325 - DNA, 25 bp, Mus musculus
gcgagaaccctcgaagaacccgaga

SEQ ID NO: 444326 - DNA, 25 bp, Mus musculus
aaagccaccgtttctcacctcaggg

SEQ ID NO: 444327 - DNA, 25 bp, Mus musculus
agagcctgggctcaagctaaagcca

SEQ ID NO: 444328 - DNA, 25 bp, Mus musculus
tcgcggtccactagacggaagaagc

SEQ ID NO: 444329 - DNA, 25 bp, Mus musculus
aggagatgttctgtgactggtaccc

SEQ ID NO: 444330 - DNA, 25 bp, Mus musculus
cgtgaagtccagcactgcgccaata

SEQ ID NO: 444331 - DNA, 25 bp, Mus musculus
accttcgccgaagctcgacgagtta

SEQ ID NO: 444332 - DNA, 25 bp, Mus musculus
cactggcgttgggaaacttgccctc

SEQ ID NO: 444333 - DNA, 25 bp, Mus musculus
cgggcgtgtacatgtcatcgatttc

SEQ ID NO: 444334 - DNA, 25 bp, Mus musculus
atcgatttccaggtggctgctatta

SEQ ID NO: 444335 - DNA, 25 bp, Mus musculus
ctgggcgaattgcagcaccttgttc

SEQ ID NO: 444336 - DNA, 25 bp, Mus musculus
tgcagtgcccacgtggaccaaatgg

SEQ ID NO: 444337 - DNA, 25 bp, Mus musculus
ccctggatggcttgttgaagtaacg

SEQ ID NO: 444338 - DNA, 25 bp, Mus musculus
ctgcagtctcatcgaacgctccgtg

SEQ ID NO: 444339 - DNA, 25 bp, Mus musculus
tccgtgctattccagcccaggtgga

SEQ ID NO: 444340 - DNA, 25 bp, Mus musculus
gccacctatcatatcgggcaagatg

SEQ ID NO: 444341 - DNA, 25 bp, Mus musculus
cccagcatactgacggtgagcaccg

SEQ ID NO: 444342 - DNA, 25 bp, Mus musculus
tccatcccgcgcagacagtagtggc

SEQ ID NO: 444343 - DNA, 25 bp, Mus musculus
gttcagcatgttcaccactacctcg

SEQ ID NO: 444344 - DNA, 25 bp, Mus musculus
gcggatccctgcgaaccttacagtc

SEQ ID NO: 444345 - DNA, 25 bp, Mus musculus
cgaaccttacagtcggctgctgcga

SEQ ID NO: 444346 - DNA, 25 bp, Mus musculus
ggctgctgcgagcacaaaggccgca

SEQ ID NO: 444347 - DNA, 25 bp, Mus musculus
caggcggcgttctgtgctaggctcc

SEQ ID NO: 444348 - DNA, 25 bp, Mus musculus
tgcagtagtccatcccgcgcagaca

SEQ ID NO: 444349 - DNA, 25 bp, Mus musculus
cggccggagcaagggctttcatatc

SEQ ID NO: 444350 - DNA, 25 bp, Mus musculus
atatccttggtatggcaatcggccc

SEQ ID NO: 444351 - DNA, 25 bp, Mus musculus
agagggtccacgcacccacagcggg

SEQ ID NO: 444352 - DNA, 25 bp, Mus musculus
cacagcggggtacaatctgcggcag

SEQ ID NO: 444353 - DNA, 25 bp, Mus musculus
aatctgcggcagagtccggttccga

SEQ ID NO: 444354 - DNA, 25 bp, Mus musculus
ggttccgagacagcgagttcagcat

SEQ ID NO: 444355 - DNA, 25 bp, Mus musculus
gctcccgggtggtgcagtagtccat

SEQ ID NO: 444356 - DNA, 25 bp, Mus musculus
taggctacttgcaggcgctggtcac

SEQ ID NO: 444357 - DNA, 25 bp, Mus musculus
gccacagcgtctcgcccgggttgaa

SEQ ID NO: 444358 - DNA, 25 bp, Mus musculus
ttggttttcagatccggctcagaca

SEQ ID NO: 444359 - DNA, 25 bp, Mus musculus
cggatctcaggacaagactgggttt

SEQ ID NO: 444360 - DNA, 25 bp, Mus musculus
caggatccaggccttgtggcctcta

SEQ ID NO: 444361 - DNA, 25 bp, Mus musculus
aaagcctccagctctagaaatccgg

SEQ ID NO: 444362 - DNA, 25 bp, Mus musculus
ccagccatggcacagaaacccaaga

SEQ ID NO: 444363 - DNA, 25 bp, Mus musculus
cgctggtcacagagttccaggaaac

SEQ ID NO: 444364 - DNA, 25 bp, Mus musculus
tccaggaaaccgagagccaaggtaa

SEQ ID NO: 444365 - DNA, 25 bp, Mus musculus
ttcagttccgaaaagccacagcgtc

SEQ ID NO: 444366 - DNA, 25 bp, Mus musculus
ggcgtgcctgccttcagttccgaaa

SEQ ID NO: 444367 - DNA, 25 bp, Mus musculus
gctagagagacttccgccctgaacc

SEQ ID NO: 444368 - DNA, 25 bp, Mus musculus
ggaagcccaggaggcgcccagtaac

SEQ ID NO: 444369 - DNA, 25 bp, Mus musculus
ttgtggcctctaccggagctcccaa

SEQ ID NO: 444370 - DNA, 25 bp, Mus musculus
gcgaggacccacaacgtcagctgtc

SEQ ID NO: 444371 - DNA, 25 bp, Mus musculus
gtcagcagctcagccactgcggtga

SEQ ID NO: 444372 - DNA, 25 bp, Mus musculus
cggacttatctttctctgcggaggc

SEQ ID NO: 444373 - DNA, 25 bp, Mus musculus
ctgatgctgttctacaagggcgcga

SEQ ID NO: 444374 - DNA, 25 bp, Mus musculus
cgctggtaatctcccacggttttct

SEQ ID NO: 444375 - DNA, 25 bp, Mus musculus
tgcggtgactctgcaactccacttc

SEQ ID NO: 444376 - DNA, 25 bp, Mus musculus
gttgcctagagctaccgcggcagta

SEQ ID NO: 444377 - DNA, 25 bp, Mus musculus
attatgcagactaggccgccctgga

SEQ ID NO: 444378 - DNA, 25 bp, Mus musculus
cagaagcccggcagattatgcagac

SEQ ID NO: 444379 - DNA, 25 bp, Mus musculus
ccggtcgatctcctccatcatggtg

SEQ ID NO: 444380 - DNA, 25 bp, Mus musculus
tcaccagcggctgcatctccgagtg

SEQ ID NO: 444381 - DNA, 25 bp, Mus musculus
ggactccctctaccttatcagatgg

SEQ ID NO: 444382 - DNA, 25 bp, Mus musculus
cggcaaagcgttttcaggactccct

SEQ ID NO: 444383 - DNA, 25 bp, Mus musculus
gacaccgcccggatcctgcattatt

SEQ ID NO: 444384 - DNA, 25 bp, Mus musculus
caacgggatgctcagcgccgactga

SEQ ID NO: 444385 - DNA, 25 bp, Mus musculus
gcgggcaggggcgacgtccactccc

SEQ ID NO: 444386 - DNA, 25 bp, Mus musculus
gacaacgggatgctcagcgccgact

SEQ ID NO: 444387 - DNA, 25 bp, Mus musculus
cggggccgctagctcgctcgctcgc

SEQ ID NO: 444388 - DNA, 25 bp, Mus musculus
gcgcccgcgagagggtccgggacaa

SEQ ID NO: 444389 - DNA, 25 bp, Mus musculus
gtctgcggagagcgggcacctcctc

SEQ ID NO: 444390 - DNA, 25 bp, Mus musculus
agcgccgactgaggctccagagcct

SEQ ID NO: 444391 - DNA, 25 bp, Mus musculus
tcagcgccgactgaggctccagagc

SEQ ID NO: 444392 - DNA, 25 bp, Mus musculus
gctcagcgccgactgaggctccaga

SEQ ID NO: 444393 - DNA, 25 bp, Mus musculus
atgctcagcgccgactgaggctcca

SEQ ID NO: 444394 - DNA, 25 bp, Mus musculus
acaacgggatgctcagcgccgactg

SEQ ID NO: 444395 - DNA, 25 bp, Mus musculus
ggacaacgggatgctcagcgccgac

SEQ ID NO: 444396 - DNA, 25 bp, Mus musculus
ccgggacaacgggatgctcagcgcc

SEQ ID NO: 444397 - DNA, 25 bp, Mus musculus
agagcgggcacctcctccccctggg

SEQ ID NO: 444398 - DNA, 25 bp, Mus musculus
caggcttgcgcgttttaaggtcggt

SEQ ID NO: 444399 - DNA, 25 bp, Mus musculus
ggcgactgcatcctcaatgaagctc

SEQ ID NO: 444400 - DNA, 25 bp, Mus musculus
gcgtgtctgactcgaggacacgccc

SEQ ID NO: 444401 - DNA, 25 bp, Mus musculus
atcctcaatgaagctcaggtcagcc

SEQ ID NO: 444402 - DNA, 25 bp, Mus musculus
ctcaatgaagctcaggtcagccatg

SEQ ID NO: 444403 - DNA, 25 bp, Mus musculus
atgaagctcaggtcagccatgggca

SEQ ID NO: 444404 - DNA, 25 bp, Mus musculus
gctcaggtcagccatgggcagctct

SEQ ID NO: 444405 - DNA, 25 bp, Mus musculus
tcagccatgggcagctctgcgacac

SEQ ID NO: 444406 - DNA, 25 bp, Mus musculus
ggaccgcactgagcgtggcagtccc

SEQ ID NO: 444407 - DNA, 25 bp, Mus musculus
tcctccttctcggggaaggcgactg

SEQ ID NO: 444408 - DNA, 25 bp, Mus musculus
tccggcgcaggcttgcgcgttttaa

SEQ ID NO: 444409 - DNA, 25 bp, Mus musculus
gggaaggcgactgcatcctcaatga

SEQ ID NO: 444410 - DNA, 25 bp, Mus musculus
ccgcgagcgcgagaggcagcggtcc

SEQ ID NO: 444411 - DNA, 25 bp, Mus musculus
ctgcatcctcaatgaagctcaggtc

SEQ ID NO: 444412 - DNA, 25 bp, Mus musculus
cctttgaatctaattgtctgagtca

SEQ ID NO: 444413 - DNA, 25 bp, Mus musculus
ctgctgcccgggtaccagccagcca

SEQ ID NO: 444414 - DNA, 25 bp, Mus musculus
ggttcggagctgacctctgctgccc

SEQ ID NO: 444415 - DNA, 25 bp, Mus musculus
cccaaacccgcggcttggatgcggg

SEQ ID NO: 444416 - DNA, 25 bp, Mus musculus
tctaattgtctgagtcaggaggaga

SEQ ID NO: 444417 - DNA, 25 bp, Mus musculus
gtcatcctttgaatctaattgtctg

SEQ ID NO: 444418 - DNA, 25 bp, Mus musculus
tgaggtcatcctttgaatctaattg

SEQ ID NO: 444419 - DNA, 25 bp, Mus musculus
gcagtgaggtcatcctttgaatcta

SEQ ID NO: 444420 - DNA, 25 bp, Mus musculus
ggcatgcagtgaggtcatcctttga

SEQ ID NO: 444421 - DNA, 25 bp, Mus musculus
gacggcatgcagtgaggtcatcctt

SEQ ID NO: 444422 - DNA, 25 bp, Mus musculus
gtccgaccggcagcctgcgggcatc

SEQ ID NO: 444423 - DNA, 25 bp, Mus musculus
gtgctcagcgctccgtgggtccgac

SEQ ID NO: 444424 - DNA, 25 bp, Mus musculus
ggccgcgcgcactgacctgggtccc

SEQ ID NO: 444425 - DNA, 25 bp, Mus musculus
caggaggagatgtggcacttgatgc

SEQ ID NO: 444426 - DNA, 25 bp, Mus musculus
atgctctcaccgaggggccacgtgc

SEQ ID NO: 444427 - DNA, 25 bp, Mus musculus
caggagacgtttttctgacttggca

SEQ ID NO: 444428 - DNA, 25 bp, Mus musculus
tgcgctttatcaggagacgtttttc

SEQ ID NO: 444429 - DNA, 25 bp, Mus musculus
cctccgcctaatgcgctttatcagg

SEQ ID NO: 444430 - DNA, 25 bp, Mus musculus
tggatcaatctgtccgcctgccgct

SEQ ID NO: 444431 - DNA, 25 bp, Mus musculus
acgggcttggatcaatctgtccgcc

SEQ ID NO: 444432 - DNA, 25 bp, Mus musculus
ggttacgggcttggatcaatctgtc

SEQ ID NO: 444433 - DNA, 25 bp, Mus musculus
ctgcctgattaatggggttacgggc

SEQ ID NO: 444434 - DNA, 25 bp, Mus musculus
ccacgctgcctgattaatggggtta

SEQ ID NO: 444435 - DNA, 25 bp, Mus musculus
ggggatccacgctgcctgattaatg

SEQ ID NO: 444436 - DNA, 25 bp, Mus musculus
tttttctgacttggcagcgtcgcgc

SEQ ID NO: 444437 - DNA, 25 bp, Mus musculus
atatttaaggggcttttagctcaga

SEQ ID NO: 444438 - DNA, 25 bp, Mus musculus
accaggcggctagggatgctctcac

SEQ ID NO: 444439 - DNA, 25 bp, Mus musculus
cttttagctcagaaggggctgaagc

SEQ ID NO: 444440 - DNA, 25 bp, Mus musculus
cggtctgtccgccttgagcgttcga

SEQ ID NO: 444441 - DNA, 25 bp, Mus musculus
agcgttcgagggtcaagcctcgcgc

SEQ ID NO: 444442 - DNA, 25 bp, Mus musculus
gagggtcaagcctcgcgcagaccgc

SEQ ID NO: 444443 - DNA, 25 bp, Mus musculus
gctcctctgctctccgcggctttaa

SEQ ID NO: 444444 - DNA, 25 bp, Mus musculus
cttccctcgcccatgtgaccgcggg

SEQ ID NO: 444445 - DNA, 25 bp, Mus musculus
gcgcgccctctggacggctatggac

SEQ ID NO: 444446 - DNA, 25 bp, Mus musculus
ctcgggccgcgggtcttgcaaacgc

SEQ ID NO: 444447 - DNA, 25 bp, Mus musculus
gcgggtcttgcaaacgcgcgcgcac

SEQ ID NO: 444448 - DNA, 25 bp, Mus musculus
agtttgcgggcaaagtttctcgtga

SEQ ID NO: 444449 - DNA, 25 bp, Mus musculus
tcacactctcagctttggccaggtc

SEQ ID NO: 444450 - DNA, 25 bp, Mus musculus
gcaaagtttctcgtgaactttccta

SEQ ID NO: 444451 - DNA, 25 bp, Mus musculus
actctcagctttggccaggtctctc

SEQ ID NO: 444452 - DNA, 25 bp, Mus musculus
tcactctacccgcacgcacgagggc

SEQ ID NO: 444453 - DNA, 25 bp, Mus musculus
cgagtgatcgctcatcacactctca

SEQ ID NO: 444454 - DNA, 25 bp, Mus musculus
ctgctgttcgcctgtgatggtggca

SEQ ID NO: 444455 - DNA, 25 bp, Mus musculus
agagctgcttcggaccactcgtgag

SEQ ID NO: 444456 - DNA, 25 bp, Mus musculus
cgctgtttcaggcagcaggcatttc

SEQ ID NO: 444457 - DNA, 25 bp, Mus musculus
catctcctgggatttggctcttacc

SEQ ID NO: 444458 - DNA, 25 bp, Mus musculus
tcttaccacggtcgccagtagacgc

SEQ ID NO: 444459 - DNA, 25 bp, Mus musculus
agtagacgctcgaccctcacggagt

SEQ ID NO: 444460 - DNA, 25 bp, Mus musculus
gcctgagagaaacccgggctgctgt

SEQ ID NO: 444461 - DNA, 25 bp, Mus musculus
ctgacacaccggagcagcgaaagcg

SEQ ID NO: 444462 - DNA, 25 bp, Mus musculus
acggctatcggaggagtcttgcgcc

SEQ ID NO: 444463 - DNA, 25 bp, Mus musculus
cttgcgcccgaagaacgcagatttg

SEQ ID NO: 444464 - DNA, 25 bp, Mus musculus
aacgcagatttgtgcctttaaaaga

SEQ ID NO: 444465 - DNA, 25 bp, Mus musculus
ctttaaaagatggacggcatgcgtc

SEQ ID NO: 444466 - DNA, 25 bp, Mus musculus
acggcatgcgtcacctgctgacaca

SEQ ID NO: 444467 - DNA, 25 bp, Mus musculus
accctcacggagtagccaagatggc

SEQ ID NO: 444468 - DNA, 25 bp, Mus musculus
taggctttggatgtcggaaataacc

SEQ ID NO: 444469 - DNA, 25 bp, Mus musculus
gagagcaccgtcacgccttgtagga

SEQ ID NO: 444470 - DNA, 25 bp, Mus musculus
agtgacgtcactgtttaggctttgg

SEQ ID NO: 444471 - DNA, 25 bp, Mus musculus
cctcaccttcctggagcctcgggtc

SEQ ID NO: 444472 - DNA, 25 bp, Mus musculus
cacgccttgtaggaagtgacgtcac

SEQ ID NO: 444473 - DNA, 25 bp, Mus musculus
tggccaatccgagagcaccgtcacg

SEQ ID NO: 444474 - DNA, 25 bp, Mus musculus
cctaaataagaagactggccaatcc

SEQ ID NO: 444475 - DNA, 25 bp, Mus musculus
tgggacgtccgcctaaataagaaga

SEQ ID NO: 444476 - DNA, 25 bp, Mus musculus
cgcagcaacccggaacagcctgagg

SEQ ID NO: 444477 - DNA, 25 bp, Mus musculus
agccgccatcgtttctgcagcctgg

SEQ ID NO: 444478 - DNA, 25 bp, Mus musculus
tgcacatcggtcagagccgccatcg

SEQ ID NO: 444479 - DNA, 25 bp, Mus musculus
agactgtagccgctgcacatcggtc

SEQ ID NO: 444480 - DNA, 25 bp, Mus musculus
cagctcctccactcgagactgtagc

SEQ ID NO: 444481 - DNA, 25 bp, Mus musculus
cgtcactgtttaggctttggatgtc

SEQ ID NO: 444482 - DNA, 25 bp, Mus musculus
cgcgtgtgacttctcgccacacttt

SEQ ID NO: 444483 - DNA, 25 bp, Mus musculus
ctcacgcctgttgctgtctatggca

SEQ ID NO: 444484 - DNA, 25 bp, Mus musculus
cctttctttactgggctcgggctca

SEQ ID NO: 444485 - DNA, 25 bp, Mus musculus
cgcaagcgtgcgctggtaaaccaga

SEQ ID NO: 444486 - DNA, 25 bp, Mus musculus
ctggtaaaccagaagcagaaccctg

SEQ ID NO: 444487 - DNA, 25 bp, Mus musculus
tgtgggccctgctaagttgaagagc

SEQ ID NO: 444488 - DNA, 25 bp, Mus musculus
ctgctaagttgaagagcgggaccgc

SEQ ID NO: 444489 - DNA, 25 bp, Mus musculus
ctgtctatggcagcctgaagctccc

SEQ ID NO: 444490 - DNA, 25 bp, Mus musculus
cctggggaactgagtgcccgtgtct

SEQ ID NO: 444491 - DNA, 25 bp, Mus musculus
cccgtgtctcgcactcgtatgggta

SEQ ID NO: 444492 - DNA, 25 bp, Mus musculus
ctcgtatgggtacaaatacttcatg

SEQ ID NO: 444493 - DNA, 25 bp, Mus musculus
cttcatgtacctaggggcagacgga

SEQ ID NO: 444494 - DNA, 25 bp, Mus musculus
tctggtcctctgctgtcctcactgt

SEQ ID NO: 444495 - DNA, 25 bp, Mus musculus
aggctggacccagcggatggtccta

SEQ ID NO: 444496 - DNA, 25 bp, Mus musculus
ggtgtctcccaccagccagattcga

SEQ ID NO: 444497 - DNA, 25 bp, Mus musculus
cccgcccagccttacaagtcgtgtc

SEQ ID NO: 444498 - DNA, 25 bp, Mus musculus
acggctagtaaactccggcccatgg

SEQ ID NO: 444499 - DNA, 25 bp, Mus musculus
gagaaagaggagaccacggctagta

SEQ ID NO: 444500 - DNA, 25 bp, Mus musculus
tctcccaccagccagattcgagggg

SEQ ID NO: 444501 - DNA, 25 bp, Mus musculus
ctcactggcggtcgcttggctgcct

SEQ ID NO: 444502 - DNA, 25 bp, Mus musculus
gccgtgcgctcactggcggtcgctt

SEQ ID NO: 444503 - DNA, 25 bp, Mus musculus
tcctgtctcagctggattccctgcg

SEQ ID NO: 444504 - DNA, 25 bp, Mus musculus
ctttcgggcggctcctgtctcagct

SEQ ID NO: 444505 - DNA, 25 bp, Mus musculus
cgggtgtctccacggcggtccgtct

SEQ ID NO: 444506 - DNA, 25 bp, Mus musculus
ggtctggacgccctgcagctacact

SEQ ID NO: 444507 - DNA, 25 bp, Mus musculus
tggcgagtcactgagcccggatccc

SEQ ID NO: 444508 - DNA, 25 bp, Mus musculus
catgaggtggcgagtcactgagccc

SEQ ID NO: 444509 - DNA, 25 bp, Mus musculus
ccggagagctatggggaaatcacgc

SEQ ID NO: 444510 - DNA, 25 bp, Mus musculus
tcctaccgccaggtccggcctcaga

SEQ ID NO: 444511 - DNA, 25 bp, Mus musculus
ggcctcagagctccgtactgctcgt

SEQ ID NO: 444512 - DNA, 25 bp, Mus musculus
tgttccagcggcacgtgcggttcct

SEQ ID NO: 444513 - DNA, 25 bp, Mus musculus
gtactgctcgttggcgaggaagccc

SEQ ID NO: 444514 - DNA, 25 bp, Mus musculus
caggaggccggactcgaaatcagct

SEQ ID NO: 444515 - DNA, 25 bp, Mus musculus
aggccggactcgaaatcagctagca

SEQ ID NO: 444516 - DNA, 25 bp, Mus musculus
gaaatcagctagcacgccgtccatg

SEQ ID NO: 444517 - DNA, 25 bp, Mus musculus
acgggccgcttcaccgccattgcca

SEQ ID NO: 444518 - DNA, 25 bp, Mus musculus
gtgtctccgcagagcacagcggcaa

SEQ ID NO: 444519 - DNA, 25 bp, Mus musculus
acagcggcaagcacggaagatgcca

SEQ ID NO: 444520 - DNA, 25 bp, Mus musculus
acggaagatgccagacccggaaaca

SEQ ID NO: 444521 - DNA, 25 bp, Mus musculus
tgccagacccggaaacaagcttccg

SEQ ID NO: 444522 - DNA, 25 bp, Mus musculus
agagctccgtactgctcgttggcga

SEQ ID NO: 444523 - DNA, 25 bp, Mus musculus
gaaagcggcggcgaaaaccctgcag

SEQ ID NO: 444524 - DNA, 25 bp, Mus musculus
ctcagacagcgaggcgtgcagaata

SEQ ID NO: 444525 - DNA, 25 bp, Mus musculus
cacaggctgtgggttcacgactcaa

SEQ ID NO: 444526 - DNA, 25 bp, Mus musculus
gtaagaccgaactagggccacaggc

SEQ ID NO: 444527 - DNA, 25 bp, Mus musculus
ggcagcctggcaccaccaacgtaag

SEQ ID NO: 444528 - DNA, 25 bp, Mus musculus
ctggatcagcactgcgataatagtc

SEQ ID NO: 444529 - DNA, 25 bp, Mus musculus
gacgaagttttgagtgcccagccac

SEQ ID NO: 444530 - DNA, 25 bp, Mus musculus
agctgcgctatttcttctctagaga

SEQ ID NO: 444531 - DNA, 25 bp, Mus musculus
cacccgcatactgtcgagcaagctg

SEQ ID NO: 444532 - DNA, 25 bp, Mus musculus
tccagccctggtgcaaaaaggagaa

SEQ ID NO: 444533 - DNA, 25 bp, Mus musculus
tcagccgagagaaggcaagctcatg

SEQ ID NO: 444534 - DNA, 25 bp, Mus musculus
ttcacgactcaaaagccgctgccta

SEQ ID NO: 444535 - DNA, 25 bp, Mus musculus
gcgttcacaaatacccactgcagct

SEQ ID NO: 444536 - DNA, 25 bp, Mus musculus
cggtgccgaagagcagcacgtactc

SEQ ID NO: 444537 - DNA, 25 bp, Mus musculus
cgcagctccacgatcagccgagaga

SEQ ID NO: 444538 - DNA, 25 bp, Mus musculus
accttccgggcgagcggtaattgct

SEQ ID NO: 444539 - DNA, 25 bp, Mus musculus
ccaccgtcacgtgttggcgactagc

SEQ ID NO: 444540 - DNA, 25 bp, Mus musculus
tctagaaacactgcgccgaccgagc

SEQ ID NO: 444541 - DNA, 25 bp, Mus musculus
cgccagcctatagcttctagaaaca

SEQ ID NO: 444542 - DNA, 25 bp, Mus musculus
gcactcctacccgaggccagggtgg

SEQ ID NO: 444543 - DNA, 25 bp, Mus musculus
cgtaggaagttctagtcccagagtc

SEQ ID NO: 444544 - DNA, 25 bp, Mus musculus
ccagcaggcttcagaggcggacgcc

SEQ ID NO: 444545 - DNA, 25 bp, Mus musculus
gagccgatcctgagcagcgccagca

SEQ ID NO: 444546 - DNA, 25 bp, Mus musculus
ctcacgtcgcatagcggagccgatc

SEQ ID NO: 444547 - DNA, 25 bp, Mus musculus
ccttaggtcaattcgtgtggcctca

SEQ ID NO: 444548 - DNA, 25 bp, Mus musculus
gggcgctcaccttgtgtaccttagg

SEQ ID NO: 444549 - DNA, 25 bp, Mus musculus
gagacatggaatggggcgctcacct

SEQ ID NO: 444550 - DNA, 25 bp, Mus musculus
ggcgactagccaatcatccagggtg

SEQ ID NO: 444551 - DNA, 25 bp, Mus musculus
cccagagtcaaggtcggcactccta

SEQ ID NO: 444552 - DNA, 25 bp, Mus musculus
agcgccacctcgtatctcctcaatc

SEQ ID NO: 444553 - DNA, 25 bp, Mus musculus
taaagtcagggaggcagtgggcgtg

SEQ ID NO: 444554 - DNA, 25 bp, Mus musculus
ttaatgcaccggctgtctgtgcagc

SEQ ID NO: 444555 - DNA, 25 bp, Mus musculus
atgcaccggctgtctgtgcagcagc

SEQ ID NO: 444556 - DNA, 25 bp, Mus musculus
ggtgcgacagaggagaccacgaccc

SEQ ID NO: 444557 - DNA, 25 bp, Mus musculus
cagaggagaccacgacccgagcgct

SEQ ID NO: 444558 - DNA, 25 bp, Mus musculus
agaggctccagcttctgctcccggg

SEQ ID NO: 444559 - DNA, 25 bp, Mus musculus
agctgtagggcgacccgacaatgac

SEQ ID NO: 444560 - DNA, 25 bp, Mus musculus
gtagggcgacccgacaatgacatga

SEQ ID NO: 444561 - DNA, 25 bp, Mus musculus
gggcgacccgacaatgacatgaggc

SEQ ID NO: 444562 - DNA, 25 bp, Mus musculus
gcgacccgacaatgacatgaggcgg

SEQ ID NO: 444563 - DNA, 25 bp, Mus musculus
gtccaccgacactgaacctcgttca

SEQ ID NO: 444564 - DNA, 25 bp, Mus musculus
agggctggacagcagcagcccacgc

SEQ ID NO: 444565 - DNA, 25 bp, Mus musculus
ccaagggctggacagcagcagccca

SEQ ID NO: 444566 - DNA, 25 bp, Mus musculus
gcgccgcggctgttattgttccgaa

SEQ ID NO: 444567 - DNA, 25 bp, Mus musculus
gcagccgtttgccacttcccggaga

SEQ ID NO: 444568 - DNA, 25 bp, Mus musculus
ctccatttccgcagtgctggcgctg

SEQ ID NO: 444569 - DNA, 25 bp, Mus musculus
tggcgtacgcctatctcttcaagta

SEQ ID NO: 444570 - DNA, 25 bp, Mus musculus
ggccatggcgtacgcctatctcttc

SEQ ID NO: 444571 - DNA, 25 bp, Mus musculus
ctgctggctctgacggcgaccgacg

SEQ ID NO: 444572 - DNA, 25 bp, Mus musculus
gcgactgaacctagcaggctccgtt

SEQ ID NO: 444573 - DNA, 25 bp, Mus musculus
tgttattgttccgaagggctgggcc

SEQ ID NO: 444574 - DNA, 25 bp, Mus musculus
tagcaggctccgtttcctcgcgact

SEQ ID NO: 444575 - DNA, 25 bp, Mus musculus
acttcccggagagtgtgacagcagc

SEQ ID NO: 444576 - DNA, 25 bp, Mus musculus
tttccgcagtgctggcgctggtgac

SEQ ID NO: 444577 - DNA, 25 bp, Mus musculus
cggcctttgctgctggctctgacgg

SEQ ID NO: 444578 - DNA, 25 bp, Mus musculus
tcatcatcggcgacacaggtgaggc

SEQ ID NO: 444579 - DNA, 25 bp, Mus musculus
aagtcgaacgaattggagcgtgacg

SEQ ID NO: 444580 - DNA, 25 bp, Mus musculus
tgtcattgtcgggtcgccctacagc

SEQ ID NO: 444581 - DNA, 25 bp, Mus musculus
gggtcgtggtctcctctgtcgcacc

SEQ ID NO: 444582 - DNA, 25 bp, Mus musculus
agcgctcgggtcgtggtctcctctg

SEQ ID NO: 444583 - DNA, 25 bp, Mus musculus
gcagaagctggagcctctgcggggc

SEQ ID NO: 444584 - DNA, 25 bp, Mus musculus
gtcattgtcgggtcgccctacagct

SEQ ID NO: 444585 - DNA, 25 bp, Mus musculus
tcatgtcattgtcgggtcgccctac

SEQ ID NO: 444586 - DNA, 25 bp, Mus musculus
gcctcatgtcattgtcgggtcgccc

SEQ ID NO: 444587 - DNA, 25 bp, Mus musculus
ccgcctcatgtcattgtcgggtcgc

SEQ ID NO: 444588 - DNA, 25 bp, Mus musculus
tgaacgaggttcagtgtcggtggac

SEQ ID NO: 444589 - DNA, 25 bp, Mus musculus
tgggctgctgctgtccagcccttgg

SEQ ID NO: 444590 - DNA, 25 bp, Mus musculus
gcgtgggctgctgctgtccagccct

SEQ ID NO: 444591 - DNA, 25 bp, Mus musculus
aggagatacgaggtggcgctggaag

SEQ ID NO: 444592 - DNA, 25 bp, Mus musculus
cgcgattgaggagatacgaggtggc

SEQ ID NO: 444593 - DNA, 25 bp, Mus musculus
cccgggagcagaagctggagcctct

SEQ ID NO: 444594 - DNA, 25 bp, Mus musculus
tgaagcacggggtccatagccgtcc

SEQ ID NO: 444595 - DNA, 25 bp, Mus musculus
tcgaacgctcaaggcggacagaccg

SEQ ID NO: 444596 - DNA, 25 bp, Mus musculus
ttgaccctcgaacgctcaaggcgga

SEQ ID NO: 444597 - DNA, 25 bp, Mus musculus
gtctgcgcgaggcttgaccctcgaa

SEQ ID NO: 444598 - DNA, 25 bp, Mus musculus
ttaaagccgcggagagcagaggagc

SEQ ID NO: 444599 - DNA, 25 bp, Mus musculus
tgccaggcgcgggaacgtgccaaag

SEQ ID NO: 444600 - DNA, 25 bp, Mus musculus
gtccatagccgtccagagggcgcgc

SEQ ID NO: 444601 - DNA, 25 bp, Mus musculus
taggaaagttcacgagaaactttgc

SEQ ID NO: 444602 - DNA, 25 bp, Mus musculus
gcgtttgcaagacccgcggcccgag

SEQ ID NO: 444603 - DNA, 25 bp, Mus musculus
gtgcgcgcgcgtttgcaagacccgc

SEQ ID NO: 444604 - DNA, 25 bp, Mus musculus
ctgagagtgtgatgagcgatcactc

SEQ ID NO: 444605 - DNA, 25 bp, Mus musculus
cctggccaaagctgagagtgtgatg

SEQ ID NO: 444606 - DNA, 25 bp, Mus musculus
agagacctggccaaagctgagagtg

SEQ ID NO: 444607 - DNA, 25 bp, Mus musculus
acgagaaactttgcccgcaaactcg

SEQ ID NO: 444608 - DNA, 25 bp, Mus musculus
gcatcaagtgccacatctcctcctg

SEQ ID NO: 444609 - DNA, 25 bp, Mus musculus
gccgcggggccgagaacttgtcacc

SEQ ID NO: 444610 - DNA, 25 bp, Mus musculus
gtcggacccacggagcgctgagcac

SEQ ID NO: 444611 - DNA, 25 bp, Mus musculus
gaccgatgcccgcaggctgccggtc

SEQ ID NO: 444612 - DNA, 25 bp, Mus musculus
gtccctcactcgctgcctcggctcg

SEQ ID NO: 444613 - DNA, 25 bp, Mus musculus
actgcatgccgtccctcactcgctg

SEQ ID NO: 444614 - DNA, 25 bp, Mus musculus
aggatgacctcactgcatgccgtcc

SEQ ID NO: 444615 - DNA, 25 bp, Mus musculus
ttcaaaggatgacctcactgcatgc

SEQ ID NO: 444616 - DNA, 25 bp, Mus musculus
ttagattcaaaggatgacctcactg

SEQ ID NO: 444617 - DNA, 25 bp, Mus musculus
ctcagacaattagattcaaaggatg

SEQ ID NO: 444618 - DNA, 25 bp, Mus musculus
cgccgcggcgcttcccgctccttcc

SEQ ID NO: 444619 - DNA, 25 bp, Mus musculus
tctcctcctgactcagacaattaga

SEQ ID NO: 444620 - DNA, 25 bp, Mus musculus
cccgcatccaagccgcgggtttggg

SEQ ID NO: 444621 - DNA, 25 bp, Mus musculus
cctcctgactcagacaattagattc

SEQ ID NO: 444622 - DNA, 25 bp, Mus musculus
gctgttcctgctgttagggtccaca

SEQ ID NO: 444623 - DNA, 25 bp, Mus musculus
aggctggccctgaaaacgccaaggg

SEQ ID NO: 444624 - DNA, 25 bp, Mus musculus
accagccggatcagtgctcagattt

SEQ ID NO: 444625 - DNA, 25 bp, Mus musculus
gctcagatttgctcgcagcgcccaa

SEQ ID NO: 444626 - DNA, 25 bp, Mus musculus
cgcatggccctcatgtgggacaatg

SEQ ID NO: 444627 - DNA, 25 bp, Mus musculus
gctccttgggctcctgggagaccaa

SEQ ID NO: 444628 - DNA, 25 bp, Mus musculus
gtggctgaaagaagatcctcccgca

SEQ ID NO: 444629 - DNA, 25 bp, Mus musculus
cctcagctgtcgttaccggggagaa

SEQ ID NO: 444630 - DNA, 25 bp, Mus musculus
agccgaggcagtcctgccgcacaaa

SEQ ID NO: 444631 - DNA, 25 bp, Mus musculus
ctgggaccaacaggcgcagacgact

SEQ ID NO: 444632 - DNA, 25 bp, Mus musculus
accctgtcgccttaccgggagctgt

SEQ ID NO: 444633 - DNA, 25 bp, Mus musculus
ttttatagagccaatagggcccacc

SEQ ID NO: 444634 - DNA, 25 bp, Mus musculus
tgctaatcatagatcggcgtcagga

SEQ ID NO: 444635 - DNA, 25 bp, Mus musculus
gccgccattgggcaatttaaaaaga

SEQ ID NO: 444636 - DNA, 25 bp, Mus musculus
aggcaggtcaaggacgcccgaacga

SEQ ID NO: 444637 - DNA, 25 bp, Mus musculus
cagaaccttccacgggcaaaaatcg

SEQ ID NO: 444638 - DNA, 25 bp, Mus musculus
caccggccgtgttcttaagcgattc

SEQ ID NO: 444639 - DNA, 25 bp, Mus musculus
cgcggcttagcaaacctggggcacc

SEQ ID NO: 444640 - DNA, 25 bp, Mus musculus
tgctgtctcagtccgcggcttagca

SEQ ID NO: 444641 - DNA, 25 bp, Mus musculus
cggggctatgcgaagctagccaatc

SEQ ID NO: 444642 - DNA, 25 bp, Mus musculus
tttaaaccgcacctcgacgccatcg

SEQ ID NO: 444643 - DNA, 25 bp, Mus musculus
acgcagcctcgcctgaggcaggtca

SEQ ID NO: 444644 - DNA, 25 bp, Mus musculus
gccaatcacagggaccggccggctg

SEQ ID NO: 444645 - DNA, 25 bp, Mus musculus
acgtgcagcattctggacgcctccg

SEQ ID NO: 444646 - DNA, 25 bp, Mus musculus
gcggaacctacgacgtgcagcattc

SEQ ID NO: 444647 - DNA, 25 bp, Mus musculus
cggcaaaggcggaacctacgacgtg

SEQ ID NO: 444648 - DNA, 25 bp, Mus musculus
cctatccgcgatctcaaacaactta

SEQ ID NO: 444649 - DNA, 25 bp, Mus musculus
tagccaatcagcgatgggcatcctg

SEQ ID NO: 444650 - DNA, 25 bp, Mus musculus
ccctgtgcaagtggatgcacgccag

SEQ ID NO: 444651 - DNA, 25 bp, Mus musculus
gagtgggagagtccccgcagcccct

SEQ ID NO: 444652 - DNA, 25 bp, Mus musculus
ccgcgccgcattgccggctgctcgt

SEQ ID NO: 444653 - DNA, 25 bp, Mus musculus
ccgcctcagcctgtcgtgccgcccg

SEQ ID NO: 444654 - DNA, 25 bp, Mus musculus
ccgctcccggtgctcggcccagcac

SEQ ID NO: 444655 - DNA, 25 bp, Mus musculus
tcggcccagcacgtcggctctggag

SEQ ID NO: 444656 - DNA, 25 bp, Mus musculus
cacgcggactgtcccggtaagcgag

SEQ ID NO: 444657 - DNA, 25 bp, Mus musculus
cggtcccggactcggatcctggtgc

SEQ ID NO: 444658 - DNA, 25 bp, Mus musculus
gtggatgcacgccagtgaccgccgc

SEQ ID NO: 444659 - DNA, 25 bp, Mus musculus
gcacgccagtgaccgccgcctctac

SEQ ID NO: 444660 - DNA, 25 bp, Mus musculus
ctctaccccgagagcgtccgtggga

SEQ ID NO: 444661 - DNA, 25 bp, Mus musculus
gacgggcatggagggagacgcccag

SEQ ID NO: 444662 - DNA, 25 bp, Mus musculus
tgcaagtggatgcacgccagtgacc

SEQ ID NO: 444663 - DNA, 25 bp, Mus musculus
tctgcggtcccggactcggatcctg

SEQ ID NO: 444664 - DNA, 25 bp, Mus musculus
agaggtatccaatcacagaagagtc

SEQ ID NO: 444665 - DNA, 25 bp, Mus musculus
agccagccagctggggtgacatcac

SEQ ID NO: 444666 - DNA, 25 bp, Mus musculus
gaggcgtttctgagcaggccagcca

SEQ ID NO: 444667 - DNA, 25 bp, Mus musculus
ctgccaggtgctgggtatctgcgac

SEQ ID NO: 444668 - DNA, 25 bp, Mus musculus
atagtctcctctgtcgtaggggtga

SEQ ID NO: 444669 - DNA, 25 bp, Mus musculus
gggcccatagtctcctctgtcgtag

SEQ ID NO: 444670 - DNA, 25 bp, Mus musculus
ttgggacaccgtgggcccatagtct

SEQ ID NO: 444671 - DNA, 25 bp, Mus musculus
caggcgactcctgtcccgagtggag

SEQ ID NO: 444672 - DNA, 25 bp, Mus musculus
ctgagtgacggatagaccgggcaat

SEQ ID NO: 444673 - DNA, 25 bp, Mus musculus
ccaatcacagaagagtctgagctga

SEQ ID NO: 444674 - DNA, 25 bp, Mus musculus
gacgctcgttgagaggtatccaatc

SEQ ID NO: 444675 - DNA, 25 bp, Mus musculus
gctatcacccggacgctcgttgaga

SEQ ID NO: 444676 - DNA, 25 bp, Mus musculus
agaagaggtggctatcacccggacg

SEQ ID NO: 444677 - DNA, 25 bp, Mus musculus
tctgagctgagtgacggatagaccg

SEQ ID NO: 444678 - DNA, 25 bp, Mus musculus
ccgaatcatcggaaggaaagctgct

SEQ ID NO: 444679 - DNA, 25 bp, Mus musculus
gtcaattggccgcagcactacgctt

SEQ ID NO: 444680 - DNA, 25 bp, Mus musculus
cacgcctagtaacgccacgtcaatt

SEQ ID NO: 444681 - DNA, 25 bp, Mus musculus
cctcaaggctgcaacacgcctagta

SEQ ID NO: 444682 - DNA, 25 bp, Mus musculus
gcagaccgtaaccaatcagaaaatt

SEQ ID NO: 444683 - DNA, 25 bp, Mus musculus
gcagacacttactcggctccagagg

SEQ ID NO: 444684 - DNA, 25 bp, Mus musculus
ggcctgcatgacacagcaccatctt

SEQ ID NO: 444685 - DNA, 25 bp, Mus musculus
ccaaaggtctccacgcagggagtgt

SEQ ID NO: 444686 - DNA, 25 bp, Mus musculus
accggcgtgccagcgccaaaggtct

SEQ ID NO: 444687 - DNA, 25 bp, Mus musculus
gtcttctgcgtgtggtcggcgacat

SEQ ID NO: 444688 - DNA, 25 bp, Mus musculus
cccttctcaggctcagggtcttctg

SEQ ID NO: 444689 - DNA, 25 bp, Mus musculus
agtgttttcccttctcaggctcagg

SEQ ID NO: 444690 - DNA, 25 bp, Mus musculus
cctcgggcttgcagtgttttccctt

SEQ ID NO: 444691 - DNA, 25 bp, Mus musculus
cagaaaattcgtttgtggcctggcc

SEQ ID NO: 444692 - DNA, 25 bp, Mus musculus
ggcgagcgccggagtctcctcagct

SEQ ID NO: 444693 - DNA, 25 bp, Mus musculus
taatcaaaatggcttccagctggtc

SEQ ID NO: 444694 - DNA, 25 bp, Mus musculus
cctccttctttggtggagcataatc

SEQ ID NO: 444695 - DNA, 25 bp, Mus musculus
cggggctgtattgtcctccttcttt

SEQ ID NO: 444696 - DNA, 25 bp, Mus musculus
gcgggagcgcgcaacgcttacataa

SEQ ID NO: 444697 - DNA, 25 bp, Mus musculus
gagcacgagcatccggggcttctca

SEQ ID NO: 444698 - DNA, 25 bp, Mus musculus
tccgcactgagggagcgcacaagca

SEQ ID NO: 444699 - DNA, 25 bp, Mus musculus
ctcagctgccgcttcacaaaagagg

SEQ ID NO: 444700 - DNA, 25 bp, Mus musculus
ctcaccttgggtttctcgtcggcca

SEQ ID NO: 444701 - DNA, 25 bp, Mus musculus
ggttgccggagcacacaccaccgat

SEQ ID NO: 444702 - DNA, 25 bp, Mus musculus
tcgagccggaccgactctggaatcc

SEQ ID NO: 444703 - DNA, 25 bp, Mus musculus
acaagccacatggttcccgccaggg

SEQ ID NO: 444704 - DNA, 25 bp, Mus musculus
gcttctcattggctgccgcttcgcg

SEQ ID NO: 444705 - DNA, 25 bp, Mus musculus
tcacaaaagaggcaccgggtccgca

SEQ ID NO: 444706 - DNA, 25 bp, Mus musculus
cttggcaccagtctctggcggcgct

SEQ ID NO: 444707 - DNA, 25 bp, Mus musculus
caagagacggttccgcgggaaactg

SEQ ID NO: 444708 - DNA, 25 bp, Mus musculus
cgggcttgctctccctgaccagaaa

SEQ ID NO: 444709 - DNA, 25 bp, Mus musculus
gttggccaagctgcaacactctcgg

SEQ ID NO: 444710 - DNA, 25 bp, Mus musculus
gagacaggaggccagccacatgcca

SEQ ID NO: 444711 - DNA, 25 bp, Mus musculus
gccacatgccaaggacgaactgctg

SEQ ID NO: 444712 - DNA, 25 bp, Mus musculus
ccaaggacgaactgctgggtctgca

SEQ ID NO: 444713 - DNA, 25 bp, Mus musculus
aggagtgggtcttggcaccagtctc

SEQ ID NO: 444714 - DNA, 25 bp, Mus musculus
caccgcgcctgtggttggccaagct

SEQ ID NO: 444715 - DNA, 25 bp, Mus musculus
tggcggcgctctgccttagaaccaa

SEQ ID NO: 444716 - DNA, 25 bp, Mus musculus
tagaaccaacggcagtccaggtttc

SEQ ID NO: 444717 - DNA, 25 bp, Mus musculus
cccgctccgtggctggaagacggac

SEQ ID NO: 444718 - DNA, 25 bp, Mus musculus
tcagagtgttgaggctagtttagga

SEQ ID NO: 444719 - DNA, 25 bp, Mus musculus
ccgcggttggttgtcttcaagagac

SEQ ID NO: 444720 - DNA, 25 bp, Mus musculus
cagagcggcctcttgtgaagcctga

SEQ ID NO: 444721 - DNA, 25 bp, Mus musculus
gaagtcccacttccacacgagtaaa

SEQ ID NO: 444722 - DNA, 25 bp, Mus musculus
ttgtgaagcctgaacccgagccctt

SEQ ID NO: 444723 - DNA, 25 bp, Mus musculus
cggcgacctccggaaccaacgagag

SEQ ID NO: 444724 - DNA, 25 bp, Mus musculus
agcctctggtgaaggttgcctcgct

SEQ ID NO: 444725 - DNA, 25 bp, Mus musculus
ttcccagctcaagacccaggtgatg

SEQ ID NO: 444726 - DNA, 25 bp, Mus musculus
agagtgattcacgtggggaccatga

SEQ ID NO: 444727 - DNA, 25 bp, Mus musculus
ggaccaggcgcggatccctaaatcc

SEQ ID NO: 444728 - DNA, 25 bp, Mus musculus
tgctgaggcacaaacaggatcacgg

SEQ ID NO: 444729 - DNA, 25 bp, Mus musculus
acgatcagacgatctggctggctga

SEQ ID NO: 444730 - DNA, 25 bp, Mus musculus
caggatccggtggaatcggcccatt

SEQ ID NO: 444731 - DNA, 25 bp, Mus musculus
ggggaccatgacctgtgaccacagt

SEQ ID NO: 444732 - DNA, 25 bp, Mus musculus
agagaggttctcaccggttccagga

SEQ ID NO: 444733 - DNA, 25 bp, Mus musculus
cggcgtccgtcaaatcgttccctgg

SEQ ID NO: 444734 - DNA, 25 bp, Mus musculus
gcagccgtgagacagcgttgttgtc

SEQ ID NO: 444735 - DNA, 25 bp, Mus musculus
ggccatgtcgctgctctgtgtgcgt

SEQ ID NO: 444736 - DNA, 25 bp, Mus musculus
attggttccgcccagtctctcgcag

SEQ ID NO: 444737 - DNA, 25 bp, Mus musculus
tctctcgcagggatcccagccggag

SEQ ID NO: 444738 - DNA, 25 bp, Mus musculus
ttctggtcgctcacgcttcgcagct

SEQ ID NO: 444739 - DNA, 25 bp, Mus musculus
acgcttcgcagctatggcgcctcgg

SEQ ID NO: 444740 - DNA, 25 bp, Mus musculus
gcgcggcacctgctgagagaaaaga

SEQ ID NO: 444741 - DNA, 25 bp, Mus musculus
cacgcctgcccggacacttgtggta

SEQ ID NO: 444742 - DNA, 25 bp, Mus musculus
acacttgtggtagtgtcccggcggc

SEQ ID NO: 444743 - DNA, 25 bp, Mus musculus
cttgccctgggtggcgaatgcgttc

SEQ ID NO: 444744 - DNA, 25 bp, Mus musculus
gcgaatgcgttcgtagtcacttcta

SEQ ID NO: 444745 - DNA, 25 bp, Mus musculus
agtcacttctaaaggtccgacgagt

SEQ ID NO: 444746 - DNA, 25 bp, Mus musculus
tatccgtccattctggcagccgtga

SEQ ID NO: 444747 - DNA, 25 bp, Mus musculus
cgcggcggactgttatccgtccatt

SEQ ID NO: 444748 - DNA, 25 bp, Mus musculus
tgtgctcggttctcagagcagctgt

SEQ ID NO: 444749 - DNA, 25 bp, Mus musculus
cgtgtgtgctcggttctcagagcag

SEQ ID NO: 444750 - DNA, 25 bp, Mus musculus
gctcggttctcagagcagctgtgcg

SEQ ID NO: 444751 - DNA, 25 bp, Mus musculus
tgtgtgctcggttctcagagcagct

SEQ ID NO: 444752 - DNA, 25 bp, Mus musculus
gtgtgtgctcggttctcagagcagc

SEQ ID NO: 444753 - DNA, 25 bp, Mus musculus
ctgtgcgtgtgtgctcggttctcag

SEQ ID NO: 444754 - DNA, 25 bp, Mus musculus
cagctgtgcgtgtgtgctcggttct

SEQ ID NO: 444755 - DNA, 25 bp, Mus musculus
agctgtgcgtgtgtgctcggttctc

SEQ ID NO: 444756 - DNA, 25 bp, Mus musculus
ctcggttctcagagcagctgtgcgt

SEQ ID NO: 444757 - DNA, 25 bp, Mus musculus
tgctcggttctcagagcagctgtgc

SEQ ID NO: 444758 - DNA, 25 bp, Mus musculus
tgcgtgtgtgctcggttctcagagc

SEQ ID NO: 444759 - DNA, 25 bp, Mus musculus
gctgtgcgtgtgtgctcggttctca

SEQ ID NO: 444760 - DNA, 25 bp, Mus musculus
gtgtgctcggttctcagagcagctg

SEQ ID NO: 444761 - DNA, 25 bp, Mus musculus
gtgctcggttctcagagcagctgtg

SEQ ID NO: 444762 - DNA, 25 bp, Mus musculus
tcggcctgccaacccaccctgccct

SEQ ID NO: 444763 - DNA, 25 bp, Mus musculus
ccggctcctccagctcaagcgcagg

SEQ ID NO: 444764 - DNA, 25 bp, Mus musculus
gcccgctggctcctggcaaagctgt

SEQ ID NO: 444765 - DNA, 25 bp, Mus musculus
ctcctggcaaagctgtgcgcgtgac

SEQ ID NO: 444766 - DNA, 25 bp, Mus musculus
tggcaaagctgtgcgcgtgactcgc

SEQ ID NO: 444767 - DNA, 25 bp, Mus musculus
cttggcgggccgaaccaacgcgcct

SEQ ID NO: 444768 - DNA, 25 bp, Mus musculus
cgagggctgcccagagcggaccatc

SEQ ID NO: 444769 - DNA, 25 bp, Mus musculus
gcggaccatcggcaccacgcctgca

SEQ ID NO: 444770 - DNA, 25 bp, Mus musculus
gggcgttaccaacgcgcggagccga

SEQ ID NO: 444771 - DNA, 25 bp, Mus musculus
cgcgagacaacgctgcccgcgcgga

SEQ ID NO: 444772 - DNA, 25 bp, Mus musculus
agaagcaaggtaggcgcgcctctcc

SEQ ID NO: 444773 - DNA, 25 bp, Mus musculus
taccagggccctggacacccactgc

SEQ ID NO: 444774 - DNA, 25 bp, Mus musculus
ccacacgcacctgctccggaggctc

SEQ ID NO: 444775 - DNA, 25 bp, Mus musculus
tccacattgccaggggtccctcggg

SEQ ID NO: 444776 - DNA, 25 bp, Mus musculus
ttcctcgcatgtaaatggctttttg

SEQ ID NO: 444777 - DNA, 25 bp, Mus musculus
cggagccgctctgcgttttgttccc

SEQ ID NO: 444778 - DNA, 25 bp, Mus musculus
ctgactagcccgagcgaaggagcga

SEQ ID NO: 444779 - DNA, 25 bp, Mus musculus
agcgagccggtgagcgcagacttcc

SEQ ID NO: 444780 - DNA, 25 bp, Mus musculus
ccaacttttgcctgcgtccgcgggg

SEQ ID NO: 444781 - DNA, 25 bp, Mus musculus
gccgagggtcacttcctcgcatgta

SEQ ID NO: 444782 - DNA, 25 bp, Mus musculus
tggctttttgttgtgctgccggcgt

SEQ ID NO: 444783 - DNA, 25 bp, Mus musculus
ttgccggctgcgttcgagagaaaag

SEQ ID NO: 444784 - DNA, 25 bp, Mus musculus
agttgggttccaactccggcgcgag

SEQ ID NO: 444785 - DNA, 25 bp, Mus musculus
ccggcgcgaacaaagtgcgtccctg

SEQ ID NO: 444786 - DNA, 25 bp, Mus musculus
tcgcagagttccgagcccgcagcta

SEQ ID NO: 444787 - DNA, 25 bp, Mus musculus
cagctcccaagtgcgcgaggacgag

SEQ ID NO: 444788 - DNA, 25 bp, Mus musculus
ggccaactccgcgtccgtggatcag

SEQ ID NO: 444789 - DNA, 25 bp, Mus musculus
cggcaccgagcacgagttgccggct

SEQ ID NO: 444790 - DNA, 25 bp, Mus musculus
cggcagcgctctcgaagctatgacc

SEQ ID NO: 444791 - DNA, 25 bp, Mus musculus
ctgagttggccaaaggccggaagaa

SEQ ID NO: 444792 - DNA, 25 bp, Mus musculus
tacctccttcgctgagttggccaaa

SEQ ID NO: 444793 - DNA, 25 bp, Mus musculus
agggttacctccttcgctgagttgg

SEQ ID NO: 444794 - DNA, 25 bp, Mus musculus
cccagaagggttacctccttcgctg

SEQ ID NO: 444795 - DNA, 25 bp, Mus musculus
taagtgagggccctgcggccctagc

SEQ ID NO: 444796 - DNA, 25 bp, Mus musculus
tacgattaagtgagggccctgcggc

SEQ ID NO: 444797 - DNA, 25 bp, Mus musculus
ttagttgcccagtacgattaagtga

SEQ ID NO: 444798 - DNA, 25 bp, Mus musculus
gcgcatgcttagttgcccagtacga

SEQ ID NO: 444799 - DNA, 25 bp, Mus musculus
ctgggctcactagagcgcatgctta

SEQ ID NO: 444800 - DNA, 25 bp, Mus musculus
tgtccgcctgggctcactagagcgc

SEQ ID NO: 444801 - DNA, 25 bp, Mus musculus
tccttcgctgagttggccaaaggcc

SEQ ID NO: 444802 - DNA, 25 bp, Mus musculus
ctctcgaagctatgaccgtagcctg

SEQ ID NO: 444803 - DNA, 25 bp, Mus musculus
agctatgaccgtagcctggagcgca

SEQ ID NO: 444804 - DNA, 25 bp, Mus musculus
cgtcggaatctcaactttacttagg

SEQ ID NO: 444805 - DNA, 25 bp, Mus musculus
ttcggcaggtcctccaggagtccac

SEQ ID NO: 444806 - DNA, 25 bp, Mus musculus
ctccaaggagttaaccgcagaccgg

SEQ ID NO: 444807 - DNA, 25 bp, Mus musculus
gcaggagaattagcgccagcagtca

SEQ ID NO: 444808 - DNA, 25 bp, Mus musculus
ccctgaaatggacagtcggagtcgg

SEQ ID NO: 444809 - DNA, 25 bp, Mus musculus
agtcaccttgagaggaggggtcaca

SEQ ID NO: 444810 - DNA, 25 bp, Mus musculus
tacagccctggatactgcgatcgga

SEQ ID NO: 444811 - DNA, 25 bp, Mus musculus
gtcaccggatcgagcgtcggaatct

SEQ ID NO: 444812 - DNA, 25 bp, Mus musculus
cagtgtcatccgtaggaaaggtccc

SEQ ID NO: 444813 - DNA, 25 bp, Mus musculus
gctcggggaacacacggatgtagca

SEQ ID NO: 444814 - DNA, 25 bp, Mus musculus
ccaggtctcttttagtgagaggaac

SEQ ID NO: 444815 - DNA, 25 bp, Mus musculus
tagccgagtcactctgccaggtctc

SEQ ID NO: 444816 - DNA, 25 bp, Mus musculus
aggggtcacaatgactagccgagtc

SEQ ID NO: 444817 - DNA, 25 bp, Mus musculus
ctgcgatcggagaagacaggtgtta

SEQ ID NO: 444818 - DNA, 25 bp, Mus musculus
gccacccaaggatcagcgcgagcga

SEQ ID NO: 444819 - DNA, 25 bp, Mus musculus
gtcgcactgcctgcgtcactatgtg

SEQ ID NO: 444820 - DNA, 25 bp, Mus musculus
cactatgtgagctgacggatgacgc

SEQ ID NO: 444821 - DNA, 25 bp, Mus musculus
cttcttggcgggctaacagtgactt

SEQ ID NO: 444822 - DNA, 25 bp, Mus musculus
acatgtccctcgtatgtagcctagg

SEQ ID NO: 444823 - DNA, 25 bp, Mus musculus
caggccttcagagcgagctgcctta

SEQ ID NO: 444824 - DNA, 25 bp, Mus musculus
ctgccttagcttctaggcgcgacta

SEQ ID NO: 444825 - DNA, 25 bp, Mus musculus
ggcgcgactaatttatgactctaca

SEQ ID NO: 444826 - DNA, 25 bp, Mus musculus
tgggcgtggtttatgcaaatattgc

SEQ ID NO: 444827 - DNA, 25 bp, Mus musculus
cccgtgttgagtattctggggctgc

SEQ ID NO: 444828 - DNA, 25 bp, Mus musculus
tgtgtctgcgccttttggagtcctt

SEQ ID NO: 444829 - DNA, 25 bp, Mus musculus
ggggcacacccaggtacctgcgaga

SEQ ID NO: 444830 - DNA, 25 bp, Mus musculus
ctgggactgcctagtagaaactgac

SEQ ID NO: 444831 - DNA, 25 bp, Mus musculus
gctttaatccacagaacggggctcc

SEQ ID NO: 444832 - DNA, 25 bp, Mus musculus
cacgctgctgtagcaccgggcagca

SEQ ID NO: 444833 - DNA, 25 bp, Mus musculus
cagcatagagcatgcgcgggcagcc

SEQ ID NO: 444834 - DNA, 25 bp, Mus musculus
ggtgcagacacgtttccgttcccaa

SEQ ID NO: 444835 - DNA, 25 bp, Mus musculus
ctaaagtgacactacggtctgaaca

SEQ ID NO: 444836 - DNA, 25 bp, Mus musculus
agcagctcccgagcggtgcagacac

SEQ ID NO: 444837 - DNA, 25 bp, Mus musculus
tgcgagtcccaggtgtagtagcatc

SEQ ID NO: 444838 - DNA, 25 bp, Mus musculus
ttcaggagccgagcgcgcagcatag

SEQ ID NO: 444839 - DNA, 25 bp, Mus musculus
ttcaaattccaaccgctcagtgggc

SEQ ID NO: 444840 - DNA, 25 bp, Mus musculus
gcgtcgcgccggagattcaaattcc

SEQ ID NO: 444841 - DNA, 25 bp, Mus musculus
ggttttactcttcccgcagcgtcgc

SEQ ID NO: 444842 - DNA, 25 bp, Mus musculus
ctctccatgtttgacccagggtttt

SEQ ID NO: 444843 - DNA, 25 bp, Mus musculus
gcggatcccgaactctccatgtttg

SEQ ID NO: 444844 - DNA, 25 bp, Mus musculus
cgttcccaacgagcacgctgctgta

SEQ ID NO: 444845 - DNA, 25 bp, Mus musculus
gcatcggtgccagacgctaaagtga

SEQ ID NO: 444846 - DNA, 25 bp, Mus musculus
aacccacgcccgaggaaagtgcgca

SEQ ID NO: 444847 - DNA, 25 bp, Mus musculus
aaagtgcgcaggctctcatccgtgt

SEQ ID NO: 444848 - DNA, 25 bp, Mus musculus
gtgtcctgtcgctcactcacgcagg

SEQ ID NO: 444849 - DNA, 25 bp, Mus musculus
ccgaggtcctgacagcggccaagat

SEQ ID NO: 444850 - DNA, 25 bp, Mus musculus
aggtgcgccgtctggaaccttccag

SEQ ID NO: 444851 - DNA, 25 bp, Mus musculus
tgactccagccattaaacgggccgg

SEQ ID NO: 444852 - DNA, 25 bp, Mus musculus
gcttagtaccctgtcctatgcctga

SEQ ID NO: 444853 - DNA, 25 bp, Mus musculus
gccgggatgacctagatcggttcta

SEQ ID NO: 444854 - DNA, 25 bp, Mus musculus
cggccctgctagagatcggagaact

SEQ ID NO: 444855 - DNA, 25 bp, Mus musculus
tcggagaactggcttgcgacggaac

SEQ ID NO: 444856 - DNA, 25 bp, Mus musculus
tgcgacggaacagtggccagtttcg

SEQ ID NO: 444857 - DNA, 25 bp, Mus musculus
tgtcttcgcttcttcctcagaggga

SEQ ID NO: 444858 - DNA, 25 bp, Mus musculus
aagggtcagaactgctgtcaggtta

SEQ ID NO: 444859 - DNA, 25 bp, Mus musculus
gggctgcctacctcttgggacaagg

SEQ ID NO: 444860 - DNA, 25 bp, Mus musculus
tctcagtgcctagagccaggtcctc

SEQ ID NO: 444861 - DNA, 25 bp, Mus musculus
ctagtgttccttcccagtctcagtg

SEQ ID NO: 444862 - DNA, 25 bp, Mus musculus
gcgggcctggcatctcttaacctag

SEQ ID NO: 444863 - DNA, 25 bp, Mus musculus
tttgcgctaccgacatagaggtggc

SEQ ID NO: 444864 - DNA, 25 bp, Mus musculus
gtcccagactcccaggtttgcgcta

SEQ ID NO: 444865 - DNA, 25 bp, Mus musculus
tgcacgcctcgagtgcctcagttta

SEQ ID NO: 444866 - DNA, 25 bp, Mus musculus
ttaaatgtctcttgggaggcggatc

SEQ ID NO: 444867 - DNA, 25 bp, Mus musculus
cagcagccgctacccttaatttaga

SEQ ID NO: 444868 - DNA, 25 bp, Mus musculus
tcagcgcttcctctgagtgacaggc

SEQ ID NO: 444869 - DNA, 25 bp, Mus musculus
gtcagcagaggccacaagacccttg

SEQ ID NO: 444870 - DNA, 25 bp, Mus musculus
gctcactgcggctgtaaaaaccttg

SEQ ID NO: 444871 - DNA, 25 bp, Mus musculus
caacgggccaatttgactccgaatt

SEQ ID NO: 444872 - DNA, 25 bp, Mus musculus
cagccgtcggaagcaaaactagctc

SEQ ID NO: 444873 - DNA, 25 bp, Mus musculus
cccggcatattttccacgaggctga

SEQ ID NO: 444874 - DNA, 25 bp, Mus musculus
ggagccacttccgagttggagagaa

SEQ ID NO: 444875 - DNA, 25 bp, Mus musculus
agcggagactgcaggaagctgctct

SEQ ID NO: 444876 - DNA, 25 bp, Mus musculus
tgctctggccgtagttctcgatgct

SEQ ID NO: 444877 - DNA, 25 bp, Mus musculus
agctctggagagaacgcccgaacta

SEQ ID NO: 444878 - DNA, 25 bp, Mus musculus
cgcccgaactaagctggagttccct

SEQ ID NO: 444879 - DNA, 25 bp, Mus musculus
aaggcggacaaggatcctcagaatc

SEQ ID NO: 444880 - DNA, 25 bp, Mus musculus
cccgcgctctatggtagcggagact

SEQ ID NO: 444881 - DNA, 25 bp, Mus musculus
tcccaggattccacggggctatgtg

SEQ ID NO: 444882 - DNA, 25 bp, Mus musculus
ggctatgtgcaccacttccgttgtg

SEQ ID NO: 444883 - DNA, 25 bp, Mus musculus
cgttgtgttggaagctgaggaatac

SEQ ID NO: 444884 - DNA, 25 bp, Mus musculus
agctaggcccttgtcccggagtgac

SEQ ID NO: 444885 - DNA, 25 bp, Mus musculus
tgcggtttagagtgacagctaggcc

SEQ ID NO: 444886 - DNA, 25 bp, Mus musculus
tgacggaggttaagtcgagccgact

SEQ ID NO: 444887 - DNA, 25 bp, Mus musculus
tttttaatagctcgaggcgaaggcg

SEQ ID NO: 444888 - DNA, 25 bp, Mus musculus
ccgggacgcaggttaccatgttcac

SEQ ID NO: 444889 - DNA, 25 bp, Mus musculus
accatgttcactggatcctgggtcc

SEQ ID NO: 444890 - DNA, 25 bp, Mus musculus
ctcggttccctctgacaggtttctg

SEQ ID NO: 444891 - DNA, 25 bp, Mus musculus
cgtttcaaaacgctgatgccagttg

SEQ ID NO: 444892 - DNA, 25 bp, Mus musculus
aaagtcagagagctcctgctgctgc

SEQ ID NO: 444893 - DNA, 25 bp, Mus musculus
agcggctacagcaacaaagtcgcca

SEQ ID NO: 444894 - DNA, 25 bp, Mus musculus
gtctggagctaaagcgacgccctcc

SEQ ID NO: 444895 - DNA, 25 bp, Mus musculus
ctctagatcctaggcgggaagggtt

SEQ ID NO: 444896 - DNA, 25 bp, Mus musculus
ggggcgcctcaaccctgaaatgtga

SEQ ID NO: 444897 - DNA, 25 bp, Mus musculus
aatgtgacaaaggaagtcccgcctc

SEQ ID NO: 444898 - DNA, 25 bp, Mus musculus
gtgaggacctccatgcgtaagaatc

SEQ ID NO: 444899 - DNA, 25 bp, Mus musculus
taagaatctgagtttggagacgcgc

SEQ ID NO: 444900 - DNA, 25 bp, Mus musculus
cccgcaggcagttcggagtcagttt

SEQ ID NO: 444901 - DNA, 25 bp, Mus musculus
ctctccctgggtcgcgtctctagat

SEQ ID NO: 444902 - DNA, 25 bp, Mus musculus
ggcccgatcagctgtgaggtgtccc

SEQ ID NO: 444903 - DNA, 25 bp, Mus musculus
cggcgggcgccctcccacctcagcc

SEQ ID NO: 444904 - DNA, 25 bp, Mus musculus
gcagctctttgctctcccggcccga

SEQ ID NO: 444905 - DNA, 25 bp, Mus musculus
cggcctgccggggaagtcacactcg

SEQ ID NO: 444906 - DNA, 25 bp, Mus musculus
gctctggcttctcgcagctctttgc

SEQ ID NO: 444907 - DNA, 25 bp, Mus musculus
atgtcccagtccttccgcggcgggc

SEQ ID NO: 444908 - DNA, 25 bp, Mus musculus
gcctgcccatgtcccagtccttccg

SEQ ID NO: 444909 - DNA, 25 bp, Mus musculus
cgcttcgctccctgcctgcccatgt

SEQ ID NO: 444910 - DNA, 25 bp, Mus musculus
gaagccgtcactgggagagtcaccc

SEQ ID NO: 444911 - DNA, 25 bp, Mus musculus
agaagccgtcactgggagagtcacc

SEQ ID NO: 444912 - DNA, 25 bp, Mus musculus
caggagcttcgggagaagccgtcac

SEQ ID NO: 444913 - DNA, 25 bp, Mus musculus
gccgccgcagctccggatgggacca

SEQ ID NO: 444914 - DNA, 25 bp, Mus musculus
ccgaggcgacctgacctggacgagc

SEQ ID NO: 444915 - DNA, 25 bp, Mus musculus
ctcccggcccgatcagctgtgaggt

SEQ ID NO: 444916 - DNA, 25 bp, Mus musculus
agagtgtcgcctgcaggcgcagccc

SEQ ID NO: 444917 - DNA, 25 bp, Mus musculus
agcacagcagcagccatcttcctga

SEQ ID NO: 444918 - DNA, 25 bp, Mus musculus
cggaacgcgccagtgcctgcaagac

SEQ ID NO: 444919 - DNA, 25 bp, Mus musculus
ttgaggtaagccgagagctggctcc

SEQ ID NO: 444920 - DNA, 25 bp, Mus musculus
gggtcccgtcgtacatctcattggc

SEQ ID NO: 444921 - DNA, 25 bp, Mus musculus
acccttggtcgaggcagtggctccg

SEQ ID NO: 444922 - DNA, 25 bp, Mus musculus
cggaatttgacccttggtcgaggca

SEQ ID NO: 444923 - DNA, 25 bp, Mus musculus
cgcccgcagagtcccggaatttgac

SEQ ID NO: 444924 - DNA, 25 bp, Mus musculus
gggactggagtcagacctgcccgcc

SEQ ID NO: 444925 - DNA, 25 bp, Mus musculus
gcttctctccgggactggagtcaga

SEQ ID NO: 444926 - DNA, 25 bp, Mus musculus
gtcgcaggcagatcgcttctctccg

SEQ ID NO: 444927 - DNA, 25 bp, Mus musculus
ctgttcccagaagcggtcgcaggca

SEQ ID NO: 444928 - DNA, 25 bp, Mus musculus
cgagagctggctcccggacagcagc

SEQ ID NO: 444929 - DNA, 25 bp, Mus musculus
atctcattggctgcctctgcgaacg

SEQ ID NO: 444930 - DNA, 25 bp, Mus musculus
tacgagcgtcccgtgctggcctggc

SEQ ID NO: 444931 - DNA, 25 bp, Mus musculus
ccggagtcgcccaggcctgaactcc

SEQ ID NO: 444932 - DNA, 25 bp, Mus musculus
cgggctttgctgagagcggccaatc

SEQ ID NO: 444933 - DNA, 25 bp, Mus musculus
gctgagagcggccaatcgcatgggg

SEQ ID NO: 444934 - DNA, 25 bp, Mus musculus
gagcgtcaggcgagcgtcacgccgc

SEQ ID NO: 444935 - DNA, 25 bp, Mus musculus
tggttaacgccggttcagcgcagcc

SEQ ID NO: 444936 - DNA, 25 bp, Mus musculus
ggttaacgccggttcagcgcagccc

SEQ ID NO: 444937 - DNA, 25 bp, Mus musculus
agcccgcgaggacgccagaggccac

SEQ ID NO: 444938 - DNA, 25 bp, Mus musculus
agccgcgggtcagctctacgagcgt

SEQ ID NO: 444939 - DNA, 25 bp, Mus musculus
gcgggtcagctctacgagcgtcccg

SEQ ID NO: 444940 - DNA, 25 bp, Mus musculus
ggtcagctctacgagcgtcccgtgc

SEQ ID NO: 444941 - DNA, 25 bp, Mus musculus
gctttgctgagagcggccaatcgca

SEQ ID NO: 444942 - DNA, 25 bp, Mus musculus
agctctacgagcgtcccgtgctggc

SEQ ID NO: 444943 - DNA, 25 bp, Mus musculus
tcagctctacgagcgtcccgtgctg

SEQ ID NO: 444944 - DNA, 25 bp, Mus musculus
cccggcatccagaacgaaaggcacg

SEQ ID NO: 444945 - DNA, 25 bp, Mus musculus
cgggccgttcaggtaccagaccaga

SEQ ID NO: 444946 - DNA, 25 bp, Mus musculus
tcttttgtggatggcggctccatgt

SEQ ID NO: 444947 - DNA, 25 bp, Mus musculus
caatcttttgtggatggcggctcca

SEQ ID NO: 444948 - DNA, 25 bp, Mus musculus
cacgggcaatcttttgtggatggcg

SEQ ID NO: 444949 - DNA, 25 bp, Mus musculus
ccgggaacggattggcgtctccgca

SEQ ID NO: 444950 - DNA, 25 bp, Mus musculus
tccagaacgaaaggcacgggcaatc

SEQ ID NO: 444951 - DNA, 25 bp, Mus musculus
tatcccggcatccagaacgaaaggc

SEQ ID NO: 444952 - DNA, 25 bp, Mus musculus
atgggagtctatcccggcatccaga

SEQ ID NO: 444953 - DNA, 25 bp, Mus musculus
tcagatgggagtctatcccggcatc

SEQ ID NO: 444954 - DNA, 25 bp, Mus musculus
tggcggtcagatgggagtctatccc

SEQ ID NO: 444955 - DNA, 25 bp, Mus musculus
tggcgtctccgcactcacagtatca

SEQ ID NO: 444956 - DNA, 25 bp, Mus musculus
acggattggcgtctccgcactcaca

SEQ ID NO: 444957 - DNA, 25 bp, Mus musculus
aaaggcacgggcaatcttttgtgga

SEQ ID NO: 444958 - DNA, 25 bp, Mus musculus
cgggaggttttgaaaactctgagcg

SEQ ID NO: 444959 - DNA, 25 bp, Mus musculus
gctgctacttctgctggccgcggcg

SEQ ID NO: 444960 - DNA, 25 bp, Mus musculus
gcgcagcgcgctgctacttctgctg

SEQ ID NO: 444961 - DNA, 25 bp, Mus musculus
tgggtccgagcatcccgcggcttcg

SEQ ID NO: 444962 - DNA, 25 bp, Mus musculus
ctacggccaggctgggtccgagcat

SEQ ID NO: 444963 - DNA, 25 bp, Mus musculus
gccaatcaccagagagccaaggcgc

SEQ ID NO: 444964 - DNA, 25 bp, Mus musculus
tgaggagtgcctcagcgctccaaga

SEQ ID NO: 444965 - DNA, 25 bp, Mus musculus
tttgaaaactctgagcggccggggc

SEQ ID NO: 444966 - DNA, 25 bp, Mus musculus
ataacaaagagccagggtccagggc

SEQ ID NO: 444967 - DNA, 25 bp, Mus musculus
tggcccataacaaagagccagggtc

SEQ ID NO: 444968 - DNA, 25 bp, Mus musculus
ggcgacacacagctggcccataaca

SEQ ID NO: 444969 - DNA, 25 bp, Mus musculus
gagtccgaaggcgacacacagctgg

SEQ ID NO: 444970 - DNA, 25 bp, Mus musculus
cgtttgaagaccgcagcccgggagc

SEQ ID NO: 444971 - DNA, 25 bp, Mus musculus
gagccgcagccaatcaccagagagc

SEQ ID NO: 444972 - DNA, 25 bp, Mus musculus
ggcggaatcccacccggccaaatga

SEQ ID NO: 444973 - DNA, 25 bp, Mus musculus
gagcggctgtttctggttcaaccag

SEQ ID NO: 444974 - DNA, 25 bp, Mus musculus
tgctctaggagacaaggcacgctca

SEQ ID NO: 444975 - DNA, 25 bp, Mus musculus
agcattcgtatccacatctggaccg

SEQ ID NO: 444976 - DNA, 25 bp, Mus musculus
cgcgcacttgctgctctaggagaca

SEQ ID NO: 444977 - DNA, 25 bp, Mus musculus
cccggccaaatgaattctaggggtg

SEQ ID NO: 444978 - DNA, 25 bp, Mus musculus
gcctgcagctgcctttgccttataa

SEQ ID NO: 444979 - DNA, 25 bp, Mus musculus
gcgcacacagcaggccatgggcaaa

SEQ ID NO: 444980 - DNA, 25 bp, Mus musculus
gggcaaatcaggtgagccacccata

SEQ ID NO: 444981 - DNA, 25 bp, Mus musculus
gggatgacgcctagaccctcgccgt

SEQ ID NO: 444982 - DNA, 25 bp, Mus musculus
ctctcgctgcaatgcgggatccctg

SEQ ID NO: 444983 - DNA, 25 bp, Mus musculus
atggagagcgcgcatagcaaagttc

SEQ ID NO: 444984 - DNA, 25 bp, Mus musculus
caaagttccgaggagcggctgtttc

SEQ ID NO: 444985 - DNA, 25 bp, Mus musculus
ggcacgctcagaatcagcattcgta

SEQ ID NO: 444986 - DNA, 25 bp, Mus musculus
gcacactcgggtcggtgctcttacg

SEQ ID NO: 444987 - DNA, 25 bp, Mus musculus
ctctgcggttgagttgggctgtcat

SEQ ID NO: 444988 - DNA, 25 bp, Mus musculus
ctgtcatggccgagttggatccatt

SEQ ID NO: 444989 - DNA, 25 bp, Mus musculus
cttggcgcagcaagagagtgagatt

SEQ ID NO: 444990 - DNA, 25 bp, Mus musculus
gaacgatgaggccttcgccatcctg

SEQ ID NO: 444991 - DNA, 25 bp, Mus musculus
tgctcttacgcggaacttgggcttc

SEQ ID NO: 444992 - DNA, 25 bp, Mus musculus
ttctggctgaagctttagaagcgca

SEQ ID NO: 444993 - DNA, 25 bp, Mus musculus
ccgtctgggtcattgcacggacctc

SEQ ID NO: 444994 - DNA, 25 bp, Mus musculus
ttgcacggacctccgctgctgcaga

SEQ ID NO: 444995 - DNA, 25 bp, Mus musculus
tagcagccgccagcacagtgtcggc

SEQ ID NO: 444996 - DNA, 25 bp, Mus musculus
cgcagatgcaccgactgtcaggatc

SEQ ID NO: 444997 - DNA, 25 bp, Mus musculus
cgagttggatccattcggcgctccc

SEQ ID NO: 444998 - DNA, 25 bp, Mus musculus
cagactgccggcttctgagtgctgc

SEQ ID NO: 444999 - DNA, 25 bp, Mus musculus
tgagattgcgggcatcgagaacgat

SEQ ID NO: 445000 - DNA, 25 bp, Mus musculus
gtcaggctcgcctttatcgtctagc

SEQ ID NO: 445001 - DNA, 25 bp, Mus musculus
gaggacgctggctcagtccaagccg

SEQ ID NO: 445002 - DNA, 25 bp, Mus musculus
gtccaagccgcagatcctgatacca

SEQ ID NO: 445003 - DNA, 25 bp, Mus musculus
gatcctgataccagcagggctccga

SEQ ID NO: 445004 - DNA, 25 bp, Mus musculus
gcggagacggatcggcacccgacaa

SEQ ID NO: 445005 - DNA, 25 bp, Mus musculus
ggatcggcacccgacaactgcgaca

SEQ ID NO: 445006 - DNA, 25 bp, Mus musculus
tccgccttgtttctgaccacgaaag

SEQ ID NO: 445007 - DNA, 25 bp, Mus musculus
ttctgaccacgaaagcctccgagcg

SEQ ID NO: 445008 - DNA, 25 bp, Mus musculus
gaccctccctgcgttttgcgtgaag

SEQ ID NO: 445009 - DNA, 25 bp, Mus musculus
cctgcgttttgcgtgaagttgttgg

SEQ ID NO: 445010 - DNA, 25 bp, Mus musculus
aagttgttggtcttgccaggtcgca

SEQ ID NO: 445011 - DNA, 25 bp, Mus musculus
cccgctcaggtgaactaggtcagac

SEQ ID NO: 445012 - DNA, 25 bp, Mus musculus
tcaggtgaactaggtcagactctcc

SEQ ID NO: 445013 - DNA, 25 bp, Mus musculus
ttatcgtctagcacggaggacgctg

SEQ ID NO: 445014 - DNA, 25 bp, Mus musculus
cacgctgagtctgacagctccggga

SEQ ID NO: 445015 - DNA, 25 bp, Mus musculus
tcggcacttggcaggctcgcgtcca

SEQ ID NO: 445016 - DNA, 25 bp, Mus musculus
ctggccaggcctacctctgcaagcc

SEQ ID NO: 445017 - DNA, 25 bp, Mus musculus
ttcacccgcacgctgagtctgacag

SEQ ID NO: 445018 - DNA, 25 bp, Mus musculus
agaggcgccctgctgcgtagaaccc

SEQ ID NO: 445019 - DNA, 25 bp, Mus musculus
ccggagcctggcacgatgctcgtga

SEQ ID NO: 445020 - DNA, 25 bp, Mus musculus
acgatgctcgtgagtcaccgactga

SEQ ID NO: 445021 - DNA, 25 bp, Mus musculus
tgctgcgtagaacccggacgcccag

SEQ ID NO: 445022 - DNA, 25 bp, Mus musculus
ctgactcgtggcctccgccgggtta

SEQ ID NO: 445023 - DNA, 25 bp, Mus musculus
cggagcgccgaacggtcgatcgctc

SEQ ID NO: 445024 - DNA, 25 bp, Mus musculus
cctccttggcgtatttctgttggtc

SEQ ID NO: 445025 - DNA, 25 bp, Mus musculus
ttctgttggtcagtcgtgtggcgca

SEQ ID NO: 445026 - DNA, 25 bp, Mus musculus
tgtggcgcaccttccgctgtcgtgt

SEQ ID NO: 445027 - DNA, 25 bp, Mus musculus
cgtgagtcaccgactgactcgtggc

SEQ ID NO: 445028 - DNA, 25 bp, Mus musculus
gtgacatcatcacttcacctgcgtc

SEQ ID NO: 445029 - DNA, 25 bp, Mus musculus
gagttctcccaagtgacatcatcac

SEQ ID NO: 445030 - DNA, 25 bp, Mus musculus
ttcacctgcgtctcgtccaggcagg

SEQ ID NO: 445031 - DNA, 25 bp, Mus musculus
gttccggcaacagagccggtgcgca

SEQ ID NO: 445032 - DNA, 25 bp, Mus musculus
caggctgccgggaaacgtccgccga

SEQ ID NO: 445033 - DNA, 25 bp, Mus musculus
gggccgccgcctcctattgtgactg

SEQ ID NO: 445034 - DNA, 25 bp, Mus musculus
aacccgggttccgactgaggcgctg

SEQ ID NO: 445035 - DNA, 25 bp, Mus musculus
actgaggcgctgtcacggcgcttcc

SEQ ID NO: 445036 - DNA, 25 bp, Mus musculus
tgtcacggcgcttccttcctcttgg

SEQ ID NO: 445037 - DNA, 25 bp, Mus musculus
caagcgctacgcttcgaaccgcaga

SEQ ID NO: 445038 - DNA, 25 bp, Mus musculus
ttcgaaccgcagaactcgacagcct

SEQ ID NO: 445039 - DNA, 25 bp, Mus musculus
ccagccaagcgcaggatcgccgggt

SEQ ID NO: 445040 - DNA, 25 bp, Mus musculus
ggatcgccgggtagctccgcctctt

SEQ ID NO: 445041 - DNA, 25 bp, Mus musculus
tcactcgctcggcttgctcgggcgg

SEQ ID NO: 445042 - DNA, 25 bp, Mus musculus
cctcacgaggtcctgccctgcccac

SEQ ID NO: 445043 - DNA, 25 bp, Mus musculus
tgcgaaaacgctttgtgaggcgctc

SEQ ID NO: 445044 - DNA, 25 bp, Mus musculus
ggtctcccgggctggacaaagctgt

SEQ ID NO: 445045 - DNA, 25 bp, Mus musculus
tgtggcgggcaaggctcctccctct

SEQ ID NO: 445046 - DNA, 25 bp, Mus musculus
cccgtacctgctccgggcgctctgc

SEQ ID NO: 445047 - DNA, 25 bp, Mus musculus
ctctgccgcaggcaccgacaccctg

SEQ ID NO: 445048 - DNA, 25 bp, Mus musculus
agacgacgaccgaggctggaagtgc

SEQ ID NO: 445049 - DNA, 25 bp, Mus musculus
gcagcggctcggactgcgactcgac

SEQ ID NO: 445050 - DNA, 25 bp, Mus musculus
ggctcggactgcgactcgactccgg

SEQ ID NO: 445051 - DNA, 25 bp, Mus musculus
gcgccgccaatgagcgctgggctcc

SEQ ID NO: 445052 - DNA, 25 bp, Mus musculus
gtctagggggatcctcagcagccgc

SEQ ID NO: 445053 - DNA, 25 bp, Mus musculus
aggcccgggccaaagctctcggcat

SEQ ID NO: 445054 - DNA, 25 bp, Mus musculus
tgcccagcgggtgcgaaaacgcttt

SEQ ID NO: 445055 - DNA, 25 bp, Mus musculus
gggccaaagctctcggcatctgcgc

SEQ ID NO: 445056 - DNA, 25 bp, Mus musculus
cgccgcacctgggtgatgggcacct

SEQ ID NO: 445057 - DNA, 25 bp, Mus musculus
actgaggacctgacaggcgcgcgct

SEQ ID NO: 445058 - DNA, 25 bp, Mus musculus
ttaatagactgcgagcgagtgctcc

SEQ ID NO: 445059 - DNA, 25 bp, Mus musculus
cccgaggagctatcatcaggcgagt

SEQ ID NO: 445060 - DNA, 25 bp, Mus musculus
cccggagcaggatttattagcagac

SEQ ID NO: 445061 - DNA, 25 bp, Mus musculus
tattagcagacaggatggggaagtt

SEQ ID NO: 445062 - DNA, 25 bp, Mus musculus
gggaagttgattagcctcagcggct

SEQ ID NO: 445063 - DNA, 25 bp, Mus musculus
ctcagcggctgaacggacatcctgt

SEQ ID NO: 445064 - DNA, 25 bp, Mus musculus
gacatcctgtcagccgggtctctta

SEQ ID NO: 445065 - DNA, 25 bp, Mus musculus
ccgggtctcttaatccaatcactta

SEQ ID NO: 445066 - DNA, 25 bp, Mus musculus
aatccaatcacttacctgtcgggcc

SEQ ID NO: 445067 - DNA, 25 bp, Mus musculus
ccaggggacccaggccaagtcttcg

SEQ ID NO: 445068 - DNA, 25 bp, Mus musculus
gccaagtcttcgacggtcccgtgct

SEQ ID NO: 445069 - DNA, 25 bp, Mus musculus
gcgcgctgcctccttaatagactgc

SEQ ID NO: 445070 - DNA, 25 bp, Mus musculus
cgattagttttatctcggaacgtca

SEQ ID NO: 445071 - DNA, 25 bp, Mus musculus
gcttcctgccgccaaatgtcaatta

SEQ ID NO: 445072 - DNA, 25 bp, Mus musculus
agtcattcattacggggcttctccc

SEQ ID NO: 445073 - DNA, 25 bp, Mus musculus
ggccggcagctactctcatgctcag

SEQ ID NO: 445074 - DNA, 25 bp, Mus musculus
tgcaaatgttcagcggaggcccagc

SEQ ID NO: 445075 - DNA, 25 bp, Mus musculus
gacttatactgattggcttcctgcc

SEQ ID NO: 445076 - DNA, 25 bp, Mus musculus
tcggaacgtcaattgacttatactg

SEQ ID NO: 445077 - DNA, 25 bp, Mus musculus
agcagcgaccgaccgccgattagtt

SEQ ID NO: 445078 - DNA, 25 bp, Mus musculus
aactcaattgttctcagcagggccc

SEQ ID NO: 445079 - DNA, 25 bp, Mus musculus
gctggcatccgttgttaccataaca

SEQ ID NO: 445080 - DNA, 25 bp, Mus musculus
agctcgcgcatcatctgctcggctg

SEQ ID NO: 445081 - DNA, 25 bp, Mus musculus
caggctcggctgtaacacttgctcc

SEQ ID NO: 445082 - DNA, 25 bp, Mus musculus
tactctcatgctcagccaggctcgg

SEQ ID NO: 445083 - DNA, 25 bp, Mus musculus
ttgagttctcctcctacgccgcgag

SEQ ID NO: 445084 - DNA, 25 bp, Mus musculus
gtggattgtccctgccttgcctctt

SEQ ID NO: 445085 - DNA, 25 bp, Mus musculus
ggctgcttcggtcttgctgcctcga

SEQ ID NO: 445086 - DNA, 25 bp, Mus musculus
tctcggcgccaaaggactgcccagg

SEQ ID NO: 445087 - DNA, 25 bp, Mus musculus
ccgggcacagtgtgagcagagatca

SEQ ID NO: 445088 - DNA, 25 bp, Mus musculus
aaaacacctctgcagccgtggggtc

SEQ ID NO: 445089 - DNA, 25 bp, Mus musculus
aaacggtgctctcagccagtcggtc

SEQ ID NO: 445090 - DNA, 25 bp, Mus musculus
ccacctccaggacggctaggggagc

SEQ ID NO: 445091 - DNA, 25 bp, Mus musculus
caggtccttcttgtttcccgcttct

SEQ ID NO: 445092 - DNA, 25 bp, Mus musculus
tttcccgcttctccgtgtctctgga

SEQ ID NO: 445093 - DNA, 25 bp, Mus musculus
tcttctgtcggctctctgacgtctc

SEQ ID NO: 445094 - DNA, 25 bp, Mus musculus
gacgtctccgacgaagttacagaga

SEQ ID NO: 445095 - DNA, 25 bp, Mus musculus
aagctgcaaccctcgaagcccggga

SEQ ID NO: 445096 - DNA, 25 bp, Mus musculus
gcctggctgtggttcacgctaccaa

SEQ ID NO: 445097 - DNA, 25 bp, Mus musculus
cgcttgccttcaaagttcccgcggg

SEQ ID NO: 445098 - DNA, 25 bp, Mus musculus
ctggggtagctgatcactgagctga

SEQ ID NO: 445099 - DNA, 25 bp, Mus musculus
ggaaagattcagactgcgcccggcc

SEQ ID NO: 445100 - DNA, 25 bp, Mus musculus
tcggaataattgaagccttccgctc

SEQ ID NO: 445101 - DNA, 25 bp, Mus musculus
cctcggtgccgccttggacttttat

SEQ ID NO: 445102 - DNA, 25 bp, Mus musculus
cagagagcagcaatgccgcctcggt

SEQ ID NO: 445103 - DNA, 25 bp, Mus musculus
accagggaaagggtgtcagctctgc

SEQ ID NO: 445104 - DNA, 25 bp, Mus musculus
cactgcgggccaagaaccagggaaa

SEQ ID NO: 445105 - DNA, 25 bp, Mus musculus
gttctcgccaacatcacaagatgtc

SEQ ID NO: 445106 - DNA, 25 bp, Mus musculus
agatcatgtcctgttctcgccaaca

SEQ ID NO: 445107 - DNA, 25 bp, Mus musculus
tctcgccatgtgagatcatgtcctg

SEQ ID NO: 445108 - DNA, 25 bp, Mus musculus
ggaactaaagagcttctcgccatgt

SEQ ID NO: 445109 - DNA, 25 bp, Mus musculus
cgtccgaaggcaccgtgaaatgatt

SEQ ID NO: 445110 - DNA, 25 bp, Mus musculus
agtcacagggtcgtacccgcttcca

SEQ ID NO: 445111 - DNA, 25 bp, Mus musculus
cactgagctgaaactaaacgtttta

SEQ ID NO: 445112 - DNA, 25 bp, Mus musculus
gggattcactctagggcggtcgcta

SEQ ID NO: 445113 - DNA, 25 bp, Mus musculus
aatacgggattcactctagggcggt

SEQ ID NO: 445114 - DNA, 25 bp, Mus musculus
atacgggattcactctagggcggtc

SEQ ID NO: 445115 - DNA, 25 bp, Mus musculus
gggcggtcgctatgctgtgaccccc

SEQ ID NO: 445116 - DNA, 25 bp, Mus musculus
taatacgggattcactctagggcgg

SEQ ID NO: 445117 - DNA, 25 bp, Mus musculus
ccaatacgggattcactctagggcg

SEQ ID NO: 445118 - DNA, 25 bp, Mus musculus
cgggattcactctagggcggtcgct

SEQ ID NO: 445119 - DNA, 25 bp, Mus musculus
atacgggattcactctagggcagtc

SEQ ID NO: 445120 - DNA, 25 bp, Mus musculus
gggattcactctagggcagtcgcta

SEQ ID NO: 445121 - DNA, 25 bp, Mus musculus
tcactctagggcagtcgctatgctg

SEQ ID NO: 445122 - DNA, 25 bp, Mus musculus
ctagggcagtcgctatgctgtgacc

SEQ ID NO: 445123 - DNA, 25 bp, Mus musculus
caatacgggattcactctagggcgg

SEQ ID NO: 445124 - DNA, 25 bp, Mus musculus
ccccaatacgggattcactctaggg

SEQ ID NO: 445125 - DNA, 25 bp, Mus musculus
ggattcactctagggcggtcgctat

SEQ ID NO: 445126 - DNA, 25 bp, Mus musculus
gcaattcagaattccctccgcggta

SEQ ID NO: 445127 - DNA, 25 bp, Mus musculus
cgggtttgccagactccgaaatata

SEQ ID NO: 445128 - DNA, 25 bp, Mus musculus
catggcgttgctctatgtgcgcttc

SEQ ID NO: 445129 - DNA, 25 bp, Mus musculus
ttcgcaccagcgtggaacaaacgtg

SEQ ID NO: 445130 - DNA, 25 bp, Mus musculus
acaaacgtgcgctgcgttcccgagg

SEQ ID NO: 445131 - DNA, 25 bp, Mus musculus
gttgcaagccacaaactccggggtc

SEQ ID NO: 445132 - DNA, 25 bp, Mus musculus
cctgatgctgggatcgcaattcaga

SEQ ID NO: 445133 - DNA, 25 bp, Mus musculus
tcagcgcgctttcaacttctccaaa

SEQ ID NO: 445134 - DNA, 25 bp, Mus musculus
caacgttgaacacagaggcggctcc

SEQ ID NO: 445135 - DNA, 25 bp, Mus musculus
ctgcggagcaggtgacaaactaaac

SEQ ID NO: 445136 - DNA, 25 bp, Mus musculus
actaaaccacttcggatgacacgga

SEQ ID NO: 445137 - DNA, 25 bp, Mus musculus
tgcggccctagagataccgagtcaa

SEQ ID NO: 445138 - DNA, 25 bp, Mus musculus
tcctttgcccattcggccagctgtg

SEQ ID NO: 445139 - DNA, 25 bp, Mus musculus
acacggaattgatgctgcggcccta

SEQ ID NO: 445140 - DNA, 25 bp, Mus musculus
ggcttccttacctcatttgtcctcg

SEQ ID NO: 445141 - DNA, 25 bp, Mus musculus
cgtcttctctgtcggcgttactcca

SEQ ID NO: 445142 - DNA, 25 bp, Mus musculus
ggcacgtcttctctgtcggcgttac

SEQ ID NO: 445143 - DNA, 25 bp, Mus musculus
cgatggccttgacgggcacgtcttc

SEQ ID NO: 445144 - DNA, 25 bp, Mus musculus
agtgcagcgcagcaaatggcctctc

SEQ ID NO: 445145 - DNA, 25 bp, Mus musculus
ggagctgtggaactaatgcgtgccc

SEQ ID NO: 445146 - DNA, 25 bp, Mus musculus
ctcgcccgcggagctgtggaactaa

SEQ ID NO: 445147 - DNA, 25 bp, Mus musculus
agtatgtgtgtgacggaccccgagc

SEQ ID NO: 445148 - DNA, 25 bp, Mus musculus
ctctacgcgtttcggttcctggttg

SEQ ID NO: 445149 - DNA, 25 bp, Mus musculus
caagagctctgttttccccggaagt

SEQ ID NO: 445150 - DNA, 25 bp, Mus musculus
ttacgcatgcgctcggaggactcgc

SEQ ID NO: 445151 - DNA, 25 bp, Mus musculus
ttgggcggaaggacagctcccaaga

SEQ ID NO: 445152 - DNA, 25 bp, Mus musculus
ttcctggttggtgcttcctggtcgc

SEQ ID NO: 445153 - DNA, 25 bp, Mus musculus
ttctcctccctggagtccgcgcgga

SEQ ID NO: 445154 - DNA, 25 bp, Mus musculus
gtctctgaagatgctcctggggtca

SEQ ID NO: 445155 - DNA, 25 bp, Mus musculus
gctctgcagacagcctcgcgtgagt

SEQ ID NO: 445156 - DNA, 25 bp, Mus musculus
ggatacctgcccttctctgttctga

SEQ ID NO: 445157 - DNA, 25 bp, Mus musculus
atgctcctggggtcaggtgtgcctc

SEQ ID NO: 445158 - DNA, 25 bp, Mus musculus
ctctgttctgacacacggagtgggg

SEQ ID NO: 445159 - DNA, 25 bp, Mus musculus
ttccgtgtctctgaagatgctcctg

SEQ ID NO: 445160 - DNA, 25 bp, Mus musculus
agggattcgccttccgtgtctctga

SEQ ID NO: 445161 - DNA, 25 bp, Mus musculus
caaacgcctacgatggtgagtggtg

SEQ ID NO: 445162 - DNA, 25 bp, Mus musculus
gtgcaaacgcctacgatggtgagtg

SEQ ID NO: 445163 - DNA, 25 bp, Mus musculus
gggcagtggacaccccatgtgcaaa

SEQ ID NO: 445164 - DNA, 25 bp, Mus musculus
cactgtccaggctttccggggatgg

SEQ ID NO: 445165 - DNA, 25 bp, Mus musculus
tgagtgcactgtccaggctttccgg

SEQ ID NO: 445166 - DNA, 25 bp, Mus musculus
acagcctcgcgtgagtgcactgtcc

SEQ ID NO: 445167 - DNA, 25 bp, Mus musculus
cacgtggatacctgcccttctctgt

SEQ ID NO: 445168 - DNA, 25 bp, Mus musculus
gcagcagatctgcagggcactagtc

SEQ ID NO: 445169 - DNA, 25 bp, Mus musculus
tagctgatagggtcgcctcacctga

SEQ ID NO: 445170 - DNA, 25 bp, Mus musculus
tcccgctaggatgcagatcccgagc

SEQ ID NO: 445171 - DNA, 25 bp, Mus musculus
tccgctcggaccgaccctgaggaag

SEQ ID NO: 445172 - DNA, 25 bp, Mus musculus
ggctcccgaatccagacagcttatg

SEQ ID NO: 445173 - DNA, 25 bp, Mus musculus
gcgcccaggccactctagctgatag

SEQ ID NO: 445174 - DNA, 25 bp, Mus musculus
cctcagcagtaagacagggtggaca

SEQ ID NO: 445175 - DNA, 25 bp, Mus musculus
aagaactgagctaccaccctcctgg

SEQ ID NO: 445176 - DNA, 25 bp, Mus musculus
ggacgcctgcgcacaagaactgagc

SEQ ID NO: 445177 - DNA, 25 bp, Mus musculus
gagaggctccatgtccagcagcaga

SEQ ID NO: 445178 - DNA, 25 bp, Mus musculus
acccagggcaggatcaagagagcca

SEQ ID NO: 445179 - DNA, 25 bp, Mus musculus
ctcatcgctcaggaggacccagggc

SEQ ID NO: 445180 - DNA, 25 bp, Mus musculus
tggccttgctctgatgaaacgaaac

SEQ ID NO: 445181 - DNA, 25 bp, Mus musculus
cttcagcccgttcgcgcggttcttt

SEQ ID NO: 445182 - DNA, 25 bp, Mus musculus
gcgagctcatggctactctggagtc

SEQ ID NO: 445183 - DNA, 25 bp, Mus musculus
tgtgctgggtaaagaccgccgaccc

SEQ ID NO: 445184 - DNA, 25 bp, Mus musculus
cccgacgacaggcagaaagctgtgc

SEQ ID NO: 445185 - DNA, 25 bp, Mus musculus
ctgtactgtggagagcccgacgaca

SEQ ID NO: 445186 - DNA, 25 bp, Mus musculus
cgctacagagtgcaaggtggctgta

SEQ ID NO: 445187 - DNA, 25 bp, Mus musculus
gagacacggagacagaggcgctaca

SEQ ID NO: 445188 - DNA, 25 bp, Mus musculus
tctggagtctcctgggatggatgac

SEQ ID NO: 445189 - DNA, 25 bp, Mus musculus
tccgcgtgtgaaccggcgagctcat

SEQ ID NO: 445190 - DNA, 25 bp, Mus musculus
cacttccggtttttgagtccgcgtg

SEQ ID NO: 445191 - DNA, 25 bp, Mus musculus
ggcggggcctagaatgtcacttccg

SEQ ID NO: 445192 - DNA, 25 bp, Mus musculus
ttccgcgtaatcctttccgcttctg

SEQ ID NO: 445193 - DNA, 25 bp, Mus musculus
atctatcgtcaccacttcggactcg

SEQ ID NO: 445194 - DNA, 25 bp, Mus musculus
ccgcttctgtctgggtaccacggta

SEQ ID NO: 445195 - DNA, 25 bp, Mus musculus
cgtggccttactgctggtgtaccct

SEQ ID NO: 445196 - DNA, 25 bp, Mus musculus
aactgccggaggctcctaggggcct

SEQ ID NO: 445197 - DNA, 25 bp, Mus musculus
ttcctgcgcctcttacctcagggag

SEQ ID NO: 445198 - DNA, 25 bp, Mus musculus
gaaaccgagtctccgcgacttgtta

SEQ ID NO: 445199 - DNA, 25 bp, Mus musculus
cctccgaaggggtgggaacagcatc

SEQ ID NO: 445200 - DNA, 25 bp, Mus musculus
tcttacctcagggagcggcgctgcc

SEQ ID NO: 445201 - DNA, 25 bp, Mus musculus
tgagcctggagcatccgcgggctcc

SEQ ID NO: 445202 - DNA, 25 bp, Mus musculus
cagccaaacgctgggcccacggagg

SEQ ID NO: 445203 - DNA, 25 bp, Mus musculus
agacacttgcaaagccctggggctg

SEQ ID NO: 445204 - DNA, 25 bp, Mus musculus
tcgcattcattctctcagacacttg

SEQ ID NO: 445205 - DNA, 25 bp, Mus musculus
tgaaggctagcaaaccgcaaaatcg

SEQ ID NO: 445206 - DNA, 25 bp, Mus musculus
tctcctgcatcccaggtgaaggcta

SEQ ID NO: 445207 - DNA, 25 bp, Mus musculus
agacccactgggtgcgcgactgcac

SEQ ID NO: 445208 - DNA, 25 bp, Mus musculus
cgacttgttaaaaccagacccactg

SEQ ID NO: 445209 - DNA, 25 bp, Mus musculus
acagcggggtccgacttcgccgcga

SEQ ID NO: 445210 - DNA, 25 bp, Mus musculus
gcgagaccctcgatccggaacattg

SEQ ID NO: 445211 - DNA, 25 bp, Mus musculus
ttgggcgagcaaaggtgacttaacc

SEQ ID NO: 445212 - DNA, 25 bp, Mus musculus
ctgaacggccaaatgaccttgggtc

SEQ ID NO: 445213 - DNA, 25 bp, Mus musculus
cgagggtattgctccgaggataaca

SEQ ID NO: 445214 - DNA, 25 bp, Mus musculus
gaggataacacgtgggagcttctta

SEQ ID NO: 445215 - DNA, 25 bp, Mus musculus
atctcctccgggtccaacttgggcg

SEQ ID NO: 445216 - DNA, 25 bp, Mus musculus
agcttcttaagcacaaacgttgggc

SEQ ID NO: 445217 - DNA, 25 bp, Mus musculus
aggtgacttaaccacgcgtcctccg

SEQ ID NO: 445218 - DNA, 25 bp, Mus musculus
ttgggcagtcctggacgtgcaagca

SEQ ID NO: 445219 - DNA, 25 bp, Mus musculus
gtggcctcacggtcacagcccagaa

SEQ ID NO: 445220 - DNA, 25 bp, Mus musculus
tcacagcccagaaggacactcactg

SEQ ID NO: 445221 - DNA, 25 bp, Mus musculus
cggaattgtattcgttctctgaacg

SEQ ID NO: 445222 - DNA, 25 bp, Mus musculus
gttccgaatggaggagaccacatcc

SEQ ID NO: 445223 - DNA, 25 bp, Mus musculus
tcactgactcgcagcagggccacgt

SEQ ID NO: 445224 - DNA, 25 bp, Mus musculus
tcctcctcaggtaagggcgaggccc

SEQ ID NO: 445225 - DNA, 25 bp, Mus musculus
atgggatccgtgtgccttaagtttc

SEQ ID NO: 445226 - DNA, 25 bp, Mus musculus
caacggttaactctgtgcatgggat

SEQ ID NO: 445227 - DNA, 25 bp, Mus musculus
ttgggacctgcaacggttaactctg

SEQ ID NO: 445228 - DNA, 25 bp, Mus musculus
ccgccagcttgcttgggacctgcaa

SEQ ID NO: 445229 - DNA, 25 bp, Mus musculus
tgggagctgctccttggcttcttcc

SEQ ID NO: 445230 - DNA, 25 bp, Mus musculus
cgccgcaaagttttggggatacctg

SEQ ID NO: 445231 - DNA, 25 bp, Mus musculus
actgcgacggcccaggacctcagga

SEQ ID NO: 445232 - DNA, 25 bp, Mus musculus
ctgttcgcccggacgatcggctgaa

SEQ ID NO: 445233 - DNA, 25 bp, Mus musculus
ttaagtttccgaggtctgcacggtg

SEQ ID NO: 445234 - DNA, 25 bp, Mus musculus
acagcccaggcctgcgtctctggga

SEQ ID NO: 445235 - DNA, 25 bp, Mus musculus
tgacctcagatgagccctgcctgtc

SEQ ID NO: 445236 - DNA, 25 bp, Mus musculus
tgccatacctgcaccagagtgggtt

SEQ ID NO: 445237 - DNA, 25 bp, Mus musculus
agcgccaactttctgagtgacctca

SEQ ID NO: 445238 - DNA, 25 bp, Mus musculus
ctgctgcgagtccacccagtaaacg

SEQ ID NO: 445239 - DNA, 25 bp, Mus musculus
cttaacctatgatcgcttgcagggg

SEQ ID NO: 445240 - DNA, 25 bp, Mus musculus
ctccgctgggctccttgtgacgcag

SEQ ID NO: 445241 - DNA, 25 bp, Mus musculus
caggcggccacacttggtgaccagc

SEQ ID NO: 445242 - DNA, 25 bp, Mus musculus
ggcgcgcacccgcattcaggcgtaa

SEQ ID NO: 445243 - DNA, 25 bp, Mus musculus
cgcattcaggcgtaacggctgctcc

SEQ ID NO: 445244 - DNA, 25 bp, Mus musculus
cccggggagaaccacctgattcagc

SEQ ID NO: 445245 - DNA, 25 bp, Mus musculus
cctgattcagcaccttgtgcacggc

SEQ ID NO: 445246 - DNA, 25 bp, Mus musculus
tccggtcccgcggacagtacttcag

SEQ ID NO: 445247 - DNA, 25 bp, Mus musculus
cagtacttcagccatggcaggcgtc

SEQ ID NO: 445248 - DNA, 25 bp, Mus musculus
atggcaggcgtcaccatcgcagctt

SEQ ID NO: 445249 - DNA, 25 bp, Mus musculus
ccatcgcagcttccggtatctactt

SEQ ID NO: 445250 - DNA, 25 bp, Mus musculus
ccaaggccgtctacgtcctcgtggt

SEQ ID NO: 445251 - DNA, 25 bp, Mus musculus
gcggctctagattcgccttaaccta

SEQ ID NO: 445252 - DNA, 25 bp, Mus musculus
ctttagggcgcgacacccggaagtg

SEQ ID NO: 445253 - DNA, 25 bp, Mus musculus
acggtgctgtcttcaacctcgagta

SEQ ID NO: 445254 - DNA, 25 bp, Mus musculus
tgtatgggtccatccatcccgcaga

SEQ ID NO: 445255 - DNA, 25 bp, Mus musculus
tgactaacctgtatgggtccatcca

SEQ ID NO: 445256 - DNA, 25 bp, Mus musculus
ttccgcacgatgactaacctgtatg

SEQ ID NO: 445257 - DNA, 25 bp, Mus musculus
gacccggctcgggacaatttccgca

SEQ ID NO: 445258 - DNA, 25 bp, Mus musculus
gcgtcgcaggcaaagctgtcaccct

SEQ ID NO: 445259 - DNA, 25 bp, Mus musculus
gagctctggagttgtccgccgccac

SEQ ID NO: 445260 - DNA, 25 bp, Mus musculus
gcgttggtcatgtttcccttcgggc

SEQ ID NO: 445261 - DNA, 25 bp, Mus musculus
gcggtggtgtccctgcttttacgtc

SEQ ID NO: 445262 - DNA, 25 bp, Mus musculus
tctccggacgggtaagctcctacac

SEQ ID NO: 445263 - DNA, 25 bp, Mus musculus
ttcaacctcgagtactctccggacg

SEQ ID NO: 445264 - DNA, 25 bp, Mus musculus
cgtctccgcagcgaggagctgacgc

SEQ ID NO: 445265 - DNA, 25 bp, Mus musculus
atcccgcagactcggtgtacctcag

SEQ ID NO: 445266 - DNA, 25 bp, Mus musculus
cgcggtacaagttgcggaacccatc

SEQ ID NO: 445267 - DNA, 25 bp, Mus musculus
cgggtaagtgatcgccacgttgttg

SEQ ID NO: 445268 - DNA, 25 bp, Mus musculus
gcgctgctcacgtgcttgtggagca

SEQ ID NO: 445269 - DNA, 25 bp, Mus musculus
caggcgcgacaggtcctcatacaga

SEQ ID NO: 445270 - DNA, 25 bp, Mus musculus
tcctcatacagaccaaacataagtg

SEQ ID NO: 445271 - DNA, 25 bp, Mus musculus
aaacataagtgccagcgtggtcgtc

SEQ ID NO: 445272 - DNA, 25 bp, Mus musculus
cagcgtggtcgtcttctgcatcagc

SEQ ID NO: 445273 - DNA, 25 bp, Mus musculus
atccttcctcagctgcaggactgca

SEQ ID NO: 445274 - DNA, 25 bp, Mus musculus
gcaggactgcatcccgggtcttgat

SEQ ID NO: 445275 - DNA, 25 bp, Mus musculus
ccgggtcttgatgccgtaaagctgc

SEQ ID NO: 445276 - DNA, 25 bp, Mus musculus
ctgctgccggaagaggatcttctga

SEQ ID NO: 445277 - DNA, 25 bp, Mus musculus
tggcaaactcgggagcgctgctcac

SEQ ID NO: 445278 - DNA, 25 bp, Mus musculus
cttctgaaccgggtaagtgatcgcc

SEQ ID NO: 445279 - DNA, 25 bp, Mus musculus
gccgccacgctacgggtggcaaact

SEQ ID NO: 445280 - DNA, 25 bp, Mus musculus
cttggcttctggcaccggagcaaag

SEQ ID NO: 445281 - DNA, 25 bp, Mus musculus
ggccagatgggcgtcctgattgtaa

SEQ ID NO: 445282 - DNA, 25 bp, Mus musculus
atgggcgtcctgattgtaacgaccc

SEQ ID NO: 445283 - DNA, 25 bp, Mus musculus
ccttctcgcacagatgtcgcaggct

SEQ ID NO: 445284 - DNA, 25 bp, Mus musculus
tctcgcacagatgtcgcaggctgcc

SEQ ID NO: 445285 - DNA, 25 bp, Mus musculus
ccacgccgcccatgaaggccgccaa

SEQ ID NO: 445286 - DNA, 25 bp, Mus musculus
ccgccgcagcgtttaaccttgactt

SEQ ID NO: 445287 - DNA, 25 bp, Mus musculus
gaaggccgccaaggcagcgcagcct

SEQ ID NO: 445288 - DNA, 25 bp, Mus musculus
cctgcccgcccgatctgggcgtcct

SEQ ID NO: 445289 - DNA, 25 bp, Mus musculus
gtcctcccgtcctccactcggcctg

SEQ ID NO: 445290 - DNA, 25 bp, Mus musculus
gaacaaaggagagcctgtgctcggc

SEQ ID NO: 445291 - DNA, 25 bp, Mus musculus
gcgtcgtccctgcagctggtgcgtc

SEQ ID NO: 445292 - DNA, 25 bp, Mus musculus
cctcttggcttctggcaccggagca

SEQ ID NO: 445293 - DNA, 25 bp, Mus musculus
cgtttaaccttgacttctgcctctt

SEQ ID NO: 445294 - DNA, 25 bp, Mus musculus
ttagcgtgtagtctgttgagatcca

SEQ ID NO: 445295 - DNA, 25 bp, Mus musculus
tctggcccgaagctagggcagcaca

SEQ ID NO: 445296 - DNA, 25 bp, Mus musculus
gccttagactctttcctgcgtgatg

SEQ ID NO: 445297 - DNA, 25 bp, Mus musculus
cctgcgtgatgaaacatggtgcctc

SEQ ID NO: 445298 - DNA, 25 bp, Mus musculus
tcggaacgagcattctccaggcttc

SEQ ID NO: 445299 - DNA, 25 bp, Mus musculus
tccatctgcccactcggggaggacg

SEQ ID NO: 445300 - DNA, 25 bp, Mus musculus
gaatggccagcaccaccggatacca

SEQ ID NO: 445301 - DNA, 25 bp, Mus musculus
tgggtagcgctatagctgccttgta

SEQ ID NO: 445302 - DNA, 25 bp, Mus musculus
cggtccggtactgactcttgtcgca

SEQ ID NO: 445303 - DNA, 25 bp, Mus musculus
ttgtcgcaccttttgccaggctgtg

SEQ ID NO: 445304 - DNA, 25 bp, Mus musculus
ccctgacttaagctgaagttatacg

SEQ ID NO: 445305 - DNA, 25 bp, Mus musculus
atccagggctgtagatagcgcgtgc

SEQ ID NO: 445306 - DNA, 25 bp, Mus musculus
cagcaagcgcgtcatttagcgtgta

SEQ ID NO: 445307 - DNA, 25 bp, Mus musculus
ggtggcctcgttgttccacaaaaca

SEQ ID NO: 445308 - DNA, 25 bp, Mus musculus
gactctggtccctcaagggtatttg

SEQ ID NO: 445309 - DNA, 25 bp, Mus musculus
gcctgcgtgccaggtgaatttttga

SEQ ID NO: 445310 - DNA, 25 bp, Mus musculus
tgatctttggcttccagcgccaccg

SEQ ID NO: 445311 - DNA, 25 bp, Mus musculus
tcctcggtagctgatctttggcttc

SEQ ID NO: 445312 - DNA, 25 bp, Mus musculus
aagggtatttgagcgagtcgactgc

SEQ ID NO: 445313 - DNA, 25 bp, Mus musculus
agttggaaccttgcgactctggtcc

SEQ ID NO: 445314 - DNA, 25 bp, Mus musculus
tgcctcacgcgtgtccggtggtgat

SEQ ID NO: 445315 - DNA, 25 bp, Mus musculus
cagctcctagtctctgcctgcaaga

SEQ ID NO: 445316 - DNA, 25 bp, Mus musculus
gccggccacttagttcccagatttc

SEQ ID NO: 445317 - DNA, 25 bp, Mus musculus
agtcagagggtgcatttcggatcgc

SEQ ID NO: 445318 - DNA, 25 bp, Mus musculus
agtgtcctggcgctgctgttcgccg

SEQ ID NO: 445319 - DNA, 25 bp, Mus musculus
ccgcccagagggatctgtgccgtgt

SEQ ID NO: 445320 - DNA, 25 bp, Mus musculus
tcattttctagtgaatccgggcagg

SEQ ID NO: 445321 - DNA, 25 bp, Mus musculus
caggctgcttttcctcggtagctga

SEQ ID NO: 445322 - DNA, 25 bp, Mus musculus
tactgtagtcttccgcttccaagcc

SEQ ID NO: 445323 - DNA, 25 bp, Mus musculus
ccgccgctggacgaatcgttgtacg

SEQ ID NO: 445324 - DNA, 25 bp, Mus musculus
tcgttgtacgtcgaaggtcccatcc

SEQ ID NO: 445325 - DNA, 25 bp, Mus musculus
aaggtcccatcccaatgtcactgtc

SEQ ID NO: 445326 - DNA, 25 bp, Mus musculus
gtcactgtccagataccgctaggta

SEQ ID NO: 445327 - DNA, 25 bp, Mus musculus
accgctaggtactgtagtcttccgc

SEQ ID NO: 445328 - DNA, 25 bp, Mus musculus
ccttgagaagctgcagagactcctg

SEQ ID NO: 445329 - DNA, 25 bp, Mus musculus
gactcctgggaggtgtagtaccaca

SEQ ID NO: 445330 - DNA, 25 bp, Mus musculus
gtgtagtaccacagcgccttgcgtg

SEQ ID NO: 445331 - DNA, 25 bp, Mus musculus
ttgcgtgcgcatttccgacgccgta

SEQ ID NO: 445332 - DNA, 25 bp, Mus musculus
tctagagggcctctcattggcgcga

SEQ ID NO: 445333 - DNA, 25 bp, Mus musculus
agttggcttttacgaccttctagag

SEQ ID NO: 445334 - DNA, 25 bp, Mus musculus
attggcgcgatcctctgaagtctgc

SEQ ID NO: 445335 - DNA, 25 bp, Mus musculus
ttccgacgccgtaaaagagcggatg

SEQ ID NO: 445336 - DNA, 25 bp, Mus musculus
aagtacttgttcagccacttggcca

SEQ ID NO: 445337 - DNA, 25 bp, Mus musculus
gccgcagtagtccaggcggcacata

SEQ ID NO: 445338 - DNA, 25 bp, Mus musculus
gccaagttcaagttctcgcagccgc

SEQ ID NO: 445339 - DNA, 25 bp, Mus musculus
cactgcgggtcggaaaacaagcgaa

SEQ ID NO: 445340 - DNA, 25 bp, Mus musculus
ccagctgcgggcttctcgagtgcac

SEQ ID NO: 445341 - DNA, 25 bp, Mus musculus
cacagacgtgtctcatagggacccg

SEQ ID NO: 445342 - DNA, 25 bp, Mus musculus
cgcgccgaccgagctttggatctcg

SEQ ID NO: 445343 - DNA, 25 bp, Mus musculus
ggcaccggtcgccaagttcaagttc

SEQ ID NO: 445344 - DNA, 25 bp, Mus musculus
gctgttgcccaagctgaagtacttg

SEQ ID NO: 445345 - DNA, 25 bp, Mus musculus
ggactcttagtcttgctgttgccca

SEQ ID NO: 445346 - DNA, 25 bp, Mus musculus
cacaggacgccgaggacgccgagca

SEQ ID NO: 445347 - DNA, 25 bp, Mus musculus
atgaggtcactcgtgctgccgctgt

SEQ ID NO: 445348 - DNA, 25 bp, Mus musculus
tcgcagtttgcgcagcgacgagccc

SEQ ID NO: 445349 - DNA, 25 bp, Mus musculus
aggcggcacatagctcgcagtttgc

SEQ ID NO: 445350 - DNA, 25 bp, Mus musculus
tactagaatttgagcctgagcgcga

SEQ ID NO: 445351 - DNA, 25 bp, Mus musculus
cccagaccaccgcaggtagctaccg

SEQ ID NO: 445352 - DNA, 25 bp, Mus musculus
aactgaccggagaacgctgatacta

SEQ ID NO: 445353 - DNA, 25 bp, Mus musculus
tgggttctttccacgccgcttccta

SEQ ID NO: 445354 - DNA, 25 bp, Mus musculus
gggtgcactgctgggttctttccac

SEQ ID NO: 445355 - DNA, 25 bp, Mus musculus
ctccctccgcactggggcacgctac

SEQ ID NO: 445356 - DNA, 25 bp, Mus musculus
gaatttgagcctgagcgcgattcgg

SEQ ID NO: 445357 - DNA, 25 bp, Mus musculus
ccggagaacgctgatactagaattt

SEQ ID NO: 445358 - DNA, 25 bp, Mus musculus
cggagcttagctggtgacggaacca

SEQ ID NO: 445359 - DNA, 25 bp, Mus musculus
gctgctgaactgaccggagaacgct

SEQ ID NO: 445360 - DNA, 25 bp, Mus musculus
ggtccgcacggctgctgaactgacc

SEQ ID NO: 445361 - DNA, 25 bp, Mus musculus
accacattggctggctagcggctga

SEQ ID NO: 445362 - DNA, 25 bp, Mus musculus
ctggtgacggaaccacattggctgg

SEQ ID NO: 445363 - DNA, 25 bp, Mus musculus
aatggcaggtctcttccgggtgcac

SEQ ID NO: 445364 - DNA, 25 bp, Mus musculus
atggccggctcccagacggacggca

SEQ ID NO: 445365 - DNA, 25 bp, Mus musculus
cccgaggcgcgactcgcacacacca

SEQ ID NO: 445366 - DNA, 25 bp, Mus musculus
tcgcgagccttgtgcaggtggccat

SEQ ID NO: 445367 - DNA, 25 bp, Mus musculus
cgcgcagacgtagcgcgcagatgct

SEQ ID NO: 445368 - DNA, 25 bp, Mus musculus
agacggacggcagcagcgcctctgc

SEQ ID NO: 445369 - DNA, 25 bp, Mus musculus
tcagagccgcagacggcgccgcgtt

SEQ ID NO: 445370 - DNA, 25 bp, Mus musculus
gccacagcgtgagcccacgggtccc

SEQ ID NO: 445371 - DNA, 25 bp, Mus musculus
agcagccgcactcgtcgcgcgcgga

SEQ ID NO: 445372 - DNA, 25 bp, Mus musculus
cgcagggcagcgatcctgctggcac

SEQ ID NO: 445373 - DNA, 25 bp, Mus musculus
atcctgctggcacgggctgcactcg

SEQ ID NO: 445374 - DNA, 25 bp, Mus musculus
tcgcagggcccatcgcgagccttgt

SEQ ID NO: 445375 - DNA, 25 bp, Mus musculus
gtctacccgcgtcgcggagcccgag

SEQ ID NO: 445376 - DNA, 25 bp, Mus musculus
tctgctcctcttagcgctcggtgcg

SEQ ID NO: 445377 - DNA, 25 bp, Mus musculus
tgcactcggggtgtcgtctacccgc

SEQ ID NO: 445378 - DNA, 25 bp, Mus musculus
tcttctcgtggctgcaccgacgcat

SEQ ID NO: 445379 - DNA, 25 bp, Mus musculus
tggctgcatcgatgccttctctctc

SEQ ID NO: 445380 - DNA, 25 bp, Mus musculus
ctctgtcttctcgtggctgcactga

SEQ ID NO: 445381 - DNA, 25 bp, Mus musculus
gctgcactgacgcatgctctgtctt

SEQ ID NO: 445382 - DNA, 25 bp, Mus musculus
atgctctgtcttctcgtggctgcac

SEQ ID NO: 445383 - DNA, 25 bp, Mus musculus
gctgcaccgacgcatgctctgtctt

SEQ ID NO: 445384 - DNA, 25 bp, Mus musculus
gctctgtcttttcgtggctgcatcg

SEQ ID NO: 445385 - DNA, 25 bp, Mus musculus
ctgcaccgacgcatgctctgtcttt

SEQ ID NO: 445386 - DNA, 25 bp, Mus musculus
tgctctgtcttttcgtggctgcatc

SEQ ID NO: 445387 - DNA, 25 bp, Mus musculus
gtggctgcatcgatgccttctctct

SEQ ID NO: 445388 - DNA, 25 bp, Mus musculus
tctctctcttctcgtggctgcactg

SEQ ID NO: 445389 - DNA, 25 bp, Mus musculus
ctgcactgacgcatgctctgtcttc

SEQ ID NO: 445390 - DNA, 25 bp, Mus musculus
ctctctcttctcgtggctgcactga

SEQ ID NO: 445391 - DNA, 25 bp, Mus musculus
tctgtcttctcgtggctgcactgac

SEQ ID NO: 445392 - DNA, 25 bp, Mus musculus
tagctcccggtcaggagcaaccggc

SEQ ID NO: 445393 - DNA, 25 bp, Mus musculus
tgcaggccgcgcacatcacacagga

SEQ ID NO: 445394 - DNA, 25 bp, Mus musculus
ttccagagcgtcgtgcgtgacgccc

SEQ ID NO: 445395 - DNA, 25 bp, Mus musculus
cagaaaccgctaggcggcgtcggtt

SEQ ID NO: 445396 - DNA, 25 bp, Mus musculus
acacaggacctacacgtagccgttc

SEQ ID NO: 445397 - DNA, 25 bp, Mus musculus
gagctctgcgcagttgtgccagccc

SEQ ID NO: 445398 - DNA, 25 bp, Mus musculus
cagcggtacccgagctctgcgcagt

SEQ ID NO: 445399 - DNA, 25 bp, Mus musculus
cgcagctctgagcaggaagtagctc

SEQ ID NO: 445400 - DNA, 25 bp, Mus musculus
ggtgattcccaagccacggctcagg

SEQ ID NO: 445401 - DNA, 25 bp, Mus musculus
gcggggctttaggtgattcccaagc

SEQ ID NO: 445402 - DNA, 25 bp, Mus musculus
cgtctgcgcagagctaagccggccg

SEQ ID NO: 445403 - DNA, 25 bp, Mus musculus
tctcacacgcggacctcgaagtggg

SEQ ID NO: 445404 - DNA, 25 bp, Mus musculus
gtcggtttcccttctcacacgcgga

SEQ ID NO: 445405 - DNA, 25 bp, Mus musculus
tagccgttcctgtcaaccgtgagcg

SEQ ID NO: 445406 - DNA, 25 bp, Mus musculus
ggcactagacctggtctcccgggga

SEQ ID NO: 445407 - DNA, 25 bp, Mus musculus
ggcgcagccatatctgggcaaaata

SEQ ID NO: 445408 - DNA, 25 bp, Mus musculus
gggcaaaatattcagctgtcgcagc

SEQ ID NO: 445409 - DNA, 25 bp, Mus musculus
cagccgctgagaagggactgagcac

SEQ ID NO: 445410 - DNA, 25 bp, Mus musculus
ctgagcacggttccctctataaata

SEQ ID NO: 445411 - DNA, 25 bp, Mus musculus
ggcgctaagcgtccctgcagcctga

SEQ ID NO: 445412 - DNA, 25 bp, Mus musculus
tgccttgggcattggcacgttgtga

SEQ ID NO: 445413 - DNA, 25 bp, Mus musculus
cacgttgtgagctggtcacgagccc

SEQ ID NO: 445414 - DNA, 25 bp, Mus musculus
gctgagtcctctgagcaccgatctg

SEQ ID NO: 445415 - DNA, 25 bp, Mus musculus
tggccggcgcctgaaaagtttccca

SEQ ID NO: 445416 - DNA, 25 bp, Mus musculus
agtttcccaaactgctggaactagc

SEQ ID NO: 445417 - DNA, 25 bp, Mus musculus
ggaactagctgaggtttaaagcacc

SEQ ID NO: 445418 - DNA, 25 bp, Mus musculus
taaagcaccagctgcgcttgcctcg

SEQ ID NO: 445419 - DNA, 25 bp, Mus musculus
cccagcctgatgatcgggtcgctgg

SEQ ID NO: 445420 - DNA, 25 bp, Mus musculus
ggcctggattccctaccgctgaaag

SEQ ID NO: 445421 - DNA, 25 bp, Mus musculus
taccgctgaaagtggcttgccctcc

SEQ ID NO: 445422 - DNA, 25 bp, Mus musculus
tgggtctcccttcaccaacttggcg

SEQ ID NO: 445423 - DNA, 25 bp, Mus musculus
tgagccgtcacctttctccggaagt

SEQ ID NO: 445424 - DNA, 25 bp, Mus musculus
ggaagtctcctaagtcgtcggcgca

SEQ ID NO: 445425 - DNA, 25 bp, Mus musculus
atcccgccgggcctgtataaagccg

SEQ ID NO: 445426 - DNA, 25 bp, Mus musculus
cgctgcggcccggataatttagctc

SEQ ID NO: 445427 - DNA, 25 bp, Mus musculus
tttagctcgctgtccagaagggccc

SEQ ID NO: 445428 - DNA, 25 bp, Mus musculus
aggcggccgcaattggacttgcaga

SEQ ID NO: 445429 - DNA, 25 bp, Mus musculus
ttgcaggcggctagcaactcagatc

SEQ ID NO: 445430 - DNA, 25 bp, Mus musculus
aactcagatcggctgcgcaccagca

SEQ ID NO: 445431 - DNA, 25 bp, Mus musculus
gcaccagcaagcagcatgtcgcgga

SEQ ID NO: 445432 - DNA, 25 bp, Mus musculus
aacgatggtaagtgctctcggcctg

SEQ ID NO: 445433 - DNA, 25 bp, Mus musculus
cggcacagctacgagaacgatggta

SEQ ID NO: 445434 - DNA, 25 bp, Mus musculus
cactccgtaggaagggaacgcgtat

SEQ ID NO: 445435 - DNA, 25 bp, Mus musculus
ctacgcatgcgcagtcgaggagtcc

SEQ ID NO: 445436 - DNA, 25 bp, Mus musculus
cgcaggctgaaagctctgcaccata

SEQ ID NO: 445437 - DNA, 25 bp, Mus musculus
aggtgacgtctgcttttcctcggcc

SEQ ID NO: 445438 - DNA, 25 bp, Mus musculus
cgaggagtcctggtggaaaagccta

SEQ ID NO: 445439 - DNA, 25 bp, Mus musculus
accaggcaaggagaagagctacgca

SEQ ID NO: 445440 - DNA, 25 bp, Mus musculus
aacagcggagccacaagtacccggc

SEQ ID NO: 445441 - DNA, 25 bp, Mus musculus
cgtattgttggtgaacagcggagcc

SEQ ID NO: 445442 - DNA, 25 bp, Mus musculus
atcgcctacacactccgtaggaagg

SEQ ID NO: 445443 - DNA, 25 bp, Mus musculus
tggcgcagcatcagtgcccgctgtc

SEQ ID NO: 445444 - DNA, 25 bp, Mus musculus
ccgggatgcggtcacaaacccgcgg

SEQ ID NO: 445445 - DNA, 25 bp, Mus musculus
acaccgagccagagcgggcggccaa

SEQ ID NO: 445446 - DNA, 25 bp, Mus musculus
ctgcaccatagacgtgccgggcaaa

SEQ ID NO: 445447 - DNA, 25 bp, Mus musculus
cctatgaagggcgaggcagtacgcc

SEQ ID NO: 445448 - DNA, 25 bp, Mus musculus
cccggcgagccggagaaacggcgcg

SEQ ID NO: 445449 - DNA, 25 bp, Mus musculus
gcgttgtgaaatcgcggggctcgct

SEQ ID NO: 445450 - DNA, 25 bp, Mus musculus
tattctgcgtgcatggtccccaccg

SEQ ID NO: 445451 - DNA, 25 bp, Mus musculus
cgctgctcgcggatattctgcgtgc

SEQ ID NO: 445452 - DNA, 25 bp, Mus musculus
ttatccgggcgcgttgtgcaaggcc

SEQ ID NO: 445453 - DNA, 25 bp, Mus musculus
attgccccgagacgcggcgtttatc

SEQ ID NO: 445454 - DNA, 25 bp, Mus musculus
ggttgcgagtccctcgacctctggc

SEQ ID NO: 445455 - DNA, 25 bp, Mus musculus
ggtggttgcgagtccctcgacctct

SEQ ID NO: 445456 - DNA, 25 bp, Mus musculus
acaatttcccagcacgaagaccgct

SEQ ID NO: 445457 - DNA, 25 bp, Mus musculus
gggacacaatttcccagcacgaaga

SEQ ID NO: 445458 - DNA, 25 bp, Mus musculus
ggacatagcgaagggacacaatttc

SEQ ID NO: 445459 - DNA, 25 bp, Mus musculus
cgaggacatagcgaagggacacaat

SEQ ID NO: 445460 - DNA, 25 bp, Mus musculus
cgcggatattctgcgtgcatggtcc

SEQ ID NO: 445461 - DNA, 25 bp, Mus musculus
cccggccgcgcgttgtgaaatcgcg

SEQ ID NO: 445462 - DNA, 25 bp, Mus musculus
cgcgcactgcttcttggtggcgctc

SEQ ID NO: 445463 - DNA, 25 bp, Mus musculus
cccggccaacgttctgcagctaata

SEQ ID NO: 445464 - DNA, 25 bp, Mus musculus
cagctaataggttgctgcaggccgg

SEQ ID NO: 445465 - DNA, 25 bp, Mus musculus
caagtcccggtcacgcgtcctaaga

SEQ ID NO: 445466 - DNA, 25 bp, Mus musculus
tatcccgtcgcgtgaacagctttta

SEQ ID NO: 445467 - DNA, 25 bp, Mus musculus
cagcttttaaccgaagtcaccgtgg

SEQ ID NO: 445468 - DNA, 25 bp, Mus musculus
gaagtcaccgtggagttccgccgcc

SEQ ID NO: 445469 - DNA, 25 bp, Mus musculus
ccgaaacttccaccacgagcgagta

SEQ ID NO: 445470 - DNA, 25 bp, Mus musculus
accacgagcgagtaagtccggggct

SEQ ID NO: 445471 - DNA, 25 bp, Mus musculus
agagaccggatcacaggtcgctttc

SEQ ID NO: 445472 - DNA, 25 bp, Mus musculus
tctagactccttcagccttgggaga

SEQ ID NO: 445473 - DNA, 25 bp, Mus musculus
ggactccgggtttcggtgcagccac

SEQ ID NO: 445474 - DNA, 25 bp, Mus musculus
gtggcgagagcatctagactccttc

SEQ ID NO: 445475 - DNA, 25 bp, Mus musculus
ggtcgctttcttggcttgggactcc

SEQ ID NO: 445476 - DNA, 25 bp, Mus musculus
ctgcatgcacgaggcgttgctcgga

SEQ ID NO: 445477 - DNA, 25 bp, Mus musculus
tctgaacccgagctctcgcgtactg

SEQ ID NO: 445478 - DNA, 25 bp, Mus musculus
agacgacttcttcttgaccggccgg

SEQ ID NO: 445479 - DNA, 25 bp, Mus musculus
tgcggctaccgagcgctgcatgcac

SEQ ID NO: 445480 - DNA, 25 bp, Mus musculus
ggttttcgttccattcccgctctgc

SEQ ID NO: 445481 - DNA, 25 bp, Mus musculus
cagtggctctggcaccgatacggat

SEQ ID NO: 445482 - DNA, 25 bp, Mus musculus
accgatacggatgtcggcgctgagc

SEQ ID NO: 445483 - DNA, 25 bp, Mus musculus
cgggctccagatggacgaagcagta

SEQ ID NO: 445484 - DNA, 25 bp, Mus musculus
atggacgaagcagtaggcgtgctca

SEQ ID NO: 445485 - DNA, 25 bp, Mus musculus
tgctcagagaggacgctgctgccac

SEQ ID NO: 445486 - DNA, 25 bp, Mus musculus
cactggacgctgagctagacgaaga

SEQ ID NO: 445487 - DNA, 25 bp, Mus musculus
acgaagaagcagagctagatacggc

SEQ ID NO: 445488 - DNA, 25 bp, Mus musculus
gcggcgtgaactggccgctgctctc

SEQ ID NO: 445489 - DNA, 25 bp, Mus musculus
ctcgcgtactggagacgacttcttc

SEQ ID NO: 445490 - DNA, 25 bp, Mus musculus
cagagccacctggattttaggcggc

SEQ ID NO: 445491 - DNA, 25 bp, Mus musculus
gggtgactatgcagagccacctgga

SEQ ID NO: 445492 - DNA, 25 bp, Mus musculus
gctttcagagaaggcagcgctactc

SEQ ID NO: 445493 - DNA, 25 bp, Mus musculus
cccggggtgactatgcagagccacc

SEQ ID NO: 445494 - DNA, 25 bp, Mus musculus
ccacctggattttaggcggccaaga

SEQ ID NO: 445495 - DNA, 25 bp, Mus musculus
cagcctggagatgcagcgtgcaccg

SEQ ID NO: 445496 - DNA, 25 bp, Mus musculus
agaaggcagcgctactccgagagcc

SEQ ID NO: 445497 - DNA, 25 bp, Mus musculus
cgagcgcctaatgagctttcagaga

SEQ ID NO: 445498 - DNA, 25 bp, Mus musculus
gtgagcgagcgcctaatgagctttc

SEQ ID NO: 445499 - DNA, 25 bp, Mus musculus
tgctctgtgagcgagcgcctaatga

SEQ ID NO: 445500 - DNA, 25 bp, Mus musculus
agcatgctctgtgagcgagcgccta

SEQ ID NO: 445501 - DNA, 25 bp, Mus musculus
cccaagtagcatgctctgtgagcga

SEQ ID NO: 445502 - DNA, 25 bp, Mus musculus
taggcggccaagacagccgcgcctg

SEQ ID NO: 445503 - DNA, 25 bp, Mus musculus
ggcagcgctactccgagagcccagg

SEQ ID NO: 445504 - DNA, 25 bp, Mus musculus
ttgatcgcctggcaccagagcgcca

SEQ ID NO: 445505 - DNA, 25 bp, Mus musculus
acccgggcgccgtctatgcgggcta

SEQ ID NO: 445506 - DNA, 25 bp, Mus musculus
tacatgcacgatgcagccgctgccg

SEQ ID NO: 445507 - DNA, 25 bp, Mus musculus
tacccggcctacatgcacgatgcag

SEQ ID NO: 445508 - DNA, 25 bp, Mus musculus
ttcgaaagcggcagcttcctgcgcc

SEQ ID NO: 445509 - DNA, 25 bp, Mus musculus
ccgcccgggcaagggcaattactgg

SEQ ID NO: 445510 - DNA, 25 bp, Mus musculus
actctgggcggcatctacaagttca

SEQ ID NO: 445511 - DNA, 25 bp, Mus musculus
cagagcggtcgtctacagctgaaga

SEQ ID NO: 445512 - DNA, 25 bp, Mus musculus
attgcggccagagcggtcgtctaca

SEQ ID NO: 445513 - DNA, 25 bp, Mus musculus
agcgctctcggtgcccgctgcaaag

SEQ ID NO: 445514 - DNA, 25 bp, Mus musculus
gtcggtggactcagcgctccagacc

SEQ ID NO: 445515 - DNA, 25 bp, Mus musculus
cccacaggagccgtcggtggactca

SEQ ID NO: 445516 - DNA, 25 bp, Mus musculus
agcgccaaggatcctctggccggtg

SEQ ID NO: 445517 - DNA, 25 bp, Mus musculus
tcttcggcttggttcccgagcggcc

SEQ ID NO: 445518 - DNA, 25 bp, Mus musculus
ctcgcgttcttctggccagggaagc

SEQ ID NO: 445519 - DNA, 25 bp, Mus musculus
cggacgccgtgaggcccatcattca

SEQ ID NO: 445520 - DNA, 25 bp, Mus musculus
ggccgacgcagctactgtactgaaa

SEQ ID NO: 445521 - DNA, 25 bp, Mus musculus
ccgtgtaccaagatcctaatacgtc

SEQ ID NO: 445522 - DNA, 25 bp, Mus musculus
cgtcactcccgttagccttagcatg

SEQ ID NO: 445523 - DNA, 25 bp, Mus musculus
ccttagcatgtcacgtggtcgtcga

SEQ ID NO: 445524 - DNA, 25 bp, Mus musculus
tggtcgtcgagacacgtgaccctta

SEQ ID NO: 445525 - DNA, 25 bp, Mus musculus
gacccttactttggcggcaaggaca

SEQ ID NO: 445526 - DNA, 25 bp, Mus musculus
caagaatgtacgtcaggtggctcgc

SEQ ID NO: 445527 - DNA, 25 bp, Mus musculus
tgcggcgccacctttttccataacg

SEQ ID NO: 445528 - DNA, 25 bp, Mus musculus
ctgcttctccaagccgcgcatggtt

SEQ ID NO: 445529 - DNA, 25 bp, Mus musculus
cgcgcatggttacaggccgctgagt

SEQ ID NO: 445530 - DNA, 25 bp, Mus musculus
ttccataacgttacctgcctccagg

SEQ ID NO: 445531 - DNA, 25 bp, Mus musculus
ccgggtcttggagaacgcgctcaat

SEQ ID NO: 445532 - DNA, 25 bp, Mus musculus
agccatgtttgcagcctcccgggat

SEQ ID NO: 445533 - DNA, 25 bp, Mus musculus
cgctgggagccatgtttgcagcctc

SEQ ID NO: 445534 - DNA, 25 bp, Mus musculus
gttgtgtaacgctgggagccatgtt

SEQ ID NO: 445535 - DNA, 25 bp, Mus musculus
ggcagccgtaagcagaacccctcgg

SEQ ID NO: 445536 - DNA, 25 bp, Mus musculus
atgtttgcagcctcccgggatgcgc

SEQ ID NO: 445537 - DNA, 25 bp, Mus musculus
gtcctctcccggagggagcgctcgc

SEQ ID NO: 445538 - DNA, 25 bp, Mus musculus
gaagcaaactttgagccgctcgccc

SEQ ID NO: 445539 - DNA, 25 bp, Mus musculus
cgggtggagaagcaaactttgagcc

SEQ ID NO: 445540 - DNA, 25 bp, Mus musculus
gcgcgggctttaactctttggcgcc

SEQ ID NO: 445541 - DNA, 25 bp, Mus musculus
cgagcgcgcgggctttaactctttg

SEQ ID NO: 445542 - DNA, 25 bp, Mus musculus
agtaatggtggccacctgcgggcca

SEQ ID NO: 445543 - DNA, 25 bp, Mus musculus
cttgcaagtaatggtggccacctgc

SEQ ID NO: 445544 - DNA, 25 bp, Mus musculus
cccgatgacttgcaagtaatggtgg

SEQ ID NO: 445545 - DNA, 25 bp, Mus musculus
ttgaaaaaaggatgcgcttcccgcc

SEQ ID NO: 445546 - DNA, 25 bp, Mus musculus
aactccgtctaacagctgctcttgc

SEQ ID NO: 445547 - DNA, 25 bp, Mus musculus
ctgcagaggtaaggctccgattggc

SEQ ID NO: 445548 - DNA, 25 bp, Mus musculus
gctccgattggctgtcgagcgagac

SEQ ID NO: 445549 - DNA, 25 bp, Mus musculus
aagcaggcgcgggtaatgcaccatg

SEQ ID NO: 445550 - DNA, 25 bp, Mus musculus
tgcaccatgccgctggaactggagc

SEQ ID NO: 445551 - DNA, 25 bp, Mus musculus
ccgctggaactggagctgtgtcccg

SEQ ID NO: 445552 - DNA, 25 bp, Mus musculus
gggtggaaagcacccgtgcttcatc

SEQ ID NO: 445553 - DNA, 25 bp, Mus musculus
cccgtgcttcatcatcgcggagatc

SEQ ID NO: 445554 - DNA, 25 bp, Mus musculus
catcatcgcggagatcggccagaac

SEQ ID NO: 445555 - DNA, 25 bp, Mus musculus
cggccagaaccaccaaggagacata

SEQ ID NO: 445556 - DNA, 25 bp, Mus musculus
caccaaggagacatagatgtggcca

SEQ ID NO: 445557 - DNA, 25 bp, Mus musculus
atagatgtggccaagcgcatgatcc

SEQ ID NO: 445558 - DNA, 25 bp, Mus musculus
cgcatgatccgcactgccaaggtga

SEQ ID NO: 445559 - DNA, 25 bp, Mus musculus
cgcgattgccttctggtcctgtgct

SEQ ID NO: 445560 - DNA, 25 bp, Mus musculus
gaaggtgtgcaagtggctcatgcca

SEQ ID NO: 445561 - DNA, 25 bp, Mus musculus
ctgtcagaccgtccggcgacaggcg

SEQ ID NO: 445562 - DNA, 25 bp, Mus musculus
cagcgagcagcggactgtcagaccg

SEQ ID NO: 445563 - DNA, 25 bp, Mus musculus
cccagtagtggcgtccggctgcgaa

SEQ ID NO: 445564 - DNA, 25 bp, Mus musculus
ttacgcaccacgactcgcggttgca

SEQ ID NO: 445565 - DNA, 25 bp, Mus musculus
ggtcgtaacgctttacgcaccacga

SEQ ID NO: 445566 - DNA, 25 bp, Mus musculus
aggcccagtactctaggtcgtaacg

SEQ ID NO: 445567 - DNA, 25 bp, Mus musculus
tggccgtcatggaaggcccagtact

SEQ ID NO: 445568 - DNA, 25 bp, Mus musculus
cgcaggcgacttcgctggccgtcat

SEQ ID NO: 445569 - DNA, 25 bp, Mus musculus
tcgtagtccaggaagacgccgagcc

SEQ ID NO: 445570 - DNA, 25 bp, Mus musculus
agaaggccagaatgccggcctcgta

SEQ ID NO: 445571 - DNA, 25 bp, Mus musculus
ccacgtcgtagaaggccagaatgcc

SEQ ID NO: 445572 - DNA, 25 bp, Mus musculus
atgccacccgccacgtcgtagaagg

SEQ ID NO: 445573 - DNA, 25 bp, Mus musculus
cgtgcatcgtgtccgggtccagcgt

SEQ ID NO: 445574 - DNA, 25 bp, Mus musculus
tcgcggcttcccacctgcacacgca

SEQ ID NO: 445575 - DNA, 25 bp, Mus musculus
tgcacacgcacagcctcctcctcgg

SEQ ID NO: 445576 - DNA, 25 bp, Mus musculus
cggtgcgcacccagaaccgggcaga

SEQ ID NO: 445577 - DNA, 25 bp, Mus musculus
tgcgcacccagaaccgggcagagcg

SEQ ID NO: 445578 - DNA, 25 bp, Mus musculus
cccagaaccgggcagagcgcgcaca

SEQ ID NO: 445579 - DNA, 25 bp, Mus musculus
agcgcgcacacacagcggccgcagc

SEQ ID NO: 445580 - DNA, 25 bp, Mus musculus
gccgcagcggcgacagaagagctca

SEQ ID NO: 445581 - DNA, 25 bp, Mus musculus
gcagcggcgacagaagagctcagcc

SEQ ID NO: 445582 - DNA, 25 bp, Mus musculus
cgacagaagagctcagccgggcgtt

SEQ ID NO: 445583 - DNA, 25 bp, Mus musculus
cagaagagctcagccgggcgttcgc

SEQ ID NO: 445584 - DNA, 25 bp, Mus musculus
ccgggcgttcgctgtgctccggaca

SEQ ID NO: 445585 - DNA, 25 bp, Mus musculus
gccatacgccccgtcgggctgaaag

SEQ ID NO: 445586 - DNA, 25 bp, Mus musculus
gcccgcccagacctgcggtgcacgc

SEQ ID NO: 445587 - DNA, 25 bp, Mus musculus
gttcgctgtgctccggacagcgcca

SEQ ID NO: 445588 - DNA, 25 bp, Mus musculus
ccgtttcccgggactggaagctgag

SEQ ID NO: 445589 - DNA, 25 bp, Mus musculus
tgagatctggccattgccagcgcgg

SEQ ID NO: 445590 - DNA, 25 bp, Mus musculus
gggtaacccagccaggacaggaaca

SEQ ID NO: 445591 - DNA, 25 bp, Mus musculus
gacaggaacaatcacgactcgggtc

SEQ ID NO: 445592 - DNA, 25 bp, Mus musculus
cctaacctctggagcgcgaacctgg

SEQ ID NO: 445593 - DNA, 25 bp, Mus musculus
tgctcctagtcacccactgagggag

SEQ ID NO: 445594 - DNA, 25 bp, Mus musculus
gccgcaccagtatcccgatggggaa

SEQ ID NO: 445595 - DNA, 25 bp, Mus musculus
tctggaggataggtctccgcgacgc

SEQ ID NO: 445596 - DNA, 25 bp, Mus musculus
ctaccttgttggctgccgcgcaggt

SEQ ID NO: 445597 - DNA, 25 bp, Mus musculus
cccttgctgagatggagactgtcat

SEQ ID NO: 445598 - DNA, 25 bp, Mus musculus
atggagactgtcatcgcgcctgcct

SEQ ID NO: 445599 - DNA, 25 bp, Mus musculus
ctgcctcccagatggctcgaagctg

SEQ ID NO: 445600 - DNA, 25 bp, Mus musculus
ctcgaagctggatcccgcagcgagc

SEQ ID NO: 445601 - DNA, 25 bp, Mus musculus
gcctggtctgggtagcagactgctc

SEQ ID NO: 445602 - DNA, 25 bp, Mus musculus
tgagctccgtcagggtagcccagcg

SEQ ID NO: 445603 - DNA, 25 bp, Mus musculus
gttgaggtccagctcgatctgacga

SEQ ID NO: 445604 - DNA, 25 bp, Mus musculus
cgctgatggaaaaaggaccacgtta

SEQ ID NO: 445605 - DNA, 25 bp, Mus musculus
agtcgtcgtactcgctgatggaaaa

SEQ ID NO: 445606 - DNA, 25 bp, Mus musculus
ccgtcaggaagccatagtcgtcgta

SEQ ID NO: 445607 - DNA, 25 bp, Mus musculus
tcgtagtctggcaccgtcaggaagc

SEQ ID NO: 445608 - DNA, 25 bp, Mus musculus
aggtcttccatctcgtagtctggca

SEQ ID NO: 445609 - DNA, 25 bp, Mus musculus
ggctagcagttttaggtcttccatc

SEQ ID NO: 445610 - DNA, 25 bp, Mus musculus
caaggcctggatcttggctagcagt

SEQ ID NO: 445611 - DNA, 25 bp, Mus musculus
tagcccagcggtcccgtagtggcct

SEQ ID NO: 445612 - DNA, 25 bp, Mus musculus
agcagctgcttgagctcagctgagg

SEQ ID NO: 445613 - DNA, 25 bp, Mus musculus
agccacctccagactcggggacggt

SEQ ID NO: 445614 - DNA, 25 bp, Mus musculus
tcgatctgacgagccgcaggatgct

SEQ ID NO: 445615 - DNA, 25 bp, Mus musculus
cccgggctagaagctcttggtagca

SEQ ID NO: 445616 - DNA, 25 bp, Mus musculus
gcagatgacctgttgcttggcatgg

SEQ ID NO: 445617 - DNA, 25 bp, Mus musculus
ctggctcaggaagtcgccgttggta

SEQ ID NO: 445618 - DNA, 25 bp, Mus musculus
caaggtcctccgtgagcttctgggt

SEQ ID NO: 445619 - DNA, 25 bp, Mus musculus
ggtgagcttgcagatgacctgttgc

SEQ ID NO: 445620 - DNA, 25 bp, Mus musculus
tcctctcctgctggctcaggaagtc

SEQ ID NO: 445621 - DNA, 25 bp, Mus musculus
ggttcttatccatgagcagctgcac

SEQ ID NO: 445622 - DNA, 25 bp, Mus musculus
tatccatgagcagctgcacgtgctg

SEQ ID NO: 445623 - DNA, 25 bp, Mus musculus
tgctggagcgcctgcacctgctgct

SEQ ID NO: 445624 - DNA, 25 bp, Mus musculus
ctctggttcagctcagcgatctgcc

SEQ ID NO: 445625 - DNA, 25 bp, Mus musculus
gctcagcgatctgccgcaccttgtg

SEQ ID NO: 445626 - DNA, 25 bp, Mus musculus
gcgatctgccgcaccttgtgccgga

SEQ ID NO: 445627 - DNA, 25 bp, Mus musculus
ttgtgccggaccagctccaaccggt

SEQ ID NO: 445628 - DNA, 25 bp, Mus musculus
atagggggcgctaccttcagatgct

SEQ ID NO: 445629 - DNA, 25 bp, Mus musculus
cttctgggtgagcttgcagatgacc

SEQ ID NO: 445630 - DNA, 25 bp, Mus musculus
ccgcaagatgccaagaggcggtgac

SEQ ID NO: 445631 - DNA, 25 bp, Mus musculus
gtccgggtaacaatcattctaagtc

SEQ ID NO: 445632 - DNA, 25 bp, Mus musculus
tcattctaagtcacggtggattccc

SEQ ID NO: 445633 - DNA, 25 bp, Mus musculus
ggtggattcccgcacacaattccac

SEQ ID NO: 445634 - DNA, 25 bp, Mus musculus
attccaccgcaagatgccaagaggc

SEQ ID NO: 445635 - DNA, 25 bp, Mus musculus
tgacgtggtggccttgcaggtcaaa

SEQ ID NO: 445636 - DNA, 25 bp, Mus musculus
tggccttgcaggtcaaaggagcatc

SEQ ID NO: 445637 - DNA, 25 bp, Mus musculus
gcaggtcaaaggagcatcaatcacc

SEQ ID NO: 445638 - DNA, 25 bp, Mus musculus
ggagcatcaatcaccacgttagctg

SEQ ID NO: 445639 - DNA, 25 bp, Mus musculus
gcgggtccgggtaacaatcattcta

SEQ ID NO: 445640 - DNA, 25 bp, Mus musculus
accacgttagctgcgggcaccgaat

SEQ ID NO: 445641 - DNA, 25 bp, Mus musculus
gtaacaatcattctaagtcacggtg

SEQ ID NO: 445642 - DNA, 25 bp, Mus musculus
tcaatcaccacgttagctgcgggca

SEQ ID NO: 445643 - DNA, 25 bp, Mus musculus
tcacggtggattcccgcacacaatt

SEQ ID NO: 445644 - DNA, 25 bp, Mus musculus
ttctttctccgaggcgctttaagcg

SEQ ID NO: 445645 - DNA, 25 bp, Mus musculus
gtccgccttacagtcaaagaccgca

SEQ ID NO: 445646 - DNA, 25 bp, Mus musculus
gagcgctccgtttccgatcctgaac

SEQ ID NO: 445647 - DNA, 25 bp, Mus musculus
gtgcgggcgcctctgtttaaaaaca

SEQ ID NO: 445648 - DNA, 25 bp, Mus musculus
tgtcggccatgttgcttcgttcgcc

SEQ ID NO: 445649 - DNA, 25 bp, Mus musculus
tgacagcaaactcagcgcaggacgg

SEQ ID NO: 445650 - DNA, 25 bp, Mus musculus
agagcgccttagacacttgacagca

SEQ ID NO: 445651 - DNA, 25 bp, Mus musculus
cagagtttcttagggaccgtgtcta

SEQ ID NO: 445652 - DNA, 25 bp, Mus musculus
gatgggtcctttgccgccaaactta

SEQ ID NO: 445653 - DNA, 25 bp, Mus musculus
tcgtagaagaaccagcggcatttcc

SEQ ID NO: 445654 - DNA, 25 bp, Mus musculus
aggtggcacttcctctcatcgtaga

SEQ ID NO: 445655 - DNA, 25 bp, Mus musculus
catcctgcgcggtgcgcgaataata

SEQ ID NO: 445656 - DNA, 25 bp, Mus musculus
gctgtccaaggggtttgcatcctgc

SEQ ID NO: 445657 - DNA, 25 bp, Mus musculus
ccgcactggagagatcgatgctgtc

SEQ ID NO: 445658 - DNA, 25 bp, Mus musculus
cctgcgactccttaggctgccaaga

SEQ ID NO: 445659 - DNA, 25 bp, Mus musculus
taggatcagaccagacctgcagcgc

SEQ ID NO: 445660 - DNA, 25 bp, Mus musculus
cgcgcacacaggagcctcgctaagg

SEQ ID NO: 445661 - DNA, 25 bp, Mus musculus
gcgagcgttggtgttctggctccaa

SEQ ID NO: 445662 - DNA, 25 bp, Mus musculus
gatcctctggaacgtggcaaacgtg

SEQ ID NO: 445663 - DNA, 25 bp, Mus musculus
ttctagtctgcctggatcctctgga

SEQ ID NO: 445664 - DNA, 25 bp, Mus musculus
ccagcggcttgtggctttctagtct

SEQ ID NO: 445665 - DNA, 25 bp, Mus musculus
ttgtcttttgctgcgcagtgactgc

SEQ ID NO: 445666 - DNA, 25 bp, Mus musculus
tgaaagacgccaacacgagccaatc

SEQ ID NO: 445667 - DNA, 25 bp, Mus musculus
ctcggacgacttgcaccagcgtgca

SEQ ID NO: 445668 - DNA, 25 bp, Mus musculus
tgtagcagcgccttagcgtccactg

SEQ ID NO: 445669 - DNA, 25 bp, Mus musculus
gggcttcgagactcctgtagcagcg

SEQ ID NO: 445670 - DNA, 25 bp, Mus musculus
cttgctgagtgcactagggacaccg

SEQ ID NO: 445671 - DNA, 25 bp, Mus musculus
ctcctcaggccaaagcttgtctttt

SEQ ID NO: 445672 - DNA, 25 bp, Mus musculus
cttctcgccgccgtcagcgtgccag

SEQ ID NO: 445673 - DNA, 25 bp, Mus musculus
cgtgagagtaagaccgtcgtagata

SEQ ID NO: 445674 - DNA, 25 bp, Mus musculus
ccgtcgtagataaggctcgagatcc

SEQ ID NO: 445675 - DNA, 25 bp, Mus musculus
taaggctcgagatccgtgctgagtc

SEQ ID NO: 445676 - DNA, 25 bp, Mus musculus
agatccgtgctgagtccctctctgc

SEQ ID NO: 445677 - DNA, 25 bp, Mus musculus
aggcagcatggtgcccagcttctcg

SEQ ID NO: 445678 - DNA, 25 bp, Mus musculus
ctgtagggctgacacaggggctgac

SEQ ID NO: 445679 - DNA, 25 bp, Mus musculus
tcagcgtgccagtggcaggcgcctt

SEQ ID NO: 445680 - DNA, 25 bp, Mus musculus
ccagcatggtgctgtcccggtgagg

SEQ ID NO: 445681 - DNA, 25 bp, Mus musculus
tacaggcccgagaccatgactcgga

SEQ ID NO: 445682 - DNA, 25 bp, Mus musculus
cccgagaccatgactcggaaggagg

SEQ ID NO: 445683 - DNA, 25 bp, Mus musculus
ccacgcctccaatggacgggaggta

SEQ ID NO: 445684 - DNA, 25 bp, Mus musculus
agctggcgtccacgcctccaatgga

SEQ ID NO: 445685 - DNA, 25 bp, Mus musculus
ctgcctgagcgccattccagcagtc

SEQ ID NO: 445686 - DNA, 25 bp, Mus musculus
ttctgctcgctcagaacggccgcgg

SEQ ID NO: 445687 - DNA, 25 bp, Mus musculus
tgcccttggccacctccttggtgag

SEQ ID NO: 445688 - DNA, 25 bp, Mus musculus
cttacctcggtgtcgtagagtcgca

SEQ ID NO: 445689 - DNA, 25 bp, Mus musculus
tcgtagagtcgcaggtccaggaagt

SEQ ID NO: 445690 - DNA, 25 bp, Mus musculus
aggagtgactcgttgcggatctgct

SEQ ID NO: 445691 - DNA, 25 bp, Mus musculus
tgctcgatggctagctccacggcgg

SEQ ID NO: 445692 - DNA, 25 bp, Mus musculus
cgggagccaacgacagcagcaacga

SEQ ID NO: 445693 - DNA, 25 bp, Mus musculus
cgccagctcactcggcccgcatggc

SEQ ID NO: 445694 - DNA, 25 bp, Mus musculus
tgacggatcaatcacgccgggaagg

SEQ ID NO: 445695 - DNA, 25 bp, Mus musculus
gtgcgcgatcgcagctctttcctgc

SEQ ID NO: 445696 - DNA, 25 bp, Mus musculus
agctctttcctgctcggagccgcgg

SEQ ID NO: 445697 - DNA, 25 bp, Mus musculus
ttcgggggaatcgaagctgctatgc

SEQ ID NO: 445698 - DNA, 25 bp, Mus musculus
cggatctgctcgatggctagctcca

SEQ ID NO: 445699 - DNA, 25 bp, Mus musculus
acctccttggtgagcggcatgaggc

SEQ ID NO: 445700 - DNA, 25 bp, Mus musculus
ttcctgttcgttcctactgaatccg

SEQ ID NO: 445701 - DNA, 25 bp, Mus musculus
tgaatcgggacgaatgggtcagccc

SEQ ID NO: 445702 - DNA, 25 bp, Mus musculus
ttcactagcgctccctaaacagtcg

SEQ ID NO: 445703 - DNA, 25 bp, Mus musculus
gaatccgacctctgggcctagctta

SEQ ID NO: 445704 - DNA, 25 bp, Mus musculus
ggtcactcttcagtcttcctgttcg

SEQ ID NO: 445705 - DNA, 25 bp, Mus musculus
gcctgtgactgtgcggtcactcttc

SEQ ID NO: 445706 - DNA, 25 bp, Mus musculus
taaacagtcgcaggctgaatcggga

SEQ ID NO: 445707 - DNA, 25 bp, Mus musculus
cgtgtcggtgtcaccctgctcgcag

SEQ ID NO: 445708 - DNA, 25 bp, Mus musculus
agttgcccgcctcatcggaacagtc

SEQ ID NO: 445709 - DNA, 25 bp, Mus musculus
ccttacgagtggctcgtggccaccg

SEQ ID NO: 445710 - DNA, 25 bp, Mus musculus
cggcgcagcaggaaccttacgagtg

SEQ ID NO: 445711 - DNA, 25 bp, Mus musculus
ttgcggctgttgaccgaggctccgc

SEQ ID NO: 445712 - DNA, 25 bp, Mus musculus
cgctccagccgtagtggttgcggct

SEQ ID NO: 445713 - DNA, 25 bp, Mus musculus
ggcctagcttagaactcatctcgca

SEQ ID NO: 445714 - DNA, 25 bp, Mus musculus
tgagcgaccgtatctcgctgcaccg

SEQ ID NO: 445715 - DNA, 25 bp, Mus musculus
cccgagcgctggaaccctctgtgag

SEQ ID NO: 445716 - DNA, 25 bp, Mus musculus
cgcagcatccttctcgggaggaggt

SEQ ID NO: 445717 - DNA, 25 bp, Mus musculus
ggacgcagcatccttctcgggagga

SEQ ID NO: 445718 - DNA, 25 bp, Mus musculus
actggcgcgtgggacgcagcatcct

SEQ ID NO: 445719 - DNA, 25 bp, Mus musculus
cctctgtgagtagtcgcggagcact

SEQ ID NO: 445720 - DNA, 25 bp, Mus musculus
atctatctgagcgaccgtatctcgc

SEQ ID NO: 445721 - DNA, 25 bp, Mus musculus
caacatctatctgagcgaccgtatc

SEQ ID NO: 445722 - DNA, 25 bp, Mus musculus
gcagcaccagatcaacatctatctg

SEQ ID NO: 445723 - DNA, 25 bp, Mus musculus
cgtgaagcagcaccagatcaacatc

SEQ ID NO: 445724 - DNA, 25 bp, Mus musculus
gcccgccgatgctctgggagcgcat

SEQ ID NO: 445725 - DNA, 25 bp, Mus musculus
aggcgttgctggcactgctggccct

SEQ ID NO: 445726 - DNA, 25 bp, Mus musculus
gcgtcacgagccagtgctgcccagg

SEQ ID NO: 445727 - DNA, 25 bp, Mus musculus
gcgctggaaccctctgtgagtagtc

SEQ ID NO: 445728 - DNA, 25 bp, Mus musculus
caggtaagccacagccgcttgggtt

SEQ ID NO: 445729 - DNA, 25 bp, Mus musculus
aactatcccaaagcgcgctgggctc

SEQ ID NO: 445730 - DNA, 25 bp, Mus musculus
agaggggttttagctgtacagtgac

SEQ ID NO: 445731 - DNA, 25 bp, Mus musculus
ctcagcgaaggcacacaagagtgtc

SEQ ID NO: 445732 - DNA, 25 bp, Mus musculus
tcctaggcgctgagatgattgcctc

SEQ ID NO: 445733 - DNA, 25 bp, Mus musculus
gagtacttgcttggcgcggcgcaca

SEQ ID NO: 445734 - DNA, 25 bp, Mus musculus
gtgacaacacactgccaaactatcc

SEQ ID NO: 445735 - DNA, 25 bp, Mus musculus
tacggcgcctcattcctggacataa

SEQ ID NO: 445736 - DNA, 25 bp, Mus musculus
tgcagacccgcgctgcgacaggtaa

SEQ ID NO: 445737 - DNA, 25 bp, Mus musculus
ccgaggtggctgctctccatcatct

SEQ ID NO: 445738 - DNA, 25 bp, Mus musculus
tgccaccgcttcttgcaggaggacc

SEQ ID NO: 445739 - DNA, 25 bp, Mus musculus
tgcaccatgacacacaggtaggacc

SEQ ID NO: 445740 - DNA, 25 bp, Mus musculus
accgagcgcagcctttgttccgcgg

SEQ ID NO: 445741 - DNA, 25 bp, Mus musculus
cctggacataaaagggagtacttgc

SEQ ID NO: 445742 - DNA, 25 bp, Mus musculus
cgctattaccgatgctttccagaaa

SEQ ID NO: 445743 - DNA, 25 bp, Mus musculus
cggtgaagcccaatagcgcccaagg

SEQ ID NO: 445744 - DNA, 25 bp, Mus musculus
cgccagcgggttatcctctactaca

SEQ ID NO: 445745 - DNA, 25 bp, Mus musculus
ggggcgtgctcttcgctattaccga

SEQ ID NO: 445746 - DNA, 25 bp, Mus musculus
ggctcccacgtgtcccgtgaagctg

SEQ ID NO: 445747 - DNA, 25 bp, Mus musculus
cgtgaagctgcggttttctccgtgc

SEQ ID NO: 445748 - DNA, 25 bp, Mus musculus
tctccgtgcccgtgatgaccaacag

SEQ ID NO: 445749 - DNA, 25 bp, Mus musculus
tgaccaacaggtggaatcgttttgc

SEQ ID NO: 445750 - DNA, 25 bp, Mus musculus
atcgttttgctgtgaccgtccaggg

SEQ ID NO: 445751 - DNA, 25 bp, Mus musculus
cctgcggctttcaagtgtggaggat

SEQ ID NO: 445752 - DNA, 25 bp, Mus musculus
gcttacagctttgggcctggtgcca

SEQ ID NO: 445753 - DNA, 25 bp, Mus musculus
gctatggcggtttcccggcttacag

SEQ ID NO: 445754 - DNA, 25 bp, Mus musculus
aaagtcatctacctgggcctgcggc

SEQ ID NO: 445755 - DNA, 25 bp, Mus musculus
accttcttcagggatttcgccattg

SEQ ID NO: 445756 - DNA, 25 bp, Mus musculus
gtcgtccgcagctcctcatcgtgtt

SEQ ID NO: 445757 - DNA, 25 bp, Mus musculus
cccggacaatattgagggtccgagt

SEQ ID NO: 445758 - DNA, 25 bp, Mus musculus
gcttcagctctttctcaaacatggc

SEQ ID NO: 445759 - DNA, 25 bp, Mus musculus
cagctcctcatcgtgttggtggcgg

SEQ ID NO: 445760 - DNA, 25 bp, Mus musculus
tctttctcaaacatggcgcggggcc

SEQ ID NO: 445761 - DNA, 25 bp, Mus musculus
cctcgagcagttacaaagggccgga

SEQ ID NO: 445762 - DNA, 25 bp, Mus musculus
gctctcggctaggtcccgctagggc

SEQ ID NO: 445763 - DNA, 25 bp, Mus musculus
cacggccgctcattggtagcccagg

SEQ ID NO: 445764 - DNA, 25 bp, Mus musculus
aggcagaaacccacggccgctcatt

SEQ ID NO: 445765 - DNA, 25 bp, Mus musculus
ggcgtggttagaggcagaaacccac

SEQ ID NO: 445766 - DNA, 25 bp, Mus musculus
tctttccctgagcaactctcacagg

SEQ ID NO: 445767 - DNA, 25 bp, Mus musculus
gtgcaacggtcacagtctttccctg

SEQ ID NO: 445768 - DNA, 25 bp, Mus musculus
tagaagaaaagagcgtgcaacggtc

SEQ ID NO: 445769 - DNA, 25 bp, Mus musculus
gggcctctggctcgcttcagctctt

SEQ ID NO: 445770 - DNA, 25 bp, Mus musculus
gcgcggtccatatcttcacatcaca

SEQ ID NO: 445771 - DNA, 25 bp, Mus musculus
cacgtagagcgccagaaagaccatg

SEQ ID NO: 445772 - DNA, 25 bp, Mus musculus
gaccatgcgcacgtaggagcagatg

SEQ ID NO: 445773 - DNA, 25 bp, Mus musculus
ctgcgcattgcaccgagagctcgcg

SEQ ID NO: 445774 - DNA, 25 bp, Mus musculus
tctcgatgaagcagtggttcgggtc

SEQ ID NO: 445775 - DNA, 25 bp, Mus musculus
ggctccgcctatacccatgtctggg

SEQ ID NO: 445776 - DNA, 25 bp, Mus musculus
cccatgtctgggtgcagaaacagca

SEQ ID NO: 445777 - DNA, 25 bp, Mus musculus
agcacagatgggctgtaaacccggg

SEQ ID NO: 445778 - DNA, 25 bp, Mus musculus
ctcggtacaggttttcggccatggt

SEQ ID NO: 445779 - DNA, 25 bp, Mus musculus
cggccatggtagatgagccgcgctt

SEQ ID NO: 445780 - DNA, 25 bp, Mus musculus
actgaaagccgagccagcgcaacta

SEQ ID NO: 445781 - DNA, 25 bp, Mus musculus
cacgtcgaactcctcgccggagaga

SEQ ID NO: 445782 - DNA, 25 bp, Mus musculus
cgagcttctgcaagctcctgcaagc

SEQ ID NO: 445783 - DNA, 25 bp, Mus musculus
tcgccggagagaaacagcacgtaga

SEQ ID NO: 445784 - DNA, 25 bp, Mus musculus
gcaacagagcaacctagcttccgct

SEQ ID NO: 445785 - DNA, 25 bp, Mus musculus
cgcgcatgcgtcagctcggcccgca

SEQ ID NO: 445786 - DNA, 25 bp, Mus musculus
cttcgcgcatgcgtcagctcggccc

SEQ ID NO: 445787 - DNA, 25 bp, Mus musculus
ctccgcccggcaggtagcctagagg

SEQ ID NO: 445788 - DNA, 25 bp, Mus musculus
gctccgcccggcaggtagcctagag

SEQ ID NO: 445789 - DNA, 25 bp, Mus musculus
gcccagagcgcaagcgctcctcctc

SEQ ID NO: 445790 - DNA, 25 bp, Mus musculus
aaaaggcccagagcgcaagcgctcc

SEQ ID NO: 445791 - DNA, 25 bp, Mus musculus
ggaaaaggcccagagcgcaagcgct

SEQ ID NO: 445792 - DNA, 25 bp, Mus musculus
cggaaaaggcccagagcgcaagcgc

SEQ ID NO: 445793 - DNA, 25 bp, Mus musculus
cccggcggaaaaggcccagagcgca

SEQ ID NO: 445794 - DNA, 25 bp, Mus musculus
cctcgccagggtcccgcgagaactt

SEQ ID NO: 445795 - DNA, 25 bp, Mus musculus
agcttccgctcctcgccagggtccc

SEQ ID NO: 445796 - DNA, 25 bp, Mus musculus
acctagcttccgctcctcgccaggg

SEQ ID NO: 445797 - DNA, 25 bp, Mus musculus
agagcaacctagcttccgctcctcg

SEQ ID NO: 445798 - DNA, 25 bp, Mus musculus
ggcagtccgctctccgggcagagtc

SEQ ID NO: 445799 - DNA, 25 bp, Mus musculus
tcgactcctccgtgacgtccgggat

SEQ ID NO: 445800 - DNA, 25 bp, Mus musculus
ccagaggcttgcaatgcccgggcga

SEQ ID NO: 445801 - DNA, 25 bp, Mus musculus
cacgttgccgggcatcagacagggt

SEQ ID NO: 445802 - DNA, 25 bp, Mus musculus
gcatcagacagggtcgaaccgagta

SEQ ID NO: 445803 - DNA, 25 bp, Mus musculus
caagatggcgactcggcagtccgct

SEQ ID NO: 445804 - DNA, 25 bp, Mus musculus
cactaaaaatagctgggacccgtct

SEQ ID NO: 445805 - DNA, 25 bp, Mus musculus
gctgggacccgtctatatttggttc

SEQ ID NO: 445806 - DNA, 25 bp, Mus musculus
ctatatttggttcgccggatcccgg

SEQ ID NO: 445807 - DNA, 25 bp, Mus musculus
tgaccgaggggaatctactccgcta

SEQ ID NO: 445808 - DNA, 25 bp, Mus musculus
ggggaatctactccgctatctgccg

SEQ ID NO: 445809 - DNA, 25 bp, Mus musculus
gccaaccgcccaatttagaaacatc

SEQ ID NO: 445810 - DNA, 25 bp, Mus musculus
agaaacatcgcctgcgtcaatcacg

SEQ ID NO: 445811 - DNA, 25 bp, Mus musculus
cgaaccgagtacaagatggcgactc

SEQ ID NO: 445812 - DNA, 25 bp, Mus musculus
actcgctctaaagacggaaccgcca

SEQ ID NO: 445813 - DNA, 25 bp, Mus musculus
cccatgagttgggatcgcagcatcc

SEQ ID NO: 445814 - DNA, 25 bp, Mus musculus
caatccagatttcggggtcgctctc

SEQ ID NO: 445815 - DNA, 25 bp, Mus musculus
tggccgcgcgaatctgagaagcctc

SEQ ID NO: 445816 - DNA, 25 bp, Mus musculus
ccttccgggacagcagctgtgactc

SEQ ID NO: 445817 - DNA, 25 bp, Mus musculus
agactggatgcctgcggaacctctc

SEQ ID NO: 445818 - DNA, 25 bp, Mus musculus
ttgcaacgctgacagagcccgcagt

SEQ ID NO: 445819 - DNA, 25 bp, Mus musculus
ctccagggctcactttgcaacgctg

SEQ ID NO: 445820 - DNA, 25 bp, Mus musculus
gctagggctcctgtggcataaatga

SEQ ID NO: 445821 - DNA, 25 bp, Mus musculus
caggcactctatggagaggctgcta

SEQ ID NO: 445822 - DNA, 25 bp, Mus musculus
acattgacgtctcgcattccaggca

SEQ ID NO: 445823 - DNA, 25 bp, Mus musculus
gtagcgtcccatgtcgtcacattga

SEQ ID NO: 445824 - DNA, 25 bp, Mus musculus
ggtttccattgtgcggccgtgagaa

SEQ ID NO: 445825 - DNA, 25 bp, Mus musculus
ggtcgctctctagaaactcgctcta

SEQ ID NO: 445826 - DNA, 25 bp, Mus musculus
gtaacttagccactcgctcgccatg

SEQ ID NO: 445827 - DNA, 25 bp, Mus musculus
ccggacaacatcaggggcaggagcc

SEQ ID NO: 445828 - DNA, 25 bp, Mus musculus
gtggggctcttccagctctcacctt

SEQ ID NO: 445829 - DNA, 25 bp, Mus musculus
cccgcactcgtagtctgcaggagga

SEQ ID NO: 445830 - DNA, 25 bp, Mus musculus
gtccctggagaagttcgagcagctg

SEQ ID NO: 445831 - DNA, 25 bp, Mus musculus
tcgctcgccatggacactcctaggg

SEQ ID NO: 445832 - DNA, 25 bp, Mus musculus
actcctagggtccttctctgggcga

SEQ ID NO: 445833 - DNA, 25 bp, Mus musculus
ctgggcgatcttcctcattagcttc

SEQ ID NO: 445834 - DNA, 25 bp, Mus musculus
attagcttcctctgggatttgccgg

SEQ ID NO: 445835 - DNA, 25 bp, Mus musculus
cgggtttccagcaggcttccatctc

SEQ ID NO: 445836 - DNA, 25 bp, Mus musculus
tccaccgaattggactccaccaaag

SEQ ID NO: 445837 - DNA, 25 bp, Mus musculus
tccaccaaagacgtggggaaccgca

SEQ ID NO: 445838 - DNA, 25 bp, Mus musculus
aagatgcagcgaactccacaagaga

SEQ ID NO: 445839 - DNA, 25 bp, Mus musculus
tttgtgtagctgctacccggctccc

SEQ ID NO: 445840 - DNA, 25 bp, Mus musculus
cacacttcaccacggggagaggaac

SEQ ID NO: 445841 - DNA, 25 bp, Mus musculus
agcccaggtcacaatggtgtgtttc

SEQ ID NO: 445842 - DNA, 25 bp, Mus musculus
ccgattggaaactccgcggaggagc

SEQ ID NO: 445843 - DNA, 25 bp, Mus musculus
tcacaatggtgtgtttcacggtttc

SEQ ID NO: 445844 - DNA, 25 bp, Mus musculus
atggtgtgtttcacggtttcctcca

SEQ ID NO: 445845 - DNA, 25 bp, Mus musculus
tgtttcacggtttcctccacacact

SEQ ID NO: 445846 - DNA, 25 bp, Mus musculus
ccacacacttcaccacggggagagg

SEQ ID NO: 445847 - DNA, 25 bp, Mus musculus
ctttgacagaggtagttatttcttc

SEQ ID NO: 445848 - DNA, 25 bp, Mus musculus
cctaatttacaaccccgaggctctg

SEQ ID NO: 445849 - DNA, 25 bp, Mus musculus
gccacgagccggagcgacagaacgt

SEQ ID NO: 445850 - DNA, 25 bp, Mus musculus
gccggagcgacagaacgtgtttcca

SEQ ID NO: 445851 - DNA, 25 bp, Mus musculus
gacagaacgtgtttccaggcgcaga

SEQ ID NO: 445852 - DNA, 25 bp, Mus musculus
gcgcagaggctttacctaggtaacc

SEQ ID NO: 445853 - DNA, 25 bp, Mus musculus
caggcgcagaggctttacctaggta

SEQ ID NO: 445854 - DNA, 25 bp, Mus musculus
caagaggacggccacgctgaccttc

SEQ ID NO: 445855 - DNA, 25 bp, Mus musculus
acgctgcctgccagcactacggagt

SEQ ID NO: 445856 - DNA, 25 bp, Mus musculus
tgtgcggcgacaacgctgcctgcca

SEQ ID NO: 445857 - DNA, 25 bp, Mus musculus
cacatgtgccgtgtgcggcgacaac

SEQ ID NO: 445858 - DNA, 25 bp, Mus musculus
accgcgtccagcctgctgggagaga

SEQ ID NO: 445859 - DNA, 25 bp, Mus musculus
ctggccaagaggacggccacgctga

SEQ ID NO: 445860 - DNA, 25 bp, Mus musculus
cagccaagctgctgcgctcgagggc

SEQ ID NO: 445861 - DNA, 25 bp, Mus musculus
tgcgcgcttcccgatcttcttcaag

SEQ ID NO: 445862 - DNA, 25 bp, Mus musculus
tggacccgcagatgaaggcggtacc

SEQ ID NO: 445863 - DNA, 25 bp, Mus musculus
gaccgctgctggacccgcagatgaa

SEQ ID NO: 445864 - DNA, 25 bp, Mus musculus
tgcgcctggctgcatcgctccggga

SEQ ID NO: 445865 - DNA, 25 bp, Mus musculus
tgtacttcaagcagtctccgccttc

SEQ ID NO: 445866 - DNA, 25 bp, Mus musculus
agcacctccatgtacttcaagcagt

SEQ ID NO: 445867 - DNA, 25 bp, Mus musculus
atcatctggggaaggcacatgtgcc

SEQ ID NO: 445868 - DNA, 25 bp, Mus musculus
acgcgacaccggtgcccaagcagga

SEQ ID NO: 445869 - DNA, 25 bp, Mus musculus
cgcgtctgcgcagtgtgtatcgacg

SEQ ID NO: 445870 - DNA, 25 bp, Mus musculus
cgcagtgtgtatcgacggcctcgag

SEQ ID NO: 445871 - DNA, 25 bp, Mus musculus
tatcgacggcctcgagcgcctaggc

SEQ ID NO: 445872 - DNA, 25 bp, Mus musculus
tcgctgggctgcgatgtgtcaccgc

SEQ ID NO: 445873 - DNA, 25 bp, Mus musculus
ggcgccggtcaccaagcccggcctc

SEQ ID NO: 445874 - DNA, 25 bp, Mus musculus
ccagaagtggccaagcctctctgtt

SEQ ID NO: 445875 - DNA, 25 bp, Mus musculus
agtggccaagcctctctgttttcag

SEQ ID NO: 445876 - DNA, 25 bp, Mus musculus
aagcctctctgttttcagttttgga

SEQ ID NO: 445877 - DNA, 25 bp, Mus musculus
tcagttttggagtagctgtccctgc

SEQ ID NO: 445878 - DNA, 25 bp, Mus musculus
ttttggagtagctgtccctgcggga

SEQ ID NO: 445879 - DNA, 25 bp, Mus musculus
ctatgccctcccgggtcgctgtgaa

SEQ ID NO: 445880 - DNA, 25 bp, Mus musculus
actccgtgagggacgacgcgacacc

SEQ ID NO: 445881 - DNA, 25 bp, Mus musculus
tcgctgtgaagagctgcttcgggcc

SEQ ID NO: 445882 - DNA, 25 bp, Mus musculus
gacacagtcggagggtttgtcaccc

SEQ ID NO: 445883 - DNA, 25 bp, Mus musculus
cccgggacgccattcttggagtcag

SEQ ID NO: 445884 - DNA, 25 bp, Mus musculus
aagggaccgcgtacctctgtgcctc

SEQ ID NO: 445885 - DNA, 25 bp, Mus musculus
gagcatctgaggtctgctaaagaca

SEQ ID NO: 445886 - DNA, 25 bp, Mus musculus
aggctacttcttcagagctcccggg

SEQ ID NO: 445887 - DNA, 25 bp, Mus musculus
tgtgcctccgggacgggaactacaa

SEQ ID NO: 445888 - DNA, 25 bp, Mus musculus
actctctttcccagtaagccctgtg

SEQ ID NO: 445889 - DNA, 25 bp, Mus musculus
ccatgtcatcggagagctgggactc

SEQ ID NO: 445890 - DNA, 25 bp, Mus musculus
ctgtagtttcattgaccatgtcatc

SEQ ID NO: 445891 - DNA, 25 bp, Mus musculus
gggtcctgcccatctcgaagcacgt

SEQ ID NO: 445892 - DNA, 25 bp, Mus musculus
gggacaacttccagagaggcctctc

SEQ ID NO: 445893 - DNA, 25 bp, Mus musculus
cagcggcgaacacccgggacaactt

SEQ ID NO: 445894 - DNA, 25 bp, Mus musculus
caggattcatggtaacgacggggtc

SEQ ID NO: 445895 - DNA, 25 bp, Mus musculus
tcaccaggagcagcaaggagcatct

SEQ ID NO: 445896 - DNA, 25 bp, Mus musculus
gaccgcaggtcgcaatcgcgcgcag

SEQ ID NO: 445897 - DNA, 25 bp, Mus musculus
gccgcttgaggcgtttcggaagccc

SEQ ID NO: 445898 - DNA, 25 bp, Mus musculus
ttcgagctcgcacaccaaaaatgga

SEQ ID NO: 445899 - DNA, 25 bp, Mus musculus
cgcacaccaaaaatggaaactccgt

SEQ ID NO: 445900 - DNA, 25 bp, Mus musculus
aaaccatggttcctatacctcagtg

SEQ ID NO: 445901 - DNA, 25 bp, Mus musculus
tatacctcagtggacgtcgagtgga

SEQ ID NO: 445902 - DNA, 25 bp, Mus musculus
tcgagtggagtctctggcccgaccc

SEQ ID NO: 445903 - DNA, 25 bp, Mus musculus
cccagaagagccgtgcaggacagac

SEQ ID NO: 445904 - DNA, 25 bp, Mus musculus
aggacagacagacgccgctcacctg

SEQ ID NO: 445905 - DNA, 25 bp, Mus musculus
cggagagcgagcgaccgtcaagccc

SEQ ID NO: 445906 - DNA, 25 bp, Mus musculus
cgctcgctcccagagcgtgttttca

SEQ ID NO: 445907 - DNA, 25 bp, Mus musculus
gctcccagagcgtgttttcaaatcg

SEQ ID NO: 445908 - DNA, 25 bp, Mus musculus
gcgggtccagatttgcacgccacgc

SEQ ID NO: 445909 - DNA, 25 bp, Mus musculus
gtgttttcaaatcgcctcgtcctca

SEQ ID NO: 445910 - DNA, 25 bp, Mus musculus
agggcccacgtcagtcaggaggctc

SEQ ID NO: 445911 - DNA, 25 bp, Mus musculus
cccggtgtgggaaaatgcattcttt

SEQ ID NO: 445912 - DNA, 25 bp, Mus musculus
gtcccactgggtaggcacacagggt

SEQ ID NO: 445913 - DNA, 25 bp, Mus musculus
cattcttttgttgttggcggagacg

SEQ ID NO: 445914 - DNA, 25 bp, Mus musculus
agtcaggaggctcgcgctaactcgt

SEQ ID NO: 445915 - DNA, 25 bp, Mus musculus
cgaaaagggcccacgtcagtcagga

SEQ ID NO: 445916 - DNA, 25 bp, Mus musculus
gtgccgttcccagcctcgtggagtc

SEQ ID NO: 445917 - DNA, 25 bp, Mus musculus
agttggcgctgaactcagagtagga

SEQ ID NO: 445918 - DNA, 25 bp, Mus musculus
atcacaaaagttggcgctgaactca

SEQ ID NO: 445919 - DNA, 25 bp, Mus musculus
ccgcccattagaatcacaaaagttg

SEQ ID NO: 445920 - DNA, 25 bp, Mus musculus
tctggagacacatcccgcccattag

SEQ ID NO: 445921 - DNA, 25 bp, Mus musculus
tcgtgtcctgaggtcggtgcacgta

SEQ ID NO: 445922 - DNA, 25 bp, Mus musculus
acacagggtctgagtcgtgtcctga

SEQ ID NO: 445923 - DNA, 25 bp, Mus musculus
ctcgcgctaactcgtgcgggcgact

SEQ ID NO: 445924 - DNA, 25 bp, Mus musculus
aggagcccgaataccaccaggatgc

SEQ ID NO: 445925 - DNA, 25 bp, Mus musculus
gctcaagaagtgctgggagaacatc

SEQ ID NO: 445926 - DNA, 25 bp, Mus musculus
cgacgcgcggactattgctctcaag

SEQ ID NO: 445927 - DNA, 25 bp, Mus musculus
ttgctctcaagcagcggacctggca

SEQ ID NO: 445928 - DNA, 25 bp, Mus musculus
ggccttggcccacgagtacaactcg

SEQ ID NO: 445929 - DNA, 25 bp, Mus musculus
agtacaactcgcagcccagcgtgtc

SEQ ID NO: 445930 - DNA, 25 bp, Mus musculus
ctgcgggacttcaaacagctcaaga

SEQ ID NO: 445931 - DNA, 25 bp, Mus musculus
ggagaacatcaaggctcggaccaaa

SEQ ID NO: 445932 - DNA, 25 bp, Mus musculus
aaattatggcccacgagaggcggga

SEQ ID NO: 445933 - DNA, 25 bp, Mus musculus
gagcccgttgctgagcagccacgtc

SEQ ID NO: 445934 - DNA, 25 bp, Mus musculus
agccacgtcctggacaaggagaaga

SEQ ID NO: 445935 - DNA, 25 bp, Mus musculus
cagcagcatgctgccggagcaactg

SEQ ID NO: 445936 - DNA, 25 bp, Mus musculus
acttccttcagagcccaccggagga

SEQ ID NO: 445937 - DNA, 25 bp, Mus musculus
ggagcaactgtacttccttcagagc

SEQ ID NO: 445938 - DNA, 25 bp, Mus musculus
gggccagcgactgccaatcctgatg

SEQ ID NO: 445939 - DNA, 25 bp, Mus musculus
aggcggcaagcctcctcagagttgc

SEQ ID NO: 445940 - DNA, 25 bp, Mus musculus
ctaaaaacgcgggagcttcgtgccg

SEQ ID NO: 445941 - DNA, 25 bp, Mus musculus
cccggatcgctttagagtaacaatc

SEQ ID NO: 445942 - DNA, 25 bp, Mus musculus
gtaacaatcacacaattccgccagg

SEQ ID NO: 445943 - DNA, 25 bp, Mus musculus
taaaggcggttttctgccacagcgc

SEQ ID NO: 445944 - DNA, 25 bp, Mus musculus
aatcagcgtcgggatctttggcttg

SEQ ID NO: 445945 - DNA, 25 bp, Mus musculus
agttgcccacaacggacatggctgc

SEQ ID NO: 445946 - DNA, 25 bp, Mus musculus
tctgagttcctacccgaggcgagga

SEQ ID NO: 445947 - DNA, 25 bp, Mus musculus
tgcacctagcaagtggcaccaaagg

SEQ ID NO: 445948 - DNA, 25 bp, Mus musculus
tgccggggtcccacgtcagaaataa

SEQ ID NO: 445949 - DNA, 25 bp, Mus musculus
ttgtgtccaacaaagaacccttggc

SEQ ID NO: 445950 - DNA, 25 bp, Mus musculus
tcctgatgccacgagtgtttatttg

SEQ ID NO: 445951 - DNA, 25 bp, Mus musculus
aggttacagctgagcgcaccaaaca

SEQ ID NO: 445952 - DNA, 25 bp, Mus musculus
ccaacgaggctgtcccgagcgcgga

SEQ ID NO: 445953 - DNA, 25 bp, Mus musculus
agcaactgctcaggtaggagccgcc

SEQ ID NO: 445954 - DNA, 25 bp, Mus musculus
agaggcaagagcaactgctcaggta

SEQ ID NO: 445955 - DNA, 25 bp, Mus musculus
ctcttcgccttctgcctgcccggga

SEQ ID NO: 445956 - DNA, 25 bp, Mus musculus
ccgtctgcggctacacgtcggtgct

SEQ ID NO: 445957 - DNA, 25 bp, Mus musculus
ggtctcccaacgaggctgtcccgag

SEQ ID NO: 445958 - DNA, 25 bp, Mus musculus
gcgagctagaagctgcgtccgtccc

SEQ ID NO: 445959 - DNA, 25 bp, Mus musculus
agcctgcgagctagaagctgcgtcc

SEQ ID NO: 445960 - DNA, 25 bp, Mus musculus
cctcaggaacaatggctccccggga

SEQ ID NO: 445961 - DNA, 25 bp, Mus musculus
gaagctctctccagtatcctcggcg

SEQ ID NO: 445962 - DNA, 25 bp, Mus musculus
cacaaagggcttctgagacaccgtc

SEQ ID NO: 445963 - DNA, 25 bp, Mus musculus
ggaaaggctcacaaagggcttctga

SEQ ID NO: 445964 - DNA, 25 bp, Mus musculus
aaggcgcgtgggaaaggctcacaaa

SEQ ID NO: 445965 - DNA, 25 bp, Mus musculus
ctacacgtcggtgcttctgctcttc

SEQ ID NO: 445966 - DNA, 25 bp, Mus musculus
ctctcctgtcatttggaaaacgtgg

SEQ ID NO: 445967 - DNA, 25 bp, Mus musculus
acctggacccaacgacaagaggagg

SEQ ID NO: 445968 - DNA, 25 bp, Mus musculus
ggggaatctgtgatcccgcgcactc

SEQ ID NO: 445969 - DNA, 25 bp, Mus musculus
tctcccacgcaagcggaatgcagca

SEQ ID NO: 445970 - DNA, 25 bp, Mus musculus
cgtctgcagccgctgcctgaatgca

SEQ ID NO: 445971 - DNA, 25 bp, Mus musculus
cccaatagggcgcaaggaaggaagc

SEQ ID NO: 445972 - DNA, 25 bp, Mus musculus
gcacagctgaggctggacatactgg

SEQ ID NO: 445973 - DNA, 25 bp, Mus musculus
gtttccgactggacgaagcgactca

SEQ ID NO: 445974 - DNA, 25 bp, Mus musculus
ccacgcctggcttgccggttgcaag

SEQ ID NO: 445975 - DNA, 25 bp, Mus musculus
tgcagatgaaggtaatgccctggtt

SEQ ID NO: 445976 - DNA, 25 bp, Mus musculus
aatgccctggttgttccgaggagga

SEQ ID NO: 445977 - DNA, 25 bp, Mus musculus
gagcgcgatcccatcccagcgagga

SEQ ID NO: 445978 - DNA, 25 bp, Mus musculus
ggctcgtaaactttcctctcctgtc

SEQ ID NO: 445979 - DNA, 25 bp, Mus musculus
gccagatggacccagaagaaagcta

SEQ ID NO: 445980 - DNA, 25 bp, Mus musculus
tatgcattccgggaaatgtagttcg

SEQ ID NO: 445981 - DNA, 25 bp, Mus musculus
tcgctccctgggcatgttgggagtt

SEQ ID NO: 445982 - DNA, 25 bp, Mus musculus
gagacacgatcagcgccgccattct

SEQ ID NO: 445983 - DNA, 25 bp, Mus musculus
cgaaggctccgggtaacgccttctg

SEQ ID NO: 445984 - DNA, 25 bp, Mus musculus
atgtagttcgcttgccatttacgga

SEQ ID NO: 445985 - DNA, 25 bp, Mus musculus
ccagacctatgcattccgggaaatg

SEQ ID NO: 445986 - DNA, 25 bp, Mus musculus
ctgacgttgcccagacctatgcatt

SEQ ID NO: 445987 - DNA, 25 bp, Mus musculus
agatgagagcttacttcagcggccc

SEQ ID NO: 445988 - DNA, 25 bp, Mus musculus
gccaatcagatgagagcttacttca

SEQ ID NO: 445989 - DNA, 25 bp, Mus musculus
cgtgcccgactcagccaatcagatg

SEQ ID NO: 445990 - DNA, 25 bp, Mus musculus
aagagcgccagacgtgcccgactca

SEQ ID NO: 445991 - DNA, 25 bp, Mus musculus
ttctcgacaagcaacccaagagcgc

SEQ ID NO: 445992 - DNA, 25 bp, Mus musculus
gatcagcgccgccattctcgacaag

SEQ ID NO: 445993 - DNA, 25 bp, Mus musculus
tcgcttgccatttacggaagaaggc

SEQ ID NO: 445994 - DNA, 25 bp, Mus musculus
ccctagagtacgaggcctatcactg

SEQ ID NO: 445995 - DNA, 25 bp, Mus musculus
agcgcgccctgcttgtagtgttcac

SEQ ID NO: 445996 - DNA, 25 bp, Mus musculus
attgctactggacgccaggaccctg

SEQ ID NO: 445997 - DNA, 25 bp, Mus musculus
tggatcctcagggaccaacccaggc

SEQ ID NO: 445998 - DNA, 25 bp, Mus musculus
cccaggccggctgggaagtcttcga

SEQ ID NO: 445999 - DNA, 25 bp, Mus musculus
gccctcagccttggaagcagctgtg

SEQ ID NO: 446000 - DNA, 25 bp, Mus musculus
accgcctctggacctgcggagtctg

SEQ ID NO: 446001 - DNA, 25 bp, Mus musculus
gtagtgttcaccagatcgcagcgca

SEQ ID NO: 446002 - DNA, 25 bp, Mus musculus
tcgcagcgcaagaacctgttcactg

SEQ ID NO: 446003 - DNA, 25 bp, Mus musculus
acctgttcactgagatgcatgagca

SEQ ID NO: 446004 - DNA, 25 bp, Mus musculus
tgcatgagcagctgggctctgcaga

SEQ ID NO: 446005 - DNA, 25 bp, Mus musculus
tcacggcaagcgacatggcaagaag

SEQ ID NO: 446006 - DNA, 25 bp, Mus musculus
agcctctgcacgtgaattttaagga

SEQ ID NO: 446007 - DNA, 25 bp, Mus musculus
gctgcgctgcagcagaaagcctctg

SEQ ID NO: 446008 - DNA, 25 bp, Mus musculus
gcatctagggccctcgctgaccttg

SEQ ID NO: 446009 - DNA, 25 bp, Mus musculus
gcgtcagctacgtcctggcttgcca

SEQ ID NO: 446010 - DNA, 25 bp, Mus musculus
ctccggtcaccttcgctggaggacg

SEQ ID NO: 446011 - DNA, 25 bp, Mus musculus
ctcagtttgcccaccttcaggcaga

SEQ ID NO: 446012 - DNA, 25 bp, Mus musculus
ccatccatccactctggggaaaata

SEQ ID NO: 446013 - DNA, 25 bp, Mus musculus
tgagcgaaagctgcgacacacccat

SEQ ID NO: 446014 - DNA, 25 bp, Mus musculus
tggcacaagaacctgagcgaaagct

SEQ ID NO: 446015 - DNA, 25 bp, Mus musculus
acaacctcctgaacgcagtgcggca

SEQ ID NO: 446016 - DNA, 25 bp, Mus musculus
caggagatgccaggtcactgtgacc

SEQ ID NO: 446017 - DNA, 25 bp, Mus musculus
tcactgaagccgcattgtggtcccg

SEQ ID NO: 446018 - DNA, 25 bp, Mus musculus
atccgcatggtgagatcatcactga

SEQ ID NO: 446019 - DNA, 25 bp, Mus musculus
agtagcggaaggctcgcctcctcca

SEQ ID NO: 446020 - DNA, 25 bp, Mus musculus
cctgcagtttctggtgataatccgc

SEQ ID NO: 446021 - DNA, 25 bp, Mus musculus
ttcaggcagagactgcgagtccagc

SEQ ID NO: 446022 - DNA, 25 bp, Mus musculus
ggagttgccagagcccaggtttgct

SEQ ID NO: 446023 - DNA, 25 bp, Mus musculus
tcgtcccggagtttggatcggaagc

SEQ ID NO: 446024 - DNA, 25 bp, Mus musculus
cgtacacaatgcttcgcgttgaaga

SEQ ID NO: 446025 - DNA, 25 bp, Mus musculus
tcgcgttgaagagaccggtcacttt

SEQ ID NO: 446026 - DNA, 25 bp, Mus musculus
tttgggactggagtctgaaacagtc

SEQ ID NO: 446027 - DNA, 25 bp, Mus musculus
cggcagcgcacacgcagaactgact

SEQ ID NO: 446028 - DNA, 25 bp, Mus musculus
ccgtgcctcgggtaaagttgaagca

SEQ ID NO: 446029 - DNA, 25 bp, Mus musculus
tctcgcagcggatcccaagtgaatc

SEQ ID NO: 446030 - DNA, 25 bp, Mus musculus
agtgaatcccttggagtccctctcg

SEQ ID NO: 446031 - DNA, 25 bp, Mus musculus
ccttcgtgaagaagcgctgggagcc

SEQ ID NO: 446032 - DNA, 25 bp, Mus musculus
ggcgaggactctcgggtcccatctt

SEQ ID NO: 446033 - DNA, 25 bp, Mus musculus
tttgcaggcgaggtccaacccagat

SEQ ID NO: 446034 - DNA, 25 bp, Mus musculus
ctgtagttagccacgccggagccag

SEQ ID NO: 446035 - DNA, 25 bp, Mus musculus
ttgctgcttgccattgacgcctcgt

SEQ ID NO: 446036 - DNA, 25 bp, Mus musculus
gtccgatgcgcttgaggatctggca

SEQ ID NO: 446037 - DNA, 25 bp, Mus musculus
cacaactggccagcgaagggtggtt

SEQ ID NO: 446038 - DNA, 25 bp, Mus musculus
cttccttggaggagcgacacaactg

SEQ ID NO: 446039 - DNA, 25 bp, Mus musculus
cccacttatttactggggtggcaga

SEQ ID NO: 446040 - DNA, 25 bp, Mus musculus
gttcagttcaggagacacccactta

SEQ ID NO: 446041 - DNA, 25 bp, Mus musculus
gctgtactctcacttggctggcttc

SEQ ID NO: 446042 - DNA, 25 bp, Mus musculus
cgagaagccgccagacttgcaaggg

SEQ ID NO: 446043 - DNA, 25 bp, Mus musculus
ttccaagttgcagcctagcggacgc

SEQ ID NO: 446044 - DNA, 25 bp, Mus musculus
cgctccctgggcattccaagttgca

SEQ ID NO: 446045 - DNA, 25 bp, Mus musculus
cctagacgcggcgaagtggtcacag

SEQ ID NO: 446046 - DNA, 25 bp, Mus musculus
atcctgagcgcagcttccctagacg

SEQ ID NO: 446047 - DNA, 25 bp, Mus musculus
ggtctctgcctccaaatcctgagcg

SEQ ID NO: 446048 - DNA, 25 bp, Mus musculus
ctcctcattactgagacccgctggg

SEQ ID NO: 446049 - DNA, 25 bp, Mus musculus
ggttctgttctgagcgccaaagttc

SEQ ID NO: 446050 - DNA, 25 bp, Mus musculus
gcccagacctggaagaggtgctgcc

SEQ ID NO: 446051 - DNA, 25 bp, Mus musculus
cctgcggacagaagccaaggctccg

SEQ ID NO: 446052 - DNA, 25 bp, Mus musculus
cgcgatgtcagcacgacctatcttc

SEQ ID NO: 446053 - DNA, 25 bp, Mus musculus
cgctttccatgttcaaaacggtata

SEQ ID NO: 446054 - DNA, 25 bp, Mus musculus
cggtatagtctcctaccttccaata

SEQ ID NO: 446055 - DNA, 25 bp, Mus musculus
cgctatgtcgtttctgtgtttttcc

SEQ ID NO: 446056 - DNA, 25 bp, Mus musculus
ccagagcatgcctgacgcgatgtca

SEQ ID NO: 446057 - DNA, 25 bp, Mus musculus
cttagggcaaaagaggaagcgcttc

SEQ ID NO: 446058 - DNA, 25 bp, Mus musculus
aagcgcttcagtcaggcagatacta

SEQ ID NO: 446059 - DNA, 25 bp, Mus musculus
ctaggcaccaacagagcgcagacgc

SEQ ID NO: 446060 - DNA, 25 bp, Mus musculus
tttgctcgcgccgaaattcaaagga

SEQ ID NO: 446061 - DNA, 25 bp, Mus musculus
aacagttccggcacggttgttggct

SEQ ID NO: 446062 - DNA, 25 bp, Mus musculus
tcactgtccactttcgcgtcgggtt

SEQ ID NO: 446063 - DNA, 25 bp, Mus musculus
ctccgaccgatagcctgaaagggcc

SEQ ID NO: 446064 - DNA, 25 bp, Mus musculus
cagtgcggagaacgggccgtattct

SEQ ID NO: 446065 - DNA, 25 bp, Mus musculus
agaacgggccgtattctgggaactg

SEQ ID NO: 446066 - DNA, 25 bp, Mus musculus
tctgagcctcttgcgcctgcgggga

SEQ ID NO: 446067 - DNA, 25 bp, Mus musculus
gtccagcagggacccaatcgaagtt

SEQ ID NO: 446068 - DNA, 25 bp, Mus musculus
gacccaatcgaagttggcccgcgca

SEQ ID NO: 446069 - DNA, 25 bp, Mus musculus
ggcggtcttcctgcgcgctcaggac

SEQ ID NO: 446070 - DNA, 25 bp, Mus musculus
ctcaggaccgcaccatgctcgcgct

SEQ ID NO: 446071 - DNA, 25 bp, Mus musculus
tgctcgcgctccgaagcggcctaag

SEQ ID NO: 446072 - DNA, 25 bp, Mus musculus
ctccgaagcggcctaaggacagcgc

SEQ ID NO: 446073 - DNA, 25 bp, Mus musculus
agcggcctaaggacagcgctggccc

SEQ ID NO: 446074 - DNA, 25 bp, Mus musculus
cccgcgggttctgacgcctcaggta

SEQ ID NO: 446075 - DNA, 25 bp, Mus musculus
ttctgacgcctcaggtaggggccgc

SEQ ID NO: 446076 - DNA, 25 bp, Mus musculus
actgtccttaggtggtgtagaaacg

SEQ ID NO: 446077 - DNA, 25 bp, Mus musculus
gaatcccgcgcagggaggtggaact

SEQ ID NO: 446078 - DNA, 25 bp, Mus musculus
gttcagtcactcagcagaaagcacg

SEQ ID NO: 446079 - DNA, 25 bp, Mus musculus
tgacctgctagccttcgggaaacgg

SEQ ID NO: 446080 - DNA, 25 bp, Mus musculus
ggggcccgctttctgtagccctggc

SEQ ID NO: 446081 - DNA, 25 bp, Mus musculus
tgagagctttgtggggcccgctttc

SEQ ID NO: 446082 - DNA, 25 bp, Mus musculus
cagaaagcacgtggagacatggccc

SEQ ID NO: 446083 - DNA, 25 bp, Mus musculus
ggcctctgtttatgtagttcagtca

SEQ ID NO: 446084 - DNA, 25 bp, Mus musculus
cccttcccggcctctgtttatgtag

SEQ ID NO: 446085 - DNA, 25 bp, Mus musculus
ggtcaaacgctgttctctccctctt

SEQ ID NO: 446086 - DNA, 25 bp, Mus musculus
ttactaccggtcaaacgctgttctc

SEQ ID NO: 446087 - DNA, 25 bp, Mus musculus
tatagattcggctgtgccgagcgcc

SEQ ID NO: 446088 - DNA, 25 bp, Mus musculus
ttccttttatagattcggctgtgcc

SEQ ID NO: 446089 - DNA, 25 bp, Mus musculus
tgccgcgactagttccttttataga

SEQ ID NO: 446090 - DNA, 25 bp, Mus musculus
gaattactggtttttgccgcgacta

SEQ ID NO: 446091 - DNA, 25 bp, Mus musculus
ttaaaccggcgacagtgcgccgccg

SEQ ID NO: 446092 - DNA, 25 bp, Mus musculus
ttgctgaccacctcgacgatgcccg

SEQ ID NO: 446093 - DNA, 25 bp, Mus musculus
cggtgacccacggtgccttctggga

SEQ ID NO: 446094 - DNA, 25 bp, Mus musculus
acagggatgcccacccgcttgctga

SEQ ID NO: 446095 - DNA, 25 bp, Mus musculus
tatccgggagaagcttggtcgcaga

SEQ ID NO: 446096 - DNA, 25 bp, Mus musculus
tgatatccgggagaagcttggtcgc

SEQ ID NO: 446097 - DNA, 25 bp, Mus musculus
atcgtcggccgcaggttgtgatatc

SEQ ID NO: 446098 - DNA, 25 bp, Mus musculus
ccgcaggttgtgatatccgggagaa

SEQ ID NO: 446099 - DNA, 25 bp, Mus musculus
cccacccgagggagctggccgtagg

SEQ ID NO: 446100 - DNA, 25 bp, Mus musculus
tgtctgggctgaggcccacccgagg

SEQ ID NO: 446101 - DNA, 25 bp, Mus musculus
acgtacctggactgtctgggctgag

SEQ ID NO: 446102 - DNA, 25 bp, Mus musculus
acccgcttgctgaccacctcgacga

SEQ ID NO: 446103 - DNA, 25 bp, Mus musculus
ccttctgggaggacgtacctggact

SEQ ID NO: 446104 - DNA, 25 bp, Mus musculus
ctgggaggacgtacctggactgtct

SEQ ID NO: 446105 - DNA, 25 bp, Mus musculus
ccgtaggggacagatggcaggggat

SEQ ID NO: 446106 - DNA, 25 bp, Mus musculus
ccggggaggcatacgcttccctctc

SEQ ID NO: 446107 - DNA, 25 bp, Mus musculus
tgcctcgcgcgtacagaagcaagtc

SEQ ID NO: 446108 - DNA, 25 bp, Mus musculus
tcgcgcgtacagaagcaagtcggcc

SEQ ID NO: 446109 - DNA, 25 bp, Mus musculus
tacagaagcaagtcggccgccttcc

SEQ ID NO: 446110 - DNA, 25 bp, Mus musculus
ggcgcctcggcctcagacgccctct

SEQ ID NO: 446111 - DNA, 25 bp, Mus musculus
ctcggcctcggtgccaccgcgaaat

SEQ ID NO: 446112 - DNA, 25 bp, Mus musculus
caagggcccggcctcgttctgggct

SEQ ID NO: 446113 - DNA, 25 bp, Mus musculus
cggcctcgttctgggctgccgtcgt

SEQ ID NO: 446114 - DNA, 25 bp, Mus musculus
ccctttccgctggggagcagctgca

SEQ ID NO: 446115 - DNA, 25 bp, Mus musculus
ggaccgcgcagcctcctgagttctt

SEQ ID NO: 446116 - DNA, 25 bp, Mus musculus
agcctcctgagttcttgccgctgtc

SEQ ID NO: 446117 - DNA, 25 bp, Mus musculus
tcctgagttcttgccgctgtcgccg

SEQ ID NO: 446118 - DNA, 25 bp, Mus musculus
tcccgcccgtctgcaggtagaggcg

SEQ ID NO: 446119 - DNA, 25 bp, Mus musculus
ccgctttcgcacctgagcagcccgt

SEQ ID NO: 446120 - DNA, 25 bp, Mus musculus
catggactcgcagaaagtaagcggg

SEQ ID NO: 446121 - DNA, 25 bp, Mus musculus
catgcgcatgcgtggcgcgctcgca

SEQ ID NO: 446122 - DNA, 25 bp, Mus musculus
tgaggaccaaggctcggcctcgcgt

SEQ ID NO: 446123 - DNA, 25 bp, Mus musculus
ccctcctcggttggagtgaggacca

SEQ ID NO: 446124 - DNA, 25 bp, Mus musculus
ctgctcttggctccgggaaggcact

SEQ ID NO: 446125 - DNA, 25 bp, Mus musculus
acccgacgggacctgagagcccgca

SEQ ID NO: 446126 - DNA, 25 bp, Mus musculus
cctagccatggactcgcagaaagta

SEQ ID NO: 446127 - DNA, 25 bp, Mus musculus
gcttagtccctagccatggactcgc

SEQ ID NO: 446128 - DNA, 25 bp, Mus musculus
tcagctccggtgacaagttcggccc

SEQ ID NO: 446129 - DNA, 25 bp, Mus musculus
agcttctcactcagctccggtgaca

SEQ ID NO: 446130 - DNA, 25 bp, Mus musculus
gggtctctaaggctcctccagcttc

SEQ ID NO: 446131 - DNA, 25 bp, Mus musculus
cagaggtagcgggtctctaaggctc

SEQ ID NO: 446132 - DNA, 25 bp, Mus musculus
tcaccctggcaaccgcggctcggta

SEQ ID NO: 446133 - DNA, 25 bp, Mus musculus
cggacgacctctgtcctgctcttgg

SEQ ID NO: 446134 - DNA, 25 bp, Mus musculus
tgctgctgctctgagtgcatccgac

SEQ ID NO: 446135 - DNA, 25 bp, Mus musculus
ggagaacaaagcaacagccagcgta

SEQ ID NO: 446136 - DNA, 25 bp, Mus musculus
cttgaccgcttctttgcgacagttg

SEQ ID NO: 446137 - DNA, 25 bp, Mus musculus
acagttgccgtaaagcgaggcctcc

SEQ ID NO: 446138 - DNA, 25 bp, Mus musculus
tccgccgcagctctagagttaggta

SEQ ID NO: 446139 - DNA, 25 bp, Mus musculus
cactgtcgctggtctactggtatac

SEQ ID NO: 446140 - DNA, 25 bp, Mus musculus
ataccctgagtagcggtcgtccacc

SEQ ID NO: 446141 - DNA, 25 bp, Mus musculus
cagtccgtgcacgagcttgctgccg

SEQ ID NO: 446142 - DNA, 25 bp, Mus musculus
ccatgctgtccgttgatcgtcctga

SEQ ID NO: 446143 - DNA, 25 bp, Mus musculus
cctgacccgcgagggttcgattttg

SEQ ID NO: 446144 - DNA, 25 bp, Mus musculus
ttttggaggttcatggagacgctta

SEQ ID NO: 446145 - DNA, 25 bp, Mus musculus
accgatcaggtgtgaggaccaatgc

SEQ ID NO: 446146 - DNA, 25 bp, Mus musculus
ggaggaactgatgcagcctgctgct

SEQ ID NO: 446147 - DNA, 25 bp, Mus musculus
ggaccaatgcatgccaaggtggctc

SEQ ID NO: 446148 - DNA, 25 bp, Mus musculus
gcgcacacagactggcgctgcgaca

SEQ ID NO: 446149 - DNA, 25 bp, Mus musculus
ctgtggcagagaccctgcgtccagg

SEQ ID NO: 446150 - DNA, 25 bp, Mus musculus
tcctgccgccagacaaagggcggtg

SEQ ID NO: 446151 - DNA, 25 bp, Mus musculus
ccgccagacaaagggcggtgtccta

SEQ ID NO: 446152 - DNA, 25 bp, Mus musculus
cctataaaggctgtggcagagaccc

SEQ ID NO: 446153 - DNA, 25 bp, Mus musculus
ctgcgtccaggcgagggcgcacaca

SEQ ID NO: 446154 - DNA, 25 bp, Mus musculus
acagctaccttgactgcgccggttc

SEQ ID NO: 446155 - DNA, 25 bp, Mus musculus
gccggttcccagctcctagcaagaa

SEQ ID NO: 446156 - DNA, 25 bp, Mus musculus
gcggtgtcctataaaggctgtggca

SEQ ID NO: 446157 - DNA, 25 bp, Mus musculus
cctagcaagaaggtgcgttgactta

SEQ ID NO: 446158 - DNA, 25 bp, Mus musculus
aactttcggcgggacaggctcaata

SEQ ID NO: 446159 - DNA, 25 bp, Mus musculus
gacaggctcaatagcgcggcacttg

SEQ ID NO: 446160 - DNA, 25 bp, Mus musculus
tcaatagcgcggcacttgggaagcc

SEQ ID NO: 446161 - DNA, 25 bp, Mus musculus
actggcgctgcgacagctaccttga

SEQ ID NO: 446162 - DNA, 25 bp, Mus musculus
actctcaggttaacgcaggcgggtg

SEQ ID NO: 446163 - DNA, 25 bp, Mus musculus
tcgggagagaaagacgcgtctgttc

SEQ ID NO: 446164 - DNA, 25 bp, Mus musculus
tctgttcaagatggcgaaggacctg

SEQ ID NO: 446165 - DNA, 25 bp, Mus musculus
aggacctggacgaacttctggatga

SEQ ID NO: 446166 - DNA, 25 bp, Mus musculus
agaccaagttctgcagactcgaccc

SEQ ID NO: 446167 - DNA, 25 bp, Mus musculus
gtttctcgcgttgccgtggaaacca

SEQ ID NO: 446168 - DNA, 25 bp, Mus musculus
tgggctactgtcctagccctcgacg

SEQ ID NO: 446169 - DNA, 25 bp, Mus musculus
cctgagggagctgagaccctacctg

SEQ ID NO: 446170 - DNA, 25 bp, Mus musculus
tgacagccctaacctgacgtggatc

SEQ ID NO: 446171 - DNA, 25 bp, Mus musculus
tgagacacgacagggccacgctgac

SEQ ID NO: 446172 - DNA, 25 bp, Mus musculus
agacccacagcgttctcatcggcga

SEQ ID NO: 446173 - DNA, 25 bp, Mus musculus
cctgactgcaaatgtcgtgcctctc

SEQ ID NO: 446174 - DNA, 25 bp, Mus musculus
tggacggttctgctacagccctgct

SEQ ID NO: 446175 - DNA, 25 bp, Mus musculus
tctggatgaagtcgagaccaagttc

SEQ ID NO: 446176 - DNA, 25 bp, Mus musculus
ttcccttttttgatatcgcccacta

SEQ ID NO: 446177 - DNA, 25 bp, Mus musculus
cgtcggtagtcgtcatggagtaccc

SEQ ID NO: 446178 - DNA, 25 bp, Mus musculus
tcgtcatggagtacccgtgggatga

SEQ ID NO: 446179 - DNA, 25 bp, Mus musculus
gtacccgtgggatgatctgactctg

SEQ ID NO: 446180 - DNA, 25 bp, Mus musculus
gtgggatgatctgactctggccttt

SEQ ID NO: 446181 - DNA, 25 bp, Mus musculus
actctggccttttcccgcacgtcca

SEQ ID NO: 446182 - DNA, 25 bp, Mus musculus
tgatatcgcccactacctggtgtcg

SEQ ID NO: 446183 - DNA, 25 bp, Mus musculus
cgcacgtccatgtttcccttttttg

SEQ ID NO: 446184 - DNA, 25 bp, Mus musculus
cgcccactacctggtgtcggtgatg

SEQ ID NO: 446185 - DNA, 25 bp, Mus musculus
ctcagtaccgagcacgggactcaga

SEQ ID NO: 446186 - DNA, 25 bp, Mus musculus
ttccgcgtcctcactgcgggaggca

SEQ ID NO: 446187 - DNA, 25 bp, Mus musculus
acgcgctcccggttccgcgtcctca

SEQ ID NO: 446188 - DNA, 25 bp, Mus musculus
tgaagcagcggccaggtgagtgaag

SEQ ID NO: 446189 - DNA, 25 bp, Mus musculus
actacctggtgtcggtgatggcgct

SEQ ID NO: 446190 - DNA, 25 bp, Mus musculus
ctcttccgaaccacgccagcccaca

SEQ ID NO: 446191 - DNA, 25 bp, Mus musculus
cctgtgccaagtgggtttacgaggt

SEQ ID NO: 446192 - DNA, 25 bp, Mus musculus
ggtttcctctgacctccgctccttc

SEQ ID NO: 446193 - DNA, 25 bp, Mus musculus
gccgcgtccggagctctctcaatgt

SEQ ID NO: 446194 - DNA, 25 bp, Mus musculus
cgctccttccttgccgctgcgtctc

SEQ ID NO: 446195 - DNA, 25 bp, Mus musculus
cggcctgtgccaagtgggtttacga

SEQ ID NO: 446196 - DNA, 25 bp, Mus musculus
tttctggagttcaccgcagccgctc

SEQ ID NO: 446197 - DNA, 25 bp, Mus musculus
gttcatttctggagttcaccgcagc

SEQ ID NO: 446198 - DNA, 25 bp, Mus musculus
ccgtgccgcaggttcatttctggag

SEQ ID NO: 446199 - DNA, 25 bp, Mus musculus
tgagtgttggccagggtggtagccc

SEQ ID NO: 446200 - DNA, 25 bp, Mus musculus
tctcaatgtcggtcgctcgaggtga

SEQ ID NO: 446201 - DNA, 25 bp, Mus musculus
agctctctcaatgtcggtcgctcga

SEQ ID NO: 446202 - DNA, 25 bp, Mus musculus
tccggagctctctcaatgtcggtcg

SEQ ID NO: 446203 - DNA, 25 bp, Mus musculus
gccagcccacaaggtaccttcacgt

SEQ ID NO: 446204 - DNA, 25 bp, Mus musculus
aaggttccgcgctcgctgagccgca

SEQ ID NO: 446205 - DNA, 25 bp, Mus musculus
ccggcttaggcaccatgcaggtcac

SEQ ID NO: 446206 - DNA, 25 bp, Mus musculus
tcaccgccggctttgtggccgacaa

SEQ ID NO: 446207 - DNA, 25 bp, Mus musculus
acatcgacccggaggagacggtatg

SEQ ID NO: 446208 - DNA, 25 bp, Mus musculus
cagaccttcaagatcgacatcgacc

SEQ ID NO: 446209 - DNA, 25 bp, Mus musculus
tgaagacccttcagcagcagacctt

SEQ ID NO: 446210 - DNA, 25 bp, Mus musculus
atgcaggtcaccctgaagacccttc

SEQ ID NO: 446211 - DNA, 25 bp, Mus musculus
cgactccgggcgaatgtgacaagcc

SEQ ID NO: 446212 - DNA, 25 bp, Mus musculus
ttctctgcgtctctcggggagtccc

SEQ ID NO: 446213 - DNA, 25 bp, Mus musculus
gccaccatcctgtggtgaggtagcg

SEQ ID NO: 446214 - DNA, 25 bp, Mus musculus
agtcacggtgatggcggccaccatc

SEQ ID NO: 446215 - DNA, 25 bp, Mus musculus
gcctgctcagatcgcccgagtctgg

SEQ ID NO: 446216 - DNA, 25 bp, Mus musculus
agcgcctctgcttgcgaagtgcgcc

SEQ ID NO: 446217 - DNA, 25 bp, Mus musculus
gagttcctgttcacgcctgcgcact

SEQ ID NO: 446218 - DNA, 25 bp, Mus musculus
tgcagttccagcgagcaccacgagg

SEQ ID NO: 446219 - DNA, 25 bp, Mus musculus
attcctctgaagaggcccgctcggc

SEQ ID NO: 446220 - DNA, 25 bp, Mus musculus
agagccacatcacagtcacccatga

SEQ ID NO: 446221 - DNA, 25 bp, Mus musculus
cgcttgtgcacacgtgggaaagctg

SEQ ID NO: 446222 - DNA, 25 bp, Mus musculus
gccagcgacagagccacatcacagt

SEQ ID NO: 446223 - DNA, 25 bp, Mus musculus
tccagcgagcaccacgaggggcgca

SEQ ID NO: 446224 - DNA, 25 bp, Mus musculus
agacaggtctgcattcctctgaaga

SEQ ID NO: 446225 - DNA, 25 bp, Mus musculus
ttggttttcgggtgcagacaggtct

SEQ ID NO: 446226 - DNA, 25 bp, Mus musculus
tgaggcctctcttccagccgttcag

SEQ ID NO: 446227 - DNA, 25 bp, Mus musculus
gtgaggtgaggcctctcttccagcc

SEQ ID NO: 446228 - DNA, 25 bp, Mus musculus
ccagaagcggcgtccgcccaggtga

SEQ ID NO: 446229 - DNA, 25 bp, Mus musculus
caggtctcattccagaagcggcgtc

SEQ ID NO: 446230 - DNA, 25 bp, Mus musculus
tgcacacgtgggaaagctgcgtgct

SEQ ID NO: 446231 - DNA, 25 bp, Mus musculus
tcacccatgataccagcctgcagtt

SEQ ID NO: 446232 - DNA, 25 bp, Mus musculus
agctcaagccctcaggcctcccggg

SEQ ID NO: 446233 - DNA, 25 bp, Mus musculus
gacctggaatacgttggtgcgctcc

SEQ ID NO: 446234 - DNA, 25 bp, Mus musculus
ctaaggagttcttccgggcgtggca

SEQ ID NO: 446235 - DNA, 25 bp, Mus musculus
acagggacgctaaggagttcttccg

SEQ ID NO: 446236 - DNA, 25 bp, Mus musculus
cctcttggagaggaacagggacgct

SEQ ID NO: 446237 - DNA, 25 bp, Mus musculus
gactctgggcgatcggctcttccgc

SEQ ID NO: 446238 - DNA, 25 bp, Mus musculus
ccgcgttactgcaagaggaccggcg

SEQ ID NO: 446239 - DNA, 25 bp, Mus musculus
tccggcagagcgagaactgccctca

SEQ ID NO: 446240 - DNA, 25 bp, Mus musculus
gaactgccctcagcggggactccag

SEQ ID NO: 446241 - DNA, 25 bp, Mus musculus
gactccaggcggagcccgatgctca

SEQ ID NO: 446242 - DNA, 25 bp, Mus musculus
gcccgatgctcactgggtcgcgcat

SEQ ID NO: 446243 - DNA, 25 bp, Mus musculus
tccgccagctgtagcggagcggctc

SEQ ID NO: 446244 - DNA, 25 bp, Mus musculus
gaatacgttggtgcgctccggcaga

SEQ ID NO: 446245 - DNA, 25 bp, Mus musculus
tgggtcgcgcatgcgccgctttcca

SEQ ID NO: 446246 - DNA, 25 bp, Mus musculus
tcctggccgcacagttggattgtca

SEQ ID NO: 446247 - DNA, 25 bp, Mus musculus
cgcagccaagcccagataaggccga

SEQ ID NO: 446248 - DNA, 25 bp, Mus musculus
ctgctgtgtcctgtccggggatccc

SEQ ID NO: 446249 - DNA, 25 bp, Mus musculus
atgaggtttcgtgctgctgtgtcct

SEQ ID NO: 446250 - DNA, 25 bp, Mus musculus
ccactggttggatcagcgcatgcgc

SEQ ID NO: 446251 - DNA, 25 bp, Mus musculus
gccgcacagttggattgtcaatcaa

SEQ ID NO: 446252 - DNA, 25 bp, Mus musculus
gtctcaggcactctggactctggtt

SEQ ID NO: 446253 - DNA, 25 bp, Mus musculus
tggctgtgctcagtctcaggcactc

SEQ ID NO: 446254 - DNA, 25 bp, Mus musculus
tgcgtctgctctcaagggtcctgac

SEQ ID NO: 446255 - DNA, 25 bp, Mus musculus
gaaaagttagtttgcgtctgctctc

SEQ ID NO: 446256 - DNA, 25 bp, Mus musculus
gcccgccgatcagacaagaaaagtt

SEQ ID NO: 446257 - DNA, 25 bp, Mus musculus
ccgaggaatagatagaggagaacga

SEQ ID NO: 446258 - DNA, 25 bp, Mus musculus
acccggagagtcaagcgtccgagga

SEQ ID NO: 446259 - DNA, 25 bp, Mus musculus
cagagccgagccactggttggatca

SEQ ID NO: 446260 - DNA, 25 bp, Mus musculus
ggattcaatataaaccggcgatgtc

SEQ ID NO: 446261 - DNA, 25 bp, Mus musculus
tgctggacgcagtgtcttctccctt

SEQ ID NO: 446262 - DNA, 25 bp, Mus musculus
ccagaaggtcctccggagtccgaag

SEQ ID NO: 446263 - DNA, 25 bp, Mus musculus
cacggaattgggacactgggacacg

SEQ ID NO: 446264 - DNA, 25 bp, Mus musculus
gattgcccgagatccttcttctttg

SEQ ID NO: 446265 - DNA, 25 bp, Mus musculus
acactcacgttagtcggggcacctg

SEQ ID NO: 446266 - DNA, 25 bp, Mus musculus
tacagggcactagcgcgacactcac

SEQ ID NO: 446267 - DNA, 25 bp, Mus musculus
ccaatggagggcaatccttgtccta

SEQ ID NO: 446268 - DNA, 25 bp, Mus musculus
gccacctcggaaggctgtagagttc

SEQ ID NO: 446269 - DNA, 25 bp, Mus musculus
tgccgggaccacacgcacttaaggc

SEQ ID NO: 446270 - DNA, 25 bp, Mus musculus
ccgaagactagtggggaaccgctgt

SEQ ID NO: 446271 - DNA, 25 bp, Mus musculus
gggtctcgagacttgtccacctaaa

SEQ ID NO: 446272 - DNA, 25 bp, Mus musculus
gctacgatcactccggcccaaaggg

SEQ ID NO: 446273 - DNA, 25 bp, Mus musculus
tgcacgctcttggactcagcagtgt

SEQ ID NO: 446274 - DNA, 25 bp, Mus musculus
gggattcctgctccggccttaaata

SEQ ID NO: 446275 - DNA, 25 bp, Mus musculus
cgctgaggaaatgagaggcttgtac

SEQ ID NO: 446276 - DNA, 25 bp, Mus musculus
ggaaaagcgctttcggtcctggctc

SEQ ID NO: 446277 - DNA, 25 bp, Mus musculus
cagccttccaggattagaaaccctt

SEQ ID NO: 446278 - DNA, 25 bp, Mus musculus
cggggtgatgtcagacagccttcca

SEQ ID NO: 446279 - DNA, 25 bp, Mus musculus
cagccgacaagaaacggggtgatgt

SEQ ID NO: 446280 - DNA, 25 bp, Mus musculus
ggcttgtacgaaacatcagccgaca

SEQ ID NO: 446281 - DNA, 25 bp, Mus musculus
cggctccgagatcgctgaggaaatg

SEQ ID NO: 446282 - DNA, 25 bp, Mus musculus
taaacaccagatcggggcagtaatt

SEQ ID NO: 446283 - DNA, 25 bp, Mus musculus
gcaggaccgggcaaacataaacacc

SEQ ID NO: 446284 - DNA, 25 bp, Mus musculus
tcctgatcacatggtgctgaagtca

SEQ ID NO: 446285 - DNA, 25 bp, Mus musculus
agggaggccagacttcctgatcaca

SEQ ID NO: 446286 - DNA, 25 bp, Mus musculus
cgcggcaggctgctacacaatgttt

SEQ ID NO: 446287 - DNA, 25 bp, Mus musculus
tacacaatgtttcccttcagtcggg

SEQ ID NO: 446288 - DNA, 25 bp, Mus musculus
agcaccgcatgctcttccggcatga

SEQ ID NO: 446289 - DNA, 25 bp, Mus musculus
aggtcacatgcatggcagggatgcc

SEQ ID NO: 446290 - DNA, 25 bp, Mus musculus
cagggatgccgaaggtctcgaacag

SEQ ID NO: 446291 - DNA, 25 bp, Mus musculus
aggtctcgaacaggagctcagcgta

SEQ ID NO: 446292 - DNA, 25 bp, Mus musculus
agctcagcgtacttctcccggttgc

SEQ ID NO: 446293 - DNA, 25 bp, Mus musculus
agggtcggacaccagcaccgcatgc

SEQ ID NO: 446294 - DNA, 25 bp, Mus musculus
gacagcagcgcctgggaggtcacat

SEQ ID NO: 446295 - DNA, 25 bp, Mus musculus
cccttcagagatgggcaccacatgc

SEQ ID NO: 446296 - DNA, 25 bp, Mus musculus
acttctcccggttgctggtggggct

SEQ ID NO: 446297 - DNA, 25 bp, Mus musculus
agccggaggtcttgccatatgagta

SEQ ID NO: 446298 - DNA, 25 bp, Mus musculus
tgggcaccacatgcgacacgccgtg

SEQ ID NO: 446299 - DNA, 25 bp, Mus musculus
cccgcatagtctacacggctgggca

SEQ ID NO: 446300 - DNA, 25 bp, Mus musculus
catatgagtagatggacagcagcgc

SEQ ID NO: 446301 - DNA, 25 bp, Mus musculus
ccaccaagccggaggtcttgccata

SEQ ID NO: 446302 - DNA, 25 bp, Mus musculus
gaccttgctgtctgctgtccctcag

SEQ ID NO: 446303 - DNA, 25 bp, Mus musculus
aggcacttctgccacgcgatgcaag

SEQ ID NO: 446304 - DNA, 25 bp, Mus musculus
agctccgctttaccgcacgggtgca

SEQ ID NO: 446305 - DNA, 25 bp, Mus musculus
ccctcccttgtggatcgatacttca

SEQ ID NO: 446306 - DNA, 25 bp, Mus musculus
gctggcgccaccagaggtagtcata

SEQ ID NO: 446307 - DNA, 25 bp, Mus musculus
gccggaactacgctcctggactaga

SEQ ID NO: 446308 - DNA, 25 bp, Mus musculus
ctttggcccaggatcacaggtgact

SEQ ID NO: 446309 - DNA, 25 bp, Mus musculus
ctcagctctttgacacccggttgtt

SEQ ID NO: 446310 - DNA, 25 bp, Mus musculus
acgggcgaatgctcacctacgacgc

SEQ ID NO: 446311 - DNA, 25 bp, Mus musculus
gcgaaacacgccaggtagcaccaga

SEQ ID NO: 446312 - DNA, 25 bp, Mus musculus
acacgatccactgaagggcgaaaca

SEQ ID NO: 446313 - DNA, 25 bp, Mus musculus
cacacgggagacgagaaacacgatc

SEQ ID NO: 446314 - DNA, 25 bp, Mus musculus
tttggaaaggaaccgccgatgcaca

SEQ ID NO: 446315 - DNA, 25 bp, Mus musculus
cgtgtacagaaagcatccgaaactc

SEQ ID NO: 446316 - DNA, 25 bp, Mus musculus
aggatcatcagctccgcctctaggg

SEQ ID NO: 446317 - DNA, 25 bp, Mus musculus
cgcggtacctgagaaaccaggggca

SEQ ID NO: 446318 - DNA, 25 bp, Mus musculus
cgccagcttggctctggaagtcaga

SEQ ID NO: 446319 - DNA, 25 bp, Mus musculus
ataggggtcctactgacccgcggct

SEQ ID NO: 446320 - DNA, 25 bp, Mus musculus
ctaggccgaacaacgcacctgctgg

SEQ ID NO: 446321 - DNA, 25 bp, Mus musculus
cgcttcaccgcgagcccaggagtag

SEQ ID NO: 446322 - DNA, 25 bp, Mus musculus
tcttgctcgcgcaatgcgggacagc

SEQ ID NO: 446323 - DNA, 25 bp, Mus musculus
agaagagtctgttccaccgagcgcg

SEQ ID NO: 446324 - DNA, 25 bp, Mus musculus
gtcctgatctccagtcccgagtcga

SEQ ID NO: 446325 - DNA, 25 bp, Mus musculus
tcccgagtcgaaggtgaagccagcc

SEQ ID NO: 446326 - DNA, 25 bp, Mus musculus
ttcgaggccacccaactctagctag

SEQ ID NO: 446327 - DNA, 25 bp, Mus musculus
caactctagctagttctgcccagca

SEQ ID NO: 446328 - DNA, 25 bp, Mus musculus
ggcgcgtagcagtccaggatcatca

SEQ ID NO: 446329 - DNA, 25 bp, Mus musculus
ccactgacccatagtctggcgcgta

SEQ ID NO: 446330 - DNA, 25 bp, Mus musculus
ccgcaggctcctgtgtaaccttatg

SEQ ID NO: 446331 - DNA, 25 bp, Mus musculus
ataggcgcccgcaaagtttcgcttc

SEQ ID NO: 446332 - DNA, 25 bp, Mus musculus
gaacgcgcgcctctgcagaggtgac

SEQ ID NO: 446333 - DNA, 25 bp, Mus musculus
gactgggtcgcctgacctgactttc

SEQ ID NO: 446334 - DNA, 25 bp, Mus musculus
gactttcctgactcgggctagcctt

SEQ ID NO: 446335 - DNA, 25 bp, Mus musculus
ggctagccttcggaaagggctctta

SEQ ID NO: 446336 - DNA, 25 bp, Mus musculus
gggctcttaagcagtccgcgaagtt

SEQ ID NO: 446337 - DNA, 25 bp, Mus musculus
gtccgcgaagttctctggaagaatg

SEQ ID NO: 446338 - DNA, 25 bp, Mus musculus
gaagaatgggcggaagctgcctcca

SEQ ID NO: 446339 - DNA, 25 bp, Mus musculus
aaaggctttgcttctcgccacccaa

SEQ ID NO: 446340 - DNA, 25 bp, Mus musculus
agccgaacacctgctgtcgctttct

SEQ ID NO: 446341 - DNA, 25 bp, Mus musculus
gggtctgcgcttaccgcacccatga

SEQ ID NO: 446342 - DNA, 25 bp, Mus musculus
aaccttatgccgaagaactccgctc

SEQ ID NO: 446343 - DNA, 25 bp, Mus musculus
gtcgctttctcccaagccaggggtc

SEQ ID NO: 446344 - DNA, 25 bp, Mus musculus
tagagcccatagagcagcgggccgc

SEQ ID NO: 446345 - DNA, 25 bp, Mus musculus
aaggaagcgcgccaagtccctcggc

SEQ ID NO: 446346 - DNA, 25 bp, Mus musculus
ctcactggaggacctttggccgcct

SEQ ID NO: 446347 - DNA, 25 bp, Mus musculus
cttgatgggcttatcgaagcgcagc

SEQ ID NO: 446348 - DNA, 25 bp, Mus musculus
agctgcccaggcagtagagcccata

SEQ ID NO: 446349 - DNA, 25 bp, Mus musculus
tccacgccgtagtcggcgaagcaga

SEQ ID NO: 446350 - DNA, 25 bp, Mus musculus
cgagctcttgaacgggtgcaggaaa

SEQ ID NO: 446351 - DNA, 25 bp, Mus musculus
tcacacccgcctctctggaaggaag

SEQ ID NO: 446352 - DNA, 25 bp, Mus musculus
aaagtgccgcacagcacggcccaga

SEQ ID NO: 446353 - DNA, 25 bp, Mus musculus
cgaggatgaagtacacgagcaccgc

SEQ ID NO: 446354 - DNA, 25 bp, Mus musculus
gcagcacaggcacacgaacagcacg

SEQ ID NO: 446355 - DNA, 25 bp, Mus musculus
cacggcgcccgtgttgtagaaagcc

SEQ ID NO: 446356 - DNA, 25 bp, Mus musculus
cccgtgttgtagaaagcctgcttga

SEQ ID NO: 446357 - DNA, 25 bp, Mus musculus
acccacaggctgctgaagtagtcga

SEQ ID NO: 446358 - DNA, 25 bp, Mus musculus
cgcggcactgcctcgtccgcgcccg

SEQ ID NO: 446359 - DNA, 25 bp, Mus musculus
ctgcgcacggatcccgcagccaggc

SEQ ID NO: 446360 - DNA, 25 bp, Mus musculus
cccgccatcgctgcgcacggatccc

SEQ ID NO: 446361 - DNA, 25 bp, Mus musculus
tcgcaggagcagtggtacccaggcc

SEQ ID NO: 446362 - DNA, 25 bp, Mus musculus
cagtcgcaggagcagtggtacccag

SEQ ID NO: 446363 - DNA, 25 bp, Mus musculus
cagcagtcgcaggagcagtggtacc

SEQ ID NO: 446364 - DNA, 25 bp, Mus musculus
agtcgtggcgcggcactgcctcgtc

SEQ ID NO: 446365 - DNA, 25 bp, Mus musculus
aaggtgccgtaggaggagtcgtggc

SEQ ID NO: 446366 - DNA, 25 bp, Mus musculus
agaactcgctggcgaaggtgccgta

SEQ ID NO: 446367 - DNA, 25 bp, Mus musculus
cgtagaactcgctggcgaaggtgcc

SEQ ID NO: 446368 - DNA, 25 bp, Mus musculus
tcgtagaactcgctggcgaaggtgc

SEQ ID NO: 446369 - DNA, 25 bp, Mus musculus
caggtcgtagaactcgctggcgaag

SEQ ID NO: 446370 - DNA, 25 bp, Mus musculus
gtccgcggggctggcatcgcaggca

SEQ ID NO: 446371 - DNA, 25 bp, Mus musculus
ccgccagcagcagtcgcaggagcag

SEQ ID NO: 446372 - DNA, 25 bp, Mus musculus
accacctgtgggtgtgtgaaccgga

SEQ ID NO: 446373 - DNA, 25 bp, Mus musculus
aaggcaccgtctgccgcagcgcagt

SEQ ID NO: 446374 - DNA, 25 bp, Mus musculus
gcgcccgttagtgcagcgtttgata

SEQ ID NO: 446375 - DNA, 25 bp, Mus musculus
tgccctgaacgaaccacgcaaactg

SEQ ID NO: 446376 - DNA, 25 bp, Mus musculus
tgaaccggacgcaggccctggtgct

SEQ ID NO: 446377 - DNA, 25 bp, Mus musculus
actgggcccgggtgcaaccacctgt

SEQ ID NO: 446378 - DNA, 25 bp, Mus musculus
tagcttgccactggaactgggcccg

SEQ ID NO: 446379 - DNA, 25 bp, Mus musculus
gcgctggcctagcttgccactggaa

SEQ ID NO: 446380 - DNA, 25 bp, Mus musculus
actccctgtcggagacactggcgct

SEQ ID NO: 446381 - DNA, 25 bp, Mus musculus
cggctggactccctgtcggagacac

SEQ ID NO: 446382 - DNA, 25 bp, Mus musculus
aaaaggctcttttggcggctggact

SEQ ID NO: 446383 - DNA, 25 bp, Mus musculus
agcgtttgataggatctgactggcc

SEQ ID NO: 446384 - DNA, 25 bp, Mus musculus
cgttagtgcagcgtttgataggatc

SEQ ID NO: 446385 - DNA, 25 bp, Mus musculus
cgggatgccctgaacgaaccacgca

SEQ ID NO: 446386 - DNA, 25 bp, Mus musculus
tgcgtacacgtaggtgagcacacac

SEQ ID NO: 446387 - DNA, 25 bp, Mus musculus
ctcccgaggcggagatgtgcacagc

SEQ ID NO: 446388 - DNA, 25 bp, Mus musculus
gccgcgtcactcaccggcaggtcca

SEQ ID NO: 446389 - DNA, 25 bp, Mus musculus
ggcaggtccacgctcacttcggttc

SEQ ID NO: 446390 - DNA, 25 bp, Mus musculus
ctcacttcggttccgtcgagcagga

SEQ ID NO: 446391 - DNA, 25 bp, Mus musculus
tcggttccgtcgagcaggaagacac

SEQ ID NO: 446392 - DNA, 25 bp, Mus musculus
tcgagcaggaagacacggcagtaaa

SEQ ID NO: 446393 - DNA, 25 bp, Mus musculus
aggtccggcgcaggaaccgcagcat

SEQ ID NO: 446394 - DNA, 25 bp, Mus musculus
agccgcgcgggagagaacgcgcaca

SEQ ID NO: 446395 - DNA, 25 bp, Mus musculus
gccagccggagcaaagcgcctgcgt

SEQ ID NO: 446396 - DNA, 25 bp, Mus musculus
agccggagcaaagcgcctgcgtgct

SEQ ID NO: 446397 - DNA, 25 bp, Mus musculus
tcccacctgggagggctgcacctcc

SEQ ID NO: 446398 - DNA, 25 bp, Mus musculus
aggtgcgctcacgtgcgtacacgta

SEQ ID NO: 446399 - DNA, 25 bp, Mus musculus
ccctgctgctgtaggtgcgctcacg

SEQ ID NO: 446400 - DNA, 25 bp, Mus musculus
agggctttgtggagttgacgtctcc

SEQ ID NO: 446401 - DNA, 25 bp, Mus musculus
cacgtgtgccgacaggtgttaggac

SEQ ID NO: 446402 - DNA, 25 bp, Mus musculus
acaggtgttaggacacacacggggc

SEQ ID NO: 446403 - DNA, 25 bp, Mus musculus
ctcgagggtggctttatgatcccga

SEQ ID NO: 446404 - DNA, 25 bp, Mus musculus
ctttatgatcccgaggagcgagcgg

SEQ ID NO: 446405 - DNA, 25 bp, Mus musculus
agacagcggcccgatggagcccgaa

SEQ ID NO: 446406 - DNA, 25 bp, Mus musculus
gcgtgtgctcaggtgctacccggcc

SEQ ID NO: 446407 - DNA, 25 bp, Mus musculus
gtggcctctgtgctgatcacgtgtt

SEQ ID NO: 446408 - DNA, 25 bp, Mus musculus
tgctgatcacgtgttcccggctctc

SEQ ID NO: 446409 - DNA, 25 bp, Mus musculus
cggtcccagaagctaccacagcggt

SEQ ID NO: 446410 - DNA, 25 bp, Mus musculus
agaagctaccacagcggtcgcatgg

SEQ ID NO: 446411 - DNA, 25 bp, Mus musculus
gcctgtgtcgccaagagctgtggca

SEQ ID NO: 446412 - DNA, 25 bp, Mus musculus
cactcctcgccaggggcagcttggt

SEQ ID NO: 446413 - DNA, 25 bp, Mus musculus
ggactgcccgtgcagaccgagacgc

SEQ ID NO: 446414 - DNA, 25 bp, Mus musculus
agtctcccatacctgcagcatccgg

SEQ ID NO: 446415 - DNA, 25 bp, Mus musculus
gtgtcacaccgcaagttaccagaga

SEQ ID NO: 446416 - DNA, 25 bp, Mus musculus
ggggctaccagctcaaccgctagtc

SEQ ID NO: 446417 - DNA, 25 bp, Mus musculus
attggtttggcactggagttcgtgc

SEQ ID NO: 446418 - DNA, 25 bp, Mus musculus
gagttcgtgccaggcccaggaaatg

SEQ ID NO: 446419 - DNA, 25 bp, Mus musculus
ccaggcccaggaaatgccatctttg

SEQ ID NO: 446420 - DNA, 25 bp, Mus musculus
tgccatctttgcaatctgaagggga

SEQ ID NO: 446421 - DNA, 25 bp, Mus musculus
ttgcaatctgaaggggaattcgccc

SEQ ID NO: 446422 - DNA, 25 bp, Mus musculus
aagcccagggctcggccagactgga

SEQ ID NO: 446423 - DNA, 25 bp, Mus musculus
ggcgcgctctctccctgcacaacgc

SEQ ID NO: 446424 - DNA, 25 bp, Mus musculus
ggagacctggggctaccagctcaac

SEQ ID NO: 446425 - DNA, 25 bp, Mus musculus
tgcacaacgcagcagtgtcacaccg

SEQ ID NO: 446426 - DNA, 25 bp, Mus musculus
tgcgtccagaacgcccagccttttg

SEQ ID NO: 446427 - DNA, 25 bp, Mus musculus
accgcaagttaccagagaagccacc

SEQ ID NO: 446428 - DNA, 25 bp, Mus musculus
tgcaacttctaggtggcgacagctg

SEQ ID NO: 446429 - DNA, 25 bp, Mus musculus
ctcgatgtttctatagcagcctctg

SEQ ID NO: 446430 - DNA, 25 bp, Mus musculus
gccgctggagtttctctggtacctc

SEQ ID NO: 446431 - DNA, 25 bp, Mus musculus
tgctatttcgcagaggccagaagcc

SEQ ID NO: 446432 - DNA, 25 bp, Mus musculus
gacagctgccaccttgccgaagact

SEQ ID NO: 446433 - DNA, 25 bp, Mus musculus
gaagactccatcgtttccctaccga

SEQ ID NO: 446434 - DNA, 25 bp, Mus musculus
tagcgcccagcgaataacgttatcc

SEQ ID NO: 446435 - DNA, 25 bp, Mus musculus
gcttcccgttttattcgcaggctgg

SEQ ID NO: 446436 - DNA, 25 bp, Mus musculus
tgcgagagcctgagcgttttcttgc

SEQ ID NO: 446437 - DNA, 25 bp, Mus musculus
gttttcttgccagtgctccagggga

SEQ ID NO: 446438 - DNA, 25 bp, Mus musculus
ggtccagcctgggtgtttaatttca

SEQ ID NO: 446439 - DNA, 25 bp, Mus musculus
tcagtccagtgtgttcgtctcgatg

SEQ ID NO: 446440 - DNA, 25 bp, Mus musculus
tcgcccgagtggaaacaccgcatga

SEQ ID NO: 446441 - DNA, 25 bp, Mus musculus
aatggcgtttcacagtctcagacaa

SEQ ID NO: 446442 - DNA, 25 bp, Mus musculus
tggtcttgtctagacccagagcgta

SEQ ID NO: 446443 - DNA, 25 bp, Mus musculus
gtcttgtctagacccagagcgtagc

SEQ ID NO: 446444 - DNA, 25 bp, Mus musculus
ttgtctagacccagagcgtagcgcg

SEQ ID NO: 446445 - DNA, 25 bp, Mus musculus
cgcgcggccaccaaggcgcaccagc

SEQ ID NO: 446446 - DNA, 25 bp, Mus musculus
cccagctcactaatcacaagcgccc

SEQ ID NO: 446447 - DNA, 25 bp, Mus musculus
cgcggagacgtcagggcggggacct

SEQ ID NO: 446448 - DNA, 25 bp, Mus musculus
gcggggacctagtgctgcggagcgc

SEQ ID NO: 446449 - DNA, 25 bp, Mus musculus
cggttgagactgggatcttgcagtt

SEQ ID NO: 446450 - DNA, 25 bp, Mus musculus
gatcttgcagttcgcggcggcgctg

SEQ ID NO: 446451 - DNA, 25 bp, Mus musculus
ccgcgccggtggagacggaggctga

SEQ ID NO: 446452 - DNA, 25 bp, Mus musculus
gctgagctctgagccagccgtgcgc

SEQ ID NO: 446453 - DNA, 25 bp, Mus musculus
agccgtgcgcgcagctttgcccgcc

SEQ ID NO: 446454 - DNA, 25 bp, Mus musculus
ccggggtcgagttgagctccccacg

SEQ ID NO: 446455 - DNA, 25 bp, Mus musculus
ccgcctggtcttgtctagacccaga

SEQ ID NO: 446456 - DNA, 25 bp, Mus musculus
gtggcggttcggaactcgggctaga

SEQ ID NO: 446457 - DNA, 25 bp, Mus musculus
gagtactgcgccctcggaactggcg

SEQ ID NO: 446458 - DNA, 25 bp, Mus musculus
gccctcggaactggcgcctagaggt

SEQ ID NO: 446459 - DNA, 25 bp, Mus musculus
cggaccaccggcctggagtggggcg

SEQ ID NO: 446460 - DNA, 25 bp, Mus musculus
tgcgccctcggaactggcgcctaga

SEQ ID NO: 446461 - DNA, 25 bp, Mus musculus
agccggagtactgcgccctcggaac

SEQ ID NO: 446462 - DNA, 25 bp, Mus musculus
agccgcaccacgctggagcggagcc

SEQ ID NO: 446463 - DNA, 25 bp, Mus musculus
cgcctttccctggacgttgggagca

SEQ ID NO: 446464 - DNA, 25 bp, Mus musculus
tgtgccgcgcctttccctggacgtt

SEQ ID NO: 446465 - DNA, 25 bp, Mus musculus
ctgctcttggcagatgcgctggccc

SEQ ID NO: 446466 - DNA, 25 bp, Mus musculus
gctgctgctcttggcagatgcgctg

SEQ ID NO: 446467 - DNA, 25 bp, Mus musculus
cgagcccagaggctgctgctcttgg

SEQ ID NO: 446468 - DNA, 25 bp, Mus musculus
ccaggcgagcccagaggctgctgct

SEQ ID NO: 446469 - DNA, 25 bp, Mus musculus
gcctagaggtgggtgttcaagttgg

SEQ ID NO: 446470 - DNA, 25 bp, Mus musculus
cagcttcgggtttttccaggctcca

SEQ ID NO: 446471 - DNA, 25 bp, Mus musculus
ggcatgcgtaccttgctctcgatca

SEQ ID NO: 446472 - DNA, 25 bp, Mus musculus
ttagtagtcacctggggtaccgatc

SEQ ID NO: 446473 - DNA, 25 bp, Mus musculus
gcaggtcactgatggagggaaacta

SEQ ID NO: 446474 - DNA, 25 bp, Mus musculus
aggccgagcccagcagtacaacaca

SEQ ID NO: 446475 - DNA, 25 bp, Mus musculus
tggcggctctccatcttttcctaga

SEQ ID NO: 446476 - DNA, 25 bp, Mus musculus
tcctgattcagttggggcacgggaa

SEQ ID NO: 446477 - DNA, 25 bp, Mus musculus
ctctcgatcagcttcaccattttgg

SEQ ID NO: 446478 - DNA, 25 bp, Mus musculus
ggagccacacgcgtctcagcagaac

SEQ ID NO: 446479 - DNA, 25 bp, Mus musculus
aaatggatccaaggcgcccaacgga

SEQ ID NO: 446480 - DNA, 25 bp, Mus musculus
gcccaacggagcttgcaaccgagtg

SEQ ID NO: 446481 - DNA, 25 bp, Mus musculus
ggcgcccgccttctctttatagaaa

SEQ ID NO: 446482 - DNA, 25 bp, Mus musculus
gctgccgaacaagaaccttagttta

SEQ ID NO: 446483 - DNA, 25 bp, Mus musculus
gcggcctggacctttctccttagta

SEQ ID NO: 446484 - DNA, 25 bp, Mus musculus
ccggggtagcaaccgcgaacctcag

SEQ ID NO: 446485 - DNA, 25 bp, Mus musculus
gaggtaccgccagtctgcccagagc

SEQ ID NO: 446486 - DNA, 25 bp, Mus musculus
tgacaccagtgccagagcccagcaa

SEQ ID NO: 446487 - DNA, 25 bp, Mus musculus
ggcgcccttggtataggtgccacca

SEQ ID NO: 446488 - DNA, 25 bp, Mus musculus
tggaagttggtccagcctgacacca

SEQ ID NO: 446489 - DNA, 25 bp, Mus musculus
tggacgactcgtccaccaggaagac

SEQ ID NO: 446490 - DNA, 25 bp, Mus musculus
tgaggaagttggtttggcccacgct

SEQ ID NO: 446491 - DNA, 25 bp, Mus musculus
cgcacgaacttgagctcgttgagga

SEQ ID NO: 446492 - DNA, 25 bp, Mus musculus
cggacagcagcttgcgcacgaactt

SEQ ID NO: 446493 - DNA, 25 bp, Mus musculus
tgagaaggtgacgatggccacacgc

SEQ ID NO: 446494 - DNA, 25 bp, Mus musculus
gcgccaccacgttgttcttggatga

SEQ ID NO: 446495 - DNA, 25 bp, Mus musculus
gagatgtaatccacgcgcgccacca

SEQ ID NO: 446496 - DNA, 25 bp, Mus musculus
ctgagtagcgcgcacttgtgttggt

SEQ ID NO: 446497 - DNA, 25 bp, Mus musculus
cccagcaacaaaaggccaggcgcga

SEQ ID NO: 446498 - DNA, 25 bp, Mus musculus
gcggacagaacccagcatggaggtc

SEQ ID NO: 446499 - DNA, 25 bp, Mus musculus
tctgcaactccgcaaaggaaggacg

SEQ ID NO: 446500 - DNA, 25 bp, Mus musculus
ggcagatctctgcaactccgcaaag

SEQ ID NO: 446501 - DNA, 25 bp, Mus musculus
tgccctccgaccctgaggccacgcc

SEQ ID NO: 446502 - DNA, 25 bp, Mus musculus
atggaggtcgccatgacacccgctt

SEQ ID NO: 446503 - DNA, 25 bp, Mus musculus
gccaaaccgaatggccttgggccgc

SEQ ID NO: 446504 - DNA, 25 bp, Mus musculus
aggttagccaaaccgaatggccttg

SEQ ID NO: 446505 - DNA, 25 bp, Mus musculus
gctggcgatggaacaggttagccaa

SEQ ID NO: 446506 - DNA, 25 bp, Mus musculus
ggcgccgcacacgttcccacgcatc

SEQ ID NO: 446507 - DNA, 25 bp, Mus musculus
cagctccaggcagtagaggtgggaa

SEQ ID NO: 446508 - DNA, 25 bp, Mus musculus
ctgcgttccacaggctctgggctct

SEQ ID NO: 446509 - DNA, 25 bp, Mus musculus
gttcagcgctctgcgttccacaggc

SEQ ID NO: 446510 - DNA, 25 bp, Mus musculus
cccaggctcggggttcagcgctctg

SEQ ID NO: 446511 - DNA, 25 bp, Mus musculus
gtcgccatgacacccgcttcgggtg

SEQ ID NO: 446512 - DNA, 25 bp, Mus musculus
cccgggctgagttccaccggctggt

SEQ ID NO: 446513 - DNA, 25 bp, Mus musculus
tgctaggtccagctccgcagttcac

SEQ ID NO: 446514 - DNA, 25 bp, Mus musculus
cggggacgcggcaccaataaacttg

SEQ ID NO: 446515 - DNA, 25 bp, Mus musculus
gccgccgtgtctttacctgctaggt

SEQ ID NO: 446516 - DNA, 25 bp, Mus musculus
gggcgcactgacctggccaaaggtc

SEQ ID NO: 446517 - DNA, 25 bp, Mus musculus
tacgtgtcacttggacggaccctgg

SEQ ID NO: 446518 - DNA, 25 bp, Mus musculus
ggaggccacctacgtgtcacttgga

SEQ ID NO: 446519 - DNA, 25 bp, Mus musculus
gcaacaggaggccacctacgtgtca

SEQ ID NO: 446520 - DNA, 25 bp, Mus musculus
acagtgcgagccgatcgcgccgatg

SEQ ID NO: 446521 - DNA, 25 bp, Mus musculus
gcggcaccaataaacttggggagcc

SEQ ID NO: 446522 - DNA, 25 bp, Mus musculus
agccatctaagtcgtcggggacgcg

SEQ ID NO: 446523 - DNA, 25 bp, Mus musculus
gcgcggacacccgagccatctaagt

SEQ ID NO: 446524 - DNA, 25 bp, Mus musculus
ggcgctcacgcgcacggctacaaag

SEQ ID NO: 446525 - DNA, 25 bp, Mus musculus
caacccgatccaggtaagcaacagg

SEQ ID NO: 446526 - DNA, 25 bp, Mus musculus
cggtcctgcgtggagttaaatcccg

SEQ ID NO: 446527 - DNA, 25 bp, Mus musculus
ttactcagctcgtcctgggaggcgg

SEQ ID NO: 446528 - DNA, 25 bp, Mus musculus
tcgcgagctcgcgactcgggagctc

SEQ ID NO: 446529 - DNA, 25 bp, Mus musculus
ttgctagcctcacgccggctcttat

SEQ ID NO: 446530 - DNA, 25 bp, Mus musculus
tcacgccggctcttatatttagaaa

SEQ ID NO: 446531 - DNA, 25 bp, Mus musculus
tcttatatttagaaagagctgagcc

SEQ ID NO: 446532 - DNA, 25 bp, Mus musculus
ttccctcagccgcacgcaagcacgc

SEQ ID NO: 446533 - DNA, 25 bp, Mus musculus
aagcacgcggcctctgacctgagtc

SEQ ID NO: 446534 - DNA, 25 bp, Mus musculus
ctctgacctgagtcggagccggtct

SEQ ID NO: 446535 - DNA, 25 bp, Mus musculus
agtcggagccggtctccatagcccg

SEQ ID NO: 446536 - DNA, 25 bp, Mus musculus
tggcgttaaaggtctgcggctgtca

SEQ ID NO: 446537 - DNA, 25 bp, Mus musculus
aaaggtctgcggctgtcacgtccgc

SEQ ID NO: 446538 - DNA, 25 bp, Mus musculus
tcacgtccgcctggtcggagctgga

SEQ ID NO: 446539 - DNA, 25 bp, Mus musculus
gtggagttaaatcccgctcccagct

SEQ ID NO: 446540 - DNA, 25 bp, Mus musculus
gggcgtgcacttcagcagcaccgcg

SEQ ID NO: 446541 - DNA, 25 bp, Mus musculus
cgggaatcgtagttcctagcctttg

SEQ ID NO: 446542 - DNA, 25 bp, Mus musculus
aatcgtagttcctagcctttgcgca

SEQ ID NO: 446543 - DNA, 25 bp, Mus musculus
agttcctagcctttgcgcaggcgca

SEQ ID NO: 446544 - DNA, 25 bp, Mus musculus
caggcgcagtgggtcccgaagtctt

SEQ ID NO: 446545 - DNA, 25 bp, Mus musculus
tgggtcccgaagtcttgcgcgcgca

SEQ ID NO: 446546 - DNA, 25 bp, Mus musculus
ctgcgggacaaggttctgaacgctt

SEQ ID NO: 446547 - DNA, 25 bp, Mus musculus
ctgaacgcttattgcggtgcagctg

SEQ ID NO: 446548 - DNA, 25 bp, Mus musculus
cgcttattgcggtgcagctggctgc

SEQ ID NO: 446549 - DNA, 25 bp, Mus musculus
gctggtgcaggtattggtgctttcc

SEQ ID NO: 446550 - DNA, 25 bp, Mus musculus
aggtattggtgctttccgccgttcg

SEQ ID NO: 446551 - DNA, 25 bp, Mus musculus
gttgtgggctccgagcgcacgcctt

SEQ ID NO: 446552 - DNA, 25 bp, Mus musculus
tccctcgcaccaggcgcgctgcgct

SEQ ID NO: 446553 - DNA, 25 bp, Mus musculus
cacgccttgggcggattgggaccca

SEQ ID NO: 446554 - DNA, 25 bp, Mus musculus
ttagttcttacctctgccatctggg

SEQ ID NO: 446555 - DNA, 25 bp, Mus musculus
gtggcgctgagaacttgtcttttcc

SEQ ID NO: 446556 - DNA, 25 bp, Mus musculus
ggcaggctcgccctgtatgtaaatc

SEQ ID NO: 446557 - DNA, 25 bp, Mus musculus
atgtaaatcgcgaaggctccgcctc

SEQ ID NO: 446558 - DNA, 25 bp, Mus musculus
tctggagactcccaggatgcgctcc

SEQ ID NO: 446559 - DNA, 25 bp, Mus musculus
gctcgcccagatctccgacgtttgg

SEQ ID NO: 446560 - DNA, 25 bp, Mus musculus
ctcgtcccggagaaagacacctgta

SEQ ID NO: 446561 - DNA, 25 bp, Mus musculus
ttgggactcgggtttgcacaatcgt

SEQ ID NO: 446562 - DNA, 25 bp, Mus musculus
cacaatcgtgttggctttcgggagc

SEQ ID NO: 446563 - DNA, 25 bp, Mus musculus
ggacacagtgagcagagacaccgtt

SEQ ID NO: 446564 - DNA, 25 bp, Mus musculus
agagacaccgttcccagacccttgt

SEQ ID NO: 446565 - DNA, 25 bp, Mus musculus
gcgcgttaccttggcggcttagttc

SEQ ID NO: 446566 - DNA, 25 bp, Mus musculus
aatcctccgactcaggaagtccgcg

SEQ ID NO: 446567 - DNA, 25 bp, Mus musculus
agacccttgtgcgaggcgcctcgac

SEQ ID NO: 446568 - DNA, 25 bp, Mus musculus
gctaggagcgcttcagacagacaga

SEQ ID NO: 446569 - DNA, 25 bp, Mus musculus
cctgcctcagaaaagaccgctgagc

SEQ ID NO: 446570 - DNA, 25 bp, Mus musculus
actgtgccgcactaggcggctagga

SEQ ID NO: 446571 - DNA, 25 bp, Mus musculus
ctagtcctgcgtgtggactgtgccg

SEQ ID NO: 446572 - DNA, 25 bp, Mus musculus
taccaggctccacaacacacagaag

SEQ ID NO: 446573 - DNA, 25 bp, Mus musculus
agaagccgcccgaggctaaggcgtc

SEQ ID NO: 446574 - DNA, 25 bp, Mus musculus
tgtactgcggcacgcgcgactgcta

SEQ ID NO: 446575 - DNA, 25 bp, Mus musculus
ccgctcggccagcaaggcggagatc

SEQ ID NO: 446576 - DNA, 25 bp, Mus musculus
atcgcgcgggcctaccgtcagctgg

SEQ ID NO: 446577 - DNA, 25 bp, Mus musculus
gccgagcgccgaggctttcctgcta

SEQ ID NO: 446578 - DNA, 25 bp, Mus musculus
ggctttcctgctagtggcgaccgcc

SEQ ID NO: 446579 - DNA, 25 bp, Mus musculus
tacgagacgctcaaggtgaggctcg

SEQ ID NO: 446580 - DNA, 25 bp, Mus musculus
ctaaggcgtccttctctcctagcaa

SEQ ID NO: 446581 - DNA, 25 bp, Mus musculus
gaccgctgagctactaagactacca

SEQ ID NO: 446582 - DNA, 25 bp, Mus musculus
cgacacgctggcgacctggactctg

SEQ ID NO: 446583 - DNA, 25 bp, Mus musculus
tagccgccatgtcttccggggccag

SEQ ID NO: 446584 - DNA, 25 bp, Mus musculus
ggtgagcgttcgtccagccggaccc

SEQ ID NO: 446585 - DNA, 25 bp, Mus musculus
ttcaggccgaatcccgggtgcttct

SEQ ID NO: 446586 - DNA, 25 bp, Mus musculus
gtgcttctggcgacacagcctgtcc

SEQ ID NO: 446587 - DNA, 25 bp, Mus musculus
tggcgacacagcctgtcccagggac

SEQ ID NO: 446588 - DNA, 25 bp, Mus musculus
tcccagggaccaggtccgatggctc

SEQ ID NO: 446589 - DNA, 25 bp, Mus musculus
gtctacaacaggctggcgacacgct

SEQ ID NO: 446590 - DNA, 25 bp, Mus musculus
taggtttgttccgaggcaccggcga

SEQ ID NO: 446591 - DNA, 25 bp, Mus musculus
agccttagccgccatgtcttccggg

SEQ ID NO: 446592 - DNA, 25 bp, Mus musculus
ctccgtgggcgtgtctacaacaggc

SEQ ID NO: 446593 - DNA, 25 bp, Mus musculus
agcgcaggcgccacctaggtttgtt

SEQ ID NO: 446594 - DNA, 25 bp, Mus musculus
agaggatcaaggtgagcgttcgtcc

SEQ ID NO: 446595 - DNA, 25 bp, Mus musculus
cgccacctaggtttgttccgaggca

SEQ ID NO: 446596 - DNA, 25 bp, Mus musculus
accagaacgcagagccgcggcgagc

SEQ ID NO: 446597 - DNA, 25 bp, Mus musculus
gactcctgggttgcaggcgactacc

SEQ ID NO: 446598 - DNA, 25 bp, Mus musculus
cagcccaagggtctggaccacggga

SEQ ID NO: 446599 - DNA, 25 bp, Mus musculus
caccagcgcgcgcacgctaaggggt

SEQ ID NO: 446600 - DNA, 25 bp, Mus musculus
acctggcccaggagggaatggcctt

SEQ ID NO: 446601 - DNA, 25 bp, Mus musculus
aatggccttgttcggcttcgtgctc

SEQ ID NO: 446602 - DNA, 25 bp, Mus musculus
tgctcttcgtggtgctgtggctgat

SEQ ID NO: 446603 - DNA, 25 bp, Mus musculus
ctgtggctgatgcatttcatgtcca

SEQ ID NO: 446604 - DNA, 25 bp, Mus musculus
gcatttcatgtccatcatctacacg

SEQ ID NO: 446605 - DNA, 25 bp, Mus musculus
tcatctacacgtgagttggagggtc

SEQ ID NO: 446606 - DNA, 25 bp, Mus musculus
tttgcggggatagagaaagctgatc

SEQ ID NO: 446607 - DNA, 25 bp, Mus musculus
gaatcgcgctggagtcgcgacccga

SEQ ID NO: 446608 - DNA, 25 bp, Mus musculus
agtcgcgacccgactcctgggttgc

SEQ ID NO: 446609 - DNA, 25 bp, Mus musculus
cgccggcagagagcacggaccagaa

SEQ ID NO: 446610 - DNA, 25 bp, Mus musculus
gctgcaacccgcatcctggagagcg

SEQ ID NO: 446611 - DNA, 25 bp, Mus musculus
ccctgtgcaaggagataaggccaga

SEQ ID NO: 446612 - DNA, 25 bp, Mus musculus
ggctcgccctcccacatcctccacg

SEQ ID NO: 446613 - DNA, 25 bp, Mus musculus
ccacatcctccacgcggcgcaccgg

SEQ ID NO: 446614 - DNA, 25 bp, Mus musculus
acccactccgggagacgcgagttgg

SEQ ID NO: 446615 - DNA, 25 bp, Mus musculus
agcagggccgcctccactacacacc

SEQ ID NO: 446616 - DNA, 25 bp, Mus musculus
gcagtctggcgtgcttctcgccgct

SEQ ID NO: 446617 - DNA, 25 bp, Mus musculus
gctccgcctccatgatccttccacg

SEQ ID NO: 446618 - DNA, 25 bp, Mus musculus
ctccagatccggagcgcgaagcgtc

SEQ ID NO: 446619 - DNA, 25 bp, Mus musculus
gcgaagcgtcctgcgcgccgagtac

SEQ ID NO: 446620 - DNA, 25 bp, Mus musculus
gagtaccctgcactcaccttccgtg

SEQ ID NO: 446621 - DNA, 25 bp, Mus musculus
accttccgtgccaggctctccgctg

SEQ ID NO: 446622 - DNA, 25 bp, Mus musculus
gctgagcagcagcacgagccgcagc

SEQ ID NO: 446623 - DNA, 25 bp, Mus musculus
cccggatctaggtgcgcctggtgca

SEQ ID NO: 446624 - DNA, 25 bp, Mus musculus
gggaacgcgcgccttgtgcttcccg

SEQ ID NO: 446625 - DNA, 25 bp, Mus musculus
ctgcgttcgcgggaacgcgcgcctt

SEQ ID NO: 446626 - DNA, 25 bp, Mus musculus
ctccgggaaaccagcgagcggagcc

SEQ ID NO: 446627 - DNA, 25 bp, Mus musculus
atccatggcccagatggaggagcgc

SEQ ID NO: 446628 - DNA, 25 bp, Mus musculus
acttacccatccatggcccagatgg

SEQ ID NO: 446629 - DNA, 25 bp, Mus musculus
gtcgccgagaggaaacgaggccagc

SEQ ID NO: 446630 - DNA, 25 bp, Mus musculus
ctcccaaggtccctgccgtcgggct

SEQ ID NO: 446631 - DNA, 25 bp, Mus musculus
ctggctcgtctctgcttcccgaagg

SEQ ID NO: 446632 - DNA, 25 bp, Mus musculus
caccattttctgagaggaagtgtgg

SEQ ID NO: 446633 - DNA, 25 bp, Mus musculus
ccgcgcaccattttctgagaggaag

SEQ ID NO: 446634 - DNA, 25 bp, Mus musculus
cagcgccgcgcaccattttctgaga

SEQ ID NO: 446635 - DNA, 25 bp, Mus musculus
aacggtgctggctagaaaagcctgg

SEQ ID NO: 446636 - DNA, 25 bp, Mus musculus
cctgaacggtgctggctagaaaagc

SEQ ID NO: 446637 - DNA, 25 bp, Mus musculus
cgcgactcgccctcctacaagcccg

SEQ ID NO: 446638 - DNA, 25 bp, Mus musculus
ctgattgtcacctacagactcggga

SEQ ID NO: 446639 - DNA, 25 bp, Mus musculus
aggtgtactccaaagcgcctgcgca

SEQ ID NO: 446640 - DNA, 25 bp, Mus musculus
tcctgggtgtcgtttgtagaactgc

SEQ ID NO: 446641 - DNA, 25 bp, Mus musculus
caggcgcacaccgtcttgtaagctc

SEQ ID NO: 446642 - DNA, 25 bp, Mus musculus
taagctctcggtcttgtaggatctc

SEQ ID NO: 446643 - DNA, 25 bp, Mus musculus
cggagagaaagttcgcctgtcactc

SEQ ID NO: 446644 - DNA, 25 bp, Mus musculus
tctgaactgcgaaggtcatgctgcc

SEQ ID NO: 446645 - DNA, 25 bp, Mus musculus
tcatgctgcccaacactgggtaaga

SEQ ID NO: 446646 - DNA, 25 bp, Mus musculus
caccggttcgcggaaagatagagtc

SEQ ID NO: 446647 - DNA, 25 bp, Mus musculus
tgcgcatgcacgagaacccaaagtt

SEQ ID NO: 446648 - DNA, 25 bp, Mus musculus
tcaaaagttgtacactgcaaggggc

SEQ ID NO: 446649 - DNA, 25 bp, Mus musculus
gtcagatactccacggggaaaggtc

SEQ ID NO: 446650 - DNA, 25 bp, Mus musculus
atgatgctctagacacgccagtggc

SEQ ID NO: 446651 - DNA, 25 bp, Mus musculus
tggcccacaggagaaactgattgtc

SEQ ID NO: 446652 - DNA, 25 bp, Mus musculus
agagtctgagacacctcggggctct

SEQ ID NO: 446653 - DNA, 25 bp, Mus musculus
ccaggacagcggacacgcgtggaaa

SEQ ID NO: 446654 - DNA, 25 bp, Mus musculus
acacgcgtggaaagtggcacagacc

SEQ ID NO: 446655 - DNA, 25 bp, Mus musculus
cacagaccgtgcgtgggttctgtac

SEQ ID NO: 446656 - DNA, 25 bp, Mus musculus
tgggttctgtacctgtcggagcgac

SEQ ID NO: 446657 - DNA, 25 bp, Mus musculus
ctgctcgcgtcgctgacaggagctt

SEQ ID NO: 446658 - DNA, 25 bp, Mus musculus
cgggcgtcgctacacacttcctgta

SEQ ID NO: 446659 - DNA, 25 bp, Mus musculus
ccgcgttcctatggacagacgcaca

SEQ ID NO: 446660 - DNA, 25 bp, Mus musculus
cagacgcacagacacctgcaggtgg

SEQ ID NO: 446661 - DNA, 25 bp, Mus musculus
cgtgaccctcagaaccttccttttg

SEQ ID NO: 446662 - DNA, 25 bp, Mus musculus
agaaccttccttttgtctgctccgg

SEQ ID NO: 446663 - DNA, 25 bp, Mus musculus
ggaacggtctgcctagctagttgca

SEQ ID NO: 446664 - DNA, 25 bp, Mus musculus
gcctagctagttgcagagtctgaga

SEQ ID NO: 446665 - DNA, 25 bp, Mus musculus
ctctgccggactagcttggttgtcc

SEQ ID NO: 446666 - DNA, 25 bp, Mus musculus
agctgttcccagagctgcacaacaa

SEQ ID NO: 446667 - DNA, 25 bp, Mus musculus
gggagagcacttcccgtcgcttccg

SEQ ID NO: 446668 - DNA, 25 bp, Mus musculus
atcaccgagcctgcacctgtgggga

SEQ ID NO: 446669 - DNA, 25 bp, Mus musculus
ttgttgcccgggcttgtttctgccc

SEQ ID NO: 446670 - DNA, 25 bp, Mus musculus
gcccagtgccaggtcacgtgcgtta

SEQ ID NO: 446671 - DNA, 25 bp, Mus musculus
tcacgtgcgttagtgacaacctctc

SEQ ID NO: 446672 - DNA, 25 bp, Mus musculus
acctgcgggtgacgggaaacctgct

SEQ ID NO: 446673 - DNA, 25 bp, Mus musculus
gctgggaagccgatcagctgttccc

SEQ ID NO: 446674 - DNA, 25 bp, Mus musculus
cgcagctctgctcggctcacgtaag

SEQ ID NO: 446675 - DNA, 25 bp, Mus musculus
ggctcacgtaagtgcgggctacaca

SEQ ID NO: 446676 - DNA, 25 bp, Mus musculus
tctggctttcatgccggactctctc

SEQ ID NO: 446677 - DNA, 25 bp, Mus musculus
agtgttctccggctcccgctttgtt

SEQ ID NO: 446678 - DNA, 25 bp, Mus musculus
cgagcacggcgacaccgagaacctg

SEQ ID NO: 446679 - DNA, 25 bp, Mus musculus
agtgacaacctctcgcagggcggcc

SEQ ID NO: 446680 - DNA, 25 bp, Mus musculus
ttcccttccgaagaatgacagtcga

SEQ ID NO: 446681 - DNA, 25 bp, Mus musculus
atcgactggacgcaacggacgctac

SEQ ID NO: 446682 - DNA, 25 bp, Mus musculus
cacgggagatgcaggccgtacaatt

SEQ ID NO: 446683 - DNA, 25 bp, Mus musculus
ttgttgagcgaagacacgagctcta

SEQ ID NO: 446684 - DNA, 25 bp, Mus musculus
gctctaagcagatgccgggtggaaa

SEQ ID NO: 446685 - DNA, 25 bp, Mus musculus
gaaaggactcgcgtctcccacggct

SEQ ID NO: 446686 - DNA, 25 bp, Mus musculus
gccgagctcgtaccgaaggctatca

SEQ ID NO: 446687 - DNA, 25 bp, Mus musculus
gtgagaaaccctcgcacactatgcc

SEQ ID NO: 446688 - DNA, 25 bp, Mus musculus
tggcgtcaccagtcctttttactta

SEQ ID NO: 446689 - DNA, 25 bp, Mus musculus
ttacttacccggaatgcgaggagcc

SEQ ID NO: 446690 - DNA, 25 bp, Mus musculus
agaaagctcgctgtccggtcgcagc

SEQ ID NO: 446691 - DNA, 25 bp, Mus musculus
cagaacccggcgagagtgcagcaat

SEQ ID NO: 446692 - DNA, 25 bp, Mus musculus
ggaagtcccgcctatcgactggacg

SEQ ID NO: 446693 - DNA, 25 bp, Mus musculus
gaaggctatcaaggccaccctgaga

SEQ ID NO: 446694 - DNA, 25 bp, Mus musculus
taagcggccagagggcatgtgtttt

SEQ ID NO: 446695 - DNA, 25 bp, Mus musculus
taacgctcgggaaagctcagcctcg

SEQ ID NO: 446696 - DNA, 25 bp, Mus musculus
gctgccaccaccagctagtgcaggg

SEQ ID NO: 446697 - DNA, 25 bp, Mus musculus
accaccagctagtgcagggcctcgg

SEQ ID NO: 446698 - DNA, 25 bp, Mus musculus
cggacctactgatggcccgcagctt

SEQ ID NO: 446699 - DNA, 25 bp, Mus musculus
tggcccgcagcttcggtgacaaggt

SEQ ID NO: 446700 - DNA, 25 bp, Mus musculus
tgctgcggtacttcgcctctgtgtc

SEQ ID NO: 446701 - DNA, 25 bp, Mus musculus
gtcgcagctgcaggctaagcggcca

SEQ ID NO: 446702 - DNA, 25 bp, Mus musculus
catgtgttttccctggctgagagtg

SEQ ID NO: 446703 - DNA, 25 bp, Mus musculus
gtggtgtaacgctcgggaaagctca

SEQ ID NO: 446704 - DNA, 25 bp, Mus musculus
ttggccaaagcctgtcctctcactg

SEQ ID NO: 446705 - DNA, 25 bp, Mus musculus
gaagctgccagtgggcgcacttcct

SEQ ID NO: 446706 - DNA, 25 bp, Mus musculus
cagcctcgcgggcaggagaagcatc

SEQ ID NO: 446707 - DNA, 25 bp, Mus musculus
ttggcgcggcttagcccacggagct

SEQ ID NO: 446708 - DNA, 25 bp, Mus musculus
cccaggactctagcgcgattgtaga

SEQ ID NO: 446709 - DNA, 25 bp, Mus musculus
tggcatccctgagtcccaggagata

SEQ ID NO: 446710 - DNA, 25 bp, Mus musculus
gggcacagacatctcccacagaaga

SEQ ID NO: 446711 - DNA, 25 bp, Mus musculus
ttcccggacagatacagactcgagc

SEQ ID NO: 446712 - DNA, 25 bp, Mus musculus
gcctcaaagagcgagtgacgattcc

SEQ ID NO: 446713 - DNA, 25 bp, Mus musculus
tggcagcaaccatccaggcagcgaa

SEQ ID NO: 446714 - DNA, 25 bp, Mus musculus
tcaactcaggtacagggcaaatgcc

SEQ ID NO: 446715 - DNA, 25 bp, Mus musculus
atcagaggacccagctcaactcagg

SEQ ID NO: 446716 - DNA, 25 bp, Mus musculus
gtcagaaggcgctccaatcagagga

SEQ ID NO: 446717 - DNA, 25 bp, Mus musculus
tggaaccttcggatcccaggtcaga

SEQ ID NO: 446718 - DNA, 25 bp, Mus musculus
ctcgtgtctggacagtgaagcccgc

SEQ ID NO: 446719 - DNA, 25 bp, Mus musculus
acaccagtgatgtcggggcacagcc

SEQ ID NO: 446720 - DNA, 25 bp, Mus musculus
gaaggacacgccttggagctccaga

SEQ ID NO: 446721 - DNA, 25 bp, Mus musculus
agctccagagcaaggaagggtcgtc

SEQ ID NO: 446722 - DNA, 25 bp, Mus musculus
cgcctctgggatcactgtgccggca

SEQ ID NO: 446723 - DNA, 25 bp, Mus musculus
ccgcaggctcggatgtagccatctc

SEQ ID NO: 446724 - DNA, 25 bp, Mus musculus
atcgctttccgcaggctcggatgta

SEQ ID NO: 446725 - DNA, 25 bp, Mus musculus
ggatgtagccatctcctccggacgc

SEQ ID NO: 446726 - DNA, 25 bp, Mus musculus
atctcctccggacgcctggctttgt

SEQ ID NO: 446727 - DNA, 25 bp, Mus musculus
cgatccagcgcctctggctttgtca

SEQ ID NO: 446728 - DNA, 25 bp, Mus musculus
ctggctttgtcaggtcctcgatgga

SEQ ID NO: 446729 - DNA, 25 bp, Mus musculus
tcagaggccgatatggcggccaccc

SEQ ID NO: 446730 - DNA, 25 bp, Mus musculus
ctggcgattcgtgagtcctggttcc

SEQ ID NO: 446731 - DNA, 25 bp, Mus musculus
ttcgtgagtcctggttcccggagct

SEQ ID NO: 446732 - DNA, 25 bp, Mus musculus
agctgcgacgtgtcccaggcaggaa

SEQ ID NO: 446733 - DNA, 25 bp, Mus musculus
cccagacctaaattcgggaggcgcg

SEQ ID NO: 446734 - DNA, 25 bp, Mus musculus
ggttctgttacagaattcggaatta

SEQ ID NO: 446735 - DNA, 25 bp, Mus musculus
tcctcgatggagtcagaggccgata

SEQ ID NO: 446736 - DNA, 25 bp, Mus musculus
gggaatgtgtcatcgccgctgtcac

SEQ ID NO: 446737 - DNA, 25 bp, Mus musculus
ggccgtctagtgtgctcaccatgcc

SEQ ID NO: 446738 - DNA, 25 bp, Mus musculus
ccgctgtcacagcaggagtagggct

SEQ ID NO: 446739 - DNA, 25 bp, Mus musculus
agtcctgagtagagtcccgggctga

SEQ ID NO: 446740 - DNA, 25 bp, Mus musculus
gagatgtcgcacaactcaggggttg

SEQ ID NO: 446741 - DNA, 25 bp, Mus musculus
agcagcgagcggacagacgcgaccc

SEQ ID NO: 446742 - DNA, 25 bp, Mus musculus
tcaccatgccggtgagtctgcgctg

SEQ ID NO: 446743 - DNA, 25 bp, Mus musculus
tcccgggctgagtcccgagcagcga

SEQ ID NO: 446744 - DNA, 25 bp, Mus musculus
ggcggtaccctggagatcctcgcag

SEQ ID NO: 446745 - DNA, 25 bp, Mus musculus
cgcaatcctagtcgagtcccaagta

SEQ ID NO: 446746 - DNA, 25 bp, Mus musculus
gcgcgcgagtgaggaccacaactcc

SEQ ID NO: 446747 - DNA, 25 bp, Mus musculus
gggatttcggagatgtcgcacaact

SEQ ID NO: 446748 - DNA, 25 bp, Mus musculus
ggcgcggtagcagccgcaatcctag

SEQ ID NO: 446749 - DNA, 25 bp, Mus musculus
cgagtcccaagtagagtcctgagta

SEQ ID NO: 446750 - DNA, 25 bp, Mus musculus
actcacccgccgcttggcgagagga

SEQ ID NO: 446751 - DNA, 25 bp, Mus musculus
ggccgaggtgacaccgctactcaga

SEQ ID NO: 446752 - DNA, 25 bp, Mus musculus
aacgcgccgagggtctgtctagacc

SEQ ID NO: 446753 - DNA, 25 bp, Mus musculus
aggaagtcggtgtcatcctcgtctc

SEQ ID NO: 446754 - DNA, 25 bp, Mus musculus
cggcaccgaacatcacgtcggcttt

SEQ ID NO: 446755 - DNA, 25 bp, Mus musculus
cacgtcggctttcgcccagctgaag

SEQ ID NO: 446756 - DNA, 25 bp, Mus musculus
cagggcctgtcaccgccggtaacgt

SEQ ID NO: 446757 - DNA, 25 bp, Mus musculus
ctgctttccggcaggacaaactctc

SEQ ID NO: 446758 - DNA, 25 bp, Mus musculus
aactctctcagggtagtgaggccca

SEQ ID NO: 446759 - DNA, 25 bp, Mus musculus
gagctcccagtgacgcaaggcctca

SEQ ID NO: 446760 - DNA, 25 bp, Mus musculus
ccctccgaggaggtggagttcctag

SEQ ID NO: 446761 - DNA, 25 bp, Mus musculus
cctttactgcggtcgtgggacacgt

SEQ ID NO: 446762 - DNA, 25 bp, Mus musculus
aagttggatgttcccagggcctgtc

SEQ ID NO: 446763 - DNA, 25 bp, Mus musculus
ccgctactcagaatgcgaaggctga

SEQ ID NO: 446764 - DNA, 25 bp, Mus musculus
tagaacgcggatttggctagggcct

SEQ ID NO: 446765 - DNA, 25 bp, Mus musculus
tgtgtagctctgtaaggccacgccc

SEQ ID NO: 446766 - DNA, 25 bp, Mus musculus
gactccagccgacctttggcaacta

SEQ ID NO: 446767 - DNA, 25 bp, Mus musculus
tggcaactaccattcccaagatact

SEQ ID NO: 446768 - DNA, 25 bp, Mus musculus
ttcccaagatacttcgcacgtagta

SEQ ID NO: 446769 - DNA, 25 bp, Mus musculus
tcgcacgtagtacgtttctgatacg

SEQ ID NO: 446770 - DNA, 25 bp, Mus musculus
ttctgatacgtttccggccagtgac

SEQ ID NO: 446771 - DNA, 25 bp, Mus musculus
cggccagtgacgcacttccactttg

SEQ ID NO: 446772 - DNA, 25 bp, Mus musculus
cacttccactttgctaggcgcgcgg

SEQ ID NO: 446773 - DNA, 25 bp, Mus musculus
cggtctgaaaagtagaacgcggatt

SEQ ID NO: 446774 - DNA, 25 bp, Mus musculus
ctcctccacggtacggagctctgga

SEQ ID NO: 446775 - DNA, 25 bp, Mus musculus
gctctggatctaagctcaggcctgc

SEQ ID NO: 446776 - DNA, 25 bp, Mus musculus
taagctcaggcctgccctagagagg

SEQ ID NO: 446777 - DNA, 25 bp, Mus musculus
taggcgcgcggttcccggtctgaaa

SEQ ID NO: 446778 - DNA, 25 bp, Mus musculus
tccacctaaacgctccgggcgtcca

SEQ ID NO: 446779 - DNA, 25 bp, Mus musculus
ggagagcgcgaagatgccccccgat

SEQ ID NO: 446780 - DNA, 25 bp, Mus musculus
cctctctcccacctcgggctccata

SEQ ID NO: 446781 - DNA, 25 bp, Mus musculus
aagtccctcaggggccgagccgaga

SEQ ID NO: 446782 - DNA, 25 bp, Mus musculus
caggttccacgtgccggaagtccct

SEQ ID NO: 446783 - DNA, 25 bp, Mus musculus
tcgctagggcgggagttccacctaa

SEQ ID NO: 446784 - DNA, 25 bp, Mus musculus
tagcttccacaggttcccgcgcctc

SEQ ID NO: 446785 - DNA, 25 bp, Mus musculus
aggcatccttagcttccacaggttc

SEQ ID NO: 446786 - DNA, 25 bp, Mus musculus
acgggtagcaggcatccttagcttc

SEQ ID NO: 446787 - DNA, 25 bp, Mus musculus
cgaaagcacgggtagcaggcatcct

SEQ ID NO: 446788 - DNA, 25 bp, Mus musculus
ggctagcaccgaggcccgaaagcac

SEQ ID NO: 446789 - DNA, 25 bp, Mus musculus
atacccaccggtgggctagcaccga

SEQ ID NO: 446790 - DNA, 25 bp, Mus musculus
gggctccatacccaccggtgggcta

SEQ ID NO: 446791 - DNA, 25 bp, Mus musculus
ttccacgtgccggaagtccctcagg

SEQ ID NO: 446792 - DNA, 25 bp, Mus musculus
agcacgcggaggagctgagagtaag

SEQ ID NO: 446793 - DNA, 25 bp, Mus musculus
agcaggggtccgagcggagccagtt

SEQ ID NO: 446794 - DNA, 25 bp, Mus musculus
ccctcggtacctgcgacaggtggag

SEQ ID NO: 446795 - DNA, 25 bp, Mus musculus
ctctcggccatgtccgcggatgtct

SEQ ID NO: 446796 - DNA, 25 bp, Mus musculus
ccatgtccgcggatgtctccgggac

SEQ ID NO: 446797 - DNA, 25 bp, Mus musculus
accgcatccgtcgagcggaggagca

SEQ ID NO: 446798 - DNA, 25 bp, Mus musculus
ccgagcacttcgagcctctgagctg

SEQ ID NO: 446799 - DNA, 25 bp, Mus musculus
gcacttcgagcctctgagctggttc

SEQ ID NO: 446800 - DNA, 25 bp, Mus musculus
tcgagcctctgagctggttctgcct

SEQ ID NO: 446801 - DNA, 25 bp, Mus musculus
ctggttctgcctctcggagcgacgg

SEQ ID NO: 446802 - DNA, 25 bp, Mus musculus
cctctcggagcgacggccggtatgc

SEQ ID NO: 446803 - DNA, 25 bp, Mus musculus
acgccctcggtacctgcgacaggtg

SEQ ID NO: 446804 - DNA, 25 bp, Mus musculus
cgctgtcaccggcaccgcatccgtc

SEQ ID NO: 446805 - DNA, 25 bp, Mus musculus
agcgacggccggtatgcgccacctg

SEQ ID NO: 446806 - DNA, 25 bp, Mus musculus
tgctccaccggctctatgtaggcga

SEQ ID NO: 446807 - DNA, 25 bp, Mus musculus
tccctcgcgcccgtcactcgccacg

SEQ ID NO: 446808 - DNA, 25 bp, Mus musculus
ctaggcgtcaccaagctcctccctc

SEQ ID NO: 446809 - DNA, 25 bp, Mus musculus
tcggacttgccattgattctcgccc

SEQ ID NO: 446810 - DNA, 25 bp, Mus musculus
gcgaccctcggacttgccattgatt

SEQ ID NO: 446811 - DNA, 25 bp, Mus musculus
ggcgatcagtagctcgcgaccctcg

SEQ ID NO: 446812 - DNA, 25 bp, Mus musculus
accggctctatgtaggcgatcagta

SEQ ID NO: 446813 - DNA, 25 bp, Mus musculus
acctggctcgggaaaagagacctga

SEQ ID NO: 446814 - DNA, 25 bp, Mus musculus
cacccacctggctcgggaaaagaga

SEQ ID NO: 446815 - DNA, 25 bp, Mus musculus
gcacggattcccacggtttagcacc

SEQ ID NO: 446816 - DNA, 25 bp, Mus musculus
cgactgcacggattcccacggttta

SEQ ID NO: 446817 - DNA, 25 bp, Mus musculus
agctcgactgcacggattcccacgg

SEQ ID NO: 446818 - DNA, 25 bp, Mus musculus
ggagcctccggggccaagtccactg

SEQ ID NO: 446819 - DNA, 25 bp, Mus musculus
ctctatgtaggcgatcagtagctcg

SEQ ID NO: 446820 - DNA, 25 bp, Mus musculus
acacagcgccataggggtgcacctc

SEQ ID NO: 446821 - DNA, 25 bp, Mus musculus
acagcgtctccgctacagcgtcaga

SEQ ID NO: 446822 - DNA, 25 bp, Mus musculus
cgcgctctgcagaaaccgaggctac

SEQ ID NO: 446823 - DNA, 25 bp, Mus musculus
ggagcccatctttgagtcccgaatc

SEQ ID NO: 446824 - DNA, 25 bp, Mus musculus
tcccgcccactctagtaggtgcata

SEQ ID NO: 446825 - DNA, 25 bp, Mus musculus
acagcgtcagagcttcgggaacaca

SEQ ID NO: 446826 - DNA, 25 bp, Mus musculus
gcctgctcacgtaccaaggacgctg

SEQ ID NO: 446827 - DNA, 25 bp, Mus musculus
tctaaaagcgcaagcccacgtgggg

SEQ ID NO: 446828 - DNA, 25 bp, Mus musculus
cgggaatgcagcttacgctcccttc

SEQ ID NO: 446829 - DNA, 25 bp, Mus musculus
agtctccggatcactggtcagctcg

SEQ ID NO: 446830 - DNA, 25 bp, Mus musculus
cggggctggaatcttggccaatcca

SEQ ID NO: 446831 - DNA, 25 bp, Mus musculus
caatccagagttgcccgagagcccg

SEQ ID NO: 446832 - DNA, 25 bp, Mus musculus
atcccggacgcagcaagaccttgta

SEQ ID NO: 446833 - DNA, 25 bp, Mus musculus
gtgcacctcaccttgttctggggtc

SEQ ID NO: 446834 - DNA, 25 bp, Mus musculus
gcgcgctccggcgtgtttacattct

SEQ ID NO: 446835 - DNA, 25 bp, Mus musculus
gcgcggggacaaggctcccacgtac

SEQ ID NO: 446836 - DNA, 25 bp, Mus musculus
gcggcgccaatatttcccgcgcggg

SEQ ID NO: 446837 - DNA, 25 bp, Mus musculus
cgtgtttacattctgcggccgctcc

SEQ ID NO: 446838 - DNA, 25 bp, Mus musculus
tctgcggccgctccacgttgtgctg

SEQ ID NO: 446839 - DNA, 25 bp, Mus musculus
gtcagcgcccggaacaggcgtctga

SEQ ID NO: 446840 - DNA, 25 bp, Mus musculus
caaggcctctgccaaaacgcggagc

SEQ ID NO: 446841 - DNA, 25 bp, Mus musculus
aaacgcggagccgaaccgtagcctg

SEQ ID NO: 446842 - DNA, 25 bp, Mus musculus
ccgtagcctgacactccgagatcta

SEQ ID NO: 446843 - DNA, 25 bp, Mus musculus
ccgagatctaagagccaccgtgagg

SEQ ID NO: 446844 - DNA, 25 bp, Mus musculus
aggagcctctgagccgtgcagccgc

SEQ ID NO: 446845 - DNA, 25 bp, Mus musculus
gtgtgtgccgtgtcacccgcaagcc

SEQ ID NO: 446846 - DNA, 25 bp, Mus musculus
cacgtggtgcggaccgtcctgctct

SEQ ID NO: 446847 - DNA, 25 bp, Mus musculus
ccacgggactgtgtgtgccgtgtca

SEQ ID NO: 446848 - DNA, 25 bp, Mus musculus
cggacgttccactccaggcttgttt

SEQ ID NO: 446849 - DNA, 25 bp, Mus musculus
cctccttggagatgttgacaccgtc

SEQ ID NO: 446850 - DNA, 25 bp, Mus musculus
gctcagctcaccaggatgtggcata

SEQ ID NO: 446851 - DNA, 25 bp, Mus musculus
tggagatgaacacacacgcggattc

SEQ ID NO: 446852 - DNA, 25 bp, Mus musculus
acgcggattctgttaaccttctgcc

SEQ ID NO: 446853 - DNA, 25 bp, Mus musculus
cgcctccttgatgatcctggtgatg

SEQ ID NO: 446854 - DNA, 25 bp, Mus musculus
tcgctaaaatatgaccctcggaggc

SEQ ID NO: 446855 - DNA, 25 bp, Mus musculus
tagcccagctttccatgtcgcaatg

SEQ ID NO: 446856 - DNA, 25 bp, Mus musculus
ctccagaggctcagaacgtagtaac

SEQ ID NO: 446857 - DNA, 25 bp, Mus musculus
tctactacacatcgcgagagctttc

SEQ ID NO: 446858 - DNA, 25 bp, Mus musculus
gagctttcgcaccacactaagtttg

SEQ ID NO: 446859 - DNA, 25 bp, Mus musculus
gaggtttccgtcgattctcccagcg

SEQ ID NO: 446860 - DNA, 25 bp, Mus musculus
acgcgctttcgcaatctcagcattg

SEQ ID NO: 446861 - DNA, 25 bp, Mus musculus
cgttgccagtgtcccacagtgcttt

SEQ ID NO: 446862 - DNA, 25 bp, Mus musculus
gatctcgcccaaaagcagatccaca

SEQ ID NO: 446863 - DNA, 25 bp, Mus musculus
ctggtccggatcgatctcgcccaaa

SEQ ID NO: 446864 - DNA, 25 bp, Mus musculus
tccacaagcctgtctgcgaccattt

SEQ ID NO: 446865 - DNA, 25 bp, Mus musculus
cagatccacatccacgaaggccttg

SEQ ID NO: 446866 - DNA, 25 bp, Mus musculus
atccacgaaggccttgtcgaactcc

SEQ ID NO: 446867 - DNA, 25 bp, Mus musculus
agcacctcaagccatcggaacatgg

SEQ ID NO: 446868 - DNA, 25 bp, Mus musculus
tcaagccatcggaacatggacaccc

SEQ ID NO: 446869 - DNA, 25 bp, Mus musculus
ctgtctgcgaccattttgacgaccg

SEQ ID NO: 446870 - DNA, 25 bp, Mus musculus
cggcagcgcagctccagagcagcaa

SEQ ID NO: 446871 - DNA, 25 bp, Mus musculus
gcagctccagagcagcaaaggaagc

SEQ ID NO: 446872 - DNA, 25 bp, Mus musculus
gcagcgacagcgacacggaagaccc

SEQ ID NO: 446873 - DNA, 25 bp, Mus musculus
ggccgtacgagagcttagccaatga

SEQ ID NO: 446874 - DNA, 25 bp, Mus musculus
atgaaaagccttcgcctccacaagc

SEQ ID NO: 446875 - DNA, 25 bp, Mus musculus
cccgcgcgaggggaactgctagcac

SEQ ID NO: 446876 - DNA, 25 bp, Mus musculus
aagaccttacttccgtcccgtgctg

SEQ ID NO: 446877 - DNA, 25 bp, Mus musculus
gaccctgaatctgatggcgaaactg

SEQ ID NO: 446878 - DNA, 25 bp, Mus musculus
tttatgcggaatattcagaccctga

SEQ ID NO: 446879 - DNA, 25 bp, Mus musculus
cgtctcttgcaatttatgcggaata

SEQ ID NO: 446880 - DNA, 25 bp, Mus musculus
gaaaaatgttttgtcgtctcttgca

SEQ ID NO: 446881 - DNA, 25 bp, Mus musculus
tgagtcataggcctgagccacaccg

SEQ ID NO: 446882 - DNA, 25 bp, Mus musculus
ccctaaattggcttatgagtcatag

SEQ ID NO: 446883 - DNA, 25 bp, Mus musculus
gtctcctgggatccggaagaagttg

SEQ ID NO: 446884 - DNA, 25 bp, Mus musculus
tgcccagacacagcccttttgattg

SEQ ID NO: 446885 - DNA, 25 bp, Mus musculus
cccgagaagtcagcgaagtagaagc

SEQ ID NO: 446886 - DNA, 25 bp, Mus musculus
tcccgtgctgatgacgtttccaaga

SEQ ID NO: 446887 - DNA, 25 bp, Mus musculus
agcgaagtagaagccgcaagacctt

SEQ ID NO: 446888 - DNA, 25 bp, Mus musculus
cgaaactggagtcgacgctgtaggc

SEQ ID NO: 446889 - DNA, 25 bp, Mus musculus
tgatgacgtttccaagagctgagca

SEQ ID NO: 446890 - DNA, 25 bp, Mus musculus
accagcgcgggccaatcagggactg

SEQ ID NO: 446891 - DNA, 25 bp, Mus musculus
ggacgccatggagcgctctctgcac

SEQ ID NO: 446892 - DNA, 25 bp, Mus musculus
caacagggacgccatggagcgctct

SEQ ID NO: 446893 - DNA, 25 bp, Mus musculus
ctggccgcaacagggacgccatgga

SEQ ID NO: 446894 - DNA, 25 bp, Mus musculus
tgtcctggccgcaacagggacgcca

SEQ ID NO: 446895 - DNA, 25 bp, Mus musculus
tgcacccacataaccaccgcctggg

SEQ ID NO: 446896 - DNA, 25 bp, Mus musculus
tgggttacctgcacccacataacca

SEQ ID NO: 446897 - DNA, 25 bp, Mus musculus
tgcctgggttacctgcacccacata

SEQ ID NO: 446898 - DNA, 25 bp, Mus musculus
aggcgaggtgcagaaaggctgagcc

SEQ ID NO: 446899 - DNA, 25 bp, Mus musculus
agccaagtcaggtggaaatctcccc

SEQ ID NO: 446900 - DNA, 25 bp, Mus musculus
caatcagggactggcgcgcccggct

SEQ ID NO: 446901 - DNA, 25 bp, Mus musculus
ggaaatctccccattcaaaccagcg

SEQ ID NO: 446902 - DNA, 25 bp, Mus musculus
atggagcgctctctgcaccgcgtct

SEQ ID NO: 446903 - DNA, 25 bp, Mus musculus
gcgcccggctgttccaacgcgcgga

SEQ ID NO: 446904 - DNA, 25 bp, Mus musculus
ttccacggagctctagggtgcaaga

SEQ ID NO: 446905 - DNA, 25 bp, Mus musculus
gccaggaggaggttctttttcatga

SEQ ID NO: 446906 - DNA, 25 bp, Mus musculus
accgcccgctatcgaggatccttag

SEQ ID NO: 446907 - DNA, 25 bp, Mus musculus
ctgcatctctaggatcctctcagga

SEQ ID NO: 446908 - DNA, 25 bp, Mus musculus
tgtagatgccaagtcaaggtcccaa

SEQ ID NO: 446909 - DNA, 25 bp, Mus musculus
ttacccacagcggtcttccacggag

SEQ ID NO: 446910 - DNA, 25 bp, Mus musculus
aggccgaacacattcagcacgctta

SEQ ID NO: 446911 - DNA, 25 bp, Mus musculus
agccgtgctcgtgagtttgagaatc

SEQ ID NO: 446912 - DNA, 25 bp, Mus musculus
atcgccttgtagaggccagaagcta

SEQ ID NO: 446913 - DNA, 25 bp, Mus musculus
tccaaaggtgtttcgcggaagttca

SEQ ID NO: 446914 - DNA, 25 bp, Mus musculus
gccattcgcagagggtcgtgtgcaa

SEQ ID NO: 446915 - DNA, 25 bp, Mus musculus
atgcacgcctgtggttgccattcgc

SEQ ID NO: 446916 - DNA, 25 bp, Mus musculus
gggccgagactttaaatcgccttca

SEQ ID NO: 446917 - DNA, 25 bp, Mus musculus
aaggtcccaactgtgtttctgcatc

SEQ ID NO: 446918 - DNA, 25 bp, Mus musculus
cccgcagcccatcggagaggacaga

SEQ ID NO: 446919 - DNA, 25 bp, Mus musculus
gatcgcgcgctccagactcccagag

SEQ ID NO: 446920 - DNA, 25 bp, Mus musculus
gtgtggcgctcccacgtggagatat

SEQ ID NO: 446921 - DNA, 25 bp, Mus musculus
cccacgtggagatatctgaagcctc

SEQ ID NO: 446922 - DNA, 25 bp, Mus musculus
gagatatctgaagcctcgtgggtcc

SEQ ID NO: 446923 - DNA, 25 bp, Mus musculus
ggagctcctgtccaagtctcacctg

SEQ ID NO: 446924 - DNA, 25 bp, Mus musculus
gtccaagtctcacctgcagctggca

SEQ ID NO: 446925 - DNA, 25 bp, Mus musculus
cgccctggtttcctggagttgagcg

SEQ ID NO: 446926 - DNA, 25 bp, Mus musculus
ttcctggagttgagcggcagacaaa

SEQ ID NO: 446927 - DNA, 25 bp, Mus musculus
gttgagcggcagacaaaggcctcca

SEQ ID NO: 446928 - DNA, 25 bp, Mus musculus
gcggcagacaaaggcctccaatccg

SEQ ID NO: 446929 - DNA, 25 bp, Mus musculus
gcggggtgtgtctgctttgcataat

SEQ ID NO: 446930 - DNA, 25 bp, Mus musculus
cataatgcccgcagcccatcggaga

SEQ ID NO: 446931 - DNA, 25 bp, Mus musculus
tgtgtctgctttgcataatgcccgc

SEQ ID NO: 446932 - DNA, 25 bp, Mus musculus
ctgtctgtctgcctcggcctgaggt

SEQ ID NO: 446933 - DNA, 25 bp, Mus musculus
gtgtctcctgattctcaggcccgtc

SEQ ID NO: 446934 - DNA, 25 bp, Mus musculus
ttcccgcaacgcatcctatgggtcg

SEQ ID NO: 446935 - DNA, 25 bp, Mus musculus
aacgcatcctatgggtcgcatgcca

SEQ ID NO: 446936 - DNA, 25 bp, Mus musculus
ctatgggtcgcatgccaagtgtctc

SEQ ID NO: 446937 - DNA, 25 bp, Mus musculus
tcgcatgccaagtgtctcctgattc

SEQ ID NO: 446938 - DNA, 25 bp, Mus musculus
tgccaagtgtctcctgattctcagg

SEQ ID NO: 446939 - DNA, 25 bp, Mus musculus
ctcaggcccgtccatcctccgccag

SEQ ID NO: 446940 - DNA, 25 bp, Mus musculus
tgcagtcccgactcacaggtttgtt

SEQ ID NO: 446941 - DNA, 25 bp, Mus musculus
cccgactcacaggtttgttggcacc

SEQ ID NO: 446942 - DNA, 25 bp, Mus musculus
tcacaggtttgttggcaccctccgc

SEQ ID NO: 446943 - DNA, 25 bp, Mus musculus
ggggctgctccttgccattcttgtt

SEQ ID NO: 446944 - DNA, 25 bp, Mus musculus
tcttagcggatgctgtctgtctgcc

SEQ ID NO: 446945 - DNA, 25 bp, Mus musculus
ccttgccattcttgttcttagcgga

SEQ ID NO: 446946 - DNA, 25 bp, Mus musculus
cggcggctgcaatcctgaggaccgc

SEQ ID NO: 446947 - DNA, 25 bp, Mus musculus
ccgtgtactggtcgaagagcagctg

SEQ ID NO: 446948 - DNA, 25 bp, Mus musculus
accagacgcagcatgggcagcagac

SEQ ID NO: 446949 - DNA, 25 bp, Mus musculus
agacgccgcttgaccgggctgtcca

SEQ ID NO: 446950 - DNA, 25 bp, Mus musculus
tgcgcaccaggtcgaagacgttgcg

SEQ ID NO: 446951 - DNA, 25 bp, Mus musculus
cagtgagtgaactgctcccgctcgg

SEQ ID NO: 446952 - DNA, 25 bp, Mus musculus
agctggcgcacgttggcagacagca

SEQ ID NO: 446953 - DNA, 25 bp, Mus musculus
taggctcagagtccggagcagtcgc

SEQ ID NO: 446954 - DNA, 25 bp, Mus musculus
cgcgaaggcaggtgaaactggaatt

SEQ ID NO: 446955 - DNA, 25 bp, Mus musculus
gaacagcagctacatgccggaaggc

SEQ ID NO: 446956 - DNA, 25 bp, Mus musculus
cgagatgcccgttcctctagggctg

SEQ ID NO: 446957 - DNA, 25 bp, Mus musculus
tcagaaagaagttagggcgccggtc

SEQ ID NO: 446958 - DNA, 25 bp, Mus musculus
cgccggtcaatctaggctcagagtc

SEQ ID NO: 446959 - DNA, 25 bp, Mus musculus
cggagtcaccggctgcagtctagac

SEQ ID NO: 446960 - DNA, 25 bp, Mus musculus
agacagtagtgggttcgtccacttc

SEQ ID NO: 446961 - DNA, 25 bp, Mus musculus
gaacctaggtcattctggccacctc

SEQ ID NO: 446962 - DNA, 25 bp, Mus musculus
cagtgtcggggccagaagctgtccc

SEQ ID NO: 446963 - DNA, 25 bp, Mus musculus
agcagttgacttaggccgttctctc

SEQ ID NO: 446964 - DNA, 25 bp, Mus musculus
tctccctcacgttcgtcactttaaa

SEQ ID NO: 446965 - DNA, 25 bp, Mus musculus
tcgagtctgcgaacctaggtcattc

SEQ ID NO: 446966 - DNA, 25 bp, Mus musculus
cacggccgtcgagtctgcgaaccta

SEQ ID NO: 446967 - DNA, 25 bp, Mus musculus
acctcaggtgcctgtggagacagta

SEQ ID NO: 446968 - DNA, 25 bp, Mus musculus
gtccgaggcccgcaagcgtgagctc

SEQ ID NO: 446969 - DNA, 25 bp, Mus musculus
ccgagaaggtgtccgaggcccgcaa

SEQ ID NO: 446970 - DNA, 25 bp, Mus musculus
gcatccagcagctactgcaggccga

SEQ ID NO: 446971 - DNA, 25 bp, Mus musculus
ctcagcaatggcgagtcagtcgcag

SEQ ID NO: 446972 - DNA, 25 bp, Mus musculus
cttaggccgttctctcagcccaaag

SEQ ID NO: 446973 - DNA, 25 bp, Mus musculus
ttaaacggttcgcccagcctctcta

SEQ ID NO: 446974 - DNA, 25 bp, Mus musculus
agagatcggggagcctgctgcccaa

SEQ ID NO: 446975 - DNA, 25 bp, Mus musculus
agatctcatgcacgtggcgggcgca

SEQ ID NO: 446976 - DNA, 25 bp, Mus musculus
ctccttcactgcagggacgagctca

SEQ ID NO: 446977 - DNA, 25 bp, Mus musculus
ttcactgcagggacgagctcagatc

SEQ ID NO: 446978 - DNA, 25 bp, Mus musculus
tgcagggacgagctcagatctcatg

SEQ ID NO: 446979 - DNA, 25 bp, Mus musculus
gacgagctcagatctcatgcacgtg

SEQ ID NO: 446980 - DNA, 25 bp, Mus musculus
ctcagatctcatgcacgtggcgggc

SEQ ID NO: 446981 - DNA, 25 bp, Mus musculus
cgtggctgatgaaacgctccgggct

SEQ ID NO: 446982 - DNA, 25 bp, Mus musculus
gctgatgaaacgctccgggctcggc

SEQ ID NO: 446983 - DNA, 25 bp, Mus musculus
gcccgagagacgctcctgccgtagg

SEQ ID NO: 446984 - DNA, 25 bp, Mus musculus
acgctcctgccgtagggcgactcgg

SEQ ID NO: 446985 - DNA, 25 bp, Mus musculus
gcgtacaaggggcatggaacctctg

SEQ ID NO: 446986 - DNA, 25 bp, Mus musculus
tccgctcaggctcgggtgacctctt

SEQ ID NO: 446987 - DNA, 25 bp, Mus musculus
ggggcatggaacctctgaccctgag

SEQ ID NO: 446988 - DNA, 25 bp, Mus musculus
tgagctcactgcagtcctcgccagt

SEQ ID NO: 446989 - DNA, 25 bp, Mus musculus
tgtccctcctcacactggccacggc

SEQ ID NO: 446990 - DNA, 25 bp, Mus musculus
cacggccctgacagtcgttggggca

SEQ ID NO: 446991 - DNA, 25 bp, Mus musculus
gtcttcgcccgtgaaaccttcttca

SEQ ID NO: 446992 - DNA, 25 bp, Mus musculus
cttcttcacagtagcaggtgccatt

SEQ ID NO: 446993 - DNA, 25 bp, Mus musculus
aggtgccattgatgcagcgaccgcg

SEQ ID NO: 446994 - DNA, 25 bp, Mus musculus
agcgaccgcggtcgaagcagtcgtt

SEQ ID NO: 446995 - DNA, 25 bp, Mus musculus
tggggcaaatgagctcactgcagtc

SEQ ID NO: 446996 - DNA, 25 bp, Mus musculus
cagtgaagccctcgtcgcagacaca

SEQ ID NO: 446997 - DNA, 25 bp, Mus musculus
gacaatcggcgggacaccgcttttc

SEQ ID NO: 446998 - DNA, 25 bp, Mus musculus
ggacaccgcttttcactgcagtctg

SEQ ID NO: 446999 - DNA, 25 bp, Mus musculus
gtctgctcctgcaaagccctcgttg

SEQ ID NO: 447000 - DNA, 25 bp, Mus musculus
aagccctcgttgcaaacacactgtc

SEQ ID NO: 447001 - DNA, 25 bp, Mus musculus
tcgaagcagtcgttggggcaaatga

SEQ ID NO: 447002 - DNA, 25 bp, Mus musculus
gcgacgcctttacactgcaagtgtg

SEQ ID NO: 447003 - DNA, 25 bp, Mus musculus
cccgccgctggaccggccacctgcg

SEQ ID NO: 447004 - DNA, 25 bp, Mus musculus
ccgcgacgcctttacactgcaagtg

SEQ ID NO: 447005 - DNA, 25 bp, Mus musculus
cgcctccgggccgacctggagctac

SEQ ID NO: 447006 - DNA, 25 bp, Mus musculus
cgctctatttcagcgggcgagggga

SEQ ID NO: 447007 - DNA, 25 bp, Mus musculus
cctagccgggcgctctatttcagcg

SEQ ID NO: 447008 - DNA, 25 bp, Mus musculus
acatgcggctctggagttgggtgct

SEQ ID NO: 447009 - DNA, 25 bp, Mus musculus
accgtcggacatgcggctctggagt

SEQ ID NO: 447010 - DNA, 25 bp, Mus musculus
tgcgagctaaagctggcagctccgg

SEQ ID NO: 447011 - DNA, 25 bp, Mus musculus
aatagtagtgcgagctaaagctggc

SEQ ID NO: 447012 - DNA, 25 bp, Mus musculus
ggcaaatagtagtgcgagctaaagc

SEQ ID NO: 447013 - DNA, 25 bp, Mus musculus
cgagaaaggaggcaaatagtagtgc

SEQ ID NO: 447014 - DNA, 25 bp, Mus musculus
cgcacgagaaaggaggcaaatagta

SEQ ID NO: 447015 - DNA, 25 bp, Mus musculus
ccgggcgctctatttcagcgggcga

SEQ ID NO: 447016 - DNA, 25 bp, Mus musculus
acgctctcgaccaatcccagttaga

SEQ ID NO: 447017 - DNA, 25 bp, Mus musculus
ctcgaaccagcaagtctgcggcggg

SEQ ID NO: 447018 - DNA, 25 bp, Mus musculus
agtcagctcgcacagcccaagatgg

SEQ ID NO: 447019 - DNA, 25 bp, Mus musculus
tacggccggctctaggctccgcaga

SEQ ID NO: 447020 - DNA, 25 bp, Mus musculus
atggcgtagtagtcggccagagtcc

SEQ ID NO: 447021 - DNA, 25 bp, Mus musculus
ggaacctctagtcagctcgcacagc

SEQ ID NO: 447022 - DNA, 25 bp, Mus musculus
tccagcaggaactcgaaccagcaag

SEQ ID NO: 447023 - DNA, 25 bp, Mus musculus
aggctttgcgcagatgcttctccaa

SEQ ID NO: 447024 - DNA, 25 bp, Mus musculus
ctcacccggacaggctttgcgcaga

SEQ ID NO: 447025 - DNA, 25 bp, Mus musculus
acgttcccggctgaggcaccgtcga

SEQ ID NO: 447026 - DNA, 25 bp, Mus musculus
tgaaactttccgcagacgctccgcg

SEQ ID NO: 447027 - DNA, 25 bp, Mus musculus
ccgcggcagaccgaaagcctttgtc

SEQ ID NO: 447028 - DNA, 25 bp, Mus musculus
cccttcgctgtgaggaccgcggcag

SEQ ID NO: 447029 - DNA, 25 bp, Mus musculus
atcccagttagacttcggaggaaag

SEQ ID NO: 447030 - DNA, 25 bp, Mus musculus
gcaggaatgcagtccgcctgactca

SEQ ID NO: 447031 - DNA, 25 bp, Mus musculus
gtaggtgcaggtcccgctgcagatc

SEQ ID NO: 447032 - DNA, 25 bp, Mus musculus
cctatcctcgcgctgacacggagag

SEQ ID NO: 447033 - DNA, 25 bp, Mus musculus
ggtggtgcacgacccgatgaccgtc

SEQ ID NO: 447034 - DNA, 25 bp, Mus musculus
acgacccgatgaccgtcgaggcagc

SEQ ID NO: 447035 - DNA, 25 bp, Mus musculus
cgggactgacccagctgggctcact

SEQ ID NO: 447036 - DNA, 25 bp, Mus musculus
cccagctgggctcactgtattaaga

SEQ ID NO: 447037 - DNA, 25 bp, Mus musculus
actgtattaagaagcggacccgcga

SEQ ID NO: 447038 - DNA, 25 bp, Mus musculus
cgcgcagcgcgcaggaatgcagtcc

SEQ ID NO: 447039 - DNA, 25 bp, Mus musculus
gtccataaagcgctgctggctcccg

SEQ ID NO: 447040 - DNA, 25 bp, Mus musculus
gcccaagtccgaggtagtctcacta

SEQ ID NO: 447041 - DNA, 25 bp, Mus musculus
tccgaggtagtctcactaaggtagg

SEQ ID NO: 447042 - DNA, 25 bp, Mus musculus
tcactaaggtaggtgcaggtcccgc

SEQ ID NO: 447043 - DNA, 25 bp, Mus musculus
ccaacgcagcccaagtccgaggtag

SEQ ID NO: 447044 - DNA, 25 bp, Mus musculus
caggcgactgtacgaattggcgact

SEQ ID NO: 447045 - DNA, 25 bp, Mus musculus
gaaggagggtctgcgaccagggact

SEQ ID NO: 447046 - DNA, 25 bp, Mus musculus
atcggattcggaagggacgggctca

SEQ ID NO: 447047 - DNA, 25 bp, Mus musculus
ctggatcggagtggcaggatcggat

SEQ ID NO: 447048 - DNA, 25 bp, Mus musculus
attgaatggcaggatttggggactg

SEQ ID NO: 447049 - DNA, 25 bp, Mus musculus
tcgcggggatccaagattgaatggc

SEQ ID NO: 447050 - DNA, 25 bp, Mus musculus
cgtgctagcgcatgcgcagaaggca

SEQ ID NO: 447051 - DNA, 25 bp, Mus musculus
aaggacgtgctagcgcatgcgcaga

SEQ ID NO: 447052 - DNA, 25 bp, Mus musculus
ccatgggaaggacgtgctagcgcat

SEQ ID NO: 447053 - DNA, 25 bp, Mus musculus
cgactgccatgggaaggacgtgcta

SEQ ID NO: 447054 - DNA, 25 bp, Mus musculus
cgactgtacgaattggcgactgcca

SEQ ID NO: 447055 - DNA, 25 bp, Mus musculus
caagttgacgggcaggcgactgtac

SEQ ID NO: 447056 - DNA, 25 bp, Mus musculus
ggcgctgagcccacagacctacaag

SEQ ID NO: 447057 - DNA, 25 bp, Mus musculus
tacgaattggcgactgccatgggaa

SEQ ID NO: 447058 - DNA, 25 bp, Mus musculus
ctctcccgcactgttgttggcctga

SEQ ID NO: 447059 - DNA, 25 bp, Mus musculus
tcctccggaattcgcgctgggaatc

SEQ ID NO: 447060 - DNA, 25 bp, Mus musculus
agggccgactcctccggaattcgcg

SEQ ID NO: 447061 - DNA, 25 bp, Mus musculus
ttcccacagctccacggaagggccg

SEQ ID NO: 447062 - DNA, 25 bp, Mus musculus
ggtgggaaatcagccgcgcttccca

SEQ ID NO: 447063 - DNA, 25 bp, Mus musculus
tcaattacccgggtgggaaatcagc

SEQ ID NO: 447064 - DNA, 25 bp, Mus musculus
taagctatcaattacccgggtggga

SEQ ID NO: 447065 - DNA, 25 bp, Mus musculus
cgctctctgagataattaagctatc

SEQ ID NO: 447066 - DNA, 25 bp, Mus musculus
acatttttgtaaacgctctctgaga

SEQ ID NO: 447067 - DNA, 25 bp, Mus musculus
agagctaaggggaacaacatttttg

SEQ ID NO: 447068 - DNA, 25 bp, Mus musculus
cgggagagctaaggggaacaacatt

SEQ ID NO: 447069 - DNA, 25 bp, Mus musculus
gttggcctgactccgacaaccaatc

SEQ ID NO: 447070 - DNA, 25 bp, Mus musculus
actgttgttggcctgactccgacaa

SEQ ID NO: 447071 - DNA, 25 bp, Mus musculus
aattcgcgctgggaatcagcaggcg

SEQ ID NO: 447072 - DNA, 25 bp, Mus musculus
acacttctttacaaccacctgtgcg

SEQ ID NO: 447073 - DNA, 25 bp, Mus musculus
tacggtgacggtcttgagccggcat

SEQ ID NO: 447074 - DNA, 25 bp, Mus musculus
gtcgctttcccgcagagcgggcagc

SEQ ID NO: 447075 - DNA, 25 bp, Mus musculus
gtgcgggcaccgctccagccgatgt

SEQ ID NO: 447076 - DNA, 25 bp, Mus musculus
agactccgcggctgtgccggctgaa

SEQ ID NO: 447077 - DNA, 25 bp, Mus musculus
cgcacaaagagaaggagacgagact

SEQ ID NO: 447078 - DNA, 25 bp, Mus musculus
ccggggagctcattacgcacaaaga

SEQ ID NO: 447079 - DNA, 25 bp, Mus musculus
ccaggtcatcttgtaccgcgatgcg

SEQ ID NO: 447080 - DNA, 25 bp, Mus musculus
gcagctcagtgttgtccaggtcatc

SEQ ID NO: 447081 - DNA, 25 bp, Mus musculus
tacccagggtgaagaagggcagctc

SEQ ID NO: 447082 - DNA, 25 bp, Mus musculus
tttcttgggactccgcgtgtgcggc

SEQ ID NO: 447083 - DNA, 25 bp, Mus musculus
cgtccggtatcacttaggggttctg

SEQ ID NO: 447084 - DNA, 25 bp, Mus musculus
tgggctgccctttgccaaccctgat

SEQ ID NO: 447085 - DNA, 25 bp, Mus musculus
ttgccaaccctgatggggcagcctg

SEQ ID NO: 447086 - DNA, 25 bp, Mus musculus
cggggacacacacgacacttaacta

SEQ ID NO: 447087 - DNA, 25 bp, Mus musculus
caatgtccgtctttggcggagagca

SEQ ID NO: 447088 - DNA, 25 bp, Mus musculus
ctgcgtccagctcgcataccgggga

SEQ ID NO: 447089 - DNA, 25 bp, Mus musculus
ttggaagagccctgcgtccagctcg

SEQ ID NO: 447090 - DNA, 25 bp, Mus musculus
ctcggtgggaacttggaagagccct

SEQ ID NO: 447091 - DNA, 25 bp, Mus musculus
agacgctttttattcggctcggtgg

SEQ ID NO: 447092 - DNA, 25 bp, Mus musculus
cggagagcagcggaaagacgctttt

SEQ ID NO: 447093 - DNA, 25 bp, Mus musculus
gccttacctggagtcaatgtccgtc

SEQ ID NO: 447094 - DNA, 25 bp, Mus musculus
tgcgcccggagtcgccttacctgga

SEQ ID NO: 447095 - DNA, 25 bp, Mus musculus
tctccagaacagaagaggacttgga

SEQ ID NO: 447096 - DNA, 25 bp, Mus musculus
caggaaacccagtctccagaacaga

SEQ ID NO: 447097 - DNA, 25 bp, Mus musculus
catggagtccaatctacaggaaacc

SEQ ID NO: 447098 - DNA, 25 bp, Mus musculus
cacgacacttaactaaaacccgcat

SEQ ID NO: 447099 - DNA, 25 bp, Mus musculus
acccgcatttaacccatggagtcca

SEQ ID NO: 447100 - DNA, 25 bp, Mus musculus
tttggcataagaactcagattaatc

SEQ ID NO: 447101 - DNA, 25 bp, Mus musculus
ccgcgacgcgagtctaggcatgtat

SEQ ID NO: 447102 - DNA, 25 bp, Mus musculus
cgacgcgagtctaggcatgtatttc

SEQ ID NO: 447103 - DNA, 25 bp, Mus musculus
cgcgagtctaggcatgtatttcttt

SEQ ID NO: 447104 - DNA, 25 bp, Mus musculus
agtctaggcatgtatttctttctca

SEQ ID NO: 447105 - DNA, 25 bp, Mus musculus
ctcatgtttggcataagaactcaga

SEQ ID NO: 447106 - DNA, 25 bp, Mus musculus
agattaatcaaattccctaaagatg

SEQ ID NO: 447107 - DNA, 25 bp, Mus musculus
tccctaaagatgaagaaggatgatg

SEQ ID NO: 447108 - DNA, 25 bp, Mus musculus
gatgaagaaggatgatggatacatg

SEQ ID NO: 447109 - DNA, 25 bp, Mus musculus
tggatacatgggacgagtggaccta

SEQ ID NO: 447110 - DNA, 25 bp, Mus musculus
acatgggacgagtggacctacagtg

SEQ ID NO: 447111 - DNA, 25 bp, Mus musculus
ggaagagcaggaagcttcctgaaga

SEQ ID NO: 447112 - DNA, 25 bp, Mus musculus
gcttcctgaagactgtagcagaaac

SEQ ID NO: 447113 - DNA, 25 bp, Mus musculus
gtatttctttctcatgtttggcata

SEQ ID NO: 447114 - DNA, 25 bp, Mus musculus
acccagctcttgttctcagtcaagc

SEQ ID NO: 447115 - DNA, 25 bp, Mus musculus
tccagcgtgcaacactaggagaaaa

SEQ ID NO: 447116 - DNA, 25 bp, Mus musculus
agggccacacctgcaaccgctgagg

SEQ ID NO: 447117 - DNA, 25 bp, Mus musculus
agtgagtcgccatcaacgggaaccc

SEQ ID NO: 447118 - DNA, 25 bp, Mus musculus
aaagaagcggtagccatgtttcgtg

SEQ ID NO: 447119 - DNA, 25 bp, Mus musculus
agggcagaacctgcgcactccagcg

SEQ ID NO: 447120 - DNA, 25 bp, Mus musculus
cgccatcttaactcagggcagaacc

SEQ ID NO: 447121 - DNA, 25 bp, Mus musculus
caagaagagctttgcctggacgcca

SEQ ID NO: 447122 - DNA, 25 bp, Mus musculus
tgcaacgacccgaaaccgggcaaga

SEQ ID NO: 447123 - DNA, 25 bp, Mus musculus
cggcgcttcttcctacggaaacaag

SEQ ID NO: 447124 - DNA, 25 bp, Mus musculus
aagcggcgccgctggaattcaaacc

SEQ ID NO: 447125 - DNA, 25 bp, Mus musculus
cccgagtccatcgtgaacgcagagt

SEQ ID NO: 447126 - DNA, 25 bp, Mus musculus
aggtaccacgaatcccaaagccagg

SEQ ID NO: 447127 - DNA, 25 bp, Mus musculus
cgagcgccatatttgttgagggtaa

SEQ ID NO: 447128 - DNA, 25 bp, Mus musculus
caaatcatctgttccactgggctgc

SEQ ID NO: 447129 - DNA, 25 bp, Mus musculus
ctgccgtccgaccaaggaaagcgtt

SEQ ID NO: 447130 - DNA, 25 bp, Mus musculus
aagcctgagcggtggtgactacaga

SEQ ID NO: 447131 - DNA, 25 bp, Mus musculus
ctggccaactgtgctcgcaagggtg

SEQ ID NO: 447132 - DNA, 25 bp, Mus musculus
accggtgacattccctgccgaggct

SEQ ID NO: 447133 - DNA, 25 bp, Mus musculus
cattcatccagtcgatcggtcagtc

SEQ ID NO: 447134 - DNA, 25 bp, Mus musculus
tcgatcggtcagtcatcttctcctc

SEQ ID NO: 447135 - DNA, 25 bp, Mus musculus
ccaaggaaagcgttgccgccgctgc

SEQ ID NO: 447136 - DNA, 25 bp, Mus musculus
cggaagccgcgttggcccacgtgat

SEQ ID NO: 447137 - DNA, 25 bp, Mus musculus
cccggcctctttgtaacggcgcaga

SEQ ID NO: 447138 - DNA, 25 bp, Mus musculus
acggcgcagaccaatcagaggactc

SEQ ID NO: 447139 - DNA, 25 bp, Mus musculus
ggctccggctttgtctacccacaga

SEQ ID NO: 447140 - DNA, 25 bp, Mus musculus
gcgcggcagattccaggccaaatca

SEQ ID NO: 447141 - DNA, 25 bp, Mus musculus
tccaacgccgccgagcagacaaagg

SEQ ID NO: 447142 - DNA, 25 bp, Mus musculus
tccctccagtcgatggctagtgatc

SEQ ID NO: 447143 - DNA, 25 bp, Mus musculus
ccttctgcggctcacaaatgcagga

SEQ ID NO: 447144 - DNA, 25 bp, Mus musculus
tgcaggtggcgccttggctaaaacc

SEQ ID NO: 447145 - DNA, 25 bp, Mus musculus
tcccacgacggtaagctccgggtca

SEQ ID NO: 447146 - DNA, 25 bp, Mus musculus
tgcaggaaggctgtgtgtctcctcc

SEQ ID NO: 447147 - DNA, 25 bp, Mus musculus
ctagtgatcccggtgcagctctttg

SEQ ID NO: 447148 - DNA, 25 bp, Mus musculus
ctcctcggctcttagcaaagggctg

SEQ ID NO: 447149 - DNA, 25 bp, Mus musculus
gcaaagggctgaccagctcctgcca

SEQ ID NO: 447150 - DNA, 25 bp, Mus musculus
ccgcaaagttctcacgacccggagg

SEQ ID NO: 447151 - DNA, 25 bp, Mus musculus
gaggcaaacgtccacgcgactgaga

SEQ ID NO: 447152 - DNA, 25 bp, Mus musculus
ctcttgcgccgcttacattaacacg

SEQ ID NO: 447153 - DNA, 25 bp, Mus musculus
acgcggtttcacactcgctagcaaa

SEQ ID NO: 447154 - DNA, 25 bp, Mus musculus
gccgcaccaacgtggggcactgacg

SEQ ID NO: 447155 - DNA, 25 bp, Mus musculus
aacccacgtagacagccagcggcga

SEQ ID NO: 447156 - DNA, 25 bp, Mus musculus
aggcgcgcatggaagtcccgccacg

SEQ ID NO: 447157 - DNA, 25 bp, Mus musculus
aggagagccagacgctcgcctccag

SEQ ID NO: 447158 - DNA, 25 bp, Mus musculus
agccgggtcagctcctcagggtccg

SEQ ID NO: 447159 - DNA, 25 bp, Mus musculus
tccaggcgcccggagccgttcgtgt

SEQ ID NO: 447160 - DNA, 25 bp, Mus musculus
tgatggcgccatcgcggtccgtgtc

SEQ ID NO: 447161 - DNA, 25 bp, Mus musculus
cacgcgcgaactccgggaaggtgat

SEQ ID NO: 447162 - DNA, 25 bp, Mus musculus
cctcgtctccgaggcgcgcatggaa

SEQ ID NO: 447163 - DNA, 25 bp, Mus musculus
cacctgggaatgagttgggcctcgt

SEQ ID NO: 447164 - DNA, 25 bp, Mus musculus
cgcctgaccacgcacctgggaatga

SEQ ID NO: 447165 - DNA, 25 bp, Mus musculus
tttccgtttgcgaagcgcacgcctc

SEQ ID NO: 447166 - DNA, 25 bp, Mus musculus
ttgggttttccgtttgcgaagcgca

SEQ ID NO: 447167 - DNA, 25 bp, Mus musculus
aggcgactcacagattgggttttcc

SEQ ID NO: 447168 - DNA, 25 bp, Mus musculus
agaaatcaccgccagttgtcgaaca

SEQ ID NO: 447169 - DNA, 25 bp, Mus musculus
gttgtcgaacagaaaaggcgactca

SEQ ID NO: 447170 - DNA, 25 bp, Mus musculus
ctgtattgagaacgtgtgaatgtcc

SEQ ID NO: 447171 - DNA, 25 bp, Mus musculus
ccggagctgcgactgtattgagaac

SEQ ID NO: 447172 - DNA, 25 bp, Mus musculus
gagggacgggttctcctcgccactc

SEQ ID NO: 447173 - DNA, 25 bp, Mus musculus
cctcccgcgtgctgctgtgtatgtt

SEQ ID NO: 447174 - DNA, 25 bp, Mus musculus
ctgctgtgtatgttcgcttcttgtc

SEQ ID NO: 447175 - DNA, 25 bp, Mus musculus
cgcttcttgtcactgtgcgccgaga

SEQ ID NO: 447176 - DNA, 25 bp, Mus musculus
ggactatgaagatgattcactttcg

SEQ ID NO: 447177 - DNA, 25 bp, Mus musculus
tttcggagctccagtatcaaatcgc

SEQ ID NO: 447178 - DNA, 25 bp, Mus musculus
tatcaaatcgctcaaccaggagatg

SEQ ID NO: 447179 - DNA, 25 bp, Mus musculus
accaggagatgaaatgcaccattcg

SEQ ID NO: 447180 - DNA, 25 bp, Mus musculus
gcaccattcgactgctggacgactc

SEQ ID NO: 447181 - DNA, 25 bp, Mus musculus
aacgtgtgaatgtccgcgtggacca

SEQ ID NO: 447182 - DNA, 25 bp, Mus musculus
gaggtctcctgccatatccaggtgc

SEQ ID NO: 447183 - DNA, 25 bp, Mus musculus
ctgctggacgactcggaggtctcct

SEQ ID NO: 447184 - DNA, 25 bp, Mus musculus
ccaacctgcaaaacggaggcgcaca

SEQ ID NO: 447185 - DNA, 25 bp, Mus musculus
ctggataaccggttcctgctcgcgc

SEQ ID NO: 447186 - DNA, 25 bp, Mus musculus
cctgcattttttctaggagctctgt

SEQ ID NO: 447187 - DNA, 25 bp, Mus musculus
tctgtgcgtgtacctccaggtttca

SEQ ID NO: 447188 - DNA, 25 bp, Mus musculus
ttgttgcaaagtcccacatgctttt

SEQ ID NO: 447189 - DNA, 25 bp, Mus musculus
atgcttttcctctcaagacctggcc

SEQ ID NO: 447190 - DNA, 25 bp, Mus musculus
tggcagctgcactctctcggagcaa

SEQ ID NO: 447191 - DNA, 25 bp, Mus musculus
tggagaaatcctgcatagtcacttg

SEQ ID NO: 447192 - DNA, 25 bp, Mus musculus
gtggcttgtcttgctcggttgttta

SEQ ID NO: 447193 - DNA, 25 bp, Mus musculus
gcctgatgaagattgatcacctttc

SEQ ID NO: 447194 - DNA, 25 bp, Mus musculus
ctctgggtctaggttggcaaattcc

SEQ ID NO: 447195 - DNA, 25 bp, Mus musculus
tggcaaattccgctcagaacgagtt

SEQ ID NO: 447196 - DNA, 25 bp, Mus musculus
agtggcgtcaagctgctggataacc

SEQ ID NO: 447197 - DNA, 25 bp, Mus musculus
gcagtcgcggcttttcaccatctac

SEQ ID NO: 447198 - DNA, 25 bp, Mus musculus
ctccacgggcgtctttccggtatct

SEQ ID NO: 447199 - DNA, 25 bp, Mus musculus
tgcgcatccgggtgctttgtgaccc

SEQ ID NO: 447200 - DNA, 25 bp, Mus musculus
cctgactcggaggacagacgaagct

SEQ ID NO: 447201 - DNA, 25 bp, Mus musculus
ggcttcctgaccgacttgttcctca

SEQ ID NO: 447202 - DNA, 25 bp, Mus musculus
tgcctgttatcacccaggcgggaaa

SEQ ID NO: 447203 - DNA, 25 bp, Mus musculus
gcctatcggctcagaatagcgtata

SEQ ID NO: 447204 - DNA, 25 bp, Mus musculus
aattcggtgaatcgccacttcgggc

SEQ ID NO: 447205 - DNA, 25 bp, Mus musculus
ctggtgagcgtgattcgaattcggt

SEQ ID NO: 447206 - DNA, 25 bp, Mus musculus
ttctccagcgacttcacgttgcggc

SEQ ID NO: 447207 - DNA, 25 bp, Mus musculus
gagcatcgtactgacccttctccag

SEQ ID NO: 447208 - DNA, 25 bp, Mus musculus
atacggttggtatctcctcatcgcc

SEQ ID NO: 447209 - DNA, 25 bp, Mus musculus
gcgccgggcgcttataaagcacgtg

SEQ ID NO: 447210 - DNA, 25 bp, Mus musculus
tttaaacaagttcgcctatcggctc

SEQ ID NO: 447211 - DNA, 25 bp, Mus musculus
agcgacccgtaagtggaggcccact

SEQ ID NO: 447212 - DNA, 25 bp, Mus musculus
ggagacccgagtggccctacggctc

SEQ ID NO: 447213 - DNA, 25 bp, Mus musculus
agccatgcccacgatggccacggga

SEQ ID NO: 447214 - DNA, 25 bp, Mus musculus
ttggcgcgctacacgccggagcctt

SEQ ID NO: 447215 - DNA, 25 bp, Mus musculus
cgtcctgctttccactgcggagcaa

SEQ ID NO: 447216 - DNA, 25 bp, Mus musculus
atggccacgggatggcaatgctcct

SEQ ID NO: 447217 - DNA, 25 bp, Mus musculus
cggagcgtttcgctagagcgcctca

SEQ ID NO: 447218 - DNA, 25 bp, Mus musculus
tggtgtctccgccaactgggtccct

SEQ ID NO: 447219 - DNA, 25 bp, Mus musculus
ggagtctcccaaacctccgagtatc

SEQ ID NO: 447220 - DNA, 25 bp, Mus musculus
tcctttgccatcgtctccgcggaga

SEQ ID NO: 447221 - DNA, 25 bp, Mus musculus
tttgggccattttctcggctcgcgc

SEQ ID NO: 447222 - DNA, 25 bp, Mus musculus
cacttctgcgtcctatttcgggaga

SEQ ID NO: 447223 - DNA, 25 bp, Mus musculus
cctgactttaagttccacttctgcg

SEQ ID NO: 447224 - DNA, 25 bp, Mus musculus
acagcttcctttccgagactcctga

SEQ ID NO: 447225 - DNA, 25 bp, Mus musculus
aatgctcctgggaggagcgagtccc

SEQ ID NO: 447226 - DNA, 25 bp, Mus musculus
caagaggcggaagtctcggcttcaa

SEQ ID NO: 447227 - DNA, 25 bp, Mus musculus
tcatccctttcattcgggtggcgtc

SEQ ID NO: 447228 - DNA, 25 bp, Mus musculus
gaggtagcaggtagcccgaccctca

SEQ ID NO: 447229 - DNA, 25 bp, Mus musculus
ctccgagcctcccttgggtcgggat

SEQ ID NO: 447230 - DNA, 25 bp, Mus musculus
aggtgctgttgctccggactgccac

SEQ ID NO: 447231 - DNA, 25 bp, Mus musculus
gctccgcggtgcaaagcagtcagct

SEQ ID NO: 447232 - DNA, 25 bp, Mus musculus
cagcggcgcaggtaacctcttcttg

SEQ ID NO: 447233 - DNA, 25 bp, Mus musculus
tgcggaacaagtcttccaaagattc

SEQ ID NO: 447234 - DNA, 25 bp, Mus musculus
acagctgtcacccagtgcggaacaa

SEQ ID NO: 447235 - DNA, 25 bp, Mus musculus
cgcgtgcgcagcgaacagctgtcac

SEQ ID NO: 447236 - DNA, 25 bp, Mus musculus
tgcgccacacgcaggcagaggcagc

SEQ ID NO: 447237 - DNA, 25 bp, Mus musculus
agcagtttagagacccacgtgaccc

SEQ ID NO: 447238 - DNA, 25 bp, Mus musculus
tcggcttcaagtcgggcacctttaa

SEQ ID NO: 447239 - DNA, 25 bp, Mus musculus
gtcgggcacctttaagcagtttaga

SEQ ID NO: 447240 - DNA, 25 bp, Mus musculus
acgcgacaactccagcaggttttta

SEQ ID NO: 447241 - DNA, 25 bp, Mus musculus
ccgaagagtgtagagcccgacagca

SEQ ID NO: 447242 - DNA, 25 bp, Mus musculus
tagagcccgacagcacgcgacaact

SEQ ID NO: 447243 - DNA, 25 bp, Mus musculus
ctccagcaggtttttaactcagggt

SEQ ID NO: 447244 - DNA, 25 bp, Mus musculus
cccatgtcagaagagtgcacagcga

SEQ ID NO: 447245 - DNA, 25 bp, Mus musculus
gctgacgtaaaagccgccgcgcttc

SEQ ID NO: 447246 - DNA, 25 bp, Mus musculus
agcacgctgacgtaaaagccgccgc

SEQ ID NO: 447247 - DNA, 25 bp, Mus musculus
tgccggaaagcagcacgctgacgta

SEQ ID NO: 447248 - DNA, 25 bp, Mus musculus
cagaagagtgcacagcgagccgagc

SEQ ID NO: 447249 - DNA, 25 bp, Mus musculus
cgagccgagccttcactttgaaatg

SEQ ID NO: 447250 - DNA, 25 bp, Mus musculus
cgagccttcactttgaaatgctgta

SEQ ID NO: 447251 - DNA, 25 bp, Mus musculus
ctttgaaatgctgtaaaatgctgcc

SEQ ID NO: 447252 - DNA, 25 bp, Mus musculus
atgctgtaaaatgctgccggaaagc

SEQ ID NO: 447253 - DNA, 25 bp, Mus musculus
ggcaggagcggaaaactcggtactc

SEQ ID NO: 447254 - DNA, 25 bp, Mus musculus
gtcctgattgcaccggccagggcca

SEQ ID NO: 447255 - DNA, 25 bp, Mus musculus
gcggaccctcgagtgtctcctattt

SEQ ID NO: 447256 - DNA, 25 bp, Mus musculus
ccgcacgagttcagagcagagaatc

SEQ ID NO: 447257 - DNA, 25 bp, Mus musculus
aatagccctccagaaacggccgctg

SEQ ID NO: 447258 - DNA, 25 bp, Mus musculus
gacggcttacctgctcacgtcggct

SEQ ID NO: 447259 - DNA, 25 bp, Mus musculus
ttggccacaaatagcaactcggctg

SEQ ID NO: 447260 - DNA, 25 bp, Mus musculus
gagggagctcaagaaagtaattttc

SEQ ID NO: 447261 - DNA, 25 bp, Mus musculus
ataacccgatactgaggcccgctgg

SEQ ID NO: 447262 - DNA, 25 bp, Mus musculus
gccaggacagagtggccagcccaca

SEQ ID NO: 447263 - DNA, 25 bp, Mus musculus
agcccacaccttgaacctggcggga

SEQ ID NO: 447264 - DNA, 25 bp, Mus musculus
ccttgactgggtgatttctaaaatc

SEQ ID NO: 447265 - DNA, 25 bp, Mus musculus
aaatcctcataactgctggagatcc

SEQ ID NO: 447266 - DNA, 25 bp, Mus musculus
ctggagatcccacggaatcgctgtg

SEQ ID NO: 447267 - DNA, 25 bp, Mus musculus
gaagcgcgagcgagataacccgata

SEQ ID NO: 447268 - DNA, 25 bp, Mus musculus
gacgccggggcgagtgcccgcaggt

SEQ ID NO: 447269 - DNA, 25 bp, Mus musculus
gcctcagccggcagcgctcgctcgg

SEQ ID NO: 447270 - DNA, 25 bp, Mus musculus
ggctgcagcgcttcggcttctttaa

SEQ ID NO: 447271 - DNA, 25 bp, Mus musculus
gctgcagcgcttcggcttctttaaa

SEQ ID NO: 447272 - DNA, 25 bp, Mus musculus
gcagcgcttcggcttctttaaaagt

SEQ ID NO: 447273 - DNA, 25 bp, Mus musculus
agcgcttcggcttctttaaaagtgg

SEQ ID NO: 447274 - DNA, 25 bp, Mus musculus
cggcttctttaaaagtggtatctgc

SEQ ID NO: 447275 - DNA, 25 bp, Mus musculus
cttctttaaaagtggtatctgcgtg

SEQ ID NO: 447276 - DNA, 25 bp, Mus musculus
ctttaaaagtggtatctgcgtgtgc

SEQ ID NO: 447277 - DNA, 25 bp, Mus musculus
taaaagtggtatctgcgtgtgcgag

SEQ ID NO: 447278 - DNA, 25 bp, Mus musculus
agcgcccgggatgctggggctcgca

SEQ ID NO: 447279 - DNA, 25 bp, Mus musculus
tgctggggctcgcactccgctggct

SEQ ID NO: 447280 - DNA, 25 bp, Mus musculus
ctcgctcggcgtcggtgggctgcag

SEQ ID NO: 447281 - DNA, 25 bp, Mus musculus
ttaaaagtggtatctgcgtgtgcga

SEQ ID NO: 447282 - DNA, 25 bp, Mus musculus
agcccagtactgagctccggagtcc

SEQ ID NO: 447283 - DNA, 25 bp, Mus musculus
ctagcctgctaaaggccggcagtta

SEQ ID NO: 447284 - DNA, 25 bp, Mus musculus
ggattctcccgcactagcctgctaa

SEQ ID NO: 447285 - DNA, 25 bp, Mus musculus
ttctgatagagctactccctgcgca

SEQ ID NO: 447286 - DNA, 25 bp, Mus musculus
tggcagctcattcggctctactttc

SEQ ID NO: 447287 - DNA, 25 bp, Mus musculus
accctgaggactttgctcggtcacg

SEQ ID NO: 447288 - DNA, 25 bp, Mus musculus
tacagctaagcttgaaccctgagga

SEQ ID NO: 447289 - DNA, 25 bp, Mus musculus
cgcctctggactcggctacagctaa

SEQ ID NO: 447290 - DNA, 25 bp, Mus musculus
actgcacatcctcagacaggagatg

SEQ ID NO: 447291 - DNA, 25 bp, Mus musculus
agcgccctggagaggttagagacca

SEQ ID NO: 447292 - DNA, 25 bp, Mus musculus
catcgagctgaagctggggcgcaaa

SEQ ID NO: 447293 - DNA, 25 bp, Mus musculus
gccagacctcagagacatcgagctg

SEQ ID NO: 447294 - DNA, 25 bp, Mus musculus
gcgccctctgcctttactgtcagtg

SEQ ID NO: 447295 - DNA, 25 bp, Mus musculus
ccctcgcaaagagtcatggaagaca

SEQ ID NO: 447296 - DNA, 25 bp, Mus musculus
agcagggctcagacacaaagcgcct

SEQ ID NO: 447297 - DNA, 25 bp, Mus musculus
taaatagcagcccagagagcaccat

SEQ ID NO: 447298 - DNA, 25 bp, Mus musculus
tccctggagaataaatagcagccca

SEQ ID NO: 447299 - DNA, 25 bp, Mus musculus
cccgagtccctggagaataaatagc

SEQ ID NO: 447300 - DNA, 25 bp, Mus musculus
tgacccgggaaggaactgcccagtc

SEQ ID NO: 447301 - DNA, 25 bp, Mus musculus
cacgaagcagggctcagacacaaag

SEQ ID NO: 447302 - DNA, 25 bp, Mus musculus
cgggcccgcgcacagcaacaggcgc

SEQ ID NO: 447303 - DNA, 25 bp, Mus musculus
ctcggctcctctccgctgtagtcgc

SEQ ID NO: 447304 - DNA, 25 bp, Mus musculus
ccgtgtggcgcgaacgctcacgcgt

SEQ ID NO: 447305 - DNA, 25 bp, Mus musculus
aacgctcacgcgtggccggagaacc

SEQ ID NO: 447306 - DNA, 25 bp, Mus musculus
agccgccgccgagatggaacgaccg

SEQ ID NO: 447307 - DNA, 25 bp, Mus musculus
ccgccgagatggaacgaccggcgca

SEQ ID NO: 447308 - DNA, 25 bp, Mus musculus
gcctgcgtatcctcggcgtcctccc

SEQ ID NO: 447309 - DNA, 25 bp, Mus musculus
caatgacccgggaaggaactgccca

SEQ ID NO: 447310 - DNA, 25 bp, Mus musculus
gccaacactgcagcaggatccggga

SEQ ID NO: 447311 - DNA, 25 bp, Mus musculus
agattcaccggttccaccctctgga

SEQ ID NO: 447312 - DNA, 25 bp, Mus musculus
aaacgcgcgttccttttgcaccagc

SEQ ID NO: 447313 - DNA, 25 bp, Mus musculus
tcgagctctctccaaatcagactta

SEQ ID NO: 447314 - DNA, 25 bp, Mus musculus
ctcttttctgtcctgggctctattc

SEQ ID NO: 447315 - DNA, 25 bp, Mus musculus
cttggctgcaaactcctcttttctg

SEQ ID NO: 447316 - DNA, 25 bp, Mus musculus
caaacgatcgatcccgcttggctgc

SEQ ID NO: 447317 - DNA, 25 bp, Mus musculus
ctggccacagcccacggaaaggatc

SEQ ID NO: 447318 - DNA, 25 bp, Mus musculus
ggaaaagcctttgctgcgctcctgc

SEQ ID NO: 447319 - DNA, 25 bp, Mus musculus
agtggcgatcgcaggcgaaactttg

SEQ ID NO: 447320 - DNA, 25 bp, Mus musculus
ggagaatgtgtcaccgcgctggtaa

SEQ ID NO: 447321 - DNA, 25 bp, Mus musculus
tttaaccctcttgcggttcgcgcgc

SEQ ID NO: 447322 - DNA, 25 bp, Mus musculus
ttcccggggtgaaatccaatctaca

SEQ ID NO: 447323 - DNA, 25 bp, Mus musculus
cgaaactttgctgcgagccgaccac

SEQ ID NO: 447324 - DNA, 25 bp, Mus musculus
cggggctccatgtcgccctagcttg

SEQ ID NO: 447325 - DNA, 25 bp, Mus musculus
gaccggccagcaccccctttcgcgc

SEQ ID NO: 447326 - DNA, 25 bp, Mus musculus
tggggccgccgagcgtttccaggcc

SEQ ID NO: 447327 - DNA, 25 bp, Mus musculus
ggggctccatgtcgccctagcttgg

SEQ ID NO: 447328 - DNA, 25 bp, Mus musculus
ccctggaggcgaccggccagcaccc

SEQ ID NO: 447329 - DNA, 25 bp, Mus musculus
agaaaagtgagcgcccggggctcca

SEQ ID NO: 447330 - DNA, 25 bp, Mus musculus
atggagaaagaaaagtgagcgcccg

SEQ ID NO: 447331 - DNA, 25 bp, Mus musculus
ggctgccccagacaatggagaaaga

SEQ ID NO: 447332 - DNA, 25 bp, Mus musculus
caaaggctgccccagacaatggaga

SEQ ID NO: 447333 - DNA, 25 bp, Mus musculus
gaaatggaggaatcaaaggctgccc

SEQ ID NO: 447334 - DNA, 25 bp, Mus musculus
ggaaatggaggaatcaaaggctgcc

SEQ ID NO: 447335 - DNA, 25 bp, Mus musculus
cgcgcgggcactctctcccacacac

SEQ ID NO: 447336 - DNA, 25 bp, Mus musculus
ctttcgcgcgggcactctctcccac

SEQ ID NO: 447337 - DNA, 25 bp, Mus musculus
tccatgtcgccctagcttggggccg

SEQ ID NO: 447338 - DNA, 25 bp, Mus musculus
ctggaagttcgagcctctgctcggg

SEQ ID NO: 447339 - DNA, 25 bp, Mus musculus
ctctgacgaagacggcagcgttgcg

SEQ ID NO: 447340 - DNA, 25 bp, Mus musculus
gcgctctgacgaagacggcagcgtt

SEQ ID NO: 447341 - DNA, 25 bp, Mus musculus
cagcagcgggcgctctgacgaagac

SEQ ID NO: 447342 - DNA, 25 bp, Mus musculus
tcatcccgcgcctgtccgccagcag

SEQ ID NO: 447343 - DNA, 25 bp, Mus musculus
aggagctggacctgcggcgcgtcac

SEQ ID NO: 447344 - DNA, 25 bp, Mus musculus
gcagcggctggatccgcggggctac

SEQ ID NO: 447345 - DNA, 25 bp, Mus musculus
cggctggaagttcgagcctctgctc

SEQ ID NO: 447346 - DNA, 25 bp, Mus musculus
gctgcggctggaagttcgagcctct

SEQ ID NO: 447347 - DNA, 25 bp, Mus musculus
ttcgttgttcccaaggctgcggctg

SEQ ID NO: 447348 - DNA, 25 bp, Mus musculus
cccttcgttgttcccaaggctgcgg

SEQ ID NO: 447349 - DNA, 25 bp, Mus musculus
cggcccttcgttgttcccaaggctg

SEQ ID NO: 447350 - DNA, 25 bp, Mus musculus
cgccgcgtaagtgccgcaggccacc

SEQ ID NO: 447351 - DNA, 25 bp, Mus musculus
gtaagtgccgcaggccacctcctcc

SEQ ID NO: 447352 - DNA, 25 bp, Mus musculus
ttccctccacgtggccggcgctgct

SEQ ID NO: 447353 - DNA, 25 bp, Mus musculus
cgttgtagacggagaccgagagccc

SEQ ID NO: 447354 - DNA, 25 bp, Mus musculus
gtttcgttgtagacggagaccgaga

SEQ ID NO: 447355 - DNA, 25 bp, Mus musculus
cgctggtttcgttgtagacggagac

SEQ ID NO: 447356 - DNA, 25 bp, Mus musculus
cctcgctggtttcgttgtagacgga

SEQ ID NO: 447357 - DNA, 25 bp, Mus musculus
cgggcctcgctggtttcgttgtaga

SEQ ID NO: 447358 - DNA, 25 bp, Mus musculus
tccttgcggtttccctccacgtggc

SEQ ID NO: 447359 - DNA, 25 bp, Mus musculus
gctgtggttccttgcggtttccctc

SEQ ID NO: 447360 - DNA, 25 bp, Mus musculus
ctggctgtggttccttgcggtttcc

SEQ ID NO: 447361 - DNA, 25 bp, Mus musculus
agcggcaggcagtacccggcccaga

SEQ ID NO: 447362 - DNA, 25 bp, Mus musculus
agccgctcttcgcttccgcccggcg

SEQ ID NO: 447363 - DNA, 25 bp, Mus musculus
ggcgcgggaagccgctcttcgcttc

SEQ ID NO: 447364 - DNA, 25 bp, Mus musculus
cctcgccgtgctgggattggcctgg

SEQ ID NO: 447365 - DNA, 25 bp, Mus musculus
tgggattggcctggtcgcgcagccc

SEQ ID NO: 447366 - DNA, 25 bp, Mus musculus
tgcgcccggcctaccttcgtctaac

SEQ ID NO: 447367 - DNA, 25 bp, Mus musculus
ccagcgacctcgaaatgaatgaaac

SEQ ID NO: 447368 - DNA, 25 bp, Mus musculus
ttcgtctaacctacctgtgcctccc

SEQ ID NO: 447369 - DNA, 25 bp, Mus musculus
gtcaatggaggtgcacggttttctc

SEQ ID NO: 447370 - DNA, 25 bp, Mus musculus
gaggtgcacggttttctcccagagg

SEQ ID NO: 447371 - DNA, 25 bp, Mus musculus
ttctcccagagggtcctctgcagct

SEQ ID NO: 447372 - DNA, 25 bp, Mus musculus
tccgcaccagcgacctcgaaatgaa

SEQ ID NO: 447373 - DNA, 25 bp, Mus musculus
ctcgaaatgaatgaaacgctcggtc

SEQ ID NO: 447374 - DNA, 25 bp, Mus musculus
atgaatgaaacgctcggtcacgccg

SEQ ID NO: 447375 - DNA, 25 bp, Mus musculus
tgaaacgctcggtcacgccgacagc

SEQ ID NO: 447376 - DNA, 25 bp, Mus musculus
agaactcggcggatttctctcccca

SEQ ID NO: 447377 - DNA, 25 bp, Mus musculus
cgctccgccgctttccactcggctc

SEQ ID NO: 447378 - DNA, 25 bp, Mus musculus
aaagacctgaaagcgctcgcagccc

SEQ ID NO: 447379 - DNA, 25 bp, Mus musculus
agccgccgagggccgaaagacctga

SEQ ID NO: 447380 - DNA, 25 bp, Mus musculus
ccatctcaatctcgagaccctgggg

SEQ ID NO: 447381 - DNA, 25 bp, Mus musculus
cgctggcggcccgtgaggtaaacct

SEQ ID NO: 447382 - DNA, 25 bp, Mus musculus
tgaggtaaacctcgcgcggcggatt

SEQ ID NO: 447383 - DNA, 25 bp, Mus musculus
gcggcggattctcctgcccaaagaa

SEQ ID NO: 447384 - DNA, 25 bp, Mus musculus
ctgcccaaagaactactcaggaggc

SEQ ID NO: 447385 - DNA, 25 bp, Mus musculus
acaggagctcgagcccatctcaatc

SEQ ID NO: 447386 - DNA, 25 bp, Mus musculus
gggaagtcaagcaccgcagccctcc

SEQ ID NO: 447387 - DNA, 25 bp, Mus musculus
cggactcccacacacaaggctggga

SEQ ID NO: 447388 - DNA, 25 bp, Mus musculus
cacaaggctgggaacctcgccaccc

SEQ ID NO: 447389 - DNA, 25 bp, Mus musculus
agaaacaagcagaggccgccccacg

SEQ ID NO: 447390 - DNA, 25 bp, Mus musculus
gtggcctggccaaaactgtcacctg

SEQ ID NO: 447391 - DNA, 25 bp, Mus musculus
aaactgtcacctgtcggagggcttg

SEQ ID NO: 447392 - DNA, 25 bp, Mus musculus
tcacctgtcggagggcttggtccag

SEQ ID NO: 447393 - DNA, 25 bp, Mus musculus
ctactcaggaggcaacaggagctcg

SEQ ID NO: 447394 - DNA, 25 bp, Mus musculus
tcccggggtgactagacagccgtac

SEQ ID NO: 447395 - DNA, 25 bp, Mus musculus
acagggaactcagaaccgactcttt

SEQ ID NO: 447396 - DNA, 25 bp, Mus musculus
ggtcacttcggtagcctagagaggc

SEQ ID NO: 447397 - DNA, 25 bp, Mus musculus
gctgaaatcaacaggtcgggcgccc

SEQ ID NO: 447398 - DNA, 25 bp, Mus musculus
ccgactcttttctggctctgggttc

SEQ ID NO: 447399 - DNA, 25 bp, Mus musculus
acgctcctcggcgtgaaggacagcc

SEQ ID NO: 447400 - DNA, 25 bp, Mus musculus
cccatagggtccaaggaggctcagg

SEQ ID NO: 447401 - DNA, 25 bp, Mus musculus
agaacggttccgcaaaagcccatag

SEQ ID NO: 447402 - DNA, 25 bp, Mus musculus
cacagaagtcgagtccagaacggtt

SEQ ID NO: 447403 - DNA, 25 bp, Mus musculus
gaacttccacagaaagcgacacaga

SEQ ID NO: 447404 - DNA, 25 bp, Mus musculus
gacacctcgcggaacttccacagaa

SEQ ID NO: 447405 - DNA, 25 bp, Mus musculus
cggcgattctggacaagggaccttt

SEQ ID NO: 447406 - DNA, 25 bp, Mus musculus
cgcgaggacccggtaggtcacttcg

SEQ ID NO: 447407 - DNA, 25 bp, Mus musculus
gctctgggttcagcccagcacgggt

SEQ ID NO: 447408 - DNA, 25 bp, Mus musculus
tgcgcttctcggagacccttaacct

SEQ ID NO: 447409 - DNA, 25 bp, Mus musculus
gccacagcagctttccggaatacga

SEQ ID NO: 447410 - DNA, 25 bp, Mus musculus
cacagccctcggacaagtccagaga

SEQ ID NO: 447411 - DNA, 25 bp, Mus musculus
cagagaacaatgcatccagcccggc

SEQ ID NO: 447412 - DNA, 25 bp, Mus musculus
tagtttctgaagcacagctcgcgca

SEQ ID NO: 447413 - DNA, 25 bp, Mus musculus
ccggagctctgcaaaactacaaatc

SEQ ID NO: 447414 - DNA, 25 bp, Mus musculus
ctcgccagcttttgccggaagggat

SEQ ID NO: 447415 - DNA, 25 bp, Mus musculus
tacgagcttcccgagttgcacacgc

SEQ ID NO: 447416 - DNA, 25 bp, Mus musculus
cacacgcgcgtgttccatgtgggct

SEQ ID NO: 447417 - DNA, 25 bp, Mus musculus
ggcccaggatttgtcgctgagcgaa

SEQ ID NO: 447418 - DNA, 25 bp, Mus musculus
ctgagcgaaccgcaggcagccgagc

SEQ ID NO: 447419 - DNA, 25 bp, Mus musculus
agccgaccgacggaggggcatccaa

SEQ ID NO: 447420 - DNA, 25 bp, Mus musculus
gatgctgcagtagccagcgatctgg

SEQ ID NO: 447421 - DNA, 25 bp, Mus musculus
ccaacgacggctttgaggatgctgc

SEQ ID NO: 447422 - DNA, 25 bp, Mus musculus
tccaggtttgaaatcgcgagtcatg

SEQ ID NO: 447423 - DNA, 25 bp, Mus musculus
ccaattgcaagcagatgccgtggga

SEQ ID NO: 447424 - DNA, 25 bp, Mus musculus
cttggcgaagatgaggtctccaggt

SEQ ID NO: 447425 - DNA, 25 bp, Mus musculus
tgaggtctccaggtttgaaatcgcg

SEQ ID NO: 447426 - DNA, 25 bp, Mus musculus
agaggcacgcgggagctgtccctct

SEQ ID NO: 447427 - DNA, 25 bp, Mus musculus
ccctggttgcgaccaattgcaagca

SEQ ID NO: 447428 - DNA, 25 bp, Mus musculus
gtaccaagtgctcgcgcaggcacgg

SEQ ID NO: 447429 - DNA, 25 bp, Mus musculus
tagcgctgggccgtaccaagtgctc

SEQ ID NO: 447430 - DNA, 25 bp, Mus musculus
gcgtctcaacggctccgagctgcaa

SEQ ID NO: 447431 - DNA, 25 bp, Mus musculus
accagctgccgcagaggcgtctcaa

SEQ ID NO: 447432 - DNA, 25 bp, Mus musculus
agatgcgagagcacagacgcgagct

SEQ ID NO: 447433 - DNA, 25 bp, Mus musculus
cgcgatcaggagatgcgagagcaca

SEQ ID NO: 447434 - DNA, 25 bp, Mus musculus
aaatcgcgagtcatgtttgaggggc

SEQ ID NO: 447435 - DNA, 25 bp, Mus musculus
ctgctctgcgtgtgtgtatttgtat

SEQ ID NO: 447436 - DNA, 25 bp, Mus musculus
cgagagccagctaagaagacgttta

SEQ ID NO: 447437 - DNA, 25 bp, Mus musculus
agtggccgttgtaaacttcacctcg

SEQ ID NO: 447438 - DNA, 25 bp, Mus musculus
tgagtacgcgcgtatcctggagctg

SEQ ID NO: 447439 - DNA, 25 bp, Mus musculus
gcgagcccgcgttctctgagtacgc

SEQ ID NO: 447440 - DNA, 25 bp, Mus musculus
gagccacccgtgtgctttgcgcacg

SEQ ID NO: 447441 - DNA, 25 bp, Mus musculus
tgaaacaaggagaaggcacagcatg

SEQ ID NO: 447442 - DNA, 25 bp, Mus musculus
ctcggttgcgggagttctgaaacaa

SEQ ID NO: 447443 - DNA, 25 bp, Mus musculus
tggaaatgtgcacgccactcggttg

SEQ ID NO: 447444 - DNA, 25 bp, Mus musculus
cttttccgaggctggaaatgtgcac

SEQ ID NO: 447445 - DNA, 25 bp, Mus musculus
caggctgctgcccttttccgaggct

SEQ ID NO: 447446 - DNA, 25 bp, Mus musculus
gctgcccagagcctcgtcgcgtgtt

SEQ ID NO: 447447 - DNA, 25 bp, Mus musculus
agaagacgtttacagagcaggaaca

SEQ ID NO: 447448 - DNA, 25 bp, Mus musculus
tcctagcgggtttctcgggccgaga

SEQ ID NO: 447449 - DNA, 25 bp, Mus musculus
agcaggaacaggctgctgccctttt

SEQ ID NO: 447450 - DNA, 25 bp, Mus musculus
gctctcccggcagggtagcagccga

SEQ ID NO: 447451 - DNA, 25 bp, Mus musculus
agccagcaattgtgcaagaggagcc

SEQ ID NO: 447452 - DNA, 25 bp, Mus musculus
gcgcgcagggcgcaaatcaccgagc

SEQ ID NO: 447453 - DNA, 25 bp, Mus musculus
cgcaaatcaccgagcgcttggtacg

SEQ ID NO: 447454 - DNA, 25 bp, Mus musculus
caccgagcgcttggtacggacggct

SEQ ID NO: 447455 - DNA, 25 bp, Mus musculus
gacggctgcgggtgattaattatcc

SEQ ID NO: 447456 - DNA, 25 bp, Mus musculus
agccggagagccagcaattgtgcaa

SEQ ID NO: 447457 - DNA, 25 bp, Mus musculus
ttaattatccgtccgctgccctggc

SEQ ID NO: 447458 - DNA, 25 bp, Mus musculus
ctcccggcagggtagcagccgagct

SEQ ID NO: 447459 - DNA, 25 bp, Mus musculus
agaagcggctctgggagaacgcagg

SEQ ID NO: 447460 - DNA, 25 bp, Mus musculus
ccgcgccgagtgtgagtgcaccgcg

SEQ ID NO: 447461 - DNA, 25 bp, Mus musculus
agagtgaagccaccgcgagccggaa

SEQ ID NO: 447462 - DNA, 25 bp, Mus musculus
tgaagccaccgcgagccggaacgga

SEQ ID NO: 447463 - DNA, 25 bp, Mus musculus
ggtgattaattatccgtccgctgcc

SEQ ID NO: 447464 - DNA, 25 bp, Mus musculus
agcaccgggcgcgaactttattccg

SEQ ID NO: 447465 - DNA, 25 bp, Mus musculus
ccagcgcccagctgtcaacaagggg

SEQ ID NO: 447466 - DNA, 25 bp, Mus musculus
cttcggggaggatgtctagccctcc

SEQ ID NO: 447467 - DNA, 25 bp, Mus musculus
gtcctcaagcttttctaggggcttc

SEQ ID NO: 447468 - DNA, 25 bp, Mus musculus
tgttcgccgcctgttttgttgttgt

SEQ ID NO: 447469 - DNA, 25 bp, Mus musculus
cgcaactgtccggactagggtgttc

SEQ ID NO: 447470 - DNA, 25 bp, Mus musculus
gcacaagtttctgctcccggcgcaa

SEQ ID NO: 447471 - DNA, 25 bp, Mus musculus
tgactgatttacacccgcgcccagg

SEQ ID NO: 447472 - DNA, 25 bp, Mus musculus
tcttggtctcctcttagcggccgcg

SEQ ID NO: 447473 - DNA, 25 bp, Mus musculus
ctcggcatgctggttgtcaagtgca

SEQ ID NO: 447474 - DNA, 25 bp, Mus musculus
ggaaacttcttaccatctcggcatg

SEQ ID NO: 447475 - DNA, 25 bp, Mus musculus
cgggtctgtccctaccaagtgcaga

SEQ ID NO: 447476 - DNA, 25 bp, Mus musculus
ccgcctcgagaacttggggccaagt

SEQ ID NO: 447477 - DNA, 25 bp, Mus musculus
gcgaactttattccgactgcggcgc

SEQ ID NO: 447478 - DNA, 25 bp, Mus musculus
tcctggtggccagagggcctctcct

SEQ ID NO: 447479 - DNA, 25 bp, Mus musculus
gctggccctgtgtcaggtatcagga

SEQ ID NO: 447480 - DNA, 25 bp, Mus musculus
agtcaggcacttcggactcgggaca

SEQ ID NO: 447481 - DNA, 25 bp, Mus musculus
ggtatcaggactggccgccggcctt

SEQ ID NO: 447482 - DNA, 25 bp, Mus musculus
cgaaggcgacgcgatcgcagctgct

SEQ ID NO: 447483 - DNA, 25 bp, Mus musculus
tcgcggataaaagcgacttactttg

SEQ ID NO: 447484 - DNA, 25 bp, Mus musculus
agccgaagtgcacgctgtgcgcagc

SEQ ID NO: 447485 - DNA, 25 bp, Mus musculus
tggagttttcaagcgggaacttgac

SEQ ID NO: 447486 - DNA, 25 bp, Mus musculus
aaaagctccgcgcatgcgtaggacg

SEQ ID NO: 447487 - DNA, 25 bp, Mus musculus
atcgccggaccaggcgggaaaagct

SEQ ID NO: 447488 - DNA, 25 bp, Mus musculus
ggcaagcccactaggaaccgcgatc

SEQ ID NO: 447489 - DNA, 25 bp, Mus musculus
atgaacttgctggtcgagcctccgc

SEQ ID NO: 447490 - DNA, 25 bp, Mus musculus
cagtggaggcgccagcaatgaactt

SEQ ID NO: 447491 - DNA, 25 bp, Mus musculus
agcctaaaggaggagctggccctgt

SEQ ID NO: 447492 - DNA, 25 bp, Mus musculus
aactcctccatgaaggcccggcggg

SEQ ID NO: 447493 - DNA, 25 bp, Mus musculus
ccggggtctctcacgtctgctagac

SEQ ID NO: 447494 - DNA, 25 bp, Mus musculus
caggccgggccagcacacacaagga

SEQ ID NO: 447495 - DNA, 25 bp, Mus musculus
tgggcagcaccaggccctggttgta

SEQ ID NO: 447496 - DNA, 25 bp, Mus musculus
ccctggttgtagtccgtgtgctccc

SEQ ID NO: 447497 - DNA, 25 bp, Mus musculus
tcggctccaaactcctccatgaagg

SEQ ID NO: 447498 - DNA, 25 bp, Mus musculus
atcccacctgcagagcggggtccaa

SEQ ID NO: 447499 - DNA, 25 bp, Mus musculus
ccatgacgctcgtctgcagctgggc

SEQ ID NO: 447500 - DNA, 25 bp, Mus musculus
gacttacattcctgtccttcgcggg

SEQ ID NO: 447501 - DNA, 25 bp, Mus musculus
tggacaactgcacgtcccggggtct

SEQ ID NO: 447502 - DNA, 25 bp, Mus musculus
agcggggtccaaacttagctctcca

SEQ ID NO: 447503 - DNA, 25 bp, Mus musculus
aaacttagctctccagcgcaagcca

SEQ ID NO: 447504 - DNA, 25 bp, Mus musculus
ccacgtggcgcggacttacattcct

SEQ ID NO: 447505 - DNA, 25 bp, Mus musculus
ggcggtctccaagcagccatgacgc

SEQ ID NO: 447506 - DNA, 25 bp, Mus musculus
cgaacgactcccacagctgaagaca

SEQ ID NO: 447507 - DNA, 25 bp, Mus musculus
ggtccctgccactctagcactcaga

SEQ ID NO: 447508 - DNA, 25 bp, Mus musculus
aaagtcgcctcggtgcggtgacctt

SEQ ID NO: 447509 - DNA, 25 bp, Mus musculus
gcgggagattatgtaaagtcgcctc

SEQ ID NO: 447510 - DNA, 25 bp, Mus musculus
tctcaggctctgcacggagggtgcc

SEQ ID NO: 447511 - DNA, 25 bp, Mus musculus
gttagtccctgcacggcagctctca

SEQ ID NO: 447512 - DNA, 25 bp, Mus musculus
cgggttcccaggcagttagtccctg

SEQ ID NO: 447513 - DNA, 25 bp, Mus musculus
tccgatcggtgctcgctccgcgagt

SEQ ID NO: 447514 - DNA, 25 bp, Mus musculus
aaagccactcaggtagggcgcgtgc

SEQ ID NO: 447515 - DNA, 25 bp, Mus musculus
catcccatcatgtcggtggcagggc

SEQ ID NO: 447516 - DNA, 25 bp, Mus musculus
atctgcatctgcatctgccggccgc

SEQ ID NO: 447517 - DNA, 25 bp, Mus musculus
acgtcagggtgtctctccgcacaag

SEQ ID NO: 447518 - DNA, 25 bp, Mus musculus
ctgaagacagcccaggcttcggacc

SEQ ID NO: 447519 - DNA, 25 bp, Mus musculus
atcacccgccctgacgtcagggtgt

SEQ ID NO: 447520 - DNA, 25 bp, Mus musculus
cctcatcggtggcatctggtgcctc

SEQ ID NO: 447521 - DNA, 25 bp, Mus musculus
ctggctcgcctcatcggtggcatct

SEQ ID NO: 447522 - DNA, 25 bp, Mus musculus
caaggctggtgacgcgtaaccgccc

SEQ ID NO: 447523 - DNA, 25 bp, Mus musculus
cggacacatcgtgctgcctggacgg

SEQ ID NO: 447524 - DNA, 25 bp, Mus musculus
ggcatctggtgcctcctctgtgtcg

SEQ ID NO: 447525 - DNA, 25 bp, Mus musculus
accatggcaaggctggtgacgcgta

SEQ ID NO: 447526 - DNA, 25 bp, Mus musculus
aactcctccaggaccatggcaaggc

SEQ ID NO: 447527 - DNA, 25 bp, Mus musculus
gggtccgcagttatcgctccacaac

SEQ ID NO: 447528 - DNA, 25 bp, Mus musculus
ccagcctggggtccgcagttatcgc

SEQ ID NO: 447529 - DNA, 25 bp, Mus musculus
ctgcaaggccgctgcagtgacgcgc

SEQ ID NO: 447530 - DNA, 25 bp, Mus musculus
ttcaaagcagcagggctgcaaggcc

SEQ ID NO: 447531 - DNA, 25 bp, Mus musculus
ccagccaggcgcacgcgctcccatt

SEQ ID NO: 447532 - DNA, 25 bp, Mus musculus
acatcgtgctgcctggacggcgctt

SEQ ID NO: 447533 - DNA, 25 bp, Mus musculus
tctgtgtcgcaggacaggtaggaca

SEQ ID NO: 447534 - DNA, 25 bp, Mus musculus
gtgccaccatcgacgtggagcactc

SEQ ID NO: 447535 - DNA, 25 bp, Mus musculus
cgggcgctgttttctgagacctcgc

SEQ ID NO: 447536 - DNA, 25 bp, Mus musculus
acgttctcgcgatgtcgccaccgga

SEQ ID NO: 447537 - DNA, 25 bp, Mus musculus
aggccctcggagttctcgcgagatg

SEQ ID NO: 447538 - DNA, 25 bp, Mus musculus
ccgggccgaagctgatcacatcact

SEQ ID NO: 447539 - DNA, 25 bp, Mus musculus
tcacatcactggtctgctctcgcta

SEQ ID NO: 447540 - DNA, 25 bp, Mus musculus
ctgctctcgctagctcggagcggct

SEQ ID NO: 447541 - DNA, 25 bp, Mus musculus
gttaggccgtgcctcaggcccagtc

SEQ ID NO: 447542 - DNA, 25 bp, Mus musculus
acgccggcaggtgatgcccaataca

SEQ ID NO: 447543 - DNA, 25 bp, Mus musculus
gtgatgcccaatacagccatgaaga

SEQ ID NO: 447544 - DNA, 25 bp, Mus musculus
gggaagaccagcatgaggtcgatca

SEQ ID NO: 447545 - DNA, 25 bp, Mus musculus
aggtcgatcatctttgcaaattata

SEQ ID NO: 447546 - DNA, 25 bp, Mus musculus
acactaggcgcctgggtgccaccat

SEQ ID NO: 447547 - DNA, 25 bp, Mus musculus
gcaaattatattgcgcgcgacacta

SEQ ID NO: 447548 - DNA, 25 bp, Mus musculus
cggtctattcttaggagccgaattc

SEQ ID NO: 447549 - DNA, 25 bp, Mus musculus
gggacccttgtcaggacaacctaga

SEQ ID NO: 447550 - DNA, 25 bp, Mus musculus
gcaggtcctgggatgcaatcacagc

SEQ ID NO: 447551 - DNA, 25 bp, Mus musculus
tagagactacgctttcccagcggga

SEQ ID NO: 447552 - DNA, 25 bp, Mus musculus
aatattactcgtttggcgcccggtg

SEQ ID NO: 447553 - DNA, 25 bp, Mus musculus
cggtggagttccctcgagttttctg

SEQ ID NO: 447554 - DNA, 25 bp, Mus musculus
gagcgtgtgacttggccaacttatg

SEQ ID NO: 447555 - DNA, 25 bp, Mus musculus
ttcagtcaggccaaacgcacttttc

SEQ ID NO: 447556 - DNA, 25 bp, Mus musculus
cccgcagccctcatagagatttttc

SEQ ID NO: 447557 - DNA, 25 bp, Mus musculus
tgccttggctaagaagtacatctgc

SEQ ID NO: 447558 - DNA, 25 bp, Mus musculus
ccctctaggacgcagacacagttaa

SEQ ID NO: 447559 - DNA, 25 bp, Mus musculus
tggctgctaattcgagaccggaaca

SEQ ID NO: 447560 - DNA, 25 bp, Mus musculus
acatcttcgtcgtgctggctgctaa

SEQ ID NO: 447561 - DNA, 25 bp, Mus musculus
cccttgcaaccgcaggaacctattg

SEQ ID NO: 447562 - DNA, 25 bp, Mus musculus
actcccgcgcttgcggaagactaca

SEQ ID NO: 447563 - DNA, 25 bp, Mus musculus
tccttactctccaaggtgcgcgtgc

SEQ ID NO: 447564 - DNA, 25 bp, Mus musculus
actacagaccacgaaggcagggtta

SEQ ID NO: 447565 - DNA, 25 bp, Mus musculus
gccgttgtgcctcaactgcagagca

SEQ ID NO: 447566 - DNA, 25 bp, Mus musculus
tgcagagcacgcctctaaagcgtcc

SEQ ID NO: 447567 - DNA, 25 bp, Mus musculus
caccacagggttctgccgccagtga

SEQ ID NO: 447568 - DNA, 25 bp, Mus musculus
cgccagtgactggacgccaaggacc

SEQ ID NO: 447569 - DNA, 25 bp, Mus musculus
tcttcccgccgaacgtgatgctgga

SEQ ID NO: 447570 - DNA, 25 bp, Mus musculus
tgatgctggagctcggatccaagcc

SEQ ID NO: 447571 - DNA, 25 bp, Mus musculus
cagcgcctgcaggtacatccagaga

SEQ ID NO: 447572 - DNA, 25 bp, Mus musculus
tgctgcttctcgaaagcggagtccc

SEQ ID NO: 447573 - DNA, 25 bp, Mus musculus
cgagctcatgctttccacgggcagg

SEQ ID NO: 447574 - DNA, 25 bp, Mus musculus
cgcccagaaaaacagacagtgactg

SEQ ID NO: 447575 - DNA, 25 bp, Mus musculus
tgtgacggaggaaaacgaaggcacc

SEQ ID NO: 447576 - DNA, 25 bp, Mus musculus
ccgcgagcccttcggtcggcagttg

SEQ ID NO: 447577 - DNA, 25 bp, Mus musculus
gtcaacctctgggtggagcccaacc

SEQ ID NO: 447578 - DNA, 25 bp, Mus musculus
caggaagctccggtgtcggacagtc

SEQ ID NO: 447579 - DNA, 25 bp, Mus musculus
ctccggtgtcggacagtcgccgact

SEQ ID NO: 447580 - DNA, 25 bp, Mus musculus
gcctcgagaggatcgactcggtgca

SEQ ID NO: 447581 - DNA, 25 bp, Mus musculus
cttcggcgtcgggattctaaggagc

SEQ ID NO: 447582 - DNA, 25 bp, Mus musculus
cgaggtccgccagaattctgccagg

SEQ ID NO: 447583 - DNA, 25 bp, Mus musculus
tcggtcggcagttgccctcgctgca

SEQ ID NO: 447584 - DNA, 25 bp, Mus musculus
cctctgggtggagcccaaccacagg

SEQ ID NO: 447585 - DNA, 25 bp, Mus musculus
aaagtggtgttctgtggaaaagagc

SEQ ID NO: 447586 - DNA, 25 bp, Mus musculus
aatagggaacagaaacatggcggtc

SEQ ID NO: 447587 - DNA, 25 bp, Mus musculus
aaacatggcggtctgtggtccggac

SEQ ID NO: 447588 - DNA, 25 bp, Mus musculus
ggcagtgcctagacgtcggtcctcc

SEQ ID NO: 447589 - DNA, 25 bp, Mus musculus
gtctgtggtccggacagtctcgccc

SEQ ID NO: 447590 - DNA, 25 bp, Mus musculus
ttccgggcgtagattaactagacta

SEQ ID NO: 447591 - DNA, 25 bp, Mus musculus
tcccagcgattgagtggctcctgta

SEQ ID NO: 447592 - DNA, 25 bp, Mus musculus
cgtggccatgcgcttctcatagaag

SEQ ID NO: 447593 - DNA, 25 bp, Mus musculus
tccacctcgatgagcttctgacagc

SEQ ID NO: 447594 - DNA, 25 bp, Mus musculus
cgcatccacgggacattttacagga

SEQ ID NO: 447595 - DNA, 25 bp, Mus musculus
tcaagacctccgctagcagagtggc

SEQ ID NO: 447596 - DNA, 25 bp, Mus musculus
gcctcggatccttctccacttagtg

SEQ ID NO: 447597 - DNA, 25 bp, Mus musculus
ggggacgcctaccttcatcttgaca

SEQ ID NO: 447598 - DNA, 25 bp, Mus musculus
ccagggcacatagcgctctaagttc

SEQ ID NO: 447599 - DNA, 25 bp, Mus musculus
tctgtcgtttatcaccggggttagc

SEQ ID NO: 447600 - DNA, 25 bp, Mus musculus
ctggtctactgaggagccgaatctc

SEQ ID NO: 447601 - DNA, 25 bp, Mus musculus
cgaatctccgtttgcgaccctggtt

SEQ ID NO: 447602 - DNA, 25 bp, Mus musculus
ggtccctcatccgtacagaagattt

SEQ ID NO: 447603 - DNA, 25 bp, Mus musculus
ggttagccgcttccagactggtcta

SEQ ID NO: 447604 - DNA, 25 bp, Mus musculus
cgcctggaagcaaccgtggacgtcc

SEQ ID NO: 447605 - DNA, 25 bp, Mus musculus
gtccaaagaggtccgggtctctgtg

SEQ ID NO: 447606 - DNA, 25 bp, Mus musculus
ttctacaacacggtgcgggacgcgg

SEQ ID NO: 447607 - DNA, 25 bp, Mus musculus
gtgcctgccattgccgagttctaca

SEQ ID NO: 447608 - DNA, 25 bp, Mus musculus
ttggtgcgaggacaactacactatc

SEQ ID NO: 447609 - DNA, 25 bp, Mus musculus
aagctgctccgatgctccagagcgg

SEQ ID NO: 447610 - DNA, 25 bp, Mus musculus
gtcgccgctgcagagaagctgctcc

SEQ ID NO: 447611 - DNA, 25 bp, Mus musculus
cgcataaagccacagacgcacagtg

SEQ ID NO: 447612 - DNA, 25 bp, Mus musculus
gaggctgtcccgcaccgcataaagc

SEQ ID NO: 447613 - DNA, 25 bp, Mus musculus
tggaaccggagagtcccgacttcca

SEQ ID NO: 447614 - DNA, 25 bp, Mus musculus
agagcgactccgaagacctttgcca

SEQ ID NO: 447615 - DNA, 25 bp, Mus musculus
tggcgttctttacacaacctggacg

SEQ ID NO: 447616 - DNA, 25 bp, Mus musculus
tctctgtgcgtttttccgtacttta

SEQ ID NO: 447617 - DNA, 25 bp, Mus musculus
ggacgtccgtggcagattcactcca

SEQ ID NO: 447618 - DNA, 25 bp, Mus musculus
taccagcactgttgagcaaggctca

SEQ ID NO: 447619 - DNA, 25 bp, Mus musculus
cccgagtggagagagttggctaact

SEQ ID NO: 447620 - DNA, 25 bp, Mus musculus
gagttggctaactcagagctgggcc

SEQ ID NO: 447621 - DNA, 25 bp, Mus musculus
tggggcgccacattcaccacggggc

SEQ ID NO: 447622 - DNA, 25 bp, Mus musculus
acctgtgagcctgcggcgcagctgc

SEQ ID NO: 447623 - DNA, 25 bp, Mus musculus
cacggcagccgcagagctggagacc

SEQ ID NO: 447624 - DNA, 25 bp, Mus musculus
gcagccgcagagctggagacccaga

SEQ ID NO: 447625 - DNA, 25 bp, Mus musculus
tgccagatttctccgcagtggggac

SEQ ID NO: 447626 - DNA, 25 bp, Mus musculus
ggagacccagagacccgcacttacc

SEQ ID NO: 447627 - DNA, 25 bp, Mus musculus
ccgcacttaccagcactgttgagca

SEQ ID NO: 447628 - DNA, 25 bp, Mus musculus
cgcctgccagatttctccgcagtgg

SEQ ID NO: 447629 - DNA, 25 bp, Mus musculus
atggacgtcgccttcgccggccgaa

SEQ ID NO: 447630 - DNA, 25 bp, Mus musculus
ccgggctcgcgatggacgtcgcctt

SEQ ID NO: 447631 - DNA, 25 bp, Mus musculus
ttgagcaaggctcacacgccgggcc

SEQ ID NO: 447632 - DNA, 25 bp, Mus musculus
cgcgagcaaaaccaacctttctcta

SEQ ID NO: 447633 - DNA, 25 bp, Mus musculus
agccaaagtggtcgcaaactccctc

SEQ ID NO: 447634 - DNA, 25 bp, Mus musculus
tgagtgcgcttcttgcgattgcaaa

SEQ ID NO: 447635 - DNA, 25 bp, Mus musculus
attattcgcctccttccaccgggtg

SEQ ID NO: 447636 - DNA, 25 bp, Mus musculus
cggagaacgcaccatcgtggcggcc

SEQ ID NO: 447637 - DNA, 25 bp, Mus musculus
aggcacacgccgaggaagtctttgt

SEQ ID NO: 447638 - DNA, 25 bp, Mus musculus
caaaacgcagaaaggcagggctact

SEQ ID NO: 447639 - DNA, 25 bp, Mus musculus
cggaatggaaactacaggcagcctc

SEQ ID NO: 447640 - DNA, 25 bp, Mus musculus
ggcagcctctgctaatgggcacaaa

SEQ ID NO: 447641 - DNA, 25 bp, Mus musculus
gcacaaactcccgtgttctttctta

SEQ ID NO: 447642 - DNA, 25 bp, Mus musculus
cttaccacggggttcgtgcacaaga

SEQ ID NO: 447643 - DNA, 25 bp, Mus musculus
tcgtgcacaagaatgaaacgtcgtc

SEQ ID NO: 447644 - DNA, 25 bp, Mus musculus
gaccagcaaggccagcccaacagag

SEQ ID NO: 447645 - DNA, 25 bp, Mus musculus
ttctctaattggaaccgcggagcgc

SEQ ID NO: 447646 - DNA, 25 bp, Mus musculus
tgcgtcagtgcgtcacagaaccctg

SEQ ID NO: 447647 - DNA, 25 bp, Mus musculus
gacatctcccgacacaaaggccgta

SEQ ID NO: 447648 - DNA, 25 bp, Mus musculus
gaaccctgatttgcatacaccaacg

SEQ ID NO: 447649 - DNA, 25 bp, Mus musculus
tatttatagagacgctgcacgctgc

SEQ ID NO: 447650 - DNA, 25 bp, Mus musculus
cccgacgcctccatatttatagaga

SEQ ID NO: 447651 - DNA, 25 bp, Mus musculus
ggcagagccgcgaactcacccaaag

SEQ ID NO: 447652 - DNA, 25 bp, Mus musculus
acctgtgagtcaccaccgggaagca

SEQ ID NO: 447653 - DNA, 25 bp, Mus musculus
aagcgacgttcaaggccaggtcacc

SEQ ID NO: 447654 - DNA, 25 bp, Mus musculus
ttcacctgcgagacaagcgacgttc

SEQ ID NO: 447655 - DNA, 25 bp, Mus musculus
gccctctgcctacctgtagcggtga

SEQ ID NO: 447656 - DNA, 25 bp, Mus musculus
cggcggccaagtcattgttcccagc

SEQ ID NO: 447657 - DNA, 25 bp, Mus musculus
tggcctgcagtcaccagaagaagga

SEQ ID NO: 447658 - DNA, 25 bp, Mus musculus
agcgaccgcggtcctaaaagccagg

SEQ ID NO: 447659 - DNA, 25 bp, Mus musculus
cgactttttcgattggcgggagctt

SEQ ID NO: 447660 - DNA, 25 bp, Mus musculus
cctgtggcagaagtgaggtaagcca

SEQ ID NO: 447661 - DNA, 25 bp, Mus musculus
ctggtgtaaggctccaggacccgct

SEQ ID NO: 447662 - DNA, 25 bp, Mus musculus
aagtaggtttcgtattggctgtctc

SEQ ID NO: 447663 - DNA, 25 bp, Mus musculus
aaggccttgtcacgcatgcgcgcga

SEQ ID NO: 447664 - DNA, 25 bp, Mus musculus
tggcacgatctgtctagcttacctg

SEQ ID NO: 447665 - DNA, 25 bp, Mus musculus
gcctcaagcggttccctggtgtaag

SEQ ID NO: 447666 - DNA, 25 bp, Mus musculus
gctcccggaggatctggcctcaagc

SEQ ID NO: 447667 - DNA, 25 bp, Mus musculus
ctattgctggtccagcgaagcgtcc

SEQ ID NO: 447668 - DNA, 25 bp, Mus musculus
cgggcagggcatttgacctgctgcc

SEQ ID NO: 447669 - DNA, 25 bp, Mus musculus
gcgaccgaagctggaccacttgggc

SEQ ID NO: 447670 - DNA, 25 bp, Mus musculus
cagttgccgcatcgggtccggctgc

SEQ ID NO: 447671 - DNA, 25 bp, Mus musculus
aagccatgcggcgtggctgaccgtc

SEQ ID NO: 447672 - DNA, 25 bp, Mus musculus
cgtattggctgtctccgacaggacc

SEQ ID NO: 447673 - DNA, 25 bp, Mus musculus
acctgcctcaggttgcggttgtcac

SEQ ID NO: 447674 - DNA, 25 bp, Mus musculus
tgtaagcttgtaggaatgcgcgtgc

SEQ ID NO: 447675 - DNA, 25 bp, Mus musculus
ccgaaccaagggcaagcaagcggtc

SEQ ID NO: 447676 - DNA, 25 bp, Mus musculus
ctgtgcgtgttgctggtaaaaaacc

SEQ ID NO: 447677 - DNA, 25 bp, Mus musculus
ccgcgtagttccagacttgcaaggc

SEQ ID NO: 447678 - DNA, 25 bp, Mus musculus
gcagagacgcccatgtcgccgttac

SEQ ID NO: 447679 - DNA, 25 bp, Mus musculus
accttcatgggagaagccggagctc

SEQ ID NO: 447680 - DNA, 25 bp, Mus musculus
gcaggccgcagacgttacaaagaga

SEQ ID NO: 447681 - DNA, 25 bp, Mus musculus
agcacgcacctcaaatctgccagga

SEQ ID NO: 447682 - DNA, 25 bp, Mus musculus
ggtgagtcatcacccggggcagtta

SEQ ID NO: 447683 - DNA, 25 bp, Mus musculus
ggggcagttacgtgaccgcttcacc

SEQ ID NO: 447684 - DNA, 25 bp, Mus musculus
cctggaatcccgacttgggcctaga

SEQ ID NO: 447685 - DNA, 25 bp, Mus musculus
tccggaaaggcagaatcccaggatc

SEQ ID NO: 447686 - DNA, 25 bp, Mus musculus
ccggtgcagggtccattatgtaagc

SEQ ID NO: 447687 - DNA, 25 bp, Mus musculus
agcggctgcacagctagtgcgcttg

SEQ ID NO: 447688 - DNA, 25 bp, Mus musculus
tcctggcctcagaagtcgcgtccag

SEQ ID NO: 447689 - DNA, 25 bp, Mus musculus
aggcttcagcatgctgcctgtgcat

SEQ ID NO: 447690 - DNA, 25 bp, Mus musculus
gcaatcgtcaggcttcagcatgctg

SEQ ID NO: 447691 - DNA, 25 bp, Mus musculus
gctcaatgggaaggcggccttgccc

SEQ ID NO: 447692 - DNA, 25 bp, Mus musculus
tccaggctcaatgggaaggcggcct

SEQ ID NO: 447693 - DNA, 25 bp, Mus musculus
gtgaactattaaagcagcaaactcc

SEQ ID NO: 447694 - DNA, 25 bp, Mus musculus
gctgctgctcctggcctcagaagtc

SEQ ID NO: 447695 - DNA, 25 bp, Mus musculus
tacagtcctgtacgcgaaggggccc

SEQ ID NO: 447696 - DNA, 25 bp, Mus musculus
caccaattccgtctgggttcaattc

SEQ ID NO: 447697 - DNA, 25 bp, Mus musculus
ctggcccaccaattccgtctgggtt

SEQ ID NO: 447698 - DNA, 25 bp, Mus musculus
ctctgggctttggagccttcccggt

SEQ ID NO: 447699 - DNA, 25 bp, Mus musculus
ccaaaacgctgctctctgggctttg

SEQ ID NO: 447700 - DNA, 25 bp, Mus musculus
agccaaaccaaaacgctgctctctg

SEQ ID NO: 447701 - DNA, 25 bp, Mus musculus
gcagcaaactccaggctcaatggga

SEQ ID NO: 447702 - DNA, 25 bp, Mus musculus
ggccctgcctttctcggctttgatt

SEQ ID NO: 447703 - DNA, 25 bp, Mus musculus
ccgcggcttcagtcgagtcagtcgc

SEQ ID NO: 447704 - DNA, 25 bp, Mus musculus
ttctcggctttgatttggggcccgc

SEQ ID NO: 447705 - DNA, 25 bp, Mus musculus
aaggcctcgcgacccgatttcgaca

SEQ ID NO: 447706 - DNA, 25 bp, Mus musculus
aacatccgagcgctgaggtaaggcc

SEQ ID NO: 447707 - DNA, 25 bp, Mus musculus
ggactcgtctatggagctgctattt

SEQ ID NO: 447708 - DNA, 25 bp, Mus musculus
cagacatggcggtggactcgtctat

SEQ ID NO: 447709 - DNA, 25 bp, Mus musculus
tcctgtttaccggaagtactgcagt

SEQ ID NO: 447710 - DNA, 25 bp, Mus musculus
gcttgagacgacagcgtcctgttta

SEQ ID NO: 447711 - DNA, 25 bp, Mus musculus
cggggcttacggcttaagtcagcaa

SEQ ID NO: 447712 - DNA, 25 bp, Mus musculus
cctttgggctcgcagaaggcgccct

SEQ ID NO: 447713 - DNA, 25 bp, Mus musculus
ttggaccactgcaaacaccgtagtc

SEQ ID NO: 447714 - DNA, 25 bp, Mus musculus
cgctactccggagaaccacgggatt

SEQ ID NO: 447715 - DNA, 25 bp, Mus musculus
aaccacgggatttggaccactgcaa

SEQ ID NO: 447716 - DNA, 25 bp, Mus musculus
aagacaggaccatgtcgaagggccc

SEQ ID NO: 447717 - DNA, 25 bp, Mus musculus
tcggtcccagcctccgagtcggaaa

SEQ ID NO: 447718 - DNA, 25 bp, Mus musculus
tcaccaacctctggtcgggcagtgg

SEQ ID NO: 447719 - DNA, 25 bp, Mus musculus
agcttacttcaactgtcaccaacct

SEQ ID NO: 447720 - DNA, 25 bp, Mus musculus
gaccggtcccagcttacttcaactg

SEQ ID NO: 447721 - DNA, 25 bp, Mus musculus
ccagaccggttccaacctgctggga

SEQ ID NO: 447722 - DNA, 25 bp, Mus musculus
tcagcggccagcgtgagtcacgcgc

SEQ ID NO: 447723 - DNA, 25 bp, Mus musculus
acgcctgacgtcagcggccagcgtg

SEQ ID NO: 447724 - DNA, 25 bp, Mus musculus
cgcagcactacacgtacgtagagcc

SEQ ID NO: 447725 - DNA, 25 bp, Mus musculus
ctaccgctcaggtgctgcaggcaca

SEQ ID NO: 447726 - DNA, 25 bp, Mus musculus
ctgaataataaaaggggagcggcga

SEQ ID NO: 447727 - DNA, 25 bp, Mus musculus
cgcggaccgcgcagactgaataata

SEQ ID NO: 447728 - DNA, 25 bp, Mus musculus
cagcctccgagtcggaaaggcagga

SEQ ID NO: 447729 - DNA, 25 bp, Mus musculus
ccgagaaaccgcagcactacacgta

SEQ ID NO: 447730 - DNA, 25 bp, Mus musculus
cctggtgcaggatggcgcgggtccc

SEQ ID NO: 447731 - DNA, 25 bp, Mus musculus
gtcctgcgggccgagcgatctcgga

SEQ ID NO: 447732 - DNA, 25 bp, Mus musculus
ttcggtcagcctgcggggtaggtct

SEQ ID NO: 447733 - DNA, 25 bp, Mus musculus
ctcgcgatttcggtcagcctgcggg

SEQ ID NO: 447734 - DNA, 25 bp, Mus musculus
gggcgctcgcgatttcggtcagcct

SEQ ID NO: 447735 - DNA, 25 bp, Mus musculus
tcggcggcaggcgttggtacctgct

SEQ ID NO: 447736 - DNA, 25 bp, Mus musculus
gggaagctcgagctggtcggcggca

SEQ ID NO: 447737 - DNA, 25 bp, Mus musculus
ttggctgtaggaaggcgggaagctc

SEQ ID NO: 447738 - DNA, 25 bp, Mus musculus
ccggcccgtggttggctgtaggaag

SEQ ID NO: 447739 - DNA, 25 bp, Mus musculus
ctgcacgccgtggtgcgcatgctcg

SEQ ID NO: 447740 - DNA, 25 bp, Mus musculus
cactgcacgccgtggtgcgcatgct

SEQ ID NO: 447741 - DNA, 25 bp, Mus musculus
gaccagcactgcacgccgtggtgcg

SEQ ID NO: 447742 - DNA, 25 bp, Mus musculus
cgggaccagcactgcacgccgtggt

SEQ ID NO: 447743 - DNA, 25 bp, Mus musculus
cgagcgatctcggaggccacggccc

SEQ ID NO: 447744 - DNA, 25 bp, Mus musculus
ttctcgcccaaagaatccgcttatt

SEQ ID NO: 447745 - DNA, 25 bp, Mus musculus
gaaaccgcgcgtagctgatatccac

SEQ ID NO: 447746 - DNA, 25 bp, Mus musculus
gacccgctacagtgacgtcatagag

SEQ ID NO: 447747 - DNA, 25 bp, Mus musculus
cggaaggaatgacccgctacagtga

SEQ ID NO: 447748 - DNA, 25 bp, Mus musculus
tgcttgtttgtgagatgtgcttttg

SEQ ID NO: 447749 - DNA, 25 bp, Mus musculus
caactgctgagagtggtatgtgctt

SEQ ID NO: 447750 - DNA, 25 bp, Mus musculus
aagcgaaagtttcgggcaactgctg

SEQ ID NO: 447751 - DNA, 25 bp, Mus musculus
gactctgagtttctttgaaaagtga

SEQ ID NO: 447752 - DNA, 25 bp, Mus musculus
cgctttccttgtgactctgagtttc

SEQ ID NO: 447753 - DNA, 25 bp, Mus musculus
tgtgccgcccatccgcacaggtgtt

SEQ ID NO: 447754 - DNA, 25 bp, Mus musculus
aatatgcacccacaggcactggcgc

SEQ ID NO: 447755 - DNA, 25 bp, Mus musculus
tgcggaccaatatgcacccacaggc

SEQ ID NO: 447756 - DNA, 25 bp, Mus musculus
gctctcccacggtgcggaccaatat

SEQ ID NO: 447757 - DNA, 25 bp, Mus musculus
tccgcacaggtgtttcgctttcctt

SEQ ID NO: 447758 - DNA, 25 bp, Mus musculus
tgcgcaggtcgaaagaaagcgccgc

SEQ ID NO: 447759 - DNA, 25 bp, Mus musculus
cgagtacgaactgaaaacaagcgaa

SEQ ID NO: 447760 - DNA, 25 bp, Mus musculus
aacaagcgaatcctcggctgtgggg

SEQ ID NO: 447761 - DNA, 25 bp, Mus musculus
cattcttgaccagcaggccagcggc

SEQ ID NO: 447762 - DNA, 25 bp, Mus musculus
ccgcggctaggcaaggttcgcgaca

SEQ ID NO: 447763 - DNA, 25 bp, Mus musculus
tctgcgtcccgcgttgtgcgcaggt

SEQ ID NO: 447764 - DNA, 25 bp, Mus musculus
agcggagagcgctccagcacgcacg

SEQ ID NO: 447765 - DNA, 25 bp, Mus musculus
acccagagtttgaaatggtgcgtgg

SEQ ID NO: 447766 - DNA, 25 bp, Mus musculus
tccaaagcacccagagtttgaaatg

SEQ ID NO: 447767 - DNA, 25 bp, Mus musculus
cgggaagtttccaaagcacccagag

SEQ ID NO: 447768 - DNA, 25 bp, Mus musculus
ttctgtgcactccaccggagaagcc

SEQ ID NO: 447769 - DNA, 25 bp, Mus musculus
tcgtttctgtgcactccaccggaga

SEQ ID NO: 447770 - DNA, 25 bp, Mus musculus
gttctcaccgcacgcctcgtttctg

SEQ ID NO: 447771 - DNA, 25 bp, Mus musculus
caaggttcgcgacagtcaccgctgg

SEQ ID NO: 447772 - DNA, 25 bp, Mus musculus
ttgagcgccatagtctctcccactg

SEQ ID NO: 447773 - DNA, 25 bp, Mus musculus
gtcagccaatcatagttcctgcgcg

SEQ ID NO: 447774 - DNA, 25 bp, Mus musculus
aagtctccaggatccttccgccgtg

SEQ ID NO: 447775 - DNA, 25 bp, Mus musculus
tccaggatccttccgccgtgttttc

SEQ ID NO: 447776 - DNA, 25 bp, Mus musculus
gtgttttcacctctcagtgttgttg

SEQ ID NO: 447777 - DNA, 25 bp, Mus musculus
cacctctcagtgttgttgacgatca

SEQ ID NO: 447778 - DNA, 25 bp, Mus musculus
tgttgttgacgatcactccgccgcc

SEQ ID NO: 447779 - DNA, 25 bp, Mus musculus
tctgagtgattcttgttgagcgcca

SEQ ID NO: 447780 - DNA, 25 bp, Mus musculus
agtctctcccactggggtcccgaga

SEQ ID NO: 447781 - DNA, 25 bp, Mus musculus
caacgctctgcgcttgcgctggtct

SEQ ID NO: 447782 - DNA, 25 bp, Mus musculus
gcgctggtctttggcccgcctctag

SEQ ID NO: 447783 - DNA, 25 bp, Mus musculus
gcctctagtggcgtcgttcgtatta

SEQ ID NO: 447784 - DNA, 25 bp, Mus musculus
cgttcgtattacagtcagccaatca

SEQ ID NO: 447785 - DNA, 25 bp, Mus musculus
gggtcccgagactcgcaacgctctg

SEQ ID NO: 447786 - DNA, 25 bp, Mus musculus
cctctagtcttacgggacttaagct

SEQ ID NO: 447787 - DNA, 25 bp, Mus musculus
ggtgagatcaccctacaagctgtga

SEQ ID NO: 447788 - DNA, 25 bp, Mus musculus
cgcactgctcactcccgcgccacgc

SEQ ID NO: 447789 - DNA, 25 bp, Mus musculus
ccgctgtggacttccctggtgcaga

SEQ ID NO: 447790 - DNA, 25 bp, Mus musculus
acttccctggtgcagacatggcctc

SEQ ID NO: 447791 - DNA, 25 bp, Mus musculus
ctggtgcagacatggcctcgggctc

SEQ ID NO: 447792 - DNA, 25 bp, Mus musculus
cacggcggtgaaggtgagatcaccc

SEQ ID NO: 447793 - DNA, 25 bp, Mus musculus
caagctgtgaatgggccagccctgc

SEQ ID NO: 447794 - DNA, 25 bp, Mus musculus
gcagggttccttctcgagcctccag

SEQ ID NO: 447795 - DNA, 25 bp, Mus musculus
gttccttctcgagcctccaggctgt

SEQ ID NO: 447796 - DNA, 25 bp, Mus musculus
cccagcctttgaactcatctgcatt

SEQ ID NO: 447797 - DNA, 25 bp, Mus musculus
gaactcatctgcattccgggcccga

SEQ ID NO: 447798 - DNA, 25 bp, Mus musculus
cggctgctgcgtcggtccctctagt

SEQ ID NO: 447799 - DNA, 25 bp, Mus musculus
gctgccaccctcttttagtaccact

SEQ ID NO: 447800 - DNA, 25 bp, Mus musculus
tgagcagaagagctgctacgtgaac

SEQ ID NO: 447801 - DNA, 25 bp, Mus musculus
cggaacgcaaatatcgcacgatgtc

SEQ ID NO: 447802 - DNA, 25 bp, Mus musculus
ggcgacgttcccagcggtacacaaa

SEQ ID NO: 447803 - DNA, 25 bp, Mus musculus
cgttcccagcggtacacaaagacca

SEQ ID NO: 447804 - DNA, 25 bp, Mus musculus
tacacaaagaccacccagcggaaca

SEQ ID NO: 447805 - DNA, 25 bp, Mus musculus
accacccagcggaacacaaagagca

SEQ ID NO: 447806 - DNA, 25 bp, Mus musculus
gagcacccagcggaacgcaaatatc

SEQ ID NO: 447807 - DNA, 25 bp, Mus musculus
atatcgcacgatgtcttgatgtccc

SEQ ID NO: 447808 - DNA, 25 bp, Mus musculus
cgctcttgggccaagtcgagcggca

SEQ ID NO: 447809 - DNA, 25 bp, Mus musculus
aggcatcgcgcacatccagccgagc

SEQ ID NO: 447810 - DNA, 25 bp, Mus musculus
agcaccaccagcgtgtccaggaagc

SEQ ID NO: 447811 - DNA, 25 bp, Mus musculus
gtagtggggtcctcgcagttcgaat

SEQ ID NO: 447812 - DNA, 25 bp, Mus musculus
caccgtagttgagcagaagagctgc

SEQ ID NO: 447813 - DNA, 25 bp, Mus musculus
cagttcgaatctgcaccgtagttga

SEQ ID NO: 447814 - DNA, 25 bp, Mus musculus
ctagcagtagctgcgccctttcgca

SEQ ID NO: 447815 - DNA, 25 bp, Mus musculus
tttcggttttaagcgcgagcatccc

SEQ ID NO: 447816 - DNA, 25 bp, Mus musculus
cgcagcccgaggacgttgtttattt

SEQ ID NO: 447817 - DNA, 25 bp, Mus musculus
ttttgaacccttagcggtacgctgc

SEQ ID NO: 447818 - DNA, 25 bp, Mus musculus
aggtttcccttgctccgagtccatc

SEQ ID NO: 447819 - DNA, 25 bp, Mus musculus
gccgatcggctttcgctccggttaa

SEQ ID NO: 447820 - DNA, 25 bp, Mus musculus
cagtcgcgcgggaaagcttcccaga

SEQ ID NO: 447821 - DNA, 25 bp, Mus musculus
cttcggcgttgaggcacctcgagac

SEQ ID NO: 447822 - DNA, 25 bp, Mus musculus
ctcagcggcggcctcactgtgacaa

SEQ ID NO: 447823 - DNA, 25 bp, Mus musculus
gcgcgctgaatcctcacagtgacca

SEQ ID NO: 447824 - DNA, 25 bp, Mus musculus
gggatcgcacgaacttcaccaagaa

SEQ ID NO: 447825 - DNA, 25 bp, Mus musculus
atgttcacgaaagccagagcgcagc

SEQ ID NO: 447826 - DNA, 25 bp, Mus musculus
ggtgcggccctcttctcaagatcct

SEQ ID NO: 447827 - DNA, 25 bp, Mus musculus
cccgaaactttcgtctatgcctgac

SEQ ID NO: 447828 - DNA, 25 bp, Mus musculus
acaggcttctgtaccaggggtcgtc

SEQ ID NO: 447829 - DNA, 25 bp, Mus musculus
tctggacagcgcacttgctggtttc

SEQ ID NO: 447830 - DNA, 25 bp, Mus musculus
tcggtcaggttctggagctcttaga

SEQ ID NO: 447831 - DNA, 25 bp, Mus musculus
ttagacccggcggtttcttgctctg

SEQ ID NO: 447832 - DNA, 25 bp, Mus musculus
ctctgggacaggacagcaaactcta

SEQ ID NO: 447833 - DNA, 25 bp, Mus musculus
gcaaactctagttagtgcgcggagc

SEQ ID NO: 447834 - DNA, 25 bp, Mus musculus
cccacagggtagctctggacagcgc

SEQ ID NO: 447835 - DNA, 25 bp, Mus musculus
tgctggtttctactcctcagaggcg

SEQ ID NO: 447836 - DNA, 25 bp, Mus musculus
gcgccttctcagaatggagcgatta

SEQ ID NO: 447837 - DNA, 25 bp, Mus musculus
ggagcgattacctcacggtcgtaga

SEQ ID NO: 447838 - DNA, 25 bp, Mus musculus
ccgcctggcctttttctgcgatcga

SEQ ID NO: 447839 - DNA, 25 bp, Mus musculus
ttctgcgatcgaccgcaagctccgg

SEQ ID NO: 447840 - DNA, 25 bp, Mus musculus
gcgcgtgtgccaagtgcaccctgat

SEQ ID NO: 447841 - DNA, 25 bp, Mus musculus
cgctgtcgcaaccatggcgtggtgt

SEQ ID NO: 447842 - DNA, 25 bp, Mus musculus
ctcccataaggtggccgaaggcgcc

SEQ ID NO: 447843 - DNA, 25 bp, Mus musculus
gcgagctagctgaacccgaagcctg

SEQ ID NO: 447844 - DNA, 25 bp, Mus musculus
ctgcgaagcagagcatccgcgcttc

SEQ ID NO: 447845 - DNA, 25 bp, Mus musculus
ttcgcgccactagcgcgcaggcaga

SEQ ID NO: 447846 - DNA, 25 bp, Mus musculus
tcagctgcgcctaccacgcaaaagg

SEQ ID NO: 447847 - DNA, 25 bp, Mus musculus
gagcagctgcgtgtcctcccataag

SEQ ID NO: 447848 - DNA, 25 bp, Mus musculus
aatgcactcacctgcgtctgggcgc

SEQ ID NO: 447849 - DNA, 25 bp, Mus musculus
cgcagtttcccggtggcgctacacg

SEQ ID NO: 447850 - DNA, 25 bp, Mus musculus
tgcagagtacgtccacgcccgtgca

SEQ ID NO: 447851 - DNA, 25 bp, Mus musculus
ccctgcaggaacttcgcgggcgcta

SEQ ID NO: 447852 - DNA, 25 bp, Mus musculus
tacacttgcctgctgcggctcggct

SEQ ID NO: 447853 - DNA, 25 bp, Mus musculus
ccgacagcaccgctcagaggagtca

SEQ ID NO: 447854 - DNA, 25 bp, Mus musculus
taccgaccggctgctgcctcagtga

SEQ ID NO: 447855 - DNA, 25 bp, Mus musculus
cacgcaaaagggatcaccacggctc

SEQ ID NO: 447856 - DNA, 25 bp, Mus musculus
ctccgctgcgtaggaccaaggacag

SEQ ID NO: 447857 - DNA, 25 bp, Mus musculus
ctgcacccggagaaatcacaaaagt

SEQ ID NO: 447858 - DNA, 25 bp, Mus musculus
ctcgtgccgataatttaaacttctc

SEQ ID NO: 447859 - DNA, 25 bp, Mus musculus
taaacttctccgaggcaaagccagc

SEQ ID NO: 447860 - DNA, 25 bp, Mus musculus
gaggcaaagccagcacctcggtccg

SEQ ID NO: 447861 - DNA, 25 bp, Mus musculus
cccggattcgctctttcgcagtaga

SEQ ID NO: 447862 - DNA, 25 bp, Mus musculus
tcgcagtagaaagccggctgttttc

SEQ ID NO: 447863 - DNA, 25 bp, Mus musculus
aaatgaagcgtgtgcctgtctgccc

SEQ ID NO: 447864 - DNA, 25 bp, Mus musculus
caaccatctttctcctggcgtcagt

SEQ ID NO: 447865 - DNA, 25 bp, Mus musculus
tcctggcgtcagttttaacaatagc

SEQ ID NO: 447866 - DNA, 25 bp, Mus musculus
taacaatagctactcgaggaagggg

SEQ ID NO: 447867 - DNA, 25 bp, Mus musculus
tatacagccgactcagctccctggg

SEQ ID NO: 447868 - DNA, 25 bp, Mus musculus
tcgcggctgccagtgagtctccctt

SEQ ID NO: 447869 - DNA, 25 bp, Mus musculus
agctccctgggtagctgcgatgcct

SEQ ID NO: 447870 - DNA, 25 bp, Mus musculus
ggctagcctattggttccacgcgtg

SEQ ID NO: 447871 - DNA, 25 bp, Mus musculus
acgaggataccaaccgggcacagtc

SEQ ID NO: 447872 - DNA, 25 bp, Mus musculus
ggcacagtcgagcacccgctgcggt

SEQ ID NO: 447873 - DNA, 25 bp, Mus musculus
cgctcttgagctcttcgccttctga

SEQ ID NO: 447874 - DNA, 25 bp, Mus musculus
cccgccagttttgtgacgtcacgga

SEQ ID NO: 447875 - DNA, 25 bp, Mus musculus
atcccttccatttggcgcggctagc

SEQ ID NO: 447876 - DNA, 25 bp, Mus musculus
gtgaccacgccctgttgctggtgaa

SEQ ID NO: 447877 - DNA, 25 bp, Mus musculus
tgggttgcgtttggactcccagatg

SEQ ID NO: 447878 - DNA, 25 bp, Mus musculus
cctgggcgggatccagcatccctga

SEQ ID NO: 447879 - DNA, 25 bp, Mus musculus
atccctgagcgcgtggcgctttggt

SEQ ID NO: 447880 - DNA, 25 bp, Mus musculus
cgctttggtagccagttgcttcctg

SEQ ID NO: 447881 - DNA, 25 bp, Mus musculus
ggctttcgcgaatgcctggcacttc

SEQ ID NO: 447882 - DNA, 25 bp, Mus musculus
tggcctgagagccaagcctcctctg

SEQ ID NO: 447883 - DNA, 25 bp, Mus musculus
cgtcacggaggtcagacaatccctt

SEQ ID NO: 447884 - DNA, 25 bp, Mus musculus
tgcttctgcagtgcatctcgctcgc

SEQ ID NO: 447885 - DNA, 25 bp, Mus musculus
acagaaggtgcttctgcagtgcatc

SEQ ID NO: 447886 - DNA, 25 bp, Mus musculus
gggcctcctggagaggttcggagga

SEQ ID NO: 447887 - DNA, 25 bp, Mus musculus
gccgcggtactcaggtgccctgggc

SEQ ID NO: 447888 - DNA, 25 bp, Mus musculus
actccgcgcaactccgggaggcgcc

SEQ ID NO: 447889 - DNA, 25 bp, Mus musculus
gtccactccgcgcaactccgggagg

SEQ ID NO: 447890 - DNA, 25 bp, Mus musculus
aggtgtgctgcaggcactgtggcca

SEQ ID NO: 447891 - DNA, 25 bp, Mus musculus
acccacgcagcctgctggggagtgc

SEQ ID NO: 447892 - DNA, 25 bp, Mus musculus
cggaacccacgcagcctgctgggga

SEQ ID NO: 447893 - DNA, 25 bp, Mus musculus
ggtgcttctgcagtgcatctcgctc

SEQ ID NO: 447894 - DNA, 25 bp, Mus musculus
aaggtgcttctgcagtgcatctcgc

SEQ ID NO: 447895 - DNA, 25 bp, Mus musculus
agaaggtgcttctgcagtgcatctc

SEQ ID NO: 447896 - DNA, 25 bp, Mus musculus
atctcgctcgctgatctccctggcg

SEQ ID NO: 447897 - DNA, 25 bp, Mus musculus
tggcggaacccacgcagcctgctgg

SEQ ID NO: 447898 - DNA, 25 bp, Mus musculus
catgcgccacatcggtccggtctgg

SEQ ID NO: 447899 - DNA, 25 bp, Mus musculus
tcggactacagccagggcctcggaa

SEQ ID NO: 447900 - DNA, 25 bp, Mus musculus
cagggcctcggaacgtccggatcat

SEQ ID NO: 447901 - DNA, 25 bp, Mus musculus
aacgtccggatcatgggcgcacagg

SEQ ID NO: 447902 - DNA, 25 bp, Mus musculus
tcggcggtacatgacctccagcttc

SEQ ID NO: 447903 - DNA, 25 bp, Mus musculus
atgacctccagcttctctagccggg

SEQ ID NO: 447904 - DNA, 25 bp, Mus musculus
ggccatggcctctcgccttgcggtt

SEQ ID NO: 447905 - DNA, 25 bp, Mus musculus
aagaggctgcggttctcgcgcctga

SEQ ID NO: 447906 - DNA, 25 bp, Mus musculus
ttctccagcctcaggcgggcgttct

SEQ ID NO: 447907 - DNA, 25 bp, Mus musculus
cgagctgaggcgtgtccttgtctct

SEQ ID NO: 447908 - DNA, 25 bp, Mus musculus
tgtccttgtctctcgcggctgagcg

SEQ ID NO: 447909 - DNA, 25 bp, Mus musculus
tcagccctgtgtccgtgcccggaaa

SEQ ID NO: 447910 - DNA, 25 bp, Mus musculus
aaagccttgtcctctgctgggtgcc

SEQ ID NO: 447911 - DNA, 25 bp, Mus musculus
tgagccgacggttctccagcctcag

SEQ ID NO: 447912 - DNA, 25 bp, Mus musculus
cgccgcttttctcgggaagacttct

SEQ ID NO: 447913 - DNA, 25 bp, Mus musculus
ttactacgcgtagcttctggaggcg

SEQ ID NO: 447914 - DNA, 25 bp, Mus musculus
ccggcgcgttttactacgcgtagct

SEQ ID NO: 447915 - DNA, 25 bp, Mus musculus
gctgtcgcagacttggcgtcacttc

SEQ ID NO: 447916 - DNA, 25 bp, Mus musculus
atggtcctcgcgctgcaaccatcgg

SEQ ID NO: 447917 - DNA, 25 bp, Mus musculus
gcttgcgccgcttttctcgggaaga

SEQ ID NO: 447918 - DNA, 25 bp, Mus musculus
aatcggtgctcctccgctttcggcg

SEQ ID NO: 447919 - DNA, 25 bp, Mus musculus
acgctggaggacgaatcggtgctcc

SEQ ID NO: 447920 - DNA, 25 bp, Mus musculus
cgaggcgaggcacgcacctgctgca

SEQ ID NO: 447921 - DNA, 25 bp, Mus musculus
cggctcttctgaggggccgcagctc

SEQ ID NO: 447922 - DNA, 25 bp, Mus musculus
tctgcagcccggctcttctgagggg

SEQ ID NO: 447923 - DNA, 25 bp, Mus musculus
cccggcactaacaatgagcttctgc

SEQ ID NO: 447924 - DNA, 25 bp, Mus musculus
gactcagaacggaaccggcggccca

SEQ ID NO: 447925 - DNA, 25 bp, Mus musculus
agccgaccgtctctgcagcaacaga

SEQ ID NO: 447926 - DNA, 25 bp, Mus musculus
tcctgagtggcacaggcctcgcaaa

SEQ ID NO: 447927 - DNA, 25 bp, Mus musculus
cttgagacttctacccagcgtgggc

SEQ ID NO: 447928 - DNA, 25 bp, Mus musculus
cacgcgacagtagcgctccagaggc

SEQ ID NO: 447929 - DNA, 25 bp, Mus musculus
tggcgcggacacaggctctcctcaa

SEQ ID NO: 447930 - DNA, 25 bp, Mus musculus
acaggctctcctcaagtcggcgcag

SEQ ID NO: 447931 - DNA, 25 bp, Mus musculus
cagcaactcggacagcgtgtggttc

SEQ ID NO: 447932 - DNA, 25 bp, Mus musculus
tcggggaaaggctcctgacaaagtg

SEQ ID NO: 447933 - DNA, 25 bp, Mus musculus
acagcgagctggacctccggaacca

SEQ ID NO: 447934 - DNA, 25 bp, Mus musculus
cccaggcaagcgaggcagaagttgt

SEQ ID NO: 447935 - DNA, 25 bp, Mus musculus
gccgcagggtagtgtcaccggctcc

SEQ ID NO: 447936 - DNA, 25 bp, Mus musculus
ctcccggagcggttccaggcagatg

SEQ ID NO: 447937 - DNA, 25 bp, Mus musculus
tgctgctcccgcctgggagggacct

SEQ ID NO: 447938 - DNA, 25 bp, Mus musculus
gggagcacgaccctcttgagacttc

SEQ ID NO: 447939 - DNA, 25 bp, Mus musculus
ctgctccagcggcacgagctcgtgg

SEQ ID NO: 447940 - DNA, 25 bp, Mus musculus
ccacaatgccgagcgtcccgagtga

SEQ ID NO: 447941 - DNA, 25 bp, Mus musculus
tcggtttcacagacagcgcccgaaa

SEQ ID NO: 447942 - DNA, 25 bp, Mus musculus
cgaaaagccaaagctcgggactcgg

SEQ ID NO: 447943 - DNA, 25 bp, Mus musculus
gagggtcactcctcccacgtgtctg

SEQ ID NO: 447944 - DNA, 25 bp, Mus musculus
tgtctgcaagcctgtggtccacccg

SEQ ID NO: 447945 - DNA, 25 bp, Mus musculus
tcccgggacacagacacaaaggctc

SEQ ID NO: 447946 - DNA, 25 bp, Mus musculus
gacacaaaggctcccggcgggtaga

SEQ ID NO: 447947 - DNA, 25 bp, Mus musculus
ctcacgtccagttcgtggcccggga

SEQ ID NO: 447948 - DNA, 25 bp, Mus musculus
gcgagcagctcagccggtatctgga

SEQ ID NO: 447949 - DNA, 25 bp, Mus musculus
gggcacagcgcgagactcgtccaca

SEQ ID NO: 447950 - DNA, 25 bp, Mus musculus
ccgagccgcctgagtgacacagcaa

SEQ ID NO: 447951 - DNA, 25 bp, Mus musculus
gagcatcacggaccgggccctctat

SEQ ID NO: 447952 - DNA, 25 bp, Mus musculus
ggaacccggtccatttcagagaaca

SEQ ID NO: 447953 - DNA, 25 bp, Mus musculus
atcaggaaattctgcgtaggcgccg

SEQ ID NO: 447954 - DNA, 25 bp, Mus musculus
cgttgctaggatacgcggcgtcgct

SEQ ID NO: 447955 - DNA, 25 bp, Mus musculus
tcacgaggagcgttttccgcgcggt

SEQ ID NO: 447956 - DNA, 25 bp, Mus musculus
caggccaatcacgaggagcgttttc

SEQ ID NO: 447957 - DNA, 25 bp, Mus musculus
atctgaggcgcagcgcaggccaatc

SEQ ID NO: 447958 - DNA, 25 bp, Mus musculus
cgcggtgaccgttgctaggatacgc

SEQ ID NO: 447959 - DNA, 25 bp, Mus musculus
ctgtctctgctctggtgagcggtga

SEQ ID NO: 447960 - DNA, 25 bp, Mus musculus
tctgctctggtgagcggtgaaacgc

SEQ ID NO: 447961 - DNA, 25 bp, Mus musculus
gcgctcgcgttgactcctcagaaag

SEQ ID NO: 447962 - DNA, 25 bp, Mus musculus
cgcgttgactcctcagaaagaagtt

SEQ ID NO: 447963 - DNA, 25 bp, Mus musculus
ctcctcagaaagaagttcatgtcgc

SEQ ID NO: 447964 - DNA, 25 bp, Mus musculus
aagaagttcatgtcgcggggaccta

SEQ ID NO: 447965 - DNA, 25 bp, Mus musculus
atgtcgcggggacctagcggcaccc

SEQ ID NO: 447966 - DNA, 25 bp, Mus musculus
cccactttaagtaccggaatctgag

SEQ ID NO: 447967 - DNA, 25 bp, Mus musculus
taagtaccggaatctgaggcgcagc

SEQ ID NO: 447968 - DNA, 25 bp, Mus musculus
acagcgcgaatgcaggtaggaatcc

SEQ ID NO: 447969 - DNA, 25 bp, Mus musculus
tgggctaactcacagcagatctttt

SEQ ID NO: 447970 - DNA, 25 bp, Mus musculus
tgtctctggttcattttcgcacaca

SEQ ID NO: 447971 - DNA, 25 bp, Mus musculus
gagaccctgctttgtggcatccatt

SEQ ID NO: 447972 - DNA, 25 bp, Mus musculus
ctttttccattcaggcgagagaccc

SEQ ID NO: 447973 - DNA, 25 bp, Mus musculus
cacgtcttacgtgggctaactcaca

SEQ ID NO: 447974 - DNA, 25 bp, Mus musculus
tgggttatctcacttctctcacgtc

SEQ ID NO: 447975 - DNA, 25 bp, Mus musculus
cccaaggaccgcatgggttatctca

SEQ ID NO: 447976 - DNA, 25 bp, Mus musculus
caggagactgcgtgaaagctgcttc

SEQ ID NO: 447977 - DNA, 25 bp, Mus musculus
catgactgcacctgacgcaggcgta

SEQ ID NO: 447978 - DNA, 25 bp, Mus musculus
actgtccatcgcagcccagaaagtg

SEQ ID NO: 447979 - DNA, 25 bp, Mus musculus
ttagacgccagtgttcaagatgctg

SEQ ID NO: 447980 - DNA, 25 bp, Mus musculus
ctagcgggcgcaggactaaattaga

SEQ ID NO: 447981 - DNA, 25 bp, Mus musculus
cccagaaagtggagataaacagtgc

SEQ ID NO: 447982 - DNA, 25 bp, Mus musculus
tagggttactgtagccgtaggcacc

SEQ ID NO: 447983 - DNA, 25 bp, Mus musculus
gcccggacttgtgagcttcttctcc

SEQ ID NO: 447984 - DNA, 25 bp, Mus musculus
gggcatcgtcgtagaaggtcgtttc

SEQ ID NO: 447985 - DNA, 25 bp, Mus musculus
ggtcgtttccatctttgcagtcata

SEQ ID NO: 447986 - DNA, 25 bp, Mus musculus
ctttgcagtcatagaacggtccgtc

SEQ ID NO: 447987 - DNA, 25 bp, Mus musculus
tccgtcacttcacgcggggttagcc

SEQ ID NO: 447988 - DNA, 25 bp, Mus musculus
cagggttaagactccgctagcactc

SEQ ID NO: 447989 - DNA, 25 bp, Mus musculus
gcgcgatgccgagctttgaaaagtc

SEQ ID NO: 447990 - DNA, 25 bp, Mus musculus
gtgctgaccagtcgtcacggaattc

SEQ ID NO: 447991 - DNA, 25 bp, Mus musculus
ccgcctgtgcgaactggtatgagta

SEQ ID NO: 447992 - DNA, 25 bp, Mus musculus
tttctttacagtctcggtggcagcc

SEQ ID NO: 447993 - DNA, 25 bp, Mus musculus
cggccacttgttaccggtcctctgg

SEQ ID NO: 447994 - DNA, 25 bp, Mus musculus
agccgctctcgatgctgtcagcagc

SEQ ID NO: 447995 - DNA, 25 bp, Mus musculus
caaggtcatgctctgttttaggatc

SEQ ID NO: 447996 - DNA, 25 bp, Mus musculus
ccatagaaggtaaagcctgggcaga

SEQ ID NO: 447997 - DNA, 25 bp, Mus musculus
actgtcaacatgtcctgagcgcttc

SEQ ID NO: 447998 - DNA, 25 bp, Mus musculus
tgagcgcttcttgggtactaggttc

SEQ ID NO: 447999 - DNA, 25 bp, Mus musculus
tactaggttcggtccctgtcgccaa

SEQ ID NO: 448000 - DNA, 25 bp, Mus musculus
cctgtcgccaaacataatgaccaga

SEQ ID NO: 448001 - DNA, 25 bp, Mus musculus
tctttctcctctcctagctctaaga

SEQ ID NO: 448002 - DNA, 25 bp, Mus musculus
ggctgctggtttcagtttctgaaga

SEQ ID NO: 448003 - DNA, 25 bp, Mus musculus
tcagtttctgaagagctaggccttg

SEQ ID NO: 448004 - DNA, 25 bp, Mus musculus
agagctaggccttgagcaaacactg

SEQ ID NO: 448005 - DNA, 25 bp, Mus musculus
cttgagcaaacactggctggcggga

SEQ ID NO: 448006 - DNA, 25 bp, Mus musculus
gagggtgttggacgccttcccaaca

SEQ ID NO: 448007 - DNA, 25 bp, Mus musculus
ggacgccttcccaacagataatgtg

SEQ ID NO: 448008 - DNA, 25 bp, Mus musculus
agataatgtgattccctgccgctgg

SEQ ID NO: 448009 - DNA, 25 bp, Mus musculus
tgaccagacattattttctttctcc

SEQ ID NO: 448010 - DNA, 25 bp, Mus musculus
gccgctgtgtgacagcctcatcatc

SEQ ID NO: 448011 - DNA, 25 bp, Mus musculus
ttgcacctgccaggtcataaacctc

SEQ ID NO: 448012 - DNA, 25 bp, Mus musculus
tgagagctccgcctcgcacaggtga

SEQ ID NO: 448013 - DNA, 25 bp, Mus musculus
catcatctgggtgagtgtagttcca

SEQ ID NO: 448014 - DNA, 25 bp, Mus musculus
ctcgcacaggtgaccaggaggcgct

SEQ ID NO: 448015 - DNA, 25 bp, Mus musculus
tgccacagtccgagctgccgctgtg

SEQ ID NO: 448016 - DNA, 25 bp, Mus musculus
gttctcggaccatggaggacccgca

SEQ ID NO: 448017 - DNA, 25 bp, Mus musculus
acgtctgcgccgtgaggcttcgcgc

SEQ ID NO: 448018 - DNA, 25 bp, Mus musculus
gtcactcagcgtgcggtgtgcgatc

SEQ ID NO: 448019 - DNA, 25 bp, Mus musculus
ggtgctcgcagaggtcactcagcgt

SEQ ID NO: 448020 - DNA, 25 bp, Mus musculus
agcttctttgtgactggtgctcgca

SEQ ID NO: 448021 - DNA, 25 bp, Mus musculus
tggagcgcgtccaatcagcagccct

SEQ ID NO: 448022 - DNA, 25 bp, Mus musculus
tccttgattggccaagagtctctgg

SEQ ID NO: 448023 - DNA, 25 bp, Mus musculus
tgtagttccacgcttgccagcgagg

SEQ ID NO: 448024 - DNA, 25 bp, Mus musculus
ccgccgggtcacaagagaggctctg

SEQ ID NO: 448025 - DNA, 25 bp, Mus musculus
atgaacctttccaacgcgcgcgctg

SEQ ID NO: 448026 - DNA, 25 bp, Mus musculus
ccgaggccctgaaactcttaaaatg

SEQ ID NO: 448027 - DNA, 25 bp, Mus musculus
atcggatcaccaaaccgaggccctg

SEQ ID NO: 448028 - DNA, 25 bp, Mus musculus
tgaaagttgtcacccgatcggatca

SEQ ID NO: 448029 - DNA, 25 bp, Mus musculus
agaggctctgggatgaaagttgtca

SEQ ID NO: 448030 - DNA, 25 bp, Mus musculus
gcgccctctggtgtccgcttgaggc

SEQ ID NO: 448031 - DNA, 25 bp, Mus musculus
aagcacattaaagcggcgccctctg

SEQ ID NO: 448032 - DNA, 25 bp, Mus musculus
atcccgggctgaagcacattaaagc

SEQ ID NO: 448033 - DNA, 25 bp, Mus musculus
cccttcgaggatcccgggctgaagc

SEQ ID NO: 448034 - DNA, 25 bp, Mus musculus
gaactggatccctagcccgactcta

SEQ ID NO: 448035 - DNA, 25 bp, Mus musculus
cgcgcccatcaggttacagagaact

SEQ ID NO: 448036 - DNA, 25 bp, Mus musculus
tcccagaggggtcccgcagattatc

SEQ ID NO: 448037 - DNA, 25 bp, Mus musculus
gcagattatcggatcgcgcccatca

SEQ ID NO: 448038 - DNA, 25 bp, Mus musculus
tgcccatgagacttcgcagagaact

SEQ ID NO: 448039 - DNA, 25 bp, Mus musculus
atggccgccacaggccttgtacgcg

SEQ ID NO: 448040 - DNA, 25 bp, Mus musculus
aacgagatctgaccgccatggccgc

SEQ ID NO: 448041 - DNA, 25 bp, Mus musculus
tgaagaacgagatctgaccgccatg

SEQ ID NO: 448042 - DNA, 25 bp, Mus musculus
tccgggatgaagaacgagatctgac

SEQ ID NO: 448043 - DNA, 25 bp, Mus musculus
ccagtccgggatgaagaacgagatc

SEQ ID NO: 448044 - DNA, 25 bp, Mus musculus
tgagacttcgcagagaactaagaga

SEQ ID NO: 448045 - DNA, 25 bp, Mus musculus
aagggaaggagaagatttgtgccca

SEQ ID NO: 448046 - DNA, 25 bp, Mus musculus
tcgcaggtctcaggccgccggaaag

SEQ ID NO: 448047 - DNA, 25 bp, Mus musculus
actggttgaagtcgcaggtctcagg

SEQ ID NO: 448048 - DNA, 25 bp, Mus musculus
tgtcaaagtactggttgaagtcgca

SEQ ID NO: 448049 - DNA, 25 bp, Mus musculus
gcgccgagatgtcaaagtactggtt

SEQ ID NO: 448050 - DNA, 25 bp, Mus musculus
caggagagcgccgagatgtcaaagt

SEQ ID NO: 448051 - DNA, 25 bp, Mus musculus
aactaagagaaggtaggcggtgcca

SEQ ID NO: 448052 - DNA, 25 bp, Mus musculus
aagatcgaccgaagtccttcctacg

SEQ ID NO: 448053 - DNA, 25 bp, Mus musculus
tcaggacccggtatcggcgccctgt

SEQ ID NO: 448054 - DNA, 25 bp, Mus musculus
gcgccctgtgcggtctcttcgtgct

SEQ ID NO: 448055 - DNA, 25 bp, Mus musculus
gctccggcctgaccctgagcttttt

SEQ ID NO: 448056 - DNA, 25 bp, Mus musculus
tgaccctgagctttttcgttgcaaa

SEQ ID NO: 448057 - DNA, 25 bp, Mus musculus
ttcgttgcaaagttgggttcccata

SEQ ID NO: 448058 - DNA, 25 bp, Mus musculus
cccatcttgcacacgttggggtgta

SEQ ID NO: 448059 - DNA, 25 bp, Mus musculus
ttggggagtgatcacaccacagctg

SEQ ID NO: 448060 - DNA, 25 bp, Mus musculus
accacagctgatctgggagcacttc

SEQ ID NO: 448061 - DNA, 25 bp, Mus musculus
agtggagtcagtcctacagtggctg

SEQ ID NO: 448062 - DNA, 25 bp, Mus musculus
agtgaccgggtcatcgggatgtccc

SEQ ID NO: 448063 - DNA, 25 bp, Mus musculus
aacctccggcctgggttgttctgct

SEQ ID NO: 448064 - DNA, 25 bp, Mus musculus
ccctcttgaagatcgaccgaagtcc

SEQ ID NO: 448065 - DNA, 25 bp, Mus musculus
ttctgctgtggccacaggcggactt

SEQ ID NO: 448066 - DNA, 25 bp, Mus musculus
gattcaaacatgcaaaaccggcgtg

SEQ ID NO: 448067 - DNA, 25 bp, Mus musculus
ggggctcccattggccacaagccgt

SEQ ID NO: 448068 - DNA, 25 bp, Mus musculus
ctcgggcgtggttactatgcaaatt

SEQ ID NO: 448069 - DNA, 25 bp, Mus musculus
tactatgcaaattgcagcgattgcg

SEQ ID NO: 448070 - DNA, 25 bp, Mus musculus
caggtgtgcgaacgtgattcaaaca

SEQ ID NO: 448071 - DNA, 25 bp, Mus musculus
aaaccggcgtgaactgcgggcaaag

SEQ ID NO: 448072 - DNA, 25 bp, Mus musculus
tgcgggcaaaggaactataatcttc

SEQ ID NO: 448073 - DNA, 25 bp, Mus musculus
ataatcttcccatctcttacgagcc

SEQ ID NO: 448074 - DNA, 25 bp, Mus musculus
tcttacgagcctgctgcaacctctg

SEQ ID NO: 448075 - DNA, 25 bp, Mus musculus
tgctgcaacctctgcaagcagggaa

SEQ ID NO: 448076 - DNA, 25 bp, Mus musculus
gagcggggcctatcaactcagaggc

SEQ ID NO: 448077 - DNA, 25 bp, Mus musculus
aactcagaggcggttctgcagccgg

SEQ ID NO: 448078 - DNA, 25 bp, Mus musculus
gtcccgacccgagcttgcgctgaag

SEQ ID NO: 448079 - DNA, 25 bp, Mus musculus
aaaccgacgaagcaggtgtgcgaac

SEQ ID NO: 448080 - DNA, 25 bp, Mus musculus
ttggcagggatccaagtcacccttg

SEQ ID NO: 448081 - DNA, 25 bp, Mus musculus
tgcccgccttctgacgcactgggag

SEQ ID NO: 448082 - DNA, 25 bp, Mus musculus
gccctccgtgcgacagaagaactcg

SEQ ID NO: 448083 - DNA, 25 bp, Mus musculus
cgcctgcagcaaggtgctcatcttc

SEQ ID NO: 448084 - DNA, 25 bp, Mus musculus
catcttcacgttgcgggacagcttg

SEQ ID NO: 448085 - DNA, 25 bp, Mus musculus
ggcgacattccggacacgacttttc

SEQ ID NO: 448086 - DNA, 25 bp, Mus musculus
acgacttttcgcaggaacgccatga

SEQ ID NO: 448087 - DNA, 25 bp, Mus musculus
acgccatgaatcctggatgcagttc

SEQ ID NO: 448088 - DNA, 25 bp, Mus musculus
atgcagttcccgcagaagctgtgcc

SEQ ID NO: 448089 - DNA, 25 bp, Mus musculus
gtcccggtagcgacctaagcagatg

SEQ ID NO: 448090 - DNA, 25 bp, Mus musculus
tcctccagcaactgagcggccatgg

SEQ ID NO: 448091 - DNA, 25 bp, Mus musculus
cgaggcccagtgctcagatctctta

SEQ ID NO: 448092 - DNA, 25 bp, Mus musculus
agatctcttaaaggggccgaggcta

SEQ ID NO: 448093 - DNA, 25 bp, Mus musculus
gcctggtgcactagaacgttccttg

SEQ ID NO: 448094 - DNA, 25 bp, Mus musculus
acgcccgcgtacagtagacagtata

SEQ ID NO: 448095 - DNA, 25 bp, Mus musculus
ggcgccctcttattaatgcgttaat

SEQ ID NO: 448096 - DNA, 25 bp, Mus musculus
gcgggcagtgctagccttagtccgt

SEQ ID NO: 448097 - DNA, 25 bp, Mus musculus
tgacacgctgcaatctggactctgg

SEQ ID NO: 448098 - DNA, 25 bp, Mus musculus
atgcgttaattaatatcggggcgcc

SEQ ID NO: 448099 - DNA, 25 bp, Mus musculus
gcacatggctaatggcgccctctta

SEQ ID NO: 448100 - DNA, 25 bp, Mus musculus
ctcggccatttgtgtgggcacatgg

SEQ ID NO: 448101 - DNA, 25 bp, Mus musculus
gtgcattcctcctgctcggccattt

SEQ ID NO: 448102 - DNA, 25 bp, Mus musculus
gtaactttgtttccatgcgggtgca

SEQ ID NO: 448103 - DNA, 25 bp, Mus musculus
tgtctcacccaggtaagcagctgcg

SEQ ID NO: 448104 - DNA, 25 bp, Mus musculus
gccgcccggcagttatgtattctcc

SEQ ID NO: 448105 - DNA, 25 bp, Mus musculus
ctctaggcggggttaaagttcagcg

SEQ ID NO: 448106 - DNA, 25 bp, Mus musculus
gcgctatgcctttaacgcccgcgta

SEQ ID NO: 448107 - DNA, 25 bp, Mus musculus
ctgctgcagttgagccgagttggaa

SEQ ID NO: 448108 - DNA, 25 bp, Mus musculus
accgtcacgagccacagggtgcgga

SEQ ID NO: 448109 - DNA, 25 bp, Mus musculus
agagccacagcggaggccacggtcc

SEQ ID NO: 448110 - DNA, 25 bp, Mus musculus
ccggggtccagctgaccgcctgaga

SEQ ID NO: 448111 - DNA, 25 bp, Mus musculus
tgaccgcctgagaacggcggctttc

SEQ ID NO: 448112 - DNA, 25 bp, Mus musculus
cggctttccggaggatattgtccca

SEQ ID NO: 448113 - DNA, 25 bp, Mus musculus
tccggaggatattgtcccaccctga

SEQ ID NO: 448114 - DNA, 25 bp, Mus musculus
gatattgtcccaccctgaggtcctc

SEQ ID NO: 448115 - DNA, 25 bp, Mus musculus
cggcgaccgtcacgagccacagggt

SEQ ID NO: 448116 - DNA, 25 bp, Mus musculus
gcaccgcgtcctcgcgcttccggtt

SEQ ID NO: 448117 - DNA, 25 bp, Mus musculus
cctcccggggtccaatggtcactag

SEQ ID NO: 448118 - DNA, 25 bp, Mus musculus
cggggtccaatggtcactagagcca

SEQ ID NO: 448119 - DNA, 25 bp, Mus musculus
caatggtcactagagccacagcgga

SEQ ID NO: 448120 - DNA, 25 bp, Mus musculus
gtcactagagccacagcggaggcca

SEQ ID NO: 448121 - DNA, 25 bp, Mus musculus
gtcctcacacttgggtgtctcctcg

SEQ ID NO: 448122 - DNA, 25 bp, Mus musculus
acctggcctcgagtgggcctcgcgt

SEQ ID NO: 448123 - DNA, 25 bp, Mus musculus
gtcgcccgatcaggtaacgctcgcg

SEQ ID NO: 448124 - DNA, 25 bp, Mus musculus
agaggaaccgacctggcctcgagtg

SEQ ID NO: 448125 - DNA, 25 bp, Mus musculus
ggagcagaggaaccgacctggcctc

SEQ ID NO: 448126 - DNA, 25 bp, Mus musculus
atcgcgcgtgctcgcggatctagcg

SEQ ID NO: 448127 - DNA, 25 bp, Mus musculus
cagcgatcgcgcgtgctcgcggatc

SEQ ID NO: 448128 - DNA, 25 bp, Mus musculus
tcaggtaacgctcgcggcgcaccga

SEQ ID NO: 448129 - DNA, 25 bp, Mus musculus
cttccgccaggtgaggaggccgtcc

SEQ ID NO: 448130 - DNA, 25 bp, Mus musculus
cagcagctgtacttccgccaggtga

SEQ ID NO: 448131 - DNA, 25 bp, Mus musculus
aggtgagggcagcagctgtacttcc

SEQ ID NO: 448132 - DNA, 25 bp, Mus musculus
gcggccgcacttccgtccaggtgag

SEQ ID NO: 448133 - DNA, 25 bp, Mus musculus
ccggacccttcacaggcgcgcagac

SEQ ID NO: 448134 - DNA, 25 bp, Mus musculus
aaggcctccggcctcctctccaggg

SEQ ID NO: 448135 - DNA, 25 bp, Mus musculus
cggcggcctgctacccacccagcca

SEQ ID NO: 448136 - DNA, 25 bp, Mus musculus
ctggaaagcaagagcgggtaccctc

SEQ ID NO: 448137 - DNA, 25 bp, Mus musculus
gacgcactagctgtgggcacaccta

SEQ ID NO: 448138 - DNA, 25 bp, Mus musculus
gtcttcagtggcacgatcctccttc

SEQ ID NO: 448139 - DNA, 25 bp, Mus musculus
tgcagctgcacggtcttcagtggca

SEQ ID NO: 448140 - DNA, 25 bp, Mus musculus
gaggacgccagaccacttaccttgg

SEQ ID NO: 448141 - DNA, 25 bp, Mus musculus
ggtctccctagtacccagagctgga

SEQ ID NO: 448142 - DNA, 25 bp, Mus musculus
cctgagtctcaaggacgacgagatc

SEQ ID NO: 448143 - DNA, 25 bp, Mus musculus
gagggtctgcaccacctgagtctca

SEQ ID NO: 448144 - DNA, 25 bp, Mus musculus
accgcagcgtccgtctgaggacagc

SEQ ID NO: 448145 - DNA, 25 bp, Mus musculus
ccagtcccgtaagctgcatccagga

SEQ ID NO: 448146 - DNA, 25 bp, Mus musculus
aggtagtcctgtaagccagccggga

SEQ ID NO: 448147 - DNA, 25 bp, Mus musculus
ctcggcgatatttaaggtagtcctg

SEQ ID NO: 448148 - DNA, 25 bp, Mus musculus
acaggcgcgatgttttgcaaaatga

SEQ ID NO: 448149 - DNA, 25 bp, Mus musculus
gaagcgaccgctgtgcaggagcaac

SEQ ID NO: 448150 - DNA, 25 bp, Mus musculus
tcctgagactgaggaaaacgcgcca

SEQ ID NO: 448151 - DNA, 25 bp, Mus musculus
agcggaaccctaacctcggcagaga

SEQ ID NO: 448152 - DNA, 25 bp, Mus musculus
acctcggcagagaaagcgcgcactg

SEQ ID NO: 448153 - DNA, 25 bp, Mus musculus
gcactggagcgccaatgagcttgca

SEQ ID NO: 448154 - DNA, 25 bp, Mus musculus
tgagcttgcaaagagccgctccagg

SEQ ID NO: 448155 - DNA, 25 bp, Mus musculus
gactgtcttctctgccggctaattg

SEQ ID NO: 448156 - DNA, 25 bp, Mus musculus
cgtataggtactttttgattggctc

SEQ ID NO: 448157 - DNA, 25 bp, Mus musculus
tttggaaattgttcagcctggattg

SEQ ID NO: 448158 - DNA, 25 bp, Mus musculus
ttggcgcatttgagcacctgaggaa

SEQ ID NO: 448159 - DNA, 25 bp, Mus musculus
actcgcgagtgctaatgtttaaaaa

SEQ ID NO: 448160 - DNA, 25 bp, Mus musculus
cgctgcctgcgctgtttaaactgca

SEQ ID NO: 448161 - DNA, 25 bp, Mus musculus
ctaccgttccagctggttccggagc

SEQ ID NO: 448162 - DNA, 25 bp, Mus musculus
gaaccggcactttccgtggacgcca

SEQ ID NO: 448163 - DNA, 25 bp, Mus musculus
tttcgcgcctctgcaacgtggagag

SEQ ID NO: 448164 - DNA, 25 bp, Mus musculus
gccgcgtacctgctgatcttctgag

SEQ ID NO: 448165 - DNA, 25 bp, Mus musculus
ggccgtgaccgtagccgccgaacgc

SEQ ID NO: 448166 - DNA, 25 bp, Mus musculus
ctgccgccacgaccgggaagaccca

SEQ ID NO: 448167 - DNA, 25 bp, Mus musculus
ccagggtaccgtaatgcgccgagga

SEQ ID NO: 448168 - DNA, 25 bp, Mus musculus
agcgcggaaccagggtaccgtaatg

SEQ ID NO: 448169 - DNA, 25 bp, Mus musculus
gtacctgctgatcttctgagcgaag

SEQ ID NO: 448170 - DNA, 25 bp, Mus musculus
ctgcggacacaaagaaccgccgagc

SEQ ID NO: 448171 - DNA, 25 bp, Mus musculus
tggcctccacgccagttccttttgt

SEQ ID NO: 448172 - DNA, 25 bp, Mus musculus
tgcactgcggcctcagtgtgcctgt

SEQ ID NO: 448173 - DNA, 25 bp, Mus musculus
ccataactttgcactgcggcctcag

SEQ ID NO: 448174 - DNA, 25 bp, Mus musculus
gcagcccataactttgcactgcggc

SEQ ID NO: 448175 - DNA, 25 bp, Mus musculus
aagtggggtgctcccatgtcccgca

SEQ ID NO: 448176 - DNA, 25 bp, Mus musculus
ccacgggtaagtggggtgctcccat

SEQ ID NO: 448177 - DNA, 25 bp, Mus musculus
cctcctcgcgctcccgttcgcgctc

SEQ ID NO: 448178 - DNA, 25 bp, Mus musculus
tgaacacccagggaaccggcggcga

SEQ ID NO: 448179 - DNA, 25 bp, Mus musculus
ccgtttggcagtggccacacctgca

SEQ ID NO: 448180 - DNA, 25 bp, Mus musculus
agtggccacacctgcatttcatttg

SEQ ID NO: 448181 - DNA, 25 bp, Mus musculus
tcatttgcttgggagcagcaccgcg

SEQ ID NO: 448182 - DNA, 25 bp, Mus musculus
accgcgacccgcctgctgatgggga

SEQ ID NO: 448183 - DNA, 25 bp, Mus musculus
ctgatggggagccttcttcgcatcc

SEQ ID NO: 448184 - DNA, 25 bp, Mus musculus
agccttcttcgcatcctcgcgatta

SEQ ID NO: 448185 - DNA, 25 bp, Mus musculus
tcctcgcgattatgacaagttatta

SEQ ID NO: 448186 - DNA, 25 bp, Mus musculus
attaattgccaccattagctgcagc

SEQ ID NO: 448187 - DNA, 25 bp, Mus musculus
tagctgcagcagactgcccgagatc

SEQ ID NO: 448188 - DNA, 25 bp, Mus musculus
cagactgcccgagatctctgctgct

SEQ ID NO: 448189 - DNA, 25 bp, Mus musculus
tctctgctgctctctggaggtgaga

SEQ ID NO: 448190 - DNA, 25 bp, Mus musculus
tgcgcatctgaacacccagggaacc

SEQ ID NO: 448191 - DNA, 25 bp, Mus musculus
aggtgagagtctgcgcatctgaaca

SEQ ID NO: 448192 - DNA, 25 bp, Mus musculus
ttaagaaatcgatatggcctgggtg

SEQ ID NO: 448193 - DNA, 25 bp, Mus musculus
tcggcttctccagcagctaccgtta

SEQ ID NO: 448194 - DNA, 25 bp, Mus musculus
cagatccacaattgaaacgtttcca

SEQ ID NO: 448195 - DNA, 25 bp, Mus musculus
atcgatcggtggtgattaagaaatc

SEQ ID NO: 448196 - DNA, 25 bp, Mus musculus
cgccgccagggaaaggcgcttttgc

SEQ ID NO: 448197 - DNA, 25 bp, Mus musculus
cacagaaaggcgtgcccggacgacc

SEQ ID NO: 448198 - DNA, 25 bp, Mus musculus
atcccgcgtgatgaagtgtcggctc

SEQ ID NO: 448199 - DNA, 25 bp, Mus musculus
agggtacctgggcactcttgctcag

SEQ ID NO: 448200 - DNA, 25 bp, Mus musculus
gaggcttttgttgctcctcggctgg

SEQ ID NO: 448201 - DNA, 25 bp, Mus musculus
cctcggctggctgaatagggatttt

SEQ ID NO: 448202 - DNA, 25 bp, Mus musculus
gagcagcatcatattgtttgacaga

SEQ ID NO: 448203 - DNA, 25 bp, Mus musculus
ttgtttgacagaatgatcccgcgtg

SEQ ID NO: 448204 - DNA, 25 bp, Mus musculus
cggacgaccacacccgaagacaggg

SEQ ID NO: 448205 - DNA, 25 bp, Mus musculus
tttgttcccaataaatcgatcggtg

SEQ ID NO: 448206 - DNA, 25 bp, Mus musculus
cgccaatcactgtaaccgaagcagt

SEQ ID NO: 448207 - DNA, 25 bp, Mus musculus
tgggcctggattgcgcatgagcaga

SEQ ID NO: 448208 - DNA, 25 bp, Mus musculus
ggctggttgggcctggattgcgcat

SEQ ID NO: 448209 - DNA, 25 bp, Mus musculus
cgcacgcgcgttcagagcgccaagg

SEQ ID NO: 448210 - DNA, 25 bp, Mus musculus
agcagtacgtctgcgcacgcgcgtt

SEQ ID NO: 448211 - DNA, 25 bp, Mus musculus
cgaagcagtacgtctgcgcacgcgc

SEQ ID NO: 448212 - DNA, 25 bp, Mus musculus
accgaagcagtacgtctgcgcacgc

SEQ ID NO: 448213 - DNA, 25 bp, Mus musculus
aaccgaagcagtacgtctgcgcacg

SEQ ID NO: 448214 - DNA, 25 bp, Mus musculus
tgtaaccgaagcagtacgtctgcgc

SEQ ID NO: 448215 - DNA, 25 bp, Mus musculus
actgtaaccgaagcagtacgtctgc

SEQ ID NO: 448216 - DNA, 25 bp, Mus musculus
cactgtaaccgaagcagtacgtctg

SEQ ID NO: 448217 - DNA, 25 bp, Mus musculus
atcactgtaaccgaagcagtacgtc

SEQ ID NO: 448218 - DNA, 25 bp, Mus musculus
gccaatcactgtaaccgaagcagta

SEQ ID NO: 448219 - DNA, 25 bp, Mus musculus
gtaaccgaagcagtacgtctgcgca

SEQ ID NO: 448220 - DNA, 25 bp, Mus musculus
atcaagatcgcggtccggtccactc

SEQ ID NO: 448221 - DNA, 25 bp, Mus musculus
cgatcacgggaatctctgcggtctc

SEQ ID NO: 448222 - DNA, 25 bp, Mus musculus
gatattaagccgctaggcccgcgcg

SEQ ID NO: 448223 - DNA, 25 bp, Mus musculus
agcagcctgagcgtctcatcattta

SEQ ID NO: 448224 - DNA, 25 bp, Mus musculus
ggccggacccagcatcagatggtaa

SEQ ID NO: 448225 - DNA, 25 bp, Mus musculus
atctctaaccgaggggaagcgttgc

SEQ ID NO: 448226 - DNA, 25 bp, Mus musculus
ttgcttttcacgctacgcaccgtaa

SEQ ID NO: 448227 - DNA, 25 bp, Mus musculus
ggcagctgggagttgttcaccaccc

SEQ ID NO: 448228 - DNA, 25 bp, Mus musculus
tcaacgaggcggacaaagtctcctg

SEQ ID NO: 448229 - DNA, 25 bp, Mus musculus
caggctagccgggaaatcgaaatta

SEQ ID NO: 448230 - DNA, 25 bp, Mus musculus
tttggagactaaaaagcggcctcga

SEQ ID NO: 448231 - DNA, 25 bp, Mus musculus
agccttgaagccagggttctcgcgc

SEQ ID NO: 448232 - DNA, 25 bp, Mus musculus
ttcgccagaggctccgccatcaaga

SEQ ID NO: 448233 - DNA, 25 bp, Mus musculus
ctgcggtctcctctagaaatcgata

SEQ ID NO: 448234 - DNA, 25 bp, Rattus norvegicus
tggaacccagatagagcagcatgtc

SEQ ID NO: 448235 - DNA, 25 bp, Rattus norvegicus
tcgggtcgctagagctgatgctact

SEQ ID NO: 448236 - DNA, 25 bp, Rattus norvegicus
tctaggctccacaccaggaaactcg

SEQ ID NO: 448237 - DNA, 25 bp, Rattus norvegicus
cggctttagccgctctccatggcaa

SEQ ID NO: 448238 - DNA, 25 bp, Rattus norvegicus
cggctcaacatcgtccatgcaaatg

SEQ ID NO: 448239 - DNA, 25 bp, Rattus norvegicus
ggaaagctccgtgcggctcaacatc

SEQ ID NO: 448240 - DNA, 25 bp, Rattus norvegicus
gccaagtctgcgctcttctgggaaa

SEQ ID NO: 448241 - DNA, 25 bp, Rattus norvegicus
ccaccacaggagactgacgaagata

SEQ ID NO: 448242 - DNA, 25 bp, Rattus norvegicus
ttgccagtgtaccaggagatccacc

SEQ ID NO: 448243 - DNA, 25 bp, Rattus norvegicus
ggagcgcctcaatgttgccagtgta

SEQ ID NO: 448244 - DNA, 25 bp, Rattus norvegicus
ctcctaagggtcagcgagaagcgac

SEQ ID NO: 448245 - DNA, 25 bp, Rattus norvegicus
ctgaaaggtgttggagacgctccta

SEQ ID NO: 448246 - DNA, 25 bp, Rattus norvegicus
tactgatcatctggaggacccgcgg

SEQ ID NO: 448247 - DNA, 25 bp, Rattus norvegicus
cgacctgctgaaccttctgcgcttg

SEQ ID NO: 448248 - DNA, 25 bp, Rattus norvegicus
ctgttgggccctggttcaccttcat

SEQ ID NO: 448249 - DNA, 25 bp, Rattus norvegicus
gggccctggttcaccttcatctgtc

SEQ ID NO: 448250 - DNA, 25 bp, Rattus norvegicus
aaagcgaatccgctgtctgctcagg

SEQ ID NO: 448251 - DNA, 25 bp, Rattus norvegicus
cagcctgggaaagcgaatccgctgt

SEQ ID NO: 448252 - DNA, 25 bp, Rattus norvegicus
agctgggaccgatccgttcccgcag

SEQ ID NO: 448253 - DNA, 25 bp, Rattus norvegicus
tttgcattctgttgaccgggagctg

SEQ ID NO: 448254 - DNA, 25 bp, Rattus norvegicus
tccgtccctttgcattctgttgacc

SEQ ID NO: 448255 - DNA, 25 bp, Rattus norvegicus
gctgtccttgtctccatttcatccg

SEQ ID NO: 448256 - DNA, 25 bp, Rattus norvegicus
cacgtcatccctcccgctgtccttg

SEQ ID NO: 448257 - DNA, 25 bp, Rattus norvegicus
tgtgatgccggccacgtcatccctc

SEQ ID NO: 448258 - DNA, 25 bp, Rattus norvegicus
gcggaaggtatgacccgacccagca

SEQ ID NO: 448259 - DNA, 25 bp, Rattus norvegicus
gtcgcggaaggtatgacccgaccca

SEQ ID NO: 448260 - DNA, 25 bp, Rattus norvegicus
tgtctccatttcatccgtccctttg

SEQ ID NO: 448261 - DNA, 25 bp, Rattus norvegicus
ggttcaccttcatctgtcctttccg

SEQ ID NO: 448262 - DNA, 25 bp, Rattus norvegicus
agagatctgtgtcctggagcaggta

SEQ ID NO: 448263 - DNA, 25 bp, Rattus norvegicus
taggctaaatcacgcgctgggcgcc

SEQ ID NO: 448264 - DNA, 25 bp, Rattus norvegicus
ctgcgcactgggctagacagttacc

SEQ ID NO: 448265 - DNA, 25 bp, Rattus norvegicus
gttaccatagcaacggagctgcttg

SEQ ID NO: 448266 - DNA, 25 bp, Rattus norvegicus
ggaagtctccgaccctggcatgcca

SEQ ID NO: 448267 - DNA, 25 bp, Rattus norvegicus
tgccaactgccggaagggcggaaat

SEQ ID NO: 448268 - DNA, 25 bp, Rattus norvegicus
gagttgaatgccagccgcagctcga

SEQ ID NO: 448269 - DNA, 25 bp, Rattus norvegicus
gcgggacaggcaagcttgatagttc

SEQ ID NO: 448270 - DNA, 25 bp, Rattus norvegicus
tttgaaaccgttcggctgtggcggc

SEQ ID NO: 448271 - DNA, 25 bp, Rattus norvegicus
gaccgcttgcttgttgtggcgccag

SEQ ID NO: 448272 - DNA, 25 bp, Rattus norvegicus
ctcttgttccttccatcagtaattc

SEQ ID NO: 448273 - DNA, 25 bp, Rattus norvegicus
ccgccaggttctgagtggaattttg

SEQ ID NO: 448274 - DNA, 25 bp, Rattus norvegicus
tacccgcagggtaggctaaatcacg

SEQ ID NO: 448275 - DNA, 25 bp, Rattus norvegicus
tcagcagccgaacgatggccaggca

SEQ ID NO: 448276 - DNA, 25 bp, Rattus norvegicus
cccggagcatgcgtaaaaggtcttg

SEQ ID NO: 448277 - DNA, 25 bp, Rattus norvegicus
ctcctgaaacacatcgctcggggca

SEQ ID NO: 448278 - DNA, 25 bp, Rattus norvegicus
agaggcctcacacctagggccaggt

SEQ ID NO: 448279 - DNA, 25 bp, Rattus norvegicus
agagcctgcatcctctggctggtcc

SEQ ID NO: 448280 - DNA, 25 bp, Rattus norvegicus
tggctggtccaggtctatgtcaaac

SEQ ID NO: 448281 - DNA, 25 bp, Rattus norvegicus
atgtcctcagcttccctgtgtcgga

SEQ ID NO: 448282 - DNA, 25 bp, Rattus norvegicus
tcaccggctgcttaagctcaatgcg

SEQ ID NO: 448283 - DNA, 25 bp, Rattus norvegicus
gaagccattcagtgggcagcggaca

SEQ ID NO: 448284 - DNA, 25 bp, Rattus norvegicus
cagcggacatgcgtagcattatctc

SEQ ID NO: 448285 - DNA, 25 bp, Rattus norvegicus
attatctcccggtgccaggtactgg

SEQ ID NO: 448286 - DNA, 25 bp, Rattus norvegicus
ccaggtactggcaggaacatgcgca

SEQ ID NO: 448287 - DNA, 25 bp, Rattus norvegicus
tgcgcagaacaccaaccgaagccaa

SEQ ID NO: 448288 - DNA, 25 bp, Rattus norvegicus
agcatgcgcgttacttgtctaaggc

SEQ ID NO: 448289 - DNA, 25 bp, Rattus norvegicus
tcaggcgctgggtaaaagccgtccc

SEQ ID NO: 448290 - DNA, 25 bp, Rattus norvegicus
gttccttcactacagcggcaagagg

SEQ ID NO: 448291 - DNA, 25 bp, Rattus norvegicus
gagtagccactccactcccagggtg

SEQ ID NO: 448292 - DNA, 25 bp, Rattus norvegicus
ccactcccagggtgtcaagcgagga

SEQ ID NO: 448293 - DNA, 25 bp, Rattus norvegicus
ttctgtcggcgtctgttgggtagcc

SEQ ID NO: 448294 - DNA, 25 bp, Rattus norvegicus
cccgcagaggctagacgcttgggca

SEQ ID NO: 448295 - DNA, 25 bp, Rattus norvegicus
cgctagccaaggtctccagagttca

SEQ ID NO: 448296 - DNA, 25 bp, Rattus norvegicus
ctccagagttcaaagaccgacaagc

SEQ ID NO: 448297 - DNA, 25 bp, Rattus norvegicus
ttcaaagaccgacaagcaaactatg

SEQ ID NO: 448298 - DNA, 25 bp, Rattus norvegicus
aaactatgttccttcactacagcgg

SEQ ID NO: 448299 - DNA, 25 bp, Rattus norvegicus
tcactacagcggcaagaggtcggtc

SEQ ID NO: 448300 - DNA, 25 bp, Rattus norvegicus
tttctgggacgcgagtagccactcc

SEQ ID NO: 448301 - DNA, 25 bp, Rattus norvegicus
gtagcccgcagaggctagacgcttg

SEQ ID NO: 448302 - DNA, 25 bp, Rattus norvegicus
gaccgacaagcaaactatgttcctt

SEQ ID NO: 448303 - DNA, 25 bp, Rattus norvegicus
cttgggcagggaagacgctagccaa

SEQ ID NO: 448304 - DNA, 25 bp, Rattus norvegicus
taccgatgccttgggtacctgcctc

SEQ ID NO: 448305 - DNA, 25 bp, Rattus norvegicus
ggcaaagttggcgattcctgagacg

SEQ ID NO: 448306 - DNA, 25 bp, Rattus norvegicus
tagtcagaatcggtggccgaggact

SEQ ID NO: 448307 - DNA, 25 bp, Rattus norvegicus
ccgcgggactgtagtagtcagaatc

SEQ ID NO: 448308 - DNA, 25 bp, Rattus norvegicus
cgctttgcggtaagaagcagaggta

SEQ ID NO: 448309 - DNA, 25 bp, Rattus norvegicus
tactggtatgggttgagcgctttgc

SEQ ID NO: 448310 - DNA, 25 bp, Rattus norvegicus
tcacgctgtgatactggtactggta

SEQ ID NO: 448311 - DNA, 25 bp, Rattus norvegicus
tgcggagccgttcacgctgtgatac

SEQ ID NO: 448312 - DNA, 25 bp, Rattus norvegicus
tccgcataagccttggccgggtagc

SEQ ID NO: 448313 - DNA, 25 bp, Rattus norvegicus
gctggcgtagccgtagtccgcataa

SEQ ID NO: 448314 - DNA, 25 bp, Rattus norvegicus
ttgtaggcgcctccgtactggtggt

SEQ ID NO: 448315 - DNA, 25 bp, Rattus norvegicus
actcgggactcggttgtaggcgcct

SEQ ID NO: 448316 - DNA, 25 bp, Rattus norvegicus
aacggagcttggaagtcgccggatc

SEQ ID NO: 448317 - DNA, 25 bp, Rattus norvegicus
cgcacgcctacctggctggctggtg

SEQ ID NO: 448318 - DNA, 25 bp, Rattus norvegicus
ttgctaggaaactcgagaaattgct

SEQ ID NO: 448319 - DNA, 25 bp, Rattus norvegicus
gaacgtaacaaataactcgctcaga

SEQ ID NO: 448320 - DNA, 25 bp, Rattus norvegicus
ctcgctcagacaagactttatctta

SEQ ID NO: 448321 - DNA, 25 bp, Rattus norvegicus
gactttatcttatacagcatttttg

SEQ ID NO: 448322 - DNA, 25 bp, Rattus norvegicus
gaaattgctacgactcctcccacag

SEQ ID NO: 448323 - DNA, 25 bp, Rattus norvegicus
agcggaggtttctgtcagctccaaa

SEQ ID NO: 448324 - DNA, 25 bp, Rattus norvegicus
tgtcagctccaaaaatcgggattcc

SEQ ID NO: 448325 - DNA, 25 bp, Rattus norvegicus
tcgggattccggaaggacaagattc

SEQ ID NO: 448326 - DNA, 25 bp, Rattus norvegicus
aagattctatgaaggaccaaaccgg

SEQ ID NO: 448327 - DNA, 25 bp, Rattus norvegicus
accaaaccggatgaaggtcgtgtgc

SEQ ID NO: 448328 - DNA, 25 bp, Rattus norvegicus
atgaaggtcgtgtgctctcttccgc

SEQ ID NO: 448329 - DNA, 25 bp, Rattus norvegicus
ggagccgtgccgaccttctgcgcag

SEQ ID NO: 448330 - DNA, 25 bp, Rattus norvegicus
acgacgagttatcttgaacgtaaca

SEQ ID NO: 448331 - DNA, 25 bp, Rattus norvegicus
ccacagtcgcgcctttagcagagag

SEQ ID NO: 448332 - DNA, 25 bp, Rattus norvegicus
acccaatttggtccagatgttatgg

SEQ ID NO: 448333 - DNA, 25 bp, Rattus norvegicus
ttgcgtcatttcgaacccaatttgg

SEQ ID NO: 448334 - DNA, 25 bp, Rattus norvegicus
gatgttatggactccgacgggttac

SEQ ID NO: 448335 - DNA, 25 bp, Rattus norvegicus
ttaccgtctcggaaactctatcacg

SEQ ID NO: 448336 - DNA, 25 bp, Rattus norvegicus
ctctatcacgcaagcaaaaggcgag

SEQ ID NO: 448337 - DNA, 25 bp, Rattus norvegicus
taaatattgagcagaaagtcgcgtg

SEQ ID NO: 448338 - DNA, 25 bp, Rattus norvegicus
agagtgtcacgtggctctccaggct

SEQ ID NO: 448339 - DNA, 25 bp, Rattus norvegicus
ggctcatcacgcctgagataaataa

SEQ ID NO: 448340 - DNA, 25 bp, Rattus norvegicus
ataaataaggcgaagcaggagcagg

SEQ ID NO: 448341 - DNA, 25 bp, Rattus norvegicus
ggactagagcgcactcggaccagct

SEQ ID NO: 448342 - DNA, 25 bp, Rattus norvegicus
ggagcgcccagcaagtgcgcacctg

SEQ ID NO: 448343 - DNA, 25 bp, Rattus norvegicus
acctgcggagcatcaccgggtccga

SEQ ID NO: 448344 - DNA, 25 bp, Rattus norvegicus
ggtccgaccgcagtgagtaccactc

SEQ ID NO: 448345 - DNA, 25 bp, Rattus norvegicus
gagacctcgacttccctaaaattgc

SEQ ID NO: 448346 - DNA, 25 bp, Rattus norvegicus
atccgtaagcctgggacgtgtgacc

SEQ ID NO: 448347 - DNA, 25 bp, Rattus norvegicus
cccgcaatgctgacgaaggacgcca

SEQ ID NO: 448348 - DNA, 25 bp, Rattus norvegicus
tcatcatgtggctgggactaaaccg

SEQ ID NO: 448349 - DNA, 25 bp, Rattus norvegicus
aacgcgtgcgggaagtttcatcatg

SEQ ID NO: 448350 - DNA, 25 bp, Rattus norvegicus
ccaagcttctgtaacgcgtgcggga

SEQ ID NO: 448351 - DNA, 25 bp, Rattus norvegicus
tcgccttacagtcgccaagcttctg

SEQ ID NO: 448352 - DNA, 25 bp, Rattus norvegicus
ggaggcttcctctcgccttacagtc

SEQ ID NO: 448353 - DNA, 25 bp, Rattus norvegicus
cgacaagacccgctggaggcttcct

SEQ ID NO: 448354 - DNA, 25 bp, Rattus norvegicus
tgtgacccggtggacagcgcatccc

SEQ ID NO: 448355 - DNA, 25 bp, Rattus norvegicus
cccgagtgttcagtatccgtaagcc

SEQ ID NO: 448356 - DNA, 25 bp, Rattus norvegicus
cagctccgtcctagatgcgcaacaa

SEQ ID NO: 448357 - DNA, 25 bp, Rattus norvegicus
ttcatgtgaaagctttcctggcagc

SEQ ID NO: 448358 - DNA, 25 bp, Rattus norvegicus
ccacgctgctcttcgttcatgtgaa

SEQ ID NO: 448359 - DNA, 25 bp, Rattus norvegicus
ctgaggtagctcagcgacaagaccc

SEQ ID NO: 448360 - DNA, 25 bp, Rattus norvegicus
ctgcatccgcacgtcgccctgtccc

SEQ ID NO: 448361 - DNA, 25 bp, Rattus norvegicus
ggccaatccctgcatccgcacgtcg

SEQ ID NO: 448362 - DNA, 25 bp, Rattus norvegicus
cagcagccgcgacgtcagctctccg

SEQ ID NO: 448363 - DNA, 25 bp, Rattus norvegicus
gacgtcagctctccgagacccgtgg

SEQ ID NO: 448364 - DNA, 25 bp, Rattus norvegicus
cgtcagctctccgagacccgtgggt

SEQ ID NO: 448365 - DNA, 25 bp, Rattus norvegicus
cagctctccgagacccgtgggtggc

SEQ ID NO: 448366 - DNA, 25 bp, Rattus norvegicus
ccagggcagcgaaggtcgagggttg

SEQ ID NO: 448367 - DNA, 25 bp, Rattus norvegicus
tagagccgcggctgatgtcaggtac

SEQ ID NO: 448368 - DNA, 25 bp, Rattus norvegicus
gcgactgaggctacggaaacgccgc

SEQ ID NO: 448369 - DNA, 25 bp, Rattus norvegicus
actgaggctacggaaacgccgcccg

SEQ ID NO: 448370 - DNA, 25 bp, Rattus norvegicus
tgaggctacggaaacgccgcccggc

SEQ ID NO: 448371 - DNA, 25 bp, Rattus norvegicus
cccggcgcggccaaacaggcgtctc

SEQ ID NO: 448372 - DNA, 25 bp, Rattus norvegicus
ttagagccgcggctgatgtcaggta

SEQ ID NO: 448373 - DNA, 25 bp, Rattus norvegicus
actcccggcggccaatccctgcatc

SEQ ID NO: 448374 - DNA, 25 bp, Rattus norvegicus
ctgaattcagaacgctcgattgtgc

SEQ ID NO: 448375 - DNA, 25 bp, Rattus norvegicus
gaagggtctcgcgagcaccgaccca

SEQ ID NO: 448376 - DNA, 25 bp, Rattus norvegicus
aggtgggataagtccacatgctccc

SEQ ID NO: 448377 - DNA, 25 bp, Rattus norvegicus
cggcgctcaaggtgggataagtcca

SEQ ID NO: 448378 - DNA, 25 bp, Rattus norvegicus
acacgccattggtgggaaagaccgc

SEQ ID NO: 448379 - DNA, 25 bp, Rattus norvegicus
gctgtgtgaactgttttagaaaatc

SEQ ID NO: 448380 - DNA, 25 bp, Rattus norvegicus
caaggctgccagatgctgtgtgaac

SEQ ID NO: 448381 - DNA, 25 bp, Rattus norvegicus
tgacttctcttctcggtcgcggaaa

SEQ ID NO: 448382 - DNA, 25 bp, Rattus norvegicus
tcgattgtgcgggttgccttccgca

SEQ ID NO: 448383 - DNA, 25 bp, Rattus norvegicus
tagcagcgacagctgaattcagaac

SEQ ID NO: 448384 - DNA, 25 bp, Rattus norvegicus
gccgagcatcttgcggggccctgct

SEQ ID NO: 448385 - DNA, 25 bp, Rattus norvegicus
ggaaagaccgctgtgcggcgctcaa

SEQ ID NO: 448386 - DNA, 25 bp, Rattus norvegicus
cccttcgagcatgcgctgccaggtg

SEQ ID NO: 448387 - DNA, 25 bp, Rattus norvegicus
tcagctctgatgctacacgccattg

SEQ ID NO: 448388 - DNA, 25 bp, Rattus norvegicus
cctgcccacaagaaggcggcggaag

SEQ ID NO: 448389 - DNA, 25 bp, Rattus norvegicus
ggctatggtcctgcccacaagaagg

SEQ ID NO: 448390 - DNA, 25 bp, Rattus norvegicus
ggcacaagtcaagggcggagaactc

SEQ ID NO: 448391 - DNA, 25 bp, Rattus norvegicus
aactcaggaggaaggcggagtctcc

SEQ ID NO: 448392 - DNA, 25 bp, Rattus norvegicus
ctgaagaggtttggtagtgggccca

SEQ ID NO: 448393 - DNA, 25 bp, Rattus norvegicus
caccgcccgctcttcggcggccatc

SEQ ID NO: 448394 - DNA, 25 bp, Rattus norvegicus
cgtacaggccggaaacgtctgtgtg

SEQ ID NO: 448395 - DNA, 25 bp, Rattus norvegicus
cgccacctcctcaggtcagtgagtg

SEQ ID NO: 448396 - DNA, 25 bp, Rattus norvegicus
ctcctcaggtcagtgagtgcggccc

SEQ ID NO: 448397 - DNA, 25 bp, Rattus norvegicus
agggccgcagtcgcggcagcttcct

SEQ ID NO: 448398 - DNA, 25 bp, Rattus norvegicus
gcgttctggtcagtgggatggtcac

SEQ ID NO: 448399 - DNA, 25 bp, Rattus norvegicus
ctcgtgtggagccttcgggcgtccc

SEQ ID NO: 448400 - DNA, 25 bp, Rattus norvegicus
gaaacgtctgtgtggcgacacgcca

SEQ ID NO: 448401 - DNA, 25 bp, Rattus norvegicus
ggactctaggctatggtcctgccca

SEQ ID NO: 448402 - DNA, 25 bp, Rattus norvegicus
ctcaggtagttttcttgcgggaggc

SEQ ID NO: 448403 - DNA, 25 bp, Rattus norvegicus
cgggtcgttcgatatactgtgataa

SEQ ID NO: 448404 - DNA, 25 bp, Rattus norvegicus
tgataacatgctggcgttgacgcgc

SEQ ID NO: 448405 - DNA, 25 bp, Rattus norvegicus
gtccaccatgattctgccgccaaaa

SEQ ID NO: 448406 - DNA, 25 bp, Rattus norvegicus
aggcttcgccaacccggcagatttc

SEQ ID NO: 448407 - DNA, 25 bp, Rattus norvegicus
atccacaggagcagctagttctcgc

SEQ ID NO: 448408 - DNA, 25 bp, Rattus norvegicus
gcggagctcaatgcttccggaagta

SEQ ID NO: 448409 - DNA, 25 bp, Rattus norvegicus
tccggaagtactggtctactgccta

SEQ ID NO: 448410 - DNA, 25 bp, Rattus norvegicus
tctgaagcggccaaacgttgacttg

SEQ ID NO: 448411 - DNA, 25 bp, Rattus norvegicus
agtcaggcttctagtcccggaatgc

SEQ ID NO: 448412 - DNA, 25 bp, Rattus norvegicus
ttccctaatggctgcggatcccgtc

SEQ ID NO: 448413 - DNA, 25 bp, Rattus norvegicus
ggggagttccattatgtccaccatg

SEQ ID NO: 448414 - DNA, 25 bp, Rattus norvegicus
tccggaagttgctgtggccgaaacg

SEQ ID NO: 448415 - DNA, 25 bp, Rattus norvegicus
ctatgattgacacccagcaggcttc

SEQ ID NO: 448416 - DNA, 25 bp, Rattus norvegicus
gcaaagtctcttttcactccggctg

SEQ ID NO: 448417 - DNA, 25 bp, Rattus norvegicus
tgaccctcacctcaaaggctgtcaa

SEQ ID NO: 448418 - DNA, 25 bp, Rattus norvegicus
actccggctgcataaccaatcctta

SEQ ID NO: 448419 - DNA, 25 bp, Rattus norvegicus
ctcgtaccgtaattggcaaagtctc

SEQ ID NO: 448420 - DNA, 25 bp, Rattus norvegicus
cagagcggaaacctcgtaccgtaat

SEQ ID NO: 448421 - DNA, 25 bp, Rattus norvegicus
aaggctgtcaactcttctgtccctc

SEQ ID NO: 448422 - DNA, 25 bp, Rattus norvegicus
aactccggagtagtgtggctctgcc

SEQ ID NO: 448423 - DNA, 25 bp, Rattus norvegicus
gtggctctgccaatcagatcagttg

SEQ ID NO: 448424 - DNA, 25 bp, Rattus norvegicus
ggcgcagacacaggattagttgcca

SEQ ID NO: 448425 - DNA, 25 bp, Rattus norvegicus
ttagttgccattccgagtgagaacc

SEQ ID NO: 448426 - DNA, 25 bp, Rattus norvegicus
ccattccgagtgagaaccgggtcga

SEQ ID NO: 448427 - DNA, 25 bp, Rattus norvegicus
cagctcacctgagagacggagtccc

SEQ ID NO: 448428 - DNA, 25 bp, Rattus norvegicus
atcagatcagttgcagccgcaggag

SEQ ID NO: 448429 - DNA, 25 bp, Rattus norvegicus
ccaatccttagaactccggagtagt

SEQ ID NO: 448430 - DNA, 25 bp, Rattus norvegicus
gccaactgtgcagacatctgtgtga

SEQ ID NO: 448431 - DNA, 25 bp, Rattus norvegicus
cttgcgatcctagatctatcttttc

SEQ ID NO: 448432 - DNA, 25 bp, Rattus norvegicus
gtgggaactcatgcttgcgatccta

SEQ ID NO: 448433 - DNA, 25 bp, Rattus norvegicus
agaacctgtggcttggtgggaactc

SEQ ID NO: 448434 - DNA, 25 bp, Rattus norvegicus
aagctgtcaggaacattctagaacc

SEQ ID NO: 448435 - DNA, 25 bp, Rattus norvegicus
ttggctaattctgaataaagctgtc

SEQ ID NO: 448436 - DNA, 25 bp, Rattus norvegicus
acctttccctcgctactgttgatgg

SEQ ID NO: 448437 - DNA, 25 bp, Rattus norvegicus
tggtagcggtttgtgccctttccac

SEQ ID NO: 448438 - DNA, 25 bp, Rattus norvegicus
agacatctgtgtgacaggctgggcc

SEQ ID NO: 448439 - DNA, 25 bp, Rattus norvegicus
gagcacattcttttatggccaactg

SEQ ID NO: 448440 - DNA, 25 bp, Rattus norvegicus
cagatttccctggaaatggaatcca

SEQ ID NO: 448441 - DNA, 25 bp, Rattus norvegicus
tcagattggtttgtccagatttccc

SEQ ID NO: 448442 - DNA, 25 bp, Rattus norvegicus
tttcacacctatcatttcagattgg

SEQ ID NO: 448443 - DNA, 25 bp, Rattus norvegicus
ccgggtgcagaatctgtgtgacaga

SEQ ID NO: 448444 - DNA, 25 bp, Rattus norvegicus
aggaagcggtccttcctgcagcggc

SEQ ID NO: 448445 - DNA, 25 bp, Rattus norvegicus
ctcaaaaggaggccggacgccagtt

SEQ ID NO: 448446 - DNA, 25 bp, Rattus norvegicus
tgggcgcaggtgctctcccgtttcc

SEQ ID NO: 448447 - DNA, 25 bp, Rattus norvegicus
ggctgacgcacgctcctaggacgcg

SEQ ID NO: 448448 - DNA, 25 bp, Rattus norvegicus
aggacgcgcgcatccgctatacatc

SEQ ID NO: 448449 - DNA, 25 bp, Rattus norvegicus
tccgctatacatccaggcccgaggg

SEQ ID NO: 448450 - DNA, 25 bp, Rattus norvegicus
ggaaggggatgatgctcctcccgca

SEQ ID NO: 448451 - DNA, 25 bp, Rattus norvegicus
cgcaaagggcagtaaaggcggcctt

SEQ ID NO: 448452 - DNA, 25 bp, Rattus norvegicus
cccagagggcaggtacctcggagcc

SEQ ID NO: 448453 - DNA, 25 bp, Rattus norvegicus
cccaggagcctctcagcggagatcg

SEQ ID NO: 448454 - DNA, 25 bp, Rattus norvegicus
ggagatcggagcgtccctccagctc

SEQ ID NO: 448455 - DNA, 25 bp, Rattus norvegicus
ccgacgtcagcgtcagcactggcga

SEQ ID NO: 448456 - DNA, 25 bp, Rattus norvegicus
agccggaatagcagcccggagcctg

SEQ ID NO: 448457 - DNA, 25 bp, Rattus norvegicus
ctccagctccctgcgccgacgtcag

SEQ ID NO: 448458 - DNA, 25 bp, Rattus norvegicus
atcaatcctgatcgcgaccggggca

SEQ ID NO: 448459 - DNA, 25 bp, Rattus norvegicus
agccggagagtggaatctatttaca

SEQ ID NO: 448460 - DNA, 25 bp, Rattus norvegicus
tttgaggaatcgttcacccacgtgc

SEQ ID NO: 448461 - DNA, 25 bp, Rattus norvegicus
cagcgcccgtgacataaatccttta

SEQ ID NO: 448462 - DNA, 25 bp, Rattus norvegicus
gcttccagtgcttgcagcttccaaa

SEQ ID NO: 448463 - DNA, 25 bp, Rattus norvegicus
ttctgaaactgggtctcatcgcgcc

SEQ ID NO: 448464 - DNA, 25 bp, Rattus norvegicus
aggcccgcgtcttatcgctcaagtt

SEQ ID NO: 448465 - DNA, 25 bp, Rattus norvegicus
cgctcaagttcaagtccggaggact

SEQ ID NO: 448466 - DNA, 25 bp, Rattus norvegicus
gaaatccgggagtcctagcctgctg

SEQ ID NO: 448467 - DNA, 25 bp, Rattus norvegicus
tagcctgctggtgtcagtgccaaca

SEQ ID NO: 448468 - DNA, 25 bp, Rattus norvegicus
gcctcttaagtttcctgcaccggga

SEQ ID NO: 448469 - DNA, 25 bp, Rattus norvegicus
caagcctaggctcccgcggatcaat

SEQ ID NO: 448470 - DNA, 25 bp, Rattus norvegicus
ggacaacgactctgccaaggctgga

SEQ ID NO: 448471 - DNA, 25 bp, Rattus norvegicus
cgggaatccaactgtgccaagccta

SEQ ID NO: 448472 - DNA, 25 bp, Rattus norvegicus
gcggcttccctagcggcgcctctag

SEQ ID NO: 448473 - DNA, 25 bp, Rattus norvegicus
tgcgcttggcgagcgcggcttccct

SEQ ID NO: 448474 - DNA, 25 bp, Rattus norvegicus
ctagcggcgcctctaggcctgggcc

SEQ ID NO: 448475 - DNA, 25 bp, Rattus norvegicus
gcctctcagagagccccagagggag

SEQ ID NO: 448476 - DNA, 25 bp, Rattus norvegicus
ccagagggagctgccaggcgcctct

SEQ ID NO: 448477 - DNA, 25 bp, Rattus norvegicus
gcccaaatcccgcaggacaggtcga

SEQ ID NO: 448478 - DNA, 25 bp, Rattus norvegicus
caaatcccgcaggacaggtcgagtc

SEQ ID NO: 448479 - DNA, 25 bp, Rattus norvegicus
aatcccgcaggacaggtcgagtctc

SEQ ID NO: 448480 - DNA, 25 bp, Rattus norvegicus
tcccgcaggacaggtcgagtctcca

SEQ ID NO: 448481 - DNA, 25 bp, Rattus norvegicus
cgcaggacaggtcgagtctccagcc

SEQ ID NO: 448482 - DNA, 25 bp, Rattus norvegicus
aggacaggtcgagtctccagccgct

SEQ ID NO: 448483 - DNA, 25 bp, Rattus norvegicus
gtcgagtctccagccgctggggtca

SEQ ID NO: 448484 - DNA, 25 bp, Rattus norvegicus
tctccagccgctggggtcaacggct

SEQ ID NO: 448485 - DNA, 25 bp, Rattus norvegicus
gcggtcggctggaagtgcgcttggc

SEQ ID NO: 448486 - DNA, 25 bp, Rattus norvegicus
gggtcgttcttctccctattgtctc

SEQ ID NO: 448487 - DNA, 25 bp, Rattus norvegicus
cttttctttccagtcacgctttgcg

SEQ ID NO: 448488 - DNA, 25 bp, Rattus norvegicus
cttagtaagtgtatccgaggcctca

SEQ ID NO: 448489 - DNA, 25 bp, Rattus norvegicus
gaccacctcacggattccttagtaa

SEQ ID NO: 448490 - DNA, 25 bp, Rattus norvegicus
ctgcctaaatagctgctctccgatt

SEQ ID NO: 448491 - DNA, 25 bp, Rattus norvegicus
ttttaccggggcacttcctctcgca

SEQ ID NO: 448492 - DNA, 25 bp, Rattus norvegicus
ctggtgcaggctaataaaagttttc

SEQ ID NO: 448493 - DNA, 25 bp, Rattus norvegicus
ttctgggtcttttttgttgcttctg

SEQ ID NO: 448494 - DNA, 25 bp, Rattus norvegicus
attgtctctgacagtcggccctcga

SEQ ID NO: 448495 - DNA, 25 bp, Rattus norvegicus
ttcttggcagagctgtatccgggtc

SEQ ID NO: 448496 - DNA, 25 bp, Rattus norvegicus
cagtttttacttccttcttggcaga

SEQ ID NO: 448497 - DNA, 25 bp, Rattus norvegicus
agcggctggtttcgtctacagtttt

SEQ ID NO: 448498 - DNA, 25 bp, Rattus norvegicus
ctttctccggcgagggaccgagtct

SEQ ID NO: 448499 - DNA, 25 bp, Rattus norvegicus
gtcggccctcgactggaaattctgg

SEQ ID NO: 448500 - DNA, 25 bp, Rattus norvegicus
gttcgctccagatgaaaagcagcca

SEQ ID NO: 448501 - DNA, 25 bp, Rattus norvegicus
atggcgcgcagactggcaggtccta

SEQ ID NO: 448502 - DNA, 25 bp, Rattus norvegicus
acaatagcatcagccgcgaccgtgg

SEQ ID NO: 448503 - DNA, 25 bp, Rattus norvegicus
acactagggaacaatagcatcagcc

SEQ ID NO: 448504 - DNA, 25 bp, Rattus norvegicus
tccagatgaaaagcagccaaagagc

SEQ ID NO: 448505 - DNA, 25 bp, Rattus norvegicus
cgctgctcctattgttcgctccaga

SEQ ID NO: 448506 - DNA, 25 bp, Rattus norvegicus
aagctctcgctgctcctattgttcg

SEQ ID NO: 448507 - DNA, 25 bp, Rattus norvegicus
gaacgtaaagctctcgctgctccta

SEQ ID NO: 448508 - DNA, 25 bp, Rattus norvegicus
tccagcagtagagaacgtaaagctc

SEQ ID NO: 448509 - DNA, 25 bp, Rattus norvegicus
cttccttctccagcagtagagaacg

SEQ ID NO: 448510 - DNA, 25 bp, Rattus norvegicus
agcctccggagccacagcactctcg

SEQ ID NO: 448511 - DNA, 25 bp, Rattus norvegicus
ccagagctcagcaggagtagcagga

SEQ ID NO: 448512 - DNA, 25 bp, Rattus norvegicus
cgggctccagagctcagcaggagta

SEQ ID NO: 448513 - DNA, 25 bp, Rattus norvegicus
gccaaagagcaactaacactaggga

SEQ ID NO: 448514 - DNA, 25 bp, Rattus norvegicus
atgctcctgcgctggcgagccgcag

SEQ ID NO: 448515 - DNA, 25 bp, Rattus norvegicus
ggccgctcagatcaagggccctggc

SEQ ID NO: 448516 - DNA, 25 bp, Rattus norvegicus
atcaagggccctggcgtcacccgag

SEQ ID NO: 448517 - DNA, 25 bp, Rattus norvegicus
accctgggagcgaagccagggccca

SEQ ID NO: 448518 - DNA, 25 bp, Rattus norvegicus
aagccagggcccaccgcggtgacag

SEQ ID NO: 448519 - DNA, 25 bp, Rattus norvegicus
cccgcatccggtccgcagcggcctt

SEQ ID NO: 448520 - DNA, 25 bp, Rattus norvegicus
gcagcggccttcctcaccgctccgg

SEQ ID NO: 448521 - DNA, 25 bp, Rattus norvegicus
ctcaccgctccggcaggggacatgg

SEQ ID NO: 448522 - DNA, 25 bp, Rattus norvegicus
tcccgggatgctcctgcgctggcga

SEQ ID NO: 448523 - DNA, 25 bp, Rattus norvegicus
gaggggtaggacaacaactgcatca

SEQ ID NO: 448524 - DNA, 25 bp, Rattus norvegicus
gggtaggacaacaactgcatcagct

SEQ ID NO: 448525 - DNA, 25 bp, Rattus norvegicus
actgcatcagctgagccgggtaccc

SEQ ID NO: 448526 - DNA, 25 bp, Rattus norvegicus
agcctgcgcgtgcgcctgcgtagtc

SEQ ID NO: 448527 - DNA, 25 bp, Rattus norvegicus
cgctcacccgcacgcggagtgctgc

SEQ ID NO: 448528 - DNA, 25 bp, Rattus norvegicus
gtcaggcctgtgcatccctccgatg

SEQ ID NO: 448529 - DNA, 25 bp, Rattus norvegicus
gtcgctccgcgcctggtactggaac

SEQ ID NO: 448530 - DNA, 25 bp, Rattus norvegicus
cctggccacccagaaggtgactggc

SEQ ID NO: 448531 - DNA, 25 bp, Rattus norvegicus
acccagaaggtgactggcctccggg

SEQ ID NO: 448532 - DNA, 25 bp, Rattus norvegicus
tgatcttgccggtgaacctttggta

SEQ ID NO: 448533 - DNA, 25 bp, Rattus norvegicus
gaacctttggtacagcgaagccatg

SEQ ID NO: 448534 - DNA, 25 bp, Rattus norvegicus
cgctctgcgctagctcactggttag

SEQ ID NO: 448535 - DNA, 25 bp, Rattus norvegicus
cactggttaggatgcttcggaaaaa

SEQ ID NO: 448536 - DNA, 25 bp, Rattus norvegicus
aagaaaaaagacgagccctgccgct

SEQ ID NO: 448537 - DNA, 25 bp, Rattus norvegicus
gccactcgcgagtcgagtcgcctgg

SEQ ID NO: 448538 - DNA, 25 bp, Rattus norvegicus
gtgctgagcgactctgcctggctca

SEQ ID NO: 448539 - DNA, 25 bp, Rattus norvegicus
agcgactctgcctggctcagcttct

SEQ ID NO: 448540 - DNA, 25 bp, Rattus norvegicus
tacagcgaagccatgggccgccgct

SEQ ID NO: 448541 - DNA, 25 bp, Rattus norvegicus
gagacccttaggactcgtcaggcct

SEQ ID NO: 448542 - DNA, 25 bp, Rattus norvegicus
cagggatcgccgtcagggtcaacgc

SEQ ID NO: 448543 - DNA, 25 bp, Rattus norvegicus
gtcaacgcgcgatgcgcgcttcctt

SEQ ID NO: 448544 - DNA, 25 bp, Rattus norvegicus
tatttccgccactgactgctggcgc

SEQ ID NO: 448545 - DNA, 25 bp, Rattus norvegicus
tggcgcgccatatttccgccactga

SEQ ID NO: 448546 - DNA, 25 bp, Rattus norvegicus
taatactggacactggcgcgccata

SEQ ID NO: 448547 - DNA, 25 bp, Rattus norvegicus
ttctctaatactggacactggcgcg

SEQ ID NO: 448548 - DNA, 25 bp, Rattus norvegicus
gcctggatagaaactttctctaata

SEQ ID NO: 448549 - DNA, 25 bp, Rattus norvegicus
ccctagcaacacagggcctggatag

SEQ ID NO: 448550 - DNA, 25 bp, Rattus norvegicus
acaagaagggcgcgaagctctcctc

SEQ ID NO: 448551 - DNA, 25 bp, Rattus norvegicus
tcccaggctggcatcttgcccaccg

SEQ ID NO: 448552 - DNA, 25 bp, Rattus norvegicus
tcctctctccgttccgttgcgaagg

SEQ ID NO: 448553 - DNA, 25 bp, Rattus norvegicus
gcaacgagggacaccgaggaacgcc

SEQ ID NO: 448554 - DNA, 25 bp, Rattus norvegicus
tcccagtggctctccacgcccagca

SEQ ID NO: 448555 - DNA, 25 bp, Rattus norvegicus
tctccgttccgttgcgaaggttaca

SEQ ID NO: 448556 - DNA, 25 bp, Rattus norvegicus
tccagcttccgctcctgctcccggg

SEQ ID NO: 448557 - DNA, 25 bp, Rattus norvegicus
ggagccgccggtggacgctcttcac

SEQ ID NO: 448558 - DNA, 25 bp, Rattus norvegicus
tatttcttgcggagccgccggtgga

SEQ ID NO: 448559 - DNA, 25 bp, Rattus norvegicus
tcgcggtatttcttgcggagccgcc

SEQ ID NO: 448560 - DNA, 25 bp, Rattus norvegicus
accttcgcggtatttcttgcggagc

SEQ ID NO: 448561 - DNA, 25 bp, Rattus norvegicus
tgcctgtttaccttcgcggtatttc

SEQ ID NO: 448562 - DNA, 25 bp, Rattus norvegicus
ccgctgcctgtttaccttcgcggta

SEQ ID NO: 448563 - DNA, 25 bp, Rattus norvegicus
gtgaggctagaaagagctgacccag

SEQ ID NO: 448564 - DNA, 25 bp, Rattus norvegicus
cctgtgaggctagaaagagctgacc

SEQ ID NO: 448565 - DNA, 25 bp, Rattus norvegicus
caatggtggcctgtgaggctagaaa

SEQ ID NO: 448566 - DNA, 25 bp, Rattus norvegicus
cccgtgtatgtcaatggtggcctgt

SEQ ID NO: 448567 - DNA, 25 bp, Rattus norvegicus
ctccgggagccgatagcccgtggcc

SEQ ID NO: 448568 - DNA, 25 bp, Rattus norvegicus
gtggcgactgcccattagggctccg

SEQ ID NO: 448569 - DNA, 25 bp, Rattus norvegicus
gactgcccattagggctccgggagc

SEQ ID NO: 448570 - DNA, 25 bp, Rattus norvegicus
caaacaccagccacaagttttattt

SEQ ID NO: 448571 - DNA, 25 bp, Rattus norvegicus
gttctagaacgtcgtgtaaccaatg

SEQ ID NO: 448572 - DNA, 25 bp, Rattus norvegicus
aaactgacgcgatagatagaagggg

SEQ ID NO: 448573 - DNA, 25 bp, Rattus norvegicus
tttcggaactttgagaaactgacgc

SEQ ID NO: 448574 - DNA, 25 bp, Rattus norvegicus
agccgtgcccgcgaaggttatttcg

SEQ ID NO: 448575 - DNA, 25 bp, Rattus norvegicus
ttcccttcgcgcgtcaagttctctg

SEQ ID NO: 448576 - DNA, 25 bp, Rattus norvegicus
tggaagagaccctcctgcacaaaca

SEQ ID NO: 448577 - DNA, 25 bp, Rattus norvegicus
atttaggtcaaggacgccgggagca

SEQ ID NO: 448578 - DNA, 25 bp, Rattus norvegicus
agccacagcgcggaaatttaggtca

SEQ ID NO: 448579 - DNA, 25 bp, Rattus norvegicus
ccggtttccagccacagcgcggaaa

SEQ ID NO: 448580 - DNA, 25 bp, Rattus norvegicus
tagttcgcactacccattcaagttc

SEQ ID NO: 448581 - DNA, 25 bp, Rattus norvegicus
ccgagtcagctcagatcacatgggc

SEQ ID NO: 448582 - DNA, 25 bp, Rattus norvegicus
gtaaccaatgcggtgacgtcacgca

SEQ ID NO: 448583 - DNA, 25 bp, Rattus norvegicus
ccttcctcggcagaggtacggagcc

SEQ ID NO: 448584 - DNA, 25 bp, Rattus norvegicus
ttccctccccgcattggcagtggtg

SEQ ID NO: 448585 - DNA, 25 bp, Rattus norvegicus
acgaagccaccgtgccgcggaccgc

SEQ ID NO: 448586 - DNA, 25 bp, Rattus norvegicus
tcgggaaggctcttcccggacctca

SEQ ID NO: 448587 - DNA, 25 bp, Rattus norvegicus
gaggcagcttcggaacttttccctc

SEQ ID NO: 448588 - DNA, 25 bp, Rattus norvegicus
ccctcgaggcagcttcggaactttt

SEQ ID NO: 448589 - DNA, 25 bp, Rattus norvegicus
ttttgttccctcgaggcagcttcgg

SEQ ID NO: 448590 - DNA, 25 bp, Rattus norvegicus
atcaggcttttgttccctcgaggca

SEQ ID NO: 448591 - DNA, 25 bp, Rattus norvegicus
cccaaatcaggcttttgttccctcg

SEQ ID NO: 448592 - DNA, 25 bp, Rattus norvegicus
aatgtccagtccagttcagccggcc

SEQ ID NO: 448593 - DNA, 25 bp, Rattus norvegicus
ttgcttcaatgtccagtccagttca

SEQ ID NO: 448594 - DNA, 25 bp, Rattus norvegicus
ggctggcttgcttcaatgtccagtc

SEQ ID NO: 448595 - DNA, 25 bp, Rattus norvegicus
gcctgtctccggagcaggctggctt

SEQ ID NO: 448596 - DNA, 25 bp, Rattus norvegicus
ctgcgcgttggagcctccttcagct

SEQ ID NO: 448597 - DNA, 25 bp, Rattus norvegicus
ctagggcagcgcacgaagccaccgt

SEQ ID NO: 448598 - DNA, 25 bp, Rattus norvegicus
cagcgcttgctgctccgttctgcgg

SEQ ID NO: 448599 - DNA, 25 bp, Rattus norvegicus
agcctccgagaaagcgcgagacaca

SEQ ID NO: 448600 - DNA, 25 bp, Rattus norvegicus
tgccagcgcgagacagcgcgagcct

SEQ ID NO: 448601 - DNA, 25 bp, Rattus norvegicus
acatacgtacagagatccgggtttg

SEQ ID NO: 448602 - DNA, 25 bp, Rattus norvegicus
gcgtttgcgttctggacccaacctc

SEQ ID NO: 448603 - DNA, 25 bp, Rattus norvegicus
ggccacggtgacatgtgtcagattt

SEQ ID NO: 448604 - DNA, 25 bp, Rattus norvegicus
cgggtcgcgcagcaaagtttcgccc

SEQ ID NO: 448605 - DNA, 25 bp, Rattus norvegicus
cgactttgctccacgctgctcgggt

SEQ ID NO: 448606 - DNA, 25 bp, Rattus norvegicus
actcgcggccagactgcgactttgc

SEQ ID NO: 448607 - DNA, 25 bp, Rattus norvegicus
gtcgcggtaagtttcttctccctca

SEQ ID NO: 448608 - DNA, 25 bp, Rattus norvegicus
cacagagggtgccacctcctgggac

SEQ ID NO: 448609 - DNA, 25 bp, Rattus norvegicus
cagggcatttatgccgcggccgcgt

SEQ ID NO: 448610 - DNA, 25 bp, Rattus norvegicus
cgcgagacacatcggcgcgtgcagc

SEQ ID NO: 448611 - DNA, 25 bp, Rattus norvegicus
atgtgtcagatttcgatatggggtc

SEQ ID NO: 448612 - DNA, 25 bp, Rattus norvegicus
agcccgagggtgaaagagacgcaca

SEQ ID NO: 448613 - DNA, 25 bp, Rattus norvegicus
gcgccacagagagagaagtgtttga

SEQ ID NO: 448614 - DNA, 25 bp, Rattus norvegicus
tggatcctaaagtccttcccggaga

SEQ ID NO: 448615 - DNA, 25 bp, Rattus norvegicus
ctggtcagactgaccggacgtgatg

SEQ ID NO: 448616 - DNA, 25 bp, Rattus norvegicus
acggctgctttcaaatcctaacttc

SEQ ID NO: 448617 - DNA, 25 bp, Rattus norvegicus
cggcgtgctggactctaaaaacagt

SEQ ID NO: 448618 - DNA, 25 bp, Rattus norvegicus
tgtcccatttgcttttcccgccaga

SEQ ID NO: 448619 - DNA, 25 bp, Rattus norvegicus
ttttcccgccagaggcaggcagttt

SEQ ID NO: 448620 - DNA, 25 bp, Rattus norvegicus
gtttcctgcacccagcacctaagta

SEQ ID NO: 448621 - DNA, 25 bp, Rattus norvegicus
cacggtgagtaacgagtgctcgcta

SEQ ID NO: 448622 - DNA, 25 bp, Rattus norvegicus
ctagtagcgagtttctgggacgtgc

SEQ ID NO: 448623 - DNA, 25 bp, Rattus norvegicus
tgggacgtgcttgcacacttacgga

SEQ ID NO: 448624 - DNA, 25 bp, Rattus norvegicus
aagaccggctccaacttcgtagttg

SEQ ID NO: 448625 - DNA, 25 bp, Rattus norvegicus
ccggatatgatgaaagggcgccaca

SEQ ID NO: 448626 - DNA, 25 bp, Rattus norvegicus
gccattggctaccagggcctctttg

SEQ ID NO: 448627 - DNA, 25 bp, Rattus norvegicus
ctgtcgctgcgcctgaaacttttcg

SEQ ID NO: 448628 - DNA, 25 bp, Rattus norvegicus
tggaccctgcgacttgctgtcgctg

SEQ ID NO: 448629 - DNA, 25 bp, Rattus norvegicus
aaaggcgggcgtggtcgcctcacct

SEQ ID NO: 448630 - DNA, 25 bp, Rattus norvegicus
cctggaaaccaaaatgaagaaggtg

SEQ ID NO: 448631 - DNA, 25 bp, Rattus norvegicus
cgacgcccagcatggacctggaaac

SEQ ID NO: 448632 - DNA, 25 bp, Rattus norvegicus
ggacgcgggactgagcccatccgac

SEQ ID NO: 448633 - DNA, 25 bp, Rattus norvegicus
gctaccagggcctctttgttccagg

SEQ ID NO: 448634 - DNA, 25 bp, Rattus norvegicus
ggcgctgtcccgctgccattggcta

SEQ ID NO: 448635 - DNA, 25 bp, Rattus norvegicus
ctgattggccactacccggcgctgt

SEQ ID NO: 448636 - DNA, 25 bp, Rattus norvegicus
agctgcacgctcaggctgcgaaggt

SEQ ID NO: 448637 - DNA, 25 bp, Rattus norvegicus
tcaccttgctagctgcacgctcagg

SEQ ID NO: 448638 - DNA, 25 bp, Rattus norvegicus
ttcccgcagcggagatccgggacgc

SEQ ID NO: 448639 - DNA, 25 bp, Rattus norvegicus
gctgcgcctgaaacttttcgaaaaa

SEQ ID NO: 448640 - DNA, 25 bp, Rattus norvegicus
cctagccagatgctgggcgaccgct

SEQ ID NO: 448641 - DNA, 25 bp, Rattus norvegicus
gatgctgggcgaccgctgactcgcc

SEQ ID NO: 448642 - DNA, 25 bp, Rattus norvegicus
gtgaccgggtgcctagccagatgct

SEQ ID NO: 448643 - DNA, 25 bp, Rattus norvegicus
acagggacgaacagacacgtgctgg

SEQ ID NO: 448644 - DNA, 25 bp, Rattus norvegicus
agacctagagcgacagggacgaaca

SEQ ID NO: 448645 - DNA, 25 bp, Rattus norvegicus
gaccgctgggacagacctagagcga

SEQ ID NO: 448646 - DNA, 25 bp, Rattus norvegicus
ccagggctaagcgtactggctgcga

SEQ ID NO: 448647 - DNA, 25 bp, Rattus norvegicus
tctccacctagaaagtttcaccttg

SEQ ID NO: 448648 - DNA, 25 bp, Rattus norvegicus
tctggcttcagactccagagctggg

SEQ ID NO: 448649 - DNA, 25 bp, Rattus norvegicus
gctgatctccctttgctctggcttc

SEQ ID NO: 448650 - DNA, 25 bp, Rattus norvegicus
gactcggggccgctgatctcccttt

SEQ ID NO: 448651 - DNA, 25 bp, Rattus norvegicus
cgcgggtgactttagagcaccagga

SEQ ID NO: 448652 - DNA, 25 bp, Rattus norvegicus
ctttgcgcgggtgactttagagcac

SEQ ID NO: 448653 - DNA, 25 bp, Rattus norvegicus
agaaagtttcaccttgtcgagggcg

SEQ ID NO: 448654 - DNA, 25 bp, Rattus norvegicus
tcgtgtgtcccgaaatgtgttcttc

SEQ ID NO: 448655 - DNA, 25 bp, Rattus norvegicus
accctgtcttccgtaggcgtgccaa

SEQ ID NO: 448656 - DNA, 25 bp, Rattus norvegicus
tgctgacggtgggaaccctgtcttc

SEQ ID NO: 448657 - DNA, 25 bp, Rattus norvegicus
atgccgtccgtgtgctgctgacggt

SEQ ID NO: 448658 - DNA, 25 bp, Rattus norvegicus
atagccaagcggtagcgatgccgtc

SEQ ID NO: 448659 - DNA, 25 bp, Rattus norvegicus
tctgaggttgtgaaatagccaagcg

SEQ ID NO: 448660 - DNA, 25 bp, Rattus norvegicus
tcttgagttgtggttctgaggttgt

SEQ ID NO: 448661 - DNA, 25 bp, Rattus norvegicus
acggatgtgtcttgagttgtggttc

SEQ ID NO: 448662 - DNA, 25 bp, Rattus norvegicus
tgcagaacatctttgacaacggatg

SEQ ID NO: 448663 - DNA, 25 bp, Rattus norvegicus
cccgcgaacgctcaaacagttgttt

SEQ ID NO: 448664 - DNA, 25 bp, Rattus norvegicus
atgtgttcttcgacgttaggaagtc

SEQ ID NO: 448665 - DNA, 25 bp, Rattus norvegicus
atttttactttcatcgtgtgtcccg

SEQ ID NO: 448666 - DNA, 25 bp, Rattus norvegicus
gtagcttattcgcagcccgcgaacg

SEQ ID NO: 448667 - DNA, 25 bp, Rattus norvegicus
gttaggaagtcaaatgcagaacatc

SEQ ID NO: 448668 - DNA, 25 bp, Rattus norvegicus
ccgggctgtcctcctaaaatactag

SEQ ID NO: 448669 - DNA, 25 bp, Rattus norvegicus
ctgttacgtcagtggttccctcggc

SEQ ID NO: 448670 - DNA, 25 bp, Rattus norvegicus
tgaatcatcccggtagccagcgagc

SEQ ID NO: 448671 - DNA, 25 bp, Rattus norvegicus
tcaagtcctgcatcgtgtggtcgtg

SEQ ID NO: 448672 - DNA, 25 bp, Rattus norvegicus
tcgtggacctatctgtggaccgtgt

SEQ ID NO: 448673 - DNA, 25 bp, Rattus norvegicus
tggttcttcctcgtgctcttcctgg

SEQ ID NO: 448674 - DNA, 25 bp, Rattus norvegicus
ttcctggtctacatcctgagggtgc

SEQ ID NO: 448675 - DNA, 25 bp, Rattus norvegicus
cccggaaagttagtgcaaagtcgcg

SEQ ID NO: 448676 - DNA, 25 bp, Rattus norvegicus
gctcgagcgtccgaattagcgccga

SEQ ID NO: 448677 - DNA, 25 bp, Rattus norvegicus
gagggcatgtccataggtccttcta

SEQ ID NO: 448678 - DNA, 25 bp, Rattus norvegicus
cttctaggagcatggatgacgtgtc

SEQ ID NO: 448679 - DNA, 25 bp, Rattus norvegicus
tgtcaggtcacccaacggaatgtcg

SEQ ID NO: 448680 - DNA, 25 bp, Rattus norvegicus
tcaacgacaatctgagcacaggtca

SEQ ID NO: 448681 - DNA, 25 bp, Rattus norvegicus
cactacacgcgcgagctgttacgtc

SEQ ID NO: 448682 - DNA, 25 bp, Rattus norvegicus
cgtctacatcaggtcagactccgtg

SEQ ID NO: 448683 - DNA, 25 bp, Rattus norvegicus
ctcccgcgcaccctgtcctttcggt

SEQ ID NO: 448684 - DNA, 25 bp, Rattus norvegicus
ggccgcctcgcccacagccaattcc

SEQ ID NO: 448685 - DNA, 25 bp, Rattus norvegicus
cccagcgagcgataaagggcagccg

SEQ ID NO: 448686 - DNA, 25 bp, Rattus norvegicus
tttcaaaagacgagcccagcgagcg

SEQ ID NO: 448687 - DNA, 25 bp, Rattus norvegicus
taaagtttcaaaagacgagcccagc

SEQ ID NO: 448688 - DNA, 25 bp, Rattus norvegicus
ggtgagactcactgataaagtttca

SEQ ID NO: 448689 - DNA, 25 bp, Rattus norvegicus
cccgccgctcgcgtctgcggctagt

SEQ ID NO: 448690 - DNA, 25 bp, Rattus norvegicus
catcaggtcagactccgtgtgcggg

SEQ ID NO: 448691 - DNA, 25 bp, Rattus norvegicus
cccttgcgtctacatcaggtcagac

SEQ ID NO: 448692 - DNA, 25 bp, Rattus norvegicus
cccgccaggcgcagtcaaagaaggg

SEQ ID NO: 448693 - DNA, 25 bp, Rattus norvegicus
ggctagtggtgagactcactgataa

SEQ ID NO: 448694 - DNA, 25 bp, Rattus norvegicus
catgcgtgcccggagcagaagcgct

SEQ ID NO: 448695 - DNA, 25 bp, Rattus norvegicus
tgcccggagcagaagcgctcagctc

SEQ ID NO: 448696 - DNA, 25 bp, Rattus norvegicus
tggcacccgcatgccgagagtggca

SEQ ID NO: 448697 - DNA, 25 bp, Rattus norvegicus
gcatgccgagagtggcacccgcatg

SEQ ID NO: 448698 - DNA, 25 bp, Rattus norvegicus
cgagagtggcacccgcatgccgaga

SEQ ID NO: 448699 - DNA, 25 bp, Rattus norvegicus
tgccgagagtgacacccgcatgccg

SEQ ID NO: 448700 - DNA, 25 bp, Rattus norvegicus
gagtgacacccgcatgccgagagtg

SEQ ID NO: 448701 - DNA, 25 bp, Rattus norvegicus
tgccgagagtggcacccgcatgccg

SEQ ID NO: 448702 - DNA, 25 bp, Rattus norvegicus
catgccgagagtggcacccgcatgc

SEQ ID NO: 448703 - DNA, 25 bp, Rattus norvegicus
atgccgagagtgacacccgcatgcc

SEQ ID NO: 448704 - DNA, 25 bp, Rattus norvegicus
agtgacacccgcatgccgagagtgg

SEQ ID NO: 448705 - DNA, 25 bp, Rattus norvegicus
ccgagagtggcacccgcatgccgag

SEQ ID NO: 448706 - DNA, 25 bp, Rattus norvegicus
agtggcacccgcatgccgagagtga

SEQ ID NO: 448707 - DNA, 25 bp, Rattus norvegicus
ccgagagtgacacccgcatgccgag

SEQ ID NO: 448708 - DNA, 25 bp, Rattus norvegicus
agtggcacccgcatgccgagagtgg

SEQ ID NO: 448709 - DNA, 25 bp, Rattus norvegicus
atgccgagagtggcacccgcatgcc

SEQ ID NO: 448710 - DNA, 25 bp, Rattus norvegicus
cttcctgctctagcggatccgaatg

SEQ ID NO: 448711 - DNA, 25 bp, Rattus norvegicus
gcaaaagaaggcacgcttcctccca

SEQ ID NO: 448712 - DNA, 25 bp, Rattus norvegicus
tgatgtccgaaagacagacacccgg

SEQ ID NO: 448713 - DNA, 25 bp, Rattus norvegicus
gcctcgcgctgatgtccgaaagaca

SEQ ID NO: 448714 - DNA, 25 bp, Rattus norvegicus
aggaccaagaactggcaccggagcg

SEQ ID NO: 448715 - DNA, 25 bp, Rattus norvegicus
gtcgctcccacaggaccaagaactg

SEQ ID NO: 448716 - DNA, 25 bp, Rattus norvegicus
tctgcgcgctggaaacgcggagccc

SEQ ID NO: 448717 - DNA, 25 bp, Rattus norvegicus
cgcttaaccctctgcgcgctggaaa

SEQ ID NO: 448718 - DNA, 25 bp, Rattus norvegicus
tctagcggatccgaatgcgagctcg

SEQ ID NO: 448719 - DNA, 25 bp, Rattus norvegicus
gtcgccatcttcctgctctagcgga

SEQ ID NO: 448720 - DNA, 25 bp, Rattus norvegicus
cagctcgcgctgtccgtcgccatct

SEQ ID NO: 448721 - DNA, 25 bp, Rattus norvegicus
acaagtcgggctcgcagctcgcgct

SEQ ID NO: 448722 - DNA, 25 bp, Rattus norvegicus
gtctacacggatcccggtgcccagg

SEQ ID NO: 448723 - DNA, 25 bp, Rattus norvegicus
cgcttaacccgctgctggctgtggc

SEQ ID NO: 448724 - DNA, 25 bp, Rattus norvegicus
tctctcctatctgcgccaagagggg

SEQ ID NO: 448725 - DNA, 25 bp, Rattus norvegicus
ccaggccgggcgaacacagagacat

SEQ ID NO: 448726 - DNA, 25 bp, Rattus norvegicus
tggcgctctcgcgagagtaactata

SEQ ID NO: 448727 - DNA, 25 bp, Rattus norvegicus
ttaaatactgaggacgcgcaacgac

SEQ ID NO: 448728 - DNA, 25 bp, Rattus norvegicus
tcagcgcacgcgatctgtcagtagc

SEQ ID NO: 448729 - DNA, 25 bp, Rattus norvegicus
tcgggctcgctacccagaagggtga

SEQ ID NO: 448730 - DNA, 25 bp, Rattus norvegicus
agtaactatagtcacggcaggcgtg

SEQ ID NO: 448731 - DNA, 25 bp, Rattus norvegicus
ctccatcccagaggccagtgacatg

SEQ ID NO: 448732 - DNA, 25 bp, Rattus norvegicus
ggcgaccgtctaggcgcacagtcct

SEQ ID NO: 448733 - DNA, 25 bp, Rattus norvegicus
caaatcgccggacagggaaggagca

SEQ ID NO: 448734 - DNA, 25 bp, Rattus norvegicus
tgcacaggactctccgtcgccggag

SEQ ID NO: 448735 - DNA, 25 bp, Rattus norvegicus
gcgggtcaccaaggctcataccgga

SEQ ID NO: 448736 - DNA, 25 bp, Rattus norvegicus
cataccggaccgcttgacagcaggc

SEQ ID NO: 448737 - DNA, 25 bp, Rattus norvegicus
caccgggaaagttgaggctcaccga

SEQ ID NO: 448738 - DNA, 25 bp, Rattus norvegicus
gttctccaaggcagacgtcatgctg

SEQ ID NO: 448739 - DNA, 25 bp, Rattus norvegicus
tacggttgatgtagttctccaaggc

SEQ ID NO: 448740 - DNA, 25 bp, Rattus norvegicus
ttccgggaatctgagaggaatcagc

SEQ ID NO: 448741 - DNA, 25 bp, Rattus norvegicus
tgagaggaatcagcaacaaggagac

SEQ ID NO: 448742 - DNA, 25 bp, Rattus norvegicus
acaaggagacaaaacaccgcccgct

SEQ ID NO: 448743 - DNA, 25 bp, Rattus norvegicus
accgcccgctagaaacacgtacaga

SEQ ID NO: 448744 - DNA, 25 bp, Rattus norvegicus
acacgtacagattcgcgcccgctgg

SEQ ID NO: 448745 - DNA, 25 bp, Rattus norvegicus
tatcgcgagactctgaggcctcagc

SEQ ID NO: 448746 - DNA, 25 bp, Rattus norvegicus
ggcctcagcggtgacgaatcagtaa

SEQ ID NO: 448747 - DNA, 25 bp, Rattus norvegicus
cgcagcgtgtttccgctgggcttcc

SEQ ID NO: 448748 - DNA, 25 bp, Rattus norvegicus
caggcggaagtgtagagttgtcacc

SEQ ID NO: 448749 - DNA, 25 bp, Rattus norvegicus
agacactggagggttctaccggacg

SEQ ID NO: 448750 - DNA, 25 bp, Rattus norvegicus
cgcccgctggcgaacgcaaatatcg

SEQ ID NO: 448751 - DNA, 25 bp, Rattus norvegicus
cccgcccgaggatacggttgatgta

SEQ ID NO: 448752 - DNA, 25 bp, Rattus norvegicus
acctggatgctctcccttggtgaca

SEQ ID NO: 448753 - DNA, 25 bp, Rattus norvegicus
ggcccatcaggcgaacgctctcttt

SEQ ID NO: 448754 - DNA, 25 bp, Rattus norvegicus
cttgaacagagagtgaaggggccca

SEQ ID NO: 448755 - DNA, 25 bp, Rattus norvegicus
gctcccgagctctataactgtcaca

SEQ ID NO: 448756 - DNA, 25 bp, Rattus norvegicus
gtgcaaggcgacagcaaagtctcta

SEQ ID NO: 448757 - DNA, 25 bp, Rattus norvegicus
ctgcctttccctttccgggtgcaag

SEQ ID NO: 448758 - DNA, 25 bp, Rattus norvegicus
gctcgccagagctttatttatgctc

SEQ ID NO: 448759 - DNA, 25 bp, Rattus norvegicus
ccgcacctttttgaacttgttgctg

SEQ ID NO: 448760 - DNA, 25 bp, Rattus norvegicus
aggagacgcctttgcctaacctgcg

SEQ ID NO: 448761 - DNA, 25 bp, Rattus norvegicus
gaagcttccctttgttcatccgagg

SEQ ID NO: 448762 - DNA, 25 bp, Rattus norvegicus
aacgctctctttcggctggcacaga

SEQ ID NO: 448763 - DNA, 25 bp, Rattus norvegicus
actgcacctgagctgaacttgaaca

SEQ ID NO: 448764 - DNA, 25 bp, Rattus norvegicus
cttatttatcgatcgcacgggcaga

SEQ ID NO: 448765 - DNA, 25 bp, Rattus norvegicus
cggcgcgtactttgccaggtatgta

SEQ ID NO: 448766 - DNA, 25 bp, Rattus norvegicus
gggtgctgctgtacccaagccggac

SEQ ID NO: 448767 - DNA, 25 bp, Rattus norvegicus
ccaaagggctgcattggctccaaca

SEQ ID NO: 448768 - DNA, 25 bp, Rattus norvegicus
agagacgctcctcgcggagagccaa

SEQ ID NO: 448769 - DNA, 25 bp, Rattus norvegicus
aggcagacactcatccggggagaga

SEQ ID NO: 448770 - DNA, 25 bp, Rattus norvegicus
acactcggggacacaaggcagacac

SEQ ID NO: 448771 - DNA, 25 bp, Rattus norvegicus
tgtggccactcaccgttcgagctgc

SEQ ID NO: 448772 - DNA, 25 bp, Rattus norvegicus
agagatgcgggacctgtggccactc

SEQ ID NO: 448773 - DNA, 25 bp, Rattus norvegicus
tcgcaccgcgctgggtagaagccgc

SEQ ID NO: 448774 - DNA, 25 bp, Rattus norvegicus
aagccggaccggtcttcattcacta

SEQ ID NO: 448775 - DNA, 25 bp, Rattus norvegicus
cgtccgggaataatggatgagcctg

SEQ ID NO: 448776 - DNA, 25 bp, Rattus norvegicus
agaaatgcagtttgccgtccgggaa

SEQ ID NO: 448777 - DNA, 25 bp, Rattus norvegicus
tctttggaagaacgtgagaaatgca

SEQ ID NO: 448778 - DNA, 25 bp, Rattus norvegicus
atcctgccgggtgactagggtttct

SEQ ID NO: 448779 - DNA, 25 bp, Rattus norvegicus
agagcacaaagcctgcgcggtccgg

SEQ ID NO: 448780 - DNA, 25 bp, Rattus norvegicus
ccgcgatgttgtacctagaagacta

SEQ ID NO: 448781 - DNA, 25 bp, Rattus norvegicus
tttctcacggtaactggcagcctcg

SEQ ID NO: 448782 - DNA, 25 bp, Rattus norvegicus
ccgcttcacggagatgcgcgagatg

SEQ ID NO: 448783 - DNA, 25 bp, Rattus norvegicus
ccgcgctacttttttcaggctgtta

SEQ ID NO: 448784 - DNA, 25 bp, Rattus norvegicus
ggcggcaggcacaccataccgttaa

SEQ ID NO: 448785 - DNA, 25 bp, Rattus norvegicus
taacacgcggggcacagcaaacact

SEQ ID NO: 448786 - DNA, 25 bp, Rattus norvegicus
tactgcatggagatgacgacactgc

SEQ ID NO: 448787 - DNA, 25 bp, Rattus norvegicus
cctttgacagtgattgagcagcttc

SEQ ID NO: 448788 - DNA, 25 bp, Rattus norvegicus
cctctgacggactgtgcctttgaca

SEQ ID NO: 448789 - DNA, 25 bp, Rattus norvegicus
ctacgctcggggaaaaagatgacta

SEQ ID NO: 448790 - DNA, 25 bp, Rattus norvegicus
ccggttgacgtcatcgctccagaca

SEQ ID NO: 448791 - DNA, 25 bp, Rattus norvegicus
tcaggcgccaaagtggagccttttt

SEQ ID NO: 448792 - DNA, 25 bp, Rattus norvegicus
cgccatattggaagggacaaaactc

SEQ ID NO: 448793 - DNA, 25 bp, Rattus norvegicus
tccggcgacagcgagtgacacaaat

SEQ ID NO: 448794 - DNA, 25 bp, Rattus norvegicus
cgctgcagcggagacccacccacat

SEQ ID NO: 448795 - DNA, 25 bp, Rattus norvegicus
ggcaaacaccggcttccaggtgcag

SEQ ID NO: 448796 - DNA, 25 bp, Rattus norvegicus
ccacatcgggctgccaaggcagcgg

SEQ ID NO: 448797 - DNA, 25 bp, Rattus norvegicus
cccgagcctcacctgcctgcggtcg

SEQ ID NO: 448798 - DNA, 25 bp, Rattus norvegicus
tcgcgccgccgtcagttctgacgga

SEQ ID NO: 448799 - DNA, 25 bp, Rattus norvegicus
ccgtcagttctgacggaggccgacg

SEQ ID NO: 448800 - DNA, 25 bp, Rattus norvegicus
cgccgaggaggaagccagctcgccc

SEQ ID NO: 448801 - DNA, 25 bp, Rattus norvegicus
aggcctcctcccacgcttcccgccg

SEQ ID NO: 448802 - DNA, 25 bp, Rattus norvegicus
cccggtcgcgtctaggactcaatct

SEQ ID NO: 448803 - DNA, 25 bp, Rattus norvegicus
cgcgtctaggactcaatctggactt

SEQ ID NO: 448804 - DNA, 25 bp, Rattus norvegicus
ggactcaatctggacttgccacgtg

SEQ ID NO: 448805 - DNA, 25 bp, Rattus norvegicus
caatctggacttgccacgtgggagc

SEQ ID NO: 448806 - DNA, 25 bp, Rattus norvegicus
ttgccacgtgggagctgccgcatcc

SEQ ID NO: 448807 - DNA, 25 bp, Rattus norvegicus
cacgaggggcaaacaccggcttcca

SEQ ID NO: 448808 - DNA, 25 bp, Rattus norvegicus
ggacccggctggagatgcgaatcct

SEQ ID NO: 448809 - DNA, 25 bp, Rattus norvegicus
ccggaggtcacccagtcagagtcct

SEQ ID NO: 448810 - DNA, 25 bp, Rattus norvegicus
tcaggacacctggacaccggaggtc

SEQ ID NO: 448811 - DNA, 25 bp, Rattus norvegicus
ctgagactcgtgtggtcaggacacc

SEQ ID NO: 448812 - DNA, 25 bp, Rattus norvegicus
ggaagttactctgaacctctcgatg

SEQ ID NO: 448813 - DNA, 25 bp, Rattus norvegicus
tggattcagaattgtcggcagcacc

SEQ ID NO: 448814 - DNA, 25 bp, Rattus norvegicus
tcgcctgggtaagtgataggacctc

SEQ ID NO: 448815 - DNA, 25 bp, Rattus norvegicus
gttcagctactgtgcgtgtgtcgcc

SEQ ID NO: 448816 - DNA, 25 bp, Rattus norvegicus
atgcgaatcctgcagagcttcctcg

SEQ ID NO: 448817 - DNA, 25 bp, Rattus norvegicus
tgtctcggtgttcccactctctgca

SEQ ID NO: 448818 - DNA, 25 bp, Rattus norvegicus
gcccacggtcacctagctctatagt

SEQ ID NO: 448819 - DNA, 25 bp, Rattus norvegicus
agcgctcagatcctggccgctgcag

SEQ ID NO: 448820 - DNA, 25 bp, Rattus norvegicus
gctgtgctgccagcgctcagatcct

SEQ ID NO: 448821 - DNA, 25 bp, Rattus norvegicus
gagcttcctcgcgtgcgttcagcta

SEQ ID NO: 448822 - DNA, 25 bp, Rattus norvegicus
tgtccatgactgagtcgccagcgtc

SEQ ID NO: 448823 - DNA, 25 bp, Rattus norvegicus
acgcggccttaccagcttgtactgc

SEQ ID NO: 448824 - DNA, 25 bp, Rattus norvegicus
cccttgagacttagagcgcagttga

SEQ ID NO: 448825 - DNA, 25 bp, Rattus norvegicus
ccaaactcgctttgcggggctctga

SEQ ID NO: 448826 - DNA, 25 bp, Rattus norvegicus
tctgagccattcactcctgctttgg

SEQ ID NO: 448827 - DNA, 25 bp, Rattus norvegicus
tcctgctttggagttcgtgtcgtac

SEQ ID NO: 448828 - DNA, 25 bp, Rattus norvegicus
ccgtcacctcggttcaggtagcaca

SEQ ID NO: 448829 - DNA, 25 bp, Rattus norvegicus
ccacgggaacgaaagggatcatgca

SEQ ID NO: 448830 - DNA, 25 bp, Rattus norvegicus
gagtggttcaccacacgcggcctta

SEQ ID NO: 448831 - DNA, 25 bp, Rattus norvegicus
atcatgcaggggatcgacgagttga

SEQ ID NO: 448832 - DNA, 25 bp, Rattus norvegicus
tgcgcgccatgattcgttcgatgga

SEQ ID NO: 448833 - DNA, 25 bp, Rattus norvegicus
gccaagggtttggatgtgctcatca

SEQ ID NO: 448834 - DNA, 25 bp, Rattus norvegicus
cgagctggagcagtcgctagcattt

SEQ ID NO: 448835 - DNA, 25 bp, Rattus norvegicus
gcgttgaggcagctactgtccatga

SEQ ID NO: 448836 - DNA, 25 bp, Rattus norvegicus
tgccagaagctgaggctcccactgc

SEQ ID NO: 448837 - DNA, 25 bp, Rattus norvegicus
gctgggcgagctttccactaaaatg

SEQ ID NO: 448838 - DNA, 25 bp, Rattus norvegicus
cgcctgggcccaaattcctggggca

SEQ ID NO: 448839 - DNA, 25 bp, Rattus norvegicus
tcccaagagcgtttggcgaccctga

SEQ ID NO: 448840 - DNA, 25 bp, Rattus norvegicus
tggccacagatcacagacacatttc

SEQ ID NO: 448841 - DNA, 25 bp, Rattus norvegicus
ttcagacgaagcaactgtggtggcc

SEQ ID NO: 448842 - DNA, 25 bp, Rattus norvegicus
gacaccctgtgtctgtgcgttcaga

SEQ ID NO: 448843 - DNA, 25 bp, Rattus norvegicus
gtcactcagtagcagcccgtgcatc

SEQ ID NO: 448844 - DNA, 25 bp, Rattus norvegicus
ccagcgtctgcgtgtcactcagtag

SEQ ID NO: 448845 - DNA, 25 bp, Rattus norvegicus
ggggaatggaatctatcgatctcta

SEQ ID NO: 448846 - DNA, 25 bp, Rattus norvegicus
agccttttgaatgtggagccgagaa

SEQ ID NO: 448847 - DNA, 25 bp, Rattus norvegicus
gccctctccgagcaaagccttttga

SEQ ID NO: 448848 - DNA, 25 bp, Rattus norvegicus
gagcgcgcttcctcgagttaacaga

SEQ ID NO: 448849 - DNA, 25 bp, Rattus norvegicus
gggtcagaggaaagccctgctgttc

SEQ ID NO: 448850 - DNA, 25 bp, Rattus norvegicus
ctcgctggaagacgggtcgagcata

SEQ ID NO: 448851 - DNA, 25 bp, Rattus norvegicus
gcccgaatgtttgccgcggacagga

SEQ ID NO: 448852 - DNA, 25 bp, Rattus norvegicus
agttcggcgcccgaatgtttgccgc

SEQ ID NO: 448853 - DNA, 25 bp, Rattus norvegicus
gctcctcgccgagcgacgctgtccc

SEQ ID NO: 448854 - DNA, 25 bp, Rattus norvegicus
actcctcctcgctggaagacgggtc

SEQ ID NO: 448855 - DNA, 25 bp, Rattus norvegicus
gccgcccggagccaccagtacctcg

SEQ ID NO: 448856 - DNA, 25 bp, Rattus norvegicus
ggttcatctcgtccctcgctgagca

SEQ ID NO: 448857 - DNA, 25 bp, Rattus norvegicus
acgtacagctgcaggcggatgcgcc

SEQ ID NO: 448858 - DNA, 25 bp, Rattus norvegicus
ctcaccacgaagacgtacagctgca

SEQ ID NO: 448859 - DNA, 25 bp, Rattus norvegicus
cgatgcacctcaccacgaagacgta

SEQ ID NO: 448860 - DNA, 25 bp, Rattus norvegicus
gttgaatgggtacgcgatgcacctc

SEQ ID NO: 448861 - DNA, 25 bp, Rattus norvegicus
ccactcaccttctgctgcctccggg

SEQ ID NO: 448862 - DNA, 25 bp, Rattus norvegicus
ataagtggccgcaggaggctcccag

SEQ ID NO: 448863 - DNA, 25 bp, Rattus norvegicus
gacacgtcgagttcggcgcccgaat

SEQ ID NO: 448864 - DNA, 25 bp, Rattus norvegicus
gcctcgtgacgtcactctacagttg

SEQ ID NO: 448865 - DNA, 25 bp, Rattus norvegicus
gagcccgccatgctcgtccacgagg

SEQ ID NO: 448866 - DNA, 25 bp, Rattus norvegicus
ccgcagtcaaccacgcagggaggca

SEQ ID NO: 448867 - DNA, 25 bp, Rattus norvegicus
ggctcttacccggtgccgcagtcaa

SEQ ID NO: 448868 - DNA, 25 bp, Rattus norvegicus
tcaggacgcccagcgaagcgtgagt

SEQ ID NO: 448869 - DNA, 25 bp, Rattus norvegicus
aaatggcttcaggacgcccagcgaa

SEQ ID NO: 448870 - DNA, 25 bp, Rattus norvegicus
cggggaaatggcttcaggacgccca

SEQ ID NO: 448871 - DNA, 25 bp, Rattus norvegicus
tccagcggtctgaccccgcggggaa

SEQ ID NO: 448872 - DNA, 25 bp, Rattus norvegicus
cagagcctagctgccaggtcgctgc

SEQ ID NO: 448873 - DNA, 25 bp, Rattus norvegicus
cgtgacgtcactctacagttggcca

SEQ ID NO: 448874 - DNA, 25 bp, Rattus norvegicus
cgtcactctacagttggccaatcgg

SEQ ID NO: 448875 - DNA, 25 bp, Rattus norvegicus
tctacagttggccaatcggggacgc

SEQ ID NO: 448876 - DNA, 25 bp, Rattus norvegicus
cagttggccaatcggggacgcgcac

SEQ ID NO: 448877 - DNA, 25 bp, Rattus norvegicus
cgtgcaccggggacccagagcctag

SEQ ID NO: 448878 - DNA, 25 bp, Rattus norvegicus
cctgaggctcgtagtgtttcgtaca

SEQ ID NO: 448879 - DNA, 25 bp, Rattus norvegicus
gtagtgtttcgtacaccctctgccg

SEQ ID NO: 448880 - DNA, 25 bp, Rattus norvegicus
cagccacagtcggacgagacaaatc

SEQ ID NO: 448881 - DNA, 25 bp, Rattus norvegicus
gacgagacaaatccgccgcgacagc

SEQ ID NO: 448882 - DNA, 25 bp, Rattus norvegicus
cgccgcgacagctccatgatgaaaa

SEQ ID NO: 448883 - DNA, 25 bp, Rattus norvegicus
cagcatcagcaacaggcaggagcca

SEQ ID NO: 448884 - DNA, 25 bp, Rattus norvegicus
cctaaatggggcctgaggctcgtag

SEQ ID NO: 448885 - DNA, 25 bp, Rattus norvegicus
agcgaacgcatcaacaaattcgaga

SEQ ID NO: 448886 - DNA, 25 bp, Rattus norvegicus
acaaattcgagaaggaagcacccac

SEQ ID NO: 448887 - DNA, 25 bp, Rattus norvegicus
agcacccaccgttggtgcgtctttc

SEQ ID NO: 448888 - DNA, 25 bp, Rattus norvegicus
ttggtgcgtctttcctgcgaaccta

SEQ ID NO: 448889 - DNA, 25 bp, Rattus norvegicus
gcgctgaagcccagcaagaacgaca

SEQ ID NO: 448890 - DNA, 25 bp, Rattus norvegicus
gaacgacagtagcaacagccacagt

SEQ ID NO: 448891 - DNA, 25 bp, Rattus norvegicus
acaggcaggagccaaaggctagcgc

SEQ ID NO: 448892 - DNA, 25 bp, Rattus norvegicus
ccaccaggccagtagtctgttcaga

SEQ ID NO: 448893 - DNA, 25 bp, Rattus norvegicus
gactgacgcctctgttaggactaaa

SEQ ID NO: 448894 - DNA, 25 bp, Rattus norvegicus
ctccacgtagggttttggcgcaaca

SEQ ID NO: 448895 - DNA, 25 bp, Rattus norvegicus
ccgcccacctaggagggagagattt

SEQ ID NO: 448896 - DNA, 25 bp, Rattus norvegicus
agaagctgctcctgtgtcacccaag

SEQ ID NO: 448897 - DNA, 25 bp, Rattus norvegicus
ccaggcccgctcaatcgaacgtaga

SEQ ID NO: 448898 - DNA, 25 bp, Rattus norvegicus
agcccgccatgactgcgctcagaga

SEQ ID NO: 448899 - DNA, 25 bp, Rattus norvegicus
ctggcccgctgattagccgaacttc

SEQ ID NO: 448900 - DNA, 25 bp, Rattus norvegicus
gctgtttaccgtcatcccacgcgta

SEQ ID NO: 448901 - DNA, 25 bp, Rattus norvegicus
gtggagtgtcgcaaacggccaatcc

SEQ ID NO: 448902 - DNA, 25 bp, Rattus norvegicus
ccgtacttacctcgtgtggagtgtc

SEQ ID NO: 448903 - DNA, 25 bp, Rattus norvegicus
gacgctagatcgcagttttcccaga

SEQ ID NO: 448904 - DNA, 25 bp, Rattus norvegicus
ttgtcccgttaaccttgcaagagca

SEQ ID NO: 448905 - DNA, 25 bp, Rattus norvegicus
taacagcgcgcaggaaaagccagcc

SEQ ID NO: 448906 - DNA, 25 bp, Rattus norvegicus
gaccacacatttcttgccgaggaag

SEQ ID NO: 448907 - DNA, 25 bp, Rattus norvegicus
acaggggtctcggtcactgaccaca

SEQ ID NO: 448908 - DNA, 25 bp, Rattus norvegicus
agagactcgttttcttgcggggtga

SEQ ID NO: 448909 - DNA, 25 bp, Rattus norvegicus
gccggcagttacagacgcagcatcc

SEQ ID NO: 448910 - DNA, 25 bp, Rattus norvegicus
gatggtcgttgtcctcgcactccag

SEQ ID NO: 448911 - DNA, 25 bp, Rattus norvegicus
ggcagtagccgcacaatccaacatg

SEQ ID NO: 448912 - DNA, 25 bp, Rattus norvegicus
gctcagcagggttgaggtcttatta

SEQ ID NO: 448913 - DNA, 25 bp, Rattus norvegicus
gttgcgtcttgtagcaccgctctgc

SEQ ID NO: 448914 - DNA, 25 bp, Rattus norvegicus
ttgtcaggctccgaagtgggactct

SEQ ID NO: 448915 - DNA, 25 bp, Rattus norvegicus
ccgcctgtgaggaaggtctaggtta

SEQ ID NO: 448916 - DNA, 25 bp, Rattus norvegicus
aggtgcctctggtttctcgaactta

SEQ ID NO: 448917 - DNA, 25 bp, Rattus norvegicus
tcgaacttagtactggccgccaccg

SEQ ID NO: 448918 - DNA, 25 bp, Rattus norvegicus
tctggcatcactgagcgggttgcgt

SEQ ID NO: 448919 - DNA, 25 bp, Rattus norvegicus
gcccgaacccgccaaggagacattg

SEQ ID NO: 448920 - DNA, 25 bp, Rattus norvegicus
ttcaggaacacttggccgtggtaga

SEQ ID NO: 448921 - DNA, 25 bp, Rattus norvegicus
gcgatcaccctgcacggcctaagga

SEQ ID NO: 448922 - DNA, 25 bp, Rattus norvegicus
gtccagggtgaggtgttgcccaccc

SEQ ID NO: 448923 - DNA, 25 bp, Rattus norvegicus
agggcacgcagcttcgttcggatcg

SEQ ID NO: 448924 - DNA, 25 bp, Rattus norvegicus
tcggccggagcttcagcagcggaca

SEQ ID NO: 448925 - DNA, 25 bp, Rattus norvegicus
tcccatagaagtagaggcgcatcca

SEQ ID NO: 448926 - DNA, 25 bp, Rattus norvegicus
tgatgccgtgcatcccatagaagta

SEQ ID NO: 448927 - DNA, 25 bp, Rattus norvegicus
ccagcacgtccagggtgatgccgtg

SEQ ID NO: 448928 - DNA, 25 bp, Rattus norvegicus
ctaggctgagccttagcgcctgacc

SEQ ID NO: 448929 - DNA, 25 bp, Rattus norvegicus
gtaccgcaaacgcaggaagcgcttc

SEQ ID NO: 448930 - DNA, 25 bp, Rattus norvegicus
ttacgcgagcggagatcgcccttcc

SEQ ID NO: 448931 - DNA, 25 bp, Rattus norvegicus
gaagcccagcatccgcagatcaagg

SEQ ID NO: 448932 - DNA, 25 bp, Rattus norvegicus
gcctggcagaggacaccagcacgtc

SEQ ID NO: 448933 - DNA, 25 bp, Rattus norvegicus
gcgagcacgtactgcagcgccaggt

SEQ ID NO: 448934 - DNA, 25 bp, Rattus norvegicus
ggcctctcccagtcgccgggccact

SEQ ID NO: 448935 - DNA, 25 bp, Rattus norvegicus
ccactgcgcgggcttcactccaggc

SEQ ID NO: 448936 - DNA, 25 bp, Rattus norvegicus
tgcctggaaccgctgcaagcaggcg

SEQ ID NO: 448937 - DNA, 25 bp, Rattus norvegicus
agcgtggtgcctggaaccgctgcaa

SEQ ID NO: 448938 - DNA, 25 bp, Rattus norvegicus
catcgcaacccgagtggagagcgtg

SEQ ID NO: 448939 - DNA, 25 bp, Rattus norvegicus
tccaccatcgcaacccgagtggaga

SEQ ID NO: 448940 - DNA, 25 bp, Rattus norvegicus
aggagcttgtcactgcctccaccat

SEQ ID NO: 448941 - DNA, 25 bp, Rattus norvegicus
agagggcgctgctgttttgtgcaca

SEQ ID NO: 448942 - DNA, 25 bp, Rattus norvegicus
cgcatagtacactggcggagaaggc

SEQ ID NO: 448943 - DNA, 25 bp, Rattus norvegicus
ctgcgcatagtacactggcggagaa

SEQ ID NO: 448944 - DNA, 25 bp, Rattus norvegicus
tggctgcgcatagtacactggcgga

SEQ ID NO: 448945 - DNA, 25 bp, Rattus norvegicus
ccggtggctgcgcatagtacactgg

SEQ ID NO: 448946 - DNA, 25 bp, Rattus norvegicus
gcgctgctgttttgtgcacagtgct

SEQ ID NO: 448947 - DNA, 25 bp, Rattus norvegicus
gggcttcactccaggccgcctccct

SEQ ID NO: 448948 - DNA, 25 bp, Rattus norvegicus
catgagggcgttcttggatctattc

SEQ ID NO: 448949 - DNA, 25 bp, Rattus norvegicus
cgagccgctgagcacacgcatgcgt

SEQ ID NO: 448950 - DNA, 25 bp, Rattus norvegicus
aaggtctgcattgacgcgcccatga

SEQ ID NO: 448951 - DNA, 25 bp, Rattus norvegicus
cccgcggacaactaaggtctgcatt

SEQ ID NO: 448952 - DNA, 25 bp, Rattus norvegicus
tgaaatccaaacctcctcaggctca

SEQ ID NO: 448953 - DNA, 25 bp, Rattus norvegicus
ctgggccatattttgcaatgaacta

SEQ ID NO: 448954 - DNA, 25 bp, Rattus norvegicus
agagttcctgcaaaactgggccata

SEQ ID NO: 448955 - DNA, 25 bp, Rattus norvegicus
cactaacagtacgtaatagagttcc

SEQ ID NO: 448956 - DNA, 25 bp, Rattus norvegicus
gatctattcacgtctcgctccgata

SEQ ID NO: 448957 - DNA, 25 bp, Rattus norvegicus
gtcactacgaagcatgagggcgttc

SEQ ID NO: 448958 - DNA, 25 bp, Rattus norvegicus
tccactagaattgcacagcggtttg

SEQ ID NO: 448959 - DNA, 25 bp, Rattus norvegicus
tttgctgaggtctcccgggtaaaca

SEQ ID NO: 448960 - DNA, 25 bp, Rattus norvegicus
tcgctccgatagtgttcggccaaca

SEQ ID NO: 448961 - DNA, 25 bp, Rattus norvegicus
acgcatgcgtactccactagaattg

SEQ ID NO: 448962 - DNA, 25 bp, Rattus norvegicus
cgggatagtgctctggatcgccaat

SEQ ID NO: 448963 - DNA, 25 bp, Rattus norvegicus
tctgccctgtggctcggacacctta

SEQ ID NO: 448964 - DNA, 25 bp, Rattus norvegicus
gtttgcctcccgctagcggctgttc

SEQ ID NO: 448965 - DNA, 25 bp, Rattus norvegicus
gtggtgctcaaagtagcgcccgcca

SEQ ID NO: 448966 - DNA, 25 bp, Rattus norvegicus
acttgctttcttttcggtggtgctc

SEQ ID NO: 448967 - DNA, 25 bp, Rattus norvegicus
ctccctatgagcacaactccgtgga

SEQ ID NO: 448968 - DNA, 25 bp, Rattus norvegicus
gcagagctcttgagaacccaggacc

SEQ ID NO: 448969 - DNA, 25 bp, Rattus norvegicus
tggatcgccaatcgcttctcaccga

SEQ ID NO: 448970 - DNA, 25 bp, Rattus norvegicus
gtaagtctgaatcaactccgagttc

SEQ ID NO: 448971 - DNA, 25 bp, Rattus norvegicus
ccagacgtgactagggatagggaca

SEQ ID NO: 448972 - DNA, 25 bp, Rattus norvegicus
aggcaagcaccacggccgcacttgt

SEQ ID NO: 448973 - DNA, 25 bp, Rattus norvegicus
gagtctcttccatgtgaataacaaa

SEQ ID NO: 448974 - DNA, 25 bp, Rattus norvegicus
tgaataacaaatactcccaccggcg

SEQ ID NO: 448975 - DNA, 25 bp, Rattus norvegicus
tgttccgccctaggttctgccctgt

SEQ ID NO: 448976 - DNA, 25 bp, Rattus norvegicus
ccaggtaaagctgcgcccagaagcc

SEQ ID NO: 448977 - DNA, 25 bp, Rattus norvegicus
ccaccaggtaaagctgcgcccagaa

SEQ ID NO: 448978 - DNA, 25 bp, Rattus norvegicus
agcaacgggcgggaaccgtgcagcc

SEQ ID NO: 448979 - DNA, 25 bp, Rattus norvegicus
aagacacgccggttagcaacgggcg

SEQ ID NO: 448980 - DNA, 25 bp, Rattus norvegicus
gaaagacaaagacacgccggttagc

SEQ ID NO: 448981 - DNA, 25 bp, Rattus norvegicus
cagggaggaaagacaaagacacgcc

SEQ ID NO: 448982 - DNA, 25 bp, Rattus norvegicus
cttcggcccgcacgggcgcagcgta

SEQ ID NO: 448983 - DNA, 25 bp, Rattus norvegicus
gatggcttcgccaggcttcggcccg

SEQ ID NO: 448984 - DNA, 25 bp, Rattus norvegicus
gtctgcagacgacctgggcgcccga

SEQ ID NO: 448985 - DNA, 25 bp, Rattus norvegicus
gagctccgaccggggaagacgccaa

SEQ ID NO: 448986 - DNA, 25 bp, Rattus norvegicus
acgcgctgcacggagcaaggcgtcc

SEQ ID NO: 448987 - DNA, 25 bp, Rattus norvegicus
tgaagaaacgcgctgcacggagcaa

SEQ ID NO: 448988 - DNA, 25 bp, Rattus norvegicus
aggctgaagaaacgcgctgcacgga

SEQ ID NO: 448989 - DNA, 25 bp, Rattus norvegicus
taaagctgcgcccagaagcccggca

SEQ ID NO: 448990 - DNA, 25 bp, Rattus norvegicus
caggcagttgacaggaggaaccgcc

SEQ ID NO: 448991 - DNA, 25 bp, Rattus norvegicus
cggaagcgccacagctcaccacgtc

SEQ ID NO: 448992 - DNA, 25 bp, Rattus norvegicus
ccacctggggcctttcgggtagcag

SEQ ID NO: 448993 - DNA, 25 bp, Rattus norvegicus
ggcctttcgggtagcagatgcttcg

SEQ ID NO: 448994 - DNA, 25 bp, Rattus norvegicus
gtagcagatgcttcgggaaacttta

SEQ ID NO: 448995 - DNA, 25 bp, Rattus norvegicus
tcgggaaactttatggaagtcagtc

SEQ ID NO: 448996 - DNA, 25 bp, Rattus norvegicus
ctttatggaagtcagtcccgttctc

SEQ ID NO: 448997 - DNA, 25 bp, Rattus norvegicus
agtcagtcccgttctctcttggccg

SEQ ID NO: 448998 - DNA, 25 bp, Rattus norvegicus
acagcccgagcgaccgccgtggaga

SEQ ID NO: 448999 - DNA, 25 bp, Rattus norvegicus
gaagcagagaagtctccggctgcga

SEQ ID NO: 449000 - DNA, 25 bp, Rattus norvegicus
tctccggctgcgacagggagcgact

SEQ ID NO: 449001 - DNA, 25 bp, Rattus norvegicus
gcgacagggagcgactgactgaccc

SEQ ID NO: 449002 - DNA, 25 bp, Rattus norvegicus
cgagggcaggaagtgacaagctcac

SEQ ID NO: 449003 - DNA, 25 bp, Rattus norvegicus
cgcgccgccaagtgcgcccaactta

SEQ ID NO: 449004 - DNA, 25 bp, Rattus norvegicus
ctgcgttagtttcccaggcagggtt

SEQ ID NO: 449005 - DNA, 25 bp, Rattus norvegicus
aataggagtgatccgcagcagcgcg

SEQ ID NO: 449006 - DNA, 25 bp, Rattus norvegicus
cagctgcagcaaataggagtgatcc

SEQ ID NO: 449007 - DNA, 25 bp, Rattus norvegicus
tggagcaggaaaacaccggcagctg

SEQ ID NO: 449008 - DNA, 25 bp, Rattus norvegicus
acccagcagggctggagcaggaaaa

SEQ ID NO: 449009 - DNA, 25 bp, Rattus norvegicus
cgcgcggcaagatgtgcagtttgcc

SEQ ID NO: 449010 - DNA, 25 bp, Rattus norvegicus
atggctgcacaaaggtaggccgcgc

SEQ ID NO: 449011 - DNA, 25 bp, Rattus norvegicus
ttttatagacgagtgaatggctgca

SEQ ID NO: 449012 - DNA, 25 bp, Rattus norvegicus
ctcagccgctgcttttgtacgcgca

SEQ ID NO: 449013 - DNA, 25 bp, Rattus norvegicus
gggctcttaggaactctgcgttagt

SEQ ID NO: 449014 - DNA, 25 bp, Rattus norvegicus
accagagagtttggggctcttagga

SEQ ID NO: 449015 - DNA, 25 bp, Rattus norvegicus
cacgctgcgacgagaccagagagtt

SEQ ID NO: 449016 - DNA, 25 bp, Rattus norvegicus
aggctgtctgctagcctcggggttt

SEQ ID NO: 449017 - DNA, 25 bp, Rattus norvegicus
gtacgcgcagaacattttatagacg

SEQ ID NO: 449018 - DNA, 25 bp, Rattus norvegicus
ttccaacctggatgcggagtgacgc

SEQ ID NO: 449019 - DNA, 25 bp, Rattus norvegicus
tgggaaacagttccaacctggatgc

SEQ ID NO: 449020 - DNA, 25 bp, Rattus norvegicus
tgacgctggcctagcaggaacactc

SEQ ID NO: 449021 - DNA, 25 bp, Rattus norvegicus
tagcaggaacactcagccagggctc

SEQ ID NO: 449022 - DNA, 25 bp, Rattus norvegicus
tcagccagggctctccggtacaggc

SEQ ID NO: 449023 - DNA, 25 bp, Rattus norvegicus
cggtacaggccctgatcctgtgccg

SEQ ID NO: 449024 - DNA, 25 bp, Rattus norvegicus
cacgatcagcccaggatttacacta

SEQ ID NO: 449025 - DNA, 25 bp, Rattus norvegicus
gatttacactaagaccggttccatc

SEQ ID NO: 449026 - DNA, 25 bp, Rattus norvegicus
agaccggttccatcacgatttccca

SEQ ID NO: 449027 - DNA, 25 bp, Rattus norvegicus
tcacgatttcccaacaactgggaca

SEQ ID NO: 449028 - DNA, 25 bp, Rattus norvegicus
gacaacaacgcttccgggtccactg

SEQ ID NO: 449029 - DNA, 25 bp, Rattus norvegicus
tgacgacagcaaaacgccacagacc

SEQ ID NO: 449030 - DNA, 25 bp, Rattus norvegicus
cggtggccaggcaaaagcactgtga

SEQ ID NO: 449031 - DNA, 25 bp, Rattus norvegicus
tccgggtccactggaagtgacgaca

SEQ ID NO: 449032 - DNA, 25 bp, Rattus norvegicus
attttcagagtctcgatcgctcagg

SEQ ID NO: 449033 - DNA, 25 bp, Rattus norvegicus
tatcggtttcctcagggattccctc

SEQ ID NO: 449034 - DNA, 25 bp, Rattus norvegicus
gcttctttcaagtccacgtctccat

SEQ ID NO: 449035 - DNA, 25 bp, Rattus norvegicus
attccctcagtgtctgccgctaacg

SEQ ID NO: 449036 - DNA, 25 bp, Rattus norvegicus
ctccaaggttttccatcgcgacagg

SEQ ID NO: 449037 - DNA, 25 bp, Rattus norvegicus
gtccttattgcttgtggtcgcgccg

SEQ ID NO: 449038 - DNA, 25 bp, Rattus norvegicus
tgccgctaacgggttcccaggagta

SEQ ID NO: 449039 - DNA, 25 bp, Rattus norvegicus
cgatcgctcagggtcttcttgtata

SEQ ID NO: 449040 - DNA, 25 bp, Rattus norvegicus
agtatagatcctccgctttagggta

SEQ ID NO: 449041 - DNA, 25 bp, Rattus norvegicus
gcgtgttcgaaagggcgtacaattc

SEQ ID NO: 449042 - DNA, 25 bp, Rattus norvegicus
ccttcctggaaatgtaatgccaatt

SEQ ID NO: 449043 - DNA, 25 bp, Rattus norvegicus
tccgttaacttgagcgcaaagtccg

SEQ ID NO: 449044 - DNA, 25 bp, Rattus norvegicus
gcttatggcttggagctggtcctta

SEQ ID NO: 449045 - DNA, 25 bp, Rattus norvegicus
tttgccgcgggacttatattatagc

SEQ ID NO: 449046 - DNA, 25 bp, Rattus norvegicus
aacggactaaaggaggcgcaggaga

SEQ ID NO: 449047 - DNA, 25 bp, Rattus norvegicus
tcagcaatggcgagctgtgcgaccg

SEQ ID NO: 449048 - DNA, 25 bp, Rattus norvegicus
ccagtgaacctgtcagcaatggcga

SEQ ID NO: 449049 - DNA, 25 bp, Rattus norvegicus
gcagccgccagtgaacctgtcagca

SEQ ID NO: 449050 - DNA, 25 bp, Rattus norvegicus
tgcgctgactggctgtgcgtctcac

SEQ ID NO: 449051 - DNA, 25 bp, Rattus norvegicus
accgaggtgagacccatggagcagc

SEQ ID NO: 449052 - DNA, 25 bp, Rattus norvegicus
ggagcccgcacagtgcgcacgcgca

SEQ ID NO: 449053 - DNA, 25 bp, Rattus norvegicus
cagaatccgggaccgaggtgagacc

SEQ ID NO: 449054 - DNA, 25 bp, Rattus norvegicus
actttcgcagggcagaatccgggac

SEQ ID NO: 449055 - DNA, 25 bp, Rattus norvegicus
cgatgtgcagcgactttcgcagggc

SEQ ID NO: 449056 - DNA, 25 bp, Rattus norvegicus
ttgctggcgggtaggttgaacccga

SEQ ID NO: 449057 - DNA, 25 bp, Rattus norvegicus
ctcttgctaaatggcgttgctggcg

SEQ ID NO: 449058 - DNA, 25 bp, Rattus norvegicus
tgcgtctcacgctcttgctaaatgg

SEQ ID NO: 449059 - DNA, 25 bp, Rattus norvegicus
ggcgccgcagcgttactgcgcatgc

SEQ ID NO: 449060 - DNA, 25 bp, Rattus norvegicus
gctgctaagaagagaggattccgcc

SEQ ID NO: 449061 - DNA, 25 bp, Rattus norvegicus
caggagttggcactcgccacctaga

SEQ ID NO: 449062 - DNA, 25 bp, Rattus norvegicus
cccagcccggctgctaagaagagag

SEQ ID NO: 449063 - DNA, 25 bp, Rattus norvegicus
aagccaggatctgcagtgtcggccc

SEQ ID NO: 449064 - DNA, 25 bp, Rattus norvegicus
gctcccgagcaagccaggatctgca

SEQ ID NO: 449065 - DNA, 25 bp, Rattus norvegicus
tccttatgggtgaggcagatcgagc

SEQ ID NO: 449066 - DNA, 25 bp, Rattus norvegicus
agcagatgcggatccttatgggtga

SEQ ID NO: 449067 - DNA, 25 bp, Rattus norvegicus
ctcttttcgcggatcttcgggaaga

SEQ ID NO: 449068 - DNA, 25 bp, Rattus norvegicus
ggcctcacggtgtccgcgctctttt

SEQ ID NO: 449069 - DNA, 25 bp, Rattus norvegicus
ttcttccgcaaacgcgcctaggggc

SEQ ID NO: 449070 - DNA, 25 bp, Rattus norvegicus
cgctcgacttcagttcttccgcaaa

SEQ ID NO: 449071 - DNA, 25 bp, Rattus norvegicus
aggcctcgctcgacttcagttcttc

SEQ ID NO: 449072 - DNA, 25 bp, Rattus norvegicus
ttcgggaagaagcagatgcggatcc

SEQ ID NO: 449073 - DNA, 25 bp, Rattus norvegicus
tagactgccctcaaggcccggaagg

SEQ ID NO: 449074 - DNA, 25 bp, Rattus norvegicus
gtccatgattcggtcacagtgattt

SEQ ID NO: 449075 - DNA, 25 bp, Rattus norvegicus
gtcaccgcaaatcagctctttcagc

SEQ ID NO: 449076 - DNA, 25 bp, Rattus norvegicus
tttcagcgcttcctggagctccgca

SEQ ID NO: 449077 - DNA, 25 bp, Rattus norvegicus
cggagcttcataaacagagtgccta

SEQ ID NO: 449078 - DNA, 25 bp, Rattus norvegicus
agtgcctattggcttgagttctagc

SEQ ID NO: 449079 - DNA, 25 bp, Rattus norvegicus
ggccgagatcgcgtctcctcttttg

SEQ ID NO: 449080 - DNA, 25 bp, Rattus norvegicus
gcttctatccagtccaccgacggta

SEQ ID NO: 449081 - DNA, 25 bp, Rattus norvegicus
ctttaccttccgtcaacctgcatgg

SEQ ID NO: 449082 - DNA, 25 bp, Rattus norvegicus
tcccgggcaaacctgtccatgattc

SEQ ID NO: 449083 - DNA, 25 bp, Rattus norvegicus
cagtgattttcgtggtcgcggcttt

SEQ ID NO: 449084 - DNA, 25 bp, Rattus norvegicus
cggccagatgctgacgtgtcctttc

SEQ ID NO: 449085 - DNA, 25 bp, Rattus norvegicus
gcaggttctggacgctaattggcca

SEQ ID NO: 449086 - DNA, 25 bp, Rattus norvegicus
tgcatggtctcagctcgcgtttcct

SEQ ID NO: 449087 - DNA, 25 bp, Rattus norvegicus
ccagtcccgctgctgttatagtgtg

SEQ ID NO: 449088 - DNA, 25 bp, Rattus norvegicus
cccgctgaatgctgacggggtgcct

SEQ ID NO: 449089 - DNA, 25 bp, Rattus norvegicus
tcagaagaccccgagcttgagcttc

SEQ ID NO: 449090 - DNA, 25 bp, Rattus norvegicus
agggctgcgttgagtcagaagaccc

SEQ ID NO: 449091 - DNA, 25 bp, Rattus norvegicus
tcgacgcaagggctgcgttgagtca

SEQ ID NO: 449092 - DNA, 25 bp, Rattus norvegicus
aggcaggcagccgagtcgacgcaag

SEQ ID NO: 449093 - DNA, 25 bp, Rattus norvegicus
gcaagcgagtcggagtgagcgtcaa

SEQ ID NO: 449094 - DNA, 25 bp, Rattus norvegicus
tgcgcggccagagtttggatctgca

SEQ ID NO: 449095 - DNA, 25 bp, Rattus norvegicus
tgcgcgctagtctcaggcgttcgca

SEQ ID NO: 449096 - DNA, 25 bp, Rattus norvegicus
ggctgcagcagttggccggcctcct

SEQ ID NO: 449097 - DNA, 25 bp, Rattus norvegicus
tccggccctggactgctgggctcag

SEQ ID NO: 449098 - DNA, 25 bp, Rattus norvegicus
ctattttggtcaggtcggagcgagc

SEQ ID NO: 449099 - DNA, 25 bp, Rattus norvegicus
tcgcagctattttggtcaggtcgga

SEQ ID NO: 449100 - DNA, 25 bp, Rattus norvegicus
ccagagtttggatctgcaggatggt

SEQ ID NO: 449101 - DNA, 25 bp, Rattus norvegicus
caggcgttcgcagctattttggtca

SEQ ID NO: 449102 - DNA, 25 bp, Rattus norvegicus
ctgactcgaatctatcctgggaacc

SEQ ID NO: 449103 - DNA, 25 bp, Rattus norvegicus
gatcagccagccgaaccgagtcgcg

SEQ ID NO: 449104 - DNA, 25 bp, Rattus norvegicus
gggaacccggactctggtgcatatc

SEQ ID NO: 449105 - DNA, 25 bp, Rattus norvegicus
ggtgcatatcacagcaggtccatga

SEQ ID NO: 449106 - DNA, 25 bp, Rattus norvegicus
gtccatgaaaaagcctgaacgcggg

SEQ ID NO: 449107 - DNA, 25 bp, Rattus norvegicus
cctgcgcgtgcaagttaagagggtc

SEQ ID NO: 449108 - DNA, 25 bp, Rattus norvegicus
ctctgggattctataatttgccttc

SEQ ID NO: 449109 - DNA, 25 bp, Rattus norvegicus
tcaaaatagtacgtgggagctgccg

SEQ ID NO: 449110 - DNA, 25 bp, Rattus norvegicus
gctgcagggttacaaacagtctctc

SEQ ID NO: 449111 - DNA, 25 bp, Rattus norvegicus
cccggcctgaattaatgtgttacta

SEQ ID NO: 449112 - DNA, 25 bp, Rattus norvegicus
tgttactattttgggcgagccagtg

SEQ ID NO: 449113 - DNA, 25 bp, Rattus norvegicus
tttccaggggaaacctaatgacgca

SEQ ID NO: 449114 - DNA, 25 bp, Rattus norvegicus
tgcaggtcagcagcagactctctgg

SEQ ID NO: 449115 - DNA, 25 bp, Rattus norvegicus
ggagtttctccgttgcccacggaca

SEQ ID NO: 449116 - DNA, 25 bp, Rattus norvegicus
aactcgcactcgagggagcggctga

SEQ ID NO: 449117 - DNA, 25 bp, Rattus norvegicus
cgggaattggcgctcgcaaggactg

SEQ ID NO: 449118 - DNA, 25 bp, Rattus norvegicus
taggctgcaacagccaccgtcgctg

SEQ ID NO: 449119 - DNA, 25 bp, Rattus norvegicus
cgtggagcactaggctgcaacagcc

SEQ ID NO: 449120 - DNA, 25 bp, Rattus norvegicus
gctcctgcgtggagcactaggctgc

SEQ ID NO: 449121 - DNA, 25 bp, Rattus norvegicus
aggcacccagagcaggacctggctc

SEQ ID NO: 449122 - DNA, 25 bp, Rattus norvegicus
ccttgaggcacccagagcaggacct

SEQ ID NO: 449123 - DNA, 25 bp, Rattus norvegicus
ttaaactaccttagactaccgctgc

SEQ ID NO: 449124 - DNA, 25 bp, Rattus norvegicus
ggagcggctgaagtcctcccttgag

SEQ ID NO: 449125 - DNA, 25 bp, Rattus norvegicus
aggattacccggctcataccaagcg

SEQ ID NO: 449126 - DNA, 25 bp, Rattus norvegicus
ctgctggcgcgacctccaggattac

SEQ ID NO: 449127 - DNA, 25 bp, Rattus norvegicus
taccgctgctctgtagctgctggcg

SEQ ID NO: 449128 - DNA, 25 bp, Rattus norvegicus
ttagactaccgctgctctgtagctg

SEQ ID NO: 449129 - DNA, 25 bp, Rattus norvegicus
gaagtcctcccttgaggcacccaga

SEQ ID NO: 449130 - DNA, 25 bp, Rattus norvegicus
gctttcctcgggagctgctctcttg

SEQ ID NO: 449131 - DNA, 25 bp, Rattus norvegicus
gtgccgtcccgtcgccgtaggagct

SEQ ID NO: 449132 - DNA, 25 bp, Rattus norvegicus
gtaggagctgctcccttcctccaga

SEQ ID NO: 449133 - DNA, 25 bp, Rattus norvegicus
cgtaagtgtcttcctcggtgctttc

SEQ ID NO: 449134 - DNA, 25 bp, Rattus norvegicus
agctgctctcttgactgctctgcaa

SEQ ID NO: 449135 - DNA, 25 bp, Rattus norvegicus
ctgctctgcaacagcacggttcaga

SEQ ID NO: 449136 - DNA, 25 bp, Rattus norvegicus
gggacacaggctgctgagcttccta

SEQ ID NO: 449137 - DNA, 25 bp, Rattus norvegicus
tgctgagcttcctaacacgtgcaag

SEQ ID NO: 449138 - DNA, 25 bp, Rattus norvegicus
tgcaagctcactctagtccaggacg

SEQ ID NO: 449139 - DNA, 25 bp, Rattus norvegicus
agtccaggacgtgcacctacctctt

SEQ ID NO: 449140 - DNA, 25 bp, Rattus norvegicus
ttccgcacgctcacaggagaagcta

SEQ ID NO: 449141 - DNA, 25 bp, Rattus norvegicus
tcacaggagaagctaccgtcgagtc

SEQ ID NO: 449142 - DNA, 25 bp, Rattus norvegicus
agctaccgtcgagtctctactttcg

SEQ ID NO: 449143 - DNA, 25 bp, Rattus norvegicus
ccagatcgctgtcatcgtaagtgtc

SEQ ID NO: 449144 - DNA, 25 bp, Rattus norvegicus
cgtgtgagaccacgcgcaaccagca

SEQ ID NO: 449145 - DNA, 25 bp, Rattus norvegicus
gtgccgggaaattcaagaagtactc

SEQ ID NO: 449146 - DNA, 25 bp, Rattus norvegicus
agcgaccgtctttgtgcagtcccag

SEQ ID NO: 449147 - DNA, 25 bp, Rattus norvegicus
agcttcttcagcgaccgtctttgtg

SEQ ID NO: 449148 - DNA, 25 bp, Rattus norvegicus
cgcaaactgcaaggaaaagttccgg

SEQ ID NO: 449149 - DNA, 25 bp, Rattus norvegicus
gtccgggaggaaacgcaaactgcaa

SEQ ID NO: 449150 - DNA, 25 bp, Rattus norvegicus
cgttgctcaaaagagtccgggagga

SEQ ID NO: 449151 - DNA, 25 bp, Rattus norvegicus
gaagtactcgttgctcaaaagagtc

SEQ ID NO: 449152 - DNA, 25 bp, Rattus norvegicus
ctgggttgagctctggcaggaaacc

SEQ ID NO: 449153 - DNA, 25 bp, Rattus norvegicus
accgagaaacaagcgtgtgagacca

SEQ ID NO: 449154 - DNA, 25 bp, Rattus norvegicus
agaccggccatgagaccgagaaaca

SEQ ID NO: 449155 - DNA, 25 bp, Rattus norvegicus
cacgaatagagtcagaccggccatg

SEQ ID NO: 449156 - DNA, 25 bp, Rattus norvegicus
gggagacggcccacgaatagagtca

SEQ ID NO: 449157 - DNA, 25 bp, Rattus norvegicus
tctggcaggaaacccgtgccgggaa

SEQ ID NO: 449158 - DNA, 25 bp, Rattus norvegicus
gctgccaccttggagaaggagatca

SEQ ID NO: 449159 - DNA, 25 bp, Rattus norvegicus
tggcaccttcgaagcctgggcagct

SEQ ID NO: 449160 - DNA, 25 bp, Rattus norvegicus
aggagatcaggacctgggcctgcta

SEQ ID NO: 449161 - DNA, 25 bp, Rattus norvegicus
atcgcgctacccaggggctccttgt

SEQ ID NO: 449162 - DNA, 25 bp, Rattus norvegicus
tcccggagacagtcggaaaagcttg

SEQ ID NO: 449163 - DNA, 25 bp, Rattus norvegicus
gcagaccaagctggaaagcccacca

SEQ ID NO: 449164 - DNA, 25 bp, Rattus norvegicus
tccaagcctgtttggcctccgtagc

SEQ ID NO: 449165 - DNA, 25 bp, Rattus norvegicus
cctccgtagccaagggcgtgaagca

SEQ ID NO: 449166 - DNA, 25 bp, Rattus norvegicus
cgtgaagcacctcgtagccctgtag

SEQ ID NO: 449167 - DNA, 25 bp, Rattus norvegicus
agccctgtagggctccgctcagcag

SEQ ID NO: 449168 - DNA, 25 bp, Rattus norvegicus
ggggtagcacccttaaagccagatc

SEQ ID NO: 449169 - DNA, 25 bp, Rattus norvegicus
cgcgatgaccgtaggcgtcgtagaa

SEQ ID NO: 449170 - DNA, 25 bp, Rattus norvegicus
ttaaagccagatcctcccaagggtg

SEQ ID NO: 449171 - DNA, 25 bp, Rattus norvegicus
gaagtccaccgtgcaatcgctgcta

SEQ ID NO: 449172 - DNA, 25 bp, Rattus norvegicus
ccttgctgggcgatcacagcttagc

SEQ ID NO: 449173 - DNA, 25 bp, Rattus norvegicus
tcgggaccgacggacctgcttctct

SEQ ID NO: 449174 - DNA, 25 bp, Rattus norvegicus
caaggctcggcgagtctagcctgtt

SEQ ID NO: 449175 - DNA, 25 bp, Rattus norvegicus
ggcgagtctagcctgttctccgttg

SEQ ID NO: 449176 - DNA, 25 bp, Rattus norvegicus
acagcttagcccacccgaagctggg

SEQ ID NO: 449177 - DNA, 25 bp, Rattus norvegicus
ctccctttgccttgctgggcgatca

SEQ ID NO: 449178 - DNA, 25 bp, Rattus norvegicus
gcgtgcgcacaccacactcccgttc

SEQ ID NO: 449179 - DNA, 25 bp, Rattus norvegicus
cattccggagaaacaccctcgggcg

SEQ ID NO: 449180 - DNA, 25 bp, Rattus norvegicus
ccacatgcacgccattccggagaaa

SEQ ID NO: 449181 - DNA, 25 bp, Rattus norvegicus
gtgcctcgttctcagcctggcgctg

SEQ ID NO: 449182 - DNA, 25 bp, Rattus norvegicus
agagccggtgcctcgttctcagcct

SEQ ID NO: 449183 - DNA, 25 bp, Rattus norvegicus
agcactgccaatcagctgcgggaga

SEQ ID NO: 449184 - DNA, 25 bp, Rattus norvegicus
aagcgcactcattcacccagcactg

SEQ ID NO: 449185 - DNA, 25 bp, Rattus norvegicus
agcctgttctccgttgcgcccaaag

SEQ ID NO: 449186 - DNA, 25 bp, Rattus norvegicus
cagcctccgagacggttagggtacg

SEQ ID NO: 449187 - DNA, 25 bp, Rattus norvegicus
gcgctcctgggcctctatctggaag

SEQ ID NO: 449188 - DNA, 25 bp, Rattus norvegicus
ttggcttcagttccggggcgctcct

SEQ ID NO: 449189 - DNA, 25 bp, Rattus norvegicus
tccgccagcgctttggcttcagttc

SEQ ID NO: 449190 - DNA, 25 bp, Rattus norvegicus
agatctcatcagtctcatccgccag

SEQ ID NO: 449191 - DNA, 25 bp, Rattus norvegicus
tgccgagttgtcacagatctcatca

SEQ ID NO: 449192 - DNA, 25 bp, Rattus norvegicus
gttgacctgaacagatgccgagttg

SEQ ID NO: 449193 - DNA, 25 bp, Rattus norvegicus
gtcttctggcttctagttgacctga

SEQ ID NO: 449194 - DNA, 25 bp, Rattus norvegicus
ttagggtacgacttcaatttgacta

SEQ ID NO: 449195 - DNA, 25 bp, Rattus norvegicus
tgagcatgagcaagatggcagcctc

SEQ ID NO: 449196 - DNA, 25 bp, Rattus norvegicus
cggcttccgttgagcatgagcaaga

SEQ ID NO: 449197 - DNA, 25 bp, Rattus norvegicus
cgtggaacctctcggcttccgttga

SEQ ID NO: 449198 - DNA, 25 bp, Rattus norvegicus
ctaggcggcgcacgctagctgctgc

SEQ ID NO: 449199 - DNA, 25 bp, Rattus norvegicus
acgacttcaatttgactacccgccg

SEQ ID NO: 449200 - DNA, 25 bp, Rattus norvegicus
ggtgccgccgctgatcaggtagtcc

SEQ ID NO: 449201 - DNA, 25 bp, Rattus norvegicus
cattcgggcgtcagcgaggaacagc

SEQ ID NO: 449202 - DNA, 25 bp, Rattus norvegicus
ggcacctcgactctggcgaccagga

SEQ ID NO: 449203 - DNA, 25 bp, Rattus norvegicus
cgcaatggcacctcgactctggcga

SEQ ID NO: 449204 - DNA, 25 bp, Rattus norvegicus
tagtccgccatgctgctgggagata

SEQ ID NO: 449205 - DNA, 25 bp, Rattus norvegicus
atcctcgggaacgtagccggtgccg

SEQ ID NO: 449206 - DNA, 25 bp, Rattus norvegicus
tgagcccatcctcgggaacgtagcc

SEQ ID NO: 449207 - DNA, 25 bp, Rattus norvegicus
agctgctgcgcggtgagcccatcct

SEQ ID NO: 449208 - DNA, 25 bp, Rattus norvegicus
gccatccgcgttggcgaagagctgc

SEQ ID NO: 449209 - DNA, 25 bp, Rattus norvegicus
cttacttgtaggtgaggccatccgc

SEQ ID NO: 449210 - DNA, 25 bp, Rattus norvegicus
gggccagtctcagcgcttacttgta

SEQ ID NO: 449211 - DNA, 25 bp, Rattus norvegicus
gctcacccaggtagggccagtctca

SEQ ID NO: 449212 - DNA, 25 bp, Rattus norvegicus
cagcgaggaacagccgtgcacgtgt

SEQ ID NO: 449213 - DNA, 25 bp, Rattus norvegicus
gggagataccgcgacccgacataaa

SEQ ID NO: 449214 - DNA, 25 bp, Rattus norvegicus
gccactatacccataaaagccctgt

SEQ ID NO: 449215 - DNA, 25 bp, Rattus norvegicus
actatacccataaaagccctgtcct

SEQ ID NO: 449216 - DNA, 25 bp, Rattus norvegicus
tgccactatacccataaaagccctg

SEQ ID NO: 449217 - DNA, 25 bp, Rattus norvegicus
atttgccactatacccataaaagcc

SEQ ID NO: 449218 - DNA, 25 bp, Rattus norvegicus
gcatttgccactatacccataaaag

SEQ ID NO: 449219 - DNA, 25 bp, Rattus norvegicus
ggcatttgccactatacccataaaa

SEQ ID NO: 449220 - DNA, 25 bp, Rattus norvegicus
aaggcatttgccactatacccataa

SEQ ID NO: 449221 - DNA, 25 bp, Rattus norvegicus
aaaggcatttgccactatacccata

SEQ ID NO: 449222 - DNA, 25 bp, Rattus norvegicus
accccaagcactaggactaaaggca

SEQ ID NO: 449223 - DNA, 25 bp, Rattus norvegicus
gctggaaccccaagcactaggacta

SEQ ID NO: 449224 - DNA, 25 bp, Rattus norvegicus
gctatgaagaccaggctggaacccc

SEQ ID NO: 449225 - DNA, 25 bp, Rattus norvegicus
ttttattggagacagcctcactgtg

SEQ ID NO: 449226 - DNA, 25 bp, Rattus norvegicus
tttttattggagacagcctcactgt

SEQ ID NO: 449227 - DNA, 25 bp, Rattus norvegicus
tatacccataaaagccctgtcctta

SEQ ID NO: 449228 - DNA, 25 bp, Rattus norvegicus
ccggaccagggaaggcaataagagc

SEQ ID NO: 449229 - DNA, 25 bp, Rattus norvegicus
agtccatcgggttccgcccttggca

SEQ ID NO: 449230 - DNA, 25 bp, Rattus norvegicus
agtgctaccgggtctgccggcgcta

SEQ ID NO: 449231 - DNA, 25 bp, Rattus norvegicus
taagagccccagtccactccggagg

SEQ ID NO: 449232 - DNA, 25 bp, Rattus norvegicus
gcccttggcactacgctctgttccg

SEQ ID NO: 449233 - DNA, 25 bp, Rattus norvegicus
ggctcccggaccagggaaggcaata

SEQ ID NO: 449234 - DNA, 25 bp, Rattus norvegicus
agcctctccgcgtggaggctcccgg

SEQ ID NO: 449235 - DNA, 25 bp, Rattus norvegicus
gttcctccatgccatgcggaggccg

SEQ ID NO: 449236 - DNA, 25 bp, Rattus norvegicus
ggtgagagcggttcctccatgccat

SEQ ID NO: 449237 - DNA, 25 bp, Rattus norvegicus
cagcggcgagagtagcccggactcc

SEQ ID NO: 449238 - DNA, 25 bp, Rattus norvegicus
gcggtctcatgtcccgggtgttgcc

SEQ ID NO: 449239 - DNA, 25 bp, Rattus norvegicus
tgcgccgcggtctcatgtcccgggt

SEQ ID NO: 449240 - DNA, 25 bp, Rattus norvegicus
tgggcgtcacctctccggctcgtag

SEQ ID NO: 449241 - DNA, 25 bp, Rattus norvegicus
ggtcctggagtccatcgggttccgc

SEQ ID NO: 449242 - DNA, 25 bp, Rattus norvegicus
tgactcccggggcactcggctgcga

SEQ ID NO: 449243 - DNA, 25 bp, Rattus norvegicus
cgtcagggctgtgcacccagagcct

SEQ ID NO: 449244 - DNA, 25 bp, Rattus norvegicus
ctgcgacgcagctgacgtagagaca

SEQ ID NO: 449245 - DNA, 25 bp, Rattus norvegicus
agacaggatgaaccgcggacgtgcc

SEQ ID NO: 449246 - DNA, 25 bp, Rattus norvegicus
gaggtccgtttctctttgctactta

SEQ ID NO: 449247 - DNA, 25 bp, Rattus norvegicus
tctcccgactcttcttcctaaggta

SEQ ID NO: 449248 - DNA, 25 bp, Rattus norvegicus
cctaaggtaaactggcccaggactg

SEQ ID NO: 449249 - DNA, 25 bp, Rattus norvegicus
ggtcaggctacctgcgttcgcgtca

SEQ ID NO: 449250 - DNA, 25 bp, Rattus norvegicus
agcttccacgttgcgactcagccga

SEQ ID NO: 449251 - DNA, 25 bp, Rattus norvegicus
gtgactctgagcagccgtctcccga

SEQ ID NO: 449252 - DNA, 25 bp, Rattus norvegicus
atccttacgcctgcacgatctagtg

SEQ ID NO: 449253 - DNA, 25 bp, Rattus norvegicus
ggtgcctgcgtggagcttccacgtt

SEQ ID NO: 449254 - DNA, 25 bp, Rattus norvegicus
cctgcacgatctagtgtgactctga

SEQ ID NO: 449255 - DNA, 25 bp, Rattus norvegicus
tacttatttctatccggagcggtgc

SEQ ID NO: 449256 - DNA, 25 bp, Rattus norvegicus
ggctgtcggccttgttctctattcg

SEQ ID NO: 449257 - DNA, 25 bp, Rattus norvegicus
ttgtagcccggcaaacactagctcc

SEQ ID NO: 449258 - DNA, 25 bp, Rattus norvegicus
aggaacgcgtcagcagtgatcatgc

SEQ ID NO: 449259 - DNA, 25 bp, Rattus norvegicus
tgggtcctcgtttgctcttactctg

SEQ ID NO: 449260 - DNA, 25 bp, Rattus norvegicus
tctctattcgtagtgggtcttcctc

SEQ ID NO: 449261 - DNA, 25 bp, Rattus norvegicus
ggtcttcctcaatccggtctcagtg

SEQ ID NO: 449262 - DNA, 25 bp, Rattus norvegicus
cagtgtacggtacccgactcgctgt

SEQ ID NO: 449263 - DNA, 25 bp, Rattus norvegicus
ttccgtaaatgaggacgtggcggtc

SEQ ID NO: 449264 - DNA, 25 bp, Rattus norvegicus
agcaaggagctaggattcagcgtcc

SEQ ID NO: 449265 - DNA, 25 bp, Rattus norvegicus
tggaaccaatagtcgcacggagaag

SEQ ID NO: 449266 - DNA, 25 bp, Rattus norvegicus
tggcgatttccagccaatccgggtc

SEQ ID NO: 449267 - DNA, 25 bp, Rattus norvegicus
atccgggtcattcaattgtggaacc

SEQ ID NO: 449268 - DNA, 25 bp, Rattus norvegicus
cagctctgcggaaagggttgtagcc

SEQ ID NO: 449269 - DNA, 25 bp, Rattus norvegicus
ttggtgtaaagaccgccgacaatcg

SEQ ID NO: 449270 - DNA, 25 bp, Rattus norvegicus
gcgggcttcaaacccacctcaagcc

SEQ ID NO: 449271 - DNA, 25 bp, Rattus norvegicus
tacctagtgttcagaggcggttccg

SEQ ID NO: 449272 - DNA, 25 bp, Rattus norvegicus
gcctcagaggtacctagtgttcaga

SEQ ID NO: 449273 - DNA, 25 bp, Rattus norvegicus
ctcgcggcctcagaggtacctagtg

SEQ ID NO: 449274 - DNA, 25 bp, Rattus norvegicus
cgcgttgcccgtttccgccaagtgg

SEQ ID NO: 449275 - DNA, 25 bp, Rattus norvegicus
aaggaacctgagacggtccgtgcgc

SEQ ID NO: 449276 - DNA, 25 bp, Rattus norvegicus
ttcagaggcggttccggccgccaaa

SEQ ID NO: 449277 - DNA, 25 bp, Rattus norvegicus
gaactgtcttctctgtccctcaagc

SEQ ID NO: 449278 - DNA, 25 bp, Rattus norvegicus
aacctgagacggtccgtgcgcacgc

SEQ ID NO: 449279 - DNA, 25 bp, Rattus norvegicus
agatgcaggccataaccagtaagtg

SEQ ID NO: 449280 - DNA, 25 bp, Rattus norvegicus
accagtaagtgcgaactgtcttctc

SEQ ID NO: 449281 - DNA, 25 bp, Rattus norvegicus
tcaagccaactctcgaatctgagcc

SEQ ID NO: 449282 - DNA, 25 bp, Rattus norvegicus
gccgccgagatgcaggccataacca

SEQ ID NO: 449283 - DNA, 25 bp, Rattus norvegicus
caggccataaccagtaagtgcgaac

SEQ ID NO: 449284 - DNA, 25 bp, Rattus norvegicus
agtctccgagagagctcagtgtccc

SEQ ID NO: 449285 - DNA, 25 bp, Rattus norvegicus
ccactcagagcgctagagaagtctc

SEQ ID NO: 449286 - DNA, 25 bp, Rattus norvegicus
gccgcgccaccatgatgaacaacag

SEQ ID NO: 449287 - DNA, 25 bp, Rattus norvegicus
tgaacaacagcaactactccgacgc

SEQ ID NO: 449288 - DNA, 25 bp, Rattus norvegicus
acgagatgccgtccaccgagaagga

SEQ ID NO: 449289 - DNA, 25 bp, Rattus norvegicus
agcaaaacacattcacgcggtggtg

SEQ ID NO: 449290 - DNA, 25 bp, Rattus norvegicus
acgagcatctcaagtgtgtgggcaa

SEQ ID NO: 449291 - DNA, 25 bp, Rattus norvegicus
tgaccgacctgcagcgagacctcag

SEQ ID NO: 449292 - DNA, 25 bp, Rattus norvegicus
ctcatcgcgctgctcgaagtgctca

SEQ ID NO: 449293 - DNA, 25 bp, Rattus norvegicus
gccagaagcgcatgtaccgcaagtt

SEQ ID NO: 449294 - DNA, 25 bp, Rattus norvegicus
cctggagttcctggagcgcgaacac

SEQ ID NO: 449295 - DNA, 25 bp, Rattus norvegicus
agcgcgaacacatcaagctcgtgtc

SEQ ID NO: 449296 - DNA, 25 bp, Rattus norvegicus
agctcgtgtccatcggtcagtacgg

SEQ ID NO: 449297 - DNA, 25 bp, Rattus norvegicus
cccgagagggagatagagccctagc

SEQ ID NO: 449298 - DNA, 25 bp, Rattus norvegicus
agtcgttccaagacctggggaggca

SEQ ID NO: 449299 - DNA, 25 bp, Rattus norvegicus
ctcctctctgctccggggtgcggac

SEQ ID NO: 449300 - DNA, 25 bp, Rattus norvegicus
agctccagcagtcgctgcagaacct

SEQ ID NO: 449301 - DNA, 25 bp, Rattus norvegicus
gttcagctccagcagtcgctgcaga

SEQ ID NO: 449302 - DNA, 25 bp, Rattus norvegicus
gccgctgctgctcgcggtccctgcg

SEQ ID NO: 449303 - DNA, 25 bp, Rattus norvegicus
gccctgggacgcacccggagccgct

SEQ ID NO: 449304 - DNA, 25 bp, Rattus norvegicus
accacttctggcaggccgggccctg

SEQ ID NO: 449305 - DNA, 25 bp, Rattus norvegicus
tccaccaccacttctggcaggccgg

SEQ ID NO: 449306 - DNA, 25 bp, Rattus norvegicus
cgttccaagacctggggaggcagaa

SEQ ID NO: 449307 - DNA, 25 bp, Rattus norvegicus
atgcggagtcgttccaagacctggg

SEQ ID NO: 449308 - DNA, 25 bp, Rattus norvegicus
gcaaagatgcggagtcgttccaaga

SEQ ID NO: 449309 - DNA, 25 bp, Rattus norvegicus
gttggcaaagatgcggagtcgttcc

SEQ ID NO: 449310 - DNA, 25 bp, Rattus norvegicus
gaacccggcgatggtggttggcaaa

SEQ ID NO: 449311 - DNA, 25 bp, Rattus norvegicus
aactcagccgggtcccgcctgggca

SEQ ID NO: 449312 - DNA, 25 bp, Rattus norvegicus
ggaggacgaagagagggcaccaagg

SEQ ID NO: 449313 - DNA, 25 bp, Rattus norvegicus
ccaccgacggggaggacgaagagag

SEQ ID NO: 449314 - DNA, 25 bp, Rattus norvegicus
gacacgcagcccaggcggtgctgga

SEQ ID NO: 449315 - DNA, 25 bp, Rattus norvegicus
cggtgctggagaagttggtccggcc

SEQ ID NO: 449316 - DNA, 25 bp, Rattus norvegicus
gtctgctgggctgagcgagaagttg

SEQ ID NO: 449317 - DNA, 25 bp, Rattus norvegicus
gaagttggggcacacccaggacgcc

SEQ ID NO: 449318 - DNA, 25 bp, Rattus norvegicus
gcagcagtagcagcgccgcccgagc

SEQ ID NO: 449319 - DNA, 25 bp, Rattus norvegicus
cgccatgctcgctcgacccgcctcg

SEQ ID NO: 449320 - DNA, 25 bp, Rattus norvegicus
acccgcctcgcggtaagtctgtgct

SEQ ID NO: 449321 - DNA, 25 bp, Rattus norvegicus
cctcgcggtaagtctgtgctctgag

SEQ ID NO: 449322 - DNA, 25 bp, Rattus norvegicus
cggtaagtctgtgctctgaggcgct

SEQ ID NO: 449323 - DNA, 25 bp, Rattus norvegicus
gggtgcggagactcaagccgccgcc

SEQ ID NO: 449324 - DNA, 25 bp, Rattus norvegicus
cgcccacccagtctttgttcaggga

SEQ ID NO: 449325 - DNA, 25 bp, Rattus norvegicus
cccagtctttgttcagggagggctc

SEQ ID NO: 449326 - DNA, 25 bp, Rattus norvegicus
ggccagcgcgaacgtctccaaagcg

SEQ ID NO: 449327 - DNA, 25 bp, Rattus norvegicus
cccgacccttttggcgcacagctcg

SEQ ID NO: 449328 - DNA, 25 bp, Rattus norvegicus
gtcgtagtctgaacaggaccagtga

SEQ ID NO: 449329 - DNA, 25 bp, Rattus norvegicus
gaagtgccttgtcgtagtctgaaca

SEQ ID NO: 449330 - DNA, 25 bp, Rattus norvegicus
caaggatgcgaagtgccttgtcgta

SEQ ID NO: 449331 - DNA, 25 bp, Rattus norvegicus
tcctcgccggggtcaaggatgcgaa

SEQ ID NO: 449332 - DNA, 25 bp, Rattus norvegicus
cgagggcccagtggacatcctccct

SEQ ID NO: 449333 - DNA, 25 bp, Rattus norvegicus
cgcaccgcagacaggtaggtcccgg

SEQ ID NO: 449334 - DNA, 25 bp, Rattus norvegicus
ctccaaagcgctccacgccgggcca

SEQ ID NO: 449335 - DNA, 25 bp, Rattus norvegicus
ccacttctccgtggtgggcgattgt

SEQ ID NO: 449336 - DNA, 25 bp, Rattus norvegicus
gtcgggatcccacttctccgtggtg

SEQ ID NO: 449337 - DNA, 25 bp, Rattus norvegicus
accgctccgacccacggcgacctgt

SEQ ID NO: 449338 - DNA, 25 bp, Rattus norvegicus
ggctactgccaagccaccgctccga

SEQ ID NO: 449339 - DNA, 25 bp, Rattus norvegicus
ccatcgttccgcatgcgcggggaaa

SEQ ID NO: 449340 - DNA, 25 bp, Rattus norvegicus
ctgctgcgccgcaaatgttccaggc

SEQ ID NO: 449341 - DNA, 25 bp, Rattus norvegicus
aatgttccaggcacaaccgccttcg

SEQ ID NO: 449342 - DNA, 25 bp, Rattus norvegicus
gaggagctgtcgtgctccatctgcc

SEQ ID NO: 449343 - DNA, 25 bp, Rattus norvegicus
agcacttgcggcctcacatcgacag

SEQ ID NO: 449344 - DNA, 25 bp, Rattus norvegicus
gcctctttctgccaggagcacttgc

SEQ ID NO: 449345 - DNA, 25 bp, Rattus norvegicus
tgcctcgtgtgcatggcctctttct

SEQ ID NO: 449346 - DNA, 25 bp, Rattus norvegicus
aggtgtcctgcgaccactgcctgaa

SEQ ID NO: 449347 - DNA, 25 bp, Rattus norvegicus
cgcagtggtcgagcagtttcttcag

SEQ ID NO: 449348 - DNA, 25 bp, Rattus norvegicus
gtgcgcccgcagctgcacaagaaca

SEQ ID NO: 449349 - DNA, 25 bp, Rattus norvegicus
cgcagtgtcgcaccgtgtaccaggt

SEQ ID NO: 449350 - DNA, 25 bp, Rattus norvegicus
tgcctaaatgagacgtgggtcgtcc

SEQ ID NO: 449351 - DNA, 25 bp, Rattus norvegicus
gcggccacaatttctgcaggtcatg

SEQ ID NO: 449352 - DNA, 25 bp, Rattus norvegicus
ctggagcccttcaaggagcccgtca

SEQ ID NO: 449353 - DNA, 25 bp, Rattus norvegicus
ttcctgaaagttcagggcgccgccc

SEQ ID NO: 449354 - DNA, 25 bp, Rattus norvegicus
cgccagaatcccagactctagagtc

SEQ ID NO: 449355 - DNA, 25 bp, Rattus norvegicus
acttggcacacttccgcctggtgca

SEQ ID NO: 449356 - DNA, 25 bp, Rattus norvegicus
agcggtcgcctgtatacttggcaca

SEQ ID NO: 449357 - DNA, 25 bp, Rattus norvegicus
acgcagcgaacctaagcagagcttc

SEQ ID NO: 449358 - DNA, 25 bp, Rattus norvegicus
cggatgcgggttcttgcttccacac

SEQ ID NO: 449359 - DNA, 25 bp, Rattus norvegicus
cctggctcctttttgtcttgtcttc

SEQ ID NO: 449360 - DNA, 25 bp, Rattus norvegicus
cagcggataggtcgttttcaggttc

SEQ ID NO: 449361 - DNA, 25 bp, Rattus norvegicus
gactggcgccatctcctcttttctg

SEQ ID NO: 449362 - DNA, 25 bp, Rattus norvegicus
agtccgatacttctcccaaggcttc

SEQ ID NO: 449363 - DNA, 25 bp, Rattus norvegicus
ggcgatgacagcgaagagtccgata

SEQ ID NO: 449364 - DNA, 25 bp, Rattus norvegicus
caaggttggcttggctccttccatg

SEQ ID NO: 449365 - DNA, 25 bp, Rattus norvegicus
cgcctggtacacgagctgcaaggtt

SEQ ID NO: 449366 - DNA, 25 bp, Rattus norvegicus
aagccaaaacgaggcgcgctccttt

SEQ ID NO: 449367 - DNA, 25 bp, Rattus norvegicus
aaaggcctacctccgcatgacacaa

SEQ ID NO: 449368 - DNA, 25 bp, Rattus norvegicus
ctgcctacggggaggagttctcctt

SEQ ID NO: 449369 - DNA, 25 bp, Rattus norvegicus
aaatacctgctcttcttcttcaaca

SEQ ID NO: 449370 - DNA, 25 bp, Rattus norvegicus
ctagaaggttcggcctgggctgccc

SEQ ID NO: 449371 - DNA, 25 bp, Rattus norvegicus
ctgcctgaggctagaaggttcggcc

SEQ ID NO: 449372 - DNA, 25 bp, Rattus norvegicus
actgtcgggcatccctggagcgccg

SEQ ID NO: 449373 - DNA, 25 bp, Rattus norvegicus
caggacacccggactgtcgggcatc

SEQ ID NO: 449374 - DNA, 25 bp, Rattus norvegicus
ggggtcacaggacacccggactgtc

SEQ ID NO: 449375 - DNA, 25 bp, Rattus norvegicus
ggtgaaatacctgctcttcttcttc

SEQ ID NO: 449376 - DNA, 25 bp, Rattus norvegicus
tcgtcagcccgctggtgaaatacct

SEQ ID NO: 449377 - DNA, 25 bp, Rattus norvegicus
gagtctccgccgctcacgctgtccg

SEQ ID NO: 449378 - DNA, 25 bp, Rattus norvegicus
ggaggagttctccttcgtcagcccg

SEQ ID NO: 449379 - DNA, 25 bp, Rattus norvegicus
cagcagtggaccatggcgcggagac

SEQ ID NO: 449380 - DNA, 25 bp, Rattus norvegicus
cccgacgcacagttcgggcggctcc

SEQ ID NO: 449381 - DNA, 25 bp, Rattus norvegicus
ttctccttcgtcagcccgctggtga

SEQ ID NO: 449382 - DNA, 25 bp, Rattus norvegicus
cctccgcgacaagtagtgcgctgtg

SEQ ID NO: 449383 - DNA, 25 bp, Rattus norvegicus
ctcagtgcagctgcgaccgacactt

SEQ ID NO: 449384 - DNA, 25 bp, Rattus norvegicus
tctgggattccaggcctcgatacct

SEQ ID NO: 449385 - DNA, 25 bp, Rattus norvegicus
tccctcttagctgcgttgcttcctg

SEQ ID NO: 449386 - DNA, 25 bp, Rattus norvegicus
cattcccggtttctgtcagcttttc

SEQ ID NO: 449387 - DNA, 25 bp, Rattus norvegicus
agctggtccctgttgagtctgttcc

SEQ ID NO: 449388 - DNA, 25 bp, Rattus norvegicus
ctgccattggccacgtgttcctaga

SEQ ID NO: 449389 - DNA, 25 bp, Rattus norvegicus
tactattggcttcacaccaggggcc

SEQ ID NO: 449390 - DNA, 25 bp, Rattus norvegicus
gcgcggatccgaacctgttatactt

SEQ ID NO: 449391 - DNA, 25 bp, Rattus norvegicus
tgctgcgtaacagtggctggacacc

SEQ ID NO: 449392 - DNA, 25 bp, Rattus norvegicus
acgctctgggcgaataagtgtacgg

SEQ ID NO: 449393 - DNA, 25 bp, Rattus norvegicus
cggggacattctcatcatctgaatg

SEQ ID NO: 449394 - DNA, 25 bp, Rattus norvegicus
ccgaagtggacttgacaggttgtca

SEQ ID NO: 449395 - DNA, 25 bp, Rattus norvegicus
agcgcgtgacctagttcgtcccgaa

SEQ ID NO: 449396 - DNA, 25 bp, Rattus norvegicus
gttcccagggttgaagacaattcca

SEQ ID NO: 449397 - DNA, 25 bp, Rattus norvegicus
cagggccagctagagcaacaaagga

SEQ ID NO: 449398 - DNA, 25 bp, Rattus norvegicus
caattccaatcgaggcgagggagtc

SEQ ID NO: 449399 - DNA, 25 bp, Rattus norvegicus
gcagctcaacatggggcccgggttc

SEQ ID NO: 449400 - DNA, 25 bp, Rattus norvegicus
caaagtttgcaaagttgggagccga

SEQ ID NO: 449401 - DNA, 25 bp, Rattus norvegicus
gggcgcaccggtcgcctaagtagcc

SEQ ID NO: 449402 - DNA, 25 bp, Rattus norvegicus
ctgcgagcctttgcgctacaacgtg

SEQ ID NO: 449403 - DNA, 25 bp, Rattus norvegicus
ttgcgctacaacgtgtgcctgggct

SEQ ID NO: 449404 - DNA, 25 bp, Rattus norvegicus
tacggagccaccactacgctgctgg

SEQ ID NO: 449405 - DNA, 25 bp, Rattus norvegicus
gactcgcaggaggaagcgcacagca

SEQ ID NO: 449406 - DNA, 25 bp, Rattus norvegicus
cgcacagcaagctcgtgctctggtc

SEQ ID NO: 449407 - DNA, 25 bp, Rattus norvegicus
atgggactggacactgacggaaaga

SEQ ID NO: 449408 - DNA, 25 bp, Rattus norvegicus
agaaaaggctcaggcctcaactgca

SEQ ID NO: 449409 - DNA, 25 bp, Rattus norvegicus
tgcattccagagagcagggccagct

SEQ ID NO: 449410 - DNA, 25 bp, Rattus norvegicus
tcaactcacctgacatgccgctttt

SEQ ID NO: 449411 - DNA, 25 bp, Rattus norvegicus
tacttttctgttagtcgctgtcctg

SEQ ID NO: 449412 - DNA, 25 bp, Rattus norvegicus
ttccgtcgcgtcatccgtttttata

SEQ ID NO: 449413 - DNA, 25 bp, Rattus norvegicus
tttcctcatctattccgtcgcgtca

SEQ ID NO: 449414 - DNA, 25 bp, Rattus norvegicus
ggagacattttcctcatctattccg

SEQ ID NO: 449415 - DNA, 25 bp, Rattus norvegicus
ctggcattcctttccggaaaccgca

SEQ ID NO: 449416 - DNA, 25 bp, Rattus norvegicus
cggcaagggagcgagtcattcttcc

SEQ ID NO: 449417 - DNA, 25 bp, Rattus norvegicus
ccggaggaaattcacgccggcaagg

SEQ ID NO: 449418 - DNA, 25 bp, Rattus norvegicus
tgacatgccgcttttcctttaaaga

SEQ ID NO: 449419 - DNA, 25 bp, Rattus norvegicus
gccggaattcaactcacctgacatg

SEQ ID NO: 449420 - DNA, 25 bp, Rattus norvegicus
cttctcgcctgcagccggaattcaa

SEQ ID NO: 449421 - DNA, 25 bp, Rattus norvegicus
gagcaaaaccatgccttctcgcctg

SEQ ID NO: 449422 - DNA, 25 bp, Rattus norvegicus
gaacggagcaaaaccatgccttctc

SEQ ID NO: 449423 - DNA, 25 bp, Rattus norvegicus
tttaaagaccgcccgcacgatcgca

SEQ ID NO: 449424 - DNA, 25 bp, Rattus norvegicus
gtgctccgctgagaagcgaagcctc

SEQ ID NO: 449425 - DNA, 25 bp, Rattus norvegicus
ctccgcgtgtaattttccgggctgt

SEQ ID NO: 449426 - DNA, 25 bp, Rattus norvegicus
ctccagcacactccgcgtgtaattt

SEQ ID NO: 449427 - DNA, 25 bp, Rattus norvegicus
gggaggagaagcacctactactaca

SEQ ID NO: 449428 - DNA, 25 bp, Rattus norvegicus
tctactacttgaacgaggcagggga

SEQ ID NO: 449429 - DNA, 25 bp, Rattus norvegicus
ggtagcgcccttctctactacttga

SEQ ID NO: 449430 - DNA, 25 bp, Rattus norvegicus
taataacatggaggtagcgcccttc

SEQ ID NO: 449431 - DNA, 25 bp, Rattus norvegicus
ggcagacttcgctactaataacatg

SEQ ID NO: 449432 - DNA, 25 bp, Rattus norvegicus
aagcgaagcctccaggtaccacggg

SEQ ID NO: 449433 - DNA, 25 bp, Rattus norvegicus
ttgaacccgctcttagagcggccgc

SEQ ID NO: 449434 - DNA, 25 bp, Rattus norvegicus
gccgagagtcttttcccacccttga

SEQ ID NO: 449435 - DNA, 25 bp, Rattus norvegicus
cacaccctctaggtcgtggagccga

SEQ ID NO: 449436 - DNA, 25 bp, Rattus norvegicus
cgccgcgcacggtcaagaaggtact

SEQ ID NO: 449437 - DNA, 25 bp, Rattus norvegicus
gtaccacgggcagacttcgctacta

SEQ ID NO: 449438 - DNA, 25 bp, Rattus norvegicus
agccgctgaggcgaaccgctaaagg

SEQ ID NO: 449439 - DNA, 25 bp, Rattus norvegicus
accagcgcgtagaggtgcagtgact

SEQ ID NO: 449440 - DNA, 25 bp, Rattus norvegicus
ctgaatttggatcccgttgtacgga

SEQ ID NO: 449441 - DNA, 25 bp, Rattus norvegicus
gccgggtgaagcctgaatttggatc

SEQ ID NO: 449442 - DNA, 25 bp, Rattus norvegicus
agatacttgacagctgccgccgggt

SEQ ID NO: 449443 - DNA, 25 bp, Rattus norvegicus
gagcgtaacagatactttccagata

SEQ ID NO: 449444 - DNA, 25 bp, Rattus norvegicus
cctaacccgcgcgaagagcgtaaca

SEQ ID NO: 449445 - DNA, 25 bp, Rattus norvegicus
cgctatctagccttggcctgcggtt

SEQ ID NO: 449446 - DNA, 25 bp, Rattus norvegicus
accgggagatatccgccagcgggaa

SEQ ID NO: 449447 - DNA, 25 bp, Rattus norvegicus
aagcgttccgcaaccagcggcggga

SEQ ID NO: 449448 - DNA, 25 bp, Rattus norvegicus
cgctaaagggaaccttcctagtatg

SEQ ID NO: 449449 - DNA, 25 bp, Rattus norvegicus
cgcccggggcagagatcttgaagct

SEQ ID NO: 449450 - DNA, 25 bp, Rattus norvegicus
ttacagccaatcgaagtttaggagg

SEQ ID NO: 449451 - DNA, 25 bp, Rattus norvegicus
ggctctccggctaatgacaacggca

SEQ ID NO: 449452 - DNA, 25 bp, Rattus norvegicus
tcccacttggagttcgcagtctttg

SEQ ID NO: 449453 - DNA, 25 bp, Rattus norvegicus
atcacgctactttgctcccacttgg

SEQ ID NO: 449454 - DNA, 25 bp, Rattus norvegicus
ccaaagcgaaaagcgacagcggggt

SEQ ID NO: 449455 - DNA, 25 bp, Rattus norvegicus
cggggtaggtagagcaaatcagaac

SEQ ID NO: 449456 - DNA, 25 bp, Rattus norvegicus
tcagaacacacactgaacccacagg

SEQ ID NO: 449457 - DNA, 25 bp, Rattus norvegicus
ccggtgccctagcaacaggtaaaca

SEQ ID NO: 449458 - DNA, 25 bp, Rattus norvegicus
caggtaaacagtgcgaggttcggcc

SEQ ID NO: 449459 - DNA, 25 bp, Rattus norvegicus
ttcggccgcgttagagcgctcgaca

SEQ ID NO: 449460 - DNA, 25 bp, Rattus norvegicus
cgacagcgggctgtctgagtgcctc

SEQ ID NO: 449461 - DNA, 25 bp, Rattus norvegicus
tggggtgaggcaaaccttgtctacc

SEQ ID NO: 449462 - DNA, 25 bp, Rattus norvegicus
aaaccttgtctaccagcatctgcgc

SEQ ID NO: 449463 - DNA, 25 bp, Rattus norvegicus
accgcgaaggcgctcaattggaggt

SEQ ID NO: 449464 - DNA, 25 bp, Rattus norvegicus
aatgcggtgcctggatttcgagact

SEQ ID NO: 449465 - DNA, 25 bp, Rattus norvegicus
gcacctccgggacaaaatcacgcta

SEQ ID NO: 449466 - DNA, 25 bp, Rattus norvegicus
ccacggtagcgcagccgctctgagg

SEQ ID NO: 449467 - DNA, 25 bp, Rattus norvegicus
ttcttgcaagttgtgaggaggcgcc

SEQ ID NO: 449468 - DNA, 25 bp, Rattus norvegicus
gctgcccaccttcttgcaagttgtg

SEQ ID NO: 449469 - DNA, 25 bp, Rattus norvegicus
ggcgctgaatatggcgcgctgccca

SEQ ID NO: 449470 - DNA, 25 bp, Rattus norvegicus
cgtgggatggttacccaggtggact

SEQ ID NO: 449471 - DNA, 25 bp, Rattus norvegicus
ttcggccggcgacctccgaagcttc

SEQ ID NO: 449472 - DNA, 25 bp, Rattus norvegicus
ctcgaggatgcgcaggccgcactag

SEQ ID NO: 449473 - DNA, 25 bp, Rattus norvegicus
aaaccgccacctcgaggatgcgcag

SEQ ID NO: 449474 - DNA, 25 bp, Rattus norvegicus
agccgctctgaggtgagtgccctac

SEQ ID NO: 449475 - DNA, 25 bp, Rattus norvegicus
tcgcagtctccacggcgcaggccca

SEQ ID NO: 449476 - DNA, 25 bp, Rattus norvegicus
cagcgctcgccattgccgctggtgg

SEQ ID NO: 449477 - DNA, 25 bp, Rattus norvegicus
caccagaggccgacgaagctgccgg

SEQ ID NO: 449478 - DNA, 25 bp, Rattus norvegicus
agcggcaccagaggccgacgaagct

SEQ ID NO: 449479 - DNA, 25 bp, Rattus norvegicus
taccgcgcaatctccagctatttca

SEQ ID NO: 449480 - DNA, 25 bp, Rattus norvegicus
ctagccaaggtgtgtgtagcacagc

SEQ ID NO: 449481 - DNA, 25 bp, Rattus norvegicus
tctgtcctagcctcctaccttgggg

SEQ ID NO: 449482 - DNA, 25 bp, Rattus norvegicus
acttggaaatccgactctgggctgg

SEQ ID NO: 449483 - DNA, 25 bp, Rattus norvegicus
gccaggcgtactgtgggaccacact

SEQ ID NO: 449484 - DNA, 25 bp, Rattus norvegicus
ggaccacactggacggctctctgtg

SEQ ID NO: 449485 - DNA, 25 bp, Rattus norvegicus
accagaggctctccactcgtgctaa

SEQ ID NO: 449486 - DNA, 25 bp, Rattus norvegicus
tgcctagccctgaagccgcacaggt

SEQ ID NO: 449487 - DNA, 25 bp, Rattus norvegicus
gatccctcggatcctccttagctag

SEQ ID NO: 449488 - DNA, 25 bp, Rattus norvegicus
gggcacagttaaggtacaccctagc

SEQ ID NO: 449489 - DNA, 25 bp, Rattus norvegicus
cccagacggcaagcacagttcaaaa

SEQ ID NO: 449490 - DNA, 25 bp, Rattus norvegicus
tagctcctagttctcccgatgaatc

SEQ ID NO: 449491 - DNA, 25 bp, Rattus norvegicus
ggtctgaccgcctagaagcctctaa

SEQ ID NO: 449492 - DNA, 25 bp, Rattus norvegicus
gggcttagccgatgttcccaccaaa

SEQ ID NO: 449493 - DNA, 25 bp, Rattus norvegicus
ccttgaatgttgctccggttggtgc

SEQ ID NO: 449494 - DNA, 25 bp, Rattus norvegicus
cagcagtcgcagaaggctccttgca

SEQ ID NO: 449495 - DNA, 25 bp, Rattus norvegicus
agttgtatttattggcgggtcgcgc

SEQ ID NO: 449496 - DNA, 25 bp, Rattus norvegicus
ttataggcgggaccagttgtattta

SEQ ID NO: 449497 - DNA, 25 bp, Rattus norvegicus
caaggcctatggtggcgctttccga

SEQ ID NO: 449498 - DNA, 25 bp, Rattus norvegicus
gtcccaccctcacgctgtgagatgt

SEQ ID NO: 449499 - DNA, 25 bp, Rattus norvegicus
ggggacttgctctaggactcacagc

SEQ ID NO: 449500 - DNA, 25 bp, Rattus norvegicus
gcgtccataggatcaagtggccatc

SEQ ID NO: 449501 - DNA, 25 bp, Rattus norvegicus
aacagcacggagaacagcgtccata

SEQ ID NO: 449502 - DNA, 25 bp, Rattus norvegicus
gtcacgccagcagtgcttgctcttg

SEQ ID NO: 449503 - DNA, 25 bp, Rattus norvegicus
gtcgaccttcttgaggcagccctcg

SEQ ID NO: 449504 - DNA, 25 bp, Rattus norvegicus
cacgggaagcgcttgtcgaccttct

SEQ ID NO: 449505 - DNA, 25 bp, Rattus norvegicus
ttgagcatgatctccttgcacggga

SEQ ID NO: 449506 - DNA, 25 bp, Rattus norvegicus
gccctgctgtcgttcttgagcatga

SEQ ID NO: 449507 - DNA, 25 bp, Rattus norvegicus
cgcgaacgctgcagactacaccata

SEQ ID NO: 449508 - DNA, 25 bp, Rattus norvegicus
gtcttaggaatccaaacgtcgtaga

SEQ ID NO: 449509 - DNA, 25 bp, Rattus norvegicus
ccgtgatgtcacctctgtgacgtca

SEQ ID NO: 449510 - DNA, 25 bp, Rattus norvegicus
agcctcgctctaggcgccgtgatgt

SEQ ID NO: 449511 - DNA, 25 bp, Rattus norvegicus
ggtcggcctctctaccctagcctcg

SEQ ID NO: 449512 - DNA, 25 bp, Rattus norvegicus
aagccgacgactccagctcggtcgg

SEQ ID NO: 449513 - DNA, 25 bp, Rattus norvegicus
cgctctcgccagctcccagctgctt

SEQ ID NO: 449514 - DNA, 25 bp, Rattus norvegicus
tcgggctgccctccggctgaggctt

SEQ ID NO: 449515 - DNA, 25 bp, Rattus norvegicus
gcttgactacgtccgtgtccatccg

SEQ ID NO: 449516 - DNA, 25 bp, Rattus norvegicus
ggatacagcttgactacgtccgtgt

SEQ ID NO: 449517 - DNA, 25 bp, Rattus norvegicus
gcagtccgaattcccctccatgaag

SEQ ID NO: 449518 - DNA, 25 bp, Rattus norvegicus
ggcgaagaacaacgcacatctcggg

SEQ ID NO: 449519 - DNA, 25 bp, Rattus norvegicus
aggcgccgtgatgtcacctctgtga

SEQ ID NO: 449520 - DNA, 25 bp, Rattus norvegicus
cagggagggcgaagaacaacgcaca

SEQ ID NO: 449521 - DNA, 25 bp, Rattus norvegicus
tccaaacgtcgtagagggaaagtca

SEQ ID NO: 449522 - DNA, 25 bp, Rattus norvegicus
gctgcggcaatcgttagcgggccat

SEQ ID NO: 449523 - DNA, 25 bp, Rattus norvegicus
ctcccgggtctcttgaggagcccgg

SEQ ID NO: 449524 - DNA, 25 bp, Rattus norvegicus
cggcaatcgttagcgggccatgtcg

SEQ ID NO: 449525 - DNA, 25 bp, Rattus norvegicus
ttagcgggccatgtcggctgcccag

SEQ ID NO: 449526 - DNA, 25 bp, Rattus norvegicus
ggggcaccggacagctcaaccgatt

SEQ ID NO: 449527 - DNA, 25 bp, Rattus norvegicus
ggcaccggacagctcaaccgattcg

SEQ ID NO: 449528 - DNA, 25 bp, Rattus norvegicus
ccggacagctcaaccgattcgtgca

SEQ ID NO: 449529 - DNA, 25 bp, Rattus norvegicus
acagctcaaccgattcgtgcagctc

SEQ ID NO: 449530 - DNA, 25 bp, Rattus norvegicus
tcaaccgattcgtgcagctctccgg

SEQ ID NO: 449531 - DNA, 25 bp, Rattus norvegicus
accgattcgtgcagctctccggacg

SEQ ID NO: 449532 - DNA, 25 bp, Rattus norvegicus
gattcgtgcagctctccggacgtcc

SEQ ID NO: 449533 - DNA, 25 bp, Rattus norvegicus
cggacgtccgcacctgccaggtgag

SEQ ID NO: 449534 - DNA, 25 bp, Rattus norvegicus
acgtccgcacctgccaggtgagtgg

SEQ ID NO: 449535 - DNA, 25 bp, Rattus norvegicus
gtctcccgggtctcttgaggagccc

SEQ ID NO: 449536 - DNA, 25 bp, Rattus norvegicus
acgatgaagcctgtggctgggacac

SEQ ID NO: 449537 - DNA, 25 bp, Rattus norvegicus
agaagccgcccagggtggtttctct

SEQ ID NO: 449538 - DNA, 25 bp, Rattus norvegicus
gatggcctcgtgcttcacagagaag

SEQ ID NO: 449539 - DNA, 25 bp, Rattus norvegicus
ttccgaatgtaagatggcctcgtgc

SEQ ID NO: 449540 - DNA, 25 bp, Rattus norvegicus
ttcaggccaggattttccgaatgta

SEQ ID NO: 449541 - DNA, 25 bp, Rattus norvegicus
tcccagtgttcaggccaggattttc

SEQ ID NO: 449542 - DNA, 25 bp, Rattus norvegicus
ttgtcgcggcaaaattcccagtgtt

SEQ ID NO: 449543 - DNA, 25 bp, Rattus norvegicus
ccagtcacttgtcgcggcaaaattc

SEQ ID NO: 449544 - DNA, 25 bp, Rattus norvegicus
ctgggacacgcttgaagccagcgcc

SEQ ID NO: 449545 - DNA, 25 bp, Rattus norvegicus
tgctgcacgatgaagcctgtggctg

SEQ ID NO: 449546 - DNA, 25 bp, Rattus norvegicus
cggagccgcagtgctgcacgatgaa

SEQ ID NO: 449547 - DNA, 25 bp, Rattus norvegicus
cgcgaagagcttaaattaaagaatc

SEQ ID NO: 449548 - DNA, 25 bp, Rattus norvegicus
ctgggtgcgcgaagagcttaaatta

SEQ ID NO: 449549 - DNA, 25 bp, Rattus norvegicus
aggtgccaccgccagtcacttgtcg

SEQ ID NO: 449550 - DNA, 25 bp, Rattus norvegicus
gctggacccaggagcgcagcgcaca

SEQ ID NO: 449551 - DNA, 25 bp, Rattus norvegicus
acggtcccatagcttcttcccggag

SEQ ID NO: 449552 - DNA, 25 bp, Rattus norvegicus
ttgcgccacgcgctggacccaggag

SEQ ID NO: 449553 - DNA, 25 bp, Rattus norvegicus
ggtcggtttcctggtgttgcgccac

SEQ ID NO: 449554 - DNA, 25 bp, Rattus norvegicus
ccacagccaagtgcgagagtccacg

SEQ ID NO: 449555 - DNA, 25 bp, Rattus norvegicus
gggagcagcacttccacagccaagt

SEQ ID NO: 449556 - DNA, 25 bp, Rattus norvegicus
ttccggtccggccacgagagactgt

SEQ ID NO: 449557 - DNA, 25 bp, Rattus norvegicus
ttttctgagcctgctgcggtctagg

SEQ ID NO: 449558 - DNA, 25 bp, Rattus norvegicus
agctgaggcggcgttttctgagcct

SEQ ID NO: 449559 - DNA, 25 bp, Rattus norvegicus
gcctcccttattctgaactgcttct

SEQ ID NO: 449560 - DNA, 25 bp, Rattus norvegicus
ctctcagattgacgcacaagtcccg

SEQ ID NO: 449561 - DNA, 25 bp, Rattus norvegicus
tgacgtacggcgctctcagattgac

SEQ ID NO: 449562 - DNA, 25 bp, Rattus norvegicus
tgcggtctaggtagtgttccggtcc

SEQ ID NO: 449563 - DNA, 25 bp, Rattus norvegicus
tcacttacgtcctctgtcacttgcg

SEQ ID NO: 449564 - DNA, 25 bp, Rattus norvegicus
ccgcgcaataacagcagtaaagata

SEQ ID NO: 449565 - DNA, 25 bp, Rattus norvegicus
gctccagagcgaaacagacagagga

SEQ ID NO: 449566 - DNA, 25 bp, Rattus norvegicus
taggacctcgttgtcgctccagagc

SEQ ID NO: 449567 - DNA, 25 bp, Rattus norvegicus
cccgcctagcgtggaggtaagctct

SEQ ID NO: 449568 - DNA, 25 bp, Rattus norvegicus
tgctatagcagctgcgtcccttcag

SEQ ID NO: 449569 - DNA, 25 bp, Rattus norvegicus
aggccaccgagcctgctatagcagc

SEQ ID NO: 449570 - DNA, 25 bp, Rattus norvegicus
agctggagacaactcgggcctcaca

SEQ ID NO: 449571 - DNA, 25 bp, Rattus norvegicus
ggcacacactgctgctgaagctgga

SEQ ID NO: 449572 - DNA, 25 bp, Rattus norvegicus
tcggtattatttctggtaaaccaca

SEQ ID NO: 449573 - DNA, 25 bp, Rattus norvegicus
gtccaaatcctgacccgcgcaataa

SEQ ID NO: 449574 - DNA, 25 bp, Rattus norvegicus
acagaggaggggatgacgacttttt

SEQ ID NO: 449575 - DNA, 25 bp, Rattus norvegicus
gaggtaagctctgtcctgtaggacc

SEQ ID NO: 449576 - DNA, 25 bp, Rattus norvegicus
acaacaccggctggaggtcacggcc

SEQ ID NO: 449577 - DNA, 25 bp, Rattus norvegicus
agggctcacgtcacggcacgcatgc

SEQ ID NO: 449578 - DNA, 25 bp, Rattus norvegicus
ggacgcccgctagcgcagcttgaat

SEQ ID NO: 449579 - DNA, 25 bp, Rattus norvegicus
agaagccgctcaatggttgccaagg

SEQ ID NO: 449580 - DNA, 25 bp, Rattus norvegicus
tagaggctccgtttactgcctcggc

SEQ ID NO: 449581 - DNA, 25 bp, Rattus norvegicus
ggctgcccaggtcagccaatagagg

SEQ ID NO: 449582 - DNA, 25 bp, Rattus norvegicus
tgtaacctctcttccgattggcctg

SEQ ID NO: 449583 - DNA, 25 bp, Rattus norvegicus
agcctcacgtcttgccactaatcta

SEQ ID NO: 449584 - DNA, 25 bp, Rattus norvegicus
cacgctcggggttctagcctcacgt

SEQ ID NO: 449585 - DNA, 25 bp, Rattus norvegicus
gacatatttgctccaaccgaccacg

SEQ ID NO: 449586 - DNA, 25 bp, Rattus norvegicus
tgcctccgggcagacatatttgctc

SEQ ID NO: 449587 - DNA, 25 bp, Rattus norvegicus
tcaggattcccaatgtgcctccggg

SEQ ID NO: 449588 - DNA, 25 bp, Rattus norvegicus
ggtgccttttcacgcagagcctaga

SEQ ID NO: 449589 - DNA, 25 bp, Rattus norvegicus
cgcctggcaccacggggtgcctttt

SEQ ID NO: 449590 - DNA, 25 bp, Rattus norvegicus
cagcttgaatcctggcggccagctc

SEQ ID NO: 449591 - DNA, 25 bp, Rattus norvegicus
cggccttcggagagtgagcacgcct

SEQ ID NO: 449592 - DNA, 25 bp, Rattus norvegicus
ggttgatctggctcaaggctctact

SEQ ID NO: 449593 - DNA, 25 bp, Rattus norvegicus
ctacttttcttagctcatcaacttt

SEQ ID NO: 449594 - DNA, 25 bp, Rattus norvegicus
ggctctacttttcttagctcatcaa

SEQ ID NO: 449595 - DNA, 25 bp, Rattus norvegicus
aaggctctacttttcttagctcatc

SEQ ID NO: 449596 - DNA, 25 bp, Rattus norvegicus
ggctcaaggctctacttttcttagc

SEQ ID NO: 449597 - DNA, 25 bp, Rattus norvegicus
gatctggctcaaggctctacttttc

SEQ ID NO: 449598 - DNA, 25 bp, Rattus norvegicus
tccatgattgctccatatttgagga

SEQ ID NO: 449599 - DNA, 25 bp, Rattus norvegicus
aaatggttgatctggctcaaggctc

SEQ ID NO: 449600 - DNA, 25 bp, Rattus norvegicus
ccaaatggttgatctggctcaaggc

SEQ ID NO: 449601 - DNA, 25 bp, Rattus norvegicus
ggaagccaaatggttgatctggctc

SEQ ID NO: 449602 - DNA, 25 bp, Rattus norvegicus
ttgaggaagccaaatggttgatctg

SEQ ID NO: 449603 - DNA, 25 bp, Rattus norvegicus
gctccatatttgaggaagccaaatg

SEQ ID NO: 449604 - DNA, 25 bp, Rattus norvegicus
tgattgctccatatttgaggaagcc

SEQ ID NO: 449605 - DNA, 25 bp, Rattus norvegicus
ctggctcaaggctctacttttctta

SEQ ID NO: 449606 - DNA, 25 bp, Rattus norvegicus
aagatagggtctggatgttcgatga

SEQ ID NO: 449607 - DNA, 25 bp, Rattus norvegicus
tctccttagggtcaaagatagggtc

SEQ ID NO: 449608 - DNA, 25 bp, Rattus norvegicus
gaaaccactgactctctccgcgttg

SEQ ID NO: 449609 - DNA, 25 bp, Rattus norvegicus
caccaccagggcgtagagggtgacc

SEQ ID NO: 449610 - DNA, 25 bp, Rattus norvegicus
tccggaggcggctcacccgaagctg

SEQ ID NO: 449611 - DNA, 25 bp, Rattus norvegicus
aagacgcgcacgagttggtcacaac

SEQ ID NO: 449612 - DNA, 25 bp, Rattus norvegicus
ccgccgctctacttgggaaggcggc

SEQ ID NO: 449613 - DNA, 25 bp, Rattus norvegicus
gagattactccagcgcgaccgtggg

SEQ ID NO: 449614 - DNA, 25 bp, Rattus norvegicus
cgttcagatccttctccttagggtc

SEQ ID NO: 449615 - DNA, 25 bp, Rattus norvegicus
ttggcaccggtttgtctgtctcgca

SEQ ID NO: 449616 - DNA, 25 bp, Rattus norvegicus
tgtctcgcagggtccaagcctttaa

SEQ ID NO: 449617 - DNA, 25 bp, Rattus norvegicus
ggtccaagcctttaaatttcctgca

SEQ ID NO: 449618 - DNA, 25 bp, Rattus norvegicus
ggccgggcatccgagattactccag

SEQ ID NO: 449619 - DNA, 25 bp, Rattus norvegicus
cgcagcagcgtctcgttcagatcct

SEQ ID NO: 449620 - DNA, 25 bp, Rattus norvegicus
gcaggcaacctggtgaggcgcaaca

SEQ ID NO: 449621 - DNA, 25 bp, Rattus norvegicus
aggcgcaacactgggaagcgcgtgg

SEQ ID NO: 449622 - DNA, 25 bp, Rattus norvegicus
tgaggcgcaacactgggaagcgcgt

SEQ ID NO: 449623 - DNA, 25 bp, Rattus norvegicus
ggtgaggcgcaacactgggaagcgc

SEQ ID NO: 449624 - DNA, 25 bp, Rattus norvegicus
ctggtgaggcgcaacactgggaagc

SEQ ID NO: 449625 - DNA, 25 bp, Rattus norvegicus
acctggtgaggcgcaacactgggaa

SEQ ID NO: 449626 - DNA, 25 bp, Rattus norvegicus
caacctggtgaggcgcaacactggg

SEQ ID NO: 449627 - DNA, 25 bp, Rattus norvegicus
ggcaacctggtgaggcgcaacactg

SEQ ID NO: 449628 - DNA, 25 bp, Rattus norvegicus
caggcaacctggtgaggcgcaacac

SEQ ID NO: 449629 - DNA, 25 bp, Rattus norvegicus
gcgcaacactgggaagcgcgtggtg

SEQ ID NO: 449630 - DNA, 25 bp, Rattus norvegicus
tgcaggcaacctggtgaggcgcaac

SEQ ID NO: 449631 - DNA, 25 bp, Rattus norvegicus
aacctggtgaggcgcaacactggga

SEQ ID NO: 449632 - DNA, 25 bp, Rattus norvegicus
aggcaacctggtgaggcgcaacact

SEQ ID NO: 449633 - DNA, 25 bp, Rattus norvegicus
gcaacctggtgaggcgcaacactgg

SEQ ID NO: 449634 - DNA, 25 bp, Rattus norvegicus
cgccgcgcgtaccagactcctcgtc

SEQ ID NO: 449635 - DNA, 25 bp, Rattus norvegicus
aacccttgcgcctgagggtgggcgt

SEQ ID NO: 449636 - DNA, 25 bp, Rattus norvegicus
cttcttgtcgaattttttaatcatc

SEQ ID NO: 449637 - DNA, 25 bp, Rattus norvegicus
aatcatcttggacggcttcccagcg

SEQ ID NO: 449638 - DNA, 25 bp, Rattus norvegicus
caccgcaaccgtcccaggcgccgca

SEQ ID NO: 449639 - DNA, 25 bp, Rattus norvegicus
aagacgctgcaggaaggcaggccct

SEQ ID NO: 449640 - DNA, 25 bp, Rattus norvegicus
aaggcaggccctgtgttctcacacc

SEQ ID NO: 449641 - DNA, 25 bp, Rattus norvegicus
aggccctgtgttctcacaccggttg

SEQ ID NO: 449642 - DNA, 25 bp, Rattus norvegicus
ctgtgttctcacaccggttgggcca

SEQ ID NO: 449643 - DNA, 25 bp, Rattus norvegicus
ttctcacaccggttgggccagcggg

SEQ ID NO: 449644 - DNA, 25 bp, Rattus norvegicus
tagggacgcaggcacgccctctgct

SEQ ID NO: 449645 - DNA, 25 bp, Rattus norvegicus
acgccctctgctccgcctactgccg

SEQ ID NO: 449646 - DNA, 25 bp, Rattus norvegicus
gccgcccccagagcaggtggatacg

SEQ ID NO: 449647 - DNA, 25 bp, Rattus norvegicus
tttttaatcatcttggacggcttcc

SEQ ID NO: 449648 - DNA, 25 bp, Rattus norvegicus
agcttcttccgagtcctccttggtg

SEQ ID NO: 449649 - DNA, 25 bp, Rattus norvegicus
tgtaatctgcctcctgcggtacgta

SEQ ID NO: 449650 - DNA, 25 bp, Rattus norvegicus
gtacgtaggacccactgctggccca

SEQ ID NO: 449651 - DNA, 25 bp, Rattus norvegicus
ttcaggcgcacccaggatagcagac

SEQ ID NO: 449652 - DNA, 25 bp, Rattus norvegicus
tctcggcgtcagagagctcatcctc

SEQ ID NO: 449653 - DNA, 25 bp, Rattus norvegicus
tcgaagcagcttgttgaggcacacg

SEQ ID NO: 449654 - DNA, 25 bp, Rattus norvegicus
ttcccgggcaccacagcttaaatca

SEQ ID NO: 449655 - DNA, 25 bp, Rattus norvegicus
gtggacatagacaccaggcactccg

SEQ ID NO: 449656 - DNA, 25 bp, Rattus norvegicus
ctccgcagcgaagtagtccaggcaa

SEQ ID NO: 449657 - DNA, 25 bp, Rattus norvegicus
cccagcagcctgagaaattatcttg

SEQ ID NO: 449658 - DNA, 25 bp, Rattus norvegicus
ctggcgagccaggtaatttcaatgc

SEQ ID NO: 449659 - DNA, 25 bp, Rattus norvegicus
tttcaatgcgcgcaagtcccggatc

SEQ ID NO: 449660 - DNA, 25 bp, Rattus norvegicus
ctcatcctcgccgaaggtctgggta

SEQ ID NO: 449661 - DNA, 25 bp, Rattus norvegicus
ccggatcgcaacttctgggcagcct

SEQ ID NO: 449662 - DNA, 25 bp, Rattus norvegicus
tgtgccacatgacgaagctcgccct

SEQ ID NO: 449663 - DNA, 25 bp, Rattus norvegicus
tcagaagcctacagtgtgccacatg

SEQ ID NO: 449664 - DNA, 25 bp, Rattus norvegicus
tccaagctgtcagaagcctacagtg

SEQ ID NO: 449665 - DNA, 25 bp, Rattus norvegicus
gggtagatggctccaagctgtcaga

SEQ ID NO: 449666 - DNA, 25 bp, Rattus norvegicus
cggacctaagcgctccgaagtcttg

SEQ ID NO: 449667 - DNA, 25 bp, Rattus norvegicus
tgacacgccgttccgagcgagccgt

SEQ ID NO: 449668 - DNA, 25 bp, Rattus norvegicus
ttcagctcgcgagctgctgcggacc

SEQ ID NO: 449669 - DNA, 25 bp, Rattus norvegicus
cgtcacgactcttgctacgcacttc

SEQ ID NO: 449670 - DNA, 25 bp, Rattus norvegicus
gggcagagggcaccaccctgtttac

SEQ ID NO: 449671 - DNA, 25 bp, Rattus norvegicus
cgcgggctccatcaaaacaaaaaca

SEQ ID NO: 449672 - DNA, 25 bp, Rattus norvegicus
ctgcacgcgggctccatcaaaacaa

SEQ ID NO: 449673 - DNA, 25 bp, Rattus norvegicus
caagactgttcagggtctgcgaccc

SEQ ID NO: 449674 - DNA, 25 bp, Rattus norvegicus
gtcctcgccactcacgcagcagctt

SEQ ID NO: 449675 - DNA, 25 bp, Rattus norvegicus
ggtagttttcggacaagactgttca

SEQ ID NO: 449676 - DNA, 25 bp, Rattus norvegicus
gccagcccaattgcgacgagtcttc

SEQ ID NO: 449677 - DNA, 25 bp, Rattus norvegicus
tggccactgtttccaaccaggcaga

SEQ ID NO: 449678 - DNA, 25 bp, Rattus norvegicus
ctgttgttaattgcacctgcctggc

SEQ ID NO: 449679 - DNA, 25 bp, Rattus norvegicus
gcctggccgattacctctgggaatc

SEQ ID NO: 449680 - DNA, 25 bp, Rattus norvegicus
cgctttgcagcaggaggaaaacttt

SEQ ID NO: 449681 - DNA, 25 bp, Rattus norvegicus
ggaaaactttatcacccagcacgag

SEQ ID NO: 449682 - DNA, 25 bp, Rattus norvegicus
cagcacgagacttctgccacgcgta

SEQ ID NO: 449683 - DNA, 25 bp, Rattus norvegicus
gacgctgcacccgatgattctgtag

SEQ ID NO: 449684 - DNA, 25 bp, Rattus norvegicus
aagaggacgctccaacccggcattc

SEQ ID NO: 449685 - DNA, 25 bp, Rattus norvegicus
gacagtcataaaaagcgcgtggcta

SEQ ID NO: 449686 - DNA, 25 bp, Rattus norvegicus
ccctagcctgaagaggcggtcactg

SEQ ID NO: 449687 - DNA, 25 bp, Rattus norvegicus
ctgcgagtgcacattccggtgagtc

SEQ ID NO: 449688 - DNA, 25 bp, Rattus norvegicus
tgagtccgatccctggagctccaga

SEQ ID NO: 449689 - DNA, 25 bp, Rattus norvegicus
cggcccagggttatgcatttctcca

SEQ ID NO: 449690 - DNA, 25 bp, Rattus norvegicus
acttgtcacgccaagctgctgcgtg

SEQ ID NO: 449691 - DNA, 25 bp, Rattus norvegicus
ctagaattttcccaggatggtggca

SEQ ID NO: 449692 - DNA, 25 bp, Rattus norvegicus
tccgagagcgtattcttctagaatt

SEQ ID NO: 449693 - DNA, 25 bp, Rattus norvegicus
tgcgcacgtagattccgagagcgta

SEQ ID NO: 449694 - DNA, 25 bp, Rattus norvegicus
ccaggaggaaaatgatgcgcacgta

SEQ ID NO: 449695 - DNA, 25 bp, Rattus norvegicus
tttctggttccttcctccggagcca

SEQ ID NO: 449696 - DNA, 25 bp, Rattus norvegicus
cctaaagaacttaccttgaggctga

SEQ ID NO: 449697 - DNA, 25 bp, Rattus norvegicus
ccatttgcctcacccggagtgcggg

SEQ ID NO: 449698 - DNA, 25 bp, Rattus norvegicus
ctgccggttaaaagttgctctgcgc

SEQ ID NO: 449699 - DNA, 25 bp, Rattus norvegicus
tgggagtcgagcacccaatccagtc

SEQ ID NO: 449700 - DNA, 25 bp, Rattus norvegicus
atagctccgacatgcccgtttcacg

SEQ ID NO: 449701 - DNA, 25 bp, Rattus norvegicus
gtccaccgggaaaatagctcggatg

SEQ ID NO: 449702 - DNA, 25 bp, Rattus norvegicus
ggatgacgcgccaacccatttgcct

SEQ ID NO: 449703 - DNA, 25 bp, Rattus norvegicus
ttgaggctgaacactgcgccgcttt

SEQ ID NO: 449704 - DNA, 25 bp, Rattus norvegicus
acctgatcctcggtagcgaagggct

SEQ ID NO: 449705 - DNA, 25 bp, Rattus norvegicus
ggaggaacctgatcctcggtagcga

SEQ ID NO: 449706 - DNA, 25 bp, Rattus norvegicus
gaggaacctgatcctcggtagcgaa

SEQ ID NO: 449707 - DNA, 25 bp, Rattus norvegicus
gaacctgatcctcggtagcgaaggg

SEQ ID NO: 449708 - DNA, 25 bp, Rattus norvegicus
cctgatcctcggtagcgaagggctg

SEQ ID NO: 449709 - DNA, 25 bp, Rattus norvegicus
aagggctggaggcaaacaccgagct

SEQ ID NO: 449710 - DNA, 25 bp, Rattus norvegicus
agggctggaggcaaacaccgagctc

SEQ ID NO: 449711 - DNA, 25 bp, Rattus norvegicus
ggctggaggcaaacaccgagctccc

SEQ ID NO: 449712 - DNA, 25 bp, Rattus norvegicus
ggcaaacaccgagctccccctgagt

SEQ ID NO: 449713 - DNA, 25 bp, Rattus norvegicus
cgcttgggagcagggagggttctgc

SEQ ID NO: 449714 - DNA, 25 bp, Rattus norvegicus
ggttctgctaccctgaggggccctc

SEQ ID NO: 449715 - DNA, 25 bp, Rattus norvegicus
cggcgcaggtggtcgccttgggaag

SEQ ID NO: 449716 - DNA, 25 bp, Rattus norvegicus
ccctgagtcgcttgggagcagggag

SEQ ID NO: 449717 - DNA, 25 bp, Rattus norvegicus
ggaacctgatcctcggtagcgaagg

SEQ ID NO: 449718 - DNA, 25 bp, Rattus norvegicus
tttcatgaccgctcggacgtgcagc

SEQ ID NO: 449719 - DNA, 25 bp, Rattus norvegicus
gagtgccggcttctgccctacgcac

SEQ ID NO: 449720 - DNA, 25 bp, Rattus norvegicus
tgaccgctcggacgtgcagcaccag

SEQ ID NO: 449721 - DNA, 25 bp, Rattus norvegicus
gtcttttcatgaccgctcggacgtg

SEQ ID NO: 449722 - DNA, 25 bp, Rattus norvegicus
ccgggtcttttcatgaccgctcgga

SEQ ID NO: 449723 - DNA, 25 bp, Rattus norvegicus
gggccgggtcttttcatgaccgctc

SEQ ID NO: 449724 - DNA, 25 bp, Rattus norvegicus
cctgcgcagcgggagttgaagcgga

SEQ ID NO: 449725 - DNA, 25 bp, Rattus norvegicus
ctgcgctcgagctgtcggcgctgct

SEQ ID NO: 449726 - DNA, 25 bp, Rattus norvegicus
tccacctaccttcccgagtaagtgc

SEQ ID NO: 449727 - DNA, 25 bp, Rattus norvegicus
cataagtggagctccttctcctcca

SEQ ID NO: 449728 - DNA, 25 bp, Rattus norvegicus
gcggccgctacggtgctgacaagat

SEQ ID NO: 449729 - DNA, 25 bp, Rattus norvegicus
cactgcataagtggagctccttctc

SEQ ID NO: 449730 - DNA, 25 bp, Rattus norvegicus
cctacgcactgcataagtggagctc

SEQ ID NO: 449731 - DNA, 25 bp, Rattus norvegicus
cctgtgagaggaacgcgcggcctcc

SEQ ID NO: 449732 - DNA, 25 bp, Rattus norvegicus
agccgggaactctggagtcactatc

SEQ ID NO: 449733 - DNA, 25 bp, Rattus norvegicus
gaataaccaagggtcggggcagagc

SEQ ID NO: 449734 - DNA, 25 bp, Rattus norvegicus
gcgaggctatccactcaccattatc

SEQ ID NO: 449735 - DNA, 25 bp, Rattus norvegicus
tcaccattatcctgggagagagatg

SEQ ID NO: 449736 - DNA, 25 bp, Rattus norvegicus
gagagagatggagtcgacagtaaca

SEQ ID NO: 449737 - DNA, 25 bp, Rattus norvegicus
cgcgcacgctgctgcgatgactccc

SEQ ID NO: 449738 - DNA, 25 bp, Rattus norvegicus
aggcctggcgacagccgggaactct

SEQ ID NO: 449739 - DNA, 25 bp, Rattus norvegicus
tggagtcactatccggctgctcctc

SEQ ID NO: 449740 - DNA, 25 bp, Rattus norvegicus
atggtgccaaggtcaggactctgcc

SEQ ID NO: 449741 - DNA, 25 bp, Rattus norvegicus
caaggtcaggactctgcctgcggcc

SEQ ID NO: 449742 - DNA, 25 bp, Rattus norvegicus
tggagtcgacagtaacagcagctgc

SEQ ID NO: 449743 - DNA, 25 bp, Rattus norvegicus
cgcacctacggcgttctccaatttg

SEQ ID NO: 449744 - DNA, 25 bp, Rattus norvegicus
gcagagccgcgaggctatccactca

SEQ ID NO: 449745 - DNA, 25 bp, Rattus norvegicus
ctacggcgttctccaatttggaggg

SEQ ID NO: 449746 - DNA, 25 bp, Rattus norvegicus
tccgtgcctaggtgcctggagctct

SEQ ID NO: 449747 - DNA, 25 bp, Rattus norvegicus
ctcgcgcctttgaagtgcacagtta

SEQ ID NO: 449748 - DNA, 25 bp, Rattus norvegicus
gcacagttaaatccacagcgcagtt

SEQ ID NO: 449749 - DNA, 25 bp, Rattus norvegicus
cgtgtgcacgcgagtgcttttggaa

SEQ ID NO: 449750 - DNA, 25 bp, Rattus norvegicus
gcagtttttgttggaagcgcccgga

SEQ ID NO: 449751 - DNA, 25 bp, Rattus norvegicus
ccggaggacatttggtgcgcctagt

SEQ ID NO: 449752 - DNA, 25 bp, Rattus norvegicus
tgcgcctagtgactgctggaaactg

SEQ ID NO: 449753 - DNA, 25 bp, Rattus norvegicus
gccggtcagggagacttcttcaagt

SEQ ID NO: 449754 - DNA, 25 bp, Rattus norvegicus
tcttttgcataaaaggggcagcggg

SEQ ID NO: 449755 - DNA, 25 bp, Rattus norvegicus
cctcgggatcgttgttttccgcgca

SEQ ID NO: 449756 - DNA, 25 bp, Rattus norvegicus
aggtctccgcaaggagtgcgccagc

SEQ ID NO: 449757 - DNA, 25 bp, Rattus norvegicus
cgccagcggatcaatggtgagtgcc

SEQ ID NO: 449758 - DNA, 25 bp, Rattus norvegicus
ttgaagttggcaggccggctatttc

SEQ ID NO: 449759 - DNA, 25 bp, Rattus norvegicus
gaggcccactcggatcttttgcata

SEQ ID NO: 449760 - DNA, 25 bp, Rattus norvegicus
cggcttctggagctcggcacaagcc

SEQ ID NO: 449761 - DNA, 25 bp, Rattus norvegicus
accccaacctgattggccgggagca

SEQ ID NO: 449762 - DNA, 25 bp, Rattus norvegicus
aggtgaccccaacctgattggccgg

SEQ ID NO: 449763 - DNA, 25 bp, Rattus norvegicus
gcaggtcacccactggcccttagag

SEQ ID NO: 449764 - DNA, 25 bp, Rattus norvegicus
cgctccgagcgcaggtcacccactg

SEQ ID NO: 449765 - DNA, 25 bp, Rattus norvegicus
agccgggatacagcgctccgagcgc

SEQ ID NO: 449766 - DNA, 25 bp, Rattus norvegicus
cgcagccgggatacagcgctccgag

SEQ ID NO: 449767 - DNA, 25 bp, Rattus norvegicus
aagcctcccggaactgctcgtccga

SEQ ID NO: 449768 - DNA, 25 bp, Rattus norvegicus
tggagctcggcacaagcctcccgga

SEQ ID NO: 449769 - DNA, 25 bp, Rattus norvegicus
cccagttagcgccggcttctggagc

SEQ ID NO: 449770 - DNA, 25 bp, Rattus norvegicus
cgggacttggcagaggaggccggac

SEQ ID NO: 449771 - DNA, 25 bp, Rattus norvegicus
ggagctcggcacaagcctcccggaa

SEQ ID NO: 449772 - DNA, 25 bp, Rattus norvegicus
tcggcacaagcctcccggaactgct

SEQ ID NO: 449773 - DNA, 25 bp, Rattus norvegicus
gcttctggagctcggcacaagcctc

SEQ ID NO: 449774 - DNA, 25 bp, Rattus norvegicus
cggaagcgcgtcatgccacaaatac

SEQ ID NO: 449775 - DNA, 25 bp, Rattus norvegicus
caaatacgaaatggtgaggatgcac

SEQ ID NO: 449776 - DNA, 25 bp, Rattus norvegicus
ggagccggcgtctttcctcttgaat

SEQ ID NO: 449777 - DNA, 25 bp, Rattus norvegicus
ccggcgtctttcctcttgaatcatt

SEQ ID NO: 449778 - DNA, 25 bp, Rattus norvegicus
ctttcctcttgaatcatttggtttt

SEQ ID NO: 449779 - DNA, 25 bp, Rattus norvegicus
ctattgagttttgttccgtcatcga

SEQ ID NO: 449780 - DNA, 25 bp, Rattus norvegicus
tgttccgtcatcgatatggcagatg

SEQ ID NO: 449781 - DNA, 25 bp, Rattus norvegicus
tcatcgatatggcagatggaatggc

SEQ ID NO: 449782 - DNA, 25 bp, Rattus norvegicus
agcccggaggtgcggcctctatgaa

SEQ ID NO: 449783 - DNA, 25 bp, Rattus norvegicus
gcctctatgaagaaggtggtgccca

SEQ ID NO: 449784 - DNA, 25 bp, Rattus norvegicus
aagcggaagcgcgtcatgccacaaa

SEQ ID NO: 449785 - DNA, 25 bp, Rattus norvegicus
aggatgcacggagtggtcctgcctt

SEQ ID NO: 449786 - DNA, 25 bp, Rattus norvegicus
cgcgtcatgccacaaatacgaaatg

SEQ ID NO: 449787 - DNA, 25 bp, Rattus norvegicus
ctatgaagaaggtggtgcccaagcg

SEQ ID NO: 449788 - DNA, 25 bp, Rattus norvegicus
tccaaggtgggcgtaatgtccaaca

SEQ ID NO: 449789 - DNA, 25 bp, Rattus norvegicus
tcgctgctgctgtgcattgaagccc

SEQ ID NO: 449790 - DNA, 25 bp, Rattus norvegicus
cgggcggactgctagcaaagtttgc

SEQ ID NO: 449791 - DNA, 25 bp, Rattus norvegicus
aagccgccagcagctccctggggag

SEQ ID NO: 449792 - DNA, 25 bp, Rattus norvegicus
tgtccttgatgccaagcgggcacgg

SEQ ID NO: 449793 - DNA, 25 bp, Rattus norvegicus
caagcaacgacagcggtggctctca

SEQ ID NO: 449794 - DNA, 25 bp, Rattus norvegicus
gaagcgcggcgtttccctccttcag

SEQ ID NO: 449795 - DNA, 25 bp, Rattus norvegicus
agctcctcttgcagcgtccaaggtg

SEQ ID NO: 449796 - DNA, 25 bp, Rattus norvegicus
cgggcttgacagctcctcttgcagc

SEQ ID NO: 449797 - DNA, 25 bp, Rattus norvegicus
gggaagccacgagcagcagagaaaa

SEQ ID NO: 449798 - DNA, 25 bp, Rattus norvegicus
gccctcctctgaacgtgtgcgtgtg

SEQ ID NO: 449799 - DNA, 25 bp, Rattus norvegicus
acactgcagatggtgcctgtaccgc

SEQ ID NO: 449800 - DNA, 25 bp, Rattus norvegicus
cagcgccgcattgacactgcagatg

SEQ ID NO: 449801 - DNA, 25 bp, Rattus norvegicus
ccgcgggctgaatgtccttgatgcc

SEQ ID NO: 449802 - DNA, 25 bp, Rattus norvegicus
gatgtgtagtactcacaccgtcggg

SEQ ID NO: 449803 - DNA, 25 bp, Rattus norvegicus
tgtagtactcacaccgtcggggtga

SEQ ID NO: 449804 - DNA, 25 bp, Rattus norvegicus
caccgtcggggtgatgtgtagtact

SEQ ID NO: 449805 - DNA, 25 bp, Rattus norvegicus
tcggggtgatgtgtagtactcacac

SEQ ID NO: 449806 - DNA, 25 bp, Rattus norvegicus
cggggtgatgtgtagtactcacacc

SEQ ID NO: 449807 - DNA, 25 bp, Rattus norvegicus
ccgtcggggtgatgtgtagtactca

SEQ ID NO: 449808 - DNA, 25 bp, Rattus norvegicus
gtgtagtactcacaccgtcggggtg

SEQ ID NO: 449809 - DNA, 25 bp, Rattus norvegicus
gtagtactcacaccgtcggggtgat

SEQ ID NO: 449810 - DNA, 25 bp, Rattus norvegicus
cacaccgtcggggtgatgtgtagta

SEQ ID NO: 449811 - DNA, 25 bp, Rattus norvegicus
cgtcggggtgatgtgtagtactcac

SEQ ID NO: 449812 - DNA, 25 bp, Rattus norvegicus
tactcacaccgtcggggtgatgtgt

SEQ ID NO: 449813 - DNA, 25 bp, Rattus norvegicus
atgtgtagtactcacaccgtcgggg

SEQ ID NO: 449814 - DNA, 25 bp, Rattus norvegicus
gtcggggtgatgtgtagtactcaca

SEQ ID NO: 449815 - DNA, 25 bp, Rattus norvegicus
agtactcacaccgtcggggtgatgt

SEQ ID NO: 449816 - DNA, 25 bp, Rattus norvegicus
ggatgcccttcaccaccgtgatgtt

SEQ ID NO: 449817 - DNA, 25 bp, Rattus norvegicus
accgtgatgttctcgttctcgtccg

SEQ ID NO: 449818 - DNA, 25 bp, Rattus norvegicus
gatccgagttcaaggactgccctcc

SEQ ID NO: 449819 - DNA, 25 bp, Rattus norvegicus
gttctcgtccgcctcgaaggtgacc

SEQ ID NO: 449820 - DNA, 25 bp, Rattus norvegicus
ggtgctagcggtcccgcccatggct

SEQ ID NO: 449821 - DNA, 25 bp, Rattus norvegicus
ccgcagagtctgagcgtggacctga

SEQ ID NO: 449822 - DNA, 25 bp, Rattus norvegicus
gacctgagcgtggacctacgagcac

SEQ ID NO: 449823 - DNA, 25 bp, Rattus norvegicus
ggacctacgagcacgtcaggaccca

SEQ ID NO: 449824 - DNA, 25 bp, Rattus norvegicus
gcacacttgcgcgtgaaagcccagg

SEQ ID NO: 449825 - DNA, 25 bp, Rattus norvegicus
ttgcgcgtgaaagcccaggacgctt

SEQ ID NO: 449826 - DNA, 25 bp, Rattus norvegicus
caggacgcttcccttgccgggtagg

SEQ ID NO: 449827 - DNA, 25 bp, Rattus norvegicus
tcctccggtcacgtgcgagaagcaa

SEQ ID NO: 449828 - DNA, 25 bp, Rattus norvegicus
tcacgtgcgagaagcaaggcacctc

SEQ ID NO: 449829 - DNA, 25 bp, Rattus norvegicus
cccttgccgggtaggagcaaggcca

SEQ ID NO: 449830 - DNA, 25 bp, Rattus norvegicus
tggaagcagacagaagtggagcaga

SEQ ID NO: 449831 - DNA, 25 bp, Rattus norvegicus
ccctgcagactttggatgagttcct

SEQ ID NO: 449832 - DNA, 25 bp, Rattus norvegicus
cctgcagactttggatgagttcctg

SEQ ID NO: 449833 - DNA, 25 bp, Rattus norvegicus
ctgcagactttggatgagttcctgg

SEQ ID NO: 449834 - DNA, 25 bp, Rattus norvegicus
tgcagactttggatgagttcctggc

SEQ ID NO: 449835 - DNA, 25 bp, Rattus norvegicus
gcagactttggatgagttcctggcg

SEQ ID NO: 449836 - DNA, 25 bp, Rattus norvegicus
cagactttggatgagttcctggcgg

SEQ ID NO: 449837 - DNA, 25 bp, Rattus norvegicus
actttggatgagttcctggcgggcc

SEQ ID NO: 449838 - DNA, 25 bp, Rattus norvegicus
ttggatgagttcctggcgggccggt

SEQ ID NO: 449839 - DNA, 25 bp, Rattus norvegicus
cctggcgggccggtgaggcgacata

SEQ ID NO: 449840 - DNA, 25 bp, Rattus norvegicus
gccggtgaggcgacatagcagtggt

SEQ ID NO: 449841 - DNA, 25 bp, Rattus norvegicus
gaggcgacatagcagtggtggacgc

SEQ ID NO: 449842 - DNA, 25 bp, Rattus norvegicus
gtggacgcagacaagcctactacga

SEQ ID NO: 449843 - DNA, 25 bp, Rattus norvegicus
ccctgtggaagcagacagaagtgga

SEQ ID NO: 449844 - DNA, 25 bp, Rattus norvegicus
gagttgctgactgcgtgggtatccc

SEQ ID NO: 449845 - DNA, 25 bp, Rattus norvegicus
agatcgctaccctagaaaacccgcg

SEQ ID NO: 449846 - DNA, 25 bp, Rattus norvegicus
ccttccagatcgctaccctagaaaa

SEQ ID NO: 449847 - DNA, 25 bp, Rattus norvegicus
gaaaaagcgcccttccagatcgcta

SEQ ID NO: 449848 - DNA, 25 bp, Rattus norvegicus
gccagcgcgcagaaaaagcgccctt

SEQ ID NO: 449849 - DNA, 25 bp, Rattus norvegicus
actgcagcagcctgcgaacaccagg

SEQ ID NO: 449850 - DNA, 25 bp, Rattus norvegicus
aggaagatcacattactgcagcagc

SEQ ID NO: 449851 - DNA, 25 bp, Rattus norvegicus
cagcaactctaggaagatcacatta

SEQ ID NO: 449852 - DNA, 25 bp, Rattus norvegicus
ccgggccagcaactctaggaagatc

SEQ ID NO: 449853 - DNA, 25 bp, Rattus norvegicus
actcaccgggccagcaactctagga

SEQ ID NO: 449854 - DNA, 25 bp, Rattus norvegicus
cgcggcccgagagggtcactcaccg

SEQ ID NO: 449855 - DNA, 25 bp, Rattus norvegicus
agcagccccggaccagcctggagaa

SEQ ID NO: 449856 - DNA, 25 bp, Rattus norvegicus
aaaacccgcgcgcaacatcaccacg

SEQ ID NO: 449857 - DNA, 25 bp, Rattus norvegicus
actgcgtgggtatcccgtatagccg

SEQ ID NO: 449858 - DNA, 25 bp, Rattus norvegicus
acacctgcgcgagaacgcgcgtgtc

SEQ ID NO: 449859 - DNA, 25 bp, Rattus norvegicus
tgtgtgaacttttggccgcaagctg

SEQ ID NO: 449860 - DNA, 25 bp, Rattus norvegicus
agcggaggaagccagttaagagatc

SEQ ID NO: 449861 - DNA, 25 bp, Rattus norvegicus
ccagttaagagatccgccgcgggga

SEQ ID NO: 449862 - DNA, 25 bp, Rattus norvegicus
gactgcagcccactccggggaagca

SEQ ID NO: 449863 - DNA, 25 bp, Rattus norvegicus
aagcagccgagttcctggggatgca

SEQ ID NO: 449864 - DNA, 25 bp, Rattus norvegicus
atgcagccctgttctggggttgcgc

SEQ ID NO: 449865 - DNA, 25 bp, Rattus norvegicus
gatggagccctgttcccggggacac

SEQ ID NO: 449866 - DNA, 25 bp, Rattus norvegicus
acagccttgctccagggatgcagtc

SEQ ID NO: 449867 - DNA, 25 bp, Rattus norvegicus
cagtccggttctcagggaatcagtc

SEQ ID NO: 449868 - DNA, 25 bp, Rattus norvegicus
aatcagtctggctcccggggatgca

SEQ ID NO: 449869 - DNA, 25 bp, Rattus norvegicus
atgcagctctgctccaagggacgca

SEQ ID NO: 449870 - DNA, 25 bp, Rattus norvegicus
tgcccggggccagatttaaattgtg

SEQ ID NO: 449871 - DNA, 25 bp, Rattus norvegicus
tcctggggacgcagtcccgctctga

SEQ ID NO: 449872 - DNA, 25 bp, Rattus norvegicus
cttggtgccgttgttgagttccaga

SEQ ID NO: 449873 - DNA, 25 bp, Rattus norvegicus
aacgacccgcaagagtgcagcgctg

SEQ ID NO: 449874 - DNA, 25 bp, Rattus norvegicus
acccgcaagagtgcagcgctggctc

SEQ ID NO: 449875 - DNA, 25 bp, Rattus norvegicus
gctccggcgcgcacctttaaatagc

SEQ ID NO: 449876 - DNA, 25 bp, Rattus norvegicus
ctgcagaaaggacgcctgcgattgg

SEQ ID NO: 449877 - DNA, 25 bp, Rattus norvegicus
ctgcgattggcgcacggctaagaga

SEQ ID NO: 449878 - DNA, 25 bp, Rattus norvegicus
tgctgcaagttacgcacaacgaccc

SEQ ID NO: 449879 - DNA, 25 bp, Rattus norvegicus
ttccaggtgcccagacccagggtgg

SEQ ID NO: 449880 - DNA, 25 bp, Rattus norvegicus
ggctagccatgattgctgcaagtta

SEQ ID NO: 449881 - DNA, 25 bp, Rattus norvegicus
ctgatgagcacctaccttccaggtg

SEQ ID NO: 449882 - DNA, 25 bp, Rattus norvegicus
ccagacccagggtgggcatcttggt

SEQ ID NO: 449883 - DNA, 25 bp, Rattus norvegicus
gttacgcacaacgacccgcaagagt

SEQ ID NO: 449884 - DNA, 25 bp, Rattus norvegicus
ggactcgcgcaatgctcgcccagag

SEQ ID NO: 449885 - DNA, 25 bp, Rattus norvegicus
gttgagttccagatggctagccatg

SEQ ID NO: 449886 - DNA, 25 bp, Rattus norvegicus
cgacgctctagggtttgggtctcta

SEQ ID NO: 449887 - DNA, 25 bp, Rattus norvegicus
cgaccggcttttcaaggtaggtgtg

SEQ ID NO: 449888 - DNA, 25 bp, Rattus norvegicus
tcacgggactgcaaacccggccttg

SEQ ID NO: 449889 - DNA, 25 bp, Rattus norvegicus
aacccggccttgagtttctcaattg

SEQ ID NO: 449890 - DNA, 25 bp, Rattus norvegicus
tgtgccgaaactaccaccttattgg

SEQ ID NO: 449891 - DNA, 25 bp, Rattus norvegicus
taaccgtacgcctgtttcttcacta

SEQ ID NO: 449892 - DNA, 25 bp, Rattus norvegicus
aacctccttctggttgccggctgga

SEQ ID NO: 449893 - DNA, 25 bp, Rattus norvegicus
ggccgtgaatgagtgacaatgctgc

SEQ ID NO: 449894 - DNA, 25 bp, Rattus norvegicus
tttccaatacacagcgccatcggtc

SEQ ID NO: 449895 - DNA, 25 bp, Rattus norvegicus
ctggcttctgggctacaaaagatcg

SEQ ID NO: 449896 - DNA, 25 bp, Rattus norvegicus
caaaagatcgtcgatgccggcggta

SEQ ID NO: 449897 - DNA, 25 bp, Rattus norvegicus
cggtagcgatgaatcctccctggca

SEQ ID NO: 449898 - DNA, 25 bp, Rattus norvegicus
ggtgtgtttcaatttcgagaacttc

SEQ ID NO: 449899 - DNA, 25 bp, Rattus norvegicus
ggtctctacggctaaagcccgcctg

SEQ ID NO: 449900 - DNA, 25 bp, Rattus norvegicus
cgttgccacggcaacaagtggcctc

SEQ ID NO: 449901 - DNA, 25 bp, Rattus norvegicus
tcgcgagactacagccgttgccacg

SEQ ID NO: 449902 - DNA, 25 bp, Rattus norvegicus
cccggccgctgaattacgatggtgt

SEQ ID NO: 449903 - DNA, 25 bp, Rattus norvegicus
acgatggtgtttcctctggccctgt

SEQ ID NO: 449904 - DNA, 25 bp, Rattus norvegicus
gatgcctggggtacatcctaaagta

SEQ ID NO: 449905 - DNA, 25 bp, Rattus norvegicus
atcctaaagtactctcccgagaggg

SEQ ID NO: 449906 - DNA, 25 bp, Rattus norvegicus
ctggtccgcgcacgtaaggagctgc

SEQ ID NO: 449907 - DNA, 25 bp, Rattus norvegicus
aggcgggttgttctcatttcgagct

SEQ ID NO: 449908 - DNA, 25 bp, Rattus norvegicus
gcagttgtttatgttgaagcttcgc

SEQ ID NO: 449909 - DNA, 25 bp, Rattus norvegicus
gaagcttcgcgaggccttctgtgca

SEQ ID NO: 449910 - DNA, 25 bp, Rattus norvegicus
gaagcttcggtctgcgcccagcgat

SEQ ID NO: 449911 - DNA, 25 bp, Rattus norvegicus
gcccagcgatgtcacctagaaaccg

SEQ ID NO: 449912 - DNA, 25 bp, Rattus norvegicus
cgctctctcggttgcagttgtttat

SEQ ID NO: 449913 - DNA, 25 bp, Rattus norvegicus
atttcgagctgtcatccggggctga

SEQ ID NO: 449914 - DNA, 25 bp, Rattus norvegicus
gagataggtccttgctcgctgccac

SEQ ID NO: 449915 - DNA, 25 bp, Rattus norvegicus
cgacatggggctaaaattagaaggc

SEQ ID NO: 449916 - DNA, 25 bp, Rattus norvegicus
cggcacagccgcttttaagaccgtg

SEQ ID NO: 449917 - DNA, 25 bp, Rattus norvegicus
agaccgtgggccatctcctttccta

SEQ ID NO: 449918 - DNA, 25 bp, Rattus norvegicus
tcgtttcttcctctctgttgcagct

SEQ ID NO: 449919 - DNA, 25 bp, Rattus norvegicus
tgcagctcgcacattcaaagcttta

SEQ ID NO: 449920 - DNA, 25 bp, Rattus norvegicus
agctttaatgcagtgcaccgccctc

SEQ ID NO: 449921 - DNA, 25 bp, Rattus norvegicus
atgaatggcagcagaaccgtgcgcc

SEQ ID NO: 449922 - DNA, 25 bp, Rattus norvegicus
cgctccgggcactgattggccactg

SEQ ID NO: 449923 - DNA, 25 bp, Rattus norvegicus
cctcgggagcagttcaagcccatga

SEQ ID NO: 449924 - DNA, 25 bp, Rattus norvegicus
ccggtgcagaagagacggagctccc

SEQ ID NO: 449925 - DNA, 25 bp, Rattus norvegicus
tcgattccagcggtgagagctctgc

SEQ ID NO: 449926 - DNA, 25 bp, Rattus norvegicus
ctccgaattttaagggaaatgaatg

SEQ ID NO: 449927 - DNA, 25 bp, Rattus norvegicus
ggatcccgagccctgacaaggaccg

SEQ ID NO: 449928 - DNA, 25 bp, Rattus norvegicus
tagaaccgcgaagcgcgcacgcatc

SEQ ID NO: 449929 - DNA, 25 bp, Rattus norvegicus
ccgggatttagaaccgcgaagcgcg

SEQ ID NO: 449930 - DNA, 25 bp, Rattus norvegicus
ccctgcagaccaccggccacatccg

SEQ ID NO: 449931 - DNA, 25 bp, Rattus norvegicus
agggcctcgggtgccccctgcagac

SEQ ID NO: 449932 - DNA, 25 bp, Rattus norvegicus
ggctggcaccgagggcctcgggtgc

SEQ ID NO: 449933 - DNA, 25 bp, Rattus norvegicus
cccgacccggccgctggctggcacc

SEQ ID NO: 449934 - DNA, 25 bp, Rattus norvegicus
gcgcgcacgcatcccaccgcccgcc

SEQ ID NO: 449935 - DNA, 25 bp, Rattus norvegicus
ccgcgaagcgcgcacgcatcccacc

SEQ ID NO: 449936 - DNA, 25 bp, Rattus norvegicus
ttagaaccgcgaagcgcgcacgcat

SEQ ID NO: 449937 - DNA, 25 bp, Rattus norvegicus
tttagaaccgcgaagcgcgcacgca

SEQ ID NO: 449938 - DNA, 25 bp, Rattus norvegicus
atttagaaccgcgaagcgcgcacgc

SEQ ID NO: 449939 - DNA, 25 bp, Rattus norvegicus
tccgggatttagaaccgcgaagcgc

SEQ ID NO: 449940 - DNA, 25 bp, Rattus norvegicus
cgcgaagcgcgcacgcatcccaccg

SEQ ID NO: 449941 - DNA, 25 bp, Rattus norvegicus
cgggatttagaaccgcgaagcgcgc

SEQ ID NO: 449942 - DNA, 25 bp, Rattus norvegicus
tgccgcagtgtgtgcgtgaagccac

SEQ ID NO: 449943 - DNA, 25 bp, Rattus norvegicus
ccagctgccgcagtgtgtgcgtgaa

SEQ ID NO: 449944 - DNA, 25 bp, Rattus norvegicus
acgcccagcctaccaatcgtgcgcc

SEQ ID NO: 449945 - DNA, 25 bp, Rattus norvegicus
tgtgtgcgtgaagccacggaagagc

SEQ ID NO: 449946 - DNA, 25 bp, Rattus norvegicus
agagcaggtactcccggaccagctc

SEQ ID NO: 449947 - DNA, 25 bp, Rattus norvegicus
gtactcccggaccagctcgtctgtg

SEQ ID NO: 449948 - DNA, 25 bp, Rattus norvegicus
accagctcgtctgtgcgctccaccg

SEQ ID NO: 449949 - DNA, 25 bp, Rattus norvegicus
cgcgcgccgcaaaagaccagagcgg

SEQ ID NO: 449950 - DNA, 25 bp, Rattus norvegicus
tgtccgccttgatctcggcatccag

SEQ ID NO: 449951 - DNA, 25 bp, Rattus norvegicus
caaaagaccagagcggctcagggca

SEQ ID NO: 449952 - DNA, 25 bp, Rattus norvegicus
aggagcctagctcgggcgcctcgta

SEQ ID NO: 449953 - DNA, 25 bp, Rattus norvegicus
tagctcgggcgcctcgtacgtcacg

SEQ ID NO: 449954 - DNA, 25 bp, Rattus norvegicus
caccgcctccgccatcgctgcgcgc

SEQ ID NO: 449955 - DNA, 25 bp, Rattus norvegicus
ctctttgtccgccttgatctcggca

SEQ ID NO: 449956 - DNA, 25 bp, Rattus norvegicus
cctgcgtgttccacaagagtcgaag

SEQ ID NO: 449957 - DNA, 25 bp, Rattus norvegicus
cctgcgactccttgagcatgtgtga

SEQ ID NO: 449958 - DNA, 25 bp, Rattus norvegicus
cttgtgtaagggtcacctgcgactc

SEQ ID NO: 449959 - DNA, 25 bp, Rattus norvegicus
ggtcacccgtgactcttagagcttg

SEQ ID NO: 449960 - DNA, 25 bp, Rattus norvegicus
cgcgattcctagagcgtgcgtgtga

SEQ ID NO: 449961 - DNA, 25 bp, Rattus norvegicus
gggtcacccgcaattcctagagcga

SEQ ID NO: 449962 - DNA, 25 bp, Rattus norvegicus
gtgtcaccgtgactcctagagcatg

SEQ ID NO: 449963 - DNA, 25 bp, Rattus norvegicus
cgcgactccttaagcgtgcgtgtca

SEQ ID NO: 449964 - DNA, 25 bp, Rattus norvegicus
gggtaagtactcttgtgttctcaga

SEQ ID NO: 449965 - DNA, 25 bp, Rattus norvegicus
agagcttcgagcaacttcctgcgtg

SEQ ID NO: 449966 - DNA, 25 bp, Rattus norvegicus
catgtgtgagaattacccgcgactc

SEQ ID NO: 449967 - DNA, 25 bp, Rattus norvegicus
gctcgtgaatgcatgaactaattta

SEQ ID NO: 449968 - DNA, 25 bp, Rattus norvegicus
ccgtgtcagtgactaatttgttcgc

SEQ ID NO: 449969 - DNA, 25 bp, Rattus norvegicus
atggttcaccgtagtggccttaagg

SEQ ID NO: 449970 - DNA, 25 bp, Rattus norvegicus
gccgagtcctcacaggagaccaatg

SEQ ID NO: 449971 - DNA, 25 bp, Rattus norvegicus
tgagcattgcaagagcgcgggattt

SEQ ID NO: 449972 - DNA, 25 bp, Rattus norvegicus
cccgccttctgtagataggtatctg

SEQ ID NO: 449973 - DNA, 25 bp, Rattus norvegicus
ttcggagaaagcgaggacctgtctt

SEQ ID NO: 449974 - DNA, 25 bp, Rattus norvegicus
agcgccggctttcttcttgttttgc

SEQ ID NO: 449975 - DNA, 25 bp, Rattus norvegicus
gctcgttcctcacgtggctactgga

SEQ ID NO: 449976 - DNA, 25 bp, Rattus norvegicus
gcaggccgggaattgaagtcatcac

SEQ ID NO: 449977 - DNA, 25 bp, Rattus norvegicus
ttgtagtcctccgatagtaaccgcc

SEQ ID NO: 449978 - DNA, 25 bp, Rattus norvegicus
tacattagggtaagactcctccggc

SEQ ID NO: 449979 - DNA, 25 bp, Rattus norvegicus
gactctcagctttcggtgggttcca

SEQ ID NO: 449980 - DNA, 25 bp, Rattus norvegicus
cctttacggctgagagagagactct

SEQ ID NO: 449981 - DNA, 25 bp, Rattus norvegicus
gaaccgggcctgactgcttcagtga

SEQ ID NO: 449982 - DNA, 25 bp, Rattus norvegicus
ttctcttagccgactccacgcgttg

SEQ ID NO: 449983 - DNA, 25 bp, Rattus norvegicus
tgcttcagtgagtccgacctttacg

SEQ ID NO: 449984 - DNA, 25 bp, Rattus norvegicus
tgctttcgccgctttccggcttgca

SEQ ID NO: 449985 - DNA, 25 bp, Rattus norvegicus
cgcctttgtgttcaggcgtcgacac

SEQ ID NO: 449986 - DNA, 25 bp, Rattus norvegicus
agtttgtgcgcagggcctgctttcg

SEQ ID NO: 449987 - DNA, 25 bp, Rattus norvegicus
tcttgcccaagccacgaggacctta

SEQ ID NO: 449988 - DNA, 25 bp, Rattus norvegicus
cgcggctacagctttgccctggaga

SEQ ID NO: 449989 - DNA, 25 bp, Rattus norvegicus
tttgccctggagacgagtgtttgaa

SEQ ID NO: 449990 - DNA, 25 bp, Rattus norvegicus
gaagccgctccgtcccagaggtatc

SEQ ID NO: 449991 - DNA, 25 bp, Rattus norvegicus
cagaggtatccttcaggtgtaggca

SEQ ID NO: 449992 - DNA, 25 bp, Rattus norvegicus
gtaggcaggctaactttcaccaagg

SEQ ID NO: 449993 - DNA, 25 bp, Rattus norvegicus
ttcaccaaggtacggctcaagtccc

SEQ ID NO: 449994 - DNA, 25 bp, Rattus norvegicus
aagtcccgggctgagaggtccagcc

SEQ ID NO: 449995 - DNA, 25 bp, Rattus norvegicus
cttacagaaggtgcccggcgagacc

SEQ ID NO: 449996 - DNA, 25 bp, Rattus norvegicus
attgtcacagccacaccggatcgtg

SEQ ID NO: 449997 - DNA, 25 bp, Rattus norvegicus
gggcaggagagctccctcagtcctc

SEQ ID NO: 449998 - DNA, 25 bp, Rattus norvegicus
tctgcgagtcgcttccgggaatgga

SEQ ID NO: 449999 - DNA, 25 bp, Rattus norvegicus
cggctctggagtcctggctcgagcc

SEQ ID NO: 450000 - DNA, 25 bp, Rattus norvegicus
gtgcacggctctggagtcctggctc

SEQ ID NO: 450001 - DNA, 25 bp, Rattus norvegicus
tcccaggtcggcggtgcacggctct

SEQ ID NO: 450002 - DNA, 25 bp, Rattus norvegicus
catgcttcagttcctggtgagtggg

SEQ ID NO: 450003 - DNA, 25 bp, Rattus norvegicus
atcatgcttcagttcctggtgagtg

SEQ ID NO: 450004 - DNA, 25 bp, Rattus norvegicus
cgacatcatgcttcagttcctggtg

SEQ ID NO: 450005 - DNA, 25 bp, Rattus norvegicus
accgacatcatgcttcagttcctgg

SEQ ID NO: 450006 - DNA, 25 bp, Rattus norvegicus
gagctgaagcatctttcacaccctc

SEQ ID NO: 450007 - DNA, 25 bp, Rattus norvegicus
tctcggagcagtgctggagctgaag

SEQ ID NO: 450008 - DNA, 25 bp, Rattus norvegicus
gcgctgcggctctgcgagtcgcttc

SEQ ID NO: 450009 - DNA, 25 bp, Rattus norvegicus
agtcctggctcgagccggtcgttgc

SEQ ID NO: 450010 - DNA, 25 bp, Rattus norvegicus
ggctctgcgagtcgcttccgggaat

SEQ ID NO: 450011 - DNA, 25 bp, Rattus norvegicus
gctggagctgaagcatctttcacac

SEQ ID NO: 450012 - DNA, 25 bp, Rattus norvegicus
gcttacctcaggagggccacttgtg

SEQ ID NO: 450013 - DNA, 25 bp, Rattus norvegicus
ctaccaaggcgccagttaaccgagg

SEQ ID NO: 450014 - DNA, 25 bp, Rattus norvegicus
gcaggttccgcctagctgaagagaa

SEQ ID NO: 450015 - DNA, 25 bp, Rattus norvegicus
agtacttttgcagcggttgggccca

SEQ ID NO: 450016 - DNA, 25 bp, Rattus norvegicus
aggaaacgacgtgcctcaggcagcc

SEQ ID NO: 450017 - DNA, 25 bp, Rattus norvegicus
ttacgcccgacgaaggacacgagga

SEQ ID NO: 450018 - DNA, 25 bp, Rattus norvegicus
tgtcgcacatcactgcagcgggatg

SEQ ID NO: 450019 - DNA, 25 bp, Rattus norvegicus
gagagaggccacagccgccttagca

SEQ ID NO: 450020 - DNA, 25 bp, Rattus norvegicus
gggcccacatgaactccttgtcgca

SEQ ID NO: 450021 - DNA, 25 bp, Rattus norvegicus
gcaggacgcttgcacttccggttca

SEQ ID NO: 450022 - DNA, 25 bp, Rattus norvegicus
gtctccgtttttcagggcccacatg

SEQ ID NO: 450023 - DNA, 25 bp, Rattus norvegicus
gcaccgaagggccacacagatccag

SEQ ID NO: 450024 - DNA, 25 bp, Rattus norvegicus
gccttagcaacacagcggttacccg

SEQ ID NO: 450025 - DNA, 25 bp, Rattus norvegicus
gccggcctgtaacgatcgagagaga

SEQ ID NO: 450026 - DNA, 25 bp, Rattus norvegicus
acaccatggcgcaacgctccggaaa

SEQ ID NO: 450027 - DNA, 25 bp, Rattus norvegicus
tgagtgctccgcaacctcggggacc

SEQ ID NO: 450028 - DNA, 25 bp, Rattus norvegicus
gccgggccaagcaaatctattgtcc

SEQ ID NO: 450029 - DNA, 25 bp, Rattus norvegicus
ggaaaggtgagtgctccgcaacctc

SEQ ID NO: 450030 - DNA, 25 bp, Rattus norvegicus
gcccgacagcactaacgcgcgggtg

SEQ ID NO: 450031 - DNA, 25 bp, Rattus norvegicus
gggtgccgggccaagcaaatctatt

SEQ ID NO: 450032 - DNA, 25 bp, Rattus norvegicus
aatctattgtccctggcggcgctga

SEQ ID NO: 450033 - DNA, 25 bp, Rattus norvegicus
aacgctccggaaaggtgagtgctcc

SEQ ID NO: 450034 - DNA, 25 bp, Rattus norvegicus
cagcaggcgccacagagtatatata

SEQ ID NO: 450035 - DNA, 25 bp, Rattus norvegicus
aggcgccacagagtatatatatata

SEQ ID NO: 450036 - DNA, 25 bp, Rattus norvegicus
tatataccggttcccaaggcggtca

SEQ ID NO: 450037 - DNA, 25 bp, Rattus norvegicus
gttcccaaggcggtcagcgacacac

SEQ ID NO: 450038 - DNA, 25 bp, Rattus norvegicus
aaggcggtcagcgacacaccatggc

SEQ ID NO: 450039 - DNA, 25 bp, Rattus norvegicus
gcgctgagccagcaggcgccacaga

SEQ ID NO: 450040 - DNA, 25 bp, Rattus norvegicus
ttctctgagccttggggtccgcagt

SEQ ID NO: 450041 - DNA, 25 bp, Rattus norvegicus
tataccacccggttctctgattgtc

SEQ ID NO: 450042 - DNA, 25 bp, Rattus norvegicus
gtaaaggcgctgctataccacccgg

SEQ ID NO: 450043 - DNA, 25 bp, Rattus norvegicus
tcaacgacaggtaaaggcgctgcta

SEQ ID NO: 450044 - DNA, 25 bp, Rattus norvegicus
cgggcgactaagtcaacgacaggta

SEQ ID NO: 450045 - DNA, 25 bp, Rattus norvegicus
cggtccaacctgagcccgccaaagg

SEQ ID NO: 450046 - DNA, 25 bp, Rattus norvegicus
ggactctaagcagtaccgctcgctc

SEQ ID NO: 450047 - DNA, 25 bp, Rattus norvegicus
gcgggcagtcagctgaggactctaa

SEQ ID NO: 450048 - DNA, 25 bp, Rattus norvegicus
ctcgcaagatccagggagaaggcaa

SEQ ID NO: 450049 - DNA, 25 bp, Rattus norvegicus
tcgcttttctctcgcaagatccagg

SEQ ID NO: 450050 - DNA, 25 bp, Rattus norvegicus
ggcgacaactaatctttcgcttttc

SEQ ID NO: 450051 - DNA, 25 bp, Rattus norvegicus
tgcggcggcgacaactaatctttcg

SEQ ID NO: 450052 - DNA, 25 bp, Rattus norvegicus
tctgattgtccgtaccaagggcccg

SEQ ID NO: 450053 - DNA, 25 bp, Rattus norvegicus
acccgtctaagtgcggcggcgacaa

SEQ ID NO: 450054 - DNA, 25 bp, Rattus norvegicus
cccaagcgacgtcacatttttaagc

SEQ ID NO: 450055 - DNA, 25 bp, Rattus norvegicus
tgcgccaaatgagcactaccgacta

SEQ ID NO: 450056 - DNA, 25 bp, Rattus norvegicus
tgagcactaccgactacacgcacaa

SEQ ID NO: 450057 - DNA, 25 bp, Rattus norvegicus
cagagctaccgaaataatgggatta

SEQ ID NO: 450058 - DNA, 25 bp, Rattus norvegicus
gggctatgccggataagacaaaatg

SEQ ID NO: 450059 - DNA, 25 bp, Rattus norvegicus
taagacaaaatgactgccctccgag

SEQ ID NO: 450060 - DNA, 25 bp, Rattus norvegicus
tgccctccgagttcacgctaacagg

SEQ ID NO: 450061 - DNA, 25 bp, Rattus norvegicus
tcacgctaacaggagacggtacgtt

SEQ ID NO: 450062 - DNA, 25 bp, Rattus norvegicus
ctagcggtgcgccaaatgagcacta

SEQ ID NO: 450063 - DNA, 25 bp, Rattus norvegicus
cgttgactacaatctccatgctatc

SEQ ID NO: 450064 - DNA, 25 bp, Rattus norvegicus
acacgcacaacggagcagagctacc

SEQ ID NO: 450065 - DNA, 25 bp, Rattus norvegicus
gacgtcacatttttaagcttcgaaa

SEQ ID NO: 450066 - DNA, 25 bp, Rattus norvegicus
aggagacggtacgttgactacaatc

SEQ ID NO: 450067 - DNA, 25 bp, Rattus norvegicus
tgggattaatgtgctgggctatgcc

SEQ ID NO: 450068 - DNA, 25 bp, Rattus norvegicus
tgtacccggaaggatttcatgcacg

SEQ ID NO: 450069 - DNA, 25 bp, Rattus norvegicus
cccaagagtccactgaggcgtcgct

SEQ ID NO: 450070 - DNA, 25 bp, Rattus norvegicus
ggcgtcgctgctcgtctctttagag

SEQ ID NO: 450071 - DNA, 25 bp, Rattus norvegicus
tctttagagttctcaggcctagctc

SEQ ID NO: 450072 - DNA, 25 bp, Rattus norvegicus
ggtggcgttcgcacctcacaagctg

SEQ ID NO: 450073 - DNA, 25 bp, Rattus norvegicus
ccggtccggttgtaactctcattga

SEQ ID NO: 450074 - DNA, 25 bp, Rattus norvegicus
aaagcgtagctaaactccggagtcg

SEQ ID NO: 450075 - DNA, 25 bp, Rattus norvegicus
aagccggaaattagcgcccagactc

SEQ ID NO: 450076 - DNA, 25 bp, Rattus norvegicus
taccctgggcagaattcgagaattg

SEQ ID NO: 450077 - DNA, 25 bp, Rattus norvegicus
ttcatgcacgcacagctggacaagc

SEQ ID NO: 450078 - DNA, 25 bp, Rattus norvegicus
agccttactgcggaggtcgcggaaa

SEQ ID NO: 450079 - DNA, 25 bp, Rattus norvegicus
gccggtctctatagcaacactcaga

SEQ ID NO: 450080 - DNA, 25 bp, Rattus norvegicus
tccggagtcgaagccgcataaagta

SEQ ID NO: 450081 - DNA, 25 bp, Rattus norvegicus
tgcgcagtgtcatagccattcgttg

SEQ ID NO: 450082 - DNA, 25 bp, Rattus norvegicus
cccaaccaatcagaggccacctctc

SEQ ID NO: 450083 - DNA, 25 bp, Rattus norvegicus
agctgggactgaacttgaactctgc

SEQ ID NO: 450084 - DNA, 25 bp, Rattus norvegicus
tcctctcccgccgaggagctggggt

SEQ ID NO: 450085 - DNA, 25 bp, Rattus norvegicus
ctcccgccgaggagctggggttcat

SEQ ID NO: 450086 - DNA, 25 bp, Rattus norvegicus
tggcaggggcagcaaatggcagccc

SEQ ID NO: 450087 - DNA, 25 bp, Rattus norvegicus
ctcctttttctaaatccagagcaaa

SEQ ID NO: 450088 - DNA, 25 bp, Rattus norvegicus
cggctgcaccgcaccggggcattgt

SEQ ID NO: 450089 - DNA, 25 bp, Rattus norvegicus
cggcctcgcccgaccagccggctcc

SEQ ID NO: 450090 - DNA, 25 bp, Rattus norvegicus
gccggctccctccaattctcccacc

SEQ ID NO: 450091 - DNA, 25 bp, Rattus norvegicus
cctgcaggcaatggaccgcagtgga

SEQ ID NO: 450092 - DNA, 25 bp, Rattus norvegicus
ttgaactctgcctgcaggcaatgga

SEQ ID NO: 450093 - DNA, 25 bp, Rattus norvegicus
tgaacttgaactctgcctgcaggca

SEQ ID NO: 450094 - DNA, 25 bp, Rattus norvegicus
ggactgaacttgaactctgcctgca

SEQ ID NO: 450095 - DNA, 25 bp, Rattus norvegicus
ttcccgcagcatccatccgcggctg

SEQ ID NO: 450096 - DNA, 25 bp, Rattus norvegicus
gagacgcctctctccgcgggtactt

SEQ ID NO: 450097 - DNA, 25 bp, Rattus norvegicus
tcagcttgcggtcccactgcaggac

SEQ ID NO: 450098 - DNA, 25 bp, Rattus norvegicus
cacgacccgtgtcctcggagatctg

SEQ ID NO: 450099 - DNA, 25 bp, Rattus norvegicus
atcgggctgtgcatccaaaaggaag

SEQ ID NO: 450100 - DNA, 25 bp, Rattus norvegicus
agaaggcagctttcatcccaagaaa

SEQ ID NO: 450101 - DNA, 25 bp, Rattus norvegicus
ccactagtgttccagacaaactttg

SEQ ID NO: 450102 - DNA, 25 bp, Rattus norvegicus
ctccgggttctgacagctcgctcag

SEQ ID NO: 450103 - DNA, 25 bp, Rattus norvegicus
tccttccaggccagtgaccaatcgg

SEQ ID NO: 450104 - DNA, 25 bp, Rattus norvegicus
cgcgcgtcttgccatctataccgta

SEQ ID NO: 450105 - DNA, 25 bp, Rattus norvegicus
ggaagtctccgcctagacctcggaa

SEQ ID NO: 450106 - DNA, 25 bp, Rattus norvegicus
cggagaggctcttttacgtcatcga

SEQ ID NO: 450107 - DNA, 25 bp, Rattus norvegicus
ttacgtcatcgaggaacgcctcctg

SEQ ID NO: 450108 - DNA, 25 bp, Rattus norvegicus
actcccttgggcttttgagctctgc

SEQ ID NO: 450109 - DNA, 25 bp, Rattus norvegicus
tcaccgtgtggtacatgagagcctc

SEQ ID NO: 450110 - DNA, 25 bp, Rattus norvegicus
ggggacattcatgaataagtgagtc

SEQ ID NO: 450111 - DNA, 25 bp, Rattus norvegicus
tatccctcaggcgatccacgggccg

SEQ ID NO: 450112 - DNA, 25 bp, Rattus norvegicus
ttatatccctcaggcgatccacggg

SEQ ID NO: 450113 - DNA, 25 bp, Rattus norvegicus
tttatatccctcaggcgatccacgg

SEQ ID NO: 450114 - DNA, 25 bp, Rattus norvegicus
ttttatatccctcaggcgatccacg

SEQ ID NO: 450115 - DNA, 25 bp, Rattus norvegicus
ttttttatatccctcaggcgatcca

SEQ ID NO: 450116 - DNA, 25 bp, Rattus norvegicus
tgagtccgtattcggtgtggcggtc

SEQ ID NO: 450117 - DNA, 25 bp, Rattus norvegicus
taagtgagtccgtattcggtgtggc

SEQ ID NO: 450118 - DNA, 25 bp, Rattus norvegicus
tgaataagtgagtccgtattcggtg

SEQ ID NO: 450119 - DNA, 25 bp, Rattus norvegicus
acattcatgaataagtgagtccgta

SEQ ID NO: 450120 - DNA, 25 bp, Rattus norvegicus
tcgggaattgaaggggggacattca

SEQ ID NO: 450121 - DNA, 25 bp, Rattus norvegicus
cctcaggcgatccacgggccggcac

SEQ ID NO: 450122 - DNA, 25 bp, Rattus norvegicus
ttcatgaataagtgagtccgtattc

SEQ ID NO: 450123 - DNA, 25 bp, Rattus norvegicus
gggagactgtggtcgggtgccctgg

SEQ ID NO: 450124 - DNA, 25 bp, Rattus norvegicus
agctttgtccgggtgcatatgatcc

SEQ ID NO: 450125 - DNA, 25 bp, Rattus norvegicus
cgctgccttcgcgaagctttgtccg

SEQ ID NO: 450126 - DNA, 25 bp, Rattus norvegicus
cccgatgtctactctggctgcttta

SEQ ID NO: 450127 - DNA, 25 bp, Rattus norvegicus
ggctgctttacagacgattccttta

SEQ ID NO: 450128 - DNA, 25 bp, Rattus norvegicus
cccacacagagacagccaatcaatg

SEQ ID NO: 450129 - DNA, 25 bp, Rattus norvegicus
tcaacctgttggacacttgcgccgt

SEQ ID NO: 450130 - DNA, 25 bp, Rattus norvegicus
cttgcgccgtgtgccaccagaacat

SEQ ID NO: 450131 - DNA, 25 bp, Rattus norvegicus
cagaacatccagagccgggtgccca

SEQ ID NO: 450132 - DNA, 25 bp, Rattus norvegicus
ccagcgctatctcatgctgacggcg

SEQ ID NO: 450133 - DNA, 25 bp, Rattus norvegicus
ttcgccattcgccacccaaggtgag

SEQ ID NO: 450134 - DNA, 25 bp, Rattus norvegicus
accagtgccggtcgagcgactcagc

SEQ ID NO: 450135 - DNA, 25 bp, Rattus norvegicus
tcagcggtccctcactttttgcaga

SEQ ID NO: 450136 - DNA, 25 bp, Rattus norvegicus
tttgcagagctctgacggttgtggc

SEQ ID NO: 450137 - DNA, 25 bp, Rattus norvegicus
tcagctcgtgtacacccgggttatg

SEQ ID NO: 450138 - DNA, 25 bp, Rattus norvegicus
ctgctgagcggacaaagccgaaaga

SEQ ID NO: 450139 - DNA, 25 bp, Rattus norvegicus
caaagccgaaagaagtgggctccct

SEQ ID NO: 450140 - DNA, 25 bp, Rattus norvegicus
agcgcagcagagaacgccgccaggg

SEQ ID NO: 450141 - DNA, 25 bp, Rattus norvegicus
ggggtctcgacgatgcttacctgag

SEQ ID NO: 450142 - DNA, 25 bp, Rattus norvegicus
ctcgacgatgcttacctgaggcgca

SEQ ID NO: 450143 - DNA, 25 bp, Rattus norvegicus
atgcttacctgaggcgcacgaggcc

SEQ ID NO: 450144 - DNA, 25 bp, Rattus norvegicus
ctgcggcagagactgggcgccttac

SEQ ID NO: 450145 - DNA, 25 bp, Rattus norvegicus
gagactgggcgccttacaccggcgc

SEQ ID NO: 450146 - DNA, 25 bp, Rattus norvegicus
ccctcccgagtctcgcagccgctgc

SEQ ID NO: 450147 - DNA, 25 bp, Rattus norvegicus
ccgcaaacccggtgatcctgaagca

SEQ ID NO: 450148 - DNA, 25 bp, Rattus norvegicus
aacccggtgatcctgaagcacgctc

SEQ ID NO: 450149 - DNA, 25 bp, Rattus norvegicus
ctgaagcacgctcctcccgagccgc

SEQ ID NO: 450150 - DNA, 25 bp, Rattus norvegicus
agcggccaaggtccctggcagagcc

SEQ ID NO: 450151 - DNA, 25 bp, Rattus norvegicus
cccggctgctgagcggacaaagccg

SEQ ID NO: 450152 - DNA, 25 bp, Rattus norvegicus
cgcgcctcagcacggcccgcagctt

SEQ ID NO: 450153 - DNA, 25 bp, Rattus norvegicus
ggccagcgcgaaggcctttgtccca

SEQ ID NO: 450154 - DNA, 25 bp, Rattus norvegicus
aggcctttgtcccatcccacccagg

SEQ ID NO: 450155 - DNA, 25 bp, Rattus norvegicus
ccaggctcgccgagagcatccggag

SEQ ID NO: 450156 - DNA, 25 bp, Rattus norvegicus
ctcgccgagagcatccggaggacac

SEQ ID NO: 450157 - DNA, 25 bp, Rattus norvegicus
cgccgagagcatccggaggacacgt

SEQ ID NO: 450158 - DNA, 25 bp, Rattus norvegicus
agagcatccggaggacacgtcccgc

SEQ ID NO: 450159 - DNA, 25 bp, Rattus norvegicus
ctgccccgctggactttgaggactc

SEQ ID NO: 450160 - DNA, 25 bp, Rattus norvegicus
aggtcctgcagaaacatgcggccgc

SEQ ID NO: 450161 - DNA, 25 bp, Rattus norvegicus
tcctgcagaaacatgcggccgccgt

SEQ ID NO: 450162 - DNA, 25 bp, Rattus norvegicus
ctgcagaaacatgcggccgccgtga

SEQ ID NO: 450163 - DNA, 25 bp, Rattus norvegicus
atgcggccgccgtgagcacacagca

SEQ ID NO: 450164 - DNA, 25 bp, Rattus norvegicus
ggccgccgtgagcacacagcacctt

SEQ ID NO: 450165 - DNA, 25 bp, Rattus norvegicus
tccggaggacacgtcccgcccgcac

SEQ ID NO: 450166 - DNA, 25 bp, Rattus norvegicus
ctcaccgctgagactgtgcatagtg

SEQ ID NO: 450167 - DNA, 25 bp, Rattus norvegicus
tcggccaggcaggtagagaaccttc

SEQ ID NO: 450168 - DNA, 25 bp, Rattus norvegicus
gcaccggccgagcagattaagcttg

SEQ ID NO: 450169 - DNA, 25 bp, Rattus norvegicus
agggtctctggcagtacttccgacg

SEQ ID NO: 450170 - DNA, 25 bp, Rattus norvegicus
ggcctccagtctccaatagcacgaa

SEQ ID NO: 450171 - DNA, 25 bp, Rattus norvegicus
ccagcagttcctccagggtcatacg

SEQ ID NO: 450172 - DNA, 25 bp, Rattus norvegicus
ctcggctttacggagaatcgaaact

SEQ ID NO: 450173 - DNA, 25 bp, Rattus norvegicus
tcagatttaaagttagccgcgcggg

SEQ ID NO: 450174 - DNA, 25 bp, Rattus norvegicus
accctcggttccaggctagacgtga

SEQ ID NO: 450175 - DNA, 25 bp, Rattus norvegicus
acctggtgagcgcttcctgtaagcc

SEQ ID NO: 450176 - DNA, 25 bp, Rattus norvegicus
acgctccgcggagtgttttcagtgc

SEQ ID NO: 450177 - DNA, 25 bp, Rattus norvegicus
gccacctcaggacttggatgttatc

SEQ ID NO: 450178 - DNA, 25 bp, Rattus norvegicus
ctccgcactggaggaaataacttga

SEQ ID NO: 450179 - DNA, 25 bp, Rattus norvegicus
gccgaggttctcgaaagtttgctcc

SEQ ID NO: 450180 - DNA, 25 bp, Rattus norvegicus
tcaccctaagggatccgcgagcgtg

SEQ ID NO: 450181 - DNA, 25 bp, Rattus norvegicus
acggacgaaagctgcgtggagttca

SEQ ID NO: 450182 - DNA, 25 bp, Rattus norvegicus
accgccgaaggagactgttcgcctg

SEQ ID NO: 450183 - DNA, 25 bp, Rattus norvegicus
gcgttcattagcctgtcaccggtga

SEQ ID NO: 450184 - DNA, 25 bp, Rattus norvegicus
gagccgcgcagagtcgcgttcatta

SEQ ID NO: 450185 - DNA, 25 bp, Rattus norvegicus
tggagcccatcagaacgtagtagcg

SEQ ID NO: 450186 - DNA, 25 bp, Rattus norvegicus
cagcggcctgcttctatttatgtgg

SEQ ID NO: 450187 - DNA, 25 bp, Rattus norvegicus
gagcgtctctagtgtgcgcatgcgc

SEQ ID NO: 450188 - DNA, 25 bp, Rattus norvegicus
tgagcaacagccacgactgtggacg

SEQ ID NO: 450189 - DNA, 25 bp, Rattus norvegicus
tctggcctccagactgttgagagga

SEQ ID NO: 450190 - DNA, 25 bp, Rattus norvegicus
gtcatttccgccgagctgtctggcc

SEQ ID NO: 450191 - DNA, 25 bp, Rattus norvegicus
caggcctatttgtgacgtcatttcc

SEQ ID NO: 450192 - DNA, 25 bp, Rattus norvegicus
ctgtgcggagaacaacgggtacaga

SEQ ID NO: 450193 - DNA, 25 bp, Rattus norvegicus
cgttgccacggagacaggcctattt

SEQ ID NO: 450194 - DNA, 25 bp, Rattus norvegicus
gggtcctctacgaggagcccaacta

SEQ ID NO: 450195 - DNA, 25 bp, Rattus norvegicus
aactaccgcggtcgcatgtacgtgg

SEQ ID NO: 450196 - DNA, 25 bp, Rattus norvegicus
agagaggcgacttccgcagcttctc

SEQ ID NO: 450197 - DNA, 25 bp, Rattus norvegicus
gcagcttctcagactgggaggccca

SEQ ID NO: 450198 - DNA, 25 bp, Rattus norvegicus
ccgccgggtgctcaactttttctag

SEQ ID NO: 450199 - DNA, 25 bp, Rattus norvegicus
cccaactgggtatgtgcgacacacg

SEQ ID NO: 450200 - DNA, 25 bp, Rattus norvegicus
gcgacacacggaggcaataaagatc

SEQ ID NO: 450201 - DNA, 25 bp, Rattus norvegicus
taaagatccagaaagcggagtgctg

SEQ ID NO: 450202 - DNA, 25 bp, Rattus norvegicus
cgggcatcggagtgctttctagacc

SEQ ID NO: 450203 - DNA, 25 bp, Rattus norvegicus
gctgtgcaaggaagccaactccctc

SEQ ID NO: 450204 - DNA, 25 bp, Rattus norvegicus
tcccaaagctaagccagagcggccg

SEQ ID NO: 450205 - DNA, 25 bp, Rattus norvegicus
ccgcaggcagcgtgttttctcaagc

SEQ ID NO: 450206 - DNA, 25 bp, Rattus norvegicus
gttttctcaagcctcggggccacgc

SEQ ID NO: 450207 - DNA, 25 bp, Rattus norvegicus
ctctggcctccaggtgggtcctcta

SEQ ID NO: 450208 - DNA, 25 bp, Rattus norvegicus
tttcttctgattccctaaggtgtca

SEQ ID NO: 450209 - DNA, 25 bp, Rattus norvegicus
ttccgagcacatcgggtacgcaagc

SEQ ID NO: 450210 - DNA, 25 bp, Rattus norvegicus
acctggttaaggctttccgagcaca

SEQ ID NO: 450211 - DNA, 25 bp, Rattus norvegicus
agcagcctaccggtacctggttaag

SEQ ID NO: 450212 - DNA, 25 bp, Rattus norvegicus
gagctgcgctacctgaacgcggcca

SEQ ID NO: 450213 - DNA, 25 bp, Rattus norvegicus
gcgcactctgcgaggccttctgcgg

SEQ ID NO: 450214 - DNA, 25 bp, Rattus norvegicus
gaccaggttcgccaaggacaggaaa

SEQ ID NO: 450215 - DNA, 25 bp, Rattus norvegicus
ccagaggctgttagggaccaggttc

SEQ ID NO: 450216 - DNA, 25 bp, Rattus norvegicus
taaggtgtcacttggcgtttcactc

SEQ ID NO: 450217 - DNA, 25 bp, Rattus norvegicus
gtaccttcccttgcttttcttctga

SEQ ID NO: 450218 - DNA, 25 bp, Rattus norvegicus
cgagaggattcggtaccttcccttg

SEQ ID NO: 450219 - DNA, 25 bp, Rattus norvegicus
ggaagtctaaagtgacgcagtcaga

SEQ ID NO: 450220 - DNA, 25 bp, Rattus norvegicus
gcgaccttcggattaaggaagtcta

SEQ ID NO: 450221 - DNA, 25 bp, Rattus norvegicus
gtttcactcgcagggcactcggtag

SEQ ID NO: 450222 - DNA, 25 bp, Rattus norvegicus
agtgcctagcgcatctcggctgcgc

SEQ ID NO: 450223 - DNA, 25 bp, Rattus norvegicus
cctactttcagtggcaggaggcgca

SEQ ID NO: 450224 - DNA, 25 bp, Rattus norvegicus
tccgggacagggctgcacagccctg

SEQ ID NO: 450225 - DNA, 25 bp, Rattus norvegicus
tggaatcgcacgtgcccgggcgtcc

SEQ ID NO: 450226 - DNA, 25 bp, Rattus norvegicus
gaggctcacgtggaatcgcacgtgc

SEQ ID NO: 450227 - DNA, 25 bp, Rattus norvegicus
cgcatgcgtacagggctcctgcgct

SEQ ID NO: 450228 - DNA, 25 bp, Rattus norvegicus
cacagccctggagcagcactgcagg

SEQ ID NO: 450229 - DNA, 25 bp, Rattus norvegicus
tcacgtgagaggaggagcctgacct

SEQ ID NO: 450230 - DNA, 25 bp, Rattus norvegicus
cccatcacgttgagtgcctagcgca

SEQ ID NO: 450231 - DNA, 25 bp, Rattus norvegicus
aacctacaaatcctcgcgcggctgg

SEQ ID NO: 450232 - DNA, 25 bp, Rattus norvegicus
ctgaagggaggataacctacaaatc

SEQ ID NO: 450233 - DNA, 25 bp, Rattus norvegicus
caagagctctgaagggaggataacc

SEQ ID NO: 450234 - DNA, 25 bp, Rattus norvegicus
ccgactcacgaccaagagctctgaa

SEQ ID NO: 450235 - DNA, 25 bp, Rattus norvegicus
ggaggagcctgacctactttcagtg

SEQ ID NO: 450236 - DNA, 25 bp, Rattus norvegicus
tgtctttcttctagcccaatcaggg

SEQ ID NO: 450237 - DNA, 25 bp, Rattus norvegicus
aaaggcctacttgacttgtcgctta

SEQ ID NO: 450238 - DNA, 25 bp, Rattus norvegicus
ttgtcgcttaaacgcctggggccga

SEQ ID NO: 450239 - DNA, 25 bp, Rattus norvegicus
cacttgctaatttgggacccggctg

SEQ ID NO: 450240 - DNA, 25 bp, Rattus norvegicus
gctcccagattggtagcgcgaggtc

SEQ ID NO: 450241 - DNA, 25 bp, Rattus norvegicus
gggaaggcctctaagggagcacata

SEQ ID NO: 450242 - DNA, 25 bp, Rattus norvegicus
ccagttaatgggcacctctcgggac

SEQ ID NO: 450243 - DNA, 25 bp, Rattus norvegicus
atgcgcgctatgctggaccagttaa

SEQ ID NO: 450244 - DNA, 25 bp, Rattus norvegicus
ctctctctcgaggtggttgccatct

SEQ ID NO: 450245 - DNA, 25 bp, Rattus norvegicus
tgtcgcgtttgtctcaggaaccgga

SEQ ID NO: 450246 - DNA, 25 bp, Rattus norvegicus
gcatgaacgcgctctgcagccgtta

SEQ ID NO: 450247 - DNA, 25 bp, Rattus norvegicus
gtcggctaaacgagcaacattctcg

SEQ ID NO: 450248 - DNA, 25 bp, Rattus norvegicus
cgaacaggctccagagtcggctaaa

SEQ ID NO: 450249 - DNA, 25 bp, Rattus norvegicus
cgactagttctaagcttggcacttg

SEQ ID NO: 450250 - DNA, 25 bp, Rattus norvegicus
ccaccacagcacatgtatcgcgccc

SEQ ID NO: 450251 - DNA, 25 bp, Rattus norvegicus
aggtgcacgccaccacagcacatgt

SEQ ID NO: 450252 - DNA, 25 bp, Rattus norvegicus
ggtgcacgccaccacagcacatgta

SEQ ID NO: 450253 - DNA, 25 bp, Rattus norvegicus
tgcacgccaccacagcacatgtatc

SEQ ID NO: 450254 - DNA, 25 bp, Rattus norvegicus
cacgccaccacagcacatgtatcgc

SEQ ID NO: 450255 - DNA, 25 bp, Rattus norvegicus
acgccaccacagcacatgtatcgcg

SEQ ID NO: 450256 - DNA, 25 bp, Rattus norvegicus
gccaccacagcacatgtatcgcgcc

SEQ ID NO: 450257 - DNA, 25 bp, Rattus norvegicus
gtgcacgccaccacagcacatgtat

SEQ ID NO: 450258 - DNA, 25 bp, Rattus norvegicus
acagcacatgtatcgcgcccggacg

SEQ ID NO: 450259 - DNA, 25 bp, Rattus norvegicus
cagcacatgtatcgcgcccggacgg

SEQ ID NO: 450260 - DNA, 25 bp, Rattus norvegicus
agcacatgtatcgcgcccggacggc

SEQ ID NO: 450261 - DNA, 25 bp, Rattus norvegicus
gcacatgtatcgcgcccggacggcc

SEQ ID NO: 450262 - DNA, 25 bp, Rattus norvegicus
cgccaccacagcacatgtatcgcgc

SEQ ID NO: 450263 - DNA, 25 bp, Rattus norvegicus
gcacgccaccacagcacatgtatcg

SEQ ID NO: 450264 - DNA, 25 bp, Rattus norvegicus
tcgtccgggaagagcgtgacattcc

SEQ ID NO: 450265 - DNA, 25 bp, Rattus norvegicus
atggtggctatcacctcgtccggga

SEQ ID NO: 450266 - DNA, 25 bp, Rattus norvegicus
acaccgtgagaggtgcacgccacca

SEQ ID NO: 450267 - DNA, 25 bp, Rattus norvegicus
gagcgtgacattccgctggatctgc

SEQ ID NO: 450268 - DNA, 25 bp, Rattus norvegicus
tgacattccgctggatctgcagcag

SEQ ID NO: 450269 - DNA, 25 bp, Rattus norvegicus
ctgcagcaggttgagcaccagagcc

SEQ ID NO: 450270 - DNA, 25 bp, Rattus norvegicus
ccagagccaggaccacgccaaatga

SEQ ID NO: 450271 - DNA, 25 bp, Rattus norvegicus
agagcacgaggctccgctgcaccag

SEQ ID NO: 450272 - DNA, 25 bp, Rattus norvegicus
agaagatggtggctatcacctcgtc

SEQ ID NO: 450273 - DNA, 25 bp, Rattus norvegicus
ccgcaatcatgcctcgcgggaggct

SEQ ID NO: 450274 - DNA, 25 bp, Rattus norvegicus
cccgcgcttgggtagctccagacgt

SEQ ID NO: 450275 - DNA, 25 bp, Rattus norvegicus
catcggcggctaggcacaccgtgag

SEQ ID NO: 450276 - DNA, 25 bp, Rattus norvegicus
gccaaatgagaagagcacgaggctc

SEQ ID NO: 450277 - DNA, 25 bp, Rattus norvegicus
gcacccaccaggcggaggagaagat

SEQ ID NO: 450278 - DNA, 25 bp, Rattus norvegicus
tcttgccatctaggcctacgcgctg

SEQ ID NO: 450279 - DNA, 25 bp, Rattus norvegicus
tagggacctggtctcaccctggcct

SEQ ID NO: 450280 - DNA, 25 bp, Rattus norvegicus
ttcgagctttccgagggctccgcta

SEQ ID NO: 450281 - DNA, 25 bp, Rattus norvegicus
ggcggctccattttcgagctttccg

SEQ ID NO: 450282 - DNA, 25 bp, Rattus norvegicus
atttctcccggagctcctgggactg

SEQ ID NO: 450283 - DNA, 25 bp, Rattus norvegicus
gaaagcgccgtagcccaggctgagc

SEQ ID NO: 450284 - DNA, 25 bp, Rattus norvegicus
aaggctggcgattccggcactggaa

SEQ ID NO: 450285 - DNA, 25 bp, Rattus norvegicus
aagcggcgatcctcggctccacgtg

SEQ ID NO: 450286 - DNA, 25 bp, Rattus norvegicus
ctacgcgctgcagcagtgcatcgtc

SEQ ID NO: 450287 - DNA, 25 bp, Rattus norvegicus
gcccgcggcagtttcttgccatcta

SEQ ID NO: 450288 - DNA, 25 bp, Rattus norvegicus
gacctcgagactcgcggagcgtcgc

SEQ ID NO: 450289 - DNA, 25 bp, Rattus norvegicus
gcctcgggctgtcttcggaggccct

SEQ ID NO: 450290 - DNA, 25 bp, Rattus norvegicus
cagtgcatcgtcctccttggtcagc

SEQ ID NO: 450291 - DNA, 25 bp, Rattus norvegicus
ccggtgggaggctgagatttctccc

SEQ ID NO: 450292 - DNA, 25 bp, Rattus norvegicus
cccagggccttgtctagagaaactc

SEQ ID NO: 450293 - DNA, 25 bp, Rattus norvegicus
cagggccttgtctagagaaactccc

SEQ ID NO: 450294 - DNA, 25 bp, Rattus norvegicus
cccactttacaagactccggaggag

SEQ ID NO: 450295 - DNA, 25 bp, Rattus norvegicus
ctttacaagactccggaggagtgcc

SEQ ID NO: 450296 - DNA, 25 bp, Rattus norvegicus
agactccggaggagtgccttggctc

SEQ ID NO: 450297 - DNA, 25 bp, Rattus norvegicus
gaggagtgccttggctcacagctgc

SEQ ID NO: 450298 - DNA, 25 bp, Rattus norvegicus
ccttggctcacagctgcgcgggagc

SEQ ID NO: 450299 - DNA, 25 bp, Rattus norvegicus
gctggtgacctgagctgtcctctct

SEQ ID NO: 450300 - DNA, 25 bp, Rattus norvegicus
tcgcggaatggagccggccagagag

SEQ ID NO: 450301 - DNA, 25 bp, Rattus norvegicus
ctgcgcccaggccacgctctccagc

SEQ ID NO: 450302 - DNA, 25 bp, Rattus norvegicus
ccacgctctccagccgaggcagagg

SEQ ID NO: 450303 - DNA, 25 bp, Rattus norvegicus
ctgctgaggcgatccgggtctggct

SEQ ID NO: 450304 - DNA, 25 bp, Rattus norvegicus
cgggtctggctatgagggcagcacc

SEQ ID NO: 450305 - DNA, 25 bp, Rattus norvegicus
cttcccagggccttgtctagagaaa

SEQ ID NO: 450306 - DNA, 25 bp, Rattus norvegicus
agccaccttctctgccctggaaata

SEQ ID NO: 450307 - DNA, 25 bp, Rattus norvegicus
aaccttgatggggagttgctagacc

SEQ ID NO: 450308 - DNA, 25 bp, Rattus norvegicus
ttcaattgagcaaaccttgatgggg

SEQ ID NO: 450309 - DNA, 25 bp, Rattus norvegicus
tttcagctggagttagagagccacc

SEQ ID NO: 450310 - DNA, 25 bp, Rattus norvegicus
tactcataaggccaaagaaattttc

SEQ ID NO: 450311 - DNA, 25 bp, Rattus norvegicus
ttcatggcaacggagaagggaacgc

SEQ ID NO: 450312 - DNA, 25 bp, Rattus norvegicus
tgtccgcggttcatggcaacggaga

SEQ ID NO: 450313 - DNA, 25 bp, Rattus norvegicus
ctgccctggaaataagatcctgctc

SEQ ID NO: 450314 - DNA, 25 bp, Rattus norvegicus
ttgctagacctgtagctgcctgtgg

SEQ ID NO: 450315 - DNA, 25 bp, Rattus norvegicus
agtcacggatccgtcttttcccaca

SEQ ID NO: 450316 - DNA, 25 bp, Rattus norvegicus
aacagaaagcagtcacggatccgtc

SEQ ID NO: 450317 - DNA, 25 bp, Rattus norvegicus
caccttcatttatcgcaaataaaca

SEQ ID NO: 450318 - DNA, 25 bp, Rattus norvegicus
ggaaataagatcctgctccaggccg

SEQ ID NO: 450319 - DNA, 25 bp, Rattus norvegicus
acctgtagctgcctgtggaggtaag

SEQ ID NO: 450320 - DNA, 25 bp, Rattus norvegicus
aatcgagcgccgatggcacggatgc

SEQ ID NO: 450321 - DNA, 25 bp, Rattus norvegicus
gggctccgttctagcctacaggcga

SEQ ID NO: 450322 - DNA, 25 bp, Rattus norvegicus
catcatccgggtggaagggtcccac

SEQ ID NO: 450323 - DNA, 25 bp, Rattus norvegicus
tcttctccatcatccgggtggaagg

SEQ ID NO: 450324 - DNA, 25 bp, Rattus norvegicus
gtttggggagccctcttctccatca

SEQ ID NO: 450325 - DNA, 25 bp, Rattus norvegicus
aacgcaacgtcaggatgaacgcctg

SEQ ID NO: 450326 - DNA, 25 bp, Rattus norvegicus
tctcgggagaatgtctagggagccc

SEQ ID NO: 450327 - DNA, 25 bp, Rattus norvegicus
agcctacaggcgagggaaatgaatg

SEQ ID NO: 450328 - DNA, 25 bp, Rattus norvegicus
gtgcgggctccgttctagcctacag

SEQ ID NO: 450329 - DNA, 25 bp, Rattus norvegicus
gctgccgggcaaagtgtcttcgccc

SEQ ID NO: 450330 - DNA, 25 bp, Rattus norvegicus
tcagcggtcccgctgccgggcaaag

SEQ ID NO: 450331 - DNA, 25 bp, Rattus norvegicus
tggaggcggccacaactttgtgtgt

SEQ ID NO: 450332 - DNA, 25 bp, Rattus norvegicus
gcgcgcaatcgagcgccgatggcac

SEQ ID NO: 450333 - DNA, 25 bp, Rattus norvegicus
gcggccacaactttgtgtgtgcgtg

SEQ ID NO: 450334 - DNA, 25 bp, Rattus norvegicus
cccggtcctcaggaacttgcagtta

SEQ ID NO: 450335 - DNA, 25 bp, Rattus norvegicus
tccatgcccatcgttgtcgtcctta

SEQ ID NO: 450336 - DNA, 25 bp, Rattus norvegicus
ttaccgtagatgagaaacttgcaga

SEQ ID NO: 450337 - DNA, 25 bp, Rattus norvegicus
acttgcagagatgcaactgcgcgca

SEQ ID NO: 450338 - DNA, 25 bp, Rattus norvegicus
agacgcagcgacgacacagccacta

SEQ ID NO: 450339 - DNA, 25 bp, Rattus norvegicus
accgaggcttagcacggacgacagc

SEQ ID NO: 450340 - DNA, 25 bp, Rattus norvegicus
gacgacagcgttgttcacaggccca

SEQ ID NO: 450341 - DNA, 25 bp, Rattus norvegicus
cccagctgggaaaacagaagcaggg

SEQ ID NO: 450342 - DNA, 25 bp, Rattus norvegicus
cacactgagcgacccggtgtgcctt

SEQ ID NO: 450343 - DNA, 25 bp, Rattus norvegicus
gggttcagtcagcagcctcgatctc

SEQ ID NO: 450344 - DNA, 25 bp, Rattus norvegicus
cctcgatctcgagaagctgagagaa

SEQ ID NO: 450345 - DNA, 25 bp, Rattus norvegicus
gagaagtttccagacggcgctggcc

SEQ ID NO: 450346 - DNA, 25 bp, Rattus norvegicus
gggctctgaagtcgcccgagcaaaa

SEQ ID NO: 450347 - DNA, 25 bp, Rattus norvegicus
acggaaacagtcactcggaattgca

SEQ ID NO: 450348 - DNA, 25 bp, Rattus norvegicus
gtttccggaggctcacgtgacctcg

SEQ ID NO: 450349 - DNA, 25 bp, Rattus norvegicus
agaagtacccgctccgctagactcg

SEQ ID NO: 450350 - DNA, 25 bp, Rattus norvegicus
cacctcacccagagggatgtggcca

SEQ ID NO: 450351 - DNA, 25 bp, Rattus norvegicus
acccagagggatgtggccagagttt

SEQ ID NO: 450352 - DNA, 25 bp, Rattus norvegicus
cagagtttccggaggctcacgtgac

SEQ ID NO: 450353 - DNA, 25 bp, Rattus norvegicus
ggctcacgtgacctcgcgcacaggt

SEQ ID NO: 450354 - DNA, 25 bp, Rattus norvegicus
tgacctcgcgcacaggtgcatgccg

SEQ ID NO: 450355 - DNA, 25 bp, Rattus norvegicus
tcgcacctgagacccgcagaagtac

SEQ ID NO: 450356 - DNA, 25 bp, Rattus norvegicus
aggctcgcacctgagacccgcagaa

SEQ ID NO: 450357 - DNA, 25 bp, Rattus norvegicus
agtgcacgcaggctcgcacctgaga

SEQ ID NO: 450358 - DNA, 25 bp, Rattus norvegicus
cccggaacaccggagtgcacgcagg

SEQ ID NO: 450359 - DNA, 25 bp, Rattus norvegicus
cttgtaggggccagctgccagcagc

SEQ ID NO: 450360 - DNA, 25 bp, Rattus norvegicus
tccgagtcttgtaggggccagctgc

SEQ ID NO: 450361 - DNA, 25 bp, Rattus norvegicus
gtggccagagtttccggaggctcac

SEQ ID NO: 450362 - DNA, 25 bp, Rattus norvegicus
caaaggcatacaaaagcggctgctc

SEQ ID NO: 450363 - DNA, 25 bp, Rattus norvegicus
ttacaaacggatagcccggcgcgga

SEQ ID NO: 450364 - DNA, 25 bp, Rattus norvegicus
caccgagggtcgttagagcccgatt

SEQ ID NO: 450365 - DNA, 25 bp, Rattus norvegicus
agcccgattcgcatcggcgagctcg

SEQ ID NO: 450366 - DNA, 25 bp, Rattus norvegicus
cgcagtctgaaacccgcagcgatgt

SEQ ID NO: 450367 - DNA, 25 bp, Rattus norvegicus
caacctctgcggaggctgacgcagc

SEQ ID NO: 450368 - DNA, 25 bp, Rattus norvegicus
cacgcaacgtcctacctgcaggtga

SEQ ID NO: 450369 - DNA, 25 bp, Rattus norvegicus
tgcaggtgacctgtttcgtccagcc

SEQ ID NO: 450370 - DNA, 25 bp, Rattus norvegicus
tcctgatgttgtggctgttgttccg

SEQ ID NO: 450371 - DNA, 25 bp, Rattus norvegicus
gcagcctccgccattactgtttatc

SEQ ID NO: 450372 - DNA, 25 bp, Rattus norvegicus
tgtttatcccacacagcaatggccc

SEQ ID NO: 450373 - DNA, 25 bp, Rattus norvegicus
ggatcacatagttccggtccggcta

SEQ ID NO: 450374 - DNA, 25 bp, Rattus norvegicus
cctccttcggcgatgctgattggtg

SEQ ID NO: 450375 - DNA, 25 bp, Rattus norvegicus
ccaccgactcacatacaaaggcata

SEQ ID NO: 450376 - DNA, 25 bp, Rattus norvegicus
ccggtggagagtaagagtccttgtc

SEQ ID NO: 450377 - DNA, 25 bp, Rattus norvegicus
tgctgcgcgctcctgcaaggtagac

SEQ ID NO: 450378 - DNA, 25 bp, Rattus norvegicus
ctctggagcaccgtggacggccagt

SEQ ID NO: 450379 - DNA, 25 bp, Rattus norvegicus
atcaactggttgagcctgagcccgg

SEQ ID NO: 450380 - DNA, 25 bp, Rattus norvegicus
ctttactccggatccgcaatgggga

SEQ ID NO: 450381 - DNA, 25 bp, Rattus norvegicus
gcgcagtacctctctttactccgga

SEQ ID NO: 450382 - DNA, 25 bp, Rattus norvegicus
gagctctgctcgctagccaagcgca

SEQ ID NO: 450383 - DNA, 25 bp, Rattus norvegicus
ccacaagcggactctggagctctgc

SEQ ID NO: 450384 - DNA, 25 bp, Rattus norvegicus
atccgcatctcgagcctttgcacga

SEQ ID NO: 450385 - DNA, 25 bp, Rattus norvegicus
gaggtctcacctgtatcggagctga

SEQ ID NO: 450386 - DNA, 25 bp, Rattus norvegicus
aagttctgagtaggggaggtctcac

SEQ ID NO: 450387 - DNA, 25 bp, Rattus norvegicus
ggcttcagacctggtgggcgcaccc

SEQ ID NO: 450388 - DNA, 25 bp, Rattus norvegicus
cccgggttattctgccggcttcaga

SEQ ID NO: 450389 - DNA, 25 bp, Rattus norvegicus
ctttgcacgaatgggaagcccgggc

SEQ ID NO: 450390 - DNA, 25 bp, Rattus norvegicus
gcggccgaagagcagcaaccctttc

SEQ ID NO: 450391 - DNA, 25 bp, Rattus norvegicus
ggcggaacaagacggtgctcacgta

SEQ ID NO: 450392 - DNA, 25 bp, Rattus norvegicus
tgagccatcactctgtcccagaggc

SEQ ID NO: 450393 - DNA, 25 bp, Rattus norvegicus
tggtcgcctcggttccagaccggga

SEQ ID NO: 450394 - DNA, 25 bp, Rattus norvegicus
gcaaccctttccagcgggcgcagga

SEQ ID NO: 450395 - DNA, 25 bp, Rattus norvegicus
ttcatcactttgtgtggccggggct

SEQ ID NO: 450396 - DNA, 25 bp, Rattus norvegicus
tgtccgggatggaggttcatcactt

SEQ ID NO: 450397 - DNA, 25 bp, Rattus norvegicus
agatctcgcctagcggccctgacag

SEQ ID NO: 450398 - DNA, 25 bp, Rattus norvegicus
gagaccgcgagactccggaagtgtc

SEQ ID NO: 450399 - DNA, 25 bp, Rattus norvegicus
agcagcggagctcaagccggagacc

SEQ ID NO: 450400 - DNA, 25 bp, Rattus norvegicus
atctggtagtcaaggcagcagcgga

SEQ ID NO: 450401 - DNA, 25 bp, Rattus norvegicus
cagaggccgaggttacccacccgtg

SEQ ID NO: 450402 - DNA, 25 bp, Rattus norvegicus
gactgagacgcctcgggacatggaa

SEQ ID NO: 450403 - DNA, 25 bp, Rattus norvegicus
gcgcgactgctacctgtggaatctg

SEQ ID NO: 450404 - DNA, 25 bp, Rattus norvegicus
cgaccgtttgcagtgacgtgcgccc

SEQ ID NO: 450405 - DNA, 25 bp, Rattus norvegicus
cggcgtttaaccttttctgtgctga

SEQ ID NO: 450406 - DNA, 25 bp, Rattus norvegicus
taaacaggaccttctgccgcactca

SEQ ID NO: 450407 - DNA, 25 bp, Rattus norvegicus
gagccacggtaaacaggaccttctg

SEQ ID NO: 450408 - DNA, 25 bp, Rattus norvegicus
atcccgcggctccagtgagctaatc

SEQ ID NO: 450409 - DNA, 25 bp, Rattus norvegicus
ccggggaagaactatggatcgctcc

SEQ ID NO: 450410 - DNA, 25 bp, Rattus norvegicus
gcccgatccggggaagaactatgga

SEQ ID NO: 450411 - DNA, 25 bp, Rattus norvegicus
ctgcaagtttcttcggccctaaagt

SEQ ID NO: 450412 - DNA, 25 bp, Rattus norvegicus
tgcccagattctgcaagtttcttcg

SEQ ID NO: 450413 - DNA, 25 bp, Rattus norvegicus
agggcccggctctgcccagattctg

SEQ ID NO: 450414 - DNA, 25 bp, Rattus norvegicus
tttctgtgctgaagatcgccacacg

SEQ ID NO: 450415 - DNA, 25 bp, Rattus norvegicus
atcgccacacgggttctcttctatc

SEQ ID NO: 450416 - DNA, 25 bp, Rattus norvegicus
ttactcactcacaggcgcccgggag

SEQ ID NO: 450417 - DNA, 25 bp, Rattus norvegicus
agctaatccgcagctggcgggcgcc

SEQ ID NO: 450418 - DNA, 25 bp, Rattus norvegicus
ttaaggagcgtgtcctaggcagaga

SEQ ID NO: 450419 - DNA, 25 bp, Rattus norvegicus
tcaggttcccattccctgcgctggg

SEQ ID NO: 450420 - DNA, 25 bp, Rattus norvegicus
tggtcccgggctcaggttcccattc

SEQ ID NO: 450421 - DNA, 25 bp, Rattus norvegicus
tggacagcttgtcgcccgtggtccc

SEQ ID NO: 450422 - DNA, 25 bp, Rattus norvegicus
tgagctctggcgctggacagcttgt

SEQ ID NO: 450423 - DNA, 25 bp, Rattus norvegicus
tgactcccggcactctgagctctgg

SEQ ID NO: 450424 - DNA, 25 bp, Rattus norvegicus
catctccatccctggtgttcggtga

SEQ ID NO: 450425 - DNA, 25 bp, Rattus norvegicus
ccggagcgttcttctctggtcttcc

SEQ ID NO: 450426 - DNA, 25 bp, Rattus norvegicus
tcgggtgggtgtccctgctgtaccc

SEQ ID NO: 450427 - DNA, 25 bp, Rattus norvegicus
ctgactgtaggctccgtgctgtcct

SEQ ID NO: 450428 - DNA, 25 bp, Rattus norvegicus
tgagtgctctgtctggctgactgta

SEQ ID NO: 450429 - DNA, 25 bp, Rattus norvegicus
gtcctaggcagagagggcagaccta

SEQ ID NO: 450430 - DNA, 25 bp, Rattus norvegicus
agcgcggtcggactcaaccctgctt

SEQ ID NO: 450431 - DNA, 25 bp, Rattus norvegicus
cgctggcttggacgctgagtgctct

SEQ ID NO: 450432 - DNA, 25 bp, Rattus norvegicus
agtgacgtcacgttccaggactcgg

SEQ ID NO: 450433 - DNA, 25 bp, Rattus norvegicus
agcaccgttcatataagccgaagca

SEQ ID NO: 450434 - DNA, 25 bp, Rattus norvegicus
gccgaagcaataaggtcagctaaga

SEQ ID NO: 450435 - DNA, 25 bp, Rattus norvegicus
taagagcaccttgccacgctgcgtc

SEQ ID NO: 450436 - DNA, 25 bp, Rattus norvegicus
ctgcgtcacgagacagccagagctc

SEQ ID NO: 450437 - DNA, 25 bp, Rattus norvegicus
ccggagcctctaaggtccgccaata

SEQ ID NO: 450438 - DNA, 25 bp, Rattus norvegicus
atagagacgcgcgacgcagtgacgt

SEQ ID NO: 450439 - DNA, 25 bp, Rattus norvegicus
aggacgatctatctgcccgttaacc

SEQ ID NO: 450440 - DNA, 25 bp, Rattus norvegicus
actgctctcccgctaggatgtctgc

SEQ ID NO: 450441 - DNA, 25 bp, Rattus norvegicus
ggctcgaacaggcagcgctgccatc

SEQ ID NO: 450442 - DNA, 25 bp, Rattus norvegicus
atcccgacgctgtcaccttgaagca

SEQ ID NO: 450443 - DNA, 25 bp, Rattus norvegicus
tcaccttgaagcagtcgcccgagcg

SEQ ID NO: 450444 - DNA, 25 bp, Rattus norvegicus
gagcttgtccgctgtggcctaccat

SEQ ID NO: 450445 - DNA, 25 bp, Rattus norvegicus
ggtccgccaatagtctgagcttgtc

SEQ ID NO: 450446 - DNA, 25 bp, Rattus norvegicus
cccgcaagtcatggccgtgacgtca

SEQ ID NO: 450447 - DNA, 25 bp, Rattus norvegicus
gggccatcgtgtatgtttacgtagc

SEQ ID NO: 450448 - DNA, 25 bp, Rattus norvegicus
ttacgtagcgagaagccacaagaca

SEQ ID NO: 450449 - DNA, 25 bp, Rattus norvegicus
ggggacactccgcagataaccacct

SEQ ID NO: 450450 - DNA, 25 bp, Rattus norvegicus
gctgcctcggttcctcacataaaca

SEQ ID NO: 450451 - DNA, 25 bp, Rattus norvegicus
tcacctcttcaggaatggccgggtc

SEQ ID NO: 450452 - DNA, 25 bp, Rattus norvegicus
tccggctccatgtcgccattgaaca

SEQ ID NO: 450453 - DNA, 25 bp, Rattus norvegicus
cgccattgaacagagcctgtccctg

SEQ ID NO: 450454 - DNA, 25 bp, Rattus norvegicus
cgccatcttcgaagcgcgagccggg

SEQ ID NO: 450455 - DNA, 25 bp, Rattus norvegicus
ggcaacggcgtcacccgcaagtcat

SEQ ID NO: 450456 - DNA, 25 bp, Rattus norvegicus
cgtcacctggatgcgtgacgtcatc

SEQ ID NO: 450457 - DNA, 25 bp, Rattus norvegicus
gtgacgtcatccgaggagcaccctc

SEQ ID NO: 450458 - DNA, 25 bp, Rattus norvegicus
tgtctccaggggagtgttccttctc

SEQ ID NO: 450459 - DNA, 25 bp, Rattus norvegicus
ggtttctacccgcacagtttccatg

SEQ ID NO: 450460 - DNA, 25 bp, Rattus norvegicus
cccgacgcggaaaagaacagttctg

SEQ ID NO: 450461 - DNA, 25 bp, Rattus norvegicus
gccgggtgcacatactctaggaaga

SEQ ID NO: 450462 - DNA, 25 bp, Rattus norvegicus
cctgagcgacctgtccatggtattg

SEQ ID NO: 450463 - DNA, 25 bp, Rattus norvegicus
gtcctgaagagtcgcgtaacgccgc

SEQ ID NO: 450464 - DNA, 25 bp, Rattus norvegicus
caaaggctggtagaaaccgtgcatc

SEQ ID NO: 450465 - DNA, 25 bp, Rattus norvegicus
aacagttctgggcacgcattcccgg

SEQ ID NO: 450466 - DNA, 25 bp, Rattus norvegicus
tcccagagacagagatccaggctgc

SEQ ID NO: 450467 - DNA, 25 bp, Rattus norvegicus
agcgcgatccgtccttcgtcgaagt

SEQ ID NO: 450468 - DNA, 25 bp, Rattus norvegicus
ttcgtcgaagtgtcgcgtcctcaga

SEQ ID NO: 450469 - DNA, 25 bp, Rattus norvegicus
gtcgagggcacttggtatttagttc

SEQ ID NO: 450470 - DNA, 25 bp, Rattus norvegicus
tgaccgtgttgagttcgccaccaca

SEQ ID NO: 450471 - DNA, 25 bp, Rattus norvegicus
tgcgggagcttctccggatcagaac

SEQ ID NO: 450472 - DNA, 25 bp, Rattus norvegicus
cagaactttttaggctgctcgcttc

SEQ ID NO: 450473 - DNA, 25 bp, Rattus norvegicus
tcgctgtccaaaagccgggctgtct

SEQ ID NO: 450474 - DNA, 25 bp, Rattus norvegicus
tgagcagggccggaacccgccagcg

SEQ ID NO: 450475 - DNA, 25 bp, Rattus norvegicus
ttttgtgagagcacacaggaaaggc

SEQ ID NO: 450476 - DNA, 25 bp, Rattus norvegicus
cctaggtcacgggagagctcgccct

SEQ ID NO: 450477 - DNA, 25 bp, Rattus norvegicus
taggtcacgggagagctcgccctgc

SEQ ID NO: 450478 - DNA, 25 bp, Rattus norvegicus
tgttccgcgtcggaacccgagggca

SEQ ID NO: 450479 - DNA, 25 bp, Rattus norvegicus
agagggagatttttgtgagagcaca

SEQ ID NO: 450480 - DNA, 25 bp, Rattus norvegicus
ggagatttttgtgagagcacacagg

SEQ ID NO: 450481 - DNA, 25 bp, Rattus norvegicus
agagcacacaggaaaggccggacgc

SEQ ID NO: 450482 - DNA, 25 bp, Rattus norvegicus
gcacacaggaaaggccggacgctga

SEQ ID NO: 450483 - DNA, 25 bp, Rattus norvegicus
cagcggtgagttcaggggagcgagc

SEQ ID NO: 450484 - DNA, 25 bp, Rattus norvegicus
cagccgtgggttgctacgctgagca

SEQ ID NO: 450485 - DNA, 25 bp, Rattus norvegicus
atcggccacgcggttgttgaccgca

SEQ ID NO: 450486 - DNA, 25 bp, Rattus norvegicus
ccacgcggttgttgaccgcagcgcg

SEQ ID NO: 450487 - DNA, 25 bp, Rattus norvegicus
cgctggctgtgtgtggtcagggtat

SEQ ID NO: 450488 - DNA, 25 bp, Rattus norvegicus
cccggatctctggaaggtggcccgc

SEQ ID NO: 450489 - DNA, 25 bp, Rattus norvegicus
tctctggaaggtggcccgcacaggt

SEQ ID NO: 450490 - DNA, 25 bp, Rattus norvegicus
ggacatcggcgcacttgcatagccc

SEQ ID NO: 450491 - DNA, 25 bp, Rattus norvegicus
gccctgcctctttctgcggtgcggt

SEQ ID NO: 450492 - DNA, 25 bp, Rattus norvegicus
cctgctccaccatggcgaggcgagg

SEQ ID NO: 450493 - DNA, 25 bp, Rattus norvegicus
ctgcaacgcggggtcctgcggcaca

SEQ ID NO: 450494 - DNA, 25 bp, Rattus norvegicus
ttcggggagcttccgcggccactcg

SEQ ID NO: 450495 - DNA, 25 bp, Rattus norvegicus
ggccaccacctggtcctcctctacg

SEQ ID NO: 450496 - DNA, 25 bp, Rattus norvegicus
tcgaaggtgaccacgaacacggcca

SEQ ID NO: 450497 - DNA, 25 bp, Rattus norvegicus
tctcaccggagcgaggatcgaaggt

SEQ ID NO: 450498 - DNA, 25 bp, Rattus norvegicus
cctaagcgactctcaccggagcgag

SEQ ID NO: 450499 - DNA, 25 bp, Rattus norvegicus
tgtgccagcgctcgcgcagcgagtc

SEQ ID NO: 450500 - DNA, 25 bp, Rattus norvegicus
ggatccctcggctccagtctggaga

SEQ ID NO: 450501 - DNA, 25 bp, Rattus norvegicus
ctgtccggacatcggcgcacttgca

SEQ ID NO: 450502 - DNA, 25 bp, Rattus norvegicus
agacaaagttgtgagtccgtagtgc

SEQ ID NO: 450503 - DNA, 25 bp, Rattus norvegicus
gtgtttcccgtgacatcagccggca

SEQ ID NO: 450504 - DNA, 25 bp, Rattus norvegicus
cccgtgacatcagccggcagcattt

SEQ ID NO: 450505 - DNA, 25 bp, Rattus norvegicus
ggcgcacattgttgacttcctgttt

SEQ ID NO: 450506 - DNA, 25 bp, Rattus norvegicus
tttgccggctctgtgcgccggaagc

SEQ ID NO: 450507 - DNA, 25 bp, Rattus norvegicus
cggcagcatttcaacggcgcacatt

SEQ ID NO: 450508 - DNA, 25 bp, Rattus norvegicus
ttgtgagtccgtagtgcacgagcgc

SEQ ID NO: 450509 - DNA, 25 bp, Rattus norvegicus
tgcggctccttgctggagtctcagt

SEQ ID NO: 450510 - DNA, 25 bp, Rattus norvegicus
gctgttccctgtgcagcctgcgatc

SEQ ID NO: 450511 - DNA, 25 bp, Rattus norvegicus
tgcagcctgcgatcgccactttaga

SEQ ID NO: 450512 - DNA, 25 bp, Rattus norvegicus
cgatcgccactttagaggaaaagta

SEQ ID NO: 450513 - DNA, 25 bp, Rattus norvegicus
aagccgggcttactcagcgctaacg

SEQ ID NO: 450514 - DNA, 25 bp, Rattus norvegicus
ttgcctatcgcgagctttgccggct

SEQ ID NO: 450515 - DNA, 25 bp, Rattus norvegicus
ttcctgtttttccttgcctatcgcg

SEQ ID NO: 450516 - DNA, 25 bp, Rattus norvegicus
agagactccaagctgcgagcagacg

SEQ ID NO: 450517 - DNA, 25 bp, Rattus norvegicus
cacgcgcgacgctaggaaagatctg

SEQ ID NO: 450518 - DNA, 25 bp, Rattus norvegicus
gctgggaagcgaggtcctcagacca

SEQ ID NO: 450519 - DNA, 25 bp, Rattus norvegicus
cagagctcagcgactccgatcgtga

SEQ ID NO: 450520 - DNA, 25 bp, Rattus norvegicus
ctcagaccagagaggacacgcgcga

SEQ ID NO: 450521 - DNA, 25 bp, Rattus norvegicus
tcagctgccagccagtaacgctttg

SEQ ID NO: 450522 - DNA, 25 bp, Rattus norvegicus
gtaacgctttgctccgctgatgctc

SEQ ID NO: 450523 - DNA, 25 bp, Rattus norvegicus
aggattttaaacacgccttgcagcg

SEQ ID NO: 450524 - DNA, 25 bp, Rattus norvegicus
ctagggagcagtccctgcttgcagc

SEQ ID NO: 450525 - DNA, 25 bp, Rattus norvegicus
gaccctaactcgtgcagtccttctg

SEQ ID NO: 450526 - DNA, 25 bp, Rattus norvegicus
tttgcccagccagcgcttcggagca

SEQ ID NO: 450527 - DNA, 25 bp, Rattus norvegicus
cgtccgaacccaagagcagagctca

SEQ ID NO: 450528 - DNA, 25 bp, Rattus norvegicus
gggtcctctcccagaatcccagaga

SEQ ID NO: 450529 - DNA, 25 bp, Rattus norvegicus
ccggcgcgagctacaggattttaaa

SEQ ID NO: 450530 - DNA, 25 bp, Rattus norvegicus
gcttctctctccactacagtatggg

SEQ ID NO: 450531 - DNA, 25 bp, Rattus norvegicus
agcggacccgcctgcaattagcaga

SEQ ID NO: 450532 - DNA, 25 bp, Rattus norvegicus
gcctgcaattagcagactgcgattg

SEQ ID NO: 450533 - DNA, 25 bp, Rattus norvegicus
cagactgcgattggctgcttgctcc

SEQ ID NO: 450534 - DNA, 25 bp, Rattus norvegicus
ggctgcttgctcctgaccctatagc

SEQ ID NO: 450535 - DNA, 25 bp, Rattus norvegicus
tgctcctgaccctatagcacttctg

SEQ ID NO: 450536 - DNA, 25 bp, Rattus norvegicus
gaccctatagcacttctgcagaccg

SEQ ID NO: 450537 - DNA, 25 bp, Rattus norvegicus
agcacttctgcagaccgcggcttca

SEQ ID NO: 450538 - DNA, 25 bp, Rattus norvegicus
ccactacagtatggggccggcgccg

SEQ ID NO: 450539 - DNA, 25 bp, Rattus norvegicus
gttcgcttctctctccactacagta

SEQ ID NO: 450540 - DNA, 25 bp, Rattus norvegicus
tctccactacagtatggggccggcg

SEQ ID NO: 450541 - DNA, 25 bp, Rattus norvegicus
aggctgcgcactagggcccttagcg

SEQ ID NO: 450542 - DNA, 25 bp, Rattus norvegicus
gcctttttcattcaccgtgctacac

SEQ ID NO: 450543 - DNA, 25 bp, Rattus norvegicus
agaccgcggcttcacgttcgcttct

SEQ ID NO: 450544 - DNA, 25 bp, Rattus norvegicus
cgcgcctccttacctatgaggtgac

SEQ ID NO: 450545 - DNA, 25 bp, Rattus norvegicus
tgggtagcatttcctccgacttggc

SEQ ID NO: 450546 - DNA, 25 bp, Rattus norvegicus
cctatgaggtgacccagagaggtag

SEQ ID NO: 450547 - DNA, 25 bp, Rattus norvegicus
gaacttagagcccagctccagcgtc

SEQ ID NO: 450548 - DNA, 25 bp, Rattus norvegicus
cggacctgggaacttagagcccagc

SEQ ID NO: 450549 - DNA, 25 bp, Rattus norvegicus
ttcccgctccgcgtgactctaggtg

SEQ ID NO: 450550 - DNA, 25 bp, Rattus norvegicus
ggtgactcttcccaaacgccatggt

SEQ ID NO: 450551 - DNA, 25 bp, Rattus norvegicus
ccaaacgccatggtagctccagaga

SEQ ID NO: 450552 - DNA, 25 bp, Rattus norvegicus
cccaagccagtcgggatgttactcc

SEQ ID NO: 450553 - DNA, 25 bp, Rattus norvegicus
tggagccggcaaaactcccacaatt

SEQ ID NO: 450554 - DNA, 25 bp, Rattus norvegicus
ccacaatcgggaatggagtggagcc

SEQ ID NO: 450555 - DNA, 25 bp, Rattus norvegicus
gtagcatttcctccgacttggccca

SEQ ID NO: 450556 - DNA, 25 bp, Rattus norvegicus
agggatcgcggtgactcttcccaaa

SEQ ID NO: 450557 - DNA, 25 bp, Rattus norvegicus
gtagctccagagaaccctcccagga

SEQ ID NO: 450558 - DNA, 25 bp, Rattus norvegicus
tcctgcccacccagccgacggccgc

SEQ ID NO: 450559 - DNA, 25 bp, Rattus norvegicus
gagctgaaggcggtgggaaaggaag

SEQ ID NO: 450560 - DNA, 25 bp, Rattus norvegicus
tgttttcattccgggtgaggccggc

SEQ ID NO: 450561 - DNA, 25 bp, Rattus norvegicus
ttccctttccctcagctctaccgcg

SEQ ID NO: 450562 - DNA, 25 bp, Rattus norvegicus
ccctcagctctaccgcgacctcctc

SEQ ID NO: 450563 - DNA, 25 bp, Rattus norvegicus
gggttcgcccgaccactcctgccca

SEQ ID NO: 450564 - DNA, 25 bp, Rattus norvegicus
cgctgccaggccgaggcccaaaccc

SEQ ID NO: 450565 - DNA, 25 bp, Rattus norvegicus
cgccaccaccgagccagccgagacc

SEQ ID NO: 450566 - DNA, 25 bp, Rattus norvegicus
cgagccagccgagaccagccaaatg

SEQ ID NO: 450567 - DNA, 25 bp, Rattus norvegicus
cgagaccagccaaatgcccggatgc

SEQ ID NO: 450568 - DNA, 25 bp, Rattus norvegicus
agaccagccaaatgcccggatgcgg

SEQ ID NO: 450569 - DNA, 25 bp, Rattus norvegicus
caaatgcccggatgcggcagaggcc

SEQ ID NO: 450570 - DNA, 25 bp, Rattus norvegicus
gcagaggccgccgtttgttttcatt

SEQ ID NO: 450571 - DNA, 25 bp, Rattus norvegicus
cagaggccgccgtttgttttcattc

SEQ ID NO: 450572 - DNA, 25 bp, Rattus norvegicus
ttcccattgggctgtgcgagcctca

SEQ ID NO: 450573 - DNA, 25 bp, Rattus norvegicus
ggtttccgcgggaatcgctagccaa

SEQ ID NO: 450574 - DNA, 25 bp, Rattus norvegicus
ttccgcgggaatcgctagccaatca

SEQ ID NO: 450575 - DNA, 25 bp, Rattus norvegicus
cgctagccaatcagatccccgagtg

SEQ ID NO: 450576 - DNA, 25 bp, Rattus norvegicus
agagtctactctcttcccattgggc

SEQ ID NO: 450577 - DNA, 25 bp, Rattus norvegicus
ctgtgcgagcctcagcgacaagtgt

SEQ ID NO: 450578 - DNA, 25 bp, Rattus norvegicus
cctcagcgacaagtgtgcgcttgcg

SEQ ID NO: 450579 - DNA, 25 bp, Rattus norvegicus
agcccgggaaaagctggaaatggcg

SEQ ID NO: 450580 - DNA, 25 bp, Rattus norvegicus
aaagctggaaatggcggcgtcgagc

SEQ ID NO: 450581 - DNA, 25 bp, Rattus norvegicus
tcgagcgggaggtctcagtcttccc

SEQ ID NO: 450582 - DNA, 25 bp, Rattus norvegicus
ctcagtcttccctgcacaggaaggg

SEQ ID NO: 450583 - DNA, 25 bp, Rattus norvegicus
ttccctgcacaggaaggggctgatg

SEQ ID NO: 450584 - DNA, 25 bp, Rattus norvegicus
tgccgagcgagcggcgcgccttctt

SEQ ID NO: 450585 - DNA, 25 bp, Rattus norvegicus
ttcccgttcttcctagagtctactc

SEQ ID NO: 450586 - DNA, 25 bp, Rattus norvegicus
agccgatgcagcccatggctccggg

SEQ ID NO: 450587 - DNA, 25 bp, Rattus norvegicus
acctggaggcgcgagggcacaggaa

SEQ ID NO: 450588 - DNA, 25 bp, Rattus norvegicus
ccatcgggagtagggaacagcgacg

SEQ ID NO: 450589 - DNA, 25 bp, Rattus norvegicus
gaacagcgacggagcaaggaaggat

SEQ ID NO: 450590 - DNA, 25 bp, Rattus norvegicus
atgctgtggagatgctaccagggaa

SEQ ID NO: 450591 - DNA, 25 bp, Rattus norvegicus
agatgctaccagggaaggaccgcgc

SEQ ID NO: 450592 - DNA, 25 bp, Rattus norvegicus
aatgagctgagagggatggaagacc

SEQ ID NO: 450593 - DNA, 25 bp, Rattus norvegicus
cgagggcacaggaatagagggacct

SEQ ID NO: 450594 - DNA, 25 bp, Rattus norvegicus
atagagggaccttagcggatggagt

SEQ ID NO: 450595 - DNA, 25 bp, Rattus norvegicus
tggagtgaaagtaaaggcgcgaggc

SEQ ID NO: 450596 - DNA, 25 bp, Rattus norvegicus
agtcctcgagccgatgcagcccatg

SEQ ID NO: 450597 - DNA, 25 bp, Rattus norvegicus
cggccctcaccgactccgggcgctc

SEQ ID NO: 450598 - DNA, 25 bp, Rattus norvegicus
gctgtctccgctcggttccgctccc

SEQ ID NO: 450599 - DNA, 25 bp, Rattus norvegicus
cctggccgcggtacccacccacagt

SEQ ID NO: 450600 - DNA, 25 bp, Rattus norvegicus
ctacgttccgggactgaccacagga

SEQ ID NO: 450601 - DNA, 25 bp, Rattus norvegicus
cttcgggacctctgggatactcgcc

SEQ ID NO: 450602 - DNA, 25 bp, Rattus norvegicus
cggacggtgagtcagttctccagca

SEQ ID NO: 450603 - DNA, 25 bp, Rattus norvegicus
ttctccagcactcgcgggtcgggag

SEQ ID NO: 450604 - DNA, 25 bp, Rattus norvegicus
ggaaatgacatcagaggcctgtgct

SEQ ID NO: 450605 - DNA, 25 bp, Rattus norvegicus
ccgcaggcggacctttgcagagcct

SEQ ID NO: 450606 - DNA, 25 bp, Rattus norvegicus
gccgctccttgtatggtctgggcgc

SEQ ID NO: 450607 - DNA, 25 bp, Rattus norvegicus
ccgcttggctagaagctgctccgga

SEQ ID NO: 450608 - DNA, 25 bp, Rattus norvegicus
accgggacgcagagtccgtggactc

SEQ ID NO: 450609 - DNA, 25 bp, Rattus norvegicus
ggtcatccgagacgcggctctcacg

SEQ ID NO: 450610 - DNA, 25 bp, Rattus norvegicus
ctcttggaccgaggagtgtcagccc

SEQ ID NO: 450611 - DNA, 25 bp, Rattus norvegicus
caaagtgaatcctttccggcctggg

SEQ ID NO: 450612 - DNA, 25 bp, Rattus norvegicus
ggacagcgagtctcctgtggcagcc

SEQ ID NO: 450613 - DNA, 25 bp, Rattus norvegicus
agggtcccatctcagtcctacgttc

SEQ ID NO: 450614 - DNA, 25 bp, Rattus norvegicus
ggccacagcctccagtcacctaaac

SEQ ID NO: 450615 - DNA, 25 bp, Rattus norvegicus
tgctccctgcgttgcttctagcggc

SEQ ID NO: 450616 - DNA, 25 bp, Rattus norvegicus
gcagtccttggctgctccctgcgtt

SEQ ID NO: 450617 - DNA, 25 bp, Rattus norvegicus
ccttccggagcagtccttggctgct

SEQ ID NO: 450618 - DNA, 25 bp, Rattus norvegicus
tgcaggaatgactgatcggcagctc

SEQ ID NO: 450619 - DNA, 25 bp, Rattus norvegicus
ctggagccacgagcgacccgagcga

SEQ ID NO: 450620 - DNA, 25 bp, Rattus norvegicus
gcacttacacaatggcggctggagc

SEQ ID NO: 450621 - DNA, 25 bp, Rattus norvegicus
ggcagccgcgcacttacacaatggc

SEQ ID NO: 450622 - DNA, 25 bp, Rattus norvegicus
taaacgcgccagcttccatccgggg

SEQ ID NO: 450623 - DNA, 25 bp, Rattus norvegicus
ggatcgcaagcgagctctcggctcc

SEQ ID NO: 450624 - DNA, 25 bp, Rattus norvegicus
gaccgggatcgcaagcgagctctcg

SEQ ID NO: 450625 - DNA, 25 bp, Rattus norvegicus
tccaggctgagcgactagaggaccg

SEQ ID NO: 450626 - DNA, 25 bp, Rattus norvegicus
gggaaagttccaggctgagcgacta

SEQ ID NO: 450627 - DNA, 25 bp, Rattus norvegicus
gccagcttccatccggggactggcg

SEQ ID NO: 450628 - DNA, 25 bp, Rattus norvegicus
acggtctgagttctctccagatttc

SEQ ID NO: 450629 - DNA, 25 bp, Rattus norvegicus
agcctactggaaaaccctctgagtc

SEQ ID NO: 450630 - DNA, 25 bp, Rattus norvegicus
tggaaaaccctctgagtcgcgctgc

SEQ ID NO: 450631 - DNA, 25 bp, Rattus norvegicus
cagtggcaaccgcagcatcaccgga

SEQ ID NO: 450632 - DNA, 25 bp, Rattus norvegicus
ctctcggttctttcctacggtctga

SEQ ID NO: 450633 - DNA, 25 bp, Rattus norvegicus
acatccttgatctcagcctgggagc

SEQ ID NO: 450634 - DNA, 25 bp, Rattus norvegicus
tcagctccatacatccttgatctca

SEQ ID NO: 450635 - DNA, 25 bp, Rattus norvegicus
gcgccacgctgaggccgaacgtgta

SEQ ID NO: 450636 - DNA, 25 bp, Rattus norvegicus
atgcttcttagtgccgcgccacgct

SEQ ID NO: 450637 - DNA, 25 bp, Rattus norvegicus
tctccagcgatgcttcttagtgccg

SEQ ID NO: 450638 - DNA, 25 bp, Rattus norvegicus
tgctgagctctctctccagcgatgc

SEQ ID NO: 450639 - DNA, 25 bp, Rattus norvegicus
tggaggcagcagtctccagctcccg

SEQ ID NO: 450640 - DNA, 25 bp, Rattus norvegicus
gggaagcttcccttcgccaggctcg

SEQ ID NO: 450641 - DNA, 25 bp, Rattus norvegicus
gcctgggagctaacagcctactgga

SEQ ID NO: 450642 - DNA, 25 bp, Rattus norvegicus
tgcggggcatgattattgggtaaca

SEQ ID NO: 450643 - DNA, 25 bp, Rattus norvegicus
cgccgtgtcgcacgcagctccaggc

SEQ ID NO: 450644 - DNA, 25 bp, Rattus norvegicus
cgcgagcactacacgccgcccgagc

SEQ ID NO: 450645 - DNA, 25 bp, Rattus norvegicus
cagagccgcggcgtcgcagtgactc

SEQ ID NO: 450646 - DNA, 25 bp, Rattus norvegicus
tacgcactgggaaaaagccggactc

SEQ ID NO: 450647 - DNA, 25 bp, Rattus norvegicus
aaagccggactcaccgcggcctgtg

SEQ ID NO: 450648 - DNA, 25 bp, Rattus norvegicus
cgggactcgtgctctcggggatccc

SEQ ID NO: 450649 - DNA, 25 bp, Rattus norvegicus
ccggggcactcattgttgcgacggt

SEQ ID NO: 450650 - DNA, 25 bp, Rattus norvegicus
ccgggatgcggtgtgcttttcgaaa

SEQ ID NO: 450651 - DNA, 25 bp, Rattus norvegicus
tgattattgggtaacagtggtgccc

SEQ ID NO: 450652 - DNA, 25 bp, Rattus norvegicus
ccgggctccgttctctctgggagcg

SEQ ID NO: 450653 - DNA, 25 bp, Rattus norvegicus
ttctctctgggagcgtggccgagca

SEQ ID NO: 450654 - DNA, 25 bp, Rattus norvegicus
tgtgcttttcgaaaggaacggagcc

SEQ ID NO: 450655 - DNA, 25 bp, Rattus norvegicus
gatcccggggcactcattgttgcga

SEQ ID NO: 450656 - DNA, 25 bp, Rattus norvegicus
caacttgtgtgtacgtcccgtccta

SEQ ID NO: 450657 - DNA, 25 bp, Rattus norvegicus
agcagcccaatcgtcatcgctttta

SEQ ID NO: 450658 - DNA, 25 bp, Rattus norvegicus
cggtaccctctcaggaaagccatgg

SEQ ID NO: 450659 - DNA, 25 bp, Rattus norvegicus
tcttttgccaacgtgcggtaccctc

SEQ ID NO: 450660 - DNA, 25 bp, Rattus norvegicus
cggctaaccgggtggaagctccaca

SEQ ID NO: 450661 - DNA, 25 bp, Rattus norvegicus
ctcgttctgaggaacgcggctaacc

SEQ ID NO: 450662 - DNA, 25 bp, Rattus norvegicus
cccgtccaatcagagggccggatga

SEQ ID NO: 450663 - DNA, 25 bp, Rattus norvegicus
tgccttcgatgtcccactgggtgtc

SEQ ID NO: 450664 - DNA, 25 bp, Rattus norvegicus
ggctgacggcgtgcattaccttcgt

SEQ ID NO: 450665 - DNA, 25 bp, Rattus norvegicus
ccacacaaaggagacttgaggctta

SEQ ID NO: 450666 - DNA, 25 bp, Rattus norvegicus
gccggatgagctgtgagccttccaa

SEQ ID NO: 450667 - DNA, 25 bp, Rattus norvegicus
cgactcggtcccaccaacttgtgtg

SEQ ID NO: 450668 - DNA, 25 bp, Rattus norvegicus
acagtctgtcctttgtctgagtgca

SEQ ID NO: 450669 - DNA, 25 bp, Rattus norvegicus
cgcctacaaaagcagcgctcgagtg

SEQ ID NO: 450670 - DNA, 25 bp, Rattus norvegicus
agaccaaacccgcaaactctgaacg

SEQ ID NO: 450671 - DNA, 25 bp, Rattus norvegicus
gcaaactctgaacgctcgctgcctt

SEQ ID NO: 450672 - DNA, 25 bp, Rattus norvegicus
aaactctgaacgctcgctgcctttc

SEQ ID NO: 450673 - DNA, 25 bp, Rattus norvegicus
aactctgaacgctcgctgcctttcg

SEQ ID NO: 450674 - DNA, 25 bp, Rattus norvegicus
tgcctttcgtctccaccggccctcc

SEQ ID NO: 450675 - DNA, 25 bp, Rattus norvegicus
tctgaacgctcgctgcctttcgtct

SEQ ID NO: 450676 - DNA, 25 bp, Rattus norvegicus
ctcgctgcctttcgtctccaccggc

SEQ ID NO: 450677 - DNA, 25 bp, Rattus norvegicus
tggcgaccgaccgacgacagcaaga

SEQ ID NO: 450678 - DNA, 25 bp, Rattus norvegicus
ggcgaccgaccgacgacagcaagac

SEQ ID NO: 450679 - DNA, 25 bp, Rattus norvegicus
accgaccgacgacagcaagaccaaa

SEQ ID NO: 450680 - DNA, 25 bp, Rattus norvegicus
gacgacagcaagaccaaacccgcaa

SEQ ID NO: 450681 - DNA, 25 bp, Rattus norvegicus
gacagcaagaccaaacccgcaaact

SEQ ID NO: 450682 - DNA, 25 bp, Rattus norvegicus
agcaagaccaaacccgcaaactctg

SEQ ID NO: 450683 - DNA, 25 bp, Rattus norvegicus
gctggcgaccgaccgacgacagcaa

SEQ ID NO: 450684 - DNA, 25 bp, Rattus norvegicus
acgccgacgcatacacacactacca

SEQ ID NO: 450685 - DNA, 25 bp, Rattus norvegicus
ctcatacccgcgcactgcacgctca

SEQ ID NO: 450686 - DNA, 25 bp, Rattus norvegicus
cgcactgcacgctcaccacagccta

SEQ ID NO: 450687 - DNA, 25 bp, Rattus norvegicus
cacactcacaatgcacgccgacgca

SEQ ID NO: 450688 - DNA, 25 bp, Rattus norvegicus
cgacgcatacacacactaccaacgc

SEQ ID NO: 450689 - DNA, 25 bp, Rattus norvegicus
gcctcctccttaacacaaaacaaca

SEQ ID NO: 450690 - DNA, 25 bp, Rattus norvegicus
tccttaacacaaaacaacaactaca

SEQ ID NO: 450691 - DNA, 25 bp, Rattus norvegicus
acaacaactacaacacgccctacgc

SEQ ID NO: 450692 - DNA, 25 bp, Rattus norvegicus
acaacacgccctacgcccgacacca

SEQ ID NO: 450693 - DNA, 25 bp, Rattus norvegicus
cgccctacgcccgacaccacaccac

SEQ ID NO: 450694 - DNA, 25 bp, Rattus norvegicus
cctctctctttcaccctcgctcgct

SEQ ID NO: 450695 - DNA, 25 bp, Rattus norvegicus
ttcaccctcgctcgctcattcactc

SEQ ID NO: 450696 - DNA, 25 bp, Rattus norvegicus
ccactaccggaccacgggacatgct

SEQ ID NO: 450697 - DNA, 25 bp, Rattus norvegicus
tacacacactaccaacgcctcctcc

SEQ ID NO: 450698 - DNA, 25 bp, Rattus norvegicus
ccctgcagttgcattgcggaaaatc

SEQ ID NO: 450699 - DNA, 25 bp, Rattus norvegicus
gtagacttcttctggcatccgagca

SEQ ID NO: 450700 - DNA, 25 bp, Rattus norvegicus
ggcagcatcgcctgaacccagcttg

SEQ ID NO: 450701 - DNA, 25 bp, Rattus norvegicus
cttaggctcggcatcctggcagcat

SEQ ID NO: 450702 - DNA, 25 bp, Rattus norvegicus
cgctggtacccggacttagagcgtc

SEQ ID NO: 450703 - DNA, 25 bp, Rattus norvegicus
ccgagggaatgaacacagcgcagtc

SEQ ID NO: 450704 - DNA, 25 bp, Rattus norvegicus
cctcctctccaagtgggaaggcgtc

SEQ ID NO: 450705 - DNA, 25 bp, Rattus norvegicus
ggctcctcacgtagctggtctgata

SEQ ID NO: 450706 - DNA, 25 bp, Rattus norvegicus
ggcaagagttgcacctgatcaggga

SEQ ID NO: 450707 - DNA, 25 bp, Rattus norvegicus
cagggaacctgcgaagataactgtg

SEQ ID NO: 450708 - DNA, 25 bp, Rattus norvegicus
atccttcaaattccgctgccgaggg

SEQ ID NO: 450709 - DNA, 25 bp, Rattus norvegicus
agtcccgcaccgcttctctgtagtg

SEQ ID NO: 450710 - DNA, 25 bp, Rattus norvegicus
ctctgtagtgaacgagcagccaaga

SEQ ID NO: 450711 - DNA, 25 bp, Rattus norvegicus
tgacgcccagctactgctcctaagg

SEQ ID NO: 450712 - DNA, 25 bp, Rattus norvegicus
aaagatacctgtgcataggcttgag

SEQ ID NO: 450713 - DNA, 25 bp, Rattus norvegicus
tactggcagtgctgcctcgcctctg

SEQ ID NO: 450714 - DNA, 25 bp, Rattus norvegicus
cggccctaggcgaacacgccgccca

SEQ ID NO: 450715 - DNA, 25 bp, Rattus norvegicus
ggcgccaagcctagccgagctcgga

SEQ ID NO: 450716 - DNA, 25 bp, Rattus norvegicus
agtgcctagctctttgcagacgctc

SEQ ID NO: 450717 - DNA, 25 bp, Rattus norvegicus
taagtcgttattaagtgcctagctc

SEQ ID NO: 450718 - DNA, 25 bp, Rattus norvegicus
tgctccgatccctaagtcgttatta

SEQ ID NO: 450719 - DNA, 25 bp, Rattus norvegicus
aatgcttcttgctccgatccctaag

SEQ ID NO: 450720 - DNA, 25 bp, Rattus norvegicus
cacccactgatggatagggcaatgc

SEQ ID NO: 450721 - DNA, 25 bp, Rattus norvegicus
gctgaagagctcacccactgatgga

SEQ ID NO: 450722 - DNA, 25 bp, Rattus norvegicus
tctggcaagggctcagagctgaaga

SEQ ID NO: 450723 - DNA, 25 bp, Rattus norvegicus
cttgaggttcatcacgggtgggtct

SEQ ID NO: 450724 - DNA, 25 bp, Rattus norvegicus
cctgcctggcatccctccttctgct

SEQ ID NO: 450725 - DNA, 25 bp, Rattus norvegicus
cctgtgcataggcttgaggttcatc

SEQ ID NO: 450726 - DNA, 25 bp, Rattus norvegicus
gtttgaatgcaagcccaaatgaagc

SEQ ID NO: 450727 - DNA, 25 bp, Rattus norvegicus
tcttccccgcagtaggcgccaggga

SEQ ID NO: 450728 - DNA, 25 bp, Rattus norvegicus
tgttgtggtcgggacgctgggcctc

SEQ ID NO: 450729 - DNA, 25 bp, Rattus norvegicus
aaagagtgtatgttgtggtcgggac

SEQ ID NO: 450730 - DNA, 25 bp, Rattus norvegicus
agccaaagagtgtatgttgtggtcg

SEQ ID NO: 450731 - DNA, 25 bp, Rattus norvegicus
gcgatggggagagccaaagagtgta

SEQ ID NO: 450732 - DNA, 25 bp, Rattus norvegicus
tgcaagcccaaatgaagcaaagggc

SEQ ID NO: 450733 - DNA, 25 bp, Rattus norvegicus
tgaatgcaagcccaaatgaagcaaa

SEQ ID NO: 450734 - DNA, 25 bp, Rattus norvegicus
tgcgtttgaatgcaagcccaaatga

SEQ ID NO: 450735 - DNA, 25 bp, Rattus norvegicus
cgtgcgtttgaatgcaagcccaaat

SEQ ID NO: 450736 - DNA, 25 bp, Rattus norvegicus
gcgtgcgtttgaatgcaagcccaaa

SEQ ID NO: 450737 - DNA, 25 bp, Rattus norvegicus
gtgcgtttgaatgcaagcccaaatg

SEQ ID NO: 450738 - DNA, 25 bp, Rattus norvegicus
aatgcaagcccaaatgaagcaaagg

SEQ ID NO: 450739 - DNA, 25 bp, Rattus norvegicus
gcgtttgaatgcaagcccaaatgaa

SEQ ID NO: 450740 - DNA, 25 bp, Rattus norvegicus
tgcctcgcaccgcattccggcgcga

SEQ ID NO: 450741 - DNA, 25 bp, Rattus norvegicus
cctgaaaaagcacggcgccagggcc

SEQ ID NO: 450742 - DNA, 25 bp, Rattus norvegicus
tgtatcctgaaaaagcacggcgcca

SEQ ID NO: 450743 - DNA, 25 bp, Rattus norvegicus
tgtgggtgtatcctgaaaaagcacg

SEQ ID NO: 450744 - DNA, 25 bp, Rattus norvegicus
cccttgtgtgggtgtatcctgaaaa

SEQ ID NO: 450745 - DNA, 25 bp, Rattus norvegicus
agcccacccttgtgtgggtgtatcc

SEQ ID NO: 450746 - DNA, 25 bp, Rattus norvegicus
ggaccgcgagcccacccttgtgtgg

SEQ ID NO: 450747 - DNA, 25 bp, Rattus norvegicus
gaaactgacactcgccgccgacccg

SEQ ID NO: 450748 - DNA, 25 bp, Rattus norvegicus
ggtcgcgcccgaaactgacactcgc

SEQ ID NO: 450749 - DNA, 25 bp, Rattus norvegicus
attccggcgcgacgccgacacctgg

SEQ ID NO: 450750 - DNA, 25 bp, Rattus norvegicus
ctcactccctgcctgcctcgcaccg

SEQ ID NO: 450751 - DNA, 25 bp, Rattus norvegicus
ttacccacgaccacaacaatgctcc

SEQ ID NO: 450752 - DNA, 25 bp, Rattus norvegicus
gacaacaacacctccttacccacga

SEQ ID NO: 450753 - DNA, 25 bp, Rattus norvegicus
gacacctggcggtcgcgcccgaaac

SEQ ID NO: 450754 - DNA, 25 bp, Rattus norvegicus
cttactaccgacctgccttctcacg

SEQ ID NO: 450755 - DNA, 25 bp, Rattus norvegicus
tgacaggccgctgtccttgggcatg

SEQ ID NO: 450756 - DNA, 25 bp, Rattus norvegicus
gacaggccgctgtccttgggcatgc

SEQ ID NO: 450757 - DNA, 25 bp, Rattus norvegicus
cgcctctccttgctagctagagccc

SEQ ID NO: 450758 - DNA, 25 bp, Rattus norvegicus
cctgacaggccgctgtccttgggca

SEQ ID NO: 450759 - DNA, 25 bp, Rattus norvegicus
ttactaccgacctgccttctcacgc

SEQ ID NO: 450760 - DNA, 25 bp, Rattus norvegicus
tactaccgacctgccttctcacgcc

SEQ ID NO: 450761 - DNA, 25 bp, Rattus norvegicus
ctaccgacctgccttctcacgcctc

SEQ ID NO: 450762 - DNA, 25 bp, Rattus norvegicus
taccgacctgccttctcacgcctct

SEQ ID NO: 450763 - DNA, 25 bp, Rattus norvegicus
accgacctgccttctcacgcctctc

SEQ ID NO: 450764 - DNA, 25 bp, Rattus norvegicus
tcacgcctctccttgctagctagag

SEQ ID NO: 450765 - DNA, 25 bp, Rattus norvegicus
cacgcctctccttgctagctagagc

SEQ ID NO: 450766 - DNA, 25 bp, Rattus norvegicus
acgcctctccttgctagctagagcc

SEQ ID NO: 450767 - DNA, 25 bp, Rattus norvegicus
ctgacaggccgctgtccttgggcat

SEQ ID NO: 450768 - DNA, 25 bp, Rattus norvegicus
ttccggagcttcatggtaaggtgcc

SEQ ID NO: 450769 - DNA, 25 bp, Rattus norvegicus
caccggctgccactcggtttgcttg

SEQ ID NO: 450770 - DNA, 25 bp, Rattus norvegicus
tctgcgtttaaaactccgagcctta

SEQ ID NO: 450771 - DNA, 25 bp, Rattus norvegicus
cgcgcacctcggctctgcgtttaaa

SEQ ID NO: 450772 - DNA, 25 bp, Rattus norvegicus
agcctgagccttcagcgctggcgcg

SEQ ID NO: 450773 - DNA, 25 bp, Rattus norvegicus
ccgcacgaatcagggcgagagccgt

SEQ ID NO: 450774 - DNA, 25 bp, Rattus norvegicus
cagcccggtgattggttagaggcaa

SEQ ID NO: 450775 - DNA, 25 bp, Rattus norvegicus
cttctgattggctgcgccgcgacca

SEQ ID NO: 450776 - DNA, 25 bp, Rattus norvegicus
gagcgcaccaaaacctccaggaagt

SEQ ID NO: 450777 - DNA, 25 bp, Rattus norvegicus
gagcaggaccaacagccaagctttc

SEQ ID NO: 450778 - DNA, 25 bp, Rattus norvegicus
ctgtgtcagcgccaagagcaggacc

SEQ ID NO: 450779 - DNA, 25 bp, Rattus norvegicus
tcggtttgcttggagcgcccaagtc

SEQ ID NO: 450780 - DNA, 25 bp, Rattus norvegicus
ttcgtgcgcatcttcggcgctcgca

SEQ ID NO: 450781 - DNA, 25 bp, Rattus norvegicus
ctccaggaagttcagcccggtgatt

SEQ ID NO: 450782 - DNA, 25 bp, Rattus norvegicus
tgtaaacccgcaggacaccactgta

SEQ ID NO: 450783 - DNA, 25 bp, Rattus norvegicus
ggcagtctgcgtgcggtcaaattat

SEQ ID NO: 450784 - DNA, 25 bp, Rattus norvegicus
ttatgacactgtaaacccgcaggac

SEQ ID NO: 450785 - DNA, 25 bp, Rattus norvegicus
ggacaccactgtaaacgtgcggaaa

SEQ ID NO: 450786 - DNA, 25 bp, Rattus norvegicus
ctctgctggtgagaaaaggctacga

SEQ ID NO: 450787 - DNA, 25 bp, Rattus norvegicus
ccgctgcgacggtggcgcagacaaa

SEQ ID NO: 450788 - DNA, 25 bp, Rattus norvegicus
gtggcgcagacaaacgccgcgcaga

SEQ ID NO: 450789 - DNA, 25 bp, Rattus norvegicus
aaacgccgcgcagaggaggctttgt

SEQ ID NO: 450790 - DNA, 25 bp, Rattus norvegicus
cctgcctaagctctgtccgctccga

SEQ ID NO: 450791 - DNA, 25 bp, Rattus norvegicus
gacgcgcctagcctgagctttgtcc

SEQ ID NO: 450792 - DNA, 25 bp, Rattus norvegicus
gcgacaaaggaggtacccgcttcgc

SEQ ID NO: 450793 - DNA, 25 bp, Rattus norvegicus
aaggcgtttgctctgctggtgagaa

SEQ ID NO: 450794 - DNA, 25 bp, Rattus norvegicus
cgtgcggtcaaattatgacactgta

SEQ ID NO: 450795 - DNA, 25 bp, Rattus norvegicus
gaaaaggctacgaagccgctgcgac

SEQ ID NO: 450796 - DNA, 25 bp, Rattus norvegicus
aggccggcagagtgcctgcagtact

SEQ ID NO: 450797 - DNA, 25 bp, Rattus norvegicus
gcgtaggctgccagctactcagcta

SEQ ID NO: 450798 - DNA, 25 bp, Rattus norvegicus
gggctcgaggtgtttttgaaatcca

SEQ ID NO: 450799 - DNA, 25 bp, Rattus norvegicus
agtcctgtcagagcgagcaccgcga

SEQ ID NO: 450800 - DNA, 25 bp, Rattus norvegicus
gagaccgcgtcttgctgtctgcaga

SEQ ID NO: 450801 - DNA, 25 bp, Rattus norvegicus
ctgtctgcagagagcactgagcggc

SEQ ID NO: 450802 - DNA, 25 bp, Rattus norvegicus
tccacgagccattctgtacagcggt

SEQ ID NO: 450803 - DNA, 25 bp, Rattus norvegicus
tgtttctaacctacacgcgccgcgg

SEQ ID NO: 450804 - DNA, 25 bp, Rattus norvegicus
taggcttagccattcgtgcgtgtgc

SEQ ID NO: 450805 - DNA, 25 bp, Rattus norvegicus
ggaaggccgacacagcgtaggctta

SEQ ID NO: 450806 - DNA, 25 bp, Rattus norvegicus
tcctgacagactgcgggacgactga

SEQ ID NO: 450807 - DNA, 25 bp, Rattus norvegicus
acagcggtgagagctgtcgttgcta

SEQ ID NO: 450808 - DNA, 25 bp, Rattus norvegicus
tgcacgggcatctctgtcacccggg

SEQ ID NO: 450809 - DNA, 25 bp, Rattus norvegicus
tgcagtactcgctgcccacaaagcg

SEQ ID NO: 450810 - DNA, 25 bp, Rattus norvegicus
ccggcttgtcgttctcgagcatcag

SEQ ID NO: 450811 - DNA, 25 bp, Rattus norvegicus
agttcctctgggaaggccaatcttc

SEQ ID NO: 450812 - DNA, 25 bp, Rattus norvegicus
ggcaacatattggaagggactcaga

SEQ ID NO: 450813 - DNA, 25 bp, Rattus norvegicus
ccagcacaacttctcggaggcaaca

SEQ ID NO: 450814 - DNA, 25 bp, Rattus norvegicus
cggcgtgactggagtggaaattttt

SEQ ID NO: 450815 - DNA, 25 bp, Rattus norvegicus
ctcagaaaggccagagtacaaatga

SEQ ID NO: 450816 - DNA, 25 bp, Rattus norvegicus
aaacgcagacgttcacgtggagccc

SEQ ID NO: 450817 - DNA, 25 bp, Rattus norvegicus
agcatcaggcggttccgctgccgaa

SEQ ID NO: 450818 - DNA, 25 bp, Rattus norvegicus
catcctcgacgtcgccgaagacaag

SEQ ID NO: 450819 - DNA, 25 bp, Rattus norvegicus
cagctcgtagcccagaaccagaggc

SEQ ID NO: 450820 - DNA, 25 bp, Rattus norvegicus
cttcagcaaaccaagccagcagttg

SEQ ID NO: 450821 - DNA, 25 bp, Rattus norvegicus
gaaacttctcttcctgctgactctg

SEQ ID NO: 450822 - DNA, 25 bp, Rattus norvegicus
cagttgagcgcctgctggatgcgaa

SEQ ID NO: 450823 - DNA, 25 bp, Rattus norvegicus
aaccagaggcagagagcgctacggc

SEQ ID NO: 450824 - DNA, 25 bp, Rattus norvegicus
cggggaacagcactcccaggatgca

SEQ ID NO: 450825 - DNA, 25 bp, Rattus norvegicus
gcgcctggaaaacgttcttcttctc

SEQ ID NO: 450826 - DNA, 25 bp, Rattus norvegicus
actcgcctgggtttgcggcaggcct

SEQ ID NO: 450827 - DNA, 25 bp, Rattus norvegicus
aggatgcagtttgtgtcaacacggc

SEQ ID NO: 450828 - DNA, 25 bp, Rattus norvegicus
tttgtgtcaacacggccgcagcctc

SEQ ID NO: 450829 - DNA, 25 bp, Rattus norvegicus
aggtctgccatcaggagccagcgct

SEQ ID NO: 450830 - DNA, 25 bp, Rattus norvegicus
aaatggccgagggaatgccgcccat

SEQ ID NO: 450831 - DNA, 25 bp, Rattus norvegicus
tgccgaaacccagggcccgcaggat

SEQ ID NO: 450832 - DNA, 25 bp, Rattus norvegicus
actgtttgctcctacgggctgtaga

SEQ ID NO: 450833 - DNA, 25 bp, Rattus norvegicus
aagcaaggctgtgttgcccaggacc

SEQ ID NO: 450834 - DNA, 25 bp, Rattus norvegicus
tggccgcttcactgagcggggactc

SEQ ID NO: 450835 - DNA, 25 bp, Rattus norvegicus
ctcgggttcctcttggcgtccgact

SEQ ID NO: 450836 - DNA, 25 bp, Rattus norvegicus
atgccgcgctgccacggtgcagctg

SEQ ID NO: 450837 - DNA, 25 bp, Rattus norvegicus
agcgccaccgaagggtactgtttgc

SEQ ID NO: 450838 - DNA, 25 bp, Rattus norvegicus
cggcactggtgcgagtagtagcaca

SEQ ID NO: 450839 - DNA, 25 bp, Rattus norvegicus
gcttccgctacaaggagtcactcaa

SEQ ID NO: 450840 - DNA, 25 bp, Rattus norvegicus
gagtttcatccgcaagcagaacctg

SEQ ID NO: 450841 - DNA, 25 bp, Rattus norvegicus
cgcgctctgtggcaagagtttcatc

SEQ ID NO: 450842 - DNA, 25 bp, Rattus norvegicus
tacagccgcaaggagcatctgcaga

SEQ ID NO: 450843 - DNA, 25 bp, Rattus norvegicus
ctcggagtgcgagaagacctacagc

SEQ ID NO: 450844 - DNA, 25 bp, Rattus norvegicus
gccaccagatgacgcaccgcggtga

SEQ ID NO: 450845 - DNA, 25 bp, Rattus norvegicus
cttcggagtgcgaaagagcctcatc

SEQ ID NO: 450846 - DNA, 25 bp, Rattus norvegicus
aagccctactcttgcctggaatgcg

SEQ ID NO: 450847 - DNA, 25 bp, Rattus norvegicus
tagcctcctggaggacggcttccct

SEQ ID NO: 450848 - DNA, 25 bp, Rattus norvegicus
gtcactcaaggaccacctgcgtgtg

SEQ ID NO: 450849 - DNA, 25 bp, Rattus norvegicus
agcggccctacaaatgctcggagtg

SEQ ID NO: 450850 - DNA, 25 bp, Rattus norvegicus
cctggaatgcggcaagaccttcgga

SEQ ID NO: 450851 - DNA, 25 bp, Rattus norvegicus
cgcggaatgcgagaagagcttcaac

SEQ ID NO: 450852 - DNA, 25 bp, Rattus norvegicus
gagcggcgctttgccatttggtgct

SEQ ID NO: 450853 - DNA, 25 bp, Rattus norvegicus
agcgcgcatgctcggcctggggagc

SEQ ID NO: 450854 - DNA, 25 bp, Rattus norvegicus
ctttgccatttggtgctggtcgtgc

SEQ ID NO: 450855 - DNA, 25 bp, Rattus norvegicus
gccatttggtgctggtcgtgcttct

SEQ ID NO: 450856 - DNA, 25 bp, Rattus norvegicus
tttggtgctggtcgtgcttctgcga

SEQ ID NO: 450857 - DNA, 25 bp, Rattus norvegicus
tggtcgtgcttctgcgagggaagga

SEQ ID NO: 450858 - DNA, 25 bp, Rattus norvegicus
cccagacacgctctcggcctgccgg

SEQ ID NO: 450859 - DNA, 25 bp, Rattus norvegicus
cctgcgccctgtcggttgggaagaa

SEQ ID NO: 450860 - DNA, 25 bp, Rattus norvegicus
ttgggaagaagtacgggctcttcgc

SEQ ID NO: 450861 - DNA, 25 bp, Rattus norvegicus
aagaagtacgggctcttcgcgggca

SEQ ID NO: 450862 - DNA, 25 bp, Rattus norvegicus
agtacgggctcttcgcgggcactgt

SEQ ID NO: 450863 - DNA, 25 bp, Rattus norvegicus
cactgtgggcgacgtgttactgccc

SEQ ID NO: 450864 - DNA, 25 bp, Rattus norvegicus
gggcgacgtgttactgcccagcgcc

SEQ ID NO: 450865 - DNA, 25 bp, Rattus norvegicus
gtgttactgcccagcgccccggtgg

SEQ ID NO: 450866 - DNA, 25 bp, Rattus norvegicus
ggtactctgcgtctttccgtagaaa

SEQ ID NO: 450867 - DNA, 25 bp, Rattus norvegicus
gggcgctcccataatgcaccttgta

SEQ ID NO: 450868 - DNA, 25 bp, Rattus norvegicus
accttgtatcaacacggcggctgtg

SEQ ID NO: 450869 - DNA, 25 bp, Rattus norvegicus
tccgggcgactggtggagcaacaca

SEQ ID NO: 450870 - DNA, 25 bp, Rattus norvegicus
tggagcaacacagtccgagcactct

SEQ ID NO: 450871 - DNA, 25 bp, Rattus norvegicus
gcactctcccgccagtcggtgttgt

SEQ ID NO: 450872 - DNA, 25 bp, Rattus norvegicus
cgactgtgaccatggcggagtcgac

SEQ ID NO: 450873 - DNA, 25 bp, Rattus norvegicus
accatggcggagtcgacgcctgctc

SEQ ID NO: 450874 - DNA, 25 bp, Rattus norvegicus
tggcgccggcggatgccgactttcc

SEQ ID NO: 450875 - DNA, 25 bp, Rattus norvegicus
tcgctctctgggtccttctgcgtca

SEQ ID NO: 450876 - DNA, 25 bp, Rattus norvegicus
tccttctgcgtcaggctcagaggct

SEQ ID NO: 450877 - DNA, 25 bp, Rattus norvegicus
ctcagaggctgggtactctgcgtct

SEQ ID NO: 450878 - DNA, 25 bp, Rattus norvegicus
gcaacagatataccgcgcggtagga

SEQ ID NO: 450879 - DNA, 25 bp, Rattus norvegicus
gcgtctttccgtagaaacttctgcg

SEQ ID NO: 450880 - DNA, 25 bp, Rattus norvegicus
ccgctagacagcagctccgaagttg

SEQ ID NO: 450881 - DNA, 25 bp, Rattus norvegicus
acggcgtgcggtccgtctgacttca

SEQ ID NO: 450882 - DNA, 25 bp, Rattus norvegicus
gcggcctcagcagcagctctgttaa

SEQ ID NO: 450883 - DNA, 25 bp, Rattus norvegicus
cagctctgttaaaggacctgcttgc

SEQ ID NO: 450884 - DNA, 25 bp, Rattus norvegicus
agtttgcggccgctagacagcagct

SEQ ID NO: 450885 - DNA, 25 bp, Rattus norvegicus
tagccatagctgaagcggcgcctgc

SEQ ID NO: 450886 - DNA, 25 bp, Rattus norvegicus
cagcagctccgaagttgggcggctt

SEQ ID NO: 450887 - DNA, 25 bp, Rattus norvegicus
aagttgggcggcttcgacttctcac

SEQ ID NO: 450888 - DNA, 25 bp, Rattus norvegicus
ggcttcgacttctcaccgacgagca

SEQ ID NO: 450889 - DNA, 25 bp, Rattus norvegicus
gcagcccgcgcctggctatatctgt

SEQ ID NO: 450890 - DNA, 25 bp, Rattus norvegicus
tggctatatctgtcggcggaggacc

SEQ ID NO: 450891 - DNA, 25 bp, Rattus norvegicus
aggaccgcagccctgcgacgacgtg

SEQ ID NO: 450892 - DNA, 25 bp, Rattus norvegicus
ctgcgacgacgtggtagccatagct

SEQ ID NO: 450893 - DNA, 25 bp, Rattus norvegicus
gttaaaggacctgcttgctgggcgc

SEQ ID NO: 450894 - DNA, 25 bp, Rattus norvegicus
actcggcgcgcggaaacagtctgcg

SEQ ID NO: 450895 - DNA, 25 bp, Rattus norvegicus
tcaggggccagccacccttgggcgt

SEQ ID NO: 450896 - DNA, 25 bp, Rattus norvegicus
aggccttttcggtgctggccgccag

SEQ ID NO: 450897 - DNA, 25 bp, Rattus norvegicus
ctccgaggccttttcggtgctggcc

SEQ ID NO: 450898 - DNA, 25 bp, Rattus norvegicus
ggcctccgaggccttttcggtgctg

SEQ ID NO: 450899 - DNA, 25 bp, Rattus norvegicus
tcccattcctagagcggccaccagc

SEQ ID NO: 450900 - DNA, 25 bp, Rattus norvegicus
gcggaaacagtctgcgccaccacca

SEQ ID NO: 450901 - DNA, 25 bp, Rattus norvegicus
ctttcaggggccagccacccttggg

SEQ ID NO: 450902 - DNA, 25 bp, Rattus norvegicus
gactggcctttcaggggccagccac

SEQ ID NO: 450903 - DNA, 25 bp, Rattus norvegicus
aggcgaggctgggactggcctttca

SEQ ID NO: 450904 - DNA, 25 bp, Rattus norvegicus
gaatcgctgcaatggaagggcacgc

SEQ ID NO: 450905 - DNA, 25 bp, Rattus norvegicus
acggtgaggaatcgctgcaatggaa

SEQ ID NO: 450906 - DNA, 25 bp, Rattus norvegicus
cgaacggtgaggaatcgctgcaatg

SEQ ID NO: 450907 - DNA, 25 bp, Rattus norvegicus
cggcgcgcggaaacagtctgcgcca

SEQ ID NO: 450908 - DNA, 25 bp, Rattus norvegicus
acttgagggactgtttgtagcggaa

SEQ ID NO: 450909 - DNA, 25 bp, Rattus norvegicus
cgcatgctcactcgcccgtgtgggt

SEQ ID NO: 450910 - DNA, 25 bp, Rattus norvegicus
acttagcacagtgcgtgcaggggta

SEQ ID NO: 450911 - DNA, 25 bp, Rattus norvegicus
tgtgcgctcgctggtgctccagcag

SEQ ID NO: 450912 - DNA, 25 bp, Rattus norvegicus
tgtgaagcgcttgccacactcagcg

SEQ ID NO: 450913 - DNA, 25 bp, Rattus norvegicus
acactcagcgcagtggtagggccgc

SEQ ID NO: 450914 - DNA, 25 bp, Rattus norvegicus
cggcagtggttagtgagcttagatt

SEQ ID NO: 450915 - DNA, 25 bp, Rattus norvegicus
gtgagcttagatttctcactgaagc

SEQ ID NO: 450916 - DNA, 25 bp, Rattus norvegicus
tgaagctcttctcacactccgggca

SEQ ID NO: 450917 - DNA, 25 bp, Rattus norvegicus
acttgaagggccgttcaccggtatg

SEQ ID NO: 450918 - DNA, 25 bp, Rattus norvegicus
tcaccggtatgagtccgctggtggc

SEQ ID NO: 450919 - DNA, 25 bp, Rattus norvegicus
aagctcttgccgcacaggctgcaaa

SEQ ID NO: 450920 - DNA, 25 bp, Rattus norvegicus
acaggctgcaaatgaaggagacttc

SEQ ID NO: 450921 - DNA, 25 bp, Rattus norvegicus
aggagacttcgtgcttgccagcatg

SEQ ID NO: 450922 - DNA, 25 bp, Rattus norvegicus
ccgagctctgcggaaaacgtgccgc

SEQ ID NO: 450923 - DNA, 25 bp, Rattus norvegicus
gcagaggctatggatcacaccgtta

SEQ ID NO: 450924 - DNA, 25 bp, Rattus norvegicus
ggatcacaccgttaaccacgccgga

SEQ ID NO: 450925 - DNA, 25 bp, Rattus norvegicus
ttaaccacgccggagtcgctgggct

SEQ ID NO: 450926 - DNA, 25 bp, Rattus norvegicus
ggccgtagcccgtgctcggtcagct

SEQ ID NO: 450927 - DNA, 25 bp, Rattus norvegicus
agcccgtgctcggtcagctcaggct

SEQ ID NO: 450928 - DNA, 25 bp, Rattus norvegicus
cgggccgactcgctacgtgaccttg

SEQ ID NO: 450929 - DNA, 25 bp, Rattus norvegicus
tcgctacgtgaccttggggcaggca

SEQ ID NO: 450930 - DNA, 25 bp, Rattus norvegicus
ccgggtgtccgtgcctcagtgtctc

SEQ ID NO: 450931 - DNA, 25 bp, Rattus norvegicus
gcctcagtgtctccgctctgcgaaa

SEQ ID NO: 450932 - DNA, 25 bp, Rattus norvegicus
tctgcgaaatgggagagccgcgtca

SEQ ID NO: 450933 - DNA, 25 bp, Rattus norvegicus
cgaaatgggagagccgcgtcagcac

SEQ ID NO: 450934 - DNA, 25 bp, Rattus norvegicus
gctcctgacgcagaggctatggatc

SEQ ID NO: 450935 - DNA, 25 bp, Rattus norvegicus
tctgcggaaaacgtgccgccggcca

SEQ ID NO: 450936 - DNA, 25 bp, Rattus norvegicus
gaacgctctgtgaagcgcttctcgc

SEQ ID NO: 450937 - DNA, 25 bp, Rattus norvegicus
cggctgaccgtgtgcaggtgcctta

SEQ ID NO: 450938 - DNA, 25 bp, Rattus norvegicus
gtgccttagccactgccgggtggtt

SEQ ID NO: 450939 - DNA, 25 bp, Rattus norvegicus
gatgaagctctttccacacactgtg

SEQ ID NO: 450940 - DNA, 25 bp, Rattus norvegicus
ctctttccacacactgtgcaggtga

SEQ ID NO: 450941 - DNA, 25 bp, Rattus norvegicus
cgcacgcctgtgtgcgttcggtagt

SEQ ID NO: 450942 - DNA, 25 bp, Rattus norvegicus
acctccgcctcctgtagcggtggaa

SEQ ID NO: 450943 - DNA, 25 bp, Rattus norvegicus
atgagcttggaacgctctgtgaagc

SEQ ID NO: 450944 - DNA, 25 bp, Rattus norvegicus
accgtgtgcaggtgccttagccact

SEQ ID NO: 450945 - DNA, 25 bp, Rattus norvegicus
gaagggcctctcaccagtgtgtagc

SEQ ID NO: 450946 - DNA, 25 bp, Rattus norvegicus
tcaccagtgtgtagcatgcggtggc

SEQ ID NO: 450947 - DNA, 25 bp, Rattus norvegicus
gctgctgtcccgtgcactgcttcca

SEQ ID NO: 450948 - DNA, 25 bp, Rattus norvegicus
gcactgcttccacctgcgctgctgc

SEQ ID NO: 450949 - DNA, 25 bp, Rattus norvegicus
agtggtcgatgagcttggaacgctc

SEQ ID NO: 450950 - DNA, 25 bp, Rattus norvegicus
acgaaggcccgtgaggcttcctgga

SEQ ID NO: 450951 - DNA, 25 bp, Rattus norvegicus
cctaaaccgggctgagtgcagcgcc

SEQ ID NO: 450952 - DNA, 25 bp, Rattus norvegicus
cagtctggctggacaaatacgagca

SEQ ID NO: 450953 - DNA, 25 bp, Rattus norvegicus
atacgagcagtactcgcgtgccgcc

SEQ ID NO: 450954 - DNA, 25 bp, Rattus norvegicus
gttgggcacatagtgggtgctcact

SEQ ID NO: 450955 - DNA, 25 bp, Rattus norvegicus
gggtgctcactatctacggaatcga

SEQ ID NO: 450956 - DNA, 25 bp, Rattus norvegicus
tcgtcacagccataggacccgcagg

SEQ ID NO: 450957 - DNA, 25 bp, Rattus norvegicus
cacctgcagctcgagcggcgaacgg

SEQ ID NO: 450958 - DNA, 25 bp, Rattus norvegicus
cggcgccagtgctttccagaagtgt

SEQ ID NO: 450959 - DNA, 25 bp, Rattus norvegicus
ttccagaagtgtccacgcagtcacg

SEQ ID NO: 450960 - DNA, 25 bp, Rattus norvegicus
tggccacctggtttggcggtataaa

SEQ ID NO: 450961 - DNA, 25 bp, Rattus norvegicus
acgcagtcacggagcagtggccacc

SEQ ID NO: 450962 - DNA, 25 bp, Rattus norvegicus
gaatcgacgtcggacacctcccagg

SEQ ID NO: 450963 - DNA, 25 bp, Rattus norvegicus
ttggcggtataaagcttgggcgtac

SEQ ID NO: 450964 - DNA, 25 bp, Rattus norvegicus
ctactggcgggagaacgaaactccg

SEQ ID NO: 450965 - DNA, 25 bp, Rattus norvegicus
tccggcaacccaacagcagaggcga

SEQ ID NO: 450966 - DNA, 25 bp, Rattus norvegicus
cgaaggaacttcatggccaccaggc

SEQ ID NO: 450967 - DNA, 25 bp, Rattus norvegicus
cccttctgctcgaatcgcttgatga

SEQ ID NO: 450968 - DNA, 25 bp, Rattus norvegicus
tcgcttgatgatctcgcccaccagg

SEQ ID NO: 450969 - DNA, 25 bp, Rattus norvegicus
gcgctgcacgccatctggcttgatg

SEQ ID NO: 450970 - DNA, 25 bp, Rattus norvegicus
gcttgatggcaatgaaggtacgctc

SEQ ID NO: 450971 - DNA, 25 bp, Rattus norvegicus
tggccatggtcctgcagaagcaaga

SEQ ID NO: 450972 - DNA, 25 bp, Rattus norvegicus
gcaagaagtgtagtcgatgaggccc

SEQ ID NO: 450973 - DNA, 25 bp, Rattus norvegicus
cggaggacacgtggctttccagata

SEQ ID NO: 450974 - DNA, 25 bp, Rattus norvegicus
ggggagtgcatccaagccttaccga

SEQ ID NO: 450975 - DNA, 25 bp, Rattus norvegicus
agactagaacgaccaccagccggcg

SEQ ID NO: 450976 - DNA, 25 bp, Rattus norvegicus
agcctgcctgatcttgccagtcgtc

SEQ ID NO: 450977 - DNA, 25 bp, Rattus norvegicus
agacgacgtggacaaactactggcg

SEQ ID NO: 450978 - DNA, 25 bp, Rattus norvegicus
ggccgcctgcgcgtctcaaacccag

SEQ ID NO: 450979 - DNA, 25 bp, Rattus norvegicus
cgggccgatgggctccgacagcctt

SEQ ID NO: 450980 - DNA, 25 bp, Rattus norvegicus
cggtcgttggctttcaaaacctgcg

SEQ ID NO: 450981 - DNA, 25 bp, Rattus norvegicus
tggctttcaaaacctgcgctcacaa

SEQ ID NO: 450982 - DNA, 25 bp, Rattus norvegicus
aacctgcgctcacaaagggatcgga

SEQ ID NO: 450983 - DNA, 25 bp, Rattus norvegicus
tgcgctcacaaagggatcggagaga

SEQ ID NO: 450984 - DNA, 25 bp, Rattus norvegicus
gggatcggagagagccgtcacacca

SEQ ID NO: 450985 - DNA, 25 bp, Rattus norvegicus
gagagagccgtcacaccagagaaag

SEQ ID NO: 450986 - DNA, 25 bp, Rattus norvegicus
cgtcacaccagagaaagccggagtt

SEQ ID NO: 450987 - DNA, 25 bp, Rattus norvegicus
acaccagagaaagccggagttcatg

SEQ ID NO: 450988 - DNA, 25 bp, Rattus norvegicus
agccggagttcatgtgaccagcgca

SEQ ID NO: 450989 - DNA, 25 bp, Rattus norvegicus
gagttcatgtgaccagcgcagtgca

SEQ ID NO: 450990 - DNA, 25 bp, Rattus norvegicus
ttcatgtgaccagcgcagtgcagcc

SEQ ID NO: 450991 - DNA, 25 bp, Rattus norvegicus
cagcgcagtgcagcccgggttccag

SEQ ID NO: 450992 - DNA, 25 bp, Rattus norvegicus
cgctccaggtaagacgagccgttgc

SEQ ID NO: 450993 - DNA, 25 bp, Rattus norvegicus
gcctatgagagaagctggtcccttt

SEQ ID NO: 450994 - DNA, 25 bp, Rattus norvegicus
ggtccctttttatccacgcatccga

SEQ ID NO: 450995 - DNA, 25 bp, Rattus norvegicus
gcacctgtacaggacgcgctcagaa

SEQ ID NO: 450996 - DNA, 25 bp, Rattus norvegicus
cgccggatgctgaaggaaacgcatg

SEQ ID NO: 450997 - DNA, 25 bp, Rattus norvegicus
aacggttgtttgcacctgagcatgc

SEQ ID NO: 450998 - DNA, 25 bp, Rattus norvegicus
agcctgacaggatgtagcgaatgcc

SEQ ID NO: 450999 - DNA, 25 bp, Rattus norvegicus
agcgaatgccaagagggtccctgaa

SEQ ID NO: 451000 - DNA, 25 bp, Rattus norvegicus
cttgcgtcgttctcgctgtgaggct

SEQ ID NO: 451001 - DNA, 25 bp, Rattus norvegicus
ggccgacccagaggagccaactctg

SEQ ID NO: 451002 - DNA, 25 bp, Rattus norvegicus
cgcttcctgtcgtgcagaactgggc

SEQ ID NO: 451003 - DNA, 25 bp, Rattus norvegicus
tcgcgaagctgagttccgccatggc

SEQ ID NO: 451004 - DNA, 25 bp, Rattus norvegicus
gtttacgtgactgcggcctatgaga

SEQ ID NO: 451005 - DNA, 25 bp, Rattus norvegicus
ccgactttgagcttgggtgagcgca

SEQ ID NO: 451006 - DNA, 25 bp, Rattus norvegicus
cggcccaggtgagatttccgactga

SEQ ID NO: 451007 - DNA, 25 bp, Rattus norvegicus
actgagcacaggcaaatggcctttc

SEQ ID NO: 451008 - DNA, 25 bp, Rattus norvegicus
ttggtgccgagtgcacattcatcgc

SEQ ID NO: 451009 - DNA, 25 bp, Rattus norvegicus
ctgatgcgtagcgaggttctttttc

SEQ ID NO: 451010 - DNA, 25 bp, Rattus norvegicus
tagcagcatcgtgcaccctctggtg

SEQ ID NO: 451011 - DNA, 25 bp, Rattus norvegicus
aagctgcgtgtacactgggtgcact

SEQ ID NO: 451012 - DNA, 25 bp, Rattus norvegicus
atcaggtgcgtcttcttgcggaaac

SEQ ID NO: 451013 - DNA, 25 bp, Rattus norvegicus
ggaaacgcttctcgcattccgtgca

SEQ ID NO: 451014 - DNA, 25 bp, Rattus norvegicus
gtgcgagcctaggtgaatcttctgg

SEQ ID NO: 451015 - DNA, 25 bp, Rattus norvegicus
atcttctggctgaagcgtttgccgc

SEQ ID NO: 451016 - DNA, 25 bp, Rattus norvegicus
caggtgggctttcttgctgaaacgc

SEQ ID NO: 451017 - DNA, 25 bp, Rattus norvegicus
gctgaaacgcttatcgcactctgag

SEQ ID NO: 451018 - DNA, 25 bp, Rattus norvegicus
gaagcatatgagcacgctgcgtgaa

SEQ ID NO: 451019 - DNA, 25 bp, Rattus norvegicus
actgtgcacaggcaaaaggtctggc

SEQ ID NO: 451020 - DNA, 25 bp, Rattus norvegicus
tcagaaatgcggcaggagccacttg

SEQ ID NO: 451021 - DNA, 25 bp, Rattus norvegicus
actttttgagtttctggtccatggg

SEQ ID NO: 451022 - DNA, 25 bp, Rattus norvegicus
ggggcgcgcaaagccacgaaaagca

SEQ ID NO: 451023 - DNA, 25 bp, Rattus norvegicus
gtgagagagcccagcaggactcaga

SEQ ID NO: 451024 - DNA, 25 bp, Rattus norvegicus
cccactccgctcgagtagaagtgtg

SEQ ID NO: 451025 - DNA, 25 bp, Rattus norvegicus
ttatcagtgcaggaatgcggcagcc

SEQ ID NO: 451026 - DNA, 25 bp, Rattus norvegicus
gggccgccggactatttctgtctta

SEQ ID NO: 451027 - DNA, 25 bp, Rattus norvegicus
tgtcggcgaattccctaaccgagaa

SEQ ID NO: 451028 - DNA, 25 bp, Rattus norvegicus
atgtttccctacttggcctgcctgg

SEQ ID NO: 451029 - DNA, 25 bp, Rattus norvegicus
ccagattccttgcagcaaatgtttc

SEQ ID NO: 451030 - DNA, 25 bp, Rattus norvegicus
caagggcacacacatctgcgggcgc

SEQ ID NO: 451031 - DNA, 25 bp, Rattus norvegicus
acacggtgtgcgagacaagggcaca

SEQ ID NO: 451032 - DNA, 25 bp, Rattus norvegicus
gcgccgtgccacaaaagggtgcaga

SEQ ID NO: 451033 - DNA, 25 bp, Rattus norvegicus
agatcggctcgtctcgccgcttctg

SEQ ID NO: 451034 - DNA, 25 bp, Rattus norvegicus
ggactgacagccctgaaacttcgcg

SEQ ID NO: 451035 - DNA, 25 bp, Rattus norvegicus
actgacagccctgaaacttcgcggg

SEQ ID NO: 451036 - DNA, 25 bp, Rattus norvegicus
gcggagggtcttcgagagacccgtc

SEQ ID NO: 451037 - DNA, 25 bp, Rattus norvegicus
gcccgaaagactcccggactgacag

SEQ ID NO: 451038 - DNA, 25 bp, Rattus norvegicus
ggctgcccgaaagactcccggactg

SEQ ID NO: 451039 - DNA, 25 bp, Rattus norvegicus
cgtttgcacaatggcgccggctgcc

SEQ ID NO: 451040 - DNA, 25 bp, Rattus norvegicus
tcccgggcggccgtttgcacaatgg

SEQ ID NO: 451041 - DNA, 25 bp, Rattus norvegicus
ttacctggcgggctcctgcggctac

SEQ ID NO: 451042 - DNA, 25 bp, Rattus norvegicus
cctcggtgtccttacctggcgggct

SEQ ID NO: 451043 - DNA, 25 bp, Rattus norvegicus
tgctccggagcctcggtgtccttac

SEQ ID NO: 451044 - DNA, 25 bp, Rattus norvegicus
gcggagatgcctgctccggagcctc

SEQ ID NO: 451045 - DNA, 25 bp, Rattus norvegicus
gcttgtaaagctccgtttgggtggc

SEQ ID NO: 451046 - DNA, 25 bp, Rattus norvegicus
gagccggcagggcttgtaaagctcc

SEQ ID NO: 451047 - DNA, 25 bp, Rattus norvegicus
gaacagtgcttcggggcaccaggct

SEQ ID NO: 451048 - DNA, 25 bp, Rattus norvegicus
tgcgtcacttgcgtaccctactagc

SEQ ID NO: 451049 - DNA, 25 bp, Rattus norvegicus
tatctgctgtgctaagcggtgagca

SEQ ID NO: 451050 - DNA, 25 bp, Rattus norvegicus
ggatgctggattcttccggaaccgc

SEQ ID NO: 451051 - DNA, 25 bp, Rattus norvegicus
cctttcgcaagttccggatgggctg

SEQ ID NO: 451052 - DNA, 25 bp, Rattus norvegicus
cagaacgcttgaaccggtgacagtc

SEQ ID NO: 451053 - DNA, 25 bp, Rattus norvegicus
tagcggcaacgcgttccttaaaaca

SEQ ID NO: 451054 - DNA, 25 bp, Rattus norvegicus
agctgtggttgtgtgatttgcgtca

SEQ ID NO: 451055 - DNA, 25 bp, Rattus norvegicus
tccagcacaaagagccagaagtagc

SEQ ID NO: 451056 - DNA, 25 bp, Rattus norvegicus
tgtactaatgaccaagccaatggga

SEQ ID NO: 451057 - DNA, 25 bp, Rattus norvegicus
catcgcaccgtcaaatgtactaatg

SEQ ID NO: 451058 - DNA, 25 bp, Rattus norvegicus
ggcccgcagcctggtattctgaatg

SEQ ID NO: 451059 - DNA, 25 bp, Rattus norvegicus
tcattgtggcgccttttatctgctg

SEQ ID NO: 451060 - DNA, 25 bp, Rattus norvegicus
gcaccgggcaccatttaacggatta

SEQ ID NO: 451061 - DNA, 25 bp, Rattus norvegicus
aacaacttttccagtgtcgcaccgc

SEQ ID NO: 451062 - DNA, 25 bp, Rattus norvegicus
ggcccactcgctaatcggaactgga

SEQ ID NO: 451063 - DNA, 25 bp, Rattus norvegicus
ttgtgaactcgaacctgctgctgtc

SEQ ID NO: 451064 - DNA, 25 bp, Rattus norvegicus
gccagcgaatgtggacggaggacac

SEQ ID NO: 451065 - DNA, 25 bp, Rattus norvegicus
actggaccggcgagccagcgaatgt

SEQ ID NO: 451066 - DNA, 25 bp, Rattus norvegicus
actcgctaatcggaactggaccggc

SEQ ID NO: 451067 - DNA, 25 bp, Rattus norvegicus
tgcgtgggacccgagatggcccact

SEQ ID NO: 451068 - DNA, 25 bp, Rattus norvegicus
cagctccacctgtggggcgcgtgac

SEQ ID NO: 451069 - DNA, 25 bp, Rattus norvegicus
tgctctatggatgggcgccgcgtcc

SEQ ID NO: 451070 - DNA, 25 bp, Rattus norvegicus
gtgaactcgaacctgctgctgtcgc

SEQ ID NO: 451071 - DNA, 25 bp, Rattus norvegicus
tccgcagctcctgtagtcacgtgga

SEQ ID NO: 451072 - DNA, 25 bp, Rattus norvegicus
acgggcctggcagttgtgaactcga

SEQ ID NO: 451073 - DNA, 25 bp, Rattus norvegicus
cctggcagttgtgaactcgaacctg

SEQ ID NO: 451074 - DNA, 25 bp, Rattus norvegicus
gagatggcccactcgctaatcggaa

SEQ ID NO: 451075 - DNA, 25 bp, Rattus norvegicus
taatcggaactggaccggcgagcca

SEQ ID NO: 451076 - DNA, 25 bp, Rattus norvegicus
agaccctttgtgtgcccagactgcg

SEQ ID NO: 451077 - DNA, 25 bp, Rattus norvegicus
cggccagacctttgacgatgaggac

SEQ ID NO: 451078 - DNA, 25 bp, Rattus norvegicus
cccacaccgggagtcacttgattgc

SEQ ID NO: 451079 - DNA, 25 bp, Rattus norvegicus
tcacttgattgcagcggagcctatg

SEQ ID NO: 451080 - DNA, 25 bp, Rattus norvegicus
gagcctatggcacaacctgcgcttg

SEQ ID NO: 451081 - DNA, 25 bp, Rattus norvegicus
ctgcgtccctgcatagctgcactga

SEQ ID NO: 451082 - DNA, 25 bp, Rattus norvegicus
gaccatgcaccagagagaccctttg

SEQ ID NO: 451083 - DNA, 25 bp, Rattus norvegicus
ctgtgatcgcagcttcagtcagaag

SEQ ID NO: 451084 - DNA, 25 bp, Rattus norvegicus
tccacaagcgctcagaggtctcagc

SEQ ID NO: 451085 - DNA, 25 bp, Rattus norvegicus
cccaacctgttgtcgcacagtaaaa

SEQ ID NO: 451086 - DNA, 25 bp, Rattus norvegicus
agaagccctacccatgcaccgagtg

SEQ ID NO: 451087 - DNA, 25 bp, Rattus norvegicus
tgcgggaagcgtttcaccaacaagc

SEQ ID NO: 451088 - DNA, 25 bp, Rattus norvegicus
agcgaccacaccagtgcccagagtg

SEQ ID NO: 451089 - DNA, 25 bp, Rattus norvegicus
gaacttcggcaagaaaacgcacctg

SEQ ID NO: 451090 - DNA, 25 bp, Rattus norvegicus
cccagcagtgttcaactcacagata

SEQ ID NO: 451091 - DNA, 25 bp, Rattus norvegicus
cgcacttatgccgagagttcagatg

SEQ ID NO: 451092 - DNA, 25 bp, Rattus norvegicus
tcagatgtcaatacacgcttgtgcg

SEQ ID NO: 451093 - DNA, 25 bp, Rattus norvegicus
cttgtgcgtgaagcagagcgctcaa

SEQ ID NO: 451094 - DNA, 25 bp, Rattus norvegicus
aatcatcgcgctgtcgtagagcaca

SEQ ID NO: 451095 - DNA, 25 bp, Rattus norvegicus
ataaattgcttagggctgcggggcc

SEQ ID NO: 451096 - DNA, 25 bp, Rattus norvegicus
caggcgaggtcagaccctggctatt

SEQ ID NO: 451097 - DNA, 25 bp, Rattus norvegicus
ttgctccaataggaccgggagtgtc

SEQ ID NO: 451098 - DNA, 25 bp, Rattus norvegicus
agtgtcatctgagccgagcatccaa

SEQ ID NO: 451099 - DNA, 25 bp, Rattus norvegicus
gcagttcccgttaaccttagccaca

SEQ ID NO: 451100 - DNA, 25 bp, Rattus norvegicus
accgagtccctgtgcaattctggcg

SEQ ID NO: 451101 - DNA, 25 bp, Rattus norvegicus
ctgctctgctgtcccggactgtaga

SEQ ID NO: 451102 - DNA, 25 bp, Rattus norvegicus
caccaggtggacaggcacagaatca

SEQ ID NO: 451103 - DNA, 25 bp, Rattus norvegicus
cctggctattggctccggagaacaa

SEQ ID NO: 451104 - DNA, 25 bp, Rattus norvegicus
ttgctcgcactgtgaacgcagcttc

SEQ ID NO: 451105 - DNA, 25 bp, Rattus norvegicus
gaagcagcaccttctcaagcacctg

SEQ ID NO: 451106 - DNA, 25 bp, Rattus norvegicus
ggcacctacgcaaccacacgggtga

SEQ ID NO: 451107 - DNA, 25 bp, Rattus norvegicus
gtgagcgaccctatgcgtgtcctga

SEQ ID NO: 451108 - DNA, 25 bp, Rattus norvegicus
ggtggtcatcgctgaacatccatca

SEQ ID NO: 451109 - DNA, 25 bp, Rattus norvegicus
gcaagagcttcacttggtggtcatc

SEQ ID NO: 451110 - DNA, 25 bp, Rattus norvegicus
aacagcgccagttcatctgcaatga

SEQ ID NO: 451111 - DNA, 25 bp, Rattus norvegicus
acccgcttaggtcctagtgaacagc

SEQ ID NO: 451112 - DNA, 25 bp, Rattus norvegicus
gggcgtatcgcctgcgcccagaatc

SEQ ID NO: 451113 - DNA, 25 bp, Rattus norvegicus
tacacgagatgctccggcatgctgc

SEQ ID NO: 451114 - DNA, 25 bp, Rattus norvegicus
tgcccgggtcaacttacacgagatg

SEQ ID NO: 451115 - DNA, 25 bp, Rattus norvegicus
gagcacatgcccgaaaccgcctagg

SEQ ID NO: 451116 - DNA, 25 bp, Rattus norvegicus
ctgctttcggcaccaagtgggcctc

SEQ ID NO: 451117 - DNA, 25 bp, Rattus norvegicus
tgtccagaatgtgagcgctgctttc

SEQ ID NO: 451118 - DNA, 25 bp, Rattus norvegicus
tgttcgcgcaggaccaggagcacca

SEQ ID NO: 451119 - DNA, 25 bp, Rattus norvegicus
cggtgctccacagcatctcgggatc

SEQ ID NO: 451120 - DNA, 25 bp, Rattus norvegicus
ggcccgggacggtgctccacagcat

SEQ ID NO: 451121 - DNA, 25 bp, Rattus norvegicus
gactcctgaagggcaggcctgagtc

SEQ ID NO: 451122 - DNA, 25 bp, Rattus norvegicus
aaccgtgccagggtggactcctgaa

SEQ ID NO: 451123 - DNA, 25 bp, Rattus norvegicus
gccaggcgcacaaccgtgccagggt

SEQ ID NO: 451124 - DNA, 25 bp, Rattus norvegicus
tcacccagtacgagcgggagaaggc

SEQ ID NO: 451125 - DNA, 25 bp, Rattus norvegicus
acgagcagctcatcacccagtacga

SEQ ID NO: 451126 - DNA, 25 bp, Rattus norvegicus
agctgttgcgggacgacaacgagca

SEQ ID NO: 451127 - DNA, 25 bp, Rattus norvegicus
agaacctggactcggtgttcgcgca

SEQ ID NO: 451128 - DNA, 25 bp, Rattus norvegicus
agcggctcatcgggcgctacgacga

SEQ ID NO: 451129 - DNA, 25 bp, Rattus norvegicus
ggtgtccggcctggccggctctatc

SEQ ID NO: 451130 - DNA, 25 bp, Rattus norvegicus
cggtgtggtataccaggaggagccc

SEQ ID NO: 451131 - DNA, 25 bp, Rattus norvegicus
cgggacgacaacgagcagctcatca

SEQ ID NO: 451132 - DNA, 25 bp, Rattus norvegicus
ttgttagccggttagacctcccagc

SEQ ID NO: 451133 - DNA, 25 bp, Rattus norvegicus
gtcagtgccgcgacttaattacttg

SEQ ID NO: 451134 - DNA, 25 bp, Rattus norvegicus
gtgtcggaacactggggtgactcct

SEQ ID NO: 451135 - DNA, 25 bp, Rattus norvegicus
ctcctccggaaagaaggatggcccg

SEQ ID NO: 451136 - DNA, 25 bp, Rattus norvegicus
cctttctccaccaggcaagttgtta

SEQ ID NO: 451137 - DNA, 25 bp, Rattus norvegicus
tgcggaagcgactaagctggcgact

SEQ ID NO: 451138 - DNA, 25 bp, Rattus norvegicus
ctctgcagcagaggtaagggctcca

SEQ ID NO: 451139 - DNA, 25 bp, Rattus norvegicus
ggcgccacgtgagtcccagactaga

SEQ ID NO: 451140 - DNA, 25 bp, Rattus norvegicus
gtcccagactagagcccaagatcag

SEQ ID NO: 451141 - DNA, 25 bp, Rattus norvegicus
ccaagatcaggagggaggttaccgt

SEQ ID NO: 451142 - DNA, 25 bp, Rattus norvegicus
gttaccgtatttatcgaggccagtg

SEQ ID NO: 451143 - DNA, 25 bp, Rattus norvegicus
tatttgcccggagccgtgcaagtcc

SEQ ID NO: 451144 - DNA, 25 bp, Rattus norvegicus
agtcctttctgggagtgtcagtgcc

SEQ ID NO: 451145 - DNA, 25 bp, Rattus norvegicus
gggtgactcctcctgcaaggcaacg

SEQ ID NO: 451146 - DNA, 25 bp, Rattus norvegicus
agtgcggtcgctgcttccgcgagcc

SEQ ID NO: 451147 - DNA, 25 bp, Rattus norvegicus
cgcagccatggccacgggcctgaga

SEQ ID NO: 451148 - DNA, 25 bp, Rattus norvegicus
tgagggctcgctcaagacccaccag

SEQ ID NO: 451149 - DNA, 25 bp, Rattus norvegicus
agcttcgcgcgtgagggctcgctca

SEQ ID NO: 451150 - DNA, 25 bp, Rattus norvegicus
ttctgccctcgctgcggcaagagct

SEQ ID NO: 451151 - DNA, 25 bp, Rattus norvegicus
ggggagcggcgaccctacttctgcc

SEQ ID NO: 451152 - DNA, 25 bp, Rattus norvegicus
atggccacgggcctgagagtcaagc

SEQ ID NO: 451153 - DNA, 25 bp, Rattus norvegicus
gcaccagcgcattcacagcggcgag

SEQ ID NO: 451154 - DNA, 25 bp, Rattus norvegicus
tgcttcagcctcaagcagaacctgc

SEQ ID NO: 451155 - DNA, 25 bp, Rattus norvegicus
acctggaagtgcaccagcgcacaca

SEQ ID NO: 451156 - DNA, 25 bp, Rattus norvegicus
gcgtcaaacacaacctggaagtgca

SEQ ID NO: 451157 - DNA, 25 bp, Rattus norvegicus
gcagccgccttcgtgtgtcccgagt

SEQ ID NO: 451158 - DNA, 25 bp, Rattus norvegicus
ggcaaggccttcagcgtcaaacaca

SEQ ID NO: 451159 - DNA, 25 bp, Rattus norvegicus
caccagtgcgcgcagtgcggtcgct

SEQ ID NO: 451160 - DNA, 25 bp, Rattus norvegicus
ggggcacgcactactccaatgaggt

SEQ ID NO: 451161 - DNA, 25 bp, Rattus norvegicus
ctggccgcagtgaaaaggatgtttg

SEQ ID NO: 451162 - DNA, 25 bp, Rattus norvegicus
cggagactccctgcaggattacgtg

SEQ ID NO: 451163 - DNA, 25 bp, Rattus norvegicus
ttacgtgcgctgcacggacaaccgc

SEQ ID NO: 451164 - DNA, 25 bp, Rattus norvegicus
acaaccgcgcgctacgagagctggt

SEQ ID NO: 451165 - DNA, 25 bp, Rattus norvegicus
gggatcgcgtgtgcgccctcaacaa

SEQ ID NO: 451166 - DNA, 25 bp, Rattus norvegicus
ccaggaccaactcaccaaggtggcg

SEQ ID NO: 451167 - DNA, 25 bp, Rattus norvegicus
tcaggttgagcagctgctggacctg

SEQ ID NO: 451168 - DNA, 25 bp, Rattus norvegicus
ccaatgaggtgtacgagctggtgca

SEQ ID NO: 451169 - DNA, 25 bp, Rattus norvegicus
gggtcgcttcaccacgcaggacagc

SEQ ID NO: 451170 - DNA, 25 bp, Rattus norvegicus
gctggtcacccaactgggtcgcttc

SEQ ID NO: 451171 - DNA, 25 bp, Rattus norvegicus
aacaaccgtgccacaggcagcgaga

SEQ ID NO: 451172 - DNA, 25 bp, Rattus norvegicus
cgcactgtcgtggtgttcacgcgca

SEQ ID NO: 451173 - DNA, 25 bp, Rattus norvegicus
gcatgcgctgttgctggtcacccaa

SEQ ID NO: 451174 - DNA, 25 bp, Rattus norvegicus
tcagcctgaggagcgaaccgaaggc

SEQ ID NO: 451175 - DNA, 25 bp, Rattus norvegicus
cccgtccattcgtgacgtagaatcc

SEQ ID NO: 451176 - DNA, 25 bp, Rattus norvegicus
tcgtgacgtagaatcccggagctgc

SEQ ID NO: 451177 - DNA, 25 bp, Rattus norvegicus
gaatcccggagctgctcggaagccc

SEQ ID NO: 451178 - DNA, 25 bp, Rattus norvegicus
aagtcacggcgacagctatgggtcc

SEQ ID NO: 451179 - DNA, 25 bp, Rattus norvegicus
ctgctgtggcgcagggtgttctccc

SEQ ID NO: 451180 - DNA, 25 bp, Rattus norvegicus
agggtgttctcccagagagcgagcc

SEQ ID NO: 451181 - DNA, 25 bp, Rattus norvegicus
ccaaggtgtcttcggttccctggct

SEQ ID NO: 451182 - DNA, 25 bp, Rattus norvegicus
gtcttcggttccctggcttccgcga

SEQ ID NO: 451183 - DNA, 25 bp, Rattus norvegicus
tggcttccgcgactggcagagagat

SEQ ID NO: 451184 - DNA, 25 bp, Rattus norvegicus
gactggcagagagatggcttctcgc

SEQ ID NO: 451185 - DNA, 25 bp, Rattus norvegicus
ggcctgcaccatgggcctcagcctg

SEQ ID NO: 451186 - DNA, 25 bp, Rattus norvegicus
cctcagcctgaggagcgaaccgaag

SEQ ID NO: 451187 - DNA, 25 bp, Rattus norvegicus
cgtagaatcccggagctgctcggaa

SEQ ID NO: 451188 - DNA, 25 bp, Rattus norvegicus
gacagcgctgcaggacaaactcaca

SEQ ID NO: 451189 - DNA, 25 bp, Rattus norvegicus
gctcccggtaatcgtggcctgttct

SEQ ID NO: 451190 - DNA, 25 bp, Rattus norvegicus
tcctcatgatggttgccatggctcc

SEQ ID NO: 451191 - DNA, 25 bp, Rattus norvegicus
cgacctcctacagttcctcatgatg

SEQ ID NO: 451192 - DNA, 25 bp, Rattus norvegicus
tgtggcgtcgccattcgacctccta

SEQ ID NO: 451193 - DNA, 25 bp, Rattus norvegicus
cttcgactgttttgcgagcgctgtg

SEQ ID NO: 451194 - DNA, 25 bp, Rattus norvegicus
ccctcagtcggaagatttgatagct

SEQ ID NO: 451195 - DNA, 25 bp, Rattus norvegicus
tggccagtttgtgtgacccgaggat

SEQ ID NO: 451196 - DNA, 25 bp, Rattus norvegicus
tttggcgtcttttcgctgcgccctg

SEQ ID NO: 451197 - DNA, 25 bp, Rattus norvegicus
ccctcttcctcggtgtgtgatgttt

SEQ ID NO: 451198 - DNA, 25 bp, Rattus norvegicus
ctgtcacttgtcgtcagcgtctgga

SEQ ID NO: 451199 - DNA, 25 bp, Rattus norvegicus
tgcacccgcgctttacgtcatggct

SEQ ID NO: 451200 - DNA, 25 bp, Rattus norvegicus
gtgttgccgggtgaaagccttttca

SEQ ID NO: 451201 - DNA, 25 bp, Rattus norvegicus
gagcagtcgtcccttcagtttcacc

SEQ ID NO: 451202 - DNA, 25 bp, Rattus norvegicus
ccactcatcgctcagcgcagggtta

SEQ ID NO: 451203 - DNA, 25 bp, Rattus norvegicus
gctcagcgcagggttaccagcccag

SEQ ID NO: 451204 - DNA, 25 bp, Rattus norvegicus
cgcagggttaccagcccagggtctt

SEQ ID NO: 451205 - DNA, 25 bp, Rattus norvegicus
gttaccagcccagggtcttggagaa

SEQ ID NO: 451206 - DNA, 25 bp, Rattus norvegicus
gggtcgggaccaaatctgacctgcc

SEQ ID NO: 451207 - DNA, 25 bp, Rattus norvegicus
aaatctgacctgcccgcgccggttt

SEQ ID NO: 451208 - DNA, 25 bp, Rattus norvegicus
gcgccggtttctgcttcacctcccg

SEQ ID NO: 451209 - DNA, 25 bp, Rattus norvegicus
cccgggatgccgtctggagcccgaa

SEQ ID NO: 451210 - DNA, 25 bp, Rattus norvegicus
gatgccgtctggagcccgaatgccc

SEQ ID NO: 451211 - DNA, 25 bp, Rattus norvegicus
atggagcccgcccgcaagcgagcag

SEQ ID NO: 451212 - DNA, 25 bp, Rattus norvegicus
ccgggcagagccaggcacaaggcca

SEQ ID NO: 451213 - DNA, 25 bp, Rattus norvegicus
agccaggcacaaggccagggccagc

SEQ ID NO: 451214 - DNA, 25 bp, Rattus norvegicus
agccgcaggtgagtgccccctaaca

SEQ ID NO: 451215 - DNA, 25 bp, Rattus norvegicus
catcgctcagcgcagggttaccagc

SEQ ID NO: 451216 - DNA, 25 bp, Rattus norvegicus
ggctttttgaatgagccacgtgttc

SEQ ID NO: 451217 - DNA, 25 bp, Rattus norvegicus
gccaccgggatcttagcgtccttga

SEQ ID NO: 451218 - DNA, 25 bp, Rattus norvegicus
tgaagacactttccaggtccgcggg

SEQ ID NO: 451219 - DNA, 25 bp, Rattus norvegicus
atggagccggtggattttgttcttc

SEQ ID NO: 451220 - DNA, 25 bp, Rattus norvegicus
cctgaaagcgcctcgatggccttga

SEQ ID NO: 451221 - DNA, 25 bp, Rattus norvegicus
agcggcgggcgaaaaccagatccca

SEQ ID NO: 451222 - DNA, 25 bp, Rattus norvegicus
cgagcccagcgtcgagtcttcctaa

SEQ ID NO: 451223 - DNA, 25 bp, Rattus norvegicus
cgagtcttcctaactctggggagga

SEQ ID NO: 451224 - DNA, 25 bp, Rattus norvegicus
gccagcgggctgtgaaaatatcaca

SEQ ID NO: 451225 - DNA, 25 bp, Rattus norvegicus
aaatatcacactacgtggggcaggc

SEQ ID NO: 451226 - DNA, 25 bp, Rattus norvegicus
gctagttgcgaaagggtccgagctt

SEQ ID NO: 451227 - DNA, 25 bp, Rattus norvegicus
gcgtagcccgtcttcaccaggaagg

SEQ ID NO: 451228 - DNA, 25 bp, Rattus norvegicus
cagcgcctcaattagagtgggtttc

SEQ ID NO: 451229 - DNA, 25 bp, Rattus norvegicus
gtctcacgtgaggaatcccagcgcc

SEQ ID NO: 451230 - DNA, 25 bp, Rattus norvegicus
catcactcatgttggccaggcgctc

SEQ ID NO: 451231 - DNA, 25 bp, Rattus norvegicus
acccgcacctcggagcagagatggg

SEQ ID NO: 451232 - DNA, 25 bp, Rattus norvegicus
cggtaccgccagaaacctcctggtg

SEQ ID NO: 451233 - DNA, 25 bp, Rattus norvegicus
atggaagcacctaccactatccggc

SEQ ID NO: 451234 - DNA, 25 bp, Rattus norvegicus
gcctgagatgccaccgatggaagca

SEQ ID NO: 451235 - DNA, 25 bp, Rattus norvegicus
tgtactcactctgccctcgaagttg

SEQ ID NO: 451236 - DNA, 25 bp, Rattus norvegicus
ctttacagacgcgacgccgccggtt

SEQ ID NO: 451237 - DNA, 25 bp, Rattus norvegicus
acggcctagtcaccgcgctgtttga

SEQ ID NO: 451238 - DNA, 25 bp, Rattus norvegicus
agagatatgtctcggctcgagggcc

SEQ ID NO: 451239 - DNA, 25 bp, Rattus norvegicus
ggcgctcccgagcactaaacaagag

SEQ ID NO: 451240 - DNA, 25 bp, Rattus norvegicus
tcgaagttgttctcctctacatcac

SEQ ID NO: 451241 - DNA, 25 bp, Rattus norvegicus
aagccatcttgggacgtgacgcgct

SEQ ID NO: 451242 - DNA, 25 bp, Rattus norvegicus
gccaggtaccagtcagccgccagaa

SEQ ID NO: 451243 - DNA, 25 bp, Rattus norvegicus
acgcggccgctcactgcaacagaga

SEQ ID NO: 451244 - DNA, 25 bp, Rattus norvegicus
ccggctttgctactttgacagcctc

SEQ ID NO: 451245 - DNA, 25 bp, Rattus norvegicus
tactttgacagcctcgaccgccggg

SEQ ID NO: 451246 - DNA, 25 bp, Rattus norvegicus
aaccagcaggccaggtaagacggag

SEQ ID NO: 451247 - DNA, 25 bp, Rattus norvegicus
cgggaaaccagcaggccaggtaaga

SEQ ID NO: 451248 - DNA, 25 bp, Rattus norvegicus
tgattgacgggaaaccagcaggcca

SEQ ID NO: 451249 - DNA, 25 bp, Rattus norvegicus
cccgggccaagagcacgtgcggtct

SEQ ID NO: 451250 - DNA, 25 bp, Rattus norvegicus
ggtctttcctcaaggcgggactaca

SEQ ID NO: 451251 - DNA, 25 bp, Rattus norvegicus
gtgctgagcgctccgggtcctacct

SEQ ID NO: 451252 - DNA, 25 bp, Rattus norvegicus
tacctccgttctggcccggaggctg

SEQ ID NO: 451253 - DNA, 25 bp, Rattus norvegicus
ctgtggctgtagctccagtttgtga

SEQ ID NO: 451254 - DNA, 25 bp, Rattus norvegicus
ctccagtttgtgagcctcgcggcag

SEQ ID NO: 451255 - DNA, 25 bp, Rattus norvegicus
ggcccgcgtgattgacgggaaacca

SEQ ID NO: 451256 - DNA, 25 bp, Rattus norvegicus
gagcacgtgcggtctttcctcaagg

SEQ ID NO: 451257 - DNA, 25 bp, Rattus norvegicus
cgcggccgcgctcatttgtgctccg

SEQ ID NO: 451258 - DNA, 25 bp, Rattus norvegicus
acgagggccggaataagcgagtgaa

SEQ ID NO: 451259 - DNA, 25 bp, Rattus norvegicus
tagcgctcagggaatccgtttcttg

SEQ ID NO: 451260 - DNA, 25 bp, Rattus norvegicus
cgcattagcgctcagggaatccgtt

SEQ ID NO: 451261 - DNA, 25 bp, Rattus norvegicus
cagggtctcttgtcggcagagctag

SEQ ID NO: 451262 - DNA, 25 bp, Rattus norvegicus
ccatggagcggctgacgttgcctcc

SEQ ID NO: 451263 - DNA, 25 bp, Rattus norvegicus
aggcaagggctcctttcgcttcccg

SEQ ID NO: 451264 - DNA, 25 bp, Rattus norvegicus
actcagagctcgaggcaagggctcc

SEQ ID NO: 451265 - DNA, 25 bp, Rattus norvegicus
tgccaggcagctgcaagacagactc

SEQ ID NO: 451266 - DNA, 25 bp, Rattus norvegicus
gtccggcggatcttgccaggcagct

SEQ ID NO: 451267 - DNA, 25 bp, Rattus norvegicus
ccaggcagtttctggcggcaaggct

SEQ ID NO: 451268 - DNA, 25 bp, Rattus norvegicus
acccggcgggtgaacgcattagcgc

SEQ ID NO: 451269 - DNA, 25 bp, Rattus norvegicus
agggaatccgtttcttggctgttcg

SEQ ID NO: 451270 - DNA, 25 bp, Rattus norvegicus
tgctcgcgcaggtccggcggatctt

SEQ ID NO: 451271 - DNA, 25 bp, Rattus norvegicus
tgaggccttaactctgctccgcggg

SEQ ID NO: 451272 - DNA, 25 bp, Rattus norvegicus
actcaaactgatctggctctcactc

SEQ ID NO: 451273 - DNA, 25 bp, Rattus norvegicus
gcggcgcttacgctagttccctgca

SEQ ID NO: 451274 - DNA, 25 bp, Rattus norvegicus
gcgcttacgctagttccctgcagga

SEQ ID NO: 451275 - DNA, 25 bp, Rattus norvegicus
cttacgctagttccctgcaggactt

SEQ ID NO: 451276 - DNA, 25 bp, Rattus norvegicus
cccgcactgcctcgtggagggtgtt

SEQ ID NO: 451277 - DNA, 25 bp, Rattus norvegicus
gaaacaggatcttacactataactc

SEQ ID NO: 451278 - DNA, 25 bp, Rattus norvegicus
ctcaaactgatctggctctcactct

SEQ ID NO: 451279 - DNA, 25 bp, Rattus norvegicus
ccttgaactcatgatgatactcctg

SEQ ID NO: 451280 - DNA, 25 bp, Rattus norvegicus
gaactcatgatgatactcctgcttc

SEQ ID NO: 451281 - DNA, 25 bp, Rattus norvegicus
aactcatgatgatactcctgcttca

SEQ ID NO: 451282 - DNA, 25 bp, Rattus norvegicus
cttcagcctcccagttgattttttg

SEQ ID NO: 451283 - DNA, 25 bp, Rattus norvegicus
tcagcctcccagttgattttttgac

SEQ ID NO: 451284 - DNA, 25 bp, Rattus norvegicus
tacactataactcaaactgatctgg

SEQ ID NO: 451285 - DNA, 25 bp, Rattus norvegicus
ggatcttacactataactcaaactg

SEQ ID NO: 451286 - DNA, 25 bp, Rattus norvegicus
cgctgccgtttttagcgcgcctgga

SEQ ID NO: 451287 - DNA, 25 bp, Rattus norvegicus
gggaaacgcggccatcatatttttg

SEQ ID NO: 451288 - DNA, 25 bp, Rattus norvegicus
cagcccggcgctgccgtttttagcg

SEQ ID NO: 451289 - DNA, 25 bp, Rattus norvegicus
cggccatcatatttttggttgcata

SEQ ID NO: 451290 - DNA, 25 bp, Rattus norvegicus
ggttgcataagcaaacgaaattaga

SEQ ID NO: 451291 - DNA, 25 bp, Rattus norvegicus
cgaaattagaaatctggaacgcgtt

SEQ ID NO: 451292 - DNA, 25 bp, Rattus norvegicus
ctggaacgcgttcaagaccttcgga

SEQ ID NO: 451293 - DNA, 25 bp, Rattus norvegicus
ccagggcagagacagatagggatta

SEQ ID NO: 451294 - DNA, 25 bp, Rattus norvegicus
cagatagggattaagcgagttgagc

SEQ ID NO: 451295 - DNA, 25 bp, Rattus norvegicus
gtttcatgggctcggttacgtaagc

SEQ ID NO: 451296 - DNA, 25 bp, Rattus norvegicus
acgtaagcccggttacacagccgtg

SEQ ID NO: 451297 - DNA, 25 bp, Rattus norvegicus
gcccggttacacagccgtggctgcg

SEQ ID NO: 451298 - DNA, 25 bp, Rattus norvegicus
cgcgcctggagtacagactccatca

SEQ ID NO: 451299 - DNA, 25 bp, Rattus norvegicus
tttagcgcgcctggagtacagactc

SEQ ID NO: 451300 - DNA, 25 bp, Rattus norvegicus
caccggtggagctcattcctcgcag

SEQ ID NO: 451301 - DNA, 25 bp, Rattus norvegicus
agcgctcgcagttgtcccagagatg

SEQ ID NO: 451302 - DNA, 25 bp, Rattus norvegicus
ggggatgctcactcttggatgttcc

SEQ ID NO: 451303 - DNA, 25 bp, Rattus norvegicus
ccaagtacagtgtctggtccctaca

SEQ ID NO: 451304 - DNA, 25 bp, Rattus norvegicus
ggcaattcccgcgacaggcaatcta

SEQ ID NO: 451305 - DNA, 25 bp, Rattus norvegicus
caggcaatctaagcggtccctgctt

SEQ ID NO: 451306 - DNA, 25 bp, Rattus norvegicus
tttatctttctctctggcagcggga

SEQ ID NO: 451307 - DNA, 25 bp, Rattus norvegicus
tctcagagcgggctgcctggaattg

SEQ ID NO: 451308 - DNA, 25 bp, Rattus norvegicus
agacgccgccactcgagcggctgtg

SEQ ID NO: 451309 - DNA, 25 bp, Rattus norvegicus
ctgccgcgacaagggcgctccataa

SEQ ID NO: 451310 - DNA, 25 bp, Rattus norvegicus
gcgctccataaaagcccgttggcga

SEQ ID NO: 451311 - DNA, 25 bp, Rattus norvegicus
gatgttcccttctcctctcagagcg

SEQ ID NO: 451312 - DNA, 25 bp, Rattus norvegicus
gggaaaaaccttgctcgactgcttc

SEQ ID NO: 451313 - DNA, 25 bp, Rattus norvegicus
tcattcctcgcagaggcgcccagag

SEQ ID NO: 451314 - DNA, 25 bp, Rattus norvegicus
acagacacctttaggggctctgaga

SEQ ID NO: 451315 - DNA, 25 bp, Rattus norvegicus
gctcctggagtctcgcgtctccttt

SEQ ID NO: 451316 - DNA, 25 bp, Rattus norvegicus
ctttgtgctataagccgatctcggc

SEQ ID NO: 451317 - DNA, 25 bp, Rattus norvegicus
gttcctctcccacagaacgctgagg

SEQ ID NO: 451318 - DNA, 25 bp, Rattus norvegicus
ctgagccagggcgaccctaagggac

SEQ ID NO: 451319 - DNA, 25 bp, Rattus norvegicus
ctctggtggcagcacctggcggcca

SEQ ID NO: 451320 - DNA, 25 bp, Rattus norvegicus
ctggcgcctgggacagacaccttta

SEQ ID NO: 451321 - DNA, 25 bp, Rattus norvegicus
gtctcgcgtctcctttgtgctataa

SEQ ID NO: 451322 - DNA, 25 bp, Rattus norvegicus
aggcggcttgctgcaactcctgctg

SEQ ID NO: 451323 - DNA, 25 bp, Rattus norvegicus
tccgagccacgaggttccagttgtt

SEQ ID NO: 451324 - DNA, 25 bp, Rattus norvegicus
ttccagttgtttggctaaagtggcc

SEQ ID NO: 451325 - DNA, 25 bp, Rattus norvegicus
taaagtggccgtgggcgagcacact

SEQ ID NO: 451326 - DNA, 25 bp, Rattus norvegicus
acctggcggccaggccacaacggag

SEQ ID NO: 451327 - DNA, 25 bp, Rattus norvegicus
ataagccgatctcggccgattcccg

SEQ ID NO: 451328 - DNA, 25 bp, Rattus norvegicus
cccaggccggaacaccaagcgggcg

SEQ ID NO: 451329 - DNA, 25 bp, Rattus norvegicus
cgcgcgctgccgctccgtccggaac

SEQ ID NO: 451330 - DNA, 25 bp, Rattus norvegicus
gcgagggaatctccccgagcaaagg

SEQ ID NO: 451331 - DNA, 25 bp, Rattus norvegicus
aacgctccgctctttcgcccgcgag

SEQ ID NO: 451332 - DNA, 25 bp, Rattus norvegicus
cgagcaaaggggaaccaacaatttg

SEQ ID NO: 451333 - DNA, 25 bp, Rattus norvegicus
ccgccgccacttacccgcgcgctgc

SEQ ID NO: 451334 - DNA, 25 bp, Rattus norvegicus
aactgagcccgcagctcgcgcccgc

SEQ ID NO: 451335 - DNA, 25 bp, Rattus norvegicus
gagcacaaactgagcccgcagctcg

SEQ ID NO: 451336 - DNA, 25 bp, Rattus norvegicus
gacgagcacaaactgagcccgcagc

SEQ ID NO: 451337 - DNA, 25 bp, Rattus norvegicus
ggagacgagcacaaactgagcccgc

SEQ ID NO: 451338 - DNA, 25 bp, Rattus norvegicus
aagggagacgagcacaaactgagcc

SEQ ID NO: 451339 - DNA, 25 bp, Rattus norvegicus
cggaagggagacgagcacaaactga

SEQ ID NO: 451340 - DNA, 25 bp, Rattus norvegicus
ctccgtccggaacgctccgctcttt

SEQ ID NO: 451341 - DNA, 25 bp, Rattus norvegicus
tttccgggagatgcgagggaatctc

SEQ ID NO: 451342 - DNA, 25 bp, Rattus norvegicus
cccgctaggctgtaactccaggatg

SEQ ID NO: 451343 - DNA, 25 bp, Rattus norvegicus
tccggcgaccagttctcaatacttt

SEQ ID NO: 451344 - DNA, 25 bp, Rattus norvegicus
tcagccgacggcagttccagaacca

SEQ ID NO: 451345 - DNA, 25 bp, Rattus norvegicus
tgtgcctgcttcagaccgggaagga

SEQ ID NO: 451346 - DNA, 25 bp, Rattus norvegicus
tgttcactgctggagacactgctcg

SEQ ID NO: 451347 - DNA, 25 bp, Rattus norvegicus
gacgccctgttgctcacctgagtgt

SEQ ID NO: 451348 - DNA, 25 bp, Rattus norvegicus
ctgaaccctagagaatggctgcatc

SEQ ID NO: 451349 - DNA, 25 bp, Rattus norvegicus
tctcggtcccagtttagacacggtg

SEQ ID NO: 451350 - DNA, 25 bp, Rattus norvegicus
ctccaggatgagcaacgccagagtg

SEQ ID NO: 451351 - DNA, 25 bp, Rattus norvegicus
tctcggatgtggtaaagcctccctc

SEQ ID NO: 451352 - DNA, 25 bp, Rattus norvegicus
ctccacggggcggaacaatatgaaa

SEQ ID NO: 451353 - DNA, 25 bp, Rattus norvegicus
ctgccgggcaattagctgaagagct

SEQ ID NO: 451354 - DNA, 25 bp, Rattus norvegicus
cgccagagtgcttcatcacagaaaa

SEQ ID NO: 451355 - DNA, 25 bp, Rattus norvegicus
cctagaactttagggcgcgcgctgc

SEQ ID NO: 451356 - DNA, 25 bp, Rattus norvegicus
tcttagggagacgtcccgctctcta

SEQ ID NO: 451357 - DNA, 25 bp, Rattus norvegicus
ggtccgggctggtcaacaccacaaa

SEQ ID NO: 451358 - DNA, 25 bp, Rattus norvegicus
ccgcgcctatgtaccggtgtcaatg

SEQ ID NO: 451359 - DNA, 25 bp, Rattus norvegicus
ggtgtcaatgcaaccacacttgttc

SEQ ID NO: 451360 - DNA, 25 bp, Rattus norvegicus
cgccgtgacgtagccgcatgtcatt

SEQ ID NO: 451361 - DNA, 25 bp, Rattus norvegicus
ccgcatgtcattggctccaggattg

SEQ ID NO: 451362 - DNA, 25 bp, Rattus norvegicus
ctccaggattgggagcgctagcaag

SEQ ID NO: 451363 - DNA, 25 bp, Rattus norvegicus
agaggcctcgtttgcccgacactta

SEQ ID NO: 451364 - DNA, 25 bp, Rattus norvegicus
ccgacacttacgacaggcccttgga

SEQ ID NO: 451365 - DNA, 25 bp, Rattus norvegicus
cgtggacgtggatgacgtcaccctc

SEQ ID NO: 451366 - DNA, 25 bp, Rattus norvegicus
tgggctcaggtaacaccggctctta

SEQ ID NO: 451367 - DNA, 25 bp, Rattus norvegicus
acaccggctcttaggactccttctg

SEQ ID NO: 451368 - DNA, 25 bp, Rattus norvegicus
agagggcgcccttcctctagaggcc

SEQ ID NO: 451369 - DNA, 25 bp, Rattus norvegicus
tccgcccacgggtagtgctaagacc

SEQ ID NO: 451370 - DNA, 25 bp, Rattus norvegicus
gtgaccacgcactaggtaacacatc

SEQ ID NO: 451371 - DNA, 25 bp, Rattus norvegicus
cgcccttcggaggactcgtgtcgga

SEQ ID NO: 451372 - DNA, 25 bp, Rattus norvegicus
ggggtcgcacgcacctgccacatct

SEQ ID NO: 451373 - DNA, 25 bp, Rattus norvegicus
ctgccacatctgtccgggagcgctg

SEQ ID NO: 451374 - DNA, 25 bp, Rattus norvegicus
accgcgcctccctttcttgtctagg

SEQ ID NO: 451375 - DNA, 25 bp, Rattus norvegicus
ctggtggttcttctctccgcggggc

SEQ ID NO: 451376 - DNA, 25 bp, Rattus norvegicus
gcgtggaatttcgtggtcttccgca

SEQ ID NO: 451377 - DNA, 25 bp, Rattus norvegicus
ctaggtaacacatcctgagggtggg

SEQ ID NO: 451378 - DNA, 25 bp, Rattus norvegicus
cggcggtgaccacgcactaggtaac

SEQ ID NO: 451379 - DNA, 25 bp, Rattus norvegicus
acgcactaggtaacacatcctgagg

SEQ ID NO: 451380 - DNA, 25 bp, Rattus norvegicus
gagaagcccgcccttcggaggactc

SEQ ID NO: 451381 - DNA, 25 bp, Rattus norvegicus
atctgtccgggagcgctgcctgacc

SEQ ID NO: 451382 - DNA, 25 bp, Rattus norvegicus
aatttcgtggtcttccgcacctgcg

SEQ ID NO: 451383 - DNA, 25 bp, Rattus norvegicus
tctagggagctggtggttcttctct

SEQ ID NO: 451384 - DNA, 25 bp, Rattus norvegicus
atcgcctactgcagagaaattagtc

SEQ ID NO: 451385 - DNA, 25 bp, Rattus norvegicus
gattcccacgctgtggctcctgaca

SEQ ID NO: 451386 - DNA, 25 bp, Rattus norvegicus
ttctctatggttgctgctgcacagc

SEQ ID NO: 451387 - DNA, 25 bp, Rattus norvegicus
gctcccgccgtgagttctctatggt

SEQ ID NO: 451388 - DNA, 25 bp, Rattus norvegicus
gccggccgtctggagacagaaatta

SEQ ID NO: 451389 - DNA, 25 bp, Rattus norvegicus
gtctctatggtaaccgcatccggcc

SEQ ID NO: 451390 - DNA, 25 bp, Rattus norvegicus
gcctgtcagtcacccgtctctatgg

SEQ ID NO: 451391 - DNA, 25 bp, Rattus norvegicus
cgaggagctccgctttgcagccact

SEQ ID NO: 451392 - DNA, 25 bp, Rattus norvegicus
cgggttctcaggtcatgccggtcag

SEQ ID NO: 451393 - DNA, 25 bp, Rattus norvegicus
agctcgcggcgtagagtaagaccga

SEQ ID NO: 451394 - DNA, 25 bp, Rattus norvegicus
ttgctctgagaactcgagcggcgga

SEQ ID NO: 451395 - DNA, 25 bp, Rattus norvegicus
gcgtccagctggtttgctctgagaa

SEQ ID NO: 451396 - DNA, 25 bp, Rattus norvegicus
caacgccagggcagctgaatcccga

SEQ ID NO: 451397 - DNA, 25 bp, Rattus norvegicus
cagagaaattagtcccgcgactgca

SEQ ID NO: 451398 - DNA, 25 bp, Rattus norvegicus
tccgcctagagtgagagccggtgct

SEQ ID NO: 451399 - DNA, 25 bp, Rattus norvegicus
aaagcttgattgatggaccccgggg

SEQ ID NO: 451400 - DNA, 25 bp, Rattus norvegicus
ccagctgtggccatccgcctagagt

SEQ ID NO: 451401 - DNA, 25 bp, Rattus norvegicus
tggccatccgcctagagtgagagcc

SEQ ID NO: 451402 - DNA, 25 bp, Rattus norvegicus
cctagagtgagagccggtgctcgtc

SEQ ID NO: 451403 - DNA, 25 bp, Rattus norvegicus
ggaaggctgatttacagcgcctgga

SEQ ID NO: 451404 - DNA, 25 bp, Rattus norvegicus
gatttacagcgcctggagggactcg

SEQ ID NO: 451405 - DNA, 25 bp, Rattus norvegicus
actcgggtgaggtccctgaagaagt

SEQ ID NO: 451406 - DNA, 25 bp, Rattus norvegicus
gtgaggtccctgaagaagtgaaacc

SEQ ID NO: 451407 - DNA, 25 bp, Rattus norvegicus
agaagtgaaacccgctctggggccg

SEQ ID NO: 451408 - DNA, 25 bp, Rattus norvegicus
cggccttccgcctagtctgggtttg

SEQ ID NO: 451409 - DNA, 25 bp, Rattus norvegicus
ctagtctgggtttgccggactgccg

SEQ ID NO: 451410 - DNA, 25 bp, Rattus norvegicus
gcgggaaagcttgattgatggaccc

SEQ ID NO: 451411 - DNA, 25 bp, Rattus norvegicus
cgagggaaggctgatttacagcgcc

SEQ ID NO: 451412 - DNA, 25 bp, Rattus norvegicus
agaatgactctctccgaagcgcggc

SEQ ID NO: 451413 - DNA, 25 bp, Rattus norvegicus
aagaatggccgctggaaaataaagc

SEQ ID NO: 451414 - DNA, 25 bp, Rattus norvegicus
ccaggccggcctctggggaaagaat

SEQ ID NO: 451415 - DNA, 25 bp, Rattus norvegicus
agcaacctccgctccagggctgcga

SEQ ID NO: 451416 - DNA, 25 bp, Rattus norvegicus
atgactctctccgaagcgcggctgc

SEQ ID NO: 451417 - DNA, 25 bp, Rattus norvegicus
tcctgagaatgactctctccgaagc

SEQ ID NO: 451418 - DNA, 25 bp, Rattus norvegicus
tggccgctggaaaataaagctttcc

SEQ ID NO: 451419 - DNA, 25 bp, Rattus norvegicus
atgagtccgaaagcagcgaagcaac

SEQ ID NO: 451420 - DNA, 25 bp, Rattus norvegicus
caaatgagtccgaaagcagcgaagc

SEQ ID NO: 451421 - DNA, 25 bp, Rattus norvegicus
cgtgttaactgcaaatgagtccgaa

SEQ ID NO: 451422 - DNA, 25 bp, Rattus norvegicus
cgagcgtgttaactgcaaatgagtc

SEQ ID NO: 451423 - DNA, 25 bp, Rattus norvegicus
cgagcgagcgtgttaactgcaaatg

SEQ ID NO: 451424 - DNA, 25 bp, Rattus norvegicus
agccgagcgagcgtgttaactgcaa

SEQ ID NO: 451425 - DNA, 25 bp, Rattus norvegicus
tcctaaaaatcctgagaatgactct

SEQ ID NO: 451426 - DNA, 25 bp, Rattus norvegicus
ttgtacgccctggtcctttgtcttc

SEQ ID NO: 451427 - DNA, 25 bp, Rattus norvegicus
tcgcaccctcgtggacgcgtggcta

SEQ ID NO: 451428 - DNA, 25 bp, Rattus norvegicus
cttctcggcctcagaaggctgggga

SEQ ID NO: 451429 - DNA, 25 bp, Rattus norvegicus
ttgggaagagctgctcccattcttc

SEQ ID NO: 451430 - DNA, 25 bp, Rattus norvegicus
cggtcgccgcactttgggaagagct

SEQ ID NO: 451431 - DNA, 25 bp, Rattus norvegicus
actccgtgtggacctggacctctgc

SEQ ID NO: 451432 - DNA, 25 bp, Rattus norvegicus
cttctgttgagcttggtgggactcc

SEQ ID NO: 451433 - DNA, 25 bp, Rattus norvegicus
tgcacctcaggcttctgttgagctt

SEQ ID NO: 451434 - DNA, 25 bp, Rattus norvegicus
gcgcaccgtgggagatgaagctccc

SEQ ID NO: 451435 - DNA, 25 bp, Rattus norvegicus
gagacggcggccagtcagcatccgc

SEQ ID NO: 451436 - DNA, 25 bp, Rattus norvegicus
ggccgggttgacacaggcatctcag

SEQ ID NO: 451437 - DNA, 25 bp, Rattus norvegicus
cggagaagctcatagcagccctctg

SEQ ID NO: 451438 - DNA, 25 bp, Rattus norvegicus
acacaggcatctcaggcgcaccgtg

SEQ ID NO: 451439 - DNA, 25 bp, Rattus norvegicus
gctacctgccaaaggccggctgctg

SEQ ID NO: 451440 - DNA, 25 bp, Rattus norvegicus
tcgcctttacacagtccgagtttga

SEQ ID NO: 451441 - DNA, 25 bp, Rattus norvegicus
caaaatgcacgcgtgggcgcataca

SEQ ID NO: 451442 - DNA, 25 bp, Rattus norvegicus
ggcctgggtgaaagccctcaaaatg

SEQ ID NO: 451443 - DNA, 25 bp, Rattus norvegicus
caccgtgtttattttgtgggcctgg

SEQ ID NO: 451444 - DNA, 25 bp, Rattus norvegicus
gttcctcagcaaggcaccgtgttta

SEQ ID NO: 451445 - DNA, 25 bp, Rattus norvegicus
ttcagaaaccagcaggttcctcagc

SEQ ID NO: 451446 - DNA, 25 bp, Rattus norvegicus
gacacccgtgcacagttcagaaacc

SEQ ID NO: 451447 - DNA, 25 bp, Rattus norvegicus
caggttgtggaaacggcgcctctcc

SEQ ID NO: 451448 - DNA, 25 bp, Rattus norvegicus
cgttaactcggatttctgggctgca

SEQ ID NO: 451449 - DNA, 25 bp, Rattus norvegicus
caggcatcgttgctacctgtgagta

SEQ ID NO: 451450 - DNA, 25 bp, Rattus norvegicus
ggtgcagtgcgaccaatcaggcatc

SEQ ID NO: 451451 - DNA, 25 bp, Rattus norvegicus
tggagaccagacagccaatcgcctg

SEQ ID NO: 451452 - DNA, 25 bp, Rattus norvegicus
tacacagtcacataggcagtttggc

SEQ ID NO: 451453 - DNA, 25 bp, Rattus norvegicus
agtttgacgtcggtctcctggagac

SEQ ID NO: 451454 - DNA, 25 bp, Rattus norvegicus
cgagaccgccgcttttctagaacct

SEQ ID NO: 451455 - DNA, 25 bp, Rattus norvegicus
cgcggactcagtcgcttcagctcga

SEQ ID NO: 451456 - DNA, 25 bp, Rattus norvegicus
tcgatttcccgcagccgagcgagaa

SEQ ID NO: 451457 - DNA, 25 bp, Rattus norvegicus
tctccgcttacgtcaggccgttacg

SEQ ID NO: 451458 - DNA, 25 bp, Rattus norvegicus
agcgggactggtttacatgacttgc

SEQ ID NO: 451459 - DNA, 25 bp, Rattus norvegicus
tgcgcaactggcttcagtgaattgc

SEQ ID NO: 451460 - DNA, 25 bp, Rattus norvegicus
cagcgtgttactacgtccggaacta

SEQ ID NO: 451461 - DNA, 25 bp, Rattus norvegicus
ttgagactgagaagcctccgccgtc

SEQ ID NO: 451462 - DNA, 25 bp, Rattus norvegicus
tgcagctacgcctttgccaatcctg

SEQ ID NO: 451463 - DNA, 25 bp, Rattus norvegicus
gccaatcctgtctccgggttttcga

SEQ ID NO: 451464 - DNA, 25 bp, Rattus norvegicus
tccgggttttcgagccacacaaata

SEQ ID NO: 451465 - DNA, 25 bp, Rattus norvegicus
tcggtccctcccagaaggacttgta

SEQ ID NO: 451466 - DNA, 25 bp, Rattus norvegicus
tggtgcttaaagaacccggctgttg

SEQ ID NO: 451467 - DNA, 25 bp, Rattus norvegicus
acggtcgcgcagtttgaaattaacg

SEQ ID NO: 451468 - DNA, 25 bp, Rattus norvegicus
cgtgagtaagccgaacctaggggag

SEQ ID NO: 451469 - DNA, 25 bp, Rattus norvegicus
cgcgcgtgagtaagccgaacctagg

SEQ ID NO: 451470 - DNA, 25 bp, Rattus norvegicus
accgcgcgtgagtaagccgaaccta

SEQ ID NO: 451471 - DNA, 25 bp, Rattus norvegicus
aggaccgcgcgtgagtaagccgaac

SEQ ID NO: 451472 - DNA, 25 bp, Rattus norvegicus
ccaggaccgcgcgtgagtaagccga

SEQ ID NO: 451473 - DNA, 25 bp, Rattus norvegicus
cagccgtccaggaccgcgcgtgagt

SEQ ID NO: 451474 - DNA, 25 bp, Rattus norvegicus
agtcagcaaactccgccgggctccg

SEQ ID NO: 451475 - DNA, 25 bp, Rattus norvegicus
tgagtcagcaaactccgccgggctc

SEQ ID NO: 451476 - DNA, 25 bp, Rattus norvegicus
ggctgcgctcctcgggtgcgctctt

SEQ ID NO: 451477 - DNA, 25 bp, Rattus norvegicus
cgctcttgggcgctcgtcgccgccg

SEQ ID NO: 451478 - DNA, 25 bp, Rattus norvegicus
tcctcgggtgcgctcttgggcgctc

SEQ ID NO: 451479 - DNA, 25 bp, Rattus norvegicus
ctggcacctgctcagccgggcttgg

SEQ ID NO: 451480 - DNA, 25 bp, Rattus norvegicus
gcgccggagatgctggcacgagccg

SEQ ID NO: 451481 - DNA, 25 bp, Rattus norvegicus
cgccgccgcgccttgagtcagcaaa

SEQ ID NO: 451482 - DNA, 25 bp, Rattus norvegicus
tgtaagtgacctacggcctgaatta

SEQ ID NO: 451483 - DNA, 25 bp, Rattus norvegicus
gatgaagacgtcttgcgtacgaaga

SEQ ID NO: 451484 - DNA, 25 bp, Rattus norvegicus
cgtacgaagaaggtatagagagttc

SEQ ID NO: 451485 - DNA, 25 bp, Rattus norvegicus
acgccggctagctctaaagtcgata

SEQ ID NO: 451486 - DNA, 25 bp, Rattus norvegicus
cggcctgaattacggggtcacagtc

SEQ ID NO: 451487 - DNA, 25 bp, Rattus norvegicus
gcaacgcattgctggtgtaagtgac

SEQ ID NO: 451488 - DNA, 25 bp, Rattus norvegicus
ctgccgctgagagtgccggttccat

SEQ ID NO: 451489 - DNA, 25 bp, Rattus norvegicus
ccggttccatcgcaagttttatgta

SEQ ID NO: 451490 - DNA, 25 bp, Rattus norvegicus
gtatataataagaacgtgcttttcc

SEQ ID NO: 451491 - DNA, 25 bp, Rattus norvegicus
cggctcacgttcttctgtctcttta

SEQ ID NO: 451492 - DNA, 25 bp, Rattus norvegicus
tctctttacagacgaatagcatgtg

SEQ ID NO: 451493 - DNA, 25 bp, Rattus norvegicus
tagcatgtgttttacgatgaagacg

SEQ ID NO: 451494 - DNA, 25 bp, Rattus norvegicus
ggcagagactccaaagcaacgcatt

SEQ ID NO: 451495 - DNA, 25 bp, Rattus norvegicus
ggtcacagtctgaatccggccgacg

SEQ ID NO: 451496 - DNA, 25 bp, Rattus norvegicus
tgggtaacccatagcaaccgtcctg

SEQ ID NO: 451497 - DNA, 25 bp, Rattus norvegicus
tgctcccgcttcctcggttgggtaa

SEQ ID NO: 451498 - DNA, 25 bp, Rattus norvegicus
cccaagctgctgagccaggtcactt

SEQ ID NO: 451499 - DNA, 25 bp, Rattus norvegicus
gtcctggtaacccatagcaactgca

SEQ ID NO: 451500 - DNA, 25 bp, Rattus norvegicus
agcaactgcactgcggaaccaggtg

SEQ ID NO: 451501 - DNA, 25 bp, Rattus norvegicus
agagcgatttaccatggcccacctg

SEQ ID NO: 451502 - DNA, 25 bp, Rattus norvegicus
agtgaggaccaaacaaagccgccgc

SEQ ID NO: 451503 - DNA, 25 bp, Rattus norvegicus
cacgctgcgatgtgcgcttatccca

SEQ ID NO: 451504 - DNA, 25 bp, Rattus norvegicus
gcgcgtggatttcgtctcttacctg

SEQ ID NO: 451505 - DNA, 25 bp, Rattus norvegicus
cttatcccaggagcttggaaccttc

SEQ ID NO: 451506 - DNA, 25 bp, Rattus norvegicus
tggagcccaatacgctaggtccctc

SEQ ID NO: 451507 - DNA, 25 bp, Rattus norvegicus
ccctctcttgtctgacccggttgta

SEQ ID NO: 451508 - DNA, 25 bp, Rattus norvegicus
ggcacgtgtgcctttgttcttcagg

SEQ ID NO: 451509 - DNA, 25 bp, Rattus norvegicus
cctgggccttctttatagctcatcc

SEQ ID NO: 451510 - DNA, 25 bp, Rattus norvegicus
caccggagacactgcggagccagga

SEQ ID NO: 451511 - DNA, 25 bp, Rattus norvegicus
cctgatattcaaatcgcctgccgtg

SEQ ID NO: 451512 - DNA, 25 bp, Rattus norvegicus
tggcagagcctgatattcaaatcgc

SEQ ID NO: 451513 - DNA, 25 bp, Rattus norvegicus
tatatgcggaggtaatgaagttgtc

SEQ ID NO: 451514 - DNA, 25 bp, Rattus norvegicus
cccggcagtcatttttatatgcgga

SEQ ID NO: 451515 - DNA, 25 bp, Rattus norvegicus
agacgcgcgagccatttgcattccc

SEQ ID NO: 451516 - DNA, 25 bp, Rattus norvegicus
gccgagacgcgcgagccatttgcat

SEQ ID NO: 451517 - DNA, 25 bp, Rattus norvegicus
gaggcgccttgggccgctcattacc

SEQ ID NO: 451518 - DNA, 25 bp, Rattus norvegicus
tgcggagccaggactacgccctgga

SEQ ID NO: 451519 - DNA, 25 bp, Rattus norvegicus
ccgagagccaggcaccggagacact

SEQ ID NO: 451520 - DNA, 25 bp, Rattus norvegicus
ttcaaatcgcctgccgtgtcgcctg

SEQ ID NO: 451521 - DNA, 25 bp, Rattus norvegicus
ggtaatgaagttgtcagcggcgccc

SEQ ID NO: 451522 - DNA, 25 bp, Rattus norvegicus
tacgccctggatgcgtcctggctct

SEQ ID NO: 451523 - DNA, 25 bp, Rattus norvegicus
gcagtcatttttatatgcggaggta

SEQ ID NO: 451524 - DNA, 25 bp, Rattus norvegicus
aggttcctaatttcctcagggattg

SEQ ID NO: 451525 - DNA, 25 bp, Rattus norvegicus
tggtagtagcttggacctagacttg

SEQ ID NO: 451526 - DNA, 25 bp, Rattus norvegicus
tggccgagacccacaacaaggaagt

SEQ ID NO: 451527 - DNA, 25 bp, Rattus norvegicus
acaaggaagtcactggctgtccagg

SEQ ID NO: 451528 - DNA, 25 bp, Rattus norvegicus
cggccttaaaggcttactgcgcttg

SEQ ID NO: 451529 - DNA, 25 bp, Rattus norvegicus
cttactgcgcttgcgtaggccttgc

SEQ ID NO: 451530 - DNA, 25 bp, Rattus norvegicus
aggccttgctatctgagtgtccaaa

SEQ ID NO: 451531 - DNA, 25 bp, Rattus norvegicus
tgtccaaagaaagcgcctccgggta

SEQ ID NO: 451532 - DNA, 25 bp, Rattus norvegicus
taggccacgcctatacacggaagcg

SEQ ID NO: 451533 - DNA, 25 bp, Rattus norvegicus
cgaattggagctatgtcacctgacc

SEQ ID NO: 451534 - DNA, 25 bp, Rattus norvegicus
acctgaccgggtcttgaagctcgta

SEQ ID NO: 451535 - DNA, 25 bp, Rattus norvegicus
ttgaagctcgtacgcgccattttcg

SEQ ID NO: 451536 - DNA, 25 bp, Rattus norvegicus
aaggctaagcgcttctgtccctgcc

SEQ ID NO: 451537 - DNA, 25 bp, Rattus norvegicus
tagacttgcaaaagcggtccgagta

SEQ ID NO: 451538 - DNA, 25 bp, Rattus norvegicus
aaagggagccgagactgacttctgc

SEQ ID NO: 451539 - DNA, 25 bp, Rattus norvegicus
gcagagtcccgaatcgcggcgccta

SEQ ID NO: 451540 - DNA, 25 bp, Rattus norvegicus
gctcgccagcctcggaatgtagagg

SEQ ID NO: 451541 - DNA, 25 bp, Rattus norvegicus
tgagccgcctgcgaaagtttaccgg

SEQ ID NO: 451542 - DNA, 25 bp, Rattus norvegicus
ccggcatcttgtgggctgaaaatct

SEQ ID NO: 451543 - DNA, 25 bp, Rattus norvegicus
cccagccgagagaactgaacaggca

SEQ ID NO: 451544 - DNA, 25 bp, Rattus norvegicus
ggctgaaaatctctgcgtggtcgca

SEQ ID NO: 451545 - DNA, 25 bp, Rattus norvegicus
gctgacttggagcattgggactaaa

SEQ ID NO: 451546 - DNA, 25 bp, Rattus norvegicus
cggcgctcctcagtgtaggtgacgc

SEQ ID NO: 451547 - DNA, 25 bp, Rattus norvegicus
tggatcaccgtttcagtggcattta

SEQ ID NO: 451548 - DNA, 25 bp, Rattus norvegicus
gcgaggttgcgtcactggctcgcca

SEQ ID NO: 451549 - DNA, 25 bp, Rattus norvegicus
ctcgaggggaaggacacgtgactct

SEQ ID NO: 451550 - DNA, 25 bp, Rattus norvegicus
acgtgactctgtcagccaatggctg

SEQ ID NO: 451551 - DNA, 25 bp, Rattus norvegicus
ccggctgtcttgtggccggcatctt

SEQ ID NO: 451552 - DNA, 25 bp, Rattus norvegicus
aaaccacgccgcagtcggtagggtg

SEQ ID NO: 451553 - DNA, 25 bp, Rattus norvegicus
caacacctgggattcgtggtagttc

SEQ ID NO: 451554 - DNA, 25 bp, Rattus norvegicus
agttctggaagagagtcccgcccta

SEQ ID NO: 451555 - DNA, 25 bp, Rattus norvegicus
cgccctaagttcttacgattcgaga

SEQ ID NO: 451556 - DNA, 25 bp, Rattus norvegicus
tacgattcgagaactacattttcca

SEQ ID NO: 451557 - DNA, 25 bp, Rattus norvegicus
caaggagcagctctgttgcgacaga

SEQ ID NO: 451558 - DNA, 25 bp, Rattus norvegicus
agcgcatccaagtgaagccggcggc

SEQ ID NO: 451559 - DNA, 25 bp, Rattus norvegicus
gttcccagagagaaaccacgccgca

SEQ ID NO: 451560 - DNA, 25 bp, Rattus norvegicus
gtcacgagaactgcgcaacacctgg

SEQ ID NO: 451561 - DNA, 25 bp, Rattus norvegicus
ggacgaactcctggcgaagaaccga

SEQ ID NO: 451562 - DNA, 25 bp, Rattus norvegicus
tgcgcgagcgccaagttcggaaact

SEQ ID NO: 451563 - DNA, 25 bp, Rattus norvegicus
aggggcagagcggtccctctctaaa

SEQ ID NO: 451564 - DNA, 25 bp, Rattus norvegicus
agcggtccctctctaaaggccctgg

SEQ ID NO: 451565 - DNA, 25 bp, Rattus norvegicus
agaactggcccaggccgagacgccg

SEQ ID NO: 451566 - DNA, 25 bp, Rattus norvegicus
actgacctttgtggccgaggcaggc

SEQ ID NO: 451567 - DNA, 25 bp, Rattus norvegicus
agcgctttggcgagggtgactgccc

SEQ ID NO: 451568 - DNA, 25 bp, Rattus norvegicus
ccagcgccagcgctttggcgagggt

SEQ ID NO: 451569 - DNA, 25 bp, Rattus norvegicus
tggggccaagtctccggactgacct

SEQ ID NO: 451570 - DNA, 25 bp, Rattus norvegicus
gccaagtctccggactgacctttgt

SEQ ID NO: 451571 - DNA, 25 bp, Rattus norvegicus
aagtctccggactgacctttgtggc

SEQ ID NO: 451572 - DNA, 25 bp, Rattus norvegicus
tctccggactgacctttgtggccga

SEQ ID NO: 451573 - DNA, 25 bp, Rattus norvegicus
cggactgacctttgtggccgaggca

SEQ ID NO: 451574 - DNA, 25 bp, Rattus norvegicus
acctggggccaagtctccggactga

SEQ ID NO: 451575 - DNA, 25 bp, Rattus norvegicus
gcagcgcggttttcttggccgcctt

SEQ ID NO: 451576 - DNA, 25 bp, Rattus norvegicus
agcgcggttttcttggccgccttct

SEQ ID NO: 451577 - DNA, 25 bp, Rattus norvegicus
catccaggggtactcaggcggctgc

SEQ ID NO: 451578 - DNA, 25 bp, Rattus norvegicus
atccaggggtactcaggcggctgca

SEQ ID NO: 451579 - DNA, 25 bp, Rattus norvegicus
tccggactgacctttgtggccgagg

SEQ ID NO: 451580 - DNA, 25 bp, Rattus norvegicus
cggagcacggcatttcccgagcagc

SEQ ID NO: 451581 - DNA, 25 bp, Rattus norvegicus
gaccgcctttgtttctgccaggccg

SEQ ID NO: 451582 - DNA, 25 bp, Rattus norvegicus
actcagcagcctggcgccctgcttg

SEQ ID NO: 451583 - DNA, 25 bp, Rattus norvegicus
tgggaaccaggcagctcagcgggcc

SEQ ID NO: 451584 - DNA, 25 bp, Rattus norvegicus
cggcatttcccgagcagcggcagca

SEQ ID NO: 451585 - DNA, 25 bp, Rattus norvegicus
agtcgcttgaaaccgcggcctctat

SEQ ID NO: 451586 - DNA, 25 bp, Rattus norvegicus
cccagagctcgctgagcttccaagg

SEQ ID NO: 451587 - DNA, 25 bp, Rattus norvegicus
gagctcgctgagcttccaaggcaga

SEQ ID NO: 451588 - DNA, 25 bp, Rattus norvegicus
gctgagcttccaaggcagacgccgc

SEQ ID NO: 451589 - DNA, 25 bp, Rattus norvegicus
acgccggagtcgcagtgctgctgca

SEQ ID NO: 451590 - DNA, 25 bp, Rattus norvegicus
ccgctgccagctcgcttctgccaga

SEQ ID NO: 451591 - DNA, 25 bp, Rattus norvegicus
ttctgccagaactccacgcagagac

SEQ ID NO: 451592 - DNA, 25 bp, Rattus norvegicus
aggccgaccgcctttgtttctgcca

SEQ ID NO: 451593 - DNA, 25 bp, Rattus norvegicus
agcagtcgcttgaaaccgcggcctc

SEQ ID NO: 451594 - DNA, 25 bp, Rattus norvegicus
aaggagcgaagctctggcccggcgc

SEQ ID NO: 451595 - DNA, 25 bp, Rattus norvegicus
cgccgcggcagaaggagcgaagctc

SEQ ID NO: 451596 - DNA, 25 bp, Rattus norvegicus
ggctataaaacgagaggcggggcgc

SEQ ID NO: 451597 - DNA, 25 bp, Rattus norvegicus
caggcgggacttggccaatggcgtc

SEQ ID NO: 451598 - DNA, 25 bp, Rattus norvegicus
ctgtcttgacgtgggcaggcgggac

SEQ ID NO: 451599 - DNA, 25 bp, Rattus norvegicus
atcagcggctgtcttgacgtgggca

SEQ ID NO: 451600 - DNA, 25 bp, Rattus norvegicus
tctaatcagcggctgtcttgacgtg

SEQ ID NO: 451601 - DNA, 25 bp, Rattus norvegicus
accatctaatcagcggctgtcttga

SEQ ID NO: 451602 - DNA, 25 bp, Rattus norvegicus
tgaccatctaatcagcggctgtctt

SEQ ID NO: 451603 - DNA, 25 bp, Rattus norvegicus
cgtgaccatctaatcagcggctgtc

SEQ ID NO: 451604 - DNA, 25 bp, Rattus norvegicus
ggcgtgaccatctaatcagcggctg

SEQ ID NO: 451605 - DNA, 25 bp, Rattus norvegicus
ggaggcgtgaccatctaatcagcgg

SEQ ID NO: 451606 - DNA, 25 bp, Rattus norvegicus
cgttcgggaggcgtgaccatctaat

SEQ ID NO: 451607 - DNA, 25 bp, Rattus norvegicus
tcgggaggcgtgaccatctaatcag

SEQ ID NO: 451608 - DNA, 25 bp, Rattus norvegicus
aggcgggtcgatggtactcaacacc

SEQ ID NO: 451609 - DNA, 25 bp, Rattus norvegicus
caagggcttgacacccgtaagggag

SEQ ID NO: 451610 - DNA, 25 bp, Rattus norvegicus
ctctgacaagggcttgacacccgta

SEQ ID NO: 451611 - DNA, 25 bp, Rattus norvegicus
tcgtgatcacactctctgacaaggg

SEQ ID NO: 451612 - DNA, 25 bp, Rattus norvegicus
tcgcgatgtttcacgatcgtgatca

SEQ ID NO: 451613 - DNA, 25 bp, Rattus norvegicus
gtcgctttttgcatcgcgatgtttc

SEQ ID NO: 451614 - DNA, 25 bp, Rattus norvegicus
ctgtcgtagtaggtcgctttttgca

SEQ ID NO: 451615 - DNA, 25 bp, Rattus norvegicus
cgtagatcgccgagctgtcgtagta

SEQ ID NO: 451616 - DNA, 25 bp, Rattus norvegicus
gtaggggtagccaccgtagatcgcc

SEQ ID NO: 451617 - DNA, 25 bp, Rattus norvegicus
acccattggctgcttggtaggggta

SEQ ID NO: 451618 - DNA, 25 bp, Rattus norvegicus
ctggcattgtaagcgaacccattgg

SEQ ID NO: 451619 - DNA, 25 bp, Rattus norvegicus
cgtatggctgctgactggcattgta

SEQ ID NO: 451620 - DNA, 25 bp, Rattus norvegicus
ccgtaagggagcacattggcacgcc

SEQ ID NO: 451621 - DNA, 25 bp, Rattus norvegicus
tcaacaccatccgtgcccagagtgg

SEQ ID NO: 451622 - DNA, 25 bp, Rattus norvegicus
ctccgcggggctagtggcaccgact

SEQ ID NO: 451623 - DNA, 25 bp, Rattus norvegicus
ggaagctccggcttgtgaactcttc

SEQ ID NO: 451624 - DNA, 25 bp, Rattus norvegicus
tgagggtatcagtcactgccggcga

SEQ ID NO: 451625 - DNA, 25 bp, Rattus norvegicus
aagtgtgagggtatcagtcactgcc

SEQ ID NO: 451626 - DNA, 25 bp, Rattus norvegicus
agcgcggcctgaactgaagtgtgag

SEQ ID NO: 451627 - DNA, 25 bp, Rattus norvegicus
gagacgtacactccaccattcagcg

SEQ ID NO: 451628 - DNA, 25 bp, Rattus norvegicus
agtggcaccgacttgggtatgtttc

SEQ ID NO: 451629 - DNA, 25 bp, Rattus norvegicus
ccgacttgggtatgtttcttatgaa

SEQ ID NO: 451630 - DNA, 25 bp, Rattus norvegicus
tttcttatgaatactgcgccgagca

SEQ ID NO: 451631 - DNA, 25 bp, Rattus norvegicus
ccgagatttaagtctgcagccataa

SEQ ID NO: 451632 - DNA, 25 bp, Rattus norvegicus
tgcagccataaatcaccgagacgta

SEQ ID NO: 451633 - DNA, 25 bp, Rattus norvegicus
tcttgaaccgagatttaagtctgca

SEQ ID NO: 451634 - DNA, 25 bp, Rattus norvegicus
cgcttaccttaacttctgacggccg

SEQ ID NO: 451635 - DNA, 25 bp, Rattus norvegicus
actccaccattcagcgctgagagcg

SEQ ID NO: 451636 - DNA, 25 bp, Rattus norvegicus
gagagccggccgcaaaaatccgctc

SEQ ID NO: 451637 - DNA, 25 bp, Rattus norvegicus
ctcgggtgagagcttactcagacca

SEQ ID NO: 451638 - DNA, 25 bp, Rattus norvegicus
ttcaacgcatacctttccggctcga

SEQ ID NO: 451639 - DNA, 25 bp, Rattus norvegicus
gcaaagggctaaggcgtattcaacg

SEQ ID NO: 451640 - DNA, 25 bp, Rattus norvegicus
actgtctggtccaaaggggctgaga

SEQ ID NO: 451641 - DNA, 25 bp, Rattus norvegicus
ggccgtgagaaccagacctaggaca

SEQ ID NO: 451642 - DNA, 25 bp, Rattus norvegicus
ctaagccagctgcagggaaggccgt

SEQ ID NO: 451643 - DNA, 25 bp, Rattus norvegicus
tttctcctccaaactgctgacgcga

SEQ ID NO: 451644 - DNA, 25 bp, Rattus norvegicus
ggcgtgggtcaataatcaacccgca

SEQ ID NO: 451645 - DNA, 25 bp, Rattus norvegicus
caaaccctcagggtcggatgtggca

SEQ ID NO: 451646 - DNA, 25 bp, Rattus norvegicus
tcgactagcgcccaggtggctctgg

SEQ ID NO: 451647 - DNA, 25 bp, Rattus norvegicus
gctcggcggcattttcccttcaaac

SEQ ID NO: 451648 - DNA, 25 bp, Rattus norvegicus
catttgaagaaagaaggcgtgggtc

SEQ ID NO: 451649 - DNA, 25 bp, Rattus norvegicus
gcgcaacttgaaagggaagagcccg

SEQ ID NO: 451650 - DNA, 25 bp, Rattus norvegicus
cggcgctcacgtggatcttcttcat

SEQ ID NO: 451651 - DNA, 25 bp, Rattus norvegicus
ttcatccaggggtacaccaccggct

SEQ ID NO: 451652 - DNA, 25 bp, Rattus norvegicus
tcgcgcgcccttggcgcgtagtatg

SEQ ID NO: 451653 - DNA, 25 bp, Rattus norvegicus
accgtgcggtgcgaactcctcgaag

SEQ ID NO: 451654 - DNA, 25 bp, Rattus norvegicus
tgcgaactcctcgaagggagggaac

SEQ ID NO: 451655 - DNA, 25 bp, Rattus norvegicus
ggctcgatgtagttggagtttatca

SEQ ID NO: 451656 - DNA, 25 bp, Rattus norvegicus
cgagctcatggtcattaatttgtga

SEQ ID NO: 451657 - DNA, 25 bp, Rattus norvegicus
ttgtgaagtgcaaaaatactaattt

SEQ ID NO: 451658 - DNA, 25 bp, Rattus norvegicus
ttctcgcggtgtcgtttttctgcgc

SEQ ID NO: 451659 - DNA, 25 bp, Rattus norvegicus
ggtgtcgtttttctgcgctcgccga

SEQ ID NO: 451660 - DNA, 25 bp, Rattus norvegicus
ctgcgatccggccaatgggaaaccc

SEQ ID NO: 451661 - DNA, 25 bp, Rattus norvegicus
gcgtgatggatgctgctagccaccc

SEQ ID NO: 451662 - DNA, 25 bp, Rattus norvegicus
gtttatcaaaaacgagctcatggtc

SEQ ID NO: 451663 - DNA, 25 bp, Rattus norvegicus
cacataccggcgctcacgtggatct

SEQ ID NO: 451664 - DNA, 25 bp, Rattus norvegicus
gccgagtccctgaattgttcgctca

SEQ ID NO: 451665 - DNA, 25 bp, Rattus norvegicus
ggtcgaattgaggttacagcccatt

SEQ ID NO: 451666 - DNA, 25 bp, Rattus norvegicus
tcctgcctgatgacctctagaggta

SEQ ID NO: 451667 - DNA, 25 bp, Rattus norvegicus
ttgtccagtcgtaaatcctgcctga

SEQ ID NO: 451668 - DNA, 25 bp, Rattus norvegicus
tggggtacgacttcgaatcacgtgc

SEQ ID NO: 451669 - DNA, 25 bp, Rattus norvegicus
ctcctacgtaggcacccaaatatgg

SEQ ID NO: 451670 - DNA, 25 bp, Rattus norvegicus
catgtactcggttccctcctacgta

SEQ ID NO: 451671 - DNA, 25 bp, Rattus norvegicus
cgcggtcgtttgtgcgtctatagca

SEQ ID NO: 451672 - DNA, 25 bp, Rattus norvegicus
ggccatttggatagcgaccgcaaaa

SEQ ID NO: 451673 - DNA, 25 bp, Rattus norvegicus
tgttcgctcacggaactatgatctc

SEQ ID NO: 451674 - DNA, 25 bp, Rattus norvegicus
accgtgactaatgtgcagcttgcgc

SEQ ID NO: 451675 - DNA, 25 bp, Rattus norvegicus
tccctcgcagttccattaggatgta

SEQ ID NO: 451676 - DNA, 25 bp, Rattus norvegicus
ccatgccattgtagccgtagccgta

SEQ ID NO: 451677 - DNA, 25 bp, Rattus norvegicus
aattatgcaactggtagtccgggcc

SEQ ID NO: 451678 - DNA, 25 bp, Rattus norvegicus
cccggcagattaatgggcacacaca

SEQ ID NO: 451679 - DNA, 25 bp, Rattus norvegicus
cggcagattaatgggcacacacagc

SEQ ID NO: 451680 - DNA, 25 bp, Rattus norvegicus
acgccaaaagcgacagcagcaaatc

SEQ ID NO: 451681 - DNA, 25 bp, Rattus norvegicus
cgacagcagcaaatcgcaccagctg

SEQ ID NO: 451682 - DNA, 25 bp, Rattus norvegicus
gcagcaaatcgcaccagctgacgca

SEQ ID NO: 451683 - DNA, 25 bp, Rattus norvegicus
caaatcgcaccagctgacgcagcgg

SEQ ID NO: 451684 - DNA, 25 bp, Rattus norvegicus
atcgcaccagctgacgcagcggcgg

SEQ ID NO: 451685 - DNA, 25 bp, Rattus norvegicus
ccaatgggaaagagcgccggagccc

SEQ ID NO: 451686 - DNA, 25 bp, Rattus norvegicus
ggcgaccgaggcagcaaagttacaa

SEQ ID NO: 451687 - DNA, 25 bp, Rattus norvegicus
cgaccgaggcagcaaagttacaaac

SEQ ID NO: 451688 - DNA, 25 bp, Rattus norvegicus
ccgaggcagcaaagttacaaacagc

SEQ ID NO: 451689 - DNA, 25 bp, Rattus norvegicus
gaggcagcaaagttacaaacagccc

SEQ ID NO: 451690 - DNA, 25 bp, Rattus norvegicus
cgcccgcccggcagattaatgggca

SEQ ID NO: 451691 - DNA, 25 bp, Rattus norvegicus
cccgcccggcagattaatgggcaca

SEQ ID NO: 451692 - DNA, 25 bp, Rattus norvegicus
gcctacctgaactgcgcatccaggg

SEQ ID NO: 451693 - DNA, 25 bp, Rattus norvegicus
gaggctcaaatacgcggcctgcacc

SEQ ID NO: 451694 - DNA, 25 bp, Rattus norvegicus
aatcagacctctaggctccgggaga

SEQ ID NO: 451695 - DNA, 25 bp, Rattus norvegicus
tctcagcagccctcacaggtggtct

SEQ ID NO: 451696 - DNA, 25 bp, Rattus norvegicus
cattttcttttggacggagctcgcc

SEQ ID NO: 451697 - DNA, 25 bp, Rattus norvegicus
cgaggtagcgtgatatatgataaca

SEQ ID NO: 451698 - DNA, 25 bp, Rattus norvegicus
ggcagctttcagtgtcggttttacg

SEQ ID NO: 451699 - DNA, 25 bp, Rattus norvegicus
cccgccgtatatttgctaaaaagcg

SEQ ID NO: 451700 - DNA, 25 bp, Rattus norvegicus
caagaagtcggctcggcattttgga

SEQ ID NO: 451701 - DNA, 25 bp, Rattus norvegicus
cgcttctctgcgagttgggtgcaaa

SEQ ID NO: 451702 - DNA, 25 bp, Rattus norvegicus
ttgacattgtataagcccggcacgt

SEQ ID NO: 451703 - DNA, 25 bp, Rattus norvegicus
cgtcggctcccagaccgtagctgga

SEQ ID NO: 451704 - DNA, 25 bp, Rattus norvegicus
cctttggcgaggtcactgcagagcc

SEQ ID NO: 451705 - DNA, 25 bp, Rattus norvegicus
catccaggggtagatgcggaaactg

SEQ ID NO: 451706 - DNA, 25 bp, Rattus norvegicus
tttcttaacactgcagccgcagctg

SEQ ID NO: 451707 - DNA, 25 bp, Rattus norvegicus
tggcccgcgtgaacttcggcaacgc

SEQ ID NO: 451708 - DNA, 25 bp, Rattus norvegicus
ccctgaaccagattttggggcctca

SEQ ID NO: 451709 - DNA, 25 bp, Rattus norvegicus
gccatctcctggacttttcttaaca

SEQ ID NO: 451710 - DNA, 25 bp, Rattus norvegicus
agaacgcctcttgcgtggagccaca

SEQ ID NO: 451711 - DNA, 25 bp, Rattus norvegicus
aggctcgcttcaagtcgacatttta

SEQ ID NO: 451712 - DNA, 25 bp, Rattus norvegicus
cgcgcaaatcccattccagaaaggc

SEQ ID NO: 451713 - DNA, 25 bp, Rattus norvegicus
tatgactactgttcacgcgcaaatc

SEQ ID NO: 451714 - DNA, 25 bp, Rattus norvegicus
tgaccctggaatagaactggcgttc

SEQ ID NO: 451715 - DNA, 25 bp, Rattus norvegicus
atctctgcttggatgcggactgtga

SEQ ID NO: 451716 - DNA, 25 bp, Rattus norvegicus
ctcgctgtccctagatctctgcttg

SEQ ID NO: 451717 - DNA, 25 bp, Rattus norvegicus
cttcgatcgatcctgaacgaccgtc

SEQ ID NO: 451718 - DNA, 25 bp, Rattus norvegicus
ttctctgtgggttcatctggtcctg

SEQ ID NO: 451719 - DNA, 25 bp, Rattus norvegicus
ccagcgttccactcacatgggcgga

SEQ ID NO: 451720 - DNA, 25 bp, Rattus norvegicus
tccagtacaggatctcggtgcttta

SEQ ID NO: 451721 - DNA, 25 bp, Rattus norvegicus
tggcaggacgcgtgctggagcttaa

SEQ ID NO: 451722 - DNA, 25 bp, Rattus norvegicus
ccacagaagcgtaggttgctgcggc

SEQ ID NO: 451723 - DNA, 25 bp, Rattus norvegicus
tggtgcagccacagaagcgtaggtt

SEQ ID NO: 451724 - DNA, 25 bp, Rattus norvegicus
tacgaccagatggtgcagccacaga

SEQ ID NO: 451725 - DNA, 25 bp, Rattus norvegicus
acctggcctacgaccagatggtgca

SEQ ID NO: 451726 - DNA, 25 bp, Rattus norvegicus
cttcaacctggcctacgaccagatg

SEQ ID NO: 451727 - DNA, 25 bp, Rattus norvegicus
ttacctgtactacctggggctgctg

SEQ ID NO: 451728 - DNA, 25 bp, Rattus norvegicus
ggatctcggtgctttacctgtacta

SEQ ID NO: 451729 - DNA, 25 bp, Rattus norvegicus
ctggagcttaaggacgagctggtgc

SEQ ID NO: 451730 - DNA, 25 bp, Rattus norvegicus
acccgggagcggcagagcttccagt

SEQ ID NO: 451731 - DNA, 25 bp, Rattus norvegicus
gcggcagagcttccagtacaggatc

SEQ ID NO: 451732 - DNA, 25 bp, Rattus norvegicus
cggtgctttacctgtactacctggg

SEQ ID NO: 451733 - DNA, 25 bp, Rattus norvegicus
ttgaacccgtgctcacccgggagcg

SEQ ID NO: 451734 - DNA, 25 bp, Rattus norvegicus
tccacatagtagttgcccagggccc

SEQ ID NO: 451735 - DNA, 25 bp, Rattus norvegicus
cgcctagcaggaaggagtccacata

SEQ ID NO: 451736 - DNA, 25 bp, Rattus norvegicus
actgggttccacgaggcaccgaaca

SEQ ID NO: 451737 - DNA, 25 bp, Rattus norvegicus
atacaccgcagcaggcaccgcattg

SEQ ID NO: 451738 - DNA, 25 bp, Rattus norvegicus
ccgacagcggttcaggtttaatgcc

SEQ ID NO: 451739 - DNA, 25 bp, Rattus norvegicus
cgctgctttcgaagaaccgcccaaa

SEQ ID NO: 451740 - DNA, 25 bp, Rattus norvegicus
ctggaggagaaccacaagcatagtc

SEQ ID NO: 451741 - DNA, 25 bp, Rattus norvegicus
cattgttttcggagaaggcgccttc

SEQ ID NO: 451742 - DNA, 25 bp, Rattus norvegicus
cgctctcattctcggcattgttttc

SEQ ID NO: 451743 - DNA, 25 bp, Rattus norvegicus
ccgatttgcaggaaggagacactta

SEQ ID NO: 451744 - DNA, 25 bp, Rattus norvegicus
gccctagattcagaggcacccatcg

SEQ ID NO: 451745 - DNA, 25 bp, Rattus norvegicus
ggcctgatccacacggttctctgga

SEQ ID NO: 451746 - DNA, 25 bp, Rattus norvegicus
ccgcccaaagtctgtctgtcctagg

SEQ ID NO: 451747 - DNA, 25 bp, Rattus norvegicus
ccgacccgccgaaattatgaaactg

SEQ ID NO: 451748 - DNA, 25 bp, Rattus norvegicus
gccggaagatcattggccactgctc

SEQ ID NO: 451749 - DNA, 25 bp, Rattus norvegicus
gaccagtgccctcgggatcgcgact

SEQ ID NO: 451750 - DNA, 25 bp, Rattus norvegicus
ggtgtcgcaaggctcagcgcatcct

SEQ ID NO: 451751 - DNA, 25 bp, Rattus norvegicus
acagattatgtaaccggcaggggcc

SEQ ID NO: 451752 - DNA, 25 bp, Rattus norvegicus
ttggccactgctccatgtggcaccg

SEQ ID NO: 451753 - DNA, 25 bp, Rattus norvegicus
gcaccggctgcgcaagttcaaagac

SEQ ID NO: 451754 - DNA, 25 bp, Rattus norvegicus
ttcaaagactgctgcgagccgccca

SEQ ID NO: 451755 - DNA, 25 bp, Rattus norvegicus
agctacccttgcgtgtgtgcacgga

SEQ ID NO: 451756 - DNA, 25 bp, Rattus norvegicus
gggtttctgcgcctttcggcgatca

SEQ ID NO: 451757 - DNA, 25 bp, Rattus norvegicus
gcgatcaagccagtcagagggcctc

SEQ ID NO: 451758 - DNA, 25 bp, Rattus norvegicus
gggcctccgagttcctgagacgcaa

SEQ ID NO: 451759 - DNA, 25 bp, Rattus norvegicus
ttgctagaagccctggcgcggcacc

SEQ ID NO: 451760 - DNA, 25 bp, Rattus norvegicus
cacggaaacagactaggcgccaaga

SEQ ID NO: 451761 - DNA, 25 bp, Rattus norvegicus
caccatcttgggagcgggcaagcct

SEQ ID NO: 451762 - DNA, 25 bp, Rattus norvegicus
gacagctcggcccaggtccacttaa

SEQ ID NO: 451763 - DNA, 25 bp, Rattus norvegicus
caaacagagccgtgcgattgtcgcc

SEQ ID NO: 451764 - DNA, 25 bp, Rattus norvegicus
gcgattgtcgccctgtaggaccaga

SEQ ID NO: 451765 - DNA, 25 bp, Rattus norvegicus
ttgtcgccctgtaggaccagaaagg

SEQ ID NO: 451766 - DNA, 25 bp, Rattus norvegicus
accagaaagggcagggcaccgagcc

SEQ ID NO: 451767 - DNA, 25 bp, Rattus norvegicus
caccgagccgggtcctgtgtctggc

SEQ ID NO: 451768 - DNA, 25 bp, Rattus norvegicus
tgatgctccgtgagtggaccctcct

SEQ ID NO: 451769 - DNA, 25 bp, Rattus norvegicus
cacctccggcgagcaggaaacgcgt

SEQ ID NO: 451770 - DNA, 25 bp, Rattus norvegicus
aggtccacttaaccgctgtcgcagg

SEQ ID NO: 451771 - DNA, 25 bp, Rattus norvegicus
taaccgctgtcgcaggcactagtga

SEQ ID NO: 451772 - DNA, 25 bp, Rattus norvegicus
cgcaggcactagtgatgctccgtga

SEQ ID NO: 451773 - DNA, 25 bp, Rattus norvegicus
actagtgatgctccgtgagtggacc

SEQ ID NO: 451774 - DNA, 25 bp, Rattus norvegicus
agtggaccctcctccgcggatttcg

SEQ ID NO: 451775 - DNA, 25 bp, Rattus norvegicus
cggcctcttctactcactcccggca

SEQ ID NO: 451776 - DNA, 25 bp, Rattus norvegicus
gtacatgttgaatagaaactccttc

SEQ ID NO: 451777 - DNA, 25 bp, Rattus norvegicus
ctccagcgtctggtgcttcgtgtaa

SEQ ID NO: 451778 - DNA, 25 bp, Rattus norvegicus
gctcgggaagcgaaaacgcgttgtc

SEQ ID NO: 451779 - DNA, 25 bp, Rattus norvegicus
gccgctctcgagtaaggtacatgtt

SEQ ID NO: 451780 - DNA, 25 bp, Rattus norvegicus
acgctacggctgatctctaggcgcc

SEQ ID NO: 451781 - DNA, 25 bp, Rattus norvegicus
tgtctgtccgtgaggtggacgctac

SEQ ID NO: 451782 - DNA, 25 bp, Rattus norvegicus
ccagattttcacttgtctgtccgtg

SEQ ID NO: 451783 - DNA, 25 bp, Rattus norvegicus
cttcagtttcatcctgcgattctga

SEQ ID NO: 451784 - DNA, 25 bp, Rattus norvegicus
tctcggttcattttcttcagtttca

SEQ ID NO: 451785 - DNA, 25 bp, Rattus norvegicus
tctcggattcggttttctcggttca

SEQ ID NO: 451786 - DNA, 25 bp, Rattus norvegicus
gctgtgagctctcggattcggtttt

SEQ ID NO: 451787 - DNA, 25 bp, Rattus norvegicus
aaaaattaaagttggctgtgagctc

SEQ ID NO: 451788 - DNA, 25 bp, Rattus norvegicus
aacgcgttgtctgggaagtttcatc

SEQ ID NO: 451789 - DNA, 25 bp, Rattus norvegicus
ttcgtgtaagggcagcgtttcttcc

SEQ ID NO: 451790 - DNA, 25 bp, Rattus norvegicus
gtaggagctctcttctttgatgttc

SEQ ID NO: 451791 - DNA, 25 bp, Rattus norvegicus
agcagatagccctttctggctgaca

SEQ ID NO: 451792 - DNA, 25 bp, Rattus norvegicus
atttggcgaagggagcagatagccc

SEQ ID NO: 451793 - DNA, 25 bp, Rattus norvegicus
gggctctccgagcatgacattgttg

SEQ ID NO: 451794 - DNA, 25 bp, Rattus norvegicus
ccaaaaaagagttcgcggcagggct

SEQ ID NO: 451795 - DNA, 25 bp, Rattus norvegicus
tgagcgagtcgaccaaaaaagagtt

SEQ ID NO: 451796 - DNA, 25 bp, Rattus norvegicus
ctctgcctgagctgatgagcgagtc

SEQ ID NO: 451797 - DNA, 25 bp, Rattus norvegicus
aagagcccgcagctttgcagcccgt

SEQ ID NO: 451798 - DNA, 25 bp, Rattus norvegicus
ctgcgcaaaagaacacgaagtggcc

SEQ ID NO: 451799 - DNA, 25 bp, Rattus norvegicus
ttggggcatttgtccgcagaatcgt

SEQ ID NO: 451800 - DNA, 25 bp, Rattus norvegicus
gaagtagcccggcactggcactccg

SEQ ID NO: 451801 - DNA, 25 bp, Rattus norvegicus
cgtggagtctaggactcgctccttt

SEQ ID NO: 451802 - DNA, 25 bp, Rattus norvegicus
gccaccggcgcaaaccagcgtgggt

SEQ ID NO: 451803 - DNA, 25 bp, Rattus norvegicus
ggacggcgcctcattacgcttgttg

SEQ ID NO: 451804 - DNA, 25 bp, Rattus norvegicus
tttgaatacgaaggggagccggaca

SEQ ID NO: 451805 - DNA, 25 bp, Rattus norvegicus
agtgcgccatctcgtggcggctacg

SEQ ID NO: 451806 - DNA, 25 bp, Rattus norvegicus
ctttgacattgatcgggagtgcgcc

SEQ ID NO: 451807 - DNA, 25 bp, Rattus norvegicus
gctccctggcggctttgacattgat

SEQ ID NO: 451808 - DNA, 25 bp, Rattus norvegicus
caagaatctcgctggggttccgggc

SEQ ID NO: 451809 - DNA, 25 bp, Rattus norvegicus
gaagcgaacaaaggccaagaatctc

SEQ ID NO: 451810 - DNA, 25 bp, Rattus norvegicus
ctgctcttagtatcagaagcgaaca

SEQ ID NO: 451811 - DNA, 25 bp, Rattus norvegicus
acgtaccgtgctgctcttagtatca

SEQ ID NO: 451812 - DNA, 25 bp, Rattus norvegicus
ggagccggacaagtgaaataacgta

SEQ ID NO: 451813 - DNA, 25 bp, Rattus norvegicus
taaattgcagcctcagtcacttctt

SEQ ID NO: 451814 - DNA, 25 bp, Rattus norvegicus
cgaaggcgctctgctttaaattgca

SEQ ID NO: 451815 - DNA, 25 bp, Rattus norvegicus
aggcctaacgaaggcgctctgcttt

SEQ ID NO: 451816 - DNA, 25 bp, Rattus norvegicus
ccgcgatgcggaaaggcctaacgaa

SEQ ID NO: 451817 - DNA, 25 bp, Rattus norvegicus
agtgaaataacgtaccgtgctgctc

SEQ ID NO: 451818 - DNA, 25 bp, Rattus norvegicus
ctggacccgagacgtagtaagtaca

SEQ ID NO: 451819 - DNA, 25 bp, Rattus norvegicus
catcattgggctaccttgggctctc

SEQ ID NO: 451820 - DNA, 25 bp, Rattus norvegicus
ctctccgcagtagccgagcttaaca

SEQ ID NO: 451821 - DNA, 25 bp, Rattus norvegicus
ttaacatgattctccactgcagctg

SEQ ID NO: 451822 - DNA, 25 bp, Rattus norvegicus
ctgcctctttgaagcggatccgtga

SEQ ID NO: 451823 - DNA, 25 bp, Rattus norvegicus
gttgaaattgacaagccgcgagcta

SEQ ID NO: 451824 - DNA, 25 bp, Rattus norvegicus
tttctttgtagccacctcaggggaa

SEQ ID NO: 451825 - DNA, 25 bp, Rattus norvegicus
gtgttctcaccgaaagcacgtaatc

SEQ ID NO: 451826 - DNA, 25 bp, Rattus norvegicus
gtaatcgccggtgtaactcatgttg

SEQ ID NO: 451827 - DNA, 25 bp, Rattus norvegicus
cccggaattgtgtagcttcaggttc

SEQ ID NO: 451828 - DNA, 25 bp, Rattus norvegicus
ccggagtctgttgtccgaaggctta

SEQ ID NO: 451829 - DNA, 25 bp, Rattus norvegicus
aggcttacgttcagcaccttcttcg

SEQ ID NO: 451830 - DNA, 25 bp, Rattus norvegicus
ttgctctggaaagcacctcagtctc

SEQ ID NO: 451831 - DNA, 25 bp, Rattus norvegicus
tggcgtattctctgaaggtcacttc

SEQ ID NO: 451832 - DNA, 25 bp, Rattus norvegicus
tacggcggctaatgcgagaggccaa

SEQ ID NO: 451833 - DNA, 25 bp, Rattus norvegicus
tagggcctggccgaggctcacccgg

SEQ ID NO: 451834 - DNA, 25 bp, Rattus norvegicus
cccgtagggcctggccgaggctcac

SEQ ID NO: 451835 - DNA, 25 bp, Rattus norvegicus
tgcgtgtgtgtctgtaaagaaggga

SEQ ID NO: 451836 - DNA, 25 bp, Rattus norvegicus
cgcggcctgacggtgcgtgtgtgtc

SEQ ID NO: 451837 - DNA, 25 bp, Rattus norvegicus
gctaatgcgagaggccaaaaatgtt

SEQ ID NO: 451838 - DNA, 25 bp, Rattus norvegicus
cggctaatgcgagaggccaaaaatg

SEQ ID NO: 451839 - DNA, 25 bp, Rattus norvegicus
gcggctaatgcgagaggccaaaaat

SEQ ID NO: 451840 - DNA, 25 bp, Rattus norvegicus
acggcggctaatgcgagaggccaaa

SEQ ID NO: 451841 - DNA, 25 bp, Rattus norvegicus
ctacggcggctaatgcgagaggcca

SEQ ID NO: 451842 - DNA, 25 bp, Rattus norvegicus
ccctacggcggctaatgcgagaggc

SEQ ID NO: 451843 - DNA, 25 bp, Rattus norvegicus
acccggagccctacggcggctaatg

SEQ ID NO: 451844 - DNA, 25 bp, Rattus norvegicus
atcgtcaacccggagccctacggcg

SEQ ID NO: 451845 - DNA, 25 bp, Rattus norvegicus
ggcggctaatgcgagaggccaaaaa

SEQ ID NO: 451846 - DNA, 25 bp, Rattus norvegicus
tgctcctgtcatgttttatttcccg

SEQ ID NO: 451847 - DNA, 25 bp, Rattus norvegicus
cggatgcgttgttctcacttgccca

SEQ ID NO: 451848 - DNA, 25 bp, Rattus norvegicus
agcagccctctgagttcgcggatgc

SEQ ID NO: 451849 - DNA, 25 bp, Rattus norvegicus
tgggcctccatcttgagcaggactg

SEQ ID NO: 451850 - DNA, 25 bp, Rattus norvegicus
tccagtgtccacgtagcacgagctg

SEQ ID NO: 451851 - DNA, 25 bp, Rattus norvegicus
tcagcaaatagtgcctggagcccgg

SEQ ID NO: 451852 - DNA, 25 bp, Rattus norvegicus
ataccggattattctcctggggacg

SEQ ID NO: 451853 - DNA, 25 bp, Rattus norvegicus
ttgcccacaccctggcacttgggta

SEQ ID NO: 451854 - DNA, 25 bp, Rattus norvegicus
gttgcgaaaccaaggctccgttcca

SEQ ID NO: 451855 - DNA, 25 bp, Rattus norvegicus
ttgggaccctcttctcagcctgtct

SEQ ID NO: 451856 - DNA, 25 bp, Rattus norvegicus
gctccaggctcccaaagcttaagtg

SEQ ID NO: 451857 - DNA, 25 bp, Rattus norvegicus
gctctccttgggtcctttcgctcag

SEQ ID NO: 451858 - DNA, 25 bp, Rattus norvegicus
gtcctcagacttcaggcgtcagatg

SEQ ID NO: 451859 - DNA, 25 bp, Rattus norvegicus
ctccgttccacgcagccaagaatta

SEQ ID NO: 451860 - DNA, 25 bp, Rattus norvegicus
ccgccgagcagggactacactgctt

SEQ ID NO: 451861 - DNA, 25 bp, Rattus norvegicus
ggacccgacgagctttgtgccgccg

SEQ ID NO: 451862 - DNA, 25 bp, Rattus norvegicus
agcgccgcgggacccgacgagcttt

SEQ ID NO: 451863 - DNA, 25 bp, Rattus norvegicus
cgaagtagccatagggcagcgccgc

SEQ ID NO: 451864 - DNA, 25 bp, Rattus norvegicus
tagccgctgccgaagtagccatagg

SEQ ID NO: 451865 - DNA, 25 bp, Rattus norvegicus
cgcacgggtagtagccgctgccgaa

SEQ ID NO: 451866 - DNA, 25 bp, Rattus norvegicus
ccatgtacttgtcggcgaaggcggc

SEQ ID NO: 451867 - DNA, 25 bp, Rattus norvegicus
cggtgtccatgtacttgtcggcgaa

SEQ ID NO: 451868 - DNA, 25 bp, Rattus norvegicus
tccttggcgcgggagctgaactcct

SEQ ID NO: 451869 - DNA, 25 bp, Rattus norvegicus
agaaggcaaactccttggcgcggga

SEQ ID NO: 451870 - DNA, 25 bp, Rattus norvegicus
cgtagccctggtggtagaaggcaaa

SEQ ID NO: 451871 - DNA, 25 bp, Rattus norvegicus
gcatatccagatagccgggcacggg

SEQ ID NO: 451872 - DNA, 25 bp, Rattus norvegicus
cccggaaccactggcatatccagat

SEQ ID NO: 451873 - DNA, 25 bp, Rattus norvegicus
agggactacactgcttggcggcctc

SEQ ID NO: 451874 - DNA, 25 bp, Rattus norvegicus
cccaagaagtgaagagcgcgctgcg

SEQ ID NO: 451875 - DNA, 25 bp, Rattus norvegicus
tatgcaaagcgagaggctccggctc

SEQ ID NO: 451876 - DNA, 25 bp, Rattus norvegicus
atcctttctcgggtctcgcgcggag

SEQ ID NO: 451877 - DNA, 25 bp, Rattus norvegicus
aactatgatgagtggggcgggaaac

SEQ ID NO: 451878 - DNA, 25 bp, Rattus norvegicus
ccgcgcagcagtcacccacggagga

SEQ ID NO: 451879 - DNA, 25 bp, Rattus norvegicus
caaagcgagaggctccggctcggct

SEQ ID NO: 451880 - DNA, 25 bp, Rattus norvegicus
cccggcgtatgcaaagcgagaggct

SEQ ID NO: 451881 - DNA, 25 bp, Rattus norvegicus
gtcatagcccgagccgcatggagaa

SEQ ID NO: 451882 - DNA, 25 bp, Rattus norvegicus
ctgtgccagcactagctcccgccgc

SEQ ID NO: 451883 - DNA, 25 bp, Rattus norvegicus
aaacatgacggtgggctcgatccag

SEQ ID NO: 451884 - DNA, 25 bp, Rattus norvegicus
cgtagagaaacatgacggtgggctc

SEQ ID NO: 451885 - DNA, 25 bp, Rattus norvegicus
ccgccgttgtcgtagagaaacatga

SEQ ID NO: 451886 - DNA, 25 bp, Rattus norvegicus
cgccgccgttgtcgtagagaaacat

SEQ ID NO: 451887 - DNA, 25 bp, Rattus norvegicus
agaagaccccagtggcgctgtttta

SEQ ID NO: 451888 - DNA, 25 bp, Rattus norvegicus
taagtgctgggaccgacacgggttc

SEQ ID NO: 451889 - DNA, 25 bp, Rattus norvegicus
gagaaagtgactgagcctccgccgc

SEQ ID NO: 451890 - DNA, 25 bp, Rattus norvegicus
atgttcatgccctaccggccgctcg

SEQ ID NO: 451891 - DNA, 25 bp, Rattus norvegicus
ctgagcaacaccttctgcgcggggc

SEQ ID NO: 451892 - DNA, 25 bp, Rattus norvegicus
tgccctcgatggtggcgctgaccac

SEQ ID NO: 451893 - DNA, 25 bp, Rattus norvegicus
tggtggcgctgaccactgcactgcc

SEQ ID NO: 451894 - DNA, 25 bp, Rattus norvegicus
ctgcctgcgcgcgagaaagtgactg

SEQ ID NO: 451895 - DNA, 25 bp, Rattus norvegicus
cgacacgggttcgaccgtcaggaag

SEQ ID NO: 451896 - DNA, 25 bp, Rattus norvegicus
ggttcgaccgtcaggaagtcccaga

SEQ ID NO: 451897 - DNA, 25 bp, Rattus norvegicus
caaaactctctccatccgcttggag

SEQ ID NO: 451898 - DNA, 25 bp, Rattus norvegicus
ccatccgcttggagtcctggagtgt

SEQ ID NO: 451899 - DNA, 25 bp, Rattus norvegicus
ggactccagagcgtacacggagttc

SEQ ID NO: 451900 - DNA, 25 bp, Rattus norvegicus
tttcccgagtctgccgggtaagtgc

SEQ ID NO: 451901 - DNA, 25 bp, Rattus norvegicus
ttctcagagactttcccgagtctgc

SEQ ID NO: 451902 - DNA, 25 bp, Rattus norvegicus
ggtggctagagagcctactctcctt

SEQ ID NO: 451903 - DNA, 25 bp, Rattus norvegicus
gctgctgctatagcgctcgggctcc

SEQ ID NO: 451904 - DNA, 25 bp, Rattus norvegicus
ctgttgctgctgctatagcgctcgg

SEQ ID NO: 451905 - DNA, 25 bp, Rattus norvegicus
caaggctagtagtcttcctcctctt

SEQ ID NO: 451906 - DNA, 25 bp, Rattus norvegicus
agcaaggctagtagtcttcctcctc

SEQ ID NO: 451907 - DNA, 25 bp, Rattus norvegicus
cccggagcaaggctagtagtcttcc

SEQ ID NO: 451908 - DNA, 25 bp, Rattus norvegicus
ctcccggagcaaggctagtagtctt

SEQ ID NO: 451909 - DNA, 25 bp, Rattus norvegicus
tcctcccggagcaaggctagtagtc

SEQ ID NO: 451910 - DNA, 25 bp, Rattus norvegicus
ggctagagagcctactctccttttc

SEQ ID NO: 451911 - DNA, 25 bp, Rattus norvegicus
tccctggggtggctagagagcctac

SEQ ID NO: 451912 - DNA, 25 bp, Rattus norvegicus
ctaggtcccaggagcctcgagcggg

SEQ ID NO: 451913 - DNA, 25 bp, Rattus norvegicus
ctccgggatgctggctaggtcccag

SEQ ID NO: 451914 - DNA, 25 bp, Rattus norvegicus
tgctccgggatgctggctaggtccc

SEQ ID NO: 451915 - DNA, 25 bp, Rattus norvegicus
tcctcctcccggagcaaggctagta

SEQ ID NO: 451916 - DNA, 25 bp, Rattus norvegicus
cgaagtgcttatctgtcgggttgca

SEQ ID NO: 451917 - DNA, 25 bp, Rattus norvegicus
cgccttgcagagaaaagctgtgcca

SEQ ID NO: 451918 - DNA, 25 bp, Rattus norvegicus
tcgccagaggggctcatcggcaccg

SEQ ID NO: 451919 - DNA, 25 bp, Rattus norvegicus
taagacctcgccagaggggctcatc

SEQ ID NO: 451920 - DNA, 25 bp, Rattus norvegicus
tggtcctctaagacctcgccagagg

SEQ ID NO: 451921 - DNA, 25 bp, Rattus norvegicus
tggtgccttggtcctctaagacctc

SEQ ID NO: 451922 - DNA, 25 bp, Rattus norvegicus
ttgcagagaaaagctgtgccagccc

SEQ ID NO: 451923 - DNA, 25 bp, Rattus norvegicus
gaggccgccttgcagagaaaagctg

SEQ ID NO: 451924 - DNA, 25 bp, Rattus norvegicus
agagaggccgccttgcagagaaaag

SEQ ID NO: 451925 - DNA, 25 bp, Rattus norvegicus
cttatctgtcgggttgcaggtcagt

SEQ ID NO: 451926 - DNA, 25 bp, Rattus norvegicus
ggattgttcgaagtgcttatctgtc

SEQ ID NO: 451927 - DNA, 25 bp, Rattus norvegicus
ccctcttgggcaaggtcaccgtctt

SEQ ID NO: 451928 - DNA, 25 bp, Rattus norvegicus
cttgggcaaggtcaccgtcttcccg

SEQ ID NO: 451929 - DNA, 25 bp, Rattus norvegicus
ctgtcgggttgcaggtcagtttccg

SEQ ID NO: 451930 - DNA, 25 bp, Rattus norvegicus
cgctgaacctgtggggccgtccatc

SEQ ID NO: 451931 - DNA, 25 bp, Rattus norvegicus
cgtccatcgtggataaggtgtgccc

SEQ ID NO: 451932 - DNA, 25 bp, Rattus norvegicus
cccagcctttctcggcagatggaga

SEQ ID NO: 451933 - DNA, 25 bp, Rattus norvegicus
tgacatgagcttgcagcccgctgaa

SEQ ID NO: 451934 - DNA, 25 bp, Rattus norvegicus
gcctgtgagactgtgagctctgccc

SEQ ID NO: 451935 - DNA, 25 bp, Rattus norvegicus
cctctccagactggttggcctgtga

SEQ ID NO: 451936 - DNA, 25 bp, Rattus norvegicus
gatggaattccctctccgtggtgca

SEQ ID NO: 451937 - DNA, 25 bp, Rattus norvegicus
ccaacaaataccaagcgctgggatg

SEQ ID NO: 451938 - DNA, 25 bp, Rattus norvegicus
tggagggtcgaatttcctcccaaca

SEQ ID NO: 451939 - DNA, 25 bp, Rattus norvegicus
agcccactgctcctggagggtcgaa

SEQ ID NO: 451940 - DNA, 25 bp, Rattus norvegicus
ccagacaggaaagggcgcagacacc

SEQ ID NO: 451941 - DNA, 25 bp, Rattus norvegicus
gagaattcctttttaagcccagaca

SEQ ID NO: 451942 - DNA, 25 bp, Rattus norvegicus
ctcggcagatggagaattccttttt

SEQ ID NO: 451943 - DNA, 25 bp, Rattus norvegicus
ggtgtcctgccaaggcggcatcccg

SEQ ID NO: 451944 - DNA, 25 bp, Rattus norvegicus
atgcccgcgtagtggcagagccctg

SEQ ID NO: 451945 - DNA, 25 bp, Rattus norvegicus
ctggccgcaaagaccggatggaacg

SEQ ID NO: 451946 - DNA, 25 bp, Rattus norvegicus
aggatacaggacctggccgcaaaga

SEQ ID NO: 451947 - DNA, 25 bp, Rattus norvegicus
cggtgctttgtcaccgcggcagcga

SEQ ID NO: 451948 - DNA, 25 bp, Rattus norvegicus
agttcgggagcggtgctttgtcacc

SEQ ID NO: 451949 - DNA, 25 bp, Rattus norvegicus
ggcgcaccaagacagcagttcggga

SEQ ID NO: 451950 - DNA, 25 bp, Rattus norvegicus
acttccgcctctggcgatcggcagt

SEQ ID NO: 451951 - DNA, 25 bp, Rattus norvegicus
tgcgacgagatacgacttccgcctc

SEQ ID NO: 451952 - DNA, 25 bp, Rattus norvegicus
agagccctgggatttgagccagaga

SEQ ID NO: 451953 - DNA, 25 bp, Rattus norvegicus
tagctattcggatgcccgcgtagtg

SEQ ID NO: 451954 - DNA, 25 bp, Rattus norvegicus
cggacttctagctattcggatgccc

SEQ ID NO: 451955 - DNA, 25 bp, Rattus norvegicus
tgtgccaagatcaaccggacttcta

SEQ ID NO: 451956 - DNA, 25 bp, Rattus norvegicus
agggaggctcactactgtgccaaga

SEQ ID NO: 451957 - DNA, 25 bp, Rattus norvegicus
ccagagaggatgctgcgacgagata

SEQ ID NO: 451958 - DNA, 25 bp, Rattus norvegicus
gaccagactccactcgggcggctgt

SEQ ID NO: 451959 - DNA, 25 bp, Rattus norvegicus
gagagagatgcaccgggaccagact

SEQ ID NO: 451960 - DNA, 25 bp, Rattus norvegicus
aatcagcgtcgagctggcggcatcc

SEQ ID NO: 451961 - DNA, 25 bp, Rattus norvegicus
tcagattccgtttgaaacaaccggc

SEQ ID NO: 451962 - DNA, 25 bp, Rattus norvegicus
gttcagagaatttcaatcagcgtcg

SEQ ID NO: 451963 - DNA, 25 bp, Rattus norvegicus
ctcgcagcttttgaagttcagagaa

SEQ ID NO: 451964 - DNA, 25 bp, Rattus norvegicus
ggcggaagccaaactcgcagctttt

SEQ ID NO: 451965 - DNA, 25 bp, Rattus norvegicus
gtaggattcccagccaccctctatg

SEQ ID NO: 451966 - DNA, 25 bp, Rattus norvegicus
tctctgccgagcgaagcgaagcttt

SEQ ID NO: 451967 - DNA, 25 bp, Rattus norvegicus
agtgcccgctcaaggcttcagattc

SEQ ID NO: 451968 - DNA, 25 bp, Rattus norvegicus
gcgaagctttttccgtggatcccag

SEQ ID NO: 451969 - DNA, 25 bp, Rattus norvegicus
gggcctcaggtcacctagacagcta

SEQ ID NO: 451970 - DNA, 25 bp, Rattus norvegicus
tctatgcctcctagccggggcggaa

SEQ ID NO: 451971 - DNA, 25 bp, Rattus norvegicus
ttccgtggatcccagcgtccagtgc

SEQ ID NO: 451972 - DNA, 25 bp, Rattus norvegicus
ggtcgccgtctacaccacgctgggg

SEQ ID NO: 451973 - DNA, 25 bp, Rattus norvegicus
tcgcatcacaaggtgaccctagctc

SEQ ID NO: 451974 - DNA, 25 bp, Rattus norvegicus
cggcacagaggagcgctcgcatcac

SEQ ID NO: 451975 - DNA, 25 bp, Rattus norvegicus
agggcaatggggcttcctcccagag

SEQ ID NO: 451976 - DNA, 25 bp, Rattus norvegicus
acagcttagaaagaagagggcaatg

SEQ ID NO: 451977 - DNA, 25 bp, Rattus norvegicus
attgcagcaagaggatgacagctta

SEQ ID NO: 451978 - DNA, 25 bp, Rattus norvegicus
cggtactgtaatgacgattgcagca

SEQ ID NO: 451979 - DNA, 25 bp, Rattus norvegicus
agtggcgtcaccagcggtactgtaa

SEQ ID NO: 451980 - DNA, 25 bp, Rattus norvegicus
tatccacttgcgttcgccgagtggc

SEQ ID NO: 451981 - DNA, 25 bp, Rattus norvegicus
agacgtttctatttatccacttgcg

SEQ ID NO: 451982 - DNA, 25 bp, Rattus norvegicus
atcttcgctgtggtagacgtttcta

SEQ ID NO: 451983 - DNA, 25 bp, Rattus norvegicus
cgggtctcctttcatcttcgctgtg

SEQ ID NO: 451984 - DNA, 25 bp, Rattus norvegicus
cgagccattagctgcgggtctcctt

SEQ ID NO: 451985 - DNA, 25 bp, Rattus norvegicus
ctggcgcatcactgccgagccatta

SEQ ID NO: 451986 - DNA, 25 bp, Rattus norvegicus
caccgagtcggatttctatgaagaa

SEQ ID NO: 451987 - DNA, 25 bp, Rattus norvegicus
cgcgagccggccctccgacttcccg

SEQ ID NO: 451988 - DNA, 25 bp, Rattus norvegicus
acggtctgctggagcggccatgctt

SEQ ID NO: 451989 - DNA, 25 bp, Rattus norvegicus
ctctctggccaagggcaacctagta

SEQ ID NO: 451990 - DNA, 25 bp, Rattus norvegicus
gccaagggcaacctagtagctcaga

SEQ ID NO: 451991 - DNA, 25 bp, Rattus norvegicus
ggcaacctagtagctcagacaccga

SEQ ID NO: 451992 - DNA, 25 bp, Rattus norvegicus
gtagctcagacaccgagtcggattt

SEQ ID NO: 451993 - DNA, 25 bp, Rattus norvegicus
ctatgaagaaatcgaggtgagctgc

SEQ ID NO: 451994 - DNA, 25 bp, Rattus norvegicus
agccacggtctgctggagcggccat

SEQ ID NO: 451995 - DNA, 25 bp, Rattus norvegicus
gacagcctctctggccaagggcaac

SEQ ID NO: 451996 - DNA, 25 bp, Rattus norvegicus
tgaaccgccagagaagatggtgccc

SEQ ID NO: 451997 - DNA, 25 bp, Rattus norvegicus
ccgctgcctgaaccgccagagaaga

SEQ ID NO: 451998 - DNA, 25 bp, Rattus norvegicus
gaagaaatcgaggtgagctgcaccc

SEQ ID NO: 451999 - DNA, 25 bp, Rattus norvegicus
aagatggtgccccacggttgcctga

SEQ ID NO: 452000 - DNA, 25 bp, Rattus norvegicus
cgtgctctcgcagccctacccgcga

SEQ ID NO: 452001 - DNA, 25 bp, Rattus norvegicus
gcgccttccgccacccaccgctcta

SEQ ID NO: 452002 - DNA, 25 bp, Rattus norvegicus
ctcctgcctcgcctgccacagcggc

SEQ ID NO: 452003 - DNA, 25 bp, Rattus norvegicus
cgccgcctcagacttcacttgtgcc

SEQ ID NO: 452004 - DNA, 25 bp, Rattus norvegicus
agacttcacttgtgcctccacctcc

SEQ ID NO: 452005 - DNA, 25 bp, Rattus norvegicus
tacccgcgacccgaactgctgtgcg

SEQ ID NO: 452006 - DNA, 25 bp, Rattus norvegicus
acccgaactgctgtgcgccttccgc

SEQ ID NO: 452007 - DNA, 25 bp, Rattus norvegicus
cgctcgacaccttccgcgtgctctc

SEQ ID NO: 452008 - DNA, 25 bp, Rattus norvegicus
ccctgccctactactcgcccgtggg

SEQ ID NO: 452009 - DNA, 25 bp, Rattus norvegicus
atgacgtggccgcacccagccgacc

SEQ ID NO: 452010 - DNA, 25 bp, Rattus norvegicus
acagcggctggccatgacgtggccg

SEQ ID NO: 452011 - DNA, 25 bp, Rattus norvegicus
gctcggactccttcctcacgttcgc

SEQ ID NO: 452012 - DNA, 25 bp, Rattus norvegicus
ctgtgctcagcaaggcctcctccgt

SEQ ID NO: 452013 - DNA, 25 bp, Rattus norvegicus
ctccacctcccgctcggactccttc

SEQ ID NO: 452014 - DNA, 25 bp, Rattus norvegicus
tcacagctcactcaggaggaaaggc

SEQ ID NO: 452015 - DNA, 25 bp, Rattus norvegicus
tcgcaatcctccctaatctcgaaga

SEQ ID NO: 452016 - DNA, 25 bp, Rattus norvegicus
atctcgaagaccctcctcccgccac

SEQ ID NO: 452017 - DNA, 25 bp, Rattus norvegicus
ctctgctgtttttgttcttctctta

SEQ ID NO: 452018 - DNA, 25 bp, Rattus norvegicus
gaggcctcacctgagccttcgcaat

SEQ ID NO: 452019 - DNA, 25 bp, Rattus norvegicus
aaggcgaggcctcacctgagccttc

SEQ ID NO: 452020 - DNA, 25 bp, Rattus norvegicus
cactcaggaggaaaggcgaggcctc

SEQ ID NO: 452021 - DNA, 25 bp, Rattus norvegicus
ggtcgcacggtccagagctcacagc

SEQ ID NO: 452022 - DNA, 25 bp, Rattus norvegicus
acacccgagtcacgaggggtcacga

SEQ ID NO: 452023 - DNA, 25 bp, Rattus norvegicus
gctgtcacacccgagtcacgagggg

SEQ ID NO: 452024 - DNA, 25 bp, Rattus norvegicus
ttctcttaacctaccaacacgctgt

SEQ ID NO: 452025 - DNA, 25 bp, Rattus norvegicus
tgctgtttttgttcttctcttaacc

SEQ ID NO: 452026 - DNA, 25 bp, Rattus norvegicus
gagctcacagctcactcaggaggaa

SEQ ID NO: 452027 - DNA, 25 bp, Rattus norvegicus
cccgtcgggctctctgctgtttttg

SEQ ID NO: 452028 - DNA, 25 bp, Rattus norvegicus
cacacggcctgtggactgcgagtgt

SEQ ID NO: 452029 - DNA, 25 bp, Rattus norvegicus
gaccacaattgtcgcttttaccctc

SEQ ID NO: 452030 - DNA, 25 bp, Rattus norvegicus
gggcgaaaagccctcttcggacagc

SEQ ID NO: 452031 - DNA, 25 bp, Rattus norvegicus
cttcggacagccagaggaagacgcg

SEQ ID NO: 452032 - DNA, 25 bp, Rattus norvegicus
acagccagaggaagacgcgcagatg

SEQ ID NO: 452033 - DNA, 25 bp, Rattus norvegicus
gcgaggtccttacccgctgcaaggc

SEQ ID NO: 452034 - DNA, 25 bp, Rattus norvegicus
ggccgctccagtaccggaggccgga

SEQ ID NO: 452035 - DNA, 25 bp, Rattus norvegicus
ctcacacacggcctgtggactgcga

SEQ ID NO: 452036 - DNA, 25 bp, Rattus norvegicus
caaccgcagcccttcgggcgaaaag

SEQ ID NO: 452037 - DNA, 25 bp, Rattus norvegicus
gggatggcccgcaccaccgcaagga

SEQ ID NO: 452038 - DNA, 25 bp, Rattus norvegicus
cgcaaggacagctcgcgcacgcgct

SEQ ID NO: 452039 - DNA, 25 bp, Rattus norvegicus
gcacgcgctctccttgctctgcttg

SEQ ID NO: 452040 - DNA, 25 bp, Rattus norvegicus
aaggaggctgccatgctgccccacg

SEQ ID NO: 452041 - DNA, 25 bp, Rattus norvegicus
gaaaagccctcttcggacagccaga

SEQ ID NO: 452042 - DNA, 25 bp, Rattus norvegicus
tttccgtggtgacgaagctctcctt

SEQ ID NO: 452043 - DNA, 25 bp, Rattus norvegicus
cgagccttcccagggcggaagtgac

SEQ ID NO: 452044 - DNA, 25 bp, Rattus norvegicus
gcctcgattgtgacgtgttctggac

SEQ ID NO: 452045 - DNA, 25 bp, Rattus norvegicus
gtgacgaagctctccttcccaagga

SEQ ID NO: 452046 - DNA, 25 bp, Rattus norvegicus
acgtgttctggacttgggtctacgg

SEQ ID NO: 452047 - DNA, 25 bp, Rattus norvegicus
tgctgggaaccgtttccgtggtgac

SEQ ID NO: 452048 - DNA, 25 bp, Rattus norvegicus
accctggaacctgggcctggcgagt

SEQ ID NO: 452049 - DNA, 25 bp, Rattus norvegicus
gtctcgaccctggaacctgggcctg

SEQ ID NO: 452050 - DNA, 25 bp, Rattus norvegicus
ttcgaggtaaccgacgctcgcgctc

SEQ ID NO: 452051 - DNA, 25 bp, Rattus norvegicus
gccgcgtgccttcgaggtaaccgac

SEQ ID NO: 452052 - DNA, 25 bp, Rattus norvegicus
tgctgaactccggagccggcgtagc

SEQ ID NO: 452053 - DNA, 25 bp, Rattus norvegicus
tctccgcttagaggaggtgtagccg

SEQ ID NO: 452054 - DNA, 25 bp, Rattus norvegicus
cggctctccgcttagaggaggtgta

SEQ ID NO: 452055 - DNA, 25 bp, Rattus norvegicus
aaggacaagcttctcccgggcctcg

SEQ ID NO: 452056 - DNA, 25 bp, Rattus norvegicus
aaatcgcgccgcgacccacccaggc

SEQ ID NO: 452057 - DNA, 25 bp, Rattus norvegicus
gatgaaccctgacattcttacccgc

SEQ ID NO: 452058 - DNA, 25 bp, Rattus norvegicus
gtgccttccctgatgaaccctgaca

SEQ ID NO: 452059 - DNA, 25 bp, Rattus norvegicus
gccgataagacaaaatggccgccgc

SEQ ID NO: 452060 - DNA, 25 bp, Rattus norvegicus
ccacgggacttacgctctcgtggtc

SEQ ID NO: 452061 - DNA, 25 bp, Rattus norvegicus
cagacgcttgggcacaggcccaagg

SEQ ID NO: 452062 - DNA, 25 bp, Rattus norvegicus
gtgctttagtctccgcggcccggac

SEQ ID NO: 452063 - DNA, 25 bp, Rattus norvegicus
tcagccgtcaggtgctttagtctcc

SEQ ID NO: 452064 - DNA, 25 bp, Rattus norvegicus
cctccttcagccgtcaggtgcttta

SEQ ID NO: 452065 - DNA, 25 bp, Rattus norvegicus
gaggttcgcgcggaatcttccctcc

SEQ ID NO: 452066 - DNA, 25 bp, Rattus norvegicus
ctccatagaacaacaaatcacccta

SEQ ID NO: 452067 - DNA, 25 bp, Rattus norvegicus
atcccggacttcctccatagaacaa

SEQ ID NO: 452068 - DNA, 25 bp, Rattus norvegicus
ggcctcaccaaggtgcttcttctgc

SEQ ID NO: 452069 - DNA, 25 bp, Rattus norvegicus
aggcccacgggacttacgctctcgt

SEQ ID NO: 452070 - DNA, 25 bp, Rattus norvegicus
ctccggcgttcctagccttccctgg

SEQ ID NO: 452071 - DNA, 25 bp, Rattus norvegicus
tctgggcctcgtcgctttggccggc

SEQ ID NO: 452072 - DNA, 25 bp, Rattus norvegicus
cattcagcgagcctggcgcagcatc

SEQ ID NO: 452073 - DNA, 25 bp, Rattus norvegicus
ttcagcgagcctggcgcagcatcca

SEQ ID NO: 452074 - DNA, 25 bp, Rattus norvegicus
gcgcagcatccagccgggcctggtc

SEQ ID NO: 452075 - DNA, 25 bp, Rattus norvegicus
cccagcgcgggctccggcgttccta

SEQ ID NO: 452076 - DNA, 25 bp, Rattus norvegicus
ttacaaaggttcctgtgggtctctg

SEQ ID NO: 452077 - DNA, 25 bp, Rattus norvegicus
acaaaggttcctgtgggtctctgga

SEQ ID NO: 452078 - DNA, 25 bp, Rattus norvegicus
aaaggttcctgtgggtctctggagc

SEQ ID NO: 452079 - DNA, 25 bp, Rattus norvegicus
gagctcggcggccgcttctcatctg

SEQ ID NO: 452080 - DNA, 25 bp, Rattus norvegicus
catctgagagcagtcccagggcccg

SEQ ID NO: 452081 - DNA, 25 bp, Rattus norvegicus
ttctcatctgagagcagtcccaggg

SEQ ID NO: 452082 - DNA, 25 bp, Rattus norvegicus
tcatctgagagcagtcccagggccc

SEQ ID NO: 452083 - DNA, 25 bp, Rattus norvegicus
cgcttctcatctgagagcagtccca

SEQ ID NO: 452084 - DNA, 25 bp, Rattus norvegicus
aggggacttgactttcgctccaggc

SEQ ID NO: 452085 - DNA, 25 bp, Rattus norvegicus
agcgcgcgtgagtttccctgacacg

SEQ ID NO: 452086 - DNA, 25 bp, Rattus norvegicus
ttgctcagtccaacgtggtcccttc

SEQ ID NO: 452087 - DNA, 25 bp, Rattus norvegicus
ggctcttgccttctccacacttgtt

SEQ ID NO: 452088 - DNA, 25 bp, Rattus norvegicus
agccgactcggaagcgtccttgttt

SEQ ID NO: 452089 - DNA, 25 bp, Rattus norvegicus
cccaacggaccgcaatgatttagaa

SEQ ID NO: 452090 - DNA, 25 bp, Rattus norvegicus
agccgcgaggttacttggtccaatg

SEQ ID NO: 452091 - DNA, 25 bp, Rattus norvegicus
gctgtgtcctgtagtcacccagaga

SEQ ID NO: 452092 - DNA, 25 bp, Rattus norvegicus
ttcaggaatcccacgtgacgtcacc

SEQ ID NO: 452093 - DNA, 25 bp, Rattus norvegicus
ccctgacacggggaacagtcatgaa

SEQ ID NO: 452094 - DNA, 25 bp, Rattus norvegicus
tgtatgtttgcctccagagcccatg

SEQ ID NO: 452095 - DNA, 25 bp, Rattus norvegicus
tgcggaaccctccagaagtgtggtc

SEQ ID NO: 452096 - DNA, 25 bp, Rattus norvegicus
tttcggccaagacgcctggtcacct

SEQ ID NO: 452097 - DNA, 25 bp, Rattus norvegicus
cccgtttctcaatgatgcagcggaa

SEQ ID NO: 452098 - DNA, 25 bp, Rattus norvegicus
atgccagttgcccatccagcgtttc

SEQ ID NO: 452099 - DNA, 25 bp, Rattus norvegicus
tggcgacactgcacgaagaccgtaa

SEQ ID NO: 452100 - DNA, 25 bp, Rattus norvegicus
gcagcagttggtcatccaggtaatc

SEQ ID NO: 452101 - DNA, 25 bp, Rattus norvegicus
cgcaagacccattctgcagcagttg

SEQ ID NO: 452102 - DNA, 25 bp, Rattus norvegicus
ccaaccgttgccgtctagatctagc

SEQ ID NO: 452103 - DNA, 25 bp, Rattus norvegicus
gccgctcagatctagtgcttccaag

SEQ ID NO: 452104 - DNA, 25 bp, Rattus norvegicus
attgaggaatcgaagcttacccagc

SEQ ID NO: 452105 - DNA, 25 bp, Rattus norvegicus
tgactagactctccaggccctcgaa

SEQ ID NO: 452106 - DNA, 25 bp, Rattus norvegicus
ggcgttcttgcccaaaaagcggatc

SEQ ID NO: 452107 - DNA, 25 bp, Rattus norvegicus
gcgactcaggcgtccaatctcgtta

SEQ ID NO: 452108 - DNA, 25 bp, Rattus norvegicus
ccgttggcgtaaaggatgcgcaatt

SEQ ID NO: 452109 - DNA, 25 bp, Rattus norvegicus
cctctagtctggagagcttctcgaa

SEQ ID NO: 452110 - DNA, 25 bp, Rattus norvegicus
cccgtccagccgtagcttgactaga

SEQ ID NO: 452111 - DNA, 25 bp, Rattus norvegicus
cggatccggttagcctccagatgta

SEQ ID NO: 452112 - DNA, 25 bp, Rattus norvegicus
ggaggtcgctgtctatctgtctccc

SEQ ID NO: 452113 - DNA, 25 bp, Rattus norvegicus
agcaactctagtctgtccggctcct

SEQ ID NO: 452114 - DNA, 25 bp, Rattus norvegicus
ccgcaccgggactgagcaagcagcg

SEQ ID NO: 452115 - DNA, 25 bp, Rattus norvegicus
agcacgaataaatagcggcggcggc

SEQ ID NO: 452116 - DNA, 25 bp, Rattus norvegicus
gagggacagcgagcacgaataaata

SEQ ID NO: 452117 - DNA, 25 bp, Rattus norvegicus
tggagagtctacctgtggccgtccc

SEQ ID NO: 452118 - DNA, 25 bp, Rattus norvegicus
cggcggaggctgaattctctagagc

SEQ ID NO: 452119 - DNA, 25 bp, Rattus norvegicus
cctccgtgtcctctggtgagtttca

SEQ ID NO: 452120 - DNA, 25 bp, Rattus norvegicus
tcaagcgggcagagtggattcagcc

SEQ ID NO: 452121 - DNA, 25 bp, Rattus norvegicus
gcaggctccgagtcctgatggtccc

SEQ ID NO: 452122 - DNA, 25 bp, Rattus norvegicus
tttgcccaacacctcggggcaggct

SEQ ID NO: 452123 - DNA, 25 bp, Rattus norvegicus
agcgctgtacactgctgctcggtcc

SEQ ID NO: 452124 - DNA, 25 bp, Rattus norvegicus
ctgagagcggtggtcccatcctcct

SEQ ID NO: 452125 - DNA, 25 bp, Rattus norvegicus
gagatggcagcgtccagcaactcta

SEQ ID NO: 452126 - DNA, 25 bp, Rattus norvegicus
aagtccctcgggaacgctagctagc

SEQ ID NO: 452127 - DNA, 25 bp, Rattus norvegicus
agcccgagtgtgtcctcagagcatc

SEQ ID NO: 452128 - DNA, 25 bp, Rattus norvegicus
tctccgtaggcgcagagacttcctc

SEQ ID NO: 452129 - DNA, 25 bp, Rattus norvegicus
cgcgccctagaatgtgagacttcca

SEQ ID NO: 452130 - DNA, 25 bp, Rattus norvegicus
ggctgactgcctaccaccattaata

SEQ ID NO: 452131 - DNA, 25 bp, Rattus norvegicus
ggcctttccgtacacaccaagtcga

SEQ ID NO: 452132 - DNA, 25 bp, Rattus norvegicus
gggtgatctgcctacttttgcatta

SEQ ID NO: 452133 - DNA, 25 bp, Rattus norvegicus
gcgactaagcttcaggcacccttga

SEQ ID NO: 452134 - DNA, 25 bp, Rattus norvegicus
tcctagtcagcgacaagggacactg

SEQ ID NO: 452135 - DNA, 25 bp, Rattus norvegicus
tgggcgagatcagcaacgattcctg

SEQ ID NO: 452136 - DNA, 25 bp, Rattus norvegicus
cccaggttgttcctatagtgtacga

SEQ ID NO: 452137 - DNA, 25 bp, Rattus norvegicus
cctgcaggtgagtgaacagattctc

SEQ ID NO: 452138 - DNA, 25 bp, Rattus norvegicus
cctctatcaggcagttccgggagaa

SEQ ID NO: 452139 - DNA, 25 bp, Rattus norvegicus
gagtcagcagcctaggtcctgtcta

SEQ ID NO: 452140 - DNA, 25 bp, Rattus norvegicus
tgcaggtagctgcaccgctcgcgtc

SEQ ID NO: 452141 - DNA, 25 bp, Rattus norvegicus
ttggagcgcagagcccagctcagcc

SEQ ID NO: 452142 - DNA, 25 bp, Rattus norvegicus
agaagcaacgccaggcactgccggc

SEQ ID NO: 452143 - DNA, 25 bp, Rattus norvegicus
tcaactgggatcctcgaggcggcaa

SEQ ID NO: 452144 - DNA, 25 bp, Rattus norvegicus
ggaccgcgactccagtaaaagtcca

SEQ ID NO: 452145 - DNA, 25 bp, Rattus norvegicus
ctccagtaaaagtccagtcggcccg

SEQ ID NO: 452146 - DNA, 25 bp, Rattus norvegicus
ttacggccagctgcaggtagctgca

SEQ ID NO: 452147 - DNA, 25 bp, Rattus norvegicus
agccaggcgcgcagaagcaacgcca

SEQ ID NO: 452148 - DNA, 25 bp, Rattus norvegicus
cagtcctgaggtgtagtagcctttg

SEQ ID NO: 452149 - DNA, 25 bp, Rattus norvegicus
acgctgggcgcgagtcttcaggacc

SEQ ID NO: 452150 - DNA, 25 bp, Rattus norvegicus
ccacgactagatcttggcggtgctc

SEQ ID NO: 452151 - DNA, 25 bp, Rattus norvegicus
gtgctccgagcagccctagcggcag

SEQ ID NO: 452152 - DNA, 25 bp, Rattus norvegicus
cagtcggcccggttacggccagctg

SEQ ID NO: 452153 - DNA, 25 bp, Rattus norvegicus
cactgccggcagatcaactgggatc

SEQ ID NO: 452154 - DNA, 25 bp, Rattus norvegicus
caacgaggcattagagttgcaatgg

SEQ ID NO: 452155 - DNA, 25 bp, Rattus norvegicus
ctctcagagagaggtaaggcgagcc

SEQ ID NO: 452156 - DNA, 25 bp, Rattus norvegicus
gaaagctcagagacacttcccgggg

SEQ ID NO: 452157 - DNA, 25 bp, Rattus norvegicus
gcgttgcaagttggcgcccaagaaa

SEQ ID NO: 452158 - DNA, 25 bp, Rattus norvegicus
gcccaagaaaagcagcaccgggttg

SEQ ID NO: 452159 - DNA, 25 bp, Rattus norvegicus
agcaccgggttgtaagactgaaagg

SEQ ID NO: 452160 - DNA, 25 bp, Rattus norvegicus
cctgatcttgaatcgggcgcgaccg

SEQ ID NO: 452161 - DNA, 25 bp, Rattus norvegicus
cagtactcgggaagaagccaggctc

SEQ ID NO: 452162 - DNA, 25 bp, Rattus norvegicus
ggaaatgtggtgactgcccaacgga

SEQ ID NO: 452163 - DNA, 25 bp, Rattus norvegicus
tgcccaacggaagagcagctgcctg

SEQ ID NO: 452164 - DNA, 25 bp, Rattus norvegicus
gctgcggcagctaggttacagcctc

SEQ ID NO: 452165 - DNA, 25 bp, Rattus norvegicus
aggttacagcctccgcatcagtagc

SEQ ID NO: 452166 - DNA, 25 bp, Rattus norvegicus
atcagtagcgcagaagaccgctggc

SEQ ID NO: 452167 - DNA, 25 bp, Rattus norvegicus
ggagcaggttctggccctgatcttg

SEQ ID NO: 452168 - DNA, 25 bp, Rattus norvegicus
gctcagtggccgcaggaaggcgccc

SEQ ID NO: 452169 - DNA, 25 bp, Rattus norvegicus
tgtgcagtgcgccagacggcgccct

SEQ ID NO: 452170 - DNA, 25 bp, Rattus norvegicus
cctccgtgtgtgcagtgcgccagac

SEQ ID NO: 452171 - DNA, 25 bp, Rattus norvegicus
actacctgagcggtgagtgccggcc

SEQ ID NO: 452172 - DNA, 25 bp, Rattus norvegicus
accaactacctgagcggtgagtgcc

SEQ ID NO: 452173 - DNA, 25 bp, Rattus norvegicus
caagtggaccaactacctgagcggt

SEQ ID NO: 452174 - DNA, 25 bp, Rattus norvegicus
gccatggagggcgtgctgtacaagt

SEQ ID NO: 452175 - DNA, 25 bp, Rattus norvegicus
tgctcctaggctgtcgcggtgaccc

SEQ ID NO: 452176 - DNA, 25 bp, Rattus norvegicus
cctaagctggtgctcctaggctgtc

SEQ ID NO: 452177 - DNA, 25 bp, Rattus norvegicus
ccgggaccctaagctggtgctccta

SEQ ID NO: 452178 - DNA, 25 bp, Rattus norvegicus
gcgtccacaccgaccgcgccaagcg

SEQ ID NO: 452179 - DNA, 25 bp, Rattus norvegicus
agcggccgctctgccgcgtccacac

SEQ ID NO: 452180 - DNA, 25 bp, Rattus norvegicus
cgcctccctcgcctctctctagcgg

SEQ ID NO: 452181 - DNA, 25 bp, Rattus norvegicus
cagacggcgccctccgccggctcgt

SEQ ID NO: 452182 - DNA, 25 bp, Rattus norvegicus
ggctcacagtccctgcggcaggatc

SEQ ID NO: 452183 - DNA, 25 bp, Rattus norvegicus
cctcgcatttacagcggattccaga

SEQ ID NO: 452184 - DNA, 25 bp, Rattus norvegicus
ttggaccctctttgcggaattacgc

SEQ ID NO: 452185 - DNA, 25 bp, Rattus norvegicus
cctgcgagtctctctaacggacaca

SEQ ID NO: 452186 - DNA, 25 bp, Rattus norvegicus
ttacgccctggagcttaaaaatgca

SEQ ID NO: 452187 - DNA, 25 bp, Rattus norvegicus
catcccaggggagcctatgtgtagc

SEQ ID NO: 452188 - DNA, 25 bp, Rattus norvegicus
cacccagcgcgtggctaagagcatc

SEQ ID NO: 452189 - DNA, 25 bp, Rattus norvegicus
tgagtatatgcgacggacgcgctcc

SEQ ID NO: 452190 - DNA, 25 bp, Rattus norvegicus
ctgcggcgacagctttgtgagtata

SEQ ID NO: 452191 - DNA, 25 bp, Rattus norvegicus
ttctacgtgctgtgtccggacaacg

SEQ ID NO: 452192 - DNA, 25 bp, Rattus norvegicus
agcgcaggatggacttctacgccga

SEQ ID NO: 452193 - DNA, 25 bp, Rattus norvegicus
ggtgttccagcacgccctttgagct

SEQ ID NO: 452194 - DNA, 25 bp, Rattus norvegicus
cgccatggacttccagcagctggca

SEQ ID NO: 452195 - DNA, 25 bp, Rattus norvegicus
cacccgcaatgctagatcttttgga

SEQ ID NO: 452196 - DNA, 25 bp, Rattus norvegicus
agcaccagccgcgagctgtgtcctg

SEQ ID NO: 452197 - DNA, 25 bp, Rattus norvegicus
tgtccatcaccacatactgggcggg

SEQ ID NO: 452198 - DNA, 25 bp, Rattus norvegicus
agcgggacccaatctctgcgctttg

SEQ ID NO: 452199 - DNA, 25 bp, Rattus norvegicus
atctctgcgctttgcctctactcgg

SEQ ID NO: 452200 - DNA, 25 bp, Rattus norvegicus
ttcctctttcccgttgcgagcggct

SEQ ID NO: 452201 - DNA, 25 bp, Rattus norvegicus
gtccgtacggctacctgagcaccag

SEQ ID NO: 452202 - DNA, 25 bp, Rattus norvegicus
gcgcggcacagtcggccttcagcat

SEQ ID NO: 452203 - DNA, 25 bp, Rattus norvegicus
tcggccttcagcattcccagcagtg

SEQ ID NO: 452204 - DNA, 25 bp, Rattus norvegicus
cagcggtggcccgtacggctcacag

SEQ ID NO: 452205 - DNA, 25 bp, Rattus norvegicus
tacggctcacaggactcggtgcaca

SEQ ID NO: 452206 - DNA, 25 bp, Rattus norvegicus
actcggtgcacagcagcccagagga

SEQ ID NO: 452207 - DNA, 25 bp, Rattus norvegicus
gccgcgtctggtgatcggctcgctc

SEQ ID NO: 452208 - DNA, 25 bp, Rattus norvegicus
gcagagtcaggacagcgggacccaa

SEQ ID NO: 452209 - DNA, 25 bp, Rattus norvegicus
cagcccagaggacggtgtcggctct

SEQ ID NO: 452210 - DNA, 25 bp, Rattus norvegicus
ctgcgtgaagctacggggctgtccc

SEQ ID NO: 452211 - DNA, 25 bp, Rattus norvegicus
cccggcgcacaccacagctggatcc

SEQ ID NO: 452212 - DNA, 25 bp, Rattus norvegicus
tgccgttgccgtagctgtcgccggc

SEQ ID NO: 452213 - DNA, 25 bp, Rattus norvegicus
aaggggtcagcatcgtcccggctcc

SEQ ID NO: 452214 - DNA, 25 bp, Rattus norvegicus
gagcaggatctaaggggtcagcatc

SEQ ID NO: 452215 - DNA, 25 bp, Rattus norvegicus
ccctcggcgcagctggagcaggatc

SEQ ID NO: 452216 - DNA, 25 bp, Rattus norvegicus
aacaggcgctaccttcggcgaagca

SEQ ID NO: 452217 - DNA, 25 bp, Rattus norvegicus
cggttgcccgaacaggcgctacctt

SEQ ID NO: 452218 - DNA, 25 bp, Rattus norvegicus
ttccggcttcttcgcttcgcgccca

SEQ ID NO: 452219 - DNA, 25 bp, Rattus norvegicus
aggagggccagttcagctcagctcc

SEQ ID NO: 452220 - DNA, 25 bp, Rattus norvegicus
gggctctagagagcttgctgagtcc

SEQ ID NO: 452221 - DNA, 25 bp, Rattus norvegicus
tcagaggaggtgtcctcacgcaacc

SEQ ID NO: 452222 - DNA, 25 bp, Rattus norvegicus
aatcgccgtgcatcaccggtccaga

SEQ ID NO: 452223 - DNA, 25 bp, Rattus norvegicus
gaagctacggggctgtcccgactcc

SEQ ID NO: 452224 - DNA, 25 bp, Rattus norvegicus
cagtgagcagtttgcccgcaccctt

SEQ ID NO: 452225 - DNA, 25 bp, Rattus norvegicus
gtcctgttcagatgcacctcggtga

SEQ ID NO: 452226 - DNA, 25 bp, Rattus norvegicus
cctcggtgaccagcagaaagacatc

SEQ ID NO: 452227 - DNA, 25 bp, Rattus norvegicus
agacatcggtcagggtcacagcgca

SEQ ID NO: 452228 - DNA, 25 bp, Rattus norvegicus
ccctcgaaggccgtgtggaaatgct

SEQ ID NO: 452229 - DNA, 25 bp, Rattus norvegicus
tgctggaaacatcggaagatgatcc

SEQ ID NO: 452230 - DNA, 25 bp, Rattus norvegicus
atgatccagcagaagagcggcaccc

SEQ ID NO: 452231 - DNA, 25 bp, Rattus norvegicus
agctgctgcagcagatgttcctgcg

SEQ ID NO: 452232 - DNA, 25 bp, Rattus norvegicus
acatccggcgggcataggctctcag

SEQ ID NO: 452233 - DNA, 25 bp, Rattus norvegicus
acctccacgcctgtgcgagcagtga

SEQ ID NO: 452234 - DNA, 25 bp, Rattus norvegicus
ctcccgcttaggaggttagctagca

SEQ ID NO: 452235 - DNA, 25 bp, Rattus norvegicus
cgtgtttcgctgcatcaggctgatg

SEQ ID NO: 452236 - DNA, 25 bp, Rattus norvegicus
gccagcctgcacgtagggtttccgc

SEQ ID NO: 452237 - DNA, 25 bp, Rattus norvegicus
cggagcagcacctttttgcgcagga

SEQ ID NO: 452238 - DNA, 25 bp, Rattus norvegicus
gcacgtaccgtgaagatgttagagc

SEQ ID NO: 452239 - DNA, 25 bp, Rattus norvegicus
gagctcggcgcagccctgcctgtgc

SEQ ID NO: 452240 - DNA, 25 bp, Rattus norvegicus
taccgtgaagatgttagagcgccgc

SEQ ID NO: 452241 - DNA, 25 bp, Rattus norvegicus
tgaagatgttagagcgccgcttgga

SEQ ID NO: 452242 - DNA, 25 bp, Rattus norvegicus
gttagagcgccgcttggactgcttg

SEQ ID NO: 452243 - DNA, 25 bp, Rattus norvegicus
agcgccgcttggactgcttgcggat

SEQ ID NO: 452244 - DNA, 25 bp, Rattus norvegicus
gtggaagaggcagcgatggtctcga

SEQ ID NO: 452245 - DNA, 25 bp, Rattus norvegicus
gatggtctcgatgcgcagctcccgc

SEQ ID NO: 452246 - DNA, 25 bp, Rattus norvegicus
tcgatgcgcagctcccgctgactga

SEQ ID NO: 452247 - DNA, 25 bp, Rattus norvegicus
gcagctcccgctgactgatgctagg

SEQ ID NO: 452248 - DNA, 25 bp, Rattus norvegicus
ctcccgctgactgatgctaggggtg

SEQ ID NO: 452249 - DNA, 25 bp, Rattus norvegicus
agtagtcgctgaaggcgctgccgcc

SEQ ID NO: 452250 - DNA, 25 bp, Rattus norvegicus
cctgcctgtgcggtgatggcatctg

SEQ ID NO: 452251 - DNA, 25 bp, Rattus norvegicus
atggggcacgtaccgtgaagatgtt

SEQ ID NO: 452252 - DNA, 25 bp, Rattus norvegicus
ggggtgacaccctgggaactcgtca

SEQ ID NO: 452253 - DNA, 25 bp, Rattus norvegicus
tctgctccggcgccgagagccaagg

SEQ ID NO: 452254 - DNA, 25 bp, Rattus norvegicus
gacaccctgggaactcgtcaggcca

SEQ ID NO: 452255 - DNA, 25 bp, Rattus norvegicus
tcggagttagcccaggggtgacacc

SEQ ID NO: 452256 - DNA, 25 bp, Rattus norvegicus
gggaactcgtcaggccagctctgct

SEQ ID NO: 452257 - DNA, 25 bp, Rattus norvegicus
gcaccaggacgagcggccactgcgc

SEQ ID NO: 452258 - DNA, 25 bp, Rattus norvegicus
tgtcccatttccctggcgggagcct

SEQ ID NO: 452259 - DNA, 25 bp, Rattus norvegicus
cgctcgcggtttgggatcaggaact

SEQ ID NO: 452260 - DNA, 25 bp, Rattus norvegicus
tggcggcacagcagcactgccgctc

SEQ ID NO: 452261 - DNA, 25 bp, Rattus norvegicus
ctagggtcgcagatctggcggcaca

SEQ ID NO: 452262 - DNA, 25 bp, Rattus norvegicus
ggatcctggactagggtcgcagatc

SEQ ID NO: 452263 - DNA, 25 bp, Rattus norvegicus
cacagggatcctggactagggtcgc

SEQ ID NO: 452264 - DNA, 25 bp, Rattus norvegicus
cggctctcagcacagggatcctgga

SEQ ID NO: 452265 - DNA, 25 bp, Rattus norvegicus
ggagcctccgcacactgcaccagga

SEQ ID NO: 452266 - DNA, 25 bp, Rattus norvegicus
gacccgcatggtcctcacagtcgga

SEQ ID NO: 452267 - DNA, 25 bp, Rattus norvegicus
tcgcagctagcctgctctccgggta

SEQ ID NO: 452268 - DNA, 25 bp, Rattus norvegicus
gtatcgggcacaacggcactgacct

SEQ ID NO: 452269 - DNA, 25 bp, Rattus norvegicus
tgcaggcgcgccacgcagcagaaca

SEQ ID NO: 452270 - DNA, 25 bp, Rattus norvegicus
cagaacacggcggaagggtttcgca

SEQ ID NO: 452271 - DNA, 25 bp, Rattus norvegicus
aagggtttcgcaggtggatcctctc

SEQ ID NO: 452272 - DNA, 25 bp, Rattus norvegicus
tggatcctctcggtcagcagattgc

SEQ ID NO: 452273 - DNA, 25 bp, Rattus norvegicus
cgtaggcgaagtacaggaacgtctc

SEQ ID NO: 452274 - DNA, 25 bp, Rattus norvegicus
tcctcacagtcggagctcgccatgt

SEQ ID NO: 452275 - DNA, 25 bp, Rattus norvegicus
ggagctcgccatgtccacttgtcca

SEQ ID NO: 452276 - DNA, 25 bp, Rattus norvegicus
tcaagcacagaagagcggggatacc

SEQ ID NO: 452277 - DNA, 25 bp, Rattus norvegicus
cggggataccgctgctaaaaagagc

SEQ ID NO: 452278 - DNA, 25 bp, Rattus norvegicus
tcagcagattgctgccgtaggcgaa

SEQ ID NO: 452279 - DNA, 25 bp, Rattus norvegicus
ctgctctccgggtatcgggcacaac

SEQ ID NO: 452280 - DNA, 25 bp, Rattus norvegicus
gttccgtgccgaatctgcggttgca

SEQ ID NO: 452281 - DNA, 25 bp, Rattus norvegicus
aggtttctccttcctctgagcactc

SEQ ID NO: 452282 - DNA, 25 bp, Rattus norvegicus
ccgattccagccgtaggtttctcct

SEQ ID NO: 452283 - DNA, 25 bp, Rattus norvegicus
gcacccgtgatccttgggcctcgtg

SEQ ID NO: 452284 - DNA, 25 bp, Rattus norvegicus
cgcagcgtgggcacccgtgatcctt

SEQ ID NO: 452285 - DNA, 25 bp, Rattus norvegicus
ctttgcttggccacgcgcagcgtgg

SEQ ID NO: 452286 - DNA, 25 bp, Rattus norvegicus
agcaggtatcgaccctcgccggcat

SEQ ID NO: 452287 - DNA, 25 bp, Rattus norvegicus
ctagctgtgcgccagcaggtatcga

SEQ ID NO: 452288 - DNA, 25 bp, Rattus norvegicus
gcctctccgagcagcatggacagcg

SEQ ID NO: 452289 - DNA, 25 bp, Rattus norvegicus
gcggcgtgctcatgccctgtctgct

SEQ ID NO: 452290 - DNA, 25 bp, Rattus norvegicus
ctatttcatcatgcaccgggcgggc

SEQ ID NO: 452291 - DNA, 25 bp, Rattus norvegicus
tgcggcctgactgcgctatttcatc

SEQ ID NO: 452292 - DNA, 25 bp, Rattus norvegicus
tgagcactccagtggcccggttcag

SEQ ID NO: 452293 - DNA, 25 bp, Rattus norvegicus
tctgcggttgcagacgcagcgtctg

SEQ ID NO: 452294 - DNA, 25 bp, Rattus norvegicus
gctgcactctctggtggctccgcgt

SEQ ID NO: 452295 - DNA, 25 bp, Rattus norvegicus
agaccgtagatcgtcagccctgcca

SEQ ID NO: 452296 - DNA, 25 bp, Rattus norvegicus
ttctctggtcaagagagcaccgacg

SEQ ID NO: 452297 - DNA, 25 bp, Rattus norvegicus
cccgacgccgctattggtcatggtc

SEQ ID NO: 452298 - DNA, 25 bp, Rattus norvegicus
cgctattggtcatggtcgagcaggc

SEQ ID NO: 452299 - DNA, 25 bp, Rattus norvegicus
cccgaggcttctcttggccaaggtc

SEQ ID NO: 452300 - DNA, 25 bp, Rattus norvegicus
ttggccaaggtcctaggagtgatcc

SEQ ID NO: 452301 - DNA, 25 bp, Rattus norvegicus
agtgatccgattgagagcggcgccc

SEQ ID NO: 452302 - DNA, 25 bp, Rattus norvegicus
gaggcacctggacgctgcactctct

SEQ ID NO: 452303 - DNA, 25 bp, Rattus norvegicus
ggcgctgctcctcagcctgctggag

SEQ ID NO: 452304 - DNA, 25 bp, Rattus norvegicus
caactgcagcctggcactggccgaa

SEQ ID NO: 452305 - DNA, 25 bp, Rattus norvegicus
cactggccgaagagctgcttttgga

SEQ ID NO: 452306 - DNA, 25 bp, Rattus norvegicus
tcgatcctcggacgggttattagcc

SEQ ID NO: 452307 - DNA, 25 bp, Rattus norvegicus
cctgctggaggccaactgcagcctg

SEQ ID NO: 452308 - DNA, 25 bp, Rattus norvegicus
cagacgctgcgtctgcaaccgcaga

SEQ ID NO: 452309 - DNA, 25 bp, Rattus norvegicus
tgcaaccgcagattcggcacggaac

SEQ ID NO: 452310 - DNA, 25 bp, Rattus norvegicus
gtgctcagaggaaggagaaacctac

SEQ ID NO: 452311 - DNA, 25 bp, Rattus norvegicus
tgaaatagcgcagtcaggccgcagg

SEQ ID NO: 452312 - DNA, 25 bp, Rattus norvegicus
gcccgcccggtgcatgatgaaatag

SEQ ID NO: 452313 - DNA, 25 bp, Rattus norvegicus
agacagggcatgagcacgccgccta

SEQ ID NO: 452314 - DNA, 25 bp, Rattus norvegicus
accactcggggcgactgtaggagca

SEQ ID NO: 452315 - DNA, 25 bp, Rattus norvegicus
gccgcaatggggctagcagctcctc

SEQ ID NO: 452316 - DNA, 25 bp, Rattus norvegicus
gtcgatacctgctggcgcacagcta

SEQ ID NO: 452317 - DNA, 25 bp, Rattus norvegicus
ccacgctgcgcgtggccaagcaaag

SEQ ID NO: 452318 - DNA, 25 bp, Rattus norvegicus
caaggatcacgggtgcccacgctgc

SEQ ID NO: 452319 - DNA, 25 bp, Rattus norvegicus
cacgaggcccaaggatcacgggtgc

SEQ ID NO: 452320 - DNA, 25 bp, Rattus norvegicus
aacctacggctggaatcggggtatg

SEQ ID NO: 452321 - DNA, 25 bp, Rattus norvegicus
ctgaaccgggccactggagtgctca

SEQ ID NO: 452322 - DNA, 25 bp, Rattus norvegicus
ccgactgtgaggaccatgcgggtca

SEQ ID NO: 452323 - DNA, 25 bp, Rattus norvegicus
acccggagagcaggctagctgcgac

SEQ ID NO: 452324 - DNA, 25 bp, Rattus norvegicus
gttgtgcccgatacccggagagcag

SEQ ID NO: 452325 - DNA, 25 bp, Rattus norvegicus
caggtcagtgccgttgtgcccgata

SEQ ID NO: 452326 - DNA, 25 bp, Rattus norvegicus
ccgtgttctgctgcgtggcgcgcct

SEQ ID NO: 452327 - DNA, 25 bp, Rattus norvegicus
tgcgaaacccttccgccgtgttctg

SEQ ID NO: 452328 - DNA, 25 bp, Rattus norvegicus
accgagaggatccacctgcgaaacc

SEQ ID NO: 452329 - DNA, 25 bp, Rattus norvegicus
cagcaatctgctgaccgagaggatc

SEQ ID NO: 452330 - DNA, 25 bp, Rattus norvegicus
gggagacgttcctgtacttcgccta

SEQ ID NO: 452331 - DNA, 25 bp, Rattus norvegicus
cgagctccgactgtgaggaccatgc

SEQ ID NO: 452332 - DNA, 25 bp, Rattus norvegicus
tggacaagtggacatggcgagctcc

SEQ ID NO: 452333 - DNA, 25 bp, Rattus norvegicus
cccgctcttctgtgcttgaagctgc

SEQ ID NO: 452334 - DNA, 25 bp, Rattus norvegicus
ctgctctttttagcagcggtatccc

SEQ ID NO: 452335 - DNA, 25 bp, Rattus norvegicus
gtacttcgcctacggcagcaatctg

SEQ ID NO: 452336 - DNA, 25 bp, Rattus norvegicus
ggctaactccgaggcctgcccactc

SEQ ID NO: 452337 - DNA, 25 bp, Rattus norvegicus
ccttggctctcggcgccggagcaga

SEQ ID NO: 452338 - DNA, 25 bp, Rattus norvegicus
agcagagctggcctgacgagttccc

SEQ ID NO: 452339 - DNA, 25 bp, Rattus norvegicus
ggtgtcacccctgggctaactccga

SEQ ID NO: 452340 - DNA, 25 bp, Rattus norvegicus
ccgctcgtcctggtgcagtgtgcgg

SEQ ID NO: 452341 - DNA, 25 bp, Rattus norvegicus
aggctcccgccagggaaatgggaca

SEQ ID NO: 452342 - DNA, 25 bp, Rattus norvegicus
agttcctgatcccaaaccgcgagcg

SEQ ID NO: 452343 - DNA, 25 bp, Rattus norvegicus
tgtgccgccagatctgcgaccctag

SEQ ID NO: 452344 - DNA, 25 bp, Rattus norvegicus
gccagatctgcgaccctagtccagg

SEQ ID NO: 452345 - DNA, 25 bp, Rattus norvegicus
tgcgaccctagtccaggatccctgt

SEQ ID NO: 452346 - DNA, 25 bp, Rattus norvegicus
ccctagtccaggatccctgtgctga

SEQ ID NO: 452347 - DNA, 25 bp, Rattus norvegicus
tccaggatccctgtgctgagagccg

SEQ ID NO: 452348 - DNA, 25 bp, Rattus norvegicus
aggatccctgtgctgagagccgccg

SEQ ID NO: 452349 - DNA, 25 bp, Rattus norvegicus
ctgacgagttcccagggtgtcaccc

SEQ ID NO: 452350 - DNA, 25 bp, Rattus norvegicus
atactgccctggctcaggcggtgcc

SEQ ID NO: 452351 - DNA, 25 bp, Rattus norvegicus
ctgagtcctggaggccaccgaggca

SEQ ID NO: 452352 - DNA, 25 bp, Rattus norvegicus
cgacagaccgccaaatggaaatgcc

SEQ ID NO: 452353 - DNA, 25 bp, Rattus norvegicus
tggaaatgccaacccttcgcatctc

SEQ ID NO: 452354 - DNA, 25 bp, Rattus norvegicus
gctagggctgcgatgcccgctagat

SEQ ID NO: 452355 - DNA, 25 bp, Rattus norvegicus
gcggaactcgggcagcgcaacctga

SEQ ID NO: 452356 - DNA, 25 bp, Rattus norvegicus
agcgcaacctgagtcctggaggcca

SEQ ID NO: 452357 - DNA, 25 bp, Rattus norvegicus
agagggaggtcacctgcgtcctcca

SEQ ID NO: 452358 - DNA, 25 bp, Rattus norvegicus
aaccctgtccgactggccaagctga

SEQ ID NO: 452359 - DNA, 25 bp, Rattus norvegicus
gccaagctgatactgccctggctca

SEQ ID NO: 452360 - DNA, 25 bp, Rattus norvegicus
tggagctgcgacagaccgccaaatg

SEQ ID NO: 452361 - DNA, 25 bp, Rattus norvegicus
ccgcggaatcctgcgctgcagcaag

SEQ ID NO: 452362 - DNA, 25 bp, Rattus norvegicus
tgcagcaagcttgtcccgctgtctt

SEQ ID NO: 452363 - DNA, 25 bp, Rattus norvegicus
tgtccgactggccaagctgatactg

SEQ ID NO: 452364 - DNA, 25 bp, Rattus norvegicus
cagcaacggctgaggcaggctcgcc

SEQ ID NO: 452365 - DNA, 25 bp, Rattus norvegicus
cgtctcagaggaagggattagtgcc

SEQ ID NO: 452366 - DNA, 25 bp, Rattus norvegicus
tcagaggaagggattagtgccagcc

SEQ ID NO: 452367 - DNA, 25 bp, Rattus norvegicus
attagtgccagcctgcgggggcaat

SEQ ID NO: 452368 - DNA, 25 bp, Rattus norvegicus
ccaccgggtctgacgtgggcagcaa

SEQ ID NO: 452369 - DNA, 25 bp, Rattus norvegicus
cgaaggctcccgcttgtgggaagac

SEQ ID NO: 452370 - DNA, 25 bp, Rattus norvegicus
ccgaccggcacgctgctgagcggaa

SEQ ID NO: 452371 - DNA, 25 bp, Rattus norvegicus
gtaggtcattgagcccaaaggcacc

SEQ ID NO: 452372 - DNA, 25 bp, Rattus norvegicus
ctggttcagggtcggcctgccctgt

SEQ ID NO: 452373 - DNA, 25 bp, Rattus norvegicus
ttcagggtcggcctgccctgttcgc

SEQ ID NO: 452374 - DNA, 25 bp, Rattus norvegicus
gttcgcctgcgccaaacggattagt

SEQ ID NO: 452375 - DNA, 25 bp, Rattus norvegicus
cgcctgcgccaaacggattagtggg

SEQ ID NO: 452376 - DNA, 25 bp, Rattus norvegicus
cgcgcaggcgctgaagcgtctcaga

SEQ ID NO: 452377 - DNA, 25 bp, Rattus norvegicus
tcccgcttgtgggaagacgctgacc

SEQ ID NO: 452378 - DNA, 25 bp, Rattus norvegicus
actgtcactgcagacccgcgctagg

SEQ ID NO: 452379 - DNA, 25 bp, Rattus norvegicus
tgtccgtcatgactcgtgtgtcccg

SEQ ID NO: 452380 - DNA, 25 bp, Rattus norvegicus
ccttcttgtggctggtgtccgtcat

SEQ ID NO: 452381 - DNA, 25 bp, Rattus norvegicus
tttcttgaagccctccttcttgtgg

SEQ ID NO: 452382 - DNA, 25 bp, Rattus norvegicus
agtggcgctcctacatttcttgaag

SEQ ID NO: 452383 - DNA, 25 bp, Rattus norvegicus
tacccgtcgatgctgaaagtggcgc

SEQ ID NO: 452384 - DNA, 25 bp, Rattus norvegicus
cccgggtgcaaagttctcaccgatg

SEQ ID NO: 452385 - DNA, 25 bp, Rattus norvegicus
acccgcgctaggtacaagctgctca

SEQ ID NO: 452386 - DNA, 25 bp, Rattus norvegicus
caccgatggtgaagctgtacccgtc

SEQ ID NO: 452387 - DNA, 25 bp, Rattus norvegicus
ccaccgccaccggaaggtgtgcaag

SEQ ID NO: 452388 - DNA, 25 bp, Rattus norvegicus
ccagacctgggagctaataaccaag

SEQ ID NO: 452389 - DNA, 25 bp, Rattus norvegicus
ataaccaaggctccgagtgaagccc

SEQ ID NO: 452390 - DNA, 25 bp, Rattus norvegicus
ggactgacaaggctatgtgtagctg

SEQ ID NO: 452391 - DNA, 25 bp, Rattus norvegicus
acaagctgctcacgccggctgcagg

SEQ ID NO: 452392 - DNA, 25 bp, Rattus norvegicus
gcaaaacggtctgtcttcccagcga

SEQ ID NO: 452393 - DNA, 25 bp, Rattus norvegicus
ctaccgacaggcaaaacggtctgtc

SEQ ID NO: 452394 - DNA, 25 bp, Rattus norvegicus
tcccagcgacgccaagggcggtaag

SEQ ID NO: 452395 - DNA, 25 bp, Rattus norvegicus
caacgtggaactgtagcaacccgcc

SEQ ID NO: 452396 - DNA, 25 bp, Rattus norvegicus
gtggaactgtagcaacccgcccgct

SEQ ID NO: 452397 - DNA, 25 bp, Rattus norvegicus
ttacctagtggcaggagttgagacg

SEQ ID NO: 452398 - DNA, 25 bp, Rattus norvegicus
cccaagcaagacttttacctagtgg

SEQ ID NO: 452399 - DNA, 25 bp, Rattus norvegicus
tggcataaggacaccggcgcagact

SEQ ID NO: 452400 - DNA, 25 bp, Rattus norvegicus
ggacaccggcgcagactttaaaata

SEQ ID NO: 452401 - DNA, 25 bp, Rattus norvegicus
gactttaaaatagcgcgcttccgcc

SEQ ID NO: 452402 - DNA, 25 bp, Rattus norvegicus
acagctgggtcagacgagactaatc

SEQ ID NO: 452403 - DNA, 25 bp, Rattus norvegicus
cgagactaatcggaggccgatcttg

SEQ ID NO: 452404 - DNA, 25 bp, Rattus norvegicus
gttcgtggtcgcgttagccgccatg

SEQ ID NO: 452405 - DNA, 25 bp, Rattus norvegicus
ccacgccggaagtggcataaggaca

SEQ ID NO: 452406 - DNA, 25 bp, Rattus norvegicus
ggagtcccggagcacacgctccgtg

SEQ ID NO: 452407 - DNA, 25 bp, Rattus norvegicus
gcaagaagcccggattcggagcgcc

SEQ ID NO: 452408 - DNA, 25 bp, Rattus norvegicus
ggcgcagacggaagctaaagctctt

SEQ ID NO: 452409 - DNA, 25 bp, Rattus norvegicus
aagctcttcctgagcgcggacagcc

SEQ ID NO: 452410 - DNA, 25 bp, Rattus norvegicus
ggaacacctgccagcgctggctact

SEQ ID NO: 452411 - DNA, 25 bp, Rattus norvegicus
caggaagcccgaacttcccgtgcgt

SEQ ID NO: 452412 - DNA, 25 bp, Rattus norvegicus
cgtagccgccagctctagacggttc

SEQ ID NO: 452413 - DNA, 25 bp, Rattus norvegicus
gtatcggtgcccagcaagtctcggc

SEQ ID NO: 452414 - DNA, 25 bp, Rattus norvegicus
tccaggaacgtcatgctggtgggcc

SEQ ID NO: 452415 - DNA, 25 bp, Rattus norvegicus
caggctgttcgtgcgcggtgcacaa

SEQ ID NO: 452416 - DNA, 25 bp, Rattus norvegicus
tgtgcaggtccagcgagtcgcagac

SEQ ID NO: 452417 - DNA, 25 bp, Rattus norvegicus
gctcagggcccacaggcgaaggcca

SEQ ID NO: 452418 - DNA, 25 bp, Rattus norvegicus
gccactacaaagatgcacagcgttc

SEQ ID NO: 452419 - DNA, 25 bp, Rattus norvegicus
tctagacggttcacctccaggaacg

SEQ ID NO: 452420 - DNA, 25 bp, Rattus norvegicus
aaagccgtcgctctgctttgtgcgg

SEQ ID NO: 452421 - DNA, 25 bp, Rattus norvegicus
cctgtcctgcatatcgtggtggtcg

SEQ ID NO: 452422 - DNA, 25 bp, Rattus norvegicus
tcggctttcaccacaagaagggctg

SEQ ID NO: 452423 - DNA, 25 bp, Rattus norvegicus
tgtgcctctgggaattgtgtgacga

SEQ ID NO: 452424 - DNA, 25 bp, Rattus norvegicus
acgagccttctgttccctgtcaatc

SEQ ID NO: 452425 - DNA, 25 bp, Rattus norvegicus
tgtcaatctccaccgacctgctggg

SEQ ID NO: 452426 - DNA, 25 bp, Rattus norvegicus
gacctgctgggtgtctacccgtaaa

SEQ ID NO: 452427 - DNA, 25 bp, Rattus norvegicus
atcttgaggaaaaactcggcgtttg

SEQ ID NO: 452428 - DNA, 25 bp, Rattus norvegicus
tttgaacgccggcatgtagtgagct

SEQ ID NO: 452429 - DNA, 25 bp, Rattus norvegicus
gggtttccacacgaatgctcaagta

SEQ ID NO: 452430 - DNA, 25 bp, Rattus norvegicus
agtaggctgacgcacttgtaggctc

SEQ ID NO: 452431 - DNA, 25 bp, Rattus norvegicus
ttgtaggctccgctctgaagaatca

SEQ ID NO: 452432 - DNA, 25 bp, Rattus norvegicus
cgcaagcctccgaatctgtagttta

SEQ ID NO: 452433 - DNA, 25 bp, Rattus norvegicus
ggcgctccggttgacatctgaaagc

SEQ ID NO: 452434 - DNA, 25 bp, Rattus norvegicus
gaagcgccggagtttgaaagccgcc

SEQ ID NO: 452435 - DNA, 25 bp, Rattus norvegicus
gttcggaaagttctattcagcggcg

SEQ ID NO: 452436 - DNA, 25 bp, Rattus norvegicus
agcagttcggaaagttctattcagc

SEQ ID NO: 452437 - DNA, 25 bp, Rattus norvegicus
cagcctcaggcgtggcctggaaaaa

SEQ ID NO: 452438 - DNA, 25 bp, Rattus norvegicus
tctgtgttggggcttcccgggctac

SEQ ID NO: 452439 - DNA, 25 bp, Rattus norvegicus
ccaaaacaatcggagccgcgcaggc

SEQ ID NO: 452440 - DNA, 25 bp, Rattus norvegicus
caccggaaagccaaaacaatcggag

SEQ ID NO: 452441 - DNA, 25 bp, Rattus norvegicus
ttcatctggctcaccgcgccctttt

SEQ ID NO: 452442 - DNA, 25 bp, Rattus norvegicus
gccggagtttgaaagccgccgccgc

SEQ ID NO: 452443 - DNA, 25 bp, Rattus norvegicus
acagctctgcctcggaaggacgccg

SEQ ID NO: 452444 - DNA, 25 bp, Rattus norvegicus
gcaaaacagctctgcctcggaagga

SEQ ID NO: 452445 - DNA, 25 bp, Rattus norvegicus
gccgcgacacgagcggggcaaaaca

SEQ ID NO: 452446 - DNA, 25 bp, Rattus norvegicus
cggtcttcagctgccgcgacacgag

SEQ ID NO: 452447 - DNA, 25 bp, Rattus norvegicus
ggttcccagatgtccgcgcctggac

SEQ ID NO: 452448 - DNA, 25 bp, Rattus norvegicus
tggggactttcctcgacggtcagaa

SEQ ID NO: 452449 - DNA, 25 bp, Rattus norvegicus
gcgctaccactatgtggggactttc

SEQ ID NO: 452450 - DNA, 25 bp, Rattus norvegicus
cggtgacttcgtgcgctaccactat

SEQ ID NO: 452451 - DNA, 25 bp, Rattus norvegicus
agctttgtgcctgacgagtgtccgc

SEQ ID NO: 452452 - DNA, 25 bp, Rattus norvegicus
gcttcagatccagcggagctttgtg

SEQ ID NO: 452453 - DNA, 25 bp, Rattus norvegicus
cgtaggagtctccatagcgtctctt

SEQ ID NO: 452454 - DNA, 25 bp, Rattus norvegicus
gctgtgagttcggagcttcagatcc

SEQ ID NO: 452455 - DNA, 25 bp, Rattus norvegicus
cctcactttttcaggccgcgcgatg

SEQ ID NO: 452456 - DNA, 25 bp, Rattus norvegicus
cctttccacgtttgcatcggcgcgg

SEQ ID NO: 452457 - DNA, 25 bp, Rattus norvegicus
cagccgggagacctttccacgtttg

SEQ ID NO: 452458 - DNA, 25 bp, Rattus norvegicus
gaattcctaagctccagtgtcccgg

SEQ ID NO: 452459 - DNA, 25 bp, Rattus norvegicus
gagcggtcgtctctaggtttctgga

SEQ ID NO: 452460 - DNA, 25 bp, Rattus norvegicus
atagcgtctcttgggaccctccgtg

SEQ ID NO: 452461 - DNA, 25 bp, Rattus norvegicus
gtcagaagttcgactccaggtaacc

SEQ ID NO: 452462 - DNA, 25 bp, Rattus norvegicus
cttcaaggtgaatatgtactgggcc

SEQ ID NO: 452463 - DNA, 25 bp, Rattus norvegicus
gggcgcggccgtaagccgcacacta

SEQ ID NO: 452464 - DNA, 25 bp, Rattus norvegicus
tgcagcttgccctctcagggccgcg

SEQ ID NO: 452465 - DNA, 25 bp, Rattus norvegicus
cgtcacttcggcagctcgcgtgaga

SEQ ID NO: 452466 - DNA, 25 bp, Rattus norvegicus
gcagctcgcgtgagagccgcagctc

SEQ ID NO: 452467 - DNA, 25 bp, Rattus norvegicus
cgcactcaccatttcgatgatcttg

SEQ ID NO: 452468 - DNA, 25 bp, Rattus norvegicus
ttcgatgatcttggtcttgcggccc

SEQ ID NO: 452469 - DNA, 25 bp, Rattus norvegicus
tgctctcggcgcgaaagcccaggag

SEQ ID NO: 452470 - DNA, 25 bp, Rattus norvegicus
ggcccgtctttctcttcaaggtgaa

SEQ ID NO: 452471 - DNA, 25 bp, Rattus norvegicus
tgaatatgtactgggccagcaccac

SEQ ID NO: 452472 - DNA, 25 bp, Rattus norvegicus
accgcgcacacactggcgctcgcca

SEQ ID NO: 452473 - DNA, 25 bp, Rattus norvegicus
acggccgcgcggtccattgaaggcc

SEQ ID NO: 452474 - DNA, 25 bp, Rattus norvegicus
cggtccattgaaggcccgcgtgctc

SEQ ID NO: 452475 - DNA, 25 bp, Rattus norvegicus
gtcttgcggcccgtctttctcttca

SEQ ID NO: 452476 - DNA, 25 bp, Rattus norvegicus
caagcttttagaagcgaggagaaaa

SEQ ID NO: 452477 - DNA, 25 bp, Rattus norvegicus
gcagcgcgctccacagactttgagg

SEQ ID NO: 452478 - DNA, 25 bp, Rattus norvegicus
gtggcttggcacgtcctccagctct

SEQ ID NO: 452479 - DNA, 25 bp, Rattus norvegicus
tgtgcagcccggcttcaggcggtcc

SEQ ID NO: 452480 - DNA, 25 bp, Rattus norvegicus
ttcaggcggtcctcgccggagccat

SEQ ID NO: 452481 - DNA, 25 bp, Rattus norvegicus
cccatcgctgcttgctcgggtttgc

SEQ ID NO: 452482 - DNA, 25 bp, Rattus norvegicus
ggagggacctttgtgcgtgtccaca

SEQ ID NO: 452483 - DNA, 25 bp, Rattus norvegicus
tttgtgcgtgtccacacgcgcatcc

SEQ ID NO: 452484 - DNA, 25 bp, Rattus norvegicus
ccacagactttgagggctccgagcc

SEQ ID NO: 452485 - DNA, 25 bp, Rattus norvegicus
acagggacatttctgcctttggaga

SEQ ID NO: 452486 - DNA, 25 bp, Rattus norvegicus
attccacggggagcttgggtgtact

SEQ ID NO: 452487 - DNA, 25 bp, Rattus norvegicus
cttgggtgtactgaagtgaagccgc

SEQ ID NO: 452488 - DNA, 25 bp, Rattus norvegicus
tagacccgggctgcggtcgactgaa

SEQ ID NO: 452489 - DNA, 25 bp, Rattus norvegicus
cctcccgcagctggtaggagggaca

SEQ ID NO: 452490 - DNA, 25 bp, Rattus norvegicus
ccgtgtccttccgagagattctaga

SEQ ID NO: 452491 - DNA, 25 bp, Rattus norvegicus
tcgcagaccagggaaaggcgcatct

SEQ ID NO: 452492 - DNA, 25 bp, Rattus norvegicus
gattctagagaaaaccgcacgccta

SEQ ID NO: 452493 - DNA, 25 bp, Rattus norvegicus
aggcgcatctttagacgctccatca

SEQ ID NO: 452494 - DNA, 25 bp, Rattus norvegicus
ctagcgtgaaaaagccgaacctcca

SEQ ID NO: 452495 - DNA, 25 bp, Rattus norvegicus
tccgtggtttgcacatctggatgca

SEQ ID NO: 452496 - DNA, 25 bp, Rattus norvegicus
cgaagccttcctggtgatccgtggt

SEQ ID NO: 452497 - DNA, 25 bp, Rattus norvegicus
agtctctttgacatggtctcgccca

SEQ ID NO: 452498 - DNA, 25 bp, Rattus norvegicus
ctccgcctctcctaggtggaacttg

SEQ ID NO: 452499 - DNA, 25 bp, Rattus norvegicus
aggcagcgacctcatagtctaggaa

SEQ ID NO: 452500 - DNA, 25 bp, Rattus norvegicus
ggcctgtttcctccgcagttccaga

SEQ ID NO: 452501 - DNA, 25 bp, Rattus norvegicus
gaagagggcaaacacggcctgtttc

SEQ ID NO: 452502 - DNA, 25 bp, Rattus norvegicus
accgctggacgctaccattggcgca

SEQ ID NO: 452503 - DNA, 25 bp, Rattus norvegicus
gcctagaaagcccacattccggtag

SEQ ID NO: 452504 - DNA, 25 bp, Rattus norvegicus
tgtccgctctccaagaagccgctta

SEQ ID NO: 452505 - DNA, 25 bp, Rattus norvegicus
gaggaagcccactcccgggacgcga

SEQ ID NO: 452506 - DNA, 25 bp, Rattus norvegicus
caaaccagcgggtcaggaggaagcc

SEQ ID NO: 452507 - DNA, 25 bp, Rattus norvegicus
ggcgatggcctatgggcaaaccagc

SEQ ID NO: 452508 - DNA, 25 bp, Rattus norvegicus
tttcccagaggaagggcgatggcct

SEQ ID NO: 452509 - DNA, 25 bp, Rattus norvegicus
aggtgagactcacctgccgcctttc

SEQ ID NO: 452510 - DNA, 25 bp, Rattus norvegicus
agaagccgcttaggtgagactcacc

SEQ ID NO: 452511 - DNA, 25 bp, Rattus norvegicus
agaagttcggaacgcggcctcttca

SEQ ID NO: 452512 - DNA, 25 bp, Rattus norvegicus
ctgcagttccttgtgtgtccgctct

SEQ ID NO: 452513 - DNA, 25 bp, Rattus norvegicus
ccagaacgagaaggctgagcagccc

SEQ ID NO: 452514 - DNA, 25 bp, Rattus norvegicus
gggccaggtcctacgctgaccagaa

SEQ ID NO: 452515 - DNA, 25 bp, Rattus norvegicus
tgcagaggccgcacgcactgtctgc

SEQ ID NO: 452516 - DNA, 25 bp, Rattus norvegicus
gcagactctcccaggcgctgcagag

SEQ ID NO: 452517 - DNA, 25 bp, Rattus norvegicus
acgcggcctcttcagcagtcagagc

SEQ ID NO: 452518 - DNA, 25 bp, Rattus norvegicus
agacagccatggttcgcttccgccg

SEQ ID NO: 452519 - DNA, 25 bp, Rattus norvegicus
tgaaagcgcggacaccctgcaactt

SEQ ID NO: 452520 - DNA, 25 bp, Rattus norvegicus
cagcccggagtaaactttgaaagcg

SEQ ID NO: 452521 - DNA, 25 bp, Rattus norvegicus
ggagtacctgaaagcgcggacaccc

SEQ ID NO: 452522 - DNA, 25 bp, Rattus norvegicus
cgcggacaccctgcaacttcgagtt

SEQ ID NO: 452523 - DNA, 25 bp, Rattus norvegicus
gacaccctgcaacttcgagttcggc

SEQ ID NO: 452524 - DNA, 25 bp, Rattus norvegicus
tgcaacttcgagttcggccaaggtc

SEQ ID NO: 452525 - DNA, 25 bp, Rattus norvegicus
ttcgagttcggccaaggtcgagaga

SEQ ID NO: 452526 - DNA, 25 bp, Rattus norvegicus
tcccgagacgcagcatcccgaggta

SEQ ID NO: 452527 - DNA, 25 bp, Rattus norvegicus
gagacgcagcatcccgaggtagaca

SEQ ID NO: 452528 - DNA, 25 bp, Rattus norvegicus
cgcagcatcccgaggtagacagcca

SEQ ID NO: 452529 - DNA, 25 bp, Rattus norvegicus
atcccgaggtagacagccatggttc

SEQ ID NO: 452530 - DNA, 25 bp, Rattus norvegicus
gccatggttcgcttccgccgcgggt

SEQ ID NO: 452531 - DNA, 25 bp, Rattus norvegicus
ggctcgcgacacacagcctcccgag

SEQ ID NO: 452532 - DNA, 25 bp, Rattus norvegicus
tctcggccagaagactccggatgcc

SEQ ID NO: 452533 - DNA, 25 bp, Rattus norvegicus
acgcgcatctctccgggctcgatgt

SEQ ID NO: 452534 - DNA, 25 bp, Rattus norvegicus
cccgtttctcgaggtggagagcagc

SEQ ID NO: 452535 - DNA, 25 bp, Rattus norvegicus
tctcgaggtggagagcagctgctct

SEQ ID NO: 452536 - DNA, 25 bp, Rattus norvegicus
ccttgaacttgacctcgggctggaa

SEQ ID NO: 452537 - DNA, 25 bp, Rattus norvegicus
ggcggggtcccatggaaaaatcaga

SEQ ID NO: 452538 - DNA, 25 bp, Rattus norvegicus
gaaagcgagctaagataactgaagc

SEQ ID NO: 452539 - DNA, 25 bp, Rattus norvegicus
gctaagataactgaagccgctctga

SEQ ID NO: 452540 - DNA, 25 bp, Rattus norvegicus
actgaagccgctctgattcctcgca

SEQ ID NO: 452541 - DNA, 25 bp, Rattus norvegicus
gccgctctgattcctcgcagcgaga

SEQ ID NO: 452542 - DNA, 25 bp, Rattus norvegicus
tggtgcgctccagcgggctataaca

SEQ ID NO: 452543 - DNA, 25 bp, Rattus norvegicus
ccagcgggctataacaggcttcctc

SEQ ID NO: 452544 - DNA, 25 bp, Rattus norvegicus
aggcttcctccggacctatttctcg

SEQ ID NO: 452545 - DNA, 25 bp, Rattus norvegicus
ccggacctatttctcggccagaaga

SEQ ID NO: 452546 - DNA, 25 bp, Rattus norvegicus
atcggcttctcctgtgcgcagactg

SEQ ID NO: 452547 - DNA, 25 bp, Rattus norvegicus
gatcggcttctcctgtgcgcagact

SEQ ID NO: 452548 - DNA, 25 bp, Rattus norvegicus
tcggcttctcctgtgcgcagactgc

SEQ ID NO: 452549 - DNA, 25 bp, Rattus norvegicus
ggcttctcctgtgcgcagactgcgg

SEQ ID NO: 452550 - DNA, 25 bp, Rattus norvegicus
ttctcctgtgcgcagactgcggggc

SEQ ID NO: 452551 - DNA, 25 bp, Rattus norvegicus
gtcaccgcggcggagtctcgggctc

SEQ ID NO: 452552 - DNA, 25 bp, Rattus norvegicus
cagtgcggggcggtcagacgctcct

SEQ ID NO: 452553 - DNA, 25 bp, Rattus norvegicus
tcctggcgggcgagcgtgtgtaggt

SEQ ID NO: 452554 - DNA, 25 bp, Rattus norvegicus
gtgtgtaggtcggtgtgcgagtcag

SEQ ID NO: 452555 - DNA, 25 bp, Rattus norvegicus
gctgctccgcccgggacagctaggt

SEQ ID NO: 452556 - DNA, 25 bp, Rattus norvegicus
aagcccctggagtgtgctaggcgtc

SEQ ID NO: 452557 - DNA, 25 bp, Rattus norvegicus
ccctggagtgtgctaggcgtcgcgt

SEQ ID NO: 452558 - DNA, 25 bp, Rattus norvegicus
tcgcgtgggccgtacgggtcgcggc

SEQ ID NO: 452559 - DNA, 25 bp, Rattus norvegicus
tcagacgctcctggcgggcgagcgt

SEQ ID NO: 452560 - DNA, 25 bp, Rattus norvegicus
ggggaaacttcattattactgtgac

SEQ ID NO: 452561 - DNA, 25 bp, Rattus norvegicus
tggggagactcgctccggctactgc

SEQ ID NO: 452562 - DNA, 25 bp, Rattus norvegicus
ccaaagggctgaacctggggagact

SEQ ID NO: 452563 - DNA, 25 bp, Rattus norvegicus
gccaccattggccaggcgggaagtc

SEQ ID NO: 452564 - DNA, 25 bp, Rattus norvegicus
tgtgtgaaccaaagggctgaacctg

SEQ ID NO: 452565 - DNA, 25 bp, Rattus norvegicus
ccgagcgagccgacggctggacctt

SEQ ID NO: 452566 - DNA, 25 bp, Rattus norvegicus
ctactgcgggatgcgtgtgcagttc

SEQ ID NO: 452567 - DNA, 25 bp, Rattus norvegicus
ctccctgcgtgaagagcatcgcggc

SEQ ID NO: 452568 - DNA, 25 bp, Rattus norvegicus
gcagcgggtgacctccctgcgtgaa

SEQ ID NO: 452569 - DNA, 25 bp, Rattus norvegicus
gtcgttctcctagctcgatctgcgg

SEQ ID NO: 452570 - DNA, 25 bp, Rattus norvegicus
cattattactgtgacgctgaaggcc

SEQ ID NO: 452571 - DNA, 25 bp, Rattus norvegicus
ctcctagctcgatctgcgggagtgc

SEQ ID NO: 452572 - DNA, 25 bp, Rattus norvegicus
gcgggaagtcgttctcctagctcga

SEQ ID NO: 452573 - DNA, 25 bp, Rattus norvegicus
ggcgacgatctcagggcaccgagcc

SEQ ID NO: 452574 - DNA, 25 bp, Rattus norvegicus
gcctccagcggcaacaacaacggga

SEQ ID NO: 452575 - DNA, 25 bp, Rattus norvegicus
ctcccgcctggggacacgaccacgc

SEQ ID NO: 452576 - DNA, 25 bp, Rattus norvegicus
taagctcggcgccttgagggcctcc

SEQ ID NO: 452577 - DNA, 25 bp, Rattus norvegicus
cccaagagccgcgtgttggccgcga

SEQ ID NO: 452578 - DNA, 25 bp, Rattus norvegicus
gttcgcaggcgcctcagcctccacc

SEQ ID NO: 452579 - DNA, 25 bp, Rattus norvegicus
cggctccggcacacgcagccgagcc

SEQ ID NO: 452580 - DNA, 25 bp, Rattus norvegicus
caacaacaacgggaccgggagcgcg

SEQ ID NO: 452581 - DNA, 25 bp, Rattus norvegicus
gctggcgggaccctaactaggaagc

SEQ ID NO: 452582 - DNA, 25 bp, Rattus norvegicus
tggagctgcctccagcggcaacaac

SEQ ID NO: 452583 - DNA, 25 bp, Rattus norvegicus
gtttaccggcgctgagatcccgccg

SEQ ID NO: 452584 - DNA, 25 bp, Rattus norvegicus
gcccggcgtttaccggcgctgagat

SEQ ID NO: 452585 - DNA, 25 bp, Rattus norvegicus
ccaaaaggcgcggtcgcgcacgctg

SEQ ID NO: 452586 - DNA, 25 bp, Rattus norvegicus
acagggctagcgcatgaggcccgga

SEQ ID NO: 452587 - DNA, 25 bp, Rattus norvegicus
gcgggaccctaactaggaagcgcgc

SEQ ID NO: 452588 - DNA, 25 bp, Rattus norvegicus
actgcggctggtccagagtgagtct

SEQ ID NO: 452589 - DNA, 25 bp, Rattus norvegicus
cctcgatcttatcgcagcgcttctg

SEQ ID NO: 452590 - DNA, 25 bp, Rattus norvegicus
cgcttctgcagctttttgagcgcca

SEQ ID NO: 452591 - DNA, 25 bp, Rattus norvegicus
ttgagcgccagaacccggcacttga

SEQ ID NO: 452592 - DNA, 25 bp, Rattus norvegicus
acttgacgggattgggcaagctctc

SEQ ID NO: 452593 - DNA, 25 bp, Rattus norvegicus
gggcaagctctcgataaagtcattt

SEQ ID NO: 452594 - DNA, 25 bp, Rattus norvegicus
gtcatttttgggcttgggcgcattc

SEQ ID NO: 452595 - DNA, 25 bp, Rattus norvegicus
ccgcgggtgcagtggcactgtcacc

SEQ ID NO: 452596 - DNA, 25 bp, Rattus norvegicus
actgtcaccggttgctgcatcctcg

SEQ ID NO: 452597 - DNA, 25 bp, Rattus norvegicus
gtccctgcttctcggggtcggccat

SEQ ID NO: 452598 - DNA, 25 bp, Rattus norvegicus
ccatcgctattgcttggctcagctg

SEQ ID NO: 452599 - DNA, 25 bp, Rattus norvegicus
ctcagctgggcttgtttgccgcagt

SEQ ID NO: 452600 - DNA, 25 bp, Rattus norvegicus
cagtctgcgactgagctggtccaga

SEQ ID NO: 452601 - DNA, 25 bp, Rattus norvegicus
ctggtccagagaggtcctgcagctg

SEQ ID NO: 452602 - DNA, 25 bp, Rattus norvegicus
accattagcccgctgcagggttgtg

SEQ ID NO: 452603 - DNA, 25 bp, Rattus norvegicus
gcggagcattgactaagtcccgccc

SEQ ID NO: 452604 - DNA, 25 bp, Rattus norvegicus
gttgcgcgctcactctgcggcggct

SEQ ID NO: 452605 - DNA, 25 bp, Rattus norvegicus
gtcggcttcgctggggacttccatt

SEQ ID NO: 452606 - DNA, 25 bp, Rattus norvegicus
tggggacttccattgctggctctgt

SEQ ID NO: 452607 - DNA, 25 bp, Rattus norvegicus
gacttccattgctggctctgttttc

SEQ ID NO: 452608 - DNA, 25 bp, Rattus norvegicus
gctggctctgttttctggccggtca

SEQ ID NO: 452609 - DNA, 25 bp, Rattus norvegicus
ttttctggccggtcaggcagaacga

SEQ ID NO: 452610 - DNA, 25 bp, Rattus norvegicus
ccagcgtccggctcggagcttgctg

SEQ ID NO: 452611 - DNA, 25 bp, Rattus norvegicus
ccggtgaccattagcccgctgcagg

SEQ ID NO: 452612 - DNA, 25 bp, Rattus norvegicus
gcctccgactttcacccagcgtccg

SEQ ID NO: 452613 - DNA, 25 bp, Rattus norvegicus
gaggcggagcattgactaagtcccg

SEQ ID NO: 452614 - DNA, 25 bp, Rattus norvegicus
ggtcaggcagaacgatgcccgctcc

SEQ ID NO: 452615 - DNA, 25 bp, Rattus norvegicus
tcgccgacaacacgttcctgcgggg

SEQ ID NO: 452616 - DNA, 25 bp, Rattus norvegicus
ctcagaggcctaccagggactgtga

SEQ ID NO: 452617 - DNA, 25 bp, Rattus norvegicus
tccagcaatggccacagctcgccca

SEQ ID NO: 452618 - DNA, 25 bp, Rattus norvegicus
ctcgctgctccagcaatggccacag

SEQ ID NO: 452619 - DNA, 25 bp, Rattus norvegicus
ttccgcgaccatcaggcgctcatga

SEQ ID NO: 452620 - DNA, 25 bp, Rattus norvegicus
attccgcgaccatcaggcgctcatg

SEQ ID NO: 452621 - DNA, 25 bp, Rattus norvegicus
aggccttggctccactcccgattcc

SEQ ID NO: 452622 - DNA, 25 bp, Rattus norvegicus
ccctggaagacggaggacggagaag

SEQ ID NO: 452623 - DNA, 25 bp, Rattus norvegicus
tttcatgaaacggttcccctccgca

SEQ ID NO: 452624 - DNA, 25 bp, Rattus norvegicus
gcgcctctttcatgaaacggttccc

SEQ ID NO: 452625 - DNA, 25 bp, Rattus norvegicus
cggcgcctctttcatgaaacggttc

SEQ ID NO: 452626 - DNA, 25 bp, Rattus norvegicus
cagaggcctaccagggactgtgagc

SEQ ID NO: 452627 - DNA, 25 bp, Rattus norvegicus
ctcctcagaggcctaccagggactg

SEQ ID NO: 452628 - DNA, 25 bp, Rattus norvegicus
cccacaacaaaagcgggctgaagtg

SEQ ID NO: 452629 - DNA, 25 bp, Rattus norvegicus
ggcggcggcgcctctttcatgaaac

SEQ ID NO: 452630 - DNA, 25 bp, Rattus norvegicus
ggattcgagcggtccgctgcagcca

SEQ ID NO: 452631 - DNA, 25 bp, Rattus norvegicus
ggcggctcctttccggctacagctt

SEQ ID NO: 452632 - DNA, 25 bp, Rattus norvegicus
ttccggctacagcttgcttacctgc

SEQ ID NO: 452633 - DNA, 25 bp, Rattus norvegicus
tgcttacctgctcccacggagtgtc

SEQ ID NO: 452634 - DNA, 25 bp, Rattus norvegicus
ttgctgggcttccagtcgctaccca

SEQ ID NO: 452635 - DNA, 25 bp, Rattus norvegicus
tggagttcacgtgctggcagatccg

SEQ ID NO: 452636 - DNA, 25 bp, Rattus norvegicus
gccaggagccagctctgagcgatca

SEQ ID NO: 452637 - DNA, 25 bp, Rattus norvegicus
tctgagcgatcaggaactgagatta

SEQ ID NO: 452638 - DNA, 25 bp, Rattus norvegicus
aactgagattactatgccaagagcc

SEQ ID NO: 452639 - DNA, 25 bp, Rattus norvegicus
ttactatgccaagagccgaggcggc

SEQ ID NO: 452640 - DNA, 25 bp, Rattus norvegicus
cctcagctgctgagtgcggactgca

SEQ ID NO: 452641 - DNA, 25 bp, Rattus norvegicus
cggagaccggcagcttcacagctcg

SEQ ID NO: 452642 - DNA, 25 bp, Rattus norvegicus
cagctcggcgccaagccagcaagga

SEQ ID NO: 452643 - DNA, 25 bp, Rattus norvegicus
tgtctgtgctttgctgggcttccag

SEQ ID NO: 452644 - DNA, 25 bp, Rattus norvegicus
catcctcgctcagcatgactgacta

SEQ ID NO: 452645 - DNA, 25 bp, Rattus norvegicus
cacacacggtgccagagcctaggga

SEQ ID NO: 452646 - DNA, 25 bp, Rattus norvegicus
gtcttagggactcacacacacggtg

SEQ ID NO: 452647 - DNA, 25 bp, Rattus norvegicus
ctcacctttgggtttgagtcttagg

SEQ ID NO: 452648 - DNA, 25 bp, Rattus norvegicus
ccacgctgacagcaggtggctgcca

SEQ ID NO: 452649 - DNA, 25 bp, Rattus norvegicus
tgcatgtgttcttgtgccgggtcac

SEQ ID NO: 452650 - DNA, 25 bp, Rattus norvegicus
gggtgctcctgcatgtgttcttgtg

SEQ ID NO: 452651 - DNA, 25 bp, Rattus norvegicus
gcccgccacgcagagtggaccgatt

SEQ ID NO: 452652 - DNA, 25 bp, Rattus norvegicus
aatcctggggtctcggtcgcagagt

SEQ ID NO: 452653 - DNA, 25 bp, Rattus norvegicus
gctcagcatgactgactacgaagct

SEQ ID NO: 452654 - DNA, 25 bp, Rattus norvegicus
gaccagcccgtagctccaaggtagc

SEQ ID NO: 452655 - DNA, 25 bp, Rattus norvegicus
tccaaggtagcgacgcggtgcgcat

SEQ ID NO: 452656 - DNA, 25 bp, Rattus norvegicus
tggcccgctcttgcaatcctggggt

SEQ ID NO: 452657 - DNA, 25 bp, Rattus norvegicus
gaccgattgctttgtggcgcacccg

SEQ ID NO: 452658 - DNA, 25 bp, Rattus norvegicus
tttcccaaagctgtagcggagcctc

SEQ ID NO: 452659 - DNA, 25 bp, Rattus norvegicus
ccaaggctgccggatacatttttta

SEQ ID NO: 452660 - DNA, 25 bp, Rattus norvegicus
tcctcggcaaccaggaaaggttgtg

SEQ ID NO: 452661 - DNA, 25 bp, Rattus norvegicus
gggaaagctgcactcaactctattg

SEQ ID NO: 452662 - DNA, 25 bp, Rattus norvegicus
tctgtggaccgcttaagagaatatc

SEQ ID NO: 452663 - DNA, 25 bp, Rattus norvegicus
agcaaagtcgtggtcaaggaggatc

SEQ ID NO: 452664 - DNA, 25 bp, Rattus norvegicus
cggcatcggaggatggaagttttcc

SEQ ID NO: 452665 - DNA, 25 bp, Rattus norvegicus
tatccttctggtggtctcgaacctg

SEQ ID NO: 452666 - DNA, 25 bp, Rattus norvegicus
cctggcgtttccttggcagtaatct

SEQ ID NO: 452667 - DNA, 25 bp, Rattus norvegicus
tcccggatgtacatttgagccatta

SEQ ID NO: 452668 - DNA, 25 bp, Rattus norvegicus
gtaaggctcggtagtatcatccgtg

SEQ ID NO: 452669 - DNA, 25 bp, Rattus norvegicus
ctcgaacaggtggttttgcagcgtg

SEQ ID NO: 452670 - DNA, 25 bp, Rattus norvegicus
gacgcccaagctgcggttcacgcga

SEQ ID NO: 452671 - DNA, 25 bp, Rattus norvegicus
tccacatcggtaagacagggctgct

SEQ ID NO: 452672 - DNA, 25 bp, Rattus norvegicus
ctctggcccggcctatctcagtggt

SEQ ID NO: 452673 - DNA, 25 bp, Rattus norvegicus
tagcaagggcgggaacctccgcgac

SEQ ID NO: 452674 - DNA, 25 bp, Rattus norvegicus
tcatgaccaagaccggtagcaaggg

SEQ ID NO: 452675 - DNA, 25 bp, Rattus norvegicus
gcgtcatcatgaccaagaccggtag

SEQ ID NO: 452676 - DNA, 25 bp, Rattus norvegicus
gggacccgcttagccggcgtcatca

SEQ ID NO: 452677 - DNA, 25 bp, Rattus norvegicus
tcctgcccgtcggaaaccgggagca

SEQ ID NO: 452678 - DNA, 25 bp, Rattus norvegicus
agcggcctcttagccctctctcctg

SEQ ID NO: 452679 - DNA, 25 bp, Rattus norvegicus
gctgagcccacgagcggcctcttag

SEQ ID NO: 452680 - DNA, 25 bp, Rattus norvegicus
cgccggcacacgctcgggcctctct

SEQ ID NO: 452681 - DNA, 25 bp, Rattus norvegicus
cccggcctatctcagtggtcgcgga

SEQ ID NO: 452682 - DNA, 25 bp, Rattus norvegicus
ccctgcacttggagtgcggcgggca

SEQ ID NO: 452683 - DNA, 25 bp, Rattus norvegicus
gggaacctccgcgacaagctggacg

SEQ ID NO: 452684 - DNA, 25 bp, Rattus norvegicus
acgtggacacggaagtggtcgtcgt

SEQ ID NO: 452685 - DNA, 25 bp, Rattus norvegicus
tatctcagtggtcgcggaaggtgac

SEQ ID NO: 452686 - DNA, 25 bp, Rattus norvegicus
gttgctgcagactcccagtgtcgga

SEQ ID NO: 452687 - DNA, 25 bp, Rattus norvegicus
aactgtccctcctggatagcaccga

SEQ ID NO: 452688 - DNA, 25 bp, Rattus norvegicus
cgcagccgcctcttatgaaggagga

SEQ ID NO: 452689 - DNA, 25 bp, Rattus norvegicus
tcaacgccctgtcggagttgctgca

SEQ ID NO: 452690 - DNA, 25 bp, Rattus norvegicus
aatatgagaccctgcagatggccca

SEQ ID NO: 452691 - DNA, 25 bp, Rattus norvegicus
cttcgaccagctgcgcaacgttatc

SEQ ID NO: 452692 - DNA, 25 bp, Rattus norvegicus
cgactggcagcaaacgcaagggagc

SEQ ID NO: 452693 - DNA, 25 bp, Rattus norvegicus
cccttcgttgaactgggttgccagc

SEQ ID NO: 452694 - DNA, 25 bp, Rattus norvegicus
tatctgctgcattctcccgagctgg

SEQ ID NO: 452695 - DNA, 25 bp, Rattus norvegicus
tgtcccgcctgctgcatgcagaaga

SEQ ID NO: 452696 - DNA, 25 bp, Rattus norvegicus
taccctacaggcgagagaccatccg

SEQ ID NO: 452697 - DNA, 25 bp, Rattus norvegicus
gggttgccagcacctcctctaacaa

SEQ ID NO: 452698 - DNA, 25 bp, Rattus norvegicus
agaagcttcgttgcacgcgacctgg

SEQ ID NO: 452699 - DNA, 25 bp, Rattus norvegicus
ctccgagccagtgcattgcgatgtc

SEQ ID NO: 452700 - DNA, 25 bp, Rattus norvegicus
gtttacagaagccagagcctctcgc

SEQ ID NO: 452701 - DNA, 25 bp, Rattus norvegicus
ccatcagtcgcctagcgtagagctc

SEQ ID NO: 452702 - DNA, 25 bp, Rattus norvegicus
aagggtcgggaagccagcgcatccc

SEQ ID NO: 452703 - DNA, 25 bp, Rattus norvegicus
aaccagcaagggtcgggaagccagc

SEQ ID NO: 452704 - DNA, 25 bp, Rattus norvegicus
ctgaagcagtgaaccagcaagggtc

SEQ ID NO: 452705 - DNA, 25 bp, Rattus norvegicus
gctgcggcacctgaagcagtgaacc

SEQ ID NO: 452706 - DNA, 25 bp, Rattus norvegicus
ccctccagaaaaggagcttgctaaa

SEQ ID NO: 452707 - DNA, 25 bp, Rattus norvegicus
ccaccggcaaagtttacagaagcca

SEQ ID NO: 452708 - DNA, 25 bp, Rattus norvegicus
gcggccacatttaacaccgtcgtca

SEQ ID NO: 452709 - DNA, 25 bp, Rattus norvegicus
gagctgcgcggccacatttaacacc

SEQ ID NO: 452710 - DNA, 25 bp, Rattus norvegicus
tgagcgcactcgctttcaggccgct

SEQ ID NO: 452711 - DNA, 25 bp, Rattus norvegicus
gtcagctggtgagcgcactcgcttt

SEQ ID NO: 452712 - DNA, 25 bp, Rattus norvegicus
cacgcgctgtcagctggtgagcgca

SEQ ID NO: 452713 - DNA, 25 bp, Rattus norvegicus
gctaaactcagagccaagcaaagcc

SEQ ID NO: 452714 - DNA, 25 bp, Rattus norvegicus
gctgactaaccttgatctctctctc

SEQ ID NO: 452715 - DNA, 25 bp, Rattus norvegicus
taatgccagtctctcgttcgtagac

SEQ ID NO: 452716 - DNA, 25 bp, Rattus norvegicus
actcccagcacgaccccgagcgaca

SEQ ID NO: 452717 - DNA, 25 bp, Rattus norvegicus
gacggcttgcccctcatactcccag

SEQ ID NO: 452718 - DNA, 25 bp, Rattus norvegicus
agccctgacactctccgtccacgag

SEQ ID NO: 452719 - DNA, 25 bp, Rattus norvegicus
gccctctaactcaaccggtgcctga

SEQ ID NO: 452720 - DNA, 25 bp, Rattus norvegicus
ctcccgccctctaactcaaccggtg

SEQ ID NO: 452721 - DNA, 25 bp, Rattus norvegicus
cctctcttttctccctctctataca

SEQ ID NO: 452722 - DNA, 25 bp, Rattus norvegicus
ctgactaaccttgatctctctctct

SEQ ID NO: 452723 - DNA, 25 bp, Rattus norvegicus
ttgctgactaaccttgatctctctc

SEQ ID NO: 452724 - DNA, 25 bp, Rattus norvegicus
cattgctgactaaccttgatctctc

SEQ ID NO: 452725 - DNA, 25 bp, Rattus norvegicus
cacattgctgactaaccttgatctc

SEQ ID NO: 452726 - DNA, 25 bp, Rattus norvegicus
tacacattgctgactaaccttgatc

SEQ ID NO: 452727 - DNA, 25 bp, Rattus norvegicus
tctcgatctctctctagtctccgcc

SEQ ID NO: 452728 - DNA, 25 bp, Rattus norvegicus
cgcgacgcttggaagaagaaggcct

SEQ ID NO: 452729 - DNA, 25 bp, Rattus norvegicus
tggcctaacaaagcgcagccggaac

SEQ ID NO: 452730 - DNA, 25 bp, Rattus norvegicus
tccgagtggcctaacaaagcgcagc

SEQ ID NO: 452731 - DNA, 25 bp, Rattus norvegicus
agtccgctgcctccgagtggcctaa

SEQ ID NO: 452732 - DNA, 25 bp, Rattus norvegicus
gttcggccctttgtgtctccgcggc

SEQ ID NO: 452733 - DNA, 25 bp, Rattus norvegicus
ttactacgaggagcctgccaggctg

SEQ ID NO: 452734 - DNA, 25 bp, Rattus norvegicus
ttccacctttgttactacgaggagc

SEQ ID NO: 452735 - DNA, 25 bp, Rattus norvegicus
cgcctccctctaagaattattttgt

SEQ ID NO: 452736 - DNA, 25 bp, Rattus norvegicus
cctgtcgcctccctctaagaattat

SEQ ID NO: 452737 - DNA, 25 bp, Rattus norvegicus
gaaggtcccggccaggctcctgtcg

SEQ ID NO: 452738 - DNA, 25 bp, Rattus norvegicus
tttcccagcgctgccttggaaggtc

SEQ ID NO: 452739 - DNA, 25 bp, Rattus norvegicus
acattttctgaccacgcgacgcttg

SEQ ID NO: 452740 - DNA, 25 bp, Rattus norvegicus
gggctgcgtgttgcgtcatcactac

SEQ ID NO: 452741 - DNA, 25 bp, Rattus norvegicus
ttgcgtcatcactacgcgctctgtg

SEQ ID NO: 452742 - DNA, 25 bp, Rattus norvegicus
cgtgggcatcgaagatctaccggta

SEQ ID NO: 452743 - DNA, 25 bp, Rattus norvegicus
ttcggcccggaagtgcccgaggagc

SEQ ID NO: 452744 - DNA, 25 bp, Rattus norvegicus
tgtctgcgacctcggtgccttcggc

SEQ ID NO: 452745 - DNA, 25 bp, Rattus norvegicus
acctcaggtgtctgcgacctcggtg

SEQ ID NO: 452746 - DNA, 25 bp, Rattus norvegicus
gaactaaacagggcgaactacaatc

SEQ ID NO: 452747 - DNA, 25 bp, Rattus norvegicus
attccggcacgtgggttcacagggc

SEQ ID NO: 452748 - DNA, 25 bp, Rattus norvegicus
gtccattccggcacgtgggttcaca

SEQ ID NO: 452749 - DNA, 25 bp, Rattus norvegicus
aacatctggtccattccggcacgtg

SEQ ID NO: 452750 - DNA, 25 bp, Rattus norvegicus
cgggaacatctggtccattccggca

SEQ ID NO: 452751 - DNA, 25 bp, Rattus norvegicus
ggtaccgggaacatctggtccattc

SEQ ID NO: 452752 - DNA, 25 bp, Rattus norvegicus
gatctaccggtaccgggaacatctg

SEQ ID NO: 452753 - DNA, 25 bp, Rattus norvegicus
catcgaagatctaccggtaccggga

SEQ ID NO: 452754 - DNA, 25 bp, Rattus norvegicus
cccgaggagccgaaatggagctggt

SEQ ID NO: 452755 - DNA, 25 bp, Rattus norvegicus
tgggcatcgaagatctaccggtacc

SEQ ID NO: 452756 - DNA, 25 bp, Rattus norvegicus
ttactttctccttgttcccagctct

SEQ ID NO: 452757 - DNA, 25 bp, Rattus norvegicus
tctcagggcctaagcagtgagctga

SEQ ID NO: 452758 - DNA, 25 bp, Rattus norvegicus
tcacctgatgagcactacacccttt

SEQ ID NO: 452759 - DNA, 25 bp, Rattus norvegicus
tatcgtcctctttactttctccttg

SEQ ID NO: 452760 - DNA, 25 bp, Rattus norvegicus
tttccatcttggttgtatcgtcctc

SEQ ID NO: 452761 - DNA, 25 bp, Rattus norvegicus
gcttttcctttccatcttggttgta

SEQ ID NO: 452762 - DNA, 25 bp, Rattus norvegicus
acatgtaggaagtagggcctcgctg

SEQ ID NO: 452763 - DNA, 25 bp, Rattus norvegicus
tagcatcggatgtgctgctatgagg

SEQ ID NO: 452764 - DNA, 25 bp, Rattus norvegicus
ctgagcgattctagcatcggatgtg

SEQ ID NO: 452765 - DNA, 25 bp, Rattus norvegicus
tttagtttattctactgagcgattc

SEQ ID NO: 452766 - DNA, 25 bp, Rattus norvegicus
cacgtgtctctgatttagtgattta

SEQ ID NO: 452767 - DNA, 25 bp, Rattus norvegicus
tccatagatgatgagaacacgtgtc

SEQ ID NO: 452768 - DNA, 25 bp, Rattus norvegicus
ctctgtgagggtctttccatagatg

SEQ ID NO: 452769 - DNA, 25 bp, Rattus norvegicus
caccacgaagtttttctttctcagg

SEQ ID NO: 452770 - DNA, 25 bp, Rattus norvegicus
agtctatgtagtgacccgcagcaag

SEQ ID NO: 452771 - DNA, 25 bp, Rattus norvegicus
ttgctttggtcactgctagcctctc

SEQ ID NO: 452772 - DNA, 25 bp, Rattus norvegicus
gcaacgccctggtagtctatgtagt

SEQ ID NO: 452773 - DNA, 25 bp, Rattus norvegicus
gctggcctgctcatctttgccctgg

SEQ ID NO: 452774 - DNA, 25 bp, Rattus norvegicus
tctcggcgctgcttcagctgcacaa

SEQ ID NO: 452775 - DNA, 25 bp, Rattus norvegicus
aacttgaccgcggagcagctctcgg

SEQ ID NO: 452776 - DNA, 25 bp, Rattus norvegicus
acccagcatgtcgtggaacttgacc

SEQ ID NO: 452777 - DNA, 25 bp, Rattus norvegicus
gccggcagctctgactttgctttgg

SEQ ID NO: 452778 - DNA, 25 bp, Rattus norvegicus
cgcctggctgggaactttcttagaa

SEQ ID NO: 452779 - DNA, 25 bp, Rattus norvegicus
cgctgcgaggtttctgaggaccgca

SEQ ID NO: 452780 - DNA, 25 bp, Rattus norvegicus
aactggacactgagcctcgcgtggc

SEQ ID NO: 452781 - DNA, 25 bp, Rattus norvegicus
ggctccactaaggtccagaaaactg

SEQ ID NO: 452782 - DNA, 25 bp, Rattus norvegicus
acagaggcgcagcttctggcttctc

SEQ ID NO: 452783 - DNA, 25 bp, Rattus norvegicus
aaggcgcctaccgaacccagcatgt

SEQ ID NO: 452784 - DNA, 25 bp, Rattus norvegicus
tacttgacatcttggtgggatcccg

SEQ ID NO: 452785 - DNA, 25 bp, Rattus norvegicus
agcagagcttagtgagccgcgtaca

SEQ ID NO: 452786 - DNA, 25 bp, Rattus norvegicus
tgagccacttcgctgcaacttctgc

SEQ ID NO: 452787 - DNA, 25 bp, Rattus norvegicus
cccgccttggaagtttgcagcgctc

SEQ ID NO: 452788 - DNA, 25 bp, Rattus norvegicus
cagcgctcgccacaaagttcggaca

SEQ ID NO: 452789 - DNA, 25 bp, Rattus norvegicus
gttcggacacttgggcatttcattt

SEQ ID NO: 452790 - DNA, 25 bp, Rattus norvegicus
aggctcaagctctgcagtgacatta

SEQ ID NO: 452791 - DNA, 25 bp, Rattus norvegicus
ttggtggatcctggtacttgacatc

SEQ ID NO: 452792 - DNA, 25 bp, Rattus norvegicus
gtgacattaggagccagcgcacact

SEQ ID NO: 452793 - DNA, 25 bp, Rattus norvegicus
acctgggttttgtccgcacagcaca

SEQ ID NO: 452794 - DNA, 25 bp, Rattus norvegicus
ttaaggtaaggagcaagatcgaatc

SEQ ID NO: 452795 - DNA, 25 bp, Rattus norvegicus
tggcccgactgcgtttgcacctacg

SEQ ID NO: 452796 - DNA, 25 bp, Rattus norvegicus
ttcattttgccctagcgtgcaggtc

SEQ ID NO: 452797 - DNA, 25 bp, Rattus norvegicus
ggcagtgccagctccattcaacatc

SEQ ID NO: 452798 - DNA, 25 bp, Rattus norvegicus
ttctgggagccgagctcatttcctc

SEQ ID NO: 452799 - DNA, 25 bp, Rattus norvegicus
tgggagccgagctcatttcctcctc

SEQ ID NO: 452800 - DNA, 25 bp, Rattus norvegicus
cctggcccgcacctcatctgcacgt

SEQ ID NO: 452801 - DNA, 25 bp, Rattus norvegicus
acctcatctgcacgtgcggcgccac

SEQ ID NO: 452802 - DNA, 25 bp, Rattus norvegicus
gaggatgctgggcatgtatgtacca

SEQ ID NO: 452803 - DNA, 25 bp, Rattus norvegicus
gggcatgtatgtaccagacaggttc

SEQ ID NO: 452804 - DNA, 25 bp, Rattus norvegicus
taccagacaggttcgccctgaagtc

SEQ ID NO: 452805 - DNA, 25 bp, Rattus norvegicus
acaggttcgccctgaagtcgtcccg

SEQ ID NO: 452806 - DNA, 25 bp, Rattus norvegicus
ctgaagtcgtcccgggtccaggacg

SEQ ID NO: 452807 - DNA, 25 bp, Rattus norvegicus
tccaggacgggatggggctctacac

SEQ ID NO: 452808 - DNA, 25 bp, Rattus norvegicus
tggggctctacacggcccgtcgcgt

SEQ ID NO: 452809 - DNA, 25 bp, Rattus norvegicus
agggagccggtgatcctgctgccct

SEQ ID NO: 452810 - DNA, 25 bp, Rattus norvegicus
gtatgtaccagacaggttcgccctg

SEQ ID NO: 452811 - DNA, 25 bp, Rattus norvegicus
gggattctgggagccgagctcattt

SEQ ID NO: 452812 - DNA, 25 bp, Rattus norvegicus
cctgcgcattcggtctgccagagag

SEQ ID NO: 452813 - DNA, 25 bp, Rattus norvegicus
caaagataagctgcctgggccgggc

SEQ ID NO: 452814 - DNA, 25 bp, Rattus norvegicus
cgcggaccctgcagccaaagataag

SEQ ID NO: 452815 - DNA, 25 bp, Rattus norvegicus
agcgcagaaatcgtcgccgagtttt

SEQ ID NO: 452816 - DNA, 25 bp, Rattus norvegicus
gaccaaggcatcaccctgcgtggga

SEQ ID NO: 452817 - DNA, 25 bp, Rattus norvegicus
tctagtgatggcacagcagctcgcc

SEQ ID NO: 452818 - DNA, 25 bp, Rattus norvegicus
ggttgacagtgttctccgttcgatc

SEQ ID NO: 452819 - DNA, 25 bp, Rattus norvegicus
ctagaggagccattagggcgccatc

SEQ ID NO: 452820 - DNA, 25 bp, Rattus norvegicus
aaaccggaagcatgaggcgggctca

SEQ ID NO: 452821 - DNA, 25 bp, Rattus norvegicus
cgggacttagggtcagctcatctgc

SEQ ID NO: 452822 - DNA, 25 bp, Rattus norvegicus
tgtgctagagcggaaccaccggatc

SEQ ID NO: 452823 - DNA, 25 bp, Rattus norvegicus
tcatctgcggtgcaactgggcttac

SEQ ID NO: 452824 - DNA, 25 bp, Rattus norvegicus
cttacggcggaagtagcgttatgga

SEQ ID NO: 452825 - DNA, 25 bp, Rattus norvegicus
agccagggccggatacaagtcgctt

SEQ ID NO: 452826 - DNA, 25 bp, Rattus norvegicus
gccttcggctgcgtaagattatcga

SEQ ID NO: 452827 - DNA, 25 bp, Rattus norvegicus
taagattatcgaggcctcggtttcc

SEQ ID NO: 452828 - DNA, 25 bp, Rattus norvegicus
cccaaccgttgagcaagtcggcctg

SEQ ID NO: 452829 - DNA, 25 bp, Rattus norvegicus
accgttgagcaagtcggcctggcag

SEQ ID NO: 452830 - DNA, 25 bp, Rattus norvegicus
ggctgcccggggatccgatgccgct

SEQ ID NO: 452831 - DNA, 25 bp, Rattus norvegicus
gatgccgctggcctttccgtacgat

SEQ ID NO: 452832 - DNA, 25 bp, Rattus norvegicus
gccgctggcctttccgtacgatcaa

SEQ ID NO: 452833 - DNA, 25 bp, Rattus norvegicus
ggcctttccgtacgatcaacagacc

SEQ ID NO: 452834 - DNA, 25 bp, Rattus norvegicus
cgtacgatcaacagacccccttgtt

SEQ ID NO: 452835 - DNA, 25 bp, Rattus norvegicus
ccttgttaagcgtcctgcctggcct

SEQ ID NO: 452836 - DNA, 25 bp, Rattus norvegicus
tgttaagcgtcctgcctggcctcca

SEQ ID NO: 452837 - DNA, 25 bp, Rattus norvegicus
tgagaaacacgtcctgaggacggcg

SEQ ID NO: 452838 - DNA, 25 bp, Rattus norvegicus
acacgtcctgaggacggcgagcccg

SEQ ID NO: 452839 - DNA, 25 bp, Rattus norvegicus
ctgcgtaagattatcgaggcctcgg

SEQ ID NO: 452840 - DNA, 25 bp, Rattus norvegicus
accgcctcgacctccgggtcacgca

SEQ ID NO: 452841 - DNA, 25 bp, Rattus norvegicus
ggtcacgcaccgctccctcacgcag

SEQ ID NO: 452842 - DNA, 25 bp, Rattus norvegicus
gctccctcacgcagccagccaggcc

SEQ ID NO: 452843 - DNA, 25 bp, Rattus norvegicus
caggccctccagtgaagggagcgtt

SEQ ID NO: 452844 - DNA, 25 bp, Rattus norvegicus
gaggctgcttgtgccttgcacgcac

SEQ ID NO: 452845 - DNA, 25 bp, Rattus norvegicus
tgcttgtgccttgcacgcacgcggc

SEQ ID NO: 452846 - DNA, 25 bp, Rattus norvegicus
acgcggcccgtatcccacttgcctg

SEQ ID NO: 452847 - DNA, 25 bp, Rattus norvegicus
gtcggagcacctcgcccggctcgtc

SEQ ID NO: 452848 - DNA, 25 bp, Rattus norvegicus
tgaagctccacaccaccaggccctg

SEQ ID NO: 452849 - DNA, 25 bp, Rattus norvegicus
gtggcgatcgccagcttgtagcgcc

SEQ ID NO: 452850 - DNA, 25 bp, Rattus norvegicus
gcgatcgccagcttgtagcgccgca

SEQ ID NO: 452851 - DNA, 25 bp, Rattus norvegicus
agcttgtagcgccgcaccagcttct

SEQ ID NO: 452852 - DNA, 25 bp, Rattus norvegicus
cgcgtccggccctgcaaaccggccg

SEQ ID NO: 452853 - DNA, 25 bp, Rattus norvegicus
cctagttcgccgaccgcctcgacct

SEQ ID NO: 452854 - DNA, 25 bp, Rattus norvegicus
cagtctccgtgctgggtcctcacag

SEQ ID NO: 452855 - DNA, 25 bp, Rattus norvegicus
cagcccggggactgcggagaactca

SEQ ID NO: 452856 - DNA, 25 bp, Rattus norvegicus
ctgggatgacactccacgaggaacc

SEQ ID NO: 452857 - DNA, 25 bp, Rattus norvegicus
gaaagagcagatccgggagagaact

SEQ ID NO: 452858 - DNA, 25 bp, Rattus norvegicus
tgacactccacgaggaaccctgcgg

SEQ ID NO: 452859 - DNA, 25 bp, Rattus norvegicus
ctaccctcgccgatctccggacgcg

SEQ ID NO: 452860 - DNA, 25 bp, Rattus norvegicus
tcgtcactacttcggggctgcctgt

SEQ ID NO: 452861 - DNA, 25 bp, Rattus norvegicus
tgagtgccaagctagcgccgggacc

SEQ ID NO: 452862 - DNA, 25 bp, Rattus norvegicus
acggcagagagtgagtgccaagcta

SEQ ID NO: 452863 - DNA, 25 bp, Rattus norvegicus
caacccagctgcaggcacgcgtgtc

SEQ ID NO: 452864 - DNA, 25 bp, Rattus norvegicus
cgcagcgagccgcaccaacccagct

SEQ ID NO: 452865 - DNA, 25 bp, Rattus norvegicus
atgatggtagcctcgcgtggctgcc

SEQ ID NO: 452866 - DNA, 25 bp, Rattus norvegicus
tggtgacgcatgatggtagcctcgc

SEQ ID NO: 452867 - DNA, 25 bp, Rattus norvegicus
ccgggagagaactgggatgacactc

SEQ ID NO: 452868 - DNA, 25 bp, Rattus norvegicus
tgggcaacggtgagtgtacaagctc

SEQ ID NO: 452869 - DNA, 25 bp, Rattus norvegicus
tctgcggccgagaattcctccaaag

SEQ ID NO: 452870 - DNA, 25 bp, Rattus norvegicus
acctttcgatcttctgctctgcggc

SEQ ID NO: 452871 - DNA, 25 bp, Rattus norvegicus
cgagtccgcaggcacacttaccttt

SEQ ID NO: 452872 - DNA, 25 bp, Rattus norvegicus
gactccgagccttgctgagcacttc

SEQ ID NO: 452873 - DNA, 25 bp, Rattus norvegicus
gctgcctcgtacacgccgacagtta

SEQ ID NO: 452874 - DNA, 25 bp, Rattus norvegicus
tccgggtctctacagacagtgggca

SEQ ID NO: 452875 - DNA, 25 bp, Rattus norvegicus
ggtcgtcatcttcatccgcagccag

SEQ ID NO: 452876 - DNA, 25 bp, Rattus norvegicus
aatggatctgcagagccacgtcccg

SEQ ID NO: 452877 - DNA, 25 bp, Rattus norvegicus
tgatgtcgttctcgcaacagaaagc

SEQ ID NO: 452878 - DNA, 25 bp, Rattus norvegicus
gggctcttgtcgttctccagtagca

SEQ ID NO: 452879 - DNA, 25 bp, Rattus norvegicus
ccgacagttatggtgcgctgactcc

SEQ ID NO: 452880 - DNA, 25 bp, Rattus norvegicus
gtcatattgcaagtgcgagtccctc

SEQ ID NO: 452881 - DNA, 25 bp, Rattus norvegicus
ggccacttacacgttgagcagcttg

SEQ ID NO: 452882 - DNA, 25 bp, Rattus norvegicus
agacacctcaggatagtcggctgtg

SEQ ID NO: 452883 - DNA, 25 bp, Rattus norvegicus
ccggccatcttgtgggaagagctga

SEQ ID NO: 452884 - DNA, 25 bp, Rattus norvegicus
gtccgctgcaatccgtggaggaacg

SEQ ID NO: 452885 - DNA, 25 bp, Rattus norvegicus
gcctgggcacctacaggaaggcttc

SEQ ID NO: 452886 - DNA, 25 bp, Rattus norvegicus
gctgcgtggtcaccaaccgattcga

SEQ ID NO: 452887 - DNA, 25 bp, Rattus norvegicus
aaccgattcgaccagctatttgacg

SEQ ID NO: 452888 - DNA, 25 bp, Rattus norvegicus
ctatttgacgacgaatcggaccctt

SEQ ID NO: 452889 - DNA, 25 bp, Rattus norvegicus
atcggaccctttcgaggtactgaag

SEQ ID NO: 452890 - DNA, 25 bp, Rattus norvegicus
ctccaacgcggcaggcaaacagttg

SEQ ID NO: 452891 - DNA, 25 bp, Rattus norvegicus
ttgcggaaagagtcccagaaagacc

SEQ ID NO: 452892 - DNA, 25 bp, Rattus norvegicus
ccagcgtcggcgtggctgacaaaaa

SEQ ID NO: 452893 - DNA, 25 bp, Rattus norvegicus
gcagccgccggtggcgcttaagaaa

SEQ ID NO: 452894 - DNA, 25 bp, Rattus norvegicus
tggtctgcagtccacgctgctcgca

SEQ ID NO: 452895 - DNA, 25 bp, Rattus norvegicus
tggttcaggagtaggcagacacctc

SEQ ID NO: 452896 - DNA, 25 bp, Rattus norvegicus
agggtcctggcacccgaaagcctag

SEQ ID NO: 452897 - DNA, 25 bp, Rattus norvegicus
ggcgctctcaccacgccctccgcga

SEQ ID NO: 452898 - DNA, 25 bp, Rattus norvegicus
ggggaagtccctcaggcgctctcac

SEQ ID NO: 452899 - DNA, 25 bp, Rattus norvegicus
ctggccctcggggaagtccctcagg

SEQ ID NO: 452900 - DNA, 25 bp, Rattus norvegicus
cagtggccatggcaagtgtccaggc

SEQ ID NO: 452901 - DNA, 25 bp, Rattus norvegicus
gtggtcctccaatgcagtggccatg

SEQ ID NO: 452902 - DNA, 25 bp, Rattus norvegicus
cgctgcagcgtggtcctccaatgca

SEQ ID NO: 452903 - DNA, 25 bp, Rattus norvegicus
ccattgctggagtccgcgctgcagc

SEQ ID NO: 452904 - DNA, 25 bp, Rattus norvegicus
tggcacccgaaagcctagcgcagcg

SEQ ID NO: 452905 - DNA, 25 bp, Rattus norvegicus
cttcccgcgctcaggacacggagag

SEQ ID NO: 452906 - DNA, 25 bp, Rattus norvegicus
ctcggcgttcactgaagttcttccc

SEQ ID NO: 452907 - DNA, 25 bp, Rattus norvegicus
ggttcctcggcgttcactgaagttc

SEQ ID NO: 452908 - DNA, 25 bp, Rattus norvegicus
taccgggttcctcggcgttcactga

SEQ ID NO: 452909 - DNA, 25 bp, Rattus norvegicus
tagcgcagcgccattgctggagtcc

SEQ ID NO: 452910 - DNA, 25 bp, Rattus norvegicus
ttgtcgtcacactccgggtcgtaga

SEQ ID NO: 452911 - DNA, 25 bp, Rattus norvegicus
gactcgcctttgatgtccctttcga

SEQ ID NO: 452912 - DNA, 25 bp, Rattus norvegicus
gttgtccaagatcgcgtgctcgctc

SEQ ID NO: 452913 - DNA, 25 bp, Rattus norvegicus
ccaggtagtagatgagagtccgctc

SEQ ID NO: 452914 - DNA, 25 bp, Rattus norvegicus
gtgctcgctcggattcaccagtctg

SEQ ID NO: 452915 - DNA, 25 bp, Rattus norvegicus
ttacgcaccagcacaccgaggtctg

SEQ ID NO: 452916 - DNA, 25 bp, Rattus norvegicus
ggtgcagcttgtagcgttccttgaa

SEQ ID NO: 452917 - DNA, 25 bp, Rattus norvegicus
tcgaccaacacctgcgagccgattg

SEQ ID NO: 452918 - DNA, 25 bp, Rattus norvegicus
gttctgctgcagctcgatctggatg

SEQ ID NO: 452919 - DNA, 25 bp, Rattus norvegicus
ctcaggcccttctgtgacgcgttct

SEQ ID NO: 452920 - DNA, 25 bp, Rattus norvegicus
gtcagcgatgtccacgtctctcagg

SEQ ID NO: 452921 - DNA, 25 bp, Rattus norvegicus
cctttcgaagtagtaggcggcgtca

SEQ ID NO: 452922 - DNA, 25 bp, Rattus norvegicus
ggcccacgaacagtgactcgccttt

SEQ ID NO: 452923 - DNA, 25 bp, Rattus norvegicus
tcgtagaggccatcgttgtccaaga

SEQ ID NO: 452924 - DNA, 25 bp, Rattus norvegicus
gcaggcaaggttatataggaagaga

SEQ ID NO: 452925 - DNA, 25 bp, Rattus norvegicus
ggacggctcgcaagtcctcaggttc

SEQ ID NO: 452926 - DNA, 25 bp, Rattus norvegicus
taccagctcgcgcacagaccggcgc

SEQ ID NO: 452927 - DNA, 25 bp, Rattus norvegicus
agcgcaaggaggagcgcacacgcac

SEQ ID NO: 452928 - DNA, 25 bp, Rattus norvegicus
aacgaacgagccgagcgaggaaggg

SEQ ID NO: 452929 - DNA, 25 bp, Rattus norvegicus
ggcagcgccagagggaacgaacgag

SEQ ID NO: 452930 - DNA, 25 bp, Rattus norvegicus
tgcagcaacagcaggcaaggttata

SEQ ID NO: 452931 - DNA, 25 bp, Rattus norvegicus
tgttccgttaccagcgaccggcagc

SEQ ID NO: 452932 - DNA, 25 bp, Rattus norvegicus
aactccgatgtgttccgttaccagc

SEQ ID NO: 452933 - DNA, 25 bp, Rattus norvegicus
gacccaactccgatgtgttccgtta

SEQ ID NO: 452934 - DNA, 25 bp, Rattus norvegicus
gtctcgagacccaactccgatgtgt

SEQ ID NO: 452935 - DNA, 25 bp, Rattus norvegicus
ggatcggagacaagtcccctgcagc

SEQ ID NO: 452936 - DNA, 25 bp, Rattus norvegicus
cgcaagtcctcaggttccgcggacg

SEQ ID NO: 452937 - DNA, 25 bp, Rattus norvegicus
ccgatgtgttccgttaccagcgacc

SEQ ID NO: 452938 - DNA, 25 bp, Rattus norvegicus
atggcggactcagtggcccgctgat

SEQ ID NO: 452939 - DNA, 25 bp, Rattus norvegicus
gcgccttggcagacggctcactcgg

SEQ ID NO: 452940 - DNA, 25 bp, Rattus norvegicus
gcgacatgctcacttcccggaagcg

SEQ ID NO: 452941 - DNA, 25 bp, Rattus norvegicus
ggggctcgagactcctctgctcgca

SEQ ID NO: 452942 - DNA, 25 bp, Rattus norvegicus
tctttgcatctttcacgacaagttc

SEQ ID NO: 452943 - DNA, 25 bp, Rattus norvegicus
cttccctagcgccgggctgcgattg

SEQ ID NO: 452944 - DNA, 25 bp, Rattus norvegicus
tctttcacgacaagttctgtggccc

SEQ ID NO: 452945 - DNA, 25 bp, Rattus norvegicus
ccgagacctgctgagagagtgacct

SEQ ID NO: 452946 - DNA, 25 bp, Rattus norvegicus
acctgctgagagagtgacctacgcg

SEQ ID NO: 452947 - DNA, 25 bp, Rattus norvegicus
agctcgtgttagtggtggaggccac

SEQ ID NO: 452948 - DNA, 25 bp, Rattus norvegicus
aggccacggactgctagcctcttgg

SEQ ID NO: 452949 - DNA, 25 bp, Rattus norvegicus
actgctagcctcttggggccgggac

SEQ ID NO: 452950 - DNA, 25 bp, Rattus norvegicus
cggacagcatcagctccgcgccttg

SEQ ID NO: 452951 - DNA, 25 bp, Rattus norvegicus
ttggcagacggctcactcgggctcg

SEQ ID NO: 452952 - DNA, 25 bp, Rattus norvegicus
ccactgccgtgtggctcgccagttt

SEQ ID NO: 452953 - DNA, 25 bp, Rattus norvegicus
tgtggctcgccagtttcttagcctc

SEQ ID NO: 452954 - DNA, 25 bp, Rattus norvegicus
tcttagcctcctcggccttggacat

SEQ ID NO: 452955 - DNA, 25 bp, Rattus norvegicus
acgtggttctccactgccgtgtggc

SEQ ID NO: 452956 - DNA, 25 bp, Rattus norvegicus
gcgctcgagcctcccttgtcgccgc

SEQ ID NO: 452957 - DNA, 25 bp, Rattus norvegicus
tcgccgcgggtctccgactgtgtac

SEQ ID NO: 452958 - DNA, 25 bp, Rattus norvegicus
ccggcaactgcacgtgggagcccga

SEQ ID NO: 452959 - DNA, 25 bp, Rattus norvegicus
gacccgcccgtagagggtgctgaag

SEQ ID NO: 452960 - DNA, 25 bp, Rattus norvegicus
cttcacgtggttctccactgccgtg

SEQ ID NO: 452961 - DNA, 25 bp, Rattus norvegicus
actcctccggaaacccgctcgcttg

SEQ ID NO: 452962 - DNA, 25 bp, Rattus norvegicus
agtttcttagcctcctcggccttgg

SEQ ID NO: 452963 - DNA, 25 bp, Rattus norvegicus
gaaacccgctcgcttgcgcaacctg

SEQ ID NO: 452964 - DNA, 25 bp, Rattus norvegicus
cgccgcctcgctccagcctctgcgg

SEQ ID NO: 452965 - DNA, 25 bp, Rattus norvegicus
tcctcggccttggacatcgtggagg

SEQ ID NO: 452966 - DNA, 25 bp, Rattus norvegicus
cgcagccaattgcagagcagacaca

SEQ ID NO: 452967 - DNA, 25 bp, Rattus norvegicus
agacacacggaaccctcgctcaatg

SEQ ID NO: 452968 - DNA, 25 bp, Rattus norvegicus
tcaatgggcgatgtctgtacaaggc

SEQ ID NO: 452969 - DNA, 25 bp, Rattus norvegicus
gtacaaggctgtcactcaggtggca

SEQ ID NO: 452970 - DNA, 25 bp, Rattus norvegicus
gctccaaggctcctagcggcgagac

SEQ ID NO: 452971 - DNA, 25 bp, Rattus norvegicus
gcagcttgcttgctcccacatcgga

SEQ ID NO: 452972 - DNA, 25 bp, Rattus norvegicus
ctacggccgaagtgaccgtggaaga

SEQ ID NO: 452973 - DNA, 25 bp, Rattus norvegicus
tgcctccggcgaacaggagtcacgc

SEQ ID NO: 452974 - DNA, 25 bp, Rattus norvegicus
ccgagtccgatgacgacgtggaact

SEQ ID NO: 452975 - DNA, 25 bp, Rattus norvegicus
cctctcgcagggatgcgagtgactg

SEQ ID NO: 452976 - DNA, 25 bp, Rattus norvegicus
tgactgcggacaagcagagagccgc

SEQ ID NO: 452977 - DNA, 25 bp, Rattus norvegicus
agagagccgcgcgacactttcctgc

SEQ ID NO: 452978 - DNA, 25 bp, Rattus norvegicus
ccacatcggatacggcatttggctt

SEQ ID NO: 452979 - DNA, 25 bp, Rattus norvegicus
tcagagtgacaaggcgcgcagccaa

SEQ ID NO: 452980 - DNA, 25 bp, Rattus norvegicus
ctggcccgcaggtataagagacgct

SEQ ID NO: 452981 - DNA, 25 bp, Rattus norvegicus
gataacttccctttctaccagcgca

SEQ ID NO: 452982 - DNA, 25 bp, Rattus norvegicus
cacatctaccagttcgtcgccgata

SEQ ID NO: 452983 - DNA, 25 bp, Rattus norvegicus
tcgtactcggcgctcatcgctatgg

SEQ ID NO: 452984 - DNA, 25 bp, Rattus norvegicus
acctgatgaagatggtgcggccacc

SEQ ID NO: 452985 - DNA, 25 bp, Rattus norvegicus
gcaccctatgggctgtccgactacg

SEQ ID NO: 452986 - DNA, 25 bp, Rattus norvegicus
cctgtattgcggagacaacttcgta

SEQ ID NO: 452987 - DNA, 25 bp, Rattus norvegicus
cggcctccgacatggccctgtattg

SEQ ID NO: 452988 - DNA, 25 bp, Rattus norvegicus
tgcgccaagggatgctctctccgaa

SEQ ID NO: 452989 - DNA, 25 bp, Rattus norvegicus
agagacgctgtattcccgccctcgg

SEQ ID NO: 452990 - DNA, 25 bp, Rattus norvegicus
ttgactccggagctagcataaagca

SEQ ID NO: 452991 - DNA, 25 bp, Rattus norvegicus
cgcgaagccgcgcacctataggtgc

SEQ ID NO: 452992 - DNA, 25 bp, Rattus norvegicus
ggaggttgcacgctgctacaaagca

SEQ ID NO: 452993 - DNA, 25 bp, Rattus norvegicus
cagcgctccaagtccgtaatcgtag

SEQ ID NO: 452994 - DNA, 25 bp, Rattus norvegicus
ctcggtctccggcagccgcggttcg

SEQ ID NO: 452995 - DNA, 25 bp, Rattus norvegicus
agcctccgcttctttaatttgggtg

SEQ ID NO: 452996 - DNA, 25 bp, Rattus norvegicus
ccagcctccgcttctttaatttggg

SEQ ID NO: 452997 - DNA, 25 bp, Rattus norvegicus
agccagcctccgcttctttaatttg

SEQ ID NO: 452998 - DNA, 25 bp, Rattus norvegicus
acaccgcctcggaggatgtgagccg

SEQ ID NO: 452999 - DNA, 25 bp, Rattus norvegicus
gctgacaccgcctcggaggatgtga

SEQ ID NO: 453000 - DNA, 25 bp, Rattus norvegicus
gatgccgggcatcccgagagccaag

SEQ ID NO: 453001 - DNA, 25 bp, Rattus norvegicus
cggcccgggttagcggagcagccac

SEQ ID NO: 453002 - DNA, 25 bp, Rattus norvegicus
gttcgggcagagctagagaaagacc

SEQ ID NO: 453003 - DNA, 25 bp, Rattus norvegicus
aagggcagccgctcggtctccggca

SEQ ID NO: 453004 - DNA, 25 bp, Rattus norvegicus
agtggtaccagtcccccagcggcgg

SEQ ID NO: 453005 - DNA, 25 bp, Rattus norvegicus
atccgatccctttaggacccagtgg

SEQ ID NO: 453006 - DNA, 25 bp, Rattus norvegicus
aatccgatccctttaggacccagtg

SEQ ID NO: 453007 - DNA, 25 bp, Rattus norvegicus
cagagctagagaaagaccgaggctc

SEQ ID NO: 453008 - DNA, 25 bp, Rattus norvegicus
ccttcggacaaacggccaggagagt

SEQ ID NO: 453009 - DNA, 25 bp, Rattus norvegicus
ccttcttctctgtagtctcccgggg

SEQ ID NO: 453010 - DNA, 25 bp, Rattus norvegicus
aggctcctttgaatcccttcttctc

SEQ ID NO: 453011 - DNA, 25 bp, Rattus norvegicus
cctgtacctgacaaggctcctttga

SEQ ID NO: 453012 - DNA, 25 bp, Rattus norvegicus
gcacacacctgtacctgacaaggct

SEQ ID NO: 453013 - DNA, 25 bp, Rattus norvegicus
tgtcaggcccggaatgcacacacct

SEQ ID NO: 453014 - DNA, 25 bp, Rattus norvegicus
ctttctttagcagaacgccttcgga

SEQ ID NO: 453015 - DNA, 25 bp, Rattus norvegicus
caaggcggctttctttagcagaacg

SEQ ID NO: 453016 - DNA, 25 bp, Rattus norvegicus
ctgcgctaaacaaggcggctttctt

SEQ ID NO: 453017 - DNA, 25 bp, Rattus norvegicus
agctccggcggaaagcgggcaagaa

SEQ ID NO: 453018 - DNA, 25 bp, Rattus norvegicus
cccgggttggcaactgcgctaaaca

SEQ ID NO: 453019 - DNA, 25 bp, Rattus norvegicus
caagaagcccgggttggcaactgcg

SEQ ID NO: 453020 - DNA, 25 bp, Rattus norvegicus
tagcagaacgccttcggacaaacgg

SEQ ID NO: 453021 - DNA, 25 bp, Rattus norvegicus
aggcccggaatgcacacacctgtac

SEQ ID NO: 453022 - DNA, 25 bp, Rattus norvegicus
ctccaggccgctccgctgcgcatgc

SEQ ID NO: 453023 - DNA, 25 bp, Rattus norvegicus
gggtcaatgaggaagccccttcttc

SEQ ID NO: 453024 - DNA, 25 bp, Rattus norvegicus
catggccaagggacgccacggcctg

SEQ ID NO: 453025 - DNA, 25 bp, Rattus norvegicus
gacggccctcggagagcctctctcc

SEQ ID NO: 453026 - DNA, 25 bp, Rattus norvegicus
cgcctgcgaaatggccgacgagccg

SEQ ID NO: 453027 - DNA, 25 bp, Rattus norvegicus
actcccgcggcctagtgaaggccga

SEQ ID NO: 453028 - DNA, 25 bp, Rattus norvegicus
gcggcccgagcttcagccctcaact

SEQ ID NO: 453029 - DNA, 25 bp, Rattus norvegicus
ggacagtagttgtagacgcccgccc

SEQ ID NO: 453030 - DNA, 25 bp, Rattus norvegicus
ggcagtggtgttcctgcctctccgc

SEQ ID NO: 453031 - DNA, 25 bp, Rattus norvegicus
accgccatggcgctggcgccgtcca

SEQ ID NO: 453032 - DNA, 25 bp, Rattus norvegicus
cggggctagaaattttcctgcgctc

SEQ ID NO: 453033 - DNA, 25 bp, Rattus norvegicus
agaaattttcctgcgctccaggccg

SEQ ID NO: 453034 - DNA, 25 bp, Rattus norvegicus
cttcttcaagcgacccccggagaga

SEQ ID NO: 453035 - DNA, 25 bp, Rattus norvegicus
tcaggaagtcaggtctccgcctcct

SEQ ID NO: 453036 - DNA, 25 bp, Rattus norvegicus
gcccgagaacttgtgcagcaccttc

SEQ ID NO: 453037 - DNA, 25 bp, Rattus norvegicus
ccgcgaggggaaacaggataaatca

SEQ ID NO: 453038 - DNA, 25 bp, Rattus norvegicus
gtcacgcactgatccatgccggaga

SEQ ID NO: 453039 - DNA, 25 bp, Rattus norvegicus
gcgccgccgattgtttttgttttca

SEQ ID NO: 453040 - DNA, 25 bp, Rattus norvegicus
tgttttcacgggaaccggccgatga

SEQ ID NO: 453041 - DNA, 25 bp, Rattus norvegicus
cagggaactttagcgagagcgtcaa

SEQ ID NO: 453042 - DNA, 25 bp, Rattus norvegicus
gagcgtcaactaagcggccggtaaa

SEQ ID NO: 453043 - DNA, 25 bp, Rattus norvegicus
gaccgaccaattgacgcaggggcta

SEQ ID NO: 453044 - DNA, 25 bp, Rattus norvegicus
ggggctaggaacgagacaaatattc

SEQ ID NO: 453045 - DNA, 25 bp, Rattus norvegicus
ttctccaatcgctagccaaggcgta

SEQ ID NO: 453046 - DNA, 25 bp, Rattus norvegicus
caatccggactgaggggacaaacca

SEQ ID NO: 453047 - DNA, 25 bp, Rattus norvegicus
ggacaaaccaatgctctcgctgttg

SEQ ID NO: 453048 - DNA, 25 bp, Rattus norvegicus
gaggcgcttaaatcttctactggga

SEQ ID NO: 453049 - DNA, 25 bp, Rattus norvegicus
tgtagtcgatgagctcttccaggcc

SEQ ID NO: 453050 - DNA, 25 bp, Rattus norvegicus
cgcgcagctacgcaactgacaggaa

SEQ ID NO: 453051 - DNA, 25 bp, Rattus norvegicus
ggaggcgtacccagtccagccttca

SEQ ID NO: 453052 - DNA, 25 bp, Rattus norvegicus
gcccagatgccgacgtcagttgtta

SEQ ID NO: 453053 - DNA, 25 bp, Rattus norvegicus
gcggcgcatccgcacagggctagtc

SEQ ID NO: 453054 - DNA, 25 bp, Rattus norvegicus
agcacagtaactcaggaggcgtacc

SEQ ID NO: 453055 - DNA, 25 bp, Rattus norvegicus
tgacaggaagcctccctggagagcc

SEQ ID NO: 453056 - DNA, 25 bp, Rattus norvegicus
cgtcggggcctagtgttatttgctt

SEQ ID NO: 453057 - DNA, 25 bp, Rattus norvegicus
tgctttttctcccttcacgactgtg

SEQ ID NO: 453058 - DNA, 25 bp, Rattus norvegicus
ttcacgactgtggtctcgcgctctt

SEQ ID NO: 453059 - DNA, 25 bp, Rattus norvegicus
ctggcccgcagtctatcggagctgc

SEQ ID NO: 453060 - DNA, 25 bp, Rattus norvegicus
ttcgatgggtggagtgcttttgaac

SEQ ID NO: 453061 - DNA, 25 bp, Rattus norvegicus
gtgcttttgaacgtaccctcttctc

SEQ ID NO: 453062 - DNA, 25 bp, Rattus norvegicus
ctcagctcttgaccgcaaggccaga

SEQ ID NO: 453063 - DNA, 25 bp, Rattus norvegicus
ttgttatgtcttgactggggccgca

SEQ ID NO: 453064 - DNA, 25 bp, Rattus norvegicus
ccttctctgggcgtctgattccctt

SEQ ID NO: 453065 - DNA, 25 bp, Rattus norvegicus
gtctgcagaccacccggaggacctg

SEQ ID NO: 453066 - DNA, 25 bp, Rattus norvegicus
gcccggaacctttctcaagcgcagg

SEQ ID NO: 453067 - DNA, 25 bp, Rattus norvegicus
gctcctaggcgcttgaggcgccaca

SEQ ID NO: 453068 - DNA, 25 bp, Rattus norvegicus
aagagtgcgcatttgctgctccgcg

SEQ ID NO: 453069 - DNA, 25 bp, Rattus norvegicus
gttcagttcatcatggggctgtttg

SEQ ID NO: 453070 - DNA, 25 bp, Rattus norvegicus
gggataggaggagttcagttcatca

SEQ ID NO: 453071 - DNA, 25 bp, Rattus norvegicus
aacccaagagaagcctcccaaagag

SEQ ID NO: 453072 - DNA, 25 bp, Rattus norvegicus
cctcccaaagagctggtaagggcca

SEQ ID NO: 453073 - DNA, 25 bp, Rattus norvegicus
ccagcgaccggggaagctacgcgct

SEQ ID NO: 453074 - DNA, 25 bp, Rattus norvegicus
gtgggaatagctagctgcgctctcc

SEQ ID NO: 453075 - DNA, 25 bp, Rattus norvegicus
ctgtgaggaagagtgcgcatttgct

SEQ ID NO: 453076 - DNA, 25 bp, Rattus norvegicus
gggcgtctgattcccttcctcgcag

SEQ ID NO: 453077 - DNA, 25 bp, Rattus norvegicus
tgcgcgcgtgcgtactacccttgct

SEQ ID NO: 453078 - DNA, 25 bp, Rattus norvegicus
gcccgtcctgaaccgtgaaccgaga

SEQ ID NO: 453079 - DNA, 25 bp, Rattus norvegicus
cctttcaaagctggacactgagaga

SEQ ID NO: 453080 - DNA, 25 bp, Rattus norvegicus
cctcgccctggcaaagaaaaggctc

SEQ ID NO: 453081 - DNA, 25 bp, Rattus norvegicus
gccgactctagctctgacttggttc

SEQ ID NO: 453082 - DNA, 25 bp, Rattus norvegicus
gacttggttcaagagctctctcaca

SEQ ID NO: 453083 - DNA, 25 bp, Rattus norvegicus
gccgctgccaccgatgattggctga

SEQ ID NO: 453084 - DNA, 25 bp, Rattus norvegicus
ttcttccatttgttgcctcgcgcta

SEQ ID NO: 453085 - DNA, 25 bp, Rattus norvegicus
cccgccgaatcggttatcgactttg

SEQ ID NO: 453086 - DNA, 25 bp, Rattus norvegicus
ccgcagcgccagtgcttttgcctaa

SEQ ID NO: 453087 - DNA, 25 bp, Rattus norvegicus
tcacacaggctcacagataagagtg

SEQ ID NO: 453088 - DNA, 25 bp, Rattus norvegicus
gacccaggaccatgagcgcctattg

SEQ ID NO: 453089 - DNA, 25 bp, Rattus norvegicus
gcgctacgcaaaaaagtcccgccga

SEQ ID NO: 453090 - DNA, 25 bp, Rattus norvegicus
ccgtggactagctcgagactcgaca

SEQ ID NO: 453091 - DNA, 25 bp, Rattus norvegicus
gcgcctattggattgcacttgaagc

SEQ ID NO: 453092 - DNA, 25 bp, Rattus norvegicus
agtggcctcttctcctgtgtccctt

SEQ ID NO: 453093 - DNA, 25 bp, Rattus norvegicus
ctgttgctttgttccatcccgggtg

SEQ ID NO: 453094 - DNA, 25 bp, Rattus norvegicus
atcttgccttgtctctgttgctttg

SEQ ID NO: 453095 - DNA, 25 bp, Rattus norvegicus
gctgggcaaggcatcttgccttgtc

SEQ ID NO: 453096 - DNA, 25 bp, Rattus norvegicus
gtcctcgcacgctggtggagtcacc

SEQ ID NO: 453097 - DNA, 25 bp, Rattus norvegicus
tgacccatgggtagccgcgggcaca

SEQ ID NO: 453098 - DNA, 25 bp, Rattus norvegicus
cgcgacgctactgacccatgggtag

SEQ ID NO: 453099 - DNA, 25 bp, Rattus norvegicus
tgtaggacgcgcgacgctactgacc

SEQ ID NO: 453100 - DNA, 25 bp, Rattus norvegicus
ttagcaggtacagtagctgcctggg

SEQ ID NO: 453101 - DNA, 25 bp, Rattus norvegicus
ccagcccgggttcggtagatctatt

SEQ ID NO: 453102 - DNA, 25 bp, Rattus norvegicus
ggtggtgtaagtggcctcttctcct

SEQ ID NO: 453103 - DNA, 25 bp, Rattus norvegicus
gccatggtgtcgtggatcatctcca

SEQ ID NO: 453104 - DNA, 25 bp, Rattus norvegicus
ccgcggtcgctaaatttagcaggta

SEQ ID NO: 453105 - DNA, 25 bp, Rattus norvegicus
ggatcatctccaggctggtggtgta

SEQ ID NO: 453106 - DNA, 25 bp, Rattus norvegicus
ctccgcgacggggacgcgctcccag

SEQ ID NO: 453107 - DNA, 25 bp, Rattus norvegicus
ctcccctgatcctccggaaccctcg

SEQ ID NO: 453108 - DNA, 25 bp, Rattus norvegicus
cacagcccgacaccgctggcgcggc

SEQ ID NO: 453109 - DNA, 25 bp, Rattus norvegicus
gctagctctagatttcgtgtcccgg

SEQ ID NO: 453110 - DNA, 25 bp, Rattus norvegicus
caggcacagcccgacaccgctggcg

SEQ ID NO: 453111 - DNA, 25 bp, Rattus norvegicus
tcgcgcgctcccgacgatttcccgg

SEQ ID NO: 453112 - DNA, 25 bp, Rattus norvegicus
gctcccgacgatttcccggtgccca

SEQ ID NO: 453113 - DNA, 25 bp, Rattus norvegicus
aggccagcctccagcgtgcgcgccc

SEQ ID NO: 453114 - DNA, 25 bp, Rattus norvegicus
gaaagcggacgctgagactccgcga

SEQ ID NO: 453115 - DNA, 25 bp, Rattus norvegicus
aagcggacgctgagactccgcgacg

SEQ ID NO: 453116 - DNA, 25 bp, Rattus norvegicus
gacgctgagactccgcgacggggac

SEQ ID NO: 453117 - DNA, 25 bp, Rattus norvegicus
tgagactccgcgacggggacgcgct

SEQ ID NO: 453118 - DNA, 25 bp, Rattus norvegicus
ctagctctagatttcgtgtcccggg

SEQ ID NO: 453119 - DNA, 25 bp, Rattus norvegicus
agctgagaggcggaaagcggacgct

SEQ ID NO: 453120 - DNA, 25 bp, Rattus norvegicus
cagtgaacgcaggtcacggacacta

SEQ ID NO: 453121 - DNA, 25 bp, Rattus norvegicus
atcttgcagcctgcctacggtggcc

SEQ ID NO: 453122 - DNA, 25 bp, Rattus norvegicus
gcccatgaagatggaggccgccatc

SEQ ID NO: 453123 - DNA, 25 bp, Rattus norvegicus
aggcagctctcacggcgcccatgaa

SEQ ID NO: 453124 - DNA, 25 bp, Rattus norvegicus
agaacactgacctgaggcagctctc

SEQ ID NO: 453125 - DNA, 25 bp, Rattus norvegicus
agtgaaccggtcaatagaacactga

SEQ ID NO: 453126 - DNA, 25 bp, Rattus norvegicus
tctcttctcagtgaaccggtcaata

SEQ ID NO: 453127 - DNA, 25 bp, Rattus norvegicus
taacattcaaactaaacgcctcctc

SEQ ID NO: 453128 - DNA, 25 bp, Rattus norvegicus
tcctacggcagagtggatccagtga

SEQ ID NO: 453129 - DNA, 25 bp, Rattus norvegicus
cacggacactacattgtgcaaggta

SEQ ID NO: 453130 - DNA, 25 bp, Rattus norvegicus
acggtggccgcagagtaaaataagc

SEQ ID NO: 453131 - DNA, 25 bp, Rattus norvegicus
cccgagccggttctcttctcagtga

SEQ ID NO: 453132 - DNA, 25 bp, Rattus norvegicus
tgtgcaaggtatcgcacagcaaacc

SEQ ID NO: 453133 - DNA, 25 bp, Rattus norvegicus
ctccgacctcaagtcgtcttgtttt

SEQ ID NO: 453134 - DNA, 25 bp, Rattus norvegicus
agcgccgtcacttcggcagagatgc

SEQ ID NO: 453135 - DNA, 25 bp, Rattus norvegicus
tgggcacgtgataggtttccaatcg

SEQ ID NO: 453136 - DNA, 25 bp, Rattus norvegicus
tcgttacttcagtctcgggccaatc

SEQ ID NO: 453137 - DNA, 25 bp, Rattus norvegicus
cgtggcttcagggacttggtaccca

SEQ ID NO: 453138 - DNA, 25 bp, Rattus norvegicus
gtcgccggactggaattactagaga

SEQ ID NO: 453139 - DNA, 25 bp, Rattus norvegicus
ctagagccctagagcgggaaaccga

SEQ ID NO: 453140 - DNA, 25 bp, Rattus norvegicus
aggcaaaggcgttcctagagcccta

SEQ ID NO: 453141 - DNA, 25 bp, Rattus norvegicus
tgatgctcacatcccaggcaaaggc

SEQ ID NO: 453142 - DNA, 25 bp, Rattus norvegicus
gcctgtcagttatccggcgtgaccg

SEQ ID NO: 453143 - DNA, 25 bp, Rattus norvegicus
acgcgggcacgcacaggaacacgca

SEQ ID NO: 453144 - DNA, 25 bp, Rattus norvegicus
agagagagtcgcctcggctaaacca

SEQ ID NO: 453145 - DNA, 25 bp, Rattus norvegicus
gtgagtcccacccttagagagagtc

SEQ ID NO: 453146 - DNA, 25 bp, Rattus norvegicus
ttgctcctcttttcgcagccggggt

SEQ ID NO: 453147 - DNA, 25 bp, Rattus norvegicus
ccaacggacaacgtgagaggcatcc

SEQ ID NO: 453148 - DNA, 25 bp, Rattus norvegicus
ctcctgcccggcattcgccccaaca

SEQ ID NO: 453149 - DNA, 25 bp, Rattus norvegicus
acaacaccctgggatggagcgactc

SEQ ID NO: 453150 - DNA, 25 bp, Rattus norvegicus
ccaacaccatgggcctgaggggttc

SEQ ID NO: 453151 - DNA, 25 bp, Rattus norvegicus
ctctccattctttccggctccggga

SEQ ID NO: 453152 - DNA, 25 bp, Rattus norvegicus
cccacaacaccctgggatggagcga

SEQ ID NO: 453153 - DNA, 25 bp, Rattus norvegicus
ctccctgcatccctacacacctcgc

SEQ ID NO: 453154 - DNA, 25 bp, Rattus norvegicus
aacaccctgggatggagcgactcca

SEQ ID NO: 453155 - DNA, 25 bp, Rattus norvegicus
caccctgggatggagcgactccagc

SEQ ID NO: 453156 - DNA, 25 bp, Rattus norvegicus
ccctgggatggagcgactccagcca

SEQ ID NO: 453157 - DNA, 25 bp, Rattus norvegicus
tgggatggagcgactccagccagcc

SEQ ID NO: 453158 - DNA, 25 bp, Rattus norvegicus
atggagcgactccagccagcccgga

SEQ ID NO: 453159 - DNA, 25 bp, Rattus norvegicus
tggagcgactccagccagcccggag

SEQ ID NO: 453160 - DNA, 25 bp, Rattus norvegicus
ccctacacacctcgcctctccattc

SEQ ID NO: 453161 - DNA, 25 bp, Rattus norvegicus
cattctttccggctccgggactctc

SEQ ID NO: 453162 - DNA, 25 bp, Rattus norvegicus
gtactccctggctgactggaacttc

SEQ ID NO: 453163 - DNA, 25 bp, Rattus norvegicus
caagccattacggtgggccgcgttt

SEQ ID NO: 453164 - DNA, 25 bp, Rattus norvegicus
gcgcaagcgcagtggaaaacacatg

SEQ ID NO: 453165 - DNA, 25 bp, Rattus norvegicus
aacacatggtggctctgcgctagaa

SEQ ID NO: 453166 - DNA, 25 bp, Rattus norvegicus
gaagcttgaagtggagtactccctg

SEQ ID NO: 453167 - DNA, 25 bp, Rattus norvegicus
actggaacttctctcgtagggacga

SEQ ID NO: 453168 - DNA, 25 bp, Rattus norvegicus
ctcgtagggacgaacctcaaaactg

SEQ ID NO: 453169 - DNA, 25 bp, Rattus norvegicus
ggacgaacctcaaaactgactcgga

SEQ ID NO: 453170 - DNA, 25 bp, Rattus norvegicus
actgactcggaagatgctggcctcc

SEQ ID NO: 453171 - DNA, 25 bp, Rattus norvegicus
aagatgctggcctccaagcacacgc

SEQ ID NO: 453172 - DNA, 25 bp, Rattus norvegicus
ccatggcggcggcttcagggcattt

SEQ ID NO: 453173 - DNA, 25 bp, Rattus norvegicus
ttcagggcatttccttcgggatgta

SEQ ID NO: 453174 - DNA, 25 bp, Rattus norvegicus
atttccttcgggatgtattcggccg

SEQ ID NO: 453175 - DNA, 25 bp, Rattus norvegicus
ctctgcgctagaagcttgaagtgga

SEQ ID NO: 453176 - DNA, 25 bp, Rattus norvegicus
ccaagccgcgtcttggctgacagcg

SEQ ID NO: 453177 - DNA, 25 bp, Rattus norvegicus
aaagtggccctcttccgacacatcg

SEQ ID NO: 453178 - DNA, 25 bp, Rattus norvegicus
caggtccggccaaagtggccctctt

SEQ ID NO: 453179 - DNA, 25 bp, Rattus norvegicus
cccgcgtggcaggtccggccaaagt

SEQ ID NO: 453180 - DNA, 25 bp, Rattus norvegicus
tgctgtgggtaaggacgacccgccc

SEQ ID NO: 453181 - DNA, 25 bp, Rattus norvegicus
gacctcggggaacccaggcagcagc

SEQ ID NO: 453182 - DNA, 25 bp, Rattus norvegicus
cccagtcagcagagcggacctcggg

SEQ ID NO: 453183 - DNA, 25 bp, Rattus norvegicus
acctgcctgccgaggtacgtggcgc

SEQ ID NO: 453184 - DNA, 25 bp, Rattus norvegicus
aagcagcggcacctgcctgccgagg

SEQ ID NO: 453185 - DNA, 25 bp, Rattus norvegicus
ccagaagccgcgaagccaagcagcg

SEQ ID NO: 453186 - DNA, 25 bp, Rattus norvegicus
tcagcatccgcgctggggaacggac

SEQ ID NO: 453187 - DNA, 25 bp, Rattus norvegicus
ctgattggccttccgcatcctcgtg

SEQ ID NO: 453188 - DNA, 25 bp, Rattus norvegicus
cgctccctttccactagcagtcgga

SEQ ID NO: 453189 - DNA, 25 bp, Rattus norvegicus
ggcgcactctgattggccttccgca

SEQ ID NO: 453190 - DNA, 25 bp, Rattus norvegicus
aggctcccggcgctgagtcaaagcc

SEQ ID NO: 453191 - DNA, 25 bp, Rattus norvegicus
gtccagtgcggcgtggtttgcctaa

SEQ ID NO: 453192 - DNA, 25 bp, Rattus norvegicus
agtgcggcgtggtttgcctaagcca

SEQ ID NO: 453193 - DNA, 25 bp, Rattus norvegicus
ggcgtggtttgcctaagccaggctc

SEQ ID NO: 453194 - DNA, 25 bp, Rattus norvegicus
cgtggtttgcctaagccaggctccc

SEQ ID NO: 453195 - DNA, 25 bp, Rattus norvegicus
gtttgcctaagccaggctcccggcg

SEQ ID NO: 453196 - DNA, 25 bp, Rattus norvegicus
cggcgctgagtcaaagcccacacag

SEQ ID NO: 453197 - DNA, 25 bp, Rattus norvegicus
gcgctgagtcaaagcccacacaggg

SEQ ID NO: 453198 - DNA, 25 bp, Rattus norvegicus
aaagcccacacagggaccagggcgc

SEQ ID NO: 453199 - DNA, 25 bp, Rattus norvegicus
ggaggggaactctagagcgcccaca

SEQ ID NO: 453200 - DNA, 25 bp, Rattus norvegicus
aggggaactctagagcgcccacacg

SEQ ID NO: 453201 - DNA, 25 bp, Rattus norvegicus
gggaactctagagcgcccacacgca

SEQ ID NO: 453202 - DNA, 25 bp, Rattus norvegicus
gaactctagagcgcccacacgcaaa

SEQ ID NO: 453203 - DNA, 25 bp, Rattus norvegicus
tggtttgcctaagccaggctcccgg

SEQ ID NO: 453204 - DNA, 25 bp, Rattus norvegicus
tgcggagctcccatagacttgcagg

SEQ ID NO: 453205 - DNA, 25 bp, Rattus norvegicus
gtgactgagttcttgggcttccagc

SEQ ID NO: 453206 - DNA, 25 bp, Rattus norvegicus
tgggcttccagctcgcgtgctttcc

SEQ ID NO: 453207 - DNA, 25 bp, Rattus norvegicus
tcccagcgagcgctcggaacatctg

SEQ ID NO: 453208 - DNA, 25 bp, Rattus norvegicus
gggacccgctgttcctgcggagctc

SEQ ID NO: 453209 - DNA, 25 bp, Rattus norvegicus
cccatagacttgcaggcaggccggc

SEQ ID NO: 453210 - DNA, 25 bp, Rattus norvegicus
ggcctctcccagcagctaatcaaaa

SEQ ID NO: 453211 - DNA, 25 bp, Rattus norvegicus
ctaatcaaaaccacagcaccgaatg

SEQ ID NO: 453212 - DNA, 25 bp, Rattus norvegicus
caccgaatgggaaccaggcggcgct

SEQ ID NO: 453213 - DNA, 25 bp, Rattus norvegicus
cgccaggcgacttaacccggtgtca

SEQ ID NO: 453214 - DNA, 25 bp, Rattus norvegicus
cttaacccggtgtcaggcctcactg

SEQ ID NO: 453215 - DNA, 25 bp, Rattus norvegicus
tgtcaggcctcactggcggcgcagc

SEQ ID NO: 453216 - DNA, 25 bp, Rattus norvegicus
ggggtactcggagctgatgacaccc

SEQ ID NO: 453217 - DNA, 25 bp, Rattus norvegicus
gaacatctggagtctggggttgcca

SEQ ID NO: 453218 - DNA, 25 bp, Rattus norvegicus
gttcagctctttcacgcacacggtc

SEQ ID NO: 453219 - DNA, 25 bp, Rattus norvegicus
agttttatagccattcgcgcgccgc

SEQ ID NO: 453220 - DNA, 25 bp, Rattus norvegicus
agcctgctcgcgtaagggctgcacc

SEQ ID NO: 453221 - DNA, 25 bp, Rattus norvegicus
tgtgcccagagcgaaaccgcgtttg

SEQ ID NO: 453222 - DNA, 25 bp, Rattus norvegicus
tctgagacctcaggcgctctgatgc

SEQ ID NO: 453223 - DNA, 25 bp, Rattus norvegicus
aattccctggctgtgtctgtgcctc

SEQ ID NO: 453224 - DNA, 25 bp, Rattus norvegicus
ccgaactcgggagcttccaagtcca

SEQ ID NO: 453225 - DNA, 25 bp, Rattus norvegicus
cgcttgagcttcttgaggccgttca

SEQ ID NO: 453226 - DNA, 25 bp, Rattus norvegicus
gggacacgcgcccacaacgattgct

SEQ ID NO: 453227 - DNA, 25 bp, Rattus norvegicus
cccgggagagctcaaagtgtcatct

SEQ ID NO: 453228 - DNA, 25 bp, Rattus norvegicus
agtgtcatctgaagtcgctgccgcc

SEQ ID NO: 453229 - DNA, 25 bp, Rattus norvegicus
tgccagcatttctgcagaacgcccg

SEQ ID NO: 453230 - DNA, 25 bp, Rattus norvegicus
gctgcgctccatctgtgtttgttta

SEQ ID NO: 453231 - DNA, 25 bp, Rattus norvegicus
ggctccttgcctttccgcttgagct

SEQ ID NO: 453232 - DNA, 25 bp, Rattus norvegicus
tacctcgagactcggactcgcgctt

SEQ ID NO: 453233 - DNA, 25 bp, Rattus norvegicus
cgcacgggaggcaagcagccaatca

SEQ ID NO: 453234 - DNA, 25 bp, Rattus norvegicus
caccggttaggagcttccgcgccgg

SEQ ID NO: 453235 - DNA, 25 bp, Rattus norvegicus
tagacatcgccaccaccggttagga

SEQ ID NO: 453236 - DNA, 25 bp, Rattus norvegicus
cgcttggaccggctagacatcgcca

SEQ ID NO: 453237 - DNA, 25 bp, Rattus norvegicus
atgagactgccgcttggaccggcta

SEQ ID NO: 453238 - DNA, 25 bp, Rattus norvegicus
tcgcgcttcccacgggtagaaccat

SEQ ID NO: 453239 - DNA, 25 bp, Rattus norvegicus
tcagaagcacagctcgctacgagtc

SEQ ID NO: 453240 - DNA, 25 bp, Rattus norvegicus
tgatgcgacccgagctacctcgaga

SEQ ID NO: 453241 - DNA, 25 bp, Rattus norvegicus
ctccttcttgatgcgacccgagcta

SEQ ID NO: 453242 - DNA, 25 bp, Rattus norvegicus
ttctcgcggtctcgctccttcttga

SEQ ID NO: 453243 - DNA, 25 bp, Rattus norvegicus
caatcaagagccgagctagcttcag

SEQ ID NO: 453244 - DNA, 25 bp, Rattus norvegicus
ggtagaaccatgagactgccgcttg

SEQ ID NO: 453245 - DNA, 25 bp, Rattus norvegicus
gagccgagctagcttcagaagcaca

SEQ ID NO: 453246 - DNA, 25 bp, Rattus norvegicus
ccggaagtcttgatccgctgccggc

SEQ ID NO: 453247 - DNA, 25 bp, Rattus norvegicus
ttaccgaggccactgcatcaacgtc

SEQ ID NO: 453248 - DNA, 25 bp, Rattus norvegicus
cctcttctttgcgtcagggctcctg

SEQ ID NO: 453249 - DNA, 25 bp, Rattus norvegicus
cgcaagccagacctacaggtgtacc

SEQ ID NO: 453250 - DNA, 25 bp, Rattus norvegicus
cccgcagggacgactacgacaagaa

SEQ ID NO: 453251 - DNA, 25 bp, Rattus norvegicus
atatccgtcggaaccagatcgctcg

SEQ ID NO: 453252 - DNA, 25 bp, Rattus norvegicus
ggcttcgtacaccatatccgtcgga

SEQ ID NO: 453253 - DNA, 25 bp, Rattus norvegicus
atgagccacggcttcgtacaccata

SEQ ID NO: 453254 - DNA, 25 bp, Rattus norvegicus
gcgtctggacatgagccacggcttc

SEQ ID NO: 453255 - DNA, 25 bp, Rattus norvegicus
cccaggatccgaatggaggcggcac

SEQ ID NO: 453256 - DNA, 25 bp, Rattus norvegicus
ggcggttctgtacccaggatccgaa

SEQ ID NO: 453257 - DNA, 25 bp, Rattus norvegicus
cggcctgaattacccggccgttgtg

SEQ ID NO: 453258 - DNA, 25 bp, Rattus norvegicus
gaggccactgcatcaacgtcagcga

SEQ ID NO: 453259 - DNA, 25 bp, Rattus norvegicus
ggtccgcgaccggaagtcttgatcc

SEQ ID NO: 453260 - DNA, 25 bp, Rattus norvegicus
tgcagacgcctacccaagctggggt

SEQ ID NO: 453261 - DNA, 25 bp, Rattus norvegicus
tctcccgcggcctccaagggatcga

SEQ ID NO: 453262 - DNA, 25 bp, Rattus norvegicus
tctctcagcgcgcccgtggcatttg

SEQ ID NO: 453263 - DNA, 25 bp, Rattus norvegicus
aagctggggtccctgtgcccacgcg

SEQ ID NO: 453264 - DNA, 25 bp, Rattus norvegicus
ggtccctgtgcccacgcgaacggga

SEQ ID NO: 453265 - DNA, 25 bp, Rattus norvegicus
gtcaggtggtttgcccgcacagcaa

SEQ ID NO: 453266 - DNA, 25 bp, Rattus norvegicus
ggtttgcccgcacagcaacgactcg

SEQ ID NO: 453267 - DNA, 25 bp, Rattus norvegicus
ctagctccagccttcaccaagccgg

SEQ ID NO: 453268 - DNA, 25 bp, Rattus norvegicus
aaacctttcagggctgctccgaggg

SEQ ID NO: 453269 - DNA, 25 bp, Rattus norvegicus
cgtggctctctttccagatgttaca

SEQ ID NO: 453270 - DNA, 25 bp, Rattus norvegicus
ttccagatgttacagccttgcccga

SEQ ID NO: 453271 - DNA, 25 bp, Rattus norvegicus
tgttacagccttgcccgagtctctc

SEQ ID NO: 453272 - DNA, 25 bp, Rattus norvegicus
ctcccaggctttccttggcatgatc

SEQ ID NO: 453273 - DNA, 25 bp, Rattus norvegicus
aggtgcgtactggactccttttctc

SEQ ID NO: 453274 - DNA, 25 bp, Rattus norvegicus
gcggcccttttctggaaggctgtga

SEQ ID NO: 453275 - DNA, 25 bp, Rattus norvegicus
agctttgggtaccacctcctctgca

SEQ ID NO: 453276 - DNA, 25 bp, Rattus norvegicus
tacaagtcccagatgccagtgcgtg

SEQ ID NO: 453277 - DNA, 25 bp, Rattus norvegicus
gcaatcttgggaaacatggccgccc

SEQ ID NO: 453278 - DNA, 25 bp, Rattus norvegicus
tgccttccgccacaggcaatcttgg

SEQ ID NO: 453279 - DNA, 25 bp, Rattus norvegicus
aacgagtccctggagttgagcgctg

SEQ ID NO: 453280 - DNA, 25 bp, Rattus norvegicus
tgcctccgcgatggaaacgagtccc

SEQ ID NO: 453281 - DNA, 25 bp, Rattus norvegicus
tgaagtttaaggtttgcctccgcga

SEQ ID NO: 453282 - DNA, 25 bp, Rattus norvegicus
ataataacaagagcggggcacactg

SEQ ID NO: 453283 - DNA, 25 bp, Rattus norvegicus
cgcaaacttcaagcagagagcaccc

SEQ ID NO: 453284 - DNA, 25 bp, Rattus norvegicus
cgtggccgctgcgatgcagaaatac

SEQ ID NO: 453285 - DNA, 25 bp, Rattus norvegicus
ccctcactgtattctggaacgcgta

SEQ ID NO: 453286 - DNA, 25 bp, Rattus norvegicus
ccgaaaagcggacacgcgatgcttc

SEQ ID NO: 453287 - DNA, 25 bp, Rattus norvegicus
gcgctcgggatctaggccgtcaaac

SEQ ID NO: 453288 - DNA, 25 bp, Rattus norvegicus
acggggcgcactctggagtctccct

SEQ ID NO: 453289 - DNA, 25 bp, Rattus norvegicus
ggctctggctttatgcccctgcaca

SEQ ID NO: 453290 - DNA, 25 bp, Rattus norvegicus
tgcctgcaaagttggggactgattc

SEQ ID NO: 453291 - DNA, 25 bp, Rattus norvegicus
aagttggggactgattcttgtggtc

SEQ ID NO: 453292 - DNA, 25 bp, Rattus norvegicus
gactgattcttgtggtcagcgtgac

SEQ ID NO: 453293 - DNA, 25 bp, Rattus norvegicus
cctggagttcggctctggctttatg

SEQ ID NO: 453294 - DNA, 25 bp, Rattus norvegicus
ggagttcggctctggctttatgccc

SEQ ID NO: 453295 - DNA, 25 bp, Rattus norvegicus
tccggctcctctgcctcgcgctgcc

SEQ ID NO: 453296 - DNA, 25 bp, Rattus norvegicus
cgcgccttctcagaggtgccgggcc

SEQ ID NO: 453297 - DNA, 25 bp, Rattus norvegicus
ccggacaaaccgaaagtagtgacag

SEQ ID NO: 453298 - DNA, 25 bp, Rattus norvegicus
caaaccgaaagtagtgacagggccg

SEQ ID NO: 453299 - DNA, 25 bp, Rattus norvegicus
ggtcaccggcgtccgacttccgatg

SEQ ID NO: 453300 - DNA, 25 bp, Rattus norvegicus
ccaggctgcctgcaaagttggggac

SEQ ID NO: 453301 - DNA, 25 bp, Rattus norvegicus
tctcaccatcgcctccgcagctgcc

SEQ ID NO: 453302 - DNA, 25 bp, Rattus norvegicus
tccgcaccctcctccgacagctccc

SEQ ID NO: 453303 - DNA, 25 bp, Rattus norvegicus
cctgccgacgaacattggaaccgcg

SEQ ID NO: 453304 - DNA, 25 bp, Rattus norvegicus
cagagccgcacagcgaaggtgagcc

SEQ ID NO: 453305 - DNA, 25 bp, Rattus norvegicus
tcgcctttgcactcgggcccaggct

SEQ ID NO: 453306 - DNA, 25 bp, Rattus norvegicus
agcttcgtgcgtcgctaccctcgag

SEQ ID NO: 453307 - DNA, 25 bp, Rattus norvegicus
tcgcatgagggcctggctgccacct

SEQ ID NO: 453308 - DNA, 25 bp, Rattus norvegicus
aacgccgcctcgcatgagggcctgg

SEQ ID NO: 453309 - DNA, 25 bp, Rattus norvegicus
ctggatgaggacgagccgccgccct

SEQ ID NO: 453310 - DNA, 25 bp, Rattus norvegicus
agccaccgggcttgaggcgcagtct

SEQ ID NO: 453311 - DNA, 25 bp, Rattus norvegicus
gctctttctgcctggagccaccggg

SEQ ID NO: 453312 - DNA, 25 bp, Rattus norvegicus
cagccggcggctctttctgcctgga

SEQ ID NO: 453313 - DNA, 25 bp, Rattus norvegicus
cgaacattggaaccgcggctaggcc

SEQ ID NO: 453314 - DNA, 25 bp, Rattus norvegicus
gccgccctcgccactcgctcggtat

SEQ ID NO: 453315 - DNA, 25 bp, Rattus norvegicus
cgtgcgtcgctaccctcgagcagag

SEQ ID NO: 453316 - DNA, 25 bp, Rattus norvegicus
gatgaacgcctcatggaagccgttg

SEQ ID NO: 453317 - DNA, 25 bp, Rattus norvegicus
gggcggtctcccttatacgatgata

SEQ ID NO: 453318 - DNA, 25 bp, Rattus norvegicus
caatttggatttgaagggcggtctc

SEQ ID NO: 453319 - DNA, 25 bp, Rattus norvegicus
cccacgtctgttgctggagaagaga

SEQ ID NO: 453320 - DNA, 25 bp, Rattus norvegicus
agtcatcctgatggcgtgggttaaa

SEQ ID NO: 453321 - DNA, 25 bp, Rattus norvegicus
ggggagcgatcagaactaaccgtgc

SEQ ID NO: 453322 - DNA, 25 bp, Rattus norvegicus
agctcgggctggaccattctatcga

SEQ ID NO: 453323 - DNA, 25 bp, Rattus norvegicus
ggcgaagcggcccagtatttataga

SEQ ID NO: 453324 - DNA, 25 bp, Rattus norvegicus
ctgcagcgatgagagaaggcgactc

SEQ ID NO: 453325 - DNA, 25 bp, Rattus norvegicus
cggggacacacattgcaaactcgca

SEQ ID NO: 453326 - DNA, 25 bp, Rattus norvegicus
gcccttctagatttctggaaccttc

SEQ ID NO: 453327 - DNA, 25 bp, Rattus norvegicus
cgatgatatggtacgtcccttccga

SEQ ID NO: 453328 - DNA, 25 bp, Rattus norvegicus
gagggtcgcttcaactctcagcagg

SEQ ID NO: 453329 - DNA, 25 bp, Rattus norvegicus
ccactagaggtttttccagacgacg

SEQ ID NO: 453330 - DNA, 25 bp, Rattus norvegicus
gatcagctcgtcgttcgctccgagg

SEQ ID NO: 453331 - DNA, 25 bp, Rattus norvegicus
gccacacaggccatggtgacccgta

SEQ ID NO: 453332 - DNA, 25 bp, Rattus norvegicus
caaagttttgacagggcgtggctcc

SEQ ID NO: 453333 - DNA, 25 bp, Rattus norvegicus
tacgcaggtcccttaaagaaagcgc

SEQ ID NO: 453334 - DNA, 25 bp, Rattus norvegicus
gggcaagaaacgctcggctccggat

SEQ ID NO: 453335 - DNA, 25 bp, Rattus norvegicus
cgttgaccagggacgacttgacctc

SEQ ID NO: 453336 - DNA, 25 bp, Rattus norvegicus
ctgctctgattctccgattcgttga

SEQ ID NO: 453337 - DNA, 25 bp, Rattus norvegicus
tcccgcagtacggaacctagggctc

SEQ ID NO: 453338 - DNA, 25 bp, Rattus norvegicus
ctcggagtccgagctactgctctga

SEQ ID NO: 453339 - DNA, 25 bp, Rattus norvegicus
caggggctgaccctaggaatccctt

SEQ ID NO: 453340 - DNA, 25 bp, Rattus norvegicus
ttcggcgaaatagtcgcgcggcttc

SEQ ID NO: 453341 - DNA, 25 bp, Rattus norvegicus
ggtgacccgtatggccaatagctga

SEQ ID NO: 453342 - DNA, 25 bp, Rattus norvegicus
ttctcactgcggacaaaaccaaagt

SEQ ID NO: 453343 - DNA, 25 bp, Rattus norvegicus
atcgtttggccgctgcagcgacaaa

SEQ ID NO: 453344 - DNA, 25 bp, Rattus norvegicus
ccgggagcaagttccgctctggcga

SEQ ID NO: 453345 - DNA, 25 bp, Rattus norvegicus
cgcgccgaggcctacccgcgaggcc

SEQ ID NO: 453346 - DNA, 25 bp, Rattus norvegicus
cttggcttacccgagcccagggacg

SEQ ID NO: 453347 - DNA, 25 bp, Rattus norvegicus
tgaccgagcagagagtttgctcgcc

SEQ ID NO: 453348 - DNA, 25 bp, Rattus norvegicus
tccgctctggcgaggtgaccgagca

SEQ ID NO: 453349 - DNA, 25 bp, Rattus norvegicus
ttccgctctggcgaggtgaccgagc

SEQ ID NO: 453350 - DNA, 25 bp, Rattus norvegicus
ccggccgggagcaagttccgctctg

SEQ ID NO: 453351 - DNA, 25 bp, Rattus norvegicus
aagcctgcttcggtgggcagcgcac

SEQ ID NO: 453352 - DNA, 25 bp, Rattus norvegicus
ctgtaagcctgcttcggtgggcagc

SEQ ID NO: 453353 - DNA, 25 bp, Rattus norvegicus
gactgtaagcctgcttcggtgggca

SEQ ID NO: 453354 - DNA, 25 bp, Rattus norvegicus
ccgactgtaagcctgcttcggtggg

SEQ ID NO: 453355 - DNA, 25 bp, Rattus norvegicus
agcagagagtttgctcgccgcggct

SEQ ID NO: 453356 - DNA, 25 bp, Rattus norvegicus
cgaggccgggcgagctccagtcacc

SEQ ID NO: 453357 - DNA, 25 bp, Rattus norvegicus
aggtgaccgagcagagagtttgctc

SEQ ID NO: 453358 - DNA, 25 bp, Rattus norvegicus
ggacgaggacacgaaacgcccctga

SEQ ID NO: 453359 - DNA, 25 bp, Rattus norvegicus
cgctgtctcgcagcacccgagccca

SEQ ID NO: 453360 - DNA, 25 bp, Rattus norvegicus
gaaacgcccctgaggtggctcccta

SEQ ID NO: 453361 - DNA, 25 bp, Rattus norvegicus
ctccctagcgcctgggcgcgtggct

SEQ ID NO: 453362 - DNA, 25 bp, Rattus norvegicus
gcgcgtggctgccaggccatcgcag

SEQ ID NO: 453363 - DNA, 25 bp, Rattus norvegicus
catcgcagacctcccggggacgtgt

SEQ ID NO: 453364 - DNA, 25 bp, Rattus norvegicus
gtgtttgtgtgctgctttgaaagcc

SEQ ID NO: 453365 - DNA, 25 bp, Rattus norvegicus
cgggactcctccggggctctcgtgt

SEQ ID NO: 453366 - DNA, 25 bp, Rattus norvegicus
gggctctcgtgtccccagatctacg

SEQ ID NO: 453367 - DNA, 25 bp, Rattus norvegicus
cagatctacgggagatcgaggccta

SEQ ID NO: 453368 - DNA, 25 bp, Rattus norvegicus
tctacgggagatcgaggcctagcga

SEQ ID NO: 453369 - DNA, 25 bp, Rattus norvegicus
agatcgaggcctagcgagccggctc

SEQ ID NO: 453370 - DNA, 25 bp, Rattus norvegicus
ggccgccacccgctccaatgcgctg

SEQ ID NO: 453371 - DNA, 25 bp, Rattus norvegicus
gctgctttgaaagccggggatccag

SEQ ID NO: 453372 - DNA, 25 bp, Rattus norvegicus
tatcccgctacgatcccgcgttggg

SEQ ID NO: 453373 - DNA, 25 bp, Rattus norvegicus
cgcgaacgcctctcgacgtggcgtt

SEQ ID NO: 453374 - DNA, 25 bp, Rattus norvegicus
gaggatccgggactcgtctaccaca

SEQ ID NO: 453375 - DNA, 25 bp, Rattus norvegicus
cagaatgttccaaaccgtcgggtcg

SEQ ID NO: 453376 - DNA, 25 bp, Rattus norvegicus
cgtcgggtcgcctgttgcaacccag

SEQ ID NO: 453377 - DNA, 25 bp, Rattus norvegicus
gctgcaaccctgctcgcgggagaca

SEQ ID NO: 453378 - DNA, 25 bp, Rattus norvegicus
tgtgcctcaccgtggattctcgttc

SEQ ID NO: 453379 - DNA, 25 bp, Rattus norvegicus
tcgttccgagctcgcgctccaggta

SEQ ID NO: 453380 - DNA, 25 bp, Rattus norvegicus
ggtactcccactcgcgttgctgcag

SEQ ID NO: 453381 - DNA, 25 bp, Rattus norvegicus
cctgatgcatctccttctcctagta

SEQ ID NO: 453382 - DNA, 25 bp, Rattus norvegicus
caagagacaaaagagcggcgcccgc

SEQ ID NO: 453383 - DNA, 25 bp, Rattus norvegicus
agctacccgtggtctcttttcctga

SEQ ID NO: 453384 - DNA, 25 bp, Rattus norvegicus
ctgctgctcacctcgcgggaaaggc

SEQ ID NO: 453385 - DNA, 25 bp, Rattus norvegicus
ctcgcgttgctgcagcaagagacaa

SEQ ID NO: 453386 - DNA, 25 bp, Rattus norvegicus
tgcaaccatggtctccggcagcagc

SEQ ID NO: 453387 - DNA, 25 bp, Rattus norvegicus
gcggctgccactgcaaccatggtct

SEQ ID NO: 453388 - DNA, 25 bp, Rattus norvegicus
cctgcggtgcccaggctcttccggg

SEQ ID NO: 453389 - DNA, 25 bp, Rattus norvegicus
ccgcccgcctgctgtcgcgcacctt

SEQ ID NO: 453390 - DNA, 25 bp, Rattus norvegicus
tcgcgcaccttcctccgtgagtcgt

SEQ ID NO: 453391 - DNA, 25 bp, Rattus norvegicus
cttcctccgtgagtcgtgccggcgg

SEQ ID NO: 453392 - DNA, 25 bp, Rattus norvegicus
gtgccggcggggctctgtcttccat

SEQ ID NO: 453393 - DNA, 25 bp, Rattus norvegicus
tctgtcttccatgcttccgtaggcc

SEQ ID NO: 453394 - DNA, 25 bp, Rattus norvegicus
cagcggtagttgctgcggctgccac

SEQ ID NO: 453395 - DNA, 25 bp, Rattus norvegicus
gtcttccatgcttccgtaggcctcg

SEQ ID NO: 453396 - DNA, 25 bp, Rattus norvegicus
ttccatgcttccgtaggcctcgggc

SEQ ID NO: 453397 - DNA, 25 bp, Rattus norvegicus
ttccgtaggcctcgggctccaggtc

SEQ ID NO: 453398 - DNA, 25 bp, Rattus norvegicus
gggctctgtcttccatgcttccgta

SEQ ID NO: 453399 - DNA, 25 bp, Rattus norvegicus
gttgctgcggctgccactgcaacca

SEQ ID NO: 453400 - DNA, 25 bp, Rattus norvegicus
aggctcgcacacactcctcagagga

SEQ ID NO: 453401 - DNA, 25 bp, Rattus norvegicus
agcgcagcagcaaagtgagacattg

SEQ ID NO: 453402 - DNA, 25 bp, Rattus norvegicus
ttgcgggtcctagaagtcgcctcct

SEQ ID NO: 453403 - DNA, 25 bp, Rattus norvegicus
ccggcacgtagttgggaaacttgcg

SEQ ID NO: 453404 - DNA, 25 bp, Rattus norvegicus
actgtcaaatcctggggagtctcga

SEQ ID NO: 453405 - DNA, 25 bp, Rattus norvegicus
tgccgatgacattctccagactgtc

SEQ ID NO: 453406 - DNA, 25 bp, Rattus norvegicus
ggactccaaggtggctgcgattcgc

SEQ ID NO: 453407 - DNA, 25 bp, Rattus norvegicus
caggcgttttccaactgggactcca

SEQ ID NO: 453408 - DNA, 25 bp, Rattus norvegicus
agcaaagcatgagccggccaggttt

SEQ ID NO: 453409 - DNA, 25 bp, Rattus norvegicus
cgcgagcagcttacgacactcagtg

SEQ ID NO: 453410 - DNA, 25 bp, Rattus norvegicus
acattgtgcgtctgccagatcctcg

SEQ ID NO: 453411 - DNA, 25 bp, Rattus norvegicus
acactcagtgagcagtcggtgccgg

SEQ ID NO: 453412 - DNA, 25 bp, Rattus norvegicus
ccgggacacgaatggcaggcgtttt

SEQ ID NO: 453413 - DNA, 25 bp, Rattus norvegicus
tgctcggagaagacgcacaatcgcg

SEQ ID NO: 453414 - DNA, 25 bp, Rattus norvegicus
gcgcaactctttcgccggcttgttc

SEQ ID NO: 453415 - DNA, 25 bp, Rattus norvegicus
ctgggcttgtctttgcgctacaaca

SEQ ID NO: 453416 - DNA, 25 bp, Rattus norvegicus
cgctggccagttcacagggttaatg

SEQ ID NO: 453417 - DNA, 25 bp, Rattus norvegicus
ctcacgtggctgtatttggatcaca

SEQ ID NO: 453418 - DNA, 25 bp, Rattus norvegicus
gcctttcagaaactgcgccgagtta

SEQ ID NO: 453419 - DNA, 25 bp, Rattus norvegicus
gccattcaattcgtgccggtgcgca

SEQ ID NO: 453420 - DNA, 25 bp, Rattus norvegicus
cgcagcctcaagtttctcgacattg

SEQ ID NO: 453421 - DNA, 25 bp, Rattus norvegicus
tcctggaagtcccttacgagcatca

SEQ ID NO: 453422 - DNA, 25 bp, Rattus norvegicus
cacctggagcataacgacttgatca

SEQ ID NO: 453423 - DNA, 25 bp, Rattus norvegicus
ccatgtgttcgagaccgtgccgtac

SEQ ID NO: 453424 - DNA, 25 bp, Rattus norvegicus
cgtacctgcagtccctacagctgga

SEQ ID NO: 453425 - DNA, 25 bp, Rattus norvegicus
gagcatcactctagccgggaacctg

SEQ ID NO: 453426 - DNA, 25 bp, Rattus norvegicus
ccggtgcgcatctttcaggactgcc

SEQ ID NO: 453427 - DNA, 25 bp, Rattus norvegicus
ggctcagcaacttccagggacgtta

SEQ ID NO: 453428 - DNA, 25 bp, Rattus norvegicus
acggaatgacagaagcgactggaga

SEQ ID NO: 453429 - DNA, 25 bp, Rattus norvegicus
ctcgtcctctgtctgcagcagctgg

SEQ ID NO: 453430 - DNA, 25 bp, Rattus norvegicus
tcctctgtctgcagcagctggcacg

SEQ ID NO: 453431 - DNA, 25 bp, Rattus norvegicus
tggcacggaatgacagaagcgactg

SEQ ID NO: 453432 - DNA, 25 bp, Rattus norvegicus
ccgggtctccgcctcactcagggct

SEQ ID NO: 453433 - DNA, 25 bp, Rattus norvegicus
tcactcagggctgccagcaaagccg

SEQ ID NO: 453434 - DNA, 25 bp, Rattus norvegicus
actcagggctgccagcaaagccgct

SEQ ID NO: 453435 - DNA, 25 bp, Rattus norvegicus
ccgcgtcctgcccaagcgagcggca

SEQ ID NO: 453436 - DNA, 25 bp, Rattus norvegicus
cacgcgcggccgctcacttgctggc

SEQ ID NO: 453437 - DNA, 25 bp, Rattus norvegicus
ttgctggctcctttgctcgtgcccg

SEQ ID NO: 453438 - DNA, 25 bp, Rattus norvegicus
gactcggccgggctagcaaagaatg

SEQ ID NO: 453439 - DNA, 25 bp, Rattus norvegicus
cggccgggctagcaaagaatgagca

SEQ ID NO: 453440 - DNA, 25 bp, Rattus norvegicus
tagcaaagaatgagcacgcgggcgc

SEQ ID NO: 453441 - DNA, 25 bp, Rattus norvegicus
tctgcagcagctggcacggaatgac

SEQ ID NO: 453442 - DNA, 25 bp, Rattus norvegicus
ttggccgtggagcatgtgctcacta

SEQ ID NO: 453443 - DNA, 25 bp, Rattus norvegicus
gtgctcactaccatgacggcgctcg

SEQ ID NO: 453444 - DNA, 25 bp, Rattus norvegicus
catctatgatgaggacgtgttggcc

SEQ ID NO: 453445 - DNA, 25 bp, Rattus norvegicus
gcgctgctagtcctcaccatctatg

SEQ ID NO: 453446 - DNA, 25 bp, Rattus norvegicus
agctggtcttcttctccggtgcgct

SEQ ID NO: 453447 - DNA, 25 bp, Rattus norvegicus
ctttaacgagctgccgcacgagctg

SEQ ID NO: 453448 - DNA, 25 bp, Rattus norvegicus
ctgcagttgcgccactttaacgagc

SEQ ID NO: 453449 - DNA, 25 bp, Rattus norvegicus
ttcccgaagcctacaagcgcagcga

SEQ ID NO: 453450 - DNA, 25 bp, Rattus norvegicus
gctcaacgtggacttgctgctcttc

SEQ ID NO: 453451 - DNA, 25 bp, Rattus norvegicus
cagtgctgccttccttagtcgcggc

SEQ ID NO: 453452 - DNA, 25 bp, Rattus norvegicus
tggccaacaagggtctgctgcctgc

SEQ ID NO: 453453 - DNA, 25 bp, Rattus norvegicus
ctgcgctacaccaactaccaggtgg

SEQ ID NO: 453454 - DNA, 25 bp, Rattus norvegicus
cgctgaccgaactggatgtccatca

SEQ ID NO: 453455 - DNA, 25 bp, Rattus norvegicus
tggcaggtactgcacgccttctaca

SEQ ID NO: 453456 - DNA, 25 bp, Rattus norvegicus
tcatgctgcttctgccgggttgggc

SEQ ID NO: 453457 - DNA, 25 bp, Rattus norvegicus
cttcatgctgcttctgccgggttgg

SEQ ID NO: 453458 - DNA, 25 bp, Rattus norvegicus
gctgggcgtggcttcatgctgcttc

SEQ ID NO: 453459 - DNA, 25 bp, Rattus norvegicus
tctcggctgggcgtggcttcatgct

SEQ ID NO: 453460 - DNA, 25 bp, Rattus norvegicus
ctcctttgtagcgtctcggctgggc

SEQ ID NO: 453461 - DNA, 25 bp, Rattus norvegicus
cgcctcctttgtagcgtctcggctg

SEQ ID NO: 453462 - DNA, 25 bp, Rattus norvegicus
gagttttgtggtggcctccgcctcc

SEQ ID NO: 453463 - DNA, 25 bp, Rattus norvegicus
gagcatgggagcgtgggagttttgt

SEQ ID NO: 453464 - DNA, 25 bp, Rattus norvegicus
cccgcagctactgcgtggggagcat

SEQ ID NO: 453465 - DNA, 25 bp, Rattus norvegicus
gaccaatcaggatgcaggatggctg

SEQ ID NO: 453466 - DNA, 25 bp, Rattus norvegicus
ctgaccaatcaggatgcaggatggc

SEQ ID NO: 453467 - DNA, 25 bp, Rattus norvegicus
aggctgtcagtgctcccgggctggt

SEQ ID NO: 453468 - DNA, 25 bp, Rattus norvegicus
gccgcctcgggagtacgctgaccaa

SEQ ID NO: 453469 - DNA, 25 bp, Rattus norvegicus
gcctcgggagtacgctgaccaatca

SEQ ID NO: 453470 - DNA, 25 bp, Rattus norvegicus
cgggcgattgcgcacgcgccgaaca

SEQ ID NO: 453471 - DNA, 25 bp, Rattus norvegicus
ggaaatctcccaggcacgcatgcgc

SEQ ID NO: 453472 - DNA, 25 bp, Rattus norvegicus
ggcgccaggtcgattccagcgatag

SEQ ID NO: 453473 - DNA, 25 bp, Rattus norvegicus
ctcaggcctcagaggactttcaggc

SEQ ID NO: 453474 - DNA, 25 bp, Rattus norvegicus
cttggaacatggcactcaggcctca

SEQ ID NO: 453475 - DNA, 25 bp, Rattus norvegicus
agacacgccaatcctgcttggaaca

SEQ ID NO: 453476 - DNA, 25 bp, Rattus norvegicus
acgcgccgaacaccaagccttagga

SEQ ID NO: 453477 - DNA, 25 bp, Rattus norvegicus
tccagcgatagcgatagcgacggca

SEQ ID NO: 453478 - DNA, 25 bp, Rattus norvegicus
atagcgatagcgacggcacgaagga

SEQ ID NO: 453479 - DNA, 25 bp, Rattus norvegicus
caggccgtctgcaggcggccgaaca

SEQ ID NO: 453480 - DNA, 25 bp, Rattus norvegicus
tgggaagggctcagttcctcaggtc

SEQ ID NO: 453481 - DNA, 25 bp, Rattus norvegicus
tcaggtctccagctctaaaggtctc

SEQ ID NO: 453482 - DNA, 25 bp, Rattus norvegicus
ctctaaaggtctctgtggccgtgcg

SEQ ID NO: 453483 - DNA, 25 bp, Rattus norvegicus
ccaagccttaggagacacgccaatc

SEQ ID NO: 453484 - DNA, 25 bp, Rattus norvegicus
tgtgcgcacgcccatgcagcaagag

SEQ ID NO: 453485 - DNA, 25 bp, Rattus norvegicus
ctcggatggcccagtgctctgaaac

SEQ ID NO: 453486 - DNA, 25 bp, Rattus norvegicus
tccacaatgacaggtttcggcggcg

SEQ ID NO: 453487 - DNA, 25 bp, Rattus norvegicus
ctctgaaaccgacttgggcccgtgt

SEQ ID NO: 453488 - DNA, 25 bp, Rattus norvegicus
cacggcaggcatcagacgcgagagc

SEQ ID NO: 453489 - DNA, 25 bp, Rattus norvegicus
gcagcaagccgtggcctggccattc

SEQ ID NO: 453490 - DNA, 25 bp, Rattus norvegicus
ggcgccggtccacaatgacaggttt

SEQ ID NO: 453491 - DNA, 25 bp, Rattus norvegicus
ggtatcaaagtgtgcgcacgcccat

SEQ ID NO: 453492 - DNA, 25 bp, Rattus norvegicus
tccagctacaaagcgggtatcaaag

SEQ ID NO: 453493 - DNA, 25 bp, Rattus norvegicus
cctgatttcgtgaagtccagctaca

SEQ ID NO: 453494 - DNA, 25 bp, Rattus norvegicus
aagggcagacacgaaacctgatttc

SEQ ID NO: 453495 - DNA, 25 bp, Rattus norvegicus
tcgggatctagagaagggcagacac

SEQ ID NO: 453496 - DNA, 25 bp, Rattus norvegicus
ccaagcctacgtccttcgggatcta

SEQ ID NO: 453497 - DNA, 25 bp, Rattus norvegicus
catcagacgcgagagcagcaagccg

SEQ ID NO: 453498 - DNA, 25 bp, Rattus norvegicus
gggcgccaggacaccctaattctgc

SEQ ID NO: 453499 - DNA, 25 bp, Rattus norvegicus
ccacagggcgcagcagcacgttgct

SEQ ID NO: 453500 - DNA, 25 bp, Rattus norvegicus
agcgggaactctagtgctcttcgga

SEQ ID NO: 453501 - DNA, 25 bp, Rattus norvegicus
tgcgcgtcccttgctcagtcttgac

SEQ ID NO: 453502 - DNA, 25 bp, Rattus norvegicus
actctagtgctcttcggatccgaaa

SEQ ID NO: 453503 - DNA, 25 bp, Rattus norvegicus
tgttttcccgaagcgcgctcagggc

SEQ ID NO: 453504 - DNA, 25 bp, Rattus norvegicus
aggtaagctgttttcccgaagcgcg

SEQ ID NO: 453505 - DNA, 25 bp, Rattus norvegicus
cttcggatccgaaaccaccgctttg

SEQ ID NO: 453506 - DNA, 25 bp, Rattus norvegicus
cggcggtcccagaaaaggtaagctg

SEQ ID NO: 453507 - DNA, 25 bp, Rattus norvegicus
aggtgatctgatctactccaggccc

SEQ ID NO: 453508 - DNA, 25 bp, Rattus norvegicus
gcccttccctaggtgatctgatcta

SEQ ID NO: 453509 - DNA, 25 bp, Rattus norvegicus
agcacgttgctgtgcccttccctag

SEQ ID NO: 453510 - DNA, 25 bp, Rattus norvegicus
tcccttgctcagtcttgactgggga

SEQ ID NO: 453511 - DNA, 25 bp, Rattus norvegicus
ccctaattctgctgagcgggaactc

SEQ ID NO: 453512 - DNA, 25 bp, Rattus norvegicus
cgcagacaccgtcgcttcgagagga

SEQ ID NO: 453513 - DNA, 25 bp, Rattus norvegicus
aacgtgttcacgtctgcagaggagc

SEQ ID NO: 453514 - DNA, 25 bp, Rattus norvegicus
ctttgaacaagaacgtgttcacgtc

SEQ ID NO: 453515 - DNA, 25 bp, Rattus norvegicus
tcgagaggactttgaacaagaacgt

SEQ ID NO: 453516 - DNA, 25 bp, Rattus norvegicus
ccgtcgcttcgagaggactttgaac

SEQ ID NO: 453517 - DNA, 25 bp, Rattus norvegicus
acaccgtcgcttcgagaggactttg

SEQ ID NO: 453518 - DNA, 25 bp, Rattus norvegicus
tctcggtgcgcagacaccgtcgctt

SEQ ID NO: 453519 - DNA, 25 bp, Rattus norvegicus
aggacacagcctcggacctctcggt

SEQ ID NO: 453520 - DNA, 25 bp, Rattus norvegicus
aggatggtagtgaggacacagcctc

SEQ ID NO: 453521 - DNA, 25 bp, Rattus norvegicus
caggaccacgagagcagcagtgaca

SEQ ID NO: 453522 - DNA, 25 bp, Rattus norvegicus
aggtgcttgcaggaccacgagagca

SEQ ID NO: 453523 - DNA, 25 bp, Rattus norvegicus
agcctcggacctctcggtgcgcaga

SEQ ID NO: 453524 - DNA, 25 bp, Rattus norvegicus
cgcacagcggttggaggagcgcgaa

SEQ ID NO: 453525 - DNA, 25 bp, Rattus norvegicus
tagtgaggacacagcctcggacctc

SEQ ID NO: 453526 - DNA, 25 bp, Rattus norvegicus
cgcgatcgctgtctgagcgcgcaca

SEQ ID NO: 453527 - DNA, 25 bp, Rattus norvegicus
ggctccggcttctgatgttgccttc

SEQ ID NO: 453528 - DNA, 25 bp, Rattus norvegicus
cctaaacgtgctgcgcgcgatcgct

SEQ ID NO: 453529 - DNA, 25 bp, Rattus norvegicus
cacgcgccaggataaagatggcttc

SEQ ID NO: 453530 - DNA, 25 bp, Rattus norvegicus
aagatggcttcctgtcccgccagcg

SEQ ID NO: 453531 - DNA, 25 bp, Rattus norvegicus
tcccgccagcgttacgtcagggtct

SEQ ID NO: 453532 - DNA, 25 bp, Rattus norvegicus
acgtcagggtctgccttcaccaagg

SEQ ID NO: 453533 - DNA, 25 bp, Rattus norvegicus
ccaaggcctttactctcgccagagg

SEQ ID NO: 453534 - DNA, 25 bp, Rattus norvegicus
tttactctcgccagaggcagcctcg

SEQ ID NO: 453535 - DNA, 25 bp, Rattus norvegicus
ccagaggcagcctcgaaaggcgagc

SEQ ID NO: 453536 - DNA, 25 bp, Rattus norvegicus
ccaccgggtgcattcgtcggggctt

SEQ ID NO: 453537 - DNA, 25 bp, Rattus norvegicus
ttgggcctgcgaagctgctgcctcc

SEQ ID NO: 453538 - DNA, 25 bp, Rattus norvegicus
gctgagccggaagtccggatgcttc

SEQ ID NO: 453539 - DNA, 25 bp, Rattus norvegicus
tgagcgcgcacacgagattccggcc

SEQ ID NO: 453540 - DNA, 25 bp, Rattus norvegicus
tccttccggaactcgggctgcagaa

SEQ ID NO: 453541 - DNA, 25 bp, Rattus norvegicus
tcgggtctcctaagcgggataactc

SEQ ID NO: 453542 - DNA, 25 bp, Rattus norvegicus
cgggcgatcgcaccttatcagagtc

SEQ ID NO: 453543 - DNA, 25 bp, Rattus norvegicus
tgacagttctgttcctctcgggcga

SEQ ID NO: 453544 - DNA, 25 bp, Rattus norvegicus
cacgggatccgtaaggctcaacttc

SEQ ID NO: 453545 - DNA, 25 bp, Rattus norvegicus
ccgaccggtctagttgctcagcgtc

SEQ ID NO: 453546 - DNA, 25 bp, Rattus norvegicus
tccaggagccacacaaagaagctta

SEQ ID NO: 453547 - DNA, 25 bp, Rattus norvegicus
gcagttcgaccgctttgaaaccagg

SEQ ID NO: 453548 - DNA, 25 bp, Rattus norvegicus
ctccgtgaataagcaggcgatcata

SEQ ID NO: 453549 - DNA, 25 bp, Rattus norvegicus
gccgacttaccttctgcacttggtt

SEQ ID NO: 453550 - DNA, 25 bp, Rattus norvegicus
caacttggtccgaagcgagccagca

SEQ ID NO: 453551 - DNA, 25 bp, Rattus norvegicus
caggtcctctgcgtgctccagattc

SEQ ID NO: 453552 - DNA, 25 bp, Rattus norvegicus
aggactttcccagctactcagactg

SEQ ID NO: 453553 - DNA, 25 bp, Rattus norvegicus
tagcctgtggtgtcctgagactcta

SEQ ID NO: 453554 - DNA, 25 bp, Rattus norvegicus
gcctctacttagtaccgctactgcg

SEQ ID NO: 453555 - DNA, 25 bp, Rattus norvegicus
ccctcggccgagctcggcctgcagc

SEQ ID NO: 453556 - DNA, 25 bp, Rattus norvegicus
agtaccgctactgcgcgggcctcgg

SEQ ID NO: 453557 - DNA, 25 bp, Rattus norvegicus
tacttagtaccgctactgcgcgggc

SEQ ID NO: 453558 - DNA, 25 bp, Rattus norvegicus
cacaccggggcgcttagtatcgcca

SEQ ID NO: 453559 - DNA, 25 bp, Rattus norvegicus
ttagtaccgctactgcgcgggcctc

SEQ ID NO: 453560 - DNA, 25 bp, Rattus norvegicus
cagcagcctctacttagtaccgcta

SEQ ID NO: 453561 - DNA, 25 bp, Rattus norvegicus
ggcagcgaggttctgggcactgagc

SEQ ID NO: 453562 - DNA, 25 bp, Rattus norvegicus
accggggcgcttagtatcgccagca

SEQ ID NO: 453563 - DNA, 25 bp, Rattus norvegicus
ggcgcttagtatcgccagcagcagc

SEQ ID NO: 453564 - DNA, 25 bp, Rattus norvegicus
tcggccctggcaagcatctctggct

SEQ ID NO: 453565 - DNA, 25 bp, Rattus norvegicus
tggcaagcatctctggctccgcctg

SEQ ID NO: 453566 - DNA, 25 bp, Rattus norvegicus
gcgtccagcagcctctacttagtac

SEQ ID NO: 453567 - DNA, 25 bp, Rattus norvegicus
gtccagcagcctctacttagtaccg

SEQ ID NO: 453568 - DNA, 25 bp, Rattus norvegicus
cacagtggcactactcagggaagtc

SEQ ID NO: 453569 - DNA, 25 bp, Rattus norvegicus
ctagtccaggggagttttgccatcc

SEQ ID NO: 453570 - DNA, 25 bp, Rattus norvegicus
ccgtccatggccaaggcgattcctt

SEQ ID NO: 453571 - DNA, 25 bp, Rattus norvegicus
ctctgcagaaaaagcggaccctcca

SEQ ID NO: 453572 - DNA, 25 bp, Rattus norvegicus
gtcccgaagcgctgactctgcagaa

SEQ ID NO: 453573 - DNA, 25 bp, Rattus norvegicus
gggagcctttatctcaccgcacgca

SEQ ID NO: 453574 - DNA, 25 bp, Rattus norvegicus
tcttaggggctctacgattgctcgc

SEQ ID NO: 453575 - DNA, 25 bp, Rattus norvegicus
ggcacagcccgagactttcaaggga

SEQ ID NO: 453576 - DNA, 25 bp, Rattus norvegicus
aatccgcaccaaggagggcacagcc

SEQ ID NO: 453577 - DNA, 25 bp, Rattus norvegicus
tcccaggctgggctactttcccaaa

SEQ ID NO: 453578 - DNA, 25 bp, Rattus norvegicus
cagccaggcgtatcatcttgcagtc

SEQ ID NO: 453579 - DNA, 25 bp, Rattus norvegicus
aagagacccacgcaggccgatctga

SEQ ID NO: 453580 - DNA, 25 bp, Rattus norvegicus
tgggtaaagcacagcccaagttttc

SEQ ID NO: 453581 - DNA, 25 bp, Rattus norvegicus
tcttgcagtctagacggcgagagcc

SEQ ID NO: 453582 - DNA, 25 bp, Rattus norvegicus
ggcctggctcaagaccgcacagtca

SEQ ID NO: 453583 - DNA, 25 bp, Rattus norvegicus
ccacagtcagtcgtacccagagatc

SEQ ID NO: 453584 - DNA, 25 bp, Rattus norvegicus
gtcccagacgtcagatttgcccgtg

SEQ ID NO: 453585 - DNA, 25 bp, Rattus norvegicus
ggctccacgtcttcctggtcagctg

SEQ ID NO: 453586 - DNA, 25 bp, Rattus norvegicus
cggctctttgactcgcaccggtaag

SEQ ID NO: 453587 - DNA, 25 bp, Rattus norvegicus
ccactttcctgaagcggctgcgatg

SEQ ID NO: 453588 - DNA, 25 bp, Rattus norvegicus
gcatgctgggaacgctagcccttcc

SEQ ID NO: 453589 - DNA, 25 bp, Rattus norvegicus
ggcatgccggtatccttacagtgta

SEQ ID NO: 453590 - DNA, 25 bp, Rattus norvegicus
tcctggtcactagagcctggagtcc

SEQ ID NO: 453591 - DNA, 25 bp, Rattus norvegicus
ccgtctaggagaagcaaggcatgcc

SEQ ID NO: 453592 - DNA, 25 bp, Rattus norvegicus
cttctggagcccagcaagccgtcta

SEQ ID NO: 453593 - DNA, 25 bp, Rattus norvegicus
gttcctgacgtcagcagagcccgga

SEQ ID NO: 453594 - DNA, 25 bp, Rattus norvegicus
tcccataagtcatccgggcctgagg

SEQ ID NO: 453595 - DNA, 25 bp, Rattus norvegicus
agacgcgctctctagaccgtacaca

SEQ ID NO: 453596 - DNA, 25 bp, Rattus norvegicus
acggcacccagtcacgatggcgttc

SEQ ID NO: 453597 - DNA, 25 bp, Rattus norvegicus
agcgcgtcttgctgcaggtgcagca

SEQ ID NO: 453598 - DNA, 25 bp, Rattus norvegicus
ttctgcagcgcgaagagtgacgagt

SEQ ID NO: 453599 - DNA, 25 bp, Rattus norvegicus
cccaaggctgtagattctgcagcgc

SEQ ID NO: 453600 - DNA, 25 bp, Rattus norvegicus
tcggcccaaggctgtagattctgca

SEQ ID NO: 453601 - DNA, 25 bp, Rattus norvegicus
ccttgttgtcctcggcccaaggctg

SEQ ID NO: 453602 - DNA, 25 bp, Rattus norvegicus
gcgtagctcacaccaccgaggcgag

SEQ ID NO: 453603 - DNA, 25 bp, Rattus norvegicus
atcgggcaggcgtagctcacaccac

SEQ ID NO: 453604 - DNA, 25 bp, Rattus norvegicus
cgacccgcgcgatgccgctcggcct

SEQ ID NO: 453605 - DNA, 25 bp, Rattus norvegicus
acccagtcacgatggcgttcgctca

SEQ ID NO: 453606 - DNA, 25 bp, Rattus norvegicus
cttcgctggtggcacggcacccagt

SEQ ID NO: 453607 - DNA, 25 bp, Rattus norvegicus
tgtcctcggcccaaggctgtagatt

SEQ ID NO: 453608 - DNA, 25 bp, Rattus norvegicus
tcgctcatcgggcaggcgtagctca

SEQ ID NO: 453609 - DNA, 25 bp, Rattus norvegicus
cccgacactgaagccaccttgttgt

SEQ ID NO: 453610 - DNA, 25 bp, Rattus norvegicus
tgccagggacgcattcttcaacagc

SEQ ID NO: 453611 - DNA, 25 bp, Rattus norvegicus
tacgccgactccgtaccgaagtcta

SEQ ID NO: 453612 - DNA, 25 bp, Rattus norvegicus
ccgtaccgaagtctagaaactgctt

SEQ ID NO: 453613 - DNA, 25 bp, Rattus norvegicus
acggggagaacttgctgaagtgctc

SEQ ID NO: 453614 - DNA, 25 bp, Rattus norvegicus
aagtgctcgatgtacttgggcgccc

SEQ ID NO: 453615 - DNA, 25 bp, Rattus norvegicus
acgcattcttcaacagcgcccggaa

SEQ ID NO: 453616 - DNA, 25 bp, Rattus norvegicus
aagcacagccgggagaccagcttcg

SEQ ID NO: 453617 - DNA, 25 bp, Rattus norvegicus
gcggtgcctccaacgtctagccaat

SEQ ID NO: 453618 - DNA, 25 bp, Rattus norvegicus
cgtctagccaatcggcttgtcccgg

SEQ ID NO: 453619 - DNA, 25 bp, Rattus norvegicus
cgtcgccaatggtcgcgcacaaaca

SEQ ID NO: 453620 - DNA, 25 bp, Rattus norvegicus
gtcgcgcacaaacaactccaggaga

SEQ ID NO: 453621 - DNA, 25 bp, Rattus norvegicus
aactccaggagagccaatagccttg

SEQ ID NO: 453622 - DNA, 25 bp, Rattus norvegicus
aatagccttgcgcttcgacacgtgg

SEQ ID NO: 453623 - DNA, 25 bp, Rattus norvegicus
gaaccagcgcatggcgacgacgcct

SEQ ID NO: 453624 - DNA, 25 bp, Rattus norvegicus
aacatgtgtccttgctcgaggcaca

SEQ ID NO: 453625 - DNA, 25 bp, Rattus norvegicus
tgacatcaccgcagacaaacatgtg

SEQ ID NO: 453626 - DNA, 25 bp, Rattus norvegicus
tcgtcacctcctgggtgcgcaatgt

SEQ ID NO: 453627 - DNA, 25 bp, Rattus norvegicus
tgcgcaatgtgagtccgaaaatgtc

SEQ ID NO: 453628 - DNA, 25 bp, Rattus norvegicus
aatgtcctcgtggtagcgttgctga

SEQ ID NO: 453629 - DNA, 25 bp, Rattus norvegicus
cgttgctgatcctgcggggagaaaa

SEQ ID NO: 453630 - DNA, 25 bp, Rattus norvegicus
ggggagaaaaagaactcagtggatc

SEQ ID NO: 453631 - DNA, 25 bp, Rattus norvegicus
ctcagtggatcagaacccgaacagg

SEQ ID NO: 453632 - DNA, 25 bp, Rattus norvegicus
cccgaacaggagctgctagtgtaga

SEQ ID NO: 453633 - DNA, 25 bp, Rattus norvegicus
gtagatctaccctagcccggccagg

SEQ ID NO: 453634 - DNA, 25 bp, Rattus norvegicus
tgctgccctctgttgccagaattcg

SEQ ID NO: 453635 - DNA, 25 bp, Rattus norvegicus
tttgcaggacgctggttgccatagt

SEQ ID NO: 453636 - DNA, 25 bp, Rattus norvegicus
tcgaggcacagcacgcggtgaacct

SEQ ID NO: 453637 - DNA, 25 bp, Rattus norvegicus
gccagaattcgctgcacggtttgca

SEQ ID NO: 453638 - DNA, 25 bp, Rattus norvegicus
ccatccaggggaaagtgagtcccgc

SEQ ID NO: 453639 - DNA, 25 bp, Rattus norvegicus
aacatccctgtgcaccgggagaagc

SEQ ID NO: 453640 - DNA, 25 bp, Rattus norvegicus
cctgagaggttggatgactggaaac

SEQ ID NO: 453641 - DNA, 25 bp, Rattus norvegicus
gatcgatgccgaagctaatgggttc

SEQ ID NO: 453642 - DNA, 25 bp, Rattus norvegicus
cggggccgctcagtatctgatcgat

SEQ ID NO: 453643 - DNA, 25 bp, Rattus norvegicus
ttggctctggccaacctgacccgga

SEQ ID NO: 453644 - DNA, 25 bp, Rattus norvegicus
gtagcctgaggttccgtggaatcca

SEQ ID NO: 453645 - DNA, 25 bp, Rattus norvegicus
ggagcgtatgcacctgacgacagta

SEQ ID NO: 453646 - DNA, 25 bp, Rattus norvegicus
cctgtcctttgcaaagcggcggccg

SEQ ID NO: 453647 - DNA, 25 bp, Rattus norvegicus
atctcaccggtgagcctgtcctttg

SEQ ID NO: 453648 - DNA, 25 bp, Rattus norvegicus
acaccgaggagctgggcaatctcac

SEQ ID NO: 453649 - DNA, 25 bp, Rattus norvegicus
tccatgggtccaagcctgagaggtt

SEQ ID NO: 453650 - DNA, 25 bp, Rattus norvegicus
tgacgacagtacctcttattgcctc

SEQ ID NO: 453651 - DNA, 25 bp, Rattus norvegicus
ggaatccactggagaacgccgcact

SEQ ID NO: 453652 - DNA, 25 bp, Rattus norvegicus
gcaggccgccataatcgggttagct

SEQ ID NO: 453653 - DNA, 25 bp, Rattus norvegicus
agctgggccggaattacattacctt

SEQ ID NO: 453654 - DNA, 25 bp, Rattus norvegicus
tagctgggccggaattacattacct

SEQ ID NO: 453655 - DNA, 25 bp, Rattus norvegicus
ttagctgggccggaattacattacc

SEQ ID NO: 453656 - DNA, 25 bp, Rattus norvegicus
ataatcgggttagctgggccggaat

SEQ ID NO: 453657 - DNA, 25 bp, Rattus norvegicus
cataatcgggttagctgggccggaa

SEQ ID NO: 453658 - DNA, 25 bp, Rattus norvegicus
ccataatcgggttagctgggccgga

SEQ ID NO: 453659 - DNA, 25 bp, Rattus norvegicus
cgccataatcgggttagctgggccg

SEQ ID NO: 453660 - DNA, 25 bp, Rattus norvegicus
gctgggccggaattacattaccttc

SEQ ID NO: 453661 - DNA, 25 bp, Rattus norvegicus
caggccgccataatcgggttagctg

SEQ ID NO: 453662 - DNA, 25 bp, Rattus norvegicus
tgcaggccgccataatcgggttagc

SEQ ID NO: 453663 - DNA, 25 bp, Rattus norvegicus
ggtgcaggccgccataatcgggtta

SEQ ID NO: 453664 - DNA, 25 bp, Rattus norvegicus
ctgccgccaccctgcccggtgcagg

SEQ ID NO: 453665 - DNA, 25 bp, Rattus norvegicus
aggccgccataatcgggttagctgg

SEQ ID NO: 453666 - DNA, 25 bp, Rattus norvegicus
atcgcgatgaggcttcggaaccagc

SEQ ID NO: 453667 - DNA, 25 bp, Rattus norvegicus
gctcccgaagctgatccagaggttg

SEQ ID NO: 453668 - DNA, 25 bp, Rattus norvegicus
gccaaatgctggactaggacgcctg

SEQ ID NO: 453669 - DNA, 25 bp, Rattus norvegicus
ccagctccagtcagtgtacaagatg

SEQ ID NO: 453670 - DNA, 25 bp, Rattus norvegicus
acagcgtctggtctcccgaaggaaa

SEQ ID NO: 453671 - DNA, 25 bp, Rattus norvegicus
tcagcctttaagatggcgtctcctc

SEQ ID NO: 453672 - DNA, 25 bp, Rattus norvegicus
ccaatccggagaatgtgaggccctc

SEQ ID NO: 453673 - DNA, 25 bp, Rattus norvegicus
gggtgtgccggaaaactagccaatc

SEQ ID NO: 453674 - DNA, 25 bp, Rattus norvegicus
ctcaggtgagcacacggggaactaa

SEQ ID NO: 453675 - DNA, 25 bp, Rattus norvegicus
cgccgtccgaagaacgcctgtggaa

SEQ ID NO: 453676 - DNA, 25 bp, Rattus norvegicus
tctcctagacttcgcgagccgggaa

SEQ ID NO: 453677 - DNA, 25 bp, Rattus norvegicus
cgccttagcggagcagggctacact

SEQ ID NO: 453678 - DNA, 25 bp, Rattus norvegicus
ccggggcacaggctatcacaagctc

SEQ ID NO: 453679 - DNA, 25 bp, Rattus norvegicus
tccgttagttgtgtgaacccaaaca

SEQ ID NO: 453680 - DNA, 25 bp, Rattus norvegicus
agcaaactcccttcccaatgtcgcg

SEQ ID NO: 453681 - DNA, 25 bp, Rattus norvegicus
ccgcttgccatgaattctggacgtc

SEQ ID NO: 453682 - DNA, 25 bp, Rattus norvegicus
catgaattctggacgtcagcgccgg

SEQ ID NO: 453683 - DNA, 25 bp, Rattus norvegicus
cagccttctgaaggtacacgccacg

SEQ ID NO: 453684 - DNA, 25 bp, Rattus norvegicus
tcgcgctccacagccttctgaaggt

SEQ ID NO: 453685 - DNA, 25 bp, Rattus norvegicus
ttgctagtaaaactttccagggcca

SEQ ID NO: 453686 - DNA, 25 bp, Rattus norvegicus
tgcgctggaggagcttgctagtaaa

SEQ ID NO: 453687 - DNA, 25 bp, Rattus norvegicus
tctgagccacggcttcctgaagccg

SEQ ID NO: 453688 - DNA, 25 bp, Rattus norvegicus
ggagcaccttctgagccacggcttc

SEQ ID NO: 453689 - DNA, 25 bp, Rattus norvegicus
gacatcctcggtcggagcatggtcc

SEQ ID NO: 453690 - DNA, 25 bp, Rattus norvegicus
agcatcgcagacatcctcggtcgga

SEQ ID NO: 453691 - DNA, 25 bp, Rattus norvegicus
gccggacaccctttagcatcgcaga

SEQ ID NO: 453692 - DNA, 25 bp, Rattus norvegicus
gtcagcgccggacaccctttagcat

SEQ ID NO: 453693 - DNA, 25 bp, Rattus norvegicus
tgcatcgccactgtgtgcgctggag

SEQ ID NO: 453694 - DNA, 25 bp, Rattus norvegicus
gacgccgcaagtcgcgcaccgcctt

SEQ ID NO: 453695 - DNA, 25 bp, Rattus norvegicus
ctggctaatgcgcaagtggtcactt

SEQ ID NO: 453696 - DNA, 25 bp, Rattus norvegicus
actgggtctggctaatgcgcaagtg

SEQ ID NO: 453697 - DNA, 25 bp, Rattus norvegicus
actggctgcacgactgggtctggct

SEQ ID NO: 453698 - DNA, 25 bp, Rattus norvegicus
agcgcgacggactggctgcacgact

SEQ ID NO: 453699 - DNA, 25 bp, Rattus norvegicus
cttggcaccgtcagagcgcgacgga

SEQ ID NO: 453700 - DNA, 25 bp, Rattus norvegicus
tccagaagtacttggcaccgtcaga

SEQ ID NO: 453701 - DNA, 25 bp, Rattus norvegicus
agcggcgattcgtcttccagaagta

SEQ ID NO: 453702 - DNA, 25 bp, Rattus norvegicus
agctggagcggcgattcgtcttcca

SEQ ID NO: 453703 - DNA, 25 bp, Rattus norvegicus
aagtggtcacttggttccagaaccg

SEQ ID NO: 453704 - DNA, 25 bp, Rattus norvegicus
gccttcactccacagcaggtgctgg

SEQ ID NO: 453705 - DNA, 25 bp, Rattus norvegicus
cactggtgtccggagacgccgcaag

SEQ ID NO: 453706 - DNA, 25 bp, Rattus norvegicus
acctggcctccctgtgcgggttgtc

SEQ ID NO: 453707 - DNA, 25 bp, Rattus norvegicus
ttcactccacagcaggtgctggagc

SEQ ID NO: 453708 - DNA, 25 bp, Rattus norvegicus
cacggctacggagcctcagtgagtc

SEQ ID NO: 453709 - DNA, 25 bp, Rattus norvegicus
tctaccacactctacagggacaatc

SEQ ID NO: 453710 - DNA, 25 bp, Rattus norvegicus
agctccgtcggcagtgcgaccaaga

SEQ ID NO: 453711 - DNA, 25 bp, Rattus norvegicus
ctagccgaactgttgctggcccttc

SEQ ID NO: 453712 - DNA, 25 bp, Rattus norvegicus
tgggcctgacgtcccaactagccga

SEQ ID NO: 453713 - DNA, 25 bp, Rattus norvegicus
cagcacctggatgctaacatcgaga

SEQ ID NO: 453714 - DNA, 25 bp, Rattus norvegicus
tccagggagacgcttcttctggctc

SEQ ID NO: 453715 - DNA, 25 bp, Rattus norvegicus
gacttacagatgtgcccttcgcgta

SEQ ID NO: 453716 - DNA, 25 bp, Rattus norvegicus
ctccagagtctgcaagcggcccgat

SEQ ID NO: 453717 - DNA, 25 bp, Rattus norvegicus
agtggccttctaccgccaatcacta

SEQ ID NO: 453718 - DNA, 25 bp, Rattus norvegicus
gcttcgtttgggactcgccgtacaa

SEQ ID NO: 453719 - DNA, 25 bp, Rattus norvegicus
gagcggcgaacgttagcttcgtttg

SEQ ID NO: 453720 - DNA, 25 bp, Rattus norvegicus
tcagtgagtccacgaaacttccggc

SEQ ID NO: 453721 - DNA, 25 bp, Rattus norvegicus
tgtgctccacctcctggctgcagag

SEQ ID NO: 453722 - DNA, 25 bp, Rattus norvegicus
ccggtcaagctggttcgagttcagt

SEQ ID NO: 453723 - DNA, 25 bp, Rattus norvegicus
cgagttcagttctgcccgtttgaga

SEQ ID NO: 453724 - DNA, 25 bp, Rattus norvegicus
cgtggagtcaacaaggtacaggttc

SEQ ID NO: 453725 - DNA, 25 bp, Rattus norvegicus
aggacctttctccaggcggtgagca

SEQ ID NO: 453726 - DNA, 25 bp, Rattus norvegicus
ctcaactgctctgtgatcgccgacg

SEQ ID NO: 453727 - DNA, 25 bp, Rattus norvegicus
ccctgcgtggacgtgttattcggta

SEQ ID NO: 453728 - DNA, 25 bp, Rattus norvegicus
ttcggtaaacttgacagggacactg

SEQ ID NO: 453729 - DNA, 25 bp, Rattus norvegicus
cggagcgcgaccctagctctacata

SEQ ID NO: 453730 - DNA, 25 bp, Rattus norvegicus
agctctacatattccgggtccctta

SEQ ID NO: 453731 - DNA, 25 bp, Rattus norvegicus
cgggtcccttactcatcgttttgca

SEQ ID NO: 453732 - DNA, 25 bp, Rattus norvegicus
ccaggagatgggtatcggctgatta

SEQ ID NO: 453733 - DNA, 25 bp, Rattus norvegicus
gctgattatgcgaggagcccacctc

SEQ ID NO: 453734 - DNA, 25 bp, Rattus norvegicus
gggtacccgccgatgacattgtaga

SEQ ID NO: 453735 - DNA, 25 bp, Rattus norvegicus
cccacattcgggctaggaacgctgc

SEQ ID NO: 453736 - DNA, 25 bp, Rattus norvegicus
gactcctccagtcctgccgtggccc

SEQ ID NO: 453737 - DNA, 25 bp, Rattus norvegicus
gacctgacgtgtagggcgggatttc

SEQ ID NO: 453738 - DNA, 25 bp, Rattus norvegicus
gcgaaggctcagttcgctgaccgca

SEQ ID NO: 453739 - DNA, 25 bp, Rattus norvegicus
aggctcagttcgctgaccgcacggt

SEQ ID NO: 453740 - DNA, 25 bp, Rattus norvegicus
gctcagttcgctgaccgcacggtgg

SEQ ID NO: 453741 - DNA, 25 bp, Rattus norvegicus
tggttttggcgctggccttcggcct

SEQ ID NO: 453742 - DNA, 25 bp, Rattus norvegicus
gcgctaccgccggactcctccagtc

SEQ ID NO: 453743 - DNA, 25 bp, Rattus norvegicus
acacgtctatttcggcatgaagact

SEQ ID NO: 453744 - DNA, 25 bp, Rattus norvegicus
actcttctggggtacctatcgccca

SEQ ID NO: 453745 - DNA, 25 bp, Rattus norvegicus
tggggtacctatcgcccacacgtct

SEQ ID NO: 453746 - DNA, 25 bp, Rattus norvegicus
tcgcccacacgtctatttcggcatg

SEQ ID NO: 453747 - DNA, 25 bp, Rattus norvegicus
ccacacgtctatttcggcatgaaga

SEQ ID NO: 453748 - DNA, 25 bp, Rattus norvegicus
gtacctatcgcccacacgtctattt

SEQ ID NO: 453749 - DNA, 25 bp, Rattus norvegicus
tttggcgctggccttcggcctgtcg

SEQ ID NO: 453750 - DNA, 25 bp, Rattus norvegicus
aggcagagtcggtgacggctgactc

SEQ ID NO: 453751 - DNA, 25 bp, Rattus norvegicus
tgtgaggcgctcaattgtctgattc

SEQ ID NO: 453752 - DNA, 25 bp, Rattus norvegicus
gagcagctgtctttgtgaggcgctc

SEQ ID NO: 453753 - DNA, 25 bp, Rattus norvegicus
ccgctaggagcagctgtctttgtga

SEQ ID NO: 453754 - DNA, 25 bp, Rattus norvegicus
ctcgcccgctaggagcagctgtctt

SEQ ID NO: 453755 - DNA, 25 bp, Rattus norvegicus
ctgctgtagcgcaccatgggtgcag

SEQ ID NO: 453756 - DNA, 25 bp, Rattus norvegicus
cccgctgctgtagcgcaccatgggt

SEQ ID NO: 453757 - DNA, 25 bp, Rattus norvegicus
cagcagcatctcttccgtgagggca

SEQ ID NO: 453758 - DNA, 25 bp, Rattus norvegicus
acgctcctcacgcttcagcagcatc

SEQ ID NO: 453759 - DNA, 25 bp, Rattus norvegicus
gccgcttccgcgcacgctcctcacg

SEQ ID NO: 453760 - DNA, 25 bp, Rattus norvegicus
ccagccaccggcagaggcagagtcg

SEQ ID NO: 453761 - DNA, 25 bp, Rattus norvegicus
tctgattcttatgctcctcggcccg

SEQ ID NO: 453762 - DNA, 25 bp, Rattus norvegicus
catctcttccgtgagggcaggggct

SEQ ID NO: 453763 - DNA, 25 bp, Rattus norvegicus
ggcgctcaattgtctgattcttatg

SEQ ID NO: 453764 - DNA, 25 bp, Rattus norvegicus
cggtctagcagcaagcttcttccta

SEQ ID NO: 453765 - DNA, 25 bp, Rattus norvegicus
cgggttggtgcttctccagtctttt

SEQ ID NO: 453766 - DNA, 25 bp, Rattus norvegicus
gctctttagatctcggctaggtgga

SEQ ID NO: 453767 - DNA, 25 bp, Rattus norvegicus
tctagaaaggcaaatccgcgatcgc

SEQ ID NO: 453768 - DNA, 25 bp, Rattus norvegicus
tccaggttgaaagcgaaggcgaccc

SEQ ID NO: 453769 - DNA, 25 bp, Rattus norvegicus
gtcagtctcacgtctgctccgggtt

SEQ ID NO: 453770 - DNA, 25 bp, Rattus norvegicus
ctgggcataccaggcattggctctt

SEQ ID NO: 453771 - DNA, 25 bp, Rattus norvegicus
cccttggaggtgttagctctttaga

SEQ ID NO: 453772 - DNA, 25 bp, Rattus norvegicus
ccagtcttttttccagatccgtgta

SEQ ID NO: 453773 - DNA, 25 bp, Rattus norvegicus
tctactctccggttggtccgatgga

SEQ ID NO: 453774 - DNA, 25 bp, Rattus norvegicus
agaaaggccgttctaggcaccgcca

SEQ ID NO: 453775 - DNA, 25 bp, Rattus norvegicus
cgccttcagcacaagacggattgga

SEQ ID NO: 453776 - DNA, 25 bp, Rattus norvegicus
gccaaagaggctaccagggttcacc

SEQ ID NO: 453777 - DNA, 25 bp, Rattus norvegicus
tttgccctagtccaggtcagtctca

SEQ ID NO: 453778 - DNA, 25 bp, Rattus norvegicus
ctggcaaccatgtttgtgcgtggta

SEQ ID NO: 453779 - DNA, 25 bp, Rattus norvegicus
cccagacgtgctcccgcgccgccac

SEQ ID NO: 453780 - DNA, 25 bp, Rattus norvegicus
gtggtacgctttacagccaaaaata

SEQ ID NO: 453781 - DNA, 25 bp, Rattus norvegicus
ccatgtttgtgcgtggtacgcttta

SEQ ID NO: 453782 - DNA, 25 bp, Rattus norvegicus
cggtgcctggcaaccatgtttgtgc

SEQ ID NO: 453783 - DNA, 25 bp, Rattus norvegicus
aataaccggctacttccggtgcctg

SEQ ID NO: 453784 - DNA, 25 bp, Rattus norvegicus
cggaatccagcaaaataaccggcta

SEQ ID NO: 453785 - DNA, 25 bp, Rattus norvegicus
cgccgccacagcttgctcatggggt

SEQ ID NO: 453786 - DNA, 25 bp, Rattus norvegicus
gggacacaagccgacatgccttttc

SEQ ID NO: 453787 - DNA, 25 bp, Rattus norvegicus
gactggaaacggtcgggacacaagc

SEQ ID NO: 453788 - DNA, 25 bp, Rattus norvegicus
ttgctcatggggtcctgcaaaggga

SEQ ID NO: 453789 - DNA, 25 bp, Rattus norvegicus
cacagcttgctcatggggtcctgca

SEQ ID NO: 453790 - DNA, 25 bp, Rattus norvegicus
cggaagaacggaatccagcaaaata

SEQ ID NO: 453791 - DNA, 25 bp, Rattus norvegicus
gtgcgtggtacgctttacagccaaa

SEQ ID NO: 453792 - DNA, 25 bp, Rattus norvegicus
taagcggagcgggaatcccgcgccc

SEQ ID NO: 453793 - DNA, 25 bp, Rattus norvegicus
tcccgcgccctcagtccagttccgg

SEQ ID NO: 453794 - DNA, 25 bp, Rattus norvegicus
ccgcccgcactcagcttggccgcgg

SEQ ID NO: 453795 - DNA, 25 bp, Rattus norvegicus
caggccacccgaagcctagtgctgg

SEQ ID NO: 453796 - DNA, 25 bp, Rattus norvegicus
cacccgaagcctagtgctgggccgg

SEQ ID NO: 453797 - DNA, 25 bp, Rattus norvegicus
ccgcccatgggctcaggatgccggt

SEQ ID NO: 453798 - DNA, 25 bp, Rattus norvegicus
acaccttcctcgacaccatcatccg

SEQ ID NO: 453799 - DNA, 25 bp, Rattus norvegicus
agccgctaagcggagcgggaatccc

SEQ ID NO: 453800 - DNA, 25 bp, Rattus norvegicus
gggcgcgcgccgcattaacccttca

SEQ ID NO: 453801 - DNA, 25 bp, Rattus norvegicus
aggggccacgtcgcgccgcagaaca

SEQ ID NO: 453802 - DNA, 25 bp, Rattus norvegicus
cattaacccttcagccgccggacca

SEQ ID NO: 453803 - DNA, 25 bp, Rattus norvegicus
tcggcgcggctcagccaatgagaag

SEQ ID NO: 453804 - DNA, 25 bp, Rattus norvegicus
caccagcccgggtcgacagacaggt

SEQ ID NO: 453805 - DNA, 25 bp, Rattus norvegicus
ggaccaagccgcaggcactgcccga

SEQ ID NO: 453806 - DNA, 25 bp, Rattus norvegicus
gggctgcaagcatgttctcgcgaaa

SEQ ID NO: 453807 - DNA, 25 bp, Rattus norvegicus
gtactcagcgacctgccggaggtga

SEQ ID NO: 453808 - DNA, 25 bp, Rattus norvegicus
ttagtgtactcagcgacctgccgga

SEQ ID NO: 453809 - DNA, 25 bp, Rattus norvegicus
gcggccgctttcgacttagtgtact

SEQ ID NO: 453810 - DNA, 25 bp, Rattus norvegicus
gatggagttcaaacgcggccgcttt

SEQ ID NO: 453811 - DNA, 25 bp, Rattus norvegicus
tccgccctggagatggagttcaaac

SEQ ID NO: 453812 - DNA, 25 bp, Rattus norvegicus
catcggagccgggtcacagtggcca

SEQ ID NO: 453813 - DNA, 25 bp, Rattus norvegicus
gcgaaaccatcggagccgggtcaca

SEQ ID NO: 453814 - DNA, 25 bp, Rattus norvegicus
gcaagcatgttctcgcgaaaccatc

SEQ ID NO: 453815 - DNA, 25 bp, Rattus norvegicus
caagcccgcgagagactgatcccag

SEQ ID NO: 453816 - DNA, 25 bp, Rattus norvegicus
agattcccggctgcactggtaggag

SEQ ID NO: 453817 - DNA, 25 bp, Rattus norvegicus
cagctggggagattcccggctgcac

SEQ ID NO: 453818 - DNA, 25 bp, Rattus norvegicus
cctgcccagcccaggtgtcgtctcc

SEQ ID NO: 453819 - DNA, 25 bp, Rattus norvegicus
ttctcgcgaaaccatcggagccggg

SEQ ID NO: 453820 - DNA, 25 bp, Rattus norvegicus
gtcccggtggtaaagatgcaggcat

SEQ ID NO: 453821 - DNA, 25 bp, Rattus norvegicus
gcgcctggagccctcagcgcctctc

SEQ ID NO: 453822 - DNA, 25 bp, Rattus norvegicus
ttgggagctgatgtcaccggcgccc

SEQ ID NO: 453823 - DNA, 25 bp, Rattus norvegicus
accctggcagtgaggtagcgccgac

SEQ ID NO: 453824 - DNA, 25 bp, Rattus norvegicus
tagcgccgacgctcggaatccttca

SEQ ID NO: 453825 - DNA, 25 bp, Rattus norvegicus
ctcggaatccttcaattcccacatg

SEQ ID NO: 453826 - DNA, 25 bp, Rattus norvegicus
attcccacatggtcctccggtcacg

SEQ ID NO: 453827 - DNA, 25 bp, Rattus norvegicus
gcaattgggagctgatgtcaccggc

SEQ ID NO: 453828 - DNA, 25 bp, Rattus norvegicus
cctctcgcggcaattgggagctgat

SEQ ID NO: 453829 - DNA, 25 bp, Rattus norvegicus
ctcagcgcctctcgcggcaattggg

SEQ ID NO: 453830 - DNA, 25 bp, Rattus norvegicus
ccggtggtaaagatgcaggcatcgc

SEQ ID NO: 453831 - DNA, 25 bp, Rattus norvegicus
tggctccccgggtttctgcgacctg

SEQ ID NO: 453832 - DNA, 25 bp, Rattus norvegicus
atgcaggcatcgcagcgcctgcagg

SEQ ID NO: 453833 - DNA, 25 bp, Rattus norvegicus
aaagatgcaggcatcgcagcgcctg

SEQ ID NO: 453834 - DNA, 25 bp, Rattus norvegicus
atacgcgcggctacgcggttgctaa

SEQ ID NO: 453835 - DNA, 25 bp, Rattus norvegicus
gccgcgatcctcaagtccctccgaa

SEQ ID NO: 453836 - DNA, 25 bp, Rattus norvegicus
caccgaccctcagcgggtctggttg

SEQ ID NO: 453837 - DNA, 25 bp, Rattus norvegicus
gcggctacgcggttgctaagcaacc

SEQ ID NO: 453838 - DNA, 25 bp, Rattus norvegicus
gaccctcagcgggtctggttgccga

SEQ ID NO: 453839 - DNA, 25 bp, Rattus norvegicus
actggaactggatacgcgcggctac

SEQ ID NO: 453840 - DNA, 25 bp, Rattus norvegicus
cctgtgactggaactggatacgcgc

SEQ ID NO: 453841 - DNA, 25 bp, Rattus norvegicus
cgtggcctgtgactggaactggata

SEQ ID NO: 453842 - DNA, 25 bp, Rattus norvegicus
agagacgacgcacggacgcacggcc

SEQ ID NO: 453843 - DNA, 25 bp, Rattus norvegicus
accatagagacgacgcacggacgca

SEQ ID NO: 453844 - DNA, 25 bp, Rattus norvegicus
cgccaccatagagacgacgcacgga

SEQ ID NO: 453845 - DNA, 25 bp, Rattus norvegicus
tcaagtccctccgaatccgccgcca

SEQ ID NO: 453846 - DNA, 25 bp, Rattus norvegicus
ttgccagacgccgcgatcctcaagt

SEQ ID NO: 453847 - DNA, 25 bp, Rattus norvegicus
cgcggttgctaagcaaccgtggacc

SEQ ID NO: 453848 - DNA, 25 bp, Rattus norvegicus
tcgaagcgcgccctttggaaatata

SEQ ID NO: 453849 - DNA, 25 bp, Rattus norvegicus
tgtcgctgcaggatctttaccactg

SEQ ID NO: 453850 - DNA, 25 bp, Rattus norvegicus
gggaccggctgaacttgaagaacaa

SEQ ID NO: 453851 - DNA, 25 bp, Rattus norvegicus
ccgctcctcgatagggtcggcagat

SEQ ID NO: 453852 - DNA, 25 bp, Rattus norvegicus
gataggtcccttctcagtgtgccca

SEQ ID NO: 453853 - DNA, 25 bp, Rattus norvegicus
ggtcctgatcccagacctcgaagcg

SEQ ID NO: 453854 - DNA, 25 bp, Rattus norvegicus
ttggaaatatatcgcgtgcgtccgc

SEQ ID NO: 453855 - DNA, 25 bp, Rattus norvegicus
actccaggtctctatcccaaggttc

SEQ ID NO: 453856 - DNA, 25 bp, Rattus norvegicus
agcgttgcgctacattccgttcttc

SEQ ID NO: 453857 - DNA, 25 bp, Rattus norvegicus
gggctcatccttcggttcacacctg

SEQ ID NO: 453858 - DNA, 25 bp, Rattus norvegicus
gctagaaatctagtccctcccgacg

SEQ ID NO: 453859 - DNA, 25 bp, Rattus norvegicus
caaggttccctctcaagcgttgcgc

SEQ ID NO: 453860 - DNA, 25 bp, Rattus norvegicus
gggttccgcttcctcgctagaaatc

SEQ ID NO: 453861 - DNA, 25 bp, Rattus norvegicus
atccttcgggtcaaacctgccattc

SEQ ID NO: 453862 - DNA, 25 bp, Rattus norvegicus
aatgaggagactgctcacagaactc

SEQ ID NO: 453863 - DNA, 25 bp, Rattus norvegicus
acttcccaggcgtagtgcgcatgcg

SEQ ID NO: 453864 - DNA, 25 bp, Rattus norvegicus
agattactgggacctgagagctttg

SEQ ID NO: 453865 - DNA, 25 bp, Rattus norvegicus
ggtcctaatcgacttcccaggcgta

SEQ ID NO: 453866 - DNA, 25 bp, Rattus norvegicus
acctgagagctttggggatcgatgc

SEQ ID NO: 453867 - DNA, 25 bp, Rattus norvegicus
gcctctcgaccgtggtcctaatcga

SEQ ID NO: 453868 - DNA, 25 bp, Rattus norvegicus
ttggcgagacattgtcagctagggc

SEQ ID NO: 453869 - DNA, 25 bp, Rattus norvegicus
cgcggagccctgacagcaggtacgc

SEQ ID NO: 453870 - DNA, 25 bp, Rattus norvegicus
ctctgccatgcttggcgagacattg

SEQ ID NO: 453871 - DNA, 25 bp, Rattus norvegicus
atcgatgtcttctctgccatgcttg

SEQ ID NO: 453872 - DNA, 25 bp, Rattus norvegicus
gctcagtgccttatcgatgtcttct

SEQ ID NO: 453873 - DNA, 25 bp, Rattus norvegicus
cgcaggtgtctagctcagtgcctta

SEQ ID NO: 453874 - DNA, 25 bp, Rattus norvegicus
tgcgcatgcgcatgcttacatgcac

SEQ ID NO: 453875 - DNA, 25 bp, Rattus norvegicus
ctcacagaactctagagattactgg

SEQ ID NO: 453876 - DNA, 25 bp, Rattus norvegicus
gaacagggtcccttgcaaagcatcc

SEQ ID NO: 453877 - DNA, 25 bp, Rattus norvegicus
cactgccagcgcagacaaggaaaca

SEQ ID NO: 453878 - DNA, 25 bp, Rattus norvegicus
tggggcgcaacaaccgcactgccag

SEQ ID NO: 453879 - DNA, 25 bp, Rattus norvegicus
actcaccgtactgccgccaggtgga

SEQ ID NO: 453880 - DNA, 25 bp, Rattus norvegicus
aaggatatcatctgtccacagcgcg

SEQ ID NO: 453881 - DNA, 25 bp, Rattus norvegicus
ccggttgatgcttggaaaggatatc

SEQ ID NO: 453882 - DNA, 25 bp, Rattus norvegicus
ggaagggcagacctctccgcactca

SEQ ID NO: 453883 - DNA, 25 bp, Rattus norvegicus
agcaaccctggctgccgctagggtc

SEQ ID NO: 453884 - DNA, 25 bp, Rattus norvegicus
gccggctcgcggatttcatcagact

SEQ ID NO: 453885 - DNA, 25 bp, Rattus norvegicus
gaaatcggtacccttggagcaagcc

SEQ ID NO: 453886 - DNA, 25 bp, Rattus norvegicus
actgcggggcatcttgcgaaccaca

SEQ ID NO: 453887 - DNA, 25 bp, Rattus norvegicus
caaagcatccgcatctccatgtgca

SEQ ID NO: 453888 - DNA, 25 bp, Rattus norvegicus
gaaacagaaaccatggcccgcgccg

SEQ ID NO: 453889 - DNA, 25 bp, Rattus norvegicus
cgcactcatctctgcggtggcagaa

SEQ ID NO: 453890 - DNA, 25 bp, Rattus norvegicus
gccgtgaagcttcggcagccctgtt

SEQ ID NO: 453891 - DNA, 25 bp, Rattus norvegicus
gcggagccggacattgggctatacc

SEQ ID NO: 453892 - DNA, 25 bp, Rattus norvegicus
aaaagcccggtctcgcgagatcctg

SEQ ID NO: 453893 - DNA, 25 bp, Rattus norvegicus
gcttcctcttgtaagtgggtcgggc

SEQ ID NO: 453894 - DNA, 25 bp, Rattus norvegicus
ggctagcaaggatgagcttcctctt

SEQ ID NO: 453895 - DNA, 25 bp, Rattus norvegicus
ccctcgggctagcaaggatgagctt

SEQ ID NO: 453896 - DNA, 25 bp, Rattus norvegicus
tcggcagccctgttgagccgcggac

SEQ ID NO: 453897 - DNA, 25 bp, Rattus norvegicus
tataccgggcctgccgcctgggaaa

SEQ ID NO: 453898 - DNA, 25 bp, Rattus norvegicus
gaggactccgcagtctgtgctggtt

SEQ ID NO: 453899 - DNA, 25 bp, Rattus norvegicus
ctgctcatcgagctgttgggaggta

SEQ ID NO: 453900 - DNA, 25 bp, Rattus norvegicus
tgttggttccgcatttctgctcatc

SEQ ID NO: 453901 - DNA, 25 bp, Rattus norvegicus
cgagatcctgttggttccgcatttc

SEQ ID NO: 453902 - DNA, 25 bp, Rattus norvegicus
cagtacgaaacccaagccgtgaagc

SEQ ID NO: 453903 - DNA, 25 bp, Rattus norvegicus
gacattgggctataccgggcctgcc

SEQ ID NO: 453904 - DNA, 25 bp, Rattus norvegicus
gccgaggcccttccttgttctcatt

SEQ ID NO: 453905 - DNA, 25 bp, Rattus norvegicus
cgtgcttgcaggtacggccggttcc

SEQ ID NO: 453906 - DNA, 25 bp, Rattus norvegicus
cgaatctggacacagtgcctgcgtc

SEQ ID NO: 453907 - DNA, 25 bp, Rattus norvegicus
agtgcctgcgtctttccggctgcac

SEQ ID NO: 453908 - DNA, 25 bp, Rattus norvegicus
tttccggctgcaccgtgacctcggg

SEQ ID NO: 453909 - DNA, 25 bp, Rattus norvegicus
tgcaccgtgacctcgggctgcgtcg

SEQ ID NO: 453910 - DNA, 25 bp, Rattus norvegicus
ggctcccgtgcttgcaggtacggcc

SEQ ID NO: 453911 - DNA, 25 bp, Rattus norvegicus
gctatgcctttgctccgcgggagcc

SEQ ID NO: 453912 - DNA, 25 bp, Rattus norvegicus
ccagggcggcgaatctggacacagt

SEQ ID NO: 453913 - DNA, 25 bp, Rattus norvegicus
ggcccttccttgttctcattcattc

SEQ ID NO: 453914 - DNA, 25 bp, Rattus norvegicus
tgccctctgcatcgtaccgggcgtg

SEQ ID NO: 453915 - DNA, 25 bp, Rattus norvegicus
ctctgcatcgtaccgggcgtgctgg

SEQ ID NO: 453916 - DNA, 25 bp, Rattus norvegicus
atggggccccgtggccgctatgcct

SEQ ID NO: 453917 - DNA, 25 bp, Rattus norvegicus
tctggacacagtgcctgcgtctttc

SEQ ID NO: 453918 - DNA, 25 bp, Rattus norvegicus
gggggacgctcagatagacagacag

SEQ ID NO: 453919 - DNA, 25 bp, Rattus norvegicus
catccagagcgggtggcaactcgtc

SEQ ID NO: 453920 - DNA, 25 bp, Rattus norvegicus
cacgagctcgcagcggcgggcgata

SEQ ID NO: 453921 - DNA, 25 bp, Rattus norvegicus
ctcgtcccgccacgagctcgcagcg

SEQ ID NO: 453922 - DNA, 25 bp, Rattus norvegicus
gggtggcaactcgtcccgccacgag

SEQ ID NO: 453923 - DNA, 25 bp, Rattus norvegicus
cagagcgggtggcaactcgtcccgc

SEQ ID NO: 453924 - DNA, 25 bp, Rattus norvegicus
aaagaacagagggcatccagagcgg

SEQ ID NO: 453925 - DNA, 25 bp, Rattus norvegicus
ccctcttggcaaaagaacagagggc

SEQ ID NO: 453926 - DNA, 25 bp, Rattus norvegicus
gcgccctcttggcaaaagaacagag

SEQ ID NO: 453927 - DNA, 25 bp, Rattus norvegicus
gggcgccctcttggcaaaagaacag

SEQ ID NO: 453928 - DNA, 25 bp, Rattus norvegicus
ccgcttgcatcctgggaggggaacc

SEQ ID NO: 453929 - DNA, 25 bp, Rattus norvegicus
tagacagacagatagcgctcccctc

SEQ ID NO: 453930 - DNA, 25 bp, Rattus norvegicus
aaccggcagcccagtgcccttcctg

SEQ ID NO: 453931 - DNA, 25 bp, Rattus norvegicus
cccgcttgcatcctgggaggggaac

SEQ ID NO: 453932 - DNA, 25 bp, Rattus norvegicus
tcacggttgaaggtttcatagagcc

SEQ ID NO: 453933 - DNA, 25 bp, Rattus norvegicus
gccagggccgtctgtaacgtgtcca

SEQ ID NO: 453934 - DNA, 25 bp, Rattus norvegicus
gtaacgtgtccaggtcttcaccgcc

SEQ ID NO: 453935 - DNA, 25 bp, Rattus norvegicus
gcctcacgactcatctcacggttga

SEQ ID NO: 453936 - DNA, 25 bp, Rattus norvegicus
tcatagagccgggtgctaagggccc

SEQ ID NO: 453937 - DNA, 25 bp, Rattus norvegicus
agaggacacagcttcggccacagcc

SEQ ID NO: 453938 - DNA, 25 bp, Rattus norvegicus
gtccggcaggctctctagcaccatt

SEQ ID NO: 453939 - DNA, 25 bp, Rattus norvegicus
cacagccgaaaaggccaccagatcg

SEQ ID NO: 453940 - DNA, 25 bp, Rattus norvegicus
cctcagagcagctctcaggccgggg

SEQ ID NO: 453941 - DNA, 25 bp, Rattus norvegicus
ggctctctagcaccattgacgggcg

SEQ ID NO: 453942 - DNA, 25 bp, Rattus norvegicus
agctcccagaagactgggtccggca

SEQ ID NO: 453943 - DNA, 25 bp, Rattus norvegicus
ggcttctggtctacccgccaaggac

SEQ ID NO: 453944 - DNA, 25 bp, Rattus norvegicus
gtcccagtcgggcttctggtctacc

SEQ ID NO: 453945 - DNA, 25 bp, Rattus norvegicus
cagatcgtgggcatcttccaggcga

SEQ ID NO: 453946 - DNA, 25 bp, Rattus norvegicus
ggcccctgcgccttccagtgttttg

SEQ ID NO: 453947 - DNA, 25 bp, Rattus norvegicus
ctgcttcggttcctgagcctgtgga

SEQ ID NO: 453948 - DNA, 25 bp, Rattus norvegicus
ttcctgagcctgtggagatcccagg

SEQ ID NO: 453949 - DNA, 25 bp, Rattus norvegicus
tgtggagatcccagggacccgctcc

SEQ ID NO: 453950 - DNA, 25 bp, Rattus norvegicus
tcggccggcctccactactgcatcg

SEQ ID NO: 453951 - DNA, 25 bp, Rattus norvegicus
tgcccagcagccaggcaggggcctt

SEQ ID NO: 453952 - DNA, 25 bp, Rattus norvegicus
ccttggtggtgggagccatcgctac

SEQ ID NO: 453953 - DNA, 25 bp, Rattus norvegicus
ggagccatcgctacaagggctgctt

SEQ ID NO: 453954 - DNA, 25 bp, Rattus norvegicus
tgcttcccaggcaggccggggatcc

SEQ ID NO: 453955 - DNA, 25 bp, Rattus norvegicus
caaccctctggcaacatacacaagg

SEQ ID NO: 453956 - DNA, 25 bp, Rattus norvegicus
tctggcaacatacacaaggcgtctc

SEQ ID NO: 453957 - DNA, 25 bp, Rattus norvegicus
aaggcgtctcctgcacttccagcgg

SEQ ID NO: 453958 - DNA, 25 bp, Rattus norvegicus
tctcctgcacttccagcgggtgcaa

SEQ ID NO: 453959 - DNA, 25 bp, Rattus norvegicus
agaaaggctggacgggaccatcttc

SEQ ID NO: 453960 - DNA, 25 bp, Rattus norvegicus
acagcagtgtgtgacgagcgaatgt

SEQ ID NO: 453961 - DNA, 25 bp, Rattus norvegicus
cacagctgcgttcagccggggttag

SEQ ID NO: 453962 - DNA, 25 bp, Rattus norvegicus
agcgcaaagtggagatcgccttcta

SEQ ID NO: 453963 - DNA, 25 bp, Rattus norvegicus
actgcgccgtcatctactgcaacga

SEQ ID NO: 453964 - DNA, 25 bp, Rattus norvegicus
tctctgcccggggaaagccacgcag

SEQ ID NO: 453965 - DNA, 25 bp, Rattus norvegicus
tgctgacacgcgttgctgacacccg

SEQ ID NO: 453966 - DNA, 25 bp, Rattus norvegicus
cgctcgtgtagagaactgcgccgtc

SEQ ID NO: 453967 - DNA, 25 bp, Rattus norvegicus
gtggagtcacctgtgtctgtgcaca

SEQ ID NO: 453968 - DNA, 25 bp, Rattus norvegicus
tgcaacgacggcttctgcgaactgt

SEQ ID NO: 453969 - DNA, 25 bp, Rattus norvegicus
gttcatcatcgctaacgctcgtgta

SEQ ID NO: 453970 - DNA, 25 bp, Rattus norvegicus
acctgcgatttcctgcatgggccgc

SEQ ID NO: 453971 - DNA, 25 bp, Rattus norvegicus
ccttctaccggaaagatggtaggcg

SEQ ID NO: 453972 - DNA, 25 bp, Rattus norvegicus
gcctcgagagaacgagcgtggatac

SEQ ID NO: 453973 - DNA, 25 bp, Rattus norvegicus
aactgtgcggctactctcgggccga

SEQ ID NO: 453974 - DNA, 25 bp, Rattus norvegicus
cacggcccaaggtgtgcgtctccgg

SEQ ID NO: 453975 - DNA, 25 bp, Rattus norvegicus
gctcctttgttctggggcctccgct

SEQ ID NO: 453976 - DNA, 25 bp, Rattus norvegicus
gctccttgccgggtcgctggttacc

SEQ ID NO: 453977 - DNA, 25 bp, Rattus norvegicus
gggtcgctggttaccctactgcgcc

SEQ ID NO: 453978 - DNA, 25 bp, Rattus norvegicus
tactgcgcccaccagggccttgcca

SEQ ID NO: 453979 - DNA, 25 bp, Rattus norvegicus
gaaagccaccggctgcaccgacctg

SEQ ID NO: 453980 - DNA, 25 bp, Rattus norvegicus
ggcaaagtttcccagcctgccgctg

SEQ ID NO: 453981 - DNA, 25 bp, Rattus norvegicus
cgagccacagaaagggcgacccgcg

SEQ ID NO: 453982 - DNA, 25 bp, Rattus norvegicus
cccaaggtgtgcgtctccgggaacg

SEQ ID NO: 453983 - DNA, 25 bp, Rattus norvegicus
agcccagccaagctcgctgcgcgcg

SEQ ID NO: 453984 - DNA, 25 bp, Rattus norvegicus
ctccgaggggccctccagagatgcg

SEQ ID NO: 453985 - DNA, 25 bp, Rattus norvegicus
gggccctccagagatgcggctgtcc

SEQ ID NO: 453986 - DNA, 25 bp, Rattus norvegicus
acttcctgccactccctgcgtgctc

SEQ ID NO: 453987 - DNA, 25 bp, Rattus norvegicus
cggagcgcacaaaggggcaaagttt

SEQ ID NO: 453988 - DNA, 25 bp, Rattus norvegicus
gcccttaccgatgttgccttcaatg

SEQ ID NO: 453989 - DNA, 25 bp, Rattus norvegicus
aatggctggttttagctcgctaagc

SEQ ID NO: 453990 - DNA, 25 bp, Rattus norvegicus
gggactgctctgttctcgcgatgtt

SEQ ID NO: 453991 - DNA, 25 bp, Rattus norvegicus
cactttctggcccttaccgatgttg

SEQ ID NO: 453992 - DNA, 25 bp, Rattus norvegicus
tgccttcaatgcagagccttcgggg

SEQ ID NO: 453993 - DNA, 25 bp, Rattus norvegicus
ggaacggaaagacgctcggagtcta

SEQ ID NO: 453994 - DNA, 25 bp, Rattus norvegicus
gctcggagtctacgcagaaggaacc

SEQ ID NO: 453995 - DNA, 25 bp, Rattus norvegicus
aaggaaccgacctgcagccatccta

SEQ ID NO: 453996 - DNA, 25 bp, Rattus norvegicus
gccatcctacccaagcttagcaagg

SEQ ID NO: 453997 - DNA, 25 bp, Rattus norvegicus
ccaagcttagcaaggcgggcacttc

SEQ ID NO: 453998 - DNA, 25 bp, Rattus norvegicus
ttccgcctgcggtaaagcgactcct

SEQ ID NO: 453999 - DNA, 25 bp, Rattus norvegicus
actcctgcgcatctctgacgtcaga

SEQ ID NO: 454000 - DNA, 25 bp, Rattus norvegicus
ccgtcagacaggaaatggctggttt

SEQ ID NO: 454001 - DNA, 25 bp, Rattus norvegicus
aggccacggcttgacagccactttc

SEQ ID NO: 454002 - DNA, 25 bp, Rattus norvegicus
ggtcccaagcgagcaccggctattt

SEQ ID NO: 454003 - DNA, 25 bp, Rattus norvegicus
aagggcatttgcactcggaccgagc

SEQ ID NO: 454004 - DNA, 25 bp, Rattus norvegicus
catcggtggagatagacgattcatc

SEQ ID NO: 454005 - DNA, 25 bp, Rattus norvegicus
tcgcaagccgcgatcagagaatgcc

SEQ ID NO: 454006 - DNA, 25 bp, Rattus norvegicus
ccggctatttgcagcttggggacgc

SEQ ID NO: 454007 - DNA, 25 bp, Rattus norvegicus
ggtccatctcagtccgcagctttgc

SEQ ID NO: 454008 - DNA, 25 bp, Rattus norvegicus
cgcagctttgcaccgatttctatcc

SEQ ID NO: 454009 - DNA, 25 bp, Rattus norvegicus
ctgcacgttcttgccgcatccaggg

SEQ ID NO: 454010 - DNA, 25 bp, Rattus norvegicus
tgtgcttttcccagtcctcagagag

SEQ ID NO: 454011 - DNA, 25 bp, Rattus norvegicus
ccctgcagggatccagtcgaacttt

SEQ ID NO: 454012 - DNA, 25 bp, Rattus norvegicus
gtcgaactttctccgtgcaagcacc

SEQ ID NO: 454013 - DNA, 25 bp, Rattus norvegicus
agaagccggatatcaggtcccaagc

SEQ ID NO: 454014 - DNA, 25 bp, Rattus norvegicus
actgggaaccaagaagggcatttgc

SEQ ID NO: 454015 - DNA, 25 bp, Rattus norvegicus
gcctgcagtgcggaagcattccaga

SEQ ID NO: 454016 - DNA, 25 bp, Rattus norvegicus
gagcgggaccgcggccccaagcgcc

SEQ ID NO: 454017 - DNA, 25 bp, Rattus norvegicus
agcgggtgtcgtggggagcaccgcg

SEQ ID NO: 454018 - DNA, 25 bp, Rattus norvegicus
cgcagcgggtgtcgtggggagcacc

SEQ ID NO: 454019 - DNA, 25 bp, Rattus norvegicus
gaggagcctggtggccgcagcgggt

SEQ ID NO: 454020 - DNA, 25 bp, Rattus norvegicus
gcgccgggaggagcctggtggccgc

SEQ ID NO: 454021 - DNA, 25 bp, Rattus norvegicus
agcgccgggaggagcctggtggccg

SEQ ID NO: 454022 - DNA, 25 bp, Rattus norvegicus
aagcgccgggaggagcctggtggcc

SEQ ID NO: 454023 - DNA, 25 bp, Rattus norvegicus
caagcgccgggaggagcctggtggc

SEQ ID NO: 454024 - DNA, 25 bp, Rattus norvegicus
ggcatgggcgatgggggcgcggagc

SEQ ID NO: 454025 - DNA, 25 bp, Rattus norvegicus
cccaagcgccgggaggagcctggtg

SEQ ID NO: 454026 - DNA, 25 bp, Rattus norvegicus
ggtgtcgtggggagcaccgcggagc

SEQ ID NO: 454027 - DNA, 25 bp, Rattus norvegicus
cagcgggtgtcgtggggagcaccgc

SEQ ID NO: 454028 - DNA, 25 bp, Rattus norvegicus
ccaagcgccgggaggagcctggtgg

SEQ ID NO: 454029 - DNA, 25 bp, Rattus norvegicus
ccgcagcgggtgtcgtggggagcac

SEQ ID NO: 454030 - DNA, 25 bp, Rattus norvegicus
gagcggaagatttgcgtgctgacac

SEQ ID NO: 454031 - DNA, 25 bp, Rattus norvegicus
cgctcggtgagacggaccactgccg

SEQ ID NO: 454032 - DNA, 25 bp, Rattus norvegicus
acaacaggcgctcggtgagacggac

SEQ ID NO: 454033 - DNA, 25 bp, Rattus norvegicus
cagcgacggacaacaggcgctcggt

SEQ ID NO: 454034 - DNA, 25 bp, Rattus norvegicus
ggacagcgacggacaacaggcgctc

SEQ ID NO: 454035 - DNA, 25 bp, Rattus norvegicus
ccctgcaggctccagggagagcggc

SEQ ID NO: 454036 - DNA, 25 bp, Rattus norvegicus
agattgctgggacctccgcctccag

SEQ ID NO: 454037 - DNA, 25 bp, Rattus norvegicus
tccgagggagattgctgggacctcc

SEQ ID NO: 454038 - DNA, 25 bp, Rattus norvegicus
tagcacgagtccgagggagattgct

SEQ ID NO: 454039 - DNA, 25 bp, Rattus norvegicus
ctgacacgggtagcacgagtccgag

SEQ ID NO: 454040 - DNA, 25 bp, Rattus norvegicus
gtgctgacacgggtagcacgagtcc

SEQ ID NO: 454041 - DNA, 25 bp, Rattus norvegicus
atttgcgtgctgacacgggtagcac

SEQ ID NO: 454042 - DNA, 25 bp, Rattus norvegicus
catcctggtacgaggtaaggggacg

SEQ ID NO: 454043 - DNA, 25 bp, Rattus norvegicus
gaagatttgcgtgctgacacgggta

SEQ ID NO: 454044 - DNA, 25 bp, Rattus norvegicus
ttcccactcgctcgctcggagccgc

SEQ ID NO: 454045 - DNA, 25 bp, Rattus norvegicus
gtaggctgtcctgccgcggctccgc

SEQ ID NO: 454046 - DNA, 25 bp, Rattus norvegicus
ctccagttcccactcgctcgctcgg

SEQ ID NO: 454047 - DNA, 25 bp, Rattus norvegicus
ccagttcccactcgctcgctcggag

SEQ ID NO: 454048 - DNA, 25 bp, Rattus norvegicus
cactcgctcgctcggagccgccgac

SEQ ID NO: 454049 - DNA, 25 bp, Rattus norvegicus
gcctggcttggctgacgcttcttcc

SEQ ID NO: 454050 - DNA, 25 bp, Rattus norvegicus
cctggcttggctgacgcttcttcct

SEQ ID NO: 454051 - DNA, 25 bp, Rattus norvegicus
ctggcttggctgacgcttcttcctc

SEQ ID NO: 454052 - DNA, 25 bp, Rattus norvegicus
tggcttggctgacgcttcttcctcg

SEQ ID NO: 454053 - DNA, 25 bp, Rattus norvegicus
gcttggctgacgcttcttcctcggc

SEQ ID NO: 454054 - DNA, 25 bp, Rattus norvegicus
cttggctgacgcttcttcctcggct

SEQ ID NO: 454055 - DNA, 25 bp, Rattus norvegicus
caccctcacccggagtacagcccct

SEQ ID NO: 454056 - DNA, 25 bp, Rattus norvegicus
aggtagggtaggctgtcctgccgcg

SEQ ID NO: 454057 - DNA, 25 bp, Rattus norvegicus
agccgccgactcaggcgctcctccg

SEQ ID NO: 454058 - DNA, 25 bp, Rattus norvegicus
acccgagtgggtagccgctgaagaa

SEQ ID NO: 454059 - DNA, 25 bp, Rattus norvegicus
ggccggacggcttcagcccagtctt

SEQ ID NO: 454060 - DNA, 25 bp, Rattus norvegicus
acggcttcagcccagtcttgtttcc

SEQ ID NO: 454061 - DNA, 25 bp, Rattus norvegicus
ttcagcccagtcttgtttcccagca

SEQ ID NO: 454062 - DNA, 25 bp, Rattus norvegicus
tcttgtttcccagcacctggccttg

SEQ ID NO: 454063 - DNA, 25 bp, Rattus norvegicus
cttggtgcacactaaggtagggtag

SEQ ID NO: 454064 - DNA, 25 bp, Rattus norvegicus
gtttcccagcacctggccttgcata

SEQ ID NO: 454065 - DNA, 25 bp, Rattus norvegicus
ccagcacctggccttgcataggttg

SEQ ID NO: 454066 - DNA, 25 bp, Rattus norvegicus
cctggccttgcataggttggtgctc

SEQ ID NO: 454067 - DNA, 25 bp, Rattus norvegicus
ccttgcataggttggtgctcagaga

SEQ ID NO: 454068 - DNA, 25 bp, Rattus norvegicus
tgcataggttggtgctcagagactt

SEQ ID NO: 454069 - DNA, 25 bp, Rattus norvegicus
tgctcagagacttggtgcacactaa

SEQ ID NO: 454070 - DNA, 25 bp, Rattus norvegicus
cagagacttggtgcacactaaggta

SEQ ID NO: 454071 - DNA, 25 bp, Rattus norvegicus
tagccgctgaagaaggctgggccac

SEQ ID NO: 454072 - DNA, 25 bp, Rattus norvegicus
ccactttccaaactcgcctgggatt

SEQ ID NO: 454073 - DNA, 25 bp, Rattus norvegicus
gcctcgagattgtgagctgaagccg

SEQ ID NO: 454074 - DNA, 25 bp, Rattus norvegicus
gactgtgaggactcgtgtctgcacc

SEQ ID NO: 454075 - DNA, 25 bp, Rattus norvegicus
actcgtgtctgcaccgcaggtctga

SEQ ID NO: 454076 - DNA, 25 bp, Rattus norvegicus
gtctgcaccgcaggtctgaccgaaa

SEQ ID NO: 454077 - DNA, 25 bp, Rattus norvegicus
accgcaggtctgaccgaaaggcgtg

SEQ ID NO: 454078 - DNA, 25 bp, Rattus norvegicus
agacccagagtagcctcggagccgg

SEQ ID NO: 454079 - DNA, 25 bp, Rattus norvegicus
acgcaatcaagttcaggcctcgaga

SEQ ID NO: 454080 - DNA, 25 bp, Rattus norvegicus
cccttgaatccggaatggcggttag

SEQ ID NO: 454081 - DNA, 25 bp, Rattus norvegicus
cgcctgggatttcccgcggcctaga

SEQ ID NO: 454082 - DNA, 25 bp, Rattus norvegicus
ccgcggcctagacactgcgtagaga

SEQ ID NO: 454083 - DNA, 25 bp, Rattus norvegicus
atcctcgatcctcgtggatctggcc

SEQ ID NO: 454084 - DNA, 25 bp, Rattus norvegicus
ccttcctggccgaggatgaacgcaa

SEQ ID NO: 454085 - DNA, 25 bp, Rattus norvegicus
ggcttggcctcccttgaatccggaa

SEQ ID NO: 454086 - DNA, 25 bp, Rattus norvegicus
cctgctacgccatcgggaaggacgt

SEQ ID NO: 454087 - DNA, 25 bp, Rattus norvegicus
ccagaggtccttacggtccttcgtg

SEQ ID NO: 454088 - DNA, 25 bp, Rattus norvegicus
ctgaagcgcattccgcagagcgtga

SEQ ID NO: 454089 - DNA, 25 bp, Rattus norvegicus
ctttcctaaagagatgctgaagcgc

SEQ ID NO: 454090 - DNA, 25 bp, Rattus norvegicus
ggctggaaactgctgcgcatctttc

SEQ ID NO: 454091 - DNA, 25 bp, Rattus norvegicus
gtccctacgagaaccgcacagtgtt

SEQ ID NO: 454092 - DNA, 25 bp, Rattus norvegicus
agcgtgacggacgagttctactctc

SEQ ID NO: 454093 - DNA, 25 bp, Rattus norvegicus
tagccctttccttctgggccagagg

SEQ ID NO: 454094 - DNA, 25 bp, Rattus norvegicus
gaagaatttcatcaaccaaggtggg

SEQ ID NO: 454095 - DNA, 25 bp, Rattus norvegicus
cctgcagaagttcgagaagaatttc

SEQ ID NO: 454096 - DNA, 25 bp, Rattus norvegicus
ctacctggagttcctgcagaagttc

SEQ ID NO: 454097 - DNA, 25 bp, Rattus norvegicus
tccgaggacctgctctacctggagt

SEQ ID NO: 454098 - DNA, 25 bp, Rattus norvegicus
cgctgaccactgctcttccgtagta

SEQ ID NO: 454099 - DNA, 25 bp, Rattus norvegicus
cacagtgttcgagtcgctggacctg

SEQ ID NO: 454100 - DNA, 25 bp, Rattus norvegicus
gcgagcatgttttgcctcgaaggca

SEQ ID NO: 454101 - DNA, 25 bp, Rattus norvegicus
ttcggcgctcctcggaggaagcccg

SEQ ID NO: 454102 - DNA, 25 bp, Rattus norvegicus
gtccgttcggcgctcctcggaggaa

SEQ ID NO: 454103 - DNA, 25 bp, Rattus norvegicus
ctgccctcgccctctggacacacac

SEQ ID NO: 454104 - DNA, 25 bp, Rattus norvegicus
cgacgcgaccgcgtcctgccctcgc

SEQ ID NO: 454105 - DNA, 25 bp, Rattus norvegicus
acgaccggcgatggtctaggcgccc

SEQ ID NO: 454106 - DNA, 25 bp, Rattus norvegicus
tactgaccgacgaccggcgatggtc

SEQ ID NO: 454107 - DNA, 25 bp, Rattus norvegicus
gaggcacgcagctactgaccgacga

SEQ ID NO: 454108 - DNA, 25 bp, Rattus norvegicus
cgctgagagaggcacgcagctactg

SEQ ID NO: 454109 - DNA, 25 bp, Rattus norvegicus
gctggcagcatttgactgtggcttg

SEQ ID NO: 454110 - DNA, 25 bp, Rattus norvegicus
ttgagtctataaccggctggccggg

SEQ ID NO: 454111 - DNA, 25 bp, Rattus norvegicus
ccaacattgagtctataaccggctg

SEQ ID NO: 454112 - DNA, 25 bp, Rattus norvegicus
tccctcggagactccaacattgagt

SEQ ID NO: 454113 - DNA, 25 bp, Rattus norvegicus
tgcctcgaaggcaagacttacagcc

SEQ ID NO: 454114 - DNA, 25 bp, Rattus norvegicus
cgcttactcgcccaagtcggaatat

SEQ ID NO: 454115 - DNA, 25 bp, Rattus norvegicus
cgcccaagtcggaatatacctacgg

SEQ ID NO: 454116 - DNA, 25 bp, Rattus norvegicus
gcttagctgccatgcgggctccaag

SEQ ID NO: 454117 - DNA, 25 bp, Rattus norvegicus
aatctcaatgggctcgcaggcaccg

SEQ ID NO: 454118 - DNA, 25 bp, Rattus norvegicus
taccaccaccagttcaatctcaatg

SEQ ID NO: 454119 - DNA, 25 bp, Rattus norvegicus
caacatgactactactcgggccagc

SEQ ID NO: 454120 - DNA, 25 bp, Rattus norvegicus
actgacctgggctattacagcgctc

SEQ ID NO: 454121 - DNA, 25 bp, Rattus norvegicus
tgcccgagtcttcggtcactgacct

SEQ ID NO: 454122 - DNA, 25 bp, Rattus norvegicus
tgccatgcgggctccaaggactcgc

SEQ ID NO: 454123 - DNA, 25 bp, Rattus norvegicus
tcctaccgacagtatggagcgtacc

SEQ ID NO: 454124 - DNA, 25 bp, Rattus norvegicus
atctccagctcgcttagctgccatg

SEQ ID NO: 454125 - DNA, 25 bp, Rattus norvegicus
agcggctccttcgatcgcaagctca

SEQ ID NO: 454126 - DNA, 25 bp, Rattus norvegicus
tcgccagcatgagcggctccttcga

SEQ ID NO: 454127 - DNA, 25 bp, Rattus norvegicus
gatcgcaagctcagcagcatcctca

SEQ ID NO: 454128 - DNA, 25 bp, Rattus norvegicus
gagtttttcgctgcctcggtgggca

SEQ ID NO: 454129 - DNA, 25 bp, Rattus norvegicus
gaggcgtcggtctaatgccgctaca

SEQ ID NO: 454130 - DNA, 25 bp, Rattus norvegicus
cagaactggggccttggattccaga

SEQ ID NO: 454131 - DNA, 25 bp, Rattus norvegicus
gaaaagagcagtcccgcctctctgc

SEQ ID NO: 454132 - DNA, 25 bp, Rattus norvegicus
cctctctgcacagggaagcacactg

SEQ ID NO: 454133 - DNA, 25 bp, Rattus norvegicus
gcaggcagaacacaactcgaaggtt

SEQ ID NO: 454134 - DNA, 25 bp, Rattus norvegicus
actcgaaggttcctagcagcgaccc

SEQ ID NO: 454135 - DNA, 25 bp, Rattus norvegicus
ccgaatcctcgcagatcaggtgggc

SEQ ID NO: 454136 - DNA, 25 bp, Rattus norvegicus
gctcaccctggtctggtcgatccta

SEQ ID NO: 454137 - DNA, 25 bp, Rattus norvegicus
tggtcgatcctagtacctccgaatc

SEQ ID NO: 454138 - DNA, 25 bp, Rattus norvegicus
ctccgaatcgtggaaccaaaaagtg

SEQ ID NO: 454139 - DNA, 25 bp, Rattus norvegicus
gtgatcgcgacctactccgagtttt

SEQ ID NO: 454140 - DNA, 25 bp, Rattus norvegicus
attggcttcggttctgtgtgaatcc

SEQ ID NO: 454141 - DNA, 25 bp, Rattus norvegicus
tgtgaatccggaacgcaaggaggtc

SEQ ID NO: 454142 - DNA, 25 bp, Rattus norvegicus
gcaaggatgcgtctccggaaccaaa

SEQ ID NO: 454143 - DNA, 25 bp, Rattus norvegicus
cagtaggaccaactcggggtcgtca

SEQ ID NO: 454144 - DNA, 25 bp, Rattus norvegicus
tcagcgcccagctgcaaaaagcggc

SEQ ID NO: 454145 - DNA, 25 bp, Rattus norvegicus
ccgacggccagagtgatgaatgcca

SEQ ID NO: 454146 - DNA, 25 bp, Rattus norvegicus
tgccacctggatgaacagcgacagc

SEQ ID NO: 454147 - DNA, 25 bp, Rattus norvegicus
ctcaagtcggtacgtaggatccgta

SEQ ID NO: 454148 - DNA, 25 bp, Rattus norvegicus
agcgacagccagctcagcacgtaca

SEQ ID NO: 454149 - DNA, 25 bp, Rattus norvegicus
gctcagcacgtacatgaaccacatg

SEQ ID NO: 454150 - DNA, 25 bp, Rattus norvegicus
ccggctcggaggatcaaaaaatcgc

SEQ ID NO: 454151 - DNA, 25 bp, Rattus norvegicus
caaaaaatcgcgctgcacccggtac

SEQ ID NO: 454152 - DNA, 25 bp, Rattus norvegicus
gagcgcctacacagaaaccggattg

SEQ ID NO: 454153 - DNA, 25 bp, Rattus norvegicus
gaaaccggattgactgggaccaata

SEQ ID NO: 454154 - DNA, 25 bp, Rattus norvegicus
tgggaccaatactggctcaagtcgg

SEQ ID NO: 454155 - DNA, 25 bp, Rattus norvegicus
ctccagaaggttcggcggaggtcca

SEQ ID NO: 454156 - DNA, 25 bp, Rattus norvegicus
cctacgcatgcgtgtcgtcatcaca

SEQ ID NO: 454157 - DNA, 25 bp, Rattus norvegicus
gcctttgtgctccatggcgcgacca

SEQ ID NO: 454158 - DNA, 25 bp, Rattus norvegicus
tgcgcgtgcgcatcccacaactaag

SEQ ID NO: 454159 - DNA, 25 bp, Rattus norvegicus
tggcagccttcggttccttcacaca

SEQ ID NO: 454160 - DNA, 25 bp, Rattus norvegicus
ggttccttcacacatcctctcagga

SEQ ID NO: 454161 - DNA, 25 bp, Rattus norvegicus
ctcaggagcctcagctgggttccgc

SEQ ID NO: 454162 - DNA, 25 bp, Rattus norvegicus
gccggcacttgaacagcggactgga

SEQ ID NO: 454163 - DNA, 25 bp, Rattus norvegicus
gtccacaccttgcttggtgcctttg

SEQ ID NO: 454164 - DNA, 25 bp, Rattus norvegicus
ggatgtagcatccacaccctacgca

SEQ ID NO: 454165 - DNA, 25 bp, Rattus norvegicus
tcatcacatgacaggggcggtgccc

SEQ ID NO: 454166 - DNA, 25 bp, Rattus norvegicus
tcgggcttgctacggcgagacctgc

SEQ ID NO: 454167 - DNA, 25 bp, Rattus norvegicus
gtgacggtagtatggccgcacttta

SEQ ID NO: 454168 - DNA, 25 bp, Rattus norvegicus
tatggccgcactttatggtggcgtg

SEQ ID NO: 454169 - DNA, 25 bp, Rattus norvegicus
agaggctgtctggacgcgacagcca

SEQ ID NO: 454170 - DNA, 25 bp, Rattus norvegicus
acacacagatgctccgggtgcggga

SEQ ID NO: 454171 - DNA, 25 bp, Rattus norvegicus
acatgaatgcggtgaggcactaata

SEQ ID NO: 454172 - DNA, 25 bp, Rattus norvegicus
catcgacatgaatgcggtgaggcac

SEQ ID NO: 454173 - DNA, 25 bp, Rattus norvegicus
aggagtacttccagcacgcttggtc

SEQ ID NO: 454174 - DNA, 25 bp, Rattus norvegicus
tacgccagcgcctcgaggagtactt

SEQ ID NO: 454175 - DNA, 25 bp, Rattus norvegicus
tgcgggagtttatccgcttccatca

SEQ ID NO: 454176 - DNA, 25 bp, Rattus norvegicus
ggcactaataggtgcggggccaccc

SEQ ID NO: 454177 - DNA, 25 bp, Rattus norvegicus
catccagcggctgtactcgggcacg

SEQ ID NO: 454178 - DNA, 25 bp, Rattus norvegicus
tgtccgccatcatccagcggctgta

SEQ ID NO: 454179 - DNA, 25 bp, Rattus norvegicus
tgccagcatcttcggcaacgtgtcc

SEQ ID NO: 454180 - DNA, 25 bp, Rattus norvegicus
agccctcatgtatgccagcatcttc

SEQ ID NO: 454181 - DNA, 25 bp, Rattus norvegicus
accggaccgcgagtgtcgttgacct

SEQ ID NO: 454182 - DNA, 25 bp, Rattus norvegicus
gtttatccgcttccatcagattccc

SEQ ID NO: 454183 - DNA, 25 bp, Rattus norvegicus
gctaccacacacagatgctccgggt

SEQ ID NO: 454184 - DNA, 25 bp, Rattus norvegicus
gccagtcattggctgccggacaacg

SEQ ID NO: 454185 - DNA, 25 bp, Rattus norvegicus
ttgagggcgaacctttcggaaggca

SEQ ID NO: 454186 - DNA, 25 bp, Rattus norvegicus
gtcatagcaaggatggtgaaaaaga

SEQ ID NO: 454187 - DNA, 25 bp, Rattus norvegicus
ccgggaaggagctttgcgcgctctc

SEQ ID NO: 454188 - DNA, 25 bp, Rattus norvegicus
gagctttgcgcgctctcggacagcc

SEQ ID NO: 454189 - DNA, 25 bp, Rattus norvegicus
ctagcgccagtcattggctgccgga

SEQ ID NO: 454190 - DNA, 25 bp, Rattus norvegicus
ctgtgtgcttcctcggatggccaga

SEQ ID NO: 454191 - DNA, 25 bp, Rattus norvegicus
tcctcggatggccagaggacccagc

SEQ ID NO: 454192 - DNA, 25 bp, Rattus norvegicus
ccgaggtctgtaccacagcacagcg

SEQ ID NO: 454193 - DNA, 25 bp, Rattus norvegicus
gagcgcgagccacggcgcacaaacg

SEQ ID NO: 454194 - DNA, 25 bp, Rattus norvegicus
gcgcacaaacgctcgaggtaccttg

SEQ ID NO: 454195 - DNA, 25 bp, Rattus norvegicus
acgctcgaggtaccttggcctcaca

SEQ ID NO: 454196 - DNA, 25 bp, Rattus norvegicus
cgaacctttcggaaggcaagagaga

SEQ ID NO: 454197 - DNA, 25 bp, Rattus norvegicus
cgcactcccgggcagtccgagagga

SEQ ID NO: 454198 - DNA, 25 bp, Rattus norvegicus
cacggagctcaacgcctggggacac

SEQ ID NO: 454199 - DNA, 25 bp, Rattus norvegicus
ggcgggaccctgcacggagctcaac

SEQ ID NO: 454200 - DNA, 25 bp, Rattus norvegicus
tctcctattggctggcttgttggtg

SEQ ID NO: 454201 - DNA, 25 bp, Rattus norvegicus
gcgaacgaggtgagggaggagctca

SEQ ID NO: 454202 - DNA, 25 bp, Rattus norvegicus
tggctggctgtcagttaaaggcgcg

SEQ ID NO: 454203 - DNA, 25 bp, Rattus norvegicus
cctgtggctgtcagtcactccctgg

SEQ ID NO: 454204 - DNA, 25 bp, Rattus norvegicus
ggattcccgcgctcgtctcctattg

SEQ ID NO: 454205 - DNA, 25 bp, Rattus norvegicus
aggagctcagagctgtgcaggtcgg

SEQ ID NO: 454206 - DNA, 25 bp, Rattus norvegicus
gcgttgcaggtgtcggactccctga

SEQ ID NO: 454207 - DNA, 25 bp, Rattus norvegicus
ttgcaggtgtcggactccctgaggc

SEQ ID NO: 454208 - DNA, 25 bp, Rattus norvegicus
tagacgcccgcgctgaggtttcaag

SEQ ID NO: 454209 - DNA, 25 bp, Rattus norvegicus
gtggctgtcagtcactccctggctc

SEQ ID NO: 454210 - DNA, 25 bp, Rattus norvegicus
tggctcctgcgctcgttgagcgctg

SEQ ID NO: 454211 - DNA, 25 bp, Rattus norvegicus
tgagcgcttcccttgtcccaggtgc

SEQ ID NO: 454212 - DNA, 25 bp, Rattus norvegicus
cctctcaggcctgacagctagcggg

SEQ ID NO: 454213 - DNA, 25 bp, Rattus norvegicus
taggcataggtagggccgctgcctt

SEQ ID NO: 454214 - DNA, 25 bp, Rattus norvegicus
tccctgtgaggtcgcggtcgactat

SEQ ID NO: 454215 - DNA, 25 bp, Rattus norvegicus
actattgtatgtgtcgcagccgctg

SEQ ID NO: 454216 - DNA, 25 bp, Rattus norvegicus
cgcagccgctgcgtacaagatggcg

SEQ ID NO: 454217 - DNA, 25 bp, Rattus norvegicus
cacggatgggatccagctgttagtc

SEQ ID NO: 454218 - DNA, 25 bp, Rattus norvegicus
ctaatgccgccgcttgcggaggagc

SEQ ID NO: 454219 - DNA, 25 bp, Rattus norvegicus
tagctgcttcgtcgctgtgactgga

SEQ ID NO: 454220 - DNA, 25 bp, Rattus norvegicus
gactggaggccgagtgctaaactgt

SEQ ID NO: 454221 - DNA, 25 bp, Rattus norvegicus
ccagtgagcaccgaagtcgagattg

SEQ ID NO: 454222 - DNA, 25 bp, Rattus norvegicus
tcgagattgttggtcctgggatgtc

SEQ ID NO: 454223 - DNA, 25 bp, Rattus norvegicus
ctttaggcgaagatgcgcatgcgtg

SEQ ID NO: 454224 - DNA, 25 bp, Rattus norvegicus
tccagctgttagtcggtaggcatag

SEQ ID NO: 454225 - DNA, 25 bp, Rattus norvegicus
ttgtcactcgctgaccgcgccgttg

SEQ ID NO: 454226 - DNA, 25 bp, Rattus norvegicus
gtttcctttccaggagaccctcaga

SEQ ID NO: 454227 - DNA, 25 bp, Rattus norvegicus
gacattcgtccagtgcctcgcagca

SEQ ID NO: 454228 - DNA, 25 bp, Rattus norvegicus
cgcgcagcctcgcattctaggctga

SEQ ID NO: 454229 - DNA, 25 bp, Rattus norvegicus
tgccagactctttggacccgtgctg

SEQ ID NO: 454230 - DNA, 25 bp, Rattus norvegicus
cttcgacgtttagtgccagactctt

SEQ ID NO: 454231 - DNA, 25 bp, Rattus norvegicus
gtgcctcgcagcagcgtttcctttc

SEQ ID NO: 454232 - DNA, 25 bp, Rattus norvegicus
cctcgcattctaggctgaccaagtc

SEQ ID NO: 454233 - DNA, 25 bp, Rattus norvegicus
gcagcagcgtttcctttccaggaga

SEQ ID NO: 454234 - DNA, 25 bp, Rattus norvegicus
atgggtgtaccttgtcccacgcgca

SEQ ID NO: 454235 - DNA, 25 bp, Rattus norvegicus
tgccctgtccttgcacgacattcgt

SEQ ID NO: 454236 - DNA, 25 bp, Rattus norvegicus
gtgcctggtctcattcttgctcctc

SEQ ID NO: 454237 - DNA, 25 bp, Rattus norvegicus
gaacaagacaccagtgcctggtctc

SEQ ID NO: 454238 - DNA, 25 bp, Rattus norvegicus
ggagaccctcagaacaagacaccag

SEQ ID NO: 454239 - DNA, 25 bp, Rattus norvegicus
gcacactccttcgacgtttagtgcc

SEQ ID NO: 454240 - DNA, 25 bp, Rattus norvegicus
taattggttctgcatagctcgggga

SEQ ID NO: 454241 - DNA, 25 bp, Rattus norvegicus
ggcggtaattggttctgcatagctc

SEQ ID NO: 454242 - DNA, 25 bp, Rattus norvegicus
atattatattaccacagggtgtgca

SEQ ID NO: 454243 - DNA, 25 bp, Rattus norvegicus
ggttctgcatagctcggggaaattg

SEQ ID NO: 454244 - DNA, 25 bp, Rattus norvegicus
ccgagatggagctcgcgcacccgct

SEQ ID NO: 454245 - DNA, 25 bp, Rattus norvegicus
cccggagtccagacgctgcggggag

SEQ ID NO: 454246 - DNA, 25 bp, Rattus norvegicus
cagcgcagagcaggcctggctcagc

SEQ ID NO: 454247 - DNA, 25 bp, Rattus norvegicus
ctccggcggtaattggttctgcata

SEQ ID NO: 454248 - DNA, 25 bp, Rattus norvegicus
taacaggaaagacgcagcgcgccga

SEQ ID NO: 454249 - DNA, 25 bp, Rattus norvegicus
aaataacaggaaagacgcagcgcgc

SEQ ID NO: 454250 - DNA, 25 bp, Rattus norvegicus
gcaccctcggggcagtaaatattat

SEQ ID NO: 454251 - DNA, 25 bp, Rattus norvegicus
accacagggtgtgcagtacgtgacc

SEQ ID NO: 454252 - DNA, 25 bp, Rattus norvegicus
cctcggggcagtaaatattatatta

SEQ ID NO: 454253 - DNA, 25 bp, Rattus norvegicus
acagggtgtgcagtacgtgacctga

SEQ ID NO: 454254 - DNA, 25 bp, Rattus norvegicus
agtgccggaaaccttcgtcgcattc

SEQ ID NO: 454255 - DNA, 25 bp, Rattus norvegicus
ggccgcaggccaaagattatttata

SEQ ID NO: 454256 - DNA, 25 bp, Rattus norvegicus
cttaacttaggaactggagcacccg

SEQ ID NO: 454257 - DNA, 25 bp, Rattus norvegicus
tctcctagggacacgtcggctcact

SEQ ID NO: 454258 - DNA, 25 bp, Rattus norvegicus
tcggctcactgtacccggagacagg

SEQ ID NO: 454259 - DNA, 25 bp, Rattus norvegicus
tactccagttagaagtgaacacgcc

SEQ ID NO: 454260 - DNA, 25 bp, Rattus norvegicus
aatggcttttccacatgcttctggg

SEQ ID NO: 454261 - DNA, 25 bp, Rattus norvegicus
cggcgccggctcctttaagagaagt

SEQ ID NO: 454262 - DNA, 25 bp, Rattus norvegicus
gggctcagagccacaactctccaga

SEQ ID NO: 454263 - DNA, 25 bp, Rattus norvegicus
gagtttcctctctgctccggtgtgg

SEQ ID NO: 454264 - DNA, 25 bp, Rattus norvegicus
cccgacggctaaacctgaagctgga

SEQ ID NO: 454265 - DNA, 25 bp, Rattus norvegicus
ggcacccacggaaggctgcttttag

SEQ ID NO: 454266 - DNA, 25 bp, Rattus norvegicus
cggagcctctcggaataaatatttc

SEQ ID NO: 454267 - DNA, 25 bp, Rattus norvegicus
ccgcctttgagtggtggtctcctag

SEQ ID NO: 454268 - DNA, 25 bp, Rattus norvegicus
ccatcgggagtgctctctggttgat

SEQ ID NO: 454269 - DNA, 25 bp, Rattus norvegicus
tccagggcccttcttctggacgccc

SEQ ID NO: 454270 - DNA, 25 bp, Rattus norvegicus
acccaagagggtcgccaagggcttg

SEQ ID NO: 454271 - DNA, 25 bp, Rattus norvegicus
cattagagccggtaacccaagaggg

SEQ ID NO: 454272 - DNA, 25 bp, Rattus norvegicus
ctctggcattagagccggtaaccca

SEQ ID NO: 454273 - DNA, 25 bp, Rattus norvegicus
gatccctctggcattagagccggta

SEQ ID NO: 454274 - DNA, 25 bp, Rattus norvegicus
tgtcgcgatccctctggcattagag

SEQ ID NO: 454275 - DNA, 25 bp, Rattus norvegicus
tcagtgtcgcgatccctctggcatt

SEQ ID NO: 454276 - DNA, 25 bp, Rattus norvegicus
aaccttcagtgtcgcgatccctctg

SEQ ID NO: 454277 - DNA, 25 bp, Rattus norvegicus
ggaaccttcagtgtcgcgatccctc

SEQ ID NO: 454278 - DNA, 25 bp, Rattus norvegicus
caagggaaccttcagtgtcgcgatc

SEQ ID NO: 454279 - DNA, 25 bp, Rattus norvegicus
tgatcaagggaaccttcagtgtcgc

SEQ ID NO: 454280 - DNA, 25 bp, Rattus norvegicus
tcgggagtgctctctggttgatcaa

SEQ ID NO: 454281 - DNA, 25 bp, Rattus norvegicus
gtgctctctggttgatcaagggaac

SEQ ID NO: 454282 - DNA, 25 bp, Rattus norvegicus
ccagtctctccgatgagcgggaatc

SEQ ID NO: 454283 - DNA, 25 bp, Rattus norvegicus
ataggcagcttgcagctcttgtcgc

SEQ ID NO: 454284 - DNA, 25 bp, Rattus norvegicus
caaacagcatgttggcggccgcttg

SEQ ID NO: 454285 - DNA, 25 bp, Rattus norvegicus
ctccaagccctcaaacagcatgttg

SEQ ID NO: 454286 - DNA, 25 bp, Rattus norvegicus
cgagggtggccagcgccgacaccaa

SEQ ID NO: 454287 - DNA, 25 bp, Rattus norvegicus
gaagcagcgtcacggacaccaggca

SEQ ID NO: 454288 - DNA, 25 bp, Rattus norvegicus
agctgctgcgacaccgccagaagca

SEQ ID NO: 454289 - DNA, 25 bp, Rattus norvegicus
agcgggaatcccatggagcccttgg

SEQ ID NO: 454290 - DNA, 25 bp, Rattus norvegicus
tgtagcaaccagtgaccagtctctc

SEQ ID NO: 454291 - DNA, 25 bp, Rattus norvegicus
cgagagcgcgcttacctgtagcaac

SEQ ID NO: 454292 - DNA, 25 bp, Rattus norvegicus
acttctggagcagctaggcgagagc

SEQ ID NO: 454293 - DNA, 25 bp, Rattus norvegicus
acacccgcggctagcggacttctgg

SEQ ID NO: 454294 - DNA, 25 bp, Rattus norvegicus
accagcgcttccgagtgtccgagct

SEQ ID NO: 454295 - DNA, 25 bp, Rattus norvegicus
cccatggagcccttggggataggca

SEQ ID NO: 454296 - DNA, 25 bp, Rattus norvegicus
tgtttatatagaggcgggagcagcg

SEQ ID NO: 454297 - DNA, 25 bp, Rattus norvegicus
ccagcacctacaaacggatgagatg

SEQ ID NO: 454298 - DNA, 25 bp, Rattus norvegicus
cgcatgcacacactcttgcgcgcgc

SEQ ID NO: 454299 - DNA, 25 bp, Rattus norvegicus
agacacatgcccgagcgcgcatgca

SEQ ID NO: 454300 - DNA, 25 bp, Rattus norvegicus
agatgagacacatgcccgagcgcgc

SEQ ID NO: 454301 - DNA, 25 bp, Rattus norvegicus
cggatgagatgagacacatgcccga

SEQ ID NO: 454302 - DNA, 25 bp, Rattus norvegicus
cctacaaacggatgagatgagacac

SEQ ID NO: 454303 - DNA, 25 bp, Rattus norvegicus
ctcagttcacctcgcgccttctctt

SEQ ID NO: 454304 - DNA, 25 bp, Rattus norvegicus
ggatcaaactcagttcacctcgcgc

SEQ ID NO: 454305 - DNA, 25 bp, Rattus norvegicus
ggcgcctcaggatcaaactcagttc

SEQ ID NO: 454306 - DNA, 25 bp, Rattus norvegicus
ttgtaggcgcctcaggatcaaactc

SEQ ID NO: 454307 - DNA, 25 bp, Rattus norvegicus
ggacccacttgtaggcgcctcagga

SEQ ID NO: 454308 - DNA, 25 bp, Rattus norvegicus
gctgccgagcgtgtgagctcccgcc

SEQ ID NO: 454309 - DNA, 25 bp, Rattus norvegicus
gccgagtccagcacctacaaacgga

SEQ ID NO: 454310 - DNA, 25 bp, Rattus norvegicus
atgggcagttccaccgcgcgcacag

SEQ ID NO: 454311 - DNA, 25 bp, Rattus norvegicus
tcgcccaagacgcaggacacccgcg

SEQ ID NO: 454312 - DNA, 25 bp, Rattus norvegicus
aaccgggacgctctcggaggacctg

SEQ ID NO: 454313 - DNA, 25 bp, Rattus norvegicus
ccggactgaagagctgctaaccaaa

SEQ ID NO: 454314 - DNA, 25 bp, Rattus norvegicus
tgaagagctgctaaccaaagcgagc

SEQ ID NO: 454315 - DNA, 25 bp, Rattus norvegicus
gcgcctcaccctctctcctcagaaa

SEQ ID NO: 454316 - DNA, 25 bp, Rattus norvegicus
cttgctccggactgaagagctgcta

SEQ ID NO: 454317 - DNA, 25 bp, Rattus norvegicus
cccagtacctgagcgtgggcccgat

SEQ ID NO: 454318 - DNA, 25 bp, Rattus norvegicus
ccgatgcaggccgtgtctgtgctct

SEQ ID NO: 454319 - DNA, 25 bp, Rattus norvegicus
gtctgtgctctcgatctctctcagg

SEQ ID NO: 454320 - DNA, 25 bp, Rattus norvegicus
atctctctcaggatccgctcgtgct

SEQ ID NO: 454321 - DNA, 25 bp, Rattus norvegicus
ttcacccgttccatcgcagggcgct

SEQ ID NO: 454322 - DNA, 25 bp, Rattus norvegicus
gcgcggccctctctcagcaaatacc

SEQ ID NO: 454323 - DNA, 25 bp, Rattus norvegicus
taaccaaagcgagcggcggcccact

SEQ ID NO: 454324 - DNA, 25 bp, Rattus norvegicus
ccaggtctaggcagtcgttctacga

SEQ ID NO: 454325 - DNA, 25 bp, Rattus norvegicus
ctcctggctctcttccttacaagta

SEQ ID NO: 454326 - DNA, 25 bp, Rattus norvegicus
ctggctctcttccttacaagtacgc

SEQ ID NO: 454327 - DNA, 25 bp, Rattus norvegicus
cttctggggtcctcctggctctctt

SEQ ID NO: 454328 - DNA, 25 bp, Rattus norvegicus
tctcttccttacaagtacgccggga

SEQ ID NO: 454329 - DNA, 25 bp, Rattus norvegicus
tccacgctctgctgggccaggtcta

SEQ ID NO: 454330 - DNA, 25 bp, Rattus norvegicus
ctaggcagtcgttctacgagaagtt

SEQ ID NO: 454331 - DNA, 25 bp, Rattus norvegicus
acgagaagttagtaggcacctgccc

SEQ ID NO: 454332 - DNA, 25 bp, Rattus norvegicus
cgctcgccggttagcctcctcacag

SEQ ID NO: 454333 - DNA, 25 bp, Rattus norvegicus
tcctcacagctgccctaacgtgggg

SEQ ID NO: 454334 - DNA, 25 bp, Rattus norvegicus
aaaaccggactggaatcgtggtgca

SEQ ID NO: 454335 - DNA, 25 bp, Rattus norvegicus
cgcgcgctgcgtgtgctactgcgag

SEQ ID NO: 454336 - DNA, 25 bp, Rattus norvegicus
cggactggaatcgtggtgcatgatc

SEQ ID NO: 454337 - DNA, 25 bp, Rattus norvegicus
tagttgccggtagagaagcggtccc

SEQ ID NO: 454338 - DNA, 25 bp, Rattus norvegicus
actgagacgtcagcgctcgggtaaa

SEQ ID NO: 454339 - DNA, 25 bp, Rattus norvegicus
aacgcaggcattggatcccggaacc

SEQ ID NO: 454340 - DNA, 25 bp, Rattus norvegicus
tctccgaagcggcaccggccttgaa

SEQ ID NO: 454341 - DNA, 25 bp, Rattus norvegicus
gctgttgaaaaggaacgcaggcatt

SEQ ID NO: 454342 - DNA, 25 bp, Rattus norvegicus
cgctcgggtaaaggagtcctgagaa

SEQ ID NO: 454343 - DNA, 25 bp, Rattus norvegicus
ttagccaatggggtttgagaggaac

SEQ ID NO: 454344 - DNA, 25 bp, Rattus norvegicus
tctgtgacctatctgtgcggcgaga

SEQ ID NO: 454345 - DNA, 25 bp, Rattus norvegicus
cgcgcccaggttctgtgacctatct

SEQ ID NO: 454346 - DNA, 25 bp, Rattus norvegicus
gtccggctagtgtgacgtcatctcc

SEQ ID NO: 454347 - DNA, 25 bp, Rattus norvegicus
gctgcgagggcccaagctccagcaa

SEQ ID NO: 454348 - DNA, 25 bp, Rattus norvegicus
tccctactcgcggtcagctgcgagg

SEQ ID NO: 454349 - DNA, 25 bp, Rattus norvegicus
caaatggtcatcgtagcgccgtcgc

SEQ ID NO: 454350 - DNA, 25 bp, Rattus norvegicus
gccttgaaggaaaaactggcaaatg

SEQ ID NO: 454351 - DNA, 25 bp, Rattus norvegicus
agtcctgagaaagcgggctgttgaa

SEQ ID NO: 454352 - DNA, 25 bp, Rattus norvegicus
gcacttaacccgcacggggcggagc

SEQ ID NO: 454353 - DNA, 25 bp, Rattus norvegicus
tacagagctcctccttcagttgccg

SEQ ID NO: 454354 - DNA, 25 bp, Rattus norvegicus
gcaactgttgcacgccggactcggt

SEQ ID NO: 454355 - DNA, 25 bp, Rattus norvegicus
gccggactcggtgcccaaatcggcg

SEQ ID NO: 454356 - DNA, 25 bp, Rattus norvegicus
aaatcggcggctgccagcaccactt

SEQ ID NO: 454357 - DNA, 25 bp, Rattus norvegicus
ggcccggctgctgcgtacagagctc

SEQ ID NO: 454358 - DNA, 25 bp, Rattus norvegicus
cttcagttgccgcagcatcgagtca

SEQ ID NO: 454359 - DNA, 25 bp, Rattus norvegicus
agcatcgagtcactgcgtgcgctta

SEQ ID NO: 454360 - DNA, 25 bp, Rattus norvegicus
tcactgcgtgcgcttagaagcaaca

SEQ ID NO: 454361 - DNA, 25 bp, Rattus norvegicus
cgcttagaagcaacaccgaaccggg

SEQ ID NO: 454362 - DNA, 25 bp, Rattus norvegicus
agcaacaccgaaccgggcgacagca

SEQ ID NO: 454363 - DNA, 25 bp, Rattus norvegicus
cttccatgcctggaactcagactca

SEQ ID NO: 454364 - DNA, 25 bp, Rattus norvegicus
agcctctcgggcctagggagctcgc

SEQ ID NO: 454365 - DNA, 25 bp, Rattus norvegicus
gtcagcacgcagacagcgcaaccta

SEQ ID NO: 454366 - DNA, 25 bp, Rattus norvegicus
caacacggtgttagggctctcgcac

SEQ ID NO: 454367 - DNA, 25 bp, Rattus norvegicus
gttctcagtagcagaggcagcccgc

SEQ ID NO: 454368 - DNA, 25 bp, Rattus norvegicus
agcatcgggaccctcttcacttcta

SEQ ID NO: 454369 - DNA, 25 bp, Rattus norvegicus
gaccatgttccagcccgcgactaag

SEQ ID NO: 454370 - DNA, 25 bp, Rattus norvegicus
taagcggggtttcaccatagagtcc

SEQ ID NO: 454371 - DNA, 25 bp, Rattus norvegicus
tggccgcctcagaagaaccgctcag

SEQ ID NO: 454372 - DNA, 25 bp, Rattus norvegicus
agctggtgttcccagaggccatgaa

SEQ ID NO: 454373 - DNA, 25 bp, Rattus norvegicus
ggctgtgttggtctctcacccaaga

SEQ ID NO: 454374 - DNA, 25 bp, Rattus norvegicus
agccttgactgtgagcgggcgatta

SEQ ID NO: 454375 - DNA, 25 bp, Rattus norvegicus
tgtcctcgctgtgtttgtgacccgg

SEQ ID NO: 454376 - DNA, 25 bp, Rattus norvegicus
tcaccgcttccagggtgagtgtcct

SEQ ID NO: 454377 - DNA, 25 bp, Rattus norvegicus
ggaatcgcttctttggtcaccgctt

SEQ ID NO: 454378 - DNA, 25 bp, Rattus norvegicus
gaggccatgaaccacccggctctga

SEQ ID NO: 454379 - DNA, 25 bp, Rattus norvegicus
ccaagaagtgagattgggaccgcca

SEQ ID NO: 454380 - DNA, 25 bp, Rattus norvegicus
gatcagctctcaggctcggaacatc

SEQ ID NO: 454381 - DNA, 25 bp, Rattus norvegicus
gatgctcacttcagtcccgttttga

SEQ ID NO: 454382 - DNA, 25 bp, Rattus norvegicus
tctcggggctaagaacccagccgtc

SEQ ID NO: 454383 - DNA, 25 bp, Rattus norvegicus
ctcggaagtccaatgggtgctgatc

SEQ ID NO: 454384 - DNA, 25 bp, Rattus norvegicus
gaccgcgcttgcgaactcggaagtc

SEQ ID NO: 454385 - DNA, 25 bp, Rattus norvegicus
caaaccgtgggctttttctctccag

SEQ ID NO: 454386 - DNA, 25 bp, Rattus norvegicus
ccagcggatacattgtggagttaca

SEQ ID NO: 454387 - DNA, 25 bp, Rattus norvegicus
tctgagccatcggtcccagcggata

SEQ ID NO: 454388 - DNA, 25 bp, Rattus norvegicus
cgggaagaacctgcgaagattaagc

SEQ ID NO: 454389 - DNA, 25 bp, Rattus norvegicus
ccagcaggcgaggtcaatactttct

SEQ ID NO: 454390 - DNA, 25 bp, Rattus norvegicus
ctggaggtgccttttgagagagatc

SEQ ID NO: 454391 - DNA, 25 bp, Rattus norvegicus
ctccggcgccgtgttttctggagaa

SEQ ID NO: 454392 - DNA, 25 bp, Rattus norvegicus
aggaaatttccgctgctctctgagc

SEQ ID NO: 454393 - DNA, 25 bp, Rattus norvegicus
tttccaactccgaagtgccgcagtc

SEQ ID NO: 454394 - DNA, 25 bp, Rattus norvegicus
accctcgggctgaagtgactttgca

SEQ ID NO: 454395 - DNA, 25 bp, Rattus norvegicus
gcctctcccgattggccgtgagcaa

SEQ ID NO: 454396 - DNA, 25 bp, Rattus norvegicus
caagagatttggctcggtgccctcc

SEQ ID NO: 454397 - DNA, 25 bp, Rattus norvegicus
gagttgcacccacgcagacctggtc

SEQ ID NO: 454398 - DNA, 25 bp, Rattus norvegicus
gtgactgtgtcacccgccaatagga

SEQ ID NO: 454399 - DNA, 25 bp, Rattus norvegicus
gagtgacccttcagaaccgctcgga

SEQ ID NO: 454400 - DNA, 25 bp, Rattus norvegicus
ccggcccatgctgcacaagactgga

SEQ ID NO: 454401 - DNA, 25 bp, Rattus norvegicus
ttgagaagcgtacgggccataccac

SEQ ID NO: 454402 - DNA, 25 bp, Rattus norvegicus
gagactgtcccgcagctcataagga

SEQ ID NO: 454403 - DNA, 25 bp, Rattus norvegicus
atcctagggcacacgcagcaccttg

SEQ ID NO: 454404 - DNA, 25 bp, Rattus norvegicus
atcaggtcgctataccggtgcacgc

SEQ ID NO: 454405 - DNA, 25 bp, Rattus norvegicus
ggcccgctggtctcatcactgaagc

SEQ ID NO: 454406 - DNA, 25 bp, Rattus norvegicus
gctccggagaatgacacagcgtttc

SEQ ID NO: 454407 - DNA, 25 bp, Rattus norvegicus
tgtatccgccatggtcactgacgcc

SEQ ID NO: 454408 - DNA, 25 bp, Rattus norvegicus
aagacctcgtccagagctacggttg

SEQ ID NO: 454409 - DNA, 25 bp, Rattus norvegicus
caccgtgtacgcgtcgctggtgctg

SEQ ID NO: 454410 - DNA, 25 bp, Rattus norvegicus
cagcacggtcacctggacgtgcgta

SEQ ID NO: 454411 - DNA, 25 bp, Rattus norvegicus
ttgcgtcttctccaccaccgaggtg

SEQ ID NO: 454412 - DNA, 25 bp, Rattus norvegicus
accattccgggcagccttgcgtctt

SEQ ID NO: 454413 - DNA, 25 bp, Rattus norvegicus
ggcggcagctcgaacgaacactctt

SEQ ID NO: 454414 - DNA, 25 bp, Rattus norvegicus
gcatctgtctcctgtgcccgcagga

SEQ ID NO: 454415 - DNA, 25 bp, Rattus norvegicus
gcagggcccgcatctgtctcctgtg

SEQ ID NO: 454416 - DNA, 25 bp, Rattus norvegicus
taagcacgagttcgcaggcggcgtt

SEQ ID NO: 454417 - DNA, 25 bp, Rattus norvegicus
tgcatggtggtaagcacgagttcgc

SEQ ID NO: 454418 - DNA, 25 bp, Rattus norvegicus
tccacaccgatgagcgagcggtgca

SEQ ID NO: 454419 - DNA, 25 bp, Rattus norvegicus
gaggtgctgtacttctctcggccca

SEQ ID NO: 454420 - DNA, 25 bp, Rattus norvegicus
agagctacggttgcccggcctagaa

SEQ ID NO: 454421 - DNA, 25 bp, Rattus norvegicus
tagaaacttgtccacaccgatgagc

SEQ ID NO: 454422 - DNA, 25 bp, Rattus norvegicus
ccgctgcttggtgaactcggagaga

SEQ ID NO: 454423 - DNA, 25 bp, Rattus norvegicus
tgcttggtgaactcggagagaaatc

SEQ ID NO: 454424 - DNA, 25 bp, Rattus norvegicus
gcgcccgctgcttggtgaactcgga

SEQ ID NO: 454425 - DNA, 25 bp, Rattus norvegicus
gcctgcgcccgctgcttggtgaact

SEQ ID NO: 454426 - DNA, 25 bp, Rattus norvegicus
gcctgcgccggcttgcgggtggcct

SEQ ID NO: 454427 - DNA, 25 bp, Rattus norvegicus
tatgttggctgcgttcacgtcgtaa

SEQ ID NO: 454428 - DNA, 25 bp, Rattus norvegicus
cctatgttggctgcgttcacgtcgt

SEQ ID NO: 454429 - DNA, 25 bp, Rattus norvegicus
ccaacctatgttggctgcgttcacg

SEQ ID NO: 454430 - DNA, 25 bp, Rattus norvegicus
gttccaacctatgttggctgcgttc

SEQ ID NO: 454431 - DNA, 25 bp, Rattus norvegicus
accgttccaacctatgttggctgcg

SEQ ID NO: 454432 - DNA, 25 bp, Rattus norvegicus
gaaccgttccaacctatgttggctg

SEQ ID NO: 454433 - DNA, 25 bp, Rattus norvegicus
tggaaccgttccaacctatgttggc

SEQ ID NO: 454434 - DNA, 25 bp, Rattus norvegicus
aacctatgttggctgcgttcacgtc

SEQ ID NO: 454435 - DNA, 25 bp, Rattus norvegicus
tggtgaactcggagagaaatccctc

SEQ ID NO: 454436 - DNA, 25 bp, Rattus norvegicus
acgcatggtgaacggcaagcccaag

SEQ ID NO: 454437 - DNA, 25 bp, Rattus norvegicus
aagcccagtatctggccttgcctga

SEQ ID NO: 454438 - DNA, 25 bp, Rattus norvegicus
tgcagcgccgtttccagaaagccca

SEQ ID NO: 454439 - DNA, 25 bp, Rattus norvegicus
tctactccagctatcagctggctgc

SEQ ID NO: 454440 - DNA, 25 bp, Rattus norvegicus
cgcgaacgatctactccagctatca

SEQ ID NO: 454441 - DNA, 25 bp, Rattus norvegicus
caagaaggtccgaaagccgcgaacg

SEQ ID NO: 454442 - DNA, 25 bp, Rattus norvegicus
aacgctcctccaagaagtctcgggg

SEQ ID NO: 454443 - DNA, 25 bp, Rattus norvegicus
ccgaggtacgcatggtgaacggcaa

SEQ ID NO: 454444 - DNA, 25 bp, Rattus norvegicus
cccttacagtgtcggtgaaagagga

SEQ ID NO: 454445 - DNA, 25 bp, Rattus norvegicus
caggctgagactaaactggtgtttt

SEQ ID NO: 454446 - DNA, 25 bp, Rattus norvegicus
ggtcgcaggctgagactaaactggt

SEQ ID NO: 454447 - DNA, 25 bp, Rattus norvegicus
cctcggtgggaactcatggaaaaca

SEQ ID NO: 454448 - DNA, 25 bp, Rattus norvegicus
tccaagaagtctcggggagatcagt

SEQ ID NO: 454449 - DNA, 25 bp, Rattus norvegicus
tccgaaagccgcgaacgatctactc

SEQ ID NO: 454450 - DNA, 25 bp, Rattus norvegicus
acaaaaaggtgacccgcgcagaagg

SEQ ID NO: 454451 - DNA, 25 bp, Rattus norvegicus
ttaggcagcgactcggtgctagaga

SEQ ID NO: 454452 - DNA, 25 bp, Rattus norvegicus
cccgtttaggcagcgactcggtgct

SEQ ID NO: 454453 - DNA, 25 bp, Rattus norvegicus
gaaggcagctagcagcctctgcaga

SEQ ID NO: 454454 - DNA, 25 bp, Rattus norvegicus
gctacgagcgaaggcagctagcagc

SEQ ID NO: 454455 - DNA, 25 bp, Rattus norvegicus
tgcagagcagcaaaggaagaaatgg

SEQ ID NO: 454456 - DNA, 25 bp, Rattus norvegicus
gattcgcttgagcacattgcagagc

SEQ ID NO: 454457 - DNA, 25 bp, Rattus norvegicus
accggattcgcttgagcacattgca

SEQ ID NO: 454458 - DNA, 25 bp, Rattus norvegicus
tcacgaccggattcgcttgagcaca

SEQ ID NO: 454459 - DNA, 25 bp, Rattus norvegicus
tggccacgccttaatcacgaccgga

SEQ ID NO: 454460 - DNA, 25 bp, Rattus norvegicus
ggcttgagatctggccacgccttaa

SEQ ID NO: 454461 - DNA, 25 bp, Rattus norvegicus
gagaggcttgagatctggccacgcc

SEQ ID NO: 454462 - DNA, 25 bp, Rattus norvegicus
cgtggcctctgcttgtgttggagga

SEQ ID NO: 454463 - DNA, 25 bp, Rattus norvegicus
gagctgcggtacaaaaaggtgaccc

SEQ ID NO: 454464 - DNA, 25 bp, Rattus norvegicus
aatgcgctaatccttctgccgcagc

SEQ ID NO: 454465 - DNA, 25 bp, Rattus norvegicus
gggccgctgtaaccactggtcccag

SEQ ID NO: 454466 - DNA, 25 bp, Rattus norvegicus
agtgcgggccgctgtaaccactggt

SEQ ID NO: 454467 - DNA, 25 bp, Rattus norvegicus
cccagccgcgattccgcccgcgagt

SEQ ID NO: 454468 - DNA, 25 bp, Rattus norvegicus
tatcagagattagggggccgcttca

SEQ ID NO: 454469 - DNA, 25 bp, Rattus norvegicus
actcgcaagtgtatcagagattagg

SEQ ID NO: 454470 - DNA, 25 bp, Rattus norvegicus
cgggaagcctactcgcaagtgtatc

SEQ ID NO: 454471 - DNA, 25 bp, Rattus norvegicus
ctgtttgctcgcgaagctggcccgg

SEQ ID NO: 454472 - DNA, 25 bp, Rattus norvegicus
gcccgcctgtttgctcgcgaagctg

SEQ ID NO: 454473 - DNA, 25 bp, Rattus norvegicus
aaatgctgcatttgggatgcggtgc

SEQ ID NO: 454474 - DNA, 25 bp, Rattus norvegicus
cgccctcactcaaatgctgcatttg

SEQ ID NO: 454475 - DNA, 25 bp, Rattus norvegicus
gctgaccagcctgcggcatccacat

SEQ ID NO: 454476 - DNA, 25 bp, Rattus norvegicus
atccttctgccgcagctggttgggc

SEQ ID NO: 454477 - DNA, 25 bp, Rattus norvegicus
attaggccacaaagggcgctgacca

SEQ ID NO: 454478 - DNA, 25 bp, Rattus norvegicus
cgtggaagtccgttttgtgagcagc

SEQ ID NO: 454479 - DNA, 25 bp, Rattus norvegicus
ttctccttctgcgtgggcgtggcag

SEQ ID NO: 454480 - DNA, 25 bp, Rattus norvegicus
gcgcactcttcctggagtaacccgg

SEQ ID NO: 454481 - DNA, 25 bp, Rattus norvegicus
tccgttttgtgagcagcgccaaggt

SEQ ID NO: 454482 - DNA, 25 bp, Rattus norvegicus
tcccggagagccattctggagtccg

SEQ ID NO: 454483 - DNA, 25 bp, Rattus norvegicus
cctcggcgctggtctggttcctgct

SEQ ID NO: 454484 - DNA, 25 bp, Rattus norvegicus
ctggtctggttcctgcttgggcccg

SEQ ID NO: 454485 - DNA, 25 bp, Rattus norvegicus
tcgtggcatgactcgtggcaatatc

SEQ ID NO: 454486 - DNA, 25 bp, Rattus norvegicus
atggcggcctccatgtgcgacgtgt

SEQ ID NO: 454487 - DNA, 25 bp, Rattus norvegicus
tcgtggcaatatcgcgcggggaaat

SEQ ID NO: 454488 - DNA, 25 bp, Rattus norvegicus
tatcgcgcggggaaattccagcctg

SEQ ID NO: 454489 - DNA, 25 bp, Rattus norvegicus
cctgggaccctgcatgcgcactctt

SEQ ID NO: 454490 - DNA, 25 bp, Rattus norvegicus
agggtcagtcctcgtggcatgactc

SEQ ID NO: 454491 - DNA, 25 bp, Rattus norvegicus
cctccatgtgcgacgtgttctcctt

SEQ ID NO: 454492 - DNA, 25 bp, Rattus norvegicus
caagaggcgccacagagctagaagc

SEQ ID NO: 454493 - DNA, 25 bp, Rattus norvegicus
tccaagatgatggtgagtggctccc

SEQ ID NO: 454494 - DNA, 25 bp, Rattus norvegicus
cgggctaacgtctcgccagaagctt

SEQ ID NO: 454495 - DNA, 25 bp, Rattus norvegicus
cggccacctcttagctaaccataga

SEQ ID NO: 454496 - DNA, 25 bp, Rattus norvegicus
actcgagttcctagagcgtccctgg

SEQ ID NO: 454497 - DNA, 25 bp, Rattus norvegicus
gcacgtctaccatggtgcctgggta

SEQ ID NO: 454498 - DNA, 25 bp, Rattus norvegicus
gccggtgttcagtgttgacatttca

SEQ ID NO: 454499 - DNA, 25 bp, Rattus norvegicus
ccgtgtggttgcagtgagatcactc

SEQ ID NO: 454500 - DNA, 25 bp, Rattus norvegicus
ctagaagccgctctgataaagtttc

SEQ ID NO: 454501 - DNA, 25 bp, Rattus norvegicus
gaacccggagctgatttgccaaaac

SEQ ID NO: 454502 - DNA, 25 bp, Rattus norvegicus
gtggcctcaacccagagctgcagtg

SEQ ID NO: 454503 - DNA, 25 bp, Rattus norvegicus
aggtgcttctcacagccggtgttca

SEQ ID NO: 454504 - DNA, 25 bp, Rattus norvegicus
tgacccgggacactgttctcaactt

SEQ ID NO: 454505 - DNA, 25 bp, Rattus norvegicus
ccaggctacctatgaaacgcacaga

SEQ ID NO: 454506 - DNA, 25 bp, Rattus norvegicus
tgtattccaggtgcgcgcgcaacga

SEQ ID NO: 454507 - DNA, 25 bp, Rattus norvegicus
gtctcgtaggtgtggctgtattcca

SEQ ID NO: 454508 - DNA, 25 bp, Rattus norvegicus
cgccgtcgcagatgctgttggtctt

SEQ ID NO: 454509 - DNA, 25 bp, Rattus norvegicus
cctggaaggacgtgctctcgaagac

SEQ ID NO: 454510 - DNA, 25 bp, Rattus norvegicus
ttcgatttcgcgtagcgcatagcgc

SEQ ID NO: 454511 - DNA, 25 bp, Rattus norvegicus
ctcgccgagtgggatttcgatttcg

SEQ ID NO: 454512 - DNA, 25 bp, Rattus norvegicus
aagccctcttcgtaggcgacgtccg

SEQ ID NO: 454513 - DNA, 25 bp, Rattus norvegicus
ggatcttgaggcgtgccaagccctc

SEQ ID NO: 454514 - DNA, 25 bp, Rattus norvegicus
ccagcttctccagggcgcggatctt

SEQ ID NO: 454515 - DNA, 25 bp, Rattus norvegicus
gcgctccagttcagcctgtagccga

SEQ ID NO: 454516 - DNA, 25 bp, Rattus norvegicus
tcctgtcgtgcagtctccaactctg

SEQ ID NO: 454517 - DNA, 25 bp, Rattus norvegicus
acaggctccggaagcgcttatgctc

SEQ ID NO: 454518 - DNA, 25 bp, Rattus norvegicus
gaagccagcagttccacgctcacgt

SEQ ID NO: 454519 - DNA, 25 bp, Rattus norvegicus
acgctcacgtccacttggcgcgaga

SEQ ID NO: 454520 - DNA, 25 bp, Rattus norvegicus
gctatgacctcactgacgttccatc

SEQ ID NO: 454521 - DNA, 25 bp, Rattus norvegicus
gacctcactgacgttccgtcaagga

SEQ ID NO: 454522 - DNA, 25 bp, Rattus norvegicus
tcaaggaagcatgcgctatgacctc

SEQ ID NO: 454523 - DNA, 25 bp, Rattus norvegicus
gctatgacctcactgacgttccgtc

SEQ ID NO: 454524 - DNA, 25 bp, Rattus norvegicus
acctcactgacgttccgtcaaggaa

SEQ ID NO: 454525 - DNA, 25 bp, Rattus norvegicus
tcaaggaagtatgcgctatgacctc

SEQ ID NO: 454526 - DNA, 25 bp, Rattus norvegicus
gtcaaggaagcatgcgctatgacct

SEQ ID NO: 454527 - DNA, 25 bp, Rattus norvegicus
ctcactgacgttccatcaagggagc

SEQ ID NO: 454528 - DNA, 25 bp, Rattus norvegicus
tgacctcactgacgttccatcaagg

SEQ ID NO: 454529 - DNA, 25 bp, Rattus norvegicus
caaggaagtatgcgctatgacctca

SEQ ID NO: 454530 - DNA, 25 bp, Rattus norvegicus
acctcactgacgttccatcaaggga

SEQ ID NO: 454531 - DNA, 25 bp, Rattus norvegicus
catcaagggagcatgcgctatgacc

SEQ ID NO: 454532 - DNA, 25 bp, Rattus norvegicus
tatgacctcactgacgttccgtcaa

SEQ ID NO: 454533 - DNA, 25 bp, Rattus norvegicus
tcaagggagcatgcgctatgacctc

SEQ ID NO: 454534 - DNA, 25 bp, Rattus norvegicus
ctttccagcaagaggggagcggcag

SEQ ID NO: 454535 - DNA, 25 bp, Rattus norvegicus
tctgctgcccacctttaatcagggc

SEQ ID NO: 454536 - DNA, 25 bp, Rattus norvegicus
ttccagttgtgtcctctgctgccca

SEQ ID NO: 454537 - DNA, 25 bp, Rattus norvegicus
ccttggagcttccagttgtgtcctc

SEQ ID NO: 454538 - DNA, 25 bp, Rattus norvegicus
gcattcctgtgccttggagcttcca

SEQ ID NO: 454539 - DNA, 25 bp, Rattus norvegicus
ggcaccaccaccaaggcattcctgt

SEQ ID NO: 454540 - DNA, 25 bp, Rattus norvegicus
tactactggggtgggagtgcaacct

SEQ ID NO: 454541 - DNA, 25 bp, Rattus norvegicus
cacgttttccgcagaagctggtggc

SEQ ID NO: 454542 - DNA, 25 bp, Rattus norvegicus
ctccggggcgggctttccagcaaga

SEQ ID NO: 454543 - DNA, 25 bp, Rattus norvegicus
aggggctcacgatgcgatcacgggc

SEQ ID NO: 454544 - DNA, 25 bp, Rattus norvegicus
ctaaggtccagagtcccagtgggtt

SEQ ID NO: 454545 - DNA, 25 bp, Rattus norvegicus
cttctccctctctaaggtccagagt

SEQ ID NO: 454546 - DNA, 25 bp, Rattus norvegicus
ttttccgcagaagctggtggcttgg

SEQ ID NO: 454547 - DNA, 25 bp, Rattus norvegicus
tgcccacctttaatcagggcctgtc

SEQ ID NO: 454548 - DNA, 25 bp, Rattus norvegicus
ggcagctgatggacagcaggtcctc

SEQ ID NO: 454549 - DNA, 25 bp, Rattus norvegicus
cctggatgaagaagctgccgctgta

SEQ ID NO: 454550 - DNA, 25 bp, Rattus norvegicus
cagacatgaggttgaagagggcctc

SEQ ID NO: 454551 - DNA, 25 bp, Rattus norvegicus
tgccaagcccaagatgccagacatg

SEQ ID NO: 454552 - DNA, 25 bp, Rattus norvegicus
gtaaaggtccggcaacaaggcatcg

SEQ ID NO: 454553 - DNA, 25 bp, Rattus norvegicus
ctcagatccggggagtaaaggtccg

SEQ ID NO: 454554 - DNA, 25 bp, Rattus norvegicus
cagcagcgtccagcgctggcgaagc

SEQ ID NO: 454555 - DNA, 25 bp, Rattus norvegicus
cctttgaaggccgaagcagcagcgt

SEQ ID NO: 454556 - DNA, 25 bp, Rattus norvegicus
ccacggcggaaaagcgtgcctccgg

SEQ ID NO: 454557 - DNA, 25 bp, Rattus norvegicus
tagagtctgctagccggaccgggca

SEQ ID NO: 454558 - DNA, 25 bp, Rattus norvegicus
tcacctggggccagcgagaaggcat

SEQ ID NO: 454559 - DNA, 25 bp, Rattus norvegicus
agggacggccaggaactctccgcct

SEQ ID NO: 454560 - DNA, 25 bp, Rattus norvegicus
ccaccagggctttggagaagtctgc

SEQ ID NO: 454561 - DNA, 25 bp, Rattus norvegicus
ggaagcttccctgcgacccacagtt

SEQ ID NO: 454562 - DNA, 25 bp, Rattus norvegicus
agctcggcctgtgacgtcgctgccg

SEQ ID NO: 454563 - DNA, 25 bp, Rattus norvegicus
aaagctcggcctgtgacgtcgctgc

SEQ ID NO: 454564 - DNA, 25 bp, Rattus norvegicus
tcgcgccgctacgtgcgcgcgagtc

SEQ ID NO: 454565 - DNA, 25 bp, Rattus norvegicus
agtccccagagcgtggagcctcgtg

SEQ ID NO: 454566 - DNA, 25 bp, Rattus norvegicus
tgagggccatgtgagagcccgggat

SEQ ID NO: 454567 - DNA, 25 bp, Rattus norvegicus
gccctccagtccgtagaatcactag

SEQ ID NO: 454568 - DNA, 25 bp, Rattus norvegicus
tccagtccgtagaatcactagttcg

SEQ ID NO: 454569 - DNA, 25 bp, Rattus norvegicus
gtccgtagaatcactagttcgagtc

SEQ ID NO: 454570 - DNA, 25 bp, Rattus norvegicus
cgtagaatcactagttcgagtcctc

SEQ ID NO: 454571 - DNA, 25 bp, Rattus norvegicus
gaatcactagttcgagtcctctgtt

SEQ ID NO: 454572 - DNA, 25 bp, Rattus norvegicus
actagttcgagtcctctgtttccca

SEQ ID NO: 454573 - DNA, 25 bp, Rattus norvegicus
gttcgagtcctctgtttcccattta

SEQ ID NO: 454574 - DNA, 25 bp, Rattus norvegicus
tcgagtcctctgtttcccatttaaa

SEQ ID NO: 454575 - DNA, 25 bp, Rattus norvegicus
gaaaaggaaagctcggcctgtgacg

SEQ ID NO: 454576 - DNA, 25 bp, Rattus norvegicus
tcctcttccacagacgcttggagcg

SEQ ID NO: 454577 - DNA, 25 bp, Rattus norvegicus
ggcaccagtacaggccggtagagca

SEQ ID NO: 454578 - DNA, 25 bp, Rattus norvegicus
tcctggccaaggtttctctctgacc

SEQ ID NO: 454579 - DNA, 25 bp, Rattus norvegicus
cctgaccgtcctggccaaggtttct

SEQ ID NO: 454580 - DNA, 25 bp, Rattus norvegicus
acgagctggctaaagcctggctgca

SEQ ID NO: 454581 - DNA, 25 bp, Rattus norvegicus
ttaacagcgagtcccagctgcaaga

SEQ ID NO: 454582 - DNA, 25 bp, Rattus norvegicus
ttggattttaacagcgagtcccagc

SEQ ID NO: 454583 - DNA, 25 bp, Rattus norvegicus
cggaggtggacttggattttaacag

SEQ ID NO: 454584 - DNA, 25 bp, Rattus norvegicus
agcgaccgaggaggcccggacctct

SEQ ID NO: 454585 - DNA, 25 bp, Rattus norvegicus
aggacctgccatggcctgacgagct

SEQ ID NO: 454586 - DNA, 25 bp, Rattus norvegicus
gcttggagcgcgacgccaacatgga

SEQ ID NO: 454587 - DNA, 25 bp, Rattus norvegicus
aaaggacgtagccagttgcggccca

SEQ ID NO: 454588 - DNA, 25 bp, Rattus norvegicus
caacgcgcgcgctggttggcagctc

SEQ ID NO: 454589 - DNA, 25 bp, Rattus norvegicus
acgccaacatggagccggaggacct

SEQ ID NO: 454590 - DNA, 25 bp, Rattus norvegicus
gtcttgcgggtctacatgacccatg

SEQ ID NO: 454591 - DNA, 25 bp, Rattus norvegicus
gtctacatgacccatgcagccatgg

SEQ ID NO: 454592 - DNA, 25 bp, Rattus norvegicus
gacccatgcagccatggctctgcga

SEQ ID NO: 454593 - DNA, 25 bp, Rattus norvegicus
ccatgcagccatggctctgcgaggg

SEQ ID NO: 454594 - DNA, 25 bp, Rattus norvegicus
ctgcgagggagtggaaagcagatcc

SEQ ID NO: 454595 - DNA, 25 bp, Rattus norvegicus
gagcctggcacgctgtgaccgccgc

SEQ ID NO: 454596 - DNA, 25 bp, Rattus norvegicus
cttattcagcgcgtcggaatgcgta

SEQ ID NO: 454597 - DNA, 25 bp, Rattus norvegicus
ctctgcgcgtcttgcgggtctacat

SEQ ID NO: 454598 - DNA, 25 bp, Rattus norvegicus
cagcgcgtcggaatgcgtagctgca

SEQ ID NO: 454599 - DNA, 25 bp, Rattus norvegicus
tcggaatgcgtagctgcagagcgaa

SEQ ID NO: 454600 - DNA, 25 bp, Rattus norvegicus
cgtagctgcagagcgaaggcagttt

SEQ ID NO: 454601 - DNA, 25 bp, Rattus norvegicus
cgaaggcagtttgttggtaaacaga

SEQ ID NO: 454602 - DNA, 25 bp, Rattus norvegicus
gtttgttggtaaacagacgctggag

SEQ ID NO: 454603 - DNA, 25 bp, Rattus norvegicus
ccggccgcttattcagcgcgtcgga

SEQ ID NO: 454604 - DNA, 25 bp, Rattus norvegicus
gctgtacttacagggcaccggcacg

SEQ ID NO: 454605 - DNA, 25 bp, Rattus norvegicus
tgggagtcttcagcctcatcctgcc

SEQ ID NO: 454606 - DNA, 25 bp, Rattus norvegicus
cgctacttgctaagcgctgtactta

SEQ ID NO: 454607 - DNA, 25 bp, Rattus norvegicus
actggctgggcgctacttgctaagc

SEQ ID NO: 454608 - DNA, 25 bp, Rattus norvegicus
atcggctactcagcgcgttgtgact

SEQ ID NO: 454609 - DNA, 25 bp, Rattus norvegicus
atcctgccactgcaggtcggagaca

SEQ ID NO: 454610 - DNA, 25 bp, Rattus norvegicus
agcccgggcgctctgggagtcttca

SEQ ID NO: 454611 - DNA, 25 bp, Rattus norvegicus
aagcctgtggccgaaagtcagccga

SEQ ID NO: 454612 - DNA, 25 bp, Rattus norvegicus
cccgagggactggagaataagcctg

SEQ ID NO: 454613 - DNA, 25 bp, Rattus norvegicus
tcaggaggctatgaacccgagggac

SEQ ID NO: 454614 - DNA, 25 bp, Rattus norvegicus
tggcccgcatagactcaggaggcta

SEQ ID NO: 454615 - DNA, 25 bp, Rattus norvegicus
aatactgtcgtgctccaacctgggc

SEQ ID NO: 454616 - DNA, 25 bp, Rattus norvegicus
ccggcacgagaaagtggaggcaata

SEQ ID NO: 454617 - DNA, 25 bp, Rattus norvegicus
cggagacaccgtctgcatcgacctg

SEQ ID NO: 454618 - DNA, 25 bp, Rattus norvegicus
tcagcctccggtatcgcctgcaggc

SEQ ID NO: 454619 - DNA, 25 bp, Rattus norvegicus
cttcgctctcaaaacggtcactgca

SEQ ID NO: 454620 - DNA, 25 bp, Rattus norvegicus
ttgccacacggcttagacgatcatg

SEQ ID NO: 454621 - DNA, 25 bp, Rattus norvegicus
tgggcggaacccactaccattttgc

SEQ ID NO: 454622 - DNA, 25 bp, Rattus norvegicus
actgcacggaaagggctatggctcc

SEQ ID NO: 454623 - DNA, 25 bp, Rattus norvegicus
aacggtcactgcacggaaagggcta

SEQ ID NO: 454624 - DNA, 25 bp, Rattus norvegicus
atgcacacttcgctctcaaaacggt

SEQ ID NO: 454625 - DNA, 25 bp, Rattus norvegicus
acactgacgaagacatgcacacttc

SEQ ID NO: 454626 - DNA, 25 bp, Rattus norvegicus
gtgacaaacactgacgaagacatgc

SEQ ID NO: 454627 - DNA, 25 bp, Rattus norvegicus
cttgggagggctcgtgacaaacact

SEQ ID NO: 454628 - DNA, 25 bp, Rattus norvegicus
ccggagccgcactcctgagactatg

SEQ ID NO: 454629 - DNA, 25 bp, Rattus norvegicus
acacggcttagacgatcatgtcccg

SEQ ID NO: 454630 - DNA, 25 bp, Rattus norvegicus
actcctgagactatgtcgctctcca

SEQ ID NO: 454631 - DNA, 25 bp, Rattus norvegicus
accattttgccacacggcttagacg

SEQ ID NO: 454632 - DNA, 25 bp, Rattus norvegicus
cgccagacgtgccagagcagccaaa

SEQ ID NO: 454633 - DNA, 25 bp, Rattus norvegicus
cgaggccagagagaacgccaagact

SEQ ID NO: 454634 - DNA, 25 bp, Rattus norvegicus
acgccaagactctgggccaccaagg

SEQ ID NO: 454635 - DNA, 25 bp, Rattus norvegicus
tctgggccaccaaggcagccggaac

SEQ ID NO: 454636 - DNA, 25 bp, Rattus norvegicus
agcgccttacctttccgggatctgg

SEQ ID NO: 454637 - DNA, 25 bp, Rattus norvegicus
cgccgtgatgacgtcacacgtcgcg

SEQ ID NO: 454638 - DNA, 25 bp, Rattus norvegicus
gatctggtttttgcccttcttcttg

SEQ ID NO: 454639 - DNA, 25 bp, Rattus norvegicus
gagcccggtccggacagacctgaga

SEQ ID NO: 454640 - DNA, 25 bp, Rattus norvegicus
ccactggttcatgtgggcgcagaga

SEQ ID NO: 454641 - DNA, 25 bp, Rattus norvegicus
gcgacctcagggctgccagaaaacg

SEQ ID NO: 454642 - DNA, 25 bp, Rattus norvegicus
gggctgccagaaaacgccgccggaa

SEQ ID NO: 454643 - DNA, 25 bp, Rattus norvegicus
ccggcaaaggaacgcgccgcgtcga

SEQ ID NO: 454644 - DNA, 25 bp, Rattus norvegicus
gtcgatgcctcgctagtgcgcatgc

SEQ ID NO: 454645 - DNA, 25 bp, Rattus norvegicus
gtatcggccataatgccactggttc

SEQ ID NO: 454646 - DNA, 25 bp, Rattus norvegicus
tccaggaagcggatctcagagtaga

SEQ ID NO: 454647 - DNA, 25 bp, Rattus norvegicus
tctcagagtagaggagcgctgccca

SEQ ID NO: 454648 - DNA, 25 bp, Rattus norvegicus
ccacagcaggcagatccctagggta

SEQ ID NO: 454649 - DNA, 25 bp, Rattus norvegicus
ccacgcagcggaatagccgtgagtc

SEQ ID NO: 454650 - DNA, 25 bp, Rattus norvegicus
ccgccgagtacaaggtagggcatca

SEQ ID NO: 454651 - DNA, 25 bp, Rattus norvegicus
atctagggcctttgtcccgagctgc

SEQ ID NO: 454652 - DNA, 25 bp, Rattus norvegicus
gcctgcctcagggacgcagatctag

SEQ ID NO: 454653 - DNA, 25 bp, Rattus norvegicus
ggctctggacttgactctgactgca

SEQ ID NO: 454654 - DNA, 25 bp, Rattus norvegicus
cactgctgggagctcacacttcttc

SEQ ID NO: 454655 - DNA, 25 bp, Rattus norvegicus
cctagggtactggagccacagaatg

SEQ ID NO: 454656 - DNA, 25 bp, Rattus norvegicus
gtgtgcctgctacacccagaaggtg

SEQ ID NO: 454657 - DNA, 25 bp, Rattus norvegicus
tggggcattccaggtccagtgtgcc

SEQ ID NO: 454658 - DNA, 25 bp, Rattus norvegicus
tgaccgcgagctcagtttcagcctg

SEQ ID NO: 454659 - DNA, 25 bp, Rattus norvegicus
ggctctgcggctctgtcatattgag

SEQ ID NO: 454660 - DNA, 25 bp, Rattus norvegicus
ttcgccttcgacttgaagctctcct

SEQ ID NO: 454661 - DNA, 25 bp, Rattus norvegicus
agatttctgtggtgctcttgagtcc

SEQ ID NO: 454662 - DNA, 25 bp, Rattus norvegicus
gccttagcatatttcgtgtcccggg

SEQ ID NO: 454663 - DNA, 25 bp, Rattus norvegicus
agctcgctctgctagcgctgggtac

SEQ ID NO: 454664 - DNA, 25 bp, Rattus norvegicus
cctggtggtcctagccttagcatat

SEQ ID NO: 454665 - DNA, 25 bp, Rattus norvegicus
cttgagtccgcttgggagagcagaa

SEQ ID NO: 454666 - DNA, 25 bp, Rattus norvegicus
gagtgtacgagccacccggagtcac

SEQ ID NO: 454667 - DNA, 25 bp, Rattus norvegicus
ccggagtcaccgagaactgtgaagc

SEQ ID NO: 454668 - DNA, 25 bp, Rattus norvegicus
cttgaactttactctgcgcggcgtt

SEQ ID NO: 454669 - DNA, 25 bp, Rattus norvegicus
ccgggcccgctctagaaagatttct

SEQ ID NO: 454670 - DNA, 25 bp, Rattus norvegicus
ccaaagcctcctgagcgccggttgt

SEQ ID NO: 454671 - DNA, 25 bp, Rattus norvegicus
ctcgccaaccgcaaagagcgcggtg

SEQ ID NO: 454672 - DNA, 25 bp, Rattus norvegicus
cggccatgagatccggcttgaactt

SEQ ID NO: 454673 - DNA, 25 bp, Rattus norvegicus
gggtacgtaggcaacactcgatgtc

SEQ ID NO: 454674 - DNA, 25 bp, Rattus norvegicus
ctgcagttgcttaacctggacgcca

SEQ ID NO: 454675 - DNA, 25 bp, Rattus norvegicus
ccttcgggctatccagtgttgattc

SEQ ID NO: 454676 - DNA, 25 bp, Rattus norvegicus
caccaggttgaaatcccttcgggct

SEQ ID NO: 454677 - DNA, 25 bp, Rattus norvegicus
cggcccaggagaaccaccaggttga

SEQ ID NO: 454678 - DNA, 25 bp, Rattus norvegicus
cgcgcgcccaaacgggattggaaat

SEQ ID NO: 454679 - DNA, 25 bp, Rattus norvegicus
cggaggtgcagcaacttcgagtgca

SEQ ID NO: 454680 - DNA, 25 bp, Rattus norvegicus
gacgctgtggtttgagaatcccgca

SEQ ID NO: 454681 - DNA, 25 bp, Rattus norvegicus
atccggttcagtgggcgggactcaa

SEQ ID NO: 454682 - DNA, 25 bp, Rattus norvegicus
cgggaaagggaatgctactgagaac

SEQ ID NO: 454683 - DNA, 25 bp, Rattus norvegicus
cggcgcgcttctcttgcctgcagtt

SEQ ID NO: 454684 - DNA, 25 bp, Rattus norvegicus
gtgttgattcagacgccacgaaccc

SEQ ID NO: 454685 - DNA, 25 bp, Rattus norvegicus
ctcccgcctggcctcggttaggagt

SEQ ID NO: 454686 - DNA, 25 bp, Rattus norvegicus
ctactgagaacaagggcgcaatggc

SEQ ID NO: 454687 - DNA, 25 bp, Rattus norvegicus
ctgtggacgctatggtgaaaagtgt

SEQ ID NO: 454688 - DNA, 25 bp, Rattus norvegicus
tccggcttgcaagagcgagttctcc

SEQ ID NO: 454689 - DNA, 25 bp, Rattus norvegicus
gcatctcaggataaggaggtccttg

SEQ ID NO: 454690 - DNA, 25 bp, Rattus norvegicus
ggtgcgatcagagaaaagattacca

SEQ ID NO: 454691 - DNA, 25 bp, Rattus norvegicus
taccaatgcaaagaggcctgtcgtg

SEQ ID NO: 454692 - DNA, 25 bp, Rattus norvegicus
cgtggacacgcagggtcctcatctc

SEQ ID NO: 454693 - DNA, 25 bp, Rattus norvegicus
tcctcatctcggatgggtctgcaag

SEQ ID NO: 454694 - DNA, 25 bp, Rattus norvegicus
ggtagacgcctttcagcccggctta

SEQ ID NO: 454695 - DNA, 25 bp, Rattus norvegicus
tactcctgcgctatcgatcccgagg

SEQ ID NO: 454696 - DNA, 25 bp, Rattus norvegicus
tcgatcccgaggctagggtttcagc

SEQ ID NO: 454697 - DNA, 25 bp, Rattus norvegicus
ttgagccgcgagaagtcgcaaggca

SEQ ID NO: 454698 - DNA, 25 bp, Rattus norvegicus
gcgggtctgacctggactgcaaccc

SEQ ID NO: 454699 - DNA, 25 bp, Rattus norvegicus
ggcctcagcgccctaaacggagatc

SEQ ID NO: 454700 - DNA, 25 bp, Rattus norvegicus
ccgagccttggtagacgcctttcag

SEQ ID NO: 454701 - DNA, 25 bp, Rattus norvegicus
agctgcgcgagccagttaactctgc

SEQ ID NO: 454702 - DNA, 25 bp, Rattus norvegicus
tccgagagctccagatgacaccgca

SEQ ID NO: 454703 - DNA, 25 bp, Rattus norvegicus
gagtcccaagcatgcgcactgggtc

SEQ ID NO: 454704 - DNA, 25 bp, Rattus norvegicus
gaggacgagacgaagccaacttggc

SEQ ID NO: 454705 - DNA, 25 bp, Rattus norvegicus
cgccacacgcggcagttgggagcac

SEQ ID NO: 454706 - DNA, 25 bp, Rattus norvegicus
ctcggttttcttcttgctactcttc

SEQ ID NO: 454707 - DNA, 25 bp, Rattus norvegicus
cttcgcgagccgcaagtttcttctc

SEQ ID NO: 454708 - DNA, 25 bp, Rattus norvegicus
ccagcagcttggcttcttcgcgagc

SEQ ID NO: 454709 - DNA, 25 bp, Rattus norvegicus
cctcatgttgttcatgacgcccatg

SEQ ID NO: 454710 - DNA, 25 bp, Rattus norvegicus
actggaggagactggttacacaacc

SEQ ID NO: 454711 - DNA, 25 bp, Rattus norvegicus
accgcacggcaacggaaggctccag

SEQ ID NO: 454712 - DNA, 25 bp, Rattus norvegicus
tagcaacccgctgcgtcgcgcggtt

SEQ ID NO: 454713 - DNA, 25 bp, Rattus norvegicus
gcagtgcgtcacagccacgcgacgt

SEQ ID NO: 454714 - DNA, 25 bp, Rattus norvegicus
ggctccaggcctcacggagactgga

SEQ ID NO: 454715 - DNA, 25 bp, Rattus norvegicus
cagttgcaagcaaagggagtcccaa

SEQ ID NO: 454716 - DNA, 25 bp, Rattus norvegicus
tggtccgcacgttcaggcgtcccat

SEQ ID NO: 454717 - DNA, 25 bp, Rattus norvegicus
gtcttcccaacgctgggctctgtta

SEQ ID NO: 454718 - DNA, 25 bp, Rattus norvegicus
gcatggttacctcagtgcctgtgcc

SEQ ID NO: 454719 - DNA, 25 bp, Rattus norvegicus
aaagccggaagtggcactgaggtcc

SEQ ID NO: 454720 - DNA, 25 bp, Rattus norvegicus
ctggtcccggtgatcgtgaaagccg

SEQ ID NO: 454721 - DNA, 25 bp, Rattus norvegicus
ttctcctgacttgcccgtgctgctg

SEQ ID NO: 454722 - DNA, 25 bp, Rattus norvegicus
agtcggctcgatcgagactcgccag

SEQ ID NO: 454723 - DNA, 25 bp, Rattus norvegicus
ctgaagagtcgccatgagcaaagcc

SEQ ID NO: 454724 - DNA, 25 bp, Rattus norvegicus
tcgccgttgtgctgagctcactgaa

SEQ ID NO: 454725 - DNA, 25 bp, Rattus norvegicus
acgtcagataccagcgccaagcctg

SEQ ID NO: 454726 - DNA, 25 bp, Rattus norvegicus
tcgcgcggtagtgacgtcagatacc

SEQ ID NO: 454727 - DNA, 25 bp, Rattus norvegicus
cggaaagcaattggctcgcgcggta

SEQ ID NO: 454728 - DNA, 25 bp, Rattus norvegicus
ggcgtcccatcagtatcgcgagata

SEQ ID NO: 454729 - DNA, 25 bp, Rattus norvegicus
cgggcggccaaaggctatctggata

SEQ ID NO: 454730 - DNA, 25 bp, Rattus norvegicus
tctagctcctagagccgagggcctc

SEQ ID NO: 454731 - DNA, 25 bp, Rattus norvegicus
cccaggctggagctgtacggatacc

SEQ ID NO: 454732 - DNA, 25 bp, Rattus norvegicus
agctgtacggataccgagtccctga

SEQ ID NO: 454733 - DNA, 25 bp, Rattus norvegicus
ataccgagtccctgactagcacacg

SEQ ID NO: 454734 - DNA, 25 bp, Rattus norvegicus
catatttgggagcacacacggccgg

SEQ ID NO: 454735 - DNA, 25 bp, Rattus norvegicus
tctccaccatgtcgcgggaagaccg

SEQ ID NO: 454736 - DNA, 25 bp, Rattus norvegicus
gaagaccgacctaggcatctccgcg

SEQ ID NO: 454737 - DNA, 25 bp, Rattus norvegicus
cgcacttaccgatcttttccggagg

SEQ ID NO: 454738 - DNA, 25 bp, Rattus norvegicus
gagcccaccagcgtagcggcgaagc

SEQ ID NO: 454739 - DNA, 25 bp, Rattus norvegicus
atggcctcccgcagctgcaaactga

SEQ ID NO: 454740 - DNA, 25 bp, Rattus norvegicus
cagctgcaaactgaccgcgggtccg

SEQ ID NO: 454741 - DNA, 25 bp, Rattus norvegicus
cagcagaccctgctctatgcgtctg

SEQ ID NO: 454742 - DNA, 25 bp, Rattus norvegicus
ctctatgcgtctgcgcgcgtttgcc

SEQ ID NO: 454743 - DNA, 25 bp, Rattus norvegicus
gagggcgtctagctcctagagccga

SEQ ID NO: 454744 - DNA, 25 bp, Rattus norvegicus
cagtgccgagcgcccctgtaatttc

SEQ ID NO: 454745 - DNA, 25 bp, Rattus norvegicus
agacggcgcccagacggccttgccc

SEQ ID NO: 454746 - DNA, 25 bp, Rattus norvegicus
ccgcgcttaccgcaggattccgccc

SEQ ID NO: 454747 - DNA, 25 bp, Rattus norvegicus
cctccgagggcgcagacaatggggt

SEQ ID NO: 454748 - DNA, 25 bp, Rattus norvegicus
cgcagacaatggggtcgctgtgccc

SEQ ID NO: 454749 - DNA, 25 bp, Rattus norvegicus
cccaaagctgctttcaatttaaacg

SEQ ID NO: 454750 - DNA, 25 bp, Rattus norvegicus
gctgctttcaatttaaacgcctcca

SEQ ID NO: 454751 - DNA, 25 bp, Rattus norvegicus
cccgagaccggagacggcgcccaga

SEQ ID NO: 454752 - DNA, 25 bp, Rattus norvegicus
aacgcctccaaacagcgggtgctgc

SEQ ID NO: 454753 - DNA, 25 bp, Rattus norvegicus
cttgcccgggtcgtgggagcgccac

SEQ ID NO: 454754 - DNA, 25 bp, Rattus norvegicus
ctgtaatttccgcagggagctgacc

SEQ ID NO: 454755 - DNA, 25 bp, Rattus norvegicus
gtaatttccgcagggagctgaccgg

SEQ ID NO: 454756 - DNA, 25 bp, Rattus norvegicus
ggagctgaccggctcaaacacggcc

SEQ ID NO: 454757 - DNA, 25 bp, Rattus norvegicus
ttaaacgcctccaaacagcgggtgc

SEQ ID NO: 454758 - DNA, 25 bp, Rattus norvegicus
cgccatcttggatcggggtttcatt

SEQ ID NO: 454759 - DNA, 25 bp, Rattus norvegicus
acgggcatttttgtgtaatcgctgc

SEQ ID NO: 454760 - DNA, 25 bp, Rattus norvegicus
tgccaaagaagaaagcgaagtagcc

SEQ ID NO: 454761 - DNA, 25 bp, Rattus norvegicus
agcgaagtagcctccagtcaagcga

SEQ ID NO: 454762 - DNA, 25 bp, Rattus norvegicus
gaggccggctcttccgcagccatag

SEQ ID NO: 454763 - DNA, 25 bp, Rattus norvegicus
gcagccatagccacctcaacgattt

SEQ ID NO: 454764 - DNA, 25 bp, Rattus norvegicus
cctcaacgatttgggaggtagcgaa

SEQ ID NO: 454765 - DNA, 25 bp, Rattus norvegicus
ccgcgactgcagcagccatggagga

SEQ ID NO: 454766 - DNA, 25 bp, Rattus norvegicus
tggaggacgagatgcccaagactct

SEQ ID NO: 454767 - DNA, 25 bp, Rattus norvegicus
actctgtgagtctggagcagcgttg

SEQ ID NO: 454768 - DNA, 25 bp, Rattus norvegicus
tgcgcctctctgcagcttattgttc

SEQ ID NO: 454769 - DNA, 25 bp, Rattus norvegicus
cagcttattgttctccgtggacgcc

SEQ ID NO: 454770 - DNA, 25 bp, Rattus norvegicus
tgcgcacgccaggatgcttagagcc

SEQ ID NO: 454771 - DNA, 25 bp, Rattus norvegicus
gtcactcggctgtcggctcctaagc

SEQ ID NO: 454772 - DNA, 25 bp, Rattus norvegicus
aaaggccgcggcaagcaaagagaga

SEQ ID NO: 454773 - DNA, 25 bp, Rattus norvegicus
agcaaccggccgttcccggaagctg

SEQ ID NO: 454774 - DNA, 25 bp, Rattus norvegicus
cgcatgggaagtgcgtttagcaacc

SEQ ID NO: 454775 - DNA, 25 bp, Rattus norvegicus
aagtgagcgtctagcgaaggatgcc

SEQ ID NO: 454776 - DNA, 25 bp, Rattus norvegicus
acttggcaccggaagtgagcgtcta

SEQ ID NO: 454777 - DNA, 25 bp, Rattus norvegicus
gacatttctgctgggccctcacttg

SEQ ID NO: 454778 - DNA, 25 bp, Rattus norvegicus
ctgtgtgtcggattgatgacatttc

SEQ ID NO: 454779 - DNA, 25 bp, Rattus norvegicus
tgagaggccaagcacaagccgggca

SEQ ID NO: 454780 - DNA, 25 bp, Rattus norvegicus
tggtcaccaaccagaggtccctaga

SEQ ID NO: 454781 - DNA, 25 bp, Rattus norvegicus
gacgtgtttgtaaaaggccgcggca

SEQ ID NO: 454782 - DNA, 25 bp, Rattus norvegicus
acagcggacagtttggacgtgtttg

SEQ ID NO: 454783 - DNA, 25 bp, Rattus norvegicus
ataacgactgtcgttacagcggaca

SEQ ID NO: 454784 - DNA, 25 bp, Rattus norvegicus
cgtgggcgtatctgaccaataacga

SEQ ID NO: 454785 - DNA, 25 bp, Rattus norvegicus
gtccctagagttgcgaggcaggtaa

SEQ ID NO: 454786 - DNA, 25 bp, Rattus norvegicus
gctgtttcaggaggccaagtaatgc

SEQ ID NO: 454787 - DNA, 25 bp, Rattus norvegicus
aggcttgaagccacgtttccgccca

SEQ ID NO: 454788 - DNA, 25 bp, Rattus norvegicus
cgtttccgcccacactagcagaagg

SEQ ID NO: 454789 - DNA, 25 bp, Rattus norvegicus
ctagcagaagggaagccgaagcagc

SEQ ID NO: 454790 - DNA, 25 bp, Rattus norvegicus
ccgaagcagcatgcgttcacgtggc

SEQ ID NO: 454791 - DNA, 25 bp, Rattus norvegicus
cccgcgatatgacgttaccacgctg

SEQ ID NO: 454792 - DNA, 25 bp, Rattus norvegicus
atatgacgttaccacgctgccgccg

SEQ ID NO: 454793 - DNA, 25 bp, Rattus norvegicus
cacaccgccgctgttcttccgccag

SEQ ID NO: 454794 - DNA, 25 bp, Rattus norvegicus
cgctccggacacgtcaccaccttcg

SEQ ID NO: 454795 - DNA, 25 bp, Rattus norvegicus
ggccaagtaatgcaaggcttgaagc

SEQ ID NO: 454796 - DNA, 25 bp, Rattus norvegicus
ttcgcgtcctttctggagagcgcgg

SEQ ID NO: 454797 - DNA, 25 bp, Rattus norvegicus
accaccttcgcgtcctttctggaga

SEQ ID NO: 454798 - DNA, 25 bp, Rattus norvegicus
gcgccgcaggttggtcacgcgcctt

SEQ ID NO: 454799 - DNA, 25 bp, Rattus norvegicus
acgacgtcaggctgtttcaggaggc

SEQ ID NO: 454800 - DNA, 25 bp, Rattus norvegicus
aggcagatctgcttaacacactcgg

SEQ ID NO: 454801 - DNA, 25 bp, Rattus norvegicus
ttgggctcgttacgtggacaagtcc

SEQ ID NO: 454802 - DNA, 25 bp, Rattus norvegicus
ctttcagtcacaccggcgtccatgg

SEQ ID NO: 454803 - DNA, 25 bp, Rattus norvegicus
tgagagtcacgttgagtccgctttc

SEQ ID NO: 454804 - DNA, 25 bp, Rattus norvegicus
tccgtgcatcagcagccgaatggtg

SEQ ID NO: 454805 - DNA, 25 bp, Rattus norvegicus
tgatgctgcctacttcctttccgtg

SEQ ID NO: 454806 - DNA, 25 bp, Rattus norvegicus
tgatgattctctccgggcagttccc

SEQ ID NO: 454807 - DNA, 25 bp, Rattus norvegicus
tgggcccagtcagcgtgatgattct

SEQ ID NO: 454808 - DNA, 25 bp, Rattus norvegicus
ccgtactgttggtcatggagctgtt

SEQ ID NO: 454809 - DNA, 25 bp, Rattus norvegicus
agcgtctccagcatgaccaggcaga

SEQ ID NO: 454810 - DNA, 25 bp, Rattus norvegicus
gatggtcatgactctcccttgcgga

SEQ ID NO: 454811 - DNA, 25 bp, Rattus norvegicus
agactgttgtcttgccacctggttc

SEQ ID NO: 454812 - DNA, 25 bp, Rattus norvegicus
tcccgccgtgcatcatggcaaagtg

SEQ ID NO: 454813 - DNA, 25 bp, Rattus norvegicus
tcctccagcttgtcgatgatcatgg

SEQ ID NO: 454814 - DNA, 25 bp, Rattus norvegicus
gatccctcccgccaggaaatggcta

SEQ ID NO: 454815 - DNA, 25 bp, Rattus norvegicus
gccatcttgggaggtcttcctgacc

SEQ ID NO: 454816 - DNA, 25 bp, Rattus norvegicus
ccggcttttttaggtcacaagactg

SEQ ID NO: 454817 - DNA, 25 bp, Rattus norvegicus
agagcgcgcgatacttgagaaaata

SEQ ID NO: 454818 - DNA, 25 bp, Rattus norvegicus
ggcaaacctgagaatccggcaaaga

SEQ ID NO: 454819 - DNA, 25 bp, Rattus norvegicus
tttgttaactctagaggcaccggca

SEQ ID NO: 454820 - DNA, 25 bp, Rattus norvegicus
gcgtccgcttcgcagaaagacttga

SEQ ID NO: 454821 - DNA, 25 bp, Rattus norvegicus
gttggcttctgttagtgaaaccctc

SEQ ID NO: 454822 - DNA, 25 bp, Rattus norvegicus
tgcccttgtgttttacgtcccgcga

SEQ ID NO: 454823 - DNA, 25 bp, Rattus norvegicus
cccgcgacggtttctctagacatta

SEQ ID NO: 454824 - DNA, 25 bp, Rattus norvegicus
tggcccggcatgtccatactggctc

SEQ ID NO: 454825 - DNA, 25 bp, Rattus norvegicus
ccgccatagtcagcccagaggaggt

SEQ ID NO: 454826 - DNA, 25 bp, Rattus norvegicus
tctcgctccgccgaagagttcgatc

SEQ ID NO: 454827 - DNA, 25 bp, Rattus norvegicus
gacgtgttaggaactcggctctcta

SEQ ID NO: 454828 - DNA, 25 bp, Rattus norvegicus
cgcaggcaggcggaattctgagaac

SEQ ID NO: 454829 - DNA, 25 bp, Rattus norvegicus
ctcctgggccgctgattggttacaa

SEQ ID NO: 454830 - DNA, 25 bp, Rattus norvegicus
ggctacgatgacgtcaccgctctgc

SEQ ID NO: 454831 - DNA, 25 bp, Rattus norvegicus
gaaacctcccggctacgatgacgtc

SEQ ID NO: 454832 - DNA, 25 bp, Rattus norvegicus
gcctcattggcctaatcctcggaaa

SEQ ID NO: 454833 - DNA, 25 bp, Rattus norvegicus
gcgggtattgggcaagtacagtaca

SEQ ID NO: 454834 - DNA, 25 bp, Rattus norvegicus
ctccattggctgaaggactcgcaac

SEQ ID NO: 454835 - DNA, 25 bp, Rattus norvegicus
cgggcttgacaaggcccggactccg

SEQ ID NO: 454836 - DNA, 25 bp, Rattus norvegicus
cttctcctgccggttggccgggctt

SEQ ID NO: 454837 - DNA, 25 bp, Rattus norvegicus
accgccgagtgtttatcccgactcg

SEQ ID NO: 454838 - DNA, 25 bp, Rattus norvegicus
agctgccgcgctggccagccagaag

SEQ ID NO: 454839 - DNA, 25 bp, Rattus norvegicus
ctggatgttcatcccgacggctgtc

SEQ ID NO: 454840 - DNA, 25 bp, Rattus norvegicus
gtgtggaaggttccagctgctcgcc

SEQ ID NO: 454841 - DNA, 25 bp, Rattus norvegicus
tgagaacaatgcctgctctttcctg

SEQ ID NO: 454842 - DNA, 25 bp, Rattus norvegicus
gcggctacgacttcgacccatcgga

SEQ ID NO: 454843 - DNA, 25 bp, Rattus norvegicus
gccgcgagattttctggactcaccc

SEQ ID NO: 454844 - DNA, 25 bp, Rattus norvegicus
gacttcgacccatcggagtcctact

SEQ ID NO: 454845 - DNA, 25 bp, Rattus norvegicus
gaaacgactccataacttccggagc

SEQ ID NO: 454846 - DNA, 25 bp, Rattus norvegicus
actccataacttccggagcagccgg

SEQ ID NO: 454847 - DNA, 25 bp, Rattus norvegicus
cggagcagccggaacttgatttttt

SEQ ID NO: 454848 - DNA, 25 bp, Rattus norvegicus
ggtagcactggtcaccgtcccaagc

SEQ ID NO: 454849 - DNA, 25 bp, Rattus norvegicus
actggaaactagcaggacgcgttgc

SEQ ID NO: 454850 - DNA, 25 bp, Rattus norvegicus
cgttgcgagggttccggctgctcca

SEQ ID NO: 454851 - DNA, 25 bp, Rattus norvegicus
tgctccagcaaaccgactacctagg

SEQ ID NO: 454852 - DNA, 25 bp, Rattus norvegicus
gcaaaccgactacctaggtcctgtc

SEQ ID NO: 454853 - DNA, 25 bp, Rattus norvegicus
tacctaggtcctgtcccggatgtcg

SEQ ID NO: 454854 - DNA, 25 bp, Rattus norvegicus
tttcctggccgactggaaactagca

SEQ ID NO: 454855 - DNA, 25 bp, Rattus norvegicus
gtcccaagccgcgagattttctgga

SEQ ID NO: 454856 - DNA, 25 bp, Rattus norvegicus
tgacagtagcagaaagtgccgctgc

SEQ ID NO: 454857 - DNA, 25 bp, Rattus norvegicus
cttaagcgatctgggaatctctgtc

SEQ ID NO: 454858 - DNA, 25 bp, Rattus norvegicus
accgtgtgcctgtgcttaagcgatc

SEQ ID NO: 454859 - DNA, 25 bp, Rattus norvegicus
cgtgcattacttccgcggttccggc

SEQ ID NO: 454860 - DNA, 25 bp, Rattus norvegicus
gaaaacagccgcagggcgtgcatta

SEQ ID NO: 454861 - DNA, 25 bp, Rattus norvegicus
ctagcacagctaggcagaaaacagc

SEQ ID NO: 454862 - DNA, 25 bp, Rattus norvegicus
aaagagcttgcgctgccggttgcgc

SEQ ID NO: 454863 - DNA, 25 bp, Rattus norvegicus
gctgctgacagaggaaagagcttgc

SEQ ID NO: 454864 - DNA, 25 bp, Rattus norvegicus
ttagccgaccggcttctcaagacct

SEQ ID NO: 454865 - DNA, 25 bp, Rattus norvegicus
ggccgccgggacagtaacagaagcc

SEQ ID NO: 454866 - DNA, 25 bp, Rattus norvegicus
cgtctgtctctgactcggggtgaca

SEQ ID NO: 454867 - DNA, 25 bp, Rattus norvegicus
ctctgtcgttagttcttcccgtaag

SEQ ID NO: 454868 - DNA, 25 bp, Rattus norvegicus
aacagaagccgtgggccgcatcttc

SEQ ID NO: 454869 - DNA, 25 bp, Rattus norvegicus
atgctccgtacctgcgcggcgtgtt

SEQ ID NO: 454870 - DNA, 25 bp, Rattus norvegicus
ctcgcccggactcgtgctgctagaa

SEQ ID NO: 454871 - DNA, 25 bp, Rattus norvegicus
ccggactcgtgctgctagaaggaga

SEQ ID NO: 454872 - DNA, 25 bp, Rattus norvegicus
tcgccgtagtcgcagtggtcgccgt

SEQ ID NO: 454873 - DNA, 25 bp, Rattus norvegicus
tgctctggtgagtctgcccggaacg

SEQ ID NO: 454874 - DNA, 25 bp, Rattus norvegicus
tgagtctgcccggaacggcacgccg

SEQ ID NO: 454875 - DNA, 25 bp, Rattus norvegicus
ggcgccgagagaccgagaactttct

SEQ ID NO: 454876 - DNA, 25 bp, Rattus norvegicus
gccgagagaccgagaactttctttg

SEQ ID NO: 454877 - DNA, 25 bp, Rattus norvegicus
ccgagaactttctttggtctgggag

SEQ ID NO: 454878 - DNA, 25 bp, Rattus norvegicus
ccggcggcggataggacttcgtcct

SEQ ID NO: 454879 - DNA, 25 bp, Rattus norvegicus
gcccgagagcccgaagttggccgcg

SEQ ID NO: 454880 - DNA, 25 bp, Rattus norvegicus
tagcgcggagcccaccgtagcctat

SEQ ID NO: 454881 - DNA, 25 bp, Rattus norvegicus
agcctatggccgctgcccacccgtt

SEQ ID NO: 454882 - DNA, 25 bp, Rattus norvegicus
cccacccgttcgtgccgcccagagt

SEQ ID NO: 454883 - DNA, 25 bp, Rattus norvegicus
gctgggttgtcagtcagagagagga

SEQ ID NO: 454884 - DNA, 25 bp, Rattus norvegicus
cccttcttgccatcgatttctttta

SEQ ID NO: 454885 - DNA, 25 bp, Rattus norvegicus
acagtatattcctgcaggcgccgtc

SEQ ID NO: 454886 - DNA, 25 bp, Rattus norvegicus
cccgccgcacgattgacagtatatt

SEQ ID NO: 454887 - DNA, 25 bp, Rattus norvegicus
tgcctctgtcatcgcaggtttaaac

SEQ ID NO: 454888 - DNA, 25 bp, Rattus norvegicus
ctctggagtgtgttactgattcatc

SEQ ID NO: 454889 - DNA, 25 bp, Rattus norvegicus
tcctctagatgacggcctttgcttc

SEQ ID NO: 454890 - DNA, 25 bp, Rattus norvegicus
tgcacgcagcgtttcctctagatga

SEQ ID NO: 454891 - DNA, 25 bp, Rattus norvegicus
tccagggctttcctgaagaaaatgc

SEQ ID NO: 454892 - DNA, 25 bp, Rattus norvegicus
ctgtagttacggctggtgcactcga

SEQ ID NO: 454893 - DNA, 25 bp, Rattus norvegicus
ttcaagtgtctctgtcccgagttcc

SEQ ID NO: 454894 - DNA, 25 bp, Rattus norvegicus
tacggcaacgttctcttcaagtgtc

SEQ ID NO: 454895 - DNA, 25 bp, Rattus norvegicus
ccagatgccagattacaccgaacta

SEQ ID NO: 454896 - DNA, 25 bp, Rattus norvegicus
ctcccggggcatcttgggaattgta

SEQ ID NO: 454897 - DNA, 25 bp, Rattus norvegicus
gctgcgcagccctaagaagcacttc

SEQ ID NO: 454898 - DNA, 25 bp, Rattus norvegicus
cgctgacgaagactggggttgaaat

SEQ ID NO: 454899 - DNA, 25 bp, Rattus norvegicus
aatccatctgcagaaccacgaagag

SEQ ID NO: 454900 - DNA, 25 bp, Rattus norvegicus
gtctcttaagactcaaatccatctg

SEQ ID NO: 454901 - DNA, 25 bp, Rattus norvegicus
gcgaaggtcctttggtgtctcttaa

SEQ ID NO: 454902 - DNA, 25 bp, Rattus norvegicus
tgggactcctcctaaagctgcgaag

SEQ ID NO: 454903 - DNA, 25 bp, Rattus norvegicus
tttgtgctaagccaacccgctgtgc

SEQ ID NO: 454904 - DNA, 25 bp, Rattus norvegicus
actgggacttcgcacgtgccaagag

SEQ ID NO: 454905 - DNA, 25 bp, Rattus norvegicus
gccgcctaatggttttccgaggagc

SEQ ID NO: 454906 - DNA, 25 bp, Rattus norvegicus
cggcggactcccaaatagccgggtg

SEQ ID NO: 454907 - DNA, 25 bp, Rattus norvegicus
cagacagtcgctgcggtagataccc

SEQ ID NO: 454908 - DNA, 25 bp, Rattus norvegicus
acaggcacggcaagcatggggcctt

SEQ ID NO: 454909 - DNA, 25 bp, Rattus norvegicus
atatcgcaacctgcgggtgctgacc

SEQ ID NO: 454910 - DNA, 25 bp, Rattus norvegicus
aggtgtggacacaacgctcctgacc

SEQ ID NO: 454911 - DNA, 25 bp, Rattus norvegicus
cgctcctgacctcgtgggacaggca

SEQ ID NO: 454912 - DNA, 25 bp, Rattus norvegicus
agcaccgccctcgacctgtaaggaa

SEQ ID NO: 454913 - DNA, 25 bp, Rattus norvegicus
gtcacggcttggagagaagcgattc

SEQ ID NO: 454914 - DNA, 25 bp, Rattus norvegicus
tcccaagggaatgtgactcggaagg

SEQ ID NO: 454915 - DNA, 25 bp, Rattus norvegicus
ccttgtaaatcccaagggaatgtga

SEQ ID NO: 454916 - DNA, 25 bp, Rattus norvegicus
agcaaccttccacggacgtcccttg

SEQ ID NO: 454917 - DNA, 25 bp, Rattus norvegicus
ttgtcctggctccagagcccgaggc

SEQ ID NO: 454918 - DNA, 25 bp, Rattus norvegicus
cgtctgaaggagcttgtcctggctc

SEQ ID NO: 454919 - DNA, 25 bp, Rattus norvegicus
gcagatccttgtcgccgccttctca

SEQ ID NO: 454920 - DNA, 25 bp, Rattus norvegicus
ggctcccgagccagcagatccttgt

SEQ ID NO: 454921 - DNA, 25 bp, Rattus norvegicus
cgcaagcgcactggcactgaagtga

SEQ ID NO: 454922 - DNA, 25 bp, Rattus norvegicus
tctgcgtaggacttggagacttgaa

SEQ ID NO: 454923 - DNA, 25 bp, Rattus norvegicus
cctgagtctgcgtaggacttggaga

SEQ ID NO: 454924 - DNA, 25 bp, Rattus norvegicus
gcgattcgagggaatccaccgccca

SEQ ID NO: 454925 - DNA, 25 bp, Rattus norvegicus
accgccctgtctgcggggcctgagt

SEQ ID NO: 454926 - DNA, 25 bp, Rattus norvegicus
acgcgtctgttccaggctctccttt

SEQ ID NO: 454927 - DNA, 25 bp, Rattus norvegicus
tacagctcaggtcgccaccggaatg

SEQ ID NO: 454928 - DNA, 25 bp, Rattus norvegicus
cagttccggccaccgtggttctgta

SEQ ID NO: 454929 - DNA, 25 bp, Rattus norvegicus
ccgtggttctgtacgatgacgcgtc

SEQ ID NO: 454930 - DNA, 25 bp, Rattus norvegicus
ttctgcttcccaggctttctctctg

SEQ ID NO: 454931 - DNA, 25 bp, Rattus norvegicus
ctccaggaacctgaagcggatgcta

SEQ ID NO: 454932 - DNA, 25 bp, Rattus norvegicus
gcggatgctagtccagaccctgcca

SEQ ID NO: 454933 - DNA, 25 bp, Rattus norvegicus
cagcgagtccggcagtctagtctga

SEQ ID NO: 454934 - DNA, 25 bp, Rattus norvegicus
gtctagtctgagctgtcgcatcccg

SEQ ID NO: 454935 - DNA, 25 bp, Rattus norvegicus
tcgcatcccggagtccatctcattg

SEQ ID NO: 454936 - DNA, 25 bp, Rattus norvegicus
tcgccagtgaccaacatcatgtgtg

SEQ ID NO: 454937 - DNA, 25 bp, Rattus norvegicus
acatcatgtgtggtaagggcagcga

SEQ ID NO: 454938 - DNA, 25 bp, Rattus norvegicus
ccactgactagtggtactctaggca

SEQ ID NO: 454939 - DNA, 25 bp, Rattus norvegicus
tgttgtgtaaacattcccttccttc

SEQ ID NO: 454940 - DNA, 25 bp, Rattus norvegicus
cttgtccggcgcacacgagcacgag

SEQ ID NO: 454941 - DNA, 25 bp, Rattus norvegicus
tcgctttagtttccgccggttcagc

SEQ ID NO: 454942 - DNA, 25 bp, Rattus norvegicus
tcaaggatttcgctttagtttccgc

SEQ ID NO: 454943 - DNA, 25 bp, Rattus norvegicus
tccagagaagttcaaggatttcgct

SEQ ID NO: 454944 - DNA, 25 bp, Rattus norvegicus
cggaagcaattgtccagagaagttc

SEQ ID NO: 454945 - DNA, 25 bp, Rattus norvegicus
tgcaaacgcccggaagcaattgtcc

SEQ ID NO: 454946 - DNA, 25 bp, Rattus norvegicus
agcacgagcgcagccacgcagagtc

SEQ ID NO: 454947 - DNA, 25 bp, Rattus norvegicus
tgcagtcgaagcagttccgtcccga

SEQ ID NO: 454948 - DNA, 25 bp, Rattus norvegicus
ttcagcgcccgggtttcgagtttca

SEQ ID NO: 454949 - DNA, 25 bp, Rattus norvegicus
cccagggcgctctgctctgtggagc

SEQ ID NO: 454950 - DNA, 25 bp, Rattus norvegicus
gctctgctctgtggagctctcgggc

SEQ ID NO: 454951 - DNA, 25 bp, Rattus norvegicus
ggctcccaagctgcgctcgaagctt

SEQ ID NO: 454952 - DNA, 25 bp, Rattus norvegicus
cgctcgaagctttgcagtcgaagca

SEQ ID NO: 454953 - DNA, 25 bp, Rattus norvegicus
tcggctctctgcaaacgcccggaag

SEQ ID NO: 454954 - DNA, 25 bp, Rattus norvegicus
tcccaccgggataagcacagacgtc

SEQ ID NO: 454955 - DNA, 25 bp, Rattus norvegicus
agcgagcacatcgagacgcagatcc

SEQ ID NO: 454956 - DNA, 25 bp, Rattus norvegicus
cctcgcggagctctgagcgagcaca

SEQ ID NO: 454957 - DNA, 25 bp, Rattus norvegicus
ctacttcagtagtcgagcggggtcc

SEQ ID NO: 454958 - DNA, 25 bp, Rattus norvegicus
gcgcgcctctgtggctacttcagta

SEQ ID NO: 454959 - DNA, 25 bp, Rattus norvegicus
aacccggctactgggatgatcgctg

SEQ ID NO: 454960 - DNA, 25 bp, Rattus norvegicus
aactccacggaggtggccgccaaga

SEQ ID NO: 454961 - DNA, 25 bp, Rattus norvegicus
ggcggccaaggaagacgcaaactcc

SEQ ID NO: 454962 - DNA, 25 bp, Rattus norvegicus
tctgcaggaggtcttccaccacttg

SEQ ID NO: 454963 - DNA, 25 bp, Rattus norvegicus
ctaccggtctggaccagtatctgca

SEQ ID NO: 454964 - DNA, 25 bp, Rattus norvegicus
gaacgagatcgtggtgctggctacc

SEQ ID NO: 454965 - DNA, 25 bp, Rattus norvegicus
ccttggctcaccattacgggctgga

SEQ ID NO: 454966 - DNA, 25 bp, Rattus norvegicus
tgaaggcgccgatccgatccactga

SEQ ID NO: 454967 - DNA, 25 bp, Rattus norvegicus
cgcgtggcacatctagaggaggaaa

SEQ ID NO: 454968 - DNA, 25 bp, Rattus norvegicus
cttgcagcgccaagtgcagcgactg

SEQ ID NO: 454969 - DNA, 25 bp, Rattus norvegicus
ttgtgcccgctgttcaacgagtggt

SEQ ID NO: 454970 - DNA, 25 bp, Rattus norvegicus
cccgtaggctcctgcagtggtcgct

SEQ ID NO: 454971 - DNA, 25 bp, Rattus norvegicus
aggcagagcttagacgttaccggtg

SEQ ID NO: 454972 - DNA, 25 bp, Rattus norvegicus
gctcctgcagtggtcgctcactgtg

SEQ ID NO: 454973 - DNA, 25 bp, Rattus norvegicus
agtggtcgctcactgtggctttccg

SEQ ID NO: 454974 - DNA, 25 bp, Rattus norvegicus
tggaaaagccagtcggacatcccgg

SEQ ID NO: 454975 - DNA, 25 bp, Rattus norvegicus
ggcgcacgagctgcagcgagctcag

SEQ ID NO: 454976 - DNA, 25 bp, Rattus norvegicus
ccgctgttcaacgagtggtgtaagg

SEQ ID NO: 454977 - DNA, 25 bp, Rattus norvegicus
ccggcgcagcttgcaccgagtgcga

SEQ ID NO: 454978 - DNA, 25 bp, Rattus norvegicus
cggtccggcgcagcttgcaccgagt

SEQ ID NO: 454979 - DNA, 25 bp, Rattus norvegicus
ccagtcggacatcccggaagcggcg

SEQ ID NO: 454980 - DNA, 25 bp, Rattus norvegicus
agagcttagacgttaccggtgagcg

SEQ ID NO: 454981 - DNA, 25 bp, Rattus norvegicus
ctttccgcgggtaggtcggcctctg

SEQ ID NO: 454982 - DNA, 25 bp, Rattus norvegicus
gcgctcacagaacggcccgcaggtt

SEQ ID NO: 454983 - DNA, 25 bp, Rattus norvegicus
cccagagcggacatcaaggcccaaa

SEQ ID NO: 454984 - DNA, 25 bp, Rattus norvegicus
gcaggttgccttccaccgcaagttg

SEQ ID NO: 454985 - DNA, 25 bp, Rattus norvegicus
gcagagctttctgccagccgtcggt

SEQ ID NO: 454986 - DNA, 25 bp, Rattus norvegicus
atgtcgttatttggctgagtgctcc

SEQ ID NO: 454987 - DNA, 25 bp, Rattus norvegicus
gtcgacaccgatggtgctgccctga

SEQ ID NO: 454988 - DNA, 25 bp, Rattus norvegicus
gaagctgaaggattggccacgaacc

SEQ ID NO: 454989 - DNA, 25 bp, Rattus norvegicus
tcctgtcactatagtccggacttcc

SEQ ID NO: 454990 - DNA, 25 bp, Rattus norvegicus
ctccagcgtcttcatggtgaagtcg

SEQ ID NO: 454991 - DNA, 25 bp, Rattus norvegicus
gcccactaacaccagcttgaacagg

SEQ ID NO: 454992 - DNA, 25 bp, Rattus norvegicus
aatcgtagtgttcgtcctggtctcc

SEQ ID NO: 454993 - DNA, 25 bp, Rattus norvegicus
agggcccgtcttgggcttacgacag

SEQ ID NO: 454994 - DNA, 25 bp, Rattus norvegicus
cacggcggtgctttcagacctgaac

SEQ ID NO: 454995 - DNA, 25 bp, Rattus norvegicus
gaagcgctgcaccacgcacgtcttg

SEQ ID NO: 454996 - DNA, 25 bp, Rattus norvegicus
ttaggcgcccggaacgaggcaggca

SEQ ID NO: 454997 - DNA, 25 bp, Rattus norvegicus
tgagtgtcattcgtggtttgggttc

SEQ ID NO: 454998 - DNA, 25 bp, Rattus norvegicus
cttgcgcggcaggaatgtgagtgtc

SEQ ID NO: 454999 - DNA, 25 bp, Rattus norvegicus
tcatctcgcgcgtaggtcggcgctt

SEQ ID NO: 455000 - DNA, 25 bp, Rattus norvegicus
caatgcgtcatctcgcgcgtaggtc

SEQ ID NO: 455001 - DNA, 25 bp, Rattus norvegicus
tgcacaatgcgtcatctcgcgcgta

SEQ ID NO: 455002 - DNA, 25 bp, Rattus norvegicus
gccggcgcatgcacaatgcgtcatc

SEQ ID NO: 455003 - DNA, 25 bp, Rattus norvegicus
gttggacagcttcccgccggcgcat

SEQ ID NO: 455004 - DNA, 25 bp, Rattus norvegicus
ttgtgcctcgttggacagcttcccg

SEQ ID NO: 455005 - DNA, 25 bp, Rattus norvegicus
acgcagttgtgcctcgttggacagc

SEQ ID NO: 455006 - DNA, 25 bp, Rattus norvegicus
ggagagaaacgcagttgtgcctcgt

SEQ ID NO: 455007 - DNA, 25 bp, Rattus norvegicus
tgtcgggagaataaatggaaaggac

SEQ ID NO: 455008 - DNA, 25 bp, Rattus norvegicus
cgcgggaacggaaaagagaggacag

SEQ ID NO: 455009 - DNA, 25 bp, Rattus norvegicus
caggatggcctttttttgtcgggag

SEQ ID NO: 455010 - DNA, 25 bp, Rattus norvegicus
ctcttccgttttgcccggatcgcgg

SEQ ID NO: 455011 - DNA, 25 bp, Rattus norvegicus
gatctgtggctcctgtggatgtttc

SEQ ID NO: 455012 - DNA, 25 bp, Rattus norvegicus
tggatgtttcgctgctcgtccctcg

SEQ ID NO: 455013 - DNA, 25 bp, Rattus norvegicus
tccagactcctgagcactacagcgg

SEQ ID NO: 455014 - DNA, 25 bp, Rattus norvegicus
ttcccgctcgtagctaggatctgtg

SEQ ID NO: 455015 - DNA, 25 bp, Rattus norvegicus
gcgcaggttataccatcggctctca

SEQ ID NO: 455016 - DNA, 25 bp, Rattus norvegicus
ggccaatcagaatcgcccgctggga

SEQ ID NO: 455017 - DNA, 25 bp, Rattus norvegicus
gcaaaggaagctacgccggccaatc

SEQ ID NO: 455018 - DNA, 25 bp, Rattus norvegicus
cgcccacgggtccaatcagcaaagg

SEQ ID NO: 455019 - DNA, 25 bp, Rattus norvegicus
attttcagggtccttgcctgcgcca

SEQ ID NO: 455020 - DNA, 25 bp, Rattus norvegicus
agactcgcaaagcagcggctgttta

SEQ ID NO: 455021 - DNA, 25 bp, Rattus norvegicus
aggagactcggacgtagacccaaga

SEQ ID NO: 455022 - DNA, 25 bp, Rattus norvegicus
agttccaggagttcccgccacactg

SEQ ID NO: 455023 - DNA, 25 bp, Rattus norvegicus
ggtctcagccgtaccaacccagaga

SEQ ID NO: 455024 - DNA, 25 bp, Rattus norvegicus
cctgagcatctttctattgcgtgga

SEQ ID NO: 455025 - DNA, 25 bp, Rattus norvegicus
aaggccagatccacgcggggattca

SEQ ID NO: 455026 - DNA, 25 bp, Rattus norvegicus
tgaaagtgttgggaaggccagatcc

SEQ ID NO: 455027 - DNA, 25 bp, Rattus norvegicus
tctggtgagggacccttgaaagtgt

SEQ ID NO: 455028 - DNA, 25 bp, Rattus norvegicus
ccatgttgaagaaattcgacaagaa

SEQ ID NO: 455029 - DNA, 25 bp, Rattus norvegicus
cgctggcaccatgttgaagaaattc

SEQ ID NO: 455030 - DNA, 25 bp, Rattus norvegicus
gctaccgctggcaccatgttgaaga

SEQ ID NO: 455031 - DNA, 25 bp, Rattus norvegicus
gtgcgcaggcgcagtccaaagagca

SEQ ID NO: 455032 - DNA, 25 bp, Rattus norvegicus
catctttctattgcgtggagctacc

SEQ ID NO: 455033 - DNA, 25 bp, Rattus norvegicus
ttgatctcaccgctaccctgagcat

SEQ ID NO: 455034 - DNA, 25 bp, Rattus norvegicus
gaaattgatctcaccgctaccctga

SEQ ID NO: 455035 - DNA, 25 bp, Rattus norvegicus
ggaagccgctgggagaaattgatct

SEQ ID NO: 455036 - DNA, 25 bp, Rattus norvegicus
ggcgcagtccaaagagcagtgctca

SEQ ID NO: 455037 - DNA, 25 bp, Rattus norvegicus
ttctattgcgtggagctaccgctgg

SEQ ID NO: 455038 - DNA, 25 bp, Rattus norvegicus
ctcgagaccgatcgcctgttacaca

SEQ ID NO: 455039 - DNA, 25 bp, Rattus norvegicus
cgatttcatccgcttcctaaatagg

SEQ ID NO: 455040 - DNA, 25 bp, Rattus norvegicus
taaataggcgatgtccgcgctactg

SEQ ID NO: 455041 - DNA, 25 bp, Rattus norvegicus
gcgggagcctcacatgtgcccagca

SEQ ID NO: 455042 - DNA, 25 bp, Rattus norvegicus
accatccggacgtggcgcctccacc

SEQ ID NO: 455043 - DNA, 25 bp, Rattus norvegicus
cagaggagacaaatcccggctgctc

SEQ ID NO: 455044 - DNA, 25 bp, Rattus norvegicus
gaggagacaaatcccggctgctcga

SEQ ID NO: 455045 - DNA, 25 bp, Rattus norvegicus
gacaaatcccggctgctcgagaccg

SEQ ID NO: 455046 - DNA, 25 bp, Rattus norvegicus
tcctaaataggcgatgtccgcgcta

SEQ ID NO: 455047 - DNA, 25 bp, Rattus norvegicus
ctgctcgagaccgatcgcctgttac

SEQ ID NO: 455048 - DNA, 25 bp, Rattus norvegicus
ccgcttcctaaataggcgatgtccg

SEQ ID NO: 455049 - DNA, 25 bp, Rattus norvegicus
ctgttacacaccgaagggccgcgaa

SEQ ID NO: 455050 - DNA, 25 bp, Rattus norvegicus
atctccgatttcatccgcttcctaa

SEQ ID NO: 455051 - DNA, 25 bp, Rattus norvegicus
aatcccggctgctcgagaccgatcg

SEQ ID NO: 455052 - DNA, 25 bp, Rattus norvegicus
aacctgccttcatcagtcggcgagg

SEQ ID NO: 455053 - DNA, 25 bp, Rattus norvegicus
cgcggcatctagtgtttcccttttc

SEQ ID NO: 455054 - DNA, 25 bp, Rattus norvegicus
tctccctcggcattttcttttttca

SEQ ID NO: 455055 - DNA, 25 bp, Rattus norvegicus
ccctgcctgcttgtatctttttctt

SEQ ID NO: 455056 - DNA, 25 bp, Rattus norvegicus
tttcttcttggctccgcaatcctgg

SEQ ID NO: 455057 - DNA, 25 bp, Rattus norvegicus
aatcctggccaaaccgcagccttta

SEQ ID NO: 455058 - DNA, 25 bp, Rattus norvegicus
acgcgcggttgttccggatctcaac

SEQ ID NO: 455059 - DNA, 25 bp, Rattus norvegicus
ctgttgccgaacttagccgataggg

SEQ ID NO: 455060 - DNA, 25 bp, Rattus norvegicus
accggtggccttgtcatctggctta

SEQ ID NO: 455061 - DNA, 25 bp, Rattus norvegicus
gcttcccaagcctcaacattgcaga

SEQ ID NO: 455062 - DNA, 25 bp, Rattus norvegicus
cattgcagaagggaactcacgggcc

SEQ ID NO: 455063 - DNA, 25 bp, Rattus norvegicus
agcttcagcctgaccgcaaaccgaa

SEQ ID NO: 455064 - DNA, 25 bp, Rattus norvegicus
caaaccgaaggcgacgctgcaaata

SEQ ID NO: 455065 - DNA, 25 bp, Rattus norvegicus
tagtactggagtcccatcctgttgg

SEQ ID NO: 455066 - DNA, 25 bp, Rattus norvegicus
cggggctagtgctctttaggtcgac

SEQ ID NO: 455067 - DNA, 25 bp, Rattus norvegicus
tttctctgctgagtccaccgaagcc

SEQ ID NO: 455068 - DNA, 25 bp, Rattus norvegicus
gagagctctcacctttctctgctga

SEQ ID NO: 455069 - DNA, 25 bp, Rattus norvegicus
tgttggtgtgaacgcagagagctct

SEQ ID NO: 455070 - DNA, 25 bp, Rattus norvegicus
cctcgagtgttgttggtgtgaacgc

SEQ ID NO: 455071 - DNA, 25 bp, Rattus norvegicus
tctccgcgatcctcgagtgttgttg

SEQ ID NO: 455072 - DNA, 25 bp, Rattus norvegicus
cagtagtacggtctccgcgatcctc

SEQ ID NO: 455073 - DNA, 25 bp, Rattus norvegicus
tccacgcagggcagtagtacggtct

SEQ ID NO: 455074 - DNA, 25 bp, Rattus norvegicus
ccggagcagagcacgtccacgcagg

SEQ ID NO: 455075 - DNA, 25 bp, Rattus norvegicus
ttagagggagactccgcgccgacca

SEQ ID NO: 455076 - DNA, 25 bp, Rattus norvegicus
ccacgttcttagagggagactccgc

SEQ ID NO: 455077 - DNA, 25 bp, Rattus norvegicus
agaggaccgcccacgttcttagagg

SEQ ID NO: 455078 - DNA, 25 bp, Rattus norvegicus
gtccaccgaagccaacctcggagga

SEQ ID NO: 455079 - DNA, 25 bp, Rattus norvegicus
ctctttaggtcgacgcttgagcgcg

SEQ ID NO: 455080 - DNA, 25 bp, Rattus norvegicus
accagcgcccggatagagtacttga

SEQ ID NO: 455081 - DNA, 25 bp, Rattus norvegicus
tcgccagactgtaggggcgtcactt

SEQ ID NO: 455082 - DNA, 25 bp, Rattus norvegicus
tcaccttcttcgtgctggcagcagc

SEQ ID NO: 455083 - DNA, 25 bp, Rattus norvegicus
tgccctccagcttcttgcggttcag

SEQ ID NO: 455084 - DNA, 25 bp, Rattus norvegicus
tcagcttgaaggatccgttggcgcc

SEQ ID NO: 455085 - DNA, 25 bp, Rattus norvegicus
tgcagcagcgtgtcgttctgcacca

SEQ ID NO: 455086 - DNA, 25 bp, Rattus norvegicus
cgcccgttctgctggtcgaaccatg

SEQ ID NO: 455087 - DNA, 25 bp, Rattus norvegicus
tagatgcgcgccagagacgagccac

SEQ ID NO: 455088 - DNA, 25 bp, Rattus norvegicus
acttgcctggctggttctttttgcg

SEQ ID NO: 455089 - DNA, 25 bp, Rattus norvegicus
tgcggttcttccttctcttgggctg

SEQ ID NO: 455090 - DNA, 25 bp, Rattus norvegicus
tctggcggagaacgctctctgctcc

SEQ ID NO: 455091 - DNA, 25 bp, Rattus norvegicus
gtggcggaccacgttgagaacaaca

SEQ ID NO: 455092 - DNA, 25 bp, Rattus norvegicus
gggcagatagacgacggaaaactcc

SEQ ID NO: 455093 - DNA, 25 bp, Rattus norvegicus
tggtcgaaccatgccaccttcctgg

SEQ ID NO: 455094 - DNA, 25 bp, Rattus norvegicus
aggatccctggacgctctcaaacgc

SEQ ID NO: 455095 - DNA, 25 bp, Rattus norvegicus
cgtgaactttctcgaggcacactta

SEQ ID NO: 455096 - DNA, 25 bp, Rattus norvegicus
agcggtctcatcctcacagccaatg

SEQ ID NO: 455097 - DNA, 25 bp, Rattus norvegicus
agccaatgtccagcccagagtagca

SEQ ID NO: 455098 - DNA, 25 bp, Rattus norvegicus
ctggtccttagcttcgcgcatcgtt

SEQ ID NO: 455099 - DNA, 25 bp, Rattus norvegicus
gcgcatcgttctgtacatctagttg

SEQ ID NO: 455100 - DNA, 25 bp, Rattus norvegicus
actgtccacagatccgtgcgggttc

SEQ ID NO: 455101 - DNA, 25 bp, Rattus norvegicus
accattcaggagtggcttcgaaccc

SEQ ID NO: 455102 - DNA, 25 bp, Rattus norvegicus
ttgtaggccctcacagtaaattgtc

SEQ ID NO: 455103 - DNA, 25 bp, Rattus norvegicus
aattgtctcgtgcacgcggctagca

SEQ ID NO: 455104 - DNA, 25 bp, Rattus norvegicus
acgaggtcacgtgcagcatcctttc

SEQ ID NO: 455105 - DNA, 25 bp, Rattus norvegicus
gcagggtctcgcacacgtgaacttt

SEQ ID NO: 455106 - DNA, 25 bp, Rattus norvegicus
gctctgaaagggctgcgataatctg

SEQ ID NO: 455107 - DNA, 25 bp, Rattus norvegicus
cgggcctggaaaaatacagcctttg

SEQ ID NO: 455108 - DNA, 25 bp, Rattus norvegicus
tcgaaataaaaagctgccgctctgc

SEQ ID NO: 455109 - DNA, 25 bp, Rattus norvegicus
tttcaataagaacgaggccgatgca

SEQ ID NO: 455110 - DNA, 25 bp, Rattus norvegicus
tgcccaagtcggagtcggaatcttt

SEQ ID NO: 455111 - DNA, 25 bp, Rattus norvegicus
agagcgtagggtatggaagtcttcc

SEQ ID NO: 455112 - DNA, 25 bp, Rattus norvegicus
cgcggccttttatcctgtgtggcga

SEQ ID NO: 455113 - DNA, 25 bp, Rattus norvegicus
tgcaccggctttgcacggcttaacc

SEQ ID NO: 455114 - DNA, 25 bp, Rattus norvegicus
gctttccagagctttgcgacgcgcc

SEQ ID NO: 455115 - DNA, 25 bp, Rattus norvegicus
ccgtttttccggagctctggacctg

SEQ ID NO: 455116 - DNA, 25 bp, Rattus norvegicus
gtgcctcaaacccaggtcatccgga

SEQ ID NO: 455117 - DNA, 25 bp, Rattus norvegicus
accggatcgcacaatccttccagtg

SEQ ID NO: 455118 - DNA, 25 bp, Rattus norvegicus
gcgccgcagtcggtaagttcctgca

SEQ ID NO: 455119 - DNA, 25 bp, Rattus norvegicus
gccgcctacacgactagcttgcgtt

SEQ ID NO: 455120 - DNA, 25 bp, Rattus norvegicus
tgtctggacgctgggcattgaacca

SEQ ID NO: 455121 - DNA, 25 bp, Rattus norvegicus
tagctcactgctcaggtctctctgg

SEQ ID NO: 455122 - DNA, 25 bp, Rattus norvegicus
gggacatcgaacaatctgaaaactc

SEQ ID NO: 455123 - DNA, 25 bp, Rattus norvegicus
tttacctgttccagagcctcggaca

SEQ ID NO: 455124 - DNA, 25 bp, Rattus norvegicus
ttccggtccagtggagttctgcacc

SEQ ID NO: 455125 - DNA, 25 bp, Rattus norvegicus
gggaacacagcggacaccaggaacc

SEQ ID NO: 455126 - DNA, 25 bp, Rattus norvegicus
cgggtcctaagtgaaccgcgcagtg

SEQ ID NO: 455127 - DNA, 25 bp, Rattus norvegicus
ggaaaagctgagaaagccgtcccga

SEQ ID NO: 455128 - DNA, 25 bp, Rattus norvegicus
tcgccttgcgcgttaatgaagaatc

SEQ ID NO: 455129 - DNA, 25 bp, Rattus norvegicus
tcctgctaggttccagggacatcga

SEQ ID NO: 455130 - DNA, 25 bp, Rattus norvegicus
gaggcttttagactctcctgctagg

SEQ ID NO: 455131 - DNA, 25 bp, Rattus norvegicus
cggccacatggggtaccattgtcga

SEQ ID NO: 455132 - DNA, 25 bp, Rattus norvegicus
cacggtcatggaattcggccacatg

SEQ ID NO: 455133 - DNA, 25 bp, Rattus norvegicus
ctcctggaactctgcacggtcatgg

SEQ ID NO: 455134 - DNA, 25 bp, Rattus norvegicus
cagacagatggacgccagtcgcaga

SEQ ID NO: 455135 - DNA, 25 bp, Rattus norvegicus
tcatgggctaaaggctgggaaaagc

SEQ ID NO: 455136 - DNA, 25 bp, Rattus norvegicus
tatcccgtgaatccgccagccttgg

SEQ ID NO: 455137 - DNA, 25 bp, Rattus norvegicus
cgggcctggcacacaactacatgga

SEQ ID NO: 455138 - DNA, 25 bp, Rattus norvegicus
tcccaagccgcagtagtggaccatg

SEQ ID NO: 455139 - DNA, 25 bp, Rattus norvegicus
tttgccctcaagacaccggtggact

SEQ ID NO: 455140 - DNA, 25 bp, Rattus norvegicus
gtcctctgtgaagctccgatggagc

SEQ ID NO: 455141 - DNA, 25 bp, Rattus norvegicus
cctgcgagcgtatgagactgaaccc

SEQ ID NO: 455142 - DNA, 25 bp, Rattus norvegicus
gacccatccctgtgtgtgacctcgt

SEQ ID NO: 455143 - DNA, 25 bp, Rattus norvegicus
ggcatgatgtgagaacccggtttca

SEQ ID NO: 455144 - DNA, 25 bp, Rattus norvegicus
cccagagtgaatgtctaggcgattg

SEQ ID NO: 455145 - DNA, 25 bp, Rattus norvegicus
ctcctgtgggcgactacgttcttat

SEQ ID NO: 455146 - DNA, 25 bp, Rattus norvegicus
gtgaagctcaaaccaggatctcctg

SEQ ID NO: 455147 - DNA, 25 bp, Rattus norvegicus
ccgctgcgagtgtaagtttgaggtt

SEQ ID NO: 455148 - DNA, 25 bp, Rattus norvegicus
ggtgtcccttactctctactgctga

SEQ ID NO: 455149 - DNA, 25 bp, Rattus norvegicus
tgcctccggacgaggtggatgtctt

SEQ ID NO: 455150 - DNA, 25 bp, Rattus norvegicus
cgtctgcgagctgtgatttcgagcc

SEQ ID NO: 455151 - DNA, 25 bp, Rattus norvegicus
aggcctaggctgtcaggccaccatc

SEQ ID NO: 455152 - DNA, 25 bp, Rattus norvegicus
tcgctcaccgccaatgatggtccgg

SEQ ID NO: 455153 - DNA, 25 bp, Rattus norvegicus
accgccaatgatggtccggatgagg

SEQ ID NO: 455154 - DNA, 25 bp, Rattus norvegicus
cgtgcccgggacagtcgaccagcgt

SEQ ID NO: 455155 - DNA, 25 bp, Rattus norvegicus
cagtcgaccagcgtgacctgcagca

SEQ ID NO: 455156 - DNA, 25 bp, Rattus norvegicus
tgcagcagcgtgtcgctagtcccgg

SEQ ID NO: 455157 - DNA, 25 bp, Rattus norvegicus
cgtgtcgctagtcccgggttcagcc

SEQ ID NO: 455158 - DNA, 25 bp, Rattus norvegicus
ccggcagcggcaccacaaaacagga

SEQ ID NO: 455159 - DNA, 25 bp, Rattus norvegicus
ccacaaaacaggagaagcccaggtc

SEQ ID NO: 455160 - DNA, 25 bp, Rattus norvegicus
agaagcccaggtcgagcgttatgcc

SEQ ID NO: 455161 - DNA, 25 bp, Rattus norvegicus
ctctgcggctgcttgtcgaaggcag

SEQ ID NO: 455162 - DNA, 25 bp, Rattus norvegicus
gctgtcttgccgctatcgatatgac

SEQ ID NO: 455163 - DNA, 25 bp, Rattus norvegicus
gccgctatcgatatgacccagcaca

SEQ ID NO: 455164 - DNA, 25 bp, Rattus norvegicus
ctttgttgaggcctaccgccatggc

SEQ ID NO: 455165 - DNA, 25 bp, Rattus norvegicus
agcggcgggtgtgtctcgacttgct

SEQ ID NO: 455166 - DNA, 25 bp, Rattus norvegicus
tttgttgaggcctaccgccatggca

SEQ ID NO: 455167 - DNA, 25 bp, Rattus norvegicus
ttgttgaggcctaccgccatggcat

SEQ ID NO: 455168 - DNA, 25 bp, Rattus norvegicus
tgttgaggcctaccgccatggcata

SEQ ID NO: 455169 - DNA, 25 bp, Rattus norvegicus
gaggcctaccgccatggcatagcgc

SEQ ID NO: 455170 - DNA, 25 bp, Rattus norvegicus
aggcctaccgccatggcatagcgca

SEQ ID NO: 455171 - DNA, 25 bp, Rattus norvegicus
ctaccgccatggcatagcgcaggac

SEQ ID NO: 455172 - DNA, 25 bp, Rattus norvegicus
accgccatggcatagcgcaggacca

SEQ ID NO: 455173 - DNA, 25 bp, Rattus norvegicus
cgccatggcatagcgcaggaccatg

SEQ ID NO: 455174 - DNA, 25 bp, Rattus norvegicus
atggcatagcgcaggaccatggctg

SEQ ID NO: 455175 - DNA, 25 bp, Rattus norvegicus
ggcatagcgcaggaccatggctgca

SEQ ID NO: 455176 - DNA, 25 bp, Rattus norvegicus
gcctaccgccatggcatagcgcagg

SEQ ID NO: 455177 - DNA, 25 bp, Rattus norvegicus
ccttgaacactttaagcagctccat

SEQ ID NO: 455178 - DNA, 25 bp, Rattus norvegicus
ctggagagcggcctagtaacggccg

SEQ ID NO: 455179 - DNA, 25 bp, Rattus norvegicus
tgtagccaatagaaaacgaagtctt

SEQ ID NO: 455180 - DNA, 25 bp, Rattus norvegicus
ctggcgtgccgtagttcctagtctc

SEQ ID NO: 455181 - DNA, 25 bp, Rattus norvegicus
cctggcgtgccgtagttcctagtct

SEQ ID NO: 455182 - DNA, 25 bp, Rattus norvegicus
gccgacaagcgtagcttgtagccaa

SEQ ID NO: 455183 - DNA, 25 bp, Rattus norvegicus
gcgtagcttgtagccaatagaaaac

SEQ ID NO: 455184 - DNA, 25 bp, Rattus norvegicus
gaagtcttttcgcttcaaccaatgg

SEQ ID NO: 455185 - DNA, 25 bp, Rattus norvegicus
tcttttcgcttcaaccaatggcgta

SEQ ID NO: 455186 - DNA, 25 bp, Rattus norvegicus
tttcgcttcaaccaatggcgtacta

SEQ ID NO: 455187 - DNA, 25 bp, Rattus norvegicus
cgcttcaaccaatggcgtactaata

SEQ ID NO: 455188 - DNA, 25 bp, Rattus norvegicus
tcaaccaatggcgtactaataaggg

SEQ ID NO: 455189 - DNA, 25 bp, Rattus norvegicus
aaccaatggcgtactaataagggcg

SEQ ID NO: 455190 - DNA, 25 bp, Rattus norvegicus
caatggcgtactaataagggcgggt

SEQ ID NO: 455191 - DNA, 25 bp, Rattus norvegicus
caagcgtagcttgtagccaatagaa

SEQ ID NO: 455192 - DNA, 25 bp, Rattus norvegicus
tgagagcggcctggccaagcaggcg

SEQ ID NO: 455193 - DNA, 25 bp, Rattus norvegicus
tgaagagcaccacgaagacgcaacg

SEQ ID NO: 455194 - DNA, 25 bp, Rattus norvegicus
tcccacagccacgtgaaggggctgg

SEQ ID NO: 455195 - DNA, 25 bp, Rattus norvegicus
attgcctcccacagccacgtgaagg

SEQ ID NO: 455196 - DNA, 25 bp, Rattus norvegicus
accacgaagacgcaacgcattgcct

SEQ ID NO: 455197 - DNA, 25 bp, Rattus norvegicus
gagcaccacgaagacgcaacgcatt

SEQ ID NO: 455198 - DNA, 25 bp, Rattus norvegicus
attgaggaggtgaagagcaccacga

SEQ ID NO: 455199 - DNA, 25 bp, Rattus norvegicus
cgtcaaaatgaagattgaggaggtg

SEQ ID NO: 455200 - DNA, 25 bp, Rattus norvegicus
cactcgtcaaaatgaagattgagga

SEQ ID NO: 455201 - DNA, 25 bp, Rattus norvegicus
gcacacactcgtcaaaatgaagatt

SEQ ID NO: 455202 - DNA, 25 bp, Rattus norvegicus
ggctgcacacactcgtcaaaatgaa

SEQ ID NO: 455203 - DNA, 25 bp, Rattus norvegicus
ccacgcaggttgtggctgcacacac

SEQ ID NO: 455204 - DNA, 25 bp, Rattus norvegicus
gtggctgcacacactcgtcaaaatg

SEQ ID NO: 455205 - DNA, 25 bp, Rattus norvegicus
tctccacgcaggttgtggctgcaca

SEQ ID NO: 455206 - DNA, 25 bp, Rattus norvegicus
ctggcagggctggcaatcgcccgct

SEQ ID NO: 455207 - DNA, 25 bp, Rattus norvegicus
cccgcgcgatcaatgggcggcgtgc

SEQ ID NO: 455208 - DNA, 25 bp, Rattus norvegicus
cgcccgctggccctgtcgctctccc

SEQ ID NO: 455209 - DNA, 25 bp, Rattus norvegicus
gtcactcggctctgtgcggtgatta

SEQ ID NO: 455210 - DNA, 25 bp, Rattus norvegicus
cggctctgtgcggtgattaatggcc

SEQ ID NO: 455211 - DNA, 25 bp, Rattus norvegicus
gtcagcgcgatggatgtggctgtca

SEQ ID NO: 455212 - DNA, 25 bp, Rattus norvegicus
ctgtcaggccgagcgtccgcgctga

SEQ ID NO: 455213 - DNA, 25 bp, Rattus norvegicus
ataagatgggccgatgcgcgcccgc

SEQ ID NO: 455214 - DNA, 25 bp, Rattus norvegicus
cgcgcccgccgattgcccgctccgt

SEQ ID NO: 455215 - DNA, 25 bp, Rattus norvegicus
tgcccgctccgtcacccgccgtcac

SEQ ID NO: 455216 - DNA, 25 bp, Rattus norvegicus
gcgccgtcagcacgcgtgattaatg

SEQ ID NO: 455217 - DNA, 25 bp, Rattus norvegicus
ccagacccttgctgcccgcggaccc

SEQ ID NO: 455218 - DNA, 25 bp, Rattus norvegicus
cagcacgcgtgattaatggggacgc

SEQ ID NO: 455219 - DNA, 25 bp, Rattus norvegicus
gaggtgcggcccagacccttgctgc

SEQ ID NO: 455220 - DNA, 25 bp, Rattus norvegicus
tttcagcgagcgaggacccttcaag

SEQ ID NO: 455221 - DNA, 25 bp, Rattus norvegicus
gcgaggacccttcaagcagcttccg

SEQ ID NO: 455222 - DNA, 25 bp, Rattus norvegicus
caggctttcagcgagcgaggaccct

SEQ ID NO: 455223 - DNA, 25 bp, Rattus norvegicus
cgaggacccttcaagcagcttctgc

SEQ ID NO: 455224 - DNA, 25 bp, Rattus norvegicus
agcgaggacccttcaagcagcttct

SEQ ID NO: 455225 - DNA, 25 bp, Rattus norvegicus
ctttcagcgagcgaggacccttcaa

SEQ ID NO: 455226 - DNA, 25 bp, Rattus norvegicus
ctcaggctttcagcgagcgaggacc

SEQ ID NO: 455227 - DNA, 25 bp, Rattus norvegicus
gagcgaggacccttcaagcagcttc

SEQ ID NO: 455228 - DNA, 25 bp, Rattus norvegicus
ttcaagcagcttccgcggcagctct

SEQ ID NO: 455229 - DNA, 25 bp, Rattus norvegicus
tcagcgagcgaggacccttcaagca

SEQ ID NO: 455230 - DNA, 25 bp, Rattus norvegicus
ggacccttcaagcagcttctgcggc

SEQ ID NO: 455231 - DNA, 25 bp, Rattus norvegicus
ccttcaagcagcttctgcggcagct

SEQ ID NO: 455232 - DNA, 25 bp, Rattus norvegicus
gcgaggacccttcaagcagcttctg

SEQ ID NO: 455233 - DNA, 25 bp, Rattus norvegicus
aggctttcagcgagcgaggaccctt

SEQ ID NO: 455234 - DNA, 25 bp, Rattus norvegicus
tagagagcagcgaaccagcacagcc

SEQ ID NO: 455235 - DNA, 25 bp, Rattus norvegicus
acgtgacagacaagtagagagcagc

SEQ ID NO: 455236 - DNA, 25 bp, Rattus norvegicus
ctcatcgttcggctggtccgtcgtc

SEQ ID NO: 455237 - DNA, 25 bp, Rattus norvegicus
gccaaggcggagctaaattggtgga

SEQ ID NO: 455238 - DNA, 25 bp, Rattus norvegicus
attacggccgctgtaggcgatgctt

SEQ ID NO: 455239 - DNA, 25 bp, Rattus norvegicus
tgtaggcgatgcttcacgactcctg

SEQ ID NO: 455240 - DNA, 25 bp, Rattus norvegicus
tgcttcacgactcctgccgtaaagg

SEQ ID NO: 455241 - DNA, 25 bp, Rattus norvegicus
actcctgccgtaaaggtcgcatgcg

SEQ ID NO: 455242 - DNA, 25 bp, Rattus norvegicus
cgtaaaggtcgcatgcggcgcatgc

SEQ ID NO: 455243 - DNA, 25 bp, Rattus norvegicus
ggcgcatgcgcacttcctctccctt

SEQ ID NO: 455244 - DNA, 25 bp, Rattus norvegicus
ttcctgtatcccgacgcagtcttgg

SEQ ID NO: 455245 - DNA, 25 bp, Rattus norvegicus
tcccgacgcagtcttggttgtggtg

SEQ ID NO: 455246 - DNA, 25 bp, Rattus norvegicus
cttggttgtggtggctcatcgttcg

SEQ ID NO: 455247 - DNA, 25 bp, Rattus norvegicus
caacaacgacaaaaacgtgacagac

SEQ ID NO: 455248 - DNA, 25 bp, Rattus norvegicus
tccggaagtgaggaacgagtcagcc

SEQ ID NO: 455249 - DNA, 25 bp, Rattus norvegicus
tcggtgaccctaagtgccagggata

SEQ ID NO: 455250 - DNA, 25 bp, Rattus norvegicus
cccaagcggagaaagaagacgtatt

SEQ ID NO: 455251 - DNA, 25 bp, Rattus norvegicus
gcctctgaggatacctaagctcttg

SEQ ID NO: 455252 - DNA, 25 bp, Rattus norvegicus
gaatcctgtcctgcattcctcctgg

SEQ ID NO: 455253 - DNA, 25 bp, Rattus norvegicus
tcctcagccgagagacacgtcagtg

SEQ ID NO: 455254 - DNA, 25 bp, Rattus norvegicus
agggatagcatgtcgcgactcagta

SEQ ID NO: 455255 - DNA, 25 bp, Rattus norvegicus
taagctcttgcgtttgaggacggtc

SEQ ID NO: 455256 - DNA, 25 bp, Rattus norvegicus
tatggccctacgaagcagactattc

SEQ ID NO: 455257 - DNA, 25 bp, Rattus norvegicus
gtacttcaccgtggttatggcccta

SEQ ID NO: 455258 - DNA, 25 bp, Rattus norvegicus
agtcagcctgtgttacttatgagta

SEQ ID NO: 455259 - DNA, 25 bp, Rattus norvegicus
agcaactgctcagactcgtccggaa

SEQ ID NO: 455260 - DNA, 25 bp, Rattus norvegicus
cgactgcgctccacttcgagtgagg

SEQ ID NO: 455261 - DNA, 25 bp, Rattus norvegicus
acgcgcgagagaacagccgtgtgtt

SEQ ID NO: 455262 - DNA, 25 bp, Rattus norvegicus
agtccctcactcagcaaatgctctg

SEQ ID NO: 455263 - DNA, 25 bp, Rattus norvegicus
actcagcaaatgctctgctctgcgc

SEQ ID NO: 455264 - DNA, 25 bp, Rattus norvegicus
accgtagtccctcactcagcaaatg

SEQ ID NO: 455265 - DNA, 25 bp, Rattus norvegicus
taacaggtgctctctctccgcgcgg

SEQ ID NO: 455266 - DNA, 25 bp, Rattus norvegicus
ggccacccagaggtaacaggtgctc

SEQ ID NO: 455267 - DNA, 25 bp, Rattus norvegicus
cgctggcggccacccagaggtaaca

SEQ ID NO: 455268 - DNA, 25 bp, Rattus norvegicus
agcgctataaatagacggagcgagg

SEQ ID NO: 455269 - DNA, 25 bp, Rattus norvegicus
cactacccgaaatgggccagtgagg

SEQ ID NO: 455270 - DNA, 25 bp, Rattus norvegicus
tgactgatcacactacccgaaatgg

SEQ ID NO: 455271 - DNA, 25 bp, Rattus norvegicus
cgggcagacctgactgatcacacta

SEQ ID NO: 455272 - DNA, 25 bp, Rattus norvegicus
agccgggcagacctgactgatcaca

SEQ ID NO: 455273 - DNA, 25 bp, Rattus norvegicus
ctacttactcgatgctgcccggccc

SEQ ID NO: 455274 - DNA, 25 bp, Rattus norvegicus
ggccagtgaggacaagcgctataaa

SEQ ID NO: 455275 - DNA, 25 bp, Rattus norvegicus
ccagaccgcgcgctaggagcaaccg

SEQ ID NO: 455276 - DNA, 25 bp, Rattus norvegicus
acagccctcgtttgcctggcgctga

SEQ ID NO: 455277 - DNA, 25 bp, Rattus norvegicus
gacttgtgcccgtcaactgcatctt

SEQ ID NO: 455278 - DNA, 25 bp, Rattus norvegicus
actgcatcttcccagaccggtgtgg

SEQ ID NO: 455279 - DNA, 25 bp, Rattus norvegicus
gtgtgggaacaacggccaggtccac

SEQ ID NO: 455280 - DNA, 25 bp, Rattus norvegicus
tccacgtcctgtgtggcgtgctgat

SEQ ID NO: 455281 - DNA, 25 bp, Rattus norvegicus
aggaggcaaagtttgtcggagaatc

SEQ ID NO: 455282 - DNA, 25 bp, Rattus norvegicus
actttgctcggggacccgcatctgc

SEQ ID NO: 455283 - DNA, 25 bp, Rattus norvegicus
ctcgcagcagctctgggctagggac

SEQ ID NO: 455284 - DNA, 25 bp, Rattus norvegicus
ccttcaggggtgtgttctggaaaag

SEQ ID NO: 455285 - DNA, 25 bp, Rattus norvegicus
cggccgcgatgagggaacagccctc

SEQ ID NO: 455286 - DNA, 25 bp, Rattus norvegicus
gcctggcgctgatactcgaggctgt

SEQ ID NO: 455287 - DNA, 25 bp, Rattus norvegicus
tgcctcaggataggagccgccgcca

SEQ ID NO: 455288 - DNA, 25 bp, Rattus norvegicus
gcgcagtagtctggctctagcccgc

SEQ ID NO: 455289 - DNA, 25 bp, Rattus norvegicus
tggcgacatgaactagagctggagc

SEQ ID NO: 455290 - DNA, 25 bp, Rattus norvegicus
ccctccggaggcaagaaacacgcgt

SEQ ID NO: 455291 - DNA, 25 bp, Rattus norvegicus
tcgaacacgtcagagtcctcagggt

SEQ ID NO: 455292 - DNA, 25 bp, Rattus norvegicus
ggtgagtgtcctcctcgaacacgtc

SEQ ID NO: 455293 - DNA, 25 bp, Rattus norvegicus
ccgaaccaggcggtcgcatccagaa

SEQ ID NO: 455294 - DNA, 25 bp, Rattus norvegicus
cccggagactagctcactaccaaga

SEQ ID NO: 455295 - DNA, 25 bp, Rattus norvegicus
gtgcccggccggatgtaaacactca

SEQ ID NO: 455296 - DNA, 25 bp, Rattus norvegicus
tggaagagcagtccgctataggccc

SEQ ID NO: 455297 - DNA, 25 bp, Rattus norvegicus
cacattgcgcgggatcttttctgaa

SEQ ID NO: 455298 - DNA, 25 bp, Rattus norvegicus
cccaggcttggaatactgaacctta

SEQ ID NO: 455299 - DNA, 25 bp, Rattus norvegicus
ctttcccggcctacttcaagttcag

SEQ ID NO: 455300 - DNA, 25 bp, Rattus norvegicus
agttcagcccaaccggcttggattc

SEQ ID NO: 455301 - DNA, 25 bp, Rattus norvegicus
ttggattccacccagaaggccgtac

SEQ ID NO: 455302 - DNA, 25 bp, Rattus norvegicus
atctcaggagttgtctgtgcccggc

SEQ ID NO: 455303 - DNA, 25 bp, Rattus norvegicus
agcctctggggacctctagtcttga

SEQ ID NO: 455304 - DNA, 25 bp, Rattus norvegicus
ttgtcagctcctcataaagttgccc

SEQ ID NO: 455305 - DNA, 25 bp, Rattus norvegicus
ctaacgaggtatccggagtgactgc

SEQ ID NO: 455306 - DNA, 25 bp, Rattus norvegicus
gagtgactgctgaatgaaaaccacg

SEQ ID NO: 455307 - DNA, 25 bp, Rattus norvegicus
gaaaaccacgtacccgagtctcaca

SEQ ID NO: 455308 - DNA, 25 bp, Rattus norvegicus
cccatatggcggtagtcgctgtcgc

SEQ ID NO: 455309 - DNA, 25 bp, Rattus norvegicus
gcggtagtcgctgtcgcagacctac

SEQ ID NO: 455310 - DNA, 25 bp, Rattus norvegicus
cgcagtcgaggacacgcgttcataa

SEQ ID NO: 455311 - DNA, 25 bp, Rattus norvegicus
gttcataacgacacgcacacgcctt

SEQ ID NO: 455312 - DNA, 25 bp, Rattus norvegicus
ccaggcaagctccacgcacatgtaa

SEQ ID NO: 455313 - DNA, 25 bp, Rattus norvegicus
tgtaaacatccaccgtggccacgca

SEQ ID NO: 455314 - DNA, 25 bp, Rattus norvegicus
acgatgcgatttctccaagggtgtc

SEQ ID NO: 455315 - DNA, 25 bp, Rattus norvegicus
gtcatacgcccactctaacgaggta

SEQ ID NO: 455316 - DNA, 25 bp, Rattus norvegicus
tccaagggtgtcacccgtgcgctct

SEQ ID NO: 455317 - DNA, 25 bp, Rattus norvegicus
gacccgccggacctttacgatgcga

SEQ ID NO: 455318 - DNA, 25 bp, Rattus norvegicus
cgaggccctaccgtggagtctggct

SEQ ID NO: 455319 - DNA, 25 bp, Rattus norvegicus
gcccaatcgatgcagcggatggccc

SEQ ID NO: 455320 - DNA, 25 bp, Rattus norvegicus
tccgcccaatcgatgcagcggatgg

SEQ ID NO: 455321 - DNA, 25 bp, Rattus norvegicus
ttggcctgcgtacccatcactcacg

SEQ ID NO: 455322 - DNA, 25 bp, Rattus norvegicus
gtacccatcactcacgcgcccatcc

SEQ ID NO: 455323 - DNA, 25 bp, Rattus norvegicus
ccctaccgtggagtctggcttcgca

SEQ ID NO: 455324 - DNA, 25 bp, Rattus norvegicus
gggcctggcgcacttcaacacccgg

SEQ ID NO: 455325 - DNA, 25 bp, Rattus norvegicus
tggcgcacttcaacacccgggggga

SEQ ID NO: 455326 - DNA, 25 bp, Rattus norvegicus
acatccctgggtagcgggtcctgca

SEQ ID NO: 455327 - DNA, 25 bp, Rattus norvegicus
cctgggtagcgggtcctgcaccctt

SEQ ID NO: 455328 - DNA, 25 bp, Rattus norvegicus
ggtcctgcaccctttgtgcagcaga

SEQ ID NO: 455329 - DNA, 25 bp, Rattus norvegicus
gcaccctttgtgcagcagacgggcc

SEQ ID NO: 455330 - DNA, 25 bp, Rattus norvegicus
agacgggccccagttacagcgaagg

SEQ ID NO: 455331 - DNA, 25 bp, Rattus norvegicus
ctaccgtggagtctggcttcgcacc

SEQ ID NO: 455332 - DNA, 25 bp, Rattus norvegicus
gcactcaggcctgccactggaggga

SEQ ID NO: 455333 - DNA, 25 bp, Rattus norvegicus
aatgtctgggcacgcccacaccatg

SEQ ID NO: 455334 - DNA, 25 bp, Rattus norvegicus
gcaccagctgccacgggttttcgcg

SEQ ID NO: 455335 - DNA, 25 bp, Rattus norvegicus
atccgtcccagaccggcgcaggtag

SEQ ID NO: 455336 - DNA, 25 bp, Rattus norvegicus
agctgccacgggttttcgcgcgaaa

SEQ ID NO: 455337 - DNA, 25 bp, Rattus norvegicus
ttcgcgcgaaaaccgggtcacgtga

SEQ ID NO: 455338 - DNA, 25 bp, Rattus norvegicus
tccagggaggactcagacgtcacga

SEQ ID NO: 455339 - DNA, 25 bp, Rattus norvegicus
acgtcacgacgtccgcgtctatcta

SEQ ID NO: 455340 - DNA, 25 bp, Rattus norvegicus
ggcttgaatgtctgggcacgcccac

SEQ ID NO: 455341 - DNA, 25 bp, Rattus norvegicus
ataggggccaagcaagccgaaaacg

SEQ ID NO: 455342 - DNA, 25 bp, Rattus norvegicus
agccgaaaacgctgaataccgcccg

SEQ ID NO: 455343 - DNA, 25 bp, Rattus norvegicus
gcccgggatcgacacacaactcacc

SEQ ID NO: 455344 - DNA, 25 bp, Rattus norvegicus
tgcgctagcttcaccgcaccagctg

SEQ ID NO: 455345 - DNA, 25 bp, Rattus norvegicus
tccgcgtctatctaggacggaagga

SEQ ID NO: 455346 - DNA, 25 bp, Rattus norvegicus
cccattacgataggctgctggaagg

SEQ ID NO: 455347 - DNA, 25 bp, Rattus norvegicus
tgcgcagcccggctctcaggtaagc

SEQ ID NO: 455348 - DNA, 25 bp, Rattus norvegicus
tcttgctccgccaagctagtgaggc

SEQ ID NO: 455349 - DNA, 25 bp, Rattus norvegicus
gactgcagtccctttaagagctccg

SEQ ID NO: 455350 - DNA, 25 bp, Rattus norvegicus
gctccaccctcggagacattgggcg

SEQ ID NO: 455351 - DNA, 25 bp, Rattus norvegicus
gtgctcagtgcgcttcccgaaacgc

SEQ ID NO: 455352 - DNA, 25 bp, Rattus norvegicus
aacaggggttgtgactgttttcaca

SEQ ID NO: 455353 - DNA, 25 bp, Rattus norvegicus
cgccacacactttgcttagcttaga

SEQ ID NO: 455354 - DNA, 25 bp, Rattus norvegicus
gacccacgtagaacctcggctgcgg

SEQ ID NO: 455355 - DNA, 25 bp, Rattus norvegicus
ttggtctgttccattcctgtgggtg

SEQ ID NO: 455356 - DNA, 25 bp, Rattus norvegicus
tggatgagtgccacaaacaggggtt

SEQ ID NO: 455357 - DNA, 25 bp, Rattus norvegicus
ttgcttagacgaaaaaacactagcc

SEQ ID NO: 455358 - DNA, 25 bp, Rattus norvegicus
cccgaaacgctttaggggtgagctg

SEQ ID NO: 455359 - DNA, 25 bp, Rattus norvegicus
aacactagccgaggcgcctgcaagt

SEQ ID NO: 455360 - DNA, 25 bp, Rattus norvegicus
gtggcgcccactcgcacgccggagc

SEQ ID NO: 455361 - DNA, 25 bp, Rattus norvegicus
caccaggcctgggaccgtccaggaa

SEQ ID NO: 455362 - DNA, 25 bp, Rattus norvegicus
ccaggcctgggaccgtccaggaagc

SEQ ID NO: 455363 - DNA, 25 bp, Rattus norvegicus
aggcctgggaccgtccaggaagcaa

SEQ ID NO: 455364 - DNA, 25 bp, Rattus norvegicus
ctgggaccgtccaggaagcaagggg

SEQ ID NO: 455365 - DNA, 25 bp, Rattus norvegicus
acctccagggaaggaatgacccgtg

SEQ ID NO: 455366 - DNA, 25 bp, Rattus norvegicus
cgcccactcgcacgccggagccgga

SEQ ID NO: 455367 - DNA, 25 bp, Rattus norvegicus
ctccagggaaggaatgacccgtgga

SEQ ID NO: 455368 - DNA, 25 bp, Rattus norvegicus
ccttgcagccgggtggagggcctgc

SEQ ID NO: 455369 - DNA, 25 bp, Rattus norvegicus
gtcctctccggtggcaccgcaccgc

SEQ ID NO: 455370 - DNA, 25 bp, Rattus norvegicus
agagccggcgtcctctccggtggca

SEQ ID NO: 455371 - DNA, 25 bp, Rattus norvegicus
cagggaaggaatgacccgtggaggc

SEQ ID NO: 455372 - DNA, 25 bp, Rattus norvegicus
gtcgtcctcgccacacaccaggcct

SEQ ID NO: 455373 - DNA, 25 bp, Rattus norvegicus
cctccagggaaggaatgacccgtgg

SEQ ID NO: 455374 - DNA, 25 bp, Rattus norvegicus
tggcagacaccgacctgatccagta

SEQ ID NO: 455375 - DNA, 25 bp, Rattus norvegicus
ctcctctacaggattgggtctccgg

SEQ ID NO: 455376 - DNA, 25 bp, Rattus norvegicus
gcggagacgcccactggctccaaga

SEQ ID NO: 455377 - DNA, 25 bp, Rattus norvegicus
ccagagactggacaccgggaaccta

SEQ ID NO: 455378 - DNA, 25 bp, Rattus norvegicus
aggtgacccacctttccagagactg

SEQ ID NO: 455379 - DNA, 25 bp, Rattus norvegicus
gcttagaagccagcgccagcctgca

SEQ ID NO: 455380 - DNA, 25 bp, Rattus norvegicus
caccgggaacctagagcacagtcta

SEQ ID NO: 455381 - DNA, 25 bp, Rattus norvegicus
cgacgccaagttctgaggcagctta

SEQ ID NO: 455382 - DNA, 25 bp, Rattus norvegicus
tgtcagctccagtagccacctgcga

SEQ ID NO: 455383 - DNA, 25 bp, Rattus norvegicus
caccgcagtgttgggtgtcagctcc

SEQ ID NO: 455384 - DNA, 25 bp, Rattus norvegicus
ccacagcgcggccacaacgtggtta

SEQ ID NO: 455385 - DNA, 25 bp, Rattus norvegicus
tgatccagtacctcagagcgaagca

SEQ ID NO: 455386 - DNA, 25 bp, Rattus norvegicus
ggtctccgggacatcgataatcgtt

SEQ ID NO: 455387 - DNA, 25 bp, Rattus norvegicus
tggctccaagagctacccacgagaa

SEQ ID NO: 455388 - DNA, 25 bp, Rattus norvegicus
gtcctattgctcatctcggcctgcg

SEQ ID NO: 455389 - DNA, 25 bp, Rattus norvegicus
caccgatcgcttaggtgccgcgggc

SEQ ID NO: 455390 - DNA, 25 bp, Rattus norvegicus
tcggcctgcgcaccgatcgcttagg

SEQ ID NO: 455391 - DNA, 25 bp, Rattus norvegicus
caccgcttgccttcaaagggcgatg

SEQ ID NO: 455392 - DNA, 25 bp, Rattus norvegicus
cccagcatgaatggggcgctgagct

SEQ ID NO: 455393 - DNA, 25 bp, Rattus norvegicus
gaagcacttgccctggtcctattgc

SEQ ID NO: 455394 - DNA, 25 bp, Rattus norvegicus
tcgccgctgcccagcatgaatgggg

SEQ ID NO: 455395 - DNA, 25 bp, Rattus norvegicus
ttcaaagggcgatggccacatcagc

SEQ ID NO: 455396 - DNA, 25 bp, Rattus norvegicus
cagccttaaaactctggactagggt

SEQ ID NO: 455397 - DNA, 25 bp, Rattus norvegicus
ccaggagtcggtgcactctacgacg

SEQ ID NO: 455398 - DNA, 25 bp, Rattus norvegicus
tgcactctacgacgagcacagactg

SEQ ID NO: 455399 - DNA, 25 bp, Rattus norvegicus
gcacagactggaaatacagctttcg

SEQ ID NO: 455400 - DNA, 25 bp, Rattus norvegicus
tacagctttcgtccacggaagggta

SEQ ID NO: 455401 - DNA, 25 bp, Rattus norvegicus
actgagtccagaggaagcacttgcc

SEQ ID NO: 455402 - DNA, 25 bp, Rattus norvegicus
gcgaccagaccagccttcagggacg

SEQ ID NO: 455403 - DNA, 25 bp, Rattus norvegicus
agatcggccgctcaggaaacccagc

SEQ ID NO: 455404 - DNA, 25 bp, Rattus norvegicus
ttctcttggcctagagaggcgtatc

SEQ ID NO: 455405 - DNA, 25 bp, Rattus norvegicus
gttgagcgccacctcgacttcctat

SEQ ID NO: 455406 - DNA, 25 bp, Rattus norvegicus
agaacacacacactaggcgaccaga

SEQ ID NO: 455407 - DNA, 25 bp, Rattus norvegicus
tgcagagtccggctagagaacacac

SEQ ID NO: 455408 - DNA, 25 bp, Rattus norvegicus
ctccgctcgagtcctggattccatg

SEQ ID NO: 455409 - DNA, 25 bp, Rattus norvegicus
gatctcgccagctgcaagcatcctg

SEQ ID NO: 455410 - DNA, 25 bp, Rattus norvegicus
agggctgccggcacatcgccgatct

SEQ ID NO: 455411 - DNA, 25 bp, Rattus norvegicus
cagagtcccttctccgggttaccag

SEQ ID NO: 455412 - DNA, 25 bp, Rattus norvegicus
gtgatgcgttctgtgccacctcaca

SEQ ID NO: 455413 - DNA, 25 bp, Rattus norvegicus
tccaagttaccctgcggggacaatg

SEQ ID NO: 455414 - DNA, 25 bp, Rattus norvegicus
tcggaccgtgggaaccactgccaca

SEQ ID NO: 455415 - DNA, 25 bp, Rattus norvegicus
ccgactctctggttccgttctcttg

SEQ ID NO: 455416 - DNA, 25 bp, Rattus norvegicus
ggcgctctctgagctgcccatgaca

SEQ ID NO: 455417 - DNA, 25 bp, Rattus norvegicus
ctcggagatacaaggcggtggaaac

SEQ ID NO: 455418 - DNA, 25 bp, Rattus norvegicus
aatacctcgttctattggctgctga

SEQ ID NO: 455419 - DNA, 25 bp, Rattus norvegicus
cgggccagcaatacctcgttctatt

SEQ ID NO: 455420 - DNA, 25 bp, Rattus norvegicus
cgtcactcgggacacgggccagcaa

SEQ ID NO: 455421 - DNA, 25 bp, Rattus norvegicus
ccgggatgacgctgctcagcggcct

SEQ ID NO: 455422 - DNA, 25 bp, Rattus norvegicus
agcaaccgggatgacgctgctcagc

SEQ ID NO: 455423 - DNA, 25 bp, Rattus norvegicus
gctctctgagctgcccatgacagga

SEQ ID NO: 455424 - DNA, 25 bp, Rattus norvegicus
ctattggctgctgagactggagcgc

SEQ ID NO: 455425 - DNA, 25 bp, Rattus norvegicus
tccatctcgaaggacacccttcggg

SEQ ID NO: 455426 - DNA, 25 bp, Rattus norvegicus
cccggatgccctgcagcacccggac

SEQ ID NO: 455427 - DNA, 25 bp, Rattus norvegicus
aaaccgacttgaggcggccggctgc

SEQ ID NO: 455428 - DNA, 25 bp, Rattus norvegicus
tacaaggcggtggaaaccgacttga

SEQ ID NO: 455429 - DNA, 25 bp, Rattus norvegicus
ggctccacagcaaccgggatgacgc

SEQ ID NO: 455430 - DNA, 25 bp, Rattus norvegicus
tcttcagcaagagttactgtccaca

SEQ ID NO: 455431 - DNA, 25 bp, Rattus norvegicus
actgtccacacagctcgcgggtagg

SEQ ID NO: 455432 - DNA, 25 bp, Rattus norvegicus
tggccagtgcgcagcgttctcaagt

SEQ ID NO: 455433 - DNA, 25 bp, Rattus norvegicus
ggcaacagggttatgatcttcagca

SEQ ID NO: 455434 - DNA, 25 bp, Rattus norvegicus
tctcatcgagggcaacagggttatg

SEQ ID NO: 455435 - DNA, 25 bp, Rattus norvegicus
cgccgcctgcgggatctcatcgagg

SEQ ID NO: 455436 - DNA, 25 bp, Rattus norvegicus
tcgtggcggcctcatgtcgtcgcca

SEQ ID NO: 455437 - DNA, 25 bp, Rattus norvegicus
caaccgccgcctgggtgctgttcgt

SEQ ID NO: 455438 - DNA, 25 bp, Rattus norvegicus
cgcaaacctcgcctgggcaggggaa

SEQ ID NO: 455439 - DNA, 25 bp, Rattus norvegicus
tcgggcgcaaacctcgcctgggcag

SEQ ID NO: 455440 - DNA, 25 bp, Rattus norvegicus
ggagcgacaacgaagccctggagaa

SEQ ID NO: 455441 - DNA, 25 bp, Rattus norvegicus
tcagcggctttgctggtgtcgtccc

SEQ ID NO: 455442 - DNA, 25 bp, Rattus norvegicus
cgttctcaagttctcagcggctttg

SEQ ID NO: 455443 - DNA, 25 bp, Rattus norvegicus
agtgcgcagcgttctcaagttctca

SEQ ID NO: 455444 - DNA, 25 bp, Rattus norvegicus
gcagaccaggctcatgcgcctcgtg

SEQ ID NO: 455445 - DNA, 25 bp, Rattus norvegicus
ccgcgccagcttgttgcggtaggct

SEQ ID NO: 455446 - DNA, 25 bp, Rattus norvegicus
tggacacgcgtgaggtccttctctg

SEQ ID NO: 455447 - DNA, 25 bp, Rattus norvegicus
cgcaaagtcggctaacgagggcagc

SEQ ID NO: 455448 - DNA, 25 bp, Rattus norvegicus
ggctcgcgcacaaagaggaaggtca

SEQ ID NO: 455449 - DNA, 25 bp, Rattus norvegicus
cagcagcacgcgcttccagttggtg

SEQ ID NO: 455450 - DNA, 25 bp, Rattus norvegicus
agaagccggtgcttgtcgtccacca

SEQ ID NO: 455451 - DNA, 25 bp, Rattus norvegicus
gtgcacttcggccatcgcagagcgc

SEQ ID NO: 455452 - DNA, 25 bp, Rattus norvegicus
tgcgcgtgccatagcgcctctggaa

SEQ ID NO: 455453 - DNA, 25 bp, Rattus norvegicus
ccaggaactcggcaaagcgcacgtc

SEQ ID NO: 455454 - DNA, 25 bp, Rattus norvegicus
gcccactacatcatagcgcactagg

SEQ ID NO: 455455 - DNA, 25 bp, Rattus norvegicus
gccagtgtttcaaacttgcccacta

SEQ ID NO: 455456 - DNA, 25 bp, Rattus norvegicus
aggcagcatcatccgccagtgtttc

SEQ ID NO: 455457 - DNA, 25 bp, Rattus norvegicus
ccggttgacttcagctggcgcaaag

SEQ ID NO: 455458 - DNA, 25 bp, Rattus norvegicus
cgtcccttcaagtgcccgctggatg

SEQ ID NO: 455459 - DNA, 25 bp, Rattus norvegicus
gccacgagcaggagagtttgttcaa

SEQ ID NO: 455460 - DNA, 25 bp, Rattus norvegicus
gtctacaacctcaaggcgcacatga

SEQ ID NO: 455461 - DNA, 25 bp, Rattus norvegicus
cggctgcggcaagaagttcaccaca

SEQ ID NO: 455462 - DNA, 25 bp, Rattus norvegicus
aagctgcgtccttttagctgcccgg

SEQ ID NO: 455463 - DNA, 25 bp, Rattus norvegicus
aacggcacctgcagtcccatgacaa

SEQ ID NO: 455464 - DNA, 25 bp, Rattus norvegicus
aaggtgcacctgctgacgcacggca

SEQ ID NO: 455465 - DNA, 25 bp, Rattus norvegicus
ttcgccaagaagcaccagttgaagg

SEQ ID NO: 455466 - DNA, 25 bp, Rattus norvegicus
tgcgcgctgagcttcgccaagaagc

SEQ ID NO: 455467 - DNA, 25 bp, Rattus norvegicus
cgactccttcgtggtactgctggaa

SEQ ID NO: 455468 - DNA, 25 bp, Rattus norvegicus
ttcaagtgcgaggtatgcgccgagc

SEQ ID NO: 455469 - DNA, 25 bp, Rattus norvegicus
cggccgacacccatgaacaggagga

SEQ ID NO: 455470 - DNA, 25 bp, Rattus norvegicus
cctcagctgggcctaagatggacct

SEQ ID NO: 455471 - DNA, 25 bp, Rattus norvegicus
cagccacgcgcggagaccaacatgg

SEQ ID NO: 455472 - DNA, 25 bp, Rattus norvegicus
gcaaatccaatgtgcgcagttcctg

SEQ ID NO: 455473 - DNA, 25 bp, Rattus norvegicus
aggtactctctgaagctgtgcgcca

SEQ ID NO: 455474 - DNA, 25 bp, Rattus norvegicus
gcgttcctgcgcttatgttccgttt

SEQ ID NO: 455475 - DNA, 25 bp, Rattus norvegicus
ccacgtacttcacacccaggggtgg

SEQ ID NO: 455476 - DNA, 25 bp, Rattus norvegicus
ctggacctgcgctcccatatggcgg

SEQ ID NO: 455477 - DNA, 25 bp, Rattus norvegicus
agcgcgctgggccttcagaaggcaa

SEQ ID NO: 455478 - DNA, 25 bp, Rattus norvegicus
ctcgtgacgtgcagcgctagccaat

SEQ ID NO: 455479 - DNA, 25 bp, Rattus norvegicus
ccagtacaggtccacgaagaggccg

SEQ ID NO: 455480 - DNA, 25 bp, Rattus norvegicus
cgcaccggaggacccagtacaggtc

SEQ ID NO: 455481 - DNA, 25 bp, Rattus norvegicus
gatcctatctcacgtgcgcaccgga

SEQ ID NO: 455482 - DNA, 25 bp, Rattus norvegicus
ctttcagtgggttctggatcctatc

SEQ ID NO: 455483 - DNA, 25 bp, Rattus norvegicus
tacgtggtctgcacttcgggactct

SEQ ID NO: 455484 - DNA, 25 bp, Rattus norvegicus
cacccgagatcctacgtggtctgca

SEQ ID NO: 455485 - DNA, 25 bp, Rattus norvegicus
agaggttactgtcggtcactgcagc

SEQ ID NO: 455486 - DNA, 25 bp, Rattus norvegicus
caagtccggccggaggaatgtggtc

SEQ ID NO: 455487 - DNA, 25 bp, Rattus norvegicus
cagaaccatgagttccgggaggagc

SEQ ID NO: 455488 - DNA, 25 bp, Rattus norvegicus
cctggcgcgaccctttcgccgccgc

SEQ ID NO: 455489 - DNA, 25 bp, Rattus norvegicus
gccagaaccatgagttccgggagga

SEQ ID NO: 455490 - DNA, 25 bp, Rattus norvegicus
cgtagctcaagtccggccggaggaa

SEQ ID NO: 455491 - DNA, 25 bp, Rattus norvegicus
cagccgccggaccttggggccgatc

SEQ ID NO: 455492 - DNA, 25 bp, Rattus norvegicus
atcttcctggccttgcgcccgcaag

SEQ ID NO: 455493 - DNA, 25 bp, Rattus norvegicus
cgcccgcaagtccacgcagccctag

SEQ ID NO: 455494 - DNA, 25 bp, Rattus norvegicus
tccacgcagccctaggcccgcaagt

SEQ ID NO: 455495 - DNA, 25 bp, Rattus norvegicus
taggcccgcaagtccaatcacccgc

SEQ ID NO: 455496 - DNA, 25 bp, Rattus norvegicus
caagtccaatcacccgcctggcgcg

SEQ ID NO: 455497 - DNA, 25 bp, Rattus norvegicus
cgcttggcgtagctcaagtccggcc

SEQ ID NO: 455498 - DNA, 25 bp, Rattus norvegicus
gcccgcttggcgtagctcaagtccg

SEQ ID NO: 455499 - DNA, 25 bp, Rattus norvegicus
cacgagccttcacggatcttcctgg

SEQ ID NO: 455500 - DNA, 25 bp, Rattus norvegicus
gtggagcaaattcctgagatgcttc

SEQ ID NO: 455501 - DNA, 25 bp, Rattus norvegicus
ggcactctgtcccaacacagcggga

SEQ ID NO: 455502 - DNA, 25 bp, Rattus norvegicus
cgtccagcagtgtggagcaaattcc

SEQ ID NO: 455503 - DNA, 25 bp, Rattus norvegicus
ttcctgagatgcttctaactccctc

SEQ ID NO: 455504 - DNA, 25 bp, Rattus norvegicus
ggtcctctctctgtctggcctcagt

SEQ ID NO: 455505 - DNA, 25 bp, Rattus norvegicus
gccaggtggccaggcacgcagaaaa

SEQ ID NO: 455506 - DNA, 25 bp, Rattus norvegicus
caccgcattggcgtggaaggcgcct

SEQ ID NO: 455507 - DNA, 25 bp, Rattus norvegicus
gcacgcagaaaaacggcgcggagtc

SEQ ID NO: 455508 - DNA, 25 bp, Rattus norvegicus
cccttccgaaggtatgtgtgcacgc

SEQ ID NO: 455509 - DNA, 25 bp, Rattus norvegicus
ccaggggcgcacagaatcggagcct

SEQ ID NO: 455510 - DNA, 25 bp, Rattus norvegicus
gtgcgcgcggaaaaccaccgcggct

SEQ ID NO: 455511 - DNA, 25 bp, Rattus norvegicus
ttgcaaagccagtggtgccgagtcc

SEQ ID NO: 455512 - DNA, 25 bp, Rattus norvegicus
gaagctattcggtcgcgtcctccgc

SEQ ID NO: 455513 - DNA, 25 bp, Rattus norvegicus
gtccgcagagcgcagaagctattcg

SEQ ID NO: 455514 - DNA, 25 bp, Rattus norvegicus
aggagcaacgtagtgcggcctcgct

SEQ ID NO: 455515 - DNA, 25 bp, Rattus norvegicus
gtcgagtcaccatggtcgccaggtt

SEQ ID NO: 455516 - DNA, 25 bp, Rattus norvegicus
agtcaccatggtcgccaggttgggc

SEQ ID NO: 455517 - DNA, 25 bp, Rattus norvegicus
cttgggatttttccctcccgcacat

SEQ ID NO: 455518 - DNA, 25 bp, Rattus norvegicus
tcccgcacatccggggtggcagtgc

SEQ ID NO: 455519 - DNA, 25 bp, Rattus norvegicus
gtgtctgtgccggtttgctctcgca

SEQ ID NO: 455520 - DNA, 25 bp, Rattus norvegicus
gtttgctctcgcagcatccggagga

SEQ ID NO: 455521 - DNA, 25 bp, Rattus norvegicus
ggcctcgctggaccaatcgccaaag

SEQ ID NO: 455522 - DNA, 25 bp, Rattus norvegicus
ggaccaatcgccaaagtgctcgttg

SEQ ID NO: 455523 - DNA, 25 bp, Rattus norvegicus
ccaaagtgctcgttgccgtggcaac

SEQ ID NO: 455524 - DNA, 25 bp, Rattus norvegicus
tgccgtggcaactgcagcatcaaac

SEQ ID NO: 455525 - DNA, 25 bp, Rattus norvegicus
tgcagcatcaaacagggccgccctg

SEQ ID NO: 455526 - DNA, 25 bp, Rattus norvegicus
cttcctccaggagcaacgtagtgcg

SEQ ID NO: 455527 - DNA, 25 bp, Rattus norvegicus
ctctcgcagcatccggaggagggac

SEQ ID NO: 455528 - DNA, 25 bp, Rattus norvegicus
ctatcgccatctctatccggaaggg

SEQ ID NO: 455529 - DNA, 25 bp, Rattus norvegicus
gcctctcagcgtctagagccttctg

SEQ ID NO: 455530 - DNA, 25 bp, Rattus norvegicus
aaacgctgcggacgatcccaagtgc

SEQ ID NO: 455531 - DNA, 25 bp, Rattus norvegicus
tggcggcctctgtaacagttccaaa

SEQ ID NO: 455532 - DNA, 25 bp, Rattus norvegicus
tttctcaccttccttcgcggcattg

SEQ ID NO: 455533 - DNA, 25 bp, Rattus norvegicus
gtggccaaccgcgtcacattgctca

SEQ ID NO: 455534 - DNA, 25 bp, Rattus norvegicus
tggaacccaaccactgcgaggcgtg

SEQ ID NO: 455535 - DNA, 25 bp, Rattus norvegicus
cacatttttccgtctggtaccgaga

SEQ ID NO: 455536 - DNA, 25 bp, Rattus norvegicus
gcgggaatagttacaggcataggcc

SEQ ID NO: 455537 - DNA, 25 bp, Rattus norvegicus
accgcctccgatcagggaaagcaga

SEQ ID NO: 455538 - DNA, 25 bp, Rattus norvegicus
ttctaggcgtttccgcgaccaatta

SEQ ID NO: 455539 - DNA, 25 bp, Rattus norvegicus
gcggcgtcaccatccaatcaatatg

SEQ ID NO: 455540 - DNA, 25 bp, Rattus norvegicus
tcgccacagccagtcggagagtacc

SEQ ID NO: 455541 - DNA, 25 bp, Rattus norvegicus
ggtcgacccaatccaggccttgcta

SEQ ID NO: 455542 - DNA, 25 bp, Rattus norvegicus
aatagctggggtaatctcgggtcga

SEQ ID NO: 455543 - DNA, 25 bp, Rattus norvegicus
tcagctcttgcaggtactcggccgc

SEQ ID NO: 455544 - DNA, 25 bp, Rattus norvegicus
aggccggcgttctcacggcttagcc

SEQ ID NO: 455545 - DNA, 25 bp, Rattus norvegicus
aggtgtcgccggtgccgctccagca

SEQ ID NO: 455546 - DNA, 25 bp, Rattus norvegicus
gcacttacttgtcgcggcggctgct

SEQ ID NO: 455547 - DNA, 25 bp, Rattus norvegicus
tctccttaatcctccgtccgaaata

SEQ ID NO: 455548 - DNA, 25 bp, Rattus norvegicus
gccgctctgcacttacttgtcgcgg

SEQ ID NO: 455549 - DNA, 25 bp, Rattus norvegicus
gtccggccgagggactcactccaca

SEQ ID NO: 455550 - DNA, 25 bp, Rattus norvegicus
tggagagcactaagcaagagtggcc

SEQ ID NO: 455551 - DNA, 25 bp, Rattus norvegicus
cgtccgaaatagctggggtaatctc

SEQ ID NO: 455552 - DNA, 25 bp, Rattus norvegicus
tcctccgtccgaaatagctggggta

SEQ ID NO: 455553 - DNA, 25 bp, Rattus norvegicus
tccgggtcagctcttgcaggtactc

SEQ ID NO: 455554 - DNA, 25 bp, Rattus norvegicus
cactaagcaagagtggcccaggcgg

SEQ ID NO: 455555 - DNA, 25 bp, Rattus norvegicus
tgctgcgccgcgacgatccgggtca

SEQ ID NO: 455556 - DNA, 25 bp, Rattus norvegicus
ccggagccggtagcgcttggcctaa

SEQ ID NO: 455557 - DNA, 25 bp, Rattus norvegicus
cgagtcgggcgagcattttcagccc

SEQ ID NO: 455558 - DNA, 25 bp, Rattus norvegicus
aagcggagagtacgggcccagtact

SEQ ID NO: 455559 - DNA, 25 bp, Rattus norvegicus
ccctccactggtgcgctctgggtag

SEQ ID NO: 455560 - DNA, 25 bp, Rattus norvegicus
gctgtatcagcgaggcccgcgccat

SEQ ID NO: 455561 - DNA, 25 bp, Rattus norvegicus
gaatgttaagcttggcggccacggc

SEQ ID NO: 455562 - DNA, 25 bp, Rattus norvegicus
ggcagcagcaccttgggaatgttaa

SEQ ID NO: 455563 - DNA, 25 bp, Rattus norvegicus
tggctcgcgtaaagggcagcagcac

SEQ ID NO: 455564 - DNA, 25 bp, Rattus norvegicus
agttcacgcgcgtggctcgcgtaaa

SEQ ID NO: 455565 - DNA, 25 bp, Rattus norvegicus
aagcttccagagtgaagttcacgcg

SEQ ID NO: 455566 - DNA, 25 bp, Rattus norvegicus
tgcgtagacagcgagcacgcgcagc

SEQ ID NO: 455567 - DNA, 25 bp, Rattus norvegicus
gtagcgcttggcctaaggcctccgc

SEQ ID NO: 455568 - DNA, 25 bp, Rattus norvegicus
ctgccctccatagcccgcgatcaga

SEQ ID NO: 455569 - DNA, 25 bp, Rattus norvegicus
cccgggcgccatgcgtagacagcga

SEQ ID NO: 455570 - DNA, 25 bp, Rattus norvegicus
ttctctttctccgaatcaccgttgc

SEQ ID NO: 455571 - DNA, 25 bp, Rattus norvegicus
agagccagtccctgtgagtctccgc

SEQ ID NO: 455572 - DNA, 25 bp, Rattus norvegicus
agtctccgcgcggtgcagcctgtgc

SEQ ID NO: 455573 - DNA, 25 bp, Rattus norvegicus
agcctgtgcggatccacgtttgcct

SEQ ID NO: 455574 - DNA, 25 bp, Rattus norvegicus
cggatccacgtttgccttctctttc

SEQ ID NO: 455575 - DNA, 25 bp, Rattus norvegicus
gcgccctcagactccgggtaagtgc

SEQ ID NO: 455576 - DNA, 25 bp, Rattus norvegicus
gctcctgtatccttgatctcggacc

SEQ ID NO: 455577 - DNA, 25 bp, Rattus norvegicus
aaattcccgttccatgcttccgatc

SEQ ID NO: 455578 - DNA, 25 bp, Rattus norvegicus
ttccatgcttccgatctcggctctt

SEQ ID NO: 455579 - DNA, 25 bp, Rattus norvegicus
ctcattcctgccgatcgttgggcgg

SEQ ID NO: 455580 - DNA, 25 bp, Rattus norvegicus
ggcgcgtccctatcccttctgtgac

SEQ ID NO: 455581 - DNA, 25 bp, Rattus norvegicus
ccgctgtgggctagaaccttctttt

SEQ ID NO: 455582 - DNA, 25 bp, Rattus norvegicus
cttccttgctttgccgtgcctcggg

SEQ ID NO: 455583 - DNA, 25 bp, Rattus norvegicus
tgctccacgctcctgtatccttgat

SEQ ID NO: 455584 - DNA, 25 bp, Rattus norvegicus
ccaaccggcgagagtctcggcgcag

SEQ ID NO: 455585 - DNA, 25 bp, Rattus norvegicus
aactgcctagccgagcctccttgat

SEQ ID NO: 455586 - DNA, 25 bp, Rattus norvegicus
agagcgctggccaaaactgcctagc

SEQ ID NO: 455587 - DNA, 25 bp, Rattus norvegicus
gctgtgaccagtcacgcgggcagca

SEQ ID NO: 455588 - DNA, 25 bp, Rattus norvegicus
tcacactgcgggaggctgtgaccag

SEQ ID NO: 455589 - DNA, 25 bp, Rattus norvegicus
aacaagcgccggtcacactgcggga

SEQ ID NO: 455590 - DNA, 25 bp, Rattus norvegicus
cccagaatctcggtttcgatcgctg

SEQ ID NO: 455591 - DNA, 25 bp, Rattus norvegicus
gcaggcctcccgagcggcaagaact

SEQ ID NO: 455592 - DNA, 25 bp, Rattus norvegicus
acagactgtgtcaggcgcgcggaca

SEQ ID NO: 455593 - DNA, 25 bp, Rattus norvegicus
cgctggacgccacacagactgtgtc

SEQ ID NO: 455594 - DNA, 25 bp, Rattus norvegicus
cctcctgacggcaaagaccggagga

SEQ ID NO: 455595 - DNA, 25 bp, Rattus norvegicus
ctgccggcgctacaaggcaggactg

SEQ ID NO: 455596 - DNA, 25 bp, Rattus norvegicus
aggcgcgcatagcacatcaacaccg

SEQ ID NO: 455597 - DNA, 25 bp, Rattus norvegicus
agtctcggcgcaggccacaggacag

SEQ ID NO: 455598 - DNA, 25 bp, Rattus norvegicus
gtgacgcagccgcaggccagaactc

SEQ ID NO: 455599 - DNA, 25 bp, Rattus norvegicus
cactccattgggtgcgtctccttgg

SEQ ID NO: 455600 - DNA, 25 bp, Rattus norvegicus
tccattgggtgcgtctccttggccg

SEQ ID NO: 455601 - DNA, 25 bp, Rattus norvegicus
cggtccggttgtctgtgacgcagcc

SEQ ID NO: 455602 - DNA, 25 bp, Rattus norvegicus
cagctcccagcgctatggaggcgtg

SEQ ID NO: 455603 - DNA, 25 bp, Rattus norvegicus
gaggcgtgttctgcgtaggccctcc

SEQ ID NO: 455604 - DNA, 25 bp, Rattus norvegicus
ctccccgtgcggagtggtgtccaga

SEQ ID NO: 455605 - DNA, 25 bp, Rattus norvegicus
cgcgtgggaccaagcatgggttctg

SEQ ID NO: 455606 - DNA, 25 bp, Rattus norvegicus
gtgaacggtgggtctcccttccgca

SEQ ID NO: 455607 - DNA, 25 bp, Rattus norvegicus
ggtgggtctcccttccgcagggcac

SEQ ID NO: 455608 - DNA, 25 bp, Rattus norvegicus
agggcacagcctcctgcaatcgcgg

SEQ ID NO: 455609 - DNA, 25 bp, Rattus norvegicus
gcaatcgcggtctacgcactacttc

SEQ ID NO: 455610 - DNA, 25 bp, Rattus norvegicus
gcggcactccattgggtgcgtctcc

SEQ ID NO: 455611 - DNA, 25 bp, Rattus norvegicus
tcccagcgctatggaggcgtgttct

SEQ ID NO: 455612 - DNA, 25 bp, Rattus norvegicus
ggagcctctgggtttccacgccgcg

SEQ ID NO: 455613 - DNA, 25 bp, Rattus norvegicus
tgaccgcggcgcagctcaacacaga

SEQ ID NO: 455614 - DNA, 25 bp, Rattus norvegicus
tccacgccgcgctccctctaagtcg

SEQ ID NO: 455615 - DNA, 25 bp, Rattus norvegicus
tggcttgtcccgctcttctccaccc

SEQ ID NO: 455616 - DNA, 25 bp, Rattus norvegicus
ctggattcaccgacggcgggtgcaa

SEQ ID NO: 455617 - DNA, 25 bp, Rattus norvegicus
tgcaaggacagactgaccgcggcgc

SEQ ID NO: 455618 - DNA, 25 bp, Rattus norvegicus
accagggctctggattcaccgacgg

SEQ ID NO: 455619 - DNA, 25 bp, Rattus norvegicus
ggcgcagctcaacacagagcacgga

SEQ ID NO: 455620 - DNA, 25 bp, Rattus norvegicus
ctcaacacagagcacggagtacaga

SEQ ID NO: 455621 - DNA, 25 bp, Rattus norvegicus
cagagcacggagtacagagtgagta

SEQ ID NO: 455622 - DNA, 25 bp, Rattus norvegicus
gagtacagagtgagtatggagcctc

SEQ ID NO: 455623 - DNA, 25 bp, Rattus norvegicus
agtgagtatggagcctctgggtttc

SEQ ID NO: 455624 - DNA, 25 bp, Rattus norvegicus
tatggagcctctgggtttccacgcc

SEQ ID NO: 455625 - DNA, 25 bp, Rattus norvegicus
gccaccagggctctggattcaccga

SEQ ID NO: 455626 - DNA, 25 bp, Rattus norvegicus
gggtccatatatacccaggacgaga

SEQ ID NO: 455627 - DNA, 25 bp, Rattus norvegicus
gactggcgggtgctcatcgcagtca

SEQ ID NO: 455628 - DNA, 25 bp, Rattus norvegicus
atcgcagtcagcgtggccacatgtg

SEQ ID NO: 455629 - DNA, 25 bp, Rattus norvegicus
cacatgtgtacatacccgggtccct

SEQ ID NO: 455630 - DNA, 25 bp, Rattus norvegicus
cgggtccctcctcagggtccatata

SEQ ID NO: 455631 - DNA, 25 bp, Rattus norvegicus
ctgctcgcgcccacaggggcaggat

SEQ ID NO: 455632 - DNA, 25 bp, Rattus norvegicus
tacccaggacgagaccgctgctcag

SEQ ID NO: 455633 - DNA, 25 bp, Rattus norvegicus
gctctgactttcagcctggctcgga

SEQ ID NO: 455634 - DNA, 25 bp, Rattus norvegicus
gcacgccgggactcttaggaagagc

SEQ ID NO: 455635 - DNA, 25 bp, Rattus norvegicus
ctccagaggcaggtggtgaagctca

SEQ ID NO: 455636 - DNA, 25 bp, Rattus norvegicus
tccatagcgtgaccagccgcctttg

SEQ ID NO: 455637 - DNA, 25 bp, Rattus norvegicus
cgcctttggccagcgcagctaggga

SEQ ID NO: 455638 - DNA, 25 bp, Rattus norvegicus
aagctcagctggtgcgagccggtcc

SEQ ID NO: 455639 - DNA, 25 bp, Rattus norvegicus
agctagggagtatgccaaagccgcc

SEQ ID NO: 455640 - DNA, 25 bp, Rattus norvegicus
agcgccgcgctttccgggtcatagt

SEQ ID NO: 455641 - DNA, 25 bp, Rattus norvegicus
cgcgccagcgatcgcggcaagtgtt

SEQ ID NO: 455642 - DNA, 25 bp, Rattus norvegicus
acccgatccggagatagactatgcc

SEQ ID NO: 455643 - DNA, 25 bp, Rattus norvegicus
ctatgcccaggctgagaaagaggtg

SEQ ID NO: 455644 - DNA, 25 bp, Rattus norvegicus
cggcgcttacccgatccggagatag

SEQ ID NO: 455645 - DNA, 25 bp, Rattus norvegicus
ccgggctgtgctgatcccgccagcc

SEQ ID NO: 455646 - DNA, 25 bp, Rattus norvegicus
ggcccggcggggcaatccacatagc

SEQ ID NO: 455647 - DNA, 25 bp, Rattus norvegicus
ggcaatccacatagcctgcgcaggg

SEQ ID NO: 455648 - DNA, 25 bp, Rattus norvegicus
tccctggacggtccgtcagtgcgtc

SEQ ID NO: 455649 - DNA, 25 bp, Rattus norvegicus
acggtccgtcagtgcgtcggtccgc

SEQ ID NO: 455650 - DNA, 25 bp, Rattus norvegicus
gcactggagactgtcctagagcgcg

SEQ ID NO: 455651 - DNA, 25 bp, Rattus norvegicus
gcttctccggcacgcgcggaaagaa

SEQ ID NO: 455652 - DNA, 25 bp, Rattus norvegicus
aactttgcttctccggcacgcgcgg

SEQ ID NO: 455653 - DNA, 25 bp, Rattus norvegicus
ggagatagactatgcccaggctgag

SEQ ID NO: 455654 - DNA, 25 bp, Rattus norvegicus
tttgcgcccgccaactaaagctata

SEQ ID NO: 455655 - DNA, 25 bp, Rattus norvegicus
tcgatggaaaccactagaccgcgtg

SEQ ID NO: 455656 - DNA, 25 bp, Rattus norvegicus
ccggcagtaggacatggttgttctc

SEQ ID NO: 455657 - DNA, 25 bp, Rattus norvegicus
ggttgttctcaacgttcccagctcg

SEQ ID NO: 455658 - DNA, 25 bp, Rattus norvegicus
cagcggctacaccttctcgttgtga

SEQ ID NO: 455659 - DNA, 25 bp, Rattus norvegicus
cagcaccgcttctcagtcgaaaata

SEQ ID NO: 455660 - DNA, 25 bp, Rattus norvegicus
gcgcacgcgcaccagtgaaatattg

SEQ ID NO: 455661 - DNA, 25 bp, Rattus norvegicus
agcgtccgacgtccgactacatttc

SEQ ID NO: 455662 - DNA, 25 bp, Rattus norvegicus
cccagcaatccttgagacgcgcatg

SEQ ID NO: 455663 - DNA, 25 bp, Rattus norvegicus
ttcctcgaggagtcttgcagctctg

SEQ ID NO: 455664 - DNA, 25 bp, Rattus norvegicus
ctgaactcgtctatctcgggctgca

SEQ ID NO: 455665 - DNA, 25 bp, Rattus norvegicus
cagcgaacgtgagtgcttcctgatc

SEQ ID NO: 455666 - DNA, 25 bp, Rattus norvegicus
cacgtttgtgggactcagctcttag

SEQ ID NO: 455667 - DNA, 25 bp, Rattus norvegicus
tccggtcgtcatcccaattcctaga

SEQ ID NO: 455668 - DNA, 25 bp, Rattus norvegicus
gtcgtcgccctttctctgtagaatg

SEQ ID NO: 455669 - DNA, 25 bp, Rattus norvegicus
gcggcccaacgtttcctagtgtctg

SEQ ID NO: 455670 - DNA, 25 bp, Rattus norvegicus
tgcagacggctgtggatatcccatc

SEQ ID NO: 455671 - DNA, 25 bp, Rattus norvegicus
ccgtaaagaccttgcggtagacaca

SEQ ID NO: 455672 - DNA, 25 bp, Rattus norvegicus
acgctttcgggccatgctagccaga

SEQ ID NO: 455673 - DNA, 25 bp, Rattus norvegicus
aaatagtgtagttcgccttccagtg

SEQ ID NO: 455674 - DNA, 25 bp, Rattus norvegicus
ttgctttgttgtcctcggcttcctg

SEQ ID NO: 455675 - DNA, 25 bp, Rattus norvegicus
cgtttgaaacatggcggacgacgta

SEQ ID NO: 455676 - DNA, 25 bp, Rattus norvegicus
cggacgacgtagatcaggtaagttt

SEQ ID NO: 455677 - DNA, 25 bp, Rattus norvegicus
ttagccgggcttgctttttccacgc

SEQ ID NO: 455678 - DNA, 25 bp, Rattus norvegicus
cacgcttcccgtggaatggcccttt

SEQ ID NO: 455679 - DNA, 25 bp, Rattus norvegicus
caggcctgctcctaaaacttccgta

SEQ ID NO: 455680 - DNA, 25 bp, Rattus norvegicus
cttccgtaggcccagagtttctcaa

SEQ ID NO: 455681 - DNA, 25 bp, Rattus norvegicus
atcgcctgacatgctgcagacttgg

SEQ ID NO: 455682 - DNA, 25 bp, Rattus norvegicus
tctgcagccactcagggctacggtc

SEQ ID NO: 455683 - DNA, 25 bp, Rattus norvegicus
tgctagagtgcgtgcatggagtgtt

SEQ ID NO: 455684 - DNA, 25 bp, Rattus norvegicus
aatgtccgcctaggaggtgtgagaa

SEQ ID NO: 455685 - DNA, 25 bp, Rattus norvegicus
tggtccgaatgtccgcctaggaggt

SEQ ID NO: 455686 - DNA, 25 bp, Rattus norvegicus
gaaaagtggtccgaatgtccgccta

SEQ ID NO: 455687 - DNA, 25 bp, Rattus norvegicus
acctggcagatggaagctagctttg

SEQ ID NO: 455688 - DNA, 25 bp, Rattus norvegicus
gaacctgaggtgcaactccgggacg

SEQ ID NO: 455689 - DNA, 25 bp, Rattus norvegicus
cagctgcgaacctgaggtgcaactc

SEQ ID NO: 455690 - DNA, 25 bp, Rattus norvegicus
agtactagaagtatgagggcgaagt

SEQ ID NO: 455691 - DNA, 25 bp, Rattus norvegicus
tcggtctgcagccactcagggctac

SEQ ID NO: 455692 - DNA, 25 bp, Rattus norvegicus
gcttcgctaggagccaaaaccggtg

SEQ ID NO: 455693 - DNA, 25 bp, Rattus norvegicus
ctaggagccaaaaccggtgggcgct

SEQ ID NO: 455694 - DNA, 25 bp, Rattus norvegicus
agcgaaggcgagcagctgcgaacct

SEQ ID NO: 455695 - DNA, 25 bp, Rattus norvegicus
agtcgagggcttcgctaggagccaa

SEQ ID NO: 455696 - DNA, 25 bp, Rattus norvegicus
cggagagctgcctgttcagacaaca

SEQ ID NO: 455697 - DNA, 25 bp, Rattus norvegicus
ccgggttctttgtgtgtccgagctc

SEQ ID NO: 455698 - DNA, 25 bp, Rattus norvegicus
ccaggcccggccaagctggtatttt

SEQ ID NO: 455699 - DNA, 25 bp, Rattus norvegicus
tggtatttttccacccagcaggatg

SEQ ID NO: 455700 - DNA, 25 bp, Rattus norvegicus
ttccacccagcaggatgggtgatgc

SEQ ID NO: 455701 - DNA, 25 bp, Rattus norvegicus
ctcgacgaggcgagcccgggttctt

SEQ ID NO: 455702 - DNA, 25 bp, Rattus norvegicus
gttcagacaacagacacgcgaggtc

SEQ ID NO: 455703 - DNA, 25 bp, Rattus norvegicus
ggtcagggagaagccgcttataaat

SEQ ID NO: 455704 - DNA, 25 bp, Rattus norvegicus
gccgcttataaattaccgcttcctc

SEQ ID NO: 455705 - DNA, 25 bp, Rattus norvegicus
cagcgtcgtactccgggacctggct

SEQ ID NO: 455706 - DNA, 25 bp, Rattus norvegicus
ggctgctgctgaactcccgtgccaa

SEQ ID NO: 455707 - DNA, 25 bp, Rattus norvegicus
tgtgggcttagccacccaggtaccc

SEQ ID NO: 455708 - DNA, 25 bp, Rattus norvegicus
tagccacccaggtacccagggcgtg

SEQ ID NO: 455709 - DNA, 25 bp, Rattus norvegicus
ggccatccgctgtgggcttagccac

SEQ ID NO: 455710 - DNA, 25 bp, Rattus norvegicus
gtcgctggcttaattatgcggcatc

SEQ ID NO: 455711 - DNA, 25 bp, Rattus norvegicus
tcgcaaggcgattaagtcgggtatc

SEQ ID NO: 455712 - DNA, 25 bp, Rattus norvegicus
caaggcgattaagtcgggtatcgtc

SEQ ID NO: 455713 - DNA, 25 bp, Rattus norvegicus
cgattaagtcgggtatcgtcagggt

SEQ ID NO: 455714 - DNA, 25 bp, Rattus norvegicus
ttgcgcaactcttgggaaggccgat

SEQ ID NO: 455715 - DNA, 25 bp, Rattus norvegicus
caggttgcgcaactcttgggaaggc

SEQ ID NO: 455716 - DNA, 25 bp, Rattus norvegicus
tgccattcaggttgcgcaactcttg

SEQ ID NO: 455717 - DNA, 25 bp, Rattus norvegicus
agccatttgccattcaggttgcgca

SEQ ID NO: 455718 - DNA, 25 bp, Rattus norvegicus
cagaagccatttgccattcaggttg

SEQ ID NO: 455719 - DNA, 25 bp, Rattus norvegicus
atcctgcatcagaagccatttgcca

SEQ ID NO: 455720 - DNA, 25 bp, Rattus norvegicus
ggagaaaatcctgcatcagaagcca

SEQ ID NO: 455721 - DNA, 25 bp, Rattus norvegicus
cgtaaggagaaaatcctgcatcaga

SEQ ID NO: 455722 - DNA, 25 bp, Rattus norvegicus
ggtgtcgtcgctggcttaattatgc

SEQ ID NO: 455723 - DNA, 25 bp, Rattus norvegicus
ggatgtgtcgcaaggcgattaagtc

SEQ ID NO: 455724 - DNA, 25 bp, Rattus norvegicus
tcgcggccctagcaattcttaatta

SEQ ID NO: 455725 - DNA, 25 bp, Rattus norvegicus
gcaattcttaattagcaccaaaccc

SEQ ID NO: 455726 - DNA, 25 bp, Rattus norvegicus
cccaaactttgctccgcggtgacag

SEQ ID NO: 455727 - DNA, 25 bp, Rattus norvegicus
cgcggtgacagtccggcgtaagtcc

SEQ ID NO: 455728 - DNA, 25 bp, Rattus norvegicus
catcctctaccctgcgggtggtgaa

SEQ ID NO: 455729 - DNA, 25 bp, Rattus norvegicus
tcagcgccggtctctttataacttg

SEQ ID NO: 455730 - DNA, 25 bp, Rattus norvegicus
tttataacttgggttgctgcgggcg

SEQ ID NO: 455731 - DNA, 25 bp, Rattus norvegicus
cgctcagtgccgcaggcccagagtg

SEQ ID NO: 455732 - DNA, 25 bp, Rattus norvegicus
caggcccagagtgcgcaggaaagtt

SEQ ID NO: 455733 - DNA, 25 bp, Rattus norvegicus
cgcaggaaagttgggcgcctagctc

SEQ ID NO: 455734 - DNA, 25 bp, Rattus norvegicus
ctagctcggtcggatccgggtccct

SEQ ID NO: 455735 - DNA, 25 bp, Rattus norvegicus
gtggctgctaatggcccagctcctc

SEQ ID NO: 455736 - DNA, 25 bp, Rattus norvegicus
gcggtcctgtccagctctgagcaaa

SEQ ID NO: 455737 - DNA, 25 bp, Rattus norvegicus
agctctgagcaaaacgcgcgtcccg

SEQ ID NO: 455738 - DNA, 25 bp, Rattus norvegicus
ttcccaaggcggatcgcaagatccc

SEQ ID NO: 455739 - DNA, 25 bp, Rattus norvegicus
gacggaggtaaattttgcccacgca

SEQ ID NO: 455740 - DNA, 25 bp, Rattus norvegicus
ccggtcctgtccgtgagcgtaccgt

SEQ ID NO: 455741 - DNA, 25 bp, Rattus norvegicus
gcaagaagcaggataatgccaatgt

SEQ ID NO: 455742 - DNA, 25 bp, Rattus norvegicus
cagagatcaaaaagtagcaagaagc

SEQ ID NO: 455743 - DNA, 25 bp, Rattus norvegicus
tgtgaagcggatgaaatcagagatc

SEQ ID NO: 455744 - DNA, 25 bp, Rattus norvegicus
cggggacatcgcctatttgtgaagc

SEQ ID NO: 455745 - DNA, 25 bp, Rattus norvegicus
tcgcctgtccggtagtccggcgacg

SEQ ID NO: 455746 - DNA, 25 bp, Rattus norvegicus
atcgatctcatgcagcccggatttg

SEQ ID NO: 455747 - DNA, 25 bp, Rattus norvegicus
tgtggaacaggcgatcgatctcatg

SEQ ID NO: 455748 - DNA, 25 bp, Rattus norvegicus
ttgcgcgtcccttcggtgtggaaca

SEQ ID NO: 455749 - DNA, 25 bp, Rattus norvegicus
tgcagtccggatttgttcccaaggc

SEQ ID NO: 455750 - DNA, 25 bp, Rattus norvegicus
gtggaacaggcgataggactcatgc

SEQ ID NO: 455751 - DNA, 25 bp, Rattus norvegicus
taaattttgcccacgcaggcgcgtc

SEQ ID NO: 455752 - DNA, 25 bp, Rattus norvegicus
tagctacttgctccgtgtttcctcc

SEQ ID NO: 455753 - DNA, 25 bp, Rattus norvegicus
cacttggaggacgtgcctttcttgc

SEQ ID NO: 455754 - DNA, 25 bp, Rattus norvegicus
atcctctcagggatctcagggcgca

SEQ ID NO: 455755 - DNA, 25 bp, Rattus norvegicus
ctggaacctccatatgacagggata

SEQ ID NO: 455756 - DNA, 25 bp, Rattus norvegicus
tgtttcctccgcctctctgtcgaga

SEQ ID NO: 455757 - DNA, 25 bp, Rattus norvegicus
tcagcgtcgctatcaaagctacttc

SEQ ID NO: 455758 - DNA, 25 bp, Rattus norvegicus
ttggacgttacagcctcctcggtga

SEQ ID NO: 455759 - DNA, 25 bp, Rattus norvegicus
actcgtagggtctgactgaggccac

SEQ ID NO: 455760 - DNA, 25 bp, Rattus norvegicus
aagctacttccggttctgctcgggg

SEQ ID NO: 455761 - DNA, 25 bp, Rattus norvegicus
tctgtcgagaatggtgacctaactg

SEQ ID NO: 455762 - DNA, 25 bp, Rattus norvegicus
ctaggtagcatacactgacgctttc

SEQ ID NO: 455763 - DNA, 25 bp, Rattus norvegicus
ggcgccgaggtcgtaaatctatgtc

SEQ ID NO: 455764 - DNA, 25 bp, Rattus norvegicus
tgtcgcaaaattacggaaactcagc

SEQ ID NO: 455765 - DNA, 25 bp, Rattus norvegicus
cctcggtgagttcaagtgtggctta

SEQ ID NO: 455766 - DNA, 25 bp, Rattus norvegicus
agcccgcgccaccttgggcgcaccg

SEQ ID NO: 455767 - DNA, 25 bp, Rattus norvegicus
cgccttaccgcggagtgctgcgccc

SEQ ID NO: 455768 - DNA, 25 bp, Rattus norvegicus
cagtgggactccgacagacggaccc

SEQ ID NO: 455769 - DNA, 25 bp, Rattus norvegicus
tgggactccgacagacggacccgca

SEQ ID NO: 455770 - DNA, 25 bp, Rattus norvegicus
cggacccgcacagcacgcagcgacc

SEQ ID NO: 455771 - DNA, 25 bp, Rattus norvegicus
acgcagcgaccagcctccggctccg

SEQ ID NO: 455772 - DNA, 25 bp, Rattus norvegicus
atgcacagagcaggtaggagcccgc

SEQ ID NO: 455773 - DNA, 25 bp, Rattus norvegicus
ccggctccgcggtggaagatgcaca

SEQ ID NO: 455774 - DNA, 25 bp, Rattus norvegicus
gggacccagggttccctctctagca

SEQ ID NO: 455775 - DNA, 25 bp, Rattus norvegicus
gttccctctctagcaacccagagtt

SEQ ID NO: 455776 - DNA, 25 bp, Rattus norvegicus
tctctagcaacccagagttcgggtg

SEQ ID NO: 455777 - DNA, 25 bp, Rattus norvegicus
cccagagttcgggtgttctgtccca

SEQ ID NO: 455778 - DNA, 25 bp, Rattus norvegicus
agttcgggtgttctgtcccacgcac

SEQ ID NO: 455779 - DNA, 25 bp, Rattus norvegicus
tccgcggtggaagatgcacagagca

SEQ ID NO: 455780 - DNA, 25 bp, Rattus norvegicus
tggcctgcccgcttcttcctgtgtt

SEQ ID NO: 455781 - DNA, 25 bp, Rattus norvegicus
ggcagggcacgacctcctgagtgac

SEQ ID NO: 455782 - DNA, 25 bp, Rattus norvegicus
tgacggccgggctggccaatcgtcc

SEQ ID NO: 455783 - DNA, 25 bp, Rattus norvegicus
cgaactctgacctttcactgacaaa

SEQ ID NO: 455784 - DNA, 25 bp, Rattus norvegicus
ccctgtataggagggccacggcctg

SEQ ID NO: 455785 - DNA, 25 bp, Rattus norvegicus
gctgaacgcggccttttacctttgc

SEQ ID NO: 455786 - DNA, 25 bp, Rattus norvegicus
cggcaccggggtcacgaactctgac

SEQ ID NO: 455787 - DNA, 25 bp, Rattus norvegicus
caataacaaagcgtggtccctccgc

SEQ ID NO: 455788 - DNA, 25 bp, Rattus norvegicus
aaagcgtggtccctccgcgactcgg

SEQ ID NO: 455789 - DNA, 25 bp, Rattus norvegicus
cagacacgggacctgctccacggtt

SEQ ID NO: 455790 - DNA, 25 bp, Rattus norvegicus
gctccacggttgttgtggcacccaa

SEQ ID NO: 455791 - DNA, 25 bp, Rattus norvegicus
tgtggcacccaaccctgaggtaaga

SEQ ID NO: 455792 - DNA, 25 bp, Rattus norvegicus
accctgaggtaagagcaagcccgtc

SEQ ID NO: 455793 - DNA, 25 bp, Rattus norvegicus
gagcaagcccgtcgggccaagtcgc

SEQ ID NO: 455794 - DNA, 25 bp, Rattus norvegicus
atcagtagggatggcctccaccgcc

SEQ ID NO: 455795 - DNA, 25 bp, Rattus norvegicus
gcctgggactcgtagttttggcctg

SEQ ID NO: 455796 - DNA, 25 bp, Rattus norvegicus
accagcgaggctccgggaatctcag

SEQ ID NO: 455797 - DNA, 25 bp, Rattus norvegicus
caggaacttctctagccgcggacca

SEQ ID NO: 455798 - DNA, 25 bp, Rattus norvegicus
aaacggcctttcatcggcatggtga

SEQ ID NO: 455799 - DNA, 25 bp, Rattus norvegicus
tcggcatggtgaagacaggaacttc

SEQ ID NO: 455800 - DNA, 25 bp, Rattus norvegicus
tctccgctacccagatactgcagtg

SEQ ID NO: 455801 - DNA, 25 bp, Rattus norvegicus
ttcaccgactccttgaataccacgt

SEQ ID NO: 455802 - DNA, 25 bp, Rattus norvegicus
cccatgcgtgttgtagttcacggtc

SEQ ID NO: 455803 - DNA, 25 bp, Rattus norvegicus
tctccggtttctatcgggatcagta

SEQ ID NO: 455804 - DNA, 25 bp, Rattus norvegicus
ccatccctcgggtggagtgaatctc

SEQ ID NO: 455805 - DNA, 25 bp, Rattus norvegicus
tcgcagccgcaaccgcgttggaaaa

SEQ ID NO: 455806 - DNA, 25 bp, Rattus norvegicus
agttcacggtcatgaccttcaccga

SEQ ID NO: 455807 - DNA, 25 bp, Rattus norvegicus
cagatactgcagtgtacggcggata

SEQ ID NO: 455808 - DNA, 25 bp, Rattus norvegicus
tgcgtcgggcagaaaccggaagaca

SEQ ID NO: 455809 - DNA, 25 bp, Rattus norvegicus
tgtgcaaactctcgcatcccgactg

SEQ ID NO: 455810 - DNA, 25 bp, Rattus norvegicus
gcatcccgactgacttgaaaaaacc

SEQ ID NO: 455811 - DNA, 25 bp, Rattus norvegicus
tgaaaaaacccagccgggagcactg

SEQ ID NO: 455812 - DNA, 25 bp, Rattus norvegicus
agcactgtagaggtccgcacggcca

SEQ ID NO: 455813 - DNA, 25 bp, Rattus norvegicus
gcatccacgggacgcgactctgcag

SEQ ID NO: 455814 - DNA, 25 bp, Rattus norvegicus
ccacgcaacacgtcgcgggcagaga

SEQ ID NO: 455815 - DNA, 25 bp, Rattus norvegicus
tgcgacttccgacagtcagccggca

SEQ ID NO: 455816 - DNA, 25 bp, Rattus norvegicus
ggcagccatagccatcggtggatcg

SEQ ID NO: 455817 - DNA, 25 bp, Rattus norvegicus
ccggaagacagactgacacgctgta

SEQ ID NO: 455818 - DNA, 25 bp, Rattus norvegicus
acacgctgtagtcgagcgccgagtc

SEQ ID NO: 455819 - DNA, 25 bp, Rattus norvegicus
cgccgagtcctcgagtgtaccgaaa

SEQ ID NO: 455820 - DNA, 25 bp, Rattus norvegicus
agaagaaagaggatgctgcgcacgc

SEQ ID NO: 455821 - DNA, 25 bp, Rattus norvegicus
cccggccttcgagattcctcagaga

SEQ ID NO: 455822 - DNA, 25 bp, Rattus norvegicus
ctgaggcttatatgagctggagacg

SEQ ID NO: 455823 - DNA, 25 bp, Rattus norvegicus
ctggcgcaggttggcgcccagctcc

SEQ ID NO: 455824 - DNA, 25 bp, Rattus norvegicus
cgcaggccgaagacaggggtgctga

SEQ ID NO: 455825 - DNA, 25 bp, Rattus norvegicus
aggccgaagacaggggtgctgacgg

SEQ ID NO: 455826 - DNA, 25 bp, Rattus norvegicus
tccggaaacctggtgggggctgagc

SEQ ID NO: 455827 - DNA, 25 bp, Rattus norvegicus
tgagcgaggaggcacggctggcgca

SEQ ID NO: 455828 - DNA, 25 bp, Rattus norvegicus
agacgcggcgcctgtgaggtcagcg

SEQ ID NO: 455829 - DNA, 25 bp, Rattus norvegicus
gctgaggcttatatgagctggagac

SEQ ID NO: 455830 - DNA, 25 bp, Rattus norvegicus
ctcctccgaggaggggctgaggctt

SEQ ID NO: 455831 - DNA, 25 bp, Rattus norvegicus
tcgactgcgcgctcctccgaggagg

SEQ ID NO: 455832 - DNA, 25 bp, Rattus norvegicus
gtcgactgcgcgctcctccgaggag

SEQ ID NO: 455833 - DNA, 25 bp, Rattus norvegicus
gaatccagggtcgactgcgcgctcc

SEQ ID NO: 455834 - DNA, 25 bp, Rattus norvegicus
tgaggcttatatgagctggagacgc

SEQ ID NO: 455835 - DNA, 25 bp, Rattus norvegicus
aggcttatatgagctggagacgcgg

SEQ ID NO: 455836 - DNA, 25 bp, Rattus norvegicus
agcgttcttggcgttaggacccagc

SEQ ID NO: 455837 - DNA, 25 bp, Rattus norvegicus
cgcggcctgacagccaactgcaaaa

SEQ ID NO: 455838 - DNA, 25 bp, Rattus norvegicus
ttctccgcccagctgtctattttca

SEQ ID NO: 455839 - DNA, 25 bp, Rattus norvegicus
ctcctcgtagccaattgataacatc

SEQ ID NO: 455840 - DNA, 25 bp, Rattus norvegicus
ggcgttgcctgatcggaaaaatcta

SEQ ID NO: 455841 - DNA, 25 bp, Rattus norvegicus
ttaacctcgatatggccgactttcc

SEQ ID NO: 455842 - DNA, 25 bp, Rattus norvegicus
cgggaggcatttccttctcggaagc

SEQ ID NO: 455843 - DNA, 25 bp, Rattus norvegicus
ctcggaagctctgagctggcatatc

SEQ ID NO: 455844 - DNA, 25 bp, Rattus norvegicus
gcacgcagctcctatgaggtccctg

SEQ ID NO: 455845 - DNA, 25 bp, Rattus norvegicus
ggtaccgctacctgttctgaacgga

SEQ ID NO: 455846 - DNA, 25 bp, Rattus norvegicus
cctgcgtctcatggccgctagcaga

SEQ ID NO: 455847 - DNA, 25 bp, Rattus norvegicus
gctagcagatccctggtgcccgaca

SEQ ID NO: 455848 - DNA, 25 bp, Rattus norvegicus
gccaccaggaatggcgtaatggttt

SEQ ID NO: 455849 - DNA, 25 bp, Rattus norvegicus
gctacggctctatgaagcgttcttg

SEQ ID NO: 455850 - DNA, 25 bp, Rattus norvegicus
agtcttttcctcgagctccggctga

SEQ ID NO: 455851 - DNA, 25 bp, Rattus norvegicus
tcccgcctggttcgggagagcacgt

SEQ ID NO: 455852 - DNA, 25 bp, Rattus norvegicus
tagctgtcccgcctggttcgggaga

SEQ ID NO: 455853 - DNA, 25 bp, Rattus norvegicus
tctgtcgggcggtctccgcctagct

SEQ ID NO: 455854 - DNA, 25 bp, Rattus norvegicus
tcggttgaatgtgtccgcgctgcag

SEQ ID NO: 455855 - DNA, 25 bp, Rattus norvegicus
agcgctgtcggttgaatgtgtccgc

SEQ ID NO: 455856 - DNA, 25 bp, Rattus norvegicus
tgccagcagcgctgtcggttgaatg

SEQ ID NO: 455857 - DNA, 25 bp, Rattus norvegicus
cttcctgccagcagcgctgtcggtt

SEQ ID NO: 455858 - DNA, 25 bp, Rattus norvegicus
tcgggagagcacgtttaccctcctc

SEQ ID NO: 455859 - DNA, 25 bp, Rattus norvegicus
tttcctcgagctccggctgaacatg

SEQ ID NO: 455860 - DNA, 25 bp, Rattus norvegicus
cggcgggacagtcttttcctcgagc

SEQ ID NO: 455861 - DNA, 25 bp, Rattus norvegicus
aggacactcaccgagcggcgggaca

SEQ ID NO: 455862 - DNA, 25 bp, Rattus norvegicus
ccggctgaacatggccgggcgcttc

SEQ ID NO: 455863 - DNA, 25 bp, Rattus norvegicus
ctccgctcgggtggaggacactcac

SEQ ID NO: 455864 - DNA, 25 bp, Rattus norvegicus
gtctgcgctccgctgagcaacgctg

SEQ ID NO: 455865 - DNA, 25 bp, Rattus norvegicus
gtgccaggactcaccgctttaggcc

SEQ ID NO: 455866 - DNA, 25 bp, Rattus norvegicus
aataccctaggtgcacgcctccagg

SEQ ID NO: 455867 - DNA, 25 bp, Rattus norvegicus
cgcgggcgctcaaataccctaggtg

SEQ ID NO: 455868 - DNA, 25 bp, Rattus norvegicus
ttagccgagccgcttcctgaatggg

SEQ ID NO: 455869 - DNA, 25 bp, Rattus norvegicus
gcataatgtccagcctgcgggcagg

SEQ ID NO: 455870 - DNA, 25 bp, Rattus norvegicus
agagaaagttctcggtggcgctcag

SEQ ID NO: 455871 - DNA, 25 bp, Rattus norvegicus
ctttaggagtcgctgaggtcctgca

SEQ ID NO: 455872 - DNA, 25 bp, Rattus norvegicus
ctgccgccaactttttgactttagg

SEQ ID NO: 455873 - DNA, 25 bp, Rattus norvegicus
ccaggatactaactgcatggtgctc

SEQ ID NO: 455874 - DNA, 25 bp, Rattus norvegicus
cgttagcagtgtggcccaggatact

SEQ ID NO: 455875 - DNA, 25 bp, Rattus norvegicus
atctcaaccaggtccggcaccagga

SEQ ID NO: 455876 - DNA, 25 bp, Rattus norvegicus
tcggggctcctcatctcaaccaggt

SEQ ID NO: 455877 - DNA, 25 bp, Rattus norvegicus
gccctttgctggcagagttagccga

SEQ ID NO: 455878 - DNA, 25 bp, Rattus norvegicus
atccaggagtctttcgagggacctc

SEQ ID NO: 455879 - DNA, 25 bp, Rattus norvegicus
atccttcgcgtgtgctcgcttttcg

SEQ ID NO: 455880 - DNA, 25 bp, Rattus norvegicus
tccctgttgcctttcggatccttcg

SEQ ID NO: 455881 - DNA, 25 bp, Rattus norvegicus
cgctctggggaccttctttgatcca

SEQ ID NO: 455882 - DNA, 25 bp, Rattus norvegicus
gtggccaactttgtcgtctcggttc

SEQ ID NO: 455883 - DNA, 25 bp, Rattus norvegicus
tctcgcttcctctcaggagacatct

SEQ ID NO: 455884 - DNA, 25 bp, Rattus norvegicus
ctttccaaagtgttgtcagcactgc

SEQ ID NO: 455885 - DNA, 25 bp, Rattus norvegicus
gcttctccggagacctcctctttgg

SEQ ID NO: 455886 - DNA, 25 bp, Rattus norvegicus
ttgggccattggtggctgtccattc

SEQ ID NO: 455887 - DNA, 25 bp, Rattus norvegicus
cgcctctctccatgtgtcgggtggc

SEQ ID NO: 455888 - DNA, 25 bp, Rattus norvegicus
tctagaagttccgttccaagtgtga

SEQ ID NO: 455889 - DNA, 25 bp, Rattus norvegicus
caagtgtgatgttcgttgggctgtc

SEQ ID NO: 455890 - DNA, 25 bp, Rattus norvegicus
tcctcctgtcggtggactttgctct

SEQ ID NO: 455891 - DNA, 25 bp, Rattus norvegicus
tggactttgctctcctctcgggcga

SEQ ID NO: 455892 - DNA, 25 bp, Rattus norvegicus
ttgcctgcaaaagcccagccaatcg

SEQ ID NO: 455893 - DNA, 25 bp, Rattus norvegicus
cacgctggtcttcggctccgcagcg

SEQ ID NO: 455894 - DNA, 25 bp, Rattus norvegicus
gaaagagcctcccaccacgctggtc

SEQ ID NO: 455895 - DNA, 25 bp, Rattus norvegicus
tccttccttttgtgcgcccgaaaga

SEQ ID NO: 455896 - DNA, 25 bp, Rattus norvegicus
agattaatccttccttttgtgcgcc

SEQ ID NO: 455897 - DNA, 25 bp, Rattus norvegicus
agccaatcgccaagattaatccttc

SEQ ID NO: 455898 - DNA, 25 bp, Rattus norvegicus
ttgtacttgcctgcaaaagcccagc

SEQ ID NO: 455899 - DNA, 25 bp, Rattus norvegicus
ggggagatcatggacttgtacttgc

SEQ ID NO: 455900 - DNA, 25 bp, Rattus norvegicus
cttccagtggccgagcgttcgaatc

SEQ ID NO: 455901 - DNA, 25 bp, Rattus norvegicus
agccttcttccagtggccgagcgtt

SEQ ID NO: 455902 - DNA, 25 bp, Rattus norvegicus
accgcctgcctgatcccagccttct

SEQ ID NO: 455903 - DNA, 25 bp, Rattus norvegicus
catggacttgtacttgcctgcaaaa

SEQ ID NO: 455904 - DNA, 25 bp, Rattus norvegicus
ctccgcagcggctgtaaggagaggc

SEQ ID NO: 455905 - DNA, 25 bp, Rattus norvegicus
tggccgagcgttcgaatccagaggt

SEQ ID NO: 455906 - DNA, 25 bp, Rattus norvegicus
acggtcttcccgcacaggtgggtcg

SEQ ID NO: 455907 - DNA, 25 bp, Rattus norvegicus
cccagctcttggtcttgtgcccttt

SEQ ID NO: 455908 - DNA, 25 bp, Rattus norvegicus
tggtcttgtgccctttccacgcctg

SEQ ID NO: 455909 - DNA, 25 bp, Rattus norvegicus
cctttccacgcctgccggagaggag

SEQ ID NO: 455910 - DNA, 25 bp, Rattus norvegicus
atgcaaggatgtagaggcacaaagg

SEQ ID NO: 455911 - DNA, 25 bp, Rattus norvegicus
caaagggatagaagaggccgcgtta

SEQ ID NO: 455912 - DNA, 25 bp, Rattus norvegicus
ccatggagaggcgtgcagcacgacc

SEQ ID NO: 455913 - DNA, 25 bp, Rattus norvegicus
tcacacagactcaaggacccaggct

SEQ ID NO: 455914 - DNA, 25 bp, Rattus norvegicus
gggcgtttttgtaggctcctacatc

SEQ ID NO: 455915 - DNA, 25 bp, Rattus norvegicus
gtaggctcctacatcccgtccaatg

SEQ ID NO: 455916 - DNA, 25 bp, Rattus norvegicus
atcccgtccaatgccagagccttgt

SEQ ID NO: 455917 - DNA, 25 bp, Rattus norvegicus
gccagagccttgtggcctgctgtct

SEQ ID NO: 455918 - DNA, 25 bp, Rattus norvegicus
gcctgctgtctgcattgactgtctg

SEQ ID NO: 455919 - DNA, 25 bp, Rattus norvegicus
ctggccaaggaaggacccatggaga

SEQ ID NO: 455920 - DNA, 25 bp, Rattus norvegicus
tgcattcgtgaacgcggccagtcca

SEQ ID NO: 455921 - DNA, 25 bp, Rattus norvegicus
atgtggctttggtgcttaacaaatc

SEQ ID NO: 455922 - DNA, 25 bp, Rattus norvegicus
tccagctctcgtaacgcaggaaatg

SEQ ID NO: 455923 - DNA, 25 bp, Rattus norvegicus
ccagagccttttggggaacacgtgc

SEQ ID NO: 455924 - DNA, 25 bp, Rattus norvegicus
aattcctacttttcctgtgccgtcg

SEQ ID NO: 455925 - DNA, 25 bp, Rattus norvegicus
tgacgccaacttgctcctgtatctg

SEQ ID NO: 455926 - DNA, 25 bp, Rattus norvegicus
tcctagggccgaccttccattgacg

SEQ ID NO: 455927 - DNA, 25 bp, Rattus norvegicus
tacagttcattctactccgcgcggc

SEQ ID NO: 455928 - DNA, 25 bp, Rattus norvegicus
ggctctgcttgttttgttacagttc

SEQ ID NO: 455929 - DNA, 25 bp, Rattus norvegicus
tttccaagctagttgccgggagccc

SEQ ID NO: 455930 - DNA, 25 bp, Rattus norvegicus
cgcccgcgagctttgtttgcattcc

SEQ ID NO: 455931 - DNA, 25 bp, Rattus norvegicus
ggctcacgggagaagcatctctctc

SEQ ID NO: 455932 - DNA, 25 bp, Rattus norvegicus
cttcttctggatcactttcgacatg

SEQ ID NO: 455933 - DNA, 25 bp, Rattus norvegicus
ggccagtccagtggttcttcttctg

SEQ ID NO: 455934 - DNA, 25 bp, Rattus norvegicus
tacatttcccgacacgccggtacaa

SEQ ID NO: 455935 - DNA, 25 bp, Rattus norvegicus
ctgggaacttgttcgcccttgttga

SEQ ID NO: 455936 - DNA, 25 bp, Rattus norvegicus
tcccaaggagcgctccggcctggga

SEQ ID NO: 455937 - DNA, 25 bp, Rattus norvegicus
ccacgacctgaagaggcggccgtaa

SEQ ID NO: 455938 - DNA, 25 bp, Rattus norvegicus
ccttggagaaatggccgcgtcggca

SEQ ID NO: 455939 - DNA, 25 bp, Rattus norvegicus
cccgggagcaagctaaacgcaatga

SEQ ID NO: 455940 - DNA, 25 bp, Rattus norvegicus
acactcattggttaggcggccctta

SEQ ID NO: 455941 - DNA, 25 bp, Rattus norvegicus
gccggcttggtcagccacactcatt

SEQ ID NO: 455942 - DNA, 25 bp, Rattus norvegicus
gccggtacaagaatactgaccaatc

SEQ ID NO: 455943 - DNA, 25 bp, Rattus norvegicus
ggtcctctgcccgacaaggagcacg

SEQ ID NO: 455944 - DNA, 25 bp, Rattus norvegicus
gcccttgttgagctttcggctccca

SEQ ID NO: 455945 - DNA, 25 bp, Rattus norvegicus
cgcaatgacatttcctctttaaata

SEQ ID NO: 455946 - DNA, 25 bp, Rattus norvegicus
attcaggtattttgaggctcgggga

SEQ ID NO: 455947 - DNA, 25 bp, Rattus norvegicus
ttagtagagccggaacccgggagca

SEQ ID NO: 455948 - DNA, 25 bp, Rattus norvegicus
agcagggtcgtccagcagctcggac

SEQ ID NO: 455949 - DNA, 25 bp, Rattus norvegicus
ttgactctggtaggtgagctgcctc

SEQ ID NO: 455950 - DNA, 25 bp, Rattus norvegicus
aagccagcacgtggccggccgagca

SEQ ID NO: 455951 - DNA, 25 bp, Rattus norvegicus
agcaagctcaggcttagagccgccc

SEQ ID NO: 455952 - DNA, 25 bp, Rattus norvegicus
ccagtaagcggctgggaaacctctg

SEQ ID NO: 455953 - DNA, 25 bp, Rattus norvegicus
gctgggaaacctctgccttccaaca

SEQ ID NO: 455954 - DNA, 25 bp, Rattus norvegicus
gccttccaacagtgcgccgaacttt

SEQ ID NO: 455955 - DNA, 25 bp, Rattus norvegicus
ggttccagtgccctgcacggctgag

SEQ ID NO: 455956 - DNA, 25 bp, Rattus norvegicus
agaacgcagagcatggggcaccaca

SEQ ID NO: 455957 - DNA, 25 bp, Rattus norvegicus
ggcaccacagcgagtggctcacgtg

SEQ ID NO: 455958 - DNA, 25 bp, Rattus norvegicus
tcacctgggacctgaccgccaagag

SEQ ID NO: 455959 - DNA, 25 bp, Rattus norvegicus
ggccgcagcgatcgctctcgcagaa

SEQ ID NO: 455960 - DNA, 25 bp, Rattus norvegicus
tctcgcagaagcttcccggcctggg

SEQ ID NO: 455961 - DNA, 25 bp, Rattus norvegicus
tgcgccgaacttttcggaactcgcc

SEQ ID NO: 455962 - DNA, 25 bp, Rattus norvegicus
gtcaccgatcggctccggtaaccaa

SEQ ID NO: 455963 - DNA, 25 bp, Rattus norvegicus
cgggagcagacacgacaccttggct

SEQ ID NO: 455964 - DNA, 25 bp, Rattus norvegicus
gcaaacgagacgtcaccgccggcgg

SEQ ID NO: 455965 - DNA, 25 bp, Rattus norvegicus
cggctcgggagcaaacgagacgtca

SEQ ID NO: 455966 - DNA, 25 bp, Rattus norvegicus
ccacctgcagcttggctagggagcg

SEQ ID NO: 455967 - DNA, 25 bp, Rattus norvegicus
atcagggtcccagcatccggctgcg

SEQ ID NO: 455968 - DNA, 25 bp, Rattus norvegicus
ctccggtaaccaactgaaggcggcg

SEQ ID NO: 455969 - DNA, 25 bp, Rattus norvegicus
acgacaccttggctccgggctcaag

SEQ ID NO: 455970 - DNA, 25 bp, Rattus norvegicus
gggtatctcccttgcctacggtcac

SEQ ID NO: 455971 - DNA, 25 bp, Rattus norvegicus
tggccgggtatctcccttgcctacg

SEQ ID NO: 455972 - DNA, 25 bp, Rattus norvegicus
tctagggaacaggacaggcctggcc

SEQ ID NO: 455973 - DNA, 25 bp, Rattus norvegicus
cccagcatggggatctagggaacag

SEQ ID NO: 455974 - DNA, 25 bp, Rattus norvegicus
ggaagatctggagaagcgactccgc

SEQ ID NO: 455975 - DNA, 25 bp, Rattus norvegicus
gacgggatcagggtcccagcatccg

SEQ ID NO: 455976 - DNA, 25 bp, Rattus norvegicus
tgcctgcctcgctgtaaacacgacg

SEQ ID NO: 455977 - DNA, 25 bp, Rattus norvegicus
gcagtgcctgcctcgctgtaaacac

SEQ ID NO: 455978 - DNA, 25 bp, Rattus norvegicus
tccgggaacaaaagaagcagtgcct

SEQ ID NO: 455979 - DNA, 25 bp, Rattus norvegicus
gccaacggaccctgtctgcgcccag

SEQ ID NO: 455980 - DNA, 25 bp, Rattus norvegicus
ctctaggtttcatggccacctccag

SEQ ID NO: 455981 - DNA, 25 bp, Rattus norvegicus
tgcgcgcgcccttccacgtacacaa

SEQ ID NO: 455982 - DNA, 25 bp, Rattus norvegicus
ccgcagactctaggtttcatggcca

SEQ ID NO: 455983 - DNA, 25 bp, Rattus norvegicus
gtagcccttagttacccgcagactc

SEQ ID NO: 455984 - DNA, 25 bp, Rattus norvegicus
catccgggagccgagggtagccctt

SEQ ID NO: 455985 - DNA, 25 bp, Rattus norvegicus
cgtgaagccacatccgggagccgag

SEQ ID NO: 455986 - DNA, 25 bp, Rattus norvegicus
cggacggtggcgtgaagccacatcc

SEQ ID NO: 455987 - DNA, 25 bp, Rattus norvegicus
tgagtcccgcccacacggaaggacg

SEQ ID NO: 455988 - DNA, 25 bp, Rattus norvegicus
acgtacacaaccaccagatccggga

SEQ ID NO: 455989 - DNA, 25 bp, Rattus norvegicus
agatccgggagctgagtcccgccca

SEQ ID NO: 455990 - DNA, 25 bp, Rattus norvegicus
gatcccacgggcacgcgcgaatcag

SEQ ID NO: 455991 - DNA, 25 bp, Rattus norvegicus
cccgcgatggcagcgcggttacctt

SEQ ID NO: 455992 - DNA, 25 bp, Rattus norvegicus
cacggagaagcggagatgctgactc

SEQ ID NO: 455993 - DNA, 25 bp, Rattus norvegicus
tgcagctaagtgctgggatccgatc

SEQ ID NO: 455994 - DNA, 25 bp, Rattus norvegicus
cccaaatcctcagggcgcgggcgga

SEQ ID NO: 455995 - DNA, 25 bp, Rattus norvegicus
ggaacctgttcagtccgggaccagc

SEQ ID NO: 455996 - DNA, 25 bp, Rattus norvegicus
tccgctcacacccaaactggaagga

SEQ ID NO: 455997 - DNA, 25 bp, Rattus norvegicus
ggaactcaggatcccgcgagtgctc

SEQ ID NO: 455998 - DNA, 25 bp, Rattus norvegicus
aagtggtctctaaaggaggaactca

SEQ ID NO: 455999 - DNA, 25 bp, Rattus norvegicus
gggcgcacgagttgacgaaattttg

SEQ ID NO: 456000 - DNA, 25 bp, Rattus norvegicus
gaagacgacagtgcaccaccggcca

SEQ ID NO: 456001 - DNA, 25 bp, Rattus norvegicus
atccctttcgggcagcgcggatgct

SEQ ID NO: 456002 - DNA, 25 bp, Rattus norvegicus
gatgctgactcagccaggcttctgc

SEQ ID NO: 456003 - DNA, 25 bp, Rattus norvegicus
cggctgcagccggtataggataaga

SEQ ID NO: 456004 - DNA, 25 bp, Rattus norvegicus
cccgggccctgataccgcctcgcga

SEQ ID NO: 456005 - DNA, 25 bp, Rattus norvegicus
gcacctcagcgcgaacttttgcgcg

SEQ ID NO: 456006 - DNA, 25 bp, Rattus norvegicus
gcgcgaacttttgcgcgctgcacgc

SEQ ID NO: 456007 - DNA, 25 bp, Rattus norvegicus
gagttcccgcctctttccactctgg

SEQ ID NO: 456008 - DNA, 25 bp, Rattus norvegicus
ccctgataccgcctcgcgacgcttg

SEQ ID NO: 456009 - DNA, 25 bp, Rattus norvegicus
accgcctcgcgacgcttgcgcactg

SEQ ID NO: 456010 - DNA, 25 bp, Rattus norvegicus
cactggggaaggtaggcggagtctt

SEQ ID NO: 456011 - DNA, 25 bp, Rattus norvegicus
agctggagagtcttgaccggggcgg

SEQ ID NO: 456012 - DNA, 25 bp, Rattus norvegicus
tacgcgctcgctgcgtcgacgtgct

SEQ ID NO: 456013 - DNA, 25 bp, Rattus norvegicus
gtcgacgtgctgacgacaggacgcc

SEQ ID NO: 456014 - DNA, 25 bp, Rattus norvegicus
cgacgtgctgacgacaggacgccca

SEQ ID NO: 456015 - DNA, 25 bp, Rattus norvegicus
acgtgctgacgacaggacgcccagg

SEQ ID NO: 456016 - DNA, 25 bp, Rattus norvegicus
tgctgacgacaggacgcccaggccg

SEQ ID NO: 456017 - DNA, 25 bp, Rattus norvegicus
aacttttgcgcgctgcacgcgaccc

SEQ ID NO: 456018 - DNA, 25 bp, Rattus norvegicus
agcagcactaacttctcagccagca

SEQ ID NO: 456019 - DNA, 25 bp, Rattus norvegicus
tgggatgaggctttaaggagaaaaa

SEQ ID NO: 456020 - DNA, 25 bp, Rattus norvegicus
gagatgagcttcaggtaagagagta

SEQ ID NO: 456021 - DNA, 25 bp, Rattus norvegicus
tgggcgggactgcagattaatagga

SEQ ID NO: 456022 - DNA, 25 bp, Rattus norvegicus
gctcctcgccatccgccatattgtt

SEQ ID NO: 456023 - DNA, 25 bp, Rattus norvegicus
gatacttacggctcctcgccatccg

SEQ ID NO: 456024 - DNA, 25 bp, Rattus norvegicus
cccagcccaactcggcgctccggca

SEQ ID NO: 456025 - DNA, 25 bp, Rattus norvegicus
accgccgcgctctctcacaacccag

SEQ ID NO: 456026 - DNA, 25 bp, Rattus norvegicus
aaagaagggtcagcatcaagctcca

SEQ ID NO: 456027 - DNA, 25 bp, Rattus norvegicus
agagaataaaagaagggtcagcatc

SEQ ID NO: 456028 - DNA, 25 bp, Rattus norvegicus
gctcctctattctccttcttttctt

SEQ ID NO: 456029 - DNA, 25 bp, Rattus norvegicus
agcagctcctctattctccttcttt

SEQ ID NO: 456030 - DNA, 25 bp, Rattus norvegicus
agcactaacttctcagccagcagct

SEQ ID NO: 456031 - DNA, 25 bp, Rattus norvegicus
agggtggaccagcgcggtcttacta

SEQ ID NO: 456032 - DNA, 25 bp, Rattus norvegicus
tgggccctgcggtgctctaaccgca

SEQ ID NO: 456033 - DNA, 25 bp, Rattus norvegicus
tctaaccgcagagccaatccgaagg

SEQ ID NO: 456034 - DNA, 25 bp, Rattus norvegicus
accgcagagccaatccgaaggagcc

SEQ ID NO: 456035 - DNA, 25 bp, Rattus norvegicus
ccgaaggagccgctgtcatctttca

SEQ ID NO: 456036 - DNA, 25 bp, Rattus norvegicus
aggagccgctgtcatctttcattca

SEQ ID NO: 456037 - DNA, 25 bp, Rattus norvegicus
tgtcatctttcattcagctggttgc

SEQ ID NO: 456038 - DNA, 25 bp, Rattus norvegicus
cctccggattccgaaggcgaagctc

SEQ ID NO: 456039 - DNA, 25 bp, Rattus norvegicus
ttccgaaggcgaagctcgccaagca

SEQ ID NO: 456040 - DNA, 25 bp, Rattus norvegicus
agctcgccaagcaaaggaacatgga

SEQ ID NO: 456041 - DNA, 25 bp, Rattus norvegicus
aggaacatggacgtgaaccttgccc

SEQ ID NO: 456042 - DNA, 25 bp, Rattus norvegicus
tgggatgatttcttcccgggctctg

SEQ ID NO: 456043 - DNA, 25 bp, Rattus norvegicus
gggctctgatcgtttcgcacggccg

SEQ ID NO: 456044 - DNA, 25 bp, Rattus norvegicus
tcattcagctggttgctaccgccgc

SEQ ID NO: 456045 - DNA, 25 bp, Rattus norvegicus
cgcggccaattttctgggccctgcg

SEQ ID NO: 456046 - DNA, 25 bp, Rattus norvegicus
agcttcctaagctccgtcaggccag

SEQ ID NO: 456047 - DNA, 25 bp, Rattus norvegicus
ctcggtgtaccatctccgcagcgtg

SEQ ID NO: 456048 - DNA, 25 bp, Rattus norvegicus
ccgcagcgtggacacggtcaagttc

SEQ ID NO: 456049 - DNA, 25 bp, Rattus norvegicus
acggtcaagttccacacgaagcggc

SEQ ID NO: 456050 - DNA, 25 bp, Rattus norvegicus
gttccacacgaagcggctgccgctg

SEQ ID NO: 456051 - DNA, 25 bp, Rattus norvegicus
ggctgccgctgaacagcaggtcctc

SEQ ID NO: 456052 - DNA, 25 bp, Rattus norvegicus
tccgcacatgaacaccgaagccatg

SEQ ID NO: 456053 - DNA, 25 bp, Rattus norvegicus
tgctttccctcggagcctgggatcc

SEQ ID NO: 456054 - DNA, 25 bp, Rattus norvegicus
ggatccgcgatactgggcacgccac

SEQ ID NO: 456055 - DNA, 25 bp, Rattus norvegicus
acgccacgctgctgtagctgacagc

SEQ ID NO: 456056 - DNA, 25 bp, Rattus norvegicus
ggggtcagatctgccactgaactcg

SEQ ID NO: 456057 - DNA, 25 bp, Rattus norvegicus
cactgaactcgcctttcactgtgtg

SEQ ID NO: 456058 - DNA, 25 bp, Rattus norvegicus
ctttcactgtgtgtcccggccaggt

SEQ ID NO: 456059 - DNA, 25 bp, Rattus norvegicus
ccgggattgggtgcccgccagccaa

SEQ ID NO: 456060 - DNA, 25 bp, Rattus norvegicus
gctctctgataaccttgggacagtc

SEQ ID NO: 456061 - DNA, 25 bp, Rattus norvegicus
ttcctccagcgactgagctctctga

SEQ ID NO: 456062 - DNA, 25 bp, Rattus norvegicus
tgggacagtcgcctacctacctgct

SEQ ID NO: 456063 - DNA, 25 bp, Rattus norvegicus
ggggctgtcgccttgctactttatt

SEQ ID NO: 456064 - DNA, 25 bp, Rattus norvegicus
gctactttattgtctgcgctgtgca

SEQ ID NO: 456065 - DNA, 25 bp, Rattus norvegicus
agcagctgtcttcctctcggtgctc

SEQ ID NO: 456066 - DNA, 25 bp, Rattus norvegicus
cgcagtcgaactccgcggcggctag

SEQ ID NO: 456067 - DNA, 25 bp, Rattus norvegicus
tggcccggtatcctcaccagaataa

SEQ ID NO: 456068 - DNA, 25 bp, Rattus norvegicus
accagaataaccacgctccgcggag

SEQ ID NO: 456069 - DNA, 25 bp, Rattus norvegicus
gccctgccaatgaggctcggcggat

SEQ ID NO: 456070 - DNA, 25 bp, Rattus norvegicus
gctgttccggcccagtcattgtatc

SEQ ID NO: 456071 - DNA, 25 bp, Rattus norvegicus
cacaggcggcgggtaacgaattcga

SEQ ID NO: 456072 - DNA, 25 bp, Rattus norvegicus
tcgaaagaatcttggggtacagcta

SEQ ID NO: 456073 - DNA, 25 bp, Rattus norvegicus
gcgcactcagcgcacctaaggtgga

SEQ ID NO: 456074 - DNA, 25 bp, Rattus norvegicus
ccgccctggtgtgagagtaaactca

SEQ ID NO: 456075 - DNA, 25 bp, Rattus norvegicus
tctgaatcgggaatcgtggcggatt

SEQ ID NO: 456076 - DNA, 25 bp, Rattus norvegicus
catgcagtctgaatcgggaatcgtg

SEQ ID NO: 456077 - DNA, 25 bp, Rattus norvegicus
agtcatgcagtctgaatcgggaatc

SEQ ID NO: 456078 - DNA, 25 bp, Rattus norvegicus
aagcaggagtcatgcagtctgaatc

SEQ ID NO: 456079 - DNA, 25 bp, Rattus norvegicus
cgggcaagcaggagtcatgcagtct

SEQ ID NO: 456080 - DNA, 25 bp, Rattus norvegicus
tccaagtcccaagcagtggaaggcg

SEQ ID NO: 456081 - DNA, 25 bp, Rattus norvegicus
tctggtccaagtcccaagcagtgga

SEQ ID NO: 456082 - DNA, 25 bp, Rattus norvegicus
cgggttctggtccaagtcccaagca

SEQ ID NO: 456083 - DNA, 25 bp, Rattus norvegicus
tgcccgggttctggtccaagtccca

SEQ ID NO: 456084 - DNA, 25 bp, Rattus norvegicus
atctttgtcaggtgcccgggttctg

SEQ ID NO: 456085 - DNA, 25 bp, Rattus norvegicus
cccatctttgtcaggtgcccgggtt

SEQ ID NO: 456086 - DNA, 25 bp, Rattus norvegicus
atcgggaatcgtggcggatttcgaa

SEQ ID NO: 456087 - DNA, 25 bp, Rattus norvegicus
tgagagtaaactcaccgcgccgggg

SEQ ID NO: 456088 - DNA, 25 bp, Rattus norvegicus
tcggattgtcactcgacgcccacta

SEQ ID NO: 456089 - DNA, 25 bp, Rattus norvegicus
ccatcttggttatgggctgcggccc

SEQ ID NO: 456090 - DNA, 25 bp, Rattus norvegicus
cgctccgtcttttttacaacaggtg

SEQ ID NO: 456091 - DNA, 25 bp, Rattus norvegicus
aggtgcattcatccattcgccgacg

SEQ ID NO: 456092 - DNA, 25 bp, Rattus norvegicus
cgagtagccctcaagtctggatgtt

SEQ ID NO: 456093 - DNA, 25 bp, Rattus norvegicus
cttcccaaggtggtgcacttgctcc

SEQ ID NO: 456094 - DNA, 25 bp, Rattus norvegicus
tccctgccaccgtgtatggggtaaa

SEQ ID NO: 456095 - DNA, 25 bp, Rattus norvegicus
ctcctatacttcttagcaccgggga

SEQ ID NO: 456096 - DNA, 25 bp, Rattus norvegicus
gcggagctggtttctcgaagcaaaa

SEQ ID NO: 456097 - DNA, 25 bp, Rattus norvegicus
cacacggttacggatctggcttttg

SEQ ID NO: 456098 - DNA, 25 bp, Rattus norvegicus
gtttccgtcttcttggcccgcaaca

SEQ ID NO: 456099 - DNA, 25 bp, Rattus norvegicus
acacgaccttgggtgctccgtaaga

SEQ ID NO: 456100 - DNA, 25 bp, Rattus norvegicus
ggacgaagctactcgccgccatctt

SEQ ID NO: 456101 - DNA, 25 bp, Rattus norvegicus
tatggggtaaaagctgccgttgccg

SEQ ID NO: 456102 - DNA, 25 bp, Rattus norvegicus
cttcgaaactgacaaagagttatgc

SEQ ID NO: 456103 - DNA, 25 bp, Rattus norvegicus
cttgtttgtttcctcttcgaaactg

SEQ ID NO: 456104 - DNA, 25 bp, Rattus norvegicus
agttatgctaaccttccgggacgcg

SEQ ID NO: 456105 - DNA, 25 bp, Rattus norvegicus
gccaagcaagcctacagactcagct

SEQ ID NO: 456106 - DNA, 25 bp, Rattus norvegicus
agcaagcctacagactcagctgctc

SEQ ID NO: 456107 - DNA, 25 bp, Rattus norvegicus
ccgaaccggcccaaagacaggcttg

SEQ ID NO: 456108 - DNA, 25 bp, Rattus norvegicus
ccaaagacaggcttgcggggcgcca

SEQ ID NO: 456109 - DNA, 25 bp, Rattus norvegicus
cgctgcccagccggctttggggaaa

SEQ ID NO: 456110 - DNA, 25 bp, Rattus norvegicus
caggctgtgcctttcctcgaaaacc

SEQ ID NO: 456111 - DNA, 25 bp, Rattus norvegicus
cccgcctcggtggagaactttcact

SEQ ID NO: 456112 - DNA, 25 bp, Rattus norvegicus
ggtggagaactttcacttcacgtcg

SEQ ID NO: 456113 - DNA, 25 bp, Rattus norvegicus
cggcaggtgaaaccgacgctcggcc

SEQ ID NO: 456114 - DNA, 25 bp, Rattus norvegicus
gcgccaggctgtgcctttcctcgaa

SEQ ID NO: 456115 - DNA, 25 bp, Rattus norvegicus
ctctttaattgctgttaacccggtg

SEQ ID NO: 456116 - DNA, 25 bp, Rattus norvegicus
ctccgagggacaggaaccgagaatc

SEQ ID NO: 456117 - DNA, 25 bp, Rattus norvegicus
cggcctgggcttatagatcgctcta

SEQ ID NO: 456118 - DNA, 25 bp, Rattus norvegicus
actcaaagttgcgacaggcggcctg

SEQ ID NO: 456119 - DNA, 25 bp, Rattus norvegicus
ggcggccaccaaacgctgacactgg

SEQ ID NO: 456120 - DNA, 25 bp, Rattus norvegicus
taagctcagtagatgatgccactcg

SEQ ID NO: 456121 - DNA, 25 bp, Rattus norvegicus
ttcggaccaaaacacgcgtggctgc

SEQ ID NO: 456122 - DNA, 25 bp, Rattus norvegicus
tccacaccgctgagttcggaccaaa

SEQ ID NO: 456123 - DNA, 25 bp, Rattus norvegicus
ctcagggttagctagagagcgtcca

SEQ ID NO: 456124 - DNA, 25 bp, Rattus norvegicus
aagcccactcgcgatcttgctacgg

SEQ ID NO: 456125 - DNA, 25 bp, Rattus norvegicus
tcaaagtttccgagcgcagcagggt

SEQ ID NO: 456126 - DNA, 25 bp, Rattus norvegicus
cttatgcaaatggacccaagggtgc

SEQ ID NO: 456127 - DNA, 25 bp, Rattus norvegicus
cagatccctgagcttaagaggcgca

SEQ ID NO: 456128 - DNA, 25 bp, Rattus norvegicus
gtgtgtatgagttttccaggctctc

SEQ ID NO: 456129 - DNA, 25 bp, Rattus norvegicus
gtcggctccagagagacgtctccga

SEQ ID NO: 456130 - DNA, 25 bp, Rattus norvegicus
ggggcagcgccatgttctccgccag

SEQ ID NO: 456131 - DNA, 25 bp, Rattus norvegicus
cagtccaacaaaggccgggcctgcg

SEQ ID NO: 456132 - DNA, 25 bp, Rattus norvegicus
cggacaagcggacccagcgcctagt

SEQ ID NO: 456133 - DNA, 25 bp, Rattus norvegicus
gactccctgcccaactggctggatg

SEQ ID NO: 456134 - DNA, 25 bp, Rattus norvegicus
agccttgccgagaggctcgctagcc

SEQ ID NO: 456135 - DNA, 25 bp, Rattus norvegicus
tgcagcgccgacagagccttgccga

SEQ ID NO: 456136 - DNA, 25 bp, Rattus norvegicus
tgtccagccagaaggtccagggcga

SEQ ID NO: 456137 - DNA, 25 bp, Rattus norvegicus
acgtgcggaactccacgcgagggcc

SEQ ID NO: 456138 - DNA, 25 bp, Rattus norvegicus
tgctatcgaggacgtgcggaactcc

SEQ ID NO: 456139 - DNA, 25 bp, Rattus norvegicus
ccaactggctggatgctatcgagga

SEQ ID NO: 456140 - DNA, 25 bp, Rattus norvegicus
ccgctggccgacttttctgattgct

SEQ ID NO: 456141 - DNA, 25 bp, Rattus norvegicus
tctgattgctgtcaccgcaaaggtc

SEQ ID NO: 456142 - DNA, 25 bp, Rattus norvegicus
cgcaaaggtcacgtcccgagcaagc

SEQ ID NO: 456143 - DNA, 25 bp, Rattus norvegicus
agcgcctagtagtctccgggcgcca

SEQ ID NO: 456144 - DNA, 25 bp, Rattus norvegicus
ggggccaaacgcgacttgtcgccac

SEQ ID NO: 456145 - DNA, 25 bp, Rattus norvegicus
tccgatcaagcgtggaagaaaagaa

SEQ ID NO: 456146 - DNA, 25 bp, Rattus norvegicus
tacctggggccaaacgcgacttgtc

SEQ ID NO: 456147 - DNA, 25 bp, Rattus norvegicus
agctccgatcaagcgtggaagaaaa

SEQ ID NO: 456148 - DNA, 25 bp, Rattus norvegicus
gaaagctccgatcaagcgtggaaga

SEQ ID NO: 456149 - DNA, 25 bp, Rattus norvegicus
ttagaaagctccgatcaagcgtgga

SEQ ID NO: 456150 - DNA, 25 bp, Rattus norvegicus
tcaatttagaaagctccgatcaagc

SEQ ID NO: 456151 - DNA, 25 bp, Rattus norvegicus
ggcgtgtgagcgctcaatttagaaa

SEQ ID NO: 456152 - DNA, 25 bp, Rattus norvegicus
gactggcgtgtgagcgctcaattta

SEQ ID NO: 456153 - DNA, 25 bp, Rattus norvegicus
ccctcccggctgtcgcaacggcgcc

SEQ ID NO: 456154 - DNA, 25 bp, Rattus norvegicus
cacctcgcgtcctgggccctgcctc

SEQ ID NO: 456155 - DNA, 25 bp, Rattus norvegicus
caaacgcgacttgtcgccacctcgc

SEQ ID NO: 456156 - DNA, 25 bp, Rattus norvegicus
gcgctcaatttagaaagctccgatc

SEQ ID NO: 456157 - DNA, 25 bp, Rattus norvegicus
cgtgtgagcgctcaatttagaaagc

SEQ ID NO: 456158 - DNA, 25 bp, Rattus norvegicus
tcccggttgaagaggaaacacacca

SEQ ID NO: 456159 - DNA, 25 bp, Rattus norvegicus
gcagagctcgcttcacaaaccaatg

SEQ ID NO: 456160 - DNA, 25 bp, Rattus norvegicus
cgcgcaggtaactggcaaccacata

SEQ ID NO: 456161 - DNA, 25 bp, Rattus norvegicus
acacaccacggggttgatgccggcc

SEQ ID NO: 456162 - DNA, 25 bp, Rattus norvegicus
tacaaaaagactgcagggcctactg

SEQ ID NO: 456163 - DNA, 25 bp, Rattus norvegicus
aacaggggaactgggctctgaaaca

SEQ ID NO: 456164 - DNA, 25 bp, Rattus norvegicus
ccaatgcctttcaggtcgcagggga

SEQ ID NO: 456165 - DNA, 25 bp, Rattus norvegicus
ctactgtcgggaaggaagaataata

SEQ ID NO: 456166 - DNA, 25 bp, Rattus norvegicus
gggacggaactagacctcggcatcc

SEQ ID NO: 456167 - DNA, 25 bp, Rattus norvegicus
cccgccagaacaggggtctatacaa

SEQ ID NO: 456168 - DNA, 25 bp, Rattus norvegicus
gtgcgtgtccactttgagagtcttg

SEQ ID NO: 456169 - DNA, 25 bp, Rattus norvegicus
cttgtgaaggcagcggagaaaaacc

SEQ ID NO: 456170 - DNA, 25 bp, Rattus norvegicus
aagatgcgcggtcacaattgaagcc

SEQ ID NO: 456171 - DNA, 25 bp, Rattus norvegicus
tgtgcgaatgtcagccacaccgagg

SEQ ID NO: 456172 - DNA, 25 bp, Rattus norvegicus
tgctacgagaggtcgggtaatcctt

SEQ ID NO: 456173 - DNA, 25 bp, Rattus norvegicus
actcaccagatagaggctgccctgc

SEQ ID NO: 456174 - DNA, 25 bp, Rattus norvegicus
gagaaagtttcagggctccgcagct

SEQ ID NO: 456175 - DNA, 25 bp, Rattus norvegicus
attaacccttacagtccggcctctg

SEQ ID NO: 456176 - DNA, 25 bp, Rattus norvegicus
gggtgggccagtcgagcaccctcct

SEQ ID NO: 456177 - DNA, 25 bp, Rattus norvegicus
ggtaatccttggctactcagcttgg

SEQ ID NO: 456178 - DNA, 25 bp, Rattus norvegicus
aggctgccctgcactaggaacacga

SEQ ID NO: 456179 - DNA, 25 bp, Rattus norvegicus
cgcgtcctgggatgctgctacgaga

SEQ ID NO: 456180 - DNA, 25 bp, Rattus norvegicus
aggtcagagaagaataccgcgtccc

SEQ ID NO: 456181 - DNA, 25 bp, Rattus norvegicus
taggaacacgaagcagcagcgggtc

SEQ ID NO: 456182 - DNA, 25 bp, Rattus norvegicus
gcagcgggtcagttgcatcttcctc

SEQ ID NO: 456183 - DNA, 25 bp, Rattus norvegicus
ccagggcccacagttcgggattctc

SEQ ID NO: 456184 - DNA, 25 bp, Rattus norvegicus
tgggcgctcagctcagctgctctga

SEQ ID NO: 456185 - DNA, 25 bp, Rattus norvegicus
ggccttttccctagtgtcactcgca

SEQ ID NO: 456186 - DNA, 25 bp, Rattus norvegicus
tgggctgcaagctgctggccttcct

SEQ ID NO: 456187 - DNA, 25 bp, Rattus norvegicus
gtcagccacgactggaccttccacg

SEQ ID NO: 456188 - DNA, 25 bp, Rattus norvegicus
cttcatccacgaccgccgcaagatg

SEQ ID NO: 456189 - DNA, 25 bp, Rattus norvegicus
tggtgggcgccacgcacctcgtcta

SEQ ID NO: 456190 - DNA, 25 bp, Rattus norvegicus
gtctaccttcgcctgctcttcttca

SEQ ID NO: 456191 - DNA, 25 bp, Rattus norvegicus
gcttctatgccgagcgcctggccgg

SEQ ID NO: 456192 - DNA, 25 bp, Rattus norvegicus
tcgacctgtgcctggccgacgggct

SEQ ID NO: 456193 - DNA, 25 bp, Rattus norvegicus
ttactacctgctgctcgacctgtgc

SEQ ID NO: 456194 - DNA, 25 bp, Rattus norvegicus
tgctcatcgtgagggagcgcagcct

SEQ ID NO: 456195 - DNA, 25 bp, Rattus norvegicus
gctgttcgctctgctcatcgtgagg

SEQ ID NO: 456196 - DNA, 25 bp, Rattus norvegicus
ggcaacgtgctgttcgctctgctca

SEQ ID NO: 456197 - DNA, 25 bp, Rattus norvegicus
tcaagcggccgccaactggacggcg

SEQ ID NO: 456198 - DNA, 25 bp, Rattus norvegicus
tgggcctcaggctggccacactcag

SEQ ID NO: 456199 - DNA, 25 bp, Rattus norvegicus
ggtgcgctaggcttcctgctgctcc

SEQ ID NO: 456200 - DNA, 25 bp, Rattus norvegicus
gcacagcgcgggtcctccatggcgt

SEQ ID NO: 456201 - DNA, 25 bp, Rattus norvegicus
agcctggcggcggttataaaggcga

SEQ ID NO: 456202 - DNA, 25 bp, Rattus norvegicus
gtgactcacgccaggcagcacgcgg

SEQ ID NO: 456203 - DNA, 25 bp, Rattus norvegicus
gcgcacacgcgcacgtgccacgcgc

SEQ ID NO: 456204 - DNA, 25 bp, Rattus norvegicus
ccacacggggcacgcccttcctggt

SEQ ID NO: 456205 - DNA, 25 bp, Rattus norvegicus
gctctgccgaatcgcgagcctggcg

SEQ ID NO: 456206 - DNA, 25 bp, Rattus norvegicus
tcctccatggcgtcccgaggaggcg

SEQ ID NO: 456207 - DNA, 25 bp, Rattus norvegicus
aaaagtagcagtagcggggcacagc

SEQ ID NO: 456208 - DNA, 25 bp, Rattus norvegicus
cagcggtagcagcaaaagtagcagt

SEQ ID NO: 456209 - DNA, 25 bp, Rattus norvegicus
ttaccccggtgatgaccgcggcatc

SEQ ID NO: 456210 - DNA, 25 bp, Rattus norvegicus
tctctggggccatccaggcgcgaca

SEQ ID NO: 456211 - DNA, 25 bp, Rattus norvegicus
ggcccggtgtctctggggccatcca

SEQ ID NO: 456212 - DNA, 25 bp, Rattus norvegicus
ttcctggtccctacacaccctgggc

SEQ ID NO: 456213 - DNA, 25 bp, Rattus norvegicus
gctgctctgccgaatcgcgagcctg

SEQ ID NO: 456214 - DNA, 25 bp, Rattus norvegicus
tatacggtatccctgaattgccatg

SEQ ID NO: 456215 - DNA, 25 bp, Rattus norvegicus
agactgcgagcgaggacaagaggct

SEQ ID NO: 456216 - DNA, 25 bp, Rattus norvegicus
tcaatattaggtgggttgttcaact

SEQ ID NO: 456217 - DNA, 25 bp, Rattus norvegicus
gtgttcaatattaggtgggttgttc

SEQ ID NO: 456218 - DNA, 25 bp, Rattus norvegicus
tgtgtgttcaatattaggtgggttg

SEQ ID NO: 456219 - DNA, 25 bp, Rattus norvegicus
ccctgaattgccatgcttgtgtgtg

SEQ ID NO: 456220 - DNA, 25 bp, Rattus norvegicus
tccctgaattgccatgcttgtgtgt

SEQ ID NO: 456221 - DNA, 25 bp, Rattus norvegicus
tatccctgaattgccatgcttgtgt

SEQ ID NO: 456222 - DNA, 25 bp, Rattus norvegicus
gtatccctgaattgccatgcttgtg

SEQ ID NO: 456223 - DNA, 25 bp, Rattus norvegicus
ggtatccctgaattgccatgcttgt

SEQ ID NO: 456224 - DNA, 25 bp, Rattus norvegicus
cggtatccctgaattgccatgcttg

SEQ ID NO: 456225 - DNA, 25 bp, Rattus norvegicus
tacggtatccctgaattgccatgct

SEQ ID NO: 456226 - DNA, 25 bp, Rattus norvegicus
acaagaggctggtgtaaagcgctca

SEQ ID NO: 456227 - DNA, 25 bp, Rattus norvegicus
atacggtatccctgaattgccatgc

SEQ ID NO: 456228 - DNA, 25 bp, Rattus norvegicus
gctgcatttaaaggcttcggcgctg

SEQ ID NO: 456229 - DNA, 25 bp, Rattus norvegicus
cttcggcgctgttcctaaaggtgca

SEQ ID NO: 456230 - DNA, 25 bp, Rattus norvegicus
tcctaaaggtgcagacgctacaatc

SEQ ID NO: 456231 - DNA, 25 bp, Rattus norvegicus
agacgctacaatcccaaaagccttc

SEQ ID NO: 456232 - DNA, 25 bp, Rattus norvegicus
aaaagccttcgtctgcagccggttt

SEQ ID NO: 456233 - DNA, 25 bp, Rattus norvegicus
ctgcagccggtttcgcttgtctttt

SEQ ID NO: 456234 - DNA, 25 bp, Rattus norvegicus
tttggccttccgaggagtggagaac

SEQ ID NO: 456235 - DNA, 25 bp, Rattus norvegicus
gaagagaaaacaaacgctggtaagc

SEQ ID NO: 456236 - DNA, 25 bp, Rattus norvegicus
gctggtaagccgtcgtcaattcaca

SEQ ID NO: 456237 - DNA, 25 bp, Rattus norvegicus
aagccgtcgtcaattcacaggaatc

SEQ ID NO: 456238 - DNA, 25 bp, Rattus norvegicus
tcaattcacaggaatccgacgctgg

SEQ ID NO: 456239 - DNA, 25 bp, Rattus norvegicus
gctggaaacttctcgcagcgaccac

SEQ ID NO: 456240 - DNA, 25 bp, Rattus norvegicus
gcttgtctttttggccttccgagga

SEQ ID NO: 456241 - DNA, 25 bp, Rattus norvegicus
gcacatcgcagatgctgcatttaaa

SEQ ID NO: 456242 - DNA, 25 bp, Rattus norvegicus
tagttccgcgcagtttgcgcgcgcc

SEQ ID NO: 456243 - DNA, 25 bp, Rattus norvegicus
atgaaaagcactctaacctgtaccc

SEQ ID NO: 456244 - DNA, 25 bp, Rattus norvegicus
ggcacggtggatgaaaagcactcta

SEQ ID NO: 456245 - DNA, 25 bp, Rattus norvegicus
cgctcctcccaggaagggcacggtg

SEQ ID NO: 456246 - DNA, 25 bp, Rattus norvegicus
tgcgaaatgaggctcctaacgctcc

SEQ ID NO: 456247 - DNA, 25 bp, Rattus norvegicus
gcggttcctgcctctgcgaaatgag

SEQ ID NO: 456248 - DNA, 25 bp, Rattus norvegicus
ttccaacctcgtgtcgcggttcctg

SEQ ID NO: 456249 - DNA, 25 bp, Rattus norvegicus
gttcagatccaagcgaccacatgcc

SEQ ID NO: 456250 - DNA, 25 bp, Rattus norvegicus
ccggggaagttgctgttcagatcca

SEQ ID NO: 456251 - DNA, 25 bp, Rattus norvegicus
actgccgcttctgccacgaggggct

SEQ ID NO: 456252 - DNA, 25 bp, Rattus norvegicus
gcagcggctccgctgaagtagttcc

SEQ ID NO: 456253 - DNA, 25 bp, Rattus norvegicus
gcacttaggaagtaccagggcccga

SEQ ID NO: 456254 - DNA, 25 bp, Rattus norvegicus
cgctgaagtagttccgcgcagtttg

SEQ ID NO: 456255 - DNA, 25 bp, Rattus norvegicus
ccacgaggggctttgtggctgtctt

SEQ ID NO: 456256 - DNA, 25 bp, Rattus norvegicus
cccactcctggaggcaggatgatta

SEQ ID NO: 456257 - DNA, 25 bp, Rattus norvegicus
cctagacctacgtaggagtgaccta

SEQ ID NO: 456258 - DNA, 25 bp, Rattus norvegicus
accgacggtgaggatcacagccttg

SEQ ID NO: 456259 - DNA, 25 bp, Rattus norvegicus
tgattaataagcagaacccttccgg

SEQ ID NO: 456260 - DNA, 25 bp, Rattus norvegicus
gagtgacctaggacacccaccggaa

SEQ ID NO: 456261 - DNA, 25 bp, Rattus norvegicus
aatccgcgcgaggaggccaccagca

SEQ ID NO: 456262 - DNA, 25 bp, Rattus norvegicus
gagggctggcaactcgagccttccc

SEQ ID NO: 456263 - DNA, 25 bp, Rattus norvegicus
tcagcggacaatgcagggattagcc

SEQ ID NO: 456264 - DNA, 25 bp, Rattus norvegicus
acataattagatacgtcagcggaca

SEQ ID NO: 456265 - DNA, 25 bp, Rattus norvegicus
cgcgcggtggttgtaagacacataa

SEQ ID NO: 456266 - DNA, 25 bp, Rattus norvegicus
attctcgtctttccgccagaaggcc

SEQ ID NO: 456267 - DNA, 25 bp, Rattus norvegicus
tcggtaacagatggagcaatcattc

SEQ ID NO: 456268 - DNA, 25 bp, Rattus norvegicus
cccagaggtgcctcggtaacagatg

SEQ ID NO: 456269 - DNA, 25 bp, Rattus norvegicus
tccgagctcagtgcaggaccgacgg

SEQ ID NO: 456270 - DNA, 25 bp, Rattus norvegicus
tcgagctaggtgcagtcgccatctt

SEQ ID NO: 456271 - DNA, 25 bp, Rattus norvegicus
ttccctggtttcttcgcggagcgga

SEQ ID NO: 456272 - DNA, 25 bp, Rattus norvegicus
ggcgctgactgcgtcacagcagctg

SEQ ID NO: 456273 - DNA, 25 bp, Rattus norvegicus
ctctgtttaatcctcgctgtaaagg

SEQ ID NO: 456274 - DNA, 25 bp, Rattus norvegicus
cctcgctgtaaaggactgcagtgca

SEQ ID NO: 456275 - DNA, 25 bp, Rattus norvegicus
agctaggtgcagtcgccatcttccg

SEQ ID NO: 456276 - DNA, 25 bp, Rattus norvegicus
ggactgcagtgcagcttccggcttt

SEQ ID NO: 456277 - DNA, 25 bp, Rattus norvegicus
gcagtgcagcttccggctttcctcg

SEQ ID NO: 456278 - DNA, 25 bp, Rattus norvegicus
gctttcctcggtcttctgagctttc

SEQ ID NO: 456279 - DNA, 25 bp, Rattus norvegicus
cggtcttctgagctttccgcttaca

SEQ ID NO: 456280 - DNA, 25 bp, Rattus norvegicus
tgagctttccgcttacatttcgagc

SEQ ID NO: 456281 - DNA, 25 bp, Rattus norvegicus
ccggagcttattccttctctgttta

SEQ ID NO: 456282 - DNA, 25 bp, Rattus norvegicus
cttacatttcgagctaggtgcagtc

SEQ ID NO: 456283 - DNA, 25 bp, Rattus norvegicus
tccgcttacatttcgagctaggtgc

SEQ ID NO: 456284 - DNA, 25 bp, Rattus norvegicus
gttagcatcgttgcgcgcgcctgaa

SEQ ID NO: 456285 - DNA, 25 bp, Rattus norvegicus
ctccgcagagggatctacagatgcc

SEQ ID NO: 456286 - DNA, 25 bp, Rattus norvegicus
ccgcgaggcgcggatttaatcgcaa

SEQ ID NO: 456287 - DNA, 25 bp, Rattus norvegicus
cgcaagcgtaggctcctgaatgaaa

SEQ ID NO: 456288 - DNA, 25 bp, Rattus norvegicus
gcgggaactcgcctcagaaagtacg

SEQ ID NO: 456289 - DNA, 25 bp, Rattus norvegicus
cagttcgaacgcaggagttagcatc

SEQ ID NO: 456290 - DNA, 25 bp, Rattus norvegicus
accggctagacacgcgacaagtacc

SEQ ID NO: 456291 - DNA, 25 bp, Rattus norvegicus
gagtgcgtatagagccggaagtccc

SEQ ID NO: 456292 - DNA, 25 bp, Rattus norvegicus
tctccttggagacaggacgctttcg

SEQ ID NO: 456293 - DNA, 25 bp, Rattus norvegicus
gctggctaggcggagtttttaaaca

SEQ ID NO: 456294 - DNA, 25 bp, Rattus norvegicus
cagcctggcttgttatgaaacttca

SEQ ID NO: 456295 - DNA, 25 bp, Rattus norvegicus
ctctagccgggaaatttgcgaactg

SEQ ID NO: 456296 - DNA, 25 bp, Rattus norvegicus
ctgacgggaacatgaattcgcttta

SEQ ID NO: 456297 - DNA, 25 bp, Rattus norvegicus
acggcttggcgtagaacttgaagtc

SEQ ID NO: 456298 - DNA, 25 bp, Rattus norvegicus
cttggataacctcccatctgaggac

SEQ ID NO: 456299 - DNA, 25 bp, Rattus norvegicus
cagcgatgcgcagagggtccgcgcc

SEQ ID NO: 456300 - DNA, 25 bp, Rattus norvegicus
cagtcccgggctagccggcctggac

SEQ ID NO: 456301 - DNA, 25 bp, Rattus norvegicus
ggccgccgtgcggcaccatgaagct

SEQ ID NO: 456302 - DNA, 25 bp, Rattus norvegicus
caccatgaagctccgcagcaaggcg

SEQ ID NO: 456303 - DNA, 25 bp, Rattus norvegicus
atctgaggacctgcgtctcccttcc

SEQ ID NO: 456304 - DNA, 25 bp, Rattus norvegicus
catgaagctccgcagcaaggcggca

SEQ ID NO: 456305 - DNA, 25 bp, Rattus norvegicus
agctccgcagcaaggcggcagcgct

SEQ ID NO: 456306 - DNA, 25 bp, Rattus norvegicus
ggcagcgctgcttctgctcgcgctg

SEQ ID NO: 456307 - DNA, 25 bp, Rattus norvegicus
tgctggctctgctgtccttgcgcgc

SEQ ID NO: 456308 - DNA, 25 bp, Rattus norvegicus
ttccctgcgcgtcccgaggctgccc

SEQ ID NO: 456309 - DNA, 25 bp, Rattus norvegicus
agtcgtggcagcttggataacctcc

SEQ ID NO: 456310 - DNA, 25 bp, Rattus norvegicus
gtggcagcttggataacctcccatc

SEQ ID NO: 456311 - DNA, 25 bp, Rattus norvegicus
gcagcttggataacctcccatctga

SEQ ID NO: 456312 - DNA, 25 bp, Rattus norvegicus
ttcaccatgctgaggctgagccttg

SEQ ID NO: 456313 - DNA, 25 bp, Rattus norvegicus
gggctccgaactcgcacctccgtcc

SEQ ID NO: 456314 - DNA, 25 bp, Rattus norvegicus
aggttctcgctctgtccgtctcgct

SEQ ID NO: 456315 - DNA, 25 bp, Rattus norvegicus
ggaggctcgccttcaccatgctgag

SEQ ID NO: 456316 - DNA, 25 bp, Rattus norvegicus
tgaggctgagccttggcaagcaaca

SEQ ID NO: 456317 - DNA, 25 bp, Rattus norvegicus
ccttggcaagcaacaggctcgagaa

SEQ ID NO: 456318 - DNA, 25 bp, Rattus norvegicus
aggctcgagaacactgcttcccaaa

SEQ ID NO: 456319 - DNA, 25 bp, Rattus norvegicus
cccgccttggacgtgcaggagcatt

SEQ ID NO: 456320 - DNA, 25 bp, Rattus norvegicus
ccttggacgtgcaggagcatttgga

SEQ ID NO: 456321 - DNA, 25 bp, Rattus norvegicus
gcatttggaggatggcagcttagtt

SEQ ID NO: 456322 - DNA, 25 bp, Rattus norvegicus
gcttggggctggattcattcaaata

SEQ ID NO: 456323 - DNA, 25 bp, Rattus norvegicus
ttcattcaaatacacgctgcagcgg

SEQ ID NO: 456324 - DNA, 25 bp, Rattus norvegicus
aatacacgctgcagcggtcggggct

SEQ ID NO: 456325 - DNA, 25 bp, Rattus norvegicus
ctgataggtgggtaaaccgcgctgc

SEQ ID NO: 456326 - DNA, 25 bp, Rattus norvegicus
agcttttccgcccttctggcagcgc

SEQ ID NO: 456327 - DNA, 25 bp, Rattus norvegicus
ctggcagcgcgccttctttctgtag

SEQ ID NO: 456328 - DNA, 25 bp, Rattus norvegicus
atggggacaccagcttttccgccct

SEQ ID NO: 456329 - DNA, 25 bp, Rattus norvegicus
aagaccgcggatggggacaccagct

SEQ ID NO: 456330 - DNA, 25 bp, Rattus norvegicus
cttcctcgtccctcccactggcggc

SEQ ID NO: 456331 - DNA, 25 bp, Rattus norvegicus
agaggagacgagaggctggaagacc

SEQ ID NO: 456332 - DNA, 25 bp, Rattus norvegicus
ccactttccagcgtaggggacagga

SEQ ID NO: 456333 - DNA, 25 bp, Rattus norvegicus
ggcgcccactttccagcgtagggga

SEQ ID NO: 456334 - DNA, 25 bp, Rattus norvegicus
ctgccggctagcagcctggggacct

SEQ ID NO: 456335 - DNA, 25 bp, Rattus norvegicus
gcgcgccttctttctgtagcgggca

SEQ ID NO: 456336 - DNA, 25 bp, Rattus norvegicus
caggtacggtgagcccagtcggtac

SEQ ID NO: 456337 - DNA, 25 bp, Rattus norvegicus
gccttctttctgtagcgggcacccg

SEQ ID NO: 456338 - DNA, 25 bp, Rattus norvegicus
ttctgtagcgggcacccgggaatct

SEQ ID NO: 456339 - DNA, 25 bp, Rattus norvegicus
tgagcccagtcggtacctccggagt

SEQ ID NO: 456340 - DNA, 25 bp, Rattus norvegicus
ctctttctttgtcggagctcacgga

SEQ ID NO: 456341 - DNA, 25 bp, Rattus norvegicus
ttttggtaactgtgctgaccgctga

SEQ ID NO: 456342 - DNA, 25 bp, Rattus norvegicus
acgaaactcgactccactgtggtgg

SEQ ID NO: 456343 - DNA, 25 bp, Rattus norvegicus
actccactgtggtggtacgtgccgt

SEQ ID NO: 456344 - DNA, 25 bp, Rattus norvegicus
tgccgtctgcgtgctgtcattagag

SEQ ID NO: 456345 - DNA, 25 bp, Rattus norvegicus
tgtcattagagtggacgagccgctc

SEQ ID NO: 456346 - DNA, 25 bp, Rattus norvegicus
ggacgagccgctcagttttggtaac

SEQ ID NO: 456347 - DNA, 25 bp, Rattus norvegicus
gtaactgtgctgaccgctgagccat

SEQ ID NO: 456348 - DNA, 25 bp, Rattus norvegicus
ggtggtggtctctgtagtagccata

SEQ ID NO: 456349 - DNA, 25 bp, Rattus norvegicus
gtagccatattgcttccgctctcgc

SEQ ID NO: 456350 - DNA, 25 bp, Rattus norvegicus
tgtccctctggtctctctttctttg

SEQ ID NO: 456351 - DNA, 25 bp, Rattus norvegicus
agcccggatgagcttccgctcttca

SEQ ID NO: 456352 - DNA, 25 bp, Rattus norvegicus
gcttccgctcttcaaagttcgtagc

SEQ ID NO: 456353 - DNA, 25 bp, Rattus norvegicus
attctcgttccttgtccctctggtc

SEQ ID NO: 456354 - DNA, 25 bp, Rattus norvegicus
ggtggtcaggccactgcgctcctcg

SEQ ID NO: 456355 - DNA, 25 bp, Rattus norvegicus
gctctttggccttcaccagatgttg

SEQ ID NO: 456356 - DNA, 25 bp, Rattus norvegicus
ccagatgttgcttgcgctcctcctt

SEQ ID NO: 456357 - DNA, 25 bp, Rattus norvegicus
tcttcatctcgctcatggcgtcatc

SEQ ID NO: 456358 - DNA, 25 bp, Rattus norvegicus
ctcgctcatggcgtcatcatcggtg

SEQ ID NO: 456359 - DNA, 25 bp, Rattus norvegicus
tcatcatcggtggtcaggccactgc

SEQ ID NO: 456360 - DNA, 25 bp, Rattus norvegicus
atgttgcttgcgctcctccttgctc

SEQ ID NO: 456361 - DNA, 25 bp, Rattus norvegicus
tcctcgcggatcttcagcgcccgct

SEQ ID NO: 456362 - DNA, 25 bp, Rattus norvegicus
agccggtcacgtaccggcctcttgg

SEQ ID NO: 456363 - DNA, 25 bp, Rattus norvegicus
cacgtaccggcctcttggtgatgta

SEQ ID NO: 456364 - DNA, 25 bp, Rattus norvegicus
taccggcctcttggtgatgtagcgc

SEQ ID NO: 456365 - DNA, 25 bp, Rattus norvegicus
tcttggtgatgtagcgcgtcccatc

SEQ ID NO: 456366 - DNA, 25 bp, Rattus norvegicus
tgatgtagcgcgtcccatcactgcg

SEQ ID NO: 456367 - DNA, 25 bp, Rattus norvegicus
ctcatggcgtcatcatcggtggtca

SEQ ID NO: 456368 - DNA, 25 bp, Rattus norvegicus
tgcgcgcacttgatgtccaacttga

SEQ ID NO: 456369 - DNA, 25 bp, Rattus norvegicus
cagtgcggtcatctgcagttcgagc

SEQ ID NO: 456370 - DNA, 25 bp, Rattus norvegicus
gcctccttcttgagcgccttgtgca

SEQ ID NO: 456371 - DNA, 25 bp, Rattus norvegicus
aacttcttctggtagcgcagtgcgg

SEQ ID NO: 456372 - DNA, 25 bp, Rattus norvegicus
tgctcgggcaagtcctgcaacttga

SEQ ID NO: 456373 - DNA, 25 bp, Rattus norvegicus
cgctgtactcggtgaacttcttctg

SEQ ID NO: 456374 - DNA, 25 bp, Rattus norvegicus
tccaacttgaggatgagacgcttga

SEQ ID NO: 456375 - DNA, 25 bp, Rattus norvegicus
gggtcctccagtaccttgtggcaca

SEQ ID NO: 456376 - DNA, 25 bp, Rattus norvegicus
cacagggcgcacttcagatcagggt

SEQ ID NO: 456377 - DNA, 25 bp, Rattus norvegicus
agatcagggtccacttcaccgtcga

SEQ ID NO: 456378 - DNA, 25 bp, Rattus norvegicus
ctctagctagctctcccaggactga

SEQ ID NO: 456379 - DNA, 25 bp, Rattus norvegicus
ttgctcccgacttcctcggaaaatg

SEQ ID NO: 456380 - DNA, 25 bp, Rattus norvegicus
gaataggactcctccggccgtattg

SEQ ID NO: 456381 - DNA, 25 bp, Rattus norvegicus
gcggtccaactcgaaacccatggtg

SEQ ID NO: 456382 - DNA, 25 bp, Rattus norvegicus
tgttctgcaaggtttcgcgcagttc

SEQ ID NO: 456383 - DNA, 25 bp, Rattus norvegicus
cgcgctgttctgcaaggtttcgcgc

SEQ ID NO: 456384 - DNA, 25 bp, Rattus norvegicus
gtcccgcgcctcacgctgctcgcac

SEQ ID NO: 456385 - DNA, 25 bp, Rattus norvegicus
gctgttctgcaaggtttcgcgcagt

SEQ ID NO: 456386 - DNA, 25 bp, Rattus norvegicus
tcacgctgctcgcaccaccacccac

SEQ ID NO: 456387 - DNA, 25 bp, Rattus norvegicus
gttctgcaaggtttcgcgcagttcc

SEQ ID NO: 456388 - DNA, 25 bp, Rattus norvegicus
ttctgcaaggtttcgcgcagttccc

SEQ ID NO: 456389 - DNA, 25 bp, Rattus norvegicus
tgcaggcgccgaaggtgcgctgcct

SEQ ID NO: 456390 - DNA, 25 bp, Rattus norvegicus
cgcctgtgccgctcaggctgaggct

SEQ ID NO: 456391 - DNA, 25 bp, Rattus norvegicus
ctgtgccgctcaggctgaggctccg

SEQ ID NO: 456392 - DNA, 25 bp, Rattus norvegicus
gctcccgggcgagcactgaagggag

SEQ ID NO: 456393 - DNA, 25 bp, Rattus norvegicus
gcggagccaacagggtcccgcgcct

SEQ ID NO: 456394 - DNA, 25 bp, Rattus norvegicus
agccaacagggtcccgcgcctcacg

SEQ ID NO: 456395 - DNA, 25 bp, Rattus norvegicus
gcgctgttctgcaaggtttcgcgca

SEQ ID NO: 456396 - DNA, 25 bp, Rattus norvegicus
ctggcgccacttagtaaaaccgagc

SEQ ID NO: 456397 - DNA, 25 bp, Rattus norvegicus
gcgggacccgtagtgccgcttcatt

SEQ ID NO: 456398 - DNA, 25 bp, Rattus norvegicus
ccgcttcattcgctgcggctcttta

SEQ ID NO: 456399 - DNA, 25 bp, Rattus norvegicus
cggctctttagtgcgtgtagacgtc

SEQ ID NO: 456400 - DNA, 25 bp, Rattus norvegicus
tgtagacgtcactgtgccgcgaccc

SEQ ID NO: 456401 - DNA, 25 bp, Rattus norvegicus
cctcagaataggaacgccacgtttc

SEQ ID NO: 456402 - DNA, 25 bp, Rattus norvegicus
gccacgtttctaaggcacctttcga

SEQ ID NO: 456403 - DNA, 25 bp, Rattus norvegicus
cgctgtgcagcgtgcgtcctaacgc

SEQ ID NO: 456404 - DNA, 25 bp, Rattus norvegicus
tcctaacgcgcccttgggagatggc

SEQ ID NO: 456405 - DNA, 25 bp, Rattus norvegicus
cccaatctaggtgatgcccggtctc

SEQ ID NO: 456406 - DNA, 25 bp, Rattus norvegicus
aaccgagccctgtccggaggaagtg

SEQ ID NO: 456407 - DNA, 25 bp, Rattus norvegicus
gcggtcgtatctcagggccgtttcc

SEQ ID NO: 456408 - DNA, 25 bp, Rattus norvegicus
tctcttctttgaaccgtgggcggcg

SEQ ID NO: 456409 - DNA, 25 bp, Rattus norvegicus
gatgcccggtctctcttctttgaac

SEQ ID NO: 456410 - DNA, 25 bp, Rattus norvegicus
gagaggctcccactggccgctgagc

SEQ ID NO: 456411 - DNA, 25 bp, Rattus norvegicus
gccgctgagccagggtagctgtccc

SEQ ID NO: 456412 - DNA, 25 bp, Rattus norvegicus
gggtcttggtctccacccatgacta

SEQ ID NO: 456413 - DNA, 25 bp, Rattus norvegicus
ttggtctccacccatgactaggcgc

SEQ ID NO: 456414 - DNA, 25 bp, Rattus norvegicus
cccgaggttaccaggcagaagcggc

SEQ ID NO: 456415 - DNA, 25 bp, Rattus norvegicus
agaagcggcaggtggtttcccatgt

SEQ ID NO: 456416 - DNA, 25 bp, Rattus norvegicus
tttcccatgttgtgcgcagcgtcct

SEQ ID NO: 456417 - DNA, 25 bp, Rattus norvegicus
tgcgcagcgtcctggtgatctccct

SEQ ID NO: 456418 - DNA, 25 bp, Rattus norvegicus
tggtgatctccctcgccggccatgt

SEQ ID NO: 456419 - DNA, 25 bp, Rattus norvegicus
ggccatgtctgtttacccgcaaagg

SEQ ID NO: 456420 - DNA, 25 bp, Rattus norvegicus
gaggatctgcgcaacgctgccgcca

SEQ ID NO: 456421 - DNA, 25 bp, Rattus norvegicus
ctccaacgaggcgagccgagagcga

SEQ ID NO: 456422 - DNA, 25 bp, Rattus norvegicus
cgagccgagagcgacacagccgagc

SEQ ID NO: 456423 - DNA, 25 bp, Rattus norvegicus
aacatcccggacagcccaggagaca

SEQ ID NO: 456424 - DNA, 25 bp, Rattus norvegicus
aatcggcgcgcagcccatcagctga

SEQ ID NO: 456425 - DNA, 25 bp, Rattus norvegicus
tcgccttgcgtcttggtgctctgct

SEQ ID NO: 456426 - DNA, 25 bp, Rattus norvegicus
ctgcggctgtctcgccttgcgtctt

SEQ ID NO: 456427 - DNA, 25 bp, Rattus norvegicus
agcagctgttgctcctgcggctgtc

SEQ ID NO: 456428 - DNA, 25 bp, Rattus norvegicus
cccaagaacgcgatttagcccagcc

SEQ ID NO: 456429 - DNA, 25 bp, Rattus norvegicus
gccttccttgagacccgatcctttg

SEQ ID NO: 456430 - DNA, 25 bp, Rattus norvegicus
tagggcgccttccttgagacccgat

SEQ ID NO: 456431 - DNA, 25 bp, Rattus norvegicus
aggcagcggcatccttgccaccgca

SEQ ID NO: 456432 - DNA, 25 bp, Rattus norvegicus
gctgaccgcttttgcttacaccagg

SEQ ID NO: 456433 - DNA, 25 bp, Rattus norvegicus
cgctgagcagccaatcggcgcgcag

SEQ ID NO: 456434 - DNA, 25 bp, Rattus norvegicus
ggaggagaccgctgagcagccaatc

SEQ ID NO: 456435 - DNA, 25 bp, Rattus norvegicus
ttgcaacgatctggcaggcccaggg

SEQ ID NO: 456436 - DNA, 25 bp, Rattus norvegicus
ggctgtagtggcgttgcaacgatct

SEQ ID NO: 456437 - DNA, 25 bp, Rattus norvegicus
gcttacaccaggtgcacgccggctg

SEQ ID NO: 456438 - DNA, 25 bp, Rattus norvegicus
gccgtcacgcatacacgcacgtatt

SEQ ID NO: 456439 - DNA, 25 bp, Rattus norvegicus
cgagaccctgcatcccttgggaatg

SEQ ID NO: 456440 - DNA, 25 bp, Rattus norvegicus
gcgactgccagataagcaaccggga

SEQ ID NO: 456441 - DNA, 25 bp, Rattus norvegicus
cacattggcacctggctgttggaca

SEQ ID NO: 456442 - DNA, 25 bp, Rattus norvegicus
ctcgcagctgctgtaccacattggc

SEQ ID NO: 456443 - DNA, 25 bp, Rattus norvegicus
gggcatccactggtactcgcagctg

SEQ ID NO: 456444 - DNA, 25 bp, Rattus norvegicus
ctacgcagtcatcgaggagcacagc

SEQ ID NO: 456445 - DNA, 25 bp, Rattus norvegicus
ttctacgtgatcgagacgcgggagc

SEQ ID NO: 456446 - DNA, 25 bp, Rattus norvegicus
cgacgaaggtgccaagaaggtcttc

SEQ ID NO: 456447 - DNA, 25 bp, Rattus norvegicus
cggctgctgtacagcgacttcctca

SEQ ID NO: 456448 - DNA, 25 bp, Rattus norvegicus
cgggatcagccacagtgcacctgga

SEQ ID NO: 456449 - DNA, 25 bp, Rattus norvegicus
cctttggcactgaaccttgggtctc

SEQ ID NO: 456450 - DNA, 25 bp, Rattus norvegicus
actaggcgtacctgtctcctttggc

SEQ ID NO: 456451 - DNA, 25 bp, Rattus norvegicus
tggcagtcaagtccagctgaagtcc

SEQ ID NO: 456452 - DNA, 25 bp, Rattus norvegicus
gcgtggagaagtccgtgaagctacc

SEQ ID NO: 456453 - DNA, 25 bp, Rattus norvegicus
gggagaagccgttaccgatgcagta

SEQ ID NO: 456454 - DNA, 25 bp, Rattus norvegicus
gaagccgttaccgatgcagtagtgg

SEQ ID NO: 456455 - DNA, 25 bp, Rattus norvegicus
tggaagagcccgaaatagccggctt

SEQ ID NO: 456456 - DNA, 25 bp, Rattus norvegicus
aaatagccggcttgcggggtgtcca

SEQ ID NO: 456457 - DNA, 25 bp, Rattus norvegicus
acgccgtcgccgatccagtagggct

SEQ ID NO: 456458 - DNA, 25 bp, Rattus norvegicus
gctggatgaagcacaccacgttgac

SEQ ID NO: 456459 - DNA, 25 bp, Rattus norvegicus
acaccacgttgacgatggcaaagca

SEQ ID NO: 456460 - DNA, 25 bp, Rattus norvegicus
ggcagcctcctgagccgggagcatc

SEQ ID NO: 456461 - DNA, 25 bp, Rattus norvegicus
tctcggcgcgcaggagacacactcg

SEQ ID NO: 456462 - DNA, 25 bp, Rattus norvegicus
tcagcccagaagcaccagttctaga

SEQ ID NO: 456463 - DNA, 25 bp, Rattus norvegicus
agcaccagttctagagtctgcatcc

SEQ ID NO: 456464 - DNA, 25 bp, Rattus norvegicus
ctccggctcaccaggcacagcctcc

SEQ ID NO: 456465 - DNA, 25 bp, Rattus norvegicus
gagtctgcatcctcgctcccggaag

SEQ ID NO: 456466 - DNA, 25 bp, Rattus norvegicus
cagccgcaggaaccagcgagggaca

SEQ ID NO: 456467 - DNA, 25 bp, Rattus norvegicus
tgcaccttagtgagagcgagcgatc

SEQ ID NO: 456468 - DNA, 25 bp, Rattus norvegicus
accttagtgagagcgagcgatcgtg

SEQ ID NO: 456469 - DNA, 25 bp, Rattus norvegicus
tgggcattcgcctcccgggagtagc

SEQ ID NO: 456470 - DNA, 25 bp, Rattus norvegicus
gaaccagcgagggacaccgcacctt

SEQ ID NO: 456471 - DNA, 25 bp, Rattus norvegicus
caagaagacctgagccagccctgta

SEQ ID NO: 456472 - DNA, 25 bp, Rattus norvegicus
aagacctgagccagccctgtacagc

SEQ ID NO: 456473 - DNA, 25 bp, Rattus norvegicus
gcgcagccatgttgttctccagtca

SEQ ID NO: 456474 - DNA, 25 bp, Rattus norvegicus
gccatgttgttctccagtcatgtga

SEQ ID NO: 456475 - DNA, 25 bp, Rattus norvegicus
tgttctccagtcatgtgatccacgg

SEQ ID NO: 456476 - DNA, 25 bp, Rattus norvegicus
tccagtcatgtgatccacggcgtca

SEQ ID NO: 456477 - DNA, 25 bp, Rattus norvegicus
cagtcatgtgatccacggcgtcacg

SEQ ID NO: 456478 - DNA, 25 bp, Rattus norvegicus
cccaagaacggaaggtgcaccttag

SEQ ID NO: 456479 - DNA, 25 bp, Rattus norvegicus
ccagcaccagcagcaagaagacctg

SEQ ID NO: 456480 - DNA, 25 bp, Rattus norvegicus
tgacaaagtgcctccattaccggcg

SEQ ID NO: 456481 - DNA, 25 bp, Rattus norvegicus
aggaacgcagaacccgctctagccg

SEQ ID NO: 456482 - DNA, 25 bp, Rattus norvegicus
gcggaggaacgcagaacccgctcta

SEQ ID NO: 456483 - DNA, 25 bp, Rattus norvegicus
tcagcactctctcggcggcgcagga

SEQ ID NO: 456484 - DNA, 25 bp, Rattus norvegicus
tctggtttcagcactctctcggcgg

SEQ ID NO: 456485 - DNA, 25 bp, Rattus norvegicus
tgcgctctggtttcagcactctctc

SEQ ID NO: 456486 - DNA, 25 bp, Rattus norvegicus
aaagtgcctccattaccggcgcggc

SEQ ID NO: 456487 - DNA, 25 bp, Rattus norvegicus
gacgtctgaatgacaaagtgcctcc

SEQ ID NO: 456488 - DNA, 25 bp, Rattus norvegicus
cggctccggttacagacgtctgaat

SEQ ID NO: 456489 - DNA, 25 bp, Rattus norvegicus
gagcattagccagccgggcggctcc

SEQ ID NO: 456490 - DNA, 25 bp, Rattus norvegicus
ctattaggagcattagccagccggg

SEQ ID NO: 456491 - DNA, 25 bp, Rattus norvegicus
tacgctgctgcacccctattaggag

SEQ ID NO: 456492 - DNA, 25 bp, Rattus norvegicus
tgcccatttgctgcctacgctgctg

SEQ ID NO: 456493 - DNA, 25 bp, Rattus norvegicus
actcgccgggttgcgctctggtttc

SEQ ID NO: 456494 - DNA, 25 bp, Rattus norvegicus
cccggtatctttctgtgcttgacta

SEQ ID NO: 456495 - DNA, 25 bp, Rattus norvegicus
cagacgtgcttggagtcacagggta

SEQ ID NO: 456496 - DNA, 25 bp, Rattus norvegicus
ttgtccaacacgtgagactcatgtg

SEQ ID NO: 456497 - DNA, 25 bp, Rattus norvegicus
gcagccgccagagcgttgtccaaca

SEQ ID NO: 456498 - DNA, 25 bp, Rattus norvegicus
cacccagctgggcaggactctggct

SEQ ID NO: 456499 - DNA, 25 bp, Rattus norvegicus
cttcatttccctggggcaggttcgc

SEQ ID NO: 456500 - DNA, 25 bp, Rattus norvegicus
ccaggagacgggaacttacttcatt

SEQ ID NO: 456501 - DNA, 25 bp, Rattus norvegicus
ttcctctcccggcttgagtcagacg

SEQ ID NO: 456502 - DNA, 25 bp, Rattus norvegicus
tggagcgaccaaggggatattcctc

SEQ ID NO: 456503 - DNA, 25 bp, Rattus norvegicus
ttcctggacactgaggctgagcgtt

SEQ ID NO: 456504 - DNA, 25 bp, Rattus norvegicus
cccaaggcgggcaattcctggacac

SEQ ID NO: 456505 - DNA, 25 bp, Rattus norvegicus
agcccgcttcccatggggtgacatc

SEQ ID NO: 456506 - DNA, 25 bp, Rattus norvegicus
gtcacagggtagaacacgtagcttc

SEQ ID NO: 456507 - DNA, 25 bp, Rattus norvegicus
gctcacacggtccacggtcaggtgc

SEQ ID NO: 456508 - DNA, 25 bp, Rattus norvegicus
ggctgccgggatggtctcacccagc

SEQ ID NO: 456509 - DNA, 25 bp, Rattus norvegicus
caaagcttcgggatcgctcggtccc

SEQ ID NO: 456510 - DNA, 25 bp, Rattus norvegicus
ccgatccttggggaagcttggcaaa

SEQ ID NO: 456511 - DNA, 25 bp, Rattus norvegicus
cgcgtcagcagaaacccgatccttg

SEQ ID NO: 456512 - DNA, 25 bp, Rattus norvegicus
tggcaccgcgtcagcagaaacccga

SEQ ID NO: 456513 - DNA, 25 bp, Rattus norvegicus
tggaagcagacgtgcctggcaccgc

SEQ ID NO: 456514 - DNA, 25 bp, Rattus norvegicus
ctgccggttcctggaagcagacgtg

SEQ ID NO: 456515 - DNA, 25 bp, Rattus norvegicus
ccgcggctaaatgcggctgccggtt

SEQ ID NO: 456516 - DNA, 25 bp, Rattus norvegicus
tagagcctttcatgtgcggcccgcg

SEQ ID NO: 456517 - DNA, 25 bp, Rattus norvegicus
gtcacgtttccgactagagcctttc

SEQ ID NO: 456518 - DNA, 25 bp, Rattus norvegicus
gcctgttgacaaaacgtcacgtttc

SEQ ID NO: 456519 - DNA, 25 bp, Rattus norvegicus
gacctgccgcgcctgttgacaaaac

SEQ ID NO: 456520 - DNA, 25 bp, Rattus norvegicus
cgcagcgggacagaatccgaaggca

SEQ ID NO: 456521 - DNA, 25 bp, Rattus norvegicus
gatggtctcacccagcgctgacctg

SEQ ID NO: 456522 - DNA, 25 bp, Rattus norvegicus
gagtctatgggacctcgccgttctt

SEQ ID NO: 456523 - DNA, 25 bp, Rattus norvegicus
cggccgggaagcctctctgaaatct

SEQ ID NO: 456524 - DNA, 25 bp, Rattus norvegicus
agctcggccttttccagaacgcctg

SEQ ID NO: 456525 - DNA, 25 bp, Rattus norvegicus
tgtcacttgctcatccggacgggtg

SEQ ID NO: 456526 - DNA, 25 bp, Rattus norvegicus
agtctgtcacagttgccgcctttcg

SEQ ID NO: 456527 - DNA, 25 bp, Rattus norvegicus
gctgtgtctttaaggcggcctggaa

SEQ ID NO: 456528 - DNA, 25 bp, Rattus norvegicus
agcgccggagggtcaattccacatt

SEQ ID NO: 456529 - DNA, 25 bp, Rattus norvegicus
ttcgtcaatgtcatcgcggtgagca

SEQ ID NO: 456530 - DNA, 25 bp, Rattus norvegicus
tctggcaagaccactttcgtcaatg

SEQ ID NO: 456531 - DNA, 25 bp, Rattus norvegicus
ggttccgctcgctcttctggaagga

SEQ ID NO: 456532 - DNA, 25 bp, Rattus norvegicus
ccgatacccgctcgtgggaagcagt

SEQ ID NO: 456533 - DNA, 25 bp, Rattus norvegicus
ctatctgtgtctacccgagtcgcgc

SEQ ID NO: 456534 - DNA, 25 bp, Rattus norvegicus
cgaatcatatgacccgctgggcttc

SEQ ID NO: 456535 - DNA, 25 bp, Rattus norvegicus
tccacttgggacgaaggagccgcat

SEQ ID NO: 456536 - DNA, 25 bp, Rattus norvegicus
ggcatgttcgtcttcggctatgaca

SEQ ID NO: 456537 - DNA, 25 bp, Rattus norvegicus
atgacaactacatggcgcacgcctt

SEQ ID NO: 456538 - DNA, 25 bp, Rattus norvegicus
gcatgggcttctaccagcggtttcc

SEQ ID NO: 456539 - DNA, 25 bp, Rattus norvegicus
ccgcgctcttattggttggaagttc

SEQ ID NO: 456540 - DNA, 25 bp, Rattus norvegicus
caatggatcagttcctggtgcgtca

SEQ ID NO: 456541 - DNA, 25 bp, Rattus norvegicus
tgcgtcacgagggagttccttaaag

SEQ ID NO: 456542 - DNA, 25 bp, Rattus norvegicus
cgcgcccggcgcttcaaaataatgc

SEQ ID NO: 456543 - DNA, 25 bp, Rattus norvegicus
acgcctttccgcaggacgagctcaa

SEQ ID NO: 456544 - DNA, 25 bp, Rattus norvegicus
tccacgcagtgctctggttggtctt

SEQ ID NO: 456545 - DNA, 25 bp, Rattus norvegicus
tgacctcggagacccgtgagtagcc

SEQ ID NO: 456546 - DNA, 25 bp, Rattus norvegicus
cctccgagtctttgagaggacacca

SEQ ID NO: 456547 - DNA, 25 bp, Rattus norvegicus
gacaccagggtctttaggatccgcc

SEQ ID NO: 456548 - DNA, 25 bp, Rattus norvegicus
cgccgtagtccgaggttcctcttct

SEQ ID NO: 456549 - DNA, 25 bp, Rattus norvegicus
tttccgctcagtttcggcttccagc

SEQ ID NO: 456550 - DNA, 25 bp, Rattus norvegicus
ctccgacgtgcgttgcaccaacgga

SEQ ID NO: 456551 - DNA, 25 bp, Rattus norvegicus
ggcgcttatccagaaggacacctcc

SEQ ID NO: 456552 - DNA, 25 bp, Rattus norvegicus
gctcactttcgtccaggcgcttatc

SEQ ID NO: 456553 - DNA, 25 bp, Rattus norvegicus
tgcgctcgaacagtcgctcactttc

SEQ ID NO: 456554 - DNA, 25 bp, Rattus norvegicus
ttgttccagggacacttatgcgctc

SEQ ID NO: 456555 - DNA, 25 bp, Rattus norvegicus
gcgcggatcctggacacttgttcca

SEQ ID NO: 456556 - DNA, 25 bp, Rattus norvegicus
caatgtaacgttaggcgcgcggatc

SEQ ID NO: 456557 - DNA, 25 bp, Rattus norvegicus
ccacaggctggaagctatgctttat

SEQ ID NO: 456558 - DNA, 25 bp, Rattus norvegicus
gatcccaacctgctgcccaatgtaa

SEQ ID NO: 456559 - DNA, 25 bp, Rattus norvegicus
cctgcggcgacatcaagagggagaa

SEQ ID NO: 456560 - DNA, 25 bp, Rattus norvegicus
ttgttcccagtgcacgccaagggtc

SEQ ID NO: 456561 - DNA, 25 bp, Rattus norvegicus
ccgcgtcctgactttgatgaagttc

SEQ ID NO: 456562 - DNA, 25 bp, Rattus norvegicus
taccgcagcagcatccggagcggca

SEQ ID NO: 456563 - DNA, 25 bp, Rattus norvegicus
gctatgctttatgccctggaccaga

SEQ ID NO: 456564 - DNA, 25 bp, Rattus norvegicus
tcagcgatgctcaggtgcttcatga

SEQ ID NO: 456565 - DNA, 25 bp, Rattus norvegicus
ggccttggagataagcttgacacta

SEQ ID NO: 456566 - DNA, 25 bp, Rattus norvegicus
cccatagaagcggaaggtgatgtcc

SEQ ID NO: 456567 - DNA, 25 bp, Rattus norvegicus
acctccagggagcactaagtcttac

SEQ ID NO: 456568 - DNA, 25 bp, Rattus norvegicus
atgcccaccacctgcaagtatttga

SEQ ID NO: 456569 - DNA, 25 bp, Rattus norvegicus
ttcgcgcagcgagaaaatgtgcacc

SEQ ID NO: 456570 - DNA, 25 bp, Rattus norvegicus
gttggatgaagaccgcccagcaatc

SEQ ID NO: 456571 - DNA, 25 bp, Rattus norvegicus
atccatgtgacgtaggccttgggtc

SEQ ID NO: 456572 - DNA, 25 bp, Rattus norvegicus
acgcgttgccactcagagccaggaa

SEQ ID NO: 456573 - DNA, 25 bp, Rattus norvegicus
ccgctgccgtcttgagtctcagatt

SEQ ID NO: 456574 - DNA, 25 bp, Rattus norvegicus
acgctccacatctgcacgaagaaga

SEQ ID NO: 456575 - DNA, 25 bp, Rattus norvegicus
cttcaccgtgcggattttggccttg

SEQ ID NO: 456576 - DNA, 25 bp, Rattus norvegicus
gtccagcacacgatgaaggccagta

SEQ ID NO: 456577 - DNA, 25 bp, Rattus norvegicus
ccagcacgatgaccggtacaatgta

SEQ ID NO: 456578 - DNA, 25 bp, Rattus norvegicus
ctagcttgcggctttgctggtggct

SEQ ID NO: 456579 - DNA, 25 bp, Rattus norvegicus
tcagcacgcggtgctgtctgaaggt

SEQ ID NO: 456580 - DNA, 25 bp, Rattus norvegicus
cgctagagggcagagcaagtcgccc

SEQ ID NO: 456581 - DNA, 25 bp, Rattus norvegicus
cgtatgtccgctagagggcagagca

SEQ ID NO: 456582 - DNA, 25 bp, Rattus norvegicus
caccacgtatgtccgctagagggca

SEQ ID NO: 456583 - DNA, 25 bp, Rattus norvegicus
aggctgcagcaccacgtatgtccgc

SEQ ID NO: 456584 - DNA, 25 bp, Rattus norvegicus
ctgtctgaaggtgcgggtccacagc

SEQ ID NO: 456585 - DNA, 25 bp, Rattus norvegicus
ccggcgtcagcacgcggtgctgtct

SEQ ID NO: 456586 - DNA, 25 bp, Rattus norvegicus
ctggatgccgtaggaagacaagaga

SEQ ID NO: 456587 - DNA, 25 bp, Rattus norvegicus
ggcgtctttgaaatcccctagcttg

SEQ ID NO: 456588 - DNA, 25 bp, Rattus norvegicus
tagatctcggcgtctttgaaatccc

SEQ ID NO: 456589 - DNA, 25 bp, Rattus norvegicus
ctaccacggggtagatctcggcgtc

SEQ ID NO: 456590 - DNA, 25 bp, Rattus norvegicus
cctccgtgctaccacggggtagatc

SEQ ID NO: 456591 - DNA, 25 bp, Rattus norvegicus
tctccgcccaggatgggagagctgc

SEQ ID NO: 456592 - DNA, 25 bp, Rattus norvegicus
ttgacactgcgttacagtgacttta

SEQ ID NO: 456593 - DNA, 25 bp, Rattus norvegicus
tcactgcgcaggaccgcggcgcgtt

SEQ ID NO: 456594 - DNA, 25 bp, Rattus norvegicus
ttagggcggccaccttgggctcact

SEQ ID NO: 456595 - DNA, 25 bp, Rattus norvegicus
cgctgattgtgacagaaacccaaaa

SEQ ID NO: 456596 - DNA, 25 bp, Rattus norvegicus
ccaggtcctccatggtcgcacttga

SEQ ID NO: 456597 - DNA, 25 bp, Rattus norvegicus
cggcgacgcgctgattgtgacagaa

SEQ ID NO: 456598 - DNA, 25 bp, Rattus norvegicus
acagtgactttatcccggcgacgcg

SEQ ID NO: 456599 - DNA, 25 bp, Rattus norvegicus
gtcgcacttgacgagaccaccagct

SEQ ID NO: 456600 - DNA, 25 bp, Rattus norvegicus
acttgacgagaccaccagctaccgg

SEQ ID NO: 456601 - DNA, 25 bp, Rattus norvegicus
tgccacgcagttcctctactcgaaa

SEQ ID NO: 456602 - DNA, 25 bp, Rattus norvegicus
ccgcgctacagcgtacgtcagatac

SEQ ID NO: 456603 - DNA, 25 bp, Rattus norvegicus
acgtcagatacgtgcggcgcgctca

SEQ ID NO: 456604 - DNA, 25 bp, Rattus norvegicus
tcacagagagcgcacagaatgctgg

SEQ ID NO: 456605 - DNA, 25 bp, Rattus norvegicus
agcgcacagaatgctgggagctgta

SEQ ID NO: 456606 - DNA, 25 bp, Rattus norvegicus
gccgctcttcctgttccggttcaga

SEQ ID NO: 456607 - DNA, 25 bp, Rattus norvegicus
gtgaccggaagggtctgtgcttgca

SEQ ID NO: 456608 - DNA, 25 bp, Rattus norvegicus
cctgagcgcgctgaacccgcaggtg

SEQ ID NO: 456609 - DNA, 25 bp, Rattus norvegicus
acaacgtggcttccggcggcgtgcc

SEQ ID NO: 456610 - DNA, 25 bp, Rattus norvegicus
gccgtgcgcgggagcaccctgaccc

SEQ ID NO: 456611 - DNA, 25 bp, Rattus norvegicus
tacgcgcacactcgcccacgccgtg

SEQ ID NO: 456612 - DNA, 25 bp, Rattus norvegicus
aactgcgcacaactttacgcgcaca

SEQ ID NO: 456613 - DNA, 25 bp, Rattus norvegicus
gtgcaaccaactgcgcacaacttta

SEQ ID NO: 456614 - DNA, 25 bp, Rattus norvegicus
ggttcagagtgcaaccaactgcgca

SEQ ID NO: 456615 - DNA, 25 bp, Rattus norvegicus
tctgtgcttgcagcgggtaactggc

SEQ ID NO: 456616 - DNA, 25 bp, Rattus norvegicus
ttcctgttccggttcagagtgcaac

SEQ ID NO: 456617 - DNA, 25 bp, Rattus norvegicus
tccgcagaggttacctccgggcagg

SEQ ID NO: 456618 - DNA, 25 bp, Rattus norvegicus
tccggttcagagtgcaaccaactgc

SEQ ID NO: 456619 - DNA, 25 bp, Rattus norvegicus
tacgagagcgccctccgcagaggtt

SEQ ID NO: 456620 - DNA, 25 bp, Rattus norvegicus
aaagcgcaggctggaacctgtagtc

SEQ ID NO: 456621 - DNA, 25 bp, Rattus norvegicus
tctacgagaactacgctgaatgagc

SEQ ID NO: 456622 - DNA, 25 bp, Rattus norvegicus
gcttgcagttggtctacgagaacta

SEQ ID NO: 456623 - DNA, 25 bp, Rattus norvegicus
ggcaggaacgcttgcagttggtcta

SEQ ID NO: 456624 - DNA, 25 bp, Rattus norvegicus
ccctagtccaggctacgggcaggaa

SEQ ID NO: 456625 - DNA, 25 bp, Rattus norvegicus
ggacgtcattcgacggcgccggctc

SEQ ID NO: 456626 - DNA, 25 bp, Rattus norvegicus
ttgtcgcgctgctcggacgtcattc

SEQ ID NO: 456627 - DNA, 25 bp, Rattus norvegicus
ctagagcggcccacgttgtcgcgct

SEQ ID NO: 456628 - DNA, 25 bp, Rattus norvegicus
aacactggggagactagagcggccc

SEQ ID NO: 456629 - DNA, 25 bp, Rattus norvegicus
ctgagaaccaacactggggagacta

SEQ ID NO: 456630 - DNA, 25 bp, Rattus norvegicus
gggcgccgaccactgagaaccaaca

SEQ ID NO: 456631 - DNA, 25 bp, Rattus norvegicus
gtcttaactagacaccgggcgccga

SEQ ID NO: 456632 - DNA, 25 bp, Rattus norvegicus
tacgctgaatgagcggcgccggtct

SEQ ID NO: 456633 - DNA, 25 bp, Rattus norvegicus
aggctggaacctgtagtcttaacta

SEQ ID NO: 456634 - DNA, 25 bp, Rattus norvegicus
atcaccgccttgagagtcctagcgc

SEQ ID NO: 456635 - DNA, 25 bp, Rattus norvegicus
ccgcttaacttagaaggggtgcagt

SEQ ID NO: 456636 - DNA, 25 bp, Rattus norvegicus
agagtcctagcgctcgcatcccaag

SEQ ID NO: 456637 - DNA, 25 bp, Rattus norvegicus
tggccgcttaacttagaaggggtgc

SEQ ID NO: 456638 - DNA, 25 bp, Rattus norvegicus
agtcctagcgctcgcatcccaagag

SEQ ID NO: 456639 - DNA, 25 bp, Rattus norvegicus
cttaacttagaaggggtgcagtgcg

SEQ ID NO: 456640 - DNA, 25 bp, Rattus norvegicus
gccctaggcgcacacgcagctccca

SEQ ID NO: 456641 - DNA, 25 bp, Rattus norvegicus
acgcagctcccatagcaatccctca

SEQ ID NO: 456642 - DNA, 25 bp, Rattus norvegicus
ctggggtttttgcatccccgagcta

SEQ ID NO: 456643 - DNA, 25 bp, Rattus norvegicus
gagctatgcgctgccggaaccatca

SEQ ID NO: 456644 - DNA, 25 bp, Rattus norvegicus
tgccggaaccatcaccgccttgaga

SEQ ID NO: 456645 - DNA, 25 bp, Rattus norvegicus
accatcaccgccttgagagtcctag

SEQ ID NO: 456646 - DNA, 25 bp, Rattus norvegicus
ccttgagagtcctagcgctcgcatc

SEQ ID NO: 456647 - DNA, 25 bp, Rattus norvegicus
ccgagctatgcgctgccggaaccat

SEQ ID NO: 456648 - DNA, 25 bp, Rattus norvegicus
atgagacatcgaccggaagcgcttc

SEQ ID NO: 456649 - DNA, 25 bp, Rattus norvegicus
ccacccagtgggcacagcgaggcag

SEQ ID NO: 456650 - DNA, 25 bp, Rattus norvegicus
tgcgcactccggcagccgttaattg

SEQ ID NO: 456651 - DNA, 25 bp, Rattus norvegicus
ccgttaattgacaggcgcctcactc

SEQ ID NO: 456652 - DNA, 25 bp, Rattus norvegicus
atttgtgttttcacacgcggcggga

SEQ ID NO: 456653 - DNA, 25 bp, Rattus norvegicus
agcagccaatcagcgatgagacatc

SEQ ID NO: 456654 - DNA, 25 bp, Rattus norvegicus
gtggagacttttccgctcccttctc

SEQ ID NO: 456655 - DNA, 25 bp, Rattus norvegicus
ttaacgaatcgaacccagctgtccc

SEQ ID NO: 456656 - DNA, 25 bp, Rattus norvegicus
acaaagcggctccaccgtccttgga

SEQ ID NO: 456657 - DNA, 25 bp, Rattus norvegicus
agagcacagcctcttctttaggcgg

SEQ ID NO: 456658 - DNA, 25 bp, Rattus norvegicus
ccgtgcggtcagtggcgtttccgct

SEQ ID NO: 456659 - DNA, 25 bp, Rattus norvegicus
gctcagagactcacgcagccctagt

SEQ ID NO: 456660 - DNA, 25 bp, Rattus norvegicus
ccaatcagatgacgaggccaggccg

SEQ ID NO: 456661 - DNA, 25 bp, Rattus norvegicus
gggcggccggattcctgactaccac

SEQ ID NO: 456662 - DNA, 25 bp, Rattus norvegicus
cggcccaggactgaccaccgggatg

SEQ ID NO: 456663 - DNA, 25 bp, Rattus norvegicus
tgaagtcggtgaaagaaccccggca

SEQ ID NO: 456664 - DNA, 25 bp, Rattus norvegicus
cccaggactgaccaccgggatgcgg

SEQ ID NO: 456665 - DNA, 25 bp, Rattus norvegicus
tcctgcgagggcagcatggtgcccg

SEQ ID NO: 456666 - DNA, 25 bp, Rattus norvegicus
atggtagagcttggaggcctcctgc

SEQ ID NO: 456667 - DNA, 25 bp, Rattus norvegicus
ctcatggtagagcttggaggcctcc

SEQ ID NO: 456668 - DNA, 25 bp, Rattus norvegicus
ccgcatgtagtgctcatggtagagc

SEQ ID NO: 456669 - DNA, 25 bp, Rattus norvegicus
ccgcgagttccgcatgtagtgctca

SEQ ID NO: 456670 - DNA, 25 bp, Rattus norvegicus
ggatgaagaccaccacgttgatgat

SEQ ID NO: 456671 - DNA, 25 bp, Rattus norvegicus
gctggatgaagaccaccacgttgat

SEQ ID NO: 456672 - DNA, 25 bp, Rattus norvegicus
ccaggcttgggagtgctcacgctgt

SEQ ID NO: 456673 - DNA, 25 bp, Rattus norvegicus
gaagaggccgaagtagccaggcttg

SEQ ID NO: 456674 - DNA, 25 bp, Rattus norvegicus
cccacgcagtagtggaagaggccga

SEQ ID NO: 456675 - DNA, 25 bp, Rattus norvegicus
ccgctgcccacgcagtagtggaaga

SEQ ID NO: 456676 - DNA, 25 bp, Rattus norvegicus
cggctgatccgggaccggcagggct

SEQ ID NO: 456677 - DNA, 25 bp, Rattus norvegicus
aggccagcgggcagtctgggcctgg

SEQ ID NO: 456678 - DNA, 25 bp, Rattus norvegicus
tctgcgcggcctccatcttgctccg

SEQ ID NO: 456679 - DNA, 25 bp, Rattus norvegicus
atgcgggaagaccaacctgggccga

SEQ ID NO: 456680 - DNA, 25 bp, Rattus norvegicus
ctccatcttgctccggctctcccgg

SEQ ID NO: 456681 - DNA, 25 bp, Rattus norvegicus
cagggctcaagctccggggctcgat

SEQ ID NO: 456682 - DNA, 25 bp, Rattus norvegicus
aagctccggggctcgatgctcctga

SEQ ID NO: 456683 - DNA, 25 bp, Rattus norvegicus
tccggggctcgatgctcctgacagc

SEQ ID NO: 456684 - DNA, 25 bp, Rattus norvegicus
gctcgatgctcctgacagcggttgc

SEQ ID NO: 456685 - DNA, 25 bp, Rattus norvegicus
cgatgctcctgacagcggttgccgt

SEQ ID NO: 456686 - DNA, 25 bp, Rattus norvegicus
ctcctgacagcggttgccgtggctc

SEQ ID NO: 456687 - DNA, 25 bp, Rattus norvegicus
cctgacagcggttgccgtggctcag

SEQ ID NO: 456688 - DNA, 25 bp, Rattus norvegicus
ctcaggcggcgtcctctgcgcggcc

SEQ ID NO: 456689 - DNA, 25 bp, Rattus norvegicus
cggccgcggagaagggatgcgggaa

SEQ ID NO: 456690 - DNA, 25 bp, Rattus norvegicus
tcgctccaatggttcctgccgttcc

SEQ ID NO: 456691 - DNA, 25 bp, Rattus norvegicus
cagccgtagtggtttagcccggctt

SEQ ID NO: 456692 - DNA, 25 bp, Rattus norvegicus
ccgccgtgaggccatttggatccct

SEQ ID NO: 456693 - DNA, 25 bp, Rattus norvegicus
gaggccatttggatccctccgcgtc

SEQ ID NO: 456694 - DNA, 25 bp, Rattus norvegicus
cgggcacgaactccagtctctgatt

SEQ ID NO: 456695 - DNA, 25 bp, Rattus norvegicus
actccagtctctgattggccgcggc

SEQ ID NO: 456696 - DNA, 25 bp, Rattus norvegicus
gccgcggcaggagtaaacatccgga

SEQ ID NO: 456697 - DNA, 25 bp, Rattus norvegicus
ttcaggaggttttagagcccgagtc

SEQ ID NO: 456698 - DNA, 25 bp, Rattus norvegicus
cccgagtccgagcttcaggtgccat

SEQ ID NO: 456699 - DNA, 25 bp, Rattus norvegicus
gcgggttccactgcctcttcaggca

SEQ ID NO: 456700 - DNA, 25 bp, Rattus norvegicus
cctcccgcagccgtagtggtttagc

SEQ ID NO: 456701 - DNA, 25 bp, Rattus norvegicus
tcagtaccgtgccaaggacagcggc

SEQ ID NO: 456702 - DNA, 25 bp, Rattus norvegicus
tcccggactcagtaccgtgccaagg

SEQ ID NO: 456703 - DNA, 25 bp, Rattus norvegicus
tggaggagttctcccggactcagta

SEQ ID NO: 456704 - DNA, 25 bp, Rattus norvegicus
tgtgctgccatctggagccgctgct

SEQ ID NO: 456705 - DNA, 25 bp, Rattus norvegicus
gtcccggccaccaagattgaaatta

SEQ ID NO: 456706 - DNA, 25 bp, Rattus norvegicus
tagcgtcccggccaccaagattgaa

SEQ ID NO: 456707 - DNA, 25 bp, Rattus norvegicus
agcttcagagcgtagcgtcccggcc

SEQ ID NO: 456708 - DNA, 25 bp, Rattus norvegicus
tctctcggcggagcttcagagcgta

SEQ ID NO: 456709 - DNA, 25 bp, Rattus norvegicus
agccatgtctctcggcggagcttca

SEQ ID NO: 456710 - DNA, 25 bp, Rattus norvegicus
ggccattggaccagccatgtctctc

SEQ ID NO: 456711 - DNA, 25 bp, Rattus norvegicus
ctacacggctttggccattggacca

SEQ ID NO: 456712 - DNA, 25 bp, Rattus norvegicus
tagcttcggcacccggggtctcgca

SEQ ID NO: 456713 - DNA, 25 bp, Rattus norvegicus
cggagcgcacacaaggctggagaga

SEQ ID NO: 456714 - DNA, 25 bp, Rattus norvegicus
ttgaaattactgtgtcgtgccggtg

SEQ ID NO: 456715 - DNA, 25 bp, Rattus norvegicus
aaattactgtgtcgtgccggtgagc

SEQ ID NO: 456716 - DNA, 25 bp, Rattus norvegicus
gctgcctccgcacatgggccactgc

SEQ ID NO: 456717 - DNA, 25 bp, Rattus norvegicus
ccggccaccaagattgaaattactg

SEQ ID NO: 456718 - DNA, 25 bp, Rattus norvegicus
gggttcccaggccagaagatccaaa

SEQ ID NO: 456719 - DNA, 25 bp, Rattus norvegicus
cggctctcccatactgcgatttcgg

SEQ ID NO: 456720 - DNA, 25 bp, Rattus norvegicus
gggagaattgacaggccattggttc

SEQ ID NO: 456721 - DNA, 25 bp, Rattus norvegicus
taggctcctcttgagctccttgggc

SEQ ID NO: 456722 - DNA, 25 bp, Rattus norvegicus
aagatccaaaagctcgggaaacgcg

SEQ ID NO: 456723 - DNA, 25 bp, Rattus norvegicus
gcagcgccacgggaccaaatttacc

SEQ ID NO: 456724 - DNA, 25 bp, Rattus norvegicus
aaccgtggcgaaagtgcgtctatgc

SEQ ID NO: 456725 - DNA, 25 bp, Rattus norvegicus
aagctcctcaatagaccggcgggga

SEQ ID NO: 456726 - DNA, 25 bp, Rattus norvegicus
aagagatcttttccagacccacagg

SEQ ID NO: 456727 - DNA, 25 bp, Rattus norvegicus
cgttagaacatggaagcgcccgctg

SEQ ID NO: 456728 - DNA, 25 bp, Rattus norvegicus
tcggtctccagaaactcccgttaga

SEQ ID NO: 456729 - DNA, 25 bp, Rattus norvegicus
tagtcgcagattcgccacaaacggc

SEQ ID NO: 456730 - DNA, 25 bp, Rattus norvegicus
cgctgtgccctgtgaggtatcaaga

SEQ ID NO: 456731 - DNA, 25 bp, Rattus norvegicus
caccttcgcgtctcggagttcgggt

SEQ ID NO: 456732 - DNA, 25 bp, Rattus norvegicus
gaggccagcagtctaaccgctccgg

SEQ ID NO: 456733 - DNA, 25 bp, Rattus norvegicus
agtaagctgggacccggaagagcca

SEQ ID NO: 456734 - DNA, 25 bp, Rattus norvegicus
caaacctcgacagccgcgcaggagg

SEQ ID NO: 456735 - DNA, 25 bp, Rattus norvegicus
caatcgccaagcagcgaggccagca

SEQ ID NO: 456736 - DNA, 25 bp, Rattus norvegicus
ggacccggaagagccacactggcgc

SEQ ID NO: 456737 - DNA, 25 bp, Rattus norvegicus
ccactctgccactccggagttctca

SEQ ID NO: 456738 - DNA, 25 bp, Rattus norvegicus
cttccggtgagagtaagctgggacc

SEQ ID NO: 456739 - DNA, 25 bp, Rattus norvegicus
ctaggatttacttccggtgagagta

SEQ ID NO: 456740 - DNA, 25 bp, Rattus norvegicus
taagcgggagctaggatttacttcc

SEQ ID NO: 456741 - DNA, 25 bp, Rattus norvegicus
ttctaggatcaaataagcgggagct

SEQ ID NO: 456742 - DNA, 25 bp, Rattus norvegicus
ctcggattggctacttctaggatca

SEQ ID NO: 456743 - DNA, 25 bp, Rattus norvegicus
gcctctcactttcttctcggattgg

SEQ ID NO: 456744 - DNA, 25 bp, Rattus norvegicus
ggagttctcattggtgcctctcact

SEQ ID NO: 456745 - DNA, 25 bp, Rattus norvegicus
actggcgcgcctttccaaacctcga

SEQ ID NO: 456746 - DNA, 25 bp, Rattus norvegicus
cagagatctgaacatccttcggctc

SEQ ID NO: 456747 - DNA, 25 bp, Rattus norvegicus
caactgctccggaactggctatggg

SEQ ID NO: 456748 - DNA, 25 bp, Rattus norvegicus
ctaaggccacctacgaatctccggg

SEQ ID NO: 456749 - DNA, 25 bp, Rattus norvegicus
cggggctctgagctcaaatctcaag

SEQ ID NO: 456750 - DNA, 25 bp, Rattus norvegicus
atctcaagggactggctacccggcc

SEQ ID NO: 456751 - DNA, 25 bp, Rattus norvegicus
cggccgaaccctagggttgctaatg

SEQ ID NO: 456752 - DNA, 25 bp, Rattus norvegicus
ggttcggcctgtcctaatttggtgc

SEQ ID NO: 456753 - DNA, 25 bp, Rattus norvegicus
tcgggccatactattgtcacacggg

SEQ ID NO: 456754 - DNA, 25 bp, Rattus norvegicus
ggaggctacaaccaaagcgccaagc

SEQ ID NO: 456755 - DNA, 25 bp, Rattus norvegicus
aggggcctcgactgctgttatgtca

SEQ ID NO: 456756 - DNA, 25 bp, Rattus norvegicus
tgcagatcttctacaagtcccagcg

SEQ ID NO: 456757 - DNA, 25 bp, Rattus norvegicus
ctccgggaagtggaatgctaggcct

SEQ ID NO: 456758 - DNA, 25 bp, Rattus norvegicus
gcggtcccagcgtgaaatcgcctca

SEQ ID NO: 456759 - DNA, 25 bp, Rattus norvegicus
cccaacctgaggtcgggccatacta

SEQ ID NO: 456760 - DNA, 25 bp, Rattus norvegicus
tccggccttctgagagactgcaatg

SEQ ID NO: 456761 - DNA, 25 bp, Rattus norvegicus
gaccctggatgagcccttgcctgat

SEQ ID NO: 456762 - DNA, 25 bp, Rattus norvegicus
ctgtccctgggcacgcaactcggag

SEQ ID NO: 456763 - DNA, 25 bp, Rattus norvegicus
agcgaacctggcaagaggcgcatgc

SEQ ID NO: 456764 - DNA, 25 bp, Rattus norvegicus
cctatcggctgcagacagaggccgc

SEQ ID NO: 456765 - DNA, 25 bp, Rattus norvegicus
ggtgaggcgcagaacggcccaccac

SEQ ID NO: 456766 - DNA, 25 bp, Rattus norvegicus
agagactgcaatggctaggtcccgc

SEQ ID NO: 456767 - DNA, 25 bp, Rattus norvegicus
gcaactcggagttccggccttctga

SEQ ID NO: 456768 - DNA, 25 bp, Rattus norvegicus
aaatttctcgtcccgctgtccctgg

SEQ ID NO: 456769 - DNA, 25 bp, Rattus norvegicus
tgtagctggctccagaggtcacagc

SEQ ID NO: 456770 - DNA, 25 bp, Rattus norvegicus
cctggtaccgccaggagggcagctc

SEQ ID NO: 456771 - DNA, 25 bp, Rattus norvegicus
cgcttctcctgagcgcggagcagct

SEQ ID NO: 456772 - DNA, 25 bp, Rattus norvegicus
caagaggcgcatgcagggcctcagc

SEQ ID NO: 456773 - DNA, 25 bp, Rattus norvegicus
ctgacaccctatcggctgcagacag

SEQ ID NO: 456774 - DNA, 25 bp, Rattus norvegicus
gttcttcacgatggcgtctcgggca

SEQ ID NO: 456775 - DNA, 25 bp, Rattus norvegicus
tccgaaagaccaagaacgcatgcgc

SEQ ID NO: 456776 - DNA, 25 bp, Rattus norvegicus
ccgggaacgagtcgccatgcactac

SEQ ID NO: 456777 - DNA, 25 bp, Rattus norvegicus
cagcgactttcagcaccgggaacga

SEQ ID NO: 456778 - DNA, 25 bp, Rattus norvegicus
tagggccttaggttcttcacgatgg

SEQ ID NO: 456779 - DNA, 25 bp, Rattus norvegicus
gcgcgaagaaaccacagagtcagtc

SEQ ID NO: 456780 - DNA, 25 bp, Rattus norvegicus
tgcactcgctctactctgggagatg

SEQ ID NO: 456781 - DNA, 25 bp, Rattus norvegicus
gggactaagttaattctgcactcgc

SEQ ID NO: 456782 - DNA, 25 bp, Rattus norvegicus
ccgcgagatatttctagggactaag

SEQ ID NO: 456783 - DNA, 25 bp, Rattus norvegicus
gcatctcgggtagacccgcgagata

SEQ ID NO: 456784 - DNA, 25 bp, Rattus norvegicus
gttcgattccgcacgatggcatctc

SEQ ID NO: 456785 - DNA, 25 bp, Rattus norvegicus
tgagacagccgtaccgaggcctttc

SEQ ID NO: 456786 - DNA, 25 bp, Rattus norvegicus
cattagcggcaaggggttcgattcc

SEQ ID NO: 456787 - DNA, 25 bp, Rattus norvegicus
agagtcagtcctccagggctagaga

SEQ ID NO: 456788 - DNA, 25 bp, Rattus norvegicus
tgctgcgctgagctgaactgcgctg

SEQ ID NO: 456789 - DNA, 25 bp, Rattus norvegicus
ttatgccgagcatcagtcccggatg

SEQ ID NO: 456790 - DNA, 25 bp, Rattus norvegicus
gcaccgctggttatgccgagcatca

SEQ ID NO: 456791 - DNA, 25 bp, Rattus norvegicus
agtgcaccgctggttatgccgagca

SEQ ID NO: 456792 - DNA, 25 bp, Rattus norvegicus
cacatacccagtgcaccgctggtta

SEQ ID NO: 456793 - DNA, 25 bp, Rattus norvegicus
tgggctgtcccacatacccagtgca

SEQ ID NO: 456794 - DNA, 25 bp, Rattus norvegicus
cggcttctctgtgggctgtcccaca

SEQ ID NO: 456795 - DNA, 25 bp, Rattus norvegicus
cagcacctgccctcctcattgcacg

SEQ ID NO: 456796 - DNA, 25 bp, Rattus norvegicus
ctgagctgaactgcgctgcgctcca

SEQ ID NO: 456797 - DNA, 25 bp, Rattus norvegicus
gtcagcgctccgcttctagctcagt

SEQ ID NO: 456798 - DNA, 25 bp, Rattus norvegicus
ccgagcatcagtcccggatgctgcg

SEQ ID NO: 456799 - DNA, 25 bp, Rattus norvegicus
ccgcagaccgatggtgctgcgctga

SEQ ID NO: 456800 - DNA, 25 bp, Rattus norvegicus
tccggagcagccaagtgaggcgtgc

SEQ ID NO: 456801 - DNA, 25 bp, Rattus norvegicus
tcattgcacgcctccggcgtcagcg

SEQ ID NO: 456802 - DNA, 25 bp, Rattus norvegicus
cgggacaggaataccatggtaggta

SEQ ID NO: 456803 - DNA, 25 bp, Rattus norvegicus
tacgtaccgggacaggaataccatg

SEQ ID NO: 456804 - DNA, 25 bp, Rattus norvegicus
atttccctgcacattgcgggcaacc

SEQ ID NO: 456805 - DNA, 25 bp, Rattus norvegicus
agcagggcgaggtgctcatttccct

SEQ ID NO: 456806 - DNA, 25 bp, Rattus norvegicus
gtgcacccaccacggggagctggaa

SEQ ID NO: 456807 - DNA, 25 bp, Rattus norvegicus
ttttcctgtgcacccaccacgggga

SEQ ID NO: 456808 - DNA, 25 bp, Rattus norvegicus
cgccacgggctactacccgcgcttc

SEQ ID NO: 456809 - DNA, 25 bp, Rattus norvegicus
gcggactctcgtcctggccgtgctg

SEQ ID NO: 456810 - DNA, 25 bp, Rattus norvegicus
ccggtgcctccgaaagtggatgaga

SEQ ID NO: 456811 - DNA, 25 bp, Rattus norvegicus
ctccgtgccggtgcctccgaaagtg

SEQ ID NO: 456812 - DNA, 25 bp, Rattus norvegicus
ggagcctcggtctcccgccaacttc

SEQ ID NO: 456813 - DNA, 25 bp, Rattus norvegicus
tcgcagaacgggcagctgtgagccc

SEQ ID NO: 456814 - DNA, 25 bp, Rattus norvegicus
cgcagacaaagaacggcgcggtccc

SEQ ID NO: 456815 - DNA, 25 bp, Rattus norvegicus
gaggtgctcatttccctgcacattg

SEQ ID NO: 456816 - DNA, 25 bp, Rattus norvegicus
tcgtgatctgccacgcctactgaga

SEQ ID NO: 456817 - DNA, 25 bp, Rattus norvegicus
tcgaacaaggccagttttactccta

SEQ ID NO: 456818 - DNA, 25 bp, Rattus norvegicus
ttttactcctacacgcagcggactc

SEQ ID NO: 456819 - DNA, 25 bp, Rattus norvegicus
cagcggactcagaggcacagcgacg

SEQ ID NO: 456820 - DNA, 25 bp, Rattus norvegicus
cacagcgacgcctggtgggagcttt

SEQ ID NO: 456821 - DNA, 25 bp, Rattus norvegicus
agctttggccgaactgctgcggacc

SEQ ID NO: 456822 - DNA, 25 bp, Rattus norvegicus
gacgcgacgtgatcgtggatctctg

SEQ ID NO: 456823 - DNA, 25 bp, Rattus norvegicus
acgcacgtggctcgcattggaccac

SEQ ID NO: 456824 - DNA, 25 bp, Rattus norvegicus
ttggaccactgccatggctctgggc

SEQ ID NO: 456825 - DNA, 25 bp, Rattus norvegicus
ggagcagggcactgtgttgctcctt

SEQ ID NO: 456826 - DNA, 25 bp, Rattus norvegicus
ttcagtcgcctctgtgccaaaggtg

SEQ ID NO: 456827 - DNA, 25 bp, Rattus norvegicus
gcgctaccgcctgcttcgtgatctg

SEQ ID NO: 456828 - DNA, 25 bp, Rattus norvegicus
cgcctactgagagcgctggatgctc

SEQ ID NO: 456829 - DNA, 25 bp, Rattus norvegicus
ccaaaggtgacattcccgggccgct

SEQ ID NO: 456830 - DNA, 25 bp, Rattus norvegicus
gggaccctgccctgcactcgaataa

SEQ ID NO: 456831 - DNA, 25 bp, Rattus norvegicus
tggcgtggtcatacttctcttctca

SEQ ID NO: 456832 - DNA, 25 bp, Rattus norvegicus
gttgagccagatgccactgcgcgtt

SEQ ID NO: 456833 - DNA, 25 bp, Rattus norvegicus
ccactcggccgatggagcatactac

SEQ ID NO: 456834 - DNA, 25 bp, Rattus norvegicus
cgctacgtcggggtctactttgacg

SEQ ID NO: 456835 - DNA, 25 bp, Rattus norvegicus
tactttgacgggctgctgcacccag

SEQ ID NO: 456836 - DNA, 25 bp, Rattus norvegicus
tgcgtgctgcccgatttcctgcaag

SEQ ID NO: 456837 - DNA, 25 bp, Rattus norvegicus
tccgccctagacagctgtacttaga

SEQ ID NO: 456838 - DNA, 25 bp, Rattus norvegicus
ccgatgcagtattcctaacagagta

SEQ ID NO: 456839 - DNA, 25 bp, Rattus norvegicus
gtagccctcgtatatctgtttgatg

SEQ ID NO: 456840 - DNA, 25 bp, Rattus norvegicus
tgctccgctggcagagcctttaatc

SEQ ID NO: 456841 - DNA, 25 bp, Rattus norvegicus
gccgcttttggttggttagtgttga

SEQ ID NO: 456842 - DNA, 25 bp, Rattus norvegicus
catggctttccatcattggctggga

SEQ ID NO: 456843 - DNA, 25 bp, Rattus norvegicus
atgcactgcagggaagcagctccca

SEQ ID NO: 456844 - DNA, 25 bp, Rattus norvegicus
gaggccgccaactgcagaccactgg

SEQ ID NO: 456845 - DNA, 25 bp, Rattus norvegicus
tcagcgagcccttggagaagctatc

SEQ ID NO: 456846 - DNA, 25 bp, Rattus norvegicus
gccacgggttccagctgatcttcag

SEQ ID NO: 456847 - DNA, 25 bp, Rattus norvegicus
tgcgcaagcacacctcactgagaga

SEQ ID NO: 456848 - DNA, 25 bp, Rattus norvegicus
cttagcccagcaagcgtgctctgtg

SEQ ID NO: 456849 - DNA, 25 bp, Rattus norvegicus
tctctcgggaacttcgctcttgcca

SEQ ID NO: 456850 - DNA, 25 bp, Rattus norvegicus
ccgcatagcagttattgggtctctc

SEQ ID NO: 456851 - DNA, 25 bp, Rattus norvegicus
cccagcagcgttgcggatgagactt

SEQ ID NO: 456852 - DNA, 25 bp, Rattus norvegicus
tggacgaccacgacccaacgatgca

SEQ ID NO: 456853 - DNA, 25 bp, Rattus norvegicus
ggtggcctcagatccagctcactca

SEQ ID NO: 456854 - DNA, 25 bp, Rattus norvegicus
tcgatgctgcggctcaaattgatgg

SEQ ID NO: 456855 - DNA, 25 bp, Rattus norvegicus
ctgtctcgaaccaagtgctcccgga

SEQ ID NO: 456856 - DNA, 25 bp, Rattus norvegicus
gcagcggtggaacacactgtctcga

SEQ ID NO: 456857 - DNA, 25 bp, Rattus norvegicus
agacttttgctgatgtccaggccgc

SEQ ID NO: 456858 - DNA, 25 bp, Rattus norvegicus
accgtgtaggcctggtcgcccgtgc

SEQ ID NO: 456859 - DNA, 25 bp, Rattus norvegicus
cagctctgccgatctcgtcggcgag

SEQ ID NO: 456860 - DNA, 25 bp, Rattus norvegicus
atgctcaggcttggccagcagagcc

SEQ ID NO: 456861 - DNA, 25 bp, Rattus norvegicus
gagatgctcaggcttggccagcaga

SEQ ID NO: 456862 - DNA, 25 bp, Rattus norvegicus
atcctcggagatgctcaggcttggc

SEQ ID NO: 456863 - DNA, 25 bp, Rattus norvegicus
cgaggcgcatcctcggagatgctca

SEQ ID NO: 456864 - DNA, 25 bp, Rattus norvegicus
ttgcgcgcgtccctgcagcctctct

SEQ ID NO: 456865 - DNA, 25 bp, Rattus norvegicus
ctgcgcgctgcatccgcagccatgc

SEQ ID NO: 456866 - DNA, 25 bp, Rattus norvegicus
atctcgtcggcgagcccgcccacag

SEQ ID NO: 456867 - DNA, 25 bp, Rattus norvegicus
aggccttgctccttgccttcctggg

SEQ ID NO: 456868 - DNA, 25 bp, Rattus norvegicus
ggttttgcaccgtgtaggcctggtc

SEQ ID NO: 456869 - DNA, 25 bp, Rattus norvegicus
tgcagcctctctccgaggcgcatcc

SEQ ID NO: 456870 - DNA, 25 bp, Rattus norvegicus
ttccctcggccagctcctcacctgc

SEQ ID NO: 456871 - DNA, 25 bp, Rattus norvegicus
agccatgcgttcaccttgcgcgcgt

SEQ ID NO: 456872 - DNA, 25 bp, Rattus norvegicus
ccctcagtcaagctggtgtggaatc

SEQ ID NO: 456873 - DNA, 25 bp, Rattus norvegicus
catgcccacgaagaaggtgattata

SEQ ID NO: 456874 - DNA, 25 bp, Rattus norvegicus
ggcagcttagctttctacgcgtact

SEQ ID NO: 456875 - DNA, 25 bp, Rattus norvegicus
tagtggcggatcatgcccacgaaga

SEQ ID NO: 456876 - DNA, 25 bp, Rattus norvegicus
ggtgattataacgatgggcaggacc

SEQ ID NO: 456877 - DNA, 25 bp, Rattus norvegicus
ccagaggcggatgttagagtcaagc

SEQ ID NO: 456878 - DNA, 25 bp, Rattus norvegicus
tgttagagtcaagcagcagctcggg

SEQ ID NO: 456879 - DNA, 25 bp, Rattus norvegicus
ccatcttcgctgaaagttggctgcg

SEQ ID NO: 456880 - DNA, 25 bp, Rattus norvegicus
tgttgcgttcctcccggattttgga

SEQ ID NO: 456881 - DNA, 25 bp, Rattus norvegicus
tggaatctggggcagcttagctttc

SEQ ID NO: 456882 - DNA, 25 bp, Rattus norvegicus
tacgcgtactgtttccagctgggcc

SEQ ID NO: 456883 - DNA, 25 bp, Rattus norvegicus
caggccttcaacttccggcgtggaa

SEQ ID NO: 456884 - DNA, 25 bp, Rattus norvegicus
ccttgatgacgtcagaacggcgtcc

SEQ ID NO: 456885 - DNA, 25 bp, Rattus norvegicus
agtcgaaaacgaagggaagcaactg

SEQ ID NO: 456886 - DNA, 25 bp, Rattus norvegicus
tcacctactgaactccacgcggatt

SEQ ID NO: 456887 - DNA, 25 bp, Rattus norvegicus
agcaaccgcctttgtgactcaggac

SEQ ID NO: 456888 - DNA, 25 bp, Rattus norvegicus
tcggcgcctagcaaccgcctttgtg

SEQ ID NO: 456889 - DNA, 25 bp, Rattus norvegicus
gcatctcttctccactcggcgccta

SEQ ID NO: 456890 - DNA, 25 bp, Rattus norvegicus
gtgtagctgccgcatctcttctcca

SEQ ID NO: 456891 - DNA, 25 bp, Rattus norvegicus
tccagtgtagctgccgcatctcttc

SEQ ID NO: 456892 - DNA, 25 bp, Rattus norvegicus
tgcacgctccagtgtagctgccgca

SEQ ID NO: 456893 - DNA, 25 bp, Rattus norvegicus
cggattgcacgctccagtgtagctg

SEQ ID NO: 456894 - DNA, 25 bp, Rattus norvegicus
ggccgagacccaccatcaccatctg

SEQ ID NO: 456895 - DNA, 25 bp, Rattus norvegicus
tactgaactccacgcggattgcacg

SEQ ID NO: 456896 - DNA, 25 bp, Rattus norvegicus
agggactcacctactgaactccacg

SEQ ID NO: 456897 - DNA, 25 bp, Rattus norvegicus
gggccagggactcacctactgaact

SEQ ID NO: 456898 - DNA, 25 bp, Rattus norvegicus
atctgggccagggactcacctactg

SEQ ID NO: 456899 - DNA, 25 bp, Rattus norvegicus
ccacgcggattgcacgctccagtgt

SEQ ID NO: 456900 - DNA, 25 bp, Rattus norvegicus
tctcaactctttcggtcagcgggcg

SEQ ID NO: 456901 - DNA, 25 bp, Rattus norvegicus
tcttcacagtgcgagtggaggagcc

SEQ ID NO: 456902 - DNA, 25 bp, Rattus norvegicus
tgcgcgcctcaatgccaggactttc

SEQ ID NO: 456903 - DNA, 25 bp, Rattus norvegicus
gactttctggggctcgaacacttgg

SEQ ID NO: 456904 - DNA, 25 bp, Rattus norvegicus
tgcgcagtcactcttcctcaggctg

SEQ ID NO: 456905 - DNA, 25 bp, Rattus norvegicus
gcgaaccgggagtacattgagatca

SEQ ID NO: 456906 - DNA, 25 bp, Rattus norvegicus
tgagcctcactaggcggtttccgtg

SEQ ID NO: 456907 - DNA, 25 bp, Rattus norvegicus
tgggtctaccctacccattgccatg

SEQ ID NO: 456908 - DNA, 25 bp, Rattus norvegicus
ttaggcccatccatcgtctgacttg

SEQ ID NO: 456909 - DNA, 25 bp, Rattus norvegicus
atcgtctgacttggtttgcgctgcc

SEQ ID NO: 456910 - DNA, 25 bp, Rattus norvegicus
gccagtctgcacttggcacgcagtg

SEQ ID NO: 456911 - DNA, 25 bp, Rattus norvegicus
cagtgcgcagccgtgtcacagtcac

SEQ ID NO: 456912 - DNA, 25 bp, Rattus norvegicus
atccggtgcagcgagagattcacca

SEQ ID NO: 456913 - DNA, 25 bp, Rattus norvegicus
ctaacgacaagacccgctagtgatc

SEQ ID NO: 456914 - DNA, 25 bp, Rattus norvegicus
cccggaaggcagctagtccagagga

SEQ ID NO: 456915 - DNA, 25 bp, Rattus norvegicus
ccaacttgagggctctaggcggcca

SEQ ID NO: 456916 - DNA, 25 bp, Rattus norvegicus
taggcggccatttccgcgttaaagc

SEQ ID NO: 456917 - DNA, 25 bp, Rattus norvegicus
aagccggacggagtacttctattgc

SEQ ID NO: 456918 - DNA, 25 bp, Rattus norvegicus
tacttctattgctggcagacctgcc

SEQ ID NO: 456919 - DNA, 25 bp, Rattus norvegicus
ggaggcgtccggttccaataatgcc

SEQ ID NO: 456920 - DNA, 25 bp, Rattus norvegicus
cgcatccacagctaccgaggtacga

SEQ ID NO: 456921 - DNA, 25 bp, Rattus norvegicus
tcaactttgatggtgagcctcagcc

SEQ ID NO: 456922 - DNA, 25 bp, Rattus norvegicus
cgtcgtgctgcctttgtggctcaac

SEQ ID NO: 456923 - DNA, 25 bp, Rattus norvegicus
tcaggtcatcttctgcaaccgcagc

SEQ ID NO: 456924 - DNA, 25 bp, Rattus norvegicus
gtgaactcgcgcgaaccctctcagg

SEQ ID NO: 456925 - DNA, 25 bp, Rattus norvegicus
cggccggttttacgctctgtgaact

SEQ ID NO: 456926 - DNA, 25 bp, Rattus norvegicus
aaggatgccgggctctgaagagata

SEQ ID NO: 456927 - DNA, 25 bp, Rattus norvegicus
taggccgcgggtactgtaacaggcc

SEQ ID NO: 456928 - DNA, 25 bp, Rattus norvegicus
ccgcgcctactcgtgttacctgagg

SEQ ID NO: 456929 - DNA, 25 bp, Rattus norvegicus
cgcagtctcgccatggcttgctaca

SEQ ID NO: 456930 - DNA, 25 bp, Rattus norvegicus
tggacgacctgtgccgcaatatcga

SEQ ID NO: 456931 - DNA, 25 bp, Rattus norvegicus
cgtcctgggtactggacgacctgtg

SEQ ID NO: 456932 - DNA, 25 bp, Rattus norvegicus
accagctgccgtcctgggtactgga

SEQ ID NO: 456933 - DNA, 25 bp, Rattus norvegicus
ggcttgctacatctaccagctgccg

SEQ ID NO: 456934 - DNA, 25 bp, Rattus norvegicus
gccgcaatatcgacacgctcagtga

SEQ ID NO: 456935 - DNA, 25 bp, Rattus norvegicus
cgccctttgctagggaagccacggc

SEQ ID NO: 456936 - DNA, 25 bp, Rattus norvegicus
cagcgccgccctttgctagggaagc

SEQ ID NO: 456937 - DNA, 25 bp, Rattus norvegicus
ttcggtgagtttgacgccactctca

SEQ ID NO: 456938 - DNA, 25 bp, Rattus norvegicus
agtttgacgccactctcagccagga

SEQ ID NO: 456939 - DNA, 25 bp, Rattus norvegicus
gacccgagatagatccgcgcctact

SEQ ID NO: 456940 - DNA, 25 bp, Rattus norvegicus
ctggatgcagttcggtgagtttgac

SEQ ID NO: 456941 - DNA, 25 bp, Rattus norvegicus
tctcagccaggacccgagatagatc

SEQ ID NO: 456942 - DNA, 25 bp, Rattus norvegicus
gcagccgtgtttcctttgcgcccgg

SEQ ID NO: 456943 - DNA, 25 bp, Rattus norvegicus
ggtttgcaggctgaggagagcattc

SEQ ID NO: 456944 - DNA, 25 bp, Rattus norvegicus
cagtgggctttcctcgaggcctgac

SEQ ID NO: 456945 - DNA, 25 bp, Rattus norvegicus
tttgcagccagtgggctttcctcga

SEQ ID NO: 456946 - DNA, 25 bp, Rattus norvegicus
tgcagttttgcagccagtgggcttt

SEQ ID NO: 456947 - DNA, 25 bp, Rattus norvegicus
ggaccccagcttggctgcagttttg

SEQ ID NO: 456948 - DNA, 25 bp, Rattus norvegicus
gcgcgtctgcggttcccagcttggc

SEQ ID NO: 456949 - DNA, 25 bp, Rattus norvegicus
cagctgcgtgcgctaggccgaagca

SEQ ID NO: 456950 - DNA, 25 bp, Rattus norvegicus
gccttggcagccgtgtttcctttgc

SEQ ID NO: 456951 - DNA, 25 bp, Rattus norvegicus
aattgccacgtagcgctgcggcggc

SEQ ID NO: 456952 - DNA, 25 bp, Rattus norvegicus
aaaaggaattgccacgtagcgctgc

SEQ ID NO: 456953 - DNA, 25 bp, Rattus norvegicus
tgtcctggaatcaaaaggaattgcc

SEQ ID NO: 456954 - DNA, 25 bp, Rattus norvegicus
ccttcataataaatgtcctggaatc

SEQ ID NO: 456955 - DNA, 25 bp, Rattus norvegicus
ctgcgtgcgctaggccgaagcagcc

SEQ ID NO: 456956 - DNA, 25 bp, Rattus norvegicus
acagctgcgcttgccgacttcggct

SEQ ID NO: 456957 - DNA, 25 bp, Rattus norvegicus
gcgctgcgtcttgtcctgagttacg

SEQ ID NO: 456958 - DNA, 25 bp, Rattus norvegicus
cagacgacaggaacgggaaaggtca

SEQ ID NO: 456959 - DNA, 25 bp, Rattus norvegicus
aacgttggaccaacaggcgcgctgc

SEQ ID NO: 456960 - DNA, 25 bp, Rattus norvegicus
tccctttggagcaataggcgctgtc

SEQ ID NO: 456961 - DNA, 25 bp, Rattus norvegicus
ccaaggcaggttcagcggagcttac

SEQ ID NO: 456962 - DNA, 25 bp, Rattus norvegicus
agctggactagctgaggtgacttcc

SEQ ID NO: 456963 - DNA, 25 bp, Rattus norvegicus
ccctgaagcccgcagcactgggatg

SEQ ID NO: 456964 - DNA, 25 bp, Rattus norvegicus
agccgcgaaggctgctgctacaatc

SEQ ID NO: 456965 - DNA, 25 bp, Rattus norvegicus
cttgtccctctgttcctggcaggtg

SEQ ID NO: 456966 - DNA, 25 bp, Rattus norvegicus
aacggcgcaaggtcaagtatcactg

SEQ ID NO: 456967 - DNA, 25 bp, Rattus norvegicus
tcaagtatcactggggcagcacgtc

SEQ ID NO: 456968 - DNA, 25 bp, Rattus norvegicus
cctctctttcttcgggctcaggtgc

SEQ ID NO: 456969 - DNA, 25 bp, Rattus norvegicus
cccagcgtctgaaagtccggcgcgg

SEQ ID NO: 456970 - DNA, 25 bp, Rattus norvegicus
cagggaggcccgttctcttccgtct

SEQ ID NO: 456971 - DNA, 25 bp, Rattus norvegicus
tccgttaacggcacctctagctctt

SEQ ID NO: 456972 - DNA, 25 bp, Rattus norvegicus
ttcacccagcacttctcaaaacgtg

SEQ ID NO: 456973 - DNA, 25 bp, Rattus norvegicus
tgccagtgtgcaccgagctacttca

SEQ ID NO: 456974 - DNA, 25 bp, Rattus norvegicus
cactgtcacgggctgccagtgtgca

SEQ ID NO: 456975 - DNA, 25 bp, Rattus norvegicus
tcgggaggcgcacctacactgtcac

SEQ ID NO: 456976 - DNA, 25 bp, Rattus norvegicus
agcgctgtagctttgtcactgttcc

SEQ ID NO: 456977 - DNA, 25 bp, Rattus norvegicus
cgctgggttctctgcagcgctgtag

SEQ ID NO: 456978 - DNA, 25 bp, Rattus norvegicus
ttgtgaatgcgctgggttctctgca

SEQ ID NO: 456979 - DNA, 25 bp, Rattus norvegicus
ttaacggcacctctagctcttcatc

SEQ ID NO: 456980 - DNA, 25 bp, Rattus norvegicus
tcctcttcctctcagatctgttgtg

SEQ ID NO: 456981 - DNA, 25 bp, Rattus norvegicus
gctcttcatcccgatagctgcacag

SEQ ID NO: 456982 - DNA, 25 bp, Rattus norvegicus
tagctgcacagcacacccagggagg

SEQ ID NO: 456983 - DNA, 25 bp, Rattus norvegicus
tctcagatctgttgtgaatgcgctg

SEQ ID NO: 456984 - DNA, 25 bp, Rattus norvegicus
tcacagcctcggacgtggcagctca

SEQ ID NO: 456985 - DNA, 25 bp, Rattus norvegicus
actcgactcacacaaaggttccgcg

SEQ ID NO: 456986 - DNA, 25 bp, Rattus norvegicus
ccctgagttccggaaggcccagcgg

SEQ ID NO: 456987 - DNA, 25 bp, Rattus norvegicus
aggcccagcggccttgccttaagct

SEQ ID NO: 456988 - DNA, 25 bp, Rattus norvegicus
ttccggttagcaacacactcgactc

SEQ ID NO: 456989 - DNA, 25 bp, Rattus norvegicus
gccgtctaccaggagcttccggtta

SEQ ID NO: 456990 - DNA, 25 bp, Rattus norvegicus
cctaaagaggcaggacacgcaaacc

SEQ ID NO: 456991 - DNA, 25 bp, Rattus norvegicus
agcagcggcgactcacagcctcgga

SEQ ID NO: 456992 - DNA, 25 bp, Rattus norvegicus
gggaccgcatcacttaccatagcta

SEQ ID NO: 456993 - DNA, 25 bp, Rattus norvegicus
gaccacgactatctcagggaccgca

SEQ ID NO: 456994 - DNA, 25 bp, Rattus norvegicus
cgtagcggtggtctgctccaagacc

SEQ ID NO: 456995 - DNA, 25 bp, Rattus norvegicus
gctcccgctccgagacctaaagagg

SEQ ID NO: 456996 - DNA, 25 bp, Rattus norvegicus
gtggcagctcagaacgcttcacttc

SEQ ID NO: 456997 - DNA, 25 bp, Rattus norvegicus
cgcaaaccttgaggtcgtagcggtg

SEQ ID NO: 456998 - DNA, 25 bp, Rattus norvegicus
tccctggacttgaagaggtagctga

SEQ ID NO: 456999 - DNA, 25 bp, Rattus norvegicus
taacccttcatagagagagctacgg

SEQ ID NO: 457000 - DNA, 25 bp, Rattus norvegicus
tccggaattcaggatgagccatgaa

SEQ ID NO: 457001 - DNA, 25 bp, Rattus norvegicus
gctgggaatcttcgatccggaattc

SEQ ID NO: 457002 - DNA, 25 bp, Rattus norvegicus
ggcatcttcttccaggtcggtgtca

SEQ ID NO: 457003 - DNA, 25 bp, Rattus norvegicus
gagttctgcttgagcgcggcatctt

SEQ ID NO: 457004 - DNA, 25 bp, Rattus norvegicus
attgttcttgttgagcgaggacggc

SEQ ID NO: 457005 - DNA, 25 bp, Rattus norvegicus
tcccgctgtcgatggcgctattgtt

SEQ ID NO: 457006 - DNA, 25 bp, Rattus norvegicus
ggggcctcagctaaagcgacgtctc

SEQ ID NO: 457007 - DNA, 25 bp, Rattus norvegicus
ggtagctgatttgctcgtgtcggtc

SEQ ID NO: 457008 - DNA, 25 bp, Rattus norvegicus
agagagctacggaacgccttcacga

SEQ ID NO: 457009 - DNA, 25 bp, Rattus norvegicus
aagcgacgtctccaggctgtggatg

SEQ ID NO: 457010 - DNA, 25 bp, Rattus norvegicus
tcggtcgtcaggttgatcccgctgt

SEQ ID NO: 457011 - DNA, 25 bp, Rattus norvegicus
gcccattgctccttgctgcgtcggg

SEQ ID NO: 457012 - DNA, 25 bp, Rattus norvegicus
aaggagtcacactcacgcccagctg

SEQ ID NO: 457013 - DNA, 25 bp, Rattus norvegicus
cggagaggaaagagcattggataac

SEQ ID NO: 457014 - DNA, 25 bp, Rattus norvegicus
ttggataacgacacgcgactagggc

SEQ ID NO: 457015 - DNA, 25 bp, Rattus norvegicus
cgactagggctagagagactggcta

SEQ ID NO: 457016 - DNA, 25 bp, Rattus norvegicus
agagactggctacgtcctggctctg

SEQ ID NO: 457017 - DNA, 25 bp, Rattus norvegicus
ctggtgacggaggactgtctccgca

SEQ ID NO: 457018 - DNA, 25 bp, Rattus norvegicus
tgactacttcaatctgcaacggagg

SEQ ID NO: 457019 - DNA, 25 bp, Rattus norvegicus
ctgcaacggaggagagaacgagaca

SEQ ID NO: 457020 - DNA, 25 bp, Rattus norvegicus
aacgagacaagttgcgagaagaaac

SEQ ID NO: 457021 - DNA, 25 bp, Rattus norvegicus
cgagaagaaacgaacaccacagcta

SEQ ID NO: 457022 - DNA, 25 bp, Rattus norvegicus
cacagctacacaactgacgggcgca

SEQ ID NO: 457023 - DNA, 25 bp, Rattus norvegicus
ctgacgggcgcaacgttacacaaca

SEQ ID NO: 457024 - DNA, 25 bp, Rattus norvegicus
cccgctcttgaaagtattgactact

SEQ ID NO: 457025 - DNA, 25 bp, Rattus norvegicus
cggaggcggtaaggagtcacactca

SEQ ID NO: 457026 - DNA, 25 bp, Rattus norvegicus
agggagaggctcgttcccctcgcac

SEQ ID NO: 457027 - DNA, 25 bp, Rattus norvegicus
acacgaagggaagggtcagagccca

SEQ ID NO: 457028 - DNA, 25 bp, Rattus norvegicus
ccgtgtcaagggcacacgaagggaa

SEQ ID NO: 457029 - DNA, 25 bp, Rattus norvegicus
ccctcgcacaggaggccgtgtcaag

SEQ ID NO: 457030 - DNA, 25 bp, Rattus norvegicus
tcccacgggacgcatccgcggccgc

SEQ ID NO: 457031 - DNA, 25 bp, Rattus norvegicus
gtgggcatcgctcccacgggacgca

SEQ ID NO: 457032 - DNA, 25 bp, Rattus norvegicus
gacggaaccaccctgcgcctgggag

SEQ ID NO: 457033 - DNA, 25 bp, Rattus norvegicus
agactgtaccatcgcgcctgaggct

SEQ ID NO: 457034 - DNA, 25 bp, Rattus norvegicus
gcagactgtaccatcgcgcctgagg

SEQ ID NO: 457035 - DNA, 25 bp, Rattus norvegicus
ggtccctgcgcagactgtaccatcg

SEQ ID NO: 457036 - DNA, 25 bp, Rattus norvegicus
gcagcccgtaatcgcggtgcggcag

SEQ ID NO: 457037 - DNA, 25 bp, Rattus norvegicus
ttccaggcgggcagcccgtaatcgc

SEQ ID NO: 457038 - DNA, 25 bp, Rattus norvegicus
ccagcgatcggttcgggttccaggc

SEQ ID NO: 457039 - DNA, 25 bp, Rattus norvegicus
acaggaggccgtgtcaagggcacac

SEQ ID NO: 457040 - DNA, 25 bp, Rattus norvegicus
gcccgccgccgagtgcccgctcaag

SEQ ID NO: 457041 - DNA, 25 bp, Rattus norvegicus
cggacccgccgaccctcacctgcgc

SEQ ID NO: 457042 - DNA, 25 bp, Rattus norvegicus
acccgtgcgggcagcggggaagaga

SEQ ID NO: 457043 - DNA, 25 bp, Rattus norvegicus
aaggtggcggaacccgtgcgggcag

SEQ ID NO: 457044 - DNA, 25 bp, Rattus norvegicus
ctacagggaagaagccgcgggaaag

SEQ ID NO: 457045 - DNA, 25 bp, Rattus norvegicus
aactctggctgcagcccaggccgct

SEQ ID NO: 457046 - DNA, 25 bp, Rattus norvegicus
ccggggctcccctggccgaactctg

SEQ ID NO: 457047 - DNA, 25 bp, Rattus norvegicus
ctgacaccgcggacaccggggctcc

SEQ ID NO: 457048 - DNA, 25 bp, Rattus norvegicus
tcaccgctgacaccgcggacaccgg

SEQ ID NO: 457049 - DNA, 25 bp, Rattus norvegicus
aaggtcaccgctgacaccgcggaca

SEQ ID NO: 457050 - DNA, 25 bp, Rattus norvegicus
tcaaggtcaccgctgacaccgcgga

SEQ ID NO: 457051 - DNA, 25 bp, Rattus norvegicus
agtgcccgctcaaggtcaccgctga

SEQ ID NO: 457052 - DNA, 25 bp, Rattus norvegicus
cccgctccggggcgatgatgccgcc

SEQ ID NO: 457053 - DNA, 25 bp, Rattus norvegicus
gagtgcccgctcaaggtcaccgctg

SEQ ID NO: 457054 - DNA, 25 bp, Rattus norvegicus
actgcgtccttgtcccgtgaggtcc

SEQ ID NO: 457055 - DNA, 25 bp, Rattus norvegicus
caaggtggagttcgtgttgagcgta

SEQ ID NO: 457056 - DNA, 25 bp, Rattus norvegicus
gcgcggtcactggaacaacaaggtg

SEQ ID NO: 457057 - DNA, 25 bp, Rattus norvegicus
ccacgagcgcggtcactggaacaac

SEQ ID NO: 457058 - DNA, 25 bp, Rattus norvegicus
acaaggcggtccacgagcgcggtca

SEQ ID NO: 457059 - DNA, 25 bp, Rattus norvegicus
aagcgctgcccctgggcaacgggaa

SEQ ID NO: 457060 - DNA, 25 bp, Rattus norvegicus
tcactggaacaacaaggtggagttc

SEQ ID NO: 457061 - DNA, 25 bp, Rattus norvegicus
ccatgactgcggagcaagcgctgcc

SEQ ID NO: 457062 - DNA, 25 bp, Rattus norvegicus
agcctctcaaaagcccgggcgcccg

SEQ ID NO: 457063 - DNA, 25 bp, Rattus norvegicus
agagatcatcggtctgggcaacgtg

SEQ ID NO: 457064 - DNA, 25 bp, Rattus norvegicus
agatcatcggtctgggcaacgtgtg

SEQ ID NO: 457065 - DNA, 25 bp, Rattus norvegicus
gtgttgagcgtagcgggagagatca

SEQ ID NO: 457066 - DNA, 25 bp, Rattus norvegicus
tgggcactgcgtccttgtcccgtga

SEQ ID NO: 457067 - DNA, 25 bp, Rattus norvegicus
gcccgccgctcgagcctctcaaaag

SEQ ID NO: 457068 - DNA, 25 bp, Rattus norvegicus
gctccgcccagagggcgtgtcctga

SEQ ID NO: 457069 - DNA, 25 bp, Rattus norvegicus
ggagccagatcaacctgcgccacgt

SEQ ID NO: 457070 - DNA, 25 bp, Rattus norvegicus
gagggagccagatcaacctgcgcca

SEQ ID NO: 457071 - DNA, 25 bp, Rattus norvegicus
ttgcccaggagggagccagatcaac

SEQ ID NO: 457072 - DNA, 25 bp, Rattus norvegicus
tcctggttcattcgccagcgggcgg

SEQ ID NO: 457073 - DNA, 25 bp, Rattus norvegicus
atgtcctggttcattcgccagcggg

SEQ ID NO: 457074 - DNA, 25 bp, Rattus norvegicus
tgccgtcgatgtcctggttcattcg

SEQ ID NO: 457075 - DNA, 25 bp, Rattus norvegicus
atcccaggaggccaggtgccgtcga

SEQ ID NO: 457076 - DNA, 25 bp, Rattus norvegicus
gcgggaccctaatctgcagcgtgtc

SEQ ID NO: 457077 - DNA, 25 bp, Rattus norvegicus
ccggccgcaggtaagaagggaggct

SEQ ID NO: 457078 - DNA, 25 bp, Rattus norvegicus
ccctcggagccctagagagctgaga

SEQ ID NO: 457079 - DNA, 25 bp, Rattus norvegicus
acaagctccgcccagagggcgtgtc

SEQ ID NO: 457080 - DNA, 25 bp, Rattus norvegicus
gcaagacggcgcggacaagctccgc

SEQ ID NO: 457081 - DNA, 25 bp, Rattus norvegicus
agccctagagagctgagaggttgca

SEQ ID NO: 457082 - DNA, 25 bp, Rattus norvegicus
gtgctgtgcctggacgcgcaaacac

SEQ ID NO: 457083 - DNA, 25 bp, Rattus norvegicus
gcctggacgcgcaaacacctgtggc

SEQ ID NO: 457084 - DNA, 25 bp, Rattus norvegicus
gcgcgcaggatgctctggcaaagcc

SEQ ID NO: 457085 - DNA, 25 bp, Rattus norvegicus
aaacacctgtggcttccgggagctg

SEQ ID NO: 457086 - DNA, 25 bp, Rattus norvegicus
gcccgccttcgcgtgctccggccac

SEQ ID NO: 457087 - DNA, 25 bp, Rattus norvegicus
tggacgcgcaaacacctgtggcttc

SEQ ID NO: 457088 - DNA, 25 bp, Rattus norvegicus
gatgctctggcaaagccggcggcct

SEQ ID NO: 457089 - DNA, 25 bp, Rattus norvegicus
ctgtagggacactccgcaggtggcc

SEQ ID NO: 457090 - DNA, 25 bp, Rattus norvegicus
cccgcagggctgtagggacactccg

SEQ ID NO: 457091 - DNA, 25 bp, Rattus norvegicus
aggcccagctctgaggtcctcgccc

SEQ ID NO: 457092 - DNA, 25 bp, Rattus norvegicus
aggatgcgctcaggcccagctctga

SEQ ID NO: 457093 - DNA, 25 bp, Rattus norvegicus
actttccccggagctggctcgggtg

SEQ ID NO: 457094 - DNA, 25 bp, Rattus norvegicus
cgccgccaccgcatcgagcagactg

SEQ ID NO: 457095 - DNA, 25 bp, Rattus norvegicus
gcgcaaacacctgtggcttccggga

SEQ ID NO: 457096 - DNA, 25 bp, Rattus norvegicus
aggcagagacgacgcacagcctcac

SEQ ID NO: 457097 - DNA, 25 bp, Rattus norvegicus
agcctggaaggcagagacgacgcac

SEQ ID NO: 457098 - DNA, 25 bp, Rattus norvegicus
ttgcacctgcgcagagagcctggaa

SEQ ID NO: 457099 - DNA, 25 bp, Rattus norvegicus
gcctttttgcacctgcgcagagagc

SEQ ID NO: 457100 - DNA, 25 bp, Rattus norvegicus
aacgccacagcctagggacggctgc

SEQ ID NO: 457101 - DNA, 25 bp, Rattus norvegicus
gctcagaaacgccacagcctaggga

SEQ ID NO: 457102 - DNA, 25 bp, Rattus norvegicus
gcaagtccggctcagaaacgccaca

SEQ ID NO: 457103 - DNA, 25 bp, Rattus norvegicus
tgcttcaggcaagtccggctcagaa

SEQ ID NO: 457104 - DNA, 25 bp, Rattus norvegicus
aaactgcggcgtgcttcaggcaagt

SEQ ID NO: 457105 - DNA, 25 bp, Rattus norvegicus
actcgggaaactgcggcgtgcttca

SEQ ID NO: 457106 - DNA, 25 bp, Rattus norvegicus
tatgaggatgccagaaccgggactc

SEQ ID NO: 457107 - DNA, 25 bp, Rattus norvegicus
ttgcccgtatgaggatgccagaacc

SEQ ID NO: 457108 - DNA, 25 bp, Rattus norvegicus
agctctgagttagttgcccgtatga

SEQ ID NO: 457109 - DNA, 25 bp, Rattus norvegicus
gctgcagctctgagttagttgcccg

SEQ ID NO: 457110 - DNA, 25 bp, Rattus norvegicus
agggcacatggacacgacgtttctc

SEQ ID NO: 457111 - DNA, 25 bp, Rattus norvegicus
tgtctcctaaagtcaccggacctga

SEQ ID NO: 457112 - DNA, 25 bp, Rattus norvegicus
tccgcggaggttccctgtctcctaa

SEQ ID NO: 457113 - DNA, 25 bp, Rattus norvegicus
ccagctcggaatgtcgtcggagacc

SEQ ID NO: 457114 - DNA, 25 bp, Rattus norvegicus
cgcatcttcccgacccatgggtgaa

SEQ ID NO: 457115 - DNA, 25 bp, Rattus norvegicus
atgtctccggtaatcatcccgctta

SEQ ID NO: 457116 - DNA, 25 bp, Rattus norvegicus
atcccgcttagtcagccacgcaagg

SEQ ID NO: 457117 - DNA, 25 bp, Rattus norvegicus
caaggcgccgagtcaccttcgtaga

SEQ ID NO: 457118 - DNA, 25 bp, Rattus norvegicus
agtctaggctctgtgtttgcaccca

SEQ ID NO: 457119 - DNA, 25 bp, Rattus norvegicus
gtttgcacccatacggcagcagctc

SEQ ID NO: 457120 - DNA, 25 bp, Rattus norvegicus
ccaaagccattaggacgcgacagtc

SEQ ID NO: 457121 - DNA, 25 bp, Rattus norvegicus
gcgacagtcaaccacacgtacctga

SEQ ID NO: 457122 - DNA, 25 bp, Rattus norvegicus
tcggggtgccacttagaatcagaaa

SEQ ID NO: 457123 - DNA, 25 bp, Rattus norvegicus
ggcgccctgcactcggaattcaaag

SEQ ID NO: 457124 - DNA, 25 bp, Rattus norvegicus
tgagccagaatcctgcgcaggccca

SEQ ID NO: 457125 - DNA, 25 bp, Rattus norvegicus
gagccgtaggcgaaggccaaactca

SEQ ID NO: 457126 - DNA, 25 bp, Rattus norvegicus
acaggtgccagacatgggactggtc

SEQ ID NO: 457127 - DNA, 25 bp, Rattus norvegicus
ggcctcggactcacctcctggtgtg

SEQ ID NO: 457128 - DNA, 25 bp, Rattus norvegicus
ctcacctcctggtgtgcactgggtc

SEQ ID NO: 457129 - DNA, 25 bp, Rattus norvegicus
gcactgggtcctgcctggcgataca

SEQ ID NO: 457130 - DNA, 25 bp, Rattus norvegicus
cctggcgatacaccgcagagccgta

SEQ ID NO: 457131 - DNA, 25 bp, Rattus norvegicus
ctccgggaagtgagccagaatcctg

SEQ ID NO: 457132 - DNA, 25 bp, Rattus norvegicus
gctgtgcagcgcctgcagcgccatg

SEQ ID NO: 457133 - DNA, 25 bp, Rattus norvegicus
accctgtgctcgcaattctcggtcg

SEQ ID NO: 457134 - DNA, 25 bp, Rattus norvegicus
attctcggtcgtgcggaccgcgctt

SEQ ID NO: 457135 - DNA, 25 bp, Rattus norvegicus
acgcacgcgcgcttcagagcggcag

SEQ ID NO: 457136 - DNA, 25 bp, Rattus norvegicus
gccgaggctctgtggcgccctctag

SEQ ID NO: 457137 - DNA, 25 bp, Rattus norvegicus
caaactcaggtcctccgggaagtga

SEQ ID NO: 457138 - DNA, 25 bp, Rattus norvegicus
gcatcacatggcacgtcatcgctca

SEQ ID NO: 457139 - DNA, 25 bp, Rattus norvegicus
gtcaacaacggcatcacatggcacg

SEQ ID NO: 457140 - DNA, 25 bp, Rattus norvegicus
atggcacgtcatcgctcagcaccag

SEQ ID NO: 457141 - DNA, 25 bp, Rattus norvegicus
tcagcaccagccgaaggacttcaca

SEQ ID NO: 457142 - DNA, 25 bp, Rattus norvegicus
ccgaaggacttcacacaagctcagc

SEQ ID NO: 457143 - DNA, 25 bp, Rattus norvegicus
caagctcagcgggtgtcttacaacg

SEQ ID NO: 457144 - DNA, 25 bp, Rattus norvegicus
tcagcgggtgtcttacaacgttccc

SEQ ID NO: 457145 - DNA, 25 bp, Rattus norvegicus
ctcagtgactcaccgagtgcggcat

SEQ ID NO: 457146 - DNA, 25 bp, Rattus norvegicus
gactcaccgagtgcggcatggaagc

SEQ ID NO: 457147 - DNA, 25 bp, Rattus norvegicus
gttattgggtcaatgccgtgaacca

SEQ ID NO: 457148 - DNA, 25 bp, Rattus norvegicus
tgccgtgaaccaaggcatcccagac

SEQ ID NO: 457149 - DNA, 25 bp, Rattus norvegicus
cagaccgcccacattgtgttgccgt

SEQ ID NO: 457150 - DNA, 25 bp, Rattus norvegicus
agcctgctcagtgactcaccgagtg

SEQ ID NO: 457151 - DNA, 25 bp, Rattus norvegicus
gcccacattgtgttgccgttttccg

SEQ ID NO: 457152 - DNA, 25 bp, Rattus norvegicus
tcagctcgctgtcgcaagccgtgaa

SEQ ID NO: 457153 - DNA, 25 bp, Rattus norvegicus
tccctttgcgccagagcctgaagga

SEQ ID NO: 457154 - DNA, 25 bp, Rattus norvegicus
gacagaagtagccacgcccttggca

SEQ ID NO: 457155 - DNA, 25 bp, Rattus norvegicus
ctgtctgctgggctcacggagacgc

SEQ ID NO: 457156 - DNA, 25 bp, Rattus norvegicus
ctcagtccctcaagccagatgatga

SEQ ID NO: 457157 - DNA, 25 bp, Rattus norvegicus
tcggacagcagcttcattgccaacc

SEQ ID NO: 457158 - DNA, 25 bp, Rattus norvegicus
tgccaacctgcccaatggctacatg

SEQ ID NO: 457159 - DNA, 25 bp, Rattus norvegicus
tgaagatggaccctcgaggttaccc

SEQ ID NO: 457160 - DNA, 25 bp, Rattus norvegicus
gcagcagcttcttcagctcgctgtc

SEQ ID NO: 457161 - DNA, 25 bp, Rattus norvegicus
tcggccgcttccaggaaggccaagg

SEQ ID NO: 457162 - DNA, 25 bp, Rattus norvegicus
ggcagactctccctttgcgccagag

SEQ ID NO: 457163 - DNA, 25 bp, Rattus norvegicus
cggagacgcggaccacctttggtcg

SEQ ID NO: 457164 - DNA, 25 bp, Rattus norvegicus
tacatgactgaccttcagcgcccgg

SEQ ID NO: 457165 - DNA, 25 bp, Rattus norvegicus
agatgatgaacttcctgaggcgccg

SEQ ID NO: 457166 - DNA, 25 bp, Rattus norvegicus
ctgacagcctgacgaggtctctctc

SEQ ID NO: 457167 - DNA, 25 bp, Rattus norvegicus
gtcatactcagacaggacccggtga

SEQ ID NO: 457168 - DNA, 25 bp, Rattus norvegicus
acgcgggctgagaagtcactttctg

SEQ ID NO: 457169 - DNA, 25 bp, Rattus norvegicus
ctgactgtctaggtgactgggtctc

SEQ ID NO: 457170 - DNA, 25 bp, Rattus norvegicus
actctctgtcaggactgtgtaactg

SEQ ID NO: 457171 - DNA, 25 bp, Rattus norvegicus
tcctgtctcaactagaggggacgtg

SEQ ID NO: 457172 - DNA, 25 bp, Rattus norvegicus
cactctgacaggacggagcgtgaca

SEQ ID NO: 457173 - DNA, 25 bp, Rattus norvegicus
acaaggtgatcgagtctgggtctga

SEQ ID NO: 457174 - DNA, 25 bp, Rattus norvegicus
cctagagagccgagtgtgactgaca

SEQ ID NO: 457175 - DNA, 25 bp, Rattus norvegicus
ccacagtggagccacctcaggtttc

SEQ ID NO: 457176 - DNA, 25 bp, Rattus norvegicus
ctcaggtttcctcagaaggtgctcc

SEQ ID NO: 457177 - DNA, 25 bp, Rattus norvegicus
aaagccaggtctccgcacggtccag

SEQ ID NO: 457178 - DNA, 25 bp, Rattus norvegicus
acggaatcttaactgaggggactga

SEQ ID NO: 457179 - DNA, 25 bp, Rattus norvegicus
gacgggctgaggagaagtcatactc

SEQ ID NO: 457180 - DNA, 25 bp, Rattus norvegicus
tctctagtgttctgtgtccagcgtg

SEQ ID NO: 457181 - DNA, 25 bp, Rattus norvegicus
acgcagccggtcgttttgcggctac

SEQ ID NO: 457182 - DNA, 25 bp, Rattus norvegicus
gttttgcggctacgcgcagctggtt

SEQ ID NO: 457183 - DNA, 25 bp, Rattus norvegicus
gccgcgctgcttgacggctacagta

SEQ ID NO: 457184 - DNA, 25 bp, Rattus norvegicus
acggctacagtaccgcctccaggtt

SEQ ID NO: 457185 - DNA, 25 bp, Rattus norvegicus
tccagcgtgtgaaccgcttcaggcg

SEQ ID NO: 457186 - DNA, 25 bp, Rattus norvegicus
cagtaccgcctccaggttgccgggt

SEQ ID NO: 457187 - DNA, 25 bp, Rattus norvegicus
taaggtaagactgacgggaagtctg

SEQ ID NO: 457188 - DNA, 25 bp, Rattus norvegicus
gccggtctctagtgttctgtgtcca

SEQ ID NO: 457189 - DNA, 25 bp, Rattus norvegicus
ctgtgtccagcgtgtgaaccgcttc

SEQ ID NO: 457190 - DNA, 25 bp, Rattus norvegicus
tgtgctaggacgcagccggtcgttt

SEQ ID NO: 457191 - DNA, 25 bp, Rattus norvegicus
tgcttgacggctacagtaccgcctc

SEQ ID NO: 457192 - DNA, 25 bp, Rattus norvegicus
tggagccggccggtctctagtgttc

SEQ ID NO: 457193 - DNA, 25 bp, Rattus norvegicus
tacagtaccgcctccaggttgccgg

SEQ ID NO: 457194 - DNA, 25 bp, Rattus norvegicus
tgatggtggttaagtttcctgccgg

SEQ ID NO: 457195 - DNA, 25 bp, Rattus norvegicus
ctgccggtactttagaagtaacgca

SEQ ID NO: 457196 - DNA, 25 bp, Rattus norvegicus
tgcaaccgcggtttgcagagagtga

SEQ ID NO: 457197 - DNA, 25 bp, Rattus norvegicus
tgtacagcggggataactcgcagga

SEQ ID NO: 457198 - DNA, 25 bp, Rattus norvegicus
cccattatgatggtggttaagtttc

SEQ ID NO: 457199 - DNA, 25 bp, Rattus norvegicus
cctgcaggtgagtgcgcatcgccgc

SEQ ID NO: 457200 - DNA, 25 bp, Rattus norvegicus
atgagcaccaagcaggtcacctgca

SEQ ID NO: 457201 - DNA, 25 bp, Rattus norvegicus
taccgccatgagcaccaagcaggtc

SEQ ID NO: 457202 - DNA, 25 bp, Rattus norvegicus
atttcagtgcgactccagcccgtgg

SEQ ID NO: 457203 - DNA, 25 bp, Rattus norvegicus
cggctttgagatttcagtgcgactc

SEQ ID NO: 457204 - DNA, 25 bp, Rattus norvegicus
cgctggcggctttgagatttcagtg

SEQ ID NO: 457205 - DNA, 25 bp, Rattus norvegicus
cctagcggaacccattatgatggtg

SEQ ID NO: 457206 - DNA, 25 bp, Rattus norvegicus
tactttagaagtaacgcacgcgtgg

SEQ ID NO: 457207 - DNA, 25 bp, Rattus norvegicus
ctggagcggcaagagctgctgcaac

SEQ ID NO: 457208 - DNA, 25 bp, Rattus norvegicus
aacccatgggagcaaaccggccctg

SEQ ID NO: 457209 - DNA, 25 bp, Rattus norvegicus
acagatggcagccacctcgcaggca

SEQ ID NO: 457210 - DNA, 25 bp, Rattus norvegicus
ctcaccgcaaaacagatggcagcca

SEQ ID NO: 457211 - DNA, 25 bp, Rattus norvegicus
gccgatgcagactcaccgcaaaaca

SEQ ID NO: 457212 - DNA, 25 bp, Rattus norvegicus
caagcagcggatggccgccgatgca

SEQ ID NO: 457213 - DNA, 25 bp, Rattus norvegicus
gctacaacaccagcgcggagaccga

SEQ ID NO: 457214 - DNA, 25 bp, Rattus norvegicus
cggcgggcgccgtctgaaacccatg

SEQ ID NO: 457215 - DNA, 25 bp, Rattus norvegicus
agctaattagaaagcggcgggcgcc

SEQ ID NO: 457216 - DNA, 25 bp, Rattus norvegicus
gcagctaacaagctaattagaaagc

SEQ ID NO: 457217 - DNA, 25 bp, Rattus norvegicus
ccgctacagtaaagagcagctaaca

SEQ ID NO: 457218 - DNA, 25 bp, Rattus norvegicus
caggacgtcgtacccgctacagtaa

SEQ ID NO: 457219 - DNA, 25 bp, Rattus norvegicus
acctcgcaggcagcgccgaggaaga

SEQ ID NO: 457220 - DNA, 25 bp, Rattus norvegicus
ctgactcaggacgtcgtacccgcta

SEQ ID NO: 457221 - DNA, 25 bp, Rattus norvegicus
cggcggcagcttcctgactcaggac

SEQ ID NO: 457222 - DNA, 25 bp, Rattus norvegicus
tccctgcgcgctcggcgcttcagag

SEQ ID NO: 457223 - DNA, 25 bp, Rattus norvegicus
tgcgcacttggagcttgcgagctca

SEQ ID NO: 457224 - DNA, 25 bp, Rattus norvegicus
gagctaggctcccttttggacatgc

SEQ ID NO: 457225 - DNA, 25 bp, Rattus norvegicus
ttcagaggaggagctaggctccctt

SEQ ID NO: 457226 - DNA, 25 bp, Rattus norvegicus
tttggacatgcgcacttggagcttg

SEQ ID NO: 457227 - DNA, 25 bp, Rattus norvegicus
tggagcttgcgagctcacgcgcgac

SEQ ID NO: 457228 - DNA, 25 bp, Rattus norvegicus
tcacgcgcgacccattgcgcatgtg

SEQ ID NO: 457229 - DNA, 25 bp, Rattus norvegicus
acccattgcgcatgtgcgttgctaa

SEQ ID NO: 457230 - DNA, 25 bp, Rattus norvegicus
ttgcgcatgtgcgttgctaagggta

SEQ ID NO: 457231 - DNA, 25 bp, Rattus norvegicus
tgctaagggtagcaaaggtagccga

SEQ ID NO: 457232 - DNA, 25 bp, Rattus norvegicus
tttgtggagagaagcctgttgctgc

SEQ ID NO: 457233 - DNA, 25 bp, Rattus norvegicus
agagaagcctgttgctgccgaggct

SEQ ID NO: 457234 - DNA, 25 bp, Rattus norvegicus
ccgtgttgacgtggagagacaaagc

SEQ ID NO: 457235 - DNA, 25 bp, Rattus norvegicus
gctcccttttggacatgcgcacttg

SEQ ID NO: 457236 - DNA, 25 bp, Rattus norvegicus
cgcctcgctgttgagcgccaggtac

SEQ ID NO: 457237 - DNA, 25 bp, Rattus norvegicus
accggacagctggtacaggcggttc

SEQ ID NO: 457238 - DNA, 25 bp, Rattus norvegicus
caggctcaagttggcaccggacagc

SEQ ID NO: 457239 - DNA, 25 bp, Rattus norvegicus
gcccgggtccaactgcaagattttg

SEQ ID NO: 457240 - DNA, 25 bp, Rattus norvegicus
gcctcagttggcacagaccctggta

SEQ ID NO: 457241 - DNA, 25 bp, Rattus norvegicus
ccacgttgagcatgctggggaacac

SEQ ID NO: 457242 - DNA, 25 bp, Rattus norvegicus
aaagcgcttccgtagccggtgtacg

SEQ ID NO: 457243 - DNA, 25 bp, Rattus norvegicus
ctcgaagcggtggtcttctaggcta

SEQ ID NO: 457244 - DNA, 25 bp, Rattus norvegicus
gagatctcgggcgtgttctcgaagc

SEQ ID NO: 457245 - DNA, 25 bp, Rattus norvegicus
agcttagccaagtctccacgcgcgt

SEQ ID NO: 457246 - DNA, 25 bp, Rattus norvegicus
tcttcagtatgttgtcgtccgacgg

SEQ ID NO: 457247 - DNA, 25 bp, Rattus norvegicus
ggctccctgtttgatcttcagtatg

SEQ ID NO: 457248 - DNA, 25 bp, Rattus norvegicus
aggcacgcacgaagcccagcttgtg

SEQ ID NO: 457249 - DNA, 25 bp, Rattus norvegicus
cgcgcactgcaagcccagttggatg

SEQ ID NO: 457250 - DNA, 25 bp, Rattus norvegicus
cgtctgccgctgtctcggcggagct

SEQ ID NO: 457251 - DNA, 25 bp, Rattus norvegicus
gacctggcgccttccgaggcgtgac

SEQ ID NO: 457252 - DNA, 25 bp, Rattus norvegicus
ggatccagggcccttctcggacatg

SEQ ID NO: 457253 - DNA, 25 bp, Rattus norvegicus
gggccatggcaaccctggtgcgcac

SEQ ID NO: 457254 - DNA, 25 bp, Rattus norvegicus
ttttgaggccatcacgggaactccc

SEQ ID NO: 457255 - DNA, 25 bp, Rattus norvegicus
ccttttgaggccatcacgggaactc

SEQ ID NO: 457256 - DNA, 25 bp, Rattus norvegicus
cccgccttttgaggccatcacggga

SEQ ID NO: 457257 - DNA, 25 bp, Rattus norvegicus
tctggcagccgcagtggacccttga

SEQ ID NO: 457258 - DNA, 25 bp, Rattus norvegicus
attcgcccgccttttgaggccatca

SEQ ID NO: 457259 - DNA, 25 bp, Rattus norvegicus
aagctcagcattcgcccgccttttg

SEQ ID NO: 457260 - DNA, 25 bp, Rattus norvegicus
tcggacatgccaagctcagcattcg

SEQ ID NO: 457261 - DNA, 25 bp, Rattus norvegicus
gggcccttctcggacatgccaagct

SEQ ID NO: 457262 - DNA, 25 bp, Rattus norvegicus
cttctcggacatgccaagctcagca

SEQ ID NO: 457263 - DNA, 25 bp, Rattus norvegicus
cggctgagacctggcgccttccgag

SEQ ID NO: 457264 - DNA, 25 bp, Rattus norvegicus
agacgacggacagccggcgtctccg

SEQ ID NO: 457265 - DNA, 25 bp, Rattus norvegicus
ggccttgggcgcgagtcctcacacg

SEQ ID NO: 457266 - DNA, 25 bp, Rattus norvegicus
tctaagaaatcggtagccgggaggc

SEQ ID NO: 457267 - DNA, 25 bp, Rattus norvegicus
ggggttgtcccaatgacaggcagaa

SEQ ID NO: 457268 - DNA, 25 bp, Rattus norvegicus
actcaccggtggagagacgacggac

SEQ ID NO: 457269 - DNA, 25 bp, Rattus norvegicus
acggctgggccagtcactcaccggt

SEQ ID NO: 457270 - DNA, 25 bp, Rattus norvegicus
gggccacgctagagagaccgcccgt

SEQ ID NO: 457271 - DNA, 25 bp, Rattus norvegicus
agccaaaggtccgagccgcgccagg

SEQ ID NO: 457272 - DNA, 25 bp, Rattus norvegicus
gcgacaccagagcagccaaaggtcc

SEQ ID NO: 457273 - DNA, 25 bp, Rattus norvegicus
agacccggagcttcggcgacaccag

SEQ ID NO: 457274 - DNA, 25 bp, Rattus norvegicus
agacgcagggtccagccggagaccc

SEQ ID NO: 457275 - DNA, 25 bp, Rattus norvegicus
tgacaggcagaaagcccggagacgc

SEQ ID NO: 457276 - DNA, 25 bp, Rattus norvegicus
ccggacgagcgagggctctaagaaa

SEQ ID NO: 457277 - DNA, 25 bp, Rattus norvegicus
ccgcaacgggccacgctagagagac

SEQ ID NO: 457278 - DNA, 25 bp, Rattus norvegicus
gcccagtcgccacagccgcccacaa

SEQ ID NO: 457279 - DNA, 25 bp, Rattus norvegicus
tgcagttcggaagctgaagcacttc

SEQ ID NO: 457280 - DNA, 25 bp, Rattus norvegicus
atcccttactgcagttcggaagctg

SEQ ID NO: 457281 - DNA, 25 bp, Rattus norvegicus
gtgagttcttcctatcccttactgc

SEQ ID NO: 457282 - DNA, 25 bp, Rattus norvegicus
gcgtcctccacgtgagttcttccta

SEQ ID NO: 457283 - DNA, 25 bp, Rattus norvegicus
aggtccagtaagctgaggcgctgca

SEQ ID NO: 457284 - DNA, 25 bp, Rattus norvegicus
cctcaggcctgccaacccacgcggg

SEQ ID NO: 457285 - DNA, 25 bp, Rattus norvegicus
tgacccagaggtgtagccacgcctc

SEQ ID NO: 457286 - DNA, 25 bp, Rattus norvegicus
gaagcacttcagcatctcgcctctt

SEQ ID NO: 457287 - DNA, 25 bp, Rattus norvegicus
ctcctgctgacagcgcatgcgcaag

SEQ ID NO: 457288 - DNA, 25 bp, Rattus norvegicus
cgaaacagcgcgagggaacgacagc

SEQ ID NO: 457289 - DNA, 25 bp, Rattus norvegicus
cccacgcgggcgcaggtccagtaag

SEQ ID NO: 457290 - DNA, 25 bp, Rattus norvegicus
cgtgacctgacccagaggtgtagcc

SEQ ID NO: 457291 - DNA, 25 bp, Rattus norvegicus
agaggtgtagccacgcctcaggcct

SEQ ID NO: 457292 - DNA, 25 bp, Rattus norvegicus
ctccagtattctaggcgcaatctca

SEQ ID NO: 457293 - DNA, 25 bp, Rattus norvegicus
cccaggtcacgtgacgacgtcatca

SEQ ID NO: 457294 - DNA, 25 bp, Rattus norvegicus
cttctttttgtccttcccgctgcag

SEQ ID NO: 457295 - DNA, 25 bp, Rattus norvegicus
gtcatcacgtgacgcgaactatgtg

SEQ ID NO: 457296 - DNA, 25 bp, Rattus norvegicus
tatgtgactaccacagcgctgggtg

SEQ ID NO: 457297 - DNA, 25 bp, Rattus norvegicus
tagcagctccggtagtcactttgga

SEQ ID NO: 457298 - DNA, 25 bp, Rattus norvegicus
tcactttggaccttgctgagtagcg

SEQ ID NO: 457299 - DNA, 25 bp, Rattus norvegicus
gaggacggccctctaggcttcttcc

SEQ ID NO: 457300 - DNA, 25 bp, Rattus norvegicus
gacccagactcagcccttctttttg

SEQ ID NO: 457301 - DNA, 25 bp, Rattus norvegicus
cccgctgcagatgaaccggacgagc

SEQ ID NO: 457302 - DNA, 25 bp, Rattus norvegicus
taggcttcttcccagcactctgctg

SEQ ID NO: 457303 - DNA, 25 bp, Rattus norvegicus
cagtcagaactggtcgctggcggct

SEQ ID NO: 457304 - DNA, 25 bp, Rattus norvegicus
cgcggggacagtttcctccagtatt

SEQ ID NO: 457305 - DNA, 25 bp, Rattus norvegicus
gcagggctggatcctttgacccaga

SEQ ID NO: 457306 - DNA, 25 bp, Rattus norvegicus
cggtcaccgcttgggtccaaggccg

SEQ ID NO: 457307 - DNA, 25 bp, Rattus norvegicus
cacttccgctggtgtcttccctttt

SEQ ID NO: 457308 - DNA, 25 bp, Rattus norvegicus
ctcagtgattacacagcacgttccc

SEQ ID NO: 457309 - DNA, 25 bp, Rattus norvegicus
cctccgcgtctcagtgattacacag

SEQ ID NO: 457310 - DNA, 25 bp, Rattus norvegicus
tccggcattttagaagccgcaagcc

SEQ ID NO: 457311 - DNA, 25 bp, Rattus norvegicus
tgcacctaggtaatccggcatttta

SEQ ID NO: 457312 - DNA, 25 bp, Rattus norvegicus
tccgctggtctgcacctaggtaatc

SEQ ID NO: 457313 - DNA, 25 bp, Rattus norvegicus
ctctttggttttccgctggtctgca

SEQ ID NO: 457314 - DNA, 25 bp, Rattus norvegicus
tgtcgtccttctcatcctctttggt

SEQ ID NO: 457315 - DNA, 25 bp, Rattus norvegicus
ggatgggcttgtcgtccttctcatc

SEQ ID NO: 457316 - DNA, 25 bp, Rattus norvegicus
ctctcacctcggatgggcttgtcgt

SEQ ID NO: 457317 - DNA, 25 bp, Rattus norvegicus
cgtgtcctctcacctcggatgggct

SEQ ID NO: 457318 - DNA, 25 bp, Rattus norvegicus
gtccaaggccgaccggtgccagagc

SEQ ID NO: 457319 - DNA, 25 bp, Rattus norvegicus
ccaccggaagtagctcagcgctctg

SEQ ID NO: 457320 - DNA, 25 bp, Rattus norvegicus
ctcttctaaccgacaacccttcctg

SEQ ID NO: 457321 - DNA, 25 bp, Rattus norvegicus
tgctacccgggcgtccgagcaaccg

SEQ ID NO: 457322 - DNA, 25 bp, Rattus norvegicus
gagcaaccgccagcgtccgaaggct

SEQ ID NO: 457323 - DNA, 25 bp, Rattus norvegicus
gcaaccgccagcgtccgaaggctag

SEQ ID NO: 457324 - DNA, 25 bp, Rattus norvegicus
aaccgccagcgtccgaaggctagga

SEQ ID NO: 457325 - DNA, 25 bp, Rattus norvegicus
gccagcgtccgaaggctaggacccg

SEQ ID NO: 457326 - DNA, 25 bp, Rattus norvegicus
cgacaacccttcctgaacgcccgtg

SEQ ID NO: 457327 - DNA, 25 bp, Rattus norvegicus
tgagcggtgtcacaaagggcggggc

SEQ ID NO: 457328 - DNA, 25 bp, Rattus norvegicus
ccctcgcgggctgattggagggcgt

SEQ ID NO: 457329 - DNA, 25 bp, Rattus norvegicus
attggagggcgtcggcagcgctgat

SEQ ID NO: 457330 - DNA, 25 bp, Rattus norvegicus
tcggcagcgctgatcggcgattggt

SEQ ID NO: 457331 - DNA, 25 bp, Rattus norvegicus
ggcgattggtgagcggtgtcacaaa

SEQ ID NO: 457332 - DNA, 25 bp, Rattus norvegicus
tcctgaacgcccgtgctacccgggc

SEQ ID NO: 457333 - DNA, 25 bp, Rattus norvegicus
agcttcgcgggccagcgtcggccgg

SEQ ID NO: 457334 - DNA, 25 bp, Rattus norvegicus
gcgtccggcctgtgtcatgcaggaa

SEQ ID NO: 457335 - DNA, 25 bp, Rattus norvegicus
tcacgtgaccggtcagtcggcgtcc

SEQ ID NO: 457336 - DNA, 25 bp, Rattus norvegicus
cgacgggccatgtgaccagcgtgtc

SEQ ID NO: 457337 - DNA, 25 bp, Rattus norvegicus
agcaacgcttttgcctgaggcgcga

SEQ ID NO: 457338 - DNA, 25 bp, Rattus norvegicus
caggtcgcctcagcaacgcttttgc

SEQ ID NO: 457339 - DNA, 25 bp, Rattus norvegicus
taccagagggcagccgctgttaccc

SEQ ID NO: 457340 - DNA, 25 bp, Rattus norvegicus
agcgccatctaccagagggcagccg

SEQ ID NO: 457341 - DNA, 25 bp, Rattus norvegicus
agtctaataacagcctcacccagcg

SEQ ID NO: 457342 - DNA, 25 bp, Rattus norvegicus
tctcaggtgaagtcttgcggcggct

SEQ ID NO: 457343 - DNA, 25 bp, Rattus norvegicus
ccacctgagctgcttgcgccgaggt

SEQ ID NO: 457344 - DNA, 25 bp, Rattus norvegicus
cggccgaaggtctcgggcgctctca

SEQ ID NO: 457345 - DNA, 25 bp, Rattus norvegicus
ctcgggcgctctcaggtgaagtctt

SEQ ID NO: 457346 - DNA, 25 bp, Rattus norvegicus
gggcggagtctaataacagcctcac

SEQ ID NO: 457347 - DNA, 25 bp, Rattus norvegicus
ggtgtaggctgcgtactgacccagc

SEQ ID NO: 457348 - DNA, 25 bp, Rattus norvegicus
aaatgtagtcgtcggtgcccgcgaa

SEQ ID NO: 457349 - DNA, 25 bp, Rattus norvegicus
agaagatgcttctcactgcagcccg

SEQ ID NO: 457350 - DNA, 25 bp, Rattus norvegicus
tgtagaaagctttgtcaagaagatg

SEQ ID NO: 457351 - DNA, 25 bp, Rattus norvegicus
ctcgaagtcattgtagaaagctttg

SEQ ID NO: 457352 - DNA, 25 bp, Rattus norvegicus
ccgcgctcgaagtcattgtagaaag

SEQ ID NO: 457353 - DNA, 25 bp, Rattus norvegicus
gatgcttctcactgcagcccgcaga

SEQ ID NO: 457354 - DNA, 25 bp, Rattus norvegicus
ctgcagcccgcagagccaatgaggc

SEQ ID NO: 457355 - DNA, 25 bp, Rattus norvegicus
caatgaggctgaggtaaatgtagtc

SEQ ID NO: 457356 - DNA, 25 bp, Rattus norvegicus
gtagtcgtcggtgcccgcgaaccac

SEQ ID NO: 457357 - DNA, 25 bp, Rattus norvegicus
gcgaaccactggctaccgggggcta

SEQ ID NO: 457358 - DNA, 25 bp, Rattus norvegicus
ctacggtgacagtgtaggaaggcat

SEQ ID NO: 457359 - DNA, 25 bp, Rattus norvegicus
tgacagtgtaggaaggcatggctct

SEQ ID NO: 457360 - DNA, 25 bp, Rattus norvegicus
cgccgcgctcgaagtcattgtagaa

SEQ ID NO: 457361 - DNA, 25 bp, Rattus norvegicus
ccgcagagccaatgaggctgaggta

SEQ ID NO: 457362 - DNA, 25 bp, Rattus norvegicus
gcttaccactcagaaggcagaccca

SEQ ID NO: 457363 - DNA, 25 bp, Rattus norvegicus
cggtgcagcctacgcagtcgtacaa

SEQ ID NO: 457364 - DNA, 25 bp, Rattus norvegicus
aggcctggcgcactcaccgtgcagg

SEQ ID NO: 457365 - DNA, 25 bp, Rattus norvegicus
ccgaggcgctcaggccgagactgac

SEQ ID NO: 457366 - DNA, 25 bp, Rattus norvegicus
agtctttctccgcagcgagccgagg

SEQ ID NO: 457367 - DNA, 25 bp, Rattus norvegicus
gcagtcgtacaatggagtctttctc

SEQ ID NO: 457368 - DNA, 25 bp, Rattus norvegicus
gaggcggagagaccctctatggtcc

SEQ ID NO: 457369 - DNA, 25 bp, Rattus norvegicus
acaatggcccggtgcagcctacgca

SEQ ID NO: 457370 - DNA, 25 bp, Rattus norvegicus
ccaccgagtcctgcggcttctttag

SEQ ID NO: 457371 - DNA, 25 bp, Rattus norvegicus
ctgcggcttctttaggcggtccttt

SEQ ID NO: 457372 - DNA, 25 bp, Rattus norvegicus
tattcctcgcttaccactcagaagg

SEQ ID NO: 457373 - DNA, 25 bp, Rattus norvegicus
gcaaggccaagtacccgctctcttt

SEQ ID NO: 457374 - DNA, 25 bp, Rattus norvegicus
agtacccgctctctttctattccgg

SEQ ID NO: 457375 - DNA, 25 bp, Rattus norvegicus
gcggtccttttgtattcctcgctta

SEQ ID NO: 457376 - DNA, 25 bp, Rattus norvegicus
tgagcatcactcaccgtccagtcat

SEQ ID NO: 457377 - DNA, 25 bp, Rattus norvegicus
tggggtgctccaagaacgcccacta

SEQ ID NO: 457378 - DNA, 25 bp, Rattus norvegicus
ccagaggccaccagcaagagagttc

SEQ ID NO: 457379 - DNA, 25 bp, Rattus norvegicus
agattcgcgcactgcggccggtcgc

SEQ ID NO: 457380 - DNA, 25 bp, Rattus norvegicus
gctctagcgccctgactgatcgcga

SEQ ID NO: 457381 - DNA, 25 bp, Rattus norvegicus
acgcccactaccttggcagtctgag

SEQ ID NO: 457382 - DNA, 25 bp, Rattus norvegicus
accttggcagtctgagcatcactca

SEQ ID NO: 457383 - DNA, 25 bp, Rattus norvegicus
agtcatcgcgcggtccagaggccac

SEQ ID NO: 457384 - DNA, 25 bp, Rattus norvegicus
agagagttcgcctgcaccagaatag

SEQ ID NO: 457385 - DNA, 25 bp, Rattus norvegicus
caccagaatagtgccggcgccgatt

SEQ ID NO: 457386 - DNA, 25 bp, Rattus norvegicus
cgccgattccaaagccgggcatctg

SEQ ID NO: 457387 - DNA, 25 bp, Rattus norvegicus
gcatctgcggcagggatcaagtccg

SEQ ID NO: 457388 - DNA, 25 bp, Rattus norvegicus
cagggatcaagtccgccctagtcca

SEQ ID NO: 457389 - DNA, 25 bp, Rattus norvegicus
cgcgggtacaagtgctcatgctcta

SEQ ID NO: 457390 - DNA, 25 bp, Rattus norvegicus
tgtgtttctatggcatccgtgctcc

SEQ ID NO: 457391 - DNA, 25 bp, Rattus norvegicus
tttctatggcatccgtgctccgtgt

SEQ ID NO: 457392 - DNA, 25 bp, Rattus norvegicus
tctatggcatccgtgctccgtgtgt

SEQ ID NO: 457393 - DNA, 25 bp, Rattus norvegicus
cgtgtgtttctatggcatccgtgct

SEQ ID NO: 457394 - DNA, 25 bp, Rattus norvegicus
gtgtttctatggcatccgtgctccg

SEQ ID NO: 457395 - DNA, 25 bp, Rattus norvegicus
gctccgtgtgtttctatggcatccg

SEQ ID NO: 457396 - DNA, 25 bp, Rattus norvegicus
tgtttctatggcatccgtgctccgt

SEQ ID NO: 457397 - DNA, 25 bp, Rattus norvegicus
ctccgtgtgtttctatggcatccgt

SEQ ID NO: 457398 - DNA, 25 bp, Rattus norvegicus
gtttctatggcatccgtgctccgtg

SEQ ID NO: 457399 - DNA, 25 bp, Rattus norvegicus
ccgtgtgtttctatggcatccgtgc

SEQ ID NO: 457400 - DNA, 25 bp, Rattus norvegicus
ctatggcatccgtgctccgtgtgtt

SEQ ID NO: 457401 - DNA, 25 bp, Rattus norvegicus
tccgtgtgtttctatggcatccgtg

SEQ ID NO: 457402 - DNA, 25 bp, Rattus norvegicus
tatggcatccgtgctccgtgtgttt

SEQ ID NO: 457403 - DNA, 25 bp, Rattus norvegicus
ttctatggcatccgtgctccgtgtg

SEQ ID NO: 457404 - DNA, 25 bp, Rattus norvegicus
agagttcttccaccggcaagcccga

SEQ ID NO: 457405 - DNA, 25 bp, Rattus norvegicus
tacttccactccaaactcagctggg

SEQ ID NO: 457406 - DNA, 25 bp, Rattus norvegicus
agggacggagcagaagcacatcatc

SEQ ID NO: 457407 - DNA, 25 bp, Rattus norvegicus
agcctgaagattcctcgcgccgagc

SEQ ID NO: 457408 - DNA, 25 bp, Rattus norvegicus
tggagtggcagcctgaagattcctc

SEQ ID NO: 457409 - DNA, 25 bp, Rattus norvegicus
ccggtggcgctccagagccaggact

SEQ ID NO: 457410 - DNA, 25 bp, Rattus norvegicus
tgccgtgactcctcccggaagggca

SEQ ID NO: 457411 - DNA, 25 bp, Rattus norvegicus
aggactcggcaggatgccgtgactc

SEQ ID NO: 457412 - DNA, 25 bp, Rattus norvegicus
gcaagcccgagtacccggtaatcta

SEQ ID NO: 457413 - DNA, 25 bp, Rattus norvegicus
cgcgtgagccggagctcagaaatcc

SEQ ID NO: 457414 - DNA, 25 bp, Rattus norvegicus
ggcggattgggagagttcttccacc

SEQ ID NO: 457415 - DNA, 25 bp, Rattus norvegicus
tccaaactcagctgggacagacagc

SEQ ID NO: 457416 - DNA, 25 bp, Rattus norvegicus
taatctagggacagggttccgagga

SEQ ID NO: 457417 - DNA, 25 bp, Rattus norvegicus
gtgtgacactgactcacgcacgtgc

SEQ ID NO: 457418 - DNA, 25 bp, Rattus norvegicus
cgctgcgcctttttcttcttaccgg

SEQ ID NO: 457419 - DNA, 25 bp, Rattus norvegicus
ttttcggctctaaagcgcccagcgc

SEQ ID NO: 457420 - DNA, 25 bp, Rattus norvegicus
gaaagaagtcgttccgcgcggttca

SEQ ID NO: 457421 - DNA, 25 bp, Rattus norvegicus
cgcggttcactgcaagcgaacttca

SEQ ID NO: 457422 - DNA, 25 bp, Rattus norvegicus
acaccgaggttttgtgctctgcgaa

SEQ ID NO: 457423 - DNA, 25 bp, Rattus norvegicus
gaagcgcagctgcaggacctagaga

SEQ ID NO: 457424 - DNA, 25 bp, Rattus norvegicus
gcgcgccagctgcactcagctagtg

SEQ ID NO: 457425 - DNA, 25 bp, Rattus norvegicus
agttgaccgtgcaggagattcattc

SEQ ID NO: 457426 - DNA, 25 bp, Rattus norvegicus
cgtgtgccagcaaactcttaaagta

SEQ ID NO: 457427 - DNA, 25 bp, Rattus norvegicus
cctcagagtgtagcgagttctctta

SEQ ID NO: 457428 - DNA, 25 bp, Rattus norvegicus
tcttacaacaccctcggggccatga

SEQ ID NO: 457429 - DNA, 25 bp, Rattus norvegicus
gcagctctagagcttgcgccaccag

SEQ ID NO: 457430 - DNA, 25 bp, Rattus norvegicus
tctgcacagttcgttggtccgtagc

SEQ ID NO: 457431 - DNA, 25 bp, Rattus norvegicus
ccgcgctctgcatcagtgacggtga

SEQ ID NO: 457432 - DNA, 25 bp, Rattus norvegicus
cgcgcagcattgcagcggctgctac

SEQ ID NO: 457433 - DNA, 25 bp, Rattus norvegicus
agccgcagacaaggatgcgctggtc

SEQ ID NO: 457434 - DNA, 25 bp, Rattus norvegicus
ggccaaaatcgccagccgcagacaa

SEQ ID NO: 457435 - DNA, 25 bp, Rattus norvegicus
tgtatcttgagcctgccgctccggc

SEQ ID NO: 457436 - DNA, 25 bp, Rattus norvegicus
gggctgtatcttgagcctgccgctc

SEQ ID NO: 457437 - DNA, 25 bp, Rattus norvegicus
ctcgacgccggctttgtctgtctgc

SEQ ID NO: 457438 - DNA, 25 bp, Rattus norvegicus
ctgctacgggctcgacgccggcttt

SEQ ID NO: 457439 - DNA, 25 bp, Rattus norvegicus
ttgtggtccggcgacgcgcagcatt

SEQ ID NO: 457440 - DNA, 25 bp, Rattus norvegicus
tcaaggcacgcgcaggctcctggga

SEQ ID NO: 457441 - DNA, 25 bp, Rattus norvegicus
atagtgcctcaaggcacgcgcaggc

SEQ ID NO: 457442 - DNA, 25 bp, Rattus norvegicus
gcggcgacgcttcccatagtgcctc

SEQ ID NO: 457443 - DNA, 25 bp, Rattus norvegicus
atcttggtttctgccgcggcaccgc

SEQ ID NO: 457444 - DNA, 25 bp, Rattus norvegicus
tccaaccagaaccagccagcgcccg

SEQ ID NO: 457445 - DNA, 25 bp, Rattus norvegicus
ccggccagcgatcttggtttctgcc

SEQ ID NO: 457446 - DNA, 25 bp, Rattus norvegicus
tggaagtagcgcttccctgcctgcg

SEQ ID NO: 457447 - DNA, 25 bp, Rattus norvegicus
gacttgtagttcgagtcctggatga

SEQ ID NO: 457448 - DNA, 25 bp, Rattus norvegicus
ttcgagtcctggatgatgtcccgga

SEQ ID NO: 457449 - DNA, 25 bp, Rattus norvegicus
atgatgtcccggagtcctgcgttac

SEQ ID NO: 457450 - DNA, 25 bp, Rattus norvegicus
cctgcgttaccaggtgtgggttcta

SEQ ID NO: 457451 - DNA, 25 bp, Rattus norvegicus
ccaggtgtgggttctacctacgcaa

SEQ ID NO: 457452 - DNA, 25 bp, Rattus norvegicus
tacctacgcaagaggtgagcagggc

SEQ ID NO: 457453 - DNA, 25 bp, Rattus norvegicus
cagcggtgtcctggtctagacgaga

SEQ ID NO: 457454 - DNA, 25 bp, Rattus norvegicus
ctagacgagagggacatcgctactc

SEQ ID NO: 457455 - DNA, 25 bp, Rattus norvegicus
catcgctactcagagccaggctcag

SEQ ID NO: 457456 - DNA, 25 bp, Rattus norvegicus
ctcagaagctgggaaggcgccctgc

SEQ ID NO: 457457 - DNA, 25 bp, Rattus norvegicus
ccctgcggctgaggtccctcgagtt

SEQ ID NO: 457458 - DNA, 25 bp, Rattus norvegicus
ctgaggtccctcgagttagcagccg

SEQ ID NO: 457459 - DNA, 25 bp, Rattus norvegicus
cggcccattgtctccggaagtggaa

SEQ ID NO: 457460 - DNA, 25 bp, Rattus norvegicus
cccgccaatggtgttagcatcgctg

SEQ ID NO: 457461 - DNA, 25 bp, Rattus norvegicus
acgcgcagctttccttcatggggag

SEQ ID NO: 457462 - DNA, 25 bp, Rattus norvegicus
gatccggaaatggaggacgaaccta

SEQ ID NO: 457463 - DNA, 25 bp, Rattus norvegicus
gcgagggtcatatccgtcccagatc

SEQ ID NO: 457464 - DNA, 25 bp, Rattus norvegicus
tgtcgctctttctgcgtcggctcaa

SEQ ID NO: 457465 - DNA, 25 bp, Rattus norvegicus
tgattcagcctcttctccctaggtg

SEQ ID NO: 457466 - DNA, 25 bp, Rattus norvegicus
cccagcgcctcaaggtaaaagaatg

SEQ ID NO: 457467 - DNA, 25 bp, Rattus norvegicus
tgctggcctagcagaacggtgcaac

SEQ ID NO: 457468 - DNA, 25 bp, Rattus norvegicus
cccggggacgaaaatcagattgaca

SEQ ID NO: 457469 - DNA, 25 bp, Rattus norvegicus
attgagtgtcgtttgtgctcccggc

SEQ ID NO: 457470 - DNA, 25 bp, Rattus norvegicus
cgcgtgcgcaagagtatcattgagt

SEQ ID NO: 457471 - DNA, 25 bp, Rattus norvegicus
tcctaggggccaaactgcgatcccg

SEQ ID NO: 457472 - DNA, 25 bp, Rattus norvegicus
cgcacaaacccttggctgctgattg

SEQ ID NO: 457473 - DNA, 25 bp, Rattus norvegicus
ttgacagccgtgttctcctaggagt

SEQ ID NO: 457474 - DNA, 25 bp, Rattus norvegicus
ggcaccgccatcacccacgctctga

SEQ ID NO: 457475 - DNA, 25 bp, Rattus norvegicus
acgcagagggccctgcctgctggac

SEQ ID NO: 457476 - DNA, 25 bp, Rattus norvegicus
aagcctaggcgcgaggctcagccca

SEQ ID NO: 457477 - DNA, 25 bp, Rattus norvegicus
gttcctgggcgtaaagcctaggcgc

SEQ ID NO: 457478 - DNA, 25 bp, Rattus norvegicus
ccatgcgccggttcctgggcgtaaa

SEQ ID NO: 457479 - DNA, 25 bp, Rattus norvegicus
gcttactggtcgtctccatgcgccg

SEQ ID NO: 457480 - DNA, 25 bp, Rattus norvegicus
atcccggaagtgcttactggtcgtc

SEQ ID NO: 457481 - DNA, 25 bp, Rattus norvegicus
ccgcgaaagctccatcccggaagtg

SEQ ID NO: 457482 - DNA, 25 bp, Rattus norvegicus
gcaggaactgatgcgtctaggaact

SEQ ID NO: 457483 - DNA, 25 bp, Rattus norvegicus
tccagccggtttagagtcatagagg

SEQ ID NO: 457484 - DNA, 25 bp, Rattus norvegicus
ccttggattccagccggtttagagt

SEQ ID NO: 457485 - DNA, 25 bp, Rattus norvegicus
tgacctccggtacgtgcccaccaac

SEQ ID NO: 457486 - DNA, 25 bp, Rattus norvegicus
tgatgcgtctaggaactgttcgttc

SEQ ID NO: 457487 - DNA, 25 bp, Rattus norvegicus
ccaagtttccgtcctgcctcgggcg

SEQ ID NO: 457488 - DNA, 25 bp, Rattus norvegicus
ggtgacagtaaacaagcctcaactg

SEQ ID NO: 457489 - DNA, 25 bp, Rattus norvegicus
ctcctctaggtgctctgagggccgg

SEQ ID NO: 457490 - DNA, 25 bp, Rattus norvegicus
ggtccgaggtcgtagccgcacacct

SEQ ID NO: 457491 - DNA, 25 bp, Rattus norvegicus
acacctctagccgtgcgaaggcggc

SEQ ID NO: 457492 - DNA, 25 bp, Rattus norvegicus
cgggatccgaagtttagagcatttc

SEQ ID NO: 457493 - DNA, 25 bp, Rattus norvegicus
gcatttctgacagggattgggccgc

SEQ ID NO: 457494 - DNA, 25 bp, Rattus norvegicus
tttcacaagactgggcgggacgact

SEQ ID NO: 457495 - DNA, 25 bp, Rattus norvegicus
ctgaagtctagagttgagttcggta

SEQ ID NO: 457496 - DNA, 25 bp, Rattus norvegicus
ggcccgaggcgcctaaagtttcaca

SEQ ID NO: 457497 - DNA, 25 bp, Rattus norvegicus
cacgcctggagaaagcgcgactttt

SEQ ID NO: 457498 - DNA, 25 bp, Rattus norvegicus
agcgcgacttttcctgagggccgta

SEQ ID NO: 457499 - DNA, 25 bp, Rattus norvegicus
cgcggctgtcttgcccggatatttg

SEQ ID NO: 457500 - DNA, 25 bp, Rattus norvegicus
gcgggtcacgctctgtagccagtcc

SEQ ID NO: 457501 - DNA, 25 bp, Rattus norvegicus
actgcctcagctacaactgccaagt

SEQ ID NO: 457502 - DNA, 25 bp, Rattus norvegicus
tcattggtgacatattggcgggccc

SEQ ID NO: 457503 - DNA, 25 bp, Rattus norvegicus
tgagaacaaaaagaagatgcacctg

SEQ ID NO: 457504 - DNA, 25 bp, Rattus norvegicus
ccctggtcatttgaacttccatttc

SEQ ID NO: 457505 - DNA, 25 bp, Rattus norvegicus
aaggggctccgcttccgcaaaagcg

SEQ ID NO: 457506 - DNA, 25 bp, Rattus norvegicus
ccaaaacgctcgtctcaaggggctc

SEQ ID NO: 457507 - DNA, 25 bp, Rattus norvegicus
ggcctgcgcgagttcttactccagc

SEQ ID NO: 457508 - DNA, 25 bp, Rattus norvegicus
caccttagaagtttccctcttcgag

SEQ ID NO: 457509 - DNA, 25 bp, Rattus norvegicus
ccaggttaccggctgcgtacttgac

SEQ ID NO: 457510 - DNA, 25 bp, Rattus norvegicus
tccgactgccgctgtagatcacgcg

SEQ ID NO: 457511 - DNA, 25 bp, Rattus norvegicus
ctctgcgtttttaaggcgtcgggtg

SEQ ID NO: 457512 - DNA, 25 bp, Rattus norvegicus
gggccacacctgcaggcacgctttt

SEQ ID NO: 457513 - DNA, 25 bp, Rattus norvegicus
tcgagcttttccacgcttcggcctg

SEQ ID NO: 457514 - DNA, 25 bp, Rattus norvegicus
tcgaacgcccgtctcggcgtggtga

SEQ ID NO: 457515 - DNA, 25 bp, Rattus norvegicus
gcgtacttgacctgctcaccttaga

SEQ ID NO: 457516 - DNA, 25 bp, Rattus norvegicus
ggctgcgcagttggaagtttccatt

SEQ ID NO: 457517 - DNA, 25 bp, Rattus norvegicus
tatctcacgcctttgctctttggca

SEQ ID NO: 457518 - DNA, 25 bp, Rattus norvegicus
ggtatctcacgcctttgctctttgg

SEQ ID NO: 457519 - DNA, 25 bp, Rattus norvegicus
agggtggtatctcacgcctttgctc

SEQ ID NO: 457520 - DNA, 25 bp, Rattus norvegicus
ggtctagggtggtatctcacgcctt

SEQ ID NO: 457521 - DNA, 25 bp, Rattus norvegicus
gttctgggtctagggtggtatctca

SEQ ID NO: 457522 - DNA, 25 bp, Rattus norvegicus
ttgctcttgtgcgttctgggtctag

SEQ ID NO: 457523 - DNA, 25 bp, Rattus norvegicus
catttgctcttgtgcgttctgggtc

SEQ ID NO: 457524 - DNA, 25 bp, Rattus norvegicus
cgcagttggaagtttccatttgctc

SEQ ID NO: 457525 - DNA, 25 bp, Rattus norvegicus
ctcagggctgcgcagttggaagttt

SEQ ID NO: 457526 - DNA, 25 bp, Rattus norvegicus
actggcaagtccactgcccagggcc

SEQ ID NO: 457527 - DNA, 25 bp, Rattus norvegicus
cccgcgtggagttcctggaactccg

SEQ ID NO: 457528 - DNA, 25 bp, Rattus norvegicus
acgctggcgcggaccgaggtaggca

SEQ ID NO: 457529 - DNA, 25 bp, Rattus norvegicus
tttccatttgctcttgtgcgttctg

SEQ ID NO: 457530 - DNA, 25 bp, Rattus norvegicus
ccggagggtagtcgagagcttctac

SEQ ID NO: 457531 - DNA, 25 bp, Rattus norvegicus
caggatgtttctggagcgccaggta

SEQ ID NO: 457532 - DNA, 25 bp, Rattus norvegicus
cagccaggatgtttctggagcgcca

SEQ ID NO: 457533 - DNA, 25 bp, Rattus norvegicus
gagccgcagccaggatgtttctgga

SEQ ID NO: 457534 - DNA, 25 bp, Rattus norvegicus
tacaccgtctgagggtcggtcaggt

SEQ ID NO: 457535 - DNA, 25 bp, Rattus norvegicus
ttctacaccgtctgagggtcggtca

SEQ ID NO: 457536 - DNA, 25 bp, Rattus norvegicus
tagtcgagagcttctacaccgtctg

SEQ ID NO: 457537 - DNA, 25 bp, Rattus norvegicus
ggcttgggcggcactggctcagccc

SEQ ID NO: 457538 - DNA, 25 bp, Rattus norvegicus
gtgtctaggccaccgagggaagtcc

SEQ ID NO: 457539 - DNA, 25 bp, Rattus norvegicus
ggtcttgttcacgaggctcgccagc

SEQ ID NO: 457540 - DNA, 25 bp, Rattus norvegicus
tagtgcccctcccagggtcttgttc

SEQ ID NO: 457541 - DNA, 25 bp, Rattus norvegicus
gtgcctcgccctgtcccttgctagt

SEQ ID NO: 457542 - DNA, 25 bp, Rattus norvegicus
gggtgcaaacgcctcactgtgcctc

SEQ ID NO: 457543 - DNA, 25 bp, Rattus norvegicus
cgagagcttctacaccgtctgaggg

SEQ ID NO: 457544 - DNA, 25 bp, Rattus norvegicus
cagggccgggcctttctctttacag

SEQ ID NO: 457545 - DNA, 25 bp, Rattus norvegicus
gcctcccactgccaagtcccgccct

SEQ ID NO: 457546 - DNA, 25 bp, Rattus norvegicus
tttctctttacagccaggacacgcc

SEQ ID NO: 457547 - DNA, 25 bp, Rattus norvegicus
gccgccgcggagcaccgccacttcc

SEQ ID NO: 457548 - DNA, 25 bp, Rattus norvegicus
cgggcctttctctttacagccagga

SEQ ID NO: 457549 - DNA, 25 bp, Rattus norvegicus
accagcggtctctggcagcagcggt

SEQ ID NO: 457550 - DNA, 25 bp, Rattus norvegicus
gggagctgtacacctggccagcgcc

SEQ ID NO: 457551 - DNA, 25 bp, Rattus norvegicus
gctgccgcctctggggagctgtaca

SEQ ID NO: 457552 - DNA, 25 bp, Rattus norvegicus
gagacagcggtactcaccgcgctcg

SEQ ID NO: 457553 - DNA, 25 bp, Rattus norvegicus
cgcggcaggagacagcggtactcac

SEQ ID NO: 457554 - DNA, 25 bp, Rattus norvegicus
tccggagcgcgcgtcaataagcgcc

SEQ ID NO: 457555 - DNA, 25 bp, Rattus norvegicus
aaacaggaccagtctccggagcgcg

SEQ ID NO: 457556 - DNA, 25 bp, Rattus norvegicus
agcggtctccaaaacaggaccagtc

SEQ ID NO: 457557 - DNA, 25 bp, Rattus norvegicus
cggtctctggcagcagcggtctcca

SEQ ID NO: 457558 - DNA, 25 bp, Rattus norvegicus
attttactgacggtgtctctgttcg

SEQ ID NO: 457559 - DNA, 25 bp, Rattus norvegicus
catcgagctcatatgcgtcatttta

SEQ ID NO: 457560 - DNA, 25 bp, Rattus norvegicus
tcgcaagatctacatcgagctcata

SEQ ID NO: 457561 - DNA, 25 bp, Rattus norvegicus
gagcccattcgcaagatctacatcg

SEQ ID NO: 457562 - DNA, 25 bp, Rattus norvegicus
ttgtcctcaacagagagcccattcg

SEQ ID NO: 457563 - DNA, 25 bp, Rattus norvegicus
atcgggatggggcttgtcctcaaca

SEQ ID NO: 457564 - DNA, 25 bp, Rattus norvegicus
tactgtccacgatggccattgcgga

SEQ ID NO: 457565 - DNA, 25 bp, Rattus norvegicus
cctgaccgcgctgcattcttactgt

SEQ ID NO: 457566 - DNA, 25 bp, Rattus norvegicus
tgcgtcattttactgacggtgtctc

SEQ ID NO: 457567 - DNA, 25 bp, Rattus norvegicus
ggtatcagtctaggcatccaccctg

SEQ ID NO: 457568 - DNA, 25 bp, Rattus norvegicus
tgggcttcttcgcgccttccctgta

SEQ ID NO: 457569 - DNA, 25 bp, Rattus norvegicus
cgcgctgcattcttactgtccacga

SEQ ID NO: 457570 - DNA, 25 bp, Rattus norvegicus
ccctctgggtatcagtctaggcatc

SEQ ID NO: 457571 - DNA, 25 bp, Rattus norvegicus
tccctgtacatcatccctctgggta

SEQ ID NO: 457572 - DNA, 25 bp, Rattus norvegicus
gacctgcgcgctgtctacgagacca

SEQ ID NO: 457573 - DNA, 25 bp, Rattus norvegicus
ttcctcctgaccttcgacttcgatg

SEQ ID NO: 457574 - DNA, 25 bp, Rattus norvegicus
tgagaccattgtggatgagaacagc

SEQ ID NO: 457575 - DNA, 25 bp, Rattus norvegicus
gccacctatcgggagggctactaca

SEQ ID NO: 457576 - DNA, 25 bp, Rattus norvegicus
cgcgtcttcaagtacctgggtgagc

SEQ ID NO: 457577 - DNA, 25 bp, Rattus norvegicus
catgggcgatttgttgcagttcata

SEQ ID NO: 457578 - DNA, 25 bp, Rattus norvegicus
cagggctcctgcttcgaggttattc

SEQ ID NO: 457579 - DNA, 25 bp, Rattus norvegicus
atttcggatgccaacaccttcggtg

SEQ ID NO: 457580 - DNA, 25 bp, Rattus norvegicus
gtgccgctggccaccacagtttatt

SEQ ID NO: 457581 - DNA, 25 bp, Rattus norvegicus
aggtgctcagcgaatacctgcgtga

SEQ ID NO: 457582 - DNA, 25 bp, Rattus norvegicus
acggcgtgcacttcgagcgcctctt

SEQ ID NO: 457583 - DNA, 25 bp, Rattus norvegicus
agcgcctcttctatgtgggtgatgg

SEQ ID NO: 457584 - DNA, 25 bp, Rattus norvegicus
aaggctgagcccagttccttccgcg

SEQ ID NO: 457585 - DNA, 25 bp, Rattus norvegicus
caatgagtacatgcaacgcgtcttc

SEQ ID NO: 457586 - DNA, 25 bp, Rattus norvegicus
tgcggacaaacctccttccgcttaa

SEQ ID NO: 457587 - DNA, 25 bp, Rattus norvegicus
cctccagacagtcggggtcacaacg

SEQ ID NO: 457588 - DNA, 25 bp, Rattus norvegicus
gcgtgctcacctccagacagtcggg

SEQ ID NO: 457589 - DNA, 25 bp, Rattus norvegicus
gatccagcgcccaccgcgtgctcac

SEQ ID NO: 457590 - DNA, 25 bp, Rattus norvegicus
tccagcacatacttctcctgaagct

SEQ ID NO: 457591 - DNA, 25 bp, Rattus norvegicus
tgccactgcgcactcagcctccagc

SEQ ID NO: 457592 - DNA, 25 bp, Rattus norvegicus
tctccttgttggctccagggcctgc

SEQ ID NO: 457593 - DNA, 25 bp, Rattus norvegicus
gaaggacacggccaccttctccttg

SEQ ID NO: 457594 - DNA, 25 bp, Rattus norvegicus
catcatacaccgtcaccgggaagga

SEQ ID NO: 457595 - DNA, 25 bp, Rattus norvegicus
cggtgcccacacctccggagaaggt

SEQ ID NO: 457596 - DNA, 25 bp, Rattus norvegicus
cagacagtcggggtcacaacggaag

SEQ ID NO: 457597 - DNA, 25 bp, Rattus norvegicus
gcggggagtcgtcttcatcatacac

SEQ ID NO: 457598 - DNA, 25 bp, Rattus norvegicus
gtcttcatcatacaccgtcaccggg

SEQ ID NO: 457599 - DNA, 25 bp, Rattus norvegicus
ttaaactccaccacagcactggcgg

SEQ ID NO: 457600 - DNA, 25 bp, Rattus norvegicus
agcagctagccgcagcgacccggtt

SEQ ID NO: 457601 - DNA, 25 bp, Rattus norvegicus
gtagctacagcaagtgcgggaatga

SEQ ID NO: 457602 - DNA, 25 bp, Rattus norvegicus
aaaagaaaatcagggcgcagcagtc

SEQ ID NO: 457603 - DNA, 25 bp, Rattus norvegicus
gcagcagtctccaagcgctggctta

SEQ ID NO: 457604 - DNA, 25 bp, Rattus norvegicus
gctggcttaagtcgtgggcttccca

SEQ ID NO: 457605 - DNA, 25 bp, Rattus norvegicus
atacgaccagcctgggatgcgcagc

SEQ ID NO: 457606 - DNA, 25 bp, Rattus norvegicus
gccagccaatgtaagcgcgcttatg

SEQ ID NO: 457607 - DNA, 25 bp, Rattus norvegicus
gctcggtgcgcagcgctaacttcgc

SEQ ID NO: 457608 - DNA, 25 bp, Rattus norvegicus
aggactcaccttctcccagtagcgg

SEQ ID NO: 457609 - DNA, 25 bp, Rattus norvegicus
cgcgtctcccaggtacggactcgga

SEQ ID NO: 457610 - DNA, 25 bp, Rattus norvegicus
tcggagccgctctccgttgctgctt

SEQ ID NO: 457611 - DNA, 25 bp, Rattus norvegicus
cttgcacggttccagttgcggtact

SEQ ID NO: 457612 - DNA, 25 bp, Rattus norvegicus
tactgatgagagacctgcgctgcct

SEQ ID NO: 457613 - DNA, 25 bp, Rattus norvegicus
aagatctgtccgcttcgcctgggca

SEQ ID NO: 457614 - DNA, 25 bp, Rattus norvegicus
cgtcaggaggcaaaggaccgaactc

SEQ ID NO: 457615 - DNA, 25 bp, Rattus norvegicus
gccagagctgtccttacgtttttca

SEQ ID NO: 457616 - DNA, 25 bp, Rattus norvegicus
accggctacagtccaacgggctttg

SEQ ID NO: 457617 - DNA, 25 bp, Rattus norvegicus
ttgaaagctctgaatcccgtcgccc

SEQ ID NO: 457618 - DNA, 25 bp, Rattus norvegicus
ggggaacctgccctagacattctag

SEQ ID NO: 457619 - DNA, 25 bp, Rattus norvegicus
ctctcaatcgagtccctccggggaa

SEQ ID NO: 457620 - DNA, 25 bp, Rattus norvegicus
gttgcgcaggcgcactttcaggttt

SEQ ID NO: 457621 - DNA, 25 bp, Rattus norvegicus
ccctgtagacggacgacttttagtg

SEQ ID NO: 457622 - DNA, 25 bp, Rattus norvegicus
gggctcgcgaaagcactcaggttca

SEQ ID NO: 457623 - DNA, 25 bp, Rattus norvegicus
cggcggatgggaaacttgccttcca

SEQ ID NO: 457624 - DNA, 25 bp, Rattus norvegicus
ctggagtgacccgatcctcgctaca

SEQ ID NO: 457625 - DNA, 25 bp, Rattus norvegicus
tttcctgggactcgcagcatagctg

SEQ ID NO: 457626 - DNA, 25 bp, Rattus norvegicus
gcagcaactggaggaagcgcatttc

SEQ ID NO: 457627 - DNA, 25 bp, Rattus norvegicus
attgtccttcgcttgtacccgtcgg

SEQ ID NO: 457628 - DNA, 25 bp, Rattus norvegicus
ttcccgcctagtgcgcaaaatgcgc

SEQ ID NO: 457629 - DNA, 25 bp, Rattus norvegicus
gcatcttcccgcctagtgcgcaaaa

SEQ ID NO: 457630 - DNA, 25 bp, Rattus norvegicus
ctaggaattgcttcccaggtgggac

SEQ ID NO: 457631 - DNA, 25 bp, Rattus norvegicus
gccgcacaatctagcggccctaaat

SEQ ID NO: 457632 - DNA, 25 bp, Rattus norvegicus
agcggccctaaattagctttgcaga

SEQ ID NO: 457633 - DNA, 25 bp, Rattus norvegicus
aaattagctttgcagaggtgcggga

SEQ ID NO: 457634 - DNA, 25 bp, Rattus norvegicus
cgctggtccctggttactgccaaca

SEQ ID NO: 457635 - DNA, 25 bp, Rattus norvegicus
tcctcccttgatgccatctagggct

SEQ ID NO: 457636 - DNA, 25 bp, Rattus norvegicus
tacgcgtgcgtcaactcctcacggt

SEQ ID NO: 457637 - DNA, 25 bp, Rattus norvegicus
ttgatgccatctagggctcacccgc

SEQ ID NO: 457638 - DNA, 25 bp, Rattus norvegicus
cctcaatgcgcggagccaaaggcta

SEQ ID NO: 457639 - DNA, 25 bp, Rattus norvegicus
tgcgcggagccaaaggctaggaatt

SEQ ID NO: 457640 - DNA, 25 bp, Rattus norvegicus
gttactgccaacagcgacctggatg

SEQ ID NO: 457641 - DNA, 25 bp, Rattus norvegicus
gtcatactcgcgctacgcgtgcgtc

SEQ ID NO: 457642 - DNA, 25 bp, Rattus norvegicus
gtccagagcagctctcacctcggtg

SEQ ID NO: 457643 - DNA, 25 bp, Rattus norvegicus
cgagaccctcccaggtcaggggatg

SEQ ID NO: 457644 - DNA, 25 bp, Rattus norvegicus
aatccgagaccctcccaggtcaggg

SEQ ID NO: 457645 - DNA, 25 bp, Rattus norvegicus
caagctcgcccactgcaatccgaga

SEQ ID NO: 457646 - DNA, 25 bp, Rattus norvegicus
aggatcccgcgctagcaagctcgcc

SEQ ID NO: 457647 - DNA, 25 bp, Rattus norvegicus
cgctgcccaacaggatcccgcgcta

SEQ ID NO: 457648 - DNA, 25 bp, Rattus norvegicus
agaccggcctccctcccgctgatct

SEQ ID NO: 457649 - DNA, 25 bp, Rattus norvegicus
ggacgccgacgtggcgggctgacaa

SEQ ID NO: 457650 - DNA, 25 bp, Rattus norvegicus
ccgtggcctctgctgcagatgccgg

SEQ ID NO: 457651 - DNA, 25 bp, Rattus norvegicus
gaggcccgtggcctctgctgcagat

SEQ ID NO: 457652 - DNA, 25 bp, Rattus norvegicus
cacctcggtgacagcggttttaggg

SEQ ID NO: 457653 - DNA, 25 bp, Rattus norvegicus
tctcacctcggtgacagcggtttta

SEQ ID NO: 457654 - DNA, 25 bp, Rattus norvegicus
accctcccaggtcaggggatgcggc

SEQ ID NO: 457655 - DNA, 25 bp, Rattus norvegicus
cagagcagctctcacctcggtgaca

SEQ ID NO: 457656 - DNA, 25 bp, Rattus norvegicus
cgcggagcggaagccttcgcgtaaa

SEQ ID NO: 457657 - DNA, 25 bp, Rattus norvegicus
gtccagagcgcaccgggagcctctg

SEQ ID NO: 457658 - DNA, 25 bp, Rattus norvegicus
ccgggagcctctggggcgcgacgaa

SEQ ID NO: 457659 - DNA, 25 bp, Rattus norvegicus
gcgcgacgaagcgaggctcacctga

SEQ ID NO: 457660 - DNA, 25 bp, Rattus norvegicus
acgaagcgaggctcacctgagcagc

SEQ ID NO: 457661 - DNA, 25 bp, Rattus norvegicus
aagcgaggctcacctgagcagcggc

SEQ ID NO: 457662 - DNA, 25 bp, Rattus norvegicus
cggagcggaagccttcgcgtaaatc

SEQ ID NO: 457663 - DNA, 25 bp, Rattus norvegicus
gaagccttcgcgtaaatccccacag

SEQ ID NO: 457664 - DNA, 25 bp, Rattus norvegicus
cacaggcgccgtccggccaccggca

SEQ ID NO: 457665 - DNA, 25 bp, Rattus norvegicus
gccaccggcaacaacgtccgggata

SEQ ID NO: 457666 - DNA, 25 bp, Rattus norvegicus
cggcaacaacgtccgggatacagcc

SEQ ID NO: 457667 - DNA, 25 bp, Rattus norvegicus
aacaacgtccgggatacagccgccg

SEQ ID NO: 457668 - DNA, 25 bp, Rattus norvegicus
atccggaggcccggtccagagcgca

SEQ ID NO: 457669 - DNA, 25 bp, Rattus norvegicus
gagcggaagccttcgcgtaaatccc

SEQ ID NO: 457670 - DNA, 25 bp, Rattus norvegicus
catgctcacacaggcacggcagcga

SEQ ID NO: 457671 - DNA, 25 bp, Rattus norvegicus
gcatgatcgctgcaaggtttctaca

SEQ ID NO: 457672 - DNA, 25 bp, Rattus norvegicus
cctcggtttgagcatgatcgctgca

SEQ ID NO: 457673 - DNA, 25 bp, Rattus norvegicus
cccggtctagcctcggtttgagcat

SEQ ID NO: 457674 - DNA, 25 bp, Rattus norvegicus
cacagcgggttttctagcctccggt

SEQ ID NO: 457675 - DNA, 25 bp, Rattus norvegicus
ggacgttgcaacacagcgggttttc

SEQ ID NO: 457676 - DNA, 25 bp, Rattus norvegicus
ccagagttcaggacgttgcaacaca

SEQ ID NO: 457677 - DNA, 25 bp, Rattus norvegicus
ccgctgtgccagagttcaggacgtt

SEQ ID NO: 457678 - DNA, 25 bp, Rattus norvegicus
ctgcaaggtttctacaggaacgggg

SEQ ID NO: 457679 - DNA, 25 bp, Rattus norvegicus
ccttctccgctgtgccagagttcag

SEQ ID NO: 457680 - DNA, 25 bp, Rattus norvegicus
catgcgtaaggccaggctccgcctt

SEQ ID NO: 457681 - DNA, 25 bp, Rattus norvegicus
agcacgcatgcgtaaggccaggctc

SEQ ID NO: 457682 - DNA, 25 bp, Rattus norvegicus
ccggtgcccagcacgcatgcgtaag

SEQ ID NO: 457683 - DNA, 25 bp, Rattus norvegicus
acacaggcacggcagcgaccggtgc

SEQ ID NO: 457684 - DNA, 25 bp, Rattus norvegicus
acataggacctgctgtccgggagcg

SEQ ID NO: 457685 - DNA, 25 bp, Rattus norvegicus
gtacaccgcccagctctgaggctta

SEQ ID NO: 457686 - DNA, 25 bp, Rattus norvegicus
ggttgctgacataggacctgctgtc

SEQ ID NO: 457687 - DNA, 25 bp, Rattus norvegicus
ctgcggactacaggttgctgacata

SEQ ID NO: 457688 - DNA, 25 bp, Rattus norvegicus
gccagccctgcggactacaggttgc

SEQ ID NO: 457689 - DNA, 25 bp, Rattus norvegicus
gaacccattaggaacattgaaacga

SEQ ID NO: 457690 - DNA, 25 bp, Rattus norvegicus
ggcacttctgaaacgaacccattag

SEQ ID NO: 457691 - DNA, 25 bp, Rattus norvegicus
tgaaaagccgacttcgtacaccgcc

SEQ ID NO: 457692 - DNA, 25 bp, Rattus norvegicus
tcacgagaacagtgaggcacttctg

SEQ ID NO: 457693 - DNA, 25 bp, Rattus norvegicus
cggttacctccaggtcacgagaaca

SEQ ID NO: 457694 - DNA, 25 bp, Rattus norvegicus
atgaagacgctgttccggttacctc

SEQ ID NO: 457695 - DNA, 25 bp, Rattus norvegicus
tcccgacagcagtgaatgaagacgc

SEQ ID NO: 457696 - DNA, 25 bp, Rattus norvegicus
tctgaggcttatcccgacagcagtg

SEQ ID NO: 457697 - DNA, 25 bp, Rattus norvegicus
tgctgtccgggagcgcttcctcgct

SEQ ID NO: 457698 - DNA, 25 bp, Rattus norvegicus
ttgaccattggccaaaaactgcttg

SEQ ID NO: 457699 - DNA, 25 bp, Rattus norvegicus
ctcgctcgggatttcatgggaacca

SEQ ID NO: 457700 - DNA, 25 bp, Rattus norvegicus
cagcgccgacacttggggaactttc

SEQ ID NO: 457701 - DNA, 25 bp, Rattus norvegicus
ttcctctggaacgtacatcctcgtg

SEQ ID NO: 457702 - DNA, 25 bp, Rattus norvegicus
ggctctggatggatccctcctccga

SEQ ID NO: 457703 - DNA, 25 bp, Rattus norvegicus
tctcgcgcaaatccaggaagccgtg

SEQ ID NO: 457704 - DNA, 25 bp, Rattus norvegicus
atccgcagtggttcttgctcccttc

SEQ ID NO: 457705 - DNA, 25 bp, Rattus norvegicus
cgcctcctttcgtgagattgtaatg

SEQ ID NO: 457706 - DNA, 25 bp, Rattus norvegicus
taatgcatcctcagtacatccgggc

SEQ ID NO: 457707 - DNA, 25 bp, Rattus norvegicus
aagaatttagcaccgcacctctggc

SEQ ID NO: 457708 - DNA, 25 bp, Rattus norvegicus
cctctggcggctacaccatttgaaa

SEQ ID NO: 457709 - DNA, 25 bp, Rattus norvegicus
ggaattttccgctccggctcgcacg

SEQ ID NO: 457710 - DNA, 25 bp, Rattus norvegicus
gctcccttcgggtgattacctgatc

SEQ ID NO: 457711 - DNA, 25 bp, Rattus norvegicus
cgcttaccttggtggttttcctctg

SEQ ID NO: 457712 - DNA, 25 bp, Rattus norvegicus
atcgcatcgtggacgttgccagcca

SEQ ID NO: 457713 - DNA, 25 bp, Rattus norvegicus
agcaggcccgagcttcctgttgtca

SEQ ID NO: 457714 - DNA, 25 bp, Rattus norvegicus
tcctgttgtcaaggcgacgatcctc

SEQ ID NO: 457715 - DNA, 25 bp, Rattus norvegicus
tcaaggcgacgatcctccaggagag

SEQ ID NO: 457716 - DNA, 25 bp, Rattus norvegicus
tcctccaggagaggtccgggccatc

SEQ ID NO: 457717 - DNA, 25 bp, Rattus norvegicus
ccatcgattggcgaggcctagcccg

SEQ ID NO: 457718 - DNA, 25 bp, Rattus norvegicus
gcggtcgattaagagggcttcctga

SEQ ID NO: 457719 - DNA, 25 bp, Rattus norvegicus
ctgggaagggacacgatatcagcct

SEQ ID NO: 457720 - DNA, 25 bp, Rattus norvegicus
ctacatcaatcgcatcgtggacgtt

SEQ ID NO: 457721 - DNA, 25 bp, Rattus norvegicus
cagccaggtggctctgtacactttc

SEQ ID NO: 457722 - DNA, 25 bp, Rattus norvegicus
gctctgtacactttcggccatcggg

SEQ ID NO: 457723 - DNA, 25 bp, Rattus norvegicus
actttcggccatcgggccaacgagt

SEQ ID NO: 457724 - DNA, 25 bp, Rattus norvegicus
aacgagcttcatctagcaggcccga

SEQ ID NO: 457725 - DNA, 25 bp, Rattus norvegicus
gacacgatatcagcctggcagccct

SEQ ID NO: 457726 - DNA, 25 bp, Rattus norvegicus
ggaaccactggcttgtatccaatca

SEQ ID NO: 457727 - DNA, 25 bp, Rattus norvegicus
cctgggctttctacttgttttctgc

SEQ ID NO: 457728 - DNA, 25 bp, Rattus norvegicus
acggagattcccatgtccttacgaa

SEQ ID NO: 457729 - DNA, 25 bp, Rattus norvegicus
cgacagacacggaaccacggagatt

SEQ ID NO: 457730 - DNA, 25 bp, Rattus norvegicus
agcttcgctacacttggcttgggcc

SEQ ID NO: 457731 - DNA, 25 bp, Rattus norvegicus
tgacgtcgggcaaccttttctaagc

SEQ ID NO: 457732 - DNA, 25 bp, Rattus norvegicus
ggcagccttctcaagccacatgacg

SEQ ID NO: 457733 - DNA, 25 bp, Rattus norvegicus
ccagcaaaggctcgggttggttact

SEQ ID NO: 457734 - DNA, 25 bp, Rattus norvegicus
caggtcagtgcaatcccagcaaagg

SEQ ID NO: 457735 - DNA, 25 bp, Rattus norvegicus
tgatcgtccatcctacaggtcagtg

SEQ ID NO: 457736 - DNA, 25 bp, Rattus norvegicus
ctgttcctgaaatgtaagcctgttg

SEQ ID NO: 457737 - DNA, 25 bp, Rattus norvegicus
tccctccagggtaaagttatgttca

SEQ ID NO: 457738 - DNA, 25 bp, Rattus norvegicus
ggccacttcattcgcggctcacaaa

SEQ ID NO: 457739 - DNA, 25 bp, Rattus norvegicus
agcggtactcagacaggcgagcctc

SEQ ID NO: 457740 - DNA, 25 bp, Rattus norvegicus
cgggaggaagacagaccgaagaggg

SEQ ID NO: 457741 - DNA, 25 bp, Rattus norvegicus
actggacagcgcctgtaaaagaggc

SEQ ID NO: 457742 - DNA, 25 bp, Rattus norvegicus
gacagcgcctgtaaaagaggcggac

SEQ ID NO: 457743 - DNA, 25 bp, Rattus norvegicus
gctgtggggtcagcgacaaactgaa

SEQ ID NO: 457744 - DNA, 25 bp, Rattus norvegicus
tgtggggtcagcgacaaactgaagc

SEQ ID NO: 457745 - DNA, 25 bp, Rattus norvegicus
tggggtcagcgacaaactgaagcga

SEQ ID NO: 457746 - DNA, 25 bp, Rattus norvegicus
gcaaaaggatcagagcgcgcgtgct

SEQ ID NO: 457747 - DNA, 25 bp, Rattus norvegicus
gcgacaaactgaagcgaaagaggga

SEQ ID NO: 457748 - DNA, 25 bp, Rattus norvegicus
gcgtgctcaacagcaagcgagcgga

SEQ ID NO: 457749 - DNA, 25 bp, Rattus norvegicus
agagcgcgcgtgctcaacagcaagc

SEQ ID NO: 457750 - DNA, 25 bp, Rattus norvegicus
gtcagcgacaaactgaagcgaaaga

SEQ ID NO: 457751 - DNA, 25 bp, Rattus norvegicus
cgcgcgtgctcaacagcaagcgagc

SEQ ID NO: 457752 - DNA, 25 bp, Rattus norvegicus
gcggagtgacagctggggcgcatct

SEQ ID NO: 457753 - DNA, 25 bp, Rattus norvegicus
agcgcgcgtgctcaacagcaagcga

SEQ ID NO: 457754 - DNA, 25 bp, Rattus norvegicus
acccagcttcctcgacgttttctga

SEQ ID NO: 457755 - DNA, 25 bp, Rattus norvegicus
cgacgttttctgaagagatccgaga

SEQ ID NO: 457756 - DNA, 25 bp, Rattus norvegicus
aacagtgcgggcagagtgcctcagc

SEQ ID NO: 457757 - DNA, 25 bp, Rattus norvegicus
ttcggccgggtccacaatgtaaaca

SEQ ID NO: 457758 - DNA, 25 bp, Rattus norvegicus
catcttggtagttgtagttcggccg

SEQ ID NO: 457759 - DNA, 25 bp, Rattus norvegicus
gctttggaaccatgatgcatcttgg

SEQ ID NO: 457760 - DNA, 25 bp, Rattus norvegicus
cccttacggaggctttggaaccatg

SEQ ID NO: 457761 - DNA, 25 bp, Rattus norvegicus
ggcgggtcgagccagtaagaccaca

SEQ ID NO: 457762 - DNA, 25 bp, Rattus norvegicus
agccgtgacgcgcatcgcacgaggc

SEQ ID NO: 457763 - DNA, 25 bp, Rattus norvegicus
ttccgacccaggcaatctgctgagc

SEQ ID NO: 457764 - DNA, 25 bp, Rattus norvegicus
cggccgcaggtcagagttccggcca

SEQ ID NO: 457765 - DNA, 25 bp, Rattus norvegicus
cccgaaatcgaacagtcggagcgaa

SEQ ID NO: 457766 - DNA, 25 bp, Rattus norvegicus
agcgaagggcttcggactctccgcc

SEQ ID NO: 457767 - DNA, 25 bp, Rattus norvegicus
agccgcgctagcctaaaccggaagc

SEQ ID NO: 457768 - DNA, 25 bp, Rattus norvegicus
gttggtcagttccagcttgccctga

SEQ ID NO: 457769 - DNA, 25 bp, Rattus norvegicus
tgaagcggtcatagccgcggccaca

SEQ ID NO: 457770 - DNA, 25 bp, Rattus norvegicus
gccatccgtgccctctgaggtcttg

SEQ ID NO: 457771 - DNA, 25 bp, Rattus norvegicus
tgaggtcttgttgcagaggcgacct

SEQ ID NO: 457772 - DNA, 25 bp, Rattus norvegicus
ttgcagaggcgaccttgggtgccca

SEQ ID NO: 457773 - DNA, 25 bp, Rattus norvegicus
cccagggagcccgtggtctcatttc

SEQ ID NO: 457774 - DNA, 25 bp, Rattus norvegicus
gcccgtggtctcatttcgcaggcag

SEQ ID NO: 457775 - DNA, 25 bp, Rattus norvegicus
tggggtctacgtagaccaggtcctc

SEQ ID NO: 457776 - DNA, 25 bp, Rattus norvegicus
ctgacgggtgatacgcatggccgca

SEQ ID NO: 457777 - DNA, 25 bp, Rattus norvegicus
ttgaagcggctgttggtcagttcca

SEQ ID NO: 457778 - DNA, 25 bp, Rattus norvegicus
ttccagcttgccctgacgggtgata

SEQ ID NO: 457779 - DNA, 25 bp, Rattus norvegicus
cctggacgctcttgaagcggtcata

SEQ ID NO: 457780 - DNA, 25 bp, Rattus norvegicus
gttccacctggacgctcttgaagcg

SEQ ID NO: 457781 - DNA, 25 bp, Rattus norvegicus
tctacgtagaccaggtcctccgggc

SEQ ID NO: 457782 - DNA, 25 bp, Rattus norvegicus
tagcccagtacctcaagggcctgga

SEQ ID NO: 457783 - DNA, 25 bp, Rattus norvegicus
gaggaagatggagacccacatctcg

SEQ ID NO: 457784 - DNA, 25 bp, Rattus norvegicus
ggaagatggagacccacatctcgtg

SEQ ID NO: 457785 - DNA, 25 bp, Rattus norvegicus
aagatggagacccacatctcgtgcc

SEQ ID NO: 457786 - DNA, 25 bp, Rattus norvegicus
gatggagacccacatctcgtgcctg

SEQ ID NO: 457787 - DNA, 25 bp, Rattus norvegicus
atggagacccacatctcgtgcctgt

SEQ ID NO: 457788 - DNA, 25 bp, Rattus norvegicus
tggagacccacatctcgtgcctgtt

SEQ ID NO: 457789 - DNA, 25 bp, Rattus norvegicus
tgcaagcagatcacagacagcagcc

SEQ ID NO: 457790 - DNA, 25 bp, Rattus norvegicus
gcaagcagatcacagacagcagcct

SEQ ID NO: 457791 - DNA, 25 bp, Rattus norvegicus
aagcagatcacagacagcagcctgg

SEQ ID NO: 457792 - DNA, 25 bp, Rattus norvegicus
atagcccagtacctcaagggcctgg

SEQ ID NO: 457793 - DNA, 25 bp, Rattus norvegicus
gcccagtacctcaagggcctggagg

SEQ ID NO: 457794 - DNA, 25 bp, Rattus norvegicus
ccagtacctcaagggcctggaggtg

SEQ ID NO: 457795 - DNA, 25 bp, Rattus norvegicus
gcatagcccagtacctcaagggcct

SEQ ID NO: 457796 - DNA, 25 bp, Rattus norvegicus
cgaaccgggaaaagcggagcagctc

SEQ ID NO: 457797 - DNA, 25 bp, Rattus norvegicus
actcctgagcttacctgccggggct

SEQ ID NO: 457798 - DNA, 25 bp, Rattus norvegicus
atcgtcgcgcgcaaaactgcagctg

SEQ ID NO: 457799 - DNA, 25 bp, Rattus norvegicus
gcgtccctaccgtccgttcaggcgc

SEQ ID NO: 457800 - DNA, 25 bp, Rattus norvegicus
tgccgaatctgtcctgaggggcgca

SEQ ID NO: 457801 - DNA, 25 bp, Rattus norvegicus
agacactccgcgctgttcgatcgtc

SEQ ID NO: 457802 - DNA, 25 bp, Rattus norvegicus
tgcccgcccggagtgccgaatctgt

SEQ ID NO: 457803 - DNA, 25 bp, Rattus norvegicus
gcggggccgactcctgagcttacct

SEQ ID NO: 457804 - DNA, 25 bp, Rattus norvegicus
cacctggccacacagcgccttcggc

SEQ ID NO: 457805 - DNA, 25 bp, Rattus norvegicus
agctttgttcgcagcggcccgcggt

SEQ ID NO: 457806 - DNA, 25 bp, Rattus norvegicus
ccacgcgccgaacgagcgccgagcc

SEQ ID NO: 457807 - DNA, 25 bp, Rattus norvegicus
tcgcgcgcaaaactgcagctgggcc

SEQ ID NO: 457808 - DNA, 25 bp, Rattus norvegicus
cgctgttcgatcgtcgcgcgcaaaa

SEQ ID NO: 457809 - DNA, 25 bp, Rattus norvegicus
cccggagtgccgaatctgtcctgag

SEQ ID NO: 457810 - DNA, 25 bp, Rattus norvegicus
ggaactatttccactctgcaaaccc

SEQ ID NO: 457811 - DNA, 25 bp, Rattus norvegicus
tgacccgggaactatttccactctg

SEQ ID NO: 457812 - DNA, 25 bp, Rattus norvegicus
ccgggaactatttccactctgcaaa

SEQ ID NO: 457813 - DNA, 25 bp, Rattus norvegicus
acccgggaactatttccactctgca

SEQ ID NO: 457814 - DNA, 25 bp, Rattus norvegicus
tcccgcaagctctgcggggacagtg

SEQ ID NO: 457815 - DNA, 25 bp, Rattus norvegicus
ctctgcggggacagtgcacggcaac

SEQ ID NO: 457816 - DNA, 25 bp, Rattus norvegicus
acagtgcacggcaaccgcgcgtgga

SEQ ID NO: 457817 - DNA, 25 bp, Rattus norvegicus
gagcgcggacgcgtgacttacccgt

SEQ ID NO: 457818 - DNA, 25 bp, Rattus norvegicus
gcgcggacgcgtgacttacccgtac

SEQ ID NO: 457819 - DNA, 25 bp, Rattus norvegicus
ccgtaccctttggagtccggagctg

SEQ ID NO: 457820 - DNA, 25 bp, Rattus norvegicus
accctttggagtccggagctgcgaa

SEQ ID NO: 457821 - DNA, 25 bp, Rattus norvegicus
agctgcgaagtgacccgggaactat

SEQ ID NO: 457822 - DNA, 25 bp, Rattus norvegicus
gctgcgaagtgacccgggaactatt

SEQ ID NO: 457823 - DNA, 25 bp, Rattus norvegicus
cagtgcacggcaaccgcgcgtggac

SEQ ID NO: 457824 - DNA, 25 bp, Rattus norvegicus
ccaggccctccggtgaggagacgca

SEQ ID NO: 457825 - DNA, 25 bp, Rattus norvegicus
agatggcctcgaggcctctgcgcct

SEQ ID NO: 457826 - DNA, 25 bp, Rattus norvegicus
cgcggggacagccatcttggtaaag

SEQ ID NO: 457827 - DNA, 25 bp, Rattus norvegicus
ccatcttggtaaaggccaggcagcg

SEQ ID NO: 457828 - DNA, 25 bp, Rattus norvegicus
cgcgggaaatgacccggctgcagcc

SEQ ID NO: 457829 - DNA, 25 bp, Rattus norvegicus
gctgcagcctaggaccgcatagtca

SEQ ID NO: 457830 - DNA, 25 bp, Rattus norvegicus
cctaggaccgcatagtcagagacga

SEQ ID NO: 457831 - DNA, 25 bp, Rattus norvegicus
gcatagtcagagacgaccgccgcca

SEQ ID NO: 457832 - DNA, 25 bp, Rattus norvegicus
cgctaacccgctgcgtgcagctgtt

SEQ ID NO: 457833 - DNA, 25 bp, Rattus norvegicus
ccctccggtgaggagacgcagcgca

SEQ ID NO: 457834 - DNA, 25 bp, Rattus norvegicus
tggcggcaaaggtagcagctcccag

SEQ ID NO: 457835 - DNA, 25 bp, Rattus norvegicus
actttaccaagatggcctcgaggcc

SEQ ID NO: 457836 - DNA, 25 bp, Rattus norvegicus
gctgcgccgactttaccaagatggc

SEQ ID NO: 457837 - DNA, 25 bp, Rattus norvegicus
tgcagctgttactgtcctcggcgga

SEQ ID NO: 457838 - DNA, 25 bp, Rattus norvegicus
cgcaggatcgagaagtgcggcactt

SEQ ID NO: 457839 - DNA, 25 bp, Rattus norvegicus
caggagtggagtggcctttcccaaa

SEQ ID NO: 457840 - DNA, 25 bp, Rattus norvegicus
tgcttgccgtaggacgtggactgct

SEQ ID NO: 457841 - DNA, 25 bp, Rattus norvegicus
tctgactcctcctgcttgccgtagg

SEQ ID NO: 457842 - DNA, 25 bp, Rattus norvegicus
agagttgcgccacacgtagcgccgc

SEQ ID NO: 457843 - DNA, 25 bp, Rattus norvegicus
gtgccgaggcagagttgcgccacac

SEQ ID NO: 457844 - DNA, 25 bp, Rattus norvegicus
aagtgcggcacttcgaggccgctaa

SEQ ID NO: 457845 - DNA, 25 bp, Rattus norvegicus
tggcctttcccaaacctggagtcgc

SEQ ID NO: 457846 - DNA, 25 bp, Rattus norvegicus
accgcgccgcaggatcgagaagtgc

SEQ ID NO: 457847 - DNA, 25 bp, Rattus norvegicus
cctgacgcgagagcggctgccgact

SEQ ID NO: 457848 - DNA, 25 bp, Rattus norvegicus
cagttcgaggttccgcctgacgcga

SEQ ID NO: 457849 - DNA, 25 bp, Rattus norvegicus
acgacaaatgcctcggcgcctgcga

SEQ ID NO: 457850 - DNA, 25 bp, Rattus norvegicus
agagcccggtcggaaacgacaaatg

SEQ ID NO: 457851 - DNA, 25 bp, Rattus norvegicus
acttcgaggccgctaaggtaactgg

SEQ ID NO: 457852 - DNA, 25 bp, Rattus norvegicus
gtggtatcgcggctccaacacgacc

SEQ ID NO: 457853 - DNA, 25 bp, Rattus norvegicus
accctggctgtaggatggctgattg

SEQ ID NO: 457854 - DNA, 25 bp, Rattus norvegicus
gctgattgctgcagaccgcaactta

SEQ ID NO: 457855 - DNA, 25 bp, Rattus norvegicus
agcgagcgaatcaggatgccaaatc

SEQ ID NO: 457856 - DNA, 25 bp, Rattus norvegicus
ctcgccacgagatttgcgacagtcg

SEQ ID NO: 457857 - DNA, 25 bp, Rattus norvegicus
tctctgcacaaggtgacacgcgcgc

SEQ ID NO: 457858 - DNA, 25 bp, Rattus norvegicus
ctttgctgctctcgtcgacttcgga

SEQ ID NO: 457859 - DNA, 25 bp, Rattus norvegicus
cttcggacttgacttacggctcctc

SEQ ID NO: 457860 - DNA, 25 bp, Rattus norvegicus
acggctcctcttctgttattctttg

SEQ ID NO: 457861 - DNA, 25 bp, Rattus norvegicus
gggctcagaccttcttcccagcgtt

SEQ ID NO: 457862 - DNA, 25 bp, Rattus norvegicus
ttcttcccagcgttccctgagcttg

SEQ ID NO: 457863 - DNA, 25 bp, Rattus norvegicus
ctgagcttgcgcctcgatctcttct

SEQ ID NO: 457864 - DNA, 25 bp, Rattus norvegicus
gctgtagtagcggttctctgcacaa

SEQ ID NO: 457865 - DNA, 25 bp, Rattus norvegicus
ctcatttagggagacctagtccgga

SEQ ID NO: 457866 - DNA, 25 bp, Rattus norvegicus
tcctctttgctacccacgaggctgg

SEQ ID NO: 457867 - DNA, 25 bp, Rattus norvegicus
tcgcccacggaagaatcggagcttg

SEQ ID NO: 457868 - DNA, 25 bp, Rattus norvegicus
ccggtattcctctgtcctgccaatt

SEQ ID NO: 457869 - DNA, 25 bp, Rattus norvegicus
cccacgactgtccttgtccatagtg

SEQ ID NO: 457870 - DNA, 25 bp, Rattus norvegicus
gcgggctcggatttatgaatgaaaa

SEQ ID NO: 457871 - DNA, 25 bp, Rattus norvegicus
cgcttcggcggaaaaatcggtgctc

SEQ ID NO: 457872 - DNA, 25 bp, Rattus norvegicus
tggcccggagaagccaccaagaagt

SEQ ID NO: 457873 - DNA, 25 bp, Rattus norvegicus
gcattggagtcgcagatgacgcttc

SEQ ID NO: 457874 - DNA, 25 bp, Rattus norvegicus
cggcagctccaacgccgtggcattg

SEQ ID NO: 457875 - DNA, 25 bp, Rattus norvegicus
actctgaggcaccactgcgggtaca

SEQ ID NO: 457876 - DNA, 25 bp, Rattus norvegicus
ggtggccgtcaaagtttcctctctg

SEQ ID NO: 457877 - DNA, 25 bp, Rattus norvegicus
agcagccgagggttgctgagacacc

SEQ ID NO: 457878 - DNA, 25 bp, Rattus norvegicus
tggccgagcctacaacggcttgttc

SEQ ID NO: 457879 - DNA, 25 bp, Rattus norvegicus
cggagcttgagccattcttggggac

SEQ ID NO: 457880 - DNA, 25 bp, Rattus norvegicus
ctgctacgatctagaaagttcacgc

SEQ ID NO: 457881 - DNA, 25 bp, Rattus norvegicus
ccatcggagagccaggcagccggcg

SEQ ID NO: 457882 - DNA, 25 bp, Rattus norvegicus
tctgccgagccaccggccgaaaccc

SEQ ID NO: 457883 - DNA, 25 bp, Rattus norvegicus
ctctttctctctgccgagccaccgg

SEQ ID NO: 457884 - DNA, 25 bp, Rattus norvegicus
ggactttgccctttgtctctctctc

SEQ ID NO: 457885 - DNA, 25 bp, Rattus norvegicus
cgggactttgccctttgtctctctc

SEQ ID NO: 457886 - DNA, 25 bp, Rattus norvegicus
ggcacccggggacgctcagcgggtc

SEQ ID NO: 457887 - DNA, 25 bp, Rattus norvegicus
aagttcacgcaccaagacgccctgg

SEQ ID NO: 457888 - DNA, 25 bp, Rattus norvegicus
ctagaaagttcacgcaccaagacgc

SEQ ID NO: 457889 - DNA, 25 bp, Rattus norvegicus
gtgggctgttgcactgcacagggac

SEQ ID NO: 457890 - DNA, 25 bp, Rattus norvegicus
ctacgatctagaaagttcacgcacc

SEQ ID NO: 457891 - DNA, 25 bp, Rattus norvegicus
ccctctgctacgatctagaaagttc

SEQ ID NO: 457892 - DNA, 25 bp, Rattus norvegicus
gatctagaaagttcacgcaccaaga

SEQ ID NO: 457893 - DNA, 25 bp, Rattus norvegicus
ccatccctctgctacgatctagaaa

SEQ ID NO: 457894 - DNA, 25 bp, Rattus norvegicus
ggcctaggaggaacgcgcctactac

SEQ ID NO: 457895 - DNA, 25 bp, Rattus norvegicus
tgaaaaccgtgaaatgggcctagga

SEQ ID NO: 457896 - DNA, 25 bp, Rattus norvegicus
tctgagtgaaaaccgtgaaatgggc

SEQ ID NO: 457897 - DNA, 25 bp, Rattus norvegicus
gatttgtagtttctgagtgaaaacc

SEQ ID NO: 457898 - DNA, 25 bp, Rattus norvegicus
ctcgagacacgatgggatttgtagt

SEQ ID NO: 457899 - DNA, 25 bp, Rattus norvegicus
cggagctcgagacacgatgggattt

SEQ ID NO: 457900 - DNA, 25 bp, Rattus norvegicus
tgaagcctccacacagcccgcttgg

SEQ ID NO: 457901 - DNA, 25 bp, Rattus norvegicus
gccgatgtctgaagcctccacacag

SEQ ID NO: 457902 - DNA, 25 bp, Rattus norvegicus
ggcgccgatgtctgaagcctccaca

SEQ ID NO: 457903 - DNA, 25 bp, Rattus norvegicus
aaatggcgccgatgtctgaagcctc

SEQ ID NO: 457904 - DNA, 25 bp, Rattus norvegicus
tccgctttaaatggcgccgatgtct

SEQ ID NO: 457905 - DNA, 25 bp, Rattus norvegicus
aacgcgcctactacttccgtgatgc

SEQ ID NO: 457906 - DNA, 25 bp, Rattus norvegicus
gcagaagaaacgcgtccgcccggga

SEQ ID NO: 457907 - DNA, 25 bp, Rattus norvegicus
ggaaactctccgctttaaatggcgc

SEQ ID NO: 457908 - DNA, 25 bp, Rattus norvegicus
gggccgacgctaccagctccagata

SEQ ID NO: 457909 - DNA, 25 bp, Rattus norvegicus
ccactcatgctcagcgcgcagaggt

SEQ ID NO: 457910 - DNA, 25 bp, Rattus norvegicus
ctctgcccaggaggctctcctagtt

SEQ ID NO: 457911 - DNA, 25 bp, Rattus norvegicus
ctgtctcggaggtgctatttgaaaa

SEQ ID NO: 457912 - DNA, 25 bp, Rattus norvegicus
agcagcatcagcaacgccacgcggg

SEQ ID NO: 457913 - DNA, 25 bp, Rattus norvegicus
agcgcctccttagcagcttgatcgg

SEQ ID NO: 457914 - DNA, 25 bp, Rattus norvegicus
gctccagatacagagtccagagtcc

SEQ ID NO: 457915 - DNA, 25 bp, Rattus norvegicus
cggcacctggaatctactccgagag

SEQ ID NO: 457916 - DNA, 25 bp, Rattus norvegicus
cccggcgctacttactgtggttcag

SEQ ID NO: 457917 - DNA, 25 bp, Rattus norvegicus
gggcaagccaggatcagagacccta

SEQ ID NO: 457918 - DNA, 25 bp, Rattus norvegicus
agaccttcaccagcgctccggatgt

SEQ ID NO: 457919 - DNA, 25 bp, Rattus norvegicus
aaacggcgcgtttctctgttcgcga

SEQ ID NO: 457920 - DNA, 25 bp, Rattus norvegicus
cagagagtcaaccacgccggcaagc

SEQ ID NO: 457921 - DNA, 25 bp, Rattus norvegicus
agttagggcgctttctctcagctcc

SEQ ID NO: 457922 - DNA, 25 bp, Rattus norvegicus
ggaggagttcacagacccgctaagt

SEQ ID NO: 457923 - DNA, 25 bp, Rattus norvegicus
tgcagaaccttgaccggcaagctga

SEQ ID NO: 457924 - DNA, 25 bp, Rattus norvegicus
cggtggcggactgatttagcagtac

SEQ ID NO: 457925 - DNA, 25 bp, Rattus norvegicus
tagcagtacgttaacttccggaagc

SEQ ID NO: 457926 - DNA, 25 bp, Rattus norvegicus
gaagcgtcctgtccctgagaggaaa

SEQ ID NO: 457927 - DNA, 25 bp, Rattus norvegicus
aacaaacgacaggaggaagcgcttc

SEQ ID NO: 457928 - DNA, 25 bp, Rattus norvegicus
ccaccttgcggggtagcttcttcct

SEQ ID NO: 457929 - DNA, 25 bp, Rattus norvegicus
ctctcctaagaagatgcgctgcggc

SEQ ID NO: 457930 - DNA, 25 bp, Rattus norvegicus
cacgcacccagagtggacggagagt

SEQ ID NO: 457931 - DNA, 25 bp, Rattus norvegicus
ttttatcggtcgcatccggcctctg

SEQ ID NO: 457932 - DNA, 25 bp, Rattus norvegicus
ctctggctgagaaaactggcatctg

SEQ ID NO: 457933 - DNA, 25 bp, Rattus norvegicus
cgtccacccaaggtagcggagcctg

SEQ ID NO: 457934 - DNA, 25 bp, Rattus norvegicus
gcttctgggtcttctgtgaggaata

SEQ ID NO: 457935 - DNA, 25 bp, Rattus norvegicus
gcgagaagacccgactagacgtggc

SEQ ID NO: 457936 - DNA, 25 bp, Rattus norvegicus
gatggctgcttctgctgttgagcgc

SEQ ID NO: 457937 - DNA, 25 bp, Rattus norvegicus
gctttacgacgacgagatggactcg

SEQ ID NO: 457938 - DNA, 25 bp, Rattus norvegicus
ggagcctgaaagtccgccctagaga

SEQ ID NO: 457939 - DNA, 25 bp, Rattus norvegicus
tggactcgtttcttcattaacagcg

SEQ ID NO: 457940 - DNA, 25 bp, Rattus norvegicus
ccggctctagtctgctcgcaggagg

SEQ ID NO: 457941 - DNA, 25 bp, Rattus norvegicus
ccgcggcgggaattagactaaaatg

SEQ ID NO: 457942 - DNA, 25 bp, Rattus norvegicus
cgatcagtatcaagcgggagggttc

SEQ ID NO: 457943 - DNA, 25 bp, Rattus norvegicus
gttcgatagcgaggacagtcacggc

SEQ ID NO: 457944 - DNA, 25 bp, Rattus norvegicus
cagtcacggctccacagcaagttga

SEQ ID NO: 457945 - DNA, 25 bp, Rattus norvegicus
tcaaaggtgatgagagccgtcggct

SEQ ID NO: 457946 - DNA, 25 bp, Rattus norvegicus
ggttccggtctttcagagatgcatc

SEQ ID NO: 457947 - DNA, 25 bp, Rattus norvegicus
ggcgaagtcgacctgcgtcagtcct

SEQ ID NO: 457948 - DNA, 25 bp, Rattus norvegicus
tcctcggctaggaaagcccgtcgtg

SEQ ID NO: 457949 - DNA, 25 bp, Rattus norvegicus
aaacagtcttcgttgagtcccgcgg

SEQ ID NO: 457950 - DNA, 25 bp, Rattus norvegicus
ccttaggagtgaaagcgatggagta

SEQ ID NO: 457951 - DNA, 25 bp, Rattus norvegicus
ggtacaggtccagcagaccgccctg

SEQ ID NO: 457952 - DNA, 25 bp, Rattus norvegicus
cagtgacagcgatgaggtacaggtc

SEQ ID NO: 457953 - DNA, 25 bp, Rattus norvegicus
agcaccagtacaggtcagtgacagc

SEQ ID NO: 457954 - DNA, 25 bp, Rattus norvegicus
gcgatccaggagcaccagtacaggt

SEQ ID NO: 457955 - DNA, 25 bp, Rattus norvegicus
ccaccaggtcggtggcgatccagga

SEQ ID NO: 457956 - DNA, 25 bp, Rattus norvegicus
ttcttggcgaagaagatggcccagc

SEQ ID NO: 457957 - DNA, 25 bp, Rattus norvegicus
cccggctgttcttggcgaagaagat

SEQ ID NO: 457958 - DNA, 25 bp, Rattus norvegicus
cagctcgatgaggtccaggatggat

SEQ ID NO: 457959 - DNA, 25 bp, Rattus norvegicus
agtagatgagccaggccaggtacgc

SEQ ID NO: 457960 - DNA, 25 bp, Rattus norvegicus
gatgctaatgctctcgtcgtcgtcc

SEQ ID NO: 457961 - DNA, 25 bp, Rattus norvegicus
tgcccaggatgagcacaaccttagg

SEQ ID NO: 457962 - DNA, 25 bp, Rattus norvegicus
caccagtggcttgctgatgctaatg

SEQ ID NO: 457963 - DNA, 25 bp, Rattus norvegicus
ccaggtacgcaaaggcgaactcgcc

SEQ ID NO: 457964 - DNA, 25 bp, Rattus norvegicus
ccatgaaccgtttccctgtgcttct

SEQ ID NO: 457965 - DNA, 25 bp, Rattus norvegicus
tctcgtccatgaaccgtttccctgt

SEQ ID NO: 457966 - DNA, 25 bp, Rattus norvegicus
tctcgtccatgaaccgtgtccctgt

SEQ ID NO: 457967 - DNA, 25 bp, Rattus norvegicus
tctcgtccatgaaccctgtccctgt

SEQ ID NO: 457968 - DNA, 25 bp, Rattus norvegicus
gtccatgaaccctgtccctgtgctt

SEQ ID NO: 457969 - DNA, 25 bp, Rattus norvegicus
tccatgaaccgtgtccctgtgcttc

SEQ ID NO: 457970 - DNA, 25 bp, Rattus norvegicus
tgaaccgtttccctgtgcttctcag

SEQ ID NO: 457971 - DNA, 25 bp, Rattus norvegicus
catgaaccgtttccctgtgcttctc

SEQ ID NO: 457972 - DNA, 25 bp, Rattus norvegicus
ctcgtccatgaaccgtttccctgtg

SEQ ID NO: 457973 - DNA, 25 bp, Rattus norvegicus
gtccatgaaccgtgtccctgtgctt

SEQ ID NO: 457974 - DNA, 25 bp, Rattus norvegicus
catgaaccgtgtccctgtgcttctc

SEQ ID NO: 457975 - DNA, 25 bp, Rattus norvegicus
gaaccgtttccctgtgcttctcagc

SEQ ID NO: 457976 - DNA, 25 bp, Rattus norvegicus
tccatgaaccgtttccctgtgcttc

SEQ ID NO: 457977 - DNA, 25 bp, Rattus norvegicus
gactctctctcgtccatgaaccgtt

SEQ ID NO: 457978 - DNA, 25 bp, Rattus norvegicus
gactctctctcgtccatgaaccgtt

SEQ ID NO: 457979 - DNA, 25 bp, Rattus norvegicus
tgaaccgtttccctgtgcttctcag

SEQ ID NO: 457980 - DNA, 25 bp, Rattus norvegicus
tccatgaaccgtttccctgtgcttc

SEQ ID NO: 457981 - DNA, 25 bp, Rattus norvegicus
catgaaccgtgtccctgtgcttctc

SEQ ID NO: 457982 - DNA, 25 bp, Rattus norvegicus
ctcgtccatgaaccgtgtccctgtg

SEQ ID NO: 457983 - DNA, 25 bp, Rattus norvegicus
ccatgaaccgtgtccctgtgcttct

SEQ ID NO: 457984 - DNA, 25 bp, Rattus norvegicus
tccatgaaccgtgtccctgtgcttc

SEQ ID NO: 457985 - DNA, 25 bp, Rattus norvegicus
ctcgtccatgaaccgtttccctgtg

SEQ ID NO: 457986 - DNA, 25 bp, Rattus norvegicus
gaaccgtttccctgtgcttctcagc

SEQ ID NO: 457987 - DNA, 25 bp, Rattus norvegicus
gactctctctcgtccatgaaccgtg

SEQ ID NO: 457988 - DNA, 25 bp, Rattus norvegicus
cgtccatgaaccgtgtccctgtgct

SEQ ID NO: 457989 - DNA, 25 bp, Rattus norvegicus
gaaccgtgtccctgtgcttctcagc

SEQ ID NO: 457990 - DNA, 25 bp, Rattus norvegicus
tctcgtccatgaaccgtgtccctgt

SEQ ID NO: 457991 - DNA, 25 bp, Rattus norvegicus
gtccatgaaccgtgtccctgtgctt

SEQ ID NO: 457992 - DNA, 25 bp, Rattus norvegicus
tccatgaaccgtgtccctgtgcttc

SEQ ID NO: 457993 - DNA, 25 bp, Rattus norvegicus
tctcgtccatgaaccgtgtccctgt

SEQ ID NO: 457994 - DNA, 25 bp, Rattus norvegicus
gaaccgtttccctgtgcttctcagc

SEQ ID NO: 457995 - DNA, 25 bp, Rattus norvegicus
tgaaccgtgtccctgtgcttctcag

SEQ ID NO: 457996 - DNA, 25 bp, Rattus norvegicus
gtccatgaaccgtttccctgtgctt

SEQ ID NO: 457997 - DNA, 25 bp, Rattus norvegicus
tctcgtccatgaaccgtttccctgt

SEQ ID NO: 457998 - DNA, 25 bp, Rattus norvegicus
tccatgaaccgtttccctgtgcttc

SEQ ID NO: 457999 - DNA, 25 bp, Rattus norvegicus
actctctctcgtccatgaaccgttt

SEQ ID NO: 458000 - DNA, 25 bp, Rattus norvegicus
catgaaccgtgtccctgtgcttctc

SEQ ID NO: 458001 - DNA, 25 bp, Rattus norvegicus
gaaccgtgtccctgtgcttctcagc

SEQ ID NO: 458002 - DNA, 25 bp, Rattus norvegicus
catgaaccgtttccctgtgcttctc

SEQ ID NO: 458003 - DNA, 25 bp, Rattus norvegicus
tgaaccgtttccctgtgcttctcag

SEQ ID NO: 458004 - DNA, 25 bp, Rattus norvegicus
gactctctctcgtccatgaaccgtt

SEQ ID NO: 458005 - DNA, 25 bp, Rattus norvegicus
cgtccatgaaccgtgtccctgtgct

SEQ ID NO: 458006 - DNA, 25 bp, Rattus norvegicus
ccacttcagtgagaagcactatttc

SEQ ID NO: 458007 - DNA, 25 bp, Rattus norvegicus
caaagtttccacttcagtgagaagc

SEQ ID NO: 458008 - DNA, 25 bp, Rattus norvegicus
gagaggacacgaggacatgctgggc

SEQ ID NO: 458009 - DNA, 25 bp, Rattus norvegicus
cagtgagaagcactatttcttgggc

SEQ ID NO: 458010 - DNA, 25 bp, Rattus norvegicus
gaagcactatttcttgggctgagcc

SEQ ID NO: 458011 - DNA, 25 bp, Rattus norvegicus
gcactatttcttgggctgagcctcc

SEQ ID NO: 458012 - DNA, 25 bp, Rattus norvegicus
cattataacattttaaaaggggctg

SEQ ID NO: 458013 - DNA, 25 bp, Rattus norvegicus
ggtggcatgtgcctttcatctcagc

SEQ ID NO: 458014 - DNA, 25 bp, Rattus norvegicus
caaccatccaataactttccaaaca

SEQ ID NO: 458015 - DNA, 25 bp, Rattus norvegicus
tgtgcctttcatctcagcacttgag

SEQ ID NO: 458016 - DNA, 25 bp, Rattus norvegicus
gccagcctggtttattagagagtga

SEQ ID NO: 458017 - DNA, 25 bp, Rattus norvegicus
gcctggtttattagagagtgagttc

SEQ ID NO: 458018 - DNA, 25 bp, Rattus norvegicus
gtggtggtggcatgtgcctttcatc

SEQ ID NO: 458019 - DNA, 25 bp, Rattus norvegicus
tccaaacaaagtttccacttcagtg

SEQ ID NO: 458020 - DNA, 25 bp, Rattus norvegicus
catgaaccgtgtccctgtgcttctc

SEQ ID NO: 458021 - DNA, 25 bp, Rattus norvegicus
gactctctctcgtccatgaaccgtg

SEQ ID NO: 458022 - DNA, 25 bp, Rattus norvegicus
cgcccgactctctctcgtccatgaa

SEQ ID NO: 458023 - DNA, 25 bp, Rattus norvegicus
ctcgtccatgaaccgtttccctgtg

SEQ ID NO: 458024 - DNA, 25 bp, Rattus norvegicus
acgcccgactctctctcgtccatga

SEQ ID NO: 458025 - DNA, 25 bp, Rattus norvegicus
gactctctctcgtccatgaaccgtt

SEQ ID NO: 458026 - DNA, 25 bp, Rattus norvegicus
cgtccatgaaccgtttccctgtgct

SEQ ID NO: 458027 - DNA, 25 bp, Rattus norvegicus
cgcccgactctctcccgtccatgaa

SEQ ID NO: 458028 - DNA, 25 bp, Rattus norvegicus
cgtccatgaaccgtgtccctgtgct

SEQ ID NO: 458029 - DNA, 25 bp, Rattus norvegicus
acgcccgactctctcccgtccatga

SEQ ID NO: 458030 - DNA, 25 bp, Rattus norvegicus
actctctctcgtccatgaaccgttt

SEQ ID NO: 458031 - DNA, 25 bp, Rattus norvegicus
catgaaccgtttccctgtgcttctc

SEQ ID NO: 458032 - DNA, 25 bp, Rattus norvegicus
gaaccgtgtccctgtgcttctcagc

SEQ ID NO: 458033 - DNA, 25 bp, Rattus norvegicus
gaaccgtttccctgtgcttctcagc

SEQ ID NO: 458034 - DNA, 25 bp, Rattus norvegicus
ccggtagatacagtagcaggcgcca

SEQ ID NO: 458035 - DNA, 25 bp, Rattus norvegicus
cgggcagcccatcgcctcacctgcg

SEQ ID NO: 458036 - DNA, 25 bp, Rattus norvegicus
gcctcacctgcggaccgcgaagggc

SEQ ID NO: 458037 - DNA, 25 bp, Rattus norvegicus
cctgcggaccgcgaagggcgcagtc

SEQ ID NO: 458038 - DNA, 25 bp, Rattus norvegicus
cgagtcagccggtagatacagtagc

SEQ ID NO: 458039 - DNA, 25 bp, Rattus norvegicus
gtcagccggtagatacagtagcagg

SEQ ID NO: 458040 - DNA, 25 bp, Rattus norvegicus
tagatacagtagcaggcgccagcgc

SEQ ID NO: 458041 - DNA, 25 bp, Rattus norvegicus
gatacagtagcaggcgccagcgccc

SEQ ID NO: 458042 - DNA, 25 bp, Rattus norvegicus
gccagcgcccaggactagcccggct

SEQ ID NO: 458043 - DNA, 25 bp, Rattus norvegicus
cgcccaggactagcccggctgccac

SEQ ID NO: 458044 - DNA, 25 bp, Rattus norvegicus
cgcgcgccgcccatactgctgccac

SEQ ID NO: 458045 - DNA, 25 bp, Rattus norvegicus
aaccagtccacatgccgggcagccc

SEQ ID NO: 458046 - DNA, 25 bp, Rattus norvegicus
ccatactgctgccaccgagctgcag

SEQ ID NO: 458047 - DNA, 25 bp, Rattus norvegicus
tgccacccagcccacgtcccgcgcg

SEQ ID NO: 458048 - DNA, 25 bp, Rattus norvegicus
gtagactgcgggtctcgcctactct

SEQ ID NO: 458049 - DNA, 25 bp, Rattus norvegicus
ggaaggagctgcgaacccacgcaac

SEQ ID NO: 458050 - DNA, 25 bp, Rattus norvegicus
cccacgcaacgctgacctgggtttg

SEQ ID NO: 458051 - DNA, 25 bp, Rattus norvegicus
tcggatcgttttcctgggacacgga

SEQ ID NO: 458052 - DNA, 25 bp, Rattus norvegicus
acacggactcttccagcgggcggaa

SEQ ID NO: 458053 - DNA, 25 bp, Rattus norvegicus
taaaggaccaaggattccgcggctc

SEQ ID NO: 458054 - DNA, 25 bp, Rattus norvegicus
ggcgcacaggcagcttccacagaca

SEQ ID NO: 458055 - DNA, 25 bp, Rattus norvegicus
tggtagtccgaccatactccacgga

SEQ ID NO: 458056 - DNA, 25 bp, Rattus norvegicus
actcgaagtcccagtgcggagcaga

SEQ ID NO: 458057 - DNA, 25 bp, Rattus norvegicus
gcgttcgcgtctctgtagttgtata

SEQ ID NO: 458058 - DNA, 25 bp, Rattus norvegicus
ggctctgagtctctcgcttcgccga

SEQ ID NO: 458059 - DNA, 25 bp, Rattus norvegicus
ggacagacacctgaccaatcagtgc

SEQ ID NO: 458060 - DNA, 25 bp, Rattus norvegicus
agtgcatctgctgacttccggaagc

SEQ ID NO: 458061 - DNA, 25 bp, Rattus norvegicus
gtccgtagccctggaactccgcgga

SEQ ID NO: 458062 - DNA, 25 bp, Rattus norvegicus
agcctgcttttgtcggcgcgggacc

SEQ ID NO: 458063 - DNA, 25 bp, Rattus norvegicus
cacctgcacctcagagcgccgctcc

SEQ ID NO: 458064 - DNA, 25 bp, Rattus norvegicus
ttcctcagtgcagctgtccgcgcag

SEQ ID NO: 458065 - DNA, 25 bp, Rattus norvegicus
cccatctgttttcctcagcgctgag

SEQ ID NO: 458066 - DNA, 25 bp, Rattus norvegicus
tcagcgctgagtggattatattgta

SEQ ID NO: 458067 - DNA, 25 bp, Rattus norvegicus
cgctgagtggattatattgtatggg

SEQ ID NO: 458068 - DNA, 25 bp, Rattus norvegicus
agcagcggccgcttcagcgactcgg

SEQ ID NO: 458069 - DNA, 25 bp, Rattus norvegicus
gagctccgctcctggtgggaagtcc

SEQ ID NO: 458070 - DNA, 25 bp, Rattus norvegicus
aagtcccggccatcgcgcacttctg

SEQ ID NO: 458071 - DNA, 25 bp, Rattus norvegicus
tctgctcgctctttcgcacggcgtt

SEQ ID NO: 458072 - DNA, 25 bp, Rattus norvegicus
gcctgccggacttcgagatcgaggt

SEQ ID NO: 458073 - DNA, 25 bp, Rattus norvegicus
acttcgagatcgaggtgagtagccg

SEQ ID NO: 458074 - DNA, 25 bp, Rattus norvegicus
tcagcttgagctcacgccgagcggc

SEQ ID NO: 458075 - DNA, 25 bp, Rattus norvegicus
tctccgcgcttctctacggggagtc

SEQ ID NO: 458076 - DNA, 25 bp, Rattus norvegicus
ggataaccacactccaccgttcttg

SEQ ID NO: 458077 - DNA, 25 bp, Rattus norvegicus
ttctaagtaggggatcaccgccttc

SEQ ID NO: 458078 - DNA, 25 bp, Rattus norvegicus
ggtcctgatccaggggaccctgaga

SEQ ID NO: 458079 - DNA, 25 bp, Rattus norvegicus
gacagcgcctgagaacgagggaccc

SEQ ID NO: 458080 - DNA, 25 bp, Rattus norvegicus
ccgcaggaaatcgtgtttcgggatc

SEQ ID NO: 458081 - DNA, 25 bp, Rattus norvegicus
cctggcgccgcctctaaataaaatc

SEQ ID NO: 458082 - DNA, 25 bp, Rattus norvegicus
acccaacagtctccaatcttagggg

SEQ ID NO: 458083 - DNA, 25 bp, Rattus norvegicus
atcttgccactgtgacctgcactgg

SEQ ID NO: 458084 - DNA, 25 bp, Rattus norvegicus
gaaaagctagcttgcacccagtcca

SEQ ID NO: 458085 - DNA, 25 bp, Rattus norvegicus
gagggcggtgacgacccaaatctcc

SEQ ID NO: 458086 - DNA, 25 bp, Rattus norvegicus
cgttttgtagagactgggttgccca

SEQ ID NO: 458087 - DNA, 25 bp, Rattus norvegicus
cccggcaaactgctagggactgaca

SEQ ID NO: 458088 - DNA, 25 bp, Rattus norvegicus
cggccgagacagacaaagagaagct

SEQ ID NO: 458089 - DNA, 25 bp, Rattus norvegicus
aaaggcgaagccacgtggtgacagc

SEQ ID NO: 458090 - DNA, 25 bp, Rattus norvegicus
ctcccactgaggaaggggtcttaga

SEQ ID NO: 458091 - DNA, 25 bp, Rattus norvegicus
ggtgacctcaccgtccaacatggcg

SEQ ID NO: 458092 - DNA, 25 bp, Rattus norvegicus
tagattaggtctgcgggtcgaacca

SEQ ID NO: 458093 - DNA, 25 bp, Rattus norvegicus
cgctgctcctgtaccctgtgggaag

SEQ ID NO: 458094 - DNA, 25 bp, Rattus norvegicus
accctgtgggaagcacctgctgcca

SEQ ID NO: 458095 - DNA, 25 bp, Rattus norvegicus
tcgtcccttctactgcagggccgga

SEQ ID NO: 458096 - DNA, 25 bp, Rattus norvegicus
tcttagagaccaccgagctgaccac

SEQ ID NO: 458097 - DNA, 25 bp, Rattus norvegicus
aaggaggctcatgcggctccgccga

SEQ ID NO: 458098 - DNA, 25 bp, Rattus norvegicus
ctccgccgaggcttcttggaatttc

SEQ ID NO: 458099 - DNA, 25 bp, Rattus norvegicus
tcttggaatttctggggagctattt

SEQ ID NO: 458100 - DNA, 25 bp, Rattus norvegicus
ctggggagctatttgggactaatcc

SEQ ID NO: 458101 - DNA, 25 bp, Rattus norvegicus
ggactaatccgacctatccagtgtg

SEQ ID NO: 458102 - DNA, 25 bp, Rattus norvegicus
acggaagcgcgtcagggtgacctca

SEQ ID NO: 458103 - DNA, 25 bp, Rattus norvegicus
gagctgaccaccgtgttgcccagcg

SEQ ID NO: 458104 - DNA, 25 bp, Rattus norvegicus
ggcgcacctgcaaactggcacgcga

SEQ ID NO: 458105 - DNA, 25 bp, Rattus norvegicus
aaccctagggtccataagctcgcta

SEQ ID NO: 458106 - DNA, 25 bp, Rattus norvegicus
cggctagctgcagtttgcggaaacc

SEQ ID NO: 458107 - DNA, 25 bp, Rattus norvegicus
gaccgacacttggacccgagctcta

SEQ ID NO: 458108 - DNA, 25 bp, Rattus norvegicus
ctgcagaggtttgccgaccgacact

SEQ ID NO: 458109 - DNA, 25 bp, Rattus norvegicus
ggtaggcagactcaccagcagacgc

SEQ ID NO: 458110 - DNA, 25 bp, Rattus norvegicus
ctcttctcccagagcggaacagtgg

SEQ ID NO: 458111 - DNA, 25 bp, Rattus norvegicus
taccaaactgagctccatgccgatc

SEQ ID NO: 458112 - DNA, 25 bp, Rattus norvegicus
ccgccgcgaaggatcagtacaatac

SEQ ID NO: 458113 - DNA, 25 bp, Rattus norvegicus
cacagctccgtggtggcaacctaca

SEQ ID NO: 458114 - DNA, 25 bp, Rattus norvegicus
cccaaagtggaccaggatcgagcga

SEQ ID NO: 458115 - DNA, 25 bp, Rattus norvegicus
cctgagatctaccaggaagcctgcc

SEQ ID NO: 458116 - DNA, 25 bp, Rattus norvegicus
caggaaggtacacccggaacctgtg

SEQ ID NO: 458117 - DNA, 25 bp, Rattus norvegicus
cgcgaccgaagggatcctgagatct

SEQ ID NO: 458118 - DNA, 25 bp, Rattus norvegicus
ccagtgggacgtgtccagccacgca

SEQ ID NO: 458119 - DNA, 25 bp, Rattus norvegicus
cactcctgctcctcgttctctgaga

SEQ ID NO: 458120 - DNA, 25 bp, Rattus norvegicus
ggggcgcactttctcagtgctcccg

SEQ ID NO: 458121 - DNA, 25 bp, Rattus norvegicus
ttcatgctgctgtgtcctcgtggcc

SEQ ID NO: 458122 - DNA, 25 bp, Rattus norvegicus
ctctgcttcatgctgctgtgtcctc

SEQ ID NO: 458123 - DNA, 25 bp, Rattus norvegicus
cgagagcacagggctcacctctgct

SEQ ID NO: 458124 - DNA, 25 bp, Rattus norvegicus
acgtgtccagccacgcatcagggcg

SEQ ID NO: 458125 - DNA, 25 bp, Rattus norvegicus
tccaccagagggaggcacaaggcac

SEQ ID NO: 458126 - DNA, 25 bp, Rattus norvegicus
cggacgcacgcgtccaccagaggga

SEQ ID NO: 458127 - DNA, 25 bp, Rattus norvegicus
agagccacagctccgccagcgttcc

SEQ ID NO: 458128 - DNA, 25 bp, Rattus norvegicus
gaagcgcacaggggcttcctcgcca

SEQ ID NO: 458129 - DNA, 25 bp, Rattus norvegicus
tcctggaggtcagggacccggacac

SEQ ID NO: 458130 - DNA, 25 bp, Rattus norvegicus
tagcacccgactcctggaggtcagg

SEQ ID NO: 458131 - DNA, 25 bp, Rattus norvegicus
ccacccgcgccaaagccgcccgtgg

SEQ ID NO: 458132 - DNA, 25 bp, Rattus norvegicus
ccatcatgagggtaccgctgtgacc

SEQ ID NO: 458133 - DNA, 25 bp, Rattus norvegicus
cttgctgagctggtactggcgaaaa

SEQ ID NO: 458134 - DNA, 25 bp, Rattus norvegicus
tctccaggagcgagttacggatctt

SEQ ID NO: 458135 - DNA, 25 bp, Rattus norvegicus
aggagtgccttctctgccaccaggc

SEQ ID NO: 458136 - DNA, 25 bp, Rattus norvegicus
tcctccagctcggtgagagagcctg

SEQ ID NO: 458137 - DNA, 25 bp, Rattus norvegicus
acctgctcggtaaaggagtcctcca

SEQ ID NO: 458138 - DNA, 25 bp, Rattus norvegicus
tgacgtcccggaaagccatcatgag

SEQ ID NO: 458139 - DNA, 25 bp, Rattus norvegicus
tcctgcagcgagcacatggtcttga

SEQ ID NO: 458140 - DNA, 25 bp, Rattus norvegicus
ccatcagttccgaggctgggacttc

SEQ ID NO: 458141 - DNA, 25 bp, Rattus norvegicus
ggttagcgatctgcaccgtgacgtc

SEQ ID NO: 458142 - DNA, 25 bp, Rattus norvegicus
tgcgcccagacagttagccacagac

SEQ ID NO: 458143 - DNA, 25 bp, Rattus norvegicus
ctgggacttccgagacctcctgagt

SEQ ID NO: 458144 - DNA, 25 bp, Rattus norvegicus
tcctcaacgggtgggtccatcagtt

SEQ ID NO: 458145 - DNA, 25 bp, Rattus norvegicus
cccttgttcggtttgaacggctgca

SEQ ID NO: 458146 - DNA, 25 bp, Rattus norvegicus
agatcctgtgctgctcgtcagcaag

SEQ ID NO: 458147 - DNA, 25 bp, Rattus norvegicus
agccgcccacactctcaggccctgc

SEQ ID NO: 458148 - DNA, 25 bp, Rattus norvegicus
aagccagccgcccacactctcaggc

SEQ ID NO: 458149 - DNA, 25 bp, Rattus norvegicus
gtgctgctcgtcagcaagccagccg

SEQ ID NO: 458150 - DNA, 25 bp, Rattus norvegicus
atcctgtgctgctcgtcagcaagcc

SEQ ID NO: 458151 - DNA, 25 bp, Rattus norvegicus
ggagatcctgtgctgctcgtcagca

SEQ ID NO: 458152 - DNA, 25 bp, Rattus norvegicus
ccgggagatcctgtgctgctcgtca

SEQ ID NO: 458153 - DNA, 25 bp, Rattus norvegicus
agggagcgtgatgcgggcgcgcaga

SEQ ID NO: 458154 - DNA, 25 bp, Rattus norvegicus
cctacgcgtgtgactcagcagcggg

SEQ ID NO: 458155 - DNA, 25 bp, Rattus norvegicus
ccctacgcgtgtgactcagcagcgg

SEQ ID NO: 458156 - DNA, 25 bp, Rattus norvegicus
cgcaccggtgaagaccgctcttccc

SEQ ID NO: 458157 - DNA, 25 bp, Rattus norvegicus
gtccgcaccggtgaagaccgctctt

SEQ ID NO: 458158 - DNA, 25 bp, Rattus norvegicus
ggtccgcaccggtgaagaccgctct

SEQ ID NO: 458159 - DNA, 25 bp, Rattus norvegicus
ctgtgctgctcgtcagcaagccagc

SEQ ID NO: 458160 - DNA, 25 bp, Rattus norvegicus
tgcagcagctgctggtgttcccaca

SEQ ID NO: 458161 - DNA, 25 bp, Rattus norvegicus
cgcggcagcacaacaactcgaggga

SEQ ID NO: 458162 - DNA, 25 bp, Rattus norvegicus
ttcgtgaggaactctgcttcccgcg

SEQ ID NO: 458163 - DNA, 25 bp, Rattus norvegicus
cccacctctgggcttcgtgaggaac

SEQ ID NO: 458164 - DNA, 25 bp, Rattus norvegicus
agggacgctccttctccttgtcagc

SEQ ID NO: 458165 - DNA, 25 bp, Rattus norvegicus
tcgcacacgcactaaggggcggacc

SEQ ID NO: 458166 - DNA, 25 bp, Rattus norvegicus
agcccagcagctctgtcggtcggtg

SEQ ID NO: 458167 - DNA, 25 bp, Rattus norvegicus
ctccttaaggtagagcacggcgcgc

SEQ ID NO: 458168 - DNA, 25 bp, Rattus norvegicus
tgcacgatggccgtgagctccttaa

SEQ ID NO: 458169 - DNA, 25 bp, Rattus norvegicus
atgaggctttgctggttctgcacga

SEQ ID NO: 458170 - DNA, 25 bp, Rattus norvegicus
cagctcatcgatgcgctggcgctgg

SEQ ID NO: 458171 - DNA, 25 bp, Rattus norvegicus
tgttcccacaggctgcggttctccg

SEQ ID NO: 458172 - DNA, 25 bp, Rattus norvegicus
actggggagtctgaaccctgctgct

SEQ ID NO: 458173 - DNA, 25 bp, Rattus norvegicus
gttctccgcgctcagctcgtctaga

SEQ ID NO: 458174 - DNA, 25 bp, Rattus norvegicus
ctgcccagggcgaatcttccaggaa

SEQ ID NO: 458175 - DNA, 25 bp, Rattus norvegicus
gagagcggcacgaaggccctacata

SEQ ID NO: 458176 - DNA, 25 bp, Rattus norvegicus
ctacataaaggctgcccggtctacg

SEQ ID NO: 458177 - DNA, 25 bp, Rattus norvegicus
ggaccctcgcctccgcaggaagaaa

SEQ ID NO: 458178 - DNA, 25 bp, Rattus norvegicus
aagagccgcgcacagagacggattc

SEQ ID NO: 458179 - DNA, 25 bp, Rattus norvegicus
tgtggacggccacacgccgtaagtc

SEQ ID NO: 458180 - DNA, 25 bp, Rattus norvegicus
ggagactgtcataaatcgccttgca

SEQ ID NO: 458181 - DNA, 25 bp, Rattus norvegicus
tcgccttgcagcagttggcacggtt

SEQ ID NO: 458182 - DNA, 25 bp, Rattus norvegicus
ttgcgctttacgacggctgagtcgc

SEQ ID NO: 458183 - DNA, 25 bp, Rattus norvegicus
tgaagcgcagccgaagacggtaacg

SEQ ID NO: 458184 - DNA, 25 bp, Rattus norvegicus
ttccgcgcgaccaggtttgaggcgc

SEQ ID NO: 458185 - DNA, 25 bp, Rattus norvegicus
cgagcgctgcattgactcacgcgca

SEQ ID NO: 458186 - DNA, 25 bp, Rattus norvegicus
gccgtaagtcgaaccggagactgtc

SEQ ID NO: 458187 - DNA, 25 bp, Rattus norvegicus
tcttcttacgttgagtgggctgctt

SEQ ID NO: 458188 - DNA, 25 bp, Rattus norvegicus
atctctttgactgtcctcctgacta

SEQ ID NO: 458189 - DNA, 25 bp, Rattus norvegicus
ttggaacatcttccagagcctgcgg

SEQ ID NO: 458190 - DNA, 25 bp, Rattus norvegicus
tcttggaacatcttccagagcctgc

SEQ ID NO: 458191 - DNA, 25 bp, Rattus norvegicus
tcctgactatattcggctcttggaa

SEQ ID NO: 458192 - DNA, 25 bp, Rattus norvegicus
ctcctgactatattcggctcttgga

SEQ ID NO: 458193 - DNA, 25 bp, Rattus norvegicus
cctcctgactatattcggctcttgg

SEQ ID NO: 458194 - DNA, 25 bp, Rattus norvegicus
tcctcctgactatattcggctcttg

SEQ ID NO: 458195 - DNA, 25 bp, Rattus norvegicus
tgtcctcctgactatattcggctct

SEQ ID NO: 458196 - DNA, 25 bp, Rattus norvegicus
ctgtcctcctgactatattcggctc

SEQ ID NO: 458197 - DNA, 25 bp, Rattus norvegicus
gactgtcctcctgactatattcggc

SEQ ID NO: 458198 - DNA, 25 bp, Rattus norvegicus
tgactgtcctcctgactatattcgg

SEQ ID NO: 458199 - DNA, 25 bp, Rattus norvegicus
tttgactgtcctcctgactatattc

SEQ ID NO: 458200 - DNA, 25 bp, Rattus norvegicus
ggaacatcttccagagcctgcggcg

SEQ ID NO: 458201 - DNA, 25 bp, Rattus norvegicus
ctctttgactgtcctcctgactata

SEQ ID NO: 458202 - DNA, 25 bp, Rattus norvegicus
tgccaagaagaaactcgccgaggtg

SEQ ID NO: 458203 - DNA, 25 bp, Rattus norvegicus
tctgctctcgagacaccgaattctc

SEQ ID NO: 458204 - DNA, 25 bp, Rattus norvegicus
agacatagggttcgctccttcgatg

SEQ ID NO: 458205 - DNA, 25 bp, Rattus norvegicus
ggagctggcgccattgccaagaaga

SEQ ID NO: 458206 - DNA, 25 bp, Rattus norvegicus
ccttcgatgttgtctgggctttgtg

SEQ ID NO: 458207 - DNA, 25 bp, Rattus norvegicus
gggctgaagcctgctctgctctcga

SEQ ID NO: 458208 - DNA, 25 bp, Rattus norvegicus
tttgtggaacgtggcgccgagctaa

SEQ ID NO: 458209 - DNA, 25 bp, Rattus norvegicus
agctaagacgaggactggggccttt

SEQ ID NO: 458210 - DNA, 25 bp, Rattus norvegicus
ctggggcctttgcaagacactccta

SEQ ID NO: 458211 - DNA, 25 bp, Rattus norvegicus
tttgcaagacactcctagacgccgc

SEQ ID NO: 458212 - DNA, 25 bp, Rattus norvegicus
tagacgccgcagcaggaagtgaata

SEQ ID NO: 458213 - DNA, 25 bp, Rattus norvegicus
cacggcacccggcttccgtgttggg

SEQ ID NO: 458214 - DNA, 25 bp, Rattus norvegicus
tccgtgttgggagctggctacagaa

SEQ ID NO: 458215 - DNA, 25 bp, Rattus norvegicus
ctggctacagaacctgggacgcgga

SEQ ID NO: 458216 - DNA, 25 bp, Rattus norvegicus
gagtgaactcggctgctgaccaatc

SEQ ID NO: 458217 - DNA, 25 bp, Rattus norvegicus
gccaacacggtagcagaagtctaga

SEQ ID NO: 458218 - DNA, 25 bp, Rattus norvegicus
agggagcgccactctccgtaatttc

SEQ ID NO: 458219 - DNA, 25 bp, Rattus norvegicus
tccgtaatttcgcagatcgccctca

SEQ ID NO: 458220 - DNA, 25 bp, Rattus norvegicus
gccctcacgtactgtcttcaactgg

SEQ ID NO: 458221 - DNA, 25 bp, Rattus norvegicus
acctatccggacacctggcgcatga

SEQ ID NO: 458222 - DNA, 25 bp, Rattus norvegicus
agctaaggttctgcggtcacatgcc

SEQ ID NO: 458223 - DNA, 25 bp, Rattus norvegicus
ttgcttcctgtttccggcttctgga

SEQ ID NO: 458224 - DNA, 25 bp, Rattus norvegicus
tcggttgctctgttttcctgtgaca

SEQ ID NO: 458225 - DNA, 25 bp, Rattus norvegicus
ggggtccttgcacacctctgcactg

SEQ ID NO: 458226 - DNA, 25 bp, Rattus norvegicus
ctctgcactgaaggaaatgcggacc

SEQ ID NO: 458227 - DNA, 25 bp, Rattus norvegicus
tggccctcgttcttgctggagatac

SEQ ID NO: 458228 - DNA, 25 bp, Rattus norvegicus
ccagtcgaccgatagctaaacagca

SEQ ID NO: 458229 - DNA, 25 bp, Rattus norvegicus
gcagttgctcagcaggctctccttg

SEQ ID NO: 458230 - DNA, 25 bp, Rattus norvegicus
agcgcgagaagcagggagataacca

SEQ ID NO: 458231 - DNA, 25 bp, Rattus norvegicus
gccgaggtggctgaggaaacatccc

SEQ ID NO: 458232 - DNA, 25 bp, Rattus norvegicus
ggtacctgggcgttgcacacgccga

SEQ ID NO: 458233 - DNA, 25 bp, Rattus norvegicus
gaagcaccgcagagcacagcagagc

SEQ ID NO: 458234 - DNA, 25 bp, Rattus norvegicus
ccgggacgcgaagcaccaaagaagc

SEQ ID NO: 458235 - DNA, 25 bp, Rattus norvegicus
gcacagccagcgcaaagcacggaga

SEQ ID NO: 458236 - DNA, 25 bp, Rattus norvegicus
tgacggacagacagcaccgagcaca

SEQ ID NO: 458237 - DNA, 25 bp, Rattus norvegicus
cgcagttccaacgagaaaccaaaca

SEQ ID NO: 458238 - DNA, 25 bp, Rattus norvegicus
ccagacagcatgctcggatggaagg

SEQ ID NO: 458239 - DNA, 25 bp, Rattus norvegicus
cacagaagtcgagattggggagccc

SEQ ID NO: 458240 - DNA, 25 bp, Rattus norvegicus
cattctaatagtagggagccaagca

SEQ ID NO: 458241 - DNA, 25 bp, Rattus norvegicus
cggactcggtaagcagggaattgta

SEQ ID NO: 458242 - DNA, 25 bp, Rattus norvegicus
atacagtgccgtgcccgaagcgaac

SEQ ID NO: 458243 - DNA, 25 bp, Rattus norvegicus
aaatgaatgagaaggcgagcggtcc

SEQ ID NO: 458244 - DNA, 25 bp, Rattus norvegicus
ccacgcgagatctggccaggggact

SEQ ID NO: 458245 - DNA, 25 bp, Rattus norvegicus
aggcgagcgcgctcgaccgactgac

SEQ ID NO: 458246 - DNA, 25 bp, Rattus norvegicus
ccgactgacacctgcgaggggacct

SEQ ID NO: 458247 - DNA, 25 bp, Rattus norvegicus
caaaccgtcctctcggagccaggaa

SEQ ID NO: 458248 - DNA, 25 bp, Rattus norvegicus
cgtcctctcggagccaggaaaacgg

SEQ ID NO: 458249 - DNA, 25 bp, Rattus norvegicus
aggtttgttccgctccgcaccgcga

SEQ ID NO: 458250 - DNA, 25 bp, Rattus norvegicus
caccgcgagagtaggccctgccgtt

SEQ ID NO: 458251 - DNA, 25 bp, Rattus norvegicus
gtgaccgctttgatgaccgccgaca

SEQ ID NO: 458252 - DNA, 25 bp, Rattus norvegicus
ttggggacaaagatgatggtaacta

SEQ ID NO: 458253 - DNA, 25 bp, Rattus norvegicus
gtaactaatagtcccgatccgcgaa

SEQ ID NO: 458254 - DNA, 25 bp, Rattus norvegicus
atccgcgaacgcaccgaagacaatg

SEQ ID NO: 458255 - DNA, 25 bp, Rattus norvegicus
cgaagacaatgcctctctgtatgga

SEQ ID NO: 458256 - DNA, 25 bp, Rattus norvegicus
atgcctctctgtatggaaaggcgcg

SEQ ID NO: 458257 - DNA, 25 bp, Rattus norvegicus
tgcggccggccgtgaccgctttgat

SEQ ID NO: 458258 - DNA, 25 bp, Rattus norvegicus
cctgctacgactgtgcgcggcacgt

SEQ ID NO: 458259 - DNA, 25 bp, Rattus norvegicus
ctgcgaagaccgcaaggctgagcct

SEQ ID NO: 458260 - DNA, 25 bp, Rattus norvegicus
gcctctacttctgcgaagaccgcaa

SEQ ID NO: 458261 - DNA, 25 bp, Rattus norvegicus
tgaggattttcaccgcgcgcctcta

SEQ ID NO: 458262 - DNA, 25 bp, Rattus norvegicus
ctcagcctgaggattttcaccgcgc

SEQ ID NO: 458263 - DNA, 25 bp, Rattus norvegicus
gatggaaccctaacctcagcctgag

SEQ ID NO: 458264 - DNA, 25 bp, Rattus norvegicus
cggcacgtggctgagtttctgagat

SEQ ID NO: 458265 - DNA, 25 bp, Rattus norvegicus
cgtgtcacctggttcacttcctgga

SEQ ID NO: 458266 - DNA, 25 bp, Rattus norvegicus
acatctcggactgggacctggaccc

SEQ ID NO: 458267 - DNA, 25 bp, Rattus norvegicus
ttgttgttcctacgctacatctcgg

SEQ ID NO: 458268 - DNA, 25 bp, Rattus norvegicus
gggctgccacgtggaattgttgttc

SEQ ID NO: 458269 - DNA, 25 bp, Rattus norvegicus
ctacgctacatctcggactgggacc

SEQ ID NO: 458270 - DNA, 25 bp, Rattus norvegicus
gctgagtttctgagatggaacccta

SEQ ID NO: 458271 - DNA, 25 bp, Rattus norvegicus
ccggccggtgttaccgtgtcacctg

SEQ ID NO: 458272 - DNA, 25 bp, Rattus norvegicus
gacgcacgcctacatagcaaccagc

SEQ ID NO: 458273 - DNA, 25 bp, Rattus norvegicus
cagggtgagccgacgctctgcgcat

SEQ ID NO: 458274 - DNA, 25 bp, Rattus norvegicus
acagcggcgcagttcactgcggatg

SEQ ID NO: 458275 - DNA, 25 bp, Rattus norvegicus
ctacagcggcgcagttcactgcgga

SEQ ID NO: 458276 - DNA, 25 bp, Rattus norvegicus
gatcttgctacagcggcgcagttca

SEQ ID NO: 458277 - DNA, 25 bp, Rattus norvegicus
ggcgatcttgctacagcggcgcagt

SEQ ID NO: 458278 - DNA, 25 bp, Rattus norvegicus
tttccggcgatcttgctacagcggc

SEQ ID NO: 458279 - DNA, 25 bp, Rattus norvegicus
cgcaactgtattttccggcgatctt

SEQ ID NO: 458280 - DNA, 25 bp, Rattus norvegicus
tgcccgcaactgtattttccggcga

SEQ ID NO: 458281 - DNA, 25 bp, Rattus norvegicus
gatttgcccgcaactgtattttccg

SEQ ID NO: 458282 - DNA, 25 bp, Rattus norvegicus
tgtaaccctgatttgcccgcaactg

SEQ ID NO: 458283 - DNA, 25 bp, Rattus norvegicus
aacgtgtaaccctgatttgcccgca

SEQ ID NO: 458284 - DNA, 25 bp, Rattus norvegicus
accagcacaaaacgtgtaaccctga

SEQ ID NO: 458285 - DNA, 25 bp, Rattus norvegicus
catagcaaccagcacaaaacgtgta

SEQ ID NO: 458286 - DNA, 25 bp, Rattus norvegicus
tccgtttctgtcttggacccaactc

SEQ ID NO: 458287 - DNA, 25 bp, Rattus norvegicus
cgatgcgcgaatgagtcagcgagct

SEQ ID NO: 458288 - DNA, 25 bp, Rattus norvegicus
ggaggcagatccaggcgactcagac

SEQ ID NO: 458289 - DNA, 25 bp, Rattus norvegicus
ttctgtcttggacccaactctggcc

SEQ ID NO: 458290 - DNA, 25 bp, Rattus norvegicus
agatccaggcgactcagactgcggg

SEQ ID NO: 458291 - DNA, 25 bp, Rattus norvegicus
tctgcgcatgctcacactcatctgg

SEQ ID NO: 458292 - DNA, 25 bp, Rattus norvegicus
cttcctggtggtctgcagcccattc

SEQ ID NO: 458293 - DNA, 25 bp, Rattus norvegicus
ggtctgcagcccattctgcctttta

SEQ ID NO: 458294 - DNA, 25 bp, Rattus norvegicus
tacgtctaaattcatcctccgcctt

SEQ ID NO: 458295 - DNA, 25 bp, Rattus norvegicus
cctccggacacttcaaccaaaaatg

SEQ ID NO: 458296 - DNA, 25 bp, Rattus norvegicus
aaaaatgcctggatgtggggaccga

SEQ ID NO: 458297 - DNA, 25 bp, Rattus norvegicus
accgaggggagaagcagaacactgc

SEQ ID NO: 458298 - DNA, 25 bp, Rattus norvegicus
acactgcgcgatgcgcgaatgagtc

SEQ ID NO: 458299 - DNA, 25 bp, Rattus norvegicus
gcccattctgccttttacgtctaaa

SEQ ID NO: 458300 - DNA, 25 bp, Rattus norvegicus
acgggatcattgttcggaggcattc

SEQ ID NO: 458301 - DNA, 25 bp, Rattus norvegicus
ggcgtgcaaatttactcttagaacc

SEQ ID NO: 458302 - DNA, 25 bp, Rattus norvegicus
ccagctgttcgggtagatgactaat

SEQ ID NO: 458303 - DNA, 25 bp, Rattus norvegicus
agccgcaggccattcggcctctttt

SEQ ID NO: 458304 - DNA, 25 bp, Rattus norvegicus
attcggcctctttttgcgcaccaca

SEQ ID NO: 458305 - DNA, 25 bp, Rattus norvegicus
tttgcgcaccacatcgctcacgttt

SEQ ID NO: 458306 - DNA, 25 bp, Rattus norvegicus
acgctgcctgcgtctttttatttca

SEQ ID NO: 458307 - DNA, 25 bp, Rattus norvegicus
tacagcacgctgctcgctgaggcta

SEQ ID NO: 458308 - DNA, 25 bp, Rattus norvegicus
tgtgtgcaaaagcaatcacccatcc

SEQ ID NO: 458309 - DNA, 25 bp, Rattus norvegicus
tcgctgaggctacgggatcattgtt

SEQ ID NO: 458310 - DNA, 25 bp, Rattus norvegicus
agatgactaatatttgatgcctgca

SEQ ID NO: 458311 - DNA, 25 bp, Rattus norvegicus
tagaaccttgtcctacagcacgctg

SEQ ID NO: 458312 - DNA, 25 bp, Rattus norvegicus
ttgatgcctgcagtccgtctctggt

SEQ ID NO: 458313 - DNA, 25 bp, Rattus norvegicus
cactgctcgcatcggcgtgcaaatt

SEQ ID NO: 458314 - DNA, 25 bp, Rattus norvegicus
gcgagtttggcgcttcggtatcata

SEQ ID NO: 458315 - DNA, 25 bp, Rattus norvegicus
ggctcttggccatgtgcttggccga

SEQ ID NO: 458316 - DNA, 25 bp, Rattus norvegicus
ccggtttgtctaacatgtgaggtcc

SEQ ID NO: 458317 - DNA, 25 bp, Rattus norvegicus
cagctacgatctatgctctaccggt

SEQ ID NO: 458318 - DNA, 25 bp, Rattus norvegicus
ccgagtcggtaggtttccatcctca

SEQ ID NO: 458319 - DNA, 25 bp, Rattus norvegicus
atccgcaggggcgattccgaacacc

SEQ ID NO: 458320 - DNA, 25 bp, Rattus norvegicus
cgtagcgccggagtgacagcaccac

SEQ ID NO: 458321 - DNA, 25 bp, Rattus norvegicus
acgctccacttaccgcggaggcaaa

SEQ ID NO: 458322 - DNA, 25 bp, Rattus norvegicus
ctgtgtcctgcttgtcacctggcca

SEQ ID NO: 458323 - DNA, 25 bp, Rattus norvegicus
tcccttaaaagggtgttgacattgc

SEQ ID NO: 458324 - DNA, 25 bp, Rattus norvegicus
cttcgtctccgaaaggactccggtg

SEQ ID NO: 458325 - DNA, 25 bp, Rattus norvegicus
tcaagcagacagcaccgctaggttt

SEQ ID NO: 458326 - DNA, 25 bp, Rattus norvegicus
accgggtagatgctccgtggacatc

SEQ ID NO: 458327 - DNA, 25 bp, Rattus norvegicus
tgctgctttaagagatacggatgcc

SEQ ID NO: 458328 - DNA, 25 bp, Rattus norvegicus
gcaccagggaagttacaacttcgta

SEQ ID NO: 458329 - DNA, 25 bp, Rattus norvegicus
cgacccagccgcctttgcagtggct

SEQ ID NO: 458330 - DNA, 25 bp, Rattus norvegicus
aacttcgtacagtccagcctccggg

SEQ ID NO: 458331 - DNA, 25 bp, Rattus norvegicus
tacagtccagcctccgggtctatct

SEQ ID NO: 458332 - DNA, 25 bp, Rattus norvegicus
agcctccgggtctatctcggatcca

SEQ ID NO: 458333 - DNA, 25 bp, Rattus norvegicus
ccgggtctatctcggatccagtttg

SEQ ID NO: 458334 - DNA, 25 bp, Rattus norvegicus
cgttccgggccaggctgacaccggg

SEQ ID NO: 458335 - DNA, 25 bp, Rattus norvegicus
ctcgtgggcccatctctgagccggt

SEQ ID NO: 458336 - DNA, 25 bp, Rattus norvegicus
cctctccttcgcgttccgggccagg

SEQ ID NO: 458337 - DNA, 25 bp, Rattus norvegicus
gcgcggatctttccacccgccgccg

SEQ ID NO: 458338 - DNA, 25 bp, Rattus norvegicus
ggtgctgcgctcactgtcccggacg

SEQ ID NO: 458339 - DNA, 25 bp, Rattus norvegicus
agttacaacttcgtacagtccagcc

SEQ ID NO: 458340 - DNA, 25 bp, Rattus norvegicus
ggcccatctctgagccggtgctgcg

SEQ ID NO: 458341 - DNA, 25 bp, Rattus norvegicus
tctatctcggatccagtttggtccc

SEQ ID NO: 458342 - DNA, 25 bp, Rattus norvegicus
cagagagaaagggagccatgcctgt

SEQ ID NO: 458343 - DNA, 25 bp, Rattus norvegicus
tgcgctcctccttaacccgcgccgg

SEQ ID NO: 458344 - DNA, 25 bp, Rattus norvegicus
ttggggcacccagtgcccggacctg

SEQ ID NO: 458345 - DNA, 25 bp, Rattus norvegicus
cagaagagaccgccgcagggcacgc

SEQ ID NO: 458346 - DNA, 25 bp, Rattus norvegicus
gtccctcccacggtggctctagagg

SEQ ID NO: 458347 - DNA, 25 bp, Rattus norvegicus
cccacggtggctctagaggagaccc

SEQ ID NO: 458348 - DNA, 25 bp, Rattus norvegicus
cctagaagtcggacctgaaggacct

SEQ ID NO: 458349 - DNA, 25 bp, Rattus norvegicus
cctgaaggacctggagtgagacctc

SEQ ID NO: 458350 - DNA, 25 bp, Rattus norvegicus
gagtgagacctcacgcctcaacgca

SEQ ID NO: 458351 - DNA, 25 bp, Rattus norvegicus
ctcaacgcacgccagacagttcggg

SEQ ID NO: 458352 - DNA, 25 bp, Rattus norvegicus
gacagttcgggacttttgaggcaga

SEQ ID NO: 458353 - DNA, 25 bp, Rattus norvegicus
agccatgcctgtggagtaggcaccc

SEQ ID NO: 458354 - DNA, 25 bp, Rattus norvegicus
actcaccgcggagaggcgtcctgac

SEQ ID NO: 458355 - DNA, 25 bp, Rattus norvegicus
acgccagacagttcgggacttttga

SEQ ID NO: 458356 - DNA, 25 bp, Rattus norvegicus
gacgtcagcgtctaccggattccgc

SEQ ID NO: 458357 - DNA, 25 bp, Rattus norvegicus
gtaagcctacgacccaggctgccag

SEQ ID NO: 458358 - DNA, 25 bp, Rattus norvegicus
agaggaagccgtcggcgtctcagcc

SEQ ID NO: 458359 - DNA, 25 bp, Rattus norvegicus
cggagctggaatacgagtctgtgct

SEQ ID NO: 458360 - DNA, 25 bp, Rattus norvegicus
gtgtgaagcccgacgtcagcgtcta

SEQ ID NO: 458361 - DNA, 25 bp, Rattus norvegicus
gagcggtcccttagtaagcctacga

SEQ ID NO: 458362 - DNA, 25 bp, Rattus norvegicus
caaccgcggttacaggtaccgagtg

SEQ ID NO: 458363 - DNA, 25 bp, Rattus norvegicus
acaggtaccgagtgggatttgcagc

SEQ ID NO: 458364 - DNA, 25 bp, Rattus norvegicus
gatttgcagccggtgaccgccagga

SEQ ID NO: 458365 - DNA, 25 bp, Rattus norvegicus
tgaccgccaggataacgactgtgtc

SEQ ID NO: 458366 - DNA, 25 bp, Rattus norvegicus
aacgactgtgtccttgggcagcaca

SEQ ID NO: 458367 - DNA, 25 bp, Rattus norvegicus
ctcgaagccgtacccaagcggaagt

SEQ ID NO: 458368 - DNA, 25 bp, Rattus norvegicus
tgtgtccttgggcagcacacaccgg

SEQ ID NO: 458369 - DNA, 25 bp, Rattus norvegicus
atacgagtctgtgctgtgtgtgaag

SEQ ID NO: 458370 - DNA, 25 bp, Rattus norvegicus
ccgcttaatccgaagtagacactga

SEQ ID NO: 458371 - DNA, 25 bp, Rattus norvegicus
caggttctgcgatccgcccgagacg

SEQ ID NO: 458372 - DNA, 25 bp, Rattus norvegicus
gctgcttcgcttccgggactgctca

SEQ ID NO: 458373 - DNA, 25 bp, Rattus norvegicus
tcagtcggactctccgccatcgctg

SEQ ID NO: 458374 - DNA, 25 bp, Rattus norvegicus
gccgctcccgctaacgccgaccaca

SEQ ID NO: 458375 - DNA, 25 bp, Rattus norvegicus
gaggcgtgctgccagagcgtccacc

SEQ ID NO: 458376 - DNA, 25 bp, Rattus norvegicus
ccgcccacacatccggcaggaaagg

SEQ ID NO: 458377 - DNA, 25 bp, Rattus norvegicus
ggtcccaatggctaagcagcgcggc

SEQ ID NO: 458378 - DNA, 25 bp, Rattus norvegicus
ccgtcccagtccgagctgagcgtgg

SEQ ID NO: 458379 - DNA, 25 bp, Rattus norvegicus
gactgctcagcagctcgtccgccga

SEQ ID NO: 458380 - DNA, 25 bp, Rattus norvegicus
cgaagtagacactgaggcgcggttc

SEQ ID NO: 458381 - DNA, 25 bp, Rattus norvegicus
ggctcaccgcttaatccgaagtaga

SEQ ID NO: 458382 - DNA, 25 bp, Rattus norvegicus
agcgtccacccacggtcctccagag

SEQ ID NO: 458383 - DNA, 25 bp, Rattus norvegicus
cactgaggcgcggttcgctcgccgt

SEQ ID NO: 458384 - DNA, 25 bp, Rattus norvegicus
tctcgtggagatatgtgtacacatc

SEQ ID NO: 458385 - DNA, 25 bp, Rattus norvegicus
gcttgcgaggctcagcagttctgca

SEQ ID NO: 458386 - DNA, 25 bp, Rattus norvegicus
gaggtatttctcgtggagatatgtg

SEQ ID NO: 458387 - DNA, 25 bp, Rattus norvegicus
agatggccgccacgcgcattctgac

SEQ ID NO: 458388 - DNA, 25 bp, Rattus norvegicus
cagaacagaagcaagatggccgcca

SEQ ID NO: 458389 - DNA, 25 bp, Rattus norvegicus
tctgcaaaggcagaacagaagcaag

SEQ ID NO: 458390 - DNA, 25 bp, Rattus norvegicus
ggctcagcagttctgcaaaggcaga

SEQ ID NO: 458391 - DNA, 25 bp, Rattus norvegicus
gctgggatggccttggcttctcaaa

SEQ ID NO: 458392 - DNA, 25 bp, Rattus norvegicus
ggagcctctcctgccgccacctgct

SEQ ID NO: 458393 - DNA, 25 bp, Rattus norvegicus
gtttgaccgggctggagcctctcct

SEQ ID NO: 458394 - DNA, 25 bp, Rattus norvegicus
aaggcctggcgcgtagcgtttgacc

SEQ ID NO: 458395 - DNA, 25 bp, Rattus norvegicus
ggatggccttggcttctcaaagccc

SEQ ID NO: 458396 - DNA, 25 bp, Rattus norvegicus
tgtacacatcgcaaggaaggcctgg

SEQ ID NO: 458397 - DNA, 25 bp, Rattus norvegicus
catcgcaaggaaggcctggcgcgta

SEQ ID NO: 458398 - DNA, 25 bp, Rattus norvegicus
tcaaacctgcgcagcgtgatgggcg

SEQ ID NO: 458399 - DNA, 25 bp, Rattus norvegicus
ggctccaaagatcaccgccgctggt

SEQ ID NO: 458400 - DNA, 25 bp, Rattus norvegicus
gggcctcaaacctgcgcagcgtgat

SEQ ID NO: 458401 - DNA, 25 bp, Rattus norvegicus
gcgctgcggcccagctcaacggaaa

SEQ ID NO: 458402 - DNA, 25 bp, Rattus norvegicus
ccagctcaacggaaacgggcgaagg

SEQ ID NO: 458403 - DNA, 25 bp, Rattus norvegicus
cagcagctctacaaacgggcctgga

SEQ ID NO: 458404 - DNA, 25 bp, Rattus norvegicus
aatcttagctcgtgtcacctgagcc

SEQ ID NO: 458405 - DNA, 25 bp, Rattus norvegicus
cgggtctcaatcttagctcgtgtca

SEQ ID NO: 458406 - DNA, 25 bp, Rattus norvegicus
gcgctgcgggtctcaatcttagctc

SEQ ID NO: 458407 - DNA, 25 bp, Rattus norvegicus
actctaaccggacaagggagagcgg

SEQ ID NO: 458408 - DNA, 25 bp, Rattus norvegicus
agacaccgactctaaccggacaagg

SEQ ID NO: 458409 - DNA, 25 bp, Rattus norvegicus
tcgtaaacactagacaccgactcta

SEQ ID NO: 458410 - DNA, 25 bp, Rattus norvegicus
cgggtaacgcatcgtaaacactaga

SEQ ID NO: 458411 - DNA, 25 bp, Rattus norvegicus
gggagcacgggtaacgcatcgtaaa

SEQ ID NO: 458412 - DNA, 25 bp, Rattus norvegicus
ccaatgggaaggcagcgagcaagcc

SEQ ID NO: 458413 - DNA, 25 bp, Rattus norvegicus
ccttaacaagttggcgacgtccctg

SEQ ID NO: 458414 - DNA, 25 bp, Rattus norvegicus
ggtgtcgaggatctgagccttaaca

SEQ ID NO: 458415 - DNA, 25 bp, Rattus norvegicus
gcccgcagttaagatggcgtctaca

SEQ ID NO: 458416 - DNA, 25 bp, Rattus norvegicus
ggggtgaagccaccgcgttctgccc

SEQ ID NO: 458417 - DNA, 25 bp, Rattus norvegicus
ataatagggtgggtctagaggctct

SEQ ID NO: 458418 - DNA, 25 bp, Rattus norvegicus
tcacctttgccttacaaacgctcgg

SEQ ID NO: 458419 - DNA, 25 bp, Rattus norvegicus
ccttcttcacgggagtcacctttgc

SEQ ID NO: 458420 - DNA, 25 bp, Rattus norvegicus
ctccaatagcagctgggtcgggatc

SEQ ID NO: 458421 - DNA, 25 bp, Rattus norvegicus
agcaggcattcgcaccgctccgtta

SEQ ID NO: 458422 - DNA, 25 bp, Rattus norvegicus
gtccggaccgagttgtactgtcacc

SEQ ID NO: 458423 - DNA, 25 bp, Rattus norvegicus
gtaacctcgaggtctggtgacgccc

SEQ ID NO: 458424 - DNA, 25 bp, Rattus norvegicus
ccggcgaccgagagtaacctcgagg

SEQ ID NO: 458425 - DNA, 25 bp, Rattus norvegicus
agttgtactgtcacctcgcctcgcg

SEQ ID NO: 458426 - DNA, 25 bp, Rattus norvegicus
ctaaggcctccaatcctcgtgtgca

SEQ ID NO: 458427 - DNA, 25 bp, Rattus norvegicus
ttcctgcactgaaaaacgccgctca

SEQ ID NO: 458428 - DNA, 25 bp, Rattus norvegicus
ccgctcacgaggttggaagccacca

SEQ ID NO: 458429 - DNA, 25 bp, Rattus norvegicus
caccactggtcgcagccatcttgta

SEQ ID NO: 458430 - DNA, 25 bp, Rattus norvegicus
ccatcttgtaagcagaccggaagtt

SEQ ID NO: 458431 - DNA, 25 bp, Rattus norvegicus
ttagaacttcacgtccgcctcactg

SEQ ID NO: 458432 - DNA, 25 bp, Rattus norvegicus
gcgcttgaaaatggcgatacctgta

SEQ ID NO: 458433 - DNA, 25 bp, Rattus norvegicus
gatacctgtacggaagcctctctaa

SEQ ID NO: 458434 - DNA, 25 bp, Rattus norvegicus
gttcagagagaacgcacttccggtg

SEQ ID NO: 458435 - DNA, 25 bp, Rattus norvegicus
tgccgccgccttcaggagaatcaga

SEQ ID NO: 458436 - DNA, 25 bp, Rattus norvegicus
tggcccagaacttaaaggacctagc

SEQ ID NO: 458437 - DNA, 25 bp, Rattus norvegicus
ggcgtccgtgagtccgtattcactg

SEQ ID NO: 458438 - DNA, 25 bp, Rattus norvegicus
ctggtgagcaacctccttccactga

SEQ ID NO: 458439 - DNA, 25 bp, Rattus norvegicus
ggacttccggatgcgccattactgt

SEQ ID NO: 458440 - DNA, 25 bp, Rattus norvegicus
ttatctggaggataagctcgtcctc

SEQ ID NO: 458441 - DNA, 25 bp, Rattus norvegicus
tcgtccatacgcacggcgttctctg

SEQ ID NO: 458442 - DNA, 25 bp, Rattus norvegicus
gggccgagaacgcttggatcacctc

SEQ ID NO: 458443 - DNA, 25 bp, Rattus norvegicus
gccaagaccactgcgagaccgaagc

SEQ ID NO: 458444 - DNA, 25 bp, Rattus norvegicus
ccagggaattagtggaccgaggcct

SEQ ID NO: 458445 - DNA, 25 bp, Rattus norvegicus
cgcattgtctctagcctcgtccata

SEQ ID NO: 458446 - DNA, 25 bp, Rattus norvegicus
ccacttggagaaggaacgaatagta

SEQ ID NO: 458447 - DNA, 25 bp, Rattus norvegicus
agaagacggcccacgcccagactag

SEQ ID NO: 458448 - DNA, 25 bp, Rattus norvegicus
taggacgccactcggtgcttgaata

SEQ ID NO: 458449 - DNA, 25 bp, Rattus norvegicus
agtgtgaacactgagatccggagga

SEQ ID NO: 458450 - DNA, 25 bp, Rattus norvegicus
ctgtattgcaggaggcggaagttcc

SEQ ID NO: 458451 - DNA, 25 bp, Rattus norvegicus
agttcccgagcgtgaatctagcaca

SEQ ID NO: 458452 - DNA, 25 bp, Rattus norvegicus
agcacacgcgtacttcctaggaaac

SEQ ID NO: 458453 - DNA, 25 bp, Rattus norvegicus
ccgaagcatcccagagaggtccgcg

SEQ ID NO: 458454 - DNA, 25 bp, Rattus norvegicus
gcttcttggccagcttggatccctc

SEQ ID NO: 458455 - DNA, 25 bp, Rattus norvegicus
tggatccctccagcggcacaaagta

SEQ ID NO: 458456 - DNA, 25 bp, Rattus norvegicus
gcacaaagtacaggtcgctgcgcgc

SEQ ID NO: 458457 - DNA, 25 bp, Rattus norvegicus
gcgcacgagttgaagccacggtcca

SEQ ID NO: 458458 - DNA, 25 bp, Rattus norvegicus
ccacggtccaggtgcttattgaacc

SEQ ID NO: 458459 - DNA, 25 bp, Rattus norvegicus
ggcgcagacctgtgagcctcaaaag

SEQ ID NO: 458460 - DNA, 25 bp, Rattus norvegicus
ccaccggcttgtctctaaatccaga

SEQ ID NO: 458461 - DNA, 25 bp, Rattus norvegicus
ctacgctggacgtgaacgcaaagcc

SEQ ID NO: 458462 - DNA, 25 bp, Rattus norvegicus
cctaggctgctcacctggctgactg

SEQ ID NO: 458463 - DNA, 25 bp, Rattus norvegicus
gctaggcacgtccaccaccttagga

SEQ ID NO: 458464 - DNA, 25 bp, Rattus norvegicus
gggtttcatactcttcagctggttc

SEQ ID NO: 458465 - DNA, 25 bp, Rattus norvegicus
ttcctgtttgatctgcgtggcagtc

SEQ ID NO: 458466 - DNA, 25 bp, Rattus norvegicus
gcagagatgacaaacttgaaggccc

SEQ ID NO: 458467 - DNA, 25 bp, Rattus norvegicus
gctctttttcttcgcgcgcgcgctg

SEQ ID NO: 458468 - DNA, 25 bp, Rattus norvegicus
cgtcagccctcctaccaagaccctc

SEQ ID NO: 458469 - DNA, 25 bp, Rattus norvegicus
cttgttgcgcggcttcagtcgctgc

SEQ ID NO: 458470 - DNA, 25 bp, Rattus norvegicus
gagtgcagtcgagctccggcgcctc

SEQ ID NO: 458471 - DNA, 25 bp, Rattus norvegicus
ctggcagcgagtgcagtcgagctcc

SEQ ID NO: 458472 - DNA, 25 bp, Rattus norvegicus
accttacctgcgagcggctcgggac

SEQ ID NO: 458473 - DNA, 25 bp, Rattus norvegicus
cggcggaccttacctgcgagcggct

SEQ ID NO: 458474 - DNA, 25 bp, Rattus norvegicus
tgcccgcaataagggaacgcgaccg

SEQ ID NO: 458475 - DNA, 25 bp, Rattus norvegicus
cggtcgtgcccgcaataagggaacg

SEQ ID NO: 458476 - DNA, 25 bp, Rattus norvegicus
ccacctcccgagctcgcgactcccg

SEQ ID NO: 458477 - DNA, 25 bp, Rattus norvegicus
ccaagtctccacctcggcgttcctc

SEQ ID NO: 458478 - DNA, 25 bp, Rattus norvegicus
ctccgcgaaccacccgcacagcatc

SEQ ID NO: 458479 - DNA, 25 bp, Rattus norvegicus
gatccgtcctgccttctccgcgaac

SEQ ID NO: 458480 - DNA, 25 bp, Rattus norvegicus
gctgccatctctccgatccgtcctg

SEQ ID NO: 458481 - DNA, 25 bp, Rattus norvegicus
tcgggcccggtcgtgcccgcaataa

SEQ ID NO: 458482 - DNA, 25 bp, Rattus norvegicus
agtggacgcggcaaggacagagtaa

SEQ ID NO: 458483 - DNA, 25 bp, Rattus norvegicus
cgctaagcccaggataacggggagt

SEQ ID NO: 458484 - DNA, 25 bp, Rattus norvegicus
caaggacagagtaaggggatgcggc

SEQ ID NO: 458485 - DNA, 25 bp, Rattus norvegicus
ggatgcggcccgatacgggcctcac

SEQ ID NO: 458486 - DNA, 25 bp, Rattus norvegicus
gatacgggcctcacctcgaggactg

SEQ ID NO: 458487 - DNA, 25 bp, Rattus norvegicus
cgggcctcacctcgaggactgcaga

SEQ ID NO: 458488 - DNA, 25 bp, Rattus norvegicus
tcacctcgaggactgcagactcagc

SEQ ID NO: 458489 - DNA, 25 bp, Rattus norvegicus
ctcgaggactgcagactcagccggt

SEQ ID NO: 458490 - DNA, 25 bp, Rattus norvegicus
actgcagactcagccggtggcggtg

SEQ ID NO: 458491 - DNA, 25 bp, Rattus norvegicus
gcggcgcctatagagccgagcgagc

SEQ ID NO: 458492 - DNA, 25 bp, Rattus norvegicus
ccgagcgagcgcatgtgacccgggg

SEQ ID NO: 458493 - DNA, 25 bp, Rattus norvegicus
cccgatgagtcaagagctgcaggcg

SEQ ID NO: 458494 - DNA, 25 bp, Rattus norvegicus
tgagtcaagagctgcaggcggagac

SEQ ID NO: 458495 - DNA, 25 bp, Rattus norvegicus
caggcggagacgcacgtacgagcgc

SEQ ID NO: 458496 - DNA, 25 bp, Rattus norvegicus
cccaccttggtggttcgacagttga

SEQ ID NO: 458497 - DNA, 25 bp, Rattus norvegicus
ctcttctaaacggagctcaccggtg

SEQ ID NO: 458498 - DNA, 25 bp, Rattus norvegicus
gcagatgagttctcccaggcatttc

SEQ ID NO: 458499 - DNA, 25 bp, Rattus norvegicus
ggcatttcttcctcccgttcatctt

SEQ ID NO: 458500 - DNA, 25 bp, Rattus norvegicus
ccgacgaagaacttcctggaaggcg

SEQ ID NO: 458501 - DNA, 25 bp, Rattus norvegicus
tggaaggcgccattgcacaaggatc

SEQ ID NO: 458502 - DNA, 25 bp, Rattus norvegicus
cacaaggatcaactctctgaaggtc

SEQ ID NO: 458503 - DNA, 25 bp, Rattus norvegicus
tgaaggtcagaacaaacgctcggct

SEQ ID NO: 458504 - DNA, 25 bp, Rattus norvegicus
tggccaccggccacttatatagatc

SEQ ID NO: 458505 - DNA, 25 bp, Rattus norvegicus
cgctgtgaagcagaactcctccttt

SEQ ID NO: 458506 - DNA, 25 bp, Rattus norvegicus
acctcccggtgtttctatattctga

SEQ ID NO: 458507 - DNA, 25 bp, Rattus norvegicus
ctgacgtttctcctttcttgtagca

SEQ ID NO: 458508 - DNA, 25 bp, Rattus norvegicus
cttgtagcaatgttctaggggtttc

SEQ ID NO: 458509 - DNA, 25 bp, Rattus norvegicus
cgacagttgagatgtcgagcctcgc

SEQ ID NO: 458510 - DNA, 25 bp, Rattus norvegicus
cgagatcggcagttggactgagcct

SEQ ID NO: 458511 - DNA, 25 bp, Rattus norvegicus
aaagcgctgccggtacaactgatgg

SEQ ID NO: 458512 - DNA, 25 bp, Rattus norvegicus
atgccaataaaaagcgctgccggta

SEQ ID NO: 458513 - DNA, 25 bp, Rattus norvegicus
tggactgagcctgcctcctggcgct

SEQ ID NO: 458514 - DNA, 25 bp, Rattus norvegicus
ctaaaggcaagacgcgcgagatcgg

SEQ ID NO: 458515 - DNA, 25 bp, Rattus norvegicus
atgagcgcgactcactatgcgcatg

SEQ ID NO: 458516 - DNA, 25 bp, Rattus norvegicus
cgcgtccaatgagcgcgactcacta

SEQ ID NO: 458517 - DNA, 25 bp, Rattus norvegicus
acggcagctcccactgtacctagta

SEQ ID NO: 458518 - DNA, 25 bp, Rattus norvegicus
tccgccatgacaccggcagcagctc

SEQ ID NO: 458519 - DNA, 25 bp, Rattus norvegicus
tcgtcggtaacactgacagcagcgc

SEQ ID NO: 458520 - DNA, 25 bp, Rattus norvegicus
gggacacggatcgtcggtaacactg

SEQ ID NO: 458521 - DNA, 25 bp, Rattus norvegicus
tatgcgcatgcgctaaaggcaagac

SEQ ID NO: 458522 - DNA, 25 bp, Rattus norvegicus
gccctctgccctgaatgccaataaa

SEQ ID NO: 458523 - DNA, 25 bp, Rattus norvegicus
gtgtcgaaagagaaagcacactcgt

SEQ ID NO: 458524 - DNA, 25 bp, Rattus norvegicus
ggagcttcgtggcaattcccgcctc

SEQ ID NO: 458525 - DNA, 25 bp, Rattus norvegicus
attgggctttgtagtcccgtccgag

SEQ ID NO: 458526 - DNA, 25 bp, Rattus norvegicus
cgcttggaccttggagcgcattgca

SEQ ID NO: 458527 - DNA, 25 bp, Rattus norvegicus
cgagtcttcattcggccgcttggac

SEQ ID NO: 458528 - DNA, 25 bp, Rattus norvegicus
cgtaacgtgggctccgagtcttcat

SEQ ID NO: 458529 - DNA, 25 bp, Rattus norvegicus
ccgcttgacgcaggcggacacgtaa

SEQ ID NO: 458530 - DNA, 25 bp, Rattus norvegicus
gcgaccaaggtgcaagcggaagaaa

SEQ ID NO: 458531 - DNA, 25 bp, Rattus norvegicus
tcccgaaatgcttgaccatagagtc

SEQ ID NO: 458532 - DNA, 25 bp, Rattus norvegicus
ttacgattggtcgaatcccgaaatg

SEQ ID NO: 458533 - DNA, 25 bp, Rattus norvegicus
ctccttgcggataaaggcggggtct

SEQ ID NO: 458534 - DNA, 25 bp, Rattus norvegicus
acatcccgcgagacgttgcttcttg

SEQ ID NO: 458535 - DNA, 25 bp, Rattus norvegicus
tgggagtgactaccgcccgcttgac

SEQ ID NO: 458536 - DNA, 25 bp, Rattus norvegicus
gggtctttttccgagatcgtgatta

SEQ ID NO: 458537 - DNA, 25 bp, Rattus norvegicus
gtcgacgagactcagaggttctaca

SEQ ID NO: 458538 - DNA, 25 bp, Rattus norvegicus
tcagaggttcgacacggaagcagta

SEQ ID NO: 458539 - DNA, 25 bp, Rattus norvegicus
cccggtaagtgatctaagtggatta

SEQ ID NO: 458540 - DNA, 25 bp, Rattus norvegicus
tggttaaattcgaagctcccgcaga

SEQ ID NO: 458541 - DNA, 25 bp, Rattus norvegicus
ccgcagacctgaacgctccattaaa

SEQ ID NO: 458542 - DNA, 25 bp, Rattus norvegicus
gctccattaaaaagctccacttatt

SEQ ID NO: 458543 - DNA, 25 bp, Rattus norvegicus
gccgaggtctctgggctagcgacct

SEQ ID NO: 458544 - DNA, 25 bp, Rattus norvegicus
tcctctgctggaaactgggaagatc

SEQ ID NO: 458545 - DNA, 25 bp, Rattus norvegicus
cgctggggcccggtaagtgatctaa

SEQ ID NO: 458546 - DNA, 25 bp, Rattus norvegicus
ggaagcagtaagctccgagacccga

SEQ ID NO: 458547 - DNA, 25 bp, Rattus norvegicus
cgagacccgagtcttttctgatgga

SEQ ID NO: 458548 - DNA, 25 bp, Rattus norvegicus
gtcttttctgatggacgttccttcc

SEQ ID NO: 458549 - DNA, 25 bp, Rattus norvegicus
ggacgttccttcctctgcgtctgca

SEQ ID NO: 458550 - DNA, 25 bp, Rattus norvegicus
tagcgacctggaggttcctctgctg

SEQ ID NO: 458551 - DNA, 25 bp, Rattus norvegicus
tctaagtggattagtggttaaattc

SEQ ID NO: 458552 - DNA, 25 bp, Rattus norvegicus
ccctgtggcgacacatcgggtacca

SEQ ID NO: 458553 - DNA, 25 bp, Rattus norvegicus
ctccctgtcgctggcgattgtccta

SEQ ID NO: 458554 - DNA, 25 bp, Rattus norvegicus
atcgggtaccactcatcgtgaccgc

SEQ ID NO: 458555 - DNA, 25 bp, Rattus norvegicus
atcgtgaccgcccagaatgtgcccg

SEQ ID NO: 458556 - DNA, 25 bp, Rattus norvegicus
tcgtctccttcatctgctgtcgctg

SEQ ID NO: 458557 - DNA, 25 bp, Rattus norvegicus
agcagactcgggagcacgtccgcca

SEQ ID NO: 458558 - DNA, 25 bp, Rattus norvegicus
gccagcacgtcgaagtgggtgacca

SEQ ID NO: 458559 - DNA, 25 bp, Rattus norvegicus
gtgaccagccgcagagccatggctc

SEQ ID NO: 458560 - DNA, 25 bp, Rattus norvegicus
agccatggctcgcaaacagcggcgg

SEQ ID NO: 458561 - DNA, 25 bp, Rattus norvegicus
ggacattccgggcaggctcacacct

SEQ ID NO: 458562 - DNA, 25 bp, Rattus norvegicus
ctgctgctttcggttcagggttctg

SEQ ID NO: 458563 - DNA, 25 bp, Rattus norvegicus
tgcaccggggagcatttcttgtagc

SEQ ID NO: 458564 - DNA, 25 bp, Rattus norvegicus
atttcttgtagctcggggacaccgc

SEQ ID NO: 458565 - DNA, 25 bp, Rattus norvegicus
ccagagcctctctgggacttcgggc

SEQ ID NO: 458566 - DNA, 25 bp, Rattus norvegicus
atcgcaagtcctggccaccgtttcg

SEQ ID NO: 458567 - DNA, 25 bp, Rattus norvegicus
tggccaccgtttcgatggtacccac

SEQ ID NO: 458568 - DNA, 25 bp, Rattus norvegicus
tggtacccactcaggagtccgttat

SEQ ID NO: 458569 - DNA, 25 bp, Rattus norvegicus
gagtccgttatacgccctccacgag

SEQ ID NO: 458570 - DNA, 25 bp, Rattus norvegicus
ctggtcagctccaagtaagacagtc

SEQ ID NO: 458571 - DNA, 25 bp, Rattus norvegicus
taagacagtcactgggcttggttgg

SEQ ID NO: 458572 - DNA, 25 bp, Rattus norvegicus
gcacctggtagtaggccctctgcag

SEQ ID NO: 458573 - DNA, 25 bp, Rattus norvegicus
tctcgcagcagagccactgcgggcg

SEQ ID NO: 458574 - DNA, 25 bp, Rattus norvegicus
ggccgagtaggctctcaggccgtcc

SEQ ID NO: 458575 - DNA, 25 bp, Rattus norvegicus
ctctcaggccgtccgcgtaaagcaa

SEQ ID NO: 458576 - DNA, 25 bp, Rattus norvegicus
ccgcgtaaagcaagtccggggcctg

SEQ ID NO: 458577 - DNA, 25 bp, Rattus norvegicus
gcaaaagcaacaaccgcaggagccg

SEQ ID NO: 458578 - DNA, 25 bp, Rattus norvegicus
gcccaccgccgaagggaaatgcgga

SEQ ID NO: 458579 - DNA, 25 bp, Rattus norvegicus
agcagcagcaaaagcaacaaccgca

SEQ ID NO: 458580 - DNA, 25 bp, Rattus norvegicus
ctgtctcctagggtcatcggcctgc

SEQ ID NO: 458581 - DNA, 25 bp, Rattus norvegicus
cggtttttcaacacgaatgagcccg

SEQ ID NO: 458582 - DNA, 25 bp, Rattus norvegicus
aggggtcctcttacctctggttgtg

SEQ ID NO: 458583 - DNA, 25 bp, Rattus norvegicus
ttacctctggttgtgtcctgctctg

SEQ ID NO: 458584 - DNA, 25 bp, Rattus norvegicus
gttgtgtcctgctctgctgaggaga

SEQ ID NO: 458585 - DNA, 25 bp, Rattus norvegicus
tcctgctctgctgaggagacgcact

SEQ ID NO: 458586 - DNA, 25 bp, Rattus norvegicus
aggagacgcactcccgacgaggctc

SEQ ID NO: 458587 - DNA, 25 bp, Rattus norvegicus
ctcagcccgcggcacgctagtttga

SEQ ID NO: 458588 - DNA, 25 bp, Rattus norvegicus
gcccgcggcacgctagtttgaggcc

SEQ ID NO: 458589 - DNA, 25 bp, Rattus norvegicus
tcatcggcctgcgagcctggggtta

SEQ ID NO: 458590 - DNA, 25 bp, Rattus norvegicus
ttagggagccgttggccagtcttgg

SEQ ID NO: 458591 - DNA, 25 bp, Rattus norvegicus
aactggacggcggtgacttagagga

SEQ ID NO: 458592 - DNA, 25 bp, Rattus norvegicus
ttcattggtgaagcggttggtgtcc

SEQ ID NO: 458593 - DNA, 25 bp, Rattus norvegicus
ccatcccggtttttcaacacgaatg

SEQ ID NO: 458594 - DNA, 25 bp, Rattus norvegicus
cgggatctgagaggcgccactctct

SEQ ID NO: 458595 - DNA, 25 bp, Rattus norvegicus
cccgggagagtcctgtttacacttg

SEQ ID NO: 458596 - DNA, 25 bp, Rattus norvegicus
gaacccgcttttaaggcggcgctgc

SEQ ID NO: 458597 - DNA, 25 bp, Rattus norvegicus
ccaaaccgcttagcagaggaaaggt

SEQ ID NO: 458598 - DNA, 25 bp, Rattus norvegicus
tcatagtggaaagggacttggagcc

SEQ ID NO: 458599 - DNA, 25 bp, Rattus norvegicus
cttgaggatcccaaaccgcttagca

SEQ ID NO: 458600 - DNA, 25 bp, Rattus norvegicus
gccactctctgaccggagggcggac

SEQ ID NO: 458601 - DNA, 25 bp, Rattus norvegicus
tgcccgtaccttggcgcttagctcg

SEQ ID NO: 458602 - DNA, 25 bp, Rattus norvegicus
gtcctgtttacacttgaggatccca

SEQ ID NO: 458603 - DNA, 25 bp, Rattus norvegicus
ttggcgcttagctcggccgctgcct

SEQ ID NO: 458604 - DNA, 25 bp, Rattus norvegicus
acgctcttctccgacatggtgccgg

SEQ ID NO: 458605 - DNA, 25 bp, Rattus norvegicus
cgctcggcaagctggctcgcagcaa

SEQ ID NO: 458606 - DNA, 25 bp, Rattus norvegicus
gtcgcggtcgctcggtcttgctcgc

SEQ ID NO: 458607 - DNA, 25 bp, Rattus norvegicus
ttagcagaggaaaggtgaggtcata

SEQ ID NO: 458608 - DNA, 25 bp, Rattus norvegicus
ccctcctgcactgagtttaaaggtc

SEQ ID NO: 458609 - DNA, 25 bp, Rattus norvegicus
agcgtctctccagagggacaggccc

SEQ ID NO: 458610 - DNA, 25 bp, Rattus norvegicus
cctcccgcaaagaaggtgcggcaca

SEQ ID NO: 458611 - DNA, 25 bp, Rattus norvegicus
cgtgccagcttaacgagacctccca

SEQ ID NO: 458612 - DNA, 25 bp, Rattus norvegicus
agactgtccgtcatgacgtcacttc

SEQ ID NO: 458613 - DNA, 25 bp, Rattus norvegicus
cctgaccgaggttcggctcctcggg

SEQ ID NO: 458614 - DNA, 25 bp, Rattus norvegicus
aggcgagaagctcccgcgcggacca

SEQ ID NO: 458615 - DNA, 25 bp, Rattus norvegicus
gccgagaccctgctcctgcagcgcc

SEQ ID NO: 458616 - DNA, 25 bp, Rattus norvegicus
cgtgccagcagaaggcggagtagtt

SEQ ID NO: 458617 - DNA, 25 bp, Rattus norvegicus
ggccgccgttcgagattctcatcga

SEQ ID NO: 458618 - DNA, 25 bp, Rattus norvegicus
cgagattctcatcgagactggcgtc

SEQ ID NO: 458619 - DNA, 25 bp, Rattus norvegicus
tctcatcgagactggcgtcggagga

SEQ ID NO: 458620 - DNA, 25 bp, Rattus norvegicus
ccggagcgtctctccagagggacag

SEQ ID NO: 458621 - DNA, 25 bp, Rattus norvegicus
gcgctcaaccagtccctcccgattc

SEQ ID NO: 458622 - DNA, 25 bp, Rattus norvegicus
cgtgtcttgcacgtgtcctcaacca

SEQ ID NO: 458623 - DNA, 25 bp, Rattus norvegicus
ctcccagctctaaactcgtgtcttg

SEQ ID NO: 458624 - DNA, 25 bp, Rattus norvegicus
tccgcgaatctgtgcccaaggccgg

SEQ ID NO: 458625 - DNA, 25 bp, Rattus norvegicus
gactgcgaccgaccgctacctggaa

SEQ ID NO: 458626 - DNA, 25 bp, Rattus norvegicus
gtcgctctagccacgcgcttctatg

SEQ ID NO: 458627 - DNA, 25 bp, Rattus norvegicus
tatggccagtttccggccgcacttc

SEQ ID NO: 458628 - DNA, 25 bp, Rattus norvegicus
gctatggcctgcttccgtttcccga

SEQ ID NO: 458629 - DNA, 25 bp, Rattus norvegicus
tgagagagcgacacctagcttccgc

SEQ ID NO: 458630 - DNA, 25 bp, Rattus norvegicus
cttccgctctgtcgataaagcttta

SEQ ID NO: 458631 - DNA, 25 bp, Rattus norvegicus
gatgccgggtgtagagaaaatcctg

SEQ ID NO: 458632 - DNA, 25 bp, Rattus norvegicus
agaaaatcctggctccgtggaggtc

SEQ ID NO: 458633 - DNA, 25 bp, Rattus norvegicus
tcctgggtagatgaaccgcccggta

SEQ ID NO: 458634 - DNA, 25 bp, Rattus norvegicus
ttcctccggccgcatgagcgttagt

SEQ ID NO: 458635 - DNA, 25 bp, Rattus norvegicus
tttcccgaccgaaggaggtgagaga

SEQ ID NO: 458636 - DNA, 25 bp, Rattus norvegicus
ctaccggtagggagctggctctgtc

SEQ ID NO: 458637 - DNA, 25 bp, Rattus norvegicus
cagttcgtcttctgcgcacaacagg

SEQ ID NO: 458638 - DNA, 25 bp, Rattus norvegicus
tctctgctagagatggggcccggtt

SEQ ID NO: 458639 - DNA, 25 bp, Rattus norvegicus
tttccagccctgtccagggagcgca

SEQ ID NO: 458640 - DNA, 25 bp, Rattus norvegicus
catggccgatctttttcccattttc

SEQ ID NO: 458641 - DNA, 25 bp, Rattus norvegicus
ctccaaattccatggccgatctttt

SEQ ID NO: 458642 - DNA, 25 bp, Rattus norvegicus
tgggtgctccctccaaattccatgg

SEQ ID NO: 458643 - DNA, 25 bp, Rattus norvegicus
tcaggttccctttccgctctgggtg

SEQ ID NO: 458644 - DNA, 25 bp, Rattus norvegicus
tcatcctgcagcttcgggcatcctc

SEQ ID NO: 458645 - DNA, 25 bp, Rattus norvegicus
gtgcagcagtcaacgtctccgcgtc

SEQ ID NO: 458646 - DNA, 25 bp, Rattus norvegicus
tctgcgcacaacaggtcggtgagga

SEQ ID NO: 458647 - DNA, 25 bp, Rattus norvegicus
tgactccatcctatcctcttggtgc

SEQ ID NO: 458648 - DNA, 25 bp, Rattus norvegicus
gccgccacaccaggcatgcaggtga

SEQ ID NO: 458649 - DNA, 25 bp, Rattus norvegicus
catcctatcctcttggtgcagcagt

SEQ ID NO: 458650 - DNA, 25 bp, Rattus norvegicus
cgaccgtgaacaggcgcgcaaaaac

SEQ ID NO: 458651 - DNA, 25 bp, Rattus norvegicus
tttcagtcacttccggggaggatcg

SEQ ID NO: 458652 - DNA, 25 bp, Rattus norvegicus
cagcgcctgtcgtttcagtcacttc

SEQ ID NO: 458653 - DNA, 25 bp, Rattus norvegicus
tccaagaatggtcacagcgcctgtc

SEQ ID NO: 458654 - DNA, 25 bp, Rattus norvegicus
acggaaaggttgtaatccaagaatg

SEQ ID NO: 458655 - DNA, 25 bp, Rattus norvegicus
acaggcgcgcaaaaacgttcaatgc

SEQ ID NO: 458656 - DNA, 25 bp, Rattus norvegicus
taaagcagcctcgatgtgggcgacc

SEQ ID NO: 458657 - DNA, 25 bp, Rattus norvegicus
gcggaagccaggctaaagcagcctc

SEQ ID NO: 458658 - DNA, 25 bp, Rattus norvegicus
acgtcttactaagggcggaagccag

SEQ ID NO: 458659 - DNA, 25 bp, Rattus norvegicus
gcaggaacatactaacgtcttacta

SEQ ID NO: 458660 - DNA, 25 bp, Rattus norvegicus
cctgtcgcaggaacatactaacgtc

SEQ ID NO: 458661 - DNA, 25 bp, Rattus norvegicus
cgtgacgtcatacctgtcgcaggaa

SEQ ID NO: 458662 - DNA, 25 bp, Rattus norvegicus
gactttgcgtgacgtcatacctgtc

SEQ ID NO: 458663 - DNA, 25 bp, Rattus norvegicus
aaaaacgttcaatgccgggcggatg

SEQ ID NO: 458664 - DNA, 25 bp, Rattus norvegicus
ctgcgggccaacctggtaaagaaca

SEQ ID NO: 458665 - DNA, 25 bp, Rattus norvegicus
ctccacgctggcagtttatgggttg

SEQ ID NO: 458666 - DNA, 25 bp, Rattus norvegicus
ttctgctgtgcttcgtgccctacaa

SEQ ID NO: 458667 - DNA, 25 bp, Rattus norvegicus
gtaacactcttcgaaacctgggcgc

SEQ ID NO: 458668 - DNA, 25 bp, Rattus norvegicus
tcagcgccgagggttttcgtaacac

SEQ ID NO: 458669 - DNA, 25 bp, Rattus norvegicus
gtgcatccgctgagactgcgccatc

SEQ ID NO: 458670 - DNA, 25 bp, Rattus norvegicus
gctggatccgctggtttactacttc

SEQ ID NO: 458671 - DNA, 25 bp, Rattus norvegicus
ggccaacctcatcatctttctgctg

SEQ ID NO: 458672 - DNA, 25 bp, Rattus norvegicus
gacagaagaccgtgcgcctcctact

SEQ ID NO: 458673 - DNA, 25 bp, Rattus norvegicus
cggctgtcgtctattcgtccggcag

SEQ ID NO: 458674 - DNA, 25 bp, Rattus norvegicus
ctgagcctgtgcttcgagagcttca

SEQ ID NO: 458675 - DNA, 25 bp, Rattus norvegicus
gtacgagaacgtcaccctgagcctg

SEQ ID NO: 458676 - DNA, 25 bp, Rattus norvegicus
agcccgaccacctgcaagtacgaga

SEQ ID NO: 458677 - DNA, 25 bp, Rattus norvegicus
gtgggctctcatcctgctgttcgcc

SEQ ID NO: 458678 - DNA, 25 bp, Rattus norvegicus
aattgcggcattcggcccgcctgtg

SEQ ID NO: 458679 - DNA, 25 bp, Rattus norvegicus
gcctgggaggccctatatgcaaata

SEQ ID NO: 458680 - DNA, 25 bp, Rattus norvegicus
agactagaggtctcgccgctcctcg

SEQ ID NO: 458681 - DNA, 25 bp, Rattus norvegicus
gtctccagggacaaccttggcacta

SEQ ID NO: 458682 - DNA, 25 bp, Rattus norvegicus
cgcggcgacggttaatcagattccc

SEQ ID NO: 458683 - DNA, 25 bp, Rattus norvegicus
tgccgcaggggccaatcgaaagcct

SEQ ID NO: 458684 - DNA, 25 bp, Rattus norvegicus
ctatatgcaaatatgagggccggga

SEQ ID NO: 458685 - DNA, 25 bp, Rattus norvegicus
gctcagattggggtcgcggtaccct

SEQ ID NO: 458686 - DNA, 25 bp, Rattus norvegicus
ggtaccctgaatgtggctgccaatg

SEQ ID NO: 458687 - DNA, 25 bp, Rattus norvegicus
ctgccaatgggagcctgaattcctc

SEQ ID NO: 458688 - DNA, 25 bp, Rattus norvegicus
gattgcgggcgatctgagccgccca

SEQ ID NO: 458689 - DNA, 25 bp, Rattus norvegicus
cagaagctttgaattgcggcattcg

SEQ ID NO: 458690 - DNA, 25 bp, Rattus norvegicus
ccgctgatctgaagagcagaagctt

SEQ ID NO: 458691 - DNA, 25 bp, Rattus norvegicus
cctccgagaaggaatggttcggcta

SEQ ID NO: 458692 - DNA, 25 bp, Rattus norvegicus
cctttaagaggcgacgccggagccg

SEQ ID NO: 458693 - DNA, 25 bp, Rattus norvegicus
cgtggccaatggttgcctgagcgac

SEQ ID NO: 458694 - DNA, 25 bp, Rattus norvegicus
gagttgtcccagaggacagcctttg

SEQ ID NO: 458695 - DNA, 25 bp, Rattus norvegicus
ttccggaagagaacctgagttgtcc

SEQ ID NO: 458696 - DNA, 25 bp, Rattus norvegicus
ttttctctggcgtcccgactctttg

SEQ ID NO: 458697 - DNA, 25 bp, Rattus norvegicus
ctttcccgtgggtgctcgcttttct

SEQ ID NO: 458698 - DNA, 25 bp, Rattus norvegicus
ttgagggagtcctgctcctcgctac

SEQ ID NO: 458699 - DNA, 25 bp, Rattus norvegicus
ctctccagggagtcgatccttcttc

SEQ ID NO: 458700 - DNA, 25 bp, Rattus norvegicus
agacatctctctcagtccgacatcg

SEQ ID NO: 458701 - DNA, 25 bp, Rattus norvegicus
agtgacaccggcgagacccagcgcg

SEQ ID NO: 458702 - DNA, 25 bp, Rattus norvegicus
acagcctttggagagctgccctgtc

SEQ ID NO: 458703 - DNA, 25 bp, Rattus norvegicus
ttgaggttattatgggctgtccgtg

SEQ ID NO: 458704 - DNA, 25 bp, Rattus norvegicus
ggcactcctggctcggtccaggcta

SEQ ID NO: 458705 - DNA, 25 bp, Rattus norvegicus
gcgaggcaacgggagagacatctct

SEQ ID NO: 458706 - DNA, 25 bp, Rattus norvegicus
tgcggccttaggagtaacaagcagg

SEQ ID NO: 458707 - DNA, 25 bp, Rattus norvegicus
agccaactcccgaactgagggcaga

SEQ ID NO: 458708 - DNA, 25 bp, Rattus norvegicus
ggcgtttacctctgtgaaccgcgga

SEQ ID NO: 458709 - DNA, 25 bp, Rattus norvegicus
cgtgttcctggatcaggtccgttcc

SEQ ID NO: 458710 - DNA, 25 bp, Rattus norvegicus
tccggaagctttgcgcgtagttcac

SEQ ID NO: 458711 - DNA, 25 bp, Rattus norvegicus
ttcactttcgcggtgtgctgcctct

SEQ ID NO: 458712 - DNA, 25 bp, Rattus norvegicus
ctgggtctgccggaaccagtcctag

SEQ ID NO: 458713 - DNA, 25 bp, Rattus norvegicus
cagtcctaggcaagccgagccttca

SEQ ID NO: 458714 - DNA, 25 bp, Rattus norvegicus
agcagggtttcgacctgagcttctc

SEQ ID NO: 458715 - DNA, 25 bp, Rattus norvegicus
gcggtgcttcgtcccagataatatc

SEQ ID NO: 458716 - DNA, 25 bp, Rattus norvegicus
agataatatccctaagcctgcgttc

SEQ ID NO: 458717 - DNA, 25 bp, Rattus norvegicus
cgtcgccttccctcatttttctttg

SEQ ID NO: 458718 - DNA, 25 bp, Rattus norvegicus
ggcgcaagttggatcctacgaagaa

SEQ ID NO: 458719 - DNA, 25 bp, Rattus norvegicus
ctctagttatcatggggcgcaagtt

SEQ ID NO: 458720 - DNA, 25 bp, Rattus norvegicus
ttccagccactcagagcgggcgagg

SEQ ID NO: 458721 - DNA, 25 bp, Rattus norvegicus
caagtggagattctgaggaggttca

SEQ ID NO: 458722 - DNA, 25 bp, Rattus norvegicus
tgaggaggttcatccagagggtcca

SEQ ID NO: 458723 - DNA, 25 bp, Rattus norvegicus
gagggtccaggccatgaaaagtccg

SEQ ID NO: 458724 - DNA, 25 bp, Rattus norvegicus
gccatgaaaagtccggaccacaatg

SEQ ID NO: 458725 - DNA, 25 bp, Rattus norvegicus
accacaatggggaggacaacttcgc

SEQ ID NO: 458726 - DNA, 25 bp, Rattus norvegicus
gcccgggacttcatggtgagtgtcc

SEQ ID NO: 458727 - DNA, 25 bp, Rattus norvegicus
cggaagcggcttccagccactcaga

SEQ ID NO: 458728 - DNA, 25 bp, Rattus norvegicus
ttcatggtgagtgtccgttctcgcc

SEQ ID NO: 458729 - DNA, 25 bp, Rattus norvegicus
tgagtgtccgttctcgccggcgcct

SEQ ID NO: 458730 - DNA, 25 bp, Rattus norvegicus
agccgcgagcgccttcggcgagctt

SEQ ID NO: 458731 - DNA, 25 bp, Rattus norvegicus
cgactacctattgtctacccggcgg

SEQ ID NO: 458732 - DNA, 25 bp, Rattus norvegicus
gctctttaagttgcgcggggagccc

SEQ ID NO: 458733 - DNA, 25 bp, Rattus norvegicus
ggaaagcggcgctgctctttaagtt

SEQ ID NO: 458734 - DNA, 25 bp, Rattus norvegicus
gtgcacgagctagagcgccgaaatc

SEQ ID NO: 458735 - DNA, 25 bp, Rattus norvegicus
cgacctaggctccaacatcaacgta

SEQ ID NO: 458736 - DNA, 25 bp, Rattus norvegicus
aacctccggtttcgctgcttcctag

SEQ ID NO: 458737 - DNA, 25 bp, Rattus norvegicus
tgcttcctagccaaggtgcacgagc

SEQ ID NO: 458738 - DNA, 25 bp, Rattus norvegicus
gccgaaatcggctgctggagaaaca

SEQ ID NO: 458739 - DNA, 25 bp, Rattus norvegicus
ggtacagaccggcttcatcagcccg

SEQ ID NO: 458740 - DNA, 25 bp, Rattus norvegicus
tttatgcccggcaccatctggtcct

SEQ ID NO: 458741 - DNA, 25 bp, Rattus norvegicus
cgcacgccgaattggaccgggattg

SEQ ID NO: 458742 - DNA, 25 bp, Rattus norvegicus
ttggaacccacgctggtgcaagggc

SEQ ID NO: 458743 - DNA, 25 bp, Rattus norvegicus
gtgggcgtccagatcgacacgatca

SEQ ID NO: 458744 - DNA, 25 bp, Rattus norvegicus
tcccgaaatccgtgcactgtataac

SEQ ID NO: 458745 - DNA, 25 bp, Rattus norvegicus
actgtataacgtgctggccaaagtg

SEQ ID NO: 458746 - DNA, 25 bp, Rattus norvegicus
agccatggctctacgcaacgaccta

SEQ ID NO: 458747 - DNA, 25 bp, Rattus norvegicus
ctggagaaacagctgcagcaggctc

SEQ ID NO: 458748 - DNA, 25 bp, Rattus norvegicus
tcctctgggcgcgaaagtaaagaaa

SEQ ID NO: 458749 - DNA, 25 bp, Rattus norvegicus
gagtagctgggcctctctcattccc

SEQ ID NO: 458750 - DNA, 25 bp, Rattus norvegicus
acgtgcacccgtaaagccgcgagta

SEQ ID NO: 458751 - DNA, 25 bp, Rattus norvegicus
tccagtcccagctcaagggcgcaga

SEQ ID NO: 458752 - DNA, 25 bp, Rattus norvegicus
ggggtgctcctgctactttagactc

SEQ ID NO: 458753 - DNA, 25 bp, Rattus norvegicus
gagggctgcagtccgtatttatagg

SEQ ID NO: 458754 - DNA, 25 bp, Rattus norvegicus
gcacaagaagatgcggctgtctcta

SEQ ID NO: 458755 - DNA, 25 bp, Rattus norvegicus
ttttcacctggcactgcacaagaag

SEQ ID NO: 458756 - DNA, 25 bp, Rattus norvegicus
accatcctctgcaatgcggagcctg

SEQ ID NO: 458757 - DNA, 25 bp, Rattus norvegicus
aaagtcagattagcgtggccagtcc

SEQ ID NO: 458758 - DNA, 25 bp, Rattus norvegicus
cccgaatttagccagaccggcatgc

SEQ ID NO: 458759 - DNA, 25 bp, Rattus norvegicus
gtccgagcgctgaccttgaggtctc

SEQ ID NO: 458760 - DNA, 25 bp, Rattus norvegicus
gagctgagattgtcccgccgaggaa

SEQ ID NO: 458761 - DNA, 25 bp, Rattus norvegicus
ggagcaacagctggggtcccgttaa

SEQ ID NO: 458762 - DNA, 25 bp, Rattus norvegicus
cggagctcggcagttccgtctactt

SEQ ID NO: 458763 - DNA, 25 bp, Rattus norvegicus
gtcggcgctgcacctgcagtaagtt

SEQ ID NO: 458764 - DNA, 25 bp, Rattus norvegicus
tgcagtaagttccaccgcagttaga

SEQ ID NO: 458765 - DNA, 25 bp, Rattus norvegicus
accgcagttagagttccgggtggct

SEQ ID NO: 458766 - DNA, 25 bp, Rattus norvegicus
gttccgtctacttcagccgcagcgt

SEQ ID NO: 458767 - DNA, 25 bp, Rattus norvegicus
ctcattgcattctctagagagggga

SEQ ID NO: 458768 - DNA, 25 bp, Rattus norvegicus
ctagagaggggacggacctccactt

SEQ ID NO: 458769 - DNA, 25 bp, Rattus norvegicus
tcctctttcagaaaaatgtgagttg

SEQ ID NO: 458770 - DNA, 25 bp, Rattus norvegicus
gttgattctggtctagggtcctcga

SEQ ID NO: 458771 - DNA, 25 bp, Rattus norvegicus
agggtcctcgacacctctttacagg

SEQ ID NO: 458772 - DNA, 25 bp, Rattus norvegicus
ccgactctgcgggacggaaaatggc

SEQ ID NO: 458773 - DNA, 25 bp, Rattus norvegicus
gaaaatggcgcattgcagcagctgc

SEQ ID NO: 458774 - DNA, 25 bp, Rattus norvegicus
ccacgaggcgtggtcatgtctaata

SEQ ID NO: 458775 - DNA, 25 bp, Rattus norvegicus
gtctccctgcctgtctcattgcatt

SEQ ID NO: 458776 - DNA, 25 bp, Rattus norvegicus
tccagggctccagtgccgggctcag

SEQ ID NO: 458777 - DNA, 25 bp, Rattus norvegicus
gggctgcggattaggaccgcctgct

SEQ ID NO: 458778 - DNA, 25 bp, Rattus norvegicus
ttcttcggaggcctggccctctgag

SEQ ID NO: 458779 - DNA, 25 bp, Rattus norvegicus
gtctccacctttcttcggaggcctg

SEQ ID NO: 458780 - DNA, 25 bp, Rattus norvegicus
gcacgtgagagctgcaggcccggaa

SEQ ID NO: 458781 - DNA, 25 bp, Rattus norvegicus
aacaggcttggccgcctcgacgcag

SEQ ID NO: 458782 - DNA, 25 bp, Rattus norvegicus
gcagaggccggcctgtcgcaatcga

SEQ ID NO: 458783 - DNA, 25 bp, Rattus norvegicus
acttcccaagcctggtggctgggcc

SEQ ID NO: 458784 - DNA, 25 bp, Rattus norvegicus
tggccacgacttcccaagcctggtg

SEQ ID NO: 458785 - DNA, 25 bp, Rattus norvegicus
agcagcgttggccacgacttcccaa

SEQ ID NO: 458786 - DNA, 25 bp, Rattus norvegicus
acgtcctgagcagcgttggccacga

SEQ ID NO: 458787 - DNA, 25 bp, Rattus norvegicus
aagcccggacgtcctgagcagcgtt

SEQ ID NO: 458788 - DNA, 25 bp, Rattus norvegicus
ggcctttcgggtcggctgaccagac

SEQ ID NO: 458789 - DNA, 25 bp, Rattus norvegicus
aggccggcctgtcgcaatcgagacg

SEQ ID NO: 458790 - DNA, 25 bp, Rattus norvegicus
acaccgtggccaggaattcggcgga

SEQ ID NO: 458791 - DNA, 25 bp, Rattus norvegicus
accggaaggactggaagatcggctt

SEQ ID NO: 458792 - DNA, 25 bp, Rattus norvegicus
agctctggagccgtcatagggatca

SEQ ID NO: 458793 - DNA, 25 bp, Rattus norvegicus
gaagatcggcttccaactggtaagc

SEQ ID NO: 458794 - DNA, 25 bp, Rattus norvegicus
gtgttaacggagaacaccgtggcca

SEQ ID NO: 458795 - DNA, 25 bp, Rattus norvegicus
ccatcggctttttcagatacactga

SEQ ID NO: 458796 - DNA, 25 bp, Rattus norvegicus
tacactgaaattaaagaggagctgg

SEQ ID NO: 458797 - DNA, 25 bp, Rattus norvegicus
agctggaagagctggaccgcatcac

SEQ ID NO: 458798 - DNA, 25 bp, Rattus norvegicus
ccgcatcacggagcagacgcttttt

SEQ ID NO: 458799 - DNA, 25 bp, Rattus norvegicus
gcagacgctttttgacttgtacaaa

SEQ ID NO: 458800 - DNA, 25 bp, Rattus norvegicus
acaaatacaactcttcctacactcg

SEQ ID NO: 458801 - DNA, 25 bp, Rattus norvegicus
gcgggtcttccagcgtacgcgacaa

SEQ ID NO: 458802 - DNA, 25 bp, Rattus norvegicus
tcttccagcgtacgcgacaacaatc

SEQ ID NO: 458803 - DNA, 25 bp, Rattus norvegicus
ggagccgtcatagggatcactgatc

SEQ ID NO: 458804 - DNA, 25 bp, Rattus norvegicus
ggccgcgtgctttgcgacatgaacc

SEQ ID NO: 458805 - DNA, 25 bp, Rattus norvegicus
ttcggaaatgggaagacgtcgtcgc

SEQ ID NO: 458806 - DNA, 25 bp, Rattus norvegicus
cttgacagtaagttgggttcgcgct

SEQ ID NO: 458807 - DNA, 25 bp, Rattus norvegicus
gcgagactctagaaagccctgccca

SEQ ID NO: 458808 - DNA, 25 bp, Rattus norvegicus
cctggagaacatccgcgagactcta

SEQ ID NO: 458809 - DNA, 25 bp, Rattus norvegicus
agaccctgcgatgctgtatgctgtg

SEQ ID NO: 458810 - DNA, 25 bp, Rattus norvegicus
tttgcgacatgaacctgcgtggctg

SEQ ID NO: 458811 - DNA, 25 bp, Rattus norvegicus
tgctggaggtgcatggtccttgtcc

SEQ ID NO: 458812 - DNA, 25 bp, Rattus norvegicus
gacacgaggccacgctggacgtagt

SEQ ID NO: 458813 - DNA, 25 bp, Rattus norvegicus
ttacagcatgctggaagcctggcgg

SEQ ID NO: 458814 - DNA, 25 bp, Rattus norvegicus
cctccgcgaggctcattacagcatg

SEQ ID NO: 458815 - DNA, 25 bp, Rattus norvegicus
tccgacacgctggaaggagttcatg

SEQ ID NO: 458816 - DNA, 25 bp, Rattus norvegicus
gcccagccacaacggcttgacagta

SEQ ID NO: 458817 - DNA, 25 bp, Rattus norvegicus
acctgcgtggctgcctggagaacat

SEQ ID NO: 458818 - DNA, 25 bp, Rattus norvegicus
cagaccaggagtgctcacttcgcgg

SEQ ID NO: 458819 - DNA, 25 bp, Rattus norvegicus
tcaggggctggaaccagtgccaccc

SEQ ID NO: 458820 - DNA, 25 bp, Rattus norvegicus
gcaatctgtcacctggtcggggtca

SEQ ID NO: 458821 - DNA, 25 bp, Rattus norvegicus
cacctgaactagtcagcaatctgtc

SEQ ID NO: 458822 - DNA, 25 bp, Rattus norvegicus
ctccctttcttttgcacctgaacta

SEQ ID NO: 458823 - DNA, 25 bp, Rattus norvegicus
cggtgtgtgccttctccctttcttt

SEQ ID NO: 458824 - DNA, 25 bp, Rattus norvegicus
tcccagcctggggactaggaccgag

SEQ ID NO: 458825 - DNA, 25 bp, Rattus norvegicus
aatccgggtcgttgtcagcttcttt

SEQ ID NO: 458826 - DNA, 25 bp, Rattus norvegicus
atgcccgctggatccggtgggaatc

SEQ ID NO: 458827 - DNA, 25 bp, Rattus norvegicus
gtgtccgggcttccgctgtccttga

SEQ ID NO: 458828 - DNA, 25 bp, Rattus norvegicus
tgctcacctgtgagcgcaggtgtcc

SEQ ID NO: 458829 - DNA, 25 bp, Rattus norvegicus
taaatgagaggttgggcgccgctac

SEQ ID NO: 458830 - DNA, 25 bp, Rattus norvegicus
gacggagccggactccggtacacca

SEQ ID NO: 458831 - DNA, 25 bp, Rattus norvegicus
ttctttggcgatggcagtcccactg

SEQ ID NO: 458832 - DNA, 25 bp, Rattus norvegicus
ttaggcgtcataagccaacggctgc

SEQ ID NO: 458833 - DNA, 25 bp, Rattus norvegicus
tgctggggcccagaagcgtaacaaa

SEQ ID NO: 458834 - DNA, 25 bp, Rattus norvegicus
tccagcggcgttagagtgtcatgct

SEQ ID NO: 458835 - DNA, 25 bp, Rattus norvegicus
gcttgaacaagaatccagcggcgtt

SEQ ID NO: 458836 - DNA, 25 bp, Rattus norvegicus
gatgtggcccggacagatttttgta

SEQ ID NO: 458837 - DNA, 25 bp, Rattus norvegicus
taaaaggcggggctaaggctaagca

SEQ ID NO: 458838 - DNA, 25 bp, Rattus norvegicus
agaacagtccgctcgcggtaaaagg

SEQ ID NO: 458839 - DNA, 25 bp, Rattus norvegicus
tcgggtctagccacgtactcacggt

SEQ ID NO: 458840 - DNA, 25 bp, Rattus norvegicus
ctgtcttccattgggtcgggtctag

SEQ ID NO: 458841 - DNA, 25 bp, Rattus norvegicus
cagaacttatgtctcaggcccgcgg

SEQ ID NO: 458842 - DNA, 25 bp, Rattus norvegicus
acggctgctagtcaggacggacttc

SEQ ID NO: 458843 - DNA, 25 bp, Rattus norvegicus
ggcgcaagtctcagcgcgcgagtta

SEQ ID NO: 458844 - DNA, 25 bp, Rattus norvegicus
aacagaccggtggactgtgcttcca

SEQ ID NO: 458845 - DNA, 25 bp, Rattus norvegicus
cacgtttcgtttgcgctgtcttcca

SEQ ID NO: 458846 - DNA, 25 bp, Rattus norvegicus
agtccaatggcaagcactgcgatgc

SEQ ID NO: 458847 - DNA, 25 bp, Rattus norvegicus
gcaagcactgcgatgccggcgagct

SEQ ID NO: 458848 - DNA, 25 bp, Rattus norvegicus
tgccggcgagctgccagagacacaa

SEQ ID NO: 458849 - DNA, 25 bp, Rattus norvegicus
tgccagagacacaacgcattgaccg

SEQ ID NO: 458850 - DNA, 25 bp, Rattus norvegicus
acgcattgaccgcagttagttctga

SEQ ID NO: 458851 - DNA, 25 bp, Rattus norvegicus
cagttagttctgaccgctggggata

SEQ ID NO: 458852 - DNA, 25 bp, Rattus norvegicus
tgaccgctggggatagcaaactcca

SEQ ID NO: 458853 - DNA, 25 bp, Rattus norvegicus
tggggatagcaaactccacaaacgc

SEQ ID NO: 458854 - DNA, 25 bp, Rattus norvegicus
cccgaggagactcacaaaggacttc

SEQ ID NO: 458855 - DNA, 25 bp, Rattus norvegicus
aaaggacttcggcatcatctcgttc

SEQ ID NO: 458856 - DNA, 25 bp, Rattus norvegicus
tcatctcgttcagccctccaagtag

SEQ ID NO: 458857 - DNA, 25 bp, Rattus norvegicus
cagccctccaagtaggcggttaccg

SEQ ID NO: 458858 - DNA, 25 bp, Rattus norvegicus
ccggacactacacggcggtgaagat

SEQ ID NO: 458859 - DNA, 25 bp, Rattus norvegicus
gaaccgcagccatagtccaatggca

SEQ ID NO: 458860 - DNA, 25 bp, Rattus norvegicus
ttgctacctcctttgaccggcatgg

SEQ ID NO: 458861 - DNA, 25 bp, Rattus norvegicus
gcgcccggccagctgtgatgcgcat

SEQ ID NO: 458862 - DNA, 25 bp, Rattus norvegicus
taaaaagtgccactccttacggcgc

SEQ ID NO: 458863 - DNA, 25 bp, Rattus norvegicus
gctggcctgaggctccacttttaaa

SEQ ID NO: 458864 - DNA, 25 bp, Rattus norvegicus
accgactgagacacgctgaggctag

SEQ ID NO: 458865 - DNA, 25 bp, Rattus norvegicus
ctcgacaaccgactgagacacgctg

SEQ ID NO: 458866 - DNA, 25 bp, Rattus norvegicus
acaagaggcacgcacgaccgggacc

SEQ ID NO: 458867 - DNA, 25 bp, Rattus norvegicus
accggcatggtacaagctggacttg

SEQ ID NO: 458868 - DNA, 25 bp, Rattus norvegicus
ggtatttgatgcacttgctacctcc

SEQ ID NO: 458869 - DNA, 25 bp, Rattus norvegicus
tcacccagaagatgaagttaaatcc

SEQ ID NO: 458870 - DNA, 25 bp, Rattus norvegicus
gagcgcgcgacagttgcctctcact

SEQ ID NO: 458871 - DNA, 25 bp, Rattus norvegicus
acccgggagcgaagtgcacagcccg

SEQ ID NO: 458872 - DNA, 25 bp, Rattus norvegicus
caagctggacttgcgtgggacaaga

SEQ ID NO: 458873 - DNA, 25 bp, Rattus norvegicus
cgcatgtgccgagggatgccgaccc

SEQ ID NO: 458874 - DNA, 25 bp, Rattus norvegicus
tcaactgtgtccacaccattcggtg

SEQ ID NO: 458875 - DNA, 25 bp, Rattus norvegicus
gtagcgcctcttggatgcacaccca

SEQ ID NO: 458876 - DNA, 25 bp, Rattus norvegicus
ttgcgcaaagcagtagcgcctcttg

SEQ ID NO: 458877 - DNA, 25 bp, Rattus norvegicus
gccaaaattgcgcaaagcagtagcg

SEQ ID NO: 458878 - DNA, 25 bp, Rattus norvegicus
gcgctgcggaagaacgccaaaattg

SEQ ID NO: 458879 - DNA, 25 bp, Rattus norvegicus
tatctgagcgctgcggaagaacgcc

SEQ ID NO: 458880 - DNA, 25 bp, Rattus norvegicus
ccagtaaggcgtatctgagcgctgc

SEQ ID NO: 458881 - DNA, 25 bp, Rattus norvegicus
gtccacaccattcggtgctggagtt

SEQ ID NO: 458882 - DNA, 25 bp, Rattus norvegicus
cctgcgacctctctaatcaactgtg

SEQ ID NO: 458883 - DNA, 25 bp, Rattus norvegicus
gaacctcgattccaattccagcctg

SEQ ID NO: 458884 - DNA, 25 bp, Rattus norvegicus
cagatctggaatacgcgaacctcga

SEQ ID NO: 458885 - DNA, 25 bp, Rattus norvegicus
tgggtgcttcccagatctggaatac

SEQ ID NO: 458886 - DNA, 25 bp, Rattus norvegicus
gggtcaatctggtgggtgcttccca

SEQ ID NO: 458887 - DNA, 25 bp, Rattus norvegicus
tgctggagttccagtaaggcgtatc

SEQ ID NO: 458888 - DNA, 25 bp, Rattus norvegicus
cggctggagggatgaccgaaactcc

SEQ ID NO: 458889 - DNA, 25 bp, Rattus norvegicus
gaaactcctggtttgcgatgccgga

SEQ ID NO: 458890 - DNA, 25 bp, Rattus norvegicus
cgacggcttctgtccgcatctttga

SEQ ID NO: 458891 - DNA, 25 bp, Rattus norvegicus
ccaagccgcgcagacccaaggagaa

SEQ ID NO: 458892 - DNA, 25 bp, Rattus norvegicus
gcaaactgctggtggcttcctcgct

SEQ ID NO: 458893 - DNA, 25 bp, Rattus norvegicus
gggctgttacgccttctccgctagc

SEQ ID NO: 458894 - DNA, 25 bp, Rattus norvegicus
tatgtccgccaagaaggttcgtacg

SEQ ID NO: 458895 - DNA, 25 bp, Rattus norvegicus
agtcaccgggttctatgtccgccaa

SEQ ID NO: 458896 - DNA, 25 bp, Rattus norvegicus
gcaaactacagccttcctcgcggga

SEQ ID NO: 458897 - DNA, 25 bp, Rattus norvegicus
ctctctgagaaggaggcatttggca

SEQ ID NO: 458898 - DNA, 25 bp, Rattus norvegicus
ggagcggcggagagtaaatacaaca

SEQ ID NO: 458899 - DNA, 25 bp, Rattus norvegicus
tccctcagtttagtgcgcccaatgg

SEQ ID NO: 458900 - DNA, 25 bp, Rattus norvegicus
tccaaagaaggtccgctccgtgatc

SEQ ID NO: 458901 - DNA, 25 bp, Rattus norvegicus
tgccggattcgccttgcagtgaacg

SEQ ID NO: 458902 - DNA, 25 bp, Rattus norvegicus
agttcggtcattcagtctcgcccac

SEQ ID NO: 458903 - DNA, 25 bp, Rattus norvegicus
ataaccagccaacccggccagatgg

SEQ ID NO: 458904 - DNA, 25 bp, Rattus norvegicus
aggtggactcgagttcggtcattca

SEQ ID NO: 458905 - DNA, 25 bp, Rattus norvegicus
tcgacatgaagagaaaggtggactc

SEQ ID NO: 458906 - DNA, 25 bp, Rattus norvegicus
tgcgcggttataaccagccaacccg

SEQ ID NO: 458907 - DNA, 25 bp, Rattus norvegicus
cccgtgaacataatctgcgcggtta

SEQ ID NO: 458908 - DNA, 25 bp, Rattus norvegicus
tctgagtcccgtgaacataatctgc

SEQ ID NO: 458909 - DNA, 25 bp, Rattus norvegicus
gagccttcaactctgagtcccgtga

SEQ ID NO: 458910 - DNA, 25 bp, Rattus norvegicus
gcagccactacccagcggtgggaaa

SEQ ID NO: 458911 - DNA, 25 bp, Rattus norvegicus
ggcagaagtaaccatggcatccgta

SEQ ID NO: 458912 - DNA, 25 bp, Rattus norvegicus
ctatttccagggacgtcgacatgaa

SEQ ID NO: 458913 - DNA, 25 bp, Rattus norvegicus
ggcatccgtatgactatttccaggg

SEQ ID NO: 458914 - DNA, 25 bp, Rattus norvegicus
ccttaccgtggcagaagtaaccatg

SEQ ID NO: 458915 - DNA, 25 bp, Rattus norvegicus
ctgggtaaggagaggagccttcaac

SEQ ID NO: 458916 - DNA, 25 bp, Rattus norvegicus
tcgcagcattcgtggtcgtcgtggt

SEQ ID NO: 458917 - DNA, 25 bp, Rattus norvegicus
cctcggagaacatgtccaggggcac

SEQ ID NO: 458918 - DNA, 25 bp, Rattus norvegicus
aatctcctcggagaacatgtccagg

SEQ ID NO: 458919 - DNA, 25 bp, Rattus norvegicus
gtagctgccatcctgggggtgacct

SEQ ID NO: 458920 - DNA, 25 bp, Rattus norvegicus
cacgcgctcgcagcattcgtggtcg

SEQ ID NO: 458921 - DNA, 25 bp, Rattus norvegicus
agatgttgatcaccacgcgctcgca

SEQ ID NO: 458922 - DNA, 25 bp, Rattus norvegicus
ccagagtcttgagctgcgtctcgaa

SEQ ID NO: 458923 - DNA, 25 bp, Rattus norvegicus
aactgggccagagtcttgagctgcg

SEQ ID NO: 458924 - DNA, 25 bp, Rattus norvegicus
cttcgggttgcccagcagcgtgttg

SEQ ID NO: 458925 - DNA, 25 bp, Rattus norvegicus
agcgcatgcgtttcttcgggttgcc

SEQ ID NO: 458926 - DNA, 25 bp, Rattus norvegicus
agggtcaaagtagcgcatgcgtttc

SEQ ID NO: 458927 - DNA, 25 bp, Rattus norvegicus
attcctcagagggtcaaagtagcgc

SEQ ID NO: 458928 - DNA, 25 bp, Rattus norvegicus
ataaaggatggcatcgaagctgggc

SEQ ID NO: 458929 - DNA, 25 bp, Rattus norvegicus
ttgcccagcagcgtgttggggaact

SEQ ID NO: 458930 - DNA, 25 bp, Rattus norvegicus
tctcgcacggtgcaagcaaacagga

SEQ ID NO: 458931 - DNA, 25 bp, Rattus norvegicus
ttctgggcgctgcaagatcagcaga

SEQ ID NO: 458932 - DNA, 25 bp, Rattus norvegicus
ccgcgagccttcagcagcttggagt

SEQ ID NO: 458933 - DNA, 25 bp, Rattus norvegicus
tctcgggtaacctgcactctccgta

SEQ ID NO: 458934 - DNA, 25 bp, Rattus norvegicus
ctggctctacatggctctcgggtaa

SEQ ID NO: 458935 - DNA, 25 bp, Rattus norvegicus
gagcccttgattcgatcccgaggga

SEQ ID NO: 458936 - DNA, 25 bp, Rattus norvegicus
ctccgaacactacgggagcccttga

SEQ ID NO: 458937 - DNA, 25 bp, Rattus norvegicus
gcaaatggcgataagcttcactctc

SEQ ID NO: 458938 - DNA, 25 bp, Rattus norvegicus
tcctctcaggagtccgatcgtttta

SEQ ID NO: 458939 - DNA, 25 bp, Rattus norvegicus
ggttcgcgtccttctcctctcagga

SEQ ID NO: 458940 - DNA, 25 bp, Rattus norvegicus
gaaacctgagaaagcgcctggaatg

SEQ ID NO: 458941 - DNA, 25 bp, Rattus norvegicus
tgctgtcctctgtctggggcagaaa

SEQ ID NO: 458942 - DNA, 25 bp, Rattus norvegicus
tctcccgagtcacccaagcaaatgg

SEQ ID NO: 458943 - DNA, 25 bp, Rattus norvegicus
atcgagcagctacggaggaaacgtc

SEQ ID NO: 458944 - DNA, 25 bp, Rattus norvegicus
accgctgattggttcctcgcacggc

SEQ ID NO: 458945 - DNA, 25 bp, Rattus norvegicus
cagagtcaccgctgattggttcctc

SEQ ID NO: 458946 - DNA, 25 bp, Rattus norvegicus
agtcaccgctgattggttcctcgca

SEQ ID NO: 458947 - DNA, 25 bp, Rattus norvegicus
ttggttcctcgcacggccttggcac

SEQ ID NO: 458948 - DNA, 25 bp, Rattus norvegicus
cccttcgcaccaccgcggctcgtgt

SEQ ID NO: 458949 - DNA, 25 bp, Rattus norvegicus
accaccgcggctcgtgtagcctgcc

SEQ ID NO: 458950 - DNA, 25 bp, Rattus norvegicus
caggctgcacgggaggaggaagcca

SEQ ID NO: 458951 - DNA, 25 bp, Rattus norvegicus
cagaagctccggtccttccagcgta

SEQ ID NO: 458952 - DNA, 25 bp, Rattus norvegicus
tccggtccttccagcgtagcggagc

SEQ ID NO: 458953 - DNA, 25 bp, Rattus norvegicus
gtccttccagcgtagcggagcctct

SEQ ID NO: 458954 - DNA, 25 bp, Rattus norvegicus
ggagcctctgaggagcccccaagaa

SEQ ID NO: 458955 - DNA, 25 bp, Rattus norvegicus
cccaagaatccagagtcaccgctga

SEQ ID NO: 458956 - DNA, 25 bp, Rattus norvegicus
agaatccagagtcaccgctgattgg

SEQ ID NO: 458957 - DNA, 25 bp, Rattus norvegicus
tccagcgtagcggagcctctgagga

SEQ ID NO: 458958 - DNA, 25 bp, Rattus norvegicus
gaccactttctaggctctggacata

SEQ ID NO: 458959 - DNA, 25 bp, Rattus norvegicus
aagggtcgcaaaagcggcagcctga

SEQ ID NO: 458960 - DNA, 25 bp, Rattus norvegicus
tctaggctctggacatattcccgca

SEQ ID NO: 458961 - DNA, 25 bp, Rattus norvegicus
ctctggacatattcccgcaagggtc

SEQ ID NO: 458962 - DNA, 25 bp, Rattus norvegicus
ttcccgcaagggtcgcaaaagcggc

SEQ ID NO: 458963 - DNA, 25 bp, Rattus norvegicus
agcctgagccgggaacatgcgcgaa

SEQ ID NO: 458964 - DNA, 25 bp, Rattus norvegicus
gcaagtcgcccaattcgtttcctac

SEQ ID NO: 458965 - DNA, 25 bp, Rattus norvegicus
acgggagaagcaagtcgcccaattc

SEQ ID NO: 458966 - DNA, 25 bp, Rattus norvegicus
ctaattgggacaaacgggagaagca

SEQ ID NO: 458967 - DNA, 25 bp, Rattus norvegicus
caacttggtgctaattgggacaaac

SEQ ID NO: 458968 - DNA, 25 bp, Rattus norvegicus
tgggttgtctgccaacttggtgcta

SEQ ID NO: 458969 - DNA, 25 bp, Rattus norvegicus
tgggtttgtgggttgtctgccaact

SEQ ID NO: 458970 - DNA, 25 bp, Rattus norvegicus
cctcaggaccactttctaggctctg

SEQ ID NO: 458971 - DNA, 25 bp, Rattus norvegicus
gagccgggaacatgcgcgaagtccc

SEQ ID NO: 458972 - DNA, 25 bp, Rattus norvegicus
tgagatgcctggaacccgcaaactg

SEQ ID NO: 458973 - DNA, 25 bp, Rattus norvegicus
acaagactcacaaggctgccgctgg

SEQ ID NO: 458974 - DNA, 25 bp, Rattus norvegicus
acttgctagctctcaccaggtcctg

SEQ ID NO: 458975 - DNA, 25 bp, Rattus norvegicus
tagctctcggtggtgcctaaaactg

SEQ ID NO: 458976 - DNA, 25 bp, Rattus norvegicus
cccgcaaactgtcgcgcgcgtgaaa

SEQ ID NO: 458977 - DNA, 25 bp, Rattus norvegicus
caccttcttcccaggagctgttcta

SEQ ID NO: 458978 - DNA, 25 bp, Rattus norvegicus
gcgcctccgtgctcaagatttctga

SEQ ID NO: 458979 - DNA, 25 bp, Rattus norvegicus
ccacgaactaggtctggccaaggtc

SEQ ID NO: 458980 - DNA, 25 bp, Rattus norvegicus
tgcagctggtctctctgccaggcta

SEQ ID NO: 458981 - DNA, 25 bp, Rattus norvegicus
tcagggatttctccgatctcatgtc

SEQ ID NO: 458982 - DNA, 25 bp, Rattus norvegicus
gatgttgatcaccagcctctcacta

SEQ ID NO: 458983 - DNA, 25 bp, Rattus norvegicus
tctcctagcagcgtgtcagggaaca

SEQ ID NO: 458984 - DNA, 25 bp, Rattus norvegicus
ttcctcaaggggtcaaagaagcgga

SEQ ID NO: 458985 - DNA, 25 bp, Rattus norvegicus
aactggctgcccgaaaagacgcttg

SEQ ID NO: 458986 - DNA, 25 bp, Rattus norvegicus
gcggccgccatcttctcccacaatg

SEQ ID NO: 458987 - DNA, 25 bp, Rattus norvegicus
acctgaaagcggacggcggccgcca

SEQ ID NO: 458988 - DNA, 25 bp, Rattus norvegicus
cagacgccaactgagaacggaagtg

SEQ ID NO: 458989 - DNA, 25 bp, Rattus norvegicus
atggacctctctgcgcagacgccaa

SEQ ID NO: 458990 - DNA, 25 bp, Rattus norvegicus
tctcatggacctctctgcgcagacg

SEQ ID NO: 458991 - DNA, 25 bp, Rattus norvegicus
ggccaaaatctcatggacctctctg

SEQ ID NO: 458992 - DNA, 25 bp, Rattus norvegicus
acggcaattacgcagggccaaaatc

SEQ ID NO: 458993 - DNA, 25 bp, Rattus norvegicus
tgcagctccaagacccggtacccgg

SEQ ID NO: 458994 - DNA, 25 bp, Rattus norvegicus
taacaacctgaaagcggacggcggc

SEQ ID NO: 458995 - DNA, 25 bp, Rattus norvegicus
tggaagcgctctaacaacctgaaag

SEQ ID NO: 458996 - DNA, 25 bp, Rattus norvegicus
acgtgacattggaagcgctctaaca

SEQ ID NO: 458997 - DNA, 25 bp, Rattus norvegicus
ccggtgacacttacgtgacattgga

SEQ ID NO: 458998 - DNA, 25 bp, Rattus norvegicus
ggtacccggtgacacttacgtgaca

SEQ ID NO: 458999 - DNA, 25 bp, Rattus norvegicus
gcgcttccgccaactacggcaatta

SEQ ID NO: 459000 - DNA, 25 bp, Rattus norvegicus
gctagagactggctctcgggcatta

SEQ ID NO: 459001 - DNA, 25 bp, Rattus norvegicus
ttggccgcacgcttctaagcttttc

SEQ ID NO: 459002 - DNA, 25 bp, Rattus norvegicus
tcgggcattattcaaaagcgaggcg

SEQ ID NO: 459003 - DNA, 25 bp, Rattus norvegicus
tccctaatgggaagaaacactcgga

SEQ ID NO: 459004 - DNA, 25 bp, Rattus norvegicus
ccactggtggagactcttggacgta

SEQ ID NO: 459005 - DNA, 25 bp, Rattus norvegicus
gaaacactcggagcctgcgacgctt

SEQ ID NO: 459006 - DNA, 25 bp, Rattus norvegicus
cccgcgtggcaccaggctagagact

SEQ ID NO: 459007 - DNA, 25 bp, Rattus norvegicus
ctagttctaggacgtcttggccgca

SEQ ID NO: 459008 - DNA, 25 bp, Rattus norvegicus
cgccgtgggatctggcgctcaccaa

SEQ ID NO: 459009 - DNA, 25 bp, Rattus norvegicus
cgcttttcgccctgggactcctaga

SEQ ID NO: 459010 - DNA, 25 bp, Rattus norvegicus
agagccctggaacggagacgccgcc

SEQ ID NO: 459011 - DNA, 25 bp, Rattus norvegicus
gctggatctctcgagtcaactgcga

SEQ ID NO: 459012 - DNA, 25 bp, Rattus norvegicus
tgcggggcttccctagttctaggac

SEQ ID NO: 459013 - DNA, 25 bp, Rattus norvegicus
ccctccttgagaaagcaaagttagg

SEQ ID NO: 459014 - DNA, 25 bp, Rattus norvegicus
gggacgtcatcgactactcacctgg

SEQ ID NO: 459015 - DNA, 25 bp, Rattus norvegicus
ttcaaatgccaacctgccgtgtctc

SEQ ID NO: 459016 - DNA, 25 bp, Rattus norvegicus
agagtcagcgggcaacagctgcaaa

SEQ ID NO: 459017 - DNA, 25 bp, Rattus norvegicus
cagctgcaaaaggaagccgagaggc

SEQ ID NO: 459018 - DNA, 25 bp, Rattus norvegicus
aaagcaggatgctaggcgggccact

SEQ ID NO: 459019 - DNA, 25 bp, Rattus norvegicus
cagcgggtggctctcaccagagact

SEQ ID NO: 459020 - DNA, 25 bp, Rattus norvegicus
ctgtcctctccctaagccatgtatg

SEQ ID NO: 459021 - DNA, 25 bp, Rattus norvegicus
acgtaaagcgcggttcaaatgccaa

SEQ ID NO: 459022 - DNA, 25 bp, Rattus norvegicus
tactcacctggtagggcgcaccatg

SEQ ID NO: 459023 - DNA, 25 bp, Rattus norvegicus
gcgcaccatggtgcccttcctagga

SEQ ID NO: 459024 - DNA, 25 bp, Rattus norvegicus
gcagctgtggcggtttcaattcccg

SEQ ID NO: 459025 - DNA, 25 bp, Rattus norvegicus
aatcatcgctctcctgcctaaggcg

SEQ ID NO: 459026 - DNA, 25 bp, Rattus norvegicus
tgcgtactgaggaaagagcgcctgc

SEQ ID NO: 459027 - DNA, 25 bp, Rattus norvegicus
ccagagactggcgacaagcacacaa

SEQ ID NO: 459028 - DNA, 25 bp, Rattus norvegicus
ggctacgacgtctacctgtcaccga

SEQ ID NO: 459029 - DNA, 25 bp, Rattus norvegicus
agattccgccagtggacgctagaga

SEQ ID NO: 459030 - DNA, 25 bp, Rattus norvegicus
gctcgcgagagctaccgagtgcaga

SEQ ID NO: 459031 - DNA, 25 bp, Rattus norvegicus
ctagagaacggctacgacgtctacc

SEQ ID NO: 459032 - DNA, 25 bp, Rattus norvegicus
gtctacctgtcaccgaagcatcact

SEQ ID NO: 459033 - DNA, 25 bp, Rattus norvegicus
tcactacctggtgagcttgggccgc

SEQ ID NO: 459034 - DNA, 25 bp, Rattus norvegicus
tgggccgctccaagcgcatcttcca

SEQ ID NO: 459035 - DNA, 25 bp, Rattus norvegicus
ttctcgcagttcctggcgcgcagga

SEQ ID NO: 459036 - DNA, 25 bp, Rattus norvegicus
cgcgcaggaacgaggtcccgctgct

SEQ ID NO: 459037 - DNA, 25 bp, Rattus norvegicus
gaggtcccgctgctgcacttctaca

SEQ ID NO: 459038 - DNA, 25 bp, Rattus norvegicus
agcgcgacccgctgaatgtgctcaa

SEQ ID NO: 459039 - DNA, 25 bp, Rattus norvegicus
cgctgaatgtgctcaagccgcggcc

SEQ ID NO: 459040 - DNA, 25 bp, Rattus norvegicus
ccataccggtatcctgctcgcgaga

SEQ ID NO: 459041 - DNA, 25 bp, Rattus norvegicus
ccagtggacgctagagaacggctac

SEQ ID NO: 459042 - DNA, 25 bp, Rattus norvegicus
ccaataggagcggagactgaagccc

SEQ ID NO: 459043 - DNA, 25 bp, Rattus norvegicus
cacaacccgactctgcagcaccttg

SEQ ID NO: 459044 - DNA, 25 bp, Rattus norvegicus
tcatcacagggctgccaataggagc

SEQ ID NO: 459045 - DNA, 25 bp, Rattus norvegicus
taacgtcatcacagggctgccaata

SEQ ID NO: 459046 - DNA, 25 bp, Rattus norvegicus
taggttaacgccctgggcgtcttgc

SEQ ID NO: 459047 - DNA, 25 bp, Rattus norvegicus
gtcgaggcggcttaacgtcatcaca

SEQ ID NO: 459048 - DNA, 25 bp, Rattus norvegicus
cggaccggctctgtagctgttggtc

SEQ ID NO: 459049 - DNA, 25 bp, Rattus norvegicus
actttgcctgcactacttccgtctg

SEQ ID NO: 459050 - DNA, 25 bp, Rattus norvegicus
actgactgcaggtccactttgcctg

SEQ ID NO: 459051 - DNA, 25 bp, Rattus norvegicus
cagcaccttgctgcgactgactgca

SEQ ID NO: 459052 - DNA, 25 bp, Rattus norvegicus
ggtccaaggcacgtgagccacaacc

SEQ ID NO: 459053 - DNA, 25 bp, Rattus norvegicus
aagcgcggcatcttggtccaaggca

SEQ ID NO: 459054 - DNA, 25 bp, Rattus norvegicus
atggtcaaggcgaagcgcggcatct

SEQ ID NO: 459055 - DNA, 25 bp, Rattus norvegicus
tgcgactgactgcaggtccactttg

SEQ ID NO: 459056 - DNA, 25 bp, Rattus norvegicus
cctccactagttaatctagcaaggg

SEQ ID NO: 459057 - DNA, 25 bp, Rattus norvegicus
tggatgtccttctgcacgcacttga

SEQ ID NO: 459058 - DNA, 25 bp, Rattus norvegicus
aggacgcggtcttccagcaggttgc

SEQ ID NO: 459059 - DNA, 25 bp, Rattus norvegicus
aggttctgcaggacgcggtcttcca

SEQ ID NO: 459060 - DNA, 25 bp, Rattus norvegicus
tcctcgatagtcaacaggttctgca

SEQ ID NO: 459061 - DNA, 25 bp, Rattus norvegicus
ggtagcgctcctcgatagtcaacag

SEQ ID NO: 459062 - DNA, 25 bp, Rattus norvegicus
gcacgcacttgaaataggaacactg

SEQ ID NO: 459063 - DNA, 25 bp, Rattus norvegicus
tctagcaagggacaggattagcgtc

SEQ ID NO: 459064 - DNA, 25 bp, Rattus norvegicus
cgcatgtacggctggatgtccttct

SEQ ID NO: 459065 - DNA, 25 bp, Rattus norvegicus
aggtagccaccatcctgcgcatgta

SEQ ID NO: 459066 - DNA, 25 bp, Rattus norvegicus
tagtcctctcgcagtttgtcgcccg

SEQ ID NO: 459067 - DNA, 25 bp, Rattus norvegicus
tgcggggctacctcgcgcacgagct

SEQ ID NO: 459068 - DNA, 25 bp, Rattus norvegicus
aggattagcgtctcgcccaagggtg

SEQ ID NO: 459069 - DNA, 25 bp, Rattus norvegicus
gaacactgcgggaggtagcgctcct

SEQ ID NO: 459070 - DNA, 25 bp, Rattus norvegicus
gccctcctttctggttcggcaatga

SEQ ID NO: 459071 - DNA, 25 bp, Rattus norvegicus
atcgaaggtcgggaaatacgccagt

SEQ ID NO: 459072 - DNA, 25 bp, Rattus norvegicus
ccagtttggatcctagtcctcttcc

SEQ ID NO: 459073 - DNA, 25 bp, Rattus norvegicus
ttaggccctcacatgataattaagg

SEQ ID NO: 459074 - DNA, 25 bp, Rattus norvegicus
gaagatatagttccgcctctccaaa

SEQ ID NO: 459075 - DNA, 25 bp, Rattus norvegicus
ttggcctatcccgaagagcggagcg

SEQ ID NO: 459076 - DNA, 25 bp, Rattus norvegicus
gcggacaccagcctgcgttctcaga

SEQ ID NO: 459077 - DNA, 25 bp, Rattus norvegicus
cattggttcatttggccgccagtaa

SEQ ID NO: 459078 - DNA, 25 bp, Rattus norvegicus
tgggcccgcctcttagtcttatagg

SEQ ID NO: 459079 - DNA, 25 bp, Rattus norvegicus
agaagagtcagttttccgctcccgc

SEQ ID NO: 459080 - DNA, 25 bp, Rattus norvegicus
ctagccttcgagactctgcgcgtct

SEQ ID NO: 459081 - DNA, 25 bp, Rattus norvegicus
gcggctaaggtaagcgccacagttc

SEQ ID NO: 459082 - DNA, 25 bp, Rattus norvegicus
gctctgacaggatcccagggctgtg

SEQ ID NO: 459083 - DNA, 25 bp, Rattus norvegicus
agacccattcctctcgctcattggt

SEQ ID NO: 459084 - DNA, 25 bp, Rattus norvegicus
caacacgcggctttttcgcggaatt

SEQ ID NO: 459085 - DNA, 25 bp, Rattus norvegicus
tcgcggaattttgacgtcacccaca

SEQ ID NO: 459086 - DNA, 25 bp, Rattus norvegicus
ctaaacacccggtgcggcgatcaga

SEQ ID NO: 459087 - DNA, 25 bp, Rattus norvegicus
ctttgaaattgagatccgccctttg

SEQ ID NO: 459088 - DNA, 25 bp, Rattus norvegicus
ctttgctccagaaaaggctggtttc

SEQ ID NO: 459089 - DNA, 25 bp, Rattus norvegicus
gctggtttctttggtttgcggtcca

SEQ ID NO: 459090 - DNA, 25 bp, Rattus norvegicus
ctggtcccagaagtccgaccgaata

SEQ ID NO: 459091 - DNA, 25 bp, Rattus norvegicus
gtccgaccgaatatcgcgattgctg

SEQ ID NO: 459092 - DNA, 25 bp, Rattus norvegicus
ttaagcctgtcttcacccgggaaga

SEQ ID NO: 459093 - DNA, 25 bp, Rattus norvegicus
gacctttttgctccttgggcacaga

SEQ ID NO: 459094 - DNA, 25 bp, Rattus norvegicus
cgagttttttcacgcgcgaccaatt

SEQ ID NO: 459095 - DNA, 25 bp, Rattus norvegicus
tctatttaaacatccgccgaattcg

SEQ ID NO: 459096 - DNA, 25 bp, Rattus norvegicus
ttgcggtccagttcttctggtccca

SEQ ID NO: 459097 - DNA, 25 bp, Rattus norvegicus
aaccacgcctctgcttggggagcca

SEQ ID NO: 459098 - DNA, 25 bp, Rattus norvegicus
cgcaccgttatgtgggaagcgaatc

SEQ ID NO: 459099 - DNA, 25 bp, Rattus norvegicus
gcgggaccaccactgattggctgga

SEQ ID NO: 459100 - DNA, 25 bp, Rattus norvegicus
cactgattggctggatccaggcgga

SEQ ID NO: 459101 - DNA, 25 bp, Rattus norvegicus
tcggaaggttcgatggtccgaagac

SEQ ID NO: 459102 - DNA, 25 bp, Rattus norvegicus
ttcgatggtccgaagacgccagctt

SEQ ID NO: 459103 - DNA, 25 bp, Rattus norvegicus
ctccgctcgatttcgcaccgttatg

SEQ ID NO: 459104 - DNA, 25 bp, Rattus norvegicus
ccgcggtgcctcaggctcagggttt

SEQ ID NO: 459105 - DNA, 25 bp, Rattus norvegicus
gcgggcctcaggctgtcaattttga

SEQ ID NO: 459106 - DNA, 25 bp, Rattus norvegicus
tcaattttgagccatgggagcgttc

SEQ ID NO: 459107 - DNA, 25 bp, Rattus norvegicus
agccatgggagcgttcgatggcctc

SEQ ID NO: 459108 - DNA, 25 bp, Rattus norvegicus
ttcgatggcctcttccacgctattg

SEQ ID NO: 459109 - DNA, 25 bp, Rattus norvegicus
tggcctcttccacgctattgcttta

SEQ ID NO: 459110 - DNA, 25 bp, Rattus norvegicus
ttatttattgttgatgttacttccg

SEQ ID NO: 459111 - DNA, 25 bp, Rattus norvegicus
tccgaagacgccagcttgtgacggg

SEQ ID NO: 459112 - DNA, 25 bp, Rattus norvegicus
ggggctgaaagcgactcagattttc

SEQ ID NO: 459113 - DNA, 25 bp, Rattus norvegicus
tggcgccttcagcacccttggacta

SEQ ID NO: 459114 - DNA, 25 bp, Rattus norvegicus
gtgcttagtactgccaccaggttgg

SEQ ID NO: 459115 - DNA, 25 bp, Rattus norvegicus
agctctccacggtgttgcagggacc

SEQ ID NO: 459116 - DNA, 25 bp, Rattus norvegicus
cgcctcgagcttgaagggtaaagtc

SEQ ID NO: 459117 - DNA, 25 bp, Rattus norvegicus
gggagcagacctggccctaatataa

SEQ ID NO: 459118 - DNA, 25 bp, Rattus norvegicus
ctatcggaatccagtgcacaggggc

SEQ ID NO: 459119 - DNA, 25 bp, Rattus norvegicus
tacctccgtgctttcgactgcgttc

SEQ ID NO: 459120 - DNA, 25 bp, Rattus norvegicus
tccgccattttcctccggaggagca

SEQ ID NO: 459121 - DNA, 25 bp, Rattus norvegicus
ggaggagtgtttcatgcccataaga

SEQ ID NO: 459122 - DNA, 25 bp, Rattus norvegicus
gcccataagagccaacaagggtttg

SEQ ID NO: 459123 - DNA, 25 bp, Rattus norvegicus
tcctccgcgacaatcgagctctgtg

SEQ ID NO: 459124 - DNA, 25 bp, Rattus norvegicus
gcggtcgccactttgttcacgtttc

SEQ ID NO: 459125 - DNA, 25 bp, Rattus norvegicus
ccagctctgcgtaaagccgggatcc

SEQ ID NO: 459126 - DNA, 25 bp, Rattus norvegicus
tggctgcatccagcctggcggttgt

SEQ ID NO: 459127 - DNA, 25 bp, Rattus norvegicus
tgcatccagcctggcggttgtggcc

SEQ ID NO: 459128 - DNA, 25 bp, Rattus norvegicus
cctggctgcatccagcctggcggtt

SEQ ID NO: 459129 - DNA, 25 bp, Rattus norvegicus
ggatccctggctgcatccagcctgg

SEQ ID NO: 459130 - DNA, 25 bp, Rattus norvegicus
ctggactccggatccctggctgcat

SEQ ID NO: 459131 - DNA, 25 bp, Rattus norvegicus
actgctctggactccggatccctgg

SEQ ID NO: 459132 - DNA, 25 bp, Rattus norvegicus
cacaatcactgctctggactccgga

SEQ ID NO: 459133 - DNA, 25 bp, Rattus norvegicus
ggacaaccacaatcactgctctgga

SEQ ID NO: 459134 - DNA, 25 bp, Rattus norvegicus
tggccaggacaaccacaatcactgc

SEQ ID NO: 459135 - DNA, 25 bp, Rattus norvegicus
ccaccgcgggccagtgggcagggag

SEQ ID NO: 459136 - DNA, 25 bp, Rattus norvegicus
cccagtctgagtaagaggggcagcc

SEQ ID NO: 459137 - DNA, 25 bp, Rattus norvegicus
tctgtgggcgcgtcccccagtctga

SEQ ID NO: 459138 - DNA, 25 bp, Rattus norvegicus
aatcactgctctggactccggatcc

SEQ ID NO: 459139 - DNA, 25 bp, Rattus norvegicus
ttgtggcccggtaagtacaggtggc

SEQ ID NO: 459140 - DNA, 25 bp, Rattus norvegicus
acggcttggcaaagtccgagtcctt

SEQ ID NO: 459141 - DNA, 25 bp, Rattus norvegicus
gctgggcttgccctgcgaaatccca

SEQ ID NO: 459142 - DNA, 25 bp, Rattus norvegicus
accggacgctgcactggaggcgaaa

SEQ ID NO: 459143 - DNA, 25 bp, Rattus norvegicus
cttctttggggaggctgcaatttga

SEQ ID NO: 459144 - DNA, 25 bp, Rattus norvegicus
cggctcgcctgcgtaactaggcttc

SEQ ID NO: 459145 - DNA, 25 bp, Rattus norvegicus
tgcggcaccgctataagcacgcttg

SEQ ID NO: 459146 - DNA, 25 bp, Rattus norvegicus
gagcactcgcggagcaaccagctgc

SEQ ID NO: 459147 - DNA, 25 bp, Rattus norvegicus
ggcatttctcccagaatgggacgga

SEQ ID NO: 459148 - DNA, 25 bp, Rattus norvegicus
ccggtggatcgaagaatcctcgcta

SEQ ID NO: 459149 - DNA, 25 bp, Rattus norvegicus
tccgagtccttgctgtccaaagatg

SEQ ID NO: 459150 - DNA, 25 bp, Rattus norvegicus
agccctgactctcgactctgaaatc

SEQ ID NO: 459151 - DNA, 25 bp, Rattus norvegicus
actttgcgggcactcggcctctcta

SEQ ID NO: 459152 - DNA, 25 bp, Rattus norvegicus
tccaaagatggactccggtggatcg

SEQ ID NO: 459153 - DNA, 25 bp, Rattus norvegicus
tgcaatttgactgctctttcccggg

SEQ ID NO: 459154 - DNA, 25 bp, Rattus norvegicus
gggttcccgacgctcgcaggccaag

SEQ ID NO: 459155 - DNA, 25 bp, Rattus norvegicus
ggtgccgtgcaatccagacccagac

SEQ ID NO: 459156 - DNA, 25 bp, Rattus norvegicus
ccagaccgaccaaggccgggctgtg

SEQ ID NO: 459157 - DNA, 25 bp, Rattus norvegicus
agtgcatcaggctgcggtggtttac

SEQ ID NO: 459158 - DNA, 25 bp, Rattus norvegicus
tttacctgggttcccgacgctcgca

SEQ ID NO: 459159 - DNA, 25 bp, Rattus norvegicus
ggttcaggtgccgtgcaatccagac

SEQ ID NO: 459160 - DNA, 25 bp, Rattus norvegicus
cccgcagaggcggatcctcgcaaag

SEQ ID NO: 459161 - DNA, 25 bp, Rattus norvegicus
gcggatcctcgcaaaggacggactc

SEQ ID NO: 459162 - DNA, 25 bp, Rattus norvegicus
tcgcaaaggacggactcacggcaca

SEQ ID NO: 459163 - DNA, 25 bp, Rattus norvegicus
tcctgcccgggaagggcccgattgc

SEQ ID NO: 459164 - DNA, 25 bp, Rattus norvegicus
gaagggcccgattgccggcaatagc

SEQ ID NO: 459165 - DNA, 25 bp, Rattus norvegicus
gattgccggcaatagccgtcccgcg

SEQ ID NO: 459166 - DNA, 25 bp, Rattus norvegicus
tcacggcacagctggggacagcgac

SEQ ID NO: 459167 - DNA, 25 bp, Rattus norvegicus
catcaggctgcggtggtttacctgg

SEQ ID NO: 459168 - DNA, 25 bp, Rattus norvegicus
gctccgcgcgtctagcgttttcgtt

SEQ ID NO: 459169 - DNA, 25 bp, Rattus norvegicus
gctgcccgcagagcgaccactgaat

SEQ ID NO: 459170 - DNA, 25 bp, Rattus norvegicus
ttaccttgggttaagcagtcagccc

SEQ ID NO: 459171 - DNA, 25 bp, Rattus norvegicus
ccctagtatcttttctcgccatcaa

SEQ ID NO: 459172 - DNA, 25 bp, Rattus norvegicus
cgccatcaagataaacacgtgcata

SEQ ID NO: 459173 - DNA, 25 bp, Rattus norvegicus
caaaggattaacagctccagctagc

SEQ ID NO: 459174 - DNA, 25 bp, Rattus norvegicus
agcgttttcgttctggagcattctc

SEQ ID NO: 459175 - DNA, 25 bp, Rattus norvegicus
gcgaccactgaatcccgcgggtgct

SEQ ID NO: 459176 - DNA, 25 bp, Rattus norvegicus
cctggatgcagaagctcgggcaacc

SEQ ID NO: 459177 - DNA, 25 bp, Rattus norvegicus
ccgtaggggaacctcggccactgca

SEQ ID NO: 459178 - DNA, 25 bp, Rattus norvegicus
gggcatctttcccagagaaccgctg

SEQ ID NO: 459179 - DNA, 25 bp, Rattus norvegicus
ccttagagactggtagtagctgtgg

SEQ ID NO: 459180 - DNA, 25 bp, Rattus norvegicus
gctacccacgttgcggccacggaag

SEQ ID NO: 459181 - DNA, 25 bp, Rattus norvegicus
gcgccatcagaggtgggtcaccctg

SEQ ID NO: 459182 - DNA, 25 bp, Rattus norvegicus
tttgcacacgtgagaatggctactg

SEQ ID NO: 459183 - DNA, 25 bp, Rattus norvegicus
acgcacgcgcggctccgaaagactc

SEQ ID NO: 459184 - DNA, 25 bp, Rattus norvegicus
aaagcaccctcaggcctctgcgggg

SEQ ID NO: 459185 - DNA, 25 bp, Rattus norvegicus
agaaagcaccctcaggcctctgcgg

SEQ ID NO: 459186 - DNA, 25 bp, Rattus norvegicus
gtgtaagaaagcaccctcaggcctc

SEQ ID NO: 459187 - DNA, 25 bp, Rattus norvegicus
cagagacgcaaggtgtaagaaagca

SEQ ID NO: 459188 - DNA, 25 bp, Rattus norvegicus
gaccgcagcagagacgcaaggtgta

SEQ ID NO: 459189 - DNA, 25 bp, Rattus norvegicus
tactgcgcaccggtagagggaccgc

SEQ ID NO: 459190 - DNA, 25 bp, Rattus norvegicus
cacacgtgagaatggctactgcgca

SEQ ID NO: 459191 - DNA, 25 bp, Rattus norvegicus
gcttttgcacacgtgagaatggcta

SEQ ID NO: 459192 - DNA, 25 bp, Rattus norvegicus
ctgcgcaagccctcgcctccgcgtt

SEQ ID NO: 459193 - DNA, 25 bp, Rattus norvegicus
ccgcagcagagacgcaaggtgtaag

SEQ ID NO: 459194 - DNA, 25 bp, Rattus norvegicus
acgtgagaatggctactgcgcaccg

SEQ ID NO: 459195 - DNA, 25 bp, Rattus norvegicus
tagagggaccgcagcagagacgcaa

SEQ ID NO: 459196 - DNA, 25 bp, Rattus norvegicus
gaatccgatcgaggctcggcaccgc

SEQ ID NO: 459197 - DNA, 25 bp, Rattus norvegicus
ctcaccgcgcttggactcggtgtga

SEQ ID NO: 459198 - DNA, 25 bp, Rattus norvegicus
gcaccgccgcggctagcggaaacag

SEQ ID NO: 459199 - DNA, 25 bp, Rattus norvegicus
acagaatggggactgtccgagctgt

SEQ ID NO: 459200 - DNA, 25 bp, Rattus norvegicus
gacgcaaagccgagacgggttgaaa

SEQ ID NO: 459201 - DNA, 25 bp, Rattus norvegicus
tactccggccaagtgtcccgcatga

SEQ ID NO: 459202 - DNA, 25 bp, Rattus norvegicus
tctcggggttccagaagactccctc

SEQ ID NO: 459203 - DNA, 25 bp, Rattus norvegicus
ttctcccaaggaggcactactgcgc

SEQ ID NO: 459204 - DNA, 25 bp, Rattus norvegicus
actactgcgccagtcgcctacgggg

SEQ ID NO: 459205 - DNA, 25 bp, Rattus norvegicus
ggctgggcgttcacacaagctaccc

SEQ ID NO: 459206 - DNA, 25 bp, Rattus norvegicus
cccaaggctgcagaaccggagtctc

SEQ ID NO: 459207 - DNA, 25 bp, Rattus norvegicus
gagtctcggctttccagctcgtgcc

SEQ ID NO: 459208 - DNA, 25 bp, Rattus norvegicus
cccgcatgagcactggaaggagaac

SEQ ID NO: 459209 - DNA, 25 bp, Rattus norvegicus
tcccacactgctgggaatccgatcg

SEQ ID NO: 459210 - DNA, 25 bp, Rattus norvegicus
ctagtgctgcccgagaccatgcagg

SEQ ID NO: 459211 - DNA, 25 bp, Rattus norvegicus
aggacactcgctccgggagcaggaa

SEQ ID NO: 459212 - DNA, 25 bp, Rattus norvegicus
cccgaggctgctacggaggacactc

SEQ ID NO: 459213 - DNA, 25 bp, Rattus norvegicus
cctcgctgtgctcctggagtacgcg

SEQ ID NO: 459214 - DNA, 25 bp, Rattus norvegicus
cgagtggcattgaatccctccacca

SEQ ID NO: 459215 - DNA, 25 bp, Rattus norvegicus
ctgtgatctacggatttcccgctca

SEQ ID NO: 459216 - DNA, 25 bp, Rattus norvegicus
gcccacacgccttgactgtgatcta

SEQ ID NO: 459217 - DNA, 25 bp, Rattus norvegicus
ggcacgacggagacacccgagaacc

SEQ ID NO: 459218 - DNA, 25 bp, Rattus norvegicus
caccttagggaggagacccggcctg

SEQ ID NO: 459219 - DNA, 25 bp, Rattus norvegicus
gctgccacccgcaccttagggagga

SEQ ID NO: 459220 - DNA, 25 bp, Rattus norvegicus
cagccttaccggtcccagggttcag

SEQ ID NO: 459221 - DNA, 25 bp, Rattus norvegicus
atgtcgcccgaactcagcagcctta

SEQ ID NO: 459222 - DNA, 25 bp, Rattus norvegicus
aggaagcaggaactcccggctctgc

SEQ ID NO: 459223 - DNA, 25 bp, Rattus norvegicus
agaccatgcaggacgcggatgtcgc

SEQ ID NO: 459224 - DNA, 25 bp, Rattus norvegicus
gtccgagctggttctcggagtagtc

SEQ ID NO: 459225 - DNA, 25 bp, Rattus norvegicus
gtcgccgacgcccattggtccagta

SEQ ID NO: 459226 - DNA, 25 bp, Rattus norvegicus
attggtccagtaccctccgctcccg

SEQ ID NO: 459227 - DNA, 25 bp, Rattus norvegicus
gctcccgtctcactggcaaatgacg

SEQ ID NO: 459228 - DNA, 25 bp, Rattus norvegicus
tggcaaatgacgctagccgcgatgc

SEQ ID NO: 459229 - DNA, 25 bp, Rattus norvegicus
tagccgcgatgctggagggtttcca

SEQ ID NO: 459230 - DNA, 25 bp, Rattus norvegicus
tggttctcggagtagtcttcatctg

SEQ ID NO: 459231 - DNA, 25 bp, Rattus norvegicus
actccagggccgaccacgacagggt

SEQ ID NO: 459232 - DNA, 25 bp, Rattus norvegicus
gccgaccacgacagggtgattccct

SEQ ID NO: 459233 - DNA, 25 bp, Rattus norvegicus
gggtgattccctgcactccactgtg

SEQ ID NO: 459234 - DNA, 25 bp, Rattus norvegicus
attccctgcactccactgtggtgcg

SEQ ID NO: 459235 - DNA, 25 bp, Rattus norvegicus
ttttcgaacctctgtcgcccgaagc

SEQ ID NO: 459236 - DNA, 25 bp, Rattus norvegicus
gaccggtggcatcagcgtccagacc

SEQ ID NO: 459237 - DNA, 25 bp, Rattus norvegicus
tctcggagtagtcttcatctgctcc

SEQ ID NO: 459238 - DNA, 25 bp, Rattus norvegicus
ctccgaaggcggaaacacgagaatc

SEQ ID NO: 459239 - DNA, 25 bp, Rattus norvegicus
tgttcatctcattctgggctccctc

SEQ ID NO: 459240 - DNA, 25 bp, Rattus norvegicus
aagatcgtccggacacctcggggct

SEQ ID NO: 459241 - DNA, 25 bp, Rattus norvegicus
ggcgtagggcacttaaccgcaagtc

SEQ ID NO: 459242 - DNA, 25 bp, Rattus norvegicus
ctggggacagaaacccaagctggac

SEQ ID NO: 459243 - DNA, 25 bp, Rattus norvegicus
ccagaggtagcccagtgggtagcta

SEQ ID NO: 459244 - DNA, 25 bp, Rattus norvegicus
attggcgacgctccgtcacgtgacc

SEQ ID NO: 459245 - DNA, 25 bp, Rattus norvegicus
gccggcgccaatttcaaacagcgga

SEQ ID NO: 459246 - DNA, 25 bp, Rattus norvegicus
cggaacaactgaaagcggcgctgcg

SEQ ID NO: 459247 - DNA, 25 bp, Rattus norvegicus
gttgaggaccgccaggaagaaagtc

SEQ ID NO: 459248 - DNA, 25 bp, Rattus norvegicus
gaagaaagtctgagccgccggcctc

SEQ ID NO: 459249 - DNA, 25 bp, Rattus norvegicus
cggcctctaacctgttcctctgtag

SEQ ID NO: 459250 - DNA, 25 bp, Rattus norvegicus
agctagaattctaccgatctgttca

SEQ ID NO: 459251 - DNA, 25 bp, Rattus norvegicus
tctacacatggggatacccggggtc

SEQ ID NO: 459252 - DNA, 25 bp, Rattus norvegicus
tggccgccggccgaaagctcctttg

SEQ ID NO: 459253 - DNA, 25 bp, Rattus norvegicus
ctcgtgtagatctatgcgtgtgaca

SEQ ID NO: 459254 - DNA, 25 bp, Rattus norvegicus
tgcgtgtgacagtggaaataaatta

SEQ ID NO: 459255 - DNA, 25 bp, Rattus norvegicus
ccgtcagacggaacccaggaagatc

SEQ ID NO: 459256 - DNA, 25 bp, Rattus norvegicus
cggaacccaggaagatcggcctgcg

SEQ ID NO: 459257 - DNA, 25 bp, Rattus norvegicus
gcagcttgtcggagcccggcacctt

SEQ ID NO: 459258 - DNA, 25 bp, Rattus norvegicus
taacgtcgtgttccctttggatatc

SEQ ID NO: 459259 - DNA, 25 bp, Rattus norvegicus
tcccaagttgggtctgggcctatct

SEQ ID NO: 459260 - DNA, 25 bp, Rattus norvegicus
tgtcttcgagggagacgcctacttc

SEQ ID NO: 459261 - DNA, 25 bp, Rattus norvegicus
agcgctccaggcgtagggttcgtct

SEQ ID NO: 459262 - DNA, 25 bp, Rattus norvegicus
aagcacaggcgttagtgcgagccgc

SEQ ID NO: 459263 - DNA, 25 bp, Rattus norvegicus
gctccaattgccttcgctggggacc

SEQ ID NO: 459264 - DNA, 25 bp, Rattus norvegicus
gcctcggcgcctcgtgtagatctat

SEQ ID NO: 459265 - DNA, 25 bp, Rattus norvegicus
tgttccctttggatatcccaagttg

SEQ ID NO: 459266 - DNA, 25 bp, Rattus norvegicus
tgcacatagctaaccgacctcatgg

SEQ ID NO: 459267 - DNA, 25 bp, Rattus norvegicus
tactgtcgtttgcagtgcgcatgca

SEQ ID NO: 459268 - DNA, 25 bp, Rattus norvegicus
cggaagtctacgtcaccgcttgagc

SEQ ID NO: 459269 - DNA, 25 bp, Rattus norvegicus
tcaggccaccgaaccggaagtctac

SEQ ID NO: 459270 - DNA, 25 bp, Rattus norvegicus
gtgcgccagtgtcaggccaccgaac

SEQ ID NO: 459271 - DNA, 25 bp, Rattus norvegicus
tgtcgacagccgtgcgccagtgtca

SEQ ID NO: 459272 - DNA, 25 bp, Rattus norvegicus
acctcatggcactctggagggctga

SEQ ID NO: 459273 - DNA, 25 bp, Rattus norvegicus
cgcttgagccttgagttccggcttt

SEQ ID NO: 459274 - DNA, 25 bp, Rattus norvegicus
agcgccacgcgctgcacatagctaa

SEQ ID NO: 459275 - DNA, 25 bp, Rattus norvegicus
cgggaagagactcccgctgaagtcc

SEQ ID NO: 459276 - DNA, 25 bp, Rattus norvegicus
tcgttatcgacgtctccgaggcaga

SEQ ID NO: 459277 - DNA, 25 bp, Rattus norvegicus
tgcgcatgcactcaccgcgtcgtta

SEQ ID NO: 459278 - DNA, 25 bp, Rattus norvegicus
cccgcccaaatactgtcgtttgcag

SEQ ID NO: 459279 - DNA, 25 bp, Rattus norvegicus
gaggtgccgagccaccgcaccaaaa

SEQ ID NO: 459280 - DNA, 25 bp, Rattus norvegicus
tcagaaagactcaggagggacaggc

SEQ ID NO: 459281 - DNA, 25 bp, Rattus norvegicus
ggaactacaggtcccggcatgcatc

SEQ ID NO: 459282 - DNA, 25 bp, Rattus norvegicus
agcccgtgacctcgctggatctcag

SEQ ID NO: 459283 - DNA, 25 bp, Rattus norvegicus
atctcagcgattgcaaaaggggcgc

SEQ ID NO: 459284 - DNA, 25 bp, Rattus norvegicus
cacaatgagctttgggccaggaacc

SEQ ID NO: 459285 - DNA, 25 bp, Rattus norvegicus
gagccgtttttggttctagctaatg

SEQ ID NO: 459286 - DNA, 25 bp, Rattus norvegicus
ttaactttcaagtgggcgagccctg

SEQ ID NO: 459287 - DNA, 25 bp, Rattus norvegicus
ctggagcaccttcgtccaggtggcc

SEQ ID NO: 459288 - DNA, 25 bp, Rattus norvegicus
gcagcccgcgtagggaagacgaatt

SEQ ID NO: 459289 - DNA, 25 bp, Rattus norvegicus
ttgagcacgccctcgtcctgcttgg

SEQ ID NO: 459290 - DNA, 25 bp, Rattus norvegicus
gggctgatgtccactccttcgagag

SEQ ID NO: 459291 - DNA, 25 bp, Rattus norvegicus
accttcatctcctcggcggtcatgg

SEQ ID NO: 459292 - DNA, 25 bp, Rattus norvegicus
gtctccgtccgcaattggtcctatc

SEQ ID NO: 459293 - DNA, 25 bp, Rattus norvegicus
ggaaggcagcgctgcccacctcgaa

SEQ ID NO: 459294 - DNA, 25 bp, Rattus norvegicus
tgctcagccctatcgcgaccctttt

SEQ ID NO: 459295 - DNA, 25 bp, Rattus norvegicus
cttgcgaaacgagtcagcagctacc

SEQ ID NO: 459296 - DNA, 25 bp, Rattus norvegicus
accgagtgtttttatgaacaaagcg

SEQ ID NO: 459297 - DNA, 25 bp, Rattus norvegicus
tacttcaaggaaagaatacacggcg

SEQ ID NO: 459298 - DNA, 25 bp, Rattus norvegicus
cgcctagcttgctacttcaaggaaa

SEQ ID NO: 459299 - DNA, 25 bp, Rattus norvegicus
atgtactcagcggaagcgcggttgc

SEQ ID NO: 459300 - DNA, 25 bp, Rattus norvegicus
ttagaaacctgaatgtactcagcgg

SEQ ID NO: 459301 - DNA, 25 bp, Rattus norvegicus
tcacaagcctttatccacacacagg

SEQ ID NO: 459302 - DNA, 25 bp, Rattus norvegicus
atcagcttctctgcctcacgggatc

SEQ ID NO: 459303 - DNA, 25 bp, Rattus norvegicus
atgttcgctgcaaagagtccgtccc

SEQ ID NO: 459304 - DNA, 25 bp, Rattus norvegicus
tccagctctgcacttgcgaaacgag

SEQ ID NO: 459305 - DNA, 25 bp, Rattus norvegicus
taccgctcagcgcaaaatgttcgct

SEQ ID NO: 459306 - DNA, 25 bp, Rattus norvegicus
gagtcagcagctaccgctcagcgca

SEQ ID NO: 459307 - DNA, 25 bp, Rattus norvegicus
ttgcgcaacgcctagcttgctactt

SEQ ID NO: 459308 - DNA, 25 bp, Rattus norvegicus
cctggaatctgatcgagtacccgca

SEQ ID NO: 459309 - DNA, 25 bp, Rattus norvegicus
aggcccgaccctcacgcctgtagtc

SEQ ID NO: 459310 - DNA, 25 bp, Rattus norvegicus
gataggctttctctcctctctacaa

SEQ ID NO: 459311 - DNA, 25 bp, Rattus norvegicus
ccggataggctttctctcctctcta

SEQ ID NO: 459312 - DNA, 25 bp, Rattus norvegicus
tgtagtccacaaccctctctcccgg

SEQ ID NO: 459313 - DNA, 25 bp, Rattus norvegicus
aactcacacttatccatgcacaggc

SEQ ID NO: 459314 - DNA, 25 bp, Rattus norvegicus
acactgcaactcacacttatccatg

SEQ ID NO: 459315 - DNA, 25 bp, Rattus norvegicus
ggctccgctccacactgcaactcac

SEQ ID NO: 459316 - DNA, 25 bp, Rattus norvegicus
ggaatctgatcgagtacccgcaccc

SEQ ID NO: 459317 - DNA, 25 bp, Rattus norvegicus
cttccgcctggaatctgatcgagta

SEQ ID NO: 459318 - DNA, 25 bp, Rattus norvegicus
tcttatgcttcttccgcctggaatc

SEQ ID NO: 459319 - DNA, 25 bp, Rattus norvegicus
aggccgtttcttatgcttcttccgc

SEQ ID NO: 459320 - DNA, 25 bp, Rattus norvegicus
cccaaggccgtttcttatgcttctt

SEQ ID NO: 459321 - DNA, 25 bp, Rattus norvegicus
cccaacccgtacgagcttctccagc

SEQ ID NO: 459322 - DNA, 25 bp, Rattus norvegicus
ctacagacacgcactgttcacgagg

SEQ ID NO: 459323 - DNA, 25 bp, Rattus norvegicus
gaccgacctaggtttctggttgaga

SEQ ID NO: 459324 - DNA, 25 bp, Rattus norvegicus
taaccttgagctccagaccgaccta

SEQ ID NO: 459325 - DNA, 25 bp, Rattus norvegicus
ttgcggccaccagcttaaccttgag

SEQ ID NO: 459326 - DNA, 25 bp, Rattus norvegicus
gagcttcaatcacggaccaagggtg

SEQ ID NO: 459327 - DNA, 25 bp, Rattus norvegicus
acctggtggcgtgagcttcaatcac

SEQ ID NO: 459328 - DNA, 25 bp, Rattus norvegicus
cagaggccctctgcggccttgtgac

SEQ ID NO: 459329 - DNA, 25 bp, Rattus norvegicus
cctcgagctcttccggggtaggact

SEQ ID NO: 459330 - DNA, 25 bp, Rattus norvegicus
aggtggccgctactttggtcccaag

SEQ ID NO: 459331 - DNA, 25 bp, Rattus norvegicus
acgcgggatgctccaggtcctcaga

SEQ ID NO: 459332 - DNA, 25 bp, Rattus norvegicus
ctggttgagaatccaaggacgcgcc

SEQ ID NO: 459333 - DNA, 25 bp, Rattus norvegicus
tttggtcccaagacacctcaggatc

SEQ ID NO: 459334 - DNA, 25 bp, Rattus norvegicus
cccgcaacctatggagactctcgga

SEQ ID NO: 459335 - DNA, 25 bp, Rattus norvegicus
tgttcacgaggcctcaaagggtgga

SEQ ID NO: 459336 - DNA, 25 bp, Rattus norvegicus
tgcagaatcgcgaagtggcccggtc

SEQ ID NO: 459337 - DNA, 25 bp, Rattus norvegicus
gcctcatcaccgagctcgacgcacc

SEQ ID NO: 459338 - DNA, 25 bp, Rattus norvegicus
agaggctgccaccattcaggcacat

SEQ ID NO: 459339 - DNA, 25 bp, Rattus norvegicus
accattcaggcacatcgctgccaaa

SEQ ID NO: 459340 - DNA, 25 bp, Rattus norvegicus
tcaggcacatcgctgccaaaagagt

SEQ ID NO: 459341 - DNA, 25 bp, Rattus norvegicus
ctgcagaatcgcgaagtggcccggt

SEQ ID NO: 459342 - DNA, 25 bp, Rattus norvegicus
tggcccggtcggtggctaccgcgag

SEQ ID NO: 459343 - DNA, 25 bp, Rattus norvegicus
tggctaccgcgagggcttgggctct

SEQ ID NO: 459344 - DNA, 25 bp, Rattus norvegicus
gcttgggctcttggggtccgtagga

SEQ ID NO: 459345 - DNA, 25 bp, Rattus norvegicus
acggctcacctggcacaagccgagg

SEQ ID NO: 459346 - DNA, 25 bp, Rattus norvegicus
ggaagaaggcctcatcaccgagctc

SEQ ID NO: 459347 - DNA, 25 bp, Rattus norvegicus
cgcagaggctgccaccattcaggca

SEQ ID NO: 459348 - DNA, 25 bp, Rattus norvegicus
gaaggcctcatcaccgagctcgacg

SEQ ID NO: 459349 - DNA, 25 bp, Rattus norvegicus
aagaaggcctcatcaccgagctcga

SEQ ID NO: 459350 - DNA, 25 bp, Rattus norvegicus
ctctttgtgggcttgtggtccctcc

SEQ ID NO: 459351 - DNA, 25 bp, Rattus norvegicus
caagaactcggaaggaaacgccttg

SEQ ID NO: 459352 - DNA, 25 bp, Rattus norvegicus
ctcggaaggaaacgccttggagtat

SEQ ID NO: 459353 - DNA, 25 bp, Rattus norvegicus
ctcgcaagaactcggaaggaaacgc

SEQ ID NO: 459354 - DNA, 25 bp, Rattus norvegicus
ctctcgcaagaactcggaaggaaac

SEQ ID NO: 459355 - DNA, 25 bp, Rattus norvegicus
gctcctctcgcaagaactcggaagg

SEQ ID NO: 459356 - DNA, 25 bp, Rattus norvegicus
cggctcctctcgcaagaactcggaa

SEQ ID NO: 459357 - DNA, 25 bp, Rattus norvegicus
ctcgtcctctttgtgggcttgtggt

SEQ ID NO: 459358 - DNA, 25 bp, Rattus norvegicus
tcctcgtcctctttgtgggcttgtg

SEQ ID NO: 459359 - DNA, 25 bp, Rattus norvegicus
acgtcctcgtcctctttgtgggctt

SEQ ID NO: 459360 - DNA, 25 bp, Rattus norvegicus
agcacgtcctcgtcctctttgtggg

SEQ ID NO: 459361 - DNA, 25 bp, Rattus norvegicus
actccgcttctgtccccagtgaagg

SEQ ID NO: 459362 - DNA, 25 bp, Rattus norvegicus
ctttgtgggcttgtggtccctccgc

SEQ ID NO: 459363 - DNA, 25 bp, Rattus norvegicus
gcccgcgaccacacgccgctgccgc

SEQ ID NO: 459364 - DNA, 25 bp, Rattus norvegicus
taaagacgcactcgtgcaccgggta

SEQ ID NO: 459365 - DNA, 25 bp, Rattus norvegicus
gtgcggataagcgaggacagtctcc

SEQ ID NO: 459366 - DNA, 25 bp, Rattus norvegicus
ggaaagccgcagctcaagagcccgc

SEQ ID NO: 459367 - DNA, 25 bp, Rattus norvegicus
taagcgaggacagtctcctcacgtc

SEQ ID NO: 459368 - DNA, 25 bp, Rattus norvegicus
cgcactcgtgcaccgggtagagcga

SEQ ID NO: 459369 - DNA, 25 bp, Rattus norvegicus
aggggcagctgcctccgtcagccac

SEQ ID NO: 459370 - DNA, 25 bp, Rattus norvegicus
gtcagccaccacaaccgggttactg

SEQ ID NO: 459371 - DNA, 25 bp, Rattus norvegicus
cacaaccgggttactgcccaggcag

SEQ ID NO: 459372 - DNA, 25 bp, Rattus norvegicus
ctcctcgcagggctccagcacgtcc

SEQ ID NO: 459373 - DNA, 25 bp, Rattus norvegicus
gagcctcgcacgcagcatgaactcc

SEQ ID NO: 459374 - DNA, 25 bp, Rattus norvegicus
ccgcgacacgcgcatctcccggagg

SEQ ID NO: 459375 - DNA, 25 bp, Rattus norvegicus
tctcagacgaggaaagccgcagctc

SEQ ID NO: 459376 - DNA, 25 bp, Rattus norvegicus
cgaggaaagccgcagctcaagagcc

SEQ ID NO: 459377 - DNA, 25 bp, Rattus norvegicus
ggcgccttcagctgcagccggtggt

SEQ ID NO: 459378 - DNA, 25 bp, Rattus norvegicus
gccgaaactcgaactccagaaactc

SEQ ID NO: 459379 - DNA, 25 bp, Rattus norvegicus
aagagcgtcaacgagggcgcgctta

SEQ ID NO: 459380 - DNA, 25 bp, Rattus norvegicus
gtataccgccggtccaacgtgccgc

SEQ ID NO: 459381 - DNA, 25 bp, Rattus norvegicus
gccaaagccatttttgccctcggta

SEQ ID NO: 459382 - DNA, 25 bp, Rattus norvegicus
gtagaaatcactagccaaagccatt

SEQ ID NO: 459383 - DNA, 25 bp, Rattus norvegicus
gtaccgcaggtagaaatcactagcc

SEQ ID NO: 459384 - DNA, 25 bp, Rattus norvegicus
tgcccgacgtagtaccgcaggtaga

SEQ ID NO: 459385 - DNA, 25 bp, Rattus norvegicus
ccttgtgcccgacgtagtaccgcag

SEQ ID NO: 459386 - DNA, 25 bp, Rattus norvegicus
gcctctccgccgctcaccgtccggc

SEQ ID NO: 459387 - DNA, 25 bp, Rattus norvegicus
actcgtgcccaaacttgcccttgtg

SEQ ID NO: 459388 - DNA, 25 bp, Rattus norvegicus
cgaactccagaaactcgtgcccaaa

SEQ ID NO: 459389 - DNA, 25 bp, Rattus norvegicus
aacgagggcgcgcttactccggtag

SEQ ID NO: 459390 - DNA, 25 bp, Rattus norvegicus
caaacttgcccttgtgcccgacgta

SEQ ID NO: 459391 - DNA, 25 bp, Rattus norvegicus
gtccggccgaaactcgaactccaga

SEQ ID NO: 459392 - DNA, 25 bp, Rattus norvegicus
tgcagccagggactcaccgagaact

SEQ ID NO: 459393 - DNA, 25 bp, Rattus norvegicus
cgctcgcggtctcgctgggtctccc

SEQ ID NO: 459394 - DNA, 25 bp, Rattus norvegicus
tctctccgggcacctcggtggcggt

SEQ ID NO: 459395 - DNA, 25 bp, Rattus norvegicus
catgccgcctctccgctctctccgg

SEQ ID NO: 459396 - DNA, 25 bp, Rattus norvegicus
tcgcccgcctcgctcatgccgcctc

SEQ ID NO: 459397 - DNA, 25 bp, Rattus norvegicus
gagaactttcttctccgcgtcctcg

SEQ ID NO: 459398 - DNA, 25 bp, Rattus norvegicus
gccagggactcaccgagaactttct

SEQ ID NO: 459399 - DNA, 25 bp, Rattus norvegicus
cacgtccatcctcgcccgccgtctc

SEQ ID NO: 459400 - DNA, 25 bp, Rattus norvegicus
ctgcatccacgtccatcctcgcccg

SEQ ID NO: 459401 - DNA, 25 bp, Rattus norvegicus
gacctggcccacgtgtcccagcccg

SEQ ID NO: 459402 - DNA, 25 bp, Rattus norvegicus
tttcccgacccacagcaaaggctcc

SEQ ID NO: 459403 - DNA, 25 bp, Rattus norvegicus
tgcggctttcccgacccacagcaaa

SEQ ID NO: 459404 - DNA, 25 bp, Rattus norvegicus
cgcgaggaaacgtgcggctttcccg

SEQ ID NO: 459405 - DNA, 25 bp, Rattus norvegicus
cagggactcaccgagaactttcttc

SEQ ID NO: 459406 - DNA, 25 bp, Rattus norvegicus
ctccagaaccttgattattaaagta

SEQ ID NO: 459407 - DNA, 25 bp, Rattus norvegicus
ccttgattattaaagtatattgggt

SEQ ID NO: 459408 - DNA, 25 bp, Rattus norvegicus
cttgcggcgctgctagttcccgtgc

SEQ ID NO: 459409 - DNA, 25 bp, Rattus norvegicus
gctgttaatctccagaaccttgatt

SEQ ID NO: 459410 - DNA, 25 bp, Rattus norvegicus
tactgcatgaacctgttctttcttc

SEQ ID NO: 459411 - DNA, 25 bp, Rattus norvegicus
cacactactgcatgaacctgttctt

SEQ ID NO: 459412 - DNA, 25 bp, Rattus norvegicus
gtatccacactactgcatgaacctg

SEQ ID NO: 459413 - DNA, 25 bp, Rattus norvegicus
tttttctaggctgttaatctccaga

SEQ ID NO: 459414 - DNA, 25 bp, Rattus norvegicus
cagaatgtatccacactactgcatg

SEQ ID NO: 459415 - DNA, 25 bp, Rattus norvegicus
ttgacagaatgtatccacactactg

SEQ ID NO: 459416 - DNA, 25 bp, Rattus norvegicus
cttgatctatttgacagaatgtatc

SEQ ID NO: 459417 - DNA, 25 bp, Rattus norvegicus
ggtgagtttcttgatctatttgaca

SEQ ID NO: 459418 - DNA, 25 bp, Rattus norvegicus
taggctgttaatctccagaaccttg

SEQ ID NO: 459419 - DNA, 25 bp, Rattus norvegicus
ggcgctgctagttcccgtgcaggac

SEQ ID NO: 459420 - DNA, 25 bp, Rattus norvegicus
acatcgcgggctcagtgatcctcaa

SEQ ID NO: 459421 - DNA, 25 bp, Rattus norvegicus
gaagaacgtgcaatctcgcgagatc

SEQ ID NO: 459422 - DNA, 25 bp, Rattus norvegicus
ttcaagatgcgcgagaagaacgtgc

SEQ ID NO: 459423 - DNA, 25 bp, Rattus norvegicus
cgctccgcggcatcttcaagatgcg

SEQ ID NO: 459424 - DNA, 25 bp, Rattus norvegicus
ggaccgcaagatggccgcttcccag

SEQ ID NO: 459425 - DNA, 25 bp, Rattus norvegicus
atttagagccctgtctgcgttgcgc

SEQ ID NO: 459426 - DNA, 25 bp, Rattus norvegicus
gtgatcctcaacatccgcttgcagg

SEQ ID NO: 459427 - DNA, 25 bp, Rattus norvegicus
gaacttcccgtacttctacatcgcg

SEQ ID NO: 459428 - DNA, 25 bp, Rattus norvegicus
ggcctggcagctgcgaatgaacttc

SEQ ID NO: 459429 - DNA, 25 bp, Rattus norvegicus
tcgccttcttcgagctggcctggca

SEQ ID NO: 459430 - DNA, 25 bp, Rattus norvegicus
cccgtacggtgtcttctgcaagggg

SEQ ID NO: 459431 - DNA, 25 bp, Rattus norvegicus
cggcctggtctgacaacgccatgac

SEQ ID NO: 459432 - DNA, 25 bp, Rattus norvegicus
aggctaaagcggtggccgcttcatc

SEQ ID NO: 459433 - DNA, 25 bp, Rattus norvegicus
tccgcttgcaggtacacatttagag

SEQ ID NO: 459434 - DNA, 25 bp, Rattus norvegicus
atctgcagcgcctccagtcttctgg

SEQ ID NO: 459435 - DNA, 25 bp, Rattus norvegicus
caaagcagaaatccggggacccgag

SEQ ID NO: 459436 - DNA, 25 bp, Rattus norvegicus
ccatcccaacgcgaggaagctggag

SEQ ID NO: 459437 - DNA, 25 bp, Rattus norvegicus
cccagcagggacaaagcagaaatcc

SEQ ID NO: 459438 - DNA, 25 bp, Rattus norvegicus
agtcttctggggctccatcccaacg

SEQ ID NO: 459439 - DNA, 25 bp, Rattus norvegicus
gctcgccggcctctgtgttgttagc

SEQ ID NO: 459440 - DNA, 25 bp, Rattus norvegicus
tctatagcttccctgcgagccgggc

SEQ ID NO: 459441 - DNA, 25 bp, Rattus norvegicus
ggacctgtctatagcttccctgcga

SEQ ID NO: 459442 - DNA, 25 bp, Rattus norvegicus
ggatccttgggtggacctgtctata

SEQ ID NO: 459443 - DNA, 25 bp, Rattus norvegicus
ctccgcggcttgacccggtagtgaa

SEQ ID NO: 459444 - DNA, 25 bp, Rattus norvegicus
agttgtactgtactggcaggatgta

SEQ ID NO: 459445 - DNA, 25 bp, Rattus norvegicus
cgtgtgagcctgtgtactagttgta

SEQ ID NO: 459446 - DNA, 25 bp, Rattus norvegicus
atccatggcagctgcagtggcagcg

SEQ ID NO: 459447 - DNA, 25 bp, Rattus norvegicus
gttgttagccgatatccatggcagc

SEQ ID NO: 459448 - DNA, 25 bp, Rattus norvegicus
agagctttctcagttctgcctttca

SEQ ID NO: 459449 - DNA, 25 bp, Rattus norvegicus
ccctgtcaactttgtagtccagtca

SEQ ID NO: 459450 - DNA, 25 bp, Rattus norvegicus
agctcccatttcctggtggattctc

SEQ ID NO: 459451 - DNA, 25 bp, Rattus norvegicus
agatcaatgagcagagagctttctc

SEQ ID NO: 459452 - DNA, 25 bp, Rattus norvegicus
tgccctgaaactctcaagatcaatg

SEQ ID NO: 459453 - DNA, 25 bp, Rattus norvegicus
tgctgggaattcacgtcagtttctg

SEQ ID NO: 459454 - DNA, 25 bp, Rattus norvegicus
ttatttcctggtggctcctttaaga

SEQ ID NO: 459455 - DNA, 25 bp, Rattus norvegicus
ataaaccaggcttgctggtcccggg

SEQ ID NO: 459456 - DNA, 25 bp, Rattus norvegicus
cctcggggagcgcacagaaaagccc

SEQ ID NO: 459457 - DNA, 25 bp, Rattus norvegicus
aaggccattgtctcgcttcctcctg

SEQ ID NO: 459458 - DNA, 25 bp, Rattus norvegicus
tcgccgcgcagaacaaaggccattg

SEQ ID NO: 459459 - DNA, 25 bp, Rattus norvegicus
cctggtggattctcttaaagcggcc

SEQ ID NO: 459460 - DNA, 25 bp, Rattus norvegicus
gtccagtcacctacgtcggttggta

SEQ ID NO: 459461 - DNA, 25 bp, Rattus norvegicus
cgcacgccttttgatttctccgcgg

SEQ ID NO: 459462 - DNA, 25 bp, Rattus norvegicus
aagaaaagggcgcacgtcagggatc

SEQ ID NO: 459463 - DNA, 25 bp, Rattus norvegicus
agtgcggcttacactcgctcgaagc

SEQ ID NO: 459464 - DNA, 25 bp, Rattus norvegicus
tgcaagtgcggcttacactcgctcg

SEQ ID NO: 459465 - DNA, 25 bp, Rattus norvegicus
aggaaaatcaaagtgcaagtgcggc

SEQ ID NO: 459466 - DNA, 25 bp, Rattus norvegicus
ggctgtccgggacgtaggaaaatca

SEQ ID NO: 459467 - DNA, 25 bp, Rattus norvegicus
tcgggactactttctgcgtcccggc

SEQ ID NO: 459468 - DNA, 25 bp, Rattus norvegicus
cgtggtcgggactactttctgcgtc

SEQ ID NO: 459469 - DNA, 25 bp, Rattus norvegicus
aggcgcattctgatgggattctttc

SEQ ID NO: 459470 - DNA, 25 bp, Rattus norvegicus
gcttacactcgctcgaagccgcgga

SEQ ID NO: 459471 - DNA, 25 bp, Rattus norvegicus
acgtcagggatctagcgcgccgctc

SEQ ID NO: 459472 - DNA, 25 bp, Rattus norvegicus
gctcatgctttccgcggccgggaga

SEQ ID NO: 459473 - DNA, 25 bp, Rattus norvegicus
tgatgggattctttccctgggcggc

SEQ ID NO: 459474 - DNA, 25 bp, Rattus norvegicus
cgcggcgcctcattcagcctcttcc

SEQ ID NO: 459475 - DNA, 25 bp, Rattus norvegicus
aaggtcttcgcgaggcgcattctga

SEQ ID NO: 459476 - DNA, 25 bp, Rattus norvegicus
cgcctttgcaaagaacgggcgaaga

SEQ ID NO: 459477 - DNA, 25 bp, Rattus norvegicus
cggataggtcgcctttgcaaagaac

SEQ ID NO: 459478 - DNA, 25 bp, Rattus norvegicus
gaacgggcgaagaggcacaagactc

SEQ ID NO: 459479 - DNA, 25 bp, Rattus norvegicus
gcacaagactctgggaaggatcgca

SEQ ID NO: 459480 - DNA, 25 bp, Rattus norvegicus
atcgcaggggatgctccgcagctcc

SEQ ID NO: 459481 - DNA, 25 bp, Rattus norvegicus
cccgcagattttgtcgtgaccaagt

SEQ ID NO: 459482 - DNA, 25 bp, Rattus norvegicus
tttgtcgtgaccaagttcctgcttc

SEQ ID NO: 459483 - DNA, 25 bp, Rattus norvegicus
ttcctgcttccgtcgcagcgactga

SEQ ID NO: 459484 - DNA, 25 bp, Rattus norvegicus
ccgtcgcagcgactgaaagtttgca

SEQ ID NO: 459485 - DNA, 25 bp, Rattus norvegicus
cgcagcgactgaaagtttgcacggg

SEQ ID NO: 459486 - DNA, 25 bp, Rattus norvegicus
gaagggcgcgttcctgccctgcaac

SEQ ID NO: 459487 - DNA, 25 bp, Rattus norvegicus
cccggagctgcttcccaggcaacat

SEQ ID NO: 459488 - DNA, 25 bp, Rattus norvegicus
tgaccaagttcctgcttccgtcgca

SEQ ID NO: 459489 - DNA, 25 bp, Rattus norvegicus
cccaaggacggataggtcgcctttg

SEQ ID NO: 459490 - DNA, 25 bp, Rattus norvegicus
ggagctgggaattagcgttggcatc

SEQ ID NO: 459491 - DNA, 25 bp, Rattus norvegicus
gtgcgatccattgacgatctattga

SEQ ID NO: 459492 - DNA, 25 bp, Rattus norvegicus
ttgacgatctattgacctctctggc

SEQ ID NO: 459493 - DNA, 25 bp, Rattus norvegicus
ctattgacctctctggctgtggcgg

SEQ ID NO: 459494 - DNA, 25 bp, Rattus norvegicus
aggcaggacccgatggccgctagac

SEQ ID NO: 459495 - DNA, 25 bp, Rattus norvegicus
tagacggagaggtggccaagccaat

SEQ ID NO: 459496 - DNA, 25 bp, Rattus norvegicus
gccaagccaataaactgcagagtcg

SEQ ID NO: 459497 - DNA, 25 bp, Rattus norvegicus
tgcagagtcgcaaagtcgcagagtc

SEQ ID NO: 459498 - DNA, 25 bp, Rattus norvegicus
tcgcaaagtcgcagagtcgggaata

SEQ ID NO: 459499 - DNA, 25 bp, Rattus norvegicus
aagtcgcagagtcgggaataaggtt

SEQ ID NO: 459500 - DNA, 25 bp, Rattus norvegicus
ggcaccttgggtctgtgctctgagc

SEQ ID NO: 459501 - DNA, 25 bp, Rattus norvegicus
tctgtgctctgagctggctactgcc

SEQ ID NO: 459502 - DNA, 25 bp, Rattus norvegicus
ggctactgccgtagcggatgaaatc

SEQ ID NO: 459503 - DNA, 25 bp, Rattus norvegicus
ccgtagcggatgaaatctagagccc

SEQ ID NO: 459504 - DNA, 25 bp, Rattus norvegicus
aactgaaggccttgcgtctcccgcg

SEQ ID NO: 459505 - DNA, 25 bp, Rattus norvegicus
tgaacgcctcaggtcggtgcctcac

SEQ ID NO: 459506 - DNA, 25 bp, Rattus norvegicus
ccggcgatctgaacgcctcaggtcg

SEQ ID NO: 459507 - DNA, 25 bp, Rattus norvegicus
gctgtccctttgctgctggcgccat

SEQ ID NO: 459508 - DNA, 25 bp, Rattus norvegicus
tatctgtggtcctgcggggtctccc

SEQ ID NO: 459509 - DNA, 25 bp, Rattus norvegicus
ccgcgcctcctcgagtatctgtggt

SEQ ID NO: 459510 - DNA, 25 bp, Rattus norvegicus
agtgaatgacagcagcgccgcccgc

SEQ ID NO: 459511 - DNA, 25 bp, Rattus norvegicus
tgagccagtgaatgacagcagcgcc

SEQ ID NO: 459512 - DNA, 25 bp, Rattus norvegicus
ccggaaggagcgagttgaaacaact

SEQ ID NO: 459513 - DNA, 25 bp, Rattus norvegicus
tcaaacccggaactgaaggccttgc

SEQ ID NO: 459514 - DNA, 25 bp, Rattus norvegicus
tcacctcccgcacgggtgttgctgg

SEQ ID NO: 459515 - DNA, 25 bp, Rattus norvegicus
cctcctcgagtatctgtggtcctgc

SEQ ID NO: 459516 - DNA, 25 bp, Rattus norvegicus
gcgagttgaaacaactgagccagtg

SEQ ID NO: 459517 - DNA, 25 bp, Rattus norvegicus
gtcgcgagccttctgtcaacccgcc

SEQ ID NO: 459518 - DNA, 25 bp, Rattus norvegicus
ccgaaggggccaatcggcctgcaga

SEQ ID NO: 459519 - DNA, 25 bp, Rattus norvegicus
gaggctacctggacgtcgtagttcc

SEQ ID NO: 459520 - DNA, 25 bp, Rattus norvegicus
tgcttgtcgccgcacgtagtctcgc

SEQ ID NO: 459521 - DNA, 25 bp, Rattus norvegicus
ttcccaaaatgccactgtgctatgg

SEQ ID NO: 459522 - DNA, 25 bp, Rattus norvegicus
gttcagaagtccacgcgagcactca

SEQ ID NO: 459523 - DNA, 25 bp, Rattus norvegicus
gggccacttgccagtgcgtctgtaa

SEQ ID NO: 459524 - DNA, 25 bp, Rattus norvegicus
tgcgtctgtaaacactcccggagcc

SEQ ID NO: 459525 - DNA, 25 bp, Rattus norvegicus
aacactcccggagcctgtcatgggg

SEQ ID NO: 459526 - DNA, 25 bp, Rattus norvegicus
agggtccgctctgccattcctgaac

SEQ ID NO: 459527 - DNA, 25 bp, Rattus norvegicus
tgccattcctgaactgatccgggtc

SEQ ID NO: 459528 - DNA, 25 bp, Rattus norvegicus
cttcagggaagcgaactgttaggcg

SEQ ID NO: 459529 - DNA, 25 bp, Rattus norvegicus
cctgtctgcggagatggatgacagc

SEQ ID NO: 459530 - DNA, 25 bp, Rattus norvegicus
gatgacagcaaggtaagtcctgggc

SEQ ID NO: 459531 - DNA, 25 bp, Rattus norvegicus
cagtcggtcgcgcagagaatatgca

SEQ ID NO: 459532 - DNA, 25 bp, Rattus norvegicus
aaatccctaaggacgtgacgctgtg

SEQ ID NO: 459533 - DNA, 25 bp, Rattus norvegicus
acgcatgcgcacacaatcacgggga

SEQ ID NO: 459534 - DNA, 25 bp, Rattus norvegicus
ctcagcctcagcgttgtccgtaaac

SEQ ID NO: 459535 - DNA, 25 bp, Rattus norvegicus
cgaaagagctcaaggccgaccgttc

SEQ ID NO: 459536 - DNA, 25 bp, Rattus norvegicus
ccgaccgttctgtggaagagttttg

SEQ ID NO: 459537 - DNA, 25 bp, Rattus norvegicus
tcgcgcagctggcacctcagaaaga

SEQ ID NO: 459538 - DNA, 25 bp, Rattus norvegicus
cagaagccagagtccgtcgccttaa

SEQ ID NO: 459539 - DNA, 25 bp, Rattus norvegicus
cgtcgccttaagatactggggtttg

SEQ ID NO: 459540 - DNA, 25 bp, Rattus norvegicus
aaaaacttggcccatggcgcctgcg

SEQ ID NO: 459541 - DNA, 25 bp, Rattus norvegicus
ctgcacgggtgacgtggatttctcc

SEQ ID NO: 459542 - DNA, 25 bp, Rattus norvegicus
ccggctccaaactgacagacatgtc

SEQ ID NO: 459543 - DNA, 25 bp, Rattus norvegicus
cgcgtcagagtcgagagcacaaatg

SEQ ID NO: 459544 - DNA, 25 bp, Rattus norvegicus
tcccaggactagagagtgagcagca

SEQ ID NO: 459545 - DNA, 25 bp, Rattus norvegicus
tttctccgagaaaaccgcgcctgct

SEQ ID NO: 459546 - DNA, 25 bp, Rattus norvegicus
agagcaggtttgttggcagtcgtac

SEQ ID NO: 459547 - DNA, 25 bp, Rattus norvegicus
ggcagtcgtacacctccgagtagtc

SEQ ID NO: 459548 - DNA, 25 bp, Rattus norvegicus
agtagtcacgcgaccagccaatgtc

SEQ ID NO: 459549 - DNA, 25 bp, Rattus norvegicus
ggagctcctcctctgtttaaataga

SEQ ID NO: 459550 - DNA, 25 bp, Rattus norvegicus
cttccaccgccatattgggcaacta

SEQ ID NO: 459551 - DNA, 25 bp, Rattus norvegicus
gtacacttgatcactgaagcttcga

SEQ ID NO: 459552 - DNA, 25 bp, Rattus norvegicus
acgtgagagtgtctaacgggagccc

SEQ ID NO: 459553 - DNA, 25 bp, Rattus norvegicus
ggatggacgccagacaaaccgagca

SEQ ID NO: 459554 - DNA, 25 bp, Rattus norvegicus
tgcagaaacctcttcggcccggtca

SEQ ID NO: 459555 - DNA, 25 bp, Rattus norvegicus
cggcccggtcaatcatgaagaacta

SEQ ID NO: 459556 - DNA, 25 bp, Rattus norvegicus
cttggagaagcactgccgagatatg

SEQ ID NO: 459557 - DNA, 25 bp, Rattus norvegicus
agcgagccagcgcaagtggaatttc

SEQ ID NO: 459558 - DNA, 25 bp, Rattus norvegicus
tgtgcagtcgcagaacttcgaagtg

SEQ ID NO: 459559 - DNA, 25 bp, Rattus norvegicus
agctctccggccgtttggctagttt

SEQ ID NO: 459560 - DNA, 25 bp, Rattus norvegicus
ggccgccggagtcagctacccgtta

SEQ ID NO: 459561 - DNA, 25 bp, Rattus norvegicus
gacggtcaccgaagcgcgcggaact

SEQ ID NO: 459562 - DNA, 25 bp, Rattus norvegicus
aagccttcccggttcgctggcggct

SEQ ID NO: 459563 - DNA, 25 bp, Rattus norvegicus
taccgcagggctccaatgatccgca

SEQ ID NO: 459564 - DNA, 25 bp, Rattus norvegicus
agttcgtggaccctccagggcagca

SEQ ID NO: 459565 - DNA, 25 bp, Rattus norvegicus
aatcactatggaaggcccacgaccc

SEQ ID NO: 459566 - DNA, 25 bp, Rattus norvegicus
cctccagacgaagaaaatcactatg

SEQ ID NO: 459567 - DNA, 25 bp, Rattus norvegicus
ctcatcatcaatcctccagacgaag

SEQ ID NO: 459568 - DNA, 25 bp, Rattus norvegicus
agccagggtagcagcgcgcagttcc

SEQ ID NO: 459569 - DNA, 25 bp, Rattus norvegicus
ctggagcctcgggaccaaaagtctc

SEQ ID NO: 459570 - DNA, 25 bp, Rattus norvegicus
actgtggagagccactgccgctttc

SEQ ID NO: 459571 - DNA, 25 bp, Rattus norvegicus
cgctcgctgtagcaactgccggtcg

SEQ ID NO: 459572 - DNA, 25 bp, Rattus norvegicus
aaaagtctctaatgtcgccggctgc

SEQ ID NO: 459573 - DNA, 25 bp, Rattus norvegicus
cgcccgctgtgaacgttcctttgcg

SEQ ID NO: 459574 - DNA, 25 bp, Rattus norvegicus
aaagcctaaaccgtgcgcctgctgc

SEQ ID NO: 459575 - DNA, 25 bp, Rattus norvegicus
ccggggattgcatcatttgcggctc

SEQ ID NO: 459576 - DNA, 25 bp, Rattus norvegicus
agccaccatcatggcgctcgggtcg

SEQ ID NO: 459577 - DNA, 25 bp, Rattus norvegicus
aatccttcggtccacaggtccgcgg

SEQ ID NO: 459578 - DNA, 25 bp, Rattus norvegicus
gcctgctgcgttttacgaatccttc

SEQ ID NO: 459579 - DNA, 25 bp, Rattus norvegicus
cctcgacgcgcctctaaaaggaacg

SEQ ID NO: 459580 - DNA, 25 bp, Rattus norvegicus
caggcggagcctcgctcttaactta

SEQ ID NO: 459581 - DNA, 25 bp, Rattus norvegicus
tttaaggtggatctgagaggctgca

SEQ ID NO: 459582 - DNA, 25 bp, Rattus norvegicus
cctgcaccgagtccactgaagattt

SEQ ID NO: 459583 - DNA, 25 bp, Rattus norvegicus
acttgattggcattggctgcgccca

SEQ ID NO: 459584 - DNA, 25 bp, Rattus norvegicus
cccgagctggtggttgtaaacttga

SEQ ID NO: 459585 - DNA, 25 bp, Rattus norvegicus
ccctccttccctttgtgtgcgtgtg

SEQ ID NO: 459586 - DNA, 25 bp, Rattus norvegicus
caaacatgttccttggccgcggagc

SEQ ID NO: 459587 - DNA, 25 bp, Rattus norvegicus
ccgcggccagtgagcttagatagaa

SEQ ID NO: 459588 - DNA, 25 bp, Rattus norvegicus
aacagaaccaccatcaccggggcat

SEQ ID NO: 459589 - DNA, 25 bp, Rattus norvegicus
tagggtcctgcacatggccccgcgt

SEQ ID NO: 459590 - DNA, 25 bp, Rattus norvegicus
tcaccgtaaatgggcctgaggcgcc

SEQ ID NO: 459591 - DNA, 25 bp, Rattus norvegicus
cgtcacgccggagtcggttgtcacc

SEQ ID NO: 459592 - DNA, 25 bp, Rattus norvegicus
gccgtcacgccggagtcggttgtca

SEQ ID NO: 459593 - DNA, 25 bp, Rattus norvegicus
ccgcgtcgccatgatgacaagcgca

SEQ ID NO: 459594 - DNA, 25 bp, Rattus norvegicus
tctaaacagaaccaccatcaccggg

SEQ ID NO: 459595 - DNA, 25 bp, Rattus norvegicus
gatcctcattcttctaaacagaacc

SEQ ID NO: 459596 - DNA, 25 bp, Rattus norvegicus
gaaaaccgccggatcctcattcttc

SEQ ID NO: 459597 - DNA, 25 bp, Rattus norvegicus
catcctataagaaaaccgccggatc

SEQ ID NO: 459598 - DNA, 25 bp, Rattus norvegicus
ctacatcctataagaaaaccgccgg

SEQ ID NO: 459599 - DNA, 25 bp, Rattus norvegicus
gcgtcgccatgatgacaagcgcaga

SEQ ID NO: 459600 - DNA, 25 bp, Rattus norvegicus
cgccatgatgacaagcgcagaaccg

SEQ ID NO: 459601 - DNA, 25 bp, Rattus norvegicus
gcgcactaaactacatcctataaga

SEQ ID NO: 459602 - DNA, 25 bp, Rattus norvegicus
ggtacccacggatcccagcagcggt

SEQ ID NO: 459603 - DNA, 25 bp, Rattus norvegicus
ggcaagcgtcccacccgcgccctta

SEQ ID NO: 459604 - DNA, 25 bp, Rattus norvegicus
gaagcgccgggctcggcgatcacgc

SEQ ID NO: 459605 - DNA, 25 bp, Rattus norvegicus
agaagtcagcggacgcaccgggcac

SEQ ID NO: 459606 - DNA, 25 bp, Rattus norvegicus
ctggggctggagaagtcagcggacg

SEQ ID NO: 459607 - DNA, 25 bp, Rattus norvegicus
cagcagcggtctccggagcgtggga

SEQ ID NO: 459608 - DNA, 25 bp, Rattus norvegicus
gcaagcgtcccacccgcgcccttaa

SEQ ID NO: 459609 - DNA, 25 bp, Rattus norvegicus
gcgatcacgcgggcgcgcagcggtc

SEQ ID NO: 459610 - DNA, 25 bp, Rattus norvegicus
acccacggatcccagcagcggtctc

SEQ ID NO: 459611 - DNA, 25 bp, Rattus norvegicus
aggtacccacggatcccagcagcgg

SEQ ID NO: 459612 - DNA, 25 bp, Rattus norvegicus
gacaggtacccacggatcccagcag

SEQ ID NO: 459613 - DNA, 25 bp, Rattus norvegicus
ggacaggtacccacggatcccagca

SEQ ID NO: 459614 - DNA, 25 bp, Rattus norvegicus
gggacaggtacccacggatcccagc

SEQ ID NO: 459615 - DNA, 25 bp, Rattus norvegicus
cccacggatcccagcagcggtctcc

SEQ ID NO: 459616 - DNA, 25 bp, Rattus norvegicus
gaggcgctccttggcagccaacgta

SEQ ID NO: 459617 - DNA, 25 bp, Rattus norvegicus
cgccgatgcgctgcggcgctttcaa

SEQ ID NO: 459618 - DNA, 25 bp, Rattus norvegicus
ggggttatcactcagcccggtcacc

SEQ ID NO: 459619 - DNA, 25 bp, Rattus norvegicus
gctgcactgccaagtgttgcgcctg

SEQ ID NO: 459620 - DNA, 25 bp, Rattus norvegicus
gcagccaacgtagctggcagctctc

SEQ ID NO: 459621 - DNA, 25 bp, Rattus norvegicus
cctagcagccatcgtggggttatca

SEQ ID NO: 459622 - DNA, 25 bp, Rattus norvegicus
ctctctgatcttctgcaattcccgg

SEQ ID NO: 459623 - DNA, 25 bp, Rattus norvegicus
ggtgcaagagatcgccgccacctgc

SEQ ID NO: 459624 - DNA, 25 bp, Rattus norvegicus
cctgccaggaccagatgcgcgaact

SEQ ID NO: 459625 - DNA, 25 bp, Rattus norvegicus
tgcgcgaactcctgagctgccttga

SEQ ID NO: 459626 - DNA, 25 bp, Rattus norvegicus
agggacgcctccatggctctttaca

SEQ ID NO: 459627 - DNA, 25 bp, Rattus norvegicus
ttacaactctgtctacttcatcgtc

SEQ ID NO: 459628 - DNA, 25 bp, Rattus norvegicus
cgctttcaagggttgctgctggacc

SEQ ID NO: 459629 - DNA, 25 bp, Rattus norvegicus
aggggcagtcaccatcacgtccgac

SEQ ID NO: 459630 - DNA, 25 bp, Rattus norvegicus
tcagggaggctttcggttcattctc

SEQ ID NO: 459631 - DNA, 25 bp, Rattus norvegicus
tcaccgtgtggttctggaaacgacc

SEQ ID NO: 459632 - DNA, 25 bp, Rattus norvegicus
tggaaacgacctgagcgctagagtc

SEQ ID NO: 459633 - DNA, 25 bp, Rattus norvegicus
cgctagagtctagtcgcgagctacg

SEQ ID NO: 459634 - DNA, 25 bp, Rattus norvegicus
aatcccgccacctatttcatgagtg

SEQ ID NO: 459635 - DNA, 25 bp, Rattus norvegicus
catgagtgactgtgcttctgacgtc

SEQ ID NO: 459636 - DNA, 25 bp, Rattus norvegicus
tctctggcacggtgactttattttc

SEQ ID NO: 459637 - DNA, 25 bp, Rattus norvegicus
ccctccggcgacagaagcctttata

SEQ ID NO: 459638 - DNA, 25 bp, Rattus norvegicus
ttataactgctttgcccggccaagg

SEQ ID NO: 459639 - DNA, 25 bp, Rattus norvegicus
gatccttgtcatccttgtcccggga

SEQ ID NO: 459640 - DNA, 25 bp, Rattus norvegicus
ttccacgcgtgagtcgcaagttctc

SEQ ID NO: 459641 - DNA, 25 bp, Rattus norvegicus
caagttctcagattcacccggagca

SEQ ID NO: 459642 - DNA, 25 bp, Rattus norvegicus
gctcatccgtagctgggttcaccgt

SEQ ID NO: 459643 - DNA, 25 bp, Rattus norvegicus
cggaactggattaggcgtgtcctct

SEQ ID NO: 459644 - DNA, 25 bp, Rattus norvegicus
acacgtaatgacacgagatggcttc

SEQ ID NO: 459645 - DNA, 25 bp, Rattus norvegicus
atggcttcatttggaaagacaagcg

SEQ ID NO: 459646 - DNA, 25 bp, Rattus norvegicus
cacgagatggcttcatttggaaaga

SEQ ID NO: 459647 - DNA, 25 bp, Rattus norvegicus
ctctccaagagcgtgggtggaattg

SEQ ID NO: 459648 - DNA, 25 bp, Rattus norvegicus
gggcgcccgcattgatctttaaaaa

SEQ ID NO: 459649 - DNA, 25 bp, Rattus norvegicus
atctgctgggctgtcgctctccaag

SEQ ID NO: 459650 - DNA, 25 bp, Rattus norvegicus
cgcccgcattgatctttaaaaaatc

SEQ ID NO: 459651 - DNA, 25 bp, Rattus norvegicus
atcattttgaaatcgccataatgcg

SEQ ID NO: 459652 - DNA, 25 bp, Rattus norvegicus
tcgccataatgcgaagaaatatggc

SEQ ID NO: 459653 - DNA, 25 bp, Rattus norvegicus
agaaatatggcgcttcggtctcgta

SEQ ID NO: 459654 - DNA, 25 bp, Rattus norvegicus
tggcgcttcggtctcgtatttcaca

SEQ ID NO: 459655 - DNA, 25 bp, Rattus norvegicus
cggtctcgtatttcacacgtaatga

SEQ ID NO: 459656 - DNA, 25 bp, Rattus norvegicus
tgtttggttccggatctgctgggct

SEQ ID NO: 459657 - DNA, 25 bp, Rattus norvegicus
gctgggcgcccgcattgatctttaa

SEQ ID NO: 459658 - DNA, 25 bp, Rattus norvegicus
acgctcccgaacagtgagttcctga

SEQ ID NO: 459659 - DNA, 25 bp, Rattus norvegicus
agacaggagacttgggcggaactga

SEQ ID NO: 459660 - DNA, 25 bp, Rattus norvegicus
gagcgcgtgagtagacaggagactt

SEQ ID NO: 459661 - DNA, 25 bp, Rattus norvegicus
actggcagcaaggtccacagggcga

SEQ ID NO: 459662 - DNA, 25 bp, Rattus norvegicus
actcactggcagcaaggtccacagg

SEQ ID NO: 459663 - DNA, 25 bp, Rattus norvegicus
gcgtaccactcactggcagcaaggt

SEQ ID NO: 459664 - DNA, 25 bp, Rattus norvegicus
atcgagcgtaccactcactggcagc

SEQ ID NO: 459665 - DNA, 25 bp, Rattus norvegicus
ggacgatcgagcgtaccactcactg

SEQ ID NO: 459666 - DNA, 25 bp, Rattus norvegicus
gtctggacgatcgagcgtaccactc

SEQ ID NO: 459667 - DNA, 25 bp, Rattus norvegicus
tcatgcccagcatggtgacgccgtg

SEQ ID NO: 459668 - DNA, 25 bp, Rattus norvegicus
tgagttcctgatcatgcccagcatg

SEQ ID NO: 459669 - DNA, 25 bp, Rattus norvegicus
aacagtgagttcctgatcatgccca

SEQ ID NO: 459670 - DNA, 25 bp, Rattus norvegicus
tctccgcccactgggcgacaccggg

SEQ ID NO: 459671 - DNA, 25 bp, Rattus norvegicus
cccgaacagtgagttcctgatcatg

SEQ ID NO: 459672 - DNA, 25 bp, Rattus norvegicus
gatgactttccttaccggctgctga

SEQ ID NO: 459673 - DNA, 25 bp, Rattus norvegicus
acagtgactgtcaggtcagagcgca

SEQ ID NO: 459674 - DNA, 25 bp, Rattus norvegicus
gacacttggggactctcggggactc

SEQ ID NO: 459675 - DNA, 25 bp, Rattus norvegicus
gaccacgctgtggagacatggcttg

SEQ ID NO: 459676 - DNA, 25 bp, Rattus norvegicus
ctcccgggtaaggagtctgcagccc

SEQ ID NO: 459677 - DNA, 25 bp, Rattus norvegicus
ccagggctctcaagctcccgggtaa

SEQ ID NO: 459678 - DNA, 25 bp, Rattus norvegicus
atggcgacagtgctgtccagggctc

SEQ ID NO: 459679 - DNA, 25 bp, Rattus norvegicus
cagcgaactacacttcccggcagga

SEQ ID NO: 459680 - DNA, 25 bp, Rattus norvegicus
tggctcgcgcaggttacacctttcc

SEQ ID NO: 459681 - DNA, 25 bp, Rattus norvegicus
acagtgggcgtctcctcctagcctg

SEQ ID NO: 459682 - DNA, 25 bp, Rattus norvegicus
tgaccagcgacagtgggcgtctcct

SEQ ID NO: 459683 - DNA, 25 bp, Rattus norvegicus
ctcagagagactcagcctggcgctg

SEQ ID NO: 459684 - DNA, 25 bp, Rattus norvegicus
cggctgctgaagcacgagcgactca

SEQ ID NO: 459685 - DNA, 25 bp, Rattus norvegicus
tcagagcgcatgtcgctgtggtctc

SEQ ID NO: 459686 - DNA, 25 bp, Rattus norvegicus
tcggtcggcctacccggcaggcaag

SEQ ID NO: 459687 - DNA, 25 bp, Rattus norvegicus
tgttttgaattgtttcgcagtgccc

SEQ ID NO: 459688 - DNA, 25 bp, Rattus norvegicus
tggcaaggaaccacgaggtttcttc

SEQ ID NO: 459689 - DNA, 25 bp, Rattus norvegicus
gtgtggcaaggaaccacgaggtttc

SEQ ID NO: 459690 - DNA, 25 bp, Rattus norvegicus
atgacttctaggacgggtgtggcaa

SEQ ID NO: 459691 - DNA, 25 bp, Rattus norvegicus
cgcttatgacttctaggacgggtgt

SEQ ID NO: 459692 - DNA, 25 bp, Rattus norvegicus
gcccgcgcttatgacttctaggacg

SEQ ID NO: 459693 - DNA, 25 bp, Rattus norvegicus
tgggtcctgcgtcggtcggcctacc

SEQ ID NO: 459694 - DNA, 25 bp, Rattus norvegicus
ccagttgcctagcagcgggcgtggt

SEQ ID NO: 459695 - DNA, 25 bp, Rattus norvegicus
ttgccacggcgacgcaccaggacgt

SEQ ID NO: 459696 - DNA, 25 bp, Rattus norvegicus
gcgacgcaccaggacgtgttttgaa

SEQ ID NO: 459697 - DNA, 25 bp, Rattus norvegicus
caccaggacgtgttttgaattgttt

SEQ ID NO: 459698 - DNA, 25 bp, Rattus norvegicus
tacccggcaggcaaggacccgccca

SEQ ID NO: 459699 - DNA, 25 bp, Rattus norvegicus
cgcagcccgcgcttatgacttctag

SEQ ID NO: 459700 - DNA, 25 bp, Rattus norvegicus
aggctggccgcttctttagactgtc

SEQ ID NO: 459701 - DNA, 25 bp, Rattus norvegicus
gaatcaagtcgtcgtggccactgta

SEQ ID NO: 459702 - DNA, 25 bp, Rattus norvegicus
cggagacatccgatcgaatcaagtc

SEQ ID NO: 459703 - DNA, 25 bp, Rattus norvegicus
gttcccataggtgacagtgtgcgtg

SEQ ID NO: 459704 - DNA, 25 bp, Rattus norvegicus
agactgtccttatactgctgtttcc

SEQ ID NO: 459705 - DNA, 25 bp, Rattus norvegicus
acggtaggccagctcgatttcatca

SEQ ID NO: 459706 - DNA, 25 bp, Rattus norvegicus
ggagcccttctttgtccctgaagta

SEQ ID NO: 459707 - DNA, 25 bp, Rattus norvegicus
ccaggtagaagtctcggagcccttc

SEQ ID NO: 459708 - DNA, 25 bp, Rattus norvegicus
tcccagtgaggcgagttctcctttg

SEQ ID NO: 459709 - DNA, 25 bp, Rattus norvegicus
tgtaaatgtcagtcaagtccacgtg

SEQ ID NO: 459710 - DNA, 25 bp, Rattus norvegicus
gtcgtcactgcgttctttgtaaatg

SEQ ID NO: 459711 - DNA, 25 bp, Rattus norvegicus
cactgaccgaatctcgcttgaagtc

SEQ ID NO: 459712 - DNA, 25 bp, Rattus norvegicus
ccgttccgtgtttgaggtgagacct

SEQ ID NO: 459713 - DNA, 25 bp, Rattus norvegicus
gcgttgccctcgatgttcccatagg

SEQ ID NO: 459714 - DNA, 25 bp, Rattus norvegicus
tttcggaagagtcaagaccgcatta

SEQ ID NO: 459715 - DNA, 25 bp, Rattus norvegicus
cgattgaaaagaccgcagcgccacc

SEQ ID NO: 459716 - DNA, 25 bp, Rattus norvegicus
caccacggcagacgggcctcatttt

SEQ ID NO: 459717 - DNA, 25 bp, Rattus norvegicus
ctcatttttcaaggcaggaggcgtg

SEQ ID NO: 459718 - DNA, 25 bp, Rattus norvegicus
ggaggcgtggccaaaatccctcatt

SEQ ID NO: 459719 - DNA, 25 bp, Rattus norvegicus
tggagaataggcatcgcgcgctctc

SEQ ID NO: 459720 - DNA, 25 bp, Rattus norvegicus
ctctcattggccgatcgcgcagtgg

SEQ ID NO: 459721 - DNA, 25 bp, Rattus norvegicus
tggagtacatagtgcgcccacgaag

SEQ ID NO: 459722 - DNA, 25 bp, Rattus norvegicus
ttgtttttgaatctgcggtggcggc

SEQ ID NO: 459723 - DNA, 25 bp, Rattus norvegicus
tgcgtaggaaggaactcgggtccca

SEQ ID NO: 459724 - DNA, 25 bp, Rattus norvegicus
cccgaaggtatatgcgagtgccagg

SEQ ID NO: 459725 - DNA, 25 bp, Rattus norvegicus
accacagtcggcgaaatgactattg

SEQ ID NO: 459726 - DNA, 25 bp, Rattus norvegicus
cgctgcatgggagcacgtgatcgct

SEQ ID NO: 459727 - DNA, 25 bp, Rattus norvegicus
agtgccaggggctgttctaaccaca

SEQ ID NO: 459728 - DNA, 25 bp, Rattus norvegicus
gccgcgctgctttctctggctgtct

SEQ ID NO: 459729 - DNA, 25 bp, Rattus norvegicus
ctgtctcctgcaggttggggctcaa

SEQ ID NO: 459730 - DNA, 25 bp, Rattus norvegicus
ttctcggctgcttttgggaagtgca

SEQ ID NO: 459731 - DNA, 25 bp, Rattus norvegicus
aggcggatcctctccgtctggaatg

SEQ ID NO: 459732 - DNA, 25 bp, Rattus norvegicus
tgggaaccaaccttcgtcctattga

SEQ ID NO: 459733 - DNA, 25 bp, Rattus norvegicus
gcttcacgtggccttgggaaccaac

SEQ ID NO: 459734 - DNA, 25 bp, Rattus norvegicus
agtcttgcctgcttgggcgcttcac

SEQ ID NO: 459735 - DNA, 25 bp, Rattus norvegicus
cagctgttgcaagagccgcacttga

SEQ ID NO: 459736 - DNA, 25 bp, Rattus norvegicus
gctgtgacctctgcctggttggatt

SEQ ID NO: 459737 - DNA, 25 bp, Rattus norvegicus
gtggcacatcgctcctccgctgtga

SEQ ID NO: 459738 - DNA, 25 bp, Rattus norvegicus
cctgccatgactgcggtggcacatc

SEQ ID NO: 459739 - DNA, 25 bp, Rattus norvegicus
ctcacctgctgagttgtgcttctca

SEQ ID NO: 459740 - DNA, 25 bp, Rattus norvegicus
tcgcgcgttttgctcacctgctgag

SEQ ID NO: 459741 - DNA, 25 bp, Rattus norvegicus
cagaggccgggacgatcttaacttt

SEQ ID NO: 459742 - DNA, 25 bp, Rattus norvegicus
caccacgtccatagccgtgaccgtc

SEQ ID NO: 459743 - DNA, 25 bp, Rattus norvegicus
ccaaacgccggatagcgggcttggt

SEQ ID NO: 459744 - DNA, 25 bp, Rattus norvegicus
cgccgagccaaacgccggatagcgg

SEQ ID NO: 459745 - DNA, 25 bp, Rattus norvegicus
gccgcgagtctcctcgtagataaga

SEQ ID NO: 459746 - DNA, 25 bp, Rattus norvegicus
gacgccgcgagtctcctcgtagata

SEQ ID NO: 459747 - DNA, 25 bp, Rattus norvegicus
gaaaaccttcaggacgccgcgagtc

SEQ ID NO: 459748 - DNA, 25 bp, Rattus norvegicus
cgcgaatcacattttcaaggaaaac

SEQ ID NO: 459749 - DNA, 25 bp, Rattus norvegicus
tgacagcatcgcgaatcacattttc

SEQ ID NO: 459750 - DNA, 25 bp, Rattus norvegicus
gtaggtgacagcatcgcgaatcaca

SEQ ID NO: 459751 - DNA, 25 bp, Rattus norvegicus
cgtgctcggtgtaggtgacagcatc

SEQ ID NO: 459752 - DNA, 25 bp, Rattus norvegicus
ccggatagcgggcttggtaatgccc

SEQ ID NO: 459753 - DNA, 25 bp, Rattus norvegicus
tcaaggaaaaccttcaggacgccgc

SEQ ID NO: 459754 - DNA, 25 bp, Rattus norvegicus
ggtgtaggtgacagcatcgcgaatc

SEQ ID NO: 459755 - DNA, 25 bp, Rattus norvegicus
agcatcgcgaatcacattttcaagg

SEQ ID NO: 459756 - DNA, 25 bp, Rattus norvegicus
agccggtgttggaacttcaggagcc

SEQ ID NO: 459757 - DNA, 25 bp, Rattus norvegicus
ctgctttcgcgagctgattgggtga

SEQ ID NO: 459758 - DNA, 25 bp, Rattus norvegicus
attgggtgaggcacctgtctgtcac

SEQ ID NO: 459759 - DNA, 25 bp, Rattus norvegicus
tcccggaactgagcgagccggtgtt

SEQ ID NO: 459760 - DNA, 25 bp, Rattus norvegicus
ccagaaggtgaagagcaagtgaact

SEQ ID NO: 459761 - DNA, 25 bp, Rattus norvegicus
caagtgaactctaccggtgctgagc

SEQ ID NO: 459762 - DNA, 25 bp, Rattus norvegicus
taccggtgctgagcccgctacagtc

SEQ ID NO: 459763 - DNA, 25 bp, Rattus norvegicus
cgctacagtccgcagccaataaagt

SEQ ID NO: 459764 - DNA, 25 bp, Rattus norvegicus
ccaataaagtcggtgaaaagcgagt

SEQ ID NO: 459765 - DNA, 25 bp, Rattus norvegicus
aaagcgagtaatcccgagagctgtg

SEQ ID NO: 459766 - DNA, 25 bp, Rattus norvegicus
agagctgtgtagtcacgggaccgac

SEQ ID NO: 459767 - DNA, 25 bp, Rattus norvegicus
ttaagcgggacacaggccacccgtg

SEQ ID NO: 459768 - DNA, 25 bp, Rattus norvegicus
ggcggcagccactgcagtttggcta

SEQ ID NO: 459769 - DNA, 25 bp, Rattus norvegicus
tggggacgagtctcaaacttaagcg

SEQ ID NO: 459770 - DNA, 25 bp, Rattus norvegicus
ggccggtgctgagtttctttgtagc

SEQ ID NO: 459771 - DNA, 25 bp, Rattus norvegicus
cgcgctcagacggttttgctatgtg

SEQ ID NO: 459772 - DNA, 25 bp, Rattus norvegicus
tgaacactagcagggcgcgctcaga

SEQ ID NO: 459773 - DNA, 25 bp, Rattus norvegicus
ctgcctttcgctgtgaacactagca

SEQ ID NO: 459774 - DNA, 25 bp, Rattus norvegicus
ttctcggtaacactgcctttcgctg

SEQ ID NO: 459775 - DNA, 25 bp, Rattus norvegicus
ggctagactcttctcggtaacactg

SEQ ID NO: 459776 - DNA, 25 bp, Rattus norvegicus
tctgcagcaggctagactcttctcg

SEQ ID NO: 459777 - DNA, 25 bp, Rattus norvegicus
gtgtccgattacagcgacgcggcgc

SEQ ID NO: 459778 - DNA, 25 bp, Rattus norvegicus
cgagcgctcggtgtccgattacagc

SEQ ID NO: 459779 - DNA, 25 bp, Rattus norvegicus
acctcggagtgaatggcaagtggcc

SEQ ID NO: 459780 - DNA, 25 bp, Rattus norvegicus
tcaacccggcacctcggagtgaatg

SEQ ID NO: 459781 - DNA, 25 bp, Rattus norvegicus
cggagcccttctccacgtcgctcaa

SEQ ID NO: 459782 - DNA, 25 bp, Rattus norvegicus
acggttttgctatgtgcgcctctcg

SEQ ID NO: 459783 - DNA, 25 bp, Rattus norvegicus
ctgagtttctttgtagcagaatccc

SEQ ID NO: 459784 - DNA, 25 bp, Rattus norvegicus
ccctgggccttgtatttcagagaag

SEQ ID NO: 459785 - DNA, 25 bp, Rattus norvegicus
ccatagcgacggttggtaccgactc

SEQ ID NO: 459786 - DNA, 25 bp, Rattus norvegicus
gtaccgactcgagcggctacacgtc

SEQ ID NO: 459787 - DNA, 25 bp, Rattus norvegicus
gagcggctacacgtcaactcacggc

SEQ ID NO: 459788 - DNA, 25 bp, Rattus norvegicus
ggccaccggtcgacgcactctggag

SEQ ID NO: 459789 - DNA, 25 bp, Rattus norvegicus
tggatctgacccagcaggcgggatc

SEQ ID NO: 459790 - DNA, 25 bp, Rattus norvegicus
cttgtatttcagagaaggcttaagg

SEQ ID NO: 459791 - DNA, 25 bp, Rattus norvegicus
ggagcacctagtccgcacgtactca

SEQ ID NO: 459792 - DNA, 25 bp, Rattus norvegicus
gtccgcacgtactcacacgactgag

SEQ ID NO: 459793 - DNA, 25 bp, Rattus norvegicus
cacgactgagagtctcccgggacgg

SEQ ID NO: 459794 - DNA, 25 bp, Rattus norvegicus
ctccgaaggggccttcacctctggg

SEQ ID NO: 459795 - DNA, 25 bp, Rattus norvegicus
ttcacctctgggtctcggtcaacca

SEQ ID NO: 459796 - DNA, 25 bp, Rattus norvegicus
gcaactgccgaaaccatagcgacgg

SEQ ID NO: 459797 - DNA, 25 bp, Rattus norvegicus
tagcgggaaacggagcacctagtcc

SEQ ID NO: 459798 - DNA, 25 bp, Rattus norvegicus
ctccactgtactttgttggctgaga

SEQ ID NO: 459799 - DNA, 25 bp, Rattus norvegicus
ccatcctggatatggaatgcggtga

SEQ ID NO: 459800 - DNA, 25 bp, Rattus norvegicus
ccctcgccggattgatttatgtcgg

SEQ ID NO: 459801 - DNA, 25 bp, Rattus norvegicus
tttatgtcggagctgacgctttatc

SEQ ID NO: 459802 - DNA, 25 bp, Rattus norvegicus
gacgctttatcaggcagtccgcaaa

SEQ ID NO: 459803 - DNA, 25 bp, Rattus norvegicus
ccaatcattttgcaaggagctccga

SEQ ID NO: 459804 - DNA, 25 bp, Rattus norvegicus
cgcgcggataatgtctgagaatgtc

SEQ ID NO: 459805 - DNA, 25 bp, Rattus norvegicus
ccatttctgggacgcttagcagcta

SEQ ID NO: 459806 - DNA, 25 bp, Rattus norvegicus
agcagctattatgtcgactcgatca

SEQ ID NO: 459807 - DNA, 25 bp, Rattus norvegicus
cgatcataagtcacgagagcgagga

SEQ ID NO: 459808 - DNA, 25 bp, Rattus norvegicus
cagccaagtttccttcgggccagta

SEQ ID NO: 459809 - DNA, 25 bp, Rattus norvegicus
cggagccctgacgtgatagcacatt

SEQ ID NO: 459810 - DNA, 25 bp, Rattus norvegicus
gtacctccgtacctggctagagccg

SEQ ID NO: 459811 - DNA, 25 bp, Rattus norvegicus
cgaggacgcgcctccagccaagttt

SEQ ID NO: 459812 - DNA, 25 bp, Rattus norvegicus
aagccgctagttgatcgaccgatta

SEQ ID NO: 459813 - DNA, 25 bp, Rattus norvegicus
tctgacgtatttccggtcgctcctc

SEQ ID NO: 459814 - DNA, 25 bp, Rattus norvegicus
cgattactctcggaattctgacgta

SEQ ID NO: 459815 - DNA, 25 bp, Rattus norvegicus
acccagaggaagaatagcgcggccc

SEQ ID NO: 459816 - DNA, 25 bp, Rattus norvegicus
gcccgcctcattccgaagcattgta

SEQ ID NO: 459817 - DNA, 25 bp, Rattus norvegicus
acattggggccagagttacttccgc

SEQ ID NO: 459818 - DNA, 25 bp, Rattus norvegicus
cactgggaccatagagggtacaata

SEQ ID NO: 459819 - DNA, 25 bp, Rattus norvegicus
tcacaccgcgttgccaagcactggg

SEQ ID NO: 459820 - DNA, 25 bp, Rattus norvegicus
atcacttccctatcggctgaccgtg

SEQ ID NO: 459821 - DNA, 25 bp, Rattus norvegicus
gcgccaaaccgctagctatacatca

SEQ ID NO: 459822 - DNA, 25 bp, Rattus norvegicus
ggcacccagggaccactatcttgaa

SEQ ID NO: 459823 - DNA, 25 bp, Rattus norvegicus
tctgcttctaagtcaggcacccagg

SEQ ID NO: 459824 - DNA, 25 bp, Rattus norvegicus
ggagcacttagtccgcacgcacaca

SEQ ID NO: 459825 - DNA, 25 bp, Rattus norvegicus
tttctgaggtggcttagaaggtccc

SEQ ID NO: 459826 - DNA, 25 bp, Rattus norvegicus
cgtgcaggcggagcattcgtaaaac

SEQ ID NO: 459827 - DNA, 25 bp, Rattus norvegicus
cgcacctcgcgacagagctcgtaga

SEQ ID NO: 459828 - DNA, 25 bp, Rattus norvegicus
tcctcggtcggtgatgtcgtagacc

SEQ ID NO: 459829 - DNA, 25 bp, Rattus norvegicus
gtgatgttcccttctcccgtgcagg

SEQ ID NO: 459830 - DNA, 25 bp, Rattus norvegicus
gtcgtagaccagcacgaagccttcc

SEQ ID NO: 459831 - DNA, 25 bp, Rattus norvegicus
ttcgtaaaacgcacaagccaattcc

SEQ ID NO: 459832 - DNA, 25 bp, Rattus norvegicus
aagccaattccgaagccagcttctc

SEQ ID NO: 459833 - DNA, 25 bp, Rattus norvegicus
ccttcctcggtactcacttgtctgg

SEQ ID NO: 459834 - DNA, 25 bp, Rattus norvegicus
gagtggtccaagtcggctttgtttc

SEQ ID NO: 459835 - DNA, 25 bp, Rattus norvegicus
tccgaccaagatgagagttacgttt

SEQ ID NO: 459836 - DNA, 25 bp, Rattus norvegicus
tctaggatattcttcagcggcagca

SEQ ID NO: 459837 - DNA, 25 bp, Rattus norvegicus
agcggcagcacgtcttcgaagcttc

SEQ ID NO: 459838 - DNA, 25 bp, Rattus norvegicus
tcttcgaagcttcctcggtcggtga

SEQ ID NO: 459839 - DNA, 25 bp, Rattus norvegicus
ctcgtagaatacctcggtgatgttc

SEQ ID NO: 459840 - DNA, 25 bp, Rattus norvegicus
tggcggcgttcacagatctcataga

SEQ ID NO: 459841 - DNA, 25 bp, Rattus norvegicus
taaggggctcgcaccctgtcctcag

SEQ ID NO: 459842 - DNA, 25 bp, Rattus norvegicus
cctgtcctcagggaagcgacctgga

SEQ ID NO: 459843 - DNA, 25 bp, Rattus norvegicus
aagcgacctggacacgtgtgtgtca

SEQ ID NO: 459844 - DNA, 25 bp, Rattus norvegicus
gtgtgtgtcactcacctgttcactc

SEQ ID NO: 459845 - DNA, 25 bp, Rattus norvegicus
cggggagacagtcgaggtcctctcc

SEQ ID NO: 459846 - DNA, 25 bp, Rattus norvegicus
cgaggtcctctccaagttcgcaatc

SEQ ID NO: 459847 - DNA, 25 bp, Rattus norvegicus
caagttcgcaatccggccgtggaga

SEQ ID NO: 459848 - DNA, 25 bp, Rattus norvegicus
agaccgggaagctctcccacgctga

SEQ ID NO: 459849 - DNA, 25 bp, Rattus norvegicus
gtcgcactcgctcagactagcagcg

SEQ ID NO: 459850 - DNA, 25 bp, Rattus norvegicus
cgcacccaggggctgaaccctaagg

SEQ ID NO: 459851 - DNA, 25 bp, Rattus norvegicus
ctccgccaccgggatgctgcagtga

SEQ ID NO: 459852 - DNA, 25 bp, Rattus norvegicus
gcaggacgcgagctccggtcagcca

SEQ ID NO: 459853 - DNA, 25 bp, Rattus norvegicus
ctcagactagcagcggagagactgc

SEQ ID NO: 459854 - DNA, 25 bp, Rattus norvegicus
aagctggctggccacgggacggagg

SEQ ID NO: 459855 - DNA, 25 bp, Rattus norvegicus
atgcgaagtgcgatgctgacgttct

SEQ ID NO: 459856 - DNA, 25 bp, Rattus norvegicus
cgaagtgcgatgctgacgttctgca

SEQ ID NO: 459857 - DNA, 25 bp, Rattus norvegicus
gaagtgcgatgctgacgttctgcaa

SEQ ID NO: 459858 - DNA, 25 bp, Rattus norvegicus
gtgatgaccggtgcattccgtggtt

SEQ ID NO: 459859 - DNA, 25 bp, Rattus norvegicus
gatgaccggtgcattccgtggttga

SEQ ID NO: 459860 - DNA, 25 bp, Rattus norvegicus
gtgacagacggcagtgccccgctta

SEQ ID NO: 459861 - DNA, 25 bp, Rattus norvegicus
agtgccccgcttatcgtagtcctcg

SEQ ID NO: 459862 - DNA, 25 bp, Rattus norvegicus
ctctgtggtgacagacggcagtgcc

SEQ ID NO: 459863 - DNA, 25 bp, Rattus norvegicus
accggtgcattccgtggttgagagc

SEQ ID NO: 459864 - DNA, 25 bp, Rattus norvegicus
gctcgcccgcctggagaccagcgct

SEQ ID NO: 459865 - DNA, 25 bp, Rattus norvegicus
tctgtggtgacagacggcagtgccc

SEQ ID NO: 459866 - DNA, 25 bp, Rattus norvegicus
atccaatcgagccaccactgacttg

SEQ ID NO: 459867 - DNA, 25 bp, Rattus norvegicus
tgaccggtgcattccgtggttgaga

SEQ ID NO: 459868 - DNA, 25 bp, Rattus norvegicus
tccttagccattaagcgacgccggc

SEQ ID NO: 459869 - DNA, 25 bp, Rattus norvegicus
gccggctcctggaacgttctagcag

SEQ ID NO: 459870 - DNA, 25 bp, Rattus norvegicus
cgttctagcaggagtcaggcacaga

SEQ ID NO: 459871 - DNA, 25 bp, Rattus norvegicus
caggcacagaagaggagagcgatcc

SEQ ID NO: 459872 - DNA, 25 bp, Rattus norvegicus
cgcaggaggacctgccaggcgacat

SEQ ID NO: 459873 - DNA, 25 bp, Rattus norvegicus
gcccgaggtctaaggctgccagccg

SEQ ID NO: 459874 - DNA, 25 bp, Rattus norvegicus
ctgccagccgggactggtcatttta

SEQ ID NO: 459875 - DNA, 25 bp, Rattus norvegicus
acgatggggcacctgcctagggaaa

SEQ ID NO: 459876 - DNA, 25 bp, Rattus norvegicus
ctcccgtggcaaccgctgtagctgt

SEQ ID NO: 459877 - DNA, 25 bp, Rattus norvegicus
tgctacctctgctcgggctctttgt

SEQ ID NO: 459878 - DNA, 25 bp, Rattus norvegicus
tttgtgctgctcaaggtagggaccc

SEQ ID NO: 459879 - DNA, 25 bp, Rattus norvegicus
cagtcctccgagatggggatccatc

SEQ ID NO: 459880 - DNA, 25 bp, Rattus norvegicus
cgcacgctttgtcctcagcgcggtg

SEQ ID NO: 459881 - DNA, 25 bp, Rattus norvegicus
tggtcattttaagcgccacggggac

SEQ ID NO: 459882 - DNA, 25 bp, Rattus norvegicus
tcggtgtgtgtacattactggaaca

SEQ ID NO: 459883 - DNA, 25 bp, Rattus norvegicus
accgtaaaacctgagtgagtccacg

SEQ ID NO: 459884 - DNA, 25 bp, Rattus norvegicus
gctctccctgcaggaaaccgtaaaa

SEQ ID NO: 459885 - DNA, 25 bp, Rattus norvegicus
agtgagtccacgtaagtcagggaga

SEQ ID NO: 459886 - DNA, 25 bp, Rattus norvegicus
tccacgtaagtcagggagaggaatg

SEQ ID NO: 459887 - DNA, 25 bp, Rattus norvegicus
ggagaggaatgacgccgcctccttc

SEQ ID NO: 459888 - DNA, 25 bp, Rattus norvegicus
tttctggttaaaagaagcggaagca

SEQ ID NO: 459889 - DNA, 25 bp, Rattus norvegicus
cggaagcaagttcggtgtgtgtaca

SEQ ID NO: 459890 - DNA, 25 bp, Rattus norvegicus
acgcggtgttgaccattgagaaggc

SEQ ID NO: 459891 - DNA, 25 bp, Rattus norvegicus
ccattgagaaggctgaatcggcgcc

SEQ ID NO: 459892 - DNA, 25 bp, Rattus norvegicus
tgaatcggcgccttcgtagtctacc

SEQ ID NO: 459893 - DNA, 25 bp, Rattus norvegicus
ggcgccttcgtagtctaccagctct

SEQ ID NO: 459894 - DNA, 25 bp, Rattus norvegicus
gacaccaccatttctggttaaaaga

SEQ ID NO: 459895 - DNA, 25 bp, Rattus norvegicus
tgtacattactggaacagtcccgcg

SEQ ID NO: 459896 - DNA, 25 bp, Rattus norvegicus
atctctgttcgctttgtcaacttga

SEQ ID NO: 459897 - DNA, 25 bp, Rattus norvegicus
tgccagcggactatgacactgaggc

SEQ ID NO: 459898 - DNA, 25 bp, Rattus norvegicus
acttcgtcagcgtgctgccagcgga

SEQ ID NO: 459899 - DNA, 25 bp, Rattus norvegicus
cctgaaaacgaggaggacttcgtca

SEQ ID NO: 459900 - DNA, 25 bp, Rattus norvegicus
ccctactggtgggacagtgcatccg

SEQ ID NO: 459901 - DNA, 25 bp, Rattus norvegicus
agagcacatctcagccctactggtg

SEQ ID NO: 459902 - DNA, 25 bp, Rattus norvegicus
acggcactgagtatgagagcacatc

SEQ ID NO: 459903 - DNA, 25 bp, Rattus norvegicus
ggcctgacccgaacggcactgagta

SEQ ID NO: 459904 - DNA, 25 bp, Rattus norvegicus
cagcaatgcgtcttccggctggcct

SEQ ID NO: 459905 - DNA, 25 bp, Rattus norvegicus
aggaagagacagacccttccatttc

SEQ ID NO: 459906 - DNA, 25 bp, Rattus norvegicus
ccgcaagacgcgataggaagagaca

SEQ ID NO: 459907 - DNA, 25 bp, Rattus norvegicus
ccgaggactcgttcatcaaaccgca

SEQ ID NO: 459908 - DNA, 25 bp, Rattus norvegicus
ctgggaagaaccaagcgggagcttc

SEQ ID NO: 459909 - DNA, 25 bp, Rattus norvegicus
tgaacaagaacaactgggaagaacc

SEQ ID NO: 459910 - DNA, 25 bp, Rattus norvegicus
accaatgtccgaggggctcttacct

SEQ ID NO: 459911 - DNA, 25 bp, Rattus norvegicus
ggtctcggggtctctcggcatccac

SEQ ID NO: 459912 - DNA, 25 bp, Rattus norvegicus
tctcggcatccacccaggcggagca

SEQ ID NO: 459913 - DNA, 25 bp, Rattus norvegicus
tggccgccgacaccagttgcaaagg

SEQ ID NO: 459914 - DNA, 25 bp, Rattus norvegicus
ccgacaccagttgcaaagggtccaa

SEQ ID NO: 459915 - DNA, 25 bp, Rattus norvegicus
ttgcaaagggtccaagtgaaccgca

SEQ ID NO: 459916 - DNA, 25 bp, Rattus norvegicus
ggtccaagtgaaccgcagcggccgc

SEQ ID NO: 459917 - DNA, 25 bp, Rattus norvegicus
tggtcccggctcacaaagaccctta

SEQ ID NO: 459918 - DNA, 25 bp, Rattus norvegicus
gccgcaccaatgtccgaggggctct

SEQ ID NO: 459919 - DNA, 25 bp, Rattus norvegicus
ctccctagacgcaagaggacctgtg

SEQ ID NO: 459920 - DNA, 25 bp, Rattus norvegicus
tagacgcaagaggacctgtggccga

SEQ ID NO: 459921 - DNA, 25 bp, Rattus norvegicus
gctcgctcccggtcacagccagcac

SEQ ID NO: 459922 - DNA, 25 bp, Rattus norvegicus
ctgagcctggcaccgctctggtccc

SEQ ID NO: 459923 - DNA, 25 bp, Rattus norvegicus
gggagtgccacgacctccctagacg

SEQ ID NO: 459924 - DNA, 25 bp, Rattus norvegicus
gggctggatatatcaacactgcaga

SEQ ID NO: 459925 - DNA, 25 bp, Rattus norvegicus
ttcctgcgctccacgtaaagtgcgc

SEQ ID NO: 459926 - DNA, 25 bp, Rattus norvegicus
gcagaaggtacggagcagtgaccca

SEQ ID NO: 459927 - DNA, 25 bp, Rattus norvegicus
attaattgcggatcggctttgcggc

SEQ ID NO: 459928 - DNA, 25 bp, Rattus norvegicus
cgccagtgaatgtcgcacagtcgtt

SEQ ID NO: 459929 - DNA, 25 bp, Rattus norvegicus
cgttggcaccggaagggttcacact

SEQ ID NO: 459930 - DNA, 25 bp, Rattus norvegicus
cacactgcgtgtgaaaggggacaaa

SEQ ID NO: 459931 - DNA, 25 bp, Rattus norvegicus
accgagttcatttgtcatgcagccc

SEQ ID NO: 459932 - DNA, 25 bp, Rattus norvegicus
ccttctttgatcagcagagggtgga

SEQ ID NO: 459933 - DNA, 25 bp, Rattus norvegicus
gagaaagcacgcaaagcctagggcc

SEQ ID NO: 459934 - DNA, 25 bp, Rattus norvegicus
tctagacgccgcacgaggttttgtc

SEQ ID NO: 459935 - DNA, 25 bp, Rattus norvegicus
tgttcccagagcaagccggggccaa

SEQ ID NO: 459936 - DNA, 25 bp, Rattus norvegicus
tccgccgtccgtgctttcatattaa

SEQ ID NO: 459937 - DNA, 25 bp, Rattus norvegicus
gcttagcttcctcgagaagtccgga

SEQ ID NO: 459938 - DNA, 25 bp, Rattus norvegicus
gcggagaattgttcctagcagatct

SEQ ID NO: 459939 - DNA, 25 bp, Rattus norvegicus
tctcctcctgcggttcccgctgatc

SEQ ID NO: 459940 - DNA, 25 bp, Rattus norvegicus
atcctgcacagggtggcccgtttct

SEQ ID NO: 459941 - DNA, 25 bp, Rattus norvegicus
gcccttctagggcatcctgcacagg

SEQ ID NO: 459942 - DNA, 25 bp, Rattus norvegicus
caggaagcagtgacggagccccctc

SEQ ID NO: 459943 - DNA, 25 bp, Rattus norvegicus
cagtagccgcgtccggtcggcagca

SEQ ID NO: 459944 - DNA, 25 bp, Rattus norvegicus
gcagatctcacgcagtagccgcgtc

SEQ ID NO: 459945 - DNA, 25 bp, Rattus norvegicus
tcctagcagatctcacgcagtagcc

SEQ ID NO: 459946 - DNA, 25 bp, Rattus norvegicus
gaattgttcctagcagatctcacgc

SEQ ID NO: 459947 - DNA, 25 bp, Rattus norvegicus
gcttggcggagaattgttcctagca

SEQ ID NO: 459948 - DNA, 25 bp, Rattus norvegicus
acagcttggcggagaattgttccta

SEQ ID NO: 459949 - DNA, 25 bp, Rattus norvegicus
cgagcaacagcttggcggagaattg

SEQ ID NO: 459950 - DNA, 25 bp, Rattus norvegicus
ttgcgagcaacagcttggcggagaa

SEQ ID NO: 459951 - DNA, 25 bp, Rattus norvegicus
tgttcctagcagatctcacgcagta

SEQ ID NO: 459952 - DNA, 25 bp, Rattus norvegicus
ggcgcagccctccatacaaggcaga

SEQ ID NO: 459953 - DNA, 25 bp, Rattus norvegicus
ccgccgacttacgtgacgggcgaag

SEQ ID NO: 459954 - DNA, 25 bp, Rattus norvegicus
tgcgagcatccaccgttcgcgcagg

SEQ ID NO: 459955 - DNA, 25 bp, Rattus norvegicus
gggaccaccggcagcctgcgagcat

SEQ ID NO: 459956 - DNA, 25 bp, Rattus norvegicus
gagaccaggttgagacgccgccgac

SEQ ID NO: 459957 - DNA, 25 bp, Rattus norvegicus
ccctgatttatctgcggtcgccgag

SEQ ID NO: 459958 - DNA, 25 bp, Rattus norvegicus
aggctccagccgagcactttgctcg

SEQ ID NO: 459959 - DNA, 25 bp, Rattus norvegicus
cgactgtggaaacggagctcggcca

SEQ ID NO: 459960 - DNA, 25 bp, Rattus norvegicus
cgccgccatcaagggcgactgtgga

SEQ ID NO: 459961 - DNA, 25 bp, Rattus norvegicus
ttcgcgatcgaagatcagtgccctc

SEQ ID NO: 459962 - DNA, 25 bp, Rattus norvegicus
gccagcagccatcttcgcgatcgaa

SEQ ID NO: 459963 - DNA, 25 bp, Rattus norvegicus
gggccgatcagccaagattggaaaa

SEQ ID NO: 459964 - DNA, 25 bp, Rattus norvegicus
cagagtcaaggccagcaggcagcca

SEQ ID NO: 459965 - DNA, 25 bp, Rattus norvegicus
agaggaactcccaaagtcgccgtcg

SEQ ID NO: 459966 - DNA, 25 bp, Rattus norvegicus
cttcttgcccggattcagggcgcta

SEQ ID NO: 459967 - DNA, 25 bp, Rattus norvegicus
agcaacggctctgagttcgcgcctg

SEQ ID NO: 459968 - DNA, 25 bp, Rattus norvegicus
gttacgtcagcaccacgctcagcaa

SEQ ID NO: 459969 - DNA, 25 bp, Rattus norvegicus
agtggacgcagtccgcgttacgtca

SEQ ID NO: 459970 - DNA, 25 bp, Rattus norvegicus
ctgccagtgattgcgctacggaaca

SEQ ID NO: 459971 - DNA, 25 bp, Rattus norvegicus
acttcctgccgctaccggtgtggac

SEQ ID NO: 459972 - DNA, 25 bp, Rattus norvegicus
cagagaaggaagaggaccgcgaccc

SEQ ID NO: 459973 - DNA, 25 bp, Rattus norvegicus
gtggatttggccttcagcggcatca

SEQ ID NO: 459974 - DNA, 25 bp, Rattus norvegicus
tcggggctcacaacaccgggtacca

SEQ ID NO: 459975 - DNA, 25 bp, Rattus norvegicus
gcggcatcacgccttacggctactt

SEQ ID NO: 459976 - DNA, 25 bp, Rattus norvegicus
tcgcgcctgtgcactttgcttcttg

SEQ ID NO: 459977 - DNA, 25 bp, Rattus norvegicus
acggctactttctgatcagcgcttg

SEQ ID NO: 459978 - DNA, 25 bp, Rattus norvegicus
tcagcgcttgcaaaggtgagctgac

SEQ ID NO: 459979 - DNA, 25 bp, Rattus norvegicus
gccatgaggcagacgccgctcactt

SEQ ID NO: 459980 - DNA, 25 bp, Rattus norvegicus
taaccacgcattaatggtaaccacg

SEQ ID NO: 459981 - DNA, 25 bp, Rattus norvegicus
cacgcattaatggtaaccacgcagc

SEQ ID NO: 459982 - DNA, 25 bp, Rattus norvegicus
gcggtaaccacgcattaatggtaac

SEQ ID NO: 459983 - DNA, 25 bp, Rattus norvegicus
cagcggtaaccacgcattaatggta

SEQ ID NO: 459984 - DNA, 25 bp, Rattus norvegicus
cagcagcggtaaccacgcattaatg

SEQ ID NO: 459985 - DNA, 25 bp, Rattus norvegicus
ggtaaccacgcagcagcggtaacca

SEQ ID NO: 459986 - DNA, 25 bp, Rattus norvegicus
acgcagcagcgctaaccacgcagca

SEQ ID NO: 459987 - DNA, 25 bp, Rattus norvegicus
acgcattaatggtaaccacgcagca

SEQ ID NO: 459988 - DNA, 25 bp, Rattus norvegicus
ttaatggtaaccacgcagcagcggt

SEQ ID NO: 459989 - DNA, 25 bp, Rattus norvegicus
taatggtaaccacgcagcagcggta

SEQ ID NO: 459990 - DNA, 25 bp, Rattus norvegicus
cagcagcgctaaccacgcagcagcg

SEQ ID NO: 459991 - DNA, 25 bp, Rattus norvegicus
gtaaccacgcagcagcggtaaccac

SEQ ID NO: 459992 - DNA, 25 bp, Rattus norvegicus
cgcagcagcgctaaccacgcagcag

SEQ ID NO: 459993 - DNA, 25 bp, Rattus norvegicus
atggtaaccacgcagcagcggtaac

SEQ ID NO: 459994 - DNA, 25 bp, Rattus norvegicus
gccttttcaccgacttccgcgctta

SEQ ID NO: 459995 - DNA, 25 bp, Rattus norvegicus
tatacaagagtgagcaggggctctg

SEQ ID NO: 459996 - DNA, 25 bp, Rattus norvegicus
cgttgcagccttcccggggtttcag

SEQ ID NO: 459997 - DNA, 25 bp, Rattus norvegicus
agttgcagccttcccgggagttcca

SEQ ID NO: 459998 - DNA, 25 bp, Rattus norvegicus
gggagttccagccacactgcctttt

SEQ ID NO: 459999 - DNA, 25 bp, Rattus norvegicus
gagttccagccacactgccttttca

SEQ ID NO: 460000 - DNA, 25 bp, Rattus norvegicus
cgacggtgatatacaagagtgagca

SEQ ID NO: 460001 - DNA, 25 bp, Rattus norvegicus
cttttcttcactcagacctgggtgc

SEQ ID NO: 460002 - DNA, 25 bp, Rattus norvegicus
cttcactcagacctgggtgcttcta

SEQ ID NO: 460003 - DNA, 25 bp, Rattus norvegicus
tcagacctgggtgcttctacgaccc

SEQ ID NO: 460004 - DNA, 25 bp, Rattus norvegicus
cccttctcctgtgaattccgccgcg

SEQ ID NO: 460005 - DNA, 25 bp, Rattus norvegicus
atgacgacggtgatatacaagagtg

SEQ ID NO: 460006 - DNA, 25 bp, Rattus norvegicus
ctctgggtgtgtccgcgttgcagcc

SEQ ID NO: 460007 - DNA, 25 bp, Rattus norvegicus
cgcgcttacttttcttcactcagac

SEQ ID NO: 460008 - DNA, 25 bp, Rattus norvegicus
ctgagtagctcctggctaggcagta

SEQ ID NO: 460009 - DNA, 25 bp, Rattus norvegicus
agtggtccgagctcactcgtggacc

SEQ ID NO: 460010 - DNA, 25 bp, Rattus norvegicus
agctggtgcaaaacctcacgggttc

SEQ ID NO: 460011 - DNA, 25 bp, Rattus norvegicus
catttcagtggtccgagctcactcg

SEQ ID NO: 460012 - DNA, 25 bp, Rattus norvegicus
ctcgtggaccctcctttatttggca

SEQ ID NO: 460013 - DNA, 25 bp, Rattus norvegicus
ggaccctcctttatttggcacgcca

SEQ ID NO: 460014 - DNA, 25 bp, Rattus norvegicus
ttggcacgccacacatcagaaaagc

SEQ ID NO: 460015 - DNA, 25 bp, Rattus norvegicus
cagaaaagcctttcccaaaagcagt

SEQ ID NO: 460016 - DNA, 25 bp, Rattus norvegicus
ttcccaaaagcagttttccagttca

SEQ ID NO: 460017 - DNA, 25 bp, Rattus norvegicus
agcagttttccagttcaacgcccgg

SEQ ID NO: 460018 - DNA, 25 bp, Rattus norvegicus
tcaacgcccggcgtctctctgagta

SEQ ID NO: 460019 - DNA, 25 bp, Rattus norvegicus
ccggcgtctctctgagtagctcctg

SEQ ID NO: 460020 - DNA, 25 bp, Rattus norvegicus
gctaggcagtagctggtgcaaaacc

SEQ ID NO: 460021 - DNA, 25 bp, Rattus norvegicus
tgcaaaacctcacgggttcggagcc

SEQ ID NO: 460022 - DNA, 25 bp, Rattus norvegicus
tctccgccttttcatctgcacttgg

SEQ ID NO: 460023 - DNA, 25 bp, Rattus norvegicus
tttcttctccgccttttcatctgca

SEQ ID NO: 460024 - DNA, 25 bp, Rattus norvegicus
ccttcacgaatttctcgcctgctcc

SEQ ID NO: 460025 - DNA, 25 bp, Rattus norvegicus
ccgccttttcatctgcacttggaga

SEQ ID NO: 460026 - DNA, 25 bp, Rattus norvegicus
cttttcatctgcacttggagacggc

SEQ ID NO: 460027 - DNA, 25 bp, Rattus norvegicus
ttcatctgcacttggagacggcgcc

SEQ ID NO: 460028 - DNA, 25 bp, Rattus norvegicus
atctgcacttggagacggcgccctc

SEQ ID NO: 460029 - DNA, 25 bp, Rattus norvegicus
ggagacggcgccctcttcctgcgcc

SEQ ID NO: 460030 - DNA, 25 bp, Rattus norvegicus
gaggccgtggtcaccgggcaccggc

SEQ ID NO: 460031 - DNA, 25 bp, Rattus norvegicus
gtaggatgggcgacgcccctctatc

SEQ ID NO: 460032 - DNA, 25 bp, Rattus norvegicus
ccgtctcagcctccagcacccttca

SEQ ID NO: 460033 - DNA, 25 bp, Rattus norvegicus
gcctccagcacccttcacgaatttc

SEQ ID NO: 460034 - DNA, 25 bp, Rattus norvegicus
tgcacttggagacggcgccctcttc

SEQ ID NO: 460035 - DNA, 25 bp, Rattus norvegicus
cggcagagcacaggtaggacgagcc

SEQ ID NO: 460036 - DNA, 25 bp, Rattus norvegicus
gctcagaaggtagaagttctgtata

SEQ ID NO: 460037 - DNA, 25 bp, Rattus norvegicus
tagaagttctgtatatgtactcgcg

SEQ ID NO: 460038 - DNA, 25 bp, Rattus norvegicus
ctcagaagctagaagttctgtatat

SEQ ID NO: 460039 - DNA, 25 bp, Rattus norvegicus
gcgatgccatgctcagaagctagaa

SEQ ID NO: 460040 - DNA, 25 bp, Rattus norvegicus
ctggcgatgccatgctcagaagcta

SEQ ID NO: 460041 - DNA, 25 bp, Rattus norvegicus
ttctgtatatgtactcgcgcagaca

SEQ ID NO: 460042 - DNA, 25 bp, Rattus norvegicus
gtagaagttctgtatatgtactcgc

SEQ ID NO: 460043 - DNA, 25 bp, Rattus norvegicus
tgccatgctcagaaggtagaagttc

SEQ ID NO: 460044 - DNA, 25 bp, Rattus norvegicus
tatatgtactcgcgcagacacagcg

SEQ ID NO: 460045 - DNA, 25 bp, Rattus norvegicus
gcgatgccatgctcagaaggtagaa

SEQ ID NO: 460046 - DNA, 25 bp, Rattus norvegicus
tgtatatgtactcgcgcagacacag

SEQ ID NO: 460047 - DNA, 25 bp, Rattus norvegicus
gaagttctgtatatgtactcgcgca

SEQ ID NO: 460048 - DNA, 25 bp, Rattus norvegicus
ctggcgatgccatgctcagaaggta

SEQ ID NO: 460049 - DNA, 25 bp, Rattus norvegicus
gccatgctcagaaggtagaagttct

SEQ ID NO: 460050 - DNA, 25 bp, Rattus norvegicus
ggaggagcagcaggcgccgccatgg

SEQ ID NO: 460051 - DNA, 25 bp, Rattus norvegicus
acttggaggagctctcccgcctcag

SEQ ID NO: 460052 - DNA, 25 bp, Rattus norvegicus
ggccgacttggaggagctctcccgc

SEQ ID NO: 460053 - DNA, 25 bp, Rattus norvegicus
atggccgacttggaggagctctccc

SEQ ID NO: 460054 - DNA, 25 bp, Rattus norvegicus
gacatggccgacttggaggagctct

SEQ ID NO: 460055 - DNA, 25 bp, Rattus norvegicus
accgacatggccgacttggaggagc

SEQ ID NO: 460056 - DNA, 25 bp, Rattus norvegicus
gctcaccgacatggccgacttggag

SEQ ID NO: 460057 - DNA, 25 bp, Rattus norvegicus
gcgctcaccgacatggccgacttgg

SEQ ID NO: 460058 - DNA, 25 bp, Rattus norvegicus
cgcaggcgcgctgcctcgtccgcgt

SEQ ID NO: 460059 - DNA, 25 bp, Rattus norvegicus
agcgcgtgtgcagcctgacgcagcc

SEQ ID NO: 460060 - DNA, 25 bp, Rattus norvegicus
cgtagcgcgtgtgcagcctgacgca

SEQ ID NO: 460061 - DNA, 25 bp, Rattus norvegicus
gctccgtagcgcgtgtgcagcctga

SEQ ID NO: 460062 - DNA, 25 bp, Rattus norvegicus
agtgcgcgcgttccggcgcgtgtcc

SEQ ID NO: 460063 - DNA, 25 bp, Rattus norvegicus
tcgtccgcgtgagtgcgcgcgttcc

SEQ ID NO: 460064 - DNA, 25 bp, Rattus norvegicus
tacacctcggtagcttcgtgcatcg

SEQ ID NO: 460065 - DNA, 25 bp, Rattus norvegicus
agtgcgccgccaagggaactcttcc

SEQ ID NO: 460066 - DNA, 25 bp, Rattus norvegicus
tcaggggactccttcctgactccag

SEQ ID NO: 460067 - DNA, 25 bp, Rattus norvegicus
tcctgtctaggggactctttggacc

SEQ ID NO: 460068 - DNA, 25 bp, Rattus norvegicus
ttgagttgacttccttgcccgatcc

SEQ ID NO: 460069 - DNA, 25 bp, Rattus norvegicus
acctcctggactggtggcccagcag

SEQ ID NO: 460070 - DNA, 25 bp, Rattus norvegicus
ggacctcctggcagcgatctccttg

SEQ ID NO: 460071 - DNA, 25 bp, Rattus norvegicus
tccttgctccgggtagagtccgggc

SEQ ID NO: 460072 - DNA, 25 bp, Rattus norvegicus
gcccgctcgccttgagaaacgtctt

SEQ ID NO: 460073 - DNA, 25 bp, Rattus norvegicus
gagaaacgtcttcgccagcatcacc

SEQ ID NO: 460074 - DNA, 25 bp, Rattus norvegicus
cgcgcggttctttcggatcgaagga

SEQ ID NO: 460075 - DNA, 25 bp, Rattus norvegicus
gaaggacgactctatcccggagaca

SEQ ID NO: 460076 - DNA, 25 bp, Rattus norvegicus
ccagaagcccttggtgtacacctcg

SEQ ID NO: 460077 - DNA, 25 bp, Rattus norvegicus
ctgagccgcatggactcggaggaca

SEQ ID NO: 460078 - DNA, 25 bp, Rattus norvegicus
gcttttgtacccacagacagcatca

SEQ ID NO: 460079 - DNA, 25 bp, Rattus norvegicus
gcgagctgccgtcatagcttttgta

SEQ ID NO: 460080 - DNA, 25 bp, Rattus norvegicus
gcatcacaaacaaagcggtacgggg

SEQ ID NO: 460081 - DNA, 25 bp, Rattus norvegicus
tgtgtgaacttgcaggggactctga

SEQ ID NO: 460082 - DNA, 25 bp, Rattus norvegicus
tctgacgaagccgaagaagattctc

SEQ ID NO: 460083 - DNA, 25 bp, Rattus norvegicus
aagattctcatccacctcgtcactg

SEQ ID NO: 460084 - DNA, 25 bp, Rattus norvegicus
cctcgtcactgagcatgagcggata

SEQ ID NO: 460085 - DNA, 25 bp, Rattus norvegicus
ggagcacatgcgacacccgagtttc

SEQ ID NO: 460086 - DNA, 25 bp, Rattus norvegicus
cccgagtttcacagtttcacgtagg

SEQ ID NO: 460087 - DNA, 25 bp, Rattus norvegicus
ttcacgtaggtgttggaactgctgg

SEQ ID NO: 460088 - DNA, 25 bp, Rattus norvegicus
gtcacaggagatggtgagccacgcc

SEQ ID NO: 460089 - DNA, 25 bp, Rattus norvegicus
agccacgcctgatgctggccgtgac

SEQ ID NO: 460090 - DNA, 25 bp, Rattus norvegicus
tgagcggataccatgagctggctcc

SEQ ID NO: 460091 - DNA, 25 bp, Rattus norvegicus
tgatcagtcggcacggcgagctgcc

SEQ ID NO: 460092 - DNA, 25 bp, Rattus norvegicus
caccgtggtgtacggtcccagcagc

SEQ ID NO: 460093 - DNA, 25 bp, Rattus norvegicus
ccctcaaggtgagctcgcgtcggac

SEQ ID NO: 460094 - DNA, 25 bp, Rattus norvegicus
gggtctgagcagagcccgtcgccca

SEQ ID NO: 460095 - DNA, 25 bp, Rattus norvegicus
gtacgcagactgcaagctcgcggca

SEQ ID NO: 460096 - DNA, 25 bp, Rattus norvegicus
atccagacctggtgcagtacgcaga

SEQ ID NO: 460097 - DNA, 25 bp, Rattus norvegicus
tgttcggtgcgcaggatccagacct

SEQ ID NO: 460098 - DNA, 25 bp, Rattus norvegicus
tctgcagcgccagagcctgttcggt

SEQ ID NO: 460099 - DNA, 25 bp, Rattus norvegicus
cagcagaacccgtgcgccgtggcgt

SEQ ID NO: 460100 - DNA, 25 bp, Rattus norvegicus
acccttcgcaaatccaggagttcta

SEQ ID NO: 460101 - DNA, 25 bp, Rattus norvegicus
ttatgactgcggcttcgcccaggac

SEQ ID NO: 460102 - DNA, 25 bp, Rattus norvegicus
ccaattattatgactgcggcttcgc

SEQ ID NO: 460103 - DNA, 25 bp, Rattus norvegicus
gagctcttatttcgtcaactcactg

SEQ ID NO: 460104 - DNA, 25 bp, Rattus norvegicus
cgccgcctcaaaattcaataaaatg

SEQ ID NO: 460105 - DNA, 25 bp, Rattus norvegicus
aggagttctaccacgggccatcgtc

SEQ ID NO: 460106 - DNA, 25 bp, Rattus norvegicus
ggggttttctgcagagcactcagca

SEQ ID NO: 460107 - DNA, 25 bp, Rattus norvegicus
tggagaccttacctggcatacttgg

SEQ ID NO: 460108 - DNA, 25 bp, Rattus norvegicus
agaggttcaaggtcgcctggagacc

SEQ ID NO: 460109 - DNA, 25 bp, Rattus norvegicus
ccctggtttctctggagaggttcaa

SEQ ID NO: 460110 - DNA, 25 bp, Rattus norvegicus
gtcgctttgactagcgccctcagga

SEQ ID NO: 460111 - DNA, 25 bp, Rattus norvegicus
ggcgtcctcatggtcgctttgacta

SEQ ID NO: 460112 - DNA, 25 bp, Rattus norvegicus
aagcgctggtgcagctctccttggg

SEQ ID NO: 460113 - DNA, 25 bp, Rattus norvegicus
tcagtctcctgtgcgccttcttctg

SEQ ID NO: 460114 - DNA, 25 bp, Rattus norvegicus
agactgggccaagcccggtctccga

SEQ ID NO: 460115 - DNA, 25 bp, Rattus norvegicus
tcctggagacgtgattccgagactg

SEQ ID NO: 460116 - DNA, 25 bp, Rattus norvegicus
cgcgaggaccaaggaagagattccg

SEQ ID NO: 460117 - DNA, 25 bp, Rattus norvegicus
ctcagctgcctaggtggcgcgacat

SEQ ID NO: 460118 - DNA, 25 bp, Rattus norvegicus
gcgctgctcttcagtctcctgtgcg

SEQ ID NO: 460119 - DNA, 25 bp, Rattus norvegicus
ccttcttctggatgggcttgtgcct

SEQ ID NO: 460120 - DNA, 25 bp, Rattus norvegicus
accgtgcgggcacatacacatacgt

SEQ ID NO: 460121 - DNA, 25 bp, Rattus norvegicus
gaacaggtgatgtctgccacgccca

SEQ ID NO: 460122 - DNA, 25 bp, Rattus norvegicus
gacatatatgtaccaccgtgcgggc

SEQ ID NO: 460123 - DNA, 25 bp, Rattus norvegicus
gccgtcagctcctccatgttggaca

SEQ ID NO: 460124 - DNA, 25 bp, Rattus norvegicus
gctggagcagcccagaagcagcaga

SEQ ID NO: 460125 - DNA, 25 bp, Rattus norvegicus
ctccatgttggacagcgccagggaa

SEQ ID NO: 460126 - DNA, 25 bp, Rattus norvegicus
gcgtagacgcctaggcaccgactta

SEQ ID NO: 460127 - DNA, 25 bp, Rattus norvegicus
ggcaccgacttaaaggcaccagatg

SEQ ID NO: 460128 - DNA, 25 bp, Rattus norvegicus
ccagatgatgccgtgctaaaaggcc

SEQ ID NO: 460129 - DNA, 25 bp, Rattus norvegicus
acacgtcccggtgcagaagcccgta

SEQ ID NO: 460130 - DNA, 25 bp, Rattus norvegicus
gcccttgacatgacagcagcgatct

SEQ ID NO: 460131 - DNA, 25 bp, Rattus norvegicus
ggacctctccatcatgctgtgcgtg

SEQ ID NO: 460132 - DNA, 25 bp, Rattus norvegicus
acgtgcacgggaagcggtatatata

SEQ ID NO: 460133 - DNA, 25 bp, Rattus norvegicus
tccctgctgcctggagaagagacgc

SEQ ID NO: 460134 - DNA, 25 bp, Rattus norvegicus
gagcagcttctcttccgggtagaca

SEQ ID NO: 460135 - DNA, 25 bp, Rattus norvegicus
ggaagccttggcatttgaacagaaa

SEQ ID NO: 460136 - DNA, 25 bp, Rattus norvegicus
ctccgggcggaacggtgtgcaaaat

SEQ ID NO: 460137 - DNA, 25 bp, Rattus norvegicus
tccaaaggcagaccagactccgggc

SEQ ID NO: 460138 - DNA, 25 bp, Rattus norvegicus
cttgattagctagggatccaaaggc

SEQ ID NO: 460139 - DNA, 25 bp, Rattus norvegicus
atggaccggggagtagaaaatgctt

SEQ ID NO: 460140 - DNA, 25 bp, Rattus norvegicus
ctcgctggagcttttatggaccggg

SEQ ID NO: 460141 - DNA, 25 bp, Rattus norvegicus
tgcgcgtattgctcgctggagcttt

SEQ ID NO: 460142 - DNA, 25 bp, Rattus norvegicus
actaagtgtgagcttccgggcaccc

SEQ ID NO: 460143 - DNA, 25 bp, Rattus norvegicus
cgggtagacaatagctggaactttc

SEQ ID NO: 460144 - DNA, 25 bp, Rattus norvegicus
ccggaagtagccttgtgagcagctt

SEQ ID NO: 460145 - DNA, 25 bp, Rattus norvegicus
gagcaccggaagtggctttagtacc

SEQ ID NO: 460146 - DNA, 25 bp, Rattus norvegicus
cacccgtagtctagtggacagagca

SEQ ID NO: 460147 - DNA, 25 bp, Rattus norvegicus
ttctcctgtgtagtcagccgccagc

SEQ ID NO: 460148 - DNA, 25 bp, Rattus norvegicus
gcggtcatcagtgcgggaagaaaac

SEQ ID NO: 460149 - DNA, 25 bp, Rattus norvegicus
tccctcacggatacccagagtaagc

SEQ ID NO: 460150 - DNA, 25 bp, Rattus norvegicus
gctcttctctggactaggcttcgca

SEQ ID NO: 460151 - DNA, 25 bp, Rattus norvegicus
agtagcgtcgccgaggctcttctct

SEQ ID NO: 460152 - DNA, 25 bp, Rattus norvegicus
ttggcctctccgtagccaatggagc

SEQ ID NO: 460153 - DNA, 25 bp, Rattus norvegicus
caacagtgcgtgctattggcctctc

SEQ ID NO: 460154 - DNA, 25 bp, Rattus norvegicus
tccaggcgcacatccgaacaacagt

SEQ ID NO: 460155 - DNA, 25 bp, Rattus norvegicus
ccttctctgatttgctgtgtggtgc

SEQ ID NO: 460156 - DNA, 25 bp, Rattus norvegicus
cctgtcagctgttccgcgtgtaaaa

SEQ ID NO: 460157 - DNA, 25 bp, Rattus norvegicus
gggcgcagccacgaacctgtcagct

SEQ ID NO: 460158 - DNA, 25 bp, Rattus norvegicus
agggctcctgaaaccgtcggcagac

SEQ ID NO: 460159 - DNA, 25 bp, Rattus norvegicus
atgacaccggcgctctgtctcacgg

SEQ ID NO: 460160 - DNA, 25 bp, Rattus norvegicus
ggaagaaaacgcacgctaaccctga

SEQ ID NO: 460161 - DNA, 25 bp, Rattus norvegicus
ggtcggtcagtcaaaagcgtgaacc

SEQ ID NO: 460162 - DNA, 25 bp, Rattus norvegicus
ggcacacacgtctttaaaaggctcg

SEQ ID NO: 460163 - DNA, 25 bp, Rattus norvegicus
ccggcacacacgtctttaaaaggct

SEQ ID NO: 460164 - DNA, 25 bp, Rattus norvegicus
tgctagaccggcacacacgtcttta

SEQ ID NO: 460165 - DNA, 25 bp, Rattus norvegicus
tctgctgctagaccggcacacacgt

SEQ ID NO: 460166 - DNA, 25 bp, Rattus norvegicus
gactctgctgctagaccggcacaca

SEQ ID NO: 460167 - DNA, 25 bp, Rattus norvegicus
tcgactctgctgctagaccggcaca

SEQ ID NO: 460168 - DNA, 25 bp, Rattus norvegicus
gtagctcgactctgctgctagaccg

SEQ ID NO: 460169 - DNA, 25 bp, Rattus norvegicus
ccagtagctcgactctgctgctaga

SEQ ID NO: 460170 - DNA, 25 bp, Rattus norvegicus
ggttcccagtagctcgactctgctg

SEQ ID NO: 460171 - DNA, 25 bp, Rattus norvegicus
agcggagccagctcggttcccagta

SEQ ID NO: 460172 - DNA, 25 bp, Rattus norvegicus
gacaccagcggagccagctcggttc

SEQ ID NO: 460173 - DNA, 25 bp, Rattus norvegicus
gaggagacaccagcggagccagctc

SEQ ID NO: 460174 - DNA, 25 bp, Rattus norvegicus
tcgctagggccggaccgccgagcga

SEQ ID NO: 460175 - DNA, 25 bp, Rattus norvegicus
gttagttcctcagcggcctcgctag

SEQ ID NO: 460176 - DNA, 25 bp, Rattus norvegicus
ggcagcaaaggcatcccactgaaga

SEQ ID NO: 460177 - DNA, 25 bp, Rattus norvegicus
ccgagctcccggatgtggagacgtt

SEQ ID NO: 460178 - DNA, 25 bp, Rattus norvegicus
agctgccacagcaggcgggcggtac

SEQ ID NO: 460179 - DNA, 25 bp, Rattus norvegicus
gcgaggcctagagaagccgccgcac

SEQ ID NO: 460180 - DNA, 25 bp, Rattus norvegicus
agaagccgccgcacctggcagcgct

SEQ ID NO: 460181 - DNA, 25 bp, Rattus norvegicus
cccagagtgcctcggggctgaccga

SEQ ID NO: 460182 - DNA, 25 bp, Rattus norvegicus
caaaggcatcccactgaagaacatc

SEQ ID NO: 460183 - DNA, 25 bp, Rattus norvegicus
ggcatcccactgaagaacatcaagc

SEQ ID NO: 460184 - DNA, 25 bp, Rattus norvegicus
cccactgaagaacatcaagcgcctg

SEQ ID NO: 460185 - DNA, 25 bp, Rattus norvegicus
tgaagaacatcaagcgcctggcggg

SEQ ID NO: 460186 - DNA, 25 bp, Rattus norvegicus
gctcattggctgggtcctgcgcgca

SEQ ID NO: 460187 - DNA, 25 bp, Rattus norvegicus
cgcagccctggacgcgggtgtcttc

SEQ ID NO: 460188 - DNA, 25 bp, Rattus norvegicus
gtgtcttccagaggtgcgcatgtgc

SEQ ID NO: 460189 - DNA, 25 bp, Rattus norvegicus
aggcctagagaagccgccgcacctg

SEQ ID NO: 460190 - DNA, 25 bp, Rattus norvegicus
cgtgcatgcacacgcgcatatgtct

SEQ ID NO: 460191 - DNA, 25 bp, Rattus norvegicus
aaattgcctcccgtgacctgcttgg

SEQ ID NO: 460192 - DNA, 25 bp, Rattus norvegicus
ctctcatcagttcattcagcggtgc

SEQ ID NO: 460193 - DNA, 25 bp, Rattus norvegicus
tcacaggcaatcctagaactctctc

SEQ ID NO: 460194 - DNA, 25 bp, Rattus norvegicus
aagagatgctcttgcgccgtgcacc

SEQ ID NO: 460195 - DNA, 25 bp, Rattus norvegicus
tggtctctttccctgcagacagtgg

SEQ ID NO: 460196 - DNA, 25 bp, Rattus norvegicus
tgtcttgctagaggaagtggcctcc

SEQ ID NO: 460197 - DNA, 25 bp, Rattus norvegicus
cgccaatgcaacttttactgggatg

SEQ ID NO: 460198 - DNA, 25 bp, Rattus norvegicus
tcagctacaaggatcttcgccaatg

SEQ ID NO: 460199 - DNA, 25 bp, Rattus norvegicus
gccacggcttcagaggtcagctaca

SEQ ID NO: 460200 - DNA, 25 bp, Rattus norvegicus
tttggctttccagctcgcacacgca

SEQ ID NO: 460201 - DNA, 25 bp, Rattus norvegicus
gcctccgggcaaatcacgagccttg

SEQ ID NO: 460202 - DNA, 25 bp, Rattus norvegicus
gaatttccgcgccagcatggccatg

SEQ ID NO: 460203 - DNA, 25 bp, Rattus norvegicus
ccctctggatgtatgtagggcccgc

SEQ ID NO: 460204 - DNA, 25 bp, Rattus norvegicus
gccgcactcacgctctaaggaggaa

SEQ ID NO: 460205 - DNA, 25 bp, Rattus norvegicus
tgcccaagctttgcggaggacaagc

SEQ ID NO: 460206 - DNA, 25 bp, Rattus norvegicus
gcctcccttcggattggtgcccaag

SEQ ID NO: 460207 - DNA, 25 bp, Rattus norvegicus
ttaacgggtcgagccctgcatcatc

SEQ ID NO: 460208 - DNA, 25 bp, Rattus norvegicus
ttcggcggagccgatttgaattcgc

SEQ ID NO: 460209 - DNA, 25 bp, Rattus norvegicus
aatccagttagcatcccgcggagca

SEQ ID NO: 460210 - DNA, 25 bp, Rattus norvegicus
gccgaggcctcattccggagaagca

SEQ ID NO: 460211 - DNA, 25 bp, Rattus norvegicus
caaacgaggtcgtgtgagcacatcc

SEQ ID NO: 460212 - DNA, 25 bp, Rattus norvegicus
gcttcggcctctcctaggattcctg

SEQ ID NO: 460213 - DNA, 25 bp, Rattus norvegicus
cggccacgattttcaccttcagctt

SEQ ID NO: 460214 - DNA, 25 bp, Rattus norvegicus
tggcacggtccatcaccggcaaatg

SEQ ID NO: 460215 - DNA, 25 bp, Rattus norvegicus
ccacgaaggcgtccgtcagatcact

SEQ ID NO: 460216 - DNA, 25 bp, Rattus norvegicus
ctgtcctggacgaatggccacatcc

SEQ ID NO: 460217 - DNA, 25 bp, Rattus norvegicus
cgtactgcagagagccgccaaatcc

SEQ ID NO: 460218 - DNA, 25 bp, Rattus norvegicus
gcatcggaagagttcgaaagggctc

SEQ ID NO: 460219 - DNA, 25 bp, Rattus norvegicus
aagctcgacgtgacggtgcaggacc

SEQ ID NO: 460220 - DNA, 25 bp, Rattus norvegicus
gctcgcccgaggtgccgaagctcga

SEQ ID NO: 460221 - DNA, 25 bp, Rattus norvegicus
aggtatcttcccgagagcgaccgtc

SEQ ID NO: 460222 - DNA, 25 bp, Rattus norvegicus
cggtctagcgcactaaggtatcttc

SEQ ID NO: 460223 - DNA, 25 bp, Rattus norvegicus
atgcttcgcggctgcccgcggtcta

SEQ ID NO: 460224 - DNA, 25 bp, Rattus norvegicus
cgtgacgctagcgtcaggccagtcc

SEQ ID NO: 460225 - DNA, 25 bp, Rattus norvegicus
cagcgatcggactccttcgggtgca

SEQ ID NO: 460226 - DNA, 25 bp, Rattus norvegicus
gtccgtcaaggctcgtaagcgctcc

SEQ ID NO: 460227 - DNA, 25 bp, Rattus norvegicus
ttcggcaaagctcgaccgtgctcgg

SEQ ID NO: 460228 - DNA, 25 bp, Rattus norvegicus
gctcgggcaaagctcgttagagccc

SEQ ID NO: 460229 - DNA, 25 bp, Rattus norvegicus
ggcagaaatcggtaggactccggta

SEQ ID NO: 460230 - DNA, 25 bp, Rattus norvegicus
gctcggcaaagctcgacagtgctcc

SEQ ID NO: 460231 - DNA, 25 bp, Rattus norvegicus
tcgtcatgctccagggcttcttcct

SEQ ID NO: 460232 - DNA, 25 bp, Rattus norvegicus
cagctcgaacgaccatcattgtaga

SEQ ID NO: 460233 - DNA, 25 bp, Rattus norvegicus
ctcgaacgaccatcattgtagatgc

SEQ ID NO: 460234 - DNA, 25 bp, Rattus norvegicus
ggagcagctcgaacgaccatcattg

SEQ ID NO: 460235 - DNA, 25 bp, Rattus norvegicus
tgctgcatgcacgtctgcttgttcc

SEQ ID NO: 460236 - DNA, 25 bp, Rattus norvegicus
tctgtgctgcatgcacgtctgcttg

SEQ ID NO: 460237 - DNA, 25 bp, Rattus norvegicus
ccatcagccgcggactacactccga

SEQ ID NO: 460238 - DNA, 25 bp, Rattus norvegicus
tgggctctgtgctgcatgcacgtct

SEQ ID NO: 460239 - DNA, 25 bp, Rattus norvegicus
ggcttatgattactgggctctgtgc

SEQ ID NO: 460240 - DNA, 25 bp, Rattus norvegicus
ttgggcttatgattactgggctctg

SEQ ID NO: 460241 - DNA, 25 bp, Rattus norvegicus
aggagttttgggcttatgattactg

SEQ ID NO: 460242 - DNA, 25 bp, Rattus norvegicus
cggaaggagttttgggcttatgatt

SEQ ID NO: 460243 - DNA, 25 bp, Rattus norvegicus
ccgcggactacactccgacggtctt

SEQ ID NO: 460244 - DNA, 25 bp, Rattus norvegicus
atcattgtagatgcgcgcacagggc

SEQ ID NO: 460245 - DNA, 25 bp, Rattus norvegicus
gaccatcattgtagatgcgcgcaca

SEQ ID NO: 460246 - DNA, 25 bp, Rattus norvegicus
ggtgacaaaaagtaggctccagctg

SEQ ID NO: 460247 - DNA, 25 bp, Rattus norvegicus
ggttcacgaatcttccaactctctg

SEQ ID NO: 460248 - DNA, 25 bp, Rattus norvegicus
tggagaaggagttcctatttaatcc

SEQ ID NO: 460249 - DNA, 25 bp, Rattus norvegicus
ggagttcctatttaatccctatctg

SEQ ID NO: 460250 - DNA, 25 bp, Rattus norvegicus
ttaatccctatctgactcgcaagcg

SEQ ID NO: 460251 - DNA, 25 bp, Rattus norvegicus
ctcgcaagcggaggatcgaggtatc

SEQ ID NO: 460252 - DNA, 25 bp, Rattus norvegicus
atcgaggtatcgcacgcgctgggac

SEQ ID NO: 460253 - DNA, 25 bp, Rattus norvegicus
acgcgctgggactgacagaaagaca

SEQ ID NO: 460254 - DNA, 25 bp, Rattus norvegicus
tgacagaaagacaggtcaaaatctg

SEQ ID NO: 460255 - DNA, 25 bp, Rattus norvegicus
tggttccagaatcggagaatgaagt

SEQ ID NO: 460256 - DNA, 25 bp, Rattus norvegicus
gcgatgcgcagaagggtgacaaaaa

SEQ ID NO: 460257 - DNA, 25 bp, Rattus norvegicus
cctgcccttattatcctggtctcta

SEQ ID NO: 460258 - DNA, 25 bp, Rattus norvegicus
cccagcagtaaatgcgagcaggagg

SEQ ID NO: 460259 - DNA, 25 bp, Rattus norvegicus
tggtctctaggctggttcacgaatc

SEQ ID NO: 460260 - DNA, 25 bp, Rattus norvegicus
taatcgctcctctgacgcgggatgc

SEQ ID NO: 460261 - DNA, 25 bp, Rattus norvegicus
ctctccagctggagcagggcgcctt

SEQ ID NO: 460262 - DNA, 25 bp, Rattus norvegicus
gcccgccaccggcacctccacagcg

SEQ ID NO: 460263 - DNA, 25 bp, Rattus norvegicus
cctctgacgcgggatgcgcagcagc

SEQ ID NO: 460264 - DNA, 25 bp, Rattus norvegicus
tcgctcctctgacgcgggatgcgca

SEQ ID NO: 460265 - DNA, 25 bp, Rattus norvegicus
ctgcgcggctctccagctggagcag

SEQ ID NO: 460266 - DNA, 25 bp, Rattus norvegicus
ctggttaatcgctcctctgacgcgg

SEQ ID NO: 460267 - DNA, 25 bp, Rattus norvegicus
tcacgcaccttaccgggtctggtta

SEQ ID NO: 460268 - DNA, 25 bp, Rattus norvegicus
tgcggttcacgcaccttaccgggtc

SEQ ID NO: 460269 - DNA, 25 bp, Rattus norvegicus
aaaacgctgcggttcacgcacctta

SEQ ID NO: 460270 - DNA, 25 bp, Rattus norvegicus
agttaaaaacgctgcggttcacgca

SEQ ID NO: 460271 - DNA, 25 bp, Rattus norvegicus
cgccacaaagttaaaaacgctgcgg

SEQ ID NO: 460272 - DNA, 25 bp, Rattus norvegicus
acgcgccacaaagttaaaaacgctg

SEQ ID NO: 460273 - DNA, 25 bp, Rattus norvegicus
tccacagcgggacgcgccacaaagt

SEQ ID NO: 460274 - DNA, 25 bp, Rattus norvegicus
tgagacccgcaggatgctggtccta

SEQ ID NO: 460275 - DNA, 25 bp, Rattus norvegicus
ggagcacccgcgctttactcaggaa

SEQ ID NO: 460276 - DNA, 25 bp, Rattus norvegicus
cagcatctccgcgtcacgggtgcgt

SEQ ID NO: 460277 - DNA, 25 bp, Rattus norvegicus
aggtatgatgggagagccaccagca

SEQ ID NO: 460278 - DNA, 25 bp, Rattus norvegicus
cccgggacaagtaggccatgacaaa

SEQ ID NO: 460279 - DNA, 25 bp, Rattus norvegicus
ctcaggaattctacccagcagggac

SEQ ID NO: 460280 - DNA, 25 bp, Rattus norvegicus
taccggaaagcctagtggcgccctc

SEQ ID NO: 460281 - DNA, 25 bp, Rattus norvegicus
tgccttgcggctaccggaaagccta

SEQ ID NO: 460282 - DNA, 25 bp, Rattus norvegicus
ccttcgcgaccagtggtgccttgcg

SEQ ID NO: 460283 - DNA, 25 bp, Rattus norvegicus
cgcatctccgagtctccagcggtga

SEQ ID NO: 460284 - DNA, 25 bp, Rattus norvegicus
tgacaacctccgagttttccgcatc

SEQ ID NO: 460285 - DNA, 25 bp, Rattus norvegicus
gcagggacaactcggcgacacatta

SEQ ID NO: 460286 - DNA, 25 bp, Rattus norvegicus
ggcgacacattagcatcaaaacggc

SEQ ID NO: 460287 - DNA, 25 bp, Rattus norvegicus
aaaccctgcattctctgtgacaacc

SEQ ID NO: 460288 - DNA, 25 bp, Rattus norvegicus
gcctgtcagcgctctgtttacagga

SEQ ID NO: 460289 - DNA, 25 bp, Rattus norvegicus
aaagttcaggcagggttgagcccgt

SEQ ID NO: 460290 - DNA, 25 bp, Rattus norvegicus
cccgccagctattcattgagaaaac

SEQ ID NO: 460291 - DNA, 25 bp, Rattus norvegicus
ccaggagcgcgggatccacccagtg

SEQ ID NO: 460292 - DNA, 25 bp, Rattus norvegicus
aagaagtgccacttgcgccaggagc

SEQ ID NO: 460293 - DNA, 25 bp, Rattus norvegicus
cgtcttgagagccaggtcccggctg

SEQ ID NO: 460294 - DNA, 25 bp, Rattus norvegicus
cgcctctcctctcgataattaaaag

SEQ ID NO: 460295 - DNA, 25 bp, Rattus norvegicus
tgcagctagttcgtattcgcctctc

SEQ ID NO: 460296 - DNA, 25 bp, Rattus norvegicus
aggaagtgtctccagcccacgtgcc

SEQ ID NO: 460297 - DNA, 25 bp, Rattus norvegicus
cactgacttgccgtgcagctagttc

SEQ ID NO: 460298 - DNA, 25 bp, Rattus norvegicus
aagcctcgcagaagtcagcctcctg

SEQ ID NO: 460299 - DNA, 25 bp, Rattus norvegicus
attgagaaaacagccggagcagagc

SEQ ID NO: 460300 - DNA, 25 bp, Rattus norvegicus
aggctgtggctagcttcagtctccc

SEQ ID NO: 460301 - DNA, 25 bp, Rattus norvegicus
ccgtgcgcgtttctaggaagtgtct

SEQ ID NO: 460302 - DNA, 25 bp, Rattus norvegicus
gcggccgctgagctagcctatcgat

SEQ ID NO: 460303 - DNA, 25 bp, Rattus norvegicus
gacccggggcttgcgcttccgatcg

SEQ ID NO: 460304 - DNA, 25 bp, Rattus norvegicus
tcggagctccgcaccgcctcggccg

SEQ ID NO: 460305 - DNA, 25 bp, Rattus norvegicus
tgagctagcctatcgatgcgctcgg

SEQ ID NO: 460306 - DNA, 25 bp, Rattus norvegicus
ctgagctagcctatcgatgcgctcg

SEQ ID NO: 460307 - DNA, 25 bp, Rattus norvegicus
gctgagctagcctatcgatgcgctc

SEQ ID NO: 460308 - DNA, 25 bp, Rattus norvegicus
cgctgagctagcctatcgatgcgct

SEQ ID NO: 460309 - DNA, 25 bp, Rattus norvegicus
gccgctgagctagcctatcgatgcg

SEQ ID NO: 460310 - DNA, 25 bp, Rattus norvegicus
cggccgctgagctagcctatcgatg

SEQ ID NO: 460311 - DNA, 25 bp, Rattus norvegicus
ccggggcttgcgcttccgatcgccc

SEQ ID NO: 460312 - DNA, 25 bp, Rattus norvegicus
gagcgcgcgatgagcccggcaggcg

SEQ ID NO: 460313 - DNA, 25 bp, Rattus norvegicus
aagcggcgaccaggacgggcctggg

SEQ ID NO: 460314 - DNA, 25 bp, Rattus norvegicus
ggccgctgagctagcctatcgatgc

SEQ ID NO: 460315 - DNA, 25 bp, Rattus norvegicus
gagctagcctatcgatgcgctcgga

SEQ ID NO: 460316 - DNA, 25 bp, Rattus norvegicus
atacgagctataaataccaccgggc

SEQ ID NO: 460317 - DNA, 25 bp, Rattus norvegicus
cccagggctctttaaatacgagcta

SEQ ID NO: 460318 - DNA, 25 bp, Rattus norvegicus
gcacaaccctgtggcgacctgggcg

SEQ ID NO: 460319 - DNA, 25 bp, Rattus norvegicus
agctataaataccaccgggctcggc

SEQ ID NO: 460320 - DNA, 25 bp, Rattus norvegicus
gggctcggcgcacacgtcactgcct

SEQ ID NO: 460321 - DNA, 25 bp, Rattus norvegicus
gcacacgtcactgcctcgcccgctt

SEQ ID NO: 460322 - DNA, 25 bp, Rattus norvegicus
ctcgcccgcttgtgattggccgcat

SEQ ID NO: 460323 - DNA, 25 bp, Rattus norvegicus
tgattggccgcatgggtatctcatt

SEQ ID NO: 460324 - DNA, 25 bp, Rattus norvegicus
gccgcatgggtatctcatttgcata

SEQ ID NO: 460325 - DNA, 25 bp, Rattus norvegicus
gcatgggtatctcatttgcataggg

SEQ ID NO: 460326 - DNA, 25 bp, Rattus norvegicus
tttgcataggggctggcacaaccct

SEQ ID NO: 460327 - DNA, 25 bp, Rattus norvegicus
gctggcacaaccctgtggcgacctg

SEQ ID NO: 460328 - DNA, 25 bp, Rattus norvegicus
cgtgcactctccgtccgggcccagc

SEQ ID NO: 460329 - DNA, 25 bp, Rattus norvegicus
ccacggcaccgtgcactctccgtcc

SEQ ID NO: 460330 - DNA, 25 bp, Rattus norvegicus
agtctgttcccaggtgctcggggca

SEQ ID NO: 460331 - DNA, 25 bp, Rattus norvegicus
tgtacaacgactatcatccaactcg

SEQ ID NO: 460332 - DNA, 25 bp, Rattus norvegicus
caaggacagtgtcgttgtacaacga

SEQ ID NO: 460333 - DNA, 25 bp, Rattus norvegicus
cagcgtttcaaacaaggacagtgtc

SEQ ID NO: 460334 - DNA, 25 bp, Rattus norvegicus
gttgtaaatcacgtgactctctctg

SEQ ID NO: 460335 - DNA, 25 bp, Rattus norvegicus
tacaggggtggcagcgttgtaaatc

SEQ ID NO: 460336 - DNA, 25 bp, Rattus norvegicus
tctcccttggcgaacgtggtacagg

SEQ ID NO: 460337 - DNA, 25 bp, Rattus norvegicus
ttggcacgtgttctctgacacccgc

SEQ ID NO: 460338 - DNA, 25 bp, Rattus norvegicus
caggcggcagcagcccatttggcac

SEQ ID NO: 460339 - DNA, 25 bp, Rattus norvegicus
ctttctgcgctgctcggagtctgtt

SEQ ID NO: 460340 - DNA, 25 bp, Rattus norvegicus
cagatccttgtcaatggcggctttc

SEQ ID NO: 460341 - DNA, 25 bp, Rattus norvegicus
tccttggttagaggcacagatcctt

SEQ ID NO: 460342 - DNA, 25 bp, Rattus norvegicus
ggttgcatcagcctccttggttaga

SEQ ID NO: 460343 - DNA, 25 bp, Rattus norvegicus
agcccatttggcacgtgttctctga

SEQ ID NO: 460344 - DNA, 25 bp, Rattus norvegicus
tcagcgcctcccagaaggccgcacc

SEQ ID NO: 460345 - DNA, 25 bp, Rattus norvegicus
aggaccagaaaagaggcggagcctc

SEQ ID NO: 460346 - DNA, 25 bp, Rattus norvegicus
ccaggaccagaaaagaggcggagcc

SEQ ID NO: 460347 - DNA, 25 bp, Rattus norvegicus
caaccaggaccagaaaagaggcgga

SEQ ID NO: 460348 - DNA, 25 bp, Rattus norvegicus
tcccaaccaggaccagaaaagaggc

SEQ ID NO: 460349 - DNA, 25 bp, Rattus norvegicus
cctcccaaccaggaccagaaaagag

SEQ ID NO: 460350 - DNA, 25 bp, Rattus norvegicus
caccgctcctctccctcccaaccag

SEQ ID NO: 460351 - DNA, 25 bp, Rattus norvegicus
gtgaggggcctaacaccgctcctct

SEQ ID NO: 460352 - DNA, 25 bp, Rattus norvegicus
ctggtgaggggcctaacaccgctcc

SEQ ID NO: 460353 - DNA, 25 bp, Rattus norvegicus
ccgctgtaacccgagctggtgaggg

SEQ ID NO: 460354 - DNA, 25 bp, Rattus norvegicus
ccgggccgctgtaacccgagctggt

SEQ ID NO: 460355 - DNA, 25 bp, Rattus norvegicus
caccgtggcgctccggtacggtgtc

SEQ ID NO: 460356 - DNA, 25 bp, Rattus norvegicus
aaggccgcaccgtggcgctccggta

SEQ ID NO: 460357 - DNA, 25 bp, Rattus norvegicus
gaccagaaaagaggcggagcctctg

SEQ ID NO: 460358 - DNA, 25 bp, Rattus norvegicus
gcgagagactttagaggccactttt

SEQ ID NO: 460359 - DNA, 25 bp, Rattus norvegicus
gcaatcgcagggaggcttaacttta

SEQ ID NO: 460360 - DNA, 25 bp, Rattus norvegicus
ccacttttgtggacgaggggaatgt

SEQ ID NO: 460361 - DNA, 25 bp, Rattus norvegicus
ctctccagatggaaatcggatgctc

SEQ ID NO: 460362 - DNA, 25 bp, Rattus norvegicus
atggaaatcggatgctcgcccggag

SEQ ID NO: 460363 - DNA, 25 bp, Rattus norvegicus
aaagtggcgattggtaggcttctgc

SEQ ID NO: 460364 - DNA, 25 bp, Rattus norvegicus
gtaggcttctgcattttgtctgaac

SEQ ID NO: 460365 - DNA, 25 bp, Rattus norvegicus
attttgtctgaaccgtggccgccca

SEQ ID NO: 460366 - DNA, 25 bp, Rattus norvegicus
gagtcgcccagaggcggcttgcaaa

SEQ ID NO: 460367 - DNA, 25 bp, Rattus norvegicus
ggcttgcaaagttggctgcttcctg

SEQ ID NO: 460368 - DNA, 25 bp, Rattus norvegicus
tggctgcttcctgcaccctggaaac

SEQ ID NO: 460369 - DNA, 25 bp, Rattus norvegicus
ccctggaaacttgcagagggcaatc

SEQ ID NO: 460370 - DNA, 25 bp, Rattus norvegicus
tgcgagcgcagtaagtacaactttc

SEQ ID NO: 460371 - DNA, 25 bp, Rattus norvegicus
gacggcaccgctgttacccgggtgc

SEQ ID NO: 460372 - DNA, 25 bp, Rattus norvegicus
cccaatgtagaggaagctggacatt

SEQ ID NO: 460373 - DNA, 25 bp, Rattus norvegicus
cccgggtacgaacagcgacagtctg

SEQ ID NO: 460374 - DNA, 25 bp, Rattus norvegicus
cagccaatcgagcttaggcagccgg

SEQ ID NO: 460375 - DNA, 25 bp, Rattus norvegicus
cccgacctgagcgaagcctctaggt

SEQ ID NO: 460376 - DNA, 25 bp, Rattus norvegicus
tttcctgttcctggcgaagttctgt

SEQ ID NO: 460377 - DNA, 25 bp, Rattus norvegicus
tcctctgagtccgaggggtccaagc

SEQ ID NO: 460378 - DNA, 25 bp, Rattus norvegicus
ctccgctgctcgcaagggtgagctt

SEQ ID NO: 460379 - DNA, 25 bp, Rattus norvegicus
gctggacattttgtcagacatgctg

SEQ ID NO: 460380 - DNA, 25 bp, Rattus norvegicus
atgaagccattgaccgagccctccg

SEQ ID NO: 460381 - DNA, 25 bp, Rattus norvegicus
tggcgctactcagagcacgtcctgc

SEQ ID NO: 460382 - DNA, 25 bp, Rattus norvegicus
ctcgggctgcagattatgaagttgc

SEQ ID NO: 460383 - DNA, 25 bp, Rattus norvegicus
cctcttctcggatgtgtctcgggct

SEQ ID NO: 460384 - DNA, 25 bp, Rattus norvegicus
gtgcgaaccacttcctcttctcgga

SEQ ID NO: 460385 - DNA, 25 bp, Rattus norvegicus
agacatgctgcttcacgctcgtgag

SEQ ID NO: 460386 - DNA, 25 bp, Rattus norvegicus
tctaagtcagaatcccgcccaggcg

SEQ ID NO: 460387 - DNA, 25 bp, Rattus norvegicus
gcgatctattgaaagtcagccctcg

SEQ ID NO: 460388 - DNA, 25 bp, Rattus norvegicus
ccctcgctgcgatctattgaaagtc

SEQ ID NO: 460389 - DNA, 25 bp, Rattus norvegicus
agctccctcgctgcgatctattgaa

SEQ ID NO: 460390 - DNA, 25 bp, Rattus norvegicus
agagcagctccctcgctgcgatcta

SEQ ID NO: 460391 - DNA, 25 bp, Rattus norvegicus
agcagagcagctccctcgctgcgat

SEQ ID NO: 460392 - DNA, 25 bp, Rattus norvegicus
tctcgcccgtcacgcttaacgcacg

SEQ ID NO: 460393 - DNA, 25 bp, Rattus norvegicus
aagctaccatctgtgggattatgac

SEQ ID NO: 460394 - DNA, 25 bp, Rattus norvegicus
gatacggcagcgccgaaggagcctc

SEQ ID NO: 460395 - DNA, 25 bp, Rattus norvegicus
tgaacgcctctaagtcagaatcccg

SEQ ID NO: 460396 - DNA, 25 bp, Rattus norvegicus
gggattatgactgaacgcctctaag

SEQ ID NO: 460397 - DNA, 25 bp, Rattus norvegicus
ctgtgggattatgactgaacgcctc

SEQ ID NO: 460398 - DNA, 25 bp, Rattus norvegicus
accatctgtgggattatgactgaac

SEQ ID NO: 460399 - DNA, 25 bp, Rattus norvegicus
gcggagagccattcgtcccgggaaa

SEQ ID NO: 460400 - DNA, 25 bp, Rattus norvegicus
cccgaacaaacttcttgcgcctttg

SEQ ID NO: 460401 - DNA, 25 bp, Rattus norvegicus
tgccgacgccaaagagctcaaagcc

SEQ ID NO: 460402 - DNA, 25 bp, Rattus norvegicus
ggaggatctctttttgccgacgcca

SEQ ID NO: 460403 - DNA, 25 bp, Rattus norvegicus
ctcccagttttgcttggtgctctca

SEQ ID NO: 460404 - DNA, 25 bp, Rattus norvegicus
agatcggccatagccacgccgttta

SEQ ID NO: 460405 - DNA, 25 bp, Rattus norvegicus
tgtccaggttactcccgactgcaga

SEQ ID NO: 460406 - DNA, 25 bp, Rattus norvegicus
caagttcggttttcgctccaggagc

SEQ ID NO: 460407 - DNA, 25 bp, Rattus norvegicus
ctggatgcgaagctcaggtaacacc

SEQ ID NO: 460408 - DNA, 25 bp, Rattus norvegicus
cggccgagagtaacttccggatcta

SEQ ID NO: 460409 - DNA, 25 bp, Rattus norvegicus
ccaaggagcagagggactcggactt

SEQ ID NO: 460410 - DNA, 25 bp, Rattus norvegicus
ctttgagcagaacctctccggggtg

SEQ ID NO: 460411 - DNA, 25 bp, Rattus norvegicus
ttcaacatgcactgcgcgccctttg

SEQ ID NO: 460412 - DNA, 25 bp, Rattus norvegicus
atatttatcagcagcgccggcacgg

SEQ ID NO: 460413 - DNA, 25 bp, Rattus norvegicus
gggctcgaaccgagttccttcaaca

SEQ ID NO: 460414 - DNA, 25 bp, Rattus norvegicus
cttagaggctaccagaggccgaacc

SEQ ID NO: 460415 - DNA, 25 bp, Rattus norvegicus
tccggcttcttaaacgcaggagcgc

SEQ ID NO: 460416 - DNA, 25 bp, Rattus norvegicus
agaaggctctaacgattgttcccaa

SEQ ID NO: 460417 - DNA, 25 bp, Rattus norvegicus
caatcgaccgttgggaagaatggtc

SEQ ID NO: 460418 - DNA, 25 bp, Rattus norvegicus
tggtcaggaccacctgagagaaccc

SEQ ID NO: 460419 - DNA, 25 bp, Rattus norvegicus
gtactagccgcagccgggataagcc

SEQ ID NO: 460420 - DNA, 25 bp, Rattus norvegicus
acggtctggtaccacccgcagaaga

SEQ ID NO: 460421 - DNA, 25 bp, Rattus norvegicus
aatcaacagccagccgcctgcaggg

SEQ ID NO: 460422 - DNA, 25 bp, Rattus norvegicus
ctgccagtagcggaggttctggtcc

SEQ ID NO: 460423 - DNA, 25 bp, Rattus norvegicus
tcctccctgccgctgtgtgagcagg

SEQ ID NO: 460424 - DNA, 25 bp, Rattus norvegicus
acacgagtgggtgaacctctgagcc

SEQ ID NO: 460425 - DNA, 25 bp, Rattus norvegicus
tcactgagctcctgccgggaacaga

SEQ ID NO: 460426 - DNA, 25 bp, Rattus norvegicus
cagagcaaacccgtgagagcagaag

SEQ ID NO: 460427 - DNA, 25 bp, Rattus norvegicus
cagaagactgactgcccggctcatc

SEQ ID NO: 460428 - DNA, 25 bp, Rattus norvegicus
gctgacaggatggacccggtcccga

SEQ ID NO: 460429 - DNA, 25 bp, Rattus norvegicus
gcgcatcgctctcacccgctggccc

SEQ ID NO: 460430 - DNA, 25 bp, Rattus norvegicus
agccgccacatcactgcgggccggg

SEQ ID NO: 460431 - DNA, 25 bp, Rattus norvegicus
gccagcaccgccaggaccagcaggc

SEQ ID NO: 460432 - DNA, 25 bp, Rattus norvegicus
tggagttcgcctgggcctccgcgct

SEQ ID NO: 460433 - DNA, 25 bp, Rattus norvegicus
ggaagctcaccgtcgctggagttcg

SEQ ID NO: 460434 - DNA, 25 bp, Rattus norvegicus
ttaagttcgggaagctcaccgtcgc

SEQ ID NO: 460435 - DNA, 25 bp, Rattus norvegicus
aggactgcccagacccgggcggcct

SEQ ID NO: 460436 - DNA, 25 bp, Rattus norvegicus
cctgaagcgcatcagcagccgggga

SEQ ID NO: 460437 - DNA, 25 bp, Rattus norvegicus
tgacaggatggacccggtcccgaac

SEQ ID NO: 460438 - DNA, 25 bp, Rattus norvegicus
cagcccaaacgaggcgctgacagga

SEQ ID NO: 460439 - DNA, 25 bp, Rattus norvegicus
gcgcgcctcctacccggaccagcgg

SEQ ID NO: 460440 - DNA, 25 bp, Rattus norvegicus
gaacccgcggcctgaagcgcatcag

SEQ ID NO: 460441 - DNA, 25 bp, Rattus norvegicus
ggttcccagcccaaacgaggcgctg

SEQ ID NO: 460442 - DNA, 25 bp, Rattus norvegicus
ctgacctaagcaggccgcagctagc

SEQ ID NO: 460443 - DNA, 25 bp, Rattus norvegicus
cctgcactaaggatgggaccggacg

SEQ ID NO: 460444 - DNA, 25 bp, Rattus norvegicus
gcgacccgccggtctctcttgagtg

SEQ ID NO: 460445 - DNA, 25 bp, Rattus norvegicus
ggtctcacggaagccacggggctaa

SEQ ID NO: 460446 - DNA, 25 bp, Rattus norvegicus
cagcctttctttcttgacgggaaga

SEQ ID NO: 460447 - DNA, 25 bp, Rattus norvegicus
tgagggctttcctctgttcgccagc

SEQ ID NO: 460448 - DNA, 25 bp, Rattus norvegicus
actcacgcaactgcaggacgctgtg

SEQ ID NO: 460449 - DNA, 25 bp, Rattus norvegicus
agaacatggcggatagactcacgca

SEQ ID NO: 460450 - DNA, 25 bp, Rattus norvegicus
taaattggccaatcgcgcgctctcg

SEQ ID NO: 460451 - DNA, 25 bp, Rattus norvegicus
ccctcaaggagggagccctatgatt

SEQ ID NO: 460452 - DNA, 25 bp, Rattus norvegicus
atcctcggccaggtatcccggaacg

SEQ ID NO: 460453 - DNA, 25 bp, Rattus norvegicus
ccgtccagcgtctccgcgaatttgg

SEQ ID NO: 460454 - DNA, 25 bp, Rattus norvegicus
gacggcttctcctgagcggagatcc

SEQ ID NO: 460455 - DNA, 25 bp, Rattus norvegicus
tggcccacagccgtcataaattggc

SEQ ID NO: 460456 - DNA, 25 bp, Rattus norvegicus
ctcagtccagcgagcctggtgcgga

SEQ ID NO: 460457 - DNA, 25 bp, Rattus norvegicus
cggcagctcgggctgaaccgcggag

SEQ ID NO: 460458 - DNA, 25 bp, Rattus norvegicus
aaggcacgctccaagcaggaggacg

SEQ ID NO: 460459 - DNA, 25 bp, Rattus norvegicus
cggaaaggcacgctccaagcaggag

SEQ ID NO: 460460 - DNA, 25 bp, Rattus norvegicus
agcctggtgcggaaaggcacgctcc

SEQ ID NO: 460461 - DNA, 25 bp, Rattus norvegicus
gcgaccaaccagttggcgctcagtc

SEQ ID NO: 460462 - DNA, 25 bp, Rattus norvegicus
acggacagcgaccaaccagttggcg

SEQ ID NO: 460463 - DNA, 25 bp, Rattus norvegicus
ctcacggacagcgaccaaccagttg

SEQ ID NO: 460464 - DNA, 25 bp, Rattus norvegicus
cctgagcgcctctcctcacggacag

SEQ ID NO: 460465 - DNA, 25 bp, Rattus norvegicus
caccgaggtcctggctggggccagg

SEQ ID NO: 460466 - DNA, 25 bp, Rattus norvegicus
cctagcggagcaccgaggtcctggc

SEQ ID NO: 460467 - DNA, 25 bp, Rattus norvegicus
ggccctagcggagcaccgaggtcct

SEQ ID NO: 460468 - DNA, 25 bp, Rattus norvegicus
accggggcacaggcgcgagttcttt

SEQ ID NO: 460469 - DNA, 25 bp, Rattus norvegicus
ggtgcggaaaggcacgctccaagca

SEQ ID NO: 460470 - DNA, 25 bp, Rattus norvegicus
ctctccggttcctttgcaaaactcg

SEQ ID NO: 460471 - DNA, 25 bp, Rattus norvegicus
ctactttctatggtgcggggtctct

SEQ ID NO: 460472 - DNA, 25 bp, Rattus norvegicus
agaaacgctgtgaagagatgggtct

SEQ ID NO: 460473 - DNA, 25 bp, Rattus norvegicus
ctccggacgcagagggcacgactcg

SEQ ID NO: 460474 - DNA, 25 bp, Rattus norvegicus
gtgcgctctccggttcctttgcaaa

SEQ ID NO: 460475 - DNA, 25 bp, Rattus norvegicus
tgcgcaccgggagcgaagccgccaa

SEQ ID NO: 460476 - DNA, 25 bp, Rattus norvegicus
ccggtcaccgatgctactttctatg

SEQ ID NO: 460477 - DNA, 25 bp, Rattus norvegicus
aaactgtgcccgagcggctgtgtcc

SEQ ID NO: 460478 - DNA, 25 bp, Rattus norvegicus
cagcagcgtcaaactgtgcccgagc

SEQ ID NO: 460479 - DNA, 25 bp, Rattus norvegicus
gacggtgcacagcagcgtcaaactg

SEQ ID NO: 460480 - DNA, 25 bp, Rattus norvegicus
cggcacaaagttgacggtgcacagc

SEQ ID NO: 460481 - DNA, 25 bp, Rattus norvegicus
agagggcacgactcgccggcacaaa

SEQ ID NO: 460482 - DNA, 25 bp, Rattus norvegicus
gctgtgtcccggtcaccgatgctac

SEQ ID NO: 460483 - DNA, 25 bp, Rattus norvegicus
gactcagtgcagagcccgtgcgctc

SEQ ID NO: 460484 - DNA, 25 bp, Rattus norvegicus
ttcgcctcaggtaagccagccgcgg

SEQ ID NO: 460485 - DNA, 25 bp, Rattus norvegicus
tcggcggcccttcgcctcaggtaag

SEQ ID NO: 460486 - DNA, 25 bp, Rattus norvegicus
aactgcaacttgtggagctcggcgg

SEQ ID NO: 460487 - DNA, 25 bp, Rattus norvegicus
aggcggaactgcaacttgtggagct

SEQ ID NO: 460488 - DNA, 25 bp, Rattus norvegicus
cagcgagccgcaggagcaaggccct

SEQ ID NO: 460489 - DNA, 25 bp, Rattus norvegicus
ggccaatcagcgagccgcaggagca

SEQ ID NO: 460490 - DNA, 25 bp, Rattus norvegicus
gctccgccaggaatgtgggagaccc

SEQ ID NO: 460491 - DNA, 25 bp, Rattus norvegicus
ggaagagcagcgaccaaccgcccgg

SEQ ID NO: 460492 - DNA, 25 bp, Rattus norvegicus
ttccgacccgggaagagcagcgacc

SEQ ID NO: 460493 - DNA, 25 bp, Rattus norvegicus
agactctgcaagtcctcagtttctc

SEQ ID NO: 460494 - DNA, 25 bp, Rattus norvegicus
gtctacctagactctgcaagtcctc

SEQ ID NO: 460495 - DNA, 25 bp, Rattus norvegicus
cgccagatgaccacgcggagctagg

SEQ ID NO: 460496 - DNA, 25 bp, Rattus norvegicus
gttgagcgccgccagatgaccacgc

SEQ ID NO: 460497 - DNA, 25 bp, Rattus norvegicus
gtccacgacacagaggcggtctttc

SEQ ID NO: 460498 - DNA, 25 bp, Rattus norvegicus
cgctgcagctaaggctgaccctata

SEQ ID NO: 460499 - DNA, 25 bp, Rattus norvegicus
ctcagcgcttgtccgttctggctcg

SEQ ID NO: 460500 - DNA, 25 bp, Rattus norvegicus
gcatttccacgagtgcgttcgctga

SEQ ID NO: 460501 - DNA, 25 bp, Rattus norvegicus
gtccttcagcatggctgccgcttcg

SEQ ID NO: 460502 - DNA, 25 bp, Rattus norvegicus
ttctggctcgccgtccttcagcatg

SEQ ID NO: 460503 - DNA, 25 bp, Rattus norvegicus
tcacctcaggggttcggggcgcact

SEQ ID NO: 460504 - DNA, 25 bp, Rattus norvegicus
agtgcgttcgctgaatccggctcac

SEQ ID NO: 460505 - DNA, 25 bp, Rattus norvegicus
tctggaggtcgccacgcatttccac

SEQ ID NO: 460506 - DNA, 25 bp, Rattus norvegicus
tcctgtgtttctctggaggtcgcca

SEQ ID NO: 460507 - DNA, 25 bp, Rattus norvegicus
tgtccgtgaccttcctcctgtgttt

SEQ ID NO: 460508 - DNA, 25 bp, Rattus norvegicus
gcgcaccttctcctcagtcgccagg

SEQ ID NO: 460509 - DNA, 25 bp, Rattus norvegicus
ggctgaccctatacccgggagcgcg

SEQ ID NO: 460510 - DNA, 25 bp, Rattus norvegicus
catggctgccgcttcgctgcagcta

SEQ ID NO: 460511 - DNA, 25 bp, Rattus norvegicus
tgaatccggctcacctcaggggttc

SEQ ID NO: 460512 - DNA, 25 bp, Rattus norvegicus
gctgtcgcatgtgcgtctgggcaac

SEQ ID NO: 460513 - DNA, 25 bp, Rattus norvegicus
gtgcagatccgcctggaagaccgct

SEQ ID NO: 460514 - DNA, 25 bp, Rattus norvegicus
gaagaccgctgctacccggtgagca

SEQ ID NO: 460515 - DNA, 25 bp, Rattus norvegicus
cccggtgagcaagagcaaattgatc

SEQ ID NO: 460516 - DNA, 25 bp, Rattus norvegicus
tgatcgaacagagcgactacttccg

SEQ ID NO: 460517 - DNA, 25 bp, Rattus norvegicus
gtgctggacttcatcaacgcgggcg

SEQ ID NO: 460518 - DNA, 25 bp, Rattus norvegicus
tgctgcgcttgctgctgtcgcatgt

SEQ ID NO: 460519 - DNA, 25 bp, Rattus norvegicus
gcccagccatgtcggccgaggagat

SEQ ID NO: 460520 - DNA, 25 bp, Rattus norvegicus
gcaactgcctggagctgtaccgcct

SEQ ID NO: 460521 - DNA, 25 bp, Rattus norvegicus
aggacgcctgcctgcgcttcatggt

SEQ ID NO: 460522 - DNA, 25 bp, Rattus norvegicus
atggtgctgcgcttccaccaggtgc

SEQ ID NO: 460523 - DNA, 25 bp, Rattus norvegicus
ggtgctgtgccagccgcaattcccg

SEQ ID NO: 460524 - DNA, 25 bp, Rattus norvegicus
gactgcagcctgaagcagaggttgc

SEQ ID NO: 460525 - DNA, 25 bp, Rattus norvegicus
cctttctgcaggtcacggcgctgct

SEQ ID NO: 460526 - DNA, 25 bp, Rattus norvegicus
tccaaccgcaggagcagtcagagcg

SEQ ID NO: 460527 - DNA, 25 bp, Rattus norvegicus
gcgaggacatgctcaccgtgcagtc

SEQ ID NO: 460528 - DNA, 25 bp, Rattus norvegicus
ctgtttgagacctgcgacgtccata

SEQ ID NO: 460529 - DNA, 25 bp, Rattus norvegicus
ttgacgtgcgcactacacaatgacg

SEQ ID NO: 460530 - DNA, 25 bp, Rattus norvegicus
tgtctccacgaactggggtccaacc

SEQ ID NO: 460531 - DNA, 25 bp, Rattus norvegicus
accatctacatcgtgggcgggtgtc

SEQ ID NO: 460532 - DNA, 25 bp, Rattus norvegicus
cgtccatatccgcaagcagcagatg

SEQ ID NO: 460533 - DNA, 25 bp, Rattus norvegicus
gctgacctctggacgctgtttgaga

SEQ ID NO: 460534 - DNA, 25 bp, Rattus norvegicus
aggcctgaacttgacgtgcgcacta

SEQ ID NO: 460535 - DNA, 25 bp, Rattus norvegicus
gagaacacgtccaaatcaggcctga

SEQ ID NO: 460536 - DNA, 25 bp, Rattus norvegicus
ggctctacctgaaggagaacacgtc

SEQ ID NO: 460537 - DNA, 25 bp, Rattus norvegicus
acggaaactcggcagtggctctacc

SEQ ID NO: 460538 - DNA, 25 bp, Rattus norvegicus
gtgcagtcctacaacacggaaactc

SEQ ID NO: 460539 - DNA, 25 bp, Rattus norvegicus
gtgtccgtggaggagaccatctaca

SEQ ID NO: 460540 - DNA, 25 bp, Rattus norvegicus
ccacttgcggcagagagcgtatata

SEQ ID NO: 460541 - DNA, 25 bp, Rattus norvegicus
ggaaggttcacacgctctgtggcca

SEQ ID NO: 460542 - DNA, 25 bp, Rattus norvegicus
tgtgagcccagccttggaaggttca

SEQ ID NO: 460543 - DNA, 25 bp, Rattus norvegicus
ttgaacaagttgcaggcgcgcgtgt

SEQ ID NO: 460544 - DNA, 25 bp, Rattus norvegicus
gaaagttgattccacaacgcccttg

SEQ ID NO: 460545 - DNA, 25 bp, Rattus norvegicus
atagctgtcggtctacctcctccgg

SEQ ID NO: 460546 - DNA, 25 bp, Rattus norvegicus
ctgtggccaacctgctgagaagtga

SEQ ID NO: 460547 - DNA, 25 bp, Rattus norvegicus
aggcctctgggtgcaaagccacttg

SEQ ID NO: 460548 - DNA, 25 bp, Rattus norvegicus
aggagtcagctgtcctgcgcaccag

SEQ ID NO: 460549 - DNA, 25 bp, Rattus norvegicus
tcttcaaacgcgagtgtcccgcagg

SEQ ID NO: 460550 - DNA, 25 bp, Rattus norvegicus
atgtctaattagtcttggcggcagc

SEQ ID NO: 460551 - DNA, 25 bp, Rattus norvegicus
gctgtggctcccatagcaatgtcta

SEQ ID NO: 460552 - DNA, 25 bp, Rattus norvegicus
acgttttacataggcgtcggggatg

SEQ ID NO: 460553 - DNA, 25 bp, Rattus norvegicus
ggctggttgcttccggaaagttgat

SEQ ID NO: 460554 - DNA, 25 bp, Rattus norvegicus
aatagtagcggcttttggccacagc

SEQ ID NO: 460555 - DNA, 25 bp, Rattus norvegicus
cgcagcacttgggaggagccgcgca

SEQ ID NO: 460556 - DNA, 25 bp, Rattus norvegicus
catgccggctcggagggcgcagcac

SEQ ID NO: 460557 - DNA, 25 bp, Rattus norvegicus
tatggcaccgcggtcggcccacagc

SEQ ID NO: 460558 - DNA, 25 bp, Rattus norvegicus
ccgcagtggcctggcgcctatggca

SEQ ID NO: 460559 - DNA, 25 bp, Rattus norvegicus
tctgcccgcttcagtccagcttccc

SEQ ID NO: 460560 - DNA, 25 bp, Rattus norvegicus
agccctcccgtctgcccgcttcagt

SEQ ID NO: 460561 - DNA, 25 bp, Rattus norvegicus
gtgaacacccagacagccctcccgt

SEQ ID NO: 460562 - DNA, 25 bp, Rattus norvegicus
gcgctgatgccgcagggcgcgccaa

SEQ ID NO: 460563 - DNA, 25 bp, Rattus norvegicus
gaaccagctgcccatgtcccgtgaa

SEQ ID NO: 460564 - DNA, 25 bp, Rattus norvegicus
tcctggactgaaccagctgcccatg

SEQ ID NO: 460565 - DNA, 25 bp, Rattus norvegicus
acccgccgtgtatgttgctcctgga

SEQ ID NO: 460566 - DNA, 25 bp, Rattus norvegicus
gcacccgccgtgtatgttgctcctg

SEQ ID NO: 460567 - DNA, 25 bp, Rattus norvegicus
gtagcggcttttggccacagccgcc

SEQ ID NO: 460568 - DNA, 25 bp, Rattus norvegicus
gtggcctctgtctgtcacacacctt

SEQ ID NO: 460569 - DNA, 25 bp, Rattus norvegicus
gcgggcctaggtggaaatcaacttc

SEQ ID NO: 460570 - DNA, 25 bp, Rattus norvegicus
tgggccactcgtagggcctaggtta

SEQ ID NO: 460571 - DNA, 25 bp, Rattus norvegicus
tcgtcctcggagacttgcacttgcg

SEQ ID NO: 460572 - DNA, 25 bp, Rattus norvegicus
gaagtgttgacccagtcgctgttcc

SEQ ID NO: 460573 - DNA, 25 bp, Rattus norvegicus
cgctggagtcctcttggagatctga

SEQ ID NO: 460574 - DNA, 25 bp, Rattus norvegicus
tggagatctgatcgcaggacacacc

SEQ ID NO: 460575 - DNA, 25 bp, Rattus norvegicus
agggagctttgcacaggagttgttc

SEQ ID NO: 460576 - DNA, 25 bp, Rattus norvegicus
gcagctctctgttggtgaggccaca

SEQ ID NO: 460577 - DNA, 25 bp, Rattus norvegicus
ctctgggctcagctaaggtccctta

SEQ ID NO: 460578 - DNA, 25 bp, Rattus norvegicus
agaggccgcccacgaattccgacgt

SEQ ID NO: 460579 - DNA, 25 bp, Rattus norvegicus
tgtgcagacactgacacatcgtccg

SEQ ID NO: 460580 - DNA, 25 bp, Rattus norvegicus
tcccgagaggaacaccttgcgaagc

SEQ ID NO: 460581 - DNA, 25 bp, Rattus norvegicus
cccacagcggcatctcgggttcttt

SEQ ID NO: 460582 - DNA, 25 bp, Rattus norvegicus
atatagagtcacgtttgggagccgg

SEQ ID NO: 460583 - DNA, 25 bp, Rattus norvegicus
gaagcaccaggtaccacaacgaaga

SEQ ID NO: 460584 - DNA, 25 bp, Rattus norvegicus
aagtcacccgcactgaagcaccagg

SEQ ID NO: 460585 - DNA, 25 bp, Rattus norvegicus
gggccgtgatcaccaacccgcaagt

SEQ ID NO: 460586 - DNA, 25 bp, Rattus norvegicus
atcatctccgggagggccgtgatca

SEQ ID NO: 460587 - DNA, 25 bp, Rattus norvegicus
gcgcccagcagcgaccaggaaggtc

SEQ ID NO: 460588 - DNA, 25 bp, Rattus norvegicus
tcaagagcctccatcatctccggga

SEQ ID NO: 460589 - DNA, 25 bp, Rattus norvegicus
ctgaacacgctagctcaagagcctc

SEQ ID NO: 460590 - DNA, 25 bp, Rattus norvegicus
agcagaggcgcggttctgaacacgc

SEQ ID NO: 460591 - DNA, 25 bp, Rattus norvegicus
agccggatatatagagtcacgtttg

SEQ ID NO: 460592 - DNA, 25 bp, Rattus norvegicus
cccagtctctgagccggatatatag

SEQ ID NO: 460593 - DNA, 25 bp, Rattus norvegicus
acacccagtctctgagccggatata

SEQ ID NO: 460594 - DNA, 25 bp, Rattus norvegicus
cggttctgaacacgctagctcaaga

SEQ ID NO: 460595 - DNA, 25 bp, Rattus norvegicus
ccaggtaccacaacgaagagcggtc

SEQ ID NO: 460596 - DNA, 25 bp, Rattus norvegicus
atcttcggattgacgcggagaccca

SEQ ID NO: 460597 - DNA, 25 bp, Rattus norvegicus
ctctctctcggcctggtttttaact

SEQ ID NO: 460598 - DNA, 25 bp, Rattus norvegicus
actcgcgatatttcctgtgttgatg

SEQ ID NO: 460599 - DNA, 25 bp, Rattus norvegicus
accgctgactgtgtccgaagggacc

SEQ ID NO: 460600 - DNA, 25 bp, Rattus norvegicus
agggcaattctcaccgctgactgtg

SEQ ID NO: 460601 - DNA, 25 bp, Rattus norvegicus
gatctcgcgagaacaagggcaattc

SEQ ID NO: 460602 - DNA, 25 bp, Rattus norvegicus
ccgggcgcacacgaagatctcgcga

SEQ ID NO: 460603 - DNA, 25 bp, Rattus norvegicus
atgtttcacagaagcccgggtcgcc

SEQ ID NO: 460604 - DNA, 25 bp, Rattus norvegicus
cagccgaccgccatgtttcacagaa

SEQ ID NO: 460605 - DNA, 25 bp, Rattus norvegicus
tcctcagagccacggagagcacagg

SEQ ID NO: 460606 - DNA, 25 bp, Rattus norvegicus
ccacgaggcatgtccctttctagga

SEQ ID NO: 460607 - DNA, 25 bp, Rattus norvegicus
acgacagcctggacgagacaacgga

SEQ ID NO: 460608 - DNA, 25 bp, Rattus norvegicus
caaacggcgcggtcaacctgaaagg

SEQ ID NO: 460609 - DNA, 25 bp, Rattus norvegicus
gaccgcaagtggagaactcgcgata

SEQ ID NO: 460610 - DNA, 25 bp, Rattus norvegicus
tccagatggcgctaggaagttccgc

SEQ ID NO: 460611 - DNA, 25 bp, Rattus norvegicus
ggtctacgacaccaagggccgcttc

SEQ ID NO: 460612 - DNA, 25 bp, Rattus norvegicus
ccgtggatctcccttcctcgaggaa

SEQ ID NO: 460613 - DNA, 25 bp, Rattus norvegicus
catcctggctcctttgacgtggtcc

SEQ ID NO: 460614 - DNA, 25 bp, Rattus norvegicus
gtttgataccggcaacctgtgcatg

SEQ ID NO: 460615 - DNA, 25 bp, Rattus norvegicus
gacaccgtgcagatctcgctagaca

SEQ ID NO: 460616 - DNA, 25 bp, Rattus norvegicus
tcttcgtgggtaccaagggcatccc

SEQ ID NO: 460617 - DNA, 25 bp, Rattus norvegicus
cccagctggcttcatggatgtcatc

SEQ ID NO: 460618 - DNA, 25 bp, Rattus norvegicus
tcagaaccgatgtggcctacccagc

SEQ ID NO: 460619 - DNA, 25 bp, Rattus norvegicus
gcatgcagcgcctcattaaggtcga

SEQ ID NO: 460620 - DNA, 25 bp, Rattus norvegicus
taggctcaagtacgctctgaccggc

SEQ ID NO: 460621 - DNA, 25 bp, Rattus norvegicus
tgctggacaaactgaccggcgtgtt

SEQ ID NO: 460622 - DNA, 25 bp, Rattus norvegicus
ggctcgcggtcccaagaaacacctg

SEQ ID NO: 460623 - DNA, 25 bp, Rattus norvegicus
tcactcgcttgtgctctgggaagga

SEQ ID NO: 460624 - DNA, 25 bp, Rattus norvegicus
gctaccaccgcggtcagcttcagtt

SEQ ID NO: 460625 - DNA, 25 bp, Rattus norvegicus
aaacgtgggtcacaggagcaatgtg

SEQ ID NO: 460626 - DNA, 25 bp, Rattus norvegicus
tggaaaacgtgggtcacaggagcaa

SEQ ID NO: 460627 - DNA, 25 bp, Rattus norvegicus
cctacataatctgccgggggtggaa

SEQ ID NO: 460628 - DNA, 25 bp, Rattus norvegicus
ccagtccctacataatctgccgggg

SEQ ID NO: 460629 - DNA, 25 bp, Rattus norvegicus
acggaccagtccctacataatctgc

SEQ ID NO: 460630 - DNA, 25 bp, Rattus norvegicus
cggcaaagcgaggaaagttgaggta

SEQ ID NO: 460631 - DNA, 25 bp, Rattus norvegicus
taagcagcccagaaggggacctgcc

SEQ ID NO: 460632 - DNA, 25 bp, Rattus norvegicus
ttgacggtgcgaggtaagcagccca

SEQ ID NO: 460633 - DNA, 25 bp, Rattus norvegicus
cggtcagcttcagttcctgccagga

SEQ ID NO: 460634 - DNA, 25 bp, Rattus norvegicus
gagcaatgtgggtgtgcgtgaaaga

SEQ ID NO: 460635 - DNA, 25 bp, Rattus norvegicus
ttgaggtagagcacggaccagtccc

SEQ ID NO: 460636 - DNA, 25 bp, Rattus norvegicus
tcagcttcagttcctgccaggagtt

SEQ ID NO: 460637 - DNA, 25 bp, Rattus norvegicus
ccctctggagggtgcccagcgaagg

SEQ ID NO: 460638 - DNA, 25 bp, Rattus norvegicus
gttagcgaagacagcccagcgcagc

SEQ ID NO: 460639 - DNA, 25 bp, Rattus norvegicus
cccagacctgggaatgcaacgcgcg

SEQ ID NO: 460640 - DNA, 25 bp, Rattus norvegicus
ggttgttcacgatcgcccacacatc

SEQ ID NO: 460641 - DNA, 25 bp, Rattus norvegicus
cggccgtagcaaaggcagctggccc

SEQ ID NO: 460642 - DNA, 25 bp, Rattus norvegicus
ctcctggatcctgggacctgaggtc

SEQ ID NO: 460643 - DNA, 25 bp, Rattus norvegicus
ggaacactcgagaaggccacccagg

SEQ ID NO: 460644 - DNA, 25 bp, Rattus norvegicus
tgttccctgcctatctcagcttcgg

SEQ ID NO: 460645 - DNA, 25 bp, Rattus norvegicus
cggccgcaagtcagcaggcttgtca

SEQ ID NO: 460646 - DNA, 25 bp, Rattus norvegicus
aggcttgtcaggtactcagtctgca

SEQ ID NO: 460647 - DNA, 25 bp, Rattus norvegicus
aggcgtgagcgattcgacaccagca

SEQ ID NO: 460648 - DNA, 25 bp, Rattus norvegicus
cgacaccagcaggacagctaaaaga

SEQ ID NO: 460649 - DNA, 25 bp, Rattus norvegicus
aaaagacaaggccagcacccgcggg

SEQ ID NO: 460650 - DNA, 25 bp, Rattus norvegicus
gcttgaagtcttccgccgtgctatc

SEQ ID NO: 460651 - DNA, 25 bp, Rattus norvegicus
ctcagcttcggaggggcagatctcc

SEQ ID NO: 460652 - DNA, 25 bp, Rattus norvegicus
ccagcccggatccaggtttcttttg

SEQ ID NO: 460653 - DNA, 25 bp, Rattus norvegicus
gtcgcgcaggactggtaaatccaaa

SEQ ID NO: 460654 - DNA, 25 bp, Rattus norvegicus
ggcccgaggcgtgaccacattaaaa

SEQ ID NO: 460655 - DNA, 25 bp, Rattus norvegicus
ggaccgcagttacggccctccataa

SEQ ID NO: 460656 - DNA, 25 bp, Rattus norvegicus
ccctcttaagcttggaccgcagtta

SEQ ID NO: 460657 - DNA, 25 bp, Rattus norvegicus
ggcatcgcggaagccctcttaagct

SEQ ID NO: 460658 - DNA, 25 bp, Rattus norvegicus
gttgactgactactcgcgacgaagg

SEQ ID NO: 460659 - DNA, 25 bp, Rattus norvegicus
tagcggaggtttgtttgtccagccc

SEQ ID NO: 460660 - DNA, 25 bp, Rattus norvegicus
gactcacagttccagaagttgactg

SEQ ID NO: 460661 - DNA, 25 bp, Rattus norvegicus
gttctgcctagatactcagcgcaca

SEQ ID NO: 460662 - DNA, 25 bp, Rattus norvegicus
cgagcccatccatcgggtggagcca

SEQ ID NO: 460663 - DNA, 25 bp, Rattus norvegicus
cataaacaacttccggtcgcgcagg

SEQ ID NO: 460664 - DNA, 25 bp, Rattus norvegicus
ccgggccaaggactaggatccagcc

SEQ ID NO: 460665 - DNA, 25 bp, Rattus norvegicus
gatccagccggacatgagtaggtga

SEQ ID NO: 460666 - DNA, 25 bp, Rattus norvegicus
ttcacctctgttctggcggagggcc

SEQ ID NO: 460667 - DNA, 25 bp, Rattus norvegicus
gtggaatttgccttccactgcctcc

SEQ ID NO: 460668 - DNA, 25 bp, Rattus norvegicus
tggcctctgcgacccagtggaattt

SEQ ID NO: 460669 - DNA, 25 bp, Rattus norvegicus
gtttctttctgtgtcggtcttccgc

SEQ ID NO: 460670 - DNA, 25 bp, Rattus norvegicus
aaggagaagcagagctttgttttgc

SEQ ID NO: 460671 - DNA, 25 bp, Rattus norvegicus
ggcttgttgcagcttcgcgttcctt

SEQ ID NO: 460672 - DNA, 25 bp, Rattus norvegicus
cccaggagcgcccaggcctgggttt

SEQ ID NO: 460673 - DNA, 25 bp, Rattus norvegicus
actaggacctcagcccgggcgctgg

SEQ ID NO: 460674 - DNA, 25 bp, Rattus norvegicus
ctctacgctcgtctgaggcctcgtt

SEQ ID NO: 460675 - DNA, 25 bp, Rattus norvegicus
cctcgttcggtgctattggcttgta

SEQ ID NO: 460676 - DNA, 25 bp, Rattus norvegicus
attggcttgtaagcgctcgccgtgc

SEQ ID NO: 460677 - DNA, 25 bp, Rattus norvegicus
ttgttctgcgccctggactcggggc

SEQ ID NO: 460678 - DNA, 25 bp, Rattus norvegicus
ggctgggtttcgttcacctctgttc

SEQ ID NO: 460679 - DNA, 25 bp, Rattus norvegicus
cagcttcgcgttccttccggtttcg

SEQ ID NO: 460680 - DNA, 25 bp, Rattus norvegicus
tacgtgagctcctgcagaaacccaa

SEQ ID NO: 460681 - DNA, 25 bp, Rattus norvegicus
gagcaggaagcacggctgcgtaaca

SEQ ID NO: 460682 - DNA, 25 bp, Rattus norvegicus
gcacggctgcgtaacatctgcatcg

SEQ ID NO: 460683 - DNA, 25 bp, Rattus norvegicus
atctgcatcgccactgctgaaaagg

SEQ ID NO: 460684 - DNA, 25 bp, Rattus norvegicus
tgctgaaaaggtgggccgctccaac

SEQ ID NO: 460685 - DNA, 25 bp, Rattus norvegicus
tacgacagcgtgatacgtgagctcc

SEQ ID NO: 460686 - DNA, 25 bp, Rattus norvegicus
gcagaaacccaatgcgcgggtcgtg

SEQ ID NO: 460687 - DNA, 25 bp, Rattus norvegicus
atgcgcgggtcgtggtcctgttcat

SEQ ID NO: 460688 - DNA, 25 bp, Rattus norvegicus
tgaatgcctccttcacctgggtggc

SEQ ID NO: 460689 - DNA, 25 bp, Rattus norvegicus
tcgcggcagccaaccgcgtgaatgc

SEQ ID NO: 460690 - DNA, 25 bp, Rattus norvegicus
tcacgagagctgatcgcggcagcca

SEQ ID NO: 460691 - DNA, 25 bp, Rattus norvegicus
tgcgcagtgacgactcacgagagct

SEQ ID NO: 460692 - DNA, 25 bp, Rattus norvegicus
cctgttcatgcgcagtgacgactca

SEQ ID NO: 460693 - DNA, 25 bp, Rattus norvegicus
aacatccgcaagtcctacgacagcg

SEQ ID NO: 460694 - DNA, 25 bp, Rattus norvegicus
tccaagtggagacccggtgctgctc

SEQ ID NO: 460695 - DNA, 25 bp, Rattus norvegicus
cgcaggagccttgcgacaagataga

SEQ ID NO: 460696 - DNA, 25 bp, Rattus norvegicus
ggtcttggctcctctcggctcagct

SEQ ID NO: 460697 - DNA, 25 bp, Rattus norvegicus
acgaggacggtggtcttggctcctc

SEQ ID NO: 460698 - DNA, 25 bp, Rattus norvegicus
gcctcagggcgagcagcagcatcac

SEQ ID NO: 460699 - DNA, 25 bp, Rattus norvegicus
cagactgcctggcagccagcgagcg

SEQ ID NO: 460700 - DNA, 25 bp, Rattus norvegicus
ctcggctcagctcaactgggctgta

SEQ ID NO: 460701 - DNA, 25 bp, Rattus norvegicus
ctcagctcaactgggctgtatcctc

SEQ ID NO: 460702 - DNA, 25 bp, Rattus norvegicus
tgtatcctcccactgacagctcggc

SEQ ID NO: 460703 - DNA, 25 bp, Rattus norvegicus
cgtgctcccgtcacgccaagaggga

SEQ ID NO: 460704 - DNA, 25 bp, Rattus norvegicus
gagcggtggcactgccaaccgcgca

SEQ ID NO: 460705 - DNA, 25 bp, Rattus norvegicus
tgccaaccgcgcaggagccttgcga

SEQ ID NO: 460706 - DNA, 25 bp, Rattus norvegicus
acaagatagagggagtcgtcagaga

SEQ ID NO: 460707 - DNA, 25 bp, Rattus norvegicus
agcagcaaatccaggcggggctcca

SEQ ID NO: 460708 - DNA, 25 bp, Rattus norvegicus
tcagagttcgcctcttctacccggg

SEQ ID NO: 460709 - DNA, 25 bp, Rattus norvegicus
ccgctggactttccctacttagtcg

SEQ ID NO: 460710 - DNA, 25 bp, Rattus norvegicus
tgcaacccactcctcgtgggcggtg

SEQ ID NO: 460711 - DNA, 25 bp, Rattus norvegicus
cggtttacgtgattgttgcggcctc

SEQ ID NO: 460712 - DNA, 25 bp, Rattus norvegicus
ggcttgacacatcacccgctggact

SEQ ID NO: 460713 - DNA, 25 bp, Rattus norvegicus
tgggtccaaataagtcagccgtgtc

SEQ ID NO: 460714 - DNA, 25 bp, Rattus norvegicus
gcctgagtaatttaaccactgggtc

SEQ ID NO: 460715 - DNA, 25 bp, Rattus norvegicus
cacggaaccacctgctgtgggctga

SEQ ID NO: 460716 - DNA, 25 bp, Rattus norvegicus
actctgcatgtgtgtgattgactac

SEQ ID NO: 460717 - DNA, 25 bp, Rattus norvegicus
gagccatttctcagcactctgcatg

SEQ ID NO: 460718 - DNA, 25 bp, Rattus norvegicus
tccagggagatcacgcccatctgct

SEQ ID NO: 460719 - DNA, 25 bp, Rattus norvegicus
gatgcgtctccctgccgtcaatcat

SEQ ID NO: 460720 - DNA, 25 bp, Rattus norvegicus
cgcgtcgttcccaggagacatcctg

SEQ ID NO: 460721 - DNA, 25 bp, Rattus norvegicus
aagctcccacggtggtcctagcgcg

SEQ ID NO: 460722 - DNA, 25 bp, Rattus norvegicus
ttcgtgcaacagtgagtgtgacttc

SEQ ID NO: 460723 - DNA, 25 bp, Rattus norvegicus
caacaaatcataaacccggcggagc

SEQ ID NO: 460724 - DNA, 25 bp, Rattus norvegicus
acccgtggatgcagcgcatgaattc

SEQ ID NO: 460725 - DNA, 25 bp, Rattus norvegicus
agcagaagtgctccacgcccgtcta

SEQ ID NO: 460726 - DNA, 25 bp, Rattus norvegicus
ctgcgcacaggacaagagcgtgttc

SEQ ID NO: 460727 - DNA, 25 bp, Rattus norvegicus
cgcaagtccgactgcgcacaggaca

SEQ ID NO: 460728 - DNA, 25 bp, Rattus norvegicus
gcgcctgccttctaccgggagaagg

SEQ ID NO: 460729 - DNA, 25 bp, Rattus norvegicus
gcggcgctcggactataaaacacaa

SEQ ID NO: 460730 - DNA, 25 bp, Rattus norvegicus
ggctttgcggcgtcctcctattacc

SEQ ID NO: 460731 - DNA, 25 bp, Rattus norvegicus
gacccggccaggacaagggctttgc

SEQ ID NO: 460732 - DNA, 25 bp, Rattus norvegicus
tatgcggacccgctgcggcactatc

SEQ ID NO: 460733 - DNA, 25 bp, Rattus norvegicus
agctgccgctctactcgtctggcta

SEQ ID NO: 460734 - DNA, 25 bp, Rattus norvegicus
ttcctatttcgtgaactccaccttc

SEQ ID NO: 460735 - DNA, 25 bp, Rattus norvegicus
tgagtgtgacttcccgctgtcccac

SEQ ID NO: 460736 - DNA, 25 bp, Rattus norvegicus
caacccatcagcttgtcgacgcaga

SEQ ID NO: 460737 - DNA, 25 bp, Rattus norvegicus
gattcgcggtcgactaagccctcta

SEQ ID NO: 460738 - DNA, 25 bp, Rattus norvegicus
ctagctttgctggattcgcggtcga

SEQ ID NO: 460739 - DNA, 25 bp, Rattus norvegicus
cggcagagcttccagcctagctttg

SEQ ID NO: 460740 - DNA, 25 bp, Rattus norvegicus
ggctggaaccatcgagcgatcgctg

SEQ ID NO: 460741 - DNA, 25 bp, Rattus norvegicus
gagtccggtcttcgtctagccgccg

SEQ ID NO: 460742 - DNA, 25 bp, Rattus norvegicus
taagtgcgatggaaccttcaggtcc

SEQ ID NO: 460743 - DNA, 25 bp, Rattus norvegicus
cccaaaacaggaagtaagtgcgatg

SEQ ID NO: 460744 - DNA, 25 bp, Rattus norvegicus
tttggagcctccatcctggttcttc

SEQ ID NO: 460745 - DNA, 25 bp, Rattus norvegicus
tcgacgcagacggaagtgacgttca

SEQ ID NO: 460746 - DNA, 25 bp, Rattus norvegicus
accgtattgcttgctgagaatggcg

SEQ ID NO: 460747 - DNA, 25 bp, Rattus norvegicus
aagccctctacgctgcctgggcgtg

SEQ ID NO: 460748 - DNA, 25 bp, Rattus norvegicus
aatggcggtcgactccgcagcaacc

SEQ ID NO: 460749 - DNA, 25 bp, Rattus norvegicus
ccatcctggtattttttggagcctc

SEQ ID NO: 460750 - DNA, 25 bp, Rattus norvegicus
ctcttggcaattagcggctgcgcga

SEQ ID NO: 460751 - DNA, 25 bp, Rattus norvegicus
atgcaggtagcccaagccgggttcc

SEQ ID NO: 460752 - DNA, 25 bp, Rattus norvegicus
ccgtttctccgcctcttggcaatta

SEQ ID NO: 460753 - DNA, 25 bp, Rattus norvegicus
gctttatttacagaggtgcgggtcc

SEQ ID NO: 460754 - DNA, 25 bp, Rattus norvegicus
cgcctcggctgcagagctttattta

SEQ ID NO: 460755 - DNA, 25 bp, Rattus norvegicus
caggcagccaatcccacgggcagag

SEQ ID NO: 460756 - DNA, 25 bp, Rattus norvegicus
ggccactgtcgcaaactggtcgggc

SEQ ID NO: 460757 - DNA, 25 bp, Rattus norvegicus
agaaagtttgcctgacgcgagtccc

SEQ ID NO: 460758 - DNA, 25 bp, Rattus norvegicus
aaggaaacaaacagcgcttggccgc

SEQ ID NO: 460759 - DNA, 25 bp, Rattus norvegicus
aatcccgacgggacgactgtcactc

SEQ ID NO: 460760 - DNA, 25 bp, Rattus norvegicus
agtccgcatcagctcgcgaagtccg

SEQ ID NO: 460761 - DNA, 25 bp, Rattus norvegicus
agccgctcaaaagcgagtccgcatc

SEQ ID NO: 460762 - DNA, 25 bp, Rattus norvegicus
ctagctcggctgagagctccgcatc

SEQ ID NO: 460763 - DNA, 25 bp, Rattus norvegicus
cgggttccgaagacagcctcgaatt

SEQ ID NO: 460764 - DNA, 25 bp, Rattus norvegicus
tcgcggggcagcctccaaccgagga

SEQ ID NO: 460765 - DNA, 25 bp, Rattus norvegicus
tggaaaaccggctttaatgtgccta

SEQ ID NO: 460766 - DNA, 25 bp, Rattus norvegicus
tctcgtgcggcttcttggtgcgcgc

SEQ ID NO: 460767 - DNA, 25 bp, Rattus norvegicus
ctctgtcagaatgagggctggtctc

SEQ ID NO: 460768 - DNA, 25 bp, Rattus norvegicus
ccaggagcctttaaaagggctcact

SEQ ID NO: 460769 - DNA, 25 bp, Rattus norvegicus
gccgctccagagagaaccaatggtg

SEQ ID NO: 460770 - DNA, 25 bp, Rattus norvegicus
tgcacctatgggaacaaagccgctc

SEQ ID NO: 460771 - DNA, 25 bp, Rattus norvegicus
ccgcacgtcattcttctagaaggga

SEQ ID NO: 460772 - DNA, 25 bp, Rattus norvegicus
ggcctaaccgcacgtcattcttcta

SEQ ID NO: 460773 - DNA, 25 bp, Rattus norvegicus
gctgcttccctaggggcgccgcagt

SEQ ID NO: 460774 - DNA, 25 bp, Rattus norvegicus
cttctctcaggatggcagcccgcgg

SEQ ID NO: 460775 - DNA, 25 bp, Rattus norvegicus
tgacctgcggccttctctcaggatg

SEQ ID NO: 460776 - DNA, 25 bp, Rattus norvegicus
ccggctttaatgtgcctaatccgca

SEQ ID NO: 460777 - DNA, 25 bp, Rattus norvegicus
gcaagcctagcacacctgtgacctg

SEQ ID NO: 460778 - DNA, 25 bp, Rattus norvegicus
cgtgatgctcacctctcgtgaagct

SEQ ID NO: 460779 - DNA, 25 bp, Rattus norvegicus
ctcgtgaagctcacctctcgtgatg

SEQ ID NO: 460780 - DNA, 25 bp, Rattus norvegicus
gtgaagcccacctctcgtgaagctc

SEQ ID NO: 460781 - DNA, 25 bp, Rattus norvegicus
tcgtgatgctcacctctcgtgaagc

SEQ ID NO: 460782 - DNA, 25 bp, Rattus norvegicus
gtgaagctcacctctcgtgaagctc

SEQ ID NO: 460783 - DNA, 25 bp, Rattus norvegicus
tcgtgaagctcacctctcgtgatgc

SEQ ID NO: 460784 - DNA, 25 bp, Rattus norvegicus
gtgaagctcacctctcgtgatgctc

SEQ ID NO: 460785 - DNA, 25 bp, Rattus norvegicus
tcgtgaagcccacctctcgtgaagc

SEQ ID NO: 460786 - DNA, 25 bp, Rattus norvegicus
cgtgaagcccacctctcgtgaagct

SEQ ID NO: 460787 - DNA, 25 bp, Rattus norvegicus
tcgtgaagctcacctctcgtgaagc

SEQ ID NO: 460788 - DNA, 25 bp, Rattus norvegicus
cgtgaagctcacctctcgtgaagcc

SEQ ID NO: 460789 - DNA, 25 bp, Rattus norvegicus
tctcgtgaagcccacctctcgtgaa

SEQ ID NO: 460790 - DNA, 25 bp, Rattus norvegicus
ctcgtgaagcccacctctcgtgaag

SEQ ID NO: 460791 - DNA, 25 bp, Rattus norvegicus
gtgatgctcacctctcgtgaagctc

SEQ ID NO: 460792 - DNA, 25 bp, Rattus norvegicus
gcgtcgctggcgctagacgcgtgtg

SEQ ID NO: 460793 - DNA, 25 bp, Rattus norvegicus
tgaagttcaggtgagggaggacgcg

SEQ ID NO: 460794 - DNA, 25 bp, Rattus norvegicus
aacacgcgcgtgaagttcaggtgag

SEQ ID NO: 460795 - DNA, 25 bp, Rattus norvegicus
ccaacacgcgcgtgaagttcaggtg

SEQ ID NO: 460796 - DNA, 25 bp, Rattus norvegicus
ctgtggccaacacgcgcgtgaagtt

SEQ ID NO: 460797 - DNA, 25 bp, Rattus norvegicus
ggacgagccgcagcgagcaaagtcc

SEQ ID NO: 460798 - DNA, 25 bp, Rattus norvegicus
accagctgtggccaacacgcgcgtg

SEQ ID NO: 460799 - DNA, 25 bp, Rattus norvegicus
aggtctgcacgccaccagctgtggc

SEQ ID NO: 460800 - DNA, 25 bp, Rattus norvegicus
aaagtccaggtctgcacgccaccag

SEQ ID NO: 460801 - DNA, 25 bp, Rattus norvegicus
gagcaaagtccaggtctgcacgcca

SEQ ID NO: 460802 - DNA, 25 bp, Rattus norvegicus
cagcgagcaaagtccaggtctgcac

SEQ ID NO: 460803 - DNA, 25 bp, Rattus norvegicus
gccgcagcgagcaaagtccaggtct

SEQ ID NO: 460804 - DNA, 25 bp, Rattus norvegicus
cttgcgggagctctcctgcgggccc

SEQ ID NO: 460805 - DNA, 25 bp, Rattus norvegicus
gcgctggggcctgcagagccagcgg

SEQ ID NO: 460806 - DNA, 25 bp, Rattus norvegicus
cccaaaccagaagggcgagatgctc

SEQ ID NO: 460807 - DNA, 25 bp, Rattus norvegicus
gacactctagcaaggcgggcgcaac

SEQ ID NO: 460808 - DNA, 25 bp, Rattus norvegicus
tggggccctgaagccgaactagaac

SEQ ID NO: 460809 - DNA, 25 bp, Rattus norvegicus
gcacagccggactgcattcagctca

SEQ ID NO: 460810 - DNA, 25 bp, Rattus norvegicus
ttcagctcagcttcgcgctactgca

SEQ ID NO: 460811 - DNA, 25 bp, Rattus norvegicus
tgcactcagccactacccgggttag

SEQ ID NO: 460812 - DNA, 25 bp, Rattus norvegicus
ggaacgcgagcagaaaatccgatta

SEQ ID NO: 460813 - DNA, 25 bp, Rattus norvegicus
ttgcagtcccggctacagcagcttc

SEQ ID NO: 460814 - DNA, 25 bp, Rattus norvegicus
agattggcctaggtccagagatgta

SEQ ID NO: 460815 - DNA, 25 bp, Rattus norvegicus
gctcagcctgctttttaccgaagtc

SEQ ID NO: 460816 - DNA, 25 bp, Rattus norvegicus
taccgaagtcttaggcgcttggcgc

SEQ ID NO: 460817 - DNA, 25 bp, Rattus norvegicus
gcttggcgctgtgttctttcttccc

SEQ ID NO: 460818 - DNA, 25 bp, Rattus norvegicus
gtcgatcagcactccgacactctag

SEQ ID NO: 460819 - DNA, 25 bp, Rattus norvegicus
atccgattagctctttgcagtcccg

SEQ ID NO: 460820 - DNA, 25 bp, Rattus norvegicus
gagactcttcttcagggccggggaa

SEQ ID NO: 460821 - DNA, 25 bp, Rattus norvegicus
gtcctcgccgcccaagcggtagatg

SEQ ID NO: 460822 - DNA, 25 bp, Rattus norvegicus
ggcagctgcgaacttacctgcccga

SEQ ID NO: 460823 - DNA, 25 bp, Rattus norvegicus
gcgctccaggaagcggtttccgtcc

SEQ ID NO: 460824 - DNA, 25 bp, Rattus norvegicus
ttctctcagtgaggcgtctccttgc

SEQ ID NO: 460825 - DNA, 25 bp, Rattus norvegicus
tctccttgcagccaggcaggcagga

SEQ ID NO: 460826 - DNA, 25 bp, Rattus norvegicus
cccggacccatctgggaaggacgca

SEQ ID NO: 460827 - DNA, 25 bp, Rattus norvegicus
tggaccagcgctttcgagagcatct

SEQ ID NO: 460828 - DNA, 25 bp, Rattus norvegicus
tcgagagcatctccgggcccagaaa

SEQ ID NO: 460829 - DNA, 25 bp, Rattus norvegicus
ctcggggctccaaagagtcctggaa

SEQ ID NO: 460830 - DNA, 25 bp, Rattus norvegicus
cgctgcctcagtgctgcattgtgcc

SEQ ID NO: 460831 - DNA, 25 bp, Rattus norvegicus
ccaggctgtagctaagtggcttcta

SEQ ID NO: 460832 - DNA, 25 bp, Rattus norvegicus
cgcaccggagtatctgggaaatgta

SEQ ID NO: 460833 - DNA, 25 bp, Rattus norvegicus
tgctcgtgctgagtttcgtcctcgc

SEQ ID NO: 460834 - DNA, 25 bp, Rattus norvegicus
ctttgctgtggatcctcatggtctc

SEQ ID NO: 460835 - DNA, 25 bp, Rattus norvegicus
ttgcggtcatcaccttctaggtttg

SEQ ID NO: 460836 - DNA, 25 bp, Rattus norvegicus
ttgctggaaccacggccttgcagtt

SEQ ID NO: 460837 - DNA, 25 bp, Rattus norvegicus
ttgcagttgcctcgccaccaggtac

SEQ ID NO: 460838 - DNA, 25 bp, Rattus norvegicus
tggacgcagttagcctcggaggctt

SEQ ID NO: 460839 - DNA, 25 bp, Rattus norvegicus
caggtactcccattaacccggtgtg

SEQ ID NO: 460840 - DNA, 25 bp, Rattus norvegicus
tctctagaatctaccgtggaaccgg

SEQ ID NO: 460841 - DNA, 25 bp, Rattus norvegicus
agctgcggcggttaaagatttgaaa

SEQ ID NO: 460842 - DNA, 25 bp, Rattus norvegicus
atggcagccaccaagcacctacatg

SEQ ID NO: 460843 - DNA, 25 bp, Rattus norvegicus
tccataccagggagaggtgctttgc

SEQ ID NO: 460844 - DNA, 25 bp, Rattus norvegicus
gtctcgaggttcatggcagccacca

SEQ ID NO: 460845 - DNA, 25 bp, Rattus norvegicus
tcgggcaggaagactctctagaatc

SEQ ID NO: 460846 - DNA, 25 bp, Rattus norvegicus
cggaggcttcagcacattgcggtca

SEQ ID NO: 460847 - DNA, 25 bp, Rattus norvegicus
atggagaccaacaccgaacgccttc

SEQ ID NO: 460848 - DNA, 25 bp, Rattus norvegicus
agccactgtgggcagcgagagccac

SEQ ID NO: 460849 - DNA, 25 bp, Rattus norvegicus
cgccgcctcgtcagagcagcatgtg

SEQ ID NO: 460850 - DNA, 25 bp, Rattus norvegicus
aagcacatcttcagcccgcctttga

SEQ ID NO: 460851 - DNA, 25 bp, Rattus norvegicus
tgtggacccaggaagttgtccttta

SEQ ID NO: 460852 - DNA, 25 bp, Rattus norvegicus
cggaggactccgattcccttgtgga

SEQ ID NO: 460853 - DNA, 25 bp, Rattus norvegicus
cgtctgctcccagagcgacggcagg

SEQ ID NO: 460854 - DNA, 25 bp, Rattus norvegicus
aaaatgccgacttgtacctgaggtc

SEQ ID NO: 460855 - DNA, 25 bp, Rattus norvegicus
ctcggtgactggaaaatgccgactt

SEQ ID NO: 460856 - DNA, 25 bp, Rattus norvegicus
gcctcagtccgagcagccactgtgg

SEQ ID NO: 460857 - DNA, 25 bp, Rattus norvegicus
tgcatcccgggttccgcagactgca

SEQ ID NO: 460858 - DNA, 25 bp, Rattus norvegicus
tgcacaggctgcatcggctgcatcc

SEQ ID NO: 460859 - DNA, 25 bp, Rattus norvegicus
aggaacagcacgctccctgcacagg

SEQ ID NO: 460860 - DNA, 25 bp, Rattus norvegicus
ctcttgggcactcggaggaacagca

SEQ ID NO: 460861 - DNA, 25 bp, Rattus norvegicus
ccctaagtgttctgggctgctgccg

SEQ ID NO: 460862 - DNA, 25 bp, Rattus norvegicus
gaaggattcgccgccagcgatgccc

SEQ ID NO: 460863 - DNA, 25 bp, Rattus norvegicus
ttccgcgggccctagggaatctgct

SEQ ID NO: 460864 - DNA, 25 bp, Rattus norvegicus
agtctcgttcacaggccacttgctc

SEQ ID NO: 460865 - DNA, 25 bp, Rattus norvegicus
ccgagtctcgttcacaggccacttg

SEQ ID NO: 460866 - DNA, 25 bp, Rattus norvegicus
tgagtccgagtctcgttcacaggcc

SEQ ID NO: 460867 - DNA, 25 bp, Rattus norvegicus
acgaagaaactggtgagtccgagtc

SEQ ID NO: 460868 - DNA, 25 bp, Rattus norvegicus
tcccacgaagaaactggtgagtccg

SEQ ID NO: 460869 - DNA, 25 bp, Rattus norvegicus
tcgggtcccacgaagaaactggtga

SEQ ID NO: 460870 - DNA, 25 bp, Rattus norvegicus
aaaaatcagactccgcgtgggactg

SEQ ID NO: 460871 - DNA, 25 bp, Rattus norvegicus
ccgaaaaatcagactccgcgtggga

SEQ ID NO: 460872 - DNA, 25 bp, Rattus norvegicus
gcgctccgcaccgaaaaatcagact

SEQ ID NO: 460873 - DNA, 25 bp, Rattus norvegicus
gctgcgctccgcaccgaaaaatcag

SEQ ID NO: 460874 - DNA, 25 bp, Rattus norvegicus
ccctcgcgaccgtaggtgtgagcag

SEQ ID NO: 460875 - DNA, 25 bp, Rattus norvegicus
agtgctcccggcagcgcagctctag

SEQ ID NO: 460876 - DNA, 25 bp, Rattus norvegicus
agagatcgcgcacgccctgtgcctg

SEQ ID NO: 460877 - DNA, 25 bp, Rattus norvegicus
caatcgctacctgacccgccggcgg

SEQ ID NO: 460878 - DNA, 25 bp, Rattus norvegicus
ctgacccgccggcggcgcatagaga

SEQ ID NO: 460879 - DNA, 25 bp, Rattus norvegicus
atagagatcgcgcacgccctgtgcc

SEQ ID NO: 460880 - DNA, 25 bp, Rattus norvegicus
aggagagcaaactgctcagtgcgtc

SEQ ID NO: 460881 - DNA, 25 bp, Rattus norvegicus
aaactgctcagtgcgtctcagctca

SEQ ID NO: 460882 - DNA, 25 bp, Rattus norvegicus
tgctcagtgcgtctcagctcagtgc

SEQ ID NO: 460883 - DNA, 25 bp, Rattus norvegicus
cagtgcgtctcagctcagtgcggag

SEQ ID NO: 460884 - DNA, 25 bp, Rattus norvegicus
aggaggaagaaaagccggccgagtg

SEQ ID NO: 460885 - DNA, 25 bp, Rattus norvegicus
ccggccgagtgaaggtgctgccaag

SEQ ID NO: 460886 - DNA, 25 bp, Rattus norvegicus
ctagggcacccgaaagccccagaag

SEQ ID NO: 460887 - DNA, 25 bp, Rattus norvegicus
ggggacttgctgtccagcgcaagac

SEQ ID NO: 460888 - DNA, 25 bp, Rattus norvegicus
acttgctgtccagcgcaagacgggc

SEQ ID NO: 460889 - DNA, 25 bp, Rattus norvegicus
gcgcatagagatcgcgcacgccctg

SEQ ID NO: 460890 - DNA, 25 bp, Rattus norvegicus
gtgtgtaaacgtgggcaggatccac

SEQ ID NO: 460891 - DNA, 25 bp, Rattus norvegicus
gggcaggatccacgtagggctgctc

SEQ ID NO: 460892 - DNA, 25 bp, Rattus norvegicus
gtctcggaggcagtggtgtgtaaac

SEQ ID NO: 460893 - DNA, 25 bp, Rattus norvegicus
ggtctccgcaagaccgcgcgcaggc

SEQ ID NO: 460894 - DNA, 25 bp, Rattus norvegicus
gcccttggcgcgagggagccacggc

SEQ ID NO: 460895 - DNA, 25 bp, Rattus norvegicus
cagcgggcactgtgcgttagccgca

SEQ ID NO: 460896 - DNA, 25 bp, Rattus norvegicus
gggcactgtgcgttagccgcatcct

SEQ ID NO: 460897 - DNA, 25 bp, Rattus norvegicus
cactgtgcgttagccgcatcctttc

SEQ ID NO: 460898 - DNA, 25 bp, Rattus norvegicus
cgcatcctttctcccggactcgggg

SEQ ID NO: 460899 - DNA, 25 bp, Rattus norvegicus
gggagggcgtccgtcgcacccattc

SEQ ID NO: 460900 - DNA, 25 bp, Rattus norvegicus
ggcgtccgtcgcacccattccgccc

SEQ ID NO: 460901 - DNA, 25 bp, Rattus norvegicus
gagcactccgtaggcccgggagctc

SEQ ID NO: 460902 - DNA, 25 bp, Rattus norvegicus
taaacgtgggcaggatccacgtagg

SEQ ID NO: 460903 - DNA, 25 bp, Rattus norvegicus
gctcctacgggggtctccgcaagac

SEQ ID NO: 460904 - DNA, 25 bp, Rattus norvegicus
ccctagcaacgctcgggcttgtgtt

SEQ ID NO: 460905 - DNA, 25 bp, Rattus norvegicus
agcgtgttttctcccagggctcgtg

SEQ ID NO: 460906 - DNA, 25 bp, Rattus norvegicus
cctagctcagattgcgcagcgtgtt

SEQ ID NO: 460907 - DNA, 25 bp, Rattus norvegicus
ggtctttctcctccctagctcagat

SEQ ID NO: 460908 - DNA, 25 bp, Rattus norvegicus
gtgtcacgaccggactttcagggtc

SEQ ID NO: 460909 - DNA, 25 bp, Rattus norvegicus
ttggatatccgctatgttgctgtgg

SEQ ID NO: 460910 - DNA, 25 bp, Rattus norvegicus
taacagctgttggatatccgctatg

SEQ ID NO: 460911 - DNA, 25 bp, Rattus norvegicus
attctggggacagtaacagctgttg

SEQ ID NO: 460912 - DNA, 25 bp, Rattus norvegicus
tgccttggtcattctggggacagta

SEQ ID NO: 460913 - DNA, 25 bp, Rattus norvegicus
acgctcgggcttgtgttagcaactg

SEQ ID NO: 460914 - DNA, 25 bp, Rattus norvegicus
tttggctctcccagcttccgtaggc

SEQ ID NO: 460915 - DNA, 25 bp, Rattus norvegicus
tgcacacccgtagaacctcctttgg

SEQ ID NO: 460916 - DNA, 25 bp, Rattus norvegicus
cggcaggacgaagaccggcagtccc

SEQ ID NO: 460917 - DNA, 25 bp, Rattus norvegicus
ttgtgttagcaactggagcgcgctg

SEQ ID NO: 460918 - DNA, 25 bp, Rattus norvegicus
aggacaggaggttacccgcagtctc

SEQ ID NO: 460919 - DNA, 25 bp, Rattus norvegicus
agggcaggacctcgctccttttcta

SEQ ID NO: 460920 - DNA, 25 bp, Rattus norvegicus
ggacctcgctccttttctagggaca

SEQ ID NO: 460921 - DNA, 25 bp, Rattus norvegicus
tccttttctagggacagagcaagcc

SEQ ID NO: 460922 - DNA, 25 bp, Rattus norvegicus
tttctagggacagagcaagccggca

SEQ ID NO: 460923 - DNA, 25 bp, Rattus norvegicus
tctggagacagcagggcaggacctc

SEQ ID NO: 460924 - DNA, 25 bp, Rattus norvegicus
ggttctgctcctggcgccgctctgg

SEQ ID NO: 460925 - DNA, 25 bp, Rattus norvegicus
ttgtgctacgctggcggttctgctc

SEQ ID NO: 460926 - DNA, 25 bp, Rattus norvegicus
gaccctttgtgctacgctggcggtt

SEQ ID NO: 460927 - DNA, 25 bp, Rattus norvegicus
tgacgaaggtgctgcgagacccgtt

SEQ ID NO: 460928 - DNA, 25 bp, Rattus norvegicus
gggcgtcccacttcaggaagcagaa

SEQ ID NO: 460929 - DNA, 25 bp, Rattus norvegicus
cagtctcggggcgtcccacttcagg

SEQ ID NO: 460930 - DNA, 25 bp, Rattus norvegicus
cccaaatgcctctggctggaggaca

SEQ ID NO: 460931 - DNA, 25 bp, Rattus norvegicus
tagtaccgtacccaaatgcctctgg

SEQ ID NO: 460932 - DNA, 25 bp, Rattus norvegicus
agctgcgagttgctattttcgaccc

SEQ ID NO: 460933 - DNA, 25 bp, Rattus norvegicus
tcacgccattggctgtgcgcaagcc

SEQ ID NO: 460934 - DNA, 25 bp, Rattus norvegicus
gagcgtgcggggcactcacgccatt

SEQ ID NO: 460935 - DNA, 25 bp, Rattus norvegicus
ctgacggagatggttgtgtaacgct

SEQ ID NO: 460936 - DNA, 25 bp, Rattus norvegicus
cgtgccttcagaggagtgtggaaat

SEQ ID NO: 460937 - DNA, 25 bp, Rattus norvegicus
tacagcgttgaaaacgttttcgtgc

SEQ ID NO: 460938 - DNA, 25 bp, Rattus norvegicus
ctgaggaggtatttggtacagcgtt

SEQ ID NO: 460939 - DNA, 25 bp, Rattus norvegicus
taaatgttgcccacacgggtggatg

SEQ ID NO: 460940 - DNA, 25 bp, Rattus norvegicus
gcggcgagtcggcattttaaatgtt

SEQ ID NO: 460941 - DNA, 25 bp, Rattus norvegicus
ttgaaggtgttgcatgaaacggcga

SEQ ID NO: 460942 - DNA, 25 bp, Rattus norvegicus
cccatttcggagtattttgcaagta

SEQ ID NO: 460943 - DNA, 25 bp, Rattus norvegicus
tggtcaggaacgctcccatttcgga

SEQ ID NO: 460944 - DNA, 25 bp, Rattus norvegicus
gggcggcttcgccagaacgcacttc

SEQ ID NO: 460945 - DNA, 25 bp, Rattus norvegicus
tgtaacgctgacctgcttgagctcc

SEQ ID NO: 460946 - DNA, 25 bp, Rattus norvegicus
gcatttcctccgtgtcccgaagtcg

SEQ ID NO: 460947 - DNA, 25 bp, Rattus norvegicus
cgaacaccgacatggttgctgctcg

SEQ ID NO: 460948 - DNA, 25 bp, Rattus norvegicus
cgcgcttatttttggtgccgtgctt

SEQ ID NO: 460949 - DNA, 25 bp, Rattus norvegicus
ttttggtgccgtgcttcttggcagc

SEQ ID NO: 460950 - DNA, 25 bp, Rattus norvegicus
cgtgcttcttggcagccgtcagctc

SEQ ID NO: 460951 - DNA, 25 bp, Rattus norvegicus
gtcagctcctgctcgatcttcttct

SEQ ID NO: 460952 - DNA, 25 bp, Rattus norvegicus
cttgtttcttgcttagcatttcctc

SEQ ID NO: 460953 - DNA, 25 bp, Rattus norvegicus
gcttagcatttcctccgtgtcccga

SEQ ID NO: 460954 - DNA, 25 bp, Rattus norvegicus
cctccgtgtcccgaagtcgctgtat

SEQ ID NO: 460955 - DNA, 25 bp, Rattus norvegicus
cgaagtcgctgtatggcctcctggg

SEQ ID NO: 460956 - DNA, 25 bp, Rattus norvegicus
gaacagcttcccgaacaccgacatg

SEQ ID NO: 460957 - DNA, 25 bp, Rattus norvegicus
agcttcccgaacaccgacatggttg

SEQ ID NO: 460958 - DNA, 25 bp, Rattus norvegicus
tcccgaagtcgctgtatggcctcct

SEQ ID NO: 460959 - DNA, 25 bp, Rattus norvegicus
tcccgaacaccgacatggttgctgc

SEQ ID NO: 460960 - DNA, 25 bp, Rattus norvegicus
cctcctctcggcagtctgcggatta

SEQ ID NO: 460961 - DNA, 25 bp, Rattus norvegicus
tacagccctggctagacaagagtgg

SEQ ID NO: 460962 - DNA, 25 bp, Rattus norvegicus
gacacggacaccgacagcggctatg

SEQ ID NO: 460963 - DNA, 25 bp, Rattus norvegicus
acccagcttctgacgccacaggtga

SEQ ID NO: 460964 - DNA, 25 bp, Rattus norvegicus
gtcttgcaatacctcgcgcgctttg

SEQ ID NO: 460965 - DNA, 25 bp, Rattus norvegicus
cctgcgccaaagaagtcttgcaata

SEQ ID NO: 460966 - DNA, 25 bp, Rattus norvegicus
gatgcgttccactcggggtttcaaa

SEQ ID NO: 460967 - DNA, 25 bp, Rattus norvegicus
tccaggccgacttggatgcgttcca

SEQ ID NO: 460968 - DNA, 25 bp, Rattus norvegicus
cgctctctgaaatcgccggtccagg

SEQ ID NO: 460969 - DNA, 25 bp, Rattus norvegicus
gcagatgtcttaacgccgcggtttt

SEQ ID NO: 460970 - DNA, 25 bp, Rattus norvegicus
gcccacgtgatgagcagatgtctta

SEQ ID NO: 460971 - DNA, 25 bp, Rattus norvegicus
agccgagctcactgtaggcagcgca

SEQ ID NO: 460972 - DNA, 25 bp, Rattus norvegicus
ctgcggattatatcgctggaatgcc

SEQ ID NO: 460973 - DNA, 25 bp, Rattus norvegicus
agtggcctggacaagtatctgtacc

SEQ ID NO: 460974 - DNA, 25 bp, Rattus norvegicus
ttggccaacagcaccacaagatggc

SEQ ID NO: 460975 - DNA, 25 bp, Rattus norvegicus
aaagcgcaggcacacgtctttgagc

SEQ ID NO: 460976 - DNA, 25 bp, Rattus norvegicus
cggcgcaaccgttgattggccaaca

SEQ ID NO: 460977 - DNA, 25 bp, Rattus norvegicus
gcagcaagacgatcggcgcctccat

SEQ ID NO: 460978 - DNA, 25 bp, Rattus norvegicus
tgaccagcggcggagcctccgaaga

SEQ ID NO: 460979 - DNA, 25 bp, Rattus norvegicus
accgtgcgcttcacgtcctcgttga

SEQ ID NO: 460980 - DNA, 25 bp, Rattus norvegicus
gtcaccttggctaggtggctgctca

SEQ ID NO: 460981 - DNA, 25 bp, Rattus norvegicus
ctccagggccagaacgaaagagctg

SEQ ID NO: 460982 - DNA, 25 bp, Rattus norvegicus
aagtcgcgactccagttcgggctcc

SEQ ID NO: 460983 - DNA, 25 bp, Rattus norvegicus
cacgcctaggtgtgcaagtcgcgac

SEQ ID NO: 460984 - DNA, 25 bp, Rattus norvegicus
ctcaggcatcctgcgtgaggttcgc

SEQ ID NO: 460985 - DNA, 25 bp, Rattus norvegicus
agggatctccggtctcctcaggcat

SEQ ID NO: 460986 - DNA, 25 bp, Rattus norvegicus
aaagagctggctcgtgctgtagagc

SEQ ID NO: 460987 - DNA, 25 bp, Rattus norvegicus
ccatggggcgcctgattgaaaaatc

SEQ ID NO: 460988 - DNA, 25 bp, Rattus norvegicus
gcgctgagatttcacctacaggggc

SEQ ID NO: 460989 - DNA, 25 bp, Rattus norvegicus
agccgccgtgatacggtgcgacttc

SEQ ID NO: 460990 - DNA, 25 bp, Rattus norvegicus
tagcctgcgcctccgaaaatgaagg

SEQ ID NO: 460991 - DNA, 25 bp, Rattus norvegicus
agcatgcgttctcgctgcttcctgc

SEQ ID NO: 460992 - DNA, 25 bp, Rattus norvegicus
tgcttcctgcctgttgtgctcgtgt

SEQ ID NO: 460993 - DNA, 25 bp, Rattus norvegicus
tgctcgtgtgaagaggcgtccttac

SEQ ID NO: 460994 - DNA, 25 bp, Rattus norvegicus
tcggataaagcaccaccgccgctag

SEQ ID NO: 460995 - DNA, 25 bp, Rattus norvegicus
gaagcaagcgctgagatttcaccta

SEQ ID NO: 460996 - DNA, 25 bp, Rattus norvegicus
acttctcttaaactagcctgcgcct

SEQ ID NO: 460997 - DNA, 25 bp, Rattus norvegicus
gccaccactgcggagttcctgcagt

SEQ ID NO: 460998 - DNA, 25 bp, Rattus norvegicus
tcctgcagttgtccgaggagaccca

SEQ ID NO: 460999 - DNA, 25 bp, Rattus norvegicus
tccgaggagacccagaggagaagcc

SEQ ID NO: 461000 - DNA, 25 bp, Rattus norvegicus
aggcgtccttactcagaagcaagcg

SEQ ID NO: 461001 - DNA, 25 bp, Rattus norvegicus
aaatgaaggcttgcagcatgcgttc

SEQ ID NO: 461002 - DNA, 25 bp, Rattus norvegicus
caaccctggcgtcgggcgtctcgtg

SEQ ID NO: 461003 - DNA, 25 bp, Rattus norvegicus
gcgtctcgtgacaggcacttccgct

SEQ ID NO: 461004 - DNA, 25 bp, Rattus norvegicus
cgtgacaggcacttccgctcggggc

SEQ ID NO: 461005 - DNA, 25 bp, Rattus norvegicus
gagcaaggccggagctttgaccata

SEQ ID NO: 461006 - DNA, 25 bp, Rattus norvegicus
aggccggagctttgaccataaagcc

SEQ ID NO: 461007 - DNA, 25 bp, Rattus norvegicus
tttgaccataaagcccaaggcggcg

SEQ ID NO: 461008 - DNA, 25 bp, Rattus norvegicus
tggagccggagtcgaacctctctgt

SEQ ID NO: 461009 - DNA, 25 bp, Rattus norvegicus
ggagtcgaacctctctgtcgcggcc

SEQ ID NO: 461010 - DNA, 25 bp, Rattus norvegicus
gaacctctctgtcgcggcctgcgtt

SEQ ID NO: 461011 - DNA, 25 bp, Rattus norvegicus
gcctgcgttgtgtctcctcctctgt

SEQ ID NO: 461012 - DNA, 25 bp, Rattus norvegicus
cctcctctgttgaccctgcggtgag

SEQ ID NO: 461013 - DNA, 25 bp, Rattus norvegicus
ctctgttgaccctgcggtgagcggc

SEQ ID NO: 461014 - DNA, 25 bp, Rattus norvegicus
gcagcgctgccaagcgcgtcacatg

SEQ ID NO: 461015 - DNA, 25 bp, Rattus norvegicus
cgaccggaacgtgacgcaaggtgga

SEQ ID NO: 461016 - DNA, 25 bp, Rattus norvegicus
ctaaattatggcagtggcagctctc

SEQ ID NO: 461017 - DNA, 25 bp, Rattus norvegicus
tccaaaggttcgaccctgtgggtga

SEQ ID NO: 461018 - DNA, 25 bp, Rattus norvegicus
ttctttcttgcttggcggttgcaca

SEQ ID NO: 461019 - DNA, 25 bp, Rattus norvegicus
tgctcagaggccaacgtcaaccttc

SEQ ID NO: 461020 - DNA, 25 bp, Rattus norvegicus
gctcgcattgaatcggccctaacga

SEQ ID NO: 461021 - DNA, 25 bp, Rattus norvegicus
cctcttgaggtcatcagtgagaatt

SEQ ID NO: 461022 - DNA, 25 bp, Rattus norvegicus
gcccggactatcagttgctaaatta

SEQ ID NO: 461023 - DNA, 25 bp, Rattus norvegicus
tcttacagggatcccgctgccatgc

SEQ ID NO: 461024 - DNA, 25 bp, Rattus norvegicus
ggctcttacggctacaattacaatg

SEQ ID NO: 461025 - DNA, 25 bp, Rattus norvegicus
atgggatggatctcagcgtcaaccg

SEQ ID NO: 461026 - DNA, 25 bp, Rattus norvegicus
tcggcctcatccagccactttgggg

SEQ ID NO: 461027 - DNA, 25 bp, Rattus norvegicus
tttcaccgaaatagacgaggccagc

SEQ ID NO: 461028 - DNA, 25 bp, Rattus norvegicus
cttctcggggcgttatccaaatggc

SEQ ID NO: 461029 - DNA, 25 bp, Rattus norvegicus
agtcactgccctgcactaacggcga

SEQ ID NO: 461030 - DNA, 25 bp, Rattus norvegicus
aaaggaaccgctgcagcctgaactc

SEQ ID NO: 461031 - DNA, 25 bp, Rattus norvegicus
ggcgtcttgggtaagtccatcccga

SEQ ID NO: 461032 - DNA, 25 bp, Rattus norvegicus
cagttctcctaagcgctgtgccggg

SEQ ID NO: 461033 - DNA, 25 bp, Rattus norvegicus
gtgttgcaagcccagttctcctaag

SEQ ID NO: 461034 - DNA, 25 bp, Rattus norvegicus
accttcggacgctggctgtgttgca

SEQ ID NO: 461035 - DNA, 25 bp, Rattus norvegicus
gagcttttgccactccgctgggacc

SEQ ID NO: 461036 - DNA, 25 bp, Rattus norvegicus
attggtcgcaagtagggagcttttg

SEQ ID NO: 461037 - DNA, 25 bp, Rattus norvegicus
actaggttcataaccaggattggtc

SEQ ID NO: 461038 - DNA, 25 bp, Rattus norvegicus
ccgggttttgagagctgccacaagc

SEQ ID NO: 461039 - DNA, 25 bp, Rattus norvegicus
ttccgctggtggcagcaaaggaacc

SEQ ID NO: 461040 - DNA, 25 bp, Rattus norvegicus
cctccctgtgagtcttccgctggtg

SEQ ID NO: 461041 - DNA, 25 bp, Rattus norvegicus
tgcactgcctctggtgactcactga

SEQ ID NO: 461042 - DNA, 25 bp, Rattus norvegicus
tgctacgcctaagggtgcactgcct

SEQ ID NO: 461043 - DNA, 25 bp, Rattus norvegicus
cggcagccacagagcactaggttca

SEQ ID NO: 461044 - DNA, 25 bp, Rattus norvegicus
ctggcccggtaacttcggatacgcg

SEQ ID NO: 461045 - DNA, 25 bp, Rattus norvegicus
gaagcgaagaccgagcggtatctgc

SEQ ID NO: 461046 - DNA, 25 bp, Rattus norvegicus
gtactcgccagacctggcccggtaa

SEQ ID NO: 461047 - DNA, 25 bp, Rattus norvegicus
cgggatctctgcgtactcgccagac

SEQ ID NO: 461048 - DNA, 25 bp, Rattus norvegicus
cgcaatcgcgtgcaccgggatctct

SEQ ID NO: 461049 - DNA, 25 bp, Rattus norvegicus
agggaacccgcaatcgcgtgcaccg

SEQ ID NO: 461050 - DNA, 25 bp, Rattus norvegicus
agcccgtgtgcaagtgtgcttaccc

SEQ ID NO: 461051 - DNA, 25 bp, Rattus norvegicus
cctctagatccgaaggaaagcgaaa

SEQ ID NO: 461052 - DNA, 25 bp, Rattus norvegicus
ccaagctttcggtttcctctagatc

SEQ ID NO: 461053 - DNA, 25 bp, Rattus norvegicus
cgcaactctggagtgactgctgtcc

SEQ ID NO: 461054 - DNA, 25 bp, Rattus norvegicus
tcccagcctcgcaactctggagtga

SEQ ID NO: 461055 - DNA, 25 bp, Rattus norvegicus
gctccagaggagaacgtggcaccgc

SEQ ID NO: 461056 - DNA, 25 bp, Rattus norvegicus
agcggtatctgcaaagggctccaga

SEQ ID NO: 461057 - DNA, 25 bp, Rattus norvegicus
cgaaggaaagcgaaactcaggcggc

SEQ ID NO: 461058 - DNA, 25 bp, Rattus norvegicus
cgcccagctagttaacccgagcggt

SEQ ID NO: 461059 - DNA, 25 bp, Rattus norvegicus
gcaggaaaaggctggcttgacgagc

SEQ ID NO: 461060 - DNA, 25 bp, Rattus norvegicus
aaaaggctggcttgacgagcgggag

SEQ ID NO: 461061 - DNA, 25 bp, Rattus norvegicus
agcgggaggatcagtcggctaaata

SEQ ID NO: 461062 - DNA, 25 bp, Rattus norvegicus
cgggaggatcagtcggctaaatact

SEQ ID NO: 461063 - DNA, 25 bp, Rattus norvegicus
gggaggatcagtcggctaaatactc

SEQ ID NO: 461064 - DNA, 25 bp, Rattus norvegicus
aggatcagtcggctaaatactcaac

SEQ ID NO: 461065 - DNA, 25 bp, Rattus norvegicus
gatcagtcggctaaatactcaaccc

SEQ ID NO: 461066 - DNA, 25 bp, Rattus norvegicus
agtcggctaaatactcaacccacaa

SEQ ID NO: 461067 - DNA, 25 bp, Rattus norvegicus
agcggtccgccgtcagctcgggttc

SEQ ID NO: 461068 - DNA, 25 bp, Rattus norvegicus
gcatctaacccaaccgcccagctag

SEQ ID NO: 461069 - DNA, 25 bp, Rattus norvegicus
ccagctagttaacccgagcggtccg

SEQ ID NO: 461070 - DNA, 25 bp, Rattus norvegicus
cggcgccggctgtggtggcacagac

SEQ ID NO: 461071 - DNA, 25 bp, Rattus norvegicus
tttaagcatctaacccaaccgccca

SEQ ID NO: 461072 - DNA, 25 bp, Rattus norvegicus
aatcggtggtagaggtcggggtatg

SEQ ID NO: 461073 - DNA, 25 bp, Rattus norvegicus
gaggcagaggccgaggtcgtggccg

SEQ ID NO: 461074 - DNA, 25 bp, Rattus norvegicus
gaagagggggctttggaggcagagg

SEQ ID NO: 461075 - DNA, 25 bp, Rattus norvegicus
cggggtatgataggtcggggaagag

SEQ ID NO: 461076 - DNA, 25 bp, Rattus norvegicus
tcggggtatgataggtcggggaaga

SEQ ID NO: 461077 - DNA, 25 bp, Rattus norvegicus
tagaggtcggggtatgataggtcgg

SEQ ID NO: 461078 - DNA, 25 bp, Rattus norvegicus
cggtggtagaggtcggggtatgata

SEQ ID NO: 461079 - DNA, 25 bp, Rattus norvegicus
tcgtggcggaatcggtggtagaggt

SEQ ID NO: 461080 - DNA, 25 bp, Rattus norvegicus
gctatgggtcgtggcggaatcggtg

SEQ ID NO: 461081 - DNA, 25 bp, Rattus norvegicus
agctatgggtcgtggcggaatcggt

SEQ ID NO: 461082 - DNA, 25 bp, Rattus norvegicus
tggagctatgggtcgtggcggaatc

SEQ ID NO: 461083 - DNA, 25 bp, Rattus norvegicus
tggcggaatcggtggtagaggtcgg

SEQ ID NO: 461084 - DNA, 25 bp, Rattus norvegicus
gtagaggtcggggtatgataggtcg

SEQ ID NO: 461085 - DNA, 25 bp, Rattus norvegicus
atcggtggtagaggtcggggtatga

SEQ ID NO: 461086 - DNA, 25 bp, Rattus norvegicus
gctccgaggtcaaaacctgctccga

SEQ ID NO: 461087 - DNA, 25 bp, Rattus norvegicus
tggtgttcgaggtcgtggaggtcct

SEQ ID NO: 461088 - DNA, 25 bp, Rattus norvegicus
atgggcttaagaagaggtggtgttc

SEQ ID NO: 461089 - DNA, 25 bp, Rattus norvegicus
cccgaatgggcttaagaagaggtgg

SEQ ID NO: 461090 - DNA, 25 bp, Rattus norvegicus
cgtagctccccgaatgggcttaaga

SEQ ID NO: 461091 - DNA, 25 bp, Rattus norvegicus
tggacgagccgtagctccccgaatg

SEQ ID NO: 461092 - DNA, 25 bp, Rattus norvegicus
ccgaggtggacgagccgtagctccc

SEQ ID NO: 461093 - DNA, 25 bp, Rattus norvegicus
ctccgaggtggacgagccgtagctc

SEQ ID NO: 461094 - DNA, 25 bp, Rattus norvegicus
cctgctccgaggtggacgagccgta

SEQ ID NO: 461095 - DNA, 25 bp, Rattus norvegicus
aaacctgctccgaggtggacgagcc

SEQ ID NO: 461096 - DNA, 25 bp, Rattus norvegicus
tcaaaacctgctccgaggtggacga

SEQ ID NO: 461097 - DNA, 25 bp, Rattus norvegicus
aggtcaaaacctgctccgaggtgga

SEQ ID NO: 461098 - DNA, 25 bp, Rattus norvegicus
cgaggtcaaaacctgctccgaggtg

SEQ ID NO: 461099 - DNA, 25 bp, Rattus norvegicus
tccgaggtcaaaacctgctccgagg

SEQ ID NO: 461100 - DNA, 25 bp, Rattus norvegicus
cccaggttccttctgtgttcacgtg

SEQ ID NO: 461101 - DNA, 25 bp, Rattus norvegicus
gaattcgcgttctttctctggccca

SEQ ID NO: 461102 - DNA, 25 bp, Rattus norvegicus
gcctggccagtaagcgatgagcaaa

SEQ ID NO: 461103 - DNA, 25 bp, Rattus norvegicus
ctagagggcgtcattctatccgacc

SEQ ID NO: 461104 - DNA, 25 bp, Rattus norvegicus
ggatagacctccagcctgacctaga

SEQ ID NO: 461105 - DNA, 25 bp, Rattus norvegicus
cactgttcttaaatccggggagcga

SEQ ID NO: 461106 - DNA, 25 bp, Rattus norvegicus
cggggacactgttgccaaaaccact

SEQ ID NO: 461107 - DNA, 25 bp, Rattus norvegicus
tctgtgattagtggcaccgcaattc

SEQ ID NO: 461108 - DNA, 25 bp, Rattus norvegicus
gctttcccgcagcagtccttgtgtg

SEQ ID NO: 461109 - DNA, 25 bp, Rattus norvegicus
cacactctcggcgtggcttatcgca

SEQ ID NO: 461110 - DNA, 25 bp, Rattus norvegicus
tttatccagagttgcggggacactg

SEQ ID NO: 461111 - DNA, 25 bp, Rattus norvegicus
tcagtgttaggagaaacccggagtc

SEQ ID NO: 461112 - DNA, 25 bp, Rattus norvegicus
tgtccgagaggaaacgttgattatc

SEQ ID NO: 461113 - DNA, 25 bp, Rattus norvegicus
tctggcccaaaccaagagcaatcgg

SEQ ID NO: 461114 - DNA, 25 bp, Rattus norvegicus
gccgcctcaaacctggtttcataca

SEQ ID NO: 461115 - DNA, 25 bp, Rattus norvegicus
gcctcaaacctggtttcatacactg

SEQ ID NO: 461116 - DNA, 25 bp, Rattus norvegicus
tcaaacctggtttcatacactgatc

SEQ ID NO: 461117 - DNA, 25 bp, Rattus norvegicus
caaacctggtttcatacactgatcg

SEQ ID NO: 461118 - DNA, 25 bp, Rattus norvegicus
aacctggtttcatacactgatcgtg

SEQ ID NO: 461119 - DNA, 25 bp, Rattus norvegicus
cctggtttcatacactgatcgtgtg

SEQ ID NO: 461120 - DNA, 25 bp, Rattus norvegicus
tggtttcatacactgatcgtgtgtc

SEQ ID NO: 461121 - DNA, 25 bp, Rattus norvegicus
gtttcatacactgatcgtgtgtccg

SEQ ID NO: 461122 - DNA, 25 bp, Rattus norvegicus
ttcatacactgatcgtgtgtccgcc

SEQ ID NO: 461123 - DNA, 25 bp, Rattus norvegicus
atacactgatcgtgtgtccgccatc

SEQ ID NO: 461124 - DNA, 25 bp, Rattus norvegicus
acactgatcgtgtgtccgccatctc

SEQ ID NO: 461125 - DNA, 25 bp, Rattus norvegicus
actgatcgtgtgtccgccatctcca

SEQ ID NO: 461126 - DNA, 25 bp, Rattus norvegicus
ctgatcgtgtgtccgccatctccag

SEQ ID NO: 461127 - DNA, 25 bp, Rattus norvegicus
ggccgcctcaaacctggtttcatac

SEQ ID NO: 461128 - DNA, 25 bp, Rattus norvegicus
cgtactaggcattgagaaaattcgc

SEQ ID NO: 461129 - DNA, 25 bp, Rattus norvegicus
gcggagcgtactaggcattgagaaa

SEQ ID NO: 461130 - DNA, 25 bp, Rattus norvegicus
gagaaaattcgccacaggcttggag

SEQ ID NO: 461131 - DNA, 25 bp, Rattus norvegicus
attcgccacaggcttggagtgcggt

SEQ ID NO: 461132 - DNA, 25 bp, Rattus norvegicus
cccggaaatctcaaggacgcctcgt

SEQ ID NO: 461133 - DNA, 25 bp, Rattus norvegicus
ggaaatctcaaggacgcctcgttgg

SEQ ID NO: 461134 - DNA, 25 bp, Rattus norvegicus
ctcaaggacgcctcgttgggagtgt

SEQ ID NO: 461135 - DNA, 25 bp, Rattus norvegicus
gagtgtcatttttgtcggtttagga

SEQ ID NO: 461136 - DNA, 25 bp, Rattus norvegicus
atgggttgggaagattactcgtaca

SEQ ID NO: 461137 - DNA, 25 bp, Rattus norvegicus
tgggaagattactcgtacatgtcta

SEQ ID NO: 461138 - DNA, 25 bp, Rattus norvegicus
ctcgtacatgtctagttgcgaacta

SEQ ID NO: 461139 - DNA, 25 bp, Rattus norvegicus
tctagttgcgaactataagtcactc

SEQ ID NO: 461140 - DNA, 25 bp, Rattus norvegicus
ataagtcactcttccctcggagccg

SEQ ID NO: 461141 - DNA, 25 bp, Rattus norvegicus
cctcgttgggagtgtcatttttgtc

SEQ ID NO: 461142 - DNA, 25 bp, Rattus norvegicus
agctccgagcgctcactggccctgg

SEQ ID NO: 461143 - DNA, 25 bp, Rattus norvegicus
cgctggccgagacgtcctccttggt

SEQ ID NO: 461144 - DNA, 25 bp, Rattus norvegicus
ccacggccaccgctggctcccgcgc

SEQ ID NO: 461145 - DNA, 25 bp, Rattus norvegicus
agagctcgcgtccacccacggccac

SEQ ID NO: 461146 - DNA, 25 bp, Rattus norvegicus
agcctcggccgagagctcgcgtcca

SEQ ID NO: 461147 - DNA, 25 bp, Rattus norvegicus
acagcccggagacgcggccagcctc

SEQ ID NO: 461148 - DNA, 25 bp, Rattus norvegicus
tgccagtgcgagaaggctgccggcc

SEQ ID NO: 461149 - DNA, 25 bp, Rattus norvegicus
ctcgccctgagagtggtgccagtgc

SEQ ID NO: 461150 - DNA, 25 bp, Rattus norvegicus
catgctcgccctgagagtggtgcca

SEQ ID NO: 461151 - DNA, 25 bp, Rattus norvegicus
tacgggcgcctagcaaccaacggcg

SEQ ID NO: 461152 - DNA, 25 bp, Rattus norvegicus
gctgtgcctggagcatcgccgggct

SEQ ID NO: 461153 - DNA, 25 bp, Rattus norvegicus
gccgagacgtcctccttggtgccgt

SEQ ID NO: 461154 - DNA, 25 bp, Rattus norvegicus
agacgtcctccttggtgccgtgggt

SEQ ID NO: 461155 - DNA, 25 bp, Rattus norvegicus
cgccgagcatgctcgccctgagagt

SEQ ID NO: 461156 - DNA, 25 bp, Rattus norvegicus
gctcgcggtttcagtcagcttgccg

SEQ ID NO: 461157 - DNA, 25 bp, Rattus norvegicus
gacagtcgtccaatcagagtcgggg

SEQ ID NO: 461158 - DNA, 25 bp, Rattus norvegicus
cgggtaagtctctgccgcggagacc

SEQ ID NO: 461159 - DNA, 25 bp, Rattus norvegicus
tcagcttgccgggtaagtctctgcc

SEQ ID NO: 461160 - DNA, 25 bp, Rattus norvegicus
gcggtttcagtcagcttgccgggta

SEQ ID NO: 461161 - DNA, 25 bp, Rattus norvegicus
cctggtgaaggatggcgcaggtcct

SEQ ID NO: 461162 - DNA, 25 bp, Rattus norvegicus
ttgctgccgggtgctcgcggtttca

SEQ ID NO: 461163 - DNA, 25 bp, Rattus norvegicus
ggcattgctacttgctgccgggtgc

SEQ ID NO: 461164 - DNA, 25 bp, Rattus norvegicus
ggcctaaggcattgctacttgctgc

SEQ ID NO: 461165 - DNA, 25 bp, Rattus norvegicus
gccggcctaaggcattgctacttgc

SEQ ID NO: 461166 - DNA, 25 bp, Rattus norvegicus
gggaagctcgagctggccggcctaa

SEQ ID NO: 461167 - DNA, 25 bp, Rattus norvegicus
ttggctgtatgaaggcgggaagctc

SEQ ID NO: 461168 - DNA, 25 bp, Rattus norvegicus
aaccggcgtggtggtgcgcatgccc

SEQ ID NO: 461169 - DNA, 25 bp, Rattus norvegicus
tttcagtcagcttgccgggtaagtc

SEQ ID NO: 461170 - DNA, 25 bp, Rattus norvegicus
tagggctgctcctacctgcgactgt

SEQ ID NO: 461171 - DNA, 25 bp, Rattus norvegicus
cacaggggcccttactgaggccaga

SEQ ID NO: 461172 - DNA, 25 bp, Rattus norvegicus
cttctgcttgttcatggggcccaca

SEQ ID NO: 461173 - DNA, 25 bp, Rattus norvegicus
acccagggtcgcttctgcttgttca

SEQ ID NO: 461174 - DNA, 25 bp, Rattus norvegicus
cgcacgaggagcttagaaggctttc

SEQ ID NO: 461175 - DNA, 25 bp, Rattus norvegicus
ggagcctaccctggaacagttccca

SEQ ID NO: 461176 - DNA, 25 bp, Rattus norvegicus
acagtggcggatgatgctcttggcc

SEQ ID NO: 461177 - DNA, 25 bp, Rattus norvegicus
agcagcccggaatcctgcctgcgta

SEQ ID NO: 461178 - DNA, 25 bp, Rattus norvegicus
agcagctccgaatcctgcctgagca

SEQ ID NO: 461179 - DNA, 25 bp, Rattus norvegicus
tgttgtgcctgagcagcagctccga

SEQ ID NO: 461180 - DNA, 25 bp, Rattus norvegicus
atgaacgctgtttgcggtcggagtc

SEQ ID NO: 461181 - DNA, 25 bp, Rattus norvegicus
tggtggacacgcacctcctcgctgt

SEQ ID NO: 461182 - DNA, 25 bp, Rattus norvegicus
cagctccctggacgctttggagtcc

SEQ ID NO: 461183 - DNA, 25 bp, Rattus norvegicus
cgtgctgggctgtttactgaatgaa

SEQ ID NO: 461184 - DNA, 25 bp, Rattus norvegicus
tattaaaatgttcgagagcctcgtg

SEQ ID NO: 461185 - DNA, 25 bp, Rattus norvegicus
tcggttttccggatacacaatagtg

SEQ ID NO: 461186 - DNA, 25 bp, Rattus norvegicus
gtgagtattcttgccggctcaggcc

SEQ ID NO: 461187 - DNA, 25 bp, Rattus norvegicus
gccacggccggtcggctagaaacag

SEQ ID NO: 461188 - DNA, 25 bp, Rattus norvegicus
gagcgagctccgctgttgctcagcg

SEQ ID NO: 461189 - DNA, 25 bp, Rattus norvegicus
tattatagtaactgcctgctcgtgg

SEQ ID NO: 461190 - DNA, 25 bp, Rattus norvegicus
tacacaatagtggacgggagcgagc

SEQ ID NO: 461191 - DNA, 25 bp, Rattus norvegicus
tctgcccgcagtcgcggttcggttt

SEQ ID NO: 461192 - DNA, 25 bp, Rattus norvegicus
ctgccaaagtatgagattaatacga

SEQ ID NO: 461193 - DNA, 25 bp, Rattus norvegicus
gagcgaactgcgtgagcatattata

SEQ ID NO: 461194 - DNA, 25 bp, Rattus norvegicus
ctcgtgacgcgcctagctgtttaac

SEQ ID NO: 461195 - DNA, 25 bp, Rattus norvegicus
ttgctacgctcagctcgcttggggt

SEQ ID NO: 461196 - DNA, 25 bp, Rattus norvegicus
caggtcacggcgtctaaaaattatt

SEQ ID NO: 461197 - DNA, 25 bp, Rattus norvegicus
gctgtttaacaaagactgccaaagt

SEQ ID NO: 461198 - DNA, 25 bp, Rattus norvegicus
gccagagggcgactgcaaacccagt

SEQ ID NO: 461199 - DNA, 25 bp, Rattus norvegicus
ttgaaatcagccaggtccgcagccg

SEQ ID NO: 461200 - DNA, 25 bp, Rattus norvegicus
gtccgcagccgtatacccatcgtgg

SEQ ID NO: 461201 - DNA, 25 bp, Rattus norvegicus
tatacccatcgtggtcgcggacgtc

SEQ ID NO: 461202 - DNA, 25 bp, Rattus norvegicus
attcaccgcgaggatctggcagcac

SEQ ID NO: 461203 - DNA, 25 bp, Rattus norvegicus
cctcgggcactccagagaagctgca

SEQ ID NO: 461204 - DNA, 25 bp, Rattus norvegicus
tcagcagcatcatgcagcggggtcc

SEQ ID NO: 461205 - DNA, 25 bp, Rattus norvegicus
atctctgcgccgtgcagcaggagcc

SEQ ID NO: 461206 - DNA, 25 bp, Rattus norvegicus
cagctgagcactttggtgtggccgc

SEQ ID NO: 461207 - DNA, 25 bp, Rattus norvegicus
cgtcgtggtcctgctccgaaaagct

SEQ ID NO: 461208 - DNA, 25 bp, Rattus norvegicus
gctccgaaaagctcacgtccgcaaa

SEQ ID NO: 461209 - DNA, 25 bp, Rattus norvegicus
accaggactgggttgtggcccatct

SEQ ID NO: 461210 - DNA, 25 bp, Rattus norvegicus
agtgggtgtggccattgaaatcagc

SEQ ID NO: 461211 - DNA, 25 bp, Rattus norvegicus
cccacaggtcctgggagatctctgc

SEQ ID NO: 461212 - DNA, 25 bp, Rattus norvegicus
tcctccaccaagtagcgcaaacagt

SEQ ID NO: 461213 - DNA, 25 bp, Rattus norvegicus
cctagagtgcccacttaagcctggg

SEQ ID NO: 461214 - DNA, 25 bp, Rattus norvegicus
aactccagctcagcggcgctctggg

SEQ ID NO: 461215 - DNA, 25 bp, Rattus norvegicus
tgcgatcccggggactcaactccag

SEQ ID NO: 461216 - DNA, 25 bp, Rattus norvegicus
cggctctgcgatcccggggactcaa

SEQ ID NO: 461217 - DNA, 25 bp, Rattus norvegicus
tccaagagcaacccggcggtgcagt

SEQ ID NO: 461218 - DNA, 25 bp, Rattus norvegicus
atggtgtcaccctcggcgccgcgat

SEQ ID NO: 461219 - DNA, 25 bp, Rattus norvegicus
cagggccatggtgtcaccctcggcg

SEQ ID NO: 461220 - DNA, 25 bp, Rattus norvegicus
ctgcatcgcctgttccagggccatg

SEQ ID NO: 461221 - DNA, 25 bp, Rattus norvegicus
agggacctcagcacgtccaggtcgc

SEQ ID NO: 461222 - DNA, 25 bp, Rattus norvegicus
cggcgtgcagggacctcagcacgtc

SEQ ID NO: 461223 - DNA, 25 bp, Rattus norvegicus
tgcagcttgcctgagcgggccgcat

SEQ ID NO: 461224 - DNA, 25 bp, Rattus norvegicus
gtgcccacttaagcctgggttccgc

SEQ ID NO: 461225 - DNA, 25 bp, Rattus norvegicus
agcgcaaacagtgcagcttgcctga

SEQ ID NO: 461226 - DNA, 25 bp, Rattus norvegicus
cgctttcccgcagaacatgagactg

SEQ ID NO: 461227 - DNA, 25 bp, Rattus norvegicus
tctctgtacgcagggtctttggata

SEQ ID NO: 461228 - DNA, 25 bp, Rattus norvegicus
gccctccagtgtgcacagttctcaa

SEQ ID NO: 461229 - DNA, 25 bp, Rattus norvegicus
gttccacggaagcacctggtgagtg

SEQ ID NO: 461230 - DNA, 25 bp, Rattus norvegicus
agcctgcgtcagtatgttccacgga

SEQ ID NO: 461231 - DNA, 25 bp, Rattus norvegicus
catcctggaaatgactgtgcgcttc

SEQ ID NO: 461232 - DNA, 25 bp, Rattus norvegicus
acgaggcgttcatctgcccgtttta

SEQ ID NO: 461233 - DNA, 25 bp, Rattus norvegicus
accactgagggactgacgagcattt

SEQ ID NO: 461234 - DNA, 25 bp, Rattus norvegicus
gtggggatccaagcacctgagtgta

SEQ ID NO: 461235 - DNA, 25 bp, Rattus norvegicus
cctgagccagctaaagggtctagta

SEQ ID NO: 461236 - DNA, 25 bp, Rattus norvegicus
cgcggatcaatgagagcctgagcca

SEQ ID NO: 461237 - DNA, 25 bp, Rattus norvegicus
ttcctaactgtggtctctgcgctca

SEQ ID NO: 461238 - DNA, 25 bp, Rattus norvegicus
ctttggatagctacctcgagggtta

SEQ ID NO: 461239 - DNA, 25 bp, Rattus norvegicus
tgggcaatggcgatattcctaactg

SEQ ID NO: 461240 - DNA, 25 bp, Rattus norvegicus
accacgcgctgtaggcccgggtgaa

SEQ ID NO: 461241 - DNA, 25 bp, Rattus norvegicus
cagccatccgggtaaagggttgaca

SEQ ID NO: 461242 - DNA, 25 bp, Rattus norvegicus
catccgggtaaagggttgacactcg

SEQ ID NO: 461243 - DNA, 25 bp, Rattus norvegicus
taaagggttgacactcggcaccacg

SEQ ID NO: 461244 - DNA, 25 bp, Rattus norvegicus
tgacactcggcaccacgcgctgtag

SEQ ID NO: 461245 - DNA, 25 bp, Rattus norvegicus
cccgcggtgacctcatcgggtggcc

SEQ ID NO: 461246 - DNA, 25 bp, Rattus norvegicus
gtagactcccggctgccaccgaagc

SEQ ID NO: 461247 - DNA, 25 bp, Rattus norvegicus
gacgctccacgaccgggcctccggc

SEQ ID NO: 461248 - DNA, 25 bp, Rattus norvegicus
tgccaccgaaccttctggaagcgga

SEQ ID NO: 461249 - DNA, 25 bp, Rattus norvegicus
aaccttctggaagcggagtcccaca

SEQ ID NO: 461250 - DNA, 25 bp, Rattus norvegicus
tctggaagcggagtcccacagccgc

SEQ ID NO: 461251 - DNA, 25 bp, Rattus norvegicus
gccgacagaactcgccgcctccgcg

SEQ ID NO: 461252 - DNA, 25 bp, Rattus norvegicus
cccgtctgcagccatccgggtaaag

SEQ ID NO: 461253 - DNA, 25 bp, Rattus norvegicus
gtcggtagcgaatcgccacgccggc

SEQ ID NO: 461254 - DNA, 25 bp, Rattus norvegicus
caggctcattcattcggcgccgggc

SEQ ID NO: 461255 - DNA, 25 bp, Rattus norvegicus
ctcctcttttatggcgcctcccagg

SEQ ID NO: 461256 - DNA, 25 bp, Rattus norvegicus
ggcctgctggacacctgttctcaga

SEQ ID NO: 461257 - DNA, 25 bp, Rattus norvegicus
gctggacacctgttctcagatcccg

SEQ ID NO: 461258 - DNA, 25 bp, Rattus norvegicus
cgccgtcgcagccaagatgtccggt

SEQ ID NO: 461259 - DNA, 25 bp, Rattus norvegicus
gtcgcagccaagatgtccggtccca

SEQ ID NO: 461260 - DNA, 25 bp, Rattus norvegicus
ggccgccatccagatctgccggtaa

SEQ ID NO: 461261 - DNA, 25 bp, Rattus norvegicus
atctgccggtaagacggaggcttgc

SEQ ID NO: 461262 - DNA, 25 bp, Rattus norvegicus
aggcttgcgggccaagccgaccctt

SEQ ID NO: 461263 - DNA, 25 bp, Rattus norvegicus
gcccgctgaggcgatgctataggct

SEQ ID NO: 461264 - DNA, 25 bp, Rattus norvegicus
aggcgatgctataggctcacaagga

SEQ ID NO: 461265 - DNA, 25 bp, Rattus norvegicus
ggctcacaaggatgctgccttcatc

SEQ ID NO: 461266 - DNA, 25 bp, Rattus norvegicus
gatgctgccttcatccggagcggcc

SEQ ID NO: 461267 - DNA, 25 bp, Rattus norvegicus
tgtgattcgcctcctctgcgcaggc

SEQ ID NO: 461268 - DNA, 25 bp, Rattus norvegicus
atccgggcaagggaccctggcactg

SEQ ID NO: 461269 - DNA, 25 bp, Rattus norvegicus
gggctccgcgccttgtagtccgagc

SEQ ID NO: 461270 - DNA, 25 bp, Rattus norvegicus
gagcccaaacctcctgcgggattcg

SEQ ID NO: 461271 - DNA, 25 bp, Rattus norvegicus
catgctgcagatccgggccgccttg

SEQ ID NO: 461272 - DNA, 25 bp, Rattus norvegicus
ccaccggcctctggctgcatcccaa

SEQ ID NO: 461273 - DNA, 25 bp, Rattus norvegicus
cggccgcagttctgaggactcttga

SEQ ID NO: 461274 - DNA, 25 bp, Rattus norvegicus
cgcagttctgaggactcttgatgta

SEQ ID NO: 461275 - DNA, 25 bp, Rattus norvegicus
actcttgatgtaggaatccgggcaa

SEQ ID NO: 461276 - DNA, 25 bp, Rattus norvegicus
cactgggcaactggcagagggatct

SEQ ID NO: 461277 - DNA, 25 bp, Rattus norvegicus
gagggatctgtcctccgttctcttg

SEQ ID NO: 461278 - DNA, 25 bp, Rattus norvegicus
gatctgtcctccgttctcttgtgcg

SEQ ID NO: 461279 - DNA, 25 bp, Rattus norvegicus
tctcttgtgcgtcctacagggcttg

SEQ ID NO: 461280 - DNA, 25 bp, Rattus norvegicus
cttgtgcgtcctacagggcttgccc

SEQ ID NO: 461281 - DNA, 25 bp, Rattus norvegicus
tctgaggactcttgatgtaggaatc

SEQ ID NO: 461282 - DNA, 25 bp, Rattus norvegicus
cgctctggccatcggcagcttccac

SEQ ID NO: 461283 - DNA, 25 bp, Rattus norvegicus
gcggcctgagtgacccagacccgag

SEQ ID NO: 461284 - DNA, 25 bp, Rattus norvegicus
gtgctgagagcacctggtgggacgc

SEQ ID NO: 461285 - DNA, 25 bp, Rattus norvegicus
tgggcagcgtttagggccagaacgc

SEQ ID NO: 461286 - DNA, 25 bp, Rattus norvegicus
aatccgggcgggaggactggacaag

SEQ ID NO: 461287 - DNA, 25 bp, Rattus norvegicus
agaacgccccgccattacaaacttg

SEQ ID NO: 461288 - DNA, 25 bp, Rattus norvegicus
tcaatgctgggtgagcgccgccgcc

SEQ ID NO: 461289 - DNA, 25 bp, Rattus norvegicus
cgcctcaatgctgggtgagcgccgc

SEQ ID NO: 461290 - DNA, 25 bp, Rattus norvegicus
atcactgcggctgctagggatacgt

SEQ ID NO: 461291 - DNA, 25 bp, Rattus norvegicus
ccaaggggcatcactgcggctgcta

SEQ ID NO: 461292 - DNA, 25 bp, Rattus norvegicus
ggcgggtcctgtcccgcgctccaag

SEQ ID NO: 461293 - DNA, 25 bp, Rattus norvegicus
ccaggcgctttagaggcggcggcct

SEQ ID NO: 461294 - DNA, 25 bp, Rattus norvegicus
cgctccaaggggcatcactgcggct

SEQ ID NO: 461295 - DNA, 25 bp, Rattus norvegicus
gagctcagccagctgagccgcggga

SEQ ID NO: 461296 - DNA, 25 bp, Rattus norvegicus
atcggcctgggcttcggcgtctgtt

SEQ ID NO: 461297 - DNA, 25 bp, Rattus norvegicus
ggcacgacaccagcgagcgtttcta

SEQ ID NO: 461298 - DNA, 25 bp, Rattus norvegicus
gcgagcgtttctacacccacggctg

SEQ ID NO: 461299 - DNA, 25 bp, Rattus norvegicus
acccacggctgtcgcttcatcgtgg

SEQ ID NO: 461300 - DNA, 25 bp, Rattus norvegicus
ctgtcgcttcatcgtggctgagatc

SEQ ID NO: 461301 - DNA, 25 bp, Rattus norvegicus
cgtcggctggcacgacaccagcgag

SEQ ID NO: 461302 - DNA, 25 bp, Rattus norvegicus
cttcatcgtggctgagatcggcctg

SEQ ID NO: 461303 - DNA, 25 bp, Rattus norvegicus
gcttcggcgtctgtttcttgctgct

SEQ ID NO: 461304 - DNA, 25 bp, Rattus norvegicus
cgtctgtttcttgctgctggtggga

SEQ ID NO: 461305 - DNA, 25 bp, Rattus norvegicus
gcgtggtctgcacggccattgccct

SEQ ID NO: 461306 - DNA, 25 bp, Rattus norvegicus
acggccattgccctcttccagacgc

SEQ ID NO: 461307 - DNA, 25 bp, Rattus norvegicus
tcttccagacgctggccacgcaggt

SEQ ID NO: 461308 - DNA, 25 bp, Rattus norvegicus
cttcactgtgcccaccatcgtggtg

SEQ ID NO: 461309 - DNA, 25 bp, Rattus norvegicus
gcaagcgccgctcctccattgacgg

SEQ ID NO: 461310 - DNA, 25 bp, Rattus norvegicus
tgcactcggattcgctgggctctgc

SEQ ID NO: 461311 - DNA, 25 bp, Rattus norvegicus
ggctatgtcacgctgcactcggatt

SEQ ID NO: 461312 - DNA, 25 bp, Rattus norvegicus
ggagactgctgagatcccgacgccc

SEQ ID NO: 461313 - DNA, 25 bp, Rattus norvegicus
acggcacggagactgctgagatccc

SEQ ID NO: 461314 - DNA, 25 bp, Rattus norvegicus
ctgcagccctcgtccctagatggtg

SEQ ID NO: 461315 - DNA, 25 bp, Rattus norvegicus
gagagcctgttgtccctgcagccct

SEQ ID NO: 461316 - DNA, 25 bp, Rattus norvegicus
agctttctgagctcgccctccgagt

SEQ ID NO: 461317 - DNA, 25 bp, Rattus norvegicus
cgccgtcgttctgcggagagcctgt

SEQ ID NO: 461318 - DNA, 25 bp, Rattus norvegicus
cttaatgctgcctgcgggctccgac

SEQ ID NO: 461319 - DNA, 25 bp, Rattus norvegicus
tggcagccctggcacacttaatgct

SEQ ID NO: 461320 - DNA, 25 bp, Rattus norvegicus
atgccgacgtgtgggcggccatccc

SEQ ID NO: 461321 - DNA, 25 bp, Rattus norvegicus
ggcggttctcccacgatgatgccga

SEQ ID NO: 461322 - DNA, 25 bp, Rattus norvegicus
tccaggagggcagccctgtttcagc

SEQ ID NO: 461323 - DNA, 25 bp, Rattus norvegicus
tgcggcagcactagcagctttctga

SEQ ID NO: 461324 - DNA, 25 bp, Rattus norvegicus
accggggactctagattgtggccag

SEQ ID NO: 461325 - DNA, 25 bp, Rattus norvegicus
tgctccgctagcaaccgcgaccttc

SEQ ID NO: 461326 - DNA, 25 bp, Rattus norvegicus
tcctcgctgcgaggggtccgctctg

SEQ ID NO: 461327 - DNA, 25 bp, Rattus norvegicus
ggggcagcgattctcctcgctgcga

SEQ ID NO: 461328 - DNA, 25 bp, Rattus norvegicus
cgcccgaggcccgttgaatgggcca

SEQ ID NO: 461329 - DNA, 25 bp, Rattus norvegicus
actgaacgcccgaggcccgttgaat

SEQ ID NO: 461330 - DNA, 25 bp, Rattus norvegicus
cgccagcagtgtgaatcagtgcaga

SEQ ID NO: 461331 - DNA, 25 bp, Rattus norvegicus
gagcgcgccagcagtgtgaatcagt

SEQ ID NO: 461332 - DNA, 25 bp, Rattus norvegicus
cagccataggtatttgcgcagggag

SEQ ID NO: 461333 - DNA, 25 bp, Rattus norvegicus
ctgcacgccgcagccataggtattt

SEQ ID NO: 461334 - DNA, 25 bp, Rattus norvegicus
agagccagtgctcggcacctgcacg

SEQ ID NO: 461335 - DNA, 25 bp, Rattus norvegicus
taccttagaggcagagccagtgctc

SEQ ID NO: 461336 - DNA, 25 bp, Rattus norvegicus
ttcccaccgtgacgcagcggtgaaa

SEQ ID NO: 461337 - DNA, 25 bp, Rattus norvegicus
gtcgggcacgcaatgtaccttagag

SEQ ID NO: 461338 - DNA, 25 bp, Rattus norvegicus
atcccttccatttggcgcggctagc

SEQ ID NO: 461339 - DNA, 25 bp, Rattus norvegicus
gcgagaatacgaaccgggcacagta

SEQ ID NO: 461340 - DNA, 25 bp, Rattus norvegicus
ggcacagtagagcacccgctgctgt

SEQ ID NO: 461341 - DNA, 25 bp, Rattus norvegicus
tccgccttccgattggctgcgcatg

SEQ ID NO: 461342 - DNA, 25 bp, Rattus norvegicus
cgctcagcgccagttttgtgacgtc

SEQ ID NO: 461343 - DNA, 25 bp, Rattus norvegicus
cgtcacggaggtcagacaatccctt

SEQ ID NO: 461344 - DNA, 25 bp, Rattus norvegicus
ggctagcctattggttccacgcgtg

SEQ ID NO: 461345 - DNA, 25 bp, Rattus norvegicus
tggctcagagatgaggaagcacctg

SEQ ID NO: 461346 - DNA, 25 bp, Rattus norvegicus
atccagcatctctgtgcgcgtggcg

SEQ ID NO: 461347 - DNA, 25 bp, Rattus norvegicus
tggcctaagggccaagcctctattg

SEQ ID NO: 461348 - DNA, 25 bp, Rattus norvegicus
tagaccgcgggaacaaacataagtg

SEQ ID NO: 461349 - DNA, 25 bp, Rattus norvegicus
cggtggatgtgtctcgcttcattca

SEQ ID NO: 461350 - DNA, 25 bp, Rattus norvegicus
ttgcgaccgaggttccgcgcgcact

SEQ ID NO: 461351 - DNA, 25 bp, Rattus norvegicus
acagctttggttgggctgcgttttg

SEQ ID NO: 461352 - DNA, 25 bp, Rattus norvegicus
cgcaaagttcacgtgagcacgggtg

SEQ ID NO: 461353 - DNA, 25 bp, Rattus norvegicus
ccctggatgcgcaaagttcacgtga

SEQ ID NO: 461354 - DNA, 25 bp, Rattus norvegicus
cgcgtgcaaagagcccgtcgtctac

SEQ ID NO: 461355 - DNA, 25 bp, Rattus norvegicus
actccgcgtgcaaagagcccgtcgt

SEQ ID NO: 461356 - DNA, 25 bp, Rattus norvegicus
atcccagcccgtcccactccgcgtg

SEQ ID NO: 461357 - DNA, 25 bp, Rattus norvegicus
gggctcccgtgcagtcaacagccgg

SEQ ID NO: 461358 - DNA, 25 bp, Rattus norvegicus
gccagaggcgagagagcggcttcca

SEQ ID NO: 461359 - DNA, 25 bp, Rattus norvegicus
ccagcgaccactcgccggggtacta

SEQ ID NO: 461360 - DNA, 25 bp, Rattus norvegicus
agagcgattacctacccagcgacca

SEQ ID NO: 461361 - DNA, 25 bp, Rattus norvegicus
gcgaggagtattcacagagcgatta

SEQ ID NO: 461362 - DNA, 25 bp, Rattus norvegicus
agttccctccgtgcgaggagtattc

SEQ ID NO: 461363 - DNA, 25 bp, Rattus norvegicus
cactgtgcagcgctacgcggcctgc

SEQ ID NO: 461364 - DNA, 25 bp, Rattus norvegicus
ttcacagagcgattacctacccagc

SEQ ID NO: 461365 - DNA, 25 bp, Rattus norvegicus
cctccgtgcgaggagtattcacaga

SEQ ID NO: 461366 - DNA, 25 bp, Rattus norvegicus
tagctttaaagtgttccggccagcc

SEQ ID NO: 461367 - DNA, 25 bp, Rattus norvegicus
agctgccgcacatctgtaggaaggc

SEQ ID NO: 461368 - DNA, 25 bp, Rattus norvegicus
ttccagctgccgcacatctgtagga

SEQ ID NO: 461369 - DNA, 25 bp, Rattus norvegicus
ttctctaggccaaacgcccggcgcc

SEQ ID NO: 461370 - DNA, 25 bp, Rattus norvegicus
cattgtgctgggcgcacaaagcggc

SEQ ID NO: 461371 - DNA, 25 bp, Rattus norvegicus
cagccgagtgttaagggcattgtgc

SEQ ID NO: 461372 - DNA, 25 bp, Rattus norvegicus
acaaaaggagcagccgagtgttaag

SEQ ID NO: 461373 - DNA, 25 bp, Rattus norvegicus
cgggaggcaccgcacaaaaggagca

SEQ ID NO: 461374 - DNA, 25 bp, Rattus norvegicus
ccacgcgccgggtagctttaaagtg

SEQ ID NO: 461375 - DNA, 25 bp, Rattus norvegicus
ctttaaagtgttccggccagccagc

SEQ ID NO: 461376 - DNA, 25 bp, Rattus norvegicus
ccgcacatctgtaggaaggccgggc

SEQ ID NO: 461377 - DNA, 25 bp, Rattus norvegicus
ggaggcaccgcacaaaaggagcagc

SEQ ID NO: 461378 - DNA, 25 bp, Rattus norvegicus
ccttgcgaatggctatggctctggg

SEQ ID NO: 461379 - DNA, 25 bp, Rattus norvegicus
cggcgcggtacaaaggcgccgcggg

SEQ ID NO: 461380 - DNA, 25 bp, Rattus norvegicus
tcgcagtgcgatcgaatggtcggta

SEQ ID NO: 461381 - DNA, 25 bp, Rattus norvegicus
atggtcggtaatgcccacttgtctc

SEQ ID NO: 461382 - DNA, 25 bp, Rattus norvegicus
gcccacttgtctccagagttctaaa

SEQ ID NO: 461383 - DNA, 25 bp, Rattus norvegicus
ctccagagttctaaacttgggccga

SEQ ID NO: 461384 - DNA, 25 bp, Rattus norvegicus
acttgggccgaacttctgcagggcg

SEQ ID NO: 461385 - DNA, 25 bp, Rattus norvegicus
tgcgacgtcacgctgtcccgagctg

SEQ ID NO: 461386 - DNA, 25 bp, Rattus norvegicus
gacagcgcacagctccgggcacttg

SEQ ID NO: 461387 - DNA, 25 bp, Rattus norvegicus
tacagtcggcgcatcggcccgctag

SEQ ID NO: 461388 - DNA, 25 bp, Rattus norvegicus
tgtacgtggccggactcaacgcgct

SEQ ID NO: 461389 - DNA, 25 bp, Rattus norvegicus
aacgcgctgttgctgcttctctacc

SEQ ID NO: 461390 - DNA, 25 bp, Rattus norvegicus
ttgaccgggacacggaccaggcaca

SEQ ID NO: 461391 - DNA, 25 bp, Rattus norvegicus
cacggacaggatgaaccggtagacc

SEQ ID NO: 461392 - DNA, 25 bp, Rattus norvegicus
acgcgcggcagcagtctcgcgagac

SEQ ID NO: 461393 - DNA, 25 bp, Rattus norvegicus
atgcgagtcttgaaccgtttctcta

SEQ ID NO: 461394 - DNA, 25 bp, Rattus norvegicus
accggggattgggtcatgaactgct

SEQ ID NO: 461395 - DNA, 25 bp, Rattus norvegicus
agccggtcttagacgatgcggccgc

SEQ ID NO: 461396 - DNA, 25 bp, Rattus norvegicus
tgctctgagccggtcttagacgatg

SEQ ID NO: 461397 - DNA, 25 bp, Rattus norvegicus
accttgctgctctgagccggtctta

SEQ ID NO: 461398 - DNA, 25 bp, Rattus norvegicus
gcgcaccttgctgctctgagccggt

SEQ ID NO: 461399 - DNA, 25 bp, Rattus norvegicus
gactcccgacgggtcgcccgcgcac

SEQ ID NO: 461400 - DNA, 25 bp, Rattus norvegicus
tgaactgctctttcctaacccggtg

SEQ ID NO: 461401 - DNA, 25 bp, Rattus norvegicus
tcgctggcgatctggaccggggatt

SEQ ID NO: 461402 - DNA, 25 bp, Rattus norvegicus
tccaggcagcgcgcgaattctgcgc

SEQ ID NO: 461403 - DNA, 25 bp, Rattus norvegicus
ttggctcacgtgttggcgccgccca

SEQ ID NO: 461404 - DNA, 25 bp, Rattus norvegicus
tcgcccgcctggttggctcacgtgt

SEQ ID NO: 461405 - DNA, 25 bp, Rattus norvegicus
ccgcccacggtggacacagcgcggc

SEQ ID NO: 461406 - DNA, 25 bp, Rattus norvegicus
actgctctttcctaacccggtgtct

SEQ ID NO: 461407 - DNA, 25 bp, Rattus norvegicus
aattctgcgcggtggtcgctggcga

SEQ ID NO: 461408 - DNA, 25 bp, Rattus norvegicus
gacagccgacttcgcgctgggaaaa

SEQ ID NO: 461409 - DNA, 25 bp, Rattus norvegicus
cgcgctgggaaaagcaatagctgcc

SEQ ID NO: 461410 - DNA, 25 bp, Rattus norvegicus
aatagctgcccgatcgttccttagg

SEQ ID NO: 461411 - DNA, 25 bp, Rattus norvegicus
ggaagacggatgtgacctgccaccc

SEQ ID NO: 461412 - DNA, 25 bp, Rattus norvegicus
cgagaggcagggctgatcgattaaa

SEQ ID NO: 461413 - DNA, 25 bp, Rattus norvegicus
gcagggctgatcgattaaagttgcc

SEQ ID NO: 461414 - DNA, 25 bp, Rattus norvegicus
aaagttgcctggctccttgcgtgca

SEQ ID NO: 461415 - DNA, 25 bp, Rattus norvegicus
tccttgcgtgcaccgtgcgctgcgg

SEQ ID NO: 461416 - DNA, 25 bp, Rattus norvegicus
gctgcgggctcttcgcgcctgcgta

SEQ ID NO: 461417 - DNA, 25 bp, Rattus norvegicus
ccgccatggcgcctgtggttagtat

SEQ ID NO: 461418 - DNA, 25 bp, Rattus norvegicus
tggttagtatggctccgcgtgcgac

SEQ ID NO: 461419 - DNA, 25 bp, Rattus norvegicus
actgcgctttgcagcgtcaggccct

SEQ ID NO: 461420 - DNA, 25 bp, Rattus norvegicus
gctgcagactggatatcgccggagc

SEQ ID NO: 461421 - DNA, 25 bp, Rattus norvegicus
ccgatcgttccttaggtggcaggga

SEQ ID NO: 461422 - DNA, 25 bp, Rattus norvegicus
gatgggatggggttgccacagcaac

SEQ ID NO: 461423 - DNA, 25 bp, Rattus norvegicus
tcacaatccgggcatgtgtgccgcc

SEQ ID NO: 461424 - DNA, 25 bp, Rattus norvegicus
cccaagtcccttcgcgggcagggtg

SEQ ID NO: 461425 - DNA, 25 bp, Rattus norvegicus
gcaaccagactggacgtcacaatcc

SEQ ID NO: 461426 - DNA, 25 bp, Rattus norvegicus
aactagtcgcgctggcggaacgatg

SEQ ID NO: 461427 - DNA, 25 bp, Rattus norvegicus
ctgttaactagtcgcgctggcggaa

SEQ ID NO: 461428 - DNA, 25 bp, Rattus norvegicus
tccgctgttaactagtcgcgctggc

SEQ ID NO: 461429 - DNA, 25 bp, Rattus norvegicus
gcgctcacccagctgcccaagacta

SEQ ID NO: 461430 - DNA, 25 bp, Rattus norvegicus
cagccagctctgctgtcgtgtcttg

SEQ ID NO: 461431 - DNA, 25 bp, Rattus norvegicus
caacagctggctggccctgcctggg

SEQ ID NO: 461432 - DNA, 25 bp, Rattus norvegicus
gtggcaacagctggctggccctgcc

SEQ ID NO: 461433 - DNA, 25 bp, Rattus norvegicus
tcccttcgcgggcagggtggcaaca

SEQ ID NO: 461434 - DNA, 25 bp, Rattus norvegicus
ccaacttgttctccgctgttaacta

SEQ ID NO: 461435 - DNA, 25 bp, Rattus norvegicus
ctggacgtcacaatccgggcatgtg

SEQ ID NO: 461436 - DNA, 25 bp, Rattus norvegicus
gaagctctccatgttcctggcctga

SEQ ID NO: 461437 - DNA, 25 bp, Rattus norvegicus
tcgcggtcctcctcggatgtcctgg

SEQ ID NO: 461438 - DNA, 25 bp, Rattus norvegicus
tggcatctgctgcttacgctccgca

SEQ ID NO: 461439 - DNA, 25 bp, Rattus norvegicus
tgcgagtcacaacaaagccatggcc

SEQ ID NO: 461440 - DNA, 25 bp, Rattus norvegicus
ccgaaaatattcactgcgagtcaca

SEQ ID NO: 461441 - DNA, 25 bp, Rattus norvegicus
cgctctgcgcttgtggatttccaaa

SEQ ID NO: 461442 - DNA, 25 bp, Rattus norvegicus
cagtctgagtggcatctgctgctta

SEQ ID NO: 461443 - DNA, 25 bp, Rattus norvegicus
tgcagctccagggtgtccgtctggc

SEQ ID NO: 461444 - DNA, 25 bp, Rattus norvegicus
ccgtgcatttggaggaagctctcca

SEQ ID NO: 461445 - DNA, 25 bp, Rattus norvegicus
ggatgtcctggggactccttaccca

SEQ ID NO: 461446 - DNA, 25 bp, Rattus norvegicus
accggatgcagggtccagtctgagt

SEQ ID NO: 461447 - DNA, 25 bp, Rattus norvegicus
atatttcatgcctgtgcgctgggcg

SEQ ID NO: 461448 - DNA, 25 bp, Rattus norvegicus
ccgtccagggaaaggccgtgcattt

SEQ ID NO: 461449 - DNA, 25 bp, Rattus norvegicus
gcccagcccttaccgatatttcatg

SEQ ID NO: 461450 - DNA, 25 bp, Rattus norvegicus
ccagcggtggactgaaccaagtacg

SEQ ID NO: 461451 - DNA, 25 bp, Rattus norvegicus
cagcatctttacctcgtgggacgcc

SEQ ID NO: 461452 - DNA, 25 bp, Rattus norvegicus
attcacgccagtcacagtctcattg

SEQ ID NO: 461453 - DNA, 25 bp, Rattus norvegicus
gtggccttcggagtccatgcaaatc

SEQ ID NO: 461454 - DNA, 25 bp, Rattus norvegicus
tccgcgcgcgtagagtcagaatcat

SEQ ID NO: 461455 - DNA, 25 bp, Rattus norvegicus
gatctcgtgcccgtctcctaggtaa

SEQ ID NO: 461456 - DNA, 25 bp, Rattus norvegicus
ggggctgcatatgttatctcacgga

SEQ ID NO: 461457 - DNA, 25 bp, Rattus norvegicus
cggacgatctggtgtttgcaaggca

SEQ ID NO: 461458 - DNA, 25 bp, Rattus norvegicus
ccctcgtatcatcattggtgcattc

SEQ ID NO: 461459 - DNA, 25 bp, Rattus norvegicus
tgcattccggttgccagctgaagtt

SEQ ID NO: 461460 - DNA, 25 bp, Rattus norvegicus
tgctgggattccttcggttagtcta

SEQ ID NO: 461461 - DNA, 25 bp, Rattus norvegicus
aaaccgatgctgtgagctcgccaga

SEQ ID NO: 461462 - DNA, 25 bp, Rattus norvegicus
cacagtctggtgtacgcgcctctat

SEQ ID NO: 461463 - DNA, 25 bp, Rattus norvegicus
tggccgcgctaccttgacgtaaaag

SEQ ID NO: 461464 - DNA, 25 bp, Rattus norvegicus
cgtgtggtgcatcgccttccagtaa

SEQ ID NO: 461465 - DNA, 25 bp, Rattus norvegicus
gcaaatccatactccgtgcctggga

SEQ ID NO: 461466 - DNA, 25 bp, Rattus norvegicus
catactccgtgcctgggaaacgctc

SEQ ID NO: 461467 - DNA, 25 bp, Rattus norvegicus
cgtgcctgggaaacgctctgtggac

SEQ ID NO: 461468 - DNA, 25 bp, Rattus norvegicus
aacgctctgtggacggagcagcagc

SEQ ID NO: 461469 - DNA, 25 bp, Rattus norvegicus
ctctgtggacggagcagcagcagca

SEQ ID NO: 461470 - DNA, 25 bp, Rattus norvegicus
tgggtgcgagccttcgaatgagtca

SEQ ID NO: 461471 - DNA, 25 bp, Rattus norvegicus
gcgagccttcgaatgagtcagcatc

SEQ ID NO: 461472 - DNA, 25 bp, Rattus norvegicus
gccttcgaatgagtcagcatcgtca

SEQ ID NO: 461473 - DNA, 25 bp, Rattus norvegicus
agtcagcatcgtcatggccaccgca

SEQ ID NO: 461474 - DNA, 25 bp, Rattus norvegicus
atccatcgtgtggtgcatcgccttc

SEQ ID NO: 461475 - DNA, 25 bp, Rattus norvegicus
gtgcatcgccttccagtaacggaca

SEQ ID NO: 461476 - DNA, 25 bp, Rattus norvegicus
ttccagtaacggacagaagcatccc

SEQ ID NO: 461477 - DNA, 25 bp, Rattus norvegicus
cgactcactcgcatccatcgtgtgg

SEQ ID NO: 461478 - DNA, 25 bp, Rattus norvegicus
ccttgggaggacacgtgacggcaga

SEQ ID NO: 461479 - DNA, 25 bp, Rattus norvegicus
agacccttgggaggacacgtgacgg

SEQ ID NO: 461480 - DNA, 25 bp, Rattus norvegicus
caagacccttgggaggacacgtgac

SEQ ID NO: 461481 - DNA, 25 bp, Rattus norvegicus
aagacccttgggaggacacgtgacg

SEQ ID NO: 461482 - DNA, 25 bp, Rattus norvegicus
ggcaagacccgtgggaggacacgtg

SEQ ID NO: 461483 - DNA, 25 bp, Rattus norvegicus
ggaggacacgtgacggcagaggcaa

SEQ ID NO: 461484 - DNA, 25 bp, Rattus norvegicus
agaggcaagacccttgggaggacac

SEQ ID NO: 461485 - DNA, 25 bp, Rattus norvegicus
acacgtgacggcagaggcaagaccc

SEQ ID NO: 461486 - DNA, 25 bp, Rattus norvegicus
aggcaagacccttgggaggacacgt

SEQ ID NO: 461487 - DNA, 25 bp, Rattus norvegicus
acccttgggaggacacgtgacggca

SEQ ID NO: 461488 - DNA, 25 bp, Rattus norvegicus
gacacgtgacggcagaggcaagacc

SEQ ID NO: 461489 - DNA, 25 bp, Rattus norvegicus
acgtgacggcagaggcaagacccgt

SEQ ID NO: 461490 - DNA, 25 bp, Rattus norvegicus
cgtgacggcagaggcaagacccttg

SEQ ID NO: 461491 - DNA, 25 bp, Rattus norvegicus
acgtgacggcagaggcaagaccctt

SEQ ID NO: 461492 - DNA, 25 bp, Rattus norvegicus
cggaaggcacgcgtaagttgagtct

SEQ ID NO: 461493 - DNA, 25 bp, Rattus norvegicus
taatagaatctgctcgcggtgtgtg

SEQ ID NO: 461494 - DNA, 25 bp, Rattus norvegicus
gtctcacactcatgactccgcgtgg

SEQ ID NO: 461495 - DNA, 25 bp, Rattus norvegicus
ctccgcgtggatcgctaatcaaatc

SEQ ID NO: 461496 - DNA, 25 bp, Rattus norvegicus
tggatcgctaatcaaatcacggtga

SEQ ID NO: 461497 - DNA, 25 bp, Rattus norvegicus
caaatcacggtgaagccgatgccga

SEQ ID NO: 461498 - DNA, 25 bp, Rattus norvegicus
agccgatgccgagtgcctcttatta

SEQ ID NO: 461499 - DNA, 25 bp, Rattus norvegicus
gcacgcgtaagttgagtctcacact

SEQ ID NO: 461500 - DNA, 25 bp, Rattus norvegicus
gcctcttattagcagtaacggtatt

SEQ ID NO: 461501 - DNA, 25 bp, Rattus norvegicus
tcgcggtgtgtgatggcgcttctaa

SEQ ID NO: 461502 - DNA, 25 bp, Rattus norvegicus
ggcgcttctaagtacttctgtcacg

SEQ ID NO: 461503 - DNA, 25 bp, Rattus norvegicus
gcttccgggagcatctgtcgttccc

SEQ ID NO: 461504 - DNA, 25 bp, Rattus norvegicus
cttctgtcacgccagcttccgggag

SEQ ID NO: 461505 - DNA, 25 bp, Rattus norvegicus
gccgagtgcctcttattagcagtaa

SEQ ID NO: 461506 - DNA, 25 bp, Rattus norvegicus
actgcgaacaccgaagggggtatgc

SEQ ID NO: 461507 - DNA, 25 bp, Rattus norvegicus
ggttccaaaatcggcgcatgaagtg

SEQ ID NO: 461508 - DNA, 25 bp, Rattus norvegicus
ccggaccgcctacactcgccagcag

SEQ ID NO: 461509 - DNA, 25 bp, Rattus norvegicus
tcgccagcaggtcctggaactggag

SEQ ID NO: 461510 - DNA, 25 bp, Rattus norvegicus
ccagcaggtcctggaactggagaag

SEQ ID NO: 461511 - DNA, 25 bp, Rattus norvegicus
agggtggagattgcccacgcgctct

SEQ ID NO: 461512 - DNA, 25 bp, Rattus norvegicus
gcccacgcgctctgcctgtccgagc

SEQ ID NO: 461513 - DNA, 25 bp, Rattus norvegicus
ggagcccaagcgctcccggaccgcc

SEQ ID NO: 461514 - DNA, 25 bp, Rattus norvegicus
tggaaaaaagaccacaagttgccca

SEQ ID NO: 461515 - DNA, 25 bp, Rattus norvegicus
agaccacaagttgcccaacaccaag

SEQ ID NO: 461516 - DNA, 25 bp, Rattus norvegicus
aagttgcccaacaccaagatccgct

SEQ ID NO: 461517 - DNA, 25 bp, Rattus norvegicus
caccaagatccgctcgggtggtacc

SEQ ID NO: 461518 - DNA, 25 bp, Rattus norvegicus
cccaagcaggaactcgaacttgggg

SEQ ID NO: 461519 - DNA, 25 bp, Rattus norvegicus
ccaagatccgctcgggtggtaccgc

SEQ ID NO: 461520 - DNA, 25 bp, Rattus norvegicus
tggccaggcgcaaaaaagaggaaac

SEQ ID NO: 461521 - DNA, 25 bp, Rattus norvegicus
tctccgcattgacgatgatgatggc

SEQ ID NO: 461522 - DNA, 25 bp, Rattus norvegicus
aaaatctcggagcatcgcttaggtg

SEQ ID NO: 461523 - DNA, 25 bp, Rattus norvegicus
aagtcgaatctgtcttcgaaggatc

SEQ ID NO: 461524 - DNA, 25 bp, Rattus norvegicus
tctgggaacagtgtcggatccgaca

SEQ ID NO: 461525 - DNA, 25 bp, Rattus norvegicus
tggcacagaatctgggaacagtgtc

SEQ ID NO: 461526 - DNA, 25 bp, Rattus norvegicus
ctgaaagccgatttggcacagaatc

SEQ ID NO: 461527 - DNA, 25 bp, Rattus norvegicus
cggttctggttaatctgaaagccga

SEQ ID NO: 461528 - DNA, 25 bp, Rattus norvegicus
ctagttgggcggttctggttaatct

SEQ ID NO: 461529 - DNA, 25 bp, Rattus norvegicus
cttggaacgcaaaggaccgctagtt

SEQ ID NO: 461530 - DNA, 25 bp, Rattus norvegicus
cggagcatcgcttaggtgtttcttt

SEQ ID NO: 461531 - DNA, 25 bp, Rattus norvegicus
tgggagcgtggacaaagtcgaatct

SEQ ID NO: 461532 - DNA, 25 bp, Rattus norvegicus
tgtcttcgaaggatctccgcattga

SEQ ID NO: 461533 - DNA, 25 bp, Rattus norvegicus
atccgacataggaagttggccaggc

SEQ ID NO: 461534 - DNA, 25 bp, Rattus norvegicus
caggggcgctcactcatgaggagca

SEQ ID NO: 461535 - DNA, 25 bp, Rattus norvegicus
acgtggtccggagacgccggcccat

SEQ ID NO: 461536 - DNA, 25 bp, Rattus norvegicus
cagagccgcgcgattgagactcggc

SEQ ID NO: 461537 - DNA, 25 bp, Rattus norvegicus
gacgtcaggcgcagcggcgccacaa

SEQ ID NO: 461538 - DNA, 25 bp, Rattus norvegicus
cccatgtttggtcgcgtggtgatga

SEQ ID NO: 461539 - DNA, 25 bp, Rattus norvegicus
caggggtgatgtgcacctccaccta

SEQ ID NO: 461540 - DNA, 25 bp, Rattus norvegicus
gcctcagggacgtgccctttccaaa

SEQ ID NO: 461541 - DNA, 25 bp, Rattus norvegicus
ctcactcatgaggagcaggaaggtg

SEQ ID NO: 461542 - DNA, 25 bp, Rattus norvegicus
agggacgtgccctttccaaacatgg

SEQ ID NO: 461543 - DNA, 25 bp, Rattus norvegicus
gccctttccaaacatggcagccaga

SEQ ID NO: 461544 - DNA, 25 bp, Rattus norvegicus
atcagcacggaggaagcgccccttc

SEQ ID NO: 461545 - DNA, 25 bp, Rattus norvegicus
atggcgggaacctcgctcgacttcc

SEQ ID NO: 461546 - DNA, 25 bp, Rattus norvegicus
gctttctaccggaaccagcaccgtg

SEQ ID NO: 461547 - DNA, 25 bp, Rattus norvegicus
gacgccggcccatgtttggtcgcgt

SEQ ID NO: 461548 - DNA, 25 bp, Rattus norvegicus
agcggactctggttgcactggacac

SEQ ID NO: 461549 - DNA, 25 bp, Rattus norvegicus
cacctggaagcggatacaacccttg

SEQ ID NO: 461550 - DNA, 25 bp, Rattus norvegicus
ggatacaacccttgcgcagcagctc

SEQ ID NO: 461551 - DNA, 25 bp, Rattus norvegicus
acgccgaacttgcacgagctgtgta

SEQ ID NO: 461552 - DNA, 25 bp, Rattus norvegicus
gagcaccgcgcacatcgcagagctg

SEQ ID NO: 461553 - DNA, 25 bp, Rattus norvegicus
ggggatgacccttgtaacattccga

SEQ ID NO: 461554 - DNA, 25 bp, Rattus norvegicus
cattccgacccggaactgtagtacg

SEQ ID NO: 461555 - DNA, 25 bp, Rattus norvegicus
ctgtagtacgtaggcacgacccgga

SEQ ID NO: 461556 - DNA, 25 bp, Rattus norvegicus
tctctacctaagtaggtgcaaccgg

SEQ ID NO: 461557 - DNA, 25 bp, Rattus norvegicus
gtgcaaccggaaacgtcctactaca

SEQ ID NO: 461558 - DNA, 25 bp, Rattus norvegicus
gagtctccctgacacctggccttgg

SEQ ID NO: 461559 - DNA, 25 bp, Rattus norvegicus
cagtcagccttagtgtgcggaatca

SEQ ID NO: 461560 - DNA, 25 bp, Rattus norvegicus
tgtgcggaatcaggttcgagcttcg

SEQ ID NO: 461561 - DNA, 25 bp, Rattus norvegicus
ctgtgtagagctcgcaacttgacgc

SEQ ID NO: 461562 - DNA, 25 bp, Rattus norvegicus
ggcaacgcgctggagacgctaccgc

SEQ ID NO: 461563 - DNA, 25 bp, Rattus norvegicus
ctggcgagctagtgtgttctctata

SEQ ID NO: 461564 - DNA, 25 bp, Rattus norvegicus
tctctataatcatttccggcacccg

SEQ ID NO: 461565 - DNA, 25 bp, Rattus norvegicus
taaggcgccgcactccggaagcggc

SEQ ID NO: 461566 - DNA, 25 bp, Rattus norvegicus
ccgctgctgcactacctcgaggtaa

SEQ ID NO: 461567 - DNA, 25 bp, Rattus norvegicus
tgctcgacctgtcgggcaacgcgct

SEQ ID NO: 461568 - DNA, 25 bp, Rattus norvegicus
ggtctgccgcagctacagagcctca

SEQ ID NO: 461569 - DNA, 25 bp, Rattus norvegicus
tggcagctgcggacaactgcctgcg

SEQ ID NO: 461570 - DNA, 25 bp, Rattus norvegicus
acctggcttcgctcaaggtcagtga

SEQ ID NO: 461571 - DNA, 25 bp, Rattus norvegicus
cctgctgtccctccttggaggatgt

SEQ ID NO: 461572 - DNA, 25 bp, Rattus norvegicus
tgcgtcgagactctctggcgagcta

SEQ ID NO: 461573 - DNA, 25 bp, Rattus norvegicus
aggatgtctttacctccgcagccgg

SEQ ID NO: 461574 - DNA, 25 bp, Rattus norvegicus
ccctgcttagtgagctggcagctgc

SEQ ID NO: 461575 - DNA, 25 bp, Rattus norvegicus
ctgcacagcctggtattgcggcgta

SEQ ID NO: 461576 - DNA, 25 bp, Rattus norvegicus
cgaggaggaagtagcagactcagcc

SEQ ID NO: 461577 - DNA, 25 bp, Rattus norvegicus
agggacgtgcgtccatacattgtgg

SEQ ID NO: 461578 - DNA, 25 bp, Rattus norvegicus
gaggtcagggacgtgcgtccataca

SEQ ID NO: 461579 - DNA, 25 bp, Rattus norvegicus
ccctgacagtcagggtgagcccgga

SEQ ID NO: 461580 - DNA, 25 bp, Rattus norvegicus
aggtcttgcacgtctcggagaaccc

SEQ ID NO: 461581 - DNA, 25 bp, Rattus norvegicus
tcaaggtcttgcacgtctcggagaa

SEQ ID NO: 461582 - DNA, 25 bp, Rattus norvegicus
tgctcaaggtcttgcacgtctcgga

SEQ ID NO: 461583 - DNA, 25 bp, Rattus norvegicus
gctgatgctcaaggtcttgcacgtc

SEQ ID NO: 461584 - DNA, 25 bp, Rattus norvegicus
cagccaggctgatgctcaaggtctt

SEQ ID NO: 461585 - DNA, 25 bp, Rattus norvegicus
gcaagggccggcaagagggctctga

SEQ ID NO: 461586 - DNA, 25 bp, Rattus norvegicus
cgtccatacattgtgggggccgtcg

SEQ ID NO: 461587 - DNA, 25 bp, Rattus norvegicus
gaagtagcagactcagccaggctga

SEQ ID NO: 461588 - DNA, 25 bp, Rattus norvegicus
ccaggctgatgctcaaggtcttgca

SEQ ID NO: 461589 - DNA, 25 bp, Rattus norvegicus
acagaaagaagaagcgggatcggaa

SEQ ID NO: 461590 - DNA, 25 bp, Rattus norvegicus
gctcaacacggacggctgtggctgt

SEQ ID NO: 461591 - DNA, 25 bp, Rattus norvegicus
gggtaggatcgcgtacagacacgta

SEQ ID NO: 461592 - DNA, 25 bp, Rattus norvegicus
tcgcgtacagacacgtacacaaggg

SEQ ID NO: 461593 - DNA, 25 bp, Rattus norvegicus
gtgtatgtgtctcctgcgtgtgccc

SEQ ID NO: 461594 - DNA, 25 bp, Rattus norvegicus
tgcgtgtgccccacagacatcgacg

SEQ ID NO: 461595 - DNA, 25 bp, Rattus norvegicus
gacatcgacgactgcgccaactctc

SEQ ID NO: 461596 - DNA, 25 bp, Rattus norvegicus
actctccgtgctgccagcaggcatg

SEQ ID NO: 461597 - DNA, 25 bp, Rattus norvegicus
tccgtgctgccagcaggcatgtgcc

SEQ ID NO: 461598 - DNA, 25 bp, Rattus norvegicus
gtatgagtgcagctgtttcgctggc

SEQ ID NO: 461599 - DNA, 25 bp, Rattus norvegicus
cagctgtttcgctggctaccggctc

SEQ ID NO: 461600 - DNA, 25 bp, Rattus norvegicus
taccggctcaacacggacggctgtg

SEQ ID NO: 461601 - DNA, 25 bp, Rattus norvegicus
cagccttggccctgttgagacggac

SEQ ID NO: 461602 - DNA, 25 bp, Rattus norvegicus
gagcgcatgccgtgcggaagcagct

SEQ ID NO: 461603 - DNA, 25 bp, Rattus norvegicus
gtttcgctggctaccggctcaacac

SEQ ID NO: 461604 - DNA, 25 bp, Rattus norvegicus
acacaggcagggcaggagtgcactt

SEQ ID NO: 461605 - DNA, 25 bp, Rattus norvegicus
cagcctcggagcctcgagcgagatt

SEQ ID NO: 461606 - DNA, 25 bp, Rattus norvegicus
cgagcgagattcctggcgcttgctc

SEQ ID NO: 461607 - DNA, 25 bp, Rattus norvegicus
cgctgcctcctctctgggctgaggg

SEQ ID NO: 461608 - DNA, 25 bp, Rattus norvegicus
atcagcggggctcttcctctgagaa

SEQ ID NO: 461609 - DNA, 25 bp, Rattus norvegicus
aaccgttgtggttcggccagcatca

SEQ ID NO: 461610 - DNA, 25 bp, Rattus norvegicus
tctggaggaccgaccgaaactgaac

SEQ ID NO: 461611 - DNA, 25 bp, Rattus norvegicus
gtggctgcgcctcttccatggctcg

SEQ ID NO: 461612 - DNA, 25 bp, Rattus norvegicus
tgccctgagcctgcaacacaggcag

SEQ ID NO: 461613 - DNA, 25 bp, Rattus norvegicus
ctccgcgaggccgtacgctagttgc

SEQ ID NO: 461614 - DNA, 25 bp, Rattus norvegicus
cttagcgcctttctcggcggaccgg

SEQ ID NO: 461615 - DNA, 25 bp, Rattus norvegicus
cgttcatgcggctagcacccgggct

SEQ ID NO: 461616 - DNA, 25 bp, Rattus norvegicus
ctggcgcaggcttagcgcctttctc

SEQ ID NO: 461617 - DNA, 25 bp, Rattus norvegicus
gctcgcccaggcctgaaagaatctg

SEQ ID NO: 461618 - DNA, 25 bp, Rattus norvegicus
cccggctggcggtggccatgaactt

SEQ ID NO: 461619 - DNA, 25 bp, Rattus norvegicus
ccggacggcaagtacctggtgagcc

SEQ ID NO: 461620 - DNA, 25 bp, Rattus norvegicus
agctctcgggcctgctctgcaggtt

SEQ ID NO: 461621 - DNA, 25 bp, Rattus norvegicus
tccgagatcctctacggctcaaagg

SEQ ID NO: 461622 - DNA, 25 bp, Rattus norvegicus
gagtcattcaagctctcgggcctgc

SEQ ID NO: 461623 - DNA, 25 bp, Rattus norvegicus
tcctctacggctcaaaggcgctcgg

SEQ ID NO: 461624 - DNA, 25 bp, Rattus norvegicus
cggtggccatgaacttctcagagtc

SEQ ID NO: 461625 - DNA, 25 bp, Rattus norvegicus
gaacctcagcgtgggcgcgcgacac

SEQ ID NO: 461626 - DNA, 25 bp, Rattus norvegicus
cgaagttcccattggctgctgctcg

SEQ ID NO: 461627 - DNA, 25 bp, Rattus norvegicus
cggccgctcgaagttcccattggct

SEQ ID NO: 461628 - DNA, 25 bp, Rattus norvegicus
taagacgcgagctcggacttcccgc

SEQ ID NO: 461629 - DNA, 25 bp, Rattus norvegicus
gtttcgcggcttgctccgagatcct

SEQ ID NO: 461630 - DNA, 25 bp, Rattus norvegicus
cctttaagacgcgagctcggacttc

SEQ ID NO: 461631 - DNA, 25 bp, Rattus norvegicus
gaacttctcagagtcattcaagctc

SEQ ID NO: 461632 - DNA, 25 bp, Rattus norvegicus
catgctctaagagttcggctctgga

SEQ ID NO: 461633 - DNA, 25 bp, Rattus norvegicus
cacgcggggcaccacttgggaataa

SEQ ID NO: 461634 - DNA, 25 bp, Rattus norvegicus
cctgttcgcaccaagaggggtcaga

SEQ ID NO: 461635 - DNA, 25 bp, Rattus norvegicus
gccacgaactccaaggcgtagctca

SEQ ID NO: 461636 - DNA, 25 bp, Rattus norvegicus
ggaagttgcttttccctgcagagtg

SEQ ID NO: 461637 - DNA, 25 bp, Rattus norvegicus
tggcctaaggcagtcggtccgcctt

SEQ ID NO: 461638 - DNA, 25 bp, Rattus norvegicus
agttcagcagggtccggagctcaaa

SEQ ID NO: 461639 - DNA, 25 bp, Rattus norvegicus
cgacccgagagaaacgcgaggatca

SEQ ID NO: 461640 - DNA, 25 bp, Rattus norvegicus
cgctcgctaggctcatgctctaaga

SEQ ID NO: 461641 - DNA, 25 bp, Rattus norvegicus
tcctgcccgagaagcgcagaccgaa

SEQ ID NO: 461642 - DNA, 25 bp, Rattus norvegicus
agcgactgggatcctctccgcacag

SEQ ID NO: 461643 - DNA, 25 bp, Rattus norvegicus
cgctcaacgcttcgctggagccgga

SEQ ID NO: 461644 - DNA, 25 bp, Rattus norvegicus
agctccgagacgaggtggccatagt

SEQ ID NO: 461645 - DNA, 25 bp, Rattus norvegicus
tcggaaaactattgcggatcccaca

SEQ ID NO: 461646 - DNA, 25 bp, Rattus norvegicus
cagcctcagaggagactggcccgcg

SEQ ID NO: 461647 - DNA, 25 bp, Rattus norvegicus
ggtttctgcgcgacttccttcgatc

SEQ ID NO: 461648 - DNA, 25 bp, Rattus norvegicus
gacttccttcgatctcccgcaaagg

SEQ ID NO: 461649 - DNA, 25 bp, Rattus norvegicus
gcaaaggcgctgatagttcggacgc

SEQ ID NO: 461650 - DNA, 25 bp, Rattus norvegicus
tccgggctgcttttgcagcgtttta

SEQ ID NO: 461651 - DNA, 25 bp, Rattus norvegicus
tgcttttgcagcgttttattgcgtt

SEQ ID NO: 461652 - DNA, 25 bp, Rattus norvegicus
gttccgaggctcaaaaacaaacagc

SEQ ID NO: 461653 - DNA, 25 bp, Rattus norvegicus
aaacaaacagccgaggcgccgccag

SEQ ID NO: 461654 - DNA, 25 bp, Rattus norvegicus
cgtcaaggccggcatcttgcccttg

SEQ ID NO: 461655 - DNA, 25 bp, Rattus norvegicus
aggccggcatcttgcccttggcgtc

SEQ ID NO: 461656 - DNA, 25 bp, Rattus norvegicus
cgcacctctgcatctccggggtggg

SEQ ID NO: 461657 - DNA, 25 bp, Rattus norvegicus
agctggggtcttttctggacactcc

SEQ ID NO: 461658 - DNA, 25 bp, Rattus norvegicus
ttctaccggcccaggtgccgctagg

SEQ ID NO: 461659 - DNA, 25 bp, Rattus norvegicus
caagcccagcctcagaggagactgg

SEQ ID NO: 461660 - DNA, 25 bp, Rattus norvegicus
gactcggtcacttctcaggccggga

SEQ ID NO: 461661 - DNA, 25 bp, Rattus norvegicus
gggccggacatatggaacccatttc

SEQ ID NO: 461662 - DNA, 25 bp, Rattus norvegicus
tcctgcagtcggaacaaagccgggg

SEQ ID NO: 461663 - DNA, 25 bp, Rattus norvegicus
ccctagtccgagaccgcacaggtaa

SEQ ID NO: 461664 - DNA, 25 bp, Rattus norvegicus
ccgtgcttctccgtggtcctgtcag

SEQ ID NO: 461665 - DNA, 25 bp, Rattus norvegicus
gaacccatttcgctggtgacattga

SEQ ID NO: 461666 - DNA, 25 bp, Rattus norvegicus
ggtcctgtcagtcgccacttctttc

SEQ ID NO: 461667 - DNA, 25 bp, Rattus norvegicus
caagctatcaggatgtggccggccc

SEQ ID NO: 461668 - DNA, 25 bp, Rattus norvegicus
cagggctcctgcagtcggaacaaag

SEQ ID NO: 461669 - DNA, 25 bp, Rattus norvegicus
actggccatcagctcttacgcgttc

SEQ ID NO: 461670 - DNA, 25 bp, Rattus norvegicus
cgctcccagggccaagctatcagga

SEQ ID NO: 461671 - DNA, 25 bp, Rattus norvegicus
cacaggtaagtgtgcggtgctcagt

SEQ ID NO: 461672 - DNA, 25 bp, Rattus norvegicus
accgagggtcccgagactggccatc

SEQ ID NO: 461673 - DNA, 25 bp, Rattus norvegicus
tgacattgaagagccgccggtgcgc

SEQ ID NO: 461674 - DNA, 25 bp, Rattus norvegicus
ctgtgagtctctcaagcctagaggc

SEQ ID NO: 461675 - DNA, 25 bp, Rattus norvegicus
gctctgcgcactgccagcctaggat

SEQ ID NO: 461676 - DNA, 25 bp, Rattus norvegicus
atgattcagtggcagactcggccgg

SEQ ID NO: 461677 - DNA, 25 bp, Rattus norvegicus
gtcgcctactacttaatgattcagt

SEQ ID NO: 461678 - DNA, 25 bp, Rattus norvegicus
acatttcgttttgtagagtcgccta

SEQ ID NO: 461679 - DNA, 25 bp, Rattus norvegicus
ctgattttgaatccgaaactacatt

SEQ ID NO: 461680 - DNA, 25 bp, Rattus norvegicus
gcccagtctactcaactgattttga

SEQ ID NO: 461681 - DNA, 25 bp, Rattus norvegicus
tggagcgaggtagcccagtctactc

SEQ ID NO: 461682 - DNA, 25 bp, Rattus norvegicus
caagcctagaggctcggaagccata

SEQ ID NO: 461683 - DNA, 25 bp, Rattus norvegicus
aagcgccaagctgtgagtctctcaa

SEQ ID NO: 461684 - DNA, 25 bp, Rattus norvegicus
ccggcagcaacgaaagcgccaagct

SEQ ID NO: 461685 - DNA, 25 bp, Rattus norvegicus
tgctcccgcttctagcgagcgcaag

SEQ ID NO: 461686 - DNA, 25 bp, Rattus norvegicus
cagcctaggatgctcccgcttctag

SEQ ID NO: 461687 - DNA, 25 bp, Rattus norvegicus
gagcgcagtgatgtccagagctatg

SEQ ID NO: 461688 - DNA, 25 bp, Rattus norvegicus
atggtcccaattacaaccacaccgg

SEQ ID NO: 461689 - DNA, 25 bp, Rattus norvegicus
cgcacaaaggcgatagagggcatga

SEQ ID NO: 461690 - DNA, 25 bp, Rattus norvegicus
agcattttgtgggttacgtttcgca

SEQ ID NO: 461691 - DNA, 25 bp, Rattus norvegicus
tcacgggccacgagatgctatcgct

SEQ ID NO: 461692 - DNA, 25 bp, Rattus norvegicus
catgctttcgagttcctgcccgtca

SEQ ID NO: 461693 - DNA, 25 bp, Rattus norvegicus
cctcattttttgaaagtctgcgtta

SEQ ID NO: 461694 - DNA, 25 bp, Rattus norvegicus
gggcaaggcctgtctctcctcctaa

SEQ ID NO: 461695 - DNA, 25 bp, Rattus norvegicus
cgccgcggaaactttctccttcttg

SEQ ID NO: 461696 - DNA, 25 bp, Rattus norvegicus
ttcaattagcggatctcgccggccc

SEQ ID NO: 461697 - DNA, 25 bp, Rattus norvegicus
ccggtgcacgctttgccttcaatta

SEQ ID NO: 461698 - DNA, 25 bp, Rattus norvegicus
tgatagcgcagaaccggtgagctcc

SEQ ID NO: 461699 - DNA, 25 bp, Rattus norvegicus
ctcctcggaggaagttcacatggtc

SEQ ID NO: 461700 - DNA, 25 bp, Rattus norvegicus
caattaatgggcgttcttccgagcc

SEQ ID NO: 461701 - DNA, 25 bp, Rattus norvegicus
tgaaactaatcttcgcgggcaaggc

SEQ ID NO: 461702 - DNA, 25 bp, Rattus norvegicus
ctgcgctcgccaagctatgcggtga

SEQ ID NO: 461703 - DNA, 25 bp, Rattus norvegicus
cggccgccactttcttccaggatgg

SEQ ID NO: 461704 - DNA, 25 bp, Rattus norvegicus
acatgctgcgggacctacatgaggc

SEQ ID NO: 461705 - DNA, 25 bp, Rattus norvegicus
tacatgaggccttcagcgagagccc

SEQ ID NO: 461706 - DNA, 25 bp, Rattus norvegicus
gaggcagttccaggccctgctgtcc

SEQ ID NO: 461707 - DNA, 25 bp, Rattus norvegicus
gaccgcgaacgcctgcaggcacagg

SEQ ID NO: 461708 - DNA, 25 bp, Rattus norvegicus
cacaggcaaaggaggccgcggacct

SEQ ID NO: 461709 - DNA, 25 bp, Rattus norvegicus
cccgcttcctggaggctgtgagaag

SEQ ID NO: 461710 - DNA, 25 bp, Rattus norvegicus
accgcgagctcttggttcccgtgac

SEQ ID NO: 461711 - DNA, 25 bp, Rattus norvegicus
ccgcctagcagagtgcctgctgctg

SEQ ID NO: 461712 - DNA, 25 bp, Rattus norvegicus
gcgggcaaccacaccggagagcacg

SEQ ID NO: 461713 - DNA, 25 bp, Rattus norvegicus
ttcctgggcgcgctagactatgtca

SEQ ID NO: 461714 - DNA, 25 bp, Rattus norvegicus
ctagactatgtcacggcttgccggc

SEQ ID NO: 461715 - DNA, 25 bp, Rattus norvegicus
tcgccaaggcctacgtgccctggaa

SEQ ID NO: 461716 - DNA, 25 bp, Rattus norvegicus
aggtcctgggcgatccagcggcaca

SEQ ID NO: 461717 - DNA, 25 bp, Rattus norvegicus
ctgggcgatccagcggcacaccatg

SEQ ID NO: 461718 - DNA, 25 bp, Rattus norvegicus
ggcacaccatgcagccgaagcgtcg

SEQ ID NO: 461719 - DNA, 25 bp, Rattus norvegicus
aagcgtcgcagaccggccaccacac

SEQ ID NO: 461720 - DNA, 25 bp, Rattus norvegicus
tgtggaccatctgctgaacccacgc

SEQ ID NO: 461721 - DNA, 25 bp, Rattus norvegicus
cacacaagctttctcctgccatagg

SEQ ID NO: 461722 - DNA, 25 bp, Rattus norvegicus
aagctttctcctgccataggctccg

SEQ ID NO: 461723 - DNA, 25 bp, Rattus norvegicus
agctccacggcctgcagaatggatc

SEQ ID NO: 461724 - DNA, 25 bp, Rattus norvegicus
ccacggcctgcagaatggatcggtc

SEQ ID NO: 461725 - DNA, 25 bp, Rattus norvegicus
ccgcagcgtgctgcttcaagcttcg

SEQ ID NO: 461726 - DNA, 25 bp, Rattus norvegicus
ttcaagcttcgcagccgactggtcg

SEQ ID NO: 461727 - DNA, 25 bp, Rattus norvegicus
actggtcgtcctcatggttcctatg

SEQ ID NO: 461728 - DNA, 25 bp, Rattus norvegicus
ggttcctatgtggaccatctgctga

SEQ ID NO: 461729 - DNA, 25 bp, Rattus norvegicus
cacatcgttttggtccaggatgccc

SEQ ID NO: 461730 - DNA, 25 bp, Rattus norvegicus
gagtaagtgccactcgcccggcgca

SEQ ID NO: 461731 - DNA, 25 bp, Rattus norvegicus
tgctcagtcccaaggagaaaaaccg

SEQ ID NO: 461732 - DNA, 25 bp, Rattus norvegicus
atcgcctccagagctccaggcatgg

SEQ ID NO: 461733 - DNA, 25 bp, Rattus norvegicus
cgctgcccgcgcctatataaggctg

SEQ ID NO: 461734 - DNA, 25 bp, Rattus norvegicus
cccgcgccaattcacaggcaattta

SEQ ID NO: 461735 - DNA, 25 bp, Rattus norvegicus
agcgaccattgtgcccgcgccaatt

SEQ ID NO: 461736 - DNA, 25 bp, Rattus norvegicus
cgggaccgcatcaacagcagcattg

SEQ ID NO: 461737 - DNA, 25 bp, Rattus norvegicus
gcgacacgcagatgaagctgcttta

SEQ ID NO: 461738 - DNA, 25 bp, Rattus norvegicus
gccgacatcctggagatggccgtca

SEQ ID NO: 461739 - DNA, 25 bp, Rattus norvegicus
atggccgtcagctacctgaagcaca

SEQ ID NO: 461740 - DNA, 25 bp, Rattus norvegicus
cctgaagcacagcaaaggtgagcta

SEQ ID NO: 461741 - DNA, 25 bp, Rattus norvegicus
accaggactacagcgagggttactc

SEQ ID NO: 461742 - DNA, 25 bp, Rattus norvegicus
tgcagttcctgaccctgcatgcagc

SEQ ID NO: 461743 - DNA, 25 bp, Rattus norvegicus
ctccaaactggagaaggccgacatc

SEQ ID NO: 461744 - DNA, 25 bp, Rattus norvegicus
cccgacgagatcttccgaaacctgg

SEQ ID NO: 461745 - DNA, 25 bp, Rattus norvegicus
ggggcggagatcattagcataattt

SEQ ID NO: 461746 - DNA, 25 bp, Rattus norvegicus
gcataatttatgcacgcggtcgttt

SEQ ID NO: 461747 - DNA, 25 bp, Rattus norvegicus
cgcggtcgtttagcagtcaattata

SEQ ID NO: 461748 - DNA, 25 bp, Rattus norvegicus
gcgcatatatttccatggctgatga

SEQ ID NO: 461749 - DNA, 25 bp, Rattus norvegicus
gctggccgggcactttcaaaatggc

SEQ ID NO: 461750 - DNA, 25 bp, Rattus norvegicus
cagcgtctaggtgcaggatcgagcc

SEQ ID NO: 461751 - DNA, 25 bp, Rattus norvegicus
ttccgaaacctggagaacgccaagc

SEQ ID NO: 461752 - DNA, 25 bp, Rattus norvegicus
cgccaagcgcttcgccattgatata

SEQ ID NO: 461753 - DNA, 25 bp, Rattus norvegicus
tgatataggtagacacggacccggt

SEQ ID NO: 461754 - DNA, 25 bp, Rattus norvegicus
ggtgcgggccatgcgcacagcctca

SEQ ID NO: 461755 - DNA, 25 bp, Rattus norvegicus
gccgcacagcctcttgggactgata

SEQ ID NO: 461756 - DNA, 25 bp, Rattus norvegicus
actgatagtgtgtgtgcagcgtcta

SEQ ID NO: 461757 - DNA, 25 bp, Rattus norvegicus
gtctggacaagagcatcacgctgcc

SEQ ID NO: 461758 - DNA, 25 bp, Rattus norvegicus
tctgcgtggccggagccttggacca

SEQ ID NO: 461759 - DNA, 25 bp, Rattus norvegicus
gagcgcttcccacatctcgaggctg

SEQ ID NO: 461760 - DNA, 25 bp, Rattus norvegicus
acatgcgcacccgtgcccaaagggg

SEQ ID NO: 461761 - DNA, 25 bp, Rattus norvegicus
cagccctgcgtctgcagcaacagga

SEQ ID NO: 461762 - DNA, 25 bp, Rattus norvegicus
tctgcagcaacaggagcggcaccta

SEQ ID NO: 461763 - DNA, 25 bp, Rattus norvegicus
agcggcacctactgtgcttctgcgg

SEQ ID NO: 461764 - DNA, 25 bp, Rattus norvegicus
tggtcagtggcctggctctgactga

SEQ ID NO: 461765 - DNA, 25 bp, Rattus norvegicus
ctggctctgactgaggctaaggctc

SEQ ID NO: 461766 - DNA, 25 bp, Rattus norvegicus
gctccgaggacatcgctttgccagg

SEQ ID NO: 461767 - DNA, 25 bp, Rattus norvegicus
atcgctttgccagggctggcgaccc

SEQ ID NO: 461768 - DNA, 25 bp, Rattus norvegicus
cgttcggcgctgtgacactgagccc

SEQ ID NO: 461769 - DNA, 25 bp, Rattus norvegicus
cgaggagcgcgctgtcactcgtgcc

SEQ ID NO: 461770 - DNA, 25 bp, Rattus norvegicus
cgccgcaaccaaagtactctttctg

SEQ ID NO: 461771 - DNA, 25 bp, Rattus norvegicus
cgggcaagcgcaacgcgcagagact

SEQ ID NO: 461772 - DNA, 25 bp, Rattus norvegicus
gcggtgcgagctcaccgaccgagta

SEQ ID NO: 461773 - DNA, 25 bp, Rattus norvegicus
cgcctccacggatatcacgcctagg

SEQ ID NO: 461774 - DNA, 25 bp, Rattus norvegicus
ttcgccctcgtggtctttgcggcct

SEQ ID NO: 461775 - DNA, 25 bp, Rattus norvegicus
gaggtacgtcgagcgtcacaggccc

SEQ ID NO: 461776 - DNA, 25 bp, Rattus norvegicus
tcaccgaccgagtagagccatggcg

SEQ ID NO: 461777 - DNA, 25 bp, Rattus norvegicus
agccatggcgcaggcgggtcctcca

SEQ ID NO: 461778 - DNA, 25 bp, Rattus norvegicus
aggcgggtcctccagaagtgatccg

SEQ ID NO: 461779 - DNA, 25 bp, Rattus norvegicus
ctccagaagtgatccgggcggcgca

SEQ ID NO: 461780 - DNA, 25 bp, Rattus norvegicus
cggcgcagaaggacgagtactacct

SEQ ID NO: 461781 - DNA, 25 bp, Rattus norvegicus
acgagtactacctgggaggcctgcg

SEQ ID NO: 461782 - DNA, 25 bp, Rattus norvegicus
agaccggcggcagctccaaagctcg

SEQ ID NO: 461783 - DNA, 25 bp, Rattus norvegicus
gcggcagctccaaagctcgttagga

SEQ ID NO: 461784 - DNA, 25 bp, Rattus norvegicus
agctccaaagctcgttaggaaagcg

SEQ ID NO: 461785 - DNA, 25 bp, Rattus norvegicus
ccacgacagaggtacgtcgagcgtc

SEQ ID NO: 461786 - DNA, 25 bp, Rattus norvegicus
tttccgcttccggtatggacgccga

SEQ ID NO: 461787 - DNA, 25 bp, Rattus norvegicus
tctggcttaattcctacacgtgtgc

SEQ ID NO: 461788 - DNA, 25 bp, Rattus norvegicus
cgacgcgtttgctttgaatattatg

SEQ ID NO: 461789 - DNA, 25 bp, Rattus norvegicus
cattgccgtcctcaggctccggaaa

SEQ ID NO: 461790 - DNA, 25 bp, Rattus norvegicus
cggaaatgcgccgtactgcacaggc

SEQ ID NO: 461791 - DNA, 25 bp, Rattus norvegicus
ccgagactgcgaccgcgaaacggta

SEQ ID NO: 461792 - DNA, 25 bp, Rattus norvegicus
ttcgcgttctccacaggcgtggtcc

SEQ ID NO: 461793 - DNA, 25 bp, Rattus norvegicus
acatgccgcccggatctgtgaggac

SEQ ID NO: 461794 - DNA, 25 bp, Rattus norvegicus
tgtgaggacgacaacaggccacctt

SEQ ID NO: 461795 - DNA, 25 bp, Rattus norvegicus
aggccaccttcttccgaagccagga

SEQ ID NO: 461796 - DNA, 25 bp, Rattus norvegicus
tcgccagtatcaaaggcgctgcctg

SEQ ID NO: 461797 - DNA, 25 bp, Rattus norvegicus
ccgcccatggccttgacagtacaga

SEQ ID NO: 461798 - DNA, 25 bp, Rattus norvegicus
atattatggtcacctggccacgccc

SEQ ID NO: 461799 - DNA, 25 bp, Rattus norvegicus
atccgggaagctgcacaggcacttc

SEQ ID NO: 461800 - DNA, 25 bp, Rattus norvegicus
aattgaagcggacgccgcgcggttc

SEQ ID NO: 461801 - DNA, 25 bp, Rattus norvegicus
cgcggttcctctggccggtctgccc

SEQ ID NO: 461802 - DNA, 25 bp, Rattus norvegicus
ggcgccgcagctttaaacagtggtc

SEQ ID NO: 461803 - DNA, 25 bp, Rattus norvegicus
cgcagctttaaacagtggtcttttt

SEQ ID NO: 461804 - DNA, 25 bp, Rattus norvegicus
ttcctttgccttcaaggaggggaga

SEQ ID NO: 461805 - DNA, 25 bp, Rattus norvegicus
tgccttcaaggaggggagatttctc

SEQ ID NO: 461806 - DNA, 25 bp, Rattus norvegicus
agatttctcgcctgccgctcgcgct

SEQ ID NO: 461807 - DNA, 25 bp, Rattus norvegicus
ccgagtgaattgaagcggacgccgc

SEQ ID NO: 461808 - DNA, 25 bp, Rattus norvegicus
cgcactaaagccgagtgaattgaag

SEQ ID NO: 461809 - DNA, 25 bp, Rattus norvegicus
gcacctttcggtctgctatttttcc

SEQ ID NO: 461810 - DNA, 25 bp, Rattus norvegicus
gagtctcccagcacctttcggtctg

SEQ ID NO: 461811 - DNA, 25 bp, Rattus norvegicus
gattctcggcgagccgagtctccca

SEQ ID NO: 461812 - DNA, 25 bp, Rattus norvegicus
cccggagctggattctcggcgagcc

SEQ ID NO: 461813 - DNA, 25 bp, Rattus norvegicus
cttcaaggaggggagatttctcgcc

SEQ ID NO: 461814 - DNA, 25 bp, Rattus norvegicus
aatgattccgcaggctgggaccgcg

SEQ ID NO: 461815 - DNA, 25 bp, Rattus norvegicus
ggttccagggcgtctctctgccgcg

SEQ ID NO: 461816 - DNA, 25 bp, Rattus norvegicus
cgcggcggttccagggcgtctctct

SEQ ID NO: 461817 - DNA, 25 bp, Rattus norvegicus
ctagcagagcttcggaccactgccg

SEQ ID NO: 461818 - DNA, 25 bp, Rattus norvegicus
cctgcaggagcctagcagagcttcg

SEQ ID NO: 461819 - DNA, 25 bp, Rattus norvegicus
ccaggaatgattccgcaggctggga

SEQ ID NO: 461820 - DNA, 25 bp, Rattus norvegicus
ccggacttggggtccaggaatgatt

SEQ ID NO: 461821 - DNA, 25 bp, Rattus norvegicus
ccgagctccctcctcgcagccggaa

SEQ ID NO: 461822 - DNA, 25 bp, Rattus norvegicus
gatccggaacccgaggactctggcc

SEQ ID NO: 461823 - DNA, 25 bp, Rattus norvegicus
tctgagaccgatccggaacccgagg

SEQ ID NO: 461824 - DNA, 25 bp, Rattus norvegicus
acgcacgctctgagaccgatccgga

SEQ ID NO: 461825 - DNA, 25 bp, Rattus norvegicus
gcagaccacgaacgcacgctctgag

SEQ ID NO: 461826 - DNA, 25 bp, Rattus norvegicus
ttccctcctcctggaggagtgctgc

SEQ ID NO: 461827 - DNA, 25 bp, Rattus norvegicus
agcctagcagagcttcggaccactg

SEQ ID NO: 461828 - DNA, 25 bp, Rattus norvegicus
gggcaggctcttccaagaacgcgcg

SEQ ID NO: 461829 - DNA, 25 bp, Rattus norvegicus
cccgggctcagtggcattcggctac

SEQ ID NO: 461830 - DNA, 25 bp, Rattus norvegicus
gggaagactccggtcctgctgccac

SEQ ID NO: 461831 - DNA, 25 bp, Rattus norvegicus
cttcctgcgcggctgggaagactcc

SEQ ID NO: 461832 - DNA, 25 bp, Rattus norvegicus
cccacaggtcgactccgctcgggtt

SEQ ID NO: 461833 - DNA, 25 bp, Rattus norvegicus
aagctcggctttgtccgcccacagg

SEQ ID NO: 461834 - DNA, 25 bp, Rattus norvegicus
ccgaactcggccaagctcggctttg

SEQ ID NO: 461835 - DNA, 25 bp, Rattus norvegicus
ccaggaatgtgaccagctctgggca

SEQ ID NO: 461836 - DNA, 25 bp, Rattus norvegicus
tgtgcgtccgcctcagccggagtgc

SEQ ID NO: 461837 - DNA, 25 bp, Rattus norvegicus
ccgcgttgtttgttgctgtgcgtcc

SEQ ID NO: 461838 - DNA, 25 bp, Rattus norvegicus
cgcctcccgcgttgtttgttgctgt

SEQ ID NO: 461839 - DNA, 25 bp, Rattus norvegicus
agcgcacatctttccggcggctcgc

SEQ ID NO: 461840 - DNA, 25 bp, Rattus norvegicus
gggttttgcgcgctcagcgcacatc

SEQ ID NO: 461841 - DNA, 25 bp, Rattus norvegicus
ggcattcggctacgcccggaccgaa

SEQ ID NO: 461842 - DNA, 25 bp, Rattus norvegicus
gagcggcctcctgggctctgtaccg

SEQ ID NO: 461843 - DNA, 25 bp, Rattus norvegicus
tgaggaccggtcggcccgcagactc

SEQ ID NO: 461844 - DNA, 25 bp, Rattus norvegicus
ccgcagactctctcggccgcggagc

SEQ ID NO: 461845 - DNA, 25 bp, Rattus norvegicus
tccgccggcctgcacgacgaggcct

SEQ ID NO: 461846 - DNA, 25 bp, Rattus norvegicus
gcctcgggtggttaccggtcatcca

SEQ ID NO: 461847 - DNA, 25 bp, Rattus norvegicus
gggtggttaccggtcatccagatta

SEQ ID NO: 461848 - DNA, 25 bp, Rattus norvegicus
gttaccggtcatccagattacgcct

SEQ ID NO: 461849 - DNA, 25 bp, Rattus norvegicus
tccagattacgcctcaacatcttgc

SEQ ID NO: 461850 - DNA, 25 bp, Rattus norvegicus
ttacgcctcaacatcttgcctttcg

SEQ ID NO: 461851 - DNA, 25 bp, Rattus norvegicus
aacatcttgcctttcgcgccgccgg

SEQ ID NO: 461852 - DNA, 25 bp, Rattus norvegicus
atgggagcccaacgagcgcggctcc

SEQ ID NO: 461853 - DNA, 25 bp, Rattus norvegicus
cgccgccacttccaccgggagccga

SEQ ID NO: 461854 - DNA, 25 bp, Rattus norvegicus
ctcctgtccggcgtttccgtggcga

SEQ ID NO: 461855 - DNA, 25 bp, Rattus norvegicus
aaggagcggcctcctgggctctgta

SEQ ID NO: 461856 - DNA, 25 bp, Rattus norvegicus
gatttccagcgccacaaaagggagc

SEQ ID NO: 461857 - DNA, 25 bp, Rattus norvegicus
cgcgctactagccacgctccgcctc

SEQ ID NO: 461858 - DNA, 25 bp, Rattus norvegicus
tcgcacacgtgcatcgcgctactag

SEQ ID NO: 461859 - DNA, 25 bp, Rattus norvegicus
tagctgcggggttcctcgcacacgt

SEQ ID NO: 461860 - DNA, 25 bp, Rattus norvegicus
cgacgttcccgcctagctgcggggt

SEQ ID NO: 461861 - DNA, 25 bp, Rattus norvegicus
cgccggacgctcttaggagaaggat

SEQ ID NO: 461862 - DNA, 25 bp, Rattus norvegicus
cacttccgccggacgctcttaggag

SEQ ID NO: 461863 - DNA, 25 bp, Rattus norvegicus
tgtaagtctcacttccgccggacgc

SEQ ID NO: 461864 - DNA, 25 bp, Rattus norvegicus
ccacaaaagggagctggcacttggc

SEQ ID NO: 461865 - DNA, 25 bp, Rattus norvegicus
atctcggcgccttagatttccagcg

SEQ ID NO: 461866 - DNA, 25 bp, Rattus norvegicus
ttcccaacggttgggatctcggcgc

SEQ ID NO: 461867 - DNA, 25 bp, Rattus norvegicus
caaggcggcagcctcgtgttcccaa

SEQ ID NO: 461868 - DNA, 25 bp, Rattus norvegicus
ctgtcgcgactctccctcaaggcgg

SEQ ID NO: 461869 - DNA, 25 bp, Rattus norvegicus
gggtctggctgtaagtctcacttcc

SEQ ID NO: 461870 - DNA, 25 bp, Rattus norvegicus
gaggcatcttccgtccctttaagga

SEQ ID NO: 461871 - DNA, 25 bp, Rattus norvegicus
ctttaaggagccgatgctgcgtccc

SEQ ID NO: 461872 - DNA, 25 bp, Rattus norvegicus
tgtgcagcacgcaggctctgacaga

SEQ ID NO: 461873 - DNA, 25 bp, Rattus norvegicus
tctttatgctctaccgaaggtgggc

SEQ ID NO: 461874 - DNA, 25 bp, Rattus norvegicus
tgcctcttcagcacggaattcttta

SEQ ID NO: 461875 - DNA, 25 bp, Rattus norvegicus
ggagagtcctgccttactcaccggc

SEQ ID NO: 461876 - DNA, 25 bp, Rattus norvegicus
cacctcgggcctggtggaaaatcca

SEQ ID NO: 461877 - DNA, 25 bp, Rattus norvegicus
cgctgcattcgcgaggcctgcaacg

SEQ ID NO: 461878 - DNA, 25 bp, Rattus norvegicus
actgacttgtgctccgcagacccgg

SEQ ID NO: 461879 - DNA, 25 bp, Rattus norvegicus
gatgagacccaaagcactgacttgt

SEQ ID NO: 461880 - DNA, 25 bp, Rattus norvegicus
ctctgacagagccaagatgagaccc

SEQ ID NO: 461881 - DNA, 25 bp, Rattus norvegicus
tttcctccgacatcaccgcgagagg

SEQ ID NO: 461882 - DNA, 25 bp, Rattus norvegicus
tagtcgcgaccgtgctggaacatct

SEQ ID NO: 461883 - DNA, 25 bp, Rattus norvegicus
ctggcctccggaccgacaatgggct

SEQ ID NO: 461884 - DNA, 25 bp, Rattus norvegicus
cccgcgcttctgagacttactggag

SEQ ID NO: 461885 - DNA, 25 bp, Rattus norvegicus
gccgtactttcttagccattcgctc

SEQ ID NO: 461886 - DNA, 25 bp, Rattus norvegicus
cggaccgatctggaaagccgtactt

SEQ ID NO: 461887 - DNA, 25 bp, Rattus norvegicus
ttccagttagcttctcggccggacc

SEQ ID NO: 461888 - DNA, 25 bp, Rattus norvegicus
ggcttgtctgtctctgttccagtta

SEQ ID NO: 461889 - DNA, 25 bp, Rattus norvegicus
tgcaagcttgtctagccctcgggtc

SEQ ID NO: 461890 - DNA, 25 bp, Rattus norvegicus
ctgagcaactcatcaaagtgcaagc

SEQ ID NO: 461891 - DNA, 25 bp, Rattus norvegicus
tccgagactgcgaggagctgagcaa

SEQ ID NO: 461892 - DNA, 25 bp, Rattus norvegicus
ggtgttttcagaccctcggcgtaca

SEQ ID NO: 461893 - DNA, 25 bp, Rattus norvegicus
actggagctgttgtgccgaagaacc

SEQ ID NO: 461894 - DNA, 25 bp, Rattus norvegicus
cggccgtggcccaataatcagagta

SEQ ID NO: 461895 - DNA, 25 bp, Rattus norvegicus
gcacctgtggccaatgagggctccc

SEQ ID NO: 461896 - DNA, 25 bp, Rattus norvegicus
aacctggctgtcgagacggccaatc

SEQ ID NO: 461897 - DNA, 25 bp, Rattus norvegicus
caaacaaactcgttggaggtgcttg

SEQ ID NO: 461898 - DNA, 25 bp, Rattus norvegicus
tgcgcaccgcatagcaccgggtggt

SEQ ID NO: 461899 - DNA, 25 bp, Rattus norvegicus
aaagctcagcgttcagcaccgagga

SEQ ID NO: 461900 - DNA, 25 bp, Rattus norvegicus
cagcaccgaggacggcggacagcac

SEQ ID NO: 461901 - DNA, 25 bp, Rattus norvegicus
aggggtcctcagaactggaatagca

SEQ ID NO: 461902 - DNA, 25 bp, Rattus norvegicus
ctggaatagcagcacgcgcaaagca

SEQ ID NO: 461903 - DNA, 25 bp, Rattus norvegicus
agcacgcgcaaagcaaaactgggtg

SEQ ID NO: 461904 - DNA, 25 bp, Rattus norvegicus
cggggttctggcaactcggaactct

SEQ ID NO: 461905 - DNA, 25 bp, Rattus norvegicus
agctgctcacctggcgccatggtgc

SEQ ID NO: 461906 - DNA, 25 bp, Rattus norvegicus
ccatggtgcggctgcgtgcacagca

SEQ ID NO: 461907 - DNA, 25 bp, Rattus norvegicus
agcagccagcccagaacgtccatgg

SEQ ID NO: 461908 - DNA, 25 bp, Rattus norvegicus
cagaacgtccatggccttgcgggct

SEQ ID NO: 461909 - DNA, 25 bp, Rattus norvegicus
cccagcgcaagcaaagttgcttcgc

SEQ ID NO: 461910 - DNA, 25 bp, Rattus norvegicus
acgcgggaggcttctgcgcaccgca

SEQ ID NO: 461911 - DNA, 25 bp, Rattus norvegicus
tagcaccgggtggtagctccaccgc

SEQ ID NO: 461912 - DNA, 25 bp, Rattus norvegicus
tcccaagccctctccctaccactcc

SEQ ID NO: 461913 - DNA, 25 bp, Rattus norvegicus
cccaccggctgctgcactacgcctg

SEQ ID NO: 461914 - DNA, 25 bp, Rattus norvegicus
tgcactacgcctgcgcaaccacagc

SEQ ID NO: 461915 - DNA, 25 bp, Rattus norvegicus
tgcgcaaccacagccctgcccgcca

SEQ ID NO: 461916 - DNA, 25 bp, Rattus norvegicus
tgcccgccaaccctacacagccttc

SEQ ID NO: 461917 - DNA, 25 bp, Rattus norvegicus
tggagctgcgcgtccaaactacgca

SEQ ID NO: 461918 - DNA, 25 bp, Rattus norvegicus
tgccatggagctgcgcgtccaaact

SEQ ID NO: 461919 - DNA, 25 bp, Rattus norvegicus
tcaaacccacggtggctgaggggca

SEQ ID NO: 461920 - DNA, 25 bp, Rattus norvegicus
tcgggcagttaagaggctaaggaac

SEQ ID NO: 461921 - DNA, 25 bp, Rattus norvegicus
ttaagaggctaaggaactgatcctg

SEQ ID NO: 461922 - DNA, 25 bp, Rattus norvegicus
aaggaactgatcctgcggggccagt

SEQ ID NO: 461923 - DNA, 25 bp, Rattus norvegicus
aaccgtggccgaggatctgtttcgg

SEQ ID NO: 461924 - DNA, 25 bp, Rattus norvegicus
acacagccttccgttgccatggagc

SEQ ID NO: 461925 - DNA, 25 bp, Rattus norvegicus
cagcctcaaacccacggtggctgag

SEQ ID NO: 461926 - DNA, 25 bp, Rattus norvegicus
gcccatcctgatggctggaggcgtc

SEQ ID NO: 461927 - DNA, 25 bp, Rattus norvegicus
ttcgagcctgaatgggttgccaagg

SEQ ID NO: 461928 - DNA, 25 bp, Rattus norvegicus
ccgggtcgtatgttcgagcctgaat

SEQ ID NO: 461929 - DNA, 25 bp, Rattus norvegicus
ggtctaggccctgatgccgggccca

SEQ ID NO: 461930 - DNA, 25 bp, Rattus norvegicus
tgattctaaaggatcgaggctgttg

SEQ ID NO: 461931 - DNA, 25 bp, Rattus norvegicus
tcggttcccagacccatgattctaa

SEQ ID NO: 461932 - DNA, 25 bp, Rattus norvegicus
gcccagtgtcgggaatcggttccca

SEQ ID NO: 461933 - DNA, 25 bp, Rattus norvegicus
cggtgcatggtcttgggttcaaagc

SEQ ID NO: 461934 - DNA, 25 bp, Rattus norvegicus
tctgggttcaaagctggattccgga

SEQ ID NO: 461935 - DNA, 25 bp, Rattus norvegicus
cctggattcaaagccggatctggga

SEQ ID NO: 461936 - DNA, 25 bp, Rattus norvegicus
cagccggatcggagatgcggcaacc

SEQ ID NO: 461937 - DNA, 25 bp, Rattus norvegicus
ggggtcttagcctcaaggcctcatc

SEQ ID NO: 461938 - DNA, 25 bp, Rattus norvegicus
ccgcgggaacaaaagcccagctctg

SEQ ID NO: 461939 - DNA, 25 bp, Rattus norvegicus
ttcatcctgctcttcagggtggggc

SEQ ID NO: 461940 - DNA, 25 bp, Rattus norvegicus
catgtagacgtccacgcgggcgcgc

SEQ ID NO: 461941 - DNA, 25 bp, Rattus norvegicus
tgcgcttgcgcactgacatccgcgg

SEQ ID NO: 461942 - DNA, 25 bp, Rattus norvegicus
ttgcgcactgacatccgcggcgcag

SEQ ID NO: 461943 - DNA, 25 bp, Rattus norvegicus
cagctctgcttggtggtgccggcct

SEQ ID NO: 461944 - DNA, 25 bp, Rattus norvegicus
agggaccgctggctcggcccagcat

SEQ ID NO: 461945 - DNA, 25 bp, Rattus norvegicus
tcggcccagcatgtagacgtccacg

SEQ ID NO: 461946 - DNA, 25 bp, Rattus norvegicus
ctctgccgggcgtcacttgccggga

SEQ ID NO: 461947 - DNA, 25 bp, Rattus norvegicus
gtgctggtggcactgacgcgcctcc

SEQ ID NO: 461948 - DNA, 25 bp, Rattus norvegicus
gcctccctgcgtccgaatgtgggtt

SEQ ID NO: 461949 - DNA, 25 bp, Rattus norvegicus
gagaagccaggtaggccgccgatct

SEQ ID NO: 461950 - DNA, 25 bp, Rattus norvegicus
cgccgatctgttcctggccagttca

SEQ ID NO: 461951 - DNA, 25 bp, Rattus norvegicus
ggccagttcagcgtgcagcaccgca

SEQ ID NO: 461952 - DNA, 25 bp, Rattus norvegicus
ccacgtgctctactgcgcatgcgtg

SEQ ID NO: 461953 - DNA, 25 bp, Rattus norvegicus
tcacttgccgggacccgtggagacc

SEQ ID NO: 461954 - DNA, 25 bp, Rattus norvegicus
cgcggctaaccagttcggcgtccgg

SEQ ID NO: 461955 - DNA, 25 bp, Rattus norvegicus
tgccgcggctaaccagttcggcgtc

SEQ ID NO: 461956 - DNA, 25 bp, Rattus norvegicus
aacctgccgcggctaaccagttcgg

SEQ ID NO: 461957 - DNA, 25 bp, Rattus norvegicus
tgcttggaacctgccgcggctaacc

SEQ ID NO: 461958 - DNA, 25 bp, Rattus norvegicus
cagcccggtgtgcttggaacctgcc

SEQ ID NO: 461959 - DNA, 25 bp, Rattus norvegicus
gcccagcccggtgtgcttggaacct

SEQ ID NO: 461960 - DNA, 25 bp, Rattus norvegicus
gccaaacttgctgccgcggagctcg

SEQ ID NO: 461961 - DNA, 25 bp, Rattus norvegicus
ggtcggtttctcctcatctccttga

SEQ ID NO: 461962 - DNA, 25 bp, Rattus norvegicus
gaggctggtagctcctcgccagcca

SEQ ID NO: 461963 - DNA, 25 bp, Rattus norvegicus
gcgtccgggtcggtttctcctcatc

SEQ ID NO: 461964 - DNA, 25 bp, Rattus norvegicus
tccttgagccttgagcaggaggctg

SEQ ID NO: 461965 - DNA, 25 bp, Rattus norvegicus
tcatctccttgagccttgagcagga

SEQ ID NO: 461966 - DNA, 25 bp, Rattus norvegicus
agcggccagacagcccgccagcagc

SEQ ID NO: 461967 - DNA, 25 bp, Rattus norvegicus
agcgccaaacttgctgccgcggagc

SEQ ID NO: 461968 - DNA, 25 bp, Rattus norvegicus
agcttacccggcagatctaacgttc

SEQ ID NO: 461969 - DNA, 25 bp, Rattus norvegicus
tggagtcagcccaggtcaatttagg

SEQ ID NO: 461970 - DNA, 25 bp, Rattus norvegicus
aggctgtgcataaactccagtggca

SEQ ID NO: 461971 - DNA, 25 bp, Rattus norvegicus
actggctgtatcttccgtgagcatg

SEQ ID NO: 461972 - DNA, 25 bp, Rattus norvegicus
aatccgtaggatgtctgctagccgc

SEQ ID NO: 461973 - DNA, 25 bp, Rattus norvegicus
cccaccagtgtgtgtcccaaatcta

SEQ ID NO: 461974 - DNA, 25 bp, Rattus norvegicus
cgccagggcatcctgtgcgtcactt

SEQ ID NO: 461975 - DNA, 25 bp, Rattus norvegicus
taccgaaggtgagaatgcgccgtta

SEQ ID NO: 461976 - DNA, 25 bp, Rattus norvegicus
ccaccttggtctcgatggaacgttc

SEQ ID NO: 461977 - DNA, 25 bp, Rattus norvegicus
cttcgcggcctcagagaattggctc

SEQ ID NO: 461978 - DNA, 25 bp, Rattus norvegicus
gcgcttcgcgtactctgactttcta

SEQ ID NO: 461979 - DNA, 25 bp, Rattus norvegicus
gggtcattcgtaggttcgccattga

SEQ ID NO: 461980 - DNA, 25 bp, Rattus norvegicus
atgactgcattaggcgccgagaagg

SEQ ID NO: 461981 - DNA, 25 bp, Rattus norvegicus
ggagcctctgaagctcgaccaatga

SEQ ID NO: 461982 - DNA, 25 bp, Rattus norvegicus
ctgttgcgcctgctacattgtgcca

SEQ ID NO: 461983 - DNA, 25 bp, Rattus norvegicus
cttcatccaaagacgcctgggcgca

SEQ ID NO: 461984 - DNA, 25 bp, Rattus norvegicus
accggctccaacgtcatctcttaga

SEQ ID NO: 461985 - DNA, 25 bp, Rattus norvegicus
tctcttagagacaccctagggcggc

SEQ ID NO: 461986 - DNA, 25 bp, Rattus norvegicus
ggcgctagacgctactttgctttta

SEQ ID NO: 461987 - DNA, 25 bp, Rattus norvegicus
tgcgtcattagctgaggacacttcc

SEQ ID NO: 461988 - DNA, 25 bp, Rattus norvegicus
gacacttccggtgcgtgcaggatac

SEQ ID NO: 461989 - DNA, 25 bp, Rattus norvegicus
cgcggttcgccgtcctcataatacg

SEQ ID NO: 461990 - DNA, 25 bp, Rattus norvegicus
gtcatcagcacgcttccgcgaagga

SEQ ID NO: 461991 - DNA, 25 bp, Rattus norvegicus
agtgaggacaatcctggctcgcgcc

SEQ ID NO: 461992 - DNA, 25 bp, Rattus norvegicus
tgtttcttcccagactccaggaccg

SEQ ID NO: 461993 - DNA, 25 bp, Rattus norvegicus
ttacgacgttcctgaagaatcccgc

SEQ ID NO: 461994 - DNA, 25 bp, Rattus norvegicus
gccgcgaccagtcttgctgcacaga

SEQ ID NO: 461995 - DNA, 25 bp, Rattus norvegicus
cccgcctcaggtttgagtgattgaa

SEQ ID NO: 461996 - DNA, 25 bp, Rattus norvegicus
cgcggagagaagacacaacccgctc

SEQ ID NO: 461997 - DNA, 25 bp, Rattus norvegicus
gtccagaacacagccggcagtgccg

SEQ ID NO: 461998 - DNA, 25 bp, Rattus norvegicus
tccgcagcggagtccagaacacagc

SEQ ID NO: 461999 - DNA, 25 bp, Rattus norvegicus
tagcctgtctggaaccgtccgcatc

SEQ ID NO: 462000 - DNA, 25 bp, Rattus norvegicus
ctcaagtagtgaaccggctagcctg

SEQ ID NO: 462001 - DNA, 25 bp, Rattus norvegicus
cggaggcactggctcaagtagtgaa

SEQ ID NO: 462002 - DNA, 25 bp, Rattus norvegicus
gctcgagttacagccttatggtggg

SEQ ID NO: 462003 - DNA, 25 bp, Rattus norvegicus
gcggacggctcgagttacagcctta

SEQ ID NO: 462004 - DNA, 25 bp, Rattus norvegicus
ccgccagcccatggcagatttgcag

SEQ ID NO: 462005 - DNA, 25 bp, Rattus norvegicus
tccaggaacgccagcgcggagagaa

SEQ ID NO: 462006 - DNA, 25 bp, Rattus norvegicus
ggcgaccctagccattccaggaacg

SEQ ID NO: 462007 - DNA, 25 bp, Rattus norvegicus
gtctctgtcggcgaccctagccatt

SEQ ID NO: 462008 - DNA, 25 bp, Rattus norvegicus
gtaggggcatctattgctccgcgcg

SEQ ID NO: 462009 - DNA, 25 bp, Rattus norvegicus
gatttgcagtcgagttagggccaca

SEQ ID NO: 462010 - DNA, 25 bp, Rattus norvegicus
gttcggggtcacagttctctggata

SEQ ID NO: 462011 - DNA, 25 bp, Rattus norvegicus
acagttctctggatacgggcccagg

SEQ ID NO: 462012 - DNA, 25 bp, Rattus norvegicus
cgcagtcccgaaggttcgcaggaaa

SEQ ID NO: 462013 - DNA, 25 bp, Rattus norvegicus
cgcaggaaaggcctagccaatcaga

SEQ ID NO: 462014 - DNA, 25 bp, Rattus norvegicus
tcagagtgcagactaaaggctggcc

SEQ ID NO: 462015 - DNA, 25 bp, Rattus norvegicus
cctcgtttagccctcctggagtagg

SEQ ID NO: 462016 - DNA, 25 bp, Rattus norvegicus
cttctgagtgacagcagcgtggaca

SEQ ID NO: 462017 - DNA, 25 bp, Rattus norvegicus
cagggctggaatcgcgcttttccca

SEQ ID NO: 462018 - DNA, 25 bp, Rattus norvegicus
tccttttcgacggttctggcttctc

SEQ ID NO: 462019 - DNA, 25 bp, Rattus norvegicus
tctccctgcccggtggagactgtag

SEQ ID NO: 462020 - DNA, 25 bp, Rattus norvegicus
agactgtagatctggcccggggaac

SEQ ID NO: 462021 - DNA, 25 bp, Rattus norvegicus
cctgagcatcgggaggctcctccag

SEQ ID NO: 462022 - DNA, 25 bp, Rattus norvegicus
cagcagggcgacctccttttcgacg

SEQ ID NO: 462023 - DNA, 25 bp, Rattus norvegicus
caatgctgaggtgtgtttccggcaa

SEQ ID NO: 462024 - DNA, 25 bp, Rattus norvegicus
cgcactggaacaccaggcggatgtg

SEQ ID NO: 462025 - DNA, 25 bp, Rattus norvegicus
tgtgtagtgcgctcacacgaagatc

SEQ ID NO: 462026 - DNA, 25 bp, Rattus norvegicus
gtgcgctcacacgaagatctgaatg

SEQ ID NO: 462027 - DNA, 25 bp, Rattus norvegicus
ctcacacgaagatctgaatgcggtc

SEQ ID NO: 462028 - DNA, 25 bp, Rattus norvegicus
atctgaatgcggtcacggatgggct

SEQ ID NO: 462029 - DNA, 25 bp, Rattus norvegicus
taagggcagcgccacagggcgcaca

SEQ ID NO: 462030 - DNA, 25 bp, Rattus norvegicus
tccatggccgcactggaacaccagg

SEQ ID NO: 462031 - DNA, 25 bp, Rattus norvegicus
acaccaggcggatgtggctgtcgat

SEQ ID NO: 462032 - DNA, 25 bp, Rattus norvegicus
gcaggtgatgcgctcctccatctgc

SEQ ID NO: 462033 - DNA, 25 bp, Rattus norvegicus
tccatctgcctgtagcgactctgta

SEQ ID NO: 462034 - DNA, 25 bp, Rattus norvegicus
gcctgtagcgactctgtagctcctc

SEQ ID NO: 462035 - DNA, 25 bp, Rattus norvegicus
ctgtagctcctctaccagttgccga

SEQ ID NO: 462036 - DNA, 25 bp, Rattus norvegicus
tcctctaccagttgccgaggcgggc

SEQ ID NO: 462037 - DNA, 25 bp, Rattus norvegicus
acagggcgcacatgctccatggccg

SEQ ID NO: 462038 - DNA, 25 bp, Rattus norvegicus
ttcgggtgacgtcttgcctgaaacg

SEQ ID NO: 462039 - DNA, 25 bp, Rattus norvegicus
gacgctctctgttgccttggagaca

SEQ ID NO: 462040 - DNA, 25 bp, Rattus norvegicus
gtacaagttcccaggacgctctctg

SEQ ID NO: 462041 - DNA, 25 bp, Rattus norvegicus
ggcacgtgtctcctgcgcagtacaa

SEQ ID NO: 462042 - DNA, 25 bp, Rattus norvegicus
cctggcatccttggaacagaaagtg

SEQ ID NO: 462043 - DNA, 25 bp, Rattus norvegicus
ctggaaatacctgcgtcctggcatc

SEQ ID NO: 462044 - DNA, 25 bp, Rattus norvegicus
ccagcgggagctctgctactctaaa

SEQ ID NO: 462045 - DNA, 25 bp, Rattus norvegicus
cttgtctggtctggcagcaaactga

SEQ ID NO: 462046 - DNA, 25 bp, Rattus norvegicus
accctgagcatgacgtacttgtctg

SEQ ID NO: 462047 - DNA, 25 bp, Rattus norvegicus
tggggcatatagctaccaaggtacc

SEQ ID NO: 462048 - DNA, 25 bp, Rattus norvegicus
ccctgcgcgtgacgcaaaatgctta

SEQ ID NO: 462049 - DNA, 25 bp, Rattus norvegicus
ccgggagctgtagtttgcagagaca

SEQ ID NO: 462050 - DNA, 25 bp, Rattus norvegicus
gacctcagcctcgtcaggatgatca

SEQ ID NO: 462051 - DNA, 25 bp, Rattus norvegicus
ctgacagtggaacctcggcttgcca

SEQ ID NO: 462052 - DNA, 25 bp, Rattus norvegicus
acgccgggctgcgtaacgctggcct

SEQ ID NO: 462053 - DNA, 25 bp, Rattus norvegicus
gtggcacctatacgcgcttcccgtg

SEQ ID NO: 462054 - DNA, 25 bp, Rattus norvegicus
ccctacaaggtgctgtccgagggcc

SEQ ID NO: 462055 - DNA, 25 bp, Rattus norvegicus
tacctgctgcccgatgtgcacgaca

SEQ ID NO: 462056 - DNA, 25 bp, Rattus norvegicus
gcttcccgtgcgatcgcgtgctttt

SEQ ID NO: 462057 - DNA, 25 bp, Rattus norvegicus
tcaactgctcgtggcgtggcaccta

SEQ ID NO: 462058 - DNA, 25 bp, Rattus norvegicus
tcttcgcgctcaactgctcgtggcg

SEQ ID NO: 462059 - DNA, 25 bp, Rattus norvegicus
gcgtgcgcgtcttcgcgctcaactg

SEQ ID NO: 462060 - DNA, 25 bp, Rattus norvegicus
tgcagtggcgcctggctcctgccga

SEQ ID NO: 462061 - DNA, 25 bp, Rattus norvegicus
gtcctgcgcaatcgcagcgtgctgc

SEQ ID NO: 462062 - DNA, 25 bp, Rattus norvegicus
cccgttcggggattccgctgccaga

SEQ ID NO: 462063 - DNA, 25 bp, Rattus norvegicus
ggattccgctgccagacgccgggct

SEQ ID NO: 462064 - DNA, 25 bp, Rattus norvegicus
gtgggcgcctgtgctttcgcagccc

SEQ ID NO: 462065 - DNA, 25 bp, Rattus norvegicus
gcgactacctgctgcccgatgtgca

SEQ ID NO: 462066 - DNA, 25 bp, Rattus norvegicus
catcgctgatttccggttaccgcca

SEQ ID NO: 462067 - DNA, 25 bp, Rattus norvegicus
acatcctcaggtagtgcaagctcca

SEQ ID NO: 462068 - DNA, 25 bp, Rattus norvegicus
ccgaacctggactgactgccgcaga

SEQ ID NO: 462069 - DNA, 25 bp, Rattus norvegicus
ggccttagctgctctcaaacagatt

SEQ ID NO: 462070 - DNA, 25 bp, Rattus norvegicus
tgtagagtaagcatcccagtaaacc

SEQ ID NO: 462071 - DNA, 25 bp, Rattus norvegicus
tacacgctccgcaaatcctcagagg

SEQ ID NO: 462072 - DNA, 25 bp, Rattus norvegicus
tcggagcatggaagcacacaacatc

SEQ ID NO: 462073 - DNA, 25 bp, Rattus norvegicus
gccgcgcccagctagtcatcagaag

SEQ ID NO: 462074 - DNA, 25 bp, Rattus norvegicus
agtttccaatattgcgcaagcgccg

SEQ ID NO: 462075 - DNA, 25 bp, Rattus norvegicus
tcctgacgtttgtctttcccgtatg

SEQ ID NO: 462076 - DNA, 25 bp, Rattus norvegicus
aggccaaggtcttccgttcctgacg

SEQ ID NO: 462077 - DNA, 25 bp, Rattus norvegicus
actttgtgtctgacagctggcggcc

SEQ ID NO: 462078 - DNA, 25 bp, Rattus norvegicus
taaaccctagagatagcgtgctatg

SEQ ID NO: 462079 - DNA, 25 bp, Rattus norvegicus
atgcgggacctgtcttgcgtacttt

SEQ ID NO: 462080 - DNA, 25 bp, Rattus norvegicus
cgacacgcgtgatcacacttgtgca

SEQ ID NO: 462081 - DNA, 25 bp, Rattus norvegicus
actcctcgacctgaccggtcatggg

SEQ ID NO: 462082 - DNA, 25 bp, Rattus norvegicus
tgctaccttgcgctgccctcgccct

SEQ ID NO: 462083 - DNA, 25 bp, Rattus norvegicus
cctgaccggtcatgggctcttccag

SEQ ID NO: 462084 - DNA, 25 bp, Rattus norvegicus
tcttccaggccatcgcgtgcttgat

SEQ ID NO: 462085 - DNA, 25 bp, Rattus norvegicus
atcgcgtgcttgatggacatgaacg

SEQ ID NO: 462086 - DNA, 25 bp, Rattus norvegicus
cttgatggacatgaacgcgctgctg

SEQ ID NO: 462087 - DNA, 25 bp, Rattus norvegicus
cgcgctgctggaccgattccataac

SEQ ID NO: 462088 - DNA, 25 bp, Rattus norvegicus
gaggaccgcgtctgccactgcaact

SEQ ID NO: 462089 - DNA, 25 bp, Rattus norvegicus
ccactgcaactgtggccggtgagtg

SEQ ID NO: 462090 - DNA, 25 bp, Rattus norvegicus
ccggctctaggcacgacacgcgtga

SEQ ID NO: 462091 - DNA, 25 bp, Rattus norvegicus
gtgatcacacttgtgcagcgggccc

SEQ ID NO: 462092 - DNA, 25 bp, Rattus norvegicus
ggaccgattccataactacatcctc

SEQ ID NO: 462093 - DNA, 25 bp, Rattus norvegicus
ctgcactgccctcgctgctaccttg

SEQ ID NO: 462094 - DNA, 25 bp, Rattus norvegicus
tgccttctcccttggggcccttgat

SEQ ID NO: 462095 - DNA, 25 bp, Rattus norvegicus
ggcgcgatttgtccagcagtctaag

SEQ ID NO: 462096 - DNA, 25 bp, Rattus norvegicus
cgccattggcatcggaggcgcgatt

SEQ ID NO: 462097 - DNA, 25 bp, Rattus norvegicus
gtgactctcgggactactagcaatc

SEQ ID NO: 462098 - DNA, 25 bp, Rattus norvegicus
tggaccgtactcgagcgtgactctc

SEQ ID NO: 462099 - DNA, 25 bp, Rattus norvegicus
gccacgacatgatctgcaagctccg

SEQ ID NO: 462100 - DNA, 25 bp, Rattus norvegicus
cccttgatgccgaagagccacgaca

SEQ ID NO: 462101 - DNA, 25 bp, Rattus norvegicus
ccatttgtccttgggcgatggccga

SEQ ID NO: 462102 - DNA, 25 bp, Rattus norvegicus
tcgggtcgaagttgctccatttgtc

SEQ ID NO: 462103 - DNA, 25 bp, Rattus norvegicus
gcgtactcacgcgagtgctccaact

SEQ ID NO: 462104 - DNA, 25 bp, Rattus norvegicus
gtgcctccgagatgaacctcccatt

SEQ ID NO: 462105 - DNA, 25 bp, Rattus norvegicus
accaaagtcgcaaaggcagctagtg

SEQ ID NO: 462106 - DNA, 25 bp, Rattus norvegicus
ctgaaaggtatacgtgcagacgacc

SEQ ID NO: 462107 - DNA, 25 bp, Rattus norvegicus
ccaccgtgctgctaagatgtcaaga

SEQ ID NO: 462108 - DNA, 25 bp, Rattus norvegicus
cccaggggtgccaatgtccggtcgt

SEQ ID NO: 462109 - DNA, 25 bp, Rattus norvegicus
actcctcgtaccctggcagcaatgg

SEQ ID NO: 462110 - DNA, 25 bp, Rattus norvegicus
ttcggaggctactcctcgtaccctg

SEQ ID NO: 462111 - DNA, 25 bp, Rattus norvegicus
agctgcgctcttcggaggctactcc

SEQ ID NO: 462112 - DNA, 25 bp, Rattus norvegicus
aacaccgcagctgcgctcttcggag

SEQ ID NO: 462113 - DNA, 25 bp, Rattus norvegicus
tgcagaaagccacctactacgacaa

SEQ ID NO: 462114 - DNA, 25 bp, Rattus norvegicus
ggcagcaatggtttcggctacgacg

SEQ ID NO: 462115 - DNA, 25 bp, Rattus norvegicus
cgggcctcgcccagcgatgcagaaa

SEQ ID NO: 462116 - DNA, 25 bp, Rattus norvegicus
tatcaggcccttgcaagttgccacc

SEQ ID NO: 462117 - DNA, 25 bp, Rattus norvegicus
tgccaatgtccggtcgtgagggtat

SEQ ID NO: 462118 - DNA, 25 bp, Rattus norvegicus
accctggcagcaatggtttcggcta

SEQ ID NO: 462119 - DNA, 25 bp, Rattus norvegicus
gcaggtcagccgcttggaacagacc

SEQ ID NO: 462120 - DNA, 25 bp, Rattus norvegicus
tcagccgcttggaacagacccggga

SEQ ID NO: 462121 - DNA, 25 bp, Rattus norvegicus
tcgtgagggtatcaggcccttgcaa

SEQ ID NO: 462122 - DNA, 25 bp, Rattus norvegicus
cagcagtcacagtcaccaggtaagt

SEQ ID NO: 462123 - DNA, 25 bp, Rattus norvegicus
gatccgctcgccagatgccgtacag

SEQ ID NO: 462124 - DNA, 25 bp, Rattus norvegicus
atggcctgcgggacacggatccgct

SEQ ID NO: 462125 - DNA, 25 bp, Rattus norvegicus
gcccgagcggaaggcagcagtcaca

SEQ ID NO: 462126 - DNA, 25 bp, Rattus norvegicus
tcaggccctggatggtagtgctgtt

SEQ ID NO: 462127 - DNA, 25 bp, Rattus norvegicus
tgctgttctggccagctggcacctc

SEQ ID NO: 462128 - DNA, 25 bp, Rattus norvegicus
ctggcacctccacgtgttctaggga

SEQ ID NO: 462129 - DNA, 25 bp, Rattus norvegicus
gtgttctagggatccgccctgcaga

SEQ ID NO: 462130 - DNA, 25 bp, Rattus norvegicus
ccctgcagaggtccgagctgtacaa

SEQ ID NO: 462131 - DNA, 25 bp, Rattus norvegicus
tacaaggtagccgagagtggagtcc

SEQ ID NO: 462132 - DNA, 25 bp, Rattus norvegicus
ggggcccaacttacacggaggctgc

SEQ ID NO: 462133 - DNA, 25 bp, Rattus norvegicus
ctgcgcggcctagtatgcgagatga

SEQ ID NO: 462134 - DNA, 25 bp, Rattus norvegicus
gcctagtatgcgagatgacgatgcg

SEQ ID NO: 462135 - DNA, 25 bp, Rattus norvegicus
tgccgtacaggccttagccgacagc

SEQ ID NO: 462136 - DNA, 25 bp, Rattus norvegicus
cgtgcactcagtcgcgcgcgcaaag

SEQ ID NO: 462137 - DNA, 25 bp, Rattus norvegicus
ctgaccgaccacagctggcagctaa

SEQ ID NO: 462138 - DNA, 25 bp, Rattus norvegicus
catgacccgcttgagcagcagccga

SEQ ID NO: 462139 - DNA, 25 bp, Rattus norvegicus
ctgtgaggaactggaatccggcttc

SEQ ID NO: 462140 - DNA, 25 bp, Rattus norvegicus
tgccaaccgcagactcaaagccatg

SEQ ID NO: 462141 - DNA, 25 bp, Rattus norvegicus
gccatgctgagcacagtccagaaca

SEQ ID NO: 462142 - DNA, 25 bp, Rattus norvegicus
ccagaacagcatcgcgcctggagtg

SEQ ID NO: 462143 - DNA, 25 bp, Rattus norvegicus
tctgagaaaccacacctactcgcgg

SEQ ID NO: 462144 - DNA, 25 bp, Rattus norvegicus
cgcaaaggccaatctgcaccggctg

SEQ ID NO: 462145 - DNA, 25 bp, Rattus norvegicus
cggctgcacggtgatgcatgccata

SEQ ID NO: 462146 - DNA, 25 bp, Rattus norvegicus
catgccatagcggtcccagacttgc

SEQ ID NO: 462147 - DNA, 25 bp, Rattus norvegicus
tgcggtgacacgcagcagccacaaa

SEQ ID NO: 462148 - DNA, 25 bp, Rattus norvegicus
acctggacagttcatgacccgcttg

SEQ ID NO: 462149 - DNA, 25 bp, Rattus norvegicus
agctaacttgccctcctaccgtgag

SEQ ID NO: 462150 - DNA, 25 bp, Rattus norvegicus
aatccgaacactatgagcgccgcgg

SEQ ID NO: 462151 - DNA, 25 bp, Rattus norvegicus
agccacggtctgagagcagcgctct

SEQ ID NO: 462152 - DNA, 25 bp, Rattus norvegicus
gtaggcagtacaaggtgtagtcgcc

SEQ ID NO: 462153 - DNA, 25 bp, Rattus norvegicus
agcagcgctctgcaacgtggacccg

SEQ ID NO: 462154 - DNA, 25 bp, Rattus norvegicus
cacggtctgagagcagcgctctgca

SEQ ID NO: 462155 - DNA, 25 bp, Rattus norvegicus
gatcttcgctgcctctgggcaggcg

SEQ ID NO: 462156 - DNA, 25 bp, Rattus norvegicus
ccgaacactatgagcgccgcggagc

SEQ ID NO: 462157 - DNA, 25 bp, Rattus norvegicus
agaggaatccgaacactatgagcgc

SEQ ID NO: 462158 - DNA, 25 bp, Rattus norvegicus
ggaatccgaacactatgagcgccgc

SEQ ID NO: 462159 - DNA, 25 bp, Rattus norvegicus
agagaggaatccgaacactatgagc

SEQ ID NO: 462160 - DNA, 25 bp, Rattus norvegicus
aggcgagcaccagaagcggcggcag

SEQ ID NO: 462161 - DNA, 25 bp, Rattus norvegicus
acaaggtgtagtcgccggaccagga

SEQ ID NO: 462162 - DNA, 25 bp, Rattus norvegicus
agtacaaggtgtagtcgccggacca

SEQ ID NO: 462163 - DNA, 25 bp, Rattus norvegicus
tgagagcagcgctctgcaacgtgga

SEQ ID NO: 462164 - DNA, 25 bp, Rattus norvegicus
ttggttcgcctactgttgcagcggg

SEQ ID NO: 462165 - DNA, 25 bp, Rattus norvegicus
cccgacagggatcacacaggtagga

SEQ ID NO: 462166 - DNA, 25 bp, Rattus norvegicus
acaggtaggactccgctccatctgg

SEQ ID NO: 462167 - DNA, 25 bp, Rattus norvegicus
tccatctggctgtgatgcgagggca

SEQ ID NO: 462168 - DNA, 25 bp, Rattus norvegicus
gatgcgagggcacgcaccattggtt

SEQ ID NO: 462169 - DNA, 25 bp, Rattus norvegicus
cgcaccattggttcgcctactgttg

SEQ ID NO: 462170 - DNA, 25 bp, Rattus norvegicus
cctggcaggtgcagttgaccacaca

SEQ ID NO: 462171 - DNA, 25 bp, Rattus norvegicus
agttgaccacacagggcgcacacca

SEQ ID NO: 462172 - DNA, 25 bp, Rattus norvegicus
aggctgcctggcatgggcactcgaa

SEQ ID NO: 462173 - DNA, 25 bp, Rattus norvegicus
ggcactcgaacgtggcagaactatt

SEQ ID NO: 462174 - DNA, 25 bp, Rattus norvegicus
tcagcagctgctccatgctctcaaa

SEQ ID NO: 462175 - DNA, 25 bp, Rattus norvegicus
gggccgcacgctactggttacatgc

SEQ ID NO: 462176 - DNA, 25 bp, Rattus norvegicus
cgctactggttacatgctttacggc

SEQ ID NO: 462177 - DNA, 25 bp, Rattus norvegicus
cagaactattgctgcgacgcggggc

SEQ ID NO: 462178 - DNA, 25 bp, Rattus norvegicus
ggactcttcagccttgtgcagtgta

SEQ ID NO: 462179 - DNA, 25 bp, Rattus norvegicus
cccggacgccctgcagataaatgca

SEQ ID NO: 462180 - DNA, 25 bp, Rattus norvegicus
gataaatgcagtcgccttcctcgag

SEQ ID NO: 462181 - DNA, 25 bp, Rattus norvegicus
acgccgcctgtgacagtggcaatcc

SEQ ID NO: 462182 - DNA, 25 bp, Rattus norvegicus
catcacatttgtctgccacagcagc

SEQ ID NO: 462183 - DNA, 25 bp, Rattus norvegicus
tcgccctgcatctcgctgtgcgaag

SEQ ID NO: 462184 - DNA, 25 bp, Rattus norvegicus
cggctgtccgcaatcctcaagacta

SEQ ID NO: 462185 - DNA, 25 bp, Rattus norvegicus
tcctcaagactaggcggtcggtctc

SEQ ID NO: 462186 - DNA, 25 bp, Rattus norvegicus
taccatgccgatgaccgtcagcatc

SEQ ID NO: 462187 - DNA, 25 bp, Rattus norvegicus
caccgaccgcaggaagttttatttg

SEQ ID NO: 462188 - DNA, 25 bp, Rattus norvegicus
ccttgggctggcactgttaactacc

SEQ ID NO: 462189 - DNA, 25 bp, Rattus norvegicus
cgtgaccctccgcatgacacagatg

SEQ ID NO: 462190 - DNA, 25 bp, Rattus norvegicus
ggccacggacattctggcatcgcga

SEQ ID NO: 462191 - DNA, 25 bp, Rattus norvegicus
cgggtctgcccattgttaacatata

SEQ ID NO: 462192 - DNA, 25 bp, Rattus norvegicus
gcgacccggaagacagtgcttgcac

SEQ ID NO: 462193 - DNA, 25 bp, Rattus norvegicus
cgtctggcacaacggaactgaactc

SEQ ID NO: 462194 - DNA, 25 bp, Rattus norvegicus
cgcagacttaagaagcggaacctga

SEQ ID NO: 462195 - DNA, 25 bp, Rattus norvegicus
tcagggacgagtctagaggcgaccc

SEQ ID NO: 462196 - DNA, 25 bp, Rattus norvegicus
acacatccgtcagggcaggactttc

SEQ ID NO: 462197 - DNA, 25 bp, Rattus norvegicus
caggactttctgaccgttgacccgg

SEQ ID NO: 462198 - DNA, 25 bp, Rattus norvegicus
gacccggaagcgcttatggtagccc

SEQ ID NO: 462199 - DNA, 25 bp, Rattus norvegicus
ggattccggggtcccatcatggtct

SEQ ID NO: 462200 - DNA, 25 bp, Rattus norvegicus
ggaaccgcctcacagaccgctattg

SEQ ID NO: 462201 - DNA, 25 bp, Rattus norvegicus
ccatggtcgaagagtcgtgctgcca

SEQ ID NO: 462202 - DNA, 25 bp, Rattus norvegicus
aaggaagaatcgctgctaccggctg

SEQ ID NO: 462203 - DNA, 25 bp, Rattus norvegicus
gcggtgaccagagccttcgttaagt

SEQ ID NO: 462204 - DNA, 25 bp, Rattus norvegicus
cgttaagtgtacgaactcccgcaga

SEQ ID NO: 462205 - DNA, 25 bp, Rattus norvegicus
atcatggtcttccttacgacgcggc

SEQ ID NO: 462206 - DNA, 25 bp, Rattus norvegicus
tgcctgacgcgatactgaaggactg

SEQ ID NO: 462207 - DNA, 25 bp, Rattus norvegicus
agacagcggtgacgttcaaccaatg

SEQ ID NO: 462208 - DNA, 25 bp, Rattus norvegicus
ggggacaggctatactccggagttc

SEQ ID NO: 462209 - DNA, 25 bp, Rattus norvegicus
ccggagttctcatcaccttggaaaa

SEQ ID NO: 462210 - DNA, 25 bp, Rattus norvegicus
ttggaaaactgcctgctgcccgacg

SEQ ID NO: 462211 - DNA, 25 bp, Rattus norvegicus
ttcacgccatccatgtcgagcggtc

SEQ ID NO: 462212 - DNA, 25 bp, Rattus norvegicus
cgagcggtctcgacatcgatacaga

SEQ ID NO: 462213 - DNA, 25 bp, Rattus norvegicus
cgatacagagactggactccgcgta

SEQ ID NO: 462214 - DNA, 25 bp, Rattus norvegicus
cgccgagctttgtaggtagccgttc

SEQ ID NO: 462215 - DNA, 25 bp, Rattus norvegicus
gtcgtcttggcccatgtcccgaaac

SEQ ID NO: 462216 - DNA, 25 bp, Rattus norvegicus
ggtacttccggcgtcagtgcctgac

SEQ ID NO: 462217 - DNA, 25 bp, Rattus norvegicus
ggtgcttcaaacctgaccgctgatc

SEQ ID NO: 462218 - DNA, 25 bp, Rattus norvegicus
aataacttgcctgaaccggtgcttc

SEQ ID NO: 462219 - DNA, 25 bp, Rattus norvegicus
aggtcggagcctgtacctctctgca

SEQ ID NO: 462220 - DNA, 25 bp, Rattus norvegicus
cgtgttaggacagaatcgggcgcca

SEQ ID NO: 462221 - DNA, 25 bp, Rattus norvegicus
aaccggaaccgatcgcttgagggca

SEQ ID NO: 462222 - DNA, 25 bp, Rattus norvegicus
gcctgttggggagcttaaaagatga

SEQ ID NO: 462223 - DNA, 25 bp, Rattus norvegicus
cttgaggaagcttgagagcctgttg

SEQ ID NO: 462224 - DNA, 25 bp, Rattus norvegicus
gaggagaaatggtcagccctaactt

SEQ ID NO: 462225 - DNA, 25 bp, Rattus norvegicus
cagcagccggaaatgatcaaggaca

SEQ ID NO: 462226 - DNA, 25 bp, Rattus norvegicus
tgcgtgcgagctcgatattgtcctg

SEQ ID NO: 462227 - DNA, 25 bp, Rattus norvegicus
ttgagggcactcaaagaacgtgtta

SEQ ID NO: 462228 - DNA, 25 bp, Rattus norvegicus
ttttatctggaaacagcggctgagg

SEQ ID NO: 462229 - DNA, 25 bp, Rattus norvegicus
tacgcagagagcactatccgggatc

SEQ ID NO: 462230 - DNA, 25 bp, Rattus norvegicus
gttaaaggccacgtgtacgcagaga

SEQ ID NO: 462231 - DNA, 25 bp, Rattus norvegicus
cgcaggtacccggaagctaactggc

SEQ ID NO: 462232 - DNA, 25 bp, Rattus norvegicus
acctgcgtatgtttggtgcgtgcga

SEQ ID NO: 462233 - DNA, 25 bp, Rattus norvegicus
tgagggagcgttccctctaaccgga

SEQ ID NO: 462234 - DNA, 25 bp, Rattus norvegicus
ccggctctgatgacttgcgtgaacc

SEQ ID NO: 462235 - DNA, 25 bp, Rattus norvegicus
cggttatcttcccaagcagctgtgg

SEQ ID NO: 462236 - DNA, 25 bp, Rattus norvegicus
ggcgccgacttgtggatatgtactc

SEQ ID NO: 462237 - DNA, 25 bp, Rattus norvegicus
cggtacgatgtagaacggcaacttc

SEQ ID NO: 462238 - DNA, 25 bp, Rattus norvegicus
cttcggcagaagttgaaaccttggc

SEQ ID NO: 462239 - DNA, 25 bp, Rattus norvegicus
tgggttccttcaagctacggttatc

SEQ ID NO: 462240 - DNA, 25 bp, Rattus norvegicus
ccgcagccctattaagtcgcgcata

SEQ ID NO: 462241 - DNA, 25 bp, Rattus norvegicus
gcacttgtggactgaccgccactta

SEQ ID NO: 462242 - DNA, 25 bp, Rattus norvegicus
ttctcgctgctcatccgcggtacga

SEQ ID NO: 462243 - DNA, 25 bp, Rattus norvegicus
cgacagctacctggcgtgccacatg

SEQ ID NO: 462244 - DNA, 25 bp, Rattus norvegicus
ggtgatctgactgcctttctcaatg

SEQ ID NO: 462245 - DNA, 25 bp, Rattus norvegicus
cgctgaccgattgcttgacctgtac

SEQ ID NO: 462246 - DNA, 25 bp, Rattus norvegicus
ttgacctgtacgcatccggcgagcg

SEQ ID NO: 462247 - DNA, 25 bp, Rattus norvegicus
gtcggtgaacaccaacgcttttgca

SEQ ID NO: 462248 - DNA, 25 bp, Rattus norvegicus
gaccagtgacgtcaccggccctgaa

SEQ ID NO: 462249 - DNA, 25 bp, Rattus norvegicus
accaggcggttcttgaacagcccga

SEQ ID NO: 462250 - DNA, 25 bp, Rattus norvegicus
cgggccgcagtagccctctgaactg

SEQ ID NO: 462251 - DNA, 25 bp, Rattus norvegicus
catggcggagaccaaaatcatttac

SEQ ID NO: 462252 - DNA, 25 bp, Rattus norvegicus
atcatttaccacatggacgaggagg

SEQ ID NO: 462253 - DNA, 25 bp, Rattus norvegicus
aggagacgccgtacctggtcaagct

SEQ ID NO: 462254 - DNA, 25 bp, Rattus norvegicus
cggacccgttctgcgcgtgcgcagt

SEQ ID NO: 462255 - DNA, 25 bp, Rattus norvegicus
agcgcgtcacgctggcagacttcaa

SEQ ID NO: 462256 - DNA, 25 bp, Rattus norvegicus
cgctggcagacttcaagaacgtgct

SEQ ID NO: 462257 - DNA, 25 bp, Rattus norvegicus
aagaacgtgctcagcaaccggccgg

SEQ ID NO: 462258 - DNA, 25 bp, Rattus norvegicus
gccggtgcacgcctacaaattcttc

SEQ ID NO: 462259 - DNA, 25 bp, Rattus norvegicus
gtctatggaccaggacttcgggtca

SEQ ID NO: 462260 - DNA, 25 bp, Rattus norvegicus
gcatgagctggcacctgtctgcgcc

SEQ ID NO: 462261 - DNA, 25 bp, Rattus norvegicus
tacctggtcaagctgcccgtagctc

SEQ ID NO: 462262 - DNA, 25 bp, Rattus norvegicus
ttgatcacgttgctgtagatggtgg

SEQ ID NO: 462263 - DNA, 25 bp, Rattus norvegicus
cgagtcactctgctcgccgcacttc

SEQ ID NO: 462264 - DNA, 25 bp, Rattus norvegicus
ctcgccgcacttccctctcggaggg

SEQ ID NO: 462265 - DNA, 25 bp, Rattus norvegicus
agtgcggggccgaccgtgaccctca

SEQ ID NO: 462266 - DNA, 25 bp, Rattus norvegicus
ccgaccgtgaccctcactggggtag

SEQ ID NO: 462267 - DNA, 25 bp, Rattus norvegicus
cgtgaccctcactggggtagcacgg

SEQ ID NO: 462268 - DNA, 25 bp, Rattus norvegicus
tcccggatcgaagggactcgggcac

SEQ ID NO: 462269 - DNA, 25 bp, Rattus norvegicus
tccgatctggtctggttcggtctcc

SEQ ID NO: 462270 - DNA, 25 bp, Rattus norvegicus
tggttcggtctcctcagacttggga

SEQ ID NO: 462271 - DNA, 25 bp, Rattus norvegicus
ccgcacctttgatcacgttgctgta

SEQ ID NO: 462272 - DNA, 25 bp, Rattus norvegicus
ggaactcctagcgcgcgcgctggtc

SEQ ID NO: 462273 - DNA, 25 bp, Rattus norvegicus
accgcagcgcacaggacggtgaccg

SEQ ID NO: 462274 - DNA, 25 bp, Rattus norvegicus
acaggattgcccgtccgatctggtc

SEQ ID NO: 462275 - DNA, 25 bp, Rattus norvegicus
gtctcctcagacttgggaccggcgg

SEQ ID NO: 462276 - DNA, 25 bp, Rattus norvegicus
tgcctgcggttcttggagtatgttt

SEQ ID NO: 462277 - DNA, 25 bp, Rattus norvegicus
ctccttagtggtagctggcaattta

SEQ ID NO: 462278 - DNA, 25 bp, Rattus norvegicus
ccgggctcagtcaagactctgcagt

SEQ ID NO: 462279 - DNA, 25 bp, Rattus norvegicus
tttcgaaacgtcgagctgggagccc

SEQ ID NO: 462280 - DNA, 25 bp, Rattus norvegicus
gaatccgccttgcagtttcgaaacg

SEQ ID NO: 462281 - DNA, 25 bp, Rattus norvegicus
ccgttgtcgctctccgcacaggaat

SEQ ID NO: 462282 - DNA, 25 bp, Rattus norvegicus
tcacagaactttagagggactccct

SEQ ID NO: 462283 - DNA, 25 bp, Rattus norvegicus
gagctgccggaagcgactccttagt

SEQ ID NO: 462284 - DNA, 25 bp, Rattus norvegicus
ggccagagcctctcagtagacacca

SEQ ID NO: 462285 - DNA, 25 bp, Rattus norvegicus
cttggccaccgttcaggaccctgaa

SEQ ID NO: 462286 - DNA, 25 bp, Rattus norvegicus
gactgaacgccaccttcgaagcttg

SEQ ID NO: 462287 - DNA, 25 bp, Rattus norvegicus
ccagtgctgaaagttcgacagaatc

SEQ ID NO: 462288 - DNA, 25 bp, Rattus norvegicus
atctggagctgttcggacatgtccc

SEQ ID NO: 462289 - DNA, 25 bp, Rattus norvegicus
gagtatgtttcccacccgaagcgcg

SEQ ID NO: 462290 - DNA, 25 bp, Rattus norvegicus
gtctatcagctgttcatcccaagga

SEQ ID NO: 462291 - DNA, 25 bp, Rattus norvegicus
gcgcgaggtctaaggctttcctgcg

SEQ ID NO: 462292 - DNA, 25 bp, Rattus norvegicus
tctaaggctttcctgcgggcggtgc

SEQ ID NO: 462293 - DNA, 25 bp, Rattus norvegicus
gaaacgtggtttgagactgcctgcc

SEQ ID NO: 462294 - DNA, 25 bp, Rattus norvegicus
gagactgcctgcctcctcgatgatg

SEQ ID NO: 462295 - DNA, 25 bp, Rattus norvegicus
cctgaaattagggtcactcccttgg

SEQ ID NO: 462296 - DNA, 25 bp, Rattus norvegicus
gtgagtccgagtcctaagcatcttc

SEQ ID NO: 462297 - DNA, 25 bp, Rattus norvegicus
ctaagcatcttctgcggcgtccggc

SEQ ID NO: 462298 - DNA, 25 bp, Rattus norvegicus
ttcatctccatagccgtctatcagc

SEQ ID NO: 462299 - DNA, 25 bp, Rattus norvegicus
ttcatcccaaggagcggaagccgga

SEQ ID NO: 462300 - DNA, 25 bp, Rattus norvegicus
tcaggtttgattgcgcgcgaggtct

SEQ ID NO: 462301 - DNA, 25 bp, Rattus norvegicus
gcctcctcgatgatgcctgaaatta

SEQ ID NO: 462302 - DNA, 25 bp, Rattus norvegicus
atcttctgcggcgtccggcgagtcc

SEQ ID NO: 462303 - DNA, 25 bp, Rattus norvegicus
tcactcccttgggtgagtccgagtc

SEQ ID NO: 462304 - DNA, 25 bp, Rattus norvegicus
cccactgcagttccggaatgtgtct

SEQ ID NO: 462305 - DNA, 25 bp, Rattus norvegicus
gtgtccttaattcgttcactcccga

SEQ ID NO: 462306 - DNA, 25 bp, Rattus norvegicus
ggctgctcccgcacaagtgtcctta

SEQ ID NO: 462307 - DNA, 25 bp, Rattus norvegicus
gaatgtgtctgcctgacgggttcta

SEQ ID NO: 462308 - DNA, 25 bp, Rattus norvegicus
taactgtgctctacctcgcaggggc

SEQ ID NO: 462309 - DNA, 25 bp, Rattus norvegicus
agaacgcccagactgctgatcgtgc

SEQ ID NO: 462310 - DNA, 25 bp, Rattus norvegicus
atttgtaccgtctgtgggagctgtc

SEQ ID NO: 462311 - DNA, 25 bp, Rattus norvegicus
aggaacccatatttgagcggctggc

SEQ ID NO: 462312 - DNA, 25 bp, Rattus norvegicus
ggccagcgttcctaggctcctaaaa

SEQ ID NO: 462313 - DNA, 25 bp, Rattus norvegicus
aagaacacaaggtagcgcgcacgca

SEQ ID NO: 462314 - DNA, 25 bp, Rattus norvegicus
tctgtgcccaagtactggaagaaca

SEQ ID NO: 462315 - DNA, 25 bp, Rattus norvegicus
agcgggaaaacgtacttgaagtctg

SEQ ID NO: 462316 - DNA, 25 bp, Rattus norvegicus
ttctagccgagtgctcccaaatgta

SEQ ID NO: 462317 - DNA, 25 bp, Rattus norvegicus
tctgggctcgactatgttaactgtg

SEQ ID NO: 462318 - DNA, 25 bp, Rattus norvegicus
ccatcttggaagctgagcgaccgta

SEQ ID NO: 462319 - DNA, 25 bp, Rattus norvegicus
atttatttggtttgccacgcgggca

SEQ ID NO: 462320 - DNA, 25 bp, Rattus norvegicus
ccgtcgggcagattagggatttatt

SEQ ID NO: 462321 - DNA, 25 bp, Rattus norvegicus
ccggagctattgtccagtgcgcacg

SEQ ID NO: 462322 - DNA, 25 bp, Rattus norvegicus
ggccttggccacagcgaactgaacg

SEQ ID NO: 462323 - DNA, 25 bp, Rattus norvegicus
ggccgtcccttgagcggccatcttg

SEQ ID NO: 462324 - DNA, 25 bp, Rattus norvegicus
gagaagcgcttccacccgcaaacag

SEQ ID NO: 462325 - DNA, 25 bp, Rattus norvegicus
ccaccaagctgcctagagaagcgct

SEQ ID NO: 462326 - DNA, 25 bp, Rattus norvegicus
gaactgacagtagagcccgccacca

SEQ ID NO: 462327 - DNA, 25 bp, Rattus norvegicus
ccgagacacctaggaactgacagta

SEQ ID NO: 462328 - DNA, 25 bp, Rattus norvegicus
cgggacgcaactatagccataaatc

SEQ ID NO: 462329 - DNA, 25 bp, Rattus norvegicus
caaccctttgcgcagtagcgggacg

SEQ ID NO: 462330 - DNA, 25 bp, Rattus norvegicus
agtgcgcacgcgtcagcaacccttt

SEQ ID NO: 462331 - DNA, 25 bp, Rattus norvegicus
ttactgagtgcgtttggggtacttg

SEQ ID NO: 462332 - DNA, 25 bp, Rattus norvegicus
ctgagccgagttccgcgtatgactt

SEQ ID NO: 462333 - DNA, 25 bp, Rattus norvegicus
tgcgcgcagctccaccagtatagcg

SEQ ID NO: 462334 - DNA, 25 bp, Rattus norvegicus
ccaggcgcgcaaaagagtcgtcatc

SEQ ID NO: 462335 - DNA, 25 bp, Rattus norvegicus
tccgccttgaggacgaactcgaagt

SEQ ID NO: 462336 - DNA, 25 bp, Rattus norvegicus
aagtctacgtgctcatccagccagg

SEQ ID NO: 462337 - DNA, 25 bp, Rattus norvegicus
tgaggttctcgtaggcatcgcgcaa

SEQ ID NO: 462338 - DNA, 25 bp, Rattus norvegicus
gcgcagcgcgccaagtataacagag

SEQ ID NO: 462339 - DNA, 25 bp, Rattus norvegicus
taggcgcttagactccctggagctg

SEQ ID NO: 462340 - DNA, 25 bp, Rattus norvegicus
gacctcgcgcgccatttctattggt

SEQ ID NO: 462341 - DNA, 25 bp, Rattus norvegicus
tgtttctcagaggttgcttccgccc

SEQ ID NO: 462342 - DNA, 25 bp, Rattus norvegicus
gtgcccgaggctgtactttttctca

SEQ ID NO: 462343 - DNA, 25 bp, Rattus norvegicus
gcgcgccgaaataccttcatgctgc

SEQ ID NO: 462344 - DNA, 25 bp, Rattus norvegicus
gcttccgcccgttagaaagatggtg

SEQ ID NO: 462345 - DNA, 25 bp, Rattus norvegicus
gagctgatatccagggcggctttga

SEQ ID NO: 462346 - DNA, 25 bp, Rattus norvegicus
cccgagtcagacagccgcgatttgc

SEQ ID NO: 462347 - DNA, 25 bp, Rattus norvegicus
tgtagtctcgccattgtaaaggagc

SEQ ID NO: 462348 - DNA, 25 bp, Rattus norvegicus
gccacaagtctgtagtctcgccatt

SEQ ID NO: 462349 - DNA, 25 bp, Rattus norvegicus
ccaagcgcggccacaagtctgtagt

SEQ ID NO: 462350 - DNA, 25 bp, Rattus norvegicus
ttagcataaggcaagcggataggtg

SEQ ID NO: 462351 - DNA, 25 bp, Rattus norvegicus
accgggcatggttagagttagcata

SEQ ID NO: 462352 - DNA, 25 bp, Rattus norvegicus
taagcgaagaggatgagatttcgca

SEQ ID NO: 462353 - DNA, 25 bp, Rattus norvegicus
tgacacgtgttgaggtaagcgaaga

SEQ ID NO: 462354 - DNA, 25 bp, Rattus norvegicus
ccggtctgcgatagtgacacgtgtt

SEQ ID NO: 462355 - DNA, 25 bp, Rattus norvegicus
cgcaggccggtctgcgatagtgaca

SEQ ID NO: 462356 - DNA, 25 bp, Rattus norvegicus
acatcgacttgcgtgccgcaggccg

SEQ ID NO: 462357 - DNA, 25 bp, Rattus norvegicus
ttctggaagacatcgacttgcgtgc

SEQ ID NO: 462358 - DNA, 25 bp, Rattus norvegicus
cattgtaaaggagcacaaagcgacg

SEQ ID NO: 462359 - DNA, 25 bp, Rattus norvegicus
ggagctgttctggaagacatcgact

SEQ ID NO: 462360 - DNA, 25 bp, Rattus norvegicus
ggactctgcgactgggcaggcaccc

SEQ ID NO: 462361 - DNA, 25 bp, Rattus norvegicus
aggagttcggcacctcaggcaggcc

SEQ ID NO: 462362 - DNA, 25 bp, Rattus norvegicus
cctcaaggcggctccggatccaggt

SEQ ID NO: 462363 - DNA, 25 bp, Rattus norvegicus
ggctccggatccaggtctaaccact

SEQ ID NO: 462364 - DNA, 25 bp, Rattus norvegicus
tctaaccactgaaacccggagaagc

SEQ ID NO: 462365 - DNA, 25 bp, Rattus norvegicus
ctgaaacccggagaagccgacatgg

SEQ ID NO: 462366 - DNA, 25 bp, Rattus norvegicus
ggcacccggcgctggtgcttcttca

SEQ ID NO: 462367 - DNA, 25 bp, Rattus norvegicus
cagcacaaagctacgcgccaggcga

SEQ ID NO: 462368 - DNA, 25 bp, Rattus norvegicus
tacgcgccaggcgattggccctgat

SEQ ID NO: 462369 - DNA, 25 bp, Rattus norvegicus
gattggccctgatccggctcacaga

SEQ ID NO: 462370 - DNA, 25 bp, Rattus norvegicus
gccctgatccggctcacagagatga

SEQ ID NO: 462371 - DNA, 25 bp, Rattus norvegicus
tccggctcacagagatgacgtcacg

SEQ ID NO: 462372 - DNA, 25 bp, Rattus norvegicus
aacacgcgctggaggagttcggcac

SEQ ID NO: 462373 - DNA, 25 bp, Rattus norvegicus
tgcttcttcagcacaaagctacgcg

SEQ ID NO: 462374 - DNA, 25 bp, Rattus norvegicus
caggctgaccatggcgcagcccaga

SEQ ID NO: 462375 - DNA, 25 bp, Rattus norvegicus
cctgagctgcagagttttccgggac

SEQ ID NO: 462376 - DNA, 25 bp, Rattus norvegicus
agctgcagagttttccgggacctga

SEQ ID NO: 462377 - DNA, 25 bp, Rattus norvegicus
tgaccatggcgcagcccagaacggc

SEQ ID NO: 462378 - DNA, 25 bp, Rattus norvegicus
tcgcgcggccaccaccaagagcagc

SEQ ID NO: 462379 - DNA, 25 bp, Rattus norvegicus
tgccggtgagcaccacattcgcctc

SEQ ID NO: 462380 - DNA, 25 bp, Rattus norvegicus
gggtccacgttgaggatctcctcca

SEQ ID NO: 462381 - DNA, 25 bp, Rattus norvegicus
acgtgtgctgcaccgggtccacgtt

SEQ ID NO: 462382 - DNA, 25 bp, Rattus norvegicus
caccttgcatgagtacgtgtgctgc

SEQ ID NO: 462383 - DNA, 25 bp, Rattus norvegicus
gtaggggcccaccttgcatgagtac

SEQ ID NO: 462384 - DNA, 25 bp, Rattus norvegicus
ctgcagaaacgtttcgggctcgttc

SEQ ID NO: 462385 - DNA, 25 bp, Rattus norvegicus
gacccgcgcgggcagcgaacaaagc

SEQ ID NO: 462386 - DNA, 25 bp, Rattus norvegicus
ccgtagtaactttcgccctgagctg

SEQ ID NO: 462387 - DNA, 25 bp, Rattus norvegicus
ggacagaactggaccgcagcaaggc

SEQ ID NO: 462388 - DNA, 25 bp, Rattus norvegicus
gcctctcgctaggactgctcgctga

SEQ ID NO: 462389 - DNA, 25 bp, Rattus norvegicus
cgccaagagccgcagggctctctgg

SEQ ID NO: 462390 - DNA, 25 bp, Rattus norvegicus
agggctctctggacacgaaaggata

SEQ ID NO: 462391 - DNA, 25 bp, Rattus norvegicus
ctctctggacacgaaaggatagcgg

SEQ ID NO: 462392 - DNA, 25 bp, Rattus norvegicus
tctggacacgaaaggatagcggagc

SEQ ID NO: 462393 - DNA, 25 bp, Rattus norvegicus
cacgaaaggatagcggagctggacc

SEQ ID NO: 462394 - DNA, 25 bp, Rattus norvegicus
atagcggagctggacctccggttcc

SEQ ID NO: 462395 - DNA, 25 bp, Rattus norvegicus
gccgcagggctctctggacacgaaa

SEQ ID NO: 462396 - DNA, 25 bp, Rattus norvegicus
gtcggcctctcgctaggactgctcg

SEQ ID NO: 462397 - DNA, 25 bp, Rattus norvegicus
tctcgctaggactgctcgctgagct

SEQ ID NO: 462398 - DNA, 25 bp, Rattus norvegicus
gcggccgtacgggtaccaccacagc

SEQ ID NO: 462399 - DNA, 25 bp, Rattus norvegicus
gggtaccaccacagcctctacgaca

SEQ ID NO: 462400 - DNA, 25 bp, Rattus norvegicus
tctacgacagcccagcagggctacg

SEQ ID NO: 462401 - DNA, 25 bp, Rattus norvegicus
ccttgggtcggcctctcgctaggac

SEQ ID NO: 462402 - DNA, 25 bp, Rattus norvegicus
cgctgcttgactgattcggacggta

SEQ ID NO: 462403 - DNA, 25 bp, Rattus norvegicus
ctgtgctccggactctgtgtcctgc

SEQ ID NO: 462404 - DNA, 25 bp, Rattus norvegicus
tccggactctgtgtcctgcctgcag

SEQ ID NO: 462405 - DNA, 25 bp, Rattus norvegicus
gtcctgcctgcaggccgctcaccac

SEQ ID NO: 462406 - DNA, 25 bp, Rattus norvegicus
accacggggctgcataacttcagcc

SEQ ID NO: 462407 - DNA, 25 bp, Rattus norvegicus
cggggctgcataacttcagcctcca

SEQ ID NO: 462408 - DNA, 25 bp, Rattus norvegicus
agcgcgacgctgcttgactgattcg

SEQ ID NO: 462409 - DNA, 25 bp, Rattus norvegicus
gcttgactgattcggacggtaggaa

SEQ ID NO: 462410 - DNA, 25 bp, Rattus norvegicus
attcggacggtaggaagactgcctg

SEQ ID NO: 462411 - DNA, 25 bp, Rattus norvegicus
cggtaggaagactgcctggccgcta

SEQ ID NO: 462412 - DNA, 25 bp, Rattus norvegicus
gcttcacacagggttgcccgacctg

SEQ ID NO: 462413 - DNA, 25 bp, Rattus norvegicus
ttcacacagggttgcccgacctgct

SEQ ID NO: 462414 - DNA, 25 bp, Rattus norvegicus
gacagacagcgcgacgctgcttgac

SEQ ID NO: 462415 - DNA, 25 bp, Rattus norvegicus
ccgctatgtccactccggcgctcgc

SEQ ID NO: 462416 - DNA, 25 bp, Rattus norvegicus
cctcgggctttgagtcggaatccga

SEQ ID NO: 462417 - DNA, 25 bp, Rattus norvegicus
tggattcttgcggaactcagcacac

SEQ ID NO: 462418 - DNA, 25 bp, Rattus norvegicus
cagcacacctgctgcgccgagagga

SEQ ID NO: 462419 - DNA, 25 bp, Rattus norvegicus
cgcactcgcgctcgagaaccttaaa

SEQ ID NO: 462420 - DNA, 25 bp, Rattus norvegicus
cgagaaccttaaagccaccagcggg

SEQ ID NO: 462421 - DNA, 25 bp, Rattus norvegicus
tgcggcgcatgctgctttgagcatc

SEQ ID NO: 462422 - DNA, 25 bp, Rattus norvegicus
catcatggctgtgtctcgctgtcca

SEQ ID NO: 462423 - DNA, 25 bp, Rattus norvegicus
agagcagtcgctaaccgggagcagc

SEQ ID NO: 462424 - DNA, 25 bp, Rattus norvegicus
cgacgagttcttggcctcgggcttt

SEQ ID NO: 462425 - DNA, 25 bp, Rattus norvegicus
ggcggagttaacagtcgacgagttc

SEQ ID NO: 462426 - DNA, 25 bp, Rattus norvegicus
cccgatataacttgcaggcgactgg

SEQ ID NO: 462427 - DNA, 25 bp, Rattus norvegicus
ccggcagaggtcttgacccgatata

SEQ ID NO: 462428 - DNA, 25 bp, Rattus norvegicus
caggttctttacgtttctaagtgtg

SEQ ID NO: 462429 - DNA, 25 bp, Rattus norvegicus
tccacggaggtgagttgaataaatg

SEQ ID NO: 462430 - DNA, 25 bp, Rattus norvegicus
tacgggacgcccaccatgcagggca

SEQ ID NO: 462431 - DNA, 25 bp, Rattus norvegicus
agtatgagtcccacgtcctccaagc

SEQ ID NO: 462432 - DNA, 25 bp, Rattus norvegicus
cgccggagtatgagtcccacgtcct

SEQ ID NO: 462433 - DNA, 25 bp, Rattus norvegicus
aggccaccagaatgcctacgcgctg

SEQ ID NO: 462434 - DNA, 25 bp, Rattus norvegicus
cttcatgaacgccttacactccatg

SEQ ID NO: 462435 - DNA, 25 bp, Rattus norvegicus
aaggccaaggggctggcctcgtcct

SEQ ID NO: 462436 - DNA, 25 bp, Rattus norvegicus
ctgaacctcagcgagcggcagatca

SEQ ID NO: 462437 - DNA, 25 bp, Rattus norvegicus
cgcgccgcgtcgagatggccaatct

SEQ ID NO: 462438 - DNA, 25 bp, Rattus norvegicus
tcaaccgttatttgtgccggccgcg

SEQ ID NO: 462439 - DNA, 25 bp, Rattus norvegicus
tacacaagcgcgcagctggttgagc

SEQ ID NO: 462440 - DNA, 25 bp, Rattus norvegicus
aagcgggcgcggacggcatacacaa

SEQ ID NO: 462441 - DNA, 25 bp, Rattus norvegicus
gatggccaatctgctgaacctcagc

SEQ ID NO: 462442 - DNA, 25 bp, Rattus norvegicus
gtggctacgcggatccgttgccgcc

SEQ ID NO: 462443 - DNA, 25 bp, Rattus norvegicus
catgcagggcagtcctgtctatgtg

SEQ ID NO: 462444 - DNA, 25 bp, Rattus norvegicus
accctcttgggtcttgaggcggtag

SEQ ID NO: 462445 - DNA, 25 bp, Rattus norvegicus
ggctgcctctctcttgcccgctcgc

SEQ ID NO: 462446 - DNA, 25 bp, Rattus norvegicus
ctcgcccgcaggtgcccaccagtgc

SEQ ID NO: 462447 - DNA, 25 bp, Rattus norvegicus
gaagcctcggctgcctctctcttgc

SEQ ID NO: 462448 - DNA, 25 bp, Rattus norvegicus
gctccaccgcacagcgcagaccgtc

SEQ ID NO: 462449 - DNA, 25 bp, Rattus norvegicus
ccatcgagggcgagctcgcccgtcc

SEQ ID NO: 462450 - DNA, 25 bp, Rattus norvegicus
aggcggttctcgagggcgccccatc

SEQ ID NO: 462451 - DNA, 25 bp, Rattus norvegicus
ctcgcccgtccgcacccgcgggagg

SEQ ID NO: 462452 - DNA, 25 bp, Rattus norvegicus
ctccgagcctgaggcggttctcgag

SEQ ID NO: 462453 - DNA, 25 bp, Rattus norvegicus
tggactgaggacctccgagcctgag

SEQ ID NO: 462454 - DNA, 25 bp, Rattus norvegicus
gtgtggactgaggacctccgagcct

SEQ ID NO: 462455 - DNA, 25 bp, Rattus norvegicus
tctgcccagaggtcccgcgaggagt

SEQ ID NO: 462456 - DNA, 25 bp, Rattus norvegicus
agcgcagaccgtctgcccagaggtc

SEQ ID NO: 462457 - DNA, 25 bp, Rattus norvegicus
accagtgcccgccactgagactgtc

SEQ ID NO: 462458 - DNA, 25 bp, Rattus norvegicus
cccgggaatcctccatcctcagcaa

SEQ ID NO: 462459 - DNA, 25 bp, Rattus norvegicus
catcctcagcaaccctggcgcctgg

SEQ ID NO: 462460 - DNA, 25 bp, Rattus norvegicus
cgcctggcgggcagagaactgactg

SEQ ID NO: 462461 - DNA, 25 bp, Rattus norvegicus
gatgcagcggttctgacctggtgct

SEQ ID NO: 462462 - DNA, 25 bp, Rattus norvegicus
ctaggcttcagcacactagctctct

SEQ ID NO: 462463 - DNA, 25 bp, Rattus norvegicus
gacctggtgctgtctcagctgccgc

SEQ ID NO: 462464 - DNA, 25 bp, Rattus norvegicus
ggttctgacctggtgctgtctcagc

SEQ ID NO: 462465 - DNA, 25 bp, Rattus norvegicus
cagcggttctgacctggtgctgtct

SEQ ID NO: 462466 - DNA, 25 bp, Rattus norvegicus
ccgtgccgcgccaccggggttggat

SEQ ID NO: 462467 - DNA, 25 bp, Rattus norvegicus
acctccctctgctcagcgcggactc

SEQ ID NO: 462468 - DNA, 25 bp, Rattus norvegicus
ttggatgcgagtgggtgttcgctct

SEQ ID NO: 462469 - DNA, 25 bp, Rattus norvegicus
tctgacctggtgctgtctcagctgc

SEQ ID NO: 462470 - DNA, 25 bp, Rattus norvegicus
aggcttcagcacactagctctctcg

SEQ ID NO: 462471 - DNA, 25 bp, Rattus norvegicus
tgggtgttcgctctgcgcgcacctc

SEQ ID NO: 462472 - DNA, 25 bp, Rattus norvegicus
caggtgtggccgcagctctggccat

SEQ ID NO: 462473 - DNA, 25 bp, Rattus norvegicus
tgtcctggtcgggacccagcctgct

SEQ ID NO: 462474 - DNA, 25 bp, Rattus norvegicus
ctctggccatgaggaccctgtggat

SEQ ID NO: 462475 - DNA, 25 bp, Rattus norvegicus
gagcagagcgctcgcccgaggctct

SEQ ID NO: 462476 - DNA, 25 bp, Rattus norvegicus
aggagaggcgcgtcccaccttggcc

SEQ ID NO: 462477 - DNA, 25 bp, Rattus norvegicus
gcaagcacctgctttgcggcggtcc

SEQ ID NO: 462478 - DNA, 25 bp, Rattus norvegicus
ggtcaggctgtgcaagcacctgctt

SEQ ID NO: 462479 - DNA, 25 bp, Rattus norvegicus
accctgtggatggtgctgtgcgctc

SEQ ID NO: 462480 - DNA, 25 bp, Rattus norvegicus
gactgctgcttcgactatgacaggg

SEQ ID NO: 462481 - DNA, 25 bp, Rattus norvegicus
ttcgactatgacagggcgtgcccag

SEQ ID NO: 462482 - DNA, 25 bp, Rattus norvegicus
atcaagcctgccgtctcaccgggga

SEQ ID NO: 462483 - DNA, 25 bp, Rattus norvegicus
gaacttgcttctgcgatcaagcctg

SEQ ID NO: 462484 - DNA, 25 bp, Rattus norvegicus
ctggacagagtctatggaacttgct

SEQ ID NO: 462485 - DNA, 25 bp, Rattus norvegicus
cttcgcccgtggctggagactggac

SEQ ID NO: 462486 - DNA, 25 bp, Rattus norvegicus
tcctgctcttcgtcgtgggcttcat

SEQ ID NO: 462487 - DNA, 25 bp, Rattus norvegicus
cggcacctttattgctcatgtggtc

SEQ ID NO: 462488 - DNA, 25 bp, Rattus norvegicus
atgtggtctgcaagcggctgctcac

SEQ ID NO: 462489 - DNA, 25 bp, Rattus norvegicus
gggcgtcctcatcggcacctttatt

SEQ ID NO: 462490 - DNA, 25 bp, Rattus norvegicus
cggctacctgtacggcttcgtgcta

SEQ ID NO: 462491 - DNA, 25 bp, Rattus norvegicus
ctggggctacatcgtgcttaatgtg

SEQ ID NO: 462492 - DNA, 25 bp, Rattus norvegicus
tgggcttcatcgtggtctccttccc

SEQ ID NO: 462493 - DNA, 25 bp, Rattus norvegicus
cagcacctcctgctctgggtggaga

SEQ ID NO: 462494 - DNA, 25 bp, Rattus norvegicus
cagcacctgttggtgccggagcctc

SEQ ID NO: 462495 - DNA, 25 bp, Rattus norvegicus
acggtgagaaactggcgctgctgct

SEQ ID NO: 462496 - DNA, 25 bp, Rattus norvegicus
tcggcgcctatctggacgccacggt

SEQ ID NO: 462497 - DNA, 25 bp, Rattus norvegicus
gactcccggtcggaccgtgtctcga

SEQ ID NO: 462498 - DNA, 25 bp, Rattus norvegicus
gagacgcgggtacctcgccactcaa

SEQ ID NO: 462499 - DNA, 25 bp, Rattus norvegicus
agagcctcgactcgctgctcggtgt

SEQ ID NO: 462500 - DNA, 25 bp, Rattus norvegicus
tgtttgcagcagaactgagtcctta

SEQ ID NO: 462501 - DNA, 25 bp, Rattus norvegicus
cctgttcttgcgctctgcgtgctca

SEQ ID NO: 462502 - DNA, 25 bp, Rattus norvegicus
cgtgctcagcttcgcctgtggaagc

SEQ ID NO: 462503 - DNA, 25 bp, Rattus norvegicus
agcttcgcctgtggaagcgagcctg

SEQ ID NO: 462504 - DNA, 25 bp, Rattus norvegicus
ctgtggaagcgagcctggccctcac

SEQ ID NO: 462505 - DNA, 25 bp, Rattus norvegicus
tgccttaccctctgaggaccgggat

SEQ ID NO: 462506 - DNA, 25 bp, Rattus norvegicus
cttaccctctgaggaccgggatcgc

SEQ ID NO: 462507 - DNA, 25 bp, Rattus norvegicus
agcaaagaacgcacgggccagcagc

SEQ ID NO: 462508 - DNA, 25 bp, Rattus norvegicus
gctctgcgtgctcagcttcgcctgt

SEQ ID NO: 462509 - DNA, 25 bp, Rattus norvegicus
agcgccatgtttgcagcagaactga

SEQ ID NO: 462510 - DNA, 25 bp, Rattus norvegicus
cagcagaactgagtccttagtgtca

SEQ ID NO: 462511 - DNA, 25 bp, Rattus norvegicus
gagtccttagtgtcagggtccgccc

SEQ ID NO: 462512 - DNA, 25 bp, Rattus norvegicus
ccggaagtctcagttcaggggcgga

SEQ ID NO: 462513 - DNA, 25 bp, Rattus norvegicus
ggccagcagcgccatgtttgcagca

SEQ ID NO: 462514 - DNA, 25 bp, Rattus norvegicus
tgagcccgcgccagtgcagctcggt

SEQ ID NO: 462515 - DNA, 25 bp, Rattus norvegicus
cgcgtttccgacgaacttggcggag

SEQ ID NO: 462516 - DNA, 25 bp, Rattus norvegicus
gcagtgttctgagacgccggactca

SEQ ID NO: 462517 - DNA, 25 bp, Rattus norvegicus
cattcccgcgtttccgacgaacttg

SEQ ID NO: 462518 - DNA, 25 bp, Rattus norvegicus
agctgactgaacacggaagctgggt

SEQ ID NO: 462519 - DNA, 25 bp, Rattus norvegicus
tgcccgggttggacggctccagcta

SEQ ID NO: 462520 - DNA, 25 bp, Rattus norvegicus
cccaccgtaattcgggcggtgagct

SEQ ID NO: 462521 - DNA, 25 bp, Rattus norvegicus
ttggcgtcgcatgtcgcagtgttct

SEQ ID NO: 462522 - DNA, 25 bp, Rattus norvegicus
acgccggactcatgtggaagctgct

SEQ ID NO: 462523 - DNA, 25 bp, Rattus norvegicus
atgcgcttccggtccgtcctcctag

SEQ ID NO: 462524 - DNA, 25 bp, Rattus norvegicus
actcatgtggaagctgctcccggcc

SEQ ID NO: 462525 - DNA, 25 bp, Rattus norvegicus
ccggccgcaagtgcggctccaggta

SEQ ID NO: 462526 - DNA, 25 bp, Rattus norvegicus
ccctaggcggccgaagctgactgaa

SEQ ID NO: 462527 - DNA, 25 bp, Rattus norvegicus
ggagttcttgcccgggaactgctga

SEQ ID NO: 462528 - DNA, 25 bp, Rattus norvegicus
cccgcacttgcggttgggaagcaaa

SEQ ID NO: 462529 - DNA, 25 bp, Rattus norvegicus
aagtcacctgaaatgaccggccagg

SEQ ID NO: 462530 - DNA, 25 bp, Rattus norvegicus
cccgcgcggtccaggaacaagaaga

SEQ ID NO: 462531 - DNA, 25 bp, Rattus norvegicus
cacacaggcatggagagcggctgct

SEQ ID NO: 462532 - DNA, 25 bp, Rattus norvegicus
cggcacgtggacgaggccgccaatt

SEQ ID NO: 462533 - DNA, 25 bp, Rattus norvegicus
ccgccaattggtggagtcgcagcga

SEQ ID NO: 462534 - DNA, 25 bp, Rattus norvegicus
gtgcgtgctcggtacccgcacttgc

SEQ ID NO: 462535 - DNA, 25 bp, Rattus norvegicus
cccatcccgagaggaaagtcacctg

SEQ ID NO: 462536 - DNA, 25 bp, Rattus norvegicus
agtccggccacgagaacctacctga

SEQ ID NO: 462537 - DNA, 25 bp, Rattus norvegicus
tcacgacctcgcactgtctcgggtg

SEQ ID NO: 462538 - DNA, 25 bp, Rattus norvegicus
gcggtcacccagagaatcccgcaaa

SEQ ID NO: 462539 - DNA, 25 bp, Rattus norvegicus
gcaaaccataggtgctccggccgca

SEQ ID NO: 462540 - DNA, 25 bp, Rattus norvegicus
tcggggtcctcacgaggcctacact

SEQ ID NO: 462541 - DNA, 25 bp, Rattus norvegicus
agcggcagcaccacacaggcatgga

SEQ ID NO: 462542 - DNA, 25 bp, Rattus norvegicus
ccatcagtgcggtcaggatgataac

SEQ ID NO: 462543 - DNA, 25 bp, Rattus norvegicus
cggcgcatcaccatcagtgcggtca

SEQ ID NO: 462544 - DNA, 25 bp, Rattus norvegicus
agtgcggtcaggatgataacgcgtc

SEQ ID NO: 462545 - DNA, 25 bp, Rattus norvegicus
gatgataacgcgtcggcccgcactt

SEQ ID NO: 462546 - DNA, 25 bp, Rattus norvegicus
acttgcgtggggtcccacgtccgcg

SEQ ID NO: 462547 - DNA, 25 bp, Rattus norvegicus
gcgtgtgaatgtgcaggtgcttcac

SEQ ID NO: 462548 - DNA, 25 bp, Rattus norvegicus
tgaatgtgcaggtgcttcactgcca

SEQ ID NO: 462549 - DNA, 25 bp, Rattus norvegicus
actgccacccgcacccgccagtccg

SEQ ID NO: 462550 - DNA, 25 bp, Rattus norvegicus
agtccgcgtgtcttgccgacgagac

SEQ ID NO: 462551 - DNA, 25 bp, Rattus norvegicus
tcttgccgacgagacggtgcctgag

SEQ ID NO: 462552 - DNA, 25 bp, Rattus norvegicus
gatggcgtccccgttcatggctcca

SEQ ID NO: 462553 - DNA, 25 bp, Rattus norvegicus
ggcggcccattctctgcagttccgg

SEQ ID NO: 462554 - DNA, 25 bp, Rattus norvegicus
ctgtccctgggagcccgtcgggtct

SEQ ID NO: 462555 - DNA, 25 bp, Rattus norvegicus
gcggagccggcgcatcaccatcagt

SEQ ID NO: 462556 - DNA, 25 bp, Rattus norvegicus
tgttcctcgcggctgccgagcctgg

SEQ ID NO: 462557 - DNA, 25 bp, Rattus norvegicus
gaggagttatgtagattaccgatga

SEQ ID NO: 462558 - DNA, 25 bp, Rattus norvegicus
tgtagattaccgatgaacattctgg

SEQ ID NO: 462559 - DNA, 25 bp, Rattus norvegicus
gattaccgatgaacattctggaggg

SEQ ID NO: 462560 - DNA, 25 bp, Rattus norvegicus
ccgatgaacattctggaggggagca

SEQ ID NO: 462561 - DNA, 25 bp, Rattus norvegicus
agctgggagcggctgaggcccttcc

SEQ ID NO: 462562 - DNA, 25 bp, Rattus norvegicus
tgaggcccttcccgcagaaactggg

SEQ ID NO: 462563 - DNA, 25 bp, Rattus norvegicus
caccggcggcgtaggaggtggagaa

SEQ ID NO: 462564 - DNA, 25 bp, Rattus norvegicus
gctgggaatcggaaccgcgggtgaa

SEQ ID NO: 462565 - DNA, 25 bp, Rattus norvegicus
gcgggtgaacttgggcgccacgttc

SEQ ID NO: 462566 - DNA, 25 bp, Rattus norvegicus
gtgaggatggtgaacacttgcagcc

SEQ ID NO: 462567 - DNA, 25 bp, Rattus norvegicus
gaggatggtgaacacttgcagccgc

SEQ ID NO: 462568 - DNA, 25 bp, Rattus norvegicus
ttgcagccgctgaccctgcctttcc

SEQ ID NO: 462569 - DNA, 25 bp, Rattus norvegicus
ggaaggaggagttatgtagattacc

SEQ ID NO: 462570 - DNA, 25 bp, Rattus norvegicus
agtcacgcactcacctactaggtcg

SEQ ID NO: 462571 - DNA, 25 bp, Rattus norvegicus
tactaggtcgccgaggaagtccagt

SEQ ID NO: 462572 - DNA, 25 bp, Rattus norvegicus
gcgtcccgtgtgcagtgcgcccaaa

SEQ ID NO: 462573 - DNA, 25 bp, Rattus norvegicus
cccgagctgggaaaagtcacgcact

SEQ ID NO: 462574 - DNA, 25 bp, Rattus norvegicus
cgcgaagcctgagggccctaagttt

SEQ ID NO: 462575 - DNA, 25 bp, Rattus norvegicus
tgggcaccggaaacccaccgagcat

SEQ ID NO: 462576 - DNA, 25 bp, Rattus norvegicus
acccagcacgcgacacttgggagtc

SEQ ID NO: 462577 - DNA, 25 bp, Rattus norvegicus
gaccggttcgtctggttcaccaatc

SEQ ID NO: 462578 - DNA, 25 bp, Rattus norvegicus
gtatcaccttttcccacagcatgca

SEQ ID NO: 462579 - DNA, 25 bp, Rattus norvegicus
tcccggctttgcaccgaattcagta

SEQ ID NO: 462580 - DNA, 25 bp, Rattus norvegicus
tggacttcacgcagtcccggctttg

SEQ ID NO: 462581 - DNA, 25 bp, Rattus norvegicus
gtctttcgaagctggtacaggtgca

SEQ ID NO: 462582 - DNA, 25 bp, Rattus norvegicus
aaagccctgggcagtctttcgaagc

SEQ ID NO: 462583 - DNA, 25 bp, Rattus norvegicus
ccagcaaggagtaccgcaaggcggt

SEQ ID NO: 462584 - DNA, 25 bp, Rattus norvegicus
cgtcacatcggctgagggaagcctg

SEQ ID NO: 462585 - DNA, 25 bp, Rattus norvegicus
acacgcaactgctggagctggagaa

SEQ ID NO: 462586 - DNA, 25 bp, Rattus norvegicus
cgccttgctggacctcaccgaaagg

SEQ ID NO: 462587 - DNA, 25 bp, Rattus norvegicus
tcaccgaaaggcaggtcaaagtctg

SEQ ID NO: 462588 - DNA, 25 bp, Rattus norvegicus
gcagactgcgcacggcctataccaa

SEQ ID NO: 462589 - DNA, 25 bp, Rattus norvegicus
gagaaccgcccgatggagaaccagg

SEQ ID NO: 462590 - DNA, 25 bp, Rattus norvegicus
ggcctataccaacacgcaactgctg

SEQ ID NO: 462591 - DNA, 25 bp, Rattus norvegicus
ggaagcctgctttctcccagccgag

SEQ ID NO: 462592 - DNA, 25 bp, Rattus norvegicus
tgcacaatgctcagagccggaggcc

SEQ ID NO: 462593 - DNA, 25 bp, Rattus norvegicus
cgagcggcaggattcgcctttcctg

SEQ ID NO: 462594 - DNA, 25 bp, Rattus norvegicus
cggacctcaacttcttcgctgcaga

SEQ ID NO: 462595 - DNA, 25 bp, Rattus norvegicus
cgctgcagattcctgtctcccgatg

SEQ ID NO: 462596 - DNA, 25 bp, Rattus norvegicus
tgtctcccgatgtccggaggccttt

SEQ ID NO: 462597 - DNA, 25 bp, Rattus norvegicus
agcgacagactcagcatcgagaacc

SEQ ID NO: 462598 - DNA, 25 bp, Rattus norvegicus
agttagtcaggctgggaagctgtca

SEQ ID NO: 462599 - DNA, 25 bp, Rattus norvegicus
ttggccgttgagaaggccgcttcca

SEQ ID NO: 462600 - DNA, 25 bp, Rattus norvegicus
tctgcccttcctgtccgaaagtaga

SEQ ID NO: 462601 - DNA, 25 bp, Rattus norvegicus
tttgcaaacctctgcgacggccttg

SEQ ID NO: 462602 - DNA, 25 bp, Rattus norvegicus
ggtcctggagcttccgctttgcaaa

SEQ ID NO: 462603 - DNA, 25 bp, Rattus norvegicus
tctccaggtctggaggtcgggcatc

SEQ ID NO: 462604 - DNA, 25 bp, Rattus norvegicus
gcacttggggattccgcggttccga

SEQ ID NO: 462605 - DNA, 25 bp, Rattus norvegicus
ttctccctctgctacgcggagcgga

SEQ ID NO: 462606 - DNA, 25 bp, Rattus norvegicus
gaagctgtcagtcatggcgctgtcc

SEQ ID NO: 462607 - DNA, 25 bp, Rattus norvegicus
ttcggtagctagtagttagtcaggc

SEQ ID NO: 462608 - DNA, 25 bp, Rattus norvegicus
cccgttctgtcaagttcggtagcta

SEQ ID NO: 462609 - DNA, 25 bp, Rattus norvegicus
aactccgctccagagtcgactttcg

SEQ ID NO: 462610 - DNA, 25 bp, Rattus norvegicus
cgggccttaggaactccgctccaga

SEQ ID NO: 462611 - DNA, 25 bp, Rattus norvegicus
tgtcctcgcgactgtggcgtcttct

SEQ ID NO: 462612 - DNA, 25 bp, Rattus norvegicus
aacgctagcaagctgccggccagga

SEQ ID NO: 462613 - DNA, 25 bp, Rattus norvegicus
aagtcagggcagcagttctgaggca

SEQ ID NO: 462614 - DNA, 25 bp, Rattus norvegicus
cagggaagctggaacgctagcaagc

SEQ ID NO: 462615 - DNA, 25 bp, Rattus norvegicus
aagctgccggccaggagcctgagca

SEQ ID NO: 462616 - DNA, 25 bp, Rattus norvegicus
agcctgagcactgcagtcacccaga

SEQ ID NO: 462617 - DNA, 25 bp, Rattus norvegicus
gagcactgcagtcacccagacactt

SEQ ID NO: 462618 - DNA, 25 bp, Rattus norvegicus
caagatcgccatctcgcagcaggcg

SEQ ID NO: 462619 - DNA, 25 bp, Rattus norvegicus
gctctgagcctacggtccagaccgg

SEQ ID NO: 462620 - DNA, 25 bp, Rattus norvegicus
gtccagaccgggaatccagctgctc

SEQ ID NO: 462621 - DNA, 25 bp, Rattus norvegicus
ccgggaatccagctgctctcgagca

SEQ ID NO: 462622 - DNA, 25 bp, Rattus norvegicus
tccagctgctctcgagcatgcgcag

SEQ ID NO: 462623 - DNA, 25 bp, Rattus norvegicus
tcctccgggtcttcgcgacggtctg

SEQ ID NO: 462624 - DNA, 25 bp, Rattus norvegicus
tggcggagaggcacgccaaccaata

SEQ ID NO: 462625 - DNA, 25 bp, Rattus norvegicus
gaggcacgccaaccaataggaggga

SEQ ID NO: 462626 - DNA, 25 bp, Rattus norvegicus
cgattcctgcgtgcccgggatttcg

SEQ ID NO: 462627 - DNA, 25 bp, Rattus norvegicus
ctctggttcccgctgccgtggagga

SEQ ID NO: 462628 - DNA, 25 bp, Rattus norvegicus
attccgcccgtcgatgctctggttc

SEQ ID NO: 462629 - DNA, 25 bp, Rattus norvegicus
agacccgggattccgcccgtcgatg

SEQ ID NO: 462630 - DNA, 25 bp, Rattus norvegicus
aagcgcgcctagacccgggattccg

SEQ ID NO: 462631 - DNA, 25 bp, Rattus norvegicus
cagtgtggctgcaagcgcgcctaga

SEQ ID NO: 462632 - DNA, 25 bp, Rattus norvegicus
tccacgcgtaccgagcgtggcagtg

SEQ ID NO: 462633 - DNA, 25 bp, Rattus norvegicus
gggccagtggttggaaaacagctca

SEQ ID NO: 462634 - DNA, 25 bp, Rattus norvegicus
cgggatttcgacctggacctggcct

SEQ ID NO: 462635 - DNA, 25 bp, Rattus norvegicus
ttcttgttgcgattcctgcgtgccc

SEQ ID NO: 462636 - DNA, 25 bp, Rattus norvegicus
cacagacgctttcttgttgcgattc

SEQ ID NO: 462637 - DNA, 25 bp, Rattus norvegicus
gcagccgctcacagacgctttcttg

SEQ ID NO: 462638 - DNA, 25 bp, Rattus norvegicus
cagtggttggaaaacagctcaacga

SEQ ID NO: 462639 - DNA, 25 bp, Rattus norvegicus
tggcctggcgcgtaagtgtgaaccc

SEQ ID NO: 462640 - DNA, 25 bp, Rattus norvegicus
tcgcgaaaggctcggcacagagaca

SEQ ID NO: 462641 - DNA, 25 bp, Rattus norvegicus
cgaggactcccaggaaacaggaggc

SEQ ID NO: 462642 - DNA, 25 bp, Rattus norvegicus
tggaagtcagtcaatcgcaacgcta

SEQ ID NO: 462643 - DNA, 25 bp, Rattus norvegicus
tgtcacgagtctggcgaaagtcctc

SEQ ID NO: 462644 - DNA, 25 bp, Rattus norvegicus
atcgcaacgctagaatgggctggtg

SEQ ID NO: 462645 - DNA, 25 bp, Rattus norvegicus
gaggaagtcgagcatccagcccgca

SEQ ID NO: 462646 - DNA, 25 bp, Rattus norvegicus
tgcacccggcagtcgaacaactctg

SEQ ID NO: 462647 - DNA, 25 bp, Rattus norvegicus
tcgaacaactctgcgtcgtctctcg

SEQ ID NO: 462648 - DNA, 25 bp, Rattus norvegicus
cttctctggagaatccgcgcttgtc

SEQ ID NO: 462649 - DNA, 25 bp, Rattus norvegicus
cccgccatgttaaaccgaaagcgtg

SEQ ID NO: 462650 - DNA, 25 bp, Rattus norvegicus
cgaaagcgcgcgttgttcctcagct

SEQ ID NO: 462651 - DNA, 25 bp, Rattus norvegicus
cagctggcgcagtttggctcacgat

SEQ ID NO: 462652 - DNA, 25 bp, Rattus norvegicus
ctcacgatgggcgtggaagtcagtc

SEQ ID NO: 462653 - DNA, 25 bp, Rattus norvegicus
cggcccgggtacaagagagaaagca

SEQ ID NO: 462654 - DNA, 25 bp, Rattus norvegicus
agggtataaacctgccgcgtctcca

SEQ ID NO: 462655 - DNA, 25 bp, Rattus norvegicus
tgcgcgccctagagctcggagtaca

SEQ ID NO: 462656 - DNA, 25 bp, Rattus norvegicus
gcgccgcagaacctttttaagtggc

SEQ ID NO: 462657 - DNA, 25 bp, Rattus norvegicus
gccggatagcgatcgtgaacgcgat

SEQ ID NO: 462658 - DNA, 25 bp, Rattus norvegicus
atcgtgaacgcgatggcaagcctgg

SEQ ID NO: 462659 - DNA, 25 bp, Rattus norvegicus
ctgtgcgcatgggttttgctgctgt

SEQ ID NO: 462660 - DNA, 25 bp, Rattus norvegicus
ttttgctgctgtgcgggcttgcaag

SEQ ID NO: 462661 - DNA, 25 bp, Rattus norvegicus
ccggatcctatgagcgcggctccaa

SEQ ID NO: 462662 - DNA, 25 bp, Rattus norvegicus
gtcccatcatcggtaaggagacttg

SEQ ID NO: 462663 - DNA, 25 bp, Rattus norvegicus
tcaggtgttgaggaccgtagtccga

SEQ ID NO: 462664 - DNA, 25 bp, Rattus norvegicus
ggcggtgccaagcacgttccctgag

SEQ ID NO: 462665 - DNA, 25 bp, Rattus norvegicus
agcgtgcagacccacgatgctcgtg

SEQ ID NO: 462666 - DNA, 25 bp, Rattus norvegicus
gcgctctgttttgcaagcgtgcaga

SEQ ID NO: 462667 - DNA, 25 bp, Rattus norvegicus
cgtagtccgagaggcgctctgtttt

SEQ ID NO: 462668 - DNA, 25 bp, Rattus norvegicus
ctgatccagggacggagccctacta

SEQ ID NO: 462669 - DNA, 25 bp, Rattus norvegicus
cagtgaaacctaacgcgtgggacca

SEQ ID NO: 462670 - DNA, 25 bp, Rattus norvegicus
ctcctgcgggcaagagctaccaggc

SEQ ID NO: 462671 - DNA, 25 bp, Rattus norvegicus
cttagcccggagcttctgatccagg

SEQ ID NO: 462672 - DNA, 25 bp, Rattus norvegicus
ggggaaatcgctctctcttggtgcg

SEQ ID NO: 462673 - DNA, 25 bp, Rattus norvegicus
agccctactagccagtccgaaatgc

SEQ ID NO: 462674 - DNA, 25 bp, Rattus norvegicus
gtccgaaatgcagactggttccaga

SEQ ID NO: 462675 - DNA, 25 bp, Rattus norvegicus
ggacgcactgggcacttaccagctg

SEQ ID NO: 462676 - DNA, 25 bp, Rattus norvegicus
ctgcagtgcgcagagacagaccagc

SEQ ID NO: 462677 - DNA, 25 bp, Rattus norvegicus
ctgtatcctgcgacttcagagctgc

SEQ ID NO: 462678 - DNA, 25 bp, Rattus norvegicus
cgcagccagctttccgttttcggac

SEQ ID NO: 462679 - DNA, 25 bp, Rattus norvegicus
cgccgcctttgttaatctgcttgca

SEQ ID NO: 462680 - DNA, 25 bp, Rattus norvegicus
ccttacctcctagcgcgagggtcgg

SEQ ID NO: 462681 - DNA, 25 bp, Rattus norvegicus
gcacagacatcctggaagggacaga

SEQ ID NO: 462682 - DNA, 25 bp, Rattus norvegicus
ggaacccagctcagtcgggccgatc

SEQ ID NO: 462683 - DNA, 25 bp, Rattus norvegicus
tcttgagcccgtacttgcgcgagta

SEQ ID NO: 462684 - DNA, 25 bp, Rattus norvegicus
tgcgcgagtacagcttgccacagta

SEQ ID NO: 462685 - DNA, 25 bp, Rattus norvegicus
gtagaggcacaagtggcccgtcttg

SEQ ID NO: 462686 - DNA, 25 bp, Rattus norvegicus
ctgccatctcggacagctgctgcgt

SEQ ID NO: 462687 - DNA, 25 bp, Rattus norvegicus
tgcatggcgatctcgcggtcgatac

SEQ ID NO: 462688 - DNA, 25 bp, Rattus norvegicus
gtcgatactggccagggaacccagc

SEQ ID NO: 462689 - DNA, 25 bp, Rattus norvegicus
tccgggtatttgagcagcccgccca

SEQ ID NO: 462690 - DNA, 25 bp, Rattus norvegicus
ccaagtgcagcttgagagggtaata

SEQ ID NO: 462691 - DNA, 25 bp, Rattus norvegicus
tagagcaggtctccgctgtacaccg

SEQ ID NO: 462692 - DNA, 25 bp, Rattus norvegicus
ctgtacaccgtgaaggccggcatga

SEQ ID NO: 462693 - DNA, 25 bp, Rattus norvegicus
tccacgtgcttgaaggccgacgcct

SEQ ID NO: 462694 - DNA, 25 bp, Rattus norvegicus
tgcgtccgcatgtggatcttgagcc

SEQ ID NO: 462695 - DNA, 25 bp, Rattus norvegicus
gccgctcaaataggagatggactcc

SEQ ID NO: 462696 - DNA, 25 bp, Rattus norvegicus
tcttctgtccgctgagtgacgcggg

SEQ ID NO: 462697 - DNA, 25 bp, Rattus norvegicus
atgcactgcgccttttcaatccggg

SEQ ID NO: 462698 - DNA, 25 bp, Rattus norvegicus
gacgtgcgtcttctgtccgctgagt

SEQ ID NO: 462699 - DNA, 25 bp, Rattus norvegicus
gaggaatccgcagcccgacgtgcgt

SEQ ID NO: 462700 - DNA, 25 bp, Rattus norvegicus
ccgcctgcgaggaggaatccgcagc

SEQ ID NO: 462701 - DNA, 25 bp, Rattus norvegicus
tgacagaaccaggagcagccgcctg

SEQ ID NO: 462702 - DNA, 25 bp, Rattus norvegicus
ctccaccgggcgcaagtgacagaac

SEQ ID NO: 462703 - DNA, 25 bp, Rattus norvegicus
gttccgtgcattgttgccaccgccg

SEQ ID NO: 462704 - DNA, 25 bp, Rattus norvegicus
cgggaagttccgtgcattgttgcca

SEQ ID NO: 462705 - DNA, 25 bp, Rattus norvegicus
agtcagcgttcacgctggtggccga

SEQ ID NO: 462706 - DNA, 25 bp, Rattus norvegicus
ccgggatgcagcagtcagcgttcac

SEQ ID NO: 462707 - DNA, 25 bp, Rattus norvegicus
gcccaaggcgcaagccagccgggat

SEQ ID NO: 462708 - DNA, 25 bp, Rattus norvegicus
acgctggggctcacggggtcctcca

SEQ ID NO: 462709 - DNA, 25 bp, Rattus norvegicus
gcgccttttggcaccgcgaacgcaa

SEQ ID NO: 462710 - DNA, 25 bp, Rattus norvegicus
ctagaggccctgttaaagcgaaatc

SEQ ID NO: 462711 - DNA, 25 bp, Rattus norvegicus
gggctctgggaacgccaccagatga

SEQ ID NO: 462712 - DNA, 25 bp, Rattus norvegicus
atagaaaggctgagaccgggctctg

SEQ ID NO: 462713 - DNA, 25 bp, Rattus norvegicus
ttaaggccggctctgaatagaaagg

SEQ ID NO: 462714 - DNA, 25 bp, Rattus norvegicus
aagaacggccaggtcgcctctctgg

SEQ ID NO: 462715 - DNA, 25 bp, Rattus norvegicus
tatcgacttaaaatgggcgtctaga

SEQ ID NO: 462716 - DNA, 25 bp, Rattus norvegicus
tctcctggcaaagccgagccggcta

SEQ ID NO: 462717 - DNA, 25 bp, Rattus norvegicus
aacgagccagcctaggccttccgga

SEQ ID NO: 462718 - DNA, 25 bp, Rattus norvegicus
agcgaaatccctcctacacgggagg

SEQ ID NO: 462719 - DNA, 25 bp, Rattus norvegicus
aacttgtagccaaggacgcagcccg

SEQ ID NO: 462720 - DNA, 25 bp, Rattus norvegicus
gcggccgagagtcttcaaacttgta

SEQ ID NO: 462721 - DNA, 25 bp, Rattus norvegicus
tccgggagacatcgaagaacggcca

SEQ ID NO: 462722 - DNA, 25 bp, Rattus norvegicus
aggttgccctgagaagctccagctc

SEQ ID NO: 462723 - DNA, 25 bp, Rattus norvegicus
cgaccagtctgagccgggccaaggc

SEQ ID NO: 462724 - DNA, 25 bp, Rattus norvegicus
ggccgagtccgatcttcttggtgac

SEQ ID NO: 462725 - DNA, 25 bp, Rattus norvegicus
tcttcttggtgaccggggcgtgcac

SEQ ID NO: 462726 - DNA, 25 bp, Rattus norvegicus
agaagctcctgcgtgtggaagctgc

SEQ ID NO: 462727 - DNA, 25 bp, Rattus norvegicus
ggcccaggctttggggtcactgcaa

SEQ ID NO: 462728 - DNA, 25 bp, Rattus norvegicus
ccaggctttggggtcactgcaaccc

SEQ ID NO: 462729 - DNA, 25 bp, Rattus norvegicus
cctgtgtcttcgcttaggcggtgag

SEQ ID NO: 462730 - DNA, 25 bp, Rattus norvegicus
gcttaggcggtgaggcctttttgta

SEQ ID NO: 462731 - DNA, 25 bp, Rattus norvegicus
gcctttttgtaggtgagccagccta

SEQ ID NO: 462732 - DNA, 25 bp, Rattus norvegicus
agccagcctagaaagagaggttttc

SEQ ID NO: 462733 - DNA, 25 bp, Rattus norvegicus
aagagaggttttctcgcgtactctc

SEQ ID NO: 462734 - DNA, 25 bp, Rattus norvegicus
gcgtactctcgcgtccagattcaca

SEQ ID NO: 462735 - DNA, 25 bp, Rattus norvegicus
tcgcgtccagattcacagaggcacc

SEQ ID NO: 462736 - DNA, 25 bp, Rattus norvegicus
tccagattcacagaggcacccggcg

SEQ ID NO: 462737 - DNA, 25 bp, Rattus norvegicus
gagccgggccgagtccgatcttctt

SEQ ID NO: 462738 - DNA, 25 bp, Rattus norvegicus
agatgggctttcattgtgagactcc

SEQ ID NO: 462739 - DNA, 25 bp, Rattus norvegicus
ggggtctgacctgaccgtgcacatg

SEQ ID NO: 462740 - DNA, 25 bp, Rattus norvegicus
agtttcacccgatccaggggtctga

SEQ ID NO: 462741 - DNA, 25 bp, Rattus norvegicus
agtttaccatccgtctttcagcggg

SEQ ID NO: 462742 - DNA, 25 bp, Rattus norvegicus
gtgagactccgcctgtatgcaaatg

SEQ ID NO: 462743 - DNA, 25 bp, Rattus norvegicus
ctccgagacgggaacagatgggctt

SEQ ID NO: 462744 - DNA, 25 bp, Rattus norvegicus
cgtgcacatgcatttactcaacgtg

SEQ ID NO: 462745 - DNA, 25 bp, Rattus norvegicus
caatcgatttgtactccgagacggg

SEQ ID NO: 462746 - DNA, 25 bp, Rattus norvegicus
ctgcgagtcgggtgacaatcgattt

SEQ ID NO: 462747 - DNA, 25 bp, Rattus norvegicus
gccgctgtcatttgctgcgagtcgg

SEQ ID NO: 462748 - DNA, 25 bp, Rattus norvegicus
tttactcaacgtggctcagcctggg

SEQ ID NO: 462749 - DNA, 25 bp, Rattus norvegicus
atggcaatcggatagtaccagcggc

SEQ ID NO: 462750 - DNA, 25 bp, Rattus norvegicus
taccagcggcaggtcaagtttacca

SEQ ID NO: 462751 - DNA, 25 bp, Rattus norvegicus
tgtatgcaaatgtgaacggagtttc

SEQ ID NO: 462752 - DNA, 25 bp, Rattus norvegicus
cgcgtgcgcagtgaaaaccctttag

SEQ ID NO: 462753 - DNA, 25 bp, Rattus norvegicus
gccgggacctggaacttattctctg

SEQ ID NO: 462754 - DNA, 25 bp, Rattus norvegicus
gatcacatgctcataagcctggctg

SEQ ID NO: 462755 - DNA, 25 bp, Rattus norvegicus
cctggctgagagtcaatatgacttc

SEQ ID NO: 462756 - DNA, 25 bp, Rattus norvegicus
gacttcagacgaaaagcggatgtta

SEQ ID NO: 462757 - DNA, 25 bp, Rattus norvegicus
ttcacttccgggtgagacccatcgg

SEQ ID NO: 462758 - DNA, 25 bp, Rattus norvegicus
gggcgccatcttgtcttgttcatga

SEQ ID NO: 462759 - DNA, 25 bp, Rattus norvegicus
gtggcgacaacggtattccggaatc

SEQ ID NO: 462760 - DNA, 25 bp, Rattus norvegicus
actcctcttggtttgtgtggcgaag

SEQ ID NO: 462761 - DNA, 25 bp, Rattus norvegicus
acttaggctgcgtacgctgcttggc

SEQ ID NO: 462762 - DNA, 25 bp, Rattus norvegicus
accggcgtccgccagagatagtgaa

SEQ ID NO: 462763 - DNA, 25 bp, Rattus norvegicus
agagagctgctcttgccgaaaaaga

SEQ ID NO: 462764 - DNA, 25 bp, Rattus norvegicus
ggagagagctcacgacccattcttc

SEQ ID NO: 462765 - DNA, 25 bp, Rattus norvegicus
gcggactcgtcaaatcggtaagatc

SEQ ID NO: 462766 - DNA, 25 bp, Rattus norvegicus
caccgcagtctctggcccttaggaa

SEQ ID NO: 462767 - DNA, 25 bp, Rattus norvegicus
ggagcaaaaagtagctgcgcctact

SEQ ID NO: 462768 - DNA, 25 bp, Rattus norvegicus
caaaaagtagctgcgcctacttcgc

SEQ ID NO: 462769 - DNA, 25 bp, Rattus norvegicus
tagctgcgcctacttcgcctcctcc

SEQ ID NO: 462770 - DNA, 25 bp, Rattus norvegicus
cgcctccacgcctcgtccgccgtgg

SEQ ID NO: 462771 - DNA, 25 bp, Rattus norvegicus
gtccgccgtggccaccgcagtctct

SEQ ID NO: 462772 - DNA, 25 bp, Rattus norvegicus
accgcagtctctggcccttaggaag

SEQ ID NO: 462773 - DNA, 25 bp, Rattus norvegicus
ctctggcccttaggaagcagagctc

SEQ ID NO: 462774 - DNA, 25 bp, Rattus norvegicus
aggaagcagagctccgggcggcggt

SEQ ID NO: 462775 - DNA, 25 bp, Rattus norvegicus
ggccaggttccagtgggcacagtat

SEQ ID NO: 462776 - DNA, 25 bp, Rattus norvegicus
ccaggttccagtgggcacagtatgg

SEQ ID NO: 462777 - DNA, 25 bp, Rattus norvegicus
tccagtgggcacagtatggggtcgc

SEQ ID NO: 462778 - DNA, 25 bp, Rattus norvegicus
gcggagcaaaaagtagctgcgccta

SEQ ID NO: 462779 - DNA, 25 bp, Rattus norvegicus
cagtctctggcccttaggaagcaga

SEQ ID NO: 462780 - DNA, 25 bp, Rattus norvegicus
tggagaggtggaaggctgagctctc

SEQ ID NO: 462781 - DNA, 25 bp, Rattus norvegicus
gccgtccggctctgtgggttcagcc

SEQ ID NO: 462782 - DNA, 25 bp, Rattus norvegicus
ttccgcaagcctgggttgccagtgg

SEQ ID NO: 462783 - DNA, 25 bp, Rattus norvegicus
aggttcttccgcaagcctgggttgc

SEQ ID NO: 462784 - DNA, 25 bp, Rattus norvegicus
tgtcggtgcggaggttcttccgcaa

SEQ ID NO: 462785 - DNA, 25 bp, Rattus norvegicus
taacttcatggaccggtgagtgtcg

SEQ ID NO: 462786 - DNA, 25 bp, Rattus norvegicus
ctcgtgtaacttcatggaccggtga

SEQ ID NO: 462787 - DNA, 25 bp, Rattus norvegicus
gagcctcctcgtgtaacttcatgga

SEQ ID NO: 462788 - DNA, 25 bp, Rattus norvegicus
agcgcggtagccgagcctcctcgtg

SEQ ID NO: 462789 - DNA, 25 bp, Rattus norvegicus
ctagaaacacttgggtttgcgtgcc

SEQ ID NO: 462790 - DNA, 25 bp, Rattus norvegicus
tcctagaaacacttgggtttgcgtg

SEQ ID NO: 462791 - DNA, 25 bp, Rattus norvegicus
gctctcgtggggttcgtttcctaga

SEQ ID NO: 462792 - DNA, 25 bp, Rattus norvegicus
ctctgtgggttcagcccgccaggtc

SEQ ID NO: 462793 - DNA, 25 bp, Rattus norvegicus
ctgagctctcgtggggttcgtttcc

SEQ ID NO: 462794 - DNA, 25 bp, Rattus norvegicus
ttggctcagccgcagtaatcgcagc

SEQ ID NO: 462795 - DNA, 25 bp, Rattus norvegicus
tccacgaactcctggtcattaggtg

SEQ ID NO: 462796 - DNA, 25 bp, Rattus norvegicus
cggctgcgtatctgctccacgaact

SEQ ID NO: 462797 - DNA, 25 bp, Rattus norvegicus
ggctcggatccctggtggaagaaaa

SEQ ID NO: 462798 - DNA, 25 bp, Rattus norvegicus
cctttgcaggattacggtgggatca

SEQ ID NO: 462799 - DNA, 25 bp, Rattus norvegicus
gacatcatcgctttccctttgcagg

SEQ ID NO: 462800 - DNA, 25 bp, Rattus norvegicus
cttctccttttatggggacatcatc

SEQ ID NO: 462801 - DNA, 25 bp, Rattus norvegicus
agagcatctccttcttcggctggtg

SEQ ID NO: 462802 - DNA, 25 bp, Rattus norvegicus
ggacctgagctggaaccagagcatc

SEQ ID NO: 462803 - DNA, 25 bp, Rattus norvegicus
gttggctttgcctcgtccaggccgt

SEQ ID NO: 462804 - DNA, 25 bp, Rattus norvegicus
acaaagaacgcctgcgagaggcctc

SEQ ID NO: 462805 - DNA, 25 bp, Rattus norvegicus
tttccacgcaccgacacaaagaacg

SEQ ID NO: 462806 - DNA, 25 bp, Rattus norvegicus
ccctggggagcaatgacatcacgtg

SEQ ID NO: 462807 - DNA, 25 bp, Rattus norvegicus
aggtgactttatcccgcctctgttg

SEQ ID NO: 462808 - DNA, 25 bp, Rattus norvegicus
atgatcccgcggcttcgtggatttc

SEQ ID NO: 462809 - DNA, 25 bp, Rattus norvegicus
cgcggcttcgtggatttcccggcct

SEQ ID NO: 462810 - DNA, 25 bp, Rattus norvegicus
caccagccctggacttggcgctgga

SEQ ID NO: 462811 - DNA, 25 bp, Rattus norvegicus
gggaagcccgccgagatgatcccgc

SEQ ID NO: 462812 - DNA, 25 bp, Rattus norvegicus
tggctaccctacacacgcgtccggg

SEQ ID NO: 462813 - DNA, 25 bp, Rattus norvegicus
caaggggtccacagcccggtggcta

SEQ ID NO: 462814 - DNA, 25 bp, Rattus norvegicus
cacacaacggcactcggcaaggggt

SEQ ID NO: 462815 - DNA, 25 bp, Rattus norvegicus
ttggcgctggatcccgctgcccgag

SEQ ID NO: 462816 - DNA, 25 bp, Rattus norvegicus
cccaaaccagggagggctagagtga

SEQ ID NO: 462817 - DNA, 25 bp, Rattus norvegicus
gtctgtgcagcagcgatgctggctc

SEQ ID NO: 462818 - DNA, 25 bp, Rattus norvegicus
tgtctctcccggtggctagcacaca

SEQ ID NO: 462819 - DNA, 25 bp, Rattus norvegicus
aagaggttctctgcgcgccgcacca

SEQ ID NO: 462820 - DNA, 25 bp, Rattus norvegicus
ttccatctgcggtgttctcccgctg

SEQ ID NO: 462821 - DNA, 25 bp, Rattus norvegicus
gggaaaaaatcaagaggttctctgc

SEQ ID NO: 462822 - DNA, 25 bp, Rattus norvegicus
tgcaggctgcgcaaccgtgacttcc

SEQ ID NO: 462823 - DNA, 25 bp, Rattus norvegicus
atactgggagcagcctcctgctgcc

SEQ ID NO: 462824 - DNA, 25 bp, Rattus norvegicus
gcgctcacggcgagctgcggacact

SEQ ID NO: 462825 - DNA, 25 bp, Rattus norvegicus
tctcttgggcctgacgcgctcacgg

SEQ ID NO: 462826 - DNA, 25 bp, Rattus norvegicus
gtgcggccgtctcttgtccgggctc

SEQ ID NO: 462827 - DNA, 25 bp, Rattus norvegicus
gacactcggcctgcaggctgcgcaa

SEQ ID NO: 462828 - DNA, 25 bp, Rattus norvegicus
cctatggtgctgtgctgctgtgcag

SEQ ID NO: 462829 - DNA, 25 bp, Rattus norvegicus
ccacgcgtgcctatggtgctgtgct

SEQ ID NO: 462830 - DNA, 25 bp, Rattus norvegicus
gctctgggcccacgcgtgcctatgg

SEQ ID NO: 462831 - DNA, 25 bp, Rattus norvegicus
tccctcctcaaggtctcgacgtccc

SEQ ID NO: 462832 - DNA, 25 bp, Rattus norvegicus
accctgcagggtacggcgctttctt

SEQ ID NO: 462833 - DNA, 25 bp, Rattus norvegicus
gtggcgaagctctgctcgcccagtc

SEQ ID NO: 462834 - DNA, 25 bp, Rattus norvegicus
cagcacgggatactgggagcagcct

SEQ ID NO: 462835 - DNA, 25 bp, Rattus norvegicus
ttgtccgggctctcttgggcctgac

SEQ ID NO: 462836 - DNA, 25 bp, Rattus norvegicus
cagctgggataaagggcggcctccc

SEQ ID NO: 462837 - DNA, 25 bp, Rattus norvegicus
aggcgctgatttcattcccgcgcgg

SEQ ID NO: 462838 - DNA, 25 bp, Rattus norvegicus
ctcttcagctgggataaagggcggc

SEQ ID NO: 462839 - DNA, 25 bp, Rattus norvegicus
ccgaggactcttcagctgggataaa

SEQ ID NO: 462840 - DNA, 25 bp, Rattus norvegicus
gggttgcgtgtctcctcctgcagcc

SEQ ID NO: 462841 - DNA, 25 bp, Rattus norvegicus
ctctctcctcctcagggacgccgcg

SEQ ID NO: 462842 - DNA, 25 bp, Rattus norvegicus
tctggggtcgttgcttccacgaaac

SEQ ID NO: 462843 - DNA, 25 bp, Rattus norvegicus
gcttctcccatgtctggggtcgttg

SEQ ID NO: 462844 - DNA, 25 bp, Rattus norvegicus
agccctggatgctcagccgtcagct

SEQ ID NO: 462845 - DNA, 25 bp, Rattus norvegicus
actcctctcgatggcttctcccatg

SEQ ID NO: 462846 - DNA, 25 bp, Rattus norvegicus
atgctcagccgtcagctgccgggag

SEQ ID NO: 462847 - DNA, 25 bp, Rattus norvegicus
gccgggaggcgctgatttcattccc

SEQ ID NO: 462848 - DNA, 25 bp, Rattus norvegicus
cctgcaagagccctggatgctcagc

SEQ ID NO: 462849 - DNA, 25 bp, Rattus norvegicus
accttgtgccttctgcggtcgccca

SEQ ID NO: 462850 - DNA, 25 bp, Rattus norvegicus
acagcgcggtgatccactggtgagc

SEQ ID NO: 462851 - DNA, 25 bp, Rattus norvegicus
actgggcgctctggttaaaggagcc

SEQ ID NO: 462852 - DNA, 25 bp, Rattus norvegicus
tcgccatgactctcggagccggact

SEQ ID NO: 462853 - DNA, 25 bp, Rattus norvegicus
ccgttgctctgcagcgcaccgtagt

SEQ ID NO: 462854 - DNA, 25 bp, Rattus norvegicus
gctgtaccaccaccgagggcttgat

SEQ ID NO: 462855 - DNA, 25 bp, Rattus norvegicus
aaccaccgttggaagctcccatgga

SEQ ID NO: 462856 - DNA, 25 bp, Rattus norvegicus
ctgcgaatagagcaaaccaccgttg

SEQ ID NO: 462857 - DNA, 25 bp, Rattus norvegicus
tggtctgcatgatggggctcatcgt

SEQ ID NO: 462858 - DNA, 25 bp, Rattus norvegicus
gcctctgcttgaattgcttggcgaa

SEQ ID NO: 462859 - DNA, 25 bp, Rattus norvegicus
tcctagtttgatccgcctctgcttg

SEQ ID NO: 462860 - DNA, 25 bp, Rattus norvegicus
cccacgtctgcttgagtaaatccta

SEQ ID NO: 462861 - DNA, 25 bp, Rattus norvegicus
aagacgttgccgtacagggtgccaa

SEQ ID NO: 462862 - DNA, 25 bp, Rattus norvegicus
caccgtgaagctgggctgcgaatag

SEQ ID NO: 462863 - DNA, 25 bp, Rattus norvegicus
gtagtcgccctgcaccaggctctgt

SEQ ID NO: 462864 - DNA, 25 bp, Rattus norvegicus
aggcctcggagcatcttaatctata

SEQ ID NO: 462865 - DNA, 25 bp, Rattus norvegicus
agttccaccctcttcagtgcgcaga

SEQ ID NO: 462866 - DNA, 25 bp, Rattus norvegicus
cacagccatttaggaggcgcattta

SEQ ID NO: 462867 - DNA, 25 bp, Rattus norvegicus
ctgagagtcccattgcgaacgcaca

SEQ ID NO: 462868 - DNA, 25 bp, Rattus norvegicus
tggctgcgaatctccacgtgttctg

SEQ ID NO: 462869 - DNA, 25 bp, Rattus norvegicus
ccgggagtggctgaactgtttataa

SEQ ID NO: 462870 - DNA, 25 bp, Rattus norvegicus
tggagcgggccggaaaaaattcatc

SEQ ID NO: 462871 - DNA, 25 bp, Rattus norvegicus
ttggccaaattaacgctcagaggga

SEQ ID NO: 462872 - DNA, 25 bp, Rattus norvegicus
gccggcacagcacagcgaatcaaaa

SEQ ID NO: 462873 - DNA, 25 bp, Rattus norvegicus
atctaagctcaaactccggtctggg

SEQ ID NO: 462874 - DNA, 25 bp, Rattus norvegicus
cgtgcctccaagtcccaaggagttg

SEQ ID NO: 462875 - DNA, 25 bp, Rattus norvegicus
tttcgcgctaatctgggcaaaaaga

SEQ ID NO: 462876 - DNA, 25 bp, Rattus norvegicus
gcctgtctgtgcaactttcgcgcta

SEQ ID NO: 462877 - DNA, 25 bp, Rattus norvegicus
tcacgactaacgaggagcgctgctc

SEQ ID NO: 462878 - DNA, 25 bp, Rattus norvegicus
tctccagtatcggatcccgcgattt

SEQ ID NO: 462879 - DNA, 25 bp, Rattus norvegicus
tttcattgaggactcgcgagagggc

SEQ ID NO: 462880 - DNA, 25 bp, Rattus norvegicus
ggcgccgagttccttatctccagta

SEQ ID NO: 462881 - DNA, 25 bp, Rattus norvegicus
aatttcgcctgcttccggttttctg

SEQ ID NO: 462882 - DNA, 25 bp, Rattus norvegicus
atcccgcgattttcctgagcgctct

SEQ ID NO: 462883 - DNA, 25 bp, Rattus norvegicus
caggaaaccagcttgaggtgcgtga

SEQ ID NO: 462884 - DNA, 25 bp, Rattus norvegicus
gtgagggcctccaaacccactgcag

SEQ ID NO: 462885 - DNA, 25 bp, Rattus norvegicus
cgggcagcgctagacttttcattga

SEQ ID NO: 462886 - DNA, 25 bp, Rattus norvegicus
tgcctcaatccagagctacgtttta

SEQ ID NO: 462887 - DNA, 25 bp, Rattus norvegicus
taaagtggtctcacctcccaagctc

SEQ ID NO: 462888 - DNA, 25 bp, Rattus norvegicus
tcccaagctctcaaagttactcaga

SEQ ID NO: 462889 - DNA, 25 bp, Rattus norvegicus
tactcagaacgtggaagcagaatgc

SEQ ID NO: 462890 - DNA, 25 bp, Rattus norvegicus
agcagaatgcctatccctgtccaga

SEQ ID NO: 462891 - DNA, 25 bp, Rattus norvegicus
tgtccagaccgacaagctctcgcga

SEQ ID NO: 462892 - DNA, 25 bp, Rattus norvegicus
ctcccgacgggccaatcctgagtgt

SEQ ID NO: 462893 - DNA, 25 bp, Rattus norvegicus
ctcaggaagtctttaaaggccggcg

SEQ ID NO: 462894 - DNA, 25 bp, Rattus norvegicus
caggcgggccaatcaacgctcagga

SEQ ID NO: 462895 - DNA, 25 bp, Rattus norvegicus
gaccgagacccggtgaagtccactc

SEQ ID NO: 462896 - DNA, 25 bp, Rattus norvegicus
ggcctcagctgaaatccacatcttt

SEQ ID NO: 462897 - DNA, 25 bp, Rattus norvegicus
accagggctctcagtggtgatcgcc

SEQ ID NO: 462898 - DNA, 25 bp, Rattus norvegicus
gccagatgcagattccggcttctcc

SEQ ID NO: 462899 - DNA, 25 bp, Rattus norvegicus
cagcaccgaaccatatagccagatg

SEQ ID NO: 462900 - DNA, 25 bp, Rattus norvegicus
tactgctcaagtcgacaacccattc

SEQ ID NO: 462901 - DNA, 25 bp, Rattus norvegicus
aatgtcaccactactgctcaagtcg

SEQ ID NO: 462902 - DNA, 25 bp, Rattus norvegicus
gcgtgtcaaccgaggccaacactta

SEQ ID NO: 462903 - DNA, 25 bp, Rattus norvegicus
ggcggtaagacgcaccttccctagc

SEQ ID NO: 462904 - DNA, 25 bp, Rattus norvegicus
cggcttctccttccgggtgagtcgc

SEQ ID NO: 462905 - DNA, 25 bp, Rattus norvegicus
gatcgccggtcagcggagaatcacc

SEQ ID NO: 462906 - DNA, 25 bp, Rattus norvegicus
gcaccaggctctctccgggataaga

SEQ ID NO: 462907 - DNA, 25 bp, Rattus norvegicus
cggctcgttctaccctcccagcagc

SEQ ID NO: 462908 - DNA, 25 bp, Rattus norvegicus
tggcgcgtgcaacccggctcgttct

SEQ ID NO: 462909 - DNA, 25 bp, Rattus norvegicus
cagcctcgcaggtggcgcgtgcaac

SEQ ID NO: 462910 - DNA, 25 bp, Rattus norvegicus
aagccagccagcctcgcaggtggcg

SEQ ID NO: 462911 - DNA, 25 bp, Rattus norvegicus
tgtccgcggaaagagaaagccagcc

SEQ ID NO: 462912 - DNA, 25 bp, Rattus norvegicus
ggtgtgcgcgctaactcgcgcgctc

SEQ ID NO: 462913 - DNA, 25 bp, Rattus norvegicus
tgcagcagtgatgatcgcgcgctct

SEQ ID NO: 462914 - DNA, 25 bp, Rattus norvegicus
gaaactgcagcagctctgtctgccc

SEQ ID NO: 462915 - DNA, 25 bp, Rattus norvegicus
accctggggaaactgcagcagctct

SEQ ID NO: 462916 - DNA, 25 bp, Rattus norvegicus
ccgctcgaccctggggaaactgcag

SEQ ID NO: 462917 - DNA, 25 bp, Rattus norvegicus
tccgggataagacggctctgctttc

SEQ ID NO: 462918 - DNA, 25 bp, Rattus norvegicus
gggtcacgcgcacaccctgctgctc

SEQ ID NO: 462919 - DNA, 25 bp, Rattus norvegicus
tctctccgggataagacggctctgc

SEQ ID NO: 462920 - DNA, 25 bp, Rattus norvegicus
acttcaacgtggagaagcgagcgga

SEQ ID NO: 462921 - DNA, 25 bp, Rattus norvegicus
gagcggagtccagcatgcgtcctcc

SEQ ID NO: 462922 - DNA, 25 bp, Rattus norvegicus
gacgagcgcaccgtcggcgttttac

SEQ ID NO: 462923 - DNA, 25 bp, Rattus norvegicus
gcatgctccctgcacacagaggtca

SEQ ID NO: 462924 - DNA, 25 bp, Rattus norvegicus
cccacgtgcgtagtgaactaagggc

SEQ ID NO: 462925 - DNA, 25 bp, Rattus norvegicus
atgacccgcgccttcaggaacttca

SEQ ID NO: 462926 - DNA, 25 bp, Rattus norvegicus
agcaggagatcagcaagaggaagcc

SEQ ID NO: 462927 - DNA, 25 bp, Rattus norvegicus
agcacctgagtcgtgagtgcggccc

SEQ ID NO: 462928 - DNA, 25 bp, Rattus norvegicus
tccaggcctccggtgacattgaggt

SEQ ID NO: 462929 - DNA, 25 bp, Rattus norvegicus
gcaaggaatcccagagcccaaggca

SEQ ID NO: 462930 - DNA, 25 bp, Rattus norvegicus
ctctcttccggggtctgcacaggat

SEQ ID NO: 462931 - DNA, 25 bp, Rattus norvegicus
tctgcacaggatgcgcgcagagtct

SEQ ID NO: 462932 - DNA, 25 bp, Rattus norvegicus
agcaatgcccgcagtagtccgcgca

SEQ ID NO: 462933 - DNA, 25 bp, Rattus norvegicus
cgcagtctcctgcaggagcacctga

SEQ ID NO: 462934 - DNA, 25 bp, Rattus norvegicus
gcctaaccagcagcgggcgccttta

SEQ ID NO: 462935 - DNA, 25 bp, Rattus norvegicus
ggcacccgggagaggttcatggcac

SEQ ID NO: 462936 - DNA, 25 bp, Rattus norvegicus
gcaggcgagcgcatcctgggtaccg

SEQ ID NO: 462937 - DNA, 25 bp, Rattus norvegicus
cgccttttgtgcgaggtgtgagcgc

SEQ ID NO: 462938 - DNA, 25 bp, Rattus norvegicus
gctctatcgccgcggcgccttttgt

SEQ ID NO: 462939 - DNA, 25 bp, Rattus norvegicus
cagcggtcaccaactcccggctcta

SEQ ID NO: 462940 - DNA, 25 bp, Rattus norvegicus
atgtccgcaaagttccgggaggcag

SEQ ID NO: 462941 - DNA, 25 bp, Rattus norvegicus
gtgcgatgtccgcaaagttccggga

SEQ ID NO: 462942 - DNA, 25 bp, Rattus norvegicus
ctgcggtgcgatgtccgcaaagttc

SEQ ID NO: 462943 - DNA, 25 bp, Rattus norvegicus
gcgcctttaagagcgagcgctggtt

SEQ ID NO: 462944 - DNA, 25 bp, Rattus norvegicus
cccgcgctgcttcgggcctcctaga

SEQ ID NO: 462945 - DNA, 25 bp, Rattus norvegicus
gccgcggcttctccgggctaccgga

SEQ ID NO: 462946 - DNA, 25 bp, Rattus norvegicus
taagagcgagcgctggttaaccgga

SEQ ID NO: 462947 - DNA, 25 bp, Rattus norvegicus
tctccgcggcaggaagcggctggct

SEQ ID NO: 462948 - DNA, 25 bp, Rattus norvegicus
taagctggctccacaccgcagggaa

SEQ ID NO: 462949 - DNA, 25 bp, Rattus norvegicus
acaccgcagggaaccagtacctttg

SEQ ID NO: 462950 - DNA, 25 bp, Rattus norvegicus
accagtacctttgcgtggactcagc

SEQ ID NO: 462951 - DNA, 25 bp, Rattus norvegicus
tggactcagcaaactgcgcccgctg

SEQ ID NO: 462952 - DNA, 25 bp, Rattus norvegicus
aaactgcgcccgctggaagtcagcc

SEQ ID NO: 462953 - DNA, 25 bp, Rattus norvegicus
aagtcagccgccagacgccggatct

SEQ ID NO: 462954 - DNA, 25 bp, Rattus norvegicus
ggatctcctcccaggcgtccgccat

SEQ ID NO: 462955 - DNA, 25 bp, Rattus norvegicus
ccgcgacaccgggaaacggcagaca

SEQ ID NO: 462956 - DNA, 25 bp, Rattus norvegicus
accgggaaacggcagacacgtcagc

SEQ ID NO: 462957 - DNA, 25 bp, Rattus norvegicus
gccctccactggcaccctgagacgg

SEQ ID NO: 462958 - DNA, 25 bp, Rattus norvegicus
gagggccaagagacctgcgtcaaca

SEQ ID NO: 462959 - DNA, 25 bp, Rattus norvegicus
tgcgtcaacaaaaaccgcaaacaga

SEQ ID NO: 462960 - DNA, 25 bp, Rattus norvegicus
cgcaaacagaaacgctaaggcggag

SEQ ID NO: 462961 - DNA, 25 bp, Rattus norvegicus
cccaccgatacccagcaggcagtgc

SEQ ID NO: 462962 - DNA, 25 bp, Rattus norvegicus
agcgggaatcggtgggtagccaggg

SEQ ID NO: 462963 - DNA, 25 bp, Rattus norvegicus
acggcggcgctgtcctagcagcgta

SEQ ID NO: 462964 - DNA, 25 bp, Rattus norvegicus
cgctgtcctagcagcgtagcgggaa

SEQ ID NO: 462965 - DNA, 25 bp, Rattus norvegicus
gctgtcctagcagcgtagcgggaat

SEQ ID NO: 462966 - DNA, 25 bp, Rattus norvegicus
tgtcctagcagcgtagcgggaatcg

SEQ ID NO: 462967 - DNA, 25 bp, Rattus norvegicus
tcctagcagcgtagcgggaatcggt

SEQ ID NO: 462968 - DNA, 25 bp, Rattus norvegicus
tcagggaaccggagtaggaaagatc

SEQ ID NO: 462969 - DNA, 25 bp, Rattus norvegicus
cagggaaccggagtaggaaagatcg

SEQ ID NO: 462970 - DNA, 25 bp, Rattus norvegicus
agtaggaaagatcggcggctccaga

SEQ ID NO: 462971 - DNA, 25 bp, Rattus norvegicus
aggaaagatcggcggctccagaggt

SEQ ID NO: 462972 - DNA, 25 bp, Rattus norvegicus
ctcttcccatctccccggctgccga

SEQ ID NO: 462973 - DNA, 25 bp, Rattus norvegicus
atctccccggctgccgaggttgccg

SEQ ID NO: 462974 - DNA, 25 bp, Rattus norvegicus
cgtagcgggaatcggtgggtagcca

SEQ ID NO: 462975 - DNA, 25 bp, Rattus norvegicus
cctagcagcgtagcgggaatcggtg

SEQ ID NO: 462976 - DNA, 25 bp, Rattus norvegicus
cttttgcagtgggagttgagcagct

SEQ ID NO: 462977 - DNA, 25 bp, Rattus norvegicus
tgactcctcaaatgtcaaccaagga

SEQ ID NO: 462978 - DNA, 25 bp, Rattus norvegicus
caaggaggaaacaagtggaaacata

SEQ ID NO: 462979 - DNA, 25 bp, Rattus norvegicus
ctcaagggcaaaaacgaatagaatc

SEQ ID NO: 462980 - DNA, 25 bp, Rattus norvegicus
acgagaaaactcagcgaacatctgc

SEQ ID NO: 462981 - DNA, 25 bp, Rattus norvegicus
atggcctatccattctctagaaggg

SEQ ID NO: 462982 - DNA, 25 bp, Rattus norvegicus
cgaacatctgctgaaagtgtagttg

SEQ ID NO: 462983 - DNA, 25 bp, Rattus norvegicus
agtgcacagtttgcttgactcctca

SEQ ID NO: 462984 - DNA, 25 bp, Rattus norvegicus
ggtgatagaaaaaccagtgagctgg

SEQ ID NO: 462985 - DNA, 25 bp, Rattus norvegicus
tgcgtagttgcagggcttttgcagt

SEQ ID NO: 462986 - DNA, 25 bp, Rattus norvegicus
ttgagacttggtatagcatggccta

SEQ ID NO: 462987 - DNA, 25 bp, Rattus norvegicus
ctgggcacagaaggctaaggtgata

SEQ ID NO: 462988 - DNA, 25 bp, Rattus norvegicus
gagctgggagcaagcatttgattga

SEQ ID NO: 462989 - DNA, 25 bp, Rattus norvegicus
agtgtagttgtgctgagcttgcgta

SEQ ID NO: 462990 - DNA, 25 bp, Rattus norvegicus
tggttccattgctgcgtctcccaga

SEQ ID NO: 462991 - DNA, 25 bp, Rattus norvegicus
cggtgtctgtagcttggagtaccca

SEQ ID NO: 462992 - DNA, 25 bp, Rattus norvegicus
agtacccacgctgggctgcagatgc

SEQ ID NO: 462993 - DNA, 25 bp, Rattus norvegicus
ctgcagatgcagtttcagcaagccg

SEQ ID NO: 462994 - DNA, 25 bp, Rattus norvegicus
cagtttcagcaagccgccgcgtgtg

SEQ ID NO: 462995 - DNA, 25 bp, Rattus norvegicus
ttccgcttttcctccggtgtctgta

SEQ ID NO: 462996 - DNA, 25 bp, Rattus norvegicus
tgcgcgcacacattgccactggttc

SEQ ID NO: 462997 - DNA, 25 bp, Rattus norvegicus
cgggaggctgcaaagacacagcatt

SEQ ID NO: 462998 - DNA, 25 bp, Rattus norvegicus
gcgtctcccagatgcagactctcag

SEQ ID NO: 462999 - DNA, 25 bp, Rattus norvegicus
tccactctccttttccgtcaaattg

SEQ ID NO: 463000 - DNA, 25 bp, Rattus norvegicus
gtcaaattgtggtcctagacgtgcc

SEQ ID NO: 463001 - DNA, 25 bp, Rattus norvegicus
ggtcctagacgtgccgcaaccgcat

SEQ ID NO: 463002 - DNA, 25 bp, Rattus norvegicus
gacacagcattgctcgccaggcctg

SEQ ID NO: 463003 - DNA, 25 bp, Rattus norvegicus
tgtggcacctgtgcgcgcacacatt

SEQ ID NO: 463004 - DNA, 25 bp, Rattus norvegicus
agcgggactggattcctgaaggccc

SEQ ID NO: 463005 - DNA, 25 bp, Rattus norvegicus
agacggccgggtccagagtctgcca

SEQ ID NO: 463006 - DNA, 25 bp, Rattus norvegicus
tccacagccactcgcaggttcgggg

SEQ ID NO: 463007 - DNA, 25 bp, Rattus norvegicus
tcaggaccaggcgtgaggaaccgcc

SEQ ID NO: 463008 - DNA, 25 bp, Rattus norvegicus
gaggaaccgcctcagggcaaacttg

SEQ ID NO: 463009 - DNA, 25 bp, Rattus norvegicus
tcagggcaaacttgggcagccaggc

SEQ ID NO: 463010 - DNA, 25 bp, Rattus norvegicus
cggggtgcagacactaacctagagg

SEQ ID NO: 463011 - DNA, 25 bp, Rattus norvegicus
cagagtctgccaggggcctccacag

SEQ ID NO: 463012 - DNA, 25 bp, Rattus norvegicus
cccacgattggctgacgggcaagca

SEQ ID NO: 463013 - DNA, 25 bp, Rattus norvegicus
cacgcaggtgatagctgcggagtcc

SEQ ID NO: 463014 - DNA, 25 bp, Rattus norvegicus
gctaacccgcgtctggccgaaagaa

SEQ ID NO: 463015 - DNA, 25 bp, Rattus norvegicus
tctggccgaaagaatcgcgagttct

SEQ ID NO: 463016 - DNA, 25 bp, Rattus norvegicus
cgagttctgttatcgctgacagtgc

SEQ ID NO: 463017 - DNA, 25 bp, Rattus norvegicus
aggcggggctccgaattccttcacg

SEQ ID NO: 463018 - DNA, 25 bp, Rattus norvegicus
accggtacctcatctgacacgcttg

SEQ ID NO: 463019 - DNA, 25 bp, Rattus norvegicus
gtgcctctgagctgatggttatgta

SEQ ID NO: 463020 - DNA, 25 bp, Rattus norvegicus
ctgcagtctgtgttgacgctgaatc

SEQ ID NO: 463021 - DNA, 25 bp, Rattus norvegicus
ggtggaccagcgtctgctacacaca

SEQ ID NO: 463022 - DNA, 25 bp, Rattus norvegicus
tttggaacagcctgaccttctgacc

SEQ ID NO: 463023 - DNA, 25 bp, Rattus norvegicus
cgcttgcgtttccaaggtggatttc

SEQ ID NO: 463024 - DNA, 25 bp, Rattus norvegicus
gtcttgctgctaaagcggtgtcaca

SEQ ID NO: 463025 - DNA, 25 bp, Rattus norvegicus
acctttcggtgcctgtagttggagc

SEQ ID NO: 463026 - DNA, 25 bp, Rattus norvegicus
tccctgcgtctcctttgaaccattg

SEQ ID NO: 463027 - DNA, 25 bp, Rattus norvegicus
aggcttcttttgaccacaggatacg

SEQ ID NO: 463028 - DNA, 25 bp, Rattus norvegicus
cagcagtctgcactgagaggccaca

SEQ ID NO: 463029 - DNA, 25 bp, Rattus norvegicus
ctcggctgccgctcgaaacaatgcg

SEQ ID NO: 463030 - DNA, 25 bp, Rattus norvegicus
cgccacagggagagttggttcgaaa

SEQ ID NO: 463031 - DNA, 25 bp, Rattus norvegicus
acccggtgcagtatcctactttgga

SEQ ID NO: 463032 - DNA, 25 bp, Rattus norvegicus
tggatcttgcgggtccaaccgaacc

SEQ ID NO: 463033 - DNA, 25 bp, Rattus norvegicus
aagtctcgcgaagccagttcctcgg

SEQ ID NO: 463034 - DNA, 25 bp, Rattus norvegicus
cgaagagatcgactacaaggagatc

SEQ ID NO: 463035 - DNA, 25 bp, Rattus norvegicus
cgccagttccgatcgcgcattttca

SEQ ID NO: 463036 - DNA, 25 bp, Rattus norvegicus
tttcattacgtcacggcgccaggta

SEQ ID NO: 463037 - DNA, 25 bp, Rattus norvegicus
ccaggtatcgcggtatcgtcctgca

SEQ ID NO: 463038 - DNA, 25 bp, Rattus norvegicus
gatgccttttcacaaaagtctcgcg

SEQ ID NO: 463039 - DNA, 25 bp, Rattus norvegicus
gccttcggtctagttccgcgccagt

SEQ ID NO: 463040 - DNA, 25 bp, Rattus norvegicus
agttcaaaccggaactggaagtgtg

SEQ ID NO: 463041 - DNA, 25 bp, Rattus norvegicus
gcgggagatcatgtcgacagcatcc

SEQ ID NO: 463042 - DNA, 25 bp, Rattus norvegicus
ctcctcgtcttctgccagtgagatg

SEQ ID NO: 463043 - DNA, 25 bp, Rattus norvegicus
ccagtgagatgatcgaagcgccatc

SEQ ID NO: 463044 - DNA, 25 bp, Rattus norvegicus
gcaggtccttaacttcgaagagatc

SEQ ID NO: 463045 - DNA, 25 bp, Rattus norvegicus
agcgccatcgcaggtccttaacttc

SEQ ID NO: 463046 - DNA, 25 bp, Rattus norvegicus
tttcccgcgcagagctcgcggtctg

SEQ ID NO: 463047 - DNA, 25 bp, Rattus norvegicus
agtttcgggccgactctgaatccca

SEQ ID NO: 463048 - DNA, 25 bp, Rattus norvegicus
tctgaatcccaagttgccctgcggc

SEQ ID NO: 463049 - DNA, 25 bp, Rattus norvegicus
ggccgcgcagagtgagaatctcttt

SEQ ID NO: 463050 - DNA, 25 bp, Rattus norvegicus
aatctcttttgttcggctgagggga

SEQ ID NO: 463051 - DNA, 25 bp, Rattus norvegicus
cgcttcatctggacgaccgacttga

SEQ ID NO: 463052 - DNA, 25 bp, Rattus norvegicus
cgacttgaggccacacggctgtttg

SEQ ID NO: 463053 - DNA, 25 bp, Rattus norvegicus
gctgtttgctcctctgggtgctact

SEQ ID NO: 463054 - DNA, 25 bp, Rattus norvegicus
ggtgctactccctgggaccgcctga

SEQ ID NO: 463055 - DNA, 25 bp, Rattus norvegicus
gaccgcctgacgcaacgcgcaagaa

SEQ ID NO: 463056 - DNA, 25 bp, Rattus norvegicus
accgattcctctcggactgtcgggc

SEQ ID NO: 463057 - DNA, 25 bp, Rattus norvegicus
ccatcggagggttagcttttcaaga

SEQ ID NO: 463058 - DNA, 25 bp, Rattus norvegicus
gaactagacgaggagcgtttgaccc

SEQ ID NO: 463059 - DNA, 25 bp, Rattus norvegicus
cgcaagaagcgcgacaccgattcct

SEQ ID NO: 463060 - DNA, 25 bp, Rattus norvegicus
acgttgagtattgcccatcgtgcta

SEQ ID NO: 463061 - DNA, 25 bp, Rattus norvegicus
cgtcttggaagtgtaactgactccc

SEQ ID NO: 463062 - DNA, 25 bp, Rattus norvegicus
cacgtgtgcacgcagtctgattctc

SEQ ID NO: 463063 - DNA, 25 bp, Rattus norvegicus
ctgattctcagaacgttgagtattg

SEQ ID NO: 463064 - DNA, 25 bp, Rattus norvegicus
cgggactcgtcttggaagtgtaact

SEQ ID NO: 463065 - DNA, 25 bp, Rattus norvegicus
atctgttccaccctacgggactcgt

SEQ ID NO: 463066 - DNA, 25 bp, Rattus norvegicus
tgagacgtcgtcctgcaccatctgt

SEQ ID NO: 463067 - DNA, 25 bp, Rattus norvegicus
gcgggttccatctatgctttccaca

SEQ ID NO: 463068 - DNA, 25 bp, Rattus norvegicus
cacctcatttgtggtgcgggttcca

SEQ ID NO: 463069 - DNA, 25 bp, Rattus norvegicus
cttacacggttcacctcatttgtgg

SEQ ID NO: 463070 - DNA, 25 bp, Rattus norvegicus
ttacctcgcttatcttacacggttc

SEQ ID NO: 463071 - DNA, 25 bp, Rattus norvegicus
ggtcgtacagtatttacctcgctta

SEQ ID NO: 463072 - DNA, 25 bp, Rattus norvegicus
tccggacagttttggtcgtacagta

SEQ ID NO: 463073 - DNA, 25 bp, Rattus norvegicus
tgctttccacatccttgagacgtcg

SEQ ID NO: 463074 - DNA, 25 bp, Rattus norvegicus
cgccattcgcggagaagcttacgcc

SEQ ID NO: 463075 - DNA, 25 bp, Rattus norvegicus
agaagcttacgccagtcacccggcg

SEQ ID NO: 463076 - DNA, 25 bp, Rattus norvegicus
cgtcgccgggtgttttggaacagca

SEQ ID NO: 463077 - DNA, 25 bp, Rattus norvegicus
cattgtattttgctcgcgtcgccgg

SEQ ID NO: 463078 - DNA, 25 bp, Rattus norvegicus
ggagccgcagcagctgtcagaccca

SEQ ID NO: 463079 - DNA, 25 bp, Rattus norvegicus
ggcgaggcggcattgtattttgctc

SEQ ID NO: 463080 - DNA, 25 bp, Rattus norvegicus
ccgcctgcctgtttacggcgggcga

SEQ ID NO: 463081 - DNA, 25 bp, Rattus norvegicus
cttatggcattttctaggaacggga

SEQ ID NO: 463082 - DNA, 25 bp, Rattus norvegicus
gcccacggccgccttatggcatttt

SEQ ID NO: 463083 - DNA, 25 bp, Rattus norvegicus
gtcaacaatgtagcgattgagagtg

SEQ ID NO: 463084 - DNA, 25 bp, Rattus norvegicus
agcgagctgccatgtgatgcgcatc

SEQ ID NO: 463085 - DNA, 25 bp, Rattus norvegicus
cgtcagcgccgaatgtcaacaatgt

SEQ ID NO: 463086 - DNA, 25 bp, Rattus norvegicus
cgggtgacgtcagcgccgaatgtca

SEQ ID NO: 463087 - DNA, 25 bp, Rattus norvegicus
ctagcgcaggaggacgaaagttccc

SEQ ID NO: 463088 - DNA, 25 bp, Rattus norvegicus
cggtgccactctgacgtcttccggt

SEQ ID NO: 463089 - DNA, 25 bp, Rattus norvegicus
acatcttccggtgccactctggcgt

SEQ ID NO: 463090 - DNA, 25 bp, Rattus norvegicus
gtcttccggtgccactctggcgtct

SEQ ID NO: 463091 - DNA, 25 bp, Rattus norvegicus
cggtgccactctggcgtcttccggt

SEQ ID NO: 463092 - DNA, 25 bp, Rattus norvegicus
tgacatcttccggtgccactctggc

SEQ ID NO: 463093 - DNA, 25 bp, Rattus norvegicus
atcttccggtgccactctggcgtct

SEQ ID NO: 463094 - DNA, 25 bp, Rattus norvegicus
acgtcttccggtgccactctggcgt

SEQ ID NO: 463095 - DNA, 25 bp, Rattus norvegicus
gcgtcttccggtgccactctggcgt

SEQ ID NO: 463096 - DNA, 25 bp, Rattus norvegicus
tggcgtcttccggtgccactctggc

SEQ ID NO: 463097 - DNA, 25 bp, Rattus norvegicus
tcttccggtgccactctggcgtctt

SEQ ID NO: 463098 - DNA, 25 bp, Rattus norvegicus
gtcttccggtgccactctgacatct

SEQ ID NO: 463099 - DNA, 25 bp, Rattus norvegicus
gtgccactctgacatcttccggtgc

SEQ ID NO: 463100 - DNA, 25 bp, Rattus norvegicus
ggtgccactctgacatcttccggtg

SEQ ID NO: 463101 - DNA, 25 bp, Rattus norvegicus
tcttccggtgccactctgacgtctt

SEQ ID NO: 463102 - DNA, 25 bp, Rattus norvegicus
tgagccacggaagcgtaccagagtt

SEQ ID NO: 463103 - DNA, 25 bp, Rattus norvegicus
agcacacggagcatcgcccggtcta

SEQ ID NO: 463104 - DNA, 25 bp, Rattus norvegicus
cctttggagagtctcgaggggctct

SEQ ID NO: 463105 - DNA, 25 bp, Rattus norvegicus
gaccgccctttggagagtctcgagg

SEQ ID NO: 463106 - DNA, 25 bp, Rattus norvegicus
gccctggcgtccttactgcgggctg

SEQ ID NO: 463107 - DNA, 25 bp, Rattus norvegicus
atctaattggttgtcggcgctcggt

SEQ ID NO: 463108 - DNA, 25 bp, Rattus norvegicus
cgtgctttgcgtctgatctaattgg

SEQ ID NO: 463109 - DNA, 25 bp, Rattus norvegicus
tgcgccgagacgtgctttgcgtctg

SEQ ID NO: 463110 - DNA, 25 bp, Rattus norvegicus
agagtttggcgccaactggaatttt

SEQ ID NO: 463111 - DNA, 25 bp, Rattus norvegicus
tttccgccttcaatggcgggaactg

SEQ ID NO: 463112 - DNA, 25 bp, Rattus norvegicus
gcccatttcccttttgagccacgga

SEQ ID NO: 463113 - DNA, 25 bp, Rattus norvegicus
ctggtgacgtcttttccgcggagaa

SEQ ID NO: 463114 - DNA, 25 bp, Rattus norvegicus
gcgtaccagagtttggcgccaactg

SEQ ID NO: 463115 - DNA, 25 bp, Rattus norvegicus
cttcaatggcgggaactggctgtgt

SEQ ID NO: 463116 - DNA, 25 bp, Rattus norvegicus
agcagcggcgaactgaacaggttcc

SEQ ID NO: 463117 - DNA, 25 bp, Rattus norvegicus
gaacaggttcctggccaagtcggtg

SEQ ID NO: 463118 - DNA, 25 bp, Rattus norvegicus
ccaccaagaatgagaagagcagcgg

SEQ ID NO: 463119 - DNA, 25 bp, Rattus norvegicus
cgctgcggctaatcgccaccaagaa

SEQ ID NO: 463120 - DNA, 25 bp, Rattus norvegicus
cacctctctgtggacctggttgccg

SEQ ID NO: 463121 - DNA, 25 bp, Rattus norvegicus
tatggagcacctctctgtggacctg

SEQ ID NO: 463122 - DNA, 25 bp, Rattus norvegicus
ggccggagactatggagcacctctc

SEQ ID NO: 463123 - DNA, 25 bp, Rattus norvegicus
cgtgtgtgtcggcttgccggctcta

SEQ ID NO: 463124 - DNA, 25 bp, Rattus norvegicus
cgagactccttcagcacgtgtgtgt

SEQ ID NO: 463125 - DNA, 25 bp, Rattus norvegicus
gctgatgacgcaacgagactccttc

SEQ ID NO: 463126 - DNA, 25 bp, Rattus norvegicus
agtcgcgccgcctcaggctgatgac

SEQ ID NO: 463127 - DNA, 25 bp, Rattus norvegicus
catttccgccgatgtgggcgtggta

SEQ ID NO: 463128 - DNA, 25 bp, Rattus norvegicus
ggcagtgacgcatttccgccgatgt

SEQ ID NO: 463129 - DNA, 25 bp, Rattus norvegicus
ttcctggccaagtcggtgagcacgg

SEQ ID NO: 463130 - DNA, 25 bp, Rattus norvegicus
acctgcgaccctgacactgaagcag

SEQ ID NO: 463131 - DNA, 25 bp, Rattus norvegicus
ctacgtagtcctgaccgcgtcggtt

SEQ ID NO: 463132 - DNA, 25 bp, Rattus norvegicus
actgaagcaggtacggcggttctct

SEQ ID NO: 463133 - DNA, 25 bp, Rattus norvegicus
accgcgtcggtttagaccgtggctg

SEQ ID NO: 463134 - DNA, 25 bp, Rattus norvegicus
ccagcggcttccgtaggcaacatgg

SEQ ID NO: 463135 - DNA, 25 bp, Rattus norvegicus
tcgaggttcacttccgcccttgtgc

SEQ ID NO: 463136 - DNA, 25 bp, Rattus norvegicus
gtccaggtgctcgaggttcacttcc

SEQ ID NO: 463137 - DNA, 25 bp, Rattus norvegicus
cgacttccgcttccgtgtccaggtg

SEQ ID NO: 463138 - DNA, 25 bp, Rattus norvegicus
tccgtctcctagaaaccaggttcgc

SEQ ID NO: 463139 - DNA, 25 bp, Rattus norvegicus
agactcgggcgtccgtctcctagaa

SEQ ID NO: 463140 - DNA, 25 bp, Rattus norvegicus
gctaacagcggaaacccgagactcg

SEQ ID NO: 463141 - DNA, 25 bp, Rattus norvegicus
cggctttctgggaaaaacagagcta

SEQ ID NO: 463142 - DNA, 25 bp, Rattus norvegicus
acttccggatgacgagttcctcccg

SEQ ID NO: 463143 - DNA, 25 bp, Rattus norvegicus
ccgccttgagcaggcctacgtagtc

SEQ ID NO: 463144 - DNA, 25 bp, Rattus norvegicus
cccgtgaacctggtagggatgctgc

SEQ ID NO: 463145 - DNA, 25 bp, Rattus norvegicus
aataggcgatgtccaccggctcggt

SEQ ID NO: 463146 - DNA, 25 bp, Rattus norvegicus
cgccagggaataggcgatgtccacc

SEQ ID NO: 463147 - DNA, 25 bp, Rattus norvegicus
gccgccgagtgcaagcagtcacagc

SEQ ID NO: 463148 - DNA, 25 bp, Rattus norvegicus
agtcacagcggaacgcggccaacgc

SEQ ID NO: 463149 - DNA, 25 bp, Rattus norvegicus
tgcgcgtgctgagcaaagctttctc

SEQ ID NO: 463150 - DNA, 25 bp, Rattus norvegicus
tttctccagactcaagaccagcctg

SEQ ID NO: 463151 - DNA, 25 bp, Rattus norvegicus
tcaagaccagcctgccttgggtgcc

SEQ ID NO: 463152 - DNA, 25 bp, Rattus norvegicus
gccggacaccaagctttccaaactg

SEQ ID NO: 463153 - DNA, 25 bp, Rattus norvegicus
aagctttccaaactggacacgctgc

SEQ ID NO: 463154 - DNA, 25 bp, Rattus norvegicus
acacgctgcgtttggcttccagcta

SEQ ID NO: 463155 - DNA, 25 bp, Rattus norvegicus
ccagcgacaactcttcggcggagga

SEQ ID NO: 463156 - DNA, 25 bp, Rattus norvegicus
accgctacgaggatagctatgtgca

SEQ ID NO: 463157 - DNA, 25 bp, Rattus norvegicus
ccagctgctgcaggaggaccgctac

SEQ ID NO: 463158 - DNA, 25 bp, Rattus norvegicus
agggctgtttcctcggccgcatcaa

SEQ ID NO: 463159 - DNA, 25 bp, Rattus norvegicus
ctgagcggggaaccagacaacctgt

SEQ ID NO: 463160 - DNA, 25 bp, Rattus norvegicus
gcatcaagcccaggcgcgtcgaatg

SEQ ID NO: 463161 - DNA, 25 bp, Rattus norvegicus
gcagcggccactggtcattgcacca

SEQ ID NO: 463162 - DNA, 25 bp, Rattus norvegicus
tccaccgcgcgtggtctagatgcct

SEQ ID NO: 463163 - DNA, 25 bp, Rattus norvegicus
gggactgcccagtaccttttgctcc

SEQ ID NO: 463164 - DNA, 25 bp, Rattus norvegicus
tccctgaggatcaccagcactcgta

SEQ ID NO: 463165 - DNA, 25 bp, Rattus norvegicus
ctgtgtccctataagcgttccctga

SEQ ID NO: 463166 - DNA, 25 bp, Rattus norvegicus
gaagagtttgcagggcgagcacttc

SEQ ID NO: 463167 - DNA, 25 bp, Rattus norvegicus
cttgccctggacagcggaagagttt

SEQ ID NO: 463168 - DNA, 25 bp, Rattus norvegicus
caaacgaccctggaaactgcccttg

SEQ ID NO: 463169 - DNA, 25 bp, Rattus norvegicus
ctgtggccacctacaagccgactgg

SEQ ID NO: 463170 - DNA, 25 bp, Rattus norvegicus
cgactggctggaaccaatggaaacc

SEQ ID NO: 463171 - DNA, 25 bp, Rattus norvegicus
cagagggtcgagaatcgtcccgccc

SEQ ID NO: 463172 - DNA, 25 bp, Rattus norvegicus
ttttagctcgacatccgaccctact

SEQ ID NO: 463173 - DNA, 25 bp, Rattus norvegicus
ctcatcacgcccacgcttgcctccg

SEQ ID NO: 463174 - DNA, 25 bp, Rattus norvegicus
acctggctcatcacgcccacgcttg

SEQ ID NO: 463175 - DNA, 25 bp, Rattus norvegicus
ggcttgcccagcacctggctcatca

SEQ ID NO: 463176 - DNA, 25 bp, Rattus norvegicus
tcgccgccgtcctcaccctgcggct

SEQ ID NO: 463177 - DNA, 25 bp, Rattus norvegicus
gtccatcctcgtagcctgccagccc

SEQ ID NO: 463178 - DNA, 25 bp, Rattus norvegicus
gaggactccggtccatcctcgtagc

SEQ ID NO: 463179 - DNA, 25 bp, Rattus norvegicus
gccacggcggggaagaatgacacgc

SEQ ID NO: 463180 - DNA, 25 bp, Rattus norvegicus
tcggcgtcggaggactccggtccat

SEQ ID NO: 463181 - DNA, 25 bp, Rattus norvegicus
ctgcctcttttagctcgacatccga

SEQ ID NO: 463182 - DNA, 25 bp, Rattus norvegicus
acgctgccgccagctgcctctttta

SEQ ID NO: 463183 - DNA, 25 bp, Rattus norvegicus
cgacccagccggcacgctgccgcca

SEQ ID NO: 463184 - DNA, 25 bp, Rattus norvegicus
cagctgtgggcgacccagccggcac

SEQ ID NO: 463185 - DNA, 25 bp, Rattus norvegicus
cggaggactccggtccatcctcgta

SEQ ID NO: 463186 - DNA, 25 bp, Rattus norvegicus
cctgcgctgcaggtggtatccgcgt

SEQ ID NO: 463187 - DNA, 25 bp, Rattus norvegicus
ctccgccaagcaagcggtggctgca

SEQ ID NO: 463188 - DNA, 25 bp, Rattus norvegicus
tctccctggagacctgggttcttgg

SEQ ID NO: 463189 - DNA, 25 bp, Rattus norvegicus
acgcttgcagagacagcgtgcagaa

SEQ ID NO: 463190 - DNA, 25 bp, Rattus norvegicus
ccgcactctctctagggtggtggtg

SEQ ID NO: 463191 - DNA, 25 bp, Rattus norvegicus
tgtgtgacaagcgtcaggtgactcg

SEQ ID NO: 463192 - DNA, 25 bp, Rattus norvegicus
gtgactcgggtcacgcagtcactcc

SEQ ID NO: 463193 - DNA, 25 bp, Rattus norvegicus
agaactgccgcgctccggctggttc

SEQ ID NO: 463194 - DNA, 25 bp, Rattus norvegicus
acagcgtgcagaactcccggagggc

SEQ ID NO: 463195 - DNA, 25 bp, Rattus norvegicus
tggtatccgcgtctccctggagacc

SEQ ID NO: 463196 - DNA, 25 bp, Rattus norvegicus
cctgggttcttggtctgcagacacc

SEQ ID NO: 463197 - DNA, 25 bp, Rattus norvegicus
cccgaatgcatctcgtgtcgtaccg

SEQ ID NO: 463198 - DNA, 25 bp, Rattus norvegicus
aatgcatctcgtgtcgtaccgggga

SEQ ID NO: 463199 - DNA, 25 bp, Rattus norvegicus
tggacacccgcactctctctagggt

SEQ ID NO: 463200 - DNA, 25 bp, Rattus norvegicus
cgccgcggctatctagtcaggaaaa

SEQ ID NO: 463201 - DNA, 25 bp, Rattus norvegicus
tcggtatcgacccaccaatgagtga

SEQ ID NO: 463202 - DNA, 25 bp, Rattus norvegicus
aggccctagtgtcccgcatcctgaa

SEQ ID NO: 463203 - DNA, 25 bp, Rattus norvegicus
agtgctactttcctggccttgaccc

SEQ ID NO: 463204 - DNA, 25 bp, Rattus norvegicus
agttgatccaatcagctagccgaga

SEQ ID NO: 463205 - DNA, 25 bp, Rattus norvegicus
gcgtttctttccgaccatgtccagg

SEQ ID NO: 463206 - DNA, 25 bp, Rattus norvegicus
tatcctacaagcttcggccctgttg

SEQ ID NO: 463207 - DNA, 25 bp, Rattus norvegicus
acccgctgctgaggtcgcagtatgc

SEQ ID NO: 463208 - DNA, 25 bp, Rattus norvegicus
agccgagactattgccgtcaccgga

SEQ ID NO: 463209 - DNA, 25 bp, Rattus norvegicus
cgtcaccggatgtcgctttgattga

SEQ ID NO: 463210 - DNA, 25 bp, Rattus norvegicus
caatagccgagtgtgtctccgcctc

SEQ ID NO: 463211 - DNA, 25 bp, Rattus norvegicus
aagtccaatgagtgtgcaggcccgc

SEQ ID NO: 463212 - DNA, 25 bp, Rattus norvegicus
tctgggacaccaagcgacaagtgct

SEQ ID NO: 463213 - DNA, 25 bp, Rattus norvegicus
cccgagaccgacttggagagaagtc

SEQ ID NO: 463214 - DNA, 25 bp, Rattus norvegicus
tccgggctcgcgctttacgcgaggc

SEQ ID NO: 463215 - DNA, 25 bp, Rattus norvegicus
tagttaatcacaccgcgcagctagg

SEQ ID NO: 463216 - DNA, 25 bp, Rattus norvegicus
gcagctaggggcctcgggtacacaa

SEQ ID NO: 463217 - DNA, 25 bp, Rattus norvegicus
tcgggtacacaagaccactcgggtc

SEQ ID NO: 463218 - DNA, 25 bp, Rattus norvegicus
cgggtccatcgcaccgagaccattg

SEQ ID NO: 463219 - DNA, 25 bp, Rattus norvegicus
agctttccgcgagctcctggggaac

SEQ ID NO: 463220 - DNA, 25 bp, Rattus norvegicus
ataacctgaagagcccgggtgagcc

SEQ ID NO: 463221 - DNA, 25 bp, Rattus norvegicus
ggaagcggtgtcttagttaatcaca

SEQ ID NO: 463222 - DNA, 25 bp, Rattus norvegicus
tggccgctacggatcctcagatctg

SEQ ID NO: 463223 - DNA, 25 bp, Rattus norvegicus
tctctgcggagtgaagctggagaca

SEQ ID NO: 463224 - DNA, 25 bp, Rattus norvegicus
cagccaagccaagggcaggtgtaaa

SEQ ID NO: 463225 - DNA, 25 bp, Rattus norvegicus
cgatgtcggccggtactactaaaca

SEQ ID NO: 463226 - DNA, 25 bp, Rattus norvegicus
gtactactaaacatcccttgccgga

SEQ ID NO: 463227 - DNA, 25 bp, Rattus norvegicus
tggagacccgctataacctgaagag

SEQ ID NO: 463228 - DNA, 25 bp, Rattus norvegicus
tcggcggcttctgtaaccagagtcc

SEQ ID NO: 463229 - DNA, 25 bp, Rattus norvegicus
acctccgcgatgaggttgtggccgc

SEQ ID NO: 463230 - DNA, 25 bp, Rattus norvegicus
tcgcacaggaaagccagctgcagcg

SEQ ID NO: 463231 - DNA, 25 bp, Rattus norvegicus
ggtctatcctagtcagccctttgta

SEQ ID NO: 463232 - DNA, 25 bp, Rattus norvegicus
tcagccctttgtaaggctcggcggc

SEQ ID NO: 463233 - DNA, 25 bp, Rattus norvegicus
gtcttgtcagtcttcggcaacgctc

SEQ ID NO: 463234 - DNA, 25 bp, Rattus norvegicus
ctcggcagtccttgccagacctatg

SEQ ID NO: 463235 - DNA, 25 bp, Rattus norvegicus
gacctatgcaatgctcggcaccttg

SEQ ID NO: 463236 - DNA, 25 bp, Rattus norvegicus
tgctcttggcaacgcttagctgtcc

SEQ ID NO: 463237 - DNA, 25 bp, Rattus norvegicus
ctcagcagccctcggcaagtctagg

SEQ ID NO: 463238 - DNA, 25 bp, Rattus norvegicus
aagtctaggcgcctcggcaacgctc

SEQ ID NO: 463239 - DNA, 25 bp, Rattus norvegicus
caacgctcggctgtccttgtcagta

SEQ ID NO: 463240 - DNA, 25 bp, Rattus norvegicus
tgtccttgtcagtactcggcggctt

SEQ ID NO: 463241 - DNA, 25 bp, Rattus norvegicus
gcagcgcgtcgtactcgcacaggaa

SEQ ID NO: 463242 - DNA, 25 bp, Rattus norvegicus
ttttgggagtgctggccaggtgtcc

SEQ ID NO: 463243 - DNA, 25 bp, Rattus norvegicus
gtcgcagacgccaccaggtgagtga

SEQ ID NO: 463244 - DNA, 25 bp, Rattus norvegicus
gcagacgccaccaggtgagtgaaga

SEQ ID NO: 463245 - DNA, 25 bp, Rattus norvegicus
caccaggtgagtgaagacgggaccc

SEQ ID NO: 463246 - DNA, 25 bp, Rattus norvegicus
ggagctgtctggatgtggatgccgc

SEQ ID NO: 463247 - DNA, 25 bp, Rattus norvegicus
caggctgtcggggtgtcatccgggt

SEQ ID NO: 463248 - DNA, 25 bp, Rattus norvegicus
tactggggctcggttgtgatgtcaa

SEQ ID NO: 463249 - DNA, 25 bp, Rattus norvegicus
cggttgtgatgtcaaggtgttggcc

SEQ ID NO: 463250 - DNA, 25 bp, Rattus norvegicus
gtgttggcctggtgtcaaggtgcgg

SEQ ID NO: 463251 - DNA, 25 bp, Rattus norvegicus
tggctccggctgtcgtggcagtgct

SEQ ID NO: 463252 - DNA, 25 bp, Rattus norvegicus
cctggtgtcactgcgctctgcaggc

SEQ ID NO: 463253 - DNA, 25 bp, Rattus norvegicus
gtgtcactgcgctctgcaggcgccg

SEQ ID NO: 463254 - DNA, 25 bp, Rattus norvegicus
caggcgccgcccactaaccttccgg

SEQ ID NO: 463255 - DNA, 25 bp, Rattus norvegicus
cccggctgtcgagctgcaggctgtc

SEQ ID NO: 463256 - DNA, 25 bp, Rattus norvegicus
accttctaaatgcaggctgttgctg

SEQ ID NO: 463257 - DNA, 25 bp, Rattus norvegicus
ctgttgctgggccacagccgctgct

SEQ ID NO: 463258 - DNA, 25 bp, Rattus norvegicus
ctccagcgagcgtcacggaaacttc

SEQ ID NO: 463259 - DNA, 25 bp, Rattus norvegicus
cgctgtggaacggagacgacagtca

SEQ ID NO: 463260 - DNA, 25 bp, Rattus norvegicus
aggttcggggcaaggaccatgactc

SEQ ID NO: 463261 - DNA, 25 bp, Rattus norvegicus
cgaggcggcgcagcaacaaatagcg

SEQ ID NO: 463262 - DNA, 25 bp, Rattus norvegicus
caccgcggctagtgttgttacccga

SEQ ID NO: 463263 - DNA, 25 bp, Rattus norvegicus
gtccacctctctgtggcggtccaat

SEQ ID NO: 463264 - DNA, 25 bp, Rattus norvegicus
tctctgtggcggtccaatccgaatg

SEQ ID NO: 463265 - DNA, 25 bp, Rattus norvegicus
gtccaatccgaatgcgcctgccagg

SEQ ID NO: 463266 - DNA, 25 bp, Rattus norvegicus
gcgcccggaggcaagacacaaacaa

SEQ ID NO: 463267 - DNA, 25 bp, Rattus norvegicus
gacacaaacaagcagcctgctgcag

SEQ ID NO: 463268 - DNA, 25 bp, Rattus norvegicus
aacaaatagcgctggccaccgcggc

SEQ ID NO: 463269 - DNA, 25 bp, Rattus norvegicus
tggatcgccgccaaccttctaaatg

SEQ ID NO: 463270 - DNA, 25 bp, Rattus norvegicus
tggcttgctaaggagctgtcggcga

SEQ ID NO: 463271 - DNA, 25 bp, Rattus norvegicus
acccgcgcgcttggtggccgctagt

SEQ ID NO: 463272 - DNA, 25 bp, Rattus norvegicus
cgaatcccactaagccggcctgggg

SEQ ID NO: 463273 - DNA, 25 bp, Rattus norvegicus
tgaactgtccgaggcgcggccagcc

SEQ ID NO: 463274 - DNA, 25 bp, Rattus norvegicus
cgcctcggtggctgaactgtccgag

SEQ ID NO: 463275 - DNA, 25 bp, Rattus norvegicus
acaagatcccgcctcggtggctgaa

SEQ ID NO: 463276 - DNA, 25 bp, Rattus norvegicus
ggcggcgtagacatggcttacaaca

SEQ ID NO: 463277 - DNA, 25 bp, Rattus norvegicus
ctgaatgaaagtggcgcgccgctga

SEQ ID NO: 463278 - DNA, 25 bp, Rattus norvegicus
cgaacctgaatgaaagtggcgcgcc

SEQ ID NO: 463279 - DNA, 25 bp, Rattus norvegicus
gccgcggagtcgaacctgaatgaaa

SEQ ID NO: 463280 - DNA, 25 bp, Rattus norvegicus
cttcgcctgacctcggaagaaaggg

SEQ ID NO: 463281 - DNA, 25 bp, Rattus norvegicus
ttccacttcgcctgacctcggaaga

SEQ ID NO: 463282 - DNA, 25 bp, Rattus norvegicus
gggcggagcttccacttcgcctgac

SEQ ID NO: 463283 - DNA, 25 bp, Rattus norvegicus
tggcttacaacaagatcccgcctcg

SEQ ID NO: 463284 - DNA, 25 bp, Rattus norvegicus
tagggttgcaattcgccgtgataaa

SEQ ID NO: 463285 - DNA, 25 bp, Rattus norvegicus
acgctcgtgtttagggttgcaattc

SEQ ID NO: 463286 - DNA, 25 bp, Rattus norvegicus
tccctggagccgacgtgacgtggct

SEQ ID NO: 463287 - DNA, 25 bp, Rattus norvegicus
tcaggtggaaaccttgcgggccgac

SEQ ID NO: 463288 - DNA, 25 bp, Rattus norvegicus
gggccgactggacccaactctctaa

SEQ ID NO: 463289 - DNA, 25 bp, Rattus norvegicus
cgaggtctaaaacgcaattcagctg

SEQ ID NO: 463290 - DNA, 25 bp, Rattus norvegicus
acgtggctccgtcaggtggaaacct

SEQ ID NO: 463291 - DNA, 25 bp, Rattus norvegicus
ttcgccgtgataaatgtaaagacca

SEQ ID NO: 463292 - DNA, 25 bp, Rattus norvegicus
tgaacgctgtgcctacagctgggtc

SEQ ID NO: 463293 - DNA, 25 bp, Rattus norvegicus
tgcgggcctaggaactgaacgctgt

SEQ ID NO: 463294 - DNA, 25 bp, Rattus norvegicus
gccaagctgctaccttgcgggccta

SEQ ID NO: 463295 - DNA, 25 bp, Rattus norvegicus
cgtcttaaaatgaacgccaagctgc

SEQ ID NO: 463296 - DNA, 25 bp, Rattus norvegicus
cctcgaatctgagcaaggcgtctta

SEQ ID NO: 463297 - DNA, 25 bp, Rattus norvegicus
ctctctaaggagaacgaggtctaaa

SEQ ID NO: 463298 - DNA, 25 bp, Rattus norvegicus
acctcccgcgaggtcctggcagtga

SEQ ID NO: 463299 - DNA, 25 bp, Rattus norvegicus
atcccttggcggagtctctgctgcc

SEQ ID NO: 463300 - DNA, 25 bp, Rattus norvegicus
gagaccgcacttggctggccttcct

SEQ ID NO: 463301 - DNA, 25 bp, Rattus norvegicus
tgagcagcgcgcatgattaacggcc

SEQ ID NO: 463302 - DNA, 25 bp, Rattus norvegicus
atgacacagtggacgccgagcgaca

SEQ ID NO: 463303 - DNA, 25 bp, Rattus norvegicus
gagcgacagggctggccctcctagc

SEQ ID NO: 463304 - DNA, 25 bp, Rattus norvegicus
ccgcgcagatcccttggcggagtct

SEQ ID NO: 463305 - DNA, 25 bp, Rattus norvegicus
actgacttactgaccgatcgccgcg

SEQ ID NO: 463306 - DNA, 25 bp, Rattus norvegicus
caggacaaaggctcattaacacgtg

SEQ ID NO: 463307 - DNA, 25 bp, Rattus norvegicus
ggctcattaacacgtgatgggacca

SEQ ID NO: 463308 - DNA, 25 bp, Rattus norvegicus
gtgatgggaccacgcttcataaatg

SEQ ID NO: 463309 - DNA, 25 bp, Rattus norvegicus
cacgcttcataaatgggactggaga

SEQ ID NO: 463310 - DNA, 25 bp, Rattus norvegicus
gcgcgcagaccgactgacttactga

SEQ ID NO: 463311 - DNA, 25 bp, Rattus norvegicus
cgggtacggctcagcaaagtttgga

SEQ ID NO: 463312 - DNA, 25 bp, Rattus norvegicus
tgtcccggtcccagaagctcgaggg

SEQ ID NO: 463313 - DNA, 25 bp, Rattus norvegicus
cccatccagggtctgtgaacccagg

SEQ ID NO: 463314 - DNA, 25 bp, Rattus norvegicus
agccgccaggcagcttctcagaacg

SEQ ID NO: 463315 - DNA, 25 bp, Rattus norvegicus
ggctggagccaactgatcttcgggc

SEQ ID NO: 463316 - DNA, 25 bp, Rattus norvegicus
tcttcgggctaagcagaagcagctg

SEQ ID NO: 463317 - DNA, 25 bp, Rattus norvegicus
cctttctcgggagttcgtgcttctg

SEQ ID NO: 463318 - DNA, 25 bp, Rattus norvegicus
agttcgtgcttctgcccgccgcagg

SEQ ID NO: 463319 - DNA, 25 bp, Rattus norvegicus
aggtgacccgcagagtccgatgtcc

SEQ ID NO: 463320 - DNA, 25 bp, Rattus norvegicus
cccttcttcctgaggcctggggatc

SEQ ID NO: 463321 - DNA, 25 bp, Rattus norvegicus
gggatcctcccggatagcgcctatc

SEQ ID NO: 463322 - DNA, 25 bp, Rattus norvegicus
agcgcctatctgtatctcccgattc

SEQ ID NO: 463323 - DNA, 25 bp, Rattus norvegicus
gtggctgcgacaccgcgctgacctg

SEQ ID NO: 463324 - DNA, 25 bp, Rattus norvegicus
ctgctcgtaatagacgccgccggga

SEQ ID NO: 463325 - DNA, 25 bp, Rattus norvegicus
cacaccacgggcctttctcgggagt

SEQ ID NO: 463326 - DNA, 25 bp, Rattus norvegicus
tcgggctcgttctcgctgctgctct

SEQ ID NO: 463327 - DNA, 25 bp, Rattus norvegicus
cactgagggcgacaccaggaactca

SEQ ID NO: 463328 - DNA, 25 bp, Rattus norvegicus
ccggacttcaagagccagggcactg

SEQ ID NO: 463329 - DNA, 25 bp, Rattus norvegicus
accattgaggcgtcactgcgcgtca

SEQ ID NO: 463330 - DNA, 25 bp, Rattus norvegicus
agctcaccgtgtctggcaaccattg

SEQ ID NO: 463331 - DNA, 25 bp, Rattus norvegicus
ctgcgctgcgaagctcaccgtgtct

SEQ ID NO: 463332 - DNA, 25 bp, Rattus norvegicus
tcgaacagtggcctgaaggcgctgc

SEQ ID NO: 463333 - DNA, 25 bp, Rattus norvegicus
agaggcgcttcgaacagtggcctga

SEQ ID NO: 463334 - DNA, 25 bp, Rattus norvegicus
aggatcagccatccgagggccagca

SEQ ID NO: 463335 - DNA, 25 bp, Rattus norvegicus
aggtgacattcgatgcctgcgaggc

SEQ ID NO: 463336 - DNA, 25 bp, Rattus norvegicus
gtatcagtctcaaccacttcgcctt

SEQ ID NO: 463337 - DNA, 25 bp, Rattus norvegicus
ggcctcgatcgtggtatcagtctca

SEQ ID NO: 463338 - DNA, 25 bp, Rattus norvegicus
acaccaggaactcatgtgggcggga

SEQ ID NO: 463339 - DNA, 25 bp, Rattus norvegicus
gcgaggcctgcaggcccaccaggat

SEQ ID NO: 463340 - DNA, 25 bp, Rattus norvegicus
cttagcccggcatctccgaagcgga

SEQ ID NO: 463341 - DNA, 25 bp, Rattus norvegicus
gcgtgcggagccactctgaaaagga

SEQ ID NO: 463342 - DNA, 25 bp, Rattus norvegicus
cttggatgacgggagtcgtagtttc

SEQ ID NO: 463343 - DNA, 25 bp, Rattus norvegicus
gtgacttctgggtaaccgcctttca

SEQ ID NO: 463344 - DNA, 25 bp, Rattus norvegicus
cctgtggccgcaggatttgaatcgg

SEQ ID NO: 463345 - DNA, 25 bp, Rattus norvegicus
cggcggcgttgttattgacgccata

SEQ ID NO: 463346 - DNA, 25 bp, Rattus norvegicus
gtcgagtgcattgcctagctctgtg

SEQ ID NO: 463347 - DNA, 25 bp, Rattus norvegicus
gttgccgccgctcacgagcttctgt

SEQ ID NO: 463348 - DNA, 25 bp, Rattus norvegicus
gagcttctgtctacaccggcgtgtt

SEQ ID NO: 463349 - DNA, 25 bp, Rattus norvegicus
tccacttccgaagggagccggtctc

SEQ ID NO: 463350 - DNA, 25 bp, Rattus norvegicus
ctgaaaaggactctggatttcgacc

SEQ ID NO: 463351 - DNA, 25 bp, Rattus norvegicus
gatttcgacccactgcttagcccgg

SEQ ID NO: 463352 - DNA, 25 bp, Rattus norvegicus
ttcgccgcagaagtatctccggatg

SEQ ID NO: 463353 - DNA, 25 bp, Rattus norvegicus
gtcgtgccactgaccgggtccactt

SEQ ID NO: 463354 - DNA, 25 bp, Rattus norvegicus
aaagttcgtcctggagcgcacgggc

SEQ ID NO: 463355 - DNA, 25 bp, Rattus norvegicus
ggactgaagttctggggaactcgct

SEQ ID NO: 463356 - DNA, 25 bp, Rattus norvegicus
aggttctgtgatacactccgactcg

SEQ ID NO: 463357 - DNA, 25 bp, Rattus norvegicus
gcccaggttctgtgatacactccga

SEQ ID NO: 463358 - DNA, 25 bp, Rattus norvegicus
ctttactccagggtgatggccgcgc

SEQ ID NO: 463359 - DNA, 25 bp, Rattus norvegicus
gttgggctcctttactccagggtga

SEQ ID NO: 463360 - DNA, 25 bp, Rattus norvegicus
cgctgcagtgataggaactgacttg

SEQ ID NO: 463361 - DNA, 25 bp, Rattus norvegicus
acccgagccacggagcagagggtac

SEQ ID NO: 463362 - DNA, 25 bp, Rattus norvegicus
gagaaaaagttcgtcctggagcgca

SEQ ID NO: 463363 - DNA, 25 bp, Rattus norvegicus
aactttgtgccactattgcccagcc

SEQ ID NO: 463364 - DNA, 25 bp, Rattus norvegicus
agctgggaactttgtgccactattg

SEQ ID NO: 463365 - DNA, 25 bp, Rattus norvegicus
agccgatttgcctcgggctcctgag

SEQ ID NO: 463366 - DNA, 25 bp, Rattus norvegicus
tggttggggacagccgatttgcctc

SEQ ID NO: 463367 - DNA, 25 bp, Rattus norvegicus
ttctggggaactcgctgcagtgata

SEQ ID NO: 463368 - DNA, 25 bp, Rattus norvegicus
ccgaacctgggcaaatcgcctaagt

SEQ ID NO: 463369 - DNA, 25 bp, Rattus norvegicus
aagctggcctcgaacccgaacctgg

SEQ ID NO: 463370 - DNA, 25 bp, Rattus norvegicus
gtactgtctggagcggcgaaccagc

SEQ ID NO: 463371 - DNA, 25 bp, Rattus norvegicus
gcaaatcgcctaagtccggttcttc

SEQ ID NO: 463372 - DNA, 25 bp, Rattus norvegicus
cggagccagagctgatgcccatcaa

SEQ ID NO: 463373 - DNA, 25 bp, Rattus norvegicus
aaacctcgccggacttgccaaacag

SEQ ID NO: 463374 - DNA, 25 bp, Rattus norvegicus
ttgccaaacaggcaccacgaatccg

SEQ ID NO: 463375 - DNA, 25 bp, Rattus norvegicus
cccacgtaccttggacacggaggag

SEQ ID NO: 463376 - DNA, 25 bp, Rattus norvegicus
gcggcagacagaacgcagtactctt

SEQ ID NO: 463377 - DNA, 25 bp, Rattus norvegicus
tgtgcctgcgcactatacacttccg

SEQ ID NO: 463378 - DNA, 25 bp, Rattus norvegicus
gctttcgtaggtcgattgcctgtca

SEQ ID NO: 463379 - DNA, 25 bp, Rattus norvegicus
ttgcctgtcaggtactgtctggagc

SEQ ID NO: 463380 - DNA, 25 bp, Rattus norvegicus
aggcaccacgaatccgcggcgagcg

SEQ ID NO: 463381 - DNA, 25 bp, Rattus norvegicus
aacgcagtactcttggggcagccag

SEQ ID NO: 463382 - DNA, 25 bp, Rattus norvegicus
tccaggtaggaacctggccggcgcc

SEQ ID NO: 463383 - DNA, 25 bp, Rattus norvegicus
cggggctctgaaaaccgcagcttcc

SEQ ID NO: 463384 - DNA, 25 bp, Rattus norvegicus
tcctaccggggctctgaaaaccgca

SEQ ID NO: 463385 - DNA, 25 bp, Rattus norvegicus
gcggccatagagacacgccggccta

SEQ ID NO: 463386 - DNA, 25 bp, Rattus norvegicus
tgcagagagagcctgcggaactgac

SEQ ID NO: 463387 - DNA, 25 bp, Rattus norvegicus
tcttgccggagccatggtgcagaga

SEQ ID NO: 463388 - DNA, 25 bp, Rattus norvegicus
cacctcttgccggagccatggtgca

SEQ ID NO: 463389 - DNA, 25 bp, Rattus norvegicus
gccgttccctagtgaccgccctcag

SEQ ID NO: 463390 - DNA, 25 bp, Rattus norvegicus
cgggaggctcactgcaccgacgtgc

SEQ ID NO: 463391 - DNA, 25 bp, Rattus norvegicus
gaaccacagcctcgctccaggtagg

SEQ ID NO: 463392 - DNA, 25 bp, Rattus norvegicus
aaaaccgcagcttccggttggctga

SEQ ID NO: 463393 - DNA, 25 bp, Rattus norvegicus
tgcggagcgacaagtctgggaaacc

SEQ ID NO: 463394 - DNA, 25 bp, Rattus norvegicus
ctcactgcaccgacgtgcgggtgca

SEQ ID NO: 463395 - DNA, 25 bp, Rattus norvegicus
gaactgacggccctgcggccataga

SEQ ID NO: 463396 - DNA, 25 bp, Rattus norvegicus
ttgcgttcccgctggtgagcgccca

SEQ ID NO: 463397 - DNA, 25 bp, Rattus norvegicus
tacaggagcgctccctctagtgcgc

SEQ ID NO: 463398 - DNA, 25 bp, Rattus norvegicus
aagtttccctgtccggcgccgctag

SEQ ID NO: 463399 - DNA, 25 bp, Rattus norvegicus
aggtgcgttcccaccagtcgcgtgc

SEQ ID NO: 463400 - DNA, 25 bp, Rattus norvegicus
cggcggagcctaaccttgggcaatt

SEQ ID NO: 463401 - DNA, 25 bp, Rattus norvegicus
ttctaatgcgcgctcccgcaggtgc

SEQ ID NO: 463402 - DNA, 25 bp, Rattus norvegicus
aggcttctggaaaggccgcaccaca

SEQ ID NO: 463403 - DNA, 25 bp, Rattus norvegicus
tctagtgcgcgttccttcccttgcg

SEQ ID NO: 463404 - DNA, 25 bp, Rattus norvegicus
ctaaccttgggcaattgcaaagcta

SEQ ID NO: 463405 - DNA, 25 bp, Rattus norvegicus
cggtgcgctccttctaatgcgcgct

SEQ ID NO: 463406 - DNA, 25 bp, Rattus norvegicus
gctagacacagagactcccggcgtc

SEQ ID NO: 463407 - DNA, 25 bp, Rattus norvegicus
ttgcaaagctaaggaagtttccctg

SEQ ID NO: 463408 - DNA, 25 bp, Rattus norvegicus
gcaccacaagccacaggcttctgga

SEQ ID NO: 463409 - DNA, 25 bp, Rattus norvegicus
tgcgctcctgctaggtgcgctctct

SEQ ID NO: 463410 - DNA, 25 bp, Rattus norvegicus
tacggaacggtgacagctcctttgc

SEQ ID NO: 463411 - DNA, 25 bp, Rattus norvegicus
cacgcctgggcgcacgtacaaaggc

SEQ ID NO: 463412 - DNA, 25 bp, Rattus norvegicus
cacaatgccacgttcggcggggtca

SEQ ID NO: 463413 - DNA, 25 bp, Rattus norvegicus
cgcacctgggtcacgtgataacaca

SEQ ID NO: 463414 - DNA, 25 bp, Rattus norvegicus
tcacctggcacagctgccggcagta

SEQ ID NO: 463415 - DNA, 25 bp, Rattus norvegicus
ccagtccggcctctgaacacaaagg

SEQ ID NO: 463416 - DNA, 25 bp, Rattus norvegicus
cccaacaacaaaggccgagcgactg

SEQ ID NO: 463417 - DNA, 25 bp, Rattus norvegicus
acaaagaccctacggtcgcagccta

SEQ ID NO: 463418 - DNA, 25 bp, Rattus norvegicus
cagctcctttgcaccgcggagagca

SEQ ID NO: 463419 - DNA, 25 bp, Rattus norvegicus
ccaagggacaactgactacggaacg

SEQ ID NO: 463420 - DNA, 25 bp, Rattus norvegicus
cagtgctgcagcaagctgaggcttc

SEQ ID NO: 463421 - DNA, 25 bp, Rattus norvegicus
cgagtgcaaggtctgcggaacaacc

SEQ ID NO: 463422 - DNA, 25 bp, Rattus norvegicus
ggcgggattggctcaagaacatcaa

SEQ ID NO: 463423 - DNA, 25 bp, Rattus norvegicus
tgacgaccgccagtgcagtgctgca

SEQ ID NO: 463424 - DNA, 25 bp, Rattus norvegicus
tgcagcagcttttcaggcagcgcta

SEQ ID NO: 463425 - DNA, 25 bp, Rattus norvegicus
gctggcatcacagatcgcctagtga

SEQ ID NO: 463426 - DNA, 25 bp, Rattus norvegicus
cacagatcgcctagtgacggccgtc

SEQ ID NO: 463427 - DNA, 25 bp, Rattus norvegicus
ctgcagccttgtggacgcgaaaatt

SEQ ID NO: 463428 - DNA, 25 bp, Rattus norvegicus
cccgaagcccacagagcgagggctg

SEQ ID NO: 463429 - DNA, 25 bp, Rattus norvegicus
agcttttcaggcagcgctacgggtg

SEQ ID NO: 463430 - DNA, 25 bp, Rattus norvegicus
agctccagagactgtcgcccgcggg

SEQ ID NO: 463431 - DNA, 25 bp, Rattus norvegicus
gcagctcctgctgtgcgcagacgag

SEQ ID NO: 463432 - DNA, 25 bp, Rattus norvegicus
gaggctcgtcctgcaggacctggcc

SEQ ID NO: 463433 - DNA, 25 bp, Rattus norvegicus
gacctggccggctttctccaaagag

SEQ ID NO: 463434 - DNA, 25 bp, Rattus norvegicus
tttctccaaagagctgagctgcatc

SEQ ID NO: 463435 - DNA, 25 bp, Rattus norvegicus
gctgagctgcatccagacgcagaga

SEQ ID NO: 463436 - DNA, 25 bp, Rattus norvegicus
atccagacgcagagacctgcagcct

SEQ ID NO: 463437 - DNA, 25 bp, Rattus norvegicus
tagtgacggccgtcgccacgctgct

SEQ ID NO: 463438 - DNA, 25 bp, Rattus norvegicus
atgatttcggccgcgcagttgttgg

SEQ ID NO: 463439 - DNA, 25 bp, Rattus norvegicus
cgagtggctggtggttttcgttggt

SEQ ID NO: 463440 - DNA, 25 bp, Rattus norvegicus
ttcgttggtgggtgctagggctggt

SEQ ID NO: 463441 - DNA, 25 bp, Rattus norvegicus
ctagggctggtgtgagcagccgccc

SEQ ID NO: 463442 - DNA, 25 bp, Rattus norvegicus
gaggaagcaccatgatttcggccgc

SEQ ID NO: 463443 - DNA, 25 bp, Rattus norvegicus
ggaagcaccatgatttcggccgcgc

SEQ ID NO: 463444 - DNA, 25 bp, Rattus norvegicus
agcaacgtgcggtgggaccacgaga

SEQ ID NO: 463445 - DNA, 25 bp, Rattus norvegicus
cagttgttggatgagttaatgggcc

SEQ ID NO: 463446 - DNA, 25 bp, Rattus norvegicus
ggatgagttaatgggccgggaccga

SEQ ID NO: 463447 - DNA, 25 bp, Rattus norvegicus
aacctggccccggatgagaagcgca

SEQ ID NO: 463448 - DNA, 25 bp, Rattus norvegicus
ccccggatgagaagcgcagcaacgt

SEQ ID NO: 463449 - DNA, 25 bp, Rattus norvegicus
agcgcagcaacgtgcggtgggacca

SEQ ID NO: 463450 - DNA, 25 bp, Rattus norvegicus
gcaccatgatttcggccgcgcagtt

SEQ ID NO: 463451 - DNA, 25 bp, Rattus norvegicus
aagcaccatgatttcggccgcgcag

SEQ ID NO: 463452 - DNA, 25 bp, Rattus norvegicus
acatcacagggcaggtccgctcagt

SEQ ID NO: 463453 - DNA, 25 bp, Rattus norvegicus
agctcgaatctctgtgtgccgggtt

SEQ ID NO: 463454 - DNA, 25 bp, Rattus norvegicus
agcccgtttgtgcagctcgaatctc

SEQ ID NO: 463455 - DNA, 25 bp, Rattus norvegicus
atgcctgagcccgtttgtgcagctc

SEQ ID NO: 463456 - DNA, 25 bp, Rattus norvegicus
cacccgagttgagggatgcctgagc

SEQ ID NO: 463457 - DNA, 25 bp, Rattus norvegicus
ctcaggtccacacccgagttgaggg

SEQ ID NO: 463458 - DNA, 25 bp, Rattus norvegicus
aactgtacagctgccctcaggtcca

SEQ ID NO: 463459 - DNA, 25 bp, Rattus norvegicus
gctcggtaactgtacagctgccctc

SEQ ID NO: 463460 - DNA, 25 bp, Rattus norvegicus
tgcacagccacccagtcgttctggt

SEQ ID NO: 463461 - DNA, 25 bp, Rattus norvegicus
ccgtaaatgaggttgatgcgattga

SEQ ID NO: 463462 - DNA, 25 bp, Rattus norvegicus
cagatcgtgccgtaaatgaggttga

SEQ ID NO: 463463 - DNA, 25 bp, Rattus norvegicus
tgcagaactcacagatcgtgccgta

SEQ ID NO: 463464 - DNA, 25 bp, Rattus norvegicus
tgtgccgggttcgaacttcctcttg

SEQ ID NO: 463465 - DNA, 25 bp, Rattus norvegicus
aggtccgctcagtgcagaactcaca

SEQ ID NO: 463466 - DNA, 25 bp, Rattus norvegicus
agatctgagaaatgcgccttgggcc

SEQ ID NO: 463467 - DNA, 25 bp, Rattus norvegicus
acacgcgtttagctcgcctctggaa

SEQ ID NO: 463468 - DNA, 25 bp, Rattus norvegicus
agctcgcctctggaagtcctttgga

SEQ ID NO: 463469 - DNA, 25 bp, Rattus norvegicus
gaagtcctttggacccgctcgcaga

SEQ ID NO: 463470 - DNA, 25 bp, Rattus norvegicus
ccgctcgcagagctcctggcttttg

SEQ ID NO: 463471 - DNA, 25 bp, Rattus norvegicus
cctcgtctcagattagctagggata

SEQ ID NO: 463472 - DNA, 25 bp, Rattus norvegicus
acaagcagcctaggaggcgggctta

SEQ ID NO: 463473 - DNA, 25 bp, Rattus norvegicus
gcgagcggcgaaagggacttccttc

SEQ ID NO: 463474 - DNA, 25 bp, Rattus norvegicus
ttagaggcgcaacaatagtggaacc

SEQ ID NO: 463475 - DNA, 25 bp, Rattus norvegicus
accgcagaggaacaaaaggccattc

SEQ ID NO: 463476 - DNA, 25 bp, Rattus norvegicus
aaaggccattcaccggttacaccag

SEQ ID NO: 463477 - DNA, 25 bp, Rattus norvegicus
ttacaccagaatgactcggtcgccc

SEQ ID NO: 463478 - DNA, 25 bp, Rattus norvegicus
tcgtgggccctccacacgcgtttag

SEQ ID NO: 463479 - DNA, 25 bp, Rattus norvegicus
tagccgggtcccgatctctgtcctt

SEQ ID NO: 463480 - DNA, 25 bp, Rattus norvegicus
gggcgcaaagccgttcccaaacaga

SEQ ID NO: 463481 - DNA, 25 bp, Rattus norvegicus
tgcagggccacttccgactggaagc

SEQ ID NO: 463482 - DNA, 25 bp, Rattus norvegicus
gggccacttccgactggaagccttc

SEQ ID NO: 463483 - DNA, 25 bp, Rattus norvegicus
acttccgactggaagccttcctgtg

SEQ ID NO: 463484 - DNA, 25 bp, Rattus norvegicus
actggaagccttcctgtggcggtgc

SEQ ID NO: 463485 - DNA, 25 bp, Rattus norvegicus
aaggcgatcgcgctcagtcgctccg

SEQ ID NO: 463486 - DNA, 25 bp, Rattus norvegicus
agtcgctccgcagcccgagactgca

SEQ ID NO: 463487 - DNA, 25 bp, Rattus norvegicus
cgctccgctgccagacgcgccacag

SEQ ID NO: 463488 - DNA, 25 bp, Rattus norvegicus
agacgcgccacagcgcctctgagag

SEQ ID NO: 463489 - DNA, 25 bp, Rattus norvegicus
gcgccacagcgcctctgagagctcc

SEQ ID NO: 463490 - DNA, 25 bp, Rattus norvegicus
gcgagctgatggctccgagcttgcg

SEQ ID NO: 463491 - DNA, 25 bp, Rattus norvegicus
cagaccgcggcgagctgatggctcc

SEQ ID NO: 463492 - DNA, 25 bp, Rattus norvegicus
gtagcgagtgtgcagggccacttcc

SEQ ID NO: 463493 - DNA, 25 bp, Rattus norvegicus
ttcccaaacagaccgcggcgagctg

SEQ ID NO: 463494 - DNA, 25 bp, Rattus norvegicus
taccggccggcaagcagaccgaggc

SEQ ID NO: 463495 - DNA, 25 bp, Rattus norvegicus
cagggaccgcaaccgcagccggctc

SEQ ID NO: 463496 - DNA, 25 bp, Rattus norvegicus
cggggaccctcggtagatctgactg

SEQ ID NO: 463497 - DNA, 25 bp, Rattus norvegicus
caagggctctttcgctcggggaaca

SEQ ID NO: 463498 - DNA, 25 bp, Rattus norvegicus
gtagatctgactgggtcgcaggacc

SEQ ID NO: 463499 - DNA, 25 bp, Rattus norvegicus
tcgcaggaccgccagcgctctggtt

SEQ ID NO: 463500 - DNA, 25 bp, Rattus norvegicus
gctctggttgcctccggtacagacc

SEQ ID NO: 463501 - DNA, 25 bp, Rattus norvegicus
ccctggggcccaggcttctggtgct

SEQ ID NO: 463502 - DNA, 25 bp, Rattus norvegicus
tccctcaaaggccggggagaagctc

SEQ ID NO: 463503 - DNA, 25 bp, Rattus norvegicus
gacagcgtagacgaggcccatcctc

SEQ ID NO: 463504 - DNA, 25 bp, Rattus norvegicus
cgcaactcctgcgaggccaagggct

SEQ ID NO: 463505 - DNA, 25 bp, Rattus norvegicus
ctgcgaggccaagggctctttcgct

SEQ ID NO: 463506 - DNA, 25 bp, Rattus norvegicus
ggcaagcagaccgaggcagcagccc

SEQ ID NO: 463507 - DNA, 25 bp, Rattus norvegicus
ccgcacgtctcactcacccactcgc

SEQ ID NO: 463508 - DNA, 25 bp, Rattus norvegicus
taaactttctgagcatcccgatccc

SEQ ID NO: 463509 - DNA, 25 bp, Rattus norvegicus
cgtatctacgaagctgcgaaggatg

SEQ ID NO: 463510 - DNA, 25 bp, Rattus norvegicus
cctgagatggaacggaccctcttcc

SEQ ID NO: 463511 - DNA, 25 bp, Rattus norvegicus
gccacctggaggatgctacgggcac

SEQ ID NO: 463512 - DNA, 25 bp, Rattus norvegicus
cccacaggaacgtcgggaagcagga

SEQ ID NO: 463513 - DNA, 25 bp, Rattus norvegicus
ccttgaagttttcagcagctggctc

SEQ ID NO: 463514 - DNA, 25 bp, Rattus norvegicus
ggtgtcatcctcttggataccttga

SEQ ID NO: 463515 - DNA, 25 bp, Rattus norvegicus
ttttacagcagcgtggggtgtcatc

SEQ ID NO: 463516 - DNA, 25 bp, Rattus norvegicus
tttctgtgacccgtacgctttcggc

SEQ ID NO: 463517 - DNA, 25 bp, Rattus norvegicus
gggtgtttctccctgatctctgaca

SEQ ID NO: 463518 - DNA, 25 bp, Rattus norvegicus
ttcatggcgacaaacctcaaggatg

SEQ ID NO: 463519 - DNA, 25 bp, Rattus norvegicus
cagcgcctgtacgttgccttagcaa

SEQ ID NO: 463520 - DNA, 25 bp, Rattus norvegicus
agaggcgaccatcggaggagattca

SEQ ID NO: 463521 - DNA, 25 bp, Rattus norvegicus
ccacgccgcggattcttttacagca

SEQ ID NO: 463522 - DNA, 25 bp, Rattus norvegicus
gacagaaacaaccttggcggccttg

SEQ ID NO: 463523 - DNA, 25 bp, Rattus norvegicus
ctgcggatccggctttcttccgtga

SEQ ID NO: 463524 - DNA, 25 bp, Rattus norvegicus
cggtgtgcacttctcgaaccctgca

SEQ ID NO: 463525 - DNA, 25 bp, Rattus norvegicus
agccctggcagtctaagcgtctcca

SEQ ID NO: 463526 - DNA, 25 bp, Rattus norvegicus
ggttgcggtctcttaccttgacatg

SEQ ID NO: 463527 - DNA, 25 bp, Rattus norvegicus
tctctctagagattcaagcagctgg

SEQ ID NO: 463528 - DNA, 25 bp, Rattus norvegicus
tttcacttgtcagcccggagccatt

SEQ ID NO: 463529 - DNA, 25 bp, Rattus norvegicus
agccaagctgtgtatgccgtcagga

SEQ ID NO: 463530 - DNA, 25 bp, Rattus norvegicus
ttgccgagcggttctcaaccatctg

SEQ ID NO: 463531 - DNA, 25 bp, Rattus norvegicus
tgtgcggataggacactcccttttg

SEQ ID NO: 463532 - DNA, 25 bp, Rattus norvegicus
ccagatgcagttcccgattggtatc

SEQ ID NO: 463533 - DNA, 25 bp, Rattus norvegicus
ctgccaagacgagggcccacagttc

SEQ ID NO: 463534 - DNA, 25 bp, Rattus norvegicus
ggttcctctgtgattctcgccactg

SEQ ID NO: 463535 - DNA, 25 bp, Rattus norvegicus
gcaccggctggtatttcacttgtca

SEQ ID NO: 463536 - DNA, 25 bp, Rattus norvegicus
tctcgccttggtgtgcgggccgcac

SEQ ID NO: 463537 - DNA, 25 bp, Rattus norvegicus
cctgtgtgctccgtgctccgtgagc

SEQ ID NO: 463538 - DNA, 25 bp, Rattus norvegicus
ccgctgtgagcggtgagtaccatgc

SEQ ID NO: 463539 - DNA, 25 bp, Rattus norvegicus
gtccgtgcaggcctttcccacggta

SEQ ID NO: 463540 - DNA, 25 bp, Rattus norvegicus
gtgcaggcctttcccacggtacaga

SEQ ID NO: 463541 - DNA, 25 bp, Rattus norvegicus
agacccgggaacacccggcgatctg

SEQ ID NO: 463542 - DNA, 25 bp, Rattus norvegicus
agctggctcctagggtgacctctct

SEQ ID NO: 463543 - DNA, 25 bp, Rattus norvegicus
cagcctgcgtcgctttgtactggga

SEQ ID NO: 463544 - DNA, 25 bp, Rattus norvegicus
cccacgggatagaaaggagcgattg

SEQ ID NO: 463545 - DNA, 25 bp, Rattus norvegicus
cccgagagttctcgccttggtgtgc

SEQ ID NO: 463546 - DNA, 25 bp, Rattus norvegicus
ggccgcaccgccagggtgtcagtct

SEQ ID NO: 463547 - DNA, 25 bp, Rattus norvegicus
tgggttcttgcttgcacccgcctgt

SEQ ID NO: 463548 - DNA, 25 bp, Rattus norvegicus
ctttgtactgggagtggctcttctc

SEQ ID NO: 463549 - DNA, 25 bp, Rattus norvegicus
ttcttgcttgcacccgcctgtgtgc

SEQ ID NO: 463550 - DNA, 25 bp, Rattus norvegicus
tgaccgagctacgattgccaacatg

SEQ ID NO: 463551 - DNA, 25 bp, Rattus norvegicus
ttcttcccggtcgacaacgttagca

SEQ ID NO: 463552 - DNA, 25 bp, Rattus norvegicus
agacgctgggaatgccttccgcctc

SEQ ID NO: 463553 - DNA, 25 bp, Rattus norvegicus
tacctggtgcagacaggtaagggaa

SEQ ID NO: 463554 - DNA, 25 bp, Rattus norvegicus
tagcatcgcgtacctggtgcagaca

SEQ ID NO: 463555 - DNA, 25 bp, Rattus norvegicus
cgacaacgttagcatcgcgtacctg

SEQ ID NO: 463556 - DNA, 25 bp, Rattus norvegicus
cggtcgacaacgttagcatcgcgta

SEQ ID NO: 463557 - DNA, 25 bp, Rattus norvegicus
agtacggcgcgacggcagccttctt

SEQ ID NO: 463558 - DNA, 25 bp, Rattus norvegicus
cgattgccaacatgtgcccagagta

SEQ ID NO: 463559 - DNA, 25 bp, Rattus norvegicus
gtccattgctgaccgagctacgatt

SEQ ID NO: 463560 - DNA, 25 bp, Rattus norvegicus
ggcccagctgtccattgctgaccga

SEQ ID NO: 463561 - DNA, 25 bp, Rattus norvegicus
cacctccgacaagttggggtcgtgg

SEQ ID NO: 463562 - DNA, 25 bp, Rattus norvegicus
gccatgtagcacctccgacaagttg

SEQ ID NO: 463563 - DNA, 25 bp, Rattus norvegicus
aacatgtgcccagagtacggcgcga

SEQ ID NO: 463564 - DNA, 25 bp, Rattus norvegicus
tggagagaaggcgagaccaaccccc

SEQ ID NO: 463565 - DNA, 25 bp, Rattus norvegicus
accgctgggccgctagaagccagct

SEQ ID NO: 463566 - DNA, 25 bp, Rattus norvegicus
tgcggcacagacaccagaccctgcc

SEQ ID NO: 463567 - DNA, 25 bp, Rattus norvegicus
atgcgtacagcaagcgcacgcagga

SEQ ID NO: 463568 - DNA, 25 bp, Rattus norvegicus
tggacgcatgcgtacagcaagcgca

SEQ ID NO: 463569 - DNA, 25 bp, Rattus norvegicus
ccgcgctctggacgcatgcgtacag

SEQ ID NO: 463570 - DNA, 25 bp, Rattus norvegicus
gcccgcgcagcaaaacacggccctc

SEQ ID NO: 463571 - DNA, 25 bp, Rattus norvegicus
gacgtagaacgctcatcaccaaagg

SEQ ID NO: 463572 - DNA, 25 bp, Rattus norvegicus
ccctgtgacgtagaacgctcatcac

SEQ ID NO: 463573 - DNA, 25 bp, Rattus norvegicus
caccctcctcgcgagacagcggaga

SEQ ID NO: 463574 - DNA, 25 bp, Rattus norvegicus
cgcgaaggcgtacccggcggcttct

SEQ ID NO: 463575 - DNA, 25 bp, Rattus norvegicus
tagaagccagctcccgccggcccag

SEQ ID NO: 463576 - DNA, 25 bp, Rattus norvegicus
cgctcatcaccaaaggcagtttggg

SEQ ID NO: 463577 - DNA, 25 bp, Rattus norvegicus
caggatccgcgaaggcgtacccggc

SEQ ID NO: 463578 - DNA, 25 bp, Rattus norvegicus
gactggacttactcctcggtaggta

SEQ ID NO: 463579 - DNA, 25 bp, Rattus norvegicus
ggcgcgatcttagcattttctcttt

SEQ ID NO: 463580 - DNA, 25 bp, Rattus norvegicus
ttccctcctgaaaggcgggctaggc

SEQ ID NO: 463581 - DNA, 25 bp, Rattus norvegicus
aggcctggatcacgtgatgcgtttc

SEQ ID NO: 463582 - DNA, 25 bp, Rattus norvegicus
gatgcgtttcaactccgggcggaag

SEQ ID NO: 463583 - DNA, 25 bp, Rattus norvegicus
cccgctgaaaaatggctgctgcatc

SEQ ID NO: 463584 - DNA, 25 bp, Rattus norvegicus
ctgctgcatccgagtgtactgcgcc

SEQ ID NO: 463585 - DNA, 25 bp, Rattus norvegicus
ctgctcccttaccatgatgccggtg

SEQ ID NO: 463586 - DNA, 25 bp, Rattus norvegicus
gtcgccgaaacctggactggactta

SEQ ID NO: 463587 - DNA, 25 bp, Rattus norvegicus
cccgcaagccgaaggcaggcagttt

SEQ ID NO: 463588 - DNA, 25 bp, Rattus norvegicus
caggcagtttgctcgcagcttggaa

SEQ ID NO: 463589 - DNA, 25 bp, Rattus norvegicus
taaattgatcgttcacgccctgccc

SEQ ID NO: 463590 - DNA, 25 bp, Rattus norvegicus
aggacacgcttttccgcctctgacg

SEQ ID NO: 463591 - DNA, 25 bp, Rattus norvegicus
ccatgatgccggtgagtcgccgaaa

SEQ ID NO: 463592 - DNA, 25 bp, Rattus norvegicus
tgacagcgcgcacccgaacctgggg

SEQ ID NO: 463593 - DNA, 25 bp, Rattus norvegicus
ttattccagaatcgctccaggggcc

SEQ ID NO: 463594 - DNA, 25 bp, Rattus norvegicus
cttgaggcgcctgcaacggcgcgat

SEQ ID NO: 463595 - DNA, 25 bp, Rattus norvegicus
ggggccggtcacttacgcgcgatcc

SEQ ID NO: 463596 - DNA, 25 bp, Rattus norvegicus
tgtgtggcacatcactcaccatgta

SEQ ID NO: 463597 - DNA, 25 bp, Rattus norvegicus
tcccgcaaaaagttattccagaatc

SEQ ID NO: 463598 - DNA, 25 bp, Rattus norvegicus
ggaacccggatctgtgtggcacatc

SEQ ID NO: 463599 - DNA, 25 bp, Rattus norvegicus
agaatcgctccaggggccacatcct

SEQ ID NO: 463600 - DNA, 25 bp, Rattus norvegicus
tcttggtccttcagccatcgccttc

SEQ ID NO: 463601 - DNA, 25 bp, Rattus norvegicus
cgcagcttctcatcgggcgtgtacc

SEQ ID NO: 463602 - DNA, 25 bp, Rattus norvegicus
catgtcgccggcgagcttaccagag

SEQ ID NO: 463603 - DNA, 25 bp, Rattus norvegicus
ccggcgagcttaccagagagtgaca

SEQ ID NO: 463604 - DNA, 25 bp, Rattus norvegicus
cagagagtgacagcgcgcacccgaa

SEQ ID NO: 463605 - DNA, 25 bp, Rattus norvegicus
accatgtacttccacagggcccggt

SEQ ID NO: 463606 - DNA, 25 bp, Rattus norvegicus
ccctggagcgattctggaataactt

SEQ ID NO: 463607 - DNA, 25 bp, Rattus norvegicus
tctctggtaagctcgccggcgacat

SEQ ID NO: 463608 - DNA, 25 bp, Rattus norvegicus
tcgccggcgacatgtcggggtacac

SEQ ID NO: 463609 - DNA, 25 bp, Rattus norvegicus
tgtcactctctggtaagctcgccgg

SEQ ID NO: 463610 - DNA, 25 bp, Rattus norvegicus
acatgtcggggtacacgcccgatga

SEQ ID NO: 463611 - DNA, 25 bp, Rattus norvegicus
cacgcccgatgagaagctgcggctg

SEQ ID NO: 463612 - DNA, 25 bp, Rattus norvegicus
tgtgccacacagatccgggttccca

SEQ ID NO: 463613 - DNA, 25 bp, Rattus norvegicus
tacatggtgagtgatgtgccacaca

SEQ ID NO: 463614 - DNA, 25 bp, Rattus norvegicus
cgattctggaataactttttgcggg

SEQ ID NO: 463615 - DNA, 25 bp, Rattus norvegicus
accgggccctgtggaagtacatggt

SEQ ID NO: 463616 - DNA, 25 bp, Rattus norvegicus
ccctgtggaagtacatggtgagtga

SEQ ID NO: 463617 - DNA, 25 bp, Rattus norvegicus
atcgcgccgttgcaggcgcctcaag

SEQ ID NO: 463618 - DNA, 25 bp, Rattus norvegicus
cccaggttcgggtgcgcgctgtcac

SEQ ID NO: 463619 - DNA, 25 bp, Rattus norvegicus
gatcgcgcgtaagtgaccggcccca

SEQ ID NO: 463620 - DNA, 25 bp, Rattus norvegicus
gcgtggtccctgaatttggaactca

SEQ ID NO: 463621 - DNA, 25 bp, Rattus norvegicus
cgggacggagtcctccctcctcgct

SEQ ID NO: 463622 - DNA, 25 bp, Rattus norvegicus
catctctgttcccagcgcggtgcaa

SEQ ID NO: 463623 - DNA, 25 bp, Rattus norvegicus
cactccgatccgctgcgcccaggtt

SEQ ID NO: 463624 - DNA, 25 bp, Rattus norvegicus
gctcgcgcgttttttcctgccggga

SEQ ID NO: 463625 - DNA, 25 bp, Rattus norvegicus
caggctcgcgcgttttttcctgccg

SEQ ID NO: 463626 - DNA, 25 bp, Rattus norvegicus
tatcttgcgcgtggtccctgaattt

SEQ ID NO: 463627 - DNA, 25 bp, Rattus norvegicus
tcccagcgcggtgcaagtgatgtaa

SEQ ID NO: 463628 - DNA, 25 bp, Rattus norvegicus
gcggcacggacacgggtccaagcca

SEQ ID NO: 463629 - DNA, 25 bp, Rattus norvegicus
tggactccggcagcggcacggacac

SEQ ID NO: 463630 - DNA, 25 bp, Rattus norvegicus
tttggaactcagacggtgcatcagc

SEQ ID NO: 463631 - DNA, 25 bp, Rattus norvegicus
aactcagacggtgcatcagcggccc

SEQ ID NO: 463632 - DNA, 25 bp, Rattus norvegicus
gcaaggcgctctggactccggcagc

SEQ ID NO: 463633 - DNA, 25 bp, Rattus norvegicus
caagtgatgtaaggcggccaggctc

SEQ ID NO: 463634 - DNA, 25 bp, Rattus norvegicus
aacccagagggcgagtcagctccgc

SEQ ID NO: 463635 - DNA, 25 bp, Rattus norvegicus
gagtctaggtccttgggtctccctc

SEQ ID NO: 463636 - DNA, 25 bp, Rattus norvegicus
gacttccggcaagtgacgcgcccgg

SEQ ID NO: 463637 - DNA, 25 bp, Rattus norvegicus
ccgggctccgctacaaaagaggtcg

SEQ ID NO: 463638 - DNA, 25 bp, Rattus norvegicus
cgctacaaaagaggtcggctgcggc

SEQ ID NO: 463639 - DNA, 25 bp, Rattus norvegicus
gcggaactttccagaacgctcggtg

SEQ ID NO: 463640 - DNA, 25 bp, Rattus norvegicus
ctttccagaacgctcggtgggtggt

SEQ ID NO: 463641 - DNA, 25 bp, Rattus norvegicus
gctcaccggtgagtctaggtccttg

SEQ ID NO: 463642 - DNA, 25 bp, Rattus norvegicus
cgaggcggcccaaggccgaagccaa

SEQ ID NO: 463643 - DNA, 25 bp, Rattus norvegicus
tgcggcttgcgcttctcctggctct

SEQ ID NO: 463644 - DNA, 25 bp, Rattus norvegicus
tggctctcctccctttctttgttga

SEQ ID NO: 463645 - DNA, 25 bp, Rattus norvegicus
ctccgccttttcgatcagggtggga

SEQ ID NO: 463646 - DNA, 25 bp, Rattus norvegicus
cctgagccgggctcggtcttcggaa

SEQ ID NO: 463647 - DNA, 25 bp, Rattus norvegicus
agctgcgctgtgctacgctcctctt

SEQ ID NO: 463648 - DNA, 25 bp, Rattus norvegicus
aggtagaaatggctgccgctctgca

SEQ ID NO: 463649 - DNA, 25 bp, Rattus norvegicus
tgggaaccggcagcaggtaaacgcc

SEQ ID NO: 463650 - DNA, 25 bp, Rattus norvegicus
ggcaccaacacgtacctggtgggaa

SEQ ID NO: 463651 - DNA, 25 bp, Rattus norvegicus
atgaccctgcaaggcaccaacacgt

SEQ ID NO: 463652 - DNA, 25 bp, Rattus norvegicus
tgctgggctgtaacccgggtcccat

SEQ ID NO: 463653 - DNA, 25 bp, Rattus norvegicus
ctctgcagcgcatcgagcagctgtc

SEQ ID NO: 463654 - DNA, 25 bp, Rattus norvegicus
acacactcgcgtgacccggaggcag

SEQ ID NO: 463655 - DNA, 25 bp, Rattus norvegicus
cgccggcggtcaccgaggtagaaat

SEQ ID NO: 463656 - DNA, 25 bp, Rattus norvegicus
tgctggccgagtgacttaaaattta

SEQ ID NO: 463657 - DNA, 25 bp, Rattus norvegicus
ctcacgtgatcggtgcggtgtcacg

SEQ ID NO: 463658 - DNA, 25 bp, Rattus norvegicus
ggtcaatgcgcgaagcctcacgtga

SEQ ID NO: 463659 - DNA, 25 bp, Rattus norvegicus
tgccaatccgttccgggtcaatgcg

SEQ ID NO: 463660 - DNA, 25 bp, Rattus norvegicus
cgagtcaccctatggcggctgccaa

SEQ ID NO: 463661 - DNA, 25 bp, Rattus norvegicus
gcatcgagcagctgtccagtcgggt

SEQ ID NO: 463662 - DNA, 25 bp, Rattus norvegicus
tctgccgcctgcatggagcaaactc

SEQ ID NO: 463663 - DNA, 25 bp, Rattus norvegicus
cctgcatggagcaaactcgggcgca

SEQ ID NO: 463664 - DNA, 25 bp, Rattus norvegicus
catggagcaaactcgggcgcaggct

SEQ ID NO: 463665 - DNA, 25 bp, Rattus norvegicus
aaactcgggcgcaggctgaaggccc

SEQ ID NO: 463666 - DNA, 25 bp, Rattus norvegicus
cgctgcccgcgccttctgccagccc

SEQ ID NO: 463667 - DNA, 25 bp, Rattus norvegicus
agccagtcccagtcccaggggggca

SEQ ID NO: 463668 - DNA, 25 bp, Rattus norvegicus
aagacgccgccggcagacgccagga

SEQ ID NO: 463669 - DNA, 25 bp, Rattus norvegicus
aggacccaccgctcattacgacatc

SEQ ID NO: 463670 - DNA, 25 bp, Rattus norvegicus
ttacgacatcttcctccctggcctc

SEQ ID NO: 463671 - DNA, 25 bp, Rattus norvegicus
tccgccgccaccgagagcctgacac

SEQ ID NO: 463672 - DNA, 25 bp, Rattus norvegicus
accgcccgcctagcacccgccaatc

SEQ ID NO: 463673 - DNA, 25 bp, Rattus norvegicus
gcgacggcagctcttaccaataagc

SEQ ID NO: 463674 - DNA, 25 bp, Rattus norvegicus
agctcttaccaataagcgctcggta

SEQ ID NO: 463675 - DNA, 25 bp, Rattus norvegicus
ataagcgctcggtacattggggacc

SEQ ID NO: 463676 - DNA, 25 bp, Rattus norvegicus
tctaaagggcgaagaaaggctacgc

SEQ ID NO: 463677 - DNA, 25 bp, Rattus norvegicus
acgccacggcaggactcactcggaa

SEQ ID NO: 463678 - DNA, 25 bp, Rattus norvegicus
cttccgctccgctagggtctaaagg

SEQ ID NO: 463679 - DNA, 25 bp, Rattus norvegicus
tccgctagggtctaaagggcgaaga

SEQ ID NO: 463680 - DNA, 25 bp, Rattus norvegicus
gagcaccctccaccctacgcgacgc

SEQ ID NO: 463681 - DNA, 25 bp, Rattus norvegicus
acgccacgccgcgaacacgccacgg

SEQ ID NO: 463682 - DNA, 25 bp, Rattus norvegicus
aaagtgcttgaaggccgcagcctcc

SEQ ID NO: 463683 - DNA, 25 bp, Rattus norvegicus
ggactcactcggaagactcgatttc

SEQ ID NO: 463684 - DNA, 25 bp, Rattus norvegicus
ggaagactcgatttcgatcgacata

SEQ ID NO: 463685 - DNA, 25 bp, Rattus norvegicus
ttcgatcgacatagcggtaacgctc

SEQ ID NO: 463686 - DNA, 25 bp, Rattus norvegicus
atagcggtaacgctccgggtctagg

SEQ ID NO: 463687 - DNA, 25 bp, Rattus norvegicus
agcacacagccggtcgcacaacacc

SEQ ID NO: 463688 - DNA, 25 bp, Rattus norvegicus
gtcacttccgctccgctagggtcta

SEQ ID NO: 463689 - DNA, 25 bp, Rattus norvegicus
agaggaagccaacccggaaagtgct

SEQ ID NO: 463690 - DNA, 25 bp, Rattus norvegicus
actcttggggactaaacgtggcgct

SEQ ID NO: 463691 - DNA, 25 bp, Rattus norvegicus
ggaacggctcacgaaacctcatctt

SEQ ID NO: 463692 - DNA, 25 bp, Rattus norvegicus
ggcgctacccgaccacagcgatgga

SEQ ID NO: 463693 - DNA, 25 bp, Rattus norvegicus
tccgaaggctcttcgcggaacctga

SEQ ID NO: 463694 - DNA, 25 bp, Rattus norvegicus
tcagccgggtttttctggcagctaa

SEQ ID NO: 463695 - DNA, 25 bp, Rattus norvegicus
tcgcgaccggagaggtaatagacca

SEQ ID NO: 463696 - DNA, 25 bp, Rattus norvegicus
ttgagccggcatcacatgcccagcg

SEQ ID NO: 463697 - DNA, 25 bp, Rattus norvegicus
ccagcgctcggtttttactcctagc

SEQ ID NO: 463698 - DNA, 25 bp, Rattus norvegicus
actcctagcgttcactgtggaactt

SEQ ID NO: 463699 - DNA, 25 bp, Rattus norvegicus
attctctctaaaccgtgccttctga

SEQ ID NO: 463700 - DNA, 25 bp, Rattus norvegicus
cttcctggcgtacccaatgactcgg

SEQ ID NO: 463701 - DNA, 25 bp, Rattus norvegicus
cgccttgcagtgaagaggagactcc

SEQ ID NO: 463702 - DNA, 25 bp, Rattus norvegicus
tatgggcctgggacagcaactaatg

SEQ ID NO: 463703 - DNA, 25 bp, Rattus norvegicus
cttctgattcaacgagctgctctcc

SEQ ID NO: 463704 - DNA, 25 bp, Rattus norvegicus
tgggtcacctcttccgctaccgtaa

SEQ ID NO: 463705 - DNA, 25 bp, Rattus norvegicus
ttctccagtgtttgggtttcctcgc

SEQ ID NO: 463706 - DNA, 25 bp, Rattus norvegicus
agcgactacgcttccgtttctggta

SEQ ID NO: 463707 - DNA, 25 bp, Rattus norvegicus
tcgggaaactccagcgagtactctg

SEQ ID NO: 463708 - DNA, 25 bp, Rattus norvegicus
ccctcggaatgactcctgcttcagg

SEQ ID NO: 463709 - DNA, 25 bp, Rattus norvegicus
gactttcttcttcacccgcggcttg

SEQ ID NO: 463710 - DNA, 25 bp, Rattus norvegicus
ctccttgctgtgagctaccttctcg

SEQ ID NO: 463711 - DNA, 25 bp, Rattus norvegicus
gctgcgggtcaacttcttacttcta

SEQ ID NO: 463712 - DNA, 25 bp, Rattus norvegicus
cggtcactttcttgctgcgggtcaa

SEQ ID NO: 463713 - DNA, 25 bp, Rattus norvegicus
gccggccgagatgaaccgattcttc

SEQ ID NO: 463714 - DNA, 25 bp, Rattus norvegicus
gtaatctcctcggtctgggtcgcct

SEQ ID NO: 463715 - DNA, 25 bp, Rattus norvegicus
ggtggttccatttcctccgtctgga

SEQ ID NO: 463716 - DNA, 25 bp, Rattus norvegicus
gccatgttctcggtctgggtcacct

SEQ ID NO: 463717 - DNA, 25 bp, Rattus norvegicus
atcgtggtcacctcctctacttggg

SEQ ID NO: 463718 - DNA, 25 bp, Rattus norvegicus
aatccgggacacgtgaccaggtgac

SEQ ID NO: 463719 - DNA, 25 bp, Rattus norvegicus
gcgactctccatagtgggccctgga

SEQ ID NO: 463720 - DNA, 25 bp, Rattus norvegicus
gttcgggccattgctctggcaagtg

SEQ ID NO: 463721 - DNA, 25 bp, Rattus norvegicus
tacgcaagttcggtcactagatccc

SEQ ID NO: 463722 - DNA, 25 bp, Rattus norvegicus
gtcagctaggacattggaagggttc

SEQ ID NO: 463723 - DNA, 25 bp, Rattus norvegicus
gggtccaacagtctagtcagctagg

SEQ ID NO: 463724 - DNA, 25 bp, Rattus norvegicus
tccggtctcaggtactgtctggttc

SEQ ID NO: 463725 - DNA, 25 bp, Rattus norvegicus
tggccggcgcatttatctgacgtcc

SEQ ID NO: 463726 - DNA, 25 bp, Rattus norvegicus
ctgtgctaggggtgtgttcttaacc

SEQ ID NO: 463727 - DNA, 25 bp, Rattus norvegicus
atagtctctggacgccggaaatccg

SEQ ID NO: 463728 - DNA, 25 bp, Rattus norvegicus
cacgcgcgtaggaacgaatagtctc

SEQ ID NO: 463729 - DNA, 25 bp, Rattus norvegicus
catttcactgtatcttcgggcggca

SEQ ID NO: 463730 - DNA, 25 bp, Rattus norvegicus
tctgacgtcccaaatgcgccatttc

SEQ ID NO: 463731 - DNA, 25 bp, Rattus norvegicus
cgcgcgggacctctagggtccaaca

SEQ ID NO: 463732 - DNA, 25 bp, Rattus norvegicus
ttccttccgggacacgcctctggaa

SEQ ID NO: 463733 - DNA, 25 bp, Rattus norvegicus
aggcgtcacaaagcgcagccaccgt

SEQ ID NO: 463734 - DNA, 25 bp, Rattus norvegicus
gcgcaggcgtcacaaagcgcagcca

SEQ ID NO: 463735 - DNA, 25 bp, Rattus norvegicus
ctccgcttggctctttaagggtggg

SEQ ID NO: 463736 - DNA, 25 bp, Rattus norvegicus
ccacctccgcttggctctttaaggg

SEQ ID NO: 463737 - DNA, 25 bp, Rattus norvegicus
gatcctctgcgacccgcccttgatc

SEQ ID NO: 463738 - DNA, 25 bp, Rattus norvegicus
agggcccaaagcgatcctctgcgac

SEQ ID NO: 463739 - DNA, 25 bp, Rattus norvegicus
tcacttagggcccaaagcgatcctc

SEQ ID NO: 463740 - DNA, 25 bp, Rattus norvegicus
atagcgccgagagcctaaggaactg

SEQ ID NO: 463741 - DNA, 25 bp, Rattus norvegicus
tggaaccgcggcgtccagccgcaca

SEQ ID NO: 463742 - DNA, 25 bp, Rattus norvegicus
ctgaggttccttccgggacacgcct

SEQ ID NO: 463743 - DNA, 25 bp, Rattus norvegicus
ccgagagcctaaggaactgaggttc

SEQ ID NO: 463744 - DNA, 25 bp, Rattus norvegicus
caggagcagagtagagcagagcaca

SEQ ID NO: 463745 - DNA, 25 bp, Rattus norvegicus
gcacaaccgtcacttagggcccaaa

SEQ ID NO: 463746 - DNA, 25 bp, Rattus norvegicus
cttctctgctctgtcgctcccgcgg

SEQ ID NO: 463747 - DNA, 25 bp, Rattus norvegicus
agggcttccggatcaccctggtgga

SEQ ID NO: 463748 - DNA, 25 bp, Rattus norvegicus
aatccctgcaggaggaaccggtgga

SEQ ID NO: 463749 - DNA, 25 bp, Rattus norvegicus
agctgaaatccctgcaggaggaacc

SEQ ID NO: 463750 - DNA, 25 bp, Rattus norvegicus
tgcttgagctgaaatccctgcagga

SEQ ID NO: 463751 - DNA, 25 bp, Rattus norvegicus
agccctgatgcttgagctgaaatcc

SEQ ID NO: 463752 - DNA, 25 bp, Rattus norvegicus
agctcgcaaaaagccctgatgcttg

SEQ ID NO: 463753 - DNA, 25 bp, Rattus norvegicus
gaccagctcgcaaaaagccctgatg

SEQ ID NO: 463754 - DNA, 25 bp, Rattus norvegicus
cagcagcagatgaccagctcgcaaa

SEQ ID NO: 463755 - DNA, 25 bp, Rattus norvegicus
gccgcgatggcccagcagcagatga

SEQ ID NO: 463756 - DNA, 25 bp, Rattus norvegicus
cttcaccatcgcctgccctccgccg

SEQ ID NO: 463757 - DNA, 25 bp, Rattus norvegicus
agggcaagcgagcacggcgatcccg

SEQ ID NO: 463758 - DNA, 25 bp, Rattus norvegicus
tcaccctggtggatgagtccgacct

SEQ ID NO: 463759 - DNA, 25 bp, Rattus norvegicus
cccgcggagaacgagagggcaagcg

SEQ ID NO: 463760 - DNA, 25 bp, Rattus norvegicus
gcgcggcgccatgatgtcagacgcc

SEQ ID NO: 463761 - DNA, 25 bp, Rattus norvegicus
tcagagtgacgggaccggagttgaa

SEQ ID NO: 463762 - DNA, 25 bp, Rattus norvegicus
attctgggcgaagggtcagagtgac

SEQ ID NO: 463763 - DNA, 25 bp, Rattus norvegicus
acggcgaccgaatggggcggattct

SEQ ID NO: 463764 - DNA, 25 bp, Rattus norvegicus
gggcccggagagatgaaaggaactg

SEQ ID NO: 463765 - DNA, 25 bp, Rattus norvegicus
cagcttttcgggacggcagcggcat

SEQ ID NO: 463766 - DNA, 25 bp, Rattus norvegicus
cacctttcagcttttcgggacggca

SEQ ID NO: 463767 - DNA, 25 bp, Rattus norvegicus
ggcgccagcacctttcagcttttcg

SEQ ID NO: 463768 - DNA, 25 bp, Rattus norvegicus
agcccagcggagactgagcccggga

SEQ ID NO: 463769 - DNA, 25 bp, Rattus norvegicus
ggtgttcgctctccctaggggcagc

SEQ ID NO: 463770 - DNA, 25 bp, Rattus norvegicus
aagaggtggtgttcgctctccctag

SEQ ID NO: 463771 - DNA, 25 bp, Rattus norvegicus
ggccttcaacatggcggctgtggta

SEQ ID NO: 463772 - DNA, 25 bp, Rattus norvegicus
aggagggaagtaggccttcaacatg

SEQ ID NO: 463773 - DNA, 25 bp, Rattus norvegicus
tgtcagacgcctaaaggggcggagc

SEQ ID NO: 463774 - DNA, 25 bp, Rattus norvegicus
agtccgccaggccacatctctatgg

SEQ ID NO: 463775 - DNA, 25 bp, Rattus norvegicus
agtgcgtgaaccctcgaagaatccg

SEQ ID NO: 463776 - DNA, 25 bp, Rattus norvegicus
ccaagctctagttacccggcaaata

SEQ ID NO: 463777 - DNA, 25 bp, Rattus norvegicus
cggtctcgacacacgctactctgag

SEQ ID NO: 463778 - DNA, 25 bp, Rattus norvegicus
tactctgagacaagcgcaccctttc

SEQ ID NO: 463779 - DNA, 25 bp, Rattus norvegicus
ttgggctcaagccaaagccaccgtg

SEQ ID NO: 463780 - DNA, 25 bp, Rattus norvegicus
gctcctcctcagtcagtttctcgga

SEQ ID NO: 463781 - DNA, 25 bp, Rattus norvegicus
aattagtgccgtcaggagaaagccc

SEQ ID NO: 463782 - DNA, 25 bp, Rattus norvegicus
ccaatggtcattcacagggcctatc

SEQ ID NO: 463783 - DNA, 25 bp, Rattus norvegicus
ccaatggttccgcttggggaagatc

SEQ ID NO: 463784 - DNA, 25 bp, Rattus norvegicus
tcgcgacgttcccagtcagaaaacc

SEQ ID NO: 463785 - DNA, 25 bp, Rattus norvegicus
aatcccgtggctcgcctgaagtgca

SEQ ID NO: 463786 - DNA, 25 bp, Rattus norvegicus
tgctcttgatctgttgctgcgggaa

SEQ ID NO: 463787 - DNA, 25 bp, Rattus norvegicus
tctcggaggacggaagaattagtgc

SEQ ID NO: 463788 - DNA, 25 bp, Rattus norvegicus
gcagcaccttgttctggtccacaga

SEQ ID NO: 463789 - DNA, 25 bp, Rattus norvegicus
ccacgcggacttcggctagcgagaa

SEQ ID NO: 463790 - DNA, 25 bp, Rattus norvegicus
aggagatgttctgtgactggtaccc

SEQ ID NO: 463791 - DNA, 25 bp, Rattus norvegicus
gtgaagtccagcaccgcgccaatgc

SEQ ID NO: 463792 - DNA, 25 bp, Rattus norvegicus
cgccgaaacgcgacgagttatagtt

SEQ ID NO: 463793 - DNA, 25 bp, Rattus norvegicus
ccagcatctcgcaggcggtggaaca

SEQ ID NO: 463794 - DNA, 25 bp, Rattus norvegicus
tggggaacttgctctcgtcgaaatc

SEQ ID NO: 463795 - DNA, 25 bp, Rattus norvegicus
cccagcatactgacggtgagcaccg

SEQ ID NO: 463796 - DNA, 25 bp, Rattus norvegicus
tgcctgcaatctcatcgaacgctcg

SEQ ID NO: 463797 - DNA, 25 bp, Rattus norvegicus
ccggcgtgtacatgtcatcgatttc

SEQ ID NO: 463798 - DNA, 25 bp, Rattus norvegicus
agcgcccatatagagcccacgtgga

SEQ ID NO: 463799 - DNA, 25 bp, Rattus norvegicus
aggtagctgacttcacccgcgtcga

SEQ ID NO: 463800 - DNA, 25 bp, Rattus norvegicus
tcgcggtccactagacggaagaagc

SEQ ID NO: 463801 - DNA, 25 bp, Rattus norvegicus
caaagtcaccataggccggcgtgta

SEQ ID NO: 463802 - DNA, 25 bp, Rattus norvegicus
agcaagggctttcgtatcctcggta

SEQ ID NO: 463803 - DNA, 25 bp, Rattus norvegicus
acccgcagcggggtacaatctgtgg

SEQ ID NO: 463804 - DNA, 25 bp, Rattus norvegicus
ggtacaatctgtggcagagtccggt

SEQ ID NO: 463805 - DNA, 25 bp, Rattus norvegicus
gtccggttccgggacagcgagttca

SEQ ID NO: 463806 - DNA, 25 bp, Rattus norvegicus
agcgagttcagcatgttcaccacta

SEQ ID NO: 463807 - DNA, 25 bp, Rattus norvegicus
cgtccagagcaagggctttcgtatc

SEQ ID NO: 463808 - DNA, 25 bp, Rattus norvegicus
tcgtatcctcggtacggcagtcgtc

SEQ ID NO: 463809 - DNA, 25 bp, Rattus norvegicus
gcggatccctgcgaaccttacagtc

SEQ ID NO: 463810 - DNA, 25 bp, Rattus norvegicus
cgaaccttacagtcggctgctgcga

SEQ ID NO: 463811 - DNA, 25 bp, Rattus norvegicus
gctgctgcgagcacaaaggccgcag

SEQ ID NO: 463812 - DNA, 25 bp, Rattus norvegicus
caggcggcgttctgtgctaggctcc

SEQ ID NO: 463813 - DNA, 25 bp, Rattus norvegicus
tgcagtagtccatcccgcgcagaca

SEQ ID NO: 463814 - DNA, 25 bp, Rattus norvegicus
cgcagacagtagtggcgtccagagc

SEQ ID NO: 463815 - DNA, 25 bp, Rattus norvegicus
agagggtccacacacccgcagcggg

SEQ ID NO: 463816 - DNA, 25 bp, Rattus norvegicus
gtctcggatctgatcaggcgccttg

SEQ ID NO: 463817 - DNA, 25 bp, Rattus norvegicus
aaacgctggaatcgaccgtgtgagc

SEQ ID NO: 463818 - DNA, 25 bp, Rattus norvegicus
cgccagaattcaatttacgcgttga

SEQ ID NO: 463819 - DNA, 25 bp, Rattus norvegicus
acgcgttgattaagcgaaaggcata

SEQ ID NO: 463820 - DNA, 25 bp, Rattus norvegicus
ataattcgcctcttcccaaactcgg

SEQ ID NO: 463821 - DNA, 25 bp, Rattus norvegicus
ctgatcagccgagggccactagtcc

SEQ ID NO: 463822 - DNA, 25 bp, Rattus norvegicus
aggacagccctctgcctgaggagca

SEQ ID NO: 463823 - DNA, 25 bp, Rattus norvegicus
aggagcagcttcgaggaattttggc

SEQ ID NO: 463824 - DNA, 25 bp, Rattus norvegicus
ctgtttcagaaaaacgcacggtcgg

SEQ ID NO: 463825 - DNA, 25 bp, Rattus norvegicus
ctagtggcgccgttgctaggcaaca

SEQ ID NO: 463826 - DNA, 25 bp, Rattus norvegicus
aacaaccgctgttggctgggcgatc

SEQ ID NO: 463827 - DNA, 25 bp, Rattus norvegicus
gatcctctaaggtgttcgttctaac

SEQ ID NO: 463828 - DNA, 25 bp, Rattus norvegicus
tgttgatcctcaaaacgaagcgtga

SEQ ID NO: 463829 - DNA, 25 bp, Rattus norvegicus
tttggcttggagacagaaactggaa

SEQ ID NO: 463830 - DNA, 25 bp, Rattus norvegicus
cggggcaaggctcctgaaaagttgt

SEQ ID NO: 463831 - DNA, 25 bp, Rattus norvegicus
aagagggccttcagcttagagcgcg

SEQ ID NO: 463832 - DNA, 25 bp, Rattus norvegicus
cagacggaagaagctcctggagtcc

SEQ ID NO: 463833 - DNA, 25 bp, Rattus norvegicus
tggcccaagcagagacccggaaaac

SEQ ID NO: 463834 - DNA, 25 bp, Rattus norvegicus
gctggaatgctcacacaggggatta

SEQ ID NO: 463835 - DNA, 25 bp, Rattus norvegicus
agctcacagtgttgacagcgtcgtc

SEQ ID NO: 463836 - DNA, 25 bp, Rattus norvegicus
agcgtcgtctttctcgcccagtaga

SEQ ID NO: 463837 - DNA, 25 bp, Rattus norvegicus
gctacccggttgttatttgagtctc

SEQ ID NO: 463838 - DNA, 25 bp, Rattus norvegicus
tttgagtctctttgccctgtgaccc

SEQ ID NO: 463839 - DNA, 25 bp, Rattus norvegicus
gtctcttccaaggatgctgtcgctc

SEQ ID NO: 463840 - DNA, 25 bp, Rattus norvegicus
gctgagacagctctagcggctcctc

SEQ ID NO: 463841 - DNA, 25 bp, Rattus norvegicus
cgagcttgtctttgcgcctagactc

SEQ ID NO: 463842 - DNA, 25 bp, Rattus norvegicus
ggcggatcctccaggacttggtaga

SEQ ID NO: 463843 - DNA, 25 bp, Rattus norvegicus
ttagctcctcctggaagggtgtctc

SEQ ID NO: 463844 - DNA, 25 bp, Rattus norvegicus
ccctcccactggagccaaataattg

SEQ ID NO: 463845 - DNA, 25 bp, Rattus norvegicus
cccactggagccaaataattgcctc

SEQ ID NO: 463846 - DNA, 25 bp, Rattus norvegicus
taattgcctcctgctttgttgtgtg

SEQ ID NO: 463847 - DNA, 25 bp, Rattus norvegicus
tcctgctttgttgtgtggtgtctgg

SEQ ID NO: 463848 - DNA, 25 bp, Rattus norvegicus
acgtgctgtggcgagagcctccctg

SEQ ID NO: 463849 - DNA, 25 bp, Rattus norvegicus
gcgagagcctccctgcgtaattacc

SEQ ID NO: 463850 - DNA, 25 bp, Rattus norvegicus
gagagcctccctgcgtaattaccct

SEQ ID NO: 463851 - DNA, 25 bp, Rattus norvegicus
cgccgccactgagcctcctgcgtcc

SEQ ID NO: 463852 - DNA, 25 bp, Rattus norvegicus
cctgcgtccgctgggccttactcac

SEQ ID NO: 463853 - DNA, 25 bp, Rattus norvegicus
cccagacgcaggcaactccctcccg

SEQ ID NO: 463854 - DNA, 25 bp, Rattus norvegicus
caaggccggggtgttcggctgcagt

SEQ ID NO: 463855 - DNA, 25 bp, Rattus norvegicus
tgggccggcgaagagctgtcccctc

SEQ ID NO: 463856 - DNA, 25 bp, Rattus norvegicus
gagccaaataattgcctcctgcttt

SEQ ID NO: 463857 - DNA, 25 bp, Rattus norvegicus
gcctcctgctttgttgtgtggtgtc

SEQ ID NO: 463858 - DNA, 25 bp, Rattus norvegicus
gcggctccaccatggcgattcgcaa

SEQ ID NO: 463859 - DNA, 25 bp, Rattus norvegicus
cctgcttcccgcgaagggttacgtg

SEQ ID NO: 463860 - DNA, 25 bp, Rattus norvegicus
tatgttcgaggtgagccctccttcc

SEQ ID NO: 463861 - DNA, 25 bp, Rattus norvegicus
tgctcttcctgctggggcttatgtt

SEQ ID NO: 463862 - DNA, 25 bp, Rattus norvegicus
tcgtctcctgtctggcgatgctctt

SEQ ID NO: 463863 - DNA, 25 bp, Rattus norvegicus
gctgcagaatcacgcggacatcgtc

SEQ ID NO: 463864 - DNA, 25 bp, Rattus norvegicus
agccatgaattcgtgctgcagaatc

SEQ ID NO: 463865 - DNA, 25 bp, Rattus norvegicus
aacccgccggtgttgagccatgaat

SEQ ID NO: 463866 - DNA, 25 bp, Rattus norvegicus
catggcgattcgcaagaagagcaac

SEQ ID NO: 463867 - DNA, 25 bp, Rattus norvegicus
gcggtttctccctggtgcgcatgct

SEQ ID NO: 463868 - DNA, 25 bp, Rattus norvegicus
aacgactccaactccctaagcgaag

SEQ ID NO: 463869 - DNA, 25 bp, Rattus norvegicus
ggactattccctggaagctcgcgcc

SEQ ID NO: 463870 - DNA, 25 bp, Rattus norvegicus
agcacgcgatggcagggactattcc

SEQ ID NO: 463871 - DNA, 25 bp, Rattus norvegicus
gaagagcaacaagaacccgccggtg

SEQ ID NO: 463872 - DNA, 25 bp, Rattus norvegicus
agctgatgctgttctacaagggcgc

SEQ ID NO: 463873 - DNA, 25 bp, Rattus norvegicus
ctacaagggcgcgaggacccacaac

SEQ ID NO: 463874 - DNA, 25 bp, Rattus norvegicus
gaatgactgagaccggcgtagctcc

SEQ ID NO: 463875 - DNA, 25 bp, Rattus norvegicus
tgcctgtctgttgctgggtaaccgc

SEQ ID NO: 463876 - DNA, 25 bp, Rattus norvegicus
gccagaggatccctgcgcgtccaag

SEQ ID NO: 463877 - DNA, 25 bp, Rattus norvegicus
gcttagcagagccagaggatccctg

SEQ ID NO: 463878 - DNA, 25 bp, Rattus norvegicus
cacttgcgggagctccttgcgcgga

SEQ ID NO: 463879 - DNA, 25 bp, Rattus norvegicus
cgcccggatcctgcattattcatga

SEQ ID NO: 463880 - DNA, 25 bp, Rattus norvegicus
gacaccgcccggatcctgcattatt

SEQ ID NO: 463881 - DNA, 25 bp, Rattus norvegicus
tcagccactgcggtgactctgcaac

SEQ ID NO: 463882 - DNA, 25 bp, Rattus norvegicus
gttgcctagagctaccgcggcagta

SEQ ID NO: 463883 - DNA, 25 bp, Rattus norvegicus
agctccgtggggttgcctagagcta

SEQ ID NO: 463884 - DNA, 25 bp, Rattus norvegicus
agaggctcgcggaatgactgagacc

SEQ ID NO: 463885 - DNA, 25 bp, Rattus norvegicus
ttattcatgagaaggcggtgtctgg

SEQ ID NO: 463886 - DNA, 25 bp, Rattus norvegicus
gtccaagatctctgttcttcgaccc

SEQ ID NO: 463887 - DNA, 25 bp, Rattus norvegicus
gtgtctatctctcctccaagctgtg

SEQ ID NO: 463888 - DNA, 25 bp, Rattus norvegicus
atctctcctccaagctgtgtgtctc

SEQ ID NO: 463889 - DNA, 25 bp, Rattus norvegicus
ctgtgtgggtcactgtctcttcata

SEQ ID NO: 463890 - DNA, 25 bp, Rattus norvegicus
gggtcactgtctcttcatatccgtc

SEQ ID NO: 463891 - DNA, 25 bp, Rattus norvegicus
tcatatccgtccaagatctctgttc

SEQ ID NO: 463892 - DNA, 25 bp, Rattus norvegicus
cttacctgagttgagcccggtgcgc

SEQ ID NO: 463893 - DNA, 25 bp, Rattus norvegicus
cgccgactgaggctcgagagcctgc

SEQ ID NO: 463894 - DNA, 25 bp, Rattus norvegicus
ctcggcgggcagcaaaaacagcgaa

SEQ ID NO: 463895 - DNA, 25 bp, Rattus norvegicus
cgggcagcaaaaacagcgaagagtc

SEQ ID NO: 463896 - DNA, 25 bp, Rattus norvegicus
aacagcgaagagtcccgcctcgtga

SEQ ID NO: 463897 - DNA, 25 bp, Rattus norvegicus
agtcccgcctcgtgagtggccagcg

SEQ ID NO: 463898 - DNA, 25 bp, Rattus norvegicus
ttgtgtctctgcctttgtgtctatc

SEQ ID NO: 463899 - DNA, 25 bp, Rattus norvegicus
atgctcagcgccgactgaggctcga

SEQ ID NO: 463900 - DNA, 25 bp, Rattus norvegicus
gcggaacactcaccgcgccctcggg

SEQ ID NO: 463901 - DNA, 25 bp, Rattus norvegicus
ctcctcccgctctcctagggcggcc

SEQ ID NO: 463902 - DNA, 25 bp, Rattus norvegicus
cgggtcttacaaacgcgcgcgcaca

SEQ ID NO: 463903 - DNA, 25 bp, Rattus norvegicus
ggcgcgccctctggaccgctatgga

SEQ ID NO: 463904 - DNA, 25 bp, Rattus norvegicus
tcgcattcgccctttctccggcgcg

SEQ ID NO: 463905 - DNA, 25 bp, Rattus norvegicus
cacgctcgcccgcactggcacgcgt

SEQ ID NO: 463906 - DNA, 25 bp, Rattus norvegicus
gcaccggctcctctgctctccgcgg

SEQ ID NO: 463907 - DNA, 25 bp, Rattus norvegicus
aagcctcgcgcagaccgacgcggaa

SEQ ID NO: 463908 - DNA, 25 bp, Rattus norvegicus
gttcgagggtcaagcctcgcgcaga

SEQ ID NO: 463909 - DNA, 25 bp, Rattus norvegicus
atctgtccgcctgagcgttcgaggg

SEQ ID NO: 463910 - DNA, 25 bp, Rattus norvegicus
acgagggccgcggatctgtccgcct

SEQ ID NO: 463911 - DNA, 25 bp, Rattus norvegicus
actttacccgcacgcacgagggccg

SEQ ID NO: 463912 - DNA, 25 bp, Rattus norvegicus
gcaaagtttctcgtgaactttccta

SEQ ID NO: 463913 - DNA, 25 bp, Rattus norvegicus
cgcctccgctttggcacgttcccgc

SEQ ID NO: 463914 - DNA, 25 bp, Rattus norvegicus
cacgtcgaactcagggttgtggtga

SEQ ID NO: 463915 - DNA, 25 bp, Rattus norvegicus
gacgaacgacaccagggcacaggga

SEQ ID NO: 463916 - DNA, 25 bp, Rattus norvegicus
acacctggcgggaagagctggatat

SEQ ID NO: 463917 - DNA, 25 bp, Rattus norvegicus
gcagctcctggagcggaaccaccaa

SEQ ID NO: 463918 - DNA, 25 bp, Rattus norvegicus
atatgttttcttgggctgagactcc

SEQ ID NO: 463919 - DNA, 25 bp, Rattus norvegicus
ccatgaggagggacgcacgtcgaac

SEQ ID NO: 463920 - DNA, 25 bp, Rattus norvegicus
atacgactcagtgttggggaccatg

SEQ ID NO: 463921 - DNA, 25 bp, Rattus norvegicus
gtcacaagtccaggaatacgactca

SEQ ID NO: 463922 - DNA, 25 bp, Rattus norvegicus
tcgcaccagacgtcacaagtccagg

SEQ ID NO: 463923 - DNA, 25 bp, Rattus norvegicus
aggcgcattgttcgcaccagacgtc

SEQ ID NO: 463924 - DNA, 25 bp, Rattus norvegicus
gcagccacctgatgcaggcgcattg

SEQ ID NO: 463925 - DNA, 25 bp, Rattus norvegicus
gaggctaccgtcatcactgccgcag

SEQ ID NO: 463926 - DNA, 25 bp, Rattus norvegicus
gcacagggaggctaccgtcatcact

SEQ ID NO: 463927 - DNA, 25 bp, Rattus norvegicus
tggagcggaaccaccaaacgcgttc

SEQ ID NO: 463928 - DNA, 25 bp, Rattus norvegicus
cggaaccgaagctctgattcgcaca

SEQ ID NO: 463929 - DNA, 25 bp, Rattus norvegicus
agctctgattcgcacatctctagca

SEQ ID NO: 463930 - DNA, 25 bp, Rattus norvegicus
gcacatctctagcacacacacaagg

SEQ ID NO: 463931 - DNA, 25 bp, Rattus norvegicus
acacacaaggcacggccatagtgca

SEQ ID NO: 463932 - DNA, 25 bp, Rattus norvegicus
cggccatagtgcaacgtgtgtcaca

SEQ ID NO: 463933 - DNA, 25 bp, Rattus norvegicus
acacacgctctcaatcacactgggg

SEQ ID NO: 463934 - DNA, 25 bp, Rattus norvegicus
cgggctctggaaggcagttacgtaa

SEQ ID NO: 463935 - DNA, 25 bp, Rattus norvegicus
gcagttacgtaaacgccctcgcagc

SEQ ID NO: 463936 - DNA, 25 bp, Rattus norvegicus
ttcctcgcacagtgccagcgcccgg

SEQ ID NO: 463937 - DNA, 25 bp, Rattus norvegicus
cgggaagaacggaaccgaagctctg

SEQ ID NO: 463938 - DNA, 25 bp, Rattus norvegicus
ccgatcccgacacagcccggggccg

SEQ ID NO: 463939 - DNA, 25 bp, Rattus norvegicus
gcaacgtgtgtcacacaggcgcgca

SEQ ID NO: 463940 - DNA, 25 bp, Rattus norvegicus
gaacagctcggcctcgcggaggctc

SEQ ID NO: 463941 - DNA, 25 bp, Rattus norvegicus
ctcaatcacactggggttggcgggt

SEQ ID NO: 463942 - DNA, 25 bp, Rattus norvegicus
gttcgactcagaggagctgatgctg

SEQ ID NO: 463943 - DNA, 25 bp, Rattus norvegicus
cagcgcagtggtccgcggtacacac

SEQ ID NO: 463944 - DNA, 25 bp, Rattus norvegicus
agctgatgctgtcacctgggcggcc

SEQ ID NO: 463945 - DNA, 25 bp, Rattus norvegicus
ttgctgttcgactcagaggagctga

SEQ ID NO: 463946 - DNA, 25 bp, Rattus norvegicus
gaaacccgggttgctgttcgactca

SEQ ID NO: 463947 - DNA, 25 bp, Rattus norvegicus
agccaagatggcgtgcagaccgaga

SEQ ID NO: 463948 - DNA, 25 bp, Rattus norvegicus
gaagacgctcaaccctcaccgggta

SEQ ID NO: 463949 - DNA, 25 bp, Rattus norvegicus
taccaccgttgccagaagacgctca

SEQ ID NO: 463950 - DNA, 25 bp, Rattus norvegicus
tgggatttggctcttaccaccgttg

SEQ ID NO: 463951 - DNA, 25 bp, Rattus norvegicus
atcgtgggccgctgtcccaggcagc

SEQ ID NO: 463952 - DNA, 25 bp, Rattus norvegicus
actcgtgagcggttggcggactccc

SEQ ID NO: 463953 - DNA, 25 bp, Rattus norvegicus
ccggagagctgctcgggccactcgt

SEQ ID NO: 463954 - DNA, 25 bp, Rattus norvegicus
gcctcgagcgtcagcgcagtggtcc

SEQ ID NO: 463955 - DNA, 25 bp, Rattus norvegicus
ctgctcgggccactcgtgagcggtt

SEQ ID NO: 463956 - DNA, 25 bp, Rattus norvegicus
gatcaatagaccgaacctctcacct

SEQ ID NO: 463957 - DNA, 25 bp, Rattus norvegicus
ccggacataagtggtagtagcatca

SEQ ID NO: 463958 - DNA, 25 bp, Rattus norvegicus
tagcatcagaccctacggcaggacg

SEQ ID NO: 463959 - DNA, 25 bp, Rattus norvegicus
acggcaggacgagtggcccgctcct

SEQ ID NO: 463960 - DNA, 25 bp, Rattus norvegicus
caccgtcgcgccttgtaggaagtga

SEQ ID NO: 463961 - DNA, 25 bp, Rattus norvegicus
tcccggaaacggatcaatagaccga

SEQ ID NO: 463962 - DNA, 25 bp, Rattus norvegicus
tctcaccttcctagagcctcgggtc

SEQ ID NO: 463963 - DNA, 25 bp, Rattus norvegicus
ctccactcgggactgtagccgctgt

SEQ ID NO: 463964 - DNA, 25 bp, Rattus norvegicus
tagccgctgtacatcggtcagagcc

SEQ ID NO: 463965 - DNA, 25 bp, Rattus norvegicus
ggtcagagccgccatcgtttctgca

SEQ ID NO: 463966 - DNA, 25 bp, Rattus norvegicus
tgggacgtccgcccaaataagaaga

SEQ ID NO: 463967 - DNA, 25 bp, Rattus norvegicus
taagaagactgaccaatccgagagc

SEQ ID NO: 463968 - DNA, 25 bp, Rattus norvegicus
tgaccaatccgagagcaccgtcgcg

SEQ ID NO: 463969 - DNA, 25 bp, Rattus norvegicus
tcctgtccagccctgtcccggaaac

SEQ ID NO: 463970 - DNA, 25 bp, Rattus norvegicus
tctcgcactcgtatgggtacaaata

SEQ ID NO: 463971 - DNA, 25 bp, Rattus norvegicus
tgagtgcccgcgtctcgcactcgta

SEQ ID NO: 463972 - DNA, 25 bp, Rattus norvegicus
gccatgactcgaggcgggaccagga

SEQ ID NO: 463973 - DNA, 25 bp, Rattus norvegicus
atacttcatgtacctaggggcggac

SEQ ID NO: 463974 - DNA, 25 bp, Rattus norvegicus
cccgaggtgtgggtcctgctaagtt

SEQ ID NO: 463975 - DNA, 25 bp, Rattus norvegicus
tgtgggtcctgctaagttgaagagc

SEQ ID NO: 463976 - DNA, 25 bp, Rattus norvegicus
cctgctaagttgaagagcgggaccg

SEQ ID NO: 463977 - DNA, 25 bp, Rattus norvegicus
tggtgtaggcctggcgacgtccctc

SEQ ID NO: 463978 - DNA, 25 bp, Rattus norvegicus
ctcacgccggttgctgtctatggca

SEQ ID NO: 463979 - DNA, 25 bp, Rattus norvegicus
ctgtctatggcagcctggagctccc

SEQ ID NO: 463980 - DNA, 25 bp, Rattus norvegicus
tggagctcccctggagaactgagtg

SEQ ID NO: 463981 - DNA, 25 bp, Rattus norvegicus
ttcatgtacctaggggcggacggat

SEQ ID NO: 463982 - DNA, 25 bp, Rattus norvegicus
ggacccagcggatcgtcccaccctc

SEQ ID NO: 463983 - DNA, 25 bp, Rattus norvegicus
ctcgtatgggtacaaatacttcatg

SEQ ID NO: 463984 - DNA, 25 bp, Rattus norvegicus
ggtcgcttagctgcctgcggtcccg

SEQ ID NO: 463985 - DNA, 25 bp, Rattus norvegicus
catgaggtggcgggtcacttagccc

SEQ ID NO: 463986 - DNA, 25 bp, Rattus norvegicus
ggtctgggcgccttgcatctacact

SEQ ID NO: 463987 - DNA, 25 bp, Rattus norvegicus
ctcactggcggtcgcttagctgcct

SEQ ID NO: 463988 - DNA, 25 bp, Rattus norvegicus
ttctgaccgcggtgcgctcactggc

SEQ ID NO: 463989 - DNA, 25 bp, Rattus norvegicus
tgcgctcttctgaccgcggtgcgct

SEQ ID NO: 463990 - DNA, 25 bp, Rattus norvegicus
tctgggcgccttgcatctacactca

SEQ ID NO: 463991 - DNA, 25 bp, Rattus norvegicus
gcagggtccccgctgtgcgctcttg

SEQ ID NO: 463992 - DNA, 25 bp, Rattus norvegicus
ggtctcagctgggttccctgcgcag

SEQ ID NO: 463993 - DNA, 25 bp, Rattus norvegicus
gctccggtctcagctgggttccctg

SEQ ID NO: 463994 - DNA, 25 bp, Rattus norvegicus
gtctccaccgcggtccgtctgccct

SEQ ID NO: 463995 - DNA, 25 bp, Rattus norvegicus
tcacctgcctggcaccgcccgaagc

SEQ ID NO: 463996 - DNA, 25 bp, Rattus norvegicus
ggcgccttgcatctacactcacctg

SEQ ID NO: 463997 - DNA, 25 bp, Rattus norvegicus
gctcttgccgccctgcgctcttctg

SEQ ID NO: 463998 - DNA, 25 bp, Rattus norvegicus
gcggaccctgaagcgctcagcgaat

SEQ ID NO: 463999 - DNA, 25 bp, Rattus norvegicus
cagacggagtccctaggagtcaagg

SEQ ID NO: 464000 - DNA, 25 bp, Rattus norvegicus
tcccgacgatcagacggagtcccta

SEQ ID NO: 464001 - DNA, 25 bp, Rattus norvegicus
gccgaagtctctcccgacgatcaga

SEQ ID NO: 464002 - DNA, 25 bp, Rattus norvegicus
ctcgcaaaatgggagccgaagtctc

SEQ ID NO: 464003 - DNA, 25 bp, Rattus norvegicus
ttgcctacgcggctgctcgcaaaat

SEQ ID NO: 464004 - DNA, 25 bp, Rattus norvegicus
catggctgggatcagcgtttgccta

SEQ ID NO: 464005 - DNA, 25 bp, Rattus norvegicus
tccaatcggtctggctttggctacg

SEQ ID NO: 464006 - DNA, 25 bp, Rattus norvegicus
caggtccacaatccggaatccaatc

SEQ ID NO: 464007 - DNA, 25 bp, Rattus norvegicus
acgacctacaaagtgagaaacagcc

SEQ ID NO: 464008 - DNA, 25 bp, Rattus norvegicus
tgtacgccaaaataatcaacgtttc

SEQ ID NO: 464009 - DNA, 25 bp, Rattus norvegicus
gctaattccgggaccgtgtacgcca

SEQ ID NO: 464010 - DNA, 25 bp, Rattus norvegicus
aataatcctggaaaggctaattccg

SEQ ID NO: 464011 - DNA, 25 bp, Rattus norvegicus
gcgctcagcgaataagaaaattatg

SEQ ID NO: 464012 - DNA, 25 bp, Rattus norvegicus
tggtccagccctgatgcaaaaagga

SEQ ID NO: 464013 - DNA, 25 bp, Rattus norvegicus
catttttctagaggggcgggcataa

SEQ ID NO: 464014 - DNA, 25 bp, Rattus norvegicus
gcaccgccctctggattgaaccatt

SEQ ID NO: 464015 - DNA, 25 bp, Rattus norvegicus
aatcggaacgtctgggtcacctagc

SEQ ID NO: 464016 - DNA, 25 bp, Rattus norvegicus
tgtggattcacagccgctgcctatg

SEQ ID NO: 464017 - DNA, 25 bp, Rattus norvegicus
gtaagaccgaactagggccacaggc

SEQ ID NO: 464018 - DNA, 25 bp, Rattus norvegicus
gcctggatcagcaccgccacaatag

SEQ ID NO: 464019 - DNA, 25 bp, Rattus norvegicus
acctgcgtactgtcgagcaagctga

SEQ ID NO: 464020 - DNA, 25 bp, Rattus norvegicus
gcgtaggtaagaccagcccgctgtc

SEQ ID NO: 464021 - DNA, 25 bp, Rattus norvegicus
cgcagctccacgatcagccgagaga

SEQ ID NO: 464022 - DNA, 25 bp, Rattus norvegicus
cagcgaggcgtgcaaaagacacatg

SEQ ID NO: 464023 - DNA, 25 bp, Rattus norvegicus
cggtgccgaagagcagcacgtactc

SEQ ID NO: 464024 - DNA, 25 bp, Rattus norvegicus
ttctctctggaagacgaagctctga

SEQ ID NO: 464025 - DNA, 25 bp, Rattus norvegicus
cgagagaaggccagctcatggtcca

SEQ ID NO: 464026 - DNA, 25 bp, Rattus norvegicus
ggaggctacacctggcccagcggca

SEQ ID NO: 464027 - DNA, 25 bp, Rattus norvegicus
gttcgcaactgggtcgcaagagtca

SEQ ID NO: 464028 - DNA, 25 bp, Rattus norvegicus
gtcgcaagagtcagcggttcccgga

SEQ ID NO: 464029 - DNA, 25 bp, Rattus norvegicus
ccatacccggggagttaggcgagca

SEQ ID NO: 464030 - DNA, 25 bp, Rattus norvegicus
acgcgaggcgcacgtgtccggaaac

SEQ ID NO: 464031 - DNA, 25 bp, Rattus norvegicus
tcacatggtttcaaggggcgctacg

SEQ ID NO: 464032 - DNA, 25 bp, Rattus norvegicus
agctgaaggtctgctccggagactg

SEQ ID NO: 464033 - DNA, 25 bp, Rattus norvegicus
gcggcaacacctaccagggctattg

SEQ ID NO: 464034 - DNA, 25 bp, Rattus norvegicus
cgagtactctggctcctggtcgcac

SEQ ID NO: 464035 - DNA, 25 bp, Rattus norvegicus
ggaagaccgcttgggttcgcaactg

SEQ ID NO: 464036 - DNA, 25 bp, Rattus norvegicus
cggagactgggctgtcctctctcgc

SEQ ID NO: 464037 - DNA, 25 bp, Rattus norvegicus
ttcgacttcgacgatggcggcacct

SEQ ID NO: 464038 - DNA, 25 bp, Rattus norvegicus
gcatggcatctgcacggggcccaag

SEQ ID NO: 464039 - DNA, 25 bp, Rattus norvegicus
gcccaagggccagggcgagtactct

SEQ ID NO: 464040 - DNA, 25 bp, Rattus norvegicus
caaccaggcagcagttattaacacg

SEQ ID NO: 464041 - DNA, 25 bp, Rattus norvegicus
tctctccgcaagtgcagagccgcgg

SEQ ID NO: 464042 - DNA, 25 bp, Rattus norvegicus
acggccacattggtaagcgcgcctc

SEQ ID NO: 464043 - DNA, 25 bp, Rattus norvegicus
gcacctgacggcgtgacggccacat

SEQ ID NO: 464044 - DNA, 25 bp, Rattus norvegicus
gggaggatctccattgaaataaaca

SEQ ID NO: 464045 - DNA, 25 bp, Rattus norvegicus
ctgtgtctctctccgcaagtgcaga

SEQ ID NO: 464046 - DNA, 25 bp, Rattus norvegicus
gagctcgcgcggtctgtgtctctct

SEQ ID NO: 464047 - DNA, 25 bp, Rattus norvegicus
tgacagcgctctctcggaggcggcc

SEQ ID NO: 464048 - DNA, 25 bp, Rattus norvegicus
cctgagcggtgacagcgctctctcg

SEQ ID NO: 464049 - DNA, 25 bp, Rattus norvegicus
cagttattaacacgggaacatggcg

SEQ ID NO: 464050 - DNA, 25 bp, Rattus norvegicus
agtcacggccggtgctttcttcccg

SEQ ID NO: 464051 - DNA, 25 bp, Rattus norvegicus
ccggccgagaggtgagcaccaggcc

SEQ ID NO: 464052 - DNA, 25 bp, Rattus norvegicus
cccgcgacgcccatcctcgaggcgc

SEQ ID NO: 464053 - DNA, 25 bp, Rattus norvegicus
ttgaaataaacaaccaggcagcagt

SEQ ID NO: 464054 - DNA, 25 bp, Rattus norvegicus
ggacgccatggcagcgaccttccgg

SEQ ID NO: 464055 - DNA, 25 bp, Rattus norvegicus
tactgggcggcctggacccgctgca

SEQ ID NO: 464056 - DNA, 25 bp, Rattus norvegicus
ggctagccaatcatccagggtgggc

SEQ ID NO: 464057 - DNA, 25 bp, Rattus norvegicus
ccttccgggcgagcggtaattactg

SEQ ID NO: 464058 - DNA, 25 bp, Rattus norvegicus
agcaggcttcagaggcggacgccat

SEQ ID NO: 464059 - DNA, 25 bp, Rattus norvegicus
agccgatcctgagcagcgccagcag

SEQ ID NO: 464060 - DNA, 25 bp, Rattus norvegicus
tgtcgcaaagcggagccgatcctga

SEQ ID NO: 464061 - DNA, 25 bp, Rattus norvegicus
gtgtgacctcatgtcgcaaagcgga

SEQ ID NO: 464062 - DNA, 25 bp, Rattus norvegicus
ctttaggttaattcgtgtgacctca

SEQ ID NO: 464063 - DNA, 25 bp, Rattus norvegicus
tgcactttcttgacggactttaggt

SEQ ID NO: 464064 - DNA, 25 bp, Rattus norvegicus
ccgtgcactttcttgacggacttta

SEQ ID NO: 464065 - DNA, 25 bp, Rattus norvegicus
aactatggagtggtgagtttatccc

SEQ ID NO: 464066 - DNA, 25 bp, Rattus norvegicus
cagtgcggagccgagccttcccgtt

SEQ ID NO: 464067 - DNA, 25 bp, Rattus norvegicus
tcgtcacgtgttggcggctagccaa

SEQ ID NO: 464068 - DNA, 25 bp, Rattus norvegicus
ggccgctcgacaaacagctcattag

SEQ ID NO: 464069 - DNA, 25 bp, Rattus norvegicus
atctttaatgcaccggctgtctgtg

SEQ ID NO: 464070 - DNA, 25 bp, Rattus norvegicus
ggagcaggcctcaggccgctcgaca

SEQ ID NO: 464071 - DNA, 25 bp, Rattus norvegicus
agaggctccagcttctgctcccggg

SEQ ID NO: 464072 - DNA, 25 bp, Rattus norvegicus
gtagggcgacccgacaatgacatga

SEQ ID NO: 464073 - DNA, 25 bp, Rattus norvegicus
cccgacaatgacatgaggcggggca

SEQ ID NO: 464074 - DNA, 25 bp, Rattus norvegicus
gcgccacattcgcagccaaggaaaa

SEQ ID NO: 464075 - DNA, 25 bp, Rattus norvegicus
gccaaggaaaaaagtagaagcagcc

SEQ ID NO: 464076 - DNA, 25 bp, Rattus norvegicus
caaagacaaggcagagccggaccgg

SEQ ID NO: 464077 - DNA, 25 bp, Rattus norvegicus
cctctggaacctagccctcaagaaa

SEQ ID NO: 464078 - DNA, 25 bp, Rattus norvegicus
ctcgtatctcctcaatcgcgacatg

SEQ ID NO: 464079 - DNA, 25 bp, Rattus norvegicus
cgcgacatgtctcgagctccgaacg

SEQ ID NO: 464080 - DNA, 25 bp, Rattus norvegicus
cccagtagatcctgcaaagacaagg

SEQ ID NO: 464081 - DNA, 25 bp, Rattus norvegicus
tgcgacagaggagaccgcgacctga

SEQ ID NO: 464082 - DNA, 25 bp, Rattus norvegicus
agtcggctggctgagttcttcccac

SEQ ID NO: 464083 - DNA, 25 bp, Rattus norvegicus
gacagagtcggctggctgagttctt

SEQ ID NO: 464084 - DNA, 25 bp, Rattus norvegicus
tgggacctcccgctactccgccgcc

SEQ ID NO: 464085 - DNA, 25 bp, Rattus norvegicus
gtcggctggctgagttcttcccacc

SEQ ID NO: 464086 - DNA, 25 bp, Rattus norvegicus
ccgggcaggtgctgatcgcagcatc

SEQ ID NO: 464087 - DNA, 25 bp, Rattus norvegicus
gcaggtgctgatcgcagcatccaca

SEQ ID NO: 464088 - DNA, 25 bp, Rattus norvegicus
aggtgctgatcgcagcatccacaca

SEQ ID NO: 464089 - DNA, 25 bp, Rattus norvegicus
cccgctctgccttgggtgtatgcgg

SEQ ID NO: 464090 - DNA, 25 bp, Rattus norvegicus
ccctgcagcgccaaccgggtccagc

SEQ ID NO: 464091 - DNA, 25 bp, Rattus norvegicus
agcgccaaccgggtccagctcccgg

SEQ ID NO: 464092 - DNA, 25 bp, Rattus norvegicus
ggcgcgctgaccttgccgcgggcgg

SEQ ID NO: 464093 - DNA, 25 bp, Rattus norvegicus
ccgcgccgcattgccggctgctcgt

SEQ ID NO: 464094 - DNA, 25 bp, Rattus norvegicus
ccctggcactgggacctcccgctac

SEQ ID NO: 464095 - DNA, 25 bp, Rattus norvegicus
tgctgatcgcagcatccacacagac

SEQ ID NO: 464096 - DNA, 25 bp, Rattus norvegicus
gctatctcccggacgctcgttgaga

SEQ ID NO: 464097 - DNA, 25 bp, Rattus norvegicus
cagcggctgatagaaggaccgcggc

SEQ ID NO: 464098 - DNA, 25 bp, Rattus norvegicus
tagaccgtgcaatggaaagcgagga

SEQ ID NO: 464099 - DNA, 25 bp, Rattus norvegicus
acgggtagaccgtgcaatggaaagc

SEQ ID NO: 464100 - DNA, 25 bp, Rattus norvegicus
ctgagtgacgggtagaccgtgcaat

SEQ ID NO: 464101 - DNA, 25 bp, Rattus norvegicus
acagcagagttcgagctgagtgacg

SEQ ID NO: 464102 - DNA, 25 bp, Rattus norvegicus
tatccaatcacagcagagttcgagc

SEQ ID NO: 464103 - DNA, 25 bp, Rattus norvegicus
tcgttgagagatatccaatcacagc

SEQ ID NO: 464104 - DNA, 25 bp, Rattus norvegicus
agctcctcaccggtgagggcgctga

SEQ ID NO: 464105 - DNA, 25 bp, Rattus norvegicus
tcccggacgctcgttgagagatatc

SEQ ID NO: 464106 - DNA, 25 bp, Rattus norvegicus
agaggtggctatctcccggacgctc

SEQ ID NO: 464107 - DNA, 25 bp, Rattus norvegicus
cctcaccggtgagggcgctgaacga

SEQ ID NO: 464108 - DNA, 25 bp, Rattus norvegicus
gacgctcgttgagagatatccaatc

SEQ ID NO: 464109 - DNA, 25 bp, Rattus norvegicus
caggcgactcctgtcccgagtggag

SEQ ID NO: 464110 - DNA, 25 bp, Rattus norvegicus
ccgcgagaggcgactaatcaaacga

SEQ ID NO: 464111 - DNA, 25 bp, Rattus norvegicus
cgtcctagcgccaaagggctccatg

SEQ ID NO: 464112 - DNA, 25 bp, Rattus norvegicus
ggcctgcatgacacagcaccatctt

SEQ ID NO: 464113 - DNA, 25 bp, Rattus norvegicus
gcctagactttcagacgcggcccga

SEQ ID NO: 464114 - DNA, 25 bp, Rattus norvegicus
cgggcacgcgcatacacttactcgg

SEQ ID NO: 464115 - DNA, 25 bp, Rattus norvegicus
acttactcggctccagaggccatgg

SEQ ID NO: 464116 - DNA, 25 bp, Rattus norvegicus
gccacgtcaattggccgtagcacta

SEQ ID NO: 464117 - DNA, 25 bp, Rattus norvegicus
agacgctagctcctaatccgcgaga

SEQ ID NO: 464118 - DNA, 25 bp, Rattus norvegicus
gagtgtggaccctaaggcctaacta

SEQ ID NO: 464119 - DNA, 25 bp, Rattus norvegicus
gacggctgcaaacgcttcacggaga

SEQ ID NO: 464120 - DNA, 25 bp, Rattus norvegicus
tcatcggaaggaaagctgctctaac

SEQ ID NO: 464121 - DNA, 25 bp, Rattus norvegicus
tcagcgactgccttaggactcgtgc

SEQ ID NO: 464122 - DNA, 25 bp, Rattus norvegicus
cagaaaattcgtttgtggcctagcc

SEQ ID NO: 464123 - DNA, 25 bp, Rattus norvegicus
ccgggcttgactcactcaggtggag

SEQ ID NO: 464124 - DNA, 25 bp, Rattus norvegicus
gaggccaaccagataccagggacga

SEQ ID NO: 464125 - DNA, 25 bp, Rattus norvegicus
ccgaggtagatcaccgttacgaagg

SEQ ID NO: 464126 - DNA, 25 bp, Rattus norvegicus
ggtgccttcaccctaatcgcaagaa

SEQ ID NO: 464127 - DNA, 25 bp, Rattus norvegicus
gaaactacttctgcactacgccgga

SEQ ID NO: 464128 - DNA, 25 bp, Rattus norvegicus
gccaggttgtctctccttagcctga

SEQ ID NO: 464129 - DNA, 25 bp, Rattus norvegicus
actgcaacactctcggccgcggttg

SEQ ID NO: 464130 - DNA, 25 bp, Rattus norvegicus
ccgcggttggttgtcttcaagagac

SEQ ID NO: 464131 - DNA, 25 bp, Rattus norvegicus
tagaactaacggcagtccaggtttc

SEQ ID NO: 464132 - DNA, 25 bp, Rattus norvegicus
agccagataccagggacgaaccgga

SEQ ID NO: 464133 - DNA, 25 bp, Rattus norvegicus
aggccagagtattgaggctacttta

SEQ ID NO: 464134 - DNA, 25 bp, Rattus norvegicus
gctactttaggaggagtgggtcttc

SEQ ID NO: 464135 - DNA, 25 bp, Rattus norvegicus
tgggtcttcgcaccagtctctggct

SEQ ID NO: 464136 - DNA, 25 bp, Rattus norvegicus
gctgcgctccgccttagaactaacg

SEQ ID NO: 464137 - DNA, 25 bp, Rattus norvegicus
ttcaagagactgttccgcgggaaac

SEQ ID NO: 464138 - DNA, 25 bp, Rattus norvegicus
agaaggttgcttcgttctcaccctc

SEQ ID NO: 464139 - DNA, 25 bp, Rattus norvegicus
tctccggaaggcatctccctaaatc

SEQ ID NO: 464140 - DNA, 25 bp, Rattus norvegicus
agagcggcctctcctgaagcctaaa

SEQ ID NO: 464141 - DNA, 25 bp, Rattus norvegicus
gaatgcggccagaagcctgcacgga

SEQ ID NO: 464142 - DNA, 25 bp, Rattus norvegicus
gagcccttcctttggctgttccact

SEQ ID NO: 464143 - DNA, 25 bp, Rattus norvegicus
cccgagtctctgaagaaggttgctt

SEQ ID NO: 464144 - DNA, 25 bp, Rattus norvegicus
ctaggtgatctctgtcccgagtctc

SEQ ID NO: 464145 - DNA, 25 bp, Rattus norvegicus
ccactagttggcgaacgtcaaatcg

SEQ ID NO: 464146 - DNA, 25 bp, Rattus norvegicus
ttcccagccgaagacctaggtgatc

SEQ ID NO: 464147 - DNA, 25 bp, Rattus norvegicus
acgtggggaccatgacctgtgaccc

SEQ ID NO: 464148 - DNA, 25 bp, Rattus norvegicus
ccggagaatgattcacgtggggacc

SEQ ID NO: 464149 - DNA, 25 bp, Rattus norvegicus
ccaccgtcaaggatcccggagaatg

SEQ ID NO: 464150 - DNA, 25 bp, Rattus norvegicus
tgcacggagccctgaagaaagacga

SEQ ID NO: 464151 - DNA, 25 bp, Rattus norvegicus
cagcgacctccggaaccaacgagag

SEQ ID NO: 464152 - DNA, 25 bp, Rattus norvegicus
actcctctgagagcggaccagcgcg

SEQ ID NO: 464153 - DNA, 25 bp, Rattus norvegicus
ccgtcctaaaggatccgaggggctg

SEQ ID NO: 464154 - DNA, 25 bp, Rattus norvegicus
gagagggccgtcctaaaggatccga

SEQ ID NO: 464155 - DNA, 25 bp, Rattus norvegicus
gcttcttacggagagggccgtccta

SEQ ID NO: 464156 - DNA, 25 bp, Rattus norvegicus
agcctgcgctggcttcttacggaga

SEQ ID NO: 464157 - DNA, 25 bp, Rattus norvegicus
ttggaacacactgcagcctgcgctg

SEQ ID NO: 464158 - DNA, 25 bp, Rattus norvegicus
ggggaaaagcgcttggaacacactg

SEQ ID NO: 464159 - DNA, 25 bp, Rattus norvegicus
ccacgggcgcgcactatggagatct

SEQ ID NO: 464160 - DNA, 25 bp, Rattus norvegicus
ccatgagcgccggtctgtagcgcgc

SEQ ID NO: 464161 - DNA, 25 bp, Rattus norvegicus
tcactgcctccaccgtcgcggatct

SEQ ID NO: 464162 - DNA, 25 bp, Rattus norvegicus
ccagcaagggttaaaggcggccgca

SEQ ID NO: 464163 - DNA, 25 bp, Rattus norvegicus
agccgagccagcaagggttaaaggc

SEQ ID NO: 464164 - DNA, 25 bp, Rattus norvegicus
tgggcttcgccttcagccgagccag

SEQ ID NO: 464165 - DNA, 25 bp, Rattus norvegicus
aagcccgagcgcagccgccaggtag

SEQ ID NO: 464166 - DNA, 25 bp, Rattus norvegicus
tcgtgtgcaacactagcgggctctg

SEQ ID NO: 464167 - DNA, 25 bp, Rattus norvegicus
catttcctaccagctgatggggccg

SEQ ID NO: 464168 - DNA, 25 bp, Rattus norvegicus
acaggccatttcctaccagctgatg

SEQ ID NO: 464169 - DNA, 25 bp, Rattus norvegicus
tgactcacaggccatttcctaccag

SEQ ID NO: 464170 - DNA, 25 bp, Rattus norvegicus
ctagcgggctctggcgtacgcagcc

SEQ ID NO: 464171 - DNA, 25 bp, Rattus norvegicus
aacactagcgggctctggcgtacgc

SEQ ID NO: 464172 - DNA, 25 bp, Rattus norvegicus
gctcttctctgatcagcttcgtgtg

SEQ ID NO: 464173 - DNA, 25 bp, Rattus norvegicus
gctctgcttggctcttctctgatca

SEQ ID NO: 464174 - DNA, 25 bp, Rattus norvegicus
cttgctctgcttggctcttctctga

SEQ ID NO: 464175 - DNA, 25 bp, Rattus norvegicus
aggctgagagccttgctctgcttgg

SEQ ID NO: 464176 - DNA, 25 bp, Rattus norvegicus
acaaagggtggcttaggctgagagc

SEQ ID NO: 464177 - DNA, 25 bp, Rattus norvegicus
ctgatcagcttcgtgtgcaacacta

SEQ ID NO: 464178 - DNA, 25 bp, Rattus norvegicus
cagcactgcgaccacggctgccacg

SEQ ID NO: 464179 - DNA, 25 bp, Rattus norvegicus
gcttggctcttctctgatcagcttc

SEQ ID NO: 464180 - DNA, 25 bp, Rattus norvegicus
tgcggcttctgtgatgacaggtcca

SEQ ID NO: 464181 - DNA, 25 bp, Rattus norvegicus
tttggctgaccagcgagctacaacc

SEQ ID NO: 464182 - DNA, 25 bp, Rattus norvegicus
ggctttggctgaccagcgagctaca

SEQ ID NO: 464183 - DNA, 25 bp, Rattus norvegicus
ctttgcggggctttggctgaccagc

SEQ ID NO: 464184 - DNA, 25 bp, Rattus norvegicus
tctgtgatgacaggtccagaagggc

SEQ ID NO: 464185 - DNA, 25 bp, Rattus norvegicus
acaaagtgatggctgcaggtcgtct

SEQ ID NO: 464186 - DNA, 25 bp, Rattus norvegicus
cggcttctgtgatgacaggtccaga

SEQ ID NO: 464187 - DNA, 25 bp, Rattus norvegicus
cgtgcggcttctgtgatgacaggtc

SEQ ID NO: 464188 - DNA, 25 bp, Rattus norvegicus
ccacgtgcggcttctgtgatgacag

SEQ ID NO: 464189 - DNA, 25 bp, Rattus norvegicus
aaagtgatggctgcaggtcgtctga

SEQ ID NO: 464190 - DNA, 25 bp, Rattus norvegicus
cagatgacggaggagacaaagtgat

SEQ ID NO: 464191 - DNA, 25 bp, Rattus norvegicus
tcggctggctgtgattggcgccggc

SEQ ID NO: 464192 - DNA, 25 bp, Rattus norvegicus
cccaacagatgacggaggagacaaa

SEQ ID NO: 464193 - DNA, 25 bp, Rattus norvegicus
gtcctggctcaccagggcgcacacg

SEQ ID NO: 464194 - DNA, 25 bp, Rattus norvegicus
tagccctggggattggttccgccca

SEQ ID NO: 464195 - DNA, 25 bp, Rattus norvegicus
tctctcacggatcccagtccgagtg

SEQ ID NO: 464196 - DNA, 25 bp, Rattus norvegicus
gagttctggtcgctcaggcttcgct

SEQ ID NO: 464197 - DNA, 25 bp, Rattus norvegicus
tcaggcttcgctgctatggcgcctc

SEQ ID NO: 464198 - DNA, 25 bp, Rattus norvegicus
ttcactctgaccctgagaacccggg

SEQ ID NO: 464199 - DNA, 25 bp, Rattus norvegicus
tctgaccctgagaacccgggcggct

SEQ ID NO: 464200 - DNA, 25 bp, Rattus norvegicus
gcgcggcacctgctgagagaaaaga

SEQ ID NO: 464201 - DNA, 25 bp, Rattus norvegicus
cacctgctgagagaaaagagggagc

SEQ ID NO: 464202 - DNA, 25 bp, Rattus norvegicus
tcagccatgtcgctgctctgcgtgc

SEQ ID NO: 464203 - DNA, 25 bp, Rattus norvegicus
tcccacgcctgtcgggacacttgtg

SEQ ID NO: 464204 - DNA, 25 bp, Rattus norvegicus
acacttgtggtagtgtcccggcggc

SEQ ID NO: 464205 - DNA, 25 bp, Rattus norvegicus
ggtagaatatgttcatagtcacttc

SEQ ID NO: 464206 - DNA, 25 bp, Rattus norvegicus
gttcatagtcacttctgcacgttcg

SEQ ID NO: 464207 - DNA, 25 bp, Rattus norvegicus
ttctgcacgttcgacgagtttaccc

SEQ ID NO: 464208 - DNA, 25 bp, Rattus norvegicus
cttggtcacccgcacctgggtttgt

SEQ ID NO: 464209 - DNA, 25 bp, Rattus norvegicus
atagtgcttttctgggatgccgcga

SEQ ID NO: 464210 - DNA, 25 bp, Rattus norvegicus
taggtgcgcgaagatagtgcttttc

SEQ ID NO: 464211 - DNA, 25 bp, Rattus norvegicus
agacctgcataggtgcgcgaagata

SEQ ID NO: 464212 - DNA, 25 bp, Rattus norvegicus
ctgtgacccggggagacctgcatag

SEQ ID NO: 464213 - DNA, 25 bp, Rattus norvegicus
acagaatctgtgacccggggagacc

SEQ ID NO: 464214 - DNA, 25 bp, Rattus norvegicus
ggtttgtggaatagtgtcactcaca

SEQ ID NO: 464215 - DNA, 25 bp, Rattus norvegicus
gagtcatggagacgccgcgagcctt

SEQ ID NO: 464216 - DNA, 25 bp, Rattus norvegicus
accagttagggctgagttgcacgcg

SEQ ID NO: 464217 - DNA, 25 bp, Rattus norvegicus
ttccgaccagttagggctgagttgc

SEQ ID NO: 464218 - DNA, 25 bp, Rattus norvegicus
gtttcttccgaccagttagggctga

SEQ ID NO: 464219 - DNA, 25 bp, Rattus norvegicus
agccttcccttctggcgcgtccctt

SEQ ID NO: 464220 - DNA, 25 bp, Rattus norvegicus
aatagtgtcactcacagaatctgtg

SEQ ID NO: 464221 - DNA, 25 bp, Rattus norvegicus
tcacccgcacctgggtttgtggaat

SEQ ID NO: 464222 - DNA, 25 bp, Rattus norvegicus
gctccgggacccacgtgggtacaca

SEQ ID NO: 464223 - DNA, 25 bp, Rattus norvegicus
gcagttggttgctctgacctgaccc

SEQ ID NO: 464224 - DNA, 25 bp, Rattus norvegicus
gacgcagttggttgctctgacctga

SEQ ID NO: 464225 - DNA, 25 bp, Rattus norvegicus
agctccaggacgcagttggttgctc

SEQ ID NO: 464226 - DNA, 25 bp, Rattus norvegicus
cagatgacttcacggagctccagga

SEQ ID NO: 464227 - DNA, 25 bp, Rattus norvegicus
tgcccgagagcagatgacttcacgg

SEQ ID NO: 464228 - DNA, 25 bp, Rattus norvegicus
acagcggagaatctgcccgagagca

SEQ ID NO: 464229 - DNA, 25 bp, Rattus norvegicus
atacgcacagcggagaatctgcccg

SEQ ID NO: 464230 - DNA, 25 bp, Rattus norvegicus
ggggtagagtaagaatacgcacagc

SEQ ID NO: 464231 - DNA, 25 bp, Rattus norvegicus
ctggtgaaaggccagccgggactgc

SEQ ID NO: 464232 - DNA, 25 bp, Rattus norvegicus
tgatatcgcggtcggtgccctgcgc

SEQ ID NO: 464233 - DNA, 25 bp, Rattus norvegicus
agcgtctgatatcgcggtcggtgcc

SEQ ID NO: 464234 - DNA, 25 bp, Rattus norvegicus
gggtacacagatagcgtctgatatc

SEQ ID NO: 464235 - DNA, 25 bp, Rattus norvegicus
cccacgtgggtacacagatagcgtc

SEQ ID NO: 464236 - DNA, 25 bp, Rattus norvegicus
ggctaccgtgagtgatccagaaccg

SEQ ID NO: 464237 - DNA, 25 bp, Rattus norvegicus
ctaggagaactgacggatgacaccc

SEQ ID NO: 464238 - DNA, 25 bp, Rattus norvegicus
cttcttggcgggctaacagtgactt

SEQ ID NO: 464239 - DNA, 25 bp, Rattus norvegicus
tacgtagcctaggaaacaggccttc

SEQ ID NO: 464240 - DNA, 25 bp, Rattus norvegicus
caggccttcagagcgagcttccttg

SEQ ID NO: 464241 - DNA, 25 bp, Rattus norvegicus
agcttccttgttttgttggcgcggc

SEQ ID NO: 464242 - DNA, 25 bp, Rattus norvegicus
ttggcgcggccattttatggctcta

SEQ ID NO: 464243 - DNA, 25 bp, Rattus norvegicus
cgcactgcctgcgtcactaggagaa

SEQ ID NO: 464244 - DNA, 25 bp, Rattus norvegicus
taggtctaaaagcaacgagccattg

SEQ ID NO: 464245 - DNA, 25 bp, Rattus norvegicus
ccagaaccggagtagttgtggtctc

SEQ ID NO: 464246 - DNA, 25 bp, Rattus norvegicus
gctgctgcttgtgtctgctctgttt

SEQ ID NO: 464247 - DNA, 25 bp, Rattus norvegicus
gggacctccgtgcactattctggtg

SEQ ID NO: 464248 - DNA, 25 bp, Rattus norvegicus
agaggctgaccgatggctttaatcc

SEQ ID NO: 464249 - DNA, 25 bp, Rattus norvegicus
tggctctacgagacgcattatttta

SEQ ID NO: 464250 - DNA, 25 bp, Rattus norvegicus
cgtcgcgccgcagattcaaattcca

SEQ ID NO: 464251 - DNA, 25 bp, Rattus norvegicus
tgccaggcgctaaggtgacacaacg

SEQ ID NO: 464252 - DNA, 25 bp, Rattus norvegicus
agtcccaggtgtggcatcggtgcca

SEQ ID NO: 464253 - DNA, 25 bp, Rattus norvegicus
attcaaattccaaccgctcggtggg

SEQ ID NO: 464254 - DNA, 25 bp, Rattus norvegicus
gacccaggattttaggcttcccaga

SEQ ID NO: 464255 - DNA, 25 bp, Rattus norvegicus
gagactctccatgcttgacccagga

SEQ ID NO: 464256 - DNA, 25 bp, Rattus norvegicus
tcggaggaaccgagactctccatgc

SEQ ID NO: 464257 - DNA, 25 bp, Rattus norvegicus
cgcaccgggcagcactcggaggaac

SEQ ID NO: 464258 - DNA, 25 bp, Rattus norvegicus
gttcccaacgagcacgctgctgtcg

SEQ ID NO: 464259 - DNA, 25 bp, Rattus norvegicus
gcagacacgtttccgttcccaacga

SEQ ID NO: 464260 - DNA, 25 bp, Rattus norvegicus
gctcccgagctgtgcagacacgttt

SEQ ID NO: 464261 - DNA, 25 bp, Rattus norvegicus
ccagttgttcctggtagcgccgctc

SEQ ID NO: 464262 - DNA, 25 bp, Rattus norvegicus
ctccgggaagcaaggtctgcgacac

SEQ ID NO: 464263 - DNA, 25 bp, Rattus norvegicus
ggcgctataagtgcccgccgaggtc

SEQ ID NO: 464264 - DNA, 25 bp, Rattus norvegicus
cagcagccgctacccttaatttaga

SEQ ID NO: 464265 - DNA, 25 bp, Rattus norvegicus
ccaaaccttgtaggggcagacgcac

SEQ ID NO: 464266 - DNA, 25 bp, Rattus norvegicus
caaaactggctcactgcgggctgta

SEQ ID NO: 464267 - DNA, 25 bp, Rattus norvegicus
ccgcatattttccacgaggctgagg

SEQ ID NO: 464268 - DNA, 25 bp, Rattus norvegicus
ctgcgggctgtaaaaaccttggtca

SEQ ID NO: 464269 - DNA, 25 bp, Rattus norvegicus
tctcagtgcctaaagccaggtcctc

SEQ ID NO: 464270 - DNA, 25 bp, Rattus norvegicus
ggctcagcgcttcctctgagtgaca

SEQ ID NO: 464271 - DNA, 25 bp, Rattus norvegicus
tgcacgcctcgagtgcctcagttta

SEQ ID NO: 464272 - DNA, 25 bp, Rattus norvegicus
ggtcccagactccaggtttgcgcta

SEQ ID NO: 464273 - DNA, 25 bp, Rattus norvegicus
ctacgtcttttcgtgtgcttgggga

SEQ ID NO: 464274 - DNA, 25 bp, Rattus norvegicus
gcgggcctggcatctattaacctag

SEQ ID NO: 464275 - DNA, 25 bp, Rattus norvegicus
ctagtgttccttcccagtctcagtg

SEQ ID NO: 464276 - DNA, 25 bp, Rattus norvegicus
ccaacgggctagtttgactccaaat

SEQ ID NO: 464277 - DNA, 25 bp, Rattus norvegicus
gtcagcagaggctacaagacccttg

SEQ ID NO: 464278 - DNA, 25 bp, Rattus norvegicus
cactggagagaacgcccgaactaaa

SEQ ID NO: 464279 - DNA, 25 bp, Rattus norvegicus
ttttttaatagctcgcggcgaaggc

SEQ ID NO: 464280 - DNA, 25 bp, Rattus norvegicus
gtgcagagcactggagagaacgccc

SEQ ID NO: 464281 - DNA, 25 bp, Rattus norvegicus
gatgctcgggctcccgcgaagcctg

SEQ ID NO: 464282 - DNA, 25 bp, Rattus norvegicus
ggcggatccggatcctcagaatccc

SEQ ID NO: 464283 - DNA, 25 bp, Rattus norvegicus
ggaagctgctctggccgcagctctc

SEQ ID NO: 464284 - DNA, 25 bp, Rattus norvegicus
ccgctctatggtcgcagagactgca

SEQ ID NO: 464285 - DNA, 25 bp, Rattus norvegicus
cggtccgctctatggtcgcagagac

SEQ ID NO: 464286 - DNA, 25 bp, Rattus norvegicus
acactctcgtccacttccgtcctgg

SEQ ID NO: 464287 - DNA, 25 bp, Rattus norvegicus
ctcgccctcccttcgacacactctc

SEQ ID NO: 464288 - DNA, 25 bp, Rattus norvegicus
gcctacctgcgctgcccagctctgc

SEQ ID NO: 464289 - DNA, 25 bp, Rattus norvegicus
cctagaacctcagcccagcccgtcc

SEQ ID NO: 464290 - DNA, 25 bp, Rattus norvegicus
cggcgaaggcggatccggatcctca

SEQ ID NO: 464291 - DNA, 25 bp, Rattus norvegicus
tctggccgcagctctcgatgctcgg

SEQ ID NO: 464292 - DNA, 25 bp, Rattus norvegicus
tttggattcagatacgaggcgcgtg

SEQ ID NO: 464293 - DNA, 25 bp, Rattus norvegicus
cagccgatctgctcggaggcaggta

SEQ ID NO: 464294 - DNA, 25 bp, Rattus norvegicus
aggacgacctccatgtgtaagagtc

SEQ ID NO: 464295 - DNA, 25 bp, Rattus norvegicus
gcgacagactccgtggatgccaccg

SEQ ID NO: 464296 - DNA, 25 bp, Rattus norvegicus
cggaagaggcgcctcaactctgaga

SEQ ID NO: 464297 - DNA, 25 bp, Rattus norvegicus
taggccgaccagctccacgaacaga

SEQ ID NO: 464298 - DNA, 25 bp, Rattus norvegicus
ctctccttgggtcgcgtctctagat

SEQ ID NO: 464299 - DNA, 25 bp, Rattus norvegicus
cggcagcggctacagcaataaagtc

SEQ ID NO: 464300 - DNA, 25 bp, Rattus norvegicus
tcagagagctcttgctgcagcggca

SEQ ID NO: 464301 - DNA, 25 bp, Rattus norvegicus
gccgtcggaagtttgtatctgagta

SEQ ID NO: 464302 - DNA, 25 bp, Rattus norvegicus
cgccagttgcagttagatgcggtcc

SEQ ID NO: 464303 - DNA, 25 bp, Rattus norvegicus
gtttcgaaacgccagcgccagttgc

SEQ ID NO: 464304 - DNA, 25 bp, Rattus norvegicus
cgcaggttaccatgttcacgggatc

SEQ ID NO: 464305 - DNA, 25 bp, Rattus norvegicus
gtctagagctaaagcgacgccttcc

SEQ ID NO: 464306 - DNA, 25 bp, Rattus norvegicus
cggaggtagacttctcacagggcta

SEQ ID NO: 464307 - DNA, 25 bp, Rattus norvegicus
catatcagggtcacacgagcccgga

SEQ ID NO: 464308 - DNA, 25 bp, Rattus norvegicus
gacccaaaggctcccggcgatctgt

SEQ ID NO: 464309 - DNA, 25 bp, Rattus norvegicus
tgcgaggacctggaaagtgacagtc

SEQ ID NO: 464310 - DNA, 25 bp, Rattus norvegicus
gccggacatgtcacaccactacgaa

SEQ ID NO: 464311 - DNA, 25 bp, Rattus norvegicus
cactacgaatcgtggttccggccga

SEQ ID NO: 464312 - DNA, 25 bp, Rattus norvegicus
tcagcctgctttgggaggatacgtc

SEQ ID NO: 464313 - DNA, 25 bp, Rattus norvegicus
gatacgtcggagaccaccagctctg

SEQ ID NO: 464314 - DNA, 25 bp, Rattus norvegicus
gagtcccaagggctggattccagtc

SEQ ID NO: 464315 - DNA, 25 bp, Rattus norvegicus
cggcgaccgacccttcgtgtgcaat

SEQ ID NO: 464316 - DNA, 25 bp, Rattus norvegicus
gtctgcagccgtgtcttcatgcgca

SEQ ID NO: 464317 - DNA, 25 bp, Rattus norvegicus
ggcatacgctaagacgtcgcatctg

SEQ ID NO: 464318 - DNA, 25 bp, Rattus norvegicus
ccatactcagggagcgctgacctca

SEQ ID NO: 464319 - DNA, 25 bp, Rattus norvegicus
tgcagcctcttcagacatatcaggg

SEQ ID NO: 464320 - DNA, 25 bp, Rattus norvegicus
caggcctcgcttcgctccctgcctg

SEQ ID NO: 464321 - DNA, 25 bp, Rattus norvegicus
atgtcccagtccttccgcgccgggc

SEQ ID NO: 464322 - DNA, 25 bp, Rattus norvegicus
gaagccgtcactgggagagtcaccc

SEQ ID NO: 464323 - DNA, 25 bp, Rattus norvegicus
cgggcgccctcccacctcagcccgg

SEQ ID NO: 464324 - DNA, 25 bp, Rattus norvegicus
ctccggataggaccagcgccccggc

SEQ ID NO: 464325 - DNA, 25 bp, Rattus norvegicus
tgcccatgtcccagtccttccgcgc

SEQ ID NO: 464326 - DNA, 25 bp, Rattus norvegicus
ctgcctgcccatgtcccagtccttc

SEQ ID NO: 464327 - DNA, 25 bp, Rattus norvegicus
tccctgcctgcccatgtcccagtcc

SEQ ID NO: 464328 - DNA, 25 bp, Rattus norvegicus
agaagccgtcactgggagagtcacc

SEQ ID NO: 464329 - DNA, 25 bp, Rattus norvegicus
gcttcaggagaagccgtcactggga

SEQ ID NO: 464330 - DNA, 25 bp, Rattus norvegicus
gagcttcaggagaagccgtcactgg

SEQ ID NO: 464331 - DNA, 25 bp, Rattus norvegicus
cccgttagcccaggcaggagcttca

SEQ ID NO: 464332 - DNA, 25 bp, Rattus norvegicus
ggcccgttagcccaggcaggagctt

SEQ ID NO: 464333 - DNA, 25 bp, Rattus norvegicus
ggagagtcacccctgcctttccctc

SEQ ID NO: 464334 - DNA, 25 bp, Rattus norvegicus
ccgtgtactgtggtgcagactgtcc

SEQ ID NO: 464335 - DNA, 25 bp, Rattus norvegicus
tccctcgtgcatgtgttacccgcgt

SEQ ID NO: 464336 - DNA, 25 bp, Rattus norvegicus
tgttacccgcgtgtggttttagcca

SEQ ID NO: 464337 - DNA, 25 bp, Rattus norvegicus
ccgcgtgtggttttagccagttctc

SEQ ID NO: 464338 - DNA, 25 bp, Rattus norvegicus
ggttttagccagttctcctatgcga

SEQ ID NO: 464339 - DNA, 25 bp, Rattus norvegicus
gccagttctcctatgcgatctcttc

SEQ ID NO: 464340 - DNA, 25 bp, Rattus norvegicus
tgcagactgtcctggtgatcacgta

SEQ ID NO: 464341 - DNA, 25 bp, Rattus norvegicus
cccgaatcccgagtatcaggagttc

SEQ ID NO: 464342 - DNA, 25 bp, Rattus norvegicus
tcccgagtatcaggagttccagaac

SEQ ID NO: 464343 - DNA, 25 bp, Rattus norvegicus
gtatcaggagttccagaaccgcctg

SEQ ID NO: 464344 - DNA, 25 bp, Rattus norvegicus
tccagaaccgcctgctgatcagagc

SEQ ID NO: 464345 - DNA, 25 bp, Rattus norvegicus
accgcctgctgatcagagcccggga

SEQ ID NO: 464346 - DNA, 25 bp, Rattus norvegicus
cccagagtttggcgcgctccagaac

SEQ ID NO: 464347 - DNA, 25 bp, Rattus norvegicus
tcctggtgatcacgtaccgagagcc

SEQ ID NO: 464348 - DNA, 25 bp, Rattus norvegicus
cagctgttcccggaagcggtcgttt

SEQ ID NO: 464349 - DNA, 25 bp, Rattus norvegicus
ggtcccgttgtgcatgtcattggct

SEQ ID NO: 464350 - DNA, 25 bp, Rattus norvegicus
agtttgtcgcctgcaggtgcagccc

SEQ ID NO: 464351 - DNA, 25 bp, Rattus norvegicus
tcttcccgagtttgtcgcctgcagg

SEQ ID NO: 464352 - DNA, 25 bp, Rattus norvegicus
agcagcagccatcttcccgagtttg

SEQ ID NO: 464353 - DNA, 25 bp, Rattus norvegicus
cctcgtccctctggctgcttctcac

SEQ ID NO: 464354 - DNA, 25 bp, Rattus norvegicus
cggaacgcgccagtgcctgcaagac

SEQ ID NO: 464355 - DNA, 25 bp, Rattus norvegicus
ccttggtagaggcagtggctccgcc

SEQ ID NO: 464356 - DNA, 25 bp, Rattus norvegicus
ctgaatttgtcccttggtagaggca

SEQ ID NO: 464357 - DNA, 25 bp, Rattus norvegicus
acagagtccctgaatttgtcccttg

SEQ ID NO: 464358 - DNA, 25 bp, Rattus norvegicus
ggagtcggacctgcccacagagtcc

SEQ ID NO: 464359 - DNA, 25 bp, Rattus norvegicus
gactggagtcggacctgcccacaga

SEQ ID NO: 464360 - DNA, 25 bp, Rattus norvegicus
tgtgcatgtcattggctgcctctgc

SEQ ID NO: 464361 - DNA, 25 bp, Rattus norvegicus
aagcggtcgtttctctcggggactg

SEQ ID NO: 464362 - DNA, 25 bp, Rattus norvegicus
gcagggcttcagttagaggccaata

SEQ ID NO: 464363 - DNA, 25 bp, Rattus norvegicus
ttcccgggacgttgtagacctgaga

SEQ ID NO: 464364 - DNA, 25 bp, Rattus norvegicus
acagaggctctcaggtaggcagcgc

SEQ ID NO: 464365 - DNA, 25 bp, Rattus norvegicus
tcagttagaggccaatagaattggg

SEQ ID NO: 464366 - DNA, 25 bp, Rattus norvegicus
ggctttgctgagagggaccaatcga

SEQ ID NO: 464367 - DNA, 25 bp, Rattus norvegicus
tttgctgagagggaccaatcgatgg

SEQ ID NO: 464368 - DNA, 25 bp, Rattus norvegicus
agcgccaggagaacgtcatgccgag

SEQ ID NO: 464369 - DNA, 25 bp, Rattus norvegicus
aggagaacgtcatgccgaggccgcc

SEQ ID NO: 464370 - DNA, 25 bp, Rattus norvegicus
gcggggcctgcttatcgccggttca

SEQ ID NO: 464371 - DNA, 25 bp, Rattus norvegicus
tgcttatcgccggttcagcgcagcc

SEQ ID NO: 464372 - DNA, 25 bp, Rattus norvegicus
atcgccggttcagcgcagcccggag

SEQ ID NO: 464373 - DNA, 25 bp, Rattus norvegicus
agtcgcccaggcctgaactcctccc

SEQ ID NO: 464374 - DNA, 25 bp, Rattus norvegicus
ccgcgggtcagctctaagagcgtcc

SEQ ID NO: 464375 - DNA, 25 bp, Rattus norvegicus
acgttgtagacctgagaggtcaccc

SEQ ID NO: 464376 - DNA, 25 bp, Rattus norvegicus
cgacggcactctcgttgctgcacaa

SEQ ID NO: 464377 - DNA, 25 bp, Rattus norvegicus
ctcgttgctgcacaaacgaagagca

SEQ ID NO: 464378 - DNA, 25 bp, Rattus norvegicus
tatcgtttttccttgtccgacggca

SEQ ID NO: 464379 - DNA, 25 bp, Rattus norvegicus
gttcagtcagatctatcgtttttcc

SEQ ID NO: 464380 - DNA, 25 bp, Rattus norvegicus
ccagactacgaatgagcctcagctt

SEQ ID NO: 464381 - DNA, 25 bp, Rattus norvegicus
gaaactgctgcactgtgccagcgta

SEQ ID NO: 464382 - DNA, 25 bp, Rattus norvegicus
cgaagagcaaactcatccgttccca

SEQ ID NO: 464383 - DNA, 25 bp, Rattus norvegicus
tccgttcccagactacgaatgagcc

SEQ ID NO: 464384 - DNA, 25 bp, Rattus norvegicus
tgtgccagcgtagtccggctgctct

SEQ ID NO: 464385 - DNA, 25 bp, Rattus norvegicus
aaaccgtcggccagaaactgctgca

SEQ ID NO: 464386 - DNA, 25 bp, Rattus norvegicus
caggtaatcaggtttcccacccgag

SEQ ID NO: 464387 - DNA, 25 bp, Rattus norvegicus
catgcttcacaggtaatcaggtttc

SEQ ID NO: 464388 - DNA, 25 bp, Rattus norvegicus
agcctcagcttgtgatatcgctaca

SEQ ID NO: 464389 - DNA, 25 bp, Rattus norvegicus
gatatcgctacacatgcttcacagg

SEQ ID NO: 464390 - DNA, 25 bp, Rattus norvegicus
agcgtcatgctggagccggacccag

SEQ ID NO: 464391 - DNA, 25 bp, Rattus norvegicus
cggtcctgagcgagtgtctcagcgc

SEQ ID NO: 464392 - DNA, 25 bp, Rattus norvegicus
gcgagtgtctcagcgctccaagatg

SEQ ID NO: 464393 - DNA, 25 bp, Rattus norvegicus
gcaccgcagccaatcaccagaagtt

SEQ ID NO: 464394 - DNA, 25 bp, Rattus norvegicus
cgttccaaaggggtctccagccgct

SEQ ID NO: 464395 - DNA, 25 bp, Rattus norvegicus
tgtctcagcgctccaagatggcgcg

SEQ ID NO: 464396 - DNA, 25 bp, Rattus norvegicus
tcttctccctgaagatcttccgaac

SEQ ID NO: 464397 - DNA, 25 bp, Rattus norvegicus
accagaagttcaaggcgccaggggc

SEQ ID NO: 464398 - DNA, 25 bp, Rattus norvegicus
tttggaaactcttagcggccagggc

SEQ ID NO: 464399 - DNA, 25 bp, Rattus norvegicus
tggcccataacaaagagccagggtc

SEQ ID NO: 464400 - DNA, 25 bp, Rattus norvegicus
ggcgacacacagctggcccataaca

SEQ ID NO: 464401 - DNA, 25 bp, Rattus norvegicus
agcccgaggccgaaggcgacacaca

SEQ ID NO: 464402 - DNA, 25 bp, Rattus norvegicus
tgacttcccgtttgaagaccgcagc

SEQ ID NO: 464403 - DNA, 25 bp, Rattus norvegicus
tccagccgctgacttcccgtttgaa

SEQ ID NO: 464404 - DNA, 25 bp, Rattus norvegicus
tggaccgccctagccagcggcggaa

SEQ ID NO: 464405 - DNA, 25 bp, Rattus norvegicus
gtcttgcgcgcgcactttcagctct

SEQ ID NO: 464406 - DNA, 25 bp, Rattus norvegicus
cagctctgggagaagcggctcagaa

SEQ ID NO: 464407 - DNA, 25 bp, Rattus norvegicus
ggctcagaaccagagttcgtgttca

SEQ ID NO: 464408 - DNA, 25 bp, Rattus norvegicus
tcgtgttcacatctggaccgcccta

SEQ ID NO: 464409 - DNA, 25 bp, Rattus norvegicus
tccctaggtcttgcgcgcgcacttt

SEQ ID NO: 464410 - DNA, 25 bp, Rattus norvegicus
ggcggaatcccaccgggccaaatga

SEQ ID NO: 464411 - DNA, 25 bp, Rattus norvegicus
gccaaatgaattctaggggtgactc

SEQ ID NO: 464412 - DNA, 25 bp, Rattus norvegicus
aattctaggggtgactcgcgcgcct

SEQ ID NO: 464413 - DNA, 25 bp, Rattus norvegicus
gcctgcagcagcctttgccttataa

SEQ ID NO: 464414 - DNA, 25 bp, Rattus norvegicus
caggccatgggcaaatcaggtaaac

SEQ ID NO: 464415 - DNA, 25 bp, Rattus norvegicus
cacagcggagccgaggagcgcacac

SEQ ID NO: 464416 - DNA, 25 bp, Rattus norvegicus
aaggcgcggacttccctaggtcttg

SEQ ID NO: 464417 - DNA, 25 bp, Rattus norvegicus
cagcctttgccttataaggcggggc

SEQ ID NO: 464418 - DNA, 25 bp, Rattus norvegicus
tcactgcaatgacttcctgattaag

SEQ ID NO: 464419 - DNA, 25 bp, Rattus norvegicus
tcccgagggctctatgcacttcatg

SEQ ID NO: 464420 - DNA, 25 bp, Rattus norvegicus
cacttctgggccagtcccgagggct

SEQ ID NO: 464421 - DNA, 25 bp, Rattus norvegicus
attcgcgacaacttccacttctggg

SEQ ID NO: 464422 - DNA, 25 bp, Rattus norvegicus
ttggcctactctggcattcgcgaca

SEQ ID NO: 464423 - DNA, 25 bp, Rattus norvegicus
aagaagtatcagacttggcctactc

SEQ ID NO: 464424 - DNA, 25 bp, Rattus norvegicus
agctgttcgagcttaaagaagtatc

SEQ ID NO: 464425 - DNA, 25 bp, Rattus norvegicus
acctcttcttggctgagctgttcga

SEQ ID NO: 464426 - DNA, 25 bp, Rattus norvegicus
gcttgcgctacctcttcttggctga

SEQ ID NO: 464427 - DNA, 25 bp, Rattus norvegicus
cctgattaagtccattcgacgcgtc

SEQ ID NO: 464428 - DNA, 25 bp, Rattus norvegicus
ccacgccttcggattcactgcaatg

SEQ ID NO: 464429 - DNA, 25 bp, Rattus norvegicus
cgcctgctccgtgatgaaaaccttc

SEQ ID NO: 464430 - DNA, 25 bp, Rattus norvegicus
ggctctatgcacttcatgcgctgcc

SEQ ID NO: 464431 - DNA, 25 bp, Rattus norvegicus
ttcgacgcgtcaactgcttgcgcta

SEQ ID NO: 464432 - DNA, 25 bp, Rattus norvegicus
gacgactcccagctttccaaagtgg

SEQ ID NO: 464433 - DNA, 25 bp, Rattus norvegicus
gtcacgagttgtctccaggactcca

SEQ ID NO: 464434 - DNA, 25 bp, Rattus norvegicus
tttgccggctgatagggtaactttc

SEQ ID NO: 464435 - DNA, 25 bp, Rattus norvegicus
gggtaactttcaccttctgattggc

SEQ ID NO: 464436 - DNA, 25 bp, Rattus norvegicus
cgcagatgcagtgactgtcaggatc

SEQ ID NO: 464437 - DNA, 25 bp, Rattus norvegicus
tggctcgccaacctaaccggatata

SEQ ID NO: 464438 - DNA, 25 bp, Rattus norvegicus
taaccggatatagaagcaaggcttc

SEQ ID NO: 464439 - DNA, 25 bp, Rattus norvegicus
ggccgtcatggctgagttggatcca

SEQ ID NO: 464440 - DNA, 25 bp, Rattus norvegicus
agttggatccatttggcgctcccgc

SEQ ID NO: 464441 - DNA, 25 bp, Rattus norvegicus
agattgcgggcatagagaacgacga

SEQ ID NO: 464442 - DNA, 25 bp, Rattus norvegicus
acgacgaggccttcgccatcctaga

SEQ ID NO: 464443 - DNA, 25 bp, Rattus norvegicus
cttctggctgaagctttaggagctc

SEQ ID NO: 464444 - DNA, 25 bp, Rattus norvegicus
cccggctgggtcattgcacagacct

SEQ ID NO: 464445 - DNA, 25 bp, Rattus norvegicus
ggctgttctttttgtggctcgccaa

SEQ ID NO: 464446 - DNA, 25 bp, Rattus norvegicus
tatttctgttggctggtcgtgtaga

SEQ ID NO: 464447 - DNA, 25 bp, Rattus norvegicus
ccctccttggcgtatttctgttggc

SEQ ID NO: 464448 - DNA, 25 bp, Rattus norvegicus
gcggagcgccgaaccgtcgatcgct

SEQ ID NO: 464449 - DNA, 25 bp, Rattus norvegicus
gcgctcgatccagcacaagccattg

SEQ ID NO: 464450 - DNA, 25 bp, Rattus norvegicus
acgatgctcgtgagtcaccgactga

SEQ ID NO: 464451 - DNA, 25 bp, Rattus norvegicus
ggtgtcagagcctggcacgatgctc

SEQ ID NO: 464452 - DNA, 25 bp, Rattus norvegicus
ggcccacaactgcagcgatggtgtc

SEQ ID NO: 464453 - DNA, 25 bp, Rattus norvegicus
gcagaacccgggcacacagcgcgag

SEQ ID NO: 464454 - DNA, 25 bp, Rattus norvegicus
cagaggcgccctgcggtgcagaacc

SEQ ID NO: 464455 - DNA, 25 bp, Rattus norvegicus
cggagcaacgcaccgggacagcaga

SEQ ID NO: 464456 - DNA, 25 bp, Rattus norvegicus
tgagcctgacagctccgggatccca

SEQ ID NO: 464457 - DNA, 25 bp, Rattus norvegicus
ggtatctcacgcctctgctcgggta

SEQ ID NO: 464458 - DNA, 25 bp, Rattus norvegicus
tacccagggccgtgctgtctgctgc

SEQ ID NO: 464459 - DNA, 25 bp, Rattus norvegicus
gtcgtgtagagagccttccgctgtc

SEQ ID NO: 464460 - DNA, 25 bp, Rattus norvegicus
agaatcgcgaatgtgggcatgcgca

SEQ ID NO: 464461 - DNA, 25 bp, Rattus norvegicus
agatgttggcatcgcaggtgttctg

SEQ ID NO: 464462 - DNA, 25 bp, Rattus norvegicus
catcgcaggtgttctgtgctggccc

SEQ ID NO: 464463 - DNA, 25 bp, Rattus norvegicus
gacaaaggccttccaggtcgcctac

SEQ ID NO: 464464 - DNA, 25 bp, Rattus norvegicus
ggccttccaggtcgcctaccagaga

SEQ ID NO: 464465 - DNA, 25 bp, Rattus norvegicus
gcctaccagagaacccgggtccaga

SEQ ID NO: 464466 - DNA, 25 bp, Rattus norvegicus
cccgggtccagaggaacagatttga

SEQ ID NO: 464467 - DNA, 25 bp, Rattus norvegicus
cagaggaacagatttgacctgaaga

SEQ ID NO: 464468 - DNA, 25 bp, Rattus norvegicus
aagtggcgttcggaaccgagtctga

SEQ ID NO: 464469 - DNA, 25 bp, Rattus norvegicus
ttcggaaccgagtctgagggtcttg

SEQ ID NO: 464470 - DNA, 25 bp, Rattus norvegicus
tgagagacggaagcactgagaactt

SEQ ID NO: 464471 - DNA, 25 bp, Rattus norvegicus
ttggacggaagagaatcgcgaatgt

SEQ ID NO: 464472 - DNA, 25 bp, Rattus norvegicus
caccctcgtggaagatgttggcatc

SEQ ID NO: 464473 - DNA, 25 bp, Rattus norvegicus
ctgagaacttagaaagggttggacg

SEQ ID NO: 464474 - DNA, 25 bp, Rattus norvegicus
tccaaccgggttctgagttctccca

SEQ ID NO: 464475 - DNA, 25 bp, Rattus norvegicus
cgtcttccaacgcagggagtgccta

SEQ ID NO: 464476 - DNA, 25 bp, Rattus norvegicus
actcgcttggctagcgcaggcagca

SEQ ID NO: 464477 - DNA, 25 bp, Rattus norvegicus
acctagccagccaagcgcaggatcg

SEQ ID NO: 464478 - DNA, 25 bp, Rattus norvegicus
gacttcctcatctgagttccggaca

SEQ ID NO: 464479 - DNA, 25 bp, Rattus norvegicus
agagcgctaggcttccgataaaacc

SEQ ID NO: 464480 - DNA, 25 bp, Rattus norvegicus
cgcgcaggcgaaacccagagcgcta

SEQ ID NO: 464481 - DNA, 25 bp, Rattus norvegicus
ttctcagcgctcgaagactagcgcg

SEQ ID NO: 464482 - DNA, 25 bp, Rattus norvegicus
ccggcgctaaaggagctggctagct

SEQ ID NO: 464483 - DNA, 25 bp, Rattus norvegicus
tgaggcgctgtcaaggcgcttcctt

SEQ ID NO: 464484 - DNA, 25 bp, Rattus norvegicus
atcgtccttgccctcggaactcggg

SEQ ID NO: 464485 - DNA, 25 bp, Rattus norvegicus
atcatcatttcacctgcgtctcgtc

SEQ ID NO: 464486 - DNA, 25 bp, Rattus norvegicus
gagtgcctaacgctgcggcagcttc

SEQ ID NO: 464487 - DNA, 25 bp, Rattus norvegicus
gttctcccaagtgacatcatcattt

SEQ ID NO: 464488 - DNA, 25 bp, Rattus norvegicus
atggggaagttgattagcctcagcg

SEQ ID NO: 464489 - DNA, 25 bp, Rattus norvegicus
actgaggacctgacaggcgcgcgct

SEQ ID NO: 464490 - DNA, 25 bp, Rattus norvegicus
gcgcgctgcctccttaatagactgc

SEQ ID NO: 464491 - DNA, 25 bp, Rattus norvegicus
ttaatagactgcgagcgagtgctcc

SEQ ID NO: 464492 - DNA, 25 bp, Rattus norvegicus
gagccatcatcaggcgagtggtccc

SEQ ID NO: 464493 - DNA, 25 bp, Rattus norvegicus
cccggagcaggatttattagcagac

SEQ ID NO: 464494 - DNA, 25 bp, Rattus norvegicus
ctcagcggctgaacggacatcctgt

SEQ ID NO: 464495 - DNA, 25 bp, Rattus norvegicus
ccgggtctcttaatccaatcactta

SEQ ID NO: 464496 - DNA, 25 bp, Rattus norvegicus
aatcacttacctgtcggggcgcgtg

SEQ ID NO: 464497 - DNA, 25 bp, Rattus norvegicus
gcagccgctggcgacctggaaccag

SEQ ID NO: 464498 - DNA, 25 bp, Rattus norvegicus
cttgctgagctctctcgctgcggat

SEQ ID NO: 464499 - DNA, 25 bp, Rattus norvegicus
tgcggatgcaccctccacgttattc

SEQ ID NO: 464500 - DNA, 25 bp, Rattus norvegicus
cgccgcacctgggtgatgggcacct

SEQ ID NO: 464501 - DNA, 25 bp, Rattus norvegicus
gacatcctgtcagccgggtctctta

SEQ ID NO: 464502 - DNA, 25 bp, Rattus norvegicus
agtcattcattacggggcttctccc

SEQ ID NO: 464503 - DNA, 25 bp, Rattus norvegicus
tgatttctccttccacaccgggagc

SEQ ID NO: 464504 - DNA, 25 bp, Rattus norvegicus
gcggtgggtttgatttctccttcca

SEQ ID NO: 464505 - DNA, 25 bp, Rattus norvegicus
attgcaaatgttcagcggaggccca

SEQ ID NO: 464506 - DNA, 25 bp, Rattus norvegicus
gccgccaaatgtcaattaaattgca

SEQ ID NO: 464507 - DNA, 25 bp, Rattus norvegicus
gcttcctgccgccaaatgtcaatta

SEQ ID NO: 464508 - DNA, 25 bp, Rattus norvegicus
gacttatactgattggcttcctgcc

SEQ ID NO: 464509 - DNA, 25 bp, Rattus norvegicus
tccgaacgtcaattgacttatactg

SEQ ID NO: 464510 - DNA, 25 bp, Rattus norvegicus
gccgaccgccgattagttttatctc

SEQ ID NO: 464511 - DNA, 25 bp, Rattus norvegicus
cccggcaaataaagtcattcattac

SEQ ID NO: 464512 - DNA, 25 bp, Rattus norvegicus
aactcaattgttctcagcagggccc

SEQ ID NO: 464513 - DNA, 25 bp, Rattus norvegicus
gctggcatccgttgttaccataaca

SEQ ID NO: 464514 - DNA, 25 bp, Rattus norvegicus
cggcggaaagctggcatccgttgtt

SEQ ID NO: 464515 - DNA, 25 bp, Rattus norvegicus
cgattagttttatctccgaacgtca

SEQ ID NO: 464516 - DNA, 25 bp, Rattus norvegicus
ggcttccttacctcatttgtcctcg

SEQ ID NO: 464517 - DNA, 25 bp, Rattus norvegicus
ggacgcggcttccttacctcatttg

SEQ ID NO: 464518 - DNA, 25 bp, Rattus norvegicus
tttggcgggtctctgacccgcggcc

SEQ ID NO: 464519 - DNA, 25 bp, Rattus norvegicus
ctctacgtgtttcggttcctggttg

SEQ ID NO: 464520 - DNA, 25 bp, Rattus norvegicus
tgtttcggttcctggttggtgcttc

SEQ ID NO: 464521 - DNA, 25 bp, Rattus norvegicus
tcctggttggtgcttcctggtcgca

SEQ ID NO: 464522 - DNA, 25 bp, Rattus norvegicus
ttcctggtcgcagccgcggcagtga

SEQ ID NO: 464523 - DNA, 25 bp, Rattus norvegicus
gcctcgcccgcggagctaatgcgtg

SEQ ID NO: 464524 - DNA, 25 bp, Rattus norvegicus
ttgggcggaagaacagctcccaaga

SEQ ID NO: 464525 - DNA, 25 bp, Rattus norvegicus
cgcagcgtagtgcagcgcagctaat

SEQ ID NO: 464526 - DNA, 25 bp, Rattus norvegicus
agtgcagcgcagctaatggcctctc

SEQ ID NO: 464527 - DNA, 25 bp, Rattus norvegicus
agctaatggcctctccgctacgtgc

SEQ ID NO: 464528 - DNA, 25 bp, Rattus norvegicus
agtatgtgtgtgacggaccccgagc

SEQ ID NO: 464529 - DNA, 25 bp, Rattus norvegicus
agtcctcgcggacgcggcttcctta

SEQ ID NO: 464530 - DNA, 25 bp, Rattus norvegicus
acagcttatggccttgctcagatga

SEQ ID NO: 464531 - DNA, 25 bp, Rattus norvegicus
gatgtgaggtacacaagtcaccgcc

SEQ ID NO: 464532 - DNA, 25 bp, Rattus norvegicus
gttctttgagaacccagcggaggcc

SEQ ID NO: 464533 - DNA, 25 bp, Rattus norvegicus
tcggaccgaccctgtgaaaggaggc

SEQ ID NO: 464534 - DNA, 25 bp, Rattus norvegicus
cactctagctgatagggacgcctca

SEQ ID NO: 464535 - DNA, 25 bp, Rattus norvegicus
ctcgccaaggccactctagctgata

SEQ ID NO: 464536 - DNA, 25 bp, Rattus norvegicus
ccgcagcaagacaaggtggacaggc

SEQ ID NO: 464537 - DNA, 25 bp, Rattus norvegicus
acgcctgcgcacaagaaccgggcta

SEQ ID NO: 464538 - DNA, 25 bp, Rattus norvegicus
gagaggctccatctccagcgggaga

SEQ ID NO: 464539 - DNA, 25 bp, Rattus norvegicus
agcaagagggccactcgtctccatc

SEQ ID NO: 464540 - DNA, 25 bp, Rattus norvegicus
ggctcccgaatccagacagcttatg

SEQ ID NO: 464541 - DNA, 25 bp, Rattus norvegicus
tcagcgttcaggaagacccaggaca

SEQ ID NO: 464542 - DNA, 25 bp, Rattus norvegicus
ttcccactgcatacggagaggctcc

SEQ ID NO: 464543 - DNA, 25 bp, Rattus norvegicus
tgcagatccggagcgagttcccact

SEQ ID NO: 464544 - DNA, 25 bp, Rattus norvegicus
gatgcgtaccgctgccctcggtgct

SEQ ID NO: 464545 - DNA, 25 bp, Rattus norvegicus
agacgctcttagagacccgggcgcg

SEQ ID NO: 464546 - DNA, 25 bp, Rattus norvegicus
tagcttggctgaagacgctcttaga

SEQ ID NO: 464547 - DNA, 25 bp, Rattus norvegicus
cgtgccctagtagcttggctgaaga

SEQ ID NO: 464548 - DNA, 25 bp, Rattus norvegicus
tgcacggtcggtcgtgccctagtag

SEQ ID NO: 464549 - DNA, 25 bp, Rattus norvegicus
tgcctgcgccgaaccggtgcacggt

SEQ ID NO: 464550 - DNA, 25 bp, Rattus norvegicus
tgaggacccaagaaccggagccgct

SEQ ID NO: 464551 - DNA, 25 bp, Rattus norvegicus
atctatccctgctgaggacccaaga

SEQ ID NO: 464552 - DNA, 25 bp, Rattus norvegicus
gagcgcacacatctatccctgctga

SEQ ID NO: 464553 - DNA, 25 bp, Rattus norvegicus
tggggtaccgagtcagctcagaacc

SEQ ID NO: 464554 - DNA, 25 bp, Rattus norvegicus
actccttggggtaccgagtcagctc

SEQ ID NO: 464555 - DNA, 25 bp, Rattus norvegicus
ctagcgtttcgctaaactccttggg

SEQ ID NO: 464556 - DNA, 25 bp, Rattus norvegicus
gaactgttccacgtttgcgggagcc

SEQ ID NO: 464557 - DNA, 25 bp, Rattus norvegicus
gccggacctgctagcgtttcgctaa

SEQ ID NO: 464558 - DNA, 25 bp, Rattus norvegicus
acagctctcctggagctccggcggc

SEQ ID NO: 464559 - DNA, 25 bp, Rattus norvegicus
gaatagcatcgtgggcgggaagtgc

SEQ ID NO: 464560 - DNA, 25 bp, Rattus norvegicus
cctttgaaggggtgggaatagcatc

SEQ ID NO: 464561 - DNA, 25 bp, Rattus norvegicus
agctctgccagagggggtccgactt

SEQ ID NO: 464562 - DNA, 25 bp, Rattus norvegicus
cagaggactgcggagctctgccaga

SEQ ID NO: 464563 - DNA, 25 bp, Rattus norvegicus
ctgccagaggactgcggagctctgc

SEQ ID NO: 464564 - DNA, 25 bp, Rattus norvegicus
aggaacccgcgcctcttacctctgg

SEQ ID NO: 464565 - DNA, 25 bp, Rattus norvegicus
tccggagaaacctcccgggcgcgca

SEQ ID NO: 464566 - DNA, 25 bp, Rattus norvegicus
tagcctggagcatccgcgggctccg

SEQ ID NO: 464567 - DNA, 25 bp, Rattus norvegicus
agagccactggtagcctggagcatc

SEQ ID NO: 464568 - DNA, 25 bp, Rattus norvegicus
cccacggagggatagagccactggt

SEQ ID NO: 464569 - DNA, 25 bp, Rattus norvegicus
cagccaaacgctgggcccacggagg

SEQ ID NO: 464570 - DNA, 25 bp, Rattus norvegicus
ggccgagggccctacctcccgcaca

SEQ ID NO: 464571 - DNA, 25 bp, Rattus norvegicus
acctcccgcacactgcccaaggccg

SEQ ID NO: 464572 - DNA, 25 bp, Rattus norvegicus
atcttccgtttcatctcctccgggt

SEQ ID NO: 464573 - DNA, 25 bp, Rattus norvegicus
tggacgcgtggcctcacggtcacag

SEQ ID NO: 464574 - DNA, 25 bp, Rattus norvegicus
agaaggacactcactgactcgcagc

SEQ ID NO: 464575 - DNA, 25 bp, Rattus norvegicus
tgactcgcagcagggccacgtagat

SEQ ID NO: 464576 - DNA, 25 bp, Rattus norvegicus
gccacgtagatgaggaagttccgaa

SEQ ID NO: 464577 - DNA, 25 bp, Rattus norvegicus
aggagaccacatcctcacgcatctt

SEQ ID NO: 464578 - DNA, 25 bp, Rattus norvegicus
ctcacggtcacagcccagaaggaca

SEQ ID NO: 464579 - DNA, 25 bp, Rattus norvegicus
agcggcagcttgctctgctccagcg

SEQ ID NO: 464580 - DNA, 25 bp, Rattus norvegicus
caaagcttgcgagagcggcagcttg

SEQ ID NO: 464581 - DNA, 25 bp, Rattus norvegicus
tcgatccggaacattgcagctctgc

SEQ ID NO: 464582 - DNA, 25 bp, Rattus norvegicus
cgcgagaccttcgatccggaacatt

SEQ ID NO: 464583 - DNA, 25 bp, Rattus norvegicus
agttccgaatggaggagaccacatc

SEQ ID NO: 464584 - DNA, 25 bp, Rattus norvegicus
tgcagctctgcctccaaagcttgcg

SEQ ID NO: 464585 - DNA, 25 bp, Rattus norvegicus
cgggtccaacttcggcgcgagacct

SEQ ID NO: 464586 - DNA, 25 bp, Rattus norvegicus
tcagcacgccgggaacggctcctcc

SEQ ID NO: 464587 - DNA, 25 bp, Rattus norvegicus
ctccctttcgtctgcactcagatga

SEQ ID NO: 464588 - DNA, 25 bp, Rattus norvegicus
gtctgcactcagatgatcagtttga

SEQ ID NO: 464589 - DNA, 25 bp, Rattus norvegicus
tgatcagtttgacgatcctcccgtc

SEQ ID NO: 464590 - DNA, 25 bp, Rattus norvegicus
cgatcctcccgtcttcaaagtgtgg

SEQ ID NO: 464591 - DNA, 25 bp, Rattus norvegicus
cttcaaagtgtggtgacggtgcaga

SEQ ID NO: 464592 - DNA, 25 bp, Rattus norvegicus
tgcagaggagtattgtgaaaggcaa

SEQ ID NO: 464593 - DNA, 25 bp, Rattus norvegicus
ctgcggaccgacgatctctggctcg

SEQ ID NO: 464594 - DNA, 25 bp, Rattus norvegicus
acgccgtctgcacaagggctctgaa

SEQ ID NO: 464595 - DNA, 25 bp, Rattus norvegicus
ggtgtgcctgaaggattatagctca

SEQ ID NO: 464596 - DNA, 25 bp, Rattus norvegicus
cacaagggctctgaagggcgtccaa

SEQ ID NO: 464597 - DNA, 25 bp, Rattus norvegicus
tccaagtggtgtgcctgaaggatta

SEQ ID NO: 464598 - DNA, 25 bp, Rattus norvegicus
ttatagctcagctgcggaccgacga

SEQ ID NO: 464599 - DNA, 25 bp, Rattus norvegicus
tgaaaggcaaaggagacgccgtctg

SEQ ID NO: 464600 - DNA, 25 bp, Rattus norvegicus
accgcccactgcgacggcccaggac

SEQ ID NO: 464601 - DNA, 25 bp, Rattus norvegicus
tcctcctcaggtaagggcgaggccc

SEQ ID NO: 464602 - DNA, 25 bp, Rattus norvegicus
cacaccgccgcaaagttttggggag

SEQ ID NO: 464603 - DNA, 25 bp, Rattus norvegicus
acaacccaggcctgcgtctctggga

SEQ ID NO: 464604 - DNA, 25 bp, Rattus norvegicus
ctgcgtctctgggagctgtttctcg

SEQ ID NO: 464605 - DNA, 25 bp, Rattus norvegicus
agctgtttctcggcttcttccacgc

SEQ ID NO: 464606 - DNA, 25 bp, Rattus norvegicus
gggtgacccgcaccgcttctcgtgt

SEQ ID NO: 464607 - DNA, 25 bp, Rattus norvegicus
gcttgcttgggacctgcaatggtta

SEQ ID NO: 464608 - DNA, 25 bp, Rattus norvegicus
gggacctgcaatggttaactctgtg

SEQ ID NO: 464609 - DNA, 25 bp, Rattus norvegicus
gttaactctgtgcatgggctccgtg

SEQ ID NO: 464610 - DNA, 25 bp, Rattus norvegicus
ccagctactgctcccgccggctccg

SEQ ID NO: 464611 - DNA, 25 bp, Rattus norvegicus
accagccgcgaggtagacctgggtt

SEQ ID NO: 464612 - DNA, 25 bp, Rattus norvegicus
tgggctccgtgtgccttaagttttc

SEQ ID NO: 464613 - DNA, 25 bp, Rattus norvegicus
tgcatgggctccgtgtgccttaagt

SEQ ID NO: 464614 - DNA, 25 bp, Rattus norvegicus
tctacgcatgcggatagctgcttca

SEQ ID NO: 464615 - DNA, 25 bp, Rattus norvegicus
tgcatactccgaggaggtctcccgc

SEQ ID NO: 464616 - DNA, 25 bp, Rattus norvegicus
aagaaccgttccttgaaggctcgcg

SEQ ID NO: 464617 - DNA, 25 bp, Rattus norvegicus
aaggctcgcgtcgttgctaggagac

SEQ ID NO: 464618 - DNA, 25 bp, Rattus norvegicus
ctaggagacaggacgccaggtctga

SEQ ID NO: 464619 - DNA, 25 bp, Rattus norvegicus
acgccaggtctgacggacccagggc

SEQ ID NO: 464620 - DNA, 25 bp, Rattus norvegicus
gtggcttgcatactccgaggaggtc

SEQ ID NO: 464621 - DNA, 25 bp, Rattus norvegicus
gagggcgggcaccacagacccagct

SEQ ID NO: 464622 - DNA, 25 bp, Rattus norvegicus
aacttcctgtaaggatggctgcggc

SEQ ID NO: 464623 - DNA, 25 bp, Rattus norvegicus
atagctgcttcatccggcggcacgc

SEQ ID NO: 464624 - DNA, 25 bp, Rattus norvegicus
aatccttagctacttccgcctccgg

SEQ ID NO: 464625 - DNA, 25 bp, Rattus norvegicus
ctccggacaaccctcatgggaactt

SEQ ID NO: 464626 - DNA, 25 bp, Rattus norvegicus
ccctcatgggaacttcctgtaagga

SEQ ID NO: 464627 - DNA, 25 bp, Rattus norvegicus
ccgttccttgaaggctcgcgtcgtt

SEQ ID NO: 464628 - DNA, 25 bp, Rattus norvegicus
gcgttggtcatgtttcccttcgggc

SEQ ID NO: 464629 - DNA, 25 bp, Rattus norvegicus
gctcgggacaatttccgcacgatga

SEQ ID NO: 464630 - DNA, 25 bp, Rattus norvegicus
acggtgctgtcttcaacctcgagta

SEQ ID NO: 464631 - DNA, 25 bp, Rattus norvegicus
ttcaacctcgagtactcgccggacg

SEQ ID NO: 464632 - DNA, 25 bp, Rattus norvegicus
tgtatggttccatccatcccgcaga

SEQ ID NO: 464633 - DNA, 25 bp, Rattus norvegicus
cacgatgactaacctgtatggttcc

SEQ ID NO: 464634 - DNA, 25 bp, Rattus norvegicus
ttccgcacgatgactaacctgtatg

SEQ ID NO: 464635 - DNA, 25 bp, Rattus norvegicus
gacccggctcgggacaatttccgca

SEQ ID NO: 464636 - DNA, 25 bp, Rattus norvegicus
gcgtcgcaggcagagctgtcaccct

SEQ ID NO: 464637 - DNA, 25 bp, Rattus norvegicus
tggagttgtccgctgccgcgtcgca

SEQ ID NO: 464638 - DNA, 25 bp, Rattus norvegicus
cccgaagctctggagttgtccgctg

SEQ ID NO: 464639 - DNA, 25 bp, Rattus norvegicus
cggcgtctccacagcgaggagctga

SEQ ID NO: 464640 - DNA, 25 bp, Rattus norvegicus
gcggtggtgtccctgcttttacgtc

SEQ ID NO: 464641 - DNA, 25 bp, Rattus norvegicus
agcgaggagctgacgcggcctctcc

SEQ ID NO: 464642 - DNA, 25 bp, Rattus norvegicus
ccgcccggcttagactgtttactgc

SEQ ID NO: 464643 - DNA, 25 bp, Rattus norvegicus
aaacgcgtcctctagcttgtagtga

SEQ ID NO: 464644 - DNA, 25 bp, Rattus norvegicus
cccgtccttaagctgaggttatacg

SEQ ID NO: 464645 - DNA, 25 bp, Rattus norvegicus
tttgccatgctctaagggtgccgct

SEQ ID NO: 464646 - DNA, 25 bp, Rattus norvegicus
gactcttgtcacaccttttgccatg

SEQ ID NO: 464647 - DNA, 25 bp, Rattus norvegicus
gcgtcggatctgctagtgactcttg

SEQ ID NO: 464648 - DNA, 25 bp, Rattus norvegicus
tggcttccctgtacagcgtcggatc

SEQ ID NO: 464649 - DNA, 25 bp, Rattus norvegicus
tgtcggatcacgtgaacagggcacc

SEQ ID NO: 464650 - DNA, 25 bp, Rattus norvegicus
cgcaagcgcagacaggttcgaccca

SEQ ID NO: 464651 - DNA, 25 bp, Rattus norvegicus
taagcctctcttctctatggccaga

SEQ ID NO: 464652 - DNA, 25 bp, Rattus norvegicus
ctgcgcgatgaaacatggtgtctca

SEQ ID NO: 464653 - DNA, 25 bp, Rattus norvegicus
gcccagacgtaatgcgagcgcagga

SEQ ID NO: 464654 - DNA, 25 bp, Rattus norvegicus
cggaatcgccagcaccacgaggtac

SEQ ID NO: 464655 - DNA, 25 bp, Rattus norvegicus
cgagcattctccaggcttccatctg

SEQ ID NO: 464656 - DNA, 25 bp, Rattus norvegicus
ccagctgcgggcttctcgagtgcac

SEQ ID NO: 464657 - DNA, 25 bp, Rattus norvegicus
cacaggacgccgaggacgcagagca

SEQ ID NO: 464658 - DNA, 25 bp, Rattus norvegicus
gagccgccgcgtgtgtgacactccg

SEQ ID NO: 464659 - DNA, 25 bp, Rattus norvegicus
tgccgctgtcgtcgggcaaagagcc

SEQ ID NO: 464660 - DNA, 25 bp, Rattus norvegicus
ggactcttggtcttgctgttgccta

SEQ ID NO: 464661 - DNA, 25 bp, Rattus norvegicus
gctgttgcctaagctgaagtacttg

SEQ ID NO: 464662 - DNA, 25 bp, Rattus norvegicus
aagtacttgttcagccacttggcca

SEQ ID NO: 464663 - DNA, 25 bp, Rattus norvegicus
cttggccatggcgaagggccgccta

SEQ ID NO: 464664 - DNA, 25 bp, Rattus norvegicus
cgccaagttcaagttctcgcagccg

SEQ ID NO: 464665 - DNA, 25 bp, Rattus norvegicus
acagacgagtctcatagggcccggg

SEQ ID NO: 464666 - DNA, 25 bp, Rattus norvegicus
ccaccgcgggtcagaaagcaagaga

SEQ ID NO: 464667 - DNA, 25 bp, Rattus norvegicus
cttctcgagtgcactggggcgagcc

SEQ ID NO: 464668 - DNA, 25 bp, Rattus norvegicus
caccggtcgccaagttcaagttctc

SEQ ID NO: 464669 - DNA, 25 bp, Rattus norvegicus
atgaggtcactcgtgctgccgctgt

SEQ ID NO: 464670 - DNA, 25 bp, Rattus norvegicus
tcggtcccggaatggcgggtctctc

SEQ ID NO: 464671 - DNA, 25 bp, Rattus norvegicus
cacggaggcgggtccacacagcttc

SEQ ID NO: 464672 - DNA, 25 bp, Rattus norvegicus
gaccggagaaagctaactgatacca

SEQ ID NO: 464673 - DNA, 25 bp, Rattus norvegicus
taactgataccagaatttgagcctg

SEQ ID NO: 464674 - DNA, 25 bp, Rattus norvegicus
cagaatttgagcctgagcgcgactc

SEQ ID NO: 464675 - DNA, 25 bp, Rattus norvegicus
tgagcgcgactcgaagcctgagccc

SEQ ID NO: 464676 - DNA, 25 bp, Rattus norvegicus
atgctagcgtatgccaccccttcgg

SEQ ID NO: 464677 - DNA, 25 bp, Rattus norvegicus
ggatgcactgcagggccctttgcac

SEQ ID NO: 464678 - DNA, 25 bp, Rattus norvegicus
ctggtgacggaaccacattggctgc

SEQ ID NO: 464679 - DNA, 25 bp, Rattus norvegicus
cacattggctgcctagcggttgcac

SEQ ID NO: 464680 - DNA, 25 bp, Rattus norvegicus
gggccctttgcacgccgcttcctat

SEQ ID NO: 464681 - DNA, 25 bp, Rattus norvegicus
agaccgccgcaggtagctaccatcg

SEQ ID NO: 464682 - DNA, 25 bp, Rattus norvegicus
acacagcttctgaaaggaccggaga

SEQ ID NO: 464683 - DNA, 25 bp, Rattus norvegicus
cggagcttagctggtgacggaacca

SEQ ID NO: 464684 - DNA, 25 bp, Rattus norvegicus
tgcgcacacacgcagagcccggtgc

SEQ ID NO: 464685 - DNA, 25 bp, Rattus norvegicus
ctcccagacggaccgcagcagcgcc

SEQ ID NO: 464686 - DNA, 25 bp, Rattus norvegicus
tcggggtgtcgtctacccgcgtcgc

SEQ ID NO: 464687 - DNA, 25 bp, Rattus norvegicus
gctgcactcggggtgtcgtctaccc

SEQ ID NO: 464688 - DNA, 25 bp, Rattus norvegicus
cgatctggctggcacgggctgcact

SEQ ID NO: 464689 - DNA, 25 bp, Rattus norvegicus
agccgcactcgtcgcgcgcggagat

SEQ ID NO: 464690 - DNA, 25 bp, Rattus norvegicus
agccgtctccgaggcgcgactcgca

SEQ ID NO: 464691 - DNA, 25 bp, Rattus norvegicus
ctctgctccgcttagcgcttggtgc

SEQ ID NO: 464692 - DNA, 25 bp, Rattus norvegicus
tcggaaccgcagacggctccgcgtt

SEQ ID NO: 464693 - DNA, 25 bp, Rattus norvegicus
cgcgcagacgtagcgcgcagatgct

SEQ ID NO: 464694 - DNA, 25 bp, Rattus norvegicus
aaccttgtgcagatggccgtggtgc

SEQ ID NO: 464695 - DNA, 25 bp, Rattus norvegicus
ggcccatcgcgaaccttgtgcagat

SEQ ID NO: 464696 - DNA, 25 bp, Rattus norvegicus
tcgcagggcccatcgcgaaccttgt

SEQ ID NO: 464697 - DNA, 25 bp, Rattus norvegicus
cgactcgcacacaccaggccagggc

SEQ ID NO: 464698 - DNA, 25 bp, Rattus norvegicus
cccgtgtgtctgtctggggaaaaga

SEQ ID NO: 464699 - DNA, 25 bp, Rattus norvegicus
aaagaggcttgggtgacagaccaga

SEQ ID NO: 464700 - DNA, 25 bp, Rattus norvegicus
gaagagttagccagctggactcgca

SEQ ID NO: 464701 - DNA, 25 bp, Rattus norvegicus
ggactcgcagtctcactccctgatt

SEQ ID NO: 464702 - DNA, 25 bp, Rattus norvegicus
actccctgatttctcggcggcggga

SEQ ID NO: 464703 - DNA, 25 bp, Rattus norvegicus
gccaggcagattggtcgtcaccctc

SEQ ID NO: 464704 - DNA, 25 bp, Rattus norvegicus
tcaccctcgctagtgagttgcgaaa

SEQ ID NO: 464705 - DNA, 25 bp, Rattus norvegicus
gttgcgaaagcttgtgcgcccagca

SEQ ID NO: 464706 - DNA, 25 bp, Rattus norvegicus
cgcccagcagagtggcgagccgtct

SEQ ID NO: 464707 - DNA, 25 bp, Rattus norvegicus
gagccgtctccggtggttctgtcct

SEQ ID NO: 464708 - DNA, 25 bp, Rattus norvegicus
attccgcgttgtttcctagcgctcg

SEQ ID NO: 464709 - DNA, 25 bp, Rattus norvegicus
gcggggatccgcgtgtccatcccat

SEQ ID NO: 464710 - DNA, 25 bp, Rattus norvegicus
tcgggtccggaacaatcctgggaga

SEQ ID NO: 464711 - DNA, 25 bp, Rattus norvegicus
gcggagcccaagacccggcttgcaa

SEQ ID NO: 464712 - DNA, 25 bp, Rattus norvegicus
cagcggtacccgagctctgcgcagt

SEQ ID NO: 464713 - DNA, 25 bp, Rattus norvegicus
tagccgttcctgtcaaccgtgagcg

SEQ ID NO: 464714 - DNA, 25 bp, Rattus norvegicus
gacctacacgtagccgttcctgtca

SEQ ID NO: 464715 - DNA, 25 bp, Rattus norvegicus
gcacatcaggcaggacctacacgta

SEQ ID NO: 464716 - DNA, 25 bp, Rattus norvegicus
ggccgcgcacatcaggcaggaccta

SEQ ID NO: 464717 - DNA, 25 bp, Rattus norvegicus
ttccagagcgtcgtgcgtgacgccc

SEQ ID NO: 464718 - DNA, 25 bp, Rattus norvegicus
gagctctgcgcagttgtgccagccc

SEQ ID NO: 464719 - DNA, 25 bp, Rattus norvegicus
tggctccctgtcaggagcaaccggc

SEQ ID NO: 464720 - DNA, 25 bp, Rattus norvegicus
tctgagcaggaagtggctccctgtc

SEQ ID NO: 464721 - DNA, 25 bp, Rattus norvegicus
gggacgtgagccaggcgtccaccca

SEQ ID NO: 464722 - DNA, 25 bp, Rattus norvegicus
aggtgattcccaagccgcggctcag

SEQ ID NO: 464723 - DNA, 25 bp, Rattus norvegicus
cttgcgtctgcgcagagctgagccg

SEQ ID NO: 464724 - DNA, 25 bp, Rattus norvegicus
gcggggctttaggtgattcccaagc

SEQ ID NO: 464725 - DNA, 25 bp, Rattus norvegicus
cgcagtgcttgcgtctgcgcagagc

SEQ ID NO: 464726 - DNA, 25 bp, Rattus norvegicus
ggcgcagccatatctgggcaaaata

SEQ ID NO: 464727 - DNA, 25 bp, Rattus norvegicus
gcaaaatattcagctgtcgccgccg

SEQ ID NO: 464728 - DNA, 25 bp, Rattus norvegicus
ccgccgccgagaagggactgagcac

SEQ ID NO: 464729 - DNA, 25 bp, Rattus norvegicus
ctgagcacggctccctctataaata

SEQ ID NO: 464730 - DNA, 25 bp, Rattus norvegicus
aatagccgccgcctcgggtggcctt

SEQ ID NO: 464731 - DNA, 25 bp, Rattus norvegicus
ctgaagatccggtcgctggcgctaa

SEQ ID NO: 464732 - DNA, 25 bp, Rattus norvegicus
ggcgctaagcgttcccgtagcctga

SEQ ID NO: 464733 - DNA, 25 bp, Rattus norvegicus
cctgacgcgcgcgaccctagttaga

SEQ ID NO: 464734 - DNA, 25 bp, Rattus norvegicus
cctagttagagtgcccggggctcta

SEQ ID NO: 464735 - DNA, 25 bp, Rattus norvegicus
ggctctagacctggtcgcctaggga

SEQ ID NO: 464736 - DNA, 25 bp, Rattus norvegicus
tcgcctagggaccttgggagcctcc

SEQ ID NO: 464737 - DNA, 25 bp, Rattus norvegicus
catcggcactttgcgagctgggtac

SEQ ID NO: 464738 - DNA, 25 bp, Rattus norvegicus
ttcccaaactgctggaactagcgag

SEQ ID NO: 464739 - DNA, 25 bp, Rattus norvegicus
aactagcgaggtttatagcgttgcg

SEQ ID NO: 464740 - DNA, 25 bp, Rattus norvegicus
gggatcgttgcagcccggataattt

SEQ ID NO: 464741 - DNA, 25 bp, Rattus norvegicus
tccggaaggtcccagagtggaaagc

SEQ ID NO: 464742 - DNA, 25 bp, Rattus norvegicus
cgcgtgcgtagaaagtccctgaaac

SEQ ID NO: 464743 - DNA, 25 bp, Rattus norvegicus
tgaaacgtcacctatctccggaagt

SEQ ID NO: 464744 - DNA, 25 bp, Rattus norvegicus
cgggaaaatactgctgggcctgtgc

SEQ ID NO: 464745 - DNA, 25 bp, Rattus norvegicus
ttttcccgagacgtctacagccaga

SEQ ID NO: 464746 - DNA, 25 bp, Rattus norvegicus
ggataatttagctcgccgtccggaa

SEQ ID NO: 464747 - DNA, 25 bp, Rattus norvegicus
gccaccgcacccaggtgagagttga

SEQ ID NO: 464748 - DNA, 25 bp, Rattus norvegicus
gccctcggtctctagggaacaaata

SEQ ID NO: 464749 - DNA, 25 bp, Rattus norvegicus
tccggcgacactgaagacttaatcc

SEQ ID NO: 464750 - DNA, 25 bp, Rattus norvegicus
tccctcactactgatcgtggaaacg

SEQ ID NO: 464751 - DNA, 25 bp, Rattus norvegicus
cgagaacacgtacccgcaataccta

SEQ ID NO: 464752 - DNA, 25 bp, Rattus norvegicus
tgcgcatcagcaagcagcatgtcgc

SEQ ID NO: 464753 - DNA, 25 bp, Rattus norvegicus
ggaagtctccaaagtcgtcggcgca

SEQ ID NO: 464754 - DNA, 25 bp, Rattus norvegicus
gtttctcctcgggttctgtctgtca

SEQ ID NO: 464755 - DNA, 25 bp, Rattus norvegicus
tcgcagcctttgctgtctctgccta

SEQ ID NO: 464756 - DNA, 25 bp, Rattus norvegicus
ttggcctgcccacaggtatacatcg

SEQ ID NO: 464757 - DNA, 25 bp, Rattus norvegicus
gtgagcctgtggaatatcctccgca

SEQ ID NO: 464758 - DNA, 25 bp, Rattus norvegicus
aagtcccggactttgcttgcggcgg

SEQ ID NO: 464759 - DNA, 25 bp, Rattus norvegicus
tcggcaaagacctgtccaaggtgtc

SEQ ID NO: 464760 - DNA, 25 bp, Rattus norvegicus
gggtcccagatgttggagcactaca

SEQ ID NO: 464761 - DNA, 25 bp, Rattus norvegicus
tggtacccactcagggccacctgtt

SEQ ID NO: 464762 - DNA, 25 bp, Rattus norvegicus
agctggagtacagcagcctcctgga

SEQ ID NO: 464763 - DNA, 25 bp, Rattus norvegicus
cgagccgctcaacacgctgcagagg

SEQ ID NO: 464764 - DNA, 25 bp, Rattus norvegicus
gtcgatgcccgtgcagctcaacgag

SEQ ID NO: 464765 - DNA, 25 bp, Rattus norvegicus
gggatgcaagcccttcaacccggtc

SEQ ID NO: 464766 - DNA, 25 bp, Rattus norvegicus
agacctacgagtgtgagcggcctga

SEQ ID NO: 464767 - DNA, 25 bp, Rattus norvegicus
ggggtttccgttttatcagcgagca

SEQ ID NO: 464768 - DNA, 25 bp, Rattus norvegicus
gaaggctagggatgcggtcccaaac

SEQ ID NO: 464769 - DNA, 25 bp, Rattus norvegicus
taacacactccgtaaacagcgcacg

SEQ ID NO: 464770 - DNA, 25 bp, Rattus norvegicus
catcgctaacacactccgtaaacag

SEQ ID NO: 464771 - DNA, 25 bp, Rattus norvegicus
ctccgctgtcgccatcgctaacaca

SEQ ID NO: 464772 - DNA, 25 bp, Rattus norvegicus
cggtgacgtccgcttctcctccgct

SEQ ID NO: 464773 - DNA, 25 bp, Rattus norvegicus
gcttccgctccacgctcgcgcgtac

SEQ ID NO: 464774 - DNA, 25 bp, Rattus norvegicus
ctggcgcagcatcagcgcccgctgc

SEQ ID NO: 464775 - DNA, 25 bp, Rattus norvegicus
gatgaaggctatgcgcgcgcccgta

SEQ ID NO: 464776 - DNA, 25 bp, Rattus norvegicus
tgcggtcccaaacccgccggatgaa

SEQ ID NO: 464777 - DNA, 25 bp, Rattus norvegicus
ctgccaagacgcagtgggaaggcta

SEQ ID NO: 464778 - DNA, 25 bp, Rattus norvegicus
ctggagtcggctgccaagacgcagt

SEQ ID NO: 464779 - DNA, 25 bp, Rattus norvegicus
acaccgagctggagtcggctgccaa

SEQ ID NO: 464780 - DNA, 25 bp, Rattus norvegicus
agctgttcccgcacaccgagctgga

SEQ ID NO: 464781 - DNA, 25 bp, Rattus norvegicus
aacccgccggatgaaggctatgcgc

SEQ ID NO: 464782 - DNA, 25 bp, Rattus norvegicus
tccggactctgcacaacacccagcg

SEQ ID NO: 464783 - DNA, 25 bp, Rattus norvegicus
ccagcgtcctcttccggactctgca

SEQ ID NO: 464784 - DNA, 25 bp, Rattus norvegicus
acaacacccagcgtcctcttccgga

SEQ ID NO: 464785 - DNA, 25 bp, Rattus norvegicus
cggactctgcacaacacccagcgtc

SEQ ID NO: 464786 - DNA, 25 bp, Rattus norvegicus
cagcgtcctcttccggactctgcac

SEQ ID NO: 464787 - DNA, 25 bp, Rattus norvegicus
ttccggactctgcacaacacccagc

SEQ ID NO: 464788 - DNA, 25 bp, Rattus norvegicus
gtcctcttccggactctgcacaaca

SEQ ID NO: 464789 - DNA, 25 bp, Rattus norvegicus
actctgcacaacacccagcgtcctc

SEQ ID NO: 464790 - DNA, 25 bp, Rattus norvegicus
ggactctgcacaacacccagcgtcc

SEQ ID NO: 464791 - DNA, 25 bp, Rattus norvegicus
acacccagcgtcctcttccggactc

SEQ ID NO: 464792 - DNA, 25 bp, Rattus norvegicus
cgtcctcttccggactctgcacaac

SEQ ID NO: 464793 - DNA, 25 bp, Rattus norvegicus
tcctcttccggactctgcacaacac

SEQ ID NO: 464794 - DNA, 25 bp, Rattus norvegicus
tgcacaacacccagcgtcctcttcc

SEQ ID NO: 464795 - DNA, 25 bp, Rattus norvegicus
cccagcgtcctcttccggactctgc

SEQ ID NO: 464796 - DNA, 25 bp, Rattus norvegicus
gcccgcgggctgtccgcctccgtcc

SEQ ID NO: 464797 - DNA, 25 bp, Rattus norvegicus
cgccgcccagcaagcgggagaaacg

SEQ ID NO: 464798 - DNA, 25 bp, Rattus norvegicus
cccagcaagcgggagaaacgccgcg

SEQ ID NO: 464799 - DNA, 25 bp, Rattus norvegicus
cggctctcacgctcggctccgggcc

SEQ ID NO: 464800 - DNA, 25 bp, Rattus norvegicus
agcgttgtgcaaggccgcgcgagcg

SEQ ID NO: 464801 - DNA, 25 bp, Rattus norvegicus
agacgcggcgcttatccgggagcgt

SEQ ID NO: 464802 - DNA, 25 bp, Rattus norvegicus
tagggcggtaattgcccggagacgc

SEQ ID NO: 464803 - DNA, 25 bp, Rattus norvegicus
ctccctgggtggttgcgagtccctc

SEQ ID NO: 464804 - DNA, 25 bp, Rattus norvegicus
cgctccctgggtggttgcgagtccc

SEQ ID NO: 464805 - DNA, 25 bp, Rattus norvegicus
ggccgtctcggtcggcccgcgctcc

SEQ ID NO: 464806 - DNA, 25 bp, Rattus norvegicus
gcgttgtgaaatcgcggggcgcgct

SEQ ID NO: 464807 - DNA, 25 bp, Rattus norvegicus
cccgactgcgcgttgtgaaatcgcg

SEQ ID NO: 464808 - DNA, 25 bp, Rattus norvegicus
ggcgtggcctgtccgtgacgtcagc

SEQ ID NO: 464809 - DNA, 25 bp, Rattus norvegicus
gtggttgcgagtccctcggcctctg

SEQ ID NO: 464810 - DNA, 25 bp, Rattus norvegicus
aatcgaattggcgttcgcgggccag

SEQ ID NO: 464811 - DNA, 25 bp, Rattus norvegicus
caaggtctcggcctggtccaggctg

SEQ ID NO: 464812 - DNA, 25 bp, Rattus norvegicus
agaaccaccctagcgagggagcgcc

SEQ ID NO: 464813 - DNA, 25 bp, Rattus norvegicus
cgtggagaaccaccctagcgaggga

SEQ ID NO: 464814 - DNA, 25 bp, Rattus norvegicus
gctgaaagcgtggagaaccacccta

SEQ ID NO: 464815 - DNA, 25 bp, Rattus norvegicus
tgaagcattaggagctgaaagcgtg

SEQ ID NO: 464816 - DNA, 25 bp, Rattus norvegicus
cctgggtgaagcattaggagctgaa

SEQ ID NO: 464817 - DNA, 25 bp, Rattus norvegicus
tgaagcctttgatgtcctgggtgaa

SEQ ID NO: 464818 - DNA, 25 bp, Rattus norvegicus
tggagctgaagcctttgatgtcctg

SEQ ID NO: 464819 - DNA, 25 bp, Rattus norvegicus
ggaggctgaaaaggcgctgtccacc

SEQ ID NO: 464820 - DNA, 25 bp, Rattus norvegicus
accttctccttcgcagagctgcgga

SEQ ID NO: 464821 - DNA, 25 bp, Rattus norvegicus
ggcttggcgctctgagccaccttct

SEQ ID NO: 464822 - DNA, 25 bp, Rattus norvegicus
cgcgtgatggagctgaagcctttga

SEQ ID NO: 464823 - DNA, 25 bp, Rattus norvegicus
agcgcccgcaaggtctcggcctggt

SEQ ID NO: 464824 - DNA, 25 bp, Rattus norvegicus
agtgctctccgtgccagccgcgaag

SEQ ID NO: 464825 - DNA, 25 bp, Rattus norvegicus
gaccgcggcgccatgacagccgaga

SEQ ID NO: 464826 - DNA, 25 bp, Rattus norvegicus
ggggaagccgccgtacagctacatc

SEQ ID NO: 464827 - DNA, 25 bp, Rattus norvegicus
cgcactcatcgcgatggctatcgcg

SEQ ID NO: 464828 - DNA, 25 bp, Rattus norvegicus
atcgcgatggctatcgcgcacgcgc

SEQ ID NO: 464829 - DNA, 25 bp, Rattus norvegicus
actctgggcggcatctacaagttca

SEQ ID NO: 464830 - DNA, 25 bp, Rattus norvegicus
cctacccggcgtacatgcatgatgc

SEQ ID NO: 464831 - DNA, 25 bp, Rattus norvegicus
acatgcatgatgcagccgctgctgc

SEQ ID NO: 464832 - DNA, 25 bp, Rattus norvegicus
acccgggagccgtctatgcgggcta

SEQ ID NO: 464833 - DNA, 25 bp, Rattus norvegicus
tcttcggcttggttcccgagcggcc

SEQ ID NO: 464834 - DNA, 25 bp, Rattus norvegicus
catcagcagccggaggttcgtgcgc

SEQ ID NO: 464835 - DNA, 25 bp, Rattus norvegicus
ttccagcccgcggtatgcacgggcg

SEQ ID NO: 464836 - DNA, 25 bp, Rattus norvegicus
gcgcttcccgttctaccgcgacaac

SEQ ID NO: 464837 - DNA, 25 bp, Rattus norvegicus
aacttcaaggaccctctggcccgtg

SEQ ID NO: 464838 - DNA, 25 bp, Rattus norvegicus
agagtcagcgttcaagagagaggca

SEQ ID NO: 464839 - DNA, 25 bp, Rattus norvegicus
acgggtgtaaggatcctggaagact

SEQ ID NO: 464840 - DNA, 25 bp, Rattus norvegicus
tttgctgagacgctggccatgggaa

SEQ ID NO: 464841 - DNA, 25 bp, Rattus norvegicus
ttacacacctcctgtgggccgcgtg

SEQ ID NO: 464842 - DNA, 25 bp, Rattus norvegicus
tgagggccacaacagcccttacaca

SEQ ID NO: 464843 - DNA, 25 bp, Rattus norvegicus
aagaggaccggaaggctgagtcttc

SEQ ID NO: 464844 - DNA, 25 bp, Rattus norvegicus
taaggatcctggaagactgggaccg

SEQ ID NO: 464845 - DNA, 25 bp, Rattus norvegicus
aggcaactctgagggaactgcgtgt

SEQ ID NO: 464846 - DNA, 25 bp, Rattus norvegicus
ggccatgggaagagtcagcgttcaa

SEQ ID NO: 464847 - DNA, 25 bp, Rattus norvegicus
ctttggcgtttgctgagacgctggc

SEQ ID NO: 464848 - DNA, 25 bp, Rattus norvegicus
atcctgccgcgtgggctttggcgtt

SEQ ID NO: 464849 - DNA, 25 bp, Rattus norvegicus
tcttcgcatcctgccgcgtgggctt

SEQ ID NO: 464850 - DNA, 25 bp, Rattus norvegicus
aaggctgagtcttcgcatcctgccg

SEQ ID NO: 464851 - DNA, 25 bp, Rattus norvegicus
accgtgggctgagggccacaacagc

SEQ ID NO: 464852 - DNA, 25 bp, Rattus norvegicus
gcctggccacgtgatccttactttg

SEQ ID NO: 464853 - DNA, 25 bp, Rattus norvegicus
gatgtactcgcaaagatacccttga

SEQ ID NO: 464854 - DNA, 25 bp, Rattus norvegicus
ctttggcggcaaggacaagaacaca

SEQ ID NO: 464855 - DNA, 25 bp, Rattus norvegicus
aagaacacacgtcaggcagctcgcg

SEQ ID NO: 464856 - DNA, 25 bp, Rattus norvegicus
gctcgcgttcttctcggcagggaag

SEQ ID NO: 464857 - DNA, 25 bp, Rattus norvegicus
agccggcaatctagcttagggcgcg

SEQ ID NO: 464858 - DNA, 25 bp, Rattus norvegicus
gcgcggcctgtttcctagaagttac

SEQ ID NO: 464859 - DNA, 25 bp, Rattus norvegicus
gttacctgtctccagggccggctga

SEQ ID NO: 464860 - DNA, 25 bp, Rattus norvegicus
ctgcttctccaagccgcgcatggtt

SEQ ID NO: 464861 - DNA, 25 bp, Rattus norvegicus
gaacgacctcaatggcggcccagta

SEQ ID NO: 464862 - DNA, 25 bp, Rattus norvegicus
taatacgtcactcccgttggccttg

SEQ ID NO: 464863 - DNA, 25 bp, Rattus norvegicus
gggacgtgtggctaaagatgtactc

SEQ ID NO: 464864 - DNA, 25 bp, Rattus norvegicus
tacccttgaattgtgagcggcctcg

SEQ ID NO: 464865 - DNA, 25 bp, Rattus norvegicus
gacagcatgcagtgtgccctccgaa

SEQ ID NO: 464866 - DNA, 25 bp, Rattus norvegicus
gcgcaaagcgcctaccgcgagctat

SEQ ID NO: 464867 - DNA, 25 bp, Rattus norvegicus
ccctgggaccacaaagtgggatgtt

SEQ ID NO: 464868 - DNA, 25 bp, Rattus norvegicus
tggacacctagcagggctcctcgaa

SEQ ID NO: 464869 - DNA, 25 bp, Rattus norvegicus
atcgccttaagtgacccggtactgg

SEQ ID NO: 464870 - DNA, 25 bp, Rattus norvegicus
ccgcagacaatgagcgagagacttg

SEQ ID NO: 464871 - DNA, 25 bp, Rattus norvegicus
tgctttacaggtcggcagctttacg

SEQ ID NO: 464872 - DNA, 25 bp, Rattus norvegicus
gaccacggggttacttagcactagc

SEQ ID NO: 464873 - DNA, 25 bp, Rattus norvegicus
gaccatccatcctctgctttacagg

SEQ ID NO: 464874 - DNA, 25 bp, Rattus norvegicus
ggctgctcattgttcggggacttga

SEQ ID NO: 464875 - DNA, 25 bp, Rattus norvegicus
aggctgcagtctctgcgggttcttc

SEQ ID NO: 464876 - DNA, 25 bp, Rattus norvegicus
cgggttcttcctgcaccgttcagct

SEQ ID NO: 464877 - DNA, 25 bp, Rattus norvegicus
tagctagcacttcggtccctccggg

SEQ ID NO: 464878 - DNA, 25 bp, Rattus norvegicus
cccatgtgtctcaagccttgcagtg

SEQ ID NO: 464879 - DNA, 25 bp, Rattus norvegicus
agcttctggccaccgtctgagagac

SEQ ID NO: 464880 - DNA, 25 bp, Rattus norvegicus
cagaaaccgcgctctggccaagggc

SEQ ID NO: 464881 - DNA, 25 bp, Rattus norvegicus
gcgcatgatccgcactgccaaggta

SEQ ID NO: 464882 - DNA, 25 bp, Rattus norvegicus
cttagatgtggccaagcgcatgatc

SEQ ID NO: 464883 - DNA, 25 bp, Rattus norvegicus
ggccagaaccaccaaggagacttag

SEQ ID NO: 464884 - DNA, 25 bp, Rattus norvegicus
catcatcgcggagatcggccagaac

SEQ ID NO: 464885 - DNA, 25 bp, Rattus norvegicus
agcacccgtgcttcatcatcgcgga

SEQ ID NO: 464886 - DNA, 25 bp, Rattus norvegicus
gttaagcaccatgccgctggagctg

SEQ ID NO: 464887 - DNA, 25 bp, Rattus norvegicus
cgaacaggcgcggttaagcaccatg

SEQ ID NO: 464888 - DNA, 25 bp, Rattus norvegicus
cccgctttctgcagaggagggctcc

SEQ ID NO: 464889 - DNA, 25 bp, Rattus norvegicus
tgtagaggagaccagcagaaaccgc

SEQ ID NO: 464890 - DNA, 25 bp, Rattus norvegicus
ctttcctgtacactctctgtagagg

SEQ ID NO: 464891 - DNA, 25 bp, Rattus norvegicus
cggcgaccaccggattcgaactttg

SEQ ID NO: 464892 - DNA, 25 bp, Rattus norvegicus
gttccgtctcagaatcggcgaccac

SEQ ID NO: 464893 - DNA, 25 bp, Rattus norvegicus
ctccgattggctgtggagagagacc

SEQ ID NO: 464894 - DNA, 25 bp, Rattus norvegicus
tggtcccagcccgagtcaaaacgct

SEQ ID NO: 464895 - DNA, 25 bp, Rattus norvegicus
cagcagcgagcagcgtacagtcagc

SEQ ID NO: 464896 - DNA, 25 bp, Rattus norvegicus
ctcggactgagcatgcgtctgcaga

SEQ ID NO: 464897 - DNA, 25 bp, Rattus norvegicus
agcacctgacgcagcgagtcgaatc

SEQ ID NO: 464898 - DNA, 25 bp, Rattus norvegicus
cccagtagtggcgtcccgctgcgaa

SEQ ID NO: 464899 - DNA, 25 bp, Rattus norvegicus
tgtcgtaacgcttcacgcaccacga

SEQ ID NO: 464900 - DNA, 25 bp, Rattus norvegicus
aggcccagtactccatgtcgtaacg

SEQ ID NO: 464901 - DNA, 25 bp, Rattus norvegicus
ctggcagtcgtggaaggcccagtac

SEQ ID NO: 464902 - DNA, 25 bp, Rattus norvegicus
agccgcagacggcttcgctggcagt

SEQ ID NO: 464903 - DNA, 25 bp, Rattus norvegicus
tcgtagtccaggaagacgccgagcc

SEQ ID NO: 464904 - DNA, 25 bp, Rattus norvegicus
gaatgccggcctcgtagtccaggaa

SEQ ID NO: 464905 - DNA, 25 bp, Rattus norvegicus
ccacgtcgtagaaggtcagaatgcc

SEQ ID NO: 464906 - DNA, 25 bp, Rattus norvegicus
atggggtcctcctacctcggactga

SEQ ID NO: 464907 - DNA, 25 bp, Rattus norvegicus
tacagtcagcccgtcggtcgacagg

SEQ ID NO: 464908 - DNA, 25 bp, Rattus norvegicus
ccgtccttgcttagtgatgatcatc

SEQ ID NO: 464909 - DNA, 25 bp, Rattus norvegicus
ggttgaacttggaccacaacaggtg

SEQ ID NO: 464910 - DNA, 25 bp, Rattus norvegicus
acaacaggtggttgctgagcgcgac

SEQ ID NO: 464911 - DNA, 25 bp, Rattus norvegicus
cagcgtagccatccaccggcgggta

SEQ ID NO: 464912 - DNA, 25 bp, Rattus norvegicus
ggcaccaaggcgctcccagaatagg

SEQ ID NO: 464913 - DNA, 25 bp, Rattus norvegicus
caggctgctaactgcccggcgatcg

SEQ ID NO: 464914 - DNA, 25 bp, Rattus norvegicus
gcccgactccggataaaagaagcga

SEQ ID NO: 464915 - DNA, 25 bp, Rattus norvegicus
agaagcgatgctgctggtccgctcc

SEQ ID NO: 464916 - DNA, 25 bp, Rattus norvegicus
cctcgtcactcggtatcggctcggt

SEQ ID NO: 464917 - DNA, 25 bp, Rattus norvegicus
gtgccggtcagcatgtctccgcagc

SEQ ID NO: 464918 - DNA, 25 bp, Rattus norvegicus
ctccacgatgcccattcgaggcggg

SEQ ID NO: 464919 - DNA, 25 bp, Rattus norvegicus
ctgctcctgggctttcttggcagca

SEQ ID NO: 464920 - DNA, 25 bp, Rattus norvegicus
tcttggcagcaggtcgctgtcacta

SEQ ID NO: 464921 - DNA, 25 bp, Rattus norvegicus
tctctgtctggtgctggttgaactt

SEQ ID NO: 464922 - DNA, 25 bp, Rattus norvegicus
tcgaccgttactcctgtgctcaatc

SEQ ID NO: 464923 - DNA, 25 bp, Rattus norvegicus
gtccagtcagactgaacgggcgccc

SEQ ID NO: 464924 - DNA, 25 bp, Rattus norvegicus
acagcgccagccacccgtccagtca

SEQ ID NO: 464925 - DNA, 25 bp, Rattus norvegicus
gttcgctgtgctccggacagcgcca

SEQ ID NO: 464926 - DNA, 25 bp, Rattus norvegicus
ccgggcgttcgctgtgctccggaca

SEQ ID NO: 464927 - DNA, 25 bp, Rattus norvegicus
acagaagagctcagccgggcgttcg

SEQ ID NO: 464928 - DNA, 25 bp, Rattus norvegicus
cgacgacagaagagctcagccgggc

SEQ ID NO: 464929 - DNA, 25 bp, Rattus norvegicus
gctgcagcgacgacagaagagctca

SEQ ID NO: 464930 - DNA, 25 bp, Rattus norvegicus
acacacaacggctgcagcgacgaca

SEQ ID NO: 464931 - DNA, 25 bp, Rattus norvegicus
agaaccgggcagagcgcacacacac

SEQ ID NO: 464932 - DNA, 25 bp, Rattus norvegicus
gtgcgctcccagaaccgggcagagc

SEQ ID NO: 464933 - DNA, 25 bp, Rattus norvegicus
gcccgcccagacctgcggtgcacgc

SEQ ID NO: 464934 - DNA, 25 bp, Rattus norvegicus
gaccgttactcctgtgctcaatctc

SEQ ID NO: 464935 - DNA, 25 bp, Rattus norvegicus
agtcagactgaacgggcgcccgcac

SEQ ID NO: 464936 - DNA, 25 bp, Rattus norvegicus
ggggtcgctgatcctagtcacacac

SEQ ID NO: 464937 - DNA, 25 bp, Rattus norvegicus
gggatgcttcctcctctaccgtttc

SEQ ID NO: 464938 - DNA, 25 bp, Rattus norvegicus
cgcgagtaacccagccaggagagga

SEQ ID NO: 464939 - DNA, 25 bp, Rattus norvegicus
atcacgactcgggtccacgggacac

SEQ ID NO: 464940 - DNA, 25 bp, Rattus norvegicus
gtcacacactgagtaggcagccgca

SEQ ID NO: 464941 - DNA, 25 bp, Rattus norvegicus
agccgcaccactatcccgttgggga

SEQ ID NO: 464942 - DNA, 25 bp, Rattus norvegicus
acagagctttgtgtgaggtcgtgac

SEQ ID NO: 464943 - DNA, 25 bp, Rattus norvegicus
ctggaggataggtcaccgagacacc

SEQ ID NO: 464944 - DNA, 25 bp, Rattus norvegicus
gagcgtctcgccctaccttgttggc

SEQ ID NO: 464945 - DNA, 25 bp, Rattus norvegicus
acgctctcgccgcagactttgggtg

SEQ ID NO: 464946 - DNA, 25 bp, Rattus norvegicus
ccttgctgagatggagacagtcacc

SEQ ID NO: 464947 - DNA, 25 bp, Rattus norvegicus
ctggatcccgcagcgagcgctctaa

SEQ ID NO: 464948 - DNA, 25 bp, Rattus norvegicus
cctcagcaggaacgccgggatgctt

SEQ ID NO: 464949 - DNA, 25 bp, Rattus norvegicus
gccaggagaggaacaatcacgactc

SEQ ID NO: 464950 - DNA, 25 bp, Rattus norvegicus
gatgcaggagagacgtgccaaacta

SEQ ID NO: 464951 - DNA, 25 bp, Rattus norvegicus
caccctacgggtgctaagcgagcta

SEQ ID NO: 464952 - DNA, 25 bp, Rattus norvegicus
tgccaaactacgtgggcgctgggtt

SEQ ID NO: 464953 - DNA, 25 bp, Rattus norvegicus
gagcacctgggaaccgacgacacct

SEQ ID NO: 464954 - DNA, 25 bp, Rattus norvegicus
cactttaaccgtgggcagggatgca

SEQ ID NO: 464955 - DNA, 25 bp, Rattus norvegicus
cttctctgaggcactttaaccgtgg

SEQ ID NO: 464956 - DNA, 25 bp, Rattus norvegicus
gcgcttcagtttaaagacaagggtc

SEQ ID NO: 464957 - DNA, 25 bp, Rattus norvegicus
cagccattggctgagtgcacgcgag

SEQ ID NO: 464958 - DNA, 25 bp, Rattus norvegicus
ttcctccgcgcagtcggccatgttg

SEQ ID NO: 464959 - DNA, 25 bp, Rattus norvegicus
tgcctaggacacttgactgcaaacc

SEQ ID NO: 464960 - DNA, 25 bp, Rattus norvegicus
cgacacctggctaggcggagccgat

SEQ ID NO: 464961 - DNA, 25 bp, Rattus norvegicus
gccagacccggaggctgtatggact

SEQ ID NO: 464962 - DNA, 25 bp, Rattus norvegicus
gccatgttgcttccttcgcctgagg

SEQ ID NO: 464963 - DNA, 25 bp, Rattus norvegicus
aggatggcgtcctctacagccgcca

SEQ ID NO: 464964 - DNA, 25 bp, Rattus norvegicus
cttacctcggtgtcatagagtcgca

SEQ ID NO: 464965 - DNA, 25 bp, Rattus norvegicus
cgggaacctaagctccagagcacca

SEQ ID NO: 464966 - DNA, 25 bp, Rattus norvegicus
gtgcgcgatcgcagctctttcctgc

SEQ ID NO: 464967 - DNA, 25 bp, Rattus norvegicus
ttctgctcgctcagaacggccgcgg

SEQ ID NO: 464968 - DNA, 25 bp, Rattus norvegicus
acctccttggtgagcggcatgaggc

SEQ ID NO: 464969 - DNA, 25 bp, Rattus norvegicus
tgcccttggccacctccttggtgag

SEQ ID NO: 464970 - DNA, 25 bp, Rattus norvegicus
gatctgctcgatggctagctccacg

SEQ ID NO: 464971 - DNA, 25 bp, Rattus norvegicus
tgactcgttgcggatctgctcgatg

SEQ ID NO: 464972 - DNA, 25 bp, Rattus norvegicus
catagagtcgcaggtccaggaagta

SEQ ID NO: 464973 - DNA, 25 bp, Rattus norvegicus
agcaccacggtctagggaatcgggc

SEQ ID NO: 464974 - DNA, 25 bp, Rattus norvegicus
gatcgcagctctttcctgctccgag

SEQ ID NO: 464975 - DNA, 25 bp, Rattus norvegicus
catgggcgactggacacttacctcg

SEQ ID NO: 464976 - DNA, 25 bp, Rattus norvegicus
cgcaggagtgactcgttgcggatct

SEQ ID NO: 464977 - DNA, 25 bp, Rattus norvegicus
tgacggatcaatcacgccgggaagg

SEQ ID NO: 464978 - DNA, 25 bp, Rattus norvegicus
gtgtcaccctgctcgcaggcgcgga

SEQ ID NO: 464979 - DNA, 25 bp, Rattus norvegicus
gtgtccgtgtcaccctgctcgcagg

SEQ ID NO: 464980 - DNA, 25 bp, Rattus norvegicus
cggcaccggcgtcccggcctccact

SEQ ID NO: 464981 - DNA, 25 bp, Rattus norvegicus
atccgagcagtccaccggcaccggc

SEQ ID NO: 464982 - DNA, 25 bp, Rattus norvegicus
gagttgcccgcctcatccgagcagt

SEQ ID NO: 464983 - DNA, 25 bp, Rattus norvegicus
acgagtggctcgtgaccaccggccg

SEQ ID NO: 464984 - DNA, 25 bp, Rattus norvegicus
ttgaccgaggctccgcggcgcagca

SEQ ID NO: 464985 - DNA, 25 bp, Rattus norvegicus
ttgcggctgttgaccgaggctccgc

SEQ ID NO: 464986 - DNA, 25 bp, Rattus norvegicus
cgctccagccgtagtggttgcggct

SEQ ID NO: 464987 - DNA, 25 bp, Rattus norvegicus
tcacctggccgcctgcatgagcgcg

SEQ ID NO: 464988 - DNA, 25 bp, Rattus norvegicus
tgagtcccggactctctccttcccg

SEQ ID NO: 464989 - DNA, 25 bp, Rattus norvegicus
gcactctcatgagtcccggactctc

SEQ ID NO: 464990 - DNA, 25 bp, Rattus norvegicus
aggaacctcacgagtggctcgtgac

SEQ ID NO: 464991 - DNA, 25 bp, Rattus norvegicus
cgcgcctgctgagtacgcgcgcgca

SEQ ID NO: 464992 - DNA, 25 bp, Rattus norvegicus
gtcgccacgctcagggctcgcccac

SEQ ID NO: 464993 - DNA, 25 bp, Rattus norvegicus
cgctccatcgtcctcgggaggaggc

SEQ ID NO: 464994 - DNA, 25 bp, Rattus norvegicus
cccgagcgctggaaccctctgtgag

SEQ ID NO: 464995 - DNA, 25 bp, Rattus norvegicus
tgagcgaccgaatctcgctgcaccg

SEQ ID NO: 464996 - DNA, 25 bp, Rattus norvegicus
caacatctatctgagcgaccgaatc

SEQ ID NO: 464997 - DNA, 25 bp, Rattus norvegicus
gcggcaccagatcaacatctatctg

SEQ ID NO: 464998 - DNA, 25 bp, Rattus norvegicus
tgtgcagcggcaccagatcaacatc

SEQ ID NO: 464999 - DNA, 25 bp, Rattus norvegicus
gtgggacgctccatcgtcctcggga

SEQ ID NO: 465000 - DNA, 25 bp, Rattus norvegicus
tgcccgccgatgctctgggagcgaa

SEQ ID NO: 465001 - DNA, 25 bp, Rattus norvegicus
gctcgcccacgtgggctccagcagg

SEQ ID NO: 465002 - DNA, 25 bp, Rattus norvegicus
cccacagcggagtgctcagcccaca

SEQ ID NO: 465003 - DNA, 25 bp, Rattus norvegicus
cgctggaaccctctgtgagtggtcg

SEQ ID NO: 465004 - DNA, 25 bp, Rattus norvegicus
aaccctctgtgagtggtcgcggagc

SEQ ID NO: 465005 - DNA, 25 bp, Rattus norvegicus
aggcgttgctggcactgctggccct

SEQ ID NO: 465006 - DNA, 25 bp, Rattus norvegicus
ccgcctttgttccgcgggcaaagtg

SEQ ID NO: 465007 - DNA, 25 bp, Rattus norvegicus
gcagctgcaccatgacacacaggta

SEQ ID NO: 465008 - DNA, 25 bp, Rattus norvegicus
atgacacacaggtaggacccgcgcc

SEQ ID NO: 465009 - DNA, 25 bp, Rattus norvegicus
tctgccaccgcttcttgcaggagga

SEQ ID NO: 465010 - DNA, 25 bp, Rattus norvegicus
accgcttcttgcaggaggaccgcgc

SEQ ID NO: 465011 - DNA, 25 bp, Rattus norvegicus
cgaggtggctgctctccatcatctc

SEQ ID NO: 465012 - DNA, 25 bp, Rattus norvegicus
acgctgctttccaccgtcctgcaga

SEQ ID NO: 465013 - DNA, 25 bp, Rattus norvegicus
gacgcgcgccgcgacaggtaagcca

SEQ ID NO: 465014 - DNA, 25 bp, Rattus norvegicus
acaggtaagccacagccgccgtttg

SEQ ID NO: 465015 - DNA, 25 bp, Rattus norvegicus
ctggggcgcctcattcctggacata

SEQ ID NO: 465016 - DNA, 25 bp, Rattus norvegicus
tcctggacataaaagggagtccttg

SEQ ID NO: 465017 - DNA, 25 bp, Rattus norvegicus
aaagggagtccttgcttggtgcagc

SEQ ID NO: 465018 - DNA, 25 bp, Rattus norvegicus
tccttgcttggtgcagcgcacaggc

SEQ ID NO: 465019 - DNA, 25 bp, Rattus norvegicus
ttcagagcgcgggtgactcaggcac

SEQ ID NO: 465020 - DNA, 25 bp, Rattus norvegicus
gtctttccctgagcaactcttacgg

SEQ ID NO: 465021 - DNA, 25 bp, Rattus norvegicus
tctttctcaaacatggcgcggggcc

SEQ ID NO: 465022 - DNA, 25 bp, Rattus norvegicus
ctggctcgcttcagctctttctcaa

SEQ ID NO: 465023 - DNA, 25 bp, Rattus norvegicus
gtcgctgcctgcttctcatcgtgtt

SEQ ID NO: 465024 - DNA, 25 bp, Rattus norvegicus
cacaaacagtggcagcgggaccatg

SEQ ID NO: 465025 - DNA, 25 bp, Rattus norvegicus
cctcgagcagttacaaagggccgga

SEQ ID NO: 465026 - DNA, 25 bp, Rattus norvegicus
aggcagaagtccagggccgctcatt

SEQ ID NO: 465027 - DNA, 25 bp, Rattus norvegicus
acgagctaccctgctgtggctggag

SEQ ID NO: 465028 - DNA, 25 bp, Rattus norvegicus
cttacgggcacacccagcgcttagt

SEQ ID NO: 465029 - DNA, 25 bp, Rattus norvegicus
aaaagagcgagcaacgtccacagtc

SEQ ID NO: 465030 - DNA, 25 bp, Rattus norvegicus
gcgatagttgagctttgccggtgca

SEQ ID NO: 465031 - DNA, 25 bp, Rattus norvegicus
agttgaaccgcggaccgtattgagg

SEQ ID NO: 465032 - DNA, 25 bp, Rattus norvegicus
gtctagggagaagaagttgaaccgc

SEQ ID NO: 465033 - DNA, 25 bp, Rattus norvegicus
cacccgccggtagagtacgagctac

SEQ ID NO: 465034 - DNA, 25 bp, Rattus norvegicus
tgcaccgagagctcgcgggtctcaa

SEQ ID NO: 465035 - DNA, 25 bp, Rattus norvegicus
tgaaagccgacccagcgcaactacg

SEQ ID NO: 465036 - DNA, 25 bp, Rattus norvegicus
cggtctcccgctgactactgaaagc

SEQ ID NO: 465037 - DNA, 25 bp, Rattus norvegicus
tcgagcttctgctagctcctacaag

SEQ ID NO: 465038 - DNA, 25 bp, Rattus norvegicus
gccatggtagatcagccgcgcctgc

SEQ ID NO: 465039 - DNA, 25 bp, Rattus norvegicus
tcggtacaggttttcggccatggta

SEQ ID NO: 465040 - DNA, 25 bp, Rattus norvegicus
aacagcacggatgggctgtaaaccc

SEQ ID NO: 465041 - DNA, 25 bp, Rattus norvegicus
cccatatctgggtgcagaaacagca

SEQ ID NO: 465042 - DNA, 25 bp, Rattus norvegicus
ggcaccgcctatacccatatctggg

SEQ ID NO: 465043 - DNA, 25 bp, Rattus norvegicus
cgggtctcaatgaaacagtggtttg

SEQ ID NO: 465044 - DNA, 25 bp, Rattus norvegicus
gaccatgcgcacgtaggagcagatg

SEQ ID NO: 465045 - DNA, 25 bp, Rattus norvegicus
cctcgccggagagaaacagcacgta

SEQ ID NO: 465046 - DNA, 25 bp, Rattus norvegicus
gtgcgcggtccatatcttcacctga

SEQ ID NO: 465047 - DNA, 25 bp, Rattus norvegicus
cacgtagagcgccagaaagaccatg

SEQ ID NO: 465048 - DNA, 25 bp, Rattus norvegicus
cccgcacagaatgaggcgcagcgga

SEQ ID NO: 465049 - DNA, 25 bp, Rattus norvegicus
ctgggcggcttagcataggcacgct

SEQ ID NO: 465050 - DNA, 25 bp, Rattus norvegicus
cctccgctagctccgagtagctgcg

SEQ ID NO: 465051 - DNA, 25 bp, Rattus norvegicus
ggccgtagagctctccgccataggc

SEQ ID NO: 465052 - DNA, 25 bp, Rattus norvegicus
aagcggatgccctcgaaggctcggc

SEQ ID NO: 465053 - DNA, 25 bp, Rattus norvegicus
aaagcgcaagcggatgccctcgaag

SEQ ID NO: 465054 - DNA, 25 bp, Rattus norvegicus
tctcaaagcgcaagcggatgccctc

SEQ ID NO: 465055 - DNA, 25 bp, Rattus norvegicus
ggctgtttctcaaagcgcaagcgga

SEQ ID NO: 465056 - DNA, 25 bp, Rattus norvegicus
tcttcctccgatggctgtttctcaa

SEQ ID NO: 465057 - DNA, 25 bp, Rattus norvegicus
agcataggcacgctcggccagcgtc

SEQ ID NO: 465058 - DNA, 25 bp, Rattus norvegicus
gctggcgggcatggcccactcctct

SEQ ID NO: 465059 - DNA, 25 bp, Rattus norvegicus
ggaagcccgcacagaatgaggcgca

SEQ ID NO: 465060 - DNA, 25 bp, Rattus norvegicus
gcttagcataggcacgctcggccag

SEQ ID NO: 465061 - DNA, 25 bp, Rattus norvegicus
actcctcttcctccgatggctgttt

SEQ ID NO: 465062 - DNA, 25 bp, Rattus norvegicus
gtccaggcttcccacccagctgtcg

SEQ ID NO: 465063 - DNA, 25 bp, Rattus norvegicus
ctttgaggtagccagacctgatttg

SEQ ID NO: 465064 - DNA, 25 bp, Rattus norvegicus
gaggtatctttgaggtagccagacc

SEQ ID NO: 465065 - DNA, 25 bp, Rattus norvegicus
gatctgattgcggagaggtatcttt

SEQ ID NO: 465066 - DNA, 25 bp, Rattus norvegicus
tctctgaattgaagatctgattgcg

SEQ ID NO: 465067 - DNA, 25 bp, Rattus norvegicus
agtattggtgcttcataaatcaatc

SEQ ID NO: 465068 - DNA, 25 bp, Rattus norvegicus
actaatcattagtattggtgcttca

SEQ ID NO: 465069 - DNA, 25 bp, Rattus norvegicus
aatcacctgcaaaactaatcattag

SEQ ID NO: 465070 - DNA, 25 bp, Rattus norvegicus
tacttcacgggtggccgcccagcgt

SEQ ID NO: 465071 - DNA, 25 bp, Rattus norvegicus
gccaccgctcccagtccaggcttcc

SEQ ID NO: 465072 - DNA, 25 bp, Rattus norvegicus
ccagacctgatttgaggaagacaag

SEQ ID NO: 465073 - DNA, 25 bp, Rattus norvegicus
gcgcgctcttggcatttaattttaa

SEQ ID NO: 465074 - DNA, 25 bp, Rattus norvegicus
cggctgcgcgctcttggcatttaat

SEQ ID NO: 465075 - DNA, 25 bp, Rattus norvegicus
ccagcgtggtgactgcgccattgaa

SEQ ID NO: 465076 - DNA, 25 bp, Rattus norvegicus
ggggaacctactccgctatctgccg

SEQ ID NO: 465077 - DNA, 25 bp, Rattus norvegicus
cgagccgagtacaagatggcgactc

SEQ ID NO: 465078 - DNA, 25 bp, Rattus norvegicus
tcgactcctccgtgacgtccgggat

SEQ ID NO: 465079 - DNA, 25 bp, Rattus norvegicus
atagccgggacccgtctatatttgg

SEQ ID NO: 465080 - DNA, 25 bp, Rattus norvegicus
acaagatggcgactctgcagtccgc

SEQ ID NO: 465081 - DNA, 25 bp, Rattus norvegicus
ccgaggggaacctactccgctatct

SEQ ID NO: 465082 - DNA, 25 bp, Rattus norvegicus
gccaaccgcccaatttagtaacatc

SEQ ID NO: 465083 - DNA, 25 bp, Rattus norvegicus
caatttagtaacatcgcctgcgtca

SEQ ID NO: 465084 - DNA, 25 bp, Rattus norvegicus
gtaacatcgcctgcgtcaatcacgc

SEQ ID NO: 465085 - DNA, 25 bp, Rattus norvegicus
aatcacgcgcctcgcgtgcgtcagc

SEQ ID NO: 465086 - DNA, 25 bp, Rattus norvegicus
ttgcccagcaccagaccgggtcgag

SEQ ID NO: 465087 - DNA, 25 bp, Rattus norvegicus
tctccgtggcgggacctggcccaga

SEQ ID NO: 465088 - DNA, 25 bp, Rattus norvegicus
cctccgtgacgtccgggatgggtat

SEQ ID NO: 465089 - DNA, 25 bp, Rattus norvegicus
acgccgtgccgcgctgaatggagac

SEQ ID NO: 465090 - DNA, 25 bp, Rattus norvegicus
ggtcgctctctagaaactcgctcta

SEQ ID NO: 465091 - DNA, 25 bp, Rattus norvegicus
cgctagggctcctgtggcataaatg

SEQ ID NO: 465092 - DNA, 25 bp, Rattus norvegicus
cataaatgacgtgccgagagagcga

SEQ ID NO: 465093 - DNA, 25 bp, Rattus norvegicus
gggaaacgtggcgacatcctagccc

SEQ ID NO: 465094 - DNA, 25 bp, Rattus norvegicus
cggcgctctcccatgagttgggatc

SEQ ID NO: 465095 - DNA, 25 bp, Rattus norvegicus
caggcactctatggagaggccgcta

SEQ ID NO: 465096 - DNA, 25 bp, Rattus norvegicus
caatccagatttcggggtcgctctc

SEQ ID NO: 465097 - DNA, 25 bp, Rattus norvegicus
ctcactttgcaacgctgacagagcg

SEQ ID NO: 465098 - DNA, 25 bp, Rattus norvegicus
ccttccgggacagcagctgtgactc

SEQ ID NO: 465099 - DNA, 25 bp, Rattus norvegicus
gtagcgtcccatggcgtcacattga

SEQ ID NO: 465100 - DNA, 25 bp, Rattus norvegicus
cgcggtttccattgtgcgtccctga

SEQ ID NO: 465101 - DNA, 25 bp, Rattus norvegicus
ttggcggcgcgaatctgagaagcct

SEQ ID NO: 465102 - DNA, 25 bp, Rattus norvegicus
agactggacgcctgcggaacctctc

SEQ ID NO: 465103 - DNA, 25 bp, Rattus norvegicus
acattgacgtctcgcattccaggca

SEQ ID NO: 465104 - DNA, 25 bp, Rattus norvegicus
gcctgagcgacagaacgtgtttcca

SEQ ID NO: 465105 - DNA, 25 bp, Rattus norvegicus
gcgcagaggctttacctaggtaacc

SEQ ID NO: 465106 - DNA, 25 bp, Rattus norvegicus
gcgacagaacgtgtttccaggcgca

SEQ ID NO: 465107 - DNA, 25 bp, Rattus norvegicus
gggtgccgacctctgagaggaaccc

SEQ ID NO: 465108 - DNA, 25 bp, Rattus norvegicus
cggccacgagcctgagcgacagaac

SEQ ID NO: 465109 - DNA, 25 bp, Rattus norvegicus
tttgacagaggtagttatttcttcc

SEQ ID NO: 465110 - DNA, 25 bp, Rattus norvegicus
gggctttgacagaggtagttatttc

SEQ ID NO: 465111 - DNA, 25 bp, Rattus norvegicus
tgttcccttcgtctgccccggagaa

SEQ ID NO: 465112 - DNA, 25 bp, Rattus norvegicus
cacacacttcaccacggggagagga

SEQ ID NO: 465113 - DNA, 25 bp, Rattus norvegicus
tgtttcacggtttcctccacacact

SEQ ID NO: 465114 - DNA, 25 bp, Rattus norvegicus
caatggtgtgtttcacggtttcctc

SEQ ID NO: 465115 - DNA, 25 bp, Rattus norvegicus
cccgggtcacaatggtgtgtttcac

SEQ ID NO: 465116 - DNA, 25 bp, Rattus norvegicus
ccattggaaactccgcggaggagcc

SEQ ID NO: 465117 - DNA, 25 bp, Rattus norvegicus
tttccaggcgcagaggctttaccta

SEQ ID NO: 465118 - DNA, 25 bp, Rattus norvegicus
caagaggacggccacgttgaccttc

SEQ ID NO: 465119 - DNA, 25 bp, Rattus norvegicus
gaccgctgctggacccgcagatgaa

SEQ ID NO: 465120 - DNA, 25 bp, Rattus norvegicus
tgctgcgcgcttcccgatcttcttc

SEQ ID NO: 465121 - DNA, 25 bp, Rattus norvegicus
agctgcgctcagtctacccctggga

SEQ ID NO: 465122 - DNA, 25 bp, Rattus norvegicus
aagctgctgcgctcgagggccatcc

SEQ ID NO: 465123 - DNA, 25 bp, Rattus norvegicus
gctcgagggccatccgtacgggctc

SEQ ID NO: 465124 - DNA, 25 bp, Rattus norvegicus
acgggctcccgctggccaagaggac

SEQ ID NO: 465125 - DNA, 25 bp, Rattus norvegicus
tgcgcctggctgcatcgctccggga

SEQ ID NO: 465126 - DNA, 25 bp, Rattus norvegicus
accgcgtccagcctgctgggagaga

SEQ ID NO: 465127 - DNA, 25 bp, Rattus norvegicus
cgtccagcctgctgggagagagccc

SEQ ID NO: 465128 - DNA, 25 bp, Rattus norvegicus
ataggagctcatcatccggcgaggg

SEQ ID NO: 465129 - DNA, 25 bp, Rattus norvegicus
atcatccggcgagggcacgtgtgct

SEQ ID NO: 465130 - DNA, 25 bp, Rattus norvegicus
tggacccgcagatgaaggcagtgcc

SEQ ID NO: 465131 - DNA, 25 bp, Rattus norvegicus
gcctgccagcactacggagtccgca

SEQ ID NO: 465132 - DNA, 25 bp, Rattus norvegicus
gagaggcaccggtctccaagcccgg

SEQ ID NO: 465133 - DNA, 25 bp, Rattus norvegicus
agttttggagtagctgtccctgcgg

SEQ ID NO: 465134 - DNA, 25 bp, Rattus norvegicus
actccatgaggacgccggtgcctaa

SEQ ID NO: 465135 - DNA, 25 bp, Rattus norvegicus
atgccctccggggtcgctatgaaga

SEQ ID NO: 465136 - DNA, 25 bp, Rattus norvegicus
ccctggtttcagttttggagtagct

SEQ ID NO: 465137 - DNA, 25 bp, Rattus norvegicus
aagtggccaagcctccctggtttca

SEQ ID NO: 465138 - DNA, 25 bp, Rattus norvegicus
caagcccggcttcgggttagtgtga

SEQ ID NO: 465139 - DNA, 25 bp, Rattus norvegicus
gacgcaccggagaggcaccggtctc

SEQ ID NO: 465140 - DNA, 25 bp, Rattus norvegicus
gtaactccgcccttagcgagaacgc

SEQ ID NO: 465141 - DNA, 25 bp, Rattus norvegicus
tgtaccgacggcctcgagcgcctag

SEQ ID NO: 465142 - DNA, 25 bp, Rattus norvegicus
ccgcgagtagaagtggccaagcctc

SEQ ID NO: 465143 - DNA, 25 bp, Rattus norvegicus
cgccctggtgactccatgaggacgc

SEQ ID NO: 465144 - DNA, 25 bp, Rattus norvegicus
ggccgtgtaactccgcccttagcga

SEQ ID NO: 465145 - DNA, 25 bp, Rattus norvegicus
gcgcactttgtaccgacggcctcga

SEQ ID NO: 465146 - DNA, 25 bp, Rattus norvegicus
gctggaactctctttcccagtaagc

SEQ ID NO: 465147 - DNA, 25 bp, Rattus norvegicus
ccagggccgctacagcgttttcttg

SEQ ID NO: 465148 - DNA, 25 bp, Rattus norvegicus
tcctgtgggcaaagtggcctgactt

SEQ ID NO: 465149 - DNA, 25 bp, Rattus norvegicus
tctgtgcctccggagaccggaacta

SEQ ID NO: 465150 - DNA, 25 bp, Rattus norvegicus
ccatgtcataggagagctggaactc

SEQ ID NO: 465151 - DNA, 25 bp, Rattus norvegicus
gtccacattgctctcactgaccatg

SEQ ID NO: 465152 - DNA, 25 bp, Rattus norvegicus
atctctaggcacgtcgggaaatgta

SEQ ID NO: 465153 - DNA, 25 bp, Rattus norvegicus
gggacaacttccagagaggcctctc

SEQ ID NO: 465154 - DNA, 25 bp, Rattus norvegicus
cagcggcgaacacccgggacaactt

SEQ ID NO: 465155 - DNA, 25 bp, Rattus norvegicus
ctcaccaggagtagcaaggagcatc

SEQ ID NO: 465156 - DNA, 25 bp, Rattus norvegicus
tacaattcccagagggttgtgcggc

SEQ ID NO: 465157 - DNA, 25 bp, Rattus norvegicus
tcgtggaccgcaggcttaagaagcc

SEQ ID NO: 465158 - DNA, 25 bp, Rattus norvegicus
ggcccagtgagggttgtacctccta

SEQ ID NO: 465159 - DNA, 25 bp, Rattus norvegicus
acagcgaaagtgaaggcagtgctcc

SEQ ID NO: 465160 - DNA, 25 bp, Rattus norvegicus
gcgaacgccaagtcctgcaagacca

SEQ ID NO: 465161 - DNA, 25 bp, Rattus norvegicus
gctccctgagcgtgttttcaaatcg

SEQ ID NO: 465162 - DNA, 25 bp, Rattus norvegicus
agaccacgccgtgtaccgcccgccg

SEQ ID NO: 465163 - DNA, 25 bp, Rattus norvegicus
cgagcgaacgccaagtcctgcaaga

SEQ ID NO: 465164 - DNA, 25 bp, Rattus norvegicus
accaggtggaaagcgagcgaacgcc

SEQ ID NO: 465165 - DNA, 25 bp, Rattus norvegicus
agacagacgccgctcaccagagaac

SEQ ID NO: 465166 - DNA, 25 bp, Rattus norvegicus
tccgcgcctcagaagggccggacag

SEQ ID NO: 465167 - DNA, 25 bp, Rattus norvegicus
agcgcggtcccttcgaggcgtttcg

SEQ ID NO: 465168 - DNA, 25 bp, Rattus norvegicus
tacgtcggcctaacacttgccaagc

SEQ ID NO: 465169 - DNA, 25 bp, Rattus norvegicus
tcgaggggagtctctagcccgaacc

SEQ ID NO: 465170 - DNA, 25 bp, Rattus norvegicus
gtgttttcaaatcgcctcgtcctca

SEQ ID NO: 465171 - DNA, 25 bp, Rattus norvegicus
ccctctaagaggggctgcgccggaa

SEQ ID NO: 465172 - DNA, 25 bp, Rattus norvegicus
ggcccgctctcacgctcccaagctg

SEQ ID NO: 465173 - DNA, 25 bp, Rattus norvegicus
gcaggcttttcgctcgctccctgag

SEQ ID NO: 465174 - DNA, 25 bp, Rattus norvegicus
atcctgaggtcggtgtacacagccc

SEQ ID NO: 465175 - DNA, 25 bp, Rattus norvegicus
cctttcgcagcttccgggccaaggt

SEQ ID NO: 465176 - DNA, 25 bp, Rattus norvegicus
aatgcgttcttttgttgttggcgga

SEQ ID NO: 465177 - DNA, 25 bp, Rattus norvegicus
catcccgggtgtgggaaaatgcgtt

SEQ ID NO: 465178 - DNA, 25 bp, Rattus norvegicus
cgggtgactgccacatcccgggtgt

SEQ ID NO: 465179 - DNA, 25 bp, Rattus norvegicus
ctcgcgctaactcgtgcgggtgact

SEQ ID NO: 465180 - DNA, 25 bp, Rattus norvegicus
cgaagaaaagggctcgcgctaactc

SEQ ID NO: 465181 - DNA, 25 bp, Rattus norvegicus
accacaaaagttggcgctgaactca

SEQ ID NO: 465182 - DNA, 25 bp, Rattus norvegicus
ctcaggagacacatcccgccgatta

SEQ ID NO: 465183 - DNA, 25 bp, Rattus norvegicus
agggtctgagtcgtatcctgaggtc

SEQ ID NO: 465184 - DNA, 25 bp, Rattus norvegicus
aggcacacagggtctgagtcgtatc

SEQ ID NO: 465185 - DNA, 25 bp, Rattus norvegicus
tcccactgagtaggcacacagggtc

SEQ ID NO: 465186 - DNA, 25 bp, Rattus norvegicus
ccttgggtcccactgagtaggcaca

SEQ ID NO: 465187 - DNA, 25 bp, Rattus norvegicus
ccgccgattagaaccacaaaagttg

SEQ ID NO: 465188 - DNA, 25 bp, Rattus norvegicus
aaggctagtgtctgtgcagcgtctc

SEQ ID NO: 465189 - DNA, 25 bp, Rattus norvegicus
aggcggtgctcgctccctagcgaca

SEQ ID NO: 465190 - DNA, 25 bp, Rattus norvegicus
caagctgctccctgaggcggtgctc

SEQ ID NO: 465191 - DNA, 25 bp, Rattus norvegicus
agctccaagctgctccctgaggcgg

SEQ ID NO: 465192 - DNA, 25 bp, Rattus norvegicus
acggtgtgagcccagctccaagctg

SEQ ID NO: 465193 - DNA, 25 bp, Rattus norvegicus
tctccacgagccgagccagggacag

SEQ ID NO: 465194 - DNA, 25 bp, Rattus norvegicus
tctgtgcagcgtctccacgagccga

SEQ ID NO: 465195 - DNA, 25 bp, Rattus norvegicus
ccggtggccaaaggctagtgtctgt

SEQ ID NO: 465196 - DNA, 25 bp, Rattus norvegicus
ggagaactacctcgcatcctgcagc

SEQ ID NO: 465197 - DNA, 25 bp, Rattus norvegicus
ggtgaggggagaactacctcgcatc

SEQ ID NO: 465198 - DNA, 25 bp, Rattus norvegicus
gccaactcagacaactccgaggtga

SEQ ID NO: 465199 - DNA, 25 bp, Rattus norvegicus
gggcgaggctctgccaactcagaca

SEQ ID NO: 465200 - DNA, 25 bp, Rattus norvegicus
ctagcaaaccggtgaggagcgaacc

SEQ ID NO: 465201 - DNA, 25 bp, Rattus norvegicus
agcaggactcaaggaacccgggcga

SEQ ID NO: 465202 - DNA, 25 bp, Rattus norvegicus
gagttcagaagcgaccagaggttgt

SEQ ID NO: 465203 - DNA, 25 bp, Rattus norvegicus
ccgtcaatgagcgcttttgcggggc

SEQ ID NO: 465204 - DNA, 25 bp, Rattus norvegicus
ctggagcgtgtgtgcgcttcggcga

SEQ ID NO: 465205 - DNA, 25 bp, Rattus norvegicus
atgggaatgtccgaggtgtgtgcgc

SEQ ID NO: 465206 - DNA, 25 bp, Rattus norvegicus
cactatgggaatgtccgaggtgtgt

SEQ ID NO: 465207 - DNA, 25 bp, Rattus norvegicus
ccgagtgtcacgtgaggcactatgg

SEQ ID NO: 465208 - DNA, 25 bp, Rattus norvegicus
gccgagtgtcacgtgaggcactatg

SEQ ID NO: 465209 - DNA, 25 bp, Rattus norvegicus
gttcagaagcgaccagaggttgtgt

SEQ ID NO: 465210 - DNA, 25 bp, Rattus norvegicus
cggagttcagaagcgaccagaggtt

SEQ ID NO: 465211 - DNA, 25 bp, Rattus norvegicus
agcgcggagttcagaagcgaccaga

SEQ ID NO: 465212 - DNA, 25 bp, Rattus norvegicus
tcagcgcggagttcagaagcgacca

SEQ ID NO: 465213 - DNA, 25 bp, Rattus norvegicus
gtcagcgcggagttcagaagcgacc

SEQ ID NO: 465214 - DNA, 25 bp, Rattus norvegicus
tcaatgagcgcttttgcggggcgga

SEQ ID NO: 465215 - DNA, 25 bp, Rattus norvegicus
ggccgagtgtcacgtgaggcactat

SEQ ID NO: 465216 - DNA, 25 bp, Rattus norvegicus
atcggcagcatgctaccggagcagc

SEQ ID NO: 465217 - DNA, 25 bp, Rattus norvegicus
ggccttggcccatgagtacaactcg

SEQ ID NO: 465218 - DNA, 25 bp, Rattus norvegicus
agtacaactcgcagcccagcgtgtc

SEQ ID NO: 465219 - DNA, 25 bp, Rattus norvegicus
gagcccgagtaccaccaggacgcag

SEQ ID NO: 465220 - DNA, 25 bp, Rattus norvegicus
ttgctctcaagcagcggacctggca

SEQ ID NO: 465221 - DNA, 25 bp, Rattus norvegicus
ccggagcagctctacttccttcaga

SEQ ID NO: 465222 - DNA, 25 bp, Rattus norvegicus
gacgcgcggactattgctctcaagc

SEQ ID NO: 465223 - DNA, 25 bp, Rattus norvegicus
caaggagaagatcggcagcatgcta

SEQ ID NO: 465224 - DNA, 25 bp, Rattus norvegicus
gcacgcacgtcctggacaaggagaa

SEQ ID NO: 465225 - DNA, 25 bp, Rattus norvegicus
gagtccgctgctgagcacgcacgtc

SEQ ID NO: 465226 - DNA, 25 bp, Rattus norvegicus
aaattatggcccacgagaggaggga

SEQ ID NO: 465227 - DNA, 25 bp, Rattus norvegicus
ttgggagaacatcaaggctcggacc

SEQ ID NO: 465228 - DNA, 25 bp, Rattus norvegicus
cagctgaagaagtgttgggagaaca

SEQ ID NO: 465229 - DNA, 25 bp, Rattus norvegicus
tgtcgctgcgggacttcaaacagct

SEQ ID NO: 465230 - DNA, 25 bp, Rattus norvegicus
ccaccggtgtagactaagggtactg

SEQ ID NO: 465231 - DNA, 25 bp, Rattus norvegicus
ccgttctgggccaccggtgtagact

SEQ ID NO: 465232 - DNA, 25 bp, Rattus norvegicus
atcaactgctcaggtaggagccgcc

SEQ ID NO: 465233 - DNA, 25 bp, Rattus norvegicus
ggcaagagcatcaactgctcaggta

SEQ ID NO: 465234 - DNA, 25 bp, Rattus norvegicus
tagactaagggtactgaggagtccc

SEQ ID NO: 465235 - DNA, 25 bp, Rattus norvegicus
ctacacgtcggtgcttctgctcttc

SEQ ID NO: 465236 - DNA, 25 bp, Rattus norvegicus
gcgagctagaggctgcgtccgtccc

SEQ ID NO: 465237 - DNA, 25 bp, Rattus norvegicus
agcctgcgagctagaggctgcgtcc

SEQ ID NO: 465238 - DNA, 25 bp, Rattus norvegicus
ccgcgcggacacaaagggaaggcga

SEQ ID NO: 465239 - DNA, 25 bp, Rattus norvegicus
gccgtctgaccagccagaaggatcc

SEQ ID NO: 465240 - DNA, 25 bp, Rattus norvegicus
acggagcagtgatcctgggtgtgct

SEQ ID NO: 465241 - DNA, 25 bp, Rattus norvegicus
ggtgcttctgctcttcgccttctgc

SEQ ID NO: 465242 - DNA, 25 bp, Rattus norvegicus
tcggcgccgtctgaccagccagaag

SEQ ID NO: 465243 - DNA, 25 bp, Rattus norvegicus
ccgtctgcggctacacgtcggtgct

SEQ ID NO: 465244 - DNA, 25 bp, Rattus norvegicus
tgctgcattccgcttgcgtgggaga

SEQ ID NO: 465245 - DNA, 25 bp, Rattus norvegicus
ataggatcgcgctctcctcctcaga

SEQ ID NO: 465246 - DNA, 25 bp, Rattus norvegicus
gggccacctgagtcgattccgtcac

SEQ ID NO: 465247 - DNA, 25 bp, Rattus norvegicus
acccaagtctgtacaggctcatctg

SEQ ID NO: 465248 - DNA, 25 bp, Rattus norvegicus
gctcatctgtgtcctaggcgccaca

SEQ ID NO: 465249 - DNA, 25 bp, Rattus norvegicus
ctgcagacaagctcctcaggcgctg

SEQ ID NO: 465250 - DNA, 25 bp, Rattus norvegicus
gtgcgcgggatcacagattcccttc

SEQ ID NO: 465251 - DNA, 25 bp, Rattus norvegicus
ttcggcgaccatccctttgctaagc

SEQ ID NO: 465252 - DNA, 25 bp, Rattus norvegicus
ctgcgcatgctcagagaggggcact

SEQ ID NO: 465253 - DNA, 25 bp, Rattus norvegicus
gcgctctctctcaggagctgaagca

SEQ ID NO: 465254 - DNA, 25 bp, Rattus norvegicus
agcatgaagcttgccgggttgtgcc

SEQ ID NO: 465255 - DNA, 25 bp, Rattus norvegicus
agtactggagactctgtggggttcc

SEQ ID NO: 465256 - DNA, 25 bp, Rattus norvegicus
gggaatcccgctacctaggtgctct

SEQ ID NO: 465257 - DNA, 25 bp, Rattus norvegicus
ttgcgccctattgggcggaccggta

SEQ ID NO: 465258 - DNA, 25 bp, Rattus norvegicus
agcttacttaagcagtcccggccgt

SEQ ID NO: 465259 - DNA, 25 bp, Rattus norvegicus
cggccgttacctaaacctgtgcact

SEQ ID NO: 465260 - DNA, 25 bp, Rattus norvegicus
aaacctgtgcactccgggaaatgta

SEQ ID NO: 465261 - DNA, 25 bp, Rattus norvegicus
atgtagttctcttgccatttacgga

SEQ ID NO: 465262 - DNA, 25 bp, Rattus norvegicus
catttacggaagaaggctgtggctc

SEQ ID NO: 465263 - DNA, 25 bp, Rattus norvegicus
ctgtggctcgctccgtgggcatgtt

SEQ ID NO: 465264 - DNA, 25 bp, Rattus norvegicus
agttagacaggttccgcgtaggctc

SEQ ID NO: 465265 - DNA, 25 bp, Rattus norvegicus
cgtaggctccgggtaacgccttctg

SEQ ID NO: 465266 - DNA, 25 bp, Rattus norvegicus
tagtgcagcttgactttgaggcgga

SEQ ID NO: 465267 - DNA, 25 bp, Rattus norvegicus
agcttgactttgaggcggaggactt

SEQ ID NO: 465268 - DNA, 25 bp, Rattus norvegicus
cttggcaacaaggaggagatattac

SEQ ID NO: 465269 - DNA, 25 bp, Rattus norvegicus
aggagatattacagggaggcccgaa

SEQ ID NO: 465270 - DNA, 25 bp, Rattus norvegicus
ttgggagttgtagttagacaggttc

SEQ ID NO: 465271 - DNA, 25 bp, Rattus norvegicus
agccaatcagatgagagcttactta

SEQ ID NO: 465272 - DNA, 25 bp, Rattus norvegicus
agtccatcgcagtggggttccagga

SEQ ID NO: 465273 - DNA, 25 bp, Rattus norvegicus
gaggccaccgcctctatagctcagg

SEQ ID NO: 465274 - DNA, 25 bp, Rattus norvegicus
gctgcgtcctggcttgccgaggcca

SEQ ID NO: 465275 - DNA, 25 bp, Rattus norvegicus
ccgtggaggcagtcagctgcgtcct

SEQ ID NO: 465276 - DNA, 25 bp, Rattus norvegicus
aggcacacccgcctggtgcagcaga

SEQ ID NO: 465277 - DNA, 25 bp, Rattus norvegicus
cgcaaacgccagagagccaggcaca

SEQ ID NO: 465278 - DNA, 25 bp, Rattus norvegicus
taggcggccgggtccgcaaacgcca

SEQ ID NO: 465279 - DNA, 25 bp, Rattus norvegicus
ggttacatccctcggcctggtgact

SEQ ID NO: 465280 - DNA, 25 bp, Rattus norvegicus
ctatgtggggctcccgggttacatc

SEQ ID NO: 465281 - DNA, 25 bp, Rattus norvegicus
ccttccttgggtcaccttcgctgga

SEQ ID NO: 465282 - DNA, 25 bp, Rattus norvegicus
tgccaggccacgtgacctgcgagct

SEQ ID NO: 465283 - DNA, 25 bp, Rattus norvegicus
ggagtagcggaaggctcgcctcctc

SEQ ID NO: 465284 - DNA, 25 bp, Rattus norvegicus
actcccgggcagctattagcgggta

SEQ ID NO: 465285 - DNA, 25 bp, Rattus norvegicus
cgttggtggcgccttcgcagaaccc

SEQ ID NO: 465286 - DNA, 25 bp, Rattus norvegicus
tttgctctgttgtccggtgctcctg

SEQ ID NO: 465287 - DNA, 25 bp, Rattus norvegicus
ataggttccttgtcctggagtttga

SEQ ID NO: 465288 - DNA, 25 bp, Rattus norvegicus
tagactcgtgatggtcgcgtttctc

SEQ ID NO: 465289 - DNA, 25 bp, Rattus norvegicus
agcccaggtttgctctgttgtccgg

SEQ ID NO: 465290 - DNA, 25 bp, Rattus norvegicus
gccctgagtggcgaggtcccatctt

SEQ ID NO: 465291 - DNA, 25 bp, Rattus norvegicus
gaggtcccatcttcccggcctgtgg

SEQ ID NO: 465292 - DNA, 25 bp, Rattus norvegicus
cctgtggcttgccacgccggaggtt

SEQ ID NO: 465293 - DNA, 25 bp, Rattus norvegicus
tgcggccagcgctttccattcaagt

SEQ ID NO: 465294 - DNA, 25 bp, Rattus norvegicus
gctttccattcaagttgcgctccct

SEQ ID NO: 465295 - DNA, 25 bp, Rattus norvegicus
ttgtttcctctctttccaggcgaga

SEQ ID NO: 465296 - DNA, 25 bp, Rattus norvegicus
tccaggcgagatccaactcagattg

SEQ ID NO: 465297 - DNA, 25 bp, Rattus norvegicus
ccaactcagattgctgcttgccata

SEQ ID NO: 465298 - DNA, 25 bp, Rattus norvegicus
tgctgcttgccataggttccttgtc

SEQ ID NO: 465299 - DNA, 25 bp, Rattus norvegicus
ggagttgctagagcccaggtttgct

SEQ ID NO: 465300 - DNA, 25 bp, Rattus norvegicus
cttagaggagcgacacaactggcca

SEQ ID NO: 465301 - DNA, 25 bp, Rattus norvegicus
tgaggtctccgcctccaaatccgga

SEQ ID NO: 465302 - DNA, 25 bp, Rattus norvegicus
aaatccggagcgcagcttccctaga

SEQ ID NO: 465303 - DNA, 25 bp, Rattus norvegicus
cgctccctgggcattccaagttgca

SEQ ID NO: 465304 - DNA, 25 bp, Rattus norvegicus
agcctagcgaacgtcggccagtgtc

SEQ ID NO: 465305 - DNA, 25 bp, Rattus norvegicus
gggctcctctgcttaacatcctctg

SEQ ID NO: 465306 - DNA, 25 bp, Rattus norvegicus
acatcctctgcaagcggggaaggcc

SEQ ID NO: 465307 - DNA, 25 bp, Rattus norvegicus
ctgtgctctcacttggctggcttct

SEQ ID NO: 465308 - DNA, 25 bp, Rattus norvegicus
ttgctgttcagttcaggcgacaccc

SEQ ID NO: 465309 - DNA, 25 bp, Rattus norvegicus
ggcgacacccacttatttactgagg

SEQ ID NO: 465310 - DNA, 25 bp, Rattus norvegicus
ttcatacacggggtgcggaaaagca

SEQ ID NO: 465311 - DNA, 25 bp, Rattus norvegicus
ctcctcattactgagacccgctggg

SEQ ID NO: 465312 - DNA, 25 bp, Rattus norvegicus
agctgccgaacctgcttcctttgca

SEQ ID NO: 465313 - DNA, 25 bp, Rattus norvegicus
gttctgttcggagcgccaaagttct

SEQ ID NO: 465314 - DNA, 25 bp, Rattus norvegicus
ggatgttggcgttctcccggtagct

SEQ ID NO: 465315 - DNA, 25 bp, Rattus norvegicus
cccctggccggccacttggtggttg

SEQ ID NO: 465316 - DNA, 25 bp, Rattus norvegicus
cgcctccgcgtcgagtcggaacttt

SEQ ID NO: 465317 - DNA, 25 bp, Rattus norvegicus
tacaggtcgggtgacctcgttgccc

SEQ ID NO: 465318 - DNA, 25 bp, Rattus norvegicus
tcccgaatacaggtcgggtgacctc

SEQ ID NO: 465319 - DNA, 25 bp, Rattus norvegicus
tctcccggtagctcccgaatacagg

SEQ ID NO: 465320 - DNA, 25 bp, Rattus norvegicus
gggtcctttgctcgcgccgaaattc

SEQ ID NO: 465321 - DNA, 25 bp, Rattus norvegicus
ttccggcacggttgttggctacggc

SEQ ID NO: 465322 - DNA, 25 bp, Rattus norvegicus
acagttccggcacggttgttggcta

SEQ ID NO: 465323 - DNA, 25 bp, Rattus norvegicus
caaagaaacagttccggcacggttg

SEQ ID NO: 465324 - DNA, 25 bp, Rattus norvegicus
gcgccgaaattcaaagaaacagttc

SEQ ID NO: 465325 - DNA, 25 bp, Rattus norvegicus
tgctcgcgccgaaattcaaagaaac

SEQ ID NO: 465326 - DNA, 25 bp, Rattus norvegicus
tcgagtcggaactttgctggtaccc

SEQ ID NO: 465327 - DNA, 25 bp, Rattus norvegicus
ccggtagctcccgaatacaggtcgg

SEQ ID NO: 465328 - DNA, 25 bp, Rattus norvegicus
cgctgctccgctgcggtctatctgg

SEQ ID NO: 465329 - DNA, 25 bp, Rattus norvegicus
tcgtgcacagggaggtggacagtgc

SEQ ID NO: 465330 - DNA, 25 bp, Rattus norvegicus
ccggctgtgcctcaggcgcctgcga

SEQ ID NO: 465331 - DNA, 25 bp, Rattus norvegicus
gcgccgccaattcccgcccagtcta

SEQ ID NO: 465332 - DNA, 25 bp, Rattus norvegicus
agtctagcacggacccaactaaagc

SEQ ID NO: 465333 - DNA, 25 bp, Rattus norvegicus
gcacggacccaactaaagctgagga

SEQ ID NO: 465334 - DNA, 25 bp, Rattus norvegicus
cccaactaaagctgaggagcacaca

SEQ ID NO: 465335 - DNA, 25 bp, Rattus norvegicus
ctgaggagcacacaaggaagcggaa

SEQ ID NO: 465336 - DNA, 25 bp, Rattus norvegicus
gaaagagcgcgtgtcccgctgctcc

SEQ ID NO: 465337 - DNA, 25 bp, Rattus norvegicus
gtctatctgggcagcaccatgctcg

SEQ ID NO: 465338 - DNA, 25 bp, Rattus norvegicus
atctgggcagcaccatgctcgcgct

SEQ ID NO: 465339 - DNA, 25 bp, Rattus norvegicus
tgctcgcgctccgaagcggcctgag

SEQ ID NO: 465340 - DNA, 25 bp, Rattus norvegicus
gctctgacgcctcaggtagggaccg

SEQ ID NO: 465341 - DNA, 25 bp, Rattus norvegicus
gcacacaaggaagcggaaagagcgc

SEQ ID NO: 465342 - DNA, 25 bp, Rattus norvegicus
tgccgcgactagttccttttataga

SEQ ID NO: 465343 - DNA, 25 bp, Rattus norvegicus
ttgagctgagccagggactccgcat

SEQ ID NO: 465344 - DNA, 25 bp, Rattus norvegicus
ccttttatagattcggctgtgccga

SEQ ID NO: 465345 - DNA, 25 bp, Rattus norvegicus
ttactaccggtcaaacgctgttctc

SEQ ID NO: 465346 - DNA, 25 bp, Rattus norvegicus
tcccggcctctgtttatgtagttca

SEQ ID NO: 465347 - DNA, 25 bp, Rattus norvegicus
gttcagtcactcagcagaaagcacg

SEQ ID NO: 465348 - DNA, 25 bp, Rattus norvegicus
gaaagcacgtggagctatggcccgc

SEQ ID NO: 465349 - DNA, 25 bp, Rattus norvegicus
tgcaagcttcgtggggtccgctttc

SEQ ID NO: 465350 - DNA, 25 bp, Rattus norvegicus
ggccctgacctgctagcttcgggta

SEQ ID NO: 465351 - DNA, 25 bp, Rattus norvegicus
cgggaaactccggacttgagctgag

SEQ ID NO: 465352 - DNA, 25 bp, Rattus norvegicus
ctcgctcgctctcggaattactggt

SEQ ID NO: 465353 - DNA, 25 bp, Rattus norvegicus
ccagctttgcgctgagccgcagaga

SEQ ID NO: 465354 - DNA, 25 bp, Rattus norvegicus
agccgcagagacagaagtgggctct

SEQ ID NO: 465355 - DNA, 25 bp, Rattus norvegicus
gaattactggtttttgccgcgacta

SEQ ID NO: 465356 - DNA, 25 bp, Rattus norvegicus
cacctctctccgctgaagcgaatgg

SEQ ID NO: 465357 - DNA, 25 bp, Rattus norvegicus
agttcagagaatgtcgccggccatg

SEQ ID NO: 465358 - DNA, 25 bp, Rattus norvegicus
ctctccgctgaagcgaatggcgagc

SEQ ID NO: 465359 - DNA, 25 bp, Rattus norvegicus
agctcaccagcggagaccgcggtaa

SEQ ID NO: 465360 - DNA, 25 bp, Rattus norvegicus
agaccgcggtaaatgatcgagctcc

SEQ ID NO: 465361 - DNA, 25 bp, Rattus norvegicus
aatgatcgagctccgaaaccctgcg

SEQ ID NO: 465362 - DNA, 25 bp, Rattus norvegicus
agctccgaaaccctgcgccgagaag

SEQ ID NO: 465363 - DNA, 25 bp, Rattus norvegicus
tggaactcaagacccgagcgcgctt

SEQ ID NO: 465364 - DNA, 25 bp, Rattus norvegicus
tcttcagcgaacttgaccggtcctg

SEQ ID NO: 465365 - DNA, 25 bp, Rattus norvegicus
ttgaccggtcctgctaactctagtt

SEQ ID NO: 465366 - DNA, 25 bp, Rattus norvegicus
gctaactctagttcaggtgctcaga

SEQ ID NO: 465367 - DNA, 25 bp, Rattus norvegicus
tagttcaggtgctcagagcctcctg

SEQ ID NO: 465368 - DNA, 25 bp, Rattus norvegicus
aagctcgccgcactctcgaccgagg

SEQ ID NO: 465369 - DNA, 25 bp, Rattus norvegicus
ctgctcctggaactcaagacccgag

SEQ ID NO: 465370 - DNA, 25 bp, Rattus norvegicus
gggaagaagtagagctgtttatttg

SEQ ID NO: 465371 - DNA, 25 bp, Rattus norvegicus
ggaaggggcatcgatctgatctatc

SEQ ID NO: 465372 - DNA, 25 bp, Rattus norvegicus
ctctcggaggaaggggcatcgatct

SEQ ID NO: 465373 - DNA, 25 bp, Rattus norvegicus
tctactcttggctctcggaggaagg

SEQ ID NO: 465374 - DNA, 25 bp, Rattus norvegicus
agactatctactcttggctctcgga

SEQ ID NO: 465375 - DNA, 25 bp, Rattus norvegicus
acatcaccagactatctactcttgg

SEQ ID NO: 465376 - DNA, 25 bp, Rattus norvegicus
tttattggtcttcgaagaagaaaca

SEQ ID NO: 465377 - DNA, 25 bp, Rattus norvegicus
cacattttgggaagaagtagagctg

SEQ ID NO: 465378 - DNA, 25 bp, Rattus norvegicus
ttggggttgcacattttgggaagaa

SEQ ID NO: 465379 - DNA, 25 bp, Rattus norvegicus
ggcgcagtgtctgcggactgtgtgc

SEQ ID NO: 465380 - DNA, 25 bp, Rattus norvegicus
tggcagcgcgcctggcgcccaccag

SEQ ID NO: 465381 - DNA, 25 bp, Rattus norvegicus
ttgccaccaccacgtggcgaggggc

SEQ ID NO: 465382 - DNA, 25 bp, Rattus norvegicus
gcggttgccaccaccacgtggcgag

SEQ ID NO: 465383 - DNA, 25 bp, Rattus norvegicus
gaagaagaaacatcaccagactatc

SEQ ID NO: 465384 - DNA, 25 bp, Rattus norvegicus
caaagttgccgcctttgcggagtcc

SEQ ID NO: 465385 - DNA, 25 bp, Rattus norvegicus
tgctggcgcagacaatgccgggacc

SEQ ID NO: 465386 - DNA, 25 bp, Rattus norvegicus
acaatgccgggacctggtaccctgc

SEQ ID NO: 465387 - DNA, 25 bp, Rattus norvegicus
ggtaccctgcactggaccggacact

SEQ ID NO: 465388 - DNA, 25 bp, Rattus norvegicus
tagtcgcgctcggtcttctgtagct

SEQ ID NO: 465389 - DNA, 25 bp, Rattus norvegicus
cgcgggactcagagcaggacagtcc

SEQ ID NO: 465390 - DNA, 25 bp, Rattus norvegicus
tcttctgtagctcgctgagcacgca

SEQ ID NO: 465391 - DNA, 25 bp, Rattus norvegicus
cgcgtcacccttatggatgcccggt

SEQ ID NO: 465392 - DNA, 25 bp, Rattus norvegicus
cgagccggaacacgcagcttcacat

SEQ ID NO: 465393 - DNA, 25 bp, Rattus norvegicus
acacgcgcaggcgaagctgcttgtc

SEQ ID NO: 465394 - DNA, 25 bp, Rattus norvegicus
cctttgcggagtccgagccggaaca

SEQ ID NO: 465395 - DNA, 25 bp, Rattus norvegicus
acccttatggatgcccggtgctggc

SEQ ID NO: 465396 - DNA, 25 bp, Rattus norvegicus
ctgagcacgcacacgcgcaggcgaa

SEQ ID NO: 465397 - DNA, 25 bp, Rattus norvegicus
cgcagcttcacatgctgacccgagg

SEQ ID NO: 465398 - DNA, 25 bp, Rattus norvegicus
tcctgagttcttgccgccgtcgccg

SEQ ID NO: 465399 - DNA, 25 bp, Rattus norvegicus
tcgccgccgagtcgtgcggggccag

SEQ ID NO: 465400 - DNA, 25 bp, Rattus norvegicus
ctcgcatgccgaggggctccggggc

SEQ ID NO: 465401 - DNA, 25 bp, Rattus norvegicus
ctgtgagcgcctgcggagccgtgcc

SEQ ID NO: 465402 - DNA, 25 bp, Rattus norvegicus
cctgcggagccgtgccctccgcgcc

SEQ ID NO: 465403 - DNA, 25 bp, Rattus norvegicus
ctgcgtcccgtgtctggcccccaat

SEQ ID NO: 465404 - DNA, 25 bp, Rattus norvegicus
tttctcacctgagcggcccgtcccg

SEQ ID NO: 465405 - DNA, 25 bp, Rattus norvegicus
cgtcccgcccgtctgcaggtagagg

SEQ ID NO: 465406 - DNA, 25 bp, Rattus norvegicus
tcccgcccgtctgcaggtagaggcg

SEQ ID NO: 465407 - DNA, 25 bp, Rattus norvegicus
gctctgcccggggaggcataccctt

SEQ ID NO: 465408 - DNA, 25 bp, Rattus norvegicus
cttcctttgccttcgggcccgcctg

SEQ ID NO: 465409 - DNA, 25 bp, Rattus norvegicus
cttcgggcccgcctgcctgctctcc

SEQ ID NO: 465410 - DNA, 25 bp, Rattus norvegicus
cgctttctcacctgagcggcccgtc

SEQ ID NO: 465411 - DNA, 25 bp, Rattus norvegicus
cgcctcctgagttcttgccgccgtc

SEQ ID NO: 465412 - DNA, 25 bp, Rattus norvegicus
agatagcggctctcaaaggctcctt

SEQ ID NO: 465413 - DNA, 25 bp, Rattus norvegicus
cactcagctccggtgactggtttgg

SEQ ID NO: 465414 - DNA, 25 bp, Rattus norvegicus
gtccggagggcttagcctctagtca

SEQ ID NO: 465415 - DNA, 25 bp, Rattus norvegicus
gggcttagcctctagtcatggactc

SEQ ID NO: 465416 - DNA, 25 bp, Rattus norvegicus
ccctccagggttggagtgaggacca

SEQ ID NO: 465417 - DNA, 25 bp, Rattus norvegicus
tcatggactcgcagaaagtaagcgg

SEQ ID NO: 465418 - DNA, 25 bp, Rattus norvegicus
gatccgacctgaccgaacctgagcg

SEQ ID NO: 465419 - DNA, 25 bp, Rattus norvegicus
gaccgaacctgagcgcccgcagggt

SEQ ID NO: 465420 - DNA, 25 bp, Rattus norvegicus
gggaccctggccgatctctgtcctg

SEQ ID NO: 465421 - DNA, 25 bp, Rattus norvegicus
ccgatctctgtcctgcttttggctg

SEQ ID NO: 465422 - DNA, 25 bp, Rattus norvegicus
tactgcgggaaggaaaccgcgagcc

SEQ ID NO: 465423 - DNA, 25 bp, Rattus norvegicus
cgtgctccgagggtgggtccctcca

SEQ ID NO: 465424 - DNA, 25 bp, Rattus norvegicus
cgacggccgagatagcggctctcaa

SEQ ID NO: 465425 - DNA, 25 bp, Rattus norvegicus
tgaggaccagggctcagcctcgcgt

SEQ ID NO: 465426 - DNA, 25 bp, Rattus norvegicus
ggcaaacctgtacggccaaaggcta

SEQ ID NO: 465427 - DNA, 25 bp, Rattus norvegicus
ctagcgaacgcagctgtgcgcttga

SEQ ID NO: 465428 - DNA, 25 bp, Rattus norvegicus
gcttgacggtttctttgcgacagtc

SEQ ID NO: 465429 - DNA, 25 bp, Rattus norvegicus
cgtgactgccgtaaagcgaggcttc

SEQ ID NO: 465430 - DNA, 25 bp, Rattus norvegicus
tccgccgcagctctagagttaggta

SEQ ID NO: 465431 - DNA, 25 bp, Rattus norvegicus
ttccctcaggcatgagtcgctggtc

SEQ ID NO: 465432 - DNA, 25 bp, Rattus norvegicus
agtcgctggtctactcgtaccctgg

SEQ ID NO: 465433 - DNA, 25 bp, Rattus norvegicus
gccacagggacagatgggtctcaca

SEQ ID NO: 465434 - DNA, 25 bp, Rattus norvegicus
acatgcccatgctgttcgttgatca

SEQ ID NO: 465435 - DNA, 25 bp, Rattus norvegicus
gttgatcatcctgacaccgcttcga

SEQ ID NO: 465436 - DNA, 25 bp, Rattus norvegicus
ccgcttcgatttttggaggttcatg

SEQ ID NO: 465437 - DNA, 25 bp, Rattus norvegicus
ttcatggagacgcttgtagaggccg

SEQ ID NO: 465438 - DNA, 25 bp, Rattus norvegicus
agcgaaccacgcgagtagaacgatc

SEQ ID NO: 465439 - DNA, 25 bp, Rattus norvegicus
ccaaaggctactcgggctagcgaac

SEQ ID NO: 465440 - DNA, 25 bp, Rattus norvegicus
ctcctaacgcatgttgtcaaacccg

SEQ ID NO: 465441 - DNA, 25 bp, Rattus norvegicus
ccggactcctaacgcatgttgtcaa

SEQ ID NO: 465442 - DNA, 25 bp, Rattus norvegicus
ggtccggactcctaacgcatgttgt

SEQ ID NO: 465443 - DNA, 25 bp, Rattus norvegicus
gaagctggtccggactcctaacgca

SEQ ID NO: 465444 - DNA, 25 bp, Rattus norvegicus
ctcttgggaagctggtccggactcc

SEQ ID NO: 465445 - DNA, 25 bp, Rattus norvegicus
gcaatagcgcggctcttgggaagct

SEQ ID NO: 465446 - DNA, 25 bp, Rattus norvegicus
gacagtggcaatagcgcggctcttg

SEQ ID NO: 465447 - DNA, 25 bp, Rattus norvegicus
aactttcggcgggacagtggcaata

SEQ ID NO: 465448 - DNA, 25 bp, Rattus norvegicus
cctggcaagaaggtgcgttgactta

SEQ ID NO: 465449 - DNA, 25 bp, Rattus norvegicus
ctcctggcaagaaggtgcgttgact

SEQ ID NO: 465450 - DNA, 25 bp, Rattus norvegicus
aggcgctgcgacaactgcgaccgcg

SEQ ID NO: 465451 - DNA, 25 bp, Rattus norvegicus
cacagacaggcgctgcgacaactgc

SEQ ID NO: 465452 - DNA, 25 bp, Rattus norvegicus
cgcatgttgtcaaacccgttttagc

SEQ ID NO: 465453 - DNA, 25 bp, Rattus norvegicus
gcgcacacagacaggcgctgcgaca

SEQ ID NO: 465454 - DNA, 25 bp, Rattus norvegicus
ggtcggtagtcgtcatggagtaccc

SEQ ID NO: 465455 - DNA, 25 bp, Rattus norvegicus
gtacccgtgggatgatctgactctg

SEQ ID NO: 465456 - DNA, 25 bp, Rattus norvegicus
gggatgatctgactctggccttctc

SEQ ID NO: 465457 - DNA, 25 bp, Rattus norvegicus
actctggccttctcccgcacgtcca

SEQ ID NO: 465458 - DNA, 25 bp, Rattus norvegicus
cgcacgtccatgtttcccttttttg

SEQ ID NO: 465459 - DNA, 25 bp, Rattus norvegicus
ttcccttttttgacatcgcccacta

SEQ ID NO: 465460 - DNA, 25 bp, Rattus norvegicus
tttgacatcgcccactacctggtgt

SEQ ID NO: 465461 - DNA, 25 bp, Rattus norvegicus
atcgcccactacctggtgtcggtga

SEQ ID NO: 465462 - DNA, 25 bp, Rattus norvegicus
cccactacctggtgtcggtgatggc

SEQ ID NO: 465463 - DNA, 25 bp, Rattus norvegicus
actacctggtgtcggtgatggcgct

SEQ ID NO: 465464 - DNA, 25 bp, Rattus norvegicus
tggcgctgaagcagcggccaggtga

SEQ ID NO: 465465 - DNA, 25 bp, Rattus norvegicus
gcccgacgcgctcctggttccgcgt

SEQ ID NO: 465466 - DNA, 25 bp, Rattus norvegicus
tggttccgcgtcctcactgccggag

SEQ ID NO: 465467 - DNA, 25 bp, Rattus norvegicus
tcgtcatggagtacccgtgggatga

SEQ ID NO: 465468 - DNA, 25 bp, Rattus norvegicus
tttctggagttcaccgcagccgctc

SEQ ID NO: 465469 - DNA, 25 bp, Rattus norvegicus
gccgcgtcaggagctctctcaatgt

SEQ ID NO: 465470 - DNA, 25 bp, Rattus norvegicus
gtcaggagctctctcaatgtcggtc

SEQ ID NO: 465471 - DNA, 25 bp, Rattus norvegicus
agctctctcaatgtcggtcgctcga

SEQ ID NO: 465472 - DNA, 25 bp, Rattus norvegicus
tctcaatgtcggtcgctcgaggtga

SEQ ID NO: 465473 - DNA, 25 bp, Rattus norvegicus
ccgcgccgcaggttcatttctggag

SEQ ID NO: 465474 - DNA, 25 bp, Rattus norvegicus
cggcctgtgccaagtgggtttacga

SEQ ID NO: 465475 - DNA, 25 bp, Rattus norvegicus
cctgtgccaagtgggtttacgaggt

SEQ ID NO: 465476 - DNA, 25 bp, Rattus norvegicus
ggtttcctctgacctccgctccttc

SEQ ID NO: 465477 - DNA, 25 bp, Rattus norvegicus
tccgctccttcattaccgctgcgtc

SEQ ID NO: 465478 - DNA, 25 bp, Rattus norvegicus
gcgccctccgaaccacgccagccca

SEQ ID NO: 465479 - DNA, 25 bp, Rattus norvegicus
gccagcccacaaggtatcttcacgt

SEQ ID NO: 465480 - DNA, 25 bp, Rattus norvegicus
ttcatttctggagttcaccgcagcc

SEQ ID NO: 465481 - DNA, 25 bp, Rattus norvegicus
cgcaggttcatttctggagttcacc

SEQ ID NO: 465482 - DNA, 25 bp, Rattus norvegicus
tgagacccgacaatgatacgccata

SEQ ID NO: 465483 - DNA, 25 bp, Rattus norvegicus
gcccacaaacaagaagatggccttc

SEQ ID NO: 465484 - DNA, 25 bp, Rattus norvegicus
ggccttctcagaaggaagctggatc

SEQ ID NO: 465485 - DNA, 25 bp, Rattus norvegicus
aagctggatccttttcctgatgatc

SEQ ID NO: 465486 - DNA, 25 bp, Rattus norvegicus
tgatgatccacatgaactcaatctg

SEQ ID NO: 465487 - DNA, 25 bp, Rattus norvegicus
ggagactttctccacgatcaccgga

SEQ ID NO: 465488 - DNA, 25 bp, Rattus norvegicus
cggcggcagcaacgagtactccgat

SEQ ID NO: 465489 - DNA, 25 bp, Rattus norvegicus
cgagtactccgataccaaagtccct

SEQ ID NO: 465490 - DNA, 25 bp, Rattus norvegicus
tctgccattttattgagacccgaca

SEQ ID NO: 465491 - DNA, 25 bp, Rattus norvegicus
gatacgccataatatacccatttta

SEQ ID NO: 465492 - DNA, 25 bp, Rattus norvegicus
aggaagttcagtcccagagaaatta

SEQ ID NO: 465493 - DNA, 25 bp, Rattus norvegicus
taagactttgcttagaaggaagctg

SEQ ID NO: 465494 - DNA, 25 bp, Rattus norvegicus
tgggactgtcttgcccacaaacaag

SEQ ID NO: 465495 - DNA, 25 bp, Rattus norvegicus
cccattttatagaacaggaagttca

SEQ ID NO: 465496 - DNA, 25 bp, Rattus norvegicus
gggcgggccttagacaatccttcca

SEQ ID NO: 465497 - DNA, 25 bp, Rattus norvegicus
cactgccggctttgtgggccgacaa

SEQ ID NO: 465498 - DNA, 25 bp, Rattus norvegicus
gatcgacatcgacccggaggagacg

SEQ ID NO: 465499 - DNA, 25 bp, Rattus norvegicus
tgaagacccttcagcagcagacctt

SEQ ID NO: 465500 - DNA, 25 bp, Rattus norvegicus
atgcaggtcaccctgaagacccttc

SEQ ID NO: 465501 - DNA, 25 bp, Rattus norvegicus
ccggcttaggcaccatgcaggtcac

SEQ ID NO: 465502 - DNA, 25 bp, Rattus norvegicus
cgactccgggcgaatgtgacaagcc

SEQ ID NO: 465503 - DNA, 25 bp, Rattus norvegicus
tgaggtagcggattctctgcgtctc

SEQ ID NO: 465504 - DNA, 25 bp, Rattus norvegicus
ggccaccatcctgtggtgaggtagc

SEQ ID NO: 465505 - DNA, 25 bp, Rattus norvegicus
agtcacggtgatggcggccaccatc

SEQ ID NO: 465506 - DNA, 25 bp, Rattus norvegicus
gcctgctcagatctcccgagtctgg

SEQ ID NO: 465507 - DNA, 25 bp, Rattus norvegicus
gagttcctgttcacgcctgcgcatt

SEQ ID NO: 465508 - DNA, 25 bp, Rattus norvegicus
ctactgagccgggtctccacgtagc

SEQ ID NO: 465509 - DNA, 25 bp, Rattus norvegicus
acggattgcgcaactcgcgccgcta

SEQ ID NO: 465510 - DNA, 25 bp, Rattus norvegicus
cttctacttggagaggaatagggcg

SEQ ID NO: 465511 - DNA, 25 bp, Rattus norvegicus
cagctctagcccttaggcctcgggg

SEQ ID NO: 465512 - DNA, 25 bp, Rattus norvegicus
cctgagagtcggacactgggcgatc

SEQ ID NO: 465513 - DNA, 25 bp, Rattus norvegicus
gacactgggcgatcggctcttccgc

SEQ ID NO: 465514 - DNA, 25 bp, Rattus norvegicus
ttccgccagccacaccctgcgatct

SEQ ID NO: 465515 - DNA, 25 bp, Rattus norvegicus
cctgcgatcttccttttcacttcta

SEQ ID NO: 465516 - DNA, 25 bp, Rattus norvegicus
ccttttcacttctacttggagagga

SEQ ID NO: 465517 - DNA, 25 bp, Rattus norvegicus
cgtggcaggagacctggaatacgtc

SEQ ID NO: 465518 - DNA, 25 bp, Rattus norvegicus
gaatacgtcggtgcgtccgtcagag

SEQ ID NO: 465519 - DNA, 25 bp, Rattus norvegicus
gcgtccgtcagagcgagaactggcc

SEQ ID NO: 465520 - DNA, 25 bp, Rattus norvegicus
cccagcgcggactccaggtagagcc

SEQ ID NO: 465521 - DNA, 25 bp, Rattus norvegicus
caggtagagccctatgcacacggga

SEQ ID NO: 465522 - DNA, 25 bp, Rattus norvegicus
ctatgcacacgggaacgcgcgtgcg

SEQ ID NO: 465523 - DNA, 25 bp, Rattus norvegicus
agacctggaatacgtcggtgcgtcc

SEQ ID NO: 465524 - DNA, 25 bp, Rattus norvegicus
ggggaagcacgcaccagattctcca

SEQ ID NO: 465525 - DNA, 25 bp, Rattus norvegicus
ctgggatactggacgttgataggac

SEQ ID NO: 465526 - DNA, 25 bp, Rattus norvegicus
ggcagcagaatagggagtgcttatt

SEQ ID NO: 465527 - DNA, 25 bp, Rattus norvegicus
gcgcccattggcctacgtgcttcaa

SEQ ID NO: 465528 - DNA, 25 bp, Rattus norvegicus
gagcctagcgttgaagagccgccgc

SEQ ID NO: 465529 - DNA, 25 bp, Rattus norvegicus
tctccgattggccaggagcctagcg

SEQ ID NO: 465530 - DNA, 25 bp, Rattus norvegicus
tggagccacgcggagtctccgattg

SEQ ID NO: 465531 - DNA, 25 bp, Rattus norvegicus
cgctgcacagcgattggctactgct

SEQ ID NO: 465532 - DNA, 25 bp, Rattus norvegicus
cggagggatattcctgccggacctc

SEQ ID NO: 465533 - DNA, 25 bp, Rattus norvegicus
cctcctaatgtgctaggcggcagca

SEQ ID NO: 465534 - DNA, 25 bp, Rattus norvegicus
ttctcgaggatggttatgagctcca

SEQ ID NO: 465535 - DNA, 25 bp, Rattus norvegicus
ctacccggagacacggtcttctcga

SEQ ID NO: 465536 - DNA, 25 bp, Rattus norvegicus
tccagccgatctgccaggagaaatg

SEQ ID NO: 465537 - DNA, 25 bp, Rattus norvegicus
cagccgcacgctcaaggaacttctg

SEQ ID NO: 465538 - DNA, 25 bp, Rattus norvegicus
gagtcccaatggagggcaatccttg

SEQ ID NO: 465539 - DNA, 25 bp, Rattus norvegicus
ctgcagaaatctaaagggcgctagc

SEQ ID NO: 465540 - DNA, 25 bp, Rattus norvegicus
gggtctcgagacttggctacctaca

SEQ ID NO: 465541 - DNA, 25 bp, Rattus norvegicus
cacttaaggccgactcaagggccga

SEQ ID NO: 465542 - DNA, 25 bp, Rattus norvegicus
atctcacctacctcattaatgtggg

SEQ ID NO: 465543 - DNA, 25 bp, Rattus norvegicus
gcgctagcgcgacactcacgttagt

SEQ ID NO: 465544 - DNA, 25 bp, Rattus norvegicus
atcactccggtccaaagggtctcga

SEQ ID NO: 465545 - DNA, 25 bp, Rattus norvegicus
tccttgtcctatcgaggggctcttg

SEQ ID NO: 465546 - DNA, 25 bp, Rattus norvegicus
ccaccttgggaaggctggagagtcc

SEQ ID NO: 465547 - DNA, 25 bp, Rattus norvegicus
tgctgggaccacacgcacttaaggc

SEQ ID NO: 465548 - DNA, 25 bp, Rattus norvegicus
acctgtgagaaaccgctgtgcgccc

SEQ ID NO: 465549 - DNA, 25 bp, Rattus norvegicus
ggacgcccgcagacctgtgagaaac

SEQ ID NO: 465550 - DNA, 25 bp, Rattus norvegicus
tacctacaatacagtggcctgagtg

SEQ ID NO: 465551 - DNA, 25 bp, Rattus norvegicus
agagaccaggagtcaggggacaccc

SEQ ID NO: 465552 - DNA, 25 bp, Rattus norvegicus
gctgggaggaaggtctgccggcacg

SEQ ID NO: 465553 - DNA, 25 bp, Rattus norvegicus
ctgggaggaaggtctgccggcacga

SEQ ID NO: 465554 - DNA, 25 bp, Rattus norvegicus
gaggcggcagggctcggggaactgg

SEQ ID NO: 465555 - DNA, 25 bp, Rattus norvegicus
ggggctgggaggaaggtctgccggc

SEQ ID NO: 465556 - DNA, 25 bp, Rattus norvegicus
gggctgggaggaaggtctgccggca

SEQ ID NO: 465557 - DNA, 25 bp, Rattus norvegicus
ggctgggaggaaggtctgccggcac

SEQ ID NO: 465558 - DNA, 25 bp, Rattus norvegicus
ggcttgtacgaaacatcagccgaca

SEQ ID NO: 465559 - DNA, 25 bp, Rattus norvegicus
gggattcctgctccggccttaaata

SEQ ID NO: 465560 - DNA, 25 bp, Rattus norvegicus
ctacgtcaggccagcgaaggccatc

SEQ ID NO: 465561 - DNA, 25 bp, Rattus norvegicus
gcttcgggaactgaccaggccgcgt

SEQ ID NO: 465562 - DNA, 25 bp, Rattus norvegicus
gcggcgggctgctacacaatgtttc

SEQ ID NO: 465563 - DNA, 25 bp, Rattus norvegicus
agggaggccagacttcctgatcaca

SEQ ID NO: 465564 - DNA, 25 bp, Rattus norvegicus
tcctgatcacatggtgctgaagtca

SEQ ID NO: 465565 - DNA, 25 bp, Rattus norvegicus
gcaggaccgggcaaacataaacacc

SEQ ID NO: 465566 - DNA, 25 bp, Rattus norvegicus
taaacaccagatcggggcagtaatt

SEQ ID NO: 465567 - DNA, 25 bp, Rattus norvegicus
cgctgaggaaatgagaggcttgtac

SEQ ID NO: 465568 - DNA, 25 bp, Rattus norvegicus
aggaagcccgcggactgcggactcc

SEQ ID NO: 465569 - DNA, 25 bp, Rattus norvegicus
cggaaaagcgctctcggtcctggct

SEQ ID NO: 465570 - DNA, 25 bp, Rattus norvegicus
cagccgacaagaaacggggtgatgt

SEQ ID NO: 465571 - DNA, 25 bp, Rattus norvegicus
cggctccgagatcgctgaggaaatg

SEQ ID NO: 465572 - DNA, 25 bp, Rattus norvegicus
agatccgaggtcctagcctggtaga

SEQ ID NO: 465573 - DNA, 25 bp, Rattus norvegicus
gagctctgctctaccgcacagggtg

SEQ ID NO: 465574 - DNA, 25 bp, Rattus norvegicus
accctcccttgtagatcgatacttc

SEQ ID NO: 465575 - DNA, 25 bp, Rattus norvegicus
gtgcacaacgttaccacgcgccgga

SEQ ID NO: 465576 - DNA, 25 bp, Rattus norvegicus
aacagttggactttggcccagcagc

SEQ ID NO: 465577 - DNA, 25 bp, Rattus norvegicus
ctcagactggaacggacgaatgctc

SEQ ID NO: 465578 - DNA, 25 bp, Rattus norvegicus
cctggtagagacagaaggactttgc

SEQ ID NO: 465579 - DNA, 25 bp, Rattus norvegicus
agatgcaccgcctctgtagatccga

SEQ ID NO: 465580 - DNA, 25 bp, Rattus norvegicus
tggtgtcacccacgagacgcactaa

SEQ ID NO: 465581 - DNA, 25 bp, Rattus norvegicus
cctcacggtacactgggtttggaag

SEQ ID NO: 465582 - DNA, 25 bp, Rattus norvegicus
ccgaaattcgaagagagaggctgtc

SEQ ID NO: 465583 - DNA, 25 bp, Rattus norvegicus
gcgcgtgcatcttccctgcagcagg

SEQ ID NO: 465584 - DNA, 25 bp, Rattus norvegicus
accaggccgcacaaagcagctcaga

SEQ ID NO: 465585 - DNA, 25 bp, Rattus norvegicus
ctcagccctttgacgcccagttgta

SEQ ID NO: 465586 - DNA, 25 bp, Rattus norvegicus
ccaggggcagaagagtttgctctac

SEQ ID NO: 465587 - DNA, 25 bp, Rattus norvegicus
tcactcggagccacagggccaggcg

SEQ ID NO: 465588 - DNA, 25 bp, Rattus norvegicus
ctaggccgaacaacgcacctgctgg

SEQ ID NO: 465589 - DNA, 25 bp, Rattus norvegicus
acaacgcacctgctgggctctaacg

SEQ ID NO: 465590 - DNA, 25 bp, Rattus norvegicus
agcccaggagtagccgccggctctg

SEQ ID NO: 465591 - DNA, 25 bp, Rattus norvegicus
catcgcgggcagtgcacaccgggac

SEQ ID NO: 465592 - DNA, 25 bp, Rattus norvegicus
ttgctctaccgagcgcgttctaatc

SEQ ID NO: 465593 - DNA, 25 bp, Rattus norvegicus
ctaatctccagtcccgagtcgaagg

SEQ ID NO: 465594 - DNA, 25 bp, Rattus norvegicus
agtcgaaggcgaggccagaagcatt

SEQ ID NO: 465595 - DNA, 25 bp, Rattus norvegicus
aagcattggaggagtggacagctcc

SEQ ID NO: 465596 - DNA, 25 bp, Rattus norvegicus
gccatggcccgccaccgatagtaga

SEQ ID NO: 465597 - DNA, 25 bp, Rattus norvegicus
tagtagagcgcgctatccgcacctc

SEQ ID NO: 465598 - DNA, 25 bp, Rattus norvegicus
tccatgagaccctggacccggtaac

SEQ ID NO: 465599 - DNA, 25 bp, Rattus norvegicus
cccgccatgcctgaccggggaaaga

SEQ ID NO: 465600 - DNA, 25 bp, Rattus norvegicus
acccgcgcttactggagcagggtga

SEQ ID NO: 465601 - DNA, 25 bp, Rattus norvegicus
tttgtagtttccagacggcggtgga

SEQ ID NO: 465602 - DNA, 25 bp, Rattus norvegicus
cgcccgtgttgtagaaagcctgttt

SEQ ID NO: 465603 - DNA, 25 bp, Rattus norvegicus
gcagcacaggcacacgaacagcacg

SEQ ID NO: 465604 - DNA, 25 bp, Rattus norvegicus
agtacacaagaaccgcggcgccgca

SEQ ID NO: 465605 - DNA, 25 bp, Rattus norvegicus
ggcctcgaggatgaagtacacaaga

SEQ ID NO: 465606 - DNA, 25 bp, Rattus norvegicus
aaggtgccgcacagcacggcccaga

SEQ ID NO: 465607 - DNA, 25 bp, Rattus norvegicus
tccacgccgtagtctgcgaagcaga

SEQ ID NO: 465608 - DNA, 25 bp, Rattus norvegicus
agagaccgtagagcagcggaccgcc

SEQ ID NO: 465609 - DNA, 25 bp, Rattus norvegicus
agctgccgaggcagtagagaccgta

SEQ ID NO: 465610 - DNA, 25 bp, Rattus norvegicus
acctgtacgcccaggtagctgccga

SEQ ID NO: 465611 - DNA, 25 bp, Rattus norvegicus
cgtgcgctagcagtacctgtacgcc

SEQ ID NO: 465612 - DNA, 25 bp, Rattus norvegicus
cacaagctgctgaagtagtcgaggc

SEQ ID NO: 465613 - DNA, 25 bp, Rattus norvegicus
tgagaggacctttggccgccttgtc

SEQ ID NO: 465614 - DNA, 25 bp, Rattus norvegicus
cctctgacaggtagcgcaggtcata

SEQ ID NO: 465615 - DNA, 25 bp, Rattus norvegicus
gacacctttgcggacgcgtcctgca

SEQ ID NO: 465616 - DNA, 25 bp, Rattus norvegicus
accctcctctgacaggtagcgcagg

SEQ ID NO: 465617 - DNA, 25 bp, Rattus norvegicus
agcagtggtacccaggccgagcgcc

SEQ ID NO: 465618 - DNA, 25 bp, Rattus norvegicus
acaggtagcgcaggtcatagaactc

SEQ ID NO: 465619 - DNA, 25 bp, Rattus norvegicus
gcaggtcatagaactcgccggcgaa

SEQ ID NO: 465620 - DNA, 25 bp, Rattus norvegicus
ggtcatagaactcgccggcgaaggt

SEQ ID NO: 465621 - DNA, 25 bp, Rattus norvegicus
agtcgtggcgcggcactgcctcgtc

SEQ ID NO: 465622 - DNA, 25 bp, Rattus norvegicus
ctcaccctatggtggcctcaccctc

SEQ ID NO: 465623 - DNA, 25 bp, Rattus norvegicus
gtccgccggactggcttcgcaggca

SEQ ID NO: 465624 - DNA, 25 bp, Rattus norvegicus
agcagcctcaagagcagtggtaccc

SEQ ID NO: 465625 - DNA, 25 bp, Rattus norvegicus
cagcctcaagagcagtggtacccag

SEQ ID NO: 465626 - DNA, 25 bp, Rattus norvegicus
tcaagagcagtggtacccaggccga

SEQ ID NO: 465627 - DNA, 25 bp, Rattus norvegicus
gtcgtccgccggactggcttcgcag

SEQ ID NO: 465628 - DNA, 25 bp, Rattus norvegicus
gctgtccagcctgaacacgaaggtg

SEQ ID NO: 465629 - DNA, 25 bp, Rattus norvegicus
acttccacaggtgcttgcaggtgcg

SEQ ID NO: 465630 - DNA, 25 bp, Rattus norvegicus
cacagcgcacttccacaggtgcttg

SEQ ID NO: 465631 - DNA, 25 bp, Rattus norvegicus
acggaagaaggcgtggtgctccaca

SEQ ID NO: 465632 - DNA, 25 bp, Rattus norvegicus
tgaagtcggatctggcggacttgct

SEQ ID NO: 465633 - DNA, 25 bp, Rattus norvegicus
gaacccagccggatgaagtcggatc

SEQ ID NO: 465634 - DNA, 25 bp, Rattus norvegicus
actgccaacctgaaccggaagcggg

SEQ ID NO: 465635 - DNA, 25 bp, Rattus norvegicus
gacgacccaggtggccggacacgaa

SEQ ID NO: 465636 - DNA, 25 bp, Rattus norvegicus
gaatccgctgctacactcactcata

SEQ ID NO: 465637 - DNA, 25 bp, Rattus norvegicus
gtggccggacacgaatccgctgcta

SEQ ID NO: 465638 - DNA, 25 bp, Rattus norvegicus
cacgaaggtgtgctcttgctcacgc

SEQ ID NO: 465639 - DNA, 25 bp, Rattus norvegicus
taaaacacgtgtggtccacgccaca

SEQ ID NO: 465640 - DNA, 25 bp, Rattus norvegicus
gagctgtcgttctctaaaacacgtg

SEQ ID NO: 465641 - DNA, 25 bp, Rattus norvegicus
tcatacacaagaaaaggagctgtcg

SEQ ID NO: 465642 - DNA, 25 bp, Rattus norvegicus
ctcttttggcggcatggctccctgt

SEQ ID NO: 465643 - DNA, 25 bp, Rattus norvegicus
aaggcaccgtctgccgcagcgcagt

SEQ ID NO: 465644 - DNA, 25 bp, Rattus norvegicus
gcgcccgttagtgcatcgtttgttt

SEQ ID NO: 465645 - DNA, 25 bp, Rattus norvegicus
ttagtgcatcgtttgtttggatctg

SEQ ID NO: 465646 - DNA, 25 bp, Rattus norvegicus
agaaaggctcttttggcggcatggc

SEQ ID NO: 465647 - DNA, 25 bp, Rattus norvegicus
atggctccctgtcggagtcactggc

SEQ ID NO: 465648 - DNA, 25 bp, Rattus norvegicus
tgtcggagtcactggcgctggccta

SEQ ID NO: 465649 - DNA, 25 bp, Rattus norvegicus
ctggcctagcttgccactggaactg

SEQ ID NO: 465650 - DNA, 25 bp, Rattus norvegicus
tagcttgccactggaactgggcccg

SEQ ID NO: 465651 - DNA, 25 bp, Rattus norvegicus
cccgggtgcaaccacctgtgggtgt

SEQ ID NO: 465652 - DNA, 25 bp, Rattus norvegicus
ggacgcaggccctggtgctgctacc

SEQ ID NO: 465653 - DNA, 25 bp, Rattus norvegicus
atgccctgcgcgtcccacgcacact

SEQ ID NO: 465654 - DNA, 25 bp, Rattus norvegicus
aactgggcccgggtgcaaccacctg

SEQ ID NO: 465655 - DNA, 25 bp, Rattus norvegicus
cccttcggccagaaaggctcttttg

SEQ ID NO: 465656 - DNA, 25 bp, Rattus norvegicus
tgagcacacacgtgtttccgggcgc

SEQ ID NO: 465657 - DNA, 25 bp, Rattus norvegicus
gccgcgtcactcaccggcaggtcca

SEQ ID NO: 465658 - DNA, 25 bp, Rattus norvegicus
ggcaggtccacgctcacttcggttc

SEQ ID NO: 465659 - DNA, 25 bp, Rattus norvegicus
ctcacttcggttccgtcgagcagga

SEQ ID NO: 465660 - DNA, 25 bp, Rattus norvegicus
tcgagcaggaagacacggcagtaaa

SEQ ID NO: 465661 - DNA, 25 bp, Rattus norvegicus
agacacggcagtaaagggtggcctt

SEQ ID NO: 465662 - DNA, 25 bp, Rattus norvegicus
aaagggtggccttggcagctcccga

SEQ ID NO: 465663 - DNA, 25 bp, Rattus norvegicus
ctcccgaggcggagatgtgcacagc

SEQ ID NO: 465664 - DNA, 25 bp, Rattus norvegicus
gagcaaagcgcctgcgtgctcccgg

SEQ ID NO: 465665 - DNA, 25 bp, Rattus norvegicus
gtgcgtacacgtaggtgagcacaca

SEQ ID NO: 465666 - DNA, 25 bp, Rattus norvegicus
aggtgcgctcacgtgcgtacacgta

SEQ ID NO: 465667 - DNA, 25 bp, Rattus norvegicus
tgctgctgtaggtgcgctcacgtgc

SEQ ID NO: 465668 - DNA, 25 bp, Rattus norvegicus
tcccacctgggagggctgcacctcc

SEQ ID NO: 465669 - DNA, 25 bp, Rattus norvegicus
ccagccggagcaaagcgcctgcgtg

SEQ ID NO: 465670 - DNA, 25 bp, Rattus norvegicus
ccctacggcccagcattcgatatga

SEQ ID NO: 465671 - DNA, 25 bp, Rattus norvegicus
cgttcggccagagatccagtgtcct

SEQ ID NO: 465672 - DNA, 25 bp, Rattus norvegicus
gacgcagaagccacaactccgggtt

SEQ ID NO: 465673 - DNA, 25 bp, Rattus norvegicus
cgcagatcctgtaccgtggccaaaa

SEQ ID NO: 465674 - DNA, 25 bp, Rattus norvegicus
gggagagccacagaacccgcagatc

SEQ ID NO: 465675 - DNA, 25 bp, Rattus norvegicus
aacctcagtcttccggggagagcca

SEQ ID NO: 465676 - DNA, 25 bp, Rattus norvegicus
gttccgaaacgctcaagacagggca

SEQ ID NO: 465677 - DNA, 25 bp, Rattus norvegicus
aatgagagccttccgatccgccagt

SEQ ID NO: 465678 - DNA, 25 bp, Rattus norvegicus
cccaagtctaggacgtcaagaatga

SEQ ID NO: 465679 - DNA, 25 bp, Rattus norvegicus
gtggactccggctcagaaattttgc

SEQ ID NO: 465680 - DNA, 25 bp, Rattus norvegicus
acaacgcagtctcatggtggactcc

SEQ ID NO: 465681 - DNA, 25 bp, Rattus norvegicus
agcctgcgagcttgtatgaacaacg

SEQ ID NO: 465682 - DNA, 25 bp, Rattus norvegicus
gtgtcctgcggcgactttgaaaacg

SEQ ID NO: 465683 - DNA, 25 bp, Rattus norvegicus
tccttcgggaaagggaagcctgcga

SEQ ID NO: 465684 - DNA, 25 bp, Rattus norvegicus
ggagttcgtgccaggcccaggaaat

SEQ ID NO: 465685 - DNA, 25 bp, Rattus norvegicus
cgaggatttccggggcgctctctct

SEQ ID NO: 465686 - DNA, 25 bp, Rattus norvegicus
cctctgctgggctgcggatacctcg

SEQ ID NO: 465687 - DNA, 25 bp, Rattus norvegicus
tgaacctcgcggactacgggaagct

SEQ ID NO: 465688 - DNA, 25 bp, Rattus norvegicus
agtggctgaacctcgcggactacgg

SEQ ID NO: 465689 - DNA, 25 bp, Rattus norvegicus
ggcgaattcgccctgagtggctgaa

SEQ ID NO: 465690 - DNA, 25 bp, Rattus norvegicus
gcacaacgcagcagagtcaccgcaa

SEQ ID NO: 465691 - DNA, 25 bp, Rattus norvegicus
aggcccaggaaatgccatctttgca

SEQ ID NO: 465692 - DNA, 25 bp, Rattus norvegicus
ttggcactggagttcgtgccaggcc

SEQ ID NO: 465693 - DNA, 25 bp, Rattus norvegicus
aacgaggaggattggtttggcactg

SEQ ID NO: 465694 - DNA, 25 bp, Rattus norvegicus
ccgcaagttgtcagagaagccaccc

SEQ ID NO: 465695 - DNA, 25 bp, Rattus norvegicus
cagagtcaccgcaagttgtcagaga

SEQ ID NO: 465696 - DNA, 25 bp, Rattus norvegicus
catctttgcaatctggggcgaattc

SEQ ID NO: 465697 - DNA, 25 bp, Rattus norvegicus
cgcagcagagtcaccgcaagttgtc

SEQ ID NO: 465698 - DNA, 25 bp, Rattus norvegicus
ggccattccctttagcatttactga

SEQ ID NO: 465699 - DNA, 25 bp, Rattus norvegicus
tggttcacgggcctccgcggaccac

SEQ ID NO: 465700 - DNA, 25 bp, Rattus norvegicus
agccttgctcggtggttccgtggct

SEQ ID NO: 465701 - DNA, 25 bp, Rattus norvegicus
gcacacggccattccctttagcatt

SEQ ID NO: 465702 - DNA, 25 bp, Rattus norvegicus
ctccagcggctccgtggctgagttg

SEQ ID NO: 465703 - DNA, 25 bp, Rattus norvegicus
tccctttagcatttactgaacacct

SEQ ID NO: 465704 - DNA, 25 bp, Rattus norvegicus
ttggctttccgggattgcatgccta

SEQ ID NO: 465705 - DNA, 25 bp, Rattus norvegicus
tccgggattgcatgcctaggaatgg

SEQ ID NO: 465706 - DNA, 25 bp, Rattus norvegicus
cctaggaatggcaagagcttggcgc

SEQ ID NO: 465707 - DNA, 25 bp, Rattus norvegicus
tggcaagagcttggcgcacaacgaa

SEQ ID NO: 465708 - DNA, 25 bp, Rattus norvegicus
cttggcgcacaacgaatctgaaatg

SEQ ID NO: 465709 - DNA, 25 bp, Rattus norvegicus
ggcgcacaacgaatctgaaatgaca

SEQ ID NO: 465710 - DNA, 25 bp, Rattus norvegicus
tctgaaatgacagcgagccttgctc

SEQ ID NO: 465711 - DNA, 25 bp, Rattus norvegicus
ggaccacctgccgaactcccgcaca

SEQ ID NO: 465712 - DNA, 25 bp, Rattus norvegicus
tgtacgccagagtgtgccctatggc

SEQ ID NO: 465713 - DNA, 25 bp, Rattus norvegicus
ggtggcttcgtgctcaacttccatg

SEQ ID NO: 465714 - DNA, 25 bp, Rattus norvegicus
ttccatgcggacacagagctgggca

SEQ ID NO: 465715 - DNA, 25 bp, Rattus norvegicus
ggggctctcttctcggcagcatgaa

SEQ ID NO: 465716 - DNA, 25 bp, Rattus norvegicus
tccgcaagtccgaatccaagtcttc

SEQ ID NO: 465717 - DNA, 25 bp, Rattus norvegicus
aagtcttccatctccagcaagcgca

SEQ ID NO: 465718 - DNA, 25 bp, Rattus norvegicus
gtccgcagtgatgcagccatgagca

SEQ ID NO: 465719 - DNA, 25 bp, Rattus norvegicus
cagaatcagttctagcgatgccaac

SEQ ID NO: 465720 - DNA, 25 bp, Rattus norvegicus
ccatcagcttcggtgacgtggactg

SEQ ID NO: 465721 - DNA, 25 bp, Rattus norvegicus
actgtgacttttgccctgtggaaga

SEQ ID NO: 465722 - DNA, 25 bp, Rattus norvegicus
agctgcagataacccggccggcaca

SEQ ID NO: 465723 - DNA, 25 bp, Rattus norvegicus
gcgaacgctccaacggcatgaagta

SEQ ID NO: 465724 - DNA, 25 bp, Rattus norvegicus
agcgcaatggcttcggcatcagcga

SEQ ID NO: 465725 - DNA, 25 bp, Rattus norvegicus
ccctgtggaagatcatgtggatgcc

SEQ ID NO: 465726 - DNA, 25 bp, Rattus norvegicus
cgaggctttcgacgcccttggcggc

SEQ ID NO: 465727 - DNA, 25 bp, Rattus norvegicus
gcgggtgctcgtccccacggtagct

SEQ ID NO: 465728 - DNA, 25 bp, Rattus norvegicus
ctaaggcagcctcgcgcctgctggg

SEQ ID NO: 465729 - DNA, 25 bp, Rattus norvegicus
ttcggccgctgcgtgacgcgtcgtt

SEQ ID NO: 465730 - DNA, 25 bp, Rattus norvegicus
ccacggtagctaaggcagcctcgcg

SEQ ID NO: 465731 - DNA, 25 bp, Rattus norvegicus
agtgtggcgaggctttcgacgccct

SEQ ID NO: 465732 - DNA, 25 bp, Rattus norvegicus
ctcaacatggcgtccggggcaggtc

SEQ ID NO: 465733 - DNA, 25 bp, Rattus norvegicus
tcctctcaacatggcgtccggggca

SEQ ID NO: 465734 - DNA, 25 bp, Rattus norvegicus
gtttcctctcaacatggcgtccggg

SEQ ID NO: 465735 - DNA, 25 bp, Rattus norvegicus
cgtcgtttcctctcaacatggcgtc

SEQ ID NO: 465736 - DNA, 25 bp, Rattus norvegicus
acgcgtcgtttcctctcaacatggc

SEQ ID NO: 465737 - DNA, 25 bp, Rattus norvegicus
tgacgcgtcgtttcctctcaacatg

SEQ ID NO: 465738 - DNA, 25 bp, Rattus norvegicus
tgcgtgacgcgtcgtttcctctcaa

SEQ ID NO: 465739 - DNA, 25 bp, Rattus norvegicus
gtagctaaggcagcctcgcgcctgc

SEQ ID NO: 465740 - DNA, 25 bp, Rattus norvegicus
gcttcccgttttattcgcaggctgg

SEQ ID NO: 465741 - DNA, 25 bp, Rattus norvegicus
cttaggtagtgccacccgttgccac

SEQ ID NO: 465742 - DNA, 25 bp, Rattus norvegicus
cttaagtaaagaggctcggtctagc

SEQ ID NO: 465743 - DNA, 25 bp, Rattus norvegicus
cggtctagcgcccagcgaataacgc

SEQ ID NO: 465744 - DNA, 25 bp, Rattus norvegicus
gcgaataacgctatccaattgcttc

SEQ ID NO: 465745 - DNA, 25 bp, Rattus norvegicus
cgctatccaattgcttcccgtttta

SEQ ID NO: 465746 - DNA, 25 bp, Rattus norvegicus
tttattcgcaggctgggatctgcga

SEQ ID NO: 465747 - DNA, 25 bp, Rattus norvegicus
ggatctgcgagagcctgagcatttt

SEQ ID NO: 465748 - DNA, 25 bp, Rattus norvegicus
cgagagcctgagcattttcttgcca

SEQ ID NO: 465749 - DNA, 25 bp, Rattus norvegicus
attttcttgccagtgctccagggga

SEQ ID NO: 465750 - DNA, 25 bp, Rattus norvegicus
gacggcttgactgctccatctcgtg

SEQ ID NO: 465751 - DNA, 25 bp, Rattus norvegicus
cgctgcctctctgggcatgttgcca

SEQ ID NO: 465752 - DNA, 25 bp, Rattus norvegicus
tgctccatctcgtgcgcggccagag

SEQ ID NO: 465753 - DNA, 25 bp, Rattus norvegicus
tccctacggaccttaggtagtgcca

SEQ ID NO: 465754 - DNA, 25 bp, Rattus norvegicus
tggggcccgcgttctgccaaaggcc

SEQ ID NO: 465755 - DNA, 25 bp, Rattus norvegicus
catgtaaggacacgtgctggggccc

SEQ ID NO: 465756 - DNA, 25 bp, Rattus norvegicus
ccttctgctggcatctctgctcaga

SEQ ID NO: 465757 - DNA, 25 bp, Rattus norvegicus
tgctggcatctctgctcagagcaga

SEQ ID NO: 465758 - DNA, 25 bp, Rattus norvegicus
tctctgctcagagcagaggcgccgc

SEQ ID NO: 465759 - DNA, 25 bp, Rattus norvegicus
aggcgccgcctggtcttgtctagac

SEQ ID NO: 465760 - DNA, 25 bp, Rattus norvegicus
cttgtctagaccctgagcgcagcgc

SEQ ID NO: 465761 - DNA, 25 bp, Rattus norvegicus
tcgctaatcacaagcaccccaggtg

SEQ ID NO: 465762 - DNA, 25 bp, Rattus norvegicus
actcgcgagcgacgagcagcagcca

SEQ ID NO: 465763 - DNA, 25 bp, Rattus norvegicus
agcgacgagcagcagccacgggtcc

SEQ ID NO: 465764 - DNA, 25 bp, Rattus norvegicus
cggttgagactgggatcttgcagtt

SEQ ID NO: 465765 - DNA, 25 bp, Rattus norvegicus
tgagctctgagccagccgtgcgcac

SEQ ID NO: 465766 - DNA, 25 bp, Rattus norvegicus
tgagccagccgtgcgcacagcttta

SEQ ID NO: 465767 - DNA, 25 bp, Rattus norvegicus
gcagccggcatgtaaggacacgtgc

SEQ ID NO: 465768 - DNA, 25 bp, Rattus norvegicus
ctccgccagatttagggtggcagta

SEQ ID NO: 465769 - DNA, 25 bp, Rattus norvegicus
tcctaggcacccaacggagcttgca

SEQ ID NO: 465770 - DNA, 25 bp, Rattus norvegicus
cggcagaacccgatggaaatggatc

SEQ ID NO: 465771 - DNA, 25 bp, Rattus norvegicus
ctctcgatcagcttcaccattttgg

SEQ ID NO: 465772 - DNA, 25 bp, Rattus norvegicus
ggcacgcataccttgctctcgatca

SEQ ID NO: 465773 - DNA, 25 bp, Rattus norvegicus
ataccgagggtgtctactgagcacc

SEQ ID NO: 465774 - DNA, 25 bp, Rattus norvegicus
caccttcggtaccaggcgttccagg

SEQ ID NO: 465775 - DNA, 25 bp, Rattus norvegicus
gctgcctaagcgtgcaccttcggta

SEQ ID NO: 465776 - DNA, 25 bp, Rattus norvegicus
cgaatcctgattcagttggggcata

SEQ ID NO: 465777 - DNA, 25 bp, Rattus norvegicus
cgaggagtggcgactctccatcttc

SEQ ID NO: 465778 - DNA, 25 bp, Rattus norvegicus
aactatggccgagccctgaggtaca

SEQ ID NO: 465779 - DNA, 25 bp, Rattus norvegicus
gcggcctggacctttttccctagca

SEQ ID NO: 465780 - DNA, 25 bp, Rattus norvegicus
ggaaacacgccttgcgccgcaggag

SEQ ID NO: 465781 - DNA, 25 bp, Rattus norvegicus
gcgggccactgatagaggaaaacta

SEQ ID NO: 465782 - DNA, 25 bp, Rattus norvegicus
gaatctcacggctgagcagcgcgca

SEQ ID NO: 465783 - DNA, 25 bp, Rattus norvegicus
gaaatgtaatccacgcgcgccacca

SEQ ID NO: 465784 - DNA, 25 bp, Rattus norvegicus
accacgttgttcttggacgagaagg

SEQ ID NO: 465785 - DNA, 25 bp, Rattus norvegicus
cgagaaggtgacgatagccacgcgc

SEQ ID NO: 465786 - DNA, 25 bp, Rattus norvegicus
ccacgggaaagtcggacagcagctt

SEQ ID NO: 465787 - DNA, 25 bp, Rattus norvegicus
gcagcttgcgcacgaatttgagttc

SEQ ID NO: 465788 - DNA, 25 bp, Rattus norvegicus
tgaggaagttggtttggcccacgct

SEQ ID NO: 465789 - DNA, 25 bp, Rattus norvegicus
ctggaggactcgtccaccaggaaga

SEQ ID NO: 465790 - DNA, 25 bp, Rattus norvegicus
acaaaaggccagacgcgtccacatc

SEQ ID NO: 465791 - DNA, 25 bp, Rattus norvegicus
ctggaagttggtccagccggacacc

SEQ ID NO: 465792 - DNA, 25 bp, Rattus norvegicus
gcgcggctggtggaaatgtaatcca

SEQ ID NO: 465793 - DNA, 25 bp, Rattus norvegicus
tgccagagcccagcaacaaaaggcc

SEQ ID NO: 465794 - DNA, 25 bp, Rattus norvegicus
gaggcacggccagtcttcccagagc

SEQ ID NO: 465795 - DNA, 25 bp, Rattus norvegicus
gaccctgggtagcagccgcgaacct

SEQ ID NO: 465796 - DNA, 25 bp, Rattus norvegicus
ggaccatctaagtcctccggggcgc

SEQ ID NO: 465797 - DNA, 25 bp, Rattus norvegicus
gaaacttggggagtccctcgccagc

SEQ ID NO: 465798 - DNA, 25 bp, Rattus norvegicus
agaaacttggggagtccctcgccag

SEQ ID NO: 465799 - DNA, 25 bp, Rattus norvegicus
gcgacaccaagaaacttggggagtc

SEQ ID NO: 465800 - DNA, 25 bp, Rattus norvegicus
tcctccggggcgcgacaccaagaaa

SEQ ID NO: 465801 - DNA, 25 bp, Rattus norvegicus
taagtcctccggggcgcgacaccaa

SEQ ID NO: 465802 - DNA, 25 bp, Rattus norvegicus
atctaagtcctccggggcgcgacac

SEQ ID NO: 465803 - DNA, 25 bp, Rattus norvegicus
catctaagtcctccggggcgcgaca

SEQ ID NO: 465804 - DNA, 25 bp, Rattus norvegicus
gaccatctaagtcctccggggcgcg

SEQ ID NO: 465805 - DNA, 25 bp, Rattus norvegicus
cggaccatctaagtcctccggggcg

SEQ ID NO: 465806 - DNA, 25 bp, Rattus norvegicus
ggacacccggaccatctaagtcctc

SEQ ID NO: 465807 - DNA, 25 bp, Rattus norvegicus
cgcggacacccggaccatctaagtc

SEQ ID NO: 465808 - DNA, 25 bp, Rattus norvegicus
gcgcggacacccggaccatctaagt

SEQ ID NO: 465809 - DNA, 25 bp, Rattus norvegicus
accatctaagtcctccggggcgcga

SEQ ID NO: 465810 - DNA, 25 bp, Rattus norvegicus
ggcgcactgacctggccaaagggca

SEQ ID NO: 465811 - DNA, 25 bp, Rattus norvegicus
taagcaaccggaggccacctacgtg

SEQ ID NO: 465812 - DNA, 25 bp, Rattus norvegicus
ggaggccacctacgtgtcactcgga

SEQ ID NO: 465813 - DNA, 25 bp, Rattus norvegicus
gccacctacgtgtcactcggacgga

SEQ ID NO: 465814 - DNA, 25 bp, Rattus norvegicus
acgtgtcactcggacggaccctggg

SEQ ID NO: 465815 - DNA, 25 bp, Rattus norvegicus
cctggggcgcactgacctggccaaa

SEQ ID NO: 465816 - DNA, 25 bp, Rattus norvegicus
actgacctggccaaagggcaggaga

SEQ ID NO: 465817 - DNA, 25 bp, Rattus norvegicus
gcgcgcgcactcactggcgctcacg

SEQ ID NO: 465818 - DNA, 25 bp, Rattus norvegicus
ggcgctcacgcgcacggctacaaag

SEQ ID NO: 465819 - DNA, 25 bp, Rattus norvegicus
cgcgcacggctacaaagccgcgggt

SEQ ID NO: 465820 - DNA, 25 bp, Rattus norvegicus
tgggacagtgcaagccgatcgcgcc

SEQ ID NO: 465821 - DNA, 25 bp, Rattus norvegicus
acagtgcaagccgatcgcgccgcag

SEQ ID NO: 465822 - DNA, 25 bp, Rattus norvegicus
gacccaggtaagcaaccggaggcca

SEQ ID NO: 465823 - DNA, 25 bp, Rattus norvegicus
cctgcaggcggcctcacacacgcgc

SEQ ID NO: 465824 - DNA, 25 bp, Rattus norvegicus
ttctgccacatccacagagcacgag

SEQ ID NO: 465825 - DNA, 25 bp, Rattus norvegicus
ttcacagaatttcccgcgctgctgc

SEQ ID NO: 465826 - DNA, 25 bp, Rattus norvegicus
ccagtcattcacagaatttcccgcg

SEQ ID NO: 465827 - DNA, 25 bp, Rattus norvegicus
cagcgacactgcctccggtggtccc

SEQ ID NO: 465828 - DNA, 25 bp, Rattus norvegicus
ctccttacctgcgtggcacccacag

SEQ ID NO: 465829 - DNA, 25 bp, Rattus norvegicus
ttttcctcccaagccgctcttctct

SEQ ID NO: 465830 - DNA, 25 bp, Rattus norvegicus
ccacatccacagagcacgagtcatg

SEQ ID NO: 465831 - DNA, 25 bp, Rattus norvegicus
ggcgctttctgccacatccacagag

SEQ ID NO: 465832 - DNA, 25 bp, Rattus norvegicus
tgcctctccgccttctggcgctttc

SEQ ID NO: 465833 - DNA, 25 bp, Rattus norvegicus
ggcacgggtgccagcttccttgcct

SEQ ID NO: 465834 - DNA, 25 bp, Rattus norvegicus
aagaggcacgggtgccagcttcctt

SEQ ID NO: 465835 - DNA, 25 bp, Rattus norvegicus
caaggagcaggcaggcggcagaaga

SEQ ID NO: 465836 - DNA, 25 bp, Rattus norvegicus
aacttccccggctcaaggagcaggc

SEQ ID NO: 465837 - DNA, 25 bp, Rattus norvegicus
atccacagagcacgagtcatgcccg

SEQ ID NO: 465838 - DNA, 25 bp, Rattus norvegicus
gaccaggggcgctgcacacaggtgt

SEQ ID NO: 465839 - DNA, 25 bp, Rattus norvegicus
ccggggctcagcacgccagtcccga

SEQ ID NO: 465840 - DNA, 25 bp, Rattus norvegicus
cgcggcctaactgctcgcccgcccg

SEQ ID NO: 465841 - DNA, 25 bp, Rattus norvegicus
cctcgaaggtgaagtccagcaaatc

SEQ ID NO: 465842 - DNA, 25 bp, Rattus norvegicus
ggtgaagtccagcaaatcgggcttg

SEQ ID NO: 465843 - DNA, 25 bp, Rattus norvegicus
agtccagcaaatcgggcttgaggca

SEQ ID NO: 465844 - DNA, 25 bp, Rattus norvegicus
aggctgtagttgatgggcgacacct

SEQ ID NO: 465845 - DNA, 25 bp, Rattus norvegicus
tagttgatgggcgacacctcggtag

SEQ ID NO: 465846 - DNA, 25 bp, Rattus norvegicus
ggcgacacctcggtaggcagccgct

SEQ ID NO: 465847 - DNA, 25 bp, Rattus norvegicus
ggcagccgctcgaagggccgcttct

SEQ ID NO: 465848 - DNA, 25 bp, Rattus norvegicus
cttctccggcatcgcggcgaggccc

SEQ ID NO: 465849 - DNA, 25 bp, Rattus norvegicus
ggctgccagccacattcaccgggcg

SEQ ID NO: 465850 - DNA, 25 bp, Rattus norvegicus
accgcctgccgagagccaccgggga

SEQ ID NO: 465851 - DNA, 25 bp, Rattus norvegicus
cacacaggtgtgctggcccctgagg

SEQ ID NO: 465852 - DNA, 25 bp, Rattus norvegicus
tcttatatttagaaagagctgagcc

SEQ ID NO: 465853 - DNA, 25 bp, Rattus norvegicus
cagtgcaaacctgaggcctacaagc

SEQ ID NO: 465854 - DNA, 25 bp, Rattus norvegicus
cgcacttactcagctcgtcctggga

SEQ ID NO: 465855 - DNA, 25 bp, Rattus norvegicus
gccttgagtctctcacgcgggacgc

SEQ ID NO: 465856 - DNA, 25 bp, Rattus norvegicus
tcacgtccgcctggccggagctgaa

SEQ ID NO: 465857 - DNA, 25 bp, Rattus norvegicus
tgcgtcctccgcgttgcgagcgtcg

SEQ ID NO: 465858 - DNA, 25 bp, Rattus norvegicus
gagctgaaggaacacgcgcccggac

SEQ ID NO: 465859 - DNA, 25 bp, Rattus norvegicus
cacgcggcctctgacctgagtcgga

SEQ ID NO: 465860 - DNA, 25 bp, Rattus norvegicus
tgctcgcctcttgccggctcttata

SEQ ID NO: 465861 - DNA, 25 bp, Rattus norvegicus
ccctgtgtggagctgagtccggctc

SEQ ID NO: 465862 - DNA, 25 bp, Rattus norvegicus
aaggtctgcggctgtcacgtccgcc

SEQ ID NO: 465863 - DNA, 25 bp, Rattus norvegicus
cggtatccatagctcgggatgctgc

SEQ ID NO: 465864 - DNA, 25 bp, Rattus norvegicus
acctgagtcggagccggtatccata

SEQ ID NO: 465865 - DNA, 25 bp, Rattus norvegicus
ctcgcgagctcacgactcgggagct

SEQ ID NO: 465866 - DNA, 25 bp, Rattus norvegicus
cgggacagggttctgaacgcttctt

SEQ ID NO: 465867 - DNA, 25 bp, Rattus norvegicus
tatgacgttcgttttggagctgcgc

SEQ ID NO: 465868 - DNA, 25 bp, Rattus norvegicus
caggtattggtggtttatgacgttc

SEQ ID NO: 465869 - DNA, 25 bp, Rattus norvegicus
ctgaacgcttcttgcggtgcagctg

SEQ ID NO: 465870 - DNA, 25 bp, Rattus norvegicus
ttccgaagtcttgcgcgcgcagctg

SEQ ID NO: 465871 - DNA, 25 bp, Rattus norvegicus
cagaggcttccgaagtcttgcgcgc

SEQ ID NO: 465872 - DNA, 25 bp, Rattus norvegicus
tcgtagttcatagcctttgcgcagg

SEQ ID NO: 465873 - DNA, 25 bp, Rattus norvegicus
ttgggacccagagcatcccgcggac

SEQ ID NO: 465874 - DNA, 25 bp, Rattus norvegicus
ggcggattgggacccagagcatccc

SEQ ID NO: 465875 - DNA, 25 bp, Rattus norvegicus
cccgggaatcgtagttcatagcctt

SEQ ID NO: 465876 - DNA, 25 bp, Rattus norvegicus
atgctgctgcgtgggcgtgcacttc

SEQ ID NO: 465877 - DNA, 25 bp, Rattus norvegicus
tgggcgtgcacttcagcagcaccgc

SEQ ID NO: 465878 - DNA, 25 bp, Rattus norvegicus
ggctgcggatgttggtgcaggtatt

SEQ ID NO: 465879 - DNA, 25 bp, Rattus norvegicus
ttcatagcctttgcgcaggcgcaga

SEQ ID NO: 465880 - DNA, 25 bp, Rattus norvegicus
gccgcctggacctttaggacgtcca

SEQ ID NO: 465881 - DNA, 25 bp, Rattus norvegicus
atgaagtcccgaggtccagaaggtg

SEQ ID NO: 465882 - DNA, 25 bp, Rattus norvegicus
ccagccgggtgatcaggtcctctat

SEQ ID NO: 465883 - DNA, 25 bp, Rattus norvegicus
cagaaggtggtgtgtggctattcct

SEQ ID NO: 465884 - DNA, 25 bp, Rattus norvegicus
ctacgagacgctcaaggtgaggctc

SEQ ID NO: 465885 - DNA, 25 bp, Rattus norvegicus
ctgaggctttcctgctagtggcgac

SEQ ID NO: 465886 - DNA, 25 bp, Rattus norvegicus
ccgctcggccagcaaggcggagatc

SEQ ID NO: 465887 - DNA, 25 bp, Rattus norvegicus
cttggtaacactcgggaagccgcgg

SEQ ID NO: 465888 - DNA, 25 bp, Rattus norvegicus
tactgagcttccaaggctacccggc

SEQ ID NO: 465889 - DNA, 25 bp, Rattus norvegicus
acctccgcctcagaatagactactg

SEQ ID NO: 465890 - DNA, 25 bp, Rattus norvegicus
ctattcctgcgtgtggactgtgccg

SEQ ID NO: 465891 - DNA, 25 bp, Rattus norvegicus
tggccggagatttgggtctcccagc

SEQ ID NO: 465892 - DNA, 25 bp, Rattus norvegicus
cttctcccgtagcaacgcgcgggga

SEQ ID NO: 465893 - DNA, 25 bp, Rattus norvegicus
cacgtgtggctaagaccgcctccga

SEQ ID NO: 465894 - DNA, 25 bp, Rattus norvegicus
accgaccaagcgacacgcgggaggc

SEQ ID NO: 465895 - DNA, 25 bp, Rattus norvegicus
cagcacaggcgccacctaggtttgt

SEQ ID NO: 465896 - DNA, 25 bp, Rattus norvegicus
tttgttccgaggcagcagcgacccg

SEQ ID NO: 465897 - DNA, 25 bp, Rattus norvegicus
agccttagtcgccatgtcttccggg

SEQ ID NO: 465898 - DNA, 25 bp, Rattus norvegicus
tcgccatgtcttccggggccagcgt

SEQ ID NO: 465899 - DNA, 25 bp, Rattus norvegicus
aggatcaaggtgagcgcctgcccag

SEQ ID NO: 465900 - DNA, 25 bp, Rattus norvegicus
cacctaggtttgttccgaggcagca

SEQ ID NO: 465901 - DNA, 25 bp, Rattus norvegicus
ccgagtcagctctggaggctccacg

SEQ ID NO: 465902 - DNA, 25 bp, Rattus norvegicus
aggctccacgggtgcttccggcgac

SEQ ID NO: 465903 - DNA, 25 bp, Rattus norvegicus
ggtgcttccggcgactcaaactgtc

SEQ ID NO: 465904 - DNA, 25 bp, Rattus norvegicus
ggcgactcaaactgtcccagggacc

SEQ ID NO: 465905 - DNA, 25 bp, Rattus norvegicus
tcccagggaccagatctgagggctc

SEQ ID NO: 465906 - DNA, 25 bp, Rattus norvegicus
agcgcctggtagagcagctgaagct

SEQ ID NO: 465907 - DNA, 25 bp, Rattus norvegicus
ctgctcgcagccttagtcgccatgt

SEQ ID NO: 465908 - DNA, 25 bp, Rattus norvegicus
caaaagaccgggtcgcccgctcagg

SEQ ID NO: 465909 - DNA, 25 bp, Rattus norvegicus
ctaaatctatcccagcggtccggtc

SEQ ID NO: 465910 - DNA, 25 bp, Rattus norvegicus
cgtctagtgcggagctaaatctatc

SEQ ID NO: 465911 - DNA, 25 bp, Rattus norvegicus
agagtcctataatgcgtctagtgcg

SEQ ID NO: 465912 - DNA, 25 bp, Rattus norvegicus
cctgtagtcccggaggccacacggt

SEQ ID NO: 465913 - DNA, 25 bp, Rattus norvegicus
gcgaggaaccacagttcggggctca

SEQ ID NO: 465914 - DNA, 25 bp, Rattus norvegicus
ccacggacttactcccagcgaggaa

SEQ ID NO: 465915 - DNA, 25 bp, Rattus norvegicus
cggactcttcgtgtagccttcgaca

SEQ ID NO: 465916 - DNA, 25 bp, Rattus norvegicus
cgcgagacctgcacttgggactaaa

SEQ ID NO: 465917 - DNA, 25 bp, Rattus norvegicus
tcaacgcgttgtcaggcaaccagcg

SEQ ID NO: 465918 - DNA, 25 bp, Rattus norvegicus
gcctctgaaagcatcaacgcgttgt

SEQ ID NO: 465919 - DNA, 25 bp, Rattus norvegicus
gggcaggccacagacgcctctgaaa

SEQ ID NO: 465920 - DNA, 25 bp, Rattus norvegicus
tgcctgcgaagagccactgaagcct

SEQ ID NO: 465921 - DNA, 25 bp, Rattus norvegicus
gccacacggtgcactcgcgactgtg

SEQ ID NO: 465922 - DNA, 25 bp, Rattus norvegicus
tgggctcctccggatttggccaaga

SEQ ID NO: 465923 - DNA, 25 bp, Rattus norvegicus
gccaagttacactcagctgccttag

SEQ ID NO: 465924 - DNA, 25 bp, Rattus norvegicus
gctgccttagaggacgcccagtctt

SEQ ID NO: 465925 - DNA, 25 bp, Rattus norvegicus
gaggacgcccagtcttgcgcgaatt

SEQ ID NO: 465926 - DNA, 25 bp, Rattus norvegicus
ccagtcttgcgcgaattcagcacca

SEQ ID NO: 465927 - DNA, 25 bp, Rattus norvegicus
cggacccgcatcgtgccgggattcg

SEQ ID NO: 465928 - DNA, 25 bp, Rattus norvegicus
ccggatttggccaagataaaatgta

SEQ ID NO: 465929 - DNA, 25 bp, Rattus norvegicus
ataaaatgtagaggcggcgcgtgct

SEQ ID NO: 465930 - DNA, 25 bp, Rattus norvegicus
gcaccaagccattcttccaattctg

SEQ ID NO: 465931 - DNA, 25 bp, Rattus norvegicus
agccattcttccaattctgagtttg

SEQ ID NO: 465932 - DNA, 25 bp, Rattus norvegicus
ttggggtgcgcaccgagactgaccc

SEQ ID NO: 465933 - DNA, 25 bp, Rattus norvegicus
tggggattccttaaataacacagtc

SEQ ID NO: 465934 - DNA, 25 bp, Rattus norvegicus
tccttaaataacacagtctctgggc

SEQ ID NO: 465935 - DNA, 25 bp, Rattus norvegicus
tgcgcgaattcagcaccaagccatt

SEQ ID NO: 465936 - DNA, 25 bp, Rattus norvegicus
acgagctggactggcaggcgtgtat

SEQ ID NO: 465937 - DNA, 25 bp, Rattus norvegicus
actcctgggttgcaggcgactgcag

SEQ ID NO: 465938 - DNA, 25 bp, Rattus norvegicus
gagtcgccacccgactcctgggttg

SEQ ID NO: 465939 - DNA, 25 bp, Rattus norvegicus
atagcgctggagtcgccacccgact

SEQ ID NO: 465940 - DNA, 25 bp, Rattus norvegicus
gaatagcgctggagtcgccacccga

SEQ ID NO: 465941 - DNA, 25 bp, Rattus norvegicus
aaggaatagcgctggagtcgccacc

SEQ ID NO: 465942 - DNA, 25 bp, Rattus norvegicus
cgcggggtcctggagaaggaatagc

SEQ ID NO: 465943 - DNA, 25 bp, Rattus norvegicus
atcgatctccttgaggcggtgcggc

SEQ ID NO: 465944 - DNA, 25 bp, Rattus norvegicus
caatcgatctccttgaggcggtgcg

SEQ ID NO: 465945 - DNA, 25 bp, Rattus norvegicus
cccaatcgatctccttgaggcggtg

SEQ ID NO: 465946 - DNA, 25 bp, Rattus norvegicus
tgcgaggatagagaaagctggtccc

SEQ ID NO: 465947 - DNA, 25 bp, Rattus norvegicus
tctgcgaggatagagaaagctggtc

SEQ ID NO: 465948 - DNA, 25 bp, Rattus norvegicus
gttgcaggcgactgcagagctctcg

SEQ ID NO: 465949 - DNA, 25 bp, Rattus norvegicus
gtagcgttctgcgaggatagagaaa

SEQ ID NO: 465950 - DNA, 25 bp, Rattus norvegicus
gctccgcctccatgatccttccacg

SEQ ID NO: 465951 - DNA, 25 bp, Rattus norvegicus
gcgactggaagctttagaaccaccc

SEQ ID NO: 465952 - DNA, 25 bp, Rattus norvegicus
gaaccacccgcttgccctctctcca

SEQ ID NO: 465953 - DNA, 25 bp, Rattus norvegicus
cccgggagacgtgagtcggagcagg

SEQ ID NO: 465954 - DNA, 25 bp, Rattus norvegicus
agcagggctgcctccactacacacc

SEQ ID NO: 465955 - DNA, 25 bp, Rattus norvegicus
cagcctggcgtgctcctcgccgctc

SEQ ID NO: 465956 - DNA, 25 bp, Rattus norvegicus
tccagacctgggaagcgtcccgcgc

SEQ ID NO: 465957 - DNA, 25 bp, Rattus norvegicus
ctcaccatccgtgcccggctctccg

SEQ ID NO: 465958 - DNA, 25 bp, Rattus norvegicus
cccgcttcctctgggtgcccgccac

SEQ ID NO: 465959 - DNA, 25 bp, Rattus norvegicus
ccctgtgcgcggagataaggccagc

SEQ ID NO: 465960 - DNA, 25 bp, Rattus norvegicus
cagaggcttccggcctcgtagcgcg

SEQ ID NO: 465961 - DNA, 25 bp, Rattus norvegicus
ctggtgtagcggctgctcgggagcc

SEQ ID NO: 465962 - DNA, 25 bp, Rattus norvegicus
ggcgactggaagctttagaaccacc

SEQ ID NO: 465963 - DNA, 25 bp, Rattus norvegicus
gtcccgcactcaccatccgtgcccg

SEQ ID NO: 465964 - DNA, 25 bp, Rattus norvegicus
ccctgaatgttgctgcctagaaaag

SEQ ID NO: 465965 - DNA, 25 bp, Rattus norvegicus
ggaccgcagttcgagacccggtcgc

SEQ ID NO: 465966 - DNA, 25 bp, Rattus norvegicus
agcgccgcgcaccattttctgagag

SEQ ID NO: 465967 - DNA, 25 bp, Rattus norvegicus
cgcaccattttctgagaggaagtgt

SEQ ID NO: 465968 - DNA, 25 bp, Rattus norvegicus
tcgccgagaggaaacgaggccagca

SEQ ID NO: 465969 - DNA, 25 bp, Rattus norvegicus
cgagaggaaacgaggccagcacagc

SEQ ID NO: 465970 - DNA, 25 bp, Rattus norvegicus
acttacccatccatggcccagatgg

SEQ ID NO: 465971 - DNA, 25 bp, Rattus norvegicus
atccatggcccagatggaggagcgc

SEQ ID NO: 465972 - DNA, 25 bp, Rattus norvegicus
agcgtcgcgcctacgttcgcgggaa

SEQ ID NO: 465973 - DNA, 25 bp, Rattus norvegicus
ctacgttcgcgggaacgcgcgcctt

SEQ ID NO: 465974 - DNA, 25 bp, Rattus norvegicus
gcgccttgtgcttcccgcttcgaga

SEQ ID NO: 465975 - DNA, 25 bp, Rattus norvegicus
ttgtgcttcccgcttcgagactcgc

SEQ ID NO: 465976 - DNA, 25 bp, Rattus norvegicus
tcccggactaagactcagggccctg

SEQ ID NO: 465977 - DNA, 25 bp, Rattus norvegicus
tccggcttcccggactaagactcag

SEQ ID NO: 465978 - DNA, 25 bp, Rattus norvegicus
ccggcttacgcaaaagcatttttca

SEQ ID NO: 465979 - DNA, 25 bp, Rattus norvegicus
gcgacgcgccgaacttaggcaagca

SEQ ID NO: 465980 - DNA, 25 bp, Rattus norvegicus
ctgatgctctagacacgccagtggc

SEQ ID NO: 465981 - DNA, 25 bp, Rattus norvegicus
tggcccacaggcgaaactgattgtc

SEQ ID NO: 465982 - DNA, 25 bp, Rattus norvegicus
ctgattgtcatcgacggacccggga

SEQ ID NO: 465983 - DNA, 25 bp, Rattus norvegicus
gaggtgtcttccaaagcgcctgcgc

SEQ ID NO: 465984 - DNA, 25 bp, Rattus norvegicus
gtctctgtcttgtaggatctctgtc

SEQ ID NO: 465985 - DNA, 25 bp, Rattus norvegicus
agggaaggttctcctgtcactcaca

SEQ ID NO: 465986 - DNA, 25 bp, Rattus norvegicus
acaggtcgctgctgttccactgcca

SEQ ID NO: 465987 - DNA, 25 bp, Rattus norvegicus
actgcgaaggtcatgctgcccaaca

SEQ ID NO: 465988 - DNA, 25 bp, Rattus norvegicus
gatcggtgaaactgccgcgcgctct

SEQ ID NO: 465989 - DNA, 25 bp, Rattus norvegicus
tggaactccggctcgcgaaaagata

SEQ ID NO: 465990 - DNA, 25 bp, Rattus norvegicus
cacaccgtcttgtagggtctctgtc

SEQ ID NO: 465991 - DNA, 25 bp, Rattus norvegicus
aaaatgcgacgattaccggcttacg

SEQ ID NO: 465992 - DNA, 25 bp, Rattus norvegicus
cgggaccctcggaactgctgtgtcc

SEQ ID NO: 465993 - DNA, 25 bp, Rattus norvegicus
agggctccttcaaaatccgcctcag

SEQ ID NO: 465994 - DNA, 25 bp, Rattus norvegicus
cgctcgcaggcccttctcgaaaggg

SEQ ID NO: 465995 - DNA, 25 bp, Rattus norvegicus
acttggtccctccagggcgcctgag

SEQ ID NO: 465996 - DNA, 25 bp, Rattus norvegicus
ctttccgctgcaggacttggtccct

SEQ ID NO: 465997 - DNA, 25 bp, Rattus norvegicus
gctcggaagaggagctcagcagccc

SEQ ID NO: 465998 - DNA, 25 bp, Rattus norvegicus
gcctggagactaacagctgctcgga

SEQ ID NO: 465999 - DNA, 25 bp, Rattus norvegicus
cttggaatcggaggccgaaagcctg

SEQ ID NO: 466000 - DNA, 25 bp, Rattus norvegicus
ctgctggtcctggaaggcttggaat

SEQ ID NO: 466001 - DNA, 25 bp, Rattus norvegicus
accgctgtgcgctggatcccaaggc

SEQ ID NO: 466002 - DNA, 25 bp, Rattus norvegicus
cggcggccgttagagctgtcgctcc

SEQ ID NO: 466003 - DNA, 25 bp, Rattus norvegicus
ccctctatgaggcagaggccgcggc

SEQ ID NO: 466004 - DNA, 25 bp, Rattus norvegicus
ccacggagacgagcgacgcgctgct

SEQ ID NO: 466005 - DNA, 25 bp, Rattus norvegicus
cgcagctgatggtgttccgcaaaaa

SEQ ID NO: 466006 - DNA, 25 bp, Rattus norvegicus
ctgtccagctagttgcagaccggta

SEQ ID NO: 466007 - DNA, 25 bp, Rattus norvegicus
ctagcttggttgtcgggagttaccg

SEQ ID NO: 466008 - DNA, 25 bp, Rattus norvegicus
ctctgccggactagcttggttgtcg

SEQ ID NO: 466009 - DNA, 25 bp, Rattus norvegicus
ccagctagttgcagaccggtaaggc

SEQ ID NO: 466010 - DNA, 25 bp, Rattus norvegicus
aacggtctgtccagctagttgcaga

SEQ ID NO: 466011 - DNA, 25 bp, Rattus norvegicus
aggaggaacggtctgtccagctagt

SEQ ID NO: 466012 - DNA, 25 bp, Rattus norvegicus
agaaccttccttttgtctgctccgg

SEQ ID NO: 466013 - DNA, 25 bp, Rattus norvegicus
cgtgaccctcagaaccttccttttg

SEQ ID NO: 466014 - DNA, 25 bp, Rattus norvegicus
acgcacagacacctgcaggtgggtg

SEQ ID NO: 466015 - DNA, 25 bp, Rattus norvegicus
acagacgcacagacacctgcaggtg

SEQ ID NO: 466016 - DNA, 25 bp, Rattus norvegicus
tatggacagacgcacagacacctgc

SEQ ID NO: 466017 - DNA, 25 bp, Rattus norvegicus
gttcctatggacagacgcacagaca

SEQ ID NO: 466018 - DNA, 25 bp, Rattus norvegicus
gcccgcgttcctatggacagacgca

SEQ ID NO: 466019 - DNA, 25 bp, Rattus norvegicus
agttgcagaccggtaaggcgcctcg

SEQ ID NO: 466020 - DNA, 25 bp, Rattus norvegicus
ttgttgagcgaagacacgagctctg

SEQ ID NO: 466021 - DNA, 25 bp, Rattus norvegicus
cggacgctacccaaggtgatttgta

SEQ ID NO: 466022 - DNA, 25 bp, Rattus norvegicus
atcgactggacccaacggacgctac

SEQ ID NO: 466023 - DNA, 25 bp, Rattus norvegicus
agcttccgcctcctgactgacagag

SEQ ID NO: 466024 - DNA, 25 bp, Rattus norvegicus
cagaacccggcgagagtgcagcaat

SEQ ID NO: 466025 - DNA, 25 bp, Rattus norvegicus
gagaaacctcgctgtccagtcgccg

SEQ ID NO: 466026 - DNA, 25 bp, Rattus norvegicus
cttacccggaatgcgaggaacctcg

SEQ ID NO: 466027 - DNA, 25 bp, Rattus norvegicus
cggcgttagggccacactttttctg

SEQ ID NO: 466028 - DNA, 25 bp, Rattus norvegicus
agtgagaaaccctcgtacgctagtc

SEQ ID NO: 466029 - DNA, 25 bp, Rattus norvegicus
ctgaaggcgatcaaggccaccctga

SEQ ID NO: 466030 - DNA, 25 bp, Rattus norvegicus
gtgagcgaagccgagctaacactga

SEQ ID NO: 466031 - DNA, 25 bp, Rattus norvegicus
gccaggtttaaaggactcgcgactc

SEQ ID NO: 466032 - DNA, 25 bp, Rattus norvegicus
ttcccttccgaagaatgacagtcga

SEQ ID NO: 466033 - DNA, 25 bp, Rattus norvegicus
gagctctgagcagttgccaggttta

SEQ ID NO: 466034 - DNA, 25 bp, Rattus norvegicus
cggccagagggcatgtgttaccctg

SEQ ID NO: 466035 - DNA, 25 bp, Rattus norvegicus
tgctgcggtacttcgcttctgtgtc

SEQ ID NO: 466036 - DNA, 25 bp, Rattus norvegicus
gcatgtgttaccctggctgagagta

SEQ ID NO: 466037 - DNA, 25 bp, Rattus norvegicus
ttggccaaagcttgtcctctcactg

SEQ ID NO: 466038 - DNA, 25 bp, Rattus norvegicus
agacgaggatggatccaggaccacc

SEQ ID NO: 466039 - DNA, 25 bp, Rattus norvegicus
ggacctactgatggcccgcagcttc

SEQ ID NO: 466040 - DNA, 25 bp, Rattus norvegicus
ccaccgactagtgcagggcctcagg

SEQ ID NO: 466041 - DNA, 25 bp, Rattus norvegicus
gttactaagatacgctccacatttt

SEQ ID NO: 466042 - DNA, 25 bp, Rattus norvegicus
tttatttcctcctgcgcgggcagtg

SEQ ID NO: 466043 - DNA, 25 bp, Rattus norvegicus
tgtggctcgaagaccctaactcacg

SEQ ID NO: 466044 - DNA, 25 bp, Rattus norvegicus
atcgcggcgacttagcccacggatc

SEQ ID NO: 466045 - DNA, 25 bp, Rattus norvegicus
ttagcccacggatctgcggtgtgtt

SEQ ID NO: 466046 - DNA, 25 bp, Rattus norvegicus
gcggtgtgttgctcaggaaagctca

SEQ ID NO: 466047 - DNA, 25 bp, Rattus norvegicus
ggaaagctcatcctcccgggcagga

SEQ ID NO: 466048 - DNA, 25 bp, Rattus norvegicus
agtaagagtccgatgcgggacagaa

SEQ ID NO: 466049 - DNA, 25 bp, Rattus norvegicus
gctttgggagcagctcagggatccc

SEQ ID NO: 466050 - DNA, 25 bp, Rattus norvegicus
ctttgagtaagagtccgatgcggga

SEQ ID NO: 466051 - DNA, 25 bp, Rattus norvegicus
ggccagtccagcatcactttgagta

SEQ ID NO: 466052 - DNA, 25 bp, Rattus norvegicus
agtggccagtccagcatcactttga

SEQ ID NO: 466053 - DNA, 25 bp, Rattus norvegicus
gctgctccgtacatcacctccagtg

SEQ ID NO: 466054 - DNA, 25 bp, Rattus norvegicus
ccgcacagcccattgagcgccgctg

SEQ ID NO: 466055 - DNA, 25 bp, Rattus norvegicus
tccagcatcactttgagtaagagtc

SEQ ID NO: 466056 - DNA, 25 bp, Rattus norvegicus
ctcagggatcccagcgccatgaccc

SEQ ID NO: 466057 - DNA, 25 bp, Rattus norvegicus
atagagatcttacggtggtagcggt

SEQ ID NO: 466058 - DNA, 25 bp, Rattus norvegicus
agaaggaagcccagcatcgccgtgc

SEQ ID NO: 466059 - DNA, 25 bp, Rattus norvegicus
tcgccgtgcagatagagatcttacg

SEQ ID NO: 466060 - DNA, 25 bp, Rattus norvegicus
gaagcccagcatcgccgtgcagata

SEQ ID NO: 466061 - DNA, 25 bp, Rattus norvegicus
cagcatcgccgtgcagatagagatc

SEQ ID NO: 466062 - DNA, 25 bp, Rattus norvegicus
accgcctctggctttgtcaggtcct

SEQ ID NO: 466063 - DNA, 25 bp, Rattus norvegicus
ggatccctccgtacagcgaaggccg

SEQ ID NO: 466064 - DNA, 25 bp, Rattus norvegicus
ggcatggatccctccgtacagcgaa

SEQ ID NO: 466065 - DNA, 25 bp, Rattus norvegicus
atcttggcatggatccctccgtaca

SEQ ID NO: 466066 - DNA, 25 bp, Rattus norvegicus
gcgcggccatcttggcatggatccc

SEQ ID NO: 466067 - DNA, 25 bp, Rattus norvegicus
gtcagaggccgacatggcggccacc

SEQ ID NO: 466068 - DNA, 25 bp, Rattus norvegicus
ttgtcaggtccttgttggagtcaga

SEQ ID NO: 466069 - DNA, 25 bp, Rattus norvegicus
gacgcctggctttgtccgtactcct

SEQ ID NO: 466070 - DNA, 25 bp, Rattus norvegicus
atctccttcggacgcctggctttgt

SEQ ID NO: 466071 - DNA, 25 bp, Rattus norvegicus
tgtagccatctccttcggacgcctg

SEQ ID NO: 466072 - DNA, 25 bp, Rattus norvegicus
caggctcgggtgtagccatctcctt

SEQ ID NO: 466073 - DNA, 25 bp, Rattus norvegicus
tgtccgtactcctccggcccaccgc

SEQ ID NO: 466074 - DNA, 25 bp, Rattus norvegicus
tccttgttggagtcagaggccgaca

SEQ ID NO: 466075 - DNA, 25 bp, Rattus norvegicus
ctggctttgtcaggtccttgttgga

SEQ ID NO: 466076 - DNA, 25 bp, Rattus norvegicus
ccacacgcaatatggcggaatctga

SEQ ID NO: 466077 - DNA, 25 bp, Rattus norvegicus
gaagttccctcccacacgcaatatg

SEQ ID NO: 466078 - DNA, 25 bp, Rattus norvegicus
cggaatctgagtctgcgcagtgcga

SEQ ID NO: 466079 - DNA, 25 bp, Rattus norvegicus
ggccgactccttcctggcaggtcaa

SEQ ID NO: 466080 - DNA, 25 bp, Rattus norvegicus
tccggcgcgaaaggccgtaccattc

SEQ ID NO: 466081 - DNA, 25 bp, Rattus norvegicus
gtaccattcccacacagagactttg

SEQ ID NO: 466082 - DNA, 25 bp, Rattus norvegicus
agagactttgcgtccctcccagttc

SEQ ID NO: 466083 - DNA, 25 bp, Rattus norvegicus
ccagttcacacgtacggatttcaga

SEQ ID NO: 466084 - DNA, 25 bp, Rattus norvegicus
ggatttcagagccagcatgtcctcg

SEQ ID NO: 466085 - DNA, 25 bp, Rattus norvegicus
gcatgtcctcgtttcgttcgcaaaa

SEQ ID NO: 466086 - DNA, 25 bp, Rattus norvegicus
aaactattattagccgagccgagcg

SEQ ID NO: 466087 - DNA, 25 bp, Rattus norvegicus
agtgttttctatgtcgctacgccgc

SEQ ID NO: 466088 - DNA, 25 bp, Rattus norvegicus
cgacgcgcgaatggtctggaccaac

SEQ ID NO: 466089 - DNA, 25 bp, Rattus norvegicus
atggtctggaccaacgtcacctccg

SEQ ID NO: 466090 - DNA, 25 bp, Rattus norvegicus
tgtcagcgacgctgtcacagcagga

SEQ ID NO: 466091 - DNA, 25 bp, Rattus norvegicus
ggtacaccggagatcttcgcagccc

SEQ ID NO: 466092 - DNA, 25 bp, Rattus norvegicus
gactgggcggtacaccggagatctt

SEQ ID NO: 466093 - DNA, 25 bp, Rattus norvegicus
tgggctcaccatgccggtgagtctg

SEQ ID NO: 466094 - DNA, 25 bp, Rattus norvegicus
cggccgtctagtgggctcaccatgc

SEQ ID NO: 466095 - DNA, 25 bp, Rattus norvegicus
aatctcgagctgagtcccgagcggg

SEQ ID NO: 466096 - DNA, 25 bp, Rattus norvegicus
ccggagttgaatctcgagctgagtc

SEQ ID NO: 466097 - DNA, 25 bp, Rattus norvegicus
tccgagtcgagtccggagttgaatc

SEQ ID NO: 466098 - DNA, 25 bp, Rattus norvegicus
cggtagcagctgcaatccgagtcga

SEQ ID NO: 466099 - DNA, 25 bp, Rattus norvegicus
ggtgctcgaggaaggaccacaactc

SEQ ID NO: 466100 - DNA, 25 bp, Rattus norvegicus
atcacgggtcagagcagtctgcacc

SEQ ID NO: 466101 - DNA, 25 bp, Rattus norvegicus
acgctgtcacagcaggagtagggct

SEQ ID NO: 466102 - DNA, 25 bp, Rattus norvegicus
acccgctggggatttcggagagatc

SEQ ID NO: 466103 - DNA, 25 bp, Rattus norvegicus
gatttcggagagatcacgggtcaga

SEQ ID NO: 466104 - DNA, 25 bp, Rattus norvegicus
agcgatgattagtcagagggctcag

SEQ ID NO: 466105 - DNA, 25 bp, Rattus norvegicus
actcacccgccgcttggcgagagga

SEQ ID NO: 466106 - DNA, 25 bp, Rattus norvegicus
gaagtcggtgtcatcctcgtctccc

SEQ ID NO: 466107 - DNA, 25 bp, Rattus norvegicus
atcacgtcggctttcgcccagctga

SEQ ID NO: 466108 - DNA, 25 bp, Rattus norvegicus
tcgcccagctgaagggaggaaactg

SEQ ID NO: 466109 - DNA, 25 bp, Rattus norvegicus
aactggatggtaccagggcctgtca

SEQ ID NO: 466110 - DNA, 25 bp, Rattus norvegicus
cggcgaactgctttccggcaggaca

SEQ ID NO: 466111 - DNA, 25 bp, Rattus norvegicus
cggcaggacaaactctctcagggta

SEQ ID NO: 466112 - DNA, 25 bp, Rattus norvegicus
ctctctcagggtagtgaggcccaga

SEQ ID NO: 466113 - DNA, 25 bp, Rattus norvegicus
aggcaaatgaggaggtgagctccca

SEQ ID NO: 466114 - DNA, 25 bp, Rattus norvegicus
tgagctcccagtgacgcaaggcctc

SEQ ID NO: 466115 - DNA, 25 bp, Rattus norvegicus
gttcctagactctgagcgatgatta

SEQ ID NO: 466116 - DNA, 25 bp, Rattus norvegicus
agaatcggcggcctttactgcggtc

SEQ ID NO: 466117 - DNA, 25 bp, Rattus norvegicus
cctttactgcggtcctgggacacgt

SEQ ID NO: 466118 - DNA, 25 bp, Rattus norvegicus
actggtacatttccggccagtgacg

SEQ ID NO: 466119 - DNA, 25 bp, Rattus norvegicus
tcttctcccgagaggttgtgccgct

SEQ ID NO: 466120 - DNA, 25 bp, Rattus norvegicus
ttgtgccgctctataaggccacgcc

SEQ ID NO: 466121 - DNA, 25 bp, Rattus norvegicus
taaggccacgcccatcgatgacagc

SEQ ID NO: 466122 - DNA, 25 bp, Rattus norvegicus
gatgacagccgacacttggcaacta

SEQ ID NO: 466123 - DNA, 25 bp, Rattus norvegicus
ggcaactaccactcccaagatactt

SEQ ID NO: 466124 - DNA, 25 bp, Rattus norvegicus
ctcctagagcacgaactggtacatt

SEQ ID NO: 466125 - DNA, 25 bp, Rattus norvegicus
cacttccactttgctaggcgcgcgg

SEQ ID NO: 466126 - DNA, 25 bp, Rattus norvegicus
ccggtctgaaaagcagaacgggatt

SEQ ID NO: 466127 - DNA, 25 bp, Rattus norvegicus
cgagcctcctccacggtacggagtt

SEQ ID NO: 466128 - DNA, 25 bp, Rattus norvegicus
acggagttccgcatctaagttcatg

SEQ ID NO: 466129 - DNA, 25 bp, Rattus norvegicus
agttcatgcttatcctctcctaggg

SEQ ID NO: 466130 - DNA, 25 bp, Rattus norvegicus
tcctctcctagggaggacgcggtcc

SEQ ID NO: 466131 - DNA, 25 bp, Rattus norvegicus
aagatacttcgcgactcctagagca

SEQ ID NO: 466132 - DNA, 25 bp, Rattus norvegicus
ccctagcaaccaggcgcgcgtcgct

SEQ ID NO: 466133 - DNA, 25 bp, Rattus norvegicus
gtggctaccgcagaggacagcgcaa

SEQ ID NO: 466134 - DNA, 25 bp, Rattus norvegicus
cacggcagcctggtaaccgaggttc

SEQ ID NO: 466135 - DNA, 25 bp, Rattus norvegicus
tccggccgtgcacggcagcctggta

SEQ ID NO: 466136 - DNA, 25 bp, Rattus norvegicus
acctccacctcgctttcggtggatg

SEQ ID NO: 466137 - DNA, 25 bp, Rattus norvegicus
tcgctagggtgggagttctacttaa

SEQ ID NO: 466138 - DNA, 25 bp, Rattus norvegicus
ggcatccgtagcttccacaggttcc

SEQ ID NO: 466139 - DNA, 25 bp, Rattus norvegicus
acgggtagctggcatccgtagcttc

SEQ ID NO: 466140 - DNA, 25 bp, Rattus norvegicus
ctgaggcccgcaagcacgggtagct

SEQ ID NO: 466141 - DNA, 25 bp, Rattus norvegicus
ggctggcactgaggcccgcaagcac

SEQ ID NO: 466142 - DNA, 25 bp, Rattus norvegicus
ccacctcgctttcggtggatgggtg

SEQ ID NO: 466143 - DNA, 25 bp, Rattus norvegicus
acctcgggctccatacccaccggcg

SEQ ID NO: 466144 - DNA, 25 bp, Rattus norvegicus
gaggacagcgcaaggactcccacct

SEQ ID NO: 466145 - DNA, 25 bp, Rattus norvegicus
tctacttaaacgctccggccgtgca

SEQ ID NO: 466146 - DNA, 25 bp, Rattus norvegicus
cttcgagtctggagtttggcttcta

SEQ ID NO: 466147 - DNA, 25 bp, Rattus norvegicus
tcccggggcaggacgtccttagctc

SEQ ID NO: 466148 - DNA, 25 bp, Rattus norvegicus
cccgcacagctggagccacagggag

SEQ ID NO: 466149 - DNA, 25 bp, Rattus norvegicus
cgccacggtttcctctgcccaagtt

SEQ ID NO: 466150 - DNA, 25 bp, Rattus norvegicus
tccaggattttcaggcggggcgccc

SEQ ID NO: 466151 - DNA, 25 bp, Rattus norvegicus
ccttttgtccaggattttcaggcgg

SEQ ID NO: 466152 - DNA, 25 bp, Rattus norvegicus
gaacagctgcgctaggcaagggctt

SEQ ID NO: 466153 - DNA, 25 bp, Rattus norvegicus
tcccgctggaagaacagctgcgcta

SEQ ID NO: 466154 - DNA, 25 bp, Rattus norvegicus
cttggtgtcccgctggaagaacagc

SEQ ID NO: 466155 - DNA, 25 bp, Rattus norvegicus
gaatggagtcgctttctgcctggtc

SEQ ID NO: 466156 - DNA, 25 bp, Rattus norvegicus
cggcccgatgaatggagtcgctttc

SEQ ID NO: 466157 - DNA, 25 bp, Rattus norvegicus
ccactgcggcccgatgaatggagtc

SEQ ID NO: 466158 - DNA, 25 bp, Rattus norvegicus
ctctctgcccgcttcggctgtgggt

SEQ ID NO: 466159 - DNA, 25 bp, Rattus norvegicus
acagtgccctggctgctgaccgcag

SEQ ID NO: 466160 - DNA, 25 bp, Rattus norvegicus
agaggcagcggctgctctaccagtg

SEQ ID NO: 466161 - DNA, 25 bp, Rattus norvegicus
gagaccctcggccttgccattgctt

SEQ ID NO: 466162 - DNA, 25 bp, Rattus norvegicus
agtcttgggcctcctgtccctttcg

SEQ ID NO: 466163 - DNA, 25 bp, Rattus norvegicus
acgccgcgagtcttgggcctcctgt

SEQ ID NO: 466164 - DNA, 25 bp, Rattus norvegicus
ccggtcacccgccacgccgcgagtc

SEQ ID NO: 466165 - DNA, 25 bp, Rattus norvegicus
cgagctcctccctcgcgccggtcac

SEQ ID NO: 466166 - DNA, 25 bp, Rattus norvegicus
ctgctttaggcgtcaccgagctcct

SEQ ID NO: 466167 - DNA, 25 bp, Rattus norvegicus
cagaagctcgagaccctcggccttg

SEQ ID NO: 466168 - DNA, 25 bp, Rattus norvegicus
cggtcagaagctcgagaccctcggc

SEQ ID NO: 466169 - DNA, 25 bp, Rattus norvegicus
acgtaggcggtcagaagctcgagac

SEQ ID NO: 466170 - DNA, 25 bp, Rattus norvegicus
tggctccacgtaggcggtcagaagc

SEQ ID NO: 466171 - DNA, 25 bp, Rattus norvegicus
agcggctgctctaccagtggctcca

SEQ ID NO: 466172 - DNA, 25 bp, Rattus norvegicus
ctggctccgggaaagcgaccagaga

SEQ ID NO: 466173 - DNA, 25 bp, Rattus norvegicus
taccagtggctccacgtaggcggtc

SEQ ID NO: 466174 - DNA, 25 bp, Rattus norvegicus
ctacactcccttcggggcagtagga

SEQ ID NO: 466175 - DNA, 25 bp, Rattus norvegicus
gtgcatagggacagcgtctccgctg

SEQ ID NO: 466176 - DNA, 25 bp, Rattus norvegicus
tctaaaagcgcaagcccacgtgggg

SEQ ID NO: 466177 - DNA, 25 bp, Rattus norvegicus
ccctccagtgggtgcatagggacag

SEQ ID NO: 466178 - DNA, 25 bp, Rattus norvegicus
gtctccgctgcagcgttagcgcttc

SEQ ID NO: 466179 - DNA, 25 bp, Rattus norvegicus
agcgttagcgcttcgggaacacagc

SEQ ID NO: 466180 - DNA, 25 bp, Rattus norvegicus
gaacacagcgccattggggtgcacc

SEQ ID NO: 466181 - DNA, 25 bp, Rattus norvegicus
attggggtgcacctcgctttgttct

SEQ ID NO: 466182 - DNA, 25 bp, Rattus norvegicus
ttgttctggggtcgtcctcccagtc

SEQ ID NO: 466183 - DNA, 25 bp, Rattus norvegicus
gttcacctaccagagacgctgctca

SEQ ID NO: 466184 - DNA, 25 bp, Rattus norvegicus
tccgagcccggattcttgacacagc

SEQ ID NO: 466185 - DNA, 25 bp, Rattus norvegicus
ggattcttgacacagcgctctcccg

SEQ ID NO: 466186 - DNA, 25 bp, Rattus norvegicus
ggaatgcagcctacactcccttcgg

SEQ ID NO: 466187 - DNA, 25 bp, Rattus norvegicus
gggcagtaggatcctcgatcagctc

SEQ ID NO: 466188 - DNA, 25 bp, Rattus norvegicus
cctccttggagatgttgacaccgtc

SEQ ID NO: 466189 - DNA, 25 bp, Rattus norvegicus
tcgctaagatatgaccctcggaagc

SEQ ID NO: 466190 - DNA, 25 bp, Rattus norvegicus
ggacttcccgcgtcgctaagatatg

SEQ ID NO: 466191 - DNA, 25 bp, Rattus norvegicus
cagttctggtgtctggacttcccgc

SEQ ID NO: 466192 - DNA, 25 bp, Rattus norvegicus
tcctcaggtctcctcgcagacagtt

SEQ ID NO: 466193 - DNA, 25 bp, Rattus norvegicus
ggcagatttaggtcctcaggcctct

SEQ ID NO: 466194 - DNA, 25 bp, Rattus norvegicus
atcctggtaatgacggcgttgggca

SEQ ID NO: 466195 - DNA, 25 bp, Rattus norvegicus
cgcctccttgatgatcctggtaatg

SEQ ID NO: 466196 - DNA, 25 bp, Rattus norvegicus
gcggattctgttaactttctggcac

SEQ ID NO: 466197 - DNA, 25 bp, Rattus norvegicus
gaacgcagggttaggatcccgctgc

SEQ ID NO: 466198 - DNA, 25 bp, Rattus norvegicus
tgacaccgtccggtagctgcaggga

SEQ ID NO: 466199 - DNA, 25 bp, Rattus norvegicus
caaaacgaaaacactggccgcgcgg

SEQ ID NO: 466200 - DNA, 25 bp, Rattus norvegicus
gctcggcttaccaggatgtggcata

SEQ ID NO: 466201 - DNA, 25 bp, Rattus norvegicus
tggagatgaacacacatgcggattc

SEQ ID NO: 466202 - DNA, 25 bp, Rattus norvegicus
cacataaccaccacctggggacagg

SEQ ID NO: 466203 - DNA, 25 bp, Rattus norvegicus
gatctggcccgcgtcagccaagtca

SEQ ID NO: 466204 - DNA, 25 bp, Rattus norvegicus
tgcaccgagtctccctcgggagccg

SEQ ID NO: 466205 - DNA, 25 bp, Rattus norvegicus
atggagcgctccctgcaccgagtct

SEQ ID NO: 466206 - DNA, 25 bp, Rattus norvegicus
caacggggacgccatggagcgctcc

SEQ ID NO: 466207 - DNA, 25 bp, Rattus norvegicus
tgacctggccgcaacggggacgcca

SEQ ID NO: 466208 - DNA, 25 bp, Rattus norvegicus
tggcccgcgtcagccaagtcaggtg

SEQ ID NO: 466209 - DNA, 25 bp, Rattus norvegicus
accacctggggacaggtcctcctga

SEQ ID NO: 466210 - DNA, 25 bp, Rattus norvegicus
tgggttacctgcacccacataacca

SEQ ID NO: 466211 - DNA, 25 bp, Rattus norvegicus
ggctgagcctgcttcctgggttacc

SEQ ID NO: 466212 - DNA, 25 bp, Rattus norvegicus
tgtggaacggctgagcctgcttcct

SEQ ID NO: 466213 - DNA, 25 bp, Rattus norvegicus
attcaaaccagcacgggccaatcag

SEQ ID NO: 466214 - DNA, 25 bp, Rattus norvegicus
tggggacaggtcctcctgacctggc

SEQ ID NO: 466215 - DNA, 25 bp, Rattus norvegicus
agtcaggtggaaatctccccattca

SEQ ID NO: 466216 - DNA, 25 bp, Rattus norvegicus
aatttgggaatctgcctgggtgtca

SEQ ID NO: 466217 - DNA, 25 bp, Rattus norvegicus
gggccgagactttaaatcgccttca

SEQ ID NO: 466218 - DNA, 25 bp, Rattus norvegicus
tgtgatagatccctgagtagcctgg

SEQ ID NO: 466219 - DNA, 25 bp, Rattus norvegicus
cgaggaccctcggtgtcaataataa

SEQ ID NO: 466220 - DNA, 25 bp, Rattus norvegicus
gtctcccaccttctgctatcgagga

SEQ ID NO: 466221 - DNA, 25 bp, Rattus norvegicus
tgcagctcttggaccctttcaggag

SEQ ID NO: 466222 - DNA, 25 bp, Rattus norvegicus
ccaagtcaaggtcccagctgcgttc

SEQ ID NO: 466223 - DNA, 25 bp, Rattus norvegicus
atacggtcactcacagcggtcttcc

SEQ ID NO: 466224 - DNA, 25 bp, Rattus norvegicus
ctaaaggtgtttcgcgggagctcaa

SEQ ID NO: 466225 - DNA, 25 bp, Rattus norvegicus
agcgtctgagctcgccaggaatcca

SEQ ID NO: 466226 - DNA, 25 bp, Rattus norvegicus
agctgcctctgggagcatagcgtct

SEQ ID NO: 466227 - DNA, 25 bp, Rattus norvegicus
cagggaccttcatggactgtgcata

SEQ ID NO: 466228 - DNA, 25 bp, Rattus norvegicus
cacgcctgtggttgccattctcaga

SEQ ID NO: 466229 - DNA, 25 bp, Rattus norvegicus
cccggagctctaagatgcaaccttt

SEQ ID NO: 466230 - DNA, 25 bp, Rattus norvegicus
agcggcagacaaaggcctccaatcc

SEQ ID NO: 466231 - DNA, 25 bp, Rattus norvegicus
tgggtccatcaatgcgcgctctaga

SEQ ID NO: 466232 - DNA, 25 bp, Rattus norvegicus
tcaatgcgcgctctagactcccaga

SEQ ID NO: 466233 - DNA, 25 bp, Rattus norvegicus
ggcgctcccacctggagatagctga

SEQ ID NO: 466234 - DNA, 25 bp, Rattus norvegicus
tagctgaagcctcgtgggtcctata

SEQ ID NO: 466235 - DNA, 25 bp, Rattus norvegicus
tcctataggacccagttcggcagcg

SEQ ID NO: 466236 - DNA, 25 bp, Rattus norvegicus
ctgagtccctaaagactgagtttca

SEQ ID NO: 466237 - DNA, 25 bp, Rattus norvegicus
tgagtttcactccttcctcgagcgg

SEQ ID NO: 466238 - DNA, 25 bp, Rattus norvegicus
gtttcctggagttgagcggcagaca

SEQ ID NO: 466239 - DNA, 25 bp, Rattus norvegicus
ctccaatccgcgcttaaggcggggc

SEQ ID NO: 466240 - DNA, 25 bp, Rattus norvegicus
gggcgtgcctgctttgcataatgcc

SEQ ID NO: 466241 - DNA, 25 bp, Rattus norvegicus
tgctttgcataatgcccgcagccgg

SEQ ID NO: 466242 - DNA, 25 bp, Rattus norvegicus
ccgcagccggtccaggacagcagag

SEQ ID NO: 466243 - DNA, 25 bp, Rattus norvegicus
agcgggaccgtagtccgagcctcac

SEQ ID NO: 466244 - DNA, 25 bp, Rattus norvegicus
cccggatgtcacgagacttcctctg

SEQ ID NO: 466245 - DNA, 25 bp, Rattus norvegicus
cgagacttcctctgccaggcgtttc

SEQ ID NO: 466246 - DNA, 25 bp, Rattus norvegicus
ctctgccaggcgtttccgagcattt

SEQ ID NO: 466247 - DNA, 25 bp, Rattus norvegicus
caggcgtttccgagcatttggttgc

SEQ ID NO: 466248 - DNA, 25 bp, Rattus norvegicus
ttccgagcatttggttgcctggcaa

SEQ ID NO: 466249 - DNA, 25 bp, Rattus norvegicus
gcaaccgccgctggctttgtaggag

SEQ ID NO: 466250 - DNA, 25 bp, Rattus norvegicus
gcccggtacagggacactgaccaaa

SEQ ID NO: 466251 - DNA, 25 bp, Rattus norvegicus
ctgaccaaaccagttacagaccgga

SEQ ID NO: 466252 - DNA, 25 bp, Rattus norvegicus
ttacagaccggactggacagagcgg

SEQ ID NO: 466253 - DNA, 25 bp, Rattus norvegicus
aaccctagccaggaacgttcgtgca

SEQ ID NO: 466254 - DNA, 25 bp, Rattus norvegicus
gaacgttcgtgcacgccgactttta

SEQ ID NO: 466255 - DNA, 25 bp, Rattus norvegicus
ttcgtgcacgccgacttttaatacg

SEQ ID NO: 466256 - DNA, 25 bp, Rattus norvegicus
gctggctttgtaggagcccggtaca

SEQ ID NO: 466257 - DNA, 25 bp, Rattus norvegicus
ccggcttcccggatgtcacgagact

SEQ ID NO: 466258 - DNA, 25 bp, Rattus norvegicus
tacgcgttgaggcagtgagtgaact

SEQ ID NO: 466259 - DNA, 25 bp, Rattus norvegicus
tagtctcagagtccggagcagtcgc

SEQ ID NO: 466260 - DNA, 25 bp, Rattus norvegicus
ggcgccggtcaatctagtctcagag

SEQ ID NO: 466261 - DNA, 25 bp, Rattus norvegicus
cgagctgcccgttcctctagggctg

SEQ ID NO: 466262 - DNA, 25 bp, Rattus norvegicus
gaacagcagctacatgccggaaggc

SEQ ID NO: 466263 - DNA, 25 bp, Rattus norvegicus
ggctgcaatcctgaggaccgcggca

SEQ ID NO: 466264 - DNA, 25 bp, Rattus norvegicus
cgcgaaggcaggtgaaactggaatt

SEQ ID NO: 466265 - DNA, 25 bp, Rattus norvegicus
acggcggctgcagtctagactggcc

SEQ ID NO: 466266 - DNA, 25 bp, Rattus norvegicus
accagacgcagcatgggcagcagac

SEQ ID NO: 466267 - DNA, 25 bp, Rattus norvegicus
tgagtgaactgctcccgctcgggct

SEQ ID NO: 466268 - DNA, 25 bp, Rattus norvegicus
tgcgcaccaggtcgaagacgttgcg

SEQ ID NO: 466269 - DNA, 25 bp, Rattus norvegicus
agcagtcgcagccagaggagccaag

SEQ ID NO: 466270 - DNA, 25 bp, Rattus norvegicus
agctggcgcacgttggcagacagca

SEQ ID NO: 466271 - DNA, 25 bp, Rattus norvegicus
tgtactggtcgaagagcagctggtc

SEQ ID NO: 466272 - DNA, 25 bp, Rattus norvegicus
cggagctccgatcagttgcgcaggc

SEQ ID NO: 466273 - DNA, 25 bp, Rattus norvegicus
gcctctcttctcgttcgtcacttta

SEQ ID NO: 466274 - DNA, 25 bp, Rattus norvegicus
tacgaacctaagtcatcctggccgc

SEQ ID NO: 466275 - DNA, 25 bp, Rattus norvegicus
cacggccgtcgagtctacgaaccta

SEQ ID NO: 466276 - DNA, 25 bp, Rattus norvegicus
acagaaactatgctcccacctgatc

SEQ ID NO: 466277 - DNA, 25 bp, Rattus norvegicus
gacagtagtgggttcgtgctctttt

SEQ ID NO: 466278 - DNA, 25 bp, Rattus norvegicus
cacagatgcctgtggggacagtagt

SEQ ID NO: 466279 - DNA, 25 bp, Rattus norvegicus
gaagccgcgaggcaggaccacagat

SEQ ID NO: 466280 - DNA, 25 bp, Rattus norvegicus
gcatccagcagctactgcaggctga

SEQ ID NO: 466281 - DNA, 25 bp, Rattus norvegicus
cgagtcagtcgcagggcatccagca

SEQ ID NO: 466282 - DNA, 25 bp, Rattus norvegicus
ttcccgcagcaatggcgagtcagtc

SEQ ID NO: 466283 - DNA, 25 bp, Rattus norvegicus
gttctctcggccgaaagttcccgca

SEQ ID NO: 466284 - DNA, 25 bp, Rattus norvegicus
agccgttgacttaggccgttctctc

SEQ ID NO: 466285 - DNA, 25 bp, Rattus norvegicus
tagggccttctacgtgtgtttgagc

SEQ ID NO: 466286 - DNA, 25 bp, Rattus norvegicus
tccttcacggcagggacgagcccag

SEQ ID NO: 466287 - DNA, 25 bp, Rattus norvegicus
agacccgggagccagctgcctaagg

SEQ ID NO: 466288 - DNA, 25 bp, Rattus norvegicus
ccctaaggccagagggcagagaccc

SEQ ID NO: 466289 - DNA, 25 bp, Rattus norvegicus
tgaaggaaccctaaggccagagggc

SEQ ID NO: 466290 - DNA, 25 bp, Rattus norvegicus
tgatttctggggtgaaggaacccta

SEQ ID NO: 466291 - DNA, 25 bp, Rattus norvegicus
taaggctcgggtgatcttttcccgc

SEQ ID NO: 466292 - DNA, 25 bp, Rattus norvegicus
tccctccgctaaggctcgggtgatc

SEQ ID NO: 466293 - DNA, 25 bp, Rattus norvegicus
gtggaacctttgaccctgcgcgtcc

SEQ ID NO: 466294 - DNA, 25 bp, Rattus norvegicus
cgtggctgatgaaacgctccgggct

SEQ ID NO: 466295 - DNA, 25 bp, Rattus norvegicus
gggacgagcccagatctcatgcacg

SEQ ID NO: 466296 - DNA, 25 bp, Rattus norvegicus
ccagctgcctaaggccgaggccagg

SEQ ID NO: 466297 - DNA, 25 bp, Rattus norvegicus
cgcagaaagggcgtggaacctttga

SEQ ID NO: 466298 - DNA, 25 bp, Rattus norvegicus
agatctcatgcacgtggcgggcaca

SEQ ID NO: 466299 - DNA, 25 bp, Rattus norvegicus
acagggctcctactggcgccctggg

SEQ ID NO: 466300 - DNA, 25 bp, Rattus norvegicus
ctgtgcctgagcagggaccgctcaa

SEQ ID NO: 466301 - DNA, 25 bp, Rattus norvegicus
tacccactttcgagttgacaacgtc

SEQ ID NO: 466302 - DNA, 25 bp, Rattus norvegicus
gatgcagttacccactttcgagttg

SEQ ID NO: 466303 - DNA, 25 bp, Rattus norvegicus
gctgtgggcgatgcagttacccact

SEQ ID NO: 466304 - DNA, 25 bp, Rattus norvegicus
taacagccttggagccgagcaggag

SEQ ID NO: 466305 - DNA, 25 bp, Rattus norvegicus
ccagggtgagtaacagccttggagc

SEQ ID NO: 466306 - DNA, 25 bp, Rattus norvegicus
ggctgccctgtctgagccacagcga

SEQ ID NO: 466307 - DNA, 25 bp, Rattus norvegicus
cgcacctcacgtcccgctccggaag

SEQ ID NO: 466308 - DNA, 25 bp, Rattus norvegicus
taggcttgtccctgcccggttccag

SEQ ID NO: 466309 - DNA, 25 bp, Rattus norvegicus
tcccagcgacttgtaggcttgtccc

SEQ ID NO: 466310 - DNA, 25 bp, Rattus norvegicus
aggtgtctgtcccagcgacttgtag

SEQ ID NO: 466311 - DNA, 25 bp, Rattus norvegicus
ccgctcaaagcctctgtcgtggggc

SEQ ID NO: 466312 - DNA, 25 bp, Rattus norvegicus
agttgacaacgtctggcattcccag

SEQ ID NO: 466313 - DNA, 25 bp, Rattus norvegicus
cagggaccgctcaaagcctctgtcg

SEQ ID NO: 466314 - DNA, 25 bp, Rattus norvegicus
agccgggcgctctatttcagcgggc

SEQ ID NO: 466315 - DNA, 25 bp, Rattus norvegicus
agcagctgcgtctccgggccgactt

SEQ ID NO: 466316 - DNA, 25 bp, Rattus norvegicus
gtctccgggccgacttggagctgcc

SEQ ID NO: 466317 - DNA, 25 bp, Rattus norvegicus
cgcgacgccttcacgctgcaagtgt

SEQ ID NO: 466318 - DNA, 25 bp, Rattus norvegicus
cacgctgcaagtgtggctgagagcc

SEQ ID NO: 466319 - DNA, 25 bp, Rattus norvegicus
tggccagaagtctccagccgtgatc

SEQ ID NO: 466320 - DNA, 25 bp, Rattus norvegicus
ccgtgatcacaggtaaggcgaaagg

SEQ ID NO: 466321 - DNA, 25 bp, Rattus norvegicus
aaggggtgccctgtcaggtagacca

SEQ ID NO: 466322 - DNA, 25 bp, Rattus norvegicus
tgtcaggtagaccatcccgcttgtc

SEQ ID NO: 466323 - DNA, 25 bp, Rattus norvegicus
ccctccgggtcgctcgtggatgtat

SEQ ID NO: 466324 - DNA, 25 bp, Rattus norvegicus
agggaccacggaagcgagactcgct

SEQ ID NO: 466325 - DNA, 25 bp, Rattus norvegicus
gactcgctttaacccatctgcagaa

SEQ ID NO: 466326 - DNA, 25 bp, Rattus norvegicus
tctccagccgtgatcacaggtaagg

SEQ ID NO: 466327 - DNA, 25 bp, Rattus norvegicus
accgtcggacatgcggctctggagt

SEQ ID NO: 466328 - DNA, 25 bp, Rattus norvegicus
ctattgccgtgggatgtacgcgcta

SEQ ID NO: 466329 - DNA, 25 bp, Rattus norvegicus
gactggatctgagtggcaggaccgg

SEQ ID NO: 466330 - DNA, 25 bp, Rattus norvegicus
atggcagaatttggggactggatct

SEQ ID NO: 466331 - DNA, 25 bp, Rattus norvegicus
ctccaagattgaatggcagaatttg

SEQ ID NO: 466332 - DNA, 25 bp, Rattus norvegicus
tcgcggggctccaagattgaatggc

SEQ ID NO: 466333 - DNA, 25 bp, Rattus norvegicus
atgtacgcgctagcgcatgcgcagg

SEQ ID NO: 466334 - DNA, 25 bp, Rattus norvegicus
ttggctattgccgtgggatgtacgc

SEQ ID NO: 466335 - DNA, 25 bp, Rattus norvegicus
ctacaaattggctattgccgtggga

SEQ ID NO: 466336 - DNA, 25 bp, Rattus norvegicus
ggcgattctacaaattggctattgc

SEQ ID NO: 466337 - DNA, 25 bp, Rattus norvegicus
gacaggcgattctacaaattggcta

SEQ ID NO: 466338 - DNA, 25 bp, Rattus norvegicus
gacagacaggcgattctacaaattg

SEQ ID NO: 466339 - DNA, 25 bp, Rattus norvegicus
gggcaagttgacagacaggcgattc

SEQ ID NO: 466340 - DNA, 25 bp, Rattus norvegicus
tgggccgtgggcctacaagccccag

SEQ ID NO: 466341 - DNA, 25 bp, Rattus norvegicus
agggtctgcgatcagggactgtggt

SEQ ID NO: 466342 - DNA, 25 bp, Rattus norvegicus
agagctaaggggagcaacatttttg

SEQ ID NO: 466343 - DNA, 25 bp, Rattus norvegicus
acatttttgtaaacgctctctgaga

SEQ ID NO: 466344 - DNA, 25 bp, Rattus norvegicus
gccacttcgcgacactgggacaaga

SEQ ID NO: 466345 - DNA, 25 bp, Rattus norvegicus
ccgggattcgcgctgggaatcagca

SEQ ID NO: 466346 - DNA, 25 bp, Rattus norvegicus
actcctccgggattcgcgctgggaa

SEQ ID NO: 466347 - DNA, 25 bp, Rattus norvegicus
gggtgggaaatcagccgcgcttccc

SEQ ID NO: 466348 - DNA, 25 bp, Rattus norvegicus
taagctatcaattacccgggtggga

SEQ ID NO: 466349 - DNA, 25 bp, Rattus norvegicus
cgctctctgagataattaagctatc

SEQ ID NO: 466350 - DNA, 25 bp, Rattus norvegicus
ggcctgactccgacaaccaatcggg

SEQ ID NO: 466351 - DNA, 25 bp, Rattus norvegicus
ttttttggcctgactccgacaacca

SEQ ID NO: 466352 - DNA, 25 bp, Rattus norvegicus
tggcgcctctcccgcactgtttttt

SEQ ID NO: 466353 - DNA, 25 bp, Rattus norvegicus
agaagcgttttcacgggagcccttg

SEQ ID NO: 466354 - DNA, 25 bp, Rattus norvegicus
aaaacatggattctgaagaagcgtt

SEQ ID NO: 466355 - DNA, 25 bp, Rattus norvegicus
acactgggacaagattcagatgccc

SEQ ID NO: 466356 - DNA, 25 bp, Rattus norvegicus
gctgtaccggctgaacccgcggagc

SEQ ID NO: 466357 - DNA, 25 bp, Rattus norvegicus
gcagcgtggataccgtgacagtctt

SEQ ID NO: 466358 - DNA, 25 bp, Rattus norvegicus
cccgtccggcatcacttatgggttc

SEQ ID NO: 466359 - DNA, 25 bp, Rattus norvegicus
aggagacgagactccgcggctgtac

SEQ ID NO: 466360 - DNA, 25 bp, Rattus norvegicus
cgcacaaagagcaggagacgagact

SEQ ID NO: 466361 - DNA, 25 bp, Rattus norvegicus
gcccagggagctcgttacgcacaaa

SEQ ID NO: 466362 - DNA, 25 bp, Rattus norvegicus
aggtcatcttgtaccgcgatgcgcc

SEQ ID NO: 466363 - DNA, 25 bp, Rattus norvegicus
cagctcggtgttgtccaggtcatct

SEQ ID NO: 466364 - DNA, 25 bp, Rattus norvegicus
tacccagggtgaagaagggcagctc

SEQ ID NO: 466365 - DNA, 25 bp, Rattus norvegicus
gtgtgcggtgcctacccttacccag

SEQ ID NO: 466366 - DNA, 25 bp, Rattus norvegicus
tttcttgggactccgcgtgtgcggt

SEQ ID NO: 466367 - DNA, 25 bp, Rattus norvegicus
cacttatgggttctgggtttcttgg

SEQ ID NO: 466368 - DNA, 25 bp, Rattus norvegicus
ttgccaaccctaacagggcagcctg

SEQ ID NO: 466369 - DNA, 25 bp, Rattus norvegicus
accgtgacagtcttgagccggcatg

SEQ ID NO: 466370 - DNA, 25 bp, Rattus norvegicus
caatgtccgtctttggcggagaaca

SEQ ID NO: 466371 - DNA, 25 bp, Rattus norvegicus
tgattctagctgaaccgggtctgta

SEQ ID NO: 466372 - DNA, 25 bp, Rattus norvegicus
gcgcagatcccgaatcgtgattcta

SEQ ID NO: 466373 - DNA, 25 bp, Rattus norvegicus
ccaaaggatcgtatgcgcgcagatc

SEQ ID NO: 466374 - DNA, 25 bp, Rattus norvegicus
cggcgagtctccttacgtgagcacc

SEQ ID NO: 466375 - DNA, 25 bp, Rattus norvegicus
ccaaggatgagcttcaggggaactc

SEQ ID NO: 466376 - DNA, 25 bp, Rattus norvegicus
cgtgccagatcagttcgcagccgtg

SEQ ID NO: 466377 - DNA, 25 bp, Rattus norvegicus
gcctggctcatactcagccttaaag

SEQ ID NO: 466378 - DNA, 25 bp, Rattus norvegicus
caggaggacgctttttattcggctc

SEQ ID NO: 466379 - DNA, 25 bp, Rattus norvegicus
cgcgagcgtctggtatttctaatta

SEQ ID NO: 466380 - DNA, 25 bp, Rattus norvegicus
agtcgtcttacctggagtcaatgtc

SEQ ID NO: 466381 - DNA, 25 bp, Rattus norvegicus
agagtgttttgtacgtcttcaggcg

SEQ ID NO: 466382 - DNA, 25 bp, Rattus norvegicus
tgggaacttggaagagccctgcgtc

SEQ ID NO: 466383 - DNA, 25 bp, Rattus norvegicus
tggtcccgaggacaggcatgaatcc

SEQ ID NO: 466384 - DNA, 25 bp, Rattus norvegicus
ttatctgtttcactgggatgcgagc

SEQ ID NO: 466385 - DNA, 25 bp, Rattus norvegicus
ggccagctgtgctcgcaagagttgt

SEQ ID NO: 466386 - DNA, 25 bp, Rattus norvegicus
gacgacaggtccacaaccgggaaga

SEQ ID NO: 466387 - DNA, 25 bp, Rattus norvegicus
gctgctggtctgttctcgaagccca

SEQ ID NO: 466388 - DNA, 25 bp, Rattus norvegicus
gtgacattccctgccgaggctgctg

SEQ ID NO: 466389 - DNA, 25 bp, Rattus norvegicus
tcatccagttgatcggtcagtcatc

SEQ ID NO: 466390 - DNA, 25 bp, Rattus norvegicus
tgctgtccgcccaaggaaagctttg

SEQ ID NO: 466391 - DNA, 25 bp, Rattus norvegicus
tcctcgataggcagcggagcccaac

SEQ ID NO: 466392 - DNA, 25 bp, Rattus norvegicus
cccaaccaattggaagtcgcgtata

SEQ ID NO: 466393 - DNA, 25 bp, Rattus norvegicus
gtatactcacgtgacccgccagctt

SEQ ID NO: 466394 - DNA, 25 bp, Rattus norvegicus
cccggcctctttgtaatggcacaaa

SEQ ID NO: 466395 - DNA, 25 bp, Rattus norvegicus
gctccggctttgtctacccacagag

SEQ ID NO: 466396 - DNA, 25 bp, Rattus norvegicus
aacgccgccgtgcagacaaaggaca

SEQ ID NO: 466397 - DNA, 25 bp, Rattus norvegicus
gcggccgactctgggccagattatc

SEQ ID NO: 466398 - DNA, 25 bp, Rattus norvegicus
cacgtgcgccgctccaacgtgggtt

SEQ ID NO: 466399 - DNA, 25 bp, Rattus norvegicus
ggccacagcctgtgttggccttcgc

SEQ ID NO: 466400 - DNA, 25 bp, Rattus norvegicus
tttacccggctctaacactcctaga

SEQ ID NO: 466401 - DNA, 25 bp, Rattus norvegicus
ttacccggctctaacactcctagag

SEQ ID NO: 466402 - DNA, 25 bp, Rattus norvegicus
agccgctcggccaaccacgtgcgcc

SEQ ID NO: 466403 - DNA, 25 bp, Rattus norvegicus
cgccgctccaacgtgggttactgac

SEQ ID NO: 466404 - DNA, 25 bp, Rattus norvegicus
ccgctccaacgtgggttactgacgc

SEQ ID NO: 466405 - DNA, 25 bp, Rattus norvegicus
ctccaacgtgggttactgacgcatg

SEQ ID NO: 466406 - DNA, 25 bp, Rattus norvegicus
ccaacgtgggttactgacgcatgcc

SEQ ID NO: 466407 - DNA, 25 bp, Rattus norvegicus
aacgtgggttactgacgcatgccgg

SEQ ID NO: 466408 - DNA, 25 bp, Rattus norvegicus
ggttactgacgcatgccggccacag

SEQ ID NO: 466409 - DNA, 25 bp, Rattus norvegicus
catgccggccacagcctgtgttggc

SEQ ID NO: 466410 - DNA, 25 bp, Rattus norvegicus
gccggccacagcctgtgttggcctt

SEQ ID NO: 466411 - DNA, 25 bp, Rattus norvegicus
tctaacactcctagagcctgccttc

SEQ ID NO: 466412 - DNA, 25 bp, Rattus norvegicus
gcagggtcacgccagtatgcgctct

SEQ ID NO: 466413 - DNA, 25 bp, Rattus norvegicus
acgcggtttcacactcgctagcaaa

SEQ ID NO: 466414 - DNA, 25 bp, Rattus norvegicus
tcccttcggtggctcacggatgcag

SEQ ID NO: 466415 - DNA, 25 bp, Rattus norvegicus
tgcaggtggcgccttggctaaaacc

SEQ ID NO: 466416 - DNA, 25 bp, Rattus norvegicus
gctaaaacccacgtagacagccaga

SEQ ID NO: 466417 - DNA, 25 bp, Rattus norvegicus
acagccagaggcgagcgccgcttct

SEQ ID NO: 466418 - DNA, 25 bp, Rattus norvegicus
tcgtcgaccggcgttgcagagtctc

SEQ ID NO: 466419 - DNA, 25 bp, Rattus norvegicus
gacccggaggcaaacgtccgcgcga

SEQ ID NO: 466420 - DNA, 25 bp, Rattus norvegicus
tccacggctactgctcgcggtgcag

SEQ ID NO: 466421 - DNA, 25 bp, Rattus norvegicus
cgcggcttgaagctgcggagcccaa

SEQ ID NO: 466422 - DNA, 25 bp, Rattus norvegicus
gcgcaaagttctctcacgacccgga

SEQ ID NO: 466423 - DNA, 25 bp, Rattus norvegicus
cccaagcagggtccaggcagggtca

SEQ ID NO: 466424 - DNA, 25 bp, Rattus norvegicus
ctcttgcgccgcttacattaacacg

SEQ ID NO: 466425 - DNA, 25 bp, Rattus norvegicus
ctcctcggctctaagcaaagggctg

SEQ ID NO: 466426 - DNA, 25 bp, Rattus norvegicus
accattggttttgatcactgcttta

SEQ ID NO: 466427 - DNA, 25 bp, Rattus norvegicus
cgacactgcagagcgttctcaacct

SEQ ID NO: 466428 - DNA, 25 bp, Rattus norvegicus
cgttctcaacctttcggccagaggg

SEQ ID NO: 466429 - DNA, 25 bp, Rattus norvegicus
cccgagcggtttgattgatgaacct

SEQ ID NO: 466430 - DNA, 25 bp, Rattus norvegicus
attgatgaacctgtccaccgagggg

SEQ ID NO: 466431 - DNA, 25 bp, Rattus norvegicus
tccctacagtgagggaggatgacct

SEQ ID NO: 466432 - DNA, 25 bp, Rattus norvegicus
ccgtaccattggttttgatcactgc

SEQ ID NO: 466433 - DNA, 25 bp, Rattus norvegicus
cactgctttattatagccacagagg

SEQ ID NO: 466434 - DNA, 25 bp, Rattus norvegicus
tagccacagaggagtgaactatacc

SEQ ID NO: 466435 - DNA, 25 bp, Rattus norvegicus
actataccagttcgtttctgtggcc

SEQ ID NO: 466436 - DNA, 25 bp, Rattus norvegicus
cccttatccatttctagtgggatcc

SEQ ID NO: 466437 - DNA, 25 bp, Rattus norvegicus
agcccagcacctggggactcctgtg

SEQ ID NO: 466438 - DNA, 25 bp, Rattus norvegicus
acctggggactcctgtgagcccgcg

SEQ ID NO: 466439 - DNA, 25 bp, Rattus norvegicus
aggatgacctcgtgtctttcttccc

SEQ ID NO: 466440 - DNA, 25 bp, Rattus norvegicus
cccgaggaacttgcgcggctgcgct

SEQ ID NO: 466441 - DNA, 25 bp, Rattus norvegicus
cagctcattcccaggtgcgtggtcg

SEQ ID NO: 466442 - DNA, 25 bp, Rattus norvegicus
aggcccagctcattcccaggtgcgt

SEQ ID NO: 466443 - DNA, 25 bp, Rattus norvegicus
cctcggagaggaggcccagctcatt

SEQ ID NO: 466444 - DNA, 25 bp, Rattus norvegicus
gggacttccacacgcgcctcggaga

SEQ ID NO: 466445 - DNA, 25 bp, Rattus norvegicus
atcaccttcccggagttcgcgcgtg

SEQ ID NO: 466446 - DNA, 25 bp, Rattus norvegicus
tggcgcaatcaccttcccggagttc

SEQ ID NO: 466447 - DNA, 25 bp, Rattus norvegicus
acacggaccgcgatggcgcaatcac

SEQ ID NO: 466448 - DNA, 25 bp, Rattus norvegicus
aggcagtgttcctggggctcgacac

SEQ ID NO: 466449 - DNA, 25 bp, Rattus norvegicus
ttccgcacgctgtgcgcggagctgc

SEQ ID NO: 466450 - DNA, 25 bp, Rattus norvegicus
cgcctagaacgtgcggagttccgca

SEQ ID NO: 466451 - DNA, 25 bp, Rattus norvegicus
acacgaactgctccgggcgcctaga

SEQ ID NO: 466452 - DNA, 25 bp, Rattus norvegicus
aacctatgacacgaactgctccggg

SEQ ID NO: 466453 - DNA, 25 bp, Rattus norvegicus
tgcgctccgtcttcacaacctatga

SEQ ID NO: 466454 - DNA, 25 bp, Rattus norvegicus
ctgccgtatccaggtgcggtggcac

SEQ ID NO: 466455 - DNA, 25 bp, Rattus norvegicus
aacgtgtgaatgtccgcgtggacca

SEQ ID NO: 466456 - DNA, 25 bp, Rattus norvegicus
ggagggacgggctctcctcgccact

SEQ ID NO: 466457 - DNA, 25 bp, Rattus norvegicus
gctcccgcgttctgctgtgtatgtt

SEQ ID NO: 466458 - DNA, 25 bp, Rattus norvegicus
ctgctgtgtatgttcgcttcttgtc

SEQ ID NO: 466459 - DNA, 25 bp, Rattus norvegicus
cgcttcttgtcactgtgcgccgaga

SEQ ID NO: 466460 - DNA, 25 bp, Rattus norvegicus
cgccgagaggcagaaggactatgaa

SEQ ID NO: 466461 - DNA, 25 bp, Rattus norvegicus
ggactatgaaaatgattcactttcg

SEQ ID NO: 466462 - DNA, 25 bp, Rattus norvegicus
tttcggagctccagtatcaaatcgc

SEQ ID NO: 466463 - DNA, 25 bp, Rattus norvegicus
tatcaaatcgctcaaccaggagatg

SEQ ID NO: 466464 - DNA, 25 bp, Rattus norvegicus
accaggagatgaaatgcaccattcg

SEQ ID NO: 466465 - DNA, 25 bp, Rattus norvegicus
gcaccattcgactgctggacgactc

SEQ ID NO: 466466 - DNA, 25 bp, Rattus norvegicus
cggaggtctcctgccgtatccaggt

SEQ ID NO: 466467 - DNA, 25 bp, Rattus norvegicus
gagccgcgactgtattgagaacgtg

SEQ ID NO: 466468 - DNA, 25 bp, Rattus norvegicus
cgtctgcatcggctcctgcctggtg

SEQ ID NO: 466469 - DNA, 25 bp, Rattus norvegicus
tgcgccagtggaagcgcgtctatgc

SEQ ID NO: 466470 - DNA, 25 bp, Rattus norvegicus
agtggaagcgcgtctatgccgtcct

SEQ ID NO: 466471 - DNA, 25 bp, Rattus norvegicus
aagcgcgtctatgccgtcctgcggg

SEQ ID NO: 466472 - DNA, 25 bp, Rattus norvegicus
cgcgctcgctctcgttgagcaagga

SEQ ID NO: 466473 - DNA, 25 bp, Rattus norvegicus
tcgctctcgttgagcaaggagcggc

SEQ ID NO: 466474 - DNA, 25 bp, Rattus norvegicus
tgcatcggctcctgcctggtggaca

SEQ ID NO: 466475 - DNA, 25 bp, Rattus norvegicus
gcctggtggacatctcctacagcga

SEQ ID NO: 466476 - DNA, 25 bp, Rattus norvegicus
ggtggacatctcctacagcgagacc

SEQ ID NO: 466477 - DNA, 25 bp, Rattus norvegicus
atctcctacagcgagaccaagagga

SEQ ID NO: 466478 - DNA, 25 bp, Rattus norvegicus
agaccaagaggaggcacgtgttccg

SEQ ID NO: 466479 - DNA, 25 bp, Rattus norvegicus
gaggcacgtgttccggctgaccacc

SEQ ID NO: 466480 - DNA, 25 bp, Rattus norvegicus
cctgcgccagtggaagcgcgtctat

SEQ ID NO: 466481 - DNA, 25 bp, Rattus norvegicus
cctgcctggtggacatctcctacag

SEQ ID NO: 466482 - DNA, 25 bp, Rattus norvegicus
atcggaggtggtgttgctccagatt

SEQ ID NO: 466483 - DNA, 25 bp, Rattus norvegicus
ggatgtccagatccgcgaggtagca

SEQ ID NO: 466484 - DNA, 25 bp, Rattus norvegicus
tgacagtccattctggccctccggg

SEQ ID NO: 466485 - DNA, 25 bp, Rattus norvegicus
gcaggtaaccgcttcttggtccgga

SEQ ID NO: 466486 - DNA, 25 bp, Rattus norvegicus
ggacctcctccagcggcgcaggtaa

SEQ ID NO: 466487 - DNA, 25 bp, Rattus norvegicus
atccctttcattcgggtggcgtctg

SEQ ID NO: 466488 - DNA, 25 bp, Rattus norvegicus
ggaggccgcactttcatccctttca

SEQ ID NO: 466489 - DNA, 25 bp, Rattus norvegicus
tgcggaacaagtcttccaaagattc

SEQ ID NO: 466490 - DNA, 25 bp, Rattus norvegicus
gctgtcacctagtgcggaacaagtc

SEQ ID NO: 466491 - DNA, 25 bp, Rattus norvegicus
gtgcgcagcgaacagctgtcaccta

SEQ ID NO: 466492 - DNA, 25 bp, Rattus norvegicus
tgaaccacacgcagagagagccagc

SEQ ID NO: 466493 - DNA, 25 bp, Rattus norvegicus
tcacgtggcggatcgtgaaccacac

SEQ ID NO: 466494 - DNA, 25 bp, Rattus norvegicus
gctccagattgccacgcctgtgtga

SEQ ID NO: 466495 - DNA, 25 bp, Rattus norvegicus
gaggtagcaggtagcccgaccctca

SEQ ID NO: 466496 - DNA, 25 bp, Rattus norvegicus
ttaacacggggtcctgtgcggaaga

SEQ ID NO: 466497 - DNA, 25 bp, Rattus norvegicus
tccagcagttctttaacacggggtc

SEQ ID NO: 466498 - DNA, 25 bp, Rattus norvegicus
gcagcacgctgacgtaaaagccgcg

SEQ ID NO: 466499 - DNA, 25 bp, Rattus norvegicus
aagaggccgacacggcggctttcgc

SEQ ID NO: 466500 - DNA, 25 bp, Rattus norvegicus
gtcctgagcaggaaactcactgcta

SEQ ID NO: 466501 - DNA, 25 bp, Rattus norvegicus
ggaaactcactgctactcgaaaacg

SEQ ID NO: 466502 - DNA, 25 bp, Rattus norvegicus
gctactcgaaaacgaggaacccata

SEQ ID NO: 466503 - DNA, 25 bp, Rattus norvegicus
agagggcacaaccttccgatcgttc

SEQ ID NO: 466504 - DNA, 25 bp, Rattus norvegicus
ccctaagagcgtagagccagacagc

SEQ ID NO: 466505 - DNA, 25 bp, Rattus norvegicus
tccgatcgttcgctttgaaatgctg

SEQ ID NO: 466506 - DNA, 25 bp, Rattus norvegicus
tgaaatgctgtaaaatgctgccgga

SEQ ID NO: 466507 - DNA, 25 bp, Rattus norvegicus
tgccggaaagcagcacgctgacgta

SEQ ID NO: 466508 - DNA, 25 bp, Rattus norvegicus
ggaacccatatcaaaagagggcaca

SEQ ID NO: 466509 - DNA, 25 bp, Rattus norvegicus
acagcacgcgacaactccagcagtt

SEQ ID NO: 466510 - DNA, 25 bp, Rattus norvegicus
gaaccgtggctgagcagaatccgga

SEQ ID NO: 466511 - DNA, 25 bp, Rattus norvegicus
taactgctggagatcccacggaatc

SEQ ID NO: 466512 - DNA, 25 bp, Rattus norvegicus
tttctaaaatcctcgtaactgctgg

SEQ ID NO: 466513 - DNA, 25 bp, Rattus norvegicus
ccttgtctgggtgatttctaaaatc

SEQ ID NO: 466514 - DNA, 25 bp, Rattus norvegicus
tttctaggcttctctctttgtttcc

SEQ ID NO: 466515 - DNA, 25 bp, Rattus norvegicus
gaacctggcggtcacagttgccggc

SEQ ID NO: 466516 - DNA, 25 bp, Rattus norvegicus
acggagtggccagcccacacctaga

SEQ ID NO: 466517 - DNA, 25 bp, Rattus norvegicus
cgcgagcgagataacccgatactga

SEQ ID NO: 466518 - DNA, 25 bp, Rattus norvegicus
acggcttacctgttcacgtcggctc

SEQ ID NO: 466519 - DNA, 25 bp, Rattus norvegicus
gggcaaatcgccgaaccgtggctga

SEQ ID NO: 466520 - DNA, 25 bp, Rattus norvegicus
agatcccacggaatcgctgtgccca

SEQ ID NO: 466521 - DNA, 25 bp, Rattus norvegicus
cccaaaagtgaagcgcgagcgagat

SEQ ID NO: 466522 - DNA, 25 bp, Rattus norvegicus
ttggccacaaatagcaactcggctg

SEQ ID NO: 466523 - DNA, 25 bp, Rattus norvegicus
gcttttaaagcagattctttggcca

SEQ ID NO: 466524 - DNA, 25 bp, Rattus norvegicus
gctcactcggcatcggtgggctgca

SEQ ID NO: 466525 - DNA, 25 bp, Rattus norvegicus
tgctggggctcgcactccgctggct

SEQ ID NO: 466526 - DNA, 25 bp, Rattus norvegicus
agtgcccgcaggtgcggcggtgcgc

SEQ ID NO: 466527 - DNA, 25 bp, Rattus norvegicus
agacgccggggcgagtgcccgcagg

SEQ ID NO: 466528 - DNA, 25 bp, Rattus norvegicus
agagcccgcgggtcccgcagacgcc

SEQ ID NO: 466529 - DNA, 25 bp, Rattus norvegicus
cggcgcactcagagcccgcgggtcc

SEQ ID NO: 466530 - DNA, 25 bp, Rattus norvegicus
taaaagtggtatctgcgtgtgcgag

SEQ ID NO: 466531 - DNA, 25 bp, Rattus norvegicus
ctttaaaagtggtatctgcgtgtgc

SEQ ID NO: 466532 - DNA, 25 bp, Rattus norvegicus
cttctttaaaagtggtatctgcgtg

SEQ ID NO: 466533 - DNA, 25 bp, Rattus norvegicus
cggcttctttaaaagtggtatctgc

SEQ ID NO: 466534 - DNA, 25 bp, Rattus norvegicus
tcggcttctttaaaagtggtatctg

SEQ ID NO: 466535 - DNA, 25 bp, Rattus norvegicus
ggctgcagcgcttcggcttctttaa

SEQ ID NO: 466536 - DNA, 25 bp, Rattus norvegicus
cttgctcgcgctcgcgcacaggcgc

SEQ ID NO: 466537 - DNA, 25 bp, Rattus norvegicus
ctcactcggcatcggtgggctgcag

SEQ ID NO: 466538 - DNA, 25 bp, Rattus norvegicus
cctggagaggctagagaccaaactg

SEQ ID NO: 466539 - DNA, 25 bp, Rattus norvegicus
gcccagtgctgagctctagagcccg

SEQ ID NO: 466540 - DNA, 25 bp, Rattus norvegicus
tcgcaaagagtcatggaagacggtc

SEQ ID NO: 466541 - DNA, 25 bp, Rattus norvegicus
acggtccgctgccagatctcagaga

SEQ ID NO: 466542 - DNA, 25 bp, Rattus norvegicus
tctcagagacatcgagctgaagctg

SEQ ID NO: 466543 - DNA, 25 bp, Rattus norvegicus
agcagtagctgcagcagcttcgcgc

SEQ ID NO: 466544 - DNA, 25 bp, Rattus norvegicus
agagaccaaactgcacatcctcagg

SEQ ID NO: 466545 - DNA, 25 bp, Rattus norvegicus
gagcgcgcctctagactcggctaca

SEQ ID NO: 466546 - DNA, 25 bp, Rattus norvegicus
actcggctacagctaggcttgaacc

SEQ ID NO: 466547 - DNA, 25 bp, Rattus norvegicus
taggcttgaaccctgaggactttgc

SEQ ID NO: 466548 - DNA, 25 bp, Rattus norvegicus
ctttgctcggtcacggggtaccctg

SEQ ID NO: 466549 - DNA, 25 bp, Rattus norvegicus
ggtaccctggcagctcagtcggctc

SEQ ID NO: 466550 - DNA, 25 bp, Rattus norvegicus
tgcagatctgccgactgcgcccggg

SEQ ID NO: 466551 - DNA, 25 bp, Rattus norvegicus
catcctcaggcaggagatggtgagt

SEQ ID NO: 466552 - DNA, 25 bp, Rattus norvegicus
aaggcatgcaggttctcaggcgtgc

SEQ ID NO: 466553 - DNA, 25 bp, Rattus norvegicus
caggagagcaccctggacagccgca

SEQ ID NO: 466554 - DNA, 25 bp, Rattus norvegicus
cagggctcacgtcgatggccagtga

SEQ ID NO: 466555 - DNA, 25 bp, Rattus norvegicus
tggccttgcactcactgctcagctg

SEQ ID NO: 466556 - DNA, 25 bp, Rattus norvegicus
aagagcgtctgcttgagctcctgca

SEQ ID NO: 466557 - DNA, 25 bp, Rattus norvegicus
accacgccgtaggacggtgtgaaga

SEQ ID NO: 466558 - DNA, 25 bp, Rattus norvegicus
agcttctgcaggctggcacagcagg

SEQ ID NO: 466559 - DNA, 25 bp, Rattus norvegicus
ggtccaggatctcgaagtacagcag

SEQ ID NO: 466560 - DNA, 25 bp, Rattus norvegicus
ccaccatgagctggccggagaggac

SEQ ID NO: 466561 - DNA, 25 bp, Rattus norvegicus
gcacgttgctctggcccaccatgag

SEQ ID NO: 466562 - DNA, 25 bp, Rattus norvegicus
cgtgcgtagaagacacgcaggttct

SEQ ID NO: 466563 - DNA, 25 bp, Rattus norvegicus
tcctggttgatgtagccaggggcca

SEQ ID NO: 466564 - DNA, 25 bp, Rattus norvegicus
agttcaccttcaccaggctgtgaca

SEQ ID NO: 466565 - DNA, 25 bp, Rattus norvegicus
gtagagccttaccacctcctggttg

SEQ ID NO: 466566 - DNA, 25 bp, Rattus norvegicus
gccgcttaccctgctcgccggcctg

SEQ ID NO: 466567 - DNA, 25 bp, Rattus norvegicus
ctggagaatagcaacccagggcgca

SEQ ID NO: 466568 - DNA, 25 bp, Rattus norvegicus
aatagcaacccagggcgcaccatcg

SEQ ID NO: 466569 - DNA, 25 bp, Rattus norvegicus
ccacgaagcagggctccagcacaaa

SEQ ID NO: 466570 - DNA, 25 bp, Rattus norvegicus
cgggcccgcgcacagcaacaggcgc

SEQ ID NO: 466571 - DNA, 25 bp, Rattus norvegicus
cagccggggaaacttccagagtctc

SEQ ID NO: 466572 - DNA, 25 bp, Rattus norvegicus
tcgccggcctggaggagactcccag

SEQ ID NO: 466573 - DNA, 25 bp, Rattus norvegicus
gctcctctccgctttaaccacggcc

SEQ ID NO: 466574 - DNA, 25 bp, Rattus norvegicus
accacggccccaagagctcggtgtg

SEQ ID NO: 466575 - DNA, 25 bp, Rattus norvegicus
tggcgggaacgctcacgcgtagcca

SEQ ID NO: 466576 - DNA, 25 bp, Rattus norvegicus
acgctcacgcgtagccagggaactg

SEQ ID NO: 466577 - DNA, 25 bp, Rattus norvegicus
cacgcgtagccagggaactggagcc

SEQ ID NO: 466578 - DNA, 25 bp, Rattus norvegicus
caggcctgcctgttcgcggcgtcct

SEQ ID NO: 466579 - DNA, 25 bp, Rattus norvegicus
agactcccagggtgggtagagcgct

SEQ ID NO: 466580 - DNA, 25 bp, Rattus norvegicus
cccggagatgcccaagaaaatcttc

SEQ ID NO: 466581 - DNA, 25 bp, Rattus norvegicus
gcaactcctcactacttctcgggaa

SEQ ID NO: 466582 - DNA, 25 bp, Rattus norvegicus
gcgtataaggtagccgtggtcccac

SEQ ID NO: 466583 - DNA, 25 bp, Rattus norvegicus
tgtgccaaggttaggcaaagcctta

SEQ ID NO: 466584 - DNA, 25 bp, Rattus norvegicus
gccttagagggtctgcagcacaaga

SEQ ID NO: 466585 - DNA, 25 bp, Rattus norvegicus
cttaaaacgcactttcccggagatg

SEQ ID NO: 466586 - DNA, 25 bp, Rattus norvegicus
cttcgagaagcaaggatttcatcta

SEQ ID NO: 466587 - DNA, 25 bp, Rattus norvegicus
ttttacagtcatctgagcccagcgg

SEQ ID NO: 466588 - DNA, 25 bp, Rattus norvegicus
cggatcaccgcaacttcgcaacaaa

SEQ ID NO: 466589 - DNA, 25 bp, Rattus norvegicus
tagccaaagattcaagttcactcgg

SEQ ID NO: 466590 - DNA, 25 bp, Rattus norvegicus
ttcactcggcgagctagatttcccg

SEQ ID NO: 466591 - DNA, 25 bp, Rattus norvegicus
ttcccggggtgaaatccaatctaca

SEQ ID NO: 466592 - DNA, 25 bp, Rattus norvegicus
tgcgatcaatcaggacggggctctg

SEQ ID NO: 466593 - DNA, 25 bp, Rattus norvegicus
tctcgggaagactagggtgtgccaa

SEQ ID NO: 466594 - DNA, 25 bp, Rattus norvegicus
gctcttccaggtgcgaatcccgcgg

SEQ ID NO: 466595 - DNA, 25 bp, Rattus norvegicus
gcggccgctttggtagcagttttca

SEQ ID NO: 466596 - DNA, 25 bp, Rattus norvegicus
cctaggacgcttcgaagtgcaggga

SEQ ID NO: 466597 - DNA, 25 bp, Rattus norvegicus
cgagctcttagttataaggcctgcc

SEQ ID NO: 466598 - DNA, 25 bp, Rattus norvegicus
tctccaaatcttaaccgagctctta

SEQ ID NO: 466599 - DNA, 25 bp, Rattus norvegicus
cgggctttgaaatagtctccaaatc

SEQ ID NO: 466600 - DNA, 25 bp, Rattus norvegicus
ttcccgcgcgctcgggctttgaaat

SEQ ID NO: 466601 - DNA, 25 bp, Rattus norvegicus
cagttttcagccgtgcgtgcacagt

SEQ ID NO: 466602 - DNA, 25 bp, Rattus norvegicus
ccggtccctagccaggtactgtagg

SEQ ID NO: 466603 - DNA, 25 bp, Rattus norvegicus
cgtaagcatgttgagctacgtggcg

SEQ ID NO: 466604 - DNA, 25 bp, Rattus norvegicus
tgggccacttcctttccgggcagcg

SEQ ID NO: 466605 - DNA, 25 bp, Rattus norvegicus
taggcttgcacacgctgggccactt

SEQ ID NO: 466606 - DNA, 25 bp, Rattus norvegicus
aggcggagcctacatgagcacctta

SEQ ID NO: 466607 - DNA, 25 bp, Rattus norvegicus
gagcaccttaggcttgcacacgctg

SEQ ID NO: 466608 - DNA, 25 bp, Rattus norvegicus
ggctgcccagacaatggagaaagaa

SEQ ID NO: 466609 - DNA, 25 bp, Rattus norvegicus
tggggccgccgagcgtttccaggcc

SEQ ID NO: 466610 - DNA, 25 bp, Rattus norvegicus
cgccgagtgaatgaacttgattccc

SEQ ID NO: 466611 - DNA, 25 bp, Rattus norvegicus
ccaccgctcgcccatcctctcctcc

SEQ ID NO: 466612 - DNA, 25 bp, Rattus norvegicus
atggagaaagaaaagtgagcgcccg

SEQ ID NO: 466613 - DNA, 25 bp, Rattus norvegicus
cccgccgagtgaatgaacttgattc

SEQ ID NO: 466614 - DNA, 25 bp, Rattus norvegicus
tgtcgccctagcttggggccgccga

SEQ ID NO: 466615 - DNA, 25 bp, Rattus norvegicus
gaatgaacttgattcccgggacctg

SEQ ID NO: 466616 - DNA, 25 bp, Rattus norvegicus
atgaacttgattcccgggacctggg

SEQ ID NO: 466617 - DNA, 25 bp, Rattus norvegicus
cgcgcgggcactctctcccacacac

SEQ ID NO: 466618 - DNA, 25 bp, Rattus norvegicus
caaaggctgcccagacaatggagaa

SEQ ID NO: 466619 - DNA, 25 bp, Rattus norvegicus
cccagacaatggagaaagaaaagtg

SEQ ID NO: 466620 - DNA, 25 bp, Rattus norvegicus
cggggctccgtgtcgccctagcttg

SEQ ID NO: 466621 - DNA, 25 bp, Rattus norvegicus
tgcgtgtgcggctgcggttcttccc

SEQ ID NO: 466622 - DNA, 25 bp, Rattus norvegicus
ccacacggtggtggtacagagccca

SEQ ID NO: 466623 - DNA, 25 bp, Rattus norvegicus
cgacgaacgcagtgagctgagccac

SEQ ID NO: 466624 - DNA, 25 bp, Rattus norvegicus
ttatgccatgcgacactctggcgcg

SEQ ID NO: 466625 - DNA, 25 bp, Rattus norvegicus
tcggcgtcatccagcagccaggagt

SEQ ID NO: 466626 - DNA, 25 bp, Rattus norvegicus
cgacctcaacttcaacgagtggaag

SEQ ID NO: 466627 - DNA, 25 bp, Rattus norvegicus
gcgtgcgaccgcacagcgacaataa

SEQ ID NO: 466628 - DNA, 25 bp, Rattus norvegicus
agcgacaataaggactctggcctca

SEQ ID NO: 466629 - DNA, 25 bp, Rattus norvegicus
tcagcagcctggagtccaccaaggc

SEQ ID NO: 466630 - DNA, 25 bp, Rattus norvegicus
attcagctgcctccagtgctgcgga

SEQ ID NO: 466631 - DNA, 25 bp, Rattus norvegicus
ccaccatggaccgtagcgtgtgctc

SEQ ID NO: 466632 - DNA, 25 bp, Rattus norvegicus
agtgtctgtgacaccctctccggtc

SEQ ID NO: 466633 - DNA, 25 bp, Rattus norvegicus
gtccttcagctcacaccatcttatg

SEQ ID NO: 466634 - DNA, 25 bp, Rattus norvegicus
gcaccgacgatgactccgagcagga

SEQ ID NO: 466635 - DNA, 25 bp, Rattus norvegicus
acgcgctccatcgtctcgggctatt

SEQ ID NO: 466636 - DNA, 25 bp, Rattus norvegicus
tttccgtgcagagaccgagaggccc

SEQ ID NO: 466637 - DNA, 25 bp, Rattus norvegicus
acgcgggaagcggcgcttcgcttcc

SEQ ID NO: 466638 - DNA, 25 bp, Rattus norvegicus
tggagcctggacagtacccgaccta

SEQ ID NO: 466639 - DNA, 25 bp, Rattus norvegicus
agcctggacagtacccgacctagcg

SEQ ID NO: 466640 - DNA, 25 bp, Rattus norvegicus
cgacctagcgccactggctgtggtt

SEQ ID NO: 466641 - DNA, 25 bp, Rattus norvegicus
cactggctgtggttccttgcggttc

SEQ ID NO: 466642 - DNA, 25 bp, Rattus norvegicus
ttccttgcggttccctgccacgtgg

SEQ ID NO: 466643 - DNA, 25 bp, Rattus norvegicus
tggctccacggcctttgctttcgaa

SEQ ID NO: 466644 - DNA, 25 bp, Rattus norvegicus
tccacggcctttgctttcgaacttg

SEQ ID NO: 466645 - DNA, 25 bp, Rattus norvegicus
cggcctttgctttcgaacttgtgtg

SEQ ID NO: 466646 - DNA, 25 bp, Rattus norvegicus
ctttcgaacttgtgtgtgcttaggc

SEQ ID NO: 466647 - DNA, 25 bp, Rattus norvegicus
tcgaacttgtgtgtgcttaggcggt

SEQ ID NO: 466648 - DNA, 25 bp, Rattus norvegicus
ctggtttccgtgcagagaccgagag

SEQ ID NO: 466649 - DNA, 25 bp, Rattus norvegicus
gcctcgctggtttccgtgcagagac

SEQ ID NO: 466650 - DNA, 25 bp, Rattus norvegicus
cagcgacctcgaaatgaatgaaacg

SEQ ID NO: 466651 - DNA, 25 bp, Rattus norvegicus
ggccgaaagacctgaaaacgctcgc

SEQ ID NO: 466652 - DNA, 25 bp, Rattus norvegicus
cgctcctccgctctccactcggctc

SEQ ID NO: 466653 - DNA, 25 bp, Rattus norvegicus
atgctccacggcaggtgcgggaccg

SEQ ID NO: 466654 - DNA, 25 bp, Rattus norvegicus
ccattcaattcagggccgcggtctc

SEQ ID NO: 466655 - DNA, 25 bp, Rattus norvegicus
agaactcggccgatttctctcacca

SEQ ID NO: 466656 - DNA, 25 bp, Rattus norvegicus
ttccggagagaactcggccgatttc

SEQ ID NO: 466657 - DNA, 25 bp, Rattus norvegicus
atgcagggacgccagagttccggag

SEQ ID NO: 466658 - DNA, 25 bp, Rattus norvegicus
tgaatgaaacgttcggtcacaccga

SEQ ID NO: 466659 - DNA, 25 bp, Rattus norvegicus
gcaccagcgacctcgaaatgaatga

SEQ ID NO: 466660 - DNA, 25 bp, Rattus norvegicus
gacctgaaaacgctcgcagcccaga

SEQ ID NO: 466661 - DNA, 25 bp, Rattus norvegicus
tgaaaacgctcgcagcccagagctg

SEQ ID NO: 466662 - DNA, 25 bp, Rattus norvegicus
gtcacaccgacagcccgagcccggg

SEQ ID NO: 466663 - DNA, 25 bp, Rattus norvegicus
aggcacggccgtcgccgtctccgct

SEQ ID NO: 466664 - DNA, 25 bp, Rattus norvegicus
gtcgggtctagaacggctccgcaaa

SEQ ID NO: 466665 - DNA, 25 bp, Rattus norvegicus
tacccaagcggatgccaggctaatg

SEQ ID NO: 466666 - DNA, 25 bp, Rattus norvegicus
cgcggtatctactgcgcacccagta

SEQ ID NO: 466667 - DNA, 25 bp, Rattus norvegicus
ttttctgggctctgggttcagccca

SEQ ID NO: 466668 - DNA, 25 bp, Rattus norvegicus
acgctgcttggcgtgaaggacagcc

SEQ ID NO: 466669 - DNA, 25 bp, Rattus norvegicus
cggctccgcaaaagcccatagggtc

SEQ ID NO: 466670 - DNA, 25 bp, Rattus norvegicus
ccacagaaagcgacagtcgggtcta

SEQ ID NO: 466671 - DNA, 25 bp, Rattus norvegicus
cccgcggaacttccacagaaagcga

SEQ ID NO: 466672 - DNA, 25 bp, Rattus norvegicus
gtttcccggccgcagggctcaagct

SEQ ID NO: 466673 - DNA, 25 bp, Rattus norvegicus
gattctggaccacaggggacgtttc

SEQ ID NO: 466674 - DNA, 25 bp, Rattus norvegicus
cggcaggtcacttcggtagcctaga

SEQ ID NO: 466675 - DNA, 25 bp, Rattus norvegicus
gctggaatcaacaggtcgggcgccc

SEQ ID NO: 466676 - DNA, 25 bp, Rattus norvegicus
agtgctaaaggaagcgctggaatca

SEQ ID NO: 466677 - DNA, 25 bp, Rattus norvegicus
cccatagggtccaaggaggctcaga

SEQ ID NO: 466678 - DNA, 25 bp, Rattus norvegicus
accgccctcggacaagccaagagaa

SEQ ID NO: 466679 - DNA, 25 bp, Rattus norvegicus
ccaacaacggctttgaggatgctgc

SEQ ID NO: 466680 - DNA, 25 bp, Rattus norvegicus
cgacggacggagaggcatccaacaa

SEQ ID NO: 466681 - DNA, 25 bp, Rattus norvegicus
tttgtcgctgaacgaaccgcaggca

SEQ ID NO: 466682 - DNA, 25 bp, Rattus norvegicus
agcagctttccagagtacgagcttc

SEQ ID NO: 466683 - DNA, 25 bp, Rattus norvegicus
ggtcgactaggagcccaggatttgt

SEQ ID NO: 466684 - DNA, 25 bp, Rattus norvegicus
tacgagcttcccgagttgcacacgc

SEQ ID NO: 466685 - DNA, 25 bp, Rattus norvegicus
caagagaacaatgcacccagccctg

SEQ ID NO: 466686 - DNA, 25 bp, Rattus norvegicus
ccgtagccagcctgccgggagatgt

SEQ ID NO: 466687 - DNA, 25 bp, Rattus norvegicus
tgtagtttctgaagcacagctcaca

SEQ ID NO: 466688 - DNA, 25 bp, Rattus norvegicus
cgcctgctagccagcttttgccgga

SEQ ID NO: 466689 - DNA, 25 bp, Rattus norvegicus
tgccggaagggatcctggctgacat

SEQ ID NO: 466690 - DNA, 25 bp, Rattus norvegicus
ccagtgggagccacagcagctttcc

SEQ ID NO: 466691 - DNA, 25 bp, Rattus norvegicus
tgcacacgcgcgtgttccacgtcgg

SEQ ID NO: 466692 - DNA, 25 bp, Rattus norvegicus
cgcgatcagtagatgcgagcaccga

SEQ ID NO: 466693 - DNA, 25 bp, Rattus norvegicus
tcagtagatgcgagcaccgacgcga

SEQ ID NO: 466694 - DNA, 25 bp, Rattus norvegicus
tagatgcgagcaccgacgcgagctg

SEQ ID NO: 466695 - DNA, 25 bp, Rattus norvegicus
tgccgcagaggcgtctcaacggctc

SEQ ID NO: 466696 - DNA, 25 bp, Rattus norvegicus
cgagtcatgtttgaggggcgacgcc

SEQ ID NO: 466697 - DNA, 25 bp, Rattus norvegicus
cagcgcagccgcgatcagtagatgc

SEQ ID NO: 466698 - DNA, 25 bp, Rattus norvegicus
acgcgcctgcgagggacagcaggga

SEQ ID NO: 466699 - DNA, 25 bp, Rattus norvegicus
gcagggagggcggttaaagcgcaaa

SEQ ID NO: 466700 - DNA, 25 bp, Rattus norvegicus
cgcgcctcctcagagcgcggcctcg

SEQ ID NO: 466701 - DNA, 25 bp, Rattus norvegicus
cgcggccacctgaggcagggatgct

SEQ ID NO: 466702 - DNA, 25 bp, Rattus norvegicus
ccagcgctcccagggcttttcccac

SEQ ID NO: 466703 - DNA, 25 bp, Rattus norvegicus
gctggccgcttctgcccacgtccac

SEQ ID NO: 466704 - DNA, 25 bp, Rattus norvegicus
accagctgccgcagaggcgtctcaa

SEQ ID NO: 466705 - DNA, 25 bp, Rattus norvegicus
agtcccaagaccagaagggggagca

SEQ ID NO: 466706 - DNA, 25 bp, Rattus norvegicus
tttagggctgctaactggtgcggac

SEQ ID NO: 466707 - DNA, 25 bp, Rattus norvegicus
cttcaccttgtagtctttctccatc

SEQ ID NO: 466708 - DNA, 25 bp, Rattus norvegicus
actctttctcccgagggttgcctgg

SEQ ID NO: 466709 - DNA, 25 bp, Rattus norvegicus
cagttgtcactctttctcccgaggg

SEQ ID NO: 466710 - DNA, 25 bp, Rattus norvegicus
gtccatcggctttcctcagttgtca

SEQ ID NO: 466711 - DNA, 25 bp, Rattus norvegicus
tcctggccctagagtccatcggctt

SEQ ID NO: 466712 - DNA, 25 bp, Rattus norvegicus
agtggccgttgtaaacttcaccttg

SEQ ID NO: 466713 - DNA, 25 bp, Rattus norvegicus
accagagtccggtcgcgtgttccca

SEQ ID NO: 466714 - DNA, 25 bp, Rattus norvegicus
gttctctgagtacgcgggtatcctg

SEQ ID NO: 466715 - DNA, 25 bp, Rattus norvegicus
gcgagcccgcgttctctgagtacgc

SEQ ID NO: 466716 - DNA, 25 bp, Rattus norvegicus
ggagcgcgcactgggcaaaacccgc

SEQ ID NO: 466717 - DNA, 25 bp, Rattus norvegicus
actgggcttgcagtgaggaccgacc

SEQ ID NO: 466718 - DNA, 25 bp, Rattus norvegicus
caaggagtaggcagagaaaacaggc

SEQ ID NO: 466719 - DNA, 25 bp, Rattus norvegicus
gaccacgcgagtccgaggtaaccgc

SEQ ID NO: 466720 - DNA, 25 bp, Rattus norvegicus
gacggctgcgggtgattaattatcc

SEQ ID NO: 466721 - DNA, 25 bp, Rattus norvegicus
aatcaccgagcgcttggtacggacg

SEQ ID NO: 466722 - DNA, 25 bp, Rattus norvegicus
cagcctgccgcccttcgggttgacc

SEQ ID NO: 466723 - DNA, 25 bp, Rattus norvegicus
cggctctcccggcagggtagcagcc

SEQ ID NO: 466724 - DNA, 25 bp, Rattus norvegicus
ccagcaattgtgcaagaggagccgg

SEQ ID NO: 466725 - DNA, 25 bp, Rattus norvegicus
cgcaaatcaccgagcgcttggtacg

SEQ ID NO: 466726 - DNA, 25 bp, Rattus norvegicus
caccgagcgcttggtacggacggct

SEQ ID NO: 466727 - DNA, 25 bp, Rattus norvegicus
ccgcagagccagcaattgtgcaaga

SEQ ID NO: 466728 - DNA, 25 bp, Rattus norvegicus
gtgattaattatccgtccgctggcc

SEQ ID NO: 466729 - DNA, 25 bp, Rattus norvegicus
cgagaagcggctctgggagaacaca

SEQ ID NO: 466730 - DNA, 25 bp, Rattus norvegicus
ccgcgccgagtgtgagtgcaccgcg

SEQ ID NO: 466731 - DNA, 25 bp, Rattus norvegicus
gagagtgaagccaccgagaaccgga

SEQ ID NO: 466732 - DNA, 25 bp, Rattus norvegicus
agaaccggaacggaggccgagagca

SEQ ID NO: 466733 - DNA, 25 bp, Rattus norvegicus
gcgcgcagggcgcaaatcaccgagc

SEQ ID NO: 466734 - DNA, 25 bp, Rattus norvegicus
tgactgatttacacccgcgcccagg

SEQ ID NO: 466735 - DNA, 25 bp, Rattus norvegicus
ggccgcgccggcacaagtttctgct

SEQ ID NO: 466736 - DNA, 25 bp, Rattus norvegicus
cagcggcctcgagaacttggggcca

SEQ ID NO: 466737 - DNA, 25 bp, Rattus norvegicus
tgtccctaccaagtgcagacgcaag

SEQ ID NO: 466738 - DNA, 25 bp, Rattus norvegicus
ggaaacttcttaccatctcggcatg

SEQ ID NO: 466739 - DNA, 25 bp, Rattus norvegicus
tcttggtctcctcttagcggccgcg

SEQ ID NO: 466740 - DNA, 25 bp, Rattus norvegicus
tcgccgcctgttttgttgttgtcct

SEQ ID NO: 466741 - DNA, 25 bp, Rattus norvegicus
gtcctcaagcttttctaggggcttc

SEQ ID NO: 466742 - DNA, 25 bp, Rattus norvegicus
cttcggggaggatgtctagccctcc

SEQ ID NO: 466743 - DNA, 25 bp, Rattus norvegicus
ccagcgcccagctgtcaacaagggg

SEQ ID NO: 466744 - DNA, 25 bp, Rattus norvegicus
gcaccgggcgcgaactttattccga

SEQ ID NO: 466745 - DNA, 25 bp, Rattus norvegicus
tttattccgactgtggcgcagcgcc

SEQ ID NO: 466746 - DNA, 25 bp, Rattus norvegicus
cacaactgtcgggactagggtgttc

SEQ ID NO: 466747 - DNA, 25 bp, Rattus norvegicus
ctcggcatgctggttgtcaagtgca

SEQ ID NO: 466748 - DNA, 25 bp, Rattus norvegicus
catgctcgcggccaggttcagctag

SEQ ID NO: 466749 - DNA, 25 bp, Rattus norvegicus
aggagctggcccagtgtcaggtatc

SEQ ID NO: 466750 - DNA, 25 bp, Rattus norvegicus
caacgcgatcgcagctgctggagga

SEQ ID NO: 466751 - DNA, 25 bp, Rattus norvegicus
cgaaggcaacgcgatcgcagctgct

SEQ ID NO: 466752 - DNA, 25 bp, Rattus norvegicus
ctctcctcggtggaggcgaaggcaa

SEQ ID NO: 466753 - DNA, 25 bp, Rattus norvegicus
cgacttactctggaggggcaaagaa

SEQ ID NO: 466754 - DNA, 25 bp, Rattus norvegicus
taaaagcgacttactctggaggggc

SEQ ID NO: 466755 - DNA, 25 bp, Rattus norvegicus
ggtcgtcgcggataaaagcgactta

SEQ ID NO: 466756 - DNA, 25 bp, Rattus norvegicus
caaagcacttgctggtcgagccctc

SEQ ID NO: 466757 - DNA, 25 bp, Rattus norvegicus
actggccgccggttttcctgtccat

SEQ ID NO: 466758 - DNA, 25 bp, Rattus norvegicus
tccagagctcatgctcgcggccagg

SEQ ID NO: 466759 - DNA, 25 bp, Rattus norvegicus
gttcagctagcgagccctcccggga

SEQ ID NO: 466760 - DNA, 25 bp, Rattus norvegicus
gtgtcaggtatcaggactggccgcc

SEQ ID NO: 466761 - DNA, 25 bp, Rattus norvegicus
gcgcacccatcgctgcctccagagc

SEQ ID NO: 466762 - DNA, 25 bp, Rattus norvegicus
ctacccttgagcgtggcaagctgaa

SEQ ID NO: 466763 - DNA, 25 bp, Rattus norvegicus
aaaggtttccgcagaccgcatcccg

SEQ ID NO: 466764 - DNA, 25 bp, Rattus norvegicus
ggcgcctgacaaaggtttccgcaga

SEQ ID NO: 466765 - DNA, 25 bp, Rattus norvegicus
ctcacctggcgcctgacaaaggttt

SEQ ID NO: 466766 - DNA, 25 bp, Rattus norvegicus
cccaaccgcctgtcctcgtcgtcgt

SEQ ID NO: 466767 - DNA, 25 bp, Rattus norvegicus
gcgtcccgcccacatccgtgcccaa

SEQ ID NO: 466768 - DNA, 25 bp, Rattus norvegicus
gggaccctacccttgagcgtggcaa

SEQ ID NO: 466769 - DNA, 25 bp, Rattus norvegicus
ggtgtgcacacttaccttccgggac

SEQ ID NO: 466770 - DNA, 25 bp, Rattus norvegicus
cgctccgaggtgtgcacacttacct

SEQ ID NO: 466771 - DNA, 25 bp, Rattus norvegicus
gtctgcatcaggtcccgcgagtgcc

SEQ ID NO: 466772 - DNA, 25 bp, Rattus norvegicus
ccggaccggtgagtggtctgcatca

SEQ ID NO: 466773 - DNA, 25 bp, Rattus norvegicus
gagtgccttggccagcaccgcagct

SEQ ID NO: 466774 - DNA, 25 bp, Rattus norvegicus
cctcccgagcgagcgagtgccttgg

SEQ ID NO: 466775 - DNA, 25 bp, Rattus norvegicus
ggcaagctgaaagcgccactcttcg

SEQ ID NO: 466776 - DNA, 25 bp, Rattus norvegicus
aggtaacgcaaacgctcctcttcca

SEQ ID NO: 466777 - DNA, 25 bp, Rattus norvegicus
ctgcgggacgcaagaatgctcgcgt

SEQ ID NO: 466778 - DNA, 25 bp, Rattus norvegicus
tgaggtaacgcaaacgctcctcttc

SEQ ID NO: 466779 - DNA, 25 bp, Rattus norvegicus
gctcctcttccaccagggtgcgctg

SEQ ID NO: 466780 - DNA, 25 bp, Rattus norvegicus
tcttccaccagggtgcgctgccgct

SEQ ID NO: 466781 - DNA, 25 bp, Rattus norvegicus
agctgcgggacgcaagaatgctcgc

SEQ ID NO: 466782 - DNA, 25 bp, Rattus norvegicus
gtcgttgaggtaacgcaaacgctcc

SEQ ID NO: 466783 - DNA, 25 bp, Rattus norvegicus
accgggtgggagaagaacgcatgtt

SEQ ID NO: 466784 - DNA, 25 bp, Rattus norvegicus
gcgccgcctccgacacgcgcatgct

SEQ ID NO: 466785 - DNA, 25 bp, Rattus norvegicus
ccgactcctggttctggagctgcgg

SEQ ID NO: 466786 - DNA, 25 bp, Rattus norvegicus
gcaccgactcctggttctggagctg

SEQ ID NO: 466787 - DNA, 25 bp, Rattus norvegicus
tcggtgcgcttcagcagcgcgcgca

SEQ ID NO: 466788 - DNA, 25 bp, Rattus norvegicus
tcagctccgcctcggtgcgcttcag

SEQ ID NO: 466789 - DNA, 25 bp, Rattus norvegicus
acgcaagaatgctcgcgtggaccgg

SEQ ID NO: 466790 - DNA, 25 bp, Rattus norvegicus
atcacccgccctgacgtcagggtgt

SEQ ID NO: 466791 - DNA, 25 bp, Rattus norvegicus
gtcagggtgtctctccgcacaagcc

SEQ ID NO: 466792 - DNA, 25 bp, Rattus norvegicus
catcccatcatgtcggtggcagggc

SEQ ID NO: 466793 - DNA, 25 bp, Rattus norvegicus
aaagccactcaggtagggcgcgtgc

SEQ ID NO: 466794 - DNA, 25 bp, Rattus norvegicus
agaccgacagacagaaggcgtcctc

SEQ ID NO: 466795 - DNA, 25 bp, Rattus norvegicus
agacagaaggcgtcctcctttgcgc

SEQ ID NO: 466796 - DNA, 25 bp, Rattus norvegicus
caccggtgttcccagactgtcggtc

SEQ ID NO: 466797 - DNA, 25 bp, Rattus norvegicus
agctctcaggctctgcacggagggt

SEQ ID NO: 466798 - DNA, 25 bp, Rattus norvegicus
gcgggagattatgtaaagtcgcctc

SEQ ID NO: 466799 - DNA, 25 bp, Rattus norvegicus
aaagtcgcctcggtgcggtgacctt

SEQ ID NO: 466800 - DNA, 25 bp, Rattus norvegicus
ccactgtcctgggatgtgctggctg

SEQ ID NO: 466801 - DNA, 25 bp, Rattus norvegicus
ggctgcagaggtgcccgcgctctac

SEQ ID NO: 466802 - DNA, 25 bp, Rattus norvegicus
ttcctctggcatcactgctctctgt

SEQ ID NO: 466803 - DNA, 25 bp, Rattus norvegicus
cccgcacagtgtacgggttccgcgg

SEQ ID NO: 466804 - DNA, 25 bp, Rattus norvegicus
gtcgcctagccaccgggcggagact

SEQ ID NO: 466805 - DNA, 25 bp, Rattus norvegicus
ccattcccttgctggtcacttcggg

SEQ ID NO: 466806 - DNA, 25 bp, Rattus norvegicus
cctcctctgtgtcgcaggacaggta

SEQ ID NO: 466807 - DNA, 25 bp, Rattus norvegicus
gtggcacctggtgcctcctctgtgt

SEQ ID NO: 466808 - DNA, 25 bp, Rattus norvegicus
tggctcgcctcatctgtggcacctg

SEQ ID NO: 466809 - DNA, 25 bp, Rattus norvegicus
tgcggctggtgacgcgtagccaccc

SEQ ID NO: 466810 - DNA, 25 bp, Rattus norvegicus
ctccgtgtctctgccaggaccatgg

SEQ ID NO: 466811 - DNA, 25 bp, Rattus norvegicus
ggggtccgcagtcaccgctccgtgt

SEQ ID NO: 466812 - DNA, 25 bp, Rattus norvegicus
cgcttgccagccaggggtccgcagt

SEQ ID NO: 466813 - DNA, 25 bp, Rattus norvegicus
ctcccattcaaagcagcggagctgc

SEQ ID NO: 466814 - DNA, 25 bp, Rattus norvegicus
gaagcacacttttcggcggcgaagc

SEQ ID NO: 466815 - DNA, 25 bp, Rattus norvegicus
aagctctgtcgcgaggctgaacctt

SEQ ID NO: 466816 - DNA, 25 bp, Rattus norvegicus
agcggagctgcaccgccactgcaga

SEQ ID NO: 466817 - DNA, 25 bp, Rattus norvegicus
tcacttcgggaagcacacttttcgg

SEQ ID NO: 466818 - DNA, 25 bp, Rattus norvegicus
acgagctgccgacattctcgcgatg

SEQ ID NO: 466819 - DNA, 25 bp, Rattus norvegicus
cgacgccggcaggtgatgccaaata

SEQ ID NO: 466820 - DNA, 25 bp, Rattus norvegicus
gttaggccgtgcctcaggcccaatc

SEQ ID NO: 466821 - DNA, 25 bp, Rattus norvegicus
ccatcctcggttggtccgccgttag

SEQ ID NO: 466822 - DNA, 25 bp, Rattus norvegicus
cagcgctgttttctgaggcctcgcc

SEQ ID NO: 466823 - DNA, 25 bp, Rattus norvegicus
tggccattgcctccagcgctgtttt

SEQ ID NO: 466824 - DNA, 25 bp, Rattus norvegicus
ttggtctccctagctccgagctgct

SEQ ID NO: 466825 - DNA, 25 bp, Rattus norvegicus
tcgcatcactagtttggtctcccta

SEQ ID NO: 466826 - DNA, 25 bp, Rattus norvegicus
ctaggctggagctgatcgcatcact

SEQ ID NO: 466827 - DNA, 25 bp, Rattus norvegicus
tctcgcgatgtcaccaccggaagtg

SEQ ID NO: 466828 - DNA, 25 bp, Rattus norvegicus
aggtcgatcatctttgcaaattata

SEQ ID NO: 466829 - DNA, 25 bp, Rattus norvegicus
gcaaattatattgcgcgcgacacca

SEQ ID NO: 466830 - DNA, 25 bp, Rattus norvegicus
aactcggagttctcgcgagataccg

SEQ ID NO: 466831 - DNA, 25 bp, Rattus norvegicus
gccatgaagaaaaaggtgctgttga

SEQ ID NO: 466832 - DNA, 25 bp, Rattus norvegicus
ggaagctctagctcccaccgtgcaa

SEQ ID NO: 466833 - DNA, 25 bp, Rattus norvegicus
gaagctctagctcccaccgtgcaat

SEQ ID NO: 466834 - DNA, 25 bp, Rattus norvegicus
cgaggaagctctagctcccaccgtg

SEQ ID NO: 466835 - DNA, 25 bp, Rattus norvegicus
gtcttccgaggaagctctagctccc

SEQ ID NO: 466836 - DNA, 25 bp, Rattus norvegicus
tggtcttccgaggaagctctagctc

SEQ ID NO: 466837 - DNA, 25 bp, Rattus norvegicus
actggtcttccgaggaagctctagc

SEQ ID NO: 466838 - DNA, 25 bp, Rattus norvegicus
tgacttccgggactggtcttccgag

SEQ ID NO: 466839 - DNA, 25 bp, Rattus norvegicus
gcaaaccaagactcccgcgcttgcg

SEQ ID NO: 466840 - DNA, 25 bp, Rattus norvegicus
agcgatacacgcaaaccaagactcc

SEQ ID NO: 466841 - DNA, 25 bp, Rattus norvegicus
ctgcagcgatacacgcaaaccaaga

SEQ ID NO: 466842 - DNA, 25 bp, Rattus norvegicus
tgactgcagcgatacacgcaaacca

SEQ ID NO: 466843 - DNA, 25 bp, Rattus norvegicus
agtgactgcagcgatacacgcaaac

SEQ ID NO: 466844 - DNA, 25 bp, Rattus norvegicus
cctgacttccgggactggtcttccg

SEQ ID NO: 466845 - DNA, 25 bp, Rattus norvegicus
gctctagctcccaccgtgcaatgcg

SEQ ID NO: 466846 - DNA, 25 bp, Rattus norvegicus
tccaagagccatcacaccacaaaag

SEQ ID NO: 466847 - DNA, 25 bp, Rattus norvegicus
caggtacatccagagatgctgcttc

SEQ ID NO: 466848 - DNA, 25 bp, Rattus norvegicus
tggcggcctctgagttttgcctcca

SEQ ID NO: 466849 - DNA, 25 bp, Rattus norvegicus
tctgagttttgcctccaccggggac

SEQ ID NO: 466850 - DNA, 25 bp, Rattus norvegicus
aggtgcgcgtaggataccatcttcc

SEQ ID NO: 466851 - DNA, 25 bp, Rattus norvegicus
cctgacgccggaactcggatccaaa

SEQ ID NO: 466852 - DNA, 25 bp, Rattus norvegicus
cagcgcctgcaggtacatccagaga

SEQ ID NO: 466853 - DNA, 25 bp, Rattus norvegicus
tgctgcttctcgaaagcggagtccc

SEQ ID NO: 466854 - DNA, 25 bp, Rattus norvegicus
cgggcggagctcatgctttccaaag

SEQ ID NO: 466855 - DNA, 25 bp, Rattus norvegicus
gctttccaaaggcacggcgactctg

SEQ ID NO: 466856 - DNA, 25 bp, Rattus norvegicus
ctgacggaggaaaacgaaggcaccg

SEQ ID NO: 466857 - DNA, 25 bp, Rattus norvegicus
cacaaaaggccgaacgcgcccagaa

SEQ ID NO: 466858 - DNA, 25 bp, Rattus norvegicus
cccagaaaaccagggcagtgactgc

SEQ ID NO: 466859 - DNA, 25 bp, Rattus norvegicus
caaaggcacggcgactctgacggag

SEQ ID NO: 466860 - DNA, 25 bp, Rattus norvegicus
ggtccagaatcaccgcacagcaagg

SEQ ID NO: 466861 - DNA, 25 bp, Rattus norvegicus
cgccgaacccggctgggctgagact

SEQ ID NO: 466862 - DNA, 25 bp, Rattus norvegicus
caccaactcgttactgcagttccga

SEQ ID NO: 466863 - DNA, 25 bp, Rattus norvegicus
gttactgcagttccgagcccagcga

SEQ ID NO: 466864 - DNA, 25 bp, Rattus norvegicus
gttccgagcccagcgaaggtaaagc

SEQ ID NO: 466865 - DNA, 25 bp, Rattus norvegicus
agcccagcgaaggtaaagcggcagc

SEQ ID NO: 466866 - DNA, 25 bp, Rattus norvegicus
gggccagatctggttgcagaaccca

SEQ ID NO: 466867 - DNA, 25 bp, Rattus norvegicus
gttgcagaacccaccgaacaggaga

SEQ ID NO: 466868 - DNA, 25 bp, Rattus norvegicus
gagcaaatcggcacggtccagaatc

SEQ ID NO: 466869 - DNA, 25 bp, Rattus norvegicus
ggcggcccagcgactgttaaatatc

SEQ ID NO: 466870 - DNA, 25 bp, Rattus norvegicus
actgttaaatatcgcctggctgccc

SEQ ID NO: 466871 - DNA, 25 bp, Rattus norvegicus
agagctgagagacgagcaaatcggc

SEQ ID NO: 466872 - DNA, 25 bp, Rattus norvegicus
tccgcgccacgtgatagcccagtgg

SEQ ID NO: 466873 - DNA, 25 bp, Rattus norvegicus
ccaccgaacaggagagctgagagac

SEQ ID NO: 466874 - DNA, 25 bp, Rattus norvegicus
ttctgggactcgaactgcttcactc

SEQ ID NO: 466875 - DNA, 25 bp, Rattus norvegicus
tctcgcgagaatagcccgagctgga

SEQ ID NO: 466876 - DNA, 25 bp, Rattus norvegicus
agcactctaagttctcgcgagaata

SEQ ID NO: 466877 - DNA, 25 bp, Rattus norvegicus
agcccaggtcacatagcactctaag

SEQ ID NO: 466878 - DNA, 25 bp, Rattus norvegicus
ttccgcttagcccaggtcacatagc

SEQ ID NO: 466879 - DNA, 25 bp, Rattus norvegicus
cgcctaggaggcgtcacgaaaaaga

SEQ ID NO: 466880 - DNA, 25 bp, Rattus norvegicus
cttgacacagccgaccgcctaggag

SEQ ID NO: 466881 - DNA, 25 bp, Rattus norvegicus
tgcttcactcagtcccagtcaggga

SEQ ID NO: 466882 - DNA, 25 bp, Rattus norvegicus
ggcagtcccgcgttctgggactcga

SEQ ID NO: 466883 - DNA, 25 bp, Rattus norvegicus
ggccctaaaagcaagcttcctcctg

SEQ ID NO: 466884 - DNA, 25 bp, Rattus norvegicus
attgctctacgtccgctgtcgcggc

SEQ ID NO: 466885 - DNA, 25 bp, Rattus norvegicus
gacacccgctgcaagtggggcttca

SEQ ID NO: 466886 - DNA, 25 bp, Rattus norvegicus
gcgatctcggatagcagagtgtcca

SEQ ID NO: 466887 - DNA, 25 bp, Rattus norvegicus
agggacgcctaccttcatcttgaca

SEQ ID NO: 466888 - DNA, 25 bp, Rattus norvegicus
ttgccaccaaccacagtagaaccgg

SEQ ID NO: 466889 - DNA, 25 bp, Rattus norvegicus
ggctaggtcctagcttccaggcttc

SEQ ID NO: 466890 - DNA, 25 bp, Rattus norvegicus
aaccggagagctagtggctaggtcc

SEQ ID NO: 466891 - DNA, 25 bp, Rattus norvegicus
gaggtccgaggcagtcactccacgc

SEQ ID NO: 466892 - DNA, 25 bp, Rattus norvegicus
agagcgactctgaaggcctttgcca

SEQ ID NO: 466893 - DNA, 25 bp, Rattus norvegicus
gacgcgcgtggacaagagcgactct

SEQ ID NO: 466894 - DNA, 25 bp, Rattus norvegicus
tctttacacaacctggacgcgcgtg

SEQ ID NO: 466895 - DNA, 25 bp, Rattus norvegicus
ggccgctctggcgttctttacacaa

SEQ ID NO: 466896 - DNA, 25 bp, Rattus norvegicus
tccgaacctggtctgtcaagtcccg

SEQ ID NO: 466897 - DNA, 25 bp, Rattus norvegicus
gcataagccgcagacgcacagtgtg

SEQ ID NO: 466898 - DNA, 25 bp, Rattus norvegicus
acagtgtgcccagcagccgctcggg

SEQ ID NO: 466899 - DNA, 25 bp, Rattus norvegicus
gtgcgaggacaactacaccatcgtg

SEQ ID NO: 466900 - DNA, 25 bp, Rattus norvegicus
atcgtgcctgccatcgccgagttct

SEQ ID NO: 466901 - DNA, 25 bp, Rattus norvegicus
tcgccgagttctacaacacggtgcg

SEQ ID NO: 466902 - DNA, 25 bp, Rattus norvegicus
ccctcctaagtcaggctcttgcggg

SEQ ID NO: 466903 - DNA, 25 bp, Rattus norvegicus
cttcgctggccgaagctgggctcgc

SEQ ID NO: 466904 - DNA, 25 bp, Rattus norvegicus
tggacgccgccttcgctggccgaag

SEQ ID NO: 466905 - DNA, 25 bp, Rattus norvegicus
gctcttacgcctcctgaggccaggg

SEQ ID NO: 466906 - DNA, 25 bp, Rattus norvegicus
ccgcacttaccagcaccggtgagca

SEQ ID NO: 466907 - DNA, 25 bp, Rattus norvegicus
cacctgtgagtctgaggcgcagcag

SEQ ID NO: 466908 - DNA, 25 bp, Rattus norvegicus
tcaccacggggccacctgtgagtct

SEQ ID NO: 466909 - DNA, 25 bp, Rattus norvegicus
gggtgccacattcaccacggggcca

SEQ ID NO: 466910 - DNA, 25 bp, Rattus norvegicus
tgggcctggggtgccacattcacca

SEQ ID NO: 466911 - DNA, 25 bp, Rattus norvegicus
agagttggctaactcagagctgggc

SEQ ID NO: 466912 - DNA, 25 bp, Rattus norvegicus
cccgagcggagagttggctaactca

SEQ ID NO: 466913 - DNA, 25 bp, Rattus norvegicus
ccctccgagagcctgggtgggccat

SEQ ID NO: 466914 - DNA, 25 bp, Rattus norvegicus
tgggctcgcgaggacactgagcagc

SEQ ID NO: 466915 - DNA, 25 bp, Rattus norvegicus
taagtcaggctcttgcgggttccct

SEQ ID NO: 466916 - DNA, 25 bp, Rattus norvegicus
gctgcagccggacccgaagcgacga

SEQ ID NO: 466917 - DNA, 25 bp, Rattus norvegicus
cagaaggagcagcaggtcaaatgcc

SEQ ID NO: 466918 - DNA, 25 bp, Rattus norvegicus
agcaggtcaaatgcccagtccgccg

SEQ ID NO: 466919 - DNA, 25 bp, Rattus norvegicus
tcgtcccggccctgacactacatgc

SEQ ID NO: 466920 - DNA, 25 bp, Rattus norvegicus
acatcctccggcttcggtctccctc

SEQ ID NO: 466921 - DNA, 25 bp, Rattus norvegicus
cgaagcgacgactgcccacccggca

SEQ ID NO: 466922 - DNA, 25 bp, Rattus norvegicus
agccggacgcttcgaagggccagca

SEQ ID NO: 466923 - DNA, 25 bp, Rattus norvegicus
gaccgacagccacgccgcatggctt

SEQ ID NO: 466924 - DNA, 25 bp, Rattus norvegicus
tggcttacctcacttctgccacagg

SEQ ID NO: 466925 - DNA, 25 bp, Rattus norvegicus
cccagcctgacctggcccgcggacc

SEQ ID NO: 466926 - DNA, 25 bp, Rattus norvegicus
acagccaataaaaattctactccga

SEQ ID NO: 466927 - DNA, 25 bp, Rattus norvegicus
aattctactccgatagccagtcccg

SEQ ID NO: 466928 - DNA, 25 bp, Rattus norvegicus
cttcgaagggccagcagaaggagca

SEQ ID NO: 466929 - DNA, 25 bp, Rattus norvegicus
cagcggctggtggaccgacagccac

SEQ ID NO: 466930 - DNA, 25 bp, Rattus norvegicus
ccttcatgggagaacccggagctcg

SEQ ID NO: 466931 - DNA, 25 bp, Rattus norvegicus
tccggaaaggccgaatcccaggatc

SEQ ID NO: 466932 - DNA, 25 bp, Rattus norvegicus
cctggaattccgacttgggcctaga

SEQ ID NO: 466933 - DNA, 25 bp, Rattus norvegicus
tcttcgatgtgtctctgcggccacc

SEQ ID NO: 466934 - DNA, 25 bp, Rattus norvegicus
cgttaccgagcgacaccttcatggg

SEQ ID NO: 466935 - DNA, 25 bp, Rattus norvegicus
ccaaggttcagcacctcagcgagct

SEQ ID NO: 466936 - DNA, 25 bp, Rattus norvegicus
tgagtcatcacctgaggcagttacg

SEQ ID NO: 466937 - DNA, 25 bp, Rattus norvegicus
ctgacagtagagtcggtgagtcatc

SEQ ID NO: 466938 - DNA, 25 bp, Rattus norvegicus
gcagcaccacgcacgtcaaatctga

SEQ ID NO: 466939 - DNA, 25 bp, Rattus norvegicus
gcaggccgcagacgttacaaagaga

SEQ ID NO: 466940 - DNA, 25 bp, Rattus norvegicus
cagctgcacagctaatgcgcctgcg

SEQ ID NO: 466941 - DNA, 25 bp, Rattus norvegicus
ggctgcgacttctgcggtcttcgat

SEQ ID NO: 466942 - DNA, 25 bp, Rattus norvegicus
caaagagaacgctctggggaaacgc

SEQ ID NO: 466943 - DNA, 25 bp, Rattus norvegicus
ggcagttacgtgaccgcttcacctc

SEQ ID NO: 466944 - DNA, 25 bp, Rattus norvegicus
ttggtgggacagaaatgagtgtctc

SEQ ID NO: 466945 - DNA, 25 bp, Rattus norvegicus
tagtcctccgcgtctacgttgagta

SEQ ID NO: 466946 - DNA, 25 bp, Rattus norvegicus
tctacgttgagtacgtgcctgggta

SEQ ID NO: 466947 - DNA, 25 bp, Rattus norvegicus
cctgggtatgtacctgcgcgcttac

SEQ ID NO: 466948 - DNA, 25 bp, Rattus norvegicus
acctgcgcgcttacggacgtgtcac

SEQ ID NO: 466949 - DNA, 25 bp, Rattus norvegicus
cttacggacgtgtcacgcttgggta

SEQ ID NO: 466950 - DNA, 25 bp, Rattus norvegicus
cacgcttgggtagcgcacacatata

SEQ ID NO: 466951 - DNA, 25 bp, Rattus norvegicus
gtagcgcacacatatacaacccatg

SEQ ID NO: 466952 - DNA, 25 bp, Rattus norvegicus
atatacaacccatgcagacacaagc

SEQ ID NO: 466953 - DNA, 25 bp, Rattus norvegicus
atgcagacacaagcacgcacgaaca

SEQ ID NO: 466954 - DNA, 25 bp, Rattus norvegicus
gcacgcacgaacaaagcaaatggga

SEQ ID NO: 466955 - DNA, 25 bp, Rattus norvegicus
aagtgacacgccgaggatgttgctc

SEQ ID NO: 466956 - DNA, 25 bp, Rattus norvegicus
aaatgagtgtctccgtcgtccctcg

SEQ ID NO: 466957 - DNA, 25 bp, Rattus norvegicus
agcaaatgggaaaagtgacacgccg

SEQ ID NO: 466958 - DNA, 25 bp, Rattus norvegicus
taggtgctgagcgagcgcacagaac

SEQ ID NO: 466959 - DNA, 25 bp, Rattus norvegicus
accctacgagggagcgctctccagg

SEQ ID NO: 466960 - DNA, 25 bp, Rattus norvegicus
agcccgatggcagtcccgaaggcag

SEQ ID NO: 466961 - DNA, 25 bp, Rattus norvegicus
cccagcatacgagaggcgtgaacgc

SEQ ID NO: 466962 - DNA, 25 bp, Rattus norvegicus
agatcctcatctggcttcacgtcgc

SEQ ID NO: 466963 - DNA, 25 bp, Rattus norvegicus
tagggatcggcatagaggccctcgc

SEQ ID NO: 466964 - DNA, 25 bp, Rattus norvegicus
ccctcgtgcagcagcccgtagggat

SEQ ID NO: 466965 - DNA, 25 bp, Rattus norvegicus
ttgtacagcgagtcctccaggtcgg

SEQ ID NO: 466966 - DNA, 25 bp, Rattus norvegicus
gaagccatagccgtctccgtagagc

SEQ ID NO: 466967 - DNA, 25 bp, Rattus norvegicus
ctgagacgtcggctagtttctgcgg

SEQ ID NO: 466968 - DNA, 25 bp, Rattus norvegicus
atctttacggaacgactggcgcacc

SEQ ID NO: 466969 - DNA, 25 bp, Rattus norvegicus
gaccgacgaggaaccagaatcttta

SEQ ID NO: 466970 - DNA, 25 bp, Rattus norvegicus
caggactctcagcaaagaccgacga

SEQ ID NO: 466971 - DNA, 25 bp, Rattus norvegicus
ggctttgcctccaggactctcagca

SEQ ID NO: 466972 - DNA, 25 bp, Rattus norvegicus
agctcggctgtctgcgctcgctctt

SEQ ID NO: 466973 - DNA, 25 bp, Rattus norvegicus
agagcgcttttaaggctgcggcaca

SEQ ID NO: 466974 - DNA, 25 bp, Rattus norvegicus
gctgcggcacacgtcggtgcataaa

SEQ ID NO: 466975 - DNA, 25 bp, Rattus norvegicus
cgtcggtgcataaaccgtgagaatc

SEQ ID NO: 466976 - DNA, 25 bp, Rattus norvegicus
cgtgagaatcgaccgaaaacagaca

SEQ ID NO: 466977 - DNA, 25 bp, Rattus norvegicus
cagaagggttcgagtctgagaactt

SEQ ID NO: 466978 - DNA, 25 bp, Rattus norvegicus
cttgaaaaaagagtggagacgcgtt

SEQ ID NO: 466979 - DNA, 25 bp, Rattus norvegicus
agacgcgttctagtccggtcgacca

SEQ ID NO: 466980 - DNA, 25 bp, Rattus norvegicus
ttctagtccggtcgaccacttcatc

SEQ ID NO: 466981 - DNA, 25 bp, Rattus norvegicus
cgctcttctcgctgggtgcaaagtt

SEQ ID NO: 466982 - DNA, 25 bp, Rattus norvegicus
gctgagctccctccaaggacacaaa

SEQ ID NO: 466983 - DNA, 25 bp, Rattus norvegicus
ctcctgagctcagctgacgggatgc

SEQ ID NO: 466984 - DNA, 25 bp, Rattus norvegicus
tgcaaagttcaggaggagacgccgc

SEQ ID NO: 466985 - DNA, 25 bp, Rattus norvegicus
aaggacacaaagaccacgcgcccgg

SEQ ID NO: 466986 - DNA, 25 bp, Rattus norvegicus
ctgagaaatccaccggaggagctcc

SEQ ID NO: 466987 - DNA, 25 bp, Rattus norvegicus
agtcctccgaaaccctggcgagtgg

SEQ ID NO: 466988 - DNA, 25 bp, Rattus norvegicus
ggtcaggagctgacgaacatccttc

SEQ ID NO: 466989 - DNA, 25 bp, Rattus norvegicus
caaacgaatcctcggctgtgggtaa

SEQ ID NO: 466990 - DNA, 25 bp, Rattus norvegicus
ccgcacgcctcattactgagaaatc

SEQ ID NO: 466991 - DNA, 25 bp, Rattus norvegicus
cgatgctggctggagtcctccgaaa

SEQ ID NO: 466992 - DNA, 25 bp, Rattus norvegicus
cccgggatgtttccaaaacatcgcg

SEQ ID NO: 466993 - DNA, 25 bp, Rattus norvegicus
catcgcgagtttgaaaccgtggctc

SEQ ID NO: 466994 - DNA, 25 bp, Rattus norvegicus
agagttccggctcccaggccgagtt

SEQ ID NO: 466995 - DNA, 25 bp, Rattus norvegicus
gagcgccacgacacggcaaggttcg

SEQ ID NO: 466996 - DNA, 25 bp, Rattus norvegicus
acacggcaaggttcgcgacagccac

SEQ ID NO: 466997 - DNA, 25 bp, Rattus norvegicus
caaaatgcgcgagcccgggcgttcc

SEQ ID NO: 466998 - DNA, 25 bp, Rattus norvegicus
cgttcctgaccagcaggcgggcagc

SEQ ID NO: 466999 - DNA, 25 bp, Rattus norvegicus
ctgtgggtaatcaccgcacgcctca

SEQ ID NO: 467000 - DNA, 25 bp, Rattus norvegicus
cccggtgcagacatggcctcgggct

SEQ ID NO: 467001 - DNA, 25 bp, Rattus norvegicus
ccacccaaggttcagccgggaggtg

SEQ ID NO: 467002 - DNA, 25 bp, Rattus norvegicus
cacagaccagcagaagccgaaaagt

SEQ ID NO: 467003 - DNA, 25 bp, Rattus norvegicus
caagctgctattgggctagttctgc

SEQ ID NO: 467004 - DNA, 25 bp, Rattus norvegicus
tgagacaccctacaagctgctattg

SEQ ID NO: 467005 - DNA, 25 bp, Rattus norvegicus
gcacggcagtgaaggtgagacaccc

SEQ ID NO: 467006 - DNA, 25 bp, Rattus norvegicus
atcccgcgctccctgggaggaagag

SEQ ID NO: 467007 - DNA, 25 bp, Rattus norvegicus
gtgccaggagggcagccaatcccgc

SEQ ID NO: 467008 - DNA, 25 bp, Rattus norvegicus
agccgaaaagtctgcaaaaggggcg

SEQ ID NO: 467009 - DNA, 25 bp, Rattus norvegicus
aactcatctgcattccgggcccggg

SEQ ID NO: 467010 - DNA, 25 bp, Rattus norvegicus
cccagcctttgaactcatctgcatt

SEQ ID NO: 467011 - DNA, 25 bp, Rattus norvegicus
tcagaccgcacagaccagcagaagc

SEQ ID NO: 467012 - DNA, 25 bp, Rattus norvegicus
ctagttctgcttggctccctctcgt

SEQ ID NO: 467013 - DNA, 25 bp, Rattus norvegicus
cgggctccgcctgcacggcagtgaa

SEQ ID NO: 467014 - DNA, 25 bp, Rattus norvegicus
ttcccagcggaggagagtagatacc

SEQ ID NO: 467015 - DNA, 25 bp, Rattus norvegicus
ataccgcacgacgtcgtgatgtccc

SEQ ID NO: 467016 - DNA, 25 bp, Rattus norvegicus
acgtcgtgatgtccccgctctaggg

SEQ ID NO: 467017 - DNA, 25 bp, Rattus norvegicus
cgctctagggccaggtcgagcggca

SEQ ID NO: 467018 - DNA, 25 bp, Rattus norvegicus
aggcatcgcgcacatccagccgcgc

SEQ ID NO: 467019 - DNA, 25 bp, Rattus norvegicus
ccctgcctggtgcagtactaccaga

SEQ ID NO: 467020 - DNA, 25 bp, Rattus norvegicus
gagtagataccgcaaataccgcacg

SEQ ID NO: 467021 - DNA, 25 bp, Rattus norvegicus
tggtgcagtactaccagagtgtcta

SEQ ID NO: 467022 - DNA, 25 bp, Rattus norvegicus
tactaccagagtgtctaggaagccc

SEQ ID NO: 467023 - DNA, 25 bp, Rattus norvegicus
accagagtgtctaggaagccctccc

SEQ ID NO: 467024 - DNA, 25 bp, Rattus norvegicus
gataccgcaaataccgcacgacgtc

SEQ ID NO: 467025 - DNA, 25 bp, Rattus norvegicus
gaaacgttcccagcggaggagagta

SEQ ID NO: 467026 - DNA, 25 bp, Rattus norvegicus
ccgcaaataccgcacgacgtcgtga

SEQ ID NO: 467027 - DNA, 25 bp, Rattus norvegicus
cggaggagagtagataccgcaaata

SEQ ID NO: 467028 - DNA, 25 bp, Rattus norvegicus
tctcgtgtgccgttctgttttcgct

SEQ ID NO: 467029 - DNA, 25 bp, Rattus norvegicus
tcggtgagggttctccggctccgaa

SEQ ID NO: 467030 - DNA, 25 bp, Rattus norvegicus
tccggctccgaatccagctctaaaa

SEQ ID NO: 467031 - DNA, 25 bp, Rattus norvegicus
tccgaatccagctctaaaaagaagg

SEQ ID NO: 467032 - DNA, 25 bp, Rattus norvegicus
agaagatccgcgaggcctgccttgg

SEQ ID NO: 467033 - DNA, 25 bp, Rattus norvegicus
acgcgcgcgggcgttttgaacgcta

SEQ ID NO: 467034 - DNA, 25 bp, Rattus norvegicus
gttttgaacgctagcggttcgctgc

SEQ ID NO: 467035 - DNA, 25 bp, Rattus norvegicus
aacgctagcggttcgctgcgctcct

SEQ ID NO: 467036 - DNA, 25 bp, Rattus norvegicus
tgcgctcctccggtgggaacagcgc

SEQ ID NO: 467037 - DNA, 25 bp, Rattus norvegicus
cctgcgcgtcgctgcggaccggtaa

SEQ ID NO: 467038 - DNA, 25 bp, Rattus norvegicus
caggtccggcagacacgaggccgca

SEQ ID NO: 467039 - DNA, 25 bp, Rattus norvegicus
cgcagcccgaggacgttgtttattt

SEQ ID NO: 467040 - DNA, 25 bp, Rattus norvegicus
ttttcggttttaagcgcgagcgcta

SEQ ID NO: 467041 - DNA, 25 bp, Rattus norvegicus
gttctctcagtctacgcctgacgcc

SEQ ID NO: 467042 - DNA, 25 bp, Rattus norvegicus
tgttacagcctcgtctctgagccgc

SEQ ID NO: 467043 - DNA, 25 bp, Rattus norvegicus
gtacaactcgcagccgcggagggca

SEQ ID NO: 467044 - DNA, 25 bp, Rattus norvegicus
cctcccgaagcggttgacggcgttg

SEQ ID NO: 467045 - DNA, 25 bp, Rattus norvegicus
gatctgcgccggcttccaggagctg

SEQ ID NO: 467046 - DNA, 25 bp, Rattus norvegicus
cccggtccgtggcagaaatggtcct

SEQ ID NO: 467047 - DNA, 25 bp, Rattus norvegicus
agaaatggtcctccgccggccttga

SEQ ID NO: 467048 - DNA, 25 bp, Rattus norvegicus
cggccttgagattgttacagcctcg

SEQ ID NO: 467049 - DNA, 25 bp, Rattus norvegicus
tccggggaaacgctcgagccctagc

SEQ ID NO: 467050 - DNA, 25 bp, Rattus norvegicus
ggaaccgcacctcaggcacagctga

SEQ ID NO: 467051 - DNA, 25 bp, Rattus norvegicus
gcactgtgcagctgcgttcagcacc

SEQ ID NO: 467052 - DNA, 25 bp, Rattus norvegicus
cgcccacatttggtgacgtcacgag

SEQ ID NO: 467053 - DNA, 25 bp, Rattus norvegicus
agtcggaaggtcttaaacgcctgcg

SEQ ID NO: 467054 - DNA, 25 bp, Rattus norvegicus
ggcagcccaggtgcccgggtacaac

SEQ ID NO: 467055 - DNA, 25 bp, Rattus norvegicus
acgctcgagccctagcgcctgggaa

SEQ ID NO: 467056 - DNA, 25 bp, Rattus norvegicus
tcggtcaggttctggagctcttaga

SEQ ID NO: 467057 - DNA, 25 bp, Rattus norvegicus
acaggctcctgtaccaggggccatc

SEQ ID NO: 467058 - DNA, 25 bp, Rattus norvegicus
aagtgcgcccgttgtcgcaaccatg

SEQ ID NO: 467059 - DNA, 25 bp, Rattus norvegicus
tttctgcgatccaccgcaagtgcgg

SEQ ID NO: 467060 - DNA, 25 bp, Rattus norvegicus
aggccgcctggcctttttctgcgat

SEQ ID NO: 467061 - DNA, 25 bp, Rattus norvegicus
gtgtccgcgactttcctaaggccgc

SEQ ID NO: 467062 - DNA, 25 bp, Rattus norvegicus
tggagcaatttcctcgtagagaccg

SEQ ID NO: 467063 - DNA, 25 bp, Rattus norvegicus
cagaagcgacttctcacaatggagc

SEQ ID NO: 467064 - DNA, 25 bp, Rattus norvegicus
gctggtttccactcctcagaagcga

SEQ ID NO: 467065 - DNA, 25 bp, Rattus norvegicus
gacagcgcgcccttgctggtttcca

SEQ ID NO: 467066 - DNA, 25 bp, Rattus norvegicus
tctctacagggtcgctctggacagc

SEQ ID NO: 467067 - DNA, 25 bp, Rattus norvegicus
ggtcctcagcggatatctctacagg

SEQ ID NO: 467068 - DNA, 25 bp, Rattus norvegicus
agaccaaactcatcgtcagtgcgtg

SEQ ID NO: 467069 - DNA, 25 bp, Rattus norvegicus
agctcttagactccgcgatttcttg

SEQ ID NO: 467070 - DNA, 25 bp, Rattus norvegicus
agccgaggacagactgacgactaga

SEQ ID NO: 467071 - DNA, 25 bp, Rattus norvegicus
actgacgactagagcgagcagctga

SEQ ID NO: 467072 - DNA, 25 bp, Rattus norvegicus
gactgacgactagagcgagcagctg

SEQ ID NO: 467073 - DNA, 25 bp, Rattus norvegicus
gcagcctgaggacagactgacgact

SEQ ID NO: 467074 - DNA, 25 bp, Rattus norvegicus
ctgacgactagagcgagcagcctga

SEQ ID NO: 467075 - DNA, 25 bp, Rattus norvegicus
cagcctgaggacagactgacgacta

SEQ ID NO: 467076 - DNA, 25 bp, Rattus norvegicus
acgactagagcgagcagcctgagga

SEQ ID NO: 467077 - DNA, 25 bp, Rattus norvegicus
gcagctgaggacagactgacgacta

SEQ ID NO: 467078 - DNA, 25 bp, Rattus norvegicus
gcagccgaggacagactgacgacta

SEQ ID NO: 467079 - DNA, 25 bp, Rattus norvegicus
actgacgactagagcgagcagccga

SEQ ID NO: 467080 - DNA, 25 bp, Rattus norvegicus
agcagccgaggacagactgacgact

SEQ ID NO: 467081 - DNA, 25 bp, Rattus norvegicus
cagactgacgactagagcgagcagc

SEQ ID NO: 467082 - DNA, 25 bp, Rattus norvegicus
agcagctgaggacagactgacgact

SEQ ID NO: 467083 - DNA, 25 bp, Rattus norvegicus
actagagcgagcagctgaggacaga

SEQ ID NO: 467084 - DNA, 25 bp, Rattus norvegicus
aatgcactcacctgcgtctgggcgc

SEQ ID NO: 467085 - DNA, 25 bp, Rattus norvegicus
cgcaaaaagggatcaccgcggctcc

SEQ ID NO: 467086 - DNA, 25 bp, Rattus norvegicus
gctcccgcacgaagagcagctgcgt

SEQ ID NO: 467087 - DNA, 25 bp, Rattus norvegicus
agagcagctgcgtgtcctcccacaa

SEQ ID NO: 467088 - DNA, 25 bp, Rattus norvegicus
gtgtcctcccacaaggcggccgaag

SEQ ID NO: 467089 - DNA, 25 bp, Rattus norvegicus
aaggctccacaggaagccggcgctg

SEQ ID NO: 467090 - DNA, 25 bp, Rattus norvegicus
cgcagtttcccggtggcgctacacg

SEQ ID NO: 467091 - DNA, 25 bp, Rattus norvegicus
tgcagagtacgtccacgcccgtgca

SEQ ID NO: 467092 - DNA, 25 bp, Rattus norvegicus
gaacttcgcgggtgctacctccact

SEQ ID NO: 467093 - DNA, 25 bp, Rattus norvegicus
aagcaagccggatgctgcctagggc

SEQ ID NO: 467094 - DNA, 25 bp, Rattus norvegicus
cctagggctgcggtggacacctagt

SEQ ID NO: 467095 - DNA, 25 bp, Rattus norvegicus
ccgacagcaccgctcagaggagtca

SEQ ID NO: 467096 - DNA, 25 bp, Rattus norvegicus
gcggctgcgcctaccacgcaaaaag

SEQ ID NO: 467097 - DNA, 25 bp, Rattus norvegicus
ctacacgccgcggtgcagagtacgt

SEQ ID NO: 467098 - DNA, 25 bp, Rattus norvegicus
aatctttgcacctgtgctcgccgcg

SEQ ID NO: 467099 - DNA, 25 bp, Rattus norvegicus
ctcagaagctgctccagcaactctg

SEQ ID NO: 467100 - DNA, 25 bp, Rattus norvegicus
gaggctcagaagctgctccagcaac

SEQ ID NO: 467101 - DNA, 25 bp, Rattus norvegicus
tggctgcgcgccgcgaaactcaggc

SEQ ID NO: 467102 - DNA, 25 bp, Rattus norvegicus
cgcgctcggtcgactccgcgcgcct

SEQ ID NO: 467103 - DNA, 25 bp, Rattus norvegicus
tgtgcctcaggcactgttgccaggt

SEQ ID NO: 467104 - DNA, 25 bp, Rattus norvegicus
agtcggtcaatctttgcacctgtgc

SEQ ID NO: 467105 - DNA, 25 bp, Rattus norvegicus
cctcaggcactgttgccaggtgcga

SEQ ID NO: 467106 - DNA, 25 bp, Rattus norvegicus
gtcagtcggtcaatctttgcacctg

SEQ ID NO: 467107 - DNA, 25 bp, Rattus norvegicus
tcaggcactgttgccaggtgcgacg

SEQ ID NO: 467108 - DNA, 25 bp, Rattus norvegicus
ggcactgttgccaggtgcgacgccc

SEQ ID NO: 467109 - DNA, 25 bp, Rattus norvegicus
cggtcaatctttgcacctgtgctcg

SEQ ID NO: 467110 - DNA, 25 bp, Rattus norvegicus
gggagtcagtcggtcaatctttgca

SEQ ID NO: 467111 - DNA, 25 bp, Rattus norvegicus
caggtgtgcctcaggcactgttgcc

SEQ ID NO: 467112 - DNA, 25 bp, Rattus norvegicus
cggtgttgggcgacttaagcatgcc

SEQ ID NO: 467113 - DNA, 25 bp, Rattus norvegicus
accggacgtcttccagctcgtagaa

SEQ ID NO: 467114 - DNA, 25 bp, Rattus norvegicus
aacaggactcctgcgaaggagacgc

SEQ ID NO: 467115 - DNA, 25 bp, Rattus norvegicus
ctcgtagaagacgttgcgagcctcg

SEQ ID NO: 467116 - DNA, 25 bp, Rattus norvegicus
ttgcgagcctcgtccttgatgagga

SEQ ID NO: 467117 - DNA, 25 bp, Rattus norvegicus
aggagacgcggccatcatggtcact

SEQ ID NO: 467118 - DNA, 25 bp, Rattus norvegicus
cccgaactgcaggaacaggactcct

SEQ ID NO: 467119 - DNA, 25 bp, Rattus norvegicus
tgatgtgtacacgtcgcgtctcctc

SEQ ID NO: 467120 - DNA, 25 bp, Rattus norvegicus
ctgctgacctcatgcgtgatgtgta

SEQ ID NO: 467121 - DNA, 25 bp, Rattus norvegicus
tgcagcgtgtccaggctgctgacct

SEQ ID NO: 467122 - DNA, 25 bp, Rattus norvegicus
aacatgtgcgcgatgagtgcgtgca

SEQ ID NO: 467123 - DNA, 25 bp, Rattus norvegicus
cttctgcgggaacatgtgcgcgatg

SEQ ID NO: 467124 - DNA, 25 bp, Rattus norvegicus
agcatgcccatggtgagcttctgcg

SEQ ID NO: 467125 - DNA, 25 bp, Rattus norvegicus
atcatggtcactgcctctgtcggcg

SEQ ID NO: 467126 - DNA, 25 bp, Rattus norvegicus
cgatggctcctcgatgactcctgga

SEQ ID NO: 467127 - DNA, 25 bp, Rattus norvegicus
ggcagtttcttggagcgatggctcc

SEQ ID NO: 467128 - DNA, 25 bp, Rattus norvegicus
cgcgccctgttgctctaggtgcaac

SEQ ID NO: 467129 - DNA, 25 bp, Rattus norvegicus
tctaggtgcaactgcagcagggccc

SEQ ID NO: 467130 - DNA, 25 bp, Rattus norvegicus
agggcccggcggtacatgacctcca

SEQ ID NO: 467131 - DNA, 25 bp, Rattus norvegicus
atgacctccagcttctctagtcggg

SEQ ID NO: 467132 - DNA, 25 bp, Rattus norvegicus
ctgagggtttcgactgcggcctccc

SEQ ID NO: 467133 - DNA, 25 bp, Rattus norvegicus
aagaggctgcggttctcgcgcttca

SEQ ID NO: 467134 - DNA, 25 bp, Rattus norvegicus
acgcatgcgccacatcgggtccggt

SEQ ID NO: 467135 - DNA, 25 bp, Rattus norvegicus
cagagctgaggcgtgtccttgtctc

SEQ ID NO: 467136 - DNA, 25 bp, Rattus norvegicus
gtgtccttgtctctcgtggctgagc

SEQ ID NO: 467137 - DNA, 25 bp, Rattus norvegicus
cctgcaatcggctggtctgctaaca

SEQ ID NO: 467138 - DNA, 25 bp, Rattus norvegicus
cggctggtctgctaacacacgacgc

SEQ ID NO: 467139 - DNA, 25 bp, Rattus norvegicus
ttcgcgcccgctggctagagccagg

SEQ ID NO: 467140 - DNA, 25 bp, Rattus norvegicus
cgacccggacgtagtgctgcacaat

SEQ ID NO: 467141 - DNA, 25 bp, Rattus norvegicus
gaaagccattcgctctgggcctgga

SEQ ID NO: 467142 - DNA, 25 bp, Rattus norvegicus
tgctgcacaatctgctgcggaacgc

SEQ ID NO: 467143 - DNA, 25 bp, Rattus norvegicus
gcgcctaacactccttcgcgagagg

SEQ ID NO: 467144 - DNA, 25 bp, Rattus norvegicus
ggaagactctcgttcccagagggca

SEQ ID NO: 467145 - DNA, 25 bp, Rattus norvegicus
tgatgggcctctccaactaccactg

SEQ ID NO: 467146 - DNA, 25 bp, Rattus norvegicus
gcgtgcgtcgagttgctttgcatca

SEQ ID NO: 467147 - DNA, 25 bp, Rattus norvegicus
tggcacgctatggaatggacaaaca

SEQ ID NO: 467148 - DNA, 25 bp, Rattus norvegicus
agagaaacaacgtccggcgcttccg

SEQ ID NO: 467149 - DNA, 25 bp, Rattus norvegicus
gcgccaagcttctccgggacatgaa

SEQ ID NO: 467150 - DNA, 25 bp, Rattus norvegicus
ccgggacatgaaccaaggcgaactg

SEQ ID NO: 467151 - DNA, 25 bp, Rattus norvegicus
ttcgattgcgcgttactcggtgacc

SEQ ID NO: 467152 - DNA, 25 bp, Rattus norvegicus
ttgtcgcccatattggcacgctatg

SEQ ID NO: 467153 - DNA, 25 bp, Rattus norvegicus
cggcctcaggttctgtcagcatcga

SEQ ID NO: 467154 - DNA, 25 bp, Rattus norvegicus
cccggcactaacaatgagcttctgc

SEQ ID NO: 467155 - DNA, 25 bp, Rattus norvegicus
tgtcgcaggcttggcgtcacttccg

SEQ ID NO: 467156 - DNA, 25 bp, Rattus norvegicus
attcagaagcgttccggcggcccaa

SEQ ID NO: 467157 - DNA, 25 bp, Rattus norvegicus
tcacttccggttgcggcgcgtttca

SEQ ID NO: 467158 - DNA, 25 bp, Rattus norvegicus
cggcgcgtttcactacgtatcgttt

SEQ ID NO: 467159 - DNA, 25 bp, Rattus norvegicus
ggacgaatcggtgctcctccgcttt

SEQ ID NO: 467160 - DNA, 25 bp, Rattus norvegicus
gccggccgtctctgcagcaacagaa

SEQ ID NO: 467161 - DNA, 25 bp, Rattus norvegicus
agcccgagacgctggaggacgaatc

SEQ ID NO: 467162 - DNA, 25 bp, Rattus norvegicus
acctgctgcagggagcccgagacgc

SEQ ID NO: 467163 - DNA, 25 bp, Rattus norvegicus
cgaggcgaggcacgcacctgctgca

SEQ ID NO: 467164 - DNA, 25 bp, Rattus norvegicus
cgtatcgtttcaagaggaggggctc

SEQ ID NO: 467165 - DNA, 25 bp, Rattus norvegicus
atggtcctcgcgctgcaaccatcag

SEQ ID NO: 467166 - DNA, 25 bp, Rattus norvegicus
agcccggctcttctgaggggccaca

SEQ ID NO: 467167 - DNA, 25 bp, Rattus norvegicus
cttctgaggggccacagctccggga

SEQ ID NO: 467168 - DNA, 25 bp, Rattus norvegicus
gctgcaaggcaacgcggaccgaaac

SEQ ID NO: 467169 - DNA, 25 bp, Rattus norvegicus
ctcacgtccagttcgtggcccggga

SEQ ID NO: 467170 - DNA, 25 bp, Rattus norvegicus
tacgatcccgggacacagacacaaa

SEQ ID NO: 467171 - DNA, 25 bp, Rattus norvegicus
ggagcgagcagctcagccggtatct

SEQ ID NO: 467172 - DNA, 25 bp, Rattus norvegicus
aactcccacaatgctgcgcgttctg

SEQ ID NO: 467173 - DNA, 25 bp, Rattus norvegicus
gggacggtgagactcggaaattctc

SEQ ID NO: 467174 - DNA, 25 bp, Rattus norvegicus
cagcccgcggtgacgcaaagtgtgt

SEQ ID NO: 467175 - DNA, 25 bp, Rattus norvegicus
agcaaccctaacatacacgccggaa

SEQ ID NO: 467176 - DNA, 25 bp, Rattus norvegicus
ccgagtggactgagtgacacagcaa

SEQ ID NO: 467177 - DNA, 25 bp, Rattus norvegicus
gccagtcagccggtacggaaggacc

SEQ ID NO: 467178 - DNA, 25 bp, Rattus norvegicus
agactcgtccacaggcccgagctgg

SEQ ID NO: 467179 - DNA, 25 bp, Rattus norvegicus
cgccggagaccggaagagccagtca

SEQ ID NO: 467180 - DNA, 25 bp, Rattus norvegicus
cccgagacccgcctgcaagagaggg

SEQ ID NO: 467181 - DNA, 25 bp, Rattus norvegicus
caaccgaagatctgtagtagtttaa

SEQ ID NO: 467182 - DNA, 25 bp, Rattus norvegicus
tgtggcgcacttccggggaaaggtc

SEQ ID NO: 467183 - DNA, 25 bp, Rattus norvegicus
gcaacccgggtcctgacgccgtcca

SEQ ID NO: 467184 - DNA, 25 bp, Rattus norvegicus
tgacgccgtccacacggacccttgg

SEQ ID NO: 467185 - DNA, 25 bp, Rattus norvegicus
gacccttggccaaccgcatcctccg

SEQ ID NO: 467186 - DNA, 25 bp, Rattus norvegicus
tccggcccttgcctagcacagcccg

SEQ ID NO: 467187 - DNA, 25 bp, Rattus norvegicus
gccgccacatctccctccacatcca

SEQ ID NO: 467188 - DNA, 25 bp, Rattus norvegicus
tccacatccacatccgcctcctcag

SEQ ID NO: 467189 - DNA, 25 bp, Rattus norvegicus
tcctcagcttccatgactgcacttg

SEQ ID NO: 467190 - DNA, 25 bp, Rattus norvegicus
agcttccatgactgcacttgacaca

SEQ ID NO: 467191 - DNA, 25 bp, Rattus norvegicus
catgactgcacttgacacaggcgta

SEQ ID NO: 467192 - DNA, 25 bp, Rattus norvegicus
tgcacttgacacaggcgtactcgtg

SEQ ID NO: 467193 - DNA, 25 bp, Rattus norvegicus
tgacacaggcgtactcgtgagatcc

SEQ ID NO: 467194 - DNA, 25 bp, Rattus norvegicus
ccgacttccggccaggagcaacccg

SEQ ID NO: 467195 - DNA, 25 bp, Rattus norvegicus
gcgtactcgtgagatcccgcgagat

SEQ ID NO: 467196 - DNA, 25 bp, Rattus norvegicus
aaagtttgtttaggagcgtgcgctc

SEQ ID NO: 467197 - DNA, 25 bp, Rattus norvegicus
caggttcaaggtcatgctctgcttc

SEQ ID NO: 467198 - DNA, 25 bp, Rattus norvegicus
ggcgcagaccagtcgtcacggaatt

SEQ ID NO: 467199 - DNA, 25 bp, Rattus norvegicus
tttctttacggtctcggtggcagcc

SEQ ID NO: 467200 - DNA, 25 bp, Rattus norvegicus
ccttaggcgcagaagaggttttgca

SEQ ID NO: 467201 - DNA, 25 bp, Rattus norvegicus
tgcaaaagttcgctccgggccactt

SEQ ID NO: 467202 - DNA, 25 bp, Rattus norvegicus
ggagccgttctcgatgctgtcagca

SEQ ID NO: 467203 - DNA, 25 bp, Rattus norvegicus
cttgtgagcttcttctccgggaaaa

SEQ ID NO: 467204 - DNA, 25 bp, Rattus norvegicus
ggtcgtttccatctttgcagtcata

SEQ ID NO: 467205 - DNA, 25 bp, Rattus norvegicus
gggcatcgtcgtagaaggtcgtttc

SEQ ID NO: 467206 - DNA, 25 bp, Rattus norvegicus
cgccactctcggactggaggaacga

SEQ ID NO: 467207 - DNA, 25 bp, Rattus norvegicus
gttactgtagccgtaggcgccactc

SEQ ID NO: 467208 - DNA, 25 bp, Rattus norvegicus
taagacaccgcttgcactcacgttg

SEQ ID NO: 467209 - DNA, 25 bp, Rattus norvegicus
gcgcgatccggagctttgaaaagtc

SEQ ID NO: 467210 - DNA, 25 bp, Rattus norvegicus
agttgaataaccctgccgcggtgtg

SEQ ID NO: 467211 - DNA, 25 bp, Rattus norvegicus
aaccctgccgcggtgtgtgtagcag

SEQ ID NO: 467212 - DNA, 25 bp, Rattus norvegicus
ccggtggatgggcagttgaataacc

SEQ ID NO: 467213 - DNA, 25 bp, Rattus norvegicus
cactagggcgcaacttccggttact

SEQ ID NO: 467214 - DNA, 25 bp, Rattus norvegicus
tcagcagacactagggcgcaacttc

SEQ ID NO: 467215 - DNA, 25 bp, Rattus norvegicus
agcgtttctgggtcagcagacacta

SEQ ID NO: 467216 - DNA, 25 bp, Rattus norvegicus
acggtaggatgggaccagcgtttct

SEQ ID NO: 467217 - DNA, 25 bp, Rattus norvegicus
aagtccttctgaacagcattagtca

SEQ ID NO: 467218 - DNA, 25 bp, Rattus norvegicus
gcgcacctgtaagtccttctgaaca

SEQ ID NO: 467219 - DNA, 25 bp, Rattus norvegicus
gtgagcgcacctgtaagtccttctg

SEQ ID NO: 467220 - DNA, 25 bp, Rattus norvegicus
gcccgtgagcgcacctgtaagtcct

SEQ ID NO: 467221 - DNA, 25 bp, Rattus norvegicus
agaccagagaattgcgcccgtgagc

SEQ ID NO: 467222 - DNA, 25 bp, Rattus norvegicus
cgatccgggcggagaccagagaatt

SEQ ID NO: 467223 - DNA, 25 bp, Rattus norvegicus
acagcattagtcagggacggtagga

SEQ ID NO: 467224 - DNA, 25 bp, Rattus norvegicus
ccatagaaggtaaagcctgggcagc

SEQ ID NO: 467225 - DNA, 25 bp, Rattus norvegicus
aagacccacgtcctactcgcctgcc

SEQ ID NO: 467226 - DNA, 25 bp, Rattus norvegicus
tactcgcctgccctccactgctagc

SEQ ID NO: 467227 - DNA, 25 bp, Rattus norvegicus
tgccctccactgctagccctcacgg

SEQ ID NO: 467228 - DNA, 25 bp, Rattus norvegicus
actgctagccctcacggccgccacc

SEQ ID NO: 467229 - DNA, 25 bp, Rattus norvegicus
ccagcctcccgcaccagacgccggc

SEQ ID NO: 467230 - DNA, 25 bp, Rattus norvegicus
tcccgcaccagacgccggccgctcc

SEQ ID NO: 467231 - DNA, 25 bp, Rattus norvegicus
acgccggccgctcctgcgctcccac

SEQ ID NO: 467232 - DNA, 25 bp, Rattus norvegicus
cctgcgctcccacgcccgcgcactg

SEQ ID NO: 467233 - DNA, 25 bp, Rattus norvegicus
cgggcgtcctcaggctggcagcccc

SEQ ID NO: 467234 - DNA, 25 bp, Rattus norvegicus
cgccgcgggcctccccatagaaggt

SEQ ID NO: 467235 - DNA, 25 bp, Rattus norvegicus
atagaaggtaaagcctgggcagcgc

SEQ ID NO: 467236 - DNA, 25 bp, Rattus norvegicus
ctaagacccacgtcctactcgcctg

SEQ ID NO: 467237 - DNA, 25 bp, Rattus norvegicus
gggcagggcggccacgtcagcggcg

SEQ ID NO: 467238 - DNA, 25 bp, Rattus norvegicus
cgcggcgtcgaggttctcggaccat

SEQ ID NO: 467239 - DNA, 25 bp, Rattus norvegicus
gtgctcgcagaggtcactcagcttg

SEQ ID NO: 467240 - DNA, 25 bp, Rattus norvegicus
gtcactcagcttgcggtgtgcgatc

SEQ ID NO: 467241 - DNA, 25 bp, Rattus norvegicus
cttctttgtgactggtgctcgcaga

SEQ ID NO: 467242 - DNA, 25 bp, Rattus norvegicus
ctggcgtccagcttctttgtgactg

SEQ ID NO: 467243 - DNA, 25 bp, Rattus norvegicus
ttccagtctcgctggcgtccagctt

SEQ ID NO: 467244 - DNA, 25 bp, Rattus norvegicus
gaggttctcggaccatggaggaccc

SEQ ID NO: 467245 - DNA, 25 bp, Rattus norvegicus
tgccacagcctgagctgccgctgtg

SEQ ID NO: 467246 - DNA, 25 bp, Rattus norvegicus
ctgccgctgtgtgacagcctcatca

SEQ ID NO: 467247 - DNA, 25 bp, Rattus norvegicus
tgtgacagcctcatcatctgggtga

SEQ ID NO: 467248 - DNA, 25 bp, Rattus norvegicus
tcatctgggtgagtgtggttccatg

SEQ ID NO: 467249 - DNA, 25 bp, Rattus norvegicus
ggttccatgcttgccggcgaggcca

SEQ ID NO: 467250 - DNA, 25 bp, Rattus norvegicus
gagtagagcacggaacctccggctg

SEQ ID NO: 467251 - DNA, 25 bp, Rattus norvegicus
acgtacacctactccgcagcctttg

SEQ ID NO: 467252 - DNA, 25 bp, Rattus norvegicus
gaagcacattaaagcggcgccctct

SEQ ID NO: 467253 - DNA, 25 bp, Rattus norvegicus
tgaacctttccgtcgcacgcgctga

SEQ ID NO: 467254 - DNA, 25 bp, Rattus norvegicus
tctgtaactctaaaatgaacctttc

SEQ ID NO: 467255 - DNA, 25 bp, Rattus norvegicus
ccaccaaactgaggatctgtaactc

SEQ ID NO: 467256 - DNA, 25 bp, Rattus norvegicus
tcggatcggaccaccaaactgagga

SEQ ID NO: 467257 - DNA, 25 bp, Rattus norvegicus
aagttgtcaccggatcggatcggac

SEQ ID NO: 467258 - DNA, 25 bp, Rattus norvegicus
aggctctgggatgaaagttgtcacc

SEQ ID NO: 467259 - DNA, 25 bp, Rattus norvegicus
cgggtcacatttagaggctctggga

SEQ ID NO: 467260 - DNA, 25 bp, Rattus norvegicus
cgcgctgtccggttacagagaacta

SEQ ID NO: 467261 - DNA, 25 bp, Rattus norvegicus
ggcgccctctggtgtccgcttgcga

SEQ ID NO: 467262 - DNA, 25 bp, Rattus norvegicus
cccggctgaagcacattaaagcggc

SEQ ID NO: 467263 - DNA, 25 bp, Rattus norvegicus
gaactagatccctaacctgcctcta

SEQ ID NO: 467264 - DNA, 25 bp, Rattus norvegicus
ccggttacagagaactagatcccta

SEQ ID NO: 467265 - DNA, 25 bp, Rattus norvegicus
tgcgaccgccgggtcacatttagag

SEQ ID NO: 467266 - DNA, 25 bp, Rattus norvegicus
cgtttctctgagatcgggaacccgc

SEQ ID NO: 467267 - DNA, 25 bp, Rattus norvegicus
gtgaacccgagtccgtgcaaacgcc

SEQ ID NO: 467268 - DNA, 25 bp, Rattus norvegicus
cacccggggaaggtcatgactttct

SEQ ID NO: 467269 - DNA, 25 bp, Rattus norvegicus
aaggtcatgactttctgaggttggg

SEQ ID NO: 467270 - DNA, 25 bp, Rattus norvegicus
ccaggggttttcagcgacacccgca

SEQ ID NO: 467271 - DNA, 25 bp, Rattus norvegicus
tagggctacgccacgcgccctgtgg

SEQ ID NO: 467272 - DNA, 25 bp, Rattus norvegicus
atcgggaacccgctgcggtcacgcg

SEQ ID NO: 467273 - DNA, 25 bp, Rattus norvegicus
cctagactagtcctcggagccgcgg

SEQ ID NO: 467274 - DNA, 25 bp, Rattus norvegicus
gccgcggatcgagacccgatctctg

SEQ ID NO: 467275 - DNA, 25 bp, Rattus norvegicus
tgcggccacaggtgcacactccagg

SEQ ID NO: 467276 - DNA, 25 bp, Rattus norvegicus
gagggagaaggacccgctactccca

SEQ ID NO: 467277 - DNA, 25 bp, Rattus norvegicus
ctttgctgcagtgcgagagccgccg

SEQ ID NO: 467278 - DNA, 25 bp, Rattus norvegicus
caactctcgtgaacccgagtccgtg

SEQ ID NO: 467279 - DNA, 25 bp, Rattus norvegicus
ttttcagcgacacccgcagctcgga

SEQ ID NO: 467280 - DNA, 25 bp, Rattus norvegicus
cagctcacccgcgtggggttatacg

SEQ ID NO: 467281 - DNA, 25 bp, Rattus norvegicus
gttcccatattcgaatcccagctca

SEQ ID NO: 467282 - DNA, 25 bp, Rattus norvegicus
tgatttgctccgactgtacttcgcg

SEQ ID NO: 467283 - DNA, 25 bp, Rattus norvegicus
agggaactctaggtggatgatttgc

SEQ ID NO: 467284 - DNA, 25 bp, Rattus norvegicus
tctactgcagcagcggagggaactc

SEQ ID NO: 467285 - DNA, 25 bp, Rattus norvegicus
ccgaagtcctttctactgcagcagc

SEQ ID NO: 467286 - DNA, 25 bp, Rattus norvegicus
gcttgaagatcaaccgaagtccttt

SEQ ID NO: 467287 - DNA, 25 bp, Rattus norvegicus
gcgcgggttccagcttgaagatcaa

SEQ ID NO: 467288 - DNA, 25 bp, Rattus norvegicus
ggatacgtcccgtgcgcgggttcca

SEQ ID NO: 467289 - DNA, 25 bp, Rattus norvegicus
gcacttcgagagacggaacagagta

SEQ ID NO: 467290 - DNA, 25 bp, Rattus norvegicus
agtgatcacattgcagctgggctgg

SEQ ID NO: 467291 - DNA, 25 bp, Rattus norvegicus
gtgtcgggagtgatcacattgcagc

SEQ ID NO: 467292 - DNA, 25 bp, Rattus norvegicus
cacccgcgtggggttatacgcgatg

SEQ ID NO: 467293 - DNA, 25 bp, Rattus norvegicus
gttgcgaaattgagttcccatattc

SEQ ID NO: 467294 - DNA, 25 bp, Rattus norvegicus
ggctgaggcagcagtgagttatttt

SEQ ID NO: 467295 - DNA, 25 bp, Rattus norvegicus
acgccgtacttccattattcactgg

SEQ ID NO: 467296 - DNA, 25 bp, Rattus norvegicus
cagcagtgagttattttgcgtgata

SEQ ID NO: 467297 - DNA, 25 bp, Rattus norvegicus
tgcgtgataaatcagctttattgtc

SEQ ID NO: 467298 - DNA, 25 bp, Rattus norvegicus
ttattgtctccacgccgtacttcca

SEQ ID NO: 467299 - DNA, 25 bp, Rattus norvegicus
tattcactggaactggacggctgcg

SEQ ID NO: 467300 - DNA, 25 bp, Rattus norvegicus
ggggcctgagctccgattgattttt

SEQ ID NO: 467301 - DNA, 25 bp, Rattus norvegicus
agctccgattgattttttccagatc

SEQ ID NO: 467302 - DNA, 25 bp, Rattus norvegicus
tttccagatcgcgtctccttcagca

SEQ ID NO: 467303 - DNA, 25 bp, Rattus norvegicus
ccttcagcacggctcgccaaaggga

SEQ ID NO: 467304 - DNA, 25 bp, Rattus norvegicus
cgccaaagggaatcgagttgactgc

SEQ ID NO: 467305 - DNA, 25 bp, Rattus norvegicus
aatcgagttgactgcggggagcttc

SEQ ID NO: 467306 - DNA, 25 bp, Rattus norvegicus
cgcatttgtgatttaaagcggcacg

SEQ ID NO: 467307 - DNA, 25 bp, Rattus norvegicus
tgcagccctgactcctggccattgc

SEQ ID NO: 467308 - DNA, 25 bp, Rattus norvegicus
cgagattcggcggtgcggacaaaac

SEQ ID NO: 467309 - DNA, 25 bp, Rattus norvegicus
ggcctgggcataggtttttctattc

SEQ ID NO: 467310 - DNA, 25 bp, Rattus norvegicus
attcaggccctctcgggcctgggca

SEQ ID NO: 467311 - DNA, 25 bp, Rattus norvegicus
tctcggctcttgctctctgtccttt

SEQ ID NO: 467312 - DNA, 25 bp, Rattus norvegicus
ctatgcggtacttgaaggatggcga

SEQ ID NO: 467313 - DNA, 25 bp, Rattus norvegicus
agcccgcgcctatgcggtacttgaa

SEQ ID NO: 467314 - DNA, 25 bp, Rattus norvegicus
gggagcacggctcctgacatgtcca

SEQ ID NO: 467315 - DNA, 25 bp, Rattus norvegicus
cccagccaatgaggttcggggccgc

SEQ ID NO: 467316 - DNA, 25 bp, Rattus norvegicus
ggactcccgcgagttccagtcctgg

SEQ ID NO: 467317 - DNA, 25 bp, Rattus norvegicus
gggtcctgtcacctcggcccgtgaa

SEQ ID NO: 467318 - DNA, 25 bp, Rattus norvegicus
gctcacacagcgttccgggtcctgt

SEQ ID NO: 467319 - DNA, 25 bp, Rattus norvegicus
gcgcagattcaaacggcggctcttg

SEQ ID NO: 467320 - DNA, 25 bp, Rattus norvegicus
tcctgacatgtccagggcatccctg

SEQ ID NO: 467321 - DNA, 25 bp, Rattus norvegicus
cggacaaaaccctgcaggaggctgc

SEQ ID NO: 467322 - DNA, 25 bp, Rattus norvegicus
cctaccaactcggaggcggttctgc

SEQ ID NO: 467323 - DNA, 25 bp, Rattus norvegicus
tactatgcaaattgcagcgattgcg

SEQ ID NO: 467324 - DNA, 25 bp, Rattus norvegicus
gttactatgcaaattgcagcgattg

SEQ ID NO: 467325 - DNA, 25 bp, Rattus norvegicus
gcgtggttactatgcaaattgcagc

SEQ ID NO: 467326 - DNA, 25 bp, Rattus norvegicus
cgtgcgtggttactatgcaaattgc

SEQ ID NO: 467327 - DNA, 25 bp, Rattus norvegicus
ctcgtgcgtggttactatgcaaatt

SEQ ID NO: 467328 - DNA, 25 bp, Rattus norvegicus
cgcctcgtgcgtggttactatgcaa

SEQ ID NO: 467329 - DNA, 25 bp, Rattus norvegicus
cctccgcctcgtgcgtggttactat

SEQ ID NO: 467330 - DNA, 25 bp, Rattus norvegicus
ccattggccaccagccgtggggaag

SEQ ID NO: 467331 - DNA, 25 bp, Rattus norvegicus
tcccattggccaccagccgtgggga

SEQ ID NO: 467332 - DNA, 25 bp, Rattus norvegicus
cgacccgagcttgcgctgaaggccg

SEQ ID NO: 467333 - DNA, 25 bp, Rattus norvegicus
tcccgacccgagcttgcgctgaagg

SEQ ID NO: 467334 - DNA, 25 bp, Rattus norvegicus
agtcccgacccgagcttgcgctgaa

SEQ ID NO: 467335 - DNA, 25 bp, Rattus norvegicus
taccaactcggaggcggttctgcag

SEQ ID NO: 467336 - DNA, 25 bp, Rattus norvegicus
gctcagcaagcaggacccggcaact

SEQ ID NO: 467337 - DNA, 25 bp, Rattus norvegicus
gcaggacccggcaactttccgtgca

SEQ ID NO: 467338 - DNA, 25 bp, Rattus norvegicus
agcaggacccggcaactttccgtgc

SEQ ID NO: 467339 - DNA, 25 bp, Rattus norvegicus
cagcaagcaggacccggcaactttc

SEQ ID NO: 467340 - DNA, 25 bp, Rattus norvegicus
ctcagcaagcaggacccggcaactt

SEQ ID NO: 467341 - DNA, 25 bp, Rattus norvegicus
aggacccggcaactttccgtgcagc

SEQ ID NO: 467342 - DNA, 25 bp, Rattus norvegicus
cggctcagcaagcaggacccggcaa

SEQ ID NO: 467343 - DNA, 25 bp, Rattus norvegicus
caggcggctcagcaagcaggacccg

SEQ ID NO: 467344 - DNA, 25 bp, Rattus norvegicus
taggcaagccccaggcggctcagca

SEQ ID NO: 467345 - DNA, 25 bp, Rattus norvegicus
agcggcggccagacagggagtcggc

SEQ ID NO: 467346 - DNA, 25 bp, Rattus norvegicus
cagggacgcccggtccgggcggctg

SEQ ID NO: 467347 - DNA, 25 bp, Rattus norvegicus
gcggagtccgcagggacgcccggtc

SEQ ID NO: 467348 - DNA, 25 bp, Rattus norvegicus
agcggccgcgcggtacgcagaggtg

SEQ ID NO: 467349 - DNA, 25 bp, Rattus norvegicus
tcagcaagcaggacccggcaacttt

SEQ ID NO: 467350 - DNA, 25 bp, Rattus norvegicus
tccggaggatattgtcccactctga

SEQ ID NO: 467351 - DNA, 25 bp, Rattus norvegicus
attgtcccactctgaggtcctcaca

SEQ ID NO: 467352 - DNA, 25 bp, Rattus norvegicus
gaccgcctgagaaggccgactttcc

SEQ ID NO: 467353 - DNA, 25 bp, Rattus norvegicus
gagaaggccgactttccggaggata

SEQ ID NO: 467354 - DNA, 25 bp, Rattus norvegicus
cgactttccggaggatattgtccca

SEQ ID NO: 467355 - DNA, 25 bp, Rattus norvegicus
aggatattgtcccactctgaggtcc

SEQ ID NO: 467356 - DNA, 25 bp, Rattus norvegicus
tcctcgcctccgacagcgccagagg

SEQ ID NO: 467357 - DNA, 25 bp, Rattus norvegicus
cggcgaccgtcacgagccacagagt

SEQ ID NO: 467358 - DNA, 25 bp, Rattus norvegicus
accgtcacgagccacagagtgcgga

SEQ ID NO: 467359 - DNA, 25 bp, Rattus norvegicus
cgccatgttgggcaccgcgtcctcg

SEQ ID NO: 467360 - DNA, 25 bp, Rattus norvegicus
ctgaccgcctgagaaggccgacttt

SEQ ID NO: 467361 - DNA, 25 bp, Rattus norvegicus
cgtcctcgcgcttccggttccgcct

SEQ ID NO: 467362 - DNA, 25 bp, Rattus norvegicus
aaggccgactttccggaggatattg

SEQ ID NO: 467363 - DNA, 25 bp, Rattus norvegicus
aggtcctcacacttgggcgtctcct

SEQ ID NO: 467364 - DNA, 25 bp, Rattus norvegicus
ccacacttccgtccaggtgagggca

SEQ ID NO: 467365 - DNA, 25 bp, Rattus norvegicus
accgacgtgaccgacgtggcctcga

SEQ ID NO: 467366 - DNA, 25 bp, Rattus norvegicus
accgacgtggcctcgagtgggcctt

SEQ ID NO: 467367 - DNA, 25 bp, Rattus norvegicus
ggtcagcgccggtggctcacaactc

SEQ ID NO: 467368 - DNA, 25 bp, Rattus norvegicus
tcacaactccgcacctggccgcaag

SEQ ID NO: 467369 - DNA, 25 bp, Rattus norvegicus
aggccgcctcaccaggattggtagc

SEQ ID NO: 467370 - DNA, 25 bp, Rattus norvegicus
cccggaacttttacaggcgcgcaga

SEQ ID NO: 467371 - DNA, 25 bp, Rattus norvegicus
tttacaggcgcgcagacgcccaggg

SEQ ID NO: 467372 - DNA, 25 bp, Rattus norvegicus
tgagggcagcagctgtacttccgcc

SEQ ID NO: 467373 - DNA, 25 bp, Rattus norvegicus
tgtacttccgccaggtgaggaggcc

SEQ ID NO: 467374 - DNA, 25 bp, Rattus norvegicus
cccggctgtcgcctgatcaggtaac

SEQ ID NO: 467375 - DNA, 25 bp, Rattus norvegicus
gatcaggtaacgctcgcggcgcact

SEQ ID NO: 467376 - DNA, 25 bp, Rattus norvegicus
tgcgagctcagcgatcgcgcgtgct

SEQ ID NO: 467377 - DNA, 25 bp, Rattus norvegicus
gcgtgctcggggatctagctcccgc

SEQ ID NO: 467378 - DNA, 25 bp, Rattus norvegicus
ggatgtcccggtgtttctcaccctg

SEQ ID NO: 467379 - DNA, 25 bp, Rattus norvegicus
ttttgttggcgcgtgtgacctcctg

SEQ ID NO: 467380 - DNA, 25 bp, Rattus norvegicus
gacctcgtggctcccaggtaaggct

SEQ ID NO: 467381 - DNA, 25 bp, Rattus norvegicus
tcccaggtaaggctgctcaaggcta

SEQ ID NO: 467382 - DNA, 25 bp, Rattus norvegicus
ggcgagtctctcctgcgctcagacg

SEQ ID NO: 467383 - DNA, 25 bp, Rattus norvegicus
gacctcctggctggacctcgtggct

SEQ ID NO: 467384 - DNA, 25 bp, Rattus norvegicus
ggacgaccggcgagtctctcctgcg

SEQ ID NO: 467385 - DNA, 25 bp, Rattus norvegicus
ctggggagtgagaattgctcctgca

SEQ ID NO: 467386 - DNA, 25 bp, Rattus norvegicus
agtgagaattgctcctgcacacgga

SEQ ID NO: 467387 - DNA, 25 bp, Rattus norvegicus
tgctcctgcacacggaaagtgggga

SEQ ID NO: 467388 - DNA, 25 bp, Rattus norvegicus
agcggccgccccagagttttgcaaa

SEQ ID NO: 467389 - DNA, 25 bp, Rattus norvegicus
gcctccgccatcgaacgcttttctc

SEQ ID NO: 467390 - DNA, 25 bp, Rattus norvegicus
acgccggccctgcttttgttggcgc

SEQ ID NO: 467391 - DNA, 25 bp, Rattus norvegicus
ggtaaggctgctcaaggctaggccc

SEQ ID NO: 467392 - DNA, 25 bp, Rattus norvegicus
acgcagcattaacaggggtcgcgga

SEQ ID NO: 467393 - DNA, 25 bp, Rattus norvegicus
ggcgggtgtccacgccaggccactt

SEQ ID NO: 467394 - DNA, 25 bp, Rattus norvegicus
cacgccaggccacttaccttgggga

SEQ ID NO: 467395 - DNA, 25 bp, Rattus norvegicus
aggccacttaccttggggagccgcg

SEQ ID NO: 467396 - DNA, 25 bp, Rattus norvegicus
gagcagcgcgagctcccacccggct

SEQ ID NO: 467397 - DNA, 25 bp, Rattus norvegicus
ccacccggctttggggtgcacgcag

SEQ ID NO: 467398 - DNA, 25 bp, Rattus norvegicus
cagctgcagctgcacggtcttccgt

SEQ ID NO: 467399 - DNA, 25 bp, Rattus norvegicus
acggtcttccgtggcacagttctcc

SEQ ID NO: 467400 - DNA, 25 bp, Rattus norvegicus
gtggcacagttctccttcctctgca

SEQ ID NO: 467401 - DNA, 25 bp, Rattus norvegicus
tgcaccgtccgcgtcctggcacgca

SEQ ID NO: 467402 - DNA, 25 bp, Rattus norvegicus
cgcgcacaccctccgggcgccctca

SEQ ID NO: 467403 - DNA, 25 bp, Rattus norvegicus
actggctgcgggcacacctaccgcg

SEQ ID NO: 467404 - DNA, 25 bp, Rattus norvegicus
tgccgcagcctctgcagggacgcag

SEQ ID NO: 467405 - DNA, 25 bp, Rattus norvegicus
cctctgcagggacgcagcattaaca

SEQ ID NO: 467406 - DNA, 25 bp, Rattus norvegicus
tccagtcgcgagaccagcctgagaa

SEQ ID NO: 467407 - DNA, 25 bp, Rattus norvegicus
gcctgagaaccaaaacccttgcgca

SEQ ID NO: 467408 - DNA, 25 bp, Rattus norvegicus
aaacccttgcgcagcctgcgggaga

SEQ ID NO: 467409 - DNA, 25 bp, Rattus norvegicus
aggcgttcggctgtgcactatttaa

SEQ ID NO: 467410 - DNA, 25 bp, Rattus norvegicus
tgtgcactatttaaggcagtgctta

SEQ ID NO: 467411 - DNA, 25 bp, Rattus norvegicus
ggcagtgcttattcttatccgatag

SEQ ID NO: 467412 - DNA, 25 bp, Rattus norvegicus
ccgatagcttgggactggatggacc

SEQ ID NO: 467413 - DNA, 25 bp, Rattus norvegicus
atggaccgtggcttcatcagcaaac

SEQ ID NO: 467414 - DNA, 25 bp, Rattus norvegicus
ttcatcagcaaactggacgcccagc

SEQ ID NO: 467415 - DNA, 25 bp, Rattus norvegicus
ccagcaggcgccgagcagctagcaa

SEQ ID NO: 467416 - DNA, 25 bp, Rattus norvegicus
gctagcaagcccgtcagccattttc

SEQ ID NO: 467417 - DNA, 25 bp, Rattus norvegicus
ttcctagcatctttggcaacccttc

SEQ ID NO: 467418 - DNA, 25 bp, Rattus norvegicus
ttggcaacccttccggagagcgcac

SEQ ID NO: 467419 - DNA, 25 bp, Rattus norvegicus
gctcgcgccagaacccgttgaagct

SEQ ID NO: 467420 - DNA, 25 bp, Rattus norvegicus
atgagccctttgaacccgacggccg

SEQ ID NO: 467421 - DNA, 25 bp, Rattus norvegicus
acagaagccgatgcgataatgtgtg

SEQ ID NO: 467422 - DNA, 25 bp, Rattus norvegicus
gccggtatggaaaacgtgtttgtga

SEQ ID NO: 467423 - DNA, 25 bp, Rattus norvegicus
gatgcaggatgaacagaagccgatg

SEQ ID NO: 467424 - DNA, 25 bp, Rattus norvegicus
cgataatgtgtgtgcggtcagtgcc

SEQ ID NO: 467425 - DNA, 25 bp, Rattus norvegicus
ccgaatgagccctttgaacccgacg

SEQ ID NO: 467426 - DNA, 25 bp, Rattus norvegicus
tccaagataccaataccgaatgagc

SEQ ID NO: 467427 - DNA, 25 bp, Rattus norvegicus
aacaggtatacgtccttccaagata

SEQ ID NO: 467428 - DNA, 25 bp, Rattus norvegicus
tcggtctacagaacaggtatacgtc

SEQ ID NO: 467429 - DNA, 25 bp, Rattus norvegicus
tgtgcacatcggtctacagaacagg

SEQ ID NO: 467430 - DNA, 25 bp, Rattus norvegicus
atcactgtttttattgtgcacatcg

SEQ ID NO: 467431 - DNA, 25 bp, Rattus norvegicus
ggcaaccgaaacacgtgaatcactg

SEQ ID NO: 467432 - DNA, 25 bp, Rattus norvegicus
cacttgcgaggaggcaaccgaaaca

SEQ ID NO: 467433 - DNA, 25 bp, Rattus norvegicus
aaacgtgtttgtgatgcaggatgca

SEQ ID NO: 467434 - DNA, 25 bp, Rattus norvegicus
cctttcgcgcctctgcaacgtggag

SEQ ID NO: 467435 - DNA, 25 bp, Rattus norvegicus
tttctccagaagtgtgtacggcgcc

SEQ ID NO: 467436 - DNA, 25 bp, Rattus norvegicus
ttgacttacagtttctccagaagtg

SEQ ID NO: 467437 - DNA, 25 bp, Rattus norvegicus
ccgcgcattttcttgacttacagtt

SEQ ID NO: 467438 - DNA, 25 bp, Rattus norvegicus
ttgcgaaattttaccgcgcattttc

SEQ ID NO: 467439 - DNA, 25 bp, Rattus norvegicus
gtttgtgatcgcagtgtcctgggtc

SEQ ID NO: 467440 - DNA, 25 bp, Rattus norvegicus
agagatgtttgtgatcgcagtgtcc

SEQ ID NO: 467441 - DNA, 25 bp, Rattus norvegicus
cacgcctttggttacgggagaggct

SEQ ID NO: 467442 - DNA, 25 bp, Rattus norvegicus
tctgcccacgcctttggttacggga

SEQ ID NO: 467443 - DNA, 25 bp, Rattus norvegicus
ctcgctcagggccatgaccgggtaa

SEQ ID NO: 467444 - DNA, 25 bp, Rattus norvegicus
agactgaggaaaacgcgccaagttc

SEQ ID NO: 467445 - DNA, 25 bp, Rattus norvegicus
gaaccggcactttccgtggacgcca

SEQ ID NO: 467446 - DNA, 25 bp, Rattus norvegicus
ctctgcaacgtggagaggagaaccg

SEQ ID NO: 467447 - DNA, 25 bp, Rattus norvegicus
gtacggcgccacgtgtcttaacgca

SEQ ID NO: 467448 - DNA, 25 bp, Rattus norvegicus
agtggcgcggggcaaaccaagccac

SEQ ID NO: 467449 - DNA, 25 bp, Rattus norvegicus
agtccctggccttggcactccgggt

SEQ ID NO: 467450 - DNA, 25 bp, Rattus norvegicus
agtggccacacctgcacttcatttg

SEQ ID NO: 467451 - DNA, 25 bp, Rattus norvegicus
gcacttcatttgcttgggagcagca

SEQ ID NO: 467452 - DNA, 25 bp, Rattus norvegicus
ttgggagcagcacggcgacccgcct

SEQ ID NO: 467453 - DNA, 25 bp, Rattus norvegicus
acccgcctgctggtggggagccttc

SEQ ID NO: 467454 - DNA, 25 bp, Rattus norvegicus
gggagccttcttcgcatcctcgcga

SEQ ID NO: 467455 - DNA, 25 bp, Rattus norvegicus
tcctcgcgattatgacaagttatta

SEQ ID NO: 467456 - DNA, 25 bp, Rattus norvegicus
ttaattgccaccattagctgcagca

SEQ ID NO: 467457 - DNA, 25 bp, Rattus norvegicus
agcagcctgcccgagatctctgctg

SEQ ID NO: 467458 - DNA, 25 bp, Rattus norvegicus
tctctgctgctctctggaggtgaga

SEQ ID NO: 467459 - DNA, 25 bp, Rattus norvegicus
ctctctggaggtgagagtctgcgca

SEQ ID NO: 467460 - DNA, 25 bp, Rattus norvegicus
gagagtctgcgcatctgaacgccca

SEQ ID NO: 467461 - DNA, 25 bp, Rattus norvegicus
atctgaacgcccagggaaccggtgg

SEQ ID NO: 467462 - DNA, 25 bp, Rattus norvegicus
ccagagatgcccaaaaccaaaccga

SEQ ID NO: 467463 - DNA, 25 bp, Rattus norvegicus
tgctccatcacgcacactacaatga

SEQ ID NO: 467464 - DNA, 25 bp, Rattus norvegicus
acagagcaggttggccgcccagcct

SEQ ID NO: 467465 - DNA, 25 bp, Rattus norvegicus
accgaactggcagcaagctggcgtc

SEQ ID NO: 467466 - DNA, 25 bp, Rattus norvegicus
caattcacgggctcctctggcggcg

SEQ ID NO: 467467 - DNA, 25 bp, Rattus norvegicus
ccgagccaattgaggtgactgtgcc

SEQ ID NO: 467468 - DNA, 25 bp, Rattus norvegicus
cattcatcagagaggcagccgagcc

SEQ ID NO: 467469 - DNA, 25 bp, Rattus norvegicus
agcacacccggacacattcatcaga

SEQ ID NO: 467470 - DNA, 25 bp, Rattus norvegicus
caccgcagcagccattggcggttgg

SEQ ID NO: 467471 - DNA, 25 bp, Rattus norvegicus
tgctggaagcgatgctaaacccttt

SEQ ID NO: 467472 - DNA, 25 bp, Rattus norvegicus
tcctgaaaatcacggcgcactgctg

SEQ ID NO: 467473 - DNA, 25 bp, Rattus norvegicus
gcaatccttcccagtcctgaaaatc

SEQ ID NO: 467474 - DNA, 25 bp, Rattus norvegicus
tcaaggagagagctgtgaagcaatc

SEQ ID NO: 467475 - DNA, 25 bp, Rattus norvegicus
caggcgtccagtgacagagcaggtt

SEQ ID NO: 467476 - DNA, 25 bp, Rattus norvegicus
cggcgagttacgtcttcgccacttg

SEQ ID NO: 467477 - DNA, 25 bp, Rattus norvegicus
agaaatagccaccaccgtcgcccgg

SEQ ID NO: 467478 - DNA, 25 bp, Rattus norvegicus
tatacagaaatagccaccaccgtcg

SEQ ID NO: 467479 - DNA, 25 bp, Rattus norvegicus
gccacttgcccattatacagaaata

SEQ ID NO: 467480 - DNA, 25 bp, Rattus norvegicus
acgtcttcgccacttgcccattata

SEQ ID NO: 467481 - DNA, 25 bp, Rattus norvegicus
gagttacgtcttcgccacttgccca

SEQ ID NO: 467482 - DNA, 25 bp, Rattus norvegicus
ctcgcctgtcataggctatattttg

SEQ ID NO: 467483 - DNA, 25 bp, Rattus norvegicus
ctcggctgaactcgcctgtcatagg

SEQ ID NO: 467484 - DNA, 25 bp, Rattus norvegicus
caggaggctcggctgaactcgcctg

SEQ ID NO: 467485 - DNA, 25 bp, Rattus norvegicus
cacggtcctagttcgcaggaggctc

SEQ ID NO: 467486 - DNA, 25 bp, Rattus norvegicus
agccgtcacggtcctagttcgcagg

SEQ ID NO: 467487 - DNA, 25 bp, Rattus norvegicus
gcctccgcgccctctcgccgacctg

SEQ ID NO: 467488 - DNA, 25 bp, Rattus norvegicus
cccatttcggcgagttacgtcttcg

SEQ ID NO: 467489 - DNA, 25 bp, Rattus norvegicus
ggctgaactcgcctgtcataggcta

SEQ ID NO: 467490 - DNA, 25 bp, Rattus norvegicus
gcggtttgtagtcggccagtctgca

SEQ ID NO: 467491 - DNA, 25 bp, Rattus norvegicus
agactcacgtaccaggtctggcggg

SEQ ID NO: 467492 - DNA, 25 bp, Rattus norvegicus
ctctagcggtctcggtggcggatac

SEQ ID NO: 467493 - DNA, 25 bp, Rattus norvegicus
ttgcggcagcagctctagcggtctc

SEQ ID NO: 467494 - DNA, 25 bp, Rattus norvegicus
cgctcacagcgttgcggcagcagct

SEQ ID NO: 467495 - DNA, 25 bp, Rattus norvegicus
ccagtctgcagccacctgcggtcgc

SEQ ID NO: 467496 - DNA, 25 bp, Rattus norvegicus
cctggcggtttgtagtcggccagtc

SEQ ID NO: 467497 - DNA, 25 bp, Rattus norvegicus
cctgaggaactgagactcacgtacc

SEQ ID NO: 467498 - DNA, 25 bp, Rattus norvegicus
ctccgcacctgaggaactgagactc

SEQ ID NO: 467499 - DNA, 25 bp, Rattus norvegicus
caggggtctccgcacctgaggaact

SEQ ID NO: 467500 - DNA, 25 bp, Rattus norvegicus
gcacgtcactggctctcaggggtct

SEQ ID NO: 467501 - DNA, 25 bp, Rattus norvegicus
tgctggcccgggcacgtcactggct

SEQ ID NO: 467502 - DNA, 25 bp, Rattus norvegicus
tgtccctgcgctcacagcgttgcgg

SEQ ID NO: 467503 - DNA, 25 bp, Rattus norvegicus
ctgagactcacgtaccaggtctggc

SEQ ID NO: 467504 - DNA, 25 bp, Rattus norvegicus
gttgtcatcacgcactccctcgagg

SEQ ID NO: 467505 - DNA, 25 bp, Rattus norvegicus
taccgttagcctggagggacccagc

SEQ ID NO: 467506 - DNA, 25 bp, Rattus norvegicus
atcccgcgtgatgaagtgtcggctc

SEQ ID NO: 467507 - DNA, 25 bp, Rattus norvegicus
ttgtttgacagaatgatcccgcgtg

SEQ ID NO: 467508 - DNA, 25 bp, Rattus norvegicus
gagcagcatcatattgtttgacaga

SEQ ID NO: 467509 - DNA, 25 bp, Rattus norvegicus
cggctggctgaatagggattttgta

SEQ ID NO: 467510 - DNA, 25 bp, Rattus norvegicus
gcggctccgaggcttttgttgctcc

SEQ ID NO: 467511 - DNA, 25 bp, Rattus norvegicus
accacgcccgaggacagggtacctg

SEQ ID NO: 467512 - DNA, 25 bp, Rattus norvegicus
ctggccacaaaaaggcgtgcccgga

SEQ ID NO: 467513 - DNA, 25 bp, Rattus norvegicus
ccgccagggaaaggcgcttttgcgc

SEQ ID NO: 467514 - DNA, 25 bp, Rattus norvegicus
ttaagaaatcgatatggcctgggtg

SEQ ID NO: 467515 - DNA, 25 bp, Rattus norvegicus
atcgatcggtggtgattaagaaatc

SEQ ID NO: 467516 - DNA, 25 bp, Rattus norvegicus
tttgttcccaataaatcgatcggtg

SEQ ID NO: 467517 - DNA, 25 bp, Rattus norvegicus
agacccaccatcagatccacaattg

SEQ ID NO: 467518 - DNA, 25 bp, Rattus norvegicus
cgatcacgggaatctctgcggtctc

SEQ ID NO: 467519 - DNA, 25 bp, Rattus norvegicus
agaaagtctcccgagcagctcaggc

SEQ ID NO: 467520 - DNA, 25 bp, Rattus norvegicus
caggctagcggggaaatcgaaatta

SEQ ID NO: 467521 - DNA, 25 bp, Rattus norvegicus
agcagccttgaagccagggttctcg

SEQ ID NO: 467522 - DNA, 25 bp, Rattus norvegicus
tacacgggaatggaccgcccagatc

SEQ ID NO: 467523 - DNA, 25 bp, Rattus norvegicus
ggaacctttcagtctcccacctgta

SEQ ID NO: 467524 - DNA, 25 bp, Rattus norvegicus
ctgcggtctcctttggaaatcgata

SEQ ID NO: 467525 - DNA, 25 bp, Rattus norvegicus
atcgatattaagtcgccaggcccgc

SEQ ID NO: 467526 - DNA, 25 bp, Rattus norvegicus
gcctgagcgcctcatcatttagcta

SEQ ID NO: 467527 - DNA, 25 bp, Rattus norvegicus
ggccggacccagcatcagatggtaa

SEQ ID NO: 467528 - DNA, 25 bp, Rattus norvegicus
atctctaaccgaggggaagcgttgc

SEQ ID NO: 467529 - DNA, 25 bp, Rattus norvegicus
tcacgctgcgcaccgtaattaatgg

SEQ ID NO: 467530 - DNA, 25 bp, Rattus norvegicus
ggctctaccatcaagaccgcggtcg

SEQ ID NO: 467531 - DNA, 25 bp, Rattus norvegicus
caagcatcggccagaggctctacca

SEQ ID NO: 467532 - DNA, 25 bp, Rattus norvegicus
cagtcctctgggtgtgagctgaccc

SEQ ID NO: 467533 - DNA, 25 bp, Rattus norvegicus
gagcgctcatcacggccagtctcaa

SEQ ID NO: 467534 - DNA, 25 bp, Rattus norvegicus
ccaagaacagcctggtgaagccacc

SEQ ID NO: 467535 - DNA, 25 bp, Rattus norvegicus
gcctggtgaagccaccctactctta

SEQ ID NO: 467536 - DNA, 25 bp, Rattus norvegicus
ctgcagagcccgcagaagaagctga

SEQ ID NO: 467537 - DNA, 25 bp, Rattus norvegicus
ccgcagaagaagctgaccctgagtg

SEQ ID NO: 467538 - DNA, 25 bp, Rattus norvegicus
accctgagtggcatctgcgagttca

SEQ ID NO: 467539 - DNA, 25 bp, Rattus norvegicus
acctgcgcgagcagacggcgctgat

SEQ ID NO: 467540 - DNA, 25 bp, Rattus norvegicus
gacggcgctgatgatgcagagcttc

SEQ ID NO: 467541 - DNA, 25 bp, Rattus norvegicus
gcagagcttcggagcctacagcctg

SEQ ID NO: 467542 - DNA, 25 bp, Rattus norvegicus
atatgtccggccagacggtgctgac

SEQ ID NO: 467543 - DNA, 25 bp, Rattus norvegicus
gcagcgccagcgatatgtccggcca

SEQ ID NO: 467544 - DNA, 25 bp, Rattus norvegicus
acagcgacgcgggttgcgacagccc

SEQ ID NO: 467545 - DNA, 25 bp, Rattus norvegicus
cgcggagggatgaccctctccggca

SEQ ID NO: 467546 - DNA, 25 bp, Rattus norvegicus
gaaagacacttcctcgcaaataccg

SEQ ID NO: 467547 - DNA, 25 bp, Rattus norvegicus
agtgtcagaagtcgtgtccactcct

SEQ ID NO: 467548 - DNA, 25 bp, Rattus norvegicus
gtccactcctcgcttcccactcgga

SEQ ID NO: 467549 - DNA, 25 bp, Rattus norvegicus
actcggaaaccgagccttattctcg

SEQ ID NO: 467550 - DNA, 25 bp, Rattus norvegicus
gagccttattctcggcggccggcgt

SEQ ID NO: 467551 - DNA, 25 bp, Rattus norvegicus
gggtcgctctgaaagacacttcctc

SEQ ID NO: 467552 - DNA, 25 bp, Rattus norvegicus
cttcctcgcaaataccgagtctgtt

SEQ ID NO: 467553 - DNA, 25 bp, Rattus norvegicus
ctggtaaacgataaacgttattgtg

SEQ ID NO: 467554 - DNA, 25 bp, Rattus norvegicus
gataaacgttattgtgccctgcgta

SEQ ID NO: 467555 - DNA, 25 bp, Rattus norvegicus
cgttattgtgccctgcgtaaacatt

SEQ ID NO: 467556 - DNA, 25 bp, Rattus norvegicus
attgtgccctgcgtaaacattccgc

SEQ ID NO: 467557 - DNA, 25 bp, Rattus norvegicus
ctgcgtaaacattccgcccagagcg

SEQ ID NO: 467558 - DNA, 25 bp, Rattus norvegicus
cccacagtgtcagaagtcgtgtcca

SEQ ID NO: 467559 - DNA, 25 bp, Rattus norvegicus
cgcaaataccgagtctgttttcctg

SEQ ID NO: 467560 - DNA, 25 bp, Rattus norvegicus
atgaggactggccaagggctcgcca

SEQ ID NO: 467561 - DNA, 25 bp, Rattus norvegicus
ctctgtgggcgccaattctggagac

SEQ ID NO: 467562 - DNA, 25 bp, Rattus norvegicus
tgcgcaggcgctttctctggttctc

SEQ ID NO: 467563 - DNA, 25 bp, Rattus norvegicus
tgagaacgcgcgtgctcctcgggct

SEQ ID NO: 467564 - DNA, 25 bp, Rattus norvegicus
tcgctcccgtgagggcgctgagaac

SEQ ID NO: 467565 - DNA, 25 bp, Rattus norvegicus
gccttacgggctcgctcccgtgagg

SEQ ID NO: 467566 - DNA, 25 bp, Rattus norvegicus
ccaggcttctcggattccagggctt

SEQ ID NO: 467567 - DNA, 25 bp, Rattus norvegicus
ggccgccaggcttctcggattccag

SEQ ID NO: 467568 - DNA, 25 bp, Rattus norvegicus
gctaagcagccgctccagctttggc

SEQ ID NO: 467569 - DNA, 25 bp, Rattus norvegicus
ccaagggctcgccactgcggagagc

SEQ ID NO: 467570 - DNA, 25 bp, Rattus norvegicus
tgggcgccaattctggagaccagag

SEQ ID NO: 467571 - DNA, 25 bp, Rattus norvegicus
aggagcaaggggctttccacctgcc

SEQ ID NO: 467572 - DNA, 25 bp, Rattus norvegicus
cctcacaggaatctgtgggctaagc

SEQ ID NO: 467573 - DNA, 25 bp, Rattus norvegicus
atctgtgggctaagcagccgctcca

SEQ ID NO: 467574 - DNA, 25 bp, Rattus norvegicus
tccggtactcccgaggatattcggc

SEQ ID NO: 467575 - DNA, 25 bp, Rattus norvegicus
tattcggcatcgtcggcagacagca

SEQ ID NO: 467576 - DNA, 25 bp, Rattus norvegicus
aggatattcggcatcgtcggcagac

SEQ ID NO: 467577 - DNA, 25 bp, Rattus norvegicus
ctcccgaggatattcggcatcgtcg

SEQ ID NO: 467578 - DNA, 25 bp, Rattus norvegicus
ggtactcccgaggatattcggcatc

SEQ ID NO: 467579 - DNA, 25 bp, Rattus norvegicus
cagggtccggtactcccgaggatat

SEQ ID NO: 467580 - DNA, 25 bp, Rattus norvegicus
tgcaccagccccacgttggagaagc

SEQ ID NO: 467581 - DNA, 25 bp, Rattus norvegicus
tgccgccgctcggaggtgtgcacca

SEQ ID NO: 467582 - DNA, 25 bp, Rattus norvegicus
ccaggctctgggcagcgatcaccgt

SEQ ID NO: 467583 - DNA, 25 bp, Rattus norvegicus
cccgctgagggcctccaggctctgg

SEQ ID NO: 467584 - DNA, 25 bp, Rattus norvegicus
catcggccttctggagcccgctgag

SEQ ID NO: 467585 - DNA, 25 bp, Rattus norvegicus
ttgcggtcagcatcggccttctgga

SEQ ID NO: 467586 - DNA, 25 bp, Rattus norvegicus
atctcgcttgcggtcagcatcggcc

SEQ ID NO: 467587 - DNA, 25 bp, Rattus norvegicus
cagcgatcaccgtgtgccgccgctc

SEQ ID NO: 467588 - DNA, 25 bp, Rattus norvegicus
ccaggcagccggactttggcgaagt

SEQ ID NO: 467589 - DNA, 25 bp, Rattus norvegicus
ccgtcgcttcgaggactagagccga

SEQ ID NO: 467590 - DNA, 25 bp, Rattus norvegicus
cgccaccatggtgaagatcgtgaca

SEQ ID NO: 467591 - DNA, 25 bp, Rattus norvegicus
tcgtgacagtgaagacgcaggcata

SEQ ID NO: 467592 - DNA, 25 bp, Rattus norvegicus
acgcaggcatatccggatcagaagc

SEQ ID NO: 467593 - DNA, 25 bp, Rattus norvegicus
gtgttccagggcaacgctaactatg

SEQ ID NO: 467594 - DNA, 25 bp, Rattus norvegicus
gcggagaatttcatccaaagcatcg

SEQ ID NO: 467595 - DNA, 25 bp, Rattus norvegicus
caaagcatcgtctccaccgtggagc

SEQ ID NO: 467596 - DNA, 25 bp, Rattus norvegicus
cggggacggtcgcttctacatgacc

SEQ ID NO: 467597 - DNA, 25 bp, Rattus norvegicus
atgaccgaggccatccagctcatcg

SEQ ID NO: 467598 - DNA, 25 bp, Rattus norvegicus
cgcatcgccgcagccaacggggtaa

SEQ ID NO: 467599 - DNA, 25 bp, Rattus norvegicus
cagtttcgcaatggttctgtcggga

SEQ ID NO: 467600 - DNA, 25 bp, Rattus norvegicus
cgctgtgctattctggtctgggatt

SEQ ID NO: 467601 - DNA, 25 bp, Rattus norvegicus
ccttggggcgttaagccagcgatct

SEQ ID NO: 467602 - DNA, 25 bp, Rattus norvegicus
cactgggcacgctcttctggagtcg

SEQ ID NO: 467603 - DNA, 25 bp, Rattus norvegicus
cgcggccgagtgagcccagagacct

SEQ ID NO: 467604 - DNA, 25 bp, Rattus norvegicus
agtcggagccggagacacacagtgt

SEQ ID NO: 467605 - DNA, 25 bp, Rattus norvegicus
agcgacacggagagcctggaactga

SEQ ID NO: 467606 - DNA, 25 bp, Rattus norvegicus
agcctggaactgaaccgctggcgga

SEQ ID NO: 467607 - DNA, 25 bp, Rattus norvegicus
gagggacaaagagttttgcaaaggc

SEQ ID NO: 467608 - DNA, 25 bp, Rattus norvegicus
gcactgggagaacccgtggatgttc

SEQ ID NO: 467609 - DNA, 25 bp, Rattus norvegicus
agaacccgtggatgttctgcgcgcc

SEQ ID NO: 467610 - DNA, 25 bp, Rattus norvegicus
accgccacgagaggaggaatgcacc

SEQ ID NO: 467611 - DNA, 25 bp, Rattus norvegicus
gctgctgcccaaggtaagcggcgcc

SEQ ID NO: 467612 - DNA, 25 bp, Rattus norvegicus
tccgtcccgcagaactgagtgcctg

SEQ ID NO: 467613 - DNA, 25 bp, Rattus norvegicus
agtgcctggcgagcgtctcgcccgt

SEQ ID NO: 467614 - DNA, 25 bp, Rattus norvegicus
gcctgggccggcctctgccattggt

SEQ ID NO: 467615 - DNA, 25 bp, Rattus norvegicus
acacacagtgtgctggagcgacacg

SEQ ID NO: 467616 - DNA, 25 bp, Rattus norvegicus
tatccataaatcaccgctgcagcgg

SEQ ID NO: 467617 - DNA, 25 bp, Rattus norvegicus
aggtaagcgaccctcttcgcgctgc

SEQ ID NO: 467618 - DNA, 25 bp, Rattus norvegicus
ggtggtcaccatgcaggtaagcgac

SEQ ID NO: 467619 - DNA, 25 bp, Rattus norvegicus
caagtgctagcgagccagatgcgga

SEQ ID NO: 467620 - DNA, 25 bp, Rattus norvegicus
catcctggacgaggcgcaagtgcta

SEQ ID NO: 467621 - DNA, 25 bp, Rattus norvegicus
acttctccatcctggacgaggcgca

SEQ ID NO: 467622 - DNA, 25 bp, Rattus norvegicus
ctgccttgtggcatgctggatcttg

SEQ ID NO: 467623 - DNA, 25 bp, Rattus norvegicus
tctggctgctctgccttgtggcatg

SEQ ID NO: 467624 - DNA, 25 bp, Rattus norvegicus
gacggccgctctggtccgtcgctgt

SEQ ID NO: 467625 - DNA, 25 bp, Rattus norvegicus
aggagaccgtaaggacggccgctct

SEQ ID NO: 467626 - DNA, 25 bp, Rattus norvegicus
taagtttgccagctacctccgccgc

SEQ ID NO: 467627 - DNA, 25 bp, Rattus norvegicus
tctcttctctcacttaggtctttta

SEQ ID NO: 467628 - DNA, 25 bp, Rattus norvegicus
ttgcagcactctcccgctgcgctga

SEQ ID NO: 467629 - DNA, 25 bp, Rattus norvegicus
gcagcgtggtggcaccagacacctc

SEQ ID NO: 467630 - DNA, 25 bp, Rattus norvegicus
atccggaccctctgctgggacggcg

SEQ ID NO: 467631 - DNA, 25 bp, Rattus norvegicus
tatgcacgctgagccctttacctcg

SEQ ID NO: 467632 - DNA, 25 bp, Rattus norvegicus
aggaggaagatatgcacgctgagcc

SEQ ID NO: 467633 - DNA, 25 bp, Rattus norvegicus
ccgcaacccggaggaatccgggctg

SEQ ID NO: 467634 - DNA, 25 bp, Rattus norvegicus
agctcccaggtatgggcaccgggcc

SEQ ID NO: 467635 - DNA, 25 bp, Rattus norvegicus
ctgagcaaccggaggaaaatcctgg

SEQ ID NO: 467636 - DNA, 25 bp, Rattus norvegicus
gctcgggatccggaccctctgctgg

SEQ ID NO: 467637 - DNA, 25 bp, Rattus norvegicus
tacgggttcaagtcccaccacctca

SEQ ID NO: 467638 - DNA, 25 bp, Rattus norvegicus
ctcaccgagtcctagattccgcagg

SEQ ID NO: 467639 - DNA, 25 bp, Rattus norvegicus
tcctagattccgcaggtgtcctgcg

SEQ ID NO: 467640 - DNA, 25 bp, Rattus norvegicus
tgtgcagggcgtgtctctgagctcc

SEQ ID NO: 467641 - DNA, 25 bp, Rattus norvegicus
ggcctctccgctttctctcccgctt

SEQ ID NO: 467642 - DNA, 25 bp, Rattus norvegicus
tccggcctctcggagtctgcagcgg

SEQ ID NO: 467643 - DNA, 25 bp, Rattus norvegicus
acagcagctcccaggtatgggcacc

SEQ ID NO: 467644 - DNA, 25 bp, Rattus norvegicus
gagttggggagccacagacaccagt

SEQ ID NO: 467645 - DNA, 25 bp, Rattus norvegicus
ccacagtggggcagagtcaagaccc

SEQ ID NO: 467646 - DNA, 25 bp, Rattus norvegicus
acaccagtcgcagtttcgatgaatc

SEQ ID NO: 467647 - DNA, 25 bp, Rattus norvegicus
tcgatgaatccggtcccttcgggca

SEQ ID NO: 467648 - DNA, 25 bp, Rattus norvegicus
cttcgggcaggacctacagtcgcct

SEQ ID NO: 467649 - DNA, 25 bp, Rattus norvegicus
atcacgctacgttccggcaagctgc

SEQ ID NO: 467650 - DNA, 25 bp, Rattus norvegicus
ccctcaagagccgaccaggggtgga

SEQ ID NO: 467651 - DNA, 25 bp, Rattus norvegicus
ccgcggggccataaacaggatgtcg

SEQ ID NO: 467652 - DNA, 25 bp, Rattus norvegicus
gtgatactcaccacttccgtgtgcg

SEQ ID NO: 467653 - DNA, 25 bp, Rattus norvegicus
tggctggcaactcggctagccttgc

SEQ ID NO: 467654 - DNA, 25 bp, Rattus norvegicus
gacacccgcggctaaggagaggcac

SEQ ID NO: 467655 - DNA, 25 bp, Rattus norvegicus
attgactacgcctccttgtctggcc

SEQ ID NO: 467656 - DNA, 25 bp, Rattus norvegicus
cccaagcttgaggaccctggagtca

SEQ ID NO: 467657 - DNA, 25 bp, Rattus norvegicus
tgcgcgtcagcagctgccggctact

SEQ ID NO: 467658 - DNA, 25 bp, Rattus norvegicus
aactggtcttccatggggtctgcgc

SEQ ID NO: 467659 - DNA, 25 bp, Rattus norvegicus
gaacctgctctcaactgggcggtga

SEQ ID NO: 467660 - DNA, 25 bp, Rattus norvegicus
cttggactcgtaaccggatgttggc

SEQ ID NO: 467661 - DNA, 25 bp, Rattus norvegicus
cagctgccatagttggttgacaaga

SEQ ID NO: 467662 - DNA, 25 bp, Rattus norvegicus
cttcttcttgggacggatgccctta

SEQ ID NO: 467663 - DNA, 25 bp, Rattus norvegicus
ccagctccttgtgcaccgtgatgcg

SEQ ID NO: 467664 - DNA, 25 bp, Rattus norvegicus
ccttagtgtcatctcgggcacgttt

SEQ ID NO: 467665 - DNA, 25 bp, Rattus norvegicus
cccgaatcctcttggcgaactggtc

SEQ ID NO: 467666 - DNA, 25 bp, Rattus norvegicus
gccacgcgttctttcttagcccgaa

SEQ ID NO: 467667 - DNA, 25 bp, Rattus norvegicus
ttcagctcgttcttggccacgcgtt

SEQ ID NO: 467668 - DNA, 25 bp, Rattus norvegicus
aagccagcaggttgcccaggtcgaa

SEQ ID NO: 467669 - DNA, 25 bp, Rattus norvegicus
tgcagcggaatgctttgctactatg

SEQ ID NO: 467670 - DNA, 25 bp, Rattus norvegicus
gctgagctgggcatctgcatcttgt

SEQ ID NO: 467671 - DNA, 25 bp, Rattus norvegicus
gtcccacacgaggttggtcttcttc

SEQ ID NO: 467672 - DNA, 25 bp, Rattus norvegicus
gcgtgtgtcacctgcaccggacgct

SEQ ID NO: 467673 - DNA, 25 bp, Rattus norvegicus
cttcgaagagaagctattaatagta

SEQ ID NO: 467674 - DNA, 25 bp, Rattus norvegicus
cagcctgaaatggttcccaggtttc

SEQ ID NO: 467675 - DNA, 25 bp, Rattus norvegicus
cgcgtgacttgcacccagcctgaaa

SEQ ID NO: 467676 - DNA, 25 bp, Rattus norvegicus
ctgtcgtgcaatcgccgcgtgactt

SEQ ID NO: 467677 - DNA, 25 bp, Rattus norvegicus
gttcggctgcgctctaaaggaaaga

SEQ ID NO: 467678 - DNA, 25 bp, Rattus norvegicus
ggctagttcacgcagcagcctccag

SEQ ID NO: 467679 - DNA, 25 bp, Rattus norvegicus
tggcgccgctactcggtgcagcgtc

SEQ ID NO: 467680 - DNA, 25 bp, Rattus norvegicus
cttttgattcacctccgggtcgtgg

SEQ ID NO: 467681 - DNA, 25 bp, Rattus norvegicus
ggggaggcggatcttttgattcacc

SEQ ID NO: 467682 - DNA, 25 bp, Rattus norvegicus
cccaggagccctcgggcgtgtgtca

SEQ ID NO: 467683 - DNA, 25 bp, Rattus norvegicus
tatgtacgtcacagggaatacgggc

SEQ ID NO: 467684 - DNA, 25 bp, Rattus norvegicus
cacttgtcgaaaacaggctagttca

SEQ ID NO: 467685 - DNA, 25 bp, Rattus norvegicus
cggcgtccgcacttgtcgaaaacag

SEQ ID NO: 467686 - DNA, 25 bp, Rattus norvegicus
gctccagtgtcctggcttcggggac

SEQ ID NO: 467687 - DNA, 25 bp, Rattus norvegicus
gggcgcttggagcatcttcccgtca

SEQ ID NO: 467688 - DNA, 25 bp, Rattus norvegicus
acgagacacaactccgggcgaagga

SEQ ID NO: 467689 - DNA, 25 bp, Rattus norvegicus
tccgggtctcatgaccgggaacgga

SEQ ID NO: 467690 - DNA, 25 bp, Rattus norvegicus
tctagctttgccatgtgatagattg

SEQ ID NO: 467691 - DNA, 25 bp, Rattus norvegicus
cgtgaccgtcgccatttttctgttt

SEQ ID NO: 467692 - DNA, 25 bp, Rattus norvegicus
aaggctcgccacaacgtgaccgtcg

SEQ ID NO: 467693 - DNA, 25 bp, Rattus norvegicus
tatctaatgacgcagcaaggctcgc

SEQ ID NO: 467694 - DNA, 25 bp, Rattus norvegicus
cttcccgctatttgcatgaggatta

SEQ ID NO: 467695 - DNA, 25 bp, Rattus norvegicus
cttcctttgttcttcccgctatttg

SEQ ID NO: 467696 - DNA, 25 bp, Rattus norvegicus
ggaaaaagcgagtgcgccacagctc

SEQ ID NO: 467697 - DNA, 25 bp, Rattus norvegicus
aacatcccggctctatttccagcgg

SEQ ID NO: 467698 - DNA, 25 bp, Rattus norvegicus
tgccggatccgtcatgtaaacaaca

SEQ ID NO: 467699 - DNA, 25 bp, Rattus norvegicus
ttcccgtcatctgggtctgcggatc

SEQ ID NO: 467700 - DNA, 25 bp, Rattus norvegicus
aagtctggtctctcctttccgccga

SEQ ID NO: 467701 - DNA, 25 bp, Rattus norvegicus
gctcggcaccgccttcgattgcagt

SEQ ID NO: 467702 - DNA, 25 bp, Rattus norvegicus
gaaagggtagtcgaccatcctggtg

SEQ ID NO: 467703 - DNA, 25 bp, Rattus norvegicus
accaacacgggtgaggagccaaggc

SEQ ID NO: 467704 - DNA, 25 bp, Rattus norvegicus
ttgttgcgggagaacctaaagacca

SEQ ID NO: 467705 - DNA, 25 bp, Rattus norvegicus
agcatctctccagcggccacttgtt

SEQ ID NO: 467706 - DNA, 25 bp, Rattus norvegicus
ccagtgcggaggaccctgcacgaca

SEQ ID NO: 467707 - DNA, 25 bp, Rattus norvegicus
aaggatcgcccagaactttggcctc

SEQ ID NO: 467708 - DNA, 25 bp, Rattus norvegicus
caagggcacggtatgcgaaaggatc

SEQ ID NO: 467709 - DNA, 25 bp, Rattus norvegicus
tggcttccaaactcctgcgcgcagt

SEQ ID NO: 467710 - DNA, 25 bp, Rattus norvegicus
agacagtcaccgagaagcggccggc

SEQ ID NO: 467711 - DNA, 25 bp, Rattus norvegicus
ccactctggggatgagacagtcacc

SEQ ID NO: 467712 - DNA, 25 bp, Rattus norvegicus
gggaccctaactggcctctcatgcg

SEQ ID NO: 467713 - DNA, 25 bp, Rattus norvegicus
cctctcatgcggtctccggtaagca

SEQ ID NO: 467714 - DNA, 25 bp, Rattus norvegicus
gccgcgcacggatttctctgcagca

SEQ ID NO: 467715 - DNA, 25 bp, Rattus norvegicus
tgaggagaatgcgatcggctttccg

SEQ ID NO: 467716 - DNA, 25 bp, Rattus norvegicus
gaggcactaagagcccgaggctgct

SEQ ID NO: 467717 - DNA, 25 bp, Rattus norvegicus
accgaggccggaggcactaagagcc

SEQ ID NO: 467718 - DNA, 25 bp, Rattus norvegicus
gcgcacacctgttcgtgcccggggt

SEQ ID NO: 467719 - DNA, 25 bp, Rattus norvegicus
ccctgggagcttcgatctaatgctc

SEQ ID NO: 467720 - DNA, 25 bp, Rattus norvegicus
ataggatcgaggctcttcccgggtt

SEQ ID NO: 467721 - DNA, 25 bp, Rattus norvegicus
atgcgagataggatcgaggctcttc

SEQ ID NO: 467722 - DNA, 25 bp, Rattus norvegicus
atgctctgccatgcgagataggatc

SEQ ID NO: 467723 - DNA, 25 bp, Rattus norvegicus
cgatctaatgctctgccatgcgaga

SEQ ID NO: 467724 - DNA, 25 bp, Rattus norvegicus
tttctctgcagcaaagggcgcgtgt

SEQ ID NO: 467725 - DNA, 25 bp, Rattus norvegicus
cagcgcgctaagatctctgggcaga

SEQ ID NO: 467726 - DNA, 25 bp, Rattus norvegicus
ctgggcagacgacttacccctggga

SEQ ID NO: 467727 - DNA, 25 bp, Rattus norvegicus
aggaagccgtcctttcagcgcgcta

SEQ ID NO: 467728 - DNA, 25 bp, Rattus norvegicus
aggggcggactgctagctgcatcaa

SEQ ID NO: 467729 - DNA, 25 bp, Rattus norvegicus
gtgcaatcggtcgtgcttcctgccg

SEQ ID NO: 467730 - DNA, 25 bp, Rattus norvegicus
cataggctgctctgtaggcgcaggc

SEQ ID NO: 467731 - DNA, 25 bp, Rattus norvegicus
agctgcatcaagctgggactccaga

SEQ ID NO: 467732 - DNA, 25 bp, Rattus norvegicus
gctggtcggagattcccgaggacca

SEQ ID NO: 467733 - DNA, 25 bp, Rattus norvegicus
tgtgcaggaaccagagccgaagtgc

SEQ ID NO: 467734 - DNA, 25 bp, Rattus norvegicus
acggtcggggcacaccgcgacgtct

SEQ ID NO: 467735 - DNA, 25 bp, Rattus norvegicus
gaggacacagagtctccatggagca

SEQ ID NO: 467736 - DNA, 25 bp, Rattus norvegicus
acagagtctccatggagcagccttg

SEQ ID NO: 467737 - DNA, 25 bp, Rattus norvegicus
gtctgtgctcactggcgtcccggac

SEQ ID NO: 467738 - DNA, 25 bp, Rattus norvegicus
tccggttctctcctcggtatcgtca

SEQ ID NO: 467739 - DNA, 25 bp, Rattus norvegicus
ttctctcctcggtatcgtcacgcgg

SEQ ID NO: 467740 - DNA, 25 bp, Rattus norvegicus
gcgacgtctgcatcctcgcgggtcg

SEQ ID NO: 467741 - DNA, 25 bp, Rattus norvegicus
gagcctcggagtcccgcataggctg

SEQ ID NO: 467742 - DNA, 25 bp, Rattus norvegicus
tggttatgaatctttgcagctggtg

SEQ ID NO: 467743 - DNA, 25 bp, Rattus norvegicus
tattgccgggctacacctacacttc

SEQ ID NO: 467744 - DNA, 25 bp, Rattus norvegicus
cttcgcgtcatgtcgggcacttgat

SEQ ID NO: 467745 - DNA, 25 bp, Rattus norvegicus
gtcgggcacttgattattattgtta

SEQ ID NO: 467746 - DNA, 25 bp, Rattus norvegicus
ttttcatccctctcttagtctgtcc

SEQ ID NO: 467747 - DNA, 25 bp, Rattus norvegicus
ggcttgcccatgagcctcctcggga

SEQ ID NO: 467748 - DNA, 25 bp, Rattus norvegicus
ttactctcttctgtttattccctcc

SEQ ID NO: 467749 - DNA, 25 bp, Rattus norvegicus
agaccagcagcgatggttatgaatc

SEQ ID NO: 467750 - DNA, 25 bp, Rattus norvegicus
gagctgcccggctattgccgggcta

SEQ ID NO: 467751 - DNA, 25 bp, Rattus norvegicus
tctttgcagctggtggacagtcacg

SEQ ID NO: 467752 - DNA, 25 bp, Rattus norvegicus
gacagtcacggggactcgagcgcac

SEQ ID NO: 467753 - DNA, 25 bp, Rattus norvegicus
accacggacagctcaggtagcggcc

SEQ ID NO: 467754 - DNA, 25 bp, Rattus norvegicus
gggagctaccggaaaaagaccagca

SEQ ID NO: 467755 - DNA, 25 bp, Rattus norvegicus
tcgggcgctgtccagcctaccggtg

SEQ ID NO: 467756 - DNA, 25 bp, Rattus norvegicus
cggagttctgcacacccgagtggga

SEQ ID NO: 467757 - DNA, 25 bp, Rattus norvegicus
ttgctgagtaaattcggagactacc

SEQ ID NO: 467758 - DNA, 25 bp, Rattus norvegicus
atcgcgcggggttgctgagtaaatt

SEQ ID NO: 467759 - DNA, 25 bp, Rattus norvegicus
cggagactaccggaatgaagttcta

SEQ ID NO: 467760 - DNA, 25 bp, Rattus norvegicus
ctaccggaatgaagttctaagtggc

SEQ ID NO: 467761 - DNA, 25 bp, Rattus norvegicus
ctagtagaatacgagctgagtggtg

SEQ ID NO: 467762 - DNA, 25 bp, Rattus norvegicus
ttctgcacacccgagtgggattggt

SEQ ID NO: 467763 - DNA, 25 bp, Rattus norvegicus
ctgcacacccgagtgggattggtgc

SEQ ID NO: 467764 - DNA, 25 bp, Rattus norvegicus
attggtgcggccaagaccagagttc

SEQ ID NO: 467765 - DNA, 25 bp, Rattus norvegicus
tgcggccaagaccagagttctgcga

SEQ ID NO: 467766 - DNA, 25 bp, Rattus norvegicus
caagaccagagttctgcgagccggg

SEQ ID NO: 467767 - DNA, 25 bp, Rattus norvegicus
ggcaggaattataactagtagaata

SEQ ID NO: 467768 - DNA, 25 bp, Rattus norvegicus
ttctaagtggcaggaattataacta

SEQ ID NO: 467769 - DNA, 25 bp, Rattus norvegicus
cggaatgaagttctaagtggcagga

SEQ ID NO: 467770 - DNA, 25 bp, Rattus norvegicus
tcgccgagcctataaatgctcgcgc

SEQ ID NO: 467771 - DNA, 25 bp, Rattus norvegicus
gtttcgccgagcctataaatgctcg

SEQ ID NO: 467772 - DNA, 25 bp, Rattus norvegicus
gagcctataaatgctcgcgcccacg

SEQ ID NO: 467773 - DNA, 25 bp, Rattus norvegicus
cctataaatgctcgcgcccacgccc

SEQ ID NO: 467774 - DNA, 25 bp, Rattus norvegicus
cacgcccacgccctcccgttcccag

SEQ ID NO: 467775 - DNA, 25 bp, Rattus norvegicus
gcagaggtgtttcgccgagcctata

SEQ ID NO: 467776 - DNA, 25 bp, Rattus norvegicus
cggcagaggtgtttcgccgagccta

SEQ ID NO: 467777 - DNA, 25 bp, Rattus norvegicus
agctcgtgcagaccgcggcctcccg

SEQ ID NO: 467778 - DNA, 25 bp, Rattus norvegicus
aggtgtttcgccgagcctataaatg

SEQ ID NO: 467779 - DNA, 25 bp, Rattus norvegicus
tgcgagctcgtgcagaccgcggcct

SEQ ID NO: 467780 - DNA, 25 bp, Rattus norvegicus
cctgtgtgcgggtgtgcgagctcgt

SEQ ID NO: 467781 - DNA, 25 bp, Rattus norvegicus
gctgagtagcgtgcagcctgtgtgc

SEQ ID NO: 467782 - DNA, 25 bp, Rattus norvegicus
ggcctcccggatgcgcggcagaggt

SEQ ID NO: 467783 - DNA, 25 bp, Rattus norvegicus
gtgtttcgccgagcctataaatgct

SEQ ID NO: 467784 - DNA, 25 bp, Rattus norvegicus
tggctgagtatggagttaatgccgt

SEQ ID NO: 467785 - DNA, 25 bp, Rattus norvegicus
ttaaaggtacactgcgaccctcgcc

SEQ ID NO: 467786 - DNA, 25 bp, Rattus norvegicus
gcgggcgttaaaggtacactgcgac

SEQ ID NO: 467787 - DNA, 25 bp, Rattus norvegicus
acatggcgggcgttaaaggtacact

SEQ ID NO: 467788 - DNA, 25 bp, Rattus norvegicus
ctccagagacatggcgggcgttaaa

SEQ ID NO: 467789 - DNA, 25 bp, Rattus norvegicus
ccagctccagagacatggcgggcgt

SEQ ID NO: 467790 - DNA, 25 bp, Rattus norvegicus
agaaagccggaagcagcgacagccc

SEQ ID NO: 467791 - DNA, 25 bp, Rattus norvegicus
gtgtgggcggcttttggagaaagcc

SEQ ID NO: 467792 - DNA, 25 bp, Rattus norvegicus
gagctttggattcgcgcgccggctc

SEQ ID NO: 467793 - DNA, 25 bp, Rattus norvegicus
gctccgttggctgagtatggagtta

SEQ ID NO: 467794 - DNA, 25 bp, Rattus norvegicus
cggaccgagctttggattcgcgcgc

SEQ ID NO: 467795 - DNA, 25 bp, Rattus norvegicus
gaccctcgcccgcggctaatgggtg

SEQ ID NO: 467796 - DNA, 25 bp, Rattus norvegicus
cgccggctctggctagtctgggtgt

SEQ ID NO: 467797 - DNA, 25 bp, Rattus norvegicus
ccgttggctgagtatggagttaatg

SEQ ID NO: 467798 - DNA, 25 bp, Rattus norvegicus
ctgagccagcggcacagagcccagg

SEQ ID NO: 467799 - DNA, 25 bp, Rattus norvegicus
accttctgagccagcggcacagagc

SEQ ID NO: 467800 - DNA, 25 bp, Rattus norvegicus
cggcacagagcccaggcatccctgc

SEQ ID NO: 467801 - DNA, 25 bp, Rattus norvegicus
ccaggcatccctgccttacgccact

SEQ ID NO: 467802 - DNA, 25 bp, Rattus norvegicus
cttacgccactccaggacacaggtg

SEQ ID NO: 467803 - DNA, 25 bp, Rattus norvegicus
caggacacaggtgggaccctcttcc

SEQ ID NO: 467804 - DNA, 25 bp, Rattus norvegicus
acacaggtgggaccctcttccagtc

SEQ ID NO: 467805 - DNA, 25 bp, Rattus norvegicus
cagtcctcaacccttggcgcggggc

SEQ ID NO: 467806 - DNA, 25 bp, Rattus norvegicus
aacccttggcgcggggccatccaag

SEQ ID NO: 467807 - DNA, 25 bp, Rattus norvegicus
gccatccaaggctgtgcaggacgca

SEQ ID NO: 467808 - DNA, 25 bp, Rattus norvegicus
aggctgtgcaggacgcaggacattc

SEQ ID NO: 467809 - DNA, 25 bp, Rattus norvegicus
caggacgcaggacattcggggaccg

SEQ ID NO: 467810 - DNA, 25 bp, Rattus norvegicus
ccgcgcagtcacctgagtggccagt

SEQ ID NO: 467811 - DNA, 25 bp, Rattus norvegicus
gggtggcccgcaccttctgagccag

SEQ ID NO: 467812 - DNA, 25 bp, Rattus norvegicus
cgcagcttgaggttgaggatgcctc

SEQ ID NO: 467813 - DNA, 25 bp, Rattus norvegicus
gcgagttgaggttccacccgggatc

SEQ ID NO: 467814 - DNA, 25 bp, Rattus norvegicus
gcagacggccgcagggattatgaat

SEQ ID NO: 467815 - DNA, 25 bp, Rattus norvegicus
acgcagggctgcgtgtaatcctcca

SEQ ID NO: 467816 - DNA, 25 bp, Rattus norvegicus
cagtaagggttcttctgcaaaagtc

SEQ ID NO: 467817 - DNA, 25 bp, Rattus norvegicus
gcctcagaggctgcggcattcagtc

SEQ ID NO: 467818 - DNA, 25 bp, Rattus norvegicus
ggggaccagatctcggattcagtgc

SEQ ID NO: 467819 - DNA, 25 bp, Rattus norvegicus
ctcggattcagtgcggttctggagc

SEQ ID NO: 467820 - DNA, 25 bp, Rattus norvegicus
ggagaggtaccggtgcttctcagca

SEQ ID NO: 467821 - DNA, 25 bp, Rattus norvegicus
tgcttctcagcacgggctggtgacc

SEQ ID NO: 467822 - DNA, 25 bp, Rattus norvegicus
tgagaccaggcttcagggctctctc

SEQ ID NO: 467823 - DNA, 25 bp, Rattus norvegicus
ccaccgactgcggtttctggagctg

SEQ ID NO: 467824 - DNA, 25 bp, Rattus norvegicus
atggcagcctaagtgcgttcagatc

SEQ ID NO: 467825 - DNA, 25 bp, Rattus norvegicus
cctgggtagcctcgatatcctgaga

SEQ ID NO: 467826 - DNA, 25 bp, Rattus norvegicus
tcgccggtgcggagcggagagcgta

SEQ ID NO: 467827 - DNA, 25 bp, Rattus norvegicus
ggagcatcgccggtttgattccaga

SEQ ID NO: 467828 - DNA, 25 bp, Rattus norvegicus
gagctggagcatcgccggtttgatt

SEQ ID NO: 467829 - DNA, 25 bp, Rattus norvegicus
aaatgagctggagcatcgccggttt

SEQ ID NO: 467830 - DNA, 25 bp, Rattus norvegicus
cagaaatgagctggagcatcgccgg

SEQ ID NO: 467831 - DNA, 25 bp, Rattus norvegicus
acgcttaggctcctgccatcagccc

SEQ ID NO: 467832 - DNA, 25 bp, Rattus norvegicus
ggccaacgcttaggctcctgccatc

SEQ ID NO: 467833 - DNA, 25 bp, Rattus norvegicus
tgcagcggccaacgcttaggctcct

SEQ ID NO: 467834 - DNA, 25 bp, Rattus norvegicus
gcctgcagcggccaacgcttaggct

SEQ ID NO: 467835 - DNA, 25 bp, Rattus norvegicus
gagagcgtaggaggaggcgacggac

SEQ ID NO: 467836 - DNA, 25 bp, Rattus norvegicus
gcatcggcctagctcggcccgagga

SEQ ID NO: 467837 - DNA, 25 bp, Rattus norvegicus
gagcatcgccggtttgattccagag

SEQ ID NO: 467838 - DNA, 25 bp, Rattus norvegicus
atcggcctagctcggcccgaggacg

SEQ ID NO: 467839 - DNA, 25 bp, Rattus norvegicus
cgacggacgcgcacacgcctgcagc

SEQ ID NO: 467840 - DNA, 25 bp, Rattus norvegicus
ccttttagggatggcttagcagctc

SEQ ID NO: 467841 - DNA, 25 bp, Rattus norvegicus
atccagtcttttgtgcggcgacacg

SEQ ID NO: 467842 - DNA, 25 bp, Rattus norvegicus
cccatagagggacacgcgtgcaatc

SEQ ID NO: 467843 - DNA, 25 bp, Rattus norvegicus
tgagcgagcatccagaagcactgcg

SEQ ID NO: 467844 - DNA, 25 bp, Rattus norvegicus
actcggggtgcataagtctgtgcta

SEQ ID NO: 467845 - DNA, 25 bp, Rattus norvegicus
tacacaagttctttggctggagctg

SEQ ID NO: 467846 - DNA, 25 bp, Rattus norvegicus
ggtgcgctcttcagccttaccacgg

SEQ ID NO: 467847 - DNA, 25 bp, Rattus norvegicus
cgctccattcgtgcctgtaccggtt

SEQ ID NO: 467848 - DNA, 25 bp, Rattus norvegicus
ccgggtccagctctaaggcaagctt

SEQ ID NO: 467849 - DNA, 25 bp, Rattus norvegicus
taaggcaagcttctctgctggagtg

SEQ ID NO: 467850 - DNA, 25 bp, Rattus norvegicus
gcgccattagaagcctgaccactga

SEQ ID NO: 467851 - DNA, 25 bp, Rattus norvegicus
gtctcagtctggtacctaggccttg

SEQ ID NO: 467852 - DNA, 25 bp, Rattus norvegicus
gcagctctgcttacctgatccacta

SEQ ID NO: 467853 - DNA, 25 bp, Rattus norvegicus
tgaccactgagcttctgagacgtcc

SEQ ID NO: 467854 - DNA, 25 bp, Rattus norvegicus
tccgtgcgctctccgggggtattgt

SEQ ID NO: 467855 - DNA, 25 bp, Rattus norvegicus
gcagcgcaggcggtgcagctcgccg

SEQ ID NO: 467856 - DNA, 25 bp, Rattus norvegicus
agctgaagggattggccgaggcagc

SEQ ID NO: 467857 - DNA, 25 bp, Rattus norvegicus
gctaccatgtgacgcggtccagagc

SEQ ID NO: 467858 - DNA, 25 bp, Rattus norvegicus
tggctaccatgtgacgcggtccaga

SEQ ID NO: 467859 - DNA, 25 bp, Rattus norvegicus
caggctggctaccatgtgacgcggt

SEQ ID NO: 467860 - DNA, 25 bp, Rattus norvegicus
ggtattgtgtcaggagatgcaggct

SEQ ID NO: 467861 - DNA, 25 bp, Rattus norvegicus
aaatgggttccgtgcgctctccggg

SEQ ID NO: 467862 - DNA, 25 bp, Rattus norvegicus
gggaaatgggttccgtgcgctctcc

SEQ ID NO: 467863 - DNA, 25 bp, Rattus norvegicus
acgggaaatgggttccgtgcgctct

SEQ ID NO: 467864 - DNA, 25 bp, Rattus norvegicus
gtggcgagcaatggggacgggaaat

SEQ ID NO: 467865 - DNA, 25 bp, Rattus norvegicus
gctgtgtgtttggagagaagcggga

SEQ ID NO: 467866 - DNA, 25 bp, Rattus norvegicus
ggaagtgcgtcaccaggtggggaag

SEQ ID NO: 467867 - DNA, 25 bp, Rattus norvegicus
atgcaggctggctaccatgtgacgc

SEQ ID NO: 467868 - DNA, 25 bp, Rattus norvegicus
gaggcagggtggctttcgacaaacc

SEQ ID NO: 467869 - DNA, 25 bp, Rattus norvegicus
acccatccttcgatcgggaaccagg

SEQ ID NO: 467870 - DNA, 25 bp, Rattus norvegicus
agtgcagcctccacaaaccatctta

SEQ ID NO: 467871 - DNA, 25 bp, Rattus norvegicus
ggcgaccgcagagcctggctcaaga

SEQ ID NO: 467872 - DNA, 25 bp, Rattus norvegicus
ctcaggaatgtttgccgggcgtcat

SEQ ID NO: 467873 - DNA, 25 bp, Rattus norvegicus
gcatggtggcgactcttagattagg

SEQ ID NO: 467874 - DNA, 25 bp, Rattus norvegicus
tctgcttacgggtgcttgtcggaga

SEQ ID NO: 467875 - DNA, 25 bp, Rattus norvegicus
ttacgcggtgaagttggtctgctta

SEQ ID NO: 467876 - DNA, 25 bp, Rattus norvegicus
ccacggatcgagtgcggaacttacg

SEQ ID NO: 467877 - DNA, 25 bp, Rattus norvegicus
ccggaatctagaggaatgggccacg

SEQ ID NO: 467878 - DNA, 25 bp, Rattus norvegicus
accgaagggctgtctccggaatcta

SEQ ID NO: 467879 - DNA, 25 bp, Rattus norvegicus
ctaagccaaaggatccgaagatgtc

SEQ ID NO: 467880 - DNA, 25 bp, Rattus norvegicus
gttttacacagaccgaactaagcca

SEQ ID NO: 467881 - DNA, 25 bp, Rattus norvegicus
agcgccgcccggaagactcttaact

SEQ ID NO: 467882 - DNA, 25 bp, Rattus norvegicus
ttcgtgcttcgtgttgctgtcgcgt

SEQ ID NO: 467883 - DNA, 25 bp, Rattus norvegicus
ctctgtcggacttgagcccagttgg

SEQ ID NO: 467884 - DNA, 25 bp, Rattus norvegicus
tgaaacttagttgggcgcagaggct

SEQ ID NO: 467885 - DNA, 25 bp, Rattus norvegicus
tgggctgggctccttgaaacttagt

SEQ ID NO: 467886 - DNA, 25 bp, Rattus norvegicus
caacatggcggaggtaagaacgagc

SEQ ID NO: 467887 - DNA, 25 bp, Rattus norvegicus
gcgcacatccgggttctggccacga

SEQ ID NO: 467888 - DNA, 25 bp, Rattus norvegicus
tgagtacccgtcgtgagtacccgga

SEQ ID NO: 467889 - DNA, 25 bp, Rattus norvegicus
tcttctcctgcgtcgtgagtacccg

SEQ ID NO: 467890 - DNA, 25 bp, Rattus norvegicus
ccgacaggtagaataggaggtattc

SEQ ID NO: 467891 - DNA, 25 bp, Rattus norvegicus
gtcgcgtccgagcaacctctctttt

SEQ ID NO: 467892 - DNA, 25 bp, Rattus norvegicus
ggaagccgcccttggcgcaacttcg

SEQ ID NO: 467893 - DNA, 25 bp, Rattus norvegicus
gaggtattcttctcctgcgtcgtga

SEQ ID NO: 467894 - DNA, 25 bp, Rattus norvegicus
gagcaacctctcttttctggtaaaa

SEQ ID NO: 467895 - DNA, 25 bp, Rattus norvegicus
gcacttcagaagtgaccgacaggta

SEQ ID NO: 467896 - DNA, 25 bp, Rattus norvegicus
gcccaggtctgtctaccagcctaga

SEQ ID NO: 467897 - DNA, 25 bp, Rattus norvegicus
ccgagagggcggaaataattttctg

SEQ ID NO: 467898 - DNA, 25 bp, Rattus norvegicus
agacttcgcggaagcgcgtcccgcg

SEQ ID NO: 467899 - DNA, 25 bp, Rattus norvegicus
cccgtgagccagacttcgcggaagc

SEQ ID NO: 467900 - DNA, 25 bp, Rattus norvegicus
tccgggaacccgtgagccagacttc

SEQ ID NO: 467901 - DNA, 25 bp, Rattus norvegicus
ttcagcctcccacgcaccgttccgg

SEQ ID NO: 467902 - DNA, 25 bp, Rattus norvegicus
aaagcgaaaccggccacactcttca

SEQ ID NO: 467903 - DNA, 25 bp, Rattus norvegicus
tggcaccgacgaaagcaaacgtagg

SEQ ID NO: 467904 - DNA, 25 bp, Rattus norvegicus
accagcctagaggagaggtcgcacc

SEQ ID NO: 467905 - DNA, 25 bp, Rattus norvegicus
gcgcagtccgttcttccagcccagg

SEQ ID NO: 467906 - DNA, 25 bp, Rattus norvegicus
gcgccgcctgcactagcgcatcgtc

SEQ ID NO: 467907 - DNA, 25 bp, Rattus norvegicus
ctgccctagtccctttgcggcggga

SEQ ID NO: 467908 - DNA, 25 bp, Rattus norvegicus
gggctgctggcaccgacgaaagcaa

SEQ ID NO: 467909 - DNA, 25 bp, Rattus norvegicus
aataattttctgtttcgccctctct

SEQ ID NO: 467910 - DNA, 25 bp, Rattus norvegicus
cctttaaccggagcatgctgacgtc

SEQ ID NO: 467911 - DNA, 25 bp, Rattus norvegicus
aaggcatcccttggtgggctcgaac

SEQ ID NO: 467912 - DNA, 25 bp, Rattus norvegicus
ccacctgtagttggtgagcacgctc

SEQ ID NO: 467913 - DNA, 25 bp, Rattus norvegicus
agcacgctcttgttgaccaccacga

SEQ ID NO: 467914 - DNA, 25 bp, Rattus norvegicus
tgaccaccacgatgagaaaggagct

SEQ ID NO: 467915 - DNA, 25 bp, Rattus norvegicus
gaaaggagctcacgccgtagaaacc

SEQ ID NO: 467916 - DNA, 25 bp, Rattus norvegicus
ccggcagccagtagcttcaggaaca

SEQ ID NO: 467917 - DNA, 25 bp, Rattus norvegicus
cagctcctcctcatctctgtgtgtg

SEQ ID NO: 467918 - DNA, 25 bp, Rattus norvegicus
atgctgacgtctgtggacttccgcc

SEQ ID NO: 467919 - DNA, 25 bp, Rattus norvegicus
ctcggggactttgccctagcatagt

SEQ ID NO: 467920 - DNA, 25 bp, Rattus norvegicus
ctagcatagttcctcgcggggtcag

SEQ ID NO: 467921 - DNA, 25 bp, Rattus norvegicus
ggaaccactgaaccggcctggcacg

SEQ ID NO: 467922 - DNA, 25 bp, Rattus norvegicus
cctggcacgcacagtgttgcgcctg

SEQ ID NO: 467923 - DNA, 25 bp, Rattus norvegicus
gcttcaggaacaccgttagcgtttc

SEQ ID NO: 467924 - DNA, 25 bp, Rattus norvegicus
ggctttctgtaagtttgcctcccgc

SEQ ID NO: 467925 - DNA, 25 bp, Rattus norvegicus
ctcccgctgtcggtgtgggttcctc

SEQ ID NO: 467926 - DNA, 25 bp, Rattus norvegicus
tgggtgggctttctgtaagtttgcc

SEQ ID NO: 467927 - DNA, 25 bp, Rattus norvegicus
cgtgccgagtcagagtgaacggccc

SEQ ID NO: 467928 - DNA, 25 bp, Rattus norvegicus
atggaccgtgccgagtcagagtgaa

SEQ ID NO: 467929 - DNA, 25 bp, Rattus norvegicus
acggctcggcgttcctccagagcgg

SEQ ID NO: 467930 - DNA, 25 bp, Rattus norvegicus
cgctcacggtgacggctcggcgttc

SEQ ID NO: 467931 - DNA, 25 bp, Rattus norvegicus
ggcttggaaaagacgtgcgcctgcg

SEQ ID NO: 467932 - DNA, 25 bp, Rattus norvegicus
aggctcctcggaggtcccaagggca

SEQ ID NO: 467933 - DNA, 25 bp, Rattus norvegicus
ctgactcttccaagggcggggcaaa

SEQ ID NO: 467934 - DNA, 25 bp, Rattus norvegicus
aaactgactgactcttccaagggcg

SEQ ID NO: 467935 - DNA, 25 bp, Rattus norvegicus
agccagccctggaccgctctgggat

SEQ ID NO: 467936 - DNA, 25 bp, Rattus norvegicus
agccagcagctggatccggctccgg

SEQ ID NO: 467937 - DNA, 25 bp, Rattus norvegicus
tgggttcctcctgagcagcgcttcc

SEQ ID NO: 467938 - DNA, 25 bp, Rattus norvegicus
cggccgcagtgtgcgcaaagttttg

SEQ ID NO: 467939 - DNA, 25 bp, Rattus norvegicus
tgagtctagagctctgaacagagtg

SEQ ID NO: 467940 - DNA, 25 bp, Rattus norvegicus
aacagagtgtggtcttcagcggctg

SEQ ID NO: 467941 - DNA, 25 bp, Rattus norvegicus
ggttcaggcatccagccgtcggatg

SEQ ID NO: 467942 - DNA, 25 bp, Rattus norvegicus
tcggatgggcgccttatggaccctg

SEQ ID NO: 467943 - DNA, 25 bp, Rattus norvegicus
cgcaatgcccactgcgggccaggag

SEQ ID NO: 467944 - DNA, 25 bp, Rattus norvegicus
gtctgaagcccaaagcccaaagccg

SEQ ID NO: 467945 - DNA, 25 bp, Rattus norvegicus
cccaaagccgagctgtagtgcctgc

SEQ ID NO: 467946 - DNA, 25 bp, Rattus norvegicus
tttcgccacgctgaaagaccaggca

SEQ ID NO: 467947 - DNA, 25 bp, Rattus norvegicus
caaagttttgggtagcgcgcaaagg

SEQ ID NO: 467948 - DNA, 25 bp, Rattus norvegicus
gtcgccctgttctgcagccagagga

SEQ ID NO: 467949 - DNA, 25 bp, Rattus norvegicus
caaaagcagagtccggtcgccctgt

SEQ ID NO: 467950 - DNA, 25 bp, Rattus norvegicus
ctgggacttggtggcgcatttcgcc

SEQ ID NO: 467951 - DNA, 25 bp, Rattus norvegicus
ctgcagccagaggatgatgagtcta

SEQ ID NO: 467952 - DNA, 25 bp, Rattus norvegicus
tatcatctcccaccacttgcttggg

SEQ ID NO: 467953 - DNA, 25 bp, Rattus norvegicus
tgcctaggaacgtggcccgctcgca

SEQ ID NO: 467954 - DNA, 25 bp, Rattus norvegicus
aggttctcggctccaatcggtctct

SEQ ID NO: 467955 - DNA, 25 bp, Rattus norvegicus
aatcggtctctactcccgggatggg

SEQ ID NO: 467956 - DNA, 25 bp, Rattus norvegicus
cgactccactgagctgtcgctcgga

SEQ ID NO: 467957 - DNA, 25 bp, Rattus norvegicus
tcggaacgcgttctggcggcgaaca

SEQ ID NO: 467958 - DNA, 25 bp, Rattus norvegicus
gcgagtgccgcagttttctatcatc

SEQ ID NO: 467959 - DNA, 25 bp, Rattus norvegicus
cttgcttgggaagctaccctgcgtc

SEQ ID NO: 467960 - DNA, 25 bp, Rattus norvegicus
gaacactcgcgatcctctccttagg

SEQ ID NO: 467961 - DNA, 25 bp, Rattus norvegicus
cttaggcttgcctaccggagaccct

SEQ ID NO: 467962 - DNA, 25 bp, Rattus norvegicus
gagtctgtcttctcccactctagga

SEQ ID NO: 467963 - DNA, 25 bp, Rattus norvegicus
aggacttgccgagttctccctaagc

SEQ ID NO: 467964 - DNA, 25 bp, Rattus norvegicus
tgccttgctagtggtactcgcgggt

SEQ ID NO: 467965 - DNA, 25 bp, Rattus norvegicus
agcccgggtactgaggatggcattc

SEQ ID NO: 467966 - DNA, 25 bp, Rattus norvegicus
tgcttctcagccatgttcggcgcgc

SEQ ID NO: 467967 - DNA, 25 bp, Rattus norvegicus
ggccctttggactgggccagtcgcc

SEQ ID NO: 467968 - DNA, 25 bp, Rattus norvegicus
ggccagtcgcccaattctgcagaca

SEQ ID NO: 467969 - DNA, 25 bp, Rattus norvegicus
gtcgcccaattctgcagacaagtga

SEQ ID NO: 467970 - DNA, 25 bp, Rattus norvegicus
ctgcagacaagtgagctgacgggta

SEQ ID NO: 467971 - DNA, 25 bp, Rattus norvegicus
tgagctgacgggtagagaaaagaca

SEQ ID NO: 467972 - DNA, 25 bp, Rattus norvegicus
aaagacagggtgctcgcagacaccc

SEQ ID NO: 467973 - DNA, 25 bp, Rattus norvegicus
cgccaaggcacagctcagaccgtgg

SEQ ID NO: 467974 - DNA, 25 bp, Rattus norvegicus
aggcacagctcagaccgtgggtccc

SEQ ID NO: 467975 - DNA, 25 bp, Rattus norvegicus
tgcactcactcttcactttgccgaa

SEQ ID NO: 467976 - DNA, 25 bp, Rattus norvegicus
cccagcacgtagtgtccgatcttca

SEQ ID NO: 467977 - DNA, 25 bp, Rattus norvegicus
gcccgaagcgtcctgaggaaagccc

SEQ ID NO: 467978 - DNA, 25 bp, Rattus norvegicus
gcagagcccgaagcgtcctgaggaa

SEQ ID NO: 467979 - DNA, 25 bp, Rattus norvegicus
acgtagtgtccgatcttcacacgcc

SEQ ID NO: 467980 - DNA, 25 bp, Rattus norvegicus
ggcgctcaacaacaacccgaggaaa

SEQ ID NO: 467981 - DNA, 25 bp, Rattus norvegicus
cggtagctggaaccacctccttagg

SEQ ID NO: 467982 - DNA, 25 bp, Rattus norvegicus
ttctgcctcttcatgggtgagcgca

SEQ ID NO: 467983 - DNA, 25 bp, Rattus norvegicus
atcccggcctgcgatttcaagttgg

SEQ ID NO: 467984 - DNA, 25 bp, Rattus norvegicus
gtgacggactcccagctgaagatca

SEQ ID NO: 467985 - DNA, 25 bp, Rattus norvegicus
ccagtcgcactagctggccttgtca

SEQ ID NO: 467986 - DNA, 25 bp, Rattus norvegicus
cctgagagtaagaacggcggtagcc

SEQ ID NO: 467987 - DNA, 25 bp, Rattus norvegicus
tccgcgctgctccattcattaagta

SEQ ID NO: 467988 - DNA, 25 bp, Rattus norvegicus
gcgtccgggacagcacagttttgca

SEQ ID NO: 467989 - DNA, 25 bp, Rattus norvegicus
ttcctgctcgggatttggctctctt

SEQ ID NO: 467990 - DNA, 25 bp, Rattus norvegicus
tccctttggactagcgaacagtttg

SEQ ID NO: 467991 - DNA, 25 bp, Rattus norvegicus
ccagcgccatgcaaagctacaagta

SEQ ID NO: 467992 - DNA, 25 bp, Rattus norvegicus
gacaaggcgatcgtccctgagagta

SEQ ID NO: 467993 - DNA, 25 bp, Rattus norvegicus
gatctggaggaaacctgtggctctc

SEQ ID NO: 467994 - DNA, 25 bp, Rattus norvegicus
agaagcgtctggataaccaaaacct

SEQ ID NO: 467995 - DNA, 25 bp, Rattus norvegicus
acaccatccacgtgagaagcgtctg

SEQ ID NO: 467996 - DNA, 25 bp, Rattus norvegicus
gtctggataaccaaaacctcgcacc

SEQ ID NO: 467997 - DNA, 25 bp, Rattus norvegicus
gcgtctggataaccaaaacctcgca

SEQ ID NO: 467998 - DNA, 25 bp, Rattus norvegicus
accatccacgcgagaagcgtctgga

SEQ ID NO: 467999 - DNA, 25 bp, Rattus norvegicus
cacgcgagaagcgtctggataacca

SEQ ID NO: 468000 - DNA, 25 bp, Rattus norvegicus
tggataaccaaaacctcgcaccatc

SEQ ID NO: 468001 - DNA, 25 bp, Rattus norvegicus
cgcgagaagcgtctggataaccaaa

SEQ ID NO: 468002 - DNA, 25 bp, Rattus norvegicus
agcgtctggataaccaaaacctcgc

SEQ ID NO: 468003 - DNA, 25 bp, Rattus norvegicus
caccatccacgcgagaagcgtctgg

SEQ ID NO: 468004 - DNA, 25 bp, Rattus norvegicus
gaagcgtctggataaccaaaacctc

SEQ ID NO: 468005 - DNA, 25 bp, Rattus norvegicus
catccacgcgagaagcgtctggata

SEQ ID NO: 468006 - DNA, 25 bp, Rattus norvegicus
aagcgtctggataaccaaaacctcg

SEQ ID NO: 468007 - DNA, 25 bp, Rattus norvegicus
tggataaccaaaacctcacaccatc

SEQ ID NO: 468008 - DNA, 25 bp, Rattus norvegicus
cttgcccaggagactggcggcttct

SEQ ID NO: 468009 - DNA, 25 bp, Rattus norvegicus
ccgactggatctacggagccaccta

SEQ ID NO: 468010 - DNA, 25 bp, Rattus norvegicus
ctccgcttcgagtcagtgatgtgcc

SEQ ID NO: 468011 - DNA, 25 bp, Rattus norvegicus
aagttcgtcaccagctccgcttcga

SEQ ID NO: 468012 - DNA, 25 bp, Rattus norvegicus
ccgggtctggtgaccaagttcgtca

SEQ ID NO: 468013 - DNA, 25 bp, Rattus norvegicus
actctgccgctgttctgtttgtgtg

SEQ ID NO: 468014 - DNA, 25 bp, Rattus norvegicus
cttctgcagattccgcgagagctga

SEQ ID NO: 468015 - DNA, 25 bp, Rattus norvegicus
ttaaccaaacaacgcgaggcttgcc

SEQ ID NO: 468016 - DNA, 25 bp, Rattus norvegicus
cgccagtcaacaggacctgggaaca

SEQ ID NO: 468017 - DNA, 25 bp, Rattus norvegicus
cgccctcagaagaaagacgccagtc

SEQ ID NO: 468018 - DNA, 25 bp, Rattus norvegicus
cgaagacgcagaagacgctcacaca

SEQ ID NO: 468019 - DNA, 25 bp, Rattus norvegicus
gggcaccgcacttaccgaagacgca

SEQ ID NO: 468020 - DNA, 25 bp, Rattus norvegicus
actctccatgcctggcgactgggga

SEQ ID NO: 468021 - DNA, 25 bp, Rattus norvegicus
gcgagagctgaagttcctcccactc

SEQ ID NO: 468022 - DNA, 25 bp, Rattus norvegicus
tgctgtgcatgggtttctcggaccc

SEQ ID NO: 468023 - DNA, 25 bp, Rattus norvegicus
cgtcaagccaccaaggccggggcgt

SEQ ID NO: 468024 - DNA, 25 bp, Rattus norvegicus
ggacctcagcaacgccgtcagcaag

SEQ ID NO: 468025 - DNA, 25 bp, Rattus norvegicus
gggactctcgtgctcgctctgcacg

SEQ ID NO: 468026 - DNA, 25 bp, Rattus norvegicus
ccggactcggagaaaaacacacaca

SEQ ID NO: 468027 - DNA, 25 bp, Rattus norvegicus
gaggaggagcagcacatgaccacgc

SEQ ID NO: 468028 - DNA, 25 bp, Rattus norvegicus
atgggacacgagtggcgtcaagcca

SEQ ID NO: 468029 - DNA, 25 bp, Rattus norvegicus
ctggagtcccgtggacagcgaacgt

SEQ ID NO: 468030 - DNA, 25 bp, Rattus norvegicus
cctgcgcttggccaagaacgacatc

SEQ ID NO: 468031 - DNA, 25 bp, Rattus norvegicus
gaacgacatcaacgaggcccgtggc

SEQ ID NO: 468032 - DNA, 25 bp, Rattus norvegicus
gtggcgctgctcaccaacgagcggc

SEQ ID NO: 468033 - DNA, 25 bp, Rattus norvegicus
cggctacgagcccatggatagcggc

SEQ ID NO: 468034 - DNA, 25 bp, Rattus norvegicus
gttgccctgacctcgccagagaggc

SEQ ID NO: 468035 - DNA, 25 bp, Rattus norvegicus
gctccgaggcccgagccatggaatc

SEQ ID NO: 468036 - DNA, 25 bp, Rattus norvegicus
ttcgttctcatccaccaacgctggg

SEQ ID NO: 468037 - DNA, 25 bp, Rattus norvegicus
agccaatgaacgcagcggctccctg

SEQ ID NO: 468038 - DNA, 25 bp, Rattus norvegicus
ttggcgacccaagccaatcgcgagg

SEQ ID NO: 468039 - DNA, 25 bp, Rattus norvegicus
gaaggggttggagttcgttctcatc

SEQ ID NO: 468040 - DNA, 25 bp, Rattus norvegicus
gctcaccattggtcgccgcctgggt

SEQ ID NO: 468041 - DNA, 25 bp, Rattus norvegicus
accaacgctgggtgtttgtgtgcct

SEQ ID NO: 468042 - DNA, 25 bp, Rattus norvegicus
gtttgtgtgcctcttcctgctaccg

SEQ ID NO: 468043 - DNA, 25 bp, Rattus norvegicus
catcttcgacatctactactacgtg

SEQ ID NO: 468044 - DNA, 25 bp, Rattus norvegicus
atctactactacgtgcgcgcctggg

SEQ ID NO: 468045 - DNA, 25 bp, Rattus norvegicus
ttcaagctgagcagtgcgccgcgct

SEQ ID NO: 468046 - DNA, 25 bp, Rattus norvegicus
cgcgcttgcacgagcagcgcgtgca

SEQ ID NO: 468047 - DNA, 25 bp, Rattus norvegicus
gcagcgcgtgcaggacatccagaaa

SEQ ID NO: 468048 - DNA, 25 bp, Rattus norvegicus
tgcaggacatccagaaacaggtgag

SEQ ID NO: 468049 - DNA, 25 bp, Rattus norvegicus
gcggcgggtccgacttacaggctcc

SEQ ID NO: 468050 - DNA, 25 bp, Rattus norvegicus
gcgacgcgtaaagaggccatgcgca

SEQ ID NO: 468051 - DNA, 25 bp, Rattus norvegicus
acgcggcgacgcgtaaagaggccat

SEQ ID NO: 468052 - DNA, 25 bp, Rattus norvegicus
gacgcgtaaagaggccatgcgcagc

SEQ ID NO: 468053 - DNA, 25 bp, Rattus norvegicus
gcgtaaagaggccatgcgcagcgtg

SEQ ID NO: 468054 - DNA, 25 bp, Rattus norvegicus
ccatgcgcagcgtggggacgagcct

SEQ ID NO: 468055 - DNA, 25 bp, Rattus norvegicus
ggacgagcctgcacgctgtggtcat

SEQ ID NO: 468056 - DNA, 25 bp, Rattus norvegicus
cgagcctgcacgctgtggtcatgcg

SEQ ID NO: 468057 - DNA, 25 bp, Rattus norvegicus
agcctgcacgctgtggtcatgcgcg

SEQ ID NO: 468058 - DNA, 25 bp, Rattus norvegicus
cacgctgtggtcatgcgcggtgtct

SEQ ID NO: 468059 - DNA, 25 bp, Rattus norvegicus
gtgtctgggtgagcgtcccctcttt

SEQ ID NO: 468060 - DNA, 25 bp, Rattus norvegicus
ggtgagcgtcccctctttggtgacc

SEQ ID NO: 468061 - DNA, 25 bp, Rattus norvegicus
ggtcagactccacccctcggccggc

SEQ ID NO: 468062 - DNA, 25 bp, Rattus norvegicus
agaaggcggcgaaccggacgcggcg

SEQ ID NO: 468063 - DNA, 25 bp, Rattus norvegicus
cctgcacgctgtggtcatgcgcggt

SEQ ID NO: 468064 - DNA, 25 bp, Rattus norvegicus
aacctcaacgcctgggccaatctgg

SEQ ID NO: 468065 - DNA, 25 bp, Rattus norvegicus
agctgcctgctgtgcgtcacctctt

SEQ ID NO: 468066 - DNA, 25 bp, Rattus norvegicus
acctgaagctccagcgagagggtct

SEQ ID NO: 468067 - DNA, 25 bp, Rattus norvegicus
tgcgtcacctcttgggagccttttc

SEQ ID NO: 468068 - DNA, 25 bp, Rattus norvegicus
gtgatgcccgcgagcatttcctgga

SEQ ID NO: 468069 - DNA, 25 bp, Rattus norvegicus
gcatttcctggaagtggcccgcaaa

SEQ ID NO: 468070 - DNA, 25 bp, Rattus norvegicus
agtggcccgcaaagaccctggcaac

SEQ ID NO: 468071 - DNA, 25 bp, Rattus norvegicus
ccaatctggcacacgtctacgggca

SEQ ID NO: 468072 - DNA, 25 bp, Rattus norvegicus
cgactggccagccttatgggcctgg

SEQ ID NO: 468073 - DNA, 25 bp, Rattus norvegicus
agcagggatatgcacatggcttcga

SEQ ID NO: 468074 - DNA, 25 bp, Rattus norvegicus
cttcgacgtgggctgtgccagtcca

SEQ ID NO: 468075 - DNA, 25 bp, Rattus norvegicus
ccagtccagaggagcgtgctcaggt

SEQ ID NO: 468076 - DNA, 25 bp, Rattus norvegicus
ctctacgacaaagcgctgggctacg

SEQ ID NO: 468077 - DNA, 25 bp, Rattus norvegicus
ggcgggcatcgcactctacgacaaa

SEQ ID NO: 468078 - DNA, 25 bp, Rattus norvegicus
cgctgcgacctgcttcaagcgtgca

SEQ ID NO: 468079 - DNA, 25 bp, Rattus norvegicus
gctacccgagctgcaactgttgcgt

SEQ ID NO: 468080 - DNA, 25 bp, Rattus norvegicus
ttgcgtggcaaatgcttacgagtcc

SEQ ID NO: 468081 - DNA, 25 bp, Rattus norvegicus
tgaagacgccaacgctgcgacctgc

SEQ ID NO: 468082 - DNA, 25 bp, Rattus norvegicus
cagtagaactggatgacgagggatc

SEQ ID NO: 468083 - DNA, 25 bp, Rattus norvegicus
acgagggatccagccatactgaggg

SEQ ID NO: 468084 - DNA, 25 bp, Rattus norvegicus
atactgagggcttcggctgcctgct

SEQ ID NO: 468085 - DNA, 25 bp, Rattus norvegicus
ctcgaggcactgcttgcccagtgga

SEQ ID NO: 468086 - DNA, 25 bp, Rattus norvegicus
ccaggcgcagcttagcgatgacgag

SEQ ID NO: 468087 - DNA, 25 bp, Rattus norvegicus
cgaggtggacatctggctgcgacat

SEQ ID NO: 468088 - DNA, 25 bp, Rattus norvegicus
ctgcgacatgcccagagcaaatatc

SEQ ID NO: 468089 - DNA, 25 bp, Rattus norvegicus
gcaaatatccggcagcacgcctgcg

SEQ ID NO: 468090 - DNA, 25 bp, Rattus norvegicus
ctgcgccaagagctgcagcgtgtgt

SEQ ID NO: 468091 - DNA, 25 bp, Rattus norvegicus
cttacgagtccagggtgaagacgcc

SEQ ID NO: 468092 - DNA, 25 bp, Rattus norvegicus
gcgcattggcttcgcgtgactgaag

SEQ ID NO: 468093 - DNA, 25 bp, Rattus norvegicus
ccgtggtctaacaggccaatctttg

SEQ ID NO: 468094 - DNA, 25 bp, Rattus norvegicus
tccggaaccgtggtctaacaggcca

SEQ ID NO: 468095 - DNA, 25 bp, Rattus norvegicus
gagcacttccggaaccgtggtctaa

SEQ ID NO: 468096 - DNA, 25 bp, Rattus norvegicus
caatctttgatcttggcgggagagc

SEQ ID NO: 468097 - DNA, 25 bp, Rattus norvegicus
ggagagcgtggctctttggtttact

SEQ ID NO: 468098 - DNA, 25 bp, Rattus norvegicus
cctccctccagagggtgggtccaga

SEQ ID NO: 468099 - DNA, 25 bp, Rattus norvegicus
ccagagggtgggtccagagcatccc

SEQ ID NO: 468100 - DNA, 25 bp, Rattus norvegicus
ccttccgtgagtgtggctttccgat

SEQ ID NO: 468101 - DNA, 25 bp, Rattus norvegicus
ggctttccgattggtgagaaataca

SEQ ID NO: 468102 - DNA, 25 bp, Rattus norvegicus
ttccgattggtgagaaatacagggg

SEQ ID NO: 468103 - DNA, 25 bp, Rattus norvegicus
ttggcttcgcgtgactgaagaggcc

SEQ ID NO: 468104 - DNA, 25 bp, Rattus norvegicus
tctaacaggccaatctttgatcttg

SEQ ID NO: 468105 - DNA, 25 bp, Rattus norvegicus
cgggccaaaccggcgcaggcgcatt

SEQ ID NO: 468106 - DNA, 25 bp, Rattus norvegicus
taaggctggctctggaacttgtcca

SEQ ID NO: 468107 - DNA, 25 bp, Rattus norvegicus
aagccgccgcggtaaggctggctct

SEQ ID NO: 468108 - DNA, 25 bp, Rattus norvegicus
ccgtgttgcgcgtggctatgcctct

SEQ ID NO: 468109 - DNA, 25 bp, Rattus norvegicus
cttccttttgctgtccgtgttgcgc

SEQ ID NO: 468110 - DNA, 25 bp, Rattus norvegicus
agcaggggtgcccttccttttgctg

SEQ ID NO: 468111 - DNA, 25 bp, Rattus norvegicus
gggccaagaaacctgccgctccttc

SEQ ID NO: 468112 - DNA, 25 bp, Rattus norvegicus
gcaacttcggcacttcaatctgggg

SEQ ID NO: 468113 - DNA, 25 bp, Rattus norvegicus
tctccatggcagctcgcaacttcgg

SEQ ID NO: 468114 - DNA, 25 bp, Rattus norvegicus
gatcagaactctccatggcagctcg

SEQ ID NO: 468115 - DNA, 25 bp, Rattus norvegicus
tgtagggtcaggatcagaactctcc

SEQ ID NO: 468116 - DNA, 25 bp, Rattus norvegicus
aactgtcatctgtagggtcaggatc

SEQ ID NO: 468117 - DNA, 25 bp, Rattus norvegicus
cgcgtccatggaactgtcatctgta

SEQ ID NO: 468118 - DNA, 25 bp, Rattus norvegicus
ctatgcctctggagttccgccgtgt

SEQ ID NO: 468119 - DNA, 25 bp, Rattus norvegicus
gaacttgtccaggaacgcgtccatg

SEQ ID NO: 468120 - DNA, 25 bp, Rattus norvegicus
cgcgccagagtcttacccaagtgct

SEQ ID NO: 468121 - DNA, 25 bp, Rattus norvegicus
ccagggacacgtgtgctcttccaga

SEQ ID NO: 468122 - DNA, 25 bp, Rattus norvegicus
gggacacgtgtgctcttccagaagg

SEQ ID NO: 468123 - DNA, 25 bp, Rattus norvegicus
gacacgtgtgctcttccagaagggg

SEQ ID NO: 468124 - DNA, 25 bp, Rattus norvegicus
cacgtgtgctcttccagaaggggag

SEQ ID NO: 468125 - DNA, 25 bp, Rattus norvegicus
cgcgcgccagagtcttacccaagtg

SEQ ID NO: 468126 - DNA, 25 bp, Rattus norvegicus
cgccagagtcttacccaagtgctgg

SEQ ID NO: 468127 - DNA, 25 bp, Rattus norvegicus
tgctgggataatcctgaccccacgg

SEQ ID NO: 468128 - DNA, 25 bp, Rattus norvegicus
aagcttggcggaagcgcctgccgta

SEQ ID NO: 468129 - DNA, 25 bp, Rattus norvegicus
agcgcctgccgtagactagactaga

SEQ ID NO: 468130 - DNA, 25 bp, Rattus norvegicus
cctgccgtagactagactagaaggc

SEQ ID NO: 468131 - DNA, 25 bp, Rattus norvegicus
ccgtagactagactagaaggcggga

SEQ ID NO: 468132 - DNA, 25 bp, Rattus norvegicus
agagccgccagggacacgtgtgctc

SEQ ID NO: 468133 - DNA, 25 bp, Rattus norvegicus
ccaagtgctgggataatcctgaccc

SEQ ID NO: 468134 - DNA, 25 bp, Rattus norvegicus
gatcgcccgcccaggctttgcaagt

SEQ ID NO: 468135 - DNA, 25 bp, Rattus norvegicus
gggtaggcgcctgtcgcagctccct

SEQ ID NO: 468136 - DNA, 25 bp, Rattus norvegicus
ccgccgctcagctaggcggtgccgc

SEQ ID NO: 468137 - DNA, 25 bp, Rattus norvegicus
cttaataaatcaaacgctcccgcag

SEQ ID NO: 468138 - DNA, 25 bp, Rattus norvegicus
tgctagaacattagcttaataaatc

SEQ ID NO: 468139 - DNA, 25 bp, Rattus norvegicus
cgggatggagaaaatgtgctagaac

SEQ ID NO: 468140 - DNA, 25 bp, Rattus norvegicus
tcattacgggatggagaaaatgtgc

SEQ ID NO: 468141 - DNA, 25 bp, Rattus norvegicus
tggaaacagctcattacgggatgga

SEQ ID NO: 468142 - DNA, 25 bp, Rattus norvegicus
ccctggtggaaacagctcattacgg

SEQ ID NO: 468143 - DNA, 25 bp, Rattus norvegicus
ggaagccgcagtcgctctgcagaca

SEQ ID NO: 468144 - DNA, 25 bp, Rattus norvegicus
gccagctcagcctccctcccggagc

SEQ ID NO: 468145 - DNA, 25 bp, Rattus norvegicus
caagtcacccttccgaggagcacag

SEQ ID NO: 468146 - DNA, 25 bp, Rattus norvegicus
ccctcctgccttggcggagctaggc

SEQ ID NO: 468147 - DNA, 25 bp, Rattus norvegicus
ttgcaagtcacccttccgaggagca

SEQ ID NO: 468148 - DNA, 25 bp, Rattus norvegicus
gggctgacgctttgacagctggaaa

SEQ ID NO: 468149 - DNA, 25 bp, Rattus norvegicus
ggcagccacgttcggttgagctcca

SEQ ID NO: 468150 - DNA, 25 bp, Rattus norvegicus
gccacgttcggttgagctccaagta

SEQ ID NO: 468151 - DNA, 25 bp, Rattus norvegicus
tcggttgagctccaagtagaccagc

SEQ ID NO: 468152 - DNA, 25 bp, Rattus norvegicus
agctccaagtagaccagcggcggcg

SEQ ID NO: 468153 - DNA, 25 bp, Rattus norvegicus
ccgcgagcaagcgagctgcaggctt

SEQ ID NO: 468154 - DNA, 25 bp, Rattus norvegicus
gacagctggaaagagcgcggagcca

SEQ ID NO: 468155 - DNA, 25 bp, Rattus norvegicus
ctgcaagccatgtttgccaaaggca

SEQ ID NO: 468156 - DNA, 25 bp, Rattus norvegicus
ttgccaaaggcaaaggctcggcggt

SEQ ID NO: 468157 - DNA, 25 bp, Rattus norvegicus
aaggcaaaggctcggcggtgccctc

SEQ ID NO: 468158 - DNA, 25 bp, Rattus norvegicus
caggctcgggaaaagtaagcctctc

SEQ ID NO: 468159 - DNA, 25 bp, Rattus norvegicus
aagtaagcctctcgcgagtggggcc

SEQ ID NO: 468160 - DNA, 25 bp, Rattus norvegicus
ctctctccgcgcctgctgtcgcagc

SEQ ID NO: 468161 - DNA, 25 bp, Rattus norvegicus
ctcttctctgcaagccatgtttgcc

SEQ ID NO: 468162 - DNA, 25 bp, Rattus norvegicus
gcacctctacctggacgccgccatc

SEQ ID NO: 468163 - DNA, 25 bp, Rattus norvegicus
gactcgggtcttcactgcacctcta

SEQ ID NO: 468164 - DNA, 25 bp, Rattus norvegicus
ggtcttcactgcacctctacctgga

SEQ ID NO: 468165 - DNA, 25 bp, Rattus norvegicus
tcttgccctcgtaggtaatgggttc

SEQ ID NO: 468166 - DNA, 25 bp, Rattus norvegicus
ctcgtaggtaatgggttccaggcca

SEQ ID NO: 468167 - DNA, 25 bp, Rattus norvegicus
ggccagggatctcgtacaccctgtc

SEQ ID NO: 468168 - DNA, 25 bp, Rattus norvegicus
ctccggtttccgagtggagcgcaca

SEQ ID NO: 468169 - DNA, 25 bp, Rattus norvegicus
cggtttccgagtggagcgcacaccc

SEQ ID NO: 468170 - DNA, 25 bp, Rattus norvegicus
cagagccagcgagtgcccgcatagc

SEQ ID NO: 468171 - DNA, 25 bp, Rattus norvegicus
atagcgggcccggacgccaaggcca

SEQ ID NO: 468172 - DNA, 25 bp, Rattus norvegicus
ggacgccaaggccataccgactcgg

SEQ ID NO: 468173 - DNA, 25 bp, Rattus norvegicus
aaggccataccgactcgggtcttca

SEQ ID NO: 468174 - DNA, 25 bp, Rattus norvegicus
gcggagcgcagtggctcattttgcg

SEQ ID NO: 468175 - DNA, 25 bp, Rattus norvegicus
catctttgcccgggcagggcctgct

SEQ ID NO: 468176 - DNA, 25 bp, Rattus norvegicus
agcttagccagccacatggcctcgg

SEQ ID NO: 468177 - DNA, 25 bp, Rattus norvegicus
caaagccaaagccagcagcaacagt

SEQ ID NO: 468178 - DNA, 25 bp, Rattus norvegicus
tgcaactagggtggcagtgggactt

SEQ ID NO: 468179 - DNA, 25 bp, Rattus norvegicus
ggtggggacaaagccaaagccagca

SEQ ID NO: 468180 - DNA, 25 bp, Rattus norvegicus
gagcacccgggtgctgagcttagcc

SEQ ID NO: 468181 - DNA, 25 bp, Rattus norvegicus
cccgggtgctgagcttagccagcca

SEQ ID NO: 468182 - DNA, 25 bp, Rattus norvegicus
tggggacaaagccaaagccagcagc

SEQ ID NO: 468183 - DNA, 25 bp, Rattus norvegicus
caacagtaggagcacccgggtgctg

SEQ ID NO: 468184 - DNA, 25 bp, Rattus norvegicus
gccaaagccagcagcaacagtagga

SEQ ID NO: 468185 - DNA, 25 bp, Rattus norvegicus
agccagcagcaacagtaggagcacc

SEQ ID NO: 468186 - DNA, 25 bp, Rattus norvegicus
gcagcaacagtaggagcacccgggt

SEQ ID NO: 468187 - DNA, 25 bp, Rattus norvegicus
ttagccagccacatggcctcggcgt

SEQ ID NO: 468188 - DNA, 25 bp, Rattus norvegicus
agccacatggcctcggcgtccggag

SEQ ID NO: 468189 - DNA, 25 bp, Rattus norvegicus
tggctaggtctaagcgctccggggc

SEQ ID NO: 468190 - DNA, 25 bp, Rattus norvegicus
tgtgaagaccagagcgcgcaccgtc

SEQ ID NO: 468191 - DNA, 25 bp, Rattus norvegicus
acgctccgtctgcaggaatggcacc

SEQ ID NO: 468192 - DNA, 25 bp, Rattus norvegicus
gggaatatctagcacagccaacatc

SEQ ID NO: 468193 - DNA, 25 bp, Rattus norvegicus
caaaagagtctttgaatggtgagcg

SEQ ID NO: 468194 - DNA, 25 bp, Rattus norvegicus
gggtcactttttgtgggtctgtaca

SEQ ID NO: 468195 - DNA, 25 bp, Rattus norvegicus
gtctgtacaaacgtgccgaccggca

SEQ ID NO: 468196 - DNA, 25 bp, Rattus norvegicus
ggcagctaatgaagccgctcccaca

SEQ ID NO: 468197 - DNA, 25 bp, Rattus norvegicus
agctcggtgctttaatgtgaagacc

SEQ ID NO: 468198 - DNA, 25 bp, Rattus norvegicus
tggcaccgtgggaatatctagcaca

SEQ ID NO: 468199 - DNA, 25 bp, Rattus norvegicus
cgtcctccggtagggcctgttaatg

SEQ ID NO: 468200 - DNA, 25 bp, Rattus norvegicus
ggcctgttaatgagccgcgagcaga

SEQ ID NO: 468201 - DNA, 25 bp, Rattus norvegicus
aatgagccgcgagcagagatgaaac

SEQ ID NO: 468202 - DNA, 25 bp, Rattus norvegicus
tcccggatctcagctcggtgcttta

SEQ ID NO: 468203 - DNA, 25 bp, Rattus norvegicus
tccgcatcacccaaactcaaaagag

SEQ ID NO: 468204 - DNA, 25 bp, Rattus norvegicus
agtcggcgtccgcttacctggcttc

SEQ ID NO: 468205 - DNA, 25 bp, Rattus norvegicus
gctgatcggccagagccacagtctg

SEQ ID NO: 468206 - DNA, 25 bp, Rattus norvegicus
agtcgagagaggacgcgcgcctttt

SEQ ID NO: 468207 - DNA, 25 bp, Rattus norvegicus
gagccacagtctgctccagcttgtg

SEQ ID NO: 468208 - DNA, 25 bp, Rattus norvegicus
tccagcttgtggagacactcgggtc

SEQ ID NO: 468209 - DNA, 25 bp, Rattus norvegicus
tcgatacctcgcaagcagggtctta

SEQ ID NO: 468210 - DNA, 25 bp, Rattus norvegicus
agggagactccaaatcgttaagagg

SEQ ID NO: 468211 - DNA, 25 bp, Rattus norvegicus
ttcggccatcttggaagggaggaaa

SEQ ID NO: 468212 - DNA, 25 bp, Rattus norvegicus
gctcccactggggtttgcagggaaa

SEQ ID NO: 468213 - DNA, 25 bp, Rattus norvegicus
cgccgagccagagacacaataacta

SEQ ID NO: 468214 - DNA, 25 bp, Rattus norvegicus
cttacgaggtagcaaggaggcaagc

SEQ ID NO: 468215 - DNA, 25 bp, Rattus norvegicus
cgagacacgaactcgggcgccgagc

SEQ ID NO: 468216 - DNA, 25 bp, Rattus norvegicus
ataactagccgaattcgagaggccc

SEQ ID NO: 468217 - DNA, 25 bp, Rattus norvegicus
gccagccctagacgcttacgaggta

SEQ ID NO: 468218 - DNA, 25 bp, Rattus norvegicus
gtcaccgagcctgtcagctgaccta

SEQ ID NO: 468219 - DNA, 25 bp, Rattus norvegicus
gcccggatttattgcgcgcctctct

SEQ ID NO: 468220 - DNA, 25 bp, Rattus norvegicus
cgcccacgagaggttttccgtctca

SEQ ID NO: 468221 - DNA, 25 bp, Rattus norvegicus
aagcgtttgactcggtcctgggaga

SEQ ID NO: 468222 - DNA, 25 bp, Rattus norvegicus
tcgctggtgactcgcaggaactaca

SEQ ID NO: 468223 - DNA, 25 bp, Rattus norvegicus
gtagggcccatcgataccaagttcc

SEQ ID NO: 468224 - DNA, 25 bp, Rattus norvegicus
tcgcgtcttcccatgtcggtgtcag

SEQ ID NO: 468225 - DNA, 25 bp, Rattus norvegicus
agcgccgagaccctagtggtgaatc

SEQ ID NO: 468226 - DNA, 25 bp, Rattus norvegicus
cccttggtgtagctgcagttttcct

SEQ ID NO: 468227 - DNA, 25 bp, Rattus norvegicus
tcctgctgtaattgccggaagtttg

SEQ ID NO: 468228 - DNA, 25 bp, Rattus norvegicus
gtttgtgctgcaggtctcgatgata

SEQ ID NO: 468229 - DNA, 25 bp, Rattus norvegicus
tgcgggaccacaagggagtatatca

SEQ ID NO: 468230 - DNA, 25 bp, Rattus norvegicus
acaaaatattgccttccagcccgga

SEQ ID NO: 468231 - DNA, 25 bp, Rattus norvegicus
ctggcccggaagaaggagaaacact

SEQ ID NO: 468232 - DNA, 25 bp, Rattus norvegicus
cggctgaccaggaagcggctcagca

SEQ ID NO: 468233 - DNA, 25 bp, Rattus norvegicus
gcagcgagcggctgcacctcacagg

SEQ ID NO: 468234 - DNA, 25 bp, Rattus norvegicus
ctaatctgtagtgggcggggcatat

SEQ ID NO: 468235 - DNA, 25 bp, Rattus norvegicus
ccaagcgagcgggtctgtgcagcac

SEQ ID NO: 468236 - DNA, 25 bp, Rattus norvegicus
actgggtcctttcgcagagctactc

SEQ ID NO: 468237 - DNA, 25 bp, Rattus norvegicus
gatcgcgagcggactgggtcctttc

SEQ ID NO: 468238 - DNA, 25 bp, Rattus norvegicus
catctaggcgggtccagtgccagga

SEQ ID NO: 468239 - DNA, 25 bp, Rattus norvegicus
tagtcctgaggaaagacgcgcaggc

SEQ ID NO: 468240 - DNA, 25 bp, Rattus norvegicus
ccgatctgagaaagcccggcagtcg

SEQ ID NO: 468241 - DNA, 25 bp, Rattus norvegicus
gtgggacagccgatctgagaaagcc

SEQ ID NO: 468242 - DNA, 25 bp, Rattus norvegicus
gcagagctactcgaggcccaagcga

SEQ ID NO: 468243 - DNA, 25 bp, Rattus norvegicus
cattaggggcgtggtctaatctgta

SEQ ID NO: 468244 - DNA, 25 bp, Rattus norvegicus
acaaagcccgtgagggtgggacaca

SEQ ID NO: 468245 - DNA, 25 bp, Rattus norvegicus
gcggctcagcacctaggccacaaag

SEQ ID NO: 468246 - DNA, 25 bp, Rattus norvegicus
ctgggtgaccgcttttgctttaaga

SEQ ID NO: 468247 - DNA, 25 bp, Rattus norvegicus
tgaccgcttttgctttaagagaggg

SEQ ID NO: 468248 - DNA, 25 bp, Rattus norvegicus
ggaggtggagaaatccaacgccctc

SEQ ID NO: 468249 - DNA, 25 bp, Rattus norvegicus
cctaaggagtcctcgctgggtgacc

SEQ ID NO: 468250 - DNA, 25 bp, Rattus norvegicus
gaactcctgagaattcgccctactt

SEQ ID NO: 468251 - DNA, 25 bp, Rattus norvegicus
accgttgcctaaggagtcctcgctg

SEQ ID NO: 468252 - DNA, 25 bp, Rattus norvegicus
tgacaccgttgcctaaggagtcctc

SEQ ID NO: 468253 - DNA, 25 bp, Rattus norvegicus
gctgctagggtgacaccgttgccta

SEQ ID NO: 468254 - DNA, 25 bp, Rattus norvegicus
atcctccgctgctagggtgacaccg

SEQ ID NO: 468255 - DNA, 25 bp, Rattus norvegicus
gcagctcagagatcctccgctgcta

SEQ ID NO: 468256 - DNA, 25 bp, Rattus norvegicus
gcgggacgcagctcagagatcctcc

SEQ ID NO: 468257 - DNA, 25 bp, Rattus norvegicus
tgtctctttaagaccaccgagaagg

SEQ ID NO: 468258 - DNA, 25 bp, Rattus norvegicus
gagaattcgccctacttcgcatgtc

SEQ ID NO: 468259 - DNA, 25 bp, Rattus norvegicus
cgccctacttcgcatgtctctttaa

SEQ ID NO: 468260 - DNA, 25 bp, Rattus norvegicus
ttcctgcctttgaacagtggtggcg

SEQ ID NO: 468261 - DNA, 25 bp, Rattus norvegicus
gacctgaccgtctcgggattggata

SEQ ID NO: 468262 - DNA, 25 bp, Rattus norvegicus
taggaacagcgcgtagggacctgac

SEQ ID NO: 468263 - DNA, 25 bp, Rattus norvegicus
atctccatggccacggctgcgagcg

SEQ ID NO: 468264 - DNA, 25 bp, Rattus norvegicus
atcctttggcgcgtgagttagttcg

SEQ ID NO: 468265 - DNA, 25 bp, Rattus norvegicus
tgagttagttcgctgtggcgctccc

SEQ ID NO: 468266 - DNA, 25 bp, Rattus norvegicus
ccctggcggttttgcaggactctgt

SEQ ID NO: 468267 - DNA, 25 bp, Rattus norvegicus
ccggttgagtctgttcaggcgaagc

SEQ ID NO: 468268 - DNA, 25 bp, Rattus norvegicus
cccacctggaggcatgtggctacgg

SEQ ID NO: 468269 - DNA, 25 bp, Rattus norvegicus
gttcttcgagtcacagcccacctgg

SEQ ID NO: 468270 - DNA, 25 bp, Rattus norvegicus
aggactctgtccaggcagcgttccg

SEQ ID NO: 468271 - DNA, 25 bp, Rattus norvegicus
cgatggaccctgcttcggaaggatt

SEQ ID NO: 468272 - DNA, 25 bp, Rattus norvegicus
atgcagcaccgtcgccctttgtttt

SEQ ID NO: 468273 - DNA, 25 bp, Rattus norvegicus
tttggactccagaggacggttcttc

SEQ ID NO: 468274 - DNA, 25 bp, Rattus norvegicus
atccgggcagcaaagctcaggcctg

SEQ ID NO: 468275 - DNA, 25 bp, Rattus norvegicus
agccctaggaggcagctggggaccc

SEQ ID NO: 468276 - DNA, 25 bp, Rattus norvegicus
gcaaatgctggagctcgaggcagtg

SEQ ID NO: 468277 - DNA, 25 bp, Rattus norvegicus
cgccctaggcagtgggcaaatgctg

SEQ ID NO: 468278 - DNA, 25 bp, Rattus norvegicus
ccagagccgccctaggcagtgggca

SEQ ID NO: 468279 - DNA, 25 bp, Rattus norvegicus
acttgggaccagttggaaggcgctc

SEQ ID NO: 468280 - DNA, 25 bp, Rattus norvegicus
acggccacttgggaccagttggaag

SEQ ID NO: 468281 - DNA, 25 bp, Rattus norvegicus
gcagcaaagctcaggcctgggtgcc

SEQ ID NO: 468282 - DNA, 25 bp, Rattus norvegicus
gctgatccgggcagcaaagctcagg

SEQ ID NO: 468283 - DNA, 25 bp, Rattus norvegicus
acgggccgcactggcaggtgctgat

SEQ ID NO: 468284 - DNA, 25 bp, Rattus norvegicus
ggcttaccgtagtcggcgaacggca

SEQ ID NO: 468285 - DNA, 25 bp, Rattus norvegicus
tcggctgcacgaggctgggcttacc

SEQ ID NO: 468286 - DNA, 25 bp, Rattus norvegicus
ggagccccccgatccaggctggaag

SEQ ID NO: 468287 - DNA, 25 bp, Rattus norvegicus
gctgggcttaccgtagtcggcgaac

SEQ ID NO: 468288 - DNA, 25 bp, Rattus norvegicus
cctgtcctctcccagaattaaggtg

SEQ ID NO: 468289 - DNA, 25 bp, Rattus norvegicus
gaccagtttcggtgtcggaacgagc

SEQ ID NO: 468290 - DNA, 25 bp, Rattus norvegicus
cccgtgaactttgcaggggatagtc

SEQ ID NO: 468291 - DNA, 25 bp, Rattus norvegicus
tggtttaatttgagacgcgcgctcc

SEQ ID NO: 468292 - DNA, 25 bp, Rattus norvegicus
agcgaagcggttcagcctttcctga

SEQ ID NO: 468293 - DNA, 25 bp, Rattus norvegicus
gcctttcctgacaatgcgtttccga

SEQ ID NO: 468294 - DNA, 25 bp, Rattus norvegicus
gagctccggagctcaccggtatctc

SEQ ID NO: 468295 - DNA, 25 bp, Rattus norvegicus
aggaacccgtggcatcctgtcctct

SEQ ID NO: 468296 - DNA, 25 bp, Rattus norvegicus
ggtgtcgggtctcactgtaccatca

SEQ ID NO: 468297 - DNA, 25 bp, Rattus norvegicus
gtctccgtggacctgactttccttg

SEQ ID NO: 468298 - DNA, 25 bp, Rattus norvegicus
tgacaggttgcgaagagactgagcc

SEQ ID NO: 468299 - DNA, 25 bp, Rattus norvegicus
cagctccctggattcgccttggatc

SEQ ID NO: 468300 - DNA, 25 bp, Rattus norvegicus
ccgctcacggttctggttaccgaag

SEQ ID NO: 468301 - DNA, 25 bp, Rattus norvegicus
ttcctatacccgctggacttctcgg

SEQ ID NO: 468302 - DNA, 25 bp, Rattus norvegicus
tctgcgacggccagttcgactgcga

SEQ ID NO: 468303 - DNA, 25 bp, Rattus norvegicus
gttcgactgcgaggaccgctcggat

SEQ ID NO: 468304 - DNA, 25 bp, Rattus norvegicus
gctctctgtcctgcgcagtgtgcgc

SEQ ID NO: 468305 - DNA, 25 bp, Rattus norvegicus
cgcacgagttccagtgcagcaaccg

SEQ ID NO: 468306 - DNA, 25 bp, Rattus norvegicus
agttccagtgcagcaaccgctcctg

SEQ ID NO: 468307 - DNA, 25 bp, Rattus norvegicus
accgctcggatgaggccgctgagct

SEQ ID NO: 468308 - DNA, 25 bp, Rattus norvegicus
catccctgagcgctgggtctgcgac

SEQ ID NO: 468309 - DNA, 25 bp, Rattus norvegicus
cacccagttcacctgccgcagcggc

SEQ ID NO: 468310 - DNA, 25 bp, Rattus norvegicus
cgcagcggcgagtgcatacacctgg

SEQ ID NO: 468311 - DNA, 25 bp, Rattus norvegicus
catacacctgggctggcgctgcgat

SEQ ID NO: 468312 - DNA, 25 bp, Rattus norvegicus
gctgcgatggcgaccgcgactgcaa

SEQ ID NO: 468313 - DNA, 25 bp, Rattus norvegicus
accgcgactgcaaggacaagtctga

SEQ ID NO: 468314 - DNA, 25 bp, Rattus norvegicus
tgcaaggacaagtctgacgaggccg

SEQ ID NO: 468315 - DNA, 25 bp, Rattus norvegicus
aggaggcggcacctgcatccctgag

SEQ ID NO: 468316 - DNA, 25 bp, Rattus norvegicus
tggcaaattcgttcccgcctccgga

SEQ ID NO: 468317 - DNA, 25 bp, Rattus norvegicus
ttcccgcctccggagagtgaaataa

SEQ ID NO: 468318 - DNA, 25 bp, Rattus norvegicus
ataaaattcctagtgtcgcggtggc

SEQ ID NO: 468319 - DNA, 25 bp, Rattus norvegicus
tggcggacgtcatttccgcgcgcca

SEQ ID NO: 468320 - DNA, 25 bp, Rattus norvegicus
accattacgccggtgtgggactcag

SEQ ID NO: 468321 - DNA, 25 bp, Rattus norvegicus
gggcgtggtctttatcttgcttcaa

SEQ ID NO: 468322 - DNA, 25 bp, Rattus norvegicus
tcagaccgcagacagtgctagtgtc

SEQ ID NO: 468323 - DNA, 25 bp, Rattus norvegicus
agtgtcatctgttcctaaagttcgg

SEQ ID NO: 468324 - DNA, 25 bp, Rattus norvegicus
aaagttcggtcttgcttgtcccttg

SEQ ID NO: 468325 - DNA, 25 bp, Rattus norvegicus
tgtcccttgcgaagcatggagagtg

SEQ ID NO: 468326 - DNA, 25 bp, Rattus norvegicus
tggagagtgacttttacctacgtta

SEQ ID NO: 468327 - DNA, 25 bp, Rattus norvegicus
gcaagtttggtcatgagttcctgga

SEQ ID NO: 468328 - DNA, 25 bp, Rattus norvegicus
ctacgtgggtcacaaaggcaagttt

SEQ ID NO: 468329 - DNA, 25 bp, Rattus norvegicus
cctggagtttgaattccgacctgac

SEQ ID NO: 468330 - DNA, 25 bp, Rattus norvegicus
gcgcggcggcaccagcttttacgac

SEQ ID NO: 468331 - DNA, 25 bp, Rattus norvegicus
cgcagtagtataacgtggacgagca

SEQ ID NO: 468332 - DNA, 25 bp, Rattus norvegicus
tataacgtggacgagcagctatggg

SEQ ID NO: 468333 - DNA, 25 bp, Rattus norvegicus
tcagagtcgcgagctcacaccagga

SEQ ID NO: 468334 - DNA, 25 bp, Rattus norvegicus
ggcacgcagcgaggtcatgcattca

SEQ ID NO: 468335 - DNA, 25 bp, Rattus norvegicus
tcttctcagaaaatcgcacttcagc

SEQ ID NO: 468336 - DNA, 25 bp, Rattus norvegicus
gcacttcagctcaaagccacactgg

SEQ ID NO: 468337 - DNA, 25 bp, Rattus norvegicus
gccacactggagaacgtcacgaacc

SEQ ID NO: 468338 - DNA, 25 bp, Rattus norvegicus
gaacgtcacgaaccttcggccagtg

SEQ ID NO: 468339 - DNA, 25 bp, Rattus norvegicus
ccttcggccagtgggcgaagacttc

SEQ ID NO: 468340 - DNA, 25 bp, Rattus norvegicus
cgaagacttccggtggtacctcaag

SEQ ID NO: 468341 - DNA, 25 bp, Rattus norvegicus
tggtacctcaaggtacgacggaaga

SEQ ID NO: 468342 - DNA, 25 bp, Rattus norvegicus
ccggaaagcagctgtcgcagtagta

SEQ ID NO: 468343 - DNA, 25 bp, Rattus norvegicus
gcaccagcttttacgacgggccgga

SEQ ID NO: 468344 - DNA, 25 bp, Rattus norvegicus
ttccgccgcagagcacgccgggaaa

SEQ ID NO: 468345 - DNA, 25 bp, Rattus norvegicus
accagtacagctctggggccctcgt

SEQ ID NO: 468346 - DNA, 25 bp, Rattus norvegicus
aggctgaagagtgagcaccagtaca

SEQ ID NO: 468347 - DNA, 25 bp, Rattus norvegicus
cggcctcaaggtgagcgtgaccttc

SEQ ID NO: 468348 - DNA, 25 bp, Rattus norvegicus
ccctggaaggtatttcggtgcttgc

SEQ ID NO: 468349 - DNA, 25 bp, Rattus norvegicus
tagtgacatgtctgtccttccctga

SEQ ID NO: 468350 - DNA, 25 bp, Rattus norvegicus
cgtctgcgcagatccggaagtcact

SEQ ID NO: 468351 - DNA, 25 bp, Rattus norvegicus
aggtcagccgactgtcacctgggcc

SEQ ID NO: 468352 - DNA, 25 bp, Rattus norvegicus
gttattgtcgactcggcctttccgc

SEQ ID NO: 468353 - DNA, 25 bp, Rattus norvegicus
acagggaaggcacttacccggcagc

SEQ ID NO: 468354 - DNA, 25 bp, Rattus norvegicus
gaagcccgccgccagatgggaacag

SEQ ID NO: 468355 - DNA, 25 bp, Rattus norvegicus
cgatcccgtcaggtgctgagaagcc

SEQ ID NO: 468356 - DNA, 25 bp, Rattus norvegicus
gcaattcaggcctccggtgagcacc

SEQ ID NO: 468357 - DNA, 25 bp, Rattus norvegicus
cgagcgaagtctctggctagtgaca

SEQ ID NO: 468358 - DNA, 25 bp, Rattus norvegicus
atcaggacgctgagaatcggctcgc

SEQ ID NO: 468359 - DNA, 25 bp, Rattus norvegicus
cttcttggtcttggttttgctggcg

SEQ ID NO: 468360 - DNA, 25 bp, Rattus norvegicus
gctggtgcagttggacgacatgccc

SEQ ID NO: 468361 - DNA, 25 bp, Rattus norvegicus
gctgcctcacggagccatggtcgcg

SEQ ID NO: 468362 - DNA, 25 bp, Rattus norvegicus
agcctgacaggaacccagctgggtt

SEQ ID NO: 468363 - DNA, 25 bp, Rattus norvegicus
aggaagacagggaatggacagcctc

SEQ ID NO: 468364 - DNA, 25 bp, Rattus norvegicus
acaagaagggctccctgctcggacg

SEQ ID NO: 468365 - DNA, 25 bp, Rattus norvegicus
ggaccgggatttggctttgcctcca

SEQ ID NO: 468366 - DNA, 25 bp, Rattus norvegicus
ggctttgcctccacctgaagtacta

SEQ ID NO: 468367 - DNA, 25 bp, Rattus norvegicus
tgaagtactaaaatggcggcagcgc

SEQ ID NO: 468368 - DNA, 25 bp, Rattus norvegicus
tgagaagaggctgggatataccatc

SEQ ID NO: 468369 - DNA, 25 bp, Rattus norvegicus
tcctgcctaggaaaccagggaccgc

SEQ ID NO: 468370 - DNA, 25 bp, Rattus norvegicus
ctttctggcacacgaaatgcttctt

SEQ ID NO: 468371 - DNA, 25 bp, Rattus norvegicus
cccggaatagcttcactttctggca

SEQ ID NO: 468372 - DNA, 25 bp, Rattus norvegicus
ggacaccgcgcagggacttaacgtc

SEQ ID NO: 468373 - DNA, 25 bp, Rattus norvegicus
cgagacagcacttaagggcctacta

SEQ ID NO: 468374 - DNA, 25 bp, Rattus norvegicus
gcacttaagggcctactaggggctc

SEQ ID NO: 468375 - DNA, 25 bp, Rattus norvegicus
cctactaggggctcccaggacaagc

SEQ ID NO: 468376 - DNA, 25 bp, Rattus norvegicus
cagcggggccaggcacgaaacagca

SEQ ID NO: 468377 - DNA, 25 bp, Rattus norvegicus
agcaggcgcggcatcatcgtcccgg

SEQ ID NO: 468378 - DNA, 25 bp, Rattus norvegicus
gcggcatcatcgtcccgggcagcaa

SEQ ID NO: 468379 - DNA, 25 bp, Rattus norvegicus
agttcctgagcaagcaggccgctgc

SEQ ID NO: 468380 - DNA, 25 bp, Rattus norvegicus
gcgcagggacttaacgtccagttca

SEQ ID NO: 468381 - DNA, 25 bp, Rattus norvegicus
gacttaacgtccagttcaactccgc

SEQ ID NO: 468382 - DNA, 25 bp, Rattus norvegicus
aactccgcccacagggcacttccgg

SEQ ID NO: 468383 - DNA, 25 bp, Rattus norvegicus
cgcccgcactcatcctctcgcagaa

SEQ ID NO: 468384 - DNA, 25 bp, Rattus norvegicus
cgcggccacgcccatgaacgggcca

SEQ ID NO: 468385 - DNA, 25 bp, Rattus norvegicus
cagcaacggcggctagagaacgcgg

SEQ ID NO: 468386 - DNA, 25 bp, Rattus norvegicus
cctggtttttcagaacttggacatt

SEQ ID NO: 468387 - DNA, 25 bp, Rattus norvegicus
aagcttcttaccaactctatgtatt

SEQ ID NO: 468388 - DNA, 25 bp, Rattus norvegicus
cttgtggccactgtcagcacacagc

SEQ ID NO: 468389 - DNA, 25 bp, Rattus norvegicus
cctgcagaaacttgtggccactgtc

SEQ ID NO: 468390 - DNA, 25 bp, Rattus norvegicus
cattgaggccaaaaggccctggttt

SEQ ID NO: 468391 - DNA, 25 bp, Rattus norvegicus
gcccgcacgcctcagcatggcctgc

SEQ ID NO: 468392 - DNA, 25 bp, Rattus norvegicus
ttcagaacttggacattgacaggtg

SEQ ID NO: 468393 - DNA, 25 bp, Rattus norvegicus
ggacattgacaggtgtgtggatatc

SEQ ID NO: 468394 - DNA, 25 bp, Rattus norvegicus
acaggtgtgtggatatcatgggaca

SEQ ID NO: 468395 - DNA, 25 bp, Rattus norvegicus
atcatgggacagagagcaggtagac

SEQ ID NO: 468396 - DNA, 25 bp, Rattus norvegicus
aggcctggcactcccgctagtagcg

SEQ ID NO: 468397 - DNA, 25 bp, Rattus norvegicus
cactcccgctagtagcgggcgcaga

SEQ ID NO: 468398 - DNA, 25 bp, Rattus norvegicus
aggtcctgcagaaacttgtggccac

SEQ ID NO: 468399 - DNA, 25 bp, Rattus norvegicus
ctgggcttcattgaggccaaaaggc

SEQ ID NO: 468400 - DNA, 25 bp, Rattus norvegicus
ttgcctgtgaggtagagttcccgaa

SEQ ID NO: 468401 - DNA, 25 bp, Rattus norvegicus
aacgcagcaggcgtagcttgcggaa

SEQ ID NO: 468402 - DNA, 25 bp, Rattus norvegicus
ccagacaagtcaagtgaacgcagca

SEQ ID NO: 468403 - DNA, 25 bp, Rattus norvegicus
caggcggttgccagacaagtcaagt

SEQ ID NO: 468404 - DNA, 25 bp, Rattus norvegicus
acatttttaggcaggcccggaggca

SEQ ID NO: 468405 - DNA, 25 bp, Rattus norvegicus
gaccttgagcacgtgtacattttta

SEQ ID NO: 468406 - DNA, 25 bp, Rattus norvegicus
gccagctcattacgcttgaccttga

SEQ ID NO: 468407 - DNA, 25 bp, Rattus norvegicus
acgcgccagagcagccagctcatta

SEQ ID NO: 468408 - DNA, 25 bp, Rattus norvegicus
agttcccgaagcttggccatgccag

SEQ ID NO: 468409 - DNA, 25 bp, Rattus norvegicus
cccggcttcgcagtcggttgcctgt

SEQ ID NO: 468410 - DNA, 25 bp, Rattus norvegicus
caggcgtagcttgcggaaggcatct

SEQ ID NO: 468411 - DNA, 25 bp, Rattus norvegicus
cacgtgtacatttttaggcaggccc

SEQ ID NO: 468412 - DNA, 25 bp, Rattus norvegicus
aagcttggccatgccagctagtgcc

SEQ ID NO: 468413 - DNA, 25 bp, Rattus norvegicus
acgcttgaccttgagcacgtgtaca

SEQ ID NO: 468414 - DNA, 25 bp, Rattus norvegicus
cctgctcctgatcccgcaggggtcc

SEQ ID NO: 468415 - DNA, 25 bp, Rattus norvegicus
ctctcccgacacaggcgcagggtcc

SEQ ID NO: 468416 - DNA, 25 bp, Rattus norvegicus
caagttttgttgtgggttcgctctc

SEQ ID NO: 468417 - DNA, 25 bp, Rattus norvegicus
gcgcgagcgagccaagttttgttgt

SEQ ID NO: 468418 - DNA, 25 bp, Rattus norvegicus
cattcaagtcgagccgtgggcgcga

SEQ ID NO: 468419 - DNA, 25 bp, Rattus norvegicus
ctgtcattcaagtcgagccgtgggc

SEQ ID NO: 468420 - DNA, 25 bp, Rattus norvegicus
cgccggctcctgtcattcaagtcga

SEQ ID NO: 468421 - DNA, 25 bp, Rattus norvegicus
agaacaggctccctggtgtccgctg

SEQ ID NO: 468422 - DNA, 25 bp, Rattus norvegicus
ccgtgggcagaacaggctccctggt

SEQ ID NO: 468423 - DNA, 25 bp, Rattus norvegicus
gccatgagaacacggcgggaagtta

SEQ ID NO: 468424 - DNA, 25 bp, Rattus norvegicus
ccctatgacggtgtacctaaccgtg

SEQ ID NO: 468425 - DNA, 25 bp, Rattus norvegicus
gctgggactgaatgtcgagtagaaa

SEQ ID NO: 468426 - DNA, 25 bp, Rattus norvegicus
gaatgtcgagtagaaaaagcgtccc

SEQ ID NO: 468427 - DNA, 25 bp, Rattus norvegicus
acagggcgggatatgggccaccctc

SEQ ID NO: 468428 - DNA, 25 bp, Rattus norvegicus
acgcgtcgaccaggacacccgaaat

SEQ ID NO: 468429 - DNA, 25 bp, Rattus norvegicus
cacaccagtgacctcggggtctgca

SEQ ID NO: 468430 - DNA, 25 bp, Rattus norvegicus
ctccgcccgtaggtggagccctttg

SEQ ID NO: 468431 - DNA, 25 bp, Rattus norvegicus
gagccctttgaagaggcctcgcccg

SEQ ID NO: 468432 - DNA, 25 bp, Rattus norvegicus
tgccgacatctcacggaggagctga

SEQ ID NO: 468433 - DNA, 25 bp, Rattus norvegicus
ccggaacttcgattttcagcgaagg

SEQ ID NO: 468434 - DNA, 25 bp, Rattus norvegicus
cgcattcggaggaaatctgccgaca

SEQ ID NO: 468435 - DNA, 25 bp, Rattus norvegicus
ggagctgagctttcacacaccagtg

SEQ ID NO: 468436 - DNA, 25 bp, Rattus norvegicus
gagctctccgatgctacgtgccctg

SEQ ID NO: 468437 - DNA, 25 bp, Rattus norvegicus
cccgaaatccaagtgcaggcgctga

SEQ ID NO: 468438 - DNA, 25 bp, Rattus norvegicus
aggcgctgacaggtcccaaccaagg

SEQ ID NO: 468439 - DNA, 25 bp, Rattus norvegicus
tcccaaccaaggtaaagttgtgtgc

SEQ ID NO: 468440 - DNA, 25 bp, Rattus norvegicus
agttgtgtgcggagatccaacacgc

SEQ ID NO: 468441 - DNA, 25 bp, Rattus norvegicus
tcagcgaaggaggtcgcggttctct

SEQ ID NO: 468442 - DNA, 25 bp, Rattus norvegicus
caatgaacaggaacacgcgagggcg

SEQ ID NO: 468443 - DNA, 25 bp, Rattus norvegicus
ctcgcagcgggtgctcagcatggct

SEQ ID NO: 468444 - DNA, 25 bp, Rattus norvegicus
ctcagcatggctggggcttgaactc

SEQ ID NO: 468445 - DNA, 25 bp, Rattus norvegicus
ctcagcagcgcaatgaacaggaaca

SEQ ID NO: 468446 - DNA, 25 bp, Rattus norvegicus
gaactcagagaaccgtcacgcccaa

SEQ ID NO: 468447 - DNA, 25 bp, Rattus norvegicus
tgcaccaagcagtggccctgcgcgt

SEQ ID NO: 468448 - DNA, 25 bp, Rattus norvegicus
tccgcggccacagcaacgggtgcaa

SEQ ID NO: 468449 - DNA, 25 bp, Rattus norvegicus
cagcaacgggtgcaagaagtggacc

SEQ ID NO: 468450 - DNA, 25 bp, Rattus norvegicus
gtgcaagaagtggaccatgacgccc

SEQ ID NO: 468451 - DNA, 25 bp, Rattus norvegicus
aggtcgcccggcgtttgaatcgccg

SEQ ID NO: 468452 - DNA, 25 bp, Rattus norvegicus
aggccgaccgccctcggactcgcgg

SEQ ID NO: 468453 - DNA, 25 bp, Rattus norvegicus
ggctcagccacccaactcctgttca

SEQ ID NO: 468454 - DNA, 25 bp, Rattus norvegicus
ggccgcacgtccaatggtcctcgct

SEQ ID NO: 468455 - DNA, 25 bp, Rattus norvegicus
tggggcttgaactcgggcgccttcc

SEQ ID NO: 468456 - DNA, 25 bp, Rattus norvegicus
gcttggttgacttccaggatgagga

SEQ ID NO: 468457 - DNA, 25 bp, Rattus norvegicus
tgtgacggaaaatggaacctccgcg

SEQ ID NO: 468458 - DNA, 25 bp, Rattus norvegicus
gctagcactttaggtgtgacggaaa

SEQ ID NO: 468459 - DNA, 25 bp, Rattus norvegicus
cacgcaagctagacgctgtgtagtc

SEQ ID NO: 468460 - DNA, 25 bp, Rattus norvegicus
ggtcagggaacactaccggcatgtg

SEQ ID NO: 468461 - DNA, 25 bp, Rattus norvegicus
cgctgaacgcgcagcctgggacata

SEQ ID NO: 468462 - DNA, 25 bp, Rattus norvegicus
cagtgctaccgcgaaaaggacccgg

SEQ ID NO: 468463 - DNA, 25 bp, Rattus norvegicus
ccaacgcaaaggttgatgggaagct

SEQ ID NO: 468464 - DNA, 25 bp, Rattus norvegicus
ggtgaagtccttcctggagaacatg

SEQ ID NO: 468465 - DNA, 25 bp, Rattus norvegicus
acgcgatttgtaggagtcggagtca

SEQ ID NO: 468466 - DNA, 25 bp, Rattus norvegicus
tgacgtcacgcacgccgccggaatg

SEQ ID NO: 468467 - DNA, 25 bp, Rattus norvegicus
cccatactgcagagcgctgacgtca

SEQ ID NO: 468468 - DNA, 25 bp, Rattus norvegicus
atgggaagctgttgtcgtctcctcc

SEQ ID NO: 468469 - DNA, 25 bp, Rattus norvegicus
gtggagtgccactaccagtgctacc

SEQ ID NO: 468470 - DNA, 25 bp, Rattus norvegicus
agcagaagacagcagccgcttcgcc

SEQ ID NO: 468471 - DNA, 25 bp, Rattus norvegicus
cgcggaagccacagcagaagacagc

SEQ ID NO: 468472 - DNA, 25 bp, Rattus norvegicus
gcgggcagctgaagccacgcactac

SEQ ID NO: 468473 - DNA, 25 bp, Rattus norvegicus
cgcgctcacgtagctcgagcaggcg

SEQ ID NO: 468474 - DNA, 25 bp, Rattus norvegicus
aggcgccgctcattgtgcctcctta

SEQ ID NO: 468475 - DNA, 25 bp, Rattus norvegicus
cgctgcagagaaaggcacggcgaaa

SEQ ID NO: 468476 - DNA, 25 bp, Rattus norvegicus
ggtcatcgcagcagtacttgtggtc

SEQ ID NO: 468477 - DNA, 25 bp, Rattus norvegicus
cgagacaccacacgacagccagaga

SEQ ID NO: 468478 - DNA, 25 bp, Rattus norvegicus
cagccagagaggcaaggtggatatt

SEQ ID NO: 468479 - DNA, 25 bp, Rattus norvegicus
caaggtggatatttgaggctctctc

SEQ ID NO: 468480 - DNA, 25 bp, Rattus norvegicus
aggctctctcttatgcgaggtacca

SEQ ID NO: 468481 - DNA, 25 bp, Rattus norvegicus
ttatgcgaggtaccaccgtgcggac

SEQ ID NO: 468482 - DNA, 25 bp, Rattus norvegicus
cagagaaaggcacggcgaaaggctc

SEQ ID NO: 468483 - DNA, 25 bp, Rattus norvegicus
gcagtacttgtggtcgcggaagcca

SEQ ID NO: 468484 - DNA, 25 bp, Rattus norvegicus
tgtccgagccgtggcacacccaaga

SEQ ID NO: 468485 - DNA, 25 bp, Rattus norvegicus
ctgaatgcacggatcgcgcagccag

SEQ ID NO: 468486 - DNA, 25 bp, Rattus norvegicus
tggcacacccaagacaagcatccgg

SEQ ID NO: 468487 - DNA, 25 bp, Rattus norvegicus
gagccgcggtacttctccagcgaca

SEQ ID NO: 468488 - DNA, 25 bp, Rattus norvegicus
cccggatgttcaccgccttgaagtc

SEQ ID NO: 468489 - DNA, 25 bp, Rattus norvegicus
ccgccttgaagtcgtagaagtcttg

SEQ ID NO: 468490 - DNA, 25 bp, Rattus norvegicus
tagaagtcttgctcggattgcgtgc

SEQ ID NO: 468491 - DNA, 25 bp, Rattus norvegicus
tggctcacttccgaggtggcgactt

SEQ ID NO: 468492 - DNA, 25 bp, Rattus norvegicus
acttggcgagggcaaagacaaggca

SEQ ID NO: 468493 - DNA, 25 bp, Rattus norvegicus
tctgcaggcgcagagtcctggctct

SEQ ID NO: 468494 - DNA, 25 bp, Rattus norvegicus
agtttccctatctgtgctccgccgg

SEQ ID NO: 468495 - DNA, 25 bp, Rattus norvegicus
tgtgctccgccggtcagcttcagat

SEQ ID NO: 468496 - DNA, 25 bp, Rattus norvegicus
gtcagcttcagatcgccggatcccg

SEQ ID NO: 468497 - DNA, 25 bp, Rattus norvegicus
cgcaaccatggctcacttccgaggt

SEQ ID NO: 468498 - DNA, 25 bp, Rattus norvegicus
tcggcgtgctggaccgcaagaccct

SEQ ID NO: 468499 - DNA, 25 bp, Rattus norvegicus
gcgcctgtagctcgcgggcttctca

SEQ ID NO: 468500 - DNA, 25 bp, Rattus norvegicus
gagctcgtcgtgtcctggcctccat

SEQ ID NO: 468501 - DNA, 25 bp, Rattus norvegicus
tggagtcctgagctcgtcgtgtcct

SEQ ID NO: 468502 - DNA, 25 bp, Rattus norvegicus
ccacaatgcagttcgcggcgcggcg

SEQ ID NO: 468503 - DNA, 25 bp, Rattus norvegicus
tccctgtcaggggagcgtcgctgac

SEQ ID NO: 468504 - DNA, 25 bp, Rattus norvegicus
ctcctccgccgaggtttgacgggtg

SEQ ID NO: 468505 - DNA, 25 bp, Rattus norvegicus
ctcgctctcctcagcgcgggtgtgt

SEQ ID NO: 468506 - DNA, 25 bp, Rattus norvegicus
caagtcgcgggtagctccgaccctt

SEQ ID NO: 468507 - DNA, 25 bp, Rattus norvegicus
gacagcgcacgcgaccctaagcttg

SEQ ID NO: 468508 - DNA, 25 bp, Rattus norvegicus
tgcaggctcgctacagccagcaagt

SEQ ID NO: 468509 - DNA, 25 bp, Rattus norvegicus
gaccctaagcttgctggcgtcctcg

SEQ ID NO: 468510 - DNA, 25 bp, Rattus norvegicus
gcttctcaggtacggagcttcgggc

SEQ ID NO: 468511 - DNA, 25 bp, Rattus norvegicus
acagccagcaagtcgcgggtagctc

SEQ ID NO: 468512 - DNA, 25 bp, Rattus norvegicus
ttcctcgatcccgtggtttgttaga

SEQ ID NO: 468513 - DNA, 25 bp, Rattus norvegicus
tcctgttggctttgcagccttgaga

SEQ ID NO: 468514 - DNA, 25 bp, Rattus norvegicus
ctttgcagccttgagaagtcgccca

SEQ ID NO: 468515 - DNA, 25 bp, Rattus norvegicus
tgcagccttgagaagtcgcccattc

SEQ ID NO: 468516 - DNA, 25 bp, Rattus norvegicus
gccttgagaagtcgcccattcattt

SEQ ID NO: 468517 - DNA, 25 bp, Rattus norvegicus
tgagaagtcgcccattcattttcct

SEQ ID NO: 468518 - DNA, 25 bp, Rattus norvegicus
atcctttcctcgatcccgtggtttg

SEQ ID NO: 468519 - DNA, 25 bp, Rattus norvegicus
ctcgatcccgtggtttgttagaaag

SEQ ID NO: 468520 - DNA, 25 bp, Rattus norvegicus
atcccgtggtttgttagaaagtgcg

SEQ ID NO: 468521 - DNA, 25 bp, Rattus norvegicus
cgtggtttgttagaaagtgcgtcca

SEQ ID NO: 468522 - DNA, 25 bp, Rattus norvegicus
ctgtgcggcgcgcttcctgttggct

SEQ ID NO: 468523 - DNA, 25 bp, Rattus norvegicus
gtgcgtccaaagtttcacgctctcg

SEQ ID NO: 468524 - DNA, 25 bp, Rattus norvegicus
aaagtttcacgctctcgcccagacg

SEQ ID NO: 468525 - DNA, 25 bp, Rattus norvegicus
cccgtggtctccatcctttcctcga

SEQ ID NO: 468526 - DNA, 25 bp, Rattus norvegicus
tgggcctctgtgatgccccatcttc

SEQ ID NO: 468527 - DNA, 25 bp, Rattus norvegicus
cgtccaatccggtcaaaggcaggcc

SEQ ID NO: 468528 - DNA, 25 bp, Rattus norvegicus
caatccggtcaaaggcaggccaacc

SEQ ID NO: 468529 - DNA, 25 bp, Rattus norvegicus
tcctacccgctcaacgccaactccg

SEQ ID NO: 468530 - DNA, 25 bp, Rattus norvegicus
ggagctctccctgggcctctgtgat

SEQ ID NO: 468531 - DNA, 25 bp, Rattus norvegicus
tccggcccggagactacaaaatatc

SEQ ID NO: 468532 - DNA, 25 bp, Rattus norvegicus
ctacaaaatatcaccgcagccggga

SEQ ID NO: 468533 - DNA, 25 bp, Rattus norvegicus
cagccgggagccgtcgccaaggaac

SEQ ID NO: 468534 - DNA, 25 bp, Rattus norvegicus
ctacgcggcggatgccagcggatcc

SEQ ID NO: 468535 - DNA, 25 bp, Rattus norvegicus
aacccaaaatcctcacctcgcttcg

SEQ ID NO: 468536 - DNA, 25 bp, Rattus norvegicus
tcacctcgcttcgacatcttgagcg

SEQ ID NO: 468537 - DNA, 25 bp, Rattus norvegicus
ctcgcttcgacatcttgagcgtccg

SEQ ID NO: 468538 - DNA, 25 bp, Rattus norvegicus
cgcaaagaccgtccaatccggtcaa

SEQ ID NO: 468539 - DNA, 25 bp, Rattus norvegicus
ggcccggagactacaaaatatcacc

SEQ ID NO: 468540 - DNA, 25 bp, Rattus norvegicus
ggtgttcgccaattctcctgctgtc

SEQ ID NO: 468541 - DNA, 25 bp, Rattus norvegicus
ttttgggctgtcctaacgagtcgaa

SEQ ID NO: 468542 - DNA, 25 bp, Rattus norvegicus
gcaactccgcggtgctgtacgtact

SEQ ID NO: 468543 - DNA, 25 bp, Rattus norvegicus
acgccgcgcatgaagactgttacca

SEQ ID NO: 468544 - DNA, 25 bp, Rattus norvegicus
tcaacctggctatcgcggacgagct

SEQ ID NO: 468545 - DNA, 25 bp, Rattus norvegicus
tgcgccctctatatcaccctgttgt

SEQ ID NO: 468546 - DNA, 25 bp, Rattus norvegicus
cggggaagtcatgtgcaagctcatc

SEQ ID NO: 468547 - DNA, 25 bp, Rattus norvegicus
agctcatcgtggctgtcgaccagta

SEQ ID NO: 468548 - DNA, 25 bp, Rattus norvegicus
cgcagaccgctacctggttgtcctg

SEQ ID NO: 468549 - DNA, 25 bp, Rattus norvegicus
tcgtgctgccttttgcggtattcgc

SEQ ID NO: 468550 - DNA, 25 bp, Rattus norvegicus
cgccagccgtctgtacactctagtg

SEQ ID NO: 468551 - DNA, 25 bp, Rattus norvegicus
gccgactgcgtgctatccagctaga

SEQ ID NO: 468552 - DNA, 25 bp, Rattus norvegicus
cactctagtgttgggcttcgccatc

SEQ ID NO: 468553 - DNA, 25 bp, Rattus norvegicus
tcgtgctgcccatcaacatcgcgga

SEQ ID NO: 468554 - DNA, 25 bp, Rattus norvegicus
ttccattcctagtcagctgagagca

SEQ ID NO: 468555 - DNA, 25 bp, Rattus norvegicus
gactttccacgtgcacggcttctga

SEQ ID NO: 468556 - DNA, 25 bp, Rattus norvegicus
gagcctaaggctttgactttccacg

SEQ ID NO: 468557 - DNA, 25 bp, Rattus norvegicus
ttcctgcgctgaaggagatctcaga

SEQ ID NO: 468558 - DNA, 25 bp, Rattus norvegicus
cttctgggagctcctgaaacatttc

SEQ ID NO: 468559 - DNA, 25 bp, Rattus norvegicus
taaacgttctcctcgccttctggga

SEQ ID NO: 468560 - DNA, 25 bp, Rattus norvegicus
tgccctcacctctcgaaagtgggta

SEQ ID NO: 468561 - DNA, 25 bp, Rattus norvegicus
cacacacgtgcacctagggccttaa

SEQ ID NO: 468562 - DNA, 25 bp, Rattus norvegicus
cgacagccctaacaagcttcggtga

SEQ ID NO: 468563 - DNA, 25 bp, Rattus norvegicus
cggagcccaaactgcacgagcgagc

SEQ ID NO: 468564 - DNA, 25 bp, Rattus norvegicus
tggcggaagtacgtcatgagccttt

SEQ ID NO: 468565 - DNA, 25 bp, Rattus norvegicus
ttgcgttcagcttcactaactagtg

SEQ ID NO: 468566 - DNA, 25 bp, Rattus norvegicus
ctttcctttagaacggcggagctga

SEQ ID NO: 468567 - DNA, 25 bp, Rattus norvegicus
gctgtggctcagaactctttccgga

SEQ ID NO: 468568 - DNA, 25 bp, Rattus norvegicus
tgctggaagtgtctgctcacagcca

SEQ ID NO: 468569 - DNA, 25 bp, Rattus norvegicus
ctgacgcttcgctgttgactgctgt

SEQ ID NO: 468570 - DNA, 25 bp, Rattus norvegicus
tacccattaggaagcggaagcctcg

SEQ ID NO: 468571 - DNA, 25 bp, Rattus norvegicus
ctctcgaagaaactacgtcagggtg

SEQ ID NO: 468572 - DNA, 25 bp, Rattus norvegicus
acgcctaccgtgtgtgaagggcgca

SEQ ID NO: 468573 - DNA, 25 bp, Rattus norvegicus
tgaagggcgcaagacgccaaacctc

SEQ ID NO: 468574 - DNA, 25 bp, Rattus norvegicus
tatcgcgttacctgctggaagtgtc

SEQ ID NO: 468575 - DNA, 25 bp, Rattus norvegicus
ccggctaccttgtggtacccattag

SEQ ID NO: 468576 - DNA, 25 bp, Rattus norvegicus
acccaaggcgtcacctgtgggcgcg

SEQ ID NO: 468577 - DNA, 25 bp, Rattus norvegicus
caggcagctggctgtgttgtcacgt

SEQ ID NO: 468578 - DNA, 25 bp, Rattus norvegicus
cgcgaggtatgccacgtgcccgctt

SEQ ID NO: 468579 - DNA, 25 bp, Rattus norvegicus
ctgcggcagcggagtatctcattct

SEQ ID NO: 468580 - DNA, 25 bp, Rattus norvegicus
gtatctcattctcctgagcgccttc

SEQ ID NO: 468581 - DNA, 25 bp, Rattus norvegicus
gccgccgtcagccagtatcgcgtta

SEQ ID NO: 468582 - DNA, 25 bp, Rattus norvegicus
ggcaagccaaagctgtttgcaaaca

SEQ ID NO: 468583 - DNA, 25 bp, Rattus norvegicus
gggactcagtaagccgcgcaggcaa

SEQ ID NO: 468584 - DNA, 25 bp, Rattus norvegicus
ccgcgcaggcaagccaaagctgttt

SEQ ID NO: 468585 - DNA, 25 bp, Rattus norvegicus
agcgccgctccagtcgcctcagcca

SEQ ID NO: 468586 - DNA, 25 bp, Rattus norvegicus
cgcgaagcctcgcactcctgagggg

SEQ ID NO: 468587 - DNA, 25 bp, Rattus norvegicus
tccacagcagggctccgccgcgaag

SEQ ID NO: 468588 - DNA, 25 bp, Rattus norvegicus
gggtcgtcactcagccgagagcctc

SEQ ID NO: 468589 - DNA, 25 bp, Rattus norvegicus
cccgacccgaaagcaggcgccagga

SEQ ID NO: 468590 - DNA, 25 bp, Rattus norvegicus
aggcccagctaagggcttcccggcg

SEQ ID NO: 468591 - DNA, 25 bp, Rattus norvegicus
gaacccaggcccagctaagggcttc

SEQ ID NO: 468592 - DNA, 25 bp, Rattus norvegicus
gccagcccagtcttcacgtacccgg

SEQ ID NO: 468593 - DNA, 25 bp, Rattus norvegicus
cccgggacaaatgcgaagggcaccg

SEQ ID NO: 468594 - DNA, 25 bp, Rattus norvegicus
tccctccgggatgtgcactcagggc

SEQ ID NO: 468595 - DNA, 25 bp, Rattus norvegicus
ctgtttgcaaacaagccgtcctttg

SEQ ID NO: 468596 - DNA, 25 bp, Rattus norvegicus
tgtctcgtactcaaccgaagggccg

SEQ ID NO: 468597 - DNA, 25 bp, Rattus norvegicus
tggggaccatccctcaggtgccgac

SEQ ID NO: 468598 - DNA, 25 bp, Rattus norvegicus
ctgcagcggggagggtcctctaaca

SEQ ID NO: 468599 - DNA, 25 bp, Rattus norvegicus
gagggtcctctaacaccagcacgcg

SEQ ID NO: 468600 - DNA, 25 bp, Rattus norvegicus
accagcacgcggcaagagcaagatg

SEQ ID NO: 468601 - DNA, 25 bp, Rattus norvegicus
cggcaagagcaagatggctgcctca

SEQ ID NO: 468602 - DNA, 25 bp, Rattus norvegicus
ctcagctgagacagagaaagaccgc

SEQ ID NO: 468603 - DNA, 25 bp, Rattus norvegicus
aaccgcgcgcctcccaactacaaag

SEQ ID NO: 468604 - DNA, 25 bp, Rattus norvegicus
caatattctgattggcggccggtga

SEQ ID NO: 468605 - DNA, 25 bp, Rattus norvegicus
gtggcggacacctcagcgtcccatt

SEQ ID NO: 468606 - DNA, 25 bp, Rattus norvegicus
agcgtcccattgtgtctgtgatacc

SEQ ID NO: 468607 - DNA, 25 bp, Rattus norvegicus
cccattgtgtctgtgataccttttg

SEQ ID NO: 468608 - DNA, 25 bp, Rattus norvegicus
ctgtgataccttttgtctcgtactc

SEQ ID NO: 468609 - DNA, 25 bp, Rattus norvegicus
tgcgccgcccgtaaccgacaggccc

SEQ ID NO: 468610 - DNA, 25 bp, Rattus norvegicus
gatacttctggagaacatgccactg

SEQ ID NO: 468611 - DNA, 25 bp, Rattus norvegicus
ttaccggaagttgtatcgaggcttc

SEQ ID NO: 468612 - DNA, 25 bp, Rattus norvegicus
gattccactgtgtacggcgactctg

SEQ ID NO: 468613 - DNA, 25 bp, Rattus norvegicus
gacgtggtcatcctagactccatga

SEQ ID NO: 468614 - DNA, 25 bp, Rattus norvegicus
acatcaaggggttccgctacgagtt

SEQ ID NO: 468615 - DNA, 25 bp, Rattus norvegicus
ctacgagttgtactgccttgcgcga

SEQ ID NO: 468616 - DNA, 25 bp, Rattus norvegicus
gcacgccgctctgcttagtttactg

SEQ ID NO: 468617 - DNA, 25 bp, Rattus norvegicus
tagtttactgcataaggcccggctg

SEQ ID NO: 468618 - DNA, 25 bp, Rattus norvegicus
tggatccaaaggatatcctgccatc

SEQ ID NO: 468619 - DNA, 25 bp, Rattus norvegicus
ccagctgtaatgactccggaatccg

SEQ ID NO: 468620 - DNA, 25 bp, Rattus norvegicus
agaaatctgcagagcctgcgccatg

SEQ ID NO: 468621 - DNA, 25 bp, Rattus norvegicus
cgaacttttggagtccttagcgctg

SEQ ID NO: 468622 - DNA, 25 bp, Rattus norvegicus
aaccgctgggatcgacccttgttca

SEQ ID NO: 468623 - DNA, 25 bp, Rattus norvegicus
cgaggcttccgcacatggatacttc

SEQ ID NO: 468624 - DNA, 25 bp, Rattus norvegicus
tccactactgccaggtgcaacagtc

SEQ ID NO: 468625 - DNA, 25 bp, Rattus norvegicus
cggatcgtacgtgggttccgcctag

SEQ ID NO: 468626 - DNA, 25 bp, Rattus norvegicus
cagcgggaacccaacccatcttctg

SEQ ID NO: 468627 - DNA, 25 bp, Rattus norvegicus
atcttctgccagagcctcaaccctc

SEQ ID NO: 468628 - DNA, 25 bp, Rattus norvegicus
tcaaccctccgtagccgaggtggga

SEQ ID NO: 468629 - DNA, 25 bp, Rattus norvegicus
cctccgtagccgaggtgggaaccag

SEQ ID NO: 468630 - DNA, 25 bp, Rattus norvegicus
tctcgtccactactgccaggtgcaa

SEQ ID NO: 468631 - DNA, 25 bp, Rattus norvegicus
tcgtacgtgggttccgcctagaggc

SEQ ID NO: 468632 - DNA, 25 bp, Rattus norvegicus
actgccaggtgcaacagtccggctg

SEQ ID NO: 468633 - DNA, 25 bp, Rattus norvegicus
cagtgtgccgcgagccagctcttat

SEQ ID NO: 468634 - DNA, 25 bp, Rattus norvegicus
cgcgagccagctcttatccgaggta

SEQ ID NO: 468635 - DNA, 25 bp, Rattus norvegicus
gagccagctcttatccgaggtaagg

SEQ ID NO: 468636 - DNA, 25 bp, Rattus norvegicus
agctcttatccgaggtaaggggcgc

SEQ ID NO: 468637 - DNA, 25 bp, Rattus norvegicus
tagccgaggtgggaaccagacccgc

SEQ ID NO: 468638 - DNA, 25 bp, Rattus norvegicus
ctgcgtcgtcccactggggaatatt

SEQ ID NO: 468639 - DNA, 25 bp, Rattus norvegicus
cgaagtccacctgcagttgcccgga

SEQ ID NO: 468640 - DNA, 25 bp, Rattus norvegicus
tgcctggcagaaacaaggcgaagtc

SEQ ID NO: 468641 - DNA, 25 bp, Rattus norvegicus
gaaaccgtttcctacgctgaccatg

SEQ ID NO: 468642 - DNA, 25 bp, Rattus norvegicus
tgtgcgaagaatcagcgaaaccgtt

SEQ ID NO: 468643 - DNA, 25 bp, Rattus norvegicus
gctacgacttgctggtgaatgctga

SEQ ID NO: 468644 - DNA, 25 bp, Rattus norvegicus
ggatccatagcgtcatcggctgtca

SEQ ID NO: 468645 - DNA, 25 bp, Rattus norvegicus
tgtttctgcaaacgtgacagctgtt

SEQ ID NO: 468646 - DNA, 25 bp, Rattus norvegicus
tagccttccctgctcctattggttg

SEQ ID NO: 468647 - DNA, 25 bp, Rattus norvegicus
ggtgcgccaggaatccagcctattc

SEQ ID NO: 468648 - DNA, 25 bp, Rattus norvegicus
cccgcccacgtcagttttcgaaatg

SEQ ID NO: 468649 - DNA, 25 bp, Rattus norvegicus
gagcactacgcggttttccagaaac

SEQ ID NO: 468650 - DNA, 25 bp, Rattus norvegicus
ggactcacgtcacaatcgcggcaaa

SEQ ID NO: 468651 - DNA, 25 bp, Rattus norvegicus
tgcccggacctgcagcctaatggac

SEQ ID NO: 468652 - DNA, 25 bp, Rattus norvegicus
ttggccacgggtcacctgcatggga

SEQ ID NO: 468653 - DNA, 25 bp, Rattus norvegicus
gaccgagggtctactcactccacta

SEQ ID NO: 468654 - DNA, 25 bp, Rattus norvegicus
agggtctactcactccactagcggc

SEQ ID NO: 468655 - DNA, 25 bp, Rattus norvegicus
tccactagcggccagcaggagagcc

SEQ ID NO: 468656 - DNA, 25 bp, Rattus norvegicus
actagcggccagcaggagagccatt

SEQ ID NO: 468657 - DNA, 25 bp, Rattus norvegicus
agcaggagagccattcgccgcggcc

SEQ ID NO: 468658 - DNA, 25 bp, Rattus norvegicus
agccgcctgaggacgccctctcccg

SEQ ID NO: 468659 - DNA, 25 bp, Rattus norvegicus
ctggcgattggccacgggtcacctg

SEQ ID NO: 468660 - DNA, 25 bp, Rattus norvegicus
gcgtcaaggccgaaggagccgcgaa

SEQ ID NO: 468661 - DNA, 25 bp, Rattus norvegicus
ctcccacccgcgagagctggggaaa

SEQ ID NO: 468662 - DNA, 25 bp, Rattus norvegicus
aggcctggaactggcttcacctgcg

SEQ ID NO: 468663 - DNA, 25 bp, Rattus norvegicus
gaactggcttcacctgcgccagcgg

SEQ ID NO: 468664 - DNA, 25 bp, Rattus norvegicus
ggaaaggcctggaactggcttcacc

SEQ ID NO: 468665 - DNA, 25 bp, Rattus norvegicus
tggccctggcaaagaggcccctggc

SEQ ID NO: 468666 - DNA, 25 bp, Rattus norvegicus
tagtccatttgctcagcggcccttc

SEQ ID NO: 468667 - DNA, 25 bp, Rattus norvegicus
gcatctccctcctggtcattggcta

SEQ ID NO: 468668 - DNA, 25 bp, Rattus norvegicus
tggtcattggctacccgcacgcaaa

SEQ ID NO: 468669 - DNA, 25 bp, Rattus norvegicus
tccacaagggaacctcgcgtacggc

SEQ ID NO: 468670 - DNA, 25 bp, Rattus norvegicus
tacggcggtctccacagctgagcac

SEQ ID NO: 468671 - DNA, 25 bp, Rattus norvegicus
ggcctcagccactcaccgtatagta

SEQ ID NO: 468672 - DNA, 25 bp, Rattus norvegicus
tcgcctatatggtattcggcatgca

SEQ ID NO: 468673 - DNA, 25 bp, Rattus norvegicus
tgggagccgccaatgacaacaaacg

SEQ ID NO: 468674 - DNA, 25 bp, Rattus norvegicus
tcccttcatcacgttagtccatttg

SEQ ID NO: 468675 - DNA, 25 bp, Rattus norvegicus
gagcagtcctgcattgtagtccagc

SEQ ID NO: 468676 - DNA, 25 bp, Rattus norvegicus
ataaatcagccagccggcgctgctc

SEQ ID NO: 468677 - DNA, 25 bp, Rattus norvegicus
tcaccgtatagtaggagagcagtcc

SEQ ID NO: 468678 - DNA, 25 bp, Rattus norvegicus
cggcctgacgtcagtcgcctatatg

SEQ ID NO: 468679 - DNA, 25 bp, Rattus norvegicus
tgtagtccagcacgaaccaacgata

SEQ ID NO: 468680 - DNA, 25 bp, Rattus norvegicus
taccagctcgcccaaggaaaaggga

SEQ ID NO: 468681 - DNA, 25 bp, Rattus norvegicus
cggaggccagttccccagttccagt

SEQ ID NO: 468682 - DNA, 25 bp, Rattus norvegicus
tgaactgtctggataaggtgagctc

SEQ ID NO: 468683 - DNA, 25 bp, Rattus norvegicus
cctgcacagttgcagccgccgcctc

SEQ ID NO: 468684 - DNA, 25 bp, Rattus norvegicus
tctggataaggtgagctcgggtccc

SEQ ID NO: 468685 - DNA, 25 bp, Rattus norvegicus
cagctcgcccaaggaaaagggaacg

SEQ ID NO: 468686 - DNA, 25 bp, Rattus norvegicus
aaggaaaagggaacgcgcgcgagca

SEQ ID NO: 468687 - DNA, 25 bp, Rattus norvegicus
cccggaaccatgaaccctaactgtg

SEQ ID NO: 468688 - DNA, 25 bp, Rattus norvegicus
gaaccatgaaccctaactgtgcccg

SEQ ID NO: 468689 - DNA, 25 bp, Rattus norvegicus
catgaaccctaactgtgcccggtgc

SEQ ID NO: 468690 - DNA, 25 bp, Rattus norvegicus
tgcccggtgcggcaaaatcgtgtac

SEQ ID NO: 468691 - DNA, 25 bp, Rattus norvegicus
gcggcaaaatcgtgtaccccacgga

SEQ ID NO: 468692 - DNA, 25 bp, Rattus norvegicus
ccacggagaaggtgaactgtctgga

SEQ ID NO: 468693 - DNA, 25 bp, Rattus norvegicus
gtcgccgtcgcctgcacagttgcag

SEQ ID NO: 468694 - DNA, 25 bp, Rattus norvegicus
tcagctctggcccacgggagcgacg

SEQ ID NO: 468695 - DNA, 25 bp, Rattus norvegicus
caagtttctcttacgggcctgacgg

SEQ ID NO: 468696 - DNA, 25 bp, Rattus norvegicus
ccagagctctatccgcaccgggttt

SEQ ID NO: 468697 - DNA, 25 bp, Rattus norvegicus
cagggcctggttccgcggctcagac

SEQ ID NO: 468698 - DNA, 25 bp, Rattus norvegicus
cctcccgtgcatgatggaaacacca

SEQ ID NO: 468699 - DNA, 25 bp, Rattus norvegicus
tggaaacaccatggctgcggcagcc

SEQ ID NO: 468700 - DNA, 25 bp, Rattus norvegicus
tctcgtgaggcttttgcgaggtagc

SEQ ID NO: 468701 - DNA, 25 bp, Rattus norvegicus
tccaggtccggtcatagctcacact

SEQ ID NO: 468702 - DNA, 25 bp, Rattus norvegicus
agctcacactctcggcaagtttctc

SEQ ID NO: 468703 - DNA, 25 bp, Rattus norvegicus
ttccctcagacttgctcagctctgg

SEQ ID NO: 468704 - DNA, 25 bp, Rattus norvegicus
ggcagggttccctcagacttgctca

SEQ ID NO: 468705 - DNA, 25 bp, Rattus norvegicus
ccaggctcgacctgctggggttacc

SEQ ID NO: 468706 - DNA, 25 bp, Rattus norvegicus
gctctatccgcaccgggttttccag

SEQ ID NO: 468707 - DNA, 25 bp, Rattus norvegicus
cccaggtgaactctcgtgaggcttt

SEQ ID NO: 468708 - DNA, 25 bp, Rattus norvegicus
tccctgtgactagtgagaaattctc

SEQ ID NO: 468709 - DNA, 25 bp, Rattus norvegicus
gatcagcagacttttctctgagaga

SEQ ID NO: 468710 - DNA, 25 bp, Rattus norvegicus
tctttgggaaccaggcaagaaggaa

SEQ ID NO: 468711 - DNA, 25 bp, Rattus norvegicus
ccaagtgtggagttggtgatcagca

SEQ ID NO: 468712 - DNA, 25 bp, Rattus norvegicus
taaaatctttgggaaccaggcaaga

SEQ ID NO: 468713 - DNA, 25 bp, Rattus norvegicus
ctctaagctctttaaaatctttggg

SEQ ID NO: 468714 - DNA, 25 bp, Rattus norvegicus
ttctctgagagaataacatttgttt

SEQ ID NO: 468715 - DNA, 25 bp, Rattus norvegicus
cctgtgactagtgagaaattctcta

SEQ ID NO: 468716 - DNA, 25 bp, Rattus norvegicus
agttggtgatcagcagacttttctc

SEQ ID NO: 468717 - DNA, 25 bp, Rattus norvegicus
ggcactccctgtgactagtgagaaa

SEQ ID NO: 468718 - DNA, 25 bp, Rattus norvegicus
agctggcactccctgtgactagtga

SEQ ID NO: 468719 - DNA, 25 bp, Rattus norvegicus
atttgttttactggagctggcactc

SEQ ID NO: 468720 - DNA, 25 bp, Rattus norvegicus
aacatttgttttactggagctggca

SEQ ID NO: 468721 - DNA, 25 bp, Rattus norvegicus
gtgagaaattctctaagctctttaa

SEQ ID NO: 468722 - DNA, 25 bp, Rattus norvegicus
tgagcgccggggtctcacctggcca

SEQ ID NO: 468723 - DNA, 25 bp, Rattus norvegicus
cccactgcgccggtgggcagcccga

SEQ ID NO: 468724 - DNA, 25 bp, Rattus norvegicus
ctgcgcctggcgtccggcgcacgca

SEQ ID NO: 468725 - DNA, 25 bp, Rattus norvegicus
gcagcgatgaccacggctagcggcc

SEQ ID NO: 468726 - DNA, 25 bp, Rattus norvegicus
gctgctgcgcaacctgcagcccgcg

SEQ ID NO: 468727 - DNA, 25 bp, Rattus norvegicus
ctagtccgggctgcgccgaccttga

SEQ ID NO: 468728 - DNA, 25 bp, Rattus norvegicus
gcgcacgcagcgatgaccacggcta

SEQ ID NO: 468729 - DNA, 25 bp, Rattus norvegicus
agtgcggctccagctgctgcgcaac

SEQ ID NO: 468730 - DNA, 25 bp, Rattus norvegicus
ttagttgtctgctcctagtccgggc

SEQ ID NO: 468731 - DNA, 25 bp, Rattus norvegicus
ctccgttagttgtctgctcctagtc

SEQ ID NO: 468732 - DNA, 25 bp, Rattus norvegicus
cagctccgttagttgtctgctccta

SEQ ID NO: 468733 - DNA, 25 bp, Rattus norvegicus
aggtgtcggcagctccgttagttgt

SEQ ID NO: 468734 - DNA, 25 bp, Rattus norvegicus
gccttgggaccgcagtgcggctcca

SEQ ID NO: 468735 - DNA, 25 bp, Rattus norvegicus
ttgtctgctcctagtccgggctgcg

SEQ ID NO: 468736 - DNA, 25 bp, Rattus norvegicus
cggtcggactgagactcgtgaagca

SEQ ID NO: 468737 - DNA, 25 bp, Rattus norvegicus
actcgtgaagcagggagatgtcatc

SEQ ID NO: 468738 - DNA, 25 bp, Rattus norvegicus
aagcagggagatgtcatccgaagtc

SEQ ID NO: 468739 - DNA, 25 bp, Rattus norvegicus
gatgtcatccgaagtcggggatttg

SEQ ID NO: 468740 - DNA, 25 bp, Rattus norvegicus
cgaagtcggggatttgaggcaattc

SEQ ID NO: 468741 - DNA, 25 bp, Rattus norvegicus
tttgaggcaattccccatcttccgg

SEQ ID NO: 468742 - DNA, 25 bp, Rattus norvegicus
ctggggtgtatgcttgagatctgag

SEQ ID NO: 468743 - DNA, 25 bp, Rattus norvegicus
aggaagaaagctgtgacccggtctc

SEQ ID NO: 468744 - DNA, 25 bp, Rattus norvegicus
agaaagctgtgacccggtctcccgc

SEQ ID NO: 468745 - DNA, 25 bp, Rattus norvegicus
cggtctcccgcacacacggcggtca

SEQ ID NO: 468746 - DNA, 25 bp, Rattus norvegicus
tcgccaaagctagcccggtcggact

SEQ ID NO: 468747 - DNA, 25 bp, Rattus norvegicus
ctccctacctgatatggcggcggcg

SEQ ID NO: 468748 - DNA, 25 bp, Rattus norvegicus
agctagcccggtcggactgagactc

SEQ ID NO: 468749 - DNA, 25 bp, Rattus norvegicus
gcggctcctgatctggctccgtccc

SEQ ID NO: 468750 - DNA, 25 bp, Rattus norvegicus
gtgtgccagctagccacgaaccatc

SEQ ID NO: 468751 - DNA, 25 bp, Rattus norvegicus
cagtagtcgtccacaattcccggag

SEQ ID NO: 468752 - DNA, 25 bp, Rattus norvegicus
aaccatcgctacactcactcgaggg

SEQ ID NO: 468753 - DNA, 25 bp, Rattus norvegicus
ggccactggcctcctttgtagctct

SEQ ID NO: 468754 - DNA, 25 bp, Rattus norvegicus
ggcctcctttgtagctctcctcttg

SEQ ID NO: 468755 - DNA, 25 bp, Rattus norvegicus
ctttgccattcgctgccgcagggct

SEQ ID NO: 468756 - DNA, 25 bp, Rattus norvegicus
ccagcaccgggagctggctgcagta

SEQ ID NO: 468757 - DNA, 25 bp, Rattus norvegicus
ccgggtgcctggaacagccaggtca

SEQ ID NO: 468758 - DNA, 25 bp, Rattus norvegicus
cagccaggtcaagagaagccgcgga

SEQ ID NO: 468759 - DNA, 25 bp, Rattus norvegicus
ggctcgtgcaggcacgctcagtgca

SEQ ID NO: 468760 - DNA, 25 bp, Rattus norvegicus
tctagccaacggaaggactgccgga

SEQ ID NO: 468761 - DNA, 25 bp, Rattus norvegicus
ccggggccagctctagccaacggaa

SEQ ID NO: 468762 - DNA, 25 bp, Rattus norvegicus
caagccggacgcgtcctaaggctca

SEQ ID NO: 468763 - DNA, 25 bp, Rattus norvegicus
ggctgcagtagtcgtccacaattcc

SEQ ID NO: 468764 - DNA, 25 bp, Rattus norvegicus
tgcccggtgccacttggttagttag

SEQ ID NO: 468765 - DNA, 25 bp, Rattus norvegicus
aggacagcgactgccagccagctca

SEQ ID NO: 468766 - DNA, 25 bp, Rattus norvegicus
tgagcgctttttgagttgaaaaacc

SEQ ID NO: 468767 - DNA, 25 bp, Rattus norvegicus
agctcgcggtagcatcgcgcctgca

SEQ ID NO: 468768 - DNA, 25 bp, Rattus norvegicus
gcctacgaccgagctagctcaagct

SEQ ID NO: 468769 - DNA, 25 bp, Rattus norvegicus
gctctccactgcaagcgctggctga

SEQ ID NO: 468770 - DNA, 25 bp, Rattus norvegicus
agtcccggagctgactcagactgca

SEQ ID NO: 468771 - DNA, 25 bp, Rattus norvegicus
cgcctccgatgatgggaagggtctt

SEQ ID NO: 468772 - DNA, 25 bp, Rattus norvegicus
tatcccttttttccgacctcatcag

SEQ ID NO: 468773 - DNA, 25 bp, Rattus norvegicus
ggagccgcgcctgacagtttctttt

SEQ ID NO: 468774 - DNA, 25 bp, Rattus norvegicus
caaatctctgatcgctgctctgttc

SEQ ID NO: 468775 - DNA, 25 bp, Rattus norvegicus
gcacttgcgcgtctttcctttagga

SEQ ID NO: 468776 - DNA, 25 bp, Rattus norvegicus
ctttttccgctgaagcaactgctgc

SEQ ID NO: 468777 - DNA, 25 bp, Rattus norvegicus
actgctgctacggttgcctctgaag

SEQ ID NO: 468778 - DNA, 25 bp, Rattus norvegicus
tggtagcgctatggcctcttcccag

SEQ ID NO: 468779 - DNA, 25 bp, Rattus norvegicus
cgacctcgatgacaggcaaaatgtg

SEQ ID NO: 468780 - DNA, 25 bp, Rattus norvegicus
ctgaaggttaccgagtgcatgagca

SEQ ID NO: 468781 - DNA, 25 bp, Rattus norvegicus
cttcccagcgtttgtttgagcaccg

SEQ ID NO: 468782 - DNA, 25 bp, Rattus norvegicus
aacctgtcttcctaccaggcggcga

SEQ ID NO: 468783 - DNA, 25 bp, Rattus norvegicus
tgaagtgtctggctctgctcgcttc

SEQ ID NO: 468784 - DNA, 25 bp, Rattus norvegicus
tccttgcggattttcaggtgaagtg

SEQ ID NO: 468785 - DNA, 25 bp, Rattus norvegicus
acatggaccgggagatgatccttgc

SEQ ID NO: 468786 - DNA, 25 bp, Rattus norvegicus
gtgcatgagcacctagtctcccgcg

SEQ ID NO: 468787 - DNA, 25 bp, Rattus norvegicus
cggaataacctgttgcgggtcctca

SEQ ID NO: 468788 - DNA, 25 bp, Rattus norvegicus
acataagcgtccctgctacacgggc

SEQ ID NO: 468789 - DNA, 25 bp, Rattus norvegicus
ccaagcgcttgacaggaggacagtc

SEQ ID NO: 468790 - DNA, 25 bp, Rattus norvegicus
agtcacgtgacagccgcaaagcgcc

SEQ ID NO: 468791 - DNA, 25 bp, Rattus norvegicus
aagcgccgctttgcgacctcgatga

SEQ ID NO: 468792 - DNA, 25 bp, Rattus norvegicus
tacacaggtctacgcggagaggcgc

SEQ ID NO: 468793 - DNA, 25 bp, Rattus norvegicus
tggaagcactcggtcacggtcagaa

SEQ ID NO: 468794 - DNA, 25 bp, Rattus norvegicus
gagccctgaggagcaacaatagagc

SEQ ID NO: 468795 - DNA, 25 bp, Rattus norvegicus
ccaattctgtctaatggagccctga

SEQ ID NO: 468796 - DNA, 25 bp, Rattus norvegicus
ggcaggcgccacattgttgtccaat

SEQ ID NO: 468797 - DNA, 25 bp, Rattus norvegicus
tcggacactgtagaatgaggggctc

SEQ ID NO: 468798 - DNA, 25 bp, Rattus norvegicus
tcccgcaggcactcagcagagcgtg

SEQ ID NO: 468799 - DNA, 25 bp, Rattus norvegicus
tgtcacgacatttgcaacgctcctc

SEQ ID NO: 468800 - DNA, 25 bp, Rattus norvegicus
ccggacacggtaattaggagcaatt

SEQ ID NO: 468801 - DNA, 25 bp, Rattus norvegicus
ccagcaaaaagcgtcttggcaagtc

SEQ ID NO: 468802 - DNA, 25 bp, Rattus norvegicus
tggcaagtctgtggtgaacgccctc

SEQ ID NO: 468803 - DNA, 25 bp, Rattus norvegicus
actcccacttcgacagcggtaattg

SEQ ID NO: 468804 - DNA, 25 bp, Rattus norvegicus
tgaattgtcacctgctcctgtcccg

SEQ ID NO: 468805 - DNA, 25 bp, Rattus norvegicus
ctctcaggcgcacggaaacttcttg

SEQ ID NO: 468806 - DNA, 25 bp, Rattus norvegicus
accacggagtggtgtccgcgctcaa

SEQ ID NO: 468807 - DNA, 25 bp, Rattus norvegicus
tactgccgctggaaggactgcctgt

SEQ ID NO: 468808 - DNA, 25 bp, Rattus norvegicus
acaagcgctactgccgctggaagga

SEQ ID NO: 468809 - DNA, 25 bp, Rattus norvegicus
cgaagtctttggctcggtttgcgcc

SEQ ID NO: 468810 - DNA, 25 bp, Rattus norvegicus
cgcgctgccgcaaccacggagtggt

SEQ ID NO: 468811 - DNA, 25 bp, Rattus norvegicus
gcagcggagaagtacccgcggaccc

SEQ ID NO: 468812 - DNA, 25 bp, Rattus norvegicus
tgtgcgccaagtgcacgctcatcgc

SEQ ID NO: 468813 - DNA, 25 bp, Rattus norvegicus
aggaaaacgaggcacgcgagttgca

SEQ ID NO: 468814 - DNA, 25 bp, Rattus norvegicus
aaggactgcctgtgcgccaagtgca

SEQ ID NO: 468815 - DNA, 25 bp, Rattus norvegicus
aggcacgcgagttgcaactgctgta

SEQ ID NO: 468816 - DNA, 25 bp, Rattus norvegicus
gttgcaactgctgtacggcactgcc

SEQ ID NO: 468817 - DNA, 25 bp, Rattus norvegicus
caacggcatcatcccaccgcggcca

SEQ ID NO: 468818 - DNA, 25 bp, Rattus norvegicus
accgcggccagcttacgaagtcttt

SEQ ID NO: 468819 - DNA, 25 bp, Rattus norvegicus
ctttggctcggtttgcgccaccgac

SEQ ID NO: 468820 - DNA, 25 bp, Rattus norvegicus
ctgacaaagaagaagccgaggccgc

SEQ ID NO: 468821 - DNA, 25 bp, Rattus norvegicus
ggactacgccttcagcgacctcatg

SEQ ID NO: 468822 - DNA, 25 bp, Rattus norvegicus
tctggcccgtgcctccaaggaggcg

SEQ ID NO: 468823 - DNA, 25 bp, Rattus norvegicus
aatcgggctcggaagctgacaaaga

SEQ ID NO: 468824 - DNA, 25 bp, Rattus norvegicus
tgtacgggcccatggtcaacggcac

SEQ ID NO: 468825 - DNA, 25 bp, Rattus norvegicus
cgcggtgcacaaggagcccggttac

SEQ ID NO: 468826 - DNA, 25 bp, Rattus norvegicus
gagaacggagatggcgagtcctttt

SEQ ID NO: 468827 - DNA, 25 bp, Rattus norvegicus
gatggcgagtccttttccgggtcgc

SEQ ID NO: 468828 - DNA, 25 bp, Rattus norvegicus
ggtctggccttcatggcgccctact

SEQ ID NO: 468829 - DNA, 25 bp, Rattus norvegicus
aggtgctcaaccaccaccgcggagg

SEQ ID NO: 468830 - DNA, 25 bp, Rattus norvegicus
gtgcaggccattgagcaggtgctca

SEQ ID NO: 468831 - DNA, 25 bp, Rattus norvegicus
acatcttgacgcgtgtcttcccggg

SEQ ID NO: 468832 - DNA, 25 bp, Rattus norvegicus
cagcggacgccgctggacatcttga

SEQ ID NO: 468833 - DNA, 25 bp, Rattus norvegicus
agaagaagccgaggccgcaccgact

SEQ ID NO: 468834 - DNA, 25 bp, Rattus norvegicus
gaacgcctttctggaatgatcgcgg

SEQ ID NO: 468835 - DNA, 25 bp, Rattus norvegicus
cgggtcccaggctggatcccttctt

SEQ ID NO: 468836 - DNA, 25 bp, Rattus norvegicus
tggatcccttcttgtccttccgaca

SEQ ID NO: 468837 - DNA, 25 bp, Rattus norvegicus
tcttgtccttccgacagaagtagga

SEQ ID NO: 468838 - DNA, 25 bp, Rattus norvegicus
ccgacagaagtaggaagtgcgcacc

SEQ ID NO: 468839 - DNA, 25 bp, Rattus norvegicus
aggaagtgcgcaccctctgggcgca

SEQ ID NO: 468840 - DNA, 25 bp, Rattus norvegicus
accctctgggcgcacacaggcaaag

SEQ ID NO: 468841 - DNA, 25 bp, Rattus norvegicus
cacaggcaaagtagggtccctgttc

SEQ ID NO: 468842 - DNA, 25 bp, Rattus norvegicus
ctggacgcgcgtcctacctgcgggt

SEQ ID NO: 468843 - DNA, 25 bp, Rattus norvegicus
tcctacctgcgggtgttgcgggact

SEQ ID NO: 468844 - DNA, 25 bp, Rattus norvegicus
ctttctggaatgatcgcgggtccca

SEQ ID NO: 468845 - DNA, 25 bp, Rattus norvegicus
catctctggtcaccgagagaacccg

SEQ ID NO: 468846 - DNA, 25 bp, Rattus norvegicus
gaccgcgccgggacatctctggtca

SEQ ID NO: 468847 - DNA, 25 bp, Rattus norvegicus
cgcgcggtcccgcagagtagcagca

SEQ ID NO: 468848 - DNA, 25 bp, Rattus norvegicus
aagtaatgctcgaatcccgttccgc

SEQ ID NO: 468849 - DNA, 25 bp, Rattus norvegicus
gggaggtgacctgcaacacttcttt

SEQ ID NO: 468850 - DNA, 25 bp, Rattus norvegicus
gcacagtgtacccttggcgtcctgg

SEQ ID NO: 468851 - DNA, 25 bp, Rattus norvegicus
cgcctgtaccctgaccctgaaggga

SEQ ID NO: 468852 - DNA, 25 bp, Rattus norvegicus
ccggagtcactgatcgcgcctgtac

SEQ ID NO: 468853 - DNA, 25 bp, Rattus norvegicus
aacacttcttttgccaggacctgcg

SEQ ID NO: 468854 - DNA, 25 bp, Rattus norvegicus
gctgcgcagaactgctcactttgtg

SEQ ID NO: 468855 - DNA, 25 bp, Rattus norvegicus
caggctgcgctggagcacgaataaa

SEQ ID NO: 468856 - DNA, 25 bp, Rattus norvegicus
ctgttctccaaagctgtccaggctg

SEQ ID NO: 468857 - DNA, 25 bp, Rattus norvegicus
tctactgttcgctggggaggaaccc

SEQ ID NO: 468858 - DNA, 25 bp, Rattus norvegicus
gggtcgtagaatgctgtcttcgcca

SEQ ID NO: 468859 - DNA, 25 bp, Rattus norvegicus
gtcttcgccagatgcagtgtcctga

SEQ ID NO: 468860 - DNA, 25 bp, Rattus norvegicus
cgcattgtacgtatcgggtttcata

SEQ ID NO: 468861 - DNA, 25 bp, Rattus norvegicus
cctgagagttattcggggtcgtaga

SEQ ID NO: 468862 - DNA, 25 bp, Rattus norvegicus
tgtctcgcctttaaccggtctccaa

SEQ ID NO: 468863 - DNA, 25 bp, Rattus norvegicus
cggggcctttagagccctctagaag

SEQ ID NO: 468864 - DNA, 25 bp, Rattus norvegicus
gtggtcccagcccttgtgcgaggca

SEQ ID NO: 468865 - DNA, 25 bp, Rattus norvegicus
tagagccctctagaagcgcagagtc

SEQ ID NO: 468866 - DNA, 25 bp, Rattus norvegicus
tctagaagcgcagagtccgatgacc

SEQ ID NO: 468867 - DNA, 25 bp, Rattus norvegicus
gaagcgcagagtccgatgaccggca

SEQ ID NO: 468868 - DNA, 25 bp, Rattus norvegicus
gtctccaattgttccgaccggtgtg

SEQ ID NO: 468869 - DNA, 25 bp, Rattus norvegicus
tgcgtgtcctcccaaggacagagtg

SEQ ID NO: 468870 - DNA, 25 bp, Rattus norvegicus
cagggcagtggccaagcgaactccg

SEQ ID NO: 468871 - DNA, 25 bp, Rattus norvegicus
gaactccggccgcacccacactcac

SEQ ID NO: 468872 - DNA, 25 bp, Rattus norvegicus
cccacactcacgctgcgggccgagg

SEQ ID NO: 468873 - DNA, 25 bp, Rattus norvegicus
agtcgagggacagggcacgctatcc

SEQ ID NO: 468874 - DNA, 25 bp, Rattus norvegicus
agggacagggcacgctatccgacac

SEQ ID NO: 468875 - DNA, 25 bp, Rattus norvegicus
cagcccttgtgcgaggcagcggcct

SEQ ID NO: 468876 - DNA, 25 bp, Rattus norvegicus
tccatccaggaaaggctggaacccg

SEQ ID NO: 468877 - DNA, 25 bp, Rattus norvegicus
agctccgaagcctcagtggccacgg

SEQ ID NO: 468878 - DNA, 25 bp, Rattus norvegicus
cctctacttccctctgcggtgaagg

SEQ ID NO: 468879 - DNA, 25 bp, Rattus norvegicus
aaagcagcccgctctcgggagccga

SEQ ID NO: 468880 - DNA, 25 bp, Rattus norvegicus
cctcacctggatagcctcggggagt

SEQ ID NO: 468881 - DNA, 25 bp, Rattus norvegicus
tggccacggaaagcccagagcaatg

SEQ ID NO: 468882 - DNA, 25 bp, Rattus norvegicus
ctccgcgacagacgttaagaggctc

SEQ ID NO: 468883 - DNA, 25 bp, Rattus norvegicus
ctctcacggaaaaagccggaacagc

SEQ ID NO: 468884 - DNA, 25 bp, Rattus norvegicus
ccggaacagctgcaaagtgacagca

SEQ ID NO: 468885 - DNA, 25 bp, Rattus norvegicus
cacgtgaccgcagtggaccgcggaa

SEQ ID NO: 468886 - DNA, 25 bp, Rattus norvegicus
ccgagagggcccaaaagtgctagca

SEQ ID NO: 468887 - DNA, 25 bp, Rattus norvegicus
aaagtgctagcaccgcgcactaggc

SEQ ID NO: 468888 - DNA, 25 bp, Rattus norvegicus
ggtcccaggtagaaccggctccatc

SEQ ID NO: 468889 - DNA, 25 bp, Rattus norvegicus
cagagcaatgggaaggcgactccgc

SEQ ID NO: 468890 - DNA, 25 bp, Rattus norvegicus
cccattcaaatttcagtggttctcc

SEQ ID NO: 468891 - DNA, 25 bp, Rattus norvegicus
tgggtcccgcgctgcacacttgtcg

SEQ ID NO: 468892 - DNA, 25 bp, Rattus norvegicus
acgccagcggagtcgcttcactctg

SEQ ID NO: 468893 - DNA, 25 bp, Rattus norvegicus
ttctggagccgcatcttcgcggagg

SEQ ID NO: 468894 - DNA, 25 bp, Rattus norvegicus
caggctccgctacctggttctggag

SEQ ID NO: 468895 - DNA, 25 bp, Rattus norvegicus
gtccacaggccggtggcgaccacgt

SEQ ID NO: 468896 - DNA, 25 bp, Rattus norvegicus
ccctgagtgccggacagggacgcat

SEQ ID NO: 468897 - DNA, 25 bp, Rattus norvegicus
cccggccgcctaactagggatcagg

SEQ ID NO: 468898 - DNA, 25 bp, Rattus norvegicus
atcagttcagcaaagccacccagag

SEQ ID NO: 468899 - DNA, 25 bp, Rattus norvegicus
ttcggcgccatcagttcagcaaagc

SEQ ID NO: 468900 - DNA, 25 bp, Rattus norvegicus
ggccggacttttcggcgccatcagt

SEQ ID NO: 468901 - DNA, 25 bp, Rattus norvegicus
ggagaagaggcacccattcaaattt

SEQ ID NO: 468902 - DNA, 25 bp, Rattus norvegicus
gacagggacgcatggtccacaggcc

SEQ ID NO: 468903 - DNA, 25 bp, Rattus norvegicus
ggacttggaagctcaatcccgaccc

SEQ ID NO: 468904 - DNA, 25 bp, Rattus norvegicus
gagcctcggctgcacgctctcctct

SEQ ID NO: 468905 - DNA, 25 bp, Rattus norvegicus
gacaacaaaaatggcggagcggagc

SEQ ID NO: 468906 - DNA, 25 bp, Rattus norvegicus
tgacagacaacaaaaatggcggagc

SEQ ID NO: 468907 - DNA, 25 bp, Rattus norvegicus
gtgggctcattgactgacagacaac

SEQ ID NO: 468908 - DNA, 25 bp, Rattus norvegicus
gcgtgggctcattgactgacagaca

SEQ ID NO: 468909 - DNA, 25 bp, Rattus norvegicus
tttagcgtgggctcattgactgaca

SEQ ID NO: 468910 - DNA, 25 bp, Rattus norvegicus
gtggttttagcgtgggctcattgac

SEQ ID NO: 468911 - DNA, 25 bp, Rattus norvegicus
cccggtggttttagcgtgggctcat

SEQ ID NO: 468912 - DNA, 25 bp, Rattus norvegicus
gtcagcccgcggatcccaccgctcg

SEQ ID NO: 468913 - DNA, 25 bp, Rattus norvegicus
agccttttctgtcagcccgcggatc

SEQ ID NO: 468914 - DNA, 25 bp, Rattus norvegicus
gagggagccttttctgtcagcccgc

SEQ ID NO: 468915 - DNA, 25 bp, Rattus norvegicus
cgctgcgcagcgtcttcctgaggga

SEQ ID NO: 468916 - DNA, 25 bp, Rattus norvegicus
ggtttccctggcaaccgctgcgcag

SEQ ID NO: 468917 - DNA, 25 bp, Rattus norvegicus
ggcggctggtttccctggcaaccgc

SEQ ID NO: 468918 - DNA, 25 bp, Rattus norvegicus
cgcaagtggcggtgcgcttcaaaac

SEQ ID NO: 468919 - DNA, 25 bp, Rattus norvegicus
ttgttgaaactactgaatccggccg

SEQ ID NO: 468920 - DNA, 25 bp, Rattus norvegicus
tgaatccggccgaaagcgactttta

SEQ ID NO: 468921 - DNA, 25 bp, Rattus norvegicus
ttaacagtgcttctcctaccctgca

SEQ ID NO: 468922 - DNA, 25 bp, Rattus norvegicus
ccctgcaacgcaactatcattatta

SEQ ID NO: 468923 - DNA, 25 bp, Rattus norvegicus
aggcgattgtatctccgctctttcc

SEQ ID NO: 468924 - DNA, 25 bp, Rattus norvegicus
gtgattgctcgggtctgacttcgca

SEQ ID NO: 468925 - DNA, 25 bp, Rattus norvegicus
cccaggcgaaagcagccgattggca

SEQ ID NO: 468926 - DNA, 25 bp, Rattus norvegicus
agcggggctttcaggaacaataaca

SEQ ID NO: 468927 - DNA, 25 bp, Rattus norvegicus
ggcgcccaccatgtacgcctttgtg

SEQ ID NO: 468928 - DNA, 25 bp, Rattus norvegicus
ggttcctggaggacaacgtctgcta

SEQ ID NO: 468929 - DNA, 25 bp, Rattus norvegicus
tcgcgactggattttgacaaccaga

SEQ ID NO: 468930 - DNA, 25 bp, Rattus norvegicus
caaccagaaggtgtacgcggtgtac

SEQ ID NO: 468931 - DNA, 25 bp, Rattus norvegicus
ttactcaatcgcactccggctgtga

SEQ ID NO: 468932 - DNA, 25 bp, Rattus norvegicus
aggcgctgcaatgcgccctggcgct

SEQ ID NO: 468933 - DNA, 25 bp, Rattus norvegicus
ctagtcccgcctcggcgtggctctt

SEQ ID NO: 468934 - DNA, 25 bp, Rattus norvegicus
tccaggctgccatgacaacgtgtcc

SEQ ID NO: 468935 - DNA, 25 bp, Rattus norvegicus
ggctgccatgacaacgtgtccgcgc

SEQ ID NO: 468936 - DNA, 25 bp, Rattus norvegicus
tcagctgctgttcgggcgggaccca

SEQ ID NO: 468937 - DNA, 25 bp, Rattus norvegicus
accctgcgcggatgccgaaggtgaa

SEQ ID NO: 468938 - DNA, 25 bp, Rattus norvegicus
aaggtgaaggcgctgcaatgcgccc

SEQ ID NO: 468939 - DNA, 25 bp, Rattus norvegicus
gctggagatccgctctgtgagtacc

SEQ ID NO: 468940 - DNA, 25 bp, Rattus norvegicus
atccgctctgtgagtaccggccttg

SEQ ID NO: 468941 - DNA, 25 bp, Rattus norvegicus
gctctgtgagtaccggccttgtcca

SEQ ID NO: 468942 - DNA, 25 bp, Rattus norvegicus
gtgagtaccggccttgtccagcctc

SEQ ID NO: 468943 - DNA, 25 bp, Rattus norvegicus
ctccgcctccaagtccgccgcccac

SEQ ID NO: 468944 - DNA, 25 bp, Rattus norvegicus
ccctggcgctggagatccgctctgt

SEQ ID NO: 468945 - DNA, 25 bp, Rattus norvegicus
gcccactgtctctcgctctggctag

SEQ ID NO: 468946 - DNA, 25 bp, Rattus norvegicus
agaagatcctcggtgcccagctggg

SEQ ID NO: 468947 - DNA, 25 bp, Rattus norvegicus
cgcccggatcggtgagcgagcgcct

SEQ ID NO: 468948 - DNA, 25 bp, Rattus norvegicus
cgcaacccccggacggaggacagtg

SEQ ID NO: 468949 - DNA, 25 bp, Rattus norvegicus
ctgctagccgccctccttgccaccg

SEQ ID NO: 468950 - DNA, 25 bp, Rattus norvegicus
cccggcaggatgcacgccgccctgg

SEQ ID NO: 468951 - DNA, 25 bp, Rattus norvegicus
tccagaagatcctcggtgcccagct

SEQ ID NO: 468952 - DNA, 25 bp, Rattus norvegicus
tgtgctccagaagatcctcggtgcc

SEQ ID NO: 468953 - DNA, 25 bp, Rattus norvegicus
gcgcctggagccctgtgctccagaa

SEQ ID NO: 468954 - DNA, 25 bp, Rattus norvegicus
tctcgcagaattccggggctcggcc

SEQ ID NO: 468955 - DNA, 25 bp, Rattus norvegicus
ccagcgggctcccagcatctcgcgc

SEQ ID NO: 468956 - DNA, 25 bp, Rattus norvegicus
gcgctctcgcagaattccggggctc

SEQ ID NO: 468957 - DNA, 25 bp, Rattus norvegicus
gcagaattccggggctcggccaacc

SEQ ID NO: 468958 - DNA, 25 bp, Rattus norvegicus
cctgcgctctcgcagaattccgggg

SEQ ID NO: 468959 - DNA, 25 bp, Rattus norvegicus
agcatctcgcgcctggagccctgtg

SEQ ID NO: 468960 - DNA, 25 bp, Rattus norvegicus
gccttgatccggacgccagtcactt

SEQ ID NO: 468961 - DNA, 25 bp, Rattus norvegicus
gatccggacgccagtcacttggttg

SEQ ID NO: 468962 - DNA, 25 bp, Rattus norvegicus
gccagtcacttggttgtgtgtgccc

SEQ ID NO: 468963 - DNA, 25 bp, Rattus norvegicus
acaagttccggaagccgcgtgcgaa

SEQ ID NO: 468964 - DNA, 25 bp, Rattus norvegicus
cccagggtctatgcgacggccacgt

SEQ ID NO: 468965 - DNA, 25 bp, Rattus norvegicus
tgagccctctccacccggctaaggc

SEQ ID NO: 468966 - DNA, 25 bp, Rattus norvegicus
acagcttttgtgtgtccaacggggt

SEQ ID NO: 468967 - DNA, 25 bp, Rattus norvegicus
agaggcctctaggacaagttccgga

SEQ ID NO: 468968 - DNA, 25 bp, Rattus norvegicus
tttgtgtgtccaacggggtgtgtct

SEQ ID NO: 468969 - DNA, 25 bp, Rattus norvegicus
tgtgtctggagaggcctctaggaca

SEQ ID NO: 468970 - DNA, 25 bp, Rattus norvegicus
tccacccggctaaggccggccttga

SEQ ID NO: 468971 - DNA, 25 bp, Rattus norvegicus
ctctaggacaagttccggaagccgc

SEQ ID NO: 468972 - DNA, 25 bp, Rattus norvegicus
cccggcgacagcttttgtgtgtcca

SEQ ID NO: 468973 - DNA, 25 bp, Rattus norvegicus
tccggaagccgcgtgcgaaccggca

SEQ ID NO: 468974 - DNA, 25 bp, Rattus norvegicus
ggaggtcgcccgcaccggaatacgc

SEQ ID NO: 468975 - DNA, 25 bp, Rattus norvegicus
gagatcccgtctgaaggtacaagta

SEQ ID NO: 468976 - DNA, 25 bp, Rattus norvegicus
ccgtctgaaggtacaagtatacgtc

SEQ ID NO: 468977 - DNA, 25 bp, Rattus norvegicus
gtacaagtatacgtcctctaaaaga

SEQ ID NO: 468978 - DNA, 25 bp, Rattus norvegicus
ctctaaaagatagaggcacgcctct

SEQ ID NO: 468979 - DNA, 25 bp, Rattus norvegicus
tagaggcacgcctctctgtccggcg

SEQ ID NO: 468980 - DNA, 25 bp, Rattus norvegicus
tctgcagctccaccgcggcttctcc

SEQ ID NO: 468981 - DNA, 25 bp, Rattus norvegicus
cctacacgctcacgcgacttcttga

SEQ ID NO: 468982 - DNA, 25 bp, Rattus norvegicus
acatctcgctaagggacaggcgtgg

SEQ ID NO: 468983 - DNA, 25 bp, Rattus norvegicus
ggaatacgccaaccggcaccacgct

SEQ ID NO: 468984 - DNA, 25 bp, Rattus norvegicus
ccagcggctgcccagcggaattacg

SEQ ID NO: 468985 - DNA, 25 bp, Rattus norvegicus
cccagcggaattacggtggctcacg

SEQ ID NO: 468986 - DNA, 25 bp, Rattus norvegicus
ctgcccagcggaattacggtggctc

SEQ ID NO: 468987 - DNA, 25 bp, Rattus norvegicus
caaccctaaacacatctcgctaagg

SEQ ID NO: 468988 - DNA, 25 bp, Rattus norvegicus
cagaaagtaaaaacacagctgactc

SEQ ID NO: 468989 - DNA, 25 bp, Rattus norvegicus
gcatgccaattacgcctgcaggcta

SEQ ID NO: 468990 - DNA, 25 bp, Rattus norvegicus
gctacaacggcgtgcatgccaatta

SEQ ID NO: 468991 - DNA, 25 bp, Rattus norvegicus
attaagcggtctcggctacaacggc

SEQ ID NO: 468992 - DNA, 25 bp, Rattus norvegicus
atgctttattaagcggtctcggcta

SEQ ID NO: 468993 - DNA, 25 bp, Rattus norvegicus
gcggtgagatatgtaatgctttatt

SEQ ID NO: 468994 - DNA, 25 bp, Rattus norvegicus
aatgaaatatggaagcggtgagata

SEQ ID NO: 468995 - DNA, 25 bp, Rattus norvegicus
gctccgcgtgaggtaatgaaatatg

SEQ ID NO: 468996 - DNA, 25 bp, Rattus norvegicus
gctgactcccattagggccctctca

SEQ ID NO: 468997 - DNA, 25 bp, Rattus norvegicus
caaagaatccactgagaagcccgtc

SEQ ID NO: 468998 - DNA, 25 bp, Rattus norvegicus
gcgtgcatcgcattatttcatttca

SEQ ID NO: 468999 - DNA, 25 bp, Rattus norvegicus
tcgcggcgtgcatcgcattatttca

SEQ ID NO: 469000 - DNA, 25 bp, Rattus norvegicus
tacggccggcccttatcgcggcgtg

SEQ ID NO: 469001 - DNA, 25 bp, Rattus norvegicus
cctctcacaggctccgcgtgaggta

SEQ ID NO: 469002 - DNA, 25 bp, Rattus norvegicus
gtgcctggactggaaatctgcaatc

SEQ ID NO: 469003 - DNA, 25 bp, Rattus norvegicus
gcctgggctctggaactggaaaagc

SEQ ID NO: 469004 - DNA, 25 bp, Rattus norvegicus
tctcattaaaatcggcgactgtgtc

SEQ ID NO: 469005 - DNA, 25 bp, Rattus norvegicus
cacgcacgctccagatttctcatta

SEQ ID NO: 469006 - DNA, 25 bp, Rattus norvegicus
agttcaaaggtgagcgcgccctagc

SEQ ID NO: 469007 - DNA, 25 bp, Rattus norvegicus
tcggattgccaaggtaaacagcgtc

SEQ ID NO: 469008 - DNA, 25 bp, Rattus norvegicus
ctgtaaaactgccactcggattgcc

SEQ ID NO: 469009 - DNA, 25 bp, Rattus norvegicus
ccctctggtcggtatttaatatctg

SEQ ID NO: 469010 - DNA, 25 bp, Rattus norvegicus
aagggatcccttggtgcagacagcc

SEQ ID NO: 469011 - DNA, 25 bp, Rattus norvegicus
atcgaattaggagacagccgggctg

SEQ ID NO: 469012 - DNA, 25 bp, Rattus norvegicus
ctcccgacacggaaaatcgaattag

SEQ ID NO: 469013 - DNA, 25 bp, Rattus norvegicus
ccaagagacgtgtgagcaaggccca

SEQ ID NO: 469014 - DNA, 25 bp, Rattus norvegicus
cccaataggtgagagcgctggcgac

SEQ ID NO: 469015 - DNA, 25 bp, Rattus norvegicus
aacagcgtccctggcagttcaaagg

SEQ ID NO: 469016 - DNA, 25 bp, Rattus norvegicus
ccgcgtggagcgaaaagaccacatt

SEQ ID NO: 469017 - DNA, 25 bp, Rattus norvegicus
ccagccgacggagaaacgccgaaca

SEQ ID NO: 469018 - DNA, 25 bp, Rattus norvegicus
cggagaaacgccgaacagcgagtcc

SEQ ID NO: 469019 - DNA, 25 bp, Rattus norvegicus
atgttgccagcagccgaacccacag

SEQ ID NO: 469020 - DNA, 25 bp, Rattus norvegicus
cgagtccgcgtggagcgaaaagacc

SEQ ID NO: 469021 - DNA, 25 bp, Rattus norvegicus
tggagcgaaaagaccacattgggca

SEQ ID NO: 469022 - DNA, 25 bp, Rattus norvegicus
gaaaagaccacattgggcagggacc

SEQ ID NO: 469023 - DNA, 25 bp, Rattus norvegicus
ccttttgcacaagcgctgagcccaa

SEQ ID NO: 469024 - DNA, 25 bp, Rattus norvegicus
tgcacaagcgctgagcccaaagatg

SEQ ID NO: 469025 - DNA, 25 bp, Rattus norvegicus
cgctgagcccaaagatggttggaaa

SEQ ID NO: 469026 - DNA, 25 bp, Rattus norvegicus
caaagatggttggaaacaatcccga

SEQ ID NO: 469027 - DNA, 25 bp, Rattus norvegicus
aatcccgagtatgttgccagcagcc

SEQ ID NO: 469028 - DNA, 25 bp, Rattus norvegicus
cgagtatgttgccagcagccgaacc

SEQ ID NO: 469029 - DNA, 25 bp, Rattus norvegicus
acgccgaacagcgagtccgcgtgga

SEQ ID NO: 469030 - DNA, 25 bp, Rattus norvegicus
ggctcgcctgcgaccctgggacttt

SEQ ID NO: 469031 - DNA, 25 bp, Rattus norvegicus
ttcgccacctttctagcctgctctc

SEQ ID NO: 469032 - DNA, 25 bp, Rattus norvegicus
ccaggagctcagagaagaggacgcc

SEQ ID NO: 469033 - DNA, 25 bp, Rattus norvegicus
ccagccacaggagattgttcttgtg

SEQ ID NO: 469034 - DNA, 25 bp, Rattus norvegicus
aggacgcctgtactgggaagagttc

SEQ ID NO: 469035 - DNA, 25 bp, Rattus norvegicus
ctgggactttccttctcagccaagc

SEQ ID NO: 469036 - DNA, 25 bp, Rattus norvegicus
gccgcctcctgtttctacttgtggc

SEQ ID NO: 469037 - DNA, 25 bp, Rattus norvegicus
cctgtttctacttgtggcctcaatg

SEQ ID NO: 469038 - DNA, 25 bp, Rattus norvegicus
tgtggcctcaatggcactgccagga

SEQ ID NO: 469039 - DNA, 25 bp, Rattus norvegicus
atggcactgccaggacgacctccga

SEQ ID NO: 469040 - DNA, 25 bp, Rattus norvegicus
gacctccgaggggtcgtcgtctgaa

SEQ ID NO: 469041 - DNA, 25 bp, Rattus norvegicus
ggtcgtcgtctgaagctgtcaagtc

SEQ ID NO: 469042 - DNA, 25 bp, Rattus norvegicus
gctgtcaagtccgagccaggagctc

SEQ ID NO: 469043 - DNA, 25 bp, Rattus norvegicus
ctgctctccagccacaggagattgt

SEQ ID NO: 469044 - DNA, 25 bp, Rattus norvegicus
tttcaacagattccaaaccctcttc

SEQ ID NO: 469045 - DNA, 25 bp, Rattus norvegicus
agtttaaataaacccgagcgcatag

SEQ ID NO: 469046 - DNA, 25 bp, Rattus norvegicus
cgctggaggaggcgaagtttaaata

SEQ ID NO: 469047 - DNA, 25 bp, Rattus norvegicus
attgagtgtgcactaccgcggcgct

SEQ ID NO: 469048 - DNA, 25 bp, Rattus norvegicus
gctcaccgagccttcaacttcattg

SEQ ID NO: 469049 - DNA, 25 bp, Rattus norvegicus
ggtcattgtcctttctggactgccc

SEQ ID NO: 469050 - DNA, 25 bp, Rattus norvegicus
ctggtcggtcattgtcctttctgga

SEQ ID NO: 469051 - DNA, 25 bp, Rattus norvegicus
aaaccagcctggtcggtcattgtcc

SEQ ID NO: 469052 - DNA, 25 bp, Rattus norvegicus
accctgggcgcagggaaaccagcct

SEQ ID NO: 469053 - DNA, 25 bp, Rattus norvegicus
ctttattcgcctgaccctgggcgca

SEQ ID NO: 469054 - DNA, 25 bp, Rattus norvegicus
tgcgtcggcgcctttattcgcctga

SEQ ID NO: 469055 - DNA, 25 bp, Rattus norvegicus
cgtcgtttaaactgcgtcggcgcct

SEQ ID NO: 469056 - DNA, 25 bp, Rattus norvegicus
cttgcaaggaccgtcgtttaaactg

SEQ ID NO: 469057 - DNA, 25 bp, Rattus norvegicus
caacttcattgagtgtgcactaccg

SEQ ID NO: 469058 - DNA, 25 bp, Rattus norvegicus
ccaccacgtctatatctgcgtcggg

SEQ ID NO: 469059 - DNA, 25 bp, Rattus norvegicus
gtgcagggcgcacccaaccagtgct

SEQ ID NO: 469060 - DNA, 25 bp, Rattus norvegicus
ctggactttcactgtgcagggcgca

SEQ ID NO: 469061 - DNA, 25 bp, Rattus norvegicus
ccctggtgttgagactcctggactt

SEQ ID NO: 469062 - DNA, 25 bp, Rattus norvegicus
tgcctctccgaccagtgttttgcgc

SEQ ID NO: 469063 - DNA, 25 bp, Rattus norvegicus
gcaacagcagctgcccagggtcatg

SEQ ID NO: 469064 - DNA, 25 bp, Rattus norvegicus
gaggacatgatctcgcaacagcagc

SEQ ID NO: 469065 - DNA, 25 bp, Rattus norvegicus
tctatatctgcgtcgggctcggaca

SEQ ID NO: 469066 - DNA, 25 bp, Rattus norvegicus
tggttttaccagagggctccgtgtc

SEQ ID NO: 469067 - DNA, 25 bp, Rattus norvegicus
cgcaatgtacgaataaggtggtttt

SEQ ID NO: 469068 - DNA, 25 bp, Rattus norvegicus
aacatatcggccgactccgggtcga

SEQ ID NO: 469069 - DNA, 25 bp, Rattus norvegicus
cgttgtcgaacatatcggccgactc

SEQ ID NO: 469070 - DNA, 25 bp, Rattus norvegicus
cagaggctgccgcttgaagcgcttg

SEQ ID NO: 469071 - DNA, 25 bp, Rattus norvegicus
gggagctctcggaggacatgatctc

SEQ ID NO: 469072 - DNA, 25 bp, Rattus norvegicus
cccagcaggctgtccaggcggaaga

SEQ ID NO: 469073 - DNA, 25 bp, Rattus norvegicus
gatcacaccacgctgcgggcgggca

SEQ ID NO: 469074 - DNA, 25 bp, Rattus norvegicus
gggcgggcagcaccacagacaagct

SEQ ID NO: 469075 - DNA, 25 bp, Rattus norvegicus
ctccctcagaagagaggctcacagg

SEQ ID NO: 469076 - DNA, 25 bp, Rattus norvegicus
agaggctcacaggtagcgctccagc

SEQ ID NO: 469077 - DNA, 25 bp, Rattus norvegicus
gtgcgccagggccatagcgataaga

SEQ ID NO: 469078 - DNA, 25 bp, Rattus norvegicus
gtgcgcatccatgtgctaggatcta

SEQ ID NO: 469079 - DNA, 25 bp, Rattus norvegicus
cagctcggtgcgcttaaagcgcttg

SEQ ID NO: 469080 - DNA, 25 bp, Rattus norvegicus
ctgttctgccacttgcgcgggctgt

SEQ ID NO: 469081 - DNA, 25 bp, Rattus norvegicus
ccggagaaagcgacgtgcgcatcca

SEQ ID NO: 469082 - DNA, 25 bp, Rattus norvegicus
gatgtacgagtaaggcggcttccca

SEQ ID NO: 469083 - DNA, 25 bp, Rattus norvegicus
ccatagcgataagagcgatgtacga

SEQ ID NO: 469084 - DNA, 25 bp, Rattus norvegicus
agccgatcctgccaaggccaggaga

SEQ ID NO: 469085 - DNA, 25 bp, Rattus norvegicus
cggctgtctcaggtaggcttctccg

SEQ ID NO: 469086 - DNA, 25 bp, Rattus norvegicus
aagctcgggaccaggacgtgcagca

SEQ ID NO: 469087 - DNA, 25 bp, Rattus norvegicus
ccgatcccagaggagaagcaagggc

SEQ ID NO: 469088 - DNA, 25 bp, Rattus norvegicus
cgcgcggaaacaaagcggacacagc

SEQ ID NO: 469089 - DNA, 25 bp, Rattus norvegicus
acgaacacgaccaacggcttcatga

SEQ ID NO: 469090 - DNA, 25 bp, Rattus norvegicus
ttcatgagttggagagggaagaacc

SEQ ID NO: 469091 - DNA, 25 bp, Rattus norvegicus
ctaccacaagatccgggtcaggttc

SEQ ID NO: 469092 - DNA, 25 bp, Rattus norvegicus
ctgacagccagggatgtagcgagaa

SEQ ID NO: 469093 - DNA, 25 bp, Rattus norvegicus
gaagaaccgcagtccgcgggttagc

SEQ ID NO: 469094 - DNA, 25 bp, Rattus norvegicus
ccagcgacgacagctgctcagcata

SEQ ID NO: 469095 - DNA, 25 bp, Rattus norvegicus
tgctcagcatacaacgcgcctctga

SEQ ID NO: 469096 - DNA, 25 bp, Rattus norvegicus
gacagcttccgctcgcgattccggt

SEQ ID NO: 469097 - DNA, 25 bp, Rattus norvegicus
ctcgcgattccggttcttcctagcg

SEQ ID NO: 469098 - DNA, 25 bp, Rattus norvegicus
cggattagccgagcactgacagcca

SEQ ID NO: 469099 - DNA, 25 bp, Rattus norvegicus
tcaggttccacgaggcggattagcc

SEQ ID NO: 469100 - DNA, 25 bp, Rattus norvegicus
aaaaccttgggattgggcgagcgct

SEQ ID NO: 469101 - DNA, 25 bp, Rattus norvegicus
gtggatcttcgtgctcctggttccc

SEQ ID NO: 469102 - DNA, 25 bp, Rattus norvegicus
caaaaccctagcttggcggcggccg

SEQ ID NO: 469103 - DNA, 25 bp, Rattus norvegicus
ggagccttctgcgtgcccaacaaac

SEQ ID NO: 469104 - DNA, 25 bp, Rattus norvegicus
gcatgcgttttgctaactccagcca

SEQ ID NO: 469105 - DNA, 25 bp, Rattus norvegicus
gggcttccggccaatcagcaggcgc

SEQ ID NO: 469106 - DNA, 25 bp, Rattus norvegicus
atgcagctgagtcgttgtgtgacac

SEQ ID NO: 469107 - DNA, 25 bp, Rattus norvegicus
ggttgtcacagcagtatgcagctga

SEQ ID NO: 469108 - DNA, 25 bp, Rattus norvegicus
cgggctccgattggttgtcacagca

SEQ ID NO: 469109 - DNA, 25 bp, Rattus norvegicus
attgggcgagcgctaatcccaggcc

SEQ ID NO: 469110 - DNA, 25 bp, Rattus norvegicus
gcggcggcgccctcggttctctaaa

SEQ ID NO: 469111 - DNA, 25 bp, Rattus norvegicus
agtagtgacacaccgagctgcggcg

SEQ ID NO: 469112 - DNA, 25 bp, Rattus norvegicus
ggtttaaatcctcagagtagtgaca

SEQ ID NO: 469113 - DNA, 25 bp, Rattus norvegicus
ttgtgtgacactcttagtaccgccc

SEQ ID NO: 469114 - DNA, 25 bp, Rattus norvegicus
ctcagcagcgctcggacaaagcgct

SEQ ID NO: 469115 - DNA, 25 bp, Rattus norvegicus
gaggcgctccgaatttcctgcccga

SEQ ID NO: 469116 - DNA, 25 bp, Rattus norvegicus
tccgaatttcctgcccgaccgaggc

SEQ ID NO: 469117 - DNA, 25 bp, Rattus norvegicus
gccgccgcgtcactggctcagcagc

SEQ ID NO: 469118 - DNA, 25 bp, Rattus norvegicus
agcgctgaccgacaggcaccagatg

SEQ ID NO: 469119 - DNA, 25 bp, Rattus norvegicus
cggacaaagcgctgaccgacaggca

SEQ ID NO: 469120 - DNA, 25 bp, Rattus norvegicus
tgaccgacaggcaccagatgctatt

SEQ ID NO: 469121 - DNA, 25 bp, Rattus norvegicus
accagatgctatttcaggcggcgcc

SEQ ID NO: 469122 - DNA, 25 bp, Rattus norvegicus
gatgctatttcaggcggcgcccggc

SEQ ID NO: 469123 - DNA, 25 bp, Rattus norvegicus
ttagcgcgcagtttccgtttttcca

SEQ ID NO: 469124 - DNA, 25 bp, Rattus norvegicus
agcgcgcagtttccgtttttccacg

SEQ ID NO: 469125 - DNA, 25 bp, Rattus norvegicus
tcggaaacagggagcccggagcctg

SEQ ID NO: 469126 - DNA, 25 bp, Rattus norvegicus
agggctggcatttcctggccgccgc

SEQ ID NO: 469127 - DNA, 25 bp, Rattus norvegicus
acaggcaccagatgctatttcaggc

SEQ ID NO: 469128 - DNA, 25 bp, Rattus norvegicus
cacgcccattgctgcatcgatgaca

SEQ ID NO: 469129 - DNA, 25 bp, Rattus norvegicus
tcctataaacagagccggcgcctga

SEQ ID NO: 469130 - DNA, 25 bp, Rattus norvegicus
ttagtcctataaacagagccggcgc

SEQ ID NO: 469131 - DNA, 25 bp, Rattus norvegicus
gggagcacagtcgttcccctatctg

SEQ ID NO: 469132 - DNA, 25 bp, Rattus norvegicus
ctgcatcgatgacaggatgtgaaga

SEQ ID NO: 469133 - DNA, 25 bp, Rattus norvegicus
tattggcgctatctgagctcccacg

SEQ ID NO: 469134 - DNA, 25 bp, Rattus norvegicus
cgtgaatacatatttattggcgcta

SEQ ID NO: 469135 - DNA, 25 bp, Rattus norvegicus
caggccgatcgtgaatacatattta

SEQ ID NO: 469136 - DNA, 25 bp, Rattus norvegicus
ccggagcaggccgatcgtgaataca

SEQ ID NO: 469137 - DNA, 25 bp, Rattus norvegicus
aaaagcatgcatttcccggagcagg

SEQ ID NO: 469138 - DNA, 25 bp, Rattus norvegicus
ctcccgtatttcagaaaaagcatgc

SEQ ID NO: 469139 - DNA, 25 bp, Rattus norvegicus
ttcccgttatctcccgtatttcaga

SEQ ID NO: 469140 - DNA, 25 bp, Rattus norvegicus
ctatctgccacgtactttcccgtta

SEQ ID NO: 469141 - DNA, 25 bp, Rattus norvegicus
gcgaggttgttagtcctataaacag

SEQ ID NO: 469142 - DNA, 25 bp, Rattus norvegicus
agccctctgcgttttattcgttgta

SEQ ID NO: 469143 - DNA, 25 bp, Rattus norvegicus
cggggagcgggatttcacattttat

SEQ ID NO: 469144 - DNA, 25 bp, Rattus norvegicus
gtaaaacgtgagcatcccggccttc

SEQ ID NO: 469145 - DNA, 25 bp, Rattus norvegicus
agccgtctcccgtggaattgcccgt

SEQ ID NO: 469146 - DNA, 25 bp, Rattus norvegicus
ccctttgcgcaatagacagaaaatc

SEQ ID NO: 469147 - DNA, 25 bp, Rattus norvegicus
accaagagtcctgtgcctgtgtgcc

SEQ ID NO: 469148 - DNA, 25 bp, Rattus norvegicus
tgtgtggtcctgtccaccaagagtc

SEQ ID NO: 469149 - DNA, 25 bp, Rattus norvegicus
agctggcgtgtgttcatctgcttcc

SEQ ID NO: 469150 - DNA, 25 bp, Rattus norvegicus
gttggacagtatgccggtctgccta

SEQ ID NO: 469151 - DNA, 25 bp, Rattus norvegicus
agcctttgcgtgtgactgatgttac

SEQ ID NO: 469152 - DNA, 25 bp, Rattus norvegicus
cccacccagtgaggttgtgtgtctg

SEQ ID NO: 469153 - DNA, 25 bp, Rattus norvegicus
tgttaggctggcttcgtaatgtccg

SEQ ID NO: 469154 - DNA, 25 bp, Rattus norvegicus
tgtcctttagaggtgcgtttgcaaa

SEQ ID NO: 469155 - DNA, 25 bp, Rattus norvegicus
ttcttttctctacgaggtcggtctg

SEQ ID NO: 469156 - DNA, 25 bp, Rattus norvegicus
cttcacgccagcaggattggggtgt

SEQ ID NO: 469157 - DNA, 25 bp, Rattus norvegicus
tgtgcgtccacgtggcgctgagttt

SEQ ID NO: 469158 - DNA, 25 bp, Rattus norvegicus
tggcgctgagtttgtccgcttttca

SEQ ID NO: 469159 - DNA, 25 bp, Rattus norvegicus
ccgcttttcaggtttcagtgcgtga

SEQ ID NO: 469160 - DNA, 25 bp, Rattus norvegicus
ttcagtgcgtgatctcttctctgtc

SEQ ID NO: 469161 - DNA, 25 bp, Rattus norvegicus
taccctgttacaggatgacggagcg

SEQ ID NO: 469162 - DNA, 25 bp, Rattus norvegicus
cggcacgcagtgaccctcaactaga

SEQ ID NO: 469163 - DNA, 25 bp, Rattus norvegicus
gggtgcccaccaccgagctgtgcag

SEQ ID NO: 469164 - DNA, 25 bp, Rattus norvegicus
accctcaactagaggggcaggaggc

SEQ ID NO: 469165 - DNA, 25 bp, Rattus norvegicus
tagtcctgctcaacggcgtcaccaa

SEQ ID NO: 469166 - DNA, 25 bp, Rattus norvegicus
tcaccaaggaaacgaaccgcgcagc

SEQ ID NO: 469167 - DNA, 25 bp, Rattus norvegicus
ccagtcatcgagctaggcgcgcgca

SEQ ID NO: 469168 - DNA, 25 bp, Rattus norvegicus
actgaagctcgccatcgggtgccca

SEQ ID NO: 469169 - DNA, 25 bp, Rattus norvegicus
gcaggcccttcacgccagcaggatt

SEQ ID NO: 469170 - DNA, 25 bp, Rattus norvegicus
ggccaggccgctgcttaatgaccct

SEQ ID NO: 469171 - DNA, 25 bp, Rattus norvegicus
ccacctgccggactggtcggatcag

SEQ ID NO: 469172 - DNA, 25 bp, Rattus norvegicus
tgcttaatgaccctcgcggggccta

SEQ ID NO: 469173 - DNA, 25 bp, Rattus norvegicus
atctcagactgtcagccgcacggtg

SEQ ID NO: 469174 - DNA, 25 bp, Rattus norvegicus
ccggctcctggaggagactgataac

SEQ ID NO: 469175 - DNA, 25 bp, Rattus norvegicus
tcctggaggagactgataacgcacc

SEQ ID NO: 469176 - DNA, 25 bp, Rattus norvegicus
gactgataacgcaccagctgggccc

SEQ ID NO: 469177 - DNA, 25 bp, Rattus norvegicus
tctactgggccgcatcaagggtccc

SEQ ID NO: 469178 - DNA, 25 bp, Rattus norvegicus
catcaagggtccctaggggcggcct

SEQ ID NO: 469179 - DNA, 25 bp, Rattus norvegicus
cgctggggagaggacccgtaactct

SEQ ID NO: 469180 - DNA, 25 bp, Rattus norvegicus
agaggacccgtaactctcgagtgac

SEQ ID NO: 469181 - DNA, 25 bp, Rattus norvegicus
ccgtaactctcgagtgaccaggggc

SEQ ID NO: 469182 - DNA, 25 bp, Rattus norvegicus
aagaccctcgtccttatcaccagtt

SEQ ID NO: 469183 - DNA, 25 bp, Rattus norvegicus
gcggggcctaatctcagactgtcag

SEQ ID NO: 469184 - DNA, 25 bp, Rattus norvegicus
tccgctctaggctgcagcggtcagc

SEQ ID NO: 469185 - DNA, 25 bp, Rattus norvegicus
gccacgcgaaagtgatcaacccgaa

SEQ ID NO: 469186 - DNA, 25 bp, Rattus norvegicus
ccgtaccgaagccacgcgaaagtga

SEQ ID NO: 469187 - DNA, 25 bp, Rattus norvegicus
cgtctcttcaaactccgtaccgaag

SEQ ID NO: 469188 - DNA, 25 bp, Rattus norvegicus
tagggctgggatttctccaggctcc

SEQ ID NO: 469189 - DNA, 25 bp, Rattus norvegicus
ctagcagtagggctgggatttctcc

SEQ ID NO: 469190 - DNA, 25 bp, Rattus norvegicus
acttggagcacttcaggctggtgga

SEQ ID NO: 469191 - DNA, 25 bp, Rattus norvegicus
cggaacatttgacacttggagcact

SEQ ID NO: 469192 - DNA, 25 bp, Rattus norvegicus
gccggtggcggaacatttgacactt

SEQ ID NO: 469193 - DNA, 25 bp, Rattus norvegicus
agccagcacgtccagagaagccgcg

SEQ ID NO: 469194 - DNA, 25 bp, Rattus norvegicus
acgtcaccctggagcgcccaatggg

SEQ ID NO: 469195 - DNA, 25 bp, Rattus norvegicus
aactaggactccagatccagcccgg

SEQ ID NO: 469196 - DNA, 25 bp, Rattus norvegicus
tgatcaacccgaaacccagcgggcg

SEQ ID NO: 469197 - DNA, 25 bp, Rattus norvegicus
gggcggagcctactaactaggactc

SEQ ID NO: 469198 - DNA, 25 bp, Rattus norvegicus
tctagcacatctcccgcaccggctg

SEQ ID NO: 469199 - DNA, 25 bp, Rattus norvegicus
catccgttccgatgcggtgcgacgt

SEQ ID NO: 469200 - DNA, 25 bp, Rattus norvegicus
ttccgatgcggtgcgacgtacgctt

SEQ ID NO: 469201 - DNA, 25 bp, Rattus norvegicus
gcagcctgtccccaaaaatctgttc

SEQ ID NO: 469202 - DNA, 25 bp, Rattus norvegicus
ctgcccatgggctatatgcgctgcg

SEQ ID NO: 469203 - DNA, 25 bp, Rattus norvegicus
gcaccggctgcccatgggctatatg

SEQ ID NO: 469204 - DNA, 25 bp, Rattus norvegicus
ccggctcgatgacctcccgcctctg

SEQ ID NO: 469205 - DNA, 25 bp, Rattus norvegicus
tgcggaagcgcgctgagagtaccca

SEQ ID NO: 469206 - DNA, 25 bp, Rattus norvegicus
aaggtgctctagcacatctcccgca

SEQ ID NO: 469207 - DNA, 25 bp, Rattus norvegicus
cggctgcgaaggtgctctagcacat

SEQ ID NO: 469208 - DNA, 25 bp, Rattus norvegicus
ctatatgcgctgcggggcagcctgt

SEQ ID NO: 469209 - DNA, 25 bp, Rattus norvegicus
gaagcgcgctgagagtacccagccc

SEQ ID NO: 469210 - DNA, 25 bp, Rattus norvegicus
cctctgcctagctggggacccgcga

SEQ ID NO: 469211 - DNA, 25 bp, Rattus norvegicus
tgcggccattgttcgccgcgccgtt

SEQ ID NO: 469212 - DNA, 25 bp, Rattus norvegicus
atgcgcacggccaacggaggcccga

SEQ ID NO: 469213 - DNA, 25 bp, Rattus norvegicus
gcccgcattaggactagggagtacc

SEQ ID NO: 469214 - DNA, 25 bp, Rattus norvegicus
ctaaggcacactctagacgcatgcg

SEQ ID NO: 469215 - DNA, 25 bp, Rattus norvegicus
tgtaagaaaactaaggcacactcta

SEQ ID NO: 469216 - DNA, 25 bp, Rattus norvegicus
taggaaccgcgcttaaagtgtaaga

SEQ ID NO: 469217 - DNA, 25 bp, Rattus norvegicus
ccggagcttagacccagaaacgtag

SEQ ID NO: 469218 - DNA, 25 bp, Rattus norvegicus
actctagacgcatgcgcacggccaa

SEQ ID NO: 469219 - DNA, 25 bp, Rattus norvegicus
cgagccggggaattgccctgcccta

SEQ ID NO: 469220 - DNA, 25 bp, Rattus norvegicus
gaagagagaagagctccggagctta

SEQ ID NO: 469221 - DNA, 25 bp, Rattus norvegicus
cgctggcccgcattaggactaggga

SEQ ID NO: 469222 - DNA, 25 bp, Rattus norvegicus
aaaatcggggctccgctggcccgca

SEQ ID NO: 469223 - DNA, 25 bp, Rattus norvegicus
ctgcgattagaagagaggagccaaa

SEQ ID NO: 469224 - DNA, 25 bp, Rattus norvegicus
ccctatttcgctgcgattagaagag

SEQ ID NO: 469225 - DNA, 25 bp, Rattus norvegicus
ttagaagagaggagccaaaatcggg

SEQ ID NO: 469226 - DNA, 25 bp, Rattus norvegicus
cacgcggaacttcggtggcggaact

SEQ ID NO: 469227 - DNA, 25 bp, Rattus norvegicus
ttctacgaccgctaccgcgacaaga

SEQ ID NO: 469228 - DNA, 25 bp, Rattus norvegicus
tgggctgaaccgagagccgccagcc

SEQ ID NO: 469229 - DNA, 25 bp, Rattus norvegicus
gagccgccagccctaagagttgctg

SEQ ID NO: 469230 - DNA, 25 bp, Rattus norvegicus
aagagttgctgtccctgctccactc

SEQ ID NO: 469231 - DNA, 25 bp, Rattus norvegicus
cggaaccttgagcacgcggaacttc

SEQ ID NO: 469232 - DNA, 25 bp, Rattus norvegicus
ccatggcggctgtagtgtccgctgc

SEQ ID NO: 469233 - DNA, 25 bp, Rattus norvegicus
aggtggccggcctctaccgaggctt

SEQ ID NO: 469234 - DNA, 25 bp, Rattus norvegicus
ctctaccgaggcttgtgtgcggtgc

SEQ ID NO: 469235 - DNA, 25 bp, Rattus norvegicus
gggttcgtgtcacctgcacagttgc

SEQ ID NO: 469236 - DNA, 25 bp, Rattus norvegicus
tcagcgagctggaaactaacccttt

SEQ ID NO: 469237 - DNA, 25 bp, Rattus norvegicus
gctaccgcgacaagatccagcagct

SEQ ID NO: 469238 - DNA, 25 bp, Rattus norvegicus
gaactcgggcctcgcggacttagag

SEQ ID NO: 469239 - DNA, 25 bp, Rattus norvegicus
acctgcacagttgcgcgtgttcccg

SEQ ID NO: 469240 - DNA, 25 bp, Rattus norvegicus
cttggttctcgcgtagcaccttctg

SEQ ID NO: 469241 - DNA, 25 bp, Rattus norvegicus
cggagctggcgtctcctcgagcact

SEQ ID NO: 469242 - DNA, 25 bp, Rattus norvegicus
tctcctcgagcactggcggcgggac

SEQ ID NO: 469243 - DNA, 25 bp, Rattus norvegicus
cccagagcagactggtgggtagacg

SEQ ID NO: 469244 - DNA, 25 bp, Rattus norvegicus
gtgggtagacgctgagacccgcccg

SEQ ID NO: 469245 - DNA, 25 bp, Rattus norvegicus
gtcacaggcaggaggacgacccggc

SEQ ID NO: 469246 - DNA, 25 bp, Rattus norvegicus
gacagagacccggagctgtccactc

SEQ ID NO: 469247 - DNA, 25 bp, Rattus norvegicus
agctgtccactcagacggagcgggt

SEQ ID NO: 469248 - DNA, 25 bp, Rattus norvegicus
ctgtccactcagacggagcgggtga

SEQ ID NO: 469249 - DNA, 25 bp, Rattus norvegicus
cttcttggttctcgcgtagcacctt

SEQ ID NO: 469250 - DNA, 25 bp, Rattus norvegicus
ggttctcgcgtagcaccttctggga

SEQ ID NO: 469251 - DNA, 25 bp, Rattus norvegicus
tctcgcgtagcaccttctgggagcg

SEQ ID NO: 469252 - DNA, 25 bp, Rattus norvegicus
gcgtagcaccttctgggagcgaccc

SEQ ID NO: 469253 - DNA, 25 bp, Rattus norvegicus
tgcttccacttttagttcttcttgg

SEQ ID NO: 469254 - DNA, 25 bp, Rattus norvegicus
taaaagtgagccagcgaggagtccc

SEQ ID NO: 469255 - DNA, 25 bp, Rattus norvegicus
agtttagctccacctcttccgcgtt

SEQ ID NO: 469256 - DNA, 25 bp, Rattus norvegicus
acctcttccgcgttctcgactgaga

SEQ ID NO: 469257 - DNA, 25 bp, Rattus norvegicus
ttccgcgttctcgactgagacctgc

SEQ ID NO: 469258 - DNA, 25 bp, Rattus norvegicus
cgttctcgactgagacctgcaggtg

SEQ ID NO: 469259 - DNA, 25 bp, Rattus norvegicus
gtggtcaactaaggtaaaagtgagc

SEQ ID NO: 469260 - DNA, 25 bp, Rattus norvegicus
aagtgagccagcgaggagtccctcc

SEQ ID NO: 469261 - DNA, 25 bp, Rattus norvegicus
ccagcgaggagtccctccgcgggaa

SEQ ID NO: 469262 - DNA, 25 bp, Rattus norvegicus
cggtgcagtcaaccgggaggggcag

SEQ ID NO: 469263 - DNA, 25 bp, Rattus norvegicus
gcagtcagggccttcggagcagctc

SEQ ID NO: 469264 - DNA, 25 bp, Rattus norvegicus
ccttcggagcagctcgaggtcatga

SEQ ID NO: 469265 - DNA, 25 bp, Rattus norvegicus
tcgaggtcatgacccgattcttcta

SEQ ID NO: 469266 - DNA, 25 bp, Rattus norvegicus
ttctcgactgagacctgcaggtggg

SEQ ID NO: 469267 - DNA, 25 bp, Rattus norvegicus
gcagctcgaggtcatgacccgattc

SEQ ID NO: 469268 - DNA, 25 bp, Rattus norvegicus
cgtttactgatccagctctcccagg

SEQ ID NO: 469269 - DNA, 25 bp, Rattus norvegicus
gaactcaaaggagcgaaggcgagaa

SEQ ID NO: 469270 - DNA, 25 bp, Rattus norvegicus
acgtgtgctaggcttctcagctgga

SEQ ID NO: 469271 - DNA, 25 bp, Rattus norvegicus
ggagcccgacgagatttgccgccca

SEQ ID NO: 469272 - DNA, 25 bp, Rattus norvegicus
tgccgcccacactggaaaggggctc

SEQ ID NO: 469273 - DNA, 25 bp, Rattus norvegicus
cagcgcgaggatgctgtagaccaca

SEQ ID NO: 469274 - DNA, 25 bp, Rattus norvegicus
gtagaccacagccaggctctgctgt

SEQ ID NO: 469275 - DNA, 25 bp, Rattus norvegicus
actcactgccgatgctgccaaggtc

SEQ ID NO: 469276 - DNA, 25 bp, Rattus norvegicus
cgatgctgccaaggtctccactgaa

SEQ ID NO: 469277 - DNA, 25 bp, Rattus norvegicus
ccaaggtctccactgaagccgctga

SEQ ID NO: 469278 - DNA, 25 bp, Rattus norvegicus
tgaagccgctgagacccgacaaaga

SEQ ID NO: 469279 - DNA, 25 bp, Rattus norvegicus
cctacctagaggtcgtttactgatc

SEQ ID NO: 469280 - DNA, 25 bp, Rattus norvegicus
agctctcccaggtgaggcacggatc

SEQ ID NO: 469281 - DNA, 25 bp, Rattus norvegicus
ccgacaaagagaaactgaccgctca

SEQ ID NO: 469282 - DNA, 25 bp, Rattus norvegicus
agacctgggattcccgccggacgct

SEQ ID NO: 469283 - DNA, 25 bp, Rattus norvegicus
caagtgacgcctcgagacctgggat

SEQ ID NO: 469284 - DNA, 25 bp, Rattus norvegicus
gcggagcctatgagagtgcacaaaa

SEQ ID NO: 469285 - DNA, 25 bp, Rattus norvegicus
gtgcacaaaaccaacgctagcagcc

SEQ ID NO: 469286 - DNA, 25 bp, Rattus norvegicus
cagcccaaggttcccagtcggtctt

SEQ ID NO: 469287 - DNA, 25 bp, Rattus norvegicus
cagaagacagcggattcaaagaggt

SEQ ID NO: 469288 - DNA, 25 bp, Rattus norvegicus
gcggattcaaagaggtcactgggct

SEQ ID NO: 469289 - DNA, 25 bp, Rattus norvegicus
ctgggctggccggtgctcctcttac

SEQ ID NO: 469290 - DNA, 25 bp, Rattus norvegicus
gcatcagtttggctatcagctgtcc

SEQ ID NO: 469291 - DNA, 25 bp, Rattus norvegicus
tgtcccatggcactcccggagctgg

SEQ ID NO: 469292 - DNA, 25 bp, Rattus norvegicus
gccgagcacactgaggcgcagtcaa

SEQ ID NO: 469293 - DNA, 25 bp, Rattus norvegicus
ggacccgctgctcctatcagatgtg

SEQ ID NO: 469294 - DNA, 25 bp, Rattus norvegicus
tgctcctatcagatgtgggaatccc

SEQ ID NO: 469295 - DNA, 25 bp, Rattus norvegicus
ggctcccaaaaattcgcatcagttt

SEQ ID NO: 469296 - DNA, 25 bp, Rattus norvegicus
gcaaagaagagcacagagaccctga

SEQ ID NO: 469297 - DNA, 25 bp, Rattus norvegicus
ttcccgaagccttctgcggggcctg

SEQ ID NO: 469298 - DNA, 25 bp, Rattus norvegicus
ccgatgccacaagcaaagaagagca

SEQ ID NO: 469299 - DNA, 25 bp, Rattus norvegicus
cgtgctggcgcttggcttctttgct

SEQ ID NO: 469300 - DNA, 25 bp, Rattus norvegicus
cgggacacaacgtaccgctggtggt

SEQ ID NO: 469301 - DNA, 25 bp, Rattus norvegicus
gcgggccgatgccacaagcaaagaa

SEQ ID NO: 469302 - DNA, 25 bp, Rattus norvegicus
ggggcctgccgtcgcctgctctatg

SEQ ID NO: 469303 - DNA, 25 bp, Rattus norvegicus
ttctttgctgcctgctgcgtgtgca

SEQ ID NO: 469304 - DNA, 25 bp, Rattus norvegicus
cactgctcgtgctggcgcttggctt

SEQ ID NO: 469305 - DNA, 25 bp, Rattus norvegicus
ctgccgggacacaacgtaccgctgg

SEQ ID NO: 469306 - DNA, 25 bp, Rattus norvegicus
agctttctcaaccttcctgccggga

SEQ ID NO: 469307 - DNA, 25 bp, Rattus norvegicus
actggtgggagctttctcaaccttc

SEQ ID NO: 469308 - DNA, 25 bp, Rattus norvegicus
tggcaggcctgaacgtgacactggt

SEQ ID NO: 469309 - DNA, 25 bp, Rattus norvegicus
cctgctctatgctgtgcctgtggct

SEQ ID NO: 469310 - DNA, 25 bp, Rattus norvegicus
cgctacctgctctgcgggcgaatca

SEQ ID NO: 469311 - DNA, 25 bp, Rattus norvegicus
tcgttgctgccgctacctcacagaa

SEQ ID NO: 469312 - DNA, 25 bp, Rattus norvegicus
tccggtccagcccagtatcagtttc

SEQ ID NO: 469313 - DNA, 25 bp, Rattus norvegicus
tcaagtcgggcctgccaatttcggc

SEQ ID NO: 469314 - DNA, 25 bp, Rattus norvegicus
ccggtcggttcgatatccgagaatc

SEQ ID NO: 469315 - DNA, 25 bp, Rattus norvegicus
aatcctcagttcagtccggtccagc

SEQ ID NO: 469316 - DNA, 25 bp, Rattus norvegicus
gcgggcgaatcagcagctcagttta

SEQ ID NO: 469317 - DNA, 25 bp, Rattus norvegicus
agtatcagtttcgagcctgcggctc

SEQ ID NO: 469318 - DNA, 25 bp, Rattus norvegicus
tcgctagggccctgacagctttgcc

SEQ ID NO: 469319 - DNA, 25 bp, Rattus norvegicus
gggttcactggctcatttggtctca

SEQ ID NO: 469320 - DNA, 25 bp, Rattus norvegicus
ggtctcagtattcactctgtccagc

SEQ ID NO: 469321 - DNA, 25 bp, Rattus norvegicus
tcaataatctgactcccggtgctcc

SEQ ID NO: 469322 - DNA, 25 bp, Rattus norvegicus
tttcgggcctgtccgtacttacaga

SEQ ID NO: 469323 - DNA, 25 bp, Rattus norvegicus
agccctgtcagtcacggaatttatg

SEQ ID NO: 469324 - DNA, 25 bp, Rattus norvegicus
gggtgtgaaggcaagcgaaactcta

SEQ ID NO: 469325 - DNA, 25 bp, Rattus norvegicus
cccgcgagagtgcagctactatttc

SEQ ID NO: 469326 - DNA, 25 bp, Rattus norvegicus
tattggcgttgctagctgacatggc

SEQ ID NO: 469327 - DNA, 25 bp, Rattus norvegicus
gttgctagctgacatggctgcgccc

SEQ ID NO: 469328 - DNA, 25 bp, Rattus norvegicus
gctgcgcccgtattaagaggtgttc

SEQ ID NO: 469329 - DNA, 25 bp, Rattus norvegicus
ttaagaggtgttcgaaagctgctga

SEQ ID NO: 469330 - DNA, 25 bp, Rattus norvegicus
tgttcgaaagctgctgaagctcgcg

SEQ ID NO: 469331 - DNA, 25 bp, Rattus norvegicus
gaagctcgcggacttcacgccagtc

SEQ ID NO: 469332 - DNA, 25 bp, Rattus norvegicus
cttcacgccagtcccgcggagacat

SEQ ID NO: 469333 - DNA, 25 bp, Rattus norvegicus
tcagtcggagttattggcgttgcta

SEQ ID NO: 469334 - DNA, 25 bp, Rattus norvegicus
ccctttgccgctgttattctaagca

SEQ ID NO: 469335 - DNA, 25 bp, Rattus norvegicus
attctaagcagctctcaattctccc

SEQ ID NO: 469336 - DNA, 25 bp, Rattus norvegicus
gcagctactatttcagtcggagtta

SEQ ID NO: 469337 - DNA, 25 bp, Rattus norvegicus
aaggcaagcgaaactctaggggcgt

SEQ ID NO: 469338 - DNA, 25 bp, Rattus norvegicus
gtcaaaaagaagctttgtcccgcgc

SEQ ID NO: 469339 - DNA, 25 bp, Rattus norvegicus
tgtcccgcgccttagaatctcgata

SEQ ID NO: 469340 - DNA, 25 bp, Rattus norvegicus
gccaggcttgaccttgaccgttgga

SEQ ID NO: 469341 - DNA, 25 bp, Rattus norvegicus
cttgaccgttggagctactagcttg

SEQ ID NO: 469342 - DNA, 25 bp, Rattus norvegicus
tactagcttggctctcgctgcccgg

SEQ ID NO: 469343 - DNA, 25 bp, Rattus norvegicus
ttggtttgtgcgagccgagttctct

SEQ ID NO: 469344 - DNA, 25 bp, Rattus norvegicus
tgagcgaagtgtggaccacgctgtc

SEQ ID NO: 469345 - DNA, 25 bp, Rattus norvegicus
ccggggtttgcctagcctgcagctt

SEQ ID NO: 469346 - DNA, 25 bp, Rattus norvegicus
cgcggcagaagcagcgagccagcct

SEQ ID NO: 469347 - DNA, 25 bp, Rattus norvegicus
cctcctcgagctaatgcattcggtc

SEQ ID NO: 469348 - DNA, 25 bp, Rattus norvegicus
cattcggtcctctttctgcgccagg

SEQ ID NO: 469349 - DNA, 25 bp, Rattus norvegicus
tgctccgcctgccttaaaacgctgg

SEQ ID NO: 469350 - DNA, 25 bp, Rattus norvegicus
gggcgctgtactgggtcaaaaagaa

SEQ ID NO: 469351 - DNA, 25 bp, Rattus norvegicus
taaaacgctggcacgccgggaacca

SEQ ID NO: 469352 - DNA, 25 bp, Rattus norvegicus
cgggccatccgcctatttacggagc

SEQ ID NO: 469353 - DNA, 25 bp, Rattus norvegicus
aaacgagtgtctgcgcccggagcgc

SEQ ID NO: 469354 - DNA, 25 bp, Rattus norvegicus
gtctcgcctcagtcctgcagccttt

SEQ ID NO: 469355 - DNA, 25 bp, Rattus norvegicus
tgcagccttttcctccacccagtgt

SEQ ID NO: 469356 - DNA, 25 bp, Rattus norvegicus
cagtgtcctgctccgcagacaggac

SEQ ID NO: 469357 - DNA, 25 bp, Rattus norvegicus
tctaaaaacgagtgtctgcgcccgg

SEQ ID NO: 469358 - DNA, 25 bp, Rattus norvegicus
tgctccgcagacaggaccgcagagc

SEQ ID NO: 469359 - DNA, 25 bp, Rattus norvegicus
ccgggcgcccgcattaaagcgcata

SEQ ID NO: 469360 - DNA, 25 bp, Rattus norvegicus
gcccgcattaaagcgcatatgcaag

SEQ ID NO: 469361 - DNA, 25 bp, Rattus norvegicus
gcgcatatgcaagccatgaattatc

SEQ ID NO: 469362 - DNA, 25 bp, Rattus norvegicus
catgaattatcaactgaaaggagtc

SEQ ID NO: 469363 - DNA, 25 bp, Rattus norvegicus
tgaaaggagtcaattaccggctcta

SEQ ID NO: 469364 - DNA, 25 bp, Rattus norvegicus
taccggctctaaaaacgagtgtctg

SEQ ID NO: 469365 - DNA, 25 bp, Rattus norvegicus
tccgcctatttacggagcgatttcc

SEQ ID NO: 469366 - DNA, 25 bp, Rattus norvegicus
gcgcggccgctaacccgattatgca

SEQ ID NO: 469367 - DNA, 25 bp, Rattus norvegicus
acaaacccgcagacgcgcgctttgg

SEQ ID NO: 469368 - DNA, 25 bp, Rattus norvegicus
attcttccgggcacaccagggcaca

SEQ ID NO: 469369 - DNA, 25 bp, Rattus norvegicus
ctgggtgagctcagaccagcctggc

SEQ ID NO: 469370 - DNA, 25 bp, Rattus norvegicus
acccgattatgcagatccgcagggg

SEQ ID NO: 469371 - DNA, 25 bp, Rattus norvegicus
cccaatccggcaaatagagtcaatc

SEQ ID NO: 469372 - DNA, 25 bp, Rattus norvegicus
tccctaagtgacagcgagagaatcg

SEQ ID NO: 469373 - DNA, 25 bp, Rattus norvegicus
atcgcgctgagcttccctaagtgac

SEQ ID NO: 469374 - DNA, 25 bp, Rattus norvegicus
gggattaggccgcaaatcgcgctga

SEQ ID NO: 469375 - DNA, 25 bp, Rattus norvegicus
ttatgaagggaacaatctggcggcc

SEQ ID NO: 469376 - DNA, 25 bp, Rattus norvegicus
tcactagcgcgtcttaggctcaacc

SEQ ID NO: 469377 - DNA, 25 bp, Rattus norvegicus
taggctcaacctcgaggcccagcga

SEQ ID NO: 469378 - DNA, 25 bp, Rattus norvegicus
cggcgctttgaagtcccaatccggc

SEQ ID NO: 469379 - DNA, 25 bp, Rattus norvegicus
cgccctaagcggctagaggatttgg

SEQ ID NO: 469380 - DNA, 25 bp, Rattus norvegicus
gctaccaatcgatcgcgggagtctg

SEQ ID NO: 469381 - DNA, 25 bp, Rattus norvegicus
ccctggttgtcatgccggagagaca

SEQ ID NO: 469382 - DNA, 25 bp, Rattus norvegicus
cttgctaagagaccgcgttattttc

SEQ ID NO: 469383 - DNA, 25 bp, Rattus norvegicus
tatggcccgtctgaaactgaccgcg

SEQ ID NO: 469384 - DNA, 25 bp, Rattus norvegicus
ccagcgaagccgttctgaggtaacc

SEQ ID NO: 469385 - DNA, 25 bp, Rattus norvegicus
tcttggcaatgcgaaccacctcgtc

SEQ ID NO: 469386 - DNA, 25 bp, Rattus norvegicus
ccctaggtagtatcagtcgagcgcc

SEQ ID NO: 469387 - DNA, 25 bp, Rattus norvegicus
taagagtcggattaccctggttgtc

SEQ ID NO: 469388 - DNA, 25 bp, Rattus norvegicus
gcgcgcgcagtcctcttaatgtatt

SEQ ID NO: 469389 - DNA, 25 bp, Rattus norvegicus
cccttcagtctggaacttccggatc

SEQ ID NO: 469390 - DNA, 25 bp, Rattus norvegicus
ggatctttccggactctccttgctg

SEQ ID NO: 469391 - DNA, 25 bp, Rattus norvegicus
tcgcacccaggcctacttgctaaga

SEQ ID NO: 469392 - DNA, 25 bp, Rattus norvegicus
ctccttgctggagagttaagagtcg

SEQ ID NO: 469393 - DNA, 25 bp, Rattus norvegicus
tctggaaagcaaaagtcgctcgctc

SEQ ID NO: 469394 - DNA, 25 bp, Rattus norvegicus
taacctgtccaggagatggctcgtg

SEQ ID NO: 469395 - DNA, 25 bp, Rattus norvegicus
cgccgcgctaataacctgtccagga

SEQ ID NO: 469396 - DNA, 25 bp, Rattus norvegicus
tccaggagatggctcgtggcaaatt

SEQ ID NO: 469397 - DNA, 25 bp, Rattus norvegicus
gtggcaaattgctttgttagtcttg

SEQ ID NO: 469398 - DNA, 25 bp, Rattus norvegicus
tttgttagtcttgtcagcgcggcca

SEQ ID NO: 469399 - DNA, 25 bp, Rattus norvegicus
ttagtcttgtcagcgcggccagggc

SEQ ID NO: 469400 - DNA, 25 bp, Rattus norvegicus
gtcagcgcgcgccatggatcaagat

SEQ ID NO: 469401 - DNA, 25 bp, Rattus norvegicus
ccatggatcaagatgatgaatcgcc

SEQ ID NO: 469402 - DNA, 25 bp, Rattus norvegicus
aagatgatgaatcgccgtggatggc

SEQ ID NO: 469403 - DNA, 25 bp, Rattus norvegicus
accgccattaactcccgaattagct

SEQ ID NO: 469404 - DNA, 25 bp, Rattus norvegicus
aactcccgaattagctctaagccgc

SEQ ID NO: 469405 - DNA, 25 bp, Rattus norvegicus
taagccgcccaccacctagccactg

SEQ ID NO: 469406 - DNA, 25 bp, Rattus norvegicus
gagcgagcccaagatgcagagaggc

SEQ ID NO: 469407 - DNA, 25 bp, Rattus norvegicus
cgcgcgccatggatcaagatgatga

SEQ ID NO: 469408 - DNA, 25 bp, Rattus norvegicus
aagccttaggggagacgagatctga

SEQ ID NO: 469409 - DNA, 25 bp, Rattus norvegicus
ccgcaatactgggatttagctcaga

SEQ ID NO: 469410 - DNA, 25 bp, Rattus norvegicus
gcggagacaaatccttttcagtttg

SEQ ID NO: 469411 - DNA, 25 bp, Rattus norvegicus
gacctcctctgcgtttgcggtcctg

SEQ ID NO: 469412 - DNA, 25 bp, Rattus norvegicus
cgtcacggttttgcctcatttggaa

SEQ ID NO: 469413 - DNA, 25 bp, Rattus norvegicus
cgcagagaacgcttcggatccgtca

SEQ ID NO: 469414 - DNA, 25 bp, Rattus norvegicus
cgagacgcaggcacccgcagagaac

SEQ ID NO: 469415 - DNA, 25 bp, Rattus norvegicus
gaagccagtgctagcaacccaggga

SEQ ID NO: 469416 - DNA, 25 bp, Rattus norvegicus
ttagctcagatctcatccttcatgg

SEQ ID NO: 469417 - DNA, 25 bp, Rattus norvegicus
ccttcatggctaccgagggctcctt

SEQ ID NO: 469418 - DNA, 25 bp, Rattus norvegicus
gagcgatccctacgagtgccgaaca

SEQ ID NO: 469419 - DNA, 25 bp, Rattus norvegicus
ggcgacagacacttaagccttaggg

SEQ ID NO: 469420 - DNA, 25 bp, Rattus norvegicus
acgcggtttaaaactccagctccag

SEQ ID NO: 469421 - DNA, 25 bp, Rattus norvegicus
agtgccgaacacgaagccagtgcta

SEQ ID NO: 469422 - DNA, 25 bp, Rattus norvegicus
acgtcacggagagcggaggtcttta

SEQ ID NO: 469423 - DNA, 25 bp, Rattus norvegicus
tcttttgtgctgtgccggggatcct

SEQ ID NO: 469424 - DNA, 25 bp, Rattus norvegicus
gcaaaaattgtagaagctcccggtc

SEQ ID NO: 469425 - DNA, 25 bp, Rattus norvegicus
tttttcttcttttgtgctgtgccgg

SEQ ID NO: 469426 - DNA, 25 bp, Rattus norvegicus
gagtgggatacgtgtctttttcttc

SEQ ID NO: 469427 - DNA, 25 bp, Rattus norvegicus
aattgtagaagctcccggtccgtcg

SEQ ID NO: 469428 - DNA, 25 bp, Rattus norvegicus
tgcaggcgtagctgcaaaaattgta

SEQ ID NO: 469429 - DNA, 25 bp, Rattus norvegicus
tcgcaccactgaggttgcaggcgta

SEQ ID NO: 469430 - DNA, 25 bp, Rattus norvegicus
agcaacttgggttggaggacgtcac

SEQ ID NO: 469431 - DNA, 25 bp, Rattus norvegicus
gaacaggctgttcgcaccactgagg

SEQ ID NO: 469432 - DNA, 25 bp, Rattus norvegicus
tactggataggccttggggcgaaca

SEQ ID NO: 469433 - DNA, 25 bp, Rattus norvegicus
ttacttactggataggccttggggc

SEQ ID NO: 469434 - DNA, 25 bp, Rattus norvegicus
agcggaggtctttacttactggata

SEQ ID NO: 469435 - DNA, 25 bp, Rattus norvegicus
gaagctcccggtccgtcgtcgcgaa

SEQ ID NO: 469436 - DNA, 25 bp, Rattus norvegicus
acatcggctacatggcgtgctcctg

SEQ ID NO: 469437 - DNA, 25 bp, Rattus norvegicus
ccatggtgcggttcagcagcggatt

SEQ ID NO: 469438 - DNA, 25 bp, Rattus norvegicus
gccagagcggcggtagccatggtgc

SEQ ID NO: 469439 - DNA, 25 bp, Rattus norvegicus
aggtgagcacctgtacctggaggtt

SEQ ID NO: 469440 - DNA, 25 bp, Rattus norvegicus
agcgaggtgagcacctgtacctgga

SEQ ID NO: 469441 - DNA, 25 bp, Rattus norvegicus
tctcctgagcgaggtgagcacctgt

SEQ ID NO: 469442 - DNA, 25 bp, Rattus norvegicus
agcccgccccagaagctgagatttc

SEQ ID NO: 469443 - DNA, 25 bp, Rattus norvegicus
tgaggctgggccactgcgtcgcctc

SEQ ID NO: 469444 - DNA, 25 bp, Rattus norvegicus
agggacatcggctacatggcgtgct

SEQ ID NO: 469445 - DNA, 25 bp, Rattus norvegicus
cggctacatggcgtgctcctgaggc

SEQ ID NO: 469446 - DNA, 25 bp, Rattus norvegicus
cagcggattgggtggcgtgctgcta

SEQ ID NO: 469447 - DNA, 25 bp, Rattus norvegicus
cctgagcgaggtgagcacctgtacc

SEQ ID NO: 469448 - DNA, 25 bp, Rattus norvegicus
ctacatggcgtgctcctgaggctgg

SEQ ID NO: 469449 - DNA, 25 bp, Rattus norvegicus
agatttctcctgagcgaggtgagca

SEQ ID NO: 469450 - DNA, 25 bp, Rattus norvegicus
acgctcagaaaagccgcgcagttgg

SEQ ID NO: 469451 - DNA, 25 bp, Rattus norvegicus
gcgagtggtgcgcacacaacttcta

SEQ ID NO: 469452 - DNA, 25 bp, Rattus norvegicus
tcggagcccgcggagcagtccttcg

SEQ ID NO: 469453 - DNA, 25 bp, Rattus norvegicus
agggcgccgtaacgctcagaaaagc

SEQ ID NO: 469454 - DNA, 25 bp, Rattus norvegicus
gaacgccgagcgaaacccgtggatc

SEQ ID NO: 469455 - DNA, 25 bp, Rattus norvegicus
ctctgctacgaacgccgagcgaaac

SEQ ID NO: 469456 - DNA, 25 bp, Rattus norvegicus
tcttctctgctacgaacgccgagcg

SEQ ID NO: 469457 - DNA, 25 bp, Rattus norvegicus
ttcccaagggtcctctcttctctgc

SEQ ID NO: 469458 - DNA, 25 bp, Rattus norvegicus
ccagaacagaactgggcgaccaggg

SEQ ID NO: 469459 - DNA, 25 bp, Rattus norvegicus
gtgggcccaagccagaacagaactg

SEQ ID NO: 469460 - DNA, 25 bp, Rattus norvegicus
taagtcaggcgtctgggactccgcg

SEQ ID NO: 469461 - DNA, 25 bp, Rattus norvegicus
cgtctcgtaagtcaggcgtctggga

SEQ ID NO: 469462 - DNA, 25 bp, Rattus norvegicus
ctccacgtctcgtaagtcaggcgtc

SEQ ID NO: 469463 - DNA, 25 bp, Rattus norvegicus
ggtgcgcacacaacttctagccctg

SEQ ID NO: 469464 - DNA, 25 bp, Rattus norvegicus
tctccaggcagaagagtctcgcgcc

SEQ ID NO: 469465 - DNA, 25 bp, Rattus norvegicus
gtcgagccgactggactcttcaagg

SEQ ID NO: 469466 - DNA, 25 bp, Rattus norvegicus
gcctttactactcgggcacagtcga

SEQ ID NO: 469467 - DNA, 25 bp, Rattus norvegicus
gcgctgtcgtggttgcctttactac

SEQ ID NO: 469468 - DNA, 25 bp, Rattus norvegicus
ggcacttgaccatctttacacgtta

SEQ ID NO: 469469 - DNA, 25 bp, Rattus norvegicus
acagctcttattctcaggcacttga

SEQ ID NO: 469470 - DNA, 25 bp, Rattus norvegicus
actcttcaaggggtcgccatcccga

SEQ ID NO: 469471 - DNA, 25 bp, Rattus norvegicus
gtcgagtctcacaggctgacaggga

SEQ ID NO: 469472 - DNA, 25 bp, Rattus norvegicus
gcccggactgtaccattgtgagcga

SEQ ID NO: 469473 - DNA, 25 bp, Rattus norvegicus
ggctatcttctgattggctcgcttg

SEQ ID NO: 469474 - DNA, 25 bp, Rattus norvegicus
ccgcttagtaactgaggtccgacca

SEQ ID NO: 469475 - DNA, 25 bp, Rattus norvegicus
ccttctgcctttgtcccgcttagta

SEQ ID NO: 469476 - DNA, 25 bp, Rattus norvegicus
gccgtttgcgccttctttctttctc

SEQ ID NO: 469477 - DNA, 25 bp, Rattus norvegicus
ctagcctgtcagtaaccgccgtttg

SEQ ID NO: 469478 - DNA, 25 bp, Rattus norvegicus
ccataggcccgctccgctcctccag

SEQ ID NO: 469479 - DNA, 25 bp, Rattus norvegicus
gcccaccctcgcttgcggacccagc

SEQ ID NO: 469480 - DNA, 25 bp, Rattus norvegicus
gatgctccggcgaggacccttcccc

SEQ ID NO: 469481 - DNA, 25 bp, Rattus norvegicus
gcttgcggacccagcccaccttacc

SEQ ID NO: 469482 - DNA, 25 bp, Rattus norvegicus
ctgggccccgcggtcgttagcaccg

SEQ ID NO: 469483 - DNA, 25 bp, Rattus norvegicus
ctccctgctgtcgtgccccataggc

SEQ ID NO: 469484 - DNA, 25 bp, Rattus norvegicus
cccactgcgcccaccctcgcttgcg

SEQ ID NO: 469485 - DNA, 25 bp, Rattus norvegicus
gctccgctcctccagtagctgcctc

SEQ ID NO: 469486 - DNA, 25 bp, Rattus norvegicus
cagtagctgcctcccgggcggcgct

SEQ ID NO: 469487 - DNA, 25 bp, Rattus norvegicus
caaagactgcggctggggcaactcg

SEQ ID NO: 469488 - DNA, 25 bp, Rattus norvegicus
gcggccgctcgcgacagcgtctccg

SEQ ID NO: 469489 - DNA, 25 bp, Rattus norvegicus
cagcgtctccgcttcatctccgcga

SEQ ID NO: 469490 - DNA, 25 bp, Rattus norvegicus
tccgcttcatctccgcgactgggcc

SEQ ID NO: 469491 - DNA, 25 bp, Rattus norvegicus
gcccaccttacctgctccctgctgt

SEQ ID NO: 469492 - DNA, 25 bp, Rattus norvegicus
ctcgtgtcctctccggaccgggaag

SEQ ID NO: 469493 - DNA, 25 bp, Rattus norvegicus
ctgcgtacggtctgtgtttctcaca

SEQ ID NO: 469494 - DNA, 25 bp, Rattus norvegicus
agtctcagtcacctgtctccacagg

SEQ ID NO: 469495 - DNA, 25 bp, Rattus norvegicus
gcgctttcagcagtctcagtcacct

SEQ ID NO: 469496 - DNA, 25 bp, Rattus norvegicus
ctgaagctgcgctttcagcagtctc

SEQ ID NO: 469497 - DNA, 25 bp, Rattus norvegicus
ggttcccgcatcagcgctgaagctg

SEQ ID NO: 469498 - DNA, 25 bp, Rattus norvegicus
gttgggaacttcctcgtgtcctctc

SEQ ID NO: 469499 - DNA, 25 bp, Rattus norvegicus
tgtttctcacaggttgggaacttcc

SEQ ID NO: 469500 - DNA, 25 bp, Rattus norvegicus
ctggagctttggaacgcactgtact

SEQ ID NO: 469501 - DNA, 25 bp, Rattus norvegicus
aacgcactgtactttcgctttcctc

SEQ ID NO: 469502 - DNA, 25 bp, Rattus norvegicus
ggcgctctgaccgtccaagtgtttt

SEQ ID NO: 469503 - DNA, 25 bp, Rattus norvegicus
ccgtccaagtgttttcgccgtcttg

SEQ ID NO: 469504 - DNA, 25 bp, Rattus norvegicus
tggaggttcctccagtctacggcgc

SEQ ID NO: 469505 - DNA, 25 bp, Rattus norvegicus
gcacgcgcagtagaaggttcccgca

SEQ ID NO: 469506 - DNA, 25 bp, Rattus norvegicus
ttcagttcccggtcggaaacgctca

SEQ ID NO: 469507 - DNA, 25 bp, Rattus norvegicus
cgctgcgggaacagcccaacgttta

SEQ ID NO: 469508 - DNA, 25 bp, Rattus norvegicus
ccaacgtttacggagcgagccgccg

SEQ ID NO: 469509 - DNA, 25 bp, Rattus norvegicus
ggtcacggaaacaagagctcacgca

SEQ ID NO: 469510 - DNA, 25 bp, Rattus norvegicus
cgggcagccattttgggaagagctt

SEQ ID NO: 469511 - DNA, 25 bp, Rattus norvegicus
ctttgttatggttgtgggctagtca

SEQ ID NO: 469512 - DNA, 25 bp, Rattus norvegicus
agtcacctctgctggtcggagaagc

SEQ ID NO: 469513 - DNA, 25 bp, Rattus norvegicus
acgccgcgagtcgtccttgaccgta

SEQ ID NO: 469514 - DNA, 25 bp, Rattus norvegicus
gcggttccagagctctccgacttca

SEQ ID NO: 469515 - DNA, 25 bp, Rattus norvegicus
aggagccttgcacactagcgtcgcc

SEQ ID NO: 469516 - DNA, 25 bp, Rattus norvegicus
gaccagaggaactaggagttgtcta

SEQ ID NO: 469517 - DNA, 25 bp, Rattus norvegicus
cctaactggccgtctatgaaaacta

SEQ ID NO: 469518 - DNA, 25 bp, Rattus norvegicus
agcagaaggagacctcgagtcgtcc

SEQ ID NO: 469519 - DNA, 25 bp, Rattus norvegicus
agaagctggggacgcgtccttagac

SEQ ID NO: 469520 - DNA, 25 bp, Rattus norvegicus
ccaccagcaggacgccaaaagggta

SEQ ID NO: 469521 - DNA, 25 bp, Rattus norvegicus
aggtagggaggcatagactctctgc

SEQ ID NO: 469522 - DNA, 25 bp, Rattus norvegicus
cgcgctgtgtgtagactcaccctga

SEQ ID NO: 469523 - DNA, 25 bp, Rattus norvegicus
cttcagaattaaaacggcgcctcca

SEQ ID NO: 469524 - DNA, 25 bp, Rattus norvegicus
ctccacagcgtagcgggacccaagg

SEQ ID NO: 469525 - DNA, 25 bp, Rattus norvegicus
cccaatagtcttggagcgcgaactc

SEQ ID NO: 469526 - DNA, 25 bp, Rattus norvegicus
ctgcaaacgttaggagcgcgtgttc

SEQ ID NO: 469527 - DNA, 25 bp, Rattus norvegicus
ggtacaacccggaaacgcttgctga

SEQ ID NO: 469528 - DNA, 25 bp, Rattus norvegicus
cttgctgaagagatccggtgaggac

SEQ ID NO: 469529 - DNA, 25 bp, Rattus norvegicus
ctgggagatcgctttctgatgccta

SEQ ID NO: 469530 - DNA, 25 bp, Rattus norvegicus
gcctacttgctagggtgctacgtga

SEQ ID NO: 469531 - DNA, 25 bp, Rattus norvegicus
tattacaactgcaagtggaggcgtc

SEQ ID NO: 469532 - DNA, 25 bp, Rattus norvegicus
acattgggctcagtcagtgacatca

SEQ ID NO: 469533 - DNA, 25 bp, Rattus norvegicus
agccgctagtccagctttggaaaga

SEQ ID NO: 469534 - DNA, 25 bp, Rattus norvegicus
cgccgttaacgctagtgcgccagct

SEQ ID NO: 469535 - DNA, 25 bp, Rattus norvegicus
tacttgtcagcggaaaccagttccg

SEQ ID NO: 469536 - DNA, 25 bp, Rattus norvegicus
cacagtcccgcttacttgtcagcgg

SEQ ID NO: 469537 - DNA, 25 bp, Rattus norvegicus
gcccatgcctcaagctcgccacagt

SEQ ID NO: 469538 - DNA, 25 bp, Rattus norvegicus
agctctccctgaggactggcccatg

SEQ ID NO: 469539 - DNA, 25 bp, Rattus norvegicus
cgcccgcgaagccaagtccaccagc

SEQ ID NO: 469540 - DNA, 25 bp, Rattus norvegicus
gaaggcagctgtcccacccaccagt

SEQ ID NO: 469541 - DNA, 25 bp, Rattus norvegicus
ctccgaacgcccgcagttgtttagg

SEQ ID NO: 469542 - DNA, 25 bp, Rattus norvegicus
gcaagtgggacttctccacaaacca

SEQ ID NO: 469543 - DNA, 25 bp, Rattus norvegicus
ctagtgcgccagctcttcgcaagtg

SEQ ID NO: 469544 - DNA, 25 bp, Rattus norvegicus
gccggcgatggagacagccaccgct

SEQ ID NO: 469545 - DNA, 25 bp, Rattus norvegicus
tcaagaaccgactggagccgggccc

SEQ ID NO: 469546 - DNA, 25 bp, Rattus norvegicus
ccggtagaggttcaagaaccgactg

SEQ ID NO: 469547 - DNA, 25 bp, Rattus norvegicus
gctcttcgcaagtgggacttctcca

SEQ ID NO: 469548 - DNA, 25 bp, Rattus norvegicus
gtgctgctactgaccacttcgccgt

SEQ ID NO: 469549 - DNA, 25 bp, Rattus norvegicus
cgaacgcaaccacgcgcggcggcct

SEQ ID NO: 469550 - DNA, 25 bp, Rattus norvegicus
ggcacagacattcgccgcaggtcgg

SEQ ID NO: 469551 - DNA, 25 bp, Rattus norvegicus
cattcgccgcaggtcggctgtttca

SEQ ID NO: 469552 - DNA, 25 bp, Rattus norvegicus
tcggctgtttcagcaccggacctcg

SEQ ID NO: 469553 - DNA, 25 bp, Rattus norvegicus
gacctcggacttgcttcacgggtgg

SEQ ID NO: 469554 - DNA, 25 bp, Rattus norvegicus
cgtcgcctccactcaccgcggcggt

SEQ ID NO: 469555 - DNA, 25 bp, Rattus norvegicus
ttgttgccgcacatccaccggctgg

SEQ ID NO: 469556 - DNA, 25 bp, Rattus norvegicus
gccctgccctgttccgcacgctcga

SEQ ID NO: 469557 - DNA, 25 bp, Rattus norvegicus
cgcgtgcgcgtcacaatgaggcttc

SEQ ID NO: 469558 - DNA, 25 bp, Rattus norvegicus
tcacaatgaggcttcggcgcggacc

SEQ ID NO: 469559 - DNA, 25 bp, Rattus norvegicus
cggacccggagcagagtgctgctac

SEQ ID NO: 469560 - DNA, 25 bp, Rattus norvegicus
acttcgccgtccttccacgcgcgca

SEQ ID NO: 469561 - DNA, 25 bp, Rattus norvegicus
tttcagcaccggacctcggacttgc

SEQ ID NO: 469562 - DNA, 25 bp, Rattus norvegicus
ttgtgagacctgtagctcgactctg

SEQ ID NO: 469563 - DNA, 25 bp, Rattus norvegicus
ctcgactctggtgagtgtgcagata

SEQ ID NO: 469564 - DNA, 25 bp, Rattus norvegicus
atatcgtggctgtgaaacgcggctc

SEQ ID NO: 469565 - DNA, 25 bp, Rattus norvegicus
tttgtgggctataaaagcagctccc

SEQ ID NO: 469566 - DNA, 25 bp, Rattus norvegicus
tcctttccgggcactccgatagagg

SEQ ID NO: 469567 - DNA, 25 bp, Rattus norvegicus
tgtcacgggttccttctccctcagg

SEQ ID NO: 469568 - DNA, 25 bp, Rattus norvegicus
ctcgcgagaactttgtgggctataa

SEQ ID NO: 469569 - DNA, 25 bp, Rattus norvegicus
tcccgcgagtgcttgagcattactc

SEQ ID NO: 469570 - DNA, 25 bp, Rattus norvegicus
gagcattactcgcattcttcacgtg

SEQ ID NO: 469571 - DNA, 25 bp, Rattus norvegicus
cgcattcttcacgtggcccttagtt

SEQ ID NO: 469572 - DNA, 25 bp, Rattus norvegicus
cgagactaacgtcgagtttcctcct

SEQ ID NO: 469573 - DNA, 25 bp, Rattus norvegicus
cccgtgagagtctcgcgagaacttt

SEQ ID NO: 469574 - DNA, 25 bp, Rattus norvegicus
aggcacgtcttcctgtgttctcacg

SEQ ID NO: 469575 - DNA, 25 bp, Rattus norvegicus
gtgttctcacggttggttctgtttg

SEQ ID NO: 469576 - DNA, 25 bp, Rattus norvegicus
agccacgaccgggagctgctatgct

SEQ ID NO: 469577 - DNA, 25 bp, Rattus norvegicus
ctagacagccacgaccgggagctgc

SEQ ID NO: 469578 - DNA, 25 bp, Rattus norvegicus
cacgaccgggagctgctatgctcgc

SEQ ID NO: 469579 - DNA, 25 bp, Rattus norvegicus
gctgcctcccttgccctccggccgg

SEQ ID NO: 469580 - DNA, 25 bp, Rattus norvegicus
tccgccgctcagttgtgcctcaggt

SEQ ID NO: 469581 - DNA, 25 bp, Rattus norvegicus
ccgctcagttgtgcctcaggtaaca

SEQ ID NO: 469582 - DNA, 25 bp, Rattus norvegicus
ctcagttgtgcctcaggtaacattg

SEQ ID NO: 469583 - DNA, 25 bp, Rattus norvegicus
tcaggtaacattgggagagagtgcc

SEQ ID NO: 469584 - DNA, 25 bp, Rattus norvegicus
agagagtgccagaggaccgcagctc

SEQ ID NO: 469585 - DNA, 25 bp, Rattus norvegicus
agaggaccgcagctcggcatccctg

SEQ ID NO: 469586 - DNA, 25 bp, Rattus norvegicus
gctcggcatccctgccgcgcgctca

SEQ ID NO: 469587 - DNA, 25 bp, Rattus norvegicus
tgccgcgcgctcagccttggctcac

SEQ ID NO: 469588 - DNA, 25 bp, Rattus norvegicus
ttgtgcctcaggtaacattgggaga

SEQ ID NO: 469589 - DNA, 25 bp, Rattus norvegicus
gcaggctagacagccacgaccggga

SEQ ID NO: 469590 - DNA, 25 bp, Rattus norvegicus
cgggccaacagtccatcgatcatta

SEQ ID NO: 469591 - DNA, 25 bp, Rattus norvegicus
catcgatcattaaccctcgggaatg

SEQ ID NO: 469592 - DNA, 25 bp, Rattus norvegicus
ctctcccatctacgcggggcatata

SEQ ID NO: 469593 - DNA, 25 bp, Rattus norvegicus
tctacgcggggcatataaccctttc

SEQ ID NO: 469594 - DNA, 25 bp, Rattus norvegicus
aggagcggtcctttccctcgagcct

SEQ ID NO: 469595 - DNA, 25 bp, Rattus norvegicus
cacctcgtctcacctgtgggctggg

SEQ ID NO: 469596 - DNA, 25 bp, Rattus norvegicus
ggggtcgaagacctccatagggatc

SEQ ID NO: 469597 - DNA, 25 bp, Rattus norvegicus
tccatagggatctcttgggaaggtg

SEQ ID NO: 469598 - DNA, 25 bp, Rattus norvegicus
atgccgctcttctggaccatggaga

SEQ ID NO: 469599 - DNA, 25 bp, Rattus norvegicus
accatggagaggatcctccggtccg

SEQ ID NO: 469600 - DNA, 25 bp, Rattus norvegicus
ccctcagcgcatgggagaggccgtc

SEQ ID NO: 469601 - DNA, 25 bp, Rattus norvegicus
actccgcttctcaaggcctggattc

SEQ ID NO: 469602 - DNA, 25 bp, Rattus norvegicus
tcgcgcagccagcaccgggtgcagt

SEQ ID NO: 469603 - DNA, 25 bp, Rattus norvegicus
aggcgaggttgacaggcattccacc

SEQ ID NO: 469604 - DNA, 25 bp, Rattus norvegicus
cccgagcaagtctgatctaggatgg

SEQ ID NO: 469605 - DNA, 25 bp, Rattus norvegicus
cggcgcaggaggtaatttatgcttc

SEQ ID NO: 469606 - DNA, 25 bp, Rattus norvegicus
ttctctggagcgtccagccggagac

SEQ ID NO: 469607 - DNA, 25 bp, Rattus norvegicus
gctggccgtcccgagtgaagccacg

SEQ ID NO: 469608 - DNA, 25 bp, Rattus norvegicus
ctcagtgtctattggctggccgtcc

SEQ ID NO: 469609 - DNA, 25 bp, Rattus norvegicus
ttccgttcccagtggtcctgtggag

SEQ ID NO: 469610 - DNA, 25 bp, Rattus norvegicus
tctcggtctcgcagtgtcaacttcc

SEQ ID NO: 469611 - DNA, 25 bp, Rattus norvegicus
tttatgcttccgcatggtgtggcgg

SEQ ID NO: 469612 - DNA, 25 bp, Rattus norvegicus
ggaacgtagagacttccgcttagtc

SEQ ID NO: 469613 - DNA, 25 bp, Rattus norvegicus
ctagccagctttctataggaacgta

SEQ ID NO: 469614 - DNA, 25 bp, Rattus norvegicus
tgaaggcacaccatcgtcactgtcc

SEQ ID NO: 469615 - DNA, 25 bp, Rattus norvegicus
gcgttggaactgaaggcacaccatc

SEQ ID NO: 469616 - DNA, 25 bp, Rattus norvegicus
ctcaccgtcagagggcgttggaact

SEQ ID NO: 469617 - DNA, 25 bp, Rattus norvegicus
gtgtcaacttccgttcccagtggtc

SEQ ID NO: 469618 - DNA, 25 bp, Rattus norvegicus
ttgtatgagaaccacgcggacgctg

SEQ ID NO: 469619 - DNA, 25 bp, Rattus norvegicus
cacaggttctgtggggtgaattgta

SEQ ID NO: 469620 - DNA, 25 bp, Rattus norvegicus
catcctccacgtcgaagcacaggtt

SEQ ID NO: 469621 - DNA, 25 bp, Rattus norvegicus
tcattcactagaaagacagcgtccc

SEQ ID NO: 469622 - DNA, 25 bp, Rattus norvegicus
gccgaagatgcgttgtaagtctctc

SEQ ID NO: 469623 - DNA, 25 bp, Rattus norvegicus
ccagccggcacatggaaggcgatgt

SEQ ID NO: 469624 - DNA, 25 bp, Rattus norvegicus
cggccacccggatctgttcttctgg

SEQ ID NO: 469625 - DNA, 25 bp, Rattus norvegicus
ggccgctcacccgtttagaattcaa

SEQ ID NO: 469626 - DNA, 25 bp, Rattus norvegicus
ttcaaagactcttgctccaggatta

SEQ ID NO: 469627 - DNA, 25 bp, Rattus norvegicus
ttaattgttggaagccgacggagtc

SEQ ID NO: 469628 - DNA, 25 bp, Rattus norvegicus
cctggtctatccgaagagcgcgttc

SEQ ID NO: 469629 - DNA, 25 bp, Rattus norvegicus
gagcgcgttctttagtcttttctga

SEQ ID NO: 469630 - DNA, 25 bp, Rattus norvegicus
tgctgcagcgccacttcaaccagaa

SEQ ID NO: 469631 - DNA, 25 bp, Rattus norvegicus
cgaacagaggtcacgaagtcaaact

SEQ ID NO: 469632 - DNA, 25 bp, Rattus norvegicus
cttgtgttccgggatggctgcgccc

SEQ ID NO: 469633 - DNA, 25 bp, Rattus norvegicus
ctggtgcggggcgctcctcagcctt

SEQ ID NO: 469634 - DNA, 25 bp, Rattus norvegicus
ggccgtcctcttcggcccgccagca

SEQ ID NO: 469635 - DNA, 25 bp, Rattus norvegicus
cagctggcggccgggtctttttact

SEQ ID NO: 469636 - DNA, 25 bp, Rattus norvegicus
cccgcgcgagcgctctgcttgtgtt

SEQ ID NO: 469637 - DNA, 25 bp, Rattus norvegicus
cgcgcgagcgctctgcttgtgttcc

SEQ ID NO: 469638 - DNA, 25 bp, Rattus norvegicus
tggcggaaaagtgggcgtacgagcg

SEQ ID NO: 469639 - DNA, 25 bp, Rattus norvegicus
ctctgcttgtgttccgggatggctg

SEQ ID NO: 469640 - DNA, 25 bp, Rattus norvegicus
ctcgcgctggtcctcaggccaacca

SEQ ID NO: 469641 - DNA, 25 bp, Rattus norvegicus
cctcagccttggcagcccgcgggcc

SEQ ID NO: 469642 - DNA, 25 bp, Rattus norvegicus
cccgagcggcgcgagcacgggactg

SEQ ID NO: 469643 - DNA, 25 bp, Rattus norvegicus
cagcaatggcggaaggaggtgagcg

SEQ ID NO: 469644 - DNA, 25 bp, Rattus norvegicus
aggaggtgagcgagaggagctgctt

SEQ ID NO: 469645 - DNA, 25 bp, Rattus norvegicus
gagcgctctgcttgtgttccgggat

SEQ ID NO: 469646 - DNA, 25 bp, Rattus norvegicus
tcaccgtaaagtccactgtggcgac

SEQ ID NO: 469647 - DNA, 25 bp, Rattus norvegicus
ctacagcgcgtgcaacagaaaactc

SEQ ID NO: 469648 - DNA, 25 bp, Rattus norvegicus
aagccgttcgcctccatggtaaaca

SEQ ID NO: 469649 - DNA, 25 bp, Rattus norvegicus
tcgcctccatggtaaacagtaactg

SEQ ID NO: 469650 - DNA, 25 bp, Rattus norvegicus
taaacagtaactgagcggtcaccgc

SEQ ID NO: 469651 - DNA, 25 bp, Rattus norvegicus
agcggtcaccgctttaatctgagtc

SEQ ID NO: 469652 - DNA, 25 bp, Rattus norvegicus
tcaccgctttaatctgagtctccgc

SEQ ID NO: 469653 - DNA, 25 bp, Rattus norvegicus
cttcctgaagagaaccacgggcggc

SEQ ID NO: 469654 - DNA, 25 bp, Rattus norvegicus
gcgccatattgagaaccacgtgacc

SEQ ID NO: 469655 - DNA, 25 bp, Rattus norvegicus
ttgagaaccacgtgaccagaccagt

SEQ ID NO: 469656 - DNA, 25 bp, Rattus norvegicus
cacgtgaccagaccagtgacagctg

SEQ ID NO: 469657 - DNA, 25 bp, Rattus norvegicus
ccagtgacagctgtggggctgcctt

SEQ ID NO: 469658 - DNA, 25 bp, Rattus norvegicus
tcggaaagcaacgtagctacagcgc

SEQ ID NO: 469659 - DNA, 25 bp, Rattus norvegicus
catcaatttttcaccgtaaagtcca

SEQ ID NO: 469660 - DNA, 25 bp, Rattus norvegicus
cgcccgcgacaggatctagcttcgg

SEQ ID NO: 469661 - DNA, 25 bp, Rattus norvegicus
ttcacgggcttcactatggccggcc

SEQ ID NO: 469662 - DNA, 25 bp, Rattus norvegicus
ctcctgggtcgcgtgcgcttcctgg

SEQ ID NO: 469663 - DNA, 25 bp, Rattus norvegicus
ctttcgtgccgcgagaggtgctcta

SEQ ID NO: 469664 - DNA, 25 bp, Rattus norvegicus
cgagaggtgctctacaagctttaca

SEQ ID NO: 469665 - DNA, 25 bp, Rattus norvegicus
caagctttacaaggacccagcggga

SEQ ID NO: 469666 - DNA, 25 bp, Rattus norvegicus
cgacaggatctagcttcggcgaggc

SEQ ID NO: 469667 - DNA, 25 bp, Rattus norvegicus
ctgcgtacgcaccaaccggcgagga

SEQ ID NO: 469668 - DNA, 25 bp, Rattus norvegicus
accaaccggcgaggagctgtgcaac

SEQ ID NO: 469669 - DNA, 25 bp, Rattus norvegicus
agctgtgcaacggacacgggctctg

SEQ ID NO: 469670 - DNA, 25 bp, Rattus norvegicus
cgggctctgggcgaagataaccaag

SEQ ID NO: 469671 - DNA, 25 bp, Rattus norvegicus
gaagataaccaaggtgcgcccgggc

SEQ ID NO: 469672 - DNA, 25 bp, Rattus norvegicus
tggacgagtctcacttcacgggctt

SEQ ID NO: 469673 - DNA, 25 bp, Rattus norvegicus
ggcgaggcgcctgcgtacgcaccaa

SEQ ID NO: 469674 - DNA, 25 bp, Rattus norvegicus
tctgctctgtgccatctattactcg

SEQ ID NO: 469675 - DNA, 25 bp, Rattus norvegicus
gggcagacggggaaatcatcaaagc

SEQ ID NO: 469676 - DNA, 25 bp, Rattus norvegicus
ccaggtcgctgaacagggcccgagt

SEQ ID NO: 469677 - DNA, 25 bp, Rattus norvegicus
cacgagctggctaagcaaggtgagc

SEQ ID NO: 469678 - DNA, 25 bp, Rattus norvegicus
gctagtacggtaccaggcggtgcac

SEQ ID NO: 469679 - DNA, 25 bp, Rattus norvegicus
cctttggcttgtcagccggaggcag

SEQ ID NO: 469680 - DNA, 25 bp, Rattus norvegicus
gcctgcgcctttggcttgtcagccg

SEQ ID NO: 469681 - DNA, 25 bp, Rattus norvegicus
ggcacgtcatatcgaaccgctcggc

SEQ ID NO: 469682 - DNA, 25 bp, Rattus norvegicus
ctgagtcggcacgtcatatcgaacc

SEQ ID NO: 469683 - DNA, 25 bp, Rattus norvegicus
ctccttcctgagtcggcacgtcata

SEQ ID NO: 469684 - DNA, 25 bp, Rattus norvegicus
gttcctccttcctgagtcggcacgt

SEQ ID NO: 469685 - DNA, 25 bp, Rattus norvegicus
tattactcggcactcgttcctcctt

SEQ ID NO: 469686 - DNA, 25 bp, Rattus norvegicus
gaaatcatcaaagcgagtccctgcc

SEQ ID NO: 469687 - DNA, 25 bp, Rattus norvegicus
gccatctattactcggcactcgttc

SEQ ID NO: 469688 - DNA, 25 bp, Rattus norvegicus
agaggctcccgtcggttctgttctt

SEQ ID NO: 469689 - DNA, 25 bp, Rattus norvegicus
gtccagaaaacgatggtgatcccga

SEQ ID NO: 469690 - DNA, 25 bp, Rattus norvegicus
ccgcatctcctctgcgtagggcgtg

SEQ ID NO: 469691 - DNA, 25 bp, Rattus norvegicus
gcacttccatgcctccacaatttgt

SEQ ID NO: 469692 - DNA, 25 bp, Rattus norvegicus
cctgtaggggaaatcgggtcaccat

SEQ ID NO: 469693 - DNA, 25 bp, Rattus norvegicus
ataagtttggttactcgcgtccgca

SEQ ID NO: 469694 - DNA, 25 bp, Rattus norvegicus
tctgttcttccagggcgcttagctc

SEQ ID NO: 469695 - DNA, 25 bp, Rattus norvegicus
gggttgctccaacaccgcctatgga

SEQ ID NO: 469696 - DNA, 25 bp, Rattus norvegicus
cgcctatggaagagagccttgagcc

SEQ ID NO: 469697 - DNA, 25 bp, Rattus norvegicus
gcttcgggctgcctgaatcaactca

SEQ ID NO: 469698 - DNA, 25 bp, Rattus norvegicus
ctcgtccacgcagagcttgtcactg

SEQ ID NO: 469699 - DNA, 25 bp, Rattus norvegicus
ttgtcactgcgtagcacgggaagca

SEQ ID NO: 469700 - DNA, 25 bp, Rattus norvegicus
tccggaagtggatcattagaaacga

SEQ ID NO: 469701 - DNA, 25 bp, Rattus norvegicus
atctcagctctcgaaccactggagc

SEQ ID NO: 469702 - DNA, 25 bp, Rattus norvegicus
atgcggctcatgatggactggcctc

SEQ ID NO: 469703 - DNA, 25 bp, Rattus norvegicus
cacattcgtgtgagggagctcaacc

SEQ ID NO: 469704 - DNA, 25 bp, Rattus norvegicus
tacaaactggtgtgcaacgtggtgc

SEQ ID NO: 469705 - DNA, 25 bp, Rattus norvegicus
gtgcacgtggtcagccgagcgctct

SEQ ID NO: 469706 - DNA, 25 bp, Rattus norvegicus
gcaggcgctgtgtgaacagatacac

SEQ ID NO: 469707 - DNA, 25 bp, Rattus norvegicus
gatggactggcctctgccaccttca

SEQ ID NO: 469708 - DNA, 25 bp, Rattus norvegicus
atgtgtgctactccggtactgaggc

SEQ ID NO: 469709 - DNA, 25 bp, Rattus norvegicus
ctgcaagtgcccagcgtgccctgaa

SEQ ID NO: 469710 - DNA, 25 bp, Rattus norvegicus
aacccttcgctgtttgctgtggcta

SEQ ID NO: 469711 - DNA, 25 bp, Rattus norvegicus
cacagctgagcgatgtgtgctactc

SEQ ID NO: 469712 - DNA, 25 bp, Rattus norvegicus
tgccctgaaggcagcattgaccaca

SEQ ID NO: 469713 - DNA, 25 bp, Rattus norvegicus
gtaccgcatagaaccggcgcccgga

SEQ ID NO: 469714 - DNA, 25 bp, Rattus norvegicus
ggtggcaccctcgtaccgcatagaa

SEQ ID NO: 469715 - DNA, 25 bp, Rattus norvegicus
cccggagaacactgggaagctgcaa

SEQ ID NO: 469716 - DNA, 25 bp, Rattus norvegicus
tggccaatctgaagcccagtcttaa

SEQ ID NO: 469717 - DNA, 25 bp, Rattus norvegicus
cgcggatgctgtcgctctgtagcac

SEQ ID NO: 469718 - DNA, 25 bp, Rattus norvegicus
ctctgtagcacgacaggagcggagc

SEQ ID NO: 469719 - DNA, 25 bp, Rattus norvegicus
cggcatggcgcactgcagcgcgaca

SEQ ID NO: 469720 - DNA, 25 bp, Rattus norvegicus
cgtggccgtaaagcaatgcggagcc

SEQ ID NO: 469721 - DNA, 25 bp, Rattus norvegicus
aaagcaatgcggagccttcgccgcc

SEQ ID NO: 469722 - DNA, 25 bp, Rattus norvegicus
cttctgggcgcccttgaaaggaccg

SEQ ID NO: 469723 - DNA, 25 bp, Rattus norvegicus
gccgcgggaccagtctggaccttct

SEQ ID NO: 469724 - DNA, 25 bp, Rattus norvegicus
agtgagcctggccaatctgaagccc

SEQ ID NO: 469725 - DNA, 25 bp, Rattus norvegicus
agcccagtcttaactccagaaaacg

SEQ ID NO: 469726 - DNA, 25 bp, Rattus norvegicus
attgcaggggccacgtcatgctgga

SEQ ID NO: 469727 - DNA, 25 bp, Rattus norvegicus
gccacgtcatgctggagatggacga

SEQ ID NO: 469728 - DNA, 25 bp, Rattus norvegicus
gagtgtgagcgcctggccctcttct

SEQ ID NO: 469729 - DNA, 25 bp, Rattus norvegicus
agtctggaccttctgcggtccttgc

SEQ ID NO: 469730 - DNA, 25 bp, Rattus norvegicus
gactttgaccgcgtaggctatacta

SEQ ID NO: 469731 - DNA, 25 bp, Rattus norvegicus
cgcctgccgagcttgttctcggttc

SEQ ID NO: 469732 - DNA, 25 bp, Rattus norvegicus
cctggtttctctacgctgcgatcgc

SEQ ID NO: 469733 - DNA, 25 bp, Rattus norvegicus
acccttgatgtaggtacggccgctg

SEQ ID NO: 469734 - DNA, 25 bp, Rattus norvegicus
cttgcccaacaagcgacccttgatg

SEQ ID NO: 469735 - DNA, 25 bp, Rattus norvegicus
ggctgcatcatcagtccggacgctc

SEQ ID NO: 469736 - DNA, 25 bp, Rattus norvegicus
tctcagtgtcagtggcttcatagca

SEQ ID NO: 469737 - DNA, 25 bp, Rattus norvegicus
gcgactctgcgggatgactttgacc

SEQ ID NO: 469738 - DNA, 25 bp, Rattus norvegicus
caccttctcgcgctgatgcggcttg

SEQ ID NO: 469739 - DNA, 25 bp, Rattus norvegicus
cgaaatcctcatctttccagggtcc

SEQ ID NO: 469740 - DNA, 25 bp, Rattus norvegicus
cggtgcaactctatctcgtttatga

SEQ ID NO: 469741 - DNA, 25 bp, Rattus norvegicus
gtgctgtaggtctcggtgcaactct

SEQ ID NO: 469742 - DNA, 25 bp, Rattus norvegicus
aatcgaacgatatggcggtgctgta

SEQ ID NO: 469743 - DNA, 25 bp, Rattus norvegicus
agagcccggcgtttttatcaatgaa

SEQ ID NO: 469744 - DNA, 25 bp, Rattus norvegicus
ctttcacagaaaacagtcctctacg

SEQ ID NO: 469745 - DNA, 25 bp, Rattus norvegicus
cctgcgcggatttagcgtgacttcc

SEQ ID NO: 469746 - DNA, 25 bp, Rattus norvegicus
ctcagtccgcctgcgcggatttagc

SEQ ID NO: 469747 - DNA, 25 bp, Rattus norvegicus
gtcctctacgaagactaggcctttc

SEQ ID NO: 469748 - DNA, 25 bp, Rattus norvegicus
aaatctcttgggtttagcctgcaca

SEQ ID NO: 469749 - DNA, 25 bp, Rattus norvegicus
ggctaatttaataacctttcacaga

SEQ ID NO: 469750 - DNA, 25 bp, Rattus norvegicus
tagcgctcctttcgctaattttctc

SEQ ID NO: 469751 - DNA, 25 bp, Rattus norvegicus
tttgcttctctctgctctagcgctc

SEQ ID NO: 469752 - DNA, 25 bp, Rattus norvegicus
aagcgaggtagtgtttgcttctctc

SEQ ID NO: 469753 - DNA, 25 bp, Rattus norvegicus
tactctacgagagcgaaagcgaggt

SEQ ID NO: 469754 - DNA, 25 bp, Rattus norvegicus
cacgagttcttactctacgagagcg

SEQ ID NO: 469755 - DNA, 25 bp, Rattus norvegicus
ggtttagcctgcacacgagttctta

SEQ ID NO: 469756 - DNA, 25 bp, Rattus norvegicus
tggtgacgccgacaaaaatctcttg

SEQ ID NO: 469757 - DNA, 25 bp, Rattus norvegicus
cgaagactaggcctttcaggccaaa

SEQ ID NO: 469758 - DNA, 25 bp, Rattus norvegicus
gcacgctcagctctccaaggttggc

SEQ ID NO: 469759 - DNA, 25 bp, Rattus norvegicus
cgcagtcgggaatgtgcagcatacc

SEQ ID NO: 469760 - DNA, 25 bp, Rattus norvegicus
taacgcagggaaaggcggtctctcc

SEQ ID NO: 469761 - DNA, 25 bp, Rattus norvegicus
acacccgcacgcaccttagtgttgg

SEQ ID NO: 469762 - DNA, 25 bp, Rattus norvegicus
cagctcatacttccgcttcttgtgg

SEQ ID NO: 469763 - DNA, 25 bp, Rattus norvegicus
cgcttcttgtggtagggttttctct

SEQ ID NO: 469764 - DNA, 25 bp, Rattus norvegicus
atacccaggtgtcatcatccgcgtg

SEQ ID NO: 469765 - DNA, 25 bp, Rattus norvegicus
agcgaggacgcaagcctgagcaacc

SEQ ID NO: 469766 - DNA, 25 bp, Rattus norvegicus
gcagccatgttggaccgctcgcagc

SEQ ID NO: 469767 - DNA, 25 bp, Rattus norvegicus
gcgcaaagcttcacggtccggtttc

SEQ ID NO: 469768 - DNA, 25 bp, Rattus norvegicus
tctttacgtctcttccggctgccgg

SEQ ID NO: 469769 - DNA, 25 bp, Rattus norvegicus
tcaaatctcttgaccttgggcggtc

SEQ ID NO: 469770 - DNA, 25 bp, Rattus norvegicus
ccgtcgcgctttaagctgaggtcgc

SEQ ID NO: 469771 - DNA, 25 bp, Rattus norvegicus
gcttgtgccagttgtcccgagagat

SEQ ID NO: 469772 - DNA, 25 bp, Rattus norvegicus
atggcctcggccgagctggattaca

SEQ ID NO: 469773 - DNA, 25 bp, Rattus norvegicus
agcgcggttgctaggacccgactag

SEQ ID NO: 469774 - DNA, 25 bp, Rattus norvegicus
tgctaggacccgactagtgggtgcc

SEQ ID NO: 469775 - DNA, 25 bp, Rattus norvegicus
gacccgactagtgggtgccgcccga

SEQ ID NO: 469776 - DNA, 25 bp, Rattus norvegicus
cgcccgaggcgcgaagcgactcggt

SEQ ID NO: 469777 - DNA, 25 bp, Rattus norvegicus
gaagcgactcggtggttgctaggca

SEQ ID NO: 469778 - DNA, 25 bp, Rattus norvegicus
ttgctaggcaggcaggtcacagagt

SEQ ID NO: 469779 - DNA, 25 bp, Rattus norvegicus
ggcccgtgctgacggcccgcaactt

SEQ ID NO: 469780 - DNA, 25 bp, Rattus norvegicus
tgaaactgcgggagttccggcagga

SEQ ID NO: 469781 - DNA, 25 bp, Rattus norvegicus
ctcggccgagctggattacagcatc

SEQ ID NO: 469782 - DNA, 25 bp, Rattus norvegicus
cgagctggattacagcatcgagatc

SEQ ID NO: 469783 - DNA, 25 bp, Rattus norvegicus
gctggattacagcatcgagatcccg

SEQ ID NO: 469784 - DNA, 25 bp, Rattus norvegicus
aggtcacagagtgcggctcggggat

SEQ ID NO: 469785 - DNA, 25 bp, Rattus norvegicus
ttcaccatggcctcggccgagctgg

SEQ ID NO: 469786 - DNA, 25 bp, Rattus norvegicus
aagctggctgcaccgaatccgtatg

SEQ ID NO: 469787 - DNA, 25 bp, Rattus norvegicus
agggtgggcgcttcttacagccccg

SEQ ID NO: 469788 - DNA, 25 bp, Rattus norvegicus
gctggagtaggagagaattattaaa

SEQ ID NO: 469789 - DNA, 25 bp, Rattus norvegicus
cctaagctggctgcaccgaatccgt

SEQ ID NO: 469790 - DNA, 25 bp, Rattus norvegicus
ctggctgcaccgaatccgtatggcc

SEQ ID NO: 469791 - DNA, 25 bp, Rattus norvegicus
ggctgcaccgaatccgtatggcccg

SEQ ID NO: 469792 - DNA, 25 bp, Rattus norvegicus
accgaatccgtatggcccgctccgg

SEQ ID NO: 469793 - DNA, 25 bp, Rattus norvegicus
ctccggcgctgacacggagcagctg

SEQ ID NO: 469794 - DNA, 25 bp, Rattus norvegicus
acacggagcagctgcggtgattcat

SEQ ID NO: 469795 - DNA, 25 bp, Rattus norvegicus
cagctgcggtgattcatgggcagcc

SEQ ID NO: 469796 - DNA, 25 bp, Rattus norvegicus
gtgattcatgggcagccgggccctg

SEQ ID NO: 469797 - DNA, 25 bp, Rattus norvegicus
gggccctgcgctgcggcccatacat

SEQ ID NO: 469798 - DNA, 25 bp, Rattus norvegicus
tgcggcccatacatcatgccagcag

SEQ ID NO: 469799 - DNA, 25 bp, Rattus norvegicus
ttaaataaacatccatacgtcaccc

SEQ ID NO: 469800 - DNA, 25 bp, Rattus norvegicus
cagagcgtcacacgcggcctggagt

SEQ ID NO: 469801 - DNA, 25 bp, Rattus norvegicus
aatagagaacagagcgtcacacgcg

SEQ ID NO: 469802 - DNA, 25 bp, Rattus norvegicus
cggactcaccattcagtcgggtttg

SEQ ID NO: 469803 - DNA, 25 bp, Rattus norvegicus
ccattcagtcgggtttgccggttgg

SEQ ID NO: 469804 - DNA, 25 bp, Rattus norvegicus
tttgccggttggctcgcactcgcaa

SEQ ID NO: 469805 - DNA, 25 bp, Rattus norvegicus
ctcgcactcgcaagaaggtctggga

SEQ ID NO: 469806 - DNA, 25 bp, Rattus norvegicus
cgcaagaaggtctgggagaaaatcc

SEQ ID NO: 469807 - DNA, 25 bp, Rattus norvegicus
agtacccgaccctcatccaggcccg

SEQ ID NO: 469808 - DNA, 25 bp, Rattus norvegicus
gcccgggctgctctaacgggagccc

SEQ ID NO: 469809 - DNA, 25 bp, Rattus norvegicus
ggcggcacttcagctcccagcagcg

SEQ ID NO: 469810 - DNA, 25 bp, Rattus norvegicus
ccatgttggccttgatcacgtgatc

SEQ ID NO: 469811 - DNA, 25 bp, Rattus norvegicus
ggccggaccggactcaccattcagt

SEQ ID NO: 469812 - DNA, 25 bp, Rattus norvegicus
atcacgtgatccgtcgccgtaacgc

SEQ ID NO: 469813 - DNA, 25 bp, Rattus norvegicus
cccggcagatgcaaaaaatagagaa

SEQ ID NO: 469814 - DNA, 25 bp, Rattus norvegicus
gcccaggaagcaaaaagagcgattt

SEQ ID NO: 469815 - DNA, 25 bp, Rattus norvegicus
gccgccagcgcttcggctttatcga

SEQ ID NO: 469816 - DNA, 25 bp, Rattus norvegicus
ttcaggtccctctctgcgttttcgg

SEQ ID NO: 469817 - DNA, 25 bp, Rattus norvegicus
gcgcaaatgcgctcttcaggtccct

SEQ ID NO: 469818 - DNA, 25 bp, Rattus norvegicus
ggcacagacacactgcgcaaatgcg

SEQ ID NO: 469819 - DNA, 25 bp, Rattus norvegicus
agggatttatgcagggtcacgagca

SEQ ID NO: 469820 - DNA, 25 bp, Rattus norvegicus
gtgctctgagaaacgtggatgatga

SEQ ID NO: 469821 - DNA, 25 bp, Rattus norvegicus
agatcccgctgtccggctgtcagac

SEQ ID NO: 469822 - DNA, 25 bp, Rattus norvegicus
cggctttatcgatccgacgggaatt

SEQ ID NO: 469823 - DNA, 25 bp, Rattus norvegicus
ggctgcccttgaacgcctttgccgg

SEQ ID NO: 469824 - DNA, 25 bp, Rattus norvegicus
acgggaatttcacttgctgtgcaga

SEQ ID NO: 469825 - DNA, 25 bp, Rattus norvegicus
cggggccgagacagataaaaccatc

SEQ ID NO: 469826 - DNA, 25 bp, Rattus norvegicus
tccagtccgcagtccggtggacgca

SEQ ID NO: 469827 - DNA, 25 bp, Rattus norvegicus
tcacgagcagcggtagagaggaaaa

SEQ ID NO: 469828 - DNA, 25 bp, Rattus norvegicus
ccggatcgcttctgcatgacaattg

SEQ ID NO: 469829 - DNA, 25 bp, Rattus norvegicus
cccggtcgctgtcattgccaaggaa

SEQ ID NO: 469830 - DNA, 25 bp, Rattus norvegicus
cgcgcggacttctcctgaagagcga

SEQ ID NO: 469831 - DNA, 25 bp, Rattus norvegicus
ctaaaagctcttgtggggccacctg

SEQ ID NO: 469832 - DNA, 25 bp, Rattus norvegicus
caccatggtgatgaggcattccctc

SEQ ID NO: 469833 - DNA, 25 bp, Rattus norvegicus
cagcgcgcagaacagagccaagcca

SEQ ID NO: 469834 - DNA, 25 bp, Rattus norvegicus
cggcgaggtcaaccgcatccctaaa

SEQ ID NO: 469835 - DNA, 25 bp, Rattus norvegicus
gcgagcttcccagcgtcataggcga

SEQ ID NO: 469836 - DNA, 25 bp, Rattus norvegicus
gcccgaataccagcaatcctgcaga

SEQ ID NO: 469837 - DNA, 25 bp, Rattus norvegicus
tgcagattcaccaagccggactccg

SEQ ID NO: 469838 - DNA, 25 bp, Rattus norvegicus
gccggactccggaatattttacaga

SEQ ID NO: 469839 - DNA, 25 bp, Rattus norvegicus
agctgggtccacatgcgtgtgcaca

SEQ ID NO: 469840 - DNA, 25 bp, Rattus norvegicus
gcacaagtccatttgggtcctcacg

SEQ ID NO: 469841 - DNA, 25 bp, Rattus norvegicus
acgcgcgcgtggagttccaatcact

SEQ ID NO: 469842 - DNA, 25 bp, Rattus norvegicus
gggagaatgtgtcctctgctttcca

SEQ ID NO: 469843 - DNA, 25 bp, Rattus norvegicus
gccaggaaaaagtaagccgagcctc

SEQ ID NO: 469844 - DNA, 25 bp, Rattus norvegicus
ctgttcattcacctcagtggcagca

SEQ ID NO: 469845 - DNA, 25 bp, Rattus norvegicus
agctgggagttgaccggtttacata

SEQ ID NO: 469846 - DNA, 25 bp, Rattus norvegicus
gcattactctaaggcctggccagtc

SEQ ID NO: 469847 - DNA, 25 bp, Rattus norvegicus
gccagcagggatcgcattactctaa

SEQ ID NO: 469848 - DNA, 25 bp, Rattus norvegicus
cgcctcgttccttataatcgctgga

SEQ ID NO: 469849 - DNA, 25 bp, Rattus norvegicus
tgattttacaagatcgtcctcccgc

SEQ ID NO: 469850 - DNA, 25 bp, Rattus norvegicus
cggcgtgctcgctgaaaagttttgc

SEQ ID NO: 469851 - DNA, 25 bp, Rattus norvegicus
ccgagccctgaaaagctccgggttg

SEQ ID NO: 469852 - DNA, 25 bp, Rattus norvegicus
ttgtgccctggaagaaaagcctttc

SEQ ID NO: 469853 - DNA, 25 bp, Rattus norvegicus
tacggaagctctccgcccaagtttg

SEQ ID NO: 469854 - DNA, 25 bp, Rattus norvegicus
ggacgaacctcgcatccctagatgg

SEQ ID NO: 469855 - DNA, 25 bp, Rattus norvegicus
gaccagagaaggcagtgcgttctta

SEQ ID NO: 469856 - DNA, 25 bp, Rattus norvegicus
tggagacgagtagccccgccttatt

SEQ ID NO: 469857 - DNA, 25 bp, Rattus norvegicus
cctgcacctggagagagcctgccgt

SEQ ID NO: 469858 - DNA, 25 bp, Rattus norvegicus
cgccttattccagctcattggccaa

SEQ ID NO: 469859 - DNA, 25 bp, Rattus norvegicus
ttccagctcattggccaaaggcgct

SEQ ID NO: 469860 - DNA, 25 bp, Rattus norvegicus
tcattggccaaaggcgctagcggcg

SEQ ID NO: 469861 - DNA, 25 bp, Rattus norvegicus
ggctcagcggttggctactacgccc

SEQ ID NO: 469862 - DNA, 25 bp, Rattus norvegicus
tgagtcggtgtgttgtggactcgtg

SEQ ID NO: 469863 - DNA, 25 bp, Rattus norvegicus
tgccgctgtcgaggctgcctggaac

SEQ ID NO: 469864 - DNA, 25 bp, Rattus norvegicus
cggagctggccctgcttctgcctgg

SEQ ID NO: 469865 - DNA, 25 bp, Rattus norvegicus
gggccgtgtccgctgccgtcaactt

SEQ ID NO: 469866 - DNA, 25 bp, Rattus norvegicus
gtcaacttcccggagcgcctgctga

SEQ ID NO: 469867 - DNA, 25 bp, Rattus norvegicus
cacctggagagagcctgccgtgctg

SEQ ID NO: 469868 - DNA, 25 bp, Rattus norvegicus
agagagcatttggagacgagtagcc

SEQ ID NO: 469869 - DNA, 25 bp, Rattus norvegicus
tggcgacagcctctccggcagctga

SEQ ID NO: 469870 - DNA, 25 bp, Rattus norvegicus
ctttctcgccacgaaggtctgggta

SEQ ID NO: 469871 - DNA, 25 bp, Rattus norvegicus
cccaggaccaacgtttggatgtgtg

SEQ ID NO: 469872 - DNA, 25 bp, Rattus norvegicus
cgtggatgcgatagcgtttgcttgc

SEQ ID NO: 469873 - DNA, 25 bp, Rattus norvegicus
tttgcttgcgggcatctgtggctaa

SEQ ID NO: 469874 - DNA, 25 bp, Rattus norvegicus
tgctcgcaccgggatgtctttctcg

SEQ ID NO: 469875 - DNA, 25 bp, Rattus norvegicus
cgtaagcctgtgtgtcatcgttgtc

SEQ ID NO: 469876 - DNA, 25 bp, Rattus norvegicus
ttgtcaccaaggaactaaagcaggc

SEQ ID NO: 469877 - DNA, 25 bp, Rattus norvegicus
acccgtgtcttgatctgtccagtcg

SEQ ID NO: 469878 - DNA, 25 bp, Rattus norvegicus
cgaagagcgtcttcggtctttctgg

SEQ ID NO: 469879 - DNA, 25 bp, Rattus norvegicus
gggaaaaatccacgtcctgccactc

SEQ ID NO: 469880 - DNA, 25 bp, Rattus norvegicus
tactctagccttccttctgggcgtg

SEQ ID NO: 469881 - DNA, 25 bp, Rattus norvegicus
gcggcatccttctcgccagctgaga

SEQ ID NO: 469882 - DNA, 25 bp, Rattus norvegicus
tccagtcgtggttctgggcgtttct

SEQ ID NO: 469883 - DNA, 25 bp, Rattus norvegicus
ggctaagagtgtgagtgctcgcacc

SEQ ID NO: 469884 - DNA, 25 bp, Rattus norvegicus
ctctcggcaggctgcagcgctggct

SEQ ID NO: 469885 - DNA, 25 bp, Rattus norvegicus
cagaaacgcgcgcttcctgtccttg

SEQ ID NO: 469886 - DNA, 25 bp, Rattus norvegicus
agccgcggctgcagaaacgcgcgct

SEQ ID NO: 469887 - DNA, 25 bp, Rattus norvegicus
atggcattatctcgggccagccgcg

SEQ ID NO: 469888 - DNA, 25 bp, Rattus norvegicus
tgcgccgggacacaatggcattatc

SEQ ID NO: 469889 - DNA, 25 bp, Rattus norvegicus
tgcagcgctggctggcccgagtcca

SEQ ID NO: 469890 - DNA, 25 bp, Rattus norvegicus
cgcgcctcccggaggggacaagaga

SEQ ID NO: 469891 - DNA, 25 bp, Rattus norvegicus
gtctggtgctgtggccaggtttcct

SEQ ID NO: 469892 - DNA, 25 bp, Rattus norvegicus
gtcacgaagtctggtgctgtggcca

SEQ ID NO: 469893 - DNA, 25 bp, Rattus norvegicus
cgtaaaggagaagtcacgaagtctg

SEQ ID NO: 469894 - DNA, 25 bp, Rattus norvegicus
ctgagaacaaaagcgggccaggccg

SEQ ID NO: 469895 - DNA, 25 bp, Rattus norvegicus
gcgccagcacccagtgagctgagaa

SEQ ID NO: 469896 - DNA, 25 bp, Rattus norvegicus
ggcacaaactgtccgccgggcgctc

SEQ ID NO: 469897 - DNA, 25 bp, Rattus norvegicus
cacccagtgagctgagaacaaaagc

SEQ ID NO: 469898 - DNA, 25 bp, Rattus norvegicus
gcggacctctaacatggggcaagtc

SEQ ID NO: 469899 - DNA, 25 bp, Rattus norvegicus
ccgctccgcctgtcccgcgtcgtga

SEQ ID NO: 469900 - DNA, 25 bp, Rattus norvegicus
tcgtgaggcaccacacggggagatt

SEQ ID NO: 469901 - DNA, 25 bp, Rattus norvegicus
ccacacggggagattggtgacgact

SEQ ID NO: 469902 - DNA, 25 bp, Rattus norvegicus
acgactgggcactgagtggcttctt

SEQ ID NO: 469903 - DNA, 25 bp, Rattus norvegicus
gcactgagtggcttcttggtgcgct

SEQ ID NO: 469904 - DNA, 25 bp, Rattus norvegicus
agtttggcctccaccctaacggctg

SEQ ID NO: 469905 - DNA, 25 bp, Rattus norvegicus
gacctctaacatggggcaagtctcg

SEQ ID NO: 469906 - DNA, 25 bp, Rattus norvegicus
ctaacatggggcaagtctcgggcaa

SEQ ID NO: 469907 - DNA, 25 bp, Rattus norvegicus
atggggcaagtctcgggcaagccca

SEQ ID NO: 469908 - DNA, 25 bp, Rattus norvegicus
gcaagtctcgggcaagcccaggcct

SEQ ID NO: 469909 - DNA, 25 bp, Rattus norvegicus
gtgaggcgccagtttggcctccacc

SEQ ID NO: 469910 - DNA, 25 bp, Rattus norvegicus
ccagcggacctctaacatggggcaa

SEQ ID NO: 469911 - DNA, 25 bp, Rattus norvegicus
tggggcccagcggacctctaacatg

SEQ ID NO: 469912 - DNA, 25 bp, Rattus norvegicus
ctccagctgctgtggaccgctctgt

SEQ ID NO: 469913 - DNA, 25 bp, Rattus norvegicus
ccggagcccaggaggctagcgggat

SEQ ID NO: 469914 - DNA, 25 bp, Rattus norvegicus
tgcgcttgcggatgccggagactca

SEQ ID NO: 469915 - DNA, 25 bp, Rattus norvegicus
cccgcctccagtgagcccgcacgcg

SEQ ID NO: 469916 - DNA, 25 bp, Rattus norvegicus
cctcccgcgctacggctcctcggag

SEQ ID NO: 469917 - DNA, 25 bp, Rattus norvegicus
gaccgacggaccactgcgctgccgc

SEQ ID NO: 469918 - DNA, 25 bp, Rattus norvegicus
agctcgggtagggatcccggctcca

SEQ ID NO: 469919 - DNA, 25 bp, Rattus norvegicus
cgccgctccagctcgggtagggatc

SEQ ID NO: 469920 - DNA, 25 bp, Rattus norvegicus
ctcctctcacgcagcgctcggggct

SEQ ID NO: 469921 - DNA, 25 bp, Rattus norvegicus
ctcaccgggtcctggactgggatct

SEQ ID NO: 469922 - DNA, 25 bp, Rattus norvegicus
tgcagcgccggtgcctcgctcaccg

SEQ ID NO: 469923 - DNA, 25 bp, Rattus norvegicus
ggccgagcgcctctgctagacacaa

SEQ ID NO: 469924 - DNA, 25 bp, Rattus norvegicus
cgagcgcctctgctagacacaaggc

SEQ ID NO: 469925 - DNA, 25 bp, Rattus norvegicus
tctgctagacacaaggccggggcga

SEQ ID NO: 469926 - DNA, 25 bp, Rattus norvegicus
aggtactggctctccacctgcgcta

SEQ ID NO: 469927 - DNA, 25 bp, Rattus norvegicus
ggcgcccaaatatgcggctcgcaga

SEQ ID NO: 469928 - DNA, 25 bp, Rattus norvegicus
gtggaacctgagctaaaaccgcgtc

SEQ ID NO: 469929 - DNA, 25 bp, Rattus norvegicus
gcgtcctcctcgacaggtactggct

SEQ ID NO: 469930 - DNA, 25 bp, Rattus norvegicus
gcactgtggtggttgtagtctcttc

SEQ ID NO: 469931 - DNA, 25 bp, Rattus norvegicus
ccctggtagacgtcatgccgtggag

SEQ ID NO: 469932 - DNA, 25 bp, Rattus norvegicus
agcgccacctgaccggcgcatgtga

SEQ ID NO: 469933 - DNA, 25 bp, Rattus norvegicus
tcctgccggccgaattgctgtttac

SEQ ID NO: 469934 - DNA, 25 bp, Rattus norvegicus
atcccgaggtagagcaactccagcc

SEQ ID NO: 469935 - DNA, 25 bp, Rattus norvegicus
cagaaggccacaaaaatcccgaggt

SEQ ID NO: 469936 - DNA, 25 bp, Rattus norvegicus
cgacgatcatgcaggcccagaaggc

SEQ ID NO: 469937 - DNA, 25 bp, Rattus norvegicus
tgctcacccacgacgatcatgcagg

SEQ ID NO: 469938 - DNA, 25 bp, Rattus norvegicus
tgtttacccaacaagctgtgaatgg

SEQ ID NO: 469939 - DNA, 25 bp, Rattus norvegicus
ggccaggaacctggtgtcgcgactc

SEQ ID NO: 469940 - DNA, 25 bp, Rattus norvegicus
gtcctcgaggtcacagcagctttgt

SEQ ID NO: 469941 - DNA, 25 bp, Rattus norvegicus
attcccggttctccactacacaagg

SEQ ID NO: 469942 - DNA, 25 bp, Rattus norvegicus
tcctaggatccacaaggtacgcttc

SEQ ID NO: 469943 - DNA, 25 bp, Rattus norvegicus
cagcagctttgtggatcgggaccaa

SEQ ID NO: 469944 - DNA, 25 bp, Rattus norvegicus
agacgcagctgtgccctccaaagtc

SEQ ID NO: 469945 - DNA, 25 bp, Rattus norvegicus
ctgctgaaggtagactccatggggc

SEQ ID NO: 469946 - DNA, 25 bp, Rattus norvegicus
gtgaactgtcctggaacgcccgcct

SEQ ID NO: 469947 - DNA, 25 bp, Rattus norvegicus
tccaggtcttcaggaggggtgaact

SEQ ID NO: 469948 - DNA, 25 bp, Rattus norvegicus
tccagctcgtacactcggtccaggt

SEQ ID NO: 469949 - DNA, 25 bp, Rattus norvegicus
cgcagataaatctcgtgactcgctc

SEQ ID NO: 469950 - DNA, 25 bp, Rattus norvegicus
tacacaaggaccgagactgcttccg

SEQ ID NO: 469951 - DNA, 25 bp, Rattus norvegicus
ccgctgacatcctaaatcgcagata

SEQ ID NO: 469952 - DNA, 25 bp, Rattus norvegicus
ggcggactccgattttctcaaccca

SEQ ID NO: 469953 - DNA, 25 bp, Rattus norvegicus
acgtgtccacgggtcctaggatcca

SEQ ID NO: 469954 - DNA, 25 bp, Rattus norvegicus
caggcgaaggaacggcacaccgcca

SEQ ID NO: 469955 - DNA, 25 bp, Rattus norvegicus
cccagtgactgacagacgggccggc

SEQ ID NO: 469956 - DNA, 25 bp, Rattus norvegicus
acctcagcaagacgcgggctgaccg

SEQ ID NO: 469957 - DNA, 25 bp, Rattus norvegicus
acccacgcctgtcctggcccggcac

SEQ ID NO: 469958 - DNA, 25 bp, Rattus norvegicus
ggcacggccaagcacatccaggttc

SEQ ID NO: 469959 - DNA, 25 bp, Rattus norvegicus
cacatccaggttcggcatggcggaa

SEQ ID NO: 469960 - DNA, 25 bp, Rattus norvegicus
catggcggaactgcgcggaaactca

SEQ ID NO: 469961 - DNA, 25 bp, Rattus norvegicus
cgcggaaactcattccgggtctttg

SEQ ID NO: 469962 - DNA, 25 bp, Rattus norvegicus
gtctttggccctgttctcgtgctag

SEQ ID NO: 469963 - DNA, 25 bp, Rattus norvegicus
ccggaacaggcgaaggaacggcaca

SEQ ID NO: 469964 - DNA, 25 bp, Rattus norvegicus
ccctatgcaccttgggaaacgtagt

SEQ ID NO: 469965 - DNA, 25 bp, Rattus norvegicus
gttctcctggcccgcgatatgctcg

SEQ ID NO: 469966 - DNA, 25 bp, Rattus norvegicus
cgatatgctcgcctcccggctttgg

SEQ ID NO: 469967 - DNA, 25 bp, Rattus norvegicus
ggccctgttctcgtgctagctcgcg

SEQ ID NO: 469968 - DNA, 25 bp, Rattus norvegicus
agatggtccacggttctccaggtgc

SEQ ID NO: 469969 - DNA, 25 bp, Rattus norvegicus
gtcgcgctctcacttaccaggtagg

SEQ ID NO: 469970 - DNA, 25 bp, Rattus norvegicus
gaggtgtgtagagttagcctcgccc

SEQ ID NO: 469971 - DNA, 25 bp, Rattus norvegicus
tgagacttagtcactttcggaagtg

SEQ ID NO: 469972 - DNA, 25 bp, Rattus norvegicus
tcgctgcacagatgtgcggtgtgtc

SEQ ID NO: 469973 - DNA, 25 bp, Rattus norvegicus
tcgcagggctctttcgctgcacaga

SEQ ID NO: 469974 - DNA, 25 bp, Rattus norvegicus
tcaccggcaccagctgtgagcgcag

SEQ ID NO: 469975 - DNA, 25 bp, Rattus norvegicus
cggaaacgtatcagctcgtcggagc

SEQ ID NO: 469976 - DNA, 25 bp, Rattus norvegicus
accgctgcagaagcggaaacgtatc

SEQ ID NO: 469977 - DNA, 25 bp, Rattus norvegicus
ctcggcggcacgaaccgctgcagaa

SEQ ID NO: 469978 - DNA, 25 bp, Rattus norvegicus
cctcatagcgagtgggccggcaaca

SEQ ID NO: 469979 - DNA, 25 bp, Rattus norvegicus
cacgtccatgaaggagacggcctca

SEQ ID NO: 469980 - DNA, 25 bp, Rattus norvegicus
tctccaggtgctgttcacgtccatg

SEQ ID NO: 469981 - DNA, 25 bp, Rattus norvegicus
cacttaccaggtaggtagtctgttg

SEQ ID NO: 469982 - DNA, 25 bp, Rattus norvegicus
ctgggaattcgaagttggtagtcac

SEQ ID NO: 469983 - DNA, 25 bp, Rattus norvegicus
agcgagacgctgaaactgggaattc

SEQ ID NO: 469984 - DNA, 25 bp, Rattus norvegicus
ggggctagacatttggagaagaccc

SEQ ID NO: 469985 - DNA, 25 bp, Rattus norvegicus
ctttcagggctcacctggctgctcc

SEQ ID NO: 469986 - DNA, 25 bp, Rattus norvegicus
gccgccgtccggtgtcaaattccag

SEQ ID NO: 469987 - DNA, 25 bp, Rattus norvegicus
gcttacctcgggtgcagggctccaa

SEQ ID NO: 469988 - DNA, 25 bp, Rattus norvegicus
atgggcaaggaggctggcttacctc

SEQ ID NO: 469989 - DNA, 25 bp, Rattus norvegicus
catttgagcgtccatcaaggggatg

SEQ ID NO: 469990 - DNA, 25 bp, Rattus norvegicus
ttttcctgccatttgagcgtccatc

SEQ ID NO: 469991 - DNA, 25 bp, Rattus norvegicus
cccagaagagagaggctgagagaaa

SEQ ID NO: 469992 - DNA, 25 bp, Rattus norvegicus
aaagagctgcgctgagggcccagaa

SEQ ID NO: 469993 - DNA, 25 bp, Rattus norvegicus
tcgaagttggtagtcacgcaaagta

SEQ ID NO: 469994 - DNA, 25 bp, Rattus norvegicus
agtcacgcaaagtagggaactggga

SEQ ID NO: 469995 - DNA, 25 bp, Rattus norvegicus
gggccgagcccaactccatccctca

SEQ ID NO: 469996 - DNA, 25 bp, Rattus norvegicus
cgacaggcaggccaatgcgaggctt

SEQ ID NO: 469997 - DNA, 25 bp, Rattus norvegicus
ctttgacaaactgacccggtcgctc

SEQ ID NO: 469998 - DNA, 25 bp, Rattus norvegicus
gacccggtcgctccgaagaggatct

SEQ ID NO: 469999 - DNA, 25 bp, Rattus norvegicus
aaggcagagatgacaaccgctactc

SEQ ID NO: 470000 - DNA, 25 bp, Rattus norvegicus
tgacaaccgctactcttggtgactc

SEQ ID NO: 470001 - DNA, 25 bp, Rattus norvegicus
actcttggtgactcccgctaggctt

SEQ ID NO: 470002 - DNA, 25 bp, Rattus norvegicus
gggtgaccgtgaccctcttctgcgc

SEQ ID NO: 470003 - DNA, 25 bp, Rattus norvegicus
tgcacacaggtgacctcggcgcgct

SEQ ID NO: 470004 - DNA, 25 bp, Rattus norvegicus
cgcggaggcaattgcagcgcttata

SEQ ID NO: 470005 - DNA, 25 bp, Rattus norvegicus
gcagccaatgagagcaccggaaccg

SEQ ID NO: 470006 - DNA, 25 bp, Rattus norvegicus
cccagagacccaatggaagtcgtag

SEQ ID NO: 470007 - DNA, 25 bp, Rattus norvegicus
gagaagacgtactttgacaaactga

SEQ ID NO: 470008 - DNA, 25 bp, Rattus norvegicus
atggaagtcgtaggccgaatccacc

SEQ ID NO: 470009 - DNA, 25 bp, Rattus norvegicus
aattgcagcgcttatagcggggaca

SEQ ID NO: 470010 - DNA, 25 bp, Rattus norvegicus
ggctcccttagctcgctagaacaaa

SEQ ID NO: 470011 - DNA, 25 bp, Rattus norvegicus
aaggtttcggtggtgagtctgacca

SEQ ID NO: 470012 - DNA, 25 bp, Rattus norvegicus
tgagtctgaccacctcgcactggta

SEQ ID NO: 470013 - DNA, 25 bp, Rattus norvegicus
tcgctagaacaaacagcctgggtta

SEQ ID NO: 470014 - DNA, 25 bp, Rattus norvegicus
accgggacggcactgacagttaata

SEQ ID NO: 470015 - DNA, 25 bp, Rattus norvegicus
gctgaaggagccgtcatcaaagttg

SEQ ID NO: 470016 - DNA, 25 bp, Rattus norvegicus
gcaaggctcccttagctcgctagaa

SEQ ID NO: 470017 - DNA, 25 bp, Rattus norvegicus
cggccgtgatgctcagcaaggctcc

SEQ ID NO: 470018 - DNA, 25 bp, Rattus norvegicus
tgatgaccttctggccggccgtgat

SEQ ID NO: 470019 - DNA, 25 bp, Rattus norvegicus
cttgtgcttgctgatgaccttctgg

SEQ ID NO: 470020 - DNA, 25 bp, Rattus norvegicus
tagaagcggccgttcttgtgcttgc

SEQ ID NO: 470021 - DNA, 25 bp, Rattus norvegicus
cctcgcactggtagaagcggccgtt

SEQ ID NO: 470022 - DNA, 25 bp, Rattus norvegicus
cggcactgacagttaatacgctccc

SEQ ID NO: 470023 - DNA, 25 bp, Rattus norvegicus
tgggttaaccgggacggcactgaca

SEQ ID NO: 470024 - DNA, 25 bp, Rattus norvegicus
agcctaccgtcctcgtcggtgcgca

SEQ ID NO: 470025 - DNA, 25 bp, Rattus norvegicus
gataatgccgttgcggctgtcagcc

SEQ ID NO: 470026 - DNA, 25 bp, Rattus norvegicus
tactgggtgataatgccgttgcggc

SEQ ID NO: 470027 - DNA, 25 bp, Rattus norvegicus
ccacggagtactgggtgataatgcc

SEQ ID NO: 470028 - DNA, 25 bp, Rattus norvegicus
ccactgcctcataggccacggagta

SEQ ID NO: 470029 - DNA, 25 bp, Rattus norvegicus
acatgccgtttacggtcctcgccgt

SEQ ID NO: 470030 - DNA, 25 bp, Rattus norvegicus
gatgccatccaccacatgccgttta

SEQ ID NO: 470031 - DNA, 25 bp, Rattus norvegicus
gaatgctcacggctgatgccatcca

SEQ ID NO: 470032 - DNA, 25 bp, Rattus norvegicus
agctggaatgctcacggctgatgcc

SEQ ID NO: 470033 - DNA, 25 bp, Rattus norvegicus
acaggtcccagctggaatgctcacg

SEQ ID NO: 470034 - DNA, 25 bp, Rattus norvegicus
cttctccaggcccaacaggtcccag

SEQ ID NO: 470035 - DNA, 25 bp, Rattus norvegicus
cggtactccgtccacttctccaggc

SEQ ID NO: 470036 - DNA, 25 bp, Rattus norvegicus
tgtgcccgcacccacacccggtact

SEQ ID NO: 470037 - DNA, 25 bp, Rattus norvegicus
tgctctcagggccagggcccacatc

SEQ ID NO: 470038 - DNA, 25 bp, Rattus norvegicus
cattgggctcttcagggggttccca

SEQ ID NO: 470039 - DNA, 25 bp, Rattus norvegicus
cattcgggcctgcacacggcgtgga

SEQ ID NO: 470040 - DNA, 25 bp, Rattus norvegicus
ggcgctcagcattcgggcctgcaca

SEQ ID NO: 470041 - DNA, 25 bp, Rattus norvegicus
tgtaccagcatggtgctggcgctca

SEQ ID NO: 470042 - DNA, 25 bp, Rattus norvegicus
ggggttcccactgtaccagcatggt

SEQ ID NO: 470043 - DNA, 25 bp, Rattus norvegicus
gtaaggagtcctgcgtcggtgttat

SEQ ID NO: 470044 - DNA, 25 bp, Rattus norvegicus
taccaggccattgggctcttcaggg

SEQ ID NO: 470045 - DNA, 25 bp, Rattus norvegicus
ccgtaccaggccattgggctcttca

SEQ ID NO: 470046 - DNA, 25 bp, Rattus norvegicus
ctggggtgtagtagactcgatatcc

SEQ ID NO: 470047 - DNA, 25 bp, Rattus norvegicus
ttatgcttgtgccaggcgctcaagg

SEQ ID NO: 470048 - DNA, 25 bp, Rattus norvegicus
ctgcgtcggtgttatgcttgtgcca

SEQ ID NO: 470049 - DNA, 25 bp, Rattus norvegicus
ttcccactgtaccagcatggtgctg

SEQ ID NO: 470050 - DNA, 25 bp, Rattus norvegicus
tgatgccaggtagcaggctgcccac

SEQ ID NO: 470051 - DNA, 25 bp, Rattus norvegicus
gctgcccacggtggtaaggagtcct

SEQ ID NO: 470052 - DNA, 25 bp, Rattus norvegicus
cgatcagactgtcggagggccagta

SEQ ID NO: 470053 - DNA, 25 bp, Rattus norvegicus
cctctcggtggccagctatcactgg

SEQ ID NO: 470054 - DNA, 25 bp, Rattus norvegicus
ctatcactggattggacgcgcgggt

SEQ ID NO: 470055 - DNA, 25 bp, Rattus norvegicus
tgtgcacaggggcatccaatcgttc

SEQ ID NO: 470056 - DNA, 25 bp, Rattus norvegicus
agcctgcagtgcagctaggtgtgca

SEQ ID NO: 470057 - DNA, 25 bp, Rattus norvegicus
atccaatcgttctggagcctgcagt

SEQ ID NO: 470058 - DNA, 25 bp, Rattus norvegicus
tctctgccttctacgtcggtgagga

SEQ ID NO: 470059 - DNA, 25 bp, Rattus norvegicus
tcctggccaaggtgctatgcgatca

SEQ ID NO: 470060 - DNA, 25 bp, Rattus norvegicus
cttcaactacatgtggctgcgcctg

SEQ ID NO: 470061 - DNA, 25 bp, Rattus norvegicus
ctctggccctgactttccacggaaa

SEQ ID NO: 470062 - DNA, 25 bp, Rattus norvegicus
tgctctgcagcagcgactaaggggc

SEQ ID NO: 470063 - DNA, 25 bp, Rattus norvegicus
tcttctcagccggtgatgctctgca

SEQ ID NO: 470064 - DNA, 25 bp, Rattus norvegicus
actaacgtgctgctctacgccgggc

SEQ ID NO: 470065 - DNA, 25 bp, Rattus norvegicus
ggcgctatccgtggcccactaacgt

SEQ ID NO: 470066 - DNA, 25 bp, Rattus norvegicus
ccggagacacacagagaagcacgta

SEQ ID NO: 470067 - DNA, 25 bp, Rattus norvegicus
agccgacttacaaccgcccaggagg

SEQ ID NO: 470068 - DNA, 25 bp, Rattus norvegicus
cgtgctcttgtgatctgctccttgg

SEQ ID NO: 470069 - DNA, 25 bp, Rattus norvegicus
cgcagccttaggaatcacgcgggcc

SEQ ID NO: 470070 - DNA, 25 bp, Rattus norvegicus
ccaaagggacccagccactgtgatc

SEQ ID NO: 470071 - DNA, 25 bp, Rattus norvegicus
ccactgtgatcagcgctccaagtca

SEQ ID NO: 470072 - DNA, 25 bp, Rattus norvegicus
ctccaagtcagagatgcccgggcgg

SEQ ID NO: 470073 - DNA, 25 bp, Rattus norvegicus
tggccgcgtcatccggttcattctc

SEQ ID NO: 470074 - DNA, 25 bp, Rattus norvegicus
ttctcgctcatttcggtcatggttg

SEQ ID NO: 470075 - DNA, 25 bp, Rattus norvegicus
tctttgggactctcaagcctttctc

SEQ ID NO: 470076 - DNA, 25 bp, Rattus norvegicus
agacggttgtggctaggaattcaga

SEQ ID NO: 470077 - DNA, 25 bp, Rattus norvegicus
gagagggcggcaattacaccgagcc

SEQ ID NO: 470078 - DNA, 25 bp, Rattus norvegicus
tccagtgaccctaggagaaaccctc

SEQ ID NO: 470079 - DNA, 25 bp, Rattus norvegicus
tcaagcctttctccagggtctgctc

SEQ ID NO: 470080 - DNA, 25 bp, Rattus norvegicus
ccactggcggcgtcgctctgcatag

SEQ ID NO: 470081 - DNA, 25 bp, Rattus norvegicus
gctcccgaattttcgatctccatct

SEQ ID NO: 470082 - DNA, 25 bp, Rattus norvegicus
cgaattttcgatctccatctcggga

SEQ ID NO: 470083 - DNA, 25 bp, Rattus norvegicus
ttttcgatctccatctcgggaccca

SEQ ID NO: 470084 - DNA, 25 bp, Rattus norvegicus
ccggggactgagaagagacgcgaaa

SEQ ID NO: 470085 - DNA, 25 bp, Rattus norvegicus
ggagaactgcgccttttggtgccca

SEQ ID NO: 470086 - DNA, 25 bp, Rattus norvegicus
tgcgccttttggtgcccaggtgcaa

SEQ ID NO: 470087 - DNA, 25 bp, Rattus norvegicus
caaggtgccactggcggcgtcgctc

SEQ ID NO: 470088 - DNA, 25 bp, Rattus norvegicus
gtcgctctgcatagccctacctggg

SEQ ID NO: 470089 - DNA, 25 bp, Rattus norvegicus
tctgcatagccctacctgggaggtg

SEQ ID NO: 470090 - DNA, 25 bp, Rattus norvegicus
catagccctacctgggaggtgcgga

SEQ ID NO: 470091 - DNA, 25 bp, Rattus norvegicus
gagcctggggcacgacgctctgctc

SEQ ID NO: 470092 - DNA, 25 bp, Rattus norvegicus
gggcacgacgctctgctccgtgtca

SEQ ID NO: 470093 - DNA, 25 bp, Rattus norvegicus
tgcccaggtgcaaggtgccactggc

SEQ ID NO: 470094 - DNA, 25 bp, Rattus norvegicus
ggaatgcacgggttacgctatagtc

SEQ ID NO: 470095 - DNA, 25 bp, Rattus norvegicus
aggccacccggtaaccatggcgacg

SEQ ID NO: 470096 - DNA, 25 bp, Rattus norvegicus
gcgcccgtgttccataaggggaatg

SEQ ID NO: 470097 - DNA, 25 bp, Rattus norvegicus
gcccgtgttccataaggggaatgca

SEQ ID NO: 470098 - DNA, 25 bp, Rattus norvegicus
cacgggttacgctatagtccctcta

SEQ ID NO: 470099 - DNA, 25 bp, Rattus norvegicus
ggttacgctatagtccctctaaaca

SEQ ID NO: 470100 - DNA, 25 bp, Rattus norvegicus
atagtccctctaaacacgtcctgtc

SEQ ID NO: 470101 - DNA, 25 bp, Rattus norvegicus
tctaaacacgtcctgtcagcacagg

SEQ ID NO: 470102 - DNA, 25 bp, Rattus norvegicus
tcctgtcagcacaggggctgctggc

SEQ ID NO: 470103 - DNA, 25 bp, Rattus norvegicus
tccataaggggaatgcacgggttac

SEQ ID NO: 470104 - DNA, 25 bp, Rattus norvegicus
acccggtaaccatggcgacggcaga

SEQ ID NO: 470105 - DNA, 25 bp, Rattus norvegicus
cgcctccgcgtccaagtcctactgg

SEQ ID NO: 470106 - DNA, 25 bp, Rattus norvegicus
ccaagtcctactgggcgccgccctt

SEQ ID NO: 470107 - DNA, 25 bp, Rattus norvegicus
acacgtcctgtcagcacaggggctg

SEQ ID NO: 470108 - DNA, 25 bp, Rattus norvegicus
ccgggaggcgactgagtgaactttc

SEQ ID NO: 470109 - DNA, 25 bp, Rattus norvegicus
agggagtaagatcgggaggcagcaa

SEQ ID NO: 470110 - DNA, 25 bp, Rattus norvegicus
aggcagcaagcgacacagggaaccg

SEQ ID NO: 470111 - DNA, 25 bp, Rattus norvegicus
tttcggagcgggtccgagcgcaccc

SEQ ID NO: 470112 - DNA, 25 bp, Rattus norvegicus
ccgcgctccgcacggagaccaggga

SEQ ID NO: 470113 - DNA, 25 bp, Rattus norvegicus
ctgagtgaactttcggagcgggtcc

SEQ ID NO: 470114 - DNA, 25 bp, Rattus norvegicus
ttagagaccgggcacaccaggaagg

SEQ ID NO: 470115 - DNA, 25 bp, Rattus norvegicus
cgcagagattagagaccgggcacac

SEQ ID NO: 470116 - DNA, 25 bp, Rattus norvegicus
cgtcctcccgggacgagccgctttg

SEQ ID NO: 470117 - DNA, 25 bp, Rattus norvegicus
cgacacagggaaccggagacaccta

SEQ ID NO: 470118 - DNA, 25 bp, Rattus norvegicus
gagaaatgcgccgagacgaagacgc

SEQ ID NO: 470119 - DNA, 25 bp, Rattus norvegicus
agacacctagggaaaccgagaaatg

SEQ ID NO: 470120 - DNA, 25 bp, Rattus norvegicus
ctagggaaaccgagaaatgcgccga

SEQ ID NO: 470121 - DNA, 25 bp, Rattus norvegicus
aaaccgagaaatgcgccgagacgaa

SEQ ID NO: 470122 - DNA, 25 bp, Rattus norvegicus
cggctagcaggaaccggaagttgtt

SEQ ID NO: 470123 - DNA, 25 bp, Rattus norvegicus
gatggacgcgttctgagttttctga

SEQ ID NO: 470124 - DNA, 25 bp, Rattus norvegicus
gacgcgttctgagttttctgattgg

SEQ ID NO: 470125 - DNA, 25 bp, Rattus norvegicus
ggggcgctccgaggccatcacactg

SEQ ID NO: 470126 - DNA, 25 bp, Rattus norvegicus
tttctgattggtgagatctgcaggc

SEQ ID NO: 470127 - DNA, 25 bp, Rattus norvegicus
attgagcccgctgacgcgagaaggt

SEQ ID NO: 470128 - DNA, 25 bp, Rattus norvegicus
agatctgcaggctgtgcgaggaacc

SEQ ID NO: 470129 - DNA, 25 bp, Rattus norvegicus
gattcgagaaagtagtgggctgccc

SEQ ID NO: 470130 - DNA, 25 bp, Rattus norvegicus
ttgggcctttgagccgttggcctga

SEQ ID NO: 470131 - DNA, 25 bp, Rattus norvegicus
cagaggcctcggctgtttgaggaaa

SEQ ID NO: 470132 - DNA, 25 bp, Rattus norvegicus
agggaggtcgctccactcctgacct

SEQ ID NO: 470133 - DNA, 25 bp, Rattus norvegicus
tgggaaagggtcgagtcgacattta

SEQ ID NO: 470134 - DNA, 25 bp, Rattus norvegicus
tctgacccggctagcaggaaccgga

SEQ ID NO: 470135 - DNA, 25 bp, Rattus norvegicus
gtcgagtcgacatttaggaagattc

SEQ ID NO: 470136 - DNA, 25 bp, Rattus norvegicus
ggcctgtggcttcttttgctttgcg

SEQ ID NO: 470137 - DNA, 25 bp, Rattus norvegicus
atgcgttcttttctgaccggctaaa

SEQ ID NO: 470138 - DNA, 25 bp, Rattus norvegicus
gtctgtagaagtgccgaatgcgttc

SEQ ID NO: 470139 - DNA, 25 bp, Rattus norvegicus
ggcacgccgaacagttattcttaaa

SEQ ID NO: 470140 - DNA, 25 bp, Rattus norvegicus
cctgactcctcagtgcgtctgtaga

SEQ ID NO: 470141 - DNA, 25 bp, Rattus norvegicus
tctcgaacacgaactgcgccatggc

SEQ ID NO: 470142 - DNA, 25 bp, Rattus norvegicus
gctgccagcgagcaatcggtgcatt

SEQ ID NO: 470143 - DNA, 25 bp, Rattus norvegicus
ggtcttccgggagcaaatctcacga

SEQ ID NO: 470144 - DNA, 25 bp, Rattus norvegicus
ggcgcgtccagttgaagcagtgaat

SEQ ID NO: 470145 - DNA, 25 bp, Rattus norvegicus
tcgattggtcgctacactgaagagg

SEQ ID NO: 470146 - DNA, 25 bp, Rattus norvegicus
gggagccttagtccgagcccaaatc

SEQ ID NO: 470147 - DNA, 25 bp, Rattus norvegicus
gtcagtcctctggaccgctcgtgtt

SEQ ID NO: 470148 - DNA, 25 bp, Rattus norvegicus
gctgctagtgttcattggctccttc

SEQ ID NO: 470149 - DNA, 25 bp, Rattus norvegicus
taaccgtcgcctttgtcgattggtc

SEQ ID NO: 470150 - DNA, 25 bp, Rattus norvegicus
taaatccgagggcttggagaagccc

SEQ ID NO: 470151 - DNA, 25 bp, Rattus norvegicus
gacacacaggtcaggaagaaacgct

SEQ ID NO: 470152 - DNA, 25 bp, Rattus norvegicus
gcctcaccagacacacaggtcagga

SEQ ID NO: 470153 - DNA, 25 bp, Rattus norvegicus
cccagacgtcggagctcctccctgc

SEQ ID NO: 470154 - DNA, 25 bp, Rattus norvegicus
tcatccttttccagcagcaggggcg

SEQ ID NO: 470155 - DNA, 25 bp, Rattus norvegicus
gcgatcatccttttccagcagcagg

SEQ ID NO: 470156 - DNA, 25 bp, Rattus norvegicus
tgcgcactatgcgatcatccttttc

SEQ ID NO: 470157 - DNA, 25 bp, Rattus norvegicus
tgggaaggtgcgcactatgcgatca

SEQ ID NO: 470158 - DNA, 25 bp, Rattus norvegicus
cccgcagcgtgacctggtgtgaacc

SEQ ID NO: 470159 - DNA, 25 bp, Rattus norvegicus
cgcctactaaatccgagggcttgga

SEQ ID NO: 470160 - DNA, 25 bp, Rattus norvegicus
cgcaggagaagacgcctactaaatc

SEQ ID NO: 470161 - DNA, 25 bp, Rattus norvegicus
cccacgcaggagaagacgcctacta

SEQ ID NO: 470162 - DNA, 25 bp, Rattus norvegicus
tgcgcctcgtgccagctccacccac

SEQ ID NO: 470163 - DNA, 25 bp, Rattus norvegicus
acctggtgtgaaccgttgcgagtga

SEQ ID NO: 470164 - DNA, 25 bp, Rattus norvegicus
tcttcctaaagagccggagcaatcc

SEQ ID NO: 470165 - DNA, 25 bp, Rattus norvegicus
tccttggaacgggatgtgcacaggc

SEQ ID NO: 470166 - DNA, 25 bp, Rattus norvegicus
agccaggcctcaatgtcgtgctaga

SEQ ID NO: 470167 - DNA, 25 bp, Rattus norvegicus
tgcaggatgcgttttcccgcggact

SEQ ID NO: 470168 - DNA, 25 bp, Rattus norvegicus
ggcgtcccggtctatagttgcagga

SEQ ID NO: 470169 - DNA, 25 bp, Rattus norvegicus
tagctcttcggtactgaggcgtccc

SEQ ID NO: 470170 - DNA, 25 bp, Rattus norvegicus
cctggcctcagatcaagaggtagac

SEQ ID NO: 470171 - DNA, 25 bp, Rattus norvegicus
agcggaagtacttgttgaaaagcca

SEQ ID NO: 470172 - DNA, 25 bp, Rattus norvegicus
gaagtttggctctgcacccggaagc

SEQ ID NO: 470173 - DNA, 25 bp, Rattus norvegicus
cgattcttgtgggacagatgtaccc

SEQ ID NO: 470174 - DNA, 25 bp, Rattus norvegicus
gccagagcagttcctatagcaacga

SEQ ID NO: 470175 - DNA, 25 bp, Rattus norvegicus
ggcacgcccaaacgccagagcagtt

SEQ ID NO: 470176 - DNA, 25 bp, Rattus norvegicus
gcgacccgcaggtgttcttcctaaa

SEQ ID NO: 470177 - DNA, 25 bp, Rattus norvegicus
gtgcttcttgggagaccgattcttg

SEQ ID NO: 470178 - DNA, 25 bp, Rattus norvegicus
cacccggggactgcaaattctagca

SEQ ID NO: 470179 - DNA, 25 bp, Rattus norvegicus
tctagcatccaaacccagattgcgg

SEQ ID NO: 470180 - DNA, 25 bp, Rattus norvegicus
ccaatggcggcggtcctataaaaag

SEQ ID NO: 470181 - DNA, 25 bp, Rattus norvegicus
cctataaaaaggcagctccgcgcgc

SEQ ID NO: 470182 - DNA, 25 bp, Rattus norvegicus
ttcctaagaacacaagaatcccttg

SEQ ID NO: 470183 - DNA, 25 bp, Rattus norvegicus
gaatcccttgtggagtgtcggttta

SEQ ID NO: 470184 - DNA, 25 bp, Rattus norvegicus
tacagggtcttaagtgagtcagggc

SEQ ID NO: 470185 - DNA, 25 bp, Rattus norvegicus
cgggagacgcatagtcacagcacgt

SEQ ID NO: 470186 - DNA, 25 bp, Rattus norvegicus
agcacgtccattctccgtttcacag

SEQ ID NO: 470187 - DNA, 25 bp, Rattus norvegicus
cacagcttgagcctcgagcgcagcg

SEQ ID NO: 470188 - DNA, 25 bp, Rattus norvegicus
gccatggagcccagcagcaaggtga

SEQ ID NO: 470189 - DNA, 25 bp, Rattus norvegicus
gcccattggctaaaagggccgagcc

SEQ ID NO: 470190 - DNA, 25 bp, Rattus norvegicus
acgatctccggggaccgcacgatgc

SEQ ID NO: 470191 - DNA, 25 bp, Rattus norvegicus
ggtgaaggcacttcctccaggcctg

SEQ ID NO: 470192 - DNA, 25 bp, Rattus norvegicus
agcagcttccaagcccttagcgaaa

SEQ ID NO: 470193 - DNA, 25 bp, Rattus norvegicus
acagccgcgacccacctcacttcgg

SEQ ID NO: 470194 - DNA, 25 bp, Rattus norvegicus
ccacgtcacctcaacacagccgcga

SEQ ID NO: 470195 - DNA, 25 bp, Rattus norvegicus
tcacttcggcagcttggtcagggac

SEQ ID NO: 470196 - DNA, 25 bp, Rattus norvegicus
agcttggtcagggacagcgccgcct

SEQ ID NO: 470197 - DNA, 25 bp, Rattus norvegicus
tccaagcccttagcgaaagcgaagg

SEQ ID NO: 470198 - DNA, 25 bp, Rattus norvegicus
gcagcggagggacactcgacacccg

SEQ ID NO: 470199 - DNA, 25 bp, Rattus norvegicus
agggacactcgacacccggcggcct

SEQ ID NO: 470200 - DNA, 25 bp, Rattus norvegicus
cccttagcgaaagcgaaggggtcag

SEQ ID NO: 470201 - DNA, 25 bp, Rattus norvegicus
ggcggcctttgggactcgcaaaaca

SEQ ID NO: 470202 - DNA, 25 bp, Rattus norvegicus
ttgggactcgcaaaacagcagcttc

SEQ ID NO: 470203 - DNA, 25 bp, Rattus norvegicus
gactcgcaaaacagcagcttccaaa

SEQ ID NO: 470204 - DNA, 25 bp, Rattus norvegicus
acctcacttcggcagcttggtcagg

SEQ ID NO: 470205 - DNA, 25 bp, Rattus norvegicus
gcttccaaaaaagcagcttccaagc

SEQ ID NO: 470206 - DNA, 25 bp, Rattus norvegicus
ttctgcgggagggacatctcaggcc

SEQ ID NO: 470207 - DNA, 25 bp, Rattus norvegicus
ccggatccgccctccaaccacagga

SEQ ID NO: 470208 - DNA, 25 bp, Rattus norvegicus
tccgccctccaaccacaggacccgc

SEQ ID NO: 470209 - DNA, 25 bp, Rattus norvegicus
tccggccacgcccaggtgtgctcgc

SEQ ID NO: 470210 - DNA, 25 bp, Rattus norvegicus
caggtgtgctcgctacgcctgcgca

SEQ ID NO: 470211 - DNA, 25 bp, Rattus norvegicus
aggtgtgctcgctacgcctgcgcag

SEQ ID NO: 470212 - DNA, 25 bp, Rattus norvegicus
ggcccgcccagtccaagggcagcgg

SEQ ID NO: 470213 - DNA, 25 bp, Rattus norvegicus
gcttgtctgcgacgtggcggagttc

SEQ ID NO: 470214 - DNA, 25 bp, Rattus norvegicus
ctgaggccgggtaaggaaacgcgcg

SEQ ID NO: 470215 - DNA, 25 bp, Rattus norvegicus
ctgctgcggacggagtggcttgccc

SEQ ID NO: 470216 - DNA, 25 bp, Rattus norvegicus
gtggcttgcccctcggcctctgaga

SEQ ID NO: 470217 - DNA, 25 bp, Rattus norvegicus
tctgagacccggccctaccgtaagc

SEQ ID NO: 470218 - DNA, 25 bp, Rattus norvegicus
tcctgctcccggatccgccctccaa

SEQ ID NO: 470219 - DNA, 25 bp, Rattus norvegicus
taaactccgcgtgggggcttgtctg

SEQ ID NO: 470220 - DNA, 25 bp, Rattus norvegicus
atctagtcacttcccaggcggcctg

SEQ ID NO: 470221 - DNA, 25 bp, Rattus norvegicus
caggttgcgctaagtggaggaccta

SEQ ID NO: 470222 - DNA, 25 bp, Rattus norvegicus
cgatgaattgcattacggggtgttg

SEQ ID NO: 470223 - DNA, 25 bp, Rattus norvegicus
gccattttcctcctctttctagacg

SEQ ID NO: 470224 - DNA, 25 bp, Rattus norvegicus
gcggtccctgctcggagccattttc

SEQ ID NO: 470225 - DNA, 25 bp, Rattus norvegicus
acccaaagtgcagcaggcggtccct

SEQ ID NO: 470226 - DNA, 25 bp, Rattus norvegicus
tgagctggcacccacatctttctgg

SEQ ID NO: 470227 - DNA, 25 bp, Rattus norvegicus
gacccacgcggaacctgagctttca

SEQ ID NO: 470228 - DNA, 25 bp, Rattus norvegicus
gcgaggactcactggcacgtactga

SEQ ID NO: 470229 - DNA, 25 bp, Rattus norvegicus
agcagggaccgcacatcaccggatc

SEQ ID NO: 470230 - DNA, 25 bp, Rattus norvegicus
gcaacgccgctcctcattgggcaga

SEQ ID NO: 470231 - DNA, 25 bp, Rattus norvegicus
gtcgctagctcggtcctcttcaaag

SEQ ID NO: 470232 - DNA, 25 bp, Rattus norvegicus
actgtcgccttgaacccaaagtgca

SEQ ID NO: 470233 - DNA, 25 bp, Rattus norvegicus
gtgcgcgagcccactaggacaagga

SEQ ID NO: 470234 - DNA, 25 bp, Rattus norvegicus
ggggtccgccataacagcacctcag

SEQ ID NO: 470235 - DNA, 25 bp, Rattus norvegicus
ggagcccgtacaactacctgcaggt

SEQ ID NO: 470236 - DNA, 25 bp, Rattus norvegicus
agggctcctgtgatacacacccgga

SEQ ID NO: 470237 - DNA, 25 bp, Rattus norvegicus
cccagatttcccgtgcctcttttga

SEQ ID NO: 470238 - DNA, 25 bp, Rattus norvegicus
gcccgtagggaagctcagactgaaa

SEQ ID NO: 470239 - DNA, 25 bp, Rattus norvegicus
gcggagctttctcattctcgggcca

SEQ ID NO: 470240 - DNA, 25 bp, Rattus norvegicus
tcctgaccacgagcttctgggtttg

SEQ ID NO: 470241 - DNA, 25 bp, Rattus norvegicus
cctgacctactttacgcagagggga

SEQ ID NO: 470242 - DNA, 25 bp, Rattus norvegicus
tggtactgaacatggagcgggctct

SEQ ID NO: 470243 - DNA, 25 bp, Rattus norvegicus
cttgcacgaccttcgcttcttcgga

SEQ ID NO: 470244 - DNA, 25 bp, Rattus norvegicus
cgccttctgcccacttgttgagtga

SEQ ID NO: 470245 - DNA, 25 bp, Rattus norvegicus
tggagttcaacaagcggagcccgta

SEQ ID NO: 470246 - DNA, 25 bp, Rattus norvegicus
cccgttaagtggaggagcaagacca

SEQ ID NO: 470247 - DNA, 25 bp, Rattus norvegicus
gtgtaagttgaagcctcccgcgaga

SEQ ID NO: 470248 - DNA, 25 bp, Rattus norvegicus
cgtgtgcagcacatgcaggaccatc

SEQ ID NO: 470249 - DNA, 25 bp, Rattus norvegicus
gccaagaggtgtcttgcgcctcaca

SEQ ID NO: 470250 - DNA, 25 bp, Rattus norvegicus
ttgcgcctcacaccacaagtgggct

SEQ ID NO: 470251 - DNA, 25 bp, Rattus norvegicus
ttggccttggtctttgggcaaaata

SEQ ID NO: 470252 - DNA, 25 bp, Rattus norvegicus
tcttagcacttcagagcggtaactc

SEQ ID NO: 470253 - DNA, 25 bp, Rattus norvegicus
gaagccctttttaggcgtcctgtga

SEQ ID NO: 470254 - DNA, 25 bp, Rattus norvegicus
tgtgaggacgcgatacaagactttc

SEQ ID NO: 470255 - DNA, 25 bp, Rattus norvegicus
ttcagcgtactgagaccaggcttcc

SEQ ID NO: 470256 - DNA, 25 bp, Rattus norvegicus
acacgtatgctcaggtctcggacta

SEQ ID NO: 470257 - DNA, 25 bp, Rattus norvegicus
accttccctgcaggcaaatcctgga

SEQ ID NO: 470258 - DNA, 25 bp, Rattus norvegicus
ccactaccgtgactgccagggactg

SEQ ID NO: 470259 - DNA, 25 bp, Rattus norvegicus
agcaggacccggctttctttgctgc

SEQ ID NO: 470260 - DNA, 25 bp, Rattus norvegicus
gggcctcgcgcactccagagaatcg

SEQ ID NO: 470261 - DNA, 25 bp, Rattus norvegicus
ttcccgcttgctcgctcagtgagcg

SEQ ID NO: 470262 - DNA, 25 bp, Rattus norvegicus
gctgcctaccatcctcaaagcccta

SEQ ID NO: 470263 - DNA, 25 bp, Rattus norvegicus
tccgcaccctacaaaagtcattatt

SEQ ID NO: 470264 - DNA, 25 bp, Rattus norvegicus
ctcaataaatttcccaagagctggg

SEQ ID NO: 470265 - DNA, 25 bp, Rattus norvegicus
acgaaggaaatccaaatactcaata

SEQ ID NO: 470266 - DNA, 25 bp, Rattus norvegicus
ttattgacaataacgaaggaaatcc

SEQ ID NO: 470267 - DNA, 25 bp, Rattus norvegicus
caaagccctagcttcaattcccagg

SEQ ID NO: 470268 - DNA, 25 bp, Rattus norvegicus
ttcccaggacaagcaaacaagagtg

SEQ ID NO: 470269 - DNA, 25 bp, Rattus norvegicus
caaacaagagtgctgtcatgtcaca

SEQ ID NO: 470270 - DNA, 25 bp, Rattus norvegicus
gtgctgtcatgtcacactctgtgtc

SEQ ID NO: 470271 - DNA, 25 bp, Rattus norvegicus
tgtcacactctgtgtcaactccttt

SEQ ID NO: 470272 - DNA, 25 bp, Rattus norvegicus
ctgtgtcaactccttttgcttttgg

SEQ ID NO: 470273 - DNA, 25 bp, Rattus norvegicus
caactccttttgcttttggcactta

SEQ ID NO: 470274 - DNA, 25 bp, Rattus norvegicus
tttgcttttggcacttacctccatc

SEQ ID NO: 470275 - DNA, 25 bp, Rattus norvegicus
ttttggcacttacctccatcacttc

SEQ ID NO: 470276 - DNA, 25 bp, Rattus norvegicus
tccttcccacggctgggtgaacgct

SEQ ID NO: 470277 - DNA, 25 bp, Rattus norvegicus
tctcccattggcctacatcgttgtc

SEQ ID NO: 470278 - DNA, 25 bp, Rattus norvegicus
tgaccgggtctctagcacctattgg

SEQ ID NO: 470279 - DNA, 25 bp, Rattus norvegicus
gctcctgtgctctcattggtacctt

SEQ ID NO: 470280 - DNA, 25 bp, Rattus norvegicus
ttggtacctttagcgactaattcgc

SEQ ID NO: 470281 - DNA, 25 bp, Rattus norvegicus
cgccgccatagagaccggaactaga

SEQ ID NO: 470282 - DNA, 25 bp, Rattus norvegicus
cggaactagaatgagagcctgggcc

SEQ ID NO: 470283 - DNA, 25 bp, Rattus norvegicus
cctgggccgagaacaccatagagta

SEQ ID NO: 470284 - DNA, 25 bp, Rattus norvegicus
caccatagagtaccgggaggacgcg

SEQ ID NO: 470285 - DNA, 25 bp, Rattus norvegicus
gctgggcctactccggccttctata

SEQ ID NO: 470286 - DNA, 25 bp, Rattus norvegicus
acgctgaggccttcttaatggttca

SEQ ID NO: 470287 - DNA, 25 bp, Rattus norvegicus
gttcaggctttttggtgatccagtc

SEQ ID NO: 470288 - DNA, 25 bp, Rattus norvegicus
ctaccgatcgaactagcgagaatgg

SEQ ID NO: 470289 - DNA, 25 bp, Rattus norvegicus
gacgcgcagagggaacgttcccgca

SEQ ID NO: 470290 - DNA, 25 bp, Rattus norvegicus
ctgcaggtcctcagtcgtagggtga

SEQ ID NO: 470291 - DNA, 25 bp, Rattus norvegicus
agcaactcggctgagaaggagctgc

SEQ ID NO: 470292 - DNA, 25 bp, Rattus norvegicus
gggccggagcctagacttgaaacaa

SEQ ID NO: 470293 - DNA, 25 bp, Rattus norvegicus
cacaacagtttgctccaggaggaga

SEQ ID NO: 470294 - DNA, 25 bp, Rattus norvegicus
ccaggaggagaacctcaaggtaact

SEQ ID NO: 470295 - DNA, 25 bp, Rattus norvegicus
tcaaggtaactctctcgcgcacgca

SEQ ID NO: 470296 - DNA, 25 bp, Rattus norvegicus
ctgcagatcctgagcaactcggctg

SEQ ID NO: 470297 - DNA, 25 bp, Rattus norvegicus
cggggctaagtcacggttccgctct

SEQ ID NO: 470298 - DNA, 25 bp, Rattus norvegicus
ctaagtcacggttccgctctctcgg

SEQ ID NO: 470299 - DNA, 25 bp, Rattus norvegicus
tctctcggctgccaacagggtgcag

SEQ ID NO: 470300 - DNA, 25 bp, Rattus norvegicus
ctgccaacagggtgcagatgctgtc

SEQ ID NO: 470301 - DNA, 25 bp, Rattus norvegicus
tgctgtcggtcgtaaacacaaaggg

SEQ ID NO: 470302 - DNA, 25 bp, Rattus norvegicus
gacttgaaacaacacaacagtttgc

SEQ ID NO: 470303 - DNA, 25 bp, Rattus norvegicus
gtgcagatgctgtcggtcgtaaaca

SEQ ID NO: 470304 - DNA, 25 bp, Rattus norvegicus
gagctctttgcagacgtggtgccta

SEQ ID NO: 470305 - DNA, 25 bp, Rattus norvegicus
atctcccgtttcttgcaggaagttg

SEQ ID NO: 470306 - DNA, 25 bp, Rattus norvegicus
ggtcgcatgaagatcgagctctttg

SEQ ID NO: 470307 - DNA, 25 bp, Rattus norvegicus
gctcggaccaactcagctaaaattc

SEQ ID NO: 470308 - DNA, 25 bp, Rattus norvegicus
tcgtgggctgagtattgcatctccc

SEQ ID NO: 470309 - DNA, 25 bp, Rattus norvegicus
agccctcccgagataggctgggtca

SEQ ID NO: 470310 - DNA, 25 bp, Rattus norvegicus
ccagtggtcttctttgatgtcagta

SEQ ID NO: 470311 - DNA, 25 bp, Rattus norvegicus
ttcaagtcccgtcaatccagtggtc

SEQ ID NO: 470312 - DNA, 25 bp, Rattus norvegicus
tacttccgagtcaaagccatggcgg

SEQ ID NO: 470313 - DNA, 25 bp, Rattus norvegicus
cctgtcaccggaagttaggcttcta

SEQ ID NO: 470314 - DNA, 25 bp, Rattus norvegicus
tccgatgaagttcgcgggacctgtc

SEQ ID NO: 470315 - DNA, 25 bp, Rattus norvegicus
tgcgtctgcgtttccgatgaagttc

SEQ ID NO: 470316 - DNA, 25 bp, Rattus norvegicus
gcgcaaccgcggactgtttccactg

SEQ ID NO: 470317 - DNA, 25 bp, Rattus norvegicus
ccatggcggtggcaaattcaagtcc

SEQ ID NO: 470318 - DNA, 25 bp, Rattus norvegicus
cacaacggtgtctcccgggcctttg

SEQ ID NO: 470319 - DNA, 25 bp, Rattus norvegicus
atggcaaccgcgctcagcaggggac

SEQ ID NO: 470320 - DNA, 25 bp, Rattus norvegicus
tgggatttccctgagagcctgcaga

SEQ ID NO: 470321 - DNA, 25 bp, Rattus norvegicus
tgtgcaccacgggaagagcaggtcc

SEQ ID NO: 470322 - DNA, 25 bp, Rattus norvegicus
ccgaagagatctggaatgtgcacca

SEQ ID NO: 470323 - DNA, 25 bp, Rattus norvegicus
ctcaccggggatccgaagagatctg

SEQ ID NO: 470324 - DNA, 25 bp, Rattus norvegicus
acatgaaggagctcaccggggatcc

SEQ ID NO: 470325 - DNA, 25 bp, Rattus norvegicus
cggcctgcagagcttcatccggatg

SEQ ID NO: 470326 - DNA, 25 bp, Rattus norvegicus
cctttgtggctgtcgggaccttcga

SEQ ID NO: 470327 - DNA, 25 bp, Rattus norvegicus
gcccacgcgcaggacacaacggtgt

SEQ ID NO: 470328 - DNA, 25 bp, Rattus norvegicus
acgaagctagcacgacagtcctttc

SEQ ID NO: 470329 - DNA, 25 bp, Rattus norvegicus
ttgcgctggacgaagctagcacgac

SEQ ID NO: 470330 - DNA, 25 bp, Rattus norvegicus
ttcatccggatgcaaggttgcgctg

SEQ ID NO: 470331 - DNA, 25 bp, Rattus norvegicus
ggaccttcgaggacagtcacgagca

SEQ ID NO: 470332 - DNA, 25 bp, Rattus norvegicus
aaagcgagccataacctcggcccag

SEQ ID NO: 470333 - DNA, 25 bp, Rattus norvegicus
ttccggatacctgagctgcgcgcag

SEQ ID NO: 470334 - DNA, 25 bp, Rattus norvegicus
ggcaactcagccaccaggtccattt

SEQ ID NO: 470335 - DNA, 25 bp, Rattus norvegicus
cgtgctcggtacaagaacaagaccc

SEQ ID NO: 470336 - DNA, 25 bp, Rattus norvegicus
cagcctggccgcaaagcgagccata

SEQ ID NO: 470337 - DNA, 25 bp, Rattus norvegicus
ttagtgcctccagacgtgaccagca

SEQ ID NO: 470338 - DNA, 25 bp, Rattus norvegicus
aggaaccttagtgcctccagacgtg

SEQ ID NO: 470339 - DNA, 25 bp, Rattus norvegicus
tcgcgcttccagaggaaccttagtg

SEQ ID NO: 470340 - DNA, 25 bp, Rattus norvegicus
aaagcgcacggctcgcgcttccaga

SEQ ID NO: 470341 - DNA, 25 bp, Rattus norvegicus
atttccgccatctgcaccgtagtca

SEQ ID NO: 470342 - DNA, 25 bp, Rattus norvegicus
gccgagcgtgctcggtacaagaaca

SEQ ID NO: 470343 - DNA, 25 bp, Rattus norvegicus
tgaagttgtccagaaagcgcacggc

SEQ ID NO: 470344 - DNA, 25 bp, Rattus norvegicus
gcccgctgctgaagttgtccagaaa

SEQ ID NO: 470345 - DNA, 25 bp, Rattus norvegicus
cagccaggaagacctccgccgacgc

SEQ ID NO: 470346 - DNA, 25 bp, Rattus norvegicus
ccgggctcaaagaagagagccgctg

SEQ ID NO: 470347 - DNA, 25 bp, Rattus norvegicus
agccaatcagcacgtcgcgccgccc

SEQ ID NO: 470348 - DNA, 25 bp, Rattus norvegicus
tctgcagaccctgccggcgaatgct

SEQ ID NO: 470349 - DNA, 25 bp, Rattus norvegicus
cgcacatggcgaccgaagctgcggt

SEQ ID NO: 470350 - DNA, 25 bp, Rattus norvegicus
agacctgcgcgcacatggcgaccga

SEQ ID NO: 470351 - DNA, 25 bp, Rattus norvegicus
tcctcgcggatgagccggtcggtca

SEQ ID NO: 470352 - DNA, 25 bp, Rattus norvegicus
acctgcgggtagtcctcgcggatga

SEQ ID NO: 470353 - DNA, 25 bp, Rattus norvegicus
caggatctgcacctgcgggtagtcc

SEQ ID NO: 470354 - DNA, 25 bp, Rattus norvegicus
atctggtcaaggaacacggcccgga

SEQ ID NO: 470355 - DNA, 25 bp, Rattus norvegicus
tgacggcgatctggtcaaggaacac

SEQ ID NO: 470356 - DNA, 25 bp, Rattus norvegicus
cgccgacaaccgtgacggcgatctg

SEQ ID NO: 470357 - DNA, 25 bp, Rattus norvegicus
agctcacctaggtggccgccgacaa

SEQ ID NO: 470358 - DNA, 25 bp, Rattus norvegicus
aagagagccgctggctcacgggacc

SEQ ID NO: 470359 - DNA, 25 bp, Rattus norvegicus
ccgggctgagctcacctaggtggcc

SEQ ID NO: 470360 - DNA, 25 bp, Rattus norvegicus
agctctcacgcctgaggcgcaagca

SEQ ID NO: 470361 - DNA, 25 bp, Rattus norvegicus
cgggttcttgacattccgaaggacg

SEQ ID NO: 470362 - DNA, 25 bp, Rattus norvegicus
tgacattccgaaggacgcgtgtccc

SEQ ID NO: 470363 - DNA, 25 bp, Rattus norvegicus
ccgggaaaatctgcgctgtgtgctt

SEQ ID NO: 470364 - DNA, 25 bp, Rattus norvegicus
aaaatctgcgctgtgtgcttgtcgg

SEQ ID NO: 470365 - DNA, 25 bp, Rattus norvegicus
ggcgcattcctcaggagttggaatc

SEQ ID NO: 470366 - DNA, 25 bp, Rattus norvegicus
ggcgcaagcactgcaaggctctccg

SEQ ID NO: 470367 - DNA, 25 bp, Rattus norvegicus
tcccgctggccgcacggaggcagaa

SEQ ID NO: 470368 - DNA, 25 bp, Rattus norvegicus
acggaggcagaaccgcgagagccta

SEQ ID NO: 470369 - DNA, 25 bp, Rattus norvegicus
agagcctagaggcactacttgtccc

SEQ ID NO: 470370 - DNA, 25 bp, Rattus norvegicus
cccgcggagggatccctcgcaaatt

SEQ ID NO: 470371 - DNA, 25 bp, Rattus norvegicus
cgcaaattgccgctgcagcgacggg

SEQ ID NO: 470372 - DNA, 25 bp, Rattus norvegicus
acctttcgcggggaacagagacgca

SEQ ID NO: 470373 - DNA, 25 bp, Rattus norvegicus
gggaggtcacgaggcgcattcctca

SEQ ID NO: 470374 - DNA, 25 bp, Rattus norvegicus
cggcggcaagaagagaagggtgctc

SEQ ID NO: 470375 - DNA, 25 bp, Rattus norvegicus
ggaaattggctgattcgcccttccc

SEQ ID NO: 470376 - DNA, 25 bp, Rattus norvegicus
cgcggaaattggctgattcgccctt

SEQ ID NO: 470377 - DNA, 25 bp, Rattus norvegicus
atctcgcggaaattggctgattcgc

SEQ ID NO: 470378 - DNA, 25 bp, Rattus norvegicus
cagcaccaaaatctcgcggaaattg

SEQ ID NO: 470379 - DNA, 25 bp, Rattus norvegicus
aggaacagcaccaaaatctcgcgga

SEQ ID NO: 470380 - DNA, 25 bp, Rattus norvegicus
gcagaggaagaaggaacagcaccaa

SEQ ID NO: 470381 - DNA, 25 bp, Rattus norvegicus
ttaatcgtgttcctgcaggcagagg

SEQ ID NO: 470382 - DNA, 25 bp, Rattus norvegicus
gagattaatcgtgttcctgcaggca

SEQ ID NO: 470383 - DNA, 25 bp, Rattus norvegicus
atcgcgagattaatcgtgttcctgc

SEQ ID NO: 470384 - DNA, 25 bp, Rattus norvegicus
cccaaagatcgcgagattaatcgtg

SEQ ID NO: 470385 - DNA, 25 bp, Rattus norvegicus
acggaacttcccaaagatcgcgaga

SEQ ID NO: 470386 - DNA, 25 bp, Rattus norvegicus
ttcagtctgaagtccccggcggcaa

SEQ ID NO: 470387 - DNA, 25 bp, Rattus norvegicus
cttcccaaagatcgcgagattaatc

SEQ ID NO: 470388 - DNA, 25 bp, Rattus norvegicus
gtcatcgtgtagtctgggtctcaga

SEQ ID NO: 470389 - DNA, 25 bp, Rattus norvegicus
actggtttatgctctgccctctaag

SEQ ID NO: 470390 - DNA, 25 bp, Rattus norvegicus
tagtggatatttagacgcgatgggc

SEQ ID NO: 470391 - DNA, 25 bp, Rattus norvegicus
tgggtctcagagctcagccctcgtt

SEQ ID NO: 470392 - DNA, 25 bp, Rattus norvegicus
gtcaggaccgctgcactggtttatg

SEQ ID NO: 470393 - DNA, 25 bp, Rattus norvegicus
gagaaccaacctgcgctcagcgtca

SEQ ID NO: 470394 - DNA, 25 bp, Rattus norvegicus
cgcagcgccagtcatcgtgtagtct

SEQ ID NO: 470395 - DNA, 25 bp, Rattus norvegicus
ccagaagtcctgctgggagccgcgc

SEQ ID NO: 470396 - DNA, 25 bp, Rattus norvegicus
aaagtttgttgacatccgagcgccc

SEQ ID NO: 470397 - DNA, 25 bp, Rattus norvegicus
cagatatgggagacccggcgcaagc

SEQ ID NO: 470398 - DNA, 25 bp, Rattus norvegicus
ccaggttgcgctcgcgggcagatat

SEQ ID NO: 470399 - DNA, 25 bp, Rattus norvegicus
gactgtccgcacatccgcagggatg

SEQ ID NO: 470400 - DNA, 25 bp, Rattus norvegicus
ctcggcgctgtggactgagcttgac

SEQ ID NO: 470401 - DNA, 25 bp, Rattus norvegicus
agccctcgttcctcataaattatag

SEQ ID NO: 470402 - DNA, 25 bp, Rattus norvegicus
tgtgctttatttttccctgattgtg

SEQ ID NO: 470403 - DNA, 25 bp, Rattus norvegicus
ccctgattgtgttttctcccgcggc

SEQ ID NO: 470404 - DNA, 25 bp, Rattus norvegicus
attgtgttttctcccgcggccgcca

SEQ ID NO: 470405 - DNA, 25 bp, Rattus norvegicus
gccaccgggaagtgcctgccacagt

SEQ ID NO: 470406 - DNA, 25 bp, Rattus norvegicus
ggattccattttgtcgctgcctttc

SEQ ID NO: 470407 - DNA, 25 bp, Rattus norvegicus
ttctcacaccaggtgtctgggtggc

SEQ ID NO: 470408 - DNA, 25 bp, Rattus norvegicus
ctggcttggggagcgcgaacctcaa

SEQ ID NO: 470409 - DNA, 25 bp, Rattus norvegicus
tggggagcgcgaacctcaagtgacc

SEQ ID NO: 470410 - DNA, 25 bp, Rattus norvegicus
gcgtcaatcactcgcagcggcggct

SEQ ID NO: 470411 - DNA, 25 bp, Rattus norvegicus
cggacggattccttgtgctttattt

SEQ ID NO: 470412 - DNA, 25 bp, Rattus norvegicus
gctgtaaccctgtgcgtgccgcgcg

SEQ ID NO: 470413 - DNA, 25 bp, Rattus norvegicus
ctgccacagtgctgggattccattt

SEQ ID NO: 470414 - DNA, 25 bp, Rattus norvegicus
gctgggctgtaaccctgtgcgtgcc

SEQ ID NO: 470415 - DNA, 25 bp, Rattus norvegicus
gtcgctgcctttctcacaccaggtg

SEQ ID NO: 470416 - DNA, 25 bp, Rattus norvegicus
gctcgctgtggactactacctgctc

SEQ ID NO: 470417 - DNA, 25 bp, Rattus norvegicus
gcggtggcccaacacagagactcca

SEQ ID NO: 470418 - DNA, 25 bp, Rattus norvegicus
agcggaagcaacagcaacggggcca

SEQ ID NO: 470419 - DNA, 25 bp, Rattus norvegicus
tgaggtcatcctctccctcggagtc

SEQ ID NO: 470420 - DNA, 25 bp, Rattus norvegicus
gggccaccaggaccagcggcaaaca

SEQ ID NO: 470421 - DNA, 25 bp, Rattus norvegicus
tggtttgggctcaccctgttcttcg

SEQ ID NO: 470422 - DNA, 25 bp, Rattus norvegicus
ccctgttcttcgtggttctgggctc

SEQ ID NO: 470423 - DNA, 25 bp, Rattus norvegicus
ggctcgctctctgtgcaagtgttca

SEQ ID NO: 470424 - DNA, 25 bp, Rattus norvegicus
gcaagtgttcagcttccggtggttt

SEQ ID NO: 470425 - DNA, 25 bp, Rattus norvegicus
ccggtggtttgtgcacgatttcagc

SEQ ID NO: 470426 - DNA, 25 bp, Rattus norvegicus
agcggattgcaagaccgtggtcagc

SEQ ID NO: 470427 - DNA, 25 bp, Rattus norvegicus
gaaggcgaggctcgtccttccacgc

SEQ ID NO: 470428 - DNA, 25 bp, Rattus norvegicus
aggcaagcatccaacgccagcaaga

SEQ ID NO: 470429 - DNA, 25 bp, Rattus norvegicus
cagcgtcaaggaaatccacccaacg

SEQ ID NO: 470430 - DNA, 25 bp, Rattus norvegicus
ggtaagcaccaagcaccctgcagca

SEQ ID NO: 470431 - DNA, 25 bp, Rattus norvegicus
cggcggttccagctttcaggatcct

SEQ ID NO: 470432 - DNA, 25 bp, Rattus norvegicus
tccagctttcaggatccttgggtgc

SEQ ID NO: 470433 - DNA, 25 bp, Rattus norvegicus
ctttcaggatccttgggtgcgagcg

SEQ ID NO: 470434 - DNA, 25 bp, Rattus norvegicus
ggctctgcgccggtgcacgcgctct

SEQ ID NO: 470435 - DNA, 25 bp, Rattus norvegicus
tcgcgttttcccaacgctacttctg

SEQ ID NO: 470436 - DNA, 25 bp, Rattus norvegicus
tttcccaacgctacttctgtcatca

SEQ ID NO: 470437 - DNA, 25 bp, Rattus norvegicus
ccaacgctacttctgtcatcatctt

SEQ ID NO: 470438 - DNA, 25 bp, Rattus norvegicus
catcatcttagggtgacgagcgttc

SEQ ID NO: 470439 - DNA, 25 bp, Rattus norvegicus
atcttagggtgacgagcgttcccgc

SEQ ID NO: 470440 - DNA, 25 bp, Rattus norvegicus
accaagcaccctgcagcaacgaggc

SEQ ID NO: 470441 - DNA, 25 bp, Rattus norvegicus
actccagggtcctgtgcggatcctc

SEQ ID NO: 470442 - DNA, 25 bp, Rattus norvegicus
cccttgggtgcgcagactccagggt

SEQ ID NO: 470443 - DNA, 25 bp, Rattus norvegicus
ggtgacgagcgttcccgcgtccgct

SEQ ID NO: 470444 - DNA, 25 bp, Rattus norvegicus
agcagccaccgactggcaaagccaa

SEQ ID NO: 470445 - DNA, 25 bp, Rattus norvegicus
tgcgggaggcccttcttctcatgca

SEQ ID NO: 470446 - DNA, 25 bp, Rattus norvegicus
agactctgcgggaggcccttcttct

SEQ ID NO: 470447 - DNA, 25 bp, Rattus norvegicus
aaatgacagcgtgggccctgtggcc

SEQ ID NO: 470448 - DNA, 25 bp, Rattus norvegicus
acgcgcacatcggagggaaatgaca

SEQ ID NO: 470449 - DNA, 25 bp, Rattus norvegicus
agcacgaggtttcccaacgcgcaca

SEQ ID NO: 470450 - DNA, 25 bp, Rattus norvegicus
actggcaaagccaagctcgctggac

SEQ ID NO: 470451 - DNA, 25 bp, Rattus norvegicus
ccaaaattggtgacaaggcgagggc

SEQ ID NO: 470452 - DNA, 25 bp, Rattus norvegicus
ccgcgcggctttgcccaaaattggt

SEQ ID NO: 470453 - DNA, 25 bp, Rattus norvegicus
tgactcacggccgtcacgtagcgcg

SEQ ID NO: 470454 - DNA, 25 bp, Rattus norvegicus
tgggaacaaagcgtcctccgcattc

SEQ ID NO: 470455 - DNA, 25 bp, Rattus norvegicus
tcgaccgctggcaagctgggaacaa

SEQ ID NO: 470456 - DNA, 25 bp, Rattus norvegicus
cggcacgttcgaccgctggcaagct

SEQ ID NO: 470457 - DNA, 25 bp, Rattus norvegicus
aagccaagctcgctggaccgcttcg

SEQ ID NO: 470458 - DNA, 25 bp, Rattus norvegicus
tgtcgtccgggctccgctctggcag

SEQ ID NO: 470459 - DNA, 25 bp, Rattus norvegicus
ccatttcgtcgctgtccatgaagtc

SEQ ID NO: 470460 - DNA, 25 bp, Rattus norvegicus
tcgctgtccatgaagtcgttgagga

SEQ ID NO: 470461 - DNA, 25 bp, Rattus norvegicus
cgttgaggatgatggactcgacgtc

SEQ ID NO: 470462 - DNA, 25 bp, Rattus norvegicus
ggactcgacgtcacactctaggctc

SEQ ID NO: 470463 - DNA, 25 bp, Rattus norvegicus
tctaggctcccgctgaacatgtcga

SEQ ID NO: 470464 - DNA, 25 bp, Rattus norvegicus
gaacatgtcgaggtccaggtcggcc

SEQ ID NO: 470465 - DNA, 25 bp, Rattus norvegicus
aagcggtccggtcctgcacccagag

SEQ ID NO: 470466 - DNA, 25 bp, Rattus norvegicus
tagggcccaggcagcgcgtccagca

SEQ ID NO: 470467 - DNA, 25 bp, Rattus norvegicus
cgccgggcagcgtcataaggctgat

SEQ ID NO: 470468 - DNA, 25 bp, Rattus norvegicus
cggcgcgaagctggcctgcttgttc

SEQ ID NO: 470469 - DNA, 25 bp, Rattus norvegicus
cagctcggctagacgcggcagctcg

SEQ ID NO: 470470 - DNA, 25 bp, Rattus norvegicus
gaagtcagcccacgcctcgtagtcg

SEQ ID NO: 470471 - DNA, 25 bp, Rattus norvegicus
cctcgtagtcgtcgctggcatgcga

SEQ ID NO: 470472 - DNA, 25 bp, Rattus norvegicus
ctggcacggcgctgcccgccatcgt

SEQ ID NO: 470473 - DNA, 25 bp, Rattus norvegicus
tgccagcaactgtgccaggagcggc

SEQ ID NO: 470474 - DNA, 25 bp, Rattus norvegicus
agtctgccgggcgtgccagcaactg

SEQ ID NO: 470475 - DNA, 25 bp, Rattus norvegicus
ccggcctaggggagccgagaattgg

SEQ ID NO: 470476 - DNA, 25 bp, Rattus norvegicus
ccgcggcgcagcaacccagaggccc

SEQ ID NO: 470477 - DNA, 25 bp, Rattus norvegicus
caggcggggccctcaccctgtctgt

SEQ ID NO: 470478 - DNA, 25 bp, Rattus norvegicus
ccatcgtcccgctggagcggcgcca

SEQ ID NO: 470479 - DNA, 25 bp, Rattus norvegicus
tgtctgcaattaccgcctggcacgg

SEQ ID NO: 470480 - DNA, 25 bp, Rattus norvegicus
ttagtctgtctgcaattaccgcctg

SEQ ID NO: 470481 - DNA, 25 bp, Rattus norvegicus
gcgagttaaaaataaccgtctcatc

SEQ ID NO: 470482 - DNA, 25 bp, Rattus norvegicus
cgccgttcattaccttaacgcgagt

SEQ ID NO: 470483 - DNA, 25 bp, Rattus norvegicus
caactgtgccaggagcggctggcac

SEQ ID NO: 470484 - DNA, 25 bp, Rattus norvegicus
cgcgccgttcattaccttaacgcga

SEQ ID NO: 470485 - DNA, 25 bp, Rattus norvegicus
tcaagagctccccaacttgtgcagg

SEQ ID NO: 470486 - DNA, 25 bp, Rattus norvegicus
cttgaagtagggcacgtagcggacc

SEQ ID NO: 470487 - DNA, 25 bp, Rattus norvegicus
gcacgtagcggaccatccagtcgta

SEQ ID NO: 470488 - DNA, 25 bp, Rattus norvegicus
aagtccgggtccacgtccacctgat

SEQ ID NO: 470489 - DNA, 25 bp, Rattus norvegicus
atccagtcgtagatctgcgagagcg

SEQ ID NO: 470490 - DNA, 25 bp, Rattus norvegicus
tctgcgagagcgtgagtctcttgtc

SEQ ID NO: 470491 - DNA, 25 bp, Rattus norvegicus
tgagtctcttgtccggggcgctctc

SEQ ID NO: 470492 - DNA, 25 bp, Rattus norvegicus
cacgcgttccgtcgggagctcttcg

SEQ ID NO: 470493 - DNA, 25 bp, Rattus norvegicus
tagcggaccatccagtcgtagatct

SEQ ID NO: 470494 - DNA, 25 bp, Rattus norvegicus
tcgctttccgcaacggtccgacctc

SEQ ID NO: 470495 - DNA, 25 bp, Rattus norvegicus
atcgctggggccgtcgccctgcgtt

SEQ ID NO: 470496 - DNA, 25 bp, Rattus norvegicus
ctctgcggcgcgaagtccgggtcca

SEQ ID NO: 470497 - DNA, 25 bp, Rattus norvegicus
gcgctcgcagcttcgcagccatggt

SEQ ID NO: 470498 - DNA, 25 bp, Rattus norvegicus
acctgatgcgctcgcagcttcgcag

SEQ ID NO: 470499 - DNA, 25 bp, Rattus norvegicus
gttccgtcgggagctcttcgctttc

SEQ ID NO: 470500 - DNA, 25 bp, Rattus norvegicus
gatcccgagtgctcccattggtgca

SEQ ID NO: 470501 - DNA, 25 bp, Rattus norvegicus
ggacgaggctcgcttgcaccatgcc

SEQ ID NO: 470502 - DNA, 25 bp, Rattus norvegicus
cagtcttcaaaggattcctcccagg

SEQ ID NO: 470503 - DNA, 25 bp, Rattus norvegicus
gcccacagtcttcaaaggattcctc

SEQ ID NO: 470504 - DNA, 25 bp, Rattus norvegicus
tgtcccgcccacagtcttcaaagga

SEQ ID NO: 470505 - DNA, 25 bp, Rattus norvegicus
cattggtgcacagcggggctgtccc

SEQ ID NO: 470506 - DNA, 25 bp, Rattus norvegicus
gctcccattggtgcacagcggggct

SEQ ID NO: 470507 - DNA, 25 bp, Rattus norvegicus
ccgagtgctcccattggtgcacagc

SEQ ID NO: 470508 - DNA, 25 bp, Rattus norvegicus
gtggagctcccgctaagggcgaccc

SEQ ID NO: 470509 - DNA, 25 bp, Rattus norvegicus
caggcgagaaacgtctggcgcggcc

SEQ ID NO: 470510 - DNA, 25 bp, Rattus norvegicus
aatccttgcttactgggtgccccgc

SEQ ID NO: 470511 - DNA, 25 bp, Rattus norvegicus
cgccgcccggtgaatgccgccgccg

SEQ ID NO: 470512 - DNA, 25 bp, Rattus norvegicus
agcccaagcccgtgccagagcccgc

SEQ ID NO: 470513 - DNA, 25 bp, Rattus norvegicus
aggctcgcttgcaccatgccggagc

SEQ ID NO: 470514 - DNA, 25 bp, Rattus norvegicus
ccatccctccatcgtggaagacacc

SEQ ID NO: 470515 - DNA, 25 bp, Rattus norvegicus
ggacctcaaaggacgtcactcgctt

SEQ ID NO: 470516 - DNA, 25 bp, Rattus norvegicus
aaggacgtcactcgcttgtgtggga

SEQ ID NO: 470517 - DNA, 25 bp, Rattus norvegicus
tcactcgcttgtgtgggagacgcga

SEQ ID NO: 470518 - DNA, 25 bp, Rattus norvegicus
ttgtgtgggagacgcgagcaatact

SEQ ID NO: 470519 - DNA, 25 bp, Rattus norvegicus
agacgcgagcaatactgtgggtccg

SEQ ID NO: 470520 - DNA, 25 bp, Rattus norvegicus
cgagcaatactgtgggtccggcgct

SEQ ID NO: 470521 - DNA, 25 bp, Rattus norvegicus
gacgggattcgaacttgggacctca

SEQ ID NO: 470522 - DNA, 25 bp, Rattus norvegicus
tcgcgaggcggctggaacatccccg

SEQ ID NO: 470523 - DNA, 25 bp, Rattus norvegicus
cttgggacctcaaaggacgtcactc

SEQ ID NO: 470524 - DNA, 25 bp, Rattus norvegicus
cctcaacctcttcgactttaatttg

SEQ ID NO: 470525 - DNA, 25 bp, Rattus norvegicus
tcaacctcttcgactttaatttggc

SEQ ID NO: 470526 - DNA, 25 bp, Rattus norvegicus
gcaatactgtgggtccggcgcttag

SEQ ID NO: 470527 - DNA, 25 bp, Rattus norvegicus
cctcaaaggacgtcactcgcttgtg

SEQ ID NO: 470528 - DNA, 25 bp, Rattus norvegicus
ctagtgtgtgactgagtctgtgtga

SEQ ID NO: 470529 - DNA, 25 bp, Rattus norvegicus
gcggtcggcttcctacttccttgac

SEQ ID NO: 470530 - DNA, 25 bp, Rattus norvegicus
ttccctcaggcacgagggacaaagg

SEQ ID NO: 470531 - DNA, 25 bp, Rattus norvegicus
gagcgaaatgtgtatgtgaggtatt

SEQ ID NO: 470532 - DNA, 25 bp, Rattus norvegicus
cgtttgcggcttgggtgccgttctc

SEQ ID NO: 470533 - DNA, 25 bp, Rattus norvegicus
tgccgtttcggtttaatctagtgtg

SEQ ID NO: 470534 - DNA, 25 bp, Rattus norvegicus
ctcgcgatacttttggaagctcgcc

SEQ ID NO: 470535 - DNA, 25 bp, Rattus norvegicus
tctggtggagtctcgcgatactttt

SEQ ID NO: 470536 - DNA, 25 bp, Rattus norvegicus
aggtgaaaaggaagcgcgaagtatc

SEQ ID NO: 470537 - DNA, 25 bp, Rattus norvegicus
gtctaacgggatgcgtttgcggctt

SEQ ID NO: 470538 - DNA, 25 bp, Rattus norvegicus
agactcgagcagctcccggtgtttc

SEQ ID NO: 470539 - DNA, 25 bp, Rattus norvegicus
tgccgttctcgcgttttctggtgaa

SEQ ID NO: 470540 - DNA, 25 bp, Rattus norvegicus
gtatcgcgagagtctaacgggatgc

SEQ ID NO: 470541 - DNA, 25 bp, Rattus norvegicus
gctagaaaaggggttccctcaggca

SEQ ID NO: 470542 - DNA, 25 bp, Rattus norvegicus
cgtcgcatccactcgggcccagtgt

SEQ ID NO: 470543 - DNA, 25 bp, Rattus norvegicus
cagcaggtttcgaacctcagtgggg

SEQ ID NO: 470544 - DNA, 25 bp, Rattus norvegicus
gccgctacagcaggtttcgaacctc

SEQ ID NO: 470545 - DNA, 25 bp, Rattus norvegicus
agcacccggccgctacagcaggttt

SEQ ID NO: 470546 - DNA, 25 bp, Rattus norvegicus
acctgcctggaacccggccagcacc

SEQ ID NO: 470547 - DNA, 25 bp, Rattus norvegicus
ttcacgtgtgccacctgcctggaac

SEQ ID NO: 470548 - DNA, 25 bp, Rattus norvegicus
ggggaattcacgtgtgccacctgcc

SEQ ID NO: 470549 - DNA, 25 bp, Rattus norvegicus
ccagcgagattctcctgggtcccag

SEQ ID NO: 470550 - DNA, 25 bp, Rattus norvegicus
gacgcgtcgccagcgagattctcct

SEQ ID NO: 470551 - DNA, 25 bp, Rattus norvegicus
aaccgcgaagcctggctcgggccca

SEQ ID NO: 470552 - DNA, 25 bp, Rattus norvegicus
tcgccctcaggtaagcgcctcgctg

SEQ ID NO: 470553 - DNA, 25 bp, Rattus norvegicus
gctccctgcgcagcggaaacatggc

SEQ ID NO: 470554 - DNA, 25 bp, Rattus norvegicus
ctcgggcccagtgcggaggctcttt

SEQ ID NO: 470555 - DNA, 25 bp, Rattus norvegicus
cgcagcggaaacatggcggctagaa

SEQ ID NO: 470556 - DNA, 25 bp, Rattus norvegicus
tcccaaagcgcctgatgcacgggtt

SEQ ID NO: 470557 - DNA, 25 bp, Rattus norvegicus
tcaaaccgaaacactgagggccttc

SEQ ID NO: 470558 - DNA, 25 bp, Rattus norvegicus
atagaggctgctggtgactcacatc

SEQ ID NO: 470559 - DNA, 25 bp, Rattus norvegicus
atgcgccagccgtctttctgagagg

SEQ ID NO: 470560 - DNA, 25 bp, Rattus norvegicus
ttcagagtctcgtgtcagccacagc

SEQ ID NO: 470561 - DNA, 25 bp, Rattus norvegicus
ctccgggatccctgaaatcagccta

SEQ ID NO: 470562 - DNA, 25 bp, Rattus norvegicus
ctcccgttagagatgcagcccattg

SEQ ID NO: 470563 - DNA, 25 bp, Rattus norvegicus
cgagaggatcactaagccgtcagtc

SEQ ID NO: 470564 - DNA, 25 bp, Rattus norvegicus
gccgtgaggcccagcaaacctacaa

SEQ ID NO: 470565 - DNA, 25 bp, Rattus norvegicus
ccacgctgacgtagtgagctcaaga

SEQ ID NO: 470566 - DNA, 25 bp, Rattus norvegicus
acccggctgctgaggatttaaagtc

SEQ ID NO: 470567 - DNA, 25 bp, Rattus norvegicus
gggacgaaaacctcagcagcacctc

SEQ ID NO: 470568 - DNA, 25 bp, Rattus norvegicus
tcctcgtcccgcaatagccgataga

SEQ ID NO: 470569 - DNA, 25 bp, Rattus norvegicus
tgcacgggttcgcaccgccgtaaaa

SEQ ID NO: 470570 - DNA, 25 bp, Rattus norvegicus
gcgcaattaccctaattacagcctg

SEQ ID NO: 470571 - DNA, 25 bp, Rattus norvegicus
ctcaggagaaatgcggcgcctttcc

SEQ ID NO: 470572 - DNA, 25 bp, Rattus norvegicus
ttctcaggagaaatgcggcgccttt

SEQ ID NO: 470573 - DNA, 25 bp, Rattus norvegicus
caggccaggaggttctcaggagaaa

SEQ ID NO: 470574 - DNA, 25 bp, Rattus norvegicus
ggctacgcaggccaggaggttctca

SEQ ID NO: 470575 - DNA, 25 bp, Rattus norvegicus
tcaggcgaagccgagtggctacgca

SEQ ID NO: 470576 - DNA, 25 bp, Rattus norvegicus
caattgtcaggcgaagccgagtggc

SEQ ID NO: 470577 - DNA, 25 bp, Rattus norvegicus
ccacacctgggtgggaagcagcagc

SEQ ID NO: 470578 - DNA, 25 bp, Rattus norvegicus
atgactgggccgctctgagcacgcg

SEQ ID NO: 470579 - DNA, 25 bp, Rattus norvegicus
ccggctaatgactgggccgctctga

SEQ ID NO: 470580 - DNA, 25 bp, Rattus norvegicus
gcccggctaatgactgggccgctct

SEQ ID NO: 470581 - DNA, 25 bp, Rattus norvegicus
ggaggccccgatgcgcgataagccc

SEQ ID NO: 470582 - DNA, 25 bp, Rattus norvegicus
taattacagcctggcctccgcggcg

SEQ ID NO: 470583 - DNA, 25 bp, Rattus norvegicus
attaccctaattacagcctggcctc

SEQ ID NO: 470584 - DNA, 25 bp, Rattus norvegicus
cccgcgacctggacattatgcttgc

SEQ ID NO: 470585 - DNA, 25 bp, Rattus norvegicus
tgagacaagagatacgcctagcctc

SEQ ID NO: 470586 - DNA, 25 bp, Rattus norvegicus
gcgagcccggataacaaaatgtgtt

SEQ ID NO: 470587 - DNA, 25 bp, Rattus norvegicus
cgcaggcgcaaagatccgggaacca

SEQ ID NO: 470588 - DNA, 25 bp, Rattus norvegicus
cacgtggccgaaatgctgctcttca

SEQ ID NO: 470589 - DNA, 25 bp, Rattus norvegicus
tgccaccggctggacatcatggaga

SEQ ID NO: 470590 - DNA, 25 bp, Rattus norvegicus
gcccgacgcacctgacaaggaagtc

SEQ ID NO: 470591 - DNA, 25 bp, Rattus norvegicus
atcaggttatcctcggcgacgtcgg

SEQ ID NO: 470592 - DNA, 25 bp, Rattus norvegicus
ggactctcagatagcgccggctttc

SEQ ID NO: 470593 - DNA, 25 bp, Rattus norvegicus
gcgccggctttctttaaacacctga

SEQ ID NO: 470594 - DNA, 25 bp, Rattus norvegicus
cacctgagaggaagaagcccgagcc

SEQ ID NO: 470595 - DNA, 25 bp, Rattus norvegicus
cccgagccacattgggtgtagaacc

SEQ ID NO: 470596 - DNA, 25 bp, Rattus norvegicus
ggttacgcctctctgtgtccagcaa

SEQ ID NO: 470597 - DNA, 25 bp, Rattus norvegicus
cctcagacaaaaagctgcggcggtc

SEQ ID NO: 470598 - DNA, 25 bp, Rattus norvegicus
ttgcaggaacctcactgtgcccggg

SEQ ID NO: 470599 - DNA, 25 bp, Rattus norvegicus
tgttgaacgccaccaccgagagacg

SEQ ID NO: 470600 - DNA, 25 bp, Rattus norvegicus
ttcgattgcttctcggacctggggt

SEQ ID NO: 470601 - DNA, 25 bp, Rattus norvegicus
tccttggccaaagcgagttcgattg

SEQ ID NO: 470602 - DNA, 25 bp, Rattus norvegicus
gccggtaacgcgcaccttcagtctg

SEQ ID NO: 470603 - DNA, 25 bp, Rattus norvegicus
gaccttggcatacggctctttcgga

SEQ ID NO: 470604 - DNA, 25 bp, Rattus norvegicus
agctgccatggctgaccacctgatg

SEQ ID NO: 470605 - DNA, 25 bp, Rattus norvegicus
acccgcgtgagacagtgaacaaatc

SEQ ID NO: 470606 - DNA, 25 bp, Rattus norvegicus
agcctgcgaacccttgtactgtctg

SEQ ID NO: 470607 - DNA, 25 bp, Rattus norvegicus
ctccgaagctctgtgcgaaagcctg

SEQ ID NO: 470608 - DNA, 25 bp, Rattus norvegicus
tcccgcctcttggtataagaaatcg

SEQ ID NO: 470609 - DNA, 25 bp, Rattus norvegicus
taaacttcttagaccggcgcccagc

SEQ ID NO: 470610 - DNA, 25 bp, Rattus norvegicus
gtctcccgcccaagaggagccgttg

SEQ ID NO: 470611 - DNA, 25 bp, Rattus norvegicus
cgtgtactgactgaccgccagctgc

SEQ ID NO: 470612 - DNA, 25 bp, Rattus norvegicus
ggtctacagggctgtggtagtccga

SEQ ID NO: 470613 - DNA, 25 bp, Rattus norvegicus
gacgttgaacccaggagccggtagc

SEQ ID NO: 470614 - DNA, 25 bp, Rattus norvegicus
tcaagcttgtgctcgatggactgca

SEQ ID NO: 470615 - DNA, 25 bp, Rattus norvegicus
gcccagcagcagatcaagcttgtgc

SEQ ID NO: 470616 - DNA, 25 bp, Rattus norvegicus
cgtaggcagcgcgagtagaagccca

SEQ ID NO: 470617 - DNA, 25 bp, Rattus norvegicus
agcggcacttgcacggtgcccaggc

SEQ ID NO: 470618 - DNA, 25 bp, Rattus norvegicus
ctaaggaaggaagttggcctagacg

SEQ ID NO: 470619 - DNA, 25 bp, Rattus norvegicus
agtccgaggtgatgtcggggtcgaa

SEQ ID NO: 470620 - DNA, 25 bp, Rattus norvegicus
tgtgctcgatggactgcacctggtg

SEQ ID NO: 470621 - DNA, 25 bp, Rattus norvegicus
gacagagatgtcctcgtggtctaca

SEQ ID NO: 470622 - DNA, 25 bp, Rattus norvegicus
tctgtgccgagacagagatgtcctc

SEQ ID NO: 470623 - DNA, 25 bp, Rattus norvegicus
agatgctgagcgtctgtgccgagac

SEQ ID NO: 470624 - DNA, 25 bp, Rattus norvegicus
tcgaagagcggcacttgcacggtgc

SEQ ID NO: 470625 - DNA, 25 bp, Rattus norvegicus
gcagatcaagcttgtgctcgatgga

SEQ ID NO: 470626 - DNA, 25 bp, Rattus norvegicus
agaggaacgacggaatcttggcctg

SEQ ID NO: 470627 - DNA, 25 bp, Rattus norvegicus
ttggcctgatgtagccttccctgtg

SEQ ID NO: 470628 - DNA, 25 bp, Rattus norvegicus
tcgggatgatgccagcctctgcgag

SEQ ID NO: 470629 - DNA, 25 bp, Rattus norvegicus
acccagtgctcaggctcgggatgat

SEQ ID NO: 470630 - DNA, 25 bp, Rattus norvegicus
ctagggtcgccggacccagtgctca

SEQ ID NO: 470631 - DNA, 25 bp, Rattus norvegicus
atgtagccttccctgtgctgctctg

SEQ ID NO: 470632 - DNA, 25 bp, Rattus norvegicus
cgacggaatcttggcctgatgtagc

SEQ ID NO: 470633 - DNA, 25 bp, Rattus norvegicus
ggtggagagagtgcattcgacaccc

SEQ ID NO: 470634 - DNA, 25 bp, Rattus norvegicus
ttccctgtgctgctctggctagggt

SEQ ID NO: 470635 - DNA, 25 bp, Rattus norvegicus
tgtgaaggtgctgcggcgtcaccaa

SEQ ID NO: 470636 - DNA, 25 bp, Rattus norvegicus
aacgctgcggcctgaaaggcgagca

SEQ ID NO: 470637 - DNA, 25 bp, Rattus norvegicus
taacaattgaaaacgctgcggcctg

SEQ ID NO: 470638 - DNA, 25 bp, Rattus norvegicus
agagcggcggctccggttacctctc

SEQ ID NO: 470639 - DNA, 25 bp, Rattus norvegicus
attgcccacccacgaaggccgacgg

SEQ ID NO: 470640 - DNA, 25 bp, Rattus norvegicus
ttccgactccaactctcttattacg

SEQ ID NO: 470641 - DNA, 25 bp, Rattus norvegicus
gacgtggtagacgaaggcccaccca

SEQ ID NO: 470642 - DNA, 25 bp, Rattus norvegicus
tccagcacgttgtagacccagttct

SEQ ID NO: 470643 - DNA, 25 bp, Rattus norvegicus
acgttgtagacccagttctgcaggc

SEQ ID NO: 470644 - DNA, 25 bp, Rattus norvegicus
ctgttcactctgcacggccgtgagc

SEQ ID NO: 470645 - DNA, 25 bp, Rattus norvegicus
ggctcagagtcgcatggctggaacc

SEQ ID NO: 470646 - DNA, 25 bp, Rattus norvegicus
tcgcatggctggaaccctggcgccg

SEQ ID NO: 470647 - DNA, 25 bp, Rattus norvegicus
ccaactcacatgaagacgtggtaga

SEQ ID NO: 470648 - DNA, 25 bp, Rattus norvegicus
tggggcggctctttccgactccaac

SEQ ID NO: 470649 - DNA, 25 bp, Rattus norvegicus
aactctcttattacgcgctccatgc

SEQ ID NO: 470650 - DNA, 25 bp, Rattus norvegicus
atgccgctcgcctttccacctgccg

SEQ ID NO: 470651 - DNA, 25 bp, Rattus norvegicus
gcgcgctgctcacatgtcaccctcc

SEQ ID NO: 470652 - DNA, 25 bp, Rattus norvegicus
gccttcccaaatcgggagggagcga

SEQ ID NO: 470653 - DNA, 25 bp, Rattus norvegicus
gagagcgaccctgggcgctcacgca

SEQ ID NO: 470654 - DNA, 25 bp, Rattus norvegicus
agcagctgaggcgactgaagtctcg

SEQ ID NO: 470655 - DNA, 25 bp, Rattus norvegicus
gcgtctcttggtgacctccgaggac

SEQ ID NO: 470656 - DNA, 25 bp, Rattus norvegicus
gtgagatctgagacttttatggccc

SEQ ID NO: 470657 - DNA, 25 bp, Rattus norvegicus
tcgcgagaattgagtagggcagcct

SEQ ID NO: 470658 - DNA, 25 bp, Rattus norvegicus
aagcgtgcgtcacggaaaacggagc

SEQ ID NO: 470659 - DNA, 25 bp, Rattus norvegicus
tactccgacgtccagcgaagaaagc

SEQ ID NO: 470660 - DNA, 25 bp, Rattus norvegicus
atctccgccagaggcgggaagcacc

SEQ ID NO: 470661 - DNA, 25 bp, Rattus norvegicus
agagggaagtgagatctccgccaga

SEQ ID NO: 470662 - DNA, 25 bp, Rattus norvegicus
cccggcgaagacacaacatggcggc

SEQ ID NO: 470663 - DNA, 25 bp, Rattus norvegicus
caatgggagaaagcccgcgggccca

SEQ ID NO: 470664 - DNA, 25 bp, Rattus norvegicus
gtcgccttccgccaatgggagaaag

SEQ ID NO: 470665 - DNA, 25 bp, Rattus norvegicus
caataaggtgccaggtccgcggcct

SEQ ID NO: 470666 - DNA, 25 bp, Rattus norvegicus
agccggcgtgaccaataaggtgcca

SEQ ID NO: 470667 - DNA, 25 bp, Rattus norvegicus
cctgcggggcaaaacggaatagtga

SEQ ID NO: 470668 - DNA, 25 bp, Rattus norvegicus
atgcccccgtgagtctctgtcgctg

SEQ ID NO: 470669 - DNA, 25 bp, Rattus norvegicus
gcttcctcccgccagtcgtggctcc

SEQ ID NO: 470670 - DNA, 25 bp, Rattus norvegicus
tcgtggctccggctttgcacccggc

SEQ ID NO: 470671 - DNA, 25 bp, Rattus norvegicus
gcacccggcggcgactgagaactgt

SEQ ID NO: 470672 - DNA, 25 bp, Rattus norvegicus
cgtagggatgtatgccatatttggg

SEQ ID NO: 470673 - DNA, 25 bp, Rattus norvegicus
gagctacgtagggatgtatgccata

SEQ ID NO: 470674 - DNA, 25 bp, Rattus norvegicus
cgccgagagctacgtagggatgtat

SEQ ID NO: 470675 - DNA, 25 bp, Rattus norvegicus
cagcaggccttgtgcgcctgcgagt

SEQ ID NO: 470676 - DNA, 25 bp, Rattus norvegicus
ggtaagtcagcaggccttgtgcgcc

SEQ ID NO: 470677 - DNA, 25 bp, Rattus norvegicus
cccacctcggggtaagtcagcaggc

SEQ ID NO: 470678 - DNA, 25 bp, Rattus norvegicus
agcggaaccccgctccaggcgtgga

SEQ ID NO: 470679 - DNA, 25 bp, Rattus norvegicus
ttgcggcgccactctgccagcggaa

SEQ ID NO: 470680 - DNA, 25 bp, Rattus norvegicus
gaactgtgtggcgactgcggagcca

SEQ ID NO: 470681 - DNA, 25 bp, Rattus norvegicus
ggggcagcacctgccttgccttgcg

SEQ ID NO: 470682 - DNA, 25 bp, Rattus norvegicus
ctcccgggcgtcctgggttgccaag

SEQ ID NO: 470683 - DNA, 25 bp, Rattus norvegicus
atgccgcccggctaccggccctcag

SEQ ID NO: 470684 - DNA, 25 bp, Rattus norvegicus
cgtccctccctcgacccagccgctc

SEQ ID NO: 470685 - DNA, 25 bp, Rattus norvegicus
atctgcggggcccattcccgtccct

SEQ ID NO: 470686 - DNA, 25 bp, Rattus norvegicus
tatcctgattgattcctcctgctcc

SEQ ID NO: 470687 - DNA, 25 bp, Rattus norvegicus
gtggcttcattatcctgattgattc

SEQ ID NO: 470688 - DNA, 25 bp, Rattus norvegicus
ggctgtggcttcattatcctgattg

SEQ ID NO: 470689 - DNA, 25 bp, Rattus norvegicus
tcctccgaaccgtctggcggacttg

SEQ ID NO: 470690 - DNA, 25 bp, Rattus norvegicus
tgctgccgctttaagattctcccgg

SEQ ID NO: 470691 - DNA, 25 bp, Rattus norvegicus
ggaaagtggtgctgccgctttaaga

SEQ ID NO: 470692 - DNA, 25 bp, Rattus norvegicus
agagtccaggctcccaccgttgcgg

SEQ ID NO: 470693 - DNA, 25 bp, Rattus norvegicus
gaccctttcggcagagtccaggctc

SEQ ID NO: 470694 - DNA, 25 bp, Rattus norvegicus
ggtaggaccctttcggcagagtcca

SEQ ID NO: 470695 - DNA, 25 bp, Rattus norvegicus
cgtctggcggacttggcactggccc

SEQ ID NO: 470696 - DNA, 25 bp, Rattus norvegicus
agcgcatgggagtcctacccggcct

SEQ ID NO: 470697 - DNA, 25 bp, Rattus norvegicus
gcctactcaccggaggatctccgga

SEQ ID NO: 470698 - DNA, 25 bp, Rattus norvegicus
tcaccggaggatctccggagcagcc

SEQ ID NO: 470699 - DNA, 25 bp, Rattus norvegicus
cgcccagtgtgcaccgaggtggcct

SEQ ID NO: 470700 - DNA, 25 bp, Rattus norvegicus
ggacaccggcctctcccgcttctca

SEQ ID NO: 470701 - DNA, 25 bp, Rattus norvegicus
cgctccgagcgcatgggagtcctac

SEQ ID NO: 470702 - DNA, 25 bp, Rattus norvegicus
cctgcaccagccgtggacgtgcggt

SEQ ID NO: 470703 - DNA, 25 bp, Rattus norvegicus
ccagacagagttcggctgtacccac

SEQ ID NO: 470704 - DNA, 25 bp, Rattus norvegicus
ttagctctgtcccagtcccagcgcc

SEQ ID NO: 470705 - DNA, 25 bp, Rattus norvegicus
tgccgagcgacccagatcccggaag

SEQ ID NO: 470706 - DNA, 25 bp, Rattus norvegicus
agcgacccagatcccggaagccgga

SEQ ID NO: 470707 - DNA, 25 bp, Rattus norvegicus
aggcggcgccttctgagggtctcca

SEQ ID NO: 470708 - DNA, 25 bp, Rattus norvegicus
gcagccacccggaccagcccgcaga

SEQ ID NO: 470709 - DNA, 25 bp, Rattus norvegicus
tgctcggatgccagacagagttcgg

SEQ ID NO: 470710 - DNA, 25 bp, Rattus norvegicus
ctgcgggaccccagaagcggcttag

SEQ ID NO: 470711 - DNA, 25 bp, Rattus norvegicus
ccaaggagccaatccgggaagagcc

SEQ ID NO: 470712 - DNA, 25 bp, Rattus norvegicus
gcctggtaccgatccacgtccttca

SEQ ID NO: 470713 - DNA, 25 bp, Rattus norvegicus
gtccttcaccgacttgcctgtcatg

SEQ ID NO: 470714 - DNA, 25 bp, Rattus norvegicus
tcaccgacttgcctgtcatggccag

SEQ ID NO: 470715 - DNA, 25 bp, Rattus norvegicus
cctgcccaggcggtcctcccgcctg

SEQ ID NO: 470716 - DNA, 25 bp, Rattus norvegicus
cttaggcggagcgagttctcggcct

SEQ ID NO: 470717 - DNA, 25 bp, Rattus norvegicus
ctcagcgtgcgggacgcacacttga

SEQ ID NO: 470718 - DNA, 25 bp, Rattus norvegicus
cagcgtgcgggacgcacacttgacc

SEQ ID NO: 470719 - DNA, 25 bp, Rattus norvegicus
gcctacttccggcagctcttcctct

SEQ ID NO: 470720 - DNA, 25 bp, Rattus norvegicus
cgagccgcaatgggctcttcccttg

SEQ ID NO: 470721 - DNA, 25 bp, Rattus norvegicus
ttggctccgcctccaaggagccaat

SEQ ID NO: 470722 - DNA, 25 bp, Rattus norvegicus
cgcctccaaggagccaatccgggaa

SEQ ID NO: 470723 - DNA, 25 bp, Rattus norvegicus
acttgcctgtcatggccagggtgcc

SEQ ID NO: 470724 - DNA, 25 bp, Rattus norvegicus
gttccacctgactcctcttgcatga

SEQ ID NO: 470725 - DNA, 25 bp, Rattus norvegicus
cagagaggacatccagttttctgga

SEQ ID NO: 470726 - DNA, 25 bp, Rattus norvegicus
tgtgtctatgtgtgggtctgtattc

SEQ ID NO: 470727 - DNA, 25 bp, Rattus norvegicus
atgtgtgggtctgtattcaggtgcc

SEQ ID NO: 470728 - DNA, 25 bp, Rattus norvegicus
tctgtattcaggtgcccttggagtc

SEQ ID NO: 470729 - DNA, 25 bp, Rattus norvegicus
ttcaggtgcccttggagtccagaga

SEQ ID NO: 470730 - DNA, 25 bp, Rattus norvegicus
agtccagagaggacatccagttttc

SEQ ID NO: 470731 - DNA, 25 bp, Rattus norvegicus
taatttttaagtatgtgtatgtgtg

SEQ ID NO: 470732 - DNA, 25 bp, Rattus norvegicus
actggagtcacaggtggctttgttc

SEQ ID NO: 470733 - DNA, 25 bp, Rattus norvegicus
gctttgttccacctgactcctcttg

SEQ ID NO: 470734 - DNA, 25 bp, Rattus norvegicus
cctgactcctcttgcatgacgattt

SEQ ID NO: 470735 - DNA, 25 bp, Rattus norvegicus
tcctcttgcatgacgatttcactga

SEQ ID NO: 470736 - DNA, 25 bp, Rattus norvegicus
aggacatccagttttctggaactgg

SEQ ID NO: 470737 - DNA, 25 bp, Rattus norvegicus
ggagtcacaggtggctttgttccac

SEQ ID NO: 470738 - DNA, 25 bp, Rattus norvegicus
gtcctgtcatctctctggcactgca

SEQ ID NO: 470739 - DNA, 25 bp, Rattus norvegicus
gccctggctcagatcgtaagtcctg

SEQ ID NO: 470740 - DNA, 25 bp, Rattus norvegicus
ccaggagtctttaggacctgttcta

SEQ ID NO: 470741 - DNA, 25 bp, Rattus norvegicus
cgaccctagcccgaggggcacttga

SEQ ID NO: 470742 - DNA, 25 bp, Rattus norvegicus
agcgcgcagtgaaggcagattgatt

SEQ ID NO: 470743 - DNA, 25 bp, Rattus norvegicus
accttgcctcgggatgcttggcctt

SEQ ID NO: 470744 - DNA, 25 bp, Rattus norvegicus
gtggcagaaacaatggtggctattc

SEQ ID NO: 470745 - DNA, 25 bp, Rattus norvegicus
ctattcagtcgacagcggagcctcc

SEQ ID NO: 470746 - DNA, 25 bp, Rattus norvegicus
ggcccgagctccagtcagacttttc

SEQ ID NO: 470747 - DNA, 25 bp, Rattus norvegicus
gtctcctctgaccatgggcttctgc

SEQ ID NO: 470748 - DNA, 25 bp, Rattus norvegicus
gggcttctgcttcacttcgcaggga

SEQ ID NO: 470749 - DNA, 25 bp, Rattus norvegicus
cggtccgcgtgctaaacagtgctag

SEQ ID NO: 470750 - DNA, 25 bp, Rattus norvegicus
cttttcctccaggtgctgtggctcg

SEQ ID NO: 470751 - DNA, 25 bp, Rattus norvegicus
ggacctgttctagtccgaccctagc

SEQ ID NO: 470752 - DNA, 25 bp, Rattus norvegicus
tcccggccaacgttctgcagctggt

SEQ ID NO: 470753 - DNA, 25 bp, Rattus norvegicus
ggtgatagcatccagactcctttag

SEQ ID NO: 470754 - DNA, 25 bp, Rattus norvegicus
ccgaggtctcgcactgtttcttggt

SEQ ID NO: 470755 - DNA, 25 bp, Rattus norvegicus
gacccagggtttcggtgcagccaca

SEQ ID NO: 470756 - DNA, 25 bp, Rattus norvegicus
ggtcgctttcttggctcgggaccca

SEQ ID NO: 470757 - DNA, 25 bp, Rattus norvegicus
agagaccggagtacaggtcgctttc

SEQ ID NO: 470758 - DNA, 25 bp, Rattus norvegicus
cgagtgagtcaagggcttgagcata

SEQ ID NO: 470759 - DNA, 25 bp, Rattus norvegicus
ccgaaacttccaccgcgagcgagtg

SEQ ID NO: 470760 - DNA, 25 bp, Rattus norvegicus
gaagtcaccgtggagttccgccgcc

SEQ ID NO: 470761 - DNA, 25 bp, Rattus norvegicus
tagctttgaaccgaagtcaccgtgg

SEQ ID NO: 470762 - DNA, 25 bp, Rattus norvegicus
atcccgtcgcgtgcgtagctttgaa

SEQ ID NO: 470763 - DNA, 25 bp, Rattus norvegicus
tgcccttaagtactggctaagcgtc

SEQ ID NO: 470764 - DNA, 25 bp, Rattus norvegicus
ctcctttagcctggggagactgtga

SEQ ID NO: 470765 - DNA, 25 bp, Rattus norvegicus
cccgagcagtgtgcccttaagtact

SEQ ID NO: 470766 - DNA, 25 bp, Rattus norvegicus
atttccggcccgaagactgagcggc

SEQ ID NO: 470767 - DNA, 25 bp, Rattus norvegicus
gtgtcaccacgatacgggtcctttc

SEQ ID NO: 470768 - DNA, 25 bp, Rattus norvegicus
ctcagaaagtgccagtggtgtcacc

SEQ ID NO: 470769 - DNA, 25 bp, Rattus norvegicus
aagtcccacatagcgtccaccgatg

SEQ ID NO: 470770 - DNA, 25 bp, Rattus norvegicus
cttctccgcagggaagtcccacata

SEQ ID NO: 470771 - DNA, 25 bp, Rattus norvegicus
tctcccttgctttggcgggttccca

SEQ ID NO: 470772 - DNA, 25 bp, Rattus norvegicus
cgcgcgggactcaaactcaaaggtt

SEQ ID NO: 470773 - DNA, 25 bp, Rattus norvegicus
ggtcctttccgaaggcttcttcaga

SEQ ID NO: 470774 - DNA, 25 bp, Rattus norvegicus
cggcggtgcacctgaaacatcactc

SEQ ID NO: 470775 - DNA, 25 bp, Rattus norvegicus
tattctgctagaataagacttgccc

SEQ ID NO: 470776 - DNA, 25 bp, Rattus norvegicus
ctccggcttctcaaggacctatata

SEQ ID NO: 470777 - DNA, 25 bp, Rattus norvegicus
ccgaagattcgcttctccgcaggga

SEQ ID NO: 470778 - DNA, 25 bp, Rattus norvegicus
agctttgccagcagtgtcacaaaga

SEQ ID NO: 470779 - DNA, 25 bp, Rattus norvegicus
aacatcactccggattctgcgcgcg

SEQ ID NO: 470780 - DNA, 25 bp, Rattus norvegicus
gttagtgacgcactccctggcgaca

SEQ ID NO: 470781 - DNA, 25 bp, Rattus norvegicus
caacagcttagcaacggcgagattc

SEQ ID NO: 470782 - DNA, 25 bp, Rattus norvegicus
tcacctggcagaagctccggcagta

SEQ ID NO: 470783 - DNA, 25 bp, Rattus norvegicus
ccgaatgttggtcctctcagaagtc

SEQ ID NO: 470784 - DNA, 25 bp, Rattus norvegicus
tacgtcactaggacgccgaatgttg

SEQ ID NO: 470785 - DNA, 25 bp, Rattus norvegicus
gcgccaattttattacgtcactagg

SEQ ID NO: 470786 - DNA, 25 bp, Rattus norvegicus
cctggcgacactggcgccaatttta

SEQ ID NO: 470787 - DNA, 25 bp, Rattus norvegicus
cccaatcgcccgtgttagtgacgca

SEQ ID NO: 470788 - DNA, 25 bp, Rattus norvegicus
accaaaccacgtgattccgcatggc

SEQ ID NO: 470789 - DNA, 25 bp, Rattus norvegicus
cagcagcgcgtaggcaaccaaacca

SEQ ID NO: 470790 - DNA, 25 bp, Rattus norvegicus
atggactcagtctcggttccggctc

SEQ ID NO: 470791 - DNA, 25 bp, Rattus norvegicus
tccagctgccagagacacggtcgta

SEQ ID NO: 470792 - DNA, 25 bp, Rattus norvegicus
tcaaagatgagacctcggacacctc

SEQ ID NO: 470793 - DNA, 25 bp, Rattus norvegicus
gcggatcctgggtctctcctccagg

SEQ ID NO: 470794 - DNA, 25 bp, Rattus norvegicus
aaagggcgtgtccacagttgggcac

SEQ ID NO: 470795 - DNA, 25 bp, Rattus norvegicus
ggcgtgtccacagttgggcacgccc

SEQ ID NO: 470796 - DNA, 25 bp, Rattus norvegicus
tctggcctaggagcgcttgaaaaag

SEQ ID NO: 470797 - DNA, 25 bp, Rattus norvegicus
gtcttagcgcgacccacttccgggc

SEQ ID NO: 470798 - DNA, 25 bp, Rattus norvegicus
aggaagaagtttggccgctcggctc

SEQ ID NO: 470799 - DNA, 25 bp, Rattus norvegicus
cgctctccacttccggcaagaaccg

SEQ ID NO: 470800 - DNA, 25 bp, Rattus norvegicus
aacgctagcccgagagagaggaaga

SEQ ID NO: 470801 - DNA, 25 bp, Rattus norvegicus
ccggctgtaacgctagcccgagaga

SEQ ID NO: 470802 - DNA, 25 bp, Rattus norvegicus
atgagccaccggctgtaacgctagc

SEQ ID NO: 470803 - DNA, 25 bp, Rattus norvegicus
agagaatctggcctaggagcgcttg

SEQ ID NO: 470804 - DNA, 25 bp, Rattus norvegicus
caccggaaatgagccaccggctgta

SEQ ID NO: 470805 - DNA, 25 bp, Rattus norvegicus
aagtttggccgctcggctcgtgact

SEQ ID NO: 470806 - DNA, 25 bp, Rattus norvegicus
cacttccgggccctcactgggcgcg

SEQ ID NO: 470807 - DNA, 25 bp, Rattus norvegicus
aagaaccgcccagcggtcttagcgc

SEQ ID NO: 470808 - DNA, 25 bp, Rattus norvegicus
atgcgttttgtgaccatagatggtc

SEQ ID NO: 470809 - DNA, 25 bp, Rattus norvegicus
cttcctgtttgctctatgcgttttg

SEQ ID NO: 470810 - DNA, 25 bp, Rattus norvegicus
gagaaaatcttccactcgcgcccta

SEQ ID NO: 470811 - DNA, 25 bp, Rattus norvegicus
gccctcgctcgattccgtggctagg

SEQ ID NO: 470812 - DNA, 25 bp, Rattus norvegicus
tgagcatctgggcatgctcgccctc

SEQ ID NO: 470813 - DNA, 25 bp, Rattus norvegicus
cagaaaagcaatggactcggtcgcg

SEQ ID NO: 470814 - DNA, 25 bp, Rattus norvegicus
tccctgtctgtggttacagaaaagc

SEQ ID NO: 470815 - DNA, 25 bp, Rattus norvegicus
gtgcaagccttggtttccctgtctg

SEQ ID NO: 470816 - DNA, 25 bp, Rattus norvegicus
cgctaggcgtgcaagccttggtttc

SEQ ID NO: 470817 - DNA, 25 bp, Rattus norvegicus
catagatggtcagatccgtggccgc

SEQ ID NO: 470818 - DNA, 25 bp, Rattus norvegicus
aaacttcgtctctcgctaggcgtgc

SEQ ID NO: 470819 - DNA, 25 bp, Rattus norvegicus
tggtcagatccgtggccgcggcaaa

SEQ ID NO: 470820 - DNA, 25 bp, Rattus norvegicus
gcggcaaagcttccgcctcaggctt

SEQ ID NO: 470821 - DNA, 25 bp, Rattus norvegicus
ggaccggtgccaaacttcgtctctc

SEQ ID NO: 470822 - DNA, 25 bp, Rattus norvegicus
tcgctgctcagccacgttctcaaag

SEQ ID NO: 470823 - DNA, 25 bp, Rattus norvegicus
acgccgggatgctctagtgttctgc

SEQ ID NO: 470824 - DNA, 25 bp, Rattus norvegicus
agccacgttctcaaagccggcaact

SEQ ID NO: 470825 - DNA, 25 bp, Rattus norvegicus
ctctagtgttctgccggccggcact

SEQ ID NO: 470826 - DNA, 25 bp, Rattus norvegicus
actctcctgaggctccggtcctagg

SEQ ID NO: 470827 - DNA, 25 bp, Rattus norvegicus
taggcgcagccgcagctactactct

SEQ ID NO: 470828 - DNA, 25 bp, Rattus norvegicus
agctactactctctctgttcgctag

SEQ ID NO: 470829 - DNA, 25 bp, Rattus norvegicus
gctagctcttagcaaaccagcaacg

SEQ ID NO: 470830 - DNA, 25 bp, Rattus norvegicus
ttagcaaaccagcaacgccggcgag

SEQ ID NO: 470831 - DNA, 25 bp, Rattus norvegicus
cgccggcgaggaaaactcctttgca

SEQ ID NO: 470832 - DNA, 25 bp, Rattus norvegicus
cgcgcctcttaaaggttcggtcctg

SEQ ID NO: 470833 - DNA, 25 bp, Rattus norvegicus
taaaggttcggtcctgcgcctctag

SEQ ID NO: 470834 - DNA, 25 bp, Rattus norvegicus
tcaccttcacctgggctggtcgttc

SEQ ID NO: 470835 - DNA, 25 bp, Rattus norvegicus
gtctggcggagagcctcgctgctca

SEQ ID NO: 470836 - DNA, 25 bp, Rattus norvegicus
tgtgcacgccctggtggcgcaccag

SEQ ID NO: 470837 - DNA, 25 bp, Rattus norvegicus
agttccgaaactggcgcctgcgagt

SEQ ID NO: 470838 - DNA, 25 bp, Rattus norvegicus
tctccgtcactaagttccgaaactg

SEQ ID NO: 470839 - DNA, 25 bp, Rattus norvegicus
gggcttctccgtcactaagttccga

SEQ ID NO: 470840 - DNA, 25 bp, Rattus norvegicus
tgtggggcttctccgtcactaagtt

SEQ ID NO: 470841 - DNA, 25 bp, Rattus norvegicus
cacactgtgcgcagctgtggggctt

SEQ ID NO: 470842 - DNA, 25 bp, Rattus norvegicus
gcttcccacactgtgcgcagctgtg

SEQ ID NO: 470843 - DNA, 25 bp, Rattus norvegicus
gtctgaaccccagcggaagcgcttc

SEQ ID NO: 470844 - DNA, 25 bp, Rattus norvegicus
ctggtgcctggctaagtctgaaccc

SEQ ID NO: 470845 - DNA, 25 bp, Rattus norvegicus
tatgtgtgcgctggtgcctggctaa

SEQ ID NO: 470846 - DNA, 25 bp, Rattus norvegicus
tcagggcacttgtgtggcttttccc

SEQ ID NO: 470847 - DNA, 25 bp, Rattus norvegicus
tcttgtcgcattcagggcacttgtg

SEQ ID NO: 470848 - DNA, 25 bp, Rattus norvegicus
ccgacgtgctaccaccggcttgtcc

SEQ ID NO: 470849 - DNA, 25 bp, Rattus norvegicus
cgcaccaggtcggaagagctgcgga

SEQ ID NO: 470850 - DNA, 25 bp, Rattus norvegicus
ccaggcttcccagtagcagggacca

SEQ ID NO: 470851 - DNA, 25 bp, Rattus norvegicus
cccggatggcactcctagtctggaa

SEQ ID NO: 470852 - DNA, 25 bp, Rattus norvegicus
tgcagactgccttcgagacagcgcg

SEQ ID NO: 470853 - DNA, 25 bp, Rattus norvegicus
caaagtttgctttgaactcgctccc

SEQ ID NO: 470854 - DNA, 25 bp, Rattus norvegicus
gcggacatggacttcgactcgtatc

SEQ ID NO: 470855 - DNA, 25 bp, Rattus norvegicus
cttcgactcgtatcagcactatttc

SEQ ID NO: 470856 - DNA, 25 bp, Rattus norvegicus
tacgactatgactgcggagaggatt

SEQ ID NO: 470857 - DNA, 25 bp, Rattus norvegicus
agaggatttctaccgctccacggcg

SEQ ID NO: 470858 - DNA, 25 bp, Rattus norvegicus
aagaaattcgagctggtgccgtcgc

SEQ ID NO: 470859 - DNA, 25 bp, Rattus norvegicus
ctgcctctgggattagtcccgggga

SEQ ID NO: 470860 - DNA, 25 bp, Rattus norvegicus
gccattcgaaagcttggggcaggaa

SEQ ID NO: 470861 - DNA, 25 bp, Rattus norvegicus
ggcaggaattatgcttccatcattc

SEQ ID NO: 470862 - DNA, 25 bp, Rattus norvegicus
atcattcgccgtgactgcatgtgga

SEQ ID NO: 470863 - DNA, 25 bp, Rattus norvegicus
gtctggaagccagtaacccggcgcc

SEQ ID NO: 470864 - DNA, 25 bp, Rattus norvegicus
gggctactggcactggcaagtccac

SEQ ID NO: 470865 - DNA, 25 bp, Rattus norvegicus
ccacttgtagtgattctcggggcta

SEQ ID NO: 470866 - DNA, 25 bp, Rattus norvegicus
tgccacgaacactgccacttgtagt

SEQ ID NO: 470867 - DNA, 25 bp, Rattus norvegicus
tctggattccgaggcctgccacgaa

SEQ ID NO: 470868 - DNA, 25 bp, Rattus norvegicus
ggttcctgtgagctctggattccga

SEQ ID NO: 470869 - DNA, 25 bp, Rattus norvegicus
gctgcagcacgagcggttcctgtga

SEQ ID NO: 470870 - DNA, 25 bp, Rattus norvegicus
catggggacagctgcttcggcgcat

SEQ ID NO: 470871 - DNA, 25 bp, Rattus norvegicus
cgcactgactgttgccatggggaca

SEQ ID NO: 470872 - DNA, 25 bp, Rattus norvegicus
agtccactctggctcttcaattagg

SEQ ID NO: 470873 - DNA, 25 bp, Rattus norvegicus
ttcggcgcatgctcagatgccttca

SEQ ID NO: 470874 - DNA, 25 bp, Rattus norvegicus
gctcttcaattaggccagcggctcg

SEQ ID NO: 470875 - DNA, 25 bp, Rattus norvegicus
ggcgagatcgtcagcgccgactcca

SEQ ID NO: 470876 - DNA, 25 bp, Rattus norvegicus
tcagcgccgactccatgcaggtaag

SEQ ID NO: 470877 - DNA, 25 bp, Rattus norvegicus
atgcaggtaaggcagcgtgcttgac

SEQ ID NO: 470878 - DNA, 25 bp, Rattus norvegicus
atggggacccaggacacctatgatg

SEQ ID NO: 470879 - DNA, 25 bp, Rattus norvegicus
agcactggcagcttctggtgaccga

SEQ ID NO: 470880 - DNA, 25 bp, Rattus norvegicus
tgcctgcttcagagacaccgacgtc

SEQ ID NO: 470881 - DNA, 25 bp, Rattus norvegicus
ctagtatcggtacagacaccttgtg

SEQ ID NO: 470882 - DNA, 25 bp, Rattus norvegicus
cccattggttgcgttcagtaagagg

SEQ ID NO: 470883 - DNA, 25 bp, Rattus norvegicus
agcgctccgagttctagtctccgaa

SEQ ID NO: 470884 - DNA, 25 bp, Rattus norvegicus
gttctgctccggacactcgcgaatt

SEQ ID NO: 470885 - DNA, 25 bp, Rattus norvegicus
tgcgaactcgagatccgctgcgctg

SEQ ID NO: 470886 - DNA, 25 bp, Rattus norvegicus
tcccatccttgtcgtcgaggcgtcg

SEQ ID NO: 470887 - DNA, 25 bp, Rattus norvegicus
cgctcgatggtgagggaagcatctt

SEQ ID NO: 470888 - DNA, 25 bp, Rattus norvegicus
atgcgagtccgctgaacatccgaga

SEQ ID NO: 470889 - DNA, 25 bp, Rattus norvegicus
cgatctcgagcaccactagcgactg

SEQ ID NO: 470890 - DNA, 25 bp, Rattus norvegicus
gttgaacctgtatcatgccatgacg

SEQ ID NO: 470891 - DNA, 25 bp, Rattus norvegicus
tccgggacttaggagctcgctcaac

SEQ ID NO: 470892 - DNA, 25 bp, Rattus norvegicus
gaccctaaaaggacgcgcatcatca

SEQ ID NO: 470893 - DNA, 25 bp, Rattus norvegicus
caagggcgtgaaggacctgaagatc

SEQ ID NO: 470894 - DNA, 25 bp, Rattus norvegicus
accgctcgggcaatgtgatcttcag

SEQ ID NO: 470895 - DNA, 25 bp, Rattus norvegicus
tgattactctaagtcagccgcggga

SEQ ID NO: 470896 - DNA, 25 bp, Rattus norvegicus
gtactctcccgaaggccacctgatt

SEQ ID NO: 470897 - DNA, 25 bp, Rattus norvegicus
ctgggcattttgctggcctctaagc

SEQ ID NO: 470898 - DNA, 25 bp, Rattus norvegicus
ggatccctgtcttggccagcaacta

SEQ ID NO: 470899 - DNA, 25 bp, Rattus norvegicus
tgcccatgtgcaaggccgcggacat

SEQ ID NO: 470900 - DNA, 25 bp, Rattus norvegicus
agatgaccgtctacctgcacagtga

SEQ ID NO: 470901 - DNA, 25 bp, Rattus norvegicus
cggcatcccggagaacctgattggt

SEQ ID NO: 470902 - DNA, 25 bp, Rattus norvegicus
tgccaatctgggcatcgggatccct

SEQ ID NO: 470903 - DNA, 25 bp, Rattus norvegicus
ctctcgagttcaaggacggcatgta

SEQ ID NO: 470904 - DNA, 25 bp, Rattus norvegicus
gcatagagcgcctgaccacacgtga

SEQ ID NO: 470905 - DNA, 25 bp, Rattus norvegicus
cgcgcaacttcaacgtgcccatgtg

SEQ ID NO: 470906 - DNA, 25 bp, Rattus norvegicus
cggctccatctaagcgacgggaatg

SEQ ID NO: 470907 - DNA, 25 bp, Rattus norvegicus
aaccggctccatctaagcgacggga

SEQ ID NO: 470908 - DNA, 25 bp, Rattus norvegicus
ctgggaaccggctccatctaagcga

SEQ ID NO: 470909 - DNA, 25 bp, Rattus norvegicus
tgtcaacatccgaggccggagactg

SEQ ID NO: 470910 - DNA, 25 bp, Rattus norvegicus
ggaatggagcattgcttgtcgtacg

SEQ ID NO: 470911 - DNA, 25 bp, Rattus norvegicus
ccatctaagcgacgggaatgcggga

SEQ ID NO: 470912 - DNA, 25 bp, Rattus norvegicus
tccggtttgtgtcaacatccgaggc

SEQ ID NO: 470913 - DNA, 25 bp, Rattus norvegicus
accgcctccggtttgtgtcaacatc

SEQ ID NO: 470914 - DNA, 25 bp, Rattus norvegicus
tgtaaaccgcctccggtttgtgtca

SEQ ID NO: 470915 - DNA, 25 bp, Rattus norvegicus
cagacccgttcagtgtaaaccgcct

SEQ ID NO: 470916 - DNA, 25 bp, Rattus norvegicus
tccagacccgttcagtgtaaaccgc

SEQ ID NO: 470917 - DNA, 25 bp, Rattus norvegicus
tgaaaccttccagacccgttcagtg

SEQ ID NO: 470918 - DNA, 25 bp, Rattus norvegicus
gaaggaggtgttttcgcctccctga

SEQ ID NO: 470919 - DNA, 25 bp, Rattus norvegicus
gtttgtgtcaacatccgaggccgga

SEQ ID NO: 470920 - DNA, 25 bp, Rattus norvegicus
gctccgctctccacccggcgatccc

SEQ ID NO: 470921 - DNA, 25 bp, Rattus norvegicus
tacgccccgaggtcagggaaagtca

SEQ ID NO: 470922 - DNA, 25 bp, Rattus norvegicus
cccgctccgctctccacccggcgat

SEQ ID NO: 470923 - DNA, 25 bp, Rattus norvegicus
actgtccgcggccaccgaccgacac

SEQ ID NO: 470924 - DNA, 25 bp, Rattus norvegicus
atgctacaacttcgcggccgcgact

SEQ ID NO: 470925 - DNA, 25 bp, Rattus norvegicus
tatgctacaacttcgcggccgcgac

SEQ ID NO: 470926 - DNA, 25 bp, Rattus norvegicus
ttatgctacaacttcgcggccgcga

SEQ ID NO: 470927 - DNA, 25 bp, Rattus norvegicus
tttatgctacaacttcgcggccgcg

SEQ ID NO: 470928 - DNA, 25 bp, Rattus norvegicus
cctttatgctacaacttcgcggccg

SEQ ID NO: 470929 - DNA, 25 bp, Rattus norvegicus
cgcctttatgctacaacttcgcggc

SEQ ID NO: 470930 - DNA, 25 bp, Rattus norvegicus
gccgcctttatgctacaacttcgcg

SEQ ID NO: 470931 - DNA, 25 bp, Rattus norvegicus
cagccgcctttatgctacaacttcg

SEQ ID NO: 470932 - DNA, 25 bp, Rattus norvegicus
ttcgccctttcttcccctcagccgc

SEQ ID NO: 470933 - DNA, 25 bp, Rattus norvegicus
gaggtcagggaaagtcacccggagc

SEQ ID NO: 470934 - DNA, 25 bp, Rattus norvegicus
ggcagtgggcacagctgtttccacc

SEQ ID NO: 470935 - DNA, 25 bp, Rattus norvegicus
taagagggcgagtttctatcgaggc

SEQ ID NO: 470936 - DNA, 25 bp, Rattus norvegicus
gagtttctatcgaggcggaggagca

SEQ ID NO: 470937 - DNA, 25 bp, Rattus norvegicus
agctcgcacgctgggtggcacagga

SEQ ID NO: 470938 - DNA, 25 bp, Rattus norvegicus
ggcttcgaagagacgtgggctgcca

SEQ ID NO: 470939 - DNA, 25 bp, Rattus norvegicus
tgggctgccagggaatgcccagagt

SEQ ID NO: 470940 - DNA, 25 bp, Rattus norvegicus
aatgcccagagtgcgggctgacagg

SEQ ID NO: 470941 - DNA, 25 bp, Rattus norvegicus
ggcacaggatgaagatcagagaagt

SEQ ID NO: 470942 - DNA, 25 bp, Rattus norvegicus
ggcagcgatcctcgcgcaggagcgc

SEQ ID NO: 470943 - DNA, 25 bp, Rattus norvegicus
caggagcccagcgatccgaggctgc

SEQ ID NO: 470944 - DNA, 25 bp, Rattus norvegicus
ccagggagcgcgaggggaaaagcat

SEQ ID NO: 470945 - DNA, 25 bp, Rattus norvegicus
caccgcggagcgcacgccgaacttc

SEQ ID NO: 470946 - DNA, 25 bp, Rattus norvegicus
agtccgcaagggtggggcatcgtaa

SEQ ID NO: 470947 - DNA, 25 bp, Rattus norvegicus
tcagagaagtgcgagcaggagccca

SEQ ID NO: 470948 - DNA, 25 bp, Rattus norvegicus
gcgtagcttcctgaccgacttgttc

SEQ ID NO: 470949 - DNA, 25 bp, Rattus norvegicus
ggcaccacgaaaacaccctagagca

SEQ ID NO: 470950 - DNA, 25 bp, Rattus norvegicus
ctagagcacagtactgacccttttc

SEQ ID NO: 470951 - DNA, 25 bp, Rattus norvegicus
ttttccagcgacttcacgttgcggc

SEQ ID NO: 470952 - DNA, 25 bp, Rattus norvegicus
ttcgaatccggtgaatcgccacttc

SEQ ID NO: 470953 - DNA, 25 bp, Rattus norvegicus
gagtcttcccggtatctttaaatgc

SEQ ID NO: 470954 - DNA, 25 bp, Rattus norvegicus
tcgccgggcgcttatatagtacgtt

SEQ ID NO: 470955 - DNA, 25 bp, Rattus norvegicus
ctcaccatggctgaggcgtagcttc

SEQ ID NO: 470956 - DNA, 25 bp, Rattus norvegicus
ttcctcagcaggagcgaacagcggt

SEQ ID NO: 470957 - DNA, 25 bp, Rattus norvegicus
cggtgagtcaggacagagcagactt

SEQ ID NO: 470958 - DNA, 25 bp, Rattus norvegicus
gacttgacaaggctccacagcacgc

SEQ ID NO: 470959 - DNA, 25 bp, Rattus norvegicus
cacgcaccacaggtctcggaaagga

SEQ ID NO: 470960 - DNA, 25 bp, Rattus norvegicus
atagtacgttcgcatccgggtcctt

SEQ ID NO: 470961 - DNA, 25 bp, Rattus norvegicus
agcgaacgtaagtcgcggcccactc

SEQ ID NO: 470962 - DNA, 25 bp, Rattus norvegicus
ggcttcgacgcggaccctacagagc

SEQ ID NO: 470963 - DNA, 25 bp, Rattus norvegicus
tgcaaatcgtgtcgccttcgagaag

SEQ ID NO: 470964 - DNA, 25 bp, Rattus norvegicus
gcctgtcactcggtgccagctgaac

SEQ ID NO: 470965 - DNA, 25 bp, Rattus norvegicus
ctgaaccaatcgatgtccaaagttg

SEQ ID NO: 470966 - DNA, 25 bp, Rattus norvegicus
tcgtccgcccgatagccagcttcat

SEQ ID NO: 470967 - DNA, 25 bp, Rattus norvegicus
aggcgggccttatgcaaatcgtgtc

SEQ ID NO: 470968 - DNA, 25 bp, Rattus norvegicus
tcgatgtccaaagttgcggagagga

SEQ ID NO: 470969 - DNA, 25 bp, Rattus norvegicus
cgccttcgagaagcaaatagtgata

SEQ ID NO: 470970 - DNA, 25 bp, Rattus norvegicus
atagtgatacaagaactggggaggc

SEQ ID NO: 470971 - DNA, 25 bp, Rattus norvegicus
ggtgccagctgaaccaatcgatgtc

SEQ ID NO: 470972 - DNA, 25 bp, Rattus norvegicus
tacagagcctgtcgtccgcccgata

SEQ ID NO: 470973 - DNA, 25 bp, Rattus norvegicus
aggctccgagccatctagcgactcg

SEQ ID NO: 470974 - DNA, 25 bp, Rattus norvegicus
catctagcgactcggcgagcggcct

SEQ ID NO: 470975 - DNA, 25 bp, Rattus norvegicus
ccctcgaagcaacctcgtggggcgg

SEQ ID NO: 470976 - DNA, 25 bp, Rattus norvegicus
gggctcactcgcactccctcccggc

SEQ ID NO: 470977 - DNA, 25 bp, Rattus norvegicus
agttccttgagctccctgtctccga

SEQ ID NO: 470978 - DNA, 25 bp, Rattus norvegicus
tcggctcagttccttgagctccctg

SEQ ID NO: 470979 - DNA, 25 bp, Rattus norvegicus
ccctaaatgtcaagcgggcggcttg

SEQ ID NO: 470980 - DNA, 25 bp, Rattus norvegicus
ggtcgaggaatcagagttcccctaa

SEQ ID NO: 470981 - DNA, 25 bp, Rattus norvegicus
ttgagctccctgtctccgacgctgt

SEQ ID NO: 470982 - DNA, 25 bp, Rattus norvegicus
atggaaccaaggcagcccccggagg

SEQ ID NO: 470983 - DNA, 25 bp, Rattus norvegicus
gccggatcggatccgagccggaaca

SEQ ID NO: 470984 - DNA, 25 bp, Rattus norvegicus
gatcggatccgagccggaacatgga

SEQ ID NO: 470985 - DNA, 25 bp, Rattus norvegicus
atccgagccggaacatggaaccaag

SEQ ID NO: 470986 - DNA, 25 bp, Rattus norvegicus
cgagccggaacatggaaccaaggca

SEQ ID NO: 470987 - DNA, 25 bp, Rattus norvegicus
ccggaacatggaaccaaggcagccc

SEQ ID NO: 470988 - DNA, 25 bp, Rattus norvegicus
caggggcagagaccgccgcggtgcc

SEQ ID NO: 470989 - DNA, 25 bp, Rattus norvegicus
tccgacgctgtcttctcccgcccgg

SEQ ID NO: 470990 - DNA, 25 bp, Rattus norvegicus
tcggggtgagagaatccagcacact

SEQ ID NO: 470991 - DNA, 25 bp, Rattus norvegicus
caggagaacgatcttaggtaagaca

SEQ ID NO: 470992 - DNA, 25 bp, Rattus norvegicus
cgcagccagctttcgccatgaagcg

SEQ ID NO: 470993 - DNA, 25 bp, Rattus norvegicus
agctttcgccatgaagcggcccagg

SEQ ID NO: 470994 - DNA, 25 bp, Rattus norvegicus
ctccgacggcgagtctgatggaccc

SEQ ID NO: 470995 - DNA, 25 bp, Rattus norvegicus
tctgatggacccatcgacgtgggtc

SEQ ID NO: 470996 - DNA, 25 bp, Rattus norvegicus
cttcccacggttcggtggcgcgtca

SEQ ID NO: 470997 - DNA, 25 bp, Rattus norvegicus
agaatccagcacactcaggtttatg

SEQ ID NO: 470998 - DNA, 25 bp, Rattus norvegicus
cactcaggtttatgcgcagcccgca

SEQ ID NO: 470999 - DNA, 25 bp, Rattus norvegicus
atgcgcagcccgcaggtgtcagcca

SEQ ID NO: 471000 - DNA, 25 bp, Rattus norvegicus
tgcagcgtctccagtgtgtccatag

SEQ ID NO: 471001 - DNA, 25 bp, Rattus norvegicus
agtgtgtccatagcaccagcgcggc

SEQ ID NO: 471002 - DNA, 25 bp, Rattus norvegicus
accaactccagggatcgcagggctg

SEQ ID NO: 471003 - DNA, 25 bp, Rattus norvegicus
tcgacgtgggtcaggagaacgatct

SEQ ID NO: 471004 - DNA, 25 bp, Rattus norvegicus
ccagagtagcacagtcacaggcgtt

SEQ ID NO: 471005 - DNA, 25 bp, Rattus norvegicus
tcagacagatacaaacacgcagatg

SEQ ID NO: 471006 - DNA, 25 bp, Rattus norvegicus
atacaaacacgcagatgcacccaga

SEQ ID NO: 471007 - DNA, 25 bp, Rattus norvegicus
agatgcacccagaaacacccacggg

SEQ ID NO: 471008 - DNA, 25 bp, Rattus norvegicus
cagaaacacccacgggcgtgtgccc

SEQ ID NO: 471009 - DNA, 25 bp, Rattus norvegicus
tagcacagtcacaggcgttcacaca

SEQ ID NO: 471010 - DNA, 25 bp, Rattus norvegicus
ttcacacagactcgggtatgcgccc

SEQ ID NO: 471011 - DNA, 25 bp, Rattus norvegicus
caaagaaacgcggaagtcaccacta

SEQ ID NO: 471012 - DNA, 25 bp, Rattus norvegicus
cgcggaagtcaccactagcacattt

SEQ ID NO: 471013 - DNA, 25 bp, Rattus norvegicus
agtcaccactagcacatttcgcgga

SEQ ID NO: 471014 - DNA, 25 bp, Rattus norvegicus
cactagcacatttcgcggaaggagc

SEQ ID NO: 471015 - DNA, 25 bp, Rattus norvegicus
acatttcgcggaaggagcctccggc

SEQ ID NO: 471016 - DNA, 25 bp, Rattus norvegicus
ggggacacggctcagacagatacaa

SEQ ID NO: 471017 - DNA, 25 bp, Rattus norvegicus
ggcgttcacacagactcgggtatgc

SEQ ID NO: 471018 - DNA, 25 bp, Rattus norvegicus
ccaaggccgctgtgagcgcagcatc

SEQ ID NO: 471019 - DNA, 25 bp, Rattus norvegicus
agagtgggcgggcacgactgcgccc

SEQ ID NO: 471020 - DNA, 25 bp, Rattus norvegicus
gggcgggcacgactgcgcccaggtc

SEQ ID NO: 471021 - DNA, 25 bp, Rattus norvegicus
ctgcgcccaggtcgcgaggcgccct

SEQ ID NO: 471022 - DNA, 25 bp, Rattus norvegicus
cccaggtcgcgaggcgcccttcgac

SEQ ID NO: 471023 - DNA, 25 bp, Rattus norvegicus
aggtcgcgaggcgcccttcgaccag

SEQ ID NO: 471024 - DNA, 25 bp, Rattus norvegicus
cgaggcgcccttcgaccagcagcgc

SEQ ID NO: 471025 - DNA, 25 bp, Rattus norvegicus
gcgcccttcgaccagcagcgcccgg

SEQ ID NO: 471026 - DNA, 25 bp, Rattus norvegicus
cccttcgaccagcagcgcccggggc

SEQ ID NO: 471027 - DNA, 25 bp, Rattus norvegicus
cccaaggccgctgtgagcgcagcat

SEQ ID NO: 471028 - DNA, 25 bp, Rattus norvegicus
caaggccgctgtgagcgcagcatct

SEQ ID NO: 471029 - DNA, 25 bp, Rattus norvegicus
ccgctgtgagcgcagcatctggctg

SEQ ID NO: 471030 - DNA, 25 bp, Rattus norvegicus
aaggccgctgtgagcgcagcatctg

SEQ ID NO: 471031 - DNA, 25 bp, Rattus norvegicus
gagggtataaatggagcggtggctg

SEQ ID NO: 471032 - DNA, 25 bp, Rattus norvegicus
gagcccggggcctatatttatcgcg

SEQ ID NO: 471033 - DNA, 25 bp, Rattus norvegicus
ccatggcctccttatacgtgggcga

SEQ ID NO: 471034 - DNA, 25 bp, Rattus norvegicus
agtaggccctgcaagaagtcctggc

SEQ ID NO: 471035 - DNA, 25 bp, Rattus norvegicus
cccttttgtcctgcagtaggccctg

SEQ ID NO: 471036 - DNA, 25 bp, Rattus norvegicus
gtccggtgtaagtcgtcccgcactc

SEQ ID NO: 471037 - DNA, 25 bp, Rattus norvegicus
agccttttgtcttggggcttttgcg

SEQ ID NO: 471038 - DNA, 25 bp, Rattus norvegicus
gccatattgtttttgagagcctttt

SEQ ID NO: 471039 - DNA, 25 bp, Rattus norvegicus
caggacagctggagagtacaaactc

SEQ ID NO: 471040 - DNA, 25 bp, Rattus norvegicus
atatttatcgcgaaacgcgtgtccc

SEQ ID NO: 471041 - DNA, 25 bp, Rattus norvegicus
ttatacgtgggcgatctgcactccg

SEQ ID NO: 471042 - DNA, 25 bp, Rattus norvegicus
cgctgtaattgtaaaccgccgggag

SEQ ID NO: 471043 - DNA, 25 bp, Rattus norvegicus
caaactccaggagagggccatattg

SEQ ID NO: 471044 - DNA, 25 bp, Rattus norvegicus
cctctgcaaggggattccctacttc

SEQ ID NO: 471045 - DNA, 25 bp, Rattus norvegicus
cttttaagctccaagccaggacagc

SEQ ID NO: 471046 - DNA, 25 bp, Rattus norvegicus
ggtcttcagcgcaccaatcaggttc

SEQ ID NO: 471047 - DNA, 25 bp, Rattus norvegicus
ttcactgtgcaggtagacggtcatc

SEQ ID NO: 471048 - DNA, 25 bp, Rattus norvegicus
gatcttcaggtccttcacgcccttg

SEQ ID NO: 471049 - DNA, 25 bp, Rattus norvegicus
accacgcgcctgacctgcttagagg

SEQ ID NO: 471050 - DNA, 25 bp, Rattus norvegicus
tcccgcggctgacttagagtaatca

SEQ ID NO: 471051 - DNA, 25 bp, Rattus norvegicus
ggtcagccttccagcccttgatcag

SEQ ID NO: 471052 - DNA, 25 bp, Rattus norvegicus
ctgaagatcacattgcccgagcggt

SEQ ID NO: 471053 - DNA, 25 bp, Rattus norvegicus
ggcgaaagtacccacgtccacgatc

SEQ ID NO: 471054 - DNA, 25 bp, Rattus norvegicus
gctctatgcgcttctcgaacctcgg

SEQ ID NO: 471055 - DNA, 25 bp, Rattus norvegicus
tgatgatgcgcgtccttttagggtc

SEQ ID NO: 471056 - DNA, 25 bp, Rattus norvegicus
atgccgtccttgaactcgagagccg

SEQ ID NO: 471057 - DNA, 25 bp, Rattus norvegicus
agggatcccgatgcccagattggca

SEQ ID NO: 471058 - DNA, 25 bp, Rattus norvegicus
ttgctggccaagacagggatcccga

SEQ ID NO: 471059 - DNA, 25 bp, Rattus norvegicus
cggccttgcacatgggcacgttgaa

SEQ ID NO: 471060 - DNA, 25 bp, Rattus norvegicus
gcccgtaggtccctcagagcaacgt

SEQ ID NO: 471061 - DNA, 25 bp, Rattus norvegicus
tcgtcatcggtcatggcgtgataca

SEQ ID NO: 471062 - DNA, 25 bp, Rattus norvegicus
gctcaggccggcgaacaatttcttg

SEQ ID NO: 471063 - DNA, 25 bp, Rattus norvegicus
ggggcacattccgttgccagaagta

SEQ ID NO: 471064 - DNA, 25 bp, Rattus norvegicus
cccttctgctctgggagtctctgta

SEQ ID NO: 471065 - DNA, 25 bp, Rattus norvegicus
tacctggctccatgggaagacattg

SEQ ID NO: 471066 - DNA, 25 bp, Rattus norvegicus
tcgcgggtagctctacagcgattga

SEQ ID NO: 471067 - DNA, 25 bp, Rattus norvegicus
gcccagggatggtctcaacaacgca

SEQ ID NO: 471068 - DNA, 25 bp, Rattus norvegicus
gattgagcaccacgcactcggcagg

SEQ ID NO: 471069 - DNA, 25 bp, Rattus norvegicus
gatcccttgagttcgcacctgtcgc

SEQ ID NO: 471070 - DNA, 25 bp, Rattus norvegicus
ctcggactttcagcagatgcgcatc

SEQ ID NO: 471071 - DNA, 25 bp, Rattus norvegicus
gacgtacggccatctcggactttca

SEQ ID NO: 471072 - DNA, 25 bp, Rattus norvegicus
gtagcccgagcactgccaggatttc

SEQ ID NO: 471073 - DNA, 25 bp, Rattus norvegicus
ctggagagacgcctttaccctgggt

SEQ ID NO: 471074 - DNA, 25 bp, Rattus norvegicus
cccacgctgggcctttcagaaggcg

SEQ ID NO: 471075 - DNA, 25 bp, Rattus norvegicus
gccggacaaatctcctgacaaagga

SEQ ID NO: 471076 - DNA, 25 bp, Rattus norvegicus
agcagtcctggtcacgccggacaaa

SEQ ID NO: 471077 - DNA, 25 bp, Rattus norvegicus
tggccgggaacaaaaggctccgctc

SEQ ID NO: 471078 - DNA, 25 bp, Rattus norvegicus
gcatgcaaacttctggccgggaaca

SEQ ID NO: 471079 - DNA, 25 bp, Rattus norvegicus
agctgtcacggtcccggcatgcaaa

SEQ ID NO: 471080 - DNA, 25 bp, Rattus norvegicus
tgcatgacaagcagtcgcctctttt

SEQ ID NO: 471081 - DNA, 25 bp, Rattus norvegicus
ggcagcagaaagtcccgtgtcctgt

SEQ ID NO: 471082 - DNA, 25 bp, Rattus norvegicus
ttagtttgtccctccggcagcagaa

SEQ ID NO: 471083 - DNA, 25 bp, Rattus norvegicus
ctagcgctcaggaagttagtttgtc

SEQ ID NO: 471084 - DNA, 25 bp, Rattus norvegicus
accgcaaccttgcaggtggctcctg

SEQ ID NO: 471085 - DNA, 25 bp, Rattus norvegicus
tgaaggactcacttagcaccgcccg

SEQ ID NO: 471086 - DNA, 25 bp, Rattus norvegicus
tgcggcagcgaccaagaggtagtct

SEQ ID NO: 471087 - DNA, 25 bp, Rattus norvegicus
agcccagcacaagggcgaacccaga

SEQ ID NO: 471088 - DNA, 25 bp, Rattus norvegicus
ttcggatccggccagataatagagc

SEQ ID NO: 471089 - DNA, 25 bp, Rattus norvegicus
tctcaactctaccagaagccggcgg

SEQ ID NO: 471090 - DNA, 25 bp, Rattus norvegicus
gccagataatagagcaaacagtgtg

SEQ ID NO: 471091 - DNA, 25 bp, Rattus norvegicus
agtcccagagcaggcggtctcccga

SEQ ID NO: 471092 - DNA, 25 bp, Rattus norvegicus
atgagagcgtctccctcgagcccaa

SEQ ID NO: 471093 - DNA, 25 bp, Rattus norvegicus
cccgggaaaccgaatgagagcgtct

SEQ ID NO: 471094 - DNA, 25 bp, Rattus norvegicus
ggggctccgaggcttatctcaactc

SEQ ID NO: 471095 - DNA, 25 bp, Rattus norvegicus
agcctcggcctttgtgcggttctgt

SEQ ID NO: 471096 - DNA, 25 bp, Rattus norvegicus
tgacccggcacgtagccggccatgg

SEQ ID NO: 471097 - DNA, 25 bp, Rattus norvegicus
aactccttctcctggctgcggttgg

SEQ ID NO: 471098 - DNA, 25 bp, Rattus norvegicus
tcgtatgcctgcacgaactccttct

SEQ ID NO: 471099 - DNA, 25 bp, Rattus norvegicus
agcacatcctcgtatgcctgcacga

SEQ ID NO: 471100 - DNA, 25 bp, Rattus norvegicus
tgcacgtcagaacaggaggccgagc

SEQ ID NO: 471101 - DNA, 25 bp, Rattus norvegicus
acagtgtgactggagatatgagagc

SEQ ID NO: 471102 - DNA, 25 bp, Rattus norvegicus
gcggtccctcctctcgtagcggccc

SEQ ID NO: 471103 - DNA, 25 bp, Rattus norvegicus
tcccagggtgactctccgaggctcg

SEQ ID NO: 471104 - DNA, 25 bp, Rattus norvegicus
cagtcccagggtgactctccgaggc

SEQ ID NO: 471105 - DNA, 25 bp, Rattus norvegicus
ctcttctcggtcagtcccagggtga

SEQ ID NO: 471106 - DNA, 25 bp, Rattus norvegicus
agctcttctcggtcagtcccagggt

SEQ ID NO: 471107 - DNA, 25 bp, Rattus norvegicus
ccagggagctcttctcggtcagtcc

SEQ ID NO: 471108 - DNA, 25 bp, Rattus norvegicus
gccctctgcgcgaccgacctctccg

SEQ ID NO: 471109 - DNA, 25 bp, Rattus norvegicus
tcccagggttaattctcactcttca

SEQ ID NO: 471110 - DNA, 25 bp, Rattus norvegicus
ccggagctcccagggttaattctca

SEQ ID NO: 471111 - DNA, 25 bp, Rattus norvegicus
cccgtgtcctctcgcggtccctcct

SEQ ID NO: 471112 - DNA, 25 bp, Rattus norvegicus
ggccgctcgatgaccctggcccgcc

SEQ ID NO: 471113 - DNA, 25 bp, Rattus norvegicus
ggtgactctccgaggctcgggctcc

SEQ ID NO: 471114 - DNA, 25 bp, Rattus norvegicus
gagctcccagggttaattctcactc

SEQ ID NO: 471115 - DNA, 25 bp, Rattus norvegicus
gggttaattctcactcttcattccc

SEQ ID NO: 471116 - DNA, 25 bp, Rattus norvegicus
acctgggtcacccacgagaggaaat

SEQ ID NO: 471117 - DNA, 25 bp, Rattus norvegicus
aagcagagcggtttgcgcctgcgca

SEQ ID NO: 471118 - DNA, 25 bp, Rattus norvegicus
cagggaaaccaagcagagcggtttg

SEQ ID NO: 471119 - DNA, 25 bp, Rattus norvegicus
ggccttgtccctgcggcaaccaggg

SEQ ID NO: 471120 - DNA, 25 bp, Rattus norvegicus
gagcgcgacgccgtaaatcgaccgc

SEQ ID NO: 471121 - DNA, 25 bp, Rattus norvegicus
gacatctacagagcgcgacgccgta

SEQ ID NO: 471122 - DNA, 25 bp, Rattus norvegicus
cccgcggtgcgacatctacagagcg

SEQ ID NO: 471123 - DNA, 25 bp, Rattus norvegicus
ctgccgtaaaggacgcccgcggtgc

SEQ ID NO: 471124 - DNA, 25 bp, Rattus norvegicus
ggaggacgcagacgcctgccgtaaa

SEQ ID NO: 471125 - DNA, 25 bp, Rattus norvegicus
cacgaccgccggcttaaggaggacg

SEQ ID NO: 471126 - DNA, 25 bp, Rattus norvegicus
gctgaccggacacagcaagcgccta

SEQ ID NO: 471127 - DNA, 25 bp, Rattus norvegicus
gcgaaccttcttggctgaccggaca

SEQ ID NO: 471128 - DNA, 25 bp, Rattus norvegicus
gaggaaatttgtctaggagcaatcc

SEQ ID NO: 471129 - DNA, 25 bp, Rattus norvegicus
ggagcaatccctagcgaaccttctt

SEQ ID NO: 471130 - DNA, 25 bp, Rattus norvegicus
aggctcgccggagtaaggcacctcc

SEQ ID NO: 471131 - DNA, 25 bp, Rattus norvegicus
ggcctcccagcagctctggacgatg

SEQ ID NO: 471132 - DNA, 25 bp, Rattus norvegicus
ttcccagtcagggaggcggtgaaca

SEQ ID NO: 471133 - DNA, 25 bp, Rattus norvegicus
cgggcgcagattgtaggctaccact

SEQ ID NO: 471134 - DNA, 25 bp, Rattus norvegicus
ggctaccactgcgtactgcacgtac

SEQ ID NO: 471135 - DNA, 25 bp, Rattus norvegicus
ctcctttcaggagctccggagcttg

SEQ ID NO: 471136 - DNA, 25 bp, Rattus norvegicus
gttctgcagcgtcttcccagtcagg

SEQ ID NO: 471137 - DNA, 25 bp, Rattus norvegicus
gcagctctggacgatgttctgcagc

SEQ ID NO: 471138 - DNA, 25 bp, Rattus norvegicus
taaggcacctccctggtggtcatct

SEQ ID NO: 471139 - DNA, 25 bp, Rattus norvegicus
gcgtggcgatctctcctttcaggag

SEQ ID NO: 471140 - DNA, 25 bp, Rattus norvegicus
gtggtcatctgccacagggtgatgc

SEQ ID NO: 471141 - DNA, 25 bp, Rattus norvegicus
gccacagggtgatgccaaaagagta

SEQ ID NO: 471142 - DNA, 25 bp, Rattus norvegicus
tgccaaaagagtagatgtcggcttt

SEQ ID NO: 471143 - DNA, 25 bp, Rattus norvegicus
gtactgcacgtactgaggctcgccg

SEQ ID NO: 471144 - DNA, 25 bp, Rattus norvegicus
gaaaaccgacactgtggggccacta

SEQ ID NO: 471145 - DNA, 25 bp, Rattus norvegicus
ggaggtctttcgcacctgcgcgaca

SEQ ID NO: 471146 - DNA, 25 bp, Rattus norvegicus
agcaagccggaaaagggccgctcca

SEQ ID NO: 471147 - DNA, 25 bp, Rattus norvegicus
catcccgcggaagggccagagacca

SEQ ID NO: 471148 - DNA, 25 bp, Rattus norvegicus
ttaccaggagttggaaggcgacgct

SEQ ID NO: 471149 - DNA, 25 bp, Rattus norvegicus
aagtccgcagcagcagcgcaggtta

SEQ ID NO: 471150 - DNA, 25 bp, Rattus norvegicus
cttccaaggccgatttggggtgctg

SEQ ID NO: 471151 - DNA, 25 bp, Rattus norvegicus
acgcggcagcaaaggagccctgaac

SEQ ID NO: 471152 - DNA, 25 bp, Rattus norvegicus
ttcagggacaccaagagtcttcggt

SEQ ID NO: 471153 - DNA, 25 bp, Rattus norvegicus
gaatctccggggaggttccgcacta

SEQ ID NO: 471154 - DNA, 25 bp, Rattus norvegicus
ttccatggcccactgaatctccggg

SEQ ID NO: 471155 - DNA, 25 bp, Rattus norvegicus
ggttcgtgagcagaatccaattttc

SEQ ID NO: 471156 - DNA, 25 bp, Rattus norvegicus
ctgaggtaatttcggccggcgccta

SEQ ID NO: 471157 - DNA, 25 bp, Rattus norvegicus
ctcgaactccatgggccgtttcagt

SEQ ID NO: 471158 - DNA, 25 bp, Rattus norvegicus
tactgggcctcacaggacgttcgtt

SEQ ID NO: 471159 - DNA, 25 bp, Rattus norvegicus
aggtcccaattgctcccgccgtata

SEQ ID NO: 471160 - DNA, 25 bp, Rattus norvegicus
gtggacacgttagcaagagaccttg

SEQ ID NO: 471161 - DNA, 25 bp, Rattus norvegicus
gtggctgtcactatggcccattaca

SEQ ID NO: 471162 - DNA, 25 bp, Rattus norvegicus
tcgagcagtcgcagtggacacgtta

SEQ ID NO: 471163 - DNA, 25 bp, Rattus norvegicus
ttccgttgctttccctcgagcagtc

SEQ ID NO: 471164 - DNA, 25 bp, Rattus norvegicus
gcttaaagcatctaactcccggaca

SEQ ID NO: 471165 - DNA, 25 bp, Rattus norvegicus
tgcagctgttgcaaagtctctccaa

SEQ ID NO: 471166 - DNA, 25 bp, Rattus norvegicus
tctgcccgggactgaaactcttgca

SEQ ID NO: 471167 - DNA, 25 bp, Rattus norvegicus
cgccgactcgaagcgcgagcagttc

SEQ ID NO: 471168 - DNA, 25 bp, Rattus norvegicus
ggctccgaggagacaaggatacaca

SEQ ID NO: 471169 - DNA, 25 bp, Rattus norvegicus
accacgtggagagatgctacgctta

SEQ ID NO: 471170 - DNA, 25 bp, Rattus norvegicus
cagcgtcccggtcgccatgaaaaca

SEQ ID NO: 471171 - DNA, 25 bp, Rattus norvegicus
tcgcctcttgctaggcaaccgaatc

SEQ ID NO: 471172 - DNA, 25 bp, Rattus norvegicus
cctgctccgtgaggaagttacgaga

SEQ ID NO: 471173 - DNA, 25 bp, Rattus norvegicus
ggccgcttcccggagcgcaagatct

SEQ ID NO: 471174 - DNA, 25 bp, Rattus norvegicus
cgcaagatctccgagagagcccaga

SEQ ID NO: 471175 - DNA, 25 bp, Rattus norvegicus
cagatgtagttcttggccaggcgca

SEQ ID NO: 471176 - DNA, 25 bp, Rattus norvegicus
tcttggagtagcagggcaccacctt

SEQ ID NO: 471177 - DNA, 25 bp, Rattus norvegicus
gcgcgccttggtcatcttgcgtttc

SEQ ID NO: 471178 - DNA, 25 bp, Rattus norvegicus
cttgacctcagccaacgtgggttca

SEQ ID NO: 471179 - DNA, 25 bp, Rattus norvegicus
ttcagggacctcttctccacgaaga

SEQ ID NO: 471180 - DNA, 25 bp, Rattus norvegicus
ctccacgaagagacactggcttggt

SEQ ID NO: 471181 - DNA, 25 bp, Rattus norvegicus
aacagcacagagtgaggggcacacc

SEQ ID NO: 471182 - DNA, 25 bp, Rattus norvegicus
ccttgcacagagtctgcacgtagga

SEQ ID NO: 471183 - DNA, 25 bp, Rattus norvegicus
accagattcgtggtgggctgtgaca

SEQ ID NO: 471184 - DNA, 25 bp, Rattus norvegicus
cgtaggacaccagatccggccgctt

SEQ ID NO: 471185 - DNA, 25 bp, Rattus norvegicus
ttacgagagttcagctgcaggcagc

SEQ ID NO: 471186 - DNA, 25 bp, Rattus norvegicus
acttaccctgctgccctgggagtgg

SEQ ID NO: 471187 - DNA, 25 bp, Rattus norvegicus
gggcactgtccacacctgcgagcgt

SEQ ID NO: 471188 - DNA, 25 bp, Rattus norvegicus
cgcagcggcaagtcctccattcaga

SEQ ID NO: 471189 - DNA, 25 bp, Rattus norvegicus
ccgggcacgtgataagcaccactta

SEQ ID NO: 471190 - DNA, 25 bp, Rattus norvegicus
tcagccgctgctagtcaggtgattc

SEQ ID NO: 471191 - DNA, 25 bp, Rattus norvegicus
gcctgcccagccaataagaagacga

SEQ ID NO: 471192 - DNA, 25 bp, Rattus norvegicus
agtttggcggtagcccaattggagc

SEQ ID NO: 471193 - DNA, 25 bp, Rattus norvegicus
ggtccagcaccatgtccctgcaata

SEQ ID NO: 471194 - DNA, 25 bp, Rattus norvegicus
cagttacggcgcagccgactcattc

SEQ ID NO: 471195 - DNA, 25 bp, Rattus norvegicus
tagaactcctcccttctggtcgctg

SEQ ID NO: 471196 - DNA, 25 bp, Rattus norvegicus
cttgcttatgggactacggcgcagc

SEQ ID NO: 471197 - DNA, 25 bp, Rattus norvegicus
gacctgggcctccaggttcgacttc

SEQ ID NO: 471198 - DNA, 25 bp, Rattus norvegicus
ccttgtggcattggcgaaaccgacc

SEQ ID NO: 471199 - DNA, 25 bp, Rattus norvegicus
cggtgacagctccaagccaaggatc

SEQ ID NO: 471200 - DNA, 25 bp, Rattus norvegicus
gtggcagatcaaatcacagcggatc

SEQ ID NO: 471201 - DNA, 25 bp, Rattus norvegicus
gatcaaatcacagcggatcaggcgc

SEQ ID NO: 471202 - DNA, 25 bp, Rattus norvegicus
ccagggcgcgtgtgcacagccacgt

SEQ ID NO: 471203 - DNA, 25 bp, Rattus norvegicus
gtgtgcacagccacgtgcgccagcc

SEQ ID NO: 471204 - DNA, 25 bp, Rattus norvegicus
gtctggggcgcagcactgagtcaca

SEQ ID NO: 471205 - DNA, 25 bp, Rattus norvegicus
agcactgagtcacagcggctgaccc

SEQ ID NO: 471206 - DNA, 25 bp, Rattus norvegicus
gagtcacagcggctgacccagcaaa

SEQ ID NO: 471207 - DNA, 25 bp, Rattus norvegicus
agcggctgacccagcaaagtgctgc

SEQ ID NO: 471208 - DNA, 25 bp, Rattus norvegicus
ccagcaaagtgctgcgagtgtgacc

SEQ ID NO: 471209 - DNA, 25 bp, Rattus norvegicus
tgtgaccggaatgaagggttgcacc

SEQ ID NO: 471210 - DNA, 25 bp, Rattus norvegicus
atgaagggttgcaccgtctgtctcc

SEQ ID NO: 471211 - DNA, 25 bp, Rattus norvegicus
ttgcaccgtctgtctccgaggtggc

SEQ ID NO: 471212 - DNA, 25 bp, Rattus norvegicus
caccgtctgtctccgaggtggcgtg

SEQ ID NO: 471213 - DNA, 25 bp, Rattus norvegicus
aggtggcgtggcagatcaaatcaca

SEQ ID NO: 471214 - DNA, 25 bp, Rattus norvegicus
cccggcttctgctgatctgtctttt

SEQ ID NO: 471215 - DNA, 25 bp, Rattus norvegicus
cccgcgcctgtgtttgagcagcggc

SEQ ID NO: 471216 - DNA, 25 bp, Rattus norvegicus
cgcggagttagcgtttccgccgagc

SEQ ID NO: 471217 - DNA, 25 bp, Rattus norvegicus
acatttgctcttgcccgcggagtta

SEQ ID NO: 471218 - DNA, 25 bp, Rattus norvegicus
ctctcagggctctttacatttgctc

SEQ ID NO: 471219 - DNA, 25 bp, Rattus norvegicus
tgcacaaagtgctctcagggctctt

SEQ ID NO: 471220 - DNA, 25 bp, Rattus norvegicus
cccggcctgatatttgcacaaagtg

SEQ ID NO: 471221 - DNA, 25 bp, Rattus norvegicus
cacttcccggcctgatatttgcaca

SEQ ID NO: 471222 - DNA, 25 bp, Rattus norvegicus
gcaaagtgaattagcgcgcagccga

SEQ ID NO: 471223 - DNA, 25 bp, Rattus norvegicus
aggtgacggcaaagtgaattagcgc

SEQ ID NO: 471224 - DNA, 25 bp, Rattus norvegicus
ccgcgccctcagaacgcttcagctg

SEQ ID NO: 471225 - DNA, 25 bp, Rattus norvegicus
ttttgctccattaggtagggccgcg

SEQ ID NO: 471226 - DNA, 25 bp, Rattus norvegicus
tgctgatctgtcttttgctccatta

SEQ ID NO: 471227 - DNA, 25 bp, Rattus norvegicus
gccgagcgccgacttctccaaaggg

SEQ ID NO: 471228 - DNA, 25 bp, Rattus norvegicus
agagtccagagttggcctaacaagc

SEQ ID NO: 471229 - DNA, 25 bp, Rattus norvegicus
gcaaatttcccaccggggccaagca

SEQ ID NO: 471230 - DNA, 25 bp, Rattus norvegicus
cttctgggacgcgtctcacctagct

SEQ ID NO: 471231 - DNA, 25 bp, Rattus norvegicus
cccggtggagacaaagtgggcagca

SEQ ID NO: 471232 - DNA, 25 bp, Rattus norvegicus
tgaaagatttgtcccccagcagcgg

SEQ ID NO: 471233 - DNA, 25 bp, Rattus norvegicus
cgttcatgaatgaaagatttgtccc

SEQ ID NO: 471234 - DNA, 25 bp, Rattus norvegicus
ttggcctaacaagctcccgttcatg

SEQ ID NO: 471235 - DNA, 25 bp, Rattus norvegicus
cacaatttaattaagtggctttaga

SEQ ID NO: 471236 - DNA, 25 bp, Rattus norvegicus
gggccaagcaactttccacaattta

SEQ ID NO: 471237 - DNA, 25 bp, Rattus norvegicus
tgtgtgcaaatttcccaccggggcc

SEQ ID NO: 471238 - DNA, 25 bp, Rattus norvegicus
cccggtgcctttgtgtgcaaatttc

SEQ ID NO: 471239 - DNA, 25 bp, Rattus norvegicus
ttttttgttgtgtggctccgggctg

SEQ ID NO: 471240 - DNA, 25 bp, Rattus norvegicus
tgggacgcgtctcacctagctcgcg

SEQ ID NO: 471241 - DNA, 25 bp, Rattus norvegicus
acaagctcccgttcatgaatgaaag

SEQ ID NO: 471242 - DNA, 25 bp, Rattus norvegicus
acggctaatagcttgagaacactca

SEQ ID NO: 471243 - DNA, 25 bp, Rattus norvegicus
atccgtgttcctggttccgccttat

SEQ ID NO: 471244 - DNA, 25 bp, Rattus norvegicus
gtgttcctggttccgccttattaca

SEQ ID NO: 471245 - DNA, 25 bp, Rattus norvegicus
gttccgccttattacacacacagtg

SEQ ID NO: 471246 - DNA, 25 bp, Rattus norvegicus
ttacacacacagtgctcccgttttg

SEQ ID NO: 471247 - DNA, 25 bp, Rattus norvegicus
acacacagtgctcccgttttgctgc

SEQ ID NO: 471248 - DNA, 25 bp, Rattus norvegicus
gctgctcctggcctggagaatttgc

SEQ ID NO: 471249 - DNA, 25 bp, Rattus norvegicus
tcctggcctggagaatttgcataga

SEQ ID NO: 471250 - DNA, 25 bp, Rattus norvegicus
cctggagaatttgcatagataactg

SEQ ID NO: 471251 - DNA, 25 bp, Rattus norvegicus
gataactgtttatcagaaaaagtcc

SEQ ID NO: 471252 - DNA, 25 bp, Rattus norvegicus
aaagtccaaatgaggctgatccagg

SEQ ID NO: 471253 - DNA, 25 bp, Rattus norvegicus
tgatccaggagggtgacggctaata

SEQ ID NO: 471254 - DNA, 25 bp, Rattus norvegicus
agcttgagaacactcagtgctgata

SEQ ID NO: 471255 - DNA, 25 bp, Rattus norvegicus
cactcagtgctgataagaaagggga

SEQ ID NO: 471256 - DNA, 25 bp, Rattus norvegicus
tgtcagcaggccagaacgcgcctct

SEQ ID NO: 471257 - DNA, 25 bp, Rattus norvegicus
cttcggaatcagacatatgcgggtt

SEQ ID NO: 471258 - DNA, 25 bp, Rattus norvegicus
agttaatccactgaagcgtagccca

SEQ ID NO: 471259 - DNA, 25 bp, Rattus norvegicus
gtagcccaaaataagcgcactgcct

SEQ ID NO: 471260 - DNA, 25 bp, Rattus norvegicus
actgcctaatgtgccgggaactgcc

SEQ ID NO: 471261 - DNA, 25 bp, Rattus norvegicus
caaggccagactgcaagcggatgtc

SEQ ID NO: 471262 - DNA, 25 bp, Rattus norvegicus
cggagcctgcatttagcgccagcga

SEQ ID NO: 471263 - DNA, 25 bp, Rattus norvegicus
agcgctgctttcacaccgactcgag

SEQ ID NO: 471264 - DNA, 25 bp, Rattus norvegicus
cgagccgcgagtttatggatcttga

SEQ ID NO: 471265 - DNA, 25 bp, Rattus norvegicus
ggatcttgattgcacccagcaggga

SEQ ID NO: 471266 - DNA, 25 bp, Rattus norvegicus
cccagcagggaatcctttttagtga

SEQ ID NO: 471267 - DNA, 25 bp, Rattus norvegicus
ctttgcattgggtgtgttggacaca

SEQ ID NO: 471268 - DNA, 25 bp, Rattus norvegicus
gttggacacacttccctgcttcgga

SEQ ID NO: 471269 - DNA, 25 bp, Rattus norvegicus
gcaccgcgaaactttacgctgtaaa

SEQ ID NO: 471270 - DNA, 25 bp, Rattus norvegicus
ccgcacctggaacacggcaaggcag

SEQ ID NO: 471271 - DNA, 25 bp, Rattus norvegicus
ccctctacggtaatgtgttctcgca

SEQ ID NO: 471272 - DNA, 25 bp, Rattus norvegicus
acaaggcggcacagcgcaccacttg

SEQ ID NO: 471273 - DNA, 25 bp, Rattus norvegicus
acacggacacgcacacggacatgca

SEQ ID NO: 471274 - DNA, 25 bp, Rattus norvegicus
cactcggacgaggatgctcccagct

SEQ ID NO: 471275 - DNA, 25 bp, Rattus norvegicus
tcgccaagcagttcaagcaacgacg

SEQ ID NO: 471276 - DNA, 25 bp, Rattus norvegicus
ccaacctggacaagatcgcggcgca

SEQ ID NO: 471277 - DNA, 25 bp, Rattus norvegicus
cacgtccattgaggtgggtgtcaaa

SEQ ID NO: 471278 - DNA, 25 bp, Rattus norvegicus
ctcgagagccactttctcaagtgtc

SEQ ID NO: 471279 - DNA, 25 bp, Rattus norvegicus
tcaagtgtcccaagccgtctgcgca

SEQ ID NO: 471280 - DNA, 25 bp, Rattus norvegicus
gtctgcgcacgagatcaccggcctg

SEQ ID NO: 471281 - DNA, 25 bp, Rattus norvegicus
cggcagaaggagaagcgcatgaccc

SEQ ID NO: 471282 - DNA, 25 bp, Rattus norvegicus
ccctcaatggctacccacgggagga

SEQ ID NO: 471283 - DNA, 25 bp, Rattus norvegicus
gcgcaagaagcgcacgtccattgag

SEQ ID NO: 471284 - DNA, 25 bp, Rattus norvegicus
tccggtattgacagaaagcagatgc

SEQ ID NO: 471285 - DNA, 25 bp, Rattus norvegicus
tgctatgcaacctatcagaagcctg

SEQ ID NO: 471286 - DNA, 25 bp, Rattus norvegicus
cagccgcttgcgacttgctatgcaa

SEQ ID NO: 471287 - DNA, 25 bp, Rattus norvegicus
taccggaagcagacccagccgcttg

SEQ ID NO: 471288 - DNA, 25 bp, Rattus norvegicus
gtccaccaggactaccggaagcaga

SEQ ID NO: 471289 - DNA, 25 bp, Rattus norvegicus
acggcgaccgcactacaagaaccag

SEQ ID NO: 471290 - DNA, 25 bp, Rattus norvegicus
aaatgctcggcaaactccaccacgg

SEQ ID NO: 471291 - DNA, 25 bp, Rattus norvegicus
gcctcctgaggtctaagaaatgctc

SEQ ID NO: 471292 - DNA, 25 bp, Rattus norvegicus
aaaagccgccgacatgcctcctgag

SEQ ID NO: 471293 - DNA, 25 bp, Rattus norvegicus
tcttggctgccttgcgaaaagccgc

SEQ ID NO: 471294 - DNA, 25 bp, Rattus norvegicus
tggcttcgttctcggtgttcccgct

SEQ ID NO: 471295 - DNA, 25 bp, Rattus norvegicus
tgcaaggcctacctggcttcgttct

SEQ ID NO: 471296 - DNA, 25 bp, Rattus norvegicus
tatcagaagcctgccttaccggaaa

SEQ ID NO: 471297 - DNA, 25 bp, Rattus norvegicus
aagcagatgcgctgtatccggatgc

SEQ ID NO: 471298 - DNA, 25 bp, Rattus norvegicus
cgtcgcgtaaccgttgggagacagt

SEQ ID NO: 471299 - DNA, 25 bp, Rattus norvegicus
cccattctgtgcaggctagcgtgtc

SEQ ID NO: 471300 - DNA, 25 bp, Rattus norvegicus
ttctgtgcaggctagcgtgtctcag

SEQ ID NO: 471301 - DNA, 25 bp, Rattus norvegicus
caggctagcgtgtctcagggtcgtc

SEQ ID NO: 471302 - DNA, 25 bp, Rattus norvegicus
tgtctcagggtcgtcgcgtaaccgt

SEQ ID NO: 471303 - DNA, 25 bp, Rattus norvegicus
gtcgtcgcgtaaccgttgggagaca

SEQ ID NO: 471304 - DNA, 25 bp, Rattus norvegicus
aaaaggttttgaaactccacagatg

SEQ ID NO: 471305 - DNA, 25 bp, Rattus norvegicus
ttgaaactccacagatgtcataacg

SEQ ID NO: 471306 - DNA, 25 bp, Rattus norvegicus
cacagatgtcataacgacgctgagg

SEQ ID NO: 471307 - DNA, 25 bp, Rattus norvegicus
atgtcataacgacgctgagggcccg

SEQ ID NO: 471308 - DNA, 25 bp, Rattus norvegicus
ataacgacgctgagggcccgcgtgt

SEQ ID NO: 471309 - DNA, 25 bp, Rattus norvegicus
ggaaacgggccaccgccacgctcgc

SEQ ID NO: 471310 - DNA, 25 bp, Rattus norvegicus
gactagtggctaaggccctggggtc

SEQ ID NO: 471311 - DNA, 25 bp, Rattus norvegicus
aggttttgaaactccacagatgtca

SEQ ID NO: 471312 - DNA, 25 bp, Rattus norvegicus
agcaggctacctcgccgcggctctc

SEQ ID NO: 471313 - DNA, 25 bp, Rattus norvegicus
acagtctgtcgcagcaggctacctc

SEQ ID NO: 471314 - DNA, 25 bp, Rattus norvegicus
acccacgccgctcgcgcccaagctc

SEQ ID NO: 471315 - DNA, 25 bp, Rattus norvegicus
ctgtttccgcgctgcgttcggacca

SEQ ID NO: 471316 - DNA, 25 bp, Rattus norvegicus
ccacacagtctgtcgcagcaggcta

SEQ ID NO: 471317 - DNA, 25 bp, Rattus norvegicus
cacttcctcggaggcttagggccgc

SEQ ID NO: 471318 - DNA, 25 bp, Rattus norvegicus
tcagagcgccagattcgcctgggct

SEQ ID NO: 471319 - DNA, 25 bp, Rattus norvegicus
agccgccgggagatcggctcccgcc

SEQ ID NO: 471320 - DNA, 25 bp, Rattus norvegicus
gcgcccgcttcgaggtgagagtccc

SEQ ID NO: 471321 - DNA, 25 bp, Rattus norvegicus
cggctcacttcctcggaggcttagg

SEQ ID NO: 471322 - DNA, 25 bp, Rattus norvegicus
ggcatctcgaacacgggatcccgcg

SEQ ID NO: 471323 - DNA, 25 bp, Rattus norvegicus
cctctgctggggcatctcgaacacg

SEQ ID NO: 471324 - DNA, 25 bp, Rattus norvegicus
tccgcgctgcgttcggaccagggtt

SEQ ID NO: 471325 - DNA, 25 bp, Rattus norvegicus
gtcgagaaggtcagagcgccagatt

SEQ ID NO: 471326 - DNA, 25 bp, Rattus norvegicus
gtaccagcctctatgccaggccata

SEQ ID NO: 471327 - DNA, 25 bp, Rattus norvegicus
ttcagagcgccatgcgagccgcgga

SEQ ID NO: 471328 - DNA, 25 bp, Rattus norvegicus
ccgcggagcgagtgtggcatctcta

SEQ ID NO: 471329 - DNA, 25 bp, Rattus norvegicus
agcgagtgtggcatctctaccaggc

SEQ ID NO: 471330 - DNA, 25 bp, Rattus norvegicus
tggcatctctaccaggcggggtacc

SEQ ID NO: 471331 - DNA, 25 bp, Rattus norvegicus
taccaggcggggtaccagcctctat

SEQ ID NO: 471332 - DNA, 25 bp, Rattus norvegicus
tctatgccaggccatatgggcttgg

SEQ ID NO: 471333 - DNA, 25 bp, Rattus norvegicus
cacgtcacgggcagcagctatcaca

SEQ ID NO: 471334 - DNA, 25 bp, Rattus norvegicus
cgggcagcagctatcacatgagaga

SEQ ID NO: 471335 - DNA, 25 bp, Rattus norvegicus
agcagctatcacatgagagacggtg

SEQ ID NO: 471336 - DNA, 25 bp, Rattus norvegicus
tatcacatgagagacggtgattggc

SEQ ID NO: 471337 - DNA, 25 bp, Rattus norvegicus
acggtgattggcatgcgtctgcatt

SEQ ID NO: 471338 - DNA, 25 bp, Rattus norvegicus
ccggcgtcttcagagcgccatgcga

SEQ ID NO: 471339 - DNA, 25 bp, Rattus norvegicus
gccatatgggcttggcacgtcacgg

SEQ ID NO: 471340 - DNA, 25 bp, Rattus norvegicus
gctcatcggccacgattcaagggta

SEQ ID NO: 471341 - DNA, 25 bp, Rattus norvegicus
ctactgtgttccctgctacgacaac

SEQ ID NO: 471342 - DNA, 25 bp, Rattus norvegicus
tgtgttccctgctacgacaacacct

SEQ ID NO: 471343 - DNA, 25 bp, Rattus norvegicus
ttcgccaacacctgtgccgagtgcc

SEQ ID NO: 471344 - DNA, 25 bp, Rattus norvegicus
ccgagtgccagcagctcatcggcca

SEQ ID NO: 471345 - DNA, 25 bp, Rattus norvegicus
tcggccacgattcaagggtaaggac

SEQ ID NO: 471346 - DNA, 25 bp, Rattus norvegicus
taaggaccggaccaaatgggtgaga

SEQ ID NO: 471347 - DNA, 25 bp, Rattus norvegicus
accggaccaaatgggtgagagtccg

SEQ ID NO: 471348 - DNA, 25 bp, Rattus norvegicus
aggaactgttttatgaggatcgcca

SEQ ID NO: 471349 - DNA, 25 bp, Rattus norvegicus
actgttttatgaggatcgccacttc

SEQ ID NO: 471350 - DNA, 25 bp, Rattus norvegicus
atcgccacttccacgagggctgctt

SEQ ID NO: 471351 - DNA, 25 bp, Rattus norvegicus
ggccgcaaatacatccagacagaca

SEQ ID NO: 471352 - DNA, 25 bp, Rattus norvegicus
gctgccgctgccagcgctccctcgc

SEQ ID NO: 471353 - DNA, 25 bp, Rattus norvegicus
gatgggagagggccaaagataaacc

SEQ ID NO: 471354 - DNA, 25 bp, Rattus norvegicus
aagcctgaccgctggctctgcggtt

SEQ ID NO: 471355 - DNA, 25 bp, Rattus norvegicus
gctcaggatccgctcagggccgcac

SEQ ID NO: 471356 - DNA, 25 bp, Rattus norvegicus
tcagggccgcacgtttttttgccaa

SEQ ID NO: 471357 - DNA, 25 bp, Rattus norvegicus
tgccaaaaaaggcaaggatgcagct

SEQ ID NO: 471358 - DNA, 25 bp, Rattus norvegicus
aaaggcaaggatgcagctgcacgcg

SEQ ID NO: 471359 - DNA, 25 bp, Rattus norvegicus
cacgcgccgcgggaacatctggatc

SEQ ID NO: 471360 - DNA, 25 bp, Rattus norvegicus
ccgcgggaacatctggatccgattc

SEQ ID NO: 471361 - DNA, 25 bp, Rattus norvegicus
ctggatccgattcccagcatgaatg

SEQ ID NO: 471362 - DNA, 25 bp, Rattus norvegicus
tccgattcccagcatgaatgggtca

SEQ ID NO: 471363 - DNA, 25 bp, Rattus norvegicus
tcccagcatgaatgggtcatggccc

SEQ ID NO: 471364 - DNA, 25 bp, Rattus norvegicus
cgcctctcgtgattcactggcgggg

SEQ ID NO: 471365 - DNA, 25 bp, Rattus norvegicus
cgatggggcggagcactcccctgct

SEQ ID NO: 471366 - DNA, 25 bp, Rattus norvegicus
ctgctggacgcccaagcctgaccgc

SEQ ID NO: 471367 - DNA, 25 bp, Rattus norvegicus
accgctggctctgcggttggactgt

SEQ ID NO: 471368 - DNA, 25 bp, Rattus norvegicus
tggagacaattttagagcagcaacg

SEQ ID NO: 471369 - DNA, 25 bp, Rattus norvegicus
cacgcggaactttggtgcagccgga

SEQ ID NO: 471370 - DNA, 25 bp, Rattus norvegicus
tgcgctcagagacacgggcgtgcaa

SEQ ID NO: 471371 - DNA, 25 bp, Rattus norvegicus
gcaggcagtgtttccggcagtgtta

SEQ ID NO: 471372 - DNA, 25 bp, Rattus norvegicus
agtccacggtgagtgaacagtggtc

SEQ ID NO: 471373 - DNA, 25 bp, Rattus norvegicus
gtctgaattgaagtaccgcggccaa

SEQ ID NO: 471374 - DNA, 25 bp, Rattus norvegicus
tgcagccggatactgcgctcagaga

SEQ ID NO: 471375 - DNA, 25 bp, Rattus norvegicus
gcatcagtaggagggcctcggccct

SEQ ID NO: 471376 - DNA, 25 bp, Rattus norvegicus
ttagagcagcaacggcgctatcatg

SEQ ID NO: 471377 - DNA, 25 bp, Rattus norvegicus
ctatcatgaggagaaagaacggctt

SEQ ID NO: 471378 - DNA, 25 bp, Rattus norvegicus
gaacggcttatggatgttatggcca

SEQ ID NO: 471379 - DNA, 25 bp, Rattus norvegicus
tgttatggccaaagaaatgctcact

SEQ ID NO: 471380 - DNA, 25 bp, Rattus norvegicus
aatgctcactaagaagtccacggtg

SEQ ID NO: 471381 - DNA, 25 bp, Rattus norvegicus
tccggcagtgttagcggtctgaatt

SEQ ID NO: 471382 - DNA, 25 bp, Rattus norvegicus
ggagccactaaagagccggaatttc

SEQ ID NO: 471383 - DNA, 25 bp, Rattus norvegicus
gcgcgactgtgacagagttgtcttc

SEQ ID NO: 471384 - DNA, 25 bp, Rattus norvegicus
tagttcctcagtcctggcctttcga

SEQ ID NO: 471385 - DNA, 25 bp, Rattus norvegicus
tttctcgggccgaggtagttcctca

SEQ ID NO: 471386 - DNA, 25 bp, Rattus norvegicus
gtccgaagcagagtcgccgaaaccc

SEQ ID NO: 471387 - DNA, 25 bp, Rattus norvegicus
ggtgacctcgtactgcttgcttatt

SEQ ID NO: 471388 - DNA, 25 bp, Rattus norvegicus
ttactctccgccagacatgagggca

SEQ ID NO: 471389 - DNA, 25 bp, Rattus norvegicus
agttctgctaggaagttactctccg

SEQ ID NO: 471390 - DNA, 25 bp, Rattus norvegicus
ggtaaaggtgttgaccatcaagcga

SEQ ID NO: 471391 - DNA, 25 bp, Rattus norvegicus
atcccgagttcctgtggctgtgcag

SEQ ID NO: 471392 - DNA, 25 bp, Rattus norvegicus
cgcccattggaggaggcaggtatca

SEQ ID NO: 471393 - DNA, 25 bp, Rattus norvegicus
acattctgctttggggcggagccac

SEQ ID NO: 471394 - DNA, 25 bp, Rattus norvegicus
tcaggggccctggttacattctgct

SEQ ID NO: 471395 - DNA, 25 bp, Rattus norvegicus
tgaggatccggctcaagttctgcta

SEQ ID NO: 471396 - DNA, 25 bp, Rattus norvegicus
tctgctcagcgttccgtcccagggt

SEQ ID NO: 471397 - DNA, 25 bp, Rattus norvegicus
ccctggatagcaaaagccaatcaca

SEQ ID NO: 471398 - DNA, 25 bp, Rattus norvegicus
ctacggtcagcttcccagtgcagca

SEQ ID NO: 471399 - DNA, 25 bp, Rattus norvegicus
ccagggtcctcagccaggtgaacta

SEQ ID NO: 471400 - DNA, 25 bp, Rattus norvegicus
agccgcggaggtaaaagcagaagct

SEQ ID NO: 471401 - DNA, 25 bp, Rattus norvegicus
tgggacttgagctctctgccgaagc

SEQ ID NO: 471402 - DNA, 25 bp, Rattus norvegicus
ccacagcctgctggttagaggagcg

SEQ ID NO: 471403 - DNA, 25 bp, Rattus norvegicus
agtgcagcacgagagcgcctgaccc

SEQ ID NO: 471404 - DNA, 25 bp, Rattus norvegicus
tccatggctgacatcgcgtattctc

SEQ ID NO: 471405 - DNA, 25 bp, Rattus norvegicus
ctggggctgagaacacctcaattcc

SEQ ID NO: 471406 - DNA, 25 bp, Rattus norvegicus
aaggcggcggctaactgcacccttc

SEQ ID NO: 471407 - DNA, 25 bp, Rattus norvegicus
ctggtctacgcatctggaaggcggc

SEQ ID NO: 471408 - DNA, 25 bp, Rattus norvegicus
caggtgaactatgtgcgtgggtaca

SEQ ID NO: 471409 - DNA, 25 bp, Rattus norvegicus
aacgagacacgactggagcgctctg

SEQ ID NO: 471410 - DNA, 25 bp, Rattus norvegicus
agttgagttcgtgcgtcacttcctc

SEQ ID NO: 471411 - DNA, 25 bp, Rattus norvegicus
tgtatcgcctcaagggccgcagtga

SEQ ID NO: 471412 - DNA, 25 bp, Rattus norvegicus
cttcctcccggaagcgagtctggac

SEQ ID NO: 471413 - DNA, 25 bp, Rattus norvegicus
tctggacggatgtctactgcgcgtc

SEQ ID NO: 471414 - DNA, 25 bp, Rattus norvegicus
tggcggtcccaactgacacgctgta

SEQ ID NO: 471415 - DNA, 25 bp, Rattus norvegicus
acacgctgtacggtctggcctgttc

SEQ ID NO: 471416 - DNA, 25 bp, Rattus norvegicus
ggctctgagctgtgtgtatcgcctc

SEQ ID NO: 471417 - DNA, 25 bp, Rattus norvegicus
aggccaagccgctggccgtgtgcct

SEQ ID NO: 471418 - DNA, 25 bp, Rattus norvegicus
ccgcgtggccgacgtctacaggtaa

SEQ ID NO: 471419 - DNA, 25 bp, Rattus norvegicus
gcttgtcctggctcaccgaggaatc

SEQ ID NO: 471420 - DNA, 25 bp, Rattus norvegicus
cgaggaatccggaactggaaatttg

SEQ ID NO: 471421 - DNA, 25 bp, Rattus norvegicus
ccgcgcgatgattccgctaagccga

SEQ ID NO: 471422 - DNA, 25 bp, Rattus norvegicus
ctcgccggccggaagttgagttcgt

SEQ ID NO: 471423 - DNA, 25 bp, Rattus norvegicus
ccaccgttcttctagtcgcatgggg

SEQ ID NO: 471424 - DNA, 25 bp, Rattus norvegicus
cttccatactgctcccacgccggga

SEQ ID NO: 471425 - DNA, 25 bp, Rattus norvegicus
ccacttatgcgcaggtcaccgtgtc

SEQ ID NO: 471426 - DNA, 25 bp, Rattus norvegicus
acctgcagtacagcctgagccgttc

SEQ ID NO: 471427 - DNA, 25 bp, Rattus norvegicus
atgcgcaggtcaccgtgtccaccgg

SEQ ID NO: 471428 - DNA, 25 bp, Rattus norvegicus
tgaggactccggtggccgctccgac

SEQ ID NO: 471429 - DNA, 25 bp, Rattus norvegicus
gcgggagccacttatgcgcaggtca

SEQ ID NO: 471430 - DNA, 25 bp, Rattus norvegicus
cggctgccgcgggagccacttatgc

SEQ ID NO: 471431 - DNA, 25 bp, Rattus norvegicus
gaacgcgccgccacgctactgcacc

SEQ ID NO: 471432 - DNA, 25 bp, Rattus norvegicus
acctactcgctgctgtgcctgcgct

SEQ ID NO: 471433 - DNA, 25 bp, Rattus norvegicus
gatctcggtacccgcgctgctagca

SEQ ID NO: 471434 - DNA, 25 bp, Rattus norvegicus
acgtctggcggcttccttccatact

SEQ ID NO: 471435 - DNA, 25 bp, Rattus norvegicus
ccgcgggacctgcagtacagcctga

SEQ ID NO: 471436 - DNA, 25 bp, Rattus norvegicus
ctggctgccgcctgaggactccggt

SEQ ID NO: 471437 - DNA, 25 bp, Rattus norvegicus
ggccgctccgacgtcacctactcgc

SEQ ID NO: 471438 - DNA, 25 bp, Rattus norvegicus
gttcgccacagagcagacggtgcgt

SEQ ID NO: 471439 - DNA, 25 bp, Rattus norvegicus
ggaggcagggcagaacccgacccca

SEQ ID NO: 471440 - DNA, 25 bp, Rattus norvegicus
gccacggccgctgcgccaggtgagt

SEQ ID NO: 471441 - DNA, 25 bp, Rattus norvegicus
ggcaacgcgggacccaatagccgcg

SEQ ID NO: 471442 - DNA, 25 bp, Rattus norvegicus
acggcaacgcgggacccaatagccg

SEQ ID NO: 471443 - DNA, 25 bp, Rattus norvegicus
cgagaaggcattgagcaaccgggca

SEQ ID NO: 471444 - DNA, 25 bp, Rattus norvegicus
cggccgagaaggcattgagcaaccg

SEQ ID NO: 471445 - DNA, 25 bp, Rattus norvegicus
tgagctcgcggcgttcgccacagag

SEQ ID NO: 471446 - DNA, 25 bp, Rattus norvegicus
ccacagagcagacggtgcgtcccta

SEQ ID NO: 471447 - DNA, 25 bp, Rattus norvegicus
cggcgttcgccacagagcagacggt

SEQ ID NO: 471448 - DNA, 25 bp, Rattus norvegicus
cccatcccttcgtcccgcatcagcc

SEQ ID NO: 471449 - DNA, 25 bp, Rattus norvegicus
gattccctccctcgtgcgagccggg

SEQ ID NO: 471450 - DNA, 25 bp, Rattus norvegicus
cagacggtgcgtccctagcccgggt

SEQ ID NO: 471451 - DNA, 25 bp, Rattus norvegicus
agagcagacggtgcgtccctagccc

SEQ ID NO: 471452 - DNA, 25 bp, Rattus norvegicus
aacgtgctttacataggtggctttc

SEQ ID NO: 471453 - DNA, 25 bp, Rattus norvegicus
caagtagtttacctcgcgtttagca

SEQ ID NO: 471454 - DNA, 25 bp, Rattus norvegicus
ggcggccagcaccaacccaggtacc

SEQ ID NO: 471455 - DNA, 25 bp, Rattus norvegicus
ggagcaccatcaatcgctcggcggc

SEQ ID NO: 471456 - DNA, 25 bp, Rattus norvegicus
tataaaggacggagcaccatcaatc

SEQ ID NO: 471457 - DNA, 25 bp, Rattus norvegicus
tggtgaagcccaagtataaaggacg

SEQ ID NO: 471458 - DNA, 25 bp, Rattus norvegicus
tcggcactgtcggcaagatggtgaa

SEQ ID NO: 471459 - DNA, 25 bp, Rattus norvegicus
acctcgcgtttagcagagcggtgtc

SEQ ID NO: 471460 - DNA, 25 bp, Rattus norvegicus
cataggtggctttcctagctgggaa

SEQ ID NO: 471461 - DNA, 25 bp, Rattus norvegicus
cgtgttcggagtccaacgtgcttta

SEQ ID NO: 471462 - DNA, 25 bp, Rattus norvegicus
gctctcaggaagtcgcgtcacgcga

SEQ ID NO: 471463 - DNA, 25 bp, Rattus norvegicus
gccgcgcgctctcaggaagtcgcgt

SEQ ID NO: 471464 - DNA, 25 bp, Rattus norvegicus
gagcccgggcaacccatggcaagcg

SEQ ID NO: 471465 - DNA, 25 bp, Rattus norvegicus
gctgggaagttctcaagtagtttac

SEQ ID NO: 471466 - DNA, 25 bp, Rattus norvegicus
aggccgacgacaacactccgctgag

SEQ ID NO: 471467 - DNA, 25 bp, Rattus norvegicus
acgccactcgattcgtccggtcggg

SEQ ID NO: 471468 - DNA, 25 bp, Rattus norvegicus
cactcgattcgtccggtcggggcag

SEQ ID NO: 471469 - DNA, 25 bp, Rattus norvegicus
ctcctgccgctgctcacgccactcg

SEQ ID NO: 471470 - DNA, 25 bp, Rattus norvegicus
ggcgccaaaccctccgcggcatgct

SEQ ID NO: 471471 - DNA, 25 bp, Rattus norvegicus
ccaccagttcgtggcgccaaaccct

SEQ ID NO: 471472 - DNA, 25 bp, Rattus norvegicus
gacaacactccgctgagggcagacc

SEQ ID NO: 471473 - DNA, 25 bp, Rattus norvegicus
caaccggctccggtgctggccgtgt

SEQ ID NO: 471474 - DNA, 25 bp, Rattus norvegicus
ttggaacagcaaccggctccggtgc

SEQ ID NO: 471475 - DNA, 25 bp, Rattus norvegicus
tgtttggaacagcaaccggctccgg

SEQ ID NO: 471476 - DNA, 25 bp, Rattus norvegicus
gccactgacgtgtttggaacagcaa

SEQ ID NO: 471477 - DNA, 25 bp, Rattus norvegicus
gcgctacttaaggtcctgctgcgtg

SEQ ID NO: 471478 - DNA, 25 bp, Rattus norvegicus
acttaaggtcctgctgcgtgagcca

SEQ ID NO: 471479 - DNA, 25 bp, Rattus norvegicus
tccctgaacggcaggccgacgacaa

SEQ ID NO: 471480 - DNA, 25 bp, Rattus norvegicus
gctgcttcattctccttgtccttcg

SEQ ID NO: 471481 - DNA, 25 bp, Rattus norvegicus
gcagggagacagcttgtgccagccc

SEQ ID NO: 471482 - DNA, 25 bp, Rattus norvegicus
ctcgcgacgaggaacagaatgcata

SEQ ID NO: 471483 - DNA, 25 bp, Rattus norvegicus
agaatgcataacaatcatgcgcgcg

SEQ ID NO: 471484 - DNA, 25 bp, Rattus norvegicus
attctccttgtccttcgtttgccta

SEQ ID NO: 471485 - DNA, 25 bp, Rattus norvegicus
ctttaaggtgccaccgccgcgtggc

SEQ ID NO: 471486 - DNA, 25 bp, Rattus norvegicus
aggacgctgcgcctttaaggtgcca

SEQ ID NO: 471487 - DNA, 25 bp, Rattus norvegicus
gaccttcagaggtcgccaggggacg

SEQ ID NO: 471488 - DNA, 25 bp, Rattus norvegicus
tctgcgcccaccttgaccttcagag

SEQ ID NO: 471489 - DNA, 25 bp, Rattus norvegicus
gctctgacttcgtgcctgccgggct

SEQ ID NO: 471490 - DNA, 25 bp, Rattus norvegicus
cttgcagctctgacttcgtgcctgc

SEQ ID NO: 471491 - DNA, 25 bp, Rattus norvegicus
tcgtttgcctagctccgggttctcg

SEQ ID NO: 471492 - DNA, 25 bp, Rattus norvegicus
ttgtccttcgtttgcctagctccgg

SEQ ID NO: 471493 - DNA, 25 bp, Rattus norvegicus
gcccggttccgctcgcgacgaggaa

SEQ ID NO: 471494 - DNA, 25 bp, Rattus norvegicus
atttcacggtgggtcttggcgactt

SEQ ID NO: 471495 - DNA, 25 bp, Rattus norvegicus
ggcgacttcttctcggcactcattc

SEQ ID NO: 471496 - DNA, 25 bp, Rattus norvegicus
tactgagtgcgtagtgtggcttaac

SEQ ID NO: 471497 - DNA, 25 bp, Rattus norvegicus
gacgctttggcgaccgtagtagtga

SEQ ID NO: 471498 - DNA, 25 bp, Rattus norvegicus
tcattcgccgatgcctccataaagc

SEQ ID NO: 471499 - DNA, 25 bp, Rattus norvegicus
tcaacggactgtgcaagtgactctc

SEQ ID NO: 471500 - DNA, 25 bp, Rattus norvegicus
gcggacggtgggaatgtcttttcca

SEQ ID NO: 471501 - DNA, 25 bp, Rattus norvegicus
ccttttgagttgaaatgagattccc

SEQ ID NO: 471502 - DNA, 25 bp, Rattus norvegicus
actcgggagtgcaaagcaccttttg

SEQ ID NO: 471503 - DNA, 25 bp, Rattus norvegicus
ttcctttggctcaagtggctcaacg

SEQ ID NO: 471504 - DNA, 25 bp, Rattus norvegicus
gtgcaaagcggtccgtcacttcctt

SEQ ID NO: 471505 - DNA, 25 bp, Rattus norvegicus
tagtgaagcaggaacgtctaagccc

SEQ ID NO: 471506 - DNA, 25 bp, Rattus norvegicus
tctacctacaaagagtatttcacgg

SEQ ID NO: 471507 - DNA, 25 bp, Rattus norvegicus
gcctccataaagcatcgatttactg

SEQ ID NO: 471508 - DNA, 25 bp, Rattus norvegicus
cagtgcgcagggtccgcctactggt

SEQ ID NO: 471509 - DNA, 25 bp, Rattus norvegicus
cctagggaatttggactggtgacgc

SEQ ID NO: 471510 - DNA, 25 bp, Rattus norvegicus
gacgcagaacgcagcctagggaatt

SEQ ID NO: 471511 - DNA, 25 bp, Rattus norvegicus
tataggcggcgcgtttcaatggccg

SEQ ID NO: 471512 - DNA, 25 bp, Rattus norvegicus
cctggagaagatgcacgatggattc

SEQ ID NO: 471513 - DNA, 25 bp, Rattus norvegicus
cgcatggcctcgcaggcagctcagg

SEQ ID NO: 471514 - DNA, 25 bp, Rattus norvegicus
gatgcacaacaagacggcgccgccg

SEQ ID NO: 471515 - DNA, 25 bp, Rattus norvegicus
actggtgacgcgcaccaggagccgc

SEQ ID NO: 471516 - DNA, 25 bp, Rattus norvegicus
gccgcttgagcccaacatggcgatg

SEQ ID NO: 471517 - DNA, 25 bp, Rattus norvegicus
tgtgtttgaggatgccaaggaaaga

SEQ ID NO: 471518 - DNA, 25 bp, Rattus norvegicus
gaatgtcccacacgaaccagtacca

SEQ ID NO: 471519 - DNA, 25 bp, Rattus norvegicus
gcggaggagcaaggaatgtcccaca

SEQ ID NO: 471520 - DNA, 25 bp, Rattus norvegicus
gcccaacatggcgatgcacaacaag

SEQ ID NO: 471521 - DNA, 25 bp, Rattus norvegicus
cgatggattctataggcggcgcgtt

SEQ ID NO: 471522 - DNA, 25 bp, Rattus norvegicus
ctttaagggcaatgacgcggaagcc

SEQ ID NO: 471523 - DNA, 25 bp, Rattus norvegicus
agcaggttccgtgcaccgggcaaaa

SEQ ID NO: 471524 - DNA, 25 bp, Rattus norvegicus
acgcgagaaggtcctggctagagcc

SEQ ID NO: 471525 - DNA, 25 bp, Rattus norvegicus
acggcaccttagtagccgcgacagg

SEQ ID NO: 471526 - DNA, 25 bp, Rattus norvegicus
agtcttgggctctgacggcacctta

SEQ ID NO: 471527 - DNA, 25 bp, Rattus norvegicus
acgccgtccgaagagtgtccatgga

SEQ ID NO: 471528 - DNA, 25 bp, Rattus norvegicus
gaccagcgatggagacactgcccga

SEQ ID NO: 471529 - DNA, 25 bp, Rattus norvegicus
cactctacgcaccagggtgaactca

SEQ ID NO: 471530 - DNA, 25 bp, Rattus norvegicus
cctcaggcttgtaccgcgactgctt

SEQ ID NO: 471531 - DNA, 25 bp, Rattus norvegicus
gccttcgtccctgagtctcatactt

SEQ ID NO: 471532 - DNA, 25 bp, Rattus norvegicus
atacttcgtctcagggacagcgctc

SEQ ID NO: 471533 - DNA, 25 bp, Rattus norvegicus
gacagcgctccattccgggaaggac

SEQ ID NO: 471534 - DNA, 25 bp, Rattus norvegicus
tgacccacggggagaaaagttgctg

SEQ ID NO: 471535 - DNA, 25 bp, Rattus norvegicus
gcgactgcttaaggcaggcgctgca

SEQ ID NO: 471536 - DNA, 25 bp, Rattus norvegicus
cgccggactaggattgcggatttcc

SEQ ID NO: 471537 - DNA, 25 bp, Rattus norvegicus
cgtgatccgaaagattgtcccaacc

SEQ ID NO: 471538 - DNA, 25 bp, Rattus norvegicus
tcttggcggggaggacaaagttcca

SEQ ID NO: 471539 - DNA, 25 bp, Rattus norvegicus
cttccttacggggaggaggcaactg

SEQ ID NO: 471540 - DNA, 25 bp, Rattus norvegicus
tgtggcgaaggttctagccctaagc

SEQ ID NO: 471541 - DNA, 25 bp, Rattus norvegicus
atttcgccgcgactgtcagcaagga

SEQ ID NO: 471542 - DNA, 25 bp, Rattus norvegicus
caaggatggccgcagacctagttct

SEQ ID NO: 471543 - DNA, 25 bp, Rattus norvegicus
acctagttctgggactggcttctgc

SEQ ID NO: 471544 - DNA, 25 bp, Rattus norvegicus
tacaggggatggattcgccggacta

SEQ ID NO: 471545 - DNA, 25 bp, Rattus norvegicus
agtggtgctctgaacgtgatccgaa

SEQ ID NO: 471546 - DNA, 25 bp, Rattus norvegicus
cgtcatccggatcggtaagggctcc

SEQ ID NO: 471547 - DNA, 25 bp, Rattus norvegicus
tggggaaggcgccaacttctctccc

SEQ ID NO: 471548 - DNA, 25 bp, Rattus norvegicus
cccagtaagatgtgcgcagcgccgc

SEQ ID NO: 471549 - DNA, 25 bp, Rattus norvegicus
tcggtggcgcccaacgatgaccgct

SEQ ID NO: 471550 - DNA, 25 bp, Rattus norvegicus
gctgcgcccgtgtaacctagagcca

SEQ ID NO: 471551 - DNA, 25 bp, Rattus norvegicus
agggccagaagcagcgccagtctgc

SEQ ID NO: 471552 - DNA, 25 bp, Rattus norvegicus
ccagtccctgcgctgagggccagaa

SEQ ID NO: 471553 - DNA, 25 bp, Rattus norvegicus
ccgttcgtgtccaggcggtgacaca

SEQ ID NO: 471554 - DNA, 25 bp, Rattus norvegicus
cgctgagctccgttcgtgtccaggc

SEQ ID NO: 471555 - DNA, 25 bp, Rattus norvegicus
aagtcaccatgctgcgggccgcgtg

SEQ ID NO: 471556 - DNA, 25 bp, Rattus norvegicus
gtcagaagtcaccatgctgcgggcc

SEQ ID NO: 471557 - DNA, 25 bp, Rattus norvegicus
taacctagagccaccgcggagcaga

SEQ ID NO: 471558 - DNA, 25 bp, Rattus norvegicus
gagcctgaaccatcatggctgcgcc

SEQ ID NO: 471559 - DNA, 25 bp, Rattus norvegicus
ttggtcgagcctgaaccatcatggc

SEQ ID NO: 471560 - DNA, 25 bp, Rattus norvegicus
acctcgattggtcgagcctgaacca

SEQ ID NO: 471561 - DNA, 25 bp, Rattus norvegicus
cgagctctcacctcgattggtcgag

SEQ ID NO: 471562 - DNA, 25 bp, Rattus norvegicus
ctcggctgctcttgtcgagctctca

SEQ ID NO: 471563 - DNA, 25 bp, Rattus norvegicus
ccgcggagtcagaagtcaccatgct

SEQ ID NO: 471564 - DNA, 25 bp, Rattus norvegicus
aacgcctctgcgcacttcgctttaa

SEQ ID NO: 471565 - DNA, 25 bp, Rattus norvegicus
tagaccagcgactgagggcccagaa

SEQ ID NO: 471566 - DNA, 25 bp, Rattus norvegicus
ccctggagcggtctttgtcacctaa

SEQ ID NO: 471567 - DNA, 25 bp, Rattus norvegicus
aaccctggggctcttcattcacctg

SEQ ID NO: 471568 - DNA, 25 bp, Rattus norvegicus
gggagatgctttacgtcctagacca

SEQ ID NO: 471569 - DNA, 25 bp, Rattus norvegicus
tgattggttcgcctttctgttccgc

SEQ ID NO: 471570 - DNA, 25 bp, Rattus norvegicus
tgtcacctaacccaataagcgctgt

SEQ ID NO: 471571 - DNA, 25 bp, Rattus norvegicus
gggcctccaggcagctaaattccga

SEQ ID NO: 471572 - DNA, 25 bp, Rattus norvegicus
ctccgaagactctgaagctgacttt

SEQ ID NO: 471573 - DNA, 25 bp, Rattus norvegicus
acgtagagcacctccgttcggacca

SEQ ID NO: 471574 - DNA, 25 bp, Rattus norvegicus
tcccggcgactaggaagctagacta

SEQ ID NO: 471575 - DNA, 25 bp, Rattus norvegicus
tcgccggtgcaaaaagttggccctg

SEQ ID NO: 471576 - DNA, 25 bp, Rattus norvegicus
agctgactttccttgttcgccggtg

SEQ ID NO: 471577 - DNA, 25 bp, Rattus norvegicus
taagcgctgttcttcggagcacctc

SEQ ID NO: 471578 - DNA, 25 bp, Rattus norvegicus
ttctctgagcctccgtgggtgttcc

SEQ ID NO: 471579 - DNA, 25 bp, Rattus norvegicus
tggctgcggactcttcttcccaaac

SEQ ID NO: 471580 - DNA, 25 bp, Rattus norvegicus
tgaggaaagggacgcactaggcacc

SEQ ID NO: 471581 - DNA, 25 bp, Rattus norvegicus
ggcctcttcccttggcgcactggct

SEQ ID NO: 471582 - DNA, 25 bp, Rattus norvegicus
cgcggaaggcggaaggcatcacgcg

SEQ ID NO: 471583 - DNA, 25 bp, Rattus norvegicus
ccctagacacaggcgggttttggcg

SEQ ID NO: 471584 - DNA, 25 bp, Rattus norvegicus
ggttgccatggcttctctgagcctc

SEQ ID NO: 471585 - DNA, 25 bp, Rattus norvegicus
tgctctgggtctcccgcggttgcca

SEQ ID NO: 471586 - DNA, 25 bp, Rattus norvegicus
atgctctgatgctctgggtctcccg

SEQ ID NO: 471587 - DNA, 25 bp, Rattus norvegicus
cgatgcgcatgctctgatgctctgg

SEQ ID NO: 471588 - DNA, 25 bp, Rattus norvegicus
tcctgcgatgcgcatgctctgatgc

SEQ ID NO: 471589 - DNA, 25 bp, Rattus norvegicus
agggacgcactaggcacccgacttt

SEQ ID NO: 471590 - DNA, 25 bp, Rattus norvegicus
ccgtgtcctgcgatgcgcatgctct

SEQ ID NO: 471591 - DNA, 25 bp, Rattus norvegicus
actggctgcggactcttcttcccaa

SEQ ID NO: 471592 - DNA, 25 bp, Rattus norvegicus
gacaacgttgatgctttcatgaaca

SEQ ID NO: 471593 - DNA, 25 bp, Rattus norvegicus
gaggacgcatcgacaacgttgatgc

SEQ ID NO: 471594 - DNA, 25 bp, Rattus norvegicus
gctttcatgaacatccgtctggcca

SEQ ID NO: 471595 - DNA, 25 bp, Rattus norvegicus
atccgtctggccaatgtcacctaca

SEQ ID NO: 471596 - DNA, 25 bp, Rattus norvegicus
atgtcacctacaccgaccgctgggg

SEQ ID NO: 471597 - DNA, 25 bp, Rattus norvegicus
tcaggttgagttggatgaccttttc

SEQ ID NO: 471598 - DNA, 25 bp, Rattus norvegicus
ccttttcgtgacaggtcgtaatgtc

SEQ ID NO: 471599 - DNA, 25 bp, Rattus norvegicus
tcgtaatgtccgatatgtccatatc

SEQ ID NO: 471600 - DNA, 25 bp, Rattus norvegicus
gtccatatcccagacggtgtgaaca

SEQ ID NO: 471601 - DNA, 25 bp, Rattus norvegicus
ggtgtgaacatcactgccacaatcg

SEQ ID NO: 471602 - DNA, 25 bp, Rattus norvegicus
gccacaatcgagcagcagctacaga

SEQ ID NO: 471603 - DNA, 25 bp, Rattus norvegicus
tcatccaccgtgtgcgcaactttgg

SEQ ID NO: 471604 - DNA, 25 bp, Rattus norvegicus
cgcaactttggtggcaagggtcaag

SEQ ID NO: 471605 - DNA, 25 bp, Rattus norvegicus
gcagctacagatcatccaccgtgtg

SEQ ID NO: 471606 - DNA, 25 bp, Rattus norvegicus
ctgtccaatcgctttacagattttg

SEQ ID NO: 471607 - DNA, 25 bp, Rattus norvegicus
gattttgactcagactccacccaga

SEQ ID NO: 471608 - DNA, 25 bp, Rattus norvegicus
ccacccagaaccaattggcgatcta

SEQ ID NO: 471609 - DNA, 25 bp, Rattus norvegicus
gcgatctaatctgtgccgcctgcct

SEQ ID NO: 471610 - DNA, 25 bp, Rattus norvegicus
acggtttccgcccatcctgaagatg

SEQ ID NO: 471611 - DNA, 25 bp, Rattus norvegicus
ccagtcagcgaagcacccggcgttt

SEQ ID NO: 471612 - DNA, 25 bp, Rattus norvegicus
actatgggcaagcagcgctgatccc

SEQ ID NO: 471613 - DNA, 25 bp, Rattus norvegicus
gacctgcgcgaccagaatggccata

SEQ ID NO: 471614 - DNA, 25 bp, Rattus norvegicus
gaatggccatagtgaattcctcctc

SEQ ID NO: 471615 - DNA, 25 bp, Rattus norvegicus
tcgactgccaggagccttggtcttc

SEQ ID NO: 471616 - DNA, 25 bp, Rattus norvegicus
ggtcttcgccgcagccctgggaaat

SEQ ID NO: 471617 - DNA, 25 bp, Rattus norvegicus
ctgggaaatgggcactgcccgcctt

SEQ ID NO: 471618 - DNA, 25 bp, Rattus norvegicus
ggcctatgcgtcacttccgttgtca

SEQ ID NO: 471619 - DNA, 25 bp, Rattus norvegicus
ccagtctcactgtagatgtagatta

SEQ ID NO: 471620 - DNA, 25 bp, Rattus norvegicus
ggatgaggacaccatgaccaggctg

SEQ ID NO: 471621 - DNA, 25 bp, Rattus norvegicus
gggaccctcgcagtagcaccctaga

SEQ ID NO: 471622 - DNA, 25 bp, Rattus norvegicus
tgctgctgaccctatgcctgctggt

SEQ ID NO: 471623 - DNA, 25 bp, Rattus norvegicus
cctctacttcgtgcttggcgtctgc

SEQ ID NO: 471624 - DNA, 25 bp, Rattus norvegicus
ccagatgggatgactccagcctgtc

SEQ ID NO: 471625 - DNA, 25 bp, Rattus norvegicus
caagcctaactagaccctggatttc

SEQ ID NO: 471626 - DNA, 25 bp, Rattus norvegicus
gggcacggagctcgtccatcataac

SEQ ID NO: 471627 - DNA, 25 bp, Rattus norvegicus
agggccaggagctgtccacagaacc

SEQ ID NO: 471628 - DNA, 25 bp, Rattus norvegicus
atctgtgaccaagtgaggcgctccc

SEQ ID NO: 471629 - DNA, 25 bp, Rattus norvegicus
tggagctactcagcaacagccttgc

SEQ ID NO: 471630 - DNA, 25 bp, Rattus norvegicus
cagcctatgcgcacatccgaggtga

SEQ ID NO: 471631 - DNA, 25 bp, Rattus norvegicus
cgtgaacgaatcctgcgggagatct

SEQ ID NO: 471632 - DNA, 25 bp, Rattus norvegicus
aggacctgacctgggtaacctcgca

SEQ ID NO: 471633 - DNA, 25 bp, Rattus norvegicus
gcgtcaatgtcttcacgtcagcaga

SEQ ID NO: 471634 - DNA, 25 bp, Rattus norvegicus
ggacccacttggacacgccactggg

SEQ ID NO: 471635 - DNA, 25 bp, Rattus norvegicus
gctggagcaagcctcgggttctcac

SEQ ID NO: 471636 - DNA, 25 bp, Rattus norvegicus
agcagaccggagattacagcttccg

SEQ ID NO: 471637 - DNA, 25 bp, Rattus norvegicus
cggaagttccggctcgaaaagcaga

SEQ ID NO: 471638 - DNA, 25 bp, Rattus norvegicus
tctcatgtgcaagacggaagttccg

SEQ ID NO: 471639 - DNA, 25 bp, Rattus norvegicus
cggaagcgtccgttctttaatacag

SEQ ID NO: 471640 - DNA, 25 bp, Rattus norvegicus
gtagcagctcgcagtgattctccgc

SEQ ID NO: 471641 - DNA, 25 bp, Rattus norvegicus
cgccgacgttgagacggacccactt

SEQ ID NO: 471642 - DNA, 25 bp, Rattus norvegicus
gaaagacttcgggtcccggcacagc

SEQ ID NO: 471643 - DNA, 25 bp, Rattus norvegicus
tccgcctggcacaagcggtacagga

SEQ ID NO: 471644 - DNA, 25 bp, Rattus norvegicus
tgtccgaatctaggtcggggtccgc

SEQ ID NO: 471645 - DNA, 25 bp, Rattus norvegicus
gaggccctcaccttgtccgaatcta

SEQ ID NO: 471646 - DNA, 25 bp, Rattus norvegicus
cccaggacgctaggctgagtatgtc

SEQ ID NO: 471647 - DNA, 25 bp, Rattus norvegicus
gattctccgccatgatcctaacaag

SEQ ID NO: 471648 - DNA, 25 bp, Rattus norvegicus
cgctggagactcctagcaacttttc

SEQ ID NO: 471649 - DNA, 25 bp, Rattus norvegicus
tctcctcatagagcgcgggattttc

SEQ ID NO: 471650 - DNA, 25 bp, Rattus norvegicus
ttagcgtcacggctggactccatca

SEQ ID NO: 471651 - DNA, 25 bp, Rattus norvegicus
ccatcaataatgcaacgccgagttc

SEQ ID NO: 471652 - DNA, 25 bp, Rattus norvegicus
ccagggagagcacgcttctcgatgc

SEQ ID NO: 471653 - DNA, 25 bp, Rattus norvegicus
tctcgatgctcattggccgatttcc

SEQ ID NO: 471654 - DNA, 25 bp, Rattus norvegicus
cccaaagcagtagcgcgcagccaag

SEQ ID NO: 471655 - DNA, 25 bp, Rattus norvegicus
cccaaggaccgcaagaagatccagt

SEQ ID NO: 471656 - DNA, 25 bp, Rattus norvegicus
aagatccagttctctgtgcccgcgc

SEQ ID NO: 471657 - DNA, 25 bp, Rattus norvegicus
gcacagtcccgcctgtccaatgttg

SEQ ID NO: 471658 - DNA, 25 bp, Rattus norvegicus
tccaatgttggacccagcctgagct

SEQ ID NO: 471659 - DNA, 25 bp, Rattus norvegicus
cagcctgagctatagcgggacgccc

SEQ ID NO: 471660 - DNA, 25 bp, Rattus norvegicus
cccacaggacgcgaagttcgctgga

SEQ ID NO: 471661 - DNA, 25 bp, Rattus norvegicus
ccggacctttgagccgatcttgggc

SEQ ID NO: 471662 - DNA, 25 bp, Rattus norvegicus
ggcggccacagccactttataatta

SEQ ID NO: 471663 - DNA, 25 bp, Rattus norvegicus
acccggacacccaggacaatgagga

SEQ ID NO: 471664 - DNA, 25 bp, Rattus norvegicus
ctggaagagcggatcgcagatgcca

SEQ ID NO: 471665 - DNA, 25 bp, Rattus norvegicus
actcacgctgccgttgttcagatgg

SEQ ID NO: 471666 - DNA, 25 bp, Rattus norvegicus
cagatgccactctgcaagagaaata

SEQ ID NO: 471667 - DNA, 25 bp, Rattus norvegicus
cttggggcaaagtcactcacgctgc

SEQ ID NO: 471668 - DNA, 25 bp, Rattus norvegicus
cacgggcgacttggggcaaagtcac

SEQ ID NO: 471669 - DNA, 25 bp, Rattus norvegicus
aacaggagacggtcgccaaggcacg

SEQ ID NO: 471670 - DNA, 25 bp, Rattus norvegicus
gacgatcgcatgcaacgagggaaca

SEQ ID NO: 471671 - DNA, 25 bp, Rattus norvegicus
cccgagaaagttggacgatcgcatg

SEQ ID NO: 471672 - DNA, 25 bp, Rattus norvegicus
ggctgcagctgacgcaggccctacg

SEQ ID NO: 471673 - DNA, 25 bp, Rattus norvegicus
ttgcttagggcaagattctggagcg

SEQ ID NO: 471674 - DNA, 25 bp, Rattus norvegicus
gattctggagcgaacactggagttc

SEQ ID NO: 471675 - DNA, 25 bp, Rattus norvegicus
cgttgttcagatggcgcaggtagct

SEQ ID NO: 471676 - DNA, 25 bp, Rattus norvegicus
tccgtctgcgcacggtatctggcca

SEQ ID NO: 471677 - DNA, 25 bp, Rattus norvegicus
tgggactcagtacaaggcccgaggc

SEQ ID NO: 471678 - DNA, 25 bp, Rattus norvegicus
gggccttacctgcaccaggcgcttg

SEQ ID NO: 471679 - DNA, 25 bp, Rattus norvegicus
caccaggcgcttggggaagagacca

SEQ ID NO: 471680 - DNA, 25 bp, Rattus norvegicus
acggcacacacctgctggatcacgt

SEQ ID NO: 471681 - DNA, 25 bp, Rattus norvegicus
gggaatgctgcccttcggaaagttg

SEQ ID NO: 471682 - DNA, 25 bp, Rattus norvegicus
tgcccttcggaaagttgggtacaga

SEQ ID NO: 471683 - DNA, 25 bp, Rattus norvegicus
cccatgatttctggggcgccctgca

SEQ ID NO: 471684 - DNA, 25 bp, Rattus norvegicus
ctgcacagcctgaccgtcagacttg

SEQ ID NO: 471685 - DNA, 25 bp, Rattus norvegicus
attgtacttcgagccaatcagaggg

SEQ ID NO: 471686 - DNA, 25 bp, Rattus norvegicus
aatctcctgggaaaatcacgtgggg

SEQ ID NO: 471687 - DNA, 25 bp, Rattus norvegicus
ccgtcagacttggtattggtgcgcg

SEQ ID NO: 471688 - DNA, 25 bp, Rattus norvegicus
ccctcgagcggagcattgtacttcg

SEQ ID NO: 471689 - DNA, 25 bp, Rattus norvegicus
gcctcgggaatctcctgggaaaatc

SEQ ID NO: 471690 - DNA, 25 bp, Rattus norvegicus
tcggtctgctacctcctgggaaatg

SEQ ID NO: 471691 - DNA, 25 bp, Rattus norvegicus
agccgatcgaggaggcccgctcaga

SEQ ID NO: 471692 - DNA, 25 bp, Rattus norvegicus
catcagctgcgttcactcaccttga

SEQ ID NO: 471693 - DNA, 25 bp, Rattus norvegicus
gttcactcaccttgaccggccgaag

SEQ ID NO: 471694 - DNA, 25 bp, Rattus norvegicus
accggccgaagcgactacagctgca

SEQ ID NO: 471695 - DNA, 25 bp, Rattus norvegicus
tgcagtctcgcaacggcacaaccgg

SEQ ID NO: 471696 - DNA, 25 bp, Rattus norvegicus
ggaaatgtagtcctatgctcctctc

SEQ ID NO: 471697 - DNA, 25 bp, Rattus norvegicus
caaagcaaagcgagcgttgggccca

SEQ ID NO: 471698 - DNA, 25 bp, Rattus norvegicus
agcgttgggcccaccgctttgcgtc

SEQ ID NO: 471699 - DNA, 25 bp, Rattus norvegicus
cgctttgcgtcacgcgcccgaagat

SEQ ID NO: 471700 - DNA, 25 bp, Rattus norvegicus
cacagaagtgtgcaagagagaaggc

SEQ ID NO: 471701 - DNA, 25 bp, Rattus norvegicus
aagatcggcgatcacgtgggcagct

SEQ ID NO: 471702 - DNA, 25 bp, Rattus norvegicus
tcacgcgcccgaagatcggcgatca

SEQ ID NO: 471703 - DNA, 25 bp, Rattus norvegicus
ctacagctgcagtctcgcaacggca

SEQ ID NO: 471704 - DNA, 25 bp, Rattus norvegicus
ctgcccgggcccttgtggggcgtct

SEQ ID NO: 471705 - DNA, 25 bp, Rattus norvegicus
actccgagccaggaaggagagggtg

SEQ ID NO: 471706 - DNA, 25 bp, Rattus norvegicus
ctgcgactccgagccaggaaggaga

SEQ ID NO: 471707 - DNA, 25 bp, Rattus norvegicus
cgctgcgactccgagccaggaagga

SEQ ID NO: 471708 - DNA, 25 bp, Rattus norvegicus
cgcgctgcgactccgagccaggaag

SEQ ID NO: 471709 - DNA, 25 bp, Rattus norvegicus
ggtccctgccgttgcggggcagtgt

SEQ ID NO: 471710 - DNA, 25 bp, Rattus norvegicus
cggctgcagagggatgagtgcggtc

SEQ ID NO: 471711 - DNA, 25 bp, Rattus norvegicus
cgggcacactggcacggctgcagag

SEQ ID NO: 471712 - DNA, 25 bp, Rattus norvegicus
cgagcgcgggcacactggcacggct

SEQ ID NO: 471713 - DNA, 25 bp, Rattus norvegicus
ctccgaggggcgctacaaggcgtca

SEQ ID NO: 471714 - DNA, 25 bp, Rattus norvegicus
cggggtgcagcggtgcgcgctccga

SEQ ID NO: 471715 - DNA, 25 bp, Rattus norvegicus
cttccagccggcgacgcaccagtgc

SEQ ID NO: 471716 - DNA, 25 bp, Rattus norvegicus
cgacgcaccagtgcggggctgccac

SEQ ID NO: 471717 - DNA, 25 bp, Rattus norvegicus
cggggcagtgtgaccgcgctgcgac

SEQ ID NO: 471718 - DNA, 25 bp, Rattus norvegicus
acgagggcctagcttcggtatgcat

SEQ ID NO: 471719 - DNA, 25 bp, Rattus norvegicus
atgcatggttccagacctgagaatc

SEQ ID NO: 471720 - DNA, 25 bp, Rattus norvegicus
ggctaaggtcacacgtgcccacgga

SEQ ID NO: 471721 - DNA, 25 bp, Rattus norvegicus
cctgcgatgcagcacggagaaactc

SEQ ID NO: 471722 - DNA, 25 bp, Rattus norvegicus
cgcagttatggagtacggagccaca

SEQ ID NO: 471723 - DNA, 25 bp, Rattus norvegicus
cagctgtcagaagatgcgtccgtgg

SEQ ID NO: 471724 - DNA, 25 bp, Rattus norvegicus
gggcctggcctctgtgaatgtacca

SEQ ID NO: 471725 - DNA, 25 bp, Rattus norvegicus
gcgaccgcgattctgctgctttgcc

SEQ ID NO: 471726 - DNA, 25 bp, Rattus norvegicus
gtaaagctcagagtagccggctacc

SEQ ID NO: 471727 - DNA, 25 bp, Rattus norvegicus
tcgaggccggtagctagtaaagctc

SEQ ID NO: 471728 - DNA, 25 bp, Rattus norvegicus
tcccgttctcttgtgtggctcccgg

SEQ ID NO: 471729 - DNA, 25 bp, Rattus norvegicus
cccacggaggatggagaagacagca

SEQ ID NO: 471730 - DNA, 25 bp, Rattus norvegicus
tccagctcagtaaaagaggatcttc

SEQ ID NO: 471731 - DNA, 25 bp, Rattus norvegicus
aaacttctaagtggtcagagggcgc

SEQ ID NO: 471732 - DNA, 25 bp, Rattus norvegicus
tggaacaaccggatgctgtagtctg

SEQ ID NO: 471733 - DNA, 25 bp, Rattus norvegicus
ctgtagtctgattttggtcggcgga

SEQ ID NO: 471734 - DNA, 25 bp, Rattus norvegicus
tctgattttggtcggcggaaccaca

SEQ ID NO: 471735 - DNA, 25 bp, Rattus norvegicus
gggccggtcagtcctagactctgag

SEQ ID NO: 471736 - DNA, 25 bp, Rattus norvegicus
tcagtcctagactctgaggggccgc

SEQ ID NO: 471737 - DNA, 25 bp, Rattus norvegicus
cggctgggttgaatcggcttctccc

SEQ ID NO: 471738 - DNA, 25 bp, Rattus norvegicus
cagcactgagcggtgggcaccatgt

SEQ ID NO: 471739 - DNA, 25 bp, Rattus norvegicus
ggcaccatgtcgaggcaggcgaacc

SEQ ID NO: 471740 - DNA, 25 bp, Rattus norvegicus
caggcgaaccgtggcaccgagagca

SEQ ID NO: 471741 - DNA, 25 bp, Rattus norvegicus
ccgtggcaccgagagcaagaaaatg

SEQ ID NO: 471742 - DNA, 25 bp, Rattus norvegicus
ccgagagcaagaaaatggtaactga

SEQ ID NO: 471743 - DNA, 25 bp, Rattus norvegicus
aatggtaactgagcgcgtgacccgg

SEQ ID NO: 471744 - DNA, 25 bp, Rattus norvegicus
ggacctgcagctctcgctgaacaac

SEQ ID NO: 471745 - DNA, 25 bp, Rattus norvegicus
tctcgctgaacaacgggtgggactt

SEQ ID NO: 471746 - DNA, 25 bp, Rattus norvegicus
ccgacgacgtcccagcccagagcct

SEQ ID NO: 471747 - DNA, 25 bp, Rattus norvegicus
cagagcgacgcggagctctggcggc

SEQ ID NO: 471748 - DNA, 25 bp, Rattus norvegicus
gcccggaggccgccctgcaggtaaa

SEQ ID NO: 471749 - DNA, 25 bp, Rattus norvegicus
tgttccctaggccagcagccgtcta

SEQ ID NO: 471750 - DNA, 25 bp, Rattus norvegicus
tctagggcagaggtccgcggagctc

SEQ ID NO: 471751 - DNA, 25 bp, Rattus norvegicus
ggcgcacacccttggctgtggctgt

SEQ ID NO: 471752 - DNA, 25 bp, Rattus norvegicus
cctaggccagcagccgtctagggca

SEQ ID NO: 471753 - DNA, 25 bp, Rattus norvegicus
tttgcagcgccggtgttccctaggc

SEQ ID NO: 471754 - DNA, 25 bp, Rattus norvegicus
atccgggtccccttcgagcgctgga

SEQ ID NO: 471755 - DNA, 25 bp, Rattus norvegicus
cctgcaggtaaaggtgggcagcgtt

SEQ ID NO: 471756 - DNA, 25 bp, Rattus norvegicus
gatgcagccaggtgtccagctccga

SEQ ID NO: 471757 - DNA, 25 bp, Rattus norvegicus
cccagtgcaaggacaggacgtagag

SEQ ID NO: 471758 - DNA, 25 bp, Rattus norvegicus
caaggacaggacgtagaggcgactc

SEQ ID NO: 471759 - DNA, 25 bp, Rattus norvegicus
ggagctccgaggctgctagcccgct

SEQ ID NO: 471760 - DNA, 25 bp, Rattus norvegicus
gtcgtcctgtaaactccttggctcc

SEQ ID NO: 471761 - DNA, 25 bp, Rattus norvegicus
ctcagctcctagtgctgtaaaaccc

SEQ ID NO: 471762 - DNA, 25 bp, Rattus norvegicus
tccttggctcctgcggcagtagcag

SEQ ID NO: 471763 - DNA, 25 bp, Rattus norvegicus
cctcccgacgcagggtgcccttgcc

SEQ ID NO: 471764 - DNA, 25 bp, Rattus norvegicus
cggcttctcctgcaggtgacctcag

SEQ ID NO: 471765 - DNA, 25 bp, Rattus norvegicus
gtgacctcagctcctagtgctgtaa

SEQ ID NO: 471766 - DNA, 25 bp, Rattus norvegicus
cccggcccaagtcggaagcagcttt

SEQ ID NO: 471767 - DNA, 25 bp, Rattus norvegicus
ggcccaagtcggaagcagctttttc

SEQ ID NO: 471768 - DNA, 25 bp, Rattus norvegicus
ggaagcagctttttctcatttgtga

SEQ ID NO: 471769 - DNA, 25 bp, Rattus norvegicus
aaactccttggctcctgcggcagta

SEQ ID NO: 471770 - DNA, 25 bp, Rattus norvegicus
tgtgaactatctcgcctcgctgcct

SEQ ID NO: 471771 - DNA, 25 bp, Rattus norvegicus
aatcttggccggctggagcgacagc

SEQ ID NO: 471772 - DNA, 25 bp, Rattus norvegicus
agccgcgaggcccaggaatcttggc

SEQ ID NO: 471773 - DNA, 25 bp, Rattus norvegicus
ctcatttgtgaactatctcgcctcg

SEQ ID NO: 471774 - DNA, 25 bp, Rattus norvegicus
ctgacttggacgaaatggtgtttta

SEQ ID NO: 471775 - DNA, 25 bp, Rattus norvegicus
gggaaatcctcgttaaggacttgca

SEQ ID NO: 471776 - DNA, 25 bp, Rattus norvegicus
cacgcgtcccacctccgaggctccg

SEQ ID NO: 471777 - DNA, 25 bp, Rattus norvegicus
tgaatcagcgtctcctgcacgcgtc

SEQ ID NO: 471778 - DNA, 25 bp, Rattus norvegicus
agctgtccaaacacggcgtctgtcc

SEQ ID NO: 471779 - DNA, 25 bp, Rattus norvegicus
aatggtgttttacggcgatttgttg

SEQ ID NO: 471780 - DNA, 25 bp, Rattus norvegicus
ccaaaacgctgacttggacgaaatg

SEQ ID NO: 471781 - DNA, 25 bp, Rattus norvegicus
agccagtctcctccgcctctgggag

SEQ ID NO: 471782 - DNA, 25 bp, Rattus norvegicus
aacacacctgggacgcgaccctggg

SEQ ID NO: 471783 - DNA, 25 bp, Rattus norvegicus
agcgggaacacacctgggacgcgac

SEQ ID NO: 471784 - DNA, 25 bp, Rattus norvegicus
caccacggactaggcggcttggtca

SEQ ID NO: 471785 - DNA, 25 bp, Rattus norvegicus
tccgcaccacggactaggcggcttg

SEQ ID NO: 471786 - DNA, 25 bp, Rattus norvegicus
tcctcgttaaggacttgcagctgtc

SEQ ID NO: 471787 - DNA, 25 bp, Rattus norvegicus
cttgcagctgtccaaacacggcgtc

SEQ ID NO: 471788 - DNA, 25 bp, Rattus norvegicus
cacgcgggatctggctctagccaag

SEQ ID NO: 471789 - DNA, 25 bp, Rattus norvegicus
catcgggccagcatctttagaaagc

SEQ ID NO: 471790 - DNA, 25 bp, Rattus norvegicus
tttagaaagctggtcacgacggagc

SEQ ID NO: 471791 - DNA, 25 bp, Rattus norvegicus
cgaggtttgtgctctgatagtggac

SEQ ID NO: 471792 - DNA, 25 bp, Rattus norvegicus
tggacatggctggagacctactacc

SEQ ID NO: 471793 - DNA, 25 bp, Rattus norvegicus
aacccggttgcagaggccttcactt

SEQ ID NO: 471794 - DNA, 25 bp, Rattus norvegicus
gacggtatcgtgtgcctcgaagaca

SEQ ID NO: 471795 - DNA, 25 bp, Rattus norvegicus
tcacttcggcagcttcgtgtacgcg

SEQ ID NO: 471796 - DNA, 25 bp, Rattus norvegicus
atgctgcggccaccttaatcgtctc

SEQ ID NO: 471797 - DNA, 25 bp, Rattus norvegicus
cttgtggcctggagtctcagcctac

SEQ ID NO: 471798 - DNA, 25 bp, Rattus norvegicus
cgagtactcgcacgcttcgctttgg

SEQ ID NO: 471799 - DNA, 25 bp, Rattus norvegicus
cgggcagacagctccctaaagtctc

SEQ ID NO: 471800 - DNA, 25 bp, Rattus norvegicus
tctggctccaggctctgaacgtgac

SEQ ID NO: 471801 - DNA, 25 bp, Rattus norvegicus
ctgaacgtgactcaggacagacgtc

SEQ ID NO: 471802 - DNA, 25 bp, Rattus norvegicus
ccgaagagttgcctggtcgtggagc

SEQ ID NO: 471803 - DNA, 25 bp, Rattus norvegicus
ctgggagatctccttccgctccgaa

SEQ ID NO: 471804 - DNA, 25 bp, Rattus norvegicus
cctggtcgtggagctggactgcgac

SEQ ID NO: 471805 - DNA, 25 bp, Rattus norvegicus
tggtgacatgaagcaggtgggtcct

SEQ ID NO: 471806 - DNA, 25 bp, Rattus norvegicus
ggtcctgcagcggtcgctgggaccg

SEQ ID NO: 471807 - DNA, 25 bp, Rattus norvegicus
tggtggtacgagagctgtctctacc

SEQ ID NO: 471808 - DNA, 25 bp, Rattus norvegicus
tggtacgagagctgtctctacccga

SEQ ID NO: 471809 - DNA, 25 bp, Rattus norvegicus
tacgagagctgtctctacccgacta

SEQ ID NO: 471810 - DNA, 25 bp, Rattus norvegicus
gagagctgtctctacccgactaatc

SEQ ID NO: 471811 - DNA, 25 bp, Rattus norvegicus
agagctgtctctacccgactaatcc

SEQ ID NO: 471812 - DNA, 25 bp, Rattus norvegicus
tacccgactaatcccgcttccctgc

SEQ ID NO: 471813 - DNA, 25 bp, Rattus norvegicus
atcccgcttccctgcccggtgtccg

SEQ ID NO: 471814 - DNA, 25 bp, Rattus norvegicus
gctgggagatctccttccgctccga

SEQ ID NO: 471815 - DNA, 25 bp, Rattus norvegicus
ctggactgcgactgaagcaggaaga

SEQ ID NO: 471816 - DNA, 25 bp, Rattus norvegicus
tccaggtctgcagttcgcctcaagc

SEQ ID NO: 471817 - DNA, 25 bp, Rattus norvegicus
aacttgcgtcgcctacagctgctga

SEQ ID NO: 471818 - DNA, 25 bp, Rattus norvegicus
gccctgcgggagcaacctttaagga

SEQ ID NO: 471819 - DNA, 25 bp, Rattus norvegicus
ctgaggcgatgtcgctgccagcccg

SEQ ID NO: 471820 - DNA, 25 bp, Rattus norvegicus
acagtcctgaggtgaggacgctgaa

SEQ ID NO: 471821 - DNA, 25 bp, Rattus norvegicus
ggtccggaacttgcgtcgcctacag

SEQ ID NO: 471822 - DNA, 25 bp, Rattus norvegicus
gatcgcgccgggctctccaggtctg

SEQ ID NO: 471823 - DNA, 25 bp, Rattus norvegicus
ttcgcctcaagcaaaagccctgcgg

SEQ ID NO: 471824 - DNA, 25 bp, Rattus norvegicus
cacccgctgtgcctgacggtgacaa

SEQ ID NO: 471825 - DNA, 25 bp, Rattus norvegicus
tgtgcctgacggtgacaatcccgag

SEQ ID NO: 471826 - DNA, 25 bp, Rattus norvegicus
caatcccgagcgagaggccagcttt

SEQ ID NO: 471827 - DNA, 25 bp, Rattus norvegicus
agcgagaggccagctttcccggcgc

SEQ ID NO: 471828 - DNA, 25 bp, Rattus norvegicus
actgctgcctgaggcgatgtcgctg

SEQ ID NO: 471829 - DNA, 25 bp, Rattus norvegicus
cgctgaagccgggtccggaacttgc

SEQ ID NO: 471830 - DNA, 25 bp, Rattus norvegicus
gaatccgctacaacggcgcccgatt

SEQ ID NO: 471831 - DNA, 25 bp, Rattus norvegicus
ccttggacttctcgtggaggacatt

SEQ ID NO: 471832 - DNA, 25 bp, Rattus norvegicus
cgcgactggcgctaaggccgcctta

SEQ ID NO: 471833 - DNA, 25 bp, Rattus norvegicus
cccgagtagagatggtagagcaccc

SEQ ID NO: 471834 - DNA, 25 bp, Rattus norvegicus
ccgcccaggccgaagaggctgaagc

SEQ ID NO: 471835 - DNA, 25 bp, Rattus norvegicus
aggacattgctctcgcggactcgtc

SEQ ID NO: 471836 - DNA, 25 bp, Rattus norvegicus
acgtcgccgctggtcatcttatcct

SEQ ID NO: 471837 - DNA, 25 bp, Rattus norvegicus
acatcttgcggttggacagcacgtc

SEQ ID NO: 471838 - DNA, 25 bp, Rattus norvegicus
ggccgtcttgagcaggtaaaacatc

SEQ ID NO: 471839 - DNA, 25 bp, Rattus norvegicus
ccagcacctacctgcacgttgggga

SEQ ID NO: 471840 - DNA, 25 bp, Rattus norvegicus
cacattacgtcggtgtctcggaacc

SEQ ID NO: 471841 - DNA, 25 bp, Rattus norvegicus
cagtccgcgtgtgcatgaccttgca

SEQ ID NO: 471842 - DNA, 25 bp, Rattus norvegicus
cccgagtggaaaagccacaagctcc

SEQ ID NO: 471843 - DNA, 25 bp, Rattus norvegicus
cgcccgcccacaaacagggagagga

SEQ ID NO: 471844 - DNA, 25 bp, Rattus norvegicus
gtacctcgcacttgcactgctcggg

SEQ ID NO: 471845 - DNA, 25 bp, Rattus norvegicus
tacctgctcccgagggtcccgcttc

SEQ ID NO: 471846 - DNA, 25 bp, Rattus norvegicus
ttccatcccatatacccgtgcggag

SEQ ID NO: 471847 - DNA, 25 bp, Rattus norvegicus
ccatatacccgtgcggaggacaggc

SEQ ID NO: 471848 - DNA, 25 bp, Rattus norvegicus
gcctaggtacctcgcacttgcactg

SEQ ID NO: 471849 - DNA, 25 bp, Rattus norvegicus
ctgctagcgcccgagtagctgccag

SEQ ID NO: 471850 - DNA, 25 bp, Rattus norvegicus
cgcccgagtagctgccagtgcgcag

SEQ ID NO: 471851 - DNA, 25 bp, Rattus norvegicus
tcaagcggggcgctcgacggcaaca

SEQ ID NO: 471852 - DNA, 25 bp, Rattus norvegicus
cgctcgacggcaacaaaggccaatg

SEQ ID NO: 471853 - DNA, 25 bp, Rattus norvegicus
cgacggcaacaaaggccaatggaga

SEQ ID NO: 471854 - DNA, 25 bp, Rattus norvegicus
cctggcggccacttgtggccgtgca

SEQ ID NO: 471855 - DNA, 25 bp, Rattus norvegicus
ccacttgtggccgtgcagcctggcg

SEQ ID NO: 471856 - DNA, 25 bp, Rattus norvegicus
gctccagtggcggaaccgtgcagtg

SEQ ID NO: 471857 - DNA, 25 bp, Rattus norvegicus
tgaggggcctaggtacctcgcactt

SEQ ID NO: 471858 - DNA, 25 bp, Rattus norvegicus
tcccttagacgtcctcgtgaccagt

SEQ ID NO: 471859 - DNA, 25 bp, Rattus norvegicus
gtgcaccggacacacggtcccattt

SEQ ID NO: 471860 - DNA, 25 bp, Rattus norvegicus
cacggtcccatttgagatcccagtc

SEQ ID NO: 471861 - DNA, 25 bp, Rattus norvegicus
tgagatcccagtcagcctcgctgcg

SEQ ID NO: 471862 - DNA, 25 bp, Rattus norvegicus
gctgcgaccgtggacagcgatccaa

SEQ ID NO: 471863 - DNA, 25 bp, Rattus norvegicus
tccaaggtccggaccggtctgtcca

SEQ ID NO: 471864 - DNA, 25 bp, Rattus norvegicus
tcttgagcttccctcccttagacgt

SEQ ID NO: 471865 - DNA, 25 bp, Rattus norvegicus
gtcctcgtgaccagtcctgaacaga

SEQ ID NO: 471866 - DNA, 25 bp, Rattus norvegicus
agtcctgaacagacccacagtcttc

SEQ ID NO: 471867 - DNA, 25 bp, Rattus norvegicus
acccacagtcttcagctggggcgcg

SEQ ID NO: 471868 - DNA, 25 bp, Rattus norvegicus
agggcatggggctccttccttccct

SEQ ID NO: 471869 - DNA, 25 bp, Rattus norvegicus
cgcgtaacgcttgctctccggaata

SEQ ID NO: 471870 - DNA, 25 bp, Rattus norvegicus
tctccggaatattggcgctgaagcg

SEQ ID NO: 471871 - DNA, 25 bp, Rattus norvegicus
gggactcgggtcacctcttgagctt

SEQ ID NO: 471872 - DNA, 25 bp, Rattus norvegicus
ccaacgaggttgagcgctgtaccgc

SEQ ID NO: 471873 - DNA, 25 bp, Rattus norvegicus
gcgcttcctgattggcagggcgata

SEQ ID NO: 471874 - DNA, 25 bp, Rattus norvegicus
tcctccctcggattggtgcaaacca

SEQ ID NO: 471875 - DNA, 25 bp, Rattus norvegicus
gccctgctctttggcgcgtttcctg

SEQ ID NO: 471876 - DNA, 25 bp, Rattus norvegicus
tcggcttgttactgcagcgcgccct

SEQ ID NO: 471877 - DNA, 25 bp, Rattus norvegicus
cacagcttatggttcggtggcacgc

SEQ ID NO: 471878 - DNA, 25 bp, Rattus norvegicus
gcgctcggtcctcacagcttatggt

SEQ ID NO: 471879 - DNA, 25 bp, Rattus norvegicus
agggtctcccattaggcttcccgcg

SEQ ID NO: 471880 - DNA, 25 bp, Rattus norvegicus
ggttcctcttgagggtctcccatta

SEQ ID NO: 471881 - DNA, 25 bp, Rattus norvegicus
cgtgcaccgctctgagaccactgga

SEQ ID NO: 471882 - DNA, 25 bp, Rattus norvegicus
gcgccgagccgaaaggactacagtt

SEQ ID NO: 471883 - DNA, 25 bp, Rattus norvegicus
atcatgaccggcgaggtggattctg

SEQ ID NO: 471884 - DNA, 25 bp, Rattus norvegicus
aagctcgaacttcgctgccgggctg

SEQ ID NO: 471885 - DNA, 25 bp, Rattus norvegicus
agctgtcgctggcaagtcaaggtta

SEQ ID NO: 471886 - DNA, 25 bp, Rattus norvegicus
ctagaaggctctcgggtcaagccgc

SEQ ID NO: 471887 - DNA, 25 bp, Rattus norvegicus
ccaggaaggagttatttcgtcgcta

SEQ ID NO: 471888 - DNA, 25 bp, Rattus norvegicus
tttcgtcgctatgtctacagcagga

SEQ ID NO: 471889 - DNA, 25 bp, Rattus norvegicus
tctacagcaggaaaaacgatggatc

SEQ ID NO: 471890 - DNA, 25 bp, Rattus norvegicus
aaaaacgatggatcggtggcgccta

SEQ ID NO: 471891 - DNA, 25 bp, Rattus norvegicus
cctagccagagtggttaggagatga

SEQ ID NO: 471892 - DNA, 25 bp, Rattus norvegicus
acggctgtgccaggaccaggcagcc

SEQ ID NO: 471893 - DNA, 25 bp, Rattus norvegicus
ctagccactgagaaacccaggaagg

SEQ ID NO: 471894 - DNA, 25 bp, Rattus norvegicus
cagttcctgcgcggagaaccgaacc

SEQ ID NO: 471895 - DNA, 25 bp, Rattus norvegicus
tgacaccggacctagaaggctctcg

SEQ ID NO: 471896 - DNA, 25 bp, Rattus norvegicus
accgaaccggcccacgtgagtcagg

SEQ ID NO: 471897 - DNA, 25 bp, Rattus norvegicus
tggttaggagatgacaccggaccta

SEQ ID NO: 471898 - DNA, 25 bp, Rattus norvegicus
aaggaccgcagcgagtgctgcagca

SEQ ID NO: 471899 - DNA, 25 bp, Rattus norvegicus
tcgccaatttcctagccactgagaa

SEQ ID NO: 471900 - DNA, 25 bp, Rattus norvegicus
aaaggagtagcctcccagagcgggc

SEQ ID NO: 471901 - DNA, 25 bp, Rattus norvegicus
tcccaacaagcatgaaaacggctcg

SEQ ID NO: 471902 - DNA, 25 bp, Rattus norvegicus
tgcctaatcccaacaagcatgaaaa

SEQ ID NO: 471903 - DNA, 25 bp, Rattus norvegicus
gagcgccttttcctgtgcctaatcc

SEQ ID NO: 471904 - DNA, 25 bp, Rattus norvegicus
gatcatcaccgtcctgagcgccttt

SEQ ID NO: 471905 - DNA, 25 bp, Rattus norvegicus
gggctgcagatcatcaccgtcctga

SEQ ID NO: 471906 - DNA, 25 bp, Rattus norvegicus
cggccctcgcacaaagccaggggtg

SEQ ID NO: 471907 - DNA, 25 bp, Rattus norvegicus
gcagacaaaggagtagcctcccaga

SEQ ID NO: 471908 - DNA, 25 bp, Rattus norvegicus
tacgttcagctgacgtttgggggtc

SEQ ID NO: 471909 - DNA, 25 bp, Rattus norvegicus
aaaacggctcggcttggccgccagc

SEQ ID NO: 471910 - DNA, 25 bp, Rattus norvegicus
tggccgccagcaggccctttgtctc

SEQ ID NO: 471911 - DNA, 25 bp, Rattus norvegicus
cgtcaccctcctcacctcagctgtc

SEQ ID NO: 471912 - DNA, 25 bp, Rattus norvegicus
cgcctccagcgcctgggcgcacaaa

SEQ ID NO: 471913 - DNA, 25 bp, Rattus norvegicus
ggctgcaccgggctgcagatcatca

SEQ ID NO: 471914 - DNA, 25 bp, Rattus norvegicus
gcataacccacagctacgtttttaa

SEQ ID NO: 471915 - DNA, 25 bp, Rattus norvegicus
cctagttcgggtgtgctgtctcact

SEQ ID NO: 471916 - DNA, 25 bp, Rattus norvegicus
gggcggtcgcatatcttgcatcaca

SEQ ID NO: 471917 - DNA, 25 bp, Rattus norvegicus
tgacgtcatcgacccgcgccaatga

SEQ ID NO: 471918 - DNA, 25 bp, Rattus norvegicus
tcgcgagagttgacgtcatcgaccc

SEQ ID NO: 471919 - DNA, 25 bp, Rattus norvegicus
tcacacacacgctctcgcgagagtt

SEQ ID NO: 471920 - DNA, 25 bp, Rattus norvegicus
tcagtgcgaagagcacccaagctca

SEQ ID NO: 471921 - DNA, 25 bp, Rattus norvegicus
gggtgcgattttatctacgtacgaa

SEQ ID NO: 471922 - DNA, 25 bp, Rattus norvegicus
ttcggaccagcctactcagcaatca

SEQ ID NO: 471923 - DNA, 25 bp, Rattus norvegicus
tgtctcactggtgaggccgcgtacc

SEQ ID NO: 471924 - DNA, 25 bp, Rattus norvegicus
ccgaacgttgcataacccacagcta

SEQ ID NO: 471925 - DNA, 25 bp, Rattus norvegicus
ggcagataaggaaaccgaacgttgc

SEQ ID NO: 471926 - DNA, 25 bp, Rattus norvegicus
gtgtgtaccttgcagcctcccgctt

SEQ ID NO: 471927 - DNA, 25 bp, Rattus norvegicus
gcctactcagcaatcagtgcgaaga

SEQ ID NO: 471928 - DNA, 25 bp, Rattus norvegicus
gacctagtcgcctagtcgtccggct

SEQ ID NO: 471929 - DNA, 25 bp, Rattus norvegicus
gcctagtcgtccggctgtccctagt

SEQ ID NO: 471930 - DNA, 25 bp, Rattus norvegicus
tcgcctagtcgtccggctgtcccta

SEQ ID NO: 471931 - DNA, 25 bp, Rattus norvegicus
gtcgcctagtcgtccggctgtccct

SEQ ID NO: 471932 - DNA, 25 bp, Rattus norvegicus
agtcgcctagtcgtccggctgtccc

SEQ ID NO: 471933 - DNA, 25 bp, Rattus norvegicus
tagtcgcctagtcgtccggctgtcc

SEQ ID NO: 471934 - DNA, 25 bp, Rattus norvegicus
ctagtcgcctagtcgtccggctgtc

SEQ ID NO: 471935 - DNA, 25 bp, Rattus norvegicus
acctagtcgcctagtcgtccggctg

SEQ ID NO: 471936 - DNA, 25 bp, Rattus norvegicus
ggacctagtcgcctagtcgtccggc

SEQ ID NO: 471937 - DNA, 25 bp, Rattus norvegicus
tggacctagtcgcctagtcgtccgg

SEQ ID NO: 471938 - DNA, 25 bp, Rattus norvegicus
atggacctagtcgcctagtcgtccg

SEQ ID NO: 471939 - DNA, 25 bp, Rattus norvegicus
gatggacctagtcgcctagtcgtcc

SEQ ID NO: 471940 - DNA, 25 bp, Rattus norvegicus
ggatggacctagtcgcctagtcgtc

SEQ ID NO: 471941 - DNA, 25 bp, Rattus norvegicus
cctagtcgcctagtcgtccggctgt

SEQ ID NO: 471942 - DNA, 25 bp, Rattus norvegicus
ccggctgtccctagtctatgtctgc

SEQ ID NO: 471943 - DNA, 25 bp, Rattus norvegicus
gcggatagacaactcctgcgcctct

SEQ ID NO: 471944 - DNA, 25 bp, Rattus norvegicus
ggacgattaccaactcctgcggata

SEQ ID NO: 471945 - DNA, 25 bp, Rattus norvegicus
agcagcccagcctggacgattacca

SEQ ID NO: 471946 - DNA, 25 bp, Rattus norvegicus
atctgcgtccaagcagcagcccagc

SEQ ID NO: 471947 - DNA, 25 bp, Rattus norvegicus
tgggctcagcaccatctgcgtccaa

SEQ ID NO: 471948 - DNA, 25 bp, Rattus norvegicus
gtaatcgggaatcgcctgggctcag

SEQ ID NO: 471949 - DNA, 25 bp, Rattus norvegicus
ggacaggcgtaatcgggaatcgcct

SEQ ID NO: 471950 - DNA, 25 bp, Rattus norvegicus
agtaccaccggctgcctgaggcggc

SEQ ID NO: 471951 - DNA, 25 bp, Rattus norvegicus
aactcctgcggatagacaactcctg

SEQ ID NO: 471952 - DNA, 25 bp, Rattus norvegicus
cctatgagtaccaccggctgcctga

SEQ ID NO: 471953 - DNA, 25 bp, Rattus norvegicus
tgctccgacctatgagtaccaccgg

SEQ ID NO: 471954 - DNA, 25 bp, Rattus norvegicus
agtctatgtctgctccgacctatga

SEQ ID NO: 471955 - DNA, 25 bp, Rattus norvegicus
tgtccctagtctatgtctgctccga

SEQ ID NO: 471956 - DNA, 25 bp, Rattus norvegicus
gagctgatggcccttgaaaaaagta

SEQ ID NO: 471957 - DNA, 25 bp, Rattus norvegicus
gggacccatgaggagccgaaaagtc

SEQ ID NO: 471958 - DNA, 25 bp, Rattus norvegicus
tggcggagacacagccctcgtccga

SEQ ID NO: 471959 - DNA, 25 bp, Rattus norvegicus
agtatgtgtgcaccaacatggggcg

SEQ ID NO: 471960 - DNA, 25 bp, Rattus norvegicus
ccatggcggagtatgtgtgcaccaa

SEQ ID NO: 471961 - DNA, 25 bp, Rattus norvegicus
acccgagattactcaccatggcgga

SEQ ID NO: 471962 - DNA, 25 bp, Rattus norvegicus
cagtgtgcccgggacccgagattac

SEQ ID NO: 471963 - DNA, 25 bp, Rattus norvegicus
ggtttggaagatccagcagccaggc

SEQ ID NO: 471964 - DNA, 25 bp, Rattus norvegicus
ctaccttcgcgatttcgttggcgca

SEQ ID NO: 471965 - DNA, 25 bp, Rattus norvegicus
gccaccaagtcctggctgccgagaa

SEQ ID NO: 471966 - DNA, 25 bp, Rattus norvegicus
ccaggctggagaccaaccacgggtc

SEQ ID NO: 471967 - DNA, 25 bp, Rattus norvegicus
tcgcgggtgtcctgcagctgtccac

SEQ ID NO: 471968 - DNA, 25 bp, Rattus norvegicus
gaaaagtcaccagccagcccgcgag

SEQ ID NO: 471969 - DNA, 25 bp, Rattus norvegicus
aactggagcggggagccctcacagc

SEQ ID NO: 471970 - DNA, 25 bp, Rattus norvegicus
aagttgtggagctgagattgcccgc

SEQ ID NO: 471971 - DNA, 25 bp, Rattus norvegicus
ttactccagcttccagcggggtcgc

SEQ ID NO: 471972 - DNA, 25 bp, Rattus norvegicus
ttagtaagttactccagcttccagc

SEQ ID NO: 471973 - DNA, 25 bp, Rattus norvegicus
ctcagctcctccagttggcagcctc

SEQ ID NO: 471974 - DNA, 25 bp, Rattus norvegicus
agttctctgaaactggtccgaaagt

SEQ ID NO: 471975 - DNA, 25 bp, Rattus norvegicus
tcctcggcaaagttctctgaaactg

SEQ ID NO: 471976 - DNA, 25 bp, Rattus norvegicus
gagactccgggaactcctcggcaaa

SEQ ID NO: 471977 - DNA, 25 bp, Rattus norvegicus
cggactccaggagactccgggaact

SEQ ID NO: 471978 - DNA, 25 bp, Rattus norvegicus
gaggaccacactggaagtccagacc

SEQ ID NO: 471979 - DNA, 25 bp, Rattus norvegicus
cactcggaggaccacactggaagtc

SEQ ID NO: 471980 - DNA, 25 bp, Rattus norvegicus
atgggacagccactcggaggaccac

SEQ ID NO: 471981 - DNA, 25 bp, Rattus norvegicus
agccgcggagctccgagagctctac

SEQ ID NO: 471982 - DNA, 25 bp, Rattus norvegicus
ggaaagtaacccgtcctgtggagca

SEQ ID NO: 471983 - DNA, 25 bp, Rattus norvegicus
atcgcgggcacccaaggtgggtctt

SEQ ID NO: 471984 - DNA, 25 bp, Rattus norvegicus
ttggctccaggatgctacagctcca

SEQ ID NO: 471985 - DNA, 25 bp, Rattus norvegicus
tcctcctctgcgtgaggggagagaa

SEQ ID NO: 471986 - DNA, 25 bp, Rattus norvegicus
tggggagccagcacttccttctttc

SEQ ID NO: 471987 - DNA, 25 bp, Rattus norvegicus
tggctcagcatgaagggtgtgtttc

SEQ ID NO: 471988 - DNA, 25 bp, Rattus norvegicus
cttgtgcgtagttctctcagcgcga

SEQ ID NO: 471989 - DNA, 25 bp, Rattus norvegicus
gcttggacatcctcgcttgtgcgta

SEQ ID NO: 471990 - DNA, 25 bp, Rattus norvegicus
ctcgcagcaaaaggctgagggcttg

SEQ ID NO: 471991 - DNA, 25 bp, Rattus norvegicus
gaccaatggcacagcagggcgctaa

SEQ ID NO: 471992 - DNA, 25 bp, Rattus norvegicus
tctcggcatcgatcagcgccggttc

SEQ ID NO: 471993 - DNA, 25 bp, Rattus norvegicus
agtctcgacagggtacggtgatgtc

SEQ ID NO: 471994 - DNA, 25 bp, Rattus norvegicus
aatcacgacatgaaggggacagccc

SEQ ID NO: 471995 - DNA, 25 bp, Rattus norvegicus
gtcacggagagatcacagcgaaatc

SEQ ID NO: 471996 - DNA, 25 bp, Rattus norvegicus
cacacttcacgatggcgcggtgatg

SEQ ID NO: 471997 - DNA, 25 bp, Rattus norvegicus
catcttgcttgtgggcaatgcccga

SEQ ID NO: 471998 - DNA, 25 bp, Rattus norvegicus
atcggagtctgacaccttgcgtccc

SEQ ID NO: 471999 - DNA, 25 bp, Rattus norvegicus
ccctgatgcgcaggcgcgctacaag

SEQ ID NO: 472000 - DNA, 25 bp, Rattus norvegicus
tcttaaagggatctccaaaccagcc

SEQ ID NO: 472001 - DNA, 25 bp, Rattus norvegicus
ctgtggtttcttaaagggatctcca

SEQ ID NO: 472002 - DNA, 25 bp, Rattus norvegicus
cagagaaattcctccgcctgtggtt

SEQ ID NO: 472003 - DNA, 25 bp, Rattus norvegicus
agtaggattattttctctcagagaa

SEQ ID NO: 472004 - DNA, 25 bp, Rattus norvegicus
agacacggcgcttcactcgctgcgg

SEQ ID NO: 472005 - DNA, 25 bp, Rattus norvegicus
agactccgtttacctcgaggatgca

SEQ ID NO: 472006 - DNA, 25 bp, Rattus norvegicus
cagagaaacttccacagactccgtt

SEQ ID NO: 472007 - DNA, 25 bp, Rattus norvegicus
agagacaaccaatcctccacgactt

SEQ ID NO: 472008 - DNA, 25 bp, Rattus norvegicus
ctcccggttactccacaagagacaa

SEQ ID NO: 472009 - DNA, 25 bp, Rattus norvegicus
cctcgaggatgcagaatcggagtct

SEQ ID NO: 472010 - DNA, 25 bp, Rattus norvegicus
cccgtgagtaggattattttctctc

SEQ ID NO: 472011 - DNA, 25 bp, Rattus norvegicus
agctttgtcccacctgccgagtgga

SEQ ID NO: 472012 - DNA, 25 bp, Rattus norvegicus
ccggctgcgtggagacacgcgctct

SEQ ID NO: 472013 - DNA, 25 bp, Rattus norvegicus
caggctcagaaggaacgctggctgc

SEQ ID NO: 472014 - DNA, 25 bp, Rattus norvegicus
gagtacctctcagggtcccgctctg

SEQ ID NO: 472015 - DNA, 25 bp, Rattus norvegicus
ctggcgggtctggagtacctctcag

SEQ ID NO: 472016 - DNA, 25 bp, Rattus norvegicus
ctggcctggacgctttgcagggacc

SEQ ID NO: 472017 - DNA, 25 bp, Rattus norvegicus
aagccttgtgcctggcctggacgct

SEQ ID NO: 472018 - DNA, 25 bp, Rattus norvegicus
ggtctccgaagccttgtgcctggcc

SEQ ID NO: 472019 - DNA, 25 bp, Rattus norvegicus
tcatcctggcctgtagtgcctcgcg

SEQ ID NO: 472020 - DNA, 25 bp, Rattus norvegicus
ggcggccacttcatcctggcctgta

SEQ ID NO: 472021 - DNA, 25 bp, Rattus norvegicus
ggactcggcggccacttcatcctgg

SEQ ID NO: 472022 - DNA, 25 bp, Rattus norvegicus
ttgctgcctgatcgcggcccgttcg

SEQ ID NO: 472023 - DNA, 25 bp, Rattus norvegicus
cagcccagccctccgttgctgcctg

SEQ ID NO: 472024 - DNA, 25 bp, Rattus norvegicus
cccttcggtgcggaggagcaaacgc

SEQ ID NO: 472025 - DNA, 25 bp, Rattus norvegicus
tctgggccgcagcaactggctccaa

SEQ ID NO: 472026 - DNA, 25 bp, Rattus norvegicus
acgcaatgggaagggcctatcctcc

SEQ ID NO: 472027 - DNA, 25 bp, Rattus norvegicus
acggaagcagttcgtgttttcatcc

SEQ ID NO: 472028 - DNA, 25 bp, Rattus norvegicus
ggcacgcaatgggaagggcctatcc

SEQ ID NO: 472029 - DNA, 25 bp, Rattus norvegicus
taatggcaggatgcggcagcaatcg

SEQ ID NO: 472030 - DNA, 25 bp, Rattus norvegicus
gtgcacggaagcagttcgtgttttc

SEQ ID NO: 472031 - DNA, 25 bp, Rattus norvegicus
gatataatggcaggatgcggcagca

SEQ ID NO: 472032 - DNA, 25 bp, Rattus norvegicus
aagcagttcgtgttttcatccctcc

SEQ ID NO: 472033 - DNA, 25 bp, Rattus norvegicus
agttcgtgttttcatccctcctcgc

SEQ ID NO: 472034 - DNA, 25 bp, Rattus norvegicus
tcgccatagcccagcgtgagcgctt

SEQ ID NO: 472035 - DNA, 25 bp, Rattus norvegicus
tagcccagcgtgagcgcttgaccca

SEQ ID NO: 472036 - DNA, 25 bp, Rattus norvegicus
agcgcttgacccatggtgagtgaca

SEQ ID NO: 472037 - DNA, 25 bp, Rattus norvegicus
ttgacccatggtgagtgacagcgcc

SEQ ID NO: 472038 - DNA, 25 bp, Rattus norvegicus
cccatggtgagtgacagcgccctgg

SEQ ID NO: 472039 - DNA, 25 bp, Rattus norvegicus
cagcaatcgggtggtgtgcacggaa

SEQ ID NO: 472040 - DNA, 25 bp, Rattus norvegicus
gaaaagatatccgactcggaggtga

SEQ ID NO: 472041 - DNA, 25 bp, Rattus norvegicus
cggtccagggcctaagcaaggccca

SEQ ID NO: 472042 - DNA, 25 bp, Rattus norvegicus
ctggcggtcccaaaggcggcaagat

SEQ ID NO: 472043 - DNA, 25 bp, Rattus norvegicus
caagatgccgggtgggcctaagcct

SEQ ID NO: 472044 - DNA, 25 bp, Rattus norvegicus
ggcccgggacctcgcacagaggaaa

SEQ ID NO: 472045 - DNA, 25 bp, Rattus norvegicus
cctcgcacagaggaaaagatatccg

SEQ ID NO: 472046 - DNA, 25 bp, Rattus norvegicus
taggttctggaggaagctgtccgtt

SEQ ID NO: 472047 - DNA, 25 bp, Rattus norvegicus
aagctgtccgtttctctaagatggc

SEQ ID NO: 472048 - DNA, 25 bp, Rattus norvegicus
ctaagatggcggcttctgcctaccc

SEQ ID NO: 472049 - DNA, 25 bp, Rattus norvegicus
gcagtggaggcctccattttgtccc

SEQ ID NO: 472050 - DNA, 25 bp, Rattus norvegicus
ggagtctcaacaacgcctccacaga

SEQ ID NO: 472051 - DNA, 25 bp, Rattus norvegicus
ctcctgcgcatgcttgcgaaggcgg

SEQ ID NO: 472052 - DNA, 25 bp, Rattus norvegicus
tccacgccgagcagcggagtctcaa

SEQ ID NO: 472053 - DNA, 25 bp, Rattus norvegicus
tgccggaagcgctcctgcgcatgct

SEQ ID NO: 472054 - DNA, 25 bp, Rattus norvegicus
taatctatcaccaacccagcggcgg

SEQ ID NO: 472055 - DNA, 25 bp, Rattus norvegicus
gcaagagaccaaacgcaccaagctc

SEQ ID NO: 472056 - DNA, 25 bp, Rattus norvegicus
gcaccaagctcagtcaccgtacaga

SEQ ID NO: 472057 - DNA, 25 bp, Rattus norvegicus
tcaccgtacagaggccaggacgcca

SEQ ID NO: 472058 - DNA, 25 bp, Rattus norvegicus
ccaggacgccaagaagcctggaagc

SEQ ID NO: 472059 - DNA, 25 bp, Rattus norvegicus
aagccggggtcacgactctctcgac

SEQ ID NO: 472060 - DNA, 25 bp, Rattus norvegicus
cgactctctcgacactgtgggcttc

SEQ ID NO: 472061 - DNA, 25 bp, Rattus norvegicus
tgtgggcttcccacctgtcgcgtca

SEQ ID NO: 472062 - DNA, 25 bp, Rattus norvegicus
cggaaaaacgccacctctctctgga

SEQ ID NO: 472063 - DNA, 25 bp, Rattus norvegicus
aagcctttgcggctgagcatgcgca

SEQ ID NO: 472064 - DNA, 25 bp, Rattus norvegicus
tgagcgactccacgaggacggataa

SEQ ID NO: 472065 - DNA, 25 bp, Rattus norvegicus
gaagcgcccactcgggtttcgcagt

SEQ ID NO: 472066 - DNA, 25 bp, Rattus norvegicus
ttcgcagtgcaaacaaccacgccgg

SEQ ID NO: 472067 - DNA, 25 bp, Rattus norvegicus
cctctctctggaaaagcggccctga

SEQ ID NO: 472068 - DNA, 25 bp, Rattus norvegicus
tggtgccatagcatcctgaggcttg

SEQ ID NO: 472069 - DNA, 25 bp, Rattus norvegicus
taaggcggtacgttgcaattgctca

SEQ ID NO: 472070 - DNA, 25 bp, Rattus norvegicus
caggcgattccagtaaagagattta

SEQ ID NO: 472071 - DNA, 25 bp, Rattus norvegicus
cccacgggagaccttgaatgctatt

SEQ ID NO: 472072 - DNA, 25 bp, Rattus norvegicus
tgctattgtgcattctccgactgga

SEQ ID NO: 472073 - DNA, 25 bp, Rattus norvegicus
cctgcggggctatagaaagccgctc

SEQ ID NO: 472074 - DNA, 25 bp, Rattus norvegicus
agcaacgtaccacgtgcccaaaggg

SEQ ID NO: 472075 - DNA, 25 bp, Rattus norvegicus
gggcgtgactctccacgtgactagg

SEQ ID NO: 472076 - DNA, 25 bp, Rattus norvegicus
atctgggtaccctcacgtgacaagg

SEQ ID NO: 472077 - DNA, 25 bp, Rattus norvegicus
agtggcagctcatcacgtgacgcgc

SEQ ID NO: 472078 - DNA, 25 bp, Rattus norvegicus
cgcgcgcttagttggagactgagtt

SEQ ID NO: 472079 - DNA, 25 bp, Rattus norvegicus
agactgagttcctccgctggccctt

SEQ ID NO: 472080 - DNA, 25 bp, Rattus norvegicus
cgccggagaatttgcgacattcaga

SEQ ID NO: 472081 - DNA, 25 bp, Rattus norvegicus
gacaaggcccgtcattttctgccgg

SEQ ID NO: 472082 - DNA, 25 bp, Rattus norvegicus
ttgcgagttctgcttggcatctttt

SEQ ID NO: 472083 - DNA, 25 bp, Rattus norvegicus
aagccctacgctgccatgctggtca

SEQ ID NO: 472084 - DNA, 25 bp, Rattus norvegicus
ggttgttcaggaagccctacgctgc

SEQ ID NO: 472085 - DNA, 25 bp, Rattus norvegicus
tctaggcgcattgcgagttctgctt

SEQ ID NO: 472086 - DNA, 25 bp, Rattus norvegicus
cgcgactgtggtcttctgggtagaa

SEQ ID NO: 472087 - DNA, 25 bp, Rattus norvegicus
ggcatctttttcactctcaccgggg

SEQ ID NO: 472088 - DNA, 25 bp, Rattus norvegicus
ttttcactctcaccggggctgccaa

SEQ ID NO: 472089 - DNA, 25 bp, Rattus norvegicus
gggctgccaagctctttcaggtctc

SEQ ID NO: 472090 - DNA, 25 bp, Rattus norvegicus
cccgtgtcacaacaaatggtgagca

SEQ ID NO: 472091 - DNA, 25 bp, Rattus norvegicus
acaaatggtgagcaacacccgggga

SEQ ID NO: 472092 - DNA, 25 bp, Rattus norvegicus
caacacccggggaaggatagcgtgt

SEQ ID NO: 472093 - DNA, 25 bp, Rattus norvegicus
aaggatagcgtgtgcttggttcccg

SEQ ID NO: 472094 - DNA, 25 bp, Rattus norvegicus
tgccaagctctttcaggtctcggcc

SEQ ID NO: 472095 - DNA, 25 bp, Rattus norvegicus
tgccatgctggtcagtctaggcgca

SEQ ID NO: 472096 - DNA, 25 bp, Rattus norvegicus
tcctagagcccaggccaagagctta

SEQ ID NO: 472097 - DNA, 25 bp, Rattus norvegicus
agcgtgtcctcacacccgctggaaa

SEQ ID NO: 472098 - DNA, 25 bp, Rattus norvegicus
cacacccgctggaaaagtcagaatc

SEQ ID NO: 472099 - DNA, 25 bp, Rattus norvegicus
aaaagtcagaatccagagtcggccc

SEQ ID NO: 472100 - DNA, 25 bp, Rattus norvegicus
gctgtcgctcagagacgccggcgct

SEQ ID NO: 472101 - DNA, 25 bp, Rattus norvegicus
tacagcatcgctctgggcgccaaga

SEQ ID NO: 472102 - DNA, 25 bp, Rattus norvegicus
caagacggattccagccagggactg

SEQ ID NO: 472103 - DNA, 25 bp, Rattus norvegicus
cagcttcgcgctgtgcttcggacag

SEQ ID NO: 472104 - DNA, 25 bp, Rattus norvegicus
tgacaccgaatgtgctggttcctgg

SEQ ID NO: 472105 - DNA, 25 bp, Rattus norvegicus
caagagcttaggtcggggtccagac

SEQ ID NO: 472106 - DNA, 25 bp, Rattus norvegicus
acagtagtctaaggggacgtgcctg

SEQ ID NO: 472107 - DNA, 25 bp, Rattus norvegicus
tgctgtgcgcggtcgtgacaccgaa

SEQ ID NO: 472108 - DNA, 25 bp, Rattus norvegicus
gtgacattcagggtgtgactgcctc

SEQ ID NO: 472109 - DNA, 25 bp, Rattus norvegicus
ggttctccctgcacaccggggattg

SEQ ID NO: 472110 - DNA, 25 bp, Rattus norvegicus
tgcagctccgcggacggactggacg

SEQ ID NO: 472111 - DNA, 25 bp, Rattus norvegicus
gactctgcccacgagagcttcactg

SEQ ID NO: 472112 - DNA, 25 bp, Rattus norvegicus
tgcccacgagagcttcactgcagca

SEQ ID NO: 472113 - DNA, 25 bp, Rattus norvegicus
cccacgagagcttcactgcagcaga

SEQ ID NO: 472114 - DNA, 25 bp, Rattus norvegicus
acgagagcttcactgcagcagaggg

SEQ ID NO: 472115 - DNA, 25 bp, Rattus norvegicus
agagcttcactgcagcagagggccc

SEQ ID NO: 472116 - DNA, 25 bp, Rattus norvegicus
ggacggactggacggccccaccatg

SEQ ID NO: 472117 - DNA, 25 bp, Rattus norvegicus
cctcgagttggcaccggtgccaccc

SEQ ID NO: 472118 - DNA, 25 bp, Rattus norvegicus
cactcatcatcaagaccattcctgg

SEQ ID NO: 472119 - DNA, 25 bp, Rattus norvegicus
atcatcaagaccattcctggccggg

SEQ ID NO: 472120 - DNA, 25 bp, Rattus norvegicus
tcaagaccattcctggccgggagga

SEQ ID NO: 472121 - DNA, 25 bp, Rattus norvegicus
agcctggcgcgacagcggaagtggc

SEQ ID NO: 472122 - DNA, 25 bp, Rattus norvegicus
tcaccgcccagagcagcaccgactc

SEQ ID NO: 472123 - DNA, 25 bp, Rattus norvegicus
acgcaccctcgagttggcaccggtg

SEQ ID NO: 472124 - DNA, 25 bp, Rattus norvegicus
ccattcctggaactacgagcggtgc

SEQ ID NO: 472125 - DNA, 25 bp, Rattus norvegicus
ggagtcccacccacaccgatgtata

SEQ ID NO: 472126 - DNA, 25 bp, Rattus norvegicus
tataagcatccatggctgcgccctc

SEQ ID NO: 472127 - DNA, 25 bp, Rattus norvegicus
ggctcgcacgacgacgcaattgctg

SEQ ID NO: 472128 - DNA, 25 bp, Rattus norvegicus
ttgctgacaacttgacgttctttga

SEQ ID NO: 472129 - DNA, 25 bp, Rattus norvegicus
ctttgaatactgcaggacgaggacc

SEQ ID NO: 472130 - DNA, 25 bp, Rattus norvegicus
ggtttcacttctggatcccgcttcg

SEQ ID NO: 472131 - DNA, 25 bp, Rattus norvegicus
gacgaggacccaaatacgcgcagtg

SEQ ID NO: 472132 - DNA, 25 bp, Rattus norvegicus
gagcgaatccagctacgcggctgca

SEQ ID NO: 472133 - DNA, 25 bp, Rattus norvegicus
cgtttcaaagtttcgctctggggcg

SEQ ID NO: 472134 - DNA, 25 bp, Rattus norvegicus
tccctggttgattcgggcgcatttc

SEQ ID NO: 472135 - DNA, 25 bp, Rattus norvegicus
tgcctcccgaggttccctggttgat

SEQ ID NO: 472136 - DNA, 25 bp, Rattus norvegicus
gtctctacggggttccgagcgaatc

SEQ ID NO: 472137 - DNA, 25 bp, Rattus norvegicus
atgtcgaatccttccctgcgcaacg

SEQ ID NO: 472138 - DNA, 25 bp, Rattus norvegicus
ggacgctccttccagaggcacgcct

SEQ ID NO: 472139 - DNA, 25 bp, Rattus norvegicus
cgccgtgattcctggatggagcggg

SEQ ID NO: 472140 - DNA, 25 bp, Rattus norvegicus
ccaccgatgggtcgcctggccctcc

SEQ ID NO: 472141 - DNA, 25 bp, Rattus norvegicus
tatgagccgccggccaccgatgggt

SEQ ID NO: 472142 - DNA, 25 bp, Rattus norvegicus
tacccactgccgtatgagccgccgg

SEQ ID NO: 472143 - DNA, 25 bp, Rattus norvegicus
gggctacccactgccgtatgagccg

SEQ ID NO: 472144 - DNA, 25 bp, Rattus norvegicus
gagggctacccactgccgtatgagc

SEQ ID NO: 472145 - DNA, 25 bp, Rattus norvegicus
cgagggctacccactgccgtatgag

SEQ ID NO: 472146 - DNA, 25 bp, Rattus norvegicus
ccagtgggcctaccgcgagggctac

SEQ ID NO: 472147 - DNA, 25 bp, Rattus norvegicus
acacgcagggccagtgggcctaccg

SEQ ID NO: 472148 - DNA, 25 bp, Rattus norvegicus
gcacggtccacacgcagggccagtg

SEQ ID NO: 472149 - DNA, 25 bp, Rattus norvegicus
cctactcagtcttccgcacggtcca

SEQ ID NO: 472150 - DNA, 25 bp, Rattus norvegicus
atggagcggggttcgcgtagcctcc

SEQ ID NO: 472151 - DNA, 25 bp, Rattus norvegicus
tccttccagaggcacgcctctgagc

SEQ ID NO: 472152 - DNA, 25 bp, Rattus norvegicus
gctgttgaaaacgtctccaccaggg

SEQ ID NO: 472153 - DNA, 25 bp, Rattus norvegicus
ctttgaccgcctttgaccttgtgga

SEQ ID NO: 472154 - DNA, 25 bp, Rattus norvegicus
accttgtggaaacacgtgcgcctgc

SEQ ID NO: 472155 - DNA, 25 bp, Rattus norvegicus
tggccagatctaggcgctatcccgt

SEQ ID NO: 472156 - DNA, 25 bp, Rattus norvegicus
tatcccgttgggagacacgaattcc

SEQ ID NO: 472157 - DNA, 25 bp, Rattus norvegicus
gaagaaggtccctccgccgatacca

SEQ ID NO: 472158 - DNA, 25 bp, Rattus norvegicus
gccgataccaaagaagccctcgcgg

SEQ ID NO: 472159 - DNA, 25 bp, Rattus norvegicus
ttccgccacagttcggctactgaga

SEQ ID NO: 472160 - DNA, 25 bp, Rattus norvegicus
tgtacacccagcgtcgaggtcactg

SEQ ID NO: 472161 - DNA, 25 bp, Rattus norvegicus
ccatcttcctggtccgacgctttga

SEQ ID NO: 472162 - DNA, 25 bp, Rattus norvegicus
gcgctcgagtccgtccttatttgga

SEQ ID NO: 472163 - DNA, 25 bp, Rattus norvegicus
cgtggctttttatgaagaatcccga

SEQ ID NO: 472164 - DNA, 25 bp, Rattus norvegicus
cgtggggatcaagcttcgtggcttt

SEQ ID NO: 472165 - DNA, 25 bp, Rattus norvegicus
gggcaccatctctgtcattatttta

SEQ ID NO: 472166 - DNA, 25 bp, Rattus norvegicus
ccgacgttcgtgttgctcccggcta

SEQ ID NO: 472167 - DNA, 25 bp, Rattus norvegicus
acgaggccacgcgtgtggcatgacc

SEQ ID NO: 472168 - DNA, 25 bp, Rattus norvegicus
aacttgtccgcttcaggcacctgca

SEQ ID NO: 472169 - DNA, 25 bp, Rattus norvegicus
gtgggctgcggtcaaaacttgtccg

SEQ ID NO: 472170 - DNA, 25 bp, Rattus norvegicus
gtctctgtaaccgtctcggcctcgg

SEQ ID NO: 472171 - DNA, 25 bp, Rattus norvegicus
tcctagttgagggagcgacgtctct

SEQ ID NO: 472172 - DNA, 25 bp, Rattus norvegicus
gagggcacttcacttcccacgagga

SEQ ID NO: 472173 - DNA, 25 bp, Rattus norvegicus
cccgagagagcctggacgctagtag

SEQ ID NO: 472174 - DNA, 25 bp, Rattus norvegicus
ggccggagctcagccaatcactgtt

SEQ ID NO: 472175 - DNA, 25 bp, Rattus norvegicus
ttcttctgtagcttggccggagctc

SEQ ID NO: 472176 - DNA, 25 bp, Rattus norvegicus
tttagctcaacacgggcgggtgcct

SEQ ID NO: 472177 - DNA, 25 bp, Rattus norvegicus
ggggcactatactgttctccgttta

SEQ ID NO: 472178 - DNA, 25 bp, Rattus norvegicus
cacgaggacggctcctggctgtgac

SEQ ID NO: 472179 - DNA, 25 bp, Rattus norvegicus
ggtgcctgtcttcgtttcttctgta

SEQ ID NO: 472180 - DNA, 25 bp, Rattus norvegicus
ccgagtgcgcgggacttacaggtgc

SEQ ID NO: 472181 - DNA, 25 bp, Rattus norvegicus
ctgcggagaactggagggtctctcc

SEQ ID NO: 472182 - DNA, 25 bp, Rattus norvegicus
gctaagcaaccagccccggaagtcg

SEQ ID NO: 472183 - DNA, 25 bp, Rattus norvegicus
agcaggagcggaggtcctcgaggcc

SEQ ID NO: 472184 - DNA, 25 bp, Rattus norvegicus
acttacaggtgcggaggcacagagc

SEQ ID NO: 472185 - DNA, 25 bp, Rattus norvegicus
gcgggccagagccactttgtacctc

SEQ ID NO: 472186 - DNA, 25 bp, Rattus norvegicus
agagccactttgtacctcgcctgag

SEQ ID NO: 472187 - DNA, 25 bp, Rattus norvegicus
cactttgtacctcgcctgagccttt

SEQ ID NO: 472188 - DNA, 25 bp, Rattus norvegicus
gtacctcgcctgagcctttccttga

SEQ ID NO: 472189 - DNA, 25 bp, Rattus norvegicus
ctgagcctttccttgaccctgtctg

SEQ ID NO: 472190 - DNA, 25 bp, Rattus norvegicus
gcctttccttgaccctgtctgcgga

SEQ ID NO: 472191 - DNA, 25 bp, Rattus norvegicus
ccttgaccctgtctgcggagaactg

SEQ ID NO: 472192 - DNA, 25 bp, Rattus norvegicus
agggtctctcccggaggcgcattgc

SEQ ID NO: 472193 - DNA, 25 bp, Rattus norvegicus
ccgcgagcgggtgaaagatggcgga

SEQ ID NO: 472194 - DNA, 25 bp, Rattus norvegicus
tgggtcgagagacgtagcagtccac

SEQ ID NO: 472195 - DNA, 25 bp, Rattus norvegicus
tggccatagaggaagcctgcctcca

SEQ ID NO: 472196 - DNA, 25 bp, Rattus norvegicus
gaatgcgaagacgaccgtcctctgc

SEQ ID NO: 472197 - DNA, 25 bp, Rattus norvegicus
ctcgaatgcgaagacgaccgtcctc

SEQ ID NO: 472198 - DNA, 25 bp, Rattus norvegicus
gatcacgtaggtacccatgagcgcc

SEQ ID NO: 472199 - DNA, 25 bp, Rattus norvegicus
acagcacactgatcacgtaggtacc

SEQ ID NO: 472200 - DNA, 25 bp, Rattus norvegicus
agcacactcttacacagcacactga

SEQ ID NO: 472201 - DNA, 25 bp, Rattus norvegicus
cgccactggccatagaggaagcctg

SEQ ID NO: 472202 - DNA, 25 bp, Rattus norvegicus
ccgtagagacgccactggccataga

SEQ ID NO: 472203 - DNA, 25 bp, Rattus norvegicus
ctccatggtccagccgtagagacgc

SEQ ID NO: 472204 - DNA, 25 bp, Rattus norvegicus
accggctccatggtccagccgtaga
